United States Patent 7,341,835 (METHODS OF ANALYSIS OF ALTERNATIVE SPLICING IN MOUSE) - sequence listing, part 6

SEQ ID NO: 199430 - DNA, 25 bp, Mus musculus
aggccatatatgcagagatgagccg

SEQ ID NO: 199431 - DNA, 25 bp, Mus musculus
aggccatcacagatgccgcaatgat

SEQ ID NO: 199432 - DNA, 25 bp, Mus musculus
aggccatcaccagggtgtttccaca

SEQ ID NO: 199433 - DNA, 25 bp, Mus musculus
aggccatcactgacaaaagaaagat

SEQ ID NO: 199434 - DNA, 25 bp, Mus musculus
aggccatccctgctgtgggcctccc

SEQ ID NO: 199435 - DNA, 25 bp, Mus musculus
aggccatcctgggttgctcttctgg

SEQ ID NO: 199436 - DNA, 25 bp, Mus musculus
aggccatcgaaagaacttgtcaatg

SEQ ID NO: 199437 - DNA, 25 bp, Mus musculus
aggccatgaaaggaccccgagagga

SEQ ID NO: 199438 - DNA, 25 bp, Mus musculus
aggccatgagagagatcccatggtt

SEQ ID NO: 199439 - DNA, 25 bp, Mus musculus
aggccatgagagaggactgcctcca

SEQ ID NO: 199440 - DNA, 25 bp, Mus musculus
aggccatgagagaggtatatgctat

SEQ ID NO: 199441 - DNA, 25 bp, Mus musculus
aggccatgagagtcctcgttgaaaa

SEQ ID NO: 199442 - DNA, 25 bp, Mus musculus
aggccatgagcataccaacattttt

SEQ ID NO: 199443 - DNA, 25 bp, Mus musculus
aggccatgagcatccagaggttgtc

SEQ ID NO: 199444 - DNA, 25 bp, Mus musculus
aggccatgagcgtaatctgcagaat

SEQ ID NO: 199445 - DNA, 25 bp, Mus musculus
aggccatgatccagagtcaggtgtg

SEQ ID NO: 199446 - DNA, 25 bp, Mus musculus
aggccatgcaaactcgccctgggca

SEQ ID NO: 199447 - DNA, 25 bp, Mus musculus
aggccatggaacaggaggaagtgaa

SEQ ID NO: 199448 - DNA, 25 bp, Mus musculus
aggccatgtggactggcaggctgtg

SEQ ID NO: 199449 - DNA, 25 bp, Mus musculus
aggccatgttactgcacgaccacag

SEQ ID NO: 199450 - DNA, 25 bp, Mus musculus
aggccatgttactggagtgccgatg

SEQ ID NO: 199451 - DNA, 25 bp, Mus musculus
aggccattgccaagaagaacgctgt

SEQ ID NO: 199452 - DNA, 25 bp, Mus musculus
aggccattggcaggttgtccgattg

SEQ ID NO: 199453 - DNA, 25 bp, Mus musculus
aggccattggtgagtatggcccacc

SEQ ID NO: 199454 - DNA, 25 bp, Mus musculus
aggccattgtggaaagcccccctac

SEQ ID NO: 199455 - DNA, 25 bp, Mus musculus
aggccattgttactgttacagattt

SEQ ID NO: 199456 - DNA, 25 bp, Mus musculus
aggccatttcaggtttggtatgcct

SEQ ID NO: 199457 - DNA, 25 bp, Mus musculus
aggccatttccaagcgcctgagaag

SEQ ID NO: 199458 - DNA, 25 bp, Mus musculus
aggcccaaagctctacagactcaga

SEQ ID NO: 199459 - DNA, 25 bp, Mus musculus
aggcccaaaggtacagagatgttgt

SEQ ID NO: 199460 - DNA, 25 bp, Mus musculus
aggcccaaaggtgttctacactcag

SEQ ID NO: 199461 - DNA, 25 bp, Mus musculus
aggcccaacccagtgacaatgcccc

SEQ ID NO: 199462 - DNA, 25 bp, Mus musculus
aggcccaagacacagataagccagg

SEQ ID NO: 199463 - DNA, 25 bp, Mus musculus
aggcccaagacatccaggccagcca

SEQ ID NO: 199464 - DNA, 25 bp, Mus musculus
aggcccaagaggaagaagtccagga

SEQ ID NO: 199465 - DNA, 25 bp, Mus musculus
aggcccaagaggaagaggaagtcca

SEQ ID NO: 199466 - DNA, 25 bp, Mus musculus
aggcccaagttgagttcatggcatc

SEQ ID NO: 199467 - DNA, 25 bp, Mus musculus
aggcccacctggagctacattgcct

SEQ ID NO: 199468 - DNA, 25 bp, Mus musculus
aggcccagaaggaggtcaagatggg

SEQ ID NO: 199469 - DNA, 25 bp, Mus musculus
aggcccagcagtgcatcctgcctct

SEQ ID NO: 199470 - DNA, 25 bp, Mus musculus
aggcccagccctgctcctgccatgc

SEQ ID NO: 199471 - DNA, 25 bp, Mus musculus
aggcccagctagctgtgcgcagttc

SEQ ID NO: 199472 - DNA, 25 bp, Mus musculus
aggcccaggaagaaacatgtatcat

SEQ ID NO: 199473 - DNA, 25 bp, Mus musculus
aggcccaggaagaagaatgtccctt

SEQ ID NO: 199474 - DNA, 25 bp, Mus musculus
aggcccaggacagctggatcgccgg

SEQ ID NO: 199475 - DNA, 25 bp, Mus musculus
aggcccaggctgagtaccagctcca

SEQ ID NO: 199476 - DNA, 25 bp, Mus musculus
aggcccagggagagcagcaggagga

SEQ ID NO: 199477 - DNA, 25 bp, Mus musculus
aggcccaggttgaccaaagaaatgg

SEQ ID NO: 199478 - DNA, 25 bp, Mus musculus
aggcccatgagcagggtgtccctgt

SEQ ID NO: 199479 - DNA, 25 bp, Mus musculus
aggcccatgtgaccctgctgacatc

SEQ ID NO: 199480 - DNA, 25 bp, Mus musculus
aggcccatgttggaggacaagacat

SEQ ID NO: 199481 - DNA, 25 bp, Mus musculus
aggcccatgttggagggagttaaat

SEQ ID NO: 199482 - DNA, 25 bp, Mus musculus
aggcccattaaggtgaacctcctcg

SEQ ID NO: 199483 - DNA, 25 bp, Mus musculus
aggccccaaaattaggctgcgggac

SEQ ID NO: 199484 - DNA, 25 bp, Mus musculus
aggccccacaggctctgcaggaacc

SEQ ID NO: 199485 - DNA, 25 bp, Mus musculus
aggccccacaggtgccaaaggcgtc

SEQ ID NO: 199486 - DNA, 25 bp, Mus musculus
aggcccccaacacggcgagcctcgt

SEQ ID NO: 199487 - DNA, 25 bp, Mus musculus
aggcccccacagccgtgtttgaccg

SEQ ID NO: 199488 - DNA, 25 bp, Mus musculus
aggcccccacagtttgtatctactt

SEQ ID NO: 199489 - DNA, 25 bp, Mus musculus
aggcccccaggattccccctctgtg

SEQ ID NO: 199490 - DNA, 25 bp, Mus musculus
aggcccccagtcagatctgtctcga

SEQ ID NO: 199491 - DNA, 25 bp, Mus musculus
aggcccccagtcaggccggggctgt

SEQ ID NO: 199492 - DNA, 25 bp, Mus musculus
aggccccccagccaggatgatgtct

SEQ ID NO: 199493 - DNA, 25 bp, Mus musculus
aggccccccagccagtgtgacccca

SEQ ID NO: 199494 - DNA, 25 bp, Mus musculus
aggccccgcaggtcaagacggccca

SEQ ID NO: 199495 - DNA, 25 bp, Mus musculus
aggccccgcccgaggcactagagca

SEQ ID NO: 199496 - DNA, 25 bp, Mus musculus
aggccccggaaggaaaagcgcaatg

SEQ ID NO: 199497 - DNA, 25 bp, Mus musculus
aggccccggccctctgcgcctgtgt

SEQ ID NO: 199498 - DNA, 25 bp, Mus musculus
aggcccctaccaggcgggatggaga

SEQ ID NO: 199499 - DNA, 25 bp, Mus musculus
aggcccctagccaccttctagctgg

SEQ ID NO: 199500 - DNA, 25 bp, Mus musculus
aggcccctagccccatctcttctga

SEQ ID NO: 199501 - DNA, 25 bp, Mus musculus
aggcccctgagcagggtgttcctgt

SEQ ID NO: 199502 - DNA, 25 bp, Mus musculus
aggcccgaaactgagaagaccagag

SEQ ID NO: 199503 - DNA, 25 bp, Mus musculus
aggcccgaagaagagctgtggtttc

SEQ ID NO: 199504 - DNA, 25 bp, Mus musculus
aggcccgagaaactgaaggagccct

SEQ ID NO: 199505 - DNA, 25 bp, Mus musculus
aggcccgccaggaattgtggaggca

SEQ ID NO: 199506 - DNA, 25 bp, Mus musculus
aggcccgccaggatatgaattggct

SEQ ID NO: 199507 - DNA, 25 bp, Mus musculus
aggcccgcctatcaaccgtggcctt

SEQ ID NO: 199508 - DNA, 25 bp, Mus musculus
aggcccgctggtcggtctgggaacg

SEQ ID NO: 199509 - DNA, 25 bp, Mus musculus
aggcccggaaaaggagtcaggcgga

SEQ ID NO: 199510 - DNA, 25 bp, Mus musculus
aggcccggaagtcgggtgacagaag

SEQ ID NO: 199511 - DNA, 25 bp, Mus musculus
aggcccggaagttcctgttcctctc

SEQ ID NO: 199512 - DNA, 25 bp, Mus musculus
aggcccggcttcgtgtatcctcaga

SEQ ID NO: 199513 - DNA, 25 bp, Mus musculus
aggcccggggtgaaggtgagcctca

SEQ ID NO: 199514 - DNA, 25 bp, Mus musculus
aggcccggtaaagtgccggcagagc

SEQ ID NO: 199515 - DNA, 25 bp, Mus musculus
aggcccggtctccgcccggcagaac

SEQ ID NO: 199516 - DNA, 25 bp, Mus musculus
aggcccggtctccgtttgcagcggg

SEQ ID NO: 199517 - DNA, 25 bp, Mus musculus
aggcccgtatcctgaagctgtttgg

SEQ ID NO: 199518 - DNA, 25 bp, Mus musculus
aggcccgtgaccacctctctggccc

SEQ ID NO: 199519 - DNA, 25 bp, Mus musculus
aggcccgtggagaggaggtggtgtc

SEQ ID NO: 199520 - DNA, 25 bp, Mus musculus
aggcccgtggagaggtctgcaaaca

SEQ ID NO: 199521 - DNA, 25 bp, Mus musculus
aggcccgtgtggaagagttcaagct

SEQ ID NO: 199522 - DNA, 25 bp, Mus musculus
aggccctaatgacattatgccctac

SEQ ID NO: 199523 - DNA, 25 bp, Mus musculus
aggccctactgggggtgaacctggt

SEQ ID NO: 199524 - DNA, 25 bp, Mus musculus
aggccctagcagatgaaaaacgact

SEQ ID NO: 199525 - DNA, 25 bp, Mus musculus
aggccctattggagaccctgggaaa

SEQ ID NO: 199526 - DNA, 25 bp, Mus musculus
aggccctcaagtctcacatcatggc

SEQ ID NO: 199527 - DNA, 25 bp, Mus musculus
aggccctcagatcaatgatgatgtt

SEQ ID NO: 199528 - DNA, 25 bp, Mus musculus
aggccctcagattgacaaggaacaa

SEQ ID NO: 199529 - DNA, 25 bp, Mus musculus
aggccctcagtggctcccacagata

SEQ ID NO: 199530 - DNA, 25 bp, Mus musculus
aggccctcagtggtcccctttacca

SEQ ID NO: 199531 - DNA, 25 bp, Mus musculus
aggccctcgaatgtgccgttctctg

SEQ ID NO: 199532 - DNA, 25 bp, Mus musculus
aggccctgaccgattcacaatgaca

SEQ ID NO: 199533 - DNA, 25 bp, Mus musculus
aggccctgagactgccagcaaattc

SEQ ID NO: 199534 - DNA, 25 bp, Mus musculus
aggccctgagcagagtcactgaggg

SEQ ID NO: 199535 - DNA, 25 bp, Mus musculus
aggccctgaggtatcaccacagctg

SEQ ID NO: 199536 - DNA, 25 bp, Mus musculus
aggccctgcagcagctgattagagt

SEQ ID NO: 199537 - DNA, 25 bp, Mus musculus
aggccctgccccagctctgggcgtg

SEQ ID NO: 199538 - DNA, 25 bp, Mus musculus
aggccctgccccaggtggggaacct

SEQ ID NO: 199539 - DNA, 25 bp, Mus musculus
aggccctgctggagctccaggacct

SEQ ID NO: 199540 - DNA, 25 bp, Mus musculus
aggccctggatggggtggtgaagcg

SEQ ID NO: 199541 - DNA, 25 bp, Mus musculus
aggccctggcagatgagcgtgaagc

SEQ ID NO: 199542 - DNA, 25 bp, Mus musculus
aggccctgggcaggctgctggttgt

SEQ ID NO: 199543 - DNA, 25 bp, Mus musculus
aggccctggggaatgtatcattgat

SEQ ID NO: 199544 - DNA, 25 bp, Mus musculus
aggccctggtaaaagcagaagcagc

SEQ ID NO: 199545 - DNA, 25 bp, Mus musculus
aggccctggtcacaggctctccttg

SEQ ID NO: 199546 - DNA, 25 bp, Mus musculus
aggccctgttcagagccctgaagac

SEQ ID NO: 199547 - DNA, 25 bp, Mus musculus
aggccctgttggtccccctggaagt

SEQ ID NO: 199548 - DNA, 25 bp, Mus musculus
aggcccttcaagttttcctggagca

SEQ ID NO: 199549 - DNA, 25 bp, Mus musculus
aggcccttcgggagcagatggtgaa

SEQ ID NO: 199550 - DNA, 25 bp, Mus musculus
aggcccttgcagaaaaaaagatgca

SEQ ID NO: 199551 - DNA, 25 bp, Mus musculus
aggccctttatgaacaaaggaagaa

SEQ ID NO: 199552 - DNA, 25 bp, Mus musculus
aggccctttatggaacagacggagc

SEQ ID NO: 199553 - DNA, 25 bp, Mus musculus
aggccgaaagtggggatgcaaactt

SEQ ID NO: 199554 - DNA, 25 bp, Mus musculus
aggccgaaccagtggctgcagcact

SEQ ID NO: 199555 - DNA, 25 bp, Mus musculus
aggccgaagcccccagttgtaccga

SEQ ID NO: 199556 - DNA, 25 bp, Mus musculus
aggccgaatccctttctaaataaag

SEQ ID NO: 199557 - DNA, 25 bp, Mus musculus
aggccgaccagcccccgtcctgcgg

SEQ ID NO: 199558 - DNA, 25 bp, Mus musculus
aggccgactgctcaccaggaccctg

SEQ ID NO: 199559 - DNA, 25 bp, Mus musculus
aggccgagaaggagtttcgaaactg

SEQ ID NO: 199560 - DNA, 25 bp, Mus musculus
aggccgagaaggctgcatctgtctg

SEQ ID NO: 199561 - DNA, 25 bp, Mus musculus
aggccgagaagtactctcagaagga

SEQ ID NO: 199562 - DNA, 25 bp, Mus musculus
aggccgagaagttgacctcctcctc

SEQ ID NO: 199563 - DNA, 25 bp, Mus musculus
aggccgagaagttgacctcgtcctc

SEQ ID NO: 199564 - DNA, 25 bp, Mus musculus
aggccgagcagaaggagggagagtt

SEQ ID NO: 199565 - DNA, 25 bp, Mus musculus
aggccgagccaagaaactatgttcc

SEQ ID NO: 199566 - DNA, 25 bp, Mus musculus
aggccgagccaaggattttaaacag

SEQ ID NO: 199567 - DNA, 25 bp, Mus musculus
aggccgagccaaggtgtgagatgca

SEQ ID NO: 199568 - DNA, 25 bp, Mus musculus
aggccgaggacatatgggtgatttt

SEQ ID NO: 199569 - DNA, 25 bp, Mus musculus
aggccgaggcaagtttccttttaga

SEQ ID NO: 199570 - DNA, 25 bp, Mus musculus
aggccgaggccaaccgtccagaagg

SEQ ID NO: 199571 - DNA, 25 bp, Mus musculus
aggccgaggccaaccgtgtgctgct

SEQ ID NO: 199572 - DNA, 25 bp, Mus musculus
aggccgagtgcaacatcctccgcaa

SEQ ID NO: 199573 - DNA, 25 bp, Mus musculus
aggccgataggaagtatgaacatca

SEQ ID NO: 199574 - DNA, 25 bp, Mus musculus
aggccgatcaggaggcaggttgtca

SEQ ID NO: 199575 - DNA, 25 bp, Mus musculus
aggccgcacagacccgaagtgtgga

SEQ ID NO: 199576 - DNA, 25 bp, Mus musculus
aggccgcacagacccgttcacgaac

SEQ ID NO: 199577 - DNA, 25 bp, Mus musculus
aggccgcacagacccgttccaggag

SEQ ID NO: 199578 - DNA, 25 bp, Mus musculus
aggccgcagggttgcagaaactgag

SEQ ID NO: 199579 - DNA, 25 bp, Mus musculus
aggccgcattaggaggaagagacca

SEQ ID NO: 199580 - DNA, 25 bp, Mus musculus
aggccgcattgctgctcagaggaag

SEQ ID NO: 199581 - DNA, 25 bp, Mus musculus
aggccgccacagcgtggtgtccttg

SEQ ID NO: 199582 - DNA, 25 bp, Mus musculus
aggccgccaggctggctcaggaggc

SEQ ID NO: 199583 - DNA, 25 bp, Mus musculus
aggccgccaggttcacggctcagca

SEQ ID NO: 199584 - DNA, 25 bp, Mus musculus
aggccgccatgggtattaagagctg

SEQ ID NO: 199585 - DNA, 25 bp, Mus musculus
aggccgcgcgcggggtgctgtgagt

SEQ ID NO: 199586 - DNA, 25 bp, Mus musculus
aggccgcggagcaaccgaagaacct

SEQ ID NO: 199587 - DNA, 25 bp, Mus musculus
aggccgcggaggtcacaggctctgt

SEQ ID NO: 199588 - DNA, 25 bp, Mus musculus
aggccgcgggaaagagtccagcctc

SEQ ID NO: 199589 - DNA, 25 bp, Mus musculus
aggccgcgggaaaggataaagcatc

SEQ ID NO: 199590 - DNA, 25 bp, Mus musculus
aggccgctacggatacaggttcact

SEQ ID NO: 199591 - DNA, 25 bp, Mus musculus
aggccgctgtctgagcgcaggctgt

SEQ ID NO: 199592 - DNA, 25 bp, Mus musculus
aggccggaaggtagcgatggtggaa

SEQ ID NO: 199593 - DNA, 25 bp, Mus musculus
aggccggcagcaccggaaaactcaa

SEQ ID NO: 199594 - DNA, 25 bp, Mus musculus
aggccggcatcgccgcttacaagca

SEQ ID NO: 199595 - DNA, 25 bp, Mus musculus
aggccggcccgaggcccggtcggtg

SEQ ID NO: 199596 - DNA, 25 bp, Mus musculus
aggccggcccgcaagctataagcga

SEQ ID NO: 199597 - DNA, 25 bp, Mus musculus
aggccggcccgcagactttgtgttg

SEQ ID NO: 199598 - DNA, 25 bp, Mus musculus
aggccgggaggcccagatgggggat

SEQ ID NO: 199599 - DNA, 25 bp, Mus musculus
aggccgggcccgaaccctcttggct

SEQ ID NO: 199600 - DNA, 25 bp, Mus musculus
aggccgggcccgggccaccaagcac

SEQ ID NO: 199601 - DNA, 25 bp, Mus musculus
aggccgtacttccgcacctcctctc

SEQ ID NO: 199602 - DNA, 25 bp, Mus musculus
aggccgtcagaactcggtatatcag

SEQ ID NO: 199603 - DNA, 25 bp, Mus musculus
aggccgtcagatgggtttcaagggc

SEQ ID NO: 199604 - DNA, 25 bp, Mus musculus
aggccgtcagtgcctgatgccacct

SEQ ID NO: 199605 - DNA, 25 bp, Mus musculus
aggccgtccacatgcttgtttatga

SEQ ID NO: 199606 - DNA, 25 bp, Mus musculus
aggccgtgaagagtgagccggtgga

SEQ ID NO: 199607 - DNA, 25 bp, Mus musculus
aggccgtgcggagctcttggatgcg

SEQ ID NO: 199608 - DNA, 25 bp, Mus musculus
aggccgtggttgtgattgaacgggc

SEQ ID NO: 199609 - DNA, 25 bp, Mus musculus
aggccgtggttgtgcatgggcgcct

SEQ ID NO: 199610 - DNA, 25 bp, Mus musculus
aggccgttacacatgagagcagcat

SEQ ID NO: 199611 - DNA, 25 bp, Mus musculus
aggccgttacacatgctatacctgc

SEQ ID NO: 199612 - DNA, 25 bp, Mus musculus
aggccgttatccagcatttccagga

SEQ ID NO: 199613 - DNA, 25 bp, Mus musculus
aggccgttcggaaggctgtgggaat

SEQ ID NO: 199614 - DNA, 25 bp, Mus musculus
aggcctaaaggctttgatgacagtt

SEQ ID NO: 199615 - DNA, 25 bp, Mus musculus
aggcctaagcacaggcagcagagct

SEQ ID NO: 199616 - DNA, 25 bp, Mus musculus
aggcctaaggaatgattggatccag

SEQ ID NO: 199617 - DNA, 25 bp, Mus musculus
aggcctaccaggtcagcttgcaagg

SEQ ID NO: 199618 - DNA, 25 bp, Mus musculus
aggcctacggatcaggtcgtgtctt

SEQ ID NO: 199619 - DNA, 25 bp, Mus musculus
aggcctacggatcagtgacctgagg

SEQ ID NO: 199620 - DNA, 25 bp, Mus musculus
aggcctactataagaagatggacta

SEQ ID NO: 199621 - DNA, 25 bp, Mus musculus
aggcctactataagccagattcccc

SEQ ID NO: 199622 - DNA, 25 bp, Mus musculus
aggcctagctcaagtcttttattca

SEQ ID NO: 199623 - DNA, 25 bp, Mus musculus
aggcctaggagatgcaagttgttct

SEQ ID NO: 199624 - DNA, 25 bp, Mus musculus
aggcctaggaggggcgtccaaagaa

SEQ ID NO: 199625 - DNA, 25 bp, Mus musculus
aggcctatgaaggaggttccgagtt

SEQ ID NO: 199626 - DNA, 25 bp, Mus musculus
aggcctatggagagttcctcaccat

SEQ ID NO: 199627 - DNA, 25 bp, Mus musculus
aggcctatgtcagcactttaatggg

SEQ ID NO: 199628 - DNA, 25 bp, Mus musculus
aggcctcaaaggttaaggagctgaa

SEQ ID NO: 199629 - DNA, 25 bp, Mus musculus
aggcctcaactataagtcttgcttc

SEQ ID NO: 199630 - DNA, 25 bp, Mus musculus
aggcctcacctctcaattgtgggtt

SEQ ID NO: 199631 - DNA, 25 bp, Mus musculus
aggcctcagaaggtggccttcccag

SEQ ID NO: 199632 - DNA, 25 bp, Mus musculus
aggcctcatgatgcctggaatgatg

SEQ ID NO: 199633 - DNA, 25 bp, Mus musculus
aggcctcatgatggggcatcctggc

SEQ ID NO: 199634 - DNA, 25 bp, Mus musculus
aggcctccacagagctggtggttcc

SEQ ID NO: 199635 - DNA, 25 bp, Mus musculus
aggcctccagcagataagagtaaag

SEQ ID NO: 199636 - DNA, 25 bp, Mus musculus
aggcctccagcaggggctggattca

SEQ ID NO: 199637 - DNA, 25 bp, Mus musculus
aggcctccaggaggaccttgttgag

SEQ ID NO: 199638 - DNA, 25 bp, Mus musculus
aggcctccaggaggagactcccata

SEQ ID NO: 199639 - DNA, 25 bp, Mus musculus
aggcctccagttctcccaggccttc

SEQ ID NO: 199640 - DNA, 25 bp, Mus musculus
aggcctccccaggtccccctgactt

SEQ ID NO: 199641 - DNA, 25 bp, Mus musculus
aggcctcctcaagctaaagaacgct

SEQ ID NO: 199642 - DNA, 25 bp, Mus musculus
aggcctcgccagaagccccccagca

SEQ ID NO: 199643 - DNA, 25 bp, Mus musculus
aggcctcgtctaggtgccgccccag

SEQ ID NO: 199644 - DNA, 25 bp, Mus musculus
aggcctcgttctctgaaccttcagc

SEQ ID NO: 199645 - DNA, 25 bp, Mus musculus
aggcctctgaggccttcttgctaag

SEQ ID NO: 199646 - DNA, 25 bp, Mus musculus
aggcctctggcagagcctgccccag

SEQ ID NO: 199647 - DNA, 25 bp, Mus musculus
aggcctctgtctgggcggcaatctg

SEQ ID NO: 199648 - DNA, 25 bp, Mus musculus
aggcctgaaaagagattcatctgtt

SEQ ID NO: 199649 - DNA, 25 bp, Mus musculus
aggcctgaaaagagatttcgatagt

SEQ ID NO: 199650 - DNA, 25 bp, Mus musculus
aggcctgaagaaggagctgcgggag

SEQ ID NO: 199651 - DNA, 25 bp, Mus musculus
aggcctgaagctgtctccagacacc

SEQ ID NO: 199652 - DNA, 25 bp, Mus musculus
aggcctgaaggtgcgggagtatgag

SEQ ID NO: 199653 - DNA, 25 bp, Mus musculus
aggcctgacactgactctcatggta

SEQ ID NO: 199654 - DNA, 25 bp, Mus musculus
aggcctgactcaggtctgctggcag

SEQ ID NO: 199655 - DNA, 25 bp, Mus musculus
aggcctgaggaatagacttttcact

SEQ ID NO: 199656 - DNA, 25 bp, Mus musculus
aggcctgaggaatagccctggcttt

SEQ ID NO: 199657 - DNA, 25 bp, Mus musculus
aggcctgaggaatagcttctggaat

SEQ ID NO: 199658 - DNA, 25 bp, Mus musculus
aggcctgaggagcttttcatgcaga

SEQ ID NO: 199659 - DNA, 25 bp, Mus musculus
aggcctgaggtccagatgggctcct

SEQ ID NO: 199660 - DNA, 25 bp, Mus musculus
aggcctgaggtccaggaactgttaa

SEQ ID NO: 199661 - DNA, 25 bp, Mus musculus
aggcctgcagacatttttagccagg

SEQ ID NO: 199662 - DNA, 25 bp, Mus musculus
aggcctgcagaggcagatataatgg

SEQ ID NO: 199663 - DNA, 25 bp, Mus musculus
aggcctgcagaggctgatataatgg

SEQ ID NO: 199664 - DNA, 25 bp, Mus musculus
aggcctgcagccaggtgattttgtc

SEQ ID NO: 199665 - DNA, 25 bp, Mus musculus
aggcctgcgaagatataaatgagtg

SEQ ID NO: 199666 - DNA, 25 bp, Mus musculus
aggcctgctgaccgacaggctctgc

SEQ ID NO: 199667 - DNA, 25 bp, Mus musculus
aggcctgctgaccgatttctgcatg

SEQ ID NO: 199668 - DNA, 25 bp, Mus musculus
aggcctgctgatgctcctgccagcg

SEQ ID NO: 199669 - DNA, 25 bp, Mus musculus
aggcctgcttacaggaagccgagat

SEQ ID NO: 199670 - DNA, 25 bp, Mus musculus
aggcctggacgaaaaccacgagctg

SEQ ID NO: 199671 - DNA, 25 bp, Mus musculus
aggcctggacgacgctgagcagggg

SEQ ID NO: 199672 - DNA, 25 bp, Mus musculus
aggcctggactgatgggaaggaggc

SEQ ID NO: 199673 - DNA, 25 bp, Mus musculus
aggcctggcaggtcctgaaacacct

SEQ ID NO: 199674 - DNA, 25 bp, Mus musculus
aggcctggcaggtgcccttctccaa

SEQ ID NO: 199675 - DNA, 25 bp, Mus musculus
aggcctggcagtgtgtctccaggct

SEQ ID NO: 199676 - DNA, 25 bp, Mus musculus
aggcctgggaggcccggcacaagga

SEQ ID NO: 199677 - DNA, 25 bp, Mus musculus
aggcctggggaaagcattgtggaat

SEQ ID NO: 199678 - DNA, 25 bp, Mus musculus
aggcctggtggatgactatgggctc

SEQ ID NO: 199679 - DNA, 25 bp, Mus musculus
aggcctgtcttcagtcccctaacct

SEQ ID NO: 199680 - DNA, 25 bp, Mus musculus
aggcctgtgagtgctgccgacctaa

SEQ ID NO: 199681 - DNA, 25 bp, Mus musculus
aggcctgtggtatcctgcctgttta

SEQ ID NO: 199682 - DNA, 25 bp, Mus musculus
aggcctgtgttgctacccctctggg

SEQ ID NO: 199683 - DNA, 25 bp, Mus musculus
aggcctgttaagaccactgttccct

SEQ ID NO: 199684 - DNA, 25 bp, Mus musculus
aggccttaaagactattaagataat

SEQ ID NO: 199685 - DNA, 25 bp, Mus musculus
aggccttaaaggaaatgaaagtgcc

SEQ ID NO: 199686 - DNA, 25 bp, Mus musculus
aggccttaaggctgccctgccctcc

SEQ ID NO: 199687 - DNA, 25 bp, Mus musculus
aggccttagggcaagattctcagcc

SEQ ID NO: 199688 - DNA, 25 bp, Mus musculus
aggccttagtctcctacatagccca

SEQ ID NO: 199689 - DNA, 25 bp, Mus musculus
aggccttagtctgctacatagccca

SEQ ID NO: 199690 - DNA, 25 bp, Mus musculus
aggccttcacaatctccagaactac

SEQ ID NO: 199691 - DNA, 25 bp, Mus musculus
aggccttcagccacatcccagaggg

SEQ ID NO: 199692 - DNA, 25 bp, Mus musculus
aggccttcagccggtttcaccgcgt

SEQ ID NO: 199693 - DNA, 25 bp, Mus musculus
aggccttccaggagatggagttgct

SEQ ID NO: 199694 - DNA, 25 bp, Mus musculus
aggccttccaggaggggctggaggg

SEQ ID NO: 199695 - DNA, 25 bp, Mus musculus
aggccttccagggctgaccagtttg

SEQ ID NO: 199696 - DNA, 25 bp, Mus musculus
aggccttcctcagcccaggtcctga

SEQ ID NO: 199697 - DNA, 25 bp, Mus musculus
aggccttcctcagcgagctggagcc

SEQ ID NO: 199698 - DNA, 25 bp, Mus musculus
aggccttctatagcccgtgtgattg

SEQ ID NO: 199699 - DNA, 25 bp, Mus musculus
aggccttctataggcctctgctcga

SEQ ID NO: 199700 - DNA, 25 bp, Mus musculus
aggccttctatagtgagattatata

SEQ ID NO: 199701 - DNA, 25 bp, Mus musculus
aggccttctatcgaattcgctccaa

SEQ ID NO: 199702 - DNA, 25 bp, Mus musculus
aggccttctggagcacatcttatac

SEQ ID NO: 199703 - DNA, 25 bp, Mus musculus
aggccttctgtcaggtgagcgtcct

SEQ ID NO: 199704 - DNA, 25 bp, Mus musculus
aggccttctttgatgtgaagacaac

SEQ ID NO: 199705 - DNA, 25 bp, Mus musculus
aggccttgaaggatttagttgtctt

SEQ ID NO: 199706 - DNA, 25 bp, Mus musculus
aggccttgaagtgctttaggattta

SEQ ID NO: 199707 - DNA, 25 bp, Mus musculus
aggccttgacctgttgaggagactt

SEQ ID NO: 199708 - DNA, 25 bp, Mus musculus
aggccttgcaagcaaggtgcagagc

SEQ ID NO: 199709 - DNA, 25 bp, Mus musculus
aggccttgcaagctatgtctgagct

SEQ ID NO: 199710 - DNA, 25 bp, Mus musculus
aggccttgcaaggggagagttagat

SEQ ID NO: 199711 - DNA, 25 bp, Mus musculus
aggccttggaaggaggtgggcctcc

SEQ ID NO: 199712 - DNA, 25 bp, Mus musculus
aggccttggcaattatttgtataac

SEQ ID NO: 199713 - DNA, 25 bp, Mus musculus
aggccttggtcgatccactctctca

SEQ ID NO: 199714 - DNA, 25 bp, Mus musculus
aggccttgtggaaaacaacaggttt

SEQ ID NO: 199715 - DNA, 25 bp, Mus musculus
aggccttgtggaaaagctgacaacg

SEQ ID NO: 199716 - DNA, 25 bp, Mus musculus
aggcctttcagagacgaagagagta

SEQ ID NO: 199717 - DNA, 25 bp, Mus musculus
aggcctttcagcttcaagaaaagaa

SEQ ID NO: 199718 - DNA, 25 bp, Mus musculus
aggcctttcaggtctgcctcggcca

SEQ ID NO: 199719 - DNA, 25 bp, Mus musculus
aggcctttcttagacacatgcagcc

SEQ ID NO: 199720 - DNA, 25 bp, Mus musculus
aggcgaaagagagccgggtcaaacc

SEQ ID NO: 199721 - DNA, 25 bp, Mus musculus
aggcgaatgatcagatgagaggctg

SEQ ID NO: 199722 - DNA, 25 bp, Mus musculus
aggcgacagtacctggaggagctgc

SEQ ID NO: 199723 - DNA, 25 bp, Mus musculus
aggcgacatcacaagagccccatgc

SEQ ID NO: 199724 - DNA, 25 bp, Mus musculus
aggcgacatcacaaggatgatgagg

SEQ ID NO: 199725 - DNA, 25 bp, Mus musculus
aggcgactgtggagtgtgcacagcc

SEQ ID NO: 199726 - DNA, 25 bp, Mus musculus
aggcgagaaatgagagaaacgcacc

SEQ ID NO: 199727 - DNA, 25 bp, Mus musculus
aggcgagaaatggaaacagctgctg

SEQ ID NO: 199728 - DNA, 25 bp, Mus musculus
aggcgagaagatccttatccttcag

SEQ ID NO: 199729 - DNA, 25 bp, Mus musculus
aggcgagaagatgggctgcatctag

SEQ ID NO: 199730 - DNA, 25 bp, Mus musculus
aggcgagagactgacctagtctggc

SEQ ID NO: 199731 - DNA, 25 bp, Mus musculus
aggcgagaggtcaaggccccacgca

SEQ ID NO: 199732 - DNA, 25 bp, Mus musculus
aggcgagcacccgggatacactttt

SEQ ID NO: 199733 - DNA, 25 bp, Mus musculus
aggcgagcacccggggaggcagagt

SEQ ID NO: 199734 - DNA, 25 bp, Mus musculus
aggcgagcagaaacttggacccttc

SEQ ID NO: 199735 - DNA, 25 bp, Mus musculus
aggcgagcagctggtggcccccgac

SEQ ID NO: 199736 - DNA, 25 bp, Mus musculus
aggcgagcagctgtggcccctcaga

SEQ ID NO: 199737 - DNA, 25 bp, Mus musculus
aggcgagcagggtcctcctgggcct

SEQ ID NO: 199738 - DNA, 25 bp, Mus musculus
aggcgagcgggctaaccattttgaa

SEQ ID NO: 199739 - DNA, 25 bp, Mus musculus
aggcgaggaagaaaaaagtcatgat

SEQ ID NO: 199740 - DNA, 25 bp, Mus musculus
aggcgaggaaggcattgggagagac

SEQ ID NO: 199741 - DNA, 25 bp, Mus musculus
aggcgaggttcaagtagtatcttta

SEQ ID NO: 199742 - DNA, 25 bp, Mus musculus
aggcgagtgatgcttattctttggg

SEQ ID NO: 199743 - DNA, 25 bp, Mus musculus
aggcgagttacaggagggaatcttg

SEQ ID NO: 199744 - DNA, 25 bp, Mus musculus
aggcgatatccgtaaagaacttgtc

SEQ ID NO: 199745 - DNA, 25 bp, Mus musculus
aggcgatcttgagcaaaagagcccg

SEQ ID NO: 199746 - DNA, 25 bp, Mus musculus
aggcgatcttgaggtggctaccgtc

SEQ ID NO: 199747 - DNA, 25 bp, Mus musculus
aggcgatgtggagaggtggagaatc

SEQ ID NO: 199748 - DNA, 25 bp, Mus musculus
aggcgcaaagactggcggaggccag

SEQ ID NO: 199749 - DNA, 25 bp, Mus musculus
aggcgcacagcggggactcgaggcc

SEQ ID NO: 199750 - DNA, 25 bp, Mus musculus
aggcgcacagcggtaaaatgtcggc

SEQ ID NO: 199751 - DNA, 25 bp, Mus musculus
aggcgcaccgcaaagatgtgaaatt

SEQ ID NO: 199752 - DNA, 25 bp, Mus musculus
aggcgcagaaggatcgccacgactc

SEQ ID NO: 199753 - DNA, 25 bp, Mus musculus
aggcgcagatttggatgactttttt

SEQ ID NO: 199754 - DNA, 25 bp, Mus musculus
aggcgcagatttgggattttgaact

SEQ ID NO: 199755 - DNA, 25 bp, Mus musculus
aggcgcagccaccgcacctgcggga

SEQ ID NO: 199756 - DNA, 25 bp, Mus musculus
aggcgcagccaccgcgctcatgcgt

SEQ ID NO: 199757 - DNA, 25 bp, Mus musculus
aggcgcagcccgggtgcaattaaaa

SEQ ID NO: 199758 - DNA, 25 bp, Mus musculus
aggcgcaggcaggggggacctgaac

SEQ ID NO: 199759 - DNA, 25 bp, Mus musculus
aggcgcaggcggaggtcagacctga

SEQ ID NO: 199760 - DNA, 25 bp, Mus musculus
aggcgcagggaggcaatggcagcta

SEQ ID NO: 199761 - DNA, 25 bp, Mus musculus
aggcgcatcaggtgaagaagagtct

SEQ ID NO: 199762 - DNA, 25 bp, Mus musculus
aggcgcatcccgtttcaagaaagta

SEQ ID NO: 199763 - DNA, 25 bp, Mus musculus
aggcgccacgacctgtgctaccaga

SEQ ID NO: 199764 - DNA, 25 bp, Mus musculus
aggcgccacggtagcgcctggcatg

SEQ ID NO: 199765 - DNA, 25 bp, Mus musculus
aggcgccaggctcagccgagatgcc

SEQ ID NO: 199766 - DNA, 25 bp, Mus musculus
aggcgccagggcaaggaggtcagac

SEQ ID NO: 199767 - DNA, 25 bp, Mus musculus
aggcgcccaaagtctcaggggccta

SEQ ID NO: 199768 - DNA, 25 bp, Mus musculus
aggcgcccacgttgggatctgaacc

SEQ ID NO: 199769 - DNA, 25 bp, Mus musculus
aggcgcccatgcagatggcctctgc

SEQ ID NO: 199770 - DNA, 25 bp, Mus musculus
aggcgccgaacagcagcgggcgggg

SEQ ID NO: 199771 - DNA, 25 bp, Mus musculus
aggcgcgaccccagctctatttcag

SEQ ID NO: 199772 - DNA, 25 bp, Mus musculus
aggcgcgaccccaggaccagctctc

SEQ ID NO: 199773 - DNA, 25 bp, Mus musculus
aggcgcgaggagctccagaaatctt

SEQ ID NO: 199774 - DNA, 25 bp, Mus musculus
aggcgcgcagtgaaagccggcggga

SEQ ID NO: 199775 - DNA, 25 bp, Mus musculus
aggcgcgccggaagcccgacatccc

SEQ ID NO: 199776 - DNA, 25 bp, Mus musculus
aggcgcgcgagaagctcgcgctgta

SEQ ID NO: 199777 - DNA, 25 bp, Mus musculus
aggcgcggacgcggagacgtttgaa

SEQ ID NO: 199778 - DNA, 25 bp, Mus musculus
aggcgcggacgcggagtctggtcca

SEQ ID NO: 199779 - DNA, 25 bp, Mus musculus
aggcgcggcaggcggtgatacttct

SEQ ID NO: 199780 - DNA, 25 bp, Mus musculus
aggcgcggcaggtggagggagcggc

SEQ ID NO: 199781 - DNA, 25 bp, Mus musculus
aggcgcggcgggatatgtggtacat

SEQ ID NO: 199782 - DNA, 25 bp, Mus musculus
aggcgcggctgcagtctttaagaaa

SEQ ID NO: 199783 - DNA, 25 bp, Mus musculus
aggcgcgggaggcggagagtgtcac

SEQ ID NO: 199784 - DNA, 25 bp, Mus musculus
aggcgcgggaggcggctctagatgg

SEQ ID NO: 199785 - DNA, 25 bp, Mus musculus
aggcgcgggaggcgtacgagatgag

SEQ ID NO: 199786 - DNA, 25 bp, Mus musculus
aggcgcggggtgatggcaggagaac

SEQ ID NO: 199787 - DNA, 25 bp, Mus musculus
aggcgcgtcagtgggtacccagaaa

SEQ ID NO: 199788 - DNA, 25 bp, Mus musculus
aggcgcgtgagacgcagaggcaggg

SEQ ID NO: 199789 - DNA, 25 bp, Mus musculus
aggcgcgtgagatgcccggaaccga

SEQ ID NO: 199790 - DNA, 25 bp, Mus musculus
aggcgctagagctagtctacccaag

SEQ ID NO: 199791 - DNA, 25 bp, Mus musculus
aggcgctagaggtgacccttcccta

SEQ ID NO: 199792 - DNA, 25 bp, Mus musculus
aggcgctagggtctgggaacgtaat

SEQ ID NO: 199793 - DNA, 25 bp, Mus musculus
aggcgctatgggtcatctgttccgg

SEQ ID NO: 199794 - DNA, 25 bp, Mus musculus
aggcgctcaagcggctcacccagga

SEQ ID NO: 199795 - DNA, 25 bp, Mus musculus
aggcgctcccaggtaggtgagctcc

SEQ ID NO: 199796 - DNA, 25 bp, Mus musculus
aggcgctccccgaggtgtgaatgag

SEQ ID NO: 199797 - DNA, 25 bp, Mus musculus
aggcgctcgagtatgcctgtggtat

SEQ ID NO: 199798 - DNA, 25 bp, Mus musculus
aggcgctcgggaaggctcctcgccg

SEQ ID NO: 199799 - DNA, 25 bp, Mus musculus
aggcgctcgggaaggcttttgaccc

SEQ ID NO: 199800 - DNA, 25 bp, Mus musculus
aggcgctgcagtcaggcatcaagga

SEQ ID NO: 199801 - DNA, 25 bp, Mus musculus
aggcgctgcgggtggcctggagagc

SEQ ID NO: 199802 - DNA, 25 bp, Mus musculus
aggcgctgctttagagtctccagag

SEQ ID NO: 199803 - DNA, 25 bp, Mus musculus
aggcgctgctttaggcccaggaggg

SEQ ID NO: 199804 - DNA, 25 bp, Mus musculus
aggcgctgtacgaggctccagcata

SEQ ID NO: 199805 - DNA, 25 bp, Mus musculus
aggcgcttctagtgccgcttctcga

SEQ ID NO: 199806 - DNA, 25 bp, Mus musculus
aggcgcttgcagaaggggcgcctaa

SEQ ID NO: 199807 - DNA, 25 bp, Mus musculus
aggcgcttgcaggcatgacgagtgt

SEQ ID NO: 199808 - DNA, 25 bp, Mus musculus
aggcgcttggagaatggcagcagca

SEQ ID NO: 199809 - DNA, 25 bp, Mus musculus
aggcgctttcaggtaaaatggaact

SEQ ID NO: 199810 - DNA, 25 bp, Mus musculus
aggcggaaagatggcgtaccttctc

SEQ ID NO: 199811 - DNA, 25 bp, Mus musculus
aggcggaagagcatctgatacgtca

SEQ ID NO: 199812 - DNA, 25 bp, Mus musculus
aggcggaagaggtcaggacccccag

SEQ ID NO: 199813 - DNA, 25 bp, Mus musculus
aggcggaagtggttctgctgcctta

SEQ ID NO: 199814 - DNA, 25 bp, Mus musculus
aggcggacaggagatgaccggttcg

SEQ ID NO: 199815 - DNA, 25 bp, Mus musculus
aggcggaccaagcacagcctcctct

SEQ ID NO: 199816 - DNA, 25 bp, Mus musculus
aggcggacgcagaattcggcccctg

SEQ ID NO: 199817 - DNA, 25 bp, Mus musculus
aggcggacgcaggtccgctacagag

SEQ ID NO: 199818 - DNA, 25 bp, Mus musculus
aggcggagaagtactctcaaaaaga

SEQ ID NO: 199819 - DNA, 25 bp, Mus musculus
aggcggagaccagaaccccagctga

SEQ ID NO: 199820 - DNA, 25 bp, Mus musculus
aggcggagagagcaacttcttcggg

SEQ ID NO: 199821 - DNA, 25 bp, Mus musculus
aggcggaggacaagggaccgtcacg

SEQ ID NO: 199822 - DNA, 25 bp, Mus musculus
aggcggaggagctgggtccatattg

SEQ ID NO: 199823 - DNA, 25 bp, Mus musculus
aggcggaggagctgggtgatggctg

SEQ ID NO: 199824 - DNA, 25 bp, Mus musculus
aggcggagtgaacgatcatgaagga

SEQ ID NO: 199825 - DNA, 25 bp, Mus musculus
aggcggagtgggtgacccgggggtg

SEQ ID NO: 199826 - DNA, 25 bp, Mus musculus
aggcggagtggttctctttctgcag

SEQ ID NO: 199827 - DNA, 25 bp, Mus musculus
aggcggatcaaccccccttaagaca

SEQ ID NO: 199828 - DNA, 25 bp, Mus musculus
aggcggatcaagatcagtataactc

SEQ ID NO: 199829 - DNA, 25 bp, Mus musculus
aggcggatctgggtacgcgtctaca

SEQ ID NO: 199830 - DNA, 25 bp, Mus musculus
aggcggatggcacccttatcacatg

SEQ ID NO: 199831 - DNA, 25 bp, Mus musculus
aggcggattccagcccaacatgcaa

SEQ ID NO: 199832 - DNA, 25 bp, Mus musculus
aggcggattcgggttcgggagcagc

SEQ ID NO: 199833 - DNA, 25 bp, Mus musculus
aggcggattgcggccaagatcgcag

SEQ ID NO: 199834 - DNA, 25 bp, Mus musculus
aggcggcagcgccgatgccgcctgc

SEQ ID NO: 199835 - DNA, 25 bp, Mus musculus
aggcggccaagggagcagccgccca

SEQ ID NO: 199836 - DNA, 25 bp, Mus musculus
aggcggccagcccagggcaaacgct

SEQ ID NO: 199837 - DNA, 25 bp, Mus musculus
aggcggccagcccaggggcacctac

SEQ ID NO: 199838 - DNA, 25 bp, Mus musculus
aggcggccagcggagagcaaagacc

SEQ ID NO: 199839 - DNA, 25 bp, Mus musculus
aggcggcccctgcagaagactgcta

SEQ ID NO: 199840 - DNA, 25 bp, Mus musculus
aggcggccgaccagatgtgaggtga

SEQ ID NO: 199841 - DNA, 25 bp, Mus musculus
aggcggcgagaaggacccggctcgc

SEQ ID NO: 199842 - DNA, 25 bp, Mus musculus
aggcggcgccacgagctggtgattg

SEQ ID NO: 199843 - DNA, 25 bp, Mus musculus
aggcggcgccggacgaccgaagcca

SEQ ID NO: 199844 - DNA, 25 bp, Mus musculus
aggcggcgcgggaggtgctggagag

SEQ ID NO: 199845 - DNA, 25 bp, Mus musculus
aggcggcggagcagaaatagatgaa

SEQ ID NO: 199846 - DNA, 25 bp, Mus musculus
aggcggcggagcagattcggaggcg

SEQ ID NO: 199847 - DNA, 25 bp, Mus musculus
aggcggctcaggtgttatagactgc

SEQ ID NO: 199848 - DNA, 25 bp, Mus musculus
aggcggctcaggtttctcccatttc

SEQ ID NO: 199849 - DNA, 25 bp, Mus musculus
aggcggctcccccaggtttccatcg

SEQ ID NO: 199850 - DNA, 25 bp, Mus musculus
aggcggctctagggcgtcccggggc

SEQ ID NO: 199851 - DNA, 25 bp, Mus musculus
aggcggctctagggggccagagttt

SEQ ID NO: 199852 - DNA, 25 bp, Mus musculus
aggcggctgcagcgggaagatgtca

SEQ ID NO: 199853 - DNA, 25 bp, Mus musculus
aggcggctggcagaacttgatcacc

SEQ ID NO: 199854 - DNA, 25 bp, Mus musculus
aggcggctggcagagactcctgaaa

SEQ ID NO: 199855 - DNA, 25 bp, Mus musculus
aggcggctggcagctgcagaagaga

SEQ ID NO: 199856 - DNA, 25 bp, Mus musculus
aggcggcttctgctgcaggagtcag

SEQ ID NO: 199857 - DNA, 25 bp, Mus musculus
aggcgggaaggccagggtcatttct

SEQ ID NO: 199858 - DNA, 25 bp, Mus musculus
aggcgggacccgagatccacgtgtc

SEQ ID NO: 199859 - DNA, 25 bp, Mus musculus
aggcgggacccgagctgtgtctctt

SEQ ID NO: 199860 - DNA, 25 bp, Mus musculus
aggcgggagatgagacgtgacttgt

SEQ ID NO: 199861 - DNA, 25 bp, Mus musculus
aggcgggcagacgtatgtttccttc

SEQ ID NO: 199862 - DNA, 25 bp, Mus musculus
aggcgggcggtgtatcctcagagat

SEQ ID NO: 199863 - DNA, 25 bp, Mus musculus
aggcgggctgcgtggcattgtcgcc

SEQ ID NO: 199864 - DNA, 25 bp, Mus musculus
aggcggggaacggtaatcccgctca

SEQ ID NO: 199865 - DNA, 25 bp, Mus musculus
aggcggggcgcagctgggcaccaca

SEQ ID NO: 199866 - DNA, 25 bp, Mus musculus
aggcgggtttgccacaatctgcctg

SEQ ID NO: 199867 - DNA, 25 bp, Mus musculus
aggcggtaaatgggcttcttggtaa

SEQ ID NO: 199868 - DNA, 25 bp, Mus musculus
aggcggtcgcccaggctccgccccc

SEQ ID NO: 199869 - DNA, 25 bp, Mus musculus
aggcggtgataacggatagacagga

SEQ ID NO: 199870 - DNA, 25 bp, Mus musculus
aggcggtgcaagcaggttatgaggt

SEQ ID NO: 199871 - DNA, 25 bp, Mus musculus
aggcggtgcgtaaaaaaatatttct

SEQ ID NO: 199872 - DNA, 25 bp, Mus musculus
aggcggtggggtaagtgtggacatt

SEQ ID NO: 199873 - DNA, 25 bp, Mus musculus
aggcggtgtgaagtaagcaatggct

SEQ ID NO: 199874 - DNA, 25 bp, Mus musculus
aggcggtttcaggacaatctctcct

SEQ ID NO: 199875 - DNA, 25 bp, Mus musculus
aggcgtatttcagatgatgacactg

SEQ ID NO: 199876 - DNA, 25 bp, Mus musculus
aggcgtccaagctcccagcagcaaa

SEQ ID NO: 199877 - DNA, 25 bp, Mus musculus
aggcgtccaaggccatcagctccag

SEQ ID NO: 199878 - DNA, 25 bp, Mus musculus
aggcgtcccaggcctggaatgcttc

SEQ ID NO: 199879 - DNA, 25 bp, Mus musculus
aggcgtccgcaggtttgatgagatc

SEQ ID NO: 199880 - DNA, 25 bp, Mus musculus
aggcgtcgcagtcaggcctcagctg

SEQ ID NO: 199881 - DNA, 25 bp, Mus musculus
aggcgtcgcagtcagtactgttaca

SEQ ID NO: 199882 - DNA, 25 bp, Mus musculus
aggcgtcgggattatcgtggccgtc

SEQ ID NO: 199883 - DNA, 25 bp, Mus musculus
aggcgtcgtagtcagcattttcttg

SEQ ID NO: 199884 - DNA, 25 bp, Mus musculus
aggcgtctaaagccattgaaaagga

SEQ ID NO: 199885 - DNA, 25 bp, Mus musculus
aggcgtctaaagccgccctcacctt

SEQ ID NO: 199886 - DNA, 25 bp, Mus musculus
aggcgtctcgagcctatcctctact

SEQ ID NO: 199887 - DNA, 25 bp, Mus musculus
aggcgtctcgaggaacgcctcgatg

SEQ ID NO: 199888 - DNA, 25 bp, Mus musculus
aggcgtgaaccctaggttctgctgc

SEQ ID NO: 199889 - DNA, 25 bp, Mus musculus
aggcgtgaagaacctaatatcagga

SEQ ID NO: 199890 - DNA, 25 bp, Mus musculus
aggcgtgaagaacctgcaactggac

SEQ ID NO: 199891 - DNA, 25 bp, Mus musculus
aggcgtgaggaaactgctgtcattc

SEQ ID NO: 199892 - DNA, 25 bp, Mus musculus
aggcgtgatcagaggtcaacagtct

SEQ ID NO: 199893 - DNA, 25 bp, Mus musculus
aggcgtgatcaggggttcttattgg

SEQ ID NO: 199894 - DNA, 25 bp, Mus musculus
aggcgtgcagataaagggagaagat

SEQ ID NO: 199895 - DNA, 25 bp, Mus musculus
aggcgtgcagatccaagcaagctcc

SEQ ID NO: 199896 - DNA, 25 bp, Mus musculus
aggcgtgcagtgggagatttttcac

SEQ ID NO: 199897 - DNA, 25 bp, Mus musculus
aggcgtgcgggtgtgaacaacgtgg

SEQ ID NO: 199898 - DNA, 25 bp, Mus musculus
aggcgtggagcagggccgactgatc

SEQ ID NO: 199899 - DNA, 25 bp, Mus musculus
aggcgtggcggacccaggcaccccg

SEQ ID NO: 199900 - DNA, 25 bp, Mus musculus
aggcgtgggaacagagccctttggg

SEQ ID NO: 199901 - DNA, 25 bp, Mus musculus
aggcgtgtctgagaaccttctcccg

SEQ ID NO: 199902 - DNA, 25 bp, Mus musculus
aggcgttcaagttaattatgacctg

SEQ ID NO: 199903 - DNA, 25 bp, Mus musculus
aggcgttcaagttaattctgtcaga

SEQ ID NO: 199904 - DNA, 25 bp, Mus musculus
aggcgtttgcacaaagttcgagaag

SEQ ID NO: 199905 - DNA, 25 bp, Mus musculus
aggctaacatggggttcggagcgac

SEQ ID NO: 199906 - DNA, 25 bp, Mus musculus
aggctaacgaggacgtctgcctggc

SEQ ID NO: 199907 - DNA, 25 bp, Mus musculus
aggctaactgaggggttggcaaaac

SEQ ID NO: 199908 - DNA, 25 bp, Mus musculus
aggctaaggggaggcccagcctcgt

SEQ ID NO: 199909 - DNA, 25 bp, Mus musculus
aggctaatgaggaagcattaggggt

SEQ ID NO: 199910 - DNA, 25 bp, Mus musculus
aggctaatgaggtttctggctccct

SEQ ID NO: 199911 - DNA, 25 bp, Mus musculus
aggctaatttatgatcgttgtccaa

SEQ ID NO: 199912 - DNA, 25 bp, Mus musculus
aggctacaaagaacccaagagatga

SEQ ID NO: 199913 - DNA, 25 bp, Mus musculus
aggctacaagcagtgccggctacag

SEQ ID NO: 199914 - DNA, 25 bp, Mus musculus
aggctacaaggtgctggtggcaaca

SEQ ID NO: 199915 - DNA, 25 bp, Mus musculus
aggctacaatccctctacttcggaa

SEQ ID NO: 199916 - DNA, 25 bp, Mus musculus
aggctacactggggcttacagggct

SEQ ID NO: 199917 - DNA, 25 bp, Mus musculus
aggctacagtctgcctttcagtcag

SEQ ID NO: 199918 - DNA, 25 bp, Mus musculus
aggctacatggggttgacctgtagt

SEQ ID NO: 199919 - DNA, 25 bp, Mus musculus
aggctaccggacagctttcttcgga

SEQ ID NO: 199920 - DNA, 25 bp, Mus musculus
aggctaccgtcgctttctccagctg

SEQ ID NO: 199921 - DNA, 25 bp, Mus musculus
aggctacctagaaagtcccaaggaa

SEQ ID NO: 199922 - DNA, 25 bp, Mus musculus
aggctacctagaacatcagaaacct

SEQ ID NO: 199923 - DNA, 25 bp, Mus musculus
aggctacctctggggtgaatgagag

SEQ ID NO: 199924 - DNA, 25 bp, Mus musculus
aggctacgacgtgctgtgtgcagca

SEQ ID NO: 199925 - DNA, 25 bp, Mus musculus
aggctacgacgtggttgcgcagaca

SEQ ID NO: 199926 - DNA, 25 bp, Mus musculus
aggctacgaggaagtaccatttagg

SEQ ID NO: 199927 - DNA, 25 bp, Mus musculus
aggctacggaggctatggggcatgg

SEQ ID NO: 199928 - DNA, 25 bp, Mus musculus
aggctacttctgcgacagtgacagc

SEQ ID NO: 199929 - DNA, 25 bp, Mus musculus
aggctacttcttctggatctctttc

SEQ ID NO: 199930 - DNA, 25 bp, Mus musculus
aggctagaaagcagatggaaaggca

SEQ ID NO: 199931 - DNA, 25 bp, Mus musculus
aggctagacaggcaggacaggtcct

SEQ ID NO: 199932 - DNA, 25 bp, Mus musculus
aggctagactggctgcgaagctggg

SEQ ID NO: 199933 - DNA, 25 bp, Mus musculus
aggctagattgagatgagcagctct

SEQ ID NO: 199934 - DNA, 25 bp, Mus musculus
aggctaggtatctccggtttaggct

SEQ ID NO: 199935 - DNA, 25 bp, Mus musculus
aggctagtgggtcatcttggaagat

SEQ ID NO: 199936 - DNA, 25 bp, Mus musculus
aggctagtggttacttacacattgg

SEQ ID NO: 199937 - DNA, 25 bp, Mus musculus
aggctagtggttacttacagtttat

SEQ ID NO: 199938 - DNA, 25 bp, Mus musculus
aggctataaagagcaaaacaattgg

SEQ ID NO: 199939 - DNA, 25 bp, Mus musculus
aggctataaggtacgaaaccagcac

SEQ ID NO: 199940 - DNA, 25 bp, Mus musculus
aggctataaggtccccagggaggag

SEQ ID NO: 199941 - DNA, 25 bp, Mus musculus
aggctataatctggtatgtgtatca

SEQ ID NO: 199942 - DNA, 25 bp, Mus musculus
aggctatagaaaggctgaaggcact

SEQ ID NO: 199943 - DNA, 25 bp, Mus musculus
aggctatagaaagggcgctttcgtt

SEQ ID NO: 199944 - DNA, 25 bp, Mus musculus
aggctatcctgaggttgcaggtcag

SEQ ID NO: 199945 - DNA, 25 bp, Mus musculus
aggctatcgtgtgagccagatcttc

SEQ ID NO: 199946 - DNA, 25 bp, Mus musculus
aggctatgaaggggtcagaatacaa

SEQ ID NO: 199947 - DNA, 25 bp, Mus musculus
aggctatgaggtacatccctgaggg

SEQ ID NO: 199948 - DNA, 25 bp, Mus musculus
aggctatgcaagggctacagagccc

SEQ ID NO: 199949 - DNA, 25 bp, Mus musculus
aggctatgctcatagggtacagcat

SEQ ID NO: 199950 - DNA, 25 bp, Mus musculus
aggctatggaattggaagcctgcgc

SEQ ID NO: 199951 - DNA, 25 bp, Mus musculus
aggctatggagagagtatgctggat

SEQ ID NO: 199952 - DNA, 25 bp, Mus musculus
aggctatggtggaggtagaagattt

SEQ ID NO: 199953 - DNA, 25 bp, Mus musculus
aggctattacgagtatggctacatc

SEQ ID NO: 199954 - DNA, 25 bp, Mus musculus
aggctatttacagagcccatggatg

SEQ ID NO: 199955 - DNA, 25 bp, Mus musculus
aggctcaagtgagggcattgccaga

SEQ ID NO: 199956 - DNA, 25 bp, Mus musculus
aggctcaagtgtgagggagatgaac

SEQ ID NO: 199957 - DNA, 25 bp, Mus musculus
aggctcacaagaaataccattctct

SEQ ID NO: 199958 - DNA, 25 bp, Mus musculus
aggctcacaaggcagaaaaaaaaat

SEQ ID NO: 199959 - DNA, 25 bp, Mus musculus
aggctcacagaagagagctgtgaat

SEQ ID NO: 199960 - DNA, 25 bp, Mus musculus
aggctcacagaaggctgttcattta

SEQ ID NO: 199961 - DNA, 25 bp, Mus musculus
aggctcaccaggatgtcttccaagc

SEQ ID NO: 199962 - DNA, 25 bp, Mus musculus
aggctcagaaaggatgtcaaagtct

SEQ ID NO: 199963 - DNA, 25 bp, Mus musculus
aggctcagagatgggcccagtgcac

SEQ ID NO: 199964 - DNA, 25 bp, Mus musculus
aggctcagaggctgatggtgaccgc

SEQ ID NO: 199965 - DNA, 25 bp, Mus musculus
aggctcagcaggaaacaaggaccaa

SEQ ID NO: 199966 - DNA, 25 bp, Mus musculus
aggctcagcagggtgctacagtgcc

SEQ ID NO: 199967 - DNA, 25 bp, Mus musculus
aggctcagctacaggctcagaaaga

SEQ ID NO: 199968 - DNA, 25 bp, Mus musculus
aggctcagggcacaggaataacaga

SEQ ID NO: 199969 - DNA, 25 bp, Mus musculus
aggctcatagacagggtttctctgt

SEQ ID NO: 199970 - DNA, 25 bp, Mus musculus
aggctcataggccaaactcaagggg

SEQ ID NO: 199971 - DNA, 25 bp, Mus musculus
aggctcatcagatgtaaacagaaag

SEQ ID NO: 199972 - DNA, 25 bp, Mus musculus
aggctcatctacaggtgccaagtcg

SEQ ID NO: 199973 - DNA, 25 bp, Mus musculus
aggctcatgtgcagaaggtctcgag

SEQ ID NO: 199974 - DNA, 25 bp, Mus musculus
aggctccaaccccccggccctgcct

SEQ ID NO: 199975 - DNA, 25 bp, Mus musculus
aggctccaagggatttggtttcgta

SEQ ID NO: 199976 - DNA, 25 bp, Mus musculus
aggctccaaggttaataatgcgaca

SEQ ID NO: 199977 - DNA, 25 bp, Mus musculus
aggctccacagattgcagcccggga

SEQ ID NO: 199978 - DNA, 25 bp, Mus musculus
aggctccacaggagatggctttcac

SEQ ID NO: 199979 - DNA, 25 bp, Mus musculus
aggctccaccgcggtctgacagcgg

SEQ ID NO: 199980 - DNA, 25 bp, Mus musculus
aggctccaccgcggttggaattcga

SEQ ID NO: 199981 - DNA, 25 bp, Mus musculus
aggctccacctaaaagtgctggacg

SEQ ID NO: 199982 - DNA, 25 bp, Mus musculus
aggctccacctaaagagccactgga

SEQ ID NO: 199983 - DNA, 25 bp, Mus musculus
aggctccacctaaagtactgaccaa

SEQ ID NO: 199984 - DNA, 25 bp, Mus musculus
aggctccacggcaatagacccagtg

SEQ ID NO: 199985 - DNA, 25 bp, Mus musculus
aggctccagaaccagataattagca

SEQ ID NO: 199986 - DNA, 25 bp, Mus musculus
aggctccagatgatgagaagctgta

SEQ ID NO: 199987 - DNA, 25 bp, Mus musculus
aggctccagatgctgtggccagcgt

SEQ ID NO: 199988 - DNA, 25 bp, Mus musculus
aggctccaggacaagatgcgagcta

SEQ ID NO: 199989 - DNA, 25 bp, Mus musculus
aggctccaggacaaggaagaaaccg

SEQ ID NO: 199990 - DNA, 25 bp, Mus musculus
aggctccagtcctgccaacccatct

SEQ ID NO: 199991 - DNA, 25 bp, Mus musculus
aggctcccgagggatcatgcctggc

SEQ ID NO: 199992 - DNA, 25 bp, Mus musculus
aggctcccgagttctacacagctgg

SEQ ID NO: 199993 - DNA, 25 bp, Mus musculus
aggctcccgcccctggtgtgctacc

SEQ ID NO: 199994 - DNA, 25 bp, Mus musculus
aggctccctgggtgtcactggtgca

SEQ ID NO: 199995 - DNA, 25 bp, Mus musculus
aggctccgagcaaggccgtgcagaa

SEQ ID NO: 199996 - DNA, 25 bp, Mus musculus
aggctccgaggtggcgaaatggatt

SEQ ID NO: 199997 - DNA, 25 bp, Mus musculus
aggctccgcagcaagatcgaggagc

SEQ ID NO: 199998 - DNA, 25 bp, Mus musculus
aggctccgtcaagcccccggaagcc

SEQ ID NO: 199999 - DNA, 25 bp, Mus musculus
aggctcctccagatgtcaacttgtg

SEQ ID NO: 200000 - DNA, 25 bp, Mus musculus
aggctcctctggcatgaacctctca

SEQ ID NO: 200001 - DNA, 25 bp, Mus musculus
aggctcctgagcagggacctgaggt

SEQ ID NO: 200002 - DNA, 25 bp, Mus musculus
aggctcctgagcaggtcttgggacc

SEQ ID NO: 200003 - DNA, 25 bp, Mus musculus
aggctcctgagccaggttgatgtag

SEQ ID NO: 200004 - DNA, 25 bp, Mus musculus
aggctcctgatgcaccagattgtac

SEQ ID NO: 200005 - DNA, 25 bp, Mus musculus
aggctcctgatggtgcctgatggct

SEQ ID NO: 200006 - DNA, 25 bp, Mus musculus
aggctccttctacagagccttgggg

SEQ ID NO: 200007 - DNA, 25 bp, Mus musculus
aggctccttctacagtgctcctttg

SEQ ID NO: 200008 - DNA, 25 bp, Mus musculus
aggctccttgataagctcgttggcg

SEQ ID NO: 200009 - DNA, 25 bp, Mus musculus
aggctcgagcagagtccgtctccca

SEQ ID NO: 200010 - DNA, 25 bp, Mus musculus
aggctcgagttgctccttcctctcc

SEQ ID NO: 200011 - DNA, 25 bp, Mus musculus
aggctcgatgaaaaacacaaaagaa

SEQ ID NO: 200012 - DNA, 25 bp, Mus musculus
aggctcgatggagaattttggttgg

SEQ ID NO: 200013 - DNA, 25 bp, Mus musculus
aggctcgcagaggcaggggtagagc

SEQ ID NO: 200014 - DNA, 25 bp, Mus musculus
aggctcgcataggcagttctcccag

SEQ ID NO: 200015 - DNA, 25 bp, Mus musculus
aggctcgccaggctggaacgcttta

SEQ ID NO: 200016 - DNA, 25 bp, Mus musculus
aggctcgccagggaagtctactgac

SEQ ID NO: 200017 - DNA, 25 bp, Mus musculus
aggctcgccagggtggctgtctgcc

SEQ ID NO: 200018 - DNA, 25 bp, Mus musculus
aggctcgcgctgacgcagtatgaga

SEQ ID NO: 200019 - DNA, 25 bp, Mus musculus
aggctcgcgctgggtgcatgtacca

SEQ ID NO: 200020 - DNA, 25 bp, Mus musculus
aggctcgcgctgtatttcagggtgc

SEQ ID NO: 200021 - DNA, 25 bp, Mus musculus
aggctcggaaacgaatacctccacg

SEQ ID NO: 200022 - DNA, 25 bp, Mus musculus
aggctcggaagaaattgataattat

SEQ ID NO: 200023 - DNA, 25 bp, Mus musculus
aggctcgggaaaagttagctttata

SEQ ID NO: 200024 - DNA, 25 bp, Mus musculus
aggctcgggggctgcccctggagac

SEQ ID NO: 200025 - DNA, 25 bp, Mus musculus
aggctcggggggaaagaggaggagc

SEQ ID NO: 200026 - DNA, 25 bp, Mus musculus
aggctcgtcaggcacagaaggagct

SEQ ID NO: 200027 - DNA, 25 bp, Mus musculus
aggctctacaggttttggctcacct

SEQ ID NO: 200028 - DNA, 25 bp, Mus musculus
aggctctacattcccaaggtgatgg

SEQ ID NO: 200029 - DNA, 25 bp, Mus musculus
aggctctatgaaaaactgatgagcc

SEQ ID NO: 200030 - DNA, 25 bp, Mus musculus
aggctctatgaaaagtctgtcagtt

SEQ ID NO: 200031 - DNA, 25 bp, Mus musculus
aggctctcaaaacagatctgtctga

SEQ ID NO: 200032 - DNA, 25 bp, Mus musculus
aggctctcattgaggcttatgtaaa

SEQ ID NO: 200033 - DNA, 25 bp, Mus musculus
aggctctccaaaagtaaagcaccgt

SEQ ID NO: 200034 - DNA, 25 bp, Mus musculus
aggctctccaggcagtgcttttaca

SEQ ID NO: 200035 - DNA, 25 bp, Mus musculus
aggctctccaggtagcctttccagt

SEQ ID NO: 200036 - DNA, 25 bp, Mus musculus
aggctctccaggtttgtgtaagtca

SEQ ID NO: 200037 - DNA, 25 bp, Mus musculus
aggctctccgggttcaataggattg

SEQ ID NO: 200038 - DNA, 25 bp, Mus musculus
aggctctcgagagaagcgagagaag

SEQ ID NO: 200039 - DNA, 25 bp, Mus musculus
aggctctctgaccgggactttgaat

SEQ ID NO: 200040 - DNA, 25 bp, Mus musculus
aggctctgactgttctctctcttgc

SEQ ID NO: 200041 - DNA, 25 bp, Mus musculus
aggctctgaggcaggtacccacccg

SEQ ID NO: 200042 - DNA, 25 bp, Mus musculus
aggctctgattaaaggtggagcagc

SEQ ID NO: 200043 - DNA, 25 bp, Mus musculus
aggctctgattaaagtaacgacatt

SEQ ID NO: 200044 - DNA, 25 bp, Mus musculus
aggctctgcagactgcacagaagat

SEQ ID NO: 200045 - DNA, 25 bp, Mus musculus
aggctctgcagcatctcagctgcct

SEQ ID NO: 200046 - DNA, 25 bp, Mus musculus
aggctctgcagcctgaagaacagag

SEQ ID NO: 200047 - DNA, 25 bp, Mus musculus
aggctctgctcaggatcccagccag

SEQ ID NO: 200048 - DNA, 25 bp, Mus musculus
aggctctggagaaagagtttgagag

SEQ ID NO: 200049 - DNA, 25 bp, Mus musculus
aggctctggagatggcaggttcagc

SEQ ID NO: 200050 - DNA, 25 bp, Mus musculus
aggctctggccaggttccgggagac

SEQ ID NO: 200051 - DNA, 25 bp, Mus musculus
aggctctgtctaggtatcttttgga

SEQ ID NO: 200052 - DNA, 25 bp, Mus musculus
aggctctgtgatcgtggccttcaaa

SEQ ID NO: 200053 - DNA, 25 bp, Mus musculus
aggctctgtggaggaagcaagggca

SEQ ID NO: 200054 - DNA, 25 bp, Mus musculus
aggctctgtgtgcgggagaaaccac

SEQ ID NO: 200055 - DNA, 25 bp, Mus musculus
aggctctgtgtgcggggatctgaag

SEQ ID NO: 200056 - DNA, 25 bp, Mus musculus
aggctctgttgctaacggacatggc

SEQ ID NO: 200057 - DNA, 25 bp, Mus musculus
aggctcttatcaggtatggggcaga

SEQ ID NO: 200058 - DNA, 25 bp, Mus musculus
aggctcttcaggtgctccaatgaga

SEQ ID NO: 200059 - DNA, 25 bp, Mus musculus
aggctcttgagccagcccataccca

SEQ ID NO: 200060 - DNA, 25 bp, Mus musculus
aggctcttgggtgacaattggtgcg

SEQ ID NO: 200061 - DNA, 25 bp, Mus musculus
aggctcttgtctggggcttcaatgg

SEQ ID NO: 200062 - DNA, 25 bp, Mus musculus
aggctgaaaaagagctgcatgagaa

SEQ ID NO: 200063 - DNA, 25 bp, Mus musculus
aggctgaaaaagcaatacgaggatt

SEQ ID NO: 200064 - DNA, 25 bp, Mus musculus
aggctgaaagtttggcttttcatgg

SEQ ID NO: 200065 - DNA, 25 bp, Mus musculus
aggctgaagagcagacttggaggta

SEQ ID NO: 200066 - DNA, 25 bp, Mus musculus
aggctgaagaggaagaagagctgga

SEQ ID NO: 200067 - DNA, 25 bp, Mus musculus
aggctgaagcgggatctgttctctc

SEQ ID NO: 200068 - DNA, 25 bp, Mus musculus
aggctgaagctcggaaacaagctcc

SEQ ID NO: 200069 - DNA, 25 bp, Mus musculus
aggctgaatcagctcaaatctaata

SEQ ID NO: 200070 - DNA, 25 bp, Mus musculus
aggctgaatgggagccatcgagaga

SEQ ID NO: 200071 - DNA, 25 bp, Mus musculus
aggctgacaaggaatttcggcagaa

SEQ ID NO: 200072 - DNA, 25 bp, Mus musculus
aggctgacaaggacacctgctttga

SEQ ID NO: 200073 - DNA, 25 bp, Mus musculus
aggctgacaaggcccttttagctac

SEQ ID NO: 200074 - DNA, 25 bp, Mus musculus
aggctgacaaggctacagcggagca

SEQ ID NO: 200075 - DNA, 25 bp, Mus musculus
aggctgacagacaagattgtaagga

SEQ ID NO: 200076 - DNA, 25 bp, Mus musculus
aggctgacaggtgagatctccagag

SEQ ID NO: 200077 - DNA, 25 bp, Mus musculus
aggctgacatgtgcctgagcggagc

SEQ ID NO: 200078 - DNA, 25 bp, Mus musculus
aggctgacatgtggagcattggcgt

SEQ ID NO: 200079 - DNA, 25 bp, Mus musculus
aggctgacattgattctgggctgag

SEQ ID NO: 200080 - DNA, 25 bp, Mus musculus
aggctgacgggtatcaccacagctg

SEQ ID NO: 200081 - DNA, 25 bp, Mus musculus
aggctgactgggtttaccagcccct

SEQ ID NO: 200082 - DNA, 25 bp, Mus musculus
aggctgagaaacagcacacagggcc

SEQ ID NO: 200083 - DNA, 25 bp, Mus musculus
aggctgagaacggaaacctccacat

SEQ ID NO: 200084 - DNA, 25 bp, Mus musculus
aggctgagaagtactctcagaagga

SEQ ID NO: 200085 - DNA, 25 bp, Mus musculus
aggctgagcagaagggccttcttga

SEQ ID NO: 200086 - DNA, 25 bp, Mus musculus
aggctgagcagcacgcctccggtct

SEQ ID NO: 200087 - DNA, 25 bp, Mus musculus
aggctgagcagcaggctgacgaggt

SEQ ID NO: 200088 - DNA, 25 bp, Mus musculus
aggctgagcagcaggtgaaccagct

SEQ ID NO: 200089 - DNA, 25 bp, Mus musculus
aggctgagccgagagaagagccctg

SEQ ID NO: 200090 - DNA, 25 bp, Mus musculus
aggctgaggagggaggagcaggcca

SEQ ID NO: 200091 - DNA, 25 bp, Mus musculus
aggctgaggattttccatctttaaa

SEQ ID NO: 200092 - DNA, 25 bp, Mus musculus
aggctgaggccaggtctcttaacct

SEQ ID NO: 200093 - DNA, 25 bp, Mus musculus
aggctgagggaccagacaaaaagtc

SEQ ID NO: 200094 - DNA, 25 bp, Mus musculus
aggctgatgaagccatcaaaggatt

SEQ ID NO: 200095 - DNA, 25 bp, Mus musculus
aggctgatgaaggacaaccctccat

SEQ ID NO: 200096 - DNA, 25 bp, Mus musculus
aggctgatgaaggagcttgaagaga

SEQ ID NO: 200097 - DNA, 25 bp, Mus musculus
aggctgatggaattgaacttttgag

SEQ ID NO: 200098 - DNA, 25 bp, Mus musculus
aggctgatggcagcctctccaggca

SEQ ID NO: 200099 - DNA, 25 bp, Mus musculus
aggctgattttcccgaatactcctc

SEQ ID NO: 200100 - DNA, 25 bp, Mus musculus
aggctgcaaaaacaaagctcctggg

SEQ ID NO: 200101 - DNA, 25 bp, Mus musculus
aggctgcaagaaaccttgtcactag

SEQ ID NO: 200102 - DNA, 25 bp, Mus musculus
aggctgcaatgaggtcaactccgtc

SEQ ID NO: 200103 - DNA, 25 bp, Mus musculus
aggctgcacctatatcctgaataaa

SEQ ID NO: 200104 - DNA, 25 bp, Mus musculus
aggctgcactcagaaccattgttgg

SEQ ID NO: 200105 - DNA, 25 bp, Mus musculus
aggctgcactcagctgccaactcca

SEQ ID NO: 200106 - DNA, 25 bp, Mus musculus
aggctgcagctgcccaggccaagca

SEQ ID NO: 200107 - DNA, 25 bp, Mus musculus
aggctgcaggatgatgcgattcatg

SEQ ID NO: 200108 - DNA, 25 bp, Mus musculus
aggctgcaggcctgtgggccgaagc

SEQ ID NO: 200109 - DNA, 25 bp, Mus musculus
aggctgccaaaacagatgaagaacc

SEQ ID NO: 200110 - DNA, 25 bp, Mus musculus
aggctgccaacagcctatcttcttc

SEQ ID NO: 200111 - DNA, 25 bp, Mus musculus
aggctgccaacaggaggttctgcag

SEQ ID NO: 200112 - DNA, 25 bp, Mus musculus
aggctgccaatcaacaatgtgccca

SEQ ID NO: 200113 - DNA, 25 bp, Mus musculus
aggctgccagattgtggctctgaac

SEQ ID NO: 200114 - DNA, 25 bp, Mus musculus
aggctgccccaggttgccactgatg

SEQ ID NO: 200115 - DNA, 25 bp, Mus musculus
aggctgcctcgaatcttaggtgccc

SEQ ID NO: 200116 - DNA, 25 bp, Mus musculus
aggctgcgaaggaagtactattact

SEQ ID NO: 200117 - DNA, 25 bp, Mus musculus
aggctgcgaccaggctttggcgttg

SEQ ID NO: 200118 - DNA, 25 bp, Mus musculus
aggctgcgatgggtggatgagaggg

SEQ ID NO: 200119 - DNA, 25 bp, Mus musculus
aggctgcgctgaggctccagccttc

SEQ ID NO: 200120 - DNA, 25 bp, Mus musculus
aggctgcggctggaggttttcccgc

SEQ ID NO: 200121 - DNA, 25 bp, Mus musculus
aggctgcggctggagtgcccacgat

SEQ ID NO: 200122 - DNA, 25 bp, Mus musculus
aggctgcgtgcagattaccttatgc

SEQ ID NO: 200123 - DNA, 25 bp, Mus musculus
aggctgctccagagcatctaaagaa

SEQ ID NO: 200124 - DNA, 25 bp, Mus musculus
aggctgctccagagctggagaagcg

SEQ ID NO: 200125 - DNA, 25 bp, Mus musculus
aggctgctcccagcgtttcccaaca

SEQ ID NO: 200126 - DNA, 25 bp, Mus musculus
aggctgctgcaggttgctgagaaat

SEQ ID NO: 200127 - DNA, 25 bp, Mus musculus
aggctgctgccaggaagaattcagt

SEQ ID NO: 200128 - DNA, 25 bp, Mus musculus
aggctgctgcgagtctgttgctgtg

SEQ ID NO: 200129 - DNA, 25 bp, Mus musculus
aggctgctggaggtctctcctggtg

SEQ ID NO: 200130 - DNA, 25 bp, Mus musculus
aggctgctggccagggtttaacgtt

SEQ ID NO: 200131 - DNA, 25 bp, Mus musculus
aggctgcttgctcatcccagcctgc

SEQ ID NO: 200132 - DNA, 25 bp, Mus musculus
aggctggaaaggagctggaggaaca

SEQ ID NO: 200133 - DNA, 25 bp, Mus musculus
aggctggaatgcagataacaattga

SEQ ID NO: 200134 - DNA, 25 bp, Mus musculus
aggctggaatgcagcttgaaggtct

SEQ ID NO: 200135 - DNA, 25 bp, Mus musculus
aggctggacagatctgctcatttta

SEQ ID NO: 200136 - DNA, 25 bp, Mus musculus
aggctggacagattcagataacaat

SEQ ID NO: 200137 - DNA, 25 bp, Mus musculus
aggctggagcggaagggtttgttcg

SEQ ID NO: 200138 - DNA, 25 bp, Mus musculus
aggctggagttggcgcgcaggctac

SEQ ID NO: 200139 - DNA, 25 bp, Mus musculus
aggctggatacagttaccagtaaga

SEQ ID NO: 200140 - DNA, 25 bp, Mus musculus
aggctggatgaccggttctaatcag

SEQ ID NO: 200141 - DNA, 25 bp, Mus musculus
aggctggatggcagccatagattgt

SEQ ID NO: 200142 - DNA, 25 bp, Mus musculus
aggctggcaaggtcaaacctgcgag

SEQ ID NO: 200143 - DNA, 25 bp, Mus musculus
aggctggcagagcctcattaacttc

SEQ ID NO: 200144 - DNA, 25 bp, Mus musculus
aggctggcaggaaccacacagagcc

SEQ ID NO: 200145 - DNA, 25 bp, Mus musculus
aggctggcaggaaggccatattgac

SEQ ID NO: 200146 - DNA, 25 bp, Mus musculus
aggctggcaggaaggccatcttgac

SEQ ID NO: 200147 - DNA, 25 bp, Mus musculus
aggctggcaggtgctcaccgagtct

SEQ ID NO: 200148 - DNA, 25 bp, Mus musculus
aggctggcatgaaatcctggggcag

SEQ ID NO: 200149 - DNA, 25 bp, Mus musculus
aggctggccagtgggttgatttctt

SEQ ID NO: 200150 - DNA, 25 bp, Mus musculus
aggctggccctctggtgtgccacag

SEQ ID NO: 200151 - DNA, 25 bp, Mus musculus
aggctggccgcaggctggcaacatg

SEQ ID NO: 200152 - DNA, 25 bp, Mus musculus
aggctggcgtagatcgactgtgccg

SEQ ID NO: 200153 - DNA, 25 bp, Mus musculus
aggctggctaccatgggagccccgc

SEQ ID NO: 200154 - DNA, 25 bp, Mus musculus
aggctggctcagaggtgtctgcctt

SEQ ID NO: 200155 - DNA, 25 bp, Mus musculus
aggctggctcagagttctcagtatg

SEQ ID NO: 200156 - DNA, 25 bp, Mus musculus
aggctggctgcctttgcggggcctt

SEQ ID NO: 200157 - DNA, 25 bp, Mus musculus
aggctggctgtcagctgctgactgt

SEQ ID NO: 200158 - DNA, 25 bp, Mus musculus
aggctgggaggagtgggaggtgctg

SEQ ID NO: 200159 - DNA, 25 bp, Mus musculus
aggctgggatccagaatccaactgt

SEQ ID NO: 200160 - DNA, 25 bp, Mus musculus
aggctgggcaaagaggtgcgtgagc

SEQ ID NO: 200161 - DNA, 25 bp, Mus musculus
aggctgggcacagattggtgttggt

SEQ ID NO: 200162 - DNA, 25 bp, Mus musculus
aggctgggcactcatgcatgctagt

SEQ ID NO: 200163 - DNA, 25 bp, Mus musculus
aggctggggaagaccttgcacttga

SEQ ID NO: 200164 - DNA, 25 bp, Mus musculus
aggctggggtgcagaatttctgaag

SEQ ID NO: 200165 - DNA, 25 bp, Mus musculus
aggctgggtcgctaccaccagtgct

SEQ ID NO: 200166 - DNA, 25 bp, Mus musculus
aggctgggtgcagtgacccttaccc

SEQ ID NO: 200167 - DNA, 25 bp, Mus musculus
aggctggtaaaggagagaatgaaga

SEQ ID NO: 200168 - DNA, 25 bp, Mus musculus
aggctggtcttcttctacatctccc

SEQ ID NO: 200169 - DNA, 25 bp, Mus musculus
aggctggtgatcaaggtgttcctgg

SEQ ID NO: 200170 - DNA, 25 bp, Mus musculus
aggctggtgcacgaccttctgcccc

SEQ ID NO: 200171 - DNA, 25 bp, Mus musculus
aggctggtgctatttatattttggt

SEQ ID NO: 200172 - DNA, 25 bp, Mus musculus
aggctggtggaggaacatggccacc

SEQ ID NO: 200173 - DNA, 25 bp, Mus musculus
aggctggtgtcaacattgtggagat

SEQ ID NO: 200174 - DNA, 25 bp, Mus musculus
aggctggtgtcggaggatataaaat

SEQ ID NO: 200175 - DNA, 25 bp, Mus musculus
aggctggttggatgggcacacgctg

SEQ ID NO: 200176 - DNA, 25 bp, Mus musculus
aggctgtaagctgtacttcttccag

SEQ ID NO: 200177 - DNA, 25 bp, Mus musculus
aggctgtactcaaggagaatctggg

SEQ ID NO: 200178 - DNA, 25 bp, Mus musculus
aggctgtatgggtctgacagaagtt

SEQ ID NO: 200179 - DNA, 25 bp, Mus musculus
aggctgtcaaaggggagaagctgct

SEQ ID NO: 200180 - DNA, 25 bp, Mus musculus
aggctgtcagaaaaagatgcaagaa

SEQ ID NO: 200181 - DNA, 25 bp, Mus musculus
aggctgtcagatttatgcaggactg

SEQ ID NO: 200182 - DNA, 25 bp, Mus musculus
aggctgtcagctcgttcgtgtctta

SEQ ID NO: 200183 - DNA, 25 bp, Mus musculus
aggctgtcaggcagaatgggcttat

SEQ ID NO: 200184 - DNA, 25 bp, Mus musculus
aggctgtcagtctagtctcctgaga

SEQ ID NO: 200185 - DNA, 25 bp, Mus musculus
aggctgtccaacaggtgcgccagga

SEQ ID NO: 200186 - DNA, 25 bp, Mus musculus
aggctgtcccgagttgaggccggcg

SEQ ID NO: 200187 - DNA, 25 bp, Mus musculus
aggctgtctcaggtggcccctgtgc

SEQ ID NO: 200188 - DNA, 25 bp, Mus musculus
aggctgtctctcagatgaccactct

SEQ ID NO: 200189 - DNA, 25 bp, Mus musculus
aggctgtgaaagctgtccagcagaa

SEQ ID NO: 200190 - DNA, 25 bp, Mus musculus
aggctgtgaatgaaataatagctac

SEQ ID NO: 200191 - DNA, 25 bp, Mus musculus
aggctgtgacccaccaacatgacct

SEQ ID NO: 200192 - DNA, 25 bp, Mus musculus
aggctgtgagaggcttcctccccag

SEQ ID NO: 200193 - DNA, 25 bp, Mus musculus
aggctgtgagagtgaagccgcccag

SEQ ID NO: 200194 - DNA, 25 bp, Mus musculus
aggctgtgagatatctgtttcaaat

SEQ ID NO: 200195 - DNA, 25 bp, Mus musculus
aggctgtgctgtgttggtccggacc

SEQ ID NO: 200196 - DNA, 25 bp, Mus musculus
aggctgtggggtccctggctcctgg

SEQ ID NO: 200197 - DNA, 25 bp, Mus musculus
aggctgtgtctgatgtcctggaatc

SEQ ID NO: 200198 - DNA, 25 bp, Mus musculus
aggctgttcagaaggctgtgggctc

SEQ ID NO: 200199 - DNA, 25 bp, Mus musculus
aggctgttcagagtcatgcagttgc

SEQ ID NO: 200200 - DNA, 25 bp, Mus musculus
aggctgttcaggtcctgctctccct

SEQ ID NO: 200201 - DNA, 25 bp, Mus musculus
aggctgtttatggatgaccaggaag

SEQ ID NO: 200202 - DNA, 25 bp, Mus musculus
aggcttaaagggtatgtccctgaac

SEQ ID NO: 200203 - DNA, 25 bp, Mus musculus
aggcttaacagagccatcgtgactt

SEQ ID NO: 200204 - DNA, 25 bp, Mus musculus
aggcttaatatgagaaaggaacata

SEQ ID NO: 200205 - DNA, 25 bp, Mus musculus
aggcttaatatgtgaaaggaacata

SEQ ID NO: 200206 - DNA, 25 bp, Mus musculus
aggcttaatgacaaattaaaagaga

SEQ ID NO: 200207 - DNA, 25 bp, Mus musculus
aggcttacagatttgtgaaagaaaa

SEQ ID NO: 200208 - DNA, 25 bp, Mus musculus
aggcttacaggcggcagaagcctac

SEQ ID NO: 200209 - DNA, 25 bp, Mus musculus
aggcttaccaagcccgttctcaaaa

SEQ ID NO: 200210 - DNA, 25 bp, Mus musculus
aggcttacccaggtttggcatagaa

SEQ ID NO: 200211 - DNA, 25 bp, Mus musculus
aggcttactcagactctaaggaggg

SEQ ID NO: 200212 - DNA, 25 bp, Mus musculus
aggcttatcggaagaaatggaagcc

SEQ ID NO: 200213 - DNA, 25 bp, Mus musculus
aggcttattccaggatggctaatcg

SEQ ID NO: 200214 - DNA, 25 bp, Mus musculus
aggcttattcttttggcctaagatc

SEQ ID NO: 200215 - DNA, 25 bp, Mus musculus
aggcttcaaaaatagctcggtcgag

SEQ ID NO: 200216 - DNA, 25 bp, Mus musculus
aggcttcaaagattacatgaaagaa

SEQ ID NO: 200217 - DNA, 25 bp, Mus musculus
aggcttcaaagttgcacctgcttag

SEQ ID NO: 200218 - DNA, 25 bp, Mus musculus
aggcttcaagcaagtaaaggccggc

SEQ ID NO: 200219 - DNA, 25 bp, Mus musculus
aggcttcaagccagaagcctgcctg

SEQ ID NO: 200220 - DNA, 25 bp, Mus musculus
aggcttcaccccaggagaaagaaag

SEQ ID NO: 200221 - DNA, 25 bp, Mus musculus
aggcttcaccccaggtgaacacctt

SEQ ID NO: 200222 - DNA, 25 bp, Mus musculus
aggcttcaccccaggtttgtatgga

SEQ ID NO: 200223 - DNA, 25 bp, Mus musculus
aggcttcaggaaatcaggacctttg

SEQ ID NO: 200224 - DNA, 25 bp, Mus musculus
aggcttccaaggctaaggtggcatc

SEQ ID NO: 200225 - DNA, 25 bp, Mus musculus
aggcttccaatccagagacctcttt

SEQ ID NO: 200226 - DNA, 25 bp, Mus musculus
aggcttccaatccagcctgaggtct

SEQ ID NO: 200227 - DNA, 25 bp, Mus musculus
aggcttccagatgggaaccagggtg

SEQ ID NO: 200228 - DNA, 25 bp, Mus musculus
aggcttccagatggtcggcagtggg

SEQ ID NO: 200229 - DNA, 25 bp, Mus musculus
aggcttccagctccagaaatcttga

SEQ ID NO: 200230 - DNA, 25 bp, Mus musculus
aggcttccaggtcagaagcctttta

SEQ ID NO: 200231 - DNA, 25 bp, Mus musculus
aggcttccgatcaattcgaagccga

SEQ ID NO: 200232 - DNA, 25 bp, Mus musculus
aggcttccgatcaggagagaaaaga

SEQ ID NO: 200233 - DNA, 25 bp, Mus musculus
aggcttcctgactttggcaccgaac

SEQ ID NO: 200234 - DNA, 25 bp, Mus musculus
aggcttcctggtagtcccatattat

SEQ ID NO: 200235 - DNA, 25 bp, Mus musculus
aggcttcctgtctttggcaccgaac

SEQ ID NO: 200236 - DNA, 25 bp, Mus musculus
aggcttcgagaacgaagaaagaaac

SEQ ID NO: 200237 - DNA, 25 bp, Mus musculus
aggcttcgagaacgtgactacgaga

SEQ ID NO: 200238 - DNA, 25 bp, Mus musculus
aggcttcgtggcgaagcagcaggat

SEQ ID NO: 200239 - DNA, 25 bp, Mus musculus
aggcttcgtggcgatcaagaagaag

SEQ ID NO: 200240 - DNA, 25 bp, Mus musculus
aggcttcgttccttgcgcgctgggg

SEQ ID NO: 200241 - DNA, 25 bp, Mus musculus
aggcttctagggacagaacaacagc

SEQ ID NO: 200242 - DNA, 25 bp, Mus musculus
aggcttctctgcaagagctgtgggc

SEQ ID NO: 200243 - DNA, 25 bp, Mus musculus
aggcttctgcacagacttggagcag

SEQ ID NO: 200244 - DNA, 25 bp, Mus musculus
aggcttctgccaaggacctccctgc

SEQ ID NO: 200245 - DNA, 25 bp, Mus musculus
aggcttctgccaaggcgcagcacct

SEQ ID NO: 200246 - DNA, 25 bp, Mus musculus
aggcttctgtcggacggggctgaaa

SEQ ID NO: 200247 - DNA, 25 bp, Mus musculus
aggcttctgtcggacttagaagaat

SEQ ID NO: 200248 - DNA, 25 bp, Mus musculus
aggcttgaaacagccgctgcaggag

SEQ ID NO: 200249 - DNA, 25 bp, Mus musculus
aggcttgaaacaggccggtagtggt

SEQ ID NO: 200250 - DNA, 25 bp, Mus musculus
aggcttgcctccggaggtgtatgca

SEQ ID NO: 200251 - DNA, 25 bp, Mus musculus
aggcttgctcaggtagctaaagcag

SEQ ID NO: 200252 - DNA, 25 bp, Mus musculus
aggcttgctgacaagcccttcaaat

SEQ ID NO: 200253 - DNA, 25 bp, Mus musculus
aggcttgcttgttggtgattgtatc

SEQ ID NO: 200254 - DNA, 25 bp, Mus musculus
aggcttggagaatctccccgaggtg

SEQ ID NO: 200255 - DNA, 25 bp, Mus musculus
aggcttggagcaagatgagatggac

SEQ ID NO: 200256 - DNA, 25 bp, Mus musculus
aggcttggcagagcaacttattttc

SEQ ID NO: 200257 - DNA, 25 bp, Mus musculus
aggcttggcaggatgacatgcacag

SEQ ID NO: 200258 - DNA, 25 bp, Mus musculus
aggcttggcagtttgcgtcctcggg

SEQ ID NO: 200259 - DNA, 25 bp, Mus musculus
aggcttgggaggaactgagtggtag

SEQ ID NO: 200260 - DNA, 25 bp, Mus musculus
aggcttgggagggtgacacttccca

SEQ ID NO: 200261 - DNA, 25 bp, Mus musculus
aggcttggggcaagatcgacatgct

SEQ ID NO: 200262 - DNA, 25 bp, Mus musculus
aggcttggggcaaggtggatacgac

SEQ ID NO: 200263 - DNA, 25 bp, Mus musculus
aggcttggtgtctggatgatgcatc

SEQ ID NO: 200264 - DNA, 25 bp, Mus musculus
aggcttggttgggaagtggattata

SEQ ID NO: 200265 - DNA, 25 bp, Mus musculus
aggcttgtccagggtatcttatttt

SEQ ID NO: 200266 - DNA, 25 bp, Mus musculus
aggcttgtgggcagaagctgacgtt

SEQ ID NO: 200267 - DNA, 25 bp, Mus musculus
aggctttaagctctggtgcaagtgt

SEQ ID NO: 200268 - DNA, 25 bp, Mus musculus
aggctttatatccttttagtgttgg

SEQ ID NO: 200269 - DNA, 25 bp, Mus musculus
aggctttcaagctaactgatgatgt

SEQ ID NO: 200270 - DNA, 25 bp, Mus musculus
aggctttccagccatggccatgcaa

SEQ ID NO: 200271 - DNA, 25 bp, Mus musculus
aggctttccagctccagcacctgcc

SEQ ID NO: 200272 - DNA, 25 bp, Mus musculus
aggctttccccaggccctccatgat

SEQ ID NO: 200273 - DNA, 25 bp, Mus musculus
aggctttcctttgggtattcccatc

SEQ ID NO: 200274 - DNA, 25 bp, Mus musculus
aggctttcgaggagaaaattctata

SEQ ID NO: 200275 - DNA, 25 bp, Mus musculus
aggctttctaatagcagcgtcccca

SEQ ID NO: 200276 - DNA, 25 bp, Mus musculus
aggctttgagtcgctgggtttaccc

SEQ ID NO: 200277 - DNA, 25 bp, Mus musculus
aggctttgcaaggaagccatcactc

SEQ ID NO: 200278 - DNA, 25 bp, Mus musculus
aggctttgcactcagcccccactgt

SEQ ID NO: 200279 - DNA, 25 bp, Mus musculus
aggctttgcactcagcgtacatgtt

SEQ ID NO: 200280 - DNA, 25 bp, Mus musculus
aggctttgccaatgctcagcagaga

SEQ ID NO: 200281 - DNA, 25 bp, Mus musculus
aggctttggaggaagtggccagatg

SEQ ID NO: 200282 - DNA, 25 bp, Mus musculus
aggctttggaggtagaggaggcttc

SEQ ID NO: 200283 - DNA, 25 bp, Mus musculus
aggctttggagtaggccagactcct

SEQ ID NO: 200284 - DNA, 25 bp, Mus musculus
aggctttgtgatatgatgagaaaac

SEQ ID NO: 200285 - DNA, 25 bp, Mus musculus
aggctttgtgtactgctctgctgct

SEQ ID NO: 200286 - DNA, 25 bp, Mus musculus
aggcttttgagagctgtctctcttt

SEQ ID NO: 200287 - DNA, 25 bp, Mus musculus
aggcttttggaagtgaagtttggtg

SEQ ID NO: 200288 - DNA, 25 bp, Mus musculus
aggcttttggccactcttggggatg

SEQ ID NO: 200289 - DNA, 25 bp, Mus musculus
aggctttttactatgcagtcacagt

SEQ ID NO: 200290 - DNA, 25 bp, Mus musculus
aggctttttcagcttgcttcccaga

SEQ ID NO: 200291 - DNA, 25 bp, Mus musculus
aggctttttcaggaggcagtgactt

SEQ ID NO: 200292 - DNA, 25 bp, Mus musculus
aggctttttcccaggcttggattta

SEQ ID NO: 200293 - DNA, 25 bp, Mus musculus
aggctttttgtggagccccgcaatc

SEQ ID NO: 200294 - DNA, 25 bp, Mus musculus
agggaaaaaggtgatgtctatcctg

SEQ ID NO: 200295 - DNA, 25 bp, Mus musculus
agggaaaaatgaaggattcagaaac

SEQ ID NO: 200296 - DNA, 25 bp, Mus musculus
agggaaaaatgccagatctctatgg

SEQ ID NO: 200297 - DNA, 25 bp, Mus musculus
agggaaaactgtccggccaggtatc

SEQ ID NO: 200298 - DNA, 25 bp, Mus musculus
agggaaaagagctggattctaatcc

SEQ ID NO: 200299 - DNA, 25 bp, Mus musculus
agggaaaatatctttgtatcttaaa

SEQ ID NO: 200300 - DNA, 25 bp, Mus musculus
agggaaacacagaaatatgccgagc

SEQ ID NO: 200301 - DNA, 25 bp, Mus musculus
agggaaaccataacgtcaaactccg

SEQ ID NO: 200302 - DNA, 25 bp, Mus musculus
agggaaactgggatctgttggcagc

SEQ ID NO: 200303 - DNA, 25 bp, Mus musculus
agggaaagaaagccgctctgcacag

SEQ ID NO: 200304 - DNA, 25 bp, Mus musculus
agggaaagaaagtcacagacaagtt

SEQ ID NO: 200305 - DNA, 25 bp, Mus musculus
agggaaagaccagacatcatcccac

SEQ ID NO: 200306 - DNA, 25 bp, Mus musculus
agggaaagaccaggacctcaccatc

SEQ ID NO: 200307 - DNA, 25 bp, Mus musculus
agggaaagagacagcacggcggctg

SEQ ID NO: 200308 - DNA, 25 bp, Mus musculus
agggaaagagataacagcagacagg

SEQ ID NO: 200309 - DNA, 25 bp, Mus musculus
agggaaagcagctgcagaggcattg

SEQ ID NO: 200310 - DNA, 25 bp, Mus musculus
agggaaagcagctggtcaaccctcc

SEQ ID NO: 200311 - DNA, 25 bp, Mus musculus
agggaaagccaagatgccagaccag

SEQ ID NO: 200312 - DNA, 25 bp, Mus musculus
agggaaaggacacgagttgcctagc

SEQ ID NO: 200313 - DNA, 25 bp, Mus musculus
agggaaataattgttgcttgtgccg

SEQ ID NO: 200314 - DNA, 25 bp, Mus musculus
agggaaatacagttattcatggtgg

SEQ ID NO: 200315 - DNA, 25 bp, Mus musculus
agggaaatcaaggaacttaatgagt

SEQ ID NO: 200316 - DNA, 25 bp, Mus musculus
agggaaatcaaggactcgctggccg

SEQ ID NO: 200317 - DNA, 25 bp, Mus musculus
agggaaatctggaactttgttgcct

SEQ ID NO: 200318 - DNA, 25 bp, Mus musculus
agggaaatggaaacacttgcagaag

SEQ ID NO: 200319 - DNA, 25 bp, Mus musculus
agggaaatggaaagtccctgacagg

SEQ ID NO: 200320 - DNA, 25 bp, Mus musculus
agggaacaagcccaggactgtggcg

SEQ ID NO: 200321 - DNA, 25 bp, Mus musculus
agggaacaaggccaggactgtggcg

SEQ ID NO: 200322 - DNA, 25 bp, Mus musculus
agggaacaaggtcagtgacatcaaa

SEQ ID NO: 200323 - DNA, 25 bp, Mus musculus
agggaacacagagcagctgcaggaa

SEQ ID NO: 200324 - DNA, 25 bp, Mus musculus
agggaacacagagttcttcttgctt

SEQ ID NO: 200325 - DNA, 25 bp, Mus musculus
agggaacacgaggttccgagtccga

SEQ ID NO: 200326 - DNA, 25 bp, Mus musculus
agggaacacttgggggagaagcgag

SEQ ID NO: 200327 - DNA, 25 bp, Mus musculus
agggaacagacactctccccgacca

SEQ ID NO: 200328 - DNA, 25 bp, Mus musculus
agggaacagccaggaggatgttgga

SEQ ID NO: 200329 - DNA, 25 bp, Mus musculus
agggaaccaggatgagattctggtg

SEQ ID NO: 200330 - DNA, 25 bp, Mus musculus
agggaacccaaccatatgagagtct

SEQ ID NO: 200331 - DNA, 25 bp, Mus musculus
agggaacccaagcaccccttgggag

SEQ ID NO: 200332 - DNA, 25 bp, Mus musculus
agggaacccaaggcctggcagaacc

SEQ ID NO: 200333 - DNA, 25 bp, Mus musculus
agggaacgccaattctaacggcaag

SEQ ID NO: 200334 - DNA, 25 bp, Mus musculus
agggaacgcctcgggggtgtctgac

SEQ ID NO: 200335 - DNA, 25 bp, Mus musculus
agggaacggcaggccgatctgtccc

SEQ ID NO: 200336 - DNA, 25 bp, Mus musculus
agggaacgggagagtggccttgtga

SEQ ID NO: 200337 - DNA, 25 bp, Mus musculus
agggaacgtggaggcccctttgtgt

SEQ ID NO: 200338 - DNA, 25 bp, Mus musculus
agggaactcaacaaggagatggctt

SEQ ID NO: 200339 - DNA, 25 bp, Mus musculus
agggaagaaagtgtctggactctcc

SEQ ID NO: 200340 - DNA, 25 bp, Mus musculus
agggaagaacaaaaggctgacgaat

SEQ ID NO: 200341 - DNA, 25 bp, Mus musculus
agggaagaagaagcccagggtgctg

SEQ ID NO: 200342 - DNA, 25 bp, Mus musculus
agggaagaataggtatcgtgtccag

SEQ ID NO: 200343 - DNA, 25 bp, Mus musculus
agggaagacaaggtgatgatgagca

SEQ ID NO: 200344 - DNA, 25 bp, Mus musculus
agggaagagaaactgctcaggagga

SEQ ID NO: 200345 - DNA, 25 bp, Mus musculus
agggaagagaataggagaaagcatc

SEQ ID NO: 200346 - DNA, 25 bp, Mus musculus
agggaagagatggctacatgggaat

SEQ ID NO: 200347 - DNA, 25 bp, Mus musculus
agggaagagatgggtattgctttca

SEQ ID NO: 200348 - DNA, 25 bp, Mus musculus
agggaagattacaaagtgcgggtcg

SEQ ID NO: 200349 - DNA, 25 bp, Mus musculus
agggaagattcggatccctaccgtg

SEQ ID NO: 200350 - DNA, 25 bp, Mus musculus
agggaagcacttcaccagtaaaaag

SEQ ID NO: 200351 - DNA, 25 bp, Mus musculus
agggaagccagggtctttgtgaaca

SEQ ID NO: 200352 - DNA, 25 bp, Mus musculus
agggaagccttggagaaaacagaga

SEQ ID NO: 200353 - DNA, 25 bp, Mus musculus
agggaagctcctggcggatgccatg

SEQ ID NO: 200354 - DNA, 25 bp, Mus musculus
agggaagctgaggaggtcataactt

SEQ ID NO: 200355 - DNA, 25 bp, Mus musculus
agggaaggaaggcacagctgatgaa

SEQ ID NO: 200356 - DNA, 25 bp, Mus musculus
agggaaggagcagcaagctggggct

SEQ ID NO: 200357 - DNA, 25 bp, Mus musculus
agggaaggagcaggcctggcagaac

SEQ ID NO: 200358 - DNA, 25 bp, Mus musculus
agggaaggcttgccactttcctaaa

SEQ ID NO: 200359 - DNA, 25 bp, Mus musculus
agggaaggtaaagatacacctatgg

SEQ ID NO: 200360 - DNA, 25 bp, Mus musculus
agggaagtaggctgaaccttcggga

SEQ ID NO: 200361 - DNA, 25 bp, Mus musculus
agggaagtccttacagcaaattgct

SEQ ID NO: 200362 - DNA, 25 bp, Mus musculus
agggaagtccttacagttttaagtg

SEQ ID NO: 200363 - DNA, 25 bp, Mus musculus
agggaagtctcaggtgtcggtgacg

SEQ ID NO: 200364 - DNA, 25 bp, Mus musculus
agggaagtctggaagaccaccagac

SEQ ID NO: 200365 - DNA, 25 bp, Mus musculus
agggaagttaggcacaatcacttcc

SEQ ID NO: 200366 - DNA, 25 bp, Mus musculus
agggaagtttgagaaatcagggatg

SEQ ID NO: 200367 - DNA, 25 bp, Mus musculus
agggaataagcagcctcaaaatgca

SEQ ID NO: 200368 - DNA, 25 bp, Mus musculus
agggaatatatgtatatactgcccc

SEQ ID NO: 200369 - DNA, 25 bp, Mus musculus
agggaatccagagatcattgatagt

SEQ ID NO: 200370 - DNA, 25 bp, Mus musculus
agggaatccagatcaaggttccagg

SEQ ID NO: 200371 - DNA, 25 bp, Mus musculus
agggaatccagatgactgcagtcaa

SEQ ID NO: 200372 - DNA, 25 bp, Mus musculus
agggaatcctggcctcccagtaaag

SEQ ID NO: 200373 - DNA, 25 bp, Mus musculus
agggaatcctggggacacttaacaa

SEQ ID NO: 200374 - DNA, 25 bp, Mus musculus
agggaatgaaaggtgatgaagtctc

SEQ ID NO: 200375 - DNA, 25 bp, Mus musculus
agggaatggactatttgcatgcaaa

SEQ ID NO: 200376 - DNA, 25 bp, Mus musculus
agggaatgggctacataccatctgc

SEQ ID NO: 200377 - DNA, 25 bp, Mus musculus
agggaatgggctacatcccgtatgt

SEQ ID NO: 200378 - DNA, 25 bp, Mus musculus
agggaatgtcagagatgggcgtgtc

SEQ ID NO: 200379 - DNA, 25 bp, Mus musculus
agggaatgtcagttcactcaccgct

SEQ ID NO: 200380 - DNA, 25 bp, Mus musculus
agggaatgtgagatacctttatcaa

SEQ ID NO: 200381 - DNA, 25 bp, Mus musculus
agggaattgctcaggaggctttaga

SEQ ID NO: 200382 - DNA, 25 bp, Mus musculus
agggaattgctcaggcgagagcagg

SEQ ID NO: 200383 - DNA, 25 bp, Mus musculus
agggacaaagctgcaggcatcgttc

SEQ ID NO: 200384 - DNA, 25 bp, Mus musculus
agggacaaccaggcaaccgagggct

SEQ ID NO: 200385 - DNA, 25 bp, Mus musculus
agggacaactgcttcggcccacaac

SEQ ID NO: 200386 - DNA, 25 bp, Mus musculus
agggacaatttaagaccctgctcac

SEQ ID NO: 200387 - DNA, 25 bp, Mus musculus
agggacaatttaagccacaagatcc

SEQ ID NO: 200388 - DNA, 25 bp, Mus musculus
agggacacatgcagaaaagtaaaga

SEQ ID NO: 200389 - DNA, 25 bp, Mus musculus
agggacacatgcagctggtgaatga

SEQ ID NO: 200390 - DNA, 25 bp, Mus musculus
agggacacatgcaggcgcatacctc

SEQ ID NO: 200391 - DNA, 25 bp, Mus musculus
agggacaccgagcggagggcaagag

SEQ ID NO: 200392 - DNA, 25 bp, Mus musculus
agggacacgagggctccttcttcta

SEQ ID NO: 200393 - DNA, 25 bp, Mus musculus
agggacacggagcagcccaccttgg

SEQ ID NO: 200394 - DNA, 25 bp, Mus musculus
agggacactttacagggagactccg

SEQ ID NO: 200395 - DNA, 25 bp, Mus musculus
agggacagcctggatacaggttcac

SEQ ID NO: 200396 - DNA, 25 bp, Mus musculus
agggacagctggttccgtggcttca

SEQ ID NO: 200397 - DNA, 25 bp, Mus musculus
agggacaggaggtcagtggagctct

SEQ ID NO: 200398 - DNA, 25 bp, Mus musculus
agggacaggccttgccagagccatg

SEQ ID NO: 200399 - DNA, 25 bp, Mus musculus
agggacagggtcagctggtcacttg

SEQ ID NO: 200400 - DNA, 25 bp, Mus musculus
agggacagtgtttggattctccagt

SEQ ID NO: 200401 - DNA, 25 bp, Mus musculus
agggacagtgtttgggcggttcgac

SEQ ID NO: 200402 - DNA, 25 bp, Mus musculus
agggacagttgaagggccttcagtg

SEQ ID NO: 200403 - DNA, 25 bp, Mus musculus
agggacatcagttccagacacgagg

SEQ ID NO: 200404 - DNA, 25 bp, Mus musculus
agggacatcgtcgggagcattactg

SEQ ID NO: 200405 - DNA, 25 bp, Mus musculus
agggacatcgtcggggccagtgact

SEQ ID NO: 200406 - DNA, 25 bp, Mus musculus
agggacatgaaggtagcatcgcctg

SEQ ID NO: 200407 - DNA, 25 bp, Mus musculus
agggacattccttatcataacagaa

SEQ ID NO: 200408 - DNA, 25 bp, Mus musculus
agggacattgcacgtggtggtaatc

SEQ ID NO: 200409 - DNA, 25 bp, Mus musculus
agggaccaagcattcacagctctga

SEQ ID NO: 200410 - DNA, 25 bp, Mus musculus
agggaccaaggaagctcgaagcggt

SEQ ID NO: 200411 - DNA, 25 bp, Mus musculus
agggaccactgagaggcctacgtga

SEQ ID NO: 200412 - DNA, 25 bp, Mus musculus
agggaccactgagcctgagcagatg

SEQ ID NO: 200413 - DNA, 25 bp, Mus musculus
agggaccatggagaccatagtctgt

SEQ ID NO: 200414 - DNA, 25 bp, Mus musculus
agggaccatggaggtgtgtgtacat

SEQ ID NO: 200415 - DNA, 25 bp, Mus musculus
agggacccagaagatgatttttgat

SEQ ID NO: 200416 - DNA, 25 bp, Mus musculus
agggacccaggcattttcccgactc

SEQ ID NO: 200417 - DNA, 25 bp, Mus musculus
agggaccccactgaggcttctcaaa

SEQ ID NO: 200418 - DNA, 25 bp, Mus musculus
agggaccccactgcactgctgttaa

SEQ ID NO: 200419 - DNA, 25 bp, Mus musculus
agggaccgatgaatccttcacacct

SEQ ID NO: 200420 - DNA, 25 bp, Mus musculus
agggaccgttggtggcatagctcta

SEQ ID NO: 200421 - DNA, 25 bp, Mus musculus
agggacctcaaggaccttggtgtga

SEQ ID NO: 200422 - DNA, 25 bp, Mus musculus
agggacctgaagcctgagaatttgc

SEQ ID NO: 200423 - DNA, 25 bp, Mus musculus
agggacctgagggtacagtcctcag

SEQ ID NO: 200424 - DNA, 25 bp, Mus musculus
agggacctgcctcgggtgagcccta

SEQ ID NO: 200425 - DNA, 25 bp, Mus musculus
agggacgaaaggagtctgagggtgg

SEQ ID NO: 200426 - DNA, 25 bp, Mus musculus
agggacgcgcggtgagccccaggtg

SEQ ID NO: 200427 - DNA, 25 bp, Mus musculus
agggacgctgtgctttcatggatcg

SEQ ID NO: 200428 - DNA, 25 bp, Mus musculus
agggacgctgttaagagttcacatg

SEQ ID NO: 200429 - DNA, 25 bp, Mus musculus
agggacggcagcccttggagttcca

SEQ ID NO: 200430 - DNA, 25 bp, Mus musculus
agggacggcaggtttttctcactgg

SEQ ID NO: 200431 - DNA, 25 bp, Mus musculus
agggactaagcccacaggagttttc

SEQ ID NO: 200432 - DNA, 25 bp, Mus musculus
agggactacagtggacaaggcgttg

SEQ ID NO: 200433 - DNA, 25 bp, Mus musculus
agggactacatattctgtcccctct

SEQ ID NO: 200434 - DNA, 25 bp, Mus musculus
agggactacatgacattaagaacgc

SEQ ID NO: 200435 - DNA, 25 bp, Mus musculus
agggactcaacgctgcagccccagg

SEQ ID NO: 200436 - DNA, 25 bp, Mus musculus
agggactcccagaagatagtcacat

SEQ ID NO: 200437 - DNA, 25 bp, Mus musculus
agggactccttgtgggaccgacgtc

SEQ ID NO: 200438 - DNA, 25 bp, Mus musculus
agggactcggagaatcatcattcaa

SEQ ID NO: 200439 - DNA, 25 bp, Mus musculus
agggactcttcaagccacttagcca

SEQ ID NO: 200440 - DNA, 25 bp, Mus musculus
agggactcttcaaggtgctggagga

SEQ ID NO: 200441 - DNA, 25 bp, Mus musculus
agggactgcaggtgtgagagtgtca

SEQ ID NO: 200442 - DNA, 25 bp, Mus musculus
agggactgctaggaagggacaaagg

SEQ ID NO: 200443 - DNA, 25 bp, Mus musculus
agggactgctaggcaaagaacgttc

SEQ ID NO: 200444 - DNA, 25 bp, Mus musculus
agggactgggaagatggatgacatt

SEQ ID NO: 200445 - DNA, 25 bp, Mus musculus
agggactgggaagccagctagacat

SEQ ID NO: 200446 - DNA, 25 bp, Mus musculus
agggactgggctgcaggtcctggtg

SEQ ID NO: 200447 - DNA, 25 bp, Mus musculus
agggactgtgagtgaccatgaaaga

SEQ ID NO: 200448 - DNA, 25 bp, Mus musculus
agggactgtgggctgggattcttca

SEQ ID NO: 200449 - DNA, 25 bp, Mus musculus
agggacttacaaagagctttctgaa

SEQ ID NO: 200450 - DNA, 25 bp, Mus musculus
agggacttcaggccttctcccaact

SEQ ID NO: 200451 - DNA, 25 bp, Mus musculus
agggacttgtcaggtttctaaacag

SEQ ID NO: 200452 - DNA, 25 bp, Mus musculus
agggactttgagtctaacaaatgct

SEQ ID NO: 200453 - DNA, 25 bp, Mus musculus
agggagaaaagaacttcgcggctca

SEQ ID NO: 200454 - DNA, 25 bp, Mus musculus
agggagaaaagggtgcgcctggacc

SEQ ID NO: 200455 - DNA, 25 bp, Mus musculus
agggagaaagagcctggcccaacta

SEQ ID NO: 200456 - DNA, 25 bp, Mus musculus
agggagaaatgggccagcaatgccc

SEQ ID NO: 200457 - DNA, 25 bp, Mus musculus
agggagaaatttgagagtccaattg

SEQ ID NO: 200458 - DNA, 25 bp, Mus musculus
agggagaagagaaggaagatccctg

SEQ ID NO: 200459 - DNA, 25 bp, Mus musculus
agggagaagagaagggactcggcca

SEQ ID NO: 200460 - DNA, 25 bp, Mus musculus
agggagaagcacctgggagagcccc

SEQ ID NO: 200461 - DNA, 25 bp, Mus musculus
agggagaatacagggattacagcaa

SEQ ID NO: 200462 - DNA, 25 bp, Mus musculus
agggagaatacagggtctgttcact

SEQ ID NO: 200463 - DNA, 25 bp, Mus musculus
agggagaatcggggtgcaccttcgt

SEQ ID NO: 200464 - DNA, 25 bp, Mus musculus
agggagaatcgggttggaggggtgc

SEQ ID NO: 200465 - DNA, 25 bp, Mus musculus
agggagaatgtttttcttacttatc

SEQ ID NO: 200466 - DNA, 25 bp, Mus musculus
agggagacaaggcggactatttcag

SEQ ID NO: 200467 - DNA, 25 bp, Mus musculus
agggagacagaagcaggtggcagga

SEQ ID NO: 200468 - DNA, 25 bp, Mus musculus
agggagacagaaggaggtggtggag

SEQ ID NO: 200469 - DNA, 25 bp, Mus musculus
agggagacagagcaggtggcagagc

SEQ ID NO: 200470 - DNA, 25 bp, Mus musculus
agggagacagaggcattcaaggttc

SEQ ID NO: 200471 - DNA, 25 bp, Mus musculus
agggagacagaggcgatgttggcga

SEQ ID NO: 200472 - DNA, 25 bp, Mus musculus
agggagacaggatccttccttgttg

SEQ ID NO: 200473 - DNA, 25 bp, Mus musculus
agggagaccaaggtgacaggaccct

SEQ ID NO: 200474 - DNA, 25 bp, Mus musculus
agggagaccctggtctccctggtcc

SEQ ID NO: 200475 - DNA, 25 bp, Mus musculus
agggagacgcacaggcatatctgct

SEQ ID NO: 200476 - DNA, 25 bp, Mus musculus
agggagagaagggaggtgtgaactg

SEQ ID NO: 200477 - DNA, 25 bp, Mus musculus
agggagagaaggtgtcttaccactg

SEQ ID NO: 200478 - DNA, 25 bp, Mus musculus
agggagagacgcaggtcatacctca

SEQ ID NO: 200479 - DNA, 25 bp, Mus musculus
agggagagacgggtatcccaggagc

SEQ ID NO: 200480 - DNA, 25 bp, Mus musculus
agggagagactggacctgctgggcc

SEQ ID NO: 200481 - DNA, 25 bp, Mus musculus
agggagaggagccgccgccatgtcc

SEQ ID NO: 200482 - DNA, 25 bp, Mus musculus
agggagaggagccgcctgtccacgg

SEQ ID NO: 200483 - DNA, 25 bp, Mus musculus
agggagaggagggtctggtcagcta

SEQ ID NO: 200484 - DNA, 25 bp, Mus musculus
agggagaggtgacacgtttcatcac

SEQ ID NO: 200485 - DNA, 25 bp, Mus musculus
agggagagtaactagctttgcatca

SEQ ID NO: 200486 - DNA, 25 bp, Mus musculus
agggagatcggctttgaattcatga

SEQ ID NO: 200487 - DNA, 25 bp, Mus musculus
agggagatgaagatggagttttccc

SEQ ID NO: 200488 - DNA, 25 bp, Mus musculus
agggagatgcacaaggccacagatg

SEQ ID NO: 200489 - DNA, 25 bp, Mus musculus
agggagatgcacaagttcatattct

SEQ ID NO: 200490 - DNA, 25 bp, Mus musculus
agggagcacagaacctttgacatgg

SEQ ID NO: 200491 - DNA, 25 bp, Mus musculus
agggagcacagctcatcctgtgctg

SEQ ID NO: 200492 - DNA, 25 bp, Mus musculus
agggagcaggaacagggtcaagtcc

SEQ ID NO: 200493 - DNA, 25 bp, Mus musculus
agggagcaggaacagggtttaatgt

SEQ ID NO: 200494 - DNA, 25 bp, Mus musculus
agggagcaggaacctgtcacaggca

SEQ ID NO: 200495 - DNA, 25 bp, Mus musculus
agggagcaggtaagcagctgctccc

SEQ ID NO: 200496 - DNA, 25 bp, Mus musculus
agggagcatgagcaggctactgccc

SEQ ID NO: 200497 - DNA, 25 bp, Mus musculus
agggagcatgtgtggctgacctgat

SEQ ID NO: 200498 - DNA, 25 bp, Mus musculus
agggagccagcctggaggccggtcc

SEQ ID NO: 200499 - DNA, 25 bp, Mus musculus
agggagccagcttggtctgacagaa

SEQ ID NO: 200500 - DNA, 25 bp, Mus musculus
agggagcccagaaccaaggcaagaa

SEQ ID NO: 200501 - DNA, 25 bp, Mus musculus
agggagccgcagggtagaggcagtc

SEQ ID NO: 200502 - DNA, 25 bp, Mus musculus
agggagccggctgatctggaccccg

SEQ ID NO: 200503 - DNA, 25 bp, Mus musculus
agggagccggctgatgccaagacgg

SEQ ID NO: 200504 - DNA, 25 bp, Mus musculus
agggagccgtgcaggcagcggctgc

SEQ ID NO: 200505 - DNA, 25 bp, Mus musculus
agggagccgtgcagggttcactatc

SEQ ID NO: 200506 - DNA, 25 bp, Mus musculus
agggagcgagagtgtgaacatggct

SEQ ID NO: 200507 - DNA, 25 bp, Mus musculus
agggagcgcacctgaggggaagatt

SEQ ID NO: 200508 - DNA, 25 bp, Mus musculus
agggagcgcacctggtgattttacc

SEQ ID NO: 200509 - DNA, 25 bp, Mus musculus
agggagcgcagcaaggtgtatgatg

SEQ ID NO: 200510 - DNA, 25 bp, Mus musculus
agggagcgctgatcatggctccttg

SEQ ID NO: 200511 - DNA, 25 bp, Mus musculus
agggagctacggctgggttacccag

SEQ ID NO: 200512 - DNA, 25 bp, Mus musculus
agggagctagatgaggttgatatgt

SEQ ID NO: 200513 - DNA, 25 bp, Mus musculus
agggagctagcaaaatcggaaatgt

SEQ ID NO: 200514 - DNA, 25 bp, Mus musculus
agggagctaggaggccacgcagtgc

SEQ ID NO: 200515 - DNA, 25 bp, Mus musculus
agggagctagtgaaactgacgtcta

SEQ ID NO: 200516 - DNA, 25 bp, Mus musculus
agggagctagtggcccacgcttgtg

SEQ ID NO: 200517 - DNA, 25 bp, Mus musculus
agggagctagtggtttaggtaatag

SEQ ID NO: 200518 - DNA, 25 bp, Mus musculus
agggagctctggatgctgaatgctc

SEQ ID NO: 200519 - DNA, 25 bp, Mus musculus
agggagctctgggaattaacaagct

SEQ ID NO: 200520 - DNA, 25 bp, Mus musculus
agggagctgctagccattctctgag

SEQ ID NO: 200521 - DNA, 25 bp, Mus musculus
agggagctgctagcccttctctgag

SEQ ID NO: 200522 - DNA, 25 bp, Mus musculus
agggaggaagcacctctgggagcct

SEQ ID NO: 200523 - DNA, 25 bp, Mus musculus
agggaggaccagcatttaagaagac

SEQ ID NO: 200524 - DNA, 25 bp, Mus musculus
agggaggaccaggagggcactcctt

SEQ ID NO: 200525 - DNA, 25 bp, Mus musculus
agggaggaggaacgctatcaagcag

SEQ ID NO: 200526 - DNA, 25 bp, Mus musculus
agggaggagtgtgtgctgtcagaag

SEQ ID NO: 200527 - DNA, 25 bp, Mus musculus
agggaggatggctgatcatatgatg

SEQ ID NO: 200528 - DNA, 25 bp, Mus musculus
agggaggatgggaaaacctggagag

SEQ ID NO: 200529 - DNA, 25 bp, Mus musculus
agggaggcagtttgcagggacatgg

SEQ ID NO: 200530 - DNA, 25 bp, Mus musculus
agggagggaccagtgacacaggaac

SEQ ID NO: 200531 - DNA, 25 bp, Mus musculus
agggagggagtgctacctgggaaga

SEQ ID NO: 200532 - DNA, 25 bp, Mus musculus
agggaggggatatggcatccagcca

SEQ ID NO: 200533 - DNA, 25 bp, Mus musculus
agggagggggcaaggctctgctccc

SEQ ID NO: 200534 - DNA, 25 bp, Mus musculus
agggagggtccgggttgtggatcat

SEQ ID NO: 200535 - DNA, 25 bp, Mus musculus
agggaggtgaggaggaagaagtgct

SEQ ID NO: 200536 - DNA, 25 bp, Mus musculus
agggaggttccagatcacacaagag

SEQ ID NO: 200537 - DNA, 25 bp, Mus musculus
agggaggttccaggtgtgtgtgacg

SEQ ID NO: 200538 - DNA, 25 bp, Mus musculus
agggagtaaaggaaacagacagctg

SEQ ID NO: 200539 - DNA, 25 bp, Mus musculus
agggagtaaaggcagtctaaagtca

SEQ ID NO: 200540 - DNA, 25 bp, Mus musculus
agggagtaaagggacatctctacac

SEQ ID NO: 200541 - DNA, 25 bp, Mus musculus
agggagtaatgcctggcacttctgt

SEQ ID NO: 200542 - DNA, 25 bp, Mus musculus
agggagtagaggaacattgaccatg

SEQ ID NO: 200543 - DNA, 25 bp, Mus musculus
agggagtcaaagggctaacagaaca

SEQ ID NO: 200544 - DNA, 25 bp, Mus musculus
agggagtcgcgaggaggaaagcgat

SEQ ID NO: 200545 - DNA, 25 bp, Mus musculus
agggagtgacatatgcccccaaggt

SEQ ID NO: 200546 - DNA, 25 bp, Mus musculus
agggagtgacgtttgagtacagtga

SEQ ID NO: 200547 - DNA, 25 bp, Mus musculus
agggagtgctacctgggaagatcct

SEQ ID NO: 200548 - DNA, 25 bp, Mus musculus
agggagtgggagattactacaaggg

SEQ ID NO: 200549 - DNA, 25 bp, Mus musculus
agggagtgggaggtagtgtcggtgg

SEQ ID NO: 200550 - DNA, 25 bp, Mus musculus
agggagtggtgggttcgagtgacgg

SEQ ID NO: 200551 - DNA, 25 bp, Mus musculus
agggagtgtgacagtgattggaagt

SEQ ID NO: 200552 - DNA, 25 bp, Mus musculus
agggagtgtggtcttctcagttact

SEQ ID NO: 200553 - DNA, 25 bp, Mus musculus
agggataagattgagaacctagcta

SEQ ID NO: 200554 - DNA, 25 bp, Mus musculus
agggataataaagaagaagtaccag

SEQ ID NO: 200555 - DNA, 25 bp, Mus musculus
agggataataaagatatccaattgt

SEQ ID NO: 200556 - DNA, 25 bp, Mus musculus
agggataatccacagctacacactt

SEQ ID NO: 200557 - DNA, 25 bp, Mus musculus
agggatacagatgtatgagtctgat

SEQ ID NO: 200558 - DNA, 25 bp, Mus musculus
agggatacaggatggtgttgctgac

SEQ ID NO: 200559 - DNA, 25 bp, Mus musculus
agggatacccggcgtaatctcaaaa

SEQ ID NO: 200560 - DNA, 25 bp, Mus musculus
agggataggcagaagggaactgagc

SEQ ID NO: 200561 - DNA, 25 bp, Mus musculus
agggatatcaagtttgcttgtcgga

SEQ ID NO: 200562 - DNA, 25 bp, Mus musculus
agggatcaaagcctcggacgtatgt

SEQ ID NO: 200563 - DNA, 25 bp, Mus musculus
agggatcaaagcctgggacgtatgt

SEQ ID NO: 200564 - DNA, 25 bp, Mus musculus
agggatcagtgggcgagcttcacaa

SEQ ID NO: 200565 - DNA, 25 bp, Mus musculus
agggatcagtggtaccgggctttca

SEQ ID NO: 200566 - DNA, 25 bp, Mus musculus
agggatcatcaggaggtgcttacat

SEQ ID NO: 200567 - DNA, 25 bp, Mus musculus
agggatccaaaatcaggtcacagac

SEQ ID NO: 200568 - DNA, 25 bp, Mus musculus
agggatccaaagaggagatcttttt

SEQ ID NO: 200569 - DNA, 25 bp, Mus musculus
agggatccacgaggacccgcctcgc

SEQ ID NO: 200570 - DNA, 25 bp, Mus musculus
agggatccatctcagggttctggct

SEQ ID NO: 200571 - DNA, 25 bp, Mus musculus
agggatcccaggtcttcctggccgg

SEQ ID NO: 200572 - DNA, 25 bp, Mus musculus
agggatccggtcgagatgaccggtt

SEQ ID NO: 200573 - DNA, 25 bp, Mus musculus
agggatccttggatggtggcaccat

SEQ ID NO: 200574 - DNA, 25 bp, Mus musculus
agggatcggcattgcctgcaggtgt

SEQ ID NO: 200575 - DNA, 25 bp, Mus musculus
agggatctccaagacctcactatct

SEQ ID NO: 200576 - DNA, 25 bp, Mus musculus
agggatctccaaggaccacaatgct

SEQ ID NO: 200577 - DNA, 25 bp, Mus musculus
agggatctgccagtgtgcccctgga

SEQ ID NO: 200578 - DNA, 25 bp, Mus musculus
agggatctttaatgcctctccagct

SEQ ID NO: 200579 - DNA, 25 bp, Mus musculus
agggatctttgagagaaatacaaga

SEQ ID NO: 200580 - DNA, 25 bp, Mus musculus
agggatgaaggacacagggactgag

SEQ ID NO: 200581 - DNA, 25 bp, Mus musculus
agggatgaaggtctgtcagtttgtc

SEQ ID NO: 200582 - DNA, 25 bp, Mus musculus
agggatgatgcaatgagttccttcg

SEQ ID NO: 200583 - DNA, 25 bp, Mus musculus
agggatgatgtgctctgtgcagccc

SEQ ID NO: 200584 - DNA, 25 bp, Mus musculus
agggatgccagatgaggagtccctg

SEQ ID NO: 200585 - DNA, 25 bp, Mus musculus
agggatgccagatgatcttccccca

SEQ ID NO: 200586 - DNA, 25 bp, Mus musculus
agggatgccatattgtttccatcct

SEQ ID NO: 200587 - DNA, 25 bp, Mus musculus
agggatgctcaaggacagtgctatg

SEQ ID NO: 200588 - DNA, 25 bp, Mus musculus
agggatgcttcagatacgggaagcc

SEQ ID NO: 200589 - DNA, 25 bp, Mus musculus
agggatggaggcaaattccaccccg

SEQ ID NO: 200590 - DNA, 25 bp, Mus musculus
agggatggatgtgattttttcagca

SEQ ID NO: 200591 - DNA, 25 bp, Mus musculus
agggatggcagaggagctggcttcg

SEQ ID NO: 200592 - DNA, 25 bp, Mus musculus
agggatggcaggctcaaagacttgg

SEQ ID NO: 200593 - DNA, 25 bp, Mus musculus
agggatggcaggtagaagaggcaga

SEQ ID NO: 200594 - DNA, 25 bp, Mus musculus
agggatggggagagttggagtttgg

SEQ ID NO: 200595 - DNA, 25 bp, Mus musculus
agggatggtgaaccgggtgaccctg

SEQ ID NO: 200596 - DNA, 25 bp, Mus musculus
agggatgtaggagatgagccgctcc

SEQ ID NO: 200597 - DNA, 25 bp, Mus musculus
agggatgtcagtcaggggacgtgga

SEQ ID NO: 200598 - DNA, 25 bp, Mus musculus
agggatgtgatgctctttctcatca

SEQ ID NO: 200599 - DNA, 25 bp, Mus musculus
agggatgtgcttctgagaagaggcc

SEQ ID NO: 200600 - DNA, 25 bp, Mus musculus
agggatgtgcttctgatgatgagag

SEQ ID NO: 200601 - DNA, 25 bp, Mus musculus
agggatgttttgggtcgcagacact

SEQ ID NO: 200602 - DNA, 25 bp, Mus musculus
agggattaattcaggagtgggaggt

SEQ ID NO: 200603 - DNA, 25 bp, Mus musculus
agggattacagtgctgtgctccatc

SEQ ID NO: 200604 - DNA, 25 bp, Mus musculus
agggattcagcacccggagcgtgcc

SEQ ID NO: 200605 - DNA, 25 bp, Mus musculus
agggattcaggggttccagtgtccc

SEQ ID NO: 200606 - DNA, 25 bp, Mus musculus
agggattcagtggggctccacctgt

SEQ ID NO: 200607 - DNA, 25 bp, Mus musculus
agggattcagtgggggagtttgtga

SEQ ID NO: 200608 - DNA, 25 bp, Mus musculus
agggattcagtgggggatttccaat

SEQ ID NO: 200609 - DNA, 25 bp, Mus musculus
agggattcatgctgtattttcatct

SEQ ID NO: 200610 - DNA, 25 bp, Mus musculus
agggattccagtactagtacttgga

SEQ ID NO: 200611 - DNA, 25 bp, Mus musculus
agggattcccgtcttctccctcctg

SEQ ID NO: 200612 - DNA, 25 bp, Mus musculus
agggattcttcaggaacaagatcct

SEQ ID NO: 200613 - DNA, 25 bp, Mus musculus
agggattgaccgacgcctcttcgcc

SEQ ID NO: 200614 - DNA, 25 bp, Mus musculus
agggatttcagatgataaaggcagt

SEQ ID NO: 200615 - DNA, 25 bp, Mus musculus
agggatttcaggctgggaatgcgtt

SEQ ID NO: 200616 - DNA, 25 bp, Mus musculus
agggatttcagtctggaaatgtctt

SEQ ID NO: 200617 - DNA, 25 bp, Mus musculus
agggatttctggacttggcagtgta

SEQ ID NO: 200618 - DNA, 25 bp, Mus musculus
agggatttgctggttttaggctagc

SEQ ID NO: 200619 - DNA, 25 bp, Mus musculus
agggcaaaagagatatatccagtga

SEQ ID NO: 200620 - DNA, 25 bp, Mus musculus
agggcaaaagagttatatccagtga

SEQ ID NO: 200621 - DNA, 25 bp, Mus musculus
agggcaaaagccgaggctctgctaa

SEQ ID NO: 200622 - DNA, 25 bp, Mus musculus
agggcaaaatctgtctccagtagaa

SEQ ID NO: 200623 - DNA, 25 bp, Mus musculus
agggcaaaatctgtgagaaggaccg

SEQ ID NO: 200624 - DNA, 25 bp, Mus musculus
agggcaacaggctgaaccattagtc

SEQ ID NO: 200625 - DNA, 25 bp, Mus musculus
agggcaacagtcatcatctgactgc

SEQ ID NO: 200626 - DNA, 25 bp, Mus musculus
agggcaacagtgaactaatgctgga

SEQ ID NO: 200627 - DNA, 25 bp, Mus musculus
agggcaacgtgatggagctggtggg

SEQ ID NO: 200628 - DNA, 25 bp, Mus musculus
agggcaactgtgtggacatcaacga

SEQ ID NO: 200629 - DNA, 25 bp, Mus musculus
agggcaagaaagatgaacgagaccg

SEQ ID NO: 200630 - DNA, 25 bp, Mus musculus
agggcaagaagcatcctcctccttg

SEQ ID NO: 200631 - DNA, 25 bp, Mus musculus
agggcaagaagcctggaattgtgtc

SEQ ID NO: 200632 - DNA, 25 bp, Mus musculus
agggcaagaaggctgcgaaaagaca

SEQ ID NO: 200633 - DNA, 25 bp, Mus musculus
agggcaagaaggtgggaatcctaga

SEQ ID NO: 200634 - DNA, 25 bp, Mus musculus
agggcaagaagtatttaggtcagtt

SEQ ID NO: 200635 - DNA, 25 bp, Mus musculus
agggcaagaccaaaaacctcatcaa

SEQ ID NO: 200636 - DNA, 25 bp, Mus musculus
agggcaagaccggcttctcctcgga

SEQ ID NO: 200637 - DNA, 25 bp, Mus musculus
agggcaagacgggcgcagttctgaa

SEQ ID NO: 200638 - DNA, 25 bp, Mus musculus
agggcaagatacacggcatcatcgc

SEQ ID NO: 200639 - DNA, 25 bp, Mus musculus
agggcaagatcaagccccacctgat

SEQ ID NO: 200640 - DNA, 25 bp, Mus musculus
agggcaaggactacctggaccagct

SEQ ID NO: 200641 - DNA, 25 bp, Mus musculus
agggcaagggactccgagggagcgc

SEQ ID NO: 200642 - DNA, 25 bp, Mus musculus
agggcaagggggagaagattaatcc

SEQ ID NO: 200643 - DNA, 25 bp, Mus musculus
agggcaagggttcttggcccagctg

SEQ ID NO: 200644 - DNA, 25 bp, Mus musculus
agggcacaagctcctgacgagcagc

SEQ ID NO: 200645 - DNA, 25 bp, Mus musculus
agggcacaagctgagcggggcccag

SEQ ID NO: 200646 - DNA, 25 bp, Mus musculus
agggcacaatgcgaccttcttcggg

SEQ ID NO: 200647 - DNA, 25 bp, Mus musculus
agggcaccaagcactgaaaactgat

SEQ ID NO: 200648 - DNA, 25 bp, Mus musculus
agggcaccaaggctgctttggcagg

SEQ ID NO: 200649 - DNA, 25 bp, Mus musculus
agggcaccaagttctccagccaaca

SEQ ID NO: 200650 - DNA, 25 bp, Mus musculus
agggcaccaggcctggaagcaccag

SEQ ID NO: 200651 - DNA, 25 bp, Mus musculus
agggcaccaggcctggggtcccctt

SEQ ID NO: 200652 - DNA, 25 bp, Mus musculus
agggcaccaggtcactacttcagtg

SEQ ID NO: 200653 - DNA, 25 bp, Mus musculus
agggcacccgccaacatgagtctgt

SEQ ID NO: 200654 - DNA, 25 bp, Mus musculus
agggcaccgtggaggcccccgtcct

SEQ ID NO: 200655 - DNA, 25 bp, Mus musculus
agggcacgatgtaaccagcctcagg

SEQ ID NO: 200656 - DNA, 25 bp, Mus musculus
agggcactaaaacggatggctctcc

SEQ ID NO: 200657 - DNA, 25 bp, Mus musculus
agggcactgagacagggctttctga

SEQ ID NO: 200658 - DNA, 25 bp, Mus musculus
agggcactgatggaggagacacggg

SEQ ID NO: 200659 - DNA, 25 bp, Mus musculus
agggcagaaactggccagcaagcct

SEQ ID NO: 200660 - DNA, 25 bp, Mus musculus
agggcagaaggaagaaaacggctca

SEQ ID NO: 200661 - DNA, 25 bp, Mus musculus
agggcagaatatgcagacagacatg

SEQ ID NO: 200662 - DNA, 25 bp, Mus musculus
agggcagagaagctggcttgctgga

SEQ ID NO: 200663 - DNA, 25 bp, Mus musculus
agggcagagccaagcacttacgcct

SEQ ID NO: 200664 - DNA, 25 bp, Mus musculus
agggcagagggatacagtacagcct

SEQ ID NO: 200665 - DNA, 25 bp, Mus musculus
agggcagataagaagggcaggattc

SEQ ID NO: 200666 - DNA, 25 bp, Mus musculus
agggcagatctggtattcttttggt

SEQ ID NO: 200667 - DNA, 25 bp, Mus musculus
agggcagcagagaatcagctgttct

SEQ ID NO: 200668 - DNA, 25 bp, Mus musculus
agggcagcgacgaggttcagattct

SEQ ID NO: 200669 - DNA, 25 bp, Mus musculus
agggcagcgaggttgtaagtgtctt

SEQ ID NO: 200670 - DNA, 25 bp, Mus musculus
agggcagcgattgtaagtgtcttaa

SEQ ID NO: 200671 - DNA, 25 bp, Mus musculus
agggcagctagctggatcaccgaca

SEQ ID NO: 200672 - DNA, 25 bp, Mus musculus
agggcagggaagaagtacgagaaag

SEQ ID NO: 200673 - DNA, 25 bp, Mus musculus
agggcagtggcgaaggcgaatctgg

SEQ ID NO: 200674 - DNA, 25 bp, Mus musculus
agggcagtgggtgctggtcttcagt

SEQ ID NO: 200675 - DNA, 25 bp, Mus musculus
agggcagttttgaaggctctgctaa

SEQ ID NO: 200676 - DNA, 25 bp, Mus musculus
agggcataactgagaatatttataa

SEQ ID NO: 200677 - DNA, 25 bp, Mus musculus
agggcataactgttatagagaatat

SEQ ID NO: 200678 - DNA, 25 bp, Mus musculus
agggcataggagaacattctggctc

SEQ ID NO: 200679 - DNA, 25 bp, Mus musculus
agggcataggaggtaacaacaacaa

SEQ ID NO: 200680 - DNA, 25 bp, Mus musculus
agggcataggcagccacctagatca

SEQ ID NO: 200681 - DNA, 25 bp, Mus musculus
agggcatatcagatacgagggcacc

SEQ ID NO: 200682 - DNA, 25 bp, Mus musculus
agggcatatcaggtcaggggtcacc

SEQ ID NO: 200683 - DNA, 25 bp, Mus musculus
agggcatcaagaagtcaacaaaagg

SEQ ID NO: 200684 - DNA, 25 bp, Mus musculus
agggcatcaagtattggctggatcc

SEQ ID NO: 200685 - DNA, 25 bp, Mus musculus
agggcatcaccatcgtggaagacat

SEQ ID NO: 200686 - DNA, 25 bp, Mus musculus
agggcatcagcgagggctgccggaa

SEQ ID NO: 200687 - DNA, 25 bp, Mus musculus
agggcatcaggaggctgcacagggt

SEQ ID NO: 200688 - DNA, 25 bp, Mus musculus
agggcatcaggcggtatgaatatca

SEQ ID NO: 200689 - DNA, 25 bp, Mus musculus
agggcatcagtgatatgtcaagaac

SEQ ID NO: 200690 - DNA, 25 bp, Mus musculus
agggcatcagtgctaatggaggttg

SEQ ID NO: 200691 - DNA, 25 bp, Mus musculus
agggcatcatccttagcagggagaa

SEQ ID NO: 200692 - DNA, 25 bp, Mus musculus
agggcatcggatgctggggctgcac

SEQ ID NO: 200693 - DNA, 25 bp, Mus musculus
agggcatcttgcagaggaggatgac

SEQ ID NO: 200694 - DNA, 25 bp, Mus musculus
agggcatgagcctcaagatggtgct

SEQ ID NO: 200695 - DNA, 25 bp, Mus musculus
agggcatgagcgggactcgccatga

SEQ ID NO: 200696 - DNA, 25 bp, Mus musculus
agggcatggacaagtccagttcagc

SEQ ID NO: 200697 - DNA, 25 bp, Mus musculus
agggcatggcagagcaccttaagga

SEQ ID NO: 200698 - DNA, 25 bp, Mus musculus
agggcatggcagagctccaggccgg

SEQ ID NO: 200699 - DNA, 25 bp, Mus musculus
agggcatgggatacatgccttctgc

SEQ ID NO: 200700 - DNA, 25 bp, Mus musculus
agggcatggtgggcagcaaagattc

SEQ ID NO: 200701 - DNA, 25 bp, Mus musculus
agggccaaacccaaggaggcggatg

SEQ ID NO: 200702 - DNA, 25 bp, Mus musculus
agggccaaagggttccattggattc

SEQ ID NO: 200703 - DNA, 25 bp, Mus musculus
agggccaagaagtctacatgtgggt

SEQ ID NO: 200704 - DNA, 25 bp, Mus musculus
agggccaatcagggtccctgagttg

SEQ ID NO: 200705 - DNA, 25 bp, Mus musculus
agggccacaaggtgaccgaggcttc

SEQ ID NO: 200706 - DNA, 25 bp, Mus musculus
agggccacactggtgctgtgacatg

SEQ ID NO: 200707 - DNA, 25 bp, Mus musculus
agggccagaagaagagtcgaaagga

SEQ ID NO: 200708 - DNA, 25 bp, Mus musculus
agggccagaaggagctcccagcgag

SEQ ID NO: 200709 - DNA, 25 bp, Mus musculus
agggccagaaggtgatggtgcaggg

SEQ ID NO: 200710 - DNA, 25 bp, Mus musculus
agggccagcattgagattgaccaga

SEQ ID NO: 200711 - DNA, 25 bp, Mus musculus
agggccagcttgctgccacagctgc

SEQ ID NO: 200712 - DNA, 25 bp, Mus musculus
agggccagggatctctctctccacc

SEQ ID NO: 200713 - DNA, 25 bp, Mus musculus
agggccagggatctgatgcgggctc

SEQ ID NO: 200714 - DNA, 25 bp, Mus musculus
agggccagtcctgtggtagaagaaa

SEQ ID NO: 200715 - DNA, 25 bp, Mus musculus
agggccatcaagaatgactctgtgg

SEQ ID NO: 200716 - DNA, 25 bp, Mus musculus
agggccatcatcagctgcagttaaa

SEQ ID NO: 200717 - DNA, 25 bp, Mus musculus
agggccatgaccaaggacaaacaga

SEQ ID NO: 200718 - DNA, 25 bp, Mus musculus
agggccatgaccggatttaattggt

SEQ ID NO: 200719 - DNA, 25 bp, Mus musculus
agggccatgaccggcttccttcaat

SEQ ID NO: 200720 - DNA, 25 bp, Mus musculus
agggccatgtcttccctctcatggg

SEQ ID NO: 200721 - DNA, 25 bp, Mus musculus
agggccattcacaggcatcctacat

SEQ ID NO: 200722 - DNA, 25 bp, Mus musculus
agggcccagagggtcgttgctccag

SEQ ID NO: 200723 - DNA, 25 bp, Mus musculus
agggcccagccaggtagccatccct

SEQ ID NO: 200724 - DNA, 25 bp, Mus musculus
agggcccagccaggttttcaggctt

SEQ ID NO: 200725 - DNA, 25 bp, Mus musculus
agggcccctgggcccacctggcctc

SEQ ID NO: 200726 - DNA, 25 bp, Mus musculus
agggcccgccacagctgagctgctc

SEQ ID NO: 200727 - DNA, 25 bp, Mus musculus
agggcccgccacaggctggagcagg

SEQ ID NO: 200728 - DNA, 25 bp, Mus musculus
agggcccgcccaaccagcagaggcc

SEQ ID NO: 200729 - DNA, 25 bp, Mus musculus
agggcccgcctcctgatccaggacc

SEQ ID NO: 200730 - DNA, 25 bp, Mus musculus
agggcccgttcagggctgggcttca

SEQ ID NO: 200731 - DNA, 25 bp, Mus musculus
agggccctcaggaacaatggcccaa

SEQ ID NO: 200732 - DNA, 25 bp, Mus musculus
agggccctcaggccagggggaaggg

SEQ ID NO: 200733 - DNA, 25 bp, Mus musculus
agggccctccgggcagagcgccgac

SEQ ID NO: 200734 - DNA, 25 bp, Mus musculus
agggccctgaagagcatgacgttcc

SEQ ID NO: 200735 - DNA, 25 bp, Mus musculus
agggccgaggaagaactccagttct

SEQ ID NO: 200736 - DNA, 25 bp, Mus musculus
agggccgaggcgaagcccgacatcc

SEQ ID NO: 200737 - DNA, 25 bp, Mus musculus
agggccgccctataggaaatggaat

SEQ ID NO: 200738 - DNA, 25 bp, Mus musculus
agggccgccgccaggtgtgcaacag

SEQ ID NO: 200739 - DNA, 25 bp, Mus musculus
agggccggacaggattgtggaattc

SEQ ID NO: 200740 - DNA, 25 bp, Mus musculus
agggccggacagtgtctcgttcgat

SEQ ID NO: 200741 - DNA, 25 bp, Mus musculus
agggccggagataatagaatctgtc

SEQ ID NO: 200742 - DNA, 25 bp, Mus musculus
agggccggctgcacaatctgcctgt

SEQ ID NO: 200743 - DNA, 25 bp, Mus musculus
agggccggctgtgtggcctcttcct

SEQ ID NO: 200744 - DNA, 25 bp, Mus musculus
agggccggggtgtgcacatggaaga

SEQ ID NO: 200745 - DNA, 25 bp, Mus musculus
agggccgtaagagtgcagaccataa

SEQ ID NO: 200746 - DNA, 25 bp, Mus musculus
agggcctaatgacagtaattatgcc

SEQ ID NO: 200747 - DNA, 25 bp, Mus musculus
agggcctcacaccaagcctgaagaa

SEQ ID NO: 200748 - DNA, 25 bp, Mus musculus
agggcctgaaggacctccacaggag

SEQ ID NO: 200749 - DNA, 25 bp, Mus musculus
agggcctgcagagaggaaaaccaaa

SEQ ID NO: 200750 - DNA, 25 bp, Mus musculus
agggcctgccagggacatcacagtg

SEQ ID NO: 200751 - DNA, 25 bp, Mus musculus
agggcctgccgctgggcgtccgacc

SEQ ID NO: 200752 - DNA, 25 bp, Mus musculus
agggcctgccgctggtaagactttg

SEQ ID NO: 200753 - DNA, 25 bp, Mus musculus
agggcctgctcaggctgtggcttac

SEQ ID NO: 200754 - DNA, 25 bp, Mus musculus
agggccttcaagaaaattacaacac

SEQ ID NO: 200755 - DNA, 25 bp, Mus musculus
agggccttcaggaagatgctaccaa

SEQ ID NO: 200756 - DNA, 25 bp, Mus musculus
agggccttgaggacctgctctcctt

SEQ ID NO: 200757 - DNA, 25 bp, Mus musculus
agggcctttgctggggacagtaaat

SEQ ID NO: 200758 - DNA, 25 bp, Mus musculus
agggccttttggtctggaagctgac

SEQ ID NO: 200759 - DNA, 25 bp, Mus musculus
agggcctttttcctatattgttgat

SEQ ID NO: 200760 - DNA, 25 bp, Mus musculus
agggcctttttcctattcttctgcc

SEQ ID NO: 200761 - DNA, 25 bp, Mus musculus
agggcgagaacctggagacggacca

SEQ ID NO: 200762 - DNA, 25 bp, Mus musculus
agggcgagaagggagatcctggtat

SEQ ID NO: 200763 - DNA, 25 bp, Mus musculus
agggcgagatgagcaaccctgggga

SEQ ID NO: 200764 - DNA, 25 bp, Mus musculus
agggcgagcccaagatctataacaa

SEQ ID NO: 200765 - DNA, 25 bp, Mus musculus
agggcgagcccaggatgggctctaa

SEQ ID NO: 200766 - DNA, 25 bp, Mus musculus
agggcgagcgggaacagaactcaaa

SEQ ID NO: 200767 - DNA, 25 bp, Mus musculus
agggcgagctccggaaaattgtgca

SEQ ID NO: 200768 - DNA, 25 bp, Mus musculus
agggcgagtctcggcaaagtctact

SEQ ID NO: 200769 - DNA, 25 bp, Mus musculus
agggcgagtctcgggactgaggctc

SEQ ID NO: 200770 - DNA, 25 bp, Mus musculus
agggcgatcccacagatccaacttt

SEQ ID NO: 200771 - DNA, 25 bp, Mus musculus
agggcgatcccacagtgcaatttgg

SEQ ID NO: 200772 - DNA, 25 bp, Mus musculus
agggcgcaagtgtgagccactgctt

SEQ ID NO: 200773 - DNA, 25 bp, Mus musculus
agggcgcagacgagagtctcggcca

SEQ ID NO: 200774 - DNA, 25 bp, Mus musculus
agggcgccagatgctggaggtaaag

SEQ ID NO: 200775 - DNA, 25 bp, Mus musculus
agggcgccgggcttcttcacaaaat

SEQ ID NO: 200776 - DNA, 25 bp, Mus musculus
agggcgcctagcgctttgagcttcc

SEQ ID NO: 200777 - DNA, 25 bp, Mus musculus
agggcgctggcggaatggcttcctt

SEQ ID NO: 200778 - DNA, 25 bp, Mus musculus
agggcggaaggccaccaggccttgc

SEQ ID NO: 200779 - DNA, 25 bp, Mus musculus
agggcggagaggcaggtctctggag

SEQ ID NO: 200780 - DNA, 25 bp, Mus musculus
agggcggagtcgcaggtgactccat

SEQ ID NO: 200781 - DNA, 25 bp, Mus musculus
agggcggagtcgcaggtgttttgca

SEQ ID NO: 200782 - DNA, 25 bp, Mus musculus
agggcggcagacgccagtgctgtat

SEQ ID NO: 200783 - DNA, 25 bp, Mus musculus
agggcggcagcgtgcctgaagacct

SEQ ID NO: 200784 - DNA, 25 bp, Mus musculus
agggcggccagagggttggtcctgt

SEQ ID NO: 200785 - DNA, 25 bp, Mus musculus
agggcggctcaccgcgtcgattctg

SEQ ID NO: 200786 - DNA, 25 bp, Mus musculus
agggcggctcaccgggtcgattctg

SEQ ID NO: 200787 - DNA, 25 bp, Mus musculus
agggcgggtcagcaagctccgggcc

SEQ ID NO: 200788 - DNA, 25 bp, Mus musculus
agggcgggtcagcggccctgtgagt

SEQ ID NO: 200789 - DNA, 25 bp, Mus musculus
agggcgtcttagatgacgtggtctc

SEQ ID NO: 200790 - DNA, 25 bp, Mus musculus
agggcgtgaaactgacaccccggag

SEQ ID NO: 200791 - DNA, 25 bp, Mus musculus
agggcgtggccatagtgaacagaag

SEQ ID NO: 200792 - DNA, 25 bp, Mus musculus
agggctacacaaaaggtggttgttg

SEQ ID NO: 200793 - DNA, 25 bp, Mus musculus
agggctacagcagaggaataaatga

SEQ ID NO: 200794 - DNA, 25 bp, Mus musculus
agggctacagctccggaccaaaatt

SEQ ID NO: 200795 - DNA, 25 bp, Mus musculus
agggctaccgtcatacctcactaca

SEQ ID NO: 200796 - DNA, 25 bp, Mus musculus
agggctaccgtcttgctggtgagca

SEQ ID NO: 200797 - DNA, 25 bp, Mus musculus
agggctacggcaaatactggtaacc

SEQ ID NO: 200798 - DNA, 25 bp, Mus musculus
agggctacgtcaaggtcccaaagcc

SEQ ID NO: 200799 - DNA, 25 bp, Mus musculus
agggctactccaggaggcaccatgt

SEQ ID NO: 200800 - DNA, 25 bp, Mus musculus
agggctatattcagggctacaacaa

SEQ ID NO: 200801 - DNA, 25 bp, Mus musculus
agggctatattcaggtgacagactt

SEQ ID NO: 200802 - DNA, 25 bp, Mus musculus
agggctatttccctgcagtctgacc

SEQ ID NO: 200803 - DNA, 25 bp, Mus musculus
agggctcaaggaggtagatgacttc

SEQ ID NO: 200804 - DNA, 25 bp, Mus musculus
agggctcaagtcgcaatgtgtcttc

SEQ ID NO: 200805 - DNA, 25 bp, Mus musculus
agggctccacactgtcccggagagt

SEQ ID NO: 200806 - DNA, 25 bp, Mus musculus
agggctccaccgcggttggtgttcg

SEQ ID NO: 200807 - DNA, 25 bp, Mus musculus
agggctccccaccagcacctcctac

SEQ ID NO: 200808 - DNA, 25 bp, Mus musculus
agggctctacttctgttcgttaaaa

SEQ ID NO: 200809 - DNA, 25 bp, Mus musculus
agggctctagcttggacagccccag

SEQ ID NO: 200810 - DNA, 25 bp, Mus musculus
agggctctagtgtcactgctcagaa

SEQ ID NO: 200811 - DNA, 25 bp, Mus musculus
agggctctccgaacctagctagcat

SEQ ID NO: 200812 - DNA, 25 bp, Mus musculus
agggctctccgagaccgaagccccg

SEQ ID NO: 200813 - DNA, 25 bp, Mus musculus
agggctctccggcgcatctcccaat

SEQ ID NO: 200814 - DNA, 25 bp, Mus musculus
agggctctgcaggaagcctgctgac

SEQ ID NO: 200815 - DNA, 25 bp, Mus musculus
agggctcttcaggtctacatgtggg

SEQ ID NO: 200816 - DNA, 25 bp, Mus musculus
agggctcttcaggtgctccaatgag

SEQ ID NO: 200817 - DNA, 25 bp, Mus musculus
agggctcttgctgttccggggcaca

SEQ ID NO: 200818 - DNA, 25 bp, Mus musculus
agggctcttgggcagcgctcaccac

SEQ ID NO: 200819 - DNA, 25 bp, Mus musculus
agggctgaagagaatatccggtctc

SEQ ID NO: 200820 - DNA, 25 bp, Mus musculus
agggctgaagagtgatgacattact

SEQ ID NO: 200821 - DNA, 25 bp, Mus musculus
agggctgagaggcaggaaatgttgc

SEQ ID NO: 200822 - DNA, 25 bp, Mus musculus
agggctgcagcttcctgcctgttca

SEQ ID NO: 200823 - DNA, 25 bp, Mus musculus
agggctgcagtgtcctgctgggagt

SEQ ID NO: 200824 - DNA, 25 bp, Mus musculus
agggctgcattggaggttaaaatta

SEQ ID NO: 200825 - DNA, 25 bp, Mus musculus
agggctgccaggagatggacatgat

SEQ ID NO: 200826 - DNA, 25 bp, Mus musculus
agggctgccaggttgaattctctta

SEQ ID NO: 200827 - DNA, 25 bp, Mus musculus
agggctgccatgcctgtgactgcag

SEQ ID NO: 200828 - DNA, 25 bp, Mus musculus
agggctgccgactgctgatctcttc

SEQ ID NO: 200829 - DNA, 25 bp, Mus musculus
agggctgccgagatgtggacgagtg

SEQ ID NO: 200830 - DNA, 25 bp, Mus musculus
agggctgccgagttgtggacgagtg

SEQ ID NO: 200831 - DNA, 25 bp, Mus musculus
agggctgcctcaggtcgcatagggc

SEQ ID NO: 200832 - DNA, 25 bp, Mus musculus
agggctggagctgaggagattattg

SEQ ID NO: 200833 - DNA, 25 bp, Mus musculus
agggctggatgtcagctctctgctg

SEQ ID NO: 200834 - DNA, 25 bp, Mus musculus
agggctggccggattggtggaggta

SEQ ID NO: 200835 - DNA, 25 bp, Mus musculus
agggctggccggtttggtggaggta

SEQ ID NO: 200836 - DNA, 25 bp, Mus musculus
agggctgggggagtccagggccgcg

SEQ ID NO: 200837 - DNA, 25 bp, Mus musculus
agggctgggtgacagagtggaccag

SEQ ID NO: 200838 - DNA, 25 bp, Mus musculus
agggctggtcacatggtgacctggc

SEQ ID NO: 200839 - DNA, 25 bp, Mus musculus
agggctgtggagacaaatgaattcc

SEQ ID NO: 200840 - DNA, 25 bp, Mus musculus
agggctgtggaggaacgggattttc

SEQ ID NO: 200841 - DNA, 25 bp, Mus musculus
agggctgtggcctggagatgcccaa

SEQ ID NO: 200842 - DNA, 25 bp, Mus musculus
agggcttaccaggtgtccctggaat

SEQ ID NO: 200843 - DNA, 25 bp, Mus musculus
agggcttattctcagctctttgatg

SEQ ID NO: 200844 - DNA, 25 bp, Mus musculus
agggcttccaaaccctgctcacact

SEQ ID NO: 200845 - DNA, 25 bp, Mus musculus
agggcttccaaagggtcctctgcag

SEQ ID NO: 200846 - DNA, 25 bp, Mus musculus
agggcttccaaggcccttgtccacc

SEQ ID NO: 200847 - DNA, 25 bp, Mus musculus
agggcttcccagacactccgtggtg

SEQ ID NO: 200848 - DNA, 25 bp, Mus musculus
agggcttcccagagaagcgatgtcc

SEQ ID NO: 200849 - DNA, 25 bp, Mus musculus
agggcttcccaggatctggagactc

SEQ ID NO: 200850 - DNA, 25 bp, Mus musculus
agggcttcccccagcagactggagg

SEQ ID NO: 200851 - DNA, 25 bp, Mus musculus
agggcttctgttcaggatatagatc

SEQ ID NO: 200852 - DNA, 25 bp, Mus musculus
agggcttcttaggtcgcaagtctgg

SEQ ID NO: 200853 - DNA, 25 bp, Mus musculus
agggcttcttcagacgaacagtcag

SEQ ID NO: 200854 - DNA, 25 bp, Mus musculus
agggcttcttcagtgatactgtcag

SEQ ID NO: 200855 - DNA, 25 bp, Mus musculus
agggcttgcggttccaaagggcctg

SEQ ID NO: 200856 - DNA, 25 bp, Mus musculus
agggcttgctgttctcctcttgcct

SEQ ID NO: 200857 - DNA, 25 bp, Mus musculus
agggctttaccagaagagggcatca

SEQ ID NO: 200858 - DNA, 25 bp, Mus musculus
agggctttaccagtctattgcatct

SEQ ID NO: 200859 - DNA, 25 bp, Mus musculus
agggctttccctgagaagcagctga

SEQ ID NO: 200860 - DNA, 25 bp, Mus musculus
agggctttctggagggagttggtgg

SEQ ID NO: 200861 - DNA, 25 bp, Mus musculus
aggggaaaagttgctggaaaccatg

SEQ ID NO: 200862 - DNA, 25 bp, Mus musculus
aggggaaaatgcgtcccatgagaat

SEQ ID NO: 200863 - DNA, 25 bp, Mus musculus
aggggaaaatggcattgtatcatca

SEQ ID NO: 200864 - DNA, 25 bp, Mus musculus
aggggaaaatgttttcgcatttcca

SEQ ID NO: 200865 - DNA, 25 bp, Mus musculus
aggggaaagaaagaatggaatctat

SEQ ID NO: 200866 - DNA, 25 bp, Mus musculus
aggggaaagaaggaatcacaggcct

SEQ ID NO: 200867 - DNA, 25 bp, Mus musculus
aggggaaagaggtgctggtggttaa

SEQ ID NO: 200868 - DNA, 25 bp, Mus musculus
aggggaacttccaggcacaaagtac

SEQ ID NO: 200869 - DNA, 25 bp, Mus musculus
aggggaagaacaatgacctccggga

SEQ ID NO: 200870 - DNA, 25 bp, Mus musculus
aggggaagactgccgtgagcatcca

SEQ ID NO: 200871 - DNA, 25 bp, Mus musculus
aggggaagactggcgcaagcggcgg

SEQ ID NO: 200872 - DNA, 25 bp, Mus musculus
aggggaagactgggagatggaacac

SEQ ID NO: 200873 - DNA, 25 bp, Mus musculus
aggggaagactggtccctgtggccc

SEQ ID NO: 200874 - DNA, 25 bp, Mus musculus
aggggaagactggtctctaactggt

SEQ ID NO: 200875 - DNA, 25 bp, Mus musculus
aggggaagaggaatattgaagagat

SEQ ID NO: 200876 - DNA, 25 bp, Mus musculus
aggggaagctgctatgcgtttctaa

SEQ ID NO: 200877 - DNA, 25 bp, Mus musculus
aggggaatatggctctggcccacag

SEQ ID NO: 200878 - DNA, 25 bp, Mus musculus
aggggaatcaaagttgctacaacta

SEQ ID NO: 200879 - DNA, 25 bp, Mus musculus
aggggaatctccgaaatcccgcaag

SEQ ID NO: 200880 - DNA, 25 bp, Mus musculus
aggggaatctccggtcccgcacacc

SEQ ID NO: 200881 - DNA, 25 bp, Mus musculus
aggggacaagatcacctttgtggat

SEQ ID NO: 200882 - DNA, 25 bp, Mus musculus
aggggacagccagtgagccatgagg

SEQ ID NO: 200883 - DNA, 25 bp, Mus musculus
aggggacagccagtggaggtccagg

SEQ ID NO: 200884 - DNA, 25 bp, Mus musculus
aggggacctcgcaagttcttccatc

SEQ ID NO: 200885 - DNA, 25 bp, Mus musculus
aggggacctgcactgtcacgcggtg

SEQ ID NO: 200886 - DNA, 25 bp, Mus musculus
aggggacctggagacagccttccct

SEQ ID NO: 200887 - DNA, 25 bp, Mus musculus
aggggaccttccaggtgacgctgac

SEQ ID NO: 200888 - DNA, 25 bp, Mus musculus
aggggacgatgaggacctcgaccta

SEQ ID NO: 200889 - DNA, 25 bp, Mus musculus
aggggacggtacctgcattgtgctt

SEQ ID NO: 200890 - DNA, 25 bp, Mus musculus
aggggactgctacgacaggtacctg

SEQ ID NO: 200891 - DNA, 25 bp, Mus musculus
aggggagaagaaccatttgacattg

SEQ ID NO: 200892 - DNA, 25 bp, Mus musculus
aggggagaagcagaccatggtgaat

SEQ ID NO: 200893 - DNA, 25 bp, Mus musculus
aggggagaagtgatgccttattgga

SEQ ID NO: 200894 - DNA, 25 bp, Mus musculus
aggggagaccggtttccaaggcaag

SEQ ID NO: 200895 - DNA, 25 bp, Mus musculus
aggggagacgtggtactcagttcgt

SEQ ID NO: 200896 - DNA, 25 bp, Mus musculus
aggggagcactggactccttcagtg

SEQ ID NO: 200897 - DNA, 25 bp, Mus musculus
aggggagcactggccctgctccctg

SEQ ID NO: 200898 - DNA, 25 bp, Mus musculus
aggggagcagaaaatgttttcagac

SEQ ID NO: 200899 - DNA, 25 bp, Mus musculus
aggggagcagccctggctgtcctgg

SEQ ID NO: 200900 - DNA, 25 bp, Mus musculus
aggggagcagggcatgaatctttct

SEQ ID NO: 200901 - DNA, 25 bp, Mus musculus
aggggagccagattatcacaaagat

SEQ ID NO: 200902 - DNA, 25 bp, Mus musculus
aggggaggaaatgagaaagatgaag

SEQ ID NO: 200903 - DNA, 25 bp, Mus musculus
aggggaggaagatggcactggatct

SEQ ID NO: 200904 - DNA, 25 bp, Mus musculus
aggggaggaagcctagccgcccgcc

SEQ ID NO: 200905 - DNA, 25 bp, Mus musculus
aggggaggaaggcatcccccgcaga

SEQ ID NO: 200906 - DNA, 25 bp, Mus musculus
aggggaggcaggtatggatgtattg

SEQ ID NO: 200907 - DNA, 25 bp, Mus musculus
aggggaggccagtggtgagaaaccc

SEQ ID NO: 200908 - DNA, 25 bp, Mus musculus
aggggaggcgagagttccagaaacc

SEQ ID NO: 200909 - DNA, 25 bp, Mus musculus
aggggagtgcgagacaaagctggct

SEQ ID NO: 200910 - DNA, 25 bp, Mus musculus
aggggataatgcactttgtggagaa

SEQ ID NO: 200911 - DNA, 25 bp, Mus musculus
aggggatatggcatccagccagcgc

SEQ ID NO: 200912 - DNA, 25 bp, Mus musculus
aggggatccaggaccagatgtaaat

SEQ ID NO: 200913 - DNA, 25 bp, Mus musculus
aggggatccaggtggcacattggaa

SEQ ID NO: 200914 - DNA, 25 bp, Mus musculus
aggggatcgacaaccacagcaaacc

SEQ ID NO: 200915 - DNA, 25 bp, Mus musculus
aggggatgcctgcaggatctgccac

SEQ ID NO: 200916 - DNA, 25 bp, Mus musculus
aggggatggtgatgaacgagaccgt

SEQ ID NO: 200917 - DNA, 25 bp, Mus musculus
aggggattgattatgagaagatctt

SEQ ID NO: 200918 - DNA, 25 bp, Mus musculus
aggggcaaaggagcatggcttggac

SEQ ID NO: 200919 - DNA, 25 bp, Mus musculus
aggggcaacctaggtgttgacttta

SEQ ID NO: 200920 - DNA, 25 bp, Mus musculus
aggggcaataccaatatagggggct

SEQ ID NO: 200921 - DNA, 25 bp, Mus musculus
aggggcacaaggcattgccacaggg

SEQ ID NO: 200922 - DNA, 25 bp, Mus musculus
aggggcacaatctgcagctcagtgg

SEQ ID NO: 200923 - DNA, 25 bp, Mus musculus
aggggcaccgatcgtgtatgacgga

SEQ ID NO: 200924 - DNA, 25 bp, Mus musculus
aggggcacctggcgaggaggaagcc

SEQ ID NO: 200925 - DNA, 25 bp, Mus musculus
aggggcacctggtctcccttccatg

SEQ ID NO: 200926 - DNA, 25 bp, Mus musculus
aggggcactgggtcgtcatgtcaaa

SEQ ID NO: 200927 - DNA, 25 bp, Mus musculus
aggggcagaggtagccattgcgggc

SEQ ID NO: 200928 - DNA, 25 bp, Mus musculus
aggggcaggcgggtgattatagagc

SEQ ID NO: 200929 - DNA, 25 bp, Mus musculus
aggggcaggtcaatagccttcctgg

SEQ ID NO: 200930 - DNA, 25 bp, Mus musculus
aggggcatccagataagatctgtga

SEQ ID NO: 200931 - DNA, 25 bp, Mus musculus
aggggccactcaacccaccctcagc

SEQ ID NO: 200932 - DNA, 25 bp, Mus musculus
aggggccagctccaggtcacaggat

SEQ ID NO: 200933 - DNA, 25 bp, Mus musculus
aggggccagctgaaggctctgtggg

SEQ ID NO: 200934 - DNA, 25 bp, Mus musculus
aggggcccagcaggtggagagcagg

SEQ ID NO: 200935 - DNA, 25 bp, Mus musculus
aggggcccaggtggacaacatcagt

SEQ ID NO: 200936 - DNA, 25 bp, Mus musculus
aggggcccataacgtgtttcatccc

SEQ ID NO: 200937 - DNA, 25 bp, Mus musculus
aggggccccagcccctctggtttca

SEQ ID NO: 200938 - DNA, 25 bp, Mus musculus
aggggccccgcggcagactccgggg

SEQ ID NO: 200939 - DNA, 25 bp, Mus musculus
aggggcccgggcttccgtgacctcg

SEQ ID NO: 200940 - DNA, 25 bp, Mus musculus
aggggccctaaataaaagcctgact

SEQ ID NO: 200941 - DNA, 25 bp, Mus musculus
aggggcctattaagctgatccacac

SEQ ID NO: 200942 - DNA, 25 bp, Mus musculus
aggggcctattaagggctcgctgct

SEQ ID NO: 200943 - DNA, 25 bp, Mus musculus
aggggcctcaggtggatgaaactca

SEQ ID NO: 200944 - DNA, 25 bp, Mus musculus
aggggcctccagcaggaacacagag

SEQ ID NO: 200945 - DNA, 25 bp, Mus musculus
aggggcctcctggccaggtggccat

SEQ ID NO: 200946 - DNA, 25 bp, Mus musculus
aggggcgagaaactgatgaagtgac

SEQ ID NO: 200947 - DNA, 25 bp, Mus musculus
aggggcgagagggagctgctgcagt

SEQ ID NO: 200948 - DNA, 25 bp, Mus musculus
aggggcgctggcaccttcaaacacc

SEQ ID NO: 200949 - DNA, 25 bp, Mus musculus
aggggcgctgggctacgatggaagc

SEQ ID NO: 200950 - DNA, 25 bp, Mus musculus
aggggcgctggtcgggctgtggcag

SEQ ID NO: 200951 - DNA, 25 bp, Mus musculus
aggggcggagctacagagactgcaa

SEQ ID NO: 200952 - DNA, 25 bp, Mus musculus
aggggcggaggatcaacgaggatca

SEQ ID NO: 200953 - DNA, 25 bp, Mus musculus
aggggcggccaggtccagcaccaag

SEQ ID NO: 200954 - DNA, 25 bp, Mus musculus
aggggcgggcttagggtggagcgac

SEQ ID NO: 200955 - DNA, 25 bp, Mus musculus
aggggcggttgcctgtagtcagaag

SEQ ID NO: 200956 - DNA, 25 bp, Mus musculus
aggggcgtcctgaagcgctgtgctt

SEQ ID NO: 200957 - DNA, 25 bp, Mus musculus
aggggcgttcaacgctccagttata

SEQ ID NO: 200958 - DNA, 25 bp, Mus musculus
aggggcgttcagtatgcctgtgtct

SEQ ID NO: 200959 - DNA, 25 bp, Mus musculus
aggggctccaggcagaagcgatgct

SEQ ID NO: 200960 - DNA, 25 bp, Mus musculus
aggggctccataaagcccatgcagg

SEQ ID NO: 200961 - DNA, 25 bp, Mus musculus
aggggctcggcaggttcgcttatct

SEQ ID NO: 200962 - DNA, 25 bp, Mus musculus
aggggctgaagtatatccatgcggc

SEQ ID NO: 200963 - DNA, 25 bp, Mus musculus
aggggctgagaaagacaggttgcag

SEQ ID NO: 200964 - DNA, 25 bp, Mus musculus
aggggctgaggaaaggaaacctcgt

SEQ ID NO: 200965 - DNA, 25 bp, Mus musculus
aggggctgcaggggacacccgtcag

SEQ ID NO: 200966 - DNA, 25 bp, Mus musculus
aggggctgccacacaatcaggactt

SEQ ID NO: 200967 - DNA, 25 bp, Mus musculus
aggggctgccggggtagctcgcggc

SEQ ID NO: 200968 - DNA, 25 bp, Mus musculus
aggggctgcctgcctacagactaca

SEQ ID NO: 200969 - DNA, 25 bp, Mus musculus
aggggctgcggcagcaagaacagaa

SEQ ID NO: 200970 - DNA, 25 bp, Mus musculus
aggggctgcggcagcacgtctgact

SEQ ID NO: 200971 - DNA, 25 bp, Mus musculus
aggggctggctgaatcatgatgaaa

SEQ ID NO: 200972 - DNA, 25 bp, Mus musculus
aggggctgtcctgctaaggaagagc

SEQ ID NO: 200973 - DNA, 25 bp, Mus musculus
aggggctgttggacttcaagaaaag

SEQ ID NO: 200974 - DNA, 25 bp, Mus musculus
aggggcttcagacaccaatgactgc

SEQ ID NO: 200975 - DNA, 25 bp, Mus musculus
aggggcttcagagatcatgtgtgcc

SEQ ID NO: 200976 - DNA, 25 bp, Mus musculus
aggggcttgataaagggaggtatga

SEQ ID NO: 200977 - DNA, 25 bp, Mus musculus
aggggcttggcaaatggaatctata

SEQ ID NO: 200978 - DNA, 25 bp, Mus musculus
aggggctttcagggggactgcaggc

SEQ ID NO: 200979 - DNA, 25 bp, Mus musculus
agggggaaaccgaggactcagagag

SEQ ID NO: 200980 - DNA, 25 bp, Mus musculus
agggggacaagaggttgcctgcagg

SEQ ID NO: 200981 - DNA, 25 bp, Mus musculus
agggggacaaggttggggaggcgag

SEQ ID NO: 200982 - DNA, 25 bp, Mus musculus
agggggacagtgaggggacgatccg

SEQ ID NO: 200983 - DNA, 25 bp, Mus musculus
agggggacagttcagggagggaagg

SEQ ID NO: 200984 - DNA, 25 bp, Mus musculus
agggggagaagggccacattgggct

SEQ ID NO: 200985 - DNA, 25 bp, Mus musculus
agggggagatcttgacatcactgac

SEQ ID NO: 200986 - DNA, 25 bp, Mus musculus
agggggagatcttggtgatccgcag

SEQ ID NO: 200987 - DNA, 25 bp, Mus musculus
agggggagatgacggcagaggagag

SEQ ID NO: 200988 - DNA, 25 bp, Mus musculus
agggggatgaagtcattgagaagtt

SEQ ID NO: 200989 - DNA, 25 bp, Mus musculus
agggggatgtagcaggcgccctgga

SEQ ID NO: 200990 - DNA, 25 bp, Mus musculus
agggggattgggaagagaacagaca

SEQ ID NO: 200991 - DNA, 25 bp, Mus musculus
agggggcaaagccaggaggaagcct

SEQ ID NO: 200992 - DNA, 25 bp, Mus musculus
agggggcaagcggttcagtacctct

SEQ ID NO: 200993 - DNA, 25 bp, Mus musculus
agggggcaaggctctgctccccctg

SEQ ID NO: 200994 - DNA, 25 bp, Mus musculus
agggggcaagggtggaccacttgga

SEQ ID NO: 200995 - DNA, 25 bp, Mus musculus
agggggcagaagaggaggtggctta

SEQ ID NO: 200996 - DNA, 25 bp, Mus musculus
agggggcaggcagccactcccgaga

SEQ ID NO: 200997 - DNA, 25 bp, Mus musculus
agggggccaggtgagttggagtgag

SEQ ID NO: 200998 - DNA, 25 bp, Mus musculus
agggggcccagaaccagggcaagaa

SEQ ID NO: 200999 - DNA, 25 bp, Mus musculus
agggggcctatacgctgcctggctc

SEQ ID NO: 201000 - DNA, 25 bp, Mus musculus
agggggcctggtccatcccgtggaa

SEQ ID NO: 201001 - DNA, 25 bp, Mus musculus
agggggccttcaaccgaaacaagct

SEQ ID NO: 201002 - DNA, 25 bp, Mus musculus
agggggcgcgcaggtgtccacagaa

SEQ ID NO: 201003 - DNA, 25 bp, Mus musculus
agggggcgcgcgcgtgacgagtgac

SEQ ID NO: 201004 - DNA, 25 bp, Mus musculus
agggggctctgaggttgaactggag

SEQ ID NO: 201005 - DNA, 25 bp, Mus musculus
agggggctgacggacgagtccggct

SEQ ID NO: 201006 - DNA, 25 bp, Mus musculus
agggggctgacggtcgaagaaagcc

SEQ ID NO: 201007 - DNA, 25 bp, Mus musculus
aggggggcccagattcacaacatca

SEQ ID NO: 201008 - DNA, 25 bp, Mus musculus
agggggggatctgatggatacggaa

SEQ ID NO: 201009 - DNA, 25 bp, Mus musculus
agggggtaaatgtgattagtgttaa

SEQ ID NO: 201010 - DNA, 25 bp, Mus musculus
agggggtaagggaggccgctcacga

SEQ ID NO: 201011 - DNA, 25 bp, Mus musculus
agggggtcagctagaagagtccttg

SEQ ID NO: 201012 - DNA, 25 bp, Mus musculus
agggggtccggatcaaaagccccag

SEQ ID NO: 201013 - DNA, 25 bp, Mus musculus
agggggtgcaggaaggtgtgaaaca

SEQ ID NO: 201014 - DNA, 25 bp, Mus musculus
agggggtgtcgagcccagccagtgg

SEQ ID NO: 201015 - DNA, 25 bp, Mus musculus
agggggttccgcgcgcttgggaccg

SEQ ID NO: 201016 - DNA, 25 bp, Mus musculus
agggggttccgcgcggagaatgact

SEQ ID NO: 201017 - DNA, 25 bp, Mus musculus
aggggtaaagatctaagctggaacc

SEQ ID NO: 201018 - DNA, 25 bp, Mus musculus
aggggtaagcacagctctgcccacc

SEQ ID NO: 201019 - DNA, 25 bp, Mus musculus
aggggtaagcacaggatcacgtggc

SEQ ID NO: 201020 - DNA, 25 bp, Mus musculus
aggggtcaaaattgacaagactgac

SEQ ID NO: 201021 - DNA, 25 bp, Mus musculus
aggggtcacaatcaggttgactctt

SEQ ID NO: 201022 - DNA, 25 bp, Mus musculus
aggggtcaggaggcgggagccttgg

SEQ ID NO: 201023 - DNA, 25 bp, Mus musculus
aggggtcaggctccttccgatgagc

SEQ ID NO: 201024 - DNA, 25 bp, Mus musculus
aggggtcgcacagaggaagccgtga

SEQ ID NO: 201025 - DNA, 25 bp, Mus musculus
aggggtctgaagtcaaataccttca

SEQ ID NO: 201026 - DNA, 25 bp, Mus musculus
aggggtgaagactgaaccaataacg

SEQ ID NO: 201027 - DNA, 25 bp, Mus musculus
aggggtgaagagggtcaacaggaca

SEQ ID NO: 201028 - DNA, 25 bp, Mus musculus
aggggtgaggacacgagttgcattg

SEQ ID NO: 201029 - DNA, 25 bp, Mus musculus
aggggtgcaagaactgccccattga

SEQ ID NO: 201030 - DNA, 25 bp, Mus musculus
aggggtgcaagggcttcttccgccg

SEQ ID NO: 201031 - DNA, 25 bp, Mus musculus
aggggtgccctaagtatccagcatg

SEQ ID NO: 201032 - DNA, 25 bp, Mus musculus
aggggtgccctgtggtaagcgagat

SEQ ID NO: 201033 - DNA, 25 bp, Mus musculus
aggggtggaaaatgacattcccatg

SEQ ID NO: 201034 - DNA, 25 bp, Mus musculus
aggggtggaagccccaggcctggtg

SEQ ID NO: 201035 - DNA, 25 bp, Mus musculus
aggggtggcagactctcttctgcag

SEQ ID NO: 201036 - DNA, 25 bp, Mus musculus
aggggtggcaggcgcaccaaccctt

SEQ ID NO: 201037 - DNA, 25 bp, Mus musculus
aggggtggcggctcctccaggcgct

SEQ ID NO: 201038 - DNA, 25 bp, Mus musculus
aggggtgggagatccgaattcgaga

SEQ ID NO: 201039 - DNA, 25 bp, Mus musculus
aggggtggtcgggctcagaaagtgc

SEQ ID NO: 201040 - DNA, 25 bp, Mus musculus
aggggtggtcggtggatggcttgct

SEQ ID NO: 201041 - DNA, 25 bp, Mus musculus
aggggtggtgacgtgctgtgtgacg

SEQ ID NO: 201042 - DNA, 25 bp, Mus musculus
aggggtgtccgtaaacttgggtgct

SEQ ID NO: 201043 - DNA, 25 bp, Mus musculus
aggggtgtccgtaaagaagaacaca

SEQ ID NO: 201044 - DNA, 25 bp, Mus musculus
aggggttagcacttggtgtggagaa

SEQ ID NO: 201045 - DNA, 25 bp, Mus musculus
aggggttatctggccgttcctcagt

SEQ ID NO: 201046 - DNA, 25 bp, Mus musculus
aggggttcaattccagccatattga

SEQ ID NO: 201047 - DNA, 25 bp, Mus musculus
aggggttcagatgccccatataggc

SEQ ID NO: 201048 - DNA, 25 bp, Mus musculus
aggggttcagccaacaattctcttg

SEQ ID NO: 201049 - DNA, 25 bp, Mus musculus
aggggttccgggtggacaagattgt

SEQ ID NO: 201050 - DNA, 25 bp, Mus musculus
aggggttcgcctgaggattggatgg

SEQ ID NO: 201051 - DNA, 25 bp, Mus musculus
aggggttgaagacgttgatgtcagt

SEQ ID NO: 201052 - DNA, 25 bp, Mus musculus
aggggttgcacaggatttccctaga

SEQ ID NO: 201053 - DNA, 25 bp, Mus musculus
aggggttgcacaggtgaagatcatg

SEQ ID NO: 201054 - DNA, 25 bp, Mus musculus
aggggttggatcagaggagtccctg

SEQ ID NO: 201055 - DNA, 25 bp, Mus musculus
aggggttggtgatggattcatgggt

SEQ ID NO: 201056 - DNA, 25 bp, Mus musculus
aggggtttcaggcagaaaatgtaac

SEQ ID NO: 201057 - DNA, 25 bp, Mus musculus
aggggtttcaggtctgcattacatt

SEQ ID NO: 201058 - DNA, 25 bp, Mus musculus
aggggtttgactcgcacatccttgt

SEQ ID NO: 201059 - DNA, 25 bp, Mus musculus
agggtaactgtcgaggaagttttct

SEQ ID NO: 201060 - DNA, 25 bp, Mus musculus
agggtaaggatcctgtttgaagaca

SEQ ID NO: 201061 - DNA, 25 bp, Mus musculus
agggtaaggatggagatcccccagg

SEQ ID NO: 201062 - DNA, 25 bp, Mus musculus
agggtaatggcaaagggagttttgt

SEQ ID NO: 201063 - DNA, 25 bp, Mus musculus
agggtacattcctgagccagtccta

SEQ ID NO: 201064 - DNA, 25 bp, Mus musculus
agggtacattcctgagccgggataa

SEQ ID NO: 201065 - DNA, 25 bp, Mus musculus
agggtaccgcgagatactactcgtc

SEQ ID NO: 201066 - DNA, 25 bp, Mus musculus
agggtagaaaaaagatgacctcaat

SEQ ID NO: 201067 - DNA, 25 bp, Mus musculus
agggtagaccttctgtctagtgaca

SEQ ID NO: 201068 - DNA, 25 bp, Mus musculus
agggtagaccttgtgtctagtgaca

SEQ ID NO: 201069 - DNA, 25 bp, Mus musculus
agggtagagacacagagaacacact

SEQ ID NO: 201070 - DNA, 25 bp, Mus musculus
agggtagagacacaggcaccatttt

SEQ ID NO: 201071 - DNA, 25 bp, Mus musculus
agggtagagacggggccctagctgc

SEQ ID NO: 201072 - DNA, 25 bp, Mus musculus
agggtagcaggagctgcaaagttgg

SEQ ID NO: 201073 - DNA, 25 bp, Mus musculus
agggtaggagggtgggatggagatt

SEQ ID NO: 201074 - DNA, 25 bp, Mus musculus
agggtagtcactgactgtatccagg

SEQ ID NO: 201075 - DNA, 25 bp, Mus musculus
agggtagtgggagccctcgtagacc

SEQ ID NO: 201076 - DNA, 25 bp, Mus musculus
agggtagttaaagagggctgtcctg

SEQ ID NO: 201077 - DNA, 25 bp, Mus musculus
agggtatcgacaggtacaatcctga

SEQ ID NO: 201078 - DNA, 25 bp, Mus musculus
agggtatcgacaggtaccagttcaa

SEQ ID NO: 201079 - DNA, 25 bp, Mus musculus
agggtattcaaacacatagacattt

SEQ ID NO: 201080 - DNA, 25 bp, Mus musculus
agggtcaaagccatctgtccctcaa

SEQ ID NO: 201081 - DNA, 25 bp, Mus musculus
agggtcaaaggataattccttaagg

SEQ ID NO: 201082 - DNA, 25 bp, Mus musculus
agggtcaaaggccacattgaatttg

SEQ ID NO: 201083 - DNA, 25 bp, Mus musculus
agggtcaacgagcctggtgccttct

SEQ ID NO: 201084 - DNA, 25 bp, Mus musculus
agggtcacagaaaccggcgatgagg

SEQ ID NO: 201085 - DNA, 25 bp, Mus musculus
agggtcacagaggttacccaggcct

SEQ ID NO: 201086 - DNA, 25 bp, Mus musculus
agggtcacaggctctgtgggtgagt

SEQ ID NO: 201087 - DNA, 25 bp, Mus musculus
agggtcacctctggaagcaaagctg

SEQ ID NO: 201088 - DNA, 25 bp, Mus musculus
agggtcacctctggggcccaggatg

SEQ ID NO: 201089 - DNA, 25 bp, Mus musculus
agggtcacctctgttggcgaatgcc

SEQ ID NO: 201090 - DNA, 25 bp, Mus musculus
agggtcactacagtgacagagattg

SEQ ID NO: 201091 - DNA, 25 bp, Mus musculus
agggtcactgtgactccagctccgt

SEQ ID NO: 201092 - DNA, 25 bp, Mus musculus
agggtcagagggacctctgttctcc

SEQ ID NO: 201093 - DNA, 25 bp, Mus musculus
agggtcagcttcggtttgctgccaa

SEQ ID NO: 201094 - DNA, 25 bp, Mus musculus
agggtcaggtgcaaaatggaacact

SEQ ID NO: 201095 - DNA, 25 bp, Mus musculus
agggtcaggtgcaagtgcagaatgg

SEQ ID NO: 201096 - DNA, 25 bp, Mus musculus
agggtcataggcacagaccaagcgg

SEQ ID NO: 201097 - DNA, 25 bp, Mus musculus
agggtcatgacactgaacctgcagc

SEQ ID NO: 201098 - DNA, 25 bp, Mus musculus
agggtcatgggatggctgcactgcc

SEQ ID NO: 201099 - DNA, 25 bp, Mus musculus
agggtcattggaggccttgagaaga

SEQ ID NO: 201100 - DNA, 25 bp, Mus musculus
agggtcattggaggtgtccatcata

SEQ ID NO: 201101 - DNA, 25 bp, Mus musculus
agggtccacatggtgatatcatggg

SEQ ID NO: 201102 - DNA, 25 bp, Mus musculus
agggtccacctggtgctacagggtt

SEQ ID NO: 201103 - DNA, 25 bp, Mus musculus
agggtccagactcgctttgaattca

SEQ ID NO: 201104 - DNA, 25 bp, Mus musculus
agggtccagagtgggtcatatcgga

SEQ ID NO: 201105 - DNA, 25 bp, Mus musculus
agggtcccagaagggtcagaaagca

SEQ ID NO: 201106 - DNA, 25 bp, Mus musculus
agggtcccagagagctgatggccag

SEQ ID NO: 201107 - DNA, 25 bp, Mus musculus
agggtccctaagagctctcttccgg

SEQ ID NO: 201108 - DNA, 25 bp, Mus musculus
agggtccctttgcacttggaatctc

SEQ ID NO: 201109 - DNA, 25 bp, Mus musculus
agggtccgagattgtctaaagccac

SEQ ID NO: 201110 - DNA, 25 bp, Mus musculus
agggtcctggcaggaagatttattg

SEQ ID NO: 201111 - DNA, 25 bp, Mus musculus
agggtcctggcaggggcagtaattg

SEQ ID NO: 201112 - DNA, 25 bp, Mus musculus
agggtcctgtgtgatctcagtaagt

SEQ ID NO: 201113 - DNA, 25 bp, Mus musculus
agggtcgagctgtcagagaagcttc

SEQ ID NO: 201114 - DNA, 25 bp, Mus musculus
agggtcgtttctgagtgagatccca

SEQ ID NO: 201115 - DNA, 25 bp, Mus musculus
agggtctatgataaggtacaaaatg

SEQ ID NO: 201116 - DNA, 25 bp, Mus musculus
agggtctcaataggtcttgtgtgat

SEQ ID NO: 201117 - DNA, 25 bp, Mus musculus
agggtctctgagtggaggtgaagcc

SEQ ID NO: 201118 - DNA, 25 bp, Mus musculus
agggtctgcaggtcttgtagaaatt

SEQ ID NO: 201119 - DNA, 25 bp, Mus musculus
agggtctgtacaaggttttgaatcc

SEQ ID NO: 201120 - DNA, 25 bp, Mus musculus
agggtcttatctcgagttgggaacc

SEQ ID NO: 201121 - DNA, 25 bp, Mus musculus
agggtcttatctcgatgaggtctca

SEQ ID NO: 201122 - DNA, 25 bp, Mus musculus
agggtcttatctcggttacacctgt

SEQ ID NO: 201123 - DNA, 25 bp, Mus musculus
agggtcttcctggtgcagtggggac

SEQ ID NO: 201124 - DNA, 25 bp, Mus musculus
agggtgaaaagggtgacataggaca

SEQ ID NO: 201125 - DNA, 25 bp, Mus musculus
agggtgaaaggggaacatctcaagt

SEQ ID NO: 201126 - DNA, 25 bp, Mus musculus
agggtgaaagggtgggatgctatgg

SEQ ID NO: 201127 - DNA, 25 bp, Mus musculus
agggtgaacaaggtgttccaggaag

SEQ ID NO: 201128 - DNA, 25 bp, Mus musculus
agggtgaacagggtgcctctggtga

SEQ ID NO: 201129 - DNA, 25 bp, Mus musculus
agggtgaagcaggagcttctggaag

SEQ ID NO: 201130 - DNA, 25 bp, Mus musculus
agggtgaccgaggtggcataggaga

SEQ ID NO: 201131 - DNA, 25 bp, Mus musculus
agggtgacgcgacagaaaccgccca

SEQ ID NO: 201132 - DNA, 25 bp, Mus musculus
agggtgacgcgacagcacaccacat

SEQ ID NO: 201133 - DNA, 25 bp, Mus musculus
agggtgagtttgaaaccaggaaaat

SEQ ID NO: 201134 - DNA, 25 bp, Mus musculus
agggtgatcgaggggctgacatgga

SEQ ID NO: 201135 - DNA, 25 bp, Mus musculus
agggtgatggtgaggtctagtgaca

SEQ ID NO: 201136 - DNA, 25 bp, Mus musculus
agggtgattgcgcaggccttcagaa

SEQ ID NO: 201137 - DNA, 25 bp, Mus musculus
agggtgcaaaaggtaccagcaaggt

SEQ ID NO: 201138 - DNA, 25 bp, Mus musculus
agggtgcaagatgatgacttctggt

SEQ ID NO: 201139 - DNA, 25 bp, Mus musculus
agggtgcaagccagcccttcagcag

SEQ ID NO: 201140 - DNA, 25 bp, Mus musculus
agggtgcacaggaaatactggggct

SEQ ID NO: 201141 - DNA, 25 bp, Mus musculus
agggtgcagaagttccctcaacccc

SEQ ID NO: 201142 - DNA, 25 bp, Mus musculus
agggtgcagcggccagaagatgcat

SEQ ID NO: 201143 - DNA, 25 bp, Mus musculus
agggtgcatgaaaggccgcaccatg

SEQ ID NO: 201144 - DNA, 25 bp, Mus musculus
agggtgccaaaaaggccaacaagat

SEQ ID NO: 201145 - DNA, 25 bp, Mus musculus
agggtgccagccagtgtacgatccc

SEQ ID NO: 201146 - DNA, 25 bp, Mus musculus
agggtgcccagtgctaggagaccat

SEQ ID NO: 201147 - DNA, 25 bp, Mus musculus
agggtgcccatggaggtcctgtcca

SEQ ID NO: 201148 - DNA, 25 bp, Mus musculus
agggtgcccgtgacaaatgaagaga

SEQ ID NO: 201149 - DNA, 25 bp, Mus musculus
agggtgcgcacagaactcaggggca

SEQ ID NO: 201150 - DNA, 25 bp, Mus musculus
agggtgcgcacagatgactggttta

SEQ ID NO: 201151 - DNA, 25 bp, Mus musculus
agggtgctcctggaaaacggggtgc

SEQ ID NO: 201152 - DNA, 25 bp, Mus musculus
agggtggaagaaaggcttggggcat

SEQ ID NO: 201153 - DNA, 25 bp, Mus musculus
agggtggagttctagtttggattaa

SEQ ID NO: 201154 - DNA, 25 bp, Mus musculus
agggtggatcgagaacactgtagct

SEQ ID NO: 201155 - DNA, 25 bp, Mus musculus
agggtggatcgagatggttgtgagc

SEQ ID NO: 201156 - DNA, 25 bp, Mus musculus
agggtggcagggggacacctggaaa

SEQ ID NO: 201157 - DNA, 25 bp, Mus musculus
agggtggcatacacagagattgact

SEQ ID NO: 201158 - DNA, 25 bp, Mus musculus
agggtggcatctacccagctgggtt

SEQ ID NO: 201159 - DNA, 25 bp, Mus musculus
agggtggcggggccctccatgatga

SEQ ID NO: 201160 - DNA, 25 bp, Mus musculus
agggtgggattattagatttagagc

SEQ ID NO: 201161 - DNA, 25 bp, Mus musculus
agggtggtcaggaaggtctatatgg

SEQ ID NO: 201162 - DNA, 25 bp, Mus musculus
agggtgtaccagcctccagctcaag

SEQ ID NO: 201163 - DNA, 25 bp, Mus musculus
agggtgtcaaccaggaacctggctc

SEQ ID NO: 201164 - DNA, 25 bp, Mus musculus
agggtgtcttctaatgttctgatgg

SEQ ID NO: 201165 - DNA, 25 bp, Mus musculus
agggtgtgcaagggcgaccagggcg

SEQ ID NO: 201166 - DNA, 25 bp, Mus musculus
agggtgtggtgggccgagccgccag

SEQ ID NO: 201167 - DNA, 25 bp, Mus musculus
agggtgttgtagcatcttggttgcc

SEQ ID NO: 201168 - DNA, 25 bp, Mus musculus
agggtgttgtagctgctcctcacag

SEQ ID NO: 201169 - DNA, 25 bp, Mus musculus
agggttaaaggagacattccaaatg

SEQ ID NO: 201170 - DNA, 25 bp, Mus musculus
agggttacagacagggtttctctgc

SEQ ID NO: 201171 - DNA, 25 bp, Mus musculus
agggttacagatgctctctgatgca

SEQ ID NO: 201172 - DNA, 25 bp, Mus musculus
agggttatgataaggactatgtcag

SEQ ID NO: 201173 - DNA, 25 bp, Mus musculus
agggttatgataagtacatggagag

SEQ ID NO: 201174 - DNA, 25 bp, Mus musculus
agggttcacaggcacactggcaacc

SEQ ID NO: 201175 - DNA, 25 bp, Mus musculus
agggttcaccagataaatttaacac

SEQ ID NO: 201176 - DNA, 25 bp, Mus musculus
agggttcaggaggggtgagtcagaa

SEQ ID NO: 201177 - DNA, 25 bp, Mus musculus
agggttccagggacttcctggccct

SEQ ID NO: 201178 - DNA, 25 bp, Mus musculus
agggttccctgatctatgaggactc

SEQ ID NO: 201179 - DNA, 25 bp, Mus musculus
agggttccggaaggttccatgatgg

SEQ ID NO: 201180 - DNA, 25 bp, Mus musculus
agggttccttcaagagcatgctggg

SEQ ID NO: 201181 - DNA, 25 bp, Mus musculus
agggttccttcaagggacttcctcg

SEQ ID NO: 201182 - DNA, 25 bp, Mus musculus
agggttctccaagtgttgaatcata

SEQ ID NO: 201183 - DNA, 25 bp, Mus musculus
agggttctctgtaagttctccctgt

SEQ ID NO: 201184 - DNA, 25 bp, Mus musculus
agggttgatcttaagatgtcagtag

SEQ ID NO: 201185 - DNA, 25 bp, Mus musculus
agggttgatcttaaggatcgagagc

SEQ ID NO: 201186 - DNA, 25 bp, Mus musculus
agggttgggaaggttctggctgccc

SEQ ID NO: 201187 - DNA, 25 bp, Mus musculus
agggttgtgatgggaggctcctatg

SEQ ID NO: 201188 - DNA, 25 bp, Mus musculus
agggttgtgatgggcggctcctatg

SEQ ID NO: 201189 - DNA, 25 bp, Mus musculus
agggtttacaaaggagcagccatgt

SEQ ID NO: 201190 - DNA, 25 bp, Mus musculus
agggtttacaaggacatatggagat

SEQ ID NO: 201191 - DNA, 25 bp, Mus musculus
agggtttgaatgtatcgcaaacgct

SEQ ID NO: 201192 - DNA, 25 bp, Mus musculus
agggtttgagagaatcgcacgtcca

SEQ ID NO: 201193 - DNA, 25 bp, Mus musculus
agggtttgttactaggattgaaatt

SEQ ID NO: 201194 - DNA, 25 bp, Mus musculus
agggtttgttcagtcgacctgataa

SEQ ID NO: 201195 - DNA, 25 bp, Mus musculus
aggtaaaaatggattagtcgtatct

SEQ ID NO: 201196 - DNA, 25 bp, Mus musculus
aggtaaaactgattgactggggaaa

SEQ ID NO: 201197 - DNA, 25 bp, Mus musculus
aggtaaactgcaggttgtcctggtg

SEQ ID NO: 201198 - DNA, 25 bp, Mus musculus
aggtaaagacagagctctgaaaggg

SEQ ID NO: 201199 - DNA, 25 bp, Mus musculus
aggtaaagacagtggattttgctgc

SEQ ID NO: 201200 - DNA, 25 bp, Mus musculus
aggtaaatgagatcatgattctgga

SEQ ID NO: 201201 - DNA, 25 bp, Mus musculus
aggtaactacggagatcagcaggct

SEQ ID NO: 201202 - DNA, 25 bp, Mus musculus
aggtaagaaggcaatggcaagccgg

SEQ ID NO: 201203 - DNA, 25 bp, Mus musculus
aggtaagaaggctcagcggaacctg

SEQ ID NO: 201204 - DNA, 25 bp, Mus musculus
aggtaagagagatctggagctgcta

SEQ ID NO: 201205 - DNA, 25 bp, Mus musculus
aggtaagcacacccagaactgagca

SEQ ID NO: 201206 - DNA, 25 bp, Mus musculus
aggtaagcacacccaggtgccagcc

SEQ ID NO: 201207 - DNA, 25 bp, Mus musculus
aggtaagcagacagatgagcgttcg

SEQ ID NO: 201208 - DNA, 25 bp, Mus musculus
aggtaagcgaagagaggaagcggga

SEQ ID NO: 201209 - DNA, 25 bp, Mus musculus
aggtaaggaaagcagcccataccca

SEQ ID NO: 201210 - DNA, 25 bp, Mus musculus
aggtaaggtaagatctcaagcatac

SEQ ID NO: 201211 - DNA, 25 bp, Mus musculus
aggtaatgattcagagacctgcttc

SEQ ID NO: 201212 - DNA, 25 bp, Mus musculus
aggtaatgattcagatatcctgtta

SEQ ID NO: 201213 - DNA, 25 bp, Mus musculus
aggtaatgttgggaggaaagaagac

SEQ ID NO: 201214 - DNA, 25 bp, Mus musculus
aggtaattgcgctccagatgaaaat

SEQ ID NO: 201215 - DNA, 25 bp, Mus musculus
aggtacaagacaacactgcttatct

SEQ ID NO: 201216 - DNA, 25 bp, Mus musculus
aggtacaagagggaagaagaagacc

SEQ ID NO: 201217 - DNA, 25 bp, Mus musculus
aggtacaaggaaggaaaagatggca

SEQ ID NO: 201218 - DNA, 25 bp, Mus musculus
aggtacacaggcgcaggtctgagcg

SEQ ID NO: 201219 - DNA, 25 bp, Mus musculus
aggtacagagaccaggtctttggcc

SEQ ID NO: 201220 - DNA, 25 bp, Mus musculus
aggtacagatcatattgatcagtgg

SEQ ID NO: 201221 - DNA, 25 bp, Mus musculus
aggtacagcacaataaaacccaagc

SEQ ID NO: 201222 - DNA, 25 bp, Mus musculus
aggtacaggcaggcaaaggctcggg

SEQ ID NO: 201223 - DNA, 25 bp, Mus musculus
aggtacaggctcaggaggcctttcc

SEQ ID NO: 201224 - DNA, 25 bp, Mus musculus
aggtacatacctagggatgccctgg

SEQ ID NO: 201225 - DNA, 25 bp, Mus musculus
aggtacatctatcagccatggcgag

SEQ ID NO: 201226 - DNA, 25 bp, Mus musculus
aggtaccacaggtaatctagctgcc

SEQ ID NO: 201227 - DNA, 25 bp, Mus musculus
aggtaccagatagaggctgatctta

SEQ ID NO: 201228 - DNA, 25 bp, Mus musculus
aggtaccagatagaggtctccctgt

SEQ ID NO: 201229 - DNA, 25 bp, Mus musculus
aggtaccagtggctacctccctccc

SEQ ID NO: 201230 - DNA, 25 bp, Mus musculus
aggtaccagttgcggatgagtacag

SEQ ID NO: 201231 - DNA, 25 bp, Mus musculus
aggtaccataaacagtatggcggct

SEQ ID NO: 201232 - DNA, 25 bp, Mus musculus
aggtaccatttccaaggccgtgcag

SEQ ID NO: 201233 - DNA, 25 bp, Mus musculus
aggtaccccacacaagtcaaaggag

SEQ ID NO: 201234 - DNA, 25 bp, Mus musculus
aggtaccccacacaatgtttagttc

SEQ ID NO: 201235 - DNA, 25 bp, Mus musculus
aggtaccgcagaagttgcagaagct

SEQ ID NO: 201236 - DNA, 25 bp, Mus musculus
aggtacctaccaggtgaaacctttg

SEQ ID NO: 201237 - DNA, 25 bp, Mus musculus
aggtacctgctgcccctctcctggg

SEQ ID NO: 201238 - DNA, 25 bp, Mus musculus
aggtacggagctggtgggaggagtg

SEQ ID NO: 201239 - DNA, 25 bp, Mus musculus
aggtactacagtgtctaatgcacta

SEQ ID NO: 201240 - DNA, 25 bp, Mus musculus
aggtactcaagcgagctgcagcgaa

SEQ ID NO: 201241 - DNA, 25 bp, Mus musculus
aggtactcaaggtaggctgctttgg

SEQ ID NO: 201242 - DNA, 25 bp, Mus musculus
aggtactccaccgaacagtggccac

SEQ ID NO: 201243 - DNA, 25 bp, Mus musculus
aggtactctcttggacctatatcca

SEQ ID NO: 201244 - DNA, 25 bp, Mus musculus
aggtactgcttccggtgtggagaag

SEQ ID NO: 201245 - DNA, 25 bp, Mus musculus
aggtactgtcggaccagcagtgccg

SEQ ID NO: 201246 - DNA, 25 bp, Mus musculus
aggtagaaaagagaagcccgtgctt

SEQ ID NO: 201247 - DNA, 25 bp, Mus musculus
aggtagagccaaagaacaaattgga

SEQ ID NO: 201248 - DNA, 25 bp, Mus musculus
aggtagagcttgggattttctttga

SEQ ID NO: 201249 - DNA, 25 bp, Mus musculus
aggtagagcttggggttttatggca

SEQ ID NO: 201250 - DNA, 25 bp, Mus musculus
aggtagagcttgggtggtcgttgaa

SEQ ID NO: 201251 - DNA, 25 bp, Mus musculus
aggtagagtcacagaaatcactcaa

SEQ ID NO: 201252 - DNA, 25 bp, Mus musculus
aggtagatgcaggagatcccccaag

SEQ ID NO: 201253 - DNA, 25 bp, Mus musculus
aggtagatgctgagaggaaaaccaa

SEQ ID NO: 201254 - DNA, 25 bp, Mus musculus
aggtagattctggtttacaatctag

SEQ ID NO: 201255 - DNA, 25 bp, Mus musculus
aggtagcaaagggtgtggaatatta

SEQ ID NO: 201256 - DNA, 25 bp, Mus musculus
aggtagcagagcagagagatcaata

SEQ ID NO: 201257 - DNA, 25 bp, Mus musculus
aggtagcagagcaggggaagcactg

SEQ ID NO: 201258 - DNA, 25 bp, Mus musculus
aggtagcagatcagatgtggcaggc

SEQ ID NO: 201259 - DNA, 25 bp, Mus musculus
aggtagcagatcaggctcctggagt

SEQ ID NO: 201260 - DNA, 25 bp, Mus musculus
aggtagccaagcttgaggcggccct

SEQ ID NO: 201261 - DNA, 25 bp, Mus musculus
aggtagctgaagctgaacctgagcc

SEQ ID NO: 201262 - DNA, 25 bp, Mus musculus
aggtaggaagatgaggacctagttg

SEQ ID NO: 201263 - DNA, 25 bp, Mus musculus
aggtaggcaaaggtggaggaagagc

SEQ ID NO: 201264 - DNA, 25 bp, Mus musculus
aggtaggcctcgggacggcctcagg

SEQ ID NO: 201265 - DNA, 25 bp, Mus musculus
aggtaggctcagagtgcgatgcggt

SEQ ID NO: 201266 - DNA, 25 bp, Mus musculus
aggtaggctcagagttcgaggaagc

SEQ ID NO: 201267 - DNA, 25 bp, Mus musculus
aggtaggctgtcagccatcttaccc

SEQ ID NO: 201268 - DNA, 25 bp, Mus musculus
aggtagtcctccatgatcgtcctgc

SEQ ID NO: 201269 - DNA, 25 bp, Mus musculus
aggtagtcttgtcctgggtgggatt

SEQ ID NO: 201270 - DNA, 25 bp, Mus musculus
aggtataaaagcttatgcactggac

SEQ ID NO: 201271 - DNA, 25 bp, Mus musculus
aggtataaagtaactctaaatcttc

SEQ ID NO: 201272 - DNA, 25 bp, Mus musculus
aggtataatggcctcggccctgcga

SEQ ID NO: 201273 - DNA, 25 bp, Mus musculus
aggtatatgactcaattctacggtg

SEQ ID NO: 201274 - DNA, 25 bp, Mus musculus
aggtatccatgcggctgtgtggaga

SEQ ID NO: 201275 - DNA, 25 bp, Mus musculus
aggtatcgaggaattctataccttt

SEQ ID NO: 201276 - DNA, 25 bp, Mus musculus
aggtatctctgaagcactgcgcaag

SEQ ID NO: 201277 - DNA, 25 bp, Mus musculus
aggtatctgtgaagcttcttaaccc

SEQ ID NO: 201278 - DNA, 25 bp, Mus musculus
aggtatcttgatgtcagcccatcac

SEQ ID NO: 201279 - DNA, 25 bp, Mus musculus
aggtatgcctttccattggacaccc

SEQ ID NO: 201280 - DNA, 25 bp, Mus musculus
aggtatggctttttatttagaagaa

SEQ ID NO: 201281 - DNA, 25 bp, Mus musculus
aggtatgggagaacagaacactgaa

SEQ ID NO: 201282 - DNA, 25 bp, Mus musculus
aggtattcatgcaggtccacgcctc

SEQ ID NO: 201283 - DNA, 25 bp, Mus musculus
aggtattcatgccaggactactgtt

SEQ ID NO: 201284 - DNA, 25 bp, Mus musculus
aggtatttccaatcccgctcaaggt

SEQ ID NO: 201285 - DNA, 25 bp, Mus musculus
aggtcaaaagaaagaattcctgaga

SEQ ID NO: 201286 - DNA, 25 bp, Mus musculus
aggtcaaaagggagaacctggcatt

SEQ ID NO: 201287 - DNA, 25 bp, Mus musculus
aggtcaaatctcagagccccaagga

SEQ ID NO: 201288 - DNA, 25 bp, Mus musculus
aggtcaacaggcgcaacctggtgga

SEQ ID NO: 201289 - DNA, 25 bp, Mus musculus
aggtcaaccagggaaaatgccaagt

SEQ ID NO: 201290 - DNA, 25 bp, Mus musculus
aggtcaacggctggacctgtttaca

SEQ ID NO: 201291 - DNA, 25 bp, Mus musculus
aggtcaagagtgggccatgaactga

SEQ ID NO: 201292 - DNA, 25 bp, Mus musculus
aggtcaagccacagagcccaagatg

SEQ ID NO: 201293 - DNA, 25 bp, Mus musculus
aggtcaaggaaaacaaattgatgat

SEQ ID NO: 201294 - DNA, 25 bp, Mus musculus
aggtcaaggaaatggtggctgcgtt

SEQ ID NO: 201295 - DNA, 25 bp, Mus musculus
aggtcaagtcacaagctcctcagga

SEQ ID NO: 201296 - DNA, 25 bp, Mus musculus
aggtcaagtcacaaggacaaagtat

SEQ ID NO: 201297 - DNA, 25 bp, Mus musculus
aggtcaagtcagtaggacaaagtat

SEQ ID NO: 201298 - DNA, 25 bp, Mus musculus
aggtcaatgaggaagtaagtgcaaa

SEQ ID NO: 201299 - DNA, 25 bp, Mus musculus
aggtcaatgaggtggacatggaagg

SEQ ID NO: 201300 - DNA, 25 bp, Mus musculus
aggtcaatgggaagtcattcagctg

SEQ ID NO: 201301 - DNA, 25 bp, Mus musculus
aggtcaattatgaagagtttgtaca

SEQ ID NO: 201302 - DNA, 25 bp, Mus musculus
aggtcacaaccaaaaatactgaagc

SEQ ID NO: 201303 - DNA, 25 bp, Mus musculus
aggtcacaccgaggatgcgtccgaa

SEQ ID NO: 201304 - DNA, 25 bp, Mus musculus
aggtcacagaggacacaaaggtctt

SEQ ID NO: 201305 - DNA, 25 bp, Mus musculus
aggtcaccagcatgggattttgcat

SEQ ID NO: 201306 - DNA, 25 bp, Mus musculus
aggtcaccaggatgggattttgcat

SEQ ID NO: 201307 - DNA, 25 bp, Mus musculus
aggtcacccaggtcctgtccttggg

SEQ ID NO: 201308 - DNA, 25 bp, Mus musculus
aggtcacctgcagatactttatgca

SEQ ID NO: 201309 - DNA, 25 bp, Mus musculus
aggtcacgtaagcagagagtggctg

SEQ ID NO: 201310 - DNA, 25 bp, Mus musculus
aggtcacgtaagcagggtcttgaca

SEQ ID NO: 201311 - DNA, 25 bp, Mus musculus
aggtcacgtaagcagggtcttggag

SEQ ID NO: 201312 - DNA, 25 bp, Mus musculus
aggtcactaggggcttcagaagagc

SEQ ID NO: 201313 - DNA, 25 bp, Mus musculus
aggtcactgagggcggtgagccgta

SEQ ID NO: 201314 - DNA, 25 bp, Mus musculus
aggtcacttgccagctcctgtgcgg

SEQ ID NO: 201315 - DNA, 25 bp, Mus musculus
aggtcagaaaccgtggatgatgaaa

SEQ ID NO: 201316 - DNA, 25 bp, Mus musculus
aggtcagaaagcctctccgaccagt

SEQ ID NO: 201317 - DNA, 25 bp, Mus musculus
aggtcagaagattttgttgacctca

SEQ ID NO: 201318 - DNA, 25 bp, Mus musculus
aggtcagaaggtgtgttatattgaa

SEQ ID NO: 201319 - DNA, 25 bp, Mus musculus
aggtcagactgaggcaccaagtata

SEQ ID NO: 201320 - DNA, 25 bp, Mus musculus
aggtcagagacacctaccgctatgt

SEQ ID NO: 201321 - DNA, 25 bp, Mus musculus
aggtcagagtcggagtcttatttta

SEQ ID NO: 201322 - DNA, 25 bp, Mus musculus
aggtcagattgaaggtcagatgtac

SEQ ID NO: 201323 - DNA, 25 bp, Mus musculus
aggtcagcaggcgctttgccctgtc

SEQ ID NO: 201324 - DNA, 25 bp, Mus musculus
aggtcagccacagctgttctagctg

SEQ ID NO: 201325 - DNA, 25 bp, Mus musculus
aggtcagcgaggtattgaagcccct

SEQ ID NO: 201326 - DNA, 25 bp, Mus musculus
aggtcaggaaagaatccaccttgac

SEQ ID NO: 201327 - DNA, 25 bp, Mus musculus
aggtcaggacccagctgtggctaga

SEQ ID NO: 201328 - DNA, 25 bp, Mus musculus
aggtcaggcgggtgaacctggcatt

SEQ ID NO: 201329 - DNA, 25 bp, Mus musculus
aggtcagggccagggattctgggca

SEQ ID NO: 201330 - DNA, 25 bp, Mus musculus
aggtcagggccaggtgtctccagtg

SEQ ID NO: 201331 - DNA, 25 bp, Mus musculus
aggtcaggggggaggacctgtgtca

SEQ ID NO: 201332 - DNA, 25 bp, Mus musculus
aggtcagtaagggggtccaaggctg

SEQ ID NO: 201333 - DNA, 25 bp, Mus musculus
aggtcagtcaggacttgctagacct

SEQ ID NO: 201334 - DNA, 25 bp, Mus musculus
aggtcagtcattgggaagactcttc

SEQ ID NO: 201335 - DNA, 25 bp, Mus musculus
aggtcagtcctgggctgggccgtcg

SEQ ID NO: 201336 - DNA, 25 bp, Mus musculus
aggtcagtttttttgcattttgttc

SEQ ID NO: 201337 - DNA, 25 bp, Mus musculus
aggtcatagcagggtgttcttctgg

SEQ ID NO: 201338 - DNA, 25 bp, Mus musculus
aggtcatataagtgacattgaaact

SEQ ID NO: 201339 - DNA, 25 bp, Mus musculus
aggtcatataatgtcatatttgaag

SEQ ID NO: 201340 - DNA, 25 bp, Mus musculus
aggtcatcaacacagactttcctgc

SEQ ID NO: 201341 - DNA, 25 bp, Mus musculus
aggtcatcaagatgaacaggatgtc

SEQ ID NO: 201342 - DNA, 25 bp, Mus musculus
aggtcatcaagcagtgctatcaaga

SEQ ID NO: 201343 - DNA, 25 bp, Mus musculus
aggtcatcaaggacttcccatggat

SEQ ID NO: 201344 - DNA, 25 bp, Mus musculus
aggtcatcaagtcaggctcagatga

SEQ ID NO: 201345 - DNA, 25 bp, Mus musculus
aggtcatcaccaccggcgcctgttt

SEQ ID NO: 201346 - DNA, 25 bp, Mus musculus
aggtcatcctcttctatgcggcagg

SEQ ID NO: 201347 - DNA, 25 bp, Mus musculus
aggtcatcctcttctgagcattccg

SEQ ID NO: 201348 - DNA, 25 bp, Mus musculus
aggtcatctgagggaaagccaccca

SEQ ID NO: 201349 - DNA, 25 bp, Mus musculus
aggtcatctgcaaacagaagcgatg

SEQ ID NO: 201350 - DNA, 25 bp, Mus musculus
aggtcatgactgccatttgcttcac

SEQ ID NO: 201351 - DNA, 25 bp, Mus musculus
aggtcatgactggggtgatctgctt

SEQ ID NO: 201352 - DNA, 25 bp, Mus musculus
aggtcatgctcaaggacatggcaga

SEQ ID NO: 201353 - DNA, 25 bp, Mus musculus
aggtcatgctgaatgctaggtagaa

SEQ ID NO: 201354 - DNA, 25 bp, Mus musculus
aggtcattcataaagattgaggaag

SEQ ID NO: 201355 - DNA, 25 bp, Mus musculus
aggtcattctgtcagacccgccagg

SEQ ID NO: 201356 - DNA, 25 bp, Mus musculus
aggtcattgaccagaccaccgctct

SEQ ID NO: 201357 - DNA, 25 bp, Mus musculus
aggtcattggcgacagggttcccca

SEQ ID NO: 201358 - DNA, 25 bp, Mus musculus
aggtcattggggttccccagtgggt

SEQ ID NO: 201359 - DNA, 25 bp, Mus musculus
aggtcatttcaggggagcgtttgcc

SEQ ID NO: 201360 - DNA, 25 bp, Mus musculus
aggtccaagaaggtgaatgaatata

SEQ ID NO: 201361 - DNA, 25 bp, Mus musculus
aggtccaaggccatgaacacggctc

SEQ ID NO: 201362 - DNA, 25 bp, Mus musculus
aggtccaccagatgctgagcaacta

SEQ ID NO: 201363 - DNA, 25 bp, Mus musculus
aggtccacccaagggtacagcatgt

SEQ ID NO: 201364 - DNA, 25 bp, Mus musculus
aggtccacgtgagacatggcacaag

SEQ ID NO: 201365 - DNA, 25 bp, Mus musculus
aggtccacgtgagatccttcttacc

SEQ ID NO: 201366 - DNA, 25 bp, Mus musculus
aggtccagagaggtgtggagaggat

SEQ ID NO: 201367 - DNA, 25 bp, Mus musculus
aggtccagagcatgggggggaaagt

SEQ ID NO: 201368 - DNA, 25 bp, Mus musculus
aggtccaggactgaatctacccaaa

SEQ ID NO: 201369 - DNA, 25 bp, Mus musculus
aggtccaggagccaggtggtgtccc

SEQ ID NO: 201370 - DNA, 25 bp, Mus musculus
aggtccaggcagaggacagctcctc

SEQ ID NO: 201371 - DNA, 25 bp, Mus musculus
aggtccaggtccaggtcccgttcaa

SEQ ID NO: 201372 - DNA, 25 bp, Mus musculus
aggtccagttggaaatgaaatgttc

SEQ ID NO: 201373 - DNA, 25 bp, Mus musculus
aggtccatgaccgaaatgcgactgt

SEQ ID NO: 201374 - DNA, 25 bp, Mus musculus
aggtccattgggcatcatgaagcag

SEQ ID NO: 201375 - DNA, 25 bp, Mus musculus
aggtcccaaccaagctgctggaagc

SEQ ID NO: 201376 - DNA, 25 bp, Mus musculus
aggtcccaaccaaggaatcactgag

SEQ ID NO: 201377 - DNA, 25 bp, Mus musculus
aggtcccaagggtgcccctggagag

SEQ ID NO: 201378 - DNA, 25 bp, Mus musculus
aggtcccagcccaagttccaaagaa

SEQ ID NO: 201379 - DNA, 25 bp, Mus musculus
aggtcccagctggggtcggagcttc

SEQ ID NO: 201380 - DNA, 25 bp, Mus musculus
aggtccccaagagtgggccaagctg

SEQ ID NO: 201381 - DNA, 25 bp, Mus musculus
aggtccccaaggtatttctctgagt

SEQ ID NO: 201382 - DNA, 25 bp, Mus musculus
aggtcccccggtatagaacgtgtga

SEQ ID NO: 201383 - DNA, 25 bp, Mus musculus
aggtcccctctggatcataaagaca

SEQ ID NO: 201384 - DNA, 25 bp, Mus musculus
aggtcccgggcagcatccagcatgt

SEQ ID NO: 201385 - DNA, 25 bp, Mus musculus
aggtcccgtacccacatcacagctc

SEQ ID NO: 201386 - DNA, 25 bp, Mus musculus
aggtccctcactaaaagcaccttca

SEQ ID NO: 201387 - DNA, 25 bp, Mus musculus
aggtccgaagcaggctcctggagtc

SEQ ID NO: 201388 - DNA, 25 bp, Mus musculus
aggtccgaagtgctgactggtcact

SEQ ID NO: 201389 - DNA, 25 bp, Mus musculus
aggtccgagagcaggtctgcctggg

SEQ ID NO: 201390 - DNA, 25 bp, Mus musculus
aggtccgagagcagtggccacagtt

SEQ ID NO: 201391 - DNA, 25 bp, Mus musculus
aggtccgcaaagagaaaagatgaga

SEQ ID NO: 201392 - DNA, 25 bp, Mus musculus
aggtccgcaaagctccttctggccg

SEQ ID NO: 201393 - DNA, 25 bp, Mus musculus
aggtccgcaaagtggcatggatggt

SEQ ID NO: 201394 - DNA, 25 bp, Mus musculus
aggtccgccggtttcaacctcttgg

SEQ ID NO: 201395 - DNA, 25 bp, Mus musculus
aggtccggagttcgtgcctccggag

SEQ ID NO: 201396 - DNA, 25 bp, Mus musculus
aggtcctaaaaggtgcaactacatt

SEQ ID NO: 201397 - DNA, 25 bp, Mus musculus
aggtcctacaagggcctgtggacct

SEQ ID NO: 201398 - DNA, 25 bp, Mus musculus
aggtcctacagctataggccgtaca

SEQ ID NO: 201399 - DNA, 25 bp, Mus musculus
aggtcctactggaacaaatgcttcc

SEQ ID NO: 201400 - DNA, 25 bp, Mus musculus
aggtcctcacctccttcacttggcc

SEQ ID NO: 201401 - DNA, 25 bp, Mus musculus
aggtcctctacaagacaatgttcta

SEQ ID NO: 201402 - DNA, 25 bp, Mus musculus
aggtcctctacaagactgtgtacag

SEQ ID NO: 201403 - DNA, 25 bp, Mus musculus
aggtcctcttggctcagctgaagga

SEQ ID NO: 201404 - DNA, 25 bp, Mus musculus
aggtcctgaagcactcggggataaa

SEQ ID NO: 201405 - DNA, 25 bp, Mus musculus
aggtcctgaagcgcctgtgagagag

SEQ ID NO: 201406 - DNA, 25 bp, Mus musculus
aggtcctgaaggccgccggtgttaa

SEQ ID NO: 201407 - DNA, 25 bp, Mus musculus
aggtcctgacagaaatccatgcgac

SEQ ID NO: 201408 - DNA, 25 bp, Mus musculus
aggtcctgcgggttctccaggggag

SEQ ID NO: 201409 - DNA, 25 bp, Mus musculus
aggtcctggagctgaacaaggagca

SEQ ID NO: 201410 - DNA, 25 bp, Mus musculus
aggtcctgggctcttctctcacgtg

SEQ ID NO: 201411 - DNA, 25 bp, Mus musculus
aggtccttgaaatcaagatgctgtc

SEQ ID NO: 201412 - DNA, 25 bp, Mus musculus
aggtccttgagtggggactgtcagg

SEQ ID NO: 201413 - DNA, 25 bp, Mus musculus
aggtcctttcccagaaaaatatgcc

SEQ ID NO: 201414 - DNA, 25 bp, Mus musculus
aggtcgaaatgaaacttccagcaat

SEQ ID NO: 201415 - DNA, 25 bp, Mus musculus
aggtcgaaatgaaagttccagcaat

SEQ ID NO: 201416 - DNA, 25 bp, Mus musculus
aggtcgaacacatgggtcggagccc

SEQ ID NO: 201417 - DNA, 25 bp, Mus musculus
aggtcgaactagaaaccagtgctgt

SEQ ID NO: 201418 - DNA, 25 bp, Mus musculus
aggtcgaactagaacaccagcagtg

SEQ ID NO: 201419 - DNA, 25 bp, Mus musculus
aggtcgagcaggagcatagaagaca

SEQ ID NO: 201420 - DNA, 25 bp, Mus musculus
aggtcgagcccgtgacaccatagag

SEQ ID NO: 201421 - DNA, 25 bp, Mus musculus
aggtcgagggaagctaaagaagtaa

SEQ ID NO: 201422 - DNA, 25 bp, Mus musculus
aggtcgatgtgggcccagacccttc

SEQ ID NO: 201423 - DNA, 25 bp, Mus musculus
aggtcgcggctcccgatggaaatcc

SEQ ID NO: 201424 - DNA, 25 bp, Mus musculus
aggtcgctcaggacatcagcaactt

SEQ ID NO: 201425 - DNA, 25 bp, Mus musculus
aggtcgctcaggcttgcagatgggt

SEQ ID NO: 201426 - DNA, 25 bp, Mus musculus
aggtcggaaggctgcctctcgctgt

SEQ ID NO: 201427 - DNA, 25 bp, Mus musculus
aggtcggacaagctctactccaggg

SEQ ID NO: 201428 - DNA, 25 bp, Mus musculus
aggtcggacaaggaaacacagagag

SEQ ID NO: 201429 - DNA, 25 bp, Mus musculus
aggtcggaggaggtgggcgttgggc

SEQ ID NO: 201430 - DNA, 25 bp, Mus musculus
aggtcggaggaggttgctgaacgaa

SEQ ID NO: 201431 - DNA, 25 bp, Mus musculus
aggtcggcagaggtaaccatggaga

SEQ ID NO: 201432 - DNA, 25 bp, Mus musculus
aggtcggcctcgatgtggaggccac

SEQ ID NO: 201433 - DNA, 25 bp, Mus musculus
aggtcggcctcgcaatacttcgtgc

SEQ ID NO: 201434 - DNA, 25 bp, Mus musculus
aggtcgtaaaaatgagcatctgtaa

SEQ ID NO: 201435 - DNA, 25 bp, Mus musculus
aggtcgtaaaaattgaaatctctca

SEQ ID NO: 201436 - DNA, 25 bp, Mus musculus
aggtcgtaaggaggtgcctgcaggc

SEQ ID NO: 201437 - DNA, 25 bp, Mus musculus
aggtcgtagtcaaggcacatcccag

SEQ ID NO: 201438 - DNA, 25 bp, Mus musculus
aggtcgtccaatgccgagaccccag

SEQ ID NO: 201439 - DNA, 25 bp, Mus musculus
aggtcgtccagctgaagaacctgga

SEQ ID NO: 201440 - DNA, 25 bp, Mus musculus
aggtcgtccatgctggagttacagg

SEQ ID NO: 201441 - DNA, 25 bp, Mus musculus
aggtctaacttcagccagaggctcc

SEQ ID NO: 201442 - DNA, 25 bp, Mus musculus
aggtctcactgctaataaagacaaa

SEQ ID NO: 201443 - DNA, 25 bp, Mus musculus
aggtctcactggttggcgcatcctt

SEQ ID NO: 201444 - DNA, 25 bp, Mus musculus
aggtctccagggcctggaatgtcct

SEQ ID NO: 201445 - DNA, 25 bp, Mus musculus
aggtctcctcagatgaggaaactga

SEQ ID NO: 201446 - DNA, 25 bp, Mus musculus
aggtctcctggtcttatatccagat

SEQ ID NO: 201447 - DNA, 25 bp, Mus musculus
aggtctccttcaggctccatgttgg

SEQ ID NO: 201448 - DNA, 25 bp, Mus musculus
aggtctccttcagttaaagctagtc

SEQ ID NO: 201449 - DNA, 25 bp, Mus musculus
aggtctccttccatggctgtgaccc

SEQ ID NO: 201450 - DNA, 25 bp, Mus musculus
aggtctcgcagcacccagcaggctc

SEQ ID NO: 201451 - DNA, 25 bp, Mus musculus
aggtctctactgcctacaagaagac

SEQ ID NO: 201452 - DNA, 25 bp, Mus musculus
aggtctctactgcctatgtgaaaac

SEQ ID NO: 201453 - DNA, 25 bp, Mus musculus
aggtctctgaaggaacagtctgaga

SEQ ID NO: 201454 - DNA, 25 bp, Mus musculus
aggtctctgcaagaaaaggcaagag

SEQ ID NO: 201455 - DNA, 25 bp, Mus musculus
aggtctctgcaagaggtgttgtcgg

SEQ ID NO: 201456 - DNA, 25 bp, Mus musculus
aggtctgagagcccaacatgcaaat

SEQ ID NO: 201457 - DNA, 25 bp, Mus musculus
aggtctgatccaggggcaggtgagg

SEQ ID NO: 201458 - DNA, 25 bp, Mus musculus
aggtctgatccagtctgcctggaga

SEQ ID NO: 201459 - DNA, 25 bp, Mus musculus
aggtctgccaggatatagctcctct

SEQ ID NO: 201460 - DNA, 25 bp, Mus musculus
aggtctgcccctgcctaagcctgaa

SEQ ID NO: 201461 - DNA, 25 bp, Mus musculus
aggtctgctcagaaaaaactggcca

SEQ ID NO: 201462 - DNA, 25 bp, Mus musculus
aggtctgcttacccgccgcagctcc

SEQ ID NO: 201463 - DNA, 25 bp, Mus musculus
aggtctgcttacccggtacctggca

SEQ ID NO: 201464 - DNA, 25 bp, Mus musculus
aggtctgtaaaaaagcaacacgttt

SEQ ID NO: 201465 - DNA, 25 bp, Mus musculus
aggtctgttctgactgctgcagctg

SEQ ID NO: 201466 - DNA, 25 bp, Mus musculus
aggtcttaaatctggggaaggaagc

SEQ ID NO: 201467 - DNA, 25 bp, Mus musculus
aggtcttaaatctggttaactattt

SEQ ID NO: 201468 - DNA, 25 bp, Mus musculus
aggtcttaaatctgttcacacagaa

SEQ ID NO: 201469 - DNA, 25 bp, Mus musculus
aggtcttcaaggaaccagcacctgt

SEQ ID NO: 201470 - DNA, 25 bp, Mus musculus
aggtcttccagatcacagacctgtc

SEQ ID NO: 201471 - DNA, 25 bp, Mus musculus
aggtcttccaggcccaaagggtgag

SEQ ID NO: 201472 - DNA, 25 bp, Mus musculus
aggtcttccctagagatggctttcc

SEQ ID NO: 201473 - DNA, 25 bp, Mus musculus
aggtcttgacagaggatctccctca

SEQ ID NO: 201474 - DNA, 25 bp, Mus musculus
aggtcttgccaaggtgattcctcct

SEQ ID NO: 201475 - DNA, 25 bp, Mus musculus
aggtcttgggaggaggcttgaagat

SEQ ID NO: 201476 - DNA, 25 bp, Mus musculus
aggtcttgtgagtaacatttcactt

SEQ ID NO: 201477 - DNA, 25 bp, Mus musculus
aggtctttaagaagggctctgctaa

SEQ ID NO: 201478 - DNA, 25 bp, Mus musculus
aggtgaaaagaagaccttgtcctgg

SEQ ID NO: 201479 - DNA, 25 bp, Mus musculus
aggtgaaagagactcggatgacgcc

SEQ ID NO: 201480 - DNA, 25 bp, Mus musculus
aggtgaaagaggtgacagctactaa

SEQ ID NO: 201481 - DNA, 25 bp, Mus musculus
aggtgaaattggaactcctggccct

SEQ ID NO: 201482 - DNA, 25 bp, Mus musculus
aggtgaacaatgcagcagcaagtcc

SEQ ID NO: 201483 - DNA, 25 bp, Mus musculus
aggtgaacatttctgtattactatg

SEQ ID NO: 201484 - DNA, 25 bp, Mus musculus
aggtgaactcagacaaggtctgggt

SEQ ID NO: 201485 - DNA, 25 bp, Mus musculus
aggtgaactcaggttcttgctatgc

SEQ ID NO: 201486 - DNA, 25 bp, Mus musculus
aggtgaagagcaaatttgacgccga

SEQ ID NO: 201487 - DNA, 25 bp, Mus musculus
aggtgaagcagaatgatatggaacc

SEQ ID NO: 201488 - DNA, 25 bp, Mus musculus
aggtgaagcatgatcagcaagtcgc

SEQ ID NO: 201489 - DNA, 25 bp, Mus musculus
aggtgaagcatggggccactgtctt

SEQ ID NO: 201490 - DNA, 25 bp, Mus musculus
aggtgaagctcagaaacttgattga

SEQ ID NO: 201491 - DNA, 25 bp, Mus musculus
aggtgaagcttggctgctgtgaagg

SEQ ID NO: 201492 - DNA, 25 bp, Mus musculus
aggtgaaggaatacgtgctgcccag

SEQ ID NO: 201493 - DNA, 25 bp, Mus musculus
aggtgaaggagaaaggcgccctggc

SEQ ID NO: 201494 - DNA, 25 bp, Mus musculus
aggtgaaggagaaaggcgctgactt

SEQ ID NO: 201495 - DNA, 25 bp, Mus musculus
aggtgacaaagcaggtaaacactgg

SEQ ID NO: 201496 - DNA, 25 bp, Mus musculus
aggtgacaacgaaaatatctgcaga

SEQ ID NO: 201497 - DNA, 25 bp, Mus musculus
aggtgacaaggaaggagctttgaca

SEQ ID NO: 201498 - DNA, 25 bp, Mus musculus
aggtgacaagggcaggctgctgtca

SEQ ID NO: 201499 - DNA, 25 bp, Mus musculus
aggtgacatttgaaaatgtcaagga

SEQ ID NO: 201500 - DNA, 25 bp, Mus musculus
aggtgaccagggtattcctggtgaa

SEQ ID NO: 201501 - DNA, 25 bp, Mus musculus
aggtgaccagtgtgagaagaaacgg

SEQ ID NO: 201502 - DNA, 25 bp, Mus musculus
aggtgaccattgaagatgatgacta

SEQ ID NO: 201503 - DNA, 25 bp, Mus musculus
aggtgacctgtgacatccggctccg

SEQ ID NO: 201504 - DNA, 25 bp, Mus musculus
aggtgacctgtgatggggaaacagg

SEQ ID NO: 201505 - DNA, 25 bp, Mus musculus
aggtgaccttggaggatttgaggcg

SEQ ID NO: 201506 - DNA, 25 bp, Mus musculus
aggtgacgctgggttgccccggagg

SEQ ID NO: 201507 - DNA, 25 bp, Mus musculus
aggtgactccaaggacaagaccagt

SEQ ID NO: 201508 - DNA, 25 bp, Mus musculus
aggtgactccaggagcagttcctcc

SEQ ID NO: 201509 - DNA, 25 bp, Mus musculus
aggtgactccaggaggagcgacagt

SEQ ID NO: 201510 - DNA, 25 bp, Mus musculus
aggtgactccaggaggcttccagct

SEQ ID NO: 201511 - DNA, 25 bp, Mus musculus
aggtgactgcccctgtcttaggaaa

SEQ ID NO: 201512 - DNA, 25 bp, Mus musculus
aggtgactgcggcgcaaccatgaag

SEQ ID NO: 201513 - DNA, 25 bp, Mus musculus
aggtgactggttgcaatcaggattc

SEQ ID NO: 201514 - DNA, 25 bp, Mus musculus
aggtgactggttgttaaatgaagct

SEQ ID NO: 201515 - DNA, 25 bp, Mus musculus
aggtgactgtgtgtttgatcctgag

SEQ ID NO: 201516 - DNA, 25 bp, Mus musculus
aggtgacttccgaggtcctggaggc

SEQ ID NO: 201517 - DNA, 25 bp, Mus musculus
aggtgagaaccgagttcctgttcct

SEQ ID NO: 201518 - DNA, 25 bp, Mus musculus
aggtgagcacctgaagatggaaaca

SEQ ID NO: 201519 - DNA, 25 bp, Mus musculus
aggtgagcaggatcggaacgtcaat

SEQ ID NO: 201520 - DNA, 25 bp, Mus musculus
aggtgagcatgcaggctctgctctg

SEQ ID NO: 201521 - DNA, 25 bp, Mus musculus
aggtgagccaggcaccttttgtgtc

SEQ ID NO: 201522 - DNA, 25 bp, Mus musculus
aggtgagctttgacgccgccaccca

SEQ ID NO: 201523 - DNA, 25 bp, Mus musculus
aggtgaggacagaagatacaatgga

SEQ ID NO: 201524 - DNA, 25 bp, Mus musculus
aggtgaggagtactgaaccttccag

SEQ ID NO: 201525 - DNA, 25 bp, Mus musculus
aggtgaggctggtggagttcatgac

SEQ ID NO: 201526 - DNA, 25 bp, Mus musculus
aggtgagggggaggtccaacacaat

SEQ ID NO: 201527 - DNA, 25 bp, Mus musculus
aggtgagtcagcagattcacaacat

SEQ ID NO: 201528 - DNA, 25 bp, Mus musculus
aggtgagtgatcagggcaccctcag

SEQ ID NO: 201529 - DNA, 25 bp, Mus musculus
aggtgagtggatgatcacttgattg

SEQ ID NO: 201530 - DNA, 25 bp, Mus musculus
aggtgatacagcaggtggggatgcg

SEQ ID NO: 201531 - DNA, 25 bp, Mus musculus
aggtgatcaaaggcattcctttgga

SEQ ID NO: 201532 - DNA, 25 bp, Mus musculus
aggtgatcaaagggtgaagtcggtg

SEQ ID NO: 201533 - DNA, 25 bp, Mus musculus
aggtgatcacgctcaccatcatgga

SEQ ID NO: 201534 - DNA, 25 bp, Mus musculus
aggtgatccagagaagagtttagcg

SEQ ID NO: 201535 - DNA, 25 bp, Mus musculus
aggtgatccgagatcgcctttgttt

SEQ ID NO: 201536 - DNA, 25 bp, Mus musculus
aggtgatgaaaactacatggaattt

SEQ ID NO: 201537 - DNA, 25 bp, Mus musculus
aggtgatgacagaggacaaaggtgt

SEQ ID NO: 201538 - DNA, 25 bp, Mus musculus
aggtgatgacagtcacctctcctct

SEQ ID NO: 201539 - DNA, 25 bp, Mus musculus
aggtgattccaccagtggacagagg

SEQ ID NO: 201540 - DNA, 25 bp, Mus musculus
aggtgattgaggacgcctcatgctc

SEQ ID NO: 201541 - DNA, 25 bp, Mus musculus
aggtgattggaggcctgggagctgc

SEQ ID NO: 201542 - DNA, 25 bp, Mus musculus
aggtgcaaagagctgaggacctgga

SEQ ID NO: 201543 - DNA, 25 bp, Mus musculus
aggtgcaaagaggaaaacaccataa

SEQ ID NO: 201544 - DNA, 25 bp, Mus musculus
aggtgcacagaggcataatcaaccc

SEQ ID NO: 201545 - DNA, 25 bp, Mus musculus
aggtgcaccaaacaggaccagagtt

SEQ ID NO: 201546 - DNA, 25 bp, Mus musculus
aggtgcaccaaacccagctgtgttc

SEQ ID NO: 201547 - DNA, 25 bp, Mus musculus
aggtgcaccaaacggttgcagaccc

SEQ ID NO: 201548 - DNA, 25 bp, Mus musculus
aggtgcaccagcgagcctgtcacag

SEQ ID NO: 201549 - DNA, 25 bp, Mus musculus
aggtgcacggctgtgtttggatgaa

SEQ ID NO: 201550 - DNA, 25 bp, Mus musculus
aggtgcacgggtgacccagatattg

SEQ ID NO: 201551 - DNA, 25 bp, Mus musculus
aggtgcactgagtaggcagaaaact

SEQ ID NO: 201552 - DNA, 25 bp, Mus musculus
aggtgcagaaggtttttcaagacag

SEQ ID NO: 201553 - DNA, 25 bp, Mus musculus
aggtgcagagggcagctgagacaca

SEQ ID NO: 201554 - DNA, 25 bp, Mus musculus
aggtgcagctggtgatcaaggacag

SEQ ID NO: 201555 - DNA, 25 bp, Mus musculus
aggtgcagttaaagctccctcttga

SEQ ID NO: 201556 - DNA, 25 bp, Mus musculus
aggtgcagttaaaggatggttccta

SEQ ID NO: 201557 - DNA, 25 bp, Mus musculus
aggtgccaacatctatttcaaggta

SEQ ID NO: 201558 - DNA, 25 bp, Mus musculus
aggtgccaacggcgagcctggcaaa

SEQ ID NO: 201559 - DNA, 25 bp, Mus musculus
aggtgccaagagggagctccgcttt

SEQ ID NO: 201560 - DNA, 25 bp, Mus musculus
aggtgccacagccaccatgccaatc

SEQ ID NO: 201561 - DNA, 25 bp, Mus musculus
aggtgccagagcagaagtcagcatc

SEQ ID NO: 201562 - DNA, 25 bp, Mus musculus
aggtgccaggaagtggtcatattca

SEQ ID NO: 201563 - DNA, 25 bp, Mus musculus
aggtgccaggatgaacagcagtacg

SEQ ID NO: 201564 - DNA, 25 bp, Mus musculus
aggtgccaggtatgcaaagtgcacc

SEQ ID NO: 201565 - DNA, 25 bp, Mus musculus
aggtgccccaagatgaggacgctcg

SEQ ID NO: 201566 - DNA, 25 bp, Mus musculus
aggtgccccagataagccaaagagc

SEQ ID NO: 201567 - DNA, 25 bp, Mus musculus
aggtgccccaggtgttccatgagca

SEQ ID NO: 201568 - DNA, 25 bp, Mus musculus
aggtgccccaggtttcttgaactcc

SEQ ID NO: 201569 - DNA, 25 bp, Mus musculus
aggtgccccgggtgaacgcggagag

SEQ ID NO: 201570 - DNA, 25 bp, Mus musculus
aggtgccctgcgggcttcgagggtg

SEQ ID NO: 201571 - DNA, 25 bp, Mus musculus
aggtgccgaacaccggttttgcctc

SEQ ID NO: 201572 - DNA, 25 bp, Mus musculus
aggtgccgaacaccgtgcacttaat

SEQ ID NO: 201573 - DNA, 25 bp, Mus musculus
aggtgcctccaagggttcccgtgag

SEQ ID NO: 201574 - DNA, 25 bp, Mus musculus
aggtgcctcggttccagggtccctg

SEQ ID NO: 201575 - DNA, 25 bp, Mus musculus
aggtgcctcgtacgggtattcccag

SEQ ID NO: 201576 - DNA, 25 bp, Mus musculus
aggtgcctcttaaagaaaaatcaag

SEQ ID NO: 201577 - DNA, 25 bp, Mus musculus
aggtgcctgaaaggttgcaggaatc

SEQ ID NO: 201578 - DNA, 25 bp, Mus musculus
aggtgcctggacagaaatatcttga

SEQ ID NO: 201579 - DNA, 25 bp, Mus musculus
aggtgcctggggaagactcaagggc

SEQ ID NO: 201580 - DNA, 25 bp, Mus musculus
aggtgcctggggaaggtgactttcc

SEQ ID NO: 201581 - DNA, 25 bp, Mus musculus
aggtgcgacaggtaaatttaacaca

SEQ ID NO: 201582 - DNA, 25 bp, Mus musculus
aggtgcgagccgtaacacaaggcac

SEQ ID NO: 201583 - DNA, 25 bp, Mus musculus
aggtgcgcccaggccaaacagtggg

SEQ ID NO: 201584 - DNA, 25 bp, Mus musculus
aggtgctaatggcaatcctggaccc

SEQ ID NO: 201585 - DNA, 25 bp, Mus musculus
aggtgctacaagaaatgtctgaagc

SEQ ID NO: 201586 - DNA, 25 bp, Mus musculus
aggtgctcaggtgtgtgtgacggcc

SEQ ID NO: 201587 - DNA, 25 bp, Mus musculus
aggtgctcatgcaggtccatgcctc

SEQ ID NO: 201588 - DNA, 25 bp, Mus musculus
aggtgctgaaaggtattcccaagcc

SEQ ID NO: 201589 - DNA, 25 bp, Mus musculus
aggtgctgaggcaccatcacaggga

SEQ ID NO: 201590 - DNA, 25 bp, Mus musculus
aggtgctgagttcatgcaaagaggc

SEQ ID NO: 201591 - DNA, 25 bp, Mus musculus
aggtgctgcaggttcttctgaattt

SEQ ID NO: 201592 - DNA, 25 bp, Mus musculus
aggtgctgcagtctcaggactcacc

SEQ ID NO: 201593 - DNA, 25 bp, Mus musculus
aggtgctgcccgagcacgcatgctg

SEQ ID NO: 201594 - DNA, 25 bp, Mus musculus
aggtgctgcccggaataacagaagc

SEQ ID NO: 201595 - DNA, 25 bp, Mus musculus
aggtgctggccgtggatattagcat

SEQ ID NO: 201596 - DNA, 25 bp, Mus musculus
aggtgcttaaaaaggcaatgatagt

SEQ ID NO: 201597 - DNA, 25 bp, Mus musculus
aggtgcttcagaagatggttacggc

SEQ ID NO: 201598 - DNA, 25 bp, Mus musculus
aggtgcttcagaaggcacctcttcc

SEQ ID NO: 201599 - DNA, 25 bp, Mus musculus
aggtgcttctggtaacccagggact

SEQ ID NO: 201600 - DNA, 25 bp, Mus musculus
aggtggaaaagcaagaagcacatgg

SEQ ID NO: 201601 - DNA, 25 bp, Mus musculus
aggtggaaacaagcgcccaggcgcg

SEQ ID NO: 201602 - DNA, 25 bp, Mus musculus
aggtggaaagcaagcagaacacaga

SEQ ID NO: 201603 - DNA, 25 bp, Mus musculus
aggtggaaagctgctaacgaggctg

SEQ ID NO: 201604 - DNA, 25 bp, Mus musculus
aggtggaacggcagacccagtttcc

SEQ ID NO: 201605 - DNA, 25 bp, Mus musculus
aggtggaactaagggactttgaata

SEQ ID NO: 201606 - DNA, 25 bp, Mus musculus
aggtggaactcagagtttgctattg

SEQ ID NO: 201607 - DNA, 25 bp, Mus musculus
aggtggaactcaggtagcactttgt

SEQ ID NO: 201608 - DNA, 25 bp, Mus musculus
aggtggaagaactatatcagtctct

SEQ ID NO: 201609 - DNA, 25 bp, Mus musculus
aggtggacaaatccaggtggctcct

SEQ ID NO: 201610 - DNA, 25 bp, Mus musculus
aggtggacatgaaagtggccgaggt

SEQ ID NO: 201611 - DNA, 25 bp, Mus musculus
aggtggacatgacagtggccgaggt

SEQ ID NO: 201612 - DNA, 25 bp, Mus musculus
aggtggacattgaggcactgcaagt

SEQ ID NO: 201613 - DNA, 25 bp, Mus musculus
aggtggaccaaaaatgtggacatct

SEQ ID NO: 201614 - DNA, 25 bp, Mus musculus
aggtggacccaggtttgccgaagat

SEQ ID NO: 201615 - DNA, 25 bp, Mus musculus
aggtggagaaacaggtcttgtccat

SEQ ID NO: 201616 - DNA, 25 bp, Mus musculus
aggtggagaagctcaaggcaaggat

SEQ ID NO: 201617 - DNA, 25 bp, Mus musculus
aggtggagaaggccaaggggaatcc

SEQ ID NO: 201618 - DNA, 25 bp, Mus musculus
aggtggagaaggccgagtacaacag

SEQ ID NO: 201619 - DNA, 25 bp, Mus musculus
aggtggagacagcccacaggatgac

SEQ ID NO: 201620 - DNA, 25 bp, Mus musculus
aggtggagcagccctgttcccttcc

SEQ ID NO: 201621 - DNA, 25 bp, Mus musculus
aggtggagcagggctcaaactcaga

SEQ ID NO: 201622 - DNA, 25 bp, Mus musculus
aggtggagcaggtgaggggtcgggg

SEQ ID NO: 201623 - DNA, 25 bp, Mus musculus
aggtggagctgagagttcttccaga

SEQ ID NO: 201624 - DNA, 25 bp, Mus musculus
aggtggagctgcctctgtacaacca

SEQ ID NO: 201625 - DNA, 25 bp, Mus musculus
aggtggaggaaaatctgaatgaggt

SEQ ID NO: 201626 - DNA, 25 bp, Mus musculus
aggtggaggagatcctggtgctgct

SEQ ID NO: 201627 - DNA, 25 bp, Mus musculus
aggtggaggagatgctgaccaacaa

SEQ ID NO: 201628 - DNA, 25 bp, Mus musculus
aggtggaggaggtggagtttgatgt

SEQ ID NO: 201629 - DNA, 25 bp, Mus musculus
aggtggaggatgacaaaatccccat

SEQ ID NO: 201630 - DNA, 25 bp, Mus musculus
aggtggaggccaagcaggtgcaggc

SEQ ID NO: 201631 - DNA, 25 bp, Mus musculus
aggtggaggccaagggagaagcaag

SEQ ID NO: 201632 - DNA, 25 bp, Mus musculus
aggtggaggccaaggggagtggagt

SEQ ID NO: 201633 - DNA, 25 bp, Mus musculus
aggtggagtgcaggccctgcaggtc

SEQ ID NO: 201634 - DNA, 25 bp, Mus musculus
aggtggatatgcaggtgcttcacct

SEQ ID NO: 201635 - DNA, 25 bp, Mus musculus
aggtggatctgttacccacaggtcc

SEQ ID NO: 201636 - DNA, 25 bp, Mus musculus
aggtggatgatctggagggatccct

SEQ ID NO: 201637 - DNA, 25 bp, Mus musculus
aggtggatgctgatgagttcttgac

SEQ ID NO: 201638 - DNA, 25 bp, Mus musculus
aggtggatgctgatggcaatgggac

SEQ ID NO: 201639 - DNA, 25 bp, Mus musculus
aggtggatgctggaggtcacatctg

SEQ ID NO: 201640 - DNA, 25 bp, Mus musculus
aggtggatgctggaggtgagccttc

SEQ ID NO: 201641 - DNA, 25 bp, Mus musculus
aggtggatgcttctcttcaggcctg

SEQ ID NO: 201642 - DNA, 25 bp, Mus musculus
aggtggatggagtgggtaacttcag

SEQ ID NO: 201643 - DNA, 25 bp, Mus musculus
aggtggatggagttcgacagaacag

SEQ ID NO: 201644 - DNA, 25 bp, Mus musculus
aggtggatgtgtgggtgcaggtggc

SEQ ID NO: 201645 - DNA, 25 bp, Mus musculus
aggtggatttgaaagaaactgccag

SEQ ID NO: 201646 - DNA, 25 bp, Mus musculus
aggtggcaaagaaccagcattttga

SEQ ID NO: 201647 - DNA, 25 bp, Mus musculus
aggtggcaacgctgacagagcggct

SEQ ID NO: 201648 - DNA, 25 bp, Mus musculus
aggtggcaaggtgcaaatagtctac

SEQ ID NO: 201649 - DNA, 25 bp, Mus musculus
aggtggcaaggtgcagataattaat

SEQ ID NO: 201650 - DNA, 25 bp, Mus musculus
aggtggcaatgccccagttccttcc

SEQ ID NO: 201651 - DNA, 25 bp, Mus musculus
aggtggcaatggaaaaagatcttcc

SEQ ID NO: 201652 - DNA, 25 bp, Mus musculus
aggtggcaatgttcagattcagaac

SEQ ID NO: 201653 - DNA, 25 bp, Mus musculus
aggtggcacagcaggacgcagagac

SEQ ID NO: 201654 - DNA, 25 bp, Mus musculus
aggtggcacggaggcaagaaggagt

SEQ ID NO: 201655 - DNA, 25 bp, Mus musculus
aggtggcagaggacctggtggctaa

SEQ ID NO: 201656 - DNA, 25 bp, Mus musculus
aggtggcagaggtgctggctggaga

SEQ ID NO: 201657 - DNA, 25 bp, Mus musculus
aggtggcaggagaaggaggtggtgg

SEQ ID NO: 201658 - DNA, 25 bp, Mus musculus
aggtggcagggttaaggcagcttct

SEQ ID NO: 201659 - DNA, 25 bp, Mus musculus
aggtggcatctcaagagttctatcc

SEQ ID NO: 201660 - DNA, 25 bp, Mus musculus
aggtggcatctcaagcctccagagg

SEQ ID NO: 201661 - DNA, 25 bp, Mus musculus
aggtggcatctcaagcctccggtca

SEQ ID NO: 201662 - DNA, 25 bp, Mus musculus
aggtggcccaggtccctgtccgcac

SEQ ID NO: 201663 - DNA, 25 bp, Mus musculus
aggtggcccggcttctgcaggcaca

SEQ ID NO: 201664 - DNA, 25 bp, Mus musculus
aggtggccgagaagctgtttgactc

SEQ ID NO: 201665 - DNA, 25 bp, Mus musculus
aggtggccgctgaccagtgaagtca

SEQ ID NO: 201666 - DNA, 25 bp, Mus musculus
aggtggccgtgggaccgtggctacc

SEQ ID NO: 201667 - DNA, 25 bp, Mus musculus
aggtggcctgtgagacagtgtgcaa

SEQ ID NO: 201668 - DNA, 25 bp, Mus musculus
aggtggccttagagtttctgcgccc

SEQ ID NO: 201669 - DNA, 25 bp, Mus musculus
aggtggcggagccgaatcctattct

SEQ ID NO: 201670 - DNA, 25 bp, Mus musculus
aggtggctacgagataacagacaaa

SEQ ID NO: 201671 - DNA, 25 bp, Mus musculus
aggtggctctcagccaccaccttgt

SEQ ID NO: 201672 - DNA, 25 bp, Mus musculus
aggtggctctctgatgcaagctgtt

SEQ ID NO: 201673 - DNA, 25 bp, Mus musculus
aggtggctgagagccgagccagaca

SEQ ID NO: 201674 - DNA, 25 bp, Mus musculus
aggtggctgagagtaaatgtgggga

SEQ ID NO: 201675 - DNA, 25 bp, Mus musculus
aggtggctgaggtaccacgtacaca

SEQ ID NO: 201676 - DNA, 25 bp, Mus musculus
aggtggctggtaccaattctattta

SEQ ID NO: 201677 - DNA, 25 bp, Mus musculus
aggtggctgtgtctttcagccctgc

SEQ ID NO: 201678 - DNA, 25 bp, Mus musculus
aggtggcttccgaggctccggcttc

SEQ ID NO: 201679 - DNA, 25 bp, Mus musculus
aggtgggacagccagctgaagtgag

SEQ ID NO: 201680 - DNA, 25 bp, Mus musculus
aggtgggacagccaggtaacaattt

SEQ ID NO: 201681 - DNA, 25 bp, Mus musculus
aggtgggattggaattgtacccatt

SEQ ID NO: 201682 - DNA, 25 bp, Mus musculus
aggtgggccaggtccacctccacct

SEQ ID NO: 201683 - DNA, 25 bp, Mus musculus
aggtgggctgagaagcggaggctgc

SEQ ID NO: 201684 - DNA, 25 bp, Mus musculus
aggtgggctgagaaggtgaggtggc

SEQ ID NO: 201685 - DNA, 25 bp, Mus musculus
aggtggggatctcagactatggcga

SEQ ID NO: 201686 - DNA, 25 bp, Mus musculus
aggtggggcagatgcgaatgaagag

SEQ ID NO: 201687 - DNA, 25 bp, Mus musculus
aggtggggccgagcaaccatgaagg

SEQ ID NO: 201688 - DNA, 25 bp, Mus musculus
aggtgggttagccaaccccaccaga

SEQ ID NO: 201689 - DNA, 25 bp, Mus musculus
aggtggtcaggacaggtacagcaca

SEQ ID NO: 201690 - DNA, 25 bp, Mus musculus
aggtggtcaggcctataccattcaa

SEQ ID NO: 201691 - DNA, 25 bp, Mus musculus
aggtggtcagttgaccaagctgcac

SEQ ID NO: 201692 - DNA, 25 bp, Mus musculus
aggtggtcatcaacggctcagaggt

SEQ ID NO: 201693 - DNA, 25 bp, Mus musculus
aggtggtccgagaggtgtgctctga

SEQ ID NO: 201694 - DNA, 25 bp, Mus musculus
aggtggtccgagttcccacgacagc

SEQ ID NO: 201695 - DNA, 25 bp, Mus musculus
aggtggtcctgggggaatggataag

SEQ ID NO: 201696 - DNA, 25 bp, Mus musculus
aggtggtctacaagacagtagccaa

SEQ ID NO: 201697 - DNA, 25 bp, Mus musculus
aggtggtgacacaagggacccggga

SEQ ID NO: 201698 - DNA, 25 bp, Mus musculus
aggtggtgacacaaggtgtggcctt

SEQ ID NO: 201699 - DNA, 25 bp, Mus musculus
aggtggtgaccaagactgcgcttcg

SEQ ID NO: 201700 - DNA, 25 bp, Mus musculus
aggtggtgagcgccgagcagaagct

SEQ ID NO: 201701 - DNA, 25 bp, Mus musculus
aggtggtgatctgcgaccagtaccg

SEQ ID NO: 201702 - DNA, 25 bp, Mus musculus
aggtggtgcaggagatcccccaaga

SEQ ID NO: 201703 - DNA, 25 bp, Mus musculus
aggtggtggaaggagctcaaggttc

SEQ ID NO: 201704 - DNA, 25 bp, Mus musculus
aggtggtggagaaggcttactgctc

SEQ ID NO: 201705 - DNA, 25 bp, Mus musculus
aggtggttcgccctagtcgagggaa

SEQ ID NO: 201706 - DNA, 25 bp, Mus musculus
aggtggttctcgaggctgctgatga

SEQ ID NO: 201707 - DNA, 25 bp, Mus musculus
aggtggttctgaaacgaagtgagaa

SEQ ID NO: 201708 - DNA, 25 bp, Mus musculus
aggtgtaatgtgagacctctgggtg

SEQ ID NO: 201709 - DNA, 25 bp, Mus musculus
aggtgtaatgtgagagattggtgtc

SEQ ID NO: 201710 - DNA, 25 bp, Mus musculus
aggtgtacaatgaaaatcttgttca

SEQ ID NO: 201711 - DNA, 25 bp, Mus musculus
aggtgtacaatgagaaacatattca

SEQ ID NO: 201712 - DNA, 25 bp, Mus musculus
aggtgtactgtggttcactacaaca

SEQ ID NO: 201713 - DNA, 25 bp, Mus musculus
aggtgtagagaaagacatggagatg

SEQ ID NO: 201714 - DNA, 25 bp, Mus musculus
aggtgtatgaaacgctgtcagccgg

SEQ ID NO: 201715 - DNA, 25 bp, Mus musculus
aggtgtatgaaaggctgtcagccgg

SEQ ID NO: 201716 - DNA, 25 bp, Mus musculus
aggtgtattcagacttcaagaccac

SEQ ID NO: 201717 - DNA, 25 bp, Mus musculus
aggtgtattcgggttcctggactga

SEQ ID NO: 201718 - DNA, 25 bp, Mus musculus
aggtgtcacagcacggtctctctgc

SEQ ID NO: 201719 - DNA, 25 bp, Mus musculus
aggtgtcacgacgaggaacaaggat

SEQ ID NO: 201720 - DNA, 25 bp, Mus musculus
aggtgtcagagccagttgtcactca

SEQ ID NO: 201721 - DNA, 25 bp, Mus musculus
aggtgtccatttcgacttctctacc

SEQ ID NO: 201722 - DNA, 25 bp, Mus musculus
aggtgtcccaggaagtcacccggtc

SEQ ID NO: 201723 - DNA, 25 bp, Mus musculus
aggtgtctggccctctccaggccat

SEQ ID NO: 201724 - DNA, 25 bp, Mus musculus
aggtgtgaacaggttccacccgact

SEQ ID NO: 201725 - DNA, 25 bp, Mus musculus
aggtgtgacgggaagcttatcaagt

SEQ ID NO: 201726 - DNA, 25 bp, Mus musculus
aggtgtgacgggaaggtgtgtgagt

SEQ ID NO: 201727 - DNA, 25 bp, Mus musculus
aggtgtgatcagcagctcgtgcctc

SEQ ID NO: 201728 - DNA, 25 bp, Mus musculus
aggtgtgcaagaaactggtcttttg

SEQ ID NO: 201729 - DNA, 25 bp, Mus musculus
aggtgtgcgcactcggaggccatgt

SEQ ID NO: 201730 - DNA, 25 bp, Mus musculus
aggtgtgctgaaatttcaaaaggac

SEQ ID NO: 201731 - DNA, 25 bp, Mus musculus
aggtgtgctggtgcgatgcatgctg

SEQ ID NO: 201732 - DNA, 25 bp, Mus musculus
aggtgtggacacgttggtcagacta

SEQ ID NO: 201733 - DNA, 25 bp, Mus musculus
aggtgtggaccaagtttgttgcata

SEQ ID NO: 201734 - DNA, 25 bp, Mus musculus
aggtgtggccttgcaaagctgttgc

SEQ ID NO: 201735 - DNA, 25 bp, Mus musculus
aggtgtgggacaaggttttgagcat

SEQ ID NO: 201736 - DNA, 25 bp, Mus musculus
aggtgtgtatgctaatgggaatgac

SEQ ID NO: 201737 - DNA, 25 bp, Mus musculus
aggtgttagaatgtgagcggacgga

SEQ ID NO: 201738 - DNA, 25 bp, Mus musculus
aggtgttcagctcctgcttctaggt

SEQ ID NO: 201739 - DNA, 25 bp, Mus musculus
aggtgttcagggaggcagatcaaga

SEQ ID NO: 201740 - DNA, 25 bp, Mus musculus
aggtgttccaggagcgcatcaactg

SEQ ID NO: 201741 - DNA, 25 bp, Mus musculus
aggtgttccaggtaggtgcatgagc

SEQ ID NO: 201742 - DNA, 25 bp, Mus musculus
aggtgtttaaggagatgaaaccctg

SEQ ID NO: 201743 - DNA, 25 bp, Mus musculus
aggtgtttcacagggtcaggtacct

SEQ ID NO: 201744 - DNA, 25 bp, Mus musculus
aggttaaaacttcagcatcttcttg

SEQ ID NO: 201745 - DNA, 25 bp, Mus musculus
aggttacaagagtgaaacatctttc

SEQ ID NO: 201746 - DNA, 25 bp, Mus musculus
aggttacaatccggaaccagctatt

SEQ ID NO: 201747 - DNA, 25 bp, Mus musculus
aggttacaatccggtggcgtcccct

SEQ ID NO: 201748 - DNA, 25 bp, Mus musculus
aggttacaccaggcttgtgaagatc

SEQ ID NO: 201749 - DNA, 25 bp, Mus musculus
aggttaccagagctgaaattagctt

SEQ ID NO: 201750 - DNA, 25 bp, Mus musculus
aggttaccagtatgcaaccgaggat

SEQ ID NO: 201751 - DNA, 25 bp, Mus musculus
aggttaccagtgtttgaaagacgta

SEQ ID NO: 201752 - DNA, 25 bp, Mus musculus
aggttaccgcacggataattgtgtg

SEQ ID NO: 201753 - DNA, 25 bp, Mus musculus
aggttacctttcagcctcccagtaa

SEQ ID NO: 201754 - DNA, 25 bp, Mus musculus
aggttacgatgaagactgccaaagt

SEQ ID NO: 201755 - DNA, 25 bp, Mus musculus
aggttacgatgaaggctgtcatggt

SEQ ID NO: 201756 - DNA, 25 bp, Mus musculus
aggttacttttgaggatgtcaagca

SEQ ID NO: 201757 - DNA, 25 bp, Mus musculus
aggttacttttggaaatacagttgg

SEQ ID NO: 201758 - DNA, 25 bp, Mus musculus
aggttagcaataggagaagatggag

SEQ ID NO: 201759 - DNA, 25 bp, Mus musculus
aggttatacagacagagggtacccg

SEQ ID NO: 201760 - DNA, 25 bp, Mus musculus
aggttatacaggacattgccctaaa

SEQ ID NO: 201761 - DNA, 25 bp, Mus musculus
aggttatagcacacatccagaaccc

SEQ ID NO: 201762 - DNA, 25 bp, Mus musculus
aggttatataagaagcccctccagg

SEQ ID NO: 201763 - DNA, 25 bp, Mus musculus
aggttatttgaacacacaggtttgg

SEQ ID NO: 201764 - DNA, 25 bp, Mus musculus
aggttatttggtacaaaatgcagca

SEQ ID NO: 201765 - DNA, 25 bp, Mus musculus
aggttcaaaaggatccagaagcact

SEQ ID NO: 201766 - DNA, 25 bp, Mus musculus
aggttcaaaaggcacagtgacctga

SEQ ID NO: 201767 - DNA, 25 bp, Mus musculus
aggttcaaaccagtaggtgcaaact

SEQ ID NO: 201768 - DNA, 25 bp, Mus musculus
aggttcaacttctggtctcacccaa

SEQ ID NO: 201769 - DNA, 25 bp, Mus musculus
aggttcaagacgatctggctgaaag

SEQ ID NO: 201770 - DNA, 25 bp, Mus musculus
aggttcagaagggccagctgacgag

SEQ ID NO: 201771 - DNA, 25 bp, Mus musculus
aggttcagcaaggtttacagtagca

SEQ ID NO: 201772 - DNA, 25 bp, Mus musculus
aggttcagggcagctctcagggcct

SEQ ID NO: 201773 - DNA, 25 bp, Mus musculus
aggttcccaaagagatgcacgggaa

SEQ ID NO: 201774 - DNA, 25 bp, Mus musculus
aggttcccaggatcaccgacaacca

SEQ ID NO: 201775 - DNA, 25 bp, Mus musculus
aggttcccagtttagccaggccctg

SEQ ID NO: 201776 - DNA, 25 bp, Mus musculus
aggttccccagcagagatgaactgg

SEQ ID NO: 201777 - DNA, 25 bp, Mus musculus
aggttccccagtcaatcgcaggcca

SEQ ID NO: 201778 - DNA, 25 bp, Mus musculus
aggttcccgcaacaggtgacccaat

SEQ ID NO: 201779 - DNA, 25 bp, Mus musculus
aggttcccttgagacaccagagaag

SEQ ID NO: 201780 - DNA, 25 bp, Mus musculus
aggttcctgatgatgatgaaccagc

SEQ ID NO: 201781 - DNA, 25 bp, Mus musculus
aggttcctgatggaaaaccaactct

SEQ ID NO: 201782 - DNA, 25 bp, Mus musculus
aggttcctgatggtgttctccaaac

SEQ ID NO: 201783 - DNA, 25 bp, Mus musculus
aggttcctgcctaccactgttccct

SEQ ID NO: 201784 - DNA, 25 bp, Mus musculus
aggttcctgcctgtgacatggacag

SEQ ID NO: 201785 - DNA, 25 bp, Mus musculus
aggttcggattcaggcttgtgtgtg

SEQ ID NO: 201786 - DNA, 25 bp, Mus musculus
aggttcggattcaggtaatcgccac

SEQ ID NO: 201787 - DNA, 25 bp, Mus musculus
aggttctaccagaggctgtgtacag

SEQ ID NO: 201788 - DNA, 25 bp, Mus musculus
aggttctacgccaagcatcatcagc

SEQ ID NO: 201789 - DNA, 25 bp, Mus musculus
aggttctcaggctattgatacagaa

SEQ ID NO: 201790 - DNA, 25 bp, Mus musculus
aggttctctagggtgaagagatgaa

SEQ ID NO: 201791 - DNA, 25 bp, Mus musculus
aggttctctagtctgcccgagagca

SEQ ID NO: 201792 - DNA, 25 bp, Mus musculus
aggttctgaaacaggaaatccggct

SEQ ID NO: 201793 - DNA, 25 bp, Mus musculus
aggttctgagaaaacctatccttgg

SEQ ID NO: 201794 - DNA, 25 bp, Mus musculus
aggttctgatatgtcacatgctgct

SEQ ID NO: 201795 - DNA, 25 bp, Mus musculus
aggttctgcagaccatgccgtccat

SEQ ID NO: 201796 - DNA, 25 bp, Mus musculus
aggttctgccgcctcctgatgacgg

SEQ ID NO: 201797 - DNA, 25 bp, Mus musculus
aggttctgccggggacccctgtgga

SEQ ID NO: 201798 - DNA, 25 bp, Mus musculus
aggttctgggaagtgcgaaatcaaa

SEQ ID NO: 201799 - DNA, 25 bp, Mus musculus
aggttctgttcccatgagaacccct

SEQ ID NO: 201800 - DNA, 25 bp, Mus musculus
aggttctgttcccatggaatcattg

SEQ ID NO: 201801 - DNA, 25 bp, Mus musculus
aggttcttgagaggccacagacctc

SEQ ID NO: 201802 - DNA, 25 bp, Mus musculus
aggttgaagagaactctgataagaa

SEQ ID NO: 201803 - DNA, 25 bp, Mus musculus
aggttgaagagatgaaaagaaaata

SEQ ID NO: 201804 - DNA, 25 bp, Mus musculus
aggttgaagagatttgacatcctca

SEQ ID NO: 201805 - DNA, 25 bp, Mus musculus
aggttgacatgagtaacatacaaga

SEQ ID NO: 201806 - DNA, 25 bp, Mus musculus
aggttgacgtgattgtgaataccct

SEQ ID NO: 201807 - DNA, 25 bp, Mus musculus
aggttgagaaaggaactcaacagag

SEQ ID NO: 201808 - DNA, 25 bp, Mus musculus
aggttgagaactgggcgtggaaaag

SEQ ID NO: 201809 - DNA, 25 bp, Mus musculus
aggttgagacagcaacggtggacaa

SEQ ID NO: 201810 - DNA, 25 bp, Mus musculus
aggttgatgggaatgtaaataaaca

SEQ ID NO: 201811 - DNA, 25 bp, Mus musculus
aggttgatggtccgcagacatctgg

SEQ ID NO: 201812 - DNA, 25 bp, Mus musculus
aggttgcaaattagtttcgtggttt

SEQ ID NO: 201813 - DNA, 25 bp, Mus musculus
aggttgccaagcaacacgtgcagga

SEQ ID NO: 201814 - DNA, 25 bp, Mus musculus
aggttgccaaggccttaatccagga

SEQ ID NO: 201815 - DNA, 25 bp, Mus musculus
aggttgcggcagatgccccacagga

SEQ ID NO: 201816 - DNA, 25 bp, Mus musculus
aggttgcgtcaagagcctcagctta

SEQ ID NO: 201817 - DNA, 25 bp, Mus musculus
aggttgctgacgagatctggccgcc

SEQ ID NO: 201818 - DNA, 25 bp, Mus musculus
aggttggaagagcaattctacagaa

SEQ ID NO: 201819 - DNA, 25 bp, Mus musculus
aggttggaataaaggaaacaagctc

SEQ ID NO: 201820 - DNA, 25 bp, Mus musculus
aggttggacccaggagccgggtgtg

SEQ ID NO: 201821 - DNA, 25 bp, Mus musculus
aggttggatgcaagctatgccccct

SEQ ID NO: 201822 - DNA, 25 bp, Mus musculus
aggttggcaggccccctgcgcatcg

SEQ ID NO: 201823 - DNA, 25 bp, Mus musculus
aggttgggttttaagtgcggagatc

SEQ ID NO: 201824 - DNA, 25 bp, Mus musculus
aggttgtcagcgggtgactttgcag

SEQ ID NO: 201825 - DNA, 25 bp, Mus musculus
aggttgtcagggttacagccactca

SEQ ID NO: 201826 - DNA, 25 bp, Mus musculus
aggttgtccggtccttcagaccaga

SEQ ID NO: 201827 - DNA, 25 bp, Mus musculus
aggttgtctcaacagcctgacagag

SEQ ID NO: 201828 - DNA, 25 bp, Mus musculus
aggttgtggtgggacaaccctccat

SEQ ID NO: 201829 - DNA, 25 bp, Mus musculus
aggttgttaagactactgggaatca

SEQ ID NO: 201830 - DNA, 25 bp, Mus musculus
aggttgttaagatcctggaccgctg

SEQ ID NO: 201831 - DNA, 25 bp, Mus musculus
aggttgttaaggacaaagcaggacc

SEQ ID NO: 201832 - DNA, 25 bp, Mus musculus
aggttgttaaggacctcataaggaa

SEQ ID NO: 201833 - DNA, 25 bp, Mus musculus
aggttgttgttcaagatgaggagac

SEQ ID NO: 201834 - DNA, 25 bp, Mus musculus
aggttgttgttcaagcatttatatc

SEQ ID NO: 201835 - DNA, 25 bp, Mus musculus
aggtttaatatttcagcagtgtgat

SEQ ID NO: 201836 - DNA, 25 bp, Mus musculus
aggtttaatgaaatgatgaaagttg

SEQ ID NO: 201837 - DNA, 25 bp, Mus musculus
aggtttaatgaaggtgattcagaag

SEQ ID NO: 201838 - DNA, 25 bp, Mus musculus
aggtttacagcagatacagttggtg

SEQ ID NO: 201839 - DNA, 25 bp, Mus musculus
aggtttagaagacagcgtggaagat

SEQ ID NO: 201840 - DNA, 25 bp, Mus musculus
aggtttaggtctggatcccacgcaa

SEQ ID NO: 201841 - DNA, 25 bp, Mus musculus
aggtttataagaacgagctgcaccg

SEQ ID NO: 201842 - DNA, 25 bp, Mus musculus
aggtttatcaaaagacttccaactg

SEQ ID NO: 201843 - DNA, 25 bp, Mus musculus
aggtttcacagagatgctgatgaaa

SEQ ID NO: 201844 - DNA, 25 bp, Mus musculus
aggtttcagataattggaggataga

SEQ ID NO: 201845 - DNA, 25 bp, Mus musculus
aggtttcagataattgggccattga

SEQ ID NO: 201846 - DNA, 25 bp, Mus musculus
aggtttccaaggtggcgacagacaa

SEQ ID NO: 201847 - DNA, 25 bp, Mus musculus
aggtttcctttcaggatggcctcag

SEQ ID NO: 201848 - DNA, 25 bp, Mus musculus
aggtttctgacaggtaaccaatgga

SEQ ID NO: 201849 - DNA, 25 bp, Mus musculus
aggtttctgaggtggagtctttcat

SEQ ID NO: 201850 - DNA, 25 bp, Mus musculus
aggtttctgtttgttttcttctgct

SEQ ID NO: 201851 - DNA, 25 bp, Mus musculus
aggtttcttctgatgaaagagaaga

SEQ ID NO: 201852 - DNA, 25 bp, Mus musculus
aggtttctttcagccttttatgtca

SEQ ID NO: 201853 - DNA, 25 bp, Mus musculus
aggtttgagaatttgacttcggagg

SEQ ID NO: 201854 - DNA, 25 bp, Mus musculus
aggtttgccagaaggaacctgaatg

SEQ ID NO: 201855 - DNA, 25 bp, Mus musculus
aggtttgccctgagagtgggccatg

SEQ ID NO: 201856 - DNA, 25 bp, Mus musculus
aggtttggtaaaagccatggccatg

SEQ ID NO: 201857 - DNA, 25 bp, Mus musculus
aggtttggtctgaaggacagggttt

SEQ ID NO: 201858 - DNA, 25 bp, Mus musculus
aggtttggtggaatgcatgcagatg

SEQ ID NO: 201859 - DNA, 25 bp, Mus musculus
aggtttgtcaaaaataaggccagca

SEQ ID NO: 201860 - DNA, 25 bp, Mus musculus
aggtttgtgttaaggcctcacacct

SEQ ID NO: 201861 - DNA, 25 bp, Mus musculus
aggttttagggcaagtctgatgagc

SEQ ID NO: 201862 - DNA, 25 bp, Mus musculus
aggttttatggactacagatttggg

SEQ ID NO: 201863 - DNA, 25 bp, Mus musculus
aggttttctgaagagatacaagggg

SEQ ID NO: 201864 - DNA, 25 bp, Mus musculus
aggttttgacaggactggaggaccg

SEQ ID NO: 201865 - DNA, 25 bp, Mus musculus
aggttttggtgaaaagtgaagatgc

SEQ ID NO: 201866 - DNA, 25 bp, Mus musculus
aggttttgttggtgtgcaacagaag

SEQ ID NO: 201867 - DNA, 25 bp, Mus musculus
aggtttttaatgatgaggtccttct

SEQ ID NO: 201868 - DNA, 25 bp, Mus musculus
aggtttttctaagagaacggtcatc

SEQ ID NO: 201869 - DNA, 25 bp, Mus musculus
agtaaaaaagaatgcactgctccct

SEQ ID NO: 201870 - DNA, 25 bp, Mus musculus
agtaaaaacatcgagatcaagaagt

SEQ ID NO: 201871 - DNA, 25 bp, Mus musculus
agtaaaaaccagaatgacccattgc

SEQ ID NO: 201872 - DNA, 25 bp, Mus musculus
agtaaaaaccagaccgacgtgacaa

SEQ ID NO: 201873 - DNA, 25 bp, Mus musculus
agtaaaaactggcattgcttcacga

SEQ ID NO: 201874 - DNA, 25 bp, Mus musculus
agtaaaagtgaaatgactgttccct

SEQ ID NO: 201875 - DNA, 25 bp, Mus musculus
agtaaaatcgataaacaacccagac

SEQ ID NO: 201876 - DNA, 25 bp, Mus musculus
agtaaacaagaattcctcagagaga

SEQ ID NO: 201877 - DNA, 25 bp, Mus musculus
agtaaacaagatctcgccctcctga

SEQ ID NO: 201878 - DNA, 25 bp, Mus musculus
agtaaacactccaggtcgcagacac

SEQ ID NO: 201879 - DNA, 25 bp, Mus musculus
agtaaaccatgaaggggactcctct

SEQ ID NO: 201880 - DNA, 25 bp, Mus musculus
agtaaaccatgaagtttctctgtgc

SEQ ID NO: 201881 - DNA, 25 bp, Mus musculus
agtaaacccagtgatcaggtgtaag

SEQ ID NO: 201882 - DNA, 25 bp, Mus musculus
agtaaacgcaggtgacctggcctca

SEQ ID NO: 201883 - DNA, 25 bp, Mus musculus
agtaaagaatccagaaacttggaaa

SEQ ID NO: 201884 - DNA, 25 bp, Mus musculus
agtaaagagaaagtgtttatgggac

SEQ ID NO: 201885 - DNA, 25 bp, Mus musculus
agtaaagattgctgctagagcatgg

SEQ ID NO: 201886 - DNA, 25 bp, Mus musculus
agtaaagcaagagcaccagaagtgc

SEQ ID NO: 201887 - DNA, 25 bp, Mus musculus
agtaaagcaaggctgtggctctgga

SEQ ID NO: 201888 - DNA, 25 bp, Mus musculus
agtaaagctcaaaagctttgcagcc

SEQ ID NO: 201889 - DNA, 25 bp, Mus musculus
agtaaagctcaaaaggcactaagca

SEQ ID NO: 201890 - DNA, 25 bp, Mus musculus
agtaaagcttgtgaaggcgctggtt

SEQ ID NO: 201891 - DNA, 25 bp, Mus musculus
agtaaataaaggaatgtgtttctga

SEQ ID NO: 201892 - DNA, 25 bp, Mus musculus
agtaaatacataaatatgtaaagaa

SEQ ID NO: 201893 - DNA, 25 bp, Mus musculus
agtaaatatttgggcccagcaacct

SEQ ID NO: 201894 - DNA, 25 bp, Mus musculus
agtaaatatttggtgctggtaactc

SEQ ID NO: 201895 - DNA, 25 bp, Mus musculus
agtaaatccaaactttatgatggtt

SEQ ID NO: 201896 - DNA, 25 bp, Mus musculus
agtaaatgaaggctggagccagtta

SEQ ID NO: 201897 - DNA, 25 bp, Mus musculus
agtaaatggaaggcatacgatgcga

SEQ ID NO: 201898 - DNA, 25 bp, Mus musculus
agtaaatggaaggttgcttttaact

SEQ ID NO: 201899 - DNA, 25 bp, Mus musculus
agtaaatgtaagtatgccatttgtc

SEQ ID NO: 201900 - DNA, 25 bp, Mus musculus
agtaaatgttagtgacagctagaat

SEQ ID NO: 201901 - DNA, 25 bp, Mus musculus
agtaaattcagatgggtggcctaac

SEQ ID NO: 201902 - DNA, 25 bp, Mus musculus
agtaaattgtcagatactgctcatc

SEQ ID NO: 201903 - DNA, 25 bp, Mus musculus
agtaacaaaatcaaggatcatgggc

SEQ ID NO: 201904 - DNA, 25 bp, Mus musculus
agtaacaacggcctcagcatcctcc

SEQ ID NO: 201905 - DNA, 25 bp, Mus musculus
agtaacaagaggcttcccgaggagg

SEQ ID NO: 201906 - DNA, 25 bp, Mus musculus
agtaacaagcaaggaatccaagtga

SEQ ID NO: 201907 - DNA, 25 bp, Mus musculus
agtaacactgagtaccagtgatggg

SEQ ID NO: 201908 - DNA, 25 bp, Mus musculus
agtaacagacctgaccaaagtcaac

SEQ ID NO: 201909 - DNA, 25 bp, Mus musculus
agtaacagactttgcatgaagttgc

SEQ ID NO: 201910 - DNA, 25 bp, Mus musculus
agtaacagaggtgataagatttcca

SEQ ID NO: 201911 - DNA, 25 bp, Mus musculus
agtaacagagttgacagttcctcag

SEQ ID NO: 201912 - DNA, 25 bp, Mus musculus
agtaacagctgcaggaatagtgatt

SEQ ID NO: 201913 - DNA, 25 bp, Mus musculus
agtaacagggattgccggaacttgt

SEQ ID NO: 201914 - DNA, 25 bp, Mus musculus
agtaaccacatccctccctccaaag

SEQ ID NO: 201915 - DNA, 25 bp, Mus musculus
agtaaccatccttcttgctttgtaa

SEQ ID NO: 201916 - DNA, 25 bp, Mus musculus
agtaaccccaggttctgccttagat

SEQ ID NO: 201917 - DNA, 25 bp, Mus musculus
agtaaccgctcaggtagtagtctgg

SEQ ID NO: 201918 - DNA, 25 bp, Mus musculus
agtaaccgctcagttcatctcaaag

SEQ ID NO: 201919 - DNA, 25 bp, Mus musculus
agtaacctaggtctgctgcaggtgt

SEQ ID NO: 201920 - DNA, 25 bp, Mus musculus
agtaacctcttcaggcccgcacttt

SEQ ID NO: 201921 - DNA, 25 bp, Mus musculus
agtaacctggagtttctgacatgaa

SEQ ID NO: 201922 - DNA, 25 bp, Mus musculus
agtaacctttaggtcttgctaggta

SEQ ID NO: 201923 - DNA, 25 bp, Mus musculus
agtaacgtgtgctgccatgctttct

SEQ ID NO: 201924 - DNA, 25 bp, Mus musculus
agtaactaactggtccagctgctgc

SEQ ID NO: 201925 - DNA, 25 bp, Mus musculus
agtaactcaaaaagcagcctttact

SEQ ID NO: 201926 - DNA, 25 bp, Mus musculus
agtaactgaaggtgtccactcccag

SEQ ID NO: 201927 - DNA, 25 bp, Mus musculus
agtaactgagttggcagatatcccg

SEQ ID NO: 201928 - DNA, 25 bp, Mus musculus
agtaactggccagagagcaatggaa

SEQ ID NO: 201929 - DNA, 25 bp, Mus musculus
agtaactggccagaggacacggatg

SEQ ID NO: 201930 - DNA, 25 bp, Mus musculus
agtaacttcaaggttatccaggccg

SEQ ID NO: 201931 - DNA, 25 bp, Mus musculus
agtaagaaagagcccagtaagagaa

SEQ ID NO: 201932 - DNA, 25 bp, Mus musculus
agtaagaaccgggacactcttctcc

SEQ ID NO: 201933 - DNA, 25 bp, Mus musculus
agtaagaagctgacatgccatatga

SEQ ID NO: 201934 - DNA, 25 bp, Mus musculus
agtaagaataaaagatgcctcagga

SEQ ID NO: 201935 - DNA, 25 bp, Mus musculus
agtaagacaaacccaggagatgaaa

SEQ ID NO: 201936 - DNA, 25 bp, Mus musculus
agtaagacaattgcgtgaagaattt

SEQ ID NO: 201937 - DNA, 25 bp, Mus musculus
agtaagaccgtggtaaatgtttcaa

SEQ ID NO: 201938 - DNA, 25 bp, Mus musculus
agtaagagaacaaattgaaatggat

SEQ ID NO: 201939 - DNA, 25 bp, Mus musculus
agtaagagaaccagcattggattgc

SEQ ID NO: 201940 - DNA, 25 bp, Mus musculus
agtaagaggaattctggctgaaagt

SEQ ID NO: 201941 - DNA, 25 bp, Mus musculus
agtaagagtttgatacgaacagaac

SEQ ID NO: 201942 - DNA, 25 bp, Mus musculus
agtaagcagaggagacctgccaggc

SEQ ID NO: 201943 - DNA, 25 bp, Mus musculus
agtaagcatcagttcagaaaccaac

SEQ ID NO: 201944 - DNA, 25 bp, Mus musculus
agtaagcatgtgtcatggctccgaa

SEQ ID NO: 201945 - DNA, 25 bp, Mus musculus
agtaagccgagttctctagcctcca

SEQ ID NO: 201946 - DNA, 25 bp, Mus musculus
agtaagcggtgggtacagtcctcag

SEQ ID NO: 201947 - DNA, 25 bp, Mus musculus
agtaaggaaactctcggtgccatgg

SEQ ID NO: 201948 - DNA, 25 bp, Mus musculus
agtaaggagagatgcctctggatgt

SEQ ID NO: 201949 - DNA, 25 bp, Mus musculus
agtaaggagagttttagatgcctct

SEQ ID NO: 201950 - DNA, 25 bp, Mus musculus
agtaagggacaagcctacacaggtg

SEQ ID NO: 201951 - DNA, 25 bp, Mus musculus
agtaagtacagttgatacactaaag

SEQ ID NO: 201952 - DNA, 25 bp, Mus musculus
agtaagtacttgaagcatgcctcat

SEQ ID NO: 201953 - DNA, 25 bp, Mus musculus
agtaagtatgataggctgggcttcc

SEQ ID NO: 201954 - DNA, 25 bp, Mus musculus
agtaagtcaggaggatcgcaagtcc

SEQ ID NO: 201955 - DNA, 25 bp, Mus musculus
agtaagtccagatctgatttgtact

SEQ ID NO: 201956 - DNA, 25 bp, Mus musculus
agtaagtctatatggagacaccaag

SEQ ID NO: 201957 - DNA, 25 bp, Mus musculus
agtaagtgaggtccagggagggata

SEQ ID NO: 201958 - DNA, 25 bp, Mus musculus
agtaagtgagtcctttcaggtctcc

SEQ ID NO: 201959 - DNA, 25 bp, Mus musculus
agtaagttatggttatcaccattcc

SEQ ID NO: 201960 - DNA, 25 bp, Mus musculus
agtaataaaatagagaatcatcatt

SEQ ID NO: 201961 - DNA, 25 bp, Mus musculus
agtaataagtgcgtgaagactctac

SEQ ID NO: 201962 - DNA, 25 bp, Mus musculus
agtaatacaagctatggtgaaataa

SEQ ID NO: 201963 - DNA, 25 bp, Mus musculus
agtaatacattcaaactacaactcc

SEQ ID NO: 201964 - DNA, 25 bp, Mus musculus
agtaatataccaagtgtcctggttg

SEQ ID NO: 201965 - DNA, 25 bp, Mus musculus
agtaatataccaatgtctcttggac

SEQ ID NO: 201966 - DNA, 25 bp, Mus musculus
agtaatcagagagtgtcacgatgtc

SEQ ID NO: 201967 - DNA, 25 bp, Mus musculus
agtaatcctccaatcactgttaaga

SEQ ID NO: 201968 - DNA, 25 bp, Mus musculus
agtaatcgatatctaatttttaaga

SEQ ID NO: 201969 - DNA, 25 bp, Mus musculus
agtaatcttatgtcaaggcaccgag

SEQ ID NO: 201970 - DNA, 25 bp, Mus musculus
agtaatgacagacattgagatatct

SEQ ID NO: 201971 - DNA, 25 bp, Mus musculus
agtaatgacagctcagttcctagga

SEQ ID NO: 201972 - DNA, 25 bp, Mus musculus
agtaatgacagctccttcctctaca

SEQ ID NO: 201973 - DNA, 25 bp, Mus musculus
agtaatgcaacgtttcagtctacag

SEQ ID NO: 201974 - DNA, 25 bp, Mus musculus
agtaatgcaacgtttcagtctgaac

SEQ ID NO: 201975 - DNA, 25 bp, Mus musculus
agtaatgcaactgtggcacctttaa

SEQ ID NO: 201976 - DNA, 25 bp, Mus musculus
agtaatgcaagtgtggcacctttaa

SEQ ID NO: 201977 - DNA, 25 bp, Mus musculus
agtaatgccaatcccatcttcatgc

SEQ ID NO: 201978 - DNA, 25 bp, Mus musculus
agtaatgcctggcacttctgtgatg

SEQ ID NO: 201979 - DNA, 25 bp, Mus musculus
agtaatgcttatgaggaagaattct

SEQ ID NO: 201980 - DNA, 25 bp, Mus musculus
agtaatggacagaaagaatgtcact

SEQ ID NO: 201981 - DNA, 25 bp, Mus musculus
agtaatggaggccaggctgtaattc

SEQ ID NO: 201982 - DNA, 25 bp, Mus musculus
agtaatggaggccaggtgacatacc

SEQ ID NO: 201983 - DNA, 25 bp, Mus musculus
agtaatgggggcctgcatccttagt

SEQ ID NO: 201984 - DNA, 25 bp, Mus musculus
agtaatgtcatggaattggggaatt

SEQ ID NO: 201985 - DNA, 25 bp, Mus musculus
agtaatgtcttccaggccaagttcc

SEQ ID NO: 201986 - DNA, 25 bp, Mus musculus
agtaatgtgaagctgcagcctgtca

SEQ ID NO: 201987 - DNA, 25 bp, Mus musculus
agtaatgtgaaggcaaagcccatgg

SEQ ID NO: 201988 - DNA, 25 bp, Mus musculus
agtaattatggatgggatcagtcag

SEQ ID NO: 201989 - DNA, 25 bp, Mus musculus
agtaattccctctgacaaaaggctt

SEQ ID NO: 201990 - DNA, 25 bp, Mus musculus
agtaattccgaaatcaacatgcaga

SEQ ID NO: 201991 - DNA, 25 bp, Mus musculus
agtaattccgagtcctgaagaaagg

SEQ ID NO: 201992 - DNA, 25 bp, Mus musculus
agtacaaaaagctgtgagtaccaga

SEQ ID NO: 201993 - DNA, 25 bp, Mus musculus
agtacaaaaaggtgcatccaagcag

SEQ ID NO: 201994 - DNA, 25 bp, Mus musculus
agtacaaaggggaagttccaggatc

SEQ ID NO: 201995 - DNA, 25 bp, Mus musculus
agtacaaataatctgcaggacagct

SEQ ID NO: 201996 - DNA, 25 bp, Mus musculus
agtacaaatagcagattttggagta

SEQ ID NO: 201997 - DNA, 25 bp, Mus musculus
agtacaacaaagaagctcttagccc

SEQ ID NO: 201998 - DNA, 25 bp, Mus musculus
agtacaaccagcacgaagcccccca

SEQ ID NO: 201999 - DNA, 25 bp, Mus musculus
agtacaagagcgaggaagaggaagt

SEQ ID NO: 202000 - DNA, 25 bp, Mus musculus
agtacaagagcgagggtccagatta

SEQ ID NO: 202001 - DNA, 25 bp, Mus musculus
agtacaaggagcttcctccaatgca

SEQ ID NO: 202002 - DNA, 25 bp, Mus musculus
agtacaatcaggcctggctgctgcc

SEQ ID NO: 202003 - DNA, 25 bp, Mus musculus
agtacaatcctgatttgtactgtgt

SEQ ID NO: 202004 - DNA, 25 bp, Mus musculus
agtacaatgagaaaaaaagacatga

SEQ ID NO: 202005 - DNA, 25 bp, Mus musculus
agtacaatgagattctgatatctgc

SEQ ID NO: 202006 - DNA, 25 bp, Mus musculus
agtacaatgagattctgcacacttc

SEQ ID NO: 202007 - DNA, 25 bp, Mus musculus
agtacacaagaaactaacactaagc

SEQ ID NO: 202008 - DNA, 25 bp, Mus musculus
agtacacacgagttgggccattcca

SEQ ID NO: 202009 - DNA, 25 bp, Mus musculus
agtacacagtgagagttcgatgccc

SEQ ID NO: 202010 - DNA, 25 bp, Mus musculus
agtacaccaagtcaaaagtgagacc

SEQ ID NO: 202011 - DNA, 25 bp, Mus musculus
agtacaccaagtcggacttacggtt

SEQ ID NO: 202012 - DNA, 25 bp, Mus musculus
agtacaccaccacgcccggcttaga

SEQ ID NO: 202013 - DNA, 25 bp, Mus musculus
agtacaccacggacaaggagcccag

SEQ ID NO: 202014 - DNA, 25 bp, Mus musculus
agtacacccaaaagatttttgaatg

SEQ ID NO: 202015 - DNA, 25 bp, Mus musculus
agtacacccaaaaggtcactccatt

SEQ ID NO: 202016 - DNA, 25 bp, Mus musculus
agtacacggtccagcagcaacccta

SEQ ID NO: 202017 - DNA, 25 bp, Mus musculus
agtacacggtccaggatgagagtca

SEQ ID NO: 202018 - DNA, 25 bp, Mus musculus
agtacactcaggctgaagctctacc

SEQ ID NO: 202019 - DNA, 25 bp, Mus musculus
agtacactcaggctgagggtaaaaa

SEQ ID NO: 202020 - DNA, 25 bp, Mus musculus
agtacactttcaaacttccaaagga

SEQ ID NO: 202021 - DNA, 25 bp, Mus musculus
agtacagaagagacaggtgagaact

SEQ ID NO: 202022 - DNA, 25 bp, Mus musculus
agtacagaagatctaaagcgggaag

SEQ ID NO: 202023 - DNA, 25 bp, Mus musculus
agtacagaagcaagggaaaatacag

SEQ ID NO: 202024 - DNA, 25 bp, Mus musculus
agtacagaagcaagggaacctgcaa

SEQ ID NO: 202025 - DNA, 25 bp, Mus musculus
agtacagaatactgtaataccagaa

SEQ ID NO: 202026 - DNA, 25 bp, Mus musculus
agtacagatatggagaaagagaaaa

SEQ ID NO: 202027 - DNA, 25 bp, Mus musculus
agtacagatttacaaagttgcttca

SEQ ID NO: 202028 - DNA, 25 bp, Mus musculus
agtacagcaaacagatgcgtgtaca

SEQ ID NO: 202029 - DNA, 25 bp, Mus musculus
agtacagcaaacagccatttcgtag

SEQ ID NO: 202030 - DNA, 25 bp, Mus musculus
agtacagcacaggctaaataaaacg

SEQ ID NO: 202031 - DNA, 25 bp, Mus musculus
agtacagcacaggttaccagtgcag

SEQ ID NO: 202032 - DNA, 25 bp, Mus musculus
agtacagcacaggttgctggttgtt

SEQ ID NO: 202033 - DNA, 25 bp, Mus musculus
agtacagcagggcttcctgaaagag

SEQ ID NO: 202034 - DNA, 25 bp, Mus musculus
agtacagcatggggcaaggagaggg

SEQ ID NO: 202035 - DNA, 25 bp, Mus musculus
agtacagcatgggtatcaccagcct

SEQ ID NO: 202036 - DNA, 25 bp, Mus musculus
agtacagccaggtgaccgagctgaa

SEQ ID NO: 202037 - DNA, 25 bp, Mus musculus
agtacagcttctggcctccaacttg

SEQ ID NO: 202038 - DNA, 25 bp, Mus musculus
agtacaggattagtttccttttaga

SEQ ID NO: 202039 - DNA, 25 bp, Mus musculus
agtacaggtagggtttcgatgagac

SEQ ID NO: 202040 - DNA, 25 bp, Mus musculus
agtacagtaagggatgttctgatat

SEQ ID NO: 202041 - DNA, 25 bp, Mus musculus
agtacagtaagtactggctctggaa

SEQ ID NO: 202042 - DNA, 25 bp, Mus musculus
agtacagtaagttcatagacagagg

SEQ ID NO: 202043 - DNA, 25 bp, Mus musculus
agtacatatgagtcgaacaccaaac

SEQ ID NO: 202044 - DNA, 25 bp, Mus musculus
agtacatcaagcgcgccaacagcct

SEQ ID NO: 202045 - DNA, 25 bp, Mus musculus
agtacatccaccctgaaacgatcag

SEQ ID NO: 202046 - DNA, 25 bp, Mus musculus
agtacatctttgaaggtctgggaca

SEQ ID NO: 202047 - DNA, 25 bp, Mus musculus
agtacatgatccagagaggtgctcg

SEQ ID NO: 202048 - DNA, 25 bp, Mus musculus
agtacatgctgacagatcgggagaa

SEQ ID NO: 202049 - DNA, 25 bp, Mus musculus
agtacatggaggaggtgcggcggca

SEQ ID NO: 202050 - DNA, 25 bp, Mus musculus
agtacatggggagatcctttctctg

SEQ ID NO: 202051 - DNA, 25 bp, Mus musculus
agtacatggggaggattcagtcctt

SEQ ID NO: 202052 - DNA, 25 bp, Mus musculus
agtacatgtgcgcagacaaacccgg

SEQ ID NO: 202053 - DNA, 25 bp, Mus musculus
agtacatgtgcgcagccgcctggga

SEQ ID NO: 202054 - DNA, 25 bp, Mus musculus
agtacattacgatgagactgaggct

SEQ ID NO: 202055 - DNA, 25 bp, Mus musculus
agtacattacggctgagcgggagca

SEQ ID NO: 202056 - DNA, 25 bp, Mus musculus
agtacattattgagatgacacagag

SEQ ID NO: 202057 - DNA, 25 bp, Mus musculus
agtacattattgaggccactgcaga

SEQ ID NO: 202058 - DNA, 25 bp, Mus musculus
agtaccaaggacctgtgttacattg

SEQ ID NO: 202059 - DNA, 25 bp, Mus musculus
agtaccaaggtgagactctgctgct

SEQ ID NO: 202060 - DNA, 25 bp, Mus musculus
agtaccacagggagtccccccatcc

SEQ ID NO: 202061 - DNA, 25 bp, Mus musculus
agtaccacgagcagcccgaggagct

SEQ ID NO: 202062 - DNA, 25 bp, Mus musculus
agtaccacttgcagacaaatgaatt

SEQ ID NO: 202063 - DNA, 25 bp, Mus musculus
agtaccagaagacctcatcgggaac

SEQ ID NO: 202064 - DNA, 25 bp, Mus musculus
agtaccagaccagtatcacagagca

SEQ ID NO: 202065 - DNA, 25 bp, Mus musculus
agtaccagaccagtcgtgttgagga

SEQ ID NO: 202066 - DNA, 25 bp, Mus musculus
agtaccagttgtcgccctttaacca

SEQ ID NO: 202067 - DNA, 25 bp, Mus musculus
agtaccatatggaagactcggagat

SEQ ID NO: 202068 - DNA, 25 bp, Mus musculus
agtaccatgcaggcgagacttcagc

SEQ ID NO: 202069 - DNA, 25 bp, Mus musculus
agtaccatgcagggttctgaggagg

SEQ ID NO: 202070 - DNA, 25 bp, Mus musculus
agtaccatgtgcaggacccaaggct

SEQ ID NO: 202071 - DNA, 25 bp, Mus musculus
agtacccacacacccaaaccaggtg

SEQ ID NO: 202072 - DNA, 25 bp, Mus musculus
agtacccatcaactaattgtcaaca

SEQ ID NO: 202073 - DNA, 25 bp, Mus musculus
agtacccatcaagccaccctgtatt

SEQ ID NO: 202074 - DNA, 25 bp, Mus musculus
agtaccccaatcggatctgtgtaag

SEQ ID NO: 202075 - DNA, 25 bp, Mus musculus
agtaccccaatcggggcaccacctg

SEQ ID NO: 202076 - DNA, 25 bp, Mus musculus
agtaccccggcctagatgcagcttc

SEQ ID NO: 202077 - DNA, 25 bp, Mus musculus
agtaccctcggcgcttgttctctac

SEQ ID NO: 202078 - DNA, 25 bp, Mus musculus
agtaccctgaaagagttaaacatct

SEQ ID NO: 202079 - DNA, 25 bp, Mus musculus
agtacccttgctgcaatgaagctga

SEQ ID NO: 202080 - DNA, 25 bp, Mus musculus
agtaccgaaagctggacgatggtag

SEQ ID NO: 202081 - DNA, 25 bp, Mus musculus
agtaccggcaaatggttgaaactga

SEQ ID NO: 202082 - DNA, 25 bp, Mus musculus
agtaccgtaaacccaaggcagtggg

SEQ ID NO: 202083 - DNA, 25 bp, Mus musculus
agtaccgttgtgagctgctggggcc

SEQ ID NO: 202084 - DNA, 25 bp, Mus musculus
agtacctagaagatcttggtaatgt

SEQ ID NO: 202085 - DNA, 25 bp, Mus musculus
agtacctcagcaaatctgtcatcca

SEQ ID NO: 202086 - DNA, 25 bp, Mus musculus
agtacctcagcttcaggaaaagctg

SEQ ID NO: 202087 - DNA, 25 bp, Mus musculus
agtacctcaggaaatctgtcatcca

SEQ ID NO: 202088 - DNA, 25 bp, Mus musculus
agtacctcaggttcaggaaaagctg

SEQ ID NO: 202089 - DNA, 25 bp, Mus musculus
agtacctcccaagccggccgttgaa

SEQ ID NO: 202090 - DNA, 25 bp, Mus musculus
agtacctcccagtactgggtacaga

SEQ ID NO: 202091 - DNA, 25 bp, Mus musculus
agtacctgaagggaaccccaatata

SEQ ID NO: 202092 - DNA, 25 bp, Mus musculus
agtacctgaaggtggagagctgtga

SEQ ID NO: 202093 - DNA, 25 bp, Mus musculus
agtacctggaccagaggagccccag

SEQ ID NO: 202094 - DNA, 25 bp, Mus musculus
agtacctggaccagcaacagtatca

SEQ ID NO: 202095 - DNA, 25 bp, Mus musculus
agtacctggagcaatcaaagtatcg

SEQ ID NO: 202096 - DNA, 25 bp, Mus musculus
agtacctggagggcctgttcttctt

SEQ ID NO: 202097 - DNA, 25 bp, Mus musculus
agtacctgtatacaggccgcttgga

SEQ ID NO: 202098 - DNA, 25 bp, Mus musculus
agtaccttcgctaggtatatatggt

SEQ ID NO: 202099 - DNA, 25 bp, Mus musculus
agtaccttgggatcagagggctcct

SEQ ID NO: 202100 - DNA, 25 bp, Mus musculus
agtaccttgggggccggcacatggg

SEQ ID NO: 202101 - DNA, 25 bp, Mus musculus
agtacctttccaataccaaatatga

SEQ ID NO: 202102 - DNA, 25 bp, Mus musculus
agtacctttccagagctgccttaca

SEQ ID NO: 202103 - DNA, 25 bp, Mus musculus
agtacgaaggcaaggcgacccctct

SEQ ID NO: 202104 - DNA, 25 bp, Mus musculus
agtacgaatttcagcgaggagagtg

SEQ ID NO: 202105 - DNA, 25 bp, Mus musculus
agtacgacatggctgccagaaaatg

SEQ ID NO: 202106 - DNA, 25 bp, Mus musculus
agtacgactgaaggagaaaattttg

SEQ ID NO: 202107 - DNA, 25 bp, Mus musculus
agtacgaggagagagcaagaggagg

SEQ ID NO: 202108 - DNA, 25 bp, Mus musculus
agtacgaggaggaacaggaaggtaa

SEQ ID NO: 202109 - DNA, 25 bp, Mus musculus
agtacgcaagatgaacactaccacc

SEQ ID NO: 202110 - DNA, 25 bp, Mus musculus
agtacgccaggagtgagagagagag

SEQ ID NO: 202111 - DNA, 25 bp, Mus musculus
agtacgcccgaggacttcaggaacc

SEQ ID NO: 202112 - DNA, 25 bp, Mus musculus
agtacgcctgcagagcccacatggt

SEQ ID NO: 202113 - DNA, 25 bp, Mus musculus
agtacgcctgcagtgctgtgaagag

SEQ ID NO: 202114 - DNA, 25 bp, Mus musculus
agtacggcgtggccttttacaacta

SEQ ID NO: 202115 - DNA, 25 bp, Mus musculus
agtacgggatttgctggacaggacg

SEQ ID NO: 202116 - DNA, 25 bp, Mus musculus
agtacgtttactgtgagttccttcg

SEQ ID NO: 202117 - DNA, 25 bp, Mus musculus
agtactacaaggacatcaatgcaag

SEQ ID NO: 202118 - DNA, 25 bp, Mus musculus
agtactagaaaagttcctgtggaag

SEQ ID NO: 202119 - DNA, 25 bp, Mus musculus
agtactagtgaggccacaggcagga

SEQ ID NO: 202120 - DNA, 25 bp, Mus musculus
agtactagttaagtgcctgaagacc

SEQ ID NO: 202121 - DNA, 25 bp, Mus musculus
agtactatctgacaagcacaaacgg

SEQ ID NO: 202122 - DNA, 25 bp, Mus musculus
agtactatctgacaagcacctatag

SEQ ID NO: 202123 - DNA, 25 bp, Mus musculus
agtactatctgacagaagtggtcct

SEQ ID NO: 202124 - DNA, 25 bp, Mus musculus
agtactatggggatgtctgtgttag

SEQ ID NO: 202125 - DNA, 25 bp, Mus musculus
agtactcacccaagattgatgacca

SEQ ID NO: 202126 - DNA, 25 bp, Mus musculus
agtactcacccaagctatgagcttg

SEQ ID NO: 202127 - DNA, 25 bp, Mus musculus
agtactcacccaaggagctgctagc

SEQ ID NO: 202128 - DNA, 25 bp, Mus musculus
agtactcacctagagtggaccagat

SEQ ID NO: 202129 - DNA, 25 bp, Mus musculus
agtactcatgatgcaagttactgta

SEQ ID NO: 202130 - DNA, 25 bp, Mus musculus
agtactcattctgaatctagtaaga

SEQ ID NO: 202131 - DNA, 25 bp, Mus musculus
agtactcattcttcttttagctcta

SEQ ID NO: 202132 - DNA, 25 bp, Mus musculus
agtactccacgttgcaggatctgtg

SEQ ID NO: 202133 - DNA, 25 bp, Mus musculus
agtactccctccagacatggaccct

SEQ ID NO: 202134 - DNA, 25 bp, Mus musculus
agtactcgatggcggagaggtgtct

SEQ ID NO: 202135 - DNA, 25 bp, Mus musculus
agtactcgatggcggagagtgaggg

SEQ ID NO: 202136 - DNA, 25 bp, Mus musculus
agtactctgtttcagtggaaacaag

SEQ ID NO: 202137 - DNA, 25 bp, Mus musculus
agtactgacaaggggtgtgattttg

SEQ ID NO: 202138 - DNA, 25 bp, Mus musculus
agtactgactcaggctctgggggac

SEQ ID NO: 202139 - DNA, 25 bp, Mus musculus
agtactgactcagtatgaagagcgc

SEQ ID NO: 202140 - DNA, 25 bp, Mus musculus
agtactgagaggtagccagaaatgg

SEQ ID NO: 202141 - DNA, 25 bp, Mus musculus
agtactgatgctggggagaatcccg

SEQ ID NO: 202142 - DNA, 25 bp, Mus musculus
agtactgcaagattggcaaagagac

SEQ ID NO: 202143 - DNA, 25 bp, Mus musculus
agtactgcagaaatatgccgagcgc

SEQ ID NO: 202144 - DNA, 25 bp, Mus musculus
agtactgcatcgcccttgactacaa

SEQ ID NO: 202145 - DNA, 25 bp, Mus musculus
agtactgcgaagatgtcaatgaatg

SEQ ID NO: 202146 - DNA, 25 bp, Mus musculus
agtactgctgtacggtagcagatat

SEQ ID NO: 202147 - DNA, 25 bp, Mus musculus
agtactgctgtacgtgagtcagccg

SEQ ID NO: 202148 - DNA, 25 bp, Mus musculus
agtactggaaggaaggtgcacactt

SEQ ID NO: 202149 - DNA, 25 bp, Mus musculus
agtactggcggtgtctctttggagg

SEQ ID NO: 202150 - DNA, 25 bp, Mus musculus
agtactgtcacagatgcaggagaca

SEQ ID NO: 202151 - DNA, 25 bp, Mus musculus
agtactgtcacaggtctggggcttt

SEQ ID NO: 202152 - DNA, 25 bp, Mus musculus
agtactgtgaaagagttgttatttc

SEQ ID NO: 202153 - DNA, 25 bp, Mus musculus
agtactgtgaaagatatgaatttgg

SEQ ID NO: 202154 - DNA, 25 bp, Mus musculus
agtacttaaggctcaggccgtggac

SEQ ID NO: 202155 - DNA, 25 bp, Mus musculus
agtacttaagtcaggaggaggctca

SEQ ID NO: 202156 - DNA, 25 bp, Mus musculus
agtacttagcactcctacagcagac

SEQ ID NO: 202157 - DNA, 25 bp, Mus musculus
agtacttagcactttatttgcagct

SEQ ID NO: 202158 - DNA, 25 bp, Mus musculus
agtacttcaagagcctgcacaggtt

SEQ ID NO: 202159 - DNA, 25 bp, Mus musculus
agtacttcctggtgggtgcaggggc

SEQ ID NO: 202160 - DNA, 25 bp, Mus musculus
agtacttcttcctcatcggaccccc

SEQ ID NO: 202161 - DNA, 25 bp, Mus musculus
agtacttcttgcacgatgacagaga

SEQ ID NO: 202162 - DNA, 25 bp, Mus musculus
agtacttgaagcatgcctcatggct

SEQ ID NO: 202163 - DNA, 25 bp, Mus musculus
agtacttgagctaccaggagcccgc

SEQ ID NO: 202164 - DNA, 25 bp, Mus musculus
agtacttggccgagcagcctgcgcc

SEQ ID NO: 202165 - DNA, 25 bp, Mus musculus
agtacttgggaatcatgaccaacac

SEQ ID NO: 202166 - DNA, 25 bp, Mus musculus
agtacttgggagctaggagaccatc

SEQ ID NO: 202167 - DNA, 25 bp, Mus musculus
agtactttgcccgagggctccgggg

SEQ ID NO: 202168 - DNA, 25 bp, Mus musculus
agtacttttgaattaggacgagtct

SEQ ID NO: 202169 - DNA, 25 bp, Mus musculus
agtacttttgaattgttcctgtgaa

SEQ ID NO: 202170 - DNA, 25 bp, Mus musculus
agtacttttgggggagctgaagaag

SEQ ID NO: 202171 - DNA, 25 bp, Mus musculus
agtacttttttggttatgggcaaag

SEQ ID NO: 202172 - DNA, 25 bp, Mus musculus
agtagaaaaaacagacagtgatgtg

SEQ ID NO: 202173 - DNA, 25 bp, Mus musculus
agtagaacaagagactaagtctggc

SEQ ID NO: 202174 - DNA, 25 bp, Mus musculus
agtagaacaagtatcatctcagagt

SEQ ID NO: 202175 - DNA, 25 bp, Mus musculus
agtagaaccaggggaaagcgcagcc

SEQ ID NO: 202176 - DNA, 25 bp, Mus musculus
agtagaactgccgggttcatcgtgg

SEQ ID NO: 202177 - DNA, 25 bp, Mus musculus
agtagaagaacagaaactacataaa

SEQ ID NO: 202178 - DNA, 25 bp, Mus musculus
agtagaagagaaaactctctacttc

SEQ ID NO: 202179 - DNA, 25 bp, Mus musculus
agtagaagagctgccctctgaagcc

SEQ ID NO: 202180 - DNA, 25 bp, Mus musculus
agtagacaagggagcatatgcagga

SEQ ID NO: 202181 - DNA, 25 bp, Mus musculus
agtagacacttgtggaaggaatctg

SEQ ID NO: 202182 - DNA, 25 bp, Mus musculus
agtagaccttaacctagcttaccat

SEQ ID NO: 202183 - DNA, 25 bp, Mus musculus
agtagacttattaaggtcacagtaa

SEQ ID NO: 202184 - DNA, 25 bp, Mus musculus
agtagagaaaaggttttctgtccac

SEQ ID NO: 202185 - DNA, 25 bp, Mus musculus
agtagagaaccccaggcacggccac

SEQ ID NO: 202186 - DNA, 25 bp, Mus musculus
agtagagaaggtccatctctgtaat

SEQ ID NO: 202187 - DNA, 25 bp, Mus musculus
agtagagaagtgattgtgaagccag

SEQ ID NO: 202188 - DNA, 25 bp, Mus musculus
agtagagaagtgcctagacaagtat

SEQ ID NO: 202189 - DNA, 25 bp, Mus musculus
agtagagacgccagttctacctcca

SEQ ID NO: 202190 - DNA, 25 bp, Mus musculus
agtagagaggcattttcttgagata

SEQ ID NO: 202191 - DNA, 25 bp, Mus musculus
agtagagaggcgagggttgtgagcc

SEQ ID NO: 202192 - DNA, 25 bp, Mus musculus
agtagagagggtcctgagtgatgtt

SEQ ID NO: 202193 - DNA, 25 bp, Mus musculus
agtagagcagccaggacaatcccag

SEQ ID NO: 202194 - DNA, 25 bp, Mus musculus
agtagagcagtagtggcttcacgga

SEQ ID NO: 202195 - DNA, 25 bp, Mus musculus
agtagagccagcaagtccacatgcg

SEQ ID NO: 202196 - DNA, 25 bp, Mus musculus
agtagagccaggcttgccatctcca

SEQ ID NO: 202197 - DNA, 25 bp, Mus musculus
agtagagctatcttataatctggag

SEQ ID NO: 202198 - DNA, 25 bp, Mus musculus
agtagaggaacattgtaaattcaag

SEQ ID NO: 202199 - DNA, 25 bp, Mus musculus
agtagaggactgttatgaaagagaa

SEQ ID NO: 202200 - DNA, 25 bp, Mus musculus
agtagaggcctttgtgaaaatgtcc

SEQ ID NO: 202201 - DNA, 25 bp, Mus musculus
agtagagggctaggcctgcctgccc

SEQ ID NO: 202202 - DNA, 25 bp, Mus musculus
agtagatgaagtgccagaaccagct

SEQ ID NO: 202203 - DNA, 25 bp, Mus musculus
agtagatttagatgccagcacctgg

SEQ ID NO: 202204 - DNA, 25 bp, Mus musculus
agtagcaaagactctgttacggcat

SEQ ID NO: 202205 - DNA, 25 bp, Mus musculus
agtagcaaaggaatgggacagaaga

SEQ ID NO: 202206 - DNA, 25 bp, Mus musculus
agtagcaaaggtgattggatgtgtc

SEQ ID NO: 202207 - DNA, 25 bp, Mus musculus
agtagcaaaggttcagcctatggaa

SEQ ID NO: 202208 - DNA, 25 bp, Mus musculus
agtagcaacaaaacgctgccgtcca

SEQ ID NO: 202209 - DNA, 25 bp, Mus musculus
agtagcaacaaagagcagcggtcag

SEQ ID NO: 202210 - DNA, 25 bp, Mus musculus
agtagcaacaagctgcgcaaaccat

SEQ ID NO: 202211 - DNA, 25 bp, Mus musculus
agtagcaatgaaggggtagaggagc

SEQ ID NO: 202212 - DNA, 25 bp, Mus musculus
agtagcagaggtaactcagcaactg

SEQ ID NO: 202213 - DNA, 25 bp, Mus musculus
agtagcagcccatacaatcctcctg

SEQ ID NO: 202214 - DNA, 25 bp, Mus musculus
agtagcagtaataggaaagccgcaa

SEQ ID NO: 202215 - DNA, 25 bp, Mus musculus
agtagcagtaattggaaagccgcaa

SEQ ID NO: 202216 - DNA, 25 bp, Mus musculus
agtagcagtggcgaggccatggtgg

SEQ ID NO: 202217 - DNA, 25 bp, Mus musculus
agtagcagtgtcagtgtgcactcag

SEQ ID NO: 202218 - DNA, 25 bp, Mus musculus
agtagccaatgatcatgaagaagat

SEQ ID NO: 202219 - DNA, 25 bp, Mus musculus
agtagccaatgatttatctgttttc

SEQ ID NO: 202220 - DNA, 25 bp, Mus musculus
agtagccaattacagaatctgggag

SEQ ID NO: 202221 - DNA, 25 bp, Mus musculus
agtagccatgatggttactaacttt

SEQ ID NO: 202222 - DNA, 25 bp, Mus musculus
agtagcccagggcagcgagatgatt

SEQ ID NO: 202223 - DNA, 25 bp, Mus musculus
agtagccccagctgagaaaaaacgc

SEQ ID NO: 202224 - DNA, 25 bp, Mus musculus
agtagcctccggctatgcatatgga

SEQ ID NO: 202225 - DNA, 25 bp, Mus musculus
agtagcggaaagctgagcagcaagt

SEQ ID NO: 202226 - DNA, 25 bp, Mus musculus
agtagcgtgaaggttcttcatgaga

SEQ ID NO: 202227 - DNA, 25 bp, Mus musculus
agtagctaaaacattctcatacaag

SEQ ID NO: 202228 - DNA, 25 bp, Mus musculus
agtagctatgaaggagatgaagagg

SEQ ID NO: 202229 - DNA, 25 bp, Mus musculus
agtagctatggacgtggaggacctg

SEQ ID NO: 202230 - DNA, 25 bp, Mus musculus
agtagctcagcagacaagaaaaatc

SEQ ID NO: 202231 - DNA, 25 bp, Mus musculus
agtagctcagcttcttcagctgaca

SEQ ID NO: 202232 - DNA, 25 bp, Mus musculus
agtagctcaggaatgtcaagtgaaa

SEQ ID NO: 202233 - DNA, 25 bp, Mus musculus
agtagcttaatagttgaaccaagac

SEQ ID NO: 202234 - DNA, 25 bp, Mus musculus
agtagcttagcatggtttattgaaa

SEQ ID NO: 202235 - DNA, 25 bp, Mus musculus
agtagcttcataatcctcagcccat

SEQ ID NO: 202236 - DNA, 25 bp, Mus musculus
agtagcttcatgctctctatctccg

SEQ ID NO: 202237 - DNA, 25 bp, Mus musculus
agtagcttccaggtggtggtcctca

SEQ ID NO: 202238 - DNA, 25 bp, Mus musculus
agtagctttgaagaatgaagaggaa

SEQ ID NO: 202239 - DNA, 25 bp, Mus musculus
agtaggacttaggagtacagagact

SEQ ID NO: 202240 - DNA, 25 bp, Mus musculus
agtaggcaaggaccccatgactcag

SEQ ID NO: 202241 - DNA, 25 bp, Mus musculus
agtaggcactgatattcgagactca

SEQ ID NO: 202242 - DNA, 25 bp, Mus musculus
agtaggcatcgagggcttcttcggc

SEQ ID NO: 202243 - DNA, 25 bp, Mus musculus
agtaggccctattggagaccctggg

SEQ ID NO: 202244 - DNA, 25 bp, Mus musculus
agtaggctaccggtgatggtgtgga

SEQ ID NO: 202245 - DNA, 25 bp, Mus musculus
agtaggctccgaggtggcgaaatgg

SEQ ID NO: 202246 - DNA, 25 bp, Mus musculus
agtagggaccaaggaagctcgaagc

SEQ ID NO: 202247 - DNA, 25 bp, Mus musculus
agtaggggtgggagatccgaattcg

SEQ ID NO: 202248 - DNA, 25 bp, Mus musculus
agtaggtatcagggtggactcagta

SEQ ID NO: 202249 - DNA, 25 bp, Mus musculus
agtaggtcccgtacccacatcacag

SEQ ID NO: 202250 - DNA, 25 bp, Mus musculus
agtaggtttgtagtgagcttagcct

SEQ ID NO: 202251 - DNA, 25 bp, Mus musculus
agtagtccaacagagaatgaagcac

SEQ ID NO: 202252 - DNA, 25 bp, Mus musculus
agtagtctggtcagatagttttgag

SEQ ID NO: 202253 - DNA, 25 bp, Mus musculus
agtagtctttcagatcctgcctcag

SEQ ID NO: 202254 - DNA, 25 bp, Mus musculus
agtagtgacaggacactactggaca

SEQ ID NO: 202255 - DNA, 25 bp, Mus musculus
agtagtgttccctgacgctgccggc

SEQ ID NO: 202256 - DNA, 25 bp, Mus musculus
agtagtgttccctgggttctgcagc

SEQ ID NO: 202257 - DNA, 25 bp, Mus musculus
agtagttaccgtggtcaagaagaat

SEQ ID NO: 202258 - DNA, 25 bp, Mus musculus
agtagttctaaagtgtcatatttga

SEQ ID NO: 202259 - DNA, 25 bp, Mus musculus
agtagtttgatgagtcttgattgga

SEQ ID NO: 202260 - DNA, 25 bp, Mus musculus
agtataaaaaacgcaataccacaga

SEQ ID NO: 202261 - DNA, 25 bp, Mus musculus
agtataaaacccatacaatttgttt

SEQ ID NO: 202262 - DNA, 25 bp, Mus musculus
agtataaaacccatccagaatgaag

SEQ ID NO: 202263 - DNA, 25 bp, Mus musculus
agtataaacactggaacttagcagg

SEQ ID NO: 202264 - DNA, 25 bp, Mus musculus
agtataaacactgtaaaggatctcc

SEQ ID NO: 202265 - DNA, 25 bp, Mus musculus
agtataacattcaaggaagccatca

SEQ ID NO: 202266 - DNA, 25 bp, Mus musculus
agtataacattcaaggcccttctga

SEQ ID NO: 202267 - DNA, 25 bp, Mus musculus
agtataactcaaggctccagaatgg

SEQ ID NO: 202268 - DNA, 25 bp, Mus musculus
agtataactcagggaatgggacagg

SEQ ID NO: 202269 - DNA, 25 bp, Mus musculus
agtataagacagatttcttctgccc

SEQ ID NO: 202270 - DNA, 25 bp, Mus musculus
agtataagacagtaagcgtcaccct

SEQ ID NO: 202271 - DNA, 25 bp, Mus musculus
agtataattcacagaactgggaagc

SEQ ID NO: 202272 - DNA, 25 bp, Mus musculus
agtatacaaaaggatttactaggtc

SEQ ID NO: 202273 - DNA, 25 bp, Mus musculus
agtatacaagattatcctgtccttg

SEQ ID NO: 202274 - DNA, 25 bp, Mus musculus
agtatacaaggtatcagtacttttt

SEQ ID NO: 202275 - DNA, 25 bp, Mus musculus
agtatacatgggagactctggagga

SEQ ID NO: 202276 - DNA, 25 bp, Mus musculus
agtatacgacaaacctgaggtctgg

SEQ ID NO: 202277 - DNA, 25 bp, Mus musculus
agtatactcatcctgggtcactgac

SEQ ID NO: 202278 - DNA, 25 bp, Mus musculus
agtatagaacctggcctcatctgta

SEQ ID NO: 202279 - DNA, 25 bp, Mus musculus
agtatagacctgaagagtacagtcg

SEQ ID NO: 202280 - DNA, 25 bp, Mus musculus
agtatagagacacagccagctcagg

SEQ ID NO: 202281 - DNA, 25 bp, Mus musculus
agtatagagacacagcctgagtgca

SEQ ID NO: 202282 - DNA, 25 bp, Mus musculus
agtatagataaatagatatgttttc

SEQ ID NO: 202283 - DNA, 25 bp, Mus musculus
agtatagataaggtgaagaaactgc

SEQ ID NO: 202284 - DNA, 25 bp, Mus musculus
agtatagataagtgtcatatttgaa

SEQ ID NO: 202285 - DNA, 25 bp, Mus musculus
agtatagcagagggctcctgctgaa

SEQ ID NO: 202286 - DNA, 25 bp, Mus musculus
agtatagccaggtcatccacaggtt

SEQ ID NO: 202287 - DNA, 25 bp, Mus musculus
agtatagctccccgaaagaaaagtt

SEQ ID NO: 202288 - DNA, 25 bp, Mus musculus
agtatatactcaaggtatcgcaggg

SEQ ID NO: 202289 - DNA, 25 bp, Mus musculus
agtatatgccagggggctctgtaaa

SEQ ID NO: 202290 - DNA, 25 bp, Mus musculus
agtatatgggaagtactggagaaga

SEQ ID NO: 202291 - DNA, 25 bp, Mus musculus
agtatatggggcagagcccgggctt

SEQ ID NO: 202292 - DNA, 25 bp, Mus musculus
agtatattcttggggaacttagcat

SEQ ID NO: 202293 - DNA, 25 bp, Mus musculus
agtatattcttggggttgaatctcc

SEQ ID NO: 202294 - DNA, 25 bp, Mus musculus
agtatattgcaggattcactagcaa

SEQ ID NO: 202295 - DNA, 25 bp, Mus musculus
agtatcaaaacttctctattctcgg

SEQ ID NO: 202296 - DNA, 25 bp, Mus musculus
agtatcacaacaagattgaggaaga

SEQ ID NO: 202297 - DNA, 25 bp, Mus musculus
agtatcacaacaaggcccatctgct

SEQ ID NO: 202298 - DNA, 25 bp, Mus musculus
agtatcacaccatagatgaccactg

SEQ ID NO: 202299 - DNA, 25 bp, Mus musculus
agtatcacagcctgaagctggagtg

SEQ ID NO: 202300 - DNA, 25 bp, Mus musculus
agtatcacgtgcagcacctggccac

SEQ ID NO: 202301 - DNA, 25 bp, Mus musculus
agtatcacgtgcagggtctttcagg

SEQ ID NO: 202302 - DNA, 25 bp, Mus musculus
agtatcactgtggaatatcgttcag

SEQ ID NO: 202303 - DNA, 25 bp, Mus musculus
agtatcactgtggcaatagtaattg

SEQ ID NO: 202304 - DNA, 25 bp, Mus musculus
agtatcagagagacaagattgagga

SEQ ID NO: 202305 - DNA, 25 bp, Mus musculus
agtatccaaaggagtgtgcagcaaa

SEQ ID NO: 202306 - DNA, 25 bp, Mus musculus
agtatccaaagttcaattttgtggg

SEQ ID NO: 202307 - DNA, 25 bp, Mus musculus
agtatccacaacaggtgtgagcagg

SEQ ID NO: 202308 - DNA, 25 bp, Mus musculus
agtatccacaacaggttccacccga

SEQ ID NO: 202309 - DNA, 25 bp, Mus musculus
agtatccagagaaacatgactttgg

SEQ ID NO: 202310 - DNA, 25 bp, Mus musculus
agtatccatcatcagaagtactccc

SEQ ID NO: 202311 - DNA, 25 bp, Mus musculus
agtatccatcttctgtatctcagaa

SEQ ID NO: 202312 - DNA, 25 bp, Mus musculus
agtatccgaggctggttatgacggc

SEQ ID NO: 202313 - DNA, 25 bp, Mus musculus
agtatcctgaaggaaagaccgtaga

SEQ ID NO: 202314 - DNA, 25 bp, Mus musculus
agtatcggaagcttgtgtcggcagt

SEQ ID NO: 202315 - DNA, 25 bp, Mus musculus
agtatcgggcttcagggggctgagg

SEQ ID NO: 202316 - DNA, 25 bp, Mus musculus
agtatcggtaactgtgaatgcttcg

SEQ ID NO: 202317 - DNA, 25 bp, Mus musculus
agtatcggtaagtgttattgtaacc

SEQ ID NO: 202318 - DNA, 25 bp, Mus musculus
agtatcggtactaatgtctgcgaca

SEQ ID NO: 202319 - DNA, 25 bp, Mus musculus
agtatcggtactcctccaaagttta

SEQ ID NO: 202320 - DNA, 25 bp, Mus musculus
agtatctaagagtgcttggctgtct

SEQ ID NO: 202321 - DNA, 25 bp, Mus musculus
agtatctaatatcagcgctcatgct

SEQ ID NO: 202322 - DNA, 25 bp, Mus musculus
agtatctatgcagggtgacaaggga

SEQ ID NO: 202323 - DNA, 25 bp, Mus musculus
agtatctcactgaaagatttgtata

SEQ ID NO: 202324 - DNA, 25 bp, Mus musculus
agtatctcagaaagacccaaatggg

SEQ ID NO: 202325 - DNA, 25 bp, Mus musculus
agtatctcagattgaagaccaaatt

SEQ ID NO: 202326 - DNA, 25 bp, Mus musculus
agtatctcagtggaggagaactatt

SEQ ID NO: 202327 - DNA, 25 bp, Mus musculus
agtatctcctcgctcttcgaacgga

SEQ ID NO: 202328 - DNA, 25 bp, Mus musculus
agtatctggaggagctggaccagat

SEQ ID NO: 202329 - DNA, 25 bp, Mus musculus
agtatctggggattctacagcacag

SEQ ID NO: 202330 - DNA, 25 bp, Mus musculus
agtatcttcagtcaagacctttgga

SEQ ID NO: 202331 - DNA, 25 bp, Mus musculus
agtatcttctgggcggaacgaagag

SEQ ID NO: 202332 - DNA, 25 bp, Mus musculus
agtatcttgagttgaactacaggga

SEQ ID NO: 202333 - DNA, 25 bp, Mus musculus
agtatcttgatcccacctaaaccaa

SEQ ID NO: 202334 - DNA, 25 bp, Mus musculus
agtatctttaccttctacttccaga

SEQ ID NO: 202335 - DNA, 25 bp, Mus musculus
agtatctttccaagagctggagaag

SEQ ID NO: 202336 - DNA, 25 bp, Mus musculus
agtatgaaagcaaggccagaagtca

SEQ ID NO: 202337 - DNA, 25 bp, Mus musculus
agtatgaaagtacagggttgtttca

SEQ ID NO: 202338 - DNA, 25 bp, Mus musculus
agtatgaacaggcctgtcgtgagtt

SEQ ID NO: 202339 - DNA, 25 bp, Mus musculus
agtatgaagaggtggcccgtaagct

SEQ ID NO: 202340 - DNA, 25 bp, Mus musculus
agtatgaagaggtggctcgtaagtt

SEQ ID NO: 202341 - DNA, 25 bp, Mus musculus
agtatgaagttttcaggggctctct

SEQ ID NO: 202342 - DNA, 25 bp, Mus musculus
agtatgaattggagctactgctttc

SEQ ID NO: 202343 - DNA, 25 bp, Mus musculus
agtatgacctcaagggctctctagt

SEQ ID NO: 202344 - DNA, 25 bp, Mus musculus
agtatgacgccagctgtgactccag

SEQ ID NO: 202345 - DNA, 25 bp, Mus musculus
agtatgagaacttctatgcggattt

SEQ ID NO: 202346 - DNA, 25 bp, Mus musculus
agtatgagaaggatgttgctgacta

SEQ ID NO: 202347 - DNA, 25 bp, Mus musculus
agtatgagatgggggaatgcacccg

SEQ ID NO: 202348 - DNA, 25 bp, Mus musculus
agtatgagatggggtcacctccaag

SEQ ID NO: 202349 - DNA, 25 bp, Mus musculus
agtatgagcaagatccagtatgtac

SEQ ID NO: 202350 - DNA, 25 bp, Mus musculus
agtatgagtctcttcagcgtcaaga

SEQ ID NO: 202351 - DNA, 25 bp, Mus musculus
agtatgatgcccaggacttagaaga

SEQ ID NO: 202352 - DNA, 25 bp, Mus musculus
agtatgatgcccagtcttaccatga

SEQ ID NO: 202353 - DNA, 25 bp, Mus musculus
agtatgatttgaggacccagttccg

SEQ ID NO: 202354 - DNA, 25 bp, Mus musculus
agtatgcacagggtatccagaagtt

SEQ ID NO: 202355 - DNA, 25 bp, Mus musculus
agtatgccagacagctgaggcccag

SEQ ID NO: 202356 - DNA, 25 bp, Mus musculus
agtatgccaggtactacatgaggcc

SEQ ID NO: 202357 - DNA, 25 bp, Mus musculus
agtatgctaagttctttgaaaccat

SEQ ID NO: 202358 - DNA, 25 bp, Mus musculus
agtatgctcgggagcatggcttgga

SEQ ID NO: 202359 - DNA, 25 bp, Mus musculus
agtatgctgagctgacacttatgcc

SEQ ID NO: 202360 - DNA, 25 bp, Mus musculus
agtatgctgagctgctggaagagca

SEQ ID NO: 202361 - DNA, 25 bp, Mus musculus
agtatggaaatagtttcttggatct

SEQ ID NO: 202362 - DNA, 25 bp, Mus musculus
agtatggaaatgtcctaccctaggc

SEQ ID NO: 202363 - DNA, 25 bp, Mus musculus
agtatggaagtggcttggctgagta

SEQ ID NO: 202364 - DNA, 25 bp, Mus musculus
agtatggaagtgtttgccgaagatg

SEQ ID NO: 202365 - DNA, 25 bp, Mus musculus
agtatggaagttcccagaaatcctg

SEQ ID NO: 202366 - DNA, 25 bp, Mus musculus
agtatggaattcttcctttgcagct

SEQ ID NO: 202367 - DNA, 25 bp, Mus musculus
agtatggaccgatgggtcccaccca

SEQ ID NO: 202368 - DNA, 25 bp, Mus musculus
agtatggaccggtgtgttcctcttt

SEQ ID NO: 202369 - DNA, 25 bp, Mus musculus
agtatggagaacaggtgagtgaaat

SEQ ID NO: 202370 - DNA, 25 bp, Mus musculus
agtatggagagcatcgagattgacc

SEQ ID NO: 202371 - DNA, 25 bp, Mus musculus
agtatggatgggtacctggaatgga

SEQ ID NO: 202372 - DNA, 25 bp, Mus musculus
agtatggcagactgcacgggcgcag

SEQ ID NO: 202373 - DNA, 25 bp, Mus musculus
agtatggcatcacgggagacaatgt

SEQ ID NO: 202374 - DNA, 25 bp, Mus musculus
agtatggctgcaaaaaagcactgga

SEQ ID NO: 202375 - DNA, 25 bp, Mus musculus
agtatggctgcaaacactcagagtg

SEQ ID NO: 202376 - DNA, 25 bp, Mus musculus
agtatggctgcaaagttgcagatat

SEQ ID NO: 202377 - DNA, 25 bp, Mus musculus
agtatgggagtcaagctgtgcaagt

SEQ ID NO: 202378 - DNA, 25 bp, Mus musculus
agtatgggcgggtaatctatgccag

SEQ ID NO: 202379 - DNA, 25 bp, Mus musculus
agtatgtaccccaactgtgccatcc

SEQ ID NO: 202380 - DNA, 25 bp, Mus musculus
agtatgtattacagagtgatggcgt

SEQ ID NO: 202381 - DNA, 25 bp, Mus musculus
agtatgtattggatatgatggttac

SEQ ID NO: 202382 - DNA, 25 bp, Mus musculus
agtatgtctcaggctgaatttgaca

SEQ ID NO: 202383 - DNA, 25 bp, Mus musculus
agtatgtgaagagctggttttgggg

SEQ ID NO: 202384 - DNA, 25 bp, Mus musculus
agtatgtgaagaggtttgttgtctc

SEQ ID NO: 202385 - DNA, 25 bp, Mus musculus
agtatgtgcaccaggttggcagagt

SEQ ID NO: 202386 - DNA, 25 bp, Mus musculus
agtatgtggaggaacatgtgtatgt

SEQ ID NO: 202387 - DNA, 25 bp, Mus musculus
agtatgtggaggccatgggaagtgt

SEQ ID NO: 202388 - DNA, 25 bp, Mus musculus
agtattaaaaatgatacatccatat

SEQ ID NO: 202389 - DNA, 25 bp, Mus musculus
agtattaaaccaggtgctgtggaaa

SEQ ID NO: 202390 - DNA, 25 bp, Mus musculus
agtattaaagataatcaaatacaac

SEQ ID NO: 202391 - DNA, 25 bp, Mus musculus
agtattaagtgcgtaatagcttgga

SEQ ID NO: 202392 - DNA, 25 bp, Mus musculus
agtattaattacagttctccaagcc

SEQ ID NO: 202393 - DNA, 25 bp, Mus musculus
agtattacaagcatccgatatcaag

SEQ ID NO: 202394 - DNA, 25 bp, Mus musculus
agtattaccgtaataaaagagcagt

SEQ ID NO: 202395 - DNA, 25 bp, Mus musculus
agtattactatgaagtttctctgcc

SEQ ID NO: 202396 - DNA, 25 bp, Mus musculus
agtattactatgaatacctctctga

SEQ ID NO: 202397 - DNA, 25 bp, Mus musculus
agtattattaaagtggttggctatg

SEQ ID NO: 202398 - DNA, 25 bp, Mus musculus
agtattattaatatggaaatgaaag

SEQ ID NO: 202399 - DNA, 25 bp, Mus musculus
agtattcaaacaaggcaagcttcta

SEQ ID NO: 202400 - DNA, 25 bp, Mus musculus
agtattcagatggaaaactacagac

SEQ ID NO: 202401 - DNA, 25 bp, Mus musculus
agtattcatccaaagatgactggtt

SEQ ID NO: 202402 - DNA, 25 bp, Mus musculus
agtattccaggaaaagatggcatct

SEQ ID NO: 202403 - DNA, 25 bp, Mus musculus
agtattccaggctctgtgcaaggac

SEQ ID NO: 202404 - DNA, 25 bp, Mus musculus
agtattccctacagaactcttgagc

SEQ ID NO: 202405 - DNA, 25 bp, Mus musculus
agtattccctacagcctgcccactg

SEQ ID NO: 202406 - DNA, 25 bp, Mus musculus
agtattcctcagaagcaaatggaga

SEQ ID NO: 202407 - DNA, 25 bp, Mus musculus
agtattcctcagaagttgtggagtt

SEQ ID NO: 202408 - DNA, 25 bp, Mus musculus
agtattcctgggggttcggcagact

SEQ ID NO: 202409 - DNA, 25 bp, Mus musculus
agtattctacagcccaggagtgttc

SEQ ID NO: 202410 - DNA, 25 bp, Mus musculus
agtattctacagctcaagactgcag

SEQ ID NO: 202411 - DNA, 25 bp, Mus musculus
agtattctacagctgaggaatgtgc

SEQ ID NO: 202412 - DNA, 25 bp, Mus musculus
agtattctgtatctgcagtgggtcc

SEQ ID NO: 202413 - DNA, 25 bp, Mus musculus
agtattgaatatgtggtgctgctgt

SEQ ID NO: 202414 - DNA, 25 bp, Mus musculus
agtattgaggagaaacgaaacccat

SEQ ID NO: 202415 - DNA, 25 bp, Mus musculus
agtattgcatatagtcctgatggga

SEQ ID NO: 202416 - DNA, 25 bp, Mus musculus
agtattggaagcatagaaggcctac

SEQ ID NO: 202417 - DNA, 25 bp, Mus musculus
agtattggcaagaaccgagctcaag

SEQ ID NO: 202418 - DNA, 25 bp, Mus musculus
agtattggcaagagtccagaaaacc

SEQ ID NO: 202419 - DNA, 25 bp, Mus musculus
agtattgggagctccagtggcagtg

SEQ ID NO: 202420 - DNA, 25 bp, Mus musculus
agtattggtagcagatttcttagat

SEQ ID NO: 202421 - DNA, 25 bp, Mus musculus
agtattgtggaggaattaattcgag

SEQ ID NO: 202422 - DNA, 25 bp, Mus musculus
agtattgtttaaactacagaacttt

SEQ ID NO: 202423 - DNA, 25 bp, Mus musculus
agtatttaagaaaagtgagaggcat

SEQ ID NO: 202424 - DNA, 25 bp, Mus musculus
agtatttaataaaggcctgtgatac

SEQ ID NO: 202425 - DNA, 25 bp, Mus musculus
agtatttaccaagcgctgatcctga

SEQ ID NO: 202426 - DNA, 25 bp, Mus musculus
agtatttaccaaggaggcatcctca

SEQ ID NO: 202427 - DNA, 25 bp, Mus musculus
agtatttatcagataaccacatttt

SEQ ID NO: 202428 - DNA, 25 bp, Mus musculus
agtatttcaggagcctctttcagaa

SEQ ID NO: 202429 - DNA, 25 bp, Mus musculus
agtatttcaggcaggcaaccttcag

SEQ ID NO: 202430 - DNA, 25 bp, Mus musculus
agtatttccaagattcactcagtgt

SEQ ID NO: 202431 - DNA, 25 bp, Mus musculus
agtatttccaagtttcactcagtgt

SEQ ID NO: 202432 - DNA, 25 bp, Mus musculus
agtatttcccaggtgcggggtcctc

SEQ ID NO: 202433 - DNA, 25 bp, Mus musculus
agtatttctggcctcggattacaaa

SEQ ID NO: 202434 - DNA, 25 bp, Mus musculus
agtatttgctggtgctgtagcccgg

SEQ ID NO: 202435 - DNA, 25 bp, Mus musculus
agtatttgtggtgataatgagtcta

SEQ ID NO: 202436 - DNA, 25 bp, Mus musculus
agtcaaaaagattgataagtatctg

SEQ ID NO: 202437 - DNA, 25 bp, Mus musculus
agtcaaaaatctggtagtgcaactt

SEQ ID NO: 202438 - DNA, 25 bp, Mus musculus
agtcaaaacagcagtgacagcagca

SEQ ID NO: 202439 - DNA, 25 bp, Mus musculus
agtcaaaaggatcgtcagtggcata

SEQ ID NO: 202440 - DNA, 25 bp, Mus musculus
agtcaaaatgtcaggttctggcacc

SEQ ID NO: 202441 - DNA, 25 bp, Mus musculus
agtcaaacagtggcttgcattgttc

SEQ ID NO: 202442 - DNA, 25 bp, Mus musculus
agtcaaacagtggtattttaacagt

SEQ ID NO: 202443 - DNA, 25 bp, Mus musculus
agtcaaagaggcaaaagcaaaagaa

SEQ ID NO: 202444 - DNA, 25 bp, Mus musculus
agtcaaagatgagattccatattaa

SEQ ID NO: 202445 - DNA, 25 bp, Mus musculus
agtcaaagccagggtctcttgtggt

SEQ ID NO: 202446 - DNA, 25 bp, Mus musculus
agtcaaagccaggtgccagctggga

SEQ ID NO: 202447 - DNA, 25 bp, Mus musculus
agtcaaagctgaggtacggcatcca

SEQ ID NO: 202448 - DNA, 25 bp, Mus musculus
agtcaaagggctaacagaacaagaa

SEQ ID NO: 202449 - DNA, 25 bp, Mus musculus
agtcaaagttcagccctgaaaagtc

SEQ ID NO: 202450 - DNA, 25 bp, Mus musculus
agtcaaagttcagccctgagaagag

SEQ ID NO: 202451 - DNA, 25 bp, Mus musculus
agtcaaatcagatgcccccacgact

SEQ ID NO: 202452 - DNA, 25 bp, Mus musculus
agtcaaatgaaggaggaattttatt

SEQ ID NO: 202453 - DNA, 25 bp, Mus musculus
agtcaaatgaaggaggcaagtcttc

SEQ ID NO: 202454 - DNA, 25 bp, Mus musculus
agtcaacaacagggaaagaaggcaa

SEQ ID NO: 202455 - DNA, 25 bp, Mus musculus
agtcaacaaggtcccagtgaagaag

SEQ ID NO: 202456 - DNA, 25 bp, Mus musculus
agtcaacaaggtgatcattggcacg

SEQ ID NO: 202457 - DNA, 25 bp, Mus musculus
agtcaacagcccgaaaagcgactca

SEQ ID NO: 202458 - DNA, 25 bp, Mus musculus
agtcaacagcccgacgtatgtttcc

SEQ ID NO: 202459 - DNA, 25 bp, Mus musculus
agtcaacataatagcctgctttttc

SEQ ID NO: 202460 - DNA, 25 bp, Mus musculus
agtcaacataataggtgagcacata

SEQ ID NO: 202461 - DNA, 25 bp, Mus musculus
agtcaacccttcaagatcccgattc

SEQ ID NO: 202462 - DNA, 25 bp, Mus musculus
agtcaacctgaaaaggacaagaaga

SEQ ID NO: 202463 - DNA, 25 bp, Mus musculus
agtcaacctgtaagtgctgtgaccc

SEQ ID NO: 202464 - DNA, 25 bp, Mus musculus
agtcaacctgtaagttcacttgttc

SEQ ID NO: 202465 - DNA, 25 bp, Mus musculus
agtcaacgtccacaagcttgtgaca

SEQ ID NO: 202466 - DNA, 25 bp, Mus musculus
agtcaacttacagaactatgtagaa

SEQ ID NO: 202467 - DNA, 25 bp, Mus musculus
agtcaacttacagcatctgctggtg

SEQ ID NO: 202468 - DNA, 25 bp, Mus musculus
agtcaagaaagcctgtaccccagta

SEQ ID NO: 202469 - DNA, 25 bp, Mus musculus
agtcaagaaaggacatctgatttga

SEQ ID NO: 202470 - DNA, 25 bp, Mus musculus
agtcaagaaagtcatcagcaggaag

SEQ ID NO: 202471 - DNA, 25 bp, Mus musculus
agtcaagaagaagatgtgttacagc

SEQ ID NO: 202472 - DNA, 25 bp, Mus musculus
agtcaagagcaagaagaagcagacc

SEQ ID NO: 202473 - DNA, 25 bp, Mus musculus
agtcaagagcaagtttggcgccgag

SEQ ID NO: 202474 - DNA, 25 bp, Mus musculus
agtcaagcaggtctgcggagattat

SEQ ID NO: 202475 - DNA, 25 bp, Mus musculus
agtcaagccggtgtcctgggtcatg

SEQ ID NO: 202476 - DNA, 25 bp, Mus musculus
agtcaaggaaaagagttaccgtcaa

SEQ ID NO: 202477 - DNA, 25 bp, Mus musculus
agtcaaggactccaggcatgtcatg

SEQ ID NO: 202478 - DNA, 25 bp, Mus musculus
agtcaaggaggacagattaattgtg

SEQ ID NO: 202479 - DNA, 25 bp, Mus musculus
agtcaaggaggacaggacaaaagag

SEQ ID NO: 202480 - DNA, 25 bp, Mus musculus
agtcaaggccaacaaagtattatga

SEQ ID NO: 202481 - DNA, 25 bp, Mus musculus
agtcaaggccaagaaagtattatga

SEQ ID NO: 202482 - DNA, 25 bp, Mus musculus
agtcaaggttccaggagagacatgc

SEQ ID NO: 202483 - DNA, 25 bp, Mus musculus
agtcaagtgccgtgcagctggcctc

SEQ ID NO: 202484 - DNA, 25 bp, Mus musculus
agtcaagtggttgcgaacaatttcg

SEQ ID NO: 202485 - DNA, 25 bp, Mus musculus
agtcaagtggttgcggagaggtttg

SEQ ID NO: 202486 - DNA, 25 bp, Mus musculus
agtcaagtggttgcggagcgagccc

SEQ ID NO: 202487 - DNA, 25 bp, Mus musculus
agtcaagtttgtgggtgaatccgtg

SEQ ID NO: 202488 - DNA, 25 bp, Mus musculus
agtcaatcagaatcagatagtaatt

SEQ ID NO: 202489 - DNA, 25 bp, Mus musculus
agtcaatcaggaatgtcaagtgaaa

SEQ ID NO: 202490 - DNA, 25 bp, Mus musculus
agtcaatcaggcgacggtgtggatg

SEQ ID NO: 202491 - DNA, 25 bp, Mus musculus
agtcaatcaggtacatccaaacgaa

SEQ ID NO: 202492 - DNA, 25 bp, Mus musculus
agtcaatgcaattgtttacatgata

SEQ ID NO: 202493 - DNA, 25 bp, Mus musculus
agtcaatgctcaggtgcagtgtctt

SEQ ID NO: 202494 - DNA, 25 bp, Mus musculus
agtcaatgggccacgtctaaagagc

SEQ ID NO: 202495 - DNA, 25 bp, Mus musculus
agtcaatgtgaacaagcttgtgaca

SEQ ID NO: 202496 - DNA, 25 bp, Mus musculus
agtcaatttcaggaaaatctgggtt

SEQ ID NO: 202497 - DNA, 25 bp, Mus musculus
agtcaatttcaggatactggctcga

SEQ ID NO: 202498 - DNA, 25 bp, Mus musculus
agtcaatttcaggggctctctaaat

SEQ ID NO: 202499 - DNA, 25 bp, Mus musculus
agtcacaaaaaaagattttggagta

SEQ ID NO: 202500 - DNA, 25 bp, Mus musculus
agtcacaacttagtcttgacttctt

SEQ ID NO: 202501 - DNA, 25 bp, Mus musculus
agtcacaacttagtgtcttcaagag

SEQ ID NO: 202502 - DNA, 25 bp, Mus musculus
agtcacaagagaatgcaggcatgtt

SEQ ID NO: 202503 - DNA, 25 bp, Mus musculus
agtcacaagaggaactttgtggtgt

SEQ ID NO: 202504 - DNA, 25 bp, Mus musculus
agtcacacaactatgttcagcagga

SEQ ID NO: 202505 - DNA, 25 bp, Mus musculus
agtcacacaaggaggatacatctct

SEQ ID NO: 202506 - DNA, 25 bp, Mus musculus
agtcacacagcgacatgtgagggag

SEQ ID NO: 202507 - DNA, 25 bp, Mus musculus
agtcacaccaagattgtttatttag

SEQ ID NO: 202508 - DNA, 25 bp, Mus musculus
agtcacaccaagcaaaacaattgca

SEQ ID NO: 202509 - DNA, 25 bp, Mus musculus
agtcacactgcgagttacacttcca

SEQ ID NO: 202510 - DNA, 25 bp, Mus musculus
agtcacactgcgggagaaagcaaga

SEQ ID NO: 202511 - DNA, 25 bp, Mus musculus
agtcacagaatgatgtgagccctgt

SEQ ID NO: 202512 - DNA, 25 bp, Mus musculus
agtcacagccccaggtggtgatgaa

SEQ ID NO: 202513 - DNA, 25 bp, Mus musculus
agtcacaggtgacaggttttactgc

SEQ ID NO: 202514 - DNA, 25 bp, Mus musculus
agtcacaggtgtagcttactaccag

SEQ ID NO: 202515 - DNA, 25 bp, Mus musculus
agtcacaggtgtagggcagaggaga

SEQ ID NO: 202516 - DNA, 25 bp, Mus musculus
agtcacaggtgtaggggttgtgctg

SEQ ID NO: 202517 - DNA, 25 bp, Mus musculus
agtcacatccatggaaagaaaggag

SEQ ID NO: 202518 - DNA, 25 bp, Mus musculus
agtcacatccatggtcctattaaac

SEQ ID NO: 202519 - DNA, 25 bp, Mus musculus
agtcacatgcagatgacctagagct

SEQ ID NO: 202520 - DNA, 25 bp, Mus musculus
agtcacatgcagatgagctcggatt

SEQ ID NO: 202521 - DNA, 25 bp, Mus musculus
agtcacatgcagatgatcgagtgct

SEQ ID NO: 202522 - DNA, 25 bp, Mus musculus
agtcacatggctgctgccacaggtg

SEQ ID NO: 202523 - DNA, 25 bp, Mus musculus
agtcaccaaatgaccccaagggttc

SEQ ID NO: 202524 - DNA, 25 bp, Mus musculus
agtcaccaagccaggatcctgtccc

SEQ ID NO: 202525 - DNA, 25 bp, Mus musculus
agtcaccaagccaggtggacttgtt

SEQ ID NO: 202526 - DNA, 25 bp, Mus musculus
agtcaccacactgctccgcaggagg

SEQ ID NO: 202527 - DNA, 25 bp, Mus musculus
agtcaccacggttcatggaaacctc

SEQ ID NO: 202528 - DNA, 25 bp, Mus musculus
agtcaccagagaatagccatgatgc

SEQ ID NO: 202529 - DNA, 25 bp, Mus musculus
agtcaccagagaatgtgcccacaga

SEQ ID NO: 202530 - DNA, 25 bp, Mus musculus
agtcaccagcttcagtaaagagggc

SEQ ID NO: 202531 - DNA, 25 bp, Mus musculus
agtcaccagcttcagtgaatggaac

SEQ ID NO: 202532 - DNA, 25 bp, Mus musculus
agtcaccatcctgtcctactgtgtg

SEQ ID NO: 202533 - DNA, 25 bp, Mus musculus
agtcacccagacctggagcctgttc

SEQ ID NO: 202534 - DNA, 25 bp, Mus musculus
agtcaccccgtgacgctgcggattt

SEQ ID NO: 202535 - DNA, 25 bp, Mus musculus
agtcaccctggacagccccggcagc

SEQ ID NO: 202536 - DNA, 25 bp, Mus musculus
agtcaccgacatgtgagccactgct

SEQ ID NO: 202537 - DNA, 25 bp, Mus musculus
agtcaccgagagtggggagtagtcc

SEQ ID NO: 202538 - DNA, 25 bp, Mus musculus
agtcaccgccaccccgggacccaca

SEQ ID NO: 202539 - DNA, 25 bp, Mus musculus
agtcaccgccggcccagtgctccat

SEQ ID NO: 202540 - DNA, 25 bp, Mus musculus
agtcaccgcctaatagggcccagtg

SEQ ID NO: 202541 - DNA, 25 bp, Mus musculus
agtcacctctgtctggtagcagcct

SEQ ID NO: 202542 - DNA, 25 bp, Mus musculus
agtcacctgctgtaattggcaactg

SEQ ID NO: 202543 - DNA, 25 bp, Mus musculus
agtcacctttcgggcaggtgatatt

SEQ ID NO: 202544 - DNA, 25 bp, Mus musculus
agtcacctttcgggtcatctagtag

SEQ ID NO: 202545 - DNA, 25 bp, Mus musculus
agtcaccttttaaaggctgctggca

SEQ ID NO: 202546 - DNA, 25 bp, Mus musculus
agtcacgctcaatgagaagcccttt

SEQ ID NO: 202547 - DNA, 25 bp, Mus musculus
agtcacggaggcctcctctgtcacc

SEQ ID NO: 202548 - DNA, 25 bp, Mus musculus
agtcacggcccaaggggtttcctga

SEQ ID NO: 202549 - DNA, 25 bp, Mus musculus
agtcacgtcaaggtagccatccctt

SEQ ID NO: 202550 - DNA, 25 bp, Mus musculus
agtcactaagaagacccagagtgat

SEQ ID NO: 202551 - DNA, 25 bp, Mus musculus
agtcactaaggagatgttagatgta

SEQ ID NO: 202552 - DNA, 25 bp, Mus musculus
agtcactaagttgaaacactaatta

SEQ ID NO: 202553 - DNA, 25 bp, Mus musculus
agtcactaagttgtcccgagtttat

SEQ ID NO: 202554 - DNA, 25 bp, Mus musculus
agtcactaccaggtgcagacccacc

SEQ ID NO: 202555 - DNA, 25 bp, Mus musculus
agtcactatcagttggtttacctgc

SEQ ID NO: 202556 - DNA, 25 bp, Mus musculus
agtcactcaagagcctcatccccga

SEQ ID NO: 202557 - DNA, 25 bp, Mus musculus
agtcactcaaggaggctgttgtgga

SEQ ID NO: 202558 - DNA, 25 bp, Mus musculus
agtcactcacatctgtgtctgataa

SEQ ID NO: 202559 - DNA, 25 bp, Mus musculus
agtcactcacatcttcttccctttc

SEQ ID NO: 202560 - DNA, 25 bp, Mus musculus
agtcactgcacagcccatcgtttct

SEQ ID NO: 202561 - DNA, 25 bp, Mus musculus
agtcactgcaggaagtatttgtaga

SEQ ID NO: 202562 - DNA, 25 bp, Mus musculus
agtcactgccaggtatgtgaagggg

SEQ ID NO: 202563 - DNA, 25 bp, Mus musculus
agtcactgcggaaactgaaaccttt

SEQ ID NO: 202564 - DNA, 25 bp, Mus musculus
agtcactgctaggtatggcactgca

SEQ ID NO: 202565 - DNA, 25 bp, Mus musculus
agtcactgggaggtgtccctgtata

SEQ ID NO: 202566 - DNA, 25 bp, Mus musculus
agtcactggggacccctgtgcagca

SEQ ID NO: 202567 - DNA, 25 bp, Mus musculus
agtcactgtggacgatgctcagacc

SEQ ID NO: 202568 - DNA, 25 bp, Mus musculus
agtcacttgtacatggaggctttgc

SEQ ID NO: 202569 - DNA, 25 bp, Mus musculus
agtcacttgtacatggtgctctaga

SEQ ID NO: 202570 - DNA, 25 bp, Mus musculus
agtcacttgtgctgcttctcaggat

SEQ ID NO: 202571 - DNA, 25 bp, Mus musculus
agtcactttccaaggaatttgaagc

SEQ ID NO: 202572 - DNA, 25 bp, Mus musculus
agtcactttcctaaccgcacagacc

SEQ ID NO: 202573 - DNA, 25 bp, Mus musculus
agtcactttcctaccagcaatgcca

SEQ ID NO: 202574 - DNA, 25 bp, Mus musculus
agtcactttcgtgggagccacatat

SEQ ID NO: 202575 - DNA, 25 bp, Mus musculus
agtcagaaaagtgttacatgtagac

SEQ ID NO: 202576 - DNA, 25 bp, Mus musculus
agtcagaaaagttgtcctctctaac

SEQ ID NO: 202577 - DNA, 25 bp, Mus musculus
agtcagaaaccccaggtttcccagg

SEQ ID NO: 202578 - DNA, 25 bp, Mus musculus
agtcagaaacgcttcctcagactgc

SEQ ID NO: 202579 - DNA, 25 bp, Mus musculus
agtcagaactgagtacacaaacaag

SEQ ID NO: 202580 - DNA, 25 bp, Mus musculus
agtcagaagatgattcagctaaatt

SEQ ID NO: 202581 - DNA, 25 bp, Mus musculus
agtcagaccagggagcccccgggcc

SEQ ID NO: 202582 - DNA, 25 bp, Mus musculus
agtcagacgatgagatggaactgga

SEQ ID NO: 202583 - DNA, 25 bp, Mus musculus
agtcagactcaagcaagacctgcag

SEQ ID NO: 202584 - DNA, 25 bp, Mus musculus
agtcagagagaacgtgaggctaagg

SEQ ID NO: 202585 - DNA, 25 bp, Mus musculus
agtcagagagactcaagaacgtgag

SEQ ID NO: 202586 - DNA, 25 bp, Mus musculus
agtcagagaggaagattacaacaac

SEQ ID NO: 202587 - DNA, 25 bp, Mus musculus
agtcagagaggagggccaaggaggc

SEQ ID NO: 202588 - DNA, 25 bp, Mus musculus
agtcagagcaagcatcgctgccatg

SEQ ID NO: 202589 - DNA, 25 bp, Mus musculus
agtcagagcaagcctggctgttttg

SEQ ID NO: 202590 - DNA, 25 bp, Mus musculus
agtcagagcacaggctcagaaatcc

SEQ ID NO: 202591 - DNA, 25 bp, Mus musculus
agtcagagcagcagaaactagacac

SEQ ID NO: 202592 - DNA, 25 bp, Mus musculus
agtcagagcagcagacaccatgtgc

SEQ ID NO: 202593 - DNA, 25 bp, Mus musculus
agtcagagcagcagactcctccctc

SEQ ID NO: 202594 - DNA, 25 bp, Mus musculus
agtcagagccacgaaggagattctg

SEQ ID NO: 202595 - DNA, 25 bp, Mus musculus
agtcagagccggcttcggagttggg

SEQ ID NO: 202596 - DNA, 25 bp, Mus musculus
agtcagaggcccaggcctctctttc

SEQ ID NO: 202597 - DNA, 25 bp, Mus musculus
agtcagaggccttgctcctaaatga

SEQ ID NO: 202598 - DNA, 25 bp, Mus musculus
agtcagagtatgagaaaataaagga

SEQ ID NO: 202599 - DNA, 25 bp, Mus musculus
agtcagagtatgagaggctgttatg

SEQ ID NO: 202600 - DNA, 25 bp, Mus musculus
agtcagagtatgaggaagaagattc

SEQ ID NO: 202601 - DNA, 25 bp, Mus musculus
agtcagagtatgagtttctcctcat

SEQ ID NO: 202602 - DNA, 25 bp, Mus musculus
agtcagagtcatgtatcgagtggcc

SEQ ID NO: 202603 - DNA, 25 bp, Mus musculus
agtcagatcgtccaaccttctgtgt

SEQ ID NO: 202604 - DNA, 25 bp, Mus musculus
agtcagatcgtccaagttgaaaggc

SEQ ID NO: 202605 - DNA, 25 bp, Mus musculus
agtcagatgcaggatgccaggcaga

SEQ ID NO: 202606 - DNA, 25 bp, Mus musculus
agtcagatgtccaagcccccacctt

SEQ ID NO: 202607 - DNA, 25 bp, Mus musculus
agtcagatgtccaaggtcagagtac

SEQ ID NO: 202608 - DNA, 25 bp, Mus musculus
agtcagatgtccaagtttggcaatg

SEQ ID NO: 202609 - DNA, 25 bp, Mus musculus
agtcagattacagatcccaggcagg

SEQ ID NO: 202610 - DNA, 25 bp, Mus musculus
agtcagattcctcagttccaccaga

SEQ ID NO: 202611 - DNA, 25 bp, Mus musculus
agtcagcaagggtattcttcagtat

SEQ ID NO: 202612 - DNA, 25 bp, Mus musculus
agtcagcacaaactacagctgtgga

SEQ ID NO: 202613 - DNA, 25 bp, Mus musculus
agtcagcacaactcctccagtgcca

SEQ ID NO: 202614 - DNA, 25 bp, Mus musculus
agtcagcaccagctcgcagtggtcc

SEQ ID NO: 202615 - DNA, 25 bp, Mus musculus
agtcagcaccagggattctgggcac

SEQ ID NO: 202616 - DNA, 25 bp, Mus musculus
agtcagccaagaaggtgaaggaaga

SEQ ID NO: 202617 - DNA, 25 bp, Mus musculus
agtcagccaggttcaataagcactt

SEQ ID NO: 202618 - DNA, 25 bp, Mus musculus
agtcagccatacggacacatgtgct

SEQ ID NO: 202619 - DNA, 25 bp, Mus musculus
agtcagccatacggagtgagcctgt

SEQ ID NO: 202620 - DNA, 25 bp, Mus musculus
agtcagccccaacatccagaaccca

SEQ ID NO: 202621 - DNA, 25 bp, Mus musculus
agtcagccccagcctggtagggatg

SEQ ID NO: 202622 - DNA, 25 bp, Mus musculus
agtcagcctttagttcctctttcca

SEQ ID NO: 202623 - DNA, 25 bp, Mus musculus
agtcagcgagaaaggagacaccgtg

SEQ ID NO: 202624 - DNA, 25 bp, Mus musculus
agtcagctcagaccctgctggacat

SEQ ID NO: 202625 - DNA, 25 bp, Mus musculus
agtcagctcagctttgcggagcctg

SEQ ID NO: 202626 - DNA, 25 bp, Mus musculus
agtcagctgacactgtagctcagtg

SEQ ID NO: 202627 - DNA, 25 bp, Mus musculus
agtcagcttgtctggaacctctcag

SEQ ID NO: 202628 - DNA, 25 bp, Mus musculus
agtcaggaaaggaatcccaatctta

SEQ ID NO: 202629 - DNA, 25 bp, Mus musculus
agtcaggaaaggcacatgaatgctc

SEQ ID NO: 202630 - DNA, 25 bp, Mus musculus
agtcaggaaaggtgccctgggacaa

SEQ ID NO: 202631 - DNA, 25 bp, Mus musculus
agtcaggattctcgatccagagaca

SEQ ID NO: 202632 - DNA, 25 bp, Mus musculus
agtcaggattctgaagtgagtaata

SEQ ID NO: 202633 - DNA, 25 bp, Mus musculus
agtcaggatttggagtctgtctcca

SEQ ID NO: 202634 - DNA, 25 bp, Mus musculus
agtcaggcagatgatgtgtgttaaa

SEQ ID NO: 202635 - DNA, 25 bp, Mus musculus
agtcaggctggagtgacgagtatct

SEQ ID NO: 202636 - DNA, 25 bp, Mus musculus
agtcagggaaggttttggtcgtgtg

SEQ ID NO: 202637 - DNA, 25 bp, Mus musculus
agtcagggccatgtcttccctctca

SEQ ID NO: 202638 - DNA, 25 bp, Mus musculus
agtcaggtggaggctgcctccactt

SEQ ID NO: 202639 - DNA, 25 bp, Mus musculus
agtcagtaagctgtggtgtacctgc

SEQ ID NO: 202640 - DNA, 25 bp, Mus musculus
agtcagtacagcaaacaattgggaa

SEQ ID NO: 202641 - DNA, 25 bp, Mus musculus
agtcagtacaggttcatcgttttta

SEQ ID NO: 202642 - DNA, 25 bp, Mus musculus
agtcagtacctaccgtgctgtgcgg

SEQ ID NO: 202643 - DNA, 25 bp, Mus musculus
agtcagtacctagatcgacagctga

SEQ ID NO: 202644 - DNA, 25 bp, Mus musculus
agtcagtattacccttctagctggg

SEQ ID NO: 202645 - DNA, 25 bp, Mus musculus
agtcagtcagctttccctgctgctt

SEQ ID NO: 202646 - DNA, 25 bp, Mus musculus
agtcagtcaggtcagctttggctat

SEQ ID NO: 202647 - DNA, 25 bp, Mus musculus
agtcagtcttacaatacggactctg

SEQ ID NO: 202648 - DNA, 25 bp, Mus musculus
agtcagtgaaaaaaaattcaagcaa

SEQ ID NO: 202649 - DNA, 25 bp, Mus musculus
agtcagtgaaaaaattgtacaatct

SEQ ID NO: 202650 - DNA, 25 bp, Mus musculus
agtcagtgaaggcaggagctgggag

SEQ ID NO: 202651 - DNA, 25 bp, Mus musculus
agtcagtgaggacttacagaagctc

SEQ ID NO: 202652 - DNA, 25 bp, Mus musculus
agtcagttaaaagaaggtaccaggt

SEQ ID NO: 202653 - DNA, 25 bp, Mus musculus
agtcagttcagcttcaattagtggg

SEQ ID NO: 202654 - DNA, 25 bp, Mus musculus
agtcagttgggagaccgtaccacca

SEQ ID NO: 202655 - DNA, 25 bp, Mus musculus
agtcagttgggagcttgcactagca

SEQ ID NO: 202656 - DNA, 25 bp, Mus musculus
agtcagttgtagagggcatctcctc

SEQ ID NO: 202657 - DNA, 25 bp, Mus musculus
agtcataagaagacacacacaggag

SEQ ID NO: 202658 - DNA, 25 bp, Mus musculus
agtcatacagaaccatgaccatcca

SEQ ID NO: 202659 - DNA, 25 bp, Mus musculus
agtcatacagaggtaccttccttgc

SEQ ID NO: 202660 - DNA, 25 bp, Mus musculus
agtcatacagaggttaaattaaaaa

SEQ ID NO: 202661 - DNA, 25 bp, Mus musculus
agtcatacagtccagacaagacatg

SEQ ID NO: 202662 - DNA, 25 bp, Mus musculus
agtcatactggtgaacggcctttcc

SEQ ID NO: 202663 - DNA, 25 bp, Mus musculus
agtcataggaacagattgagaaatg

SEQ ID NO: 202664 - DNA, 25 bp, Mus musculus
agtcatattcagagcctcagcttaa

SEQ ID NO: 202665 - DNA, 25 bp, Mus musculus
agtcatattcggtggatttctttat

SEQ ID NO: 202666 - DNA, 25 bp, Mus musculus
agtcatcaacctaatgcctgaacca

SEQ ID NO: 202667 - DNA, 25 bp, Mus musculus
agtcatcaagacttcataagggctg

SEQ ID NO: 202668 - DNA, 25 bp, Mus musculus
agtcatcaaggtaaaccgagagtgt

SEQ ID NO: 202669 - DNA, 25 bp, Mus musculus
agtcatcactgtcatccaggacatg

SEQ ID NO: 202670 - DNA, 25 bp, Mus musculus
agtcatccccgatgatcatcccctc

SEQ ID NO: 202671 - DNA, 25 bp, Mus musculus
agtcatcctgtgagttgggtgcaaa

SEQ ID NO: 202672 - DNA, 25 bp, Mus musculus
agtcatccttcgaggatgtctcgga

SEQ ID NO: 202673 - DNA, 25 bp, Mus musculus
agtcatccttcgaggcttgctttgc

SEQ ID NO: 202674 - DNA, 25 bp, Mus musculus
agtcatccttggcatggatgataca

SEQ ID NO: 202675 - DNA, 25 bp, Mus musculus
agtcatcgagcaatggctaggagac

SEQ ID NO: 202676 - DNA, 25 bp, Mus musculus
agtcatctaggctaaaggacacagc

SEQ ID NO: 202677 - DNA, 25 bp, Mus musculus
agtcatctctgaaagttctcctgtc

SEQ ID NO: 202678 - DNA, 25 bp, Mus musculus
agtcatctgcgaacacgactccttc

SEQ ID NO: 202679 - DNA, 25 bp, Mus musculus
agtcatgaaagaggctaccttaagg

SEQ ID NO: 202680 - DNA, 25 bp, Mus musculus
agtcatgagaacacaaattgaagtg

SEQ ID NO: 202681 - DNA, 25 bp, Mus musculus
agtcatgagtgcagaggggaacctg

SEQ ID NO: 202682 - DNA, 25 bp, Mus musculus
agtcatgcccagcttcccatcatca

SEQ ID NO: 202683 - DNA, 25 bp, Mus musculus
agtcatgcccagggagtccccccat

SEQ ID NO: 202684 - DNA, 25 bp, Mus musculus
agtcatgcccagtgcctatgcttgt

SEQ ID NO: 202685 - DNA, 25 bp, Mus musculus
agtcatgcctctgcagacgtggaga

SEQ ID NO: 202686 - DNA, 25 bp, Mus musculus
agtcatggaacaggtgagaggctat

SEQ ID NO: 202687 - DNA, 25 bp, Mus musculus
agtcatggacggtttgaagatcaac

SEQ ID NO: 202688 - DNA, 25 bp, Mus musculus
agtcatggacgttcggggatgaggt

SEQ ID NO: 202689 - DNA, 25 bp, Mus musculus
agtcatggtcccgggtgaacagagt

SEQ ID NO: 202690 - DNA, 25 bp, Mus musculus
agtcattaactccatgtaatcgtgt

SEQ ID NO: 202691 - DNA, 25 bp, Mus musculus
agtcattaagggtgatgtttataag

SEQ ID NO: 202692 - DNA, 25 bp, Mus musculus
agtcattataacaggtgagacgaca

SEQ ID NO: 202693 - DNA, 25 bp, Mus musculus
agtcattcaaacctgaacgctggaa

SEQ ID NO: 202694 - DNA, 25 bp, Mus musculus
agtcattcaaacctgtggtttgctc

SEQ ID NO: 202695 - DNA, 25 bp, Mus musculus
agtcattcaagtttatctccggcat

SEQ ID NO: 202696 - DNA, 25 bp, Mus musculus
agtcattgaagacccaactccgaag

SEQ ID NO: 202697 - DNA, 25 bp, Mus musculus
agtcattgggagagtccttatcgga

SEQ ID NO: 202698 - DNA, 25 bp, Mus musculus
agtcatttcagccgtgtttgaccgg

SEQ ID NO: 202699 - DNA, 25 bp, Mus musculus
agtcatttctcacggaaacctaggc

SEQ ID NO: 202700 - DNA, 25 bp, Mus musculus
agtcatttctcacgggcacatctca

SEQ ID NO: 202701 - DNA, 25 bp, Mus musculus
agtcatttgttcgggaacctttgct

SEQ ID NO: 202702 - DNA, 25 bp, Mus musculus
agtcatttgttcgggcttacggtga

SEQ ID NO: 202703 - DNA, 25 bp, Mus musculus
agtcattttcatgatcacaaaattt

SEQ ID NO: 202704 - DNA, 25 bp, Mus musculus
agtcattttgaaagatgtccttcaa

SEQ ID NO: 202705 - DNA, 25 bp, Mus musculus
agtcattttgtgcagcttacctgtg

SEQ ID NO: 202706 - DNA, 25 bp, Mus musculus
agtcattttgtgcaggatctgctga

SEQ ID NO: 202707 - DNA, 25 bp, Mus musculus
agtccaaaagagtacacacgaagga

SEQ ID NO: 202708 - DNA, 25 bp, Mus musculus
agtccaaacagttcagatttcaact

SEQ ID NO: 202709 - DNA, 25 bp, Mus musculus
agtccaaatcacaggcatatgctat

SEQ ID NO: 202710 - DNA, 25 bp, Mus musculus
agtccaacagagaatgaagcactct

SEQ ID NO: 202711 - DNA, 25 bp, Mus musculus
agtccaaccctaaagatcctgttgt

SEQ ID NO: 202712 - DNA, 25 bp, Mus musculus
agtccaacctcgggctcaaaaaatt

SEQ ID NO: 202713 - DNA, 25 bp, Mus musculus
agtccaacgaaaggtaacatttcac

SEQ ID NO: 202714 - DNA, 25 bp, Mus musculus
agtccaagaaaatatttcagataca

SEQ ID NO: 202715 - DNA, 25 bp, Mus musculus
agtccaagaagaggagaaaccaaga

SEQ ID NO: 202716 - DNA, 25 bp, Mus musculus
agtccaagaagatgctgtcgccgag

SEQ ID NO: 202717 - DNA, 25 bp, Mus musculus
agtccaagatatgagaaccacagtg

SEQ ID NO: 202718 - DNA, 25 bp, Mus musculus
agtccaagattgcccaatgatccac

SEQ ID NO: 202719 - DNA, 25 bp, Mus musculus
agtccaagcacgccgcagcagcctg

SEQ ID NO: 202720 - DNA, 25 bp, Mus musculus
agtccaagcacggggacagcttcgt

SEQ ID NO: 202721 - DNA, 25 bp, Mus musculus
agtccaagctgaaggaccaagtctc

SEQ ID NO: 202722 - DNA, 25 bp, Mus musculus
agtccaaggcactagagccccagat

SEQ ID NO: 202723 - DNA, 25 bp, Mus musculus
agtccaaggcactagggtgccacct

SEQ ID NO: 202724 - DNA, 25 bp, Mus musculus
agtccaagtataaggtggctctcga

SEQ ID NO: 202725 - DNA, 25 bp, Mus musculus
agtccaagtcagtttctgatgacct

SEQ ID NO: 202726 - DNA, 25 bp, Mus musculus
agtccaagtccggtcagagcagcag

SEQ ID NO: 202727 - DNA, 25 bp, Mus musculus
agtccaagtgcgatatgatgaatgg

SEQ ID NO: 202728 - DNA, 25 bp, Mus musculus
agtccaattcagccaccagcacagc

SEQ ID NO: 202729 - DNA, 25 bp, Mus musculus
agtccaattcaggcatggtccaggt

SEQ ID NO: 202730 - DNA, 25 bp, Mus musculus
agtccacacccagcacaggtccctg

SEQ ID NO: 202731 - DNA, 25 bp, Mus musculus
agtccacaccgggacaaccatcatg

SEQ ID NO: 202732 - DNA, 25 bp, Mus musculus
agtccacaggcagatgaacacaatg

SEQ ID NO: 202733 - DNA, 25 bp, Mus musculus
agtccacatttgagaacggccggtt

SEQ ID NO: 202734 - DNA, 25 bp, Mus musculus
agtccacatttgagtgtgaagtgag

SEQ ID NO: 202735 - DNA, 25 bp, Mus musculus
agtccaccatattcttttgaatatg

SEQ ID NO: 202736 - DNA, 25 bp, Mus musculus
agtccaccatgctgatggggattgg

SEQ ID NO: 202737 - DNA, 25 bp, Mus musculus
agtccaccctgcacctggtccttcg

SEQ ID NO: 202738 - DNA, 25 bp, Mus musculus
agtccaccgtgggaggttctccagt

SEQ ID NO: 202739 - DNA, 25 bp, Mus musculus
agtccaccgtgggagtggattttgc

SEQ ID NO: 202740 - DNA, 25 bp, Mus musculus
agtccacctgggatcatgggctcta

SEQ ID NO: 202741 - DNA, 25 bp, Mus musculus
agtccactgactttaactggtacac

SEQ ID NO: 202742 - DNA, 25 bp, Mus musculus
agtccactgcattgaacagcgtctg

SEQ ID NO: 202743 - DNA, 25 bp, Mus musculus
agtccacttgtttggttgtggccta

SEQ ID NO: 202744 - DNA, 25 bp, Mus musculus
agtccagaaagtcaacgcctcaaga

SEQ ID NO: 202745 - DNA, 25 bp, Mus musculus
agtccagaagaaatattatgggctg

SEQ ID NO: 202746 - DNA, 25 bp, Mus musculus
agtccagacaccatgccagcccact

SEQ ID NO: 202747 - DNA, 25 bp, Mus musculus
agtccagagcaaggttgctcttctg

SEQ ID NO: 202748 - DNA, 25 bp, Mus musculus
agtccagagcaccctgctgctgaat

SEQ ID NO: 202749 - DNA, 25 bp, Mus musculus
agtccagatctgatgaacacaatga

SEQ ID NO: 202750 - DNA, 25 bp, Mus musculus
agtccagcaagaggaccagagttca

SEQ ID NO: 202751 - DNA, 25 bp, Mus musculus
agtccagcaaggagattcttccaag

SEQ ID NO: 202752 - DNA, 25 bp, Mus musculus
agtccagcactagggctccttctcc

SEQ ID NO: 202753 - DNA, 25 bp, Mus musculus
agtccagcagactgatacctccgac

SEQ ID NO: 202754 - DNA, 25 bp, Mus musculus
agtccagcgagtgtgctagaggctg

SEQ ID NO: 202755 - DNA, 25 bp, Mus musculus
agtccagctccaagttatctccaga

SEQ ID NO: 202756 - DNA, 25 bp, Mus musculus
agtccaggaggaagaggaagtccaa

SEQ ID NO: 202757 - DNA, 25 bp, Mus musculus
agtccaggaggaagatgctgtcgcc

SEQ ID NO: 202758 - DNA, 25 bp, Mus musculus
agtccaggtgcagctgctggaccct

SEQ ID NO: 202759 - DNA, 25 bp, Mus musculus
agtccaggtgttttggttcatcttg

SEQ ID NO: 202760 - DNA, 25 bp, Mus musculus
agtccagttcgataccgttcctgtg

SEQ ID NO: 202761 - DNA, 25 bp, Mus musculus
agtccagttcgatttgatatccttt

SEQ ID NO: 202762 - DNA, 25 bp, Mus musculus
agtccagtttgggaagaaaggtggc

SEQ ID NO: 202763 - DNA, 25 bp, Mus musculus
agtccagtttgggtgtctggagaca

SEQ ID NO: 202764 - DNA, 25 bp, Mus musculus
agtccatcaacatcctaatcctgga

SEQ ID NO: 202765 - DNA, 25 bp, Mus musculus
agtccatcaccaagaacaagaaaac

SEQ ID NO: 202766 - DNA, 25 bp, Mus musculus
agtccatcacgattcaggctctttc

SEQ ID NO: 202767 - DNA, 25 bp, Mus musculus
agtccatgaaagtgagatgagcatc

SEQ ID NO: 202768 - DNA, 25 bp, Mus musculus
agtccatgcaaacggtgttcaatat

SEQ ID NO: 202769 - DNA, 25 bp, Mus musculus
agtccatggagagattgatcctgtt

SEQ ID NO: 202770 - DNA, 25 bp, Mus musculus
agtccatgttggagtttggattcga

SEQ ID NO: 202771 - DNA, 25 bp, Mus musculus
agtccattaggctcttctgcgatgt

SEQ ID NO: 202772 - DNA, 25 bp, Mus musculus
agtccattccagaggcattaaaagc

SEQ ID NO: 202773 - DNA, 25 bp, Mus musculus
agtccattcgacaaagatgactaca

SEQ ID NO: 202774 - DNA, 25 bp, Mus musculus
agtccattctcacatccatgaagaa

SEQ ID NO: 202775 - DNA, 25 bp, Mus musculus
agtccattgaggcgcccttgacagc

SEQ ID NO: 202776 - DNA, 25 bp, Mus musculus
agtccatttagcatggctgttggaa

SEQ ID NO: 202777 - DNA, 25 bp, Mus musculus
agtcccaaaagaccatgtgacccat

SEQ ID NO: 202778 - DNA, 25 bp, Mus musculus
agtcccaaaggatgcatgctgttct

SEQ ID NO: 202779 - DNA, 25 bp, Mus musculus
agtcccaaagggtcttcagattaca

SEQ ID NO: 202780 - DNA, 25 bp, Mus musculus
agtcccaaaggtgtcctgcaggtct

SEQ ID NO: 202781 - DNA, 25 bp, Mus musculus
agtcccaaatcagatcgacatcagg

SEQ ID NO: 202782 - DNA, 25 bp, Mus musculus
agtcccaactcaaggtctgatccgg

SEQ ID NO: 202783 - DNA, 25 bp, Mus musculus
agtcccaactcaaggtgctgtccca

SEQ ID NO: 202784 - DNA, 25 bp, Mus musculus
agtcccaagagggggaatacctcca

SEQ ID NO: 202785 - DNA, 25 bp, Mus musculus
agtcccaagccaggctttcttgatc

SEQ ID NO: 202786 - DNA, 25 bp, Mus musculus
agtcccacacctacttcattataga

SEQ ID NO: 202787 - DNA, 25 bp, Mus musculus
agtcccagaacagatcgggaagctg

SEQ ID NO: 202788 - DNA, 25 bp, Mus musculus
agtcccagaagaggacactacatga

SEQ ID NO: 202789 - DNA, 25 bp, Mus musculus
agtcccagaatatgaccccagcagc

SEQ ID NO: 202790 - DNA, 25 bp, Mus musculus
agtcccagaatatgcgatgatccct

SEQ ID NO: 202791 - DNA, 25 bp, Mus musculus
agtcccagacagcagctgcagtatc

SEQ ID NO: 202792 - DNA, 25 bp, Mus musculus
agtcccagacagcttgcttgccttt

SEQ ID NO: 202793 - DNA, 25 bp, Mus musculus
agtcccagagaaaaggtggagcttt

SEQ ID NO: 202794 - DNA, 25 bp, Mus musculus
agtcccagcagactgagcaagagcc

SEQ ID NO: 202795 - DNA, 25 bp, Mus musculus
agtcccagcagagtgatggttgccc

SEQ ID NO: 202796 - DNA, 25 bp, Mus musculus
agtcccagcaggacatggatttgat

SEQ ID NO: 202797 - DNA, 25 bp, Mus musculus
agtcccagcgagatggagttgctat

SEQ ID NO: 202798 - DNA, 25 bp, Mus musculus
agtcccagctgagactggctggtgg

SEQ ID NO: 202799 - DNA, 25 bp, Mus musculus
agtcccaggaggatctcccagaagc

SEQ ID NO: 202800 - DNA, 25 bp, Mus musculus
agtcccagtagcaagatggactgta

SEQ ID NO: 202801 - DNA, 25 bp, Mus musculus
agtcccagtgcaggatttactaggt

SEQ ID NO: 202802 - DNA, 25 bp, Mus musculus
agtcccagtgcagggataacaacac

SEQ ID NO: 202803 - DNA, 25 bp, Mus musculus
agtcccagtggaagcaccagcctag

SEQ ID NO: 202804 - DNA, 25 bp, Mus musculus
agtcccatgacttttgtacaaacaa

SEQ ID NO: 202805 - DNA, 25 bp, Mus musculus
agtcccatgcgtcaggaaatgtgtt

SEQ ID NO: 202806 - DNA, 25 bp, Mus musculus
agtccccaaagaaaggtcaaatggt

SEQ ID NO: 202807 - DNA, 25 bp, Mus musculus
agtccccaaataatgacctagccct

SEQ ID NO: 202808 - DNA, 25 bp, Mus musculus
agtccccaaataatgatgtctatac

SEQ ID NO: 202809 - DNA, 25 bp, Mus musculus
agtccccaaggactttctgagcccc

SEQ ID NO: 202810 - DNA, 25 bp, Mus musculus
agtccccacctactgggaccagcgg

SEQ ID NO: 202811 - DNA, 25 bp, Mus musculus
agtccccagcaagcaagaggaggca

SEQ ID NO: 202812 - DNA, 25 bp, Mus musculus
agtccccagtcaggtagcctttcca

SEQ ID NO: 202813 - DNA, 25 bp, Mus musculus
agtccccagtgaaagcagaagatac

SEQ ID NO: 202814 - DNA, 25 bp, Mus musculus
agtccccatctcagagctctcttcc

SEQ ID NO: 202815 - DNA, 25 bp, Mus musculus
agtccccatctcagccagcagaggc

SEQ ID NO: 202816 - DNA, 25 bp, Mus musculus
agtccccatctcagctccggaaagg

SEQ ID NO: 202817 - DNA, 25 bp, Mus musculus
agtcccccaaactgaagaagtagct

SEQ ID NO: 202818 - DNA, 25 bp, Mus musculus
agtcccccctagccagcggaaggtg

SEQ ID NO: 202819 - DNA, 25 bp, Mus musculus
agtcccccctcaggacattcagagc

SEQ ID NO: 202820 - DNA, 25 bp, Mus musculus
agtcccccctgaatgggtccctatt

SEQ ID NO: 202821 - DNA, 25 bp, Mus musculus
agtcccccgcaagcctcctggagga

SEQ ID NO: 202822 - DNA, 25 bp, Mus musculus
agtccccgaggagatctcccctctg

SEQ ID NO: 202823 - DNA, 25 bp, Mus musculus
agtccccgaggagctacagttttat

SEQ ID NO: 202824 - DNA, 25 bp, Mus musculus
agtcccctttaaggctccaggatga

SEQ ID NO: 202825 - DNA, 25 bp, Mus musculus
agtcccgaaatggggttggtgtcat

SEQ ID NO: 202826 - DNA, 25 bp, Mus musculus
agtcccgaagatccgcctccgactc

SEQ ID NO: 202827 - DNA, 25 bp, Mus musculus
agtcccgaaggggacagcttcgtgg

SEQ ID NO: 202828 - DNA, 25 bp, Mus musculus
agtcccgaggccaaccgcgtagcca

SEQ ID NO: 202829 - DNA, 25 bp, Mus musculus
agtcccgaggttgagccccacatgg

SEQ ID NO: 202830 - DNA, 25 bp, Mus musculus
agtcccgatcaagatcaacaacccc

SEQ ID NO: 202831 - DNA, 25 bp, Mus musculus
agtcccgatgaagaactaagtggaa

SEQ ID NO: 202832 - DNA, 25 bp, Mus musculus
agtcccgatgaagaatggataacga

SEQ ID NO: 202833 - DNA, 25 bp, Mus musculus
agtcccgtatccttgaattacatcc

SEQ ID NO: 202834 - DNA, 25 bp, Mus musculus
agtcccgtatccttgtgttatccaa

SEQ ID NO: 202835 - DNA, 25 bp, Mus musculus
agtccctacgcctggactaacggtt

SEQ ID NO: 202836 - DNA, 25 bp, Mus musculus
agtccctagaggtgttggtggaatg

SEQ ID NO: 202837 - DNA, 25 bp, Mus musculus
agtccctataaccgatgagaaccac

SEQ ID NO: 202838 - DNA, 25 bp, Mus musculus
agtccctcacacacctgcacgttct

SEQ ID NO: 202839 - DNA, 25 bp, Mus musculus
agtccctcaccttggcagccatcat

SEQ ID NO: 202840 - DNA, 25 bp, Mus musculus
agtccctcaccttgggaatcccaat

SEQ ID NO: 202841 - DNA, 25 bp, Mus musculus
agtccctcagggtgatgtgaacaga

SEQ ID NO: 202842 - DNA, 25 bp, Mus musculus
agtccctcttagagtttcaagaaca

SEQ ID NO: 202843 - DNA, 25 bp, Mus musculus
agtccctgcaggtgaagaagactca

SEQ ID NO: 202844 - DNA, 25 bp, Mus musculus
agtccctggcggttcacaagagcaa

SEQ ID NO: 202845 - DNA, 25 bp, Mus musculus
agtccctggctgagtatgagcccag

SEQ ID NO: 202846 - DNA, 25 bp, Mus musculus
agtccctgttcagagggagagccga

SEQ ID NO: 202847 - DNA, 25 bp, Mus musculus
agtccctgttcagaggtcctgatag

SEQ ID NO: 202848 - DNA, 25 bp, Mus musculus
agtcccttcagcctggggctgacat

SEQ ID NO: 202849 - DNA, 25 bp, Mus musculus
agtccgaatttcaagcccatctctc

SEQ ID NO: 202850 - DNA, 25 bp, Mus musculus
agtccgaatttcaaggggacgattt

SEQ ID NO: 202851 - DNA, 25 bp, Mus musculus
agtccgaatttcaaggtctttaagt

SEQ ID NO: 202852 - DNA, 25 bp, Mus musculus
agtccgactggaactggaaaaggag

SEQ ID NO: 202853 - DNA, 25 bp, Mus musculus
agtccgagaaggaaaagtggtcatt

SEQ ID NO: 202854 - DNA, 25 bp, Mus musculus
agtccgagaaggcctgtgtgggcag

SEQ ID NO: 202855 - DNA, 25 bp, Mus musculus
agtccgagagttcaaaggtgaagag

SEQ ID NO: 202856 - DNA, 25 bp, Mus musculus
agtccgaggactatgagaccaccat

SEQ ID NO: 202857 - DNA, 25 bp, Mus musculus
agtccgaggcctacctcccttttgc

SEQ ID NO: 202858 - DNA, 25 bp, Mus musculus
agtccgaggcctatgttgatctaac

SEQ ID NO: 202859 - DNA, 25 bp, Mus musculus
agtccgaggttctgccgcaggagat

SEQ ID NO: 202860 - DNA, 25 bp, Mus musculus
agtccgcagacccccaggaaacacc

SEQ ID NO: 202861 - DNA, 25 bp, Mus musculus
agtccgcatcagaggaaggagatga

SEQ ID NO: 202862 - DNA, 25 bp, Mus musculus
agtccgcccgaagccctattctgaa

SEQ ID NO: 202863 - DNA, 25 bp, Mus musculus
agtccgcccgaagcttggtgaggtc

SEQ ID NO: 202864 - DNA, 25 bp, Mus musculus
agtccgcccgaaggttaacaagcct

SEQ ID NO: 202865 - DNA, 25 bp, Mus musculus
agtccgcgagtggggttgcggccgt

SEQ ID NO: 202866 - DNA, 25 bp, Mus musculus
agtccgcgatggagaaaactttaga

SEQ ID NO: 202867 - DNA, 25 bp, Mus musculus
agtccgcgatggagagagaaaagga

SEQ ID NO: 202868 - DNA, 25 bp, Mus musculus
agtccggcacgccgttcggggtcta

SEQ ID NO: 202869 - DNA, 25 bp, Mus musculus
agtccggcggtagccaccaagatcc

SEQ ID NO: 202870 - DNA, 25 bp, Mus musculus
agtccgggaaaggattcagatatta

SEQ ID NO: 202871 - DNA, 25 bp, Mus musculus
agtccgggagactcgatctgcccac

SEQ ID NO: 202872 - DNA, 25 bp, Mus musculus
agtccggggaccgaaagtctcctgc

SEQ ID NO: 202873 - DNA, 25 bp, Mus musculus
agtccgtatgtggagaacgttgaca

SEQ ID NO: 202874 - DNA, 25 bp, Mus musculus
agtccgtgatcagaattgcatttgt

SEQ ID NO: 202875 - DNA, 25 bp, Mus musculus
agtccgtgatcagttccgtatctac

SEQ ID NO: 202876 - DNA, 25 bp, Mus musculus
agtccgtgctcaaatgagaaaagtt

SEQ ID NO: 202877 - DNA, 25 bp, Mus musculus
agtccgtgctcaagatcaaagaaga

SEQ ID NO: 202878 - DNA, 25 bp, Mus musculus
agtccgtgctgagacgtcatcatgt

SEQ ID NO: 202879 - DNA, 25 bp, Mus musculus
agtcctaacacttccagaaactcat

SEQ ID NO: 202880 - DNA, 25 bp, Mus musculus
agtcctacaggtttgttaagaagtt

SEQ ID NO: 202881 - DNA, 25 bp, Mus musculus
agtcctacagtgtctacagctacct

SEQ ID NO: 202882 - DNA, 25 bp, Mus musculus
agtcctagaaaaccaaactgcagct

SEQ ID NO: 202883 - DNA, 25 bp, Mus musculus
agtcctagaagcctggcaaaatgaa

SEQ ID NO: 202884 - DNA, 25 bp, Mus musculus
agtcctagaggccgggataactggg

SEQ ID NO: 202885 - DNA, 25 bp, Mus musculus
agtcctatataggtgacagtggaag

SEQ ID NO: 202886 - DNA, 25 bp, Mus musculus
agtcctatgcagaagaagtactaca

SEQ ID NO: 202887 - DNA, 25 bp, Mus musculus
agtcctcaaactcactctgcagagc

SEQ ID NO: 202888 - DNA, 25 bp, Mus musculus
agtcctcaaagacaatgtgtctact

SEQ ID NO: 202889 - DNA, 25 bp, Mus musculus
agtcctcaactaggagcttcgatat

SEQ ID NO: 202890 - DNA, 25 bp, Mus musculus
agtcctcacacagtgtccaacctgt

SEQ ID NO: 202891 - DNA, 25 bp, Mus musculus
agtcctcacagtgagtgatagctgc

SEQ ID NO: 202892 - DNA, 25 bp, Mus musculus
agtcctcacatgcaggatccaaacc

SEQ ID NO: 202893 - DNA, 25 bp, Mus musculus
agtcctcagaagagcatggcagaag

SEQ ID NO: 202894 - DNA, 25 bp, Mus musculus
agtcctcagaagcatggtgtgctcc

SEQ ID NO: 202895 - DNA, 25 bp, Mus musculus
agtcctcagaggccagttgttgctg

SEQ ID NO: 202896 - DNA, 25 bp, Mus musculus
agtcctcagccagcaaacaggccct

SEQ ID NO: 202897 - DNA, 25 bp, Mus musculus
agtcctccatgatcgtcctgcttct

SEQ ID NO: 202898 - DNA, 25 bp, Mus musculus
agtcctccccagaaatagatgaaga

SEQ ID NO: 202899 - DNA, 25 bp, Mus musculus
agtcctccggaccatgctgcctgtg

SEQ ID NO: 202900 - DNA, 25 bp, Mus musculus
agtcctccggtctgaaactcttctg

SEQ ID NO: 202901 - DNA, 25 bp, Mus musculus
agtcctcctaaggtgatcttagtgg

SEQ ID NO: 202902 - DNA, 25 bp, Mus musculus
agtcctcctaagtggagggcagcaa

SEQ ID NO: 202903 - DNA, 25 bp, Mus musculus
agtcctcctccacctaaggtggtaa

SEQ ID NO: 202904 - DNA, 25 bp, Mus musculus
agtcctcgaccagctgcttaaagga

SEQ ID NO: 202905 - DNA, 25 bp, Mus musculus
agtcctcgaggagatcccagccatc

SEQ ID NO: 202906 - DNA, 25 bp, Mus musculus
agtcctcggaggagtatatatcctg

SEQ ID NO: 202907 - DNA, 25 bp, Mus musculus
agtcctctgtggaaagcagatgaga

SEQ ID NO: 202908 - DNA, 25 bp, Mus musculus
agtcctgacaagccgcccctcggcc

SEQ ID NO: 202909 - DNA, 25 bp, Mus musculus
agtcctgacacaagcgaccgggact

SEQ ID NO: 202910 - DNA, 25 bp, Mus musculus
agtcctgaggacagagaaagagcta

SEQ ID NO: 202911 - DNA, 25 bp, Mus musculus
agtcctgataggcaggagatgagcc

SEQ ID NO: 202912 - DNA, 25 bp, Mus musculus
agtcctgcagagtagagctctggct

SEQ ID NO: 202913 - DNA, 25 bp, Mus musculus
agtcctgcagatcgtcctgcttctc

SEQ ID NO: 202914 - DNA, 25 bp, Mus musculus
agtcctgcagccctctctccttctc

SEQ ID NO: 202915 - DNA, 25 bp, Mus musculus
agtcctgcccagctcaatggtggct

SEQ ID NO: 202916 - DNA, 25 bp, Mus musculus
agtcctgcccaggatggcagtacct

SEQ ID NO: 202917 - DNA, 25 bp, Mus musculus
agtcctgctagagcgcatcccagcc

SEQ ID NO: 202918 - DNA, 25 bp, Mus musculus
agtcctggaatgtcatggccttatc

SEQ ID NO: 202919 - DNA, 25 bp, Mus musculus
agtcctggagctgtgcatcctttta

SEQ ID NO: 202920 - DNA, 25 bp, Mus musculus
agtcctggagctgtggttcgttctc

SEQ ID NO: 202921 - DNA, 25 bp, Mus musculus
agtcctggaggcaggcgacaagcat

SEQ ID NO: 202922 - DNA, 25 bp, Mus musculus
agtcctggaggctggagtcacagag

SEQ ID NO: 202923 - DNA, 25 bp, Mus musculus
agtcctggagtcaagctggaaccac

SEQ ID NO: 202924 - DNA, 25 bp, Mus musculus
agtcctggcacagagaacctgtgct

SEQ ID NO: 202925 - DNA, 25 bp, Mus musculus
agtcctggcacaggtacaaagtgaa

SEQ ID NO: 202926 - DNA, 25 bp, Mus musculus
agtcctggcagactgtaccatcaag

SEQ ID NO: 202927 - DNA, 25 bp, Mus musculus
agtcctggcagagacagagatgggc

SEQ ID NO: 202928 - DNA, 25 bp, Mus musculus
agtcctggcaggactttcctggaac

SEQ ID NO: 202929 - DNA, 25 bp, Mus musculus
agtcctggccgccaagttgaagttc

SEQ ID NO: 202930 - DNA, 25 bp, Mus musculus
agtcctgggaaaggtgtggtatctc

SEQ ID NO: 202931 - DNA, 25 bp, Mus musculus
agtcctgggttaaggagagcacaca

SEQ ID NO: 202932 - DNA, 25 bp, Mus musculus
agtcctggtgaactgtccatccaac

SEQ ID NO: 202933 - DNA, 25 bp, Mus musculus
agtcctggtggtccccagcaggccc

SEQ ID NO: 202934 - DNA, 25 bp, Mus musculus
agtcctgtcctcagggaccgcagca

SEQ ID NO: 202935 - DNA, 25 bp, Mus musculus
agtcctgtcctcagggccttcaggg

SEQ ID NO: 202936 - DNA, 25 bp, Mus musculus
agtcctgtgagacagtgtttcttgg

SEQ ID NO: 202937 - DNA, 25 bp, Mus musculus
agtcctgtgagagatggatgtcctt

SEQ ID NO: 202938 - DNA, 25 bp, Mus musculus
agtcctgttcagcaccaacaccacc

SEQ ID NO: 202939 - DNA, 25 bp, Mus musculus
agtcctgttcagcaccatcagcacc

SEQ ID NO: 202940 - DNA, 25 bp, Mus musculus
agtccttaaaggtttatgggactgt

SEQ ID NO: 202941 - DNA, 25 bp, Mus musculus
agtccttaaggtgcagacccacctg

SEQ ID NO: 202942 - DNA, 25 bp, Mus musculus
agtccttacagcaaattgctgttga

SEQ ID NO: 202943 - DNA, 25 bp, Mus musculus
agtccttacagttttaagtggaaga

SEQ ID NO: 202944 - DNA, 25 bp, Mus musculus
agtccttatgacacgtccccatctg

SEQ ID NO: 202945 - DNA, 25 bp, Mus musculus
agtccttcagagaaacagcagcacc

SEQ ID NO: 202946 - DNA, 25 bp, Mus musculus
agtccttcagggcaatctctgtggt

SEQ ID NO: 202947 - DNA, 25 bp, Mus musculus
agtccttcccaggagtacacggtca

SEQ ID NO: 202948 - DNA, 25 bp, Mus musculus
agtccttgatgtcggtggcgcccag

SEQ ID NO: 202949 - DNA, 25 bp, Mus musculus
agtccttggcagcaggaggagccat

SEQ ID NO: 202950 - DNA, 25 bp, Mus musculus
agtccttgtgtattggcattggagg

SEQ ID NO: 202951 - DNA, 25 bp, Mus musculus
agtcctttcagggcttcttcgtgtc

SEQ ID NO: 202952 - DNA, 25 bp, Mus musculus
agtcctttcagtcttttgatggatt

SEQ ID NO: 202953 - DNA, 25 bp, Mus musculus
agtcctttccgggtggcaaggagta

SEQ ID NO: 202954 - DNA, 25 bp, Mus musculus
agtcctttctggtgtccgccgatgc

SEQ ID NO: 202955 - DNA, 25 bp, Mus musculus
agtcctttgagattgagcgtcacga

SEQ ID NO: 202956 - DNA, 25 bp, Mus musculus
agtcctttgctagggaaagagaaat

SEQ ID NO: 202957 - DNA, 25 bp, Mus musculus
agtccttttcagacccgggtcggtg

SEQ ID NO: 202958 - DNA, 25 bp, Mus musculus
agtcgaaaagatatcccctgtatat

SEQ ID NO: 202959 - DNA, 25 bp, Mus musculus
agtcgaaacattgtggatttcaaac

SEQ ID NO: 202960 - DNA, 25 bp, Mus musculus
agtcgaaagaggcagacatcgactc

SEQ ID NO: 202961 - DNA, 25 bp, Mus musculus
agtcgaagacacagtgaagcatgac

SEQ ID NO: 202962 - DNA, 25 bp, Mus musculus
agtcgaagactaagtggactaaaga

SEQ ID NO: 202963 - DNA, 25 bp, Mus musculus
agtcgactatgtgtacaagaccgag

SEQ ID NO: 202964 - DNA, 25 bp, Mus musculus
agtcgacttcaggtacaggtcccag

SEQ ID NO: 202965 - DNA, 25 bp, Mus musculus
agtcgacttcaggtggtaagagaag

SEQ ID NO: 202966 - DNA, 25 bp, Mus musculus
agtcgcaactcaaggtaggtgtaca

SEQ ID NO: 202967 - DNA, 25 bp, Mus musculus
agtcgcaactcaaggtcctttccca

SEQ ID NO: 202968 - DNA, 25 bp, Mus musculus
agtcgcagaactgcactggcgtctg

SEQ ID NO: 202969 - DNA, 25 bp, Mus musculus
agtcgcagcagaaactggaggtact

SEQ ID NO: 202970 - DNA, 25 bp, Mus musculus
agtcgcagcagctaacagagaagtc

SEQ ID NO: 202971 - DNA, 25 bp, Mus musculus
agtcgcagtggtgcaggcagtgcag

SEQ ID NO: 202972 - DNA, 25 bp, Mus musculus
agtcgcattcgaagagccaccgaag

SEQ ID NO: 202973 - DNA, 25 bp, Mus musculus
agtcgcattcgatgaaatcgtggac

SEQ ID NO: 202974 - DNA, 25 bp, Mus musculus
agtcgccaaataagaacaactaggc

SEQ ID NO: 202975 - DNA, 25 bp, Mus musculus
agtcgccaaataagacagtgaaatc

SEQ ID NO: 202976 - DNA, 25 bp, Mus musculus
agtcgccaaggtgaccccaggctcc

SEQ ID NO: 202977 - DNA, 25 bp, Mus musculus
agtcgccacgcgagcaagctctcac

SEQ ID NO: 202978 - DNA, 25 bp, Mus musculus
agtcgccatgcctacaacacagcag

SEQ ID NO: 202979 - DNA, 25 bp, Mus musculus
agtcgccatgtcaccccaggatgag

SEQ ID NO: 202980 - DNA, 25 bp, Mus musculus
agtcgcccaaaagacctagtggttt

SEQ ID NO: 202981 - DNA, 25 bp, Mus musculus
agtcgcccctgaagatggagagaag

SEQ ID NO: 202982 - DNA, 25 bp, Mus musculus
agtcgcccgggaggcgctggcggtg

SEQ ID NO: 202983 - DNA, 25 bp, Mus musculus
agtcgccctagagttgaggccggcg

SEQ ID NO: 202984 - DNA, 25 bp, Mus musculus
agtcgccgacaggagctacgagagg

SEQ ID NO: 202985 - DNA, 25 bp, Mus musculus
agtcgccgacaggaggcgacccagt

SEQ ID NO: 202986 - DNA, 25 bp, Mus musculus
agtcgccggaggacacagagctgca

SEQ ID NO: 202987 - DNA, 25 bp, Mus musculus
agtcgcctcagaaaatgtatctcgt

SEQ ID NO: 202988 - DNA, 25 bp, Mus musculus
agtcgcctcgagaaccctgcacctg

SEQ ID NO: 202989 - DNA, 25 bp, Mus musculus
agtcgcctcgaggaagaaggcattg

SEQ ID NO: 202990 - DNA, 25 bp, Mus musculus
agtcgctcaacaagagagaaggctt

SEQ ID NO: 202991 - DNA, 25 bp, Mus musculus
agtcgctcctatggcatgtgggcac

SEQ ID NO: 202992 - DNA, 25 bp, Mus musculus
agtcgctgttacggaggcgaagagg

SEQ ID NO: 202993 - DNA, 25 bp, Mus musculus
agtcgctgttacgggctgtgacaat

SEQ ID NO: 202994 - DNA, 25 bp, Mus musculus
agtcgcttcagcctttaccctccgg

SEQ ID NO: 202995 - DNA, 25 bp, Mus musculus
agtcgcttgcaaggttcctgtccca

SEQ ID NO: 202996 - DNA, 25 bp, Mus musculus
agtcgcttgcaagtgtgacttggaa

SEQ ID NO: 202997 - DNA, 25 bp, Mus musculus
agtcggaaagtgtggagcaaaaata

SEQ ID NO: 202998 - DNA, 25 bp, Mus musculus
agtcggaattcctaccctcagaagg

SEQ ID NO: 202999 - DNA, 25 bp, Mus musculus
agtcggacaataataaaagactagt

SEQ ID NO: 203000 - DNA, 25 bp, Mus musculus
agtcggaccagatggtgacttgccg

SEQ ID NO: 203001 - DNA, 25 bp, Mus musculus
agtcggagaaaagggagaacctggt

SEQ ID NO: 203002 - DNA, 25 bp, Mus musculus
agtcggagaagtcccgttgtatcag

SEQ ID NO: 203003 - DNA, 25 bp, Mus musculus
agtcggagacccggatttcccagcc

SEQ ID NO: 203004 - DNA, 25 bp, Mus musculus
agtcggagaggtacagattcctcga

SEQ ID NO: 203005 - DNA, 25 bp, Mus musculus
agtcggagaggttgacgtcgagcag

SEQ ID NO: 203006 - DNA, 25 bp, Mus musculus
agtcggagccatgcctcttcgactt

SEQ ID NO: 203007 - DNA, 25 bp, Mus musculus
agtcggagccatggagcatttcact

SEQ ID NO: 203008 - DNA, 25 bp, Mus musculus
agtcggatgaggaagggcccgggga

SEQ ID NO: 203009 - DNA, 25 bp, Mus musculus
agtcggcacaatcagagccttggct

SEQ ID NO: 203010 - DNA, 25 bp, Mus musculus
agtcggcattgcccgcccatgtgcc

SEQ ID NO: 203011 - DNA, 25 bp, Mus musculus
agtcggcctgcaggcctgtcgaggg

SEQ ID NO: 203012 - DNA, 25 bp, Mus musculus
agtcggcctgcaggtgcggacctat

SEQ ID NO: 203013 - DNA, 25 bp, Mus musculus
agtcggcctgcagtttcaggcctgt

SEQ ID NO: 203014 - DNA, 25 bp, Mus musculus
agtcggcggggacagatctcaagac

SEQ ID NO: 203015 - DNA, 25 bp, Mus musculus
agtcggcttaggagccacatataga

SEQ ID NO: 203016 - DNA, 25 bp, Mus musculus
agtcgggacccttgcacaagcagtt

SEQ ID NO: 203017 - DNA, 25 bp, Mus musculus
agtcgggccggacagaacagtaaac

SEQ ID NO: 203018 - DNA, 25 bp, Mus musculus
agtcgggctgatcgaaaaggactct

SEQ ID NO: 203019 - DNA, 25 bp, Mus musculus
agtcgggctgatcgtgaccatcttt

SEQ ID NO: 203020 - DNA, 25 bp, Mus musculus
agtcggtgcttggctctggctgaga

SEQ ID NO: 203021 - DNA, 25 bp, Mus musculus
agtcggtgtgtatgattccctgtcg

SEQ ID NO: 203022 - DNA, 25 bp, Mus musculus
agtcggtttaaagcggggatctgat

SEQ ID NO: 203023 - DNA, 25 bp, Mus musculus
agtcggtttatcatgacaccaagct

SEQ ID NO: 203024 - DNA, 25 bp, Mus musculus
agtcgtattaggcttaactccggcc

SEQ ID NO: 203025 - DNA, 25 bp, Mus musculus
agtcgtctcctggccagagttccaa

SEQ ID NO: 203026 - DNA, 25 bp, Mus musculus
agtcgtctcctgggacagaagatgc

SEQ ID NO: 203027 - DNA, 25 bp, Mus musculus
agtcgtgaagcgactccggccctcg

SEQ ID NO: 203028 - DNA, 25 bp, Mus musculus
agtcgtgttggaaggtggcattgac

SEQ ID NO: 203029 - DNA, 25 bp, Mus musculus
agtcgttgaagagagttgtggttat

SEQ ID NO: 203030 - DNA, 25 bp, Mus musculus
agtcgttgaaggtactagcaagatg

SEQ ID NO: 203031 - DNA, 25 bp, Mus musculus
agtcgttgacaggaaagagtaggaa

SEQ ID NO: 203032 - DNA, 25 bp, Mus musculus
agtcgttgactctggtagagcagat

SEQ ID NO: 203033 - DNA, 25 bp, Mus musculus
agtcgtttggacttcaaatctcagc

SEQ ID NO: 203034 - DNA, 25 bp, Mus musculus
agtctaaaaaccagtcggcagacca

SEQ ID NO: 203035 - DNA, 25 bp, Mus musculus
agtctaaagggaagcgattatagag

SEQ ID NO: 203036 - DNA, 25 bp, Mus musculus
agtctaacctggttggtttgggatg

SEQ ID NO: 203037 - DNA, 25 bp, Mus musculus
agtctaagaatgctgttttgaatca

SEQ ID NO: 203038 - DNA, 25 bp, Mus musculus
agtctacaaaagctcttcagagaag

SEQ ID NO: 203039 - DNA, 25 bp, Mus musculus
agtctacaaaaggtgaagtatttga

SEQ ID NO: 203040 - DNA, 25 bp, Mus musculus
agtctacaatcggtggagacacaga

SEQ ID NO: 203041 - DNA, 25 bp, Mus musculus
agtctaccatatttggtataagggg

SEQ ID NO: 203042 - DNA, 25 bp, Mus musculus
agtctacccaaagtgatcaactttt

SEQ ID NO: 203043 - DNA, 25 bp, Mus musculus
agtctacccggcagttgggttctga

SEQ ID NO: 203044 - DNA, 25 bp, Mus musculus
agtctacccggtttattatatacac

SEQ ID NO: 203045 - DNA, 25 bp, Mus musculus
agtctacctgcagcatcgaatcctg

SEQ ID NO: 203046 - DNA, 25 bp, Mus musculus
agtctacctgcaggagaccccatgt

SEQ ID NO: 203047 - DNA, 25 bp, Mus musculus
agtctactcacaggagaaaatgctg

SEQ ID NO: 203048 - DNA, 25 bp, Mus musculus
agtctacttcattgaccataacaca

SEQ ID NO: 203049 - DNA, 25 bp, Mus musculus
agtctagaaaacataggagacagct

SEQ ID NO: 203050 - DNA, 25 bp, Mus musculus
agtctagaaaacgctaatctttctg

SEQ ID NO: 203051 - DNA, 25 bp, Mus musculus
agtctaggaaggtccttttgatagg

SEQ ID NO: 203052 - DNA, 25 bp, Mus musculus
agtctaggatgctggacgctggatc

SEQ ID NO: 203053 - DNA, 25 bp, Mus musculus
agtctataaatttgcaagagccaga

SEQ ID NO: 203054 - DNA, 25 bp, Mus musculus
agtctatagcacgaccccttatccc

SEQ ID NO: 203055 - DNA, 25 bp, Mus musculus
agtctatagcacggtaacacaagta

SEQ ID NO: 203056 - DNA, 25 bp, Mus musculus
agtctatcttggaaaagatgacgag

SEQ ID NO: 203057 - DNA, 25 bp, Mus musculus
agtctatgtcagacagggaacaaca

SEQ ID NO: 203058 - DNA, 25 bp, Mus musculus
agtctattaaaatgaagcattggat

SEQ ID NO: 203059 - DNA, 25 bp, Mus musculus
agtctattctgactggagccctttc

SEQ ID NO: 203060 - DNA, 25 bp, Mus musculus
agtctcaaaactggcttggagtcaa

SEQ ID NO: 203061 - DNA, 25 bp, Mus musculus
agtctcaaaactgggattattggcc

SEQ ID NO: 203062 - DNA, 25 bp, Mus musculus
agtctcaaacaataggtgaccagtg

SEQ ID NO: 203063 - DNA, 25 bp, Mus musculus
agtctcacagccgagggttgatgct

SEQ ID NO: 203064 - DNA, 25 bp, Mus musculus
agtctcacctggcaagatgaatatg

SEQ ID NO: 203065 - DNA, 25 bp, Mus musculus
agtctcaccttgtctgtctgcaggt

SEQ ID NO: 203066 - DNA, 25 bp, Mus musculus
agtctcagaagtcagcggctgcgta

SEQ ID NO: 203067 - DNA, 25 bp, Mus musculus
agtctcagaggatagctctctacag

SEQ ID NO: 203068 - DNA, 25 bp, Mus musculus
agtctcagcagaggtggaaagtacg

SEQ ID NO: 203069 - DNA, 25 bp, Mus musculus
agtctcagcatagaaagtcctcgcg

SEQ ID NO: 203070 - DNA, 25 bp, Mus musculus
agtctcagcatagaagtttaccgac

SEQ ID NO: 203071 - DNA, 25 bp, Mus musculus
agtctcatgtgcatgtccatgctgt

SEQ ID NO: 203072 - DNA, 25 bp, Mus musculus
agtctcatgtgcatgttcatgactt

SEQ ID NO: 203073 - DNA, 25 bp, Mus musculus
agtctcattcctccagctacactcc

SEQ ID NO: 203074 - DNA, 25 bp, Mus musculus
agtctcattttaaggccctgtggtt

SEQ ID NO: 203075 - DNA, 25 bp, Mus musculus
agtctccaagatggcggtaaatgat

SEQ ID NO: 203076 - DNA, 25 bp, Mus musculus
agtctccacagattgacggcggggc

SEQ ID NO: 203077 - DNA, 25 bp, Mus musculus
agtctccagaaagaggcgccctgtg

SEQ ID NO: 203078 - DNA, 25 bp, Mus musculus
agtctccagaaagaggtgggtcttc

SEQ ID NO: 203079 - DNA, 25 bp, Mus musculus
agtctccagaaagtgctttgcatgg

SEQ ID NO: 203080 - DNA, 25 bp, Mus musculus
agtctccagaaagtggtatcccata

SEQ ID NO: 203081 - DNA, 25 bp, Mus musculus
agtctccatcctgggttggctgatg

SEQ ID NO: 203082 - DNA, 25 bp, Mus musculus
agtctccatctatagatcttaccaa

SEQ ID NO: 203083 - DNA, 25 bp, Mus musculus
agtctccatctataggattcatgaa

SEQ ID NO: 203084 - DNA, 25 bp, Mus musculus
agtctccattcaggagacattccaa

SEQ ID NO: 203085 - DNA, 25 bp, Mus musculus
agtctccattcagggttcccgggcc

SEQ ID NO: 203086 - DNA, 25 bp, Mus musculus
agtctcccagctccttcactcactc

SEQ ID NO: 203087 - DNA, 25 bp, Mus musculus
agtctcccaggaagatctgctatca

SEQ ID NO: 203088 - DNA, 25 bp, Mus musculus
agtctcccagtggtactgccaccgc

SEQ ID NO: 203089 - DNA, 25 bp, Mus musculus
agtctccgacgggcactatgaacga

SEQ ID NO: 203090 - DNA, 25 bp, Mus musculus
agtctccgggaacgtgccaatagaa

SEQ ID NO: 203091 - DNA, 25 bp, Mus musculus
agtctccggggatgaattgtctgga

SEQ ID NO: 203092 - DNA, 25 bp, Mus musculus
agtctccgggtgagtttgccaggca

SEQ ID NO: 203093 - DNA, 25 bp, Mus musculus
agtctccgtccccagaacccgagcc

SEQ ID NO: 203094 - DNA, 25 bp, Mus musculus
agtctcctagtgagcttgtccaggt

SEQ ID NO: 203095 - DNA, 25 bp, Mus musculus
agtctcctcagagagtcagtccttc

SEQ ID NO: 203096 - DNA, 25 bp, Mus musculus
agtctcctcagagtctgcgagaaat

SEQ ID NO: 203097 - DNA, 25 bp, Mus musculus
agtctcctcagccaaaacaacaccc

SEQ ID NO: 203098 - DNA, 25 bp, Mus musculus
agtctcctcagccaaaacaacagcc

SEQ ID NO: 203099 - DNA, 25 bp, Mus musculus
agtctcctcagccaaaacgacaccc

SEQ ID NO: 203100 - DNA, 25 bp, Mus musculus
agtctcctcagctacaacaacagcc

SEQ ID NO: 203101 - DNA, 25 bp, Mus musculus
agtctcctcccagtgccctgggggg

SEQ ID NO: 203102 - DNA, 25 bp, Mus musculus
agtctcctctcagcaaagctgttgc

SEQ ID NO: 203103 - DNA, 25 bp, Mus musculus
agtctcctgagagaaattttcctcg

SEQ ID NO: 203104 - DNA, 25 bp, Mus musculus
agtctcctgaggttcaggacctgca

SEQ ID NO: 203105 - DNA, 25 bp, Mus musculus
agtctcctggcagccaaccaatgga

SEQ ID NO: 203106 - DNA, 25 bp, Mus musculus
agtctcctgtcagatgggattgatg

SEQ ID NO: 203107 - DNA, 25 bp, Mus musculus
agtctccttgcagagcaggcaagga

SEQ ID NO: 203108 - DNA, 25 bp, Mus musculus
agtctcgacaacatgcattcattca

SEQ ID NO: 203109 - DNA, 25 bp, Mus musculus
agtctcggtgaaagggattgaaatt

SEQ ID NO: 203110 - DNA, 25 bp, Mus musculus
agtctcgtcacagataacatctggt

SEQ ID NO: 203111 - DNA, 25 bp, Mus musculus
agtctcgtcacaggaatggcggccc

SEQ ID NO: 203112 - DNA, 25 bp, Mus musculus
agtctctaaaacaagagatttgaag

SEQ ID NO: 203113 - DNA, 25 bp, Mus musculus
agtctctatcaaaggttgccgaggc

SEQ ID NO: 203114 - DNA, 25 bp, Mus musculus
agtctctcaagagtcaccatgtaga

SEQ ID NO: 203115 - DNA, 25 bp, Mus musculus
agtctctcaagcgtcaagaactgga

SEQ ID NO: 203116 - DNA, 25 bp, Mus musculus
agtctctcaagtatctcagcaataa

SEQ ID NO: 203117 - DNA, 25 bp, Mus musculus
agtctctcataaagccctttctgac

SEQ ID NO: 203118 - DNA, 25 bp, Mus musculus
agtctctccatcaggtttctttctt

SEQ ID NO: 203119 - DNA, 25 bp, Mus musculus
agtctctctgcaagatcatgctggg

SEQ ID NO: 203120 - DNA, 25 bp, Mus musculus
agtctctcttccatgtctcccatca

SEQ ID NO: 203121 - DNA, 25 bp, Mus musculus
agtctctgagtgaggagacccagaa

SEQ ID NO: 203122 - DNA, 25 bp, Mus musculus
agtctctgcaagtggccctgccgcc

SEQ ID NO: 203123 - DNA, 25 bp, Mus musculus
agtctctgcaggtgcccaaaactga

SEQ ID NO: 203124 - DNA, 25 bp, Mus musculus
agtctctgccaaacacaccagaagg

SEQ ID NO: 203125 - DNA, 25 bp, Mus musculus
agtctctgccaacattgtcctcgta

SEQ ID NO: 203126 - DNA, 25 bp, Mus musculus
agtctctgcccttcaggatgagctt

SEQ ID NO: 203127 - DNA, 25 bp, Mus musculus
agtctctgcctgaaggtttgacttc

SEQ ID NO: 203128 - DNA, 25 bp, Mus musculus
agtctctggcgctgatcccactgca

SEQ ID NO: 203129 - DNA, 25 bp, Mus musculus
agtctctggcggccccactgaagac

SEQ ID NO: 203130 - DNA, 25 bp, Mus musculus
agtctctgttccgaggagaagccta

SEQ ID NO: 203131 - DNA, 25 bp, Mus musculus
agtctctgttccgtcacagtcacgc

SEQ ID NO: 203132 - DNA, 25 bp, Mus musculus
agtctcttaaaggagagcttgaact

SEQ ID NO: 203133 - DNA, 25 bp, Mus musculus
agtctcttcctctgctctgccttct

SEQ ID NO: 203134 - DNA, 25 bp, Mus musculus
agtctgaaaggctccagatacctgt

SEQ ID NO: 203135 - DNA, 25 bp, Mus musculus
agtctgaagcaggaaggaacagctc

SEQ ID NO: 203136 - DNA, 25 bp, Mus musculus
agtctgaagcaggatctgaagaaga

SEQ ID NO: 203137 - DNA, 25 bp, Mus musculus
agtctgaagggattggagatagcaa

SEQ ID NO: 203138 - DNA, 25 bp, Mus musculus
agtctgaatggtgggtgcaagtccc

SEQ ID NO: 203139 - DNA, 25 bp, Mus musculus
agtctgacacagcaattaccaagga

SEQ ID NO: 203140 - DNA, 25 bp, Mus musculus
agtctgacccccattgttcccacag

SEQ ID NO: 203141 - DNA, 25 bp, Mus musculus
agtctgaccgagtcagcaggaccaa

SEQ ID NO: 203142 - DNA, 25 bp, Mus musculus
agtctgacctctacaagaagactca

SEQ ID NO: 203143 - DNA, 25 bp, Mus musculus
agtctgacctgggagagtttgtgag

SEQ ID NO: 203144 - DNA, 25 bp, Mus musculus
agtctgagagcccaccttctccccc

SEQ ID NO: 203145 - DNA, 25 bp, Mus musculus
agtctgagaggcggaagaagctgcg

SEQ ID NO: 203146 - DNA, 25 bp, Mus musculus
agtctgagccgaatccaccttgaca

SEQ ID NO: 203147 - DNA, 25 bp, Mus musculus
agtctgagggagccagaatcacttc

SEQ ID NO: 203148 - DNA, 25 bp, Mus musculus
agtctgatatctgctgcttccagca

SEQ ID NO: 203149 - DNA, 25 bp, Mus musculus
agtctgatgaaagggaggctacaga

SEQ ID NO: 203150 - DNA, 25 bp, Mus musculus
agtctgatgaaaggggagggcactg

SEQ ID NO: 203151 - DNA, 25 bp, Mus musculus
agtctgcaaaccatgatctcaagac

SEQ ID NO: 203152 - DNA, 25 bp, Mus musculus
agtctgcaaaccatgcctcaatcta

SEQ ID NO: 203153 - DNA, 25 bp, Mus musculus
agtctgcaacagttgtttaatgaac

SEQ ID NO: 203154 - DNA, 25 bp, Mus musculus
agtctgcacaggaaatgaaagcttg

SEQ ID NO: 203155 - DNA, 25 bp, Mus musculus
agtctgcagagataaagccactctt

SEQ ID NO: 203156 - DNA, 25 bp, Mus musculus
agtctgcaggccgagatcaagatgc

SEQ ID NO: 203157 - DNA, 25 bp, Mus musculus
agtctgcaggccgagcaggtccttg

SEQ ID NO: 203158 - DNA, 25 bp, Mus musculus
agtctgcataaggctgcggagaagg

SEQ ID NO: 203159 - DNA, 25 bp, Mus musculus
agtctgcgccctcaggatgactgag

SEQ ID NO: 203160 - DNA, 25 bp, Mus musculus
agtctgcgcctaggggaggatcatg

SEQ ID NO: 203161 - DNA, 25 bp, Mus musculus
agtctgcggggcggttgccgctggt

SEQ ID NO: 203162 - DNA, 25 bp, Mus musculus
agtctgctcactgggggaatgcggg

SEQ ID NO: 203163 - DNA, 25 bp, Mus musculus
agtctgctcagggcggcttcatttg

SEQ ID NO: 203164 - DNA, 25 bp, Mus musculus
agtctgctgggaagatgagccagat

SEQ ID NO: 203165 - DNA, 25 bp, Mus musculus
agtctggacaggtcacgctggagtt

SEQ ID NO: 203166 - DNA, 25 bp, Mus musculus
agtctggagccggtgagcctggagg

SEQ ID NO: 203167 - DNA, 25 bp, Mus musculus
agtctggaggagattggcatccaga

SEQ ID NO: 203168 - DNA, 25 bp, Mus musculus
agtctggaggaggttcttcgtgatc

SEQ ID NO: 203169 - DNA, 25 bp, Mus musculus
agtctggatacccagtttgcagatg

SEQ ID NO: 203170 - DNA, 25 bp, Mus musculus
agtctggcaaaatgaacactaccac

SEQ ID NO: 203171 - DNA, 25 bp, Mus musculus
agtctggcaaaggccaaggaagtag

SEQ ID NO: 203172 - DNA, 25 bp, Mus musculus
agtctggcaggagtgctcaccaagt

SEQ ID NO: 203173 - DNA, 25 bp, Mus musculus
agtctggcaggatcttgtgctgaaa

SEQ ID NO: 203174 - DNA, 25 bp, Mus musculus
agtctggctatcatactgctgataa

SEQ ID NO: 203175 - DNA, 25 bp, Mus musculus
agtctgggccagcagactggaagct

SEQ ID NO: 203176 - DNA, 25 bp, Mus musculus
agtctgggccagcaggtggcccgag

SEQ ID NO: 203177 - DNA, 25 bp, Mus musculus
agtctgggggaggaaagaccacagt

SEQ ID NO: 203178 - DNA, 25 bp, Mus musculus
agtctggggggtcagcagccttatc

SEQ ID NO: 203179 - DNA, 25 bp, Mus musculus
agtctggtcagatagttttgagata

SEQ ID NO: 203180 - DNA, 25 bp, Mus musculus
agtctggtctacatagtgtgagtca

SEQ ID NO: 203181 - DNA, 25 bp, Mus musculus
agtctgtacaggttcctgcagacag

SEQ ID NO: 203182 - DNA, 25 bp, Mus musculus
agtctgtcaagggggtggcaccgaa

SEQ ID NO: 203183 - DNA, 25 bp, Mus musculus
agtctgtcctcaagtgagccccagg

SEQ ID NO: 203184 - DNA, 25 bp, Mus musculus
agtctgtcgtagagacactctgcac

SEQ ID NO: 203185 - DNA, 25 bp, Mus musculus
agtctgtgaagagccacaatcatgt

SEQ ID NO: 203186 - DNA, 25 bp, Mus musculus
agtctgtgaaggagaagtttgagat

SEQ ID NO: 203187 - DNA, 25 bp, Mus musculus
agtctgtgagcacaggacataataa

SEQ ID NO: 203188 - DNA, 25 bp, Mus musculus
agtctgtgaggctgggacccacgaa

SEQ ID NO: 203189 - DNA, 25 bp, Mus musculus
agtctgtgcacttagtagaaaatga

SEQ ID NO: 203190 - DNA, 25 bp, Mus musculus
agtctgtgctgctgccttccctcct

SEQ ID NO: 203191 - DNA, 25 bp, Mus musculus
agtctgtgctgctgcgcggtgacca

SEQ ID NO: 203192 - DNA, 25 bp, Mus musculus
agtctgtgtccaggcttcagaagag

SEQ ID NO: 203193 - DNA, 25 bp, Mus musculus
agtctgttagcgagttccagaatac

SEQ ID NO: 203194 - DNA, 25 bp, Mus musculus
agtctgttcagactgtactccctcc

SEQ ID NO: 203195 - DNA, 25 bp, Mus musculus
agtctgttttatgagatgtccagct

SEQ ID NO: 203196 - DNA, 25 bp, Mus musculus
agtcttaaaaatgcaccaacaattc

SEQ ID NO: 203197 - DNA, 25 bp, Mus musculus
agtcttaagtatttgatgctggaga

SEQ ID NO: 203198 - DNA, 25 bp, Mus musculus
agtcttaagtatttggctcagtgtt

SEQ ID NO: 203199 - DNA, 25 bp, Mus musculus
agtcttacagcctttgtttctgtgt

SEQ ID NO: 203200 - DNA, 25 bp, Mus musculus
agtcttacagcttgggcaataggaa

SEQ ID NO: 203201 - DNA, 25 bp, Mus musculus
agtcttacaggagttaggatctgta

SEQ ID NO: 203202 - DNA, 25 bp, Mus musculus
agtcttacagtattaccaggagtct

SEQ ID NO: 203203 - DNA, 25 bp, Mus musculus
agtcttacagtccattttgaatcaa

SEQ ID NO: 203204 - DNA, 25 bp, Mus musculus
agtcttacatggaaggaggcatgga

SEQ ID NO: 203205 - DNA, 25 bp, Mus musculus
agtcttacatggaagggcgtggagc

SEQ ID NO: 203206 - DNA, 25 bp, Mus musculus
agtcttagaagcagaatggaatgac

SEQ ID NO: 203207 - DNA, 25 bp, Mus musculus
agtcttagtgcaggccaaaagtcac

SEQ ID NO: 203208 - DNA, 25 bp, Mus musculus
agtcttagtgcaggctttggcagct

SEQ ID NO: 203209 - DNA, 25 bp, Mus musculus
agtcttatcaccagggagctaagaa

SEQ ID NO: 203210 - DNA, 25 bp, Mus musculus
agtcttcaaaagagtgttgaagtcc

SEQ ID NO: 203211 - DNA, 25 bp, Mus musculus
agtcttcaaaagtgaggaagaaaaa

SEQ ID NO: 203212 - DNA, 25 bp, Mus musculus
agtcttcacagagctgtgaaatcag

SEQ ID NO: 203213 - DNA, 25 bp, Mus musculus
agtcttcatagagacacaccagagg

SEQ ID NO: 203214 - DNA, 25 bp, Mus musculus
agtcttcatagagatctccttgtca

SEQ ID NO: 203215 - DNA, 25 bp, Mus musculus
agtcttcatctgactctggctcctc

SEQ ID NO: 203216 - DNA, 25 bp, Mus musculus
agtcttcattgtcagtcagggatca

SEQ ID NO: 203217 - DNA, 25 bp, Mus musculus
agtcttcatttgtgtaattttgtgc

SEQ ID NO: 203218 - DNA, 25 bp, Mus musculus
agtcttcccagagtttccagagtct

SEQ ID NO: 203219 - DNA, 25 bp, Mus musculus
agtcttcccaggatgagtctgacta

SEQ ID NO: 203220 - DNA, 25 bp, Mus musculus
agtcttcctaaatctgcagaagaag

SEQ ID NO: 203221 - DNA, 25 bp, Mus musculus
agtcttcctcagaattatctgggaa

SEQ ID NO: 203222 - DNA, 25 bp, Mus musculus
agtcttcgaataaggactgcatcaa

SEQ ID NO: 203223 - DNA, 25 bp, Mus musculus
agtcttcgaataagtaataaaagag

SEQ ID NO: 203224 - DNA, 25 bp, Mus musculus
agtcttcggggccctctgtcctgga

SEQ ID NO: 203225 - DNA, 25 bp, Mus musculus
agtcttcgtgggacctcgcaagctg

SEQ ID NO: 203226 - DNA, 25 bp, Mus musculus
agtcttctcgatctttgggaccatc

SEQ ID NO: 203227 - DNA, 25 bp, Mus musculus
agtcttctctggcttttctcatgtc

SEQ ID NO: 203228 - DNA, 25 bp, Mus musculus
agtcttctctgtcacttgcctcgga

SEQ ID NO: 203229 - DNA, 25 bp, Mus musculus
agtcttgaactttaagaaaagatgt

SEQ ID NO: 203230 - DNA, 25 bp, Mus musculus
agtcttgaactttgcaaattgaaga

SEQ ID NO: 203231 - DNA, 25 bp, Mus musculus
agtcttgacataagtgaacctagta

SEQ ID NO: 203232 - DNA, 25 bp, Mus musculus
agtcttgcagggtcagtcatatcat

SEQ ID NO: 203233 - DNA, 25 bp, Mus musculus
agtcttgctagcagcaatcatctgg

SEQ ID NO: 203234 - DNA, 25 bp, Mus musculus
agtcttggacctcagagatgaggag

SEQ ID NO: 203235 - DNA, 25 bp, Mus musculus
agtcttggcagagttttgcctgttc

SEQ ID NO: 203236 - DNA, 25 bp, Mus musculus
agtcttggctgttccttcttggagg

SEQ ID NO: 203237 - DNA, 25 bp, Mus musculus
agtcttgggcctgggcccataccca

SEQ ID NO: 203238 - DNA, 25 bp, Mus musculus
agtcttgtaatttgaactgtgaaac

SEQ ID NO: 203239 - DNA, 25 bp, Mus musculus
agtcttgtggtgctagacctgaact

SEQ ID NO: 203240 - DNA, 25 bp, Mus musculus
agtcttgtggtgctgcatctacata

SEQ ID NO: 203241 - DNA, 25 bp, Mus musculus
agtctttaaggagaaagcatccacc

SEQ ID NO: 203242 - DNA, 25 bp, Mus musculus
agtctttaagtgagcccttgaatgc

SEQ ID NO: 203243 - DNA, 25 bp, Mus musculus
agtctttaagtggttctgtgtataa

SEQ ID NO: 203244 - DNA, 25 bp, Mus musculus
agtctttacccagcctccatagact

SEQ ID NO: 203245 - DNA, 25 bp, Mus musculus
agtctttcacaagaggctccatagg

SEQ ID NO: 203246 - DNA, 25 bp, Mus musculus
agtctttcagatcctgcctcagaga

SEQ ID NO: 203247 - DNA, 25 bp, Mus musculus
agtctttcaggaagaagaccttcgg

SEQ ID NO: 203248 - DNA, 25 bp, Mus musculus
agtctttccattgagttcctccgca

SEQ ID NO: 203249 - DNA, 25 bp, Mus musculus
agtctttccgaagtctggggctatg

SEQ ID NO: 203250 - DNA, 25 bp, Mus musculus
agtctttctaacagagaagaatatc

SEQ ID NO: 203251 - DNA, 25 bp, Mus musculus
agtctttctctggccctgtatccct

SEQ ID NO: 203252 - DNA, 25 bp, Mus musculus
agtctttctgccagcgggtccggag

SEQ ID NO: 203253 - DNA, 25 bp, Mus musculus
agtctttgcctaggttgagaacaaa

SEQ ID NO: 203254 - DNA, 25 bp, Mus musculus
agtctttggaaagggacatcatcga

SEQ ID NO: 203255 - DNA, 25 bp, Mus musculus
agtctttggacctccctccaactct

SEQ ID NO: 203256 - DNA, 25 bp, Mus musculus
agtcttttgcagcagtcctatgcac

SEQ ID NO: 203257 - DNA, 25 bp, Mus musculus
agtgaaaaagtgccactgaggtcta

SEQ ID NO: 203258 - DNA, 25 bp, Mus musculus
agtgaaaaatcagggggcctgtggc

SEQ ID NO: 203259 - DNA, 25 bp, Mus musculus
agtgaaaacctgcttgtttctgggg

SEQ ID NO: 203260 - DNA, 25 bp, Mus musculus
agtgaaacacatcccaggcacccca

SEQ ID NO: 203261 - DNA, 25 bp, Mus musculus
agtgaaacagctgggtgttaacccg

SEQ ID NO: 203262 - DNA, 25 bp, Mus musculus
agtgaaactcaaagagcgtcaggaa

SEQ ID NO: 203263 - DNA, 25 bp, Mus musculus
agtgaaactcaaattttaatccagg

SEQ ID NO: 203264 - DNA, 25 bp, Mus musculus
agtgaaagcgacagctctacaacag

SEQ ID NO: 203265 - DNA, 25 bp, Mus musculus
agtgaaagttagaaatttcaacgtt

SEQ ID NO: 203266 - DNA, 25 bp, Mus musculus
agtgaaatgtcagaaaatcaagaga

SEQ ID NO: 203267 - DNA, 25 bp, Mus musculus
agtgaaatgtctgcccagaaaaatg

SEQ ID NO: 203268 - DNA, 25 bp, Mus musculus
agtgaaatgtgcagattgtgggttg

SEQ ID NO: 203269 - DNA, 25 bp, Mus musculus
agtgaacaagaactggaatgcactt

SEQ ID NO: 203270 - DNA, 25 bp, Mus musculus
agtgaacactgacgcttttgtcaat

SEQ ID NO: 203271 - DNA, 25 bp, Mus musculus
agtgaacagtaggtgagcttagcct

SEQ ID NO: 203272 - DNA, 25 bp, Mus musculus
agtgaacatccagatcatccacacg

SEQ ID NO: 203273 - DNA, 25 bp, Mus musculus
agtgaacattttcaagacatttgag

SEQ ID NO: 203274 - DNA, 25 bp, Mus musculus
agtgaaccagacagctgtgccaccg

SEQ ID NO: 203275 - DNA, 25 bp, Mus musculus
agtgaaccagacaggcacctgtgct

SEQ ID NO: 203276 - DNA, 25 bp, Mus musculus
agtgaacgagccacctcccaagctg

SEQ ID NO: 203277 - DNA, 25 bp, Mus musculus
agtgaacgtcacaggcatatatcga

SEQ ID NO: 203278 - DNA, 25 bp, Mus musculus
agtgaactaggtggccttagacatg

SEQ ID NO: 203279 - DNA, 25 bp, Mus musculus
agtgaactgaagttgaaaagagcgg

SEQ ID NO: 203280 - DNA, 25 bp, Mus musculus
agtgaactgaatgtgtttcctttgc

SEQ ID NO: 203281 - DNA, 25 bp, Mus musculus
agtgaactgcgggacatctatgacc

SEQ ID NO: 203282 - DNA, 25 bp, Mus musculus
agtgaactgcgggagtctttgtctg

SEQ ID NO: 203283 - DNA, 25 bp, Mus musculus
agtgaactgggccgctctctgcctc

SEQ ID NO: 203284 - DNA, 25 bp, Mus musculus
agtgaacttcagcagagactccaag

SEQ ID NO: 203285 - DNA, 25 bp, Mus musculus
agtgaagaaatcttccatcctacta

SEQ ID NO: 203286 - DNA, 25 bp, Mus musculus
agtgaagaactggagaaaccatgga

SEQ ID NO: 203287 - DNA, 25 bp, Mus musculus
agtgaagaactggagtattttaacc

SEQ ID NO: 203288 - DNA, 25 bp, Mus musculus
agtgaagaagaactcctacctggac

SEQ ID NO: 203289 - DNA, 25 bp, Mus musculus
agtgaagaagcgagatcatcagtac

SEQ ID NO: 203290 - DNA, 25 bp, Mus musculus
agtgaagacggacaccatgatatct

SEQ ID NO: 203291 - DNA, 25 bp, Mus musculus
agtgaagacggacagtgttacgaag

SEQ ID NO: 203292 - DNA, 25 bp, Mus musculus
agtgaagagcgagatgttgaacttg

SEQ ID NO: 203293 - DNA, 25 bp, Mus musculus
agtgaagagctggtggaaggatcat

SEQ ID NO: 203294 - DNA, 25 bp, Mus musculus
agtgaagaggaggtcccccagaggt

SEQ ID NO: 203295 - DNA, 25 bp, Mus musculus
agtgaagatcatgtgagcatcgtgg

SEQ ID NO: 203296 - DNA, 25 bp, Mus musculus
agtgaagattcaggcttgttccccc

SEQ ID NO: 203297 - DNA, 25 bp, Mus musculus
agtgaagcaacctccagctctcttc

SEQ ID NO: 203298 - DNA, 25 bp, Mus musculus
agtgaagcaactaagattcctctcg

SEQ ID NO: 203299 - DNA, 25 bp, Mus musculus
agtgaagcaactaaggttcagagaa

SEQ ID NO: 203300 - DNA, 25 bp, Mus musculus
agtgaagcaccaggtttggaaacag

SEQ ID NO: 203301 - DNA, 25 bp, Mus musculus
agtgaagcaggcagggcattttccg

SEQ ID NO: 203302 - DNA, 25 bp, Mus musculus
agtgaagccagtaaacaaggccagg

SEQ ID NO: 203303 - DNA, 25 bp, Mus musculus
agtgaagcctgctggtcctacagtg

SEQ ID NO: 203304 - DNA, 25 bp, Mus musculus
agtgaagctcaagatggagaaatgg

SEQ ID NO: 203305 - DNA, 25 bp, Mus musculus
agtgaagctcaaggttgattctttc

SEQ ID NO: 203306 - DNA, 25 bp, Mus musculus
agtgaaggaaataaaatggttatgt

SEQ ID NO: 203307 - DNA, 25 bp, Mus musculus
agtgaaggagtttctggtgtgatcc

SEQ ID NO: 203308 - DNA, 25 bp, Mus musculus
agtgaaggcaaaaaggccaaagcct

SEQ ID NO: 203309 - DNA, 25 bp, Mus musculus
agtgaaggccggaggatggaaccaa

SEQ ID NO: 203310 - DNA, 25 bp, Mus musculus
agtgaaggccggagttccctcacaa

SEQ ID NO: 203311 - DNA, 25 bp, Mus musculus
agtgaaggctggctgcctttgcggg

SEQ ID NO: 203312 - DNA, 25 bp, Mus musculus
agtgaaggggcagtctgtccatcag

SEQ ID NO: 203313 - DNA, 25 bp, Mus musculus
agtgaaggtgacaggtctattttcc

SEQ ID NO: 203314 - DNA, 25 bp, Mus musculus
agtgaagtgtctactaatttcccag

SEQ ID NO: 203315 - DNA, 25 bp, Mus musculus
agtgaagttattcagaagagagcca

SEQ ID NO: 203316 - DNA, 25 bp, Mus musculus
agtgaagttattcatgctcgattta

SEQ ID NO: 203317 - DNA, 25 bp, Mus musculus
agtgaatacgaagctgttgccgcac

SEQ ID NO: 203318 - DNA, 25 bp, Mus musculus
agtgaatatgttttgcattttcttc

SEQ ID NO: 203319 - DNA, 25 bp, Mus musculus
agtgaatattccaggaacattagaa

SEQ ID NO: 203320 - DNA, 25 bp, Mus musculus
agtgaatcagcctcaccttcagccc

SEQ ID NO: 203321 - DNA, 25 bp, Mus musculus
agtgaatccaggtggcacaagactt

SEQ ID NO: 203322 - DNA, 25 bp, Mus musculus
agtgaatgaaggctttaacagaaaa

SEQ ID NO: 203323 - DNA, 25 bp, Mus musculus
agtgaatgacgagccccacaggatc

SEQ ID NO: 203324 - DNA, 25 bp, Mus musculus
agtgaatgacgagtgtggagagcaa

SEQ ID NO: 203325 - DNA, 25 bp, Mus musculus
agtgaattagatataatgtttaatt

SEQ ID NO: 203326 - DNA, 25 bp, Mus musculus
agtgaattcttggacctgagttcag

SEQ ID NO: 203327 - DNA, 25 bp, Mus musculus
agtgaatttccagatgcaggtgtcc

SEQ ID NO: 203328 - DNA, 25 bp, Mus musculus
agtgacaactccacagagtcattct

SEQ ID NO: 203329 - DNA, 25 bp, Mus musculus
agtgacaagggagaattcggtggct

SEQ ID NO: 203330 - DNA, 25 bp, Mus musculus
agtgacaagggagggaaaattgaat

SEQ ID NO: 203331 - DNA, 25 bp, Mus musculus
agtgacaagtccagtagaggaagcc

SEQ ID NO: 203332 - DNA, 25 bp, Mus musculus
agtgacaagtgcgagaacatgtttg

SEQ ID NO: 203333 - DNA, 25 bp, Mus musculus
agtgacaagtgcgagatcaaagaac

SEQ ID NO: 203334 - DNA, 25 bp, Mus musculus
agtgacacagcttcagcggtgggtc

SEQ ID NO: 203335 - DNA, 25 bp, Mus musculus
agtgacacaggttcagcggtgggtc

SEQ ID NO: 203336 - DNA, 25 bp, Mus musculus
agtgacaccagagaccttaaccgaa

SEQ ID NO: 203337 - DNA, 25 bp, Mus musculus
agtgacactccacacttggatgctc

SEQ ID NO: 203338 - DNA, 25 bp, Mus musculus
agtgacactccacagaagtgtacag

SEQ ID NO: 203339 - DNA, 25 bp, Mus musculus
agtgacagagaaagtgatctttccg

SEQ ID NO: 203340 - DNA, 25 bp, Mus musculus
agtgacagagagtcagtgggccccg

SEQ ID NO: 203341 - DNA, 25 bp, Mus musculus
agtgacaggcatgagtaaagacatt

SEQ ID NO: 203342 - DNA, 25 bp, Mus musculus
agtgacaggggacccatgagcttcc

SEQ ID NO: 203343 - DNA, 25 bp, Mus musculus
agtgacagtgacccggctaagcatg

SEQ ID NO: 203344 - DNA, 25 bp, Mus musculus
agtgacagtgacccggtgaagactt

SEQ ID NO: 203345 - DNA, 25 bp, Mus musculus
agtgacagtgacctggctgaagaat

SEQ ID NO: 203346 - DNA, 25 bp, Mus musculus
agtgacagtgagagcgggtccggaa

SEQ ID NO: 203347 - DNA, 25 bp, Mus musculus
agtgacatagagtgtgctgctctgg

SEQ ID NO: 203348 - DNA, 25 bp, Mus musculus
agtgacatatgcccccaaggtctct

SEQ ID NO: 203349 - DNA, 25 bp, Mus musculus
agtgacatcattcagaatctgtccg

SEQ ID NO: 203350 - DNA, 25 bp, Mus musculus
agtgacatcctagacaacaacggga

SEQ ID NO: 203351 - DNA, 25 bp, Mus musculus
agtgacatcgcatcggctcttagat

SEQ ID NO: 203352 - DNA, 25 bp, Mus musculus
agtgacatcggcgccagagcttctg

SEQ ID NO: 203353 - DNA, 25 bp, Mus musculus
agtgaccaaccagattgagagccac

SEQ ID NO: 203354 - DNA, 25 bp, Mus musculus
agtgaccaaccaggtcgagtgtcac

SEQ ID NO: 203355 - DNA, 25 bp, Mus musculus
agtgaccacagagagttctccagat

SEQ ID NO: 203356 - DNA, 25 bp, Mus musculus
agtgaccacaggacaggattatgga

SEQ ID NO: 203357 - DNA, 25 bp, Mus musculus
agtgaccacccagatgttgccgcac

SEQ ID NO: 203358 - DNA, 25 bp, Mus musculus
agtgaccacgctgtgttgacatcct

SEQ ID NO: 203359 - DNA, 25 bp, Mus musculus
agtgaccacggggtaaaggccgagt

SEQ ID NO: 203360 - DNA, 25 bp, Mus musculus
agtgaccagccgagaacgaggccct

SEQ ID NO: 203361 - DNA, 25 bp, Mus musculus
agtgaccagcgtgtccaccctgaag

SEQ ID NO: 203362 - DNA, 25 bp, Mus musculus
agtgaccagtggagtgaagccagcc

SEQ ID NO: 203363 - DNA, 25 bp, Mus musculus
agtgaccatccagaaaaaacactga

SEQ ID NO: 203364 - DNA, 25 bp, Mus musculus
agtgaccatggtggtgatgaccatt

SEQ ID NO: 203365 - DNA, 25 bp, Mus musculus
agtgaccattgagcaagaactatgt

SEQ ID NO: 203366 - DNA, 25 bp, Mus musculus
agtgaccattgaggttatctggctg

SEQ ID NO: 203367 - DNA, 25 bp, Mus musculus
agtgaccccatgtggccacagtaca

SEQ ID NO: 203368 - DNA, 25 bp, Mus musculus
agtgacccccagcagtctaaggtgg

SEQ ID NO: 203369 - DNA, 25 bp, Mus musculus
agtgaccccctggcaggacactact

SEQ ID NO: 203370 - DNA, 25 bp, Mus musculus
agtgaccgaatgagaaaggtttaac

SEQ ID NO: 203371 - DNA, 25 bp, Mus musculus
agtgaccgaatgagagactctacag

SEQ ID NO: 203372 - DNA, 25 bp, Mus musculus
agtgaccgaatgagctgccgagtgt

SEQ ID NO: 203373 - DNA, 25 bp, Mus musculus
agtgacctaacaggtgtgaaagatg

SEQ ID NO: 203374 - DNA, 25 bp, Mus musculus
agtgacctggaaagtgtctttgcca

SEQ ID NO: 203375 - DNA, 25 bp, Mus musculus
agtgacggccctggagatggaagcc

SEQ ID NO: 203376 - DNA, 25 bp, Mus musculus
agtgacgtcgggaactgaagagccg

SEQ ID NO: 203377 - DNA, 25 bp, Mus musculus
agtgacgtcgggaagttccgtgtac

SEQ ID NO: 203378 - DNA, 25 bp, Mus musculus
agtgacgtgaaagccagagacgccc

SEQ ID NO: 203379 - DNA, 25 bp, Mus musculus
agtgacgtggatgagtacgctccag

SEQ ID NO: 203380 - DNA, 25 bp, Mus musculus
agtgacgtgggctggcgcttgtttg

SEQ ID NO: 203381 - DNA, 25 bp, Mus musculus
agtgacgtggtgggaagaggtgcca

SEQ ID NO: 203382 - DNA, 25 bp, Mus musculus
agtgactaaaagtagtagaaggagg

SEQ ID NO: 203383 - DNA, 25 bp, Mus musculus
agtgactactttagggccatgttca

SEQ ID NO: 203384 - DNA, 25 bp, Mus musculus
agtgactactttagtgctgaggtga

SEQ ID NO: 203385 - DNA, 25 bp, Mus musculus
agtgactcagacatggaaaccagac

SEQ ID NO: 203386 - DNA, 25 bp, Mus musculus
agtgactcagctattcgtcttcata

SEQ ID NO: 203387 - DNA, 25 bp, Mus musculus
agtgactcaggaagccataatttgt

SEQ ID NO: 203388 - DNA, 25 bp, Mus musculus
agtgactcatgagaaaagagaagca

SEQ ID NO: 203389 - DNA, 25 bp, Mus musculus
agtgactcatgaggctcatccagag

SEQ ID NO: 203390 - DNA, 25 bp, Mus musculus
agtgactccaggctgtccttgttgg

SEQ ID NO: 203391 - DNA, 25 bp, Mus musculus
agtgactcctccatgctggacagtg

SEQ ID NO: 203392 - DNA, 25 bp, Mus musculus
agtgactcctttcccaacactatga

SEQ ID NO: 203393 - DNA, 25 bp, Mus musculus
agtgactctgccgaccccttcctga

SEQ ID NO: 203394 - DNA, 25 bp, Mus musculus
agtgactctgctcttctagattatt

SEQ ID NO: 203395 - DNA, 25 bp, Mus musculus
agtgactgaaaaagttccaccaggt

SEQ ID NO: 203396 - DNA, 25 bp, Mus musculus
agtgactgagagtggaatgcagtgg

SEQ ID NO: 203397 - DNA, 25 bp, Mus musculus
agtgactgcagaaccaagggccagg

SEQ ID NO: 203398 - DNA, 25 bp, Mus musculus
agtgactgcaggctcatgagcagcg

SEQ ID NO: 203399 - DNA, 25 bp, Mus musculus
agtgactggacccatgtccttcagg

SEQ ID NO: 203400 - DNA, 25 bp, Mus musculus
agtgactggaggattctgtacccag

SEQ ID NO: 203401 - DNA, 25 bp, Mus musculus
agtgactgtaagttgtctgacatct

SEQ ID NO: 203402 - DNA, 25 bp, Mus musculus
agtgactgtagtctgacatctctcc

SEQ ID NO: 203403 - DNA, 25 bp, Mus musculus
agtgactgtgtaacggagcacctcc

SEQ ID NO: 203404 - DNA, 25 bp, Mus musculus
agtgactgtgttagatgctcctgaa

SEQ ID NO: 203405 - DNA, 25 bp, Mus musculus
agtgactgtgttagttgaacccaca

SEQ ID NO: 203406 - DNA, 25 bp, Mus musculus
agtgactgttatatgcagcagaaga

SEQ ID NO: 203407 - DNA, 25 bp, Mus musculus
agtgacttcagtggggcgtctccgc

SEQ ID NO: 203408 - DNA, 25 bp, Mus musculus
agtgacttccacaggacctataaga

SEQ ID NO: 203409 - DNA, 25 bp, Mus musculus
agtgacttccgtggtgggattttcc

SEQ ID NO: 203410 - DNA, 25 bp, Mus musculus
agtgactttaaggacagttatctgc

SEQ ID NO: 203411 - DNA, 25 bp, Mus musculus
agtgagaaaaggatgattgagatag

SEQ ID NO: 203412 - DNA, 25 bp, Mus musculus
agtgagaaaaggccctcaacttcct

SEQ ID NO: 203413 - DNA, 25 bp, Mus musculus
agtgagaaaggagacacggtctctc

SEQ ID NO: 203414 - DNA, 25 bp, Mus musculus
agtgagaaaggagacatggagtaca

SEQ ID NO: 203415 - DNA, 25 bp, Mus musculus
agtgagaaaggggacagtcaaaagg

SEQ ID NO: 203416 - DNA, 25 bp, Mus musculus
agtgagaacaggtcctatgagggca

SEQ ID NO: 203417 - DNA, 25 bp, Mus musculus
agtgagaaccagagcatcgtgctgg

SEQ ID NO: 203418 - DNA, 25 bp, Mus musculus
agtgagaaccagagggacagcatcg

SEQ ID NO: 203419 - DNA, 25 bp, Mus musculus
agtgagaaccttacccacaggtccg

SEQ ID NO: 203420 - DNA, 25 bp, Mus musculus
agtgagaagagagagaagctcggac

SEQ ID NO: 203421 - DNA, 25 bp, Mus musculus
agtgagaagattacgacgggcagaa

SEQ ID NO: 203422 - DNA, 25 bp, Mus musculus
agtgagaatgagacgtccagcgtgc

SEQ ID NO: 203423 - DNA, 25 bp, Mus musculus
agtgagaatgaggaaggcaagcgca

SEQ ID NO: 203424 - DNA, 25 bp, Mus musculus
agtgagaatgattggagcctgccgg

SEQ ID NO: 203425 - DNA, 25 bp, Mus musculus
agtgagaatgggttaactgctcttt

SEQ ID NO: 203426 - DNA, 25 bp, Mus musculus
agtgagacagtcatcgctccaccca

SEQ ID NO: 203427 - DNA, 25 bp, Mus musculus
agtgagacagtgggggatcttcgag

SEQ ID NO: 203428 - DNA, 25 bp, Mus musculus
agtgagaccggaccagctccccata

SEQ ID NO: 203429 - DNA, 25 bp, Mus musculus
agtgagacctgcgacaacaacggga

SEQ ID NO: 203430 - DNA, 25 bp, Mus musculus
agtgagactaatagtgcagaggaga

SEQ ID NO: 203431 - DNA, 25 bp, Mus musculus
agtgagactaatccagctgaacata

SEQ ID NO: 203432 - DNA, 25 bp, Mus musculus
agtgagagcaagagatacttcaagc

SEQ ID NO: 203433 - DNA, 25 bp, Mus musculus
agtgagagccagtcgtttcagctct

SEQ ID NO: 203434 - DNA, 25 bp, Mus musculus
agtgagagcgagcaaccttcaaaca

SEQ ID NO: 203435 - DNA, 25 bp, Mus musculus
agtgagaggctcaggcagaagatcc

SEQ ID NO: 203436 - DNA, 25 bp, Mus musculus
agtgagagttaagggcacagagaac

SEQ ID NO: 203437 - DNA, 25 bp, Mus musculus
agtgagatacagattgctaataatc

SEQ ID NO: 203438 - DNA, 25 bp, Mus musculus
agtgagatcgcagccttccctgtgc

SEQ ID NO: 203439 - DNA, 25 bp, Mus musculus
agtgagatcgtttcctcctcagata

SEQ ID NO: 203440 - DNA, 25 bp, Mus musculus
agtgagcaagcaggaggaggcctct

SEQ ID NO: 203441 - DNA, 25 bp, Mus musculus
agtgagcacggatgaaaatttttcc

SEQ ID NO: 203442 - DNA, 25 bp, Mus musculus
agtgagcacggttatttttgaagtt

SEQ ID NO: 203443 - DNA, 25 bp, Mus musculus
agtgagcaggggtgactactttggg

SEQ ID NO: 203444 - DNA, 25 bp, Mus musculus
agtgagcatcctctaccacacccgt

SEQ ID NO: 203445 - DNA, 25 bp, Mus musculus
agtgagccaccaggagaggaaacga

SEQ ID NO: 203446 - DNA, 25 bp, Mus musculus
agtgagccccagaccacctcatcct

SEQ ID NO: 203447 - DNA, 25 bp, Mus musculus
agtgagccccaggtctgtctccgtg

SEQ ID NO: 203448 - DNA, 25 bp, Mus musculus
agtgagcctggtcaggcagtccctc

SEQ ID NO: 203449 - DNA, 25 bp, Mus musculus
agtgagcctggtcaggtgaaagcag

SEQ ID NO: 203450 - DNA, 25 bp, Mus musculus
agtgagcgaaagactttactggaaa

SEQ ID NO: 203451 - DNA, 25 bp, Mus musculus
agtgagcgggggctgagtgtcagtg

SEQ ID NO: 203452 - DNA, 25 bp, Mus musculus
agtgagctgaaggacgagggccttg

SEQ ID NO: 203453 - DNA, 25 bp, Mus musculus
agtgagctgcctgagcttcatgccc

SEQ ID NO: 203454 - DNA, 25 bp, Mus musculus
agtgaggaaaggagggcggaaatga

SEQ ID NO: 203455 - DNA, 25 bp, Mus musculus
agtgaggaaccccggaagcacaaat

SEQ ID NO: 203456 - DNA, 25 bp, Mus musculus
agtgaggacacagagaagctcattg

SEQ ID NO: 203457 - DNA, 25 bp, Mus musculus
agtgaggacaggcttttgattgcag

SEQ ID NO: 203458 - DNA, 25 bp, Mus musculus
agtgaggactgggttgactgtgggt

SEQ ID NO: 203459 - DNA, 25 bp, Mus musculus
agtgaggagaaggacctcaccatcc

SEQ ID NO: 203460 - DNA, 25 bp, Mus musculus
agtgaggcagaggtcccgtcaggaa

SEQ ID NO: 203461 - DNA, 25 bp, Mus musculus
agtgaggccacagtgtgtcagaaat

SEQ ID NO: 203462 - DNA, 25 bp, Mus musculus
agtgaggccccagggcaactgggtg

SEQ ID NO: 203463 - DNA, 25 bp, Mus musculus
agtgaggctgaagaggaagaagagc

SEQ ID NO: 203464 - DNA, 25 bp, Mus musculus
agtgagggaagatggagatattcta

SEQ ID NO: 203465 - DNA, 25 bp, Mus musculus
agtgagggatggcaggctcaaagac

SEQ ID NO: 203466 - DNA, 25 bp, Mus musculus
agtgaggtgggccagacatcagaac

SEQ ID NO: 203467 - DNA, 25 bp, Mus musculus
agtgaggtgtgttgaggtcattgca

SEQ ID NO: 203468 - DNA, 25 bp, Mus musculus
agtgagtactccacgttgcaggatc

SEQ ID NO: 203469 - DNA, 25 bp, Mus musculus
agtgagtagagagggtcctgagtga

SEQ ID NO: 203470 - DNA, 25 bp, Mus musculus
agtgagtagcaccaatgggcatagg

SEQ ID NO: 203471 - DNA, 25 bp, Mus musculus
agtgagtcaggaacaaagtattgag

SEQ ID NO: 203472 - DNA, 25 bp, Mus musculus
agtgagtcaggtgttaaatgaatac

SEQ ID NO: 203473 - DNA, 25 bp, Mus musculus
agtgagtccgatgccttacggtcaa

SEQ ID NO: 203474 - DNA, 25 bp, Mus musculus
agtgagtccgcaccttcagggtccc

SEQ ID NO: 203475 - DNA, 25 bp, Mus musculus
agtgagtcctccccttcaaagctgt

SEQ ID NO: 203476 - DNA, 25 bp, Mus musculus
agtgagtcggcagggctctgagtca

SEQ ID NO: 203477 - DNA, 25 bp, Mus musculus
agtgagtcggcagttgaaagtgggg

SEQ ID NO: 203478 - DNA, 25 bp, Mus musculus
agtgagtgacagagcctccaggtga

SEQ ID NO: 203479 - DNA, 25 bp, Mus musculus
agtgagtgccaaggttcatatggga

SEQ ID NO: 203480 - DNA, 25 bp, Mus musculus
agtgagtgccagcgaatggctattc

SEQ ID NO: 203481 - DNA, 25 bp, Mus musculus
agtgagtggctggattcctatctac

SEQ ID NO: 203482 - DNA, 25 bp, Mus musculus
agtgagtgtgtgtgtcagcggtctg

SEQ ID NO: 203483 - DNA, 25 bp, Mus musculus
agtgagtttcccccacttacagact

SEQ ID NO: 203484 - DNA, 25 bp, Mus musculus
agtgataaaggagattgaggacggc

SEQ ID NO: 203485 - DNA, 25 bp, Mus musculus
agtgataaaggaggccttggaaata

SEQ ID NO: 203486 - DNA, 25 bp, Mus musculus
agtgataacgaacggtaccatggtt

SEQ ID NO: 203487 - DNA, 25 bp, Mus musculus
agtgatacgcacagatcttgatatg

SEQ ID NO: 203488 - DNA, 25 bp, Mus musculus
agtgatagaaaagcttggctttccc

SEQ ID NO: 203489 - DNA, 25 bp, Mus musculus
agtgatagtggcaatccagatcatg

SEQ ID NO: 203490 - DNA, 25 bp, Mus musculus
agtgatatacaggtggaatgacatt

SEQ ID NO: 203491 - DNA, 25 bp, Mus musculus
agtgatcaagattagacgtggtctg

SEQ ID NO: 203492 - DNA, 25 bp, Mus musculus
agtgatcaagattcaaaataaacca

SEQ ID NO: 203493 - DNA, 25 bp, Mus musculus
agtgatcacaggattgctgctggac

SEQ ID NO: 203494 - DNA, 25 bp, Mus musculus
agtgatcacaggcctgggcatgtgt

SEQ ID NO: 203495 - DNA, 25 bp, Mus musculus
agtgatcacagggccaaaggcgaca

SEQ ID NO: 203496 - DNA, 25 bp, Mus musculus
agtgatcatgtgcctctcctttccc

SEQ ID NO: 203497 - DNA, 25 bp, Mus musculus
agtgatccagtctgttgtctactgc

SEQ ID NO: 203498 - DNA, 25 bp, Mus musculus
agtgatcgatgccagaaagaagagc

SEQ ID NO: 203499 - DNA, 25 bp, Mus musculus
agtgatcgatgccagattttgcctc

SEQ ID NO: 203500 - DNA, 25 bp, Mus musculus
agtgatcgatgccaggtttcacttt

SEQ ID NO: 203501 - DNA, 25 bp, Mus musculus
agtgatctctcaggtgccaacagga

SEQ ID NO: 203502 - DNA, 25 bp, Mus musculus
agtgatcttcagggggtgattagtg

SEQ ID NO: 203503 - DNA, 25 bp, Mus musculus
agtgatcttctaaagttgattgaat

SEQ ID NO: 203504 - DNA, 25 bp, Mus musculus
agtgatgaaaagcttgttcggccag

SEQ ID NO: 203505 - DNA, 25 bp, Mus musculus
agtgatgaaaaggaagtaccattgg

SEQ ID NO: 203506 - DNA, 25 bp, Mus musculus
agtgatgaagaagccttcctgttct

SEQ ID NO: 203507 - DNA, 25 bp, Mus musculus
agtgatgaaggagaggatgatgtca

SEQ ID NO: 203508 - DNA, 25 bp, Mus musculus
agtgatgatgagcaggaaaagaagc

SEQ ID NO: 203509 - DNA, 25 bp, Mus musculus
agtgatgatgtttttccctaggcag

SEQ ID NO: 203510 - DNA, 25 bp, Mus musculus
agtgatgctacaggtaaagtccttt

SEQ ID NO: 203511 - DNA, 25 bp, Mus musculus
agtgatgctcacagagaacagtaca

SEQ ID NO: 203512 - DNA, 25 bp, Mus musculus
agtgatgctcacaggaagttcattc

SEQ ID NO: 203513 - DNA, 25 bp, Mus musculus
agtgatgctgaccagcacgtaactt

SEQ ID NO: 203514 - DNA, 25 bp, Mus musculus
agtgatgctgaccgagatccctgac

SEQ ID NO: 203515 - DNA, 25 bp, Mus musculus
agtgatgctgatgagtgccttgctc

SEQ ID NO: 203516 - DNA, 25 bp, Mus musculus
agtgatgctgcgaagctgatggtgc

SEQ ID NO: 203517 - DNA, 25 bp, Mus musculus
agtgatgctggacaccgccttagga

SEQ ID NO: 203518 - DNA, 25 bp, Mus musculus
agtgatgcttattctttgggagccc

SEQ ID NO: 203519 - DNA, 25 bp, Mus musculus
agtgatggacaggtttttggtgcat

SEQ ID NO: 203520 - DNA, 25 bp, Mus musculus
agtgatggagactcagaaagcctta

SEQ ID NO: 203521 - DNA, 25 bp, Mus musculus
agtgatggagatgagaagaagccgg

SEQ ID NO: 203522 - DNA, 25 bp, Mus musculus
agtgatggagatgcgctccctcctt

SEQ ID NO: 203523 - DNA, 25 bp, Mus musculus
agtgatggagatggggtcctaaagg

SEQ ID NO: 203524 - DNA, 25 bp, Mus musculus
agtgatggaggacttctgtgtgtca

SEQ ID NO: 203525 - DNA, 25 bp, Mus musculus
agtgatggagtcggctcttaaccgg

SEQ ID NO: 203526 - DNA, 25 bp, Mus musculus
agtgatggcgactgttgccctctat

SEQ ID NO: 203527 - DNA, 25 bp, Mus musculus
agtgatggggcagaagaaactcttg

SEQ ID NO: 203528 - DNA, 25 bp, Mus musculus
agtgatggtaagcttctctctaaca

SEQ ID NO: 203529 - DNA, 25 bp, Mus musculus
agtgatggtgctcagggtacagcat

SEQ ID NO: 203530 - DNA, 25 bp, Mus musculus
agtgatgtccatgaggcctgtccca

SEQ ID NO: 203531 - DNA, 25 bp, Mus musculus
agtgatgtgtttggactcacacacg

SEQ ID NO: 203532 - DNA, 25 bp, Mus musculus
agtgatgtgtttggggaggcagatg

SEQ ID NO: 203533 - DNA, 25 bp, Mus musculus
agtgattacagagaattgtatttct

SEQ ID NO: 203534 - DNA, 25 bp, Mus musculus
agtgattacagaggctttggtatag

SEQ ID NO: 203535 - DNA, 25 bp, Mus musculus
agtgattacagaggttgccatgaag

SEQ ID NO: 203536 - DNA, 25 bp, Mus musculus
agtgattactttgagcgtcgagcag

SEQ ID NO: 203537 - DNA, 25 bp, Mus musculus
agtgattactttgagtttgctgggg

SEQ ID NO: 203538 - DNA, 25 bp, Mus musculus
agtgattatagttgattgaatcaac

SEQ ID NO: 203539 - DNA, 25 bp, Mus musculus
agtgattatagtttcagagccatct

SEQ ID NO: 203540 - DNA, 25 bp, Mus musculus
agtgattccaggttcagtacctctc

SEQ ID NO: 203541 - DNA, 25 bp, Mus musculus
agtgattctgcaaaaaatactttga

SEQ ID NO: 203542 - DNA, 25 bp, Mus musculus
agtgattgtaagaatgaagatatcc

SEQ ID NO: 203543 - DNA, 25 bp, Mus musculus
agtgattgtaatctacttttttact

SEQ ID NO: 203544 - DNA, 25 bp, Mus musculus
agtgatttaaaggatgacgagaagg

SEQ ID NO: 203545 - DNA, 25 bp, Mus musculus
agtgatttaggaatgttcttgggag

SEQ ID NO: 203546 - DNA, 25 bp, Mus musculus
agtgatttgctgtcagaagctatcc

SEQ ID NO: 203547 - DNA, 25 bp, Mus musculus
agtgatttggagaggtacaactgat

SEQ ID NO: 203548 - DNA, 25 bp, Mus musculus
agtgcaaaacagatggagaataggg

SEQ ID NO: 203549 - DNA, 25 bp, Mus musculus
agtgcaaaacaggatatcctgtacc

SEQ ID NO: 203550 - DNA, 25 bp, Mus musculus
agtgcaaagaatggctacatctttt

SEQ ID NO: 203551 - DNA, 25 bp, Mus musculus
agtgcaaagagagacaggaatcctt

SEQ ID NO: 203552 - DNA, 25 bp, Mus musculus
agtgcaaagcagagacggtaacacg

SEQ ID NO: 203553 - DNA, 25 bp, Mus musculus
agtgcaaaggaggtgttttagctca

SEQ ID NO: 203554 - DNA, 25 bp, Mus musculus
agtgcaacacaagatttccacccag

SEQ ID NO: 203555 - DNA, 25 bp, Mus musculus
agtgcaacacaaggctgtgtctctc

SEQ ID NO: 203556 - DNA, 25 bp, Mus musculus
agtgcaacatcccagccaaagcaaa

SEQ ID NO: 203557 - DNA, 25 bp, Mus musculus
agtgcaaccagacatccagaaccca

SEQ ID NO: 203558 - DNA, 25 bp, Mus musculus
agtgcaacccgtggcagtcaagctc

SEQ ID NO: 203559 - DNA, 25 bp, Mus musculus
agtgcaacggacaggagacctgaac

SEQ ID NO: 203560 - DNA, 25 bp, Mus musculus
agtgcaactacagccttgatgacca

SEQ ID NO: 203561 - DNA, 25 bp, Mus musculus
agtgcaagacagcacaccctaaagc

SEQ ID NO: 203562 - DNA, 25 bp, Mus musculus
agtgcaagagtgagggtgatctgca

SEQ ID NO: 203563 - DNA, 25 bp, Mus musculus
agtgcaagatatgaaattgttgata

SEQ ID NO: 203564 - DNA, 25 bp, Mus musculus
agtgcaagcagagagagaagacgac

SEQ ID NO: 203565 - DNA, 25 bp, Mus musculus
agtgcaagcagttgcacgtttgtga

SEQ ID NO: 203566 - DNA, 25 bp, Mus musculus
agtgcaagcattcagctccctgccc

SEQ ID NO: 203567 - DNA, 25 bp, Mus musculus
agtgcaagccaaggtgaaacttcag

SEQ ID NO: 203568 - DNA, 25 bp, Mus musculus
agtgcaagccaaggttacctctgga

SEQ ID NO: 203569 - DNA, 25 bp, Mus musculus
agtgcaagccccaagaggatgatta

SEQ ID NO: 203570 - DNA, 25 bp, Mus musculus
agtgcaagccccatgtcactgcctt

SEQ ID NO: 203571 - DNA, 25 bp, Mus musculus
agtgcaaggaaatccggacatctat

SEQ ID NO: 203572 - DNA, 25 bp, Mus musculus
agtgcaagtctccaggtgctgctgg

SEQ ID NO: 203573 - DNA, 25 bp, Mus musculus
agtgcaatccagcccttacagagga

SEQ ID NO: 203574 - DNA, 25 bp, Mus musculus
agtgcaatccaggtcctggaatcct

SEQ ID NO: 203575 - DNA, 25 bp, Mus musculus
agtgcaatgcaggacagtggtgact

SEQ ID NO: 203576 - DNA, 25 bp, Mus musculus
agtgcaatgcagtccgtggtggatg

SEQ ID NO: 203577 - DNA, 25 bp, Mus musculus
agtgcaatggatcagttggagaatc

SEQ ID NO: 203578 - DNA, 25 bp, Mus musculus
agtgcaatggcttccatacgacagt

SEQ ID NO: 203579 - DNA, 25 bp, Mus musculus
agtgcacaagtgcacttaatgcagc

SEQ ID NO: 203580 - DNA, 25 bp, Mus musculus
agtgcacagaacctcgttgccattc

SEQ ID NO: 203581 - DNA, 25 bp, Mus musculus
agtgcacagctggtatgcatggacc

SEQ ID NO: 203582 - DNA, 25 bp, Mus musculus
agtgcacagtggatgttcctccatt

SEQ ID NO: 203583 - DNA, 25 bp, Mus musculus
agtgcaccaaagaccgtggggcagt

SEQ ID NO: 203584 - DNA, 25 bp, Mus musculus
agtgcaccaagaagctgcagcaata

SEQ ID NO: 203585 - DNA, 25 bp, Mus musculus
agtgcaccagcaagctgagttccta

SEQ ID NO: 203586 - DNA, 25 bp, Mus musculus
agtgcaccctggaacagcttcagag

SEQ ID NO: 203587 - DNA, 25 bp, Mus musculus
agtgcaccggaagatggacgacatg

SEQ ID NO: 203588 - DNA, 25 bp, Mus musculus
agtgcaccggggtctgctgacagac

SEQ ID NO: 203589 - DNA, 25 bp, Mus musculus
agtgcactcagacagatggtgcaga

SEQ ID NO: 203590 - DNA, 25 bp, Mus musculus
agtgcacttagcatgatgacttgct

SEQ ID NO: 203591 - DNA, 25 bp, Mus musculus
agtgcagaagctgtagctatctctg

SEQ ID NO: 203592 - DNA, 25 bp, Mus musculus
agtgcagacagaacggtcattgatt

SEQ ID NO: 203593 - DNA, 25 bp, Mus musculus
agtgcagacgtagagggatttaaag

SEQ ID NO: 203594 - DNA, 25 bp, Mus musculus
agtgcagagactgtgagcaaagaaa

SEQ ID NO: 203595 - DNA, 25 bp, Mus musculus
agtgcagagacttcttccctaggaa

SEQ ID NO: 203596 - DNA, 25 bp, Mus musculus
agtgcagcagccccaccagtgggac

SEQ ID NO: 203597 - DNA, 25 bp, Mus musculus
agtgcagcagggcaagcttctagcc

SEQ ID NO: 203598 - DNA, 25 bp, Mus musculus
agtgcagcaggttcaccgtctcccg

SEQ ID NO: 203599 - DNA, 25 bp, Mus musculus
agtgcagccaccaggacgcagagac

SEQ ID NO: 203600 - DNA, 25 bp, Mus musculus
agtgcagccagcagcatgtgtttca

SEQ ID NO: 203601 - DNA, 25 bp, Mus musculus
agtgcagcctcagccaagttgaagt

SEQ ID NO: 203602 - DNA, 25 bp, Mus musculus
agtgcagcgacggatcgaagcctgt

SEQ ID NO: 203603 - DNA, 25 bp, Mus musculus
agtgcagcgggagggcagcagagct

SEQ ID NO: 203604 - DNA, 25 bp, Mus musculus
agtgcagctgaggagcagctgcctt

SEQ ID NO: 203605 - DNA, 25 bp, Mus musculus
agtgcagcttgagtagcttatctac

SEQ ID NO: 203606 - DNA, 25 bp, Mus musculus
agtgcagcttggagtggatttgtct

SEQ ID NO: 203607 - DNA, 25 bp, Mus musculus
agtgcagctttgttgagaaggagcg

SEQ ID NO: 203608 - DNA, 25 bp, Mus musculus
agtgcaggaaagacatggaaggcct

SEQ ID NO: 203609 - DNA, 25 bp, Mus musculus
agtgcaggaaagatggccctgcatg

SEQ ID NO: 203610 - DNA, 25 bp, Mus musculus
agtgcaggaagaacagaggcgtgag

SEQ ID NO: 203611 - DNA, 25 bp, Mus musculus
agtgcaggatgcaggtcaactgaag

SEQ ID NO: 203612 - DNA, 25 bp, Mus musculus
agtgcaggcggaacaagacaacctc

SEQ ID NO: 203613 - DNA, 25 bp, Mus musculus
agtgcaggctccagaatggagctgc

SEQ ID NO: 203614 - DNA, 25 bp, Mus musculus
agtgcaggctccaggtacacctggt

SEQ ID NO: 203615 - DNA, 25 bp, Mus musculus
agtgcagggctggaagccattcagt

SEQ ID NO: 203616 - DNA, 25 bp, Mus musculus
agtgcagtaagaaggaattagaaag

SEQ ID NO: 203617 - DNA, 25 bp, Mus musculus
agtgcagtaagaaggaggataaaat

SEQ ID NO: 203618 - DNA, 25 bp, Mus musculus
agtgcagtaagtctggagccaatta

SEQ ID NO: 203619 - DNA, 25 bp, Mus musculus
agtgcagtgaccagaacatcaaact

SEQ ID NO: 203620 - DNA, 25 bp, Mus musculus
agtgcagtgaccagggtgccacaac

SEQ ID NO: 203621 - DNA, 25 bp, Mus musculus
agtgcagtgactcagacatggaaac

SEQ ID NO: 203622 - DNA, 25 bp, Mus musculus
agtgcagtgactcagctattcgtct

SEQ ID NO: 203623 - DNA, 25 bp, Mus musculus
agtgcagtggcccagctgctgtcaa

SEQ ID NO: 203624 - DNA, 25 bp, Mus musculus
agtgcagttatatggtggtgacgta

SEQ ID NO: 203625 - DNA, 25 bp, Mus musculus
agtgcatcaaacaagttgatcaaga

SEQ ID NO: 203626 - DNA, 25 bp, Mus musculus
agtgcatcaaacagtatgaagaaga

SEQ ID NO: 203627 - DNA, 25 bp, Mus musculus
agtgcatcacacgatttgtgaaaac

SEQ ID NO: 203628 - DNA, 25 bp, Mus musculus
agtgcatcacacggctcattcacct

SEQ ID NO: 203629 - DNA, 25 bp, Mus musculus
agtgcatcattcaggtttttcctga

SEQ ID NO: 203630 - DNA, 25 bp, Mus musculus
agtgcatccatgcagtattcaagag

SEQ ID NO: 203631 - DNA, 25 bp, Mus musculus
agtgcatctggagaccaggttctct

SEQ ID NO: 203632 - DNA, 25 bp, Mus musculus
agtgcatctggcctcgaactcagaa

SEQ ID NO: 203633 - DNA, 25 bp, Mus musculus
agtgcatgagtttccagatccagag

SEQ ID NO: 203634 - DNA, 25 bp, Mus musculus
agtgcattagcctgccaccaccacc

SEQ ID NO: 203635 - DNA, 25 bp, Mus musculus
agtgcattgagaaagaagtcaacaa

SEQ ID NO: 203636 - DNA, 25 bp, Mus musculus
agtgcattgagagctgtctgtctag

SEQ ID NO: 203637 - DNA, 25 bp, Mus musculus
agtgcattgccaaggcgttcgtgcc

SEQ ID NO: 203638 - DNA, 25 bp, Mus musculus
agtgccaaaagaattcagaaggagc

SEQ ID NO: 203639 - DNA, 25 bp, Mus musculus
agtgccaaaagtgctggacccaaag

SEQ ID NO: 203640 - DNA, 25 bp, Mus musculus
agtgccaaaataatgacaccattct

SEQ ID NO: 203641 - DNA, 25 bp, Mus musculus
agtgccaaatggcccagcaaggacc

SEQ ID NO: 203642 - DNA, 25 bp, Mus musculus
agtgccaagaagggttgagattgag

SEQ ID NO: 203643 - DNA, 25 bp, Mus musculus
agtgccaatgaagaatctggtccag

SEQ ID NO: 203644 - DNA, 25 bp, Mus musculus
agtgccaatgaagaccctggtcttt

SEQ ID NO: 203645 - DNA, 25 bp, Mus musculus
agtgccacaaaggaacctacttggt

SEQ ID NO: 203646 - DNA, 25 bp, Mus musculus
agtgccacagctcctccctggccca

SEQ ID NO: 203647 - DNA, 25 bp, Mus musculus
agtgccacagtgaaaaaagcaacta

SEQ ID NO: 203648 - DNA, 25 bp, Mus musculus
agtgccacagtgaaggagcagatta

SEQ ID NO: 203649 - DNA, 25 bp, Mus musculus
agtgccacggaggatctagataaaa

SEQ ID NO: 203650 - DNA, 25 bp, Mus musculus
agtgccacggagtcggaccaggagg

SEQ ID NO: 203651 - DNA, 25 bp, Mus musculus
agtgccacggctgagttaagaatca

SEQ ID NO: 203652 - DNA, 25 bp, Mus musculus
agtgccagcacccaggccctgtcca

SEQ ID NO: 203653 - DNA, 25 bp, Mus musculus
agtgccagcagaagatgatgactat

SEQ ID NO: 203654 - DNA, 25 bp, Mus musculus
agtgccagcagaagattctactcaa

SEQ ID NO: 203655 - DNA, 25 bp, Mus musculus
agtgccagcccaggcctccagcccg

SEQ ID NO: 203656 - DNA, 25 bp, Mus musculus
agtgccagccggactcctccaccct

SEQ ID NO: 203657 - DNA, 25 bp, Mus musculus
agtgccagcgaatggctattcaagt

SEQ ID NO: 203658 - DNA, 25 bp, Mus musculus
agtgccagctgacagatggcgttga

SEQ ID NO: 203659 - DNA, 25 bp, Mus musculus
agtgccagggaggtgtgaatgaggc

SEQ ID NO: 203660 - DNA, 25 bp, Mus musculus
agtgccagtaaagcatatgggtgat

SEQ ID NO: 203661 - DNA, 25 bp, Mus musculus
agtgccatagaaggttaatggagtg

SEQ ID NO: 203662 - DNA, 25 bp, Mus musculus
agtgccattaggttttcttaaagaa

SEQ ID NO: 203663 - DNA, 25 bp, Mus musculus
agtgcccacagacaggtggtggctg

SEQ ID NO: 203664 - DNA, 25 bp, Mus musculus
agtgcccacccatcactcagcactc

SEQ ID NO: 203665 - DNA, 25 bp, Mus musculus
agtgcccacccgagtcattcgacgt

SEQ ID NO: 203666 - DNA, 25 bp, Mus musculus
agtgcccagctcacgagacagggca

SEQ ID NO: 203667 - DNA, 25 bp, Mus musculus
agtgcccccaccggatgcagaagag

SEQ ID NO: 203668 - DNA, 25 bp, Mus musculus
agtgcccccagagagctctcatggt

SEQ ID NO: 203669 - DNA, 25 bp, Mus musculus
agtgcccccaggcttccccccaatg

SEQ ID NO: 203670 - DNA, 25 bp, Mus musculus
agtgccccgggagagacggagattt

SEQ ID NO: 203671 - DNA, 25 bp, Mus musculus
agtgcccctcaggcggtgctataca

SEQ ID NO: 203672 - DNA, 25 bp, Mus musculus
agtgcccgcccaggttgtcttgaca

SEQ ID NO: 203673 - DNA, 25 bp, Mus musculus
agtgccctgctggacattcaggagc

SEQ ID NO: 203674 - DNA, 25 bp, Mus musculus
agtgccctgctggacctgttcagcc

SEQ ID NO: 203675 - DNA, 25 bp, Mus musculus
agtgccgaaagtggctatgcaatga

SEQ ID NO: 203676 - DNA, 25 bp, Mus musculus
agtgccgcacagtctggaataaaag

SEQ ID NO: 203677 - DNA, 25 bp, Mus musculus
agtgccgcatgcaggtggaccctca

SEQ ID NO: 203678 - DNA, 25 bp, Mus musculus
agtgccgcctacaggattcctgtct

SEQ ID NO: 203679 - DNA, 25 bp, Mus musculus
agtgccgcctacagtgcagggagac

SEQ ID NO: 203680 - DNA, 25 bp, Mus musculus
agtgccgctgcttgcaaggagaagt

SEQ ID NO: 203681 - DNA, 25 bp, Mus musculus
agtgccggtgctgtaagaggaaatc

SEQ ID NO: 203682 - DNA, 25 bp, Mus musculus
agtgccggtggtgtaagaggaaatc

SEQ ID NO: 203683 - DNA, 25 bp, Mus musculus
agtgccggttagggactgcatgaga

SEQ ID NO: 203684 - DNA, 25 bp, Mus musculus
agtgccggttaggggcgaatggacc

SEQ ID NO: 203685 - DNA, 25 bp, Mus musculus
agtgcctaccaggtgctgaggatca

SEQ ID NO: 203686 - DNA, 25 bp, Mus musculus
agtgcctaccaggtgtccgtaaatg

SEQ ID NO: 203687 - DNA, 25 bp, Mus musculus
agtgcctattgtgaggaactaatga

SEQ ID NO: 203688 - DNA, 25 bp, Mus musculus
agtgcctcagggcaccaccgtgggc

SEQ ID NO: 203689 - DNA, 25 bp, Mus musculus
agtgcctcagtgaagaaactgacgc

SEQ ID NO: 203690 - DNA, 25 bp, Mus musculus
agtgcctcagtgcttctacctggca

SEQ ID NO: 203691 - DNA, 25 bp, Mus musculus
agtgcctcagtggtggtgagctctt

SEQ ID NO: 203692 - DNA, 25 bp, Mus musculus
agtgcctcatcttttgctggaattt

SEQ ID NO: 203693 - DNA, 25 bp, Mus musculus
agtgcctcccacgtcagaaccgtta

SEQ ID NO: 203694 - DNA, 25 bp, Mus musculus
agtgcctctgactaggtctgcgaat

SEQ ID NO: 203695 - DNA, 25 bp, Mus musculus
agtgcctctgagaaggtctgcgaat

SEQ ID NO: 203696 - DNA, 25 bp, Mus musculus
agtgcctgacaccgatggcagactt

SEQ ID NO: 203697 - DNA, 25 bp, Mus musculus
agtgcctgagaggcgtccccattcc

SEQ ID NO: 203698 - DNA, 25 bp, Mus musculus
agtgcctgcaggatcggaacgtcaa

SEQ ID NO: 203699 - DNA, 25 bp, Mus musculus
agtgcctgccagctgagaagccatt

SEQ ID NO: 203700 - DNA, 25 bp, Mus musculus
agtgcctgccaggtgagaagccatt

SEQ ID NO: 203701 - DNA, 25 bp, Mus musculus
agtgccttaaaagaaaccatggaat

SEQ ID NO: 203702 - DNA, 25 bp, Mus musculus
agtgccttcagagtgatccaccttg

SEQ ID NO: 203703 - DNA, 25 bp, Mus musculus
agtgccttcaggtgccttggagcac

SEQ ID NO: 203704 - DNA, 25 bp, Mus musculus
agtgcctttgaggtcaatcttggaa

SEQ ID NO: 203705 - DNA, 25 bp, Mus musculus
agtgcgaaagagaacctgctcctcc

SEQ ID NO: 203706 - DNA, 25 bp, Mus musculus
agtgcgaaagagattacaggacagg

SEQ ID NO: 203707 - DNA, 25 bp, Mus musculus
agtgcgaccaacagaaaacaagcac

SEQ ID NO: 203708 - DNA, 25 bp, Mus musculus
agtgcgaccaacagattcctgttgc

SEQ ID NO: 203709 - DNA, 25 bp, Mus musculus
agtgcgactgaagcgaaggctgata

SEQ ID NO: 203710 - DNA, 25 bp, Mus musculus
agtgcgagcagatgagggcgctgtg

SEQ ID NO: 203711 - DNA, 25 bp, Mus musculus
agtgcgagccagcagctctgaactc

SEQ ID NO: 203712 - DNA, 25 bp, Mus musculus
agtgcgagcgggttgctgttctggc

SEQ ID NO: 203713 - DNA, 25 bp, Mus musculus
agtgcgcaaatgaagaagccggcat

SEQ ID NO: 203714 - DNA, 25 bp, Mus musculus
agtgcgcaaatgggagaagaaatgg

SEQ ID NO: 203715 - DNA, 25 bp, Mus musculus
agtgcgcacgccggaccctgagccg

SEQ ID NO: 203716 - DNA, 25 bp, Mus musculus
agtgcgcccgggagaaggaactcag

SEQ ID NO: 203717 - DNA, 25 bp, Mus musculus
agtgcgcctccgccggtgagctcct

SEQ ID NO: 203718 - DNA, 25 bp, Mus musculus
agtgcgcgacaggctgtttggtctc

SEQ ID NO: 203719 - DNA, 25 bp, Mus musculus
agtgcgcgacaggttctggatggtg

SEQ ID NO: 203720 - DNA, 25 bp, Mus musculus
agtgcgcggccgaggtacaatgtca

SEQ ID NO: 203721 - DNA, 25 bp, Mus musculus
agtgcgcgggtggtgtaagaataaa

SEQ ID NO: 203722 - DNA, 25 bp, Mus musculus
agtgcgcttcattcaagtgcgcaaa

SEQ ID NO: 203723 - DNA, 25 bp, Mus musculus
agtgcgcttcattcaatttgatcaa

SEQ ID NO: 203724 - DNA, 25 bp, Mus musculus
agtgcggaaatgggagaagaaatgg

SEQ ID NO: 203725 - DNA, 25 bp, Mus musculus
agtgcggaactaaagcaaatggtta

SEQ ID NO: 203726 - DNA, 25 bp, Mus musculus
agtgcggacacccggcctggccatg

SEQ ID NO: 203727 - DNA, 25 bp, Mus musculus
agtgcggacctaaataacgagcctt

SEQ ID NO: 203728 - DNA, 25 bp, Mus musculus
agtgcggaccttcactacttcgatg

SEQ ID NO: 203729 - DNA, 25 bp, Mus musculus
agtgcggacgggaatctggtcggct

SEQ ID NO: 203730 - DNA, 25 bp, Mus musculus
agtgcggagggcgggggcagagatc

SEQ ID NO: 203731 - DNA, 25 bp, Mus musculus
agtgcggagggggccccccagaagg

SEQ ID NO: 203732 - DNA, 25 bp, Mus musculus
agtgcggcagccgtggtcatagtca

SEQ ID NO: 203733 - DNA, 25 bp, Mus musculus
agtgcggccggatgagattatgcgg

SEQ ID NO: 203734 - DNA, 25 bp, Mus musculus
agtgcggccggatgccactacgaag

SEQ ID NO: 203735 - DNA, 25 bp, Mus musculus
agtgcggcggtcaaggccctcagcc

SEQ ID NO: 203736 - DNA, 25 bp, Mus musculus
agtgcggcggtcaaggtcacggtct

SEQ ID NO: 203737 - DNA, 25 bp, Mus musculus
agtgcggtactgaaggattctccag

SEQ ID NO: 203738 - DNA, 25 bp, Mus musculus
agtgcggtccaggagattgtgcctt

SEQ ID NO: 203739 - DNA, 25 bp, Mus musculus
agtgcgtacagaagaactcctggcc

SEQ ID NO: 203740 - DNA, 25 bp, Mus musculus
agtgcgtacagagaacttaccgatc

SEQ ID NO: 203741 - DNA, 25 bp, Mus musculus
agtgcgtccagtatcagcatgtgtt

SEQ ID NO: 203742 - DNA, 25 bp, Mus musculus
agtgcgtggaagagtccccaagagc

SEQ ID NO: 203743 - DNA, 25 bp, Mus musculus
agtgcgttatcagagtgaagccata

SEQ ID NO: 203744 - DNA, 25 bp, Mus musculus
agtgcgttatcgagcctactagttc

SEQ ID NO: 203745 - DNA, 25 bp, Mus musculus
agtgcgttatcgaggaaagcatgtg

SEQ ID NO: 203746 - DNA, 25 bp, Mus musculus
agtgcgttatcgaggtaatatatat

SEQ ID NO: 203747 - DNA, 25 bp, Mus musculus
agtgctaatctaggtcttgccgtgg

SEQ ID NO: 203748 - DNA, 25 bp, Mus musculus
agtgctacaccccctcacgcctcac

SEQ ID NO: 203749 - DNA, 25 bp, Mus musculus
agtgctacaggcactcttcaacctc

SEQ ID NO: 203750 - DNA, 25 bp, Mus musculus
agtgctacaggttctcacgcggttt

SEQ ID NO: 203751 - DNA, 25 bp, Mus musculus
agtgctacaggttctgctgactttg

SEQ ID NO: 203752 - DNA, 25 bp, Mus musculus
agtgctacatcggaggaaatgaggc

SEQ ID NO: 203753 - DNA, 25 bp, Mus musculus
agtgctatggagtgcctttctttct

SEQ ID NO: 203754 - DNA, 25 bp, Mus musculus
agtgctcaactggctgttggaaagc

SEQ ID NO: 203755 - DNA, 25 bp, Mus musculus
agtgctcaccaagagctttgtaaat

SEQ ID NO: 203756 - DNA, 25 bp, Mus musculus
agtgctcagaagtttgcagggacat

SEQ ID NO: 203757 - DNA, 25 bp, Mus musculus
agtgctcagcaggtttgggaaaaat

SEQ ID NO: 203758 - DNA, 25 bp, Mus musculus
agtgctcaggaatgcaacttctcgg

SEQ ID NO: 203759 - DNA, 25 bp, Mus musculus
agtgctcagggtttaagtcttgaac

SEQ ID NO: 203760 - DNA, 25 bp, Mus musculus
agtgctcataggaattcactgtgaa

SEQ ID NO: 203761 - DNA, 25 bp, Mus musculus
agtgctcatccagctcagcacattg

SEQ ID NO: 203762 - DNA, 25 bp, Mus musculus
agtgctcatccaggaacaacttcca

SEQ ID NO: 203763 - DNA, 25 bp, Mus musculus
agtgctcatccaggtgggatatgag

SEQ ID NO: 203764 - DNA, 25 bp, Mus musculus
agtgctccaaggatcgtggagttga

SEQ ID NO: 203765 - DNA, 25 bp, Mus musculus
agtgctccagtatgcagattaagaa

SEQ ID NO: 203766 - DNA, 25 bp, Mus musculus
agtgctcccaaagcattagcagaga

SEQ ID NO: 203767 - DNA, 25 bp, Mus musculus
agtgctcccaggggtgatctgcttt

SEQ ID NO: 203768 - DNA, 25 bp, Mus musculus
agtgctccccaaagaccctctatgg

SEQ ID NO: 203769 - DNA, 25 bp, Mus musculus
agtgctcctaaccgcgttggctctc

SEQ ID NO: 203770 - DNA, 25 bp, Mus musculus
agtgctcctctagaggctgtggggt

SEQ ID NO: 203771 - DNA, 25 bp, Mus musculus
agtgctctactcgtcctcttccact

SEQ ID NO: 203772 - DNA, 25 bp, Mus musculus
agtgctctagccgagatgtggtgac

SEQ ID NO: 203773 - DNA, 25 bp, Mus musculus
agtgctctagccgaggccatgtgga

SEQ ID NO: 203774 - DNA, 25 bp, Mus musculus
agtgctctccagcaggttacagtac

SEQ ID NO: 203775 - DNA, 25 bp, Mus musculus
agtgctctggtcctccttgtcctcc

SEQ ID NO: 203776 - DNA, 25 bp, Mus musculus
agtgctctgttgcatatgacatgga

SEQ ID NO: 203777 - DNA, 25 bp, Mus musculus
agtgctctgttgcgctgacccctgc

SEQ ID NO: 203778 - DNA, 25 bp, Mus musculus
agtgctcttcagaatgtgaagagac

SEQ ID NO: 203779 - DNA, 25 bp, Mus musculus
agtgctctttggcagatcagtaatg

SEQ ID NO: 203780 - DNA, 25 bp, Mus musculus
agtgctgaagaggaagagcagaagg

SEQ ID NO: 203781 - DNA, 25 bp, Mus musculus
agtgctgaagatgatcaaaaagccg

SEQ ID NO: 203782 - DNA, 25 bp, Mus musculus
agtgctgaagatgtttccacagtgc

SEQ ID NO: 203783 - DNA, 25 bp, Mus musculus
agtgctgaagccgagagaaatgtct

SEQ ID NO: 203784 - DNA, 25 bp, Mus musculus
agtgctgaagccgggaggggctttt

SEQ ID NO: 203785 - DNA, 25 bp, Mus musculus
agtgctgaagccgtaagggttggag

SEQ ID NO: 203786 - DNA, 25 bp, Mus musculus
agtgctgaaggcagggaagcggcct

SEQ ID NO: 203787 - DNA, 25 bp, Mus musculus
agtgctgaatggggctttcccgctc

SEQ ID NO: 203788 - DNA, 25 bp, Mus musculus
agtgctgaccgttgaatcttttgag

SEQ ID NO: 203789 - DNA, 25 bp, Mus musculus
agtgctgagcagtaacttgaatccc

SEQ ID NO: 203790 - DNA, 25 bp, Mus musculus
agtgctgataggatccacgcacatt

SEQ ID NO: 203791 - DNA, 25 bp, Mus musculus
agtgctgatccctagagatgtcttc

SEQ ID NO: 203792 - DNA, 25 bp, Mus musculus
agtgctgatccctaggtcagacggg

SEQ ID NO: 203793 - DNA, 25 bp, Mus musculus
agtgctgatgatcaggaccagtgtc

SEQ ID NO: 203794 - DNA, 25 bp, Mus musculus
agtgctgatggagtttgtggaaaac

SEQ ID NO: 203795 - DNA, 25 bp, Mus musculus
agtgctgcacaatgccttaggattc

SEQ ID NO: 203796 - DNA, 25 bp, Mus musculus
agtgctgcaggaggctactttttgt

SEQ ID NO: 203797 - DNA, 25 bp, Mus musculus
agtgctgcctgagccctaggaccat

SEQ ID NO: 203798 - DNA, 25 bp, Mus musculus
agtgctgcctgaggtagtgactgtg

SEQ ID NO: 203799 - DNA, 25 bp, Mus musculus
agtgctgcgacaaggcccttggact

SEQ ID NO: 203800 - DNA, 25 bp, Mus musculus
agtgctgcgtccctctggggctgtg

SEQ ID NO: 203801 - DNA, 25 bp, Mus musculus
agtgctgctgaagaggcagaggagt

SEQ ID NO: 203802 - DNA, 25 bp, Mus musculus
agtgctggacaggccggggcccgcc

SEQ ID NO: 203803 - DNA, 25 bp, Mus musculus
agtgctgggagccgacagggagttc

SEQ ID NO: 203804 - DNA, 25 bp, Mus musculus
agtgctgggagcctcttagctgctt

SEQ ID NO: 203805 - DNA, 25 bp, Mus musculus
agtgctgggatggggaacatgacat

SEQ ID NO: 203806 - DNA, 25 bp, Mus musculus
agtgctgtatccacgagaggcacgc

SEQ ID NO: 203807 - DNA, 25 bp, Mus musculus
agtgctgtgacccaggagctgcctt

SEQ ID NO: 203808 - DNA, 25 bp, Mus musculus
agtgctgttcagggtgactcatatt

SEQ ID NO: 203809 - DNA, 25 bp, Mus musculus
agtgctgttttgatgattccaagag

SEQ ID NO: 203810 - DNA, 25 bp, Mus musculus
agtgcttagtgtggatctgttaaga

SEQ ID NO: 203811 - DNA, 25 bp, Mus musculus
agtgcttatcatcagcaacagcaac

SEQ ID NO: 203812 - DNA, 25 bp, Mus musculus
agtgcttattatgctggataataag

SEQ ID NO: 203813 - DNA, 25 bp, Mus musculus
agtgcttccaaagcacaggctggct

SEQ ID NO: 203814 - DNA, 25 bp, Mus musculus
agtgcttccaaagccaggtgtcaga

SEQ ID NO: 203815 - DNA, 25 bp, Mus musculus
agtgcttcctcgagaagccaacaga

SEQ ID NO: 203816 - DNA, 25 bp, Mus musculus
agtgcttcctcgatgagatcgtggg

SEQ ID NO: 203817 - DNA, 25 bp, Mus musculus
agtgcttctgtgaaagaattgaata

SEQ ID NO: 203818 - DNA, 25 bp, Mus musculus
agtgcttggcgcgaaaaggtggaca

SEQ ID NO: 203819 - DNA, 25 bp, Mus musculus
agtgcttggcgcgatatgctaatga

SEQ ID NO: 203820 - DNA, 25 bp, Mus musculus
agtgcttggcgcggtgaaggcgata

SEQ ID NO: 203821 - DNA, 25 bp, Mus musculus
agtgcttgttcaggtgtcctatgcc

SEQ ID NO: 203822 - DNA, 25 bp, Mus musculus
agtgctttccggaagattcatcgca

SEQ ID NO: 203823 - DNA, 25 bp, Mus musculus
agtgctttggagaagaaccatcagt

SEQ ID NO: 203824 - DNA, 25 bp, Mus musculus
agtgctttggagaaggagcttcagt

SEQ ID NO: 203825 - DNA, 25 bp, Mus musculus
agtggaaaagaaccaaagaattcca

SEQ ID NO: 203826 - DNA, 25 bp, Mus musculus
agtggaaacctttccatattgtatt

SEQ ID NO: 203827 - DNA, 25 bp, Mus musculus
agtggaaactttgatctgctgttgt

SEQ ID NO: 203828 - DNA, 25 bp, Mus musculus
agtggaaactttgatgaaacttttt

SEQ ID NO: 203829 - DNA, 25 bp, Mus musculus
agtggaaagcgtgactccagaacac

SEQ ID NO: 203830 - DNA, 25 bp, Mus musculus
agtggaaaggcaggtgtccacagcc

SEQ ID NO: 203831 - DNA, 25 bp, Mus musculus
agtggaacactgactgtcacagtgg

SEQ ID NO: 203832 - DNA, 25 bp, Mus musculus
agtggaacagatcgctgtagtgcct

SEQ ID NO: 203833 - DNA, 25 bp, Mus musculus
agtggaacaggaatatgtggcatca

SEQ ID NO: 203834 - DNA, 25 bp, Mus musculus
agtggaacattcttctgccttggct

SEQ ID NO: 203835 - DNA, 25 bp, Mus musculus
agtggaacgcagggatgccctgctg

SEQ ID NO: 203836 - DNA, 25 bp, Mus musculus
agtggaacgggcagtgtggtgagca

SEQ ID NO: 203837 - DNA, 25 bp, Mus musculus
agtggaactacaggtgaccccaaag

SEQ ID NO: 203838 - DNA, 25 bp, Mus musculus
agtggaagaaagcacattgtagtct

SEQ ID NO: 203839 - DNA, 25 bp, Mus musculus
agtggaagacagagaatttcatctt

SEQ ID NO: 203840 - DNA, 25 bp, Mus musculus
agtggaagacagagttcctctgcta

SEQ ID NO: 203841 - DNA, 25 bp, Mus musculus
agtggaagagcggagactactggat

SEQ ID NO: 203842 - DNA, 25 bp, Mus musculus
agtggaagaggaggaaactttggtt

SEQ ID NO: 203843 - DNA, 25 bp, Mus musculus
agtggaagaggaggaactatggtcc

SEQ ID NO: 203844 - DNA, 25 bp, Mus musculus
agtggaagaggaggaccatatggtg

SEQ ID NO: 203845 - DNA, 25 bp, Mus musculus
agtggaagcagagtcggagcagaag

SEQ ID NO: 203846 - DNA, 25 bp, Mus musculus
agtggaagccagctttttgatcacg

SEQ ID NO: 203847 - DNA, 25 bp, Mus musculus
agtggaagcgaaggcaaacttaaac

SEQ ID NO: 203848 - DNA, 25 bp, Mus musculus
agtggaagctaaaagagcatgaagg

SEQ ID NO: 203849 - DNA, 25 bp, Mus musculus
agtggaaggggttccatgatggagt

SEQ ID NO: 203850 - DNA, 25 bp, Mus musculus
agtggaataagagctcagtaagttc

SEQ ID NO: 203851 - DNA, 25 bp, Mus musculus
agtggaatctcaaaaaggttactgc

SEQ ID NO: 203852 - DNA, 25 bp, Mus musculus
agtggaatgggatgagaaagatgaa

SEQ ID NO: 203853 - DNA, 25 bp, Mus musculus
agtggaatggggatggcactggatc

SEQ ID NO: 203854 - DNA, 25 bp, Mus musculus
agtggaatggggcctagccgcccgc

SEQ ID NO: 203855 - DNA, 25 bp, Mus musculus
agtggaatgtcaagatgaagatgaa

SEQ ID NO: 203856 - DNA, 25 bp, Mus musculus
agtggaatgtcaagatgttaacgaa

SEQ ID NO: 203857 - DNA, 25 bp, Mus musculus
agtggaattatagccacaatcacaa

SEQ ID NO: 203858 - DNA, 25 bp, Mus musculus
agtggacaaagatgagtggataagt

SEQ ID NO: 203859 - DNA, 25 bp, Mus musculus
agtggacaatcatggctgtcatggt

SEQ ID NO: 203860 - DNA, 25 bp, Mus musculus
agtggacagaagatttcctctgaga

SEQ ID NO: 203861 - DNA, 25 bp, Mus musculus
agtggacaggccaaagcttcctgaa

SEQ ID NO: 203862 - DNA, 25 bp, Mus musculus
agtggacatgaagctgtttgtatgg

SEQ ID NO: 203863 - DNA, 25 bp, Mus musculus
agtggacatgaaggtgcctcagcca

SEQ ID NO: 203864 - DNA, 25 bp, Mus musculus
agtggaccacagtcaccgagagtga

SEQ ID NO: 203865 - DNA, 25 bp, Mus musculus
agtggaccacattaggactctgttg

SEQ ID NO: 203866 - DNA, 25 bp, Mus musculus
agtggaccacattaggatctgaagt

SEQ ID NO: 203867 - DNA, 25 bp, Mus musculus
agtggaccagaggatatctgggcgg

SEQ ID NO: 203868 - DNA, 25 bp, Mus musculus
agtggaccagcagcagcagcagcca

SEQ ID NO: 203869 - DNA, 25 bp, Mus musculus
agtggaccaggactaccttattgcc

SEQ ID NO: 203870 - DNA, 25 bp, Mus musculus
agtggaccatcaaacagacctttgg

SEQ ID NO: 203871 - DNA, 25 bp, Mus musculus
agtggacccagaggagacttgtgca

SEQ ID NO: 203872 - DNA, 25 bp, Mus musculus
agtggacccagccccgggaacaccg

SEQ ID NO: 203873 - DNA, 25 bp, Mus musculus
agtggacccagggctgttgggagaa

SEQ ID NO: 203874 - DNA, 25 bp, Mus musculus
agtggaccccaaaggccatgaagaa

SEQ ID NO: 203875 - DNA, 25 bp, Mus musculus
agtggaccctcagattgatgacatt

SEQ ID NO: 203876 - DNA, 25 bp, Mus musculus
agtggacgcgaggtacaacgcctac

SEQ ID NO: 203877 - DNA, 25 bp, Mus musculus
agtggacgcgagtttcggacccagt

SEQ ID NO: 203878 - DNA, 25 bp, Mus musculus
agtggacgctcaggggaggggcgac

SEQ ID NO: 203879 - DNA, 25 bp, Mus musculus
agtggacttgatccctgctgtctga

SEQ ID NO: 203880 - DNA, 25 bp, Mus musculus
agtggactttctcagatcgtttagg

SEQ ID NO: 203881 - DNA, 25 bp, Mus musculus
agtggactttctcaggagtctcatg

SEQ ID NO: 203882 - DNA, 25 bp, Mus musculus
agtggagaaaaacgaaaatcttcaa

SEQ ID NO: 203883 - DNA, 25 bp, Mus musculus
agtggagaaaagagaatattttcca

SEQ ID NO: 203884 - DNA, 25 bp, Mus musculus
agtggagaaaagaggaatattagtt

SEQ ID NO: 203885 - DNA, 25 bp, Mus musculus
agtggagaaaggtttccttctctta

SEQ ID NO: 203886 - DNA, 25 bp, Mus musculus
agtggagaagagatgctggtccctt

SEQ ID NO: 203887 - DNA, 25 bp, Mus musculus
agtggagaagaggatgcccctgtgg

SEQ ID NO: 203888 - DNA, 25 bp, Mus musculus
agtggagaagatctcttcactggtc

SEQ ID NO: 203889 - DNA, 25 bp, Mus musculus
agtggagaagtatattggattttct

SEQ ID NO: 203890 - DNA, 25 bp, Mus musculus
agtggagaataagcgtgaagtgcag

SEQ ID NO: 203891 - DNA, 25 bp, Mus musculus
agtggagaataagtggtacagggta

SEQ ID NO: 203892 - DNA, 25 bp, Mus musculus
agtggagaatgaagatgctgggttt

SEQ ID NO: 203893 - DNA, 25 bp, Mus musculus
agtggagactgagcaaatcggccaa

SEQ ID NO: 203894 - DNA, 25 bp, Mus musculus
agtggagactggtcttgctttgtgc

SEQ ID NO: 203895 - DNA, 25 bp, Mus musculus
agtggagagcgtgaaagagtttcta

SEQ ID NO: 203896 - DNA, 25 bp, Mus musculus
agtggagaggagctctcctatgtgg

SEQ ID NO: 203897 - DNA, 25 bp, Mus musculus
agtggagagggaccttcttcacctg

SEQ ID NO: 203898 - DNA, 25 bp, Mus musculus
agtggagataccaggcacaatcact

SEQ ID NO: 203899 - DNA, 25 bp, Mus musculus
agtggagcagcttacagatgtcctt

SEQ ID NO: 203900 - DNA, 25 bp, Mus musculus
agtggagcgtggagaccatcttcaa

SEQ ID NO: 203901 - DNA, 25 bp, Mus musculus
agtggagctggacctcggcctagcc

SEQ ID NO: 203902 - DNA, 25 bp, Mus musculus
agtggagctggagggctaaaaccga

SEQ ID NO: 203903 - DNA, 25 bp, Mus musculus
agtggagctggtctgggactgtgcc

SEQ ID NO: 203904 - DNA, 25 bp, Mus musculus
agtggaggaagcacctcccactaat

SEQ ID NO: 203905 - DNA, 25 bp, Mus musculus
agtggaggaagctcatctacggacc

SEQ ID NO: 203906 - DNA, 25 bp, Mus musculus
agtggaggagcagtgccctcagcca

SEQ ID NO: 203907 - DNA, 25 bp, Mus musculus
agtggaggaggacttggtgaaatgt

SEQ ID NO: 203908 - DNA, 25 bp, Mus musculus
agtggaggcaaatatctgaaagatt

SEQ ID NO: 203909 - DNA, 25 bp, Mus musculus
agtggaggcaagatgcctttgcggg

SEQ ID NO: 203910 - DNA, 25 bp, Mus musculus
agtggaggcaaggaagacatacatg

SEQ ID NO: 203911 - DNA, 25 bp, Mus musculus
agtggaggcgccactgcccacactt

SEQ ID NO: 203912 - DNA, 25 bp, Mus musculus
agtggagggccctgtctgtactgta

SEQ ID NO: 203913 - DNA, 25 bp, Mus musculus
agtggagggtgccaaaaaggccaac

SEQ ID NO: 203914 - DNA, 25 bp, Mus musculus
agtggaggtgaaggccaatacatat

SEQ ID NO: 203915 - DNA, 25 bp, Mus musculus
agtggagtccacgtacaagtatgaa

SEQ ID NO: 203916 - DNA, 25 bp, Mus musculus
agtggagtccgtcacgctggcggtg

SEQ ID NO: 203917 - DNA, 25 bp, Mus musculus
agtggagtggggacggcagcggctc

SEQ ID NO: 203918 - DNA, 25 bp, Mus musculus
agtggataaatagatgcccgtgtgg

SEQ ID NO: 203919 - DNA, 25 bp, Mus musculus
agtggatcaggcactggcccagttc

SEQ ID NO: 203920 - DNA, 25 bp, Mus musculus
agtggatcaggtactggcccttggg

SEQ ID NO: 203921 - DNA, 25 bp, Mus musculus
agtggatccagatctcggacgctgt

SEQ ID NO: 203922 - DNA, 25 bp, Mus musculus
agtggatccctgctgacaaggacac

SEQ ID NO: 203923 - DNA, 25 bp, Mus musculus
agtggatcgcggggtcccagctcct

SEQ ID NO: 203924 - DNA, 25 bp, Mus musculus
agtggatctctcagcaccatatcct

SEQ ID NO: 203925 - DNA, 25 bp, Mus musculus
agtggatgatcaaaaccaggggctg

SEQ ID NO: 203926 - DNA, 25 bp, Mus musculus
agtggatgcagctgccatcaaactt

SEQ ID NO: 203927 - DNA, 25 bp, Mus musculus
agtggatgctgatggcaatggcacc

SEQ ID NO: 203928 - DNA, 25 bp, Mus musculus
agtggatgttcaattggcttcgtga

SEQ ID NO: 203929 - DNA, 25 bp, Mus musculus
agtggattcatgactcaggcccaca

SEQ ID NO: 203930 - DNA, 25 bp, Mus musculus
agtggattctgaccacctcatcctc

SEQ ID NO: 203931 - DNA, 25 bp, Mus musculus
agtggcaaaccgggaataattctcc

SEQ ID NO: 203932 - DNA, 25 bp, Mus musculus
agtggcaaatgtgagaatgaaactt

SEQ ID NO: 203933 - DNA, 25 bp, Mus musculus
agtggcaaatgtgagttgtctgttg

SEQ ID NO: 203934 - DNA, 25 bp, Mus musculus
agtggcaagagagatctccagtcct

SEQ ID NO: 203935 - DNA, 25 bp, Mus musculus
agtggcaaggacagtctcatgcttg

SEQ ID NO: 203936 - DNA, 25 bp, Mus musculus
agtggcaattcaggttcattttgct

SEQ ID NO: 203937 - DNA, 25 bp, Mus musculus
agtggcaattcaggttcccaggtgg

SEQ ID NO: 203938 - DNA, 25 bp, Mus musculus
agtggcaattcaggttctcttgcca

SEQ ID NO: 203939 - DNA, 25 bp, Mus musculus
agtggcacagatgccctaggtctag

SEQ ID NO: 203940 - DNA, 25 bp, Mus musculus
agtggcacaggtctccaccgctatg

SEQ ID NO: 203941 - DNA, 25 bp, Mus musculus
agtggcaccagtgggaggtctggac

SEQ ID NO: 203942 - DNA, 25 bp, Mus musculus
agtggcaccggtttacatctcggaa

SEQ ID NO: 203943 - DNA, 25 bp, Mus musculus
agtggcaccttcagaggcagagaga

SEQ ID NO: 203944 - DNA, 25 bp, Mus musculus
agtggcaccttcagctacatcaggt

SEQ ID NO: 203945 - DNA, 25 bp, Mus musculus
agtggcactgtcctcccagtggcac

SEQ ID NO: 203946 - DNA, 25 bp, Mus musculus
agtggcagaaagcagtgagtacggc

SEQ ID NO: 203947 - DNA, 25 bp, Mus musculus
agtggcagaagactcagaggcctgg

SEQ ID NO: 203948 - DNA, 25 bp, Mus musculus
agtggcagagaagggcaaacattgt

SEQ ID NO: 203949 - DNA, 25 bp, Mus musculus
agtggcagcaccgggctaaagaagc

SEQ ID NO: 203950 - DNA, 25 bp, Mus musculus
agtggcagcgaagatcacaaggttt

SEQ ID NO: 203951 - DNA, 25 bp, Mus musculus
agtggcagcgaaggcctccttgaac

SEQ ID NO: 203952 - DNA, 25 bp, Mus musculus
agtggcaggagaaacccaagcctgc

SEQ ID NO: 203953 - DNA, 25 bp, Mus musculus
agtggcaggagaagcgtagaccctt

SEQ ID NO: 203954 - DNA, 25 bp, Mus musculus
agtggcaggagccctggcctgagag

SEQ ID NO: 203955 - DNA, 25 bp, Mus musculus
agtggcaggaggcctatgtgaacca

SEQ ID NO: 203956 - DNA, 25 bp, Mus musculus
agtggcaggaggtccggagttcaaa

SEQ ID NO: 203957 - DNA, 25 bp, Mus musculus
agtggcatgaaaaggcccttgctgc

SEQ ID NO: 203958 - DNA, 25 bp, Mus musculus
agtggcatgtgggcatcatcgcaga

SEQ ID NO: 203959 - DNA, 25 bp, Mus musculus
agtggcatgtggttcttcccgaaaa

SEQ ID NO: 203960 - DNA, 25 bp, Mus musculus
agtggcatgttcccaaatagctttc

SEQ ID NO: 203961 - DNA, 25 bp, Mus musculus
agtggcatttctgatgggcagcccc

SEQ ID NO: 203962 - DNA, 25 bp, Mus musculus
agtggcatttctgtggctaacttcg

SEQ ID NO: 203963 - DNA, 25 bp, Mus musculus
agtggccaagctgaacatccagagt

SEQ ID NO: 203964 - DNA, 25 bp, Mus musculus
agtggccaggtattgagacaatgat

SEQ ID NO: 203965 - DNA, 25 bp, Mus musculus
agtggcccagctgctgtcaacaaca

SEQ ID NO: 203966 - DNA, 25 bp, Mus musculus
agtggccccgaggtctcagatctga

SEQ ID NO: 203967 - DNA, 25 bp, Mus musculus
agtggccccgagtgccagttgccag

SEQ ID NO: 203968 - DNA, 25 bp, Mus musculus
agtggccctggcagagaacacagca

SEQ ID NO: 203969 - DNA, 25 bp, Mus musculus
agtggccctgtcctgccatcatgaa

SEQ ID NO: 203970 - DNA, 25 bp, Mus musculus
agtggccgaggaggtccagattatc

SEQ ID NO: 203971 - DNA, 25 bp, Mus musculus
agtggccgttgttggagccactggc

SEQ ID NO: 203972 - DNA, 25 bp, Mus musculus
agtggcctacagggctggctgtgga

SEQ ID NO: 203973 - DNA, 25 bp, Mus musculus
agtggcctcagataatgatttttcc

SEQ ID NO: 203974 - DNA, 25 bp, Mus musculus
agtggcctcaggtgcgttcattcct

SEQ ID NO: 203975 - DNA, 25 bp, Mus musculus
agtggcctcgcatggtcatggtcac

SEQ ID NO: 203976 - DNA, 25 bp, Mus musculus
agtggcctcggtgattgaagtgagt

SEQ ID NO: 203977 - DNA, 25 bp, Mus musculus
agtggcctcttcacaattacgctcg

SEQ ID NO: 203978 - DNA, 25 bp, Mus musculus
agtggccttgaacaggacaggccga

SEQ ID NO: 203979 - DNA, 25 bp, Mus musculus
agtggcgaaggcgaatctggttttg

SEQ ID NO: 203980 - DNA, 25 bp, Mus musculus
agtggcgaaggtcttccatgtttgt

SEQ ID NO: 203981 - DNA, 25 bp, Mus musculus
agtggcgagaccggggcatggaaca

SEQ ID NO: 203982 - DNA, 25 bp, Mus musculus
agtggcgcagatgggatacagattt

SEQ ID NO: 203983 - DNA, 25 bp, Mus musculus
agtggcgcagatggtcaccctgctg

SEQ ID NO: 203984 - DNA, 25 bp, Mus musculus
agtggcgcaggatggcgcagaagaa

SEQ ID NO: 203985 - DNA, 25 bp, Mus musculus
agtggcgcagttttactttcaagga

SEQ ID NO: 203986 - DNA, 25 bp, Mus musculus
agtggcggagcaggggaagagacac

SEQ ID NO: 203987 - DNA, 25 bp, Mus musculus
agtggctcaagaccctgaaggctat

SEQ ID NO: 203988 - DNA, 25 bp, Mus musculus
agtggctcaaggctatcgaggaggg

SEQ ID NO: 203989 - DNA, 25 bp, Mus musculus
agtggctcacttgggtgctggtctc

SEQ ID NO: 203990 - DNA, 25 bp, Mus musculus
agtggctcagctctgccatttcctc

SEQ ID NO: 203991 - DNA, 25 bp, Mus musculus
agtggctccggacagaccatggcaa

SEQ ID NO: 203992 - DNA, 25 bp, Mus musculus
agtggctccggacaggatgcatttg

SEQ ID NO: 203993 - DNA, 25 bp, Mus musculus
agtggctccggacagtttcctttta

SEQ ID NO: 203994 - DNA, 25 bp, Mus musculus
agtggctcctggcactttgaattgc

SEQ ID NO: 203995 - DNA, 25 bp, Mus musculus
agtggctctggcatgctgagccggc

SEQ ID NO: 203996 - DNA, 25 bp, Mus musculus
agtggctgcaaaaacttgagaatta

SEQ ID NO: 203997 - DNA, 25 bp, Mus musculus
agtggctgcaaaaaggtcctggtct

SEQ ID NO: 203998 - DNA, 25 bp, Mus musculus
agtggctgcagagaatgatgtcact

SEQ ID NO: 203999 - DNA, 25 bp, Mus musculus
agtggctgcggctgttaagaagaaa

SEQ ID NO: 204000 - DNA, 25 bp, Mus musculus
agtggctgcgggtattcccaggttg

SEQ ID NO: 204001 - DNA, 25 bp, Mus musculus
agtggctgtatggcgatgagaatga

SEQ ID NO: 204002 - DNA, 25 bp, Mus musculus
agtggctgtatggcggcccgtggga

SEQ ID NO: 204003 - DNA, 25 bp, Mus musculus
agtggcttacagtggaatgggcctg

SEQ ID NO: 204004 - DNA, 25 bp, Mus musculus
agtggcttacagtgggaagacatgg

SEQ ID NO: 204005 - DNA, 25 bp, Mus musculus
agtggcttccctgagctgggaacac

SEQ ID NO: 204006 - DNA, 25 bp, Mus musculus
agtggcttccggaaggaactggtga

SEQ ID NO: 204007 - DNA, 25 bp, Mus musculus
agtggcttccggaaggcctctggat

SEQ ID NO: 204008 - DNA, 25 bp, Mus musculus
agtgggaaagggagtcatgtggctg

SEQ ID NO: 204009 - DNA, 25 bp, Mus musculus
agtgggaacgcagagcagtgggaag

SEQ ID NO: 204010 - DNA, 25 bp, Mus musculus
agtgggaagcaaaggctcaagtcat

SEQ ID NO: 204011 - DNA, 25 bp, Mus musculus
agtgggaagttggtacagagcatca

SEQ ID NO: 204012 - DNA, 25 bp, Mus musculus
agtgggacaagatgcagcaccgagg

SEQ ID NO: 204013 - DNA, 25 bp, Mus musculus
agtgggacagaacggttgatttagg

SEQ ID NO: 204014 - DNA, 25 bp, Mus musculus
agtgggacaggagaacgagaagaac

SEQ ID NO: 204015 - DNA, 25 bp, Mus musculus
agtgggaccaagaacacggtacaac

SEQ ID NO: 204016 - DNA, 25 bp, Mus musculus
agtgggacccagcatgctggcgact

SEQ ID NO: 204017 - DNA, 25 bp, Mus musculus
agtgggacctcaggctgactgctgt

SEQ ID NO: 204018 - DNA, 25 bp, Mus musculus
agtgggagaaagtgagagcaccact

SEQ ID NO: 204019 - DNA, 25 bp, Mus musculus
agtgggagaaggtgcagcagctggt

SEQ ID NO: 204020 - DNA, 25 bp, Mus musculus
agtgggagcactggctcacccatga

SEQ ID NO: 204021 - DNA, 25 bp, Mus musculus
agtgggaggaggaatttgacaagat

SEQ ID NO: 204022 - DNA, 25 bp, Mus musculus
agtgggagtgcagattgaaaaatgc

SEQ ID NO: 204023 - DNA, 25 bp, Mus musculus
agtgggatggagctcctggtgaaca

SEQ ID NO: 204024 - DNA, 25 bp, Mus musculus
agtgggcacaagacagacaaggaac

SEQ ID NO: 204025 - DNA, 25 bp, Mus musculus
agtgggcacaagagtcagctctggt

SEQ ID NO: 204026 - DNA, 25 bp, Mus musculus
agtgggcagatgcacatgcagaaca

SEQ ID NO: 204027 - DNA, 25 bp, Mus musculus
agtgggcaggcacccagcggaacac

SEQ ID NO: 204028 - DNA, 25 bp, Mus musculus
agtgggcagggtgaagtgtgtccga

SEQ ID NO: 204029 - DNA, 25 bp, Mus musculus
agtgggcagtacactgcctcaggcg

SEQ ID NO: 204030 - DNA, 25 bp, Mus musculus
agtgggcagtacattgccattaccc

SEQ ID NO: 204031 - DNA, 25 bp, Mus musculus
agtgggccacttgcccatgttacca

SEQ ID NO: 204032 - DNA, 25 bp, Mus musculus
agtgggcccccaagccttggaaata

SEQ ID NO: 204033 - DNA, 25 bp, Mus musculus
agtgggctccagcagcccaagccca

SEQ ID NO: 204034 - DNA, 25 bp, Mus musculus
agtgggctgcggtatcagcctagca

SEQ ID NO: 204035 - DNA, 25 bp, Mus musculus
agtggggaaaccaaggacacactga

SEQ ID NO: 204036 - DNA, 25 bp, Mus musculus
agtggggaacaggtctttcatagta

SEQ ID NO: 204037 - DNA, 25 bp, Mus musculus
agtggggacaccattaccatgcagc

SEQ ID NO: 204038 - DNA, 25 bp, Mus musculus
agtggggagggcgaggtgctcctaa

SEQ ID NO: 204039 - DNA, 25 bp, Mus musculus
agtggggcatgagtgtaatgttcaa

SEQ ID NO: 204040 - DNA, 25 bp, Mus musculus
agtggggcctggaggacatcatgtt

SEQ ID NO: 204041 - DNA, 25 bp, Mus musculus
agtggggcggcccctgcccggatgg

SEQ ID NO: 204042 - DNA, 25 bp, Mus musculus
agtggggcttatggtgtctgatctg

SEQ ID NO: 204043 - DNA, 25 bp, Mus musculus
agtgggggaacaggttgagtgatgg

SEQ ID NO: 204044 - DNA, 25 bp, Mus musculus
agtgggggaacagtttctctaatag

SEQ ID NO: 204045 - DNA, 25 bp, Mus musculus
agtgggggatcctgcagaggacttt

SEQ ID NO: 204046 - DNA, 25 bp, Mus musculus
agtgggggtaagggtggaatgtacg

SEQ ID NO: 204047 - DNA, 25 bp, Mus musculus
agtggggtcccgggctactcttccg

SEQ ID NO: 204048 - DNA, 25 bp, Mus musculus
agtggggtgacgaggtggagtacat

SEQ ID NO: 204049 - DNA, 25 bp, Mus musculus
agtgggtacagagtataaaggaggg

SEQ ID NO: 204050 - DNA, 25 bp, Mus musculus
agtgggtaccaggcacaggctaccc

SEQ ID NO: 204051 - DNA, 25 bp, Mus musculus
agtgggtggagagcatgggggggaa

SEQ ID NO: 204052 - DNA, 25 bp, Mus musculus
agtgggttctgcaggaggagtgatg

SEQ ID NO: 204053 - DNA, 25 bp, Mus musculus
agtggtaaaaagagctgtaatagac

SEQ ID NO: 204054 - DNA, 25 bp, Mus musculus
agtggtagtgtactgtgaccgtgat

SEQ ID NO: 204055 - DNA, 25 bp, Mus musculus
agtggtataggatcttgaaacagga

SEQ ID NO: 204056 - DNA, 25 bp, Mus musculus
agtggtatgaggttgaacggacaga

SEQ ID NO: 204057 - DNA, 25 bp, Mus musculus
agtggtatgagtggttcagaaattg

SEQ ID NO: 204058 - DNA, 25 bp, Mus musculus
agtggtccacaagggggggctgttc

SEQ ID NO: 204059 - DNA, 25 bp, Mus musculus
agtggtccagaccctcagtgctcac

SEQ ID NO: 204060 - DNA, 25 bp, Mus musculus
agtggtccagggatgaactgtgaaa

SEQ ID NO: 204061 - DNA, 25 bp, Mus musculus
agtggtccaggttctaagcgcagca

SEQ ID NO: 204062 - DNA, 25 bp, Mus musculus
agtggtccatgtctctttctccaga

SEQ ID NO: 204063 - DNA, 25 bp, Mus musculus
agtggtcccagaatggaagcccaga

SEQ ID NO: 204064 - DNA, 25 bp, Mus musculus
agtggtcccagggccagaaaaagct

SEQ ID NO: 204065 - DNA, 25 bp, Mus musculus
agtggtccctgagttcgtcaatgca

SEQ ID NO: 204066 - DNA, 25 bp, Mus musculus
agtggtcctgtcagcttcagccacc

SEQ ID NO: 204067 - DNA, 25 bp, Mus musculus
agtggtcctgtcagtggatgtgtcc

SEQ ID NO: 204068 - DNA, 25 bp, Mus musculus
agtggtctcagaagtgccttcaaga

SEQ ID NO: 204069 - DNA, 25 bp, Mus musculus
agtggtctgcaaaggagaatcacac

SEQ ID NO: 204070 - DNA, 25 bp, Mus musculus
agtggtgaacattagcaacaagacg

SEQ ID NO: 204071 - DNA, 25 bp, Mus musculus
agtggtgaaggacctcagtgcagaa

SEQ ID NO: 204072 - DNA, 25 bp, Mus musculus
agtggtgaagggacacgcctgcgaa

SEQ ID NO: 204073 - DNA, 25 bp, Mus musculus
agtggtgacaggctccatccaaccc

SEQ ID NO: 204074 - DNA, 25 bp, Mus musculus
agtggtgatgctgtcatcaaggctc

SEQ ID NO: 204075 - DNA, 25 bp, Mus musculus
agtggtgcgaggaggtggagcctac

SEQ ID NO: 204076 - DNA, 25 bp, Mus musculus
agtggtgctcaggcaagatgggcat

SEQ ID NO: 204077 - DNA, 25 bp, Mus musculus
agtggtgctcagtggcagcatggag

SEQ ID NO: 204078 - DNA, 25 bp, Mus musculus
agtggtggaagaggagaactttgac

SEQ ID NO: 204079 - DNA, 25 bp, Mus musculus
agtggtggaagtcgtgttcaaggac

SEQ ID NO: 204080 - DNA, 25 bp, Mus musculus
agtggtggacctcaggcatcctgca

SEQ ID NO: 204081 - DNA, 25 bp, Mus musculus
agtggtggacctcaggcatcctgga

SEQ ID NO: 204082 - DNA, 25 bp, Mus musculus
agtggtggagccttcccatcaggga

SEQ ID NO: 204083 - DNA, 25 bp, Mus musculus
agtggtggaggggatcctggacacc

SEQ ID NO: 204084 - DNA, 25 bp, Mus musculus
agtggtggaggtcagagtcagagtt

SEQ ID NO: 204085 - DNA, 25 bp, Mus musculus
agtggtggaggtcagggtagtacaa

SEQ ID NO: 204086 - DNA, 25 bp, Mus musculus
agtggtggccaggacagcaaccatc

SEQ ID NO: 204087 - DNA, 25 bp, Mus musculus
agtggtggccctgtctctctggact

SEQ ID NO: 204088 - DNA, 25 bp, Mus musculus
agtggtggcctgtggtttatggtgt

SEQ ID NO: 204089 - DNA, 25 bp, Mus musculus
agtggtggctttggtggcatatcca

SEQ ID NO: 204090 - DNA, 25 bp, Mus musculus
agtggtgggagccctatgctgctgt

SEQ ID NO: 204091 - DNA, 25 bp, Mus musculus
agtggtggtgccaattgctggtgcc

SEQ ID NO: 204092 - DNA, 25 bp, Mus musculus
agtggtgtcggcattgctagcttgg

SEQ ID NO: 204093 - DNA, 25 bp, Mus musculus
agtggtgtcggtgttgccagtgttg

SEQ ID NO: 204094 - DNA, 25 bp, Mus musculus
agtggtgtgttagagtggattgaaa

SEQ ID NO: 204095 - DNA, 25 bp, Mus musculus
agtggtgtgttaggtatggctttcc

SEQ ID NO: 204096 - DNA, 25 bp, Mus musculus
agtggtgtgttaggtgcggtggcta

SEQ ID NO: 204097 - DNA, 25 bp, Mus musculus
agtggttccatcaagggaagaagga

SEQ ID NO: 204098 - DNA, 25 bp, Mus musculus
agtggttctagctttaaggaccatc

SEQ ID NO: 204099 - DNA, 25 bp, Mus musculus
agtggttctaggagctcagactgaa

SEQ ID NO: 204100 - DNA, 25 bp, Mus musculus
agtggttctccagagggaaaaagcc

SEQ ID NO: 204101 - DNA, 25 bp, Mus musculus
agtggttctgaacacggtacaacct

SEQ ID NO: 204102 - DNA, 25 bp, Mus musculus
agtggttcttcaggcgtggctcccg

SEQ ID NO: 204103 - DNA, 25 bp, Mus musculus
agtggttcttcaggtacatggcttc

SEQ ID NO: 204104 - DNA, 25 bp, Mus musculus
agtggttcttcaggtcagaaggaga

SEQ ID NO: 204105 - DNA, 25 bp, Mus musculus
agtggttgaatgatccagagtcctc

SEQ ID NO: 204106 - DNA, 25 bp, Mus musculus
agtggttgattgagaaggagggaga

SEQ ID NO: 204107 - DNA, 25 bp, Mus musculus
agtggttgcgaacaatttcgaagag

SEQ ID NO: 204108 - DNA, 25 bp, Mus musculus
agtggttgcggagaggtttgcagcc

SEQ ID NO: 204109 - DNA, 25 bp, Mus musculus
agtggttgcggagcgagcccggcct

SEQ ID NO: 204110 - DNA, 25 bp, Mus musculus
agtggttgctatggaacatcattca

SEQ ID NO: 204111 - DNA, 25 bp, Mus musculus
agtggttgctatggtctgggagggt

SEQ ID NO: 204112 - DNA, 25 bp, Mus musculus
agtggtttttgacagaccagccaca

SEQ ID NO: 204113 - DNA, 25 bp, Mus musculus
agtggtttttgacagcctcattaac

SEQ ID NO: 204114 - DNA, 25 bp, Mus musculus
agtgtaaaagaaagatgatgacata

SEQ ID NO: 204115 - DNA, 25 bp, Mus musculus
agtgtaaacaattagatttagagct

SEQ ID NO: 204116 - DNA, 25 bp, Mus musculus
agtgtaaatctaagatcaactatgg

SEQ ID NO: 204117 - DNA, 25 bp, Mus musculus
agtgtaaattccccttttatgctgc

SEQ ID NO: 204118 - DNA, 25 bp, Mus musculus
agtgtaaccaaagatgtcgcactgg

SEQ ID NO: 204119 - DNA, 25 bp, Mus musculus
agtgtaacccagtgtggtgaactca

SEQ ID NO: 204120 - DNA, 25 bp, Mus musculus
agtgtaactgttacgaaatctcata

SEQ ID NO: 204121 - DNA, 25 bp, Mus musculus
agtgtaactgttacgatccatcttt

SEQ ID NO: 204122 - DNA, 25 bp, Mus musculus
agtgtaagcccggccgaattcgagg

SEQ ID NO: 204123 - DNA, 25 bp, Mus musculus
agtgtaatcagcagctgttctcata

SEQ ID NO: 204124 - DNA, 25 bp, Mus musculus
agtgtacagtgcttctcagacacaa

SEQ ID NO: 204125 - DNA, 25 bp, Mus musculus
agtgtacgaagcagctccttaattg

SEQ ID NO: 204126 - DNA, 25 bp, Mus musculus
agtgtactgaggaaagcagaggagt

SEQ ID NO: 204127 - DNA, 25 bp, Mus musculus
agtgtactgaggcatatttaattag

SEQ ID NO: 204128 - DNA, 25 bp, Mus musculus
agtgtactggatgtttgagacagag

SEQ ID NO: 204129 - DNA, 25 bp, Mus musculus
agtgtagaattctcactggccgggg

SEQ ID NO: 204130 - DNA, 25 bp, Mus musculus
agtgtagagccacagaactgtcctg

SEQ ID NO: 204131 - DNA, 25 bp, Mus musculus
agtgtagagccacagagacagtgtt

SEQ ID NO: 204132 - DNA, 25 bp, Mus musculus
agtgtagagccacaggatctcaatt

SEQ ID NO: 204133 - DNA, 25 bp, Mus musculus
agtgtaggagaaggtccaacgggcg

SEQ ID NO: 204134 - DNA, 25 bp, Mus musculus
agtgtagtaggtctgttcctgcgcc

SEQ ID NO: 204135 - DNA, 25 bp, Mus musculus
agtgtagtgaaaagctgcagcaata

SEQ ID NO: 204136 - DNA, 25 bp, Mus musculus
agtgtagtggatcaggcactggccc

SEQ ID NO: 204137 - DNA, 25 bp, Mus musculus
agtgtatacagtggcccatcatggc

SEQ ID NO: 204138 - DNA, 25 bp, Mus musculus
agtgtatcaggatgatgctgttgaa

SEQ ID NO: 204139 - DNA, 25 bp, Mus musculus
agtgtatccaggctttaagcactgg

SEQ ID NO: 204140 - DNA, 25 bp, Mus musculus
agtgtatccagggaccaccacacca

SEQ ID NO: 204141 - DNA, 25 bp, Mus musculus
agtgtatccagggataatcttgggg

SEQ ID NO: 204142 - DNA, 25 bp, Mus musculus
agtgtatctcaacagcaagctgcct

SEQ ID NO: 204143 - DNA, 25 bp, Mus musculus
agtgtatgaggcagccatctccatt

SEQ ID NO: 204144 - DNA, 25 bp, Mus musculus
agtgtatgaggcagggctcattttc

SEQ ID NO: 204145 - DNA, 25 bp, Mus musculus
agtgtatgagggccagaacgtcttc

SEQ ID NO: 204146 - DNA, 25 bp, Mus musculus
agtgtatgccacatgagtctttcaa

SEQ ID NO: 204147 - DNA, 25 bp, Mus musculus
agtgtatgtcttggtggtcactaac

SEQ ID NO: 204148 - DNA, 25 bp, Mus musculus
agtgtattcaaagaacttagtagtc

SEQ ID NO: 204149 - DNA, 25 bp, Mus musculus
agtgtattcccaggacccacattgt

SEQ ID NO: 204150 - DNA, 25 bp, Mus musculus
agtgtcaaatatggacctgggtcgc

SEQ ID NO: 204151 - DNA, 25 bp, Mus musculus
agtgtcaaatatggccaccaggcct

SEQ ID NO: 204152 - DNA, 25 bp, Mus musculus
agtgtcaaccagtgctcagagttct

SEQ ID NO: 204153 - DNA, 25 bp, Mus musculus
agtgtcaaccatcttgctctacaaa

SEQ ID NO: 204154 - DNA, 25 bp, Mus musculus
agtgtcaagtttcagcctcttagca

SEQ ID NO: 204155 - DNA, 25 bp, Mus musculus
agtgtcaagtttcaggacacacagg

SEQ ID NO: 204156 - DNA, 25 bp, Mus musculus
agtgtcaatcaatggtgtcccagat

SEQ ID NO: 204157 - DNA, 25 bp, Mus musculus
agtgtcaatccctgatactgtagaa

SEQ ID NO: 204158 - DNA, 25 bp, Mus musculus
agtgtcacaagatggagcaggaaat

SEQ ID NO: 204159 - DNA, 25 bp, Mus musculus
agtgtcacagtgtggttgatgacat

SEQ ID NO: 204160 - DNA, 25 bp, Mus musculus
agtgtcaccacccagaaggaataca

SEQ ID NO: 204161 - DNA, 25 bp, Mus musculus
agtgtcaccacccaggcctcccaag

SEQ ID NO: 204162 - DNA, 25 bp, Mus musculus
agtgtcaccccggtccctccgagcc

SEQ ID NO: 204163 - DNA, 25 bp, Mus musculus
agtgtcactggtttgtacagtgtct

SEQ ID NO: 204164 - DNA, 25 bp, Mus musculus
agtgtcagaattggggaccctctga

SEQ ID NO: 204165 - DNA, 25 bp, Mus musculus
agtgtcagagaaggtctcccatgtt

SEQ ID NO: 204166 - DNA, 25 bp, Mus musculus
agtgtcagccagggcggagctacac

SEQ ID NO: 204167 - DNA, 25 bp, Mus musculus
agtgtcagctacgcaggaagggccc

SEQ ID NO: 204168 - DNA, 25 bp, Mus musculus
agtgtcagctacgccgatcgggtca

SEQ ID NO: 204169 - DNA, 25 bp, Mus musculus
agtgtcaggagcagattgccagggc

SEQ ID NO: 204170 - DNA, 25 bp, Mus musculus
agtgtcagtatgtggtccagtgtga

SEQ ID NO: 204171 - DNA, 25 bp, Mus musculus
agtgtcagtgggttatttcgctgca

SEQ ID NO: 204172 - DNA, 25 bp, Mus musculus
agtgtcatcaaggtctttccggact

SEQ ID NO: 204173 - DNA, 25 bp, Mus musculus
agtgtcattaagcccacaaggcccg

SEQ ID NO: 204174 - DNA, 25 bp, Mus musculus
agtgtcattttcagaatggtcgatg

SEQ ID NO: 204175 - DNA, 25 bp, Mus musculus
agtgtccacagtacctgagaaaggc

SEQ ID NO: 204176 - DNA, 25 bp, Mus musculus
agtgtccaccagggtttgacctgcc

SEQ ID NO: 204177 - DNA, 25 bp, Mus musculus
agtgtccatgaggttttggggcgag

SEQ ID NO: 204178 - DNA, 25 bp, Mus musculus
agtgtccatgctcttttgtgactgg

SEQ ID NO: 204179 - DNA, 25 bp, Mus musculus
agtgtcccaagagggtgtattacct

SEQ ID NO: 204180 - DNA, 25 bp, Mus musculus
agtgtcccaatccgggctgtggaaa

SEQ ID NO: 204181 - DNA, 25 bp, Mus musculus
agtgtcccaggtccctgtggcccct

SEQ ID NO: 204182 - DNA, 25 bp, Mus musculus
agtgtcccaggtctctaactggttt

SEQ ID NO: 204183 - DNA, 25 bp, Mus musculus
agtgtccgtgcatgaccatgtaatt

SEQ ID NO: 204184 - DNA, 25 bp, Mus musculus
agtgtccgtgctgaaccccacagct

SEQ ID NO: 204185 - DNA, 25 bp, Mus musculus
agtgtccgtggatgaccatgtaatt

SEQ ID NO: 204186 - DNA, 25 bp, Mus musculus
agtgtccgtggtgaaccccacagct

SEQ ID NO: 204187 - DNA, 25 bp, Mus musculus
agtgtcctagaatcaataagcttgg

SEQ ID NO: 204188 - DNA, 25 bp, Mus musculus
agtgtcctagcagattgtccttctg

SEQ ID NO: 204189 - DNA, 25 bp, Mus musculus
agtgtcctaggtcttgagagagctt

SEQ ID NO: 204190 - DNA, 25 bp, Mus musculus
agtgtcctcttctagttctttgtat

SEQ ID NO: 204191 - DNA, 25 bp, Mus musculus
agtgtcctggaaggtggtttgctct

SEQ ID NO: 204192 - DNA, 25 bp, Mus musculus
agtgtcctggcagcccaaacgatga

SEQ ID NO: 204193 - DNA, 25 bp, Mus musculus
agtgtctactaatttcccagcagtt

SEQ ID NO: 204194 - DNA, 25 bp, Mus musculus
agtgtctatggacgaccataaactc

SEQ ID NO: 204195 - DNA, 25 bp, Mus musculus
agtgtctcagaacgttttccaaggc

SEQ ID NO: 204196 - DNA, 25 bp, Mus musculus
agtgtctcagaaggttttccaaggc

SEQ ID NO: 204197 - DNA, 25 bp, Mus musculus
agtgtctcagaatgcaaagtatggc

SEQ ID NO: 204198 - DNA, 25 bp, Mus musculus
agtgtctcagccttcgtagtgcacc

SEQ ID NO: 204199 - DNA, 25 bp, Mus musculus
agtgtctcaggaatgtcaagtgaaa

SEQ ID NO: 204200 - DNA, 25 bp, Mus musculus
agtgtctcaggcggcttggattttg

SEQ ID NO: 204201 - DNA, 25 bp, Mus musculus
agtgtctcaggtgactcaagtacaa

SEQ ID NO: 204202 - DNA, 25 bp, Mus musculus
agtgtctcaggtgactccaatgaag

SEQ ID NO: 204203 - DNA, 25 bp, Mus musculus
agtgtctcccaggctttgaagggcc

SEQ ID NO: 204204 - DNA, 25 bp, Mus musculus
agtgtctctgatcaagagcacctgg

SEQ ID NO: 204205 - DNA, 25 bp, Mus musculus
agtgtctctgtccttgtcttatctc

SEQ ID NO: 204206 - DNA, 25 bp, Mus musculus
agtgtctctgtccttttgcctttat

SEQ ID NO: 204207 - DNA, 25 bp, Mus musculus
agtgtctgaaatgacacggagagcc

SEQ ID NO: 204208 - DNA, 25 bp, Mus musculus
agtgtctgccagatctgtggccagc

SEQ ID NO: 204209 - DNA, 25 bp, Mus musculus
agtgtctgccattgcaggatctgtg

SEQ ID NO: 204210 - DNA, 25 bp, Mus musculus
agtgtctgcgagcccagatgcccat

SEQ ID NO: 204211 - DNA, 25 bp, Mus musculus
agtgtctgcgatggttgtgagctac

SEQ ID NO: 204212 - DNA, 25 bp, Mus musculus
agtgtctggaatcccaggccaacta

SEQ ID NO: 204213 - DNA, 25 bp, Mus musculus
agtgtctggagataacaatcgaaag

SEQ ID NO: 204214 - DNA, 25 bp, Mus musculus
agtgtctggatgccagccactgctg

SEQ ID NO: 204215 - DNA, 25 bp, Mus musculus
agtgtcttaggttcttgtagtgcta

SEQ ID NO: 204216 - DNA, 25 bp, Mus musculus
agtgtcttatttaagacttcattga

SEQ ID NO: 204217 - DNA, 25 bp, Mus musculus
agtgtcttctcgcatgcacgcctac

SEQ ID NO: 204218 - DNA, 25 bp, Mus musculus
agtgtcttttctatagatgcccaac

SEQ ID NO: 204219 - DNA, 25 bp, Mus musculus
agtgtgaaaaaagtcattgaagagg

SEQ ID NO: 204220 - DNA, 25 bp, Mus musculus
agtgtgaacagaggcagaaactttg

SEQ ID NO: 204221 - DNA, 25 bp, Mus musculus
agtgtgaactccagggaggttagaa

SEQ ID NO: 204222 - DNA, 25 bp, Mus musculus
agtgtgaagacgtgagcaagatggg

SEQ ID NO: 204223 - DNA, 25 bp, Mus musculus
agtgtgaagacgtggaggcatccag

SEQ ID NO: 204224 - DNA, 25 bp, Mus musculus
agtgtgaagagatccaggcttacaa

SEQ ID NO: 204225 - DNA, 25 bp, Mus musculus
agtgtgaagatctgctttcccaggc

SEQ ID NO: 204226 - DNA, 25 bp, Mus musculus
agtgtgacaaggtggtacaggatct

SEQ ID NO: 204227 - DNA, 25 bp, Mus musculus
agtgtgacagtgattggaagtgccc

SEQ ID NO: 204228 - DNA, 25 bp, Mus musculus
agtgtgacgacaagatttgaaagaa

SEQ ID NO: 204229 - DNA, 25 bp, Mus musculus
agtgtgagataacacgtataggggc

SEQ ID NO: 204230 - DNA, 25 bp, Mus musculus
agtgtgagcctatccgcctccgact

SEQ ID NO: 204231 - DNA, 25 bp, Mus musculus
agtgtgaggacaagagtgtggaaaa

SEQ ID NO: 204232 - DNA, 25 bp, Mus musculus
agtgtgaggcatgggtgtcagtgct

SEQ ID NO: 204233 - DNA, 25 bp, Mus musculus
agtgtgagttgtcaggtaaagatga

SEQ ID NO: 204234 - DNA, 25 bp, Mus musculus
agtgtgatgaccaaggaggagcccc

SEQ ID NO: 204235 - DNA, 25 bp, Mus musculus
agtgtgattgggagaaaccactggt

SEQ ID NO: 204236 - DNA, 25 bp, Mus musculus
agtgtgcagaatgtctcacagatct

SEQ ID NO: 204237 - DNA, 25 bp, Mus musculus
agtgtgcagcagcagttgcaacaac

SEQ ID NO: 204238 - DNA, 25 bp, Mus musculus
agtgtgccaccaggatccaagccta

SEQ ID NO: 204239 - DNA, 25 bp, Mus musculus
agtgtgccagccaggtgggcatgac

SEQ ID NO: 204240 - DNA, 25 bp, Mus musculus
agtgtgccctgaagctcctgtatga

SEQ ID NO: 204241 - DNA, 25 bp, Mus musculus
agtgtgccctgaaggtcagaaaccc

SEQ ID NO: 204242 - DNA, 25 bp, Mus musculus
agtgtgcgaagatgtggatgagtgc

SEQ ID NO: 204243 - DNA, 25 bp, Mus musculus
agtgtgcgagcaggtagtcaatacc

SEQ ID NO: 204244 - DNA, 25 bp, Mus musculus
agtgtgcgcagcctggaagggcgtt

SEQ ID NO: 204245 - DNA, 25 bp, Mus musculus
agtgtgcgcagcttgcttctccaga

SEQ ID NO: 204246 - DNA, 25 bp, Mus musculus
agtgtgcgcctgccccgcgagaaag

SEQ ID NO: 204247 - DNA, 25 bp, Mus musculus
agtgtgcgctggaggtctaagccga

SEQ ID NO: 204248 - DNA, 25 bp, Mus musculus
agtgtgctgagaagctgagttccta

SEQ ID NO: 204249 - DNA, 25 bp, Mus musculus
agtgtggaaacagaccacaggatgg

SEQ ID NO: 204250 - DNA, 25 bp, Mus musculus
agtgtggaagagctcccgccagtga

SEQ ID NO: 204251 - DNA, 25 bp, Mus musculus
agtgtggaagtctggtcatctgact

SEQ ID NO: 204252 - DNA, 25 bp, Mus musculus
agtgtggaagttctgcaactgtgtc

SEQ ID NO: 204253 - DNA, 25 bp, Mus musculus
agtgtggaattatgtctgaggaaga

SEQ ID NO: 204254 - DNA, 25 bp, Mus musculus
agtgtggaccatcggggtacctgga

SEQ ID NO: 204255 - DNA, 25 bp, Mus musculus
agtgtggcagtagatgaagaacaac

SEQ ID NO: 204256 - DNA, 25 bp, Mus musculus
agtgtggccaatggcatgccttgga

SEQ ID NO: 204257 - DNA, 25 bp, Mus musculus
agtgtggccaatggctgtcgatatt

SEQ ID NO: 204258 - DNA, 25 bp, Mus musculus
agtgtggctagcaagctgcctcgta

SEQ ID NO: 204259 - DNA, 25 bp, Mus musculus
agtgtggctgcaaaggccactttgc

SEQ ID NO: 204260 - DNA, 25 bp, Mus musculus
agtgtggcttggtacctggaatgga

SEQ ID NO: 204261 - DNA, 25 bp, Mus musculus
agtgtgggaaatacggtatcaccag

SEQ ID NO: 204262 - DNA, 25 bp, Mus musculus
agtgtggggattaaggcaggttgtc

SEQ ID NO: 204263 - DNA, 25 bp, Mus musculus
agtgtgggtgagcaggtgcgggagg

SEQ ID NO: 204264 - DNA, 25 bp, Mus musculus
agtgtggtgactgttggtcctgtgg

SEQ ID NO: 204265 - DNA, 25 bp, Mus musculus
agtgtggtttgcagcttcatggttt

SEQ ID NO: 204266 - DNA, 25 bp, Mus musculus
agtgtggtttgcagggatgcggtaa

SEQ ID NO: 204267 - DNA, 25 bp, Mus musculus
agtgtgtcaaatctctcatggaact

SEQ ID NO: 204268 - DNA, 25 bp, Mus musculus
agtgtgtcacacgtgtggggctgcc

SEQ ID NO: 204269 - DNA, 25 bp, Mus musculus
agtgtgtcaggcattcggggcacgg

SEQ ID NO: 204270 - DNA, 25 bp, Mus musculus
agtgtgtctcaggtggtccacaagg

SEQ ID NO: 204271 - DNA, 25 bp, Mus musculus
agtgtgtctgaccagcatgcccgct

SEQ ID NO: 204272 - DNA, 25 bp, Mus musculus
agtgtgtgaagcaaggagaactcat

SEQ ID NO: 204273 - DNA, 25 bp, Mus musculus
agtgtgtgcaaatgacccaggatgt

SEQ ID NO: 204274 - DNA, 25 bp, Mus musculus
agtgtgtgcagcggggagagttaga

SEQ ID NO: 204275 - DNA, 25 bp, Mus musculus
agtgtgtgtcgtgctggtctgtgcg

SEQ ID NO: 204276 - DNA, 25 bp, Mus musculus
agtgtgtgtgcaacgatactgtatc

SEQ ID NO: 204277 - DNA, 25 bp, Mus musculus
agtgtgtgttattggactctgggct

SEQ ID NO: 204278 - DNA, 25 bp, Mus musculus
agtgtgtgtttggagaacccagatt

SEQ ID NO: 204279 - DNA, 25 bp, Mus musculus
agtgtgttaagccaaatttacggat

SEQ ID NO: 204280 - DNA, 25 bp, Mus musculus
agtgtgttaagtattttggaaatat

SEQ ID NO: 204281 - DNA, 25 bp, Mus musculus
agtgtgttctggcagggacgaaact

SEQ ID NO: 204282 - DNA, 25 bp, Mus musculus
agtgttaccagcaccaccaaaaaag

SEQ ID NO: 204283 - DNA, 25 bp, Mus musculus
agtgttactcaggtaccagcgctga

SEQ ID NO: 204284 - DNA, 25 bp, Mus musculus
agtgttcaaacatgcccagttgcag

SEQ ID NO: 204285 - DNA, 25 bp, Mus musculus
agtgttcaaagggctgaacgacaaa

SEQ ID NO: 204286 - DNA, 25 bp, Mus musculus
agtgttcaagccgccccacgaggcc

SEQ ID NO: 204287 - DNA, 25 bp, Mus musculus
agtgttcaagggtctcttgtggtac

SEQ ID NO: 204288 - DNA, 25 bp, Mus musculus
agtgttcaaggtagccattgcgggc

SEQ ID NO: 204289 - DNA, 25 bp, Mus musculus
agtgttcacactacctttctgattg

SEQ ID NO: 204290 - DNA, 25 bp, Mus musculus
agtgttcacatcaacaggaacgtca

SEQ ID NO: 204291 - DNA, 25 bp, Mus musculus
agtgttcagaaagcgctcctgttat

SEQ ID NO: 204292 - DNA, 25 bp, Mus musculus
agtgttcagtgatgtgatggaggat

SEQ ID NO: 204293 - DNA, 25 bp, Mus musculus
agtgttccaaggagaccccctcctg

SEQ ID NO: 204294 - DNA, 25 bp, Mus musculus
agtgttccaaggtttggtgccgtga

SEQ ID NO: 204295 - DNA, 25 bp, Mus musculus
agtgttccaggacatgctacccatg

SEQ ID NO: 204296 - DNA, 25 bp, Mus musculus
agtgttccctgacgctgccggcgaa

SEQ ID NO: 204297 - DNA, 25 bp, Mus musculus
agtgttccctgggttctgcagcttc

SEQ ID NO: 204298 - DNA, 25 bp, Mus musculus
agtgttctgtgcaggtgcagacctg

SEQ ID NO: 204299 - DNA, 25 bp, Mus musculus
agtgttctgttgttattttccttca

SEQ ID NO: 204300 - DNA, 25 bp, Mus musculus
agtgttgaaagtggagcaaaatgcc

SEQ ID NO: 204301 - DNA, 25 bp, Mus musculus
agtgttgaacagagaaattagccga

SEQ ID NO: 204302 - DNA, 25 bp, Mus musculus
agtgttgaccctgcagaaaacttct

SEQ ID NO: 204303 - DNA, 25 bp, Mus musculus
agtgttgcatgatcaaaaggaaaac

SEQ ID NO: 204304 - DNA, 25 bp, Mus musculus
agtgttgctgagattgccaaaatgc

SEQ ID NO: 204305 - DNA, 25 bp, Mus musculus
agtgttgcttgctgtgcctcagatc

SEQ ID NO: 204306 - DNA, 25 bp, Mus musculus
agtgttgcttgttttgctggtaact

SEQ ID NO: 204307 - DNA, 25 bp, Mus musculus
agtgttggaatggtcagcctctcag

SEQ ID NO: 204308 - DNA, 25 bp, Mus musculus
agtgttggacagattgtaggtgaag

SEQ ID NO: 204309 - DNA, 25 bp, Mus musculus
agtgttggactcatgagagcaaaga

SEQ ID NO: 204310 - DNA, 25 bp, Mus musculus
agtgttggtgccatggtggcttcag

SEQ ID NO: 204311 - DNA, 25 bp, Mus musculus
agtgttgtgaggagtccatgaagat

SEQ ID NO: 204312 - DNA, 25 bp, Mus musculus
agtgttgtgcagagactgccttgtg

SEQ ID NO: 204313 - DNA, 25 bp, Mus musculus
agtgttgtgcagaggcggccatgct

SEQ ID NO: 204314 - DNA, 25 bp, Mus musculus
agtgttgtgtccggtataagtgcta

SEQ ID NO: 204315 - DNA, 25 bp, Mus musculus
agtgttgttactgaggaacttcctg

SEQ ID NO: 204316 - DNA, 25 bp, Mus musculus
agtgtttaccacgcatgcagctggt

SEQ ID NO: 204317 - DNA, 25 bp, Mus musculus
agtgtttatggcttgaagatgcagt

SEQ ID NO: 204318 - DNA, 25 bp, Mus musculus
agtgtttctagaggcctcaaacagc

SEQ ID NO: 204319 - DNA, 25 bp, Mus musculus
agtgtttctgcaagatgaacgagac

SEQ ID NO: 204320 - DNA, 25 bp, Mus musculus
agtgtttgaatgaccttcttttgga

SEQ ID NO: 204321 - DNA, 25 bp, Mus musculus
agtgtttgctattgggcacaaatat

SEQ ID NO: 204322 - DNA, 25 bp, Mus musculus
agtgtttgctcagtgctggcctttg

SEQ ID NO: 204323 - DNA, 25 bp, Mus musculus
agtgtttggacggtgtgccggactc

SEQ ID NO: 204324 - DNA, 25 bp, Mus musculus
agtgtttggcaggatgctcgggaca

SEQ ID NO: 204325 - DNA, 25 bp, Mus musculus
agtgtttggcagtctccaaaacccc

SEQ ID NO: 204326 - DNA, 25 bp, Mus musculus
agtgttttcagaatggcttcctttg

SEQ ID NO: 204327 - DNA, 25 bp, Mus musculus
agtgttttcagggccctcagccgat

SEQ ID NO: 204328 - DNA, 25 bp, Mus musculus
agtgttttctcacagcatggtctga

SEQ ID NO: 204329 - DNA, 25 bp, Mus musculus
agtgttttctctcttttatttcagg

SEQ ID NO: 204330 - DNA, 25 bp, Mus musculus
agtgtttttgcagaatgtgtgctgt

SEQ ID NO: 204331 - DNA, 25 bp, Mus musculus
agttaaaaaacaaggtgagacagta

SEQ ID NO: 204332 - DNA, 25 bp, Mus musculus
agttaaaaaatcttgcccagtccca

SEQ ID NO: 204333 - DNA, 25 bp, Mus musculus
agttaaaaagtggaatgcagtggcc

SEQ ID NO: 204334 - DNA, 25 bp, Mus musculus
agttaaaaatattgagactggaagt

SEQ ID NO: 204335 - DNA, 25 bp, Mus musculus
agttaaaaatattgggtatgaaagt

SEQ ID NO: 204336 - DNA, 25 bp, Mus musculus
agttaaaaatcgcctcaccattgag

SEQ ID NO: 204337 - DNA, 25 bp, Mus musculus
agttaaagaggtgaactgccctcaa

SEQ ID NO: 204338 - DNA, 25 bp, Mus musculus
agttaaagtttcagcaacccagcat

SEQ ID NO: 204339 - DNA, 25 bp, Mus musculus
agttaacagaaacttcagaaaagta

SEQ ID NO: 204340 - DNA, 25 bp, Mus musculus
agttaaccagagtttgagtgacaga

SEQ ID NO: 204341 - DNA, 25 bp, Mus musculus
agttaaccagtgctgagcctaccac

SEQ ID NO: 204342 - DNA, 25 bp, Mus musculus
agttaacccacagacaaggaatatg

SEQ ID NO: 204343 - DNA, 25 bp, Mus musculus
agttaactgacacgagtgcgcaaac

SEQ ID NO: 204344 - DNA, 25 bp, Mus musculus
agttaactgacacgcaacagatagt

SEQ ID NO: 204345 - DNA, 25 bp, Mus musculus
agttaactgacacggtaagtcttct

SEQ ID NO: 204346 - DNA, 25 bp, Mus musculus
agttaagagaggtaatagaattgcc

SEQ ID NO: 204347 - DNA, 25 bp, Mus musculus
agttaagccagaggcaatgggctct

SEQ ID NO: 204348 - DNA, 25 bp, Mus musculus
agttaagctgagtgtcctggttgcc

SEQ ID NO: 204349 - DNA, 25 bp, Mus musculus
agttaaggaacaggctttcatgctg

SEQ ID NO: 204350 - DNA, 25 bp, Mus musculus
agttaagtagtcttttcacagagcc

SEQ ID NO: 204351 - DNA, 25 bp, Mus musculus
agttaagtcaggaaaccaagcgcct

SEQ ID NO: 204352 - DNA, 25 bp, Mus musculus
agttaatagcagagggctaccgtgt

SEQ ID NO: 204353 - DNA, 25 bp, Mus musculus
agttaatatcaaggtactgtctgat

SEQ ID NO: 204354 - DNA, 25 bp, Mus musculus
agttaatcttgtctcctcgaagata

SEQ ID NO: 204355 - DNA, 25 bp, Mus musculus
agttaatcttgtctcttctcacagg

SEQ ID NO: 204356 - DNA, 25 bp, Mus musculus
agttaatcttgtttgagtcttcaga

SEQ ID NO: 204357 - DNA, 25 bp, Mus musculus
agttaatgaggggtattcagagtgg

SEQ ID NO: 204358 - DNA, 25 bp, Mus musculus
agttaattctagaaggttttctgtc

SEQ ID NO: 204359 - DNA, 25 bp, Mus musculus
agttaattctccattgaaatgttgt

SEQ ID NO: 204360 - DNA, 25 bp, Mus musculus
agttaattgagtgtgttctcagggg

SEQ ID NO: 204361 - DNA, 25 bp, Mus musculus
agttaattgctggccttcgttttca

SEQ ID NO: 204362 - DNA, 25 bp, Mus musculus
agttacaccaagattctgggctaat

SEQ ID NO: 204363 - DNA, 25 bp, Mus musculus
agttacaccaagtttctgggctaat

SEQ ID NO: 204364 - DNA, 25 bp, Mus musculus
agttacagaaggtttggaggtacca

SEQ ID NO: 204365 - DNA, 25 bp, Mus musculus
agttacagcagtcactgctggggtt

SEQ ID NO: 204366 - DNA, 25 bp, Mus musculus
agttacaggggcccagactgatctt

SEQ ID NO: 204367 - DNA, 25 bp, Mus musculus
agttacagggtatttttcttactca

SEQ ID NO: 204368 - DNA, 25 bp, Mus musculus
agttacagtttgccccggctgagga

SEQ ID NO: 204369 - DNA, 25 bp, Mus musculus
agttacatgcaggtcataaatgaag

SEQ ID NO: 204370 - DNA, 25 bp, Mus musculus
agttacatgtatgatttctgtacac

SEQ ID NO: 204371 - DNA, 25 bp, Mus musculus
agttaccaagagtaaggacgagtct

SEQ ID NO: 204372 - DNA, 25 bp, Mus musculus
agttaccaggaccgctcctttgacg

SEQ ID NO: 204373 - DNA, 25 bp, Mus musculus
agttaccaggggcacgaccagttca

SEQ ID NO: 204374 - DNA, 25 bp, Mus musculus
agttaccctgttgaggtttttcatc

SEQ ID NO: 204375 - DNA, 25 bp, Mus musculus
agttaccgtaatggacggatctttg

SEQ ID NO: 204376 - DNA, 25 bp, Mus musculus
agttacctagatattgctgttggag

SEQ ID NO: 204377 - DNA, 25 bp, Mus musculus
agttacctaggcttttcactggact

SEQ ID NO: 204378 - DNA, 25 bp, Mus musculus
agttacctatgaccatctgtgtaag

SEQ ID NO: 204379 - DNA, 25 bp, Mus musculus
agttacctatgaccgaatataccat

SEQ ID NO: 204380 - DNA, 25 bp, Mus musculus
agttacgtaggtctggtcagctacc

SEQ ID NO: 204381 - DNA, 25 bp, Mus musculus
agttactaattactgaaaaagaagt

SEQ ID NO: 204382 - DNA, 25 bp, Mus musculus
agttactaattactggattctgctc

SEQ ID NO: 204383 - DNA, 25 bp, Mus musculus
agttactagcacaaggtgactacga

SEQ ID NO: 204384 - DNA, 25 bp, Mus musculus
agttactcaggggtggatgagaggg

SEQ ID NO: 204385 - DNA, 25 bp, Mus musculus
agttactcaggtggctggtggtgga

SEQ ID NO: 204386 - DNA, 25 bp, Mus musculus
agttactcatgaaaacttgctagaa

SEQ ID NO: 204387 - DNA, 25 bp, Mus musculus
agttactctacatcccctcctctct

SEQ ID NO: 204388 - DNA, 25 bp, Mus musculus
agttactctacttcatctactctgt

SEQ ID NO: 204389 - DNA, 25 bp, Mus musculus
agttactggcattggaccatctgct

SEQ ID NO: 204390 - DNA, 25 bp, Mus musculus
agttactggcattggatctcaggaa

SEQ ID NO: 204391 - DNA, 25 bp, Mus musculus
agttacttagtggagagaacagata

SEQ ID NO: 204392 - DNA, 25 bp, Mus musculus
agttacttagtggtgagacgtggaa

SEQ ID NO: 204393 - DNA, 25 bp, Mus musculus
agttacttctgatggcctcgaactc

SEQ ID NO: 204394 - DNA, 25 bp, Mus musculus
agttagaaaagagtatgctgtcaag

SEQ ID NO: 204395 - DNA, 25 bp, Mus musculus
agttagaaaagcatccgcagacatc

SEQ ID NO: 204396 - DNA, 25 bp, Mus musculus
agttagaaaagccatagattgtaag

SEQ ID NO: 204397 - DNA, 25 bp, Mus musculus
agttagaaaagctatagagaagtct

SEQ ID NO: 204398 - DNA, 25 bp, Mus musculus
agttagaaaaggcatctgtggcaag

SEQ ID NO: 204399 - DNA, 25 bp, Mus musculus
agttagaactcaggcaggaagagga

SEQ ID NO: 204400 - DNA, 25 bp, Mus musculus
agttagaagctctgaatgacaaaaa

SEQ ID NO: 204401 - DNA, 25 bp, Mus musculus
agttagaagctcttaaaaaacagtt

SEQ ID NO: 204402 - DNA, 25 bp, Mus musculus
agttagaccatggcacccgatggcc

SEQ ID NO: 204403 - DNA, 25 bp, Mus musculus
agttagaccatgtggtgaccatcat

SEQ ID NO: 204404 - DNA, 25 bp, Mus musculus
agttagacgaggaggtggagttgtt

SEQ ID NO: 204405 - DNA, 25 bp, Mus musculus
agttagacttgcaagcacctttctt

SEQ ID NO: 204406 - DNA, 25 bp, Mus musculus
agttagagaaacatggtggcgacag

SEQ ID NO: 204407 - DNA, 25 bp, Mus musculus
agttagagaaggctcatacaacact

SEQ ID NO: 204408 - DNA, 25 bp, Mus musculus
agttagagacaaaggttctaatcag

SEQ ID NO: 204409 - DNA, 25 bp, Mus musculus
agttagagagagagagagagacaaa

SEQ ID NO: 204410 - DNA, 25 bp, Mus musculus
agttagaggtcacaacttctcacac

SEQ ID NO: 204411 - DNA, 25 bp, Mus musculus
agttagatctagtgagcagcacctc

SEQ ID NO: 204412 - DNA, 25 bp, Mus musculus
agttagatctagtttttagagaaat

SEQ ID NO: 204413 - DNA, 25 bp, Mus musculus
agttagcaaccgctatggaattgcc

SEQ ID NO: 204414 - DNA, 25 bp, Mus musculus
agttagcaccgtggtgagtaatagt

SEQ ID NO: 204415 - DNA, 25 bp, Mus musculus
agttagcagtcaaactcagcaacag

SEQ ID NO: 204416 - DNA, 25 bp, Mus musculus
agttagcagtcaatatatggactaa

SEQ ID NO: 204417 - DNA, 25 bp, Mus musculus
agttagccagaatggagaatggagt

SEQ ID NO: 204418 - DNA, 25 bp, Mus musculus
agttagctgagacacttgtgagcct

SEQ ID NO: 204419 - DNA, 25 bp, Mus musculus
agttagctgagtcggctgcacggct

SEQ ID NO: 204420 - DNA, 25 bp, Mus musculus
agttagctggcaaagattttctttg

SEQ ID NO: 204421 - DNA, 25 bp, Mus musculus
agttaggaaaggaaagcactgccac

SEQ ID NO: 204422 - DNA, 25 bp, Mus musculus
agttaggaccacgagtattgttaca

SEQ ID NO: 204423 - DNA, 25 bp, Mus musculus
agttaggtgagaaagcagaagatac

SEQ ID NO: 204424 - DNA, 25 bp, Mus musculus
agttagtacagatgcagacagcctt

SEQ ID NO: 204425 - DNA, 25 bp, Mus musculus
agttagtcctggcaggactttcctg

SEQ ID NO: 204426 - DNA, 25 bp, Mus musculus
agttagtggccagggttgaagacaa

SEQ ID NO: 204427 - DNA, 25 bp, Mus musculus
agttataccaaattcttctggaata

SEQ ID NO: 204428 - DNA, 25 bp, Mus musculus
agttataccaaattgaaaagatatg

SEQ ID NO: 204429 - DNA, 25 bp, Mus musculus
agttatagactggcctcatctgttc

SEQ ID NO: 204430 - DNA, 25 bp, Mus musculus
agttatagccaggatttcccagcct

SEQ ID NO: 204431 - DNA, 25 bp, Mus musculus
agttatagccaggtctccagcagaa

SEQ ID NO: 204432 - DNA, 25 bp, Mus musculus
agttatatcaggggtcggcacaaga

SEQ ID NO: 204433 - DNA, 25 bp, Mus musculus
agttatatgaaagttacgagaagca

SEQ ID NO: 204434 - DNA, 25 bp, Mus musculus
agttatcaaagaggatgtctcggaa

SEQ ID NO: 204435 - DNA, 25 bp, Mus musculus
agttatctgacccttcctatctgcc

SEQ ID NO: 204436 - DNA, 25 bp, Mus musculus
agttatctgcagaatgtgtatgcac

SEQ ID NO: 204437 - DNA, 25 bp, Mus musculus
agttatgaagccagacaagttggca

SEQ ID NO: 204438 - DNA, 25 bp, Mus musculus
agttatgaagccaggtccctcaaag

SEQ ID NO: 204439 - DNA, 25 bp, Mus musculus
agttatgatgaggccaagcacgtga

SEQ ID NO: 204440 - DNA, 25 bp, Mus musculus
agttatgcagaacttgtcacaaacg

SEQ ID NO: 204441 - DNA, 25 bp, Mus musculus
agttatgctccagagtgagagactt

SEQ ID NO: 204442 - DNA, 25 bp, Mus musculus
agttatgctccagagtttcagttcc

SEQ ID NO: 204443 - DNA, 25 bp, Mus musculus
agttatgctccagccactctgctga

SEQ ID NO: 204444 - DNA, 25 bp, Mus musculus
agttatgtcaggagttcaccttttc

SEQ ID NO: 204445 - DNA, 25 bp, Mus musculus
agttattcagtggttctgggaagtt

SEQ ID NO: 204446 - DNA, 25 bp, Mus musculus
agttattcagttcgttactggcagg

SEQ ID NO: 204447 - DNA, 25 bp, Mus musculus
agttatttagacaagatcctgaggg

SEQ ID NO: 204448 - DNA, 25 bp, Mus musculus
agttatttctccagagcgtgcccct

SEQ ID NO: 204449 - DNA, 25 bp, Mus musculus
agttatttctccaggcttcacagag

SEQ ID NO: 204450 - DNA, 25 bp, Mus musculus
agttattttggggaaggatattcag

SEQ ID NO: 204451 - DNA, 25 bp, Mus musculus
agttcaaaaccaagattaattgcct

SEQ ID NO: 204452 - DNA, 25 bp, Mus musculus
agttcaaacaggcagctgagacaca

SEQ ID NO: 204453 - DNA, 25 bp, Mus musculus
agttcaaacagtcgagagctatgag

SEQ ID NO: 204454 - DNA, 25 bp, Mus musculus
agttcaaacatacagctttgtaccc

SEQ ID NO: 204455 - DNA, 25 bp, Mus musculus
agttcaaacatccaggtggctctgg

SEQ ID NO: 204456 - DNA, 25 bp, Mus musculus
agttcaaagatctaaatgcaaatgt

SEQ ID NO: 204457 - DNA, 25 bp, Mus musculus
agttcaaagcatgattggagagaga

SEQ ID NO: 204458 - DNA, 25 bp, Mus musculus
agttcaaagcatgtcttttgctgat

SEQ ID NO: 204459 - DNA, 25 bp, Mus musculus
agttcaaaggcaaaattcttccaag

SEQ ID NO: 204460 - DNA, 25 bp, Mus musculus
agttcaaaggcaaagcttccctggt

SEQ ID NO: 204461 - DNA, 25 bp, Mus musculus
agttcaaatcccaagttccgtgagg

SEQ ID NO: 204462 - DNA, 25 bp, Mus musculus
agttcaaatgagacatcctatgagt

SEQ ID NO: 204463 - DNA, 25 bp, Mus musculus
agttcaaatgcgcttaaaggatagc

SEQ ID NO: 204464 - DNA, 25 bp, Mus musculus
agttcaacaaacggtgtttgcctgc

SEQ ID NO: 204465 - DNA, 25 bp, Mus musculus
agttcaacaaacgttgacttgctgg

SEQ ID NO: 204466 - DNA, 25 bp, Mus musculus
agttcaactgcgagatgaaatggaa

SEQ ID NO: 204467 - DNA, 25 bp, Mus musculus
agttcaacttcgctagttgatttat

SEQ ID NO: 204468 - DNA, 25 bp, Mus musculus
agttcaagagagcaggcaaggagaa

SEQ ID NO: 204469 - DNA, 25 bp, Mus musculus
agttcaagaggaagaaatgcccccg

SEQ ID NO: 204470 - DNA, 25 bp, Mus musculus
agttcaagaggacacaatgtaggaa

SEQ ID NO: 204471 - DNA, 25 bp, Mus musculus
agttcaagcaaatggtattcatgca

SEQ ID NO: 204472 - DNA, 25 bp, Mus musculus
agttcaagcaagactgtacatttgc

SEQ ID NO: 204473 - DNA, 25 bp, Mus musculus
agttcaagcaagtaaaccggcctca

SEQ ID NO: 204474 - DNA, 25 bp, Mus musculus
agttcaaggccaagatccgggactt

SEQ ID NO: 204475 - DNA, 25 bp, Mus musculus
agttcaaggccaagggtctactata

SEQ ID NO: 204476 - DNA, 25 bp, Mus musculus
agttcaagtccttggaaattagaag

SEQ ID NO: 204477 - DNA, 25 bp, Mus musculus
agttcaagtccttggaccatggtat

SEQ ID NO: 204478 - DNA, 25 bp, Mus musculus
agttcaatgagcggtttgagtggga

SEQ ID NO: 204479 - DNA, 25 bp, Mus musculus
agttcaatggccagaagcaccaaga

SEQ ID NO: 204480 - DNA, 25 bp, Mus musculus
agttcaatggccaggtcaggagttt

SEQ ID NO: 204481 - DNA, 25 bp, Mus musculus
agttcacaagataaccaacaaccag

SEQ ID NO: 204482 - DNA, 25 bp, Mus musculus
agttcacaaggaatgtatcattgat

SEQ ID NO: 204483 - DNA, 25 bp, Mus musculus
agttcacacagcagaaagtgtcacc

SEQ ID NO: 204484 - DNA, 25 bp, Mus musculus
agttcacagagcatgcaacccacat

SEQ ID NO: 204485 - DNA, 25 bp, Mus musculus
agttcacagcagatgtaaagaacat

SEQ ID NO: 204486 - DNA, 25 bp, Mus musculus
agttcacagcaggtttaaaaaatac

SEQ ID NO: 204487 - DNA, 25 bp, Mus musculus
agttcacagcatgaaggactttcga

SEQ ID NO: 204488 - DNA, 25 bp, Mus musculus
agttcacagcgcactgtttgattgc

SEQ ID NO: 204489 - DNA, 25 bp, Mus musculus
agttcaccaagatatttatcaacaa

SEQ ID NO: 204490 - DNA, 25 bp, Mus musculus
agttcaccacagtgactccatacca

SEQ ID NO: 204491 - DNA, 25 bp, Mus musculus
agttcaccaggcaggcagtacaggc

SEQ ID NO: 204492 - DNA, 25 bp, Mus musculus
agttcaccaggcaggtaagcttcaa

SEQ ID NO: 204493 - DNA, 25 bp, Mus musculus
agttcacccgagtcccctgagggat

SEQ ID NO: 204494 - DNA, 25 bp, Mus musculus
agttcacccggaaggccctcaatga

SEQ ID NO: 204495 - DNA, 25 bp, Mus musculus
agttcactaccctcccaaactggcc

SEQ ID NO: 204496 - DNA, 25 bp, Mus musculus
agttcactagctgggtacctcttgt

SEQ ID NO: 204497 - DNA, 25 bp, Mus musculus
agttcactcaagagttcacaagcca

SEQ ID NO: 204498 - DNA, 25 bp, Mus musculus
agttcactcaaggagctctgtgaat

SEQ ID NO: 204499 - DNA, 25 bp, Mus musculus
agttcactctagagtcttttattca

SEQ ID NO: 204500 - DNA, 25 bp, Mus musculus
agttcactgaacagacagctccgaa

SEQ ID NO: 204501 - DNA, 25 bp, Mus musculus
agttcactgtcaagtcaagactgtt

SEQ ID NO: 204502 - DNA, 25 bp, Mus musculus
agttcacttgcaggtgttgtttgtg

SEQ ID NO: 204503 - DNA, 25 bp, Mus musculus
agttcacttgcagtcgagcaaaaga

SEQ ID NO: 204504 - DNA, 25 bp, Mus musculus
agttcagaaaacagcatcaaggatg

SEQ ID NO: 204505 - DNA, 25 bp, Mus musculus
agttcagaaaacaggtaaaggctat

SEQ ID NO: 204506 - DNA, 25 bp, Mus musculus
agttcagaaaccatggtcgcttata

SEQ ID NO: 204507 - DNA, 25 bp, Mus musculus
agttcagaaaccatgtctcgaagat

SEQ ID NO: 204508 - DNA, 25 bp, Mus musculus
agttcagaagaggatgactgagtgg

SEQ ID NO: 204509 - DNA, 25 bp, Mus musculus
agttcagagacctcaacgaatccgt

SEQ ID NO: 204510 - DNA, 25 bp, Mus musculus
agttcagagctggcttccatggaga

SEQ ID NO: 204511 - DNA, 25 bp, Mus musculus
agttcagagtgtcaaaaccgctttc

SEQ ID NO: 204512 - DNA, 25 bp, Mus musculus
agttcagcaagctttgcagccagct

SEQ ID NO: 204513 - DNA, 25 bp, Mus musculus
agttcagcagaggagacagcagtgg

SEQ ID NO: 204514 - DNA, 25 bp, Mus musculus
agttcagcagcctgcagcagggcaa

SEQ ID NO: 204515 - DNA, 25 bp, Mus musculus
agttcagcaggataaaggcataatc

SEQ ID NO: 204516 - DNA, 25 bp, Mus musculus
agttcagcagggcacctacgcccgg

SEQ ID NO: 204517 - DNA, 25 bp, Mus musculus
agttcagccaggagggagcggacat

SEQ ID NO: 204518 - DNA, 25 bp, Mus musculus
agttcagcgggtcaggtatatgcac

SEQ ID NO: 204519 - DNA, 25 bp, Mus musculus
agttcagcgggtcaggtatggatga

SEQ ID NO: 204520 - DNA, 25 bp, Mus musculus
agttcaggaagctgatttcacaata

SEQ ID NO: 204521 - DNA, 25 bp, Mus musculus
agttcaggaaggtgcagacacaagt

SEQ ID NO: 204522 - DNA, 25 bp, Mus musculus
agttcaggacctctcctattacacg

SEQ ID NO: 204523 - DNA, 25 bp, Mus musculus
agttcaggcagctgtgctcactgct

SEQ ID NO: 204524 - DNA, 25 bp, Mus musculus
agttcaggcaggtaatgccatcatg

SEQ ID NO: 204525 - DNA, 25 bp, Mus musculus
agttcaggcttcaggtgcaggtcct

SEQ ID NO: 204526 - DNA, 25 bp, Mus musculus
agttcagggaagaatcggtttctgg

SEQ ID NO: 204527 - DNA, 25 bp, Mus musculus
agttcagggtgatgctctcccagtg

SEQ ID NO: 204528 - DNA, 25 bp, Mus musculus
agttcaggtacaagattgagaaatg

SEQ ID NO: 204529 - DNA, 25 bp, Mus musculus
agttcaggttctgagaaaacctatc

SEQ ID NO: 204530 - DNA, 25 bp, Mus musculus
agttcagtagctatgagccagaatt

SEQ ID NO: 204531 - DNA, 25 bp, Mus musculus
agttcagtgacagattgctgttctt

SEQ ID NO: 204532 - DNA, 25 bp, Mus musculus
agttcagtgatgacttggatgttgt

SEQ ID NO: 204533 - DNA, 25 bp, Mus musculus
agttcataaacaagatgaaattata

SEQ ID NO: 204534 - DNA, 25 bp, Mus musculus
agttcataaacaaggtcgctggtca

SEQ ID NO: 204535 - DNA, 25 bp, Mus musculus
agttcataatcaaggcgtatgggca

SEQ ID NO: 204536 - DNA, 25 bp, Mus musculus
agttcatcacgactgtgcaacagcg

SEQ ID NO: 204537 - DNA, 25 bp, Mus musculus
agttcatcagaggagaaatgggtct

SEQ ID NO: 204538 - DNA, 25 bp, Mus musculus
agttcatcagcgggcccctctccaa

SEQ ID NO: 204539 - DNA, 25 bp, Mus musculus
agttcatcaggtatttgtactgtgg

SEQ ID NO: 204540 - DNA, 25 bp, Mus musculus
agttcatccagtgagaaaattgtac

SEQ ID NO: 204541 - DNA, 25 bp, Mus musculus
agttcatccagtgaggaatcttccg

SEQ ID NO: 204542 - DNA, 25 bp, Mus musculus
agttcatgaaagatcgattatattt

SEQ ID NO: 204543 - DNA, 25 bp, Mus musculus
agttcatgaacacccagtattttgg

SEQ ID NO: 204544 - DNA, 25 bp, Mus musculus
agttcatgaaggaagcgggtgcagc

SEQ ID NO: 204545 - DNA, 25 bp, Mus musculus
agttcatgaaggaggatttcgatgt

SEQ ID NO: 204546 - DNA, 25 bp, Mus musculus
agttcatgacaagtgggccaatccg

SEQ ID NO: 204547 - DNA, 25 bp, Mus musculus
agttcatgaggatctaccgttacca

SEQ ID NO: 204548 - DNA, 25 bp, Mus musculus
agttcatgatggattgggtcgaaaa

SEQ ID NO: 204549 - DNA, 25 bp, Mus musculus
agttcatgcactttgccacaggcat

SEQ ID NO: 204550 - DNA, 25 bp, Mus musculus
agttcattttgaaacacgagaagcc

SEQ ID NO: 204551 - DNA, 25 bp, Mus musculus
agttccaacagactggattttggga

SEQ ID NO: 204552 - DNA, 25 bp, Mus musculus
agttccaacagtctgatgatttgaa

SEQ ID NO: 204553 - DNA, 25 bp, Mus musculus
agttccaactggggcacttccccac

SEQ ID NO: 204554 - DNA, 25 bp, Mus musculus
agttccaagaaaggtgcttacagac

SEQ ID NO: 204555 - DNA, 25 bp, Mus musculus
agttccaagaggtgggatgctatgg

SEQ ID NO: 204556 - DNA, 25 bp, Mus musculus
agttccaagcagcatgggtcggagc

SEQ ID NO: 204557 - DNA, 25 bp, Mus musculus
agttccacacccaggttctgattgg

SEQ ID NO: 204558 - DNA, 25 bp, Mus musculus
agttccacagaggttctatggtaca

SEQ ID NO: 204559 - DNA, 25 bp, Mus musculus
agttccaccaggcagcatctgagga

SEQ ID NO: 204560 - DNA, 25 bp, Mus musculus
agttccaccccacaggtatatacgg

SEQ ID NO: 204561 - DNA, 25 bp, Mus musculus
agttccactcctagctccacccccc

SEQ ID NO: 204562 - DNA, 25 bp, Mus musculus
agttccactgggctcccatcctgtg

SEQ ID NO: 204563 - DNA, 25 bp, Mus musculus
agttccagaaagtgatcacagaata

SEQ ID NO: 204564 - DNA, 25 bp, Mus musculus
agttccagaagaagaaataaagtgg

SEQ ID NO: 204565 - DNA, 25 bp, Mus musculus
agttccagataactgcctttgtacc

SEQ ID NO: 204566 - DNA, 25 bp, Mus musculus
agttccaggaggaagaagactcaga

SEQ ID NO: 204567 - DNA, 25 bp, Mus musculus
agttccatagtgatgttaattatct

SEQ ID NO: 204568 - DNA, 25 bp, Mus musculus
agttccattacaagaccgaccaggg

SEQ ID NO: 204569 - DNA, 25 bp, Mus musculus
agttccattgactaggccagggtca

SEQ ID NO: 204570 - DNA, 25 bp, Mus musculus
agttcccaacggggttaagcctgat

SEQ ID NO: 204571 - DNA, 25 bp, Mus musculus
agttcccactggcgctgaagtggag

SEQ ID NO: 204572 - DNA, 25 bp, Mus musculus
agttcccactggggctgaagtggag

SEQ ID NO: 204573 - DNA, 25 bp, Mus musculus
agttcccagtcagacactgcatatg

SEQ ID NO: 204574 - DNA, 25 bp, Mus musculus
agttcccagtcagagctctgaacat

SEQ ID NO: 204575 - DNA, 25 bp, Mus musculus
agttcccatgttgttgctggttgtt

SEQ ID NO: 204576 - DNA, 25 bp, Mus musculus
agttccccggtatccctctcacggc

SEQ ID NO: 204577 - DNA, 25 bp, Mus musculus
agttcccgatccaggtctctgagtg

SEQ ID NO: 204578 - DNA, 25 bp, Mus musculus
agttcccgcctggtctctctgggat

SEQ ID NO: 204579 - DNA, 25 bp, Mus musculus
agttccctccggatggttcagcccc

SEQ ID NO: 204580 - DNA, 25 bp, Mus musculus
agttccctcctggccttcccagagg

SEQ ID NO: 204581 - DNA, 25 bp, Mus musculus
agttccctggatgagcaagaaggag

SEQ ID NO: 204582 - DNA, 25 bp, Mus musculus
agttccctgtcctaggtagcagagg

SEQ ID NO: 204583 - DNA, 25 bp, Mus musculus
agttcccttcaaggcatgagagaat

SEQ ID NO: 204584 - DNA, 25 bp, Mus musculus
agttcccttctggccttcccagagg

SEQ ID NO: 204585 - DNA, 25 bp, Mus musculus
agttccgaaagaagtggaataagtg

SEQ ID NO: 204586 - DNA, 25 bp, Mus musculus
agttccgaaagatgtggaataagtg

SEQ ID NO: 204587 - DNA, 25 bp, Mus musculus
agttccggacctatgagtgtgatcc

SEQ ID NO: 204588 - DNA, 25 bp, Mus musculus
agttccgggcagggatttcagccat

SEQ ID NO: 204589 - DNA, 25 bp, Mus musculus
agttccgggtccaggcactttctag

SEQ ID NO: 204590 - DNA, 25 bp, Mus musculus
agttccggtcattaggttcaaccag

SEQ ID NO: 204591 - DNA, 25 bp, Mus musculus
agttccgttggcgtctccaaggccg

SEQ ID NO: 204592 - DNA, 25 bp, Mus musculus
agttccgttgggatccgcgcgggcc

SEQ ID NO: 204593 - DNA, 25 bp, Mus musculus
agttcctacctccagactttggttc

SEQ ID NO: 204594 - DNA, 25 bp, Mus musculus
agttcctacctccagaggttggcga

SEQ ID NO: 204595 - DNA, 25 bp, Mus musculus
agttcctacctccagatttaggtcg

SEQ ID NO: 204596 - DNA, 25 bp, Mus musculus
agttcctacctccaggcacttagcg

SEQ ID NO: 204597 - DNA, 25 bp, Mus musculus
agttcctacctccagtacctcactg

SEQ ID NO: 204598 - DNA, 25 bp, Mus musculus
agttcctatgtcacctccaagtaaa

SEQ ID NO: 204599 - DNA, 25 bp, Mus musculus
agttcctcaaacaagaaaaagagaa

SEQ ID NO: 204600 - DNA, 25 bp, Mus musculus
agttcctcaaacaagaagaatcctg

SEQ ID NO: 204601 - DNA, 25 bp, Mus musculus
agttcctcaaacaaggcaccaagga

SEQ ID NO: 204602 - DNA, 25 bp, Mus musculus
agttcctcaaagaaggtcagctggc

SEQ ID NO: 204603 - DNA, 25 bp, Mus musculus
agttcctcatttacgagcacgagtg

SEQ ID NO: 204604 - DNA, 25 bp, Mus musculus
agttcctgaaggttgctagacctga

SEQ ID NO: 204605 - DNA, 25 bp, Mus musculus
agttcctgagcggcatcccagagac

SEQ ID NO: 204606 - DNA, 25 bp, Mus musculus
agttcctgccccgtgaggagactgc

SEQ ID NO: 204607 - DNA, 25 bp, Mus musculus
agttcctgcgaggctgctccactac

SEQ ID NO: 204608 - DNA, 25 bp, Mus musculus
agttcctgcttcctgccacagcacc

SEQ ID NO: 204609 - DNA, 25 bp, Mus musculus
agttcctggaaatccactgcagctc

SEQ ID NO: 204610 - DNA, 25 bp, Mus musculus
agttcctggaaatgcacggggagat

SEQ ID NO: 204611 - DNA, 25 bp, Mus musculus
agttcctggacttcgggtcagtgaa

SEQ ID NO: 204612 - DNA, 25 bp, Mus musculus
agttcctggacttcggtatatccaa

SEQ ID NO: 204613 - DNA, 25 bp, Mus musculus
agttcctgtaaggagacgttcattt

SEQ ID NO: 204614 - DNA, 25 bp, Mus musculus
agttccttcgggcctctgaagaaca

SEQ ID NO: 204615 - DNA, 25 bp, Mus musculus
agttccttcggtgtgtcctggtcct

SEQ ID NO: 204616 - DNA, 25 bp, Mus musculus
agttcgaaagtgaagatatggagtc

SEQ ID NO: 204617 - DNA, 25 bp, Mus musculus
agttcgaataccggcatgtcatgtt

SEQ ID NO: 204618 - DNA, 25 bp, Mus musculus
agttcgaattgctctggcgttaaaa

SEQ ID NO: 204619 - DNA, 25 bp, Mus musculus
agttcgaattgttcactgaggaatt

SEQ ID NO: 204620 - DNA, 25 bp, Mus musculus
agttcgacgccttaaaagatgatga

SEQ ID NO: 204621 - DNA, 25 bp, Mus musculus
agttcgactccagctatgacaggga

SEQ ID NO: 204622 - DNA, 25 bp, Mus musculus
agttcgactccagctatgctcctac

SEQ ID NO: 204623 - DNA, 25 bp, Mus musculus
agttcgaggccagccggctacacag

SEQ ID NO: 204624 - DNA, 25 bp, Mus musculus
agttcgatgttcaggagcaggatat

SEQ ID NO: 204625 - DNA, 25 bp, Mus musculus
agttcgatgttcagggcaaccgtcc

SEQ ID NO: 204626 - DNA, 25 bp, Mus musculus
agttcgcaccacccctgccactgcc

SEQ ID NO: 204627 - DNA, 25 bp, Mus musculus
agttcgcagaacagaaactggacgc

SEQ ID NO: 204628 - DNA, 25 bp, Mus musculus
agttcgcagcctggacctggggatt

SEQ ID NO: 204629 - DNA, 25 bp, Mus musculus
agttcgcagcctgttcagaattggg

SEQ ID NO: 204630 - DNA, 25 bp, Mus musculus
agttcgcaggagggcgaagagaaag

SEQ ID NO: 204631 - DNA, 25 bp, Mus musculus
agttcgcctattgtggcaagtggtt

SEQ ID NO: 204632 - DNA, 25 bp, Mus musculus
agttcggacatctgtggttcggcag

SEQ ID NO: 204633 - DNA, 25 bp, Mus musculus
agttcggagaggctctgtctgccca

SEQ ID NO: 204634 - DNA, 25 bp, Mus musculus
agttcggagaggtggttctggaatg

SEQ ID NO: 204635 - DNA, 25 bp, Mus musculus
agttcggcaaagagacttctggtgc

SEQ ID NO: 204636 - DNA, 25 bp, Mus musculus
agttcggcaaaggtgacatttgcaa

SEQ ID NO: 204637 - DNA, 25 bp, Mus musculus
agttcggctacaggagatccagtca

SEQ ID NO: 204638 - DNA, 25 bp, Mus musculus
agttcgggcaggtgcagtaagtgct

SEQ ID NO: 204639 - DNA, 25 bp, Mus musculus
agttcgtagaagtggtgattgaagg

SEQ ID NO: 204640 - DNA, 25 bp, Mus musculus
agttcgtgcccaaggttgtccagag

SEQ ID NO: 204641 - DNA, 25 bp, Mus musculus
agttcgtggaaggcaagaagaaata

SEQ ID NO: 204642 - DNA, 25 bp, Mus musculus
agttcgtggaaggggaagacagcgc

SEQ ID NO: 204643 - DNA, 25 bp, Mus musculus
agttcgttttcctgggagactccag

SEQ ID NO: 204644 - DNA, 25 bp, Mus musculus
agttctaaagtgtcatatttgaaga

SEQ ID NO: 204645 - DNA, 25 bp, Mus musculus
agttctacaaccaagaaggtttgat

SEQ ID NO: 204646 - DNA, 25 bp, Mus musculus
agttctacaaccaaggagaatagca

SEQ ID NO: 204647 - DNA, 25 bp, Mus musculus
agttctacagcaagttcgatccttc

SEQ ID NO: 204648 - DNA, 25 bp, Mus musculus
agttctacaggcacatcatctttgc

SEQ ID NO: 204649 - DNA, 25 bp, Mus musculus
agttctacaggcctgagaataccca

SEQ ID NO: 204650 - DNA, 25 bp, Mus musculus
agttctacaggctgccacaggtgta

SEQ ID NO: 204651 - DNA, 25 bp, Mus musculus
agttctaccgcagtggctgggcact

SEQ ID NO: 204652 - DNA, 25 bp, Mus musculus
agttctacctgaaggatctgaaaac

SEQ ID NO: 204653 - DNA, 25 bp, Mus musculus
agttctactttaatggtgagtacgc

SEQ ID NO: 204654 - DNA, 25 bp, Mus musculus
agttctatagttcaggcatctacta

SEQ ID NO: 204655 - DNA, 25 bp, Mus musculus
agttctatatgctgtctcctaagaa

SEQ ID NO: 204656 - DNA, 25 bp, Mus musculus
agttctatatgttcgcatggacgca

SEQ ID NO: 204657 - DNA, 25 bp, Mus musculus
agttctatgatggagaatccgggct

SEQ ID NO: 204658 - DNA, 25 bp, Mus musculus
agttctcacaggacatgaaggcacc

SEQ ID NO: 204659 - DNA, 25 bp, Mus musculus
agttctcacaggtcatgaaggcacc

SEQ ID NO: 204660 - DNA, 25 bp, Mus musculus
agttctcatgtctgcccaggaccct

SEQ ID NO: 204661 - DNA, 25 bp, Mus musculus
agttctccagagccaaggctgttgt

SEQ ID NO: 204662 - DNA, 25 bp, Mus musculus
agttctcccaggttgttcctcaaag

SEQ ID NO: 204663 - DNA, 25 bp, Mus musculus
agttctctagaaccaggcagcgggc

SEQ ID NO: 204664 - DNA, 25 bp, Mus musculus
agttctctataaaaagaaaaatatt

SEQ ID NO: 204665 - DNA, 25 bp, Mus musculus
agttctctctaaacctttgacatgg

SEQ ID NO: 204666 - DNA, 25 bp, Mus musculus
agttctctgacaggaatgaatttca

SEQ ID NO: 204667 - DNA, 25 bp, Mus musculus
agttctctgagactcgtctgccaga

SEQ ID NO: 204668 - DNA, 25 bp, Mus musculus
agttctctgtaagtgcctggtgaag

SEQ ID NO: 204669 - DNA, 25 bp, Mus musculus
agttctctgtcgggtaagcagctgc

SEQ ID NO: 204670 - DNA, 25 bp, Mus musculus
agttctctgttcagcccttcccaca

SEQ ID NO: 204671 - DNA, 25 bp, Mus musculus
agttctctgttcaggatatgcagta

SEQ ID NO: 204672 - DNA, 25 bp, Mus musculus
agttctgaaacataatcacagaact

SEQ ID NO: 204673 - DNA, 25 bp, Mus musculus
agttctgaacagcagctcccgttac

SEQ ID NO: 204674 - DNA, 25 bp, Mus musculus
agttctgaacagcaggtcccaggat

SEQ ID NO: 204675 - DNA, 25 bp, Mus musculus
agttctgactgcgacatttacattg

SEQ ID NO: 204676 - DNA, 25 bp, Mus musculus
agttctgactgcggttgaaatgggc

SEQ ID NO: 204677 - DNA, 25 bp, Mus musculus
agttctgagaaagacaactgaggat

SEQ ID NO: 204678 - DNA, 25 bp, Mus musculus
agttctgatcttgaacggggtgcca

SEQ ID NO: 204679 - DNA, 25 bp, Mus musculus
agttctgcaaggatgaattgtctgg

SEQ ID NO: 204680 - DNA, 25 bp, Mus musculus
agttctgcaccagcaggaagtgatg

SEQ ID NO: 204681 - DNA, 25 bp, Mus musculus
agttctgcaccaggcatagcaggaa

SEQ ID NO: 204682 - DNA, 25 bp, Mus musculus
agttctgcagagttctacagcctcc

SEQ ID NO: 204683 - DNA, 25 bp, Mus musculus
agttctgcaggacaatgccttagcc

SEQ ID NO: 204684 - DNA, 25 bp, Mus musculus
agttctgccagcgcctgtgagagag

SEQ ID NO: 204685 - DNA, 25 bp, Mus musculus
agttctgccagtgtgattttgacat

SEQ ID NO: 204686 - DNA, 25 bp, Mus musculus
agttctggaatatcctggaccatgc

SEQ ID NO: 204687 - DNA, 25 bp, Mus musculus
agttctggagacccggatgggagcc

SEQ ID NO: 204688 - DNA, 25 bp, Mus musculus
agttctggctcagatgcgattcatg

SEQ ID NO: 204689 - DNA, 25 bp, Mus musculus
agttctgggaagcttccagctttat

SEQ ID NO: 204690 - DNA, 25 bp, Mus musculus
agttctgggaagtctccaggctttg

SEQ ID NO: 204691 - DNA, 25 bp, Mus musculus
agttctgggagaacaaagtattgag

SEQ ID NO: 204692 - DNA, 25 bp, Mus musculus
agttctgggtgaaggagagtttggg

SEQ ID NO: 204693 - DNA, 25 bp, Mus musculus
agttctgttgcaagcctacttctcc

SEQ ID NO: 204694 - DNA, 25 bp, Mus musculus
agttctgttgcaaggtgatctctgc

SEQ ID NO: 204695 - DNA, 25 bp, Mus musculus
agttcttaacaggcacgtgacacaa

SEQ ID NO: 204696 - DNA, 25 bp, Mus musculus
agttcttaccagaacttgatcacca

SEQ ID NO: 204697 - DNA, 25 bp, Mus musculus
agttcttaccagagttctggccagg

SEQ ID NO: 204698 - DNA, 25 bp, Mus musculus
agttcttaccagatgacaaatcatc

SEQ ID NO: 204699 - DNA, 25 bp, Mus musculus
agttcttcaagaatgacattgtcaa

SEQ ID NO: 204700 - DNA, 25 bp, Mus musculus
agttcttcaccagcccagagaactc

SEQ ID NO: 204701 - DNA, 25 bp, Mus musculus
agttcttcagagagatgacataaca

SEQ ID NO: 204702 - DNA, 25 bp, Mus musculus
agttcttcagagggtttcatatgtc

SEQ ID NO: 204703 - DNA, 25 bp, Mus musculus
agttcttcagagggtttcatctgcc

SEQ ID NO: 204704 - DNA, 25 bp, Mus musculus
agttcttcagtgctgagcctaccac

SEQ ID NO: 204705 - DNA, 25 bp, Mus musculus
agttcttcgtgacgataagtgggca

SEQ ID NO: 204706 - DNA, 25 bp, Mus musculus
agttcttcgtgacgttattagaagc

SEQ ID NO: 204707 - DNA, 25 bp, Mus musculus
agttcttcgttgggggcactcagaa

SEQ ID NO: 204708 - DNA, 25 bp, Mus musculus
agttcttctcaggggaggagtacgg

SEQ ID NO: 204709 - DNA, 25 bp, Mus musculus
agttcttctcagggttggaaatcgt

SEQ ID NO: 204710 - DNA, 25 bp, Mus musculus
agttcttctcaggtatattgaaata

SEQ ID NO: 204711 - DNA, 25 bp, Mus musculus
agttcttctggcaccagcccatcaa

SEQ ID NO: 204712 - DNA, 25 bp, Mus musculus
agttcttgcatggggatgatgactc

SEQ ID NO: 204713 - DNA, 25 bp, Mus musculus
agttcttgcctgcaggaagcaccat

SEQ ID NO: 204714 - DNA, 25 bp, Mus musculus
agttcttgcctgcagttccgtttcc

SEQ ID NO: 204715 - DNA, 25 bp, Mus musculus
agttcttgtgggaagcattcaacta

SEQ ID NO: 204716 - DNA, 25 bp, Mus musculus
agttcttgtgggggatgcttggcct

SEQ ID NO: 204717 - DNA, 25 bp, Mus musculus
agttcttgtgggtggccatgcagat

SEQ ID NO: 204718 - DNA, 25 bp, Mus musculus
agttcttgtttcaggaaatggctgc

SEQ ID NO: 204719 - DNA, 25 bp, Mus musculus
agttcttgtttcaggacttcctcca

SEQ ID NO: 204720 - DNA, 25 bp, Mus musculus
agttcttgtttctgactctaaaaca

SEQ ID NO: 204721 - DNA, 25 bp, Mus musculus
agttcttgtttctggatccttgaca

SEQ ID NO: 204722 - DNA, 25 bp, Mus musculus
agttctttatttgagtgcagcagct

SEQ ID NO: 204723 - DNA, 25 bp, Mus musculus
agttctttcgatgcggaatataagc

SEQ ID NO: 204724 - DNA, 25 bp, Mus musculus
agttctttcgttgcggaatataagc

SEQ ID NO: 204725 - DNA, 25 bp, Mus musculus
agttctttctgaggtgtcagatgcc

SEQ ID NO: 204726 - DNA, 25 bp, Mus musculus
agttcttttaggaagctcaataaag

SEQ ID NO: 204727 - DNA, 25 bp, Mus musculus
agttgaaacaagggggagaagcgag

SEQ ID NO: 204728 - DNA, 25 bp, Mus musculus
agttgaaacactatggatcgcagct

SEQ ID NO: 204729 - DNA, 25 bp, Mus musculus
agttgaaactgttatctgggagtat

SEQ ID NO: 204730 - DNA, 25 bp, Mus musculus
agttgaaactttagtgccatggcag

SEQ ID NO: 204731 - DNA, 25 bp, Mus musculus
agttgaagaagagcctggaagtggg

SEQ ID NO: 204732 - DNA, 25 bp, Mus musculus
agttgaagaagtgggaatccggaag

SEQ ID NO: 204733 - DNA, 25 bp, Mus musculus
agttgaagagatccacgtctctcgt

SEQ ID NO: 204734 - DNA, 25 bp, Mus musculus
agttgaagaggcacagagaactgaa

SEQ ID NO: 204735 - DNA, 25 bp, Mus musculus
agttgaatcaggagcttacagatgt

SEQ ID NO: 204736 - DNA, 25 bp, Mus musculus
agttgacacactggagggagactgt

SEQ ID NO: 204737 - DNA, 25 bp, Mus musculus
agttgacagagaaagatgccaagct

SEQ ID NO: 204738 - DNA, 25 bp, Mus musculus
agttgacatccgacttcgccctcag

SEQ ID NO: 204739 - DNA, 25 bp, Mus musculus
agttgaccccaggccctgcaggtcg

SEQ ID NO: 204740 - DNA, 25 bp, Mus musculus
agttgagatggagtctctagccaag

SEQ ID NO: 204741 - DNA, 25 bp, Mus musculus
agttgagcctcaggactcagagagg

SEQ ID NO: 204742 - DNA, 25 bp, Mus musculus
agttgagcggcggctggtaagaaca

SEQ ID NO: 204743 - DNA, 25 bp, Mus musculus
agttgagcttaatgctttaatgact

SEQ ID NO: 204744 - DNA, 25 bp, Mus musculus
agttgagcttaatgtttgttaacgc

SEQ ID NO: 204745 - DNA, 25 bp, Mus musculus
agttgaggcctgggtgtgcattatg

SEQ ID NO: 204746 - DNA, 25 bp, Mus musculus
agttgagttattggtaacttcaatt

SEQ ID NO: 204747 - DNA, 25 bp, Mus musculus
agttgataaagactccattagcaga

SEQ ID NO: 204748 - DNA, 25 bp, Mus musculus
agttgatctggtgtgttatcgacga

SEQ ID NO: 204749 - DNA, 25 bp, Mus musculus
agttgatcttaataatcctattgca

SEQ ID NO: 204750 - DNA, 25 bp, Mus musculus
agttgatgcaaggctttcctttgat

SEQ ID NO: 204751 - DNA, 25 bp, Mus musculus
agttgatgcaagggagctggaggaa

SEQ ID NO: 204752 - DNA, 25 bp, Mus musculus
agttgattgggaatttggcagctgg

SEQ ID NO: 204753 - DNA, 25 bp, Mus musculus
agttgatttgagggatggagagtca

SEQ ID NO: 204754 - DNA, 25 bp, Mus musculus
agttgcaagatgcaggccccttccc

SEQ ID NO: 204755 - DNA, 25 bp, Mus musculus
agttgcacaaggtcattgaagccag

SEQ ID NO: 204756 - DNA, 25 bp, Mus musculus
agttgcagagaaccccaaaggtact

SEQ ID NO: 204757 - DNA, 25 bp, Mus musculus
agttgcagagacctcagacagctcc

SEQ ID NO: 204758 - DNA, 25 bp, Mus musculus
agttgcagatactcagcctcaggga

SEQ ID NO: 204759 - DNA, 25 bp, Mus musculus
agttgccacaccatataccgaagca

SEQ ID NO: 204760 - DNA, 25 bp, Mus musculus
agttgccacaccatatataaactac

SEQ ID NO: 204761 - DNA, 25 bp, Mus musculus
agttgccagcccaaagaggatctaa

SEQ ID NO: 204762 - DNA, 25 bp, Mus musculus
agttgccatcattggaaagatctat

SEQ ID NO: 204763 - DNA, 25 bp, Mus musculus
agttgcccctataaaaactccgatg

SEQ ID NO: 204764 - DNA, 25 bp, Mus musculus
agttgccctgactctaccgcaccct

SEQ ID NO: 204765 - DNA, 25 bp, Mus musculus
agttgcctacatgtagctgagacct

SEQ ID NO: 204766 - DNA, 25 bp, Mus musculus
agttgcctcaagacatttgagggac

SEQ ID NO: 204767 - DNA, 25 bp, Mus musculus
agttgcctcaaggtcctctgtctct

SEQ ID NO: 204768 - DNA, 25 bp, Mus musculus
agttgcctcagcaccaaggagatcc

SEQ ID NO: 204769 - DNA, 25 bp, Mus musculus
agttgcctcggagtttcagcctcaa

SEQ ID NO: 204770 - DNA, 25 bp, Mus musculus
agttgcctgactcgctcggaagctg

SEQ ID NO: 204771 - DNA, 25 bp, Mus musculus
agttgcctgtgagaaggccctgggg

SEQ ID NO: 204772 - DNA, 25 bp, Mus musculus
agttgcctttccccggaggaattcg

SEQ ID NO: 204773 - DNA, 25 bp, Mus musculus
agttgctaaaactgccttggggtgc

SEQ ID NO: 204774 - DNA, 25 bp, Mus musculus
agttgctaaaagtgcctcctgagaa

SEQ ID NO: 204775 - DNA, 25 bp, Mus musculus
agttgctaaacagcatccagggaaa

SEQ ID NO: 204776 - DNA, 25 bp, Mus musculus
agttgctcaggcagtgcttttacat

SEQ ID NO: 204777 - DNA, 25 bp, Mus musculus
agttgctccccagccctgaggtgcg

SEQ ID NO: 204778 - DNA, 25 bp, Mus musculus
agttgctgaggttgccaagaagttg

SEQ ID NO: 204779 - DNA, 25 bp, Mus musculus
agttgctgcagacccgtggattccc

SEQ ID NO: 204780 - DNA, 25 bp, Mus musculus
agttgctgctgattttcatttcctc

SEQ ID NO: 204781 - DNA, 25 bp, Mus musculus
agttgctgctggtgccagggtgtca

SEQ ID NO: 204782 - DNA, 25 bp, Mus musculus
agttgctgtgaaaccgggctccatg

SEQ ID NO: 204783 - DNA, 25 bp, Mus musculus
agttgctgttatcggaaataaagaa

SEQ ID NO: 204784 - DNA, 25 bp, Mus musculus
agttgcttagaggctcttgaaatgg

SEQ ID NO: 204785 - DNA, 25 bp, Mus musculus
agttgcttctcaccaaggtctgagt

SEQ ID NO: 204786 - DNA, 25 bp, Mus musculus
agttgcttctgttaggtgctggaga

SEQ ID NO: 204787 - DNA, 25 bp, Mus musculus
agttgctttctgtgaggccaggttc

SEQ ID NO: 204788 - DNA, 25 bp, Mus musculus
agttgctttctgtttctaatcctgg

SEQ ID NO: 204789 - DNA, 25 bp, Mus musculus
agttgcttttaaaggattaaaggag

SEQ ID NO: 204790 - DNA, 25 bp, Mus musculus
agttggaaaaggagaagctacttgc

SEQ ID NO: 204791 - DNA, 25 bp, Mus musculus
agttggaaaggcatttacactcttc

SEQ ID NO: 204792 - DNA, 25 bp, Mus musculus
agttggaaatcagcaagaagagaac

SEQ ID NO: 204793 - DNA, 25 bp, Mus musculus
agttggaaatcaggggtctgcaaca

SEQ ID NO: 204794 - DNA, 25 bp, Mus musculus
agttggaaggctccgcccactaccg

SEQ ID NO: 204795 - DNA, 25 bp, Mus musculus
agttggaatcagggctacggctacc

SEQ ID NO: 204796 - DNA, 25 bp, Mus musculus
agttggacaagatgcaagttctgct

SEQ ID NO: 204797 - DNA, 25 bp, Mus musculus
agttggacagagctggcaagggaac

SEQ ID NO: 204798 - DNA, 25 bp, Mus musculus
agttggagatgacatgtttcattgg

SEQ ID NO: 204799 - DNA, 25 bp, Mus musculus
agttggagatgtgggctgcgaccca

SEQ ID NO: 204800 - DNA, 25 bp, Mus musculus
agttggagatgtgtccagacctttt

SEQ ID NO: 204801 - DNA, 25 bp, Mus musculus
agttggagcaggccctgcaggaaag

SEQ ID NO: 204802 - DNA, 25 bp, Mus musculus
agttggatctcataagagaggagcc

SEQ ID NO: 204803 - DNA, 25 bp, Mus musculus
agttggatgaaaattccaagttgta

SEQ ID NO: 204804 - DNA, 25 bp, Mus musculus
agttggcatccaaggtccagggagt

SEQ ID NO: 204805 - DNA, 25 bp, Mus musculus
agttggccaaggtgtttcccagcca

SEQ ID NO: 204806 - DNA, 25 bp, Mus musculus
agttggccaggaaggggagccaggc

SEQ ID NO: 204807 - DNA, 25 bp, Mus musculus
agttggcccggcccactcagaggct

SEQ ID NO: 204808 - DNA, 25 bp, Mus musculus
agttggccgatatgaaaatccatgg

SEQ ID NO: 204809 - DNA, 25 bp, Mus musculus
agttggcgattagactctgccttca

SEQ ID NO: 204810 - DNA, 25 bp, Mus musculus
agttggcgattagaggtctgacatg

SEQ ID NO: 204811 - DNA, 25 bp, Mus musculus
agttggctgcccaaggtgaacttga

SEQ ID NO: 204812 - DNA, 25 bp, Mus musculus
agttggctgcccaaggttgttgcta

SEQ ID NO: 204813 - DNA, 25 bp, Mus musculus
agttggctggagggaaggtggctgg

SEQ ID NO: 204814 - DNA, 25 bp, Mus musculus
agttggctggtggagtgttctccag

SEQ ID NO: 204815 - DNA, 25 bp, Mus musculus
agttggcttggcttgagatttttaa

SEQ ID NO: 204816 - DNA, 25 bp, Mus musculus
agttggctttaacaatctccattcg

SEQ ID NO: 204817 - DNA, 25 bp, Mus musculus
agttgggaagagtgccatgacaatg

SEQ ID NO: 204818 - DNA, 25 bp, Mus musculus
agttgggaagagtgtgtcctgagtt

SEQ ID NO: 204819 - DNA, 25 bp, Mus musculus
agttggtaaagagcatcataagggt

SEQ ID NO: 204820 - DNA, 25 bp, Mus musculus
agttggtaaatgtttatggagccgt

SEQ ID NO: 204821 - DNA, 25 bp, Mus musculus
agttggtaatggagcccgagttcgt

SEQ ID NO: 204822 - DNA, 25 bp, Mus musculus
agttggtaggtgcgccaaacagtgg

SEQ ID NO: 204823 - DNA, 25 bp, Mus musculus
agttggtcaagtgcatcgaggagtt

SEQ ID NO: 204824 - DNA, 25 bp, Mus musculus
agttggtccatatatttcttctgat

SEQ ID NO: 204825 - DNA, 25 bp, Mus musculus
agttggtccttctggagcccctggt

SEQ ID NO: 204826 - DNA, 25 bp, Mus musculus
agttggtgaagaaacttgtggaaac

SEQ ID NO: 204827 - DNA, 25 bp, Mus musculus
agttggtggctacctgaagctgatg

SEQ ID NO: 204828 - DNA, 25 bp, Mus musculus
agttggtgtggaggctcatctcaga

SEQ ID NO: 204829 - DNA, 25 bp, Mus musculus
agttggtgtggaggggctcctctgt

SEQ ID NO: 204830 - DNA, 25 bp, Mus musculus
agttggttcaggtggaacatccaga

SEQ ID NO: 204831 - DNA, 25 bp, Mus musculus
agttggttcagtatcctgtggaaca

SEQ ID NO: 204832 - DNA, 25 bp, Mus musculus
agttggttgggtgaatttcatgatt

SEQ ID NO: 204833 - DNA, 25 bp, Mus musculus
agttggttttgaagaaaggctttgg

SEQ ID NO: 204834 - DNA, 25 bp, Mus musculus
agttgtaattccaactctggttgac

SEQ ID NO: 204835 - DNA, 25 bp, Mus musculus
agttgtagagggcatctcctcccaa

SEQ ID NO: 204836 - DNA, 25 bp, Mus musculus
agttgtaggacaaaggtatggcttt

SEQ ID NO: 204837 - DNA, 25 bp, Mus musculus
agttgtcaacaagctcattcagttc

SEQ ID NO: 204838 - DNA, 25 bp, Mus musculus
agttgtcaatcagcacaatgctcca

SEQ ID NO: 204839 - DNA, 25 bp, Mus musculus
agttgtcagcgactgggtgccattg

SEQ ID NO: 204840 - DNA, 25 bp, Mus musculus
agttgtcatccacacctccatccca

SEQ ID NO: 204841 - DNA, 25 bp, Mus musculus
agttgtccaagattttaccggaaga

SEQ ID NO: 204842 - DNA, 25 bp, Mus musculus
agttgtccaaggaatgtggcttcgg

SEQ ID NO: 204843 - DNA, 25 bp, Mus musculus
agttgtccagagccaccagccatgc

SEQ ID NO: 204844 - DNA, 25 bp, Mus musculus
agttgtccatcaaagccccagaaga

SEQ ID NO: 204845 - DNA, 25 bp, Mus musculus
agttgtccatcaaagctgacttctc

SEQ ID NO: 204846 - DNA, 25 bp, Mus musculus
agttgtccccttcgcggccgtcaga

SEQ ID NO: 204847 - DNA, 25 bp, Mus musculus
agttgtccccttcggatgaattgtc

SEQ ID NO: 204848 - DNA, 25 bp, Mus musculus
agttgtccctgaggagcagggcatt

SEQ ID NO: 204849 - DNA, 25 bp, Mus musculus
agttgtccgcccgagatcatcagaa

SEQ ID NO: 204850 - DNA, 25 bp, Mus musculus
agttgtcgggcagaactgtgtctgt

SEQ ID NO: 204851 - DNA, 25 bp, Mus musculus
agttgtcgggcagccagccattcat

SEQ ID NO: 204852 - DNA, 25 bp, Mus musculus
agttgtctacgtcacagagctgctg

SEQ ID NO: 204853 - DNA, 25 bp, Mus musculus
agttgtgagaataagttcaaggtgc

SEQ ID NO: 204854 - DNA, 25 bp, Mus musculus
agttgtgagagaaggaagaggcaaa

SEQ ID NO: 204855 - DNA, 25 bp, Mus musculus
agttgtgatcttattaattggaggc

SEQ ID NO: 204856 - DNA, 25 bp, Mus musculus
agttgtgatcttggaggctggtcca

SEQ ID NO: 204857 - DNA, 25 bp, Mus musculus
agttgtgcattggactcgttactgg

SEQ ID NO: 204858 - DNA, 25 bp, Mus musculus
agttgtggtgactgacctatccgct

SEQ ID NO: 204859 - DNA, 25 bp, Mus musculus
agttgtgtgccaccatttgaaaggc

SEQ ID NO: 204860 - DNA, 25 bp, Mus musculus
agttgtgtgccattgctgctgattt

SEQ ID NO: 204861 - DNA, 25 bp, Mus musculus
agttgttcaagagaaaccatttatt

SEQ ID NO: 204862 - DNA, 25 bp, Mus musculus
agttgttcaagatgggagaatgaag

SEQ ID NO: 204863 - DNA, 25 bp, Mus musculus
agttgttcatgtcctgaaggggaag

SEQ ID NO: 204864 - DNA, 25 bp, Mus musculus
agttgttgagctctgaactcactga

SEQ ID NO: 204865 - DNA, 25 bp, Mus musculus
agttgttggagacaaagctggctgc

SEQ ID NO: 204866 - DNA, 25 bp, Mus musculus
agttgttggaggaactgctgaagaa

SEQ ID NO: 204867 - DNA, 25 bp, Mus musculus
agttgttggcagagaactgatagaa

SEQ ID NO: 204868 - DNA, 25 bp, Mus musculus
agttgttggcaggtattcaatacac

SEQ ID NO: 204869 - DNA, 25 bp, Mus musculus
agttgttgttcaagctgcctcaggc

SEQ ID NO: 204870 - DNA, 25 bp, Mus musculus
agttgttgttcaaggaatatagagc

SEQ ID NO: 204871 - DNA, 25 bp, Mus musculus
agttgtttaacggtagcgcctggca

SEQ ID NO: 204872 - DNA, 25 bp, Mus musculus
agttgtttgacttaccatgctcgca

SEQ ID NO: 204873 - DNA, 25 bp, Mus musculus
agtttaaagatgaacatctcagcgg

SEQ ID NO: 204874 - DNA, 25 bp, Mus musculus
agtttaaagcaaggtgaatgtttga

SEQ ID NO: 204875 - DNA, 25 bp, Mus musculus
agtttaaatgcagacttaattcagg

SEQ ID NO: 204876 - DNA, 25 bp, Mus musculus
agtttaaatgcaggtctcagccagt

SEQ ID NO: 204877 - DNA, 25 bp, Mus musculus
agtttaacaagacagtggagcatgg

SEQ ID NO: 204878 - DNA, 25 bp, Mus musculus
agtttaacacacaagattcttccag

SEQ ID NO: 204879 - DNA, 25 bp, Mus musculus
agtttaacacacaagcctccatgca

SEQ ID NO: 204880 - DNA, 25 bp, Mus musculus
agtttaaggagagagctttccctcc

SEQ ID NO: 204881 - DNA, 25 bp, Mus musculus
agtttaaggagagaggagcaagtgt

SEQ ID NO: 204882 - DNA, 25 bp, Mus musculus
agtttaattatgatggagaagaaac

SEQ ID NO: 204883 - DNA, 25 bp, Mus musculus
agtttaattatggtatgcagccact

SEQ ID NO: 204884 - DNA, 25 bp, Mus musculus
agtttacaaaatgagacctgggcgg

SEQ ID NO: 204885 - DNA, 25 bp, Mus musculus
agtttacaattcctgtacactcacg

SEQ ID NO: 204886 - DNA, 25 bp, Mus musculus
agtttacagagaggaccatctgcga

SEQ ID NO: 204887 - DNA, 25 bp, Mus musculus
agtttacagccacagccacaacctg

SEQ ID NO: 204888 - DNA, 25 bp, Mus musculus
agtttacctaccaggacctgatctc

SEQ ID NO: 204889 - DNA, 25 bp, Mus musculus
agtttacgaactcggctaccaagag

SEQ ID NO: 204890 - DNA, 25 bp, Mus musculus
agtttacgggggaggctgctctgag

SEQ ID NO: 204891 - DNA, 25 bp, Mus musculus
agtttagagccaggttcaatataca

SEQ ID NO: 204892 - DNA, 25 bp, Mus musculus
agtttagtgtagcacttactagtgg

SEQ ID NO: 204893 - DNA, 25 bp, Mus musculus
agtttagtgtagcttgaactttcca

SEQ ID NO: 204894 - DNA, 25 bp, Mus musculus
agtttagtgtagttccctcctttag

SEQ ID NO: 204895 - DNA, 25 bp, Mus musculus
agtttataagggtcgtcatgtcaaa

SEQ ID NO: 204896 - DNA, 25 bp, Mus musculus
agtttatacagatctttcatttgtc

SEQ ID NO: 204897 - DNA, 25 bp, Mus musculus
agtttatacagggtgacatttgtga

SEQ ID NO: 204898 - DNA, 25 bp, Mus musculus
agtttatagattctgattcttcgtg

SEQ ID NO: 204899 - DNA, 25 bp, Mus musculus
agtttatagattctttcttgaacac

SEQ ID NO: 204900 - DNA, 25 bp, Mus musculus
agtttatcaaagtcatgtaggaaat

SEQ ID NO: 204901 - DNA, 25 bp, Mus musculus
agtttatgatgagtttgtgacttaa

SEQ ID NO: 204902 - DNA, 25 bp, Mus musculus
agtttattacagcactcaaatctac

SEQ ID NO: 204903 - DNA, 25 bp, Mus musculus
agtttattacagtgtgttcaaagca

SEQ ID NO: 204904 - DNA, 25 bp, Mus musculus
agtttcacaagtggatagagagagt

SEQ ID NO: 204905 - DNA, 25 bp, Mus musculus
agtttcagagtttctaagctgacta

SEQ ID NO: 204906 - DNA, 25 bp, Mus musculus
agtttcagcacaacaatgcagatag

SEQ ID NO: 204907 - DNA, 25 bp, Mus musculus
agtttcagcacaacatgggaaaacc

SEQ ID NO: 204908 - DNA, 25 bp, Mus musculus
agtttcagccctcagtggaccctga

SEQ ID NO: 204909 - DNA, 25 bp, Mus musculus
agtttcagttacaagcaacaacaac

SEQ ID NO: 204910 - DNA, 25 bp, Mus musculus
agtttcagttacaaggcaatgtatg

SEQ ID NO: 204911 - DNA, 25 bp, Mus musculus
agtttcataacatagactgaaacag

SEQ ID NO: 204912 - DNA, 25 bp, Mus musculus
agtttcatccagggtcacaaaccta

SEQ ID NO: 204913 - DNA, 25 bp, Mus musculus
agtttccaaaagctcctggctagag

SEQ ID NO: 204914 - DNA, 25 bp, Mus musculus
agtttccacaccgacactgcaaatg

SEQ ID NO: 204915 - DNA, 25 bp, Mus musculus
agtttccacagaatggactcgctac

SEQ ID NO: 204916 - DNA, 25 bp, Mus musculus
agtttccagcaagttctggatgatt

SEQ ID NO: 204917 - DNA, 25 bp, Mus musculus
agtttccagctggagggagagcgtg

SEQ ID NO: 204918 - DNA, 25 bp, Mus musculus
agtttccatagaaccagtcttcagt

SEQ ID NO: 204919 - DNA, 25 bp, Mus musculus
agtttcccccacttacagactgaag

SEQ ID NO: 204920 - DNA, 25 bp, Mus musculus
agtttccggagggactcaaagctgg

SEQ ID NO: 204921 - DNA, 25 bp, Mus musculus
agtttccgtgcctttgaagatgagc

SEQ ID NO: 204922 - DNA, 25 bp, Mus musculus
agtttcctagattgcttcctgagga

SEQ ID NO: 204923 - DNA, 25 bp, Mus musculus
agtttcctctacagacagaccctgc

SEQ ID NO: 204924 - DNA, 25 bp, Mus musculus
agtttcctctacaggggacctggct

SEQ ID NO: 204925 - DNA, 25 bp, Mus musculus
agtttcctgcagctatccttcgggg

SEQ ID NO: 204926 - DNA, 25 bp, Mus musculus
agtttcctgggagaaacactcatca

SEQ ID NO: 204927 - DNA, 25 bp, Mus musculus
agtttcctgttcggaacctggactt

SEQ ID NO: 204928 - DNA, 25 bp, Mus musculus
agtttccttgcagatatactgctgt

SEQ ID NO: 204929 - DNA, 25 bp, Mus musculus
agtttccttgcaggtccattcacac

SEQ ID NO: 204930 - DNA, 25 bp, Mus musculus
agtttcgagctggggttattcccaa

SEQ ID NO: 204931 - DNA, 25 bp, Mus musculus
agtttcggccggacgctagcagaat

SEQ ID NO: 204932 - DNA, 25 bp, Mus musculus
agtttcggccggacgggaagcttag

SEQ ID NO: 204933 - DNA, 25 bp, Mus musculus
agtttcgtcaagatcaaggtcacca

SEQ ID NO: 204934 - DNA, 25 bp, Mus musculus
agtttcgtcaaggtcaccaaggctg

SEQ ID NO: 204935 - DNA, 25 bp, Mus musculus
agtttctacccagaggaagaatttg

SEQ ID NO: 204936 - DNA, 25 bp, Mus musculus
agtttctagacttcggatccagcaa

SEQ ID NO: 204937 - DNA, 25 bp, Mus musculus
agtttctatgccgatcaaaaggaaa

SEQ ID NO: 204938 - DNA, 25 bp, Mus musculus
agtttctcaagggttgagctccata

SEQ ID NO: 204939 - DNA, 25 bp, Mus musculus
agtttctcagaatcccctggttgaa

SEQ ID NO: 204940 - DNA, 25 bp, Mus musculus
agtttctcagtgacatcactgagga

SEQ ID NO: 204941 - DNA, 25 bp, Mus musculus
agtttctcgcagagtgttcctgact

SEQ ID NO: 204942 - DNA, 25 bp, Mus musculus
agtttctcgcagatatattaccaaa

SEQ ID NO: 204943 - DNA, 25 bp, Mus musculus
agtttctctaccaggtctgtcacct

SEQ ID NO: 204944 - DNA, 25 bp, Mus musculus
agtttctctagatttcaccaacgta

SEQ ID NO: 204945 - DNA, 25 bp, Mus musculus
agtttctgcagacttgtactggttt

SEQ ID NO: 204946 - DNA, 25 bp, Mus musculus
agtttctgctctgaaggaaagagat

SEQ ID NO: 204947 - DNA, 25 bp, Mus musculus
agtttctgctctgcatggtgacatg

SEQ ID NO: 204948 - DNA, 25 bp, Mus musculus
agtttctgctctggcccgtgggatt

SEQ ID NO: 204949 - DNA, 25 bp, Mus musculus
agtttctgcttgatgtcctagaaga

SEQ ID NO: 204950 - DNA, 25 bp, Mus musculus
agtttctgtgaagatgggaaataag

SEQ ID NO: 204951 - DNA, 25 bp, Mus musculus
agtttctgttctctgatttggggat

SEQ ID NO: 204952 - DNA, 25 bp, Mus musculus
agtttctgttctctggcgtaatagc

SEQ ID NO: 204953 - DNA, 25 bp, Mus musculus
agtttctgttctctggtgaagaaat

SEQ ID NO: 204954 - DNA, 25 bp, Mus musculus
agtttcttgcaaagatcactggaga

SEQ ID NO: 204955 - DNA, 25 bp, Mus musculus
agtttcttgggaggaagtccacatt

SEQ ID NO: 204956 - DNA, 25 bp, Mus musculus
agtttctttctgcctgcacatttca

SEQ ID NO: 204957 - DNA, 25 bp, Mus musculus
agtttcttttggaggtgcagtgtat

SEQ ID NO: 204958 - DNA, 25 bp, Mus musculus
agtttgaaaggatgtcttccaagcg

SEQ ID NO: 204959 - DNA, 25 bp, Mus musculus
agtttgaaagggtacagtaagcgag

SEQ ID NO: 204960 - DNA, 25 bp, Mus musculus
agtttgaaatcattgctatgtccac

SEQ ID NO: 204961 - DNA, 25 bp, Mus musculus
agtttgaaatctgatggttaccaca

SEQ ID NO: 204962 - DNA, 25 bp, Mus musculus
agtttgaaatgtcagactcattgaa

SEQ ID NO: 204963 - DNA, 25 bp, Mus musculus
agtttgaaatgtcaggatgccccag

SEQ ID NO: 204964 - DNA, 25 bp, Mus musculus
agtttgaataataggaatatccgaa

SEQ ID NO: 204965 - DNA, 25 bp, Mus musculus
agtttgaataatatttccctcatgg

SEQ ID NO: 204966 - DNA, 25 bp, Mus musculus
agtttgaatgtccaggaccccctgg

SEQ ID NO: 204967 - DNA, 25 bp, Mus musculus
agtttgacaaaggaaaaagaggcct

SEQ ID NO: 204968 - DNA, 25 bp, Mus musculus
agtttgacaagatgaatgaccagga

SEQ ID NO: 204969 - DNA, 25 bp, Mus musculus
agtttgacaggacacagagctgcag

SEQ ID NO: 204970 - DNA, 25 bp, Mus musculus
agtttgaccccccagacttctggac

SEQ ID NO: 204971 - DNA, 25 bp, Mus musculus
agtttgactatcagcatggggctgc

SEQ ID NO: 204972 - DNA, 25 bp, Mus musculus
agtttgactatcaggacctccagga

SEQ ID NO: 204973 - DNA, 25 bp, Mus musculus
agtttgactggagacagcagtatgt

SEQ ID NO: 204974 - DNA, 25 bp, Mus musculus
agtttgactgggccatgccgctgat

SEQ ID NO: 204975 - DNA, 25 bp, Mus musculus
agtttgagcagaagtggttcccagt

SEQ ID NO: 204976 - DNA, 25 bp, Mus musculus
agtttgaggagcagttcctgaatgc

SEQ ID NO: 204977 - DNA, 25 bp, Mus musculus
agtttgaggaggctcaacgcacagc

SEQ ID NO: 204978 - DNA, 25 bp, Mus musculus
agtttgagtgggaagatgatcttcc

SEQ ID NO: 204979 - DNA, 25 bp, Mus musculus
agtttgataccggatggtggattag

SEQ ID NO: 204980 - DNA, 25 bp, Mus musculus
agtttgatgcccaaggcaacttaag

SEQ ID NO: 204981 - DNA, 25 bp, Mus musculus
agtttgatgcccaggcaacttaagg

SEQ ID NO: 204982 - DNA, 25 bp, Mus musculus
agtttgatggcaagggtcatgtggg

SEQ ID NO: 204983 - DNA, 25 bp, Mus musculus
agtttgatggcaaggtgctgtctga

SEQ ID NO: 204984 - DNA, 25 bp, Mus musculus
agtttgattcaacagatgtctttca

SEQ ID NO: 204985 - DNA, 25 bp, Mus musculus
agtttgattcaacaggcaatcgaga

SEQ ID NO: 204986 - DNA, 25 bp, Mus musculus
agtttgcaaagaagaaacagcattg

SEQ ID NO: 204987 - DNA, 25 bp, Mus musculus
agtttgcaaaggaaatatatcccgg

SEQ ID NO: 204988 - DNA, 25 bp, Mus musculus
agtttgcagaggatgacgtcagtga

SEQ ID NO: 204989 - DNA, 25 bp, Mus musculus
agtttgcagaggtgctggaaatggg

SEQ ID NO: 204990 - DNA, 25 bp, Mus musculus
agtttgcaggagcattaagaagaag

SEQ ID NO: 204991 - DNA, 25 bp, Mus musculus
agtttgcaggctcaggactggagga

SEQ ID NO: 204992 - DNA, 25 bp, Mus musculus
agtttgcattcacagacacggctaa

SEQ ID NO: 204993 - DNA, 25 bp, Mus musculus
agtttgcattcacagggtacagatt

SEQ ID NO: 204994 - DNA, 25 bp, Mus musculus
agtttgcattccgcttgcttcccag

SEQ ID NO: 204995 - DNA, 25 bp, Mus musculus
agtttgcatttaggaggactgacaa

SEQ ID NO: 204996 - DNA, 25 bp, Mus musculus
agtttgccatcaggtattggcttgc

SEQ ID NO: 204997 - DNA, 25 bp, Mus musculus
agtttgccatgaagcggctgctgcc

SEQ ID NO: 204998 - DNA, 25 bp, Mus musculus
agtttgccgcagccagccctctgcc

SEQ ID NO: 204999 - DNA, 25 bp, Mus musculus
agtttgccgcaggcccggcacagtc

SEQ ID NO: 205000 - DNA, 25 bp, Mus musculus
agtttgccttagagcacggcatccc

SEQ ID NO: 205001 - DNA, 25 bp, Mus musculus
agtttgctaagaactttgttgcctt

SEQ ID NO: 205002 - DNA, 25 bp, Mus musculus
agtttgctatgaacctgcagccagc

SEQ ID NO: 205003 - DNA, 25 bp, Mus musculus
agtttgctattggccaggctggcct

SEQ ID NO: 205004 - DNA, 25 bp, Mus musculus
agtttgctattggggggctctgcaa

SEQ ID NO: 205005 - DNA, 25 bp, Mus musculus
agtttgctattgtctaaatctcagg

SEQ ID NO: 205006 - DNA, 25 bp, Mus musculus
agtttgctcagaagtttacagagcc

SEQ ID NO: 205007 - DNA, 25 bp, Mus musculus
agtttgctgaccagaatttttcaga

SEQ ID NO: 205008 - DNA, 25 bp, Mus musculus
agtttgctgaccagctgtatatctg

SEQ ID NO: 205009 - DNA, 25 bp, Mus musculus
agtttgctgtagtaattcttcagtc

SEQ ID NO: 205010 - DNA, 25 bp, Mus musculus
agtttgcttgtaaggtgcaaaagaa

SEQ ID NO: 205011 - DNA, 25 bp, Mus musculus
agtttggaaacgccattatttgcat

SEQ ID NO: 205012 - DNA, 25 bp, Mus musculus
agtttggaaacggattctgctctaa

SEQ ID NO: 205013 - DNA, 25 bp, Mus musculus
agtttggaagaatgacatacggccg

SEQ ID NO: 205014 - DNA, 25 bp, Mus musculus
agtttggaagataccaacatttttt

SEQ ID NO: 205015 - DNA, 25 bp, Mus musculus
agtttggaagttgccatccagtgtt

SEQ ID NO: 205016 - DNA, 25 bp, Mus musculus
agtttggaccgactcgttactgatg

SEQ ID NO: 205017 - DNA, 25 bp, Mus musculus
agtttggaccgactggttactgatg

SEQ ID NO: 205018 - DNA, 25 bp, Mus musculus
agtttggagagtggatggcaggaga

SEQ ID NO: 205019 - DNA, 25 bp, Mus musculus
agtttggagccgactgggctgtttc

SEQ ID NO: 205020 - DNA, 25 bp, Mus musculus
agtttggcaaggaagcagaacaagc

SEQ ID NO: 205021 - DNA, 25 bp, Mus musculus
agtttggcagagtatacgaagcaga

SEQ ID NO: 205022 - DNA, 25 bp, Mus musculus
agtttggcagtgtcaaaggtcccca

SEQ ID NO: 205023 - DNA, 25 bp, Mus musculus
agtttggcatgaaaggaggaagcgg

SEQ ID NO: 205024 - DNA, 25 bp, Mus musculus
agtttggcatgaaaggcccagcttc

SEQ ID NO: 205025 - DNA, 25 bp, Mus musculus
agtttggcatgaaaggttttgtttt

SEQ ID NO: 205026 - DNA, 25 bp, Mus musculus
agtttggcatgctggtttcaccatc

SEQ ID NO: 205027 - DNA, 25 bp, Mus musculus
agtttggccctccttcacgtagaaa

SEQ ID NO: 205028 - DNA, 25 bp, Mus musculus
agtttggctgacaggattgtccgga

SEQ ID NO: 205029 - DNA, 25 bp, Mus musculus
agtttggctgacagtcatgagagcc

SEQ ID NO: 205030 - DNA, 25 bp, Mus musculus
agtttggcttcccgttgccctatgc

SEQ ID NO: 205031 - DNA, 25 bp, Mus musculus
agtttggcttccggttgccctatgc

SEQ ID NO: 205032 - DNA, 25 bp, Mus musculus
agtttgggagaccgagctcagcagt

SEQ ID NO: 205033 - DNA, 25 bp, Mus musculus
agtttgggatgaatgccagctctag

SEQ ID NO: 205034 - DNA, 25 bp, Mus musculus
agtttggggagtctggtaaataagc

SEQ ID NO: 205035 - DNA, 25 bp, Mus musculus
agtttggtctctggtggaattgggc

SEQ ID NO: 205036 - DNA, 25 bp, Mus musculus
agtttgtaaagcctcttcggtgatc

SEQ ID NO: 205037 - DNA, 25 bp, Mus musculus
agtttgtaaccatgaaaatcagaaa

SEQ ID NO: 205038 - DNA, 25 bp, Mus musculus
agtttgtagaaaaggggcatcgtct

SEQ ID NO: 205039 - DNA, 25 bp, Mus musculus
agtttgtatcgacagttctgtaagc

SEQ ID NO: 205040 - DNA, 25 bp, Mus musculus
agtttgtatcttcgggctcgctgcc

SEQ ID NO: 205041 - DNA, 25 bp, Mus musculus
agtttgtattgcagagctgtttgac

SEQ ID NO: 205042 - DNA, 25 bp, Mus musculus
agtttgtattgcagcttctagagct

SEQ ID NO: 205043 - DNA, 25 bp, Mus musculus
agtttgtccaacagctcctggagct

SEQ ID NO: 205044 - DNA, 25 bp, Mus musculus
agtttgtccaacagtaatttgtcag

SEQ ID NO: 205045 - DNA, 25 bp, Mus musculus
agtttgtccgcagaaatctgtcttt

SEQ ID NO: 205046 - DNA, 25 bp, Mus musculus
agtttgtccgcaggaacctgaatga

SEQ ID NO: 205047 - DNA, 25 bp, Mus musculus
agtttgtgaatgattcccatcatga

SEQ ID NO: 205048 - DNA, 25 bp, Mus musculus
agtttgtggggtcagggggactatg

SEQ ID NO: 205049 - DNA, 25 bp, Mus musculus
agtttgttctacaagctgactcatc

SEQ ID NO: 205050 - DNA, 25 bp, Mus musculus
agtttgtttgaggaagctcacaaga

SEQ ID NO: 205051 - DNA, 25 bp, Mus musculus
agtttgtttgctcgctcgggcaaag

SEQ ID NO: 205052 - DNA, 25 bp, Mus musculus
agttttaaaagcaagtctgcgtggc

SEQ ID NO: 205053 - DNA, 25 bp, Mus musculus
agttttaaaagcctggctccgtgga

SEQ ID NO: 205054 - DNA, 25 bp, Mus musculus
agttttaaaagtccagccatttcaa

SEQ ID NO: 205055 - DNA, 25 bp, Mus musculus
agttttaacttaatgtttgaaatgc

SEQ ID NO: 205056 - DNA, 25 bp, Mus musculus
agttttaagagagattcctttctcc

SEQ ID NO: 205057 - DNA, 25 bp, Mus musculus
agttttaagagaggatttaacagtg

SEQ ID NO: 205058 - DNA, 25 bp, Mus musculus
agttttaagagaggtggctttgcag

SEQ ID NO: 205059 - DNA, 25 bp, Mus musculus
agttttacaggaatctgggcaaatc

SEQ ID NO: 205060 - DNA, 25 bp, Mus musculus
agttttacagtggaaagcccatgat

SEQ ID NO: 205061 - DNA, 25 bp, Mus musculus
agttttagagatccctctgagacca

SEQ ID NO: 205062 - DNA, 25 bp, Mus musculus
agttttaggaaagatataccgcatt

SEQ ID NO: 205063 - DNA, 25 bp, Mus musculus
agttttagtccttgccctgccgaag

SEQ ID NO: 205064 - DNA, 25 bp, Mus musculus
agttttagtgcattgcagaagttgg

SEQ ID NO: 205065 - DNA, 25 bp, Mus musculus
agttttagtggcatcccctgtgagg

SEQ ID NO: 205066 - DNA, 25 bp, Mus musculus
agttttatatccacgataattttat

SEQ ID NO: 205067 - DNA, 25 bp, Mus musculus
agttttatgagaggaacctgtcttt

SEQ ID NO: 205068 - DNA, 25 bp, Mus musculus
agttttatgagcagggcgatgaaga

SEQ ID NO: 205069 - DNA, 25 bp, Mus musculus
agttttcaagaaatattatgctgaa

SEQ ID NO: 205070 - DNA, 25 bp, Mus musculus
agttttcaagaaatgtatctttccg

SEQ ID NO: 205071 - DNA, 25 bp, Mus musculus
agttttcaatcccagttacatttca

SEQ ID NO: 205072 - DNA, 25 bp, Mus musculus
agttttcaatcccagttatcttgac

SEQ ID NO: 205073 - DNA, 25 bp, Mus musculus
agttttcacaaatttatcctgtagt

SEQ ID NO: 205074 - DNA, 25 bp, Mus musculus
agttttcatttcaagatgtgccctt

SEQ ID NO: 205075 - DNA, 25 bp, Mus musculus
agttttccaggtcgtggttcaattc

SEQ ID NO: 205076 - DNA, 25 bp, Mus musculus
agttttccagtgaagccatggcaga

SEQ ID NO: 205077 - DNA, 25 bp, Mus musculus
agttttccattgggtcaggatcatg

SEQ ID NO: 205078 - DNA, 25 bp, Mus musculus
agttttccccaaggcaagtcttgga

SEQ ID NO: 205079 - DNA, 25 bp, Mus musculus
agttttccccaaggctagcttccga

SEQ ID NO: 205080 - DNA, 25 bp, Mus musculus
agttttcctacagagagaacctgga

SEQ ID NO: 205081 - DNA, 25 bp, Mus musculus
agttttcggagtctattgcatctgc

SEQ ID NO: 205082 - DNA, 25 bp, Mus musculus
agttttctcaggaaattgggcttgc

SEQ ID NO: 205083 - DNA, 25 bp, Mus musculus
agttttctcaggagaaccagacttg

SEQ ID NO: 205084 - DNA, 25 bp, Mus musculus
agttttctccagatgacttcttggg

SEQ ID NO: 205085 - DNA, 25 bp, Mus musculus
agttttctgaggagggtgtaaaaga

SEQ ID NO: 205086 - DNA, 25 bp, Mus musculus
agttttctgccagattcaagaacct

SEQ ID NO: 205087 - DNA, 25 bp, Mus musculus
agttttcttcccagccggttccagc

SEQ ID NO: 205088 - DNA, 25 bp, Mus musculus
agttttgaaaaagaatatatttgaa

SEQ ID NO: 205089 - DNA, 25 bp, Mus musculus
agttttgaaaaaggtgactcatttt

SEQ ID NO: 205090 - DNA, 25 bp, Mus musculus
agttttgaagcactaggttcacgct

SEQ ID NO: 205091 - DNA, 25 bp, Mus musculus
agttttgaaggctctgctaaggccg

SEQ ID NO: 205092 - DNA, 25 bp, Mus musculus
agttttgatgcagctatgaaggggc

SEQ ID NO: 205093 - DNA, 25 bp, Mus musculus
agttttgctgagaatggaatcatca

SEQ ID NO: 205094 - DNA, 25 bp, Mus musculus
agttttggccaagatccccagcctc

SEQ ID NO: 205095 - DNA, 25 bp, Mus musculus
agttttggtagagggacagtgtctt

SEQ ID NO: 205096 - DNA, 25 bp, Mus musculus
agttttgtcaagacaatggattctg

SEQ ID NO: 205097 - DNA, 25 bp, Mus musculus
agttttgtccgccagggttcggcag

SEQ ID NO: 205098 - DNA, 25 bp, Mus musculus
agttttgtgagcaccttcagctttc

SEQ ID NO: 205099 - DNA, 25 bp, Mus musculus
agttttgtgcagagattaagcacat

SEQ ID NO: 205100 - DNA, 25 bp, Mus musculus
agttttgtggaagagagtccagaaa

SEQ ID NO: 205101 - DNA, 25 bp, Mus musculus
agttttgttttgttatgaatgcagg

SEQ ID NO: 205102 - DNA, 25 bp, Mus musculus
agtttttagcgttctccacccatga

SEQ ID NO: 205103 - DNA, 25 bp, Mus musculus
agtttttcacagatcactggtgtta

SEQ ID NO: 205104 - DNA, 25 bp, Mus musculus
agtttttcacctatctgggggcacc

SEQ ID NO: 205105 - DNA, 25 bp, Mus musculus
agtttttcagaatttcttaatgtca

SEQ ID NO: 205106 - DNA, 25 bp, Mus musculus
agtttttcagctatggaccgtcacg

SEQ ID NO: 205107 - DNA, 25 bp, Mus musculus
agtttttccaccgctctccagcccc

SEQ ID NO: 205108 - DNA, 25 bp, Mus musculus
agtttttcctgtgtcccgtgtcaca

SEQ ID NO: 205109 - DNA, 25 bp, Mus musculus
agtttttcgatgagatggcggatcc

SEQ ID NO: 205110 - DNA, 25 bp, Mus musculus
agtttttcgatgaggctgaattgca

SEQ ID NO: 205111 - DNA, 25 bp, Mus musculus
agtttttctgatggtctgcagatgg

SEQ ID NO: 205112 - DNA, 25 bp, Mus musculus
agtttttggaggcaactgtgcccaa

SEQ ID NO: 205113 - DNA, 25 bp, Mus musculus
agtttttgttggaaatacagttgga

SEQ ID NO: 205114 - DNA, 25 bp, Mus musculus
agttttttcagagatcccgcccgga

SEQ ID NO: 205115 - DNA, 25 bp, Mus musculus
ataaaaaaaccgacaagctgggctg

SEQ ID NO: 205116 - DNA, 25 bp, Mus musculus
ataaaaaaattcagggaatgcagtc

SEQ ID NO: 205117 - DNA, 25 bp, Mus musculus
ataaaaaaattcatctacaggctct

SEQ ID NO: 205118 - DNA, 25 bp, Mus musculus
ataaaaaacgcaataccacagatga

SEQ ID NO: 205119 - DNA, 25 bp, Mus musculus
ataaaaaagtaaaagaattgcggcg

SEQ ID NO: 205120 - DNA, 25 bp, Mus musculus
ataaaaaagtaaaagcacttggtgg

SEQ ID NO: 205121 - DNA, 25 bp, Mus musculus
ataaaaaataaggctcatcctaaag

SEQ ID NO: 205122 - DNA, 25 bp, Mus musculus
ataaaaacagaacagttgaatagat

SEQ ID NO: 205123 - DNA, 25 bp, Mus musculus
ataaaaacagaaggcgaaggacgaa

SEQ ID NO: 205124 - DNA, 25 bp, Mus musculus
ataaaaacattgcaaagaactgaca

SEQ ID NO: 205125 - DNA, 25 bp, Mus musculus
ataaaaactcaggtcctttgcaaac

SEQ ID NO: 205126 - DNA, 25 bp, Mus musculus
ataaaaagaaacggcggctggcaaa

SEQ ID NO: 205127 - DNA, 25 bp, Mus musculus
ataaaaagagactgttgtaacagtt

SEQ ID NO: 205128 - DNA, 25 bp, Mus musculus
ataaaaagcagatgcatgttcctgc

SEQ ID NO: 205129 - DNA, 25 bp, Mus musculus
ataaaaagcagatgtcatatgcctg

SEQ ID NO: 205130 - DNA, 25 bp, Mus musculus
ataaaaagcaggggttccttgtgga

SEQ ID NO: 205131 - DNA, 25 bp, Mus musculus
ataaaaatggtgtccttggacttct

SEQ ID NO: 205132 - DNA, 25 bp, Mus musculus
ataaaaattacagtaccaaagcagt

SEQ ID NO: 205133 - DNA, 25 bp, Mus musculus
ataaaacaacagttaatttagagtg

SEQ ID NO: 205134 - DNA, 25 bp, Mus musculus
ataaaacatgctggaggcattccat

SEQ ID NO: 205135 - DNA, 25 bp, Mus musculus
ataaaacatggcattctgcatttgg

SEQ ID NO: 205136 - DNA, 25 bp, Mus musculus
ataaaaccacgactccagatgtagc

SEQ ID NO: 205137 - DNA, 25 bp, Mus musculus
ataaaaccaggtttgcttatgatgg

SEQ ID NO: 205138 - DNA, 25 bp, Mus musculus
ataaaactacgagctcctgcttcct

SEQ ID NO: 205139 - DNA, 25 bp, Mus musculus
ataaaactacgaggtgttctgccca

SEQ ID NO: 205140 - DNA, 25 bp, Mus musculus
ataaaactacgagtcacaccagaag

SEQ ID NO: 205141 - DNA, 25 bp, Mus musculus
ataaaactacgagtttatagaacaa

SEQ ID NO: 205142 - DNA, 25 bp, Mus musculus
ataaaactggggttcgcaacgttct

SEQ ID NO: 205143 - DNA, 25 bp, Mus musculus
ataaaactgggtggtcatatgcttt

SEQ ID NO: 205144 - DNA, 25 bp, Mus musculus
ataaaacttcagttgttgacctcct

SEQ ID NO: 205145 - DNA, 25 bp, Mus musculus
ataaaacttgggtgctgaaggggat

SEQ ID NO: 205146 - DNA, 25 bp, Mus musculus
ataaaagaaagaatgctcaaaggtg

SEQ ID NO: 205147 - DNA, 25 bp, Mus musculus
ataaaagaatgatgccagcatgtct

SEQ ID NO: 205148 - DNA, 25 bp, Mus musculus
ataaaagacaaaggggaagacatct

SEQ ID NO: 205149 - DNA, 25 bp, Mus musculus
ataaaagacggcatccagctcagcg

SEQ ID NO: 205150 - DNA, 25 bp, Mus musculus
ataaaagaggagcagggcttctatt

SEQ ID NO: 205151 - DNA, 25 bp, Mus musculus
ataaaagaggagcagtaaaagctgg

SEQ ID NO: 205152 - DNA, 25 bp, Mus musculus
ataaaagcaaagagtcttatcagct

SEQ ID NO: 205153 - DNA, 25 bp, Mus musculus
ataaaagcaacagagagtgcactga

SEQ ID NO: 205154 - DNA, 25 bp, Mus musculus
ataaaagcaacagagttcttgcctc

SEQ ID NO: 205155 - DNA, 25 bp, Mus musculus
ataaaagcatcaggcaagaggcaaa

SEQ ID NO: 205156 - DNA, 25 bp, Mus musculus
ataaaagcatcagttgtgactgtga

SEQ ID NO: 205157 - DNA, 25 bp, Mus musculus
ataaaagcattaaagcccagtgccc

SEQ ID NO: 205158 - DNA, 25 bp, Mus musculus
ataaaagcggccataaactgtacat

SEQ ID NO: 205159 - DNA, 25 bp, Mus musculus
ataaaagctcaggaagtctttaatg

SEQ ID NO: 205160 - DNA, 25 bp, Mus musculus
ataaaagctgaagtgaagtctggca

SEQ ID NO: 205161 - DNA, 25 bp, Mus musculus
ataaaaggtgccacaggcaccatgt

SEQ ID NO: 205162 - DNA, 25 bp, Mus musculus
ataaaagtcaagtgatcaaccggaa

SEQ ID NO: 205163 - DNA, 25 bp, Mus musculus
ataaaatactacatttttttccaga

SEQ ID NO: 205164 - DNA, 25 bp, Mus musculus
ataaaatagaaaataaaatcttggc

SEQ ID NO: 205165 - DNA, 25 bp, Mus musculus
ataaaatatgtcagatttcaactat

SEQ ID NO: 205166 - DNA, 25 bp, Mus musculus
ataaaatcaagatgtctgttggtga

SEQ ID NO: 205167 - DNA, 25 bp, Mus musculus
ataaaatgctatgtgctgagccacc

SEQ ID NO: 205168 - DNA, 25 bp, Mus musculus
ataaaatggagagaggtaagaagta

SEQ ID NO: 205169 - DNA, 25 bp, Mus musculus
ataaaatggagagtctggatgtgga

SEQ ID NO: 205170 - DNA, 25 bp, Mus musculus
ataaaattaaacctaatgcttgcat

SEQ ID NO: 205171 - DNA, 25 bp, Mus musculus
ataaaattacagagaatgcatcaga

SEQ ID NO: 205172 - DNA, 25 bp, Mus musculus
ataaaattacagctcagtctggaac

SEQ ID NO: 205173 - DNA, 25 bp, Mus musculus
ataaaattcatatgggtaactgtgc

SEQ ID NO: 205174 - DNA, 25 bp, Mus musculus
ataaaattctggagctggaggagaa

SEQ ID NO: 205175 - DNA, 25 bp, Mus musculus
ataaaattgatgcatctctgacatt

SEQ ID NO: 205176 - DNA, 25 bp, Mus musculus
ataaacaaaataaatggtctactga

SEQ ID NO: 205177 - DNA, 25 bp, Mus musculus
ataaacactggaacttagcaggact

SEQ ID NO: 205178 - DNA, 25 bp, Mus musculus
ataaacactgtaaaggatctccctc

SEQ ID NO: 205179 - DNA, 25 bp, Mus musculus
ataaacagaaagcttcacggaaacc

SEQ ID NO: 205180 - DNA, 25 bp, Mus musculus
ataaacagatagaagaagaaaagca

SEQ ID NO: 205181 - DNA, 25 bp, Mus musculus
ataaacagatagaagatcaacaacc

SEQ ID NO: 205182 - DNA, 25 bp, Mus musculus
ataaacagcaacgttttacaaacct

SEQ ID NO: 205183 - DNA, 25 bp, Mus musculus
ataaacagcaagcctgtcattcctt

SEQ ID NO: 205184 - DNA, 25 bp, Mus musculus
ataaacagcaaggggagatgttgcg

SEQ ID NO: 205185 - DNA, 25 bp, Mus musculus
ataaacatcgagaagcaactgcgct

SEQ ID NO: 205186 - DNA, 25 bp, Mus musculus
ataaacatcgagaagtatcagcggt

SEQ ID NO: 205187 - DNA, 25 bp, Mus musculus
ataaacatcttgagatcttcaactt

SEQ ID NO: 205188 - DNA, 25 bp, Mus musculus
ataaacattcaagctctgcctcacg

SEQ ID NO: 205189 - DNA, 25 bp, Mus musculus
ataaacattcgacagggaagggaac

SEQ ID NO: 205190 - DNA, 25 bp, Mus musculus
ataaaccaaaagctagagacaagcg

SEQ ID NO: 205191 - DNA, 25 bp, Mus musculus
ataaaccaaaagcttgtgggcgaaa

SEQ ID NO: 205192 - DNA, 25 bp, Mus musculus
ataaaccaacagaggaattcatcag

SEQ ID NO: 205193 - DNA, 25 bp, Mus musculus
ataaaccagaactgagcagtgtcgt

SEQ ID NO: 205194 - DNA, 25 bp, Mus musculus
ataaacccagctccctacactatca

SEQ ID NO: 205195 - DNA, 25 bp, Mus musculus
ataaacgacaggtgtgtggaggtca

SEQ ID NO: 205196 - DNA, 25 bp, Mus musculus
ataaacgacaggtgtgttgaaagca

SEQ ID NO: 205197 - DNA, 25 bp, Mus musculus
ataaacgagcaagcttctacataca

SEQ ID NO: 205198 - DNA, 25 bp, Mus musculus
ataaacgttttgctggccttcagtg

SEQ ID NO: 205199 - DNA, 25 bp, Mus musculus
ataaactacagactccatgaatttg

SEQ ID NO: 205200 - DNA, 25 bp, Mus musculus
ataaactcaagccaggaaccatgat

SEQ ID NO: 205201 - DNA, 25 bp, Mus musculus
ataaactcaaggaggcagagacccg

SEQ ID NO: 205202 - DNA, 25 bp, Mus musculus
ataaactcaagggctcgggccatca

SEQ ID NO: 205203 - DNA, 25 bp, Mus musculus
ataaacttaatgaggacatggcttg

SEQ ID NO: 205204 - DNA, 25 bp, Mus musculus
ataaacttgaaagatgacagtcccc

SEQ ID NO: 205205 - DNA, 25 bp, Mus musculus
ataaagaaaacagagacgaagacat

SEQ ID NO: 205206 - DNA, 25 bp, Mus musculus
ataaagaaaacagttgagtggtacc

SEQ ID NO: 205207 - DNA, 25 bp, Mus musculus
ataaagaaaaggctggaagttctgc

SEQ ID NO: 205208 - DNA, 25 bp, Mus musculus
ataaagaaaatataaacaccagttt

SEQ ID NO: 205209 - DNA, 25 bp, Mus musculus
ataaagaaaatgcagcgttcctgct

SEQ ID NO: 205210 - DNA, 25 bp, Mus musculus
ataaagaaactactcactggcctac

SEQ ID NO: 205211 - DNA, 25 bp, Mus musculus
ataaagaaagcagggtgaaggagga

SEQ ID NO: 205212 - DNA, 25 bp, Mus musculus
ataaagaaaggtgaccagaatggag

SEQ ID NO: 205213 - DNA, 25 bp, Mus musculus
ataaagaagattagttgaagaacag

SEQ ID NO: 205214 - DNA, 25 bp, Mus musculus
ataaagaagccaccccctctttgct

SEQ ID NO: 205215 - DNA, 25 bp, Mus musculus
ataaagaagccagcccctctttgct

SEQ ID NO: 205216 - DNA, 25 bp, Mus musculus
ataaagaatggcgtgcattttctgc

SEQ ID NO: 205217 - DNA, 25 bp, Mus musculus
ataaagaatttgggagggctggaga

SEQ ID NO: 205218 - DNA, 25 bp, Mus musculus
ataaagacagaggttcttgcagcca

SEQ ID NO: 205219 - DNA, 25 bp, Mus musculus
ataaagacagggaggtggacatcac

SEQ ID NO: 205220 - DNA, 25 bp, Mus musculus
ataaagaccttgagagctgttctgc

SEQ ID NO: 205221 - DNA, 25 bp, Mus musculus
ataaagacgatgaggagaaagaaaa

SEQ ID NO: 205222 - DNA, 25 bp, Mus musculus
ataaagagaaaaggtctttcgcacc

SEQ ID NO: 205223 - DNA, 25 bp, Mus musculus
ataaagagaaaagtgttaatggcca

SEQ ID NO: 205224 - DNA, 25 bp, Mus musculus
ataaagagcagatcaaattgcttat

SEQ ID NO: 205225 - DNA, 25 bp, Mus musculus
ataaagagcaggtgtcacaactgct

SEQ ID NO: 205226 - DNA, 25 bp, Mus musculus
ataaagagcagttctcctatttcat

SEQ ID NO: 205227 - DNA, 25 bp, Mus musculus
ataaagagcgagtcgaattggcaga

SEQ ID NO: 205228 - DNA, 25 bp, Mus musculus
ataaagataacccggcactgaatgc

SEQ ID NO: 205229 - DNA, 25 bp, Mus musculus
ataaagatgaacagcaattatagtg

SEQ ID NO: 205230 - DNA, 25 bp, Mus musculus
ataaagatgttaggggagcttctgg

SEQ ID NO: 205231 - DNA, 25 bp, Mus musculus
ataaagcaaatatgcaacacagata

SEQ ID NO: 205232 - DNA, 25 bp, Mus musculus
ataaagcaaggaggggctgagaaaa

SEQ ID NO: 205233 - DNA, 25 bp, Mus musculus
ataaagcacttggggccctagagaa

SEQ ID NO: 205234 - DNA, 25 bp, Mus musculus
ataaagcagacccgggcagatatca

SEQ ID NO: 205235 - DNA, 25 bp, Mus musculus
ataaagcagagacaaattgaacaag

SEQ ID NO: 205236 - DNA, 25 bp, Mus musculus
ataaagcagaggagactctaacacg

SEQ ID NO: 205237 - DNA, 25 bp, Mus musculus
ataaagcagttttgaattacctgaa

SEQ ID NO: 205238 - DNA, 25 bp, Mus musculus
ataaagcagttttgttagttttcat

SEQ ID NO: 205239 - DNA, 25 bp, Mus musculus
ataaagccagagccatcgtgacttt

SEQ ID NO: 205240 - DNA, 25 bp, Mus musculus
ataaagccaggcagtgaagcagatt

SEQ ID NO: 205241 - DNA, 25 bp, Mus musculus
ataaagcccaaactcccacaatcta

SEQ ID NO: 205242 - DNA, 25 bp, Mus musculus
ataaagcccaagtggaacggctgca

SEQ ID NO: 205243 - DNA, 25 bp, Mus musculus
ataaagcgaatgaacttttctatct

SEQ ID NO: 205244 - DNA, 25 bp, Mus musculus
ataaagcgaggctgaaaggaaatgt

SEQ ID NO: 205245 - DNA, 25 bp, Mus musculus
ataaagcgagtttcactttcaggct

SEQ ID NO: 205246 - DNA, 25 bp, Mus musculus
ataaaggaccctgatgctaagaagc

SEQ ID NO: 205247 - DNA, 25 bp, Mus musculus
ataaaggaccgaggattgaagtgag

SEQ ID NO: 205248 - DNA, 25 bp, Mus musculus
ataaaggactgattgtgaattccca

SEQ ID NO: 205249 - DNA, 25 bp, Mus musculus
ataaaggatggcggtgttagaacaa

SEQ ID NO: 205250 - DNA, 25 bp, Mus musculus
ataaaggctttttactatgcagtca

SEQ ID NO: 205251 - DNA, 25 bp, Mus musculus
ataaagggtgaggtgtgccaaagaa

SEQ ID NO: 205252 - DNA, 25 bp, Mus musculus
ataaagggtgagttttatgtgatag

SEQ ID NO: 205253 - DNA, 25 bp, Mus musculus
ataaagtaactctaaatcttcaagt

SEQ ID NO: 205254 - DNA, 25 bp, Mus musculus
ataaagtatcagaaatccacttctc

SEQ ID NO: 205255 - DNA, 25 bp, Mus musculus
ataaagtatcagatgtctttattcc

SEQ ID NO: 205256 - DNA, 25 bp, Mus musculus
ataaagtatcagggctggcagtctg

SEQ ID NO: 205257 - DNA, 25 bp, Mus musculus
ataaagtattctgtatctgcagtgg

SEQ ID NO: 205258 - DNA, 25 bp, Mus musculus
ataaagtcagagatccagaaattcc

SEQ ID NO: 205259 - DNA, 25 bp, Mus musculus
ataaagtcaggtatcttttggataa

SEQ ID NO: 205260 - DNA, 25 bp, Mus musculus
ataaagtcaggttttgatatttctc

SEQ ID NO: 205261 - DNA, 25 bp, Mus musculus
ataaagtctctgaaactcaagtcaa

SEQ ID NO: 205262 - DNA, 25 bp, Mus musculus
ataaagttttgagagaagcagaaga

SEQ ID NO: 205263 - DNA, 25 bp, Mus musculus
ataaagtttttggaagctttgctga

SEQ ID NO: 205264 - DNA, 25 bp, Mus musculus
ataaagtttttggtatgctggtgtg

SEQ ID NO: 205265 - DNA, 25 bp, Mus musculus
ataaataattaaggaaagggctgtg

SEQ ID NO: 205266 - DNA, 25 bp, Mus musculus
ataaatacaaaacctgggcattcct

SEQ ID NO: 205267 - DNA, 25 bp, Mus musculus
ataaatacactctgattactacaag

SEQ ID NO: 205268 - DNA, 25 bp, Mus musculus
ataaataccggttcttcctcggcaa

SEQ ID NO: 205269 - DNA, 25 bp, Mus musculus
ataaataccggtttggagattctca

SEQ ID NO: 205270 - DNA, 25 bp, Mus musculus
ataaatactgaagtgtattccttac

SEQ ID NO: 205271 - DNA, 25 bp, Mus musculus
ataaatagataataccaaacgtcta

SEQ ID NO: 205272 - DNA, 25 bp, Mus musculus
ataaataggagctccaccccaggcc

SEQ ID NO: 205273 - DNA, 25 bp, Mus musculus
ataaatataaaaagaggaaactgca

SEQ ID NO: 205274 - DNA, 25 bp, Mus musculus
ataaatataaaaaggtaacaactga

SEQ ID NO: 205275 - DNA, 25 bp, Mus musculus
ataaatattgaaatcgcatcatatt

SEQ ID NO: 205276 - DNA, 25 bp, Mus musculus
ataaatattgggaggactcaggagg

SEQ ID NO: 205277 - DNA, 25 bp, Mus musculus
ataaatgagtctgctattgatagca

SEQ ID NO: 205278 - DNA, 25 bp, Mus musculus
ataaatgatcttgaactcacagaag

SEQ ID NO: 205279 - DNA, 25 bp, Mus musculus
ataaatgatgtatgtcgcactggct

SEQ ID NO: 205280 - DNA, 25 bp, Mus musculus
ataaatgcagtatctctcctctctg

SEQ ID NO: 205281 - DNA, 25 bp, Mus musculus
ataaatggaaaaacagctctcctct

SEQ ID NO: 205282 - DNA, 25 bp, Mus musculus
ataaatgtcaggactcaggacgggg

SEQ ID NO: 205283 - DNA, 25 bp, Mus musculus
ataaattaaagcaagcctgtggtta

SEQ ID NO: 205284 - DNA, 25 bp, Mus musculus
ataaattccaaaacactgtaacatg

SEQ ID NO: 205285 - DNA, 25 bp, Mus musculus
ataaattctcaaaacccaatgatga

SEQ ID NO: 205286 - DNA, 25 bp, Mus musculus
ataaattctcaaaatgttcaagcca

SEQ ID NO: 205287 - DNA, 25 bp, Mus musculus
ataaattgaagggtatttcaacaat

SEQ ID NO: 205288 - DNA, 25 bp, Mus musculus
ataaattgcaccaggatctttctca

SEQ ID NO: 205289 - DNA, 25 bp, Mus musculus
ataaattgctacagggtggttatgc

SEQ ID NO: 205290 - DNA, 25 bp, Mus musculus
ataaatttaaaaagggagatgagta

SEQ ID NO: 205291 - DNA, 25 bp, Mus musculus
ataacaaaaactgaacgaacacagc

SEQ ID NO: 205292 - DNA, 25 bp, Mus musculus
ataacaaaaaggccctaggcctgac

SEQ ID NO: 205293 - DNA, 25 bp, Mus musculus
ataacaaaaaggtgatgaaggactc

SEQ ID NO: 205294 - DNA, 25 bp, Mus musculus
ataacaaaaatctaggcatggtctg

SEQ ID NO: 205295 - DNA, 25 bp, Mus musculus
ataacaaactggatgcagagaatgc

SEQ ID NO: 205296 - DNA, 25 bp, Mus musculus
ataacaacaaagaagggattcaccc

SEQ ID NO: 205297 - DNA, 25 bp, Mus musculus
ataacaacgtctatttttattccat

SEQ ID NO: 205298 - DNA, 25 bp, Mus musculus
ataacaagaacactccagggtttcc

SEQ ID NO: 205299 - DNA, 25 bp, Mus musculus
ataacaagactacaatgcttctctc

SEQ ID NO: 205300 - DNA, 25 bp, Mus musculus
ataacaataaagctgcagtgttgaa

SEQ ID NO: 205301 - DNA, 25 bp, Mus musculus
ataacaattgaagtcagaaggagac

SEQ ID NO: 205302 - DNA, 25 bp, Mus musculus
ataacacataccaggttacaaggac

SEQ ID NO: 205303 - DNA, 25 bp, Mus musculus
ataacacgacaaggtgtccaggcct

SEQ ID NO: 205304 - DNA, 25 bp, Mus musculus
ataacactgcagaggactagagtgt

SEQ ID NO: 205305 - DNA, 25 bp, Mus musculus
ataacactgcagggtctccaactga

SEQ ID NO: 205306 - DNA, 25 bp, Mus musculus
ataacacttgacatctcaataaata

SEQ ID NO: 205307 - DNA, 25 bp, Mus musculus
ataacacttgattctcattgaaatc

SEQ ID NO: 205308 - DNA, 25 bp, Mus musculus
ataacagagatttgctggatctcat

SEQ ID NO: 205309 - DNA, 25 bp, Mus musculus
ataacagagatttgtctcaatggaa

SEQ ID NO: 205310 - DNA, 25 bp, Mus musculus
ataacagcaatggcctccaactgga

SEQ ID NO: 205311 - DNA, 25 bp, Mus musculus
ataacagcaatgggccaccagaatg

SEQ ID NO: 205312 - DNA, 25 bp, Mus musculus
ataacagtgactggtcctattttct

SEQ ID NO: 205313 - DNA, 25 bp, Mus musculus
ataacatacccagtgccttgccatc

SEQ ID NO: 205314 - DNA, 25 bp, Mus musculus
ataacatacccagtgtgtcatcaat

SEQ ID NO: 205315 - DNA, 25 bp, Mus musculus
ataacatccatccttcatgattgtc

SEQ ID NO: 205316 - DNA, 25 bp, Mus musculus
ataacatgagcatcatcagctggtt

SEQ ID NO: 205317 - DNA, 25 bp, Mus musculus
ataacatgcagatattcagtgaact

SEQ ID NO: 205318 - DNA, 25 bp, Mus musculus
ataacatgtttaagaaggtgcccac

SEQ ID NO: 205319 - DNA, 25 bp, Mus musculus
ataacattcaaggaagccatcactc

SEQ ID NO: 205320 - DNA, 25 bp, Mus musculus
ataacattcaaggcccttctgaaac

SEQ ID NO: 205321 - DNA, 25 bp, Mus musculus
ataaccacagtaaggtcacgaagtt

SEQ ID NO: 205322 - DNA, 25 bp, Mus musculus
ataaccacatttaaatgattataga

SEQ ID NO: 205323 - DNA, 25 bp, Mus musculus
ataaccacatttaagtcagattatc

SEQ ID NO: 205324 - DNA, 25 bp, Mus musculus
ataaccagaatccagtatctcttgc

SEQ ID NO: 205325 - DNA, 25 bp, Mus musculus
ataaccagaatccagtttcagatac

SEQ ID NO: 205326 - DNA, 25 bp, Mus musculus
ataaccagcaacagctcctgaggaa

SEQ ID NO: 205327 - DNA, 25 bp, Mus musculus
ataacccagataccagattaagctt

SEQ ID NO: 205328 - DNA, 25 bp, Mus musculus
ataacccagataccattaaaaagag

SEQ ID NO: 205329 - DNA, 25 bp, Mus musculus
ataacccaggctgcatgagtggtga

SEQ ID NO: 205330 - DNA, 25 bp, Mus musculus
ataacccagtaatttgtactatacc

SEQ ID NO: 205331 - DNA, 25 bp, Mus musculus
ataacccggcagaactacacatact

SEQ ID NO: 205332 - DNA, 25 bp, Mus musculus
ataaccctaaaggccttgcatcaaa

SEQ ID NO: 205333 - DNA, 25 bp, Mus musculus
ataacccttcggtgacccaccctct

SEQ ID NO: 205334 - DNA, 25 bp, Mus musculus
ataacctacaagctaccacatttga

SEQ ID NO: 205335 - DNA, 25 bp, Mus musculus
ataacctacaagttgttatccgatg

SEQ ID NO: 205336 - DNA, 25 bp, Mus musculus
ataacctacacagcgtacggcatgt

SEQ ID NO: 205337 - DNA, 25 bp, Mus musculus
ataacctcaagtgactgtggtctgc

SEQ ID NO: 205338 - DNA, 25 bp, Mus musculus
ataacctccagggaggtatggaccc

SEQ ID NO: 205339 - DNA, 25 bp, Mus musculus
ataacctgcaaacactgccccccaa

SEQ ID NO: 205340 - DNA, 25 bp, Mus musculus
ataacgaacggtaccatggttgttc

SEQ ID NO: 205341 - DNA, 25 bp, Mus musculus
ataacgctaacaggatgagattgtc

SEQ ID NO: 205342 - DNA, 25 bp, Mus musculus
ataacgctaagtgtgatgaatgcag

SEQ ID NO: 205343 - DNA, 25 bp, Mus musculus
ataacggactgctgaccttggggct

SEQ ID NO: 205344 - DNA, 25 bp, Mus musculus
ataacggagttggtgaatgatacca

SEQ ID NO: 205345 - DNA, 25 bp, Mus musculus
ataacggtggggtttgcaatagcaa

SEQ ID NO: 205346 - DNA, 25 bp, Mus musculus
ataacgtaacgcccggccacacagc

SEQ ID NO: 205347 - DNA, 25 bp, Mus musculus
ataacgtacacagatatgaggaatt

SEQ ID NO: 205348 - DNA, 25 bp, Mus musculus
ataacgtacacaggtttgcagctag

SEQ ID NO: 205349 - DNA, 25 bp, Mus musculus
ataacgtctgcatactatcgtggag

SEQ ID NO: 205350 - DNA, 25 bp, Mus musculus
ataacgtggactgaggtgctgcact

SEQ ID NO: 205351 - DNA, 25 bp, Mus musculus
ataacgttgggaaggaagaacgctg

SEQ ID NO: 205352 - DNA, 25 bp, Mus musculus
ataactaaccccgaaggcaaataag

SEQ ID NO: 205353 - DNA, 25 bp, Mus musculus
ataactacaaggatcctgctggccg

SEQ ID NO: 205354 - DNA, 25 bp, Mus musculus
ataactaccagatgccaccgcagtg

SEQ ID NO: 205355 - DNA, 25 bp, Mus musculus
ataactaccaggcttatacaactgt

SEQ ID NO: 205356 - DNA, 25 bp, Mus musculus
ataactacttgcagattctcttctg

SEQ ID NO: 205357 - DNA, 25 bp, Mus musculus
ataactacttgcaggccacagacaa

SEQ ID NO: 205358 - DNA, 25 bp, Mus musculus
ataactatcgcgaacgagagaggga

SEQ ID NO: 205359 - DNA, 25 bp, Mus musculus
ataactatgcctgtggttgagccct

SEQ ID NO: 205360 - DNA, 25 bp, Mus musculus
ataactcaaggctccagaatgggcg

SEQ ID NO: 205361 - DNA, 25 bp, Mus musculus
ataactcaatgggatttggtgcaga

SEQ ID NO: 205362 - DNA, 25 bp, Mus musculus
ataactcaattcctctattgtatgg

SEQ ID NO: 205363 - DNA, 25 bp, Mus musculus
ataactcagcaggaactatgaatgg

SEQ ID NO: 205364 - DNA, 25 bp, Mus musculus
ataactcagttttagcctgcggagc

SEQ ID NO: 205365 - DNA, 25 bp, Mus musculus
ataactcggagcagaaatgcatcgc

SEQ ID NO: 205366 - DNA, 25 bp, Mus musculus
ataactcggagcagatcggtgcagc

SEQ ID NO: 205367 - DNA, 25 bp, Mus musculus
ataactctctggacgcccctgtgaa

SEQ ID NO: 205368 - DNA, 25 bp, Mus musculus
ataactgaagatgaaaaaggtcatt

SEQ ID NO: 205369 - DNA, 25 bp, Mus musculus
ataactggctgggtggaaccaggcc

SEQ ID NO: 205370 - DNA, 25 bp, Mus musculus
ataactgggaggatgagccccaaga

SEQ ID NO: 205371 - DNA, 25 bp, Mus musculus
ataactgggctgttttacctctagg

SEQ ID NO: 205372 - DNA, 25 bp, Mus musculus
ataactggtgcccagggtgctggtg

SEQ ID NO: 205373 - DNA, 25 bp, Mus musculus
ataacttaaagagtatagaaatatc

SEQ ID NO: 205374 - DNA, 25 bp, Mus musculus
ataacttatggcaggtccaaacatc

SEQ ID NO: 205375 - DNA, 25 bp, Mus musculus
ataacttcagaaggaataaaagctg

SEQ ID NO: 205376 - DNA, 25 bp, Mus musculus
ataacttccagagaatctcagtatg

SEQ ID NO: 205377 - DNA, 25 bp, Mus musculus
ataacttccagatccaggccttcaa

SEQ ID NO: 205378 - DNA, 25 bp, Mus musculus
ataacttcctgagaaggacttgatc

SEQ ID NO: 205379 - DNA, 25 bp, Mus musculus
ataacttctttgaggaggtattcac

SEQ ID NO: 205380 - DNA, 25 bp, Mus musculus
ataacttgcagattctgcttcgaga

SEQ ID NO: 205381 - DNA, 25 bp, Mus musculus
ataactttcagccgatcaacttctg

SEQ ID NO: 205382 - DNA, 25 bp, Mus musculus
ataactttgtcaagtccaagacagg

SEQ ID NO: 205383 - DNA, 25 bp, Mus musculus
ataagaaagaaagatggttgtccct

SEQ ID NO: 205384 - DNA, 25 bp, Mus musculus
ataagaaatcttggccaggaccctg

SEQ ID NO: 205385 - DNA, 25 bp, Mus musculus
ataagaaccagactgcagagaagga

SEQ ID NO: 205386 - DNA, 25 bp, Mus musculus
ataagaaccagagaaggaagaattt

SEQ ID NO: 205387 - DNA, 25 bp, Mus musculus
ataagaaccagtactgggttgaatc

SEQ ID NO: 205388 - DNA, 25 bp, Mus musculus
ataagaactgctccgctcggctctg

SEQ ID NO: 205389 - DNA, 25 bp, Mus musculus
ataagaactggcacaagtctaagaa

SEQ ID NO: 205390 - DNA, 25 bp, Mus musculus
ataagaagatgatccccagtgtttc

SEQ ID NO: 205391 - DNA, 25 bp, Mus musculus
ataagaagatgatcgtcttcaagcc

SEQ ID NO: 205392 - DNA, 25 bp, Mus musculus
ataagaagccagatgtgaactgggg

SEQ ID NO: 205393 - DNA, 25 bp, Mus musculus
ataagaagctcaagtccattacaat

SEQ ID NO: 205394 - DNA, 25 bp, Mus musculus
ataagaagtgtttccacgatgatgc

SEQ ID NO: 205395 - DNA, 25 bp, Mus musculus
ataagaatccatttgatgaagctca

SEQ ID NO: 205396 - DNA, 25 bp, Mus musculus
ataagaatgaggaagaaaaagagag

SEQ ID NO: 205397 - DNA, 25 bp, Mus musculus
ataagaatggttatgataattagca

SEQ ID NO: 205398 - DNA, 25 bp, Mus musculus
ataagacaagagtttgggaaatgga

SEQ ID NO: 205399 - DNA, 25 bp, Mus musculus
ataagacagacatggggagtcttct

SEQ ID NO: 205400 - DNA, 25 bp, Mus musculus
ataagaccagatcatctttagatgg

SEQ ID NO: 205401 - DNA, 25 bp, Mus musculus
ataagaccatcagattatgggacag

SEQ ID NO: 205402 - DNA, 25 bp, Mus musculus
ataagacccagcagaataactgcca

SEQ ID NO: 205403 - DNA, 25 bp, Mus musculus
ataagactgggatgtttctttcatc

SEQ ID NO: 205404 - DNA, 25 bp, Mus musculus
ataagactgggtaaatttgatcctg

SEQ ID NO: 205405 - DNA, 25 bp, Mus musculus
ataagagaagctggctgtataggat

SEQ ID NO: 205406 - DNA, 25 bp, Mus musculus
ataagagatgacagctgaggaccga

SEQ ID NO: 205407 - DNA, 25 bp, Mus musculus
ataagagatgacgtcaggggaggag

SEQ ID NO: 205408 - DNA, 25 bp, Mus musculus
ataagagcacagcttctccagcctc

SEQ ID NO: 205409 - DNA, 25 bp, Mus musculus
ataagagcacagtgctggctgcgag

SEQ ID NO: 205410 - DNA, 25 bp, Mus musculus
ataagagcgttctctggtgcaagtg

SEQ ID NO: 205411 - DNA, 25 bp, Mus musculus
ataagagctggagcattttctgcag

SEQ ID NO: 205412 - DNA, 25 bp, Mus musculus
ataagaggcggtgactccataccaa

SEQ ID NO: 205413 - DNA, 25 bp, Mus musculus
ataagagtgcagctcagagacatgt

SEQ ID NO: 205414 - DNA, 25 bp, Mus musculus
ataagatagagcggggaaaaatgga

SEQ ID NO: 205415 - DNA, 25 bp, Mus musculus
ataagatagttaaagagggttgccc

SEQ ID NO: 205416 - DNA, 25 bp, Mus musculus
ataagatcctctcggtaaatggcca

SEQ ID NO: 205417 - DNA, 25 bp, Mus musculus
ataagatgaaggctcacagcgagta

SEQ ID NO: 205418 - DNA, 25 bp, Mus musculus
ataagatgaggtcctccaccttcgc

SEQ ID NO: 205419 - DNA, 25 bp, Mus musculus
ataagatgcactccatgaatgggtt

SEQ ID NO: 205420 - DNA, 25 bp, Mus musculus
ataagatggtggtgagtgcctatga

SEQ ID NO: 205421 - DNA, 25 bp, Mus musculus
ataagattgagaacctagctagcat

SEQ ID NO: 205422 - DNA, 25 bp, Mus musculus
ataagcaaacatgtttccttttaga

SEQ ID NO: 205423 - DNA, 25 bp, Mus musculus
ataagcaaatgggggaagccctata

SEQ ID NO: 205424 - DNA, 25 bp, Mus musculus
ataagcaatcaaagcttatttccaa

SEQ ID NO: 205425 - DNA, 25 bp, Mus musculus
ataagcaatcaaaggtgagacgaca

SEQ ID NO: 205426 - DNA, 25 bp, Mus musculus
ataagcaccgaatgcacaatctctg

SEQ ID NO: 205427 - DNA, 25 bp, Mus musculus
ataagcaccggcctctggaaatgtc

SEQ ID NO: 205428 - DNA, 25 bp, Mus musculus
ataagcactgtgttttcagtaaatg

SEQ ID NO: 205429 - DNA, 25 bp, Mus musculus
ataagcagctgacagagggtacccg

SEQ ID NO: 205430 - DNA, 25 bp, Mus musculus
ataagcagtacaaacctctttctca

SEQ ID NO: 205431 - DNA, 25 bp, Mus musculus
ataagcagtccagatttcatcctga

SEQ ID NO: 205432 - DNA, 25 bp, Mus musculus
ataagcagtccagccctattctgaa

SEQ ID NO: 205433 - DNA, 25 bp, Mus musculus
ataagcagtccagctcgtctgatcc

SEQ ID NO: 205434 - DNA, 25 bp, Mus musculus
ataagcagtccaggttcttactctg

SEQ ID NO: 205435 - DNA, 25 bp, Mus musculus
ataagcatgtgtaggacccagccac

SEQ ID NO: 205436 - DNA, 25 bp, Mus musculus
ataagccatcaggtccatggagaga

SEQ ID NO: 205437 - DNA, 25 bp, Mus musculus
ataagcccgagcaggacttggatgt

SEQ ID NO: 205438 - DNA, 25 bp, Mus musculus
ataagcctggtggacccatggatga

SEQ ID NO: 205439 - DNA, 25 bp, Mus musculus
ataagcgccggaggactgcatgagt

SEQ ID NO: 205440 - DNA, 25 bp, Mus musculus
ataagcgggccgagatgtggtgatc

SEQ ID NO: 205441 - DNA, 25 bp, Mus musculus
ataagcgggccgaggttggatcatg

SEQ ID NO: 205442 - DNA, 25 bp, Mus musculus
ataagctaaaagaattgggatatga

SEQ ID NO: 205443 - DNA, 25 bp, Mus musculus
ataagctaaaagcatggctgctcgc

SEQ ID NO: 205444 - DNA, 25 bp, Mus musculus
ataagctacaggagcttcaagtcaa

SEQ ID NO: 205445 - DNA, 25 bp, Mus musculus
ataagctctgacttcagaacatgac

SEQ ID NO: 205446 - DNA, 25 bp, Mus musculus
ataagctctggggatgaagagatgg

SEQ ID NO: 205447 - DNA, 25 bp, Mus musculus
ataagctgtactacgtaaccaccaa

SEQ ID NO: 205448 - DNA, 25 bp, Mus musculus
ataagcttgctgagactctccgctg

SEQ ID NO: 205449 - DNA, 25 bp, Mus musculus
ataagcttgctgagggtttcccagt

SEQ ID NO: 205450 - DNA, 25 bp, Mus musculus
ataaggaaaaggggctgtctacaga

SEQ ID NO: 205451 - DNA, 25 bp, Mus musculus
ataaggaacaggacggacggaatga

SEQ ID NO: 205452 - DNA, 25 bp, Mus musculus
ataaggaacagtcagagctaagaca

SEQ ID NO: 205453 - DNA, 25 bp, Mus musculus
ataaggacattagattgatcaggga

SEQ ID NO: 205454 - DNA, 25 bp, Mus musculus
ataaggaccaggatacaaattggaa

SEQ ID NO: 205455 - DNA, 25 bp, Mus musculus
ataaggagcagaatgagaagacttt

SEQ ID NO: 205456 - DNA, 25 bp, Mus musculus
ataaggagccgagtgcagttcctcc

SEQ ID NO: 205457 - DNA, 25 bp, Mus musculus
ataaggatattagggtctctgctac

SEQ ID NO: 205458 - DNA, 25 bp, Mus musculus
ataaggcaagacagattacaaaaga

SEQ ID NO: 205459 - DNA, 25 bp, Mus musculus
ataaggcactgaagggccacacatg

SEQ ID NO: 205460 - DNA, 25 bp, Mus musculus
ataaggcagagcaggttatttcgct

SEQ ID NO: 205461 - DNA, 25 bp, Mus musculus
ataaggccaaggtttcctttgccaa

SEQ ID NO: 205462 - DNA, 25 bp, Mus musculus
ataaggccacatgttttatggctat

SEQ ID NO: 205463 - DNA, 25 bp, Mus musculus
ataaggctcagagagtctgcaggag

SEQ ID NO: 205464 - DNA, 25 bp, Mus musculus
ataagggcacacctagtcaggtgag

SEQ ID NO: 205465 - DNA, 25 bp, Mus musculus
ataagggctgagaggcaggaaatgt

SEQ ID NO: 205466 - DNA, 25 bp, Mus musculus
ataaggtataaggcttgctcttcag

SEQ ID NO: 205467 - DNA, 25 bp, Mus musculus
ataaggtcaagcctgtgggccgaag

SEQ ID NO: 205468 - DNA, 25 bp, Mus musculus
ataaggtggttcctttggggagata

SEQ ID NO: 205469 - DNA, 25 bp, Mus musculus
ataagtaaaggagaggagccaaaag

SEQ ID NO: 205470 - DNA, 25 bp, Mus musculus
ataagtaaccaaatgagtaagaaag

SEQ ID NO: 205471 - DNA, 25 bp, Mus musculus
ataagtaaccaacacagatccagtc

SEQ ID NO: 205472 - DNA, 25 bp, Mus musculus
ataagtaccaggctggtaagaacag

SEQ ID NO: 205473 - DNA, 25 bp, Mus musculus
ataagtactacaaggacatcaatgc

SEQ ID NO: 205474 - DNA, 25 bp, Mus musculus
ataagtatgggagtgaaggatatat

SEQ ID NO: 205475 - DNA, 25 bp, Mus musculus
ataagtatgggtggtactgcagaaa

SEQ ID NO: 205476 - DNA, 25 bp, Mus musculus
ataagtcgtattaggcttaactccg

SEQ ID NO: 205477 - DNA, 25 bp, Mus musculus
ataagtgaagagagaagtttattga

SEQ ID NO: 205478 - DNA, 25 bp, Mus musculus
ataagtggttctagctttaaggacc

SEQ ID NO: 205479 - DNA, 25 bp, Mus musculus
ataagtggttctaggagctcagact

SEQ ID NO: 205480 - DNA, 25 bp, Mus musculus
ataagtgtgagatcgagtgcttcag

SEQ ID NO: 205481 - DNA, 25 bp, Mus musculus
ataagttcaaagcgcaacaggtcct

SEQ ID NO: 205482 - DNA, 25 bp, Mus musculus
ataagttcaaagctctaggactcca

SEQ ID NO: 205483 - DNA, 25 bp, Mus musculus
ataagttcaaagggcaacaggtcct

SEQ ID NO: 205484 - DNA, 25 bp, Mus musculus
ataagttcaaaggtctaggactcca

SEQ ID NO: 205485 - DNA, 25 bp, Mus musculus
ataagttccaacagactggattttg

SEQ ID NO: 205486 - DNA, 25 bp, Mus musculus
ataagttccaacagtctgatgattt

SEQ ID NO: 205487 - DNA, 25 bp, Mus musculus
ataagttgtgtgccaccatttgaaa

SEQ ID NO: 205488 - DNA, 25 bp, Mus musculus
ataagttgtgtgccattgctgctga

SEQ ID NO: 205489 - DNA, 25 bp, Mus musculus
ataagtttgaggtattctgctatgc

SEQ ID NO: 205490 - DNA, 25 bp, Mus musculus
ataagtttggatgatttaccttgct

SEQ ID NO: 205491 - DNA, 25 bp, Mus musculus
ataataaaaagtgctctatgcccag

SEQ ID NO: 205492 - DNA, 25 bp, Mus musculus
ataataaacaaatttctttcaactg

SEQ ID NO: 205493 - DNA, 25 bp, Mus musculus
ataataaatattgggaggactcagg

SEQ ID NO: 205494 - DNA, 25 bp, Mus musculus
ataataacaaaaactgaacgaacac

SEQ ID NO: 205495 - DNA, 25 bp, Mus musculus
ataataacccaggtagtataactcc

SEQ ID NO: 205496 - DNA, 25 bp, Mus musculus
ataataacccagtgggtaagctgaa

SEQ ID NO: 205497 - DNA, 25 bp, Mus musculus
ataataccaggattgtctacaacca

SEQ ID NO: 205498 - DNA, 25 bp, Mus musculus
ataataccaggtggtgccacagagc

SEQ ID NO: 205499 - DNA, 25 bp, Mus musculus
ataataccatccggttatgggatat

SEQ ID NO: 205500 - DNA, 25 bp, Mus musculus
ataatactagaagatacatcactaa

SEQ ID NO: 205501 - DNA, 25 bp, Mus musculus
ataatagaagatattaaacgacaca

SEQ ID NO: 205502 - DNA, 25 bp, Mus musculus
ataatagaagatattttttgagaaa

SEQ ID NO: 205503 - DNA, 25 bp, Mus musculus
ataatagcagtggcagcaatgttcc

SEQ ID NO: 205504 - DNA, 25 bp, Mus musculus
ataatagccagaacaaatataaagc

SEQ ID NO: 205505 - DNA, 25 bp, Mus musculus
ataataggatcgagatcccgctcaa

SEQ ID NO: 205506 - DNA, 25 bp, Mus musculus
ataatatcttggctttcccccttgt

SEQ ID NO: 205507 - DNA, 25 bp, Mus musculus
ataatatgaatgtctcaggtgaaaa

SEQ ID NO: 205508 - DNA, 25 bp, Mus musculus
ataatatgatgaggggttgccacat

SEQ ID NO: 205509 - DNA, 25 bp, Mus musculus
ataatattacgcaacatatgaaagt

SEQ ID NO: 205510 - DNA, 25 bp, Mus musculus
ataatatttctaatgcggcattcca

SEQ ID NO: 205511 - DNA, 25 bp, Mus musculus
ataatcaaacattatcagcagcgtc

SEQ ID NO: 205512 - DNA, 25 bp, Mus musculus
ataatcaaactacgaccccagcagc

SEQ ID NO: 205513 - DNA, 25 bp, Mus musculus
ataatcaaagatcttgtttttagcc

SEQ ID NO: 205514 - DNA, 25 bp, Mus musculus
ataatcaaatgggttgtgtggtgag

SEQ ID NO: 205515 - DNA, 25 bp, Mus musculus
ataatcacactgaagtgatcccaac

SEQ ID NO: 205516 - DNA, 25 bp, Mus musculus
ataatcagagctgagggaataaaac

SEQ ID NO: 205517 - DNA, 25 bp, Mus musculus
ataatcagaggtatgccttcatgcc

SEQ ID NO: 205518 - DNA, 25 bp, Mus musculus
ataatcagagtacagaggtccctcg

SEQ ID NO: 205519 - DNA, 25 bp, Mus musculus
ataatcagtgtaagctgctcttaac

SEQ ID NO: 205520 - DNA, 25 bp, Mus musculus
ataatcatcttcttcagggtgatgc

SEQ ID NO: 205521 - DNA, 25 bp, Mus musculus
ataatccacagctacacacttgaat

SEQ ID NO: 205522 - DNA, 25 bp, Mus musculus
ataatccaccatgactggtggaagg

SEQ ID NO: 205523 - DNA, 25 bp, Mus musculus
ataatccagccctctaataaagctt

SEQ ID NO: 205524 - DNA, 25 bp, Mus musculus
ataatcccaatgacagttctgcccc

SEQ ID NO: 205525 - DNA, 25 bp, Mus musculus
ataatcctgtggctgaccatatcag

SEQ ID NO: 205526 - DNA, 25 bp, Mus musculus
ataatcctgttttgatggaaggacc

SEQ ID NO: 205527 - DNA, 25 bp, Mus musculus
ataatcgaaggttggctgctgagca

SEQ ID NO: 205528 - DNA, 25 bp, Mus musculus
ataatcgcaaaaacatcaaactgaa

SEQ ID NO: 205529 - DNA, 25 bp, Mus musculus
ataatctgaagaccatggagcaagt

SEQ ID NO: 205530 - DNA, 25 bp, Mus musculus
ataatctgtcacagaaagaaagact

SEQ ID NO: 205531 - DNA, 25 bp, Mus musculus
ataatctgtgaagatgtccagctcg

SEQ ID NO: 205532 - DNA, 25 bp, Mus musculus
ataatcttaacagtgtcttggctga

SEQ ID NO: 205533 - DNA, 25 bp, Mus musculus
ataatcttggtggagaaactcttca

SEQ ID NO: 205534 - DNA, 25 bp, Mus musculus
ataatctttcaaggaccctgatttt

SEQ ID NO: 205535 - DNA, 25 bp, Mus musculus
ataatctttcaaggtttgaccaaaa

SEQ ID NO: 205536 - DNA, 25 bp, Mus musculus
ataatgaaaaggtaatgtatgtgga

SEQ ID NO: 205537 - DNA, 25 bp, Mus musculus
ataatgaaagcccagttcggaaaac

SEQ ID NO: 205538 - DNA, 25 bp, Mus musculus
ataatgaaatggatataaccaagaa

SEQ ID NO: 205539 - DNA, 25 bp, Mus musculus
ataatgaaatggggattggtgtgtg

SEQ ID NO: 205540 - DNA, 25 bp, Mus musculus
ataatgaatgtcaagggaagttgag

SEQ ID NO: 205541 - DNA, 25 bp, Mus musculus
ataatgacttgggacaaaagaaaga

SEQ ID NO: 205542 - DNA, 25 bp, Mus musculus
ataatgagaaatgttgtcagagaat

SEQ ID NO: 205543 - DNA, 25 bp, Mus musculus
ataatgagtttgagatactaagcaa

SEQ ID NO: 205544 - DNA, 25 bp, Mus musculus
ataatgatacctcgttcgtgtctta

SEQ ID NO: 205545 - DNA, 25 bp, Mus musculus
ataatgatgggaagaaacctgatca

SEQ ID NO: 205546 - DNA, 25 bp, Mus musculus
ataatgatgggaaggacaaaccaga

SEQ ID NO: 205547 - DNA, 25 bp, Mus musculus
ataatgattccgatggagggacggc

SEQ ID NO: 205548 - DNA, 25 bp, Mus musculus
ataatgcaaaagactaacctaacat

SEQ ID NO: 205549 - DNA, 25 bp, Mus musculus
ataatgcagggcacaccaagagcca

SEQ ID NO: 205550 - DNA, 25 bp, Mus musculus
ataatgccaacagcactatagttcc

SEQ ID NO: 205551 - DNA, 25 bp, Mus musculus
ataatgccactgaggagctcctagt

SEQ ID NO: 205552 - DNA, 25 bp, Mus musculus
ataatgccactgagtgaagcgtctg

SEQ ID NO: 205553 - DNA, 25 bp, Mus musculus
ataatgccgtggctgctccagtttc

SEQ ID NO: 205554 - DNA, 25 bp, Mus musculus
ataatgccgtggtgtggcttgacct

SEQ ID NO: 205555 - DNA, 25 bp, Mus musculus
ataatgctacgcaggggaaatcctg

SEQ ID NO: 205556 - DNA, 25 bp, Mus musculus
ataatggaaaacacagtttggcttg

SEQ ID NO: 205557 - DNA, 25 bp, Mus musculus
ataatggaagccagaaataggacca

SEQ ID NO: 205558 - DNA, 25 bp, Mus musculus
ataatggaagggccatgccacctcc

SEQ ID NO: 205559 - DNA, 25 bp, Mus musculus
ataatggacccacatgaaaaatgtg

SEQ ID NO: 205560 - DNA, 25 bp, Mus musculus
ataatggactaaacctctgaaactg

SEQ ID NO: 205561 - DNA, 25 bp, Mus musculus
ataatggagatggttctgccgatct

SEQ ID NO: 205562 - DNA, 25 bp, Mus musculus
ataatggcagtggtcctacggctct

SEQ ID NO: 205563 - DNA, 25 bp, Mus musculus
ataatggcctcggtcactttcacga

SEQ ID NO: 205564 - DNA, 25 bp, Mus musculus
ataatggcggggaagctcagtttaa

SEQ ID NO: 205565 - DNA, 25 bp, Mus musculus
ataatggtgatggtcttctccatcg

SEQ ID NO: 205566 - DNA, 25 bp, Mus musculus
ataatggtggagttggccaaacagt

SEQ ID NO: 205567 - DNA, 25 bp, Mus musculus
ataatgtaatctgggtgttgacgat

SEQ ID NO: 205568 - DNA, 25 bp, Mus musculus
ataatgtagatgaaactgaaggctc

SEQ ID NO: 205569 - DNA, 25 bp, Mus musculus
ataatgtagatgaggaagcaaggga

SEQ ID NO: 205570 - DNA, 25 bp, Mus musculus
ataatgtgaaagactaggccaatcc

SEQ ID NO: 205571 - DNA, 25 bp, Mus musculus
ataatgtgtgccaagatattgatga

SEQ ID NO: 205572 - DNA, 25 bp, Mus musculus
ataatgttcattttactgtgtggag

SEQ ID NO: 205573 - DNA, 25 bp, Mus musculus
ataatgttgaaggaagccaaaaacg

SEQ ID NO: 205574 - DNA, 25 bp, Mus musculus
ataattaaaaagtttgcatttcctc

SEQ ID NO: 205575 - DNA, 25 bp, Mus musculus
ataattactgagacaacactggtag

SEQ ID NO: 205576 - DNA, 25 bp, Mus musculus
ataattatttggctgatgaagaatg

SEQ ID NO: 205577 - DNA, 25 bp, Mus musculus
ataattcacagaactgggaagcacg

SEQ ID NO: 205578 - DNA, 25 bp, Mus musculus
ataattcactgctaaaatacattac

SEQ ID NO: 205579 - DNA, 25 bp, Mus musculus
ataattcatccaggtcaagtggaga

SEQ ID NO: 205580 - DNA, 25 bp, Mus musculus
ataattcatccaggttcttaaattc

SEQ ID NO: 205581 - DNA, 25 bp, Mus musculus
ataattccaatgatgttgcaaaatc

SEQ ID NO: 205582 - DNA, 25 bp, Mus musculus
ataattccccagaaattgatgagaa

SEQ ID NO: 205583 - DNA, 25 bp, Mus musculus
ataattccccaggcgttaagcatct

SEQ ID NO: 205584 - DNA, 25 bp, Mus musculus
ataattcctaccacagaaactgcac

SEQ ID NO: 205585 - DNA, 25 bp, Mus musculus
ataattcctcacagacacactggat

SEQ ID NO: 205586 - DNA, 25 bp, Mus musculus
ataattcttgatgagacctctttga

SEQ ID NO: 205587 - DNA, 25 bp, Mus musculus
ataattgaagaagcaacagacttta

SEQ ID NO: 205588 - DNA, 25 bp, Mus musculus
ataattgcaaagataactgggaaaa

SEQ ID NO: 205589 - DNA, 25 bp, Mus musculus
ataattgcaaaggaaggaaggtctg

SEQ ID NO: 205590 - DNA, 25 bp, Mus musculus
ataattgcccaggactcgttaatgt

SEQ ID NO: 205591 - DNA, 25 bp, Mus musculus
ataattgcccagtatttaacagacc

SEQ ID NO: 205592 - DNA, 25 bp, Mus musculus
ataattggtttaagtgctgtgaaga

SEQ ID NO: 205593 - DNA, 25 bp, Mus musculus
ataatttataagagagatggttgtc

SEQ ID NO: 205594 - DNA, 25 bp, Mus musculus
ataatttcaaggttgattctttcag

SEQ ID NO: 205595 - DNA, 25 bp, Mus musculus
ataatttcagctgccagtgaaggag

SEQ ID NO: 205596 - DNA, 25 bp, Mus musculus
ataatttcatacagacgcttgatcc

SEQ ID NO: 205597 - DNA, 25 bp, Mus musculus
ataatttcatacaggattcaatgtt

SEQ ID NO: 205598 - DNA, 25 bp, Mus musculus
ataattttattacgtttggcaaaca

SEQ ID NO: 205599 - DNA, 25 bp, Mus musculus
atacaaaacaactgataaaagagtc

SEQ ID NO: 205600 - DNA, 25 bp, Mus musculus
atacaaaacgctgtaagccgtgcct

SEQ ID NO: 205601 - DNA, 25 bp, Mus musculus
atacaaactgttcaggtagcaacaa

SEQ ID NO: 205602 - DNA, 25 bp, Mus musculus
atacaaagcaaagatcattgcttgt

SEQ ID NO: 205603 - DNA, 25 bp, Mus musculus
atacaaatacaggaagacatttcag

SEQ ID NO: 205604 - DNA, 25 bp, Mus musculus
atacaacactggaagaaaatatcca

SEQ ID NO: 205605 - DNA, 25 bp, Mus musculus
atacaacactggtgtgtcagtcacc

SEQ ID NO: 205606 - DNA, 25 bp, Mus musculus
atacaacatctgatggaacctgtac

SEQ ID NO: 205607 - DNA, 25 bp, Mus musculus
atacaacatctgatggtctatctcc

SEQ ID NO: 205608 - DNA, 25 bp, Mus musculus
atacaacatgctgttgtgaacttgg

SEQ ID NO: 205609 - DNA, 25 bp, Mus musculus
atacaaccgggattgacccaccgtt

SEQ ID NO: 205610 - DNA, 25 bp, Mus musculus
atacaaccgggattggcagaattac

SEQ ID NO: 205611 - DNA, 25 bp, Mus musculus
atacaactcagatcccaagcagtat

SEQ ID NO: 205612 - DNA, 25 bp, Mus musculus
atacaactcagatctccatcagaat

SEQ ID NO: 205613 - DNA, 25 bp, Mus musculus
atacaacttcaggtgaaaattttga

SEQ ID NO: 205614 - DNA, 25 bp, Mus musculus
atacaagaagacaggtaaacacaag

SEQ ID NO: 205615 - DNA, 25 bp, Mus musculus
atacaagaagagttatgaaaagatt

SEQ ID NO: 205616 - DNA, 25 bp, Mus musculus
atacaagaccaggggttcaaggaag

SEQ ID NO: 205617 - DNA, 25 bp, Mus musculus
atacaagagaggtgactacgggggc

SEQ ID NO: 205618 - DNA, 25 bp, Mus musculus
atacaagagcttctactggtgcagt

SEQ ID NO: 205619 - DNA, 25 bp, Mus musculus
atacaagagcttctgagtctatcct

SEQ ID NO: 205620 - DNA, 25 bp, Mus musculus
atacaagcaggtttttctccaggag

SEQ ID NO: 205621 - DNA, 25 bp, Mus musculus
atacaagcgggctttgctgctgctc

SEQ ID NO: 205622 - DNA, 25 bp, Mus musculus
atacaaggataagaatgaagaagaa

SEQ ID NO: 205623 - DNA, 25 bp, Mus musculus
atacaagtatgaacacaattttgaa

SEQ ID NO: 205624 - DNA, 25 bp, Mus musculus
atacaatatggggctgccggtggac

SEQ ID NO: 205625 - DNA, 25 bp, Mus musculus
atacaatattagaaggaacaactgt

SEQ ID NO: 205626 - DNA, 25 bp, Mus musculus
atacaatttctggaaatgatatatt

SEQ ID NO: 205627 - DNA, 25 bp, Mus musculus
atacaatttgtcgataatctgtatc

SEQ ID NO: 205628 - DNA, 25 bp, Mus musculus
atacacaaaagtcaaatgtggatat

SEQ ID NO: 205629 - DNA, 25 bp, Mus musculus
atacacaaccagtttccgttcagac

SEQ ID NO: 205630 - DNA, 25 bp, Mus musculus
atacacaatgagactcaccataagt

SEQ ID NO: 205631 - DNA, 25 bp, Mus musculus
atacacagagaacaaaggctccttc

SEQ ID NO: 205632 - DNA, 25 bp, Mus musculus
atacacagagaagtatagaagaaga

SEQ ID NO: 205633 - DNA, 25 bp, Mus musculus
atacacagagagcgatacacacaag

SEQ ID NO: 205634 - DNA, 25 bp, Mus musculus
atacacagagatatagtgctggccc

SEQ ID NO: 205635 - DNA, 25 bp, Mus musculus
atacacatagttacttgggatttgg

SEQ ID NO: 205636 - DNA, 25 bp, Mus musculus
atacacatatggaggggctttttac

SEQ ID NO: 205637 - DNA, 25 bp, Mus musculus
atacacattaaccagtgcacttaag

SEQ ID NO: 205638 - DNA, 25 bp, Mus musculus
atacacattctcaataacctgtgtg

SEQ ID NO: 205639 - DNA, 25 bp, Mus musculus
atacaccagcccataaaaacgtcaa

SEQ ID NO: 205640 - DNA, 25 bp, Mus musculus
atacaccatcacagaatacactgta

SEQ ID NO: 205641 - DNA, 25 bp, Mus musculus
atacaccatcacagtgttccttcct

SEQ ID NO: 205642 - DNA, 25 bp, Mus musculus
atacacgtctgcccgtgtgctgatg

SEQ ID NO: 205643 - DNA, 25 bp, Mus musculus
atacacgtgcaggtactgtggcaag

SEQ ID NO: 205644 - DNA, 25 bp, Mus musculus
atacactacatacgatctcctccac

SEQ ID NO: 205645 - DNA, 25 bp, Mus musculus
atacactataaggtttgctatgcgc

SEQ ID NO: 205646 - DNA, 25 bp, Mus musculus
atacactctgattactacaagggaa

SEQ ID NO: 205647 - DNA, 25 bp, Mus musculus
atacactgagctcatgaccaggtgc

SEQ ID NO: 205648 - DNA, 25 bp, Mus musculus
atacagaaacaggagaatccaaatg

SEQ ID NO: 205649 - DNA, 25 bp, Mus musculus
atacagaaacaggagttattaaaat

SEQ ID NO: 205650 - DNA, 25 bp, Mus musculus
atacagaaagagtatgaaaagacac

SEQ ID NO: 205651 - DNA, 25 bp, Mus musculus
atacagaaagagtctttctcctttg

SEQ ID NO: 205652 - DNA, 25 bp, Mus musculus
atacagaaatgaaagtatcaagcac

SEQ ID NO: 205653 - DNA, 25 bp, Mus musculus
atacagaaccgaggtagtcaagaac

SEQ ID NO: 205654 - DNA, 25 bp, Mus musculus
atacagaagaagaaaagctcaacag

SEQ ID NO: 205655 - DNA, 25 bp, Mus musculus
atacagaatatttaatacgaacaga

SEQ ID NO: 205656 - DNA, 25 bp, Mus musculus
atacagacaggttaactgagggatg

SEQ ID NO: 205657 - DNA, 25 bp, Mus musculus
atacagaccttactgtggcctcaga

SEQ ID NO: 205658 - DNA, 25 bp, Mus musculus
atacagatatggagtaacaactgtt

SEQ ID NO: 205659 - DNA, 25 bp, Mus musculus
atacagatatggagtatacaataga

SEQ ID NO: 205660 - DNA, 25 bp, Mus musculus
atacagatcagagaaaatatggcac

SEQ ID NO: 205661 - DNA, 25 bp, Mus musculus
atacagatcagggagcctttgccta

SEQ ID NO: 205662 - DNA, 25 bp, Mus musculus
atacagcaaataaggagacagtgat

SEQ ID NO: 205663 - DNA, 25 bp, Mus musculus
atacagcagaagaggaccacgactt

SEQ ID NO: 205664 - DNA, 25 bp, Mus musculus
atacagcagcagggcacgtcagagg

SEQ ID NO: 205665 - DNA, 25 bp, Mus musculus
atacagccaacagagcttggccaga

SEQ ID NO: 205666 - DNA, 25 bp, Mus musculus
atacagccaaggccaggtagctgaa

SEQ ID NO: 205667 - DNA, 25 bp, Mus musculus
atacagccagagaagtgacagggaa

SEQ ID NO: 205668 - DNA, 25 bp, Mus musculus
atacagccaggaaacaaagcttagc

SEQ ID NO: 205669 - DNA, 25 bp, Mus musculus
atacagccaggaaggaatctgctat

SEQ ID NO: 205670 - DNA, 25 bp, Mus musculus
atacagccaggatctgagtgttcga

SEQ ID NO: 205671 - DNA, 25 bp, Mus musculus
atacagccaggatgaggtagatgac

SEQ ID NO: 205672 - DNA, 25 bp, Mus musculus
atacagcttttatcaaaggtgtgcc

SEQ ID NO: 205673 - DNA, 25 bp, Mus musculus
atacaggactcaggtagatgagagg

SEQ ID NO: 205674 - DNA, 25 bp, Mus musculus
atacaggactcaggtaggttgatgg

SEQ ID NO: 205675 - DNA, 25 bp, Mus musculus
atacagggagcctgctttggtacta

SEQ ID NO: 205676 - DNA, 25 bp, Mus musculus
atacaggtcatcaagatgaacagga

SEQ ID NO: 205677 - DNA, 25 bp, Mus musculus
atacaggtcatcaaggacttcccat

SEQ ID NO: 205678 - DNA, 25 bp, Mus musculus
atacagtaaatggaagatcaagatc

SEQ ID NO: 205679 - DNA, 25 bp, Mus musculus
atacataaatatgcaaacagggagg

SEQ ID NO: 205680 - DNA, 25 bp, Mus musculus
atacataaatatgtaaagaacatgt

SEQ ID NO: 205681 - DNA, 25 bp, Mus musculus
atacatagcgacagcgaaggacgaa

SEQ ID NO: 205682 - DNA, 25 bp, Mus musculus
atacatattcttcatcgtcatttac

SEQ ID NO: 205683 - DNA, 25 bp, Mus musculus
atacatcaaaagctgcagaatctgt

SEQ ID NO: 205684 - DNA, 25 bp, Mus musculus
atacatcagagacttcagtactcgc

SEQ ID NO: 205685 - DNA, 25 bp, Mus musculus
atacatccaggtgcatggaggactg

SEQ ID NO: 205686 - DNA, 25 bp, Mus musculus
atacatccctgccaaatttccaagc

SEQ ID NO: 205687 - DNA, 25 bp, Mus musculus
atacatccctgccaacaagaacctg

SEQ ID NO: 205688 - DNA, 25 bp, Mus musculus
atacatccggggactgagtggggtc

SEQ ID NO: 205689 - DNA, 25 bp, Mus musculus
atacatctagtggcagagagttgaa

SEQ ID NO: 205690 - DNA, 25 bp, Mus musculus
atacatctgccagtgtcctggcata

SEQ ID NO: 205691 - DNA, 25 bp, Mus musculus
atacatgctttgatgtcccgcatgg

SEQ ID NO: 205692 - DNA, 25 bp, Mus musculus
atacatgggcaacgctggacgtaaa

SEQ ID NO: 205693 - DNA, 25 bp, Mus musculus
atacatggtggtacaccatgaggcc

SEQ ID NO: 205694 - DNA, 25 bp, Mus musculus
atacatgtcaagatgtgaatgagtg

SEQ ID NO: 205695 - DNA, 25 bp, Mus musculus
atacatgtcaagatgtggatgagtg

SEQ ID NO: 205696 - DNA, 25 bp, Mus musculus
atacatgtcaagcatcagtgaacac

SEQ ID NO: 205697 - DNA, 25 bp, Mus musculus
atacattaaaagttttcagcagact

SEQ ID NO: 205698 - DNA, 25 bp, Mus musculus
atacattaaaggaggcacttgactc

SEQ ID NO: 205699 - DNA, 25 bp, Mus musculus
atacattattggagatcgtggcctt

SEQ ID NO: 205700 - DNA, 25 bp, Mus musculus
atacattattggaggtgctctgccc

SEQ ID NO: 205701 - DNA, 25 bp, Mus musculus
atacattcagagcaggagcctttga

SEQ ID NO: 205702 - DNA, 25 bp, Mus musculus
atacattcagcccacttggtgcctc

SEQ ID NO: 205703 - DNA, 25 bp, Mus musculus
atacattcaggaagccgaaatgttg

SEQ ID NO: 205704 - DNA, 25 bp, Mus musculus
atacattccagggccttattttggc

SEQ ID NO: 205705 - DNA, 25 bp, Mus musculus
atacattctcaaggtttcttttaca

SEQ ID NO: 205706 - DNA, 25 bp, Mus musculus
atacatttaaaagctatgacttcac

SEQ ID NO: 205707 - DNA, 25 bp, Mus musculus
atacatttaaaaggccatatcaata

SEQ ID NO: 205708 - DNA, 25 bp, Mus musculus
atacatttcaaggcacagaagaaaa

SEQ ID NO: 205709 - DNA, 25 bp, Mus musculus
atacatttcaagtcttcaggaaaga

SEQ ID NO: 205710 - DNA, 25 bp, Mus musculus
atacattttcacggacaagccctca

SEQ ID NO: 205711 - DNA, 25 bp, Mus musculus
ataccaaaaagcagatggagacacg

SEQ ID NO: 205712 - DNA, 25 bp, Mus musculus
ataccaaaaagcagattgtccatcc

SEQ ID NO: 205713 - DNA, 25 bp, Mus musculus
ataccaaaaatagcgaccagttcgt

SEQ ID NO: 205714 - DNA, 25 bp, Mus musculus
ataccaaatcagcagaaatggagga

SEQ ID NO: 205715 - DNA, 25 bp, Mus musculus
ataccaacaaggcaaagggtggtgg

SEQ ID NO: 205716 - DNA, 25 bp, Mus musculus
ataccaacgtggtccactgacaaag

SEQ ID NO: 205717 - DNA, 25 bp, Mus musculus
ataccaactacaggtcaccttgttg

SEQ ID NO: 205718 - DNA, 25 bp, Mus musculus
ataccaagaagtgtcgagagctgta

SEQ ID NO: 205719 - DNA, 25 bp, Mus musculus
ataccaagccatggtacactgtggg

SEQ ID NO: 205720 - DNA, 25 bp, Mus musculus
ataccaagcctagtgctaccaaggg

SEQ ID NO: 205721 - DNA, 25 bp, Mus musculus
ataccaaggactgctacaccttaca

SEQ ID NO: 205722 - DNA, 25 bp, Mus musculus
ataccaaggactggccttctcagta

SEQ ID NO: 205723 - DNA, 25 bp, Mus musculus
ataccaaggaggccaaattgggaca

SEQ ID NO: 205724 - DNA, 25 bp, Mus musculus
ataccaaggagtttctatgattgtt

SEQ ID NO: 205725 - DNA, 25 bp, Mus musculus
ataccaatagagggggctactgagt

SEQ ID NO: 205726 - DNA, 25 bp, Mus musculus
ataccaatggcctgatcacaactgg

SEQ ID NO: 205727 - DNA, 25 bp, Mus musculus
ataccaatttaagctccagctccag

SEQ ID NO: 205728 - DNA, 25 bp, Mus musculus
ataccacaacacaacaatcttggga

SEQ ID NO: 205729 - DNA, 25 bp, Mus musculus
ataccacacagcaaggggacggggc

SEQ ID NO: 205730 - DNA, 25 bp, Mus musculus
ataccacacagcaagggggaagcat

SEQ ID NO: 205731 - DNA, 25 bp, Mus musculus
ataccacagcgtgctctcaatgaag

SEQ ID NO: 205732 - DNA, 25 bp, Mus musculus
ataccagaatgaggatcccagaaag

SEQ ID NO: 205733 - DNA, 25 bp, Mus musculus
ataccagagatagagacaaaagact

SEQ ID NO: 205734 - DNA, 25 bp, Mus musculus
ataccagcgaggggtcccgtagccg

SEQ ID NO: 205735 - DNA, 25 bp, Mus musculus
ataccagcttcagatctacccaaac

SEQ ID NO: 205736 - DNA, 25 bp, Mus musculus
ataccagcttcaggttgcatcagtg

SEQ ID NO: 205737 - DNA, 25 bp, Mus musculus
ataccagctttagtcctcaaaggcc

SEQ ID NO: 205738 - DNA, 25 bp, Mus musculus
ataccaggaatttccacagtgcctt

SEQ ID NO: 205739 - DNA, 25 bp, Mus musculus
ataccagggaaactgggatctgttg

SEQ ID NO: 205740 - DNA, 25 bp, Mus musculus
ataccaggtccgaagtgctgactgg

SEQ ID NO: 205741 - DNA, 25 bp, Mus musculus
ataccagtgaaatgcctgcccagaa

SEQ ID NO: 205742 - DNA, 25 bp, Mus musculus
ataccagtgaaatgtctgcccagaa

SEQ ID NO: 205743 - DNA, 25 bp, Mus musculus
ataccatacacaaggccagctgttg

SEQ ID NO: 205744 - DNA, 25 bp, Mus musculus
ataccatatcagtgccttgtatgtg

SEQ ID NO: 205745 - DNA, 25 bp, Mus musculus
ataccatccggttatgggatattga

SEQ ID NO: 205746 - DNA, 25 bp, Mus musculus
ataccatgaggcttacagtccaagc

SEQ ID NO: 205747 - DNA, 25 bp, Mus musculus
ataccattaaaaagcctcaagccca

SEQ ID NO: 205748 - DNA, 25 bp, Mus musculus
ataccattaaaaagctcactctgca

SEQ ID NO: 205749 - DNA, 25 bp, Mus musculus
atacccaaagatctttataagctat

SEQ ID NO: 205750 - DNA, 25 bp, Mus musculus
atacccaaaggtatcacagccacaa

SEQ ID NO: 205751 - DNA, 25 bp, Mus musculus
atacccaatcagggggagatcttgg

SEQ ID NO: 205752 - DNA, 25 bp, Mus musculus
atacccaatcaggtgatccgcaggg

SEQ ID NO: 205753 - DNA, 25 bp, Mus musculus
atacccacacacaagtctggccaca

SEQ ID NO: 205754 - DNA, 25 bp, Mus musculus
atacccagagccctgcaactcccac

SEQ ID NO: 205755 - DNA, 25 bp, Mus musculus
atacccagccaaagccctggactat

SEQ ID NO: 205756 - DNA, 25 bp, Mus musculus
atacccagcctggtctatacagagg

SEQ ID NO: 205757 - DNA, 25 bp, Mus musculus
atacccatgtctgaccttctgcccc

SEQ ID NO: 205758 - DNA, 25 bp, Mus musculus
atacccatttcacagggagcccgaa

SEQ ID NO: 205759 - DNA, 25 bp, Mus musculus
ataccccatgcagctatctaacttc

SEQ ID NO: 205760 - DNA, 25 bp, Mus musculus
ataccccatggagactcggctgact

SEQ ID NO: 205761 - DNA, 25 bp, Mus musculus
ataccccatgtcagggagacagctg

SEQ ID NO: 205762 - DNA, 25 bp, Mus musculus
ataccccccggtgccacattctggg

SEQ ID NO: 205763 - DNA, 25 bp, Mus musculus
atacccccgccacattgacagttct

SEQ ID NO: 205764 - DNA, 25 bp, Mus musculus
ataccccctttggagacctccacac

SEQ ID NO: 205765 - DNA, 25 bp, Mus musculus
ataccccgaatccagaatcggaaga

SEQ ID NO: 205766 - DNA, 25 bp, Mus musculus
atacccctctataaaactggtggtg

SEQ ID NO: 205767 - DNA, 25 bp, Mus musculus
atacccctctctggtggtggagctg

SEQ ID NO: 205768 - DNA, 25 bp, Mus musculus
atacccctcttgacccagccctgca

SEQ ID NO: 205769 - DNA, 25 bp, Mus musculus
atacccctgagggaggtgaccattg

SEQ ID NO: 205770 - DNA, 25 bp, Mus musculus
atacccgacaatgcttttgtcaatc

SEQ ID NO: 205771 - DNA, 25 bp, Mus musculus
atacccgacccgatttctctgtgta

SEQ ID NO: 205772 - DNA, 25 bp, Mus musculus
atacccgacccggcaccagccacac

SEQ ID NO: 205773 - DNA, 25 bp, Mus musculus
ataccctagccggaaagccagtgta

SEQ ID NO: 205774 - DNA, 25 bp, Mus musculus
ataccctagccgtgtacaagtctcc

SEQ ID NO: 205775 - DNA, 25 bp, Mus musculus
ataccctcacaaccccggctacaac

SEQ ID NO: 205776 - DNA, 25 bp, Mus musculus
ataccctctgtggtgagcatcagat

SEQ ID NO: 205777 - DNA, 25 bp, Mus musculus
ataccctctgtgtgacagctcaact

SEQ ID NO: 205778 - DNA, 25 bp, Mus musculus
ataccctgcagcatagcatctcccg

SEQ ID NO: 205779 - DNA, 25 bp, Mus musculus
ataccctgcaggtgatctgtctggc

SEQ ID NO: 205780 - DNA, 25 bp, Mus musculus
ataccctggtaactgctgggggctc

SEQ ID NO: 205781 - DNA, 25 bp, Mus musculus
atacccttaccacctatgtgccatg

SEQ ID NO: 205782 - DNA, 25 bp, Mus musculus
atacccttttcagactcttgtgtac

SEQ ID NO: 205783 - DNA, 25 bp, Mus musculus
atacccttttcaggtcgtgcatgac

SEQ ID NO: 205784 - DNA, 25 bp, Mus musculus
ataccgaaaatgaaggttctgggct

SEQ ID NO: 205785 - DNA, 25 bp, Mus musculus
ataccgaaaatgaagtcgagcctgt

SEQ ID NO: 205786 - DNA, 25 bp, Mus musculus
ataccgcaagagacagataaatccc

SEQ ID NO: 205787 - DNA, 25 bp, Mus musculus
ataccgcaagatcgtctacttcatg

SEQ ID NO: 205788 - DNA, 25 bp, Mus musculus
ataccgcaagggcctgctgaaaatg

SEQ ID NO: 205789 - DNA, 25 bp, Mus musculus
ataccggccaggtgtatgatgaaaa

SEQ ID NO: 205790 - DNA, 25 bp, Mus musculus
ataccgtaggtggtcaactattcct

SEQ ID NO: 205791 - DNA, 25 bp, Mus musculus
ataccgtgagcaggtacctggagtc

SEQ ID NO: 205792 - DNA, 25 bp, Mus musculus
ataccgttgtcccagaggtgcccca

SEQ ID NO: 205793 - DNA, 25 bp, Mus musculus
ataccgttgtcccagctgtccctcc

SEQ ID NO: 205794 - DNA, 25 bp, Mus musculus
atacctacccctcaagaaaagctac

SEQ ID NO: 205795 - DNA, 25 bp, Mus musculus
atacctacccctcaagccttcctgc

SEQ ID NO: 205796 - DNA, 25 bp, Mus musculus
atacctagcaggtcctcatgggtat

SEQ ID NO: 205797 - DNA, 25 bp, Mus musculus
atacctatgacttagcaggttcttg

SEQ ID NO: 205798 - DNA, 25 bp, Mus musculus
atacctcaagctggcacagtgatgc

SEQ ID NO: 205799 - DNA, 25 bp, Mus musculus
atacctcaagggtgaggatcctttt

SEQ ID NO: 205800 - DNA, 25 bp, Mus musculus
atacctcaatcaaggtcagtcgtat

SEQ ID NO: 205801 - DNA, 25 bp, Mus musculus
atacctcaatcaaggtgtggtccca

SEQ ID NO: 205802 - DNA, 25 bp, Mus musculus
atacctcacaggacctggagttgct

SEQ ID NO: 205803 - DNA, 25 bp, Mus musculus
atacctcacaggtgatccactgcgt

SEQ ID NO: 205804 - DNA, 25 bp, Mus musculus
atacctcgagaattatagtgaacat

SEQ ID NO: 205805 - DNA, 25 bp, Mus musculus
atacctctaggcctgctctgttcac

SEQ ID NO: 205806 - DNA, 25 bp, Mus musculus
atacctctaggccttatattgtgtg

SEQ ID NO: 205807 - DNA, 25 bp, Mus musculus
atacctgacaggagtggggatactg

SEQ ID NO: 205808 - DNA, 25 bp, Mus musculus
atacctgacaggcaggccaggagtg

SEQ ID NO: 205809 - DNA, 25 bp, Mus musculus
atacctgaccacggtgattgggata

SEQ ID NO: 205810 - DNA, 25 bp, Mus musculus
atacctgaccacggtttggctcctt

SEQ ID NO: 205811 - DNA, 25 bp, Mus musculus
atacctgagaattgattcatctgtt

SEQ ID NO: 205812 - DNA, 25 bp, Mus musculus
atacctgagctcgatgtcggttgga

SEQ ID NO: 205813 - DNA, 25 bp, Mus musculus
atacctgagctcgctggcttctccc

SEQ ID NO: 205814 - DNA, 25 bp, Mus musculus
atacctgctgagggacccagggtcc

SEQ ID NO: 205815 - DNA, 25 bp, Mus musculus
atacctgctgctccagcacggaagc

SEQ ID NO: 205816 - DNA, 25 bp, Mus musculus
atacctgcttaccggtatgacccat

SEQ ID NO: 205817 - DNA, 25 bp, Mus musculus
atacctgcttttgaggagttccact

SEQ ID NO: 205818 - DNA, 25 bp, Mus musculus
atacctggagcacacatccattcct

SEQ ID NO: 205819 - DNA, 25 bp, Mus musculus
atacctggagtgtctggtcctggat

SEQ ID NO: 205820 - DNA, 25 bp, Mus musculus
atacctggatcctgagcatgctgcc

SEQ ID NO: 205821 - DNA, 25 bp, Mus musculus
atacctggatgaggagaaacttgaa

SEQ ID NO: 205822 - DNA, 25 bp, Mus musculus
atacctggatgaggagaactttgtg

SEQ ID NO: 205823 - DNA, 25 bp, Mus musculus
atacctggggacagaattgccctag

SEQ ID NO: 205824 - DNA, 25 bp, Mus musculus
ataccttacggtccctttccttgca

SEQ ID NO: 205825 - DNA, 25 bp, Mus musculus
ataccttagttcagaatgtgattct

SEQ ID NO: 205826 - DNA, 25 bp, Mus musculus
ataccttagttcagatcctagcccg

SEQ ID NO: 205827 - DNA, 25 bp, Mus musculus
ataccttcaagatgctgggtgccct

SEQ ID NO: 205828 - DNA, 25 bp, Mus musculus
ataccttcaagccaccttcaagacc

SEQ ID NO: 205829 - DNA, 25 bp, Mus musculus
ataccttcgagatgctgggtgccct

SEQ ID NO: 205830 - DNA, 25 bp, Mus musculus
ataccttcgagccttcccagaggcc

SEQ ID NO: 205831 - DNA, 25 bp, Mus musculus
ataccttgaactgagctggtgggga

SEQ ID NO: 205832 - DNA, 25 bp, Mus musculus
atacctttaacagcccttagggcca

SEQ ID NO: 205833 - DNA, 25 bp, Mus musculus
atacctttaacagcctctttccagg

SEQ ID NO: 205834 - DNA, 25 bp, Mus musculus
atacctttaacaggattccagtctt

SEQ ID NO: 205835 - DNA, 25 bp, Mus musculus
atacctttaacagggccatcatgga

SEQ ID NO: 205836 - DNA, 25 bp, Mus musculus
atacgaaaaggaacttacacatttg

SEQ ID NO: 205837 - DNA, 25 bp, Mus musculus
atacgaaaaggctctacctctgaag

SEQ ID NO: 205838 - DNA, 25 bp, Mus musculus
atacgaaagtcccagcactccgtcc

SEQ ID NO: 205839 - DNA, 25 bp, Mus musculus
atacgaacgtggatgaggctgtaga

SEQ ID NO: 205840 - DNA, 25 bp, Mus musculus
atacgaactgcctgatgtaaagaat

SEQ ID NO: 205841 - DNA, 25 bp, Mus musculus
atacgaagaggaagaggaggcccaa

SEQ ID NO: 205842 - DNA, 25 bp, Mus musculus
atacgaagaggaatcttttgtgttt

SEQ ID NO: 205843 - DNA, 25 bp, Mus musculus
atacgacaaacctgaggtctggaag

SEQ ID NO: 205844 - DNA, 25 bp, Mus musculus
atacgacaaataagatgcacgccat

SEQ ID NO: 205845 - DNA, 25 bp, Mus musculus
atacgacagctgcctcctagctttc

SEQ ID NO: 205846 - DNA, 25 bp, Mus musculus
atacgacagctgggctacttgatta

SEQ ID NO: 205847 - DNA, 25 bp, Mus musculus
atacgatcacaagatgtctggtcag

SEQ ID NO: 205848 - DNA, 25 bp, Mus musculus
atacgatcacaagattggcgaaaga

SEQ ID NO: 205849 - DNA, 25 bp, Mus musculus
atacgatcacagataactatgctaa

SEQ ID NO: 205850 - DNA, 25 bp, Mus musculus
atacgatcacagggatctcgattgt

SEQ ID NO: 205851 - DNA, 25 bp, Mus musculus
atacgatctctttgggtccattttc

SEQ ID NO: 205852 - DNA, 25 bp, Mus musculus
atacgattcagatggttacggctct

SEQ ID NO: 205853 - DNA, 25 bp, Mus musculus
atacgcacagatcttgatatggaag

SEQ ID NO: 205854 - DNA, 25 bp, Mus musculus
atacgccacaagaactggaacagac

SEQ ID NO: 205855 - DNA, 25 bp, Mus musculus
atacgccacaagtaatcagccagtc

SEQ ID NO: 205856 - DNA, 25 bp, Mus musculus
atacgccttttatgcatcttggcat

SEQ ID NO: 205857 - DNA, 25 bp, Mus musculus
atacgcggcgagccggtgtgagaag

SEQ ID NO: 205858 - DNA, 25 bp, Mus musculus
atacgcggcggcgcctgtgtctggc

SEQ ID NO: 205859 - DNA, 25 bp, Mus musculus
atacgctacacgactggcccagatg

SEQ ID NO: 205860 - DNA, 25 bp, Mus musculus
atacgctcagccatgaagatgaggg

SEQ ID NO: 205861 - DNA, 25 bp, Mus musculus
atacgctctgagaagtactctcaag

SEQ ID NO: 205862 - DNA, 25 bp, Mus musculus
atacgctctgagaatgtatgactcg

SEQ ID NO: 205863 - DNA, 25 bp, Mus musculus
atacgctgccgtgtacccctccaca

SEQ ID NO: 205864 - DNA, 25 bp, Mus musculus
atacgctgctgagataggacgggag

SEQ ID NO: 205865 - DNA, 25 bp, Mus musculus
atacgctgctgagcttcacctggtt

SEQ ID NO: 205866 - DNA, 25 bp, Mus musculus
atacgctggccactggtttatatcc

SEQ ID NO: 205867 - DNA, 25 bp, Mus musculus
atacggaagcaaggaaaatccaatt

SEQ ID NO: 205868 - DNA, 25 bp, Mus musculus
atacggaagcccctctggaaccggg

SEQ ID NO: 205869 - DNA, 25 bp, Mus musculus
atacggacacataactggctctgtc

SEQ ID NO: 205870 - DNA, 25 bp, Mus musculus
atacggacataaatattcttgtaga

SEQ ID NO: 205871 - DNA, 25 bp, Mus musculus
atacggacttggacattaaggcccg

SEQ ID NO: 205872 - DNA, 25 bp, Mus musculus
atacggcacctcgacacgtgtgcaa

SEQ ID NO: 205873 - DNA, 25 bp, Mus musculus
atacggcacctcggctggaaccctg

SEQ ID NO: 205874 - DNA, 25 bp, Mus musculus
atacggcctttattaagtacagtcc

SEQ ID NO: 205875 - DNA, 25 bp, Mus musculus
atacgggaagcaaacattcgagatc

SEQ ID NO: 205876 - DNA, 25 bp, Mus musculus
atacgggattggcctagaaggaggg

SEQ ID NO: 205877 - DNA, 25 bp, Mus musculus
atacgggcaacaaaatggcagtgaa

SEQ ID NO: 205878 - DNA, 25 bp, Mus musculus
atacgggcaacaaagatttctgaaa

SEQ ID NO: 205879 - DNA, 25 bp, Mus musculus
atacgggcaacaaagtgcactaggc

SEQ ID NO: 205880 - DNA, 25 bp, Mus musculus
atacgggcaacaaatatgtctggat

SEQ ID NO: 205881 - DNA, 25 bp, Mus musculus
atacgggcgcgagggcgccgagcgc

SEQ ID NO: 205882 - DNA, 25 bp, Mus musculus
atacgggctgattcgctactcggag

SEQ ID NO: 205883 - DNA, 25 bp, Mus musculus
atacgggctggccaagcccagagaa

SEQ ID NO: 205884 - DNA, 25 bp, Mus musculus
atacgggctggtccaaaaggaactt

SEQ ID NO: 205885 - DNA, 25 bp, Mus musculus
atacggtggtgcaatctgccagctt

SEQ ID NO: 205886 - DNA, 25 bp, Mus musculus
atacggtggtgcacctcgcctgcat

SEQ ID NO: 205887 - DNA, 25 bp, Mus musculus
atacggtggtgcaggctctccttcc

SEQ ID NO: 205888 - DNA, 25 bp, Mus musculus
atacggttcggtcaccactcaagat

SEQ ID NO: 205889 - DNA, 25 bp, Mus musculus
atacgtatagccaggtggtgaccgt

SEQ ID NO: 205890 - DNA, 25 bp, Mus musculus
atacgtcaaagagcagtgacttatg

SEQ ID NO: 205891 - DNA, 25 bp, Mus musculus
atacgtgaagttctccaaggagagg

SEQ ID NO: 205892 - DNA, 25 bp, Mus musculus
atacgtgctaataagattgagtctg

SEQ ID NO: 205893 - DNA, 25 bp, Mus musculus
atacgtgctaataaggggttgatag

SEQ ID NO: 205894 - DNA, 25 bp, Mus musculus
atacgtgcttggcggcgcctgtgag

SEQ ID NO: 205895 - DNA, 25 bp, Mus musculus
atacgtgtcgtcagcagccttttgg

SEQ ID NO: 205896 - DNA, 25 bp, Mus musculus
atacgttatgaaagacctgtgttgc

SEQ ID NO: 205897 - DNA, 25 bp, Mus musculus
atacgttccaggagttacagcttcc

SEQ ID NO: 205898 - DNA, 25 bp, Mus musculus
atacgttcgcaactcacggatgatt

SEQ ID NO: 205899 - DNA, 25 bp, Mus musculus
atacgttgttgctaagacattcgac

SEQ ID NO: 205900 - DNA, 25 bp, Mus musculus
atacgtttttcagaatgccggacac

SEQ ID NO: 205901 - DNA, 25 bp, Mus musculus
atactaaaaggagacagtggaatcc

SEQ ID NO: 205902 - DNA, 25 bp, Mus musculus
atactaaaagtgaagcctgtctgca

SEQ ID NO: 205903 - DNA, 25 bp, Mus musculus
atactaactaaaggatgacagtccc

SEQ ID NO: 205904 - DNA, 25 bp, Mus musculus
atactaatttatcgcggaaccctct

SEQ ID NO: 205905 - DNA, 25 bp, Mus musculus
atactaatttatggcggaaccctct

SEQ ID NO: 205906 - DNA, 25 bp, Mus musculus
atactacatttttttccagaggcct

SEQ ID NO: 205907 - DNA, 25 bp, Mus musculus
atactaccacaaggggacatgaagc

SEQ ID NO: 205908 - DNA, 25 bp, Mus musculus
atactacgttgatcacctcaaccag

SEQ ID NO: 205909 - DNA, 25 bp, Mus musculus
atactagaagatacatcactaaaga

SEQ ID NO: 205910 - DNA, 25 bp, Mus musculus
atactatctatgcaaaagtagacaa

SEQ ID NO: 205911 - DNA, 25 bp, Mus musculus
atactatggtaaagatccctcaaga

SEQ ID NO: 205912 - DNA, 25 bp, Mus musculus
atactattacggcatcctgagtgat

SEQ ID NO: 205913 - DNA, 25 bp, Mus musculus
atactattacggcatggaccttgac

SEQ ID NO: 205914 - DNA, 25 bp, Mus musculus
atactattgttgcaatcatggcaga

SEQ ID NO: 205915 - DNA, 25 bp, Mus musculus
atactcaaagggcagcacatgagcg

SEQ ID NO: 205916 - DNA, 25 bp, Mus musculus
atactcaaaggtgttggggccactc

SEQ ID NO: 205917 - DNA, 25 bp, Mus musculus
atactcaactcaaatattatgagaa

SEQ ID NO: 205918 - DNA, 25 bp, Mus musculus
atactcaactcaaatattttgaaaa

SEQ ID NO: 205919 - DNA, 25 bp, Mus musculus
atactcaactcaactctctgaaaac

SEQ ID NO: 205920 - DNA, 25 bp, Mus musculus
atactcacagaaagaagaatcctca

SEQ ID NO: 205921 - DNA, 25 bp, Mus musculus
atactcacgtgaatgatggcactga

SEQ ID NO: 205922 - DNA, 25 bp, Mus musculus
atactcagccccagagcagctctta

SEQ ID NO: 205923 - DNA, 25 bp, Mus musculus
atactcagtccattgtaatctcaga

SEQ ID NO: 205924 - DNA, 25 bp, Mus musculus
atactcatcctgggtcactgacaat

SEQ ID NO: 205925 - DNA, 25 bp, Mus musculus
atactcatctcaggacagctccctc

SEQ ID NO: 205926 - DNA, 25 bp, Mus musculus
atactcatctcagggctgtccaaga

SEQ ID NO: 205927 - DNA, 25 bp, Mus musculus
atactccaattaatccccccttcta

SEQ ID NO: 205928 - DNA, 25 bp, Mus musculus
atactccactcttggatatcacgta

SEQ ID NO: 205929 - DNA, 25 bp, Mus musculus
atactccactcttggcaagtcggct

SEQ ID NO: 205930 - DNA, 25 bp, Mus musculus
atactcccgtttggtgaactgactc

SEQ ID NO: 205931 - DNA, 25 bp, Mus musculus
atactcccttcagagggaggggcga

SEQ ID NO: 205932 - DNA, 25 bp, Mus musculus
atactccgcaaccgatcacttgtgg

SEQ ID NO: 205933 - DNA, 25 bp, Mus musculus
atactcgagccaggttctctccact

SEQ ID NO: 205934 - DNA, 25 bp, Mus musculus
atactctacgacacgaacctgccag

SEQ ID NO: 205935 - DNA, 25 bp, Mus musculus
atactctcagagatgctggagtgtc

SEQ ID NO: 205936 - DNA, 25 bp, Mus musculus
atactctctttttagtctctggaag

SEQ ID NO: 205937 - DNA, 25 bp, Mus musculus
atactctgtgccagacatcctgcag

SEQ ID NO: 205938 - DNA, 25 bp, Mus musculus
atactctgtgccagccatgaatgtc

SEQ ID NO: 205939 - DNA, 25 bp, Mus musculus
atactctttaaggaagattactttg

SEQ ID NO: 205940 - DNA, 25 bp, Mus musculus
atactgaaatgactggaaagttaat

SEQ ID NO: 205941 - DNA, 25 bp, Mus musculus
atactgaagaaggacagctcctctg

SEQ ID NO: 205942 - DNA, 25 bp, Mus musculus
atactgagcacggtgcctgtggcct

SEQ ID NO: 205943 - DNA, 25 bp, Mus musculus
atactgagcacggtgttcctgtagt

SEQ ID NO: 205944 - DNA, 25 bp, Mus musculus
atactgagctgactaagccccagtc

SEQ ID NO: 205945 - DNA, 25 bp, Mus musculus
atactgagggtggaagggccaggga

SEQ ID NO: 205946 - DNA, 25 bp, Mus musculus
atactgagtttttagatattatgag

SEQ ID NO: 205947 - DNA, 25 bp, Mus musculus
atactgatactggtgaagaaaatct

SEQ ID NO: 205948 - DNA, 25 bp, Mus musculus
atactgatagaccctgttgactgac

SEQ ID NO: 205949 - DNA, 25 bp, Mus musculus
atactgatgcctcaggttcaaccag

SEQ ID NO: 205950 - DNA, 25 bp, Mus musculus
atactgattctgtggaactagtctt

SEQ ID NO: 205951 - DNA, 25 bp, Mus musculus
atactgcagagctacgagtctggtc

SEQ ID NO: 205952 - DNA, 25 bp, Mus musculus
atactgcatacacaggaaagggctg

SEQ ID NO: 205953 - DNA, 25 bp, Mus musculus
atactgcataccgacaacatctggg

SEQ ID NO: 205954 - DNA, 25 bp, Mus musculus
atactgcatgacatcaacagtgatg

SEQ ID NO: 205955 - DNA, 25 bp, Mus musculus
atactgccaaaggtcttttccgggc

SEQ ID NO: 205956 - DNA, 25 bp, Mus musculus
atactgccacatgctgctggggcca

SEQ ID NO: 205957 - DNA, 25 bp, Mus musculus
atactgccatcaaggcccctaacag

SEQ ID NO: 205958 - DNA, 25 bp, Mus musculus
atactgccatttgatcacagccgag

SEQ ID NO: 205959 - DNA, 25 bp, Mus musculus
atactgccgtaccagagccattcat

SEQ ID NO: 205960 - DNA, 25 bp, Mus musculus
atactgccgtaccagggacattctt

SEQ ID NO: 205961 - DNA, 25 bp, Mus musculus
atactgctcaatccatcgagacaca

SEQ ID NO: 205962 - DNA, 25 bp, Mus musculus
atactgctggagggctgcagtatgg

SEQ ID NO: 205963 - DNA, 25 bp, Mus musculus
atactgcttaagtatttttctgacc

SEQ ID NO: 205964 - DNA, 25 bp, Mus musculus
atactgcttcaacttctcttgcagg

SEQ ID NO: 205965 - DNA, 25 bp, Mus musculus
atactggaaaaggtgtactttgtgg

SEQ ID NO: 205966 - DNA, 25 bp, Mus musculus
atactggaaatgtagggtaagggtc

SEQ ID NO: 205967 - DNA, 25 bp, Mus musculus
atactggaagaagaaacagtcaagt

SEQ ID NO: 205968 - DNA, 25 bp, Mus musculus
atactggaagtagaaacagtcaagt

SEQ ID NO: 205969 - DNA, 25 bp, Mus musculus
atactggaattacaggctgacccct

SEQ ID NO: 205970 - DNA, 25 bp, Mus musculus
atactgtaactccaggggcactatg

SEQ ID NO: 205971 - DNA, 25 bp, Mus musculus
atactgtaaggtatgtcactggctg

SEQ ID NO: 205972 - DNA, 25 bp, Mus musculus
atactgtaagtgagggagctggctc

SEQ ID NO: 205973 - DNA, 25 bp, Mus musculus
atactgtagaggaatgcctccaatt

SEQ ID NO: 205974 - DNA, 25 bp, Mus musculus
atactgtagaggagaatccttcctt

SEQ ID NO: 205975 - DNA, 25 bp, Mus musculus
atactgtctactggtgccctcccat

SEQ ID NO: 205976 - DNA, 25 bp, Mus musculus
atactgtctactgttccaccaaggg

SEQ ID NO: 205977 - DNA, 25 bp, Mus musculus
atactgtcttctctgcctcccgagt

SEQ ID NO: 205978 - DNA, 25 bp, Mus musculus
atactgtgaaggaagccaaagagaa

SEQ ID NO: 205979 - DNA, 25 bp, Mus musculus
atactgtgacaggagggctggcggc

SEQ ID NO: 205980 - DNA, 25 bp, Mus musculus
atactgtgagctggcccagtcctcc

SEQ ID NO: 205981 - DNA, 25 bp, Mus musculus
atactgtgagctggttcacccaccc

SEQ ID NO: 205982 - DNA, 25 bp, Mus musculus
atactgtggagactatgacagtttt

SEQ ID NO: 205983 - DNA, 25 bp, Mus musculus
atactgtggagggctccacctgaag

SEQ ID NO: 205984 - DNA, 25 bp, Mus musculus
atactgttgagcctgagaaatgcca

SEQ ID NO: 205985 - DNA, 25 bp, Mus musculus
atacttacagattggccaggattct

SEQ ID NO: 205986 - DNA, 25 bp, Mus musculus
atacttacaggagctgatcttttca

SEQ ID NO: 205987 - DNA, 25 bp, Mus musculus
atacttacagtcacatgtggcctga

SEQ ID NO: 205988 - DNA, 25 bp, Mus musculus
atacttactcccaagactctgaggt

SEQ ID NO: 205989 - DNA, 25 bp, Mus musculus
atacttactcccaagatggctgtct

SEQ ID NO: 205990 - DNA, 25 bp, Mus musculus
atacttactcccaagcccctggacc

SEQ ID NO: 205991 - DNA, 25 bp, Mus musculus
atacttagacaggtatccattatga

SEQ ID NO: 205992 - DNA, 25 bp, Mus musculus
atacttaggaaagccccggcagccc

SEQ ID NO: 205993 - DNA, 25 bp, Mus musculus
atacttcacagagaaatattactgg

SEQ ID NO: 205994 - DNA, 25 bp, Mus musculus
atacttcacagagagcatgtgaccg

SEQ ID NO: 205995 - DNA, 25 bp, Mus musculus
atacttccaagccaactaagaagat

SEQ ID NO: 205996 - DNA, 25 bp, Mus musculus
atacttccatgaaacaatcccacgc

SEQ ID NO: 205997 - DNA, 25 bp, Mus musculus
atacttccatggccgtaattaacaa

SEQ ID NO: 205998 - DNA, 25 bp, Mus musculus
atacttcccaagacagcattttccc

SEQ ID NO: 205999 - DNA, 25 bp, Mus musculus
atacttctgcaatgcctggcttccc

SEQ ID NO: 206000 - DNA, 25 bp, Mus musculus
atacttcttcatccacatctacatc

SEQ ID NO: 206001 - DNA, 25 bp, Mus musculus
atacttgacatagcctgcaggggtc

SEQ ID NO: 206002 - DNA, 25 bp, Mus musculus
atacttgcaagggtgactcaggagg

SEQ ID NO: 206003 - DNA, 25 bp, Mus musculus
atacttgcacaccgctggtttgtcc

SEQ ID NO: 206004 - DNA, 25 bp, Mus musculus
atacttgctagctgccgactacagg

SEQ ID NO: 206005 - DNA, 25 bp, Mus musculus
atacttggacttgagcagcgaccac

SEQ ID NO: 206006 - DNA, 25 bp, Mus musculus
atacttggagaaactggaggtactg

SEQ ID NO: 206007 - DNA, 25 bp, Mus musculus
atactttaaagagaatgtggtcttt

SEQ ID NO: 206008 - DNA, 25 bp, Mus musculus
atactttaaagatgaaaactttatt

SEQ ID NO: 206009 - DNA, 25 bp, Mus musculus
atactttaagaggctggattgtcct

SEQ ID NO: 206010 - DNA, 25 bp, Mus musculus
atactttacagaccagtgtgtgcca

SEQ ID NO: 206011 - DNA, 25 bp, Mus musculus
atactttccagaacacttcagttat

SEQ ID NO: 206012 - DNA, 25 bp, Mus musculus
atactttgtgaagctctgaaaacct

SEQ ID NO: 206013 - DNA, 25 bp, Mus musculus
atactttgtgaaggacatctttggc

SEQ ID NO: 206014 - DNA, 25 bp, Mus musculus
atactttgtgaaggggcagcatttt

SEQ ID NO: 206015 - DNA, 25 bp, Mus musculus
atagaaaaaaacacctggacttctc

SEQ ID NO: 206016 - DNA, 25 bp, Mus musculus
atagaaaatgaagtttctacactaa

SEQ ID NO: 206017 - DNA, 25 bp, Mus musculus
atagaaacgggttctgctgccttaa

SEQ ID NO: 206018 - DNA, 25 bp, Mus musculus
atagaaatgcaaaaggaccctgata

SEQ ID NO: 206019 - DNA, 25 bp, Mus musculus
atagaaatgcaagtttgtcaatata

SEQ ID NO: 206020 - DNA, 25 bp, Mus musculus
atagaaattctcacctccctagcac

SEQ ID NO: 206021 - DNA, 25 bp, Mus musculus
atagaacacatagtgtggatccaac

SEQ ID NO: 206022 - DNA, 25 bp, Mus musculus
atagaacacatagttaaccttggtg

SEQ ID NO: 206023 - DNA, 25 bp, Mus musculus
atagaacaggagcagatcaggaatc

SEQ ID NO: 206024 - DNA, 25 bp, Mus musculus
atagaacaggagcagatccgctctc

SEQ ID NO: 206025 - DNA, 25 bp, Mus musculus
atagaacagtcacagactgtatgag

SEQ ID NO: 206026 - DNA, 25 bp, Mus musculus
atagaacagtcacagagagtggtga

SEQ ID NO: 206027 - DNA, 25 bp, Mus musculus
atagaacagtcacagatggctttat

SEQ ID NO: 206028 - DNA, 25 bp, Mus musculus
atagaacagtcacagcgtattgtca

SEQ ID NO: 206029 - DNA, 25 bp, Mus musculus
atagaacagtcacaggcagatattg

SEQ ID NO: 206030 - DNA, 25 bp, Mus musculus
atagaacctggcctcatctgtatgc

SEQ ID NO: 206031 - DNA, 25 bp, Mus musculus
atagaagaaatcaaggaaacactca

SEQ ID NO: 206032 - DNA, 25 bp, Mus musculus
atagaagaactaaaggataacttca

SEQ ID NO: 206033 - DNA, 25 bp, Mus musculus
atagaagaagtgagctgaagaggcg

SEQ ID NO: 206034 - DNA, 25 bp, Mus musculus
atagaagaggagggactgatttgct

SEQ ID NO: 206035 - DNA, 25 bp, Mus musculus
atagaagatattaaacgacacaagg

SEQ ID NO: 206036 - DNA, 25 bp, Mus musculus
atagaagatattttttgagaaatgg

SEQ ID NO: 206037 - DNA, 25 bp, Mus musculus
atagaaggaaacagttcagggcgac

SEQ ID NO: 206038 - DNA, 25 bp, Mus musculus
atagaaggagaaggtctcaggagct

SEQ ID NO: 206039 - DNA, 25 bp, Mus musculus
atagaatacatggcccctgaaatct

SEQ ID NO: 206040 - DNA, 25 bp, Mus musculus
atagaatagacaaggctttgatgag

SEQ ID NO: 206041 - DNA, 25 bp, Mus musculus
atagaatcagcaggtctgatcttgc

SEQ ID NO: 206042 - DNA, 25 bp, Mus musculus
atagaatccgttgaagactttctgg

SEQ ID NO: 206043 - DNA, 25 bp, Mus musculus
atagaatggactttgaagcattttt

SEQ ID NO: 206044 - DNA, 25 bp, Mus musculus
atagacaaaggagagaagagaggct

SEQ ID NO: 206045 - DNA, 25 bp, Mus musculus
atagacaaggcaaagcggtcccacc

SEQ ID NO: 206046 - DNA, 25 bp, Mus musculus
atagacacctgagatatcaagttca

SEQ ID NO: 206047 - DNA, 25 bp, Mus musculus
atagacagccagctgttgaggaccc

SEQ ID NO: 206048 - DNA, 25 bp, Mus musculus
atagacagtagaggctccgcaggag

SEQ ID NO: 206049 - DNA, 25 bp, Mus musculus
atagaccagatctcacaggaaaacc

SEQ ID NO: 206050 - DNA, 25 bp, Mus musculus
atagaccagcgctcctccagacaac

SEQ ID NO: 206051 - DNA, 25 bp, Mus musculus
atagacctcatcttcagtccctaaa

SEQ ID NO: 206052 - DNA, 25 bp, Mus musculus
atagacctcatggcctctacaagca

SEQ ID NO: 206053 - DNA, 25 bp, Mus musculus
atagacctcattgggcaagagcttg

SEQ ID NO: 206054 - DNA, 25 bp, Mus musculus
atagacctgaagagtacagtcgctt

SEQ ID NO: 206055 - DNA, 25 bp, Mus musculus
atagacgagaggctcagagccctga

SEQ ID NO: 206056 - DNA, 25 bp, Mus musculus
atagacggctatgaatcatccaggt

SEQ ID NO: 206057 - DNA, 25 bp, Mus musculus
atagacgtcaggtggccatcaaagt

SEQ ID NO: 206058 - DNA, 25 bp, Mus musculus
atagactaccaggttgggataaaca

SEQ ID NO: 206059 - DNA, 25 bp, Mus musculus
atagactagatatggaacgggagcg

SEQ ID NO: 206060 - DNA, 25 bp, Mus musculus
atagactatacatgtgaatgaactc

SEQ ID NO: 206061 - DNA, 25 bp, Mus musculus
atagactggcctcatctgttccggc

SEQ ID NO: 206062 - DNA, 25 bp, Mus musculus
atagacttcaggaataaagtggtga

SEQ ID NO: 206063 - DNA, 25 bp, Mus musculus
atagacttcagtttgatttccagga

SEQ ID NO: 206064 - DNA, 25 bp, Mus musculus
atagactttgcagaaatgaagcaga

SEQ ID NO: 206065 - DNA, 25 bp, Mus musculus
atagagaaaaagtaaagacatttcc

SEQ ID NO: 206066 - DNA, 25 bp, Mus musculus
atagagaaaacgtgaaaaaggtcca

SEQ ID NO: 206067 - DNA, 25 bp, Mus musculus
atagagaaaagtacaacagaatagc

SEQ ID NO: 206068 - DNA, 25 bp, Mus musculus
atagagaaagaaaaagtggagtaca

SEQ ID NO: 206069 - DNA, 25 bp, Mus musculus
atagagaaagccaatgcaccatgaa

SEQ ID NO: 206070 - DNA, 25 bp, Mus musculus
atagagaatcaggctgtcaccaacg

SEQ ID NO: 206071 - DNA, 25 bp, Mus musculus
atagagacacagccagctcaggaag

SEQ ID NO: 206072 - DNA, 25 bp, Mus musculus
atagagacacagcctgagtgcatac

SEQ ID NO: 206073 - DNA, 25 bp, Mus musculus
atagagacagaaagctcagaggctg

SEQ ID NO: 206074 - DNA, 25 bp, Mus musculus
atagagacctaccttctggagaagt

SEQ ID NO: 206075 - DNA, 25 bp, Mus musculus
atagagagccttagaggcccacgag

SEQ ID NO: 206076 - DNA, 25 bp, Mus musculus
atagagatggagaaggaaaaacaca

SEQ ID NO: 206077 - DNA, 25 bp, Mus musculus
atagagatgtcccagcaacattttg

SEQ ID NO: 206078 - DNA, 25 bp, Mus musculus
atagagattaaggagctatcgaaga

SEQ ID NO: 206079 - DNA, 25 bp, Mus musculus
atagagcaggtaaagtaccaaatat

SEQ ID NO: 206080 - DNA, 25 bp, Mus musculus
atagagccagcacgcatttgatgga

SEQ ID NO: 206081 - DNA, 25 bp, Mus musculus
atagagccagtatccatggaatgtg

SEQ ID NO: 206082 - DNA, 25 bp, Mus musculus
atagagctgcttcaggaattctctg

SEQ ID NO: 206083 - DNA, 25 bp, Mus musculus
atagagctggaggataaataaggaa

SEQ ID NO: 206084 - DNA, 25 bp, Mus musculus
atagaggaagatggaggttccattt

SEQ ID NO: 206085 - DNA, 25 bp, Mus musculus
atagaggacatgtcgtccctaatgt

SEQ ID NO: 206086 - DNA, 25 bp, Mus musculus
atagaggacatgtcgtgtttctttc

SEQ ID NO: 206087 - DNA, 25 bp, Mus musculus
atagaggatctcagttcacatatgg

SEQ ID NO: 206088 - DNA, 25 bp, Mus musculus
atagagtacttgagctaccaggagc

SEQ ID NO: 206089 - DNA, 25 bp, Mus musculus
atagagttgcttcacgtcttaccca

SEQ ID NO: 206090 - DNA, 25 bp, Mus musculus
atagagtttcagatacaccaagtat

SEQ ID NO: 206091 - DNA, 25 bp, Mus musculus
atagagtttcagcacccacagagtt

SEQ ID NO: 206092 - DNA, 25 bp, Mus musculus
atagataaatagatatgttttcttc

SEQ ID NO: 206093 - DNA, 25 bp, Mus musculus
atagatcatatacaggagcagtaca

SEQ ID NO: 206094 - DNA, 25 bp, Mus musculus
atagatccagtaaagccaacaaatt

SEQ ID NO: 206095 - DNA, 25 bp, Mus musculus
atagatccagtaaagtccaggtaca

SEQ ID NO: 206096 - DNA, 25 bp, Mus musculus
atagatccccagagactttgcaatt

SEQ ID NO: 206097 - DNA, 25 bp, Mus musculus
atagatccccagtgactttgcaatt

SEQ ID NO: 206098 - DNA, 25 bp, Mus musculus
atagatctaaaggagctgtgaaatc

SEQ ID NO: 206099 - DNA, 25 bp, Mus musculus
atagatgcaggaggattggaagctg

SEQ ID NO: 206100 - DNA, 25 bp, Mus musculus
atagatgcaggagtgagattatata

SEQ ID NO: 206101 - DNA, 25 bp, Mus musculus
atagatgcttatgtggatatgctac

SEQ ID NO: 206102 - DNA, 25 bp, Mus musculus
atagatggcattgatggtgaccgag

SEQ ID NO: 206103 - DNA, 25 bp, Mus musculus
atagatgtaggtgaaaaatctctca

SEQ ID NO: 206104 - DNA, 25 bp, Mus musculus
atagatgtgaggtcacctcagcacc

SEQ ID NO: 206105 - DNA, 25 bp, Mus musculus
atagattcacttgctgtaagaacta

SEQ ID NO: 206106 - DNA, 25 bp, Mus musculus
atagattcacttggcttgttacatg

SEQ ID NO: 206107 - DNA, 25 bp, Mus musculus
atagattccaactaaaaataggaaa

SEQ ID NO: 206108 - DNA, 25 bp, Mus musculus
atagattccaactaagagttggcca

SEQ ID NO: 206109 - DNA, 25 bp, Mus musculus
atagattgatacagggacaagtgac

SEQ ID NO: 206110 - DNA, 25 bp, Mus musculus
atagatttcctacagggaaatcagt

SEQ ID NO: 206111 - DNA, 25 bp, Mus musculus
atagatttcctacaggtggggcttt

SEQ ID NO: 206112 - DNA, 25 bp, Mus musculus
atagatttccttctgggttctcaaa

SEQ ID NO: 206113 - DNA, 25 bp, Mus musculus
atagatttggaagagacctcaatta

SEQ ID NO: 206114 - DNA, 25 bp, Mus musculus
atagatttggaagcaggaatgtctg

SEQ ID NO: 206115 - DNA, 25 bp, Mus musculus
atagcaaaaggacaggatgtagata

SEQ ID NO: 206116 - DNA, 25 bp, Mus musculus
atagcaacaacagccatgggttctc

SEQ ID NO: 206117 - DNA, 25 bp, Mus musculus
atagcaacatgaaggtcatgtagga

SEQ ID NO: 206118 - DNA, 25 bp, Mus musculus
atagcaacgggggcatctgcaacgg

SEQ ID NO: 206119 - DNA, 25 bp, Mus musculus
atagcaacttggttctcacgagagg

SEQ ID NO: 206120 - DNA, 25 bp, Mus musculus
atagcaaggagaaagaaaagtcaaa

SEQ ID NO: 206121 - DNA, 25 bp, Mus musculus
atagcaaggagggattttgaacttt

SEQ ID NO: 206122 - DNA, 25 bp, Mus musculus
atagcaagggcaggactcctttaca

SEQ ID NO: 206123 - DNA, 25 bp, Mus musculus
atagcaatgagaatgattcccttca

SEQ ID NO: 206124 - DNA, 25 bp, Mus musculus
atagcaattaaggaactagaggctg

SEQ ID NO: 206125 - DNA, 25 bp, Mus musculus
atagcaattaagggagtggccaggt

SEQ ID NO: 206126 - DNA, 25 bp, Mus musculus
atagcacacacaagggctgggtatg

SEQ ID NO: 206127 - DNA, 25 bp, Mus musculus
atagcacatgggagggactgggggc

SEQ ID NO: 206128 - DNA, 25 bp, Mus musculus
atagcaccgtgaaggtctggacatg

SEQ ID NO: 206129 - DNA, 25 bp, Mus musculus
atagcagacatgaaggcctttgttg

SEQ ID NO: 206130 - DNA, 25 bp, Mus musculus
atagcagaccggatcctcttcagca

SEQ ID NO: 206131 - DNA, 25 bp, Mus musculus
atagcagagggctcctgctgaaggt

SEQ ID NO: 206132 - DNA, 25 bp, Mus musculus
atagcagagtggcagcacgatggtc

SEQ ID NO: 206133 - DNA, 25 bp, Mus musculus
atagcagccaggggggagctgctgc

SEQ ID NO: 206134 - DNA, 25 bp, Mus musculus
atagcagcctggcccatctccgagt

SEQ ID NO: 206135 - DNA, 25 bp, Mus musculus
atagcagcctggtacccccttgcag

SEQ ID NO: 206136 - DNA, 25 bp, Mus musculus
atagcagcttgggtcttgacgaagt

SEQ ID NO: 206137 - DNA, 25 bp, Mus musculus
atagcagtgatcccgcttcgatgac

SEQ ID NO: 206138 - DNA, 25 bp, Mus musculus
atagcatacctgtatgaccggttgc

SEQ ID NO: 206139 - DNA, 25 bp, Mus musculus
atagcatcaggcactgttgtaggcg

SEQ ID NO: 206140 - DNA, 25 bp, Mus musculus
atagcatcaggcgcgagcttcattt

SEQ ID NO: 206141 - DNA, 25 bp, Mus musculus
atagcatgctgccagggcaccagcg

SEQ ID NO: 206142 - DNA, 25 bp, Mus musculus
atagcatttcaggatggaaccgcgc

SEQ ID NO: 206143 - DNA, 25 bp, Mus musculus
atagccaagagaggtcactatggtg

SEQ ID NO: 206144 - DNA, 25 bp, Mus musculus
atagccaagagagttctgttggctc

SEQ ID NO: 206145 - DNA, 25 bp, Mus musculus
atagccaaggacaagaaacatcttt

SEQ ID NO: 206146 - DNA, 25 bp, Mus musculus
atagccaaggacaagagtttcttgg

SEQ ID NO: 206147 - DNA, 25 bp, Mus musculus
atagccagatgaggaagctggaagg

SEQ ID NO: 206148 - DNA, 25 bp, Mus musculus
atagccatattgccctctgttttct

SEQ ID NO: 206149 - DNA, 25 bp, Mus musculus
atagccatgctttctggcatatgcc

SEQ ID NO: 206150 - DNA, 25 bp, Mus musculus
atagcccagaaggcgggcaggaaga

SEQ ID NO: 206151 - DNA, 25 bp, Mus musculus
atagcccagcaggaagcaacttctt

SEQ ID NO: 206152 - DNA, 25 bp, Mus musculus
atagcccagcaggtgaccaaccact

SEQ ID NO: 206153 - DNA, 25 bp, Mus musculus
atagcccctatggctgtagcagtgg

SEQ ID NO: 206154 - DNA, 25 bp, Mus musculus
atagccccttcctgagcatctgtgg

SEQ ID NO: 206155 - DNA, 25 bp, Mus musculus
atagcccggtttcacttgagagcac

SEQ ID NO: 206156 - DNA, 25 bp, Mus musculus
atagcccggtttcagttgagagcac

SEQ ID NO: 206157 - DNA, 25 bp, Mus musculus
atagccctcaactcaagtagtaggc

SEQ ID NO: 206158 - DNA, 25 bp, Mus musculus
atagcctgctgggtccaccataagt

SEQ ID NO: 206159 - DNA, 25 bp, Mus musculus
atagccttcaggaaacaaagcaaac

SEQ ID NO: 206160 - DNA, 25 bp, Mus musculus
atagccttctgcaccaaggagatcc

SEQ ID NO: 206161 - DNA, 25 bp, Mus musculus
atagcgatgaggaagatgatgatga

SEQ ID NO: 206162 - DNA, 25 bp, Mus musculus
atagcgcgctttgagggcctgaaga

SEQ ID NO: 206163 - DNA, 25 bp, Mus musculus
atagcgtcagcgggggaacagtaca

SEQ ID NO: 206164 - DNA, 25 bp, Mus musculus
atagctacaacaaccgccgagacct

SEQ ID NO: 206165 - DNA, 25 bp, Mus musculus
atagctatcacaaataaagaaaagg

SEQ ID NO: 206166 - DNA, 25 bp, Mus musculus
atagctatcacaaatatttcctctt

SEQ ID NO: 206167 - DNA, 25 bp, Mus musculus
atagctcagttgtggtagtgtgaag

SEQ ID NO: 206168 - DNA, 25 bp, Mus musculus
atagctccacatgaactcacagaag

SEQ ID NO: 206169 - DNA, 25 bp, Mus musculus
atagctccacatgacattctctggc

SEQ ID NO: 206170 - DNA, 25 bp, Mus musculus
atagctccacatgccatttaccaat

SEQ ID NO: 206171 - DNA, 25 bp, Mus musculus
atagctccagtgacccaccgttctt

SEQ ID NO: 206172 - DNA, 25 bp, Mus musculus
atagctccccgaaagaaaagtttca

SEQ ID NO: 206173 - DNA, 25 bp, Mus musculus
atagctccctccgatgtcatatgcc

SEQ ID NO: 206174 - DNA, 25 bp, Mus musculus
atagctcctccagagctcccagacc

SEQ ID NO: 206175 - DNA, 25 bp, Mus musculus
atagctcctcggaagaggagaaggg

SEQ ID NO: 206176 - DNA, 25 bp, Mus musculus
atagctcctcggaagcactgctaca

SEQ ID NO: 206177 - DNA, 25 bp, Mus musculus
atagctcctcggaagcatctcctct

SEQ ID NO: 206178 - DNA, 25 bp, Mus musculus
atagctctcaggtcaactcctggag

SEQ ID NO: 206179 - DNA, 25 bp, Mus musculus
atagctctccagacacaagcatcta

SEQ ID NO: 206180 - DNA, 25 bp, Mus musculus
atagctgaaaagaaagggccaaata

SEQ ID NO: 206181 - DNA, 25 bp, Mus musculus
atagctgaaaaggtgtctctggttg

SEQ ID NO: 206182 - DNA, 25 bp, Mus musculus
atagctgcagtagaaaaagttaaga

SEQ ID NO: 206183 - DNA, 25 bp, Mus musculus
atagctgcttggaagttggcagtat

SEQ ID NO: 206184 - DNA, 25 bp, Mus musculus
atagctgggccgggattctgaaagg

SEQ ID NO: 206185 - DNA, 25 bp, Mus musculus
atagctgtctggtttgtggacagtc

SEQ ID NO: 206186 - DNA, 25 bp, Mus musculus
atagcttacatacccttcgcaggtg

SEQ ID NO: 206187 - DNA, 25 bp, Mus musculus
atagcttcactgataaaacacggac

SEQ ID NO: 206188 - DNA, 25 bp, Mus musculus
atagcttggtccaggaaaatggaca

SEQ ID NO: 206189 - DNA, 25 bp, Mus musculus
atagctttccaggacaagaagatgc

SEQ ID NO: 206190 - DNA, 25 bp, Mus musculus
atagctttgataaatttgaattctg

SEQ ID NO: 206191 - DNA, 25 bp, Mus musculus
ataggaaacatacagtggatgaata

SEQ ID NO: 206192 - DNA, 25 bp, Mus musculus
ataggaaagcaagggaacctagtaa

SEQ ID NO: 206193 - DNA, 25 bp, Mus musculus
ataggaaataggttaaatggaatcc

SEQ ID NO: 206194 - DNA, 25 bp, Mus musculus
ataggaaatgcagaccagcagaact

SEQ ID NO: 206195 - DNA, 25 bp, Mus musculus
ataggaacaaagacaggaaatctgc

SEQ ID NO: 206196 - DNA, 25 bp, Mus musculus
ataggaacagattgagaaatggcat

SEQ ID NO: 206197 - DNA, 25 bp, Mus musculus
ataggaagtatgacccacagggctc

SEQ ID NO: 206198 - DNA, 25 bp, Mus musculus
ataggaagtgtgtggacatcaatga

SEQ ID NO: 206199 - DNA, 25 bp, Mus musculus
ataggaatacaacttctcgccgagg

SEQ ID NO: 206200 - DNA, 25 bp, Mus musculus
ataggaatacaagagaggactagaa

SEQ ID NO: 206201 - DNA, 25 bp, Mus musculus
ataggaatacaagttgactgcattc

SEQ ID NO: 206202 - DNA, 25 bp, Mus musculus
ataggaattgtagagaatttcttgc

SEQ ID NO: 206203 - DNA, 25 bp, Mus musculus
ataggaattgtagagttgctcacag

SEQ ID NO: 206204 - DNA, 25 bp, Mus musculus
ataggaattgtagagttggctcacg

SEQ ID NO: 206205 - DNA, 25 bp, Mus musculus
ataggacactacgaacagcacatta

SEQ ID NO: 206206 - DNA, 25 bp, Mus musculus
ataggacaggacggggtccctccaa

SEQ ID NO: 206207 - DNA, 25 bp, Mus musculus
ataggacagtctcccatggctattg

SEQ ID NO: 206208 - DNA, 25 bp, Mus musculus
ataggacatctgaaagctgagcccc

SEQ ID NO: 206209 - DNA, 25 bp, Mus musculus
ataggacattttccttcccgtcgaa

SEQ ID NO: 206210 - DNA, 25 bp, Mus musculus
ataggacggcagagaatccgtgacc

SEQ ID NO: 206211 - DNA, 25 bp, Mus musculus
ataggagaaccaaaaataatctata

SEQ ID NO: 206212 - DNA, 25 bp, Mus musculus
ataggagaaccaaacaaatgaagaa

SEQ ID NO: 206213 - DNA, 25 bp, Mus musculus
ataggagaagtatgagctggtgtcc

SEQ ID NO: 206214 - DNA, 25 bp, Mus musculus
ataggagacaggtggcgacagacaa

SEQ ID NO: 206215 - DNA, 25 bp, Mus musculus
ataggagacagtcagtggatacggt

SEQ ID NO: 206216 - DNA, 25 bp, Mus musculus
ataggagctttactgaagactgttt

SEQ ID NO: 206217 - DNA, 25 bp, Mus musculus
ataggaggcggtaaccatagagatg

SEQ ID NO: 206218 - DNA, 25 bp, Mus musculus
ataggatccctggagtccctggctc

SEQ ID NO: 206219 - DNA, 25 bp, Mus musculus
ataggatcgagatcccgctcaaggt

SEQ ID NO: 206220 - DNA, 25 bp, Mus musculus
ataggatgcttcctttctagtgagt

SEQ ID NO: 206221 - DNA, 25 bp, Mus musculus
ataggatgtttcctgagatgtaaag

SEQ ID NO: 206222 - DNA, 25 bp, Mus musculus
ataggatgtttcctgaggctactga

SEQ ID NO: 206223 - DNA, 25 bp, Mus musculus
ataggatgtttcctgtctagtgagt

SEQ ID NO: 206224 - DNA, 25 bp, Mus musculus
ataggatgtttcctgtctggtgagt

SEQ ID NO: 206225 - DNA, 25 bp, Mus musculus
ataggattaccgaaggcaaatggaa

SEQ ID NO: 206226 - DNA, 25 bp, Mus musculus
ataggattccaggagtccctggctc

SEQ ID NO: 206227 - DNA, 25 bp, Mus musculus
ataggcaaaggttctgcctcatgga

SEQ ID NO: 206228 - DNA, 25 bp, Mus musculus
ataggcaattcaacttgatttctta

SEQ ID NO: 206229 - DNA, 25 bp, Mus musculus
ataggcaattgggtccccatcctca

SEQ ID NO: 206230 - DNA, 25 bp, Mus musculus
ataggcagaagggaactgagccgtg

SEQ ID NO: 206231 - DNA, 25 bp, Mus musculus
ataggcagagcagctccatcagcag

SEQ ID NO: 206232 - DNA, 25 bp, Mus musculus
ataggcagaggtcagtaccatgaat

SEQ ID NO: 206233 - DNA, 25 bp, Mus musculus
ataggcagatccggcgaatacagga

SEQ ID NO: 206234 - DNA, 25 bp, Mus musculus
ataggcagcatgtctgatgaaagtg

SEQ ID NO: 206235 - DNA, 25 bp, Mus musculus
ataggcagcatttccagacagtcat

SEQ ID NO: 206236 - DNA, 25 bp, Mus musculus
ataggcatagactacttttaagggg

SEQ ID NO: 206237 - DNA, 25 bp, Mus musculus
ataggccagagtgggtcatctctga

SEQ ID NO: 206238 - DNA, 25 bp, Mus musculus
ataggccagagtggtggttcccgac

SEQ ID NO: 206239 - DNA, 25 bp, Mus musculus
ataggcctgagacttccttaccgag

SEQ ID NO: 206240 - DNA, 25 bp, Mus musculus
ataggcgaggttcaagtagtatctt

SEQ ID NO: 206241 - DNA, 25 bp, Mus musculus
ataggctatgcaagggctacagagc

SEQ ID NO: 206242 - DNA, 25 bp, Mus musculus
ataggctatgggcacgtgcggcatc

SEQ ID NO: 206243 - DNA, 25 bp, Mus musculus
ataggctgccaatcaacaatgtgcc

SEQ ID NO: 206244 - DNA, 25 bp, Mus musculus
ataggctgcgatgggtggatgagag

SEQ ID NO: 206245 - DNA, 25 bp, Mus musculus
ataggctttgccaatgctcagcaga

SEQ ID NO: 206246 - DNA, 25 bp, Mus musculus
ataggcttttggccactcttgggga

SEQ ID NO: 206247 - DNA, 25 bp, Mus musculus
atagggagaggagccgccgccatgt

SEQ ID NO: 206248 - DNA, 25 bp, Mus musculus
atagggagaggagccgcctgtccac

SEQ ID NO: 206249 - DNA, 25 bp, Mus musculus
atagggaggaagcacctctgggagc

SEQ ID NO: 206250 - DNA, 25 bp, Mus musculus
atagggagtcgcgaggaggaaagcg

SEQ ID NO: 206251 - DNA, 25 bp, Mus musculus
atagggatgtgatgctctttctcat

SEQ ID NO: 206252 - DNA, 25 bp, Mus musculus
atagggcacaggtatattgaaatat

SEQ ID NO: 206253 - DNA, 25 bp, Mus musculus
atagggcggtcagctcactaaggtg

SEQ ID NO: 206254 - DNA, 25 bp, Mus musculus
ataggggagaagcagaccatggtga

SEQ ID NO: 206255 - DNA, 25 bp, Mus musculus
ataggggagcagccctggctgtcct

SEQ ID NO: 206256 - DNA, 25 bp, Mus musculus
ataggggagcagggcatgaatcttt

SEQ ID NO: 206257 - DNA, 25 bp, Mus musculus
ataggggtggaagccccaggcctgg

SEQ ID NO: 206258 - DNA, 25 bp, Mus musculus
atagggtagttaaagagggctgtcc

SEQ ID NO: 206259 - DNA, 25 bp, Mus musculus
ataggtacagttctgacacaacacc

SEQ ID NO: 206260 - DNA, 25 bp, Mus musculus
ataggtataatggcctcggccctgc

SEQ ID NO: 206261 - DNA, 25 bp, Mus musculus
ataggtatgggagaacagaacactg

SEQ ID NO: 206262 - DNA, 25 bp, Mus musculus
ataggtcctacagctataggccgta

SEQ ID NO: 206263 - DNA, 25 bp, Mus musculus
ataggtgacaaggaaggagctttga

SEQ ID NO: 206264 - DNA, 25 bp, Mus musculus
ataggttctgggaagtgcgaaatca

SEQ ID NO: 206265 - DNA, 25 bp, Mus musculus
atagtaccatgcaggcgagacttca

SEQ ID NO: 206266 - DNA, 25 bp, Mus musculus
atagtaccatgcagggttctgagga

SEQ ID NO: 206267 - DNA, 25 bp, Mus musculus
atagtactttccgttgtgtccagat

SEQ ID NO: 206268 - DNA, 25 bp, Mus musculus
atagtagaagagaaaactctctact

SEQ ID NO: 206269 - DNA, 25 bp, Mus musculus
atagtagagaagtgattgtgaagcc

SEQ ID NO: 206270 - DNA, 25 bp, Mus musculus
atagtagagaagtgcctagacaagt

SEQ ID NO: 206271 - DNA, 25 bp, Mus musculus
atagtaggcactgatattcgagact

SEQ ID NO: 206272 - DNA, 25 bp, Mus musculus
atagtagttctcttcccatactggt

SEQ ID NO: 206273 - DNA, 25 bp, Mus musculus
atagtatgagagcatattccgcgta

SEQ ID NO: 206274 - DNA, 25 bp, Mus musculus
atagtatgaggtacctgtcgtaggg

SEQ ID NO: 206275 - DNA, 25 bp, Mus musculus
atagtatgagtgatgtcctcgcatt

SEQ ID NO: 206276 - DNA, 25 bp, Mus musculus
atagtcacaggacgtccagcaggag

SEQ ID NO: 206277 - DNA, 25 bp, Mus musculus
atagtcacccagacctggagcctgt

SEQ ID NO: 206278 - DNA, 25 bp, Mus musculus
atagtcactaaggagatgttagatg

SEQ ID NO: 206279 - DNA, 25 bp, Mus musculus
atagtcattttcatgatcacaaaat

SEQ ID NO: 206280 - DNA, 25 bp, Mus musculus
atagtccaacagaaagcaaagatat

SEQ ID NO: 206281 - DNA, 25 bp, Mus musculus
atagtccaacaggtgactgttcaga

SEQ ID NO: 206282 - DNA, 25 bp, Mus musculus
atagtccaacatcttcagcaaacga

SEQ ID NO: 206283 - DNA, 25 bp, Mus musculus
atagtccactgcattgaacagcgtc

SEQ ID NO: 206284 - DNA, 25 bp, Mus musculus
atagtccagcagactgatacctccg

SEQ ID NO: 206285 - DNA, 25 bp, Mus musculus
atagtccccaaggactttctgagcc

SEQ ID NO: 206286 - DNA, 25 bp, Mus musculus
atagtccttgtgaggcccagcctcg

SEQ ID NO: 206287 - DNA, 25 bp, Mus musculus
atagtctctaggatgctccagacct

SEQ ID NO: 206288 - DNA, 25 bp, Mus musculus
atagtcttttacccagtagagatga

SEQ ID NO: 206289 - DNA, 25 bp, Mus musculus
atagtgaacgagccacctcccaagc

SEQ ID NO: 206290 - DNA, 25 bp, Mus musculus
atagtgacagtgacgatggggaggc

SEQ ID NO: 206291 - DNA, 25 bp, Mus musculus
atagtgaccatggtggtgatgacca

SEQ ID NO: 206292 - DNA, 25 bp, Mus musculus
atagtgataagcaccctgtgacctg

SEQ ID NO: 206293 - DNA, 25 bp, Mus musculus
atagtgatggggcagaagaaactct

SEQ ID NO: 206294 - DNA, 25 bp, Mus musculus
atagtgcagtaagtctggagccaat

SEQ ID NO: 206295 - DNA, 25 bp, Mus musculus
atagtgcatttctcatctacattag

SEQ ID NO: 206296 - DNA, 25 bp, Mus musculus
atagtgcgtacagaagaactcctgg

SEQ ID NO: 206297 - DNA, 25 bp, Mus musculus
atagtgcgtacagagaacttaccga

SEQ ID NO: 206298 - DNA, 25 bp, Mus musculus
atagtggaaaagaaccaaagaattc

SEQ ID NO: 206299 - DNA, 25 bp, Mus musculus
atagtggaacgcagggatgccctgc

SEQ ID NO: 206300 - DNA, 25 bp, Mus musculus
atagtggagggtgtcccctgaactg

SEQ ID NO: 206301 - DNA, 25 bp, Mus musculus
atagtggcatgtgggcatcatcgca

SEQ ID NO: 206302 - DNA, 25 bp, Mus musculus
atagtggcatgtggttcttcccgaa

SEQ ID NO: 206303 - DNA, 25 bp, Mus musculus
atagtggctgcagagaatgatgtca

SEQ ID NO: 206304 - DNA, 25 bp, Mus musculus
atagtggctgcggctgttaagaaga

SEQ ID NO: 206305 - DNA, 25 bp, Mus musculus
atagtggctgcgggtattcccaggt

SEQ ID NO: 206306 - DNA, 25 bp, Mus musculus
atagtggtaaggccatcgaagacgg

SEQ ID NO: 206307 - DNA, 25 bp, Mus musculus
atagtggtaagtgcggctggctctg

SEQ ID NO: 206308 - DNA, 25 bp, Mus musculus
atagtgtccatgtcaatatacagta

SEQ ID NO: 206309 - DNA, 25 bp, Mus musculus
atagtgttctgttgttattttcctt

SEQ ID NO: 206310 - DNA, 25 bp, Mus musculus
atagttaaagagggttgccccggct

SEQ ID NO: 206311 - DNA, 25 bp, Mus musculus
atagttcaaagcatgattggagaga

SEQ ID NO: 206312 - DNA, 25 bp, Mus musculus
atagttcaaagcatgtcttttgctg

SEQ ID NO: 206313 - DNA, 25 bp, Mus musculus
atagttcaaatgcgcttaaaggata

SEQ ID NO: 206314 - DNA, 25 bp, Mus musculus
atagttctgcagagttctacagcct

SEQ ID NO: 206315 - DNA, 25 bp, Mus musculus
atagttctgcaggacaatgccttag

SEQ ID NO: 206316 - DNA, 25 bp, Mus musculus
atagttgcctgtgagaaggccctgg

SEQ ID NO: 206317 - DNA, 25 bp, Mus musculus
atagttgctgcagacccgtggattc

SEQ ID NO: 206318 - DNA, 25 bp, Mus musculus
atagttggtgtttggcacagactat

SEQ ID NO: 206319 - DNA, 25 bp, Mus musculus
atagtttagggtgtctagcccacac

SEQ ID NO: 206320 - DNA, 25 bp, Mus musculus
atagtttgctgtagtaattcttcag

SEQ ID NO: 206321 - DNA, 25 bp, Mus musculus
atagtttttctgatggtctgcagat

SEQ ID NO: 206322 - DNA, 25 bp, Mus musculus
atataaaaagaggaaactgcactgc

SEQ ID NO: 206323 - DNA, 25 bp, Mus musculus
atataaaaaggtaacaactgattgg

SEQ ID NO: 206324 - DNA, 25 bp, Mus musculus
atataaaacttgggtgctgaagggg

SEQ ID NO: 206325 - DNA, 25 bp, Mus musculus
atataaaatagaaatgtgaatcctc

SEQ ID NO: 206326 - DNA, 25 bp, Mus musculus
atataaaatggaagctttaaatgct

SEQ ID NO: 206327 - DNA, 25 bp, Mus musculus
atataaaatgggtcaaatagaaatc

SEQ ID NO: 206328 - DNA, 25 bp, Mus musculus
atataaaattcacagaggagattcc

SEQ ID NO: 206329 - DNA, 25 bp, Mus musculus
atataaacaacttccattcgaacaa

SEQ ID NO: 206330 - DNA, 25 bp, Mus musculus
atataaacctgaaggcatcagtttg

SEQ ID NO: 206331 - DNA, 25 bp, Mus musculus
atataaactcaagccaggaaccatg

SEQ ID NO: 206332 - DNA, 25 bp, Mus musculus
atataaactcaagggctcgggccat

SEQ ID NO: 206333 - DNA, 25 bp, Mus musculus
atataaactggcgagatgtccctgc

SEQ ID NO: 206334 - DNA, 25 bp, Mus musculus
atataaagaggcttgcacagcatat

SEQ ID NO: 206335 - DNA, 25 bp, Mus musculus
atataaagtctctgaaactcaagtc

SEQ ID NO: 206336 - DNA, 25 bp, Mus musculus
atataaatgtcaggactcaggacgg

SEQ ID NO: 206337 - DNA, 25 bp, Mus musculus
atataacacttgacatctcaataaa

SEQ ID NO: 206338 - DNA, 25 bp, Mus musculus
atataacacttgattctcattgaaa

SEQ ID NO: 206339 - DNA, 25 bp, Mus musculus
atataacatctttaactacaagggc

SEQ ID NO: 206340 - DNA, 25 bp, Mus musculus
atataacatgcagatattcagtgaa

SEQ ID NO: 206341 - DNA, 25 bp, Mus musculus
atataagaagaccctatctaacttg

SEQ ID NO: 206342 - DNA, 25 bp, Mus musculus
atataagaagcccctccaggccggc

SEQ ID NO: 206343 - DNA, 25 bp, Mus musculus
atataagaaggcactaaccctatct

SEQ ID NO: 206344 - DNA, 25 bp, Mus musculus
atataaggagaagtgcccggctcat

SEQ ID NO: 206345 - DNA, 25 bp, Mus musculus
atataaggagcttttcatccttaga

SEQ ID NO: 206346 - DNA, 25 bp, Mus musculus
atataagtgaggtgttacatcctga

SEQ ID NO: 206347 - DNA, 25 bp, Mus musculus
atataatgctagataaatgggagaa

SEQ ID NO: 206348 - DNA, 25 bp, Mus musculus
atataattaaaaagtttgcatttcc

SEQ ID NO: 206349 - DNA, 25 bp, Mus musculus
atataattcaggttgatgaaaaaac

SEQ ID NO: 206350 - DNA, 25 bp, Mus musculus
atataattcagtgactcactatgta

SEQ ID NO: 206351 - DNA, 25 bp, Mus musculus
atataattcatattacaggcctgag

SEQ ID NO: 206352 - DNA, 25 bp, Mus musculus
atataattcattttgaccagcctcg

SEQ ID NO: 206353 - DNA, 25 bp, Mus musculus
atataattgaagaagcaacagactt

SEQ ID NO: 206354 - DNA, 25 bp, Mus musculus
atatacacaggccatcctggacatg

SEQ ID NO: 206355 - DNA, 25 bp, Mus musculus
atatacagaccttactgtggcctca

SEQ ID NO: 206356 - DNA, 25 bp, Mus musculus
atatacatggtggtacaccatgagg

SEQ ID NO: 206357 - DNA, 25 bp, Mus musculus
atatacatttcaaggcacagaagaa

SEQ ID NO: 206358 - DNA, 25 bp, Mus musculus
atatacatttcaagtcttcaggaaa

SEQ ID NO: 206359 - DNA, 25 bp, Mus musculus
atataccaaaggttcaaaagaggaa

SEQ ID NO: 206360 - DNA, 25 bp, Mus musculus
atataccatgaggcttacagtccaa

SEQ ID NO: 206361 - DNA, 25 bp, Mus musculus
atataccccatggagactcggctga

SEQ ID NO: 206362 - DNA, 25 bp, Mus musculus
atatacccgacaatgcttttgtcaa

SEQ ID NO: 206363 - DNA, 25 bp, Mus musculus
atatacggaagcccctctggaaccg

SEQ ID NO: 206364 - DNA, 25 bp, Mus musculus
atatacgggctgattcgctactcgg

SEQ ID NO: 206365 - DNA, 25 bp, Mus musculus
atatacgggctggccaagcccagag

SEQ ID NO: 206366 - DNA, 25 bp, Mus musculus
atatacgggctggtccaaaaggaac

SEQ ID NO: 206367 - DNA, 25 bp, Mus musculus
atatactaccacaaggggacatgaa

SEQ ID NO: 206368 - DNA, 25 bp, Mus musculus
atatactcaaagggcagcacatgag

SEQ ID NO: 206369 - DNA, 25 bp, Mus musculus
atatactcaaaggtgttggggccac

SEQ ID NO: 206370 - DNA, 25 bp, Mus musculus
atatactcaaggtatcgcagggtgg

SEQ ID NO: 206371 - DNA, 25 bp, Mus musculus
atatactcatctgccatggtgtgga

SEQ ID NO: 206372 - DNA, 25 bp, Mus musculus
atatactgaaatgactggaaagtta

SEQ ID NO: 206373 - DNA, 25 bp, Mus musculus
atatactgctggagggctgcagtat

SEQ ID NO: 206374 - DNA, 25 bp, Mus musculus
atatacttagacaggtatccattat

SEQ ID NO: 206375 - DNA, 25 bp, Mus musculus
atatacttcagaatctgaccacaga

SEQ ID NO: 206376 - DNA, 25 bp, Mus musculus
atatacttcagctccaacagaggaa

SEQ ID NO: 206377 - DNA, 25 bp, Mus musculus
atatacttcaggaactaattctgaa

SEQ ID NO: 206378 - DNA, 25 bp, Mus musculus
atatacttctgcaatgcctggcttc

SEQ ID NO: 206379 - DNA, 25 bp, Mus musculus
atatagaaaatgaagtttctacact

SEQ ID NO: 206380 - DNA, 25 bp, Mus musculus
atatagagcagtaccaaatatgccc

SEQ ID NO: 206381 - DNA, 25 bp, Mus musculus
atatagagctggaggataaataagg

SEQ ID NO: 206382 - DNA, 25 bp, Mus musculus
atatagatttccttctgggttctca

SEQ ID NO: 206383 - DNA, 25 bp, Mus musculus
atatagcaacttggttctcacgaga

SEQ ID NO: 206384 - DNA, 25 bp, Mus musculus
atatagcacagaacctatcaacaca

SEQ ID NO: 206385 - DNA, 25 bp, Mus musculus
atatagcatttcaggatggaaccgc

SEQ ID NO: 206386 - DNA, 25 bp, Mus musculus
atatagccttcaggaaacaaagcaa

SEQ ID NO: 206387 - DNA, 25 bp, Mus musculus
atatagcttcactgataaaacacgg

SEQ ID NO: 206388 - DNA, 25 bp, Mus musculus
atataggacactacgaacagcacat

SEQ ID NO: 206389 - DNA, 25 bp, Mus musculus
atataggacggcagagaatccgtga

SEQ ID NO: 206390 - DNA, 25 bp, Mus musculus
atataggcaattcaacttgatttct

SEQ ID NO: 206391 - DNA, 25 bp, Mus musculus
atataggcaattgggtccccatcct

SEQ ID NO: 206392 - DNA, 25 bp, Mus musculus
atataggcatagactacttttaagg

SEQ ID NO: 206393 - DNA, 25 bp, Mus musculus
atataggtatgggagaacagaacac

SEQ ID NO: 206394 - DNA, 25 bp, Mus musculus
atatataaagaggcttgcacagcat

SEQ ID NO: 206395 - DNA, 25 bp, Mus musculus
atatataattaaaaagtttgcattt

SEQ ID NO: 206396 - DNA, 25 bp, Mus musculus
atatatacagatttgcaacagcatg

SEQ ID NO: 206397 - DNA, 25 bp, Mus musculus
atatatacgggttctccttgctggg

SEQ ID NO: 206398 - DNA, 25 bp, Mus musculus
atatatactgaaatgactggaaagt

SEQ ID NO: 206399 - DNA, 25 bp, Mus musculus
atatatagcaaaaatgtgaatcctc

SEQ ID NO: 206400 - DNA, 25 bp, Mus musculus
atatatagcaactttaaaggattaa

SEQ ID NO: 206401 - DNA, 25 bp, Mus musculus
atatatatggaagaccaccagactg

SEQ ID NO: 206402 - DNA, 25 bp, Mus musculus
atatatcacacaaaaattccagagg

SEQ ID NO: 206403 - DNA, 25 bp, Mus musculus
atatatcacacaaagacccacagtt

SEQ ID NO: 206404 - DNA, 25 bp, Mus musculus
atatatcagtgagatttcaccgaga

SEQ ID NO: 206405 - DNA, 25 bp, Mus musculus
atatatctgcttgtagagctgtcgg

SEQ ID NO: 206406 - DNA, 25 bp, Mus musculus
atatatcttcaatgaaattacactt

SEQ ID NO: 206407 - DNA, 25 bp, Mus musculus
atatatcttcaatggtctgacagtc

SEQ ID NO: 206408 - DNA, 25 bp, Mus musculus
atatatgaggtaccagctctactca

SEQ ID NO: 206409 - DNA, 25 bp, Mus musculus
atatatgcagagatgagccgccagc

SEQ ID NO: 206410 - DNA, 25 bp, Mus musculus
atatatgcgaaaggcctgtccgagg

SEQ ID NO: 206411 - DNA, 25 bp, Mus musculus
atatatgcgaaagggaacttcccca

SEQ ID NO: 206412 - DNA, 25 bp, Mus musculus
atatatggagcagaagcaaatcaga

SEQ ID NO: 206413 - DNA, 25 bp, Mus musculus
atatatgtatatactgccccggagg

SEQ ID NO: 206414 - DNA, 25 bp, Mus musculus
atatatgtggggccgagcaatatga

SEQ ID NO: 206415 - DNA, 25 bp, Mus musculus
atatattaaccgggaatcacctggc

SEQ ID NO: 206416 - DNA, 25 bp, Mus musculus
atatattacatagacatgcagaagt

SEQ ID NO: 206417 - DNA, 25 bp, Mus musculus
atatattatgaaagaatcccagtaa

SEQ ID NO: 206418 - DNA, 25 bp, Mus musculus
atatattatgaaagctatcatgaga

SEQ ID NO: 206419 - DNA, 25 bp, Mus musculus
atatattgaaaatccctgactctgg

SEQ ID NO: 206420 - DNA, 25 bp, Mus musculus
atatattgaagtgcggtgtttaaaa

SEQ ID NO: 206421 - DNA, 25 bp, Mus musculus
atatattgtaacagaatccgaatct

SEQ ID NO: 206422 - DNA, 25 bp, Mus musculus
atatatttgctcaaagccatcttca

SEQ ID NO: 206423 - DNA, 25 bp, Mus musculus
atatatttgctcaaatggcctcctg

SEQ ID NO: 206424 - DNA, 25 bp, Mus musculus
atatatttttacagggaggagcctc

SEQ ID NO: 206425 - DNA, 25 bp, Mus musculus
atatcaaaaagggaatcttacttca

SEQ ID NO: 206426 - DNA, 25 bp, Mus musculus
atatcaaaatcagagccagaaactc

SEQ ID NO: 206427 - DNA, 25 bp, Mus musculus
atatcaaaatcaggagatggagttc

SEQ ID NO: 206428 - DNA, 25 bp, Mus musculus
atatcaaagaggtagtagtctggaa

SEQ ID NO: 206429 - DNA, 25 bp, Mus musculus
atatcaacatcaaagtaatcccctc

SEQ ID NO: 206430 - DNA, 25 bp, Mus musculus
atatcaacctgaagattacgctcga

SEQ ID NO: 206431 - DNA, 25 bp, Mus musculus
atatcaacttgattcgaggaactgg

SEQ ID NO: 206432 - DNA, 25 bp, Mus musculus
atatcaagaaacccccatagaatgt

SEQ ID NO: 206433 - DNA, 25 bp, Mus musculus
atatcaagaaactaatactctacag

SEQ ID NO: 206434 - DNA, 25 bp, Mus musculus
atatcaagaagccctggctgtcctg

SEQ ID NO: 206435 - DNA, 25 bp, Mus musculus
atatcaagaaggagtttgacaagaa

SEQ ID NO: 206436 - DNA, 25 bp, Mus musculus
atatcaagaaggctgctttgcgttt

SEQ ID NO: 206437 - DNA, 25 bp, Mus musculus
atatcaagccgcctgtttctggacc

SEQ ID NO: 206438 - DNA, 25 bp, Mus musculus
atatcaagccgcgttttacgatggg

SEQ ID NO: 206439 - DNA, 25 bp, Mus musculus
atatcaatacagggtctgtgatggt

SEQ ID NO: 206440 - DNA, 25 bp, Mus musculus
atatcacacaaaaattccagaggtt

SEQ ID NO: 206441 - DNA, 25 bp, Mus musculus
atatcacacaaagacccacagttat

SEQ ID NO: 206442 - DNA, 25 bp, Mus musculus
atatcaccaaacagacaccaacttt

SEQ ID NO: 206443 - DNA, 25 bp, Mus musculus
atatcaccaaagctgaaaggggtct

SEQ ID NO: 206444 - DNA, 25 bp, Mus musculus
atatcaccaaagtcctgaaggggaa

SEQ ID NO: 206445 - DNA, 25 bp, Mus musculus
atatcaccattaaggactctgcagg

SEQ ID NO: 206446 - DNA, 25 bp, Mus musculus
atatcaccattaaggactgcaggct

SEQ ID NO: 206447 - DNA, 25 bp, Mus musculus
atatcaccattaaggacttcctgaa

SEQ ID NO: 206448 - DNA, 25 bp, Mus musculus
atatcacgaggacaaagataatgga

SEQ ID NO: 206449 - DNA, 25 bp, Mus musculus
atatcacgctgcatgaactggagaa

SEQ ID NO: 206450 - DNA, 25 bp, Mus musculus
atatcactactggggaaacaggcac

SEQ ID NO: 206451 - DNA, 25 bp, Mus musculus
atatcactactgtggtcgtgcagac

SEQ ID NO: 206452 - DNA, 25 bp, Mus musculus
atatcactctgggaggcccggtgct

SEQ ID NO: 206453 - DNA, 25 bp, Mus musculus
atatcactctgttccatgccatgga

SEQ ID NO: 206454 - DNA, 25 bp, Mus musculus
atatcagaagtttcagtctggaagg

SEQ ID NO: 206455 - DNA, 25 bp, Mus musculus
atatcagagatatcataggacccag

SEQ ID NO: 206456 - DNA, 25 bp, Mus musculus
atatcagagatggacctgcaggtga

SEQ ID NO: 206457 - DNA, 25 bp, Mus musculus
atatcagcacggacgattccggagc

SEQ ID NO: 206458 - DNA, 25 bp, Mus musculus
atatcagcacgggtcacccagaagc

SEQ ID NO: 206459 - DNA, 25 bp, Mus musculus
atatcagcttagaaggctgtgaatg

SEQ ID NO: 206460 - DNA, 25 bp, Mus musculus
atatcagggctcaaggaggtagatg

SEQ ID NO: 206461 - DNA, 25 bp, Mus musculus
atatcagtgagatttcaccgagatg

SEQ ID NO: 206462 - DNA, 25 bp, Mus musculus
atatcagttatctgacccttcctat

SEQ ID NO: 206463 - DNA, 25 bp, Mus musculus
atatcatatctggccatcagacact

SEQ ID NO: 206464 - DNA, 25 bp, Mus musculus
atatcatatctgtgtgaaaatagga

SEQ ID NO: 206465 - DNA, 25 bp, Mus musculus
atatcatccaggtgtgttatccacg

SEQ ID NO: 206466 - DNA, 25 bp, Mus musculus
atatcatccagttgctgcttcaagc

SEQ ID NO: 206467 - DNA, 25 bp, Mus musculus
atatcatctcagatggaggctgcag

SEQ ID NO: 206468 - DNA, 25 bp, Mus musculus
atatcatgagctttcccgaaagatt

SEQ ID NO: 206469 - DNA, 25 bp, Mus musculus
atatcatgaggtcggcagattcaga

SEQ ID NO: 206470 - DNA, 25 bp, Mus musculus
atatcatggtgcagtaccatgcact

SEQ ID NO: 206471 - DNA, 25 bp, Mus musculus
atatcatgttgaagatggtaaaagc

SEQ ID NO: 206472 - DNA, 25 bp, Mus musculus
atatcatgttgaagctcatctacgg

SEQ ID NO: 206473 - DNA, 25 bp, Mus musculus
atatcattagcaacgctgttcctgg

SEQ ID NO: 206474 - DNA, 25 bp, Mus musculus
atatcatttagaggacattcactga

SEQ ID NO: 206475 - DNA, 25 bp, Mus musculus
atatccacgctttctctgctgccct

SEQ ID NO: 206476 - DNA, 25 bp, Mus musculus
atatccaggaagaaattccaaatta

SEQ ID NO: 206477 - DNA, 25 bp, Mus musculus
atatccaggaaggctcagcaacaac

SEQ ID NO: 206478 - DNA, 25 bp, Mus musculus
atatccaggagagagtctccgctgc

SEQ ID NO: 206479 - DNA, 25 bp, Mus musculus
atatccaggaggtgacccacaacca

SEQ ID NO: 206480 - DNA, 25 bp, Mus musculus
atatccaggagttgatctttataga

SEQ ID NO: 206481 - DNA, 25 bp, Mus musculus
atatccatcggagccggggggacct

SEQ ID NO: 206482 - DNA, 25 bp, Mus musculus
atatcccaagagggtgtagcccgga

SEQ ID NO: 206483 - DNA, 25 bp, Mus musculus
atatcccagatctctctggcttttg

SEQ ID NO: 206484 - DNA, 25 bp, Mus musculus
atatcccagatgctcatctttgggt

SEQ ID NO: 206485 - DNA, 25 bp, Mus musculus
atatccccaacacggtcggaaactc

SEQ ID NO: 206486 - DNA, 25 bp, Mus musculus
atatccccacagcagtcctgtggat

SEQ ID NO: 206487 - DNA, 25 bp, Mus musculus
atatccccaggtactgtgcaggcac

SEQ ID NO: 206488 - DNA, 25 bp, Mus musculus
atatccctaagattttgttcctggc

SEQ ID NO: 206489 - DNA, 25 bp, Mus musculus
atatcccttgcattccatattggaa

SEQ ID NO: 206490 - DNA, 25 bp, Mus musculus
atatccgtcgaaaagcggcatctgt

SEQ ID NO: 206491 - DNA, 25 bp, Mus musculus
atatccgtgagtcagatgttccagc

SEQ ID NO: 206492 - DNA, 25 bp, Mus musculus
atatcctcagattcagaaaaaccag

SEQ ID NO: 206493 - DNA, 25 bp, Mus musculus
atatcctcagcctctccagcttctg

SEQ ID NO: 206494 - DNA, 25 bp, Mus musculus
atatcctcagtgtttgtgcctgtcc

SEQ ID NO: 206495 - DNA, 25 bp, Mus musculus
atatccttcaggatggaacagacta

SEQ ID NO: 206496 - DNA, 25 bp, Mus musculus
atatccttccagatgtatcgggata

SEQ ID NO: 206497 - DNA, 25 bp, Mus musculus
atatccttccagatgtatctggata

SEQ ID NO: 206498 - DNA, 25 bp, Mus musculus
atatccttccaggagtttatcatgt

SEQ ID NO: 206499 - DNA, 25 bp, Mus musculus
atatccttctagtgttgggcaacca

SEQ ID NO: 206500 - DNA, 25 bp, Mus musculus
atatcgacccgaagagtacagtcgt

SEQ ID NO: 206501 - DNA, 25 bp, Mus musculus
atatcgacccgaaggtcgttttgaa

SEQ ID NO: 206502 - DNA, 25 bp, Mus musculus
atatcgacttcaggctgatctcttc

SEQ ID NO: 206503 - DNA, 25 bp, Mus musculus
atatcgaggatttagctggtccaaa

SEQ ID NO: 206504 - DNA, 25 bp, Mus musculus
atatcgccagtgatttccggtacaa

SEQ ID NO: 206505 - DNA, 25 bp, Mus musculus
atatcgtccaggtatttgataacac

SEQ ID NO: 206506 - DNA, 25 bp, Mus musculus
atatcgtcccagttttcgcatacca

SEQ ID NO: 206507 - DNA, 25 bp, Mus musculus
atatcgtcctgcgctctttgagcgc

SEQ ID NO: 206508 - DNA, 25 bp, Mus musculus
atatctaaagtggttccctcaaccc

SEQ ID NO: 206509 - DNA, 25 bp, Mus musculus
atatctaaccagcagatagtctaca

SEQ ID NO: 206510 - DNA, 25 bp, Mus musculus
atatctacactgaattttagaaagg

SEQ ID NO: 206511 - DNA, 25 bp, Mus musculus
atatctacactgagtccaaacatca

SEQ ID NO: 206512 - DNA, 25 bp, Mus musculus
atatctacactgagtgccagtcatt

SEQ ID NO: 206513 - DNA, 25 bp, Mus musculus
atatctacactgagtggttcctcag

SEQ ID NO: 206514 - DNA, 25 bp, Mus musculus
atatctacaggtctgacaagacaca

SEQ ID NO: 206515 - DNA, 25 bp, Mus musculus
atatctacatatcaactcaacaagg

SEQ ID NO: 206516 - DNA, 25 bp, Mus musculus
atatctaccaccaacgagagccatc

SEQ ID NO: 206517 - DNA, 25 bp, Mus musculus
atatctaccaggtaagattaaaaga

SEQ ID NO: 206518 - DNA, 25 bp, Mus musculus
atatctacctgcagagctttgtggc

SEQ ID NO: 206519 - DNA, 25 bp, Mus musculus
atatctacctgcaggtcacccacgt

SEQ ID NO: 206520 - DNA, 25 bp, Mus musculus
atatctagcacccaggttactcggc

SEQ ID NO: 206521 - DNA, 25 bp, Mus musculus
atatctatctgcatgtccagatcag

SEQ ID NO: 206522 - DNA, 25 bp, Mus musculus
atatctcaacaaggcacggcagctc

SEQ ID NO: 206523 - DNA, 25 bp, Mus musculus
atatctcacccagacaggcttctaa

SEQ ID NO: 206524 - DNA, 25 bp, Mus musculus
atatctcagcaggtaaatgagaaaa

SEQ ID NO: 206525 - DNA, 25 bp, Mus musculus
atatctcagcaggtggcagctagtt

SEQ ID NO: 206526 - DNA, 25 bp, Mus musculus
atatctcggacgtgagggtcacaca

SEQ ID NO: 206527 - DNA, 25 bp, Mus musculus
atatctcggagcggtttcctctgag

SEQ ID NO: 206528 - DNA, 25 bp, Mus musculus
atatctcttcaggtgccagcctcac

SEQ ID NO: 206529 - DNA, 25 bp, Mus musculus
atatctgacctgtgctgagcctacc

SEQ ID NO: 206530 - DNA, 25 bp, Mus musculus
atatctgcatgttgagacacaaaga

SEQ ID NO: 206531 - DNA, 25 bp, Mus musculus
atatctgctaaggctttggagtttt

SEQ ID NO: 206532 - DNA, 25 bp, Mus musculus
atatctgcttgtagagctgtcggcc

SEQ ID NO: 206533 - DNA, 25 bp, Mus musculus
atatctggccagaaatggcctccac

SEQ ID NO: 206534 - DNA, 25 bp, Mus musculus
atatctgtaccagggtgtacattgg

SEQ ID NO: 206535 - DNA, 25 bp, Mus musculus
atatctgtgtacagggttcggcaga

SEQ ID NO: 206536 - DNA, 25 bp, Mus musculus
atatctgtgtatagagttcgaaatt

SEQ ID NO: 206537 - DNA, 25 bp, Mus musculus
atatctgtgtatagatgatgaggaa

SEQ ID NO: 206538 - DNA, 25 bp, Mus musculus
atatcttactcagaaaaatttccta

SEQ ID NO: 206539 - DNA, 25 bp, Mus musculus
atatcttactcagggcattacacaa

SEQ ID NO: 206540 - DNA, 25 bp, Mus musculus
atatcttcaatgaaattacacttgt

SEQ ID NO: 206541 - DNA, 25 bp, Mus musculus
atatcttcaatggtctgacagtctc

SEQ ID NO: 206542 - DNA, 25 bp, Mus musculus
atatcttcagagactggaagtgatt

SEQ ID NO: 206543 - DNA, 25 bp, Mus musculus
atatcttcattaagatggatgtagg

SEQ ID NO: 206544 - DNA, 25 bp, Mus musculus
atatcttcttcacaggaagtcctcg

SEQ ID NO: 206545 - DNA, 25 bp, Mus musculus
atatcttctttctcatctttgggta

SEQ ID NO: 206546 - DNA, 25 bp, Mus musculus
atatcttgaagcaggtggactcccc

SEQ ID NO: 206547 - DNA, 25 bp, Mus musculus
atatcttggaccacgctatggtttt

SEQ ID NO: 206548 - DNA, 25 bp, Mus musculus
atatcttgtaagctaaacagaaaga

SEQ ID NO: 206549 - DNA, 25 bp, Mus musculus
atatctttaagcaacctcactttgg

SEQ ID NO: 206550 - DNA, 25 bp, Mus musculus
atatctttatatcttaaaagatgtg

SEQ ID NO: 206551 - DNA, 25 bp, Mus musculus
atatctttcagaggagcctatcacg

SEQ ID NO: 206552 - DNA, 25 bp, Mus musculus
atatctttcaggtggtatagctgta

SEQ ID NO: 206553 - DNA, 25 bp, Mus musculus
atatctttgaagaccttgcttttac

SEQ ID NO: 206554 - DNA, 25 bp, Mus musculus
atatctttgaagatgctgtcttcag

SEQ ID NO: 206555 - DNA, 25 bp, Mus musculus
atatctttgaaggacgtgtaattcc

SEQ ID NO: 206556 - DNA, 25 bp, Mus musculus
atatctttgaagtactaagtataac

SEQ ID NO: 206557 - DNA, 25 bp, Mus musculus
atatctttgggagacgctctgtctc

SEQ ID NO: 206558 - DNA, 25 bp, Mus musculus
atatctttggtctgtccgaatctcc

SEQ ID NO: 206559 - DNA, 25 bp, Mus musculus
atatctttgtatatgaggtgactgg

SEQ ID NO: 206560 - DNA, 25 bp, Mus musculus
atatgaaaaagggggccacattatc

SEQ ID NO: 206561 - DNA, 25 bp, Mus musculus
atatgaaagagtagtttcaagaaca

SEQ ID NO: 206562 - DNA, 25 bp, Mus musculus
atatgaacagctggccgactgcttt

SEQ ID NO: 206563 - DNA, 25 bp, Mus musculus
atatgaacaggcatgtaatgaattc

SEQ ID NO: 206564 - DNA, 25 bp, Mus musculus
atatgaagaagcacttttagatggc

SEQ ID NO: 206565 - DNA, 25 bp, Mus musculus
atatgaagaggaggcgggccccggg

SEQ ID NO: 206566 - DNA, 25 bp, Mus musculus
atatgaagcacacaggggtagtgtt

SEQ ID NO: 206567 - DNA, 25 bp, Mus musculus
atatgaagcagattgattatacggt

SEQ ID NO: 206568 - DNA, 25 bp, Mus musculus
atatgaaggagataacaggacggac

SEQ ID NO: 206569 - DNA, 25 bp, Mus musculus
atatgaagtatggatggaagaattt

SEQ ID NO: 206570 - DNA, 25 bp, Mus musculus
atatgaatatcaagatggatgctgc

SEQ ID NO: 206571 - DNA, 25 bp, Mus musculus
atatgaatatgtatgtgtttttcag

SEQ ID NO: 206572 - DNA, 25 bp, Mus musculus
atatgaatattagtgaacttatttc

SEQ ID NO: 206573 - DNA, 25 bp, Mus musculus
atatgaatattgctggcctataaag

SEQ ID NO: 206574 - DNA, 25 bp, Mus musculus
atatgacaactgttggctggctctc

SEQ ID NO: 206575 - DNA, 25 bp, Mus musculus
atatgacagaagtctgcgtggtggc

SEQ ID NO: 206576 - DNA, 25 bp, Mus musculus
atatgacatagcttgtgacgaatgg

SEQ ID NO: 206577 - DNA, 25 bp, Mus musculus
atatgacatggagtggaagacatga

SEQ ID NO: 206578 - DNA, 25 bp, Mus musculus
atatgaccgtatcaccattgaaata

SEQ ID NO: 206579 - DNA, 25 bp, Mus musculus
atatgactcaattctacggtgagac

SEQ ID NO: 206580 - DNA, 25 bp, Mus musculus
atatgacttccatataagtttcttt

SEQ ID NO: 206581 - DNA, 25 bp, Mus musculus
atatgacttgggagaagagacttgc

SEQ ID NO: 206582 - DNA, 25 bp, Mus musculus
atatgacttgtttggatttagggtg

SEQ ID NO: 206583 - DNA, 25 bp, Mus musculus
atatgagaaaatttccaggaccttt

SEQ ID NO: 206584 - DNA, 25 bp, Mus musculus
atatgagaagtcaaactacaactcc

SEQ ID NO: 206585 - DNA, 25 bp, Mus musculus
atatgagcaaacgtatgcagagatg

SEQ ID NO: 206586 - DNA, 25 bp, Mus musculus
atatgagcagatgaaacggcttgtc

SEQ ID NO: 206587 - DNA, 25 bp, Mus musculus
atatgagcatccagtgtatccagag

SEQ ID NO: 206588 - DNA, 25 bp, Mus musculus
atatgaggagcaccagctagccacg

SEQ ID NO: 206589 - DNA, 25 bp, Mus musculus
atatgaggagtcagtacaggctacc

SEQ ID NO: 206590 - DNA, 25 bp, Mus musculus
atatgaggctttggttttgttgagt

SEQ ID NO: 206591 - DNA, 25 bp, Mus musculus
atatgagggctcaagtcgcaatgtg

SEQ ID NO: 206592 - DNA, 25 bp, Mus musculus
atatgagtccaccaatggctcaaca

SEQ ID NO: 206593 - DNA, 25 bp, Mus musculus
atatgagtggaaggtggcccagatg

SEQ ID NO: 206594 - DNA, 25 bp, Mus musculus
atatgagtggaaggtgggattggtt

SEQ ID NO: 206595 - DNA, 25 bp, Mus musculus
atatgatacaggtctaccgcagccg

SEQ ID NO: 206596 - DNA, 25 bp, Mus musculus
atatgatcaacgaagcaatggcacc

SEQ ID NO: 206597 - DNA, 25 bp, Mus musculus
atatgatgaccgagaggaagacatt

SEQ ID NO: 206598 - DNA, 25 bp, Mus musculus
atatgatgagaggccgggcccctcc

SEQ ID NO: 206599 - DNA, 25 bp, Mus musculus
atatgatgagaggcgacgtagtcac

SEQ ID NO: 206600 - DNA, 25 bp, Mus musculus
atatgatgaggggttgccacatctg

SEQ ID NO: 206601 - DNA, 25 bp, Mus musculus
atatgatggtggctatggaggtttt

SEQ ID NO: 206602 - DNA, 25 bp, Mus musculus
atatgattccagatgcacgccatcc

SEQ ID NO: 206603 - DNA, 25 bp, Mus musculus
atatgattccaggctactagtcagt

SEQ ID NO: 206604 - DNA, 25 bp, Mus musculus
atatgattctgctgagcatttgcta

SEQ ID NO: 206605 - DNA, 25 bp, Mus musculus
atatgattctgctggtgtgggactt

SEQ ID NO: 206606 - DNA, 25 bp, Mus musculus
atatgcaaatagagtaaaggagttt

SEQ ID NO: 206607 - DNA, 25 bp, Mus musculus
atatgcaaatagggtgaaagaattg

SEQ ID NO: 206608 - DNA, 25 bp, Mus musculus
atatgcaagtggaggtgaagtattt

SEQ ID NO: 206609 - DNA, 25 bp, Mus musculus
atatgcaatttcggagcttcaccct

SEQ ID NO: 206610 - DNA, 25 bp, Mus musculus
atatgcacagtggcttctattttga

SEQ ID NO: 206611 - DNA, 25 bp, Mus musculus
atatgcacgaaggatggcgagacac

SEQ ID NO: 206612 - DNA, 25 bp, Mus musculus
atatgcagaaaatacaacctccaag

SEQ ID NO: 206613 - DNA, 25 bp, Mus musculus
atatgcagaagagaagaaaaattca

SEQ ID NO: 206614 - DNA, 25 bp, Mus musculus
atatgcagaagagttagcaaaacgt

SEQ ID NO: 206615 - DNA, 25 bp, Mus musculus
atatgcagcagatttttatcattaa

SEQ ID NO: 206616 - DNA, 25 bp, Mus musculus
atatgcagcaggggggagcaccgtc

SEQ ID NO: 206617 - DNA, 25 bp, Mus musculus
atatgcagctgaggcgtaagttgga

SEQ ID NO: 206618 - DNA, 25 bp, Mus musculus
atatgcagctgagtccacgtgaagt

SEQ ID NO: 206619 - DNA, 25 bp, Mus musculus
atatgcaggcttatgctttgatcca

SEQ ID NO: 206620 - DNA, 25 bp, Mus musculus
atatgccaatggctggaagctaaac

SEQ ID NO: 206621 - DNA, 25 bp, Mus musculus
atatgccaccatccgtgactgtcct

SEQ ID NO: 206622 - DNA, 25 bp, Mus musculus
atatgccagggggctctgtaaaaga

SEQ ID NO: 206623 - DNA, 25 bp, Mus musculus
atatgcccagcgagccagagcccca

SEQ ID NO: 206624 - DNA, 25 bp, Mus musculus
atatgcccaggagactttccttctg

SEQ ID NO: 206625 - DNA, 25 bp, Mus musculus
atatgcccaggagagtttccttctg

SEQ ID NO: 206626 - DNA, 25 bp, Mus musculus
atatgcccaggtgaagcctgacggc

SEQ ID NO: 206627 - DNA, 25 bp, Mus musculus
atatgcccttgaaagcagaccgcgc

SEQ ID NO: 206628 - DNA, 25 bp, Mus musculus
atatgcctaaagggtatgtgtattt

SEQ ID NO: 206629 - DNA, 25 bp, Mus musculus
atatgcgaaaggcctgtccgaggac

SEQ ID NO: 206630 - DNA, 25 bp, Mus musculus
atatgcgaaagggaacttccccatg

SEQ ID NO: 206631 - DNA, 25 bp, Mus musculus
atatgcgaagctcccgccatgagaa

SEQ ID NO: 206632 - DNA, 25 bp, Mus musculus
atatgcgctggtggacgcagacgat

SEQ ID NO: 206633 - DNA, 25 bp, Mus musculus
atatgcgctggttccagatgcctga

SEQ ID NO: 206634 - DNA, 25 bp, Mus musculus
atatgctactgcaggtaaatgagat

SEQ ID NO: 206635 - DNA, 25 bp, Mus musculus
atatgctctacaagaattttacagc

SEQ ID NO: 206636 - DNA, 25 bp, Mus musculus
atatgctgaaggagttattcctgat

SEQ ID NO: 206637 - DNA, 25 bp, Mus musculus
atatgctgaagtatttcatggttct

SEQ ID NO: 206638 - DNA, 25 bp, Mus musculus
atatgctgcagagcttcacttggtt

SEQ ID NO: 206639 - DNA, 25 bp, Mus musculus
atatgcttatgggaggtccaaatat

SEQ ID NO: 206640 - DNA, 25 bp, Mus musculus
atatgcttttaaggcagcccaccca

SEQ ID NO: 206641 - DNA, 25 bp, Mus musculus
atatggaaaaaggaaatatatgaag

SEQ ID NO: 206642 - DNA, 25 bp, Mus musculus
atatggaaaaatatggaacaaaagt

SEQ ID NO: 206643 - DNA, 25 bp, Mus musculus
atatggaaaatgattcaaggcctct

SEQ ID NO: 206644 - DNA, 25 bp, Mus musculus
atatggaaaatggtgttgctgtcat

SEQ ID NO: 206645 - DNA, 25 bp, Mus musculus
atatggaaaatgtttcaacctggat

SEQ ID NO: 206646 - DNA, 25 bp, Mus musculus
atatggaaagtaaattcagttccaa

SEQ ID NO: 206647 - DNA, 25 bp, Mus musculus
atatggaagtgctccttccgcttcc

SEQ ID NO: 206648 - DNA, 25 bp, Mus musculus
atatggaatacacagcagggcatca

SEQ ID NO: 206649 - DNA, 25 bp, Mus musculus
atatggacaggggatagcccacctc

SEQ ID NO: 206650 - DNA, 25 bp, Mus musculus
atatggaccacagccacctgggccc

SEQ ID NO: 206651 - DNA, 25 bp, Mus musculus
atatggaccctgctgaccctgtaca

SEQ ID NO: 206652 - DNA, 25 bp, Mus musculus
atatggagagacgtgtcctgggctt

SEQ ID NO: 206653 - DNA, 25 bp, Mus musculus
atatggagagtatgctattaagaag

SEQ ID NO: 206654 - DNA, 25 bp, Mus musculus
atatggagcaaaaaatgggctacac

SEQ ID NO: 206655 - DNA, 25 bp, Mus musculus
atatggagcaaaagtatgaattagg

SEQ ID NO: 206656 - DNA, 25 bp, Mus musculus
atatggagcagaagcaaatcagaag

SEQ ID NO: 206657 - DNA, 25 bp, Mus musculus
atatggagggagcctggaggatgaa

SEQ ID NO: 206658 - DNA, 25 bp, Mus musculus
atatggatgcataaggaaagacaag

SEQ ID NO: 206659 - DNA, 25 bp, Mus musculus
atatggattattgggcttgggtgac

SEQ ID NO: 206660 - DNA, 25 bp, Mus musculus
atatggattcagattactcgggaca

SEQ ID NO: 206661 - DNA, 25 bp, Mus musculus
atatggattcagggctgaggcacta

SEQ ID NO: 206662 - DNA, 25 bp, Mus musculus
atatggcacccaagaatcagagcga

SEQ ID NO: 206663 - DNA, 25 bp, Mus musculus
atatggcacccaagctttcagatgc

SEQ ID NO: 206664 - DNA, 25 bp, Mus musculus
atatggcacccgttattggaaataa

SEQ ID NO: 206665 - DNA, 25 bp, Mus musculus
atatggccagaatgaccatactcac

SEQ ID NO: 206666 - DNA, 25 bp, Mus musculus
atatggcccacaaggaatgtgggtg

SEQ ID NO: 206667 - DNA, 25 bp, Mus musculus
atatggctatgccttctaggtttga

SEQ ID NO: 206668 - DNA, 25 bp, Mus musculus
atatggctctggtcgtggacgcaga

SEQ ID NO: 206669 - DNA, 25 bp, Mus musculus
atatgggattatcagaacaaaacgt

SEQ ID NO: 206670 - DNA, 25 bp, Mus musculus
atatgggctgcagaggattctcatt

SEQ ID NO: 206671 - DNA, 25 bp, Mus musculus
atatgggctgcagagtgtcctttat

SEQ ID NO: 206672 - DNA, 25 bp, Mus musculus
atatggtactgagtactctctgagt

SEQ ID NO: 206673 - DNA, 25 bp, Mus musculus
atatggtatgccaaacagcagttat

SEQ ID NO: 206674 - DNA, 25 bp, Mus musculus
atatggtcaaggcggagccagatgt

SEQ ID NO: 206675 - DNA, 25 bp, Mus musculus
atatggttttgctgtacagagaggc

SEQ ID NO: 206676 - DNA, 25 bp, Mus musculus
atatgtacaggcagaccgaaggctc

SEQ ID NO: 206677 - DNA, 25 bp, Mus musculus
atatgtacagtcccagaagtatcat

SEQ ID NO: 206678 - DNA, 25 bp, Mus musculus
atatgtagcagctgtggcagacctt

SEQ ID NO: 206679 - DNA, 25 bp, Mus musculus
atatgtataacaaggattctcaaag

SEQ ID NO: 206680 - DNA, 25 bp, Mus musculus
atatgtatgacgttgctgatcactg

SEQ ID NO: 206681 - DNA, 25 bp, Mus musculus
atatgtcaacagaattccagaggtt

SEQ ID NO: 206682 - DNA, 25 bp, Mus musculus
atatgtcaacagcccagaaggctct

SEQ ID NO: 206683 - DNA, 25 bp, Mus musculus
atatgtcaacaggacccacagttat

SEQ ID NO: 206684 - DNA, 25 bp, Mus musculus
atatgtcagaggaggtggagcctac

SEQ ID NO: 206685 - DNA, 25 bp, Mus musculus
atatgtccctggatgatattatcaa

SEQ ID NO: 206686 - DNA, 25 bp, Mus musculus
atatgtctgagtaaggagagtcctt

SEQ ID NO: 206687 - DNA, 25 bp, Mus musculus
atatgtctgtatgagaacaaagcca

SEQ ID NO: 206688 - DNA, 25 bp, Mus musculus
atatgtctgtatgagtggctgagag

SEQ ID NO: 206689 - DNA, 25 bp, Mus musculus
atatgtgaaggaagaagaaatcgat

SEQ ID NO: 206690 - DNA, 25 bp, Mus musculus
atatgtgacctgaaggagccaacac

SEQ ID NO: 206691 - DNA, 25 bp, Mus musculus
atatgtgacctggactcagccttgg

SEQ ID NO: 206692 - DNA, 25 bp, Mus musculus
atatgtgagtcaaaggtcacatgct

SEQ ID NO: 206693 - DNA, 25 bp, Mus musculus
atatgtgcggctcggtccgacgcac

SEQ ID NO: 206694 - DNA, 25 bp, Mus musculus
atatgtgttatgagtttgtgatgtc

SEQ ID NO: 206695 - DNA, 25 bp, Mus musculus
atatgtgttattgagctgggaggca

SEQ ID NO: 206696 - DNA, 25 bp, Mus musculus
atatgttattcagaggaccagagtt

SEQ ID NO: 206697 - DNA, 25 bp, Mus musculus
atatgttctcatccagagcctttat

SEQ ID NO: 206698 - DNA, 25 bp, Mus musculus
atatgtttagagcttcccccaccca

SEQ ID NO: 206699 - DNA, 25 bp, Mus musculus
atattaaacttacatcaaaattata

SEQ ID NO: 206700 - DNA, 25 bp, Mus musculus
atattaaacttacatgtttgaggat

SEQ ID NO: 206701 - DNA, 25 bp, Mus musculus
atattaaagagtccttcactcgtct

SEQ ID NO: 206702 - DNA, 25 bp, Mus musculus
atattaaatcctgaagtccacaatt

SEQ ID NO: 206703 - DNA, 25 bp, Mus musculus
atattaaatgggacctacacactgc

SEQ ID NO: 206704 - DNA, 25 bp, Mus musculus
atattaacccttggagtaaaaatgg

SEQ ID NO: 206705 - DNA, 25 bp, Mus musculus
atattacatagacatgcagaagttc

SEQ ID NO: 206706 - DNA, 25 bp, Mus musculus
atattacatgggtcattcacatgtc

SEQ ID NO: 206707 - DNA, 25 bp, Mus musculus
atattaccctagattggtgctgatg

SEQ ID NO: 206708 - DNA, 25 bp, Mus musculus
atattaccctgatggaaactcccag

SEQ ID NO: 206709 - DNA, 25 bp, Mus musculus
atattaccctgatggtcataatgat

SEQ ID NO: 206710 - DNA, 25 bp, Mus musculus
atattactcaacaacatccccgatg

SEQ ID NO: 206711 - DNA, 25 bp, Mus musculus
atattactgtagcaaagacggttta

SEQ ID NO: 206712 - DNA, 25 bp, Mus musculus
atattacttgtaaagatttgagaaa

SEQ ID NO: 206713 - DNA, 25 bp, Mus musculus
atattagaggagtcgctaagattgt

SEQ ID NO: 206714 - DNA, 25 bp, Mus musculus
atattatatgaactatgatggattc

SEQ ID NO: 206715 - DNA, 25 bp, Mus musculus
atattatccccatggagaaaatccc

SEQ ID NO: 206716 - DNA, 25 bp, Mus musculus
atattatccccatgttagaattgcc

SEQ ID NO: 206717 - DNA, 25 bp, Mus musculus
atattatgaaagaatcccagtaaac

SEQ ID NO: 206718 - DNA, 25 bp, Mus musculus
atattatgaaagctatcatgagaag

SEQ ID NO: 206719 - DNA, 25 bp, Mus musculus
atattatggaagagagtttcatggg

SEQ ID NO: 206720 - DNA, 25 bp, Mus musculus
atattattgatacatccatggggtc

SEQ ID NO: 206721 - DNA, 25 bp, Mus musculus
atattattgatattgacccattgat

SEQ ID NO: 206722 - DNA, 25 bp, Mus musculus
atattattggcaggattgaaagcta

SEQ ID NO: 206723 - DNA, 25 bp, Mus musculus
atattattggcagggcagaggagac

SEQ ID NO: 206724 - DNA, 25 bp, Mus musculus
atattcaaaaaggtatctggaggag

SEQ ID NO: 206725 - DNA, 25 bp, Mus musculus
atattcaaaaagtatgtttcattat

SEQ ID NO: 206726 - DNA, 25 bp, Mus musculus
atattcaaacaagttcaaagaagaa

SEQ ID NO: 206727 - DNA, 25 bp, Mus musculus
atattcaaatctggaatgttccgga

SEQ ID NO: 206728 - DNA, 25 bp, Mus musculus
atattcaaccagctgtgaccatagc

SEQ ID NO: 206729 - DNA, 25 bp, Mus musculus
atattcaagacgccttgggatgtct

SEQ ID NO: 206730 - DNA, 25 bp, Mus musculus
atattcaagcaaccatttaagaaga

SEQ ID NO: 206731 - DNA, 25 bp, Mus musculus
atattcacaagagcgttataacctg

SEQ ID NO: 206732 - DNA, 25 bp, Mus musculus
atattcacagaagaacactcaaggc

SEQ ID NO: 206733 - DNA, 25 bp, Mus musculus
atattcacagaattggcagaggggg

SEQ ID NO: 206734 - DNA, 25 bp, Mus musculus
atattcacagattatttatagcaca

SEQ ID NO: 206735 - DNA, 25 bp, Mus musculus
atattcacaggagtcgatagcggca

SEQ ID NO: 206736 - DNA, 25 bp, Mus musculus
atattcacaggtattccttttttgt

SEQ ID NO: 206737 - DNA, 25 bp, Mus musculus
atattcagcaacagcatccgccacc

SEQ ID NO: 206738 - DNA, 25 bp, Mus musculus
atattcagcagatttgtgaaaacat

SEQ ID NO: 206739 - DNA, 25 bp, Mus musculus
atattccaaaggatggaggccagta

SEQ ID NO: 206740 - DNA, 25 bp, Mus musculus
atattccataagatcatctttagat

SEQ ID NO: 206741 - DNA, 25 bp, Mus musculus
atattcccagcttctccagttggca

SEQ ID NO: 206742 - DNA, 25 bp, Mus musculus
atattccctgactgctgcccgaatg

SEQ ID NO: 206743 - DNA, 25 bp, Mus musculus
atattccctgatgttgcattgatga

SEQ ID NO: 206744 - DNA, 25 bp, Mus musculus
atattcctagacagacaaagtttct

SEQ ID NO: 206745 - DNA, 25 bp, Mus musculus
atattcctagacagtgttcctagga

SEQ ID NO: 206746 - DNA, 25 bp, Mus musculus
atattcctaggaccttctaccgttt

SEQ ID NO: 206747 - DNA, 25 bp, Mus musculus
atattcctccaaaatactgttcagc

SEQ ID NO: 206748 - DNA, 25 bp, Mus musculus
atattcctccaaagtgtgacttatg

SEQ ID NO: 206749 - DNA, 25 bp, Mus musculus
atattcctccatacgaacagcaagg

SEQ ID NO: 206750 - DNA, 25 bp, Mus musculus
atattcgaggagactcctgaggctt

SEQ ID NO: 206751 - DNA, 25 bp, Mus musculus
atattcggtggatttctttattcaa

SEQ ID NO: 206752 - DNA, 25 bp, Mus musculus
atattcgtgagcgctctctgctctc

SEQ ID NO: 206753 - DNA, 25 bp, Mus musculus
atattcgtgagcggcaattcaaatg

SEQ ID NO: 206754 - DNA, 25 bp, Mus musculus
atattctaagatgctcctgccagcg

SEQ ID NO: 206755 - DNA, 25 bp, Mus musculus
atattctatgccagacttggaggta

SEQ ID NO: 206756 - DNA, 25 bp, Mus musculus
atattctcccagagatcttcaaaat

SEQ ID NO: 206757 - DNA, 25 bp, Mus musculus
atattctgtaacgtatgatggatcg

SEQ ID NO: 206758 - DNA, 25 bp, Mus musculus
atattctgtaacgtatgatggattc

SEQ ID NO: 206759 - DNA, 25 bp, Mus musculus
atattcttcatcgtcatttacttcg

SEQ ID NO: 206760 - DNA, 25 bp, Mus musculus
atattcttctaagggaatacagtga

SEQ ID NO: 206761 - DNA, 25 bp, Mus musculus
atattcttggggaacttagcataac

SEQ ID NO: 206762 - DNA, 25 bp, Mus musculus
atattcttggggttgaatctccagt

SEQ ID NO: 206763 - DNA, 25 bp, Mus musculus
atattgaaaagagagccaagcctcc

SEQ ID NO: 206764 - DNA, 25 bp, Mus musculus
atattgaaaaggcggcaaagtgcgt

SEQ ID NO: 206765 - DNA, 25 bp, Mus musculus
atattgacacacatgcgggtggagt

SEQ ID NO: 206766 - DNA, 25 bp, Mus musculus
atattgagaccctacacttattcat

SEQ ID NO: 206767 - DNA, 25 bp, Mus musculus
atattgagaccctacatgtacccct

SEQ ID NO: 206768 - DNA, 25 bp, Mus musculus
atattgagcagattctcgactatct

SEQ ID NO: 206769 - DNA, 25 bp, Mus musculus
atattgataaacgccaccgctccct

SEQ ID NO: 206770 - DNA, 25 bp, Mus musculus
atattgataaagttcaacttcttga

SEQ ID NO: 206771 - DNA, 25 bp, Mus musculus
atattgatcaaagtgccagtgaacc

SEQ ID NO: 206772 - DNA, 25 bp, Mus musculus
atattgatcaaagtggaaatggatc

SEQ ID NO: 206773 - DNA, 25 bp, Mus musculus
atattgatgctgctgtccggcggtt

SEQ ID NO: 206774 - DNA, 25 bp, Mus musculus
atattgatgttgattgatgtgggtc

SEQ ID NO: 206775 - DNA, 25 bp, Mus musculus
atattgatgttggaaactgtggctg

SEQ ID NO: 206776 - DNA, 25 bp, Mus musculus
atattgcatagggtaaatgagaaaa

SEQ ID NO: 206777 - DNA, 25 bp, Mus musculus
atattgccaatggtgcagccggatg

SEQ ID NO: 206778 - DNA, 25 bp, Mus musculus
atattgccagagaaggaacatggct

SEQ ID NO: 206779 - DNA, 25 bp, Mus musculus
atattgccaggagttggcatccatt

SEQ ID NO: 206780 - DNA, 25 bp, Mus musculus
atattgccagtgactacaaatacaa

SEQ ID NO: 206781 - DNA, 25 bp, Mus musculus
atattgcccaaggacctgagcccaa

SEQ ID NO: 206782 - DNA, 25 bp, Mus musculus
atattgcccaagtcaaagtaaacaa

SEQ ID NO: 206783 - DNA, 25 bp, Mus musculus
atattgccgtgaaagaaaccggctc

SEQ ID NO: 206784 - DNA, 25 bp, Mus musculus
atattgccgtgaaaggctcagcggc

SEQ ID NO: 206785 - DNA, 25 bp, Mus musculus
atattggaaggtcctcagaatggtt

SEQ ID NO: 206786 - DNA, 25 bp, Mus musculus
atattggacaagaagttgttcaagg

SEQ ID NO: 206787 - DNA, 25 bp, Mus musculus
atattggacaagtagaggggaccat

SEQ ID NO: 206788 - DNA, 25 bp, Mus musculus
atattggcaacagacctgcctggag

SEQ ID NO: 206789 - DNA, 25 bp, Mus musculus
atattggcaacagttggaacgctat

SEQ ID NO: 206790 - DNA, 25 bp, Mus musculus
atattggcgcaccactctcaagctg

SEQ ID NO: 206791 - DNA, 25 bp, Mus musculus
atattgggaacgaccaaggactcac

SEQ ID NO: 206792 - DNA, 25 bp, Mus musculus
atattgtaacagaatccgaatcttg

SEQ ID NO: 206793 - DNA, 25 bp, Mus musculus
atattgtcaagaagcaagacttggg

SEQ ID NO: 206794 - DNA, 25 bp, Mus musculus
atattgtcaagatcgtaccgagaag

SEQ ID NO: 206795 - DNA, 25 bp, Mus musculus
atattgtcaaggaactgaaagacaa

SEQ ID NO: 206796 - DNA, 25 bp, Mus musculus
atattgtcagcaggttgatgcaagt

SEQ ID NO: 206797 - DNA, 25 bp, Mus musculus
atattgtcatatccaactgtgttat

SEQ ID NO: 206798 - DNA, 25 bp, Mus musculus
atattgtcgttggcttcctgcctgg

SEQ ID NO: 206799 - DNA, 25 bp, Mus musculus
atattgtgtagaatatatttgaaat

SEQ ID NO: 206800 - DNA, 25 bp, Mus musculus
atattgttacatgggtttatccatg

SEQ ID NO: 206801 - DNA, 25 bp, Mus musculus
atattgttacatgtgtatctccaga

SEQ ID NO: 206802 - DNA, 25 bp, Mus musculus
atattgttcggatgctgaatcccta

SEQ ID NO: 206803 - DNA, 25 bp, Mus musculus
atatttaaagctgcaggcacacgga

SEQ ID NO: 206804 - DNA, 25 bp, Mus musculus
atatttagaaggttctacttagcca

SEQ ID NO: 206805 - DNA, 25 bp, Mus musculus
atatttattatttaggcttggctgg

SEQ ID NO: 206806 - DNA, 25 bp, Mus musculus
atatttattatttaggtcattttga

SEQ ID NO: 206807 - DNA, 25 bp, Mus musculus
atatttattgcatccgatatcaaga

SEQ ID NO: 206808 - DNA, 25 bp, Mus musculus
atatttattggatgactaggacccc

SEQ ID NO: 206809 - DNA, 25 bp, Mus musculus
atatttattggtgaagccgagcttg

SEQ ID NO: 206810 - DNA, 25 bp, Mus musculus
atatttcacggacgtcagggccgtc

SEQ ID NO: 206811 - DNA, 25 bp, Mus musculus
atatttcagacaggattggtagctt

SEQ ID NO: 206812 - DNA, 25 bp, Mus musculus
atatttccggctgctcctgatgctg

SEQ ID NO: 206813 - DNA, 25 bp, Mus musculus
atatttcgtgcacagcaaaactctt

SEQ ID NO: 206814 - DNA, 25 bp, Mus musculus
atatttcgtgcacatttttgcagcc

SEQ ID NO: 206815 - DNA, 25 bp, Mus musculus
atatttctaatgggggtcctgctcc

SEQ ID NO: 206816 - DNA, 25 bp, Mus musculus
atatttctagaagatcattgcaacg

SEQ ID NO: 206817 - DNA, 25 bp, Mus musculus
atatttctgaacctagtctctgtcc

SEQ ID NO: 206818 - DNA, 25 bp, Mus musculus
atatttcttccaaggcagaagagtg

SEQ ID NO: 206819 - DNA, 25 bp, Mus musculus
atatttctttaaaaggtgaggcatg

SEQ ID NO: 206820 - DNA, 25 bp, Mus musculus
atatttgatcaacagacgtatgttg

SEQ ID NO: 206821 - DNA, 25 bp, Mus musculus
atatttgatcaacagccaaaccact

SEQ ID NO: 206822 - DNA, 25 bp, Mus musculus
atatttgattttcaggcagaaattt

SEQ ID NO: 206823 - DNA, 25 bp, Mus musculus
atatttgattttcaggggctccaac

SEQ ID NO: 206824 - DNA, 25 bp, Mus musculus
atatttgcaagatgagatgaacgat

SEQ ID NO: 206825 - DNA, 25 bp, Mus musculus
atatttgcagaagtcgagtccctgc

SEQ ID NO: 206826 - DNA, 25 bp, Mus musculus
atatttgcaggtgtcctccaccagt

SEQ ID NO: 206827 - DNA, 25 bp, Mus musculus
atatttgccaataatccgtgccggc

SEQ ID NO: 206828 - DNA, 25 bp, Mus musculus
atatttgccaataatgcagaccagc

SEQ ID NO: 206829 - DNA, 25 bp, Mus musculus
atatttgctcaaagccatcttcaga

SEQ ID NO: 206830 - DNA, 25 bp, Mus musculus
atatttgctcaaatggcctcctggg

SEQ ID NO: 206831 - DNA, 25 bp, Mus musculus
atatttgctccgctttttgcaatgt

SEQ ID NO: 206832 - DNA, 25 bp, Mus musculus
atatttgcttctgaggtggtcctgg

SEQ ID NO: 206833 - DNA, 25 bp, Mus musculus
atatttggagccagacacttgtctc

SEQ ID NO: 206834 - DNA, 25 bp, Mus musculus
atatttggagccagcgacccatacg

SEQ ID NO: 206835 - DNA, 25 bp, Mus musculus
atatttgggaaaaggactagcggac

SEQ ID NO: 206836 - DNA, 25 bp, Mus musculus
atatttgggaaaaggtgatgcctgc

SEQ ID NO: 206837 - DNA, 25 bp, Mus musculus
atatttgtccgtatgttatatctca

SEQ ID NO: 206838 - DNA, 25 bp, Mus musculus
atatttgtgaaaggcactgaagatc

SEQ ID NO: 206839 - DNA, 25 bp, Mus musculus
atatttgttcttaaggatacagagg

SEQ ID NO: 206840 - DNA, 25 bp, Mus musculus
atatttgttcttaagtggccaaatg

SEQ ID NO: 206841 - DNA, 25 bp, Mus musculus
atattttatataattggcctacagg

SEQ ID NO: 206842 - DNA, 25 bp, Mus musculus
atattttcaggtgaaccagaacagc

SEQ ID NO: 206843 - DNA, 25 bp, Mus musculus
atattttccaagcagggaccaggat

SEQ ID NO: 206844 - DNA, 25 bp, Mus musculus
atattttccaagcagttactgctga

SEQ ID NO: 206845 - DNA, 25 bp, Mus musculus
atattttctacagctctcaacctac

SEQ ID NO: 206846 - DNA, 25 bp, Mus musculus
atattttctcagcaagccccgccca

SEQ ID NO: 206847 - DNA, 25 bp, Mus musculus
atattttgaggttccatctgtccta

SEQ ID NO: 206848 - DNA, 25 bp, Mus musculus
atattttgccaaaggtgttttacat

SEQ ID NO: 206849 - DNA, 25 bp, Mus musculus
atattttgtgagttcaaaattgggg

SEQ ID NO: 206850 - DNA, 25 bp, Mus musculus
atatttttaagtaggaaaatgacag

SEQ ID NO: 206851 - DNA, 25 bp, Mus musculus
atatttttaagtgtgatcccaccag

SEQ ID NO: 206852 - DNA, 25 bp, Mus musculus
atatttttacagggaggagcctcga

SEQ ID NO: 206853 - DNA, 25 bp, Mus musculus
atatttttgaaggttaatatccttc

SEQ ID NO: 206854 - DNA, 25 bp, Mus musculus
atatttttgaagtatgcgagcattg

SEQ ID NO: 206855 - DNA, 25 bp, Mus musculus
atattttttgagacaaaagatgtat

SEQ ID NO: 206856 - DNA, 25 bp, Mus musculus
atcaaaaagacaggttagaaagctg

SEQ ID NO: 206857 - DNA, 25 bp, Mus musculus
atcaaaaagcacagaacaagcctgc

SEQ ID NO: 206858 - DNA, 25 bp, Mus musculus
atcaaaaatagccagccaagtctga

SEQ ID NO: 206859 - DNA, 25 bp, Mus musculus
atcaaaaatagccagcctgtcaaga

SEQ ID NO: 206860 - DNA, 25 bp, Mus musculus
atcaaaaatcagataacaactattc

SEQ ID NO: 206861 - DNA, 25 bp, Mus musculus
atcaaaaatcagataagaaacctga

SEQ ID NO: 206862 - DNA, 25 bp, Mus musculus
atcaaaacagaggtgcaaagaaatg

SEQ ID NO: 206863 - DNA, 25 bp, Mus musculus
atcaaaaccaaacaatttgctccta

SEQ ID NO: 206864 - DNA, 25 bp, Mus musculus
atcaaaacggaaggacctgcaatga

SEQ ID NO: 206865 - DNA, 25 bp, Mus musculus
atcaaaactactaaatggaaatgat

SEQ ID NO: 206866 - DNA, 25 bp, Mus musculus
atcaaaactagttggacacccccgc

SEQ ID NO: 206867 - DNA, 25 bp, Mus musculus
atcaaaactggaagtttggtgagcg

SEQ ID NO: 206868 - DNA, 25 bp, Mus musculus
atcaaaagaatgctgtgtctgcttc

SEQ ID NO: 206869 - DNA, 25 bp, Mus musculus
atcaaaagatcaagggtgacaggaa

SEQ ID NO: 206870 - DNA, 25 bp, Mus musculus
atcaaaagatcaaggtgatctacgt

SEQ ID NO: 206871 - DNA, 25 bp, Mus musculus
atcaaaagcaggttgtccagagcta

SEQ ID NO: 206872 - DNA, 25 bp, Mus musculus
atcaaaaggagaagaaatgcttatt

SEQ ID NO: 206873 - DNA, 25 bp, Mus musculus
atcaaaaggaggaagctggctaaga

SEQ ID NO: 206874 - DNA, 25 bp, Mus musculus
atcaaaaggatgcagaaaatgtagg

SEQ ID NO: 206875 - DNA, 25 bp, Mus musculus
atcaaaaggcctgaagcacgtaact

SEQ ID NO: 206876 - DNA, 25 bp, Mus musculus
atcaaaatcagagccagaaactccg

SEQ ID NO: 206877 - DNA, 25 bp, Mus musculus
atcaaaatcaggagatggagttcct

SEQ ID NO: 206878 - DNA, 25 bp, Mus musculus
atcaaaatcttggtggaagatgagc

SEQ ID NO: 206879 - DNA, 25 bp, Mus musculus
atcaaaatgaaaaatatggaattgc

SEQ ID NO: 206880 - DNA, 25 bp, Mus musculus
atcaaaatgaaaaatggaatgactg

SEQ ID NO: 206881 - DNA, 25 bp, Mus musculus
atcaaaattcagattgccttctccc

SEQ ID NO: 206882 - DNA, 25 bp, Mus musculus
atcaaaatttctatgaggagagagc

SEQ ID NO: 206883 - DNA, 25 bp, Mus musculus
atcaaacaggtaagctatgaaaaaa

SEQ ID NO: 206884 - DNA, 25 bp, Mus musculus
atcaaacatatgctgagaaatccat

SEQ ID NO: 206885 - DNA, 25 bp, Mus musculus
atcaaacatatggcacttcttggac

SEQ ID NO: 206886 - DNA, 25 bp, Mus musculus
atcaaacatcggaagaactctcagc

SEQ ID NO: 206887 - DNA, 25 bp, Mus musculus
atcaaacattatcagcagcgtcgcc

SEQ ID NO: 206888 - DNA, 25 bp, Mus musculus
atcaaaccaaaaggcatcatagctg

SEQ ID NO: 206889 - DNA, 25 bp, Mus musculus
atcaaaccacagctgcactggcgtc

SEQ ID NO: 206890 - DNA, 25 bp, Mus musculus
atcaaaccacagtgagaagtctgtc

SEQ ID NO: 206891 - DNA, 25 bp, Mus musculus
atcaaacccctctgtggtttctcag

SEQ ID NO: 206892 - DNA, 25 bp, Mus musculus
atcaaacctgcatgccatgatcaaa

SEQ ID NO: 206893 - DNA, 25 bp, Mus musculus
atcaaactacgaccccagcagcgac

SEQ ID NO: 206894 - DNA, 25 bp, Mus musculus
atcaaactatcaggtactctatcta

SEQ ID NO: 206895 - DNA, 25 bp, Mus musculus
atcaaactcacaagagcaaagccaa

SEQ ID NO: 206896 - DNA, 25 bp, Mus musculus
atcaaactcacaaggtatcgaagtg

SEQ ID NO: 206897 - DNA, 25 bp, Mus musculus
atcaaactctccaaggccgacgtgg

SEQ ID NO: 206898 - DNA, 25 bp, Mus musculus
atcaaagaaacccatcttcatgcgc

SEQ ID NO: 206899 - DNA, 25 bp, Mus musculus
atcaaagacagagttgactcctgag

SEQ ID NO: 206900 - DNA, 25 bp, Mus musculus
atcaaagagagaatccatggagctt

SEQ ID NO: 206901 - DNA, 25 bp, Mus musculus
atcaaagagtgcagcatcgccctga

SEQ ID NO: 206902 - DNA, 25 bp, Mus musculus
atcaaagagtgcagttttggttcta

SEQ ID NO: 206903 - DNA, 25 bp, Mus musculus
atcaaagcagtccggcatgaggatc

SEQ ID NO: 206904 - DNA, 25 bp, Mus musculus
atcaaagcattcgctatggagttac

SEQ ID NO: 206905 - DNA, 25 bp, Mus musculus
atcaaagctctgaccattcccggag

SEQ ID NO: 206906 - DNA, 25 bp, Mus musculus
atcaaagctgcagaggagcaacttt

SEQ ID NO: 206907 - DNA, 25 bp, Mus musculus
atcaaagctgcagagtttcatgatg

SEQ ID NO: 206908 - DNA, 25 bp, Mus musculus
atcaaagctggcaaggcttttgctg

SEQ ID NO: 206909 - DNA, 25 bp, Mus musculus
atcaaagctggcaaggtacggactc

SEQ ID NO: 206910 - DNA, 25 bp, Mus musculus
atcaaagctggcaaggttcgaacct

SEQ ID NO: 206911 - DNA, 25 bp, Mus musculus
atcaaaggaccatgatgatttctgg

SEQ ID NO: 206912 - DNA, 25 bp, Mus musculus
atcaaaggaccatggcatcaaccct

SEQ ID NO: 206913 - DNA, 25 bp, Mus musculus
atcaaagggatggttcaggctgtgc

SEQ ID NO: 206914 - DNA, 25 bp, Mus musculus
atcaaaggtttggcttctccagttg

SEQ ID NO: 206915 - DNA, 25 bp, Mus musculus
atcaaagtcagaagggcatcctggc

SEQ ID NO: 206916 - DNA, 25 bp, Mus musculus
atcaaagtgaaagttaatgaaatca

SEQ ID NO: 206917 - DNA, 25 bp, Mus musculus
atcaaagtgagaggttcagacagta

SEQ ID NO: 206918 - DNA, 25 bp, Mus musculus
atcaaagtgatagtggcaatccaga

SEQ ID NO: 206919 - DNA, 25 bp, Mus musculus
atcaaagtgggggatcctgcagagg

SEQ ID NO: 206920 - DNA, 25 bp, Mus musculus
atcaaatattacatgggtcattcac

SEQ ID NO: 206921 - DNA, 25 bp, Mus musculus
atcaaatccaccgccatctccctct

SEQ ID NO: 206922 - DNA, 25 bp, Mus musculus
atcaaatggcagaggtcacttttgt

SEQ ID NO: 206923 - DNA, 25 bp, Mus musculus
atcaaatggcagtatatatgttttg

SEQ ID NO: 206924 - DNA, 25 bp, Mus musculus
atcaaatgttacaggcatcaaaaag

SEQ ID NO: 206925 - DNA, 25 bp, Mus musculus
atcaaatgttacaggtcatggaaaa

SEQ ID NO: 206926 - DNA, 25 bp, Mus musculus
atcaaatttgcaccccaggggtggc

SEQ ID NO: 206927 - DNA, 25 bp, Mus musculus
atcaacaacagaaatgtgaaaaact

SEQ ID NO: 206928 - DNA, 25 bp, Mus musculus
atcaacaacgcagccactcttgggg

SEQ ID NO: 206929 - DNA, 25 bp, Mus musculus
atcaacaacgcagccctacaaaggc

SEQ ID NO: 206930 - DNA, 25 bp, Mus musculus
atcaacaagaagttaattatacccg

SEQ ID NO: 206931 - DNA, 25 bp, Mus musculus
atcaacacaccctttggggcgatgg

SEQ ID NO: 206932 - DNA, 25 bp, Mus musculus
atcaacacagactttcctgccccct

SEQ ID NO: 206933 - DNA, 25 bp, Mus musculus
atcaacacatataaggaggaatttg

SEQ ID NO: 206934 - DNA, 25 bp, Mus musculus
atcaacagagaggtgataggtgctt

SEQ ID NO: 206935 - DNA, 25 bp, Mus musculus
atcaacagagaggtttatttcctgc

SEQ ID NO: 206936 - DNA, 25 bp, Mus musculus
atcaacagagtatgtcaataggcag

SEQ ID NO: 206937 - DNA, 25 bp, Mus musculus
atcaacagggctgatatccctgtgg

SEQ ID NO: 206938 - DNA, 25 bp, Mus musculus
atcaacagtgagcaactgatggtgt

SEQ ID NO: 206939 - DNA, 25 bp, Mus musculus
atcaacatcaaagtaatcccctccc

SEQ ID NO: 206940 - DNA, 25 bp, Mus musculus
atcaaccaaaagctggcatctgacc

SEQ ID NO: 206941 - DNA, 25 bp, Mus musculus
atcaaccaacagcctcctggactgc

SEQ ID NO: 206942 - DNA, 25 bp, Mus musculus
atcaaccaagctgctcttctcagca

SEQ ID NO: 206943 - DNA, 25 bp, Mus musculus
atcaaccacccccacgacccactga

SEQ ID NO: 206944 - DNA, 25 bp, Mus musculus
atcaaccagctccaaccctttgcgg

SEQ ID NO: 206945 - DNA, 25 bp, Mus musculus
atcaaccatagggttctacagtgag

SEQ ID NO: 206946 - DNA, 25 bp, Mus musculus
atcaaccatgggaagatcccaacgc

SEQ ID NO: 206947 - DNA, 25 bp, Mus musculus
atcaacccactgggtggctttgtgc

SEQ ID NO: 206948 - DNA, 25 bp, Mus musculus
atcaaccctctcagtgtgtgacttt

SEQ ID NO: 206949 - DNA, 25 bp, Mus musculus
atcaaccctctccagcaggcacctc

SEQ ID NO: 206950 - DNA, 25 bp, Mus musculus
atcaaccctgagacagctcttcttc

SEQ ID NO: 206951 - DNA, 25 bp, Mus musculus
atcaaccctgagtgccaggaccctg

SEQ ID NO: 206952 - DNA, 25 bp, Mus musculus
atcaacctcaactgtgtgtgcaaca

SEQ ID NO: 206953 - DNA, 25 bp, Mus musculus
atcaacctgaagattacgctcgatt

SEQ ID NO: 206954 - DNA, 25 bp, Mus musculus
atcaacctgaatcagggcagcgctg

SEQ ID NO: 206955 - DNA, 25 bp, Mus musculus
atcaacgacaaggtggcccagctgc

SEQ ID NO: 206956 - DNA, 25 bp, Mus musculus
atcaacgagaggacggcctgggtcc

SEQ ID NO: 206957 - DNA, 25 bp, Mus musculus
atcaacgagcagcaagtggtggaat

SEQ ID NO: 206958 - DNA, 25 bp, Mus musculus
atcaacgccatccagggtggagctt

SEQ ID NO: 206959 - DNA, 25 bp, Mus musculus
atcaacgccatccaggtccctaagc

SEQ ID NO: 206960 - DNA, 25 bp, Mus musculus
atcaacggggagaagtactgcggtg

SEQ ID NO: 206961 - DNA, 25 bp, Mus musculus
atcaacgtgctggaacttggcacac

SEQ ID NO: 206962 - DNA, 25 bp, Mus musculus
atcaacgtgctggacctataagaac

SEQ ID NO: 206963 - DNA, 25 bp, Mus musculus
atcaactaaccaatactggagtaac

SEQ ID NO: 206964 - DNA, 25 bp, Mus musculus
atcaactacaagctgtatcttttca

SEQ ID NO: 206965 - DNA, 25 bp, Mus musculus
atcaactacaagggcccacccttca

SEQ ID NO: 206966 - DNA, 25 bp, Mus musculus
atcaactacagcgagagtctatata

SEQ ID NO: 206967 - DNA, 25 bp, Mus musculus
atcaactacgggtatttggctccca

SEQ ID NO: 206968 - DNA, 25 bp, Mus musculus
atcaactccagcagcatccacagga

SEQ ID NO: 206969 - DNA, 25 bp, Mus musculus
atcaactccagcaggtctcggacaa

SEQ ID NO: 206970 - DNA, 25 bp, Mus musculus
atcaactctcatctgttctcagcca

SEQ ID NO: 206971 - DNA, 25 bp, Mus musculus
atcaactgcagccaggctatgctgt

SEQ ID NO: 206972 - DNA, 25 bp, Mus musculus
atcaacttaggcgtgtataagtgag

SEQ ID NO: 206973 - DNA, 25 bp, Mus musculus
atcaacttcaagccctccaaccaca

SEQ ID NO: 206974 - DNA, 25 bp, Mus musculus
atcaacttcaagggccagctagaga

SEQ ID NO: 206975 - DNA, 25 bp, Mus musculus
atcaacttgaaagctatccttcacc

SEQ ID NO: 206976 - DNA, 25 bp, Mus musculus
atcaacttgaaagcttatctgagtc

SEQ ID NO: 206977 - DNA, 25 bp, Mus musculus
atcaactttccagacccagcatgta

SEQ ID NO: 206978 - DNA, 25 bp, Mus musculus
atcaactttgatgtcctagcagggc

SEQ ID NO: 206979 - DNA, 25 bp, Mus musculus
atcaagaaaagaggagcgctggccg

SEQ ID NO: 206980 - DNA, 25 bp, Mus musculus
atcaagaaactaatactctacaggc

SEQ ID NO: 206981 - DNA, 25 bp, Mus musculus
atcaagaaaggctccgtgctgccac

SEQ ID NO: 206982 - DNA, 25 bp, Mus musculus
atcaagaaagggtacacccagcagc

SEQ ID NO: 206983 - DNA, 25 bp, Mus musculus
atcaagaaatctgcccttagtgggg

SEQ ID NO: 206984 - DNA, 25 bp, Mus musculus
atcaagaagaaggacttttcccctg

SEQ ID NO: 206985 - DNA, 25 bp, Mus musculus
atcaagaagaaggattccaaggaaa

SEQ ID NO: 206986 - DNA, 25 bp, Mus musculus
atcaagaaggagctaattcgatgac

SEQ ID NO: 206987 - DNA, 25 bp, Mus musculus
atcaagaaggcgtaccgaaagaagg

SEQ ID NO: 206988 - DNA, 25 bp, Mus musculus
atcaagaatgaagtgtatcccctac

SEQ ID NO: 206989 - DNA, 25 bp, Mus musculus
atcaagaattccattatgtgagctc

SEQ ID NO: 206990 - DNA, 25 bp, Mus musculus
atcaagacccacgcaaactacagct

SEQ ID NO: 206991 - DNA, 25 bp, Mus musculus
atcaagactgccaaggttactttgg

SEQ ID NO: 206992 - DNA, 25 bp, Mus musculus
atcaagactggcaaggttactttgg

SEQ ID NO: 206993 - DNA, 25 bp, Mus musculus
atcaagagaagcccgagttcgtgag

SEQ ID NO: 206994 - DNA, 25 bp, Mus musculus
atcaagagaagcgagccagagcccc

SEQ ID NO: 206995 - DNA, 25 bp, Mus musculus
atcaagagaatcgagcctagaatac

SEQ ID NO: 206996 - DNA, 25 bp, Mus musculus
atcaagagagcaagctcatcattct

SEQ ID NO: 206997 - DNA, 25 bp, Mus musculus
atcaagagatcttctcggacctgta

SEQ ID NO: 206998 - DNA, 25 bp, Mus musculus
atcaagagatgttctcggacctgta

SEQ ID NO: 206999 - DNA, 25 bp, Mus musculus
atcaagagtcagacgaaggaagaac

SEQ ID NO: 207000 - DNA, 25 bp, Mus musculus
atcaagatctttaaaaggctactga

SEQ ID NO: 207001 - DNA, 25 bp, Mus musculus
atcaagatgactaagatgctaaaag

SEQ ID NO: 207002 - DNA, 25 bp, Mus musculus
atcaagatgatgaggctgagaaggc

SEQ ID NO: 207003 - DNA, 25 bp, Mus musculus
atcaagattatccagagtcctattg

SEQ ID NO: 207004 - DNA, 25 bp, Mus musculus
atcaagattatccagggaaaggaag

SEQ ID NO: 207005 - DNA, 25 bp, Mus musculus
atcaagcaaacccaggaagagcggt

SEQ ID NO: 207006 - DNA, 25 bp, Mus musculus
atcaagcaaacccaggagacacacc

SEQ ID NO: 207007 - DNA, 25 bp, Mus musculus
atcaagcaaacccagttgagcaaaa

SEQ ID NO: 207008 - DNA, 25 bp, Mus musculus
atcaagcaccttggacaaagtctcg

SEQ ID NO: 207009 - DNA, 25 bp, Mus musculus
atcaagcacggcacagtttgtcttc

SEQ ID NO: 207010 - DNA, 25 bp, Mus musculus
atcaagcagaaaatgagtccactcg

SEQ ID NO: 207011 - DNA, 25 bp, Mus musculus
atcaagcaggagccatgcagtggtg

SEQ ID NO: 207012 - DNA, 25 bp, Mus musculus
atcaagccagagagccctggcacaa

SEQ ID NO: 207013 - DNA, 25 bp, Mus musculus
atcaagccagagagtgctcaacctc

SEQ ID NO: 207014 - DNA, 25 bp, Mus musculus
atcaagcctcagcagggatcacatg

SEQ ID NO: 207015 - DNA, 25 bp, Mus musculus
atcaagcctggtacttgctacagcc

SEQ ID NO: 207016 - DNA, 25 bp, Mus musculus
atcaagcgactgctctttacagccg

SEQ ID NO: 207017 - DNA, 25 bp, Mus musculus
atcaagcgactgtttagctttttct

SEQ ID NO: 207018 - DNA, 25 bp, Mus musculus
atcaagcgacttaaagaaggtcctt

SEQ ID NO: 207019 - DNA, 25 bp, Mus musculus
atcaagcgagactccctccaaccct

SEQ ID NO: 207020 - DNA, 25 bp, Mus musculus
atcaagcgagatggccgccaagagc

SEQ ID NO: 207021 - DNA, 25 bp, Mus musculus
atcaagcgcaaaggaaaatgactca

SEQ ID NO: 207022 - DNA, 25 bp, Mus musculus
atcaagcgcaaagggcccacatggt

SEQ ID NO: 207023 - DNA, 25 bp, Mus musculus
atcaagcgcagcgggagaacagtta

SEQ ID NO: 207024 - DNA, 25 bp, Mus musculus
atcaagcgcgccctggccaacagcc

SEQ ID NO: 207025 - DNA, 25 bp, Mus musculus
atcaagcgctctacaggggaggtgg

SEQ ID NO: 207026 - DNA, 25 bp, Mus musculus
atcaagcggccagggacgatccgta

SEQ ID NO: 207027 - DNA, 25 bp, Mus musculus
atcaagcggccagggagagacgaca

SEQ ID NO: 207028 - DNA, 25 bp, Mus musculus
atcaagcgggcagagatgaacgggc

SEQ ID NO: 207029 - DNA, 25 bp, Mus musculus
atcaagcgggcagagtctgctcatt

SEQ ID NO: 207030 - DNA, 25 bp, Mus musculus
atcaagcgggcagagttttatcttt

SEQ ID NO: 207031 - DNA, 25 bp, Mus musculus
atcaagctacagatatgggacacag

SEQ ID NO: 207032 - DNA, 25 bp, Mus musculus
atcaaggaacaagctagtggggtag

SEQ ID NO: 207033 - DNA, 25 bp, Mus musculus
atcaaggacctccaggacctcaggg

SEQ ID NO: 207034 - DNA, 25 bp, Mus musculus
atcaaggagcaggacatcaacaagg

SEQ ID NO: 207035 - DNA, 25 bp, Mus musculus
atcaaggagctcccctcccacccac

SEQ ID NO: 207036 - DNA, 25 bp, Mus musculus
atcaaggatatcgacgtgatcatgg

SEQ ID NO: 207037 - DNA, 25 bp, Mus musculus
atcaaggcaaaattggaaagagaac

SEQ ID NO: 207038 - DNA, 25 bp, Mus musculus
atcaaggcaaaattgtctgtccact

SEQ ID NO: 207039 - DNA, 25 bp, Mus musculus
atcaaggcacaggatctagataaaa

SEQ ID NO: 207040 - DNA, 25 bp, Mus musculus
atcaaggcagagtgctcgatccgac

SEQ ID NO: 207041 - DNA, 25 bp, Mus musculus
atcaaggccaaggccaacctggaga

SEQ ID NO: 207042 - DNA, 25 bp, Mus musculus
atcaaggccctcagattgacaagga

SEQ ID NO: 207043 - DNA, 25 bp, Mus musculus
atcaaggccgttcggaaggctgtgg

SEQ ID NO: 207044 - DNA, 25 bp, Mus musculus
atcaaggcctcaggtggagccagtg

SEQ ID NO: 207045 - DNA, 25 bp, Mus musculus
atcaagggcatccaccacggcccca

SEQ ID NO: 207046 - DNA, 25 bp, Mus musculus
atcaaggtagaggcccctaacagct

SEQ ID NO: 207047 - DNA, 25 bp, Mus musculus
atcaaggtcagatctataccttcct

SEQ ID NO: 207048 - DNA, 25 bp, Mus musculus
atcaaggtctggatattgaagtaat

SEQ ID NO: 207049 - DNA, 25 bp, Mus musculus
atcaaggtctggtgagaagctggat

SEQ ID NO: 207050 - DNA, 25 bp, Mus musculus
atcaagtagcaatgaaggggtagag

SEQ ID NO: 207051 - DNA, 25 bp, Mus musculus
atcaagtcaggctcagatgaggtgc

SEQ ID NO: 207052 - DNA, 25 bp, Mus musculus
atcaagtccagaagaaatattatgg

SEQ ID NO: 207053 - DNA, 25 bp, Mus musculus
atcaagtgaccatgcaagcgtattt

SEQ ID NO: 207054 - DNA, 25 bp, Mus musculus
atcaagtgaccatggaagcgtattt

SEQ ID NO: 207055 - DNA, 25 bp, Mus musculus
atcaagtgaggaatctgaggaagct

SEQ ID NO: 207056 - DNA, 25 bp, Mus musculus
atcaagtgcctcagggcaccaccgt

SEQ ID NO: 207057 - DNA, 25 bp, Mus musculus
atcaagttactcaggggtggatgag

SEQ ID NO: 207058 - DNA, 25 bp, Mus musculus
atcaagttctcagatgaatatctga

SEQ ID NO: 207059 - DNA, 25 bp, Mus musculus
atcaataaagagcaggtgtcacaac

SEQ ID NO: 207060 - DNA, 25 bp, Mus musculus
atcaataaattaaagcaagcctgtg

SEQ ID NO: 207061 - DNA, 25 bp, Mus musculus
atcaataatgacaccacctactgca

SEQ ID NO: 207062 - DNA, 25 bp, Mus musculus
atcaatacagatcagggagcctttg

SEQ ID NO: 207063 - DNA, 25 bp, Mus musculus
atcaatacagggtctgtgatggtga

SEQ ID NO: 207064 - DNA, 25 bp, Mus musculus
atcaatacctggagcacacatccat

SEQ ID NO: 207065 - DNA, 25 bp, Mus musculus
atcaatacctggagtgtctggtcct

SEQ ID NO: 207066 - DNA, 25 bp, Mus musculus
atcaatagtcaaggtgaatatgaag

SEQ ID NO: 207067 - DNA, 25 bp, Mus musculus
atcaatatagcacagaacctatcaa

SEQ ID NO: 207068 - DNA, 25 bp, Mus musculus
atcaatatcacagaaaagtgtgtaa

SEQ ID NO: 207069 - DNA, 25 bp, Mus musculus
atcaatatcacgaggacaaagataa

SEQ ID NO: 207070 - DNA, 25 bp, Mus musculus
atcaatatgagtggtactgcagaaa

SEQ ID NO: 207071 - DNA, 25 bp, Mus musculus
atcaatcaagatgactgtgatgagc

SEQ ID NO: 207072 - DNA, 25 bp, Mus musculus
atcaatcaatctatctacctatcta

SEQ ID NO: 207073 - DNA, 25 bp, Mus musculus
atcaatcccagggctccgggatctg

SEQ ID NO: 207074 - DNA, 25 bp, Mus musculus
atcaatcccatgcagctcggggtct

SEQ ID NO: 207075 - DNA, 25 bp, Mus musculus
atcaatcccccaatgtgccttcagg

SEQ ID NO: 207076 - DNA, 25 bp, Mus musculus
atcaatctagaaggtggtgacattc

SEQ ID NO: 207077 - DNA, 25 bp, Mus musculus
atcaatctgcagaagcggcctctgg

SEQ ID NO: 207078 - DNA, 25 bp, Mus musculus
atcaatgacaacttcatcgactgct

SEQ ID NO: 207079 - DNA, 25 bp, Mus musculus
atcaatgacactgaggtcgcatcaa

SEQ ID NO: 207080 - DNA, 25 bp, Mus musculus
atcaatgaccaatatgagaaagttt

SEQ ID NO: 207081 - DNA, 25 bp, Mus musculus
atcaatgacccgctgttcattcctt

SEQ ID NO: 207082 - DNA, 25 bp, Mus musculus
atcaatgactttaaggaggccacgc

SEQ ID NO: 207083 - DNA, 25 bp, Mus musculus
atcaatgcaggaaaggaaacagtta

SEQ ID NO: 207084 - DNA, 25 bp, Mus musculus
atcaatgccaaccgtcctgggctcc

SEQ ID NO: 207085 - DNA, 25 bp, Mus musculus
atcaatgccagtcccatcccatccc

SEQ ID NO: 207086 - DNA, 25 bp, Mus musculus
atcaatgcgtacagtagcatccggg

SEQ ID NO: 207087 - DNA, 25 bp, Mus musculus
atcaatgctgaagaaagcgaaatcc

SEQ ID NO: 207088 - DNA, 25 bp, Mus musculus
atcaatgctttgaatttaaaatctg

SEQ ID NO: 207089 - DNA, 25 bp, Mus musculus
atcaatgctttgttcacagaggcga

SEQ ID NO: 207090 - DNA, 25 bp, Mus musculus
atcaatggcgtgatccaggaagccc

SEQ ID NO: 207091 - DNA, 25 bp, Mus musculus
atcaatggctatgttggaaatataa

SEQ ID NO: 207092 - DNA, 25 bp, Mus musculus
atcaatgggtcccttttgcagtctg

SEQ ID NO: 207093 - DNA, 25 bp, Mus musculus
atcaatggtcgaattcgccgcatgt

SEQ ID NO: 207094 - DNA, 25 bp, Mus musculus
atcaatgtgccaatattcaaggaca

SEQ ID NO: 207095 - DNA, 25 bp, Mus musculus
atcaatgtggagaatgcatttttca

SEQ ID NO: 207096 - DNA, 25 bp, Mus musculus
atcaatgtgttccttgcccagtctc

SEQ ID NO: 207097 - DNA, 25 bp, Mus musculus
atcaatgttaagggatcgcttacac

SEQ ID NO: 207098 - DNA, 25 bp, Mus musculus
atcaatgttggccccacgggtacct

SEQ ID NO: 207099 - DNA, 25 bp, Mus musculus
atcaatgttggtgggcttccaccac

SEQ ID NO: 207100 - DNA, 25 bp, Mus musculus
atcaatgttggtggtggcttccacc

SEQ ID NO: 207101 - DNA, 25 bp, Mus musculus
atcaattacatcaagaagtccaagg

SEQ ID NO: 207102 - DNA, 25 bp, Mus musculus
atcaattactacaagggccagtata

SEQ ID NO: 207103 - DNA, 25 bp, Mus musculus
atcaattcaggaggaaacagttgct

SEQ ID NO: 207104 - DNA, 25 bp, Mus musculus
atcaattgccagtctgcaagccaga

SEQ ID NO: 207105 - DNA, 25 bp, Mus musculus
atcaattttcaggaatgggacggct

SEQ ID NO: 207106 - DNA, 25 bp, Mus musculus
atcaattttcaggtaataccagaag

SEQ ID NO: 207107 - DNA, 25 bp, Mus musculus
atcacaaaaatataattggcctttt

SEQ ID NO: 207108 - DNA, 25 bp, Mus musculus
atcacaaaagctgcatagactcatg

SEQ ID NO: 207109 - DNA, 25 bp, Mus musculus
atcacaaacacagacattcccagct

SEQ ID NO: 207110 - DNA, 25 bp, Mus musculus
atcacaaacacagaggagcttaatt

SEQ ID NO: 207111 - DNA, 25 bp, Mus musculus
atcacaaagtccaagaactgatgtc

SEQ ID NO: 207112 - DNA, 25 bp, Mus musculus
atcacaaagtccaagattgcgctgg

SEQ ID NO: 207113 - DNA, 25 bp, Mus musculus
atcacaacaagattgaggaagacac

SEQ ID NO: 207114 - DNA, 25 bp, Mus musculus
atcacaacaaggcccatctgctcaa

SEQ ID NO: 207115 - DNA, 25 bp, Mus musculus
atcacaacccagttcccacttggac

SEQ ID NO: 207116 - DNA, 25 bp, Mus musculus
atcacaacccctgaccataggtcaa

SEQ ID NO: 207117 - DNA, 25 bp, Mus musculus
atcacaacccctgggtggagtttac

SEQ ID NO: 207118 - DNA, 25 bp, Mus musculus
atcacaaggtctgatactcttggtc

SEQ ID NO: 207119 - DNA, 25 bp, Mus musculus
atcacaagtgtgtctcaaaagattc

SEQ ID NO: 207120 - DNA, 25 bp, Mus musculus
atcacaatagggcgctctgcctcac

SEQ ID NO: 207121 - DNA, 25 bp, Mus musculus
atcacaatagggcggctatcctacc

SEQ ID NO: 207122 - DNA, 25 bp, Mus musculus
atcacaatagggcggttatgggtgc

SEQ ID NO: 207123 - DNA, 25 bp, Mus musculus
atcacaatagggcggtttatctgag

SEQ ID NO: 207124 - DNA, 25 bp, Mus musculus
atcacacaaaaattccagaggttgg

SEQ ID NO: 207125 - DNA, 25 bp, Mus musculus
atcacacaaagacccacagttatca

SEQ ID NO: 207126 - DNA, 25 bp, Mus musculus
atcacacaacccaggtggatcccac

SEQ ID NO: 207127 - DNA, 25 bp, Mus musculus
atcacacacacttccttcccatcct

SEQ ID NO: 207128 - DNA, 25 bp, Mus musculus
atcacacacagatctcagtaagagc

SEQ ID NO: 207129 - DNA, 25 bp, Mus musculus
atcacaccacagggctatgagaagt

SEQ ID NO: 207130 - DNA, 25 bp, Mus musculus
atcacaccacaggtcccaggagaaa

SEQ ID NO: 207131 - DNA, 25 bp, Mus musculus
atcacaccacagttgctaagggtac

SEQ ID NO: 207132 - DNA, 25 bp, Mus musculus
atcacaccagatgctgccagccctg

SEQ ID NO: 207133 - DNA, 25 bp, Mus musculus
atcacaccagggagcaggatcaccc

SEQ ID NO: 207134 - DNA, 25 bp, Mus musculus
atcacaccatagatgaccactgtgt

SEQ ID NO: 207135 - DNA, 25 bp, Mus musculus
atcacactattgggatggaagactg

SEQ ID NO: 207136 - DNA, 25 bp, Mus musculus
atcacactattggtcctgagttcaa

SEQ ID NO: 207137 - DNA, 25 bp, Mus musculus
atcacactggccaatgactgtgagg

SEQ ID NO: 207138 - DNA, 25 bp, Mus musculus
atcacactgttgaagagaaggagga

SEQ ID NO: 207139 - DNA, 25 bp, Mus musculus
atcacacttacgaagatggctctga

SEQ ID NO: 207140 - DNA, 25 bp, Mus musculus
atcacagaaaagaaccggcactgtc

SEQ ID NO: 207141 - DNA, 25 bp, Mus musculus
atcacagaaaagggaacagagagac

SEQ ID NO: 207142 - DNA, 25 bp, Mus musculus
atcacagaacttgacgtcagggccg

SEQ ID NO: 207143 - DNA, 25 bp, Mus musculus
atcacagaacttgtgcaggtgttct

SEQ ID NO: 207144 - DNA, 25 bp, Mus musculus
atcacagaaggtccctagcaggaga

SEQ ID NO: 207145 - DNA, 25 bp, Mus musculus
atcacagatggcctgcaatgcctct

SEQ ID NO: 207146 - DNA, 25 bp, Mus musculus
atcacagcacaggaggaagcaaggg

SEQ ID NO: 207147 - DNA, 25 bp, Mus musculus
atcacagccaggaagtcacctgggc

SEQ ID NO: 207148 - DNA, 25 bp, Mus musculus
atcacagcctggcaccctcctgccc

SEQ ID NO: 207149 - DNA, 25 bp, Mus musculus
atcacagcctgtaaaaagaacccgg

SEQ ID NO: 207150 - DNA, 25 bp, Mus musculus
atcacagctctacctaggattcgag

SEQ ID NO: 207151 - DNA, 25 bp, Mus musculus
atcacaggacggaaagcgaatggac

SEQ ID NO: 207152 - DNA, 25 bp, Mus musculus
atcacaggactcaagtcctccacag

SEQ ID NO: 207153 - DNA, 25 bp, Mus musculus
atcacaggagcatctcaatgggaga

SEQ ID NO: 207154 - DNA, 25 bp, Mus musculus
atcacaggatcagaggtcaccttcc

SEQ ID NO: 207155 - DNA, 25 bp, Mus musculus
atcacaggcaagaaggagaggaata

SEQ ID NO: 207156 - DNA, 25 bp, Mus musculus
atcacaggcctgcagacatttttag

SEQ ID NO: 207157 - DNA, 25 bp, Mus musculus
atcacaggcctgcagccaggtgatt

SEQ ID NO: 207158 - DNA, 25 bp, Mus musculus
atcacagggcacccatgcatcagca

SEQ ID NO: 207159 - DNA, 25 bp, Mus musculus
atcacagtgacagggcccaatgtaa

SEQ ID NO: 207160 - DNA, 25 bp, Mus musculus
atcacagtgtcccaggtccctgtgg

SEQ ID NO: 207161 - DNA, 25 bp, Mus musculus
atcacagtgtcccaggtctctaact

SEQ ID NO: 207162 - DNA, 25 bp, Mus musculus
atcacagttgtctacgtcacagagc

SEQ ID NO: 207163 - DNA, 25 bp, Mus musculus
atcacagtttaggaactggtatgtg

SEQ ID NO: 207164 - DNA, 25 bp, Mus musculus
atcacagtttagtggctgacctact

SEQ ID NO: 207165 - DNA, 25 bp, Mus musculus
atcacatacacgatattgatgagtg

SEQ ID NO: 207166 - DNA, 25 bp, Mus musculus
atcacatacacgcaatgcaccgatg

SEQ ID NO: 207167 - DNA, 25 bp, Mus musculus
atcacataggctatgggcacgtgcg

SEQ ID NO: 207168 - DNA, 25 bp, Mus musculus
atcacatatacgcagtactccggag

SEQ ID NO: 207169 - DNA, 25 bp, Mus musculus
atcacatcaggtgacagagttagtc

SEQ ID NO: 207170 - DNA, 25 bp, Mus musculus
atcacatccgctgcgagcctgcgga

SEQ ID NO: 207171 - DNA, 25 bp, Mus musculus
atcacatcctgtgtggaccagcaga

SEQ ID NO: 207172 - DNA, 25 bp, Mus musculus
atcacatctcacagactgtggatat

SEQ ID NO: 207173 - DNA, 25 bp, Mus musculus
atcacatgatggagcctcaaggcat

SEQ ID NO: 207174 - DNA, 25 bp, Mus musculus
atcacatggatgaaaaaaaggacct

SEQ ID NO: 207175 - DNA, 25 bp, Mus musculus
atcacatggatggtgttctcgggac

SEQ ID NO: 207176 - DNA, 25 bp, Mus musculus
atcacatgtatgtctctgcccttcc

SEQ ID NO: 207177 - DNA, 25 bp, Mus musculus
atcacattaaagtttcactagaaga

SEQ ID NO: 207178 - DNA, 25 bp, Mus musculus
atcacattcataaaggtcagaaggc

SEQ ID NO: 207179 - DNA, 25 bp, Mus musculus
atcacattcataaaggtctagaggg

SEQ ID NO: 207180 - DNA, 25 bp, Mus musculus
atcacattggcgtcttctgggacct

SEQ ID NO: 207181 - DNA, 25 bp, Mus musculus
atcaccaaacagacaccaacttttt

SEQ ID NO: 207182 - DNA, 25 bp, Mus musculus
atcaccaaagccccccatcaacact

SEQ ID NO: 207183 - DNA, 25 bp, Mus musculus
atcaccaaagctgaaaggggtctgc

SEQ ID NO: 207184 - DNA, 25 bp, Mus musculus
atcaccaaagtcctgaaggggaaga

SEQ ID NO: 207185 - DNA, 25 bp, Mus musculus
atcaccaactttccaagattacctt

SEQ ID NO: 207186 - DNA, 25 bp, Mus musculus
atcaccaaggccagcttttcctaga

SEQ ID NO: 207187 - DNA, 25 bp, Mus musculus
atcaccacagacagatgccctttga

SEQ ID NO: 207188 - DNA, 25 bp, Mus musculus
atcaccacagtttcgttatcagcac

SEQ ID NO: 207189 - DNA, 25 bp, Mus musculus
atcaccaccaaaggggagcgaggac

SEQ ID NO: 207190 - DNA, 25 bp, Mus musculus
atcaccaccacataagattgtctca

SEQ ID NO: 207191 - DNA, 25 bp, Mus musculus
atcaccaccatcggctatggtcatg

SEQ ID NO: 207192 - DNA, 25 bp, Mus musculus
atcaccacgaaaatctccttcgggc

SEQ ID NO: 207193 - DNA, 25 bp, Mus musculus
atcaccacgatcagagtgatgtgca

SEQ ID NO: 207194 - DNA, 25 bp, Mus musculus
atcaccagaagacaagactggcagg

SEQ ID NO: 207195 - DNA, 25 bp, Mus musculus
atcaccagcagtgcccggggtctgg

SEQ ID NO: 207196 - DNA, 25 bp, Mus musculus
atcaccagccaccatcgagacacag

SEQ ID NO: 207197 - DNA, 25 bp, Mus musculus
atcaccagccagtgtggggcaggca

SEQ ID NO: 207198 - DNA, 25 bp, Mus musculus
atcaccagcgcgaaggtgatgctag

SEQ ID NO: 207199 - DNA, 25 bp, Mus musculus
atcaccaggagctcggacggcgccc

SEQ ID NO: 207200 - DNA, 25 bp, Mus musculus
atcaccaggagctctcctcccaagg

SEQ ID NO: 207201 - DNA, 25 bp, Mus musculus
atcaccaggagtatgcttgagagtt

SEQ ID NO: 207202 - DNA, 25 bp, Mus musculus
atcaccaggcagttgcccatggagg

SEQ ID NO: 207203 - DNA, 25 bp, Mus musculus
atcaccaggtgtttcagggctacca

SEQ ID NO: 207204 - DNA, 25 bp, Mus musculus
atcaccagtgaggagattccccccc

SEQ ID NO: 207205 - DNA, 25 bp, Mus musculus
atcaccatcaatgagatcagtgaaa

SEQ ID NO: 207206 - DNA, 25 bp, Mus musculus
atcaccatgatctgtgccattgcca

SEQ ID NO: 207207 - DNA, 25 bp, Mus musculus
atcaccattaaggactctgcaggac

SEQ ID NO: 207208 - DNA, 25 bp, Mus musculus
atcaccattaaggactgcaggctgt

SEQ ID NO: 207209 - DNA, 25 bp, Mus musculus
atcaccattaaggacttcctgaaga

SEQ ID NO: 207210 - DNA, 25 bp, Mus musculus
atcaccattggcaagggcacagtca

SEQ ID NO: 207211 - DNA, 25 bp, Mus musculus
atcaccatttgcagaggcaggcagg

SEQ ID NO: 207212 - DNA, 25 bp, Mus musculus
atcacccaaacatagtgaagttgtt

SEQ ID NO: 207213 - DNA, 25 bp, Mus musculus
atcacccaagagcagagagatcatc

SEQ ID NO: 207214 - DNA, 25 bp, Mus musculus
atcacccaaggttcagacaatgaat

SEQ ID NO: 207215 - DNA, 25 bp, Mus musculus
atcacccacgtctcttcaacagact

SEQ ID NO: 207216 - DNA, 25 bp, Mus musculus
atcacccagacaagggaggatctcc

SEQ ID NO: 207217 - DNA, 25 bp, Mus musculus
atcacccagacaagggccctctggt

SEQ ID NO: 207218 - DNA, 25 bp, Mus musculus
atcacccaggctgccggaaccagct

SEQ ID NO: 207219 - DNA, 25 bp, Mus musculus
atcaccccagaagagggctacaggg

SEQ ID NO: 207220 - DNA, 25 bp, Mus musculus
atcaccccagaagagtttgtggcag

SEQ ID NO: 207221 - DNA, 25 bp, Mus musculus
atcaccccagaggtgtggccaaacg

SEQ ID NO: 207222 - DNA, 25 bp, Mus musculus
atcaccccatcggtgtagcccggat

SEQ ID NO: 207223 - DNA, 25 bp, Mus musculus
atcacccccgccactggcttggcat

SEQ ID NO: 207224 - DNA, 25 bp, Mus musculus
atcacccccggtggtgaagggcaga

SEQ ID NO: 207225 - DNA, 25 bp, Mus musculus
atcacccccgtgctccccctgcagg

SEQ ID NO: 207226 - DNA, 25 bp, Mus musculus
atcacccggactcagatcatcttta

SEQ ID NO: 207227 - DNA, 25 bp, Mus musculus
atcaccctcaggaggagaatgaaat

SEQ ID NO: 207228 - DNA, 25 bp, Mus musculus
atcaccctcagtttgtgcttgtcct

SEQ ID NO: 207229 - DNA, 25 bp, Mus musculus
atcaccctgacctgcaactcctcac

SEQ ID NO: 207230 - DNA, 25 bp, Mus musculus
atcaccctggagacgactctagaga

SEQ ID NO: 207231 - DNA, 25 bp, Mus musculus
atcacccttccctgagacaatgtct

SEQ ID NO: 207232 - DNA, 25 bp, Mus musculus
atcacccttccctggaaaatctgga

SEQ ID NO: 207233 - DNA, 25 bp, Mus musculus
atcacccttcttagtatcctttagc

SEQ ID NO: 207234 - DNA, 25 bp, Mus musculus
atcacccttcttagtgggtcctgtg

SEQ ID NO: 207235 - DNA, 25 bp, Mus musculus
atcacccttgcagcatacgaaggac

SEQ ID NO: 207236 - DNA, 25 bp, Mus musculus
atcaccgactcagacagagtctttc

SEQ ID NO: 207237 - DNA, 25 bp, Mus musculus
atcaccgactcagctgactcaagag

SEQ ID NO: 207238 - DNA, 25 bp, Mus musculus
atcaccgcactgattttggctctgg

SEQ ID NO: 207239 - DNA, 25 bp, Mus musculus
atcaccgcactgcttcaggacccca

SEQ ID NO: 207240 - DNA, 25 bp, Mus musculus
atcaccgcggtgggtgatgtcttcc

SEQ ID NO: 207241 - DNA, 25 bp, Mus musculus
atcaccggcgaggagtctgcaggtg

SEQ ID NO: 207242 - DNA, 25 bp, Mus musculus
atcaccgtcacagagccccctgtgc

SEQ ID NO: 207243 - DNA, 25 bp, Mus musculus
atcaccgtcacagagtcataccaaa

SEQ ID NO: 207244 - DNA, 25 bp, Mus musculus
atcaccgtccagatccccaccctca

SEQ ID NO: 207245 - DNA, 25 bp, Mus musculus
atcaccgtccaggtctgggtggcca

SEQ ID NO: 207246 - DNA, 25 bp, Mus musculus
atcaccgtgagcaagtgtgggaccc

SEQ ID NO: 207247 - DNA, 25 bp, Mus musculus
atcacctacatccgcaggctgctgg

SEQ ID NO: 207248 - DNA, 25 bp, Mus musculus
atcacctacatcctcctgagcggag

SEQ ID NO: 207249 - DNA, 25 bp, Mus musculus
atcacctacgggccctatgccgtca

SEQ ID NO: 207250 - DNA, 25 bp, Mus musculus
atcacctatgacgagtccatgctgg

SEQ ID NO: 207251 - DNA, 25 bp, Mus musculus
atcacctatgagacactaaagtaca

SEQ ID NO: 207252 - DNA, 25 bp, Mus musculus
atcacctatgagagcggagaagctg

SEQ ID NO: 207253 - DNA, 25 bp, Mus musculus
atcacctatgagatggtagaagaga

SEQ ID NO: 207254 - DNA, 25 bp, Mus musculus
atcacctcagaggatacaagcagca

SEQ ID NO: 207255 - DNA, 25 bp, Mus musculus
atcacctcatgcagaaggtgattac

SEQ ID NO: 207256 - DNA, 25 bp, Mus musculus
atcacctcatgcaggagtatgcaaa

SEQ ID NO: 207257 - DNA, 25 bp, Mus musculus
atcacctccagaacaatgagcttct

SEQ ID NO: 207258 - DNA, 25 bp, Mus musculus
atcacctccagctaattgccttgtt

SEQ ID NO: 207259 - DNA, 25 bp, Mus musculus
atcacctcggtgcaggctatctatg

SEQ ID NO: 207260 - DNA, 25 bp, Mus musculus
atcacctctaagagacgtggagcta

SEQ ID NO: 207261 - DNA, 25 bp, Mus musculus
atcacctctggaacttagcccagca

SEQ ID NO: 207262 - DNA, 25 bp, Mus musculus
atcacctgagggccaacgaggtgac

SEQ ID NO: 207263 - DNA, 25 bp, Mus musculus
atcacctggaagaaggtcaagcact

SEQ ID NO: 207264 - DNA, 25 bp, Mus musculus
atcacctggaagaagtgcatgcttt

SEQ ID NO: 207265 - DNA, 25 bp, Mus musculus
atcacctggacaagcctccattaac

SEQ ID NO: 207266 - DNA, 25 bp, Mus musculus
atcacctggacaagctgatgccttc

SEQ ID NO: 207267 - DNA, 25 bp, Mus musculus
atcaccttaacgctgttggtcagaa

SEQ ID NO: 207268 - DNA, 25 bp, Mus musculus
atcaccttccagaactctgcagccc

SEQ ID NO: 207269 - DNA, 25 bp, Mus musculus
atcaccttccagactcagaactttc

SEQ ID NO: 207270 - DNA, 25 bp, Mus musculus
atcaccttccaggctcaaactacca

SEQ ID NO: 207271 - DNA, 25 bp, Mus musculus
atcaccttggatggcaaggtcagcc

SEQ ID NO: 207272 - DNA, 25 bp, Mus musculus
atcacgaactacaggaagagagagt

SEQ ID NO: 207273 - DNA, 25 bp, Mus musculus
atcacgaagcacagctgtgacgagc

SEQ ID NO: 207274 - DNA, 25 bp, Mus musculus
atcacgacagcctgcctggccccca

SEQ ID NO: 207275 - DNA, 25 bp, Mus musculus
atcacgagaagaagagctgaagggt

SEQ ID NO: 207276 - DNA, 25 bp, Mus musculus
atcacgagaagaaggtgatggatgg

SEQ ID NO: 207277 - DNA, 25 bp, Mus musculus
atcacgagtttcaggctccatttgg

SEQ ID NO: 207278 - DNA, 25 bp, Mus musculus
atcacgcaaggcatcccgaggtcct

SEQ ID NO: 207279 - DNA, 25 bp, Mus musculus
atcacgcagtgtggcttgacctcag

SEQ ID NO: 207280 - DNA, 25 bp, Mus musculus
atcacgcgcctctgtaaaacccaga

SEQ ID NO: 207281 - DNA, 25 bp, Mus musculus
atcacgctgcatgaactggagaatt

SEQ ID NO: 207282 - DNA, 25 bp, Mus musculus
atcacggaactcgctaagccgggca

SEQ ID NO: 207283 - DNA, 25 bp, Mus musculus
atcacggaactcgtgaatgatacca

SEQ ID NO: 207284 - DNA, 25 bp, Mus musculus
atcacggaaggtgtctcagacataa

SEQ ID NO: 207285 - DNA, 25 bp, Mus musculus
atcacggcagatggcagtgaaattc

SEQ ID NO: 207286 - DNA, 25 bp, Mus musculus
atcacggccctcccagagccgtact

SEQ ID NO: 207287 - DNA, 25 bp, Mus musculus
atcacgggacaaggtcccatctgca

SEQ ID NO: 207288 - DNA, 25 bp, Mus musculus
atcacgggacaagttaattcaggac

SEQ ID NO: 207289 - DNA, 25 bp, Mus musculus
atcacgggccagctggctctggaat

SEQ ID NO: 207290 - DNA, 25 bp, Mus musculus
atcacggtacccttatttgaccaga

SEQ ID NO: 207291 - DNA, 25 bp, Mus musculus
atcacgtccaagaatttcacccacc

SEQ ID NO: 207292 - DNA, 25 bp, Mus musculus
atcacgtccaaggtggctgtgcctg

SEQ ID NO: 207293 - DNA, 25 bp, Mus musculus
atcacgtctgtgaagatcactgtta

SEQ ID NO: 207294 - DNA, 25 bp, Mus musculus
atcacgtgcagcacctggccacatt

SEQ ID NO: 207295 - DNA, 25 bp, Mus musculus
atcacgtgcagggtctttcaggtta

SEQ ID NO: 207296 - DNA, 25 bp, Mus musculus
atcactaaaagaagtgctcagagtt

SEQ ID NO: 207297 - DNA, 25 bp, Mus musculus
atcactaaggcaaagattattggat

SEQ ID NO: 207298 - DNA, 25 bp, Mus musculus
atcactaataaagaagtgtgctggt

SEQ ID NO: 207299 - DNA, 25 bp, Mus musculus
atcactacataagcgaagctctggg

SEQ ID NO: 207300 - DNA, 25 bp, Mus musculus
atcactaccatcggctatggcaata

SEQ ID NO: 207301 - DNA, 25 bp, Mus musculus
atcactactggggaaacaggcactt

SEQ ID NO: 207302 - DNA, 25 bp, Mus musculus
atcactactgtggtcgtgcagactt

SEQ ID NO: 207303 - DNA, 25 bp, Mus musculus
atcactagaggtcgatcgcgatcgg

SEQ ID NO: 207304 - DNA, 25 bp, Mus musculus
atcactaggaagggtgagtggggca

SEQ ID NO: 207305 - DNA, 25 bp, Mus musculus
atcactataaagggagttggaaaga

SEQ ID NO: 207306 - DNA, 25 bp, Mus musculus
atcactataaaggggtgctggtgtt

SEQ ID NO: 207307 - DNA, 25 bp, Mus musculus
atcactatgatgcctgttcctgcca

SEQ ID NO: 207308 - DNA, 25 bp, Mus musculus
atcactcaaggagaagctgtgtgag

SEQ ID NO: 207309 - DNA, 25 bp, Mus musculus
atcactcacgagctctttgacatct

SEQ ID NO: 207310 - DNA, 25 bp, Mus musculus
atcactcaggagaagccctcgaagg

SEQ ID NO: 207311 - DNA, 25 bp, Mus musculus
atcactcaggaggttctgacgggaa

SEQ ID NO: 207312 - DNA, 25 bp, Mus musculus
atcactcaggagttgcagctccacc

SEQ ID NO: 207313 - DNA, 25 bp, Mus musculus
atcactcagtgcatgaggaagcagc

SEQ ID NO: 207314 - DNA, 25 bp, Mus musculus
atcactccccagccgtgggaatggt

SEQ ID NO: 207315 - DNA, 25 bp, Mus musculus
atcactcccccgcacttctagacag

SEQ ID NO: 207316 - DNA, 25 bp, Mus musculus
atcactccgacacctcctgcccctc

SEQ ID NO: 207317 - DNA, 25 bp, Mus musculus
atcactcctaagcaccaaggaaccc

SEQ ID NO: 207318 - DNA, 25 bp, Mus musculus
atcactcctaagcggttaatttcta

SEQ ID NO: 207319 - DNA, 25 bp, Mus musculus
atcactcgagcttctagggacctat

SEQ ID NO: 207320 - DNA, 25 bp, Mus musculus
atcactctcaacctgctgtcgctac

SEQ ID NO: 207321 - DNA, 25 bp, Mus musculus
atcactctcagtcaggtttggacgt

SEQ ID NO: 207322 - DNA, 25 bp, Mus musculus
atcactctccggatgttgggaagtc

SEQ ID NO: 207323 - DNA, 25 bp, Mus musculus
atcactctgttcagtgaacctaaca

SEQ ID NO: 207324 - DNA, 25 bp, Mus musculus
atcactgaaaaatgtagttcctaat

SEQ ID NO: 207325 - DNA, 25 bp, Mus musculus
atcactgacaagcaaggaaagactg

SEQ ID NO: 207326 - DNA, 25 bp, Mus musculus
atcactgacggacagatcttcttgg

SEQ ID NO: 207327 - DNA, 25 bp, Mus musculus
atcactgactacaggcactggcaga

SEQ ID NO: 207328 - DNA, 25 bp, Mus musculus
atcactgagctcaagcccccggaag

SEQ ID NO: 207329 - DNA, 25 bp, Mus musculus
atcactgcaaaatgaacccacagct

SEQ ID NO: 207330 - DNA, 25 bp, Mus musculus
atcactgccaaggacgaaaaggggg

SEQ ID NO: 207331 - DNA, 25 bp, Mus musculus
atcactgccactcagcttgatactc

SEQ ID NO: 207332 - DNA, 25 bp, Mus musculus
atcactgcccatagaactagatcag

SEQ ID NO: 207333 - DNA, 25 bp, Mus musculus
atcactgcgagatgagctttgatcc

SEQ ID NO: 207334 - DNA, 25 bp, Mus musculus
atcactgcgagctgcttgacatgga

SEQ ID NO: 207335 - DNA, 25 bp, Mus musculus
atcactgcttgcccaagtgtgcctg

SEQ ID NO: 207336 - DNA, 25 bp, Mus musculus
atcactggagatgtggctcaccatg

SEQ ID NO: 207337 - DNA, 25 bp, Mus musculus
atcactggagcaggccttatgacct

SEQ ID NO: 207338 - DNA, 25 bp, Mus musculus
atcactggctgagaacccttctggt

SEQ ID NO: 207339 - DNA, 25 bp, Mus musculus
atcactgtccaagacccagcaacta

SEQ ID NO: 207340 - DNA, 25 bp, Mus musculus
atcactgtccaagagttgtttgcag

SEQ ID NO: 207341 - DNA, 25 bp, Mus musculus
atcactgtccaaggatggaaggtca

SEQ ID NO: 207342 - DNA, 25 bp, Mus musculus
atcactgtccaagtggacacgggcc

SEQ ID NO: 207343 - DNA, 25 bp, Mus musculus
atcactgtgaatggttaccatacca

SEQ ID NO: 207344 - DNA, 25 bp, Mus musculus
atcactgtgaccactcgtcctgagg

SEQ ID NO: 207345 - DNA, 25 bp, Mus musculus
atcactgtggataaaaatatgccca

SEQ ID NO: 207346 - DNA, 25 bp, Mus musculus
atcactgtgggccccctcccttctg

SEQ ID NO: 207347 - DNA, 25 bp, Mus musculus
atcactgttgagggatgacctgcca

SEQ ID NO: 207348 - DNA, 25 bp, Mus musculus
atcactgttgctcacctttcaacag

SEQ ID NO: 207349 - DNA, 25 bp, Mus musculus
atcacttcaagtgggtaaagcagga

SEQ ID NO: 207350 - DNA, 25 bp, Mus musculus
atcacttgggtgagaatgcctggat

SEQ ID NO: 207351 - DNA, 25 bp, Mus musculus
atcactttcaaaggcatctagtctt

SEQ ID NO: 207352 - DNA, 25 bp, Mus musculus
atcactttgaaaaggctgtcaccct

SEQ ID NO: 207353 - DNA, 25 bp, Mus musculus
atcactttgagattgtaaaagctgg

SEQ ID NO: 207354 - DNA, 25 bp, Mus musculus
atcacttttcctactttcactctac

SEQ ID NO: 207355 - DNA, 25 bp, Mus musculus
atcagaaaaatttgctcaggaaacc

SEQ ID NO: 207356 - DNA, 25 bp, Mus musculus
atcagaaaagcccagttctaattca

SEQ ID NO: 207357 - DNA, 25 bp, Mus musculus
atcagaaaaggtgactaataaacat

SEQ ID NO: 207358 - DNA, 25 bp, Mus musculus
atcagaaaatgagctctgttaagga

SEQ ID NO: 207359 - DNA, 25 bp, Mus musculus
atcagaaacagaagactctattctt

SEQ ID NO: 207360 - DNA, 25 bp, Mus musculus
atcagaaacctgaacctgtggacaa

SEQ ID NO: 207361 - DNA, 25 bp, Mus musculus
atcagaaacctgatattcagacaca

SEQ ID NO: 207362 - DNA, 25 bp, Mus musculus
atcagaaactccaggaccaggagga

SEQ ID NO: 207363 - DNA, 25 bp, Mus musculus
atcagaaagggatgaatatgaggat

SEQ ID NO: 207364 - DNA, 25 bp, Mus musculus
atcagaacagcgcaagaagagagcc

SEQ ID NO: 207365 - DNA, 25 bp, Mus musculus
atcagaacaggagtaagcatggaaa

SEQ ID NO: 207366 - DNA, 25 bp, Mus musculus
atcagaacataatggactccctgga

SEQ ID NO: 207367 - DNA, 25 bp, Mus musculus
atcagaacataatggatggagagga

SEQ ID NO: 207368 - DNA, 25 bp, Mus musculus
atcagaaccttcctgacctgggcgg

SEQ ID NO: 207369 - DNA, 25 bp, Mus musculus
atcagaaccttcctggggtctgtga

SEQ ID NO: 207370 - DNA, 25 bp, Mus musculus
atcagaagaagattggagcatatga

SEQ ID NO: 207371 - DNA, 25 bp, Mus musculus
atcagaagaagattggagcctatga

SEQ ID NO: 207372 - DNA, 25 bp, Mus musculus
atcagaagaagggtttcaaaaacaa

SEQ ID NO: 207373 - DNA, 25 bp, Mus musculus
atcagaagaaggtcaaagaaggcaa

SEQ ID NO: 207374 - DNA, 25 bp, Mus musculus
atcagaagatgaaaaagggttcaaa

SEQ ID NO: 207375 - DNA, 25 bp, Mus musculus
atcagaagcaaggttttcgggttgc

SEQ ID NO: 207376 - DNA, 25 bp, Mus musculus
atcagaagcaggcagtgaggccagg

SEQ ID NO: 207377 - DNA, 25 bp, Mus musculus
atcagaagccggggagtcccatggt

SEQ ID NO: 207378 - DNA, 25 bp, Mus musculus
atcagaataaggttcagcctatgga

SEQ ID NO: 207379 - DNA, 25 bp, Mus musculus
atcagaatcaaaaggtggcagatga

SEQ ID NO: 207380 - DNA, 25 bp, Mus musculus
atcagaatcacaaccagccagacca

SEQ ID NO: 207381 - DNA, 25 bp, Mus musculus
atcagaattttccagttccagtgca

SEQ ID NO: 207382 - DNA, 25 bp, Mus musculus
atcagacaaaagattcgcctaaaac

SEQ ID NO: 207383 - DNA, 25 bp, Mus musculus
atcagacaactggaggagttggaag

SEQ ID NO: 207384 - DNA, 25 bp, Mus musculus
atcagacaagaaaagtgaagaactg

SEQ ID NO: 207385 - DNA, 25 bp, Mus musculus
atcagacaagaaccctaattcccct

SEQ ID NO: 207386 - DNA, 25 bp, Mus musculus
atcagacaagctatggtatctccca

SEQ ID NO: 207387 - DNA, 25 bp, Mus musculus
atcagacactggtgaggagcatgtc

SEQ ID NO: 207388 - DNA, 25 bp, Mus musculus
atcagacagaggactactgttgaag

SEQ ID NO: 207389 - DNA, 25 bp, Mus musculus
atcagacagctcttgctgtttccaa

SEQ ID NO: 207390 - DNA, 25 bp, Mus musculus
atcagacagggcaacgtttcatact

SEQ ID NO: 207391 - DNA, 25 bp, Mus musculus
atcagacagtgacccagttgacatc

SEQ ID NO: 207392 - DNA, 25 bp, Mus musculus
atcagacatggattgcagtgctccc

SEQ ID NO: 207393 - DNA, 25 bp, Mus musculus
atcagaccacaggttctcccctatg

SEQ ID NO: 207394 - DNA, 25 bp, Mus musculus
atcagaccacaggtttgtccagagg

SEQ ID NO: 207395 - DNA, 25 bp, Mus musculus
atcagaccagaagctgaccaccttt

SEQ ID NO: 207396 - DNA, 25 bp, Mus musculus
atcagaccagcagagacgttcacag

SEQ ID NO: 207397 - DNA, 25 bp, Mus musculus
atcagaccaggccagctgttgccag

SEQ ID NO: 207398 - DNA, 25 bp, Mus musculus
atcagaccctggagccaccccgctg

SEQ ID NO: 207399 - DNA, 25 bp, Mus musculus
atcagaccttaggggacttacttct

SEQ ID NO: 207400 - DNA, 25 bp, Mus musculus
atcagacgacctagagatgtggtca

SEQ ID NO: 207401 - DNA, 25 bp, Mus musculus
atcagacgctcagatatgctgaagg

SEQ ID NO: 207402 - DNA, 25 bp, Mus musculus
atcagacgtcactggagttcttttc

SEQ ID NO: 207403 - DNA, 25 bp, Mus musculus
atcagactcttcatttgatgcagca

SEQ ID NO: 207404 - DNA, 25 bp, Mus musculus
atcagacttcagatctgttgaacag

SEQ ID NO: 207405 - DNA, 25 bp, Mus musculus
atcagacttctacctgtgtcttcct

SEQ ID NO: 207406 - DNA, 25 bp, Mus musculus
atcagagaaaggttctcaacgcctg

SEQ ID NO: 207407 - DNA, 25 bp, Mus musculus
atcagagaaaggtttaacatctcaa

SEQ ID NO: 207408 - DNA, 25 bp, Mus musculus
atcagagagacatcttctctgtcac

SEQ ID NO: 207409 - DNA, 25 bp, Mus musculus
atcagagaggatgtaacttatccgc

SEQ ID NO: 207410 - DNA, 25 bp, Mus musculus
atcagagagggaagaaaatggagac

SEQ ID NO: 207411 - DNA, 25 bp, Mus musculus
atcagagatggacagcagcatcact

SEQ ID NO: 207412 - DNA, 25 bp, Mus musculus
atcagagatgttactctcgtcccac

SEQ ID NO: 207413 - DNA, 25 bp, Mus musculus
atcagagcactagtgggactctgta

SEQ ID NO: 207414 - DNA, 25 bp, Mus musculus
atcagagcagtgagcagtgggagac

SEQ ID NO: 207415 - DNA, 25 bp, Mus musculus
atcagagcagtgaggataccgctat

SEQ ID NO: 207416 - DNA, 25 bp, Mus musculus
atcagagcgatgtctggtccttcgg

SEQ ID NO: 207417 - DNA, 25 bp, Mus musculus
atcagagcgtcaaggtgtgggataa

SEQ ID NO: 207418 - DNA, 25 bp, Mus musculus
atcagaggaatggcgtactcagttc

SEQ ID NO: 207419 - DNA, 25 bp, Mus musculus
atcagaggagagcccagaggctcaa

SEQ ID NO: 207420 - DNA, 25 bp, Mus musculus
atcagaggagattgaagggcggatg

SEQ ID NO: 207421 - DNA, 25 bp, Mus musculus
atcagaggcacagagaaagaatcat

SEQ ID NO: 207422 - DNA, 25 bp, Mus musculus
atcagaggcacagagatcaaaggca

SEQ ID NO: 207423 - DNA, 25 bp, Mus musculus
atcagagtacagaggtccctcggtt

SEQ ID NO: 207424 - DNA, 25 bp, Mus musculus
atcagagtaggtttgattggcagct

SEQ ID NO: 207425 - DNA, 25 bp, Mus musculus
atcagagttgaaaccgacagagcat

SEQ ID NO: 207426 - DNA, 25 bp, Mus musculus
atcagataaagcaaattaaaaagga

SEQ ID NO: 207427 - DNA, 25 bp, Mus musculus
atcagatcaggtggatgtgtgtact

SEQ ID NO: 207428 - DNA, 25 bp, Mus musculus
atcagatccgtgccatcgctgaacg

SEQ ID NO: 207429 - DNA, 25 bp, Mus musculus
atcagatgcaggttgcgttacagta

SEQ ID NO: 207430 - DNA, 25 bp, Mus musculus
atcagatgcccagcaccccttgggg

SEQ ID NO: 207431 - DNA, 25 bp, Mus musculus
atcagattcaggcaacaatatcttt

SEQ ID NO: 207432 - DNA, 25 bp, Mus musculus
atcagattctcagcttttaatatat

SEQ ID NO: 207433 - DNA, 25 bp, Mus musculus
atcagattctcaggtaagctctgat

SEQ ID NO: 207434 - DNA, 25 bp, Mus musculus
atcagattgaaaagcttactaagca

SEQ ID NO: 207435 - DNA, 25 bp, Mus musculus
atcagatttaaaggttatagttatg

SEQ ID NO: 207436 - DNA, 25 bp, Mus musculus
atcagatttatggagtgtttgatga

SEQ ID NO: 207437 - DNA, 25 bp, Mus musculus
atcagcaaaaacaaatcattgcaac

SEQ ID NO: 207438 - DNA, 25 bp, Mus musculus
atcagcaaatgacatctggattatg

SEQ ID NO: 207439 - DNA, 25 bp, Mus musculus
atcagcaaccttgacgcatcgtggc

SEQ ID NO: 207440 - DNA, 25 bp, Mus musculus
atcagcaactgacaggggagcaaat

SEQ ID NO: 207441 - DNA, 25 bp, Mus musculus
atcagcaactgagaggggagcaaat

SEQ ID NO: 207442 - DNA, 25 bp, Mus musculus
atcagcaagagcttatttcctcaag

SEQ ID NO: 207443 - DNA, 25 bp, Mus musculus
atcagcaagcagcttcaggatctca

SEQ ID NO: 207444 - DNA, 25 bp, Mus musculus
atcagcaagccaccaccacgaaaac

SEQ ID NO: 207445 - DNA, 25 bp, Mus musculus
atcagcaagctgattaccaggaagg

SEQ ID NO: 207446 - DNA, 25 bp, Mus musculus
atcagcaaggagctagctgagccac

SEQ ID NO: 207447 - DNA, 25 bp, Mus musculus
atcagcaagttccagaacctgggtg

SEQ ID NO: 207448 - DNA, 25 bp, Mus musculus
atcagcaatggaagggcagcagagc

SEQ ID NO: 207449 - DNA, 25 bp, Mus musculus
atcagcaatgtggacctggccatgg

SEQ ID NO: 207450 - DNA, 25 bp, Mus musculus
atcagcacagaccggggagctctgc

SEQ ID NO: 207451 - DNA, 25 bp, Mus musculus
atcagcacatgggagtggtcacagc

SEQ ID NO: 207452 - DNA, 25 bp, Mus musculus
atcagcacatgggctttcccagtga

SEQ ID NO: 207453 - DNA, 25 bp, Mus musculus
atcagcacattatagtggaacacca

SEQ ID NO: 207454 - DNA, 25 bp, Mus musculus
atcagcaccatcagggtatatccga

SEQ ID NO: 207455 - DNA, 25 bp, Mus musculus
atcagcaccatgcaggctgtcttct

SEQ ID NO: 207456 - DNA, 25 bp, Mus musculus
atcagcaccatgtcaaatcctctgg

SEQ ID NO: 207457 - DNA, 25 bp, Mus musculus
atcagcacgaatggtgcagtctttg

SEQ ID NO: 207458 - DNA, 25 bp, Mus musculus
atcagcagaaggaagagcggtcgag

SEQ ID NO: 207459 - DNA, 25 bp, Mus musculus
atcagcagagaactactttctccag

SEQ ID NO: 207460 - DNA, 25 bp, Mus musculus
atcagcagaggtgctgttaccagat

SEQ ID NO: 207461 - DNA, 25 bp, Mus musculus
atcagcagcccagaccctacaagta

SEQ ID NO: 207462 - DNA, 25 bp, Mus musculus
atcagcagctgtggctaacttcgac

SEQ ID NO: 207463 - DNA, 25 bp, Mus musculus
atcagcaggccaactctacaatggc

SEQ ID NO: 207464 - DNA, 25 bp, Mus musculus
atcagcaggtaattagtgaaatggt

SEQ ID NO: 207465 - DNA, 25 bp, Mus musculus
atcagcagtacagacgaaatgcctg

SEQ ID NO: 207466 - DNA, 25 bp, Mus musculus
atcagcagtacaggccggccacgaa

SEQ ID NO: 207467 - DNA, 25 bp, Mus musculus
atcagcatacaagggagactctgga

SEQ ID NO: 207468 - DNA, 25 bp, Mus musculus
atcagcatagaagctgcgttggaca

SEQ ID NO: 207469 - DNA, 25 bp, Mus musculus
atcagcataggatcaagtagacatg

SEQ ID NO: 207470 - DNA, 25 bp, Mus musculus
atcagcatagggatctgagaattgc

SEQ ID NO: 207471 - DNA, 25 bp, Mus musculus
atcagcatagtgaagggcgagcttc

SEQ ID NO: 207472 - DNA, 25 bp, Mus musculus
atcagcatattccagatgttctgat

SEQ ID NO: 207473 - DNA, 25 bp, Mus musculus
atcagcatcagattccaaatctatg

SEQ ID NO: 207474 - DNA, 25 bp, Mus musculus
atcagcatcagtctggagcaaaagc

SEQ ID NO: 207475 - DNA, 25 bp, Mus musculus
atcagcatccagtcctggcttaaca

SEQ ID NO: 207476 - DNA, 25 bp, Mus musculus
atcagcatcgtcaagagccgcctgc

SEQ ID NO: 207477 - DNA, 25 bp, Mus musculus
atcagcatcgtgtttactccagact

SEQ ID NO: 207478 - DNA, 25 bp, Mus musculus
atcagccaagccgctgcccagacta

SEQ ID NO: 207479 - DNA, 25 bp, Mus musculus
atcagccaaggttactcctagaact

SEQ ID NO: 207480 - DNA, 25 bp, Mus musculus
atcagccaggtaagaatctacccag

SEQ ID NO: 207481 - DNA, 25 bp, Mus musculus
atcagcccaggatgctatctcccag

SEQ ID NO: 207482 - DNA, 25 bp, Mus musculus
atcagcccaggcgattaaatcccct

SEQ ID NO: 207483 - DNA, 25 bp, Mus musculus
atcagcccggcagccacatgttccc

SEQ ID NO: 207484 - DNA, 25 bp, Mus musculus
atcagccctcccaaaacatgacttt

SEQ ID NO: 207485 - DNA, 25 bp, Mus musculus
atcagccctgagggcagagcagcca

SEQ ID NO: 207486 - DNA, 25 bp, Mus musculus
atcagccctggttcaggcagctgct

SEQ ID NO: 207487 - DNA, 25 bp, Mus musculus
atcagccgagatgaacctctagtct

SEQ ID NO: 207488 - DNA, 25 bp, Mus musculus
atcagccgggaagaggtgctgagct

SEQ ID NO: 207489 - DNA, 25 bp, Mus musculus
atcagccgtggatgaacaggccgat

SEQ ID NO: 207490 - DNA, 25 bp, Mus musculus
atcagcctcaggaagaaactatcaa

SEQ ID NO: 207491 - DNA, 25 bp, Mus musculus
atcagcctcaggaatacatcatgga

SEQ ID NO: 207492 - DNA, 25 bp, Mus musculus
atcagcctctgcagatgcctgagca

SEQ ID NO: 207493 - DNA, 25 bp, Mus musculus
atcagcctctgcagcactgccagag

SEQ ID NO: 207494 - DNA, 25 bp, Mus musculus
atcagcctgaccaaggagcaggcgg

SEQ ID NO: 207495 - DNA, 25 bp, Mus musculus
atcagcctgttgttgctcaccaagg

SEQ ID NO: 207496 - DNA, 25 bp, Mus musculus
atcagcgacacgcgggcgtccgaaa

SEQ ID NO: 207497 - DNA, 25 bp, Mus musculus
atcagcgacatcgatggagatgggt

SEQ ID NO: 207498 - DNA, 25 bp, Mus musculus
atcagcgatctggagccccgcaagt

SEQ ID NO: 207499 - DNA, 25 bp, Mus musculus
atcagcgatctggagctgcagcgct

SEQ ID NO: 207500 - DNA, 25 bp, Mus musculus
atcagcgatgagatggtacagaact

SEQ ID NO: 207501 - DNA, 25 bp, Mus musculus
atcagcgatgaggtagttttgagct

SEQ ID NO: 207502 - DNA, 25 bp, Mus musculus
atcagctacaagatgctgggtgccc

SEQ ID NO: 207503 - DNA, 25 bp, Mus musculus
atcagctatagcctggacctgctct

SEQ ID NO: 207504 - DNA, 25 bp, Mus musculus
atcagctatagcctggtgcttgaga

SEQ ID NO: 207505 - DNA, 25 bp, Mus musculus
atcagctcgagtgccatccgtgagc

SEQ ID NO: 207506 - DNA, 25 bp, Mus musculus
atcagctctgagtggtgggacgaca

SEQ ID NO: 207507 - DNA, 25 bp, Mus musculus
atcagctctgggcgtcagtgttcat

SEQ ID NO: 207508 - DNA, 25 bp, Mus musculus
atcagctgaaggaactcagagaaag

SEQ ID NO: 207509 - DNA, 25 bp, Mus musculus
atcagctgaagtgtgggagtatgga

SEQ ID NO: 207510 - DNA, 25 bp, Mus musculus
atcagctgcaggtggccaagacgaa

SEQ ID NO: 207511 - DNA, 25 bp, Mus musculus
atcagctgctgagcagctgcagcag

SEQ ID NO: 207512 - DNA, 25 bp, Mus musculus
atcagctggagaaggtggacggtat

SEQ ID NO: 207513 - DNA, 25 bp, Mus musculus
atcagctgtcagtgcactgatgtct

SEQ ID NO: 207514 - DNA, 25 bp, Mus musculus
atcagctgtcagttctttgccagaa

SEQ ID NO: 207515 - DNA, 25 bp, Mus musculus
atcagcttagaaggctgtgaatgaa

SEQ ID NO: 207516 - DNA, 25 bp, Mus musculus
atcagcttcattgatgaagcccgct

SEQ ID NO: 207517 - DNA, 25 bp, Mus musculus
atcagcttcattggggttccttgga

SEQ ID NO: 207518 - DNA, 25 bp, Mus musculus
atcagcttccacagaaactcaagtc

SEQ ID NO: 207519 - DNA, 25 bp, Mus musculus
atcagcttccacagaccatgcctta

SEQ ID NO: 207520 - DNA, 25 bp, Mus musculus
atcagcttccacaggtttcctttgg

SEQ ID NO: 207521 - DNA, 25 bp, Mus musculus
atcagcttctcagtgaatttgacaa

SEQ ID NO: 207522 - DNA, 25 bp, Mus musculus
atcagcttttctaaggcatcaatac

SEQ ID NO: 207523 - DNA, 25 bp, Mus musculus
atcagcttttgcagatgaatatgaa

SEQ ID NO: 207524 - DNA, 25 bp, Mus musculus
atcagcttttgcagggggcaccctc

SEQ ID NO: 207525 - DNA, 25 bp, Mus musculus
atcagcttttgcagtggacatccca

SEQ ID NO: 207526 - DNA, 25 bp, Mus musculus
atcaggaagaagactgcccgtggtt

SEQ ID NO: 207527 - DNA, 25 bp, Mus musculus
atcaggacacacagacactgtcctg

SEQ ID NO: 207528 - DNA, 25 bp, Mus musculus
atcaggacactggagatgatcctta

SEQ ID NO: 207529 - DNA, 25 bp, Mus musculus
atcaggaccaagcccttcccctggg

SEQ ID NO: 207530 - DNA, 25 bp, Mus musculus
atcaggactccatttacaacttcag

SEQ ID NO: 207531 - DNA, 25 bp, Mus musculus
atcaggactctcaggtaaatgcatt

SEQ ID NO: 207532 - DNA, 25 bp, Mus musculus
atcaggagtagcaactggtctctgg

SEQ ID NO: 207533 - DNA, 25 bp, Mus musculus
atcaggcaagcagctccagtcagtc

SEQ ID NO: 207534 - DNA, 25 bp, Mus musculus
atcaggcatccagtgagctgcttat

SEQ ID NO: 207535 - DNA, 25 bp, Mus musculus
atcaggcgatatccgtaaagaactt

SEQ ID NO: 207536 - DNA, 25 bp, Mus musculus
atcaggctccacagattgcagcccg

SEQ ID NO: 207537 - DNA, 25 bp, Mus musculus
atcaggctgaaagtttggcttttca

SEQ ID NO: 207538 - DNA, 25 bp, Mus musculus
atcagggaaatcaaggaacttaatg

SEQ ID NO: 207539 - DNA, 25 bp, Mus musculus
atcagggaaatcaaggactcgctgg

SEQ ID NO: 207540 - DNA, 25 bp, Mus musculus
atcagggaagatacattgtgtgtga

SEQ ID NO: 207541 - DNA, 25 bp, Mus musculus
atcagggaagcttccctgttgaaag

SEQ ID NO: 207542 - DNA, 25 bp, Mus musculus
atcagggagaatcggggtgcacctt

SEQ ID NO: 207543 - DNA, 25 bp, Mus musculus
atcagggagaatcgggttggagggg

SEQ ID NO: 207544 - DNA, 25 bp, Mus musculus
atcagggatgtaggagatgagccgc

SEQ ID NO: 207545 - DNA, 25 bp, Mus musculus
atcagggcatatcagatacgagggc

SEQ ID NO: 207546 - DNA, 25 bp, Mus musculus
atcagggcatatcaggtcaggggtc

SEQ ID NO: 207547 - DNA, 25 bp, Mus musculus
atcagggctcaaggaggtagatgac

SEQ ID NO: 207548 - DNA, 25 bp, Mus musculus
atcagggtcaagacaaatcttccta

SEQ ID NO: 207549 - DNA, 25 bp, Mus musculus
atcagggtcaaggttgtagttcccc

SEQ ID NO: 207550 - DNA, 25 bp, Mus musculus
atcagggtcacagaaaccggcgatg

SEQ ID NO: 207551 - DNA, 25 bp, Mus musculus
atcagggtcacaggctctgtgggtg

SEQ ID NO: 207552 - DNA, 25 bp, Mus musculus
atcagggtgtaccagcctccagctc

SEQ ID NO: 207553 - DNA, 25 bp, Mus musculus
atcagggttccagggacttcctggc

SEQ ID NO: 207554 - DNA, 25 bp, Mus musculus
atcaggtcaccaccatgggattttg

SEQ ID NO: 207555 - DNA, 25 bp, Mus musculus
atcaggtcaccagcatgggattttg

SEQ ID NO: 207556 - DNA, 25 bp, Mus musculus
atcaggtccaagagtctgaaggaag

SEQ ID NO: 207557 - DNA, 25 bp, Mus musculus
atcaggtccaagtccgtaattgagc

SEQ ID NO: 207558 - DNA, 25 bp, Mus musculus
atcaggtccagggcaatggcagcag

SEQ ID NO: 207559 - DNA, 25 bp, Mus musculus
atcaggtcccccggtatagaacgtg

SEQ ID NO: 207560 - DNA, 25 bp, Mus musculus
atcaggtcctggatgaacgagaccg

SEQ ID NO: 207561 - DNA, 25 bp, Mus musculus
atcaggtctccttcccttgaacaac

SEQ ID NO: 207562 - DNA, 25 bp, Mus musculus
atcaggtctgaggatatgacattac

SEQ ID NO: 207563 - DNA, 25 bp, Mus musculus
atcaggtgctaggttaaagatcgag

SEQ ID NO: 207564 - DNA, 25 bp, Mus musculus
atcaggtggatttgaaagaaactgc

SEQ ID NO: 207565 - DNA, 25 bp, Mus musculus
atcaggtgggaggttgtgcccacca

SEQ ID NO: 207566 - DNA, 25 bp, Mus musculus
atcagtaatcctccaatcactgtta

SEQ ID NO: 207567 - DNA, 25 bp, Mus musculus
atcagtaattatggatgggatcagt

SEQ ID NO: 207568 - DNA, 25 bp, Mus musculus
atcagtacagggagcagatcaagcg

SEQ ID NO: 207569 - DNA, 25 bp, Mus musculus
atcagtacagtcatgcctgcagcct

SEQ ID NO: 207570 - DNA, 25 bp, Mus musculus
atcagtatacatgggagactctgga

SEQ ID NO: 207571 - DNA, 25 bp, Mus musculus
atcagtcaaagaatgtcccctatat

SEQ ID NO: 207572 - DNA, 25 bp, Mus musculus
atcagtcaaagagaaacaaagcaaa

SEQ ID NO: 207573 - DNA, 25 bp, Mus musculus
atcagtcagccccaacatccagaac

SEQ ID NO: 207574 - DNA, 25 bp, Mus musculus
atcagtcagggttacagagtcatca

SEQ ID NO: 207575 - DNA, 25 bp, Mus musculus
atcagtcctcagatgcggtgagcac

SEQ ID NO: 207576 - DNA, 25 bp, Mus musculus
atcagtcctccccagaaatagatga

SEQ ID NO: 207577 - DNA, 25 bp, Mus musculus
atcagtcgcattcgaagagccaccg

SEQ ID NO: 207578 - DNA, 25 bp, Mus musculus
atcagtcgcattcgatgaaatcgtg

SEQ ID NO: 207579 - DNA, 25 bp, Mus musculus
atcagtctcagcatcctcatgtgta

SEQ ID NO: 207580 - DNA, 25 bp, Mus musculus
atcagtctttaagtgccttcagtca

SEQ ID NO: 207581 - DNA, 25 bp, Mus musculus
atcagtgaaaacctgcttgtttctg

SEQ ID NO: 207582 - DNA, 25 bp, Mus musculus
atcagtgactgtaagttgtctgaca

SEQ ID NO: 207583 - DNA, 25 bp, Mus musculus
atcagtgactgtagtctgacatctc

SEQ ID NO: 207584 - DNA, 25 bp, Mus musculus
atcagtgagaaagtggacaccatgg

SEQ ID NO: 207585 - DNA, 25 bp, Mus musculus
atcagtgagctcctgctgttctatg

SEQ ID NO: 207586 - DNA, 25 bp, Mus musculus
atcagtgagtaccgtggccttccac

SEQ ID NO: 207587 - DNA, 25 bp, Mus musculus
atcagtgatgatttcctattatgac

SEQ ID NO: 207588 - DNA, 25 bp, Mus musculus
atcagtgatgctctccttacagaca

SEQ ID NO: 207589 - DNA, 25 bp, Mus musculus
atcagtggaagccaaggataacctt

SEQ ID NO: 207590 - DNA, 25 bp, Mus musculus
atcagtggaaggcagttaaaccaga

SEQ ID NO: 207591 - DNA, 25 bp, Mus musculus
atcagtggaagtcttgaaatacagc

SEQ ID NO: 207592 - DNA, 25 bp, Mus musculus
atcagtggatcgatatcaacaacaa

SEQ ID NO: 207593 - DNA, 25 bp, Mus musculus
atcagtggattctgaccacctcatc

SEQ ID NO: 207594 - DNA, 25 bp, Mus musculus
atcagtgggaggaggaatttgacaa

SEQ ID NO: 207595 - DNA, 25 bp, Mus musculus
atcagtggggcggcccctgcccgga

SEQ ID NO: 207596 - DNA, 25 bp, Mus musculus
atcagtggtccagaccctcagtgct

SEQ ID NO: 207597 - DNA, 25 bp, Mus musculus
atcagtggtccaggttctaagcgca

SEQ ID NO: 207598 - DNA, 25 bp, Mus musculus
atcagtgtaagctgctcttaacctt

SEQ ID NO: 207599 - DNA, 25 bp, Mus musculus
atcagtgtatcaggatgatgctgtt

SEQ ID NO: 207600 - DNA, 25 bp, Mus musculus
atcagtgtgagtatatacacttctg

SEQ ID NO: 207601 - DNA, 25 bp, Mus musculus
atcagttagaagctcttaaaaaaca

SEQ ID NO: 207602 - DNA, 25 bp, Mus musculus
atcagttatagccaggatttcccag

SEQ ID NO: 207603 - DNA, 25 bp, Mus musculus
atcagttatagccaggtctccagca

SEQ ID NO: 207604 - DNA, 25 bp, Mus musculus
atcagttatctgacccttcctatct

SEQ ID NO: 207605 - DNA, 25 bp, Mus musculus
atcagttcaagtctgttatctccta

SEQ ID NO: 207606 - DNA, 25 bp, Mus musculus
atcagttctgtgctcaaagatccag

SEQ ID NO: 207607 - DNA, 25 bp, Mus musculus
atcagttcttttaggaagctcaata

SEQ ID NO: 207608 - DNA, 25 bp, Mus musculus
atcagttgttgagctctgaactcac

SEQ ID NO: 207609 - DNA, 25 bp, Mus musculus
atcagtttaggattcagctggcgga

SEQ ID NO: 207610 - DNA, 25 bp, Mus musculus
atcagtttagtgctgacagtagagt

SEQ ID NO: 207611 - DNA, 25 bp, Mus musculus
atcagtttgacaaaggaaaaagagg

SEQ ID NO: 207612 - DNA, 25 bp, Mus musculus
atcataaacgacaggtgtgtggagg

SEQ ID NO: 207613 - DNA, 25 bp, Mus musculus
atcataaacgacaggtgtgttgaaa

SEQ ID NO: 207614 - DNA, 25 bp, Mus musculus
atcataaagaggctcacaactcagt

SEQ ID NO: 207615 - DNA, 25 bp, Mus musculus
atcataaagccaggcagtgaagcag

SEQ ID NO: 207616 - DNA, 25 bp, Mus musculus
atcataacccggcagaactacacat

SEQ ID NO: 207617 - DNA, 25 bp, Mus musculus
atcataacgctaacaggatgagatt

SEQ ID NO: 207618 - DNA, 25 bp, Mus musculus
atcataacgctaagtgtgatgaatg

SEQ ID NO: 207619 - DNA, 25 bp, Mus musculus
atcataactatcgcgaacgagagag

SEQ ID NO: 207620 - DNA, 25 bp, Mus musculus
atcatacaagtttgtgtggccatca

SEQ ID NO: 207621 - DNA, 25 bp, Mus musculus
atcatacatctagtggcagagagtt

SEQ ID NO: 207622 - DNA, 25 bp, Mus musculus
atcatacttgcacaccgctggtttg

SEQ ID NO: 207623 - DNA, 25 bp, Mus musculus
atcatagccaaggaaggtggggttg

SEQ ID NO: 207624 - DNA, 25 bp, Mus musculus
atcatagccaaggtggacggtatcc

SEQ ID NO: 207625 - DNA, 25 bp, Mus musculus
atcatagccaagttcctgtacggga

SEQ ID NO: 207626 - DNA, 25 bp, Mus musculus
atcatagtggaaaagaaccaaagaa

SEQ ID NO: 207627 - DNA, 25 bp, Mus musculus
atcatatacaggagcagtacagtgg

SEQ ID NO: 207628 - DNA, 25 bp, Mus musculus
atcatatctggccatcagacactgg

SEQ ID NO: 207629 - DNA, 25 bp, Mus musculus
atcatatctgtgtgaaaataggatt

SEQ ID NO: 207630 - DNA, 25 bp, Mus musculus
atcatatctttcagaggagcctatc

SEQ ID NO: 207631 - DNA, 25 bp, Mus musculus
atcatatctttcaggtggtatagct

SEQ ID NO: 207632 - DNA, 25 bp, Mus musculus
atcatatgataatattaagaatgcc

SEQ ID NO: 207633 - DNA, 25 bp, Mus musculus
atcatatgatagtctgatatgccga

SEQ ID NO: 207634 - DNA, 25 bp, Mus musculus
atcatatggagagacgtgtcctggg

SEQ ID NO: 207635 - DNA, 25 bp, Mus musculus
atcatatggagagtatgctattaag

SEQ ID NO: 207636 - DNA, 25 bp, Mus musculus
atcatcaaaactggaagtttggtga

SEQ ID NO: 207637 - DNA, 25 bp, Mus musculus
atcatcaacgtgctggaacttggca

SEQ ID NO: 207638 - DNA, 25 bp, Mus musculus
atcatcaacgtgctggacctataag

SEQ ID NO: 207639 - DNA, 25 bp, Mus musculus
atcatcaactctatattagctcaat

SEQ ID NO: 207640 - DNA, 25 bp, Mus musculus
atcatcaagaagagcctccccaggt

SEQ ID NO: 207641 - DNA, 25 bp, Mus musculus
atcatcaagaaggtgcaggtggttc

SEQ ID NO: 207642 - DNA, 25 bp, Mus musculus
atcatcaaggccaaggccaacctgg

SEQ ID NO: 207643 - DNA, 25 bp, Mus musculus
atcatcaagggccactccagaagtg

SEQ ID NO: 207644 - DNA, 25 bp, Mus musculus
atcatcaatccaaacatctgtggcc

SEQ ID NO: 207645 - DNA, 25 bp, Mus musculus
atcatcaatggcattgtggaggatt

SEQ ID NO: 207646 - DNA, 25 bp, Mus musculus
atcatcacagacaccacggcgacga

SEQ ID NO: 207647 - DNA, 25 bp, Mus musculus
atcatcacagatcttcggaaccagc

SEQ ID NO: 207648 - DNA, 25 bp, Mus musculus
atcatcacagattctcgagcaggtg

SEQ ID NO: 207649 - DNA, 25 bp, Mus musculus
atcatcacagcaatccgccacttga

SEQ ID NO: 207650 - DNA, 25 bp, Mus musculus
atcatcacagcctggcaccctcctg

SEQ ID NO: 207651 - DNA, 25 bp, Mus musculus
atcatcacagcctgtaaaaagaacc

SEQ ID NO: 207652 - DNA, 25 bp, Mus musculus
atcatcacaggagttggtgacacac

SEQ ID NO: 207653 - DNA, 25 bp, Mus musculus
atcatcacaggtattccagcatctt

SEQ ID NO: 207654 - DNA, 25 bp, Mus musculus
atcatcacagtgctgaagacagtgc

SEQ ID NO: 207655 - DNA, 25 bp, Mus musculus
atcatcaccagaataagcctgcacg

SEQ ID NO: 207656 - DNA, 25 bp, Mus musculus
atcatcacccaagatcatcatgcac

SEQ ID NO: 207657 - DNA, 25 bp, Mus musculus
atcatcacggcagatggcagtgaaa

SEQ ID NO: 207658 - DNA, 25 bp, Mus musculus
atcatcaggaggtgcttacatgttg

SEQ ID NO: 207659 - DNA, 25 bp, Mus musculus
atcatcataaatgttaaaattctgt

SEQ ID NO: 207660 - DNA, 25 bp, Mus musculus
atcatccacaagactgcgggaagga

SEQ ID NO: 207661 - DNA, 25 bp, Mus musculus
atcatccacagcagttgagtggtga

SEQ ID NO: 207662 - DNA, 25 bp, Mus musculus
atcatccacgcagtgattgacgaga

SEQ ID NO: 207663 - DNA, 25 bp, Mus musculus
atcatccagcatgtgtctaacaagc

SEQ ID NO: 207664 - DNA, 25 bp, Mus musculus
atcatccagccctacatccagaacc

SEQ ID NO: 207665 - DNA, 25 bp, Mus musculus
atcatccaggcagatgaagaggtcg

SEQ ID NO: 207666 - DNA, 25 bp, Mus musculus
atcatccaggcaggtataaaagagg

SEQ ID NO: 207667 - DNA, 25 bp, Mus musculus
atcatccattcaggcgtccgcgagt

SEQ ID NO: 207668 - DNA, 25 bp, Mus musculus
atcatcccagcctatgggaaggtgt

SEQ ID NO: 207669 - DNA, 25 bp, Mus musculus
atcatcccaggagtgttactagatg

SEQ ID NO: 207670 - DNA, 25 bp, Mus musculus
atcatcccagtcttcatcagctgcc

SEQ ID NO: 207671 - DNA, 25 bp, Mus musculus
atcatccccaggcgctttgccctgt

SEQ ID NO: 207672 - DNA, 25 bp, Mus musculus
atcatcccggcgcctccccatctgc

SEQ ID NO: 207673 - DNA, 25 bp, Mus musculus
atcatcccgggagttccgactctga

SEQ ID NO: 207674 - DNA, 25 bp, Mus musculus
atcatcccggtatccctggaactga

SEQ ID NO: 207675 - DNA, 25 bp, Mus musculus
atcatccctcctcaggtggggctcc

SEQ ID NO: 207676 - DNA, 25 bp, Mus musculus
atcatccctgtgcgggccatcaatt

SEQ ID NO: 207677 - DNA, 25 bp, Mus musculus
atcatccctgtgcgggttgccgatg

SEQ ID NO: 207678 - DNA, 25 bp, Mus musculus
atcatccggaaggctgtggcagttt

SEQ ID NO: 207679 - DNA, 25 bp, Mus musculus
atcatccggaagtgtgtccctccag

SEQ ID NO: 207680 - DNA, 25 bp, Mus musculus
atcatccggcagaagcgcctgtctc

SEQ ID NO: 207681 - DNA, 25 bp, Mus musculus
atcatccgggaggaactgcacgggc

SEQ ID NO: 207682 - DNA, 25 bp, Mus musculus
atcatcctgaacatgccaggcacga

SEQ ID NO: 207683 - DNA, 25 bp, Mus musculus
atcatcctgacaggtgctgagttcc

SEQ ID NO: 207684 - DNA, 25 bp, Mus musculus
atcatcctgagtgacatggaaatag

SEQ ID NO: 207685 - DNA, 25 bp, Mus musculus
atcatcctgagtgacgtcatccact

SEQ ID NO: 207686 - DNA, 25 bp, Mus musculus
atcatcctgagtgagatggaaatag

SEQ ID NO: 207687 - DNA, 25 bp, Mus musculus
atcatcctgagtgagcagaaaatgc

SEQ ID NO: 207688 - DNA, 25 bp, Mus musculus
atcatcctgagtgaggtcatccact

SEQ ID NO: 207689 - DNA, 25 bp, Mus musculus
atcatcctgctgacaggactatgac

SEQ ID NO: 207690 - DNA, 25 bp, Mus musculus
atcatcctgctgacctacattcagc

SEQ ID NO: 207691 - DNA, 25 bp, Mus musculus
atcatcctgctgtcaggactatgac

SEQ ID NO: 207692 - DNA, 25 bp, Mus musculus
atcatcctgctgtcctacattcagc

SEQ ID NO: 207693 - DNA, 25 bp, Mus musculus
atcatcctggtgttcctgctggcag

SEQ ID NO: 207694 - DNA, 25 bp, Mus musculus
atcatccttagcaagagatgtcgat

SEQ ID NO: 207695 - DNA, 25 bp, Mus musculus
atcatccttagcagggagaagaaac

SEQ ID NO: 207696 - DNA, 25 bp, Mus musculus
atcatcctttttataatcatgctgc

SEQ ID NO: 207697 - DNA, 25 bp, Mus musculus
atcatcgaaatgaagattggataac

SEQ ID NO: 207698 - DNA, 25 bp, Mus musculus
atcatcgaaatgatgccagaatttc

SEQ ID NO: 207699 - DNA, 25 bp, Mus musculus
atcatcgaaatggaaatcagagatg

SEQ ID NO: 207700 - DNA, 25 bp, Mus musculus
atcatcgaacagactcaccacctcc

SEQ ID NO: 207701 - DNA, 25 bp, Mus musculus
atcatcgaacagttcatgcaacaga

SEQ ID NO: 207702 - DNA, 25 bp, Mus musculus
atcatcgaagctcccatctccagga

SEQ ID NO: 207703 - DNA, 25 bp, Mus musculus
atcatcgaagtctttgtccaggagc

SEQ ID NO: 207704 - DNA, 25 bp, Mus musculus
atcatcgaagtggaaaacatggcgc

SEQ ID NO: 207705 - DNA, 25 bp, Mus musculus
atcatcgacccccttttgcaatggc

SEQ ID NO: 207706 - DNA, 25 bp, Mus musculus
atcatcgcactgcagacaattgcct

SEQ ID NO: 207707 - DNA, 25 bp, Mus musculus
atcatcgctgtgttttctcgtgacc

SEQ ID NO: 207708 - DNA, 25 bp, Mus musculus
atcatcgggaagttctgattcaaag

SEQ ID NO: 207709 - DNA, 25 bp, Mus musculus
atcatcgtttaacaatggaacatag

SEQ ID NO: 207710 - DNA, 25 bp, Mus musculus
atcatctaccctgaggagaatgaag

SEQ ID NO: 207711 - DNA, 25 bp, Mus musculus
atcatctacttaaacgctttatctt

SEQ ID NO: 207712 - DNA, 25 bp, Mus musculus
atcatctacttaaaggctttatctt

SEQ ID NO: 207713 - DNA, 25 bp, Mus musculus
atcatctataacccgataatcccct

SEQ ID NO: 207714 - DNA, 25 bp, Mus musculus
atcatctataacccgattccaggtt

SEQ ID NO: 207715 - DNA, 25 bp, Mus musculus
atcatctattagggcttatttcaaa

SEQ ID NO: 207716 - DNA, 25 bp, Mus musculus
atcatctcacaggttcaaaagagga

SEQ ID NO: 207717 - DNA, 25 bp, Mus musculus
atcatctcacagtctgttgcaggga

SEQ ID NO: 207718 - DNA, 25 bp, Mus musculus
atcatctcattgctaagaatgtggc

SEQ ID NO: 207719 - DNA, 25 bp, Mus musculus
atcatctctcattactcgggtttca

SEQ ID NO: 207720 - DNA, 25 bp, Mus musculus
atcatctgacaaaagaaagaatatg

SEQ ID NO: 207721 - DNA, 25 bp, Mus musculus
atcatctgacccaggtgtccccatg

SEQ ID NO: 207722 - DNA, 25 bp, Mus musculus
atcatctgcccctcgcgagagctgg

SEQ ID NO: 207723 - DNA, 25 bp, Mus musculus
atcatctgcctcaggtcttcggatc

SEQ ID NO: 207724 - DNA, 25 bp, Mus musculus
atcatctgcggaagggaaacaacct

SEQ ID NO: 207725 - DNA, 25 bp, Mus musculus
atcatctggccagaaccagacttgg

SEQ ID NO: 207726 - DNA, 25 bp, Mus musculus
atcatctggccaggatactcacagg

SEQ ID NO: 207727 - DNA, 25 bp, Mus musculus
atcatgaaaaaactaaggagttttg

SEQ ID NO: 207728 - DNA, 25 bp, Mus musculus
atcatgaaaaaacttttgcactcct

SEQ ID NO: 207729 - DNA, 25 bp, Mus musculus
atcatgaacctgctcctggccgtgg

SEQ ID NO: 207730 - DNA, 25 bp, Mus musculus
atcatgaacggacccaagtgtgcag

SEQ ID NO: 207731 - DNA, 25 bp, Mus musculus
atcatgaactaccagtccggcttca

SEQ ID NO: 207732 - DNA, 25 bp, Mus musculus
atcatgaatcccagcccggagggcc

SEQ ID NO: 207733 - DNA, 25 bp, Mus musculus
atcatgaatgtgaaagagtttctag

SEQ ID NO: 207734 - DNA, 25 bp, Mus musculus
atcatgacagaacagccttgtcttt

SEQ ID NO: 207735 - DNA, 25 bp, Mus musculus
atcatgacagaattccagaggcaag

SEQ ID NO: 207736 - DNA, 25 bp, Mus musculus
atcatgacaggcccattcttccgct

SEQ ID NO: 207737 - DNA, 25 bp, Mus musculus
atcatgacattcgcttcaaaatcca

SEQ ID NO: 207738 - DNA, 25 bp, Mus musculus
atcatgacttcttgttcagtcacca

SEQ ID NO: 207739 - DNA, 25 bp, Mus musculus
atcatgagaaggctgctttgattat

SEQ ID NO: 207740 - DNA, 25 bp, Mus musculus
atcatgagacttagaatccttctga

SEQ ID NO: 207741 - DNA, 25 bp, Mus musculus
atcatgagacttagtagctagaaga

SEQ ID NO: 207742 - DNA, 25 bp, Mus musculus
atcatgagccaggactgctagacac

SEQ ID NO: 207743 - DNA, 25 bp, Mus musculus
atcatgagccaggtggctgtgggca

SEQ ID NO: 207744 - DNA, 25 bp, Mus musculus
atcatgaggtcggcagattcagagc

SEQ ID NO: 207745 - DNA, 25 bp, Mus musculus
atcatgataaatgaggacatagcat

SEQ ID NO: 207746 - DNA, 25 bp, Mus musculus
atcatgattcagaagatgatttttg

SEQ ID NO: 207747 - DNA, 25 bp, Mus musculus
atcatgattccacaggcaatccaga

SEQ ID NO: 207748 - DNA, 25 bp, Mus musculus
atcatgcataaattgaatctgtata

SEQ ID NO: 207749 - DNA, 25 bp, Mus musculus
atcatgccaagacaactcctgagga

SEQ ID NO: 207750 - DNA, 25 bp, Mus musculus
atcatgccaagcctgttcattaaaa

SEQ ID NO: 207751 - DNA, 25 bp, Mus musculus
atcatgccaaggactctggaggaag

SEQ ID NO: 207752 - DNA, 25 bp, Mus musculus
atcatgcgcccgaatgacagtcctt

SEQ ID NO: 207753 - DNA, 25 bp, Mus musculus
atcatgctatagagctgtcatagcc

SEQ ID NO: 207754 - DNA, 25 bp, Mus musculus
atcatgctatagagtcgacaagcag

SEQ ID NO: 207755 - DNA, 25 bp, Mus musculus
atcatgctatagagtctggattttc

SEQ ID NO: 207756 - DNA, 25 bp, Mus musculus
atcatgctattaaagctggtgagaa

SEQ ID NO: 207757 - DNA, 25 bp, Mus musculus
atcatgctcggatcaagcaaatcgt

SEQ ID NO: 207758 - DNA, 25 bp, Mus musculus
atcatgctcggctatctgcacctgg

SEQ ID NO: 207759 - DNA, 25 bp, Mus musculus
atcatgctgagcacttttgtgtaat

SEQ ID NO: 207760 - DNA, 25 bp, Mus musculus
atcatgctgatcaaactggattcag

SEQ ID NO: 207761 - DNA, 25 bp, Mus musculus
atcatgctggcaaaggcgggttcca

SEQ ID NO: 207762 - DNA, 25 bp, Mus musculus
atcatgctggggaaacaactggaag

SEQ ID NO: 207763 - DNA, 25 bp, Mus musculus
atcatgctgggtggaagtgagaggc

SEQ ID NO: 207764 - DNA, 25 bp, Mus musculus
atcatgctttaccaggaacatttca

SEQ ID NO: 207765 - DNA, 25 bp, Mus musculus
atcatgctttaccaggatatgactg

SEQ ID NO: 207766 - DNA, 25 bp, Mus musculus
atcatggaattcgtactgcgtttgg

SEQ ID NO: 207767 - DNA, 25 bp, Mus musculus
atcatggacggggcatttggcacaa

SEQ ID NO: 207768 - DNA, 25 bp, Mus musculus
atcatggagaatatccggagacaaa

SEQ ID NO: 207769 - DNA, 25 bp, Mus musculus
atcatggagtattgataacaacaaa

SEQ ID NO: 207770 - DNA, 25 bp, Mus musculus
atcatggcagtgaagcggatacggg

SEQ ID NO: 207771 - DNA, 25 bp, Mus musculus
atcatgggaaggatgggtaacaaag

SEQ ID NO: 207772 - DNA, 25 bp, Mus musculus
atcatgggaaggatgtcctttcaac

SEQ ID NO: 207773 - DNA, 25 bp, Mus musculus
atcatgggaatctgatccgctgtac

SEQ ID NO: 207774 - DNA, 25 bp, Mus musculus
atcatgggacagaagggtgaccagg

SEQ ID NO: 207775 - DNA, 25 bp, Mus musculus
atcatggggaaaagtgcgcaaactt

SEQ ID NO: 207776 - DNA, 25 bp, Mus musculus
atcatgggtattggtccagaacaca

SEQ ID NO: 207777 - DNA, 25 bp, Mus musculus
atcatgggtattggtccagtccctg

SEQ ID NO: 207778 - DNA, 25 bp, Mus musculus
atcatggtcgttggccagagtggac

SEQ ID NO: 207779 - DNA, 25 bp, Mus musculus
atcatggtgagtcatctccatccac

SEQ ID NO: 207780 - DNA, 25 bp, Mus musculus
atcatggtgcagtaccatgcactag

SEQ ID NO: 207781 - DNA, 25 bp, Mus musculus
atcatggtgcagtgctgttgaattt

SEQ ID NO: 207782 - DNA, 25 bp, Mus musculus
atcatggttgcccccaaggtctctg

SEQ ID NO: 207783 - DNA, 25 bp, Mus musculus
atcatgtaccaaggagacaaaattc

SEQ ID NO: 207784 - DNA, 25 bp, Mus musculus
atcatgtagggagcaacatcctttg

SEQ ID NO: 207785 - DNA, 25 bp, Mus musculus
atcatgtagggagtatgaaggtcaa

SEQ ID NO: 207786 - DNA, 25 bp, Mus musculus
atcatgtcacacagcactcatgaac

SEQ ID NO: 207787 - DNA, 25 bp, Mus musculus
atcatgtcacagcgtctgttgacat

SEQ ID NO: 207788 - DNA, 25 bp, Mus musculus
atcatgtcacagggcagcaagttca

SEQ ID NO: 207789 - DNA, 25 bp, Mus musculus
atcatgtcatcaggcagcctgatct

SEQ ID NO: 207790 - DNA, 25 bp, Mus musculus
atcatgtcttcaagtaaaggatctc

SEQ ID NO: 207791 - DNA, 25 bp, Mus musculus
atcatgtgaggcacgtggacatctt

SEQ ID NO: 207792 - DNA, 25 bp, Mus musculus
atcatgtggaaagaggagaaccatc

SEQ ID NO: 207793 - DNA, 25 bp, Mus musculus
atcatgtggaaagaggtggcagtgg

SEQ ID NO: 207794 - DNA, 25 bp, Mus musculus
atcatgttcaagaaatccttttatc

SEQ ID NO: 207795 - DNA, 25 bp, Mus musculus
atcatgttcaagaaatctgatagac

SEQ ID NO: 207796 - DNA, 25 bp, Mus musculus
atcatgttcaagaaatttgatgaaa

SEQ ID NO: 207797 - DNA, 25 bp, Mus musculus
atcatgttcaagaaccatgaacaca

SEQ ID NO: 207798 - DNA, 25 bp, Mus musculus
atcatgttcctccttgtagcaatgc

SEQ ID NO: 207799 - DNA, 25 bp, Mus musculus
atcatgttgaagatggtaaaagcta

SEQ ID NO: 207800 - DNA, 25 bp, Mus musculus
atcatgttgaagctcatctacggac

SEQ ID NO: 207801 - DNA, 25 bp, Mus musculus
atcatgttgctgaagcttcaaaaga

SEQ ID NO: 207802 - DNA, 25 bp, Mus musculus
atcatgtttggacctgatatttgtg

SEQ ID NO: 207803 - DNA, 25 bp, Mus musculus
atcattacagaaaagggtgtgtttg

SEQ ID NO: 207804 - DNA, 25 bp, Mus musculus
atcattacagacacacctgcaaaga

SEQ ID NO: 207805 - DNA, 25 bp, Mus musculus
atcattacaggtcctgagataaaat

SEQ ID NO: 207806 - DNA, 25 bp, Mus musculus
atcattaccaggcataactcctggc

SEQ ID NO: 207807 - DNA, 25 bp, Mus musculus
atcattagaagaatcagcagccgct

SEQ ID NO: 207808 - DNA, 25 bp, Mus musculus
atcattagcaacgctgttcctgggc

SEQ ID NO: 207809 - DNA, 25 bp, Mus musculus
atcattataaatgctacaataaaag

SEQ ID NO: 207810 - DNA, 25 bp, Mus musculus
atcattatgaccctgcctccacagg

SEQ ID NO: 207811 - DNA, 25 bp, Mus musculus
atcattatgaccctgctttttaaat

SEQ ID NO: 207812 - DNA, 25 bp, Mus musculus
atcattattcagggattgcttacat

SEQ ID NO: 207813 - DNA, 25 bp, Mus musculus
atcattattcagttgtttgttgctg

SEQ ID NO: 207814 - DNA, 25 bp, Mus musculus
atcattattcgagcccccaagctct

SEQ ID NO: 207815 - DNA, 25 bp, Mus musculus
atcattattcgagctatcttcagac

SEQ ID NO: 207816 - DNA, 25 bp, Mus musculus
atcattattttagacacagaatgtt

SEQ ID NO: 207817 - DNA, 25 bp, Mus musculus
atcattcaaaaggaggtttccccag

SEQ ID NO: 207818 - DNA, 25 bp, Mus musculus
atcattcagaaacaggtggtgatga

SEQ ID NO: 207819 - DNA, 25 bp, Mus musculus
atcattccaagaagaagcccgggac

SEQ ID NO: 207820 - DNA, 25 bp, Mus musculus
atcattccaatgtggaaaagaagac

SEQ ID NO: 207821 - DNA, 25 bp, Mus musculus
atcattccattagtaaccgtgtgga

SEQ ID NO: 207822 - DNA, 25 bp, Mus musculus
atcattcccaagaatctgggtgtga

SEQ ID NO: 207823 - DNA, 25 bp, Mus musculus
atcattcccaagacaagcagtaaca

SEQ ID NO: 207824 - DNA, 25 bp, Mus musculus
atcattcccaagcatccagcgtcaa

SEQ ID NO: 207825 - DNA, 25 bp, Mus musculus
atcattcccataagtctgcgagtaa

SEQ ID NO: 207826 - DNA, 25 bp, Mus musculus
atcattcctatcagcttgcgtgtga

SEQ ID NO: 207827 - DNA, 25 bp, Mus musculus
atcattcctccacaaaggtcagaag

SEQ ID NO: 207828 - DNA, 25 bp, Mus musculus
atcattcctccacaagagcctgagt

SEQ ID NO: 207829 - DNA, 25 bp, Mus musculus
atcattctgacagctgtgaactgtg

SEQ ID NO: 207830 - DNA, 25 bp, Mus musculus
atcattcttaccaagaagtttgttc

SEQ ID NO: 207831 - DNA, 25 bp, Mus musculus
atcattgaagagaagagccttgttg

SEQ ID NO: 207832 - DNA, 25 bp, Mus musculus
atcattgacagattctttctaaagt

SEQ ID NO: 207833 - DNA, 25 bp, Mus musculus
atcattgacagtcctgatgcttccc

SEQ ID NO: 207834 - DNA, 25 bp, Mus musculus
atcattgaccagcaccacctgcccc

SEQ ID NO: 207835 - DNA, 25 bp, Mus musculus
atcattgacttaaaggaactagagg

SEQ ID NO: 207836 - DNA, 25 bp, Mus musculus
atcattgagaacctgtctccttaaa

SEQ ID NO: 207837 - DNA, 25 bp, Mus musculus
atcattgaggatctggaagctcaag

SEQ ID NO: 207838 - DNA, 25 bp, Mus musculus
atcattgagggcagcctggacactg

SEQ ID NO: 207839 - DNA, 25 bp, Mus musculus
atcattgatatgtcaactcagatga

SEQ ID NO: 207840 - DNA, 25 bp, Mus musculus
atcattgatgaaagagaaaaaaatc

SEQ ID NO: 207841 - DNA, 25 bp, Mus musculus
atcattgatggcaagatcttctgtg

SEQ ID NO: 207842 - DNA, 25 bp, Mus musculus
atcattgatgggaatccggaaacct

SEQ ID NO: 207843 - DNA, 25 bp, Mus musculus
atcattgatggtcctgcttggcgag

SEQ ID NO: 207844 - DNA, 25 bp, Mus musculus
atcattgcaaaggatgaagtcgccc

SEQ ID NO: 207845 - DNA, 25 bp, Mus musculus
atcattgcaatctccacatggtcta

SEQ ID NO: 207846 - DNA, 25 bp, Mus musculus
atcattgcagatgttcgagctgcaa

SEQ ID NO: 207847 - DNA, 25 bp, Mus musculus
atcattgcagctgtgatcactgctg

SEQ ID NO: 207848 - DNA, 25 bp, Mus musculus
atcattgcaggctcaaacatactgg

SEQ ID NO: 207849 - DNA, 25 bp, Mus musculus
atcattgcatatgatcactctcggg

SEQ ID NO: 207850 - DNA, 25 bp, Mus musculus
atcattgcatccatgccgagctccg

SEQ ID NO: 207851 - DNA, 25 bp, Mus musculus
atcattgccaacccagtgaactcca

SEQ ID NO: 207852 - DNA, 25 bp, Mus musculus
atcattgctacagagtacctgaact

SEQ ID NO: 207853 - DNA, 25 bp, Mus musculus
atcattgctcaagaccccggcagcc

SEQ ID NO: 207854 - DNA, 25 bp, Mus musculus
atcattggaaacaagaatgcctacg

SEQ ID NO: 207855 - DNA, 25 bp, Mus musculus
atcattggcgattccggggtgcacc

SEQ ID NO: 207856 - DNA, 25 bp, Mus musculus
atcattggcggtgcccagatcattg

SEQ ID NO: 207857 - DNA, 25 bp, Mus musculus
atcattgtccgtgcaaaactggtga

SEQ ID NO: 207858 - DNA, 25 bp, Mus musculus
atcattgtggtcaaggacggacccg

SEQ ID NO: 207859 - DNA, 25 bp, Mus musculus
atcatttaatggtcaggggagtaca

SEQ ID NO: 207860 - DNA, 25 bp, Mus musculus
atcatttagaggacattcactgaac

SEQ ID NO: 207861 - DNA, 25 bp, Mus musculus
atcatttatggagggttcctggtac

SEQ ID NO: 207862 - DNA, 25 bp, Mus musculus
atcatttcaaccgaattggcaaggt

SEQ ID NO: 207863 - DNA, 25 bp, Mus musculus
atcatttcaagagtgagaagcgcca

SEQ ID NO: 207864 - DNA, 25 bp, Mus musculus
atcatttcagaagcatgtaatgagg

SEQ ID NO: 207865 - DNA, 25 bp, Mus musculus
atcatttcctttgaggaaatggatc

SEQ ID NO: 207866 - DNA, 25 bp, Mus musculus
atcatttgtaccatctgtaccgtgg

SEQ ID NO: 207867 - DNA, 25 bp, Mus musculus
atcatttttaagaggcaagaaacaa

SEQ ID NO: 207868 - DNA, 25 bp, Mus musculus
atcatttttaatcagtctgttatct

SEQ ID NO: 207869 - DNA, 25 bp, Mus musculus
atcatttttctgacaagcaggtggt

SEQ ID NO: 207870 - DNA, 25 bp, Mus musculus
atcatttttctggtgtgatcctgct

SEQ ID NO: 207871 - DNA, 25 bp, Mus musculus
atcattttttcgtcacagatcacac

SEQ ID NO: 207872 - DNA, 25 bp, Mus musculus
atccaaaaaggatacatgaggatcc

SEQ ID NO: 207873 - DNA, 25 bp, Mus musculus
atccaaaacacacagtgtatgaaga

SEQ ID NO: 207874 - DNA, 25 bp, Mus musculus
atccaaaataccaccaagctcctcc

SEQ ID NO: 207875 - DNA, 25 bp, Mus musculus
atccaaaatcaggaacccactggtt

SEQ ID NO: 207876 - DNA, 25 bp, Mus musculus
atccaaaatcaggcaccccgtggca

SEQ ID NO: 207877 - DNA, 25 bp, Mus musculus
atccaaaatcaggtcacagacgaac

SEQ ID NO: 207878 - DNA, 25 bp, Mus musculus
atccaaaatcaggttgctggctctt

SEQ ID NO: 207879 - DNA, 25 bp, Mus musculus
atccaaaatgaagccaatgctgagg

SEQ ID NO: 207880 - DNA, 25 bp, Mus musculus
atccaaaatgaaggcaaagggatgt

SEQ ID NO: 207881 - DNA, 25 bp, Mus musculus
atccaaacacagatccgagtggtga

SEQ ID NO: 207882 - DNA, 25 bp, Mus musculus
atccaaacacagatggatgtagtga

SEQ ID NO: 207883 - DNA, 25 bp, Mus musculus
atccaaacattgtgcgtctccatga

SEQ ID NO: 207884 - DNA, 25 bp, Mus musculus
atccaaacattgtgttaccggaggg

SEQ ID NO: 207885 - DNA, 25 bp, Mus musculus
atccaaacgggaacaatataagcag

SEQ ID NO: 207886 - DNA, 25 bp, Mus musculus
atccaaactacattgccaaccgagg

SEQ ID NO: 207887 - DNA, 25 bp, Mus musculus
atccaaactacattgttttcatctt

SEQ ID NO: 207888 - DNA, 25 bp, Mus musculus
atccaaagacacttcctctctctgg

SEQ ID NO: 207889 - DNA, 25 bp, Mus musculus
atccaaagagcagcacctgacgttc

SEQ ID NO: 207890 - DNA, 25 bp, Mus musculus
atccaaagaggagatctttttgctt

SEQ ID NO: 207891 - DNA, 25 bp, Mus musculus
atccaaatatacaaggctcaaactc

SEQ ID NO: 207892 - DNA, 25 bp, Mus musculus
atccaaatcagacccggcactgata

SEQ ID NO: 207893 - DNA, 25 bp, Mus musculus
atccaacaccaacagatgttctgat

SEQ ID NO: 207894 - DNA, 25 bp, Mus musculus
atccaacaccaacaggggtggtgga

SEQ ID NO: 207895 - DNA, 25 bp, Mus musculus
atccaacaccccgctgctgccttcc

SEQ ID NO: 207896 - DNA, 25 bp, Mus musculus
atccaacaccccgcttctcttgcct

SEQ ID NO: 207897 - DNA, 25 bp, Mus musculus
atccaacagagcccagcagcagctg

SEQ ID NO: 207898 - DNA, 25 bp, Mus musculus
atccaacatacaaagacgacgctca

SEQ ID NO: 207899 - DNA, 25 bp, Mus musculus
atccaacatacaaagctggcttaat

SEQ ID NO: 207900 - DNA, 25 bp, Mus musculus
atccaacatcaatagtggagatttt

SEQ ID NO: 207901 - DNA, 25 bp, Mus musculus
atccaacatcaatagtgtaattatt

SEQ ID NO: 207902 - DNA, 25 bp, Mus musculus
atccaaccctcgaatcaacctaccg

SEQ ID NO: 207903 - DNA, 25 bp, Mus musculus
atccaacctccaaagctcatttttc

SEQ ID NO: 207904 - DNA, 25 bp, Mus musculus
atccaacctccaaaggacacaccag

SEQ ID NO: 207905 - DNA, 25 bp, Mus musculus
atccaacctcctaggaaagctgtag

SEQ ID NO: 207906 - DNA, 25 bp, Mus musculus
atccaacctcctaggaataggtgaa

SEQ ID NO: 207907 - DNA, 25 bp, Mus musculus
atccaacctttgccatgggccttgc

SEQ ID NO: 207908 - DNA, 25 bp, Mus musculus
atccaacgacaatcagcgccttgct

SEQ ID NO: 207909 - DNA, 25 bp, Mus musculus
atccaacgacattgatacactaaag

SEQ ID NO: 207910 - DNA, 25 bp, Mus musculus
atccaagaaagatcgctcctttgat

SEQ ID NO: 207911 - DNA, 25 bp, Mus musculus
atccaagaactgctgtctattgcat

SEQ ID NO: 207912 - DNA, 25 bp, Mus musculus
atccaagaatatagtcaagttacaa

SEQ ID NO: 207913 - DNA, 25 bp, Mus musculus
atccaagacaaaagatttgcaacag

SEQ ID NO: 207914 - DNA, 25 bp, Mus musculus
atccaagagtcggccacaggttgtg

SEQ ID NO: 207915 - DNA, 25 bp, Mus musculus
atccaagatctgaaagttgggatgg

SEQ ID NO: 207916 - DNA, 25 bp, Mus musculus
atccaagcaggctgtcgcttaccgc

SEQ ID NO: 207917 - DNA, 25 bp, Mus musculus
atccaagccaagtgccctccaagaa

SEQ ID NO: 207918 - DNA, 25 bp, Mus musculus
atccaagccagatcgacagcaaaga

SEQ ID NO: 207919 - DNA, 25 bp, Mus musculus
atccaagccagatcgccctacatga

SEQ ID NO: 207920 - DNA, 25 bp, Mus musculus
atccaagggccaggagactgttctg

SEQ ID NO: 207921 - DNA, 25 bp, Mus musculus
atccaagggcttattctcagctctt

SEQ ID NO: 207922 - DNA, 25 bp, Mus musculus
atccaagggggtgcctgtgggccga

SEQ ID NO: 207923 - DNA, 25 bp, Mus musculus
atccaagtaatgagaggaagacgac

SEQ ID NO: 207924 - DNA, 25 bp, Mus musculus
atccaagtgagttacaagacttaaa

SEQ ID NO: 207925 - DNA, 25 bp, Mus musculus
atccaagtgccaggtacaaccagca

SEQ ID NO: 207926 - DNA, 25 bp, Mus musculus
atccaagtgggtattccatgtctga

SEQ ID NO: 207927 - DNA, 25 bp, Mus musculus
atccaagttggcaggaacatcattc

SEQ ID NO: 207928 - DNA, 25 bp, Mus musculus
atccaatagagaggttgatgttttg

SEQ ID NO: 207929 - DNA, 25 bp, Mus musculus
atccaatattcacaggtattccttt

SEQ ID NO: 207930 - DNA, 25 bp, Mus musculus
atccaatcctgtcaggtgaaaatgc

SEQ ID NO: 207931 - DNA, 25 bp, Mus musculus
atccaatcggaagggtcctaaacaa

SEQ ID NO: 207932 - DNA, 25 bp, Mus musculus
atccaatgaagccctcttattacag

SEQ ID NO: 207933 - DNA, 25 bp, Mus musculus
atccaatgaaggaaaaggtgcggct

SEQ ID NO: 207934 - DNA, 25 bp, Mus musculus
atccaatgccaatcgctgcctccag

SEQ ID NO: 207935 - DNA, 25 bp, Mus musculus
atccaattctataggtcctgaggga

SEQ ID NO: 207936 - DNA, 25 bp, Mus musculus
atccacaaagaggcggttacaggga

SEQ ID NO: 207937 - DNA, 25 bp, Mus musculus
atccacaacaggtgtgagcaggtgg

SEQ ID NO: 207938 - DNA, 25 bp, Mus musculus
atccacaacaggttccacccgactc

SEQ ID NO: 207939 - DNA, 25 bp, Mus musculus
atccacaacagtgagaggactttta

SEQ ID NO: 207940 - DNA, 25 bp, Mus musculus
atccacaacccagccaccaatgaag

SEQ ID NO: 207941 - DNA, 25 bp, Mus musculus
atccacaactgcaggctgtttggtc

SEQ ID NO: 207942 - DNA, 25 bp, Mus musculus
atccacaaggataggtcatgctgtg

SEQ ID NO: 207943 - DNA, 25 bp, Mus musculus
atccacaagtgcgaggactgcggga

SEQ ID NO: 207944 - DNA, 25 bp, Mus musculus
atccacacagcaggacagttgtcca

SEQ ID NO: 207945 - DNA, 25 bp, Mus musculus
atccacacaggcgagaagcctcaca

SEQ ID NO: 207946 - DNA, 25 bp, Mus musculus
atccacaccgccgtgacgtcttacg

SEQ ID NO: 207947 - DNA, 25 bp, Mus musculus
atccacaccgcttgcttgggtcctg

SEQ ID NO: 207948 - DNA, 25 bp, Mus musculus
atccacactggaaagggcagcctct

SEQ ID NO: 207949 - DNA, 25 bp, Mus musculus
atccacagagatgtgaagccatcca

SEQ ID NO: 207950 - DNA, 25 bp, Mus musculus
atccacagagcttggctgaagagga

SEQ ID NO: 207951 - DNA, 25 bp, Mus musculus
atccacagcagttgagtggtgattt

SEQ ID NO: 207952 - DNA, 25 bp, Mus musculus
atccacagcccctttgacactcctc

SEQ ID NO: 207953 - DNA, 25 bp, Mus musculus
atccacaggaacaagatcctgcaca

SEQ ID NO: 207954 - DNA, 25 bp, Mus musculus
atccacaggaacaaggtgtggccaa

SEQ ID NO: 207955 - DNA, 25 bp, Mus musculus
atccacaggatgaaggttaggcacg

SEQ ID NO: 207956 - DNA, 25 bp, Mus musculus
atccacaggcagtgaggaatggtga

SEQ ID NO: 207957 - DNA, 25 bp, Mus musculus
atccacagtggagatccagacaggc

SEQ ID NO: 207958 - DNA, 25 bp, Mus musculus
atccacattgagagcaccaagaccg

SEQ ID NO: 207959 - DNA, 25 bp, Mus musculus
atccaccacagataactctcttcac

SEQ ID NO: 207960 - DNA, 25 bp, Mus musculus
atccaccacaggaggaaaaagaaat

SEQ ID NO: 207961 - DNA, 25 bp, Mus musculus
atccaccatcaagagcaccccatct

SEQ ID NO: 207962 - DNA, 25 bp, Mus musculus
atccaccattactctacggctggcc

SEQ ID NO: 207963 - DNA, 25 bp, Mus musculus
atccacccagcaagaaaaagccaca

SEQ ID NO: 207964 - DNA, 25 bp, Mus musculus
atccaccccaagaaaaagctccctg

SEQ ID NO: 207965 - DNA, 25 bp, Mus musculus
atccacccgagaagacagcatgaag

SEQ ID NO: 207966 - DNA, 25 bp, Mus musculus
atccacccgagcactgtctatggag

SEQ ID NO: 207967 - DNA, 25 bp, Mus musculus
atccaccctgacaggatgcaagctg

SEQ ID NO: 207968 - DNA, 25 bp, Mus musculus
atccaccctgacaggcaggtaccac

SEQ ID NO: 207969 - DNA, 25 bp, Mus musculus
atccaccctgacaggggcataagga

SEQ ID NO: 207970 - DNA, 25 bp, Mus musculus
atccaccgcggagatggatggcctt

SEQ ID NO: 207971 - DNA, 25 bp, Mus musculus
atccaccgcgggaccttctgtctcc

SEQ ID NO: 207972 - DNA, 25 bp, Mus musculus
atccacctgtgaggtttcaagtgcc

SEQ ID NO: 207973 - DNA, 25 bp, Mus musculus
atccacgcagcctctgcctcggtgc

SEQ ID NO: 207974 - DNA, 25 bp, Mus musculus
atccacgcagctgccccttaccggg

SEQ ID NO: 207975 - DNA, 25 bp, Mus musculus
atccacggaggaggagctgatccac

SEQ ID NO: 207976 - DNA, 25 bp, Mus musculus
atccacggaggccctgcccaggaag

SEQ ID NO: 207977 - DNA, 25 bp, Mus musculus
atccacggagtcagaactgggctct

SEQ ID NO: 207978 - DNA, 25 bp, Mus musculus
atccacggagtcaggacggggctct

SEQ ID NO: 207979 - DNA, 25 bp, Mus musculus
atccacgttctagattggccgtttg

SEQ ID NO: 207980 - DNA, 25 bp, Mus musculus
atccacgttctaggctcctgtgcta

SEQ ID NO: 207981 - DNA, 25 bp, Mus musculus
atccactgaaacattttaacagtga

SEQ ID NO: 207982 - DNA, 25 bp, Mus musculus
atccactgtcctcactatgcccgac

SEQ ID NO: 207983 - DNA, 25 bp, Mus musculus
atccacttatcacttcattgtatct

SEQ ID NO: 207984 - DNA, 25 bp, Mus musculus
atccacttatcagttcattgtatct

SEQ ID NO: 207985 - DNA, 25 bp, Mus musculus
atccactttcttgggtctttggggc

SEQ ID NO: 207986 - DNA, 25 bp, Mus musculus
atccactttgtcaagtggattaccg

SEQ ID NO: 207987 - DNA, 25 bp, Mus musculus
atccagaaaagctctccgtaaattc

SEQ ID NO: 207988 - DNA, 25 bp, Mus musculus
atccagaaaagctgtcttcagacac

SEQ ID NO: 207989 - DNA, 25 bp, Mus musculus
atccagaaacgagaagaagcagacc

SEQ ID NO: 207990 - DNA, 25 bp, Mus musculus
atccagaaagatcaagagcacctgg

SEQ ID NO: 207991 - DNA, 25 bp, Mus musculus
atccagaaagatctggccaacatag

SEQ ID NO: 207992 - DNA, 25 bp, Mus musculus
atccagaaatccaagaaaatgtaca

SEQ ID NO: 207993 - DNA, 25 bp, Mus musculus
atccagaacaatggagacaccaaga

SEQ ID NO: 207994 - DNA, 25 bp, Mus musculus
atccagaacagggcgtgcctaggac

SEQ ID NO: 207995 - DNA, 25 bp, Mus musculus
atccagaacaggtgaccttggagtg

SEQ ID NO: 207996 - DNA, 25 bp, Mus musculus
atccagaacctggagaatgtggttg

SEQ ID NO: 207997 - DNA, 25 bp, Mus musculus
atccagaagcagaggacgttcgtaa

SEQ ID NO: 207998 - DNA, 25 bp, Mus musculus
atccagaagtttggggacctggaag

SEQ ID NO: 207999 - DNA, 25 bp, Mus musculus
atccagaatggtggccacttggatg

SEQ ID NO: 208000 - DNA, 25 bp, Mus musculus
atccagaatgtggatcggtcatggg

SEQ ID NO: 208001 - DNA, 25 bp, Mus musculus
atccagaattgattacaacaaccct

SEQ ID NO: 208002 - DNA, 25 bp, Mus musculus
atccagacaaccaggtcagaaaacc

SEQ ID NO: 208003 - DNA, 25 bp, Mus musculus
atccagacaacggccccacctgtca

SEQ ID NO: 208004 - DNA, 25 bp, Mus musculus
atccagacacagatggaggtagtga

SEQ ID NO: 208005 - DNA, 25 bp, Mus musculus
atccagacacaggcaactggcccga

SEQ ID NO: 208006 - DNA, 25 bp, Mus musculus
atccagacacgcagttacagaccac

SEQ ID NO: 208007 - DNA, 25 bp, Mus musculus
atccagacacgcattcctgggagat

SEQ ID NO: 208008 - DNA, 25 bp, Mus musculus
atccagaccccatttgggttccagt

SEQ ID NO: 208009 - DNA, 25 bp, Mus musculus
atccagacctcaggtttaacacaca

SEQ ID NO: 208010 - DNA, 25 bp, Mus musculus
atccagactcggggttctctggaaa

SEQ ID NO: 208011 - DNA, 25 bp, Mus musculus
atccagagccagggaagggcaatgc

SEQ ID NO: 208012 - DNA, 25 bp, Mus musculus
atccagaggaagttgtcctggtcag

SEQ ID NO: 208013 - DNA, 25 bp, Mus musculus
atccagaggcagcaagaaaagcaga

SEQ ID NO: 208014 - DNA, 25 bp, Mus musculus
atccagaggcagctgcgagcttcca

SEQ ID NO: 208015 - DNA, 25 bp, Mus musculus
atccagaggcagttagccttacaag

SEQ ID NO: 208016 - DNA, 25 bp, Mus musculus
atccagagggcattgacctagagac

SEQ ID NO: 208017 - DNA, 25 bp, Mus musculus
atccagagtggagctgtaatagact

SEQ ID NO: 208018 - DNA, 25 bp, Mus musculus
atccagatcagaaagcctaggacct

SEQ ID NO: 208019 - DNA, 25 bp, Mus musculus
atccagatcagaaaggcagtttgtg

SEQ ID NO: 208020 - DNA, 25 bp, Mus musculus
atccagatcagaaagggtgtgtggg

SEQ ID NO: 208021 - DNA, 25 bp, Mus musculus
atccagatctctatggtcccttttg

SEQ ID NO: 208022 - DNA, 25 bp, Mus musculus
atccagatctgccggatcatgcgtc

SEQ ID NO: 208023 - DNA, 25 bp, Mus musculus
atccagatctgccgggctgcctcta

SEQ ID NO: 208024 - DNA, 25 bp, Mus musculus
atccagatgtaagtgccctggaact

SEQ ID NO: 208025 - DNA, 25 bp, Mus musculus
atccagatgtgcagcgccgagtaca

SEQ ID NO: 208026 - DNA, 25 bp, Mus musculus
atccagatgttccagaagaagctgg

SEQ ID NO: 208027 - DNA, 25 bp, Mus musculus
atccagatgttccaggagggagtat

SEQ ID NO: 208028 - DNA, 25 bp, Mus musculus
atccagcaaacagatactctgtcaa

SEQ ID NO: 208029 - DNA, 25 bp, Mus musculus
atccagcaaacagccaaagttgtta

SEQ ID NO: 208030 - DNA, 25 bp, Mus musculus
atccagcaaaccagaagagcccttg

SEQ ID NO: 208031 - DNA, 25 bp, Mus musculus
atccagcaccagtacctcatgcctg

SEQ ID NO: 208032 - DNA, 25 bp, Mus musculus
atccagcaccttcagctatctaact

SEQ ID NO: 208033 - DNA, 25 bp, Mus musculus
atccagcagacgtcccccgccacag

SEQ ID NO: 208034 - DNA, 25 bp, Mus musculus
atccagcagaggaaaggagagtgtt

SEQ ID NO: 208035 - DNA, 25 bp, Mus musculus
atccagcagaggtgcagttaaaaac

SEQ ID NO: 208036 - DNA, 25 bp, Mus musculus
atccagcagcacttctcctctctga

SEQ ID NO: 208037 - DNA, 25 bp, Mus musculus
atccagcagcaggaccagtgtgtgg

SEQ ID NO: 208038 - DNA, 25 bp, Mus musculus
atccagcagcagtttgtgcagtggg

SEQ ID NO: 208039 - DNA, 25 bp, Mus musculus
atccagcagctcagggactcagcga

SEQ ID NO: 208040 - DNA, 25 bp, Mus musculus
atccagcaggcatccagggcagaag

SEQ ID NO: 208041 - DNA, 25 bp, Mus musculus
atccagcagttacacctggagcact

SEQ ID NO: 208042 - DNA, 25 bp, Mus musculus
atccagcatgtgtctaacaagcacc

SEQ ID NO: 208043 - DNA, 25 bp, Mus musculus
atccagccccttcagaacctgtctg

SEQ ID NO: 208044 - DNA, 25 bp, Mus musculus
atccagccccttcagctgtgcagaa

SEQ ID NO: 208045 - DNA, 25 bp, Mus musculus
atccagccctacatccagaacccag

SEQ ID NO: 208046 - DNA, 25 bp, Mus musculus
atccagcctgaaactgttattggac

SEQ ID NO: 208047 - DNA, 25 bp, Mus musculus
atccagcctggctgacgttggggtt

SEQ ID NO: 208048 - DNA, 25 bp, Mus musculus
atccagccttggatccaattatagt

SEQ ID NO: 208049 - DNA, 25 bp, Mus musculus
atccagctcactactgtaacagaag

SEQ ID NO: 208050 - DNA, 25 bp, Mus musculus
atccagctcagttctgcgctcgggg

SEQ ID NO: 208051 - DNA, 25 bp, Mus musculus
atccagctgatcgagaaaacataaa

SEQ ID NO: 208052 - DNA, 25 bp, Mus musculus
atccagctgttgcacaaacagcgcc

SEQ ID NO: 208053 - DNA, 25 bp, Mus musculus
atccagcttctagagatcatgaggg

SEQ ID NO: 208054 - DNA, 25 bp, Mus musculus
atccagcttctagagcctgtttctc

SEQ ID NO: 208055 - DNA, 25 bp, Mus musculus
atccagcttgtattgcagttttagt

SEQ ID NO: 208056 - DNA, 25 bp, Mus musculus
atccaggaaacaagaacgtatctcc

SEQ ID NO: 208057 - DNA, 25 bp, Mus musculus
atccaggaacctctcctcctggctg

SEQ ID NO: 208058 - DNA, 25 bp, Mus musculus
atccaggaagaaattccaaattaca

SEQ ID NO: 208059 - DNA, 25 bp, Mus musculus
atccaggaaggctcagcaacaactt

SEQ ID NO: 208060 - DNA, 25 bp, Mus musculus
atccaggacacgtttctgtgttgtg

SEQ ID NO: 208061 - DNA, 25 bp, Mus musculus
atccaggacagttgtccacgtacag

SEQ ID NO: 208062 - DNA, 25 bp, Mus musculus
atccaggacatagagaccatagaat

SEQ ID NO: 208063 - DNA, 25 bp, Mus musculus
atccaggacctcaaggacggtattt

SEQ ID NO: 208064 - DNA, 25 bp, Mus musculus
atccaggacgaagggtcctgtgcgc

SEQ ID NO: 208065 - DNA, 25 bp, Mus musculus
atccaggagacaaattgagacctac

SEQ ID NO: 208066 - DNA, 25 bp, Mus musculus
atccaggagacaagcatctaatgat

SEQ ID NO: 208067 - DNA, 25 bp, Mus musculus
atccaggaggtcaagattcgggaag

SEQ ID NO: 208068 - DNA, 25 bp, Mus musculus
atccaggagtcccagtgtcttgctg

SEQ ID NO: 208069 - DNA, 25 bp, Mus musculus
atccaggatgggccgaaagaattca

SEQ ID NO: 208070 - DNA, 25 bp, Mus musculus
atccaggcagagctggcaccagaaa

SEQ ID NO: 208071 - DNA, 25 bp, Mus musculus
atccaggcagatgaagaggtcggca

SEQ ID NO: 208072 - DNA, 25 bp, Mus musculus
atccaggcagctgggtaccgggtgc

SEQ ID NO: 208073 - DNA, 25 bp, Mus musculus
atccaggcaggtataaaagaggtta

SEQ ID NO: 208074 - DNA, 25 bp, Mus musculus
atccaggccaggctgggcagcatcg

SEQ ID NO: 208075 - DNA, 25 bp, Mus musculus
atccaggccaggtacatctatggga

SEQ ID NO: 208076 - DNA, 25 bp, Mus musculus
atccaggccattgtggaaagccccc

SEQ ID NO: 208077 - DNA, 25 bp, Mus musculus
atccaggctgacaaggcccttttag

SEQ ID NO: 208078 - DNA, 25 bp, Mus musculus
atccaggcttgccctctgttttctg

SEQ ID NO: 208079 - DNA, 25 bp, Mus musculus
atccagggcaagaaagtatccacgg

SEQ ID NO: 208080 - DNA, 25 bp, Mus musculus
atccagggcaaggtatgtcctctgg

SEQ ID NO: 208081 - DNA, 25 bp, Mus musculus
atccagggccctccgggcagagcgc

SEQ ID NO: 208082 - DNA, 25 bp, Mus musculus
atccaggggtggtcgggctcagaaa

SEQ ID NO: 208083 - DNA, 25 bp, Mus musculus
atccaggggtggtcggtggatggct

SEQ ID NO: 208084 - DNA, 25 bp, Mus musculus
atccaggttcccagtttagccaggc

SEQ ID NO: 208085 - DNA, 25 bp, Mus musculus
atccaggttgtagcaaatgacaaga

SEQ ID NO: 208086 - DNA, 25 bp, Mus musculus
atccagtaaagccaacaaattactc

SEQ ID NO: 208087 - DNA, 25 bp, Mus musculus
atccagtaaagtccaggtacatagg

SEQ ID NO: 208088 - DNA, 25 bp, Mus musculus
atccagtacaggtgaatatactgta

SEQ ID NO: 208089 - DNA, 25 bp, Mus musculus
atccagtcaaggaggaggatgacta

SEQ ID NO: 208090 - DNA, 25 bp, Mus musculus
atccagtcaaggatgactatgacgt

SEQ ID NO: 208091 - DNA, 25 bp, Mus musculus
atccagtccacagccattcctgcgc

SEQ ID NO: 208092 - DNA, 25 bp, Mus musculus
atccagtgagaaaattgtacaatct

SEQ ID NO: 208093 - DNA, 25 bp, Mus musculus
atccagtgaggaatcttccgaggaa

SEQ ID NO: 208094 - DNA, 25 bp, Mus musculus
atccagtgaggcctcaggtccaggc

SEQ ID NO: 208095 - DNA, 25 bp, Mus musculus
atccagtgccagcccaggcctccag

SEQ ID NO: 208096 - DNA, 25 bp, Mus musculus
atccagttattcagtggttctggga

SEQ ID NO: 208097 - DNA, 25 bp, Mus musculus
atccagttattcagttcgttactgg

SEQ ID NO: 208098 - DNA, 25 bp, Mus musculus
atccagttcaggatgagatgctggc

SEQ ID NO: 208099 - DNA, 25 bp, Mus musculus
atccagttccaagaggtgggatgct

SEQ ID NO: 208100 - DNA, 25 bp, Mus musculus
atccataaacacggcttttttcaca

SEQ ID NO: 208101 - DNA, 25 bp, Mus musculus
atccataaacatgctcagcaaagaa

SEQ ID NO: 208102 - DNA, 25 bp, Mus musculus
atccataaacatggaataccaaatt

SEQ ID NO: 208103 - DNA, 25 bp, Mus musculus
atccataaagaggatggagatattc

SEQ ID NO: 208104 - DNA, 25 bp, Mus musculus
atccatagaacagaactcatgggaa

SEQ ID NO: 208105 - DNA, 25 bp, Mus musculus
atccatagaacaggccaaagtagaa

SEQ ID NO: 208106 - DNA, 25 bp, Mus musculus
atccatcaactaaccaatactggag

SEQ ID NO: 208107 - DNA, 25 bp, Mus musculus
atccatcaagtgggttcatgtactg

SEQ ID NO: 208108 - DNA, 25 bp, Mus musculus
atccatcagtacagggagcagatca

SEQ ID NO: 208109 - DNA, 25 bp, Mus musculus
atccatcagtacagtcatgcctgca

SEQ ID NO: 208110 - DNA, 25 bp, Mus musculus
atccatccgcgaggaaatctcagaa

SEQ ID NO: 208111 - DNA, 25 bp, Mus musculus
atccatcctgcagaagcaccctagg

SEQ ID NO: 208112 - DNA, 25 bp, Mus musculus
atccatcgcaagtccacttgatccc

SEQ ID NO: 208113 - DNA, 25 bp, Mus musculus
atccatcggagccggggggacctcg

SEQ ID NO: 208114 - DNA, 25 bp, Mus musculus
atccatcggcaccggcttttcctag

SEQ ID NO: 208115 - DNA, 25 bp, Mus musculus
atccatctacaggcctgtccactgg

SEQ ID NO: 208116 - DNA, 25 bp, Mus musculus
atccatctcagggttctggctgctt

SEQ ID NO: 208117 - DNA, 25 bp, Mus musculus
atccatgaaaagcaagatgggcata

SEQ ID NO: 208118 - DNA, 25 bp, Mus musculus
atccatgaacaagaagtcctaccct

SEQ ID NO: 208119 - DNA, 25 bp, Mus musculus
atccatgaaggagcctacagaaacc

SEQ ID NO: 208120 - DNA, 25 bp, Mus musculus
atccatgaaggagtccgctcagaat

SEQ ID NO: 208121 - DNA, 25 bp, Mus musculus
atccatgacaaggagtatgtcaggg

SEQ ID NO: 208122 - DNA, 25 bp, Mus musculus
atccatgagaaggtactgaatgagg

SEQ ID NO: 208123 - DNA, 25 bp, Mus musculus
atccatgagtactacagcatgggcg

SEQ ID NO: 208124 - DNA, 25 bp, Mus musculus
atccatgcagtattcaagagacagt

SEQ ID NO: 208125 - DNA, 25 bp, Mus musculus
atccatggacatgatgttgacggca

SEQ ID NO: 208126 - DNA, 25 bp, Mus musculus
atccatggacatgcacaatatcgcc

SEQ ID NO: 208127 - DNA, 25 bp, Mus musculus
atccatggagggctgagccggatct

SEQ ID NO: 208128 - DNA, 25 bp, Mus musculus
atccatggcatcagaacggggctct

SEQ ID NO: 208129 - DNA, 25 bp, Mus musculus
atccatggcatcaggacgggcctct

SEQ ID NO: 208130 - DNA, 25 bp, Mus musculus
atccatgtccactgaggaaacctca

SEQ ID NO: 208131 - DNA, 25 bp, Mus musculus
atccatgtccactgagggtgtgctg

SEQ ID NO: 208132 - DNA, 25 bp, Mus musculus
atccatgtcccacaattctcgacta

SEQ ID NO: 208133 - DNA, 25 bp, Mus musculus
atccatgtcccacagtaacccctct

SEQ ID NO: 208134 - DNA, 25 bp, Mus musculus
atccatgttcgacaccacgccccac

SEQ ID NO: 208135 - DNA, 25 bp, Mus musculus
atccatgttcgagtgctaaggatac

SEQ ID NO: 208136 - DNA, 25 bp, Mus musculus
atccattatgaaattgaagaccaaa

SEQ ID NO: 208137 - DNA, 25 bp, Mus musculus
atccattatgaagaaacagggaagc

SEQ ID NO: 208138 - DNA, 25 bp, Mus musculus
atccattcaaaggcattggccagga

SEQ ID NO: 208139 - DNA, 25 bp, Mus musculus
atccattcacctacgattaccacac

SEQ ID NO: 208140 - DNA, 25 bp, Mus musculus
atccattcacctacggcaagagatg

SEQ ID NO: 208141 - DNA, 25 bp, Mus musculus
atccattcaggcgtccgcgagttca

SEQ ID NO: 208142 - DNA, 25 bp, Mus musculus
atccattcatttcagttgcctctct

SEQ ID NO: 208143 - DNA, 25 bp, Mus musculus
atccattccggcgcccatggcgaat

SEQ ID NO: 208144 - DNA, 25 bp, Mus musculus
atccattctctccagctctgggccc

SEQ ID NO: 208145 - DNA, 25 bp, Mus musculus
atccattgcataaccccaaatctca

SEQ ID NO: 208146 - DNA, 25 bp, Mus musculus
atccattttcagtgatataccgata

SEQ ID NO: 208147 - DNA, 25 bp, Mus musculus
atccattttcagtgtttgtgaggaa

SEQ ID NO: 208148 - DNA, 25 bp, Mus musculus
atcccaaaagatctagatccagaga

SEQ ID NO: 208149 - DNA, 25 bp, Mus musculus
atcccaaaattgctgtgatcgcctg

SEQ ID NO: 208150 - DNA, 25 bp, Mus musculus
atcccaaagaaccatggatcggttc

SEQ ID NO: 208151 - DNA, 25 bp, Mus musculus
atcccaaagcctgaaaccaaaattc

SEQ ID NO: 208152 - DNA, 25 bp, Mus musculus
atcccaaagcctgatgaggatgatg

SEQ ID NO: 208153 - DNA, 25 bp, Mus musculus
atcccaacacccagcaagaagtcta

SEQ ID NO: 208154 - DNA, 25 bp, Mus musculus
atcccaaccgagatcctatgattga

SEQ ID NO: 208155 - DNA, 25 bp, Mus musculus
atcccaacgtacagagccattgtca

SEQ ID NO: 208156 - DNA, 25 bp, Mus musculus
atcccaagagggtgtagcccggatc

SEQ ID NO: 208157 - DNA, 25 bp, Mus musculus
atcccaagggaagggaggaagagac

SEQ ID NO: 208158 - DNA, 25 bp, Mus musculus
atcccaagggaaggggagaggcctg

SEQ ID NO: 208159 - DNA, 25 bp, Mus musculus
atcccaagtagcatgctacaaatga

SEQ ID NO: 208160 - DNA, 25 bp, Mus musculus
atcccaagttcaagggaatcaaaga

SEQ ID NO: 208161 - DNA, 25 bp, Mus musculus
atcccaatgctcggtccgcggaggg

SEQ ID NO: 208162 - DNA, 25 bp, Mus musculus
atcccaatgtggaagaagctcagaa

SEQ ID NO: 208163 - DNA, 25 bp, Mus musculus
atcccacagggtggtcatgatcaca

SEQ ID NO: 208164 - DNA, 25 bp, Mus musculus
atcccaccaagctctctgctggaaa

SEQ ID NO: 208165 - DNA, 25 bp, Mus musculus
atcccaccaaggtgaaggcccacgg

SEQ ID NO: 208166 - DNA, 25 bp, Mus musculus
atcccaccaattcccacagagaacc

SEQ ID NO: 208167 - DNA, 25 bp, Mus musculus
atcccaccaccgggtgtgatgaatc

SEQ ID NO: 208168 - DNA, 25 bp, Mus musculus
atcccacccctcaagcatgaccagt

SEQ ID NO: 208169 - DNA, 25 bp, Mus musculus
atcccacccctcaagttcacagctc

SEQ ID NO: 208170 - DNA, 25 bp, Mus musculus
atcccactattggctttggaccttg

SEQ ID NO: 208171 - DNA, 25 bp, Mus musculus
atcccactctgaggagaagaattga

SEQ ID NO: 208172 - DNA, 25 bp, Mus musculus
atcccactctgaggtccagagttca

SEQ ID NO: 208173 - DNA, 25 bp, Mus musculus
atcccactgatgacactttcatggt

SEQ ID NO: 208174 - DNA, 25 bp, Mus musculus
atcccactgtacaacatcagccatg

SEQ ID NO: 208175 - DNA, 25 bp, Mus musculus
atcccactgtacaacttgactggtc

SEQ ID NO: 208176 - DNA, 25 bp, Mus musculus
atcccactgtgcaaactctggcctg

SEQ ID NO: 208177 - DNA, 25 bp, Mus musculus
atcccagaaaggatgaggccatcct

SEQ ID NO: 208178 - DNA, 25 bp, Mus musculus
atcccagacagacggtggcgcctca

SEQ ID NO: 208179 - DNA, 25 bp, Mus musculus
atcccagacagagatgctgcctggg

SEQ ID NO: 208180 - DNA, 25 bp, Mus musculus
atcccagagccaaaaaccaaagatg

SEQ ID NO: 208181 - DNA, 25 bp, Mus musculus
atcccagagccaaaacttccacgga

SEQ ID NO: 208182 - DNA, 25 bp, Mus musculus
atcccagatctctctggcttttggg

SEQ ID NO: 208183 - DNA, 25 bp, Mus musculus
atcccagatgctcatctttgggtaa

SEQ ID NO: 208184 - DNA, 25 bp, Mus musculus
atcccagcagcaagaaggtgacggg

SEQ ID NO: 208185 - DNA, 25 bp, Mus musculus
atcccagcagcaagtgggcagaagt

SEQ ID NO: 208186 - DNA, 25 bp, Mus musculus
atcccagcagcattctgcagacctc

SEQ ID NO: 208187 - DNA, 25 bp, Mus musculus
atcccagccctcacctcctgtctca

SEQ ID NO: 208188 - DNA, 25 bp, Mus musculus
atcccagccggagtgttcttttgtt

SEQ ID NO: 208189 - DNA, 25 bp, Mus musculus
atcccagcgaaaagcccattggaat

SEQ ID NO: 208190 - DNA, 25 bp, Mus musculus
atcccagctggaagcaggagaggaa

SEQ ID NO: 208191 - DNA, 25 bp, Mus musculus
atcccagctgtcgctgactcccctg

SEQ ID NO: 208192 - DNA, 25 bp, Mus musculus
atcccaggaaaggtgattgatgaga

SEQ ID NO: 208193 - DNA, 25 bp, Mus musculus
atcccaggaacaggtatacaagaga

SEQ ID NO: 208194 - DNA, 25 bp, Mus musculus
atcccaggaagctggagaaggggtg

SEQ ID NO: 208195 - DNA, 25 bp, Mus musculus
atcccaggaagctggtccagctcag

SEQ ID NO: 208196 - DNA, 25 bp, Mus musculus
atcccaggagatcttcccacggtgg

SEQ ID NO: 208197 - DNA, 25 bp, Mus musculus
atcccaggggaaggctactacatgg

SEQ ID NO: 208198 - DNA, 25 bp, Mus musculus
atcccagggttacagacagggtttc

SEQ ID NO: 208199 - DNA, 25 bp, Mus musculus
atcccagggttacagatgctctctg

SEQ ID NO: 208200 - DNA, 25 bp, Mus musculus
atcccaggtgacaccgcttggctcc

SEQ ID NO: 208201 - DNA, 25 bp, Mus musculus
atcccagtgctgcacatgatggcat

SEQ ID NO: 208202 - DNA, 25 bp, Mus musculus
atcccagtgctgggtctcttttaaa

SEQ ID NO: 208203 - DNA, 25 bp, Mus musculus
atcccagttctcagagccccgtatt

SEQ ID NO: 208204 - DNA, 25 bp, Mus musculus
atcccatacctgctgagggacccag

SEQ ID NO: 208205 - DNA, 25 bp, Mus musculus
atcccatacctgctgctccagcacg

SEQ ID NO: 208206 - DNA, 25 bp, Mus musculus
atcccatatatgtggggccgagcaa

SEQ ID NO: 208207 - DNA, 25 bp, Mus musculus
atcccatcacctggaacaacctgaa

SEQ ID NO: 208208 - DNA, 25 bp, Mus musculus
atcccatcagccgagatgaacctct

SEQ ID NO: 208209 - DNA, 25 bp, Mus musculus
atcccatctccgatggtggaaccag

SEQ ID NO: 208210 - DNA, 25 bp, Mus musculus
atcccatctgcttcgagagctgtgc

SEQ ID NO: 208211 - DNA, 25 bp, Mus musculus
atcccatgaccaaaggactctgatc

SEQ ID NO: 208212 - DNA, 25 bp, Mus musculus
atcccatgcagctcggggtctggtt

SEQ ID NO: 208213 - DNA, 25 bp, Mus musculus
atcccatgcccctgtttcactggct

SEQ ID NO: 208214 - DNA, 25 bp, Mus musculus
atcccatggaacaccccatgcttac

SEQ ID NO: 208215 - DNA, 25 bp, Mus musculus
atcccatgtgtgcagcttccattga

SEQ ID NO: 208216 - DNA, 25 bp, Mus musculus
atcccatgtgtgcaggttgtacttg

SEQ ID NO: 208217 - DNA, 25 bp, Mus musculus
atcccattggaaagatggtggaacc

SEQ ID NO: 208218 - DNA, 25 bp, Mus musculus
atcccattgtgggagagccaggcta

SEQ ID NO: 208219 - DNA, 25 bp, Mus musculus
atccccaaacccaggtctggaggtg

SEQ ID NO: 208220 - DNA, 25 bp, Mus musculus
atccccaaagatggacaaaagagaa

SEQ ID NO: 208221 - DNA, 25 bp, Mus musculus
atccccaacacggtcggaaactccg

SEQ ID NO: 208222 - DNA, 25 bp, Mus musculus
atccccaacagcgggaacttcattg

SEQ ID NO: 208223 - DNA, 25 bp, Mus musculus
atccccaacaggtggtgaagcagta

SEQ ID NO: 208224 - DNA, 25 bp, Mus musculus
atccccaacttcaagggtgctgctc

SEQ ID NO: 208225 - DNA, 25 bp, Mus musculus
atccccaagaaccagacccgagtca

SEQ ID NO: 208226 - DNA, 25 bp, Mus musculus
atccccaatacctgtcctagcctgt

SEQ ID NO: 208227 - DNA, 25 bp, Mus musculus
atccccaatgtggaaaccatccttg

SEQ ID NO: 208228 - DNA, 25 bp, Mus musculus
atccccacagataattctgaaataa

SEQ ID NO: 208229 - DNA, 25 bp, Mus musculus
atccccacagcacgccactggcaga

SEQ ID NO: 208230 - DNA, 25 bp, Mus musculus
atccccacagcagtcctgtggatca

SEQ ID NO: 208231 - DNA, 25 bp, Mus musculus
atccccacaggagaaatgctcttct

SEQ ID NO: 208232 - DNA, 25 bp, Mus musculus
atccccacagggtcagttttgtgca

SEQ ID NO: 208233 - DNA, 25 bp, Mus musculus
atccccacaggtgatggacagaatc

SEQ ID NO: 208234 - DNA, 25 bp, Mus musculus
atccccacagtacccatgatgcaca

SEQ ID NO: 208235 - DNA, 25 bp, Mus musculus
atccccaccaggacctgcaagcaca

SEQ ID NO: 208236 - DNA, 25 bp, Mus musculus
atccccaccgtctttgacaactatt

SEQ ID NO: 208237 - DNA, 25 bp, Mus musculus
atccccaccgtgacgtgttcttaat

SEQ ID NO: 208238 - DNA, 25 bp, Mus musculus
atccccagacagttacacgtctgct

SEQ ID NO: 208239 - DNA, 25 bp, Mus musculus
atccccagacgagcaccaaggaaat

SEQ ID NO: 208240 - DNA, 25 bp, Mus musculus
atccccagagagaaccttcttccac

SEQ ID NO: 208241 - DNA, 25 bp, Mus musculus
atccccagagagatgaggaaagtga

SEQ ID NO: 208242 - DNA, 25 bp, Mus musculus
atccccagagagcatttctggctgc

SEQ ID NO: 208243 - DNA, 25 bp, Mus musculus
atccccagaggattatcacaaaatt

SEQ ID NO: 208244 - DNA, 25 bp, Mus musculus
atccccagccctattcaggttattg

SEQ ID NO: 208245 - DNA, 25 bp, Mus musculus
atccccagccctcaacttaatgagc

SEQ ID NO: 208246 - DNA, 25 bp, Mus musculus
atccccagttcccaggtctttcata

SEQ ID NO: 208247 - DNA, 25 bp, Mus musculus
atccccagttcctggaccctgtatt

SEQ ID NO: 208248 - DNA, 25 bp, Mus musculus
atccccagttcttagaccctgtatt

SEQ ID NO: 208249 - DNA, 25 bp, Mus musculus
atccccagttgtccccaaggtcagc

SEQ ID NO: 208250 - DNA, 25 bp, Mus musculus
atccccatagcagacaacaacagtt

SEQ ID NO: 208251 - DNA, 25 bp, Mus musculus
atccccatagcaggggaagaagagg

SEQ ID NO: 208252 - DNA, 25 bp, Mus musculus
atccccatagcaggtattccagcat

SEQ ID NO: 208253 - DNA, 25 bp, Mus musculus
atccccatcaagaaatctgaccctg

SEQ ID NO: 208254 - DNA, 25 bp, Mus musculus
atccccatcaggccaaccagaggag

SEQ ID NO: 208255 - DNA, 25 bp, Mus musculus
atccccatcgataggcccagcagct

SEQ ID NO: 208256 - DNA, 25 bp, Mus musculus
atccccatcgataggctcaggtatt

SEQ ID NO: 208257 - DNA, 25 bp, Mus musculus
atccccatcgatagtgtgtgccctt

SEQ ID NO: 208258 - DNA, 25 bp, Mus musculus
atccccatgaagagtctttgcagtt

SEQ ID NO: 208259 - DNA, 25 bp, Mus musculus
atcccccaagagcaagagaagcagc

SEQ ID NO: 208260 - DNA, 25 bp, Mus musculus
atcccccaaggaagctctttgtgtt

SEQ ID NO: 208261 - DNA, 25 bp, Mus musculus
atcccccaatgtgccttcaggatgt

SEQ ID NO: 208262 - DNA, 25 bp, Mus musculus
atcccccaccagaaggaccctgctc

SEQ ID NO: 208263 - DNA, 25 bp, Mus musculus
atcccccaccagaaggtggtagcca

SEQ ID NO: 208264 - DNA, 25 bp, Mus musculus
atcccccagagaggccaggctggga

SEQ ID NO: 208265 - DNA, 25 bp, Mus musculus
atcccccagagagtcatggaccaac

SEQ ID NO: 208266 - DNA, 25 bp, Mus musculus
atcccccagagccacgagcaatgct

SEQ ID NO: 208267 - DNA, 25 bp, Mus musculus
atcccccagagccaggagcaatgct

SEQ ID NO: 208268 - DNA, 25 bp, Mus musculus
atcccccagggtgaagcactggata

SEQ ID NO: 208269 - DNA, 25 bp, Mus musculus
atcccccagggttgtgacttagaac

SEQ ID NO: 208270 - DNA, 25 bp, Mus musculus
atccccccagccaggatgatgtcta

SEQ ID NO: 208271 - DNA, 25 bp, Mus musculus
atcccccgaaataggctgctggcac

SEQ ID NO: 208272 - DNA, 25 bp, Mus musculus
atcccccgcagcgtttggaaaacga

SEQ ID NO: 208273 - DNA, 25 bp, Mus musculus
atcccccgctgcacaacacccccgc

SEQ ID NO: 208274 - DNA, 25 bp, Mus musculus
atcccccggaatggtgaagtgtgtc

SEQ ID NO: 208275 - DNA, 25 bp, Mus musculus
atccccctcacagtaattcttcagt

SEQ ID NO: 208276 - DNA, 25 bp, Mus musculus
atccccctgtgtgcatcagcatcat

SEQ ID NO: 208277 - DNA, 25 bp, Mus musculus
atccccgagcccggaagagaaaaga

SEQ ID NO: 208278 - DNA, 25 bp, Mus musculus
atccccgatgacaagcttgctcgcc

SEQ ID NO: 208279 - DNA, 25 bp, Mus musculus
atccccgatgatcatcccctctgga

SEQ ID NO: 208280 - DNA, 25 bp, Mus musculus
atccccggctacagaactttgtacc

SEQ ID NO: 208281 - DNA, 25 bp, Mus musculus
atccccggctccaggactactacgt

SEQ ID NO: 208282 - DNA, 25 bp, Mus musculus
atccccggggatgagtcctcaaatg

SEQ ID NO: 208283 - DNA, 25 bp, Mus musculus
atccccgtggtacaggccctgttgc

SEQ ID NO: 208284 - DNA, 25 bp, Mus musculus
atcccctaggacccccactcaggag

SEQ ID NO: 208285 - DNA, 25 bp, Mus musculus
atcccctagggagctccgggagcag

SEQ ID NO: 208286 - DNA, 25 bp, Mus musculus
atcccctcagctaacaatgaagagg

SEQ ID NO: 208287 - DNA, 25 bp, Mus musculus
atcccctcatgaaggaagtggagac

SEQ ID NO: 208288 - DNA, 25 bp, Mus musculus
atcccctcatgaagggtacggattg

SEQ ID NO: 208289 - DNA, 25 bp, Mus musculus
atcccctcccaagtttcagattacg

SEQ ID NO: 208290 - DNA, 25 bp, Mus musculus
atcccctcgccccaggcactgggct

SEQ ID NO: 208291 - DNA, 25 bp, Mus musculus
atcccctctgcagtgtatgtggctc

SEQ ID NO: 208292 - DNA, 25 bp, Mus musculus
atcccctgaaacatgctggtgtcta

SEQ ID NO: 208293 - DNA, 25 bp, Mus musculus
atcccctgccccaggacttctctgt

SEQ ID NO: 208294 - DNA, 25 bp, Mus musculus
atcccctgggagtgggaggagtgaa

SEQ ID NO: 208295 - DNA, 25 bp, Mus musculus
atccccttaaaggatcctctgaagc

SEQ ID NO: 208296 - DNA, 25 bp, Mus musculus
atccccttatcagagcctgccccag

SEQ ID NO: 208297 - DNA, 25 bp, Mus musculus
atccccttcagccggattacacagg

SEQ ID NO: 208298 - DNA, 25 bp, Mus musculus
atccccttggaaagcttttatgaaa

SEQ ID NO: 208299 - DNA, 25 bp, Mus musculus
atcccgaccattgggtttaatgtgg

SEQ ID NO: 208300 - DNA, 25 bp, Mus musculus
atcccgactgtgatctgtgagtctc

SEQ ID NO: 208301 - DNA, 25 bp, Mus musculus
atcccgagaatacgcagaccaaact

SEQ ID NO: 208302 - DNA, 25 bp, Mus musculus
atcccgatcaagatcatactctcct

SEQ ID NO: 208303 - DNA, 25 bp, Mus musculus
atcccgcaaggtcccgcacaccatg

SEQ ID NO: 208304 - DNA, 25 bp, Mus musculus
atcccgcagaatatggagggcccca

SEQ ID NO: 208305 - DNA, 25 bp, Mus musculus
atcccgccaggtttctttcagcctc

SEQ ID NO: 208306 - DNA, 25 bp, Mus musculus
atcccgctctccgtagtgaagctgt

SEQ ID NO: 208307 - DNA, 25 bp, Mus musculus
atcccgctggatcaggtattccttt

SEQ ID NO: 208308 - DNA, 25 bp, Mus musculus
atcccgctggatcaggttaactttg

SEQ ID NO: 208309 - DNA, 25 bp, Mus musculus
atcccgctggatcagtttaggattt

SEQ ID NO: 208310 - DNA, 25 bp, Mus musculus
atcccggactctgagacgccacagg

SEQ ID NO: 208311 - DNA, 25 bp, Mus musculus
atcccggagaagaggcaatcaagcc

SEQ ID NO: 208312 - DNA, 25 bp, Mus musculus
atcccggatttttgttgaagtactc

SEQ ID NO: 208313 - DNA, 25 bp, Mus musculus
atcccggctgcagggtctgtcaccg

SEQ ID NO: 208314 - DNA, 25 bp, Mus musculus
atcccgggataggcttctgtgtcag

SEQ ID NO: 208315 - DNA, 25 bp, Mus musculus
atcccgggcaggcagtatgggctta

SEQ ID NO: 208316 - DNA, 25 bp, Mus musculus
atcccgtgaaggtgattcagacaag

SEQ ID NO: 208317 - DNA, 25 bp, Mus musculus
atccctaaaggtgtcataagccgaa

SEQ ID NO: 208318 - DNA, 25 bp, Mus musculus
atccctaccattctgtccggtcggg

SEQ ID NO: 208319 - DNA, 25 bp, Mus musculus
atccctactccaaggtgaagcagaa

SEQ ID NO: 208320 - DNA, 25 bp, Mus musculus
atccctagaaagcggcctgacctgc

SEQ ID NO: 208321 - DNA, 25 bp, Mus musculus
atccctagaaagcgggactttgcca

SEQ ID NO: 208322 - DNA, 25 bp, Mus musculus
atccctagatatcaaagtctggatg

SEQ ID NO: 208323 - DNA, 25 bp, Mus musculus
atccctagatatgaaagtctggatg

SEQ ID NO: 208324 - DNA, 25 bp, Mus musculus
atccctagctggaaggactgggcaa

SEQ ID NO: 208325 - DNA, 25 bp, Mus musculus
atccctaggcaatgacaccctgtac

SEQ ID NO: 208326 - DNA, 25 bp, Mus musculus
atccctaggcaatgcactactctcc

SEQ ID NO: 208327 - DNA, 25 bp, Mus musculus
atccctataagtaaggaatgaattc

SEQ ID NO: 208328 - DNA, 25 bp, Mus musculus
atccctataagtaaggctgtagaaa

SEQ ID NO: 208329 - DNA, 25 bp, Mus musculus
atccctcaagtgaccacacactggc

SEQ ID NO: 208330 - DNA, 25 bp, Mus musculus
atccctcagaagcatctccatcgcc

SEQ ID NO: 208331 - DNA, 25 bp, Mus musculus
atccctccagcggaactggctcaga

SEQ ID NO: 208332 - DNA, 25 bp, Mus musculus
atccctccaggaggagcaggacaac

SEQ ID NO: 208333 - DNA, 25 bp, Mus musculus
atccctcctcaggtggggctcccag

SEQ ID NO: 208334 - DNA, 25 bp, Mus musculus
atccctcctgaggggatcccaggtt

SEQ ID NO: 208335 - DNA, 25 bp, Mus musculus
atccctcgacctggaggatgtttct

SEQ ID NO: 208336 - DNA, 25 bp, Mus musculus
atccctctaaaagaagcgtgcaatc

SEQ ID NO: 208337 - DNA, 25 bp, Mus musculus
atccctctaaaagcttcctgcagta

SEQ ID NO: 208338 - DNA, 25 bp, Mus musculus
atccctctcagccccctggtgctcc

SEQ ID NO: 208339 - DNA, 25 bp, Mus musculus
atccctctcaggtttacagccccaa

SEQ ID NO: 208340 - DNA, 25 bp, Mus musculus
atccctctggaagtgccgaattcga

SEQ ID NO: 208341 - DNA, 25 bp, Mus musculus
atccctctggatcggttaagcatat

SEQ ID NO: 208342 - DNA, 25 bp, Mus musculus
atccctctggtgaattccaaggctg

SEQ ID NO: 208343 - DNA, 25 bp, Mus musculus
atccctctgtgcactgagcagcctg

SEQ ID NO: 208344 - DNA, 25 bp, Mus musculus
atccctctgttttgccattgctgga

SEQ ID NO: 208345 - DNA, 25 bp, Mus musculus
atccctgaactgcacacgccaaaga

SEQ ID NO: 208346 - DNA, 25 bp, Mus musculus
atccctgaattgacccagcccgggg

SEQ ID NO: 208347 - DNA, 25 bp, Mus musculus
atccctgactcatggtggcccgagg

SEQ ID NO: 208348 - DNA, 25 bp, Mus musculus
atccctgagtttcaggagcggctgc

SEQ ID NO: 208349 - DNA, 25 bp, Mus musculus
atccctgcaaggaaagagtgccacc

SEQ ID NO: 208350 - DNA, 25 bp, Mus musculus
atccctgcacttgtggatggagacc

SEQ ID NO: 208351 - DNA, 25 bp, Mus musculus
atccctgcagctaaggcagaaaaga

SEQ ID NO: 208352 - DNA, 25 bp, Mus musculus
atccctgcaggacaggtggcctctg

SEQ ID NO: 208353 - DNA, 25 bp, Mus musculus
atccctgcaggggcctgtgtatgct

SEQ ID NO: 208354 - DNA, 25 bp, Mus musculus
atccctgcatagaggtagttcctaa

SEQ ID NO: 208355 - DNA, 25 bp, Mus musculus
atccctgcatagaggtgtgaaattg

SEQ ID NO: 208356 - DNA, 25 bp, Mus musculus
atccctgccaaatttccaagcaaga

SEQ ID NO: 208357 - DNA, 25 bp, Mus musculus
atccctgccaacaagaacctgaaga

SEQ ID NO: 208358 - DNA, 25 bp, Mus musculus
atccctgcccgcctgtaagttccag

SEQ ID NO: 208359 - DNA, 25 bp, Mus musculus
atccctgcccgcctgtcgccttgaa

SEQ ID NO: 208360 - DNA, 25 bp, Mus musculus
atccctgccctcaaggtaatggatg

SEQ ID NO: 208361 - DNA, 25 bp, Mus musculus
atccctgccctcaaggtggtgaaga

SEQ ID NO: 208362 - DNA, 25 bp, Mus musculus
atccctgcctgaggagctgcagaag

SEQ ID NO: 208363 - DNA, 25 bp, Mus musculus
atccctgctatgacactggctggag

SEQ ID NO: 208364 - DNA, 25 bp, Mus musculus
atccctgctatgggcatattgtatt

SEQ ID NO: 208365 - DNA, 25 bp, Mus musculus
atccctgctcattattcccccagaa

SEQ ID NO: 208366 - DNA, 25 bp, Mus musculus
atccctgctctgttgtgtatccagg

SEQ ID NO: 208367 - DNA, 25 bp, Mus musculus
atccctggaaaagcctgaaaatcag

SEQ ID NO: 208368 - DNA, 25 bp, Mus musculus
atccctggaccaggtgaaaaaagcc

SEQ ID NO: 208369 - DNA, 25 bp, Mus musculus
atccctggacttcagaaccagcagc

SEQ ID NO: 208370 - DNA, 25 bp, Mus musculus
atccctggcaaaaggtgcccgaggt

SEQ ID NO: 208371 - DNA, 25 bp, Mus musculus
atccctggcctatctccctggagtt

SEQ ID NO: 208372 - DNA, 25 bp, Mus musculus
atccctggctccctcatcagcgaaa

SEQ ID NO: 208373 - DNA, 25 bp, Mus musculus
atccctgggaaaaggacgctattac

SEQ ID NO: 208374 - DNA, 25 bp, Mus musculus
atccctggtcctgtgggtctccctg

SEQ ID NO: 208375 - DNA, 25 bp, Mus musculus
atccctggtcctgtgggtgaaccag

SEQ ID NO: 208376 - DNA, 25 bp, Mus musculus
atccctggtcctgtgggtgagcaag

SEQ ID NO: 208377 - DNA, 25 bp, Mus musculus
atccctggtgcccagagagaggcag

SEQ ID NO: 208378 - DNA, 25 bp, Mus musculus
atccctgtaacagccaaacaccatg

SEQ ID NO: 208379 - DNA, 25 bp, Mus musculus
atccctgtaacaggaatgggctgct

SEQ ID NO: 208380 - DNA, 25 bp, Mus musculus
atccctgtgcgggccatcaattacc

SEQ ID NO: 208381 - DNA, 25 bp, Mus musculus
atccctgtgcgggttgccgatgctg

SEQ ID NO: 208382 - DNA, 25 bp, Mus musculus
atccctgtggaacagccgtgtaggt

SEQ ID NO: 208383 - DNA, 25 bp, Mus musculus
atccctgtggcaggtgaccttggac

SEQ ID NO: 208384 - DNA, 25 bp, Mus musculus
atccctgtggcagtggaggtgaagc

SEQ ID NO: 208385 - DNA, 25 bp, Mus musculus
atccctgttcactcaacagacctga

SEQ ID NO: 208386 - DNA, 25 bp, Mus musculus
atcccttaccgcgtcgagcagaaca

SEQ ID NO: 208387 - DNA, 25 bp, Mus musculus
atcccttcagaatacacatgccaat

SEQ ID NO: 208388 - DNA, 25 bp, Mus musculus
atcccttcagagggacagaccaccg

SEQ ID NO: 208389 - DNA, 25 bp, Mus musculus
atcccttcagccgagaaacatccca

SEQ ID NO: 208390 - DNA, 25 bp, Mus musculus
atcccttcagccgagaagaactttg

SEQ ID NO: 208391 - DNA, 25 bp, Mus musculus
atcccttccagaagtcttgtgtgat

SEQ ID NO: 208392 - DNA, 25 bp, Mus musculus
atcccttccagaatgtcaagtgccc

SEQ ID NO: 208393 - DNA, 25 bp, Mus musculus
atcccttccgggctgtggaaggatc

SEQ ID NO: 208394 - DNA, 25 bp, Mus musculus
atcccttctcctgagctacatatta

SEQ ID NO: 208395 - DNA, 25 bp, Mus musculus
atcccttgaggagttaccaaataaa

SEQ ID NO: 208396 - DNA, 25 bp, Mus musculus
atccgaaaaagccggagcctcaaca

SEQ ID NO: 208397 - DNA, 25 bp, Mus musculus
atccgaagcccaagaaataaatcat

SEQ ID NO: 208398 - DNA, 25 bp, Mus musculus
atccgaagctcagccacgggggccg

SEQ ID NO: 208399 - DNA, 25 bp, Mus musculus
atccgaagtcaagcctttcatcacc

SEQ ID NO: 208400 - DNA, 25 bp, Mus musculus
atccgaatctttgagtgtgagaaac

SEQ ID NO: 208401 - DNA, 25 bp, Mus musculus
atccgaccagacagatggataccaa

SEQ ID NO: 208402 - DNA, 25 bp, Mus musculus
atccgaccagcttttttaaacagcc

SEQ ID NO: 208403 - DNA, 25 bp, Mus musculus
atccgaccaggatggcttccccatt

SEQ ID NO: 208404 - DNA, 25 bp, Mus musculus
atccgactacgggtggactatagtg

SEQ ID NO: 208405 - DNA, 25 bp, Mus musculus
atccgacttctaggcgtgtgtatag

SEQ ID NO: 208406 - DNA, 25 bp, Mus musculus
atccgagacagattacttcgcaacc

SEQ ID NO: 208407 - DNA, 25 bp, Mus musculus
atccgagctgatgtgtggagcctgg

SEQ ID NO: 208408 - DNA, 25 bp, Mus musculus
atccgaggacaatcgggtgatccag

SEQ ID NO: 208409 - DNA, 25 bp, Mus musculus
atccgagggcggtggaggaacagac

SEQ ID NO: 208410 - DNA, 25 bp, Mus musculus
atccgagtaatcctgtgtcttggtt

SEQ ID NO: 208411 - DNA, 25 bp, Mus musculus
atccgagtagtgtgtgacggaatgg

SEQ ID NO: 208412 - DNA, 25 bp, Mus musculus
atccgcaacactgaccgaggcaatg

SEQ ID NO: 208413 - DNA, 25 bp, Mus musculus
atccgcaagctgccccccaagtgtc

SEQ ID NO: 208414 - DNA, 25 bp, Mus musculus
atccgcaagctgtctgatcagtgca

SEQ ID NO: 208415 - DNA, 25 bp, Mus musculus
atccgcaatgccctggctttcctgg

SEQ ID NO: 208416 - DNA, 25 bp, Mus musculus
atccgcaatgcttctggaatttctg

SEQ ID NO: 208417 - DNA, 25 bp, Mus musculus
atccgcacagtcaaggagctgggca

SEQ ID NO: 208418 - DNA, 25 bp, Mus musculus
atccgcactgccaaggagtgtgggg

SEQ ID NO: 208419 - DNA, 25 bp, Mus musculus
atccgcactgccaaggtttcctgcc

SEQ ID NO: 208420 - DNA, 25 bp, Mus musculus
atccgcatccagaggatgctgccca

SEQ ID NO: 208421 - DNA, 25 bp, Mus musculus
atccgcattgcagatgaacgagacc

SEQ ID NO: 208422 - DNA, 25 bp, Mus musculus
atccgccaccaggccaaccatattc

SEQ ID NO: 208423 - DNA, 25 bp, Mus musculus
atccgccacgccgtctgggtacatg

SEQ ID NO: 208424 - DNA, 25 bp, Mus musculus
atccgcccaacaggcgctgtgaggt

SEQ ID NO: 208425 - DNA, 25 bp, Mus musculus
atccgcccaacatgccaccttacac

SEQ ID NO: 208426 - DNA, 25 bp, Mus musculus
atccgcccaagagctcaaagcccaa

SEQ ID NO: 208427 - DNA, 25 bp, Mus musculus
atccgccccagaccctgttagacca

SEQ ID NO: 208428 - DNA, 25 bp, Mus musculus
atccgccccgcacagtatcagaaat

SEQ ID NO: 208429 - DNA, 25 bp, Mus musculus
atccgcctccccgatcccgcccgga

SEQ ID NO: 208430 - DNA, 25 bp, Mus musculus
atccgcctgctggacagcgtgctgg

SEQ ID NO: 208431 - DNA, 25 bp, Mus musculus
atccgcgccaagaacatttaaaaga

SEQ ID NO: 208432 - DNA, 25 bp, Mus musculus
atccgcgtgggatccaaggactgtg

SEQ ID NO: 208433 - DNA, 25 bp, Mus musculus
atccgctggagaattccttctctga

SEQ ID NO: 208434 - DNA, 25 bp, Mus musculus
atccgctggagcccgagtggcacca

SEQ ID NO: 208435 - DNA, 25 bp, Mus musculus
atccgctggagcccgatggttttcg

SEQ ID NO: 208436 - DNA, 25 bp, Mus musculus
atccgctgtgctttgacctcgaaaa

SEQ ID NO: 208437 - DNA, 25 bp, Mus musculus
atccggaaccagcctctgacctcca

SEQ ID NO: 208438 - DNA, 25 bp, Mus musculus
atccggaaccaggtgtcaccctgag

SEQ ID NO: 208439 - DNA, 25 bp, Mus musculus
atccggaacggtctgaaggtcactt

SEQ ID NO: 208440 - DNA, 25 bp, Mus musculus
atccggaacggtggttgtggaggca

SEQ ID NO: 208441 - DNA, 25 bp, Mus musculus
atccggaagtataagccggaagagg

SEQ ID NO: 208442 - DNA, 25 bp, Mus musculus
atccggaagtattagccggaagagg

SEQ ID NO: 208443 - DNA, 25 bp, Mus musculus
atccggacagccagcgatggggatt

SEQ ID NO: 208444 - DNA, 25 bp, Mus musculus
atccggacaggctgacgatgctcac

SEQ ID NO: 208445 - DNA, 25 bp, Mus musculus
atccggagccagaatgacagccaag

SEQ ID NO: 208446 - DNA, 25 bp, Mus musculus
atccggagccaggtcatccacgcct

SEQ ID NO: 208447 - DNA, 25 bp, Mus musculus
atccggatagacaagcgtgagaatg

SEQ ID NO: 208448 - DNA, 25 bp, Mus musculus
atccggcagaagcgcctgtctcacg

SEQ ID NO: 208449 - DNA, 25 bp, Mus musculus
atccggccaggacctagggaaggga

SEQ ID NO: 208450 - DNA, 25 bp, Mus musculus
atccggccccgaaacgccagcgatg

SEQ ID NO: 208451 - DNA, 25 bp, Mus musculus
atccggctgcaagatgagcctgggg

SEQ ID NO: 208452 - DNA, 25 bp, Mus musculus
atccggctgcaagggttgttaaaca

SEQ ID NO: 208453 - DNA, 25 bp, Mus musculus
atccgggaagggaaactgcccgtga

SEQ ID NO: 208454 - DNA, 25 bp, Mus musculus
atccgggacaacgaggagaacattt

SEQ ID NO: 208455 - DNA, 25 bp, Mus musculus
atccgggacagaggaccaggaggat

SEQ ID NO: 208456 - DNA, 25 bp, Mus musculus
atccgggacagcaagaagttcctgt

SEQ ID NO: 208457 - DNA, 25 bp, Mus musculus
atccgggagaaggtcctgggcaagt

SEQ ID NO: 208458 - DNA, 25 bp, Mus musculus
atccgggagctggagtcctttggaa

SEQ ID NO: 208459 - DNA, 25 bp, Mus musculus
atccgggaggaactgcacgggcgca

SEQ ID NO: 208460 - DNA, 25 bp, Mus musculus
atccgggccgtggaagcatcagttc

SEQ ID NO: 208461 - DNA, 25 bp, Mus musculus
atccggggcttgcagaggcctacgt

SEQ ID NO: 208462 - DNA, 25 bp, Mus musculus
atccggtcatgggagttagggagac

SEQ ID NO: 208463 - DNA, 25 bp, Mus musculus
atccggtcgagatgaccggttcgaa

SEQ ID NO: 208464 - DNA, 25 bp, Mus musculus
atccggtgcaggctgactttttggg

SEQ ID NO: 208465 - DNA, 25 bp, Mus musculus
atccggtgcaggctggttaccatgg

SEQ ID NO: 208466 - DNA, 25 bp, Mus musculus
atccggttgttgccgaatacaccaa

SEQ ID NO: 208467 - DNA, 25 bp, Mus musculus
atccgtaggaagaagtccctctcgt

SEQ ID NO: 208468 - DNA, 25 bp, Mus musculus
atccgtatcaactcaacaaggacat

SEQ ID NO: 208469 - DNA, 25 bp, Mus musculus
atccgtatcaagacatgttcagcat

SEQ ID NO: 208470 - DNA, 25 bp, Mus musculus
atccgtatcaagacatgttcagtat

SEQ ID NO: 208471 - DNA, 25 bp, Mus musculus
atccgtatccaggattccctggaga

SEQ ID NO: 208472 - DNA, 25 bp, Mus musculus
atccgtattgtgcaggcatccaggg

SEQ ID NO: 208473 - DNA, 25 bp, Mus musculus
atccgtgaaggaagaggctgtggcc

SEQ ID NO: 208474 - DNA, 25 bp, Mus musculus
atccgtgacagactcaaactagaaa

SEQ ID NO: 208475 - DNA, 25 bp, Mus musculus
atccgtgacaggccctttgaacgga

SEQ ID NO: 208476 - DNA, 25 bp, Mus musculus
atccgtgagtcagatgttccagccc

SEQ ID NO: 208477 - DNA, 25 bp, Mus musculus
atccgtgagtttttggagttagaac

SEQ ID NO: 208478 - DNA, 25 bp, Mus musculus
atccgtgccatcatggacatcgata

SEQ ID NO: 208479 - DNA, 25 bp, Mus musculus
atccgtgcctctgagatcccgtttc

SEQ ID NO: 208480 - DNA, 25 bp, Mus musculus
atccgtggacaacctggacagctta

SEQ ID NO: 208481 - DNA, 25 bp, Mus musculus
atccgtggggccaggcctcttaggt

SEQ ID NO: 208482 - DNA, 25 bp, Mus musculus
atccgtgtagaggagcaggcgagca

SEQ ID NO: 208483 - DNA, 25 bp, Mus musculus
atccgttcaggctgacggctgaggc

SEQ ID NO: 208484 - DNA, 25 bp, Mus musculus
atccgtttacaggtgctgggcgtta

SEQ ID NO: 208485 - DNA, 25 bp, Mus musculus
atccgtttacaggtggtggtcgcta

SEQ ID NO: 208486 - DNA, 25 bp, Mus musculus
atcctaaagagactaagccccagtc

SEQ ID NO: 208487 - DNA, 25 bp, Mus musculus
atcctaaaggggtctttgtgaacac

SEQ ID NO: 208488 - DNA, 25 bp, Mus musculus
atcctaaagggtgacaaaggggaca

SEQ ID NO: 208489 - DNA, 25 bp, Mus musculus
atcctaaatcagctgctgaaatcgt

SEQ ID NO: 208490 - DNA, 25 bp, Mus musculus
atcctaaatcaggtcatggttttta

SEQ ID NO: 208491 - DNA, 25 bp, Mus musculus
atcctaaatttaagtatgcagtact

SEQ ID NO: 208492 - DNA, 25 bp, Mus musculus
atcctaagcaaaaggctgaggagct

SEQ ID NO: 208493 - DNA, 25 bp, Mus musculus
atcctaagccaacatgccatatgaa

SEQ ID NO: 208494 - DNA, 25 bp, Mus musculus
atcctaatatcacagaacagcactt

SEQ ID NO: 208495 - DNA, 25 bp, Mus musculus
atcctaatttcttggggcgctttca

SEQ ID NO: 208496 - DNA, 25 bp, Mus musculus
atcctaatttcttggtgaatgaact

SEQ ID NO: 208497 - DNA, 25 bp, Mus musculus
atcctaccacggctcgccagaggcc

SEQ ID NO: 208498 - DNA, 25 bp, Mus musculus
atcctaccacggctctacttcccca

SEQ ID NO: 208499 - DNA, 25 bp, Mus musculus
atcctacctacggtgactctggcac

SEQ ID NO: 208500 - DNA, 25 bp, Mus musculus
atcctagaaatgacttctgaataag

SEQ ID NO: 208501 - DNA, 25 bp, Mus musculus
atcctagaaatgcagaccaggaatc

SEQ ID NO: 208502 - DNA, 25 bp, Mus musculus
atcctagaaatgccttctccctagc

SEQ ID NO: 208503 - DNA, 25 bp, Mus musculus
atcctagcggtttgcctgagaatac

SEQ ID NO: 208504 - DNA, 25 bp, Mus musculus
atcctagctggggatttgtatacat

SEQ ID NO: 208505 - DNA, 25 bp, Mus musculus
atcctaggccagtctccctatgagc

SEQ ID NO: 208506 - DNA, 25 bp, Mus musculus
atcctatacccacctgtctctctca

SEQ ID NO: 208507 - DNA, 25 bp, Mus musculus
atcctatcaagaggcaggaagcgat

SEQ ID NO: 208508 - DNA, 25 bp, Mus musculus
atcctatcaaggctcatcagcagga

SEQ ID NO: 208509 - DNA, 25 bp, Mus musculus
atcctatcagggtgaaggaggtgta

SEQ ID NO: 208510 - DNA, 25 bp, Mus musculus
atcctatgaaggtggtatgtccgtg

SEQ ID NO: 208511 - DNA, 25 bp, Mus musculus
atcctatgaatctgttgatgacatt

SEQ ID NO: 208512 - DNA, 25 bp, Mus musculus
atcctcaaagcgacccctgaacaga

SEQ ID NO: 208513 - DNA, 25 bp, Mus musculus
atcctcaaaggatacaacttctctc

SEQ ID NO: 208514 - DNA, 25 bp, Mus musculus
atcctcaacagcttgtgaccttgtt

SEQ ID NO: 208515 - DNA, 25 bp, Mus musculus
atcctcaaccacagtgtggacaaga

SEQ ID NO: 208516 - DNA, 25 bp, Mus musculus
atcctcaagcgcggtttccgtgaga

SEQ ID NO: 208517 - DNA, 25 bp, Mus musculus
atcctcaatagttgaactttctaga

SEQ ID NO: 208518 - DNA, 25 bp, Mus musculus
atcctcacaaaagcacttgcaagaa

SEQ ID NO: 208519 - DNA, 25 bp, Mus musculus
atcctcacgcagacagtgtccattc

SEQ ID NO: 208520 - DNA, 25 bp, Mus musculus
atcctcagacaagaggtaaagaaga

SEQ ID NO: 208521 - DNA, 25 bp, Mus musculus
atcctcagagatggccgccaagagc

SEQ ID NO: 208522 - DNA, 25 bp, Mus musculus
atcctcagaggccaggaccatcctt

SEQ ID NO: 208523 - DNA, 25 bp, Mus musculus
atcctcatcaccggagaatccggag

SEQ ID NO: 208524 - DNA, 25 bp, Mus musculus
atcctcatcagatgttttaaggatt

SEQ ID NO: 208525 - DNA, 25 bp, Mus musculus
atcctcatcccatgcttccaaacta

SEQ ID NO: 208526 - DNA, 25 bp, Mus musculus
atcctcatccctcctgaggggatgc

SEQ ID NO: 208527 - DNA, 25 bp, Mus musculus
atcctcatcggggtacttttgatgc

SEQ ID NO: 208528 - DNA, 25 bp, Mus musculus
atcctcatgcctggataagagtaaa

SEQ ID NO: 208529 - DNA, 25 bp, Mus musculus
atcctcattgagacccccgatggca

SEQ ID NO: 208530 - DNA, 25 bp, Mus musculus
atcctccaaagcatggaaataaatg

SEQ ID NO: 208531 - DNA, 25 bp, Mus musculus
atcctccaaagcatggcaatgcttg

SEQ ID NO: 208532 - DNA, 25 bp, Mus musculus
atcctccaacaatcctccatgtgaa

SEQ ID NO: 208533 - DNA, 25 bp, Mus musculus
atcctccaagaggcggagtcgccgg

SEQ ID NO: 208534 - DNA, 25 bp, Mus musculus
atcctccagccaggaatggcaagat

SEQ ID NO: 208535 - DNA, 25 bp, Mus musculus
atcctccagccaggtgatgttctga

SEQ ID NO: 208536 - DNA, 25 bp, Mus musculus
atcctccaggaccatgcaaaagcaa

SEQ ID NO: 208537 - DNA, 25 bp, Mus musculus
atcctccagtgactccatcaaagag

SEQ ID NO: 208538 - DNA, 25 bp, Mus musculus
atcctccagtgtctccagaacaagt

SEQ ID NO: 208539 - DNA, 25 bp, Mus musculus
atcctccatgacgcctgacctgctg

SEQ ID NO: 208540 - DNA, 25 bp, Mus musculus
atcctccatgagtgaacccacagct

SEQ ID NO: 208541 - DNA, 25 bp, Mus musculus
atcctcccaacagatgcagcgaagc

SEQ ID NO: 208542 - DNA, 25 bp, Mus musculus
atcctcccagccactggtgtgactg

SEQ ID NO: 208543 - DNA, 25 bp, Mus musculus
atcctcccagggttcactgatcacc

SEQ ID NO: 208544 - DNA, 25 bp, Mus musculus
atcctcccccaacactacaggcgcc

SEQ ID NO: 208545 - DNA, 25 bp, Mus musculus
atcctcccccaagactacaggcgcc

SEQ ID NO: 208546 - DNA, 25 bp, Mus musculus
atcctccgacagttcaaccagacag

SEQ ID NO: 208547 - DNA, 25 bp, Mus musculus
atcctccgacagttcagtcaacaga

SEQ ID NO: 208548 - DNA, 25 bp, Mus musculus
atcctccgagagttctgtccttgga

SEQ ID NO: 208549 - DNA, 25 bp, Mus musculus
atcctccgagtacatcaccaagctt

SEQ ID NO: 208550 - DNA, 25 bp, Mus musculus
atcctccggggcaacattttgatgg

SEQ ID NO: 208551 - DNA, 25 bp, Mus musculus
atcctccggggcatccagggaaatg

SEQ ID NO: 208552 - DNA, 25 bp, Mus musculus
atcctcctcctggcaatcccctggt

SEQ ID NO: 208553 - DNA, 25 bp, Mus musculus
atcctcctcctggcagtaagatcct

SEQ ID NO: 208554 - DNA, 25 bp, Mus musculus
atcctcctccttgggcccattgact

SEQ ID NO: 208555 - DNA, 25 bp, Mus musculus
atcctcctcgaatgataatctggag

SEQ ID NO: 208556 - DNA, 25 bp, Mus musculus
atcctcctgcctcagtaaaggccaa

SEQ ID NO: 208557 - DNA, 25 bp, Mus musculus
atcctcctgttggtggtcatcaact

SEQ ID NO: 208558 - DNA, 25 bp, Mus musculus
atcctccttagcaaggtcaacaaca

SEQ ID NO: 208559 - DNA, 25 bp, Mus musculus
atcctccttcagctgataatactag

SEQ ID NO: 208560 - DNA, 25 bp, Mus musculus
atcctcgaaacagggtcacgtctct

SEQ ID NO: 208561 - DNA, 25 bp, Mus musculus
atcctcgaccagagagaagcaacca

SEQ ID NO: 208562 - DNA, 25 bp, Mus musculus
atcctcgcccaaggagagctctctg

SEQ ID NO: 208563 - DNA, 25 bp, Mus musculus
atcctcgccgagcagaacatgccgg

SEQ ID NO: 208564 - DNA, 25 bp, Mus musculus
atcctcgccgagcagcctgtagtga

SEQ ID NO: 208565 - DNA, 25 bp, Mus musculus
atcctcgcctttggtaccacgtaca

SEQ ID NO: 208566 - DNA, 25 bp, Mus musculus
atcctcggcaacaagacgctgccgt

SEQ ID NO: 208567 - DNA, 25 bp, Mus musculus
atcctcggcctggtcaccgaagtga

SEQ ID NO: 208568 - DNA, 25 bp, Mus musculus
atcctcgggggactggcaatgtttg

SEQ ID NO: 208569 - DNA, 25 bp, Mus musculus
atcctcgggggactggccatgtttg

SEQ ID NO: 208570 - DNA, 25 bp, Mus musculus
atcctcgggtctgaggaacagtctg

SEQ ID NO: 208571 - DNA, 25 bp, Mus musculus
atcctctaagcaggtaaacgagttg

SEQ ID NO: 208572 - DNA, 25 bp, Mus musculus
atcctctaagcaggtttctacccca

SEQ ID NO: 208573 - DNA, 25 bp, Mus musculus
atcctctacatgggtaaaaagcaag

SEQ ID NO: 208574 - DNA, 25 bp, Mus musculus
atcctctaccctcaaccagcaagcc

SEQ ID NO: 208575 - DNA, 25 bp, Mus musculus
atcctctcaatgaattcctggagga

SEQ ID NO: 208576 - DNA, 25 bp, Mus musculus
atcctctccaggacccaagtttctt

SEQ ID NO: 208577 - DNA, 25 bp, Mus musculus
atcctctcctggtggagagagccag

SEQ ID NO: 208578 - DNA, 25 bp, Mus musculus
atcctctctgaggtgacccctacac

SEQ ID NO: 208579 - DNA, 25 bp, Mus musculus
atcctctctggcctctctcttgtgg

SEQ ID NO: 208580 - DNA, 25 bp, Mus musculus
atcctctgaacctgccgaattcgag

SEQ ID NO: 208581 - DNA, 25 bp, Mus musculus
atcctctgagcccctccccccgcca

SEQ ID NO: 208582 - DNA, 25 bp, Mus musculus
atcctctgcactgctctcaggagaa

SEQ ID NO: 208583 - DNA, 25 bp, Mus musculus
atcctctggagacaggttttctctg

SEQ ID NO: 208584 - DNA, 25 bp, Mus musculus
atcctctggagggtctggaatccct

SEQ ID NO: 208585 - DNA, 25 bp, Mus musculus
atcctctggagtcgagctcctgggg

SEQ ID NO: 208586 - DNA, 25 bp, Mus musculus
atcctctggagtcgatgaggatcca

SEQ ID NO: 208587 - DNA, 25 bp, Mus musculus
atcctctgtgaagctgtttgttcag

SEQ ID NO: 208588 - DNA, 25 bp, Mus musculus
atcctctgtgaaggtcacagtaatg

SEQ ID NO: 208589 - DNA, 25 bp, Mus musculus
atcctcttcatcaggatgctgcaca

SEQ ID NO: 208590 - DNA, 25 bp, Mus musculus
atcctcttctatgcggcaggccaga

SEQ ID NO: 208591 - DNA, 25 bp, Mus musculus
atcctcttctgagcattccggctgg

SEQ ID NO: 208592 - DNA, 25 bp, Mus musculus
atcctcttctggaaggactaccacc

SEQ ID NO: 208593 - DNA, 25 bp, Mus musculus
atcctcttctggaaggactcgggac

SEQ ID NO: 208594 - DNA, 25 bp, Mus musculus
atcctctttgacactctcgtgggcg

SEQ ID NO: 208595 - DNA, 25 bp, Mus musculus
atcctctttgacacttttctcaaca

SEQ ID NO: 208596 - DNA, 25 bp, Mus musculus
atcctctttttccagcagttggaat

SEQ ID NO: 208597 - DNA, 25 bp, Mus musculus
atcctgaaaaatgtgggggttgctg

SEQ ID NO: 208598 - DNA, 25 bp, Mus musculus
atcctgaaaagtattgataatgagt

SEQ ID NO: 208599 - DNA, 25 bp, Mus musculus
atcctgaaacaggtactacttgtcc

SEQ ID NO: 208600 - DNA, 25 bp, Mus musculus
atcctgaaactcaggttatgaggtg

SEQ ID NO: 208601 - DNA, 25 bp, Mus musculus
atcctgaaagatcttggtgggctgt

SEQ ID NO: 208602 - DNA, 25 bp, Mus musculus
atcctgaaagggctgtgcggacaga

SEQ ID NO: 208603 - DNA, 25 bp, Mus musculus
atcctgaacaggatgctgccagccc

SEQ ID NO: 208604 - DNA, 25 bp, Mus musculus
atcctgaacatgccaggcacgagcc

SEQ ID NO: 208605 - DNA, 25 bp, Mus musculus
atcctgaagaagattaacttgagta

SEQ ID NO: 208606 - DNA, 25 bp, Mus musculus
atcctgaagaagcacgcccactgga

SEQ ID NO: 208607 - DNA, 25 bp, Mus musculus
atcctgaagacgcatttagtaaaga

SEQ ID NO: 208608 - DNA, 25 bp, Mus musculus
atcctgaagctgcgacaagggtctg

SEQ ID NO: 208609 - DNA, 25 bp, Mus musculus
atcctgaagtgattttcctcgcatc

SEQ ID NO: 208610 - DNA, 25 bp, Mus musculus
atcctgacaagggcacgtggagata

SEQ ID NO: 208611 - DNA, 25 bp, Mus musculus
atcctgacagaaacacataaacctc

SEQ ID NO: 208612 - DNA, 25 bp, Mus musculus
atcctgacagaagatgattctgagg

SEQ ID NO: 208613 - DNA, 25 bp, Mus musculus
atcctgacagctacgacacgtggat

SEQ ID NO: 208614 - DNA, 25 bp, Mus musculus
atcctgacaggtgctgagttccctt

SEQ ID NO: 208615 - DNA, 25 bp, Mus musculus
atcctgaccagagagcttctgtgtg

SEQ ID NO: 208616 - DNA, 25 bp, Mus musculus
atcctgactcagaagaaccaatcac

SEQ ID NO: 208617 - DNA, 25 bp, Mus musculus
atcctgactcagaaggtgtacagac

SEQ ID NO: 208618 - DNA, 25 bp, Mus musculus
atcctgactgtctacagtgtctagc

SEQ ID NO: 208619 - DNA, 25 bp, Mus musculus
atcctgagaatgaatgaacaaaacc

SEQ ID NO: 208620 - DNA, 25 bp, Mus musculus
atcctgagaatggtctctctgggat

SEQ ID NO: 208621 - DNA, 25 bp, Mus musculus
atcctgagacaggctccgtccatgc

SEQ ID NO: 208622 - DNA, 25 bp, Mus musculus
atcctgagacttgttcaaggggagg

SEQ ID NO: 208623 - DNA, 25 bp, Mus musculus
atcctgagagacaggcaataccgga

SEQ ID NO: 208624 - DNA, 25 bp, Mus musculus
atcctgagatacaaggaaagaaagg

SEQ ID NO: 208625 - DNA, 25 bp, Mus musculus
atcctgagcaaaggctacaacaagg

SEQ ID NO: 208626 - DNA, 25 bp, Mus musculus
atcctgagcaggttgtggatgtggc

SEQ ID NO: 208627 - DNA, 25 bp, Mus musculus
atcctgagcgcgagaactttcaaag

SEQ ID NO: 208628 - DNA, 25 bp, Mus musculus
atcctgaggaccgtgttcgtaagca

SEQ ID NO: 208629 - DNA, 25 bp, Mus musculus
atcctgagtctcaagagccaaggac

SEQ ID NO: 208630 - DNA, 25 bp, Mus musculus
atcctgagtgagatggaaataggga

SEQ ID NO: 208631 - DNA, 25 bp, Mus musculus
atcctgagtgagcagaaaatgcgac

SEQ ID NO: 208632 - DNA, 25 bp, Mus musculus
atcctgagtgagctcatccactgga

SEQ ID NO: 208633 - DNA, 25 bp, Mus musculus
atcctgagtgaggtcatccactgga

SEQ ID NO: 208634 - DNA, 25 bp, Mus musculus
atcctgagtgagttggaaataggga

SEQ ID NO: 208635 - DNA, 25 bp, Mus musculus
atcctgataaacttcccacgacagc

SEQ ID NO: 208636 - DNA, 25 bp, Mus musculus
atcctgatcacaggacagctccctc

SEQ ID NO: 208637 - DNA, 25 bp, Mus musculus
atcctgatctgtgtgggcgggtgca

SEQ ID NO: 208638 - DNA, 25 bp, Mus musculus
atcctgatggaaagaacagacaagg

SEQ ID NO: 208639 - DNA, 25 bp, Mus musculus
atcctgattgagggccgcaaacagg

SEQ ID NO: 208640 - DNA, 25 bp, Mus musculus
atcctgcaagggagcccggtggttc

SEQ ID NO: 208641 - DNA, 25 bp, Mus musculus
atcctgcaccaggaagagttgggct

SEQ ID NO: 208642 - DNA, 25 bp, Mus musculus
atcctgcactcaggtagtgacatgg

SEQ ID NO: 208643 - DNA, 25 bp, Mus musculus
atcctgcagaagcaccctaggatac

SEQ ID NO: 208644 - DNA, 25 bp, Mus musculus
atcctgcatctgaagaggtggccat

SEQ ID NO: 208645 - DNA, 25 bp, Mus musculus
atcctgccacaggtactactgggcc

SEQ ID NO: 208646 - DNA, 25 bp, Mus musculus
atcctgccagaaccacctgtagctc

SEQ ID NO: 208647 - DNA, 25 bp, Mus musculus
atcctgccagaggaagcccgtgctt

SEQ ID NO: 208648 - DNA, 25 bp, Mus musculus
atcctgccagccaggagacacaaac

SEQ ID NO: 208649 - DNA, 25 bp, Mus musculus
atcctgcccagtgttgaagaaattg

SEQ ID NO: 208650 - DNA, 25 bp, Mus musculus
atcctgccctatgaccactctagag

SEQ ID NO: 208651 - DNA, 25 bp, Mus musculus
atcctgccctttctctctttagctg

SEQ ID NO: 208652 - DNA, 25 bp, Mus musculus
atcctgcctgtgccggcctttaatg

SEQ ID NO: 208653 - DNA, 25 bp, Mus musculus
atcctgccttgacactagttgctgg

SEQ ID NO: 208654 - DNA, 25 bp, Mus musculus
atcctgcgggttttgctggaccgca

SEQ ID NO: 208655 - DNA, 25 bp, Mus musculus
atcctgctgacaggactatgacttg

SEQ ID NO: 208656 - DNA, 25 bp, Mus musculus
atcctgctgacctacattcagccat

SEQ ID NO: 208657 - DNA, 25 bp, Mus musculus
atcctgctgagaggactatgacttg

SEQ ID NO: 208658 - DNA, 25 bp, Mus musculus
atcctgctgagctacattcagccat

SEQ ID NO: 208659 - DNA, 25 bp, Mus musculus
atcctgctggccagatagacaggaa

SEQ ID NO: 208660 - DNA, 25 bp, Mus musculus
atcctggaatgaagggagaagcagg

SEQ ID NO: 208661 - DNA, 25 bp, Mus musculus
atcctggacagaaccagctcctgat

SEQ ID NO: 208662 - DNA, 25 bp, Mus musculus
atcctggacaggccaaccaggatct

SEQ ID NO: 208663 - DNA, 25 bp, Mus musculus
atcctggacagtctgcacctgtctg

SEQ ID NO: 208664 - DNA, 25 bp, Mus musculus
atcctggacattactggccagttca

SEQ ID NO: 208665 - DNA, 25 bp, Mus musculus
atcctggaccccgagagccccaagg

SEQ ID NO: 208666 - DNA, 25 bp, Mus musculus
atcctggagatgagaaataaagatt

SEQ ID NO: 208667 - DNA, 25 bp, Mus musculus
atcctggagatgagtcacagcccag

SEQ ID NO: 208668 - DNA, 25 bp, Mus musculus
atcctggagcgttcactgtgagcct

SEQ ID NO: 208669 - DNA, 25 bp, Mus musculus
atcctggagctagcatctagtgctt

SEQ ID NO: 208670 - DNA, 25 bp, Mus musculus
atcctggagctaggtcattttacct

SEQ ID NO: 208671 - DNA, 25 bp, Mus musculus
atcctggaggatcagttggcaaagc

SEQ ID NO: 208672 - DNA, 25 bp, Mus musculus
atcctggatctgagggaaatctgct

SEQ ID NO: 208673 - DNA, 25 bp, Mus musculus
atcctggcaagaggagcactcaccc

SEQ ID NO: 208674 - DNA, 25 bp, Mus musculus
atcctggcagagacggagggcatgc

SEQ ID NO: 208675 - DNA, 25 bp, Mus musculus
atcctggcaggggacccagccgtag

SEQ ID NO: 208676 - DNA, 25 bp, Mus musculus
atcctggctcaaggctttggctccc

SEQ ID NO: 208677 - DNA, 25 bp, Mus musculus
atcctgggatcctgggagaatttag

SEQ ID NO: 208678 - DNA, 25 bp, Mus musculus
atcctgggctgcatgcattgtggct

SEQ ID NO: 208679 - DNA, 25 bp, Mus musculus
atcctgggctgggacgaagtagctc

SEQ ID NO: 208680 - DNA, 25 bp, Mus musculus
atcctgggttccagaccagccacga

SEQ ID NO: 208681 - DNA, 25 bp, Mus musculus
atcctggtgcctagatgctgaatgc

SEQ ID NO: 208682 - DNA, 25 bp, Mus musculus
atcctggtgcgagacaccccccagg

SEQ ID NO: 208683 - DNA, 25 bp, Mus musculus
atcctggtgcgagagtcacccagca

SEQ ID NO: 208684 - DNA, 25 bp, Mus musculus
atcctggtggcgggagcctttttct

SEQ ID NO: 208685 - DNA, 25 bp, Mus musculus
atcctggtggcggggaaggcagatg

SEQ ID NO: 208686 - DNA, 25 bp, Mus musculus
atcctggtttgaagatcccaatact

SEQ ID NO: 208687 - DNA, 25 bp, Mus musculus
atcctggtttgaaggtttggagtcg

SEQ ID NO: 208688 - DNA, 25 bp, Mus musculus
atcctggtttgggtccgtgttcacc

SEQ ID NO: 208689 - DNA, 25 bp, Mus musculus
atcctgtaagactttaacccatgag

SEQ ID NO: 208690 - DNA, 25 bp, Mus musculus
atcctgtaaggcactggtgaagtgg

SEQ ID NO: 208691 - DNA, 25 bp, Mus musculus
atcctgtactgcgtggtgacatctc

SEQ ID NO: 208692 - DNA, 25 bp, Mus musculus
atcctgtcaatgcagcccagatgga

SEQ ID NO: 208693 - DNA, 25 bp, Mus musculus
atcctgtcaatgcagcttgttttag

SEQ ID NO: 208694 - DNA, 25 bp, Mus musculus
atcctgtcaatgcaggcgacctggc

SEQ ID NO: 208695 - DNA, 25 bp, Mus musculus
atcctgtcaggtgaaaatgctgatc

SEQ ID NO: 208696 - DNA, 25 bp, Mus musculus
atcctgtcccgaaacaagccttcac

SEQ ID NO: 208697 - DNA, 25 bp, Mus musculus
atcctgtccgaggatggatgccctg

SEQ ID NO: 208698 - DNA, 25 bp, Mus musculus
atcctgtcgctgtggctacgtgttc

SEQ ID NO: 208699 - DNA, 25 bp, Mus musculus
atcctgtctatggagaaaataagtc

SEQ ID NO: 208700 - DNA, 25 bp, Mus musculus
atcctgtcttttttgaaattggcac

SEQ ID NO: 208701 - DNA, 25 bp, Mus musculus
atcctgtcttttttgctgagaaagt

SEQ ID NO: 208702 - DNA, 25 bp, Mus musculus
atcctgtgaagatattgacgaatgc

SEQ ID NO: 208703 - DNA, 25 bp, Mus musculus
atcctgtgaagatgtggatgagtgc

SEQ ID NO: 208704 - DNA, 25 bp, Mus musculus
atcctgtgagttgggtgcaaagctt

SEQ ID NO: 208705 - DNA, 25 bp, Mus musculus
atcctgtgctacaaaaaactgagac

SEQ ID NO: 208706 - DNA, 25 bp, Mus musculus
atcctgtgctacaagtccacacacg

SEQ ID NO: 208707 - DNA, 25 bp, Mus musculus
atcctgtggctaagtaagaaatcca

SEQ ID NO: 208708 - DNA, 25 bp, Mus musculus
atcctgtggctaagtgactaataaa

SEQ ID NO: 208709 - DNA, 25 bp, Mus musculus
atcctgtggctaatcctgtctgtag

SEQ ID NO: 208710 - DNA, 25 bp, Mus musculus
atcctgtggctaatttcagagtgat

SEQ ID NO: 208711 - DNA, 25 bp, Mus musculus
atcctgtgtccctcatacaactaga

SEQ ID NO: 208712 - DNA, 25 bp, Mus musculus
atcctgtgtctccaatcgtggatga

SEQ ID NO: 208713 - DNA, 25 bp, Mus musculus
atcctgtgtgaggtccctccagcta

SEQ ID NO: 208714 - DNA, 25 bp, Mus musculus
atcctgtgtggaccagcagagaaca

SEQ ID NO: 208715 - DNA, 25 bp, Mus musculus
atcctgttagctgaggtgccgacaa

SEQ ID NO: 208716 - DNA, 25 bp, Mus musculus
atcctgttcttatgcctgaaaaaga

SEQ ID NO: 208717 - DNA, 25 bp, Mus musculus
atcctgttgcgcagcgtctcctgta

SEQ ID NO: 208718 - DNA, 25 bp, Mus musculus
atcctgttttgatggaaggaccctc

SEQ ID NO: 208719 - DNA, 25 bp, Mus musculus
atccttacagcaggtggccccttct

SEQ ID NO: 208720 - DNA, 25 bp, Mus musculus
atccttacaggagccaggccacaga

SEQ ID NO: 208721 - DNA, 25 bp, Mus musculus
atccttacatgcgctgtaagatgaa

SEQ ID NO: 208722 - DNA, 25 bp, Mus musculus
atccttacatgctcctgaccacttg

SEQ ID NO: 208723 - DNA, 25 bp, Mus musculus
atccttaccacagaatccagattct

SEQ ID NO: 208724 - DNA, 25 bp, Mus musculus
atccttaccacaggctccaagattt

SEQ ID NO: 208725 - DNA, 25 bp, Mus musculus
atccttaccacaggtgctacttttc

SEQ ID NO: 208726 - DNA, 25 bp, Mus musculus
atccttaccagtgaggctgctggaa

SEQ ID NO: 208727 - DNA, 25 bp, Mus musculus
atccttaccagtgaggctgtgtcta

SEQ ID NO: 208728 - DNA, 25 bp, Mus musculus
atccttacgggaaggtgcacacttt

SEQ ID NO: 208729 - DNA, 25 bp, Mus musculus
atccttacggtgataaaattgccac

SEQ ID NO: 208730 - DNA, 25 bp, Mus musculus
atccttagtcaccagtgccagcgga

SEQ ID NO: 208731 - DNA, 25 bp, Mus musculus
atccttagtcagacgcgcacggacc

SEQ ID NO: 208732 - DNA, 25 bp, Mus musculus
atccttatagcagaaaccatcaaaa

SEQ ID NO: 208733 - DNA, 25 bp, Mus musculus
atccttataggagaaaccatcaaaa

SEQ ID NO: 208734 - DNA, 25 bp, Mus musculus
atccttatcagacgaaagagcctgt

SEQ ID NO: 208735 - DNA, 25 bp, Mus musculus
atccttcaaagcagaagcctcctgc

SEQ ID NO: 208736 - DNA, 25 bp, Mus musculus
atccttcaagaaaccctgaagctgc

SEQ ID NO: 208737 - DNA, 25 bp, Mus musculus
atccttcaagactgcaggcaccatc

SEQ ID NO: 208738 - DNA, 25 bp, Mus musculus
atccttcaaggtctgtgattgctgc

SEQ ID NO: 208739 - DNA, 25 bp, Mus musculus
atccttcaccaatttatcaaaagtt

SEQ ID NO: 208740 - DNA, 25 bp, Mus musculus
atccttcacgaaagaacttatttgt

SEQ ID NO: 208741 - DNA, 25 bp, Mus musculus
atccttcacgttgggttcgccaagc

SEQ ID NO: 208742 - DNA, 25 bp, Mus musculus
atccttcaggacaaggttttcaaaa

SEQ ID NO: 208743 - DNA, 25 bp, Mus musculus
atccttccaaaaggcccacagcagc

SEQ ID NO: 208744 - DNA, 25 bp, Mus musculus
atccttccaagactcagattagccc

SEQ ID NO: 208745 - DNA, 25 bp, Mus musculus
atccttccagatgtatcgggatatt

SEQ ID NO: 208746 - DNA, 25 bp, Mus musculus
atccttccagatgtatctggatatt

SEQ ID NO: 208747 - DNA, 25 bp, Mus musculus
atccttccaggagtttatcatgtgc

SEQ ID NO: 208748 - DNA, 25 bp, Mus musculus
atccttcccatttgattgagaaatg

SEQ ID NO: 208749 - DNA, 25 bp, Mus musculus
atccttccgacccctacttcagcac

SEQ ID NO: 208750 - DNA, 25 bp, Mus musculus
atccttcgaggatgtctcggaacta

SEQ ID NO: 208751 - DNA, 25 bp, Mus musculus
atccttcgaggcttgctttgcttcc

SEQ ID NO: 208752 - DNA, 25 bp, Mus musculus
atccttcgccacagaaatggcctcc

SEQ ID NO: 208753 - DNA, 25 bp, Mus musculus
atccttcgttgccaggagatggcct

SEQ ID NO: 208754 - DNA, 25 bp, Mus musculus
atccttctagtgttgggcaaccatt

SEQ ID NO: 208755 - DNA, 25 bp, Mus musculus
atccttctccagattatctgcaatg

SEQ ID NO: 208756 - DNA, 25 bp, Mus musculus
atccttctgagagctgtccagctcg

SEQ ID NO: 208757 - DNA, 25 bp, Mus musculus
atccttctgagccaatagtaaccag

SEQ ID NO: 208758 - DNA, 25 bp, Mus musculus
atccttcttgtggccctattgtgtg

SEQ ID NO: 208759 - DNA, 25 bp, Mus musculus
atccttctttgttgggtgggactat

SEQ ID NO: 208760 - DNA, 25 bp, Mus musculus
atccttgaaagccctctgggcgtgg

SEQ ID NO: 208761 - DNA, 25 bp, Mus musculus
atccttgactccaagcggggctctg

SEQ ID NO: 208762 - DNA, 25 bp, Mus musculus
atccttgagcatgatgttgccatcc

SEQ ID NO: 208763 - DNA, 25 bp, Mus musculus
atccttgagcatgcaccagccacaa

SEQ ID NO: 208764 - DNA, 25 bp, Mus musculus
atccttgcagtcagaaaatgggtaa

SEQ ID NO: 208765 - DNA, 25 bp, Mus musculus
atccttgcatgatatggcataagat

SEQ ID NO: 208766 - DNA, 25 bp, Mus musculus
atccttgctatgaacacccctggct

SEQ ID NO: 208767 - DNA, 25 bp, Mus musculus
atccttgctattgctcctgggcctg

SEQ ID NO: 208768 - DNA, 25 bp, Mus musculus
atccttggagaatggttataagtac

SEQ ID NO: 208769 - DNA, 25 bp, Mus musculus
atccttggatggcagctgtccggca

SEQ ID NO: 208770 - DNA, 25 bp, Mus musculus
atccttggcagaagctctgcagatc

SEQ ID NO: 208771 - DNA, 25 bp, Mus musculus
atccttggcagaaggtagcacggct

SEQ ID NO: 208772 - DNA, 25 bp, Mus musculus
atccttgtcaaagatcgactgtgcc

SEQ ID NO: 208773 - DNA, 25 bp, Mus musculus
atccttgtcaaagtctacaaaatac

SEQ ID NO: 208774 - DNA, 25 bp, Mus musculus
atccttgtcgctgcggatgggacaa

SEQ ID NO: 208775 - DNA, 25 bp, Mus musculus
atccttgtgcttaggacgggttccc

SEQ ID NO: 208776 - DNA, 25 bp, Mus musculus
atccttgtggaaaagaaccagcggg

SEQ ID NO: 208777 - DNA, 25 bp, Mus musculus
atccttgtggacttctgggatacag

SEQ ID NO: 208778 - DNA, 25 bp, Mus musculus
atccttgtgggtatttgatgtccag

SEQ ID NO: 208779 - DNA, 25 bp, Mus musculus
atccttgttaggtgccgcattgcac

SEQ ID NO: 208780 - DNA, 25 bp, Mus musculus
atcctttcacaggtgctgggcgtta

SEQ ID NO: 208781 - DNA, 25 bp, Mus musculus
atcctttcaggagcccagctcccaa

SEQ ID NO: 208782 - DNA, 25 bp, Mus musculus
atcctttcaggtgctgtaggagccc

SEQ ID NO: 208783 - DNA, 25 bp, Mus musculus
atcctttcctaacgctgctgcattt

SEQ ID NO: 208784 - DNA, 25 bp, Mus musculus
atcctttgcatgtgtctaaggatga

SEQ ID NO: 208785 - DNA, 25 bp, Mus musculus
atcctttggagaattgcagtactgt

SEQ ID NO: 208786 - DNA, 25 bp, Mus musculus
atcctttgtgtggttcttcttgctt

SEQ ID NO: 208787 - DNA, 25 bp, Mus musculus
atcctttgttgatggtattgcgcga

SEQ ID NO: 208788 - DNA, 25 bp, Mus musculus
atccttttccagacagtccaggatg

SEQ ID NO: 208789 - DNA, 25 bp, Mus musculus
atccttttgcagatggagggaagac

SEQ ID NO: 208790 - DNA, 25 bp, Mus musculus
atccttttgcagatggtagaaggac

SEQ ID NO: 208791 - DNA, 25 bp, Mus musculus
atccttttgtctacaggcttcctga

SEQ ID NO: 208792 - DNA, 25 bp, Mus musculus
atcctttttataatcatgctgctta

SEQ ID NO: 208793 - DNA, 25 bp, Mus musculus
atcctttttcaacttggagaagaac

SEQ ID NO: 208794 - DNA, 25 bp, Mus musculus
atcctttttgtgttcttgggagtcg

SEQ ID NO: 208795 - DNA, 25 bp, Mus musculus
atcgaaaaggctgtaatttggcctc

SEQ ID NO: 208796 - DNA, 25 bp, Mus musculus
atcgaaaatgagcaactggtggttg

SEQ ID NO: 208797 - DNA, 25 bp, Mus musculus
atcgaaagaacttgtcaatgtccca

SEQ ID NO: 208798 - DNA, 25 bp, Mus musculus
atcgaaagcaagtctcgttacatca

SEQ ID NO: 208799 - DNA, 25 bp, Mus musculus
atcgaaagtcaggaaactgaagctc

SEQ ID NO: 208800 - DNA, 25 bp, Mus musculus
atcgaaataaattgaaaaacatgtg

SEQ ID NO: 208801 - DNA, 25 bp, Mus musculus
atcgaagagctggaccgtgctggaa

SEQ ID NO: 208802 - DNA, 25 bp, Mus musculus
atcgaagagtgggaagaacttccat

SEQ ID NO: 208803 - DNA, 25 bp, Mus musculus
atcgaagcagaaaatgaacaggttg

SEQ ID NO: 208804 - DNA, 25 bp, Mus musculus
atcgaagcccttggtccagaatagc

SEQ ID NO: 208805 - DNA, 25 bp, Mus musculus
atcgaagcgtttgatgactccggaa

SEQ ID NO: 208806 - DNA, 25 bp, Mus musculus
atcgaagcgtttgcaatcccggaag

SEQ ID NO: 208807 - DNA, 25 bp, Mus musculus
atcgaagcgtttggctccttccgct

SEQ ID NO: 208808 - DNA, 25 bp, Mus musculus
atcgaaggcctgcaagacgacaagg

SEQ ID NO: 208809 - DNA, 25 bp, Mus musculus
atcgaaggcctggtcattcaatatt

SEQ ID NO: 208810 - DNA, 25 bp, Mus musculus
atcgaataaagtcagagatccagaa

SEQ ID NO: 208811 - DNA, 25 bp, Mus musculus
atcgaataaagtcaggtatcttttg

SEQ ID NO: 208812 - DNA, 25 bp, Mus musculus
atcgaataaagtcaggttttgatat

SEQ ID NO: 208813 - DNA, 25 bp, Mus musculus
atcgaatacccgactcagccctaga

SEQ ID NO: 208814 - DNA, 25 bp, Mus musculus
atcgaatacccgagttggattgtcc

SEQ ID NO: 208815 - DNA, 25 bp, Mus musculus
atcgaatctacagggatgaatggat

SEQ ID NO: 208816 - DNA, 25 bp, Mus musculus
atcgaatctacaggttatacaatgg

SEQ ID NO: 208817 - DNA, 25 bp, Mus musculus
atcgacaaagacaacactgcttatc

SEQ ID NO: 208818 - DNA, 25 bp, Mus musculus
atcgacaaagtcaaggtgtatgaga

SEQ ID NO: 208819 - DNA, 25 bp, Mus musculus
atcgacaacatgaatgaatctgagc

SEQ ID NO: 208820 - DNA, 25 bp, Mus musculus
atcgacacaaatgaagaaaaaactc

SEQ ID NO: 208821 - DNA, 25 bp, Mus musculus
atcgacacaataaaattgaagagct

SEQ ID NO: 208822 - DNA, 25 bp, Mus musculus
atcgacaccttggggcaacctatcc

SEQ ID NO: 208823 - DNA, 25 bp, Mus musculus
atcgacactgtagccacgcgagttg

SEQ ID NO: 208824 - DNA, 25 bp, Mus musculus
atcgacagagcccaggagcacctca

SEQ ID NO: 208825 - DNA, 25 bp, Mus musculus
atcgacagagcccaggtctgctgcc

SEQ ID NO: 208826 - DNA, 25 bp, Mus musculus
atcgacagaggatgagggtgaggac

SEQ ID NO: 208827 - DNA, 25 bp, Mus musculus
atcgacatcaagatcatcgcccccc

SEQ ID NO: 208828 - DNA, 25 bp, Mus musculus
atcgaccacacagcggggagaaggt

SEQ ID NO: 208829 - DNA, 25 bp, Mus musculus
atcgaccacacagcggtcgctatgc

SEQ ID NO: 208830 - DNA, 25 bp, Mus musculus
atcgacccgaagagtacagtcgttt

SEQ ID NO: 208831 - DNA, 25 bp, Mus musculus
atcgacccgaaggtcgttttgaagc

SEQ ID NO: 208832 - DNA, 25 bp, Mus musculus
atcgaccctgagactggtatgggcc

SEQ ID NO: 208833 - DNA, 25 bp, Mus musculus
atcgaccctgagcttgcaagatacc

SEQ ID NO: 208834 - DNA, 25 bp, Mus musculus
atcgaccgcaaggtcaactcctgga

SEQ ID NO: 208835 - DNA, 25 bp, Mus musculus
atcgaccggttccaggatccagccg

SEQ ID NO: 208836 - DNA, 25 bp, Mus musculus
atcgacctacaggacagctatacag

SEQ ID NO: 208837 - DNA, 25 bp, Mus musculus
atcgacctacaggaggggcccggcc

SEQ ID NO: 208838 - DNA, 25 bp, Mus musculus
atcgacctgagccccgagcctttga

SEQ ID NO: 208839 - DNA, 25 bp, Mus musculus
atcgacctggctgctgcaagaaccc

SEQ ID NO: 208840 - DNA, 25 bp, Mus musculus
atcgaccttccaggagatcctgaac

SEQ ID NO: 208841 - DNA, 25 bp, Mus musculus
atcgaccttccaggttttgggaact

SEQ ID NO: 208842 - DNA, 25 bp, Mus musculus
atcgacgacctccacaaggttctga

SEQ ID NO: 208843 - DNA, 25 bp, Mus musculus
atcgacggcctggtagtattaaagg

SEQ ID NO: 208844 - DNA, 25 bp, Mus musculus
atcgactgcgtcaagacccggatgc

SEQ ID NO: 208845 - DNA, 25 bp, Mus musculus
atcgactgcgtcaaggtgcagccgg

SEQ ID NO: 208846 - DNA, 25 bp, Mus musculus
atcgacttatcaaaggtgtggccca

SEQ ID NO: 208847 - DNA, 25 bp, Mus musculus
atcgacttcaaggacacagcaggcc

SEQ ID NO: 208848 - DNA, 25 bp, Mus musculus
atcgacttcaggctgatctcttcgt

SEQ ID NO: 208849 - DNA, 25 bp, Mus musculus
atcgactttgaaggacaaattgcac

SEQ ID NO: 208850 - DNA, 25 bp, Mus musculus
atcgactttgaaggtccttgctgcc

SEQ ID NO: 208851 - DNA, 25 bp, Mus musculus
atcgactttgccagaaagtgagcca

SEQ ID NO: 208852 - DNA, 25 bp, Mus musculus
atcgagaaaaccctggcgtttagag

SEQ ID NO: 208853 - DNA, 25 bp, Mus musculus
atcgagaaatagaagggaacaagtc

SEQ ID NO: 208854 - DNA, 25 bp, Mus musculus
atcgagaagccaggagaaactacaa

SEQ ID NO: 208855 - DNA, 25 bp, Mus musculus
atcgagaagccaggtggtgaccata

SEQ ID NO: 208856 - DNA, 25 bp, Mus musculus
atcgagaattaatagctaaaaggac

SEQ ID NO: 208857 - DNA, 25 bp, Mus musculus
atcgagagagaaaaaatcaaccact

SEQ ID NO: 208858 - DNA, 25 bp, Mus musculus
atcgagagagaaaaaatcaatccag

SEQ ID NO: 208859 - DNA, 25 bp, Mus musculus
atcgagaggagtggctcaggagtta

SEQ ID NO: 208860 - DNA, 25 bp, Mus musculus
atcgagaggcgcgaggccgcaaaac

SEQ ID NO: 208861 - DNA, 25 bp, Mus musculus
atcgagatgcacaaccaggcggaaa

SEQ ID NO: 208862 - DNA, 25 bp, Mus musculus
atcgagcaatggctaggagaccatc

SEQ ID NO: 208863 - DNA, 25 bp, Mus musculus
atcgagcacctccgggacctgtttc

SEQ ID NO: 208864 - DNA, 25 bp, Mus musculus
atcgagcaggccctttccgatctca

SEQ ID NO: 208865 - DNA, 25 bp, Mus musculus
atcgagcagtggatggaagacagcg

SEQ ID NO: 208866 - DNA, 25 bp, Mus musculus
atcgagctcatgaacacttcagtta

SEQ ID NO: 208867 - DNA, 25 bp, Mus musculus
atcgagctcatgatcagtaatggaa

SEQ ID NO: 208868 - DNA, 25 bp, Mus musculus
atcgagctcatgtgttctgtgccaa

SEQ ID NO: 208869 - DNA, 25 bp, Mus musculus
atcgagctcatgttaccgaagtgca

SEQ ID NO: 208870 - DNA, 25 bp, Mus musculus
atcgaggacgtcccgcacgtagaag

SEQ ID NO: 208871 - DNA, 25 bp, Mus musculus
atcgaggagatcgagggcctgatct

SEQ ID NO: 208872 - DNA, 25 bp, Mus musculus
atcgaggaggtgtaccacagcagcc

SEQ ID NO: 208873 - DNA, 25 bp, Mus musculus
atcgaggatcctcaggaggaagaac

SEQ ID NO: 208874 - DNA, 25 bp, Mus musculus
atcgaggatttagctggtccaaagc

SEQ ID NO: 208875 - DNA, 25 bp, Mus musculus
atcgaggcatggccagtaatgttaa

SEQ ID NO: 208876 - DNA, 25 bp, Mus musculus
atcgaggcatgggtgaacggccttt

SEQ ID NO: 208877 - DNA, 25 bp, Mus musculus
atcgagggatacagatgtatgagtc

SEQ ID NO: 208878 - DNA, 25 bp, Mus musculus
atcgagggatacaggatggtgttgc

SEQ ID NO: 208879 - DNA, 25 bp, Mus musculus
atcgaggtatttccaatcccgctca

SEQ ID NO: 208880 - DNA, 25 bp, Mus musculus
atcgaggtggcaggccccactgaaa

SEQ ID NO: 208881 - DNA, 25 bp, Mus musculus
atcgagtaaaatcgataaacaaccc

SEQ ID NO: 208882 - DNA, 25 bp, Mus musculus
atcgagtacaggagttattcctgat

SEQ ID NO: 208883 - DNA, 25 bp, Mus musculus
atcgagtacgaagtgggctaaagcc

SEQ ID NO: 208884 - DNA, 25 bp, Mus musculus
atcgagtgtcaagactgtgatttac

SEQ ID NO: 208885 - DNA, 25 bp, Mus musculus
atcgagttctgggagaacaaagtat

SEQ ID NO: 208886 - DNA, 25 bp, Mus musculus
atcgagtttgaaattcctatcacat

SEQ ID NO: 208887 - DNA, 25 bp, Mus musculus
atcgataaccagagccaacctttgg

SEQ ID NO: 208888 - DNA, 25 bp, Mus musculus
atcgataaccaggtgagaaaggcag

SEQ ID NO: 208889 - DNA, 25 bp, Mus musculus
atcgataccgtgatgcaattgctga

SEQ ID NO: 208890 - DNA, 25 bp, Mus musculus
atcgatactgtggagactatgacag

SEQ ID NO: 208891 - DNA, 25 bp, Mus musculus
atcgatactgtggagggctccacct

SEQ ID NO: 208892 - DNA, 25 bp, Mus musculus
atcgatagcaacgggggcatctgca

SEQ ID NO: 208893 - DNA, 25 bp, Mus musculus
atcgatataaagactcggtacccca

SEQ ID NO: 208894 - DNA, 25 bp, Mus musculus
atcgatataaagattgccctgaccg

SEQ ID NO: 208895 - DNA, 25 bp, Mus musculus
atcgatatcaggttgatccccaaag

SEQ ID NO: 208896 - DNA, 25 bp, Mus musculus
atcgatatctaatttttaagacaat

SEQ ID NO: 208897 - DNA, 25 bp, Mus musculus
atcgatcgatcgagtcagtccgacc

SEQ ID NO: 208898 - DNA, 25 bp, Mus musculus
atcgatgacgtgaaaagacaccgaa

SEQ ID NO: 208899 - DNA, 25 bp, Mus musculus
atcgatgagacaagaagactgctgg

SEQ ID NO: 208900 - DNA, 25 bp, Mus musculus
atcgatgagacaagatcttcaagca

SEQ ID NO: 208901 - DNA, 25 bp, Mus musculus
atcgatgcagtgaagcctggtgttc

SEQ ID NO: 208902 - DNA, 25 bp, Mus musculus
atcgatgccagaaagaagagctgaa

SEQ ID NO: 208903 - DNA, 25 bp, Mus musculus
atcgatgccagattttgcctcagta

SEQ ID NO: 208904 - DNA, 25 bp, Mus musculus
atcgatgccaggtttcactttttca

SEQ ID NO: 208905 - DNA, 25 bp, Mus musculus
atcgatgccatggacgtgactgcac

SEQ ID NO: 208906 - DNA, 25 bp, Mus musculus
atcgatggcgtgacctcctcttgct

SEQ ID NO: 208907 - DNA, 25 bp, Mus musculus
atcgatgtgcacatgctggtagctg

SEQ ID NO: 208908 - DNA, 25 bp, Mus musculus
atcgatgtgcgagattgtgaaggga

SEQ ID NO: 208909 - DNA, 25 bp, Mus musculus
atcgatgtgcgagggaaggttgtga

SEQ ID NO: 208910 - DNA, 25 bp, Mus musculus
atcgattcaaggatcgcattgtatc

SEQ ID NO: 208911 - DNA, 25 bp, Mus musculus
atcgattccagcgtctcaaagggta

SEQ ID NO: 208912 - DNA, 25 bp, Mus musculus
atcgattccagcgtttcatgaacca

SEQ ID NO: 208913 - DNA, 25 bp, Mus musculus
atcgattccgaatctgcctcagcct

SEQ ID NO: 208914 - DNA, 25 bp, Mus musculus
atcgattccgatttgtgctagtgaa

SEQ ID NO: 208915 - DNA, 25 bp, Mus musculus
atcgatttcgggacctacccctttg

SEQ ID NO: 208916 - DNA, 25 bp, Mus musculus
atcgcaagaaaaagtctgatgccaa

SEQ ID NO: 208917 - DNA, 25 bp, Mus musculus
atcgcaaggttgcagcacgcagcag

SEQ ID NO: 208918 - DNA, 25 bp, Mus musculus
atcgcaattggaaggatgcagggct

SEQ ID NO: 208919 - DNA, 25 bp, Mus musculus
atcgcacagacgattcctcagatgt

SEQ ID NO: 208920 - DNA, 25 bp, Mus musculus
atcgcacagctctatggtatcgctg

SEQ ID NO: 208921 - DNA, 25 bp, Mus musculus
atcgcacaggaagggactgagacta

SEQ ID NO: 208922 - DNA, 25 bp, Mus musculus
atcgcactgcagacaattgcctata

SEQ ID NO: 208923 - DNA, 25 bp, Mus musculus
atcgcagaccattgcccagactcgg

SEQ ID NO: 208924 - DNA, 25 bp, Mus musculus
atcgcagagacagaggaggccatgt

SEQ ID NO: 208925 - DNA, 25 bp, Mus musculus
atcgcagaggggacaatgccaagtt

SEQ ID NO: 208926 - DNA, 25 bp, Mus musculus
atcgcaggacacgaaaactgtcctt

SEQ ID NO: 208927 - DNA, 25 bp, Mus musculus
atcgcagtgcacagagcatatgaaa

SEQ ID NO: 208928 - DNA, 25 bp, Mus musculus
atcgcagtgctcagtgtggctgagg

SEQ ID NO: 208929 - DNA, 25 bp, Mus musculus
atcgcatttttcaataatgtatatt

SEQ ID NO: 208930 - DNA, 25 bp, Mus musculus
atcgccaagcggacccagccacctc

SEQ ID NO: 208931 - DNA, 25 bp, Mus musculus
atcgccaatgctgacttggagctgg

SEQ ID NO: 208932 - DNA, 25 bp, Mus musculus
atcgccaatggttggttttgaccct

SEQ ID NO: 208933 - DNA, 25 bp, Mus musculus
atcgccacagagcctacagagtgat

SEQ ID NO: 208934 - DNA, 25 bp, Mus musculus
atcgccagctcaggcaccttaagga

SEQ ID NO: 208935 - DNA, 25 bp, Mus musculus
atcgccagtgatttccggtacaaag

SEQ ID NO: 208936 - DNA, 25 bp, Mus musculus
atcgccatcctggcgatcattacag

SEQ ID NO: 208937 - DNA, 25 bp, Mus musculus
atcgccatcctggcggggaattcta

SEQ ID NO: 208938 - DNA, 25 bp, Mus musculus
atcgcccacagcagagtctgtgcgc

SEQ ID NO: 208939 - DNA, 25 bp, Mus musculus
atcgccccagctccaaggaaacgcg

SEQ ID NO: 208940 - DNA, 25 bp, Mus musculus
atcgccccctggcaggtgatgcttt

SEQ ID NO: 208941 - DNA, 25 bp, Mus musculus
atcgcccctaagccttcaagatggt

SEQ ID NO: 208942 - DNA, 25 bp, Mus musculus
atcgcccctaaggtaagttctcgtc

SEQ ID NO: 208943 - DNA, 25 bp, Mus musculus
atcgcccggcaggcctatgagaagc

SEQ ID NO: 208944 - DNA, 25 bp, Mus musculus
atcgccctggtggggttggtggctg

SEQ ID NO: 208945 - DNA, 25 bp, Mus musculus
atcgccctggtgggtccaagtacag

SEQ ID NO: 208946 - DNA, 25 bp, Mus musculus
atcgccgaaaagaaatggaagatag

SEQ ID NO: 208947 - DNA, 25 bp, Mus musculus
atcgccgagaggaaccaagatgacc

SEQ ID NO: 208948 - DNA, 25 bp, Mus musculus
atcgccggaaagagacacagcagtc

SEQ ID NO: 208949 - DNA, 25 bp, Mus musculus
atcgcctactgcagtcagctggccg

SEQ ID NO: 208950 - DNA, 25 bp, Mus musculus
atcgcctcaaggagtatgtctccaa

SEQ ID NO: 208951 - DNA, 25 bp, Mus musculus
atcgcctcagagaacttctgcagcc

SEQ ID NO: 208952 - DNA, 25 bp, Mus musculus
atcgcctcagagatactacggagga

SEQ ID NO: 208953 - DNA, 25 bp, Mus musculus
atcgcctccagcctatttaagagtg

SEQ ID NO: 208954 - DNA, 25 bp, Mus musculus
atcgcctccaggccagcagcaacat

SEQ ID NO: 208955 - DNA, 25 bp, Mus musculus
atcgcctcttggattctgtgtcttt

SEQ ID NO: 208956 - DNA, 25 bp, Mus musculus
atcgcctgcagagaggaagacgact

SEQ ID NO: 208957 - DNA, 25 bp, Mus musculus
atcgcctgcagggcatggaacaaga

SEQ ID NO: 208958 - DNA, 25 bp, Mus musculus
atcgcctgcagggtgagttggtgaa

SEQ ID NO: 208959 - DNA, 25 bp, Mus musculus
atcgcctgcatcgagggagtagaac

SEQ ID NO: 208960 - DNA, 25 bp, Mus musculus
atcgcctttgaccaggaacttagcc

SEQ ID NO: 208961 - DNA, 25 bp, Mus musculus
atcgcctttgaccaggtaaccggtg

SEQ ID NO: 208962 - DNA, 25 bp, Mus musculus
atcgcgcagcgacaatggaggtgaa

SEQ ID NO: 208963 - DNA, 25 bp, Mus musculus
atcgcgcagcgacattgtgtgttcc

SEQ ID NO: 208964 - DNA, 25 bp, Mus musculus
atcgcgcgcgaggcggaggccaggc

SEQ ID NO: 208965 - DNA, 25 bp, Mus musculus
atcgcgcgcgggggtgttccctcac

SEQ ID NO: 208966 - DNA, 25 bp, Mus musculus
atcgcggcgtccggacactgcagaa

SEQ ID NO: 208967 - DNA, 25 bp, Mus musculus
atcgcgtcccggcccagggccttgc

SEQ ID NO: 208968 - DNA, 25 bp, Mus musculus
atcgctacagatactttatgcatgg

SEQ ID NO: 208969 - DNA, 25 bp, Mus musculus
atcgctcgaggaatcaaaagtcagg

SEQ ID NO: 208970 - DNA, 25 bp, Mus musculus
atcgctgaatttacggtcaccattc

SEQ ID NO: 208971 - DNA, 25 bp, Mus musculus
atcgctgaatttacggtggctctcc

SEQ ID NO: 208972 - DNA, 25 bp, Mus musculus
atcgctgacgtagaggaaatgctgt

SEQ ID NO: 208973 - DNA, 25 bp, Mus musculus
atcgctgcaggaacgtttggatgaa

SEQ ID NO: 208974 - DNA, 25 bp, Mus musculus
atcgctgccaccatgaaaggagaag

SEQ ID NO: 208975 - DNA, 25 bp, Mus musculus
atcgctgcccaggtccgcacgctca

SEQ ID NO: 208976 - DNA, 25 bp, Mus musculus
atcgctggtgaggaaccacagcgag

SEQ ID NO: 208977 - DNA, 25 bp, Mus musculus
atcgctggtgggggcgctcctgggc

SEQ ID NO: 208978 - DNA, 25 bp, Mus musculus
atcgctgtccagctcgtagtgcatg

SEQ ID NO: 208979 - DNA, 25 bp, Mus musculus
atcgctgtccaggagctggagaagc

SEQ ID NO: 208980 - DNA, 25 bp, Mus musculus
atcgctgtctccaagccaagaggac

SEQ ID NO: 208981 - DNA, 25 bp, Mus musculus
atcgctgtgtctatcgtgcgggccc

SEQ ID NO: 208982 - DNA, 25 bp, Mus musculus
atcgctgtgtctatgtgaagccatc

SEQ ID NO: 208983 - DNA, 25 bp, Mus musculus
atcgcttacttaaaggaagtggaac

SEQ ID NO: 208984 - DNA, 25 bp, Mus musculus
atcgcttagcagacgcttaaaggat

SEQ ID NO: 208985 - DNA, 25 bp, Mus musculus
atcgcttcaatgcaccgggtgctca

SEQ ID NO: 208986 - DNA, 25 bp, Mus musculus
atcgcttctttgaggactccagatt

SEQ ID NO: 208987 - DNA, 25 bp, Mus musculus
atcgctttcaactgtatggtcttgg

SEQ ID NO: 208988 - DNA, 25 bp, Mus musculus
atcgctttctgaatggtttggctac

SEQ ID NO: 208989 - DNA, 25 bp, Mus musculus
atcggaaaaaggaaggtcatcgtgg

SEQ ID NO: 208990 - DNA, 25 bp, Mus musculus
atcggaacaagtctgggacctgtca

SEQ ID NO: 208991 - DNA, 25 bp, Mus musculus
atcggaacaattggtacccttgtcc

SEQ ID NO: 208992 - DNA, 25 bp, Mus musculus
atcggaaccagttccctcagccaat

SEQ ID NO: 208993 - DNA, 25 bp, Mus musculus
atcggaaccatggctagcctctgcc

SEQ ID NO: 208994 - DNA, 25 bp, Mus musculus
atcggaaccatgtgaaaccttccac

SEQ ID NO: 208995 - DNA, 25 bp, Mus musculus
atcggaacctctaccactacagcca

SEQ ID NO: 208996 - DNA, 25 bp, Mus musculus
atcggaactgagccatctcttggcg

SEQ ID NO: 208997 - DNA, 25 bp, Mus musculus
atcggaagagaccaagcaaaatgag

SEQ ID NO: 208998 - DNA, 25 bp, Mus musculus
atcggaagcctctgagtcgcttcaa

SEQ ID NO: 208999 - DNA, 25 bp, Mus musculus
atcggaagcctctggaattggaaat

SEQ ID NO: 209000 - DNA, 25 bp, Mus musculus
atcggacagggatgagaccggggcc

SEQ ID NO: 209001 - DNA, 25 bp, Mus musculus
atcggaccccgaggagccaacatgt

SEQ ID NO: 209002 - DNA, 25 bp, Mus musculus
atcggacctgatttcaagtccaact

SEQ ID NO: 209003 - DNA, 25 bp, Mus musculus
atcggacctgctatctgatgtccag

SEQ ID NO: 209004 - DNA, 25 bp, Mus musculus
atcggactaggtctgcctgggctta

SEQ ID NO: 209005 - DNA, 25 bp, Mus musculus
atcggactagtggccacagttaagc

SEQ ID NO: 209006 - DNA, 25 bp, Mus musculus
atcggactatacaaggtggggatgc

SEQ ID NO: 209007 - DNA, 25 bp, Mus musculus
atcggactcgctgagctccagttat

SEQ ID NO: 209008 - DNA, 25 bp, Mus musculus
atcggacttttgatcctcacttcct

SEQ ID NO: 209009 - DNA, 25 bp, Mus musculus
atcggacttttggacagtttcttga

SEQ ID NO: 209010 - DNA, 25 bp, Mus musculus
atcggagagaatgggttcaatgtat

SEQ ID NO: 209011 - DNA, 25 bp, Mus musculus
atcggagagaccaggtaggcgacgc

SEQ ID NO: 209012 - DNA, 25 bp, Mus musculus
atcggagatttgcagtccaacgtcg

SEQ ID NO: 209013 - DNA, 25 bp, Mus musculus
atcggagccgcagcagttgccccag

SEQ ID NO: 209014 - DNA, 25 bp, Mus musculus
atcggagtgccaagacacaagcatc

SEQ ID NO: 209015 - DNA, 25 bp, Mus musculus
atcggagtgccaattattctgtttt

SEQ ID NO: 209016 - DNA, 25 bp, Mus musculus
atcggatcaatggctctgcctggta

SEQ ID NO: 209017 - DNA, 25 bp, Mus musculus
atcggatgagcagagaccactgcta

SEQ ID NO: 209018 - DNA, 25 bp, Mus musculus
atcggattcacaaataaagtggtga

SEQ ID NO: 209019 - DNA, 25 bp, Mus musculus
atcggcaccggcttttcctagatga

SEQ ID NO: 209020 - DNA, 25 bp, Mus musculus
atcggcagaaagctaaaaagatctg

SEQ ID NO: 209021 - DNA, 25 bp, Mus musculus
atcggcagatcagagattgttattg

SEQ ID NO: 209022 - DNA, 25 bp, Mus musculus
atcggcagatcagaggttgagcttg

SEQ ID NO: 209023 - DNA, 25 bp, Mus musculus
atcggcagcgtcaggggacagacca

SEQ ID NO: 209024 - DNA, 25 bp, Mus musculus
atcggcaggcagaggcagatatcaa

SEQ ID NO: 209025 - DNA, 25 bp, Mus musculus
atcggcatcgcggaggatcggtcat

SEQ ID NO: 209026 - DNA, 25 bp, Mus musculus
atcggcatgaaccacaagacctgct

SEQ ID NO: 209027 - DNA, 25 bp, Mus musculus
atcggcatggtttgctaggtattga

SEQ ID NO: 209028 - DNA, 25 bp, Mus musculus
atcggcatgttctctgaattcctgt

SEQ ID NO: 209029 - DNA, 25 bp, Mus musculus
atcggccagtgagcccatcatcttc

SEQ ID NO: 209030 - DNA, 25 bp, Mus musculus
atcggccagtgccaaggcctggcca

SEQ ID NO: 209031 - DNA, 25 bp, Mus musculus
atcggcctccaacgtatcccaccaa

SEQ ID NO: 209032 - DNA, 25 bp, Mus musculus
atcggcctgcggaggataagacctc

SEQ ID NO: 209033 - DNA, 25 bp, Mus musculus
atcggcgagcccagggaatattttt

SEQ ID NO: 209034 - DNA, 25 bp, Mus musculus
atcggcgagcccagtacgctccaga

SEQ ID NO: 209035 - DNA, 25 bp, Mus musculus
atcggctacacagaagttcagttcc

SEQ ID NO: 209036 - DNA, 25 bp, Mus musculus
atcggctacacagatgttcactgaa

SEQ ID NO: 209037 - DNA, 25 bp, Mus musculus
atcggctacacagtctgggtgtttg

SEQ ID NO: 209038 - DNA, 25 bp, Mus musculus
atcggctcagggtcttggaggagga

SEQ ID NO: 209039 - DNA, 25 bp, Mus musculus
atcggctcattgaggtgaatgggca

SEQ ID NO: 209040 - DNA, 25 bp, Mus musculus
atcggctccacacgggacaagctct

SEQ ID NO: 209041 - DNA, 25 bp, Mus musculus
atcggctccacacggttacaggccc

SEQ ID NO: 209042 - DNA, 25 bp, Mus musculus
atcggctccgagggagcagaaggcc

SEQ ID NO: 209043 - DNA, 25 bp, Mus musculus
atcggctccgaggtgggaaactacc

SEQ ID NO: 209044 - DNA, 25 bp, Mus musculus
atcggctctccgggtgtaaagatct

SEQ ID NO: 209045 - DNA, 25 bp, Mus musculus
atcggctgtcagagactatgaaatc

SEQ ID NO: 209046 - DNA, 25 bp, Mus musculus
atcggcttcagatatttatcaacaa

SEQ ID NO: 209047 - DNA, 25 bp, Mus musculus
atcggcttggtttggttccagtgtc

SEQ ID NO: 209048 - DNA, 25 bp, Mus musculus
atcggctttgcaaaagtacgatcag

SEQ ID NO: 209049 - DNA, 25 bp, Mus musculus
atcggctttgcaaagtgattcgtaa

SEQ ID NO: 209050 - DNA, 25 bp, Mus musculus
atcggctttgcaaatgctcagcaga

SEQ ID NO: 209051 - DNA, 25 bp, Mus musculus
atcgggaaacgtctctggagctggg

SEQ ID NO: 209052 - DNA, 25 bp, Mus musculus
atcgggaacatggagcacatggctg

SEQ ID NO: 209053 - DNA, 25 bp, Mus musculus
atcgggaagctgaggaaaccaatgt

SEQ ID NO: 209054 - DNA, 25 bp, Mus musculus
atcgggaagctgaggtctaatctct

SEQ ID NO: 209055 - DNA, 25 bp, Mus musculus
atcgggacagcataagcagtacgct

SEQ ID NO: 209056 - DNA, 25 bp, Mus musculus
atcgggacaggacgcgtccagagat

SEQ ID NO: 209057 - DNA, 25 bp, Mus musculus
atcgggacaggaggcgtccagagat

SEQ ID NO: 209058 - DNA, 25 bp, Mus musculus
atcgggacctaaagcctgagaattt

SEQ ID NO: 209059 - DNA, 25 bp, Mus musculus
atcgggatggcagcataggtggcag

SEQ ID NO: 209060 - DNA, 25 bp, Mus musculus
atcgggatggcaggatccaagtgaa

SEQ ID NO: 209061 - DNA, 25 bp, Mus musculus
atcgggcgagctgtaaaagctggca

SEQ ID NO: 209062 - DNA, 25 bp, Mus musculus
atcgggctgcagatgggcaccaaca

SEQ ID NO: 209063 - DNA, 25 bp, Mus musculus
atcgggctgcctggcgtggccgaga

SEQ ID NO: 209064 - DNA, 25 bp, Mus musculus
atcgggctgcctgtctccctccaga

SEQ ID NO: 209065 - DNA, 25 bp, Mus musculus
atcgggcttcagggggctgaggcga

SEQ ID NO: 209066 - DNA, 25 bp, Mus musculus
atcgggcttgggcccagagtatgtt

SEQ ID NO: 209067 - DNA, 25 bp, Mus musculus
atcggggacaagggtgacaagggag

SEQ ID NO: 209068 - DNA, 25 bp, Mus musculus
atcggggactaacaggactccaagc

SEQ ID NO: 209069 - DNA, 25 bp, Mus musculus
atcggggcagaagagattgtggatg

SEQ ID NO: 209070 - DNA, 25 bp, Mus musculus
atcggggcaggatggcagccacaga

SEQ ID NO: 209071 - DNA, 25 bp, Mus musculus
atcggggcgcgcggtgtgaagaaaa

SEQ ID NO: 209072 - DNA, 25 bp, Mus musculus
atcggggttgtcaggtatgagcatg

SEQ ID NO: 209073 - DNA, 25 bp, Mus musculus
atcgggtcatctaagaatgaagcca

SEQ ID NO: 209074 - DNA, 25 bp, Mus musculus
atcgggtcgtaggtctcaaaagatt

SEQ ID NO: 209075 - DNA, 25 bp, Mus musculus
atcgggtgacagggccctggatgtc

SEQ ID NO: 209076 - DNA, 25 bp, Mus musculus
atcgggttaaggttgaggagccctc

SEQ ID NO: 209077 - DNA, 25 bp, Mus musculus
atcggtacaggacagctttgcaaat

SEQ ID NO: 209078 - DNA, 25 bp, Mus musculus
atcggtacagggactgagactatgg

SEQ ID NO: 209079 - DNA, 25 bp, Mus musculus
atcggtacagtggcaggacagcttt

SEQ ID NO: 209080 - DNA, 25 bp, Mus musculus
atcggtccagtgaggctgtcatctg

SEQ ID NO: 209081 - DNA, 25 bp, Mus musculus
atcggtccagtgaggggtgcactct

SEQ ID NO: 209082 - DNA, 25 bp, Mus musculus
atcggtgcccctgaccccatgactc

SEQ ID NO: 209083 - DNA, 25 bp, Mus musculus
atcggtggcggaagctggaatgcct

SEQ ID NO: 209084 - DNA, 25 bp, Mus musculus
atcggtgtcggatcagctgcctgct

SEQ ID NO: 209085 - DNA, 25 bp, Mus musculus
atcggttagagcagatggaagattc

SEQ ID NO: 209086 - DNA, 25 bp, Mus musculus
atcggttctggcgctccggcactca

SEQ ID NO: 209087 - DNA, 25 bp, Mus musculus
atcggttctggcgggattcctctgc

SEQ ID NO: 209088 - DNA, 25 bp, Mus musculus
atcggtttatgcctgagcgcttctt

SEQ ID NO: 209089 - DNA, 25 bp, Mus musculus
atcggtttatgcctgatccaacagg

SEQ ID NO: 209090 - DNA, 25 bp, Mus musculus
atcggtttcttcaaggacgtagagt

SEQ ID NO: 209091 - DNA, 25 bp, Mus musculus
atcgtacttcctctggactctgtga

SEQ ID NO: 209092 - DNA, 25 bp, Mus musculus
atcgtacttcctctgtggaaggact

SEQ ID NO: 209093 - DNA, 25 bp, Mus musculus
atcgtagaggcggatcacattccag

SEQ ID NO: 209094 - DNA, 25 bp, Mus musculus
atcgtagaggcggggctctgccacg

SEQ ID NO: 209095 - DNA, 25 bp, Mus musculus
atcgtaggggcgaggcacccaagca

SEQ ID NO: 209096 - DNA, 25 bp, Mus musculus
atcgtattactgaagcttaaaaagc

SEQ ID NO: 209097 - DNA, 25 bp, Mus musculus
atcgtcaaagaaggggaggaagttt

SEQ ID NO: 209098 - DNA, 25 bp, Mus musculus
atcgtcaagtactggttgggtggtc

SEQ ID NO: 209099 - DNA, 25 bp, Mus musculus
atcgtcaagtactggtttacaggaa

SEQ ID NO: 209100 - DNA, 25 bp, Mus musculus
atcgtcacatgatcatggatatacc

SEQ ID NO: 209101 - DNA, 25 bp, Mus musculus
atcgtcacccacagcaatgagaggt

SEQ ID NO: 209102 - DNA, 25 bp, Mus musculus
atcgtcacggattccacactacgcc

SEQ ID NO: 209103 - DNA, 25 bp, Mus musculus
atcgtcactgacaccaattctaggg

SEQ ID NO: 209104 - DNA, 25 bp, Mus musculus
atcgtcactgatgcccttcccggtg

SEQ ID NO: 209105 - DNA, 25 bp, Mus musculus
atcgtcactgatgtatgacctgcca

SEQ ID NO: 209106 - DNA, 25 bp, Mus musculus
atcgtcagacagcacatcgtcagcg

SEQ ID NO: 209107 - DNA, 25 bp, Mus musculus
atcgtcagacagctacagcacatcg

SEQ ID NO: 209108 - DNA, 25 bp, Mus musculus
atcgtcagcaagctgtgggccacat

SEQ ID NO: 209109 - DNA, 25 bp, Mus musculus
atcgtcatacgtccctggaggctgt

SEQ ID NO: 209110 - DNA, 25 bp, Mus musculus
atcgtcatatcaggtaacgggcaac

SEQ ID NO: 209111 - DNA, 25 bp, Mus musculus
atcgtccatgtcgggtgtgaagatt

SEQ ID NO: 209112 - DNA, 25 bp, Mus musculus
atcgtcccagcggctgaccaaggcc

SEQ ID NO: 209113 - DNA, 25 bp, Mus musculus
atcgtcccagttttcgcataccatc

SEQ ID NO: 209114 - DNA, 25 bp, Mus musculus
atcgtccccggacggagctgaagaa

SEQ ID NO: 209115 - DNA, 25 bp, Mus musculus
atcgtccgccagactcagtccgcta

SEQ ID NO: 209116 - DNA, 25 bp, Mus musculus
atcgtccgccagagtacagttgacc

SEQ ID NO: 209117 - DNA, 25 bp, Mus musculus
atcgtcctaacccagaacatgtttg

SEQ ID NO: 209118 - DNA, 25 bp, Mus musculus
atcgtcctgcgctctttgagcgctg

SEQ ID NO: 209119 - DNA, 25 bp, Mus musculus
atcgtcctgggtggctctcccaggg

SEQ ID NO: 209120 - DNA, 25 bp, Mus musculus
atcgtccttgaaagccctctgggcg

SEQ ID NO: 209121 - DNA, 25 bp, Mus musculus
atcgtcgcagaaagtaagccccaaa

SEQ ID NO: 209122 - DNA, 25 bp, Mus musculus
atcgtcgcagacagctgagtagatg

SEQ ID NO: 209123 - DNA, 25 bp, Mus musculus
atcgtcgcctgcaggatactttgga

SEQ ID NO: 209124 - DNA, 25 bp, Mus musculus
atcgtcgcctgcaggtgattttcga

SEQ ID NO: 209125 - DNA, 25 bp, Mus musculus
atcgtcgcctgcaggtgtctaagca

SEQ ID NO: 209126 - DNA, 25 bp, Mus musculus
atcgtcggtattttcaggaaatcag

SEQ ID NO: 209127 - DNA, 25 bp, Mus musculus
atcgtctctgagccacctgcgcaac

SEQ ID NO: 209128 - DNA, 25 bp, Mus musculus
atcgtctctttcaaattaattgtgg

SEQ ID NO: 209129 - DNA, 25 bp, Mus musculus
atcgtctgagtggagaacttcacct

SEQ ID NO: 209130 - DNA, 25 bp, Mus musculus
atcgtcttcagattggagattttat

SEQ ID NO: 209131 - DNA, 25 bp, Mus musculus
atcgtgaacctgcagtggaccccga

SEQ ID NO: 209132 - DNA, 25 bp, Mus musculus
atcgtgacagagatggtcaagagat

SEQ ID NO: 209133 - DNA, 25 bp, Mus musculus
atcgtgacagaggaacagaaattct

SEQ ID NO: 209134 - DNA, 25 bp, Mus musculus
atcgtgacagaggcgttctctgcgg

SEQ ID NO: 209135 - DNA, 25 bp, Mus musculus
atcgtgacagagtggaatctggtgt

SEQ ID NO: 209136 - DNA, 25 bp, Mus musculus
atcgtgacagagtgggacctggtgt

SEQ ID NO: 209137 - DNA, 25 bp, Mus musculus
atcgtgactgagtggaaccttgtgt

SEQ ID NO: 209138 - DNA, 25 bp, Mus musculus
atcgtgagtggtcctgtccaagaac

SEQ ID NO: 209139 - DNA, 25 bp, Mus musculus
atcgtgatcggcaagaagccagttg

SEQ ID NO: 209140 - DNA, 25 bp, Mus musculus
atcgtgatcggtgagaaggaccgaa

SEQ ID NO: 209141 - DNA, 25 bp, Mus musculus
atcgtgcaccgcctgacccccagcc

SEQ ID NO: 209142 - DNA, 25 bp, Mus musculus
atcgtgcaccgggatttaaagttgg

SEQ ID NO: 209143 - DNA, 25 bp, Mus musculus
atcgtgcactagcgggacttggtga

SEQ ID NO: 209144 - DNA, 25 bp, Mus musculus
atcgtgcactagcggtctcaaaaga

SEQ ID NO: 209145 - DNA, 25 bp, Mus musculus
atcgtgcccgatgaacgagaccgtg

SEQ ID NO: 209146 - DNA, 25 bp, Mus musculus
atcgtgcgcaaactgactgatgatg

SEQ ID NO: 209147 - DNA, 25 bp, Mus musculus
atcgtgcgcaaactggcgccccttg

SEQ ID NO: 209148 - DNA, 25 bp, Mus musculus
atcgtgctccagtgtggcgctgact

SEQ ID NO: 209149 - DNA, 25 bp, Mus musculus
atcgtgctgttcccgatccgtactt

SEQ ID NO: 209150 - DNA, 25 bp, Mus musculus
atcgtggaagccttgccatgcagtg

SEQ ID NO: 209151 - DNA, 25 bp, Mus musculus
atcgtggaagtggaaaacccaggtc

SEQ ID NO: 209152 - DNA, 25 bp, Mus musculus
atcgtggacctccactccaggcagc

SEQ ID NO: 209153 - DNA, 25 bp, Mus musculus
atcgtggagcacatatcgacttgga

SEQ ID NO: 209154 - DNA, 25 bp, Mus musculus
atcgtggcaaaaagtcagtccgacc

SEQ ID NO: 209155 - DNA, 25 bp, Mus musculus
atcgtggcctggagcttaccagccc

SEQ ID NO: 209156 - DNA, 25 bp, Mus musculus
atcgtggcctggagtgttgaagatg

SEQ ID NO: 209157 - DNA, 25 bp, Mus musculus
atcgtgggacataagttctacggcc

SEQ ID NO: 209158 - DNA, 25 bp, Mus musculus
atcgtgggagggaatagccagagcc

SEQ ID NO: 209159 - DNA, 25 bp, Mus musculus
atcgtgggtggagctgaagaaagca

SEQ ID NO: 209160 - DNA, 25 bp, Mus musculus
atcgtgggtggagctgaagaaagcc

SEQ ID NO: 209161 - DNA, 25 bp, Mus musculus
atcgtggtgacaagggcaacagcag

SEQ ID NO: 209162 - DNA, 25 bp, Mus musculus
atcgtggttacagagccgagcagtt

SEQ ID NO: 209163 - DNA, 25 bp, Mus musculus
atcgtggttacaggaaataatgaag

SEQ ID NO: 209164 - DNA, 25 bp, Mus musculus
atcgtgtacagggtgaagttgattc

SEQ ID NO: 209165 - DNA, 25 bp, Mus musculus
atcgtgtctagaccttaaactacac

SEQ ID NO: 209166 - DNA, 25 bp, Mus musculus
atcgtgtctagagccttgcacatta

SEQ ID NO: 209167 - DNA, 25 bp, Mus musculus
atcgtgtctatcggccgctcacccc

SEQ ID NO: 209168 - DNA, 25 bp, Mus musculus
atcgtgtgagccagatcttctggag

SEQ ID NO: 209169 - DNA, 25 bp, Mus musculus
atcgtgtgcgggcatttcagggaag

SEQ ID NO: 209170 - DNA, 25 bp, Mus musculus
atcgtgtttggaaaggcgaccgtgc

SEQ ID NO: 209171 - DNA, 25 bp, Mus musculus
atcgtgtttggaaaggctggcaagt

SEQ ID NO: 209172 - DNA, 25 bp, Mus musculus
atcgttagaagcaaaatctacatca

SEQ ID NO: 209173 - DNA, 25 bp, Mus musculus
atcgttagaagctgaaggaagagga

SEQ ID NO: 209174 - DNA, 25 bp, Mus musculus
atcgttatgttgattcacaatgaca

SEQ ID NO: 209175 - DNA, 25 bp, Mus musculus
atcgttcttccacccaaggacccct

SEQ ID NO: 209176 - DNA, 25 bp, Mus musculus
atcgttcttccagccaaggacccct

SEQ ID NO: 209177 - DNA, 25 bp, Mus musculus
atcgttcttgctggtgcactgcctg

SEQ ID NO: 209178 - DNA, 25 bp, Mus musculus
atcgttcttgtcaataaggtaatgt

SEQ ID NO: 209179 - DNA, 25 bp, Mus musculus
atcgttgccaagagagtacacggtc

SEQ ID NO: 209180 - DNA, 25 bp, Mus musculus
atcgttgccaagaggaaaatagctt

SEQ ID NO: 209181 - DNA, 25 bp, Mus musculus
atcgttggagctcaggtgcccctgg

SEQ ID NO: 209182 - DNA, 25 bp, Mus musculus
atcgtttaattttagctgaaccaat

SEQ ID NO: 209183 - DNA, 25 bp, Mus musculus
atcgtttatagagacttaaaacctg

SEQ ID NO: 209184 - DNA, 25 bp, Mus musculus
atcgtttctattgaaatctcacagg

SEQ ID NO: 209185 - DNA, 25 bp, Mus musculus
atcgtttctattgaatacaggctag

SEQ ID NO: 209186 - DNA, 25 bp, Mus musculus
atcgtttcttcccaggtgaagtgga

SEQ ID NO: 209187 - DNA, 25 bp, Mus musculus
atcgtttgaaaaagtcctaatcctg

SEQ ID NO: 209188 - DNA, 25 bp, Mus musculus
atctaaaaaaccagatcatcacctc

SEQ ID NO: 209189 - DNA, 25 bp, Mus musculus
atctaaactgacccccgtcagagga

SEQ ID NO: 209190 - DNA, 25 bp, Mus musculus
atctaaactggatcgaagtaaacaa

SEQ ID NO: 209191 - DNA, 25 bp, Mus musculus
atctaaagtggttccctcaaccccg

SEQ ID NO: 209192 - DNA, 25 bp, Mus musculus
atctaaattctaagatgggatgtga

SEQ ID NO: 209193 - DNA, 25 bp, Mus musculus
atctaacaaggagcgagattttgaa

SEQ ID NO: 209194 - DNA, 25 bp, Mus musculus
atctaacaaggttcatttaattccc

SEQ ID NO: 209195 - DNA, 25 bp, Mus musculus
atctaacaattttcagcagtacccc

SEQ ID NO: 209196 - DNA, 25 bp, Mus musculus
atctaacacgaagaggtatatgtgg

SEQ ID NO: 209197 - DNA, 25 bp, Mus musculus
atctaacatatttgaggcggaggca

SEQ ID NO: 209198 - DNA, 25 bp, Mus musculus
atctaaccagcagatagtctacatg

SEQ ID NO: 209199 - DNA, 25 bp, Mus musculus
atctaaccatataccagaggaggag

SEQ ID NO: 209200 - DNA, 25 bp, Mus musculus
atctaacccaggtgatgaagtctcg

SEQ ID NO: 209201 - DNA, 25 bp, Mus musculus
atctaagaaagccagagaaggtgtg

SEQ ID NO: 209202 - DNA, 25 bp, Mus musculus
atctaagaaagccagcagcattaga

SEQ ID NO: 209203 - DNA, 25 bp, Mus musculus
atctaagaaggctacaaggtggggt

SEQ ID NO: 209204 - DNA, 25 bp, Mus musculus
atctaagcagccttcctgcagcagc

SEQ ID NO: 209205 - DNA, 25 bp, Mus musculus
atctaagcaggtggcccgacgggaa

SEQ ID NO: 209206 - DNA, 25 bp, Mus musculus
atctaagccaggttgccatgaagtg

SEQ ID NO: 209207 - DNA, 25 bp, Mus musculus
atctaaggaaggaaaaccataaggg

SEQ ID NO: 209208 - DNA, 25 bp, Mus musculus
atctaagtctacccggcagttgggt

SEQ ID NO: 209209 - DNA, 25 bp, Mus musculus
atctaagtctacccggtttattata

SEQ ID NO: 209210 - DNA, 25 bp, Mus musculus
atctaataacctcaagtgactgtgg

SEQ ID NO: 209211 - DNA, 25 bp, Mus musculus
atctaatatcagcgctcatgctccg

SEQ ID NO: 209212 - DNA, 25 bp, Mus musculus
atctaatatgaaggaagtacttaag

SEQ ID NO: 209213 - DNA, 25 bp, Mus musculus
atctaatccaggatgctgggcagtt

SEQ ID NO: 209214 - DNA, 25 bp, Mus musculus
atctaatccagggtctgccgtcatc

SEQ ID NO: 209215 - DNA, 25 bp, Mus musculus
atctaatgatgctttcagacttggt

SEQ ID NO: 209216 - DNA, 25 bp, Mus musculus
atctaatgatggaacatgtctcagg

SEQ ID NO: 209217 - DNA, 25 bp, Mus musculus
atctaatgctgacacctcctcatgg

SEQ ID NO: 209218 - DNA, 25 bp, Mus musculus
atctaatgctgacagctcctcatgg

SEQ ID NO: 209219 - DNA, 25 bp, Mus musculus
atctaattcagatcatgattctgga

SEQ ID NO: 209220 - DNA, 25 bp, Mus musculus
atctaattgtgggagtctgcagtga

SEQ ID NO: 209221 - DNA, 25 bp, Mus musculus
atctacaagacgcagctcggtgagg

SEQ ID NO: 209222 - DNA, 25 bp, Mus musculus
atctacacaatttgggagtgagcta

SEQ ID NO: 209223 - DNA, 25 bp, Mus musculus
atctacacagaaccagagcatgacc

SEQ ID NO: 209224 - DNA, 25 bp, Mus musculus
atctacacccaggtgattcgagtca

SEQ ID NO: 209225 - DNA, 25 bp, Mus musculus
atctacactgaattttagaaaggaa

SEQ ID NO: 209226 - DNA, 25 bp, Mus musculus
atctacactgagtccaaacatcaca

SEQ ID NO: 209227 - DNA, 25 bp, Mus musculus
atctacactgagtgccagtcattat

SEQ ID NO: 209228 - DNA, 25 bp, Mus musculus
atctacactgagtggttcctcagac

SEQ ID NO: 209229 - DNA, 25 bp, Mus musculus
atctacactgcactgggtgggctga

SEQ ID NO: 209230 - DNA, 25 bp, Mus musculus
atctacactggaattacactatcag

SEQ ID NO: 209231 - DNA, 25 bp, Mus musculus
atctacactgttgttggccgcccca

SEQ ID NO: 209232 - DNA, 25 bp, Mus musculus
atctacacttttcatgcagatcctg

SEQ ID NO: 209233 - DNA, 25 bp, Mus musculus
atctacagaagagagacatctcctg

SEQ ID NO: 209234 - DNA, 25 bp, Mus musculus
atctacagcaaaccaggactagaca

SEQ ID NO: 209235 - DNA, 25 bp, Mus musculus
atctacagcaaacctggactagaca

SEQ ID NO: 209236 - DNA, 25 bp, Mus musculus
atctacagctgctggaaattagagc

SEQ ID NO: 209237 - DNA, 25 bp, Mus musculus
atctacagctgctggctgagggtgg

SEQ ID NO: 209238 - DNA, 25 bp, Mus musculus
atctacagtgggcagcaaagattca

SEQ ID NO: 209239 - DNA, 25 bp, Mus musculus
atctacagtgggccggcggccaatc

SEQ ID NO: 209240 - DNA, 25 bp, Mus musculus
atctacatatcaactcaacaaggac

SEQ ID NO: 209241 - DNA, 25 bp, Mus musculus
atctacatttcagacatcccgctta

SEQ ID NO: 209242 - DNA, 25 bp, Mus musculus
atctacatttcagatcctcctacca

SEQ ID NO: 209243 - DNA, 25 bp, Mus musculus
atctaccaaaacaaccctggcctat

SEQ ID NO: 209244 - DNA, 25 bp, Mus musculus
atctaccaaagtctcactttatctc

SEQ ID NO: 209245 - DNA, 25 bp, Mus musculus
atctaccacaaatattatcactacc

SEQ ID NO: 209246 - DNA, 25 bp, Mus musculus
atctaccacaacctgaagaacatgg

SEQ ID NO: 209247 - DNA, 25 bp, Mus musculus
atctaccaccaacgagagccatcct

SEQ ID NO: 209248 - DNA, 25 bp, Mus musculus
atctaccactacacccagctgccct

SEQ ID NO: 209249 - DNA, 25 bp, Mus musculus
atctaccaggaaataatccttgcta

SEQ ID NO: 209250 - DNA, 25 bp, Mus musculus
atctaccaggtacagcaatgacatt

SEQ ID NO: 209251 - DNA, 25 bp, Mus musculus
atctacccaatggaggttctgaaga

SEQ ID NO: 209252 - DNA, 25 bp, Mus musculus
atctacctaccagccctgggtcctg

SEQ ID NO: 209253 - DNA, 25 bp, Mus musculus
atctacctaccaggatggtccacct

SEQ ID NO: 209254 - DNA, 25 bp, Mus musculus
atctacctagaaaagatttcacaca

SEQ ID NO: 209255 - DNA, 25 bp, Mus musculus
atctacctctttgaggaactttgat

SEQ ID NO: 209256 - DNA, 25 bp, Mus musculus
atctacctctttgagggaagaagcc

SEQ ID NO: 209257 - DNA, 25 bp, Mus musculus
atctacctgcagagctttgtggcgt

SEQ ID NO: 209258 - DNA, 25 bp, Mus musculus
atctacctgcaggtcacccacgtgt

SEQ ID NO: 209259 - DNA, 25 bp, Mus musculus
atctacgacaggctcatcagcggct

SEQ ID NO: 209260 - DNA, 25 bp, Mus musculus
atctacgagcagggcacaactgtgc

SEQ ID NO: 209261 - DNA, 25 bp, Mus musculus
atctacgaggtagatgcacgggaat

SEQ ID NO: 209262 - DNA, 25 bp, Mus musculus
atctacggcagaaaggggagtgtgt

SEQ ID NO: 209263 - DNA, 25 bp, Mus musculus
atctacggcagtacatttttatacc

SEQ ID NO: 209264 - DNA, 25 bp, Mus musculus
atctacgggcaggctcccggacctc

SEQ ID NO: 209265 - DNA, 25 bp, Mus musculus
atctactaagaaatgtcataaagga

SEQ ID NO: 209266 - DNA, 25 bp, Mus musculus
atctactacaaggtttgaagagtgg

SEQ ID NO: 209267 - DNA, 25 bp, Mus musculus
atctactatatctctgctcatgtct

SEQ ID NO: 209268 - DNA, 25 bp, Mus musculus
atctactcctcagctggaattttgg

SEQ ID NO: 209269 - DNA, 25 bp, Mus musculus
atctactcttggttcttcattgagt

SEQ ID NO: 209270 - DNA, 25 bp, Mus musculus
atctactgacagttgtccgtgtaat

SEQ ID NO: 209271 - DNA, 25 bp, Mus musculus
atctactggcaaggtggtctacttc

SEQ ID NO: 209272 - DNA, 25 bp, Mus musculus
atctactggcaaggtggtctatttc

SEQ ID NO: 209273 - DNA, 25 bp, Mus musculus
atctacttaaagcctttatcttctg

SEQ ID NO: 209274 - DNA, 25 bp, Mus musculus
atctacttaaaggctttatcttctg

SEQ ID NO: 209275 - DNA, 25 bp, Mus musculus
atctacttcattgatcataatacga

SEQ ID NO: 209276 - DNA, 25 bp, Mus musculus
atctactttaaaggcaaatggaaga

SEQ ID NO: 209277 - DNA, 25 bp, Mus musculus
atctactttgactgcagcagaagtt

SEQ ID NO: 209278 - DNA, 25 bp, Mus musculus
atctactttgctcagcagatatctc

SEQ ID NO: 209279 - DNA, 25 bp, Mus musculus
atctagaagaagaagctgaagtcat

SEQ ID NO: 209280 - DNA, 25 bp, Mus musculus
atctagaatacctgaagaaaattcg

SEQ ID NO: 209281 - DNA, 25 bp, Mus musculus
atctagagaaatatgtgcatgagct

SEQ ID NO: 209282 - DNA, 25 bp, Mus musculus
atctagagacacggaagcctgtgct

SEQ ID NO: 209283 - DNA, 25 bp, Mus musculus
atctagagctagcgggttatgcctc

SEQ ID NO: 209284 - DNA, 25 bp, Mus musculus
atctagcaagcagctatggccggtg

SEQ ID NO: 209285 - DNA, 25 bp, Mus musculus
atctagcaagcaggcatgacttgcc

SEQ ID NO: 209286 - DNA, 25 bp, Mus musculus
atctagcacccaggttactcggcgg

SEQ ID NO: 209287 - DNA, 25 bp, Mus musculus
atctagcattacaaggaggtgcccc

SEQ ID NO: 209288 - DNA, 25 bp, Mus musculus
atctagctaatggggtagctgggag

SEQ ID NO: 209289 - DNA, 25 bp, Mus musculus
atctagctcgagaagggcagttata

SEQ ID NO: 209290 - DNA, 25 bp, Mus musculus
atctagctcgagaagtctgatcagc

SEQ ID NO: 209291 - DNA, 25 bp, Mus musculus
atctaggccctcagatcaatgatga

SEQ ID NO: 209292 - DNA, 25 bp, Mus musculus
atctaggtatggtctgccggaagcc

SEQ ID NO: 209293 - DNA, 25 bp, Mus musculus
atctagtaacctttaggtcttgcta

SEQ ID NO: 209294 - DNA, 25 bp, Mus musculus
atctagtaatgacaagccctcatca

SEQ ID NO: 209295 - DNA, 25 bp, Mus musculus
atctagtgaatagtggaggagtgta

SEQ ID NO: 209296 - DNA, 25 bp, Mus musculus
atctagtgcaggtgagtgcaggatc

SEQ ID NO: 209297 - DNA, 25 bp, Mus musculus
atctagtgccaggaaaatactaaag

SEQ ID NO: 209298 - DNA, 25 bp, Mus musculus
atctagttccgagtcccgctcacgc

SEQ ID NO: 209299 - DNA, 25 bp, Mus musculus
atctagtttgactaccaaaggagct

SEQ ID NO: 209300 - DNA, 25 bp, Mus musculus
atctataaaacatatttccagggta

SEQ ID NO: 209301 - DNA, 25 bp, Mus musculus
atctataacccgataatcccctatg

SEQ ID NO: 209302 - DNA, 25 bp, Mus musculus
atctataacccgattccaggttgac

SEQ ID NO: 209303 - DNA, 25 bp, Mus musculus
atctataacttcaaaaagcagcctt

SEQ ID NO: 209304 - DNA, 25 bp, Mus musculus
atctataacttcaatgtctttaaca

SEQ ID NO: 209305 - DNA, 25 bp, Mus musculus
atctataagcagcctgctgtggagg

SEQ ID NO: 209306 - DNA, 25 bp, Mus musculus
atctataagcagtgtgctgtgagaa

SEQ ID NO: 209307 - DNA, 25 bp, Mus musculus
atctatacaggtgacctcttggttc

SEQ ID NO: 209308 - DNA, 25 bp, Mus musculus
atctataccagataaaaactacagt

SEQ ID NO: 209309 - DNA, 25 bp, Mus musculus
atctatagcctggctcggttctctc

SEQ ID NO: 209310 - DNA, 25 bp, Mus musculus
atctatataggcaaaggtgatttat

SEQ ID NO: 209311 - DNA, 25 bp, Mus musculus
atctatatggcaccagaggtcatca

SEQ ID NO: 209312 - DNA, 25 bp, Mus musculus
atctatattggaaggtcctcagaat

SEQ ID NO: 209313 - DNA, 25 bp, Mus musculus
atctatcaaaggtgatttcaatctc

SEQ ID NO: 209314 - DNA, 25 bp, Mus musculus
atctatcaagggagcaccatcatgt

SEQ ID NO: 209315 - DNA, 25 bp, Mus musculus
atctatcaatcaatctatctaccta

SEQ ID NO: 209316 - DNA, 25 bp, Mus musculus
atctatcacaaaagctgcatagact

SEQ ID NO: 209317 - DNA, 25 bp, Mus musculus
atctatccaagcaggctgtcgctta

SEQ ID NO: 209318 - DNA, 25 bp, Mus musculus
atctatcgaaaatgagcaactggtg

SEQ ID NO: 209319 - DNA, 25 bp, Mus musculus
atctatcgagtacgaagtgggctaa

SEQ ID NO: 209320 - DNA, 25 bp, Mus musculus
atctatctatcatctatctacctat

SEQ ID NO: 209321 - DNA, 25 bp, Mus musculus
atctatctatctatcatctatctac

SEQ ID NO: 209322 - DNA, 25 bp, Mus musculus
atctatctcggtacggacattgctg

SEQ ID NO: 209323 - DNA, 25 bp, Mus musculus
atctatctcgtttttcaaaacatag

SEQ ID NO: 209324 - DNA, 25 bp, Mus musculus
atctatctgaaggccctgtccacgg

SEQ ID NO: 209325 - DNA, 25 bp, Mus musculus
atctatgaatgcactgacactgaag

SEQ ID NO: 209326 - DNA, 25 bp, Mus musculus
atctatgacgtgaccctggaagaca

SEQ ID NO: 209327 - DNA, 25 bp, Mus musculus
atctatgagagaatatcaaagaata

SEQ ID NO: 209328 - DNA, 25 bp, Mus musculus
atctatgcagggtgacaagggagat

SEQ ID NO: 209329 - DNA, 25 bp, Mus musculus
atctatgcatccaagaaggatcctg

SEQ ID NO: 209330 - DNA, 25 bp, Mus musculus
atctatgcatccaaggctgtcggcg

SEQ ID NO: 209331 - DNA, 25 bp, Mus musculus
atctatgccgtggacaacaattacg

SEQ ID NO: 209332 - DNA, 25 bp, Mus musculus
atctatgccgtggatgaacggggta

SEQ ID NO: 209333 - DNA, 25 bp, Mus musculus
atctatgctaccctaggaaggagta

SEQ ID NO: 209334 - DNA, 25 bp, Mus musculus
atctatggagagagtgctgaggctg

SEQ ID NO: 209335 - DNA, 25 bp, Mus musculus
atctatgggcatgctagcaaaaaag

SEQ ID NO: 209336 - DNA, 25 bp, Mus musculus
atctatgggcatggcatcgtcttca

SEQ ID NO: 209337 - DNA, 25 bp, Mus musculus
atctatggggagacaccagaggcat

SEQ ID NO: 209338 - DNA, 25 bp, Mus musculus
atctatgtcagtgaggttcctgctg

SEQ ID NO: 209339 - DNA, 25 bp, Mus musculus
atctatgtgattggttaccaggaga

SEQ ID NO: 209340 - DNA, 25 bp, Mus musculus
atctatgtgccagctgcaacggaag

SEQ ID NO: 209341 - DNA, 25 bp, Mus musculus
atctatgtgccaggctgcccgccca

SEQ ID NO: 209342 - DNA, 25 bp, Mus musculus
atctatgtggcttagcagatcatca

SEQ ID NO: 209343 - DNA, 25 bp, Mus musculus
atctattaaaagccccagaccctcc

SEQ ID NO: 209344 - DNA, 25 bp, Mus musculus
atctattaaaaggtcaccaccatag

SEQ ID NO: 209345 - DNA, 25 bp, Mus musculus
atctattacaggtgaatacattgtt

SEQ ID NO: 209346 - DNA, 25 bp, Mus musculus
atctattatgtagatgtgcagaaat

SEQ ID NO: 209347 - DNA, 25 bp, Mus musculus
atctattattggtactggcggagga

SEQ ID NO: 209348 - DNA, 25 bp, Mus musculus
atctattcctgaataaacactgaat

SEQ ID NO: 209349 - DNA, 25 bp, Mus musculus
atctattcttgacggacttaaaagg

SEQ ID NO: 209350 - DNA, 25 bp, Mus musculus
atctattgattagtacaaacaggcc

SEQ ID NO: 209351 - DNA, 25 bp, Mus musculus
atctattgcagagttacccctggac

SEQ ID NO: 209352 - DNA, 25 bp, Mus musculus
atctattgcagcagtgtcagacaca

SEQ ID NO: 209353 - DNA, 25 bp, Mus musculus
atctattttcaagaaagtgttggat

SEQ ID NO: 209354 - DNA, 25 bp, Mus musculus
atctattttcaggatgtcagtgggg

SEQ ID NO: 209355 - DNA, 25 bp, Mus musculus
atctattttcaggggtttcgtgttg

SEQ ID NO: 209356 - DNA, 25 bp, Mus musculus
atctattttcggatgtacatgctgt

SEQ ID NO: 209357 - DNA, 25 bp, Mus musculus
atctcaaaacctgacaagacatttc

SEQ ID NO: 209358 - DNA, 25 bp, Mus musculus
atctcaaacaaagcatcgctgatag

SEQ ID NO: 209359 - DNA, 25 bp, Mus musculus
atctcaaacaaagcatctatccagc

SEQ ID NO: 209360 - DNA, 25 bp, Mus musculus
atctcaaaccaacagtatcacatct

SEQ ID NO: 209361 - DNA, 25 bp, Mus musculus
atctcaaaccaacagttccctgccg

SEQ ID NO: 209362 - DNA, 25 bp, Mus musculus
atctcaaaccaacattcagcaggac

SEQ ID NO: 209363 - DNA, 25 bp, Mus musculus
atctcaacaaggcacggcagctctt

SEQ ID NO: 209364 - DNA, 25 bp, Mus musculus
atctcaacacctcacgaaggggcaa

SEQ ID NO: 209365 - DNA, 25 bp, Mus musculus
atctcaacagaacaggatttgtgca

SEQ ID NO: 209366 - DNA, 25 bp, Mus musculus
atctcaacagaacagtgctcttggc

SEQ ID NO: 209367 - DNA, 25 bp, Mus musculus
atctcaacagcaagctgcctagttg

SEQ ID NO: 209368 - DNA, 25 bp, Mus musculus
atctcaacaggacaagaaaagaaaa

SEQ ID NO: 209369 - DNA, 25 bp, Mus musculus
atctcaacaggtttatttatttatt

SEQ ID NO: 209370 - DNA, 25 bp, Mus musculus
atctcaaccaggatgcgtacactgc

SEQ ID NO: 209371 - DNA, 25 bp, Mus musculus
atctcaactccatggtcagcaacat

SEQ ID NO: 209372 - DNA, 25 bp, Mus musculus
atctcaactgcaagatggccactga

SEQ ID NO: 209373 - DNA, 25 bp, Mus musculus
atctcaactgcaagattgcccagct

SEQ ID NO: 209374 - DNA, 25 bp, Mus musculus
atctcaacttgaggccatccgctgc

SEQ ID NO: 209375 - DNA, 25 bp, Mus musculus
atctcaacttgagtcagaagaggca

SEQ ID NO: 209376 - DNA, 25 bp, Mus musculus
atctcaagaaaggatggatgatcca

SEQ ID NO: 209377 - DNA, 25 bp, Mus musculus
atctcaagcaagttgataatgaaga

SEQ ID NO: 209378 - DNA, 25 bp, Mus musculus
atctcaagtcaaagaaatggcctcc

SEQ ID NO: 209379 - DNA, 25 bp, Mus musculus
atctcacaacgggcaccaccacaag

SEQ ID NO: 209380 - DNA, 25 bp, Mus musculus
atctcacaagttagccctagaacca

SEQ ID NO: 209381 - DNA, 25 bp, Mus musculus
atctcacaattttacgcagatagag

SEQ ID NO: 209382 - DNA, 25 bp, Mus musculus
atctcacaattttctggactgaagg

SEQ ID NO: 209383 - DNA, 25 bp, Mus musculus
atctcacagtggagatgaatctggc

SEQ ID NO: 209384 - DNA, 25 bp, Mus musculus
atctcaccaaggattacacagtgcg

SEQ ID NO: 209385 - DNA, 25 bp, Mus musculus
atctcaccaataaagcccacagaag

SEQ ID NO: 209386 - DNA, 25 bp, Mus musculus
atctcaccaataaaggcaaatcctc

SEQ ID NO: 209387 - DNA, 25 bp, Mus musculus
atctcaccagaaactatggtggccc

SEQ ID NO: 209388 - DNA, 25 bp, Mus musculus
atctcaccagggcccagtcatttac

SEQ ID NO: 209389 - DNA, 25 bp, Mus musculus
atctcaccagttgtgtgaattatgt

SEQ ID NO: 209390 - DNA, 25 bp, Mus musculus
atctcaccattgttataataaagac

SEQ ID NO: 209391 - DNA, 25 bp, Mus musculus
atctcacccagacaggcttctaaag

SEQ ID NO: 209392 - DNA, 25 bp, Mus musculus
atctcaccggcaaggtgatgcttct

SEQ ID NO: 209393 - DNA, 25 bp, Mus musculus
atctcacgagacatatctgaagaga

SEQ ID NO: 209394 - DNA, 25 bp, Mus musculus
atctcacgagggagaaactgcctac

SEQ ID NO: 209395 - DNA, 25 bp, Mus musculus
atctcactacggaggtgcatcctga

SEQ ID NO: 209396 - DNA, 25 bp, Mus musculus
atctcactcaggctcccatgtgtga

SEQ ID NO: 209397 - DNA, 25 bp, Mus musculus
atctcactgaaagatttgtatacat

SEQ ID NO: 209398 - DNA, 25 bp, Mus musculus
atctcactgcagacactccactctc

SEQ ID NO: 209399 - DNA, 25 bp, Mus musculus
atctcactgtgctaaaggcccacgt

SEQ ID NO: 209400 - DNA, 25 bp, Mus musculus
atctcactgtgctataggcccacgt

SEQ ID NO: 209401 - DNA, 25 bp, Mus musculus
atctcactgtggtccagattataga

SEQ ID NO: 209402 - DNA, 25 bp, Mus musculus
atctcagaaaatggctcctcggtgg

SEQ ID NO: 209403 - DNA, 25 bp, Mus musculus
atctcagacagcaagacaaacgagg

SEQ ID NO: 209404 - DNA, 25 bp, Mus musculus
atctcagcaaaaagcctaagaaagt

SEQ ID NO: 209405 - DNA, 25 bp, Mus musculus
atctcagcaagatggagcgggtagt

SEQ ID NO: 209406 - DNA, 25 bp, Mus musculus
atctcagcaaggtgatctggggaac

SEQ ID NO: 209407 - DNA, 25 bp, Mus musculus
atctcagcacaccagaactatgccg

SEQ ID NO: 209408 - DNA, 25 bp, Mus musculus
atctcagcactgtgtgtcaccgtgc

SEQ ID NO: 209409 - DNA, 25 bp, Mus musculus
atctcagcaggtaaatgagaaaaca

SEQ ID NO: 209410 - DNA, 25 bp, Mus musculus
atctcagcaggtggcagctagtttg

SEQ ID NO: 209411 - DNA, 25 bp, Mus musculus
atctcagccatgatggtaacaaaag

SEQ ID NO: 209412 - DNA, 25 bp, Mus musculus
atctcagctgcctttggcaacctcc

SEQ ID NO: 209413 - DNA, 25 bp, Mus musculus
atctcaggacggagatgaacatctg

SEQ ID NO: 209414 - DNA, 25 bp, Mus musculus
atctcaggcttcaggaagtgtgcca

SEQ ID NO: 209415 - DNA, 25 bp, Mus musculus
atctcagtgaaaggtaaaccagatg

SEQ ID NO: 209416 - DNA, 25 bp, Mus musculus
atctcagtgcaatggatcagttgga

SEQ ID NO: 209417 - DNA, 25 bp, Mus musculus
atctcagtgcaatggcttccatacg

SEQ ID NO: 209418 - DNA, 25 bp, Mus musculus
atctcataaataaggtgcgagaaga

SEQ ID NO: 209419 - DNA, 25 bp, Mus musculus
atctcataaataaggttgtgcattt

SEQ ID NO: 209420 - DNA, 25 bp, Mus musculus
atctcataagtaaaggagaggagcc

SEQ ID NO: 209421 - DNA, 25 bp, Mus musculus
atctcatcaagaccctgaagacagc

SEQ ID NO: 209422 - DNA, 25 bp, Mus musculus
atctcatcaaggcacataccatgtt

SEQ ID NO: 209423 - DNA, 25 bp, Mus musculus
atctcatcaatgcaggaaaggaaac

SEQ ID NO: 209424 - DNA, 25 bp, Mus musculus
atctcatcacaggagcatctcaatg

SEQ ID NO: 209425 - DNA, 25 bp, Mus musculus
atctcatcatagatatcacaaccac

SEQ ID NO: 209426 - DNA, 25 bp, Mus musculus
atctcatcatagatgacttccatag

SEQ ID NO: 209427 - DNA, 25 bp, Mus musculus
atctcatggagagtaaaagttggca

SEQ ID NO: 209428 - DNA, 25 bp, Mus musculus
atctcatggctatactgatcatttc

SEQ ID NO: 209429 - DNA, 25 bp, Mus musculus
atctcatgttgagtgacaaaagaac

SEQ ID NO: 209430 - DNA, 25 bp, Mus musculus
atctcatgtttaattgttcctgctg

SEQ ID NO: 209431 - DNA, 25 bp, Mus musculus
atctcattcagaacccattccaagc

SEQ ID NO: 209432 - DNA, 25 bp, Mus musculus
atctccaaaccccattcaacctcta

SEQ ID NO: 209433 - DNA, 25 bp, Mus musculus
atctccaaacccctgagggagagca

SEQ ID NO: 209434 - DNA, 25 bp, Mus musculus
atctccaacaacaaagaagcctgat

SEQ ID NO: 209435 - DNA, 25 bp, Mus musculus
atctccaagcaggggtattttgcct

SEQ ID NO: 209436 - DNA, 25 bp, Mus musculus
atctccaagcagtatgtctggattt

SEQ ID NO: 209437 - DNA, 25 bp, Mus musculus
atctccaaggactcaggcagctgga

SEQ ID NO: 209438 - DNA, 25 bp, Mus musculus
atctccaatggactaaattcggaga

SEQ ID NO: 209439 - DNA, 25 bp, Mus musculus
atctccacaaaggtgtattccctgg

SEQ ID NO: 209440 - DNA, 25 bp, Mus musculus
atctccacagctgcggtgctcttag

SEQ ID NO: 209441 - DNA, 25 bp, Mus musculus
atctccaccactcaggtgttttctc

SEQ ID NO: 209442 - DNA, 25 bp, Mus musculus
atctccaccagtcggtgttgacttt

SEQ ID NO: 209443 - DNA, 25 bp, Mus musculus
atctccacctcaaagagttgaaaag

SEQ ID NO: 209444 - DNA, 25 bp, Mus musculus
atctccacctcaaaggtctgtgttg

SEQ ID NO: 209445 - DNA, 25 bp, Mus musculus
atctccacttctaaggcggcgacag

SEQ ID NO: 209446 - DNA, 25 bp, Mus musculus
atctccacttgggtgaaagacaagg

SEQ ID NO: 209447 - DNA, 25 bp, Mus musculus
atctccagacagataccagaagctc

SEQ ID NO: 209448 - DNA, 25 bp, Mus musculus
atctccagaccttcacgcatcatga

SEQ ID NO: 209449 - DNA, 25 bp, Mus musculus
atctccagagtgataatgtgtacaa

SEQ ID NO: 209450 - DNA, 25 bp, Mus musculus
atctccagcccaggtgaacaccatg

SEQ ID NO: 209451 - DNA, 25 bp, Mus musculus
atctccagtaccattgcaagtactc

SEQ ID NO: 209452 - DNA, 25 bp, Mus musculus
atctccatcaaagaaattagccagg

SEQ ID NO: 209453 - DNA, 25 bp, Mus musculus
atctccatcaaaggacctgatagat

SEQ ID NO: 209454 - DNA, 25 bp, Mus musculus
atctcccaccagaggctgatccccg

SEQ ID NO: 209455 - DNA, 25 bp, Mus musculus
atctcccaggagattggagaccgaa

SEQ ID NO: 209456 - DNA, 25 bp, Mus musculus
atctccctggaaggggagccccgca

SEQ ID NO: 209457 - DNA, 25 bp, Mus musculus
atctccctggcgagtgactcagacc

SEQ ID NO: 209458 - DNA, 25 bp, Mus musculus
atctccgaagatacttgaaccagtt

SEQ ID NO: 209459 - DNA, 25 bp, Mus musculus
atctccgccagaagcctgcatcctt

SEQ ID NO: 209460 - DNA, 25 bp, Mus musculus
atctcctaaaagaagtcgttcccca

SEQ ID NO: 209461 - DNA, 25 bp, Mus musculus
atctcctaacagatgaacagtgttt

SEQ ID NO: 209462 - DNA, 25 bp, Mus musculus
atctcctaacagctatgaaaggaca

SEQ ID NO: 209463 - DNA, 25 bp, Mus musculus
atctcctacgagcagcgggtgctga

SEQ ID NO: 209464 - DNA, 25 bp, Mus musculus
atctcctacgagcagggctgtgcga

SEQ ID NO: 209465 - DNA, 25 bp, Mus musculus
atctcctaggagtgcgcgatgattt

SEQ ID NO: 209466 - DNA, 25 bp, Mus musculus
atctcctaggtttcaggaatgggca

SEQ ID NO: 209467 - DNA, 25 bp, Mus musculus
atctcctcagaggcagcatcctgtt

SEQ ID NO: 209468 - DNA, 25 bp, Mus musculus
atctcctcagagtctgatgccaagc

SEQ ID NO: 209469 - DNA, 25 bp, Mus musculus
atctcctcagagtctgcaagaaact

SEQ ID NO: 209470 - DNA, 25 bp, Mus musculus
atctcctccagcggcagtacatccc

SEQ ID NO: 209471 - DNA, 25 bp, Mus musculus
atctcctccccagatcagcaccgac

SEQ ID NO: 209472 - DNA, 25 bp, Mus musculus
atctcctccgcagaggccaagtgag

SEQ ID NO: 209473 - DNA, 25 bp, Mus musculus
atctcctcgacgggtcctgcatggt

SEQ ID NO: 209474 - DNA, 25 bp, Mus musculus
atctcctctaaaaggcaacaactct

SEQ ID NO: 209475 - DNA, 25 bp, Mus musculus
atctcctctaaaagggccgcgcctg

SEQ ID NO: 209476 - DNA, 25 bp, Mus musculus
atctcctctcctgaaaatgactccc

SEQ ID NO: 209477 - DNA, 25 bp, Mus musculus
atctcctgccaggaatgaagaaaga

SEQ ID NO: 209478 - DNA, 25 bp, Mus musculus
atctcctggaaaactgggcccattg

SEQ ID NO: 209479 - DNA, 25 bp, Mus musculus
atctcctggagctcagcttttccag

SEQ ID NO: 209480 - DNA, 25 bp, Mus musculus
atctcctgggccctcaccagagcag

SEQ ID NO: 209481 - DNA, 25 bp, Mus musculus
atctccttatcaggacgcacatgca

SEQ ID NO: 209482 - DNA, 25 bp, Mus musculus
atctccttccaaagaggatttgttg

SEQ ID NO: 209483 - DNA, 25 bp, Mus musculus
atctccttccacagacttcccaaga

SEQ ID NO: 209484 - DNA, 25 bp, Mus musculus
atctccttccacagctgctccgaaa

SEQ ID NO: 209485 - DNA, 25 bp, Mus musculus
atctcgacagcgcggagacgcgtgg

SEQ ID NO: 209486 - DNA, 25 bp, Mus musculus
atctcgcacagcatgatcaacaggc

SEQ ID NO: 209487 - DNA, 25 bp, Mus musculus
atctcgcacaggacctaaagattgt

SEQ ID NO: 209488 - DNA, 25 bp, Mus musculus
atctcgcagaggagttagcgacgcc

SEQ ID NO: 209489 - DNA, 25 bp, Mus musculus
atctcgcctgtggttggtgacaaac

SEQ ID NO: 209490 - DNA, 25 bp, Mus musculus
atctcgctgctataggcatgaaaga

SEQ ID NO: 209491 - DNA, 25 bp, Mus musculus
atctcgctgctataggctactattg

SEQ ID NO: 209492 - DNA, 25 bp, Mus musculus
atctcggcccacgaggatcgtctga

SEQ ID NO: 209493 - DNA, 25 bp, Mus musculus
atctctaaaactgaagcaccttcag

SEQ ID NO: 209494 - DNA, 25 bp, Mus musculus
atctctaaaacttctatcatcctga

SEQ ID NO: 209495 - DNA, 25 bp, Mus musculus
atctctacagaggaaggcattactg

SEQ ID NO: 209496 - DNA, 25 bp, Mus musculus
atctctacagattcctgcggaacat

SEQ ID NO: 209497 - DNA, 25 bp, Mus musculus
atctctacagctcagatgtttttac

SEQ ID NO: 209498 - DNA, 25 bp, Mus musculus
atctctacaggtagggacccgaaag

SEQ ID NO: 209499 - DNA, 25 bp, Mus musculus
atctctagctgaagtgagcaaacca

SEQ ID NO: 209500 - DNA, 25 bp, Mus musculus
atctctatggaagaggaatcttcaa

SEQ ID NO: 209501 - DNA, 25 bp, Mus musculus
atctctcaaaggatcctgctggccg

SEQ ID NO: 209502 - DNA, 25 bp, Mus musculus
atctctcaaaggatgacatttgcac

SEQ ID NO: 209503 - DNA, 25 bp, Mus musculus
atctctcaagacctcttctagaaaa

SEQ ID NO: 209504 - DNA, 25 bp, Mus musculus
atctctcacatggagaaactgctgt

SEQ ID NO: 209505 - DNA, 25 bp, Mus musculus
atctctcaggctctctaactgatgg

SEQ ID NO: 209506 - DNA, 25 bp, Mus musculus
atctctcatcagcatccgccaccac

SEQ ID NO: 209507 - DNA, 25 bp, Mus musculus
atctctccagccaggctgcttctga

SEQ ID NO: 209508 - DNA, 25 bp, Mus musculus
atctctccagccagtgaggatccca

SEQ ID NO: 209509 - DNA, 25 bp, Mus musculus
atctctccagccatatctggcacca

SEQ ID NO: 209510 - DNA, 25 bp, Mus musculus
atctctccattcaggcacagatgct

SEQ ID NO: 209511 - DNA, 25 bp, Mus musculus
atctctccattcaggtagtgactgc

SEQ ID NO: 209512 - DNA, 25 bp, Mus musculus
atctctcctaaaaggattgcaaaag

SEQ ID NO: 209513 - DNA, 25 bp, Mus musculus
atctctcctctgaaggctagccctg

SEQ ID NO: 209514 - DNA, 25 bp, Mus musculus
atctctctacagccctcagccaaac

SEQ ID NO: 209515 - DNA, 25 bp, Mus musculus
atctctctctgtggaggtgaagccg

SEQ ID NO: 209516 - DNA, 25 bp, Mus musculus
atctctctcttacagatcaagatct

SEQ ID NO: 209517 - DNA, 25 bp, Mus musculus
atctctctcttacaggcactacaga

SEQ ID NO: 209518 - DNA, 25 bp, Mus musculus
atctctgaaactgatgcagtgacct

SEQ ID NO: 209519 - DNA, 25 bp, Mus musculus
atctctgaaagttctcctgtctatc

SEQ ID NO: 209520 - DNA, 25 bp, Mus musculus
atctctgaacctgttccagctacgg

SEQ ID NO: 209521 - DNA, 25 bp, Mus musculus
atctctgaagcactgcgcaagatgg

SEQ ID NO: 209522 - DNA, 25 bp, Mus musculus
atctctgacatggaggatatgctgt

SEQ ID NO: 209523 - DNA, 25 bp, Mus musculus
atctctgacttagagaagagtggga

SEQ ID NO: 209524 - DNA, 25 bp, Mus musculus
atctctgacttagaggaaatgctgt

SEQ ID NO: 209525 - DNA, 25 bp, Mus musculus
atctctgagcgtgccttcatcaagt

SEQ ID NO: 209526 - DNA, 25 bp, Mus musculus
atctctgccagctttgtttactagc

SEQ ID NO: 209527 - DNA, 25 bp, Mus musculus
atctctgcctgtaacggagactctg

SEQ ID NO: 209528 - DNA, 25 bp, Mus musculus
atctctgctttcctgggaaggtgtg

SEQ ID NO: 209529 - DNA, 25 bp, Mus musculus
atctctggaagggtttctctgtata

SEQ ID NO: 209530 - DNA, 25 bp, Mus musculus
atctctggaaggtgagcctcaggga

SEQ ID NO: 209531 - DNA, 25 bp, Mus musculus
atctctggagattgtcctgctttaa

SEQ ID NO: 209532 - DNA, 25 bp, Mus musculus
atctctggcgttattgctgtctccc

SEQ ID NO: 209533 - DNA, 25 bp, Mus musculus
atctctgggattaacctggatcctg

SEQ ID NO: 209534 - DNA, 25 bp, Mus musculus
atctctggtaacagaagaaaagatg

SEQ ID NO: 209535 - DNA, 25 bp, Mus musculus
atctctggtttgcctcctgaataaa

SEQ ID NO: 209536 - DNA, 25 bp, Mus musculus
atctctgtacgcatgtgacaccaga

SEQ ID NO: 209537 - DNA, 25 bp, Mus musculus
atctctgtatgtgactgtcctagag

SEQ ID NO: 209538 - DNA, 25 bp, Mus musculus
atctctgtgagagggtatgtctcct

SEQ ID NO: 209539 - DNA, 25 bp, Mus musculus
atctctgtggaagagacctctgcta

SEQ ID NO: 209540 - DNA, 25 bp, Mus musculus
atctctgttggggcttcacacctac

SEQ ID NO: 209541 - DNA, 25 bp, Mus musculus
atctcttagtgagaagccagtggat

SEQ ID NO: 209542 - DNA, 25 bp, Mus musculus
atctcttagtgataacaaagatact

SEQ ID NO: 209543 - DNA, 25 bp, Mus musculus
atctcttcaagtgatagttctcagt

SEQ ID NO: 209544 - DNA, 25 bp, Mus musculus
atctcttcagcctgggctcagccat

SEQ ID NO: 209545 - DNA, 25 bp, Mus musculus
atctcttcaggtgccagcctcacaa

SEQ ID NO: 209546 - DNA, 25 bp, Mus musculus
atctcttccaagaggcaacaactgt

SEQ ID NO: 209547 - DNA, 25 bp, Mus musculus
atctcttccaggaatgtctcgaggc

SEQ ID NO: 209548 - DNA, 25 bp, Mus musculus
atctcttcccccagatgcctgtcgg

SEQ ID NO: 209549 - DNA, 25 bp, Mus musculus
atctcttctgcccagccaccccgct

SEQ ID NO: 209550 - DNA, 25 bp, Mus musculus
atctcttgtggatggcttcaagcca

SEQ ID NO: 209551 - DNA, 25 bp, Mus musculus
atctctttcaggtagagcttgagat

SEQ ID NO: 209552 - DNA, 25 bp, Mus musculus
atctctttcagtatcctgtgcgtcc

SEQ ID NO: 209553 - DNA, 25 bp, Mus musculus
atctctttccgggtgaacagagaga

SEQ ID NO: 209554 - DNA, 25 bp, Mus musculus
atctcttttaggatggacgacagag

SEQ ID NO: 209555 - DNA, 25 bp, Mus musculus
atctgaaaaatcaagaaatgtgcct

SEQ ID NO: 209556 - DNA, 25 bp, Mus musculus
atctgaaaaatcaagttgtcactca

SEQ ID NO: 209557 - DNA, 25 bp, Mus musculus
atctgaaaatttggaggcagcaccg

SEQ ID NO: 209558 - DNA, 25 bp, Mus musculus
atctgaaacatggtggtaagagaag

SEQ ID NO: 209559 - DNA, 25 bp, Mus musculus
atctgaaaccagagtccagcttggt

SEQ ID NO: 209560 - DNA, 25 bp, Mus musculus
atctgaaaccaggagattggccggt

SEQ ID NO: 209561 - DNA, 25 bp, Mus musculus
atctgaaactgaactcggagagtaa

SEQ ID NO: 209562 - DNA, 25 bp, Mus musculus
atctgaaacttttgttttcctgaaa

SEQ ID NO: 209563 - DNA, 25 bp, Mus musculus
atctgaaagaggatatcaagttcat

SEQ ID NO: 209564 - DNA, 25 bp, Mus musculus
atctgaagaaatcaaaggctcttgg

SEQ ID NO: 209565 - DNA, 25 bp, Mus musculus
atctgaagaacgggtatggctttgt

SEQ ID NO: 209566 - DNA, 25 bp, Mus musculus
atctgaagaacggtctgttatgttc

SEQ ID NO: 209567 - DNA, 25 bp, Mus musculus
atctgaagcaggaagcaggaagcct

SEQ ID NO: 209568 - DNA, 25 bp, Mus musculus
atctgaagcctggttccctcaaccc

SEQ ID NO: 209569 - DNA, 25 bp, Mus musculus
atctgaaggagatggcaattccggt

SEQ ID NO: 209570 - DNA, 25 bp, Mus musculus
atctgaaggcctggttctgcataag

SEQ ID NO: 209571 - DNA, 25 bp, Mus musculus
atctgaagggcaaggaactaccgtg

SEQ ID NO: 209572 - DNA, 25 bp, Mus musculus
atctgaagggcaaggtgctcatctg

SEQ ID NO: 209573 - DNA, 25 bp, Mus musculus
atctgaataagtgcggacctatggt

SEQ ID NO: 209574 - DNA, 25 bp, Mus musculus
atctgaattcaagggaaacaactgg

SEQ ID NO: 209575 - DNA, 25 bp, Mus musculus
atctgaattcagaggaggtggctga

SEQ ID NO: 209576 - DNA, 25 bp, Mus musculus
atctgacaaaagaaagaatatgtac

SEQ ID NO: 209577 - DNA, 25 bp, Mus musculus
atctgacaacagccaagagaaacat

SEQ ID NO: 209578 - DNA, 25 bp, Mus musculus
atctgacaacaggtcaccttcgtct

SEQ ID NO: 209579 - DNA, 25 bp, Mus musculus
atctgacaaggacccacattgtgga

SEQ ID NO: 209580 - DNA, 25 bp, Mus musculus
atctgaccaaggtttggcctcacaa

SEQ ID NO: 209581 - DNA, 25 bp, Mus musculus
atctgaccatacaggctgggccggt

SEQ ID NO: 209582 - DNA, 25 bp, Mus musculus
atctgacccaagagattgctatgga

SEQ ID NO: 209583 - DNA, 25 bp, Mus musculus
atctgacccaagcttatgatggagc

SEQ ID NO: 209584 - DNA, 25 bp, Mus musculus
atctgacccaggtgtccccatgact

SEQ ID NO: 209585 - DNA, 25 bp, Mus musculus
atctgacctgtgctgagcctaccac

SEQ ID NO: 209586 - DNA, 25 bp, Mus musculus
atctgacgaaaaaagatgattcttt

SEQ ID NO: 209587 - DNA, 25 bp, Mus musculus
atctgacgaaaaaaggaatgtcctc

SEQ ID NO: 209588 - DNA, 25 bp, Mus musculus
atctgacgcaagagcaggaatccag

SEQ ID NO: 209589 - DNA, 25 bp, Mus musculus
atctgactcaagggaagtaagcaat

SEQ ID NO: 209590 - DNA, 25 bp, Mus musculus
atctgactccacgtcgtggtcctgc

SEQ ID NO: 209591 - DNA, 25 bp, Mus musculus
atctgacttttagaaccagctcagc

SEQ ID NO: 209592 - DNA, 25 bp, Mus musculus
atctgagaaaacaggtcttaatttg

SEQ ID NO: 209593 - DNA, 25 bp, Mus musculus
atctgagaaatcaggtcttaatttg

SEQ ID NO: 209594 - DNA, 25 bp, Mus musculus
atctgagaacggtgatgctagcgag

SEQ ID NO: 209595 - DNA, 25 bp, Mus musculus
atctgagagaggtgaaccaccaaaa

SEQ ID NO: 209596 - DNA, 25 bp, Mus musculus
atctgagagataaggcacctccaag

SEQ ID NO: 209597 - DNA, 25 bp, Mus musculus
atctgagccatctgggaaagatgtg

SEQ ID NO: 209598 - DNA, 25 bp, Mus musculus
atctgagcccagcagcgtaaacgac

SEQ ID NO: 209599 - DNA, 25 bp, Mus musculus
atctgagctgccgaacaaaaaaggc

SEQ ID NO: 209600 - DNA, 25 bp, Mus musculus
atctgaggatacagcaacttctaag

SEQ ID NO: 209601 - DNA, 25 bp, Mus musculus
atctgagtcaggatgcgtacactgc

SEQ ID NO: 209602 - DNA, 25 bp, Mus musculus
atctgagttggcaggaagaaaatgc

SEQ ID NO: 209603 - DNA, 25 bp, Mus musculus
atctgagttggcagtcacaaactcg

SEQ ID NO: 209604 - DNA, 25 bp, Mus musculus
atctgatagcctgggtttgtcactc

SEQ ID NO: 209605 - DNA, 25 bp, Mus musculus
atctgatcagaacaggacgcgggtc

SEQ ID NO: 209606 - DNA, 25 bp, Mus musculus
atctgatcagcagaggtgctgttac

SEQ ID NO: 209607 - DNA, 25 bp, Mus musculus
atctgatcaggtccagcctgatgag

SEQ ID NO: 209608 - DNA, 25 bp, Mus musculus
atctgatcagtctcggcatctctgt

SEQ ID NO: 209609 - DNA, 25 bp, Mus musculus
atctgatccaaaaaggatacatgag

SEQ ID NO: 209610 - DNA, 25 bp, Mus musculus
atctgatctgagaggcctctcctgc

SEQ ID NO: 209611 - DNA, 25 bp, Mus musculus
atctgatgaggttgtcttgaaggat

SEQ ID NO: 209612 - DNA, 25 bp, Mus musculus
atctgatgatggtcgggtgagagcc

SEQ ID NO: 209613 - DNA, 25 bp, Mus musculus
atctgatggaggagtcttctatgag

SEQ ID NO: 209614 - DNA, 25 bp, Mus musculus
atctgatgtggaaaggaaaatagaa

SEQ ID NO: 209615 - DNA, 25 bp, Mus musculus
atctgattcaggtacacaactggag

SEQ ID NO: 209616 - DNA, 25 bp, Mus musculus
atctgattccagctgaccagggtgg

SEQ ID NO: 209617 - DNA, 25 bp, Mus musculus
atctgattcctcagggcatcgtgaa

SEQ ID NO: 209618 - DNA, 25 bp, Mus musculus
atctgattgtgagcggaaaagtgta

SEQ ID NO: 209619 - DNA, 25 bp, Mus musculus
atctgcaaacagaagcgatgtccta

SEQ ID NO: 209620 - DNA, 25 bp, Mus musculus
atctgcaaagaaatcctacgaacat

SEQ ID NO: 209621 - DNA, 25 bp, Mus musculus
atctgcaagaaaaggaaggaactca

SEQ ID NO: 209622 - DNA, 25 bp, Mus musculus
atctgcaagaaaaggactggacaga

SEQ ID NO: 209623 - DNA, 25 bp, Mus musculus
atctgcaagaaaaggctcatgtgtt

SEQ ID NO: 209624 - DNA, 25 bp, Mus musculus
atctgcaagccaagcagtctctggt

SEQ ID NO: 209625 - DNA, 25 bp, Mus musculus
atctgcaaggaaggttggcagcgtg

SEQ ID NO: 209626 - DNA, 25 bp, Mus musculus
atctgcaaggatgctacggaagagt

SEQ ID NO: 209627 - DNA, 25 bp, Mus musculus
atctgcaaggatggagaatacattg

SEQ ID NO: 209628 - DNA, 25 bp, Mus musculus
atctgcaaggcaggtcttccatgtt

SEQ ID NO: 209629 - DNA, 25 bp, Mus musculus
atctgcaagtggcaggattctgaat

SEQ ID NO: 209630 - DNA, 25 bp, Mus musculus
atctgcactgaacagtcaaattctc

SEQ ID NO: 209631 - DNA, 25 bp, Mus musculus
atctgcactgcagggttttggcgac

SEQ ID NO: 209632 - DNA, 25 bp, Mus musculus
atctgcacttcgtggggagcaggtc

SEQ ID NO: 209633 - DNA, 25 bp, Mus musculus
atctgcagaaaaatatcgtttgcct

SEQ ID NO: 209634 - DNA, 25 bp, Mus musculus
atctgcagaaagtggaagaaaatgg

SEQ ID NO: 209635 - DNA, 25 bp, Mus musculus
atctgcagagctcagtcagaaggca

SEQ ID NO: 209636 - DNA, 25 bp, Mus musculus
atctgcagaggtcagtcagaaggca

SEQ ID NO: 209637 - DNA, 25 bp, Mus musculus
atctgcagagtgcagtattgtggaa

SEQ ID NO: 209638 - DNA, 25 bp, Mus musculus
atctgcagcgagcctatagtttggc

SEQ ID NO: 209639 - DNA, 25 bp, Mus musculus
atctgcagcgagtgcccttcgcatt

SEQ ID NO: 209640 - DNA, 25 bp, Mus musculus
atctgcagcgagtttggccaaggag

SEQ ID NO: 209641 - DNA, 25 bp, Mus musculus
atctgcaggagcaggccaacgaggg

SEQ ID NO: 209642 - DNA, 25 bp, Mus musculus
atctgcatcagactccgtgcttctg

SEQ ID NO: 209643 - DNA, 25 bp, Mus musculus
atctgcatgagcagtaccccctggc

SEQ ID NO: 209644 - DNA, 25 bp, Mus musculus
atctgcatgagcagtcgatggctgt

SEQ ID NO: 209645 - DNA, 25 bp, Mus musculus
atctgcatgttgagacacaaagatc

SEQ ID NO: 209646 - DNA, 25 bp, Mus musculus
atctgcattcacacaaatagcatgt

SEQ ID NO: 209647 - DNA, 25 bp, Mus musculus
atctgcattcacacaattaccagaa

SEQ ID NO: 209648 - DNA, 25 bp, Mus musculus
atctgccaacagacccagtgttgag

SEQ ID NO: 209649 - DNA, 25 bp, Mus musculus
atctgccaacaggaatgggtaggag

SEQ ID NO: 209650 - DNA, 25 bp, Mus musculus
atctgccaagagacaaacagaagtt

SEQ ID NO: 209651 - DNA, 25 bp, Mus musculus
atctgccaagtggtccagtgtgagc

SEQ ID NO: 209652 - DNA, 25 bp, Mus musculus
atctgccacgagagagctgcaagac

SEQ ID NO: 209653 - DNA, 25 bp, Mus musculus
atctgccagaaagtgacagcatcct

SEQ ID NO: 209654 - DNA, 25 bp, Mus musculus
atctgccagctgcaggtggtggctg

SEQ ID NO: 209655 - DNA, 25 bp, Mus musculus
atctgccagctggagacctccacac

SEQ ID NO: 209656 - DNA, 25 bp, Mus musculus
atctgccattctcaggaaaactact

SEQ ID NO: 209657 - DNA, 25 bp, Mus musculus
atctgcccaattgttatggctttga

SEQ ID NO: 209658 - DNA, 25 bp, Mus musculus
atctgcccagaggacgaggcggaag

SEQ ID NO: 209659 - DNA, 25 bp, Mus musculus
atctgcccctcgcgagagctggctc

SEQ ID NO: 209660 - DNA, 25 bp, Mus musculus
atctgccgagaggggtcccacagag

SEQ ID NO: 209661 - DNA, 25 bp, Mus musculus
atctgccggctgccgttccgagccc

SEQ ID NO: 209662 - DNA, 25 bp, Mus musculus
atctgcctaccaggtgcagagcccc

SEQ ID NO: 209663 - DNA, 25 bp, Mus musculus
atctgcctaccaggtggcaaaggaa

SEQ ID NO: 209664 - DNA, 25 bp, Mus musculus
atctgcctcaagaaatttgtcaagc

SEQ ID NO: 209665 - DNA, 25 bp, Mus musculus
atctgcctcagagaacatgagctgt

SEQ ID NO: 209666 - DNA, 25 bp, Mus musculus
atctgcctcagagcacctacgcttg

SEQ ID NO: 209667 - DNA, 25 bp, Mus musculus
atctgcctcaggtcttcggatcagt

SEQ ID NO: 209668 - DNA, 25 bp, Mus musculus
atctgcctcattgtacaagtctcca

SEQ ID NO: 209669 - DNA, 25 bp, Mus musculus
atctgcctgccattgctgctctgac

SEQ ID NO: 209670 - DNA, 25 bp, Mus musculus
atctgcctgccattgctgctgacaa

SEQ ID NO: 209671 - DNA, 25 bp, Mus musculus
atctgcctggtggaggcggacctat

SEQ ID NO: 209672 - DNA, 25 bp, Mus musculus
atctgccttcagaaaaaatgctgtt

SEQ ID NO: 209673 - DNA, 25 bp, Mus musculus
atctgcgccccgggctccagcatac

SEQ ID NO: 209674 - DNA, 25 bp, Mus musculus
atctgcgcgggagagtcctttcaag

SEQ ID NO: 209675 - DNA, 25 bp, Mus musculus
atctgcgctggcaggttgtagatac

SEQ ID NO: 209676 - DNA, 25 bp, Mus musculus
atctgcggaagggaaacaacctgat

SEQ ID NO: 209677 - DNA, 25 bp, Mus musculus
atctgcggagcctaagtctgtacca

SEQ ID NO: 209678 - DNA, 25 bp, Mus musculus
atctgcgtaccccagaccgattttg

SEQ ID NO: 209679 - DNA, 25 bp, Mus musculus
atctgcgtcattcagagaggaatgc

SEQ ID NO: 209680 - DNA, 25 bp, Mus musculus
atctgcgtgtgagcgtggcacaaga

SEQ ID NO: 209681 - DNA, 25 bp, Mus musculus
atctgctaaaagatttctgcatgaa

SEQ ID NO: 209682 - DNA, 25 bp, Mus musculus
atctgctaagaaggattcatggttg

SEQ ID NO: 209683 - DNA, 25 bp, Mus musculus
atctgctaagaagggtgctcacttc

SEQ ID NO: 209684 - DNA, 25 bp, Mus musculus
atctgctaaggctttggagttttta

SEQ ID NO: 209685 - DNA, 25 bp, Mus musculus
atctgctaccacagccgctagtcag

SEQ ID NO: 209686 - DNA, 25 bp, Mus musculus
atctgctaccacaggagccgaaagc

SEQ ID NO: 209687 - DNA, 25 bp, Mus musculus
atctgctagagaagggcaagtctga

SEQ ID NO: 209688 - DNA, 25 bp, Mus musculus
atctgctagagactggctctccaag

SEQ ID NO: 209689 - DNA, 25 bp, Mus musculus
atctgctagagctctggtgttctat

SEQ ID NO: 209690 - DNA, 25 bp, Mus musculus
atctgctagaggttcacaacaaaga

SEQ ID NO: 209691 - DNA, 25 bp, Mus musculus
atctgctagagtaggtgcttcccgg

SEQ ID NO: 209692 - DNA, 25 bp, Mus musculus
atctgctagcatagatattttgaga

SEQ ID NO: 209693 - DNA, 25 bp, Mus musculus
atctgctagcatcagggcccatttg

SEQ ID NO: 209694 - DNA, 25 bp, Mus musculus
atctgctcagatggtttagacacgt

SEQ ID NO: 209695 - DNA, 25 bp, Mus musculus
atctgctcatccgctcccatctcca

SEQ ID NO: 209696 - DNA, 25 bp, Mus musculus
atctgctgacaattgcttctacttc

SEQ ID NO: 209697 - DNA, 25 bp, Mus musculus
atctgctgacgcttcgctgcggggt

SEQ ID NO: 209698 - DNA, 25 bp, Mus musculus
atctgctgacggatagcggcggctt

SEQ ID NO: 209699 - DNA, 25 bp, Mus musculus
atctgctgcccctcctgggccctgg

SEQ ID NO: 209700 - DNA, 25 bp, Mus musculus
atctgctggatcatgcacctccaga

SEQ ID NO: 209701 - DNA, 25 bp, Mus musculus
atctgcttataagactgaagaggga

SEQ ID NO: 209702 - DNA, 25 bp, Mus musculus
atctgcttataaggacccatagatg

SEQ ID NO: 209703 - DNA, 25 bp, Mus musculus
atctgcttgtagagctgtcggccat

SEQ ID NO: 209704 - DNA, 25 bp, Mus musculus
atctggaaaacaggcccacagaaca

SEQ ID NO: 209705 - DNA, 25 bp, Mus musculus
atctggaaaatgccactccgtgtat

SEQ ID NO: 209706 - DNA, 25 bp, Mus musculus
atctggaaagacaggagcttatcat

SEQ ID NO: 209707 - DNA, 25 bp, Mus musculus
atctggaaaggtttccaaaatgcct

SEQ ID NO: 209708 - DNA, 25 bp, Mus musculus
atctggaacagacacagcccttgac

SEQ ID NO: 209709 - DNA, 25 bp, Mus musculus
atctggaacagggaacaagcttatt

SEQ ID NO: 209710 - DNA, 25 bp, Mus musculus
atctggaagctaaaaatctggccgc

SEQ ID NO: 209711 - DNA, 25 bp, Mus musculus
atctggaagtgagagttcattgttt

SEQ ID NO: 209712 - DNA, 25 bp, Mus musculus
atctggaagtgccaaagtagaagag

SEQ ID NO: 209713 - DNA, 25 bp, Mus musculus
atctggacaattacggtgcccgagg

SEQ ID NO: 209714 - DNA, 25 bp, Mus musculus
atctggacctcacctccttatagct

SEQ ID NO: 209715 - DNA, 25 bp, Mus musculus
atctggacttacaggtactatgggt

SEQ ID NO: 209716 - DNA, 25 bp, Mus musculus
atctggagacactagacctgaacta

SEQ ID NO: 209717 - DNA, 25 bp, Mus musculus
atctggagaccaggttctctgccaa

SEQ ID NO: 209718 - DNA, 25 bp, Mus musculus
atctggagaccccagcaccacatct

SEQ ID NO: 209719 - DNA, 25 bp, Mus musculus
atctggagacctggtacggagcaga

SEQ ID NO: 209720 - DNA, 25 bp, Mus musculus
atctggagatggcagttccctccag

SEQ ID NO: 209721 - DNA, 25 bp, Mus musculus
atctggagcagcagcctcagggctg

SEQ ID NO: 209722 - DNA, 25 bp, Mus musculus
atctggaggagctggaccagatctg

SEQ ID NO: 209723 - DNA, 25 bp, Mus musculus
atctggaggggtgagtgtggatctg

SEQ ID NO: 209724 - DNA, 25 bp, Mus musculus
atctggagtgtgggccagacccatg

SEQ ID NO: 209725 - DNA, 25 bp, Mus musculus
atctggagttacggtgaaactagat

SEQ ID NO: 209726 - DNA, 25 bp, Mus musculus
atctggataaaaaggtagcaacaat

SEQ ID NO: 209727 - DNA, 25 bp, Mus musculus
atctggataaagagttcaggaagga

SEQ ID NO: 209728 - DNA, 25 bp, Mus musculus
atctggatgacaagccaagcccgat

SEQ ID NO: 209729 - DNA, 25 bp, Mus musculus
atctggatgccccaggaactggatg

SEQ ID NO: 209730 - DNA, 25 bp, Mus musculus
atctggatgccccagttttataggc

SEQ ID NO: 209731 - DNA, 25 bp, Mus musculus
atctggcaaagggtatacctggcct

SEQ ID NO: 209732 - DNA, 25 bp, Mus musculus
atctggcaagagcggcctcggtgct

SEQ ID NO: 209733 - DNA, 25 bp, Mus musculus
atctggcacagaagctgattggcgt

SEQ ID NO: 209734 - DNA, 25 bp, Mus musculus
atctggcactaacagaacctttaga

SEQ ID NO: 209735 - DNA, 25 bp, Mus musculus
atctggcaggccctcagaatatggc

SEQ ID NO: 209736 - DNA, 25 bp, Mus musculus
atctggcaggggactctcctgctcc

SEQ ID NO: 209737 - DNA, 25 bp, Mus musculus
atctggccaaacgaaagctgggctc

SEQ ID NO: 209738 - DNA, 25 bp, Mus musculus
atctggccacaggggcattgttgtg

SEQ ID NO: 209739 - DNA, 25 bp, Mus musculus
atctggccagaaatggcctccacct

SEQ ID NO: 209740 - DNA, 25 bp, Mus musculus
atctggccagaaccagacttgggat

SEQ ID NO: 209741 - DNA, 25 bp, Mus musculus
atctggccagagaaggtgcttgaca

SEQ ID NO: 209742 - DNA, 25 bp, Mus musculus
atctggccagagaagtctttctgtc

SEQ ID NO: 209743 - DNA, 25 bp, Mus musculus
atctggccaggatactcacaggctt

SEQ ID NO: 209744 - DNA, 25 bp, Mus musculus
atctggcccagaggccaagtgagac

SEQ ID NO: 209745 - DNA, 25 bp, Mus musculus
atctggcctggcgcttaatgaaaaa

SEQ ID NO: 209746 - DNA, 25 bp, Mus musculus
atctggcgacatgatatttgaagga

SEQ ID NO: 209747 - DNA, 25 bp, Mus musculus
atctggcgggcaatggtgaatgaga

SEQ ID NO: 209748 - DNA, 25 bp, Mus musculus
atctggctccaactggcgtccctac

SEQ ID NO: 209749 - DNA, 25 bp, Mus musculus
atctggctccaactgggtctgagtg

SEQ ID NO: 209750 - DNA, 25 bp, Mus musculus
atctggctgctgcaggtcctgtggg

SEQ ID NO: 209751 - DNA, 25 bp, Mus musculus
atctggctgctgcagtgctggggat

SEQ ID NO: 209752 - DNA, 25 bp, Mus musculus
atctggctgtagcagctgcaccaca

SEQ ID NO: 209753 - DNA, 25 bp, Mus musculus
atctggctttcaagggaacaaagaa

SEQ ID NO: 209754 - DNA, 25 bp, Mus musculus
atctggctttcaagttgtggagctc

SEQ ID NO: 209755 - DNA, 25 bp, Mus musculus
atctgggaagaagccaccatggggc

SEQ ID NO: 209756 - DNA, 25 bp, Mus musculus
atctgggaccctggtacctcatcaa

SEQ ID NO: 209757 - DNA, 25 bp, Mus musculus
atctgggacgtgaaggacttcaaga

SEQ ID NO: 209758 - DNA, 25 bp, Mus musculus
atctgggatcattcacagatcattc

SEQ ID NO: 209759 - DNA, 25 bp, Mus musculus
atctgggattcagtcattaggattg

SEQ ID NO: 209760 - DNA, 25 bp, Mus musculus
atctgggcatgtggccattatgttt

SEQ ID NO: 209761 - DNA, 25 bp, Mus musculus
atctgggcatgtggggtgatcctgt

SEQ ID NO: 209762 - DNA, 25 bp, Mus musculus
atctgggcttaaaaggcatccaagg

SEQ ID NO: 209763 - DNA, 25 bp, Mus musculus
atctggggaactctgataagataca

SEQ ID NO: 209764 - DNA, 25 bp, Mus musculus
atctggggattctacagcacagggg

SEQ ID NO: 209765 - DNA, 25 bp, Mus musculus
atctggggcagaagattgctttggc

SEQ ID NO: 209766 - DNA, 25 bp, Mus musculus
atctggggcagaagcgcattaaaga

SEQ ID NO: 209767 - DNA, 25 bp, Mus musculus
atctggggtcctgctcctgcaaaaa

SEQ ID NO: 209768 - DNA, 25 bp, Mus musculus
atctgggttagagatgagacctgct

SEQ ID NO: 209769 - DNA, 25 bp, Mus musculus
atctggtgtggcagtagaaacagat

SEQ ID NO: 209770 - DNA, 25 bp, Mus musculus
atctggtgtggcattttttggacca

SEQ ID NO: 209771 - DNA, 25 bp, Mus musculus
atctggttttaggtccagcgagcac

SEQ ID NO: 209772 - DNA, 25 bp, Mus musculus
atctgtaacaacaggaggcccagcc

SEQ ID NO: 209773 - DNA, 25 bp, Mus musculus
atctgtaacatcttctcacatcatg

SEQ ID NO: 209774 - DNA, 25 bp, Mus musculus
atctgtaaccagaatggattgaatg

SEQ ID NO: 209775 - DNA, 25 bp, Mus musculus
atctgtaacggaaggtgcatctgct

SEQ ID NO: 209776 - DNA, 25 bp, Mus musculus
atctgtaactgaggctttaacagaa

SEQ ID NO: 209777 - DNA, 25 bp, Mus musculus
atctgtaagaaggtcccaggtaaat

SEQ ID NO: 209778 - DNA, 25 bp, Mus musculus
atctgtaatagcaggatgctggtcc

SEQ ID NO: 209779 - DNA, 25 bp, Mus musculus
atctgtaataggtgtgtgctgaaga

SEQ ID NO: 209780 - DNA, 25 bp, Mus musculus
atctgtacaagggtgaaaaaggaga

SEQ ID NO: 209781 - DNA, 25 bp, Mus musculus
atctgtaccagccgtgactgtccca

SEQ ID NO: 209782 - DNA, 25 bp, Mus musculus
atctgtaccagggtgtacattggtg

SEQ ID NO: 209783 - DNA, 25 bp, Mus musculus
atctgtaccaggtgcgcaaggacct

SEQ ID NO: 209784 - DNA, 25 bp, Mus musculus
atctgtacctgcaactcaatcgttt

SEQ ID NO: 209785 - DNA, 25 bp, Mus musculus
atctgtacctgcaagaagaaagtcc

SEQ ID NO: 209786 - DNA, 25 bp, Mus musculus
atctgtactagggaatattggcagc

SEQ ID NO: 209787 - DNA, 25 bp, Mus musculus
atctgtactgtgtacagtgcttctc

SEQ ID NO: 209788 - DNA, 25 bp, Mus musculus
atctgtagcacccagttcttgcagg

SEQ ID NO: 209789 - DNA, 25 bp, Mus musculus
atctgtagggctgcctctctggatg

SEQ ID NO: 209790 - DNA, 25 bp, Mus musculus
atctgtagggctgttgccaaggcac

SEQ ID NO: 209791 - DNA, 25 bp, Mus musculus
atctgtatgagtggcctcgaactca

SEQ ID NO: 209792 - DNA, 25 bp, Mus musculus
atctgtcacagaaagaaagactgcg

SEQ ID NO: 209793 - DNA, 25 bp, Mus musculus
atctgtcacttgggagtttgcccaa

SEQ ID NO: 209794 - DNA, 25 bp, Mus musculus
atctgtccacatgcccctgtgatgc

SEQ ID NO: 209795 - DNA, 25 bp, Mus musculus
atctgtccacatgcgtttgatatcg

SEQ ID NO: 209796 - DNA, 25 bp, Mus musculus
atctgtccccgaggctgcttatgat

SEQ ID NO: 209797 - DNA, 25 bp, Mus musculus
atctgtcctgaggagtgtgcagcca

SEQ ID NO: 209798 - DNA, 25 bp, Mus musculus
atctgtctaagaatctcctgtaaaa

SEQ ID NO: 209799 - DNA, 25 bp, Mus musculus
atctgtctcgagagctgaagacacc

SEQ ID NO: 209800 - DNA, 25 bp, Mus musculus
atctgtctgaaaacgatgatggagc

SEQ ID NO: 209801 - DNA, 25 bp, Mus musculus
atctgtctgaaatactgatccagaa

SEQ ID NO: 209802 - DNA, 25 bp, Mus musculus
atctgtctgaaatgagcatctgtaa

SEQ ID NO: 209803 - DNA, 25 bp, Mus musculus
atctgtctgatggaggtaaaagtaa

SEQ ID NO: 209804 - DNA, 25 bp, Mus musculus
atctgtctgcaaggatccagcaatg

SEQ ID NO: 209805 - DNA, 25 bp, Mus musculus
atctgtctgcaggtgttatttccaa

SEQ ID NO: 209806 - DNA, 25 bp, Mus musculus
atctgtctttcagggtggtaggaat

SEQ ID NO: 209807 - DNA, 25 bp, Mus musculus
atctgtgaagatgtccagctcgccg

SEQ ID NO: 209808 - DNA, 25 bp, Mus musculus
atctgtgaagcttcttaaccccaac

SEQ ID NO: 209809 - DNA, 25 bp, Mus musculus
atctgtgacgggtttcgtgctacca

SEQ ID NO: 209810 - DNA, 25 bp, Mus musculus
atctgtgattataaaagctttgatg

SEQ ID NO: 209811 - DNA, 25 bp, Mus musculus
atctgtgcacagactgactttgcac

SEQ ID NO: 209812 - DNA, 25 bp, Mus musculus
atctgtgcactgctgaagaaggacc

SEQ ID NO: 209813 - DNA, 25 bp, Mus musculus
atctgtgcagggtgatagcacactc

SEQ ID NO: 209814 - DNA, 25 bp, Mus musculus
atctgtgcaggtcctacggctctgt

SEQ ID NO: 209815 - DNA, 25 bp, Mus musculus
atctgtgcatgggccagcgtgacgg

SEQ ID NO: 209816 - DNA, 25 bp, Mus musculus
atctgtgccacacagatgctggaga

SEQ ID NO: 209817 - DNA, 25 bp, Mus musculus
atctgtgccatgccaggtggttctg

SEQ ID NO: 209818 - DNA, 25 bp, Mus musculus
atctgtgcctcgatggcactgcctt

SEQ ID NO: 209819 - DNA, 25 bp, Mus musculus
atctgtgctgcccagatcttggtga

SEQ ID NO: 209820 - DNA, 25 bp, Mus musculus
atctgtgctggctgcaaccaagtgc

SEQ ID NO: 209821 - DNA, 25 bp, Mus musculus
atctgtggataagctatatccacct

SEQ ID NO: 209822 - DNA, 25 bp, Mus musculus
atctgtggcaaagttagagaacgtg

SEQ ID NO: 209823 - DNA, 25 bp, Mus musculus
atctgtggctgaattacacagtcga

SEQ ID NO: 209824 - DNA, 25 bp, Mus musculus
atctgtgggagtatgtcatggccac

SEQ ID NO: 209825 - DNA, 25 bp, Mus musculus
atctgtggggaagctcctgactatg

SEQ ID NO: 209826 - DNA, 25 bp, Mus musculus
atctgtggtggttctttcagctaca

SEQ ID NO: 209827 - DNA, 25 bp, Mus musculus
atctgtgtacagggttcggcagact

SEQ ID NO: 209828 - DNA, 25 bp, Mus musculus
atctgtgtatagagttcgaaatttg

SEQ ID NO: 209829 - DNA, 25 bp, Mus musculus
atctgtgtatagatgatgaggaatc

SEQ ID NO: 209830 - DNA, 25 bp, Mus musculus
atctgtgtgacaccaacgacctgca

SEQ ID NO: 209831 - DNA, 25 bp, Mus musculus
atctgtgtgacaccattcattgatg

SEQ ID NO: 209832 - DNA, 25 bp, Mus musculus
atctgtgtgggaacgtgttccggtc

SEQ ID NO: 209833 - DNA, 25 bp, Mus musculus
atctgtgtttccctacatccagaac

SEQ ID NO: 209834 - DNA, 25 bp, Mus musculus
atctgttacagcaaggtggctcagg

SEQ ID NO: 209835 - DNA, 25 bp, Mus musculus
atctgttcaacagcactgttgccaa

SEQ ID NO: 209836 - DNA, 25 bp, Mus musculus
atctgttcaacagggaccaaatgac

SEQ ID NO: 209837 - DNA, 25 bp, Mus musculus
atctgttgaagagcaagttgctccc

SEQ ID NO: 209838 - DNA, 25 bp, Mus musculus
atctgttggcctggtacaggaccct

SEQ ID NO: 209839 - DNA, 25 bp, Mus musculus
atctgtttcaaatcccagaaaccgg

SEQ ID NO: 209840 - DNA, 25 bp, Mus musculus
atctgtttcaagaagatctgcctca

SEQ ID NO: 209841 - DNA, 25 bp, Mus musculus
atctgttttagcaatcccacaggga

SEQ ID NO: 209842 - DNA, 25 bp, Mus musculus
atctgttttttagcacaatggaagg

SEQ ID NO: 209843 - DNA, 25 bp, Mus musculus
atcttaaaagaggtctggaagactc

SEQ ID NO: 209844 - DNA, 25 bp, Mus musculus
atcttaaagatgaggtcctgtaata

SEQ ID NO: 209845 - DNA, 25 bp, Mus musculus
atcttaaagatggaggcgccgagga

SEQ ID NO: 209846 - DNA, 25 bp, Mus musculus
atcttaaagatggcttgtccatgcg

SEQ ID NO: 209847 - DNA, 25 bp, Mus musculus
atcttaaagatgggggctgaggcga

SEQ ID NO: 209848 - DNA, 25 bp, Mus musculus
atcttaaataaaggtatggcctcac

SEQ ID NO: 209849 - DNA, 25 bp, Mus musculus
atcttaacaagggataactctctgc

SEQ ID NO: 209850 - DNA, 25 bp, Mus musculus
atcttaacagtgtcttggctgaacg

SEQ ID NO: 209851 - DNA, 25 bp, Mus musculus
atcttaactggagttggtcgaatta

SEQ ID NO: 209852 - DNA, 25 bp, Mus musculus
atcttaagaaagaggaagcagaaat

SEQ ID NO: 209853 - DNA, 25 bp, Mus musculus
atcttaagaaatgctgcggcaccat

SEQ ID NO: 209854 - DNA, 25 bp, Mus musculus
atcttaagactggcctgctgcaaaa

SEQ ID NO: 209855 - DNA, 25 bp, Mus musculus
atcttaagaggaggtccttgttcac

SEQ ID NO: 209856 - DNA, 25 bp, Mus musculus
atcttaataatcctattgcagtgag

SEQ ID NO: 209857 - DNA, 25 bp, Mus musculus
atcttaattaagaacattacttcat

SEQ ID NO: 209858 - DNA, 25 bp, Mus musculus
atcttacaagaagtaaagcttagta

SEQ ID NO: 209859 - DNA, 25 bp, Mus musculus
atcttacaagaatgcagaaggctgg

SEQ ID NO: 209860 - DNA, 25 bp, Mus musculus
atcttacaggaggccacatggtgat

SEQ ID NO: 209861 - DNA, 25 bp, Mus musculus
atcttacatgctctgaagatggctg

SEQ ID NO: 209862 - DNA, 25 bp, Mus musculus
atcttaccaagattctaaggtgaag

SEQ ID NO: 209863 - DNA, 25 bp, Mus musculus
atcttacccaaagcccacctggaag

SEQ ID NO: 209864 - DNA, 25 bp, Mus musculus
atcttacggagggctggatcgtgac

SEQ ID NO: 209865 - DNA, 25 bp, Mus musculus
atcttactcagaaaaatttcctatc

SEQ ID NO: 209866 - DNA, 25 bp, Mus musculus
atcttactcagggcattacacaagc

SEQ ID NO: 209867 - DNA, 25 bp, Mus musculus
atcttactgctttgactgtactccc

SEQ ID NO: 209868 - DNA, 25 bp, Mus musculus
atcttagaacatcctttactgtgat

SEQ ID NO: 209869 - DNA, 25 bp, Mus musculus
atcttagacctggaatcagatgaag

SEQ ID NO: 209870 - DNA, 25 bp, Mus musculus
atcttagttcgttgtgatgacgacc

SEQ ID NO: 209871 - DNA, 25 bp, Mus musculus
atcttatcagacaaagtaaatcaga

SEQ ID NO: 209872 - DNA, 25 bp, Mus musculus
atcttatcaggagcacggcatccct

SEQ ID NO: 209873 - DNA, 25 bp, Mus musculus
atcttatctctgtgtgtgccgacaa

SEQ ID NO: 209874 - DNA, 25 bp, Mus musculus
atcttatgctagaaaaggttgcacg

SEQ ID NO: 209875 - DNA, 25 bp, Mus musculus
atcttatgtcaaggcaccgagatgg

SEQ ID NO: 209876 - DNA, 25 bp, Mus musculus
atcttattccagtcccactcactta

SEQ ID NO: 209877 - DNA, 25 bp, Mus musculus
atcttattccatagtagtgggcagc

SEQ ID NO: 209878 - DNA, 25 bp, Mus musculus
atcttcaaagggattaacatccttg

SEQ ID NO: 209879 - DNA, 25 bp, Mus musculus
atcttcaactccgagctggaattcg

SEQ ID NO: 209880 - DNA, 25 bp, Mus musculus
atcttcaagcagagaaagaacgaac

SEQ ID NO: 209881 - DNA, 25 bp, Mus musculus
atcttcaagcagcctgaaaggcaag

SEQ ID NO: 209882 - DNA, 25 bp, Mus musculus
atcttcaatgaaattacacttgtga

SEQ ID NO: 209883 - DNA, 25 bp, Mus musculus
atcttcaatggtctgacagtctcta

SEQ ID NO: 209884 - DNA, 25 bp, Mus musculus
atcttcaatgtggctcactttagtg

SEQ ID NO: 209885 - DNA, 25 bp, Mus musculus
atcttcacaggagagagactgagaa

SEQ ID NO: 209886 - DNA, 25 bp, Mus musculus
atcttcaccactgaccggggggtgt

SEQ ID NO: 209887 - DNA, 25 bp, Mus musculus
atcttcaccaggtccagctagctgg

SEQ ID NO: 209888 - DNA, 25 bp, Mus musculus
atcttcaccagtctaaatccagtga

SEQ ID NO: 209889 - DNA, 25 bp, Mus musculus
atcttcagagccagatagacctctt

SEQ ID NO: 209890 - DNA, 25 bp, Mus musculus
atcttcagagggttcccagccccac

SEQ ID NO: 209891 - DNA, 25 bp, Mus musculus
atcttcagccaaagaaccccaaatc

SEQ ID NO: 209892 - DNA, 25 bp, Mus musculus
atcttcagccaaagcctattggtgt

SEQ ID NO: 209893 - DNA, 25 bp, Mus musculus
atcttcagccaaaggagccagtcac

SEQ ID NO: 209894 - DNA, 25 bp, Mus musculus
atcttcagccaaaggattgggacat

SEQ ID NO: 209895 - DNA, 25 bp, Mus musculus
atcttcagcctggcagaaaacttct

SEQ ID NO: 209896 - DNA, 25 bp, Mus musculus
atcttcagctacattttcagctttg

SEQ ID NO: 209897 - DNA, 25 bp, Mus musculus
atcttcagggggtgattagtgttaa

SEQ ID NO: 209898 - DNA, 25 bp, Mus musculus
atcttcaggggtcagcaggaagaag

SEQ ID NO: 209899 - DNA, 25 bp, Mus musculus
atcttcagtgcaaggatggaaggac

SEQ ID NO: 209900 - DNA, 25 bp, Mus musculus
atcttcagtgcaaggttatcctgct

SEQ ID NO: 209901 - DNA, 25 bp, Mus musculus
atcttcagttttagatcaagaatga

SEQ ID NO: 209902 - DNA, 25 bp, Mus musculus
atcttcataacaaggatatagtgca

SEQ ID NO: 209903 - DNA, 25 bp, Mus musculus
atcttcatcaagtcacagtaatgaa

SEQ ID NO: 209904 - DNA, 25 bp, Mus musculus
atcttcatctccaaggttggtgaca

SEQ ID NO: 209905 - DNA, 25 bp, Mus musculus
atcttcatctgctgggaccagagtg

SEQ ID NO: 209906 - DNA, 25 bp, Mus musculus
atcttcattaagatggatgtaggtc

SEQ ID NO: 209907 - DNA, 25 bp, Mus musculus
atcttcattgctcagacggccagag

SEQ ID NO: 209908 - DNA, 25 bp, Mus musculus
atcttcattgctcagcatgagaatg

SEQ ID NO: 209909 - DNA, 25 bp, Mus musculus
atcttccaagattagaacacctagt

SEQ ID NO: 209910 - DNA, 25 bp, Mus musculus
atcttccagaccagggacggaaact

SEQ ID NO: 209911 - DNA, 25 bp, Mus musculus
atcttccatctggtcctgcatgtcc

SEQ ID NO: 209912 - DNA, 25 bp, Mus musculus
atcttccccaggttctccaagccag

SEQ ID NO: 209913 - DNA, 25 bp, Mus musculus
atcttccccgtgaaggacagtcatg

SEQ ID NO: 209914 - DNA, 25 bp, Mus musculus
atcttccctggcacagaaacatcat

SEQ ID NO: 209915 - DNA, 25 bp, Mus musculus
atcttccctggcaccgggcactgac

SEQ ID NO: 209916 - DNA, 25 bp, Mus musculus
atcttccgatggcagaaacttgatt

SEQ ID NO: 209917 - DNA, 25 bp, Mus musculus
atcttccgggagatccccactcctt

SEQ ID NO: 209918 - DNA, 25 bp, Mus musculus
atcttcctgcaagaactgagcctgg

SEQ ID NO: 209919 - DNA, 25 bp, Mus musculus
atcttcctgcaagcagccttcagat

SEQ ID NO: 209920 - DNA, 25 bp, Mus musculus
atcttcctgcaagggtggccatggg

SEQ ID NO: 209921 - DNA, 25 bp, Mus musculus
atcttcctgtccaccctgttggcag

SEQ ID NO: 209922 - DNA, 25 bp, Mus musculus
atcttccttaaagggattggagctg

SEQ ID NO: 209923 - DNA, 25 bp, Mus musculus
atcttccttaaaggggcgacctggc

SEQ ID NO: 209924 - DNA, 25 bp, Mus musculus
atcttcgagataagacagtgatgat

SEQ ID NO: 209925 - DNA, 25 bp, Mus musculus
atcttcgccataggtagcattgcca

SEQ ID NO: 209926 - DNA, 25 bp, Mus musculus
atcttcgcggcggggtggcggtggg

SEQ ID NO: 209927 - DNA, 25 bp, Mus musculus
atcttcgggagaggaacagtatcca

SEQ ID NO: 209928 - DNA, 25 bp, Mus musculus
atcttcgggagaggaggtttgggat

SEQ ID NO: 209929 - DNA, 25 bp, Mus musculus
atcttcgtactagaggctgctgtcc

SEQ ID NO: 209930 - DNA, 25 bp, Mus musculus
atcttcgtactagctcacttcatga

SEQ ID NO: 209931 - DNA, 25 bp, Mus musculus
atcttcgtactagctcctggacttc

SEQ ID NO: 209932 - DNA, 25 bp, Mus musculus
atcttcgtctcctgccgtggatgct

SEQ ID NO: 209933 - DNA, 25 bp, Mus musculus
atcttctaaagttgattgaatcaac

SEQ ID NO: 209934 - DNA, 25 bp, Mus musculus
atcttctacatggtgccatcagcaa

SEQ ID NO: 209935 - DNA, 25 bp, Mus musculus
atcttctatggagagaaacaacccg

SEQ ID NO: 209936 - DNA, 25 bp, Mus musculus
atcttctcagatcatagcagaactt

SEQ ID NO: 209937 - DNA, 25 bp, Mus musculus
atcttctcagggacaggggcagacc

SEQ ID NO: 209938 - DNA, 25 bp, Mus musculus
atcttctccaagttgctgcaatagt

SEQ ID NO: 209939 - DNA, 25 bp, Mus musculus
atcttctcccagatgaccaagatgt

SEQ ID NO: 209940 - DNA, 25 bp, Mus musculus
atcttctctgcagaccggcccaacg

SEQ ID NO: 209941 - DNA, 25 bp, Mus musculus
atcttctgaaagctctgtacaactc

SEQ ID NO: 209942 - DNA, 25 bp, Mus musculus
atcttctgatatgaggacccatcct

SEQ ID NO: 209943 - DNA, 25 bp, Mus musculus
atcttctgccatacccgcaaaacag

SEQ ID NO: 209944 - DNA, 25 bp, Mus musculus
atcttctgccgccagcattgacctc

SEQ ID NO: 209945 - DNA, 25 bp, Mus musculus
atcttctggaccctgcatggtttat

SEQ ID NO: 209946 - DNA, 25 bp, Mus musculus
atcttctggagagaagtgtgctggt

SEQ ID NO: 209947 - DNA, 25 bp, Mus musculus
atcttctggagagggcatcatggct

SEQ ID NO: 209948 - DNA, 25 bp, Mus musculus
atcttctgggcggaacgaagagctc

SEQ ID NO: 209949 - DNA, 25 bp, Mus musculus
atcttcttaaggagagcgattcaat

SEQ ID NO: 209950 - DNA, 25 bp, Mus musculus
atcttcttcacaggaagtcctcggg

SEQ ID NO: 209951 - DNA, 25 bp, Mus musculus
atcttcttccagtgcaggtcctaat

SEQ ID NO: 209952 - DNA, 25 bp, Mus musculus
atcttgaacttgaagctggttcatg

SEQ ID NO: 209953 - DNA, 25 bp, Mus musculus
atcttgaagcaggtggactccccta

SEQ ID NO: 209954 - DNA, 25 bp, Mus musculus
atcttgaaggagatggattctgatg

SEQ ID NO: 209955 - DNA, 25 bp, Mus musculus
atcttgacaagacagaggagggcgc

SEQ ID NO: 209956 - DNA, 25 bp, Mus musculus
atcttgacaagtggagagtacagtg

SEQ ID NO: 209957 - DNA, 25 bp, Mus musculus
atcttgactcggaggaagacgatga

SEQ ID NO: 209958 - DNA, 25 bp, Mus musculus
atcttgactcggtggacaccatgat

SEQ ID NO: 209959 - DNA, 25 bp, Mus musculus
atcttgagattactggagtgctgac

SEQ ID NO: 209960 - DNA, 25 bp, Mus musculus
atcttgataaaagtgaatttcctac

SEQ ID NO: 209961 - DNA, 25 bp, Mus musculus
atcttgataggatctgcttaaatgg

SEQ ID NO: 209962 - DNA, 25 bp, Mus musculus
atcttgatctaggccttcctataga

SEQ ID NO: 209963 - DNA, 25 bp, Mus musculus
atcttgatttggggttcccagcagt

SEQ ID NO: 209964 - DNA, 25 bp, Mus musculus
atcttgcaactccatctcggaagaa

SEQ ID NO: 209965 - DNA, 25 bp, Mus musculus
atcttgcaactgaatctgcctgtaa

SEQ ID NO: 209966 - DNA, 25 bp, Mus musculus
atcttgcacttccagatctctgaca

SEQ ID NO: 209967 - DNA, 25 bp, Mus musculus
atcttgcagaagaacatgtttggga

SEQ ID NO: 209968 - DNA, 25 bp, Mus musculus
atcttgcagaagagtcaggagctgc

SEQ ID NO: 209969 - DNA, 25 bp, Mus musculus
atcttgcagcttcatgagtttaaat

SEQ ID NO: 209970 - DNA, 25 bp, Mus musculus
atcttgcaggcctggagataaagtt

SEQ ID NO: 209971 - DNA, 25 bp, Mus musculus
atcttgctcctgcactggtgcagga

SEQ ID NO: 209972 - DNA, 25 bp, Mus musculus
atcttgcttagatggcaggttcagc

SEQ ID NO: 209973 - DNA, 25 bp, Mus musculus
atcttgcttagcctcaaagagttgc

SEQ ID NO: 209974 - DNA, 25 bp, Mus musculus
atcttgcttcgaagccagacacacc

SEQ ID NO: 209975 - DNA, 25 bp, Mus musculus
atcttggaatacagtgccgtgatgt

SEQ ID NO: 209976 - DNA, 25 bp, Mus musculus
atcttggaccacgctatggttttgg

SEQ ID NO: 209977 - DNA, 25 bp, Mus musculus
atcttggacggacagaatacaccat

SEQ ID NO: 209978 - DNA, 25 bp, Mus musculus
atcttggacggcttgactaaaatac

SEQ ID NO: 209979 - DNA, 25 bp, Mus musculus
atcttggacggcttgatgaggtctc

SEQ ID NO: 209980 - DNA, 25 bp, Mus musculus
atcttggacggcttgatgagtaaga

SEQ ID NO: 209981 - DNA, 25 bp, Mus musculus
atcttggacggcttggggatccagc

SEQ ID NO: 209982 - DNA, 25 bp, Mus musculus
atcttggacttcagccctagtctga

SEQ ID NO: 209983 - DNA, 25 bp, Mus musculus
atcttggagaaaatcttggaccttc

SEQ ID NO: 209984 - DNA, 25 bp, Mus musculus
atcttggccaaatgtaccgtctaac

SEQ ID NO: 209985 - DNA, 25 bp, Mus musculus
atcttggccctggtggatcagaaca

SEQ ID NO: 209986 - DNA, 25 bp, Mus musculus
atcttggctataaaaaatgccaggc

SEQ ID NO: 209987 - DNA, 25 bp, Mus musculus
atcttggctggtggctaccaaggac

SEQ ID NO: 209988 - DNA, 25 bp, Mus musculus
atcttgggaagagacaaagacatct

SEQ ID NO: 209989 - DNA, 25 bp, Mus musculus
atcttgggagaagtatgcttccact

SEQ ID NO: 209990 - DNA, 25 bp, Mus musculus
atcttgggagaagtttcttctagta

SEQ ID NO: 209991 - DNA, 25 bp, Mus musculus
atcttggtcaagaactgtactcttg

SEQ ID NO: 209992 - DNA, 25 bp, Mus musculus
atcttggtcaaggtacaactgtaac

SEQ ID NO: 209993 - DNA, 25 bp, Mus musculus
atcttggtccaggatctttctcaag

SEQ ID NO: 209994 - DNA, 25 bp, Mus musculus
atcttggtccaggtcatcccagtgg

SEQ ID NO: 209995 - DNA, 25 bp, Mus musculus
atcttggtgaataagtacaacaaag

SEQ ID NO: 209996 - DNA, 25 bp, Mus musculus
atcttgtaagcgtggggatgtcctt

SEQ ID NO: 209997 - DNA, 25 bp, Mus musculus
atcttgtaagctaaacagaaagaat

SEQ ID NO: 209998 - DNA, 25 bp, Mus musculus
atcttgtaagggtggggatgtcctt

SEQ ID NO: 209999 - DNA, 25 bp, Mus musculus
atcttgtactcagccagaagcaccc

SEQ ID NO: 210000 - DNA, 25 bp, Mus musculus
atcttgtatgctagttcactttaat

SEQ ID NO: 210001 - DNA, 25 bp, Mus musculus
atcttgtcaggaacctcagctgacg

SEQ ID NO: 210002 - DNA, 25 bp, Mus musculus
atcttgtcaggtgtgatgaatgcag

SEQ ID NO: 210003 - DNA, 25 bp, Mus musculus
atcttgtcctgtaaggtggtctgtg

SEQ ID NO: 210004 - DNA, 25 bp, Mus musculus
atcttgtgagagggtctgcatttgc

SEQ ID NO: 210005 - DNA, 25 bp, Mus musculus
atcttgtggggatctacttcaccgg

SEQ ID NO: 210006 - DNA, 25 bp, Mus musculus
atcttgtgggggtcttctgggtagg

SEQ ID NO: 210007 - DNA, 25 bp, Mus musculus
atctttaaaagatgttcctcctgcg

SEQ ID NO: 210008 - DNA, 25 bp, Mus musculus
atctttaaaatcgatcaaatgggaa

SEQ ID NO: 210009 - DNA, 25 bp, Mus musculus
atctttaaagcgcagtgctaactta

SEQ ID NO: 210010 - DNA, 25 bp, Mus musculus
atctttaaatatatttactggctcc

SEQ ID NO: 210011 - DNA, 25 bp, Mus musculus
atctttaagctgggaggaagagaca

SEQ ID NO: 210012 - DNA, 25 bp, Mus musculus
atctttaatgcctctccagcttctg

SEQ ID NO: 210013 - DNA, 25 bp, Mus musculus
atctttacatatctacgcctgcaac

SEQ ID NO: 210014 - DNA, 25 bp, Mus musculus
atctttacatctggctgagcatcct

SEQ ID NO: 210015 - DNA, 25 bp, Mus musculus
atctttagaagaagtgctctggatg

SEQ ID NO: 210016 - DNA, 25 bp, Mus musculus
atctttagagatggtgaagaattta

SEQ ID NO: 210017 - DNA, 25 bp, Mus musculus
atctttagagcaggtttaaacgcat

SEQ ID NO: 210018 - DNA, 25 bp, Mus musculus
atctttatatcttaaaagatgtgat

SEQ ID NO: 210019 - DNA, 25 bp, Mus musculus
atctttatcagcaatgctggtggtg

SEQ ID NO: 210020 - DNA, 25 bp, Mus musculus
atctttatctcaaattctggaattg

SEQ ID NO: 210021 - DNA, 25 bp, Mus musculus
atctttatctcacacgccggtggac

SEQ ID NO: 210022 - DNA, 25 bp, Mus musculus
atctttatgtctgagggtttggaaa

SEQ ID NO: 210023 - DNA, 25 bp, Mus musculus
atctttatgtctgaggtatctcatt

SEQ ID NO: 210024 - DNA, 25 bp, Mus musculus
atctttattaagcatgtgaagtaca

SEQ ID NO: 210025 - DNA, 25 bp, Mus musculus
atctttattaagtacaaatcgaagt

SEQ ID NO: 210026 - DNA, 25 bp, Mus musculus
atctttcaacgccaaccactctgaa

SEQ ID NO: 210027 - DNA, 25 bp, Mus musculus
atctttcaacttcagagctgtgcct

SEQ ID NO: 210028 - DNA, 25 bp, Mus musculus
atctttcaacttcaggagcctttgg

SEQ ID NO: 210029 - DNA, 25 bp, Mus musculus
atctttcaaggaccctgattttaaa

SEQ ID NO: 210030 - DNA, 25 bp, Mus musculus
atctttcaaggtttgaccaaaaggg

SEQ ID NO: 210031 - DNA, 25 bp, Mus musculus
atctttcagatggtgatatacatgg

SEQ ID NO: 210032 - DNA, 25 bp, Mus musculus
atctttcatgataaaggtgatcact

SEQ ID NO: 210033 - DNA, 25 bp, Mus musculus
atctttccaaaagcaactgctttgc

SEQ ID NO: 210034 - DNA, 25 bp, Mus musculus
atctttccaaaagctcctgggacct

SEQ ID NO: 210035 - DNA, 25 bp, Mus musculus
atctttccaagagctggagaagctg

SEQ ID NO: 210036 - DNA, 25 bp, Mus musculus
atctttccagttacaaatttccaca

SEQ ID NO: 210037 - DNA, 25 bp, Mus musculus
atctttcccaggacgatagccagcc

SEQ ID NO: 210038 - DNA, 25 bp, Mus musculus
atctttcccaggacggctactggca

SEQ ID NO: 210039 - DNA, 25 bp, Mus musculus
atctttccctcagagccagcccagg

SEQ ID NO: 210040 - DNA, 25 bp, Mus musculus
atctttcctggctagaccacattca

SEQ ID NO: 210041 - DNA, 25 bp, Mus musculus
atctttcctggtccatcaacctggc

SEQ ID NO: 210042 - DNA, 25 bp, Mus musculus
atctttccttcggacgctgaaccca

SEQ ID NO: 210043 - DNA, 25 bp, Mus musculus
atctttctcagattccttgtaatgg

SEQ ID NO: 210044 - DNA, 25 bp, Mus musculus
atctttctgggtcagaaacgtactt

SEQ ID NO: 210045 - DNA, 25 bp, Mus musculus
atctttctggtaatccccggcagcc

SEQ ID NO: 210046 - DNA, 25 bp, Mus musculus
atctttgaaaaccaggaaaataggt

SEQ ID NO: 210047 - DNA, 25 bp, Mus musculus
atctttgaagaccttgcttttacat

SEQ ID NO: 210048 - DNA, 25 bp, Mus musculus
atctttgaagatgctgtcttcagta

SEQ ID NO: 210049 - DNA, 25 bp, Mus musculus
atctttgaaggacgtgtaattccct

SEQ ID NO: 210050 - DNA, 25 bp, Mus musculus
atctttgaaggtctgggacacctca

SEQ ID NO: 210051 - DNA, 25 bp, Mus musculus
atctttgaagtactaagtataactt

SEQ ID NO: 210052 - DNA, 25 bp, Mus musculus
atctttgacaagcactataagactg

SEQ ID NO: 210053 - DNA, 25 bp, Mus musculus
atctttgagaatccccggcagccca

SEQ ID NO: 210054 - DNA, 25 bp, Mus musculus
atctttgatcgggtgctgacagagc

SEQ ID NO: 210055 - DNA, 25 bp, Mus musculus
atctttgatcggtccctctccaggg

SEQ ID NO: 210056 - DNA, 25 bp, Mus musculus
atctttgcatatcagatctgatgtt

SEQ ID NO: 210057 - DNA, 25 bp, Mus musculus
atctttgcccattgatttaggtcgc

SEQ ID NO: 210058 - DNA, 25 bp, Mus musculus
atctttgctgaaatgcacctagtgt

SEQ ID NO: 210059 - DNA, 25 bp, Mus musculus
atctttgctgaaatggtgacccgca

SEQ ID NO: 210060 - DNA, 25 bp, Mus musculus
atctttggaaaaaagctctcttaag

SEQ ID NO: 210061 - DNA, 25 bp, Mus musculus
atctttggaaaaaagttctaggcaa

SEQ ID NO: 210062 - DNA, 25 bp, Mus musculus
atctttggagaaaaatgtggaattg

SEQ ID NO: 210063 - DNA, 25 bp, Mus musculus
atctttggagaataatgtggaattg

SEQ ID NO: 210064 - DNA, 25 bp, Mus musculus
atcttttccaaacatcaacatggct

SEQ ID NO: 210065 - DNA, 25 bp, Mus musculus
atcttttccaggtgcagagtggtgg

SEQ ID NO: 210066 - DNA, 25 bp, Mus musculus
atcttttcgcagaagccacagaaga

SEQ ID NO: 210067 - DNA, 25 bp, Mus musculus
atcttttctgcggttgatccaaaag

SEQ ID NO: 210068 - DNA, 25 bp, Mus musculus
atcttttggaaaggtttttcttgat

SEQ ID NO: 210069 - DNA, 25 bp, Mus musculus
atctttttaaaaagtgtgttcaaag

SEQ ID NO: 210070 - DNA, 25 bp, Mus musculus
atctttttaaggtacagcaagggag

SEQ ID NO: 210071 - DNA, 25 bp, Mus musculus
atctttttcatggaagtgtgtgatg

SEQ ID NO: 210072 - DNA, 25 bp, Mus musculus
atctttttgaagaagcagaaaagta

SEQ ID NO: 210073 - DNA, 25 bp, Mus musculus
atctttttgagagtagtataagaaa

SEQ ID NO: 210074 - DNA, 25 bp, Mus musculus
atctttttgagagtattattggcat

SEQ ID NO: 210075 - DNA, 25 bp, Mus musculus
atcttttttttattgagtctcatgt

SEQ ID NO: 210076 - DNA, 25 bp, Mus musculus
atgaaaaaactaaggagttttggag

SEQ ID NO: 210077 - DNA, 25 bp, Mus musculus
atgaaaaaacttttgcactccttcc

SEQ ID NO: 210078 - DNA, 25 bp, Mus musculus
atgaaaaaaggctctggaatggcag

SEQ ID NO: 210079 - DNA, 25 bp, Mus musculus
atgaaaaaataggttttcctgcagc

SEQ ID NO: 210080 - DNA, 25 bp, Mus musculus
atgaaaaacagggaagctgcccggg

SEQ ID NO: 210081 - DNA, 25 bp, Mus musculus
atgaaaaacagggaagctgctaaag

SEQ ID NO: 210082 - DNA, 25 bp, Mus musculus
atgaaaaactcagtcgtgcggggtc

SEQ ID NO: 210083 - DNA, 25 bp, Mus musculus
atgaaaaaggccaagatatttatca

SEQ ID NO: 210084 - DNA, 25 bp, Mus musculus
atgaaaaagggggccacattatctt

SEQ ID NO: 210085 - DNA, 25 bp, Mus musculus
atgaaaaataagattggccaggtga

SEQ ID NO: 210086 - DNA, 25 bp, Mus musculus
atgaaaaataaggtagagcaactga

SEQ ID NO: 210087 - DNA, 25 bp, Mus musculus
atgaaaacaccaggcagtggtggat

SEQ ID NO: 210088 - DNA, 25 bp, Mus musculus
atgaaaacaggcccagaggaactgg

SEQ ID NO: 210089 - DNA, 25 bp, Mus musculus
atgaaaacagggcacctccgtctgg

SEQ ID NO: 210090 - DNA, 25 bp, Mus musculus
atgaaaacccagtgagatgagtcag

SEQ ID NO: 210091 - DNA, 25 bp, Mus musculus
atgaaaaccgacctatgtcaccttc

SEQ ID NO: 210092 - DNA, 25 bp, Mus musculus
atgaaaaccgacttccagattacca

SEQ ID NO: 210093 - DNA, 25 bp, Mus musculus
atgaaaaccgcagacctgtgttgcg

SEQ ID NO: 210094 - DNA, 25 bp, Mus musculus
atgaaaaccgcaggtatggcatttc

SEQ ID NO: 210095 - DNA, 25 bp, Mus musculus
atgaaaaccgcaggtgagaagacaa

SEQ ID NO: 210096 - DNA, 25 bp, Mus musculus
atgaaaacctggatctgatggaaca

SEQ ID NO: 210097 - DNA, 25 bp, Mus musculus
atgaaaacctgtattttgaggaatt

SEQ ID NO: 210098 - DNA, 25 bp, Mus musculus
atgaaaactgagggagatgagacag

SEQ ID NO: 210099 - DNA, 25 bp, Mus musculus
atgaaaactggtgaagggccggatg

SEQ ID NO: 210100 - DNA, 25 bp, Mus musculus
atgaaaagcctgacagaagtcgagg

SEQ ID NO: 210101 - DNA, 25 bp, Mus musculus
atgaaaagcctgctccaggtctggt

SEQ ID NO: 210102 - DNA, 25 bp, Mus musculus
atgaaaagtgcggggaagcgcttgg

SEQ ID NO: 210103 - DNA, 25 bp, Mus musculus
atgaaaatagattagcattcttgaa

SEQ ID NO: 210104 - DNA, 25 bp, Mus musculus
atgaaaatcaccagatggtctcagc

SEQ ID NO: 210105 - DNA, 25 bp, Mus musculus
atgaaaatccaaaaggacacatgta

SEQ ID NO: 210106 - DNA, 25 bp, Mus musculus
atgaaaatccaaaaggatctggaga

SEQ ID NO: 210107 - DNA, 25 bp, Mus musculus
atgaaaatctcaagacaaaaagata

SEQ ID NO: 210108 - DNA, 25 bp, Mus musculus
atgaaaatctcaaggtctatcctaa

SEQ ID NO: 210109 - DNA, 25 bp, Mus musculus
atgaaaatggaactagtaacaagga

SEQ ID NO: 210110 - DNA, 25 bp, Mus musculus
atgaaaattattggattgcagtgct

SEQ ID NO: 210111 - DNA, 25 bp, Mus musculus
atgaaacaaagagttcaactagatg

SEQ ID NO: 210112 - DNA, 25 bp, Mus musculus
atgaaacaaagatgcccttagacca

SEQ ID NO: 210113 - DNA, 25 bp, Mus musculus
atgaaacagtcaaaacaattcacat

SEQ ID NO: 210114 - DNA, 25 bp, Mus musculus
atgaaacagtgaaaaccataagggt

SEQ ID NO: 210115 - DNA, 25 bp, Mus musculus
atgaaaccacatccgtggttttttg

SEQ ID NO: 210116 - DNA, 25 bp, Mus musculus
atgaaaccacatccgtttggaaatg

SEQ ID NO: 210117 - DNA, 25 bp, Mus musculus
atgaaacccaattccaaatctatgc

SEQ ID NO: 210118 - DNA, 25 bp, Mus musculus
atgaaacccagcagccatccttgca

SEQ ID NO: 210119 - DNA, 25 bp, Mus musculus
atgaaacccagcagtatgaatattc

SEQ ID NO: 210120 - DNA, 25 bp, Mus musculus
atgaaacctgggactttactggaaa

SEQ ID NO: 210121 - DNA, 25 bp, Mus musculus
atgaaaccttccgacttgtctcagg

SEQ ID NO: 210122 - DNA, 25 bp, Mus musculus
atgaaacggctccaggctgctggca

SEQ ID NO: 210123 - DNA, 25 bp, Mus musculus
atgaaactcgactccagggaagttc

SEQ ID NO: 210124 - DNA, 25 bp, Mus musculus
atgaaactgcagatccaggtggatg

SEQ ID NO: 210125 - DNA, 25 bp, Mus musculus
atgaaactgcagtgctggcagaaga

SEQ ID NO: 210126 - DNA, 25 bp, Mus musculus
atgaaagaagagcaggaaccccaga

SEQ ID NO: 210127 - DNA, 25 bp, Mus musculus
atgaaagacagaaacaaactgttcc

SEQ ID NO: 210128 - DNA, 25 bp, Mus musculus
atgaaagacagggacatgaaacctg

SEQ ID NO: 210129 - DNA, 25 bp, Mus musculus
atgaaagagaaaggtgttgacctga

SEQ ID NO: 210130 - DNA, 25 bp, Mus musculus
atgaaagaggaaatggagcctgtga

SEQ ID NO: 210131 - DNA, 25 bp, Mus musculus
atgaaagaggctaccttaagggcgt

SEQ ID NO: 210132 - DNA, 25 bp, Mus musculus
atgaaagagtagtttcaagaacatg

SEQ ID NO: 210133 - DNA, 25 bp, Mus musculus
atgaaagagtggcggaacatgaagt

SEQ ID NO: 210134 - DNA, 25 bp, Mus musculus
atgaaagagtggcggtcctggagtt

SEQ ID NO: 210135 - DNA, 25 bp, Mus musculus
atgaaagcaactgtggaagaatttg

SEQ ID NO: 210136 - DNA, 25 bp, Mus musculus
atgaaagcaaggccagaagtcaatg

SEQ ID NO: 210137 - DNA, 25 bp, Mus musculus
atgaaagcaagtcagatgaatggaa

SEQ ID NO: 210138 - DNA, 25 bp, Mus musculus
atgaaagcagccatgtactcggtgg

SEQ ID NO: 210139 - DNA, 25 bp, Mus musculus
atgaaagcagggcttacatacctag

SEQ ID NO: 210140 - DNA, 25 bp, Mus musculus
atgaaagcagtggtccatgccgtgg

SEQ ID NO: 210141 - DNA, 25 bp, Mus musculus
atgaaagctcaggactctcggctct

SEQ ID NO: 210142 - DNA, 25 bp, Mus musculus
atgaaaggcacatacttggtacatt

SEQ ID NO: 210143 - DNA, 25 bp, Mus musculus
atgaaagtaacactgagtaccagtg

SEQ ID NO: 210144 - DNA, 25 bp, Mus musculus
atgaaagtacagggttgtttcaaag

SEQ ID NO: 210145 - DNA, 25 bp, Mus musculus
atgaaagtacaggtagagatctgcc

SEQ ID NO: 210146 - DNA, 25 bp, Mus musculus
atgaaagtctgtctagagtttcaag

SEQ ID NO: 210147 - DNA, 25 bp, Mus musculus
atgaaatagaagaggactccatata

SEQ ID NO: 210148 - DNA, 25 bp, Mus musculus
atgaaatagaagaggccttctttct

SEQ ID NO: 210149 - DNA, 25 bp, Mus musculus
atgaaatatgcaggaggggaagcag

SEQ ID NO: 210150 - DNA, 25 bp, Mus musculus
atgaaatatgcagtgagcatgtttt

SEQ ID NO: 210151 - DNA, 25 bp, Mus musculus
atgaaatatgcccagcgagccagag

SEQ ID NO: 210152 - DNA, 25 bp, Mus musculus
atgaaatatgcccaggtgaagcctg

SEQ ID NO: 210153 - DNA, 25 bp, Mus musculus
atgaaatattccaagttcagtggtc

SEQ ID NO: 210154 - DNA, 25 bp, Mus musculus
atgaaatcaagaatctcgatctgcc

SEQ ID NO: 210155 - DNA, 25 bp, Mus musculus
atgaaatcaaggaacaagcaatggc

SEQ ID NO: 210156 - DNA, 25 bp, Mus musculus
atgaaatcaaggaagactcttcaat

SEQ ID NO: 210157 - DNA, 25 bp, Mus musculus
atgaaatcaaggtaactatggatgc

SEQ ID NO: 210158 - DNA, 25 bp, Mus musculus
atgaaatcaaggttccgtgttgcca

SEQ ID NO: 210159 - DNA, 25 bp, Mus musculus
atgaaatcaagtatgcaacccagct

SEQ ID NO: 210160 - DNA, 25 bp, Mus musculus
atgaaatcacacaatatgtagctgg

SEQ ID NO: 210161 - DNA, 25 bp, Mus musculus
atgaaatcacacagttttcagatat

SEQ ID NO: 210162 - DNA, 25 bp, Mus musculus
atgaaatcacagaactagacaccct

SEQ ID NO: 210163 - DNA, 25 bp, Mus musculus
atgaaatcacaggtcctgctgtctc

SEQ ID NO: 210164 - DNA, 25 bp, Mus musculus
atgaaatcagccacaccttcaactc

SEQ ID NO: 210165 - DNA, 25 bp, Mus musculus
atgaaatcccaggtgatgacacacc

SEQ ID NO: 210166 - DNA, 25 bp, Mus musculus
atgaaatccttcctggaaggccgga

SEQ ID NO: 210167 - DNA, 25 bp, Mus musculus
atgaaatgaaaaaggcccaagagga

SEQ ID NO: 210168 - DNA, 25 bp, Mus musculus
atgaaatgaaaaaggttaaggagct

SEQ ID NO: 210169 - DNA, 25 bp, Mus musculus
atgaaatgagtttctctaatagcat

SEQ ID NO: 210170 - DNA, 25 bp, Mus musculus
atgaaatgatccaggtactgcaggg

SEQ ID NO: 210171 - DNA, 25 bp, Mus musculus
atgaaatgattgactctggtgtgag

SEQ ID NO: 210172 - DNA, 25 bp, Mus musculus
atgaaatggcaaagtacccaggcaa

SEQ ID NO: 210173 - DNA, 25 bp, Mus musculus
atgaaattcaaggatccagtgaaag

SEQ ID NO: 210174 - DNA, 25 bp, Mus musculus
atgaaattggacaggattggcccct

SEQ ID NO: 210175 - DNA, 25 bp, Mus musculus
atgaaattggacaggtccttcattt

SEQ ID NO: 210176 - DNA, 25 bp, Mus musculus
atgaaatttcaggtcacgttcatga

SEQ ID NO: 210177 - DNA, 25 bp, Mus musculus
atgaacaaatcccaggagcaagtgt

SEQ ID NO: 210178 - DNA, 25 bp, Mus musculus
atgaacaaatcccagttgtaggcca

SEQ ID NO: 210179 - DNA, 25 bp, Mus musculus
atgaacaacgcaggactaaattcgg

SEQ ID NO: 210180 - DNA, 25 bp, Mus musculus
atgaacaagaagtcctaccctaggc

SEQ ID NO: 210181 - DNA, 25 bp, Mus musculus
atgaacaagaggcagatgggcatat

SEQ ID NO: 210182 - DNA, 25 bp, Mus musculus
atgaacaatttccaggtcatgagca

SEQ ID NO: 210183 - DNA, 25 bp, Mus musculus
atgaacacaataaggctcatgcaca

SEQ ID NO: 210184 - DNA, 25 bp, Mus musculus
atgaacacagctatcgcggtaaaga

SEQ ID NO: 210185 - DNA, 25 bp, Mus musculus
atgaacacagctttttgccttcgag

SEQ ID NO: 210186 - DNA, 25 bp, Mus musculus
atgaacaccagaagcctaagagttc

SEQ ID NO: 210187 - DNA, 25 bp, Mus musculus
atgaacaccaggtttggacgtcatg

SEQ ID NO: 210188 - DNA, 25 bp, Mus musculus
atgaacacgctcagaaatgacctgc

SEQ ID NO: 210189 - DNA, 25 bp, Mus musculus
atgaacactgtccaacactggccag

SEQ ID NO: 210190 - DNA, 25 bp, Mus musculus
atgaacagaatgagatcatcgatga

SEQ ID NO: 210191 - DNA, 25 bp, Mus musculus
atgaacagacagctgaaattacccc

SEQ ID NO: 210192 - DNA, 25 bp, Mus musculus
atgaacagatttgccagggagatgt

SEQ ID NO: 210193 - DNA, 25 bp, Mus musculus
atgaacagcaaaggtcaatatccaa

SEQ ID NO: 210194 - DNA, 25 bp, Mus musculus
atgaacagctggccgactgcttttc

SEQ ID NO: 210195 - DNA, 25 bp, Mus musculus
atgaacagttagaggaaagaacagg

SEQ ID NO: 210196 - DNA, 25 bp, Mus musculus
atgaacagttagaggttcgagaaat

SEQ ID NO: 210197 - DNA, 25 bp, Mus musculus
atgaacatccagagccgtctgggta

SEQ ID NO: 210198 - DNA, 25 bp, Mus musculus
atgaacatccagtaataatatcttt

SEQ ID NO: 210199 - DNA, 25 bp, Mus musculus
atgaacatgtgaagatttctgctcc

SEQ ID NO: 210200 - DNA, 25 bp, Mus musculus
atgaacatttaagagtgaatgccat

SEQ ID NO: 210201 - DNA, 25 bp, Mus musculus
atgaacatttaaggcaattctgcct

SEQ ID NO: 210202 - DNA, 25 bp, Mus musculus
atgaaccaaagaagatgccgctcca

SEQ ID NO: 210203 - DNA, 25 bp, Mus musculus
atgaaccaaagaagtacggcgagct

SEQ ID NO: 210204 - DNA, 25 bp, Mus musculus
atgaaccaagatgaatgagcgccaa

SEQ ID NO: 210205 - DNA, 25 bp, Mus musculus
atgaaccaagatgctgtgcagaatg

SEQ ID NO: 210206 - DNA, 25 bp, Mus musculus
atgaaccagcggagttcaatgcgag

SEQ ID NO: 210207 - DNA, 25 bp, Mus musculus
atgaaccagcggagtttcagtctgg

SEQ ID NO: 210208 - DNA, 25 bp, Mus musculus
atgaaccatcccccatgcggctggg

SEQ ID NO: 210209 - DNA, 25 bp, Mus musculus
atgaaccgaggcatcaaggcctgca

SEQ ID NO: 210210 - DNA, 25 bp, Mus musculus
atgaaccgcacttgctagtgtgccc

SEQ ID NO: 210211 - DNA, 25 bp, Mus musculus
atgaaccggcagtttcgaaactgca

SEQ ID NO: 210212 - DNA, 25 bp, Mus musculus
atgaaccgtgaggggaactggtatc

SEQ ID NO: 210213 - DNA, 25 bp, Mus musculus
atgaacctcagcattgtgatgacca

SEQ ID NO: 210214 - DNA, 25 bp, Mus musculus
atgaacctggaaaacactggccaaa

SEQ ID NO: 210215 - DNA, 25 bp, Mus musculus
atgaacctggaaggccaaatccttg

SEQ ID NO: 210216 - DNA, 25 bp, Mus musculus
atgaacgcaaagaggtaaatgatct

SEQ ID NO: 210217 - DNA, 25 bp, Mus musculus
atgaacgcaaagagtaacttgtttg

SEQ ID NO: 210218 - DNA, 25 bp, Mus musculus
atgaacgcaaggactttgaatccaa

SEQ ID NO: 210219 - DNA, 25 bp, Mus musculus
atgaacgcaatgtggaccatcttcc

SEQ ID NO: 210220 - DNA, 25 bp, Mus musculus
atgaacgcccgggcctggaagcgct

SEQ ID NO: 210221 - DNA, 25 bp, Mus musculus
atgaacggacaagaagtattttatc

SEQ ID NO: 210222 - DNA, 25 bp, Mus musculus
atgaacggacaagttgtgtgcgctg

SEQ ID NO: 210223 - DNA, 25 bp, Mus musculus
atgaacggcatcaggcgcagataga

SEQ ID NO: 210224 - DNA, 25 bp, Mus musculus
atgaacgggtgtgactctcttttgg

SEQ ID NO: 210225 - DNA, 25 bp, Mus musculus
atgaactaaagcttgacaaaaaagg

SEQ ID NO: 210226 - DNA, 25 bp, Mus musculus
atgaactaccagtccggcttcagcc

SEQ ID NO: 210227 - DNA, 25 bp, Mus musculus
atgaactacttaaactccgactgat

SEQ ID NO: 210228 - DNA, 25 bp, Mus musculus
atgaactacttaaagctctggatta

SEQ ID NO: 210229 - DNA, 25 bp, Mus musculus
atgaactagcctggcatcccagcct

SEQ ID NO: 210230 - DNA, 25 bp, Mus musculus
atgaactcactgtgaatgggaacac

SEQ ID NO: 210231 - DNA, 25 bp, Mus musculus
atgaactcagctctgatgtctccac

SEQ ID NO: 210232 - DNA, 25 bp, Mus musculus
atgaactcagtgagagttgtagtgc

SEQ ID NO: 210233 - DNA, 25 bp, Mus musculus
atgaactcctgaaagaaattcaagc

SEQ ID NO: 210234 - DNA, 25 bp, Mus musculus
atgaactctggtggttcaccaccca

SEQ ID NO: 210235 - DNA, 25 bp, Mus musculus
atgaactcttcaagagagatcctgg

SEQ ID NO: 210236 - DNA, 25 bp, Mus musculus
atgaactcttcaagatcctaaattt

SEQ ID NO: 210237 - DNA, 25 bp, Mus musculus
atgaactgaggagacttcttcgagg

SEQ ID NO: 210238 - DNA, 25 bp, Mus musculus
atgaactgaggagggtggccaaaca

SEQ ID NO: 210239 - DNA, 25 bp, Mus musculus
atgaactgcctgacttgtgacacct

SEQ ID NO: 210240 - DNA, 25 bp, Mus musculus
atgaactgcgcaggttacatccagg

SEQ ID NO: 210241 - DNA, 25 bp, Mus musculus
atgaactgttggcccttgattgtga

SEQ ID NO: 210242 - DNA, 25 bp, Mus musculus
atgaacttgggaatgtacctgaact

SEQ ID NO: 210243 - DNA, 25 bp, Mus musculus
atgaacttgggttttatgattccct

SEQ ID NO: 210244 - DNA, 25 bp, Mus musculus
atgaacttggtccaggcaaacaggg

SEQ ID NO: 210245 - DNA, 25 bp, Mus musculus
atgaactttgaatgctcacactgcc

SEQ ID NO: 210246 - DNA, 25 bp, Mus musculus
atgaagaaaactgtggcaacataac

SEQ ID NO: 210247 - DNA, 25 bp, Mus musculus
atgaagaaaagcccctttcctcgat

SEQ ID NO: 210248 - DNA, 25 bp, Mus musculus
atgaagaaaagcgcagaagagcagt

SEQ ID NO: 210249 - DNA, 25 bp, Mus musculus
atgaagaaagaacatgcataccagg

SEQ ID NO: 210250 - DNA, 25 bp, Mus musculus
atgaagaaatattatcacaaagatt

SEQ ID NO: 210251 - DNA, 25 bp, Mus musculus
atgaagaaatcgagcgccaggctcc

SEQ ID NO: 210252 - DNA, 25 bp, Mus musculus
atgaagaagcacttttagatggcta

SEQ ID NO: 210253 - DNA, 25 bp, Mus musculus
atgaagaagtcaagccaggtgccca

SEQ ID NO: 210254 - DNA, 25 bp, Mus musculus
atgaagaagtcaagggaaaagtatg

SEQ ID NO: 210255 - DNA, 25 bp, Mus musculus
atgaagaatctagagctgatcataa

SEQ ID NO: 210256 - DNA, 25 bp, Mus musculus
atgaagaatttgtggaagaggagac

SEQ ID NO: 210257 - DNA, 25 bp, Mus musculus
atgaagacaaggtgctggtctccta

SEQ ID NO: 210258 - DNA, 25 bp, Mus musculus
atgaagacacgggtgatgtcccgca

SEQ ID NO: 210259 - DNA, 25 bp, Mus musculus
atgaagacaggagtcttttattcaa

SEQ ID NO: 210260 - DNA, 25 bp, Mus musculus
atgaagacagggaacagacatcctt

SEQ ID NO: 210261 - DNA, 25 bp, Mus musculus
atgaagacagttcagagtgcagtga

SEQ ID NO: 210262 - DNA, 25 bp, Mus musculus
atgaagaccaaaacgccagccacct

SEQ ID NO: 210263 - DNA, 25 bp, Mus musculus
atgaagaccaaaacgggggagcagt

SEQ ID NO: 210264 - DNA, 25 bp, Mus musculus
atgaagaccaacagaacttgacgag

SEQ ID NO: 210265 - DNA, 25 bp, Mus musculus
atgaagaccccgggtcttgttgcag

SEQ ID NO: 210266 - DNA, 25 bp, Mus musculus
atgaagaccgggcatctggagattt

SEQ ID NO: 210267 - DNA, 25 bp, Mus musculus
atgaagacggtgcttggcctgttct

SEQ ID NO: 210268 - DNA, 25 bp, Mus musculus
atgaagacgtgggcgatggttgtgg

SEQ ID NO: 210269 - DNA, 25 bp, Mus musculus
atgaagacgtgggcggctgttttga

SEQ ID NO: 210270 - DNA, 25 bp, Mus musculus
atgaagactcctctgattcagatgc

SEQ ID NO: 210271 - DNA, 25 bp, Mus musculus
atgaagagaaaatgaaagcagaccg

SEQ ID NO: 210272 - DNA, 25 bp, Mus musculus
atgaagagaaagtacacactgcgct

SEQ ID NO: 210273 - DNA, 25 bp, Mus musculus
atgaagagaaatggttcccataaca

SEQ ID NO: 210274 - DNA, 25 bp, Mus musculus
atgaagagaagagccttgttgatac

SEQ ID NO: 210275 - DNA, 25 bp, Mus musculus
atgaagagaatatgaccacctatct

SEQ ID NO: 210276 - DNA, 25 bp, Mus musculus
atgaagagaatatgagatcctgcaa

SEQ ID NO: 210277 - DNA, 25 bp, Mus musculus
atgaagagaatatgagttccagcag

SEQ ID NO: 210278 - DNA, 25 bp, Mus musculus
atgaagagaggcatgttggagacct

SEQ ID NO: 210279 - DNA, 25 bp, Mus musculus
atgaagagattcaaagcagaatacc

SEQ ID NO: 210280 - DNA, 25 bp, Mus musculus
atgaagaggagagtgatgctgttgt

SEQ ID NO: 210281 - DNA, 25 bp, Mus musculus
atgaagaggaggcgggccccgggga

SEQ ID NO: 210282 - DNA, 25 bp, Mus musculus
atgaagagggcaaatatggttatgt

SEQ ID NO: 210283 - DNA, 25 bp, Mus musculus
atgaagataacctaagtaccagcag

SEQ ID NO: 210284 - DNA, 25 bp, Mus musculus
atgaagatcaagatcattgctcctc

SEQ ID NO: 210285 - DNA, 25 bp, Mus musculus
atgaagatcaagcagatgtggatca

SEQ ID NO: 210286 - DNA, 25 bp, Mus musculus
atgaagatcccacataccattttgg

SEQ ID NO: 210287 - DNA, 25 bp, Mus musculus
atgaagatcgatgagctttcactct

SEQ ID NO: 210288 - DNA, 25 bp, Mus musculus
atgaagatcgctgagatccgaaagg

SEQ ID NO: 210289 - DNA, 25 bp, Mus musculus
atgaagatgaacagagcctcccaaa

SEQ ID NO: 210290 - DNA, 25 bp, Mus musculus
atgaagatgataacacctgctctca

SEQ ID NO: 210291 - DNA, 25 bp, Mus musculus
atgaagatgataactcctgctctca

SEQ ID NO: 210292 - DNA, 25 bp, Mus musculus
atgaagatgctgcaggcaccagaaa

SEQ ID NO: 210293 - DNA, 25 bp, Mus musculus
atgaagatgctgcaggtctgggaag

SEQ ID NO: 210294 - DNA, 25 bp, Mus musculus
atgaagatggcgaaattgggaaaga

SEQ ID NO: 210295 - DNA, 25 bp, Mus musculus
atgaagatggcgaatcaccgcctcc

SEQ ID NO: 210296 - DNA, 25 bp, Mus musculus
atgaagatgggattgatgatgattc

SEQ ID NO: 210297 - DNA, 25 bp, Mus musculus
atgaagatgtgaagatgatcagtgc

SEQ ID NO: 210298 - DNA, 25 bp, Mus musculus
atgaagattgagagccagcgggcca

SEQ ID NO: 210299 - DNA, 25 bp, Mus musculus
atgaagattgaggagaagaaggtgg

SEQ ID NO: 210300 - DNA, 25 bp, Mus musculus
atgaagatttagagagttccagtga

SEQ ID NO: 210301 - DNA, 25 bp, Mus musculus
atgaagcacacaggggtagtgttgc

SEQ ID NO: 210302 - DNA, 25 bp, Mus musculus
atgaagcagaagaggagagtgataa

SEQ ID NO: 210303 - DNA, 25 bp, Mus musculus
atgaagcagaagaggatcctgggca

SEQ ID NO: 210304 - DNA, 25 bp, Mus musculus
atgaagcaggtgaagatgacgatgg

SEQ ID NO: 210305 - DNA, 25 bp, Mus musculus
atgaagcatgcggatccccggatcc

SEQ ID NO: 210306 - DNA, 25 bp, Mus musculus
atgaagcatgcggtttctgatgtct

SEQ ID NO: 210307 - DNA, 25 bp, Mus musculus
atgaagccaagattgtaagggccaa

SEQ ID NO: 210308 - DNA, 25 bp, Mus musculus
atgaagccaagccctcccaggacgc

SEQ ID NO: 210309 - DNA, 25 bp, Mus musculus
atgaagccaagggcccagtgtgcat

SEQ ID NO: 210310 - DNA, 25 bp, Mus musculus
atgaagccagaagatgtagctaaaa

SEQ ID NO: 210311 - DNA, 25 bp, Mus musculus
atgaagccagacaagttggcattaa

SEQ ID NO: 210312 - DNA, 25 bp, Mus musculus
atgaagccagagatttaaggcaaga

SEQ ID NO: 210313 - DNA, 25 bp, Mus musculus
atgaagccagatgctgatgctgttt

SEQ ID NO: 210314 - DNA, 25 bp, Mus musculus
atgaagccagcactagcaacaagcg

SEQ ID NO: 210315 - DNA, 25 bp, Mus musculus
atgaagccaggtaattcagagatct

SEQ ID NO: 210316 - DNA, 25 bp, Mus musculus
atgaagccaggtccctcaaagttgt

SEQ ID NO: 210317 - DNA, 25 bp, Mus musculus
atgaagccatgtgcacagccctgag

SEQ ID NO: 210318 - DNA, 25 bp, Mus musculus
atgaagcccttcaagagcttctgca

SEQ ID NO: 210319 - DNA, 25 bp, Mus musculus
atgaagcccttcaaggatatggact

SEQ ID NO: 210320 - DNA, 25 bp, Mus musculus
atgaagccttagaggacgtagagat

SEQ ID NO: 210321 - DNA, 25 bp, Mus musculus
atgaagccttctcaggccagatttt

SEQ ID NO: 210322 - DNA, 25 bp, Mus musculus
atgaagcctttcaggatgaagacct

SEQ ID NO: 210323 - DNA, 25 bp, Mus musculus
atgaagcctttcaggtgcctctccc

SEQ ID NO: 210324 - DNA, 25 bp, Mus musculus
atgaagcgaaggacggatcttgtaa

SEQ ID NO: 210325 - DNA, 25 bp, Mus musculus
atgaagcggctacaggcggcaggaa

SEQ ID NO: 210326 - DNA, 25 bp, Mus musculus
atgaagctacgccaatcaaaacccc

SEQ ID NO: 210327 - DNA, 25 bp, Mus musculus
atgaagctacgtcgacgcataatta

SEQ ID NO: 210328 - DNA, 25 bp, Mus musculus
atgaagctcctgaagacccaggggg

SEQ ID NO: 210329 - DNA, 25 bp, Mus musculus
atgaagctcctgaaggaagaagaac

SEQ ID NO: 210330 - DNA, 25 bp, Mus musculus
atgaagctctgatgcgctctgagga

SEQ ID NO: 210331 - DNA, 25 bp, Mus musculus
atgaagctgaaggcatcatagacac

SEQ ID NO: 210332 - DNA, 25 bp, Mus musculus
atgaagctgagagcactctgtggag

SEQ ID NO: 210333 - DNA, 25 bp, Mus musculus
atgaagctgtagtgcagttgaacac

SEQ ID NO: 210334 - DNA, 25 bp, Mus musculus
atgaagctgtagtgccaactactca

SEQ ID NO: 210335 - DNA, 25 bp, Mus musculus
atgaaggaaagactcaggcagctgg

SEQ ID NO: 210336 - DNA, 25 bp, Mus musculus
atgaaggaaagttacccagcatgcc

SEQ ID NO: 210337 - DNA, 25 bp, Mus musculus
atgaaggaatggtcacgatctagat

SEQ ID NO: 210338 - DNA, 25 bp, Mus musculus
atgaaggacatagtttcaggcacca

SEQ ID NO: 210339 - DNA, 25 bp, Mus musculus
atgaaggactttacctcgctgagca

SEQ ID NO: 210340 - DNA, 25 bp, Mus musculus
atgaaggagataacaggacggactg

SEQ ID NO: 210341 - DNA, 25 bp, Mus musculus
atgaaggatcaggatgacgatgctg

SEQ ID NO: 210342 - DNA, 25 bp, Mus musculus
atgaaggatcaggcccttaaggatg

SEQ ID NO: 210343 - DNA, 25 bp, Mus musculus
atgaaggatgaagagctaaggcgca

SEQ ID NO: 210344 - DNA, 25 bp, Mus musculus
atgaaggatgaagagggccccgtgg

SEQ ID NO: 210345 - DNA, 25 bp, Mus musculus
atgaaggatgacttggagattttgc

SEQ ID NO: 210346 - DNA, 25 bp, Mus musculus
atgaaggcaccaatttcgttgtgga

SEQ ID NO: 210347 - DNA, 25 bp, Mus musculus
atgaaggcagagttctttgcagatg

SEQ ID NO: 210348 - DNA, 25 bp, Mus musculus
atgaaggcgctcgagtatgcctgtg

SEQ ID NO: 210349 - DNA, 25 bp, Mus musculus
atgaaggcgtgaatatgacatctgc

SEQ ID NO: 210350 - DNA, 25 bp, Mus musculus
atgaaggcgtggcaacatacgcagc

SEQ ID NO: 210351 - DNA, 25 bp, Mus musculus
atgaaggcgtgggtatgcaatataa

SEQ ID NO: 210352 - DNA, 25 bp, Mus musculus
atgaaggctgaacttccactttgcc

SEQ ID NO: 210353 - DNA, 25 bp, Mus musculus
atgaagggcagagggaaggctcctg

SEQ ID NO: 210354 - DNA, 25 bp, Mus musculus
atgaagggcaggctccggcttcgtc

SEQ ID NO: 210355 - DNA, 25 bp, Mus musculus
atgaaggtcaacaccatcaccaccc

SEQ ID NO: 210356 - DNA, 25 bp, Mus musculus
atgaaggtcgatgtgggcccagacc

SEQ ID NO: 210357 - DNA, 25 bp, Mus musculus
atgaaggtgaggctggtggagttca

SEQ ID NO: 210358 - DNA, 25 bp, Mus musculus
atgaaggtgccggttttggcacgtg

SEQ ID NO: 210359 - DNA, 25 bp, Mus musculus
atgaaggtgctgagttcatgcaaag

SEQ ID NO: 210360 - DNA, 25 bp, Mus musculus
atgaaggtggcagaggtgctggctg

SEQ ID NO: 210361 - DNA, 25 bp, Mus musculus
atgaaggttcatctctcccttctca

SEQ ID NO: 210362 - DNA, 25 bp, Mus musculus
atgaagtaaaacaagatactcattt

SEQ ID NO: 210363 - DNA, 25 bp, Mus musculus
atgaagtacaagaatcttatggcaa

SEQ ID NO: 210364 - DNA, 25 bp, Mus musculus
atgaagtacaggctggacattgtgc

SEQ ID NO: 210365 - DNA, 25 bp, Mus musculus
atgaagtacctgaacgtgctggcca

SEQ ID NO: 210366 - DNA, 25 bp, Mus musculus
atgaagtagacagcctgatgtgtga

SEQ ID NO: 210367 - DNA, 25 bp, Mus musculus
atgaagtagacaggcattggactac

SEQ ID NO: 210368 - DNA, 25 bp, Mus musculus
atgaagtagagaggcattttcttga

SEQ ID NO: 210369 - DNA, 25 bp, Mus musculus
atgaagtagagccagcaagtccaca

SEQ ID NO: 210370 - DNA, 25 bp, Mus musculus
atgaagtagagccaggcttgccatc

SEQ ID NO: 210371 - DNA, 25 bp, Mus musculus
atgaagtattagaaaaagatgttgg

SEQ ID NO: 210372 - DNA, 25 bp, Mus musculus
atgaagtattagaataaatgaagga

SEQ ID NO: 210373 - DNA, 25 bp, Mus musculus
atgaagtcactcggtgtgggctttg

SEQ ID NO: 210374 - DNA, 25 bp, Mus musculus
atgaagtcagagggtgctggtgaca

SEQ ID NO: 210375 - DNA, 25 bp, Mus musculus
atgaagtcccagtggccagtgaaga

SEQ ID NO: 210376 - DNA, 25 bp, Mus musculus
atgaagtcctggcctgcagctgagc

SEQ ID NO: 210377 - DNA, 25 bp, Mus musculus
atgaagttagcaggagatgcgggct

SEQ ID NO: 210378 - DNA, 25 bp, Mus musculus
atgaagttccttcgggcctctgaag

SEQ ID NO: 210379 - DNA, 25 bp, Mus musculus
atgaagttccttcggtgtgtcctgg

SEQ ID NO: 210380 - DNA, 25 bp, Mus musculus
atgaagttgcaagaagacaccctga

SEQ ID NO: 210381 - DNA, 25 bp, Mus musculus
atgaagttgccagaaggagaagcag

SEQ ID NO: 210382 - DNA, 25 bp, Mus musculus
atgaagtttgatgcccaggcaactt

SEQ ID NO: 210383 - DNA, 25 bp, Mus musculus
atgaataagcagttccgggcttgca

SEQ ID NO: 210384 - DNA, 25 bp, Mus musculus
atgaatacactgagctcatgaccag

SEQ ID NO: 210385 - DNA, 25 bp, Mus musculus
atgaatacaggagtggaggctggag

SEQ ID NO: 210386 - DNA, 25 bp, Mus musculus
atgaatacccctctataaaactggt

SEQ ID NO: 210387 - DNA, 25 bp, Mus musculus
atgaatacccctctctggtggtgga

SEQ ID NO: 210388 - DNA, 25 bp, Mus musculus
atgaatacgtcagacatctggcagg

SEQ ID NO: 210389 - DNA, 25 bp, Mus musculus
atgaatactcagcaatgtgggctgg

SEQ ID NO: 210390 - DNA, 25 bp, Mus musculus
atgaatactcaggatactgggaacc

SEQ ID NO: 210391 - DNA, 25 bp, Mus musculus
atgaatatacagcgtttgacttttg

SEQ ID NO: 210392 - DNA, 25 bp, Mus musculus
atgaatatcaagaaacccccataga

SEQ ID NO: 210393 - DNA, 25 bp, Mus musculus
atgaatatccagagactaagtctgg

SEQ ID NO: 210394 - DNA, 25 bp, Mus musculus
atgaatcacaggacctggagttgct

SEQ ID NO: 210395 - DNA, 25 bp, Mus musculus
atgaatcagcacatcctcatattca

SEQ ID NO: 210396 - DNA, 25 bp, Mus musculus
atgaatcagcacttcctcatattca

SEQ ID NO: 210397 - DNA, 25 bp, Mus musculus
atgaatcaggatgatctcaaagcca

SEQ ID NO: 210398 - DNA, 25 bp, Mus musculus
atgaatcaggatgtgtctctctcca

SEQ ID NO: 210399 - DNA, 25 bp, Mus musculus
atgaatccagaggttggaatgaaat

SEQ ID NO: 210400 - DNA, 25 bp, Mus musculus
atgaatccgttcaggctgacggctg

SEQ ID NO: 210401 - DNA, 25 bp, Mus musculus
atgaatcctaaagagactaagcccc

SEQ ID NO: 210402 - DNA, 25 bp, Mus musculus
atgaatcctatcagggtgaaggagg

SEQ ID NO: 210403 - DNA, 25 bp, Mus musculus
atgaatccttgcagtcagaaaatgg

SEQ ID NO: 210404 - DNA, 25 bp, Mus musculus
atgaatctgatcctggcctgtgttg

SEQ ID NO: 210405 - DNA, 25 bp, Mus musculus
atgaatcttcaggggctggctgtgg

SEQ ID NO: 210406 - DNA, 25 bp, Mus musculus
atgaatctttctgggtcagaaacgt

SEQ ID NO: 210407 - DNA, 25 bp, Mus musculus
atgaatgaacttgggggactgcagg

SEQ ID NO: 210408 - DNA, 25 bp, Mus musculus
atgaatgacgaataggtgaagggaa

SEQ ID NO: 210409 - DNA, 25 bp, Mus musculus
atgaatgagtttgaggcgggatcca

SEQ ID NO: 210410 - DNA, 25 bp, Mus musculus
atgaatgcaggactgtctccttagt

SEQ ID NO: 210411 - DNA, 25 bp, Mus musculus
atgaatgcagtagaagccatgctgg

SEQ ID NO: 210412 - DNA, 25 bp, Mus musculus
atgaatggattggtatgtgtgcaac

SEQ ID NO: 210413 - DNA, 25 bp, Mus musculus
atgaatggcaagtgactgtctgctc

SEQ ID NO: 210414 - DNA, 25 bp, Mus musculus
atgaatggcagtcactacagctact

SEQ ID NO: 210415 - DNA, 25 bp, Mus musculus
atgaatggcctgagaattcttttcg

SEQ ID NO: 210416 - DNA, 25 bp, Mus musculus
atgaatgtactgaaggatttctggt

SEQ ID NO: 210417 - DNA, 25 bp, Mus musculus
atgaatgtcaagggaagttgagaag

SEQ ID NO: 210418 - DNA, 25 bp, Mus musculus
atgaatgttccaagtaccccagcaa

SEQ ID NO: 210419 - DNA, 25 bp, Mus musculus
atgaatgttccccattgtaacataa

SEQ ID NO: 210420 - DNA, 25 bp, Mus musculus
atgaatgttccccgtaacaaatcac

SEQ ID NO: 210421 - DNA, 25 bp, Mus musculus
atgaatgttccccgtcagaaacgta

SEQ ID NO: 210422 - DNA, 25 bp, Mus musculus
atgaattacaggaaatgcttgatga

SEQ ID NO: 210423 - DNA, 25 bp, Mus musculus
atgaattatgagcacgatcagtatg

SEQ ID NO: 210424 - DNA, 25 bp, Mus musculus
atgaattatgagcaggatcagtatg

SEQ ID NO: 210425 - DNA, 25 bp, Mus musculus
atgaattattttcagagaagcagaa

SEQ ID NO: 210426 - DNA, 25 bp, Mus musculus
atgaattcaaaagatagtgttttgg

SEQ ID NO: 210427 - DNA, 25 bp, Mus musculus
atgaattcaaaagctgccgttcggc

SEQ ID NO: 210428 - DNA, 25 bp, Mus musculus
atgaattcaaggtggacattcgctt

SEQ ID NO: 210429 - DNA, 25 bp, Mus musculus
atgaatttaaggagattaatagaga

SEQ ID NO: 210430 - DNA, 25 bp, Mus musculus
atgaatttaaggagttcatcagcct

SEQ ID NO: 210431 - DNA, 25 bp, Mus musculus
atgaatttcaaggggctgaggcgat

SEQ ID NO: 210432 - DNA, 25 bp, Mus musculus
atgaatttcacaatactacctgtct

SEQ ID NO: 210433 - DNA, 25 bp, Mus musculus
atgaatttcagactctgaattcggt

SEQ ID NO: 210434 - DNA, 25 bp, Mus musculus
atgaatttcagagggccttcagcgg

SEQ ID NO: 210435 - DNA, 25 bp, Mus musculus
atgaatttcaggaatataccatgct

SEQ ID NO: 210436 - DNA, 25 bp, Mus musculus
atgaatttgaacagggcctgtctga

SEQ ID NO: 210437 - DNA, 25 bp, Mus musculus
atgaatttgaacaggtcatgcagtt

SEQ ID NO: 210438 - DNA, 25 bp, Mus musculus
atgaatttgacttcttagcacttaa

SEQ ID NO: 210439 - DNA, 25 bp, Mus musculus
atgaattttccaagctgatcatatg

SEQ ID NO: 210440 - DNA, 25 bp, Mus musculus
atgaattttccaggtctctttaagg

SEQ ID NO: 210441 - DNA, 25 bp, Mus musculus
atgaattttccagttcaaaaggaca

SEQ ID NO: 210442 - DNA, 25 bp, Mus musculus
atgacaaaaaagagctctcttacag

SEQ ID NO: 210443 - DNA, 25 bp, Mus musculus
atgacaaaaaggtttgcacctgaca

SEQ ID NO: 210444 - DNA, 25 bp, Mus musculus
atgacaaacaagctgctaactcagg

SEQ ID NO: 210445 - DNA, 25 bp, Mus musculus
atgacaaacaagctttgaaaagtac

SEQ ID NO: 210446 - DNA, 25 bp, Mus musculus
atgacaaacatttttcagtatggtc

SEQ ID NO: 210447 - DNA, 25 bp, Mus musculus
atgacaacagtttgggggacatcct

SEQ ID NO: 210448 - DNA, 25 bp, Mus musculus
atgacaaccagggtggtgcccccaa

SEQ ID NO: 210449 - DNA, 25 bp, Mus musculus
atgacaacccgatagaggagcatag

SEQ ID NO: 210450 - DNA, 25 bp, Mus musculus
atgacaacctagaggccttgtctca

SEQ ID NO: 210451 - DNA, 25 bp, Mus musculus
atgacaacctgttggagagaagaca

SEQ ID NO: 210452 - DNA, 25 bp, Mus musculus
atgacaacgtcaaccctccacgcca

SEQ ID NO: 210453 - DNA, 25 bp, Mus musculus
atgacaacgtcaggtatggcatttc

SEQ ID NO: 210454 - DNA, 25 bp, Mus musculus
atgacaactgttggctggctctcac

SEQ ID NO: 210455 - DNA, 25 bp, Mus musculus
atgacaagacagttcccttcagcat

SEQ ID NO: 210456 - DNA, 25 bp, Mus musculus
atgacaagagaaagcgccaagggaa

SEQ ID NO: 210457 - DNA, 25 bp, Mus musculus
atgacaagcaggtttgctgaggagc

SEQ ID NO: 210458 - DNA, 25 bp, Mus musculus
atgacaagtacaggagctttgtcat

SEQ ID NO: 210459 - DNA, 25 bp, Mus musculus
atgacaagtacaggaggccgagtgg

SEQ ID NO: 210460 - DNA, 25 bp, Mus musculus
atgacaatgaagaaaggaagtggaa

SEQ ID NO: 210461 - DNA, 25 bp, Mus musculus
atgacaatgggggtgaagcttctag

SEQ ID NO: 210462 - DNA, 25 bp, Mus musculus
atgacaattaccagtgatatgctgt

SEQ ID NO: 210463 - DNA, 25 bp, Mus musculus
atgacacagaggggctggctgtggg

SEQ ID NO: 210464 - DNA, 25 bp, Mus musculus
atgacacagaggtggaggagagcat

SEQ ID NO: 210465 - DNA, 25 bp, Mus musculus
atgacacagaggtggcggagaacaa

SEQ ID NO: 210466 - DNA, 25 bp, Mus musculus
atgacacatgatgctatcatgaaca

SEQ ID NO: 210467 - DNA, 25 bp, Mus musculus
atgacacatgatggctatttgaaac

SEQ ID NO: 210468 - DNA, 25 bp, Mus musculus
atgacacatgctcaggacccataga

SEQ ID NO: 210469 - DNA, 25 bp, Mus musculus
atgacaccaggacttcctccatcag

SEQ ID NO: 210470 - DNA, 25 bp, Mus musculus
atgacaccatcaagcacccaggagg

SEQ ID NO: 210471 - DNA, 25 bp, Mus musculus
atgacaccatgcctgctgacaagga

SEQ ID NO: 210472 - DNA, 25 bp, Mus musculus
atgacacccagggtcctcactgcag

SEQ ID NO: 210473 - DNA, 25 bp, Mus musculus
atgacacggagagaagattaaggac

SEQ ID NO: 210474 - DNA, 25 bp, Mus musculus
atgacactaaacatggagtggatgc

SEQ ID NO: 210475 - DNA, 25 bp, Mus musculus
atgacactcagatcaaattgcttat

SEQ ID NO: 210476 - DNA, 25 bp, Mus musculus
atgacactgaggtcgcatcaaatat

SEQ ID NO: 210477 - DNA, 25 bp, Mus musculus
atgacactgcttttctccttccgca

SEQ ID NO: 210478 - DNA, 25 bp, Mus musculus
atgacagaacagtttttggcctttg

SEQ ID NO: 210479 - DNA, 25 bp, Mus musculus
atgacagaagctgattggccattcc

SEQ ID NO: 210480 - DNA, 25 bp, Mus musculus
atgacagacagtttcgcatttggct

SEQ ID NO: 210481 - DNA, 25 bp, Mus musculus
atgacagcaacagttagagatggtg

SEQ ID NO: 210482 - DNA, 25 bp, Mus musculus
atgacagcaacttcaaagctgtgtc

SEQ ID NO: 210483 - DNA, 25 bp, Mus musculus
atgacagcataggtccctcactctc

SEQ ID NO: 210484 - DNA, 25 bp, Mus musculus
atgacagccttaccctgattaacct

SEQ ID NO: 210485 - DNA, 25 bp, Mus musculus
atgacagctatgtccccagtgacct

SEQ ID NO: 210486 - DNA, 25 bp, Mus musculus
atgacaggactaagagggtgtttct

SEQ ID NO: 210487 - DNA, 25 bp, Mus musculus
atgacaggactaaggggaagactgt

SEQ ID NO: 210488 - DNA, 25 bp, Mus musculus
atgacaggtctaaaaggcttggtgg

SEQ ID NO: 210489 - DNA, 25 bp, Mus musculus
atgacaggtctatgctgaggggtgg

SEQ ID NO: 210490 - DNA, 25 bp, Mus musculus
atgacagtatggaagggcctagtca

SEQ ID NO: 210491 - DNA, 25 bp, Mus musculus
atgacagtcaatcagaatcagatag

SEQ ID NO: 210492 - DNA, 25 bp, Mus musculus
atgacagtcaatcaggtacatccaa

SEQ ID NO: 210493 - DNA, 25 bp, Mus musculus
atgacagtgaagatccagccataaa

SEQ ID NO: 210494 - DNA, 25 bp, Mus musculus
atgacagtgaaggtatgctgcaaga

SEQ ID NO: 210495 - DNA, 25 bp, Mus musculus
atgacagtgaagtgtaacaactaaa

SEQ ID NO: 210496 - DNA, 25 bp, Mus musculus
atgacagtgagaacacaaacctcca

SEQ ID NO: 210497 - DNA, 25 bp, Mus musculus
atgacagtgtctcggttattcccaa

SEQ ID NO: 210498 - DNA, 25 bp, Mus musculus
atgacagtgtggctcagactcctga

SEQ ID NO: 210499 - DNA, 25 bp, Mus musculus
atgacatcaacaaggtgtttgagtt

SEQ ID NO: 210500 - DNA, 25 bp, Mus musculus
atgacatcaagaagggagaagaaat

SEQ ID NO: 210501 - DNA, 25 bp, Mus musculus
atgacatcaccacccgagaaacctg

SEQ ID NO: 210502 - DNA, 25 bp, Mus musculus
atgacatcaccagccgagaaacctg

SEQ ID NO: 210503 - DNA, 25 bp, Mus musculus
atgacatcagaaaattagaccgatt

SEQ ID NO: 210504 - DNA, 25 bp, Mus musculus
atgacatcagaggagagcccagagg

SEQ ID NO: 210505 - DNA, 25 bp, Mus musculus
atgacatcagcagcggacagttctg

SEQ ID NO: 210506 - DNA, 25 bp, Mus musculus
atgacatcagccctggttcaggcag

SEQ ID NO: 210507 - DNA, 25 bp, Mus musculus
atgacatcaggacccgggtcggtga

SEQ ID NO: 210508 - DNA, 25 bp, Mus musculus
atgacatccaggacctcatgtggca

SEQ ID NO: 210509 - DNA, 25 bp, Mus musculus
atgacatccagtcaccagatttcgt

SEQ ID NO: 210510 - DNA, 25 bp, Mus musculus
atgacatccctttcttgagatgctg

SEQ ID NO: 210511 - DNA, 25 bp, Mus musculus
atgacatccggacagccagcgatgg

SEQ ID NO: 210512 - DNA, 25 bp, Mus musculus
atgacatccggacaggctgacgatg

SEQ ID NO: 210513 - DNA, 25 bp, Mus musculus
atgacatccggatgctgaccttcat

SEQ ID NO: 210514 - DNA, 25 bp, Mus musculus
atgacatccgggtcaaggctggttc

SEQ ID NO: 210515 - DNA, 25 bp, Mus musculus
atgacatccttggcagcactgcagg

SEQ ID NO: 210516 - DNA, 25 bp, Mus musculus
atgacatcgggaggaatgctgtgga

SEQ ID NO: 210517 - DNA, 25 bp, Mus musculus
atgacatctatgtgattggttacca

SEQ ID NO: 210518 - DNA, 25 bp, Mus musculus
atgacatcttctgggtattcggcac

SEQ ID NO: 210519 - DNA, 25 bp, Mus musculus
atgacatggagtggaagacatgaac

SEQ ID NO: 210520 - DNA, 25 bp, Mus musculus
atgacatgtcaaggtcctgggtgag

SEQ ID NO: 210521 - DNA, 25 bp, Mus musculus
atgacattcacctgctgtcttccct

SEQ ID NO: 210522 - DNA, 25 bp, Mus musculus
atgacattccttcattagtgaaaag

SEQ ID NO: 210523 - DNA, 25 bp, Mus musculus
atgacattcgcttcaaaatccagcc

SEQ ID NO: 210524 - DNA, 25 bp, Mus musculus
atgacattgcctcccacccgctggc

SEQ ID NO: 210525 - DNA, 25 bp, Mus musculus
atgacattgtagaaaaaatcgatgc

SEQ ID NO: 210526 - DNA, 25 bp, Mus musculus
atgacatttaaaacagttgccatcc

SEQ ID NO: 210527 - DNA, 25 bp, Mus musculus
atgacatttaccatatgacttttcc

SEQ ID NO: 210528 - DNA, 25 bp, Mus musculus
atgacatttctgttggaggcctccc

SEQ ID NO: 210529 - DNA, 25 bp, Mus musculus
atgaccaaaagggcaacatccccga

SEQ ID NO: 210530 - DNA, 25 bp, Mus musculus
atgaccaaacaggccatcgtgtatg

SEQ ID NO: 210531 - DNA, 25 bp, Mus musculus
atgaccaaacaggcgctgctaagtt

SEQ ID NO: 210532 - DNA, 25 bp, Mus musculus
atgaccaaacgttagaaaagtcctg

SEQ ID NO: 210533 - DNA, 25 bp, Mus musculus
atgaccaaaggactctgatcactgg

SEQ ID NO: 210534 - DNA, 25 bp, Mus musculus
atgaccaacaagtagcaggattgtc

SEQ ID NO: 210535 - DNA, 25 bp, Mus musculus
atgaccaacagcaacatggccaatg

SEQ ID NO: 210536 - DNA, 25 bp, Mus musculus
atgaccaacagtttgaaggaaggaa

SEQ ID NO: 210537 - DNA, 25 bp, Mus musculus
atgaccaagaggtcgctcgcattcg

SEQ ID NO: 210538 - DNA, 25 bp, Mus musculus
atgaccaagttacaggaggcagtga

SEQ ID NO: 210539 - DNA, 25 bp, Mus musculus
atgaccaagttacaggtctcctgtt

SEQ ID NO: 210540 - DNA, 25 bp, Mus musculus
atgaccaatatgagaaagtttggtg

SEQ ID NO: 210541 - DNA, 25 bp, Mus musculus
atgaccaatcaggatgtgatcaagg

SEQ ID NO: 210542 - DNA, 25 bp, Mus musculus
atgaccacagctgttggtctgatag

SEQ ID NO: 210543 - DNA, 25 bp, Mus musculus
atgaccaccactaccatcacggaga

SEQ ID NO: 210544 - DNA, 25 bp, Mus musculus
atgaccaccgacatggtaaagaact

SEQ ID NO: 210545 - DNA, 25 bp, Mus musculus
atgaccactgcaaggtgctgagacg

SEQ ID NO: 210546 - DNA, 25 bp, Mus musculus
atgaccagagagtgatgtggagaga

SEQ ID NO: 210547 - DNA, 25 bp, Mus musculus
atgaccagagccccgggcctctggc

SEQ ID NO: 210548 - DNA, 25 bp, Mus musculus
atgaccagtgatcggcgccagtggt

SEQ ID NO: 210549 - DNA, 25 bp, Mus musculus
atgaccagtggaaatgatgtacgtc

SEQ ID NO: 210550 - DNA, 25 bp, Mus musculus
atgaccagtgtcgttaggagaggag

SEQ ID NO: 210551 - DNA, 25 bp, Mus musculus
atgaccatacagatcatgtcatcag

SEQ ID NO: 210552 - DNA, 25 bp, Mus musculus
atgaccatacaggtatgtcatcagg

SEQ ID NO: 210553 - DNA, 25 bp, Mus musculus
atgaccattagtatagcaagaagcc

SEQ ID NO: 210554 - DNA, 25 bp, Mus musculus
atgacccaaggaatgattcccgttg

SEQ ID NO: 210555 - DNA, 25 bp, Mus musculus
atgacccagacatgctgctcatcgg

SEQ ID NO: 210556 - DNA, 25 bp, Mus musculus
atgacccagttgatggtcacccttc

SEQ ID NO: 210557 - DNA, 25 bp, Mus musculus
atgacccagttgatggttggcagaa

SEQ ID NO: 210558 - DNA, 25 bp, Mus musculus
atgaccccagtgaccgtctggttcc

SEQ ID NO: 210559 - DNA, 25 bp, Mus musculus
atgaccccagtgtcctttatttctc

SEQ ID NO: 210560 - DNA, 25 bp, Mus musculus
atgacccccacgtgattccttagaa

SEQ ID NO: 210561 - DNA, 25 bp, Mus musculus
atgacccccacgtggaagaaaggtc

SEQ ID NO: 210562 - DNA, 25 bp, Mus musculus
atgacccctatcctctctttgtgac

SEQ ID NO: 210563 - DNA, 25 bp, Mus musculus
atgacccctgcgaggcggtgctggt

SEQ ID NO: 210564 - DNA, 25 bp, Mus musculus
atgacccctggaggaaactctgatg

SEQ ID NO: 210565 - DNA, 25 bp, Mus musculus
atgacccctggaggtggagacagaa

SEQ ID NO: 210566 - DNA, 25 bp, Mus musculus
atgacccgctgttcattccttggaa

SEQ ID NO: 210567 - DNA, 25 bp, Mus musculus
atgacccggaggagagtccaccact

SEQ ID NO: 210568 - DNA, 25 bp, Mus musculus
atgacccgtaagaccaagcgcccag

SEQ ID NO: 210569 - DNA, 25 bp, Mus musculus
atgaccctagcttaagtatacctgg

SEQ ID NO: 210570 - DNA, 25 bp, Mus musculus
atgaccctcagaaaaaagtggttat

SEQ ID NO: 210571 - DNA, 25 bp, Mus musculus
atgaccctggaggtgagaaagtctg

SEQ ID NO: 210572 - DNA, 25 bp, Mus musculus
atgacccttggcagacagggtccct

SEQ ID NO: 210573 - DNA, 25 bp, Mus musculus
atgaccgcaagaaaagtatcaagga

SEQ ID NO: 210574 - DNA, 25 bp, Mus musculus
atgaccgcctggtctacgtgatcat

SEQ ID NO: 210575 - DNA, 25 bp, Mus musculus
atgaccggaagtcactggtgacgct

SEQ ID NO: 210576 - DNA, 25 bp, Mus musculus
atgaccggagagaaggtctaatgcg

SEQ ID NO: 210577 - DNA, 25 bp, Mus musculus
atgaccggcagggtgatgctgagtt

SEQ ID NO: 210578 - DNA, 25 bp, Mus musculus
atgaccgtaaagtgttcgtgggtag

SEQ ID NO: 210579 - DNA, 25 bp, Mus musculus
atgaccgtaccaagggatagcccac

SEQ ID NO: 210580 - DNA, 25 bp, Mus musculus
atgaccgtatcaccattgaaatacc

SEQ ID NO: 210581 - DNA, 25 bp, Mus musculus
atgaccgtgccgaacgtgctggcca

SEQ ID NO: 210582 - DNA, 25 bp, Mus musculus
atgacctaatgcagtcatccttcct

SEQ ID NO: 210583 - DNA, 25 bp, Mus musculus
atgacctagctgagccctacaaagg

SEQ ID NO: 210584 - DNA, 25 bp, Mus musculus
atgacctaggaaggcccagcccccg

SEQ ID NO: 210585 - DNA, 25 bp, Mus musculus
atgacctcaagggctctctagtgtc

SEQ ID NO: 210586 - DNA, 25 bp, Mus musculus
atgacctcaccgactctgcaaagca

SEQ ID NO: 210587 - DNA, 25 bp, Mus musculus
atgacctcaccgtgatcaacttttg

SEQ ID NO: 210588 - DNA, 25 bp, Mus musculus
atgacctcattacagtgtgactgca

SEQ ID NO: 210589 - DNA, 25 bp, Mus musculus
atgacctccaagggcccaatgtaaa

SEQ ID NO: 210590 - DNA, 25 bp, Mus musculus
atgacctcgaaaacgggctgtaaaa

SEQ ID NO: 210591 - DNA, 25 bp, Mus musculus
atgacctctatagcgtctctacagc

SEQ ID NO: 210592 - DNA, 25 bp, Mus musculus
atgacctctatataaactgaagtgc

SEQ ID NO: 210593 - DNA, 25 bp, Mus musculus
atgacctctatgtaactgtcaccgt

SEQ ID NO: 210594 - DNA, 25 bp, Mus musculus
atgacctgactgacccattgaagaa

SEQ ID NO: 210595 - DNA, 25 bp, Mus musculus
atgacctgatagcagctgtgagtac

SEQ ID NO: 210596 - DNA, 25 bp, Mus musculus
atgacctggaagacgagctctatgc

SEQ ID NO: 210597 - DNA, 25 bp, Mus musculus
atgacctggaagataaactgaagtg

SEQ ID NO: 210598 - DNA, 25 bp, Mus musculus
atgacctggacaagatcatagaact

SEQ ID NO: 210599 - DNA, 25 bp, Mus musculus
atgacctggtggccaattggagcat

SEQ ID NO: 210600 - DNA, 25 bp, Mus musculus
atgacctggtggccagcaaccttcc

SEQ ID NO: 210601 - DNA, 25 bp, Mus musculus
atgacctgtatcagacacctctgca

SEQ ID NO: 210602 - DNA, 25 bp, Mus musculus
atgaccttactgtcccttttgctcg

SEQ ID NO: 210603 - DNA, 25 bp, Mus musculus
atgaccttgaagaggatcccagtcc

SEQ ID NO: 210604 - DNA, 25 bp, Mus musculus
atgaccttgaccagctcttcattgg

SEQ ID NO: 210605 - DNA, 25 bp, Mus musculus
atgaccttgaggacagacaaggaac

SEQ ID NO: 210606 - DNA, 25 bp, Mus musculus
atgaccttggaagggcctggttctc

SEQ ID NO: 210607 - DNA, 25 bp, Mus musculus
atgaccttggacaagatagccaagg

SEQ ID NO: 210608 - DNA, 25 bp, Mus musculus
atgaccttggacaaggagcagatag

SEQ ID NO: 210609 - DNA, 25 bp, Mus musculus
atgacctttaagaggtgtgctgatg

SEQ ID NO: 210610 - DNA, 25 bp, Mus musculus
atgaccttttcggggtcatcttggc

SEQ ID NO: 210611 - DNA, 25 bp, Mus musculus
atgacgacaagactggccaggtcat

SEQ ID NO: 210612 - DNA, 25 bp, Mus musculus
atgacgacagcccatctgctgctcc

SEQ ID NO: 210613 - DNA, 25 bp, Mus musculus
atgacgagaacagaaaatactcttg

SEQ ID NO: 210614 - DNA, 25 bp, Mus musculus
atgacgagctaaccttcttttaaag

SEQ ID NO: 210615 - DNA, 25 bp, Mus musculus
atgacgagctctcttctcttccctc

SEQ ID NO: 210616 - DNA, 25 bp, Mus musculus
atgacgatagctgagagtcgacaat

SEQ ID NO: 210617 - DNA, 25 bp, Mus musculus
atgacgatagtggttccggaagcct

SEQ ID NO: 210618 - DNA, 25 bp, Mus musculus
atgacgatggtctcccttctcagca

SEQ ID NO: 210619 - DNA, 25 bp, Mus musculus
atgacgcagagctgctcagggtgcc

SEQ ID NO: 210620 - DNA, 25 bp, Mus musculus
atgacgcagagctggctcccgcgta

SEQ ID NO: 210621 - DNA, 25 bp, Mus musculus
atgacgccagctgtgactccagttc

SEQ ID NO: 210622 - DNA, 25 bp, Mus musculus
atgacgccaggatcccattttcagg

SEQ ID NO: 210623 - DNA, 25 bp, Mus musculus
atgacgctgaggtggtatataaccg

SEQ ID NO: 210624 - DNA, 25 bp, Mus musculus
atgacgctgaggttttatataaccg

SEQ ID NO: 210625 - DNA, 25 bp, Mus musculus
atgacggagcgaaatacttaaggaa

SEQ ID NO: 210626 - DNA, 25 bp, Mus musculus
atgacggcaaaaaatgtaacatttc

SEQ ID NO: 210627 - DNA, 25 bp, Mus musculus
atgacggcaaaaaatgttggtttgc

SEQ ID NO: 210628 - DNA, 25 bp, Mus musculus
atgacgtagcagaagcagatataat

SEQ ID NO: 210629 - DNA, 25 bp, Mus musculus
atgacgtagcagaagggttcactgc

SEQ ID NO: 210630 - DNA, 25 bp, Mus musculus
atgacgtccaccagtgaaaatgtgc

SEQ ID NO: 210631 - DNA, 25 bp, Mus musculus
atgacgtctctaagtaacatacaag

SEQ ID NO: 210632 - DNA, 25 bp, Mus musculus
atgacgtcttggctcatgctgcctg

SEQ ID NO: 210633 - DNA, 25 bp, Mus musculus
atgacgtgaccctggaagacatccc

SEQ ID NO: 210634 - DNA, 25 bp, Mus musculus
atgacgtggatgcaggccctgcttc

SEQ ID NO: 210635 - DNA, 25 bp, Mus musculus
atgacgtggatgcagggagcccccg

SEQ ID NO: 210636 - DNA, 25 bp, Mus musculus
atgacgtggccagcttcatcttccg

SEQ ID NO: 210637 - DNA, 25 bp, Mus musculus
atgacgtggccagtgcttttacagt

SEQ ID NO: 210638 - DNA, 25 bp, Mus musculus
atgacgtgttcgagaaccgttacga

SEQ ID NO: 210639 - DNA, 25 bp, Mus musculus
atgactaaagaagaaaaatgatacc

SEQ ID NO: 210640 - DNA, 25 bp, Mus musculus
atgactaacagggagtacaccttta

SEQ ID NO: 210641 - DNA, 25 bp, Mus musculus
atgactaagcacaagagtcacctgt

SEQ ID NO: 210642 - DNA, 25 bp, Mus musculus
atgactacagcattacacccgtcaa

SEQ ID NO: 210643 - DNA, 25 bp, Mus musculus
atgactacctgggaattaccaggag

SEQ ID NO: 210644 - DNA, 25 bp, Mus musculus
atgactacctgggacattcctggag

SEQ ID NO: 210645 - DNA, 25 bp, Mus musculus
atgactactatcggcgacgcctggg

SEQ ID NO: 210646 - DNA, 25 bp, Mus musculus
atgactactatcggcgtcttcccaa

SEQ ID NO: 210647 - DNA, 25 bp, Mus musculus
atgactactttaagggactgatgga

SEQ ID NO: 210648 - DNA, 25 bp, Mus musculus
atgactagagacctgcaggggagcc

SEQ ID NO: 210649 - DNA, 25 bp, Mus musculus
atgactatcagaaaggagatgaata

SEQ ID NO: 210650 - DNA, 25 bp, Mus musculus
atgactatcgatgatgtgatgagtt

SEQ ID NO: 210651 - DNA, 25 bp, Mus musculus
atgactcaacgggggggcagtgccc

SEQ ID NO: 210652 - DNA, 25 bp, Mus musculus
atgactcagaagaaaaaaagtattc

SEQ ID NO: 210653 - DNA, 25 bp, Mus musculus
atgactcagaagctcttgtcctgaa

SEQ ID NO: 210654 - DNA, 25 bp, Mus musculus
atgactcagactggttgatccccaa

SEQ ID NO: 210655 - DNA, 25 bp, Mus musculus
atgactccctcaagaacaaagtcac

SEQ ID NO: 210656 - DNA, 25 bp, Mus musculus
atgactccctcaagattcaaacaga

SEQ ID NO: 210657 - DNA, 25 bp, Mus musculus
atgactcctgacggtgaccctaaaa

SEQ ID NO: 210658 - DNA, 25 bp, Mus musculus
atgactcgaaggaacctaagtcatc

SEQ ID NO: 210659 - DNA, 25 bp, Mus musculus
atgactctagccagcagggcctcaa

SEQ ID NO: 210660 - DNA, 25 bp, Mus musculus
atgactctcaggcaaggccagctga

SEQ ID NO: 210661 - DNA, 25 bp, Mus musculus
atgactctctgtggacgcaagcgcc

SEQ ID NO: 210662 - DNA, 25 bp, Mus musculus
atgactctggagaaggccaacagca

SEQ ID NO: 210663 - DNA, 25 bp, Mus musculus
atgactgaaatctacttaaaattct

SEQ ID NO: 210664 - DNA, 25 bp, Mus musculus
atgactgaaatctcgagatctttgc

SEQ ID NO: 210665 - DNA, 25 bp, Mus musculus
atgactgaagggcatccgtctcttg

SEQ ID NO: 210666 - DNA, 25 bp, Mus musculus
atgactgaccgggagagggataaag

SEQ ID NO: 210667 - DNA, 25 bp, Mus musculus
atgactgatcgaaaggtggcctcct

SEQ ID NO: 210668 - DNA, 25 bp, Mus musculus
atgactgcaagattatttatgtggc

SEQ ID NO: 210669 - DNA, 25 bp, Mus musculus
atgactgcacgcagaaagatgacag

SEQ ID NO: 210670 - DNA, 25 bp, Mus musculus
atgactgccaagattcatgaataaa

SEQ ID NO: 210671 - DNA, 25 bp, Mus musculus
atgactgccgccccaacccgtgtca

SEQ ID NO: 210672 - DNA, 25 bp, Mus musculus
atgactgccttgggctggtgagatg

SEQ ID NO: 210673 - DNA, 25 bp, Mus musculus
atgactgggaaactactatagaaaa

SEQ ID NO: 210674 - DNA, 25 bp, Mus musculus
atgactggttaggaaacctgccata

SEQ ID NO: 210675 - DNA, 25 bp, Mus musculus
atgactgtaaagaagctggctgtga

SEQ ID NO: 210676 - DNA, 25 bp, Mus musculus
atgactgtctatacaactaaaatta

SEQ ID NO: 210677 - DNA, 25 bp, Mus musculus
atgactgtctatagacctgcaatga

SEQ ID NO: 210678 - DNA, 25 bp, Mus musculus
atgactgtgaagaaccgacgcagac

SEQ ID NO: 210679 - DNA, 25 bp, Mus musculus
atgactgtgtggtgtcgattgatga

SEQ ID NO: 210680 - DNA, 25 bp, Mus musculus
atgactgtgtggttgcagaagctgg

SEQ ID NO: 210681 - DNA, 25 bp, Mus musculus
atgactgttaccaatgcaccttcca

SEQ ID NO: 210682 - DNA, 25 bp, Mus musculus
atgacttaccgattctgttcccagt

SEQ ID NO: 210683 - DNA, 25 bp, Mus musculus
atgacttagaagacgagctgtatgc

SEQ ID NO: 210684 - DNA, 25 bp, Mus musculus
atgacttagaagagaaagtggccca

SEQ ID NO: 210685 - DNA, 25 bp, Mus musculus
atgacttagaagataagtttctttg

SEQ ID NO: 210686 - DNA, 25 bp, Mus musculus
atgacttagaagatcaactctacca

SEQ ID NO: 210687 - DNA, 25 bp, Mus musculus
atgacttagaggactagcccactgt

SEQ ID NO: 210688 - DNA, 25 bp, Mus musculus
atgacttagaggactgtcagaaaac

SEQ ID NO: 210689 - DNA, 25 bp, Mus musculus
atgacttcaaggctgacatctggtc

SEQ ID NO: 210690 - DNA, 25 bp, Mus musculus
atgacttcagagaatacctgtctcc

SEQ ID NO: 210691 - DNA, 25 bp, Mus musculus
atgacttcagatggaggctggacag

SEQ ID NO: 210692 - DNA, 25 bp, Mus musculus
atgacttcagctgctgacctcactt

SEQ ID NO: 210693 - DNA, 25 bp, Mus musculus
atgacttccagaaggatctgaaagc

SEQ ID NO: 210694 - DNA, 25 bp, Mus musculus
atgacttccatataagtttctttgc

SEQ ID NO: 210695 - DNA, 25 bp, Mus musculus
atgacttccctctagatttgatcaa

SEQ ID NO: 210696 - DNA, 25 bp, Mus musculus
atgacttccgggactcaccagctga

SEQ ID NO: 210697 - DNA, 25 bp, Mus musculus
atgactttaagcaggtgctgctggt

SEQ ID NO: 210698 - DNA, 25 bp, Mus musculus
atgactttaaggaggccacgcagtg

SEQ ID NO: 210699 - DNA, 25 bp, Mus musculus
atgactttctctgtaccgtcagaag

SEQ ID NO: 210700 - DNA, 25 bp, Mus musculus
atgactttctgaagcttcttcacat

SEQ ID NO: 210701 - DNA, 25 bp, Mus musculus
atgactttgaagatgaccgcaaccc

SEQ ID NO: 210702 - DNA, 25 bp, Mus musculus
atgactttggatggaagacttcgag

SEQ ID NO: 210703 - DNA, 25 bp, Mus musculus
atgactttggcaccaggaagcctgt

SEQ ID NO: 210704 - DNA, 25 bp, Mus musculus
atgactttgtaagaaactggtcaaa

SEQ ID NO: 210705 - DNA, 25 bp, Mus musculus
atgactttgtaaggtatctacttta

SEQ ID NO: 210706 - DNA, 25 bp, Mus musculus
atgagaaaaaggattcagaatttcc

SEQ ID NO: 210707 - DNA, 25 bp, Mus musculus
atgagaaaaaggtcctggagtgggc

SEQ ID NO: 210708 - DNA, 25 bp, Mus musculus
atgagaaaactggggtaattgaaca

SEQ ID NO: 210709 - DNA, 25 bp, Mus musculus
atgagaaaatttccaggacctttgt

SEQ ID NO: 210710 - DNA, 25 bp, Mus musculus
atgagaaagatgtgccagaaacaga

SEQ ID NO: 210711 - DNA, 25 bp, Mus musculus
atgagaaagcatgctctctgttggg

SEQ ID NO: 210712 - DNA, 25 bp, Mus musculus
atgagaaataaagacaaaaggcttg

SEQ ID NO: 210713 - DNA, 25 bp, Mus musculus
atgagaaataagaggtacccagact

SEQ ID NO: 210714 - DNA, 25 bp, Mus musculus
atgagaaatacggtgaggccctggg

SEQ ID NO: 210715 - DNA, 25 bp, Mus musculus
atgagaacaaagtggcctatgagcg

SEQ ID NO: 210716 - DNA, 25 bp, Mus musculus
atgagaacagagagatggatgatcc

SEQ ID NO: 210717 - DNA, 25 bp, Mus musculus
atgagaacaggatggacagtctctc

SEQ ID NO: 210718 - DNA, 25 bp, Mus musculus
atgagaacagggtaggtgagctcca

SEQ ID NO: 210719 - DNA, 25 bp, Mus musculus
atgagaaccggaagaaagccgaagc

SEQ ID NO: 210720 - DNA, 25 bp, Mus musculus
atgagaactatgcaggtattgcagc

SEQ ID NO: 210721 - DNA, 25 bp, Mus musculus
atgagaagagaagacactaccactg

SEQ ID NO: 210722 - DNA, 25 bp, Mus musculus
atgagaagaggaagcttcttgatgg

SEQ ID NO: 210723 - DNA, 25 bp, Mus musculus
atgagaagatgagctcagcagtcag

SEQ ID NO: 210724 - DNA, 25 bp, Mus musculus
atgagaagatgagtcgggatataag

SEQ ID NO: 210725 - DNA, 25 bp, Mus musculus
atgagaagcccaagctgcagacgga

SEQ ID NO: 210726 - DNA, 25 bp, Mus musculus
atgagaaggaagagggtaaactggt

SEQ ID NO: 210727 - DNA, 25 bp, Mus musculus
atgagaaggagggggagctcaacta

SEQ ID NO: 210728 - DNA, 25 bp, Mus musculus
atgagaaggaggggttccccatcac

SEQ ID NO: 210729 - DNA, 25 bp, Mus musculus
atgagaataatctttgtgcgctctg

SEQ ID NO: 210730 - DNA, 25 bp, Mus musculus
atgagaataatgtttgctttgagtg

SEQ ID NO: 210731 - DNA, 25 bp, Mus musculus
atgagaatgacaggagccatccgca

SEQ ID NO: 210732 - DNA, 25 bp, Mus musculus
atgagaatgatccagctacatcaaa

SEQ ID NO: 210733 - DNA, 25 bp, Mus musculus
atgagaatgggctaggcaaaagatg

SEQ ID NO: 210734 - DNA, 25 bp, Mus musculus
atgagaatgggctagtcacagttgc

SEQ ID NO: 210735 - DNA, 25 bp, Mus musculus
atgagaattttacagaatcctgaaa

SEQ ID NO: 210736 - DNA, 25 bp, Mus musculus
atgagacaaagggagctgaaggttg

SEQ ID NO: 210737 - DNA, 25 bp, Mus musculus
atgagacaagaagactgctggacac

SEQ ID NO: 210738 - DNA, 25 bp, Mus musculus
atgagacaagagatgtgcttgtgtg

SEQ ID NO: 210739 - DNA, 25 bp, Mus musculus
atgagacaagatcttcaagcaactt

SEQ ID NO: 210740 - DNA, 25 bp, Mus musculus
atgagacaattgaggaaccaacaca

SEQ ID NO: 210741 - DNA, 25 bp, Mus musculus
atgagacacacgcgcttgttctcta

SEQ ID NO: 210742 - DNA, 25 bp, Mus musculus
atgagacacggagcggtactgctca

SEQ ID NO: 210743 - DNA, 25 bp, Mus musculus
atgagacagatggaccctcctcatc

SEQ ID NO: 210744 - DNA, 25 bp, Mus musculus
atgagaccacagatgccaattcatc

SEQ ID NO: 210745 - DNA, 25 bp, Mus musculus
atgagacccacatggaatggacctg

SEQ ID NO: 210746 - DNA, 25 bp, Mus musculus
atgagacccagctttccctgctgct

SEQ ID NO: 210747 - DNA, 25 bp, Mus musculus
atgagaccctggacatgaacaagct

SEQ ID NO: 210748 - DNA, 25 bp, Mus musculus
atgagaccctgtacatgggctgtgt

SEQ ID NO: 210749 - DNA, 25 bp, Mus musculus
atgagacgggaagctgtacagagag

SEQ ID NO: 210750 - DNA, 25 bp, Mus musculus
atgagactgagagaggaccatgctc

SEQ ID NO: 210751 - DNA, 25 bp, Mus musculus
atgagactggagagacgagagaata

SEQ ID NO: 210752 - DNA, 25 bp, Mus musculus
atgagactggatctctttcctttgc

SEQ ID NO: 210753 - DNA, 25 bp, Mus musculus
atgagacttagaatccttctgaagg

SEQ ID NO: 210754 - DNA, 25 bp, Mus musculus
atgagacttagtagctagaagaatg

SEQ ID NO: 210755 - DNA, 25 bp, Mus musculus
atgagacttgtattccctgtgagtg

SEQ ID NO: 210756 - DNA, 25 bp, Mus musculus
atgagagaaaacttttatccatgac

SEQ ID NO: 210757 - DNA, 25 bp, Mus musculus
atgagagaaaaggcctgctggtgac

SEQ ID NO: 210758 - DNA, 25 bp, Mus musculus
atgagagaaagaatcccaagaggtt

SEQ ID NO: 210759 - DNA, 25 bp, Mus musculus
atgagagaaagaatgcccagatgtc

SEQ ID NO: 210760 - DNA, 25 bp, Mus musculus
atgagagcaaggatttatatgaata

SEQ ID NO: 210761 - DNA, 25 bp, Mus musculus
atgagagcaccccgatcccagagag

SEQ ID NO: 210762 - DNA, 25 bp, Mus musculus
atgagagcaggtcaaggaggccatg

SEQ ID NO: 210763 - DNA, 25 bp, Mus musculus
atgagagcagtgggagccggtgaag

SEQ ID NO: 210764 - DNA, 25 bp, Mus musculus
atgagagcattaagcatccagcatg

SEQ ID NO: 210765 - DNA, 25 bp, Mus musculus
atgagagcgatccagtttgacgccg

SEQ ID NO: 210766 - DNA, 25 bp, Mus musculus
atgagagctcagccctagtcgaggg

SEQ ID NO: 210767 - DNA, 25 bp, Mus musculus
atgagagctgtaatagttccgagga

SEQ ID NO: 210768 - DNA, 25 bp, Mus musculus
atgagaggaacgagtgtggccagac

SEQ ID NO: 210769 - DNA, 25 bp, Mus musculus
atgagaggatgcctcctggaacatg

SEQ ID NO: 210770 - DNA, 25 bp, Mus musculus
atgagaggatgctgagagtccatgc

SEQ ID NO: 210771 - DNA, 25 bp, Mus musculus
atgagaggccagatcctaaatttga

SEQ ID NO: 210772 - DNA, 25 bp, Mus musculus
atgagagggagcttcgttacgacga

SEQ ID NO: 210773 - DNA, 25 bp, Mus musculus
atgagagggaggtctgggacatgtt

SEQ ID NO: 210774 - DNA, 25 bp, Mus musculus
atgagagtgagagaggcatgaaagt

SEQ ID NO: 210775 - DNA, 25 bp, Mus musculus
atgagagttgactctgtgcagattc

SEQ ID NO: 210776 - DNA, 25 bp, Mus musculus
atgagagttgggcacttgctggatc

SEQ ID NO: 210777 - DNA, 25 bp, Mus musculus
atgagagttgtgaggagatccccca

SEQ ID NO: 210778 - DNA, 25 bp, Mus musculus
atgagataatccaccatgactggtg

SEQ ID NO: 210779 - DNA, 25 bp, Mus musculus
atgagatacaagggtcaatatagac

SEQ ID NO: 210780 - DNA, 25 bp, Mus musculus
atgagatacaaggtgtagtggctgg

SEQ ID NO: 210781 - DNA, 25 bp, Mus musculus
atgagatatttgtggtagtgtgaag

SEQ ID NO: 210782 - DNA, 25 bp, Mus musculus
atgagatcaacctgccactgtccat

SEQ ID NO: 210783 - DNA, 25 bp, Mus musculus
atgagatcaacgctgaccatttgaa

SEQ ID NO: 210784 - DNA, 25 bp, Mus musculus
atgagatcaacggtgaccatttgaa

SEQ ID NO: 210785 - DNA, 25 bp, Mus musculus
atgagatccagctgtaggagacttt

SEQ ID NO: 210786 - DNA, 25 bp, Mus musculus
atgagatcccagcccccgaaactct

SEQ ID NO: 210787 - DNA, 25 bp, Mus musculus
atgagatcccagctgagaaagcgct

SEQ ID NO: 210788 - DNA, 25 bp, Mus musculus
atgagatctcccaggctgtgacctc

SEQ ID NO: 210789 - DNA, 25 bp, Mus musculus
atgagatggaagctgccactgactg

SEQ ID NO: 210790 - DNA, 25 bp, Mus musculus
atgagatggagaggtgaggctgctg

SEQ ID NO: 210791 - DNA, 25 bp, Mus musculus
atgagatgggggaatgcacccgagg

SEQ ID NO: 210792 - DNA, 25 bp, Mus musculus
atgagatggggtcacctccaaggtc

SEQ ID NO: 210793 - DNA, 25 bp, Mus musculus
atgagatgtgtatagcgagatcttt

SEQ ID NO: 210794 - DNA, 25 bp, Mus musculus
atgagatgtttgttggattcagtcc

SEQ ID NO: 210795 - DNA, 25 bp, Mus musculus
atgagattcctgagatgaccacagg

SEQ ID NO: 210796 - DNA, 25 bp, Mus musculus
atgagattctgaccaagtgttgtac

SEQ ID NO: 210797 - DNA, 25 bp, Mus musculus
atgagattctgacccatgcttctct

SEQ ID NO: 210798 - DNA, 25 bp, Mus musculus
atgagattctggtcattcgaaaggg

SEQ ID NO: 210799 - DNA, 25 bp, Mus musculus
atgagattgatgatgaatatgaagg

SEQ ID NO: 210800 - DNA, 25 bp, Mus musculus
atgagatttcctgactgctcttttc

SEQ ID NO: 210801 - DNA, 25 bp, Mus musculus
atgagcaaaagctggtgcaacacgt

SEQ ID NO: 210802 - DNA, 25 bp, Mus musculus
atgagcaaacgtatgcagagatgcc

SEQ ID NO: 210803 - DNA, 25 bp, Mus musculus
atgagcaaagaggtgcaagatctct

SEQ ID NO: 210804 - DNA, 25 bp, Mus musculus
atgagcaaagccaaacaccatgtca

SEQ ID NO: 210805 - DNA, 25 bp, Mus musculus
atgagcaaagggccacaatacccac

SEQ ID NO: 210806 - DNA, 25 bp, Mus musculus
atgagcaagaccatgactggccaaa

SEQ ID NO: 210807 - DNA, 25 bp, Mus musculus
atgagcaagcggcccttgattgtga

SEQ ID NO: 210808 - DNA, 25 bp, Mus musculus
atgagcaagcggcttgttatgctgc

SEQ ID NO: 210809 - DNA, 25 bp, Mus musculus
atgagcaaggcgaacaactcgatcg

SEQ ID NO: 210810 - DNA, 25 bp, Mus musculus
atgagcaaggcgaacaactggaacg

SEQ ID NO: 210811 - DNA, 25 bp, Mus musculus
atgagcaatctgtaaagaaaacgtg

SEQ ID NO: 210812 - DNA, 25 bp, Mus musculus
atgagcaattgcgagctctgcagga

SEQ ID NO: 210813 - DNA, 25 bp, Mus musculus
atgagcacaagactgacctaggtgg

SEQ ID NO: 210814 - DNA, 25 bp, Mus musculus
atgagcacaagagctgcgaggagaa

SEQ ID NO: 210815 - DNA, 25 bp, Mus musculus
atgagcacaatcaagtctaaactag

SEQ ID NO: 210816 - DNA, 25 bp, Mus musculus
atgagcactctagttctgacagtat

SEQ ID NO: 210817 - DNA, 25 bp, Mus musculus
atgagcactcttgtccctttaaaaa

SEQ ID NO: 210818 - DNA, 25 bp, Mus musculus
atgagcagaaagatcagtatgcatt

SEQ ID NO: 210819 - DNA, 25 bp, Mus musculus
atgagcagaaaggacaaagcccagt

SEQ ID NO: 210820 - DNA, 25 bp, Mus musculus
atgagcagaacctcaggttctccct

SEQ ID NO: 210821 - DNA, 25 bp, Mus musculus
atgagcagaagaaaccttgttcccc

SEQ ID NO: 210822 - DNA, 25 bp, Mus musculus
atgagcagcaatggtaaatatgtgt

SEQ ID NO: 210823 - DNA, 25 bp, Mus musculus
atgagcagctcctgacaaacgtcct

SEQ ID NO: 210824 - DNA, 25 bp, Mus musculus
atgagcagctctgcagtatgctgac

SEQ ID NO: 210825 - DNA, 25 bp, Mus musculus
atgagcaggaccaagctggcaagcg

SEQ ID NO: 210826 - DNA, 25 bp, Mus musculus
atgagcaggaccaaggatcagacaa

SEQ ID NO: 210827 - DNA, 25 bp, Mus musculus
atgagcagggcaatgttctgtcttc

SEQ ID NO: 210828 - DNA, 25 bp, Mus musculus
atgagcatcagcgggcaaatcattt

SEQ ID NO: 210829 - DNA, 25 bp, Mus musculus
atgagcatccagtgtatccagagtg

SEQ ID NO: 210830 - DNA, 25 bp, Mus musculus
atgagcatcccgactttaagctcga

SEQ ID NO: 210831 - DNA, 25 bp, Mus musculus
atgagcattacctggttcataagcc

SEQ ID NO: 210832 - DNA, 25 bp, Mus musculus
atgagcattgctgagcagatgggcc

SEQ ID NO: 210833 - DNA, 25 bp, Mus musculus
atgagcattgctgcggtgacagagg

SEQ ID NO: 210834 - DNA, 25 bp, Mus musculus
atgagccaaggaccagagtgagggc

SEQ ID NO: 210835 - DNA, 25 bp, Mus musculus
atgagccaaggcatagagatctctg

SEQ ID NO: 210836 - DNA, 25 bp, Mus musculus
atgagccactgccagcgttccatgt

SEQ ID NO: 210837 - DNA, 25 bp, Mus musculus
atgagccaggacgacctggcgagaa

SEQ ID NO: 210838 - DNA, 25 bp, Mus musculus
atgagccagtcccgcatccttcaga

SEQ ID NO: 210839 - DNA, 25 bp, Mus musculus
atgagcccaaagcacccatgctgga

SEQ ID NO: 210840 - DNA, 25 bp, Mus musculus
atgagcccagcaccgatcggtcagc

SEQ ID NO: 210841 - DNA, 25 bp, Mus musculus
atgagcctcagggccccttaggcca

SEQ ID NO: 210842 - DNA, 25 bp, Mus musculus
atgagcctgcctttaccccagcccc

SEQ ID NO: 210843 - DNA, 25 bp, Mus musculus
atgagccttgagatggcgttgacgt

SEQ ID NO: 210844 - DNA, 25 bp, Mus musculus
atgagcgactggtctgtgagtttca

SEQ ID NO: 210845 - DNA, 25 bp, Mus musculus
atgagcgcaggctgtactacgaggg

SEQ ID NO: 210846 - DNA, 25 bp, Mus musculus
atgagcgcattttaaagcccaactc

SEQ ID NO: 210847 - DNA, 25 bp, Mus musculus
atgagcggatatgaccaagttttac

SEQ ID NO: 210848 - DNA, 25 bp, Mus musculus
atgagcggatatggtagccaaggag

SEQ ID NO: 210849 - DNA, 25 bp, Mus musculus
atgagcggcaggttgggtcggaact

SEQ ID NO: 210850 - DNA, 25 bp, Mus musculus
atgagcgggagaaggctctgtccaa

SEQ ID NO: 210851 - DNA, 25 bp, Mus musculus
atgagcgtaaaaatgagtgaaaaag

SEQ ID NO: 210852 - DNA, 25 bp, Mus musculus
atgagcgtaaaaatggaaatgcttg

SEQ ID NO: 210853 - DNA, 25 bp, Mus musculus
atgagcgtcctctcgagacatgaaa

SEQ ID NO: 210854 - DNA, 25 bp, Mus musculus
atgagcgtcctctcggaggtaacag

SEQ ID NO: 210855 - DNA, 25 bp, Mus musculus
atgagcgttactgccgatgcaatgc

SEQ ID NO: 210856 - DNA, 25 bp, Mus musculus
atgagctaatacgagggagaagaca

SEQ ID NO: 210857 - DNA, 25 bp, Mus musculus
atgagctaccgggacaagagtgaag

SEQ ID NO: 210858 - DNA, 25 bp, Mus musculus
atgagctacttcccacccctgcctg

SEQ ID NO: 210859 - DNA, 25 bp, Mus musculus
atgagctacttgaaaagtaaagaac

SEQ ID NO: 210860 - DNA, 25 bp, Mus musculus
atgagctcatacagagtccaggctg

SEQ ID NO: 210861 - DNA, 25 bp, Mus musculus
atgagctcatacagtctcaacagat

SEQ ID NO: 210862 - DNA, 25 bp, Mus musculus
atgagctcatcctagcaggtatgcc

SEQ ID NO: 210863 - DNA, 25 bp, Mus musculus
atgagctcatggagagagcagtaga

SEQ ID NO: 210864 - DNA, 25 bp, Mus musculus
atgagctcatggagcttgagatctt

SEQ ID NO: 210865 - DNA, 25 bp, Mus musculus
atgagctccaagagctgttagctga

SEQ ID NO: 210866 - DNA, 25 bp, Mus musculus
atgagctccaaggatgctctggagg

SEQ ID NO: 210867 - DNA, 25 bp, Mus musculus
atgagctggtgtcactgcagatgag

SEQ ID NO: 210868 - DNA, 25 bp, Mus musculus
atgagctgttacaggtactgcgaat

SEQ ID NO: 210869 - DNA, 25 bp, Mus musculus
atgagctgttacagtttttcagctg

SEQ ID NO: 210870 - DNA, 25 bp, Mus musculus
atgagcttcctcttcagcagccgct

SEQ ID NO: 210871 - DNA, 25 bp, Mus musculus
atgagcttcctcttcgttattttaa

SEQ ID NO: 210872 - DNA, 25 bp, Mus musculus
atgagcttgccctggtcaggcagca

SEQ ID NO: 210873 - DNA, 25 bp, Mus musculus
atgagctttcccgagacagcctgcc

SEQ ID NO: 210874 - DNA, 25 bp, Mus musculus
atgagctttgtcaagaacctacatg

SEQ ID NO: 210875 - DNA, 25 bp, Mus musculus
atgagctttgtcaagggctggggag

SEQ ID NO: 210876 - DNA, 25 bp, Mus musculus
atgaggaaacccagtcgcatagggc

SEQ ID NO: 210877 - DNA, 25 bp, Mus musculus
atgaggaaagacatgatactgtcag

SEQ ID NO: 210878 - DNA, 25 bp, Mus musculus
atgaggaaagcacagagaccagcta

SEQ ID NO: 210879 - DNA, 25 bp, Mus musculus
atgaggaaagcacagggaagctggg

SEQ ID NO: 210880 - DNA, 25 bp, Mus musculus
atgaggaacaagattcgagagcaaa

SEQ ID NO: 210881 - DNA, 25 bp, Mus musculus
atgaggaagaggaacacgcagcact

SEQ ID NO: 210882 - DNA, 25 bp, Mus musculus
atgaggaaggcgaagatgagcgttc

SEQ ID NO: 210883 - DNA, 25 bp, Mus musculus
atgaggaagtctgcactggaaccac

SEQ ID NO: 210884 - DNA, 25 bp, Mus musculus
atgaggaagtctgcagtgccggtgc

SEQ ID NO: 210885 - DNA, 25 bp, Mus musculus
atgaggaatgagtggccttgtgaat

SEQ ID NO: 210886 - DNA, 25 bp, Mus musculus
atgaggacaaaacaggaatggaagc

SEQ ID NO: 210887 - DNA, 25 bp, Mus musculus
atgaggacaaaacagtgaccaagaa

SEQ ID NO: 210888 - DNA, 25 bp, Mus musculus
atgaggaccaggtggtagttaataa

SEQ ID NO: 210889 - DNA, 25 bp, Mus musculus
atgaggaccagtgggcatgggtcct

SEQ ID NO: 210890 - DNA, 25 bp, Mus musculus
atgaggacgacccaggaagagaaag

SEQ ID NO: 210891 - DNA, 25 bp, Mus musculus
atgaggacgacccaggcaaagggaa

SEQ ID NO: 210892 - DNA, 25 bp, Mus musculus
atgaggactgtgagtgttcccagga

SEQ ID NO: 210893 - DNA, 25 bp, Mus musculus
atgaggagaaacaggcaagtgctct

SEQ ID NO: 210894 - DNA, 25 bp, Mus musculus
atgaggagaagcctatgggaaggtg

SEQ ID NO: 210895 - DNA, 25 bp, Mus musculus
atgaggagatcaagaggatagatag

SEQ ID NO: 210896 - DNA, 25 bp, Mus musculus
atgaggagatcaaggacttgcacca

SEQ ID NO: 210897 - DNA, 25 bp, Mus musculus
atgaggagctgaggagagaacattg

SEQ ID NO: 210898 - DNA, 25 bp, Mus musculus
atgaggagctggaggttgcgagaac

SEQ ID NO: 210899 - DNA, 25 bp, Mus musculus
atgaggaggaagtttacagtagcat

SEQ ID NO: 210900 - DNA, 25 bp, Mus musculus
atgaggataaagaatgacagcccat

SEQ ID NO: 210901 - DNA, 25 bp, Mus musculus
atgaggatagggttgtcgatgagtt

SEQ ID NO: 210902 - DNA, 25 bp, Mus musculus
atgaggatgaagatgatgaggaaga

SEQ ID NO: 210903 - DNA, 25 bp, Mus musculus
atgaggatggccagtggaagaaaca

SEQ ID NO: 210904 - DNA, 25 bp, Mus musculus
atgaggatggggacgaaagcatcca

SEQ ID NO: 210905 - DNA, 25 bp, Mus musculus
atgaggatttgggatttagaattcc

SEQ ID NO: 210906 - DNA, 25 bp, Mus musculus
atgaggcaaaagcagaaccgggatg

SEQ ID NO: 210907 - DNA, 25 bp, Mus musculus
atgaggcaagtcagaggccaaaatg

SEQ ID NO: 210908 - DNA, 25 bp, Mus musculus
atgaggcacaaggagcaagacccaa

SEQ ID NO: 210909 - DNA, 25 bp, Mus musculus
atgaggccatgagagtcctcgttga

SEQ ID NO: 210910 - DNA, 25 bp, Mus musculus
atgaggcccgagaaactgaaggagc

SEQ ID NO: 210911 - DNA, 25 bp, Mus musculus
atgaggccgccatgggtattaagag

SEQ ID NO: 210912 - DNA, 25 bp, Mus musculus
atgaggccggcgtcctccgccccct

SEQ ID NO: 210913 - DNA, 25 bp, Mus musculus
atgaggcgaaggaaagctcacaaca

SEQ ID NO: 210914 - DNA, 25 bp, Mus musculus
atgaggcgagaggtgaaagagctgg

SEQ ID NO: 210915 - DNA, 25 bp, Mus musculus
atgaggcgtgggcttcgggacacag

SEQ ID NO: 210916 - DNA, 25 bp, Mus musculus
atgaggctccagtcctgccaaccca

SEQ ID NO: 210917 - DNA, 25 bp, Mus musculus
atgaggcttacagatttgtgaaaga

SEQ ID NO: 210918 - DNA, 25 bp, Mus musculus
atgaggcttacaggcggcagaagcc

SEQ ID NO: 210919 - DNA, 25 bp, Mus musculus
atgaggctttggttttgttgagttt

SEQ ID NO: 210920 - DNA, 25 bp, Mus musculus
atgagggaagacaaggtgatgatga

SEQ ID NO: 210921 - DNA, 25 bp, Mus musculus
atgagggactgctaggaagggacaa

SEQ ID NO: 210922 - DNA, 25 bp, Mus musculus
atgagggactgctaggcaaagaacg

SEQ ID NO: 210923 - DNA, 25 bp, Mus musculus
atgagggagaggagggtctggtcag

SEQ ID NO: 210924 - DNA, 25 bp, Mus musculus
atgagggaggagtgtgtgctgtcag

SEQ ID NO: 210925 - DNA, 25 bp, Mus musculus
atgagggctcaagtcgcaatgtgtc

SEQ ID NO: 210926 - DNA, 25 bp, Mus musculus
atgagggctggagtggcaaaacctg

SEQ ID NO: 210927 - DNA, 25 bp, Mus musculus
atgaggggagccagattatcacaaa

SEQ ID NO: 210928 - DNA, 25 bp, Mus musculus
atgaggggcggccaggtccagcacc

SEQ ID NO: 210929 - DNA, 25 bp, Mus musculus
atgagggggtccggatcaaaagccc

SEQ ID NO: 210930 - DNA, 25 bp, Mus musculus
atgagggtaagtatcagatggagat

SEQ ID NO: 210931 - DNA, 25 bp, Mus musculus
atgagggtagcaggagctgcaaagt

SEQ ID NO: 210932 - DNA, 25 bp, Mus musculus
atgaggtcaagagtgggccatgaac

SEQ ID NO: 210933 - DNA, 25 bp, Mus musculus
atgaggtcacgtaaacagagagtgg

SEQ ID NO: 210934 - DNA, 25 bp, Mus musculus
atgaggtccaggagatacttcaagc

SEQ ID NO: 210935 - DNA, 25 bp, Mus musculus
atgaggtccaggtgacaataaattt

SEQ ID NO: 210936 - DNA, 25 bp, Mus musculus
atgaggtggaggagatgctgaccaa

SEQ ID NO: 210937 - DNA, 25 bp, Mus musculus
atgaggtggaggaggtggagtttga

SEQ ID NO: 210938 - DNA, 25 bp, Mus musculus
atgaggttcctgatgatgatgaacc

SEQ ID NO: 210939 - DNA, 25 bp, Mus musculus
atgaggttcctgatggaaaaccaac

SEQ ID NO: 210940 - DNA, 25 bp, Mus musculus
atgaggttcctgatggtgttctcca

SEQ ID NO: 210941 - DNA, 25 bp, Mus musculus
atgaggttggcaggccccctgcgca

SEQ ID NO: 210942 - DNA, 25 bp, Mus musculus
atgagtaagtggcttgcagcgtggc

SEQ ID NO: 210943 - DNA, 25 bp, Mus musculus
atgagtacaaagcatacgaggaaac

SEQ ID NO: 210944 - DNA, 25 bp, Mus musculus
atgagtacctcacgaaatctgtcat

SEQ ID NO: 210945 - DNA, 25 bp, Mus musculus
atgagtacctcacgttcaggaaaag

SEQ ID NO: 210946 - DNA, 25 bp, Mus musculus
atgagtacctcaggaaatctgtcat

SEQ ID NO: 210947 - DNA, 25 bp, Mus musculus
atgagtacctcaggttcaggaaaag

SEQ ID NO: 210948 - DNA, 25 bp, Mus musculus
atgagtactacagcatgggcgcatg

SEQ ID NO: 210949 - DNA, 25 bp, Mus musculus
atgagtactgcaagattggcaaaga

SEQ ID NO: 210950 - DNA, 25 bp, Mus musculus
atgagtagcaacaaaacgctgccgt

SEQ ID NO: 210951 - DNA, 25 bp, Mus musculus
atgagtagcaacaaagagcagcggt

SEQ ID NO: 210952 - DNA, 25 bp, Mus musculus
atgagtagcgaaagcaaatcagaag

SEQ ID NO: 210953 - DNA, 25 bp, Mus musculus
atgagtagcttcataatcctcagcc

SEQ ID NO: 210954 - DNA, 25 bp, Mus musculus
atgagtagcttcatgctctctatct

SEQ ID NO: 210955 - DNA, 25 bp, Mus musculus
atgagtagtgggatgagagtcattc

SEQ ID NO: 210956 - DNA, 25 bp, Mus musculus
atgagtatcttgagttgaactacag

SEQ ID NO: 210957 - DNA, 25 bp, Mus musculus
atgagtatgcaggtcctgatgaagt

SEQ ID NO: 210958 - DNA, 25 bp, Mus musculus
atgagtatgggaagagtcactccag

SEQ ID NO: 210959 - DNA, 25 bp, Mus musculus
atgagtatgtgctggaggatctgga

SEQ ID NO: 210960 - DNA, 25 bp, Mus musculus
atgagtattttgatgttgccttcat

SEQ ID NO: 210961 - DNA, 25 bp, Mus musculus
atgagtattttggtataggcagagt

SEQ ID NO: 210962 - DNA, 25 bp, Mus musculus
atgagtcaagattactatgacatgg

SEQ ID NO: 210963 - DNA, 25 bp, Mus musculus
atgagtcaagccgagatgactgacc

SEQ ID NO: 210964 - DNA, 25 bp, Mus musculus
atgagtcacaattttatattggctg

SEQ ID NO: 210965 - DNA, 25 bp, Mus musculus
atgagtcagaagcccatctcggtca

SEQ ID NO: 210966 - DNA, 25 bp, Mus musculus
atgagtcagaaggtgttgcagccca

SEQ ID NO: 210967 - DNA, 25 bp, Mus musculus
atgagtcatacagaggtaccttcct

SEQ ID NO: 210968 - DNA, 25 bp, Mus musculus
atgagtcatacagaggttaaattaa

SEQ ID NO: 210969 - DNA, 25 bp, Mus musculus
atgagtccaaaggatcagactgaac

SEQ ID NO: 210970 - DNA, 25 bp, Mus musculus
atgagtccaaagtttccattgggaa

SEQ ID NO: 210971 - DNA, 25 bp, Mus musculus
atgagtccaaattttatattggctg

SEQ ID NO: 210972 - DNA, 25 bp, Mus musculus
atgagtccaagttctatattggctg

SEQ ID NO: 210973 - DNA, 25 bp, Mus musculus
atgagtccaccaatggctcaacaac

SEQ ID NO: 210974 - DNA, 25 bp, Mus musculus
atgagtccagacttcttgtgaagat

SEQ ID NO: 210975 - DNA, 25 bp, Mus musculus
atgagtccaggctagatatggattt

SEQ ID NO: 210976 - DNA, 25 bp, Mus musculus
atgagtcccaggtgtattccctgga

SEQ ID NO: 210977 - DNA, 25 bp, Mus musculus
atgagtcctttggcttcaccgctga

SEQ ID NO: 210978 - DNA, 25 bp, Mus musculus
atgagtctcaggaacctgacagaac

SEQ ID NO: 210979 - DNA, 25 bp, Mus musculus
atgagtctcaggttccacgagtacc

SEQ ID NO: 210980 - DNA, 25 bp, Mus musculus
atgagtctccacagattgacggcgg

SEQ ID NO: 210981 - DNA, 25 bp, Mus musculus
atgagtctcccaggaagatctgcta

SEQ ID NO: 210982 - DNA, 25 bp, Mus musculus
atgagtctctcaagcgtcaagaact

SEQ ID NO: 210983 - DNA, 25 bp, Mus musculus
atgagtctctgagtgaggagaccca

SEQ ID NO: 210984 - DNA, 25 bp, Mus musculus
atgagtctcttcagcgtcaagaact

SEQ ID NO: 210985 - DNA, 25 bp, Mus musculus
atgagtctgaagggattggagatag

SEQ ID NO: 210986 - DNA, 25 bp, Mus musculus
atgagtgagatcgcagccttccctg

SEQ ID NO: 210987 - DNA, 25 bp, Mus musculus
atgagtgagatcgtttcctcctcag

SEQ ID NO: 210988 - DNA, 25 bp, Mus musculus
atgagtgcagaaaatattaatggta

SEQ ID NO: 210989 - DNA, 25 bp, Mus musculus
atgagtgcagaggggaacctgcaca

SEQ ID NO: 210990 - DNA, 25 bp, Mus musculus
atgagtgcagcgtgttacccattcc

SEQ ID NO: 210991 - DNA, 25 bp, Mus musculus
atgagtgcagttttcagcagatcag

SEQ ID NO: 210992 - DNA, 25 bp, Mus musculus
atgagtgccaaatggcccagcaagg

SEQ ID NO: 210993 - DNA, 25 bp, Mus musculus
atgagtggaaggtggcccagatgat

SEQ ID NO: 210994 - DNA, 25 bp, Mus musculus
atgagtggaaggtgggattggtttc

SEQ ID NO: 210995 - DNA, 25 bp, Mus musculus
atgagtggagccagagaacagcttt

SEQ ID NO: 210996 - DNA, 25 bp, Mus musculus
atgagtggagctggtctgggactgt

SEQ ID NO: 210997 - DNA, 25 bp, Mus musculus
atgagtggatctccacttgggttat

SEQ ID NO: 210998 - DNA, 25 bp, Mus musculus
atgagtggtacatatgacaatggat

SEQ ID NO: 210999 - DNA, 25 bp, Mus musculus
atgagtggtacgacatgacaatgga

SEQ ID NO: 211000 - DNA, 25 bp, Mus musculus
atgagtgttggaatggtcagcctct

SEQ ID NO: 211001 - DNA, 25 bp, Mus musculus
atgagttaaggcgtcgaggtggaaa

SEQ ID NO: 211002 - DNA, 25 bp, Mus musculus
atgagttacatgtatgatttctgta

SEQ ID NO: 211003 - DNA, 25 bp, Mus musculus
atgagttagagagagagagagagac

SEQ ID NO: 211004 - DNA, 25 bp, Mus musculus
atgagttagaggtcttgttgcgggt

SEQ ID NO: 211005 - DNA, 25 bp, Mus musculus
atgagttcaaagaaaatccctgaga

SEQ ID NO: 211006 - DNA, 25 bp, Mus musculus
atgagttcaaggccttgctgtatcc

SEQ ID NO: 211007 - DNA, 25 bp, Mus musculus
atgagttcaaggtggtggtcgtgca

SEQ ID NO: 211008 - DNA, 25 bp, Mus musculus
atgagttcatcgatggctaaagtaa

SEQ ID NO: 211009 - DNA, 25 bp, Mus musculus
atgagttcatcgatgtctacttcat

SEQ ID NO: 211010 - DNA, 25 bp, Mus musculus
atgagttcattgcaattcttggcca

SEQ ID NO: 211011 - DNA, 25 bp, Mus musculus
atgagttcgagcccgccggagtcct

SEQ ID NO: 211012 - DNA, 25 bp, Mus musculus
atgagttctaccgcagtggctgggc

SEQ ID NO: 211013 - DNA, 25 bp, Mus musculus
atgagttctcccataccctccacac

SEQ ID NO: 211014 - DNA, 25 bp, Mus musculus
atgagttctgaatgtgatgttggaa

SEQ ID NO: 211015 - DNA, 25 bp, Mus musculus
atgagttgctaaaactgccttgggg

SEQ ID NO: 211016 - DNA, 25 bp, Mus musculus
atgagttgctaaaagtgcctcctga

SEQ ID NO: 211017 - DNA, 25 bp, Mus musculus
atgagttgtgcctgccgacataaga

SEQ ID NO: 211018 - DNA, 25 bp, Mus musculus
atgagtttaaggttaaatgagcagt

SEQ ID NO: 211019 - DNA, 25 bp, Mus musculus
atgagtttgagatactaagcaacca

SEQ ID NO: 211020 - DNA, 25 bp, Mus musculus
atgagtttgaggcgggatccacggc

SEQ ID NO: 211021 - DNA, 25 bp, Mus musculus
atgataaagagaaacttttagcgga

SEQ ID NO: 211022 - DNA, 25 bp, Mus musculus
atgataaagagatgagacctgctcg

SEQ ID NO: 211023 - DNA, 25 bp, Mus musculus
atgataaagaggaagaagaaagaaa

SEQ ID NO: 211024 - DNA, 25 bp, Mus musculus
atgataaagggtgaggtgtgccaaa

SEQ ID NO: 211025 - DNA, 25 bp, Mus musculus
atgataaagggtgagttttatgtga

SEQ ID NO: 211026 - DNA, 25 bp, Mus musculus
atgataaatgaggacatagcattgt

SEQ ID NO: 211027 - DNA, 25 bp, Mus musculus
atgataacagagcaacccgatagca

SEQ ID NO: 211028 - DNA, 25 bp, Mus musculus
atgataacagagcatacaagcaatg

SEQ ID NO: 211029 - DNA, 25 bp, Mus musculus
atgataacagagtcaatccccttct

SEQ ID NO: 211030 - DNA, 25 bp, Mus musculus
atgataagctgaatgatatggaacc

SEQ ID NO: 211031 - DNA, 25 bp, Mus musculus
atgataagctgggtaaaactccacc

SEQ ID NO: 211032 - DNA, 25 bp, Mus musculus
atgataatgaaggaattgctatctt

SEQ ID NO: 211033 - DNA, 25 bp, Mus musculus
atgataatgagtattctagtcaaga

SEQ ID NO: 211034 - DNA, 25 bp, Mus musculus
atgataatgtagatgaaactgaagg

SEQ ID NO: 211035 - DNA, 25 bp, Mus musculus
atgataatgtagatgaggaagcaag

SEQ ID NO: 211036 - DNA, 25 bp, Mus musculus
atgatacatatgagtcaaacgttct

SEQ ID NO: 211037 - DNA, 25 bp, Mus musculus
atgatacatccaggtgcatggagga

SEQ ID NO: 211038 - DNA, 25 bp, Mus musculus
atgatagaatgttgctggtgaagaa

SEQ ID NO: 211039 - DNA, 25 bp, Mus musculus
atgatagcctcgtggaactggaaca

SEQ ID NO: 211040 - DNA, 25 bp, Mus musculus
atgatagcgatgaggaagatgatga

SEQ ID NO: 211041 - DNA, 25 bp, Mus musculus
atgataggagacgattgcagggatg

SEQ ID NO: 211042 - DNA, 25 bp, Mus musculus
atgatagtagtgtcctggaggccac

SEQ ID NO: 211043 - DNA, 25 bp, Mus musculus
atgatagtagttacacctctaagtt

SEQ ID NO: 211044 - DNA, 25 bp, Mus musculus
atgatatcacaaatgttaactcatt

SEQ ID NO: 211045 - DNA, 25 bp, Mus musculus
atgatatctttgtatatgaggtgac

SEQ ID NO: 211046 - DNA, 25 bp, Mus musculus
atgatatgaggagtcagtacaggct

SEQ ID NO: 211047 - DNA, 25 bp, Mus musculus
atgatatggacaggggatagcccac

SEQ ID NO: 211048 - DNA, 25 bp, Mus musculus
atgatattaagatgctaacattttt

SEQ ID NO: 211049 - DNA, 25 bp, Mus musculus
atgatattcaagcgtctgttgcggt

SEQ ID NO: 211050 - DNA, 25 bp, Mus musculus
atgatattcaaggaacagcgtctgt

SEQ ID NO: 211051 - DNA, 25 bp, Mus musculus
atgatattgggtttgatctgtggat

SEQ ID NO: 211052 - DNA, 25 bp, Mus musculus
atgatattggtgatgtaaccattac

SEQ ID NO: 211053 - DNA, 25 bp, Mus musculus
atgatattgtcatatccaactgtgt

SEQ ID NO: 211054 - DNA, 25 bp, Mus musculus
atgatcaaaaccaggggctgtcagc

SEQ ID NO: 211055 - DNA, 25 bp, Mus musculus
atgatcaacaacaccaaggagttta

SEQ ID NO: 211056 - DNA, 25 bp, Mus musculus
atgatcaacgaagcaatggcaccat

SEQ ID NO: 211057 - DNA, 25 bp, Mus musculus
atgatcaactctcatctgttctcag

SEQ ID NO: 211058 - DNA, 25 bp, Mus musculus
atgatcaagggcatccaccacggcc

SEQ ID NO: 211059 - DNA, 25 bp, Mus musculus
atgatcaatggtcgtagttatgatg

SEQ ID NO: 211060 - DNA, 25 bp, Mus musculus
atgatcacagaacttgacgtcaggg

SEQ ID NO: 211061 - DNA, 25 bp, Mus musculus
atgatcacagaacttgtgcaggtgt

SEQ ID NO: 211062 - DNA, 25 bp, Mus musculus
atgatcacaggacacctatatcaac

SEQ ID NO: 211063 - DNA, 25 bp, Mus musculus
atgatcacaggtgacaatcttcaga

SEQ ID NO: 211064 - DNA, 25 bp, Mus musculus
atgatcaccagtgattcaggccaag

SEQ ID NO: 211065 - DNA, 25 bp, Mus musculus
atgatcaccctggagacgactctag

SEQ ID NO: 211066 - DNA, 25 bp, Mus musculus
atgatcacgtccaagaatttcaccc

SEQ ID NO: 211067 - DNA, 25 bp, Mus musculus
atgatcacgtccaaggtggctgtgc

SEQ ID NO: 211068 - DNA, 25 bp, Mus musculus
atgatcagacaggaaaggatgtggc

SEQ ID NO: 211069 - DNA, 25 bp, Mus musculus
atgatcagcacatgggagtggtcac

SEQ ID NO: 211070 - DNA, 25 bp, Mus musculus
atgatcagcacatgggctttcccag

SEQ ID NO: 211071 - DNA, 25 bp, Mus musculus
atgatcaggtgctaggttaaagatc

SEQ ID NO: 211072 - DNA, 25 bp, Mus musculus
atgatccacaggccctttggagacg

SEQ ID NO: 211073 - DNA, 25 bp, Mus musculus
atgatccagaaagatcaagagcacc

SEQ ID NO: 211074 - DNA, 25 bp, Mus musculus
atgatccagaagcaacatggcttct

SEQ ID NO: 211075 - DNA, 25 bp, Mus musculus
atgatccagaagcagaggacgttcg

SEQ ID NO: 211076 - DNA, 25 bp, Mus musculus
atgatcccagagctggtttggccct

SEQ ID NO: 211077 - DNA, 25 bp, Mus musculus
atgatccccaatgtggaaaccatcc

SEQ ID NO: 211078 - DNA, 25 bp, Mus musculus
atgatcccgggataggcttctgtgt

SEQ ID NO: 211079 - DNA, 25 bp, Mus musculus
atgatccgagaggccttggaagcta

SEQ ID NO: 211080 - DNA, 25 bp, Mus musculus
atgatccgccagtttacagacctgc

SEQ ID NO: 211081 - DNA, 25 bp, Mus musculus
atgatcctcatcggggtacttttga

SEQ ID NO: 211082 - DNA, 25 bp, Mus musculus
atgatcctgggctgggacgaagtag

SEQ ID NO: 211083 - DNA, 25 bp, Mus musculus
atgatccttctgagagctgtccagc

SEQ ID NO: 211084 - DNA, 25 bp, Mus musculus
atgatccttctgagccaatagtaac

SEQ ID NO: 211085 - DNA, 25 bp, Mus musculus
atgatcgacacaaatgaagaaaaaa

SEQ ID NO: 211086 - DNA, 25 bp, Mus musculus
atgatcgacacaataaaattgaaga

SEQ ID NO: 211087 - DNA, 25 bp, Mus musculus
atgatcggctccgagggagcagaag

SEQ ID NO: 211088 - DNA, 25 bp, Mus musculus
atgatcggctccgaggtgggaaact

SEQ ID NO: 211089 - DNA, 25 bp, Mus musculus
atgatcgggaacatggagcacatgg

SEQ ID NO: 211090 - DNA, 25 bp, Mus musculus
atgatctagtttgtttggtgtacag

SEQ ID NO: 211091 - DNA, 25 bp, Mus musculus
atgatctccaaggactcaggcagct

SEQ ID NO: 211092 - DNA, 25 bp, Mus musculus
atgatctctgggacctggaattcgg

SEQ ID NO: 211093 - DNA, 25 bp, Mus musculus
atgatctggaagagactttggccag

SEQ ID NO: 211094 - DNA, 25 bp, Mus musculus
atgatctggaagatgaagtctatgc

SEQ ID NO: 211095 - DNA, 25 bp, Mus musculus
atgatctggacgatgattctgacag

SEQ ID NO: 211096 - DNA, 25 bp, Mus musculus
atgatctggagtgccccgagcctaa

SEQ ID NO: 211097 - DNA, 25 bp, Mus musculus
atgatctgtcacttgggagtttgcc

SEQ ID NO: 211098 - DNA, 25 bp, Mus musculus
atgatctgtgccatgccaggtggtt

SEQ ID NO: 211099 - DNA, 25 bp, Mus musculus
atgatcttcctggacaaaccaattc

SEQ ID NO: 211100 - DNA, 25 bp, Mus musculus
atgatcttctgccatacccgcaaaa

SEQ ID NO: 211101 - DNA, 25 bp, Mus musculus
atgatcttgaactcacagaaggaag

SEQ ID NO: 211102 - DNA, 25 bp, Mus musculus
atgatcttgagtctgcaactgtgtc

SEQ ID NO: 211103 - DNA, 25 bp, Mus musculus
atgatcttgctattgaagtggacct

SEQ ID NO: 211104 - DNA, 25 bp, Mus musculus
atgatctttaagaatggtcctcctc

SEQ ID NO: 211105 - DNA, 25 bp, Mus musculus
atgatctttaagaatggtgacaagt

SEQ ID NO: 211106 - DNA, 25 bp, Mus musculus
atgatctttagaagactgctggaca

SEQ ID NO: 211107 - DNA, 25 bp, Mus musculus
atgatgaaaaacgtgaagcttccct

SEQ ID NO: 211108 - DNA, 25 bp, Mus musculus
atgatgaaaacggaacaccagatgc

SEQ ID NO: 211109 - DNA, 25 bp, Mus musculus
atgatgaaacagtcaaaacaattca

SEQ ID NO: 211110 - DNA, 25 bp, Mus musculus
atgatgaaacagtgaaaaccataag

SEQ ID NO: 211111 - DNA, 25 bp, Mus musculus
atgatgaaagcagccatgtactcgg

SEQ ID NO: 211112 - DNA, 25 bp, Mus musculus
atgatgaaagcagtggtccatgccg

SEQ ID NO: 211113 - DNA, 25 bp, Mus musculus
atgatgaaagccctctctatagcct

SEQ ID NO: 211114 - DNA, 25 bp, Mus musculus
atgatgaaaggcatccttacttcga

SEQ ID NO: 211115 - DNA, 25 bp, Mus musculus
atgatgaacatggaagggttattaa

SEQ ID NO: 211116 - DNA, 25 bp, Mus musculus
atgatgaacatggtgaagattcctg

SEQ ID NO: 211117 - DNA, 25 bp, Mus musculus
atgatgaagaccgggcatctggaga

SEQ ID NO: 211118 - DNA, 25 bp, Mus musculus
atgatgaagatcgctgagatccgaa

SEQ ID NO: 211119 - DNA, 25 bp, Mus musculus
atgatgaatgacgaataggtgaagg

SEQ ID NO: 211120 - DNA, 25 bp, Mus musculus
atgatgaatggcaagtgactgtctg

SEQ ID NO: 211121 - DNA, 25 bp, Mus musculus
atgatgaatggcagtcactacagct

SEQ ID NO: 211122 - DNA, 25 bp, Mus musculus
atgatgacaattttgaagaaggcga

SEQ ID NO: 211123 - DNA, 25 bp, Mus musculus
atgatgacaggtttctactgcactt

SEQ ID NO: 211124 - DNA, 25 bp, Mus musculus
atgatgaccaggatctgacacacat

SEQ ID NO: 211125 - DNA, 25 bp, Mus musculus
atgatgaccaggattacttacactc

SEQ ID NO: 211126 - DNA, 25 bp, Mus musculus
atgatgacgagctaaccttctttta

SEQ ID NO: 211127 - DNA, 25 bp, Mus musculus
atgatgacgagctctcttctcttcc

SEQ ID NO: 211128 - DNA, 25 bp, Mus musculus
atgatgacgatggtctcccttctca

SEQ ID NO: 211129 - DNA, 25 bp, Mus musculus
atgatgactcgaaggaacctaagtc

SEQ ID NO: 211130 - DNA, 25 bp, Mus musculus
atgatgagaaaggggaggagcgcta

SEQ ID NO: 211131 - DNA, 25 bp, Mus musculus
atgatgagaggccgggcccctcccc

SEQ ID NO: 211132 - DNA, 25 bp, Mus musculus
atgatgagaggcgacgtagtcaccg

SEQ ID NO: 211133 - DNA, 25 bp, Mus musculus
atgatgagcaggaaaagaagccgga

SEQ ID NO: 211134 - DNA, 25 bp, Mus musculus
atgatgagtcacaattttatattgg

SEQ ID NO: 211135 - DNA, 25 bp, Mus musculus
atgatgatagaatgttgctggtgaa

SEQ ID NO: 211136 - DNA, 25 bp, Mus musculus
atgatgatcaggaatctagagaagc

SEQ ID NO: 211137 - DNA, 25 bp, Mus musculus
atgatgatcgtggaccctgccatca

SEQ ID NO: 211138 - DNA, 25 bp, Mus musculus
atgatgatcgtggcgggatccgcag

SEQ ID NO: 211139 - DNA, 25 bp, Mus musculus
atgatgatcgtggtttggcctggaa

SEQ ID NO: 211140 - DNA, 25 bp, Mus musculus
atgatgatgagaagggcaggtcccc

SEQ ID NO: 211141 - DNA, 25 bp, Mus musculus
atgatgatgcagggccctggccaca

SEQ ID NO: 211142 - DNA, 25 bp, Mus musculus
atgatgatggcttagatgaaatcat

SEQ ID NO: 211143 - DNA, 25 bp, Mus musculus
atgatgcaagggttctggaatactt

SEQ ID NO: 211144 - DNA, 25 bp, Mus musculus
atgatgcaattcgggaggctttgga

SEQ ID NO: 211145 - DNA, 25 bp, Mus musculus
atgatgcaatttaaaattgtggtgg

SEQ ID NO: 211146 - DNA, 25 bp, Mus musculus
atgatgcactgtcagaacaagcctg

SEQ ID NO: 211147 - DNA, 25 bp, Mus musculus
atgatgcactgtcaggttccgagtc

SEQ ID NO: 211148 - DNA, 25 bp, Mus musculus
atgatgcagaggccaagaagatagc

SEQ ID NO: 211149 - DNA, 25 bp, Mus musculus
atgatgcagtgcaggcaatacagag

SEQ ID NO: 211150 - DNA, 25 bp, Mus musculus
atgatgcatccgatgtcgtcctgga

SEQ ID NO: 211151 - DNA, 25 bp, Mus musculus
atgatgcatcggatgtcgtcctgga

SEQ ID NO: 211152 - DNA, 25 bp, Mus musculus
atgatgccatagcatggaagactgc

SEQ ID NO: 211153 - DNA, 25 bp, Mus musculus
atgatgccatgtacgcgtctacagc

SEQ ID NO: 211154 - DNA, 25 bp, Mus musculus
atgatgcccaggacttagaagagtt

SEQ ID NO: 211155 - DNA, 25 bp, Mus musculus
atgatgcccagtcttaccatgagcg

SEQ ID NO: 211156 - DNA, 25 bp, Mus musculus
atgatgccccagcaaacacaattag

SEQ ID NO: 211157 - DNA, 25 bp, Mus musculus
atgatgccccaggaaacacaattag

SEQ ID NO: 211158 - DNA, 25 bp, Mus musculus
atgatgcccccacttaatgcccaaa

SEQ ID NO: 211159 - DNA, 25 bp, Mus musculus
atgatgcggagaatataggcaaaga

SEQ ID NO: 211160 - DNA, 25 bp, Mus musculus
atgatgcgggagggaccttgtgcca

SEQ ID NO: 211161 - DNA, 25 bp, Mus musculus
atgatgcggggggcctggatcgtca

SEQ ID NO: 211162 - DNA, 25 bp, Mus musculus
atgatgcgggtttctccggctgtct

SEQ ID NO: 211163 - DNA, 25 bp, Mus musculus
atgatgctagctctggtacacctac

SEQ ID NO: 211164 - DNA, 25 bp, Mus musculus
atgatgcttcagctgagtgtgacag

SEQ ID NO: 211165 - DNA, 25 bp, Mus musculus
atgatgcttcagctgggtggcacag

SEQ ID NO: 211166 - DNA, 25 bp, Mus musculus
atgatggaacaagacttgatttcat

SEQ ID NO: 211167 - DNA, 25 bp, Mus musculus
atgatggaacaagtgcatggaggac

SEQ ID NO: 211168 - DNA, 25 bp, Mus musculus
atgatggacaagaaaaagaataatc

SEQ ID NO: 211169 - DNA, 25 bp, Mus musculus
atgatggacaaggtggagtttgtcc

SEQ ID NO: 211170 - DNA, 25 bp, Mus musculus
atgatggacaggaaacagacagctg

SEQ ID NO: 211171 - DNA, 25 bp, Mus musculus
atgatggacatatcaattactggga

SEQ ID NO: 211172 - DNA, 25 bp, Mus musculus
atgatggacatatcatcatacccca

SEQ ID NO: 211173 - DNA, 25 bp, Mus musculus
atgatggaccatgaagcaaagctgc

SEQ ID NO: 211174 - DNA, 25 bp, Mus musculus
atgatggagaggtggacatggaagg

SEQ ID NO: 211175 - DNA, 25 bp, Mus musculus
atgatggattttaagggtctcacac

SEQ ID NO: 211176 - DNA, 25 bp, Mus musculus
atgatggcagagtgttcaacttctg

SEQ ID NO: 211177 - DNA, 25 bp, Mus musculus
atgatggctgagatccggggttcta

SEQ ID NO: 211178 - DNA, 25 bp, Mus musculus
atgatggcttagatgaaatcatcat

SEQ ID NO: 211179 - DNA, 25 bp, Mus musculus
atgatgggaagaaacctgatcagga

SEQ ID NO: 211180 - DNA, 25 bp, Mus musculus
atgatgggaaggacaaaccagagaa

SEQ ID NO: 211181 - DNA, 25 bp, Mus musculus
atgatgggagcacagaggggaaggc

SEQ ID NO: 211182 - DNA, 25 bp, Mus musculus
atgatgggagcacagtgtgcagctt

SEQ ID NO: 211183 - DNA, 25 bp, Mus musculus
atgatggggtcccaggaggagtggg

SEQ ID NO: 211184 - DNA, 25 bp, Mus musculus
atgatggggtcccagggatccgttt

SEQ ID NO: 211185 - DNA, 25 bp, Mus musculus
atgatgggtcctggagtgaacccaa

SEQ ID NO: 211186 - DNA, 25 bp, Mus musculus
atgatggtccctctggtcttgatgg

SEQ ID NO: 211187 - DNA, 25 bp, Mus musculus
atgatgtacaggtcatagatgagca

SEQ ID NO: 211188 - DNA, 25 bp, Mus musculus
atgatgtaccagggagtggctggat

SEQ ID NO: 211189 - DNA, 25 bp, Mus musculus
atgatgtacgcaccagttgaatttt

SEQ ID NO: 211190 - DNA, 25 bp, Mus musculus
atgatgtacgccagtgaattcatct

SEQ ID NO: 211191 - DNA, 25 bp, Mus musculus
atgatgtatttgtggggtaatcagg

SEQ ID NO: 211192 - DNA, 25 bp, Mus musculus
atgatgtcacctcggctaaggatgg

SEQ ID NO: 211193 - DNA, 25 bp, Mus musculus
atgatgtcagcgtcaatactatcaa

SEQ ID NO: 211194 - DNA, 25 bp, Mus musculus
atgatgtcatgcaagcatttgacat

SEQ ID NO: 211195 - DNA, 25 bp, Mus musculus
atgatgtcatgcaaggttcaaaggg

SEQ ID NO: 211196 - DNA, 25 bp, Mus musculus
atgatgtcatgcaagtttgtatgcc

SEQ ID NO: 211197 - DNA, 25 bp, Mus musculus
atgatgtccaagtacaaatatagag

SEQ ID NO: 211198 - DNA, 25 bp, Mus musculus
atgatgtcctatatgaactgagaaa

SEQ ID NO: 211199 - DNA, 25 bp, Mus musculus
atgatgtgaccctggacaaactgta

SEQ ID NO: 211200 - DNA, 25 bp, Mus musculus
atgatgtgaggcactaagtgaccgc

SEQ ID NO: 211201 - DNA, 25 bp, Mus musculus
atgatgtgctctgtgcagccctggc

SEQ ID NO: 211202 - DNA, 25 bp, Mus musculus
atgatgtggaagattttaattcctt

SEQ ID NO: 211203 - DNA, 25 bp, Mus musculus
atgatgtgggagaccactgggacac

SEQ ID NO: 211204 - DNA, 25 bp, Mus musculus
atgatgttcaaacacttcgacaagg

SEQ ID NO: 211205 - DNA, 25 bp, Mus musculus
atgatgttggtgatctgaaaacatc

SEQ ID NO: 211206 - DNA, 25 bp, Mus musculus
atgatgttgtccctgacaggtttgg

SEQ ID NO: 211207 - DNA, 25 bp, Mus musculus
atgatgtttacaagtatgagaccag

SEQ ID NO: 211208 - DNA, 25 bp, Mus musculus
atgattaaagtgaggaataagactg

SEQ ID NO: 211209 - DNA, 25 bp, Mus musculus
atgattaacctggtgctggatttct

SEQ ID NO: 211210 - DNA, 25 bp, Mus musculus
atgattaatgacaccaattctaggg

SEQ ID NO: 211211 - DNA, 25 bp, Mus musculus
atgattacaacatttcagaaggttg

SEQ ID NO: 211212 - DNA, 25 bp, Mus musculus
atgattacaatgcaagaaatcctac

SEQ ID NO: 211213 - DNA, 25 bp, Mus musculus
atgattagagggggacatgtcaatc

SEQ ID NO: 211214 - DNA, 25 bp, Mus musculus
atgattatagaaaaggtcattttga

SEQ ID NO: 211215 - DNA, 25 bp, Mus musculus
atgattattggagccccagaacgag

SEQ ID NO: 211216 - DNA, 25 bp, Mus musculus
atgattattgggtgtgcattatgtg

SEQ ID NO: 211217 - DNA, 25 bp, Mus musculus
atgattcacagtggtaagattggtc

SEQ ID NO: 211218 - DNA, 25 bp, Mus musculus
atgattcagaagatgatttttggtg

SEQ ID NO: 211219 - DNA, 25 bp, Mus musculus
atgattcatctagaggttttacaga

SEQ ID NO: 211220 - DNA, 25 bp, Mus musculus
atgattcatctagagtacaaaacag

SEQ ID NO: 211221 - DNA, 25 bp, Mus musculus
atgattccacaggcaatccagatca

SEQ ID NO: 211222 - DNA, 25 bp, Mus musculus
atgattccactagggctattctcct

SEQ ID NO: 211223 - DNA, 25 bp, Mus musculus
atgattccagatgcacgccatccct

SEQ ID NO: 211224 - DNA, 25 bp, Mus musculus
atgattccagcagtcaggctgggac

SEQ ID NO: 211225 - DNA, 25 bp, Mus musculus
atgattccaggctactagtcagtgc

SEQ ID NO: 211226 - DNA, 25 bp, Mus musculus
atgattccgaagcacctttggggaa

SEQ ID NO: 211227 - DNA, 25 bp, Mus musculus
atgattcctctgaggatgacaagga

SEQ ID NO: 211228 - DNA, 25 bp, Mus musculus
atgattctgctgagcatttgctagc

SEQ ID NO: 211229 - DNA, 25 bp, Mus musculus
atgattctgctggtgtgggacttga

SEQ ID NO: 211230 - DNA, 25 bp, Mus musculus
atgattgacaatgagacgctgccag

SEQ ID NO: 211231 - DNA, 25 bp, Mus musculus
atgattggacagcctgccgggcctc

SEQ ID NO: 211232 - DNA, 25 bp, Mus musculus
atgattggacaggcatcaagattct

SEQ ID NO: 211233 - DNA, 25 bp, Mus musculus
atgattggcaagcagtggtgacgta

SEQ ID NO: 211234 - DNA, 25 bp, Mus musculus
atgattggctgtagtttccagagtc

SEQ ID NO: 211235 - DNA, 25 bp, Mus musculus
atgattgtaaagggtctcctgtgag

SEQ ID NO: 211236 - DNA, 25 bp, Mus musculus
atgattgtgggcaggatatttgtgt

SEQ ID NO: 211237 - DNA, 25 bp, Mus musculus
atgatttatgggctcattgttggag

SEQ ID NO: 211238 - DNA, 25 bp, Mus musculus
atgatttatgtttgagattgctgag

SEQ ID NO: 211239 - DNA, 25 bp, Mus musculus
atgatttccagagagaagacctgat

SEQ ID NO: 211240 - DNA, 25 bp, Mus musculus
atgatttccagcctcatgtcatagt

SEQ ID NO: 211241 - DNA, 25 bp, Mus musculus
atgatttcccagcacagcaagctga

SEQ ID NO: 211242 - DNA, 25 bp, Mus musculus
atgatttcccagcagagcaagctga

SEQ ID NO: 211243 - DNA, 25 bp, Mus musculus
atgatttcgatagcaatgcagttgc

SEQ ID NO: 211244 - DNA, 25 bp, Mus musculus
atgatttgaggacccagttccgccg

SEQ ID NO: 211245 - DNA, 25 bp, Mus musculus
atgatttgtagaactagtccttatc

SEQ ID NO: 211246 - DNA, 25 bp, Mus musculus
atgatttgtagaactatgcattttg

SEQ ID NO: 211247 - DNA, 25 bp, Mus musculus
atgattttaatagctcgatgacctc

SEQ ID NO: 211248 - DNA, 25 bp, Mus musculus
atgattttaatagtgctagccatcg

SEQ ID NO: 211249 - DNA, 25 bp, Mus musculus
atgattttacagagtgctaccagta

SEQ ID NO: 211250 - DNA, 25 bp, Mus musculus
atgattttacagtgtgctaccagta

SEQ ID NO: 211251 - DNA, 25 bp, Mus musculus
atgattttaggttacagccaagctc

SEQ ID NO: 211252 - DNA, 25 bp, Mus musculus
atgatttttttggaatgggcaaaga

SEQ ID NO: 211253 - DNA, 25 bp, Mus musculus
atgcaaaaaggtctgctgaagacag

SEQ ID NO: 211254 - DNA, 25 bp, Mus musculus
atgcaaaatagcggtcacacaactg

SEQ ID NO: 211255 - DNA, 25 bp, Mus musculus
atgcaaaatatcagctggtggctgg

SEQ ID NO: 211256 - DNA, 25 bp, Mus musculus
atgcaaaatatcagtctagccgcag

SEQ ID NO: 211257 - DNA, 25 bp, Mus musculus
atgcaaacaagggcaccctggagga

SEQ ID NO: 211258 - DNA, 25 bp, Mus musculus
atgcaaacagaacatgttggagcag

SEQ ID NO: 211259 - DNA, 25 bp, Mus musculus
atgcaaaccagcaagctcctgggcc

SEQ ID NO: 211260 - DNA, 25 bp, Mus musculus
atgcaaaccagcaagtgcgactgta

SEQ ID NO: 211261 - DNA, 25 bp, Mus musculus
atgcaaaccccagatatccagcttg

SEQ ID NO: 211262 - DNA, 25 bp, Mus musculus
atgcaaactcgccctgggcagtgac

SEQ ID NO: 211263 - DNA, 25 bp, Mus musculus
atgcaaagacaggagggagaaagag

SEQ ID NO: 211264 - DNA, 25 bp, Mus musculus
atgcaaagcagaacaggggctaccc

SEQ ID NO: 211265 - DNA, 25 bp, Mus musculus
atgcaaataagtgaaaaggaagatg

SEQ ID NO: 211266 - DNA, 25 bp, Mus musculus
atgcaaatagagtaaaggagtttgg

SEQ ID NO: 211267 - DNA, 25 bp, Mus musculus
atgcaaatagggtgaaagaattgac

SEQ ID NO: 211268 - DNA, 25 bp, Mus musculus
atgcaaatgaacaagctgagtatga

SEQ ID NO: 211269 - DNA, 25 bp, Mus musculus
atgcaaatgaggatgcccctaaatc

SEQ ID NO: 211270 - DNA, 25 bp, Mus musculus
atgcaaatgagttccagacaggatt

SEQ ID NO: 211271 - DNA, 25 bp, Mus musculus
atgcaaatgggaacaactgtataag

SEQ ID NO: 211272 - DNA, 25 bp, Mus musculus
atgcaacaacaagggaagtactccg

SEQ ID NO: 211273 - DNA, 25 bp, Mus musculus
atgcaacaacaagggagctcactca

SEQ ID NO: 211274 - DNA, 25 bp, Mus musculus
atgcaacaggcttaggtgccacatt

SEQ ID NO: 211275 - DNA, 25 bp, Mus musculus
atgcaaccgaagctgacattatctc

SEQ ID NO: 211276 - DNA, 25 bp, Mus musculus
atgcaacgtaatgcctcagttccac

SEQ ID NO: 211277 - DNA, 25 bp, Mus musculus
atgcaagccgggaagcctatcctct

SEQ ID NO: 211278 - DNA, 25 bp, Mus musculus
atgcaagccttcagaatctgggata

SEQ ID NO: 211279 - DNA, 25 bp, Mus musculus
atgcaagccttcagacacctagatg

SEQ ID NO: 211280 - DNA, 25 bp, Mus musculus
atgcaaggcccatgtcttccctaca

SEQ ID NO: 211281 - DNA, 25 bp, Mus musculus
atgcaagtaatcggagaggtattct

SEQ ID NO: 211282 - DNA, 25 bp, Mus musculus
atgcaagtaatcggtggcaattatg

SEQ ID NO: 211283 - DNA, 25 bp, Mus musculus
atgcaagtggaggtgaagtatttga

SEQ ID NO: 211284 - DNA, 25 bp, Mus musculus
atgcaagtgggagaatccacctcat

SEQ ID NO: 211285 - DNA, 25 bp, Mus musculus
atgcaatcaaagttgtcctggggaa

SEQ ID NO: 211286 - DNA, 25 bp, Mus musculus
atgcaatcaatgtttgcaaaaaatt

SEQ ID NO: 211287 - DNA, 25 bp, Mus musculus
atgcaatgacggtgccccctacagc

SEQ ID NO: 211288 - DNA, 25 bp, Mus musculus
atgcaattcgggaggctttggagga

SEQ ID NO: 211289 - DNA, 25 bp, Mus musculus
atgcaattggactcaagcggatagc

SEQ ID NO: 211290 - DNA, 25 bp, Mus musculus
atgcaattgtttacatgatagatgc

SEQ ID NO: 211291 - DNA, 25 bp, Mus musculus
atgcaatttaaaattgtggtgggtt

SEQ ID NO: 211292 - DNA, 25 bp, Mus musculus
atgcaatttcggagcttcaccctga

SEQ ID NO: 211293 - DNA, 25 bp, Mus musculus
atgcacaaacaggcggaaattgtga

SEQ ID NO: 211294 - DNA, 25 bp, Mus musculus
atgcacaaacagtgccccaggtact

SEQ ID NO: 211295 - DNA, 25 bp, Mus musculus
atgcacaagattttagtttgggatc

SEQ ID NO: 211296 - DNA, 25 bp, Mus musculus
atgcacacagccaaccccaacaaga

SEQ ID NO: 211297 - DNA, 25 bp, Mus musculus
atgcacacagtggatgaagaagaga

SEQ ID NO: 211298 - DNA, 25 bp, Mus musculus
atgcacacagtggtaccgttttgca

SEQ ID NO: 211299 - DNA, 25 bp, Mus musculus
atgcacagaccagtacatgacaatg

SEQ ID NO: 211300 - DNA, 25 bp, Mus musculus
atgcacatagaagccgtatcaaggt

SEQ ID NO: 211301 - DNA, 25 bp, Mus musculus
atgcacatgtcagatactttggcaa

SEQ ID NO: 211302 - DNA, 25 bp, Mus musculus
atgcacatgtctcgaattatcaaga

SEQ ID NO: 211303 - DNA, 25 bp, Mus musculus
atgcacatgtgtagggtgtgtgagg

SEQ ID NO: 211304 - DNA, 25 bp, Mus musculus
atgcaccaaatgactcgaccgatca

SEQ ID NO: 211305 - DNA, 25 bp, Mus musculus
atgcaccaatgtgagatctggcggg

SEQ ID NO: 211306 - DNA, 25 bp, Mus musculus
atgcaccaatgtgagcacacagcat

SEQ ID NO: 211307 - DNA, 25 bp, Mus musculus
atgcacccaactatactgtcactgc

SEQ ID NO: 211308 - DNA, 25 bp, Mus musculus
atgcacctacggcccagaccaccgg

SEQ ID NO: 211309 - DNA, 25 bp, Mus musculus
atgcacctcaagagggagagaaaat

SEQ ID NO: 211310 - DNA, 25 bp, Mus musculus
atgcacctcaagaggtacctaagag

SEQ ID NO: 211311 - DNA, 25 bp, Mus musculus
atgcacctggaagatgctggagacc

SEQ ID NO: 211312 - DNA, 25 bp, Mus musculus
atgcacctggaaggtatgacattat

SEQ ID NO: 211313 - DNA, 25 bp, Mus musculus
atgcacgaaggatggcgagacacca

SEQ ID NO: 211314 - DNA, 25 bp, Mus musculus
atgcacgactccgctctcactcttg

SEQ ID NO: 211315 - DNA, 25 bp, Mus musculus
atgcacggagttgtgggaccgtacg

SEQ ID NO: 211316 - DNA, 25 bp, Mus musculus
atgcacgggaaggaagtgggcagca

SEQ ID NO: 211317 - DNA, 25 bp, Mus musculus
atgcactagcaggtatggcggctct

SEQ ID NO: 211318 - DNA, 25 bp, Mus musculus
atgcactagcagttgctcaaatgct

SEQ ID NO: 211319 - DNA, 25 bp, Mus musculus
atgcactcaactggctcgggagcct

SEQ ID NO: 211320 - DNA, 25 bp, Mus musculus
atgcactcactgtgagcacagcggc

SEQ ID NO: 211321 - DNA, 25 bp, Mus musculus
atgcactcagggtgactacaaccag

SEQ ID NO: 211322 - DNA, 25 bp, Mus musculus
atgcactcaggttgaaggtggagga

SEQ ID NO: 211323 - DNA, 25 bp, Mus musculus
atgcactcctcccagcagttatgat

SEQ ID NO: 211324 - DNA, 25 bp, Mus musculus
atgcactcctggatatccggcgcca

SEQ ID NO: 211325 - DNA, 25 bp, Mus musculus
atgcactgcagaaggctctgaagga

SEQ ID NO: 211326 - DNA, 25 bp, Mus musculus
atgcactgtaacgagcgcttgtaca

SEQ ID NO: 211327 - DNA, 25 bp, Mus musculus
atgcactgtcagaacaagcctgcca

SEQ ID NO: 211328 - DNA, 25 bp, Mus musculus
atgcactgtcaggttccgagtccga

SEQ ID NO: 211329 - DNA, 25 bp, Mus musculus
atgcacttcggggaggacagggtaa

SEQ ID NO: 211330 - DNA, 25 bp, Mus musculus
atgcacttcggggaggtggccaagc

SEQ ID NO: 211331 - DNA, 25 bp, Mus musculus
atgcagaaaaagcttcaaactctcc

SEQ ID NO: 211332 - DNA, 25 bp, Mus musculus
atgcagaaagcaggattcctctact

SEQ ID NO: 211333 - DNA, 25 bp, Mus musculus
atgcagaaagcaggtcatccgggtg

SEQ ID NO: 211334 - DNA, 25 bp, Mus musculus
atgcagaacagtcacagcggagtga

SEQ ID NO: 211335 - DNA, 25 bp, Mus musculus
atgcagaagagaagaaaaattcaac

SEQ ID NO: 211336 - DNA, 25 bp, Mus musculus
atgcagaagagttagcaaaacgtgg

SEQ ID NO: 211337 - DNA, 25 bp, Mus musculus
atgcagaatgcagagtacagttgtg

SEQ ID NO: 211338 - DNA, 25 bp, Mus musculus
atgcagaatgcaggtggaccctcag

SEQ ID NO: 211339 - DNA, 25 bp, Mus musculus
atgcagacaaagatggggcaaatct

SEQ ID NO: 211340 - DNA, 25 bp, Mus musculus
atgcagacacgagatcttgtacaac

SEQ ID NO: 211341 - DNA, 25 bp, Mus musculus
atgcagacaggcttcgccggcagga

SEQ ID NO: 211342 - DNA, 25 bp, Mus musculus
atgcagacagtgtggcatcagctat

SEQ ID NO: 211343 - DNA, 25 bp, Mus musculus
atgcagaccacccaggctttaaaga

SEQ ID NO: 211344 - DNA, 25 bp, Mus musculus
atgcagaccatggggccgaggagga

SEQ ID NO: 211345 - DNA, 25 bp, Mus musculus
atgcagactaaaggcatgcagtatg

SEQ ID NO: 211346 - DNA, 25 bp, Mus musculus
atgcagactaaaggtgttgacagct

SEQ ID NO: 211347 - DNA, 25 bp, Mus musculus
atgcagactacagcggtcagcagag

SEQ ID NO: 211348 - DNA, 25 bp, Mus musculus
atgcagactcatggctgggctctac

SEQ ID NO: 211349 - DNA, 25 bp, Mus musculus
atgcagacttccacagcacagcccc

SEQ ID NO: 211350 - DNA, 25 bp, Mus musculus
atgcagacttccgggtctgacagag

SEQ ID NO: 211351 - DNA, 25 bp, Mus musculus
atgcagagacagatttgatcaaaaa

SEQ ID NO: 211352 - DNA, 25 bp, Mus musculus
atgcagagaccgctacatcagaaga

SEQ ID NO: 211353 - DNA, 25 bp, Mus musculus
atgcagagactgtgctgtatctggt

SEQ ID NO: 211354 - DNA, 25 bp, Mus musculus
atgcagagcaggtttgacatggctg

SEQ ID NO: 211355 - DNA, 25 bp, Mus musculus
atgcagagcgagatcaagaaatcca

SEQ ID NO: 211356 - DNA, 25 bp, Mus musculus
atgcagagcttaagccaatccatgg

SEQ ID NO: 211357 - DNA, 25 bp, Mus musculus
atgcagaggaccaaggaagccgtga

SEQ ID NO: 211358 - DNA, 25 bp, Mus musculus
atgcagaggtgacagatcccacaac

SEQ ID NO: 211359 - DNA, 25 bp, Mus musculus
atgcagagtcaaagatgttgatcct

SEQ ID NO: 211360 - DNA, 25 bp, Mus musculus
atgcagatggagatgcagccttatg

SEQ ID NO: 211361 - DNA, 25 bp, Mus musculus
atgcagatgggggcagagatgcagc

SEQ ID NO: 211362 - DNA, 25 bp, Mus musculus
atgcagatgggtggcaagacattgt

SEQ ID NO: 211363 - DNA, 25 bp, Mus musculus
atgcagcaaagagttccaacaccca

SEQ ID NO: 211364 - DNA, 25 bp, Mus musculus
atgcagcaaaggaaggacagacgaa

SEQ ID NO: 211365 - DNA, 25 bp, Mus musculus
atgcagcaaccaagctgtgattgga

SEQ ID NO: 211366 - DNA, 25 bp, Mus musculus
atgcagcaaccaaggagacagtgat

SEQ ID NO: 211367 - DNA, 25 bp, Mus musculus
atgcagcacaacccttccaggcaga

SEQ ID NO: 211368 - DNA, 25 bp, Mus musculus
atgcagcacagcagatttaggaccg

SEQ ID NO: 211369 - DNA, 25 bp, Mus musculus
atgcagcacagcagggacagggtgg

SEQ ID NO: 211370 - DNA, 25 bp, Mus musculus
atgcagcaccctgacacccagggct

SEQ ID NO: 211371 - DNA, 25 bp, Mus musculus
atgcagcaccctgccagtggcccag

SEQ ID NO: 211372 - DNA, 25 bp, Mus musculus
atgcagcacctgatagctcgggagg

SEQ ID NO: 211373 - DNA, 25 bp, Mus musculus
atgcagcagaacctggaagctatgc

SEQ ID NO: 211374 - DNA, 25 bp, Mus musculus
atgcagcagcttagagaagctgatg

SEQ ID NO: 211375 - DNA, 25 bp, Mus musculus
atgcagcagcttagggatacaagtt

SEQ ID NO: 211376 - DNA, 25 bp, Mus musculus
atgcagcagtatgccttcctcaagc

SEQ ID NO: 211377 - DNA, 25 bp, Mus musculus
atgcagcatctgaggaacaagcaat

SEQ ID NO: 211378 - DNA, 25 bp, Mus musculus
atgcagcatctgaggaagactcttc

SEQ ID NO: 211379 - DNA, 25 bp, Mus musculus
atgcagcatgaaaggatcttctacc

SEQ ID NO: 211380 - DNA, 25 bp, Mus musculus
atgcagccagcgggtattcccctac

SEQ ID NO: 211381 - DNA, 25 bp, Mus musculus
atgcagccaggcgatgacgtggtct

SEQ ID NO: 211382 - DNA, 25 bp, Mus musculus
atgcagccagggcctgtgtttggaa

SEQ ID NO: 211383 - DNA, 25 bp, Mus musculus
atgcagcccttttgatctcttggga

SEQ ID NO: 211384 - DNA, 25 bp, Mus musculus
atgcagccgctggatccagccgcag

SEQ ID NO: 211385 - DNA, 25 bp, Mus musculus
atgcagcgactggctctggtccttc

SEQ ID NO: 211386 - DNA, 25 bp, Mus musculus
atgcagcgcgcagacgggtccagtg

SEQ ID NO: 211387 - DNA, 25 bp, Mus musculus
atgcagcgcgcagcccctggaggaa

SEQ ID NO: 211388 - DNA, 25 bp, Mus musculus
atgcagctaaagatgaacatgaaac

SEQ ID NO: 211389 - DNA, 25 bp, Mus musculus
atgcagctccccaccacttacttgt

SEQ ID NO: 211390 - DNA, 25 bp, Mus musculus
atgcagctgaggcgtaagttggatt

SEQ ID NO: 211391 - DNA, 25 bp, Mus musculus
atgcagctgagtccacgtgaagtca

SEQ ID NO: 211392 - DNA, 25 bp, Mus musculus
atgcagctgcaaaggagggctgctg

SEQ ID NO: 211393 - DNA, 25 bp, Mus musculus
atgcagctgccatcaaacttcagga

SEQ ID NO: 211394 - DNA, 25 bp, Mus musculus
atgcagctggtggagcactacacca

SEQ ID NO: 211395 - DNA, 25 bp, Mus musculus
atgcaggaagcgctgctccgaaaga

SEQ ID NO: 211396 - DNA, 25 bp, Mus musculus
atgcaggaagctcagatgctgcagt

SEQ ID NO: 211397 - DNA, 25 bp, Mus musculus
atgcaggaatatttaaggctgcaag

SEQ ID NO: 211398 - DNA, 25 bp, Mus musculus
atgcaggacagggaggtactgatac

SEQ ID NO: 211399 - DNA, 25 bp, Mus musculus
atgcaggacagggaggttccagaat

SEQ ID NO: 211400 - DNA, 25 bp, Mus musculus
atgcaggactgtctccttagtgcat

SEQ ID NO: 211401 - DNA, 25 bp, Mus musculus
atgcaggagctacggaggaggcaaa

SEQ ID NO: 211402 - DNA, 25 bp, Mus musculus
atgcaggagctacggatagcgaggt

SEQ ID NO: 211403 - DNA, 25 bp, Mus musculus
atgcaggaggaggagcatatgctgg

SEQ ID NO: 211404 - DNA, 25 bp, Mus musculus
atgcaggatgccagccccgccttcc

SEQ ID NO: 211405 - DNA, 25 bp, Mus musculus
atgcaggcacaagcctccattgagg

SEQ ID NO: 211406 - DNA, 25 bp, Mus musculus
atgcaggcactgcacgagtctgaga

SEQ ID NO: 211407 - DNA, 25 bp, Mus musculus
atgcaggcccaagcctccattgagg

SEQ ID NO: 211408 - DNA, 25 bp, Mus musculus
atgcaggcccaaggtctccatggtg

SEQ ID NO: 211409 - DNA, 25 bp, Mus musculus
atgcaggccgcattaggaggaagag

SEQ ID NO: 211410 - DNA, 25 bp, Mus musculus
atgcaggccgcattgctgctcagag

SEQ ID NO: 211411 - DNA, 25 bp, Mus musculus
atgcaggctacgaatttaaagagga

SEQ ID NO: 211412 - DNA, 25 bp, Mus musculus
atgcaggctgtcagatttatgcagg

SEQ ID NO: 211413 - DNA, 25 bp, Mus musculus
atgcaggctgtcagctcgttcgtgt

SEQ ID NO: 211414 - DNA, 25 bp, Mus musculus
atgcaggcttatgctttgatccagt

SEQ ID NO: 211415 - DNA, 25 bp, Mus musculus
atgcagggcagcgaggttgtaagtg

SEQ ID NO: 211416 - DNA, 25 bp, Mus musculus
atgcagggcagcgattgtaagtgtc

SEQ ID NO: 211417 - DNA, 25 bp, Mus musculus
atgcagggccagaaggagctcccag

SEQ ID NO: 211418 - DNA, 25 bp, Mus musculus
atgcagggccagaaggtgatggtgc

SEQ ID NO: 211419 - DNA, 25 bp, Mus musculus
atgcagggctgctaaccccgagatg

SEQ ID NO: 211420 - DNA, 25 bp, Mus musculus
atgcagggctgctctagaagtcaag

SEQ ID NO: 211421 - DNA, 25 bp, Mus musculus
atgcagggtgaaaggggaacatctc

SEQ ID NO: 211422 - DNA, 25 bp, Mus musculus
atgcagggtgaaagggtgggatgct

SEQ ID NO: 211423 - DNA, 25 bp, Mus musculus
atgcaggtcttgtgagtaacatttc

SEQ ID NO: 211424 - DNA, 25 bp, Mus musculus
atgcaggtgcaaagagctgaggacc

SEQ ID NO: 211425 - DNA, 25 bp, Mus musculus
atgcagtagaagccatgctggccct

SEQ ID NO: 211426 - DNA, 25 bp, Mus musculus
atgcagtattagtgctacagcctgc

SEQ ID NO: 211427 - DNA, 25 bp, Mus musculus
atgcagtcccaggaggatctcccag

SEQ ID NO: 211428 - DNA, 25 bp, Mus musculus
atgcagtgcaggcaatacagagtgc

SEQ ID NO: 211429 - DNA, 25 bp, Mus musculus
atgcagtggctggcatgctacaaat

SEQ ID NO: 211430 - DNA, 25 bp, Mus musculus
atgcagtgtaaagattgcaaattca

SEQ ID NO: 211431 - DNA, 25 bp, Mus musculus
atgcagtgtggctagcaagctgcct

SEQ ID NO: 211432 - DNA, 25 bp, Mus musculus
atgcagtgtgtgaagcaaggagaac

SEQ ID NO: 211433 - DNA, 25 bp, Mus musculus
atgcagtgtgtggcacctctgcagt

SEQ ID NO: 211434 - DNA, 25 bp, Mus musculus
atgcagttaagagaacagcacatta

SEQ ID NO: 211435 - DNA, 25 bp, Mus musculus
atgcagttaagaggatcgctgcaga

SEQ ID NO: 211436 - DNA, 25 bp, Mus musculus
atgcagttatgcagaacttgtcaca

SEQ ID NO: 211437 - DNA, 25 bp, Mus musculus
atgcagttctcgttgtgaaaatgtc

SEQ ID NO: 211438 - DNA, 25 bp, Mus musculus
atgcagttgtggtatcccaagggtt

SEQ ID NO: 211439 - DNA, 25 bp, Mus musculus
atgcagttgtgtgactatgcaagct

SEQ ID NO: 211440 - DNA, 25 bp, Mus musculus
atgcagttgtgtgggtgaatgggat

SEQ ID NO: 211441 - DNA, 25 bp, Mus musculus
atgcataaacaggctgagattgtga

SEQ ID NO: 211442 - DNA, 25 bp, Mus musculus
atgcataaacaggctgagatttgag

SEQ ID NO: 211443 - DNA, 25 bp, Mus musculus
atgcataaattgaatctgtataaac

SEQ ID NO: 211444 - DNA, 25 bp, Mus musculus
atgcataatcttggtggagaaactc

SEQ ID NO: 211445 - DNA, 25 bp, Mus musculus
atgcatcactaggaacagcatctga

SEQ ID NO: 211446 - DNA, 25 bp, Mus musculus
atgcatcagaaaaggtgactaataa

SEQ ID NO: 211447 - DNA, 25 bp, Mus musculus
atgcatcattgtcgctgcccaggca

SEQ ID NO: 211448 - DNA, 25 bp, Mus musculus
atgcatcatttgaacaatgcccagc

SEQ ID NO: 211449 - DNA, 25 bp, Mus musculus
atgcatcatttgactgaggaccatt

SEQ ID NO: 211450 - DNA, 25 bp, Mus musculus
atgcatccaagaaggatcctgtagc

SEQ ID NO: 211451 - DNA, 25 bp, Mus musculus
atgcatccaaggctgtcggcgagcc

SEQ ID NO: 211452 - DNA, 25 bp, Mus musculus
atgcatccacagagcttggctgaag

SEQ ID NO: 211453 - DNA, 25 bp, Mus musculus
atgcatcccacagggtggtcatgat

SEQ ID NO: 211454 - DNA, 25 bp, Mus musculus
atgcatccgtatcaactcaacaagg

SEQ ID NO: 211455 - DNA, 25 bp, Mus musculus
atgcatccgtatcaagacatgttca

SEQ ID NO: 211456 - DNA, 25 bp, Mus musculus
atgcatcctggcaggggacccagcc

SEQ ID NO: 211457 - DNA, 25 bp, Mus musculus
atgcatctgagccttctaggaaaga

SEQ ID NO: 211458 - DNA, 25 bp, Mus musculus
atgcatgaatatacagagtaagtct

SEQ ID NO: 211459 - DNA, 25 bp, Mus musculus
atgcatgcatgtggtcaacctgttg

SEQ ID NO: 211460 - DNA, 25 bp, Mus musculus
atgcatgccaggttcccactatgta

SEQ ID NO: 211461 - DNA, 25 bp, Mus musculus
atgcatggaaaggaagttggcagta

SEQ ID NO: 211462 - DNA, 25 bp, Mus musculus
atgcatgggcagacacagccctgga

SEQ ID NO: 211463 - DNA, 25 bp, Mus musculus
atgcatgtagatatggcagacgagg

SEQ ID NO: 211464 - DNA, 25 bp, Mus musculus
atgcatgtccaggttctcacgcggt

SEQ ID NO: 211465 - DNA, 25 bp, Mus musculus
atgcatgttgtcagggcctaagatc

SEQ ID NO: 211466 - DNA, 25 bp, Mus musculus
atgcatgttgtcaggggaagagatg

SEQ ID NO: 211467 - DNA, 25 bp, Mus musculus
atgcattaaatcagcaagccccgcc

SEQ ID NO: 211468 - DNA, 25 bp, Mus musculus
atgcattaattcaaaaaagatcatt

SEQ ID NO: 211469 - DNA, 25 bp, Mus musculus
atgcattcagaggtggggtaagtgc

SEQ ID NO: 211470 - DNA, 25 bp, Mus musculus
atgcattcaggggtgattcagacaa

SEQ ID NO: 211471 - DNA, 25 bp, Mus musculus
atgcattcagtgaaggatttgaact

SEQ ID NO: 211472 - DNA, 25 bp, Mus musculus
atgcattcttcaagagtttatccat

SEQ ID NO: 211473 - DNA, 25 bp, Mus musculus
atgcattgagacgtccgagataccc

SEQ ID NO: 211474 - DNA, 25 bp, Mus musculus
atgcattgctgaagatacgccaatg

SEQ ID NO: 211475 - DNA, 25 bp, Mus musculus
atgcattgctgaaggaatttgagca

SEQ ID NO: 211476 - DNA, 25 bp, Mus musculus
atgcatttcaggttaatatccttcc

SEQ ID NO: 211477 - DNA, 25 bp, Mus musculus
atgcatttctacagaacctgctttc

SEQ ID NO: 211478 - DNA, 25 bp, Mus musculus
atgcatttctcaggaaacacgatgg

SEQ ID NO: 211479 - DNA, 25 bp, Mus musculus
atgcatttgagtgacaaagtctaca

SEQ ID NO: 211480 - DNA, 25 bp, Mus musculus
atgcattttcacgacatccatgggg

SEQ ID NO: 211481 - DNA, 25 bp, Mus musculus
atgccaaaatcatgctgacacccag

SEQ ID NO: 211482 - DNA, 25 bp, Mus musculus
atgccaaaattgaagagaatcaaaa

SEQ ID NO: 211483 - DNA, 25 bp, Mus musculus
atgccaaacagagcatgctggagaa

SEQ ID NO: 211484 - DNA, 25 bp, Mus musculus
atgccaaacagctgcagagaaaagc

SEQ ID NO: 211485 - DNA, 25 bp, Mus musculus
atgccaaactccgtgtcgaccagct

SEQ ID NO: 211486 - DNA, 25 bp, Mus musculus
atgccaaagagatgaaggagtcagc

SEQ ID NO: 211487 - DNA, 25 bp, Mus musculus
atgccaaagccctgaatggcttcac

SEQ ID NO: 211488 - DNA, 25 bp, Mus musculus
atgccaaattagtgcatgaagttgc

SEQ ID NO: 211489 - DNA, 25 bp, Mus musculus
atgccaacagcactatagttccctc

SEQ ID NO: 211490 - DNA, 25 bp, Mus musculus
atgccaacgtgagagtcattcagaa

SEQ ID NO: 211491 - DNA, 25 bp, Mus musculus
atgccaacgtgagggagcctgtata

SEQ ID NO: 211492 - DNA, 25 bp, Mus musculus
atgccaagaccagggacggtctgac

SEQ ID NO: 211493 - DNA, 25 bp, Mus musculus
atgccaagacgaagaatggatacac

SEQ ID NO: 211494 - DNA, 25 bp, Mus musculus
atgccaagagcaagaaagtatgagt

SEQ ID NO: 211495 - DNA, 25 bp, Mus musculus
atgccaagaggaataaaaggaaaat

SEQ ID NO: 211496 - DNA, 25 bp, Mus musculus
atgccaagccatgaggcaagaaact

SEQ ID NO: 211497 - DNA, 25 bp, Mus musculus
atgccaaggaggagtcagacacaga

SEQ ID NO: 211498 - DNA, 25 bp, Mus musculus
atgccaaggaggtgagacggaaggc

SEQ ID NO: 211499 - DNA, 25 bp, Mus musculus
atgccaaggcaggctgtcaggttgt

SEQ ID NO: 211500 - DNA, 25 bp, Mus musculus
atgccaagtgccagaacaccaagct

SEQ ID NO: 211501 - DNA, 25 bp, Mus musculus
atgccaagtttgagcatgccaccag

SEQ ID NO: 211502 - DNA, 25 bp, Mus musculus
atgccaagtttgagtctggagacgt

SEQ ID NO: 211503 - DNA, 25 bp, Mus musculus
atgccaataaggctgtggaagaaat

SEQ ID NO: 211504 - DNA, 25 bp, Mus musculus
atgccaatgcgactgcttttttccg

SEQ ID NO: 211505 - DNA, 25 bp, Mus musculus
atgccaattgaggtcatgatgaatg

SEQ ID NO: 211506 - DNA, 25 bp, Mus musculus
atgccacaaaaggagccataattcc

SEQ ID NO: 211507 - DNA, 25 bp, Mus musculus
atgccacacagaggacggctgaacg

SEQ ID NO: 211508 - DNA, 25 bp, Mus musculus
atgccacagtttctcccatccccac

SEQ ID NO: 211509 - DNA, 25 bp, Mus musculus
atgccacatcctgtgccaataactt

SEQ ID NO: 211510 - DNA, 25 bp, Mus musculus
atgccaccatccgtgactgtcctgg

SEQ ID NO: 211511 - DNA, 25 bp, Mus musculus
atgccacctaggtttgaagactccc

SEQ ID NO: 211512 - DNA, 25 bp, Mus musculus
atgccacgctgagcaccatcaatca

SEQ ID NO: 211513 - DNA, 25 bp, Mus musculus
atgccacggaggatgaggatgagga

SEQ ID NO: 211514 - DNA, 25 bp, Mus musculus
atgccacggaggatgtcccgcatgg

SEQ ID NO: 211515 - DNA, 25 bp, Mus musculus
atgccactgaggagctcctagttaa

SEQ ID NO: 211516 - DNA, 25 bp, Mus musculus
atgccactgagtgaagcgtctgcct

SEQ ID NO: 211517 - DNA, 25 bp, Mus musculus
atgccacttccaaggtagcgttggt

SEQ ID NO: 211518 - DNA, 25 bp, Mus musculus
atgccagaaacacagatttacctta

SEQ ID NO: 211519 - DNA, 25 bp, Mus musculus
atgccagaaacacagggggtgcagc

SEQ ID NO: 211520 - DNA, 25 bp, Mus musculus
atgccagaacagatagtcgtacaag

SEQ ID NO: 211521 - DNA, 25 bp, Mus musculus
atgccagaaggaggcggcgctctcg

SEQ ID NO: 211522 - DNA, 25 bp, Mus musculus
atgccagaatagaaggccgttgact

SEQ ID NO: 211523 - DNA, 25 bp, Mus musculus
atgccagacttaaagatttcacagg

SEQ ID NO: 211524 - DNA, 25 bp, Mus musculus
atgccagacttaaagtggcccagac

SEQ ID NO: 211525 - DNA, 25 bp, Mus musculus
atgccagagcatggggctctctttg

SEQ ID NO: 211526 - DNA, 25 bp, Mus musculus
atgccagatgaggagtccctggtgc

SEQ ID NO: 211527 - DNA, 25 bp, Mus musculus
atgccagatgaggatcatggctgct

SEQ ID NO: 211528 - DNA, 25 bp, Mus musculus
atgccagatgatcttcccccaccac

SEQ ID NO: 211529 - DNA, 25 bp, Mus musculus
atgccagcacccgccgccgctcctc

SEQ ID NO: 211530 - DNA, 25 bp, Mus musculus
atgccagcagtctgtatgaggattg

SEQ ID NO: 211531 - DNA, 25 bp, Mus musculus
atgccagcatcagggagcctgtata

SEQ ID NO: 211532 - DNA, 25 bp, Mus musculus
atgccagcatgtctgattgcctcat

SEQ ID NO: 211533 - DNA, 25 bp, Mus musculus
atgccagcccactggaagccgaagc

SEQ ID NO: 211534 - DNA, 25 bp, Mus musculus
atgccagccgatggaaaggtcaatt

SEQ ID NO: 211535 - DNA, 25 bp, Mus musculus
atgccagcgccgctttcccgaaaga

SEQ ID NO: 211536 - DNA, 25 bp, Mus musculus
atgccaggcaagaaaaggaacaccg

SEQ ID NO: 211537 - DNA, 25 bp, Mus musculus
atgccagtaacaggcacatccagga

SEQ ID NO: 211538 - DNA, 25 bp, Mus musculus
atgccagtaatacattcaaactaca

SEQ ID NO: 211539 - DNA, 25 bp, Mus musculus
atgccagtgaagtgataagttgcaa

SEQ ID NO: 211540 - DNA, 25 bp, Mus musculus
atgccagtgtctcaggaatgtcaag

SEQ ID NO: 211541 - DNA, 25 bp, Mus musculus
atgccagtgtctcaggtgactccaa

SEQ ID NO: 211542 - DNA, 25 bp, Mus musculus
atgccagttaatgcttcaaactgtt

SEQ ID NO: 211543 - DNA, 25 bp, Mus musculus
atgccataaggaaatcctaccttga

SEQ ID NO: 211544 - DNA, 25 bp, Mus musculus
atgccatattgtttccatcctttat

SEQ ID NO: 211545 - DNA, 25 bp, Mus musculus
atgccatcaagaatgaggagattgt

SEQ ID NO: 211546 - DNA, 25 bp, Mus musculus
atgccatcactggccgagctctgct

SEQ ID NO: 211547 - DNA, 25 bp, Mus musculus
atgccatcagcccaggatgctatct

SEQ ID NO: 211548 - DNA, 25 bp, Mus musculus
atgccatcagcccaggcgattaaat

SEQ ID NO: 211549 - DNA, 25 bp, Mus musculus
atgccatcagtgaatcaaaggataa

SEQ ID NO: 211550 - DNA, 25 bp, Mus musculus
atgccatcgctgcattctgctctgg

SEQ ID NO: 211551 - DNA, 25 bp, Mus musculus
atgccatcggccaggtttggccgtc

SEQ ID NO: 211552 - DNA, 25 bp, Mus musculus
atgccatcggccagtgggatctggt

SEQ ID NO: 211553 - DNA, 25 bp, Mus musculus
atgccatcgtgaccatgctcaagct

SEQ ID NO: 211554 - DNA, 25 bp, Mus musculus
atgccatgaaacccaattccaaatc

SEQ ID NO: 211555 - DNA, 25 bp, Mus musculus
atgccatgaagcagaagggactcag

SEQ ID NO: 211556 - DNA, 25 bp, Mus musculus
atgccatgaagccattttcagtcaa

SEQ ID NO: 211557 - DNA, 25 bp, Mus musculus
atgccatgccaggaactccatggcg

SEQ ID NO: 211558 - DNA, 25 bp, Mus musculus
atgccatgccaggaggaaaggggaa

SEQ ID NO: 211559 - DNA, 25 bp, Mus musculus
atgccatggacgtgactgcacccca

SEQ ID NO: 211560 - DNA, 25 bp, Mus musculus
atgccattattgctttcgaggacgc

SEQ ID NO: 211561 - DNA, 25 bp, Mus musculus
atgccattccaggtaaatgggccag

SEQ ID NO: 211562 - DNA, 25 bp, Mus musculus
atgccatttcagcaggatagtcatt

SEQ ID NO: 211563 - DNA, 25 bp, Mus musculus
atgccatttcagcaggttcaggcgc

SEQ ID NO: 211564 - DNA, 25 bp, Mus musculus
atgcccaaaagaaaggctgaagggg

SEQ ID NO: 211565 - DNA, 25 bp, Mus musculus
atgcccaagagcgatctagggcggc

SEQ ID NO: 211566 - DNA, 25 bp, Mus musculus
atgcccaatggcacccaggcccgtg

SEQ ID NO: 211567 - DNA, 25 bp, Mus musculus
atgcccaccagagcgagtacattgc

SEQ ID NO: 211568 - DNA, 25 bp, Mus musculus
atgcccaccagttgacagggctgga

SEQ ID NO: 211569 - DNA, 25 bp, Mus musculus
atgcccacgtcaccctggtcttcct

SEQ ID NO: 211570 - DNA, 25 bp, Mus musculus
atgcccactggacttcaggaaccat

SEQ ID NO: 211571 - DNA, 25 bp, Mus musculus
atgcccaggaaagagcccaagatga

SEQ ID NO: 211572 - DNA, 25 bp, Mus musculus
atgcccaggaaagtttctatgttgt

SEQ ID NO: 211573 - DNA, 25 bp, Mus musculus
atgcccaggacagaggattccctgt

SEQ ID NO: 211574 - DNA, 25 bp, Mus musculus
atgcccaggagaaactgggagctga

SEQ ID NO: 211575 - DNA, 25 bp, Mus musculus
atgcccaggagaaagctattacaag

SEQ ID NO: 211576 - DNA, 25 bp, Mus musculus
atgcccaggagactttccttctgtc

SEQ ID NO: 211577 - DNA, 25 bp, Mus musculus
atgcccaggagagtttccttctgtc

SEQ ID NO: 211578 - DNA, 25 bp, Mus musculus
atgcccaggcccaaatgtaccgtct

SEQ ID NO: 211579 - DNA, 25 bp, Mus musculus
atgcccagtgcctatgcttgtggtc

SEQ ID NO: 211580 - DNA, 25 bp, Mus musculus
atgcccatccggttccagtggtggc

SEQ ID NO: 211581 - DNA, 25 bp, Mus musculus
atgcccatccgttcaattccacgca

SEQ ID NO: 211582 - DNA, 25 bp, Mus musculus
atgcccatgacaagctccaccgcac

SEQ ID NO: 211583 - DNA, 25 bp, Mus musculus
atgcccatgatgggcctggtttgga

SEQ ID NO: 211584 - DNA, 25 bp, Mus musculus
atgcccatgccctgtgatcagacca

SEQ ID NO: 211585 - DNA, 25 bp, Mus musculus
atgcccattctcagcatcatgctgg

SEQ ID NO: 211586 - DNA, 25 bp, Mus musculus
atgccccaagattcagtcccaagtc

SEQ ID NO: 211587 - DNA, 25 bp, Mus musculus
atgccccaaggaaagagtgccaccc

SEQ ID NO: 211588 - DNA, 25 bp, Mus musculus
atgccccacttcagaaggcccgaaa

SEQ ID NO: 211589 - DNA, 25 bp, Mus musculus
atgccccacttcagtgtgtagaagg

SEQ ID NO: 211590 - DNA, 25 bp, Mus musculus
atgccccaggaaacacaattagaag

SEQ ID NO: 211591 - DNA, 25 bp, Mus musculus
atgccccaggtaacacaattagaag

SEQ ID NO: 211592 - DNA, 25 bp, Mus musculus
atgcccccaagagatcccgtttcat

SEQ ID NO: 211593 - DNA, 25 bp, Mus musculus
atgcccccaaggacttaaaagagga

SEQ ID NO: 211594 - DNA, 25 bp, Mus musculus
atgcccccacttaatgcccaaagga

SEQ ID NO: 211595 - DNA, 25 bp, Mus musculus
atgccccccaggagagtgtgctggg

SEQ ID NO: 211596 - DNA, 25 bp, Mus musculus
atgcccccgcaaggagatggagttc

SEQ ID NO: 211597 - DNA, 25 bp, Mus musculus
atgccccgtaacaggaattatttta

SEQ ID NO: 211598 - DNA, 25 bp, Mus musculus
atgcccctggctgaggcagagcagc

SEQ ID NO: 211599 - DNA, 25 bp, Mus musculus
atgcccctgtcatctctcaccctcg

SEQ ID NO: 211600 - DNA, 25 bp, Mus musculus
atgcccctgttggaattcgacaccg

SEQ ID NO: 211601 - DNA, 25 bp, Mus musculus
atgcccgaaggagccgggtcaaacc

SEQ ID NO: 211602 - DNA, 25 bp, Mus musculus
atgcccgaaggtagagaaacctagt

SEQ ID NO: 211603 - DNA, 25 bp, Mus musculus
atgcccggaattgaaagaatttgcc

SEQ ID NO: 211604 - DNA, 25 bp, Mus musculus
atgcccggcttagaactctccgctg

SEQ ID NO: 211605 - DNA, 25 bp, Mus musculus
atgcccgggacaaagggtgaagcag

SEQ ID NO: 211606 - DNA, 25 bp, Mus musculus
atgccctgcaccactttgccagcac

SEQ ID NO: 211607 - DNA, 25 bp, Mus musculus
atgccctgcagggtttgtccgccct

SEQ ID NO: 211608 - DNA, 25 bp, Mus musculus
atgccctgcaggtcaatgtgattga

SEQ ID NO: 211609 - DNA, 25 bp, Mus musculus
atgccctggacgttgagtgtggaaa

SEQ ID NO: 211610 - DNA, 25 bp, Mus musculus
atgccctggccgaggaagccgagat

SEQ ID NO: 211611 - DNA, 25 bp, Mus musculus
atgccctgggagacggggttgaccg

SEQ ID NO: 211612 - DNA, 25 bp, Mus musculus
atgccctgtggctatattgctgcct

SEQ ID NO: 211613 - DNA, 25 bp, Mus musculus
atgccctgtggcttcattttccagt

SEQ ID NO: 211614 - DNA, 25 bp, Mus musculus
atgcccttagatttctacacgagaa

SEQ ID NO: 211615 - DNA, 25 bp, Mus musculus
atgcccttcggcaaggtcggaacct

SEQ ID NO: 211616 - DNA, 25 bp, Mus musculus
atgcccttcgggagacaaatgtgcg

SEQ ID NO: 211617 - DNA, 25 bp, Mus musculus
atgcccttcgggagccatcaagagt

SEQ ID NO: 211618 - DNA, 25 bp, Mus musculus
atgcccttttcccgtgtgttcaggg

SEQ ID NO: 211619 - DNA, 25 bp, Mus musculus
atgccgagatggcacgttttgtgcc

SEQ ID NO: 211620 - DNA, 25 bp, Mus musculus
atgccgatggagctgtcttgcaggt

SEQ ID NO: 211621 - DNA, 25 bp, Mus musculus
atgccgatgtaccaggaaacatccg

SEQ ID NO: 211622 - DNA, 25 bp, Mus musculus
atgccgcagggaagagcgggctaac

SEQ ID NO: 211623 - DNA, 25 bp, Mus musculus
atgccgccacaaagaaaggaaacac

SEQ ID NO: 211624 - DNA, 25 bp, Mus musculus
atgccgctgaagagcgtattgaagg

SEQ ID NO: 211625 - DNA, 25 bp, Mus musculus
atgccgcttgcgtggctcggatggc

SEQ ID NO: 211626 - DNA, 25 bp, Mus musculus
atgccggaagcagtagctaagatgc

SEQ ID NO: 211627 - DNA, 25 bp, Mus musculus
atgccgggatcaaggcagagatgct

SEQ ID NO: 211628 - DNA, 25 bp, Mus musculus
atgccggtgagtacgcctgctaagc

SEQ ID NO: 211629 - DNA, 25 bp, Mus musculus
atgccgtcatgtcccggaacagcct

SEQ ID NO: 211630 - DNA, 25 bp, Mus musculus
atgccgtcctgcaccaacctgcgag

SEQ ID NO: 211631 - DNA, 25 bp, Mus musculus
atgccgtggaggaccccagcagcat

SEQ ID NO: 211632 - DNA, 25 bp, Mus musculus
atgccgttgactgtgtactcgattt

SEQ ID NO: 211633 - DNA, 25 bp, Mus musculus
atgcctaaagggtatgtgtatttgg

SEQ ID NO: 211634 - DNA, 25 bp, Mus musculus
atgcctaactttcagttcaaaccgg

SEQ ID NO: 211635 - DNA, 25 bp, Mus musculus
atgcctacagctcttaacctttaca

SEQ ID NO: 211636 - DNA, 25 bp, Mus musculus
atgcctacaggttcttcttcacata

SEQ ID NO: 211637 - DNA, 25 bp, Mus musculus
atgcctaccccaaaaattatggacc

SEQ ID NO: 211638 - DNA, 25 bp, Mus musculus
atgcctagaagagtggttcttcgag

SEQ ID NO: 211639 - DNA, 25 bp, Mus musculus
atgcctagaaggggcaatgtcatca

SEQ ID NO: 211640 - DNA, 25 bp, Mus musculus
atgcctcacctgctccaggtttcct

SEQ ID NO: 211641 - DNA, 25 bp, Mus musculus
atgcctcacctgggtgctacagaag

SEQ ID NO: 211642 - DNA, 25 bp, Mus musculus
atgcctcagtggtgggttttttcag

SEQ ID NO: 211643 - DNA, 25 bp, Mus musculus
atgcctccgtgctgggggcagaatc

SEQ ID NO: 211644 - DNA, 25 bp, Mus musculus
atgcctcggcggtgttcacctacaa

SEQ ID NO: 211645 - DNA, 25 bp, Mus musculus
atgcctctaaaaacccacaactcct

SEQ ID NO: 211646 - DNA, 25 bp, Mus musculus
atgcctctaaaaagccacaactcct

SEQ ID NO: 211647 - DNA, 25 bp, Mus musculus
atgcctctaggttccagcagcactg

SEQ ID NO: 211648 - DNA, 25 bp, Mus musculus
atgcctctcttggaattaaaggaca

SEQ ID NO: 211649 - DNA, 25 bp, Mus musculus
atgcctcttacgtgtgttctcaggg

SEQ ID NO: 211650 - DNA, 25 bp, Mus musculus
atgcctgaaaaagaggcggcgggcc

SEQ ID NO: 211651 - DNA, 25 bp, Mus musculus
atgcctgaaaaaggtactgttggat

SEQ ID NO: 211652 - DNA, 25 bp, Mus musculus
atgcctgaagacgttattgctcggc

SEQ ID NO: 211653 - DNA, 25 bp, Mus musculus
atgcctgaaggctctggtgtcctcc

SEQ ID NO: 211654 - DNA, 25 bp, Mus musculus
atgcctgactcagactggttgggcg

SEQ ID NO: 211655 - DNA, 25 bp, Mus musculus
atgcctgactcaggcaggccagctt

SEQ ID NO: 211656 - DNA, 25 bp, Mus musculus
atgcctgagtgccagtgcccgcccc

SEQ ID NO: 211657 - DNA, 25 bp, Mus musculus
atgcctgatctttaggaggagcagg

SEQ ID NO: 211658 - DNA, 25 bp, Mus musculus
atgcctgcaggatctgccactgtga

SEQ ID NO: 211659 - DNA, 25 bp, Mus musculus
atgcctgcataaggttataagtaca

SEQ ID NO: 211660 - DNA, 25 bp, Mus musculus
atgcctgcataagtgagcaactgtt

SEQ ID NO: 211661 - DNA, 25 bp, Mus musculus
atgcctgccatgagacgaaagtagg

SEQ ID NO: 211662 - DNA, 25 bp, Mus musculus
atgcctgccatgaggaattcttcta

SEQ ID NO: 211663 - DNA, 25 bp, Mus musculus
atgcctgcctgcaaatttcaggtga

SEQ ID NO: 211664 - DNA, 25 bp, Mus musculus
atgcctgccttgaggacgggcagaa

SEQ ID NO: 211665 - DNA, 25 bp, Mus musculus
atgcctgccttgaggctggctactg

SEQ ID NO: 211666 - DNA, 25 bp, Mus musculus
atgcctgctatgagaaactccccaa

SEQ ID NO: 211667 - DNA, 25 bp, Mus musculus
atgcctgctgagcaagcgttttggt

SEQ ID NO: 211668 - DNA, 25 bp, Mus musculus
atgcctggatcaggaagcatatatt

SEQ ID NO: 211669 - DNA, 25 bp, Mus musculus
atgcctgggaggccatggaggaact

SEQ ID NO: 211670 - DNA, 25 bp, Mus musculus
atgcctgtcatgaggaactcagaaa

SEQ ID NO: 211671 - DNA, 25 bp, Mus musculus
atgcctgtcatgaggaactcagcca

SEQ ID NO: 211672 - DNA, 25 bp, Mus musculus
atgcctgtctggaaacaacctgatc

SEQ ID NO: 211673 - DNA, 25 bp, Mus musculus
atgcctgtgctagacagtgtgctca

SEQ ID NO: 211674 - DNA, 25 bp, Mus musculus
atgcctgtgctcaggggagaaaggc

SEQ ID NO: 211675 - DNA, 25 bp, Mus musculus
atgcctgtgctcaggtaatggaaaa

SEQ ID NO: 211676 - DNA, 25 bp, Mus musculus
atgcctgtggggctgcgaggcctga

SEQ ID NO: 211677 - DNA, 25 bp, Mus musculus
atgccttagtgggctgggtgggtga

SEQ ID NO: 211678 - DNA, 25 bp, Mus musculus
atgccttcaagaaagatgtccttgg

SEQ ID NO: 211679 - DNA, 25 bp, Mus musculus
atgccttcagacagaaaacgaagtc

SEQ ID NO: 211680 - DNA, 25 bp, Mus musculus
atgccttccaaggaaacctctgccg

SEQ ID NO: 211681 - DNA, 25 bp, Mus musculus
atgccttccaaggttgagagctgtt

SEQ ID NO: 211682 - DNA, 25 bp, Mus musculus
atgccttcccaccttcaaaactggt

SEQ ID NO: 211683 - DNA, 25 bp, Mus musculus
atgccttcccagaagaaaacatgaa

SEQ ID NO: 211684 - DNA, 25 bp, Mus musculus
atgccttcctgtcgatccccagcct

SEQ ID NO: 211685 - DNA, 25 bp, Mus musculus
atgccttcctgtgtgccctgctttc

SEQ ID NO: 211686 - DNA, 25 bp, Mus musculus
atgccttcctgtgtggaacaacgaa

SEQ ID NO: 211687 - DNA, 25 bp, Mus musculus
atgccttcttactgtgtcctactga

SEQ ID NO: 211688 - DNA, 25 bp, Mus musculus
atgccttgtgcctacttgagcatcg

SEQ ID NO: 211689 - DNA, 25 bp, Mus musculus
atgcctttccattggacacccccgc

SEQ ID NO: 211690 - DNA, 25 bp, Mus musculus
atgcctttctggagaaaaacaaaat

SEQ ID NO: 211691 - DNA, 25 bp, Mus musculus
atgcctttgacgtcctattaccagc

SEQ ID NO: 211692 - DNA, 25 bp, Mus musculus
atgcgaaattcaacatggccaatgc

SEQ ID NO: 211693 - DNA, 25 bp, Mus musculus
atgcgaagatagagatctggccgcc

SEQ ID NO: 211694 - DNA, 25 bp, Mus musculus
atgcgaagcagatttatggtctgca

SEQ ID NO: 211695 - DNA, 25 bp, Mus musculus
atgcgaagcagggtgtgcagattat

SEQ ID NO: 211696 - DNA, 25 bp, Mus musculus
atgcgaagctcccgccatgagaatt

SEQ ID NO: 211697 - DNA, 25 bp, Mus musculus
atgcgagccaagatggacaacggag

SEQ ID NO: 211698 - DNA, 25 bp, Mus musculus
atgcgagctgatggctttgtgcccc

SEQ ID NO: 211699 - DNA, 25 bp, Mus musculus
atgcgagctggtccctgagttggaa

SEQ ID NO: 211700 - DNA, 25 bp, Mus musculus
atgcgattcatctaaatggtgccat

SEQ ID NO: 211701 - DNA, 25 bp, Mus musculus
atgcgatttttgagaactgatagtg

SEQ ID NO: 211702 - DNA, 25 bp, Mus musculus
atgcgcacggtagcactcagcatgg

SEQ ID NO: 211703 - DNA, 25 bp, Mus musculus
atgcgcagagatggttggcctgcta

SEQ ID NO: 211704 - DNA, 25 bp, Mus musculus
atgcgccacgagaacgtcattgggc

SEQ ID NO: 211705 - DNA, 25 bp, Mus musculus
atgcgccacgagaactggacatttg

SEQ ID NO: 211706 - DNA, 25 bp, Mus musculus
atgcgccatgacaagatcgtgattg

SEQ ID NO: 211707 - DNA, 25 bp, Mus musculus
atgcgccccagcgccctgtgtgtca

SEQ ID NO: 211708 - DNA, 25 bp, Mus musculus
atgcgcgctagaagatgttaaagaa

SEQ ID NO: 211709 - DNA, 25 bp, Mus musculus
atgcgcgctagaagctactcaggtg

SEQ ID NO: 211710 - DNA, 25 bp, Mus musculus
atgcgctataaccgagactggtaca

SEQ ID NO: 211711 - DNA, 25 bp, Mus musculus
atgcgctataaccgggctgggcctg

SEQ ID NO: 211712 - DNA, 25 bp, Mus musculus
atgcgctgaggcccagtatagtgga

SEQ ID NO: 211713 - DNA, 25 bp, Mus musculus
atgcgctgtggggatggaaatgcag

SEQ ID NO: 211714 - DNA, 25 bp, Mus musculus
atgcggacaggcctgagtacttctg

SEQ ID NO: 211715 - DNA, 25 bp, Mus musculus
atgcggacaggccttgttttcatgc

SEQ ID NO: 211716 - DNA, 25 bp, Mus musculus
atgcggagagactgggatgagcaca

SEQ ID NO: 211717 - DNA, 25 bp, Mus musculus
atgcggagtacatgaagcacacagg

SEQ ID NO: 211718 - DNA, 25 bp, Mus musculus
atgcggatatgtggccgatctgtcc

SEQ ID NO: 211719 - DNA, 25 bp, Mus musculus
atgcggccgcccaagagtcctttgc

SEQ ID NO: 211720 - DNA, 25 bp, Mus musculus
atgcgggagaaggtttttcgttgga

SEQ ID NO: 211721 - DNA, 25 bp, Mus musculus
atgcgggagccaggagaacgggatg

SEQ ID NO: 211722 - DNA, 25 bp, Mus musculus
atgcgggagccagttccaggcgaat

SEQ ID NO: 211723 - DNA, 25 bp, Mus musculus
atgcgggcgcaaggcctctctttct

SEQ ID NO: 211724 - DNA, 25 bp, Mus musculus
atgcgggcgtcggttgggtttctct

SEQ ID NO: 211725 - DNA, 25 bp, Mus musculus
atgcggttacgaagaagaggaaagg

SEQ ID NO: 211726 - DNA, 25 bp, Mus musculus
atgcggttagtcgagaactgataga

SEQ ID NO: 211727 - DNA, 25 bp, Mus musculus
atgcgtacagaaaagcggcatctgt

SEQ ID NO: 211728 - DNA, 25 bp, Mus musculus
atgcgtacagccaggagtaggaaca

SEQ ID NO: 211729 - DNA, 25 bp, Mus musculus
atgcgtacagtagcatccgggctaa

SEQ ID NO: 211730 - DNA, 25 bp, Mus musculus
atgcgtaggaagggtggtgctgatc

SEQ ID NO: 211731 - DNA, 25 bp, Mus musculus
atgcgtcactgaccggaggaacaag

SEQ ID NO: 211732 - DNA, 25 bp, Mus musculus
atgcgtcagtggtcgcagacacttt

SEQ ID NO: 211733 - DNA, 25 bp, Mus musculus
atgcgtccaagctgtttcctctgca

SEQ ID NO: 211734 - DNA, 25 bp, Mus musculus
atgcgtccaaggcaaatttcaggtg

SEQ ID NO: 211735 - DNA, 25 bp, Mus musculus
atgcgtccaagtatctagcattcac

SEQ ID NO: 211736 - DNA, 25 bp, Mus musculus
atgcgtcgagcagagtgtctacatt

SEQ ID NO: 211737 - DNA, 25 bp, Mus musculus
atgcgtctaggtcttccaagttgct

SEQ ID NO: 211738 - DNA, 25 bp, Mus musculus
atgcgtctgccaggcagacggctct

SEQ ID NO: 211739 - DNA, 25 bp, Mus musculus
atgcgtcttcaggtaataaagctct

SEQ ID NO: 211740 - DNA, 25 bp, Mus musculus
atgcgtgatctgggtactgtggcaa

SEQ ID NO: 211741 - DNA, 25 bp, Mus musculus
atgcgtgccacagttcttgctgctg

SEQ ID NO: 211742 - DNA, 25 bp, Mus musculus
atgcgtgccagggcgacagtggagg

SEQ ID NO: 211743 - DNA, 25 bp, Mus musculus
atgcgtggcggagatggcgcggccg

SEQ ID NO: 211744 - DNA, 25 bp, Mus musculus
atgcgttcacagagtgcaaattcac

SEQ ID NO: 211745 - DNA, 25 bp, Mus musculus
atgcgttcttcacaggtggcttctg

SEQ ID NO: 211746 - DNA, 25 bp, Mus musculus
atgcgttgggatcagattgataagt

SEQ ID NO: 211747 - DNA, 25 bp, Mus musculus
atgctaaatatgttctagaagccca

SEQ ID NO: 211748 - DNA, 25 bp, Mus musculus
atgctaacaagagtgaaattccaca

SEQ ID NO: 211749 - DNA, 25 bp, Mus musculus
atgctaacaggaaaaattctccctg

SEQ ID NO: 211750 - DNA, 25 bp, Mus musculus
atgctaacaggggctaccagccaac

SEQ ID NO: 211751 - DNA, 25 bp, Mus musculus
atgctaactttccactatttgctgc

SEQ ID NO: 211752 - DNA, 25 bp, Mus musculus
atgctaagaaataagcagatccttg

SEQ ID NO: 211753 - DNA, 25 bp, Mus musculus
atgctaagaaataaggatcgttcat

SEQ ID NO: 211754 - DNA, 25 bp, Mus musculus
atgctaagaggggatgtgaagtgtt

SEQ ID NO: 211755 - DNA, 25 bp, Mus musculus
atgctaaggatgatctgatgatgag

SEQ ID NO: 211756 - DNA, 25 bp, Mus musculus
atgctaatagaagtagtccccacct

SEQ ID NO: 211757 - DNA, 25 bp, Mus musculus
atgctaataggccaggtggttgcag

SEQ ID NO: 211758 - DNA, 25 bp, Mus musculus
atgctaatagggaagaccgggccac

SEQ ID NO: 211759 - DNA, 25 bp, Mus musculus
atgctaatgcactgtctcaaaatca

SEQ ID NO: 211760 - DNA, 25 bp, Mus musculus
atgctacaaagacatccttctacgg

SEQ ID NO: 211761 - DNA, 25 bp, Mus musculus
atgctacaaaggaaagaattgaata

SEQ ID NO: 211762 - DNA, 25 bp, Mus musculus
atgctacaagcacaactcctaatag

SEQ ID NO: 211763 - DNA, 25 bp, Mus musculus
atgctacagagtggccaccctttgt

SEQ ID NO: 211764 - DNA, 25 bp, Mus musculus
atgctaccaacaagtatgaggtaga

SEQ ID NO: 211765 - DNA, 25 bp, Mus musculus
atgctaccagaagccagatgagagc

SEQ ID NO: 211766 - DNA, 25 bp, Mus musculus
atgctaccagcatttgatgaccagt

SEQ ID NO: 211767 - DNA, 25 bp, Mus musculus
atgctacgatagccatgagggcaga

SEQ ID NO: 211768 - DNA, 25 bp, Mus musculus
atgctacgatagccattcccttcag

SEQ ID NO: 211769 - DNA, 25 bp, Mus musculus
atgctacgcaggggaaatcctggcc

SEQ ID NO: 211770 - DNA, 25 bp, Mus musculus
atgctacggaggtgccttagctgga

SEQ ID NO: 211771 - DNA, 25 bp, Mus musculus
atgctactcaggggcagttggtgac

SEQ ID NO: 211772 - DNA, 25 bp, Mus musculus
atgctactgcaggtaaatgagatca

SEQ ID NO: 211773 - DNA, 25 bp, Mus musculus
atgctactgtgcgcaatggatctgt

SEQ ID NO: 211774 - DNA, 25 bp, Mus musculus
atgctagaaaaggttgcacgatttc

SEQ ID NO: 211775 - DNA, 25 bp, Mus musculus
atgctagaagaatataaaaatagta

SEQ ID NO: 211776 - DNA, 25 bp, Mus musculus
atgctagaaggtcccttcagcacac

SEQ ID NO: 211777 - DNA, 25 bp, Mus musculus
atgctagctctggtacacctacaca

SEQ ID NO: 211778 - DNA, 25 bp, Mus musculus
atgctagctgggcaagatggtgtca

SEQ ID NO: 211779 - DNA, 25 bp, Mus musculus
atgctaggaacaaagagaacctgca

SEQ ID NO: 211780 - DNA, 25 bp, Mus musculus
atgctaggaacaaagagaccccgag

SEQ ID NO: 211781 - DNA, 25 bp, Mus musculus
atgctaggaacaaaggtcaggtgcc

SEQ ID NO: 211782 - DNA, 25 bp, Mus musculus
atgctaggcaatggtcactcggacg

SEQ ID NO: 211783 - DNA, 25 bp, Mus musculus
atgctatagagctgtcatagcctgt

SEQ ID NO: 211784 - DNA, 25 bp, Mus musculus
atgctatagagtcgacaagcagtga

SEQ ID NO: 211785 - DNA, 25 bp, Mus musculus
atgctatagagtctggattttcctg

SEQ ID NO: 211786 - DNA, 25 bp, Mus musculus
atgctataggaggatctcccagaag

SEQ ID NO: 211787 - DNA, 25 bp, Mus musculus
atgctatccacgcagcctctgcctc

SEQ ID NO: 211788 - DNA, 25 bp, Mus musculus
atgctatccacgcagctgcccctta

SEQ ID NO: 211789 - DNA, 25 bp, Mus musculus
atgctatccagatgtacgtgccctg

SEQ ID NO: 211790 - DNA, 25 bp, Mus musculus
atgctatcgagatggtgacttgccg

SEQ ID NO: 211791 - DNA, 25 bp, Mus musculus
atgctatcgaggtttttaagcctat

SEQ ID NO: 211792 - DNA, 25 bp, Mus musculus
atgctatgactagagacctgcaggg

SEQ ID NO: 211793 - DNA, 25 bp, Mus musculus
atgctatgagctgatacaagtgatg

SEQ ID NO: 211794 - DNA, 25 bp, Mus musculus
atgctatgatcaacgcctgtaggga

SEQ ID NO: 211795 - DNA, 25 bp, Mus musculus
atgctatgtcagaaggcttatcagg

SEQ ID NO: 211796 - DNA, 25 bp, Mus musculus
atgctatgtcaggaaaccatccaat

SEQ ID NO: 211797 - DNA, 25 bp, Mus musculus
atgctattaaagctggtgagaaatg

SEQ ID NO: 211798 - DNA, 25 bp, Mus musculus
atgctattgctcaggccctggcaca

SEQ ID NO: 211799 - DNA, 25 bp, Mus musculus
atgctattggcttctcccatgatga

SEQ ID NO: 211800 - DNA, 25 bp, Mus musculus
atgctcaaagccatggtttgactct

SEQ ID NO: 211801 - DNA, 25 bp, Mus musculus
atgctcaaattcggggcttcctcga

SEQ ID NO: 211802 - DNA, 25 bp, Mus musculus
atgctcaaattcggtgcagcccgga

SEQ ID NO: 211803 - DNA, 25 bp, Mus musculus
atgctcaagtgtaagagtgtgtttg

SEQ ID NO: 211804 - DNA, 25 bp, Mus musculus
atgctcacaaggtgcagacctgaag

SEQ ID NO: 211805 - DNA, 25 bp, Mus musculus
atgctcacagagaacagtacactgg

SEQ ID NO: 211806 - DNA, 25 bp, Mus musculus
atgctcacaggaagttcattcaaaa

SEQ ID NO: 211807 - DNA, 25 bp, Mus musculus
atgctcactggatcgccgcccttca

SEQ ID NO: 211808 - DNA, 25 bp, Mus musculus
atgctcagacaaagatgggctacac

SEQ ID NO: 211809 - DNA, 25 bp, Mus musculus
atgctcagccagctgagggagtatg

SEQ ID NO: 211810 - DNA, 25 bp, Mus musculus
atgctcatagggtacagcatgtttg

SEQ ID NO: 211811 - DNA, 25 bp, Mus musculus
atgctcatggtagcgaccacctgca

SEQ ID NO: 211812 - DNA, 25 bp, Mus musculus
atgctcattgtgattatgtgggtac

SEQ ID NO: 211813 - DNA, 25 bp, Mus musculus
atgctcattgtggtactgataggtt

SEQ ID NO: 211814 - DNA, 25 bp, Mus musculus
atgctcccaacaggttctgggcctc

SEQ ID NO: 211815 - DNA, 25 bp, Mus musculus
atgctcccgctaagtcgtcagcgca

SEQ ID NO: 211816 - DNA, 25 bp, Mus musculus
atgctcccgctagtgttgcagaggt

SEQ ID NO: 211817 - DNA, 25 bp, Mus musculus
atgctccgaaagcatgtggaattcc

SEQ ID NO: 211818 - DNA, 25 bp, Mus musculus
atgctccgagccgctggtttgtcct

SEQ ID NO: 211819 - DNA, 25 bp, Mus musculus
atgctccgagggtctgactacagaa

SEQ ID NO: 211820 - DNA, 25 bp, Mus musculus
atgctccggggagaaaaatgtatac

SEQ ID NO: 211821 - DNA, 25 bp, Mus musculus
atgctcctccgggaagaatgggagt

SEQ ID NO: 211822 - DNA, 25 bp, Mus musculus
atgctcctccggtgccagtgacctt

SEQ ID NO: 211823 - DNA, 25 bp, Mus musculus
atgctcctgatgcgggagcacagtc

SEQ ID NO: 211824 - DNA, 25 bp, Mus musculus
atgctccttggctgaaccttcggga

SEQ ID NO: 211825 - DNA, 25 bp, Mus musculus
atgctcgcagaaaaagcagcgatgc

SEQ ID NO: 211826 - DNA, 25 bp, Mus musculus
atgctcggcttcagagcactaaagc

SEQ ID NO: 211827 - DNA, 25 bp, Mus musculus
atgctcggcttcagctggaaaggca

SEQ ID NO: 211828 - DNA, 25 bp, Mus musculus
atgctcggcttcaggtgaagctgag

SEQ ID NO: 211829 - DNA, 25 bp, Mus musculus
atgctcgggctgttgacagctagaa

SEQ ID NO: 211830 - DNA, 25 bp, Mus musculus
atgctcggggggaaggcccaaacaa

SEQ ID NO: 211831 - DNA, 25 bp, Mus musculus
atgctcgtctgatgtcatggctccg

SEQ ID NO: 211832 - DNA, 25 bp, Mus musculus
atgctcgtctgatgttcacctcacc

SEQ ID NO: 211833 - DNA, 25 bp, Mus musculus
atgctctacaagaattttacagccc

SEQ ID NO: 211834 - DNA, 25 bp, Mus musculus
atgctctacgagaaataccgacagt

SEQ ID NO: 211835 - DNA, 25 bp, Mus musculus
atgctctataaggatgttcgcaacc

SEQ ID NO: 211836 - DNA, 25 bp, Mus musculus
atgctctcacaggtccgctacagag

SEQ ID NO: 211837 - DNA, 25 bp, Mus musculus
atgctctcagaggttcctgacaccg

SEQ ID NO: 211838 - DNA, 25 bp, Mus musculus
atgctctcaggagttcctggtctga

SEQ ID NO: 211839 - DNA, 25 bp, Mus musculus
atgctctcaggctggcatcatgcca

SEQ ID NO: 211840 - DNA, 25 bp, Mus musculus
atgctctccctctagagtgcagagg

SEQ ID NO: 211841 - DNA, 25 bp, Mus musculus
atgctctcctgcaggaagtggacat

SEQ ID NO: 211842 - DNA, 25 bp, Mus musculus
atgctctctggtcttgtgcaactgt

SEQ ID NO: 211843 - DNA, 25 bp, Mus musculus
atgctctcttcattctcatacaaga

SEQ ID NO: 211844 - DNA, 25 bp, Mus musculus
atgctctgcaggcttcgagtacctt

SEQ ID NO: 211845 - DNA, 25 bp, Mus musculus
atgctctggctccagagaaatcttc

SEQ ID NO: 211846 - DNA, 25 bp, Mus musculus
atgctctgtgatgaccaagatcttc

SEQ ID NO: 211847 - DNA, 25 bp, Mus musculus
atgctcttcccccacagtcccagac

SEQ ID NO: 211848 - DNA, 25 bp, Mus musculus
atgctcttcctcgcgtttcatgcag

SEQ ID NO: 211849 - DNA, 25 bp, Mus musculus
atgctcttcgtctgctgggattcct

SEQ ID NO: 211850 - DNA, 25 bp, Mus musculus
atgctcttcgtgttccgctactgcc

SEQ ID NO: 211851 - DNA, 25 bp, Mus musculus
atgctgaaaagaatgatggaaactt

SEQ ID NO: 211852 - DNA, 25 bp, Mus musculus
atgctgaaaagagcaaggaacccct

SEQ ID NO: 211853 - DNA, 25 bp, Mus musculus
atgctgaaaagttgccagtagttat

SEQ ID NO: 211854 - DNA, 25 bp, Mus musculus
atgctgaaactgatgccatgcagaa

SEQ ID NO: 211855 - DNA, 25 bp, Mus musculus
atgctgaaactgtatgccatgttcc

SEQ ID NO: 211856 - DNA, 25 bp, Mus musculus
atgctgaaatggacgtatgttccat

SEQ ID NO: 211857 - DNA, 25 bp, Mus musculus
atgctgaaattacggccgagatcca

SEQ ID NO: 211858 - DNA, 25 bp, Mus musculus
atgctgaaattggatgcaaaacatc

SEQ ID NO: 211859 - DNA, 25 bp, Mus musculus
atgctgaacgctgagatcatctttc

SEQ ID NO: 211860 - DNA, 25 bp, Mus musculus
atgctgaataggtatctgatcaacg

SEQ ID NO: 211861 - DNA, 25 bp, Mus musculus
atgctgaataggtgaattgagacct

SEQ ID NO: 211862 - DNA, 25 bp, Mus musculus
atgctgaatcgaaaggctcaggtca

SEQ ID NO: 211863 - DNA, 25 bp, Mus musculus
atgctgaatgctaggtagaagccca

SEQ ID NO: 211864 - DNA, 25 bp, Mus musculus
atgctgacaaagcaaatgaaaagaa

SEQ ID NO: 211865 - DNA, 25 bp, Mus musculus
atgctgacagatcgggagaatcagt

SEQ ID NO: 211866 - DNA, 25 bp, Mus musculus
atgctgacagctcctcatggactcc

SEQ ID NO: 211867 - DNA, 25 bp, Mus musculus
atgctgacaggtcctcatggactcc

SEQ ID NO: 211868 - DNA, 25 bp, Mus musculus
atgctgacatggtcaaccagtacag

SEQ ID NO: 211869 - DNA, 25 bp, Mus musculus
atgctgacattactggcatgcctgt

SEQ ID NO: 211870 - DNA, 25 bp, Mus musculus
atgctgaccagatcgtgagacatga

SEQ ID NO: 211871 - DNA, 25 bp, Mus musculus
atgctgaccaggatcttcccaacaa

SEQ ID NO: 211872 - DNA, 25 bp, Mus musculus
atgctgaccaggcagttctagatga

SEQ ID NO: 211873 - DNA, 25 bp, Mus musculus
atgctgacggaccccggcaggagga

SEQ ID NO: 211874 - DNA, 25 bp, Mus musculus
atgctgacggacccctgtttgtaag

SEQ ID NO: 211875 - DNA, 25 bp, Mus musculus
atgctgactcgagcattgcagagct

SEQ ID NO: 211876 - DNA, 25 bp, Mus musculus
atgctgactcggctgaaagcaaaat

SEQ ID NO: 211877 - DNA, 25 bp, Mus musculus
atgctgactcgggttatcttctctg

SEQ ID NO: 211878 - DNA, 25 bp, Mus musculus
atgctgactgacccttcctacctat

SEQ ID NO: 211879 - DNA, 25 bp, Mus musculus
atgctgactggaaagcactctccag

SEQ ID NO: 211880 - DNA, 25 bp, Mus musculus
atgctgactggtgtcgtttcagcca

SEQ ID NO: 211881 - DNA, 25 bp, Mus musculus
atgctgagaaacaggtggaagagct

SEQ ID NO: 211882 - DNA, 25 bp, Mus musculus
atgctgagagttgaaaaacatgtgg

SEQ ID NO: 211883 - DNA, 25 bp, Mus musculus
atgctgagattacagaatcgtatgg

SEQ ID NO: 211884 - DNA, 25 bp, Mus musculus
atgctgagattacagggacagtgat

SEQ ID NO: 211885 - DNA, 25 bp, Mus musculus
atgctgagcgaggagtgactgcaaa

SEQ ID NO: 211886 - DNA, 25 bp, Mus musculus
atgctgagcgaggtgtgactgcaaa

SEQ ID NO: 211887 - DNA, 25 bp, Mus musculus
atgctgagctgacacttatgcctcc

SEQ ID NO: 211888 - DNA, 25 bp, Mus musculus
atgctgagctgctggaagagcatcg

SEQ ID NO: 211889 - DNA, 25 bp, Mus musculus
atgctgagggtggttagaaagctgt

SEQ ID NO: 211890 - DNA, 25 bp, Mus musculus
atgctgataaggccttgctcaacag

SEQ ID NO: 211891 - DNA, 25 bp, Mus musculus
atgctgatcaaactggattcagaac

SEQ ID NO: 211892 - DNA, 25 bp, Mus musculus
atgctgatcaaccattgcagacctt

SEQ ID NO: 211893 - DNA, 25 bp, Mus musculus
atgctgatcaagcaccacacagtca

SEQ ID NO: 211894 - DNA, 25 bp, Mus musculus
atgctgatccagtgaagtcgagttc

SEQ ID NO: 211895 - DNA, 25 bp, Mus musculus
atgctgatcctatggtgaatccccc

SEQ ID NO: 211896 - DNA, 25 bp, Mus musculus
atgctgatgccattctatttatttc

SEQ ID NO: 211897 - DNA, 25 bp, Mus musculus
atgctgatgccttagacttgcagcc

SEQ ID NO: 211898 - DNA, 25 bp, Mus musculus
atgctgcaagcaccttctagcacca

SEQ ID NO: 211899 - DNA, 25 bp, Mus musculus
atgctgcaagtatagaacattgcat

SEQ ID NO: 211900 - DNA, 25 bp, Mus musculus
atgctgcagaatatgtgtacatgtg

SEQ ID NO: 211901 - DNA, 25 bp, Mus musculus
atgctgcagagcttcacttggttca

SEQ ID NO: 211902 - DNA, 25 bp, Mus musculus
atgctgcagataagtgattgacatt

SEQ ID NO: 211903 - DNA, 25 bp, Mus musculus
atgctgcagataagttactctcagc

SEQ ID NO: 211904 - DNA, 25 bp, Mus musculus
atgctgcagatgcgggaggggaaaa

SEQ ID NO: 211905 - DNA, 25 bp, Mus musculus
atgctgcattctggcgcctagtgag

SEQ ID NO: 211906 - DNA, 25 bp, Mus musculus
atgctgccaattttgagcagttcct

SEQ ID NO: 211907 - DNA, 25 bp, Mus musculus
atgctgccaatttttgacaacagaa

SEQ ID NO: 211908 - DNA, 25 bp, Mus musculus
atgctgccagctggacaggcctgag

SEQ ID NO: 211909 - DNA, 25 bp, Mus musculus
atgctgccaggagacgctctgtctc

SEQ ID NO: 211910 - DNA, 25 bp, Mus musculus
atgctgccagggcaccagcgtctat

SEQ ID NO: 211911 - DNA, 25 bp, Mus musculus
atgctgccattgagaaaatgaaaca

SEQ ID NO: 211912 - DNA, 25 bp, Mus musculus
atgctgccattgagacgtaccacca

SEQ ID NO: 211913 - DNA, 25 bp, Mus musculus
atgctgcccagccggtaagaccagc

SEQ ID NO: 211914 - DNA, 25 bp, Mus musculus
atgctgccccagggttcttttaggt

SEQ ID NO: 211915 - DNA, 25 bp, Mus musculus
atgctgccccaggttgtgtggagga

SEQ ID NO: 211916 - DNA, 25 bp, Mus musculus
atgctgcccctcagcagcagcaaca

SEQ ID NO: 211917 - DNA, 25 bp, Mus musculus
atgctgccctattcctcagggtctc

SEQ ID NO: 211918 - DNA, 25 bp, Mus musculus
atgctgccgtttggtggtgaagcag

SEQ ID NO: 211919 - DNA, 25 bp, Mus musculus
atgctgcctcaggtacctttgaccg

SEQ ID NO: 211920 - DNA, 25 bp, Mus musculus
atgctgcctcagtttgacagcagtc

SEQ ID NO: 211921 - DNA, 25 bp, Mus musculus
atgctgccttttcctgggatcagcc

SEQ ID NO: 211922 - DNA, 25 bp, Mus musculus
atgctgcgaagctgatggtgcctcc

SEQ ID NO: 211923 - DNA, 25 bp, Mus musculus
atgctgcggagcattctgtgccccc

SEQ ID NO: 211924 - DNA, 25 bp, Mus musculus
atgctgcggagcattgtgaccactg

SEQ ID NO: 211925 - DNA, 25 bp, Mus musculus
atgctgctacgaaatccatacttgt

SEQ ID NO: 211926 - DNA, 25 bp, Mus musculus
atgctgctacgaggaggaagatggt

SEQ ID NO: 211927 - DNA, 25 bp, Mus musculus
atgctgctagacgtggctgtgagtc

SEQ ID NO: 211928 - DNA, 25 bp, Mus musculus
atgctgctcctgcaggtggaagcac

SEQ ID NO: 211929 - DNA, 25 bp, Mus musculus
atgctgctgacatgttctactgggc

SEQ ID NO: 211930 - DNA, 25 bp, Mus musculus
atgctggaattaaaggaaactagaa

SEQ ID NO: 211931 - DNA, 25 bp, Mus musculus
atgctggacaatttaggctacagaa

SEQ ID NO: 211932 - DNA, 25 bp, Mus musculus
atgctggacccgctgcggctgctgt

SEQ ID NO: 211933 - DNA, 25 bp, Mus musculus
atgctggacccgtccattggagaat

SEQ ID NO: 211934 - DNA, 25 bp, Mus musculus
atgctggacctgggggcagcccggg

SEQ ID NO: 211935 - DNA, 25 bp, Mus musculus
atgctggagaatcttctctgtccac

SEQ ID NO: 211936 - DNA, 25 bp, Mus musculus
atgctggaggcccaggatttggtgt

SEQ ID NO: 211937 - DNA, 25 bp, Mus musculus
atgctggaggtacgctggatcgcgg

SEQ ID NO: 211938 - DNA, 25 bp, Mus musculus
atgctggagtttcaggaactaatga

SEQ ID NO: 211939 - DNA, 25 bp, Mus musculus
atgctggatccccacaatgatctgc

SEQ ID NO: 211940 - DNA, 25 bp, Mus musculus
atgctggatgatactatcgtggagc

SEQ ID NO: 211941 - DNA, 25 bp, Mus musculus
atgctggatttatgataaagctgct

SEQ ID NO: 211942 - DNA, 25 bp, Mus musculus
atgctggcaaagagtgatggcgtgc

SEQ ID NO: 211943 - DNA, 25 bp, Mus musculus
atgctggcaaaggcgggttccagca

SEQ ID NO: 211944 - DNA, 25 bp, Mus musculus
atgctggcagcgaacatgcgccggg

SEQ ID NO: 211945 - DNA, 25 bp, Mus musculus
atgctggcaggtatctgtgtgactt

SEQ ID NO: 211946 - DNA, 25 bp, Mus musculus
atgctggccaagttcagcaagaagg

SEQ ID NO: 211947 - DNA, 25 bp, Mus musculus
atgctggccagccggtttaagcagg

SEQ ID NO: 211948 - DNA, 25 bp, Mus musculus
atgctggccatgagtactttgtgtt

SEQ ID NO: 211949 - DNA, 25 bp, Mus musculus
atgctggccctggagcctggttacc

SEQ ID NO: 211950 - DNA, 25 bp, Mus musculus
atgctggccctgggtattgactttg

SEQ ID NO: 211951 - DNA, 25 bp, Mus musculus
atgctggcctgacaggagtccccgg

SEQ ID NO: 211952 - DNA, 25 bp, Mus musculus
atgctggcctggcgttccacgccta

SEQ ID NO: 211953 - DNA, 25 bp, Mus musculus
atgctggccttatgtccagccattt

SEQ ID NO: 211954 - DNA, 25 bp, Mus musculus
atgctggctttttcacttgataccc

SEQ ID NO: 211955 - DNA, 25 bp, Mus musculus
atgctgggaaagaatctgcatgtgt

SEQ ID NO: 211956 - DNA, 25 bp, Mus musculus
atgctgggaaagggaattttaatat

SEQ ID NO: 211957 - DNA, 25 bp, Mus musculus
atgctgggaggaggtggcccagagt

SEQ ID NO: 211958 - DNA, 25 bp, Mus musculus
atgctgggattaaaggtgtgggaac

SEQ ID NO: 211959 - DNA, 25 bp, Mus musculus
atgctggggctacagatagggtctc

SEQ ID NO: 211960 - DNA, 25 bp, Mus musculus
atgctggggctacagatttatgaca

SEQ ID NO: 211961 - DNA, 25 bp, Mus musculus
atgctgggggctgggggggccaaga

SEQ ID NO: 211962 - DNA, 25 bp, Mus musculus
atgctgggtggagagatcattcctc

SEQ ID NO: 211963 - DNA, 25 bp, Mus musculus
atgctggtagatttgttgaatgaca

SEQ ID NO: 211964 - DNA, 25 bp, Mus musculus
atgctggtcaaagatgacctggatg

SEQ ID NO: 211965 - DNA, 25 bp, Mus musculus
atgctggtcacgagctcttctgatc

SEQ ID NO: 211966 - DNA, 25 bp, Mus musculus
atgctggtcacgaggtaaccatctt

SEQ ID NO: 211967 - DNA, 25 bp, Mus musculus
atgctggtggagaaggtgtaaccag

SEQ ID NO: 211968 - DNA, 25 bp, Mus musculus
atgctggtgtccgagatgcatgctg

SEQ ID NO: 211969 - DNA, 25 bp, Mus musculus
atgctggtgtccgaggtcttcagat

SEQ ID NO: 211970 - DNA, 25 bp, Mus musculus
atgctggtgtccgagtgtcctgcag

SEQ ID NO: 211971 - DNA, 25 bp, Mus musculus
atgctgtagagagacaatgtctatg

SEQ ID NO: 211972 - DNA, 25 bp, Mus musculus
atgctgtagtagtgactctcttttg

SEQ ID NO: 211973 - DNA, 25 bp, Mus musculus
atgctgtatctggtgctctacctta

SEQ ID NO: 211974 - DNA, 25 bp, Mus musculus
atgctgtatctggtgctctaccttc

SEQ ID NO: 211975 - DNA, 25 bp, Mus musculus
atgctgtcaaggcccgcctggctgc

SEQ ID NO: 211976 - DNA, 25 bp, Mus musculus
atgctgtcagggatggtgaagagca

SEQ ID NO: 211977 - DNA, 25 bp, Mus musculus
atgctgtcatcgaaggagctgtgcg

SEQ ID NO: 211978 - DNA, 25 bp, Mus musculus
atgctgtccactttgatcttcatgg

SEQ ID NO: 211979 - DNA, 25 bp, Mus musculus
atgctgtccagagatgggtggctgg

SEQ ID NO: 211980 - DNA, 25 bp, Mus musculus
atgctgtcggtggctacagatgtct

SEQ ID NO: 211981 - DNA, 25 bp, Mus musculus
atgctgtctatgtactgtgctactc

SEQ ID NO: 211982 - DNA, 25 bp, Mus musculus
atgctgtgaatctgtttcccatgct

SEQ ID NO: 211983 - DNA, 25 bp, Mus musculus
atgctgtgagtgctccgtggcctct

SEQ ID NO: 211984 - DNA, 25 bp, Mus musculus
atgctgtgcaaatggcaagctgtgc

SEQ ID NO: 211985 - DNA, 25 bp, Mus musculus
atgctgtgcaaatggtacaatcagc

SEQ ID NO: 211986 - DNA, 25 bp, Mus musculus
atgctgtgccttgcacaacccggtc

SEQ ID NO: 211987 - DNA, 25 bp, Mus musculus
atgctgtgctgggtcacttttcata

SEQ ID NO: 211988 - DNA, 25 bp, Mus musculus
atgctgtggaccagtacctgatact

SEQ ID NO: 211989 - DNA, 25 bp, Mus musculus
atgctgtggagattcatgacttgca

SEQ ID NO: 211990 - DNA, 25 bp, Mus musculus
atgctgtggtgacgctagagaactg

SEQ ID NO: 211991 - DNA, 25 bp, Mus musculus
atgctgtgtgcaggagagatgggtg

SEQ ID NO: 211992 - DNA, 25 bp, Mus musculus
atgctgttattctggtatgggacgt

SEQ ID NO: 211993 - DNA, 25 bp, Mus musculus
atgctgttctgaatgaagggacctg

SEQ ID NO: 211994 - DNA, 25 bp, Mus musculus
atgctgttcttttcaggggagtttg

SEQ ID NO: 211995 - DNA, 25 bp, Mus musculus
atgctgttgaaaaaagcttatccat

SEQ ID NO: 211996 - DNA, 25 bp, Mus musculus
atgctgtttgagcgatttattgcca

SEQ ID NO: 211997 - DNA, 25 bp, Mus musculus
atgctgtttgcaagaatgcatctta

SEQ ID NO: 211998 - DNA, 25 bp, Mus musculus
atgctgtttgcaaggtatccattat

SEQ ID NO: 211999 - DNA, 25 bp, Mus musculus
atgcttacacatgtgcacattttac

SEQ ID NO: 212000 - DNA, 25 bp, Mus musculus
atgcttacagctcaaaggtgacaca

SEQ ID NO: 212001 - DNA, 25 bp, Mus musculus
atgcttacccagtggggtacatgta

SEQ ID NO: 212002 - DNA, 25 bp, Mus musculus
atgcttaggagagtgacagctagaa

SEQ ID NO: 212003 - DNA, 25 bp, Mus musculus
atgcttataagggtccgtcgtaacc

SEQ ID NO: 212004 - DNA, 25 bp, Mus musculus
atgcttatctagggtggaagaaagc

SEQ ID NO: 212005 - DNA, 25 bp, Mus musculus
atgcttatgaggaagaattctttca

SEQ ID NO: 212006 - DNA, 25 bp, Mus musculus
atgcttatgggaggtccaaatatca

SEQ ID NO: 212007 - DNA, 25 bp, Mus musculus
atgcttcactagaaagaaaaatgac

SEQ ID NO: 212008 - DNA, 25 bp, Mus musculus
atgcttcagagaaggacagtgtccc

SEQ ID NO: 212009 - DNA, 25 bp, Mus musculus
atgcttcagagaaggatgggggaac

SEQ ID NO: 212010 - DNA, 25 bp, Mus musculus
atgcttcagcaggagctgctaagtc

SEQ ID NO: 212011 - DNA, 25 bp, Mus musculus
atgcttcagctgagtgtgacagata

SEQ ID NO: 212012 - DNA, 25 bp, Mus musculus
atgcttcagctgggtggcacagtga

SEQ ID NO: 212013 - DNA, 25 bp, Mus musculus
atgcttccagagtcttgtgatatgc

SEQ ID NO: 212014 - DNA, 25 bp, Mus musculus
atgcttcctaggatggtggcccaga

SEQ ID NO: 212015 - DNA, 25 bp, Mus musculus
atgcttcctatcgacatcccaggcg

SEQ ID NO: 212016 - DNA, 25 bp, Mus musculus
atgcttcctatcggcctttcagaca

SEQ ID NO: 212017 - DNA, 25 bp, Mus musculus
atgcttcctttctagtgagtgccaa

SEQ ID NO: 212018 - DNA, 25 bp, Mus musculus
atgcttcggaaagtccttcaggctc

SEQ ID NO: 212019 - DNA, 25 bp, Mus musculus
atgcttcggcaggttttgtcgctaa

SEQ ID NO: 212020 - DNA, 25 bp, Mus musculus
atgcttctgcccaggtgagaggtgt

SEQ ID NO: 212021 - DNA, 25 bp, Mus musculus
atgcttctgccccaggtgtaaagaa

SEQ ID NO: 212022 - DNA, 25 bp, Mus musculus
atgcttctgtactcacttctgctga

SEQ ID NO: 212023 - DNA, 25 bp, Mus musculus
atgcttctgtggcctacctgtttat

SEQ ID NO: 212024 - DNA, 25 bp, Mus musculus
atgcttctgttggagataccttcct

SEQ ID NO: 212025 - DNA, 25 bp, Mus musculus
atgcttcttcagtacaggctatgtt

SEQ ID NO: 212026 - DNA, 25 bp, Mus musculus
atgcttgagaagatgaggtgaacac

SEQ ID NO: 212027 - DNA, 25 bp, Mus musculus
atgcttgcatcgggattctgtaaca

SEQ ID NO: 212028 - DNA, 25 bp, Mus musculus
atgcttgcatcggggtcagtggata

SEQ ID NO: 212029 - DNA, 25 bp, Mus musculus
atgcttgccacagagcccttgctta

SEQ ID NO: 212030 - DNA, 25 bp, Mus musculus
atgcttgccacaggagacgtggctg

SEQ ID NO: 212031 - DNA, 25 bp, Mus musculus
atgcttgccagggtgacagtggggg

SEQ ID NO: 212032 - DNA, 25 bp, Mus musculus
atgcttgccagtgggggaccgcttg

SEQ ID NO: 212033 - DNA, 25 bp, Mus musculus
atgcttgccccgagtctccatcttt

SEQ ID NO: 212034 - DNA, 25 bp, Mus musculus
atgcttgcgctccgcaagccccgcc

SEQ ID NO: 212035 - DNA, 25 bp, Mus musculus
atgcttgctgaacccccacagaacc

SEQ ID NO: 212036 - DNA, 25 bp, Mus musculus
atgcttggagtgttcctaactttga

SEQ ID NO: 212037 - DNA, 25 bp, Mus musculus
atgcttgggtaagcagtggattctg

SEQ ID NO: 212038 - DNA, 25 bp, Mus musculus
atgcttgtcatctgagtcaacggtt

SEQ ID NO: 212039 - DNA, 25 bp, Mus musculus
atgcttgtcccctgctctgccgcac

SEQ ID NO: 212040 - DNA, 25 bp, Mus musculus
atgcttgttaaggctgctgaaaaat

SEQ ID NO: 212041 - DNA, 25 bp, Mus musculus
atgctttaaaagcaaggatcatgga

SEQ ID NO: 212042 - DNA, 25 bp, Mus musculus
atgctttaaaaggaaaatacataga

SEQ ID NO: 212043 - DNA, 25 bp, Mus musculus
atgctttaccaggaacatttcagag

SEQ ID NO: 212044 - DNA, 25 bp, Mus musculus
atgctttaccaggatatgactgcgc

SEQ ID NO: 212045 - DNA, 25 bp, Mus musculus
atgctttagagtgatgatgactgtg

SEQ ID NO: 212046 - DNA, 25 bp, Mus musculus
atgctttcagaaattccctgcggtg

SEQ ID NO: 212047 - DNA, 25 bp, Mus musculus
atgctttcagaagacctggcggtgt

SEQ ID NO: 212048 - DNA, 25 bp, Mus musculus
atgctttcagccccagccgttcagg

SEQ ID NO: 212049 - DNA, 25 bp, Mus musculus
atgctttcatcggctcggatgtggt

SEQ ID NO: 212050 - DNA, 25 bp, Mus musculus
atgctttccaggattcacagaaatc

SEQ ID NO: 212051 - DNA, 25 bp, Mus musculus
atgctttccctaacatcgagaaggt

SEQ ID NO: 212052 - DNA, 25 bp, Mus musculus
atgctttccgcaaggccctttatgg

SEQ ID NO: 212053 - DNA, 25 bp, Mus musculus
atgctttctcttgagactcgttact

SEQ ID NO: 212054 - DNA, 25 bp, Mus musculus
atgctttctcttgagggtaacaaga

SEQ ID NO: 212055 - DNA, 25 bp, Mus musculus
atgctttgatgtcccgcatggttcg

SEQ ID NO: 212056 - DNA, 25 bp, Mus musculus
atgctttgcgctcagggaaaggtga

SEQ ID NO: 212057 - DNA, 25 bp, Mus musculus
atgctttgcgctcagggcatccatg

SEQ ID NO: 212058 - DNA, 25 bp, Mus musculus
atgctttgggcttcttgtgtccatt

SEQ ID NO: 212059 - DNA, 25 bp, Mus musculus
atgctttggtaagctgcgatattta

SEQ ID NO: 212060 - DNA, 25 bp, Mus musculus
atgcttttaaggcagcccacccaaa

SEQ ID NO: 212061 - DNA, 25 bp, Mus musculus
atgcttttcctggagagcctgacaa

SEQ ID NO: 212062 - DNA, 25 bp, Mus musculus
atggaaaaaagggaacgaagagctc

SEQ ID NO: 212063 - DNA, 25 bp, Mus musculus
atggaaaaaagggtggccggcaaga

SEQ ID NO: 212064 - DNA, 25 bp, Mus musculus
atggaaaaagcaggtttctggacgg

SEQ ID NO: 212065 - DNA, 25 bp, Mus musculus
atggaaaaaggaaatatatgaagaa

SEQ ID NO: 212066 - DNA, 25 bp, Mus musculus
atggaaaaaggtgttcgaatttgct

SEQ ID NO: 212067 - DNA, 25 bp, Mus musculus
atggaaaaatatggaacaaaagttg

SEQ ID NO: 212068 - DNA, 25 bp, Mus musculus
atggaaaacacagtttggcttgtgc

SEQ ID NO: 212069 - DNA, 25 bp, Mus musculus
atggaaaacctgaggagccaacaga

SEQ ID NO: 212070 - DNA, 25 bp, Mus musculus
atggaaaacctgagggtgatttcag

SEQ ID NO: 212071 - DNA, 25 bp, Mus musculus
atggaaaagataaaacagcgtttat

SEQ ID NO: 212072 - DNA, 25 bp, Mus musculus
atggaaaagcgaggaggcggctcag

SEQ ID NO: 212073 - DNA, 25 bp, Mus musculus
atggaaaagctggtggacaataaca

SEQ ID NO: 212074 - DNA, 25 bp, Mus musculus
atggaaaagtctaagggcagtttag

SEQ ID NO: 212075 - DNA, 25 bp, Mus musculus
atggaaaatgaagatgctagaaaat

SEQ ID NO: 212076 - DNA, 25 bp, Mus musculus
atggaaaatgaaggttgcacgattt

SEQ ID NO: 212077 - DNA, 25 bp, Mus musculus
atggaaaatgattcaaggcctcttc

SEQ ID NO: 212078 - DNA, 25 bp, Mus musculus
atggaaaatggtgttgctgtcatca

SEQ ID NO: 212079 - DNA, 25 bp, Mus musculus
atggaaaatgtttcaacctggatga

SEQ ID NO: 212080 - DNA, 25 bp, Mus musculus
atggaaacacccagagcctctcggc

SEQ ID NO: 212081 - DNA, 25 bp, Mus musculus
atggaaacaggtttaatcttgttca

SEQ ID NO: 212082 - DNA, 25 bp, Mus musculus
atggaaacagtcaccaaggagctgg

SEQ ID NO: 212083 - DNA, 25 bp, Mus musculus
atggaaaccagaagcgaatggaaga

SEQ ID NO: 212084 - DNA, 25 bp, Mus musculus
atggaaaccagcaggtgcagcaggt

SEQ ID NO: 212085 - DNA, 25 bp, Mus musculus
atggaaaccaggacaagaagacaga

SEQ ID NO: 212086 - DNA, 25 bp, Mus musculus
atggaaaccagtattgcagcaccca

SEQ ID NO: 212087 - DNA, 25 bp, Mus musculus
atggaaacccagcgctaactgtcct

SEQ ID NO: 212088 - DNA, 25 bp, Mus musculus
atggaaactaaggcattactcatca

SEQ ID NO: 212089 - DNA, 25 bp, Mus musculus
atggaaactaaggctggccttgtgg

SEQ ID NO: 212090 - DNA, 25 bp, Mus musculus
atggaaactgagcacattaatccag

SEQ ID NO: 212091 - DNA, 25 bp, Mus musculus
atggaaactgagcaccaaacaacat

SEQ ID NO: 212092 - DNA, 25 bp, Mus musculus
atggaaactgagcaccaagcttaca

SEQ ID NO: 212093 - DNA, 25 bp, Mus musculus
atggaaactgagcagcagaataaag

SEQ ID NO: 212094 - DNA, 25 bp, Mus musculus
atggaaactgagcattttgctctgt

SEQ ID NO: 212095 - DNA, 25 bp, Mus musculus
atggaaagcaatcactctgtggagg

SEQ ID NO: 212096 - DNA, 25 bp, Mus musculus
atggaaagcacagaactctttgttg

SEQ ID NO: 212097 - DNA, 25 bp, Mus musculus
atggaaaggcatgtataatgcctgc

SEQ ID NO: 212098 - DNA, 25 bp, Mus musculus
atggaaagtcacagctttctcaggg

SEQ ID NO: 212099 - DNA, 25 bp, Mus musculus
atggaaataatgctcttcatcttgc

SEQ ID NO: 212100 - DNA, 25 bp, Mus musculus
atggaaataccatgatttctaggca

SEQ ID NO: 212101 - DNA, 25 bp, Mus musculus
atggaaatgaggaggctgctcagtg

SEQ ID NO: 212102 - DNA, 25 bp, Mus musculus
atggaacaaggacctctgcttgctc

SEQ ID NO: 212103 - DNA, 25 bp, Mus musculus
atggaacaagtaaggatagatgggg

SEQ ID NO: 212104 - DNA, 25 bp, Mus musculus
atggaacaagtacaaccctcagcct

SEQ ID NO: 212105 - DNA, 25 bp, Mus musculus
atggaacaatcacagacagcttacc

SEQ ID NO: 212106 - DNA, 25 bp, Mus musculus
atggaacaatcacagaggccagaag

SEQ ID NO: 212107 - DNA, 25 bp, Mus musculus
atggaacaatcacaggtgtagatgt

SEQ ID NO: 212108 - DNA, 25 bp, Mus musculus
atggaaccagaaaatgagaaaatac

SEQ ID NO: 212109 - DNA, 25 bp, Mus musculus
atggaaccagctctgttaaggaaga

SEQ ID NO: 212110 - DNA, 25 bp, Mus musculus
atggaaccattacagccatccccag

SEQ ID NO: 212111 - DNA, 25 bp, Mus musculus
atggaaccgatcagtatatacactt

SEQ ID NO: 212112 - DNA, 25 bp, Mus musculus
atggaacctggcgcccaatgaacca

SEQ ID NO: 212113 - DNA, 25 bp, Mus musculus
atggaacctggcgcggcactcctag

SEQ ID NO: 212114 - DNA, 25 bp, Mus musculus
atggaacggcagatgataatgttca

SEQ ID NO: 212115 - DNA, 25 bp, Mus musculus
atggaacggcagatgtggtacacgg

SEQ ID NO: 212116 - DNA, 25 bp, Mus musculus
atggaacggtgaaggtgtggaatgt

SEQ ID NO: 212117 - DNA, 25 bp, Mus musculus
atggaagaaaagttcctagtctcca

SEQ ID NO: 212118 - DNA, 25 bp, Mus musculus
atggaagaaggatattacaaatgaa

SEQ ID NO: 212119 - DNA, 25 bp, Mus musculus
atggaagaaggtatcaactggcagg

SEQ ID NO: 212120 - DNA, 25 bp, Mus musculus
atggaagacagagctgcatgagtga

SEQ ID NO: 212121 - DNA, 25 bp, Mus musculus
atggaagagagtttcatgggatcat

SEQ ID NO: 212122 - DNA, 25 bp, Mus musculus
atggaagagctggatgccttattgg

SEQ ID NO: 212123 - DNA, 25 bp, Mus musculus
atggaagcagaaaattgtgcaagca

SEQ ID NO: 212124 - DNA, 25 bp, Mus musculus
atggaagcagatcctgcctctcagg

SEQ ID NO: 212125 - DNA, 25 bp, Mus musculus
atggaagcagggaggctgcaaagga

SEQ ID NO: 212126 - DNA, 25 bp, Mus musculus
atggaagccaaggtgaaagccgccc

SEQ ID NO: 212127 - DNA, 25 bp, Mus musculus
atggaagccagaaataggaccaagg

SEQ ID NO: 212128 - DNA, 25 bp, Mus musculus
atggaagcccagctcacaggaagga

SEQ ID NO: 212129 - DNA, 25 bp, Mus musculus
atggaagccctgaatgttctccctc

SEQ ID NO: 212130 - DNA, 25 bp, Mus musculus
atggaagcccttaccagcccagctt

SEQ ID NO: 212131 - DNA, 25 bp, Mus musculus
atggaagccgaggtctgcattacat

SEQ ID NO: 212132 - DNA, 25 bp, Mus musculus
atggaaggcatgggtcccgagcatt

SEQ ID NO: 212133 - DNA, 25 bp, Mus musculus
atggaaggcctgggagggtaccctg

SEQ ID NO: 212134 - DNA, 25 bp, Mus musculus
atggaagtagacacctacatacaga

SEQ ID NO: 212135 - DNA, 25 bp, Mus musculus
atggaagtccttaaggtgcagaccc

SEQ ID NO: 212136 - DNA, 25 bp, Mus musculus
atggaagtgtccaggtgtaaccagc

SEQ ID NO: 212137 - DNA, 25 bp, Mus musculus
atggaagttgactgagcacgtgagt

SEQ ID NO: 212138 - DNA, 25 bp, Mus musculus
atggaatacacagcagggcatcagc

SEQ ID NO: 212139 - DNA, 25 bp, Mus musculus
atggaatcagctgctctgccctgtc

SEQ ID NO: 212140 - DNA, 25 bp, Mus musculus
atggaatcaggcggccccctttcag

SEQ ID NO: 212141 - DNA, 25 bp, Mus musculus
atggaatcagggtgcgactggacct

SEQ ID NO: 212142 - DNA, 25 bp, Mus musculus
atggaatcaggtgccaacaggctgc

SEQ ID NO: 212143 - DNA, 25 bp, Mus musculus
atggaatcctcagctgtcgagaaac

SEQ ID NO: 212144 - DNA, 25 bp, Mus musculus
atggaatcctcaggtatcagagaag

SEQ ID NO: 212145 - DNA, 25 bp, Mus musculus
atggaatcctcaggttcctgccctc

SEQ ID NO: 212146 - DNA, 25 bp, Mus musculus
atggaatcctctggcaagcgcgccc

SEQ ID NO: 212147 - DNA, 25 bp, Mus musculus
atggaatctgtctctctcctctctt

SEQ ID NO: 212148 - DNA, 25 bp, Mus musculus
atggaatggaaggccttgttaccca

SEQ ID NO: 212149 - DNA, 25 bp, Mus musculus
atggaatgtgagatatgatgaatgg

SEQ ID NO: 212150 - DNA, 25 bp, Mus musculus
atggaatgttccagacgtgaagccc

SEQ ID NO: 212151 - DNA, 25 bp, Mus musculus
atggaattataagtactattaatcc

SEQ ID NO: 212152 - DNA, 25 bp, Mus musculus
atggaattcctgggcatccagggca

SEQ ID NO: 212153 - DNA, 25 bp, Mus musculus
atggaattgcagtctgtgatgctcc

SEQ ID NO: 212154 - DNA, 25 bp, Mus musculus
atggacaaagctggtcagtacactg

SEQ ID NO: 212155 - DNA, 25 bp, Mus musculus
atggacaactatgagtgaactccgg

SEQ ID NO: 212156 - DNA, 25 bp, Mus musculus
atggacaagcctgactgcctcttta

SEQ ID NO: 212157 - DNA, 25 bp, Mus musculus
atggacaagctcctagatcttgatg

SEQ ID NO: 212158 - DNA, 25 bp, Mus musculus
atggacaagctccttccagtgacag

SEQ ID NO: 212159 - DNA, 25 bp, Mus musculus
atggacaatcagcgcctgttggtct

SEQ ID NO: 212160 - DNA, 25 bp, Mus musculus
atggacaatcagggtctatctacac

SEQ ID NO: 212161 - DNA, 25 bp, Mus musculus
atggacaatgaagattacgaacatg

SEQ ID NO: 212162 - DNA, 25 bp, Mus musculus
atggacacaggtatacaaggagcag

SEQ ID NO: 212163 - DNA, 25 bp, Mus musculus
atggacacggtggatggagcgagat

SEQ ID NO: 212164 - DNA, 25 bp, Mus musculus
atggacagaaagaatgtcactgctc

SEQ ID NO: 212165 - DNA, 25 bp, Mus musculus
atggacagaccctgggacagcaggt

SEQ ID NO: 212166 - DNA, 25 bp, Mus musculus
atggacagaccctgggctccaccct

SEQ ID NO: 212167 - DNA, 25 bp, Mus musculus
atggacagaccctggtcactcatca

SEQ ID NO: 212168 - DNA, 25 bp, Mus musculus
atggacagagactggggctgcagga

SEQ ID NO: 212169 - DNA, 25 bp, Mus musculus
atggacagatgtccactcccgagac

SEQ ID NO: 212170 - DNA, 25 bp, Mus musculus
atggacagcgagcagtgttgcctct

SEQ ID NO: 212171 - DNA, 25 bp, Mus musculus
atggacagcgaggcatgctacacca

SEQ ID NO: 212172 - DNA, 25 bp, Mus musculus
atggacagggtaaagaaggaatggg

SEQ ID NO: 212173 - DNA, 25 bp, Mus musculus
atggacagtgccagctgaggatggt

SEQ ID NO: 212174 - DNA, 25 bp, Mus musculus
atggacatagaagggcttggctgag

SEQ ID NO: 212175 - DNA, 25 bp, Mus musculus
atggacatagtttaggtattgcttt

SEQ ID NO: 212176 - DNA, 25 bp, Mus musculus
atggacatatcaattactgggattc

SEQ ID NO: 212177 - DNA, 25 bp, Mus musculus
atggacatatcatcataccccacat

SEQ ID NO: 212178 - DNA, 25 bp, Mus musculus
atggacatccgtggctccattgtct

SEQ ID NO: 212179 - DNA, 25 bp, Mus musculus
atggacatcctgaactactttgaga

SEQ ID NO: 212180 - DNA, 25 bp, Mus musculus
atggacatcctgcctccttccttgt

SEQ ID NO: 212181 - DNA, 25 bp, Mus musculus
atggacatggtggagcactacacca

SEQ ID NO: 212182 - DNA, 25 bp, Mus musculus
atggacatggtggagctggctggct

SEQ ID NO: 212183 - DNA, 25 bp, Mus musculus
atggacattgccaagttaaaaggag

SEQ ID NO: 212184 - DNA, 25 bp, Mus musculus
atggaccaaacacgtgaagaagagt

SEQ ID NO: 212185 - DNA, 25 bp, Mus musculus
atggaccaagggccaagtgtggatc

SEQ ID NO: 212186 - DNA, 25 bp, Mus musculus
atggaccaaggtgttggggccactc

SEQ ID NO: 212187 - DNA, 25 bp, Mus musculus
atggaccagacaaagacatggaccc

SEQ ID NO: 212188 - DNA, 25 bp, Mus musculus
atggaccagacaaagccgacccttt

SEQ ID NO: 212189 - DNA, 25 bp, Mus musculus
atggaccagctgcactatgtgacgg

SEQ ID NO: 212190 - DNA, 25 bp, Mus musculus
atggaccatatcaagtctatgcatg

SEQ ID NO: 212191 - DNA, 25 bp, Mus musculus
atggaccatggtggagtttgggagc

SEQ ID NO: 212192 - DNA, 25 bp, Mus musculus
atggacccacatgaaaaatgtgtct

SEQ ID NO: 212193 - DNA, 25 bp, Mus musculus
atggacccaggtaaacagttgccaa

SEQ ID NO: 212194 - DNA, 25 bp, Mus musculus
atggacccaggttactccagtgagg

SEQ ID NO: 212195 - DNA, 25 bp, Mus musculus
atggaccccagatgcaccatgggct

SEQ ID NO: 212196 - DNA, 25 bp, Mus musculus
atggaccccctttcgccacagccca

SEQ ID NO: 212197 - DNA, 25 bp, Mus musculus
atggacccctatgaggagctcctag

SEQ ID NO: 212198 - DNA, 25 bp, Mus musculus
atggacccgatagcctcggccctgc

SEQ ID NO: 212199 - DNA, 25 bp, Mus musculus
atggaccctgctgaccctgtacaca

SEQ ID NO: 212200 - DNA, 25 bp, Mus musculus
atggaccgccaggcactgggaaaac

SEQ ID NO: 212201 - DNA, 25 bp, Mus musculus
atggacctagtccaaggcggttggc

SEQ ID NO: 212202 - DNA, 25 bp, Mus musculus
atggacctatcaccagtatcatagt

SEQ ID NO: 212203 - DNA, 25 bp, Mus musculus
atggacctgaagggcatgttcctgt

SEQ ID NO: 212204 - DNA, 25 bp, Mus musculus
atggacctgcctctgagtgctgcac

SEQ ID NO: 212205 - DNA, 25 bp, Mus musculus
atggaccttcccctgtctctgcact

SEQ ID NO: 212206 - DNA, 25 bp, Mus musculus
atggacgaagaggatcttagtgaat

SEQ ID NO: 212207 - DNA, 25 bp, Mus musculus
atggacgaagagtgaattcgggata

SEQ ID NO: 212208 - DNA, 25 bp, Mus musculus
atggacgagacaaactgccagaaag

SEQ ID NO: 212209 - DNA, 25 bp, Mus musculus
atggacgagacaaagtgctgctgtt

SEQ ID NO: 212210 - DNA, 25 bp, Mus musculus
atggacggggcaagtgcatttggca

SEQ ID NO: 212211 - DNA, 25 bp, Mus musculus
atggacgttcagagttactacctgg

SEQ ID NO: 212212 - DNA, 25 bp, Mus musculus
atggactaaacctctgaaactgtaa

SEQ ID NO: 212213 - DNA, 25 bp, Mus musculus
atggactagcgagccataaaagaga

SEQ ID NO: 212214 - DNA, 25 bp, Mus musculus
atggactagcggcctggtctcagcg

SEQ ID NO: 212215 - DNA, 25 bp, Mus musculus
atggactagcgtttcaggcctggtc

SEQ ID NO: 212216 - DNA, 25 bp, Mus musculus
atggactatgccctcagctggggcc

SEQ ID NO: 212217 - DNA, 25 bp, Mus musculus
atggactcgcagaaagaagctctac

SEQ ID NO: 212218 - DNA, 25 bp, Mus musculus
atggactggaaaacagtgaaggccc

SEQ ID NO: 212219 - DNA, 25 bp, Mus musculus
atggacttaaaggtgcctggaagaa

SEQ ID NO: 212220 - DNA, 25 bp, Mus musculus
atggacttaagaacttttcctattt

SEQ ID NO: 212221 - DNA, 25 bp, Mus musculus
atggacttaagaccatgctcgcatt

SEQ ID NO: 212222 - DNA, 25 bp, Mus musculus
atggacttggcatctgggtgtttgg

SEQ ID NO: 212223 - DNA, 25 bp, Mus musculus
atggacttgggaacacaccagtggg

SEQ ID NO: 212224 - DNA, 25 bp, Mus musculus
atggactttgaagcatttttcagcc

SEQ ID NO: 212225 - DNA, 25 bp, Mus musculus
atggactttggaggacagaaaaatg

SEQ ID NO: 212226 - DNA, 25 bp, Mus musculus
atggactttggagtctgaatatgca

SEQ ID NO: 212227 - DNA, 25 bp, Mus musculus
atggactttttgatcgatgatgaaa

SEQ ID NO: 212228 - DNA, 25 bp, Mus musculus
atggagaaaaagtaaatataatcaa

SEQ ID NO: 212229 - DNA, 25 bp, Mus musculus
atggagaaaacctgaagactgagca

SEQ ID NO: 212230 - DNA, 25 bp, Mus musculus
atggagaaaacttctaaagatggca

SEQ ID NO: 212231 - DNA, 25 bp, Mus musculus
atggagaaaatttgccttgaattct

SEQ ID NO: 212232 - DNA, 25 bp, Mus musculus
atggagaacaggatgaagaagagaa

SEQ ID NO: 212233 - DNA, 25 bp, Mus musculus
atggagaacaggtgagtgaaatcct

SEQ ID NO: 212234 - DNA, 25 bp, Mus musculus
atggagaacaggtgcttttacaact

SEQ ID NO: 212235 - DNA, 25 bp, Mus musculus
atggagaacgagagtctccatcatc

SEQ ID NO: 212236 - DNA, 25 bp, Mus musculus
atggagaacgagcctggaattgtgt

SEQ ID NO: 212237 - DNA, 25 bp, Mus musculus
atggagaactccaaggtcctaggtg

SEQ ID NO: 212238 - DNA, 25 bp, Mus musculus
atggagaactgccccaccattctcc

SEQ ID NO: 212239 - DNA, 25 bp, Mus musculus
atggagaacttcttaacatatgaca

SEQ ID NO: 212240 - DNA, 25 bp, Mus musculus
atggagaatatccggagacaaaccc

SEQ ID NO: 212241 - DNA, 25 bp, Mus musculus
atggagaatggtaccgcgcccgggt

SEQ ID NO: 212242 - DNA, 25 bp, Mus musculus
atggagacaaggaacatggaatacc

SEQ ID NO: 212243 - DNA, 25 bp, Mus musculus
atggagacagaaaagaatgcagtca

SEQ ID NO: 212244 - DNA, 25 bp, Mus musculus
atggagacagagtggtgattagaaa

SEQ ID NO: 212245 - DNA, 25 bp, Mus musculus
atggagacccaggtgataactccct

SEQ ID NO: 212246 - DNA, 25 bp, Mus musculus
atggagacccattgtgccccaattc

SEQ ID NO: 212247 - DNA, 25 bp, Mus musculus
atggagacgagggctcttgtgttaa

SEQ ID NO: 212248 - DNA, 25 bp, Mus musculus
atggagactgcattcacatagatga

SEQ ID NO: 212249 - DNA, 25 bp, Mus musculus
atggagactgcattgacatagatga

SEQ ID NO: 212250 - DNA, 25 bp, Mus musculus
atggagagaagcaaatttccattga

SEQ ID NO: 212251 - DNA, 25 bp, Mus musculus
atggagagaagcaggagcttgaacc

SEQ ID NO: 212252 - DNA, 25 bp, Mus musculus
atggagagaagcaggaggatcatgc

SEQ ID NO: 212253 - DNA, 25 bp, Mus musculus
atggagagaggaggctgctcccctg

SEQ ID NO: 212254 - DNA, 25 bp, Mus musculus
atggagagagtttggaagaactgaa

SEQ ID NO: 212255 - DNA, 25 bp, Mus musculus
atggagagcaaagaaccccagctga

SEQ ID NO: 212256 - DNA, 25 bp, Mus musculus
atggagagcagattgaaggtgctcc

SEQ ID NO: 212257 - DNA, 25 bp, Mus musculus
atggagaggaaggcgcgggctggga

SEQ ID NO: 212258 - DNA, 25 bp, Mus musculus
atggagaggatcgcccccaccccgc

SEQ ID NO: 212259 - DNA, 25 bp, Mus musculus
atggagaggtaatgcctgtggtcgt

SEQ ID NO: 212260 - DNA, 25 bp, Mus musculus
atggagaggttccagatggagctga

SEQ ID NO: 212261 - DNA, 25 bp, Mus musculus
atggagaggttccagttaccagtaa

SEQ ID NO: 212262 - DNA, 25 bp, Mus musculus
atggagatctaccagcaaaatcttg

SEQ ID NO: 212263 - DNA, 25 bp, Mus musculus
atggagatctaccagggatgagttt

SEQ ID NO: 212264 - DNA, 25 bp, Mus musculus
atggagatgcagatggtgaaagtga

SEQ ID NO: 212265 - DNA, 25 bp, Mus musculus
atggagatgggatgcctggattctg

SEQ ID NO: 212266 - DNA, 25 bp, Mus musculus
atggagcaaaaaatgggctacacat

SEQ ID NO: 212267 - DNA, 25 bp, Mus musculus
atggagcaaaagtatgaattagggg

SEQ ID NO: 212268 - DNA, 25 bp, Mus musculus
atggagcaaagaactgagattgcac

SEQ ID NO: 212269 - DNA, 25 bp, Mus musculus
atggagcaaaggcaccatcggtttc

SEQ ID NO: 212270 - DNA, 25 bp, Mus musculus
atggagcaaggtgtccatgttggaa

SEQ ID NO: 212271 - DNA, 25 bp, Mus musculus
atggagcaagtgatgacagactctg

SEQ ID NO: 212272 - DNA, 25 bp, Mus musculus
atggagcaggagccctgcctagccc

SEQ ID NO: 212273 - DNA, 25 bp, Mus musculus
atggagcagttaacgcggggggacg

SEQ ID NO: 212274 - DNA, 25 bp, Mus musculus
atggagcatcctgccgtggtgaagg

SEQ ID NO: 212275 - DNA, 25 bp, Mus musculus
atggagccaaacatttctcgggatt

SEQ ID NO: 212276 - DNA, 25 bp, Mus musculus
atggagccaaagaatgaataaaatg

SEQ ID NO: 212277 - DNA, 25 bp, Mus musculus
atggagccagaccactcggccctga

SEQ ID NO: 212278 - DNA, 25 bp, Mus musculus
atggagccagagaacctacaacaac

SEQ ID NO: 212279 - DNA, 25 bp, Mus musculus
atggagcccagaaatgtacggagtt

SEQ ID NO: 212280 - DNA, 25 bp, Mus musculus
atggagcccagaaattatttggtat

SEQ ID NO: 212281 - DNA, 25 bp, Mus musculus
atggagccccacggatttcagtttt

SEQ ID NO: 212282 - DNA, 25 bp, Mus musculus
atggagcctgggaagagaagaacca

SEQ ID NO: 212283 - DNA, 25 bp, Mus musculus
atggagcctgggaagctccaggtgc

SEQ ID NO: 212284 - DNA, 25 bp, Mus musculus
atggagcgaggaaggcacctgatgc

SEQ ID NO: 212285 - DNA, 25 bp, Mus musculus
atggagcgaggaagggatcgcttac

SEQ ID NO: 212286 - DNA, 25 bp, Mus musculus
atggagcgatggttgtcggtgcctg

SEQ ID NO: 212287 - DNA, 25 bp, Mus musculus
atggagcgatgtacctgacctctgt

SEQ ID NO: 212288 - DNA, 25 bp, Mus musculus
atggagcgatgtggacagaagtacc

SEQ ID NO: 212289 - DNA, 25 bp, Mus musculus
atggagcggaagagccccagcggga

SEQ ID NO: 212290 - DNA, 25 bp, Mus musculus
atggagcggagcctctctgcctttc

SEQ ID NO: 212291 - DNA, 25 bp, Mus musculus
atggagcggaggtctcattgggaga

SEQ ID NO: 212292 - DNA, 25 bp, Mus musculus
atggagcggtgtgctcggccatcga

SEQ ID NO: 212293 - DNA, 25 bp, Mus musculus
atggagcggtgtggtcattgggctt

SEQ ID NO: 212294 - DNA, 25 bp, Mus musculus
atggagctctatggccgagaaccag

SEQ ID NO: 212295 - DNA, 25 bp, Mus musculus
atggagctctatggccgagaaccat

SEQ ID NO: 212296 - DNA, 25 bp, Mus musculus
atggagctctttctacctccagtgt

SEQ ID NO: 212297 - DNA, 25 bp, Mus musculus
atggagctgttccagttacagattc

SEQ ID NO: 212298 - DNA, 25 bp, Mus musculus
atggagcttttagaacgttttagag

SEQ ID NO: 212299 - DNA, 25 bp, Mus musculus
atggaggaaaggttacagcaggcgg

SEQ ID NO: 212300 - DNA, 25 bp, Mus musculus
atggaggaagaagacagcatgaaga

SEQ ID NO: 212301 - DNA, 25 bp, Mus musculus
atggaggaagacagggttccagtga

SEQ ID NO: 212302 - DNA, 25 bp, Mus musculus
atggaggaatgtctataacaataaa

SEQ ID NO: 212303 - DNA, 25 bp, Mus musculus
atggaggacaagagcaacagtacca

SEQ ID NO: 212304 - DNA, 25 bp, Mus musculus
atggaggacaagattaggaatcagt

SEQ ID NO: 212305 - DNA, 25 bp, Mus musculus
atggaggacgtttgagcgaatctca

SEQ ID NO: 212306 - DNA, 25 bp, Mus musculus
atggaggagagggctctgctctgaa

SEQ ID NO: 212307 - DNA, 25 bp, Mus musculus
atggaggagctagagaactacatgg

SEQ ID NO: 212308 - DNA, 25 bp, Mus musculus
atggaggaggagagtataaaggagg

SEQ ID NO: 212309 - DNA, 25 bp, Mus musculus
atggaggagggaagagtctgaggaa

SEQ ID NO: 212310 - DNA, 25 bp, Mus musculus
atggaggatgtggagctggaccaga

SEQ ID NO: 212311 - DNA, 25 bp, Mus musculus
atggaggccaggaaaacggcaacta

SEQ ID NO: 212312 - DNA, 25 bp, Mus musculus
atggaggccaggctgtaattcaaaa

SEQ ID NO: 212313 - DNA, 25 bp, Mus musculus
atggaggccaggtgacataccgcgt

SEQ ID NO: 212314 - DNA, 25 bp, Mus musculus
atggaggccggagaggagccgctgc

SEQ ID NO: 212315 - DNA, 25 bp, Mus musculus
atggagggaagagaaactgctcagg

SEQ ID NO: 212316 - DNA, 25 bp, Mus musculus
atggagggagcctggaggatgaaaa

SEQ ID NO: 212317 - DNA, 25 bp, Mus musculus
atggaggtaatgttgggaggaaaga

SEQ ID NO: 212318 - DNA, 25 bp, Mus musculus
atggaggtagaaaatcttctggaag

SEQ ID NO: 212319 - DNA, 25 bp, Mus musculus
atggaggtgaaagaggtgacagcta

SEQ ID NO: 212320 - DNA, 25 bp, Mus musculus
atggagtaactgagttggcagatat

SEQ ID NO: 212321 - DNA, 25 bp, Mus musculus
atggagtacaggatcaataagccaa

SEQ ID NO: 212322 - DNA, 25 bp, Mus musculus
atggagtatacaaaaaagcctgagc

SEQ ID NO: 212323 - DNA, 25 bp, Mus musculus
atggagtatcaggatgctgtgcgca

SEQ ID NO: 212324 - DNA, 25 bp, Mus musculus
atggagtatccagagaaacatgact

SEQ ID NO: 212325 - DNA, 25 bp, Mus musculus
atggagtcggctcttaaccggctct

SEQ ID NO: 212326 - DNA, 25 bp, Mus musculus
atggagtctctggagcagcgtgcca

SEQ ID NO: 212327 - DNA, 25 bp, Mus musculus
atggagtgaagtgcctcagagcgcc

SEQ ID NO: 212328 - DNA, 25 bp, Mus musculus
atggagtggcaggagccctggcctg

SEQ ID NO: 212329 - DNA, 25 bp, Mus musculus
atggagtgtaagaggcggcccctga

SEQ ID NO: 212330 - DNA, 25 bp, Mus musculus
atggagtgtaagtggcggcccctga

SEQ ID NO: 212331 - DNA, 25 bp, Mus musculus
atggagtgttgtgaggagtccatga

SEQ ID NO: 212332 - DNA, 25 bp, Mus musculus
atggagttaagcacggaaataacca

SEQ ID NO: 212333 - DNA, 25 bp, Mus musculus
atggagttaagtggctaaaagccaa

SEQ ID NO: 212334 - DNA, 25 bp, Mus musculus
atggagttctggggacaatggtgac

SEQ ID NO: 212335 - DNA, 25 bp, Mus musculus
atggagttgctggaaaatctggatg

SEQ ID NO: 212336 - DNA, 25 bp, Mus musculus
atggagttgctggaacagattttct

SEQ ID NO: 212337 - DNA, 25 bp, Mus musculus
atggagttggacattggtgcccagg

SEQ ID NO: 212338 - DNA, 25 bp, Mus musculus
atggagttgtccaagattttaccgg

SEQ ID NO: 212339 - DNA, 25 bp, Mus musculus
atggagttgtccaaggaatgtggct

SEQ ID NO: 212340 - DNA, 25 bp, Mus musculus
atggagtttaaagatgtcattgtcc

SEQ ID NO: 212341 - DNA, 25 bp, Mus musculus
atggagtttaaagtgtcgtgttctg

SEQ ID NO: 212342 - DNA, 25 bp, Mus musculus
atggataaaggagccgggtgtgggc

SEQ ID NO: 212343 - DNA, 25 bp, Mus musculus
atggataaaggtgctggagagtctg

SEQ ID NO: 212344 - DNA, 25 bp, Mus musculus
atggataatatcttggctttccccc

SEQ ID NO: 212345 - DNA, 25 bp, Mus musculus
atggatacaacactggaagaaaata

SEQ ID NO: 212346 - DNA, 25 bp, Mus musculus
atggatacaacactggtgtgtcagt

SEQ ID NO: 212347 - DNA, 25 bp, Mus musculus
atggatacaatgagcagcacctcca

SEQ ID NO: 212348 - DNA, 25 bp, Mus musculus
atggatacacaactattgtcccaga

SEQ ID NO: 212349 - DNA, 25 bp, Mus musculus
atggatacccagacctgattgtggg

SEQ ID NO: 212350 - DNA, 25 bp, Mus musculus
atggatacccaggcctgattgtggg

SEQ ID NO: 212351 - DNA, 25 bp, Mus musculus
atggatacttacaggagctgatctt

SEQ ID NO: 212352 - DNA, 25 bp, Mus musculus
atggatagccaggtgccagaactgg

SEQ ID NO: 212353 - DNA, 25 bp, Mus musculus
atggatatagacaacagaaagccta

SEQ ID NO: 212354 - DNA, 25 bp, Mus musculus
atggatatgaggtccagagattcat

SEQ ID NO: 212355 - DNA, 25 bp, Mus musculus
atggatatgatggtggctatggagg

SEQ ID NO: 212356 - DNA, 25 bp, Mus musculus
atggatcagattcaggcaacaatat

SEQ ID NO: 212357 - DNA, 25 bp, Mus musculus
atggatcaggaagatcctggcccgc

SEQ ID NO: 212358 - DNA, 25 bp, Mus musculus
atggatcaggtgggaggttgtgccc

SEQ ID NO: 212359 - DNA, 25 bp, Mus musculus
atggatcataattgggtttcttctt

SEQ ID NO: 212360 - DNA, 25 bp, Mus musculus
atggatccaccagcactgcccccca

SEQ ID NO: 212361 - DNA, 25 bp, Mus musculus
atggatcccactgatgccaagtatc

SEQ ID NO: 212362 - DNA, 25 bp, Mus musculus
atggatcccgggcgtccatgctgga

SEQ ID NO: 212363 - DNA, 25 bp, Mus musculus
atggatccctctatgctgtgggatc

SEQ ID NO: 212364 - DNA, 25 bp, Mus musculus
atggatccttgctaatttgaaatat

SEQ ID NO: 212365 - DNA, 25 bp, Mus musculus
atggatctaccaaagtctcacttta

SEQ ID NO: 212366 - DNA, 25 bp, Mus musculus
atggatctcactgtggtccagatta

SEQ ID NO: 212367 - DNA, 25 bp, Mus musculus
atggatctgcctgcgatctagggcg

SEQ ID NO: 212368 - DNA, 25 bp, Mus musculus
atggatctgcctggtacaactgtaa

SEQ ID NO: 212369 - DNA, 25 bp, Mus musculus
atggatctttgggcttgtgatgcct

SEQ ID NO: 212370 - DNA, 25 bp, Mus musculus
atggatctttgggtctgaacgggat

SEQ ID NO: 212371 - DNA, 25 bp, Mus musculus
atggatgaaacagcatcaaaagacg

SEQ ID NO: 212372 - DNA, 25 bp, Mus musculus
atggatgaactcctgaaagaaattc

SEQ ID NO: 212373 - DNA, 25 bp, Mus musculus
atggatgaagaactcgacagcccgg

SEQ ID NO: 212374 - DNA, 25 bp, Mus musculus
atggatgaaggcaagctacagtttc

SEQ ID NO: 212375 - DNA, 25 bp, Mus musculus
atggatgaaggctagctacagtttc

SEQ ID NO: 212376 - DNA, 25 bp, Mus musculus
atggatgaattcaaggtggacattc

SEQ ID NO: 212377 - DNA, 25 bp, Mus musculus
atggatgaattgaagccccacagga

SEQ ID NO: 212378 - DNA, 25 bp, Mus musculus
atggatgaatttcaggaatatacca

SEQ ID NO: 212379 - DNA, 25 bp, Mus musculus
atggatgaatttgctggactcttgg

SEQ ID NO: 212380 - DNA, 25 bp, Mus musculus
atggatgaccagttggcaaagctcc

SEQ ID NO: 212381 - DNA, 25 bp, Mus musculus
atggatgatagtagtgtcctggagg

SEQ ID NO: 212382 - DNA, 25 bp, Mus musculus
atggatgatagtagttacacctcta

SEQ ID NO: 212383 - DNA, 25 bp, Mus musculus
atggatgatctggacgatgattctg

SEQ ID NO: 212384 - DNA, 25 bp, Mus musculus
atggatgattaaggactttctgagc

SEQ ID NO: 212385 - DNA, 25 bp, Mus musculus
atggatgcaaagcagaacaggggct

SEQ ID NO: 212386 - DNA, 25 bp, Mus musculus
atggatgcaggggtcccaatttcat

SEQ ID NO: 212387 - DNA, 25 bp, Mus musculus
atggatgcaggtgtagcagtgggat

SEQ ID NO: 212388 - DNA, 25 bp, Mus musculus
atggatgcataaggaaagacaagaa

SEQ ID NO: 212389 - DNA, 25 bp, Mus musculus
atggatgctaatgcactgtctcaaa

SEQ ID NO: 212390 - DNA, 25 bp, Mus musculus
atggatgctctcaggagttcctggt

SEQ ID NO: 212391 - DNA, 25 bp, Mus musculus
atggatgctgccagctggacaggcc

SEQ ID NO: 212392 - DNA, 25 bp, Mus musculus
atggatgctgtgtccaccacggccc

SEQ ID NO: 212393 - DNA, 25 bp, Mus musculus
atggatggaaggggtgaccactgac

SEQ ID NO: 212394 - DNA, 25 bp, Mus musculus
atggatggagagaatgccacggtcc

SEQ ID NO: 212395 - DNA, 25 bp, Mus musculus
atggatggagaggttacagctgtgg

SEQ ID NO: 212396 - DNA, 25 bp, Mus musculus
atggatggagggatcgcttacactt

SEQ ID NO: 212397 - DNA, 25 bp, Mus musculus
atggatggagtgacggatgacgact

SEQ ID NO: 212398 - DNA, 25 bp, Mus musculus
atggatgggagacaatcccagctgg

SEQ ID NO: 212399 - DNA, 25 bp, Mus musculus
atggatgggagacctggaaccctac

SEQ ID NO: 212400 - DNA, 25 bp, Mus musculus
atggatgggagacgatctggacgtg

SEQ ID NO: 212401 - DNA, 25 bp, Mus musculus
atggatgtcagttctgtgaacagat

SEQ ID NO: 212402 - DNA, 25 bp, Mus musculus
atggatgtccagctggctaacctca

SEQ ID NO: 212403 - DNA, 25 bp, Mus musculus
atggatgttggcaaggcccgaggct

SEQ ID NO: 212404 - DNA, 25 bp, Mus musculus
atggattaaagctatcccctctgcc

SEQ ID NO: 212405 - DNA, 25 bp, Mus musculus
atggattacaagactccactgcaaa

SEQ ID NO: 212406 - DNA, 25 bp, Mus musculus
atggattaccatctagatgttggct

SEQ ID NO: 212407 - DNA, 25 bp, Mus musculus
atggattattgggcttgggtgactc

SEQ ID NO: 212408 - DNA, 25 bp, Mus musculus
atggattcactagggaaggaaaaga

SEQ ID NO: 212409 - DNA, 25 bp, Mus musculus
atggattcagaaaattaatgagtta

SEQ ID NO: 212410 - DNA, 25 bp, Mus musculus
atggattcagagtccagaactttcc

SEQ ID NO: 212411 - DNA, 25 bp, Mus musculus
atggattcagattactcgggacaag

SEQ ID NO: 212412 - DNA, 25 bp, Mus musculus
atggattcagggctgaggcactagc

SEQ ID NO: 212413 - DNA, 25 bp, Mus musculus
atggattcagtggggtgatgctccg

SEQ ID NO: 212414 - DNA, 25 bp, Mus musculus
atggattcccaggtgaggacacttg

SEQ ID NO: 212415 - DNA, 25 bp, Mus musculus
atggattctgattgtggaagcttac

SEQ ID NO: 212416 - DNA, 25 bp, Mus musculus
atggattcttggcacttgatgcact

SEQ ID NO: 212417 - DNA, 25 bp, Mus musculus
atggattggcttccaggaggcaggc

SEQ ID NO: 212418 - DNA, 25 bp, Mus musculus
atggattgtcgcgatagagtacaac

SEQ ID NO: 212419 - DNA, 25 bp, Mus musculus
atggattgtgtgagagattggtgtc

SEQ ID NO: 212420 - DNA, 25 bp, Mus musculus
atggatttagaggaggatatgatgg

SEQ ID NO: 212421 - DNA, 25 bp, Mus musculus
atggatttcaaatctaaagcgggaa

SEQ ID NO: 212422 - DNA, 25 bp, Mus musculus
atggatttcagattgccagatcagt

SEQ ID NO: 212423 - DNA, 25 bp, Mus musculus
atggatttcagattggtggaccttc

SEQ ID NO: 212424 - DNA, 25 bp, Mus musculus
atggatttgacggagccacggccgc

SEQ ID NO: 212425 - DNA, 25 bp, Mus musculus
atggatttgatagacgtgaacgaag

SEQ ID NO: 212426 - DNA, 25 bp, Mus musculus
atggatttgctcaaaccagaacttg

SEQ ID NO: 212427 - DNA, 25 bp, Mus musculus
atggattttaaaaggaaacagacag

SEQ ID NO: 212428 - DNA, 25 bp, Mus musculus
atggattttaagggtctcacaccag

SEQ ID NO: 212429 - DNA, 25 bp, Mus musculus
atggattttaaggtgagactgtgga

SEQ ID NO: 212430 - DNA, 25 bp, Mus musculus
atggcaaaaaggtggtggagaaaaa

SEQ ID NO: 212431 - DNA, 25 bp, Mus musculus
atggcaaaagatgccagtctaattg

SEQ ID NO: 212432 - DNA, 25 bp, Mus musculus
atggcaaaagatgtgtggtatctct

SEQ ID NO: 212433 - DNA, 25 bp, Mus musculus
atggcaaaagtttcttctgggacca

SEQ ID NO: 212434 - DNA, 25 bp, Mus musculus
atggcaaacacctccctctcccagt

SEQ ID NO: 212435 - DNA, 25 bp, Mus musculus
atggcaaattttggtgctggggaca

SEQ ID NO: 212436 - DNA, 25 bp, Mus musculus
atggcaacaggtttatggtcggctg

SEQ ID NO: 212437 - DNA, 25 bp, Mus musculus
atggcaacctcctctgacctctggg

SEQ ID NO: 212438 - DNA, 25 bp, Mus musculus
atggcaagattaaagctaaggaata

SEQ ID NO: 212439 - DNA, 25 bp, Mus musculus
atggcaagattaaaggaaccaatga

SEQ ID NO: 212440 - DNA, 25 bp, Mus musculus
atggcaaggagctttggaacctccg

SEQ ID NO: 212441 - DNA, 25 bp, Mus musculus
atggcaagggaggaccgggctcatc

SEQ ID NO: 212442 - DNA, 25 bp, Mus musculus
atggcaagggagggcgtggacgggt

SEQ ID NO: 212443 - DNA, 25 bp, Mus musculus
atggcaagtgctcaggaagactctt

SEQ ID NO: 212444 - DNA, 25 bp, Mus musculus
atggcaagtgctcaggaggccatga

SEQ ID NO: 212445 - DNA, 25 bp, Mus musculus
atggcaatgccaggtggcccagagt

SEQ ID NO: 212446 - DNA, 25 bp, Mus musculus
atggcaatgccaggttgaacgacat

SEQ ID NO: 212447 - DNA, 25 bp, Mus musculus
atggcaatggcagaaagaactcacg

SEQ ID NO: 212448 - DNA, 25 bp, Mus musculus
atggcaatggcagtgagcaccactc

SEQ ID NO: 212449 - DNA, 25 bp, Mus musculus
atggcaatgtccaggaccgcattgg

SEQ ID NO: 212450 - DNA, 25 bp, Mus musculus
atggcaatttcaaggcaactttcca

SEQ ID NO: 212451 - DNA, 25 bp, Mus musculus
atggcacaagaacaagtaagaagtt

SEQ ID NO: 212452 - DNA, 25 bp, Mus musculus
atggcacacagaaaggggagtgtgt

SEQ ID NO: 212453 - DNA, 25 bp, Mus musculus
atggcacagaagatgctgacaaatc

SEQ ID NO: 212454 - DNA, 25 bp, Mus musculus
atggcacagacatgatggtgggcat

SEQ ID NO: 212455 - DNA, 25 bp, Mus musculus
atggcacattcaaggacatcgagga

SEQ ID NO: 212456 - DNA, 25 bp, Mus musculus
atggcacattcaaggactgggctga

SEQ ID NO: 212457 - DNA, 25 bp, Mus musculus
atggcaccaggattttaattcctgc

SEQ ID NO: 212458 - DNA, 25 bp, Mus musculus
atggcacccaagaatcagagcgaga

SEQ ID NO: 212459 - DNA, 25 bp, Mus musculus
atggcacccaagctttcagatgcag

SEQ ID NO: 212460 - DNA, 25 bp, Mus musculus
atggcacccaggcacggagggagtt

SEQ ID NO: 212461 - DNA, 25 bp, Mus musculus
atggcacccaggcgcgaagggagct

SEQ ID NO: 212462 - DNA, 25 bp, Mus musculus
atggcacccaggtacgcagggaata

SEQ ID NO: 212463 - DNA, 25 bp, Mus musculus
atggcactgattggtgctgtcagat

SEQ ID NO: 212464 - DNA, 25 bp, Mus musculus
atggcactgcagctgctcctggcac

SEQ ID NO: 212465 - DNA, 25 bp, Mus musculus
atggcactgggtggtgaaagtgaag

SEQ ID NO: 212466 - DNA, 25 bp, Mus musculus
atggcagacagagaggctccgcagg

SEQ ID NO: 212467 - DNA, 25 bp, Mus musculus
atggcagagtgttcaacttctgtag

SEQ ID NO: 212468 - DNA, 25 bp, Mus musculus
atggcagcaaacccctccccctccg

SEQ ID NO: 212469 - DNA, 25 bp, Mus musculus
atggcagcaaagatccctccccgcg

SEQ ID NO: 212470 - DNA, 25 bp, Mus musculus
atggcagcacagcttagaaccatac

SEQ ID NO: 212471 - DNA, 25 bp, Mus musculus
atggcagcagcttctaggtgcgccc

SEQ ID NO: 212472 - DNA, 25 bp, Mus musculus
atggcagcctgtcaacaatggctca

SEQ ID NO: 212473 - DNA, 25 bp, Mus musculus
atggcagcctgtcaagaatatcgcc

SEQ ID NO: 212474 - DNA, 25 bp, Mus musculus
atggcaggaaatctcaccacatctc

SEQ ID NO: 212475 - DNA, 25 bp, Mus musculus
atggcaggcagtgtggattgtctgg

SEQ ID NO: 212476 - DNA, 25 bp, Mus musculus
atggcagtagctcagcttcttcagc

SEQ ID NO: 212477 - DNA, 25 bp, Mus musculus
atggcagtagctcaggaatgtcaag

SEQ ID NO: 212478 - DNA, 25 bp, Mus musculus
atggcagtgaagcggatacgggcca

SEQ ID NO: 212479 - DNA, 25 bp, Mus musculus
atggcagtgtgcagatttgtgaata

SEQ ID NO: 212480 - DNA, 25 bp, Mus musculus
atggcagttgcgggagtgggaggtg

SEQ ID NO: 212481 - DNA, 25 bp, Mus musculus
atggcatatcagccatggacggagt

SEQ ID NO: 212482 - DNA, 25 bp, Mus musculus
atggcatatgagcagatgaaacggc

SEQ ID NO: 212483 - DNA, 25 bp, Mus musculus
atggcatcaagttcatgggcggtgg

SEQ ID NO: 212484 - DNA, 25 bp, Mus musculus
atggcatcacctttattgacagtaa

SEQ ID NO: 212485 - DNA, 25 bp, Mus musculus
atggcatcacgggagacaatgtccg

SEQ ID NO: 212486 - DNA, 25 bp, Mus musculus
atggcatcagaacggggctctttac

SEQ ID NO: 212487 - DNA, 25 bp, Mus musculus
atggcatcaggacgggcctcttcac

SEQ ID NO: 212488 - DNA, 25 bp, Mus musculus
atggcatctggaaagacaggagctt

SEQ ID NO: 212489 - DNA, 25 bp, Mus musculus
atggcatctggaaaggtttccaaaa

SEQ ID NO: 212490 - DNA, 25 bp, Mus musculus
atggcatgaccaagatgccaaagac

SEQ ID NO: 212491 - DNA, 25 bp, Mus musculus
atggcatgaccaaggtacttcctgg

SEQ ID NO: 212492 - DNA, 25 bp, Mus musculus
atggcatgatgtgaggcactaagtg

SEQ ID NO: 212493 - DNA, 25 bp, Mus musculus
atggcatggatgaagaactcgacag

SEQ ID NO: 212494 - DNA, 25 bp, Mus musculus
atggcatgtggctcctacccaggtc

SEQ ID NO: 212495 - DNA, 25 bp, Mus musculus
atggcatgtggctcgacatgaacga

SEQ ID NO: 212496 - DNA, 25 bp, Mus musculus
atggcattgatggtgaccgaggtcc

SEQ ID NO: 212497 - DNA, 25 bp, Mus musculus
atggccaaaacaagagttcaagtcc

SEQ ID NO: 212498 - DNA, 25 bp, Mus musculus
atggccaaaataaaggattcacaga

SEQ ID NO: 212499 - DNA, 25 bp, Mus musculus
atggccaagaagacatccctgaagt

SEQ ID NO: 212500 - DNA, 25 bp, Mus musculus
atggccaagaagtctacatgtgggt

SEQ ID NO: 212501 - DNA, 25 bp, Mus musculus
atggccaaggaaaattgtccagcgc

SEQ ID NO: 212502 - DNA, 25 bp, Mus musculus
atggccaagggactaaagaagatgc

SEQ ID NO: 212503 - DNA, 25 bp, Mus musculus
atggccaataaggatcgcctgaatt

SEQ ID NO: 212504 - DNA, 25 bp, Mus musculus
atggccaatgaggtcactcgttaca

SEQ ID NO: 212505 - DNA, 25 bp, Mus musculus
atggccaatggtcagttggtgaaga

SEQ ID NO: 212506 - DNA, 25 bp, Mus musculus
atggccaccagaagattcagaatgt

SEQ ID NO: 212507 - DNA, 25 bp, Mus musculus
atggccacctccaagaatggtggca

SEQ ID NO: 212508 - DNA, 25 bp, Mus musculus
atggccactgtggcctcctgagtga

SEQ ID NO: 212509 - DNA, 25 bp, Mus musculus
atggccactgtggtctctgtgatga

SEQ ID NO: 212510 - DNA, 25 bp, Mus musculus
atggccacttgcaggagttcgagga

SEQ ID NO: 212511 - DNA, 25 bp, Mus musculus
atggccacttgcaggctgtggggtc

SEQ ID NO: 212512 - DNA, 25 bp, Mus musculus
atggccagatctaggcagtgcacag

SEQ ID NO: 212513 - DNA, 25 bp, Mus musculus
atggccagatctagtgctcacatgg

SEQ ID NO: 212514 - DNA, 25 bp, Mus musculus
atggccagcaagatgatgactctgc

SEQ ID NO: 212515 - DNA, 25 bp, Mus musculus
atggccagcaggctccagcccactc

SEQ ID NO: 212516 - DNA, 25 bp, Mus musculus
atggccagcaggtgcttgtgtgtaa

SEQ ID NO: 212517 - DNA, 25 bp, Mus musculus
atggccagccctgctctcggagact

SEQ ID NO: 212518 - DNA, 25 bp, Mus musculus
atggccagctgcagacgaagcttct

SEQ ID NO: 212519 - DNA, 25 bp, Mus musculus
atggccagctgcagagcgaagtcac

SEQ ID NO: 212520 - DNA, 25 bp, Mus musculus
atggccagctgcagctgctgataaa

SEQ ID NO: 212521 - DNA, 25 bp, Mus musculus
atggccaggcctagccaggtgtaga

SEQ ID NO: 212522 - DNA, 25 bp, Mus musculus
atggccagggctcaggagctccttc

SEQ ID NO: 212523 - DNA, 25 bp, Mus musculus
atggccagtaactctgaatgtgaaa

SEQ ID NO: 212524 - DNA, 25 bp, Mus musculus
atggccatcaagacctctcacagcc

SEQ ID NO: 212525 - DNA, 25 bp, Mus musculus
atggccatcagtcctctacgaatgt

SEQ ID NO: 212526 - DNA, 25 bp, Mus musculus
atggccatccagaagcctccccagc

SEQ ID NO: 212527 - DNA, 25 bp, Mus musculus
atggccatgtacccagaggatcatt

SEQ ID NO: 212528 - DNA, 25 bp, Mus musculus
atggccatgtacccccatgcccggt

SEQ ID NO: 212529 - DNA, 25 bp, Mus musculus
atggccatgtacccgcacgtgacac

SEQ ID NO: 212530 - DNA, 25 bp, Mus musculus
atggccatgtgtttgagatcctgtc

SEQ ID NO: 212531 - DNA, 25 bp, Mus musculus
atggcccaaagagggagcggaagcc

SEQ ID NO: 212532 - DNA, 25 bp, Mus musculus
atggcccacaaggaatgtgggtgcc

SEQ ID NO: 212533 - DNA, 25 bp, Mus musculus
atggcccaggcctggcttcttcaca

SEQ ID NO: 212534 - DNA, 25 bp, Mus musculus
atggcccccatggttcagcatgggc

SEQ ID NO: 212535 - DNA, 25 bp, Mus musculus
atggcccctgttggcatcctcaaat

SEQ ID NO: 212536 - DNA, 25 bp, Mus musculus
atggcccggagcacgcagcccgact

SEQ ID NO: 212537 - DNA, 25 bp, Mus musculus
atggcccggattaaggggacctggc

SEQ ID NO: 212538 - DNA, 25 bp, Mus musculus
atggccctaaaggggttggtgctat

SEQ ID NO: 212539 - DNA, 25 bp, Mus musculus
atggccctggggaagaagagtctga

SEQ ID NO: 212540 - DNA, 25 bp, Mus musculus
atggccctggggctgggtccttggc

SEQ ID NO: 212541 - DNA, 25 bp, Mus musculus
atggccggagcagagtctggccaca

SEQ ID NO: 212542 - DNA, 25 bp, Mus musculus
atggccggccggcgggtgcccagat

SEQ ID NO: 212543 - DNA, 25 bp, Mus musculus
atggccgggacaaggtaatgttctc

SEQ ID NO: 212544 - DNA, 25 bp, Mus musculus
atggccggggcgaggttctctccac

SEQ ID NO: 212545 - DNA, 25 bp, Mus musculus
atggccgtattgagagttgcattgt

SEQ ID NO: 212546 - DNA, 25 bp, Mus musculus
atggccgtattgaggaacaaaggac

SEQ ID NO: 212547 - DNA, 25 bp, Mus musculus
atggcctaccagagcaatttttata

SEQ ID NO: 212548 - DNA, 25 bp, Mus musculus
atggcctattacatgccaacaattc

SEQ ID NO: 212549 - DNA, 25 bp, Mus musculus
atggcctattacatggatacatggg

SEQ ID NO: 212550 - DNA, 25 bp, Mus musculus
atggcctcacacaagtttaaaagga

SEQ ID NO: 212551 - DNA, 25 bp, Mus musculus
atggcctcacagatccgtgaagagg

SEQ ID NO: 212552 - DNA, 25 bp, Mus musculus
atggcctcagaagctcgaagcggtc

SEQ ID NO: 212553 - DNA, 25 bp, Mus musculus
atggcctcagcaatgtgaagctgaa

SEQ ID NO: 212554 - DNA, 25 bp, Mus musculus
atggcctcaggtggcccggcagatc

SEQ ID NO: 212555 - DNA, 25 bp, Mus musculus
atggcctccatgtggatataccgct

SEQ ID NO: 212556 - DNA, 25 bp, Mus musculus
atggcctccatgtggcatttggcac

SEQ ID NO: 212557 - DNA, 25 bp, Mus musculus
atggcctctatctggggactgcctc

SEQ ID NO: 212558 - DNA, 25 bp, Mus musculus
atggcctctatctgggttggacctc

SEQ ID NO: 212559 - DNA, 25 bp, Mus musculus
atggcctctgcaggtggcgacctgc

SEQ ID NO: 212560 - DNA, 25 bp, Mus musculus
atggcctgagaattcttttcgtcct

SEQ ID NO: 212561 - DNA, 25 bp, Mus musculus
atggcctggtgtgggctaaattggt

SEQ ID NO: 212562 - DNA, 25 bp, Mus musculus
atggcctgtctcagatgtcttcagt

SEQ ID NO: 212563 - DNA, 25 bp, Mus musculus
atggcctgtgtgcatgtgaacgagt

SEQ ID NO: 212564 - DNA, 25 bp, Mus musculus
atggcctgtgtggatgtgaacgagt

SEQ ID NO: 212565 - DNA, 25 bp, Mus musculus
atggccttgaaaagatgaatgagaa

SEQ ID NO: 212566 - DNA, 25 bp, Mus musculus
atggccttgaaaagattggccacct

SEQ ID NO: 212567 - DNA, 25 bp, Mus musculus
atggccttgaaaaggtagacccaca

SEQ ID NO: 212568 - DNA, 25 bp, Mus musculus
atggccttgatgtgagccatgagcc

SEQ ID NO: 212569 - DNA, 25 bp, Mus musculus
atggccttgtaaacatcagctgcgg

SEQ ID NO: 212570 - DNA, 25 bp, Mus musculus
atggcctttaagcctggaaaggaaa

SEQ ID NO: 212571 - DNA, 25 bp, Mus musculus
atggcctttaccagcctgccgacat

SEQ ID NO: 212572 - DNA, 25 bp, Mus musculus
atggcctttaccaggacagccactt

SEQ ID NO: 212573 - DNA, 25 bp, Mus musculus
atggcctttaccagggtctcagcac

SEQ ID NO: 212574 - DNA, 25 bp, Mus musculus
atggcctttcaggtgatctgtctgg

SEQ ID NO: 212575 - DNA, 25 bp, Mus musculus
atggcctttttgcctccagcgtctc

SEQ ID NO: 212576 - DNA, 25 bp, Mus musculus
atggcgaaccaggtgatcaggtgta

SEQ ID NO: 212577 - DNA, 25 bp, Mus musculus
atggcgaaggaggatgaggaacctg

SEQ ID NO: 212578 - DNA, 25 bp, Mus musculus
atggcgaaggagggtggccggactg

SEQ ID NO: 212579 - DNA, 25 bp, Mus musculus
atggcgacagaaaggaatcccaatg

SEQ ID NO: 212580 - DNA, 25 bp, Mus musculus
atggcgaccagtacaaggccacaga

SEQ ID NO: 212581 - DNA, 25 bp, Mus musculus
atggcgacctggtgactccatacca

SEQ ID NO: 212582 - DNA, 25 bp, Mus musculus
atggcgactgttgccctctatacct

SEQ ID NO: 212583 - DNA, 25 bp, Mus musculus
atggcgagacaactaaattttccaa

SEQ ID NO: 212584 - DNA, 25 bp, Mus musculus
atggcgaggagccatcaagcaaatt

SEQ ID NO: 212585 - DNA, 25 bp, Mus musculus
atggcgaggaggaggtgtagcccat

SEQ ID NO: 212586 - DNA, 25 bp, Mus musculus
atggcgaggaggatctgatggacaa

SEQ ID NO: 212587 - DNA, 25 bp, Mus musculus
atggcgagtggaaggtcctcatcat

SEQ ID NO: 212588 - DNA, 25 bp, Mus musculus
atggcgagtggaagtcgtggaagac

SEQ ID NO: 212589 - DNA, 25 bp, Mus musculus
atggcgccagccaggacggcttcac

SEQ ID NO: 212590 - DNA, 25 bp, Mus musculus
atggcgccccaccagaaaacgagga

SEQ ID NO: 212591 - DNA, 25 bp, Mus musculus
atggcgccgccgggttcaagcgctg

SEQ ID NO: 212592 - DNA, 25 bp, Mus musculus
atggcgcctgtgaaaaagcttgtgg

SEQ ID NO: 212593 - DNA, 25 bp, Mus musculus
atggcgctccagactgtacccacag

SEQ ID NO: 212594 - DNA, 25 bp, Mus musculus
atggcgctccagaggctggaggagc

SEQ ID NO: 212595 - DNA, 25 bp, Mus musculus
atggcgctccagggacctctgagct

SEQ ID NO: 212596 - DNA, 25 bp, Mus musculus
atggcgctccaggtgcccatcagct

SEQ ID NO: 212597 - DNA, 25 bp, Mus musculus
atggcgctgtccagggtcttcaaag

SEQ ID NO: 212598 - DNA, 25 bp, Mus musculus
atggcggaagatataacagactttc

SEQ ID NO: 212599 - DNA, 25 bp, Mus musculus
atggcggacagtttcctgtggcctt

SEQ ID NO: 212600 - DNA, 25 bp, Mus musculus
atggcggagaggtattagaagataa

SEQ ID NO: 212601 - DNA, 25 bp, Mus musculus
atggcggagaggtgttctctgagga

SEQ ID NO: 212602 - DNA, 25 bp, Mus musculus
atggcggaggaggagttctccaaca

SEQ ID NO: 212603 - DNA, 25 bp, Mus musculus
atggcggaggggcaggttctggtat

SEQ ID NO: 212604 - DNA, 25 bp, Mus musculus
atggcggatcatgtgcagagcctgg

SEQ ID NO: 212605 - DNA, 25 bp, Mus musculus
atggcggccgaggtctgactgggcc

SEQ ID NO: 212606 - DNA, 25 bp, Mus musculus
atggcggccgccaaggacagtcacg

SEQ ID NO: 212607 - DNA, 25 bp, Mus musculus
atggcggcctttaggatgggaaagt

SEQ ID NO: 212608 - DNA, 25 bp, Mus musculus
atggcggcctttaggctccccatat

SEQ ID NO: 212609 - DNA, 25 bp, Mus musculus
atggcggctctacagccagaatgtc

SEQ ID NO: 212610 - DNA, 25 bp, Mus musculus
atggcggctctaggctccagcagcc

SEQ ID NO: 212611 - DNA, 25 bp, Mus musculus
atggcggctgggaccctgtacacat

SEQ ID NO: 212612 - DNA, 25 bp, Mus musculus
atggcgggcaacagttcactgagga

SEQ ID NO: 212613 - DNA, 25 bp, Mus musculus
atggcgggccggactatgcaagctg

SEQ ID NO: 212614 - DNA, 25 bp, Mus musculus
atggcgggccgggtttctgttgatg

SEQ ID NO: 212615 - DNA, 25 bp, Mus musculus
atggcggtggacatcatcctgggca

SEQ ID NO: 212616 - DNA, 25 bp, Mus musculus
atggcggtgtcaagaaaaggaagtc

SEQ ID NO: 212617 - DNA, 25 bp, Mus musculus
atggcggtgtcaagccacagagcaa

SEQ ID NO: 212618 - DNA, 25 bp, Mus musculus
atggcggtgtcaaggaaccacaaac

SEQ ID NO: 212619 - DNA, 25 bp, Mus musculus
atggcgtaaagagactgatgtctgg

SEQ ID NO: 212620 - DNA, 25 bp, Mus musculus
atggcgtaaagaggttctccccaat

SEQ ID NO: 212621 - DNA, 25 bp, Mus musculus
atggcgtcgccggggatagaagtgg

SEQ ID NO: 212622 - DNA, 25 bp, Mus musculus
atggcgtgacctcctcttgcttctg

SEQ ID NO: 212623 - DNA, 25 bp, Mus musculus
atggcgtgatccaggaagccccgaa

SEQ ID NO: 212624 - DNA, 25 bp, Mus musculus
atggcgtggcagtgtacagctgtaa

SEQ ID NO: 212625 - DNA, 25 bp, Mus musculus
atggcgttggagatctcatcccgta

SEQ ID NO: 212626 - DNA, 25 bp, Mus musculus
atggcgttggagtgtcccatcctga

SEQ ID NO: 212627 - DNA, 25 bp, Mus musculus
atggctaaaactgtgcagttgtact

SEQ ID NO: 212628 - DNA, 25 bp, Mus musculus
atggctaacccaggaactggtgctc

SEQ ID NO: 212629 - DNA, 25 bp, Mus musculus
atggctaagtgggccctgcattatc

SEQ ID NO: 212630 - DNA, 25 bp, Mus musculus
atggctacagggtttatttggtcaa

SEQ ID NO: 212631 - DNA, 25 bp, Mus musculus
atggctacatttgtcctctctaaca

SEQ ID NO: 212632 - DNA, 25 bp, Mus musculus
atggctacggaatgtcacttgcagt

SEQ ID NO: 212633 - DNA, 25 bp, Mus musculus
atggctacggccatctttttttgct

SEQ ID NO: 212634 - DNA, 25 bp, Mus musculus
atggctactatactctgtattctgt

SEQ ID NO: 212635 - DNA, 25 bp, Mus musculus
atggctactggggatgcacaaaaag

SEQ ID NO: 212636 - DNA, 25 bp, Mus musculus
atggctactggttcaagatggcttt

SEQ ID NO: 212637 - DNA, 25 bp, Mus musculus
atggctagctcgtgtgccgtgcagg

SEQ ID NO: 212638 - DNA, 25 bp, Mus musculus
atggctatccagatattgctgttgg

SEQ ID NO: 212639 - DNA, 25 bp, Mus musculus
atggctatgccttctaggtttgata

SEQ ID NO: 212640 - DNA, 25 bp, Mus musculus
atggctatgttggaaatataaatga

SEQ ID NO: 212641 - DNA, 25 bp, Mus musculus
atggctattcggagaataatgtttt

SEQ ID NO: 212642 - DNA, 25 bp, Mus musculus
atggctattgagcatgcaccattgt

SEQ ID NO: 212643 - DNA, 25 bp, Mus musculus
atggctcaagcaggaacctagcaaa

SEQ ID NO: 212644 - DNA, 25 bp, Mus musculus
atggctcaagcagggccacaatgcc

SEQ ID NO: 212645 - DNA, 25 bp, Mus musculus
atggctcaagcaggtaacaaatcac

SEQ ID NO: 212646 - DNA, 25 bp, Mus musculus
atggctcaaggaacagtgagcagaa

SEQ ID NO: 212647 - DNA, 25 bp, Mus musculus
atggctcactggtcctgcgactgga

SEQ ID NO: 212648 - DNA, 25 bp, Mus musculus
atggctcagggccatcgaagacggc

SEQ ID NO: 212649 - DNA, 25 bp, Mus musculus
atggctcagtgggctccgtgaagac

SEQ ID NO: 212650 - DNA, 25 bp, Mus musculus
atggctcatcagctggctctgtcca

SEQ ID NO: 212651 - DNA, 25 bp, Mus musculus
atggctcattgaaggttcaaccatt

SEQ ID NO: 212652 - DNA, 25 bp, Mus musculus
atggctccaccactgagtttgaaga

SEQ ID NO: 212653 - DNA, 25 bp, Mus musculus
atggctccacccaggctaccttcat

SEQ ID NO: 212654 - DNA, 25 bp, Mus musculus
atggctccattcagagcataccaga

SEQ ID NO: 212655 - DNA, 25 bp, Mus musculus
atggctccattcagttttccttttt

SEQ ID NO: 212656 - DNA, 25 bp, Mus musculus
atggctccctgcatgtacccctcaa

SEQ ID NO: 212657 - DNA, 25 bp, Mus musculus
atggctccttaccaggagatcgaga

SEQ ID NO: 212658 - DNA, 25 bp, Mus musculus
atggctcgcaggtttgcctgcaatg

SEQ ID NO: 212659 - DNA, 25 bp, Mus musculus
atggctcggtgtgtcccttagaaga

SEQ ID NO: 212660 - DNA, 25 bp, Mus musculus
atggctcggtgtgtgctgcttttga

SEQ ID NO: 212661 - DNA, 25 bp, Mus musculus
atggctctcattattttcacaaagt

SEQ ID NO: 212662 - DNA, 25 bp, Mus musculus
atggctctgcaggtagccagaaatg

SEQ ID NO: 212663 - DNA, 25 bp, Mus musculus
atggctctggggttggttctggaca

SEQ ID NO: 212664 - DNA, 25 bp, Mus musculus
atggctctggtcgtggacgcagacg

SEQ ID NO: 212665 - DNA, 25 bp, Mus musculus
atggctcttttccaggtggttttcc

SEQ ID NO: 212666 - DNA, 25 bp, Mus musculus
atggctgaagtgaggggggtccagc

SEQ ID NO: 212667 - DNA, 25 bp, Mus musculus
atggctgaagtgagtgggcccagcc

SEQ ID NO: 212668 - DNA, 25 bp, Mus musculus
atggctgacaaagagcttccacttt

SEQ ID NO: 212669 - DNA, 25 bp, Mus musculus
atggctgacaaagggcactggttca

SEQ ID NO: 212670 - DNA, 25 bp, Mus musculus
atggctgacaagatgcaggtactac

SEQ ID NO: 212671 - DNA, 25 bp, Mus musculus
atggctgacaagcctatcctctact

SEQ ID NO: 212672 - DNA, 25 bp, Mus musculus
atggctgacacgcttccaggtccga

SEQ ID NO: 212673 - DNA, 25 bp, Mus musculus
atggctgacacggtccgaggagaca

SEQ ID NO: 212674 - DNA, 25 bp, Mus musculus
atggctgacagatctcggcaaaagt

SEQ ID NO: 212675 - DNA, 25 bp, Mus musculus
atggctgacagcttggatctgtctg

SEQ ID NO: 212676 - DNA, 25 bp, Mus musculus
atggctgaccttcatgcaaggctgg

SEQ ID NO: 212677 - DNA, 25 bp, Mus musculus
atggctgatgaggtataccaagaca

SEQ ID NO: 212678 - DNA, 25 bp, Mus musculus
atggctgcaaaaaagcactggaatg

SEQ ID NO: 212679 - DNA, 25 bp, Mus musculus
atggctgcaaacactcagagtgatt

SEQ ID NO: 212680 - DNA, 25 bp, Mus musculus
atggctgcaaagttgcagatatcaa

SEQ ID NO: 212681 - DNA, 25 bp, Mus musculus
atggctgcaagaaaatgccagaaaa

SEQ ID NO: 212682 - DNA, 25 bp, Mus musculus
atggctgcgtttgagcctgagcctt

SEQ ID NO: 212683 - DNA, 25 bp, Mus musculus
atggctgctgggaagtccgcccgtg

SEQ ID NO: 212684 - DNA, 25 bp, Mus musculus
atggctgcttataagagagcttcat

SEQ ID NO: 212685 - DNA, 25 bp, Mus musculus
atggctgcttataaggtgcacacag

SEQ ID NO: 212686 - DNA, 25 bp, Mus musculus
atggctggaacggctattcgctgcc

SEQ ID NO: 212687 - DNA, 25 bp, Mus musculus
atggctggaccgaagcccaaagccc

SEQ ID NO: 212688 - DNA, 25 bp, Mus musculus
atggctggaggaatctgcgaagttt

SEQ ID NO: 212689 - DNA, 25 bp, Mus musculus
atggctggaggggatgccaacaagg

SEQ ID NO: 212690 - DNA, 25 bp, Mus musculus
atggctggaggggtgatggtaatgc

SEQ ID NO: 212691 - DNA, 25 bp, Mus musculus
atggctggcaatgtccacagacaaa

SEQ ID NO: 212692 - DNA, 25 bp, Mus musculus
atggctgggccctgtttttgggaat

SEQ ID NO: 212693 - DNA, 25 bp, Mus musculus
atggctggtccatcctctggaccgt

SEQ ID NO: 212694 - DNA, 25 bp, Mus musculus
atggctgtatttgaaaaaactggcc

SEQ ID NO: 212695 - DNA, 25 bp, Mus musculus
atggctgtatttggaatgggctgct

SEQ ID NO: 212696 - DNA, 25 bp, Mus musculus
atggctgtgctgcagaaaaagcaga

SEQ ID NO: 212697 - DNA, 25 bp, Mus musculus
atggctgtgtgattgatcctgttac

SEQ ID NO: 212698 - DNA, 25 bp, Mus musculus
atggcttaaaagagtctcccccaca

SEQ ID NO: 212699 - DNA, 25 bp, Mus musculus
atggcttaaaagccgaagaagcagg

SEQ ID NO: 212700 - DNA, 25 bp, Mus musculus
atggcttaaaagctcgtgtggccag

SEQ ID NO: 212701 - DNA, 25 bp, Mus musculus
atggcttaaacgccataacccagac

SEQ ID NO: 212702 - DNA, 25 bp, Mus musculus
atggcttaacagaacaggagtgtgt

SEQ ID NO: 212703 - DNA, 25 bp, Mus musculus
atggcttaagaccgaagggaggagc

SEQ ID NO: 212704 - DNA, 25 bp, Mus musculus
atggcttaagggaccgacgtctgct

SEQ ID NO: 212705 - DNA, 25 bp, Mus musculus
atggcttatatgtgcacatggcgac

SEQ ID NO: 212706 - DNA, 25 bp, Mus musculus
atggcttatatgtggagctgtgtgg

SEQ ID NO: 212707 - DNA, 25 bp, Mus musculus
atggcttatgaacagatcaagcggg

SEQ ID NO: 212708 - DNA, 25 bp, Mus musculus
atggcttcaaacaagttcaaaagga

SEQ ID NO: 212709 - DNA, 25 bp, Mus musculus
atggcttcacctgggagaagagagg

SEQ ID NO: 212710 - DNA, 25 bp, Mus musculus
atggcttcactgcgctggcattgac

SEQ ID NO: 212711 - DNA, 25 bp, Mus musculus
atggcttcaggttgatatcaaaatt

SEQ ID NO: 212712 - DNA, 25 bp, Mus musculus
atggcttcctgcggcagagagtact

SEQ ID NO: 212713 - DNA, 25 bp, Mus musculus
atggcttccttcatgaagataagca

SEQ ID NO: 212714 - DNA, 25 bp, Mus musculus
atggcttctcccaaattaaatgatg

SEQ ID NO: 212715 - DNA, 25 bp, Mus musculus
atggcttctctctcggtggagacac

SEQ ID NO: 212716 - DNA, 25 bp, Mus musculus
atggcttctctcttccacttgtagt

SEQ ID NO: 212717 - DNA, 25 bp, Mus musculus
atggcttctgagaaactggtcaaaa

SEQ ID NO: 212718 - DNA, 25 bp, Mus musculus
atggcttctttctccttgtggacaa

SEQ ID NO: 212719 - DNA, 25 bp, Mus musculus
atggcttgaagatgataattagcac

SEQ ID NO: 212720 - DNA, 25 bp, Mus musculus
atggcttgctgaagctcaggtacct

SEQ ID NO: 212721 - DNA, 25 bp, Mus musculus
atggcttgctgaagtggcttttcat

SEQ ID NO: 212722 - DNA, 25 bp, Mus musculus
atggcttggaatgagactgcagatc

SEQ ID NO: 212723 - DNA, 25 bp, Mus musculus
atggcttgtgctcaaacaggctctg

SEQ ID NO: 212724 - DNA, 25 bp, Mus musculus
atggctttacaggaaatctgacgtt

SEQ ID NO: 212725 - DNA, 25 bp, Mus musculus
atggctttagcaagagcatggtcaa

SEQ ID NO: 212726 - DNA, 25 bp, Mus musculus
atggctttagcaaggcccgcggcca

SEQ ID NO: 212727 - DNA, 25 bp, Mus musculus
atggcttttatgatcattttaagca

SEQ ID NO: 212728 - DNA, 25 bp, Mus musculus
atggcttttgcaggtctgacagcgg

SEQ ID NO: 212729 - DNA, 25 bp, Mus musculus
atggctttttatttagaagaaagca

SEQ ID NO: 212730 - DNA, 25 bp, Mus musculus
atgggaaaaccaaaggtccagaata

SEQ ID NO: 212731 - DNA, 25 bp, Mus musculus
atgggaaaacggtatatgcaccatc

SEQ ID NO: 212732 - DNA, 25 bp, Mus musculus
atgggaaacctgaatctgtatcgat

SEQ ID NO: 212733 - DNA, 25 bp, Mus musculus
atgggaaactgccgccacagtacat

SEQ ID NO: 212734 - DNA, 25 bp, Mus musculus
atgggaaagcaccagcccacctaaa

SEQ ID NO: 212735 - DNA, 25 bp, Mus musculus
atgggaaatacccaagtaccagcaa

SEQ ID NO: 212736 - DNA, 25 bp, Mus musculus
atgggaagaaaattgcagcctggag

SEQ ID NO: 212737 - DNA, 25 bp, Mus musculus
atgggaagactccaattcattgctt

SEQ ID NO: 212738 - DNA, 25 bp, Mus musculus
atgggaagatggaccggcagatgtt

SEQ ID NO: 212739 - DNA, 25 bp, Mus musculus
atgggaagcaggtacccacccggaa

SEQ ID NO: 212740 - DNA, 25 bp, Mus musculus
atgggaagcgacatgcgtactgagc

SEQ ID NO: 212741 - DNA, 25 bp, Mus musculus
atgggaagcgacatggtaagaatga

SEQ ID NO: 212742 - DNA, 25 bp, Mus musculus
atgggaaggacatgaatgtgttaat

SEQ ID NO: 212743 - DNA, 25 bp, Mus musculus
atgggaaggagctgtcagtagaagc

SEQ ID NO: 212744 - DNA, 25 bp, Mus musculus
atgggaaggatgaagattcctatca

SEQ ID NO: 212745 - DNA, 25 bp, Mus musculus
atgggaaggatgggtaacaaaggag

SEQ ID NO: 212746 - DNA, 25 bp, Mus musculus
atgggaaggatgtcctttcaacagg

SEQ ID NO: 212747 - DNA, 25 bp, Mus musculus
atgggaatctgatccgctgtactct

SEQ ID NO: 212748 - DNA, 25 bp, Mus musculus
atgggaattgtacagatatcgatga

SEQ ID NO: 212749 - DNA, 25 bp, Mus musculus
atgggacagaagggtgaccagggcg

SEQ ID NO: 212750 - DNA, 25 bp, Mus musculus
atgggacaggagacaattacaatgg

SEQ ID NO: 212751 - DNA, 25 bp, Mus musculus
atgggacaggagtgtctcttcttgc

SEQ ID NO: 212752 - DNA, 25 bp, Mus musculus
atgggacatgccaggtcctacatct

SEQ ID NO: 212753 - DNA, 25 bp, Mus musculus
atgggacccaggctgccctgccctc

SEQ ID NO: 212754 - DNA, 25 bp, Mus musculus
atgggacctcacctacccaaagctg

SEQ ID NO: 212755 - DNA, 25 bp, Mus musculus
atgggacctcagagtaatataaaga

SEQ ID NO: 212756 - DNA, 25 bp, Mus musculus
atgggacctcaggtctgttgtgggg

SEQ ID NO: 212757 - DNA, 25 bp, Mus musculus
atgggacgaagaagacctgtattcc

SEQ ID NO: 212758 - DNA, 25 bp, Mus musculus
atgggactaggatgatgtctacaga

SEQ ID NO: 212759 - DNA, 25 bp, Mus musculus
atgggactctgaacaaatcctgctg

SEQ ID NO: 212760 - DNA, 25 bp, Mus musculus
atgggactggagggtgacagaagac

SEQ ID NO: 212761 - DNA, 25 bp, Mus musculus
atgggacttaatttgagcataagga

SEQ ID NO: 212762 - DNA, 25 bp, Mus musculus
atgggagaaaggggcgctcctggca

SEQ ID NO: 212763 - DNA, 25 bp, Mus musculus
atgggagaagagacaattgggaaga

SEQ ID NO: 212764 - DNA, 25 bp, Mus musculus
atgggagaccacaagccggtgttcc

SEQ ID NO: 212765 - DNA, 25 bp, Mus musculus
atgggagaccggggaaaatgcactg

SEQ ID NO: 212766 - DNA, 25 bp, Mus musculus
atgggagaccgggtgacactggacc

SEQ ID NO: 212767 - DNA, 25 bp, Mus musculus
atgggagagctaaggatcaagcact

SEQ ID NO: 212768 - DNA, 25 bp, Mus musculus
atgggagatgagaaattatgcttca

SEQ ID NO: 212769 - DNA, 25 bp, Mus musculus
atgggagatgataaaagctttgatg

SEQ ID NO: 212770 - DNA, 25 bp, Mus musculus
atgggagcacagaggggaaggccca

SEQ ID NO: 212771 - DNA, 25 bp, Mus musculus
atgggagcacagtgtgcagcttgca

SEQ ID NO: 212772 - DNA, 25 bp, Mus musculus
atgggagcagcatgggatcccggag

SEQ ID NO: 212773 - DNA, 25 bp, Mus musculus
atgggagcctctttttcctgcaata

SEQ ID NO: 212774 - DNA, 25 bp, Mus musculus
atgggagctgatgttcaggtaaatg

SEQ ID NO: 212775 - DNA, 25 bp, Mus musculus
atgggagctggtaaatgatgatgag

SEQ ID NO: 212776 - DNA, 25 bp, Mus musculus
atgggaggaagggagatataaacaa

SEQ ID NO: 212777 - DNA, 25 bp, Mus musculus
atgggaggaggcacttgaatattgc

SEQ ID NO: 212778 - DNA, 25 bp, Mus musculus
atgggaggctatggtcgtggtggtg

SEQ ID NO: 212779 - DNA, 25 bp, Mus musculus
atgggagtgaggtgacttctgtgac

SEQ ID NO: 212780 - DNA, 25 bp, Mus musculus
atgggataaaaagaatgctgccaag

SEQ ID NO: 212781 - DNA, 25 bp, Mus musculus
atgggatacaaagtcctctcagcag

SEQ ID NO: 212782 - DNA, 25 bp, Mus musculus
atgggatacaagaacaatttttatt

SEQ ID NO: 212783 - DNA, 25 bp, Mus musculus
atgggatacatgccttctgccagca

SEQ ID NO: 212784 - DNA, 25 bp, Mus musculus
atgggatatgaggtgcagcagaaag

SEQ ID NO: 212785 - DNA, 25 bp, Mus musculus
atgggatccagagggctgactctgt

SEQ ID NO: 212786 - DNA, 25 bp, Mus musculus
atgggatcccccagggtgaagcact

SEQ ID NO: 212787 - DNA, 25 bp, Mus musculus
atgggatcccccagggttgtgactt

SEQ ID NO: 212788 - DNA, 25 bp, Mus musculus
atgggatccctgctttgtggaagga

SEQ ID NO: 212789 - DNA, 25 bp, Mus musculus
atgggatgaaacggaacattttccc

SEQ ID NO: 212790 - DNA, 25 bp, Mus musculus
atgggatgaaacggttctgtgatga

SEQ ID NO: 212791 - DNA, 25 bp, Mus musculus
atgggatgcaactgatgtttcccag

SEQ ID NO: 212792 - DNA, 25 bp, Mus musculus
atgggatgcaactgggaagagagca

SEQ ID NO: 212793 - DNA, 25 bp, Mus musculus
atgggatgggaaaggtgactctggc

SEQ ID NO: 212794 - DNA, 25 bp, Mus musculus
atgggatgttggcctgatgccctca

SEQ ID NO: 212795 - DNA, 25 bp, Mus musculus
atgggatgttgggtgtttgaagctt

SEQ ID NO: 212796 - DNA, 25 bp, Mus musculus
atgggattaccacaaatactggatg

SEQ ID NO: 212797 - DNA, 25 bp, Mus musculus
atgggattatcagaacaaaacgtgt

SEQ ID NO: 212798 - DNA, 25 bp, Mus musculus
atgggattcagaagataattggaga

SEQ ID NO: 212799 - DNA, 25 bp, Mus musculus
atgggattccaggagaaccacaatg

SEQ ID NO: 212800 - DNA, 25 bp, Mus musculus
atgggatttcaggataacctctttc

SEQ ID NO: 212801 - DNA, 25 bp, Mus musculus
atgggcaaaggaagatttgatgaaa

SEQ ID NO: 212802 - DNA, 25 bp, Mus musculus
atgggcaaatcaggaaaggatgtgg

SEQ ID NO: 212803 - DNA, 25 bp, Mus musculus
atgggcaacctttggtagagacctt

SEQ ID NO: 212804 - DNA, 25 bp, Mus musculus
atgggcaatatcatgattgaccccg

SEQ ID NO: 212805 - DNA, 25 bp, Mus musculus
atgggcaatgacacgtccccatctg

SEQ ID NO: 212806 - DNA, 25 bp, Mus musculus
atgggcaatggcttcgcaggctgca

SEQ ID NO: 212807 - DNA, 25 bp, Mus musculus
atgggcaatggctttgcgggctgcg

SEQ ID NO: 212808 - DNA, 25 bp, Mus musculus
atgggcacaaggcgacccaagctcc

SEQ ID NO: 212809 - DNA, 25 bp, Mus musculus
atgggcacaagggtgtggactgcga

SEQ ID NO: 212810 - DNA, 25 bp, Mus musculus
atgggcacagtgaccccagttttgc

SEQ ID NO: 212811 - DNA, 25 bp, Mus musculus
atgggcagaggtatatgtggttgct

SEQ ID NO: 212812 - DNA, 25 bp, Mus musculus
atgggcagctgagattcctgctgct

SEQ ID NO: 212813 - DNA, 25 bp, Mus musculus
atgggcagctgaggtgtgactttga

SEQ ID NO: 212814 - DNA, 25 bp, Mus musculus
atgggcaggtattcacctacaagca

SEQ ID NO: 212815 - DNA, 25 bp, Mus musculus
atgggcatcacagtcagtacaggct

SEQ ID NO: 212816 - DNA, 25 bp, Mus musculus
atgggcatgatgcccccgcctcctc

SEQ ID NO: 212817 - DNA, 25 bp, Mus musculus
atgggcatgtctacacctgcatggc

SEQ ID NO: 212818 - DNA, 25 bp, Mus musculus
atgggcatgtgcgggtctatgaatg

SEQ ID NO: 212819 - DNA, 25 bp, Mus musculus
atgggccaagcagaaaagaaatggt

SEQ ID NO: 212820 - DNA, 25 bp, Mus musculus
atgggccaaggaaaatgatgaagaa

SEQ ID NO: 212821 - DNA, 25 bp, Mus musculus
atgggccacagctcggtcgtccagt

SEQ ID NO: 212822 - DNA, 25 bp, Mus musculus
atgggccacgctctgtgcaccgagg

SEQ ID NO: 212823 - DNA, 25 bp, Mus musculus
atgggccacggaactcatcttcgag

SEQ ID NO: 212824 - DNA, 25 bp, Mus musculus
atgggccagtgatgagatgccatcc

SEQ ID NO: 212825 - DNA, 25 bp, Mus musculus
atgggccatattcaggcaaatgctg

SEQ ID NO: 212826 - DNA, 25 bp, Mus musculus
atgggcccacagtgggggctgaaga

SEQ ID NO: 212827 - DNA, 25 bp, Mus musculus
atgggcccacagtggttctcactgt

SEQ ID NO: 212828 - DNA, 25 bp, Mus musculus
atgggcccacctcctggcatgcggc

SEQ ID NO: 212829 - DNA, 25 bp, Mus musculus
atgggccctctgggaccaagaggaa

SEQ ID NO: 212830 - DNA, 25 bp, Mus musculus
atgggccctgcaggactgttcccga

SEQ ID NO: 212831 - DNA, 25 bp, Mus musculus
atgggccctttacccctgcttcctg

SEQ ID NO: 212832 - DNA, 25 bp, Mus musculus
atgggccgccagaattcagtagctt

SEQ ID NO: 212833 - DNA, 25 bp, Mus musculus
atgggccgctacgtgaatgagatca

SEQ ID NO: 212834 - DNA, 25 bp, Mus musculus
atgggcctgaggctcttcgcggcaa

SEQ ID NO: 212835 - DNA, 25 bp, Mus musculus
atgggccttgtacaggtatcacaag

SEQ ID NO: 212836 - DNA, 25 bp, Mus musculus
atgggcgagacacattgcgctggct

SEQ ID NO: 212837 - DNA, 25 bp, Mus musculus
atgggcgagtgcggtttcgtggtgg

SEQ ID NO: 212838 - DNA, 25 bp, Mus musculus
atgggcgcaccaaggccatggtggc

SEQ ID NO: 212839 - DNA, 25 bp, Mus musculus
atgggcgcagacatgaaagcttgcg

SEQ ID NO: 212840 - DNA, 25 bp, Mus musculus
atgggcgcggtcaagaaaggctctg

SEQ ID NO: 212841 - DNA, 25 bp, Mus musculus
atgggcgcggtcaaggatcatctgc

SEQ ID NO: 212842 - DNA, 25 bp, Mus musculus
atgggcggagatctgagtgcccgtc

SEQ ID NO: 212843 - DNA, 25 bp, Mus musculus
atgggcgggctgacgcttcccaacc

SEQ ID NO: 212844 - DNA, 25 bp, Mus musculus
atgggcgggctgctgagaagacgct

SEQ ID NO: 212845 - DNA, 25 bp, Mus musculus
atgggcgggctggtatgcgtcttct

SEQ ID NO: 212846 - DNA, 25 bp, Mus musculus
atgggcgtgcggattgtcgcagcaa

SEQ ID NO: 212847 - DNA, 25 bp, Mus musculus
atgggctacataccatctgccagca

SEQ ID NO: 212848 - DNA, 25 bp, Mus musculus
atgggctacatcccgtatgtgcagc

SEQ ID NO: 212849 - DNA, 25 bp, Mus musculus
atgggctacatgccctcagccagca

SEQ ID NO: 212850 - DNA, 25 bp, Mus musculus
atgggctacatggcctcttcctgca

SEQ ID NO: 212851 - DNA, 25 bp, Mus musculus
atgggctacattgcacacttgaagg

SEQ ID NO: 212852 - DNA, 25 bp, Mus musculus
atgggctagagcaagccccgcccaa

SEQ ID NO: 212853 - DNA, 25 bp, Mus musculus
atgggctatgacagccagcccgctt

SEQ ID NO: 212854 - DNA, 25 bp, Mus musculus
atgggctcagcaaaggcagctgaga

SEQ ID NO: 212855 - DNA, 25 bp, Mus musculus
atgggctccccaggagatggcctga

SEQ ID NO: 212856 - DNA, 25 bp, Mus musculus
atgggctcccggccccgtggggcgc

SEQ ID NO: 212857 - DNA, 25 bp, Mus musculus
atgggctctgaagggtacaccatga

SEQ ID NO: 212858 - DNA, 25 bp, Mus musculus
atgggctctgaagggtggaataagc

SEQ ID NO: 212859 - DNA, 25 bp, Mus musculus
atgggctctttgggtatgtgcagca

SEQ ID NO: 212860 - DNA, 25 bp, Mus musculus
atgggctgaagagaatgcaaagctc

SEQ ID NO: 212861 - DNA, 25 bp, Mus musculus
atgggctgaagagatttgaaagtga

SEQ ID NO: 212862 - DNA, 25 bp, Mus musculus
atgggctgcagaggattctcattgt

SEQ ID NO: 212863 - DNA, 25 bp, Mus musculus
atgggctgcagagtgtcctttattt

SEQ ID NO: 212864 - DNA, 25 bp, Mus musculus
atgggctgcagggacctcccgggtc

SEQ ID NO: 212865 - DNA, 25 bp, Mus musculus
atgggcttcactggtaaacaggtga

SEQ ID NO: 212866 - DNA, 25 bp, Mus musculus
atgggcttgtcaaaccagtccagtt

SEQ ID NO: 212867 - DNA, 25 bp, Mus musculus
atgggctttcacttaggaatgtgac

SEQ ID NO: 212868 - DNA, 25 bp, Mus musculus
atgggctttctcagggctctggcgc

SEQ ID NO: 212869 - DNA, 25 bp, Mus musculus
atggggaaacaactgggctcgggcc

SEQ ID NO: 212870 - DNA, 25 bp, Mus musculus
atggggacaacgaaggtgaccccat

SEQ ID NO: 212871 - DNA, 25 bp, Mus musculus
atggggacagtgtcttacacttagc

SEQ ID NO: 212872 - DNA, 25 bp, Mus musculus
atggggagagagggcaatgcgagca

SEQ ID NO: 212873 - DNA, 25 bp, Mus musculus
atggggagagttggagtttggagct

SEQ ID NO: 212874 - DNA, 25 bp, Mus musculus
atggggagcccaggtccggtgagca

SEQ ID NO: 212875 - DNA, 25 bp, Mus musculus
atggggagctggccccacagggctt

SEQ ID NO: 212876 - DNA, 25 bp, Mus musculus
atggggagctggctaagctggtgct

SEQ ID NO: 212877 - DNA, 25 bp, Mus musculus
atggggagtaaagacctgttgtact

SEQ ID NO: 212878 - DNA, 25 bp, Mus musculus
atggggagtaaagtggcagacctgt

SEQ ID NO: 212879 - DNA, 25 bp, Mus musculus
atggggagtttgagatcccactgag

SEQ ID NO: 212880 - DNA, 25 bp, Mus musculus
atggggatccagccgagcccggtct

SEQ ID NO: 212881 - DNA, 25 bp, Mus musculus
atggggatccagccggttactctcc

SEQ ID NO: 212882 - DNA, 25 bp, Mus musculus
atggggatgagaaagttgatgaaga

SEQ ID NO: 212883 - DNA, 25 bp, Mus musculus
atggggcagccaggctggggatgac

SEQ ID NO: 212884 - DNA, 25 bp, Mus musculus
atggggcagccagtcttcctgtccc

SEQ ID NO: 212885 - DNA, 25 bp, Mus musculus
atggggcaggcagtgacgcgccgcc

SEQ ID NO: 212886 - DNA, 25 bp, Mus musculus
atggggcagtttagaaatgcactta

SEQ ID NO: 212887 - DNA, 25 bp, Mus musculus
atggggcctttagatgggaaagttg

SEQ ID NO: 212888 - DNA, 25 bp, Mus musculus
atggggctcctcctccaggcatgcg

SEQ ID NO: 212889 - DNA, 25 bp, Mus musculus
atggggctgtgatggaatttcacgt

SEQ ID NO: 212890 - DNA, 25 bp, Mus musculus
atggggctgtgatggtagcatcgcc

SEQ ID NO: 212891 - DNA, 25 bp, Mus musculus
atggggcttaactggttacaaaatg

SEQ ID NO: 212892 - DNA, 25 bp, Mus musculus
atggggcttctagccagagccatgc

SEQ ID NO: 212893 - DNA, 25 bp, Mus musculus
atgggggaaggtgacgccatctggg

SEQ ID NO: 212894 - DNA, 25 bp, Mus musculus
atgggggactggcaggaccgtcacg

SEQ ID NO: 212895 - DNA, 25 bp, Mus musculus
atgggggcaggtggctttgtggctc

SEQ ID NO: 212896 - DNA, 25 bp, Mus musculus
atgggggccatctcacccatggcta

SEQ ID NO: 212897 - DNA, 25 bp, Mus musculus
atgggggcccacaggtgcagttggt

SEQ ID NO: 212898 - DNA, 25 bp, Mus musculus
atgggggcccacagttggtgaacaa

SEQ ID NO: 212899 - DNA, 25 bp, Mus musculus
atgggggcctgggtccaagccggcc

SEQ ID NO: 212900 - DNA, 25 bp, Mus musculus
atggggggacctgcactcagcagga

SEQ ID NO: 212901 - DNA, 25 bp, Mus musculus
atggggtaaagataaacaacaaagc

SEQ ID NO: 212902 - DNA, 25 bp, Mus musculus
atggggtaaaggagtcaactgagag

SEQ ID NO: 212903 - DNA, 25 bp, Mus musculus
atggggtacagggtgaagtactgga

SEQ ID NO: 212904 - DNA, 25 bp, Mus musculus
atggggtatttcagggattctcctg

SEQ ID NO: 212905 - DNA, 25 bp, Mus musculus
atggggtcccaggaggagtgggagc

SEQ ID NO: 212906 - DNA, 25 bp, Mus musculus
atggggtcccagggatccgtttcat

SEQ ID NO: 212907 - DNA, 25 bp, Mus musculus
atggggtgctgatggggaaggaccg

SEQ ID NO: 212908 - DNA, 25 bp, Mus musculus
atggggtgctgatgtttgagatgct

SEQ ID NO: 212909 - DNA, 25 bp, Mus musculus
atggggtttttcaggatgccacagt

SEQ ID NO: 212910 - DNA, 25 bp, Mus musculus
atgggtacaagggcaagctccagaa

SEQ ID NO: 212911 - DNA, 25 bp, Mus musculus
atgggtacagaccaggacaaagaga

SEQ ID NO: 212912 - DNA, 25 bp, Mus musculus
atgggtacaggacatacaggaagtg

SEQ ID NO: 212913 - DNA, 25 bp, Mus musculus
atgggtaggtggagtattggcttcc

SEQ ID NO: 212914 - DNA, 25 bp, Mus musculus
atgggtagtgatgtaagcggtaacc

SEQ ID NO: 212915 - DNA, 25 bp, Mus musculus
atgggtattggtccagaacacagcc

SEQ ID NO: 212916 - DNA, 25 bp, Mus musculus
atgggtattggtccagtccctgcta

SEQ ID NO: 212917 - DNA, 25 bp, Mus musculus
atgggtcagacagcgtcatcatgac

SEQ ID NO: 212918 - DNA, 25 bp, Mus musculus
atgggtcagacaggcaagggctcat

SEQ ID NO: 212919 - DNA, 25 bp, Mus musculus
atgggtcatgcagccctcaggaaga

SEQ ID NO: 212920 - DNA, 25 bp, Mus musculus
atgggtcatggaactcatcttcgag

SEQ ID NO: 212921 - DNA, 25 bp, Mus musculus
atgggtcctggagtgaacccaacaa

SEQ ID NO: 212922 - DNA, 25 bp, Mus musculus
atgggtctgacaggcacagtagact

SEQ ID NO: 212923 - DNA, 25 bp, Mus musculus
atgggtctgacagtgttgtcatgac

SEQ ID NO: 212924 - DNA, 25 bp, Mus musculus
atgggtctgctcaagagtgaagaca

SEQ ID NO: 212925 - DNA, 25 bp, Mus musculus
atgggtgaagaagaagctgactgcg

SEQ ID NO: 212926 - DNA, 25 bp, Mus musculus
atgggtgatgctggggagatggtgc

SEQ ID NO: 212927 - DNA, 25 bp, Mus musculus
atgggtggaggcaaagacacttgtg

SEQ ID NO: 212928 - DNA, 25 bp, Mus musculus
atgggtggccatgggaaatggagca

SEQ ID NO: 212929 - DNA, 25 bp, Mus musculus
atgggtggccatgtgcccagccccc

SEQ ID NO: 212930 - DNA, 25 bp, Mus musculus
atgggtgtgcctgaggagtccctgt

SEQ ID NO: 212931 - DNA, 25 bp, Mus musculus
atgggtgtgcctgaggctgacctgt

SEQ ID NO: 212932 - DNA, 25 bp, Mus musculus
atgggttacaacatgggagaggcag

SEQ ID NO: 212933 - DNA, 25 bp, Mus musculus
atgggttatattatgggcaaagcag

SEQ ID NO: 212934 - DNA, 25 bp, Mus musculus
atgggttcaggttctgccaccagct

SEQ ID NO: 212935 - DNA, 25 bp, Mus musculus
atgggttggggagtattactatgaa

SEQ ID NO: 212936 - DNA, 25 bp, Mus musculus
atgggtttcaagcctggggaaaaag

SEQ ID NO: 212937 - DNA, 25 bp, Mus musculus
atgggtttcaagtcttgtgatggat

SEQ ID NO: 212938 - DNA, 25 bp, Mus musculus
atgggtttgtcaaaccagtccagtt

SEQ ID NO: 212939 - DNA, 25 bp, Mus musculus
atggtaaagacagcacagcccccca

SEQ ID NO: 212940 - DNA, 25 bp, Mus musculus
atggtaaagacagcctaaccatgcc

SEQ ID NO: 212941 - DNA, 25 bp, Mus musculus
atggtaacaggcctgatggaatcgg

SEQ ID NO: 212942 - DNA, 25 bp, Mus musculus
atggtaacagtcaacaaatgcatgt

SEQ ID NO: 212943 - DNA, 25 bp, Mus musculus
atggtaaccacacagcttgttcggt

SEQ ID NO: 212944 - DNA, 25 bp, Mus musculus
atggtaaggagaaggatggcctcag

SEQ ID NO: 212945 - DNA, 25 bp, Mus musculus
atggtacaaacagaggatcaatacc

SEQ ID NO: 212946 - DNA, 25 bp, Mus musculus
atggtacagaatgggataaagatga

SEQ ID NO: 212947 - DNA, 25 bp, Mus musculus
atggtacagaatgggatctttttaa

SEQ ID NO: 212948 - DNA, 25 bp, Mus musculus
atggtacagaatgggctgaaccaat

SEQ ID NO: 212949 - DNA, 25 bp, Mus musculus
atggtacagaatggggggtcaacag

SEQ ID NO: 212950 - DNA, 25 bp, Mus musculus
atggtacctacccagcgtccccatg

SEQ ID NO: 212951 - DNA, 25 bp, Mus musculus
atggtacgaagcgccctttccgtca

SEQ ID NO: 212952 - DNA, 25 bp, Mus musculus
atggtactgtaggtggatagtccaa

SEQ ID NO: 212953 - DNA, 25 bp, Mus musculus
atggtagaaagatctaaaggggtga

SEQ ID NO: 212954 - DNA, 25 bp, Mus musculus
atggtagaaaggcctttgtagattt

SEQ ID NO: 212955 - DNA, 25 bp, Mus musculus
atggtagaaccagacgatggaggct

SEQ ID NO: 212956 - DNA, 25 bp, Mus musculus
atggtagaagtctttatagatacct

SEQ ID NO: 212957 - DNA, 25 bp, Mus musculus
atggtagacggggtattgaagggcg

SEQ ID NO: 212958 - DNA, 25 bp, Mus musculus
atggtagactgataggactccagag

SEQ ID NO: 212959 - DNA, 25 bp, Mus musculus
atggtagattacgctcacaacaact

SEQ ID NO: 212960 - DNA, 25 bp, Mus musculus
atggtagattgccagagctccacgc

SEQ ID NO: 212961 - DNA, 25 bp, Mus musculus
atggtagccccagaacccatgtgag

SEQ ID NO: 212962 - DNA, 25 bp, Mus musculus
atggtagccccagataaggaatatc

SEQ ID NO: 212963 - DNA, 25 bp, Mus musculus
atggtagccgctgccgtgacttact

SEQ ID NO: 212964 - DNA, 25 bp, Mus musculus
atggtagccggaagctgtgctgaat

SEQ ID NO: 212965 - DNA, 25 bp, Mus musculus
atggtagttacagccaacggtaacg

SEQ ID NO: 212966 - DNA, 25 bp, Mus musculus
atggtagttacaggtcataaaagga

SEQ ID NO: 212967 - DNA, 25 bp, Mus musculus
atggtataaggatgacatcgttctg

SEQ ID NO: 212968 - DNA, 25 bp, Mus musculus
atggtatccacatgggtctcctgga

SEQ ID NO: 212969 - DNA, 25 bp, Mus musculus
atggtatgccaaacagcagttattc

SEQ ID NO: 212970 - DNA, 25 bp, Mus musculus
atggtcaaggcggagccagatgtta

SEQ ID NO: 212971 - DNA, 25 bp, Mus musculus
atggtcacacaaagaaacaggtatg

SEQ ID NO: 212972 - DNA, 25 bp, Mus musculus
atggtcacacaaaggtatgtgatga

SEQ ID NO: 212973 - DNA, 25 bp, Mus musculus
atggtcagaagagggggacctacac

SEQ ID NO: 212974 - DNA, 25 bp, Mus musculus
atggtcagcaatggggctggagaga

SEQ ID NO: 212975 - DNA, 25 bp, Mus musculus
atggtcagcaatgggttcagacctc

SEQ ID NO: 212976 - DNA, 25 bp, Mus musculus
atggtcaggtgtgacagacatcaca

SEQ ID NO: 212977 - DNA, 25 bp, Mus musculus
atggtcagtgttggtttcaacctct

SEQ ID NO: 212978 - DNA, 25 bp, Mus musculus
atggtcatcagagctgtactggcga

SEQ ID NO: 212979 - DNA, 25 bp, Mus musculus
atggtcatcagtgtcctcctatcgg

SEQ ID NO: 212980 - DNA, 25 bp, Mus musculus
atggtcatcccccacgctgacagcc

SEQ ID NO: 212981 - DNA, 25 bp, Mus musculus
atggtcatcggaaattaccggacgc

SEQ ID NO: 212982 - DNA, 25 bp, Mus musculus
atggtcatcggcaactatcgaactc

SEQ ID NO: 212983 - DNA, 25 bp, Mus musculus
atggtccaaagggcaacccaggtcc

SEQ ID NO: 212984 - DNA, 25 bp, Mus musculus
atggtccaacgacctgagcccaacc

SEQ ID NO: 212985 - DNA, 25 bp, Mus musculus
atggtccaatttgtctagtgctggc

SEQ ID NO: 212986 - DNA, 25 bp, Mus musculus
atggtcccaaaggtgcagctggccc

SEQ ID NO: 212987 - DNA, 25 bp, Mus musculus
atggtcccacccagacaggcttcag

SEQ ID NO: 212988 - DNA, 25 bp, Mus musculus
atggtcccgggtgaacagagtatct

SEQ ID NO: 212989 - DNA, 25 bp, Mus musculus
atggtccctcctaagactgtatcac

SEQ ID NO: 212990 - DNA, 25 bp, Mus musculus
atggtccctctggtcttgatggtcc

SEQ ID NO: 212991 - DNA, 25 bp, Mus musculus
atggtcctagtcaagagaatccatc

SEQ ID NO: 212992 - DNA, 25 bp, Mus musculus
atggtcctgagaaaggtataaatgg

SEQ ID NO: 212993 - DNA, 25 bp, Mus musculus
atggtcctgagctgtttggggcaac

SEQ ID NO: 212994 - DNA, 25 bp, Mus musculus
atggtcgaattcgccgcatgtctcg

SEQ ID NO: 212995 - DNA, 25 bp, Mus musculus
atggtcgatgaagagtttgatttta

SEQ ID NO: 212996 - DNA, 25 bp, Mus musculus
atggtcgatggtggatgtacagttt

SEQ ID NO: 212997 - DNA, 25 bp, Mus musculus
atggtcgttggccagagtggactgg

SEQ ID NO: 212998 - DNA, 25 bp, Mus musculus
atggtctagcaagccgggtatccca

SEQ ID NO: 212999 - DNA, 25 bp, Mus musculus
atggtctagcaagggcaatgacatc

SEQ ID NO: 213000 - DNA, 25 bp, Mus musculus
atggtctcgagatgaagatatcacg

SEQ ID NO: 213001 - DNA, 25 bp, Mus musculus
atggtctcgagcagcagtgaaggct

SEQ ID NO: 213002 - DNA, 25 bp, Mus musculus
atggtctcttcccatacatggcctg

SEQ ID NO: 213003 - DNA, 25 bp, Mus musculus
atggtctggagcaagcccacaccgc

SEQ ID NO: 213004 - DNA, 25 bp, Mus musculus
atggtctgggttaaatggtttgtct

SEQ ID NO: 213005 - DNA, 25 bp, Mus musculus
atggtctgtggaatgtgacaaacgg

SEQ ID NO: 213006 - DNA, 25 bp, Mus musculus
atggtcttctatccccaatatctct

SEQ ID NO: 213007 - DNA, 25 bp, Mus musculus
atggtcttctatgcccaatatctct

SEQ ID NO: 213008 - DNA, 25 bp, Mus musculus
atggtgaaccgggtgaccctggtga

SEQ ID NO: 213009 - DNA, 25 bp, Mus musculus
atggtgaacgcttctagggacctat

SEQ ID NO: 213010 - DNA, 25 bp, Mus musculus
atggtgaacgggacctattaaaaga

SEQ ID NO: 213011 - DNA, 25 bp, Mus musculus
atggtgaactctgtctgcaatcctg

SEQ ID NO: 213012 - DNA, 25 bp, Mus musculus
atggtgaactggctgacagttgatg

SEQ ID NO: 213013 - DNA, 25 bp, Mus musculus
atggtgaactggctgactgccttgt

SEQ ID NO: 213014 - DNA, 25 bp, Mus musculus
atggtgaactggctgagacttgcta

SEQ ID NO: 213015 - DNA, 25 bp, Mus musculus
atggtgaagagcaggtatctcagac

SEQ ID NO: 213016 - DNA, 25 bp, Mus musculus
atggtgaaggaagatgaggctcgca

SEQ ID NO: 213017 - DNA, 25 bp, Mus musculus
atggtgaaggcatgggtcttcggat

SEQ ID NO: 213018 - DNA, 25 bp, Mus musculus
atggtgaatgcacagacgtggacga

SEQ ID NO: 213019 - DNA, 25 bp, Mus musculus
atggtgaattgggatgatgaggaat

SEQ ID NO: 213020 - DNA, 25 bp, Mus musculus
atggtgacagtccctctgaggctcc

SEQ ID NO: 213021 - DNA, 25 bp, Mus musculus
atggtgacatggtcccggaagatgg

SEQ ID NO: 213022 - DNA, 25 bp, Mus musculus
atggtgacggggatcgaaacatgat

SEQ ID NO: 213023 - DNA, 25 bp, Mus musculus
atggtgactgatggtggaatgtacg

SEQ ID NO: 213024 - DNA, 25 bp, Mus musculus
atggtgagaagggagaggctggtcg

SEQ ID NO: 213025 - DNA, 25 bp, Mus musculus
atggtgagcaagttgagctctgagg

SEQ ID NO: 213026 - DNA, 25 bp, Mus musculus
atggtgatggaaagctgagcccagg

SEQ ID NO: 213027 - DNA, 25 bp, Mus musculus
atggtgattatagcaatcagcagag

SEQ ID NO: 213028 - DNA, 25 bp, Mus musculus
atggtgcacgcctctgcctcccgag

SEQ ID NO: 213029 - DNA, 25 bp, Mus musculus
atggtgcagtgctgttgaattttct

SEQ ID NO: 213030 - DNA, 25 bp, Mus musculus
atggtgcagtggtggagcaaagccc

SEQ ID NO: 213031 - DNA, 25 bp, Mus musculus
atggtgccgtgttctcgaaaaggtg

SEQ ID NO: 213032 - DNA, 25 bp, Mus musculus
atggtgctcagggtacagcatgttt

SEQ ID NO: 213033 - DNA, 25 bp, Mus musculus
atggtgctctgggtttcctgtggcc

SEQ ID NO: 213034 - DNA, 25 bp, Mus musculus
atggtgctgatgtcccgccgaacgc

SEQ ID NO: 213035 - DNA, 25 bp, Mus musculus
atggtgcttcggtacctgggccagc

SEQ ID NO: 213036 - DNA, 25 bp, Mus musculus
atggtggactgtcagactgctgggc

SEQ ID NO: 213037 - DNA, 25 bp, Mus musculus
atggtggactgtcaggattctcttt

SEQ ID NO: 213038 - DNA, 25 bp, Mus musculus
atggtggagttggccaaacagtggg

SEQ ID NO: 213039 - DNA, 25 bp, Mus musculus
atggtggatggtgacctgctggcag

SEQ ID NO: 213040 - DNA, 25 bp, Mus musculus
atggtggatttaggagaggatgaag

SEQ ID NO: 213041 - DNA, 25 bp, Mus musculus
atggtggcaggtgactccagctccg

SEQ ID NO: 213042 - DNA, 25 bp, Mus musculus
atggtggcaggtgggacctgaccaa

SEQ ID NO: 213043 - DNA, 25 bp, Mus musculus
atggtggccaaggttccctaccgcc

SEQ ID NO: 213044 - DNA, 25 bp, Mus musculus
atggtggccacctgggtgcagtgtg

SEQ ID NO: 213045 - DNA, 25 bp, Mus musculus
atggtggccagggttttaatgtagt

SEQ ID NO: 213046 - DNA, 25 bp, Mus musculus
atggtggccgacaaagttccacagg

SEQ ID NO: 213047 - DNA, 25 bp, Mus musculus
atggtggctcacagctgtgatgagt

SEQ ID NO: 213048 - DNA, 25 bp, Mus musculus
atggtggctctcagcttgcagacaa

SEQ ID NO: 213049 - DNA, 25 bp, Mus musculus
atggtggctctcaggagcgcggcct

SEQ ID NO: 213050 - DNA, 25 bp, Mus musculus
atggtggctgatgaaatgggtctag

SEQ ID NO: 213051 - DNA, 25 bp, Mus musculus
atggtgggacagggcaagaccgtga

SEQ ID NO: 213052 - DNA, 25 bp, Mus musculus
atggtggtaggcaggttgttcgtag

SEQ ID NO: 213053 - DNA, 25 bp, Mus musculus
atggtggtatcatgatgacacttgt

SEQ ID NO: 213054 - DNA, 25 bp, Mus musculus
atggtggtatcatggtggatacagt

SEQ ID NO: 213055 - DNA, 25 bp, Mus musculus
atggtggtctccgggttctgcagga

SEQ ID NO: 213056 - DNA, 25 bp, Mus musculus
atggtggtggacagggaatgtacgg

SEQ ID NO: 213057 - DNA, 25 bp, Mus musculus
atggtggtggacagtgcctatgaag

SEQ ID NO: 213058 - DNA, 25 bp, Mus musculus
atggtggtggttctgacagagcctc

SEQ ID NO: 213059 - DNA, 25 bp, Mus musculus
atggtggttttactgagttgcactc

SEQ ID NO: 213060 - DNA, 25 bp, Mus musculus
atggtgtaatgctttgtcggatatg

SEQ ID NO: 213061 - DNA, 25 bp, Mus musculus
atggtgtagcacatttccttctggc

SEQ ID NO: 213062 - DNA, 25 bp, Mus musculus
atggtgtagcaggcagcaaagaaga

SEQ ID NO: 213063 - DNA, 25 bp, Mus musculus
atggtgtataatgaatttcagaaat

SEQ ID NO: 213064 - DNA, 25 bp, Mus musculus
atggtgtataatggcatttgagcac

SEQ ID NO: 213065 - DNA, 25 bp, Mus musculus
atggtgtcactgcaagagcggcccc

SEQ ID NO: 213066 - DNA, 25 bp, Mus musculus
atggtgtcagaaaaaatgtggggat

SEQ ID NO: 213067 - DNA, 25 bp, Mus musculus
atggtgtgaagaaaagaaagtccag

SEQ ID NO: 213068 - DNA, 25 bp, Mus musculus
atggtgtgaaggaatcttctgagag

SEQ ID NO: 213069 - DNA, 25 bp, Mus musculus
atggtgtgactgagttggccgcccc

SEQ ID NO: 213070 - DNA, 25 bp, Mus musculus
atggtgtgaggggtcccacagaggc

SEQ ID NO: 213071 - DNA, 25 bp, Mus musculus
atggtgtggagtttgcagattcctt

SEQ ID NO: 213072 - DNA, 25 bp, Mus musculus
atggtgtggtggccagtgggtgcat

SEQ ID NO: 213073 - DNA, 25 bp, Mus musculus
atggtgtgtttgaggagatttctaa

SEQ ID NO: 213074 - DNA, 25 bp, Mus musculus
atggtgttatcaagctgaggattga

SEQ ID NO: 213075 - DNA, 25 bp, Mus musculus
atggtgttcctactggagttaaagg

SEQ ID NO: 213076 - DNA, 25 bp, Mus musculus
atggtgtttaaggccaagcatctgg

SEQ ID NO: 213077 - DNA, 25 bp, Mus musculus
atggtgtttgcaggagtgtacccta

SEQ ID NO: 213078 - DNA, 25 bp, Mus musculus
atggttaaccagagtcctggatgcc

SEQ ID NO: 213079 - DNA, 25 bp, Mus musculus
atggttaataatgatgctgtggtta

SEQ ID NO: 213080 - DNA, 25 bp, Mus musculus
atggttacacagggctgttcaggtg

SEQ ID NO: 213081 - DNA, 25 bp, Mus musculus
atggttatactaatggaattgctag

SEQ ID NO: 213082 - DNA, 25 bp, Mus musculus
atggttatactgccttaacatgggc

SEQ ID NO: 213083 - DNA, 25 bp, Mus musculus
atggttatcacaagtgtgtgggata

SEQ ID NO: 213084 - DNA, 25 bp, Mus musculus
atggttatggttatgcttcaaatgg

SEQ ID NO: 213085 - DNA, 25 bp, Mus musculus
atggttcaagacaagataagccgac

SEQ ID NO: 213086 - DNA, 25 bp, Mus musculus
atggttcaagtgggtgttccagtga

SEQ ID NO: 213087 - DNA, 25 bp, Mus musculus
atggttcaagtgttcctgtccacag

SEQ ID NO: 213088 - DNA, 25 bp, Mus musculus
atggttcacagagatcccagaaacc

SEQ ID NO: 213089 - DNA, 25 bp, Mus musculus
atggttcataccaggttgtaagcat

SEQ ID NO: 213090 - DNA, 25 bp, Mus musculus
atggttcctcagaaaatgaagtccc

SEQ ID NO: 213091 - DNA, 25 bp, Mus musculus
atggttcctcagaacctgggaggca

SEQ ID NO: 213092 - DNA, 25 bp, Mus musculus
atggttcctcagagccgagcaatgg

SEQ ID NO: 213093 - DNA, 25 bp, Mus musculus
atggttctaggctttgatgacagtt

SEQ ID NO: 213094 - DNA, 25 bp, Mus musculus
atggttctgggggcaaactggaagg

SEQ ID NO: 213095 - DNA, 25 bp, Mus musculus
atggttgaaatagaattgatggaat

SEQ ID NO: 213096 - DNA, 25 bp, Mus musculus
atggttgaaatagagggaccagtct

SEQ ID NO: 213097 - DNA, 25 bp, Mus musculus
atggttgaagacacaggaggcagcc

SEQ ID NO: 213098 - DNA, 25 bp, Mus musculus
atggttgacaggcaataccctttct

SEQ ID NO: 213099 - DNA, 25 bp, Mus musculus
atggttgcaggtctgcaataatttc

SEQ ID NO: 213100 - DNA, 25 bp, Mus musculus
atggttggcaggtgaatttggaagg

SEQ ID NO: 213101 - DNA, 25 bp, Mus musculus
atggttggctcaacttgatttctta

SEQ ID NO: 213102 - DNA, 25 bp, Mus musculus
atggttgggaaggaaaagggctatg

SEQ ID NO: 213103 - DNA, 25 bp, Mus musculus
atggttgtgtctcttactggggcct

SEQ ID NO: 213104 - DNA, 25 bp, Mus musculus
atggtttaacttattagtacttgtg

SEQ ID NO: 213105 - DNA, 25 bp, Mus musculus
atggtttaagacgcttaaaggatgg

SEQ ID NO: 213106 - DNA, 25 bp, Mus musculus
atggtttacagactgttttccaagc

SEQ ID NO: 213107 - DNA, 25 bp, Mus musculus
atggtttacaggtttactgctaggc

SEQ ID NO: 213108 - DNA, 25 bp, Mus musculus
atggtttgcgtttgcagtatgaagt

SEQ ID NO: 213109 - DNA, 25 bp, Mus musculus
atggttttacggagtaagccatgag

SEQ ID NO: 213110 - DNA, 25 bp, Mus musculus
atggtttttggtctcagtgtgttgt

SEQ ID NO: 213111 - DNA, 25 bp, Mus musculus
atgtaaaaagatggatcagtttgac

SEQ ID NO: 213112 - DNA, 25 bp, Mus musculus
atgtaaacctgaactatgacaatga

SEQ ID NO: 213113 - DNA, 25 bp, Mus musculus
atgtaaacctgttgccaagaactat

SEQ ID NO: 213114 - DNA, 25 bp, Mus musculus
atgtaacaccaaaggcgacctggcg

SEQ ID NO: 213115 - DNA, 25 bp, Mus musculus
atgtaacagagggaaaacagttgga

SEQ ID NO: 213116 - DNA, 25 bp, Mus musculus
atgtaacagagggttcccatctcct

SEQ ID NO: 213117 - DNA, 25 bp, Mus musculus
atgtaacagagggtttgaagatcaa

SEQ ID NO: 213118 - DNA, 25 bp, Mus musculus
atgtaaccatagatcgcaagccatg

SEQ ID NO: 213119 - DNA, 25 bp, Mus musculus
atgtaaccataggcccgaggacggt

SEQ ID NO: 213120 - DNA, 25 bp, Mus musculus
atgtaagaatgtctacaagcaggaa

SEQ ID NO: 213121 - DNA, 25 bp, Mus musculus
atgtaagcagctgtccggcagagag

SEQ ID NO: 213122 - DNA, 25 bp, Mus musculus
atgtaagctgcagagaagctagaaa

SEQ ID NO: 213123 - DNA, 25 bp, Mus musculus
atgtaagttaccatgcctgtctcct

SEQ ID NO: 213124 - DNA, 25 bp, Mus musculus
atgtaataaaaagaagctgaagtca

SEQ ID NO: 213125 - DNA, 25 bp, Mus musculus
atgtaataaaaagatgccagcagag

SEQ ID NO: 213126 - DNA, 25 bp, Mus musculus
atgtaatctgggtgttgacgatgcc

SEQ ID NO: 213127 - DNA, 25 bp, Mus musculus
atgtaatggacgggcattttgttcc

SEQ ID NO: 213128 - DNA, 25 bp, Mus musculus
atgtacaaaacgcccattttcctga

SEQ ID NO: 213129 - DNA, 25 bp, Mus musculus
atgtacaaaatatttggtgacttca

SEQ ID NO: 213130 - DNA, 25 bp, Mus musculus
atgtacaaagaaatggcaaccagat

SEQ ID NO: 213131 - DNA, 25 bp, Mus musculus
atgtacaaataaaagtcttactcct

SEQ ID NO: 213132 - DNA, 25 bp, Mus musculus
atgtacaacagaatgaccagtgcct

SEQ ID NO: 213133 - DNA, 25 bp, Mus musculus
atgtacactaaggtaagaaatccag

SEQ ID NO: 213134 - DNA, 25 bp, Mus musculus
atgtacactaggaagtcagaggcaa

SEQ ID NO: 213135 - DNA, 25 bp, Mus musculus
atgtacagaaagagtatgaaaagac

SEQ ID NO: 213136 - DNA, 25 bp, Mus musculus
atgtacagaagcagattaagcacat

SEQ ID NO: 213137 - DNA, 25 bp, Mus musculus
atgtacagaagtttgcccggctctc

SEQ ID NO: 213138 - DNA, 25 bp, Mus musculus
atgtacatatgaaacctgccatatg

SEQ ID NO: 213139 - DNA, 25 bp, Mus musculus
atgtacatatggtcgaccccatccc

SEQ ID NO: 213140 - DNA, 25 bp, Mus musculus
atgtaccaaggagacaaaattctac

SEQ ID NO: 213141 - DNA, 25 bp, Mus musculus
atgtaccagaaataggagcagttga

SEQ ID NO: 213142 - DNA, 25 bp, Mus musculus
atgtaccagatcaaggtggttgaag

SEQ ID NO: 213143 - DNA, 25 bp, Mus musculus
atgtaccagggagtggctggatgag

SEQ ID NO: 213144 - DNA, 25 bp, Mus musculus
atgtacccaagagttgtcttggaca

SEQ ID NO: 213145 - DNA, 25 bp, Mus musculus
atgtaccgactttcacgatatgtga

SEQ ID NO: 213146 - DNA, 25 bp, Mus musculus
atgtaccttcaagggatttaaacga

SEQ ID NO: 213147 - DNA, 25 bp, Mus musculus
atgtacgaggaccatcccacacagt

SEQ ID NO: 213148 - DNA, 25 bp, Mus musculus
atgtacgagggaaggatcatcgaat

SEQ ID NO: 213149 - DNA, 25 bp, Mus musculus
atgtacgcaaaataataggaagaag

SEQ ID NO: 213150 - DNA, 25 bp, Mus musculus
atgtacgcaaaatagttgaaaaaca

SEQ ID NO: 213151 - DNA, 25 bp, Mus musculus
atgtacgccaagaaatccaggaagt

SEQ ID NO: 213152 - DNA, 25 bp, Mus musculus
atgtactaagacctgttcccgtcta

SEQ ID NO: 213153 - DNA, 25 bp, Mus musculus
atgtactaagggatacagtggaatg

SEQ ID NO: 213154 - DNA, 25 bp, Mus musculus
atgtactaaggtatacagttttgca

SEQ ID NO: 213155 - DNA, 25 bp, Mus musculus
atgtactaagtttccccctgctctt

SEQ ID NO: 213156 - DNA, 25 bp, Mus musculus
atgtactacaatggcattggagtca

SEQ ID NO: 213157 - DNA, 25 bp, Mus musculus
atgtactcaggatatgctgtcattc

SEQ ID NO: 213158 - DNA, 25 bp, Mus musculus
atgtactcagggggaaaatgctata

SEQ ID NO: 213159 - DNA, 25 bp, Mus musculus
atgtactgaaggatttctggtaggt

SEQ ID NO: 213160 - DNA, 25 bp, Mus musculus
atgtactgaaggtctttgacgatgg

SEQ ID NO: 213161 - DNA, 25 bp, Mus musculus
atgtactggacaaacaaacaaacaa

SEQ ID NO: 213162 - DNA, 25 bp, Mus musculus
atgtacttcaggccacagacttccc

SEQ ID NO: 213163 - DNA, 25 bp, Mus musculus
atgtacttcattgtacgatctttgc

SEQ ID NO: 213164 - DNA, 25 bp, Mus musculus
atgtagaaaagaagctcaataaagt

SEQ ID NO: 213165 - DNA, 25 bp, Mus musculus
atgtagaaaagattaatggggaatg

SEQ ID NO: 213166 - DNA, 25 bp, Mus musculus
atgtagaaacaaggtgctctgttgc

SEQ ID NO: 213167 - DNA, 25 bp, Mus musculus
atgtagaaacgaaacgttgacaaac

SEQ ID NO: 213168 - DNA, 25 bp, Mus musculus
atgtagaaataaagatgatcagtca

SEQ ID NO: 213169 - DNA, 25 bp, Mus musculus
atgtagaacagattagtgggtattg

SEQ ID NO: 213170 - DNA, 25 bp, Mus musculus
atgtagaacctgccctctgaccgtg

SEQ ID NO: 213171 - DNA, 25 bp, Mus musculus
atgtagagaaggccatcgcccacta

SEQ ID NO: 213172 - DNA, 25 bp, Mus musculus
atgtagagatctcagtgcccttatg

SEQ ID NO: 213173 - DNA, 25 bp, Mus musculus
atgtagagcaaggaaagaccgtaga

SEQ ID NO: 213174 - DNA, 25 bp, Mus musculus
atgtagaggcagagccccactccac

SEQ ID NO: 213175 - DNA, 25 bp, Mus musculus
atgtagatatggcagacgaggcata

SEQ ID NO: 213176 - DNA, 25 bp, Mus musculus
atgtagcaggcgcgcggtgacattg

SEQ ID NO: 213177 - DNA, 25 bp, Mus musculus
atgtagccaacccttcactgaagtg

SEQ ID NO: 213178 - DNA, 25 bp, Mus musculus
atgtagcccggagccttctgatgga

SEQ ID NO: 213179 - DNA, 25 bp, Mus musculus
atgtagccgcctcaaacatgtcctc

SEQ ID NO: 213180 - DNA, 25 bp, Mus musculus
atgtagcctacagatgaaaaacgac

SEQ ID NO: 213181 - DNA, 25 bp, Mus musculus
atgtagcctacaggtggcggaggac

SEQ ID NO: 213182 - DNA, 25 bp, Mus musculus
atgtagctcagaatgtgaagctctt

SEQ ID NO: 213183 - DNA, 25 bp, Mus musculus
atgtagctcaggttcccctccagac

SEQ ID NO: 213184 - DNA, 25 bp, Mus musculus
atgtaggcctcaactataagtcttg

SEQ ID NO: 213185 - DNA, 25 bp, Mus musculus
atgtagggagcaacatcctttgtac

SEQ ID NO: 213186 - DNA, 25 bp, Mus musculus
atgtagggagtatgaaggtcaaaaa

SEQ ID NO: 213187 - DNA, 25 bp, Mus musculus
atgtaggtggaagtcttctatgagt

SEQ ID NO: 213188 - DNA, 25 bp, Mus musculus
atgtagtgaagctatgccattgtgc

SEQ ID NO: 213189 - DNA, 25 bp, Mus musculus
atgtagtgaagctccttggcgagca

SEQ ID NO: 213190 - DNA, 25 bp, Mus musculus
atgtagtgaggacagtagaattttg

SEQ ID NO: 213191 - DNA, 25 bp, Mus musculus
atgtagtgaggcagcagagtgaagt

SEQ ID NO: 213192 - DNA, 25 bp, Mus musculus
atgtagttcagagtgtcaaaaccgc

SEQ ID NO: 213193 - DNA, 25 bp, Mus musculus
atgtagttgattgggaatttggcag

SEQ ID NO: 213194 - DNA, 25 bp, Mus musculus
atgtataaagatgtggtgaaggctc

SEQ ID NO: 213195 - DNA, 25 bp, Mus musculus
atgtataaagttctagatgtggtga

SEQ ID NO: 213196 - DNA, 25 bp, Mus musculus
atgtataacaaggattctcaaagct

SEQ ID NO: 213197 - DNA, 25 bp, Mus musculus
atgtatacagatgccgatgaatgtg

SEQ ID NO: 213198 - DNA, 25 bp, Mus musculus
atgtatacaggtttgttaactgaaa

SEQ ID NO: 213199 - DNA, 25 bp, Mus musculus
atgtatacagttgccgatgaatgtg

SEQ ID NO: 213200 - DNA, 25 bp, Mus musculus
atgtataccaggaatttccacagtg

SEQ ID NO: 213201 - DNA, 25 bp, Mus musculus
atgtatacgacgacccgtctcgata

SEQ ID NO: 213202 - DNA, 25 bp, Mus musculus
atgtatacgacgactcgtccgtctc

SEQ ID NO: 213203 - DNA, 25 bp, Mus musculus
atgtatacgacgatgttgagactgt

SEQ ID NO: 213204 - DNA, 25 bp, Mus musculus
atgtatatacaggaaaactcctcct

SEQ ID NO: 213205 - DNA, 25 bp, Mus musculus
atgtatatattaggctatgtggtgg

SEQ ID NO: 213206 - DNA, 25 bp, Mus musculus
atgtatatcagacactgtcctgttg

SEQ ID NO: 213207 - DNA, 25 bp, Mus musculus
atgtatatccacagtcaagccctgc

SEQ ID NO: 213208 - DNA, 25 bp, Mus musculus
atgtatatctttaagcaacctcact

SEQ ID NO: 213209 - DNA, 25 bp, Mus musculus
atgtatcagatgcaggttgcgttac

SEQ ID NO: 213210 - DNA, 25 bp, Mus musculus
atgtatcagggtaagacatacaaca

SEQ ID NO: 213211 - DNA, 25 bp, Mus musculus
atgtatccaaaagaaatccagagag

SEQ ID NO: 213212 - DNA, 25 bp, Mus musculus
atgtatccaaaagcaaatttcgcag

SEQ ID NO: 213213 - DNA, 25 bp, Mus musculus
atgtatccaagggagcccaggaagt

SEQ ID NO: 213214 - DNA, 25 bp, Mus musculus
atgtatccagaggaagttgtcctgg

SEQ ID NO: 213215 - DNA, 25 bp, Mus musculus
atgtatccagaggatgttgggcagg

SEQ ID NO: 213216 - DNA, 25 bp, Mus musculus
atgtatccaggctcacccagactta

SEQ ID NO: 213217 - DNA, 25 bp, Mus musculus
atgtatccaggtcacccagatctct

SEQ ID NO: 213218 - DNA, 25 bp, Mus musculus
atgtatcggaggacaccaaagtgaa

SEQ ID NO: 213219 - DNA, 25 bp, Mus musculus
atgtatgacgaggagacccgcatcc

SEQ ID NO: 213220 - DNA, 25 bp, Mus musculus
atgtatgacgttgctgatcactgga

SEQ ID NO: 213221 - DNA, 25 bp, Mus musculus
atgtatgagctggatagagagatga

SEQ ID NO: 213222 - DNA, 25 bp, Mus musculus
atgtatgatgaggagacccgcatcc

SEQ ID NO: 213223 - DNA, 25 bp, Mus musculus
atgtatgcagggacgcatcgttgat

SEQ ID NO: 213224 - DNA, 25 bp, Mus musculus
atgtatgccaagagcaagaaagtat

SEQ ID NO: 213225 - DNA, 25 bp, Mus musculus
atgtatgccaagaggaataaaagga

SEQ ID NO: 213226 - DNA, 25 bp, Mus musculus
atgtatgccagcatgtctgattgcc

SEQ ID NO: 213227 - DNA, 25 bp, Mus musculus
atgtatgcgcaaggcttcattctca

SEQ ID NO: 213228 - DNA, 25 bp, Mus musculus
atgtatggcaaggatttaattaaag

SEQ ID NO: 213229 - DNA, 25 bp, Mus musculus
atgtatggcaaggctggccttctaa

SEQ ID NO: 213230 - DNA, 25 bp, Mus musculus
atgtatgtatacaggtttgttaact

SEQ ID NO: 213231 - DNA, 25 bp, Mus musculus
atgtattacagagtgatggcgtgca

SEQ ID NO: 213232 - DNA, 25 bp, Mus musculus
atgtattcaagatgctggagacttg

SEQ ID NO: 213233 - DNA, 25 bp, Mus musculus
atgtattcaaggtctgcgacgagcc

SEQ ID NO: 213234 - DNA, 25 bp, Mus musculus
atgtattccagcatccagaattcaa

SEQ ID NO: 213235 - DNA, 25 bp, Mus musculus
atgtattccaggcgttacaatattt

SEQ ID NO: 213236 - DNA, 25 bp, Mus musculus
atgtattccatagggatccaagcct

SEQ ID NO: 213237 - DNA, 25 bp, Mus musculus
atgtattccatagggcatgccttca

SEQ ID NO: 213238 - DNA, 25 bp, Mus musculus
atgtattccccgtgaatcccttgtg

SEQ ID NO: 213239 - DNA, 25 bp, Mus musculus
atgtattctgcaaaaccttatgcac

SEQ ID NO: 213240 - DNA, 25 bp, Mus musculus
atgtattctgcaaacttcaagcaca

SEQ ID NO: 213241 - DNA, 25 bp, Mus musculus
atgtattggataagaccaccgctct

SEQ ID NO: 213242 - DNA, 25 bp, Mus musculus
atgtattggctggatcccaagtctt

SEQ ID NO: 213243 - DNA, 25 bp, Mus musculus
atgtatttgtggggtaatcaggaag

SEQ ID NO: 213244 - DNA, 25 bp, Mus musculus
atgtcaaaaaggtatggttccgacc

SEQ ID NO: 213245 - DNA, 25 bp, Mus musculus
atgtcaaaacctgggcaagatccgg

SEQ ID NO: 213246 - DNA, 25 bp, Mus musculus
atgtcaaagcccaagaaatagcaga

SEQ ID NO: 213247 - DNA, 25 bp, Mus musculus
atgtcaaagcccaaggacatgggag

SEQ ID NO: 213248 - DNA, 25 bp, Mus musculus
atgtcaaatcaagatgtcattaaag

SEQ ID NO: 213249 - DNA, 25 bp, Mus musculus
atgtcaacagaattccagaggttgg

SEQ ID NO: 213250 - DNA, 25 bp, Mus musculus
atgtcaacagaccgctccggcctgc

SEQ ID NO: 213251 - DNA, 25 bp, Mus musculus
atgtcaacagcccagaaggctcttt

SEQ ID NO: 213252 - DNA, 25 bp, Mus musculus
atgtcaacagccgcctggtttacca

SEQ ID NO: 213253 - DNA, 25 bp, Mus musculus
atgtcaacagccggtgataactccc

SEQ ID NO: 213254 - DNA, 25 bp, Mus musculus
atgtcaacagcgtgagcaccactct

SEQ ID NO: 213255 - DNA, 25 bp, Mus musculus
atgtcaacaggacccacagttatca

SEQ ID NO: 213256 - DNA, 25 bp, Mus musculus
atgtcaaccgacccccaggctcaac

SEQ ID NO: 213257 - DNA, 25 bp, Mus musculus
atgtcaacggcttgtctgtgccacc

SEQ ID NO: 213258 - DNA, 25 bp, Mus musculus
atgtcaagaccaaacggcccccttg

SEQ ID NO: 213259 - DNA, 25 bp, Mus musculus
atgtcaagaggcctcacaccttgaa

SEQ ID NO: 213260 - DNA, 25 bp, Mus musculus
atgtcaagtcatttcctgtagaaga

SEQ ID NO: 213261 - DNA, 25 bp, Mus musculus
atgtcaatatgaagagtaaagatgg

SEQ ID NO: 213262 - DNA, 25 bp, Mus musculus
atgtcaatcacaacttgaaagatgc

SEQ ID NO: 213263 - DNA, 25 bp, Mus musculus
atgtcaatctgaaagagttcttgcc

SEQ ID NO: 213264 - DNA, 25 bp, Mus musculus
atgtcaatctgaaaggtacccagaa

SEQ ID NO: 213265 - DNA, 25 bp, Mus musculus
atgtcaatgcccccaaccccatcca

SEQ ID NO: 213266 - DNA, 25 bp, Mus musculus
atgtcacacagcactcatgaacact

SEQ ID NO: 213267 - DNA, 25 bp, Mus musculus
atgtcacagagcacttttaataacc

SEQ ID NO: 213268 - DNA, 25 bp, Mus musculus
atgtcacagagcagaatgattggca

SEQ ID NO: 213269 - DNA, 25 bp, Mus musculus
atgtcacagagcagttttaataacc

SEQ ID NO: 213270 - DNA, 25 bp, Mus musculus
atgtcacagtaccgtcacctccaag

SEQ ID NO: 213271 - DNA, 25 bp, Mus musculus
atgtcaccacacaggtatcagtgag

SEQ ID NO: 213272 - DNA, 25 bp, Mus musculus
atgtcaccacacagtcttaggcaac

SEQ ID NO: 213273 - DNA, 25 bp, Mus musculus
atgtcaccctgatggtgccccttcc

SEQ ID NO: 213274 - DNA, 25 bp, Mus musculus
atgtcacctatgatgaggactacca

SEQ ID NO: 213275 - DNA, 25 bp, Mus musculus
atgtcacctatgatggacaagaagc

SEQ ID NO: 213276 - DNA, 25 bp, Mus musculus
atgtcacctcggctaaggatgggga

SEQ ID NO: 213277 - DNA, 25 bp, Mus musculus
atgtcaccttcagctacccctgcag

SEQ ID NO: 213278 - DNA, 25 bp, Mus musculus
atgtcactcacccccaattccagga

SEQ ID NO: 213279 - DNA, 25 bp, Mus musculus
atgtcactcaggtgcggacattcta

SEQ ID NO: 213280 - DNA, 25 bp, Mus musculus
atgtcactccagagaaattcccaac

SEQ ID NO: 213281 - DNA, 25 bp, Mus musculus
atgtcactccagaggccacaaaaga

SEQ ID NO: 213282 - DNA, 25 bp, Mus musculus
atgtcacttgtgactgaggctccac

SEQ ID NO: 213283 - DNA, 25 bp, Mus musculus
atgtcagaaagactctactgtatac

SEQ ID NO: 213284 - DNA, 25 bp, Mus musculus
atgtcagaaagagtctactgtatac

SEQ ID NO: 213285 - DNA, 25 bp, Mus musculus
atgtcagaggaggtggagcctacta

SEQ ID NO: 213286 - DNA, 25 bp, Mus musculus
atgtcagatattgttgttgttacag

SEQ ID NO: 213287 - DNA, 25 bp, Mus musculus
atgtcagcacagctgtctgggattc

SEQ ID NO: 213288 - DNA, 25 bp, Mus musculus
atgtcagcagataggatctgtactg

SEQ ID NO: 213289 - DNA, 25 bp, Mus musculus
atgtcagcagatcaacttctgagac

SEQ ID NO: 213290 - DNA, 25 bp, Mus musculus
atgtcagcaggaaatgatggatgtc

SEQ ID NO: 213291 - DNA, 25 bp, Mus musculus
atgtcagcaggatggcacgctcaag

SEQ ID NO: 213292 - DNA, 25 bp, Mus musculus
atgtcagcaggctggcgcattggat

SEQ ID NO: 213293 - DNA, 25 bp, Mus musculus
atgtcagcccaggtgctgtgagtgg

SEQ ID NO: 213294 - DNA, 25 bp, Mus musculus
atgtcagcttcaaggtggacagcag

SEQ ID NO: 213295 - DNA, 25 bp, Mus musculus
atgtcaggagttcaccttttccact

SEQ ID NO: 213296 - DNA, 25 bp, Mus musculus
atgtcaggccggaggctcctgtagt

SEQ ID NO: 213297 - DNA, 25 bp, Mus musculus
atgtcagggaggtataagtgctaca

SEQ ID NO: 213298 - DNA, 25 bp, Mus musculus
atgtcagtcaggggacgtggaacac

SEQ ID NO: 213299 - DNA, 25 bp, Mus musculus
atgtcagtgaggttcctgctgctgt

SEQ ID NO: 213300 - DNA, 25 bp, Mus musculus
atgtcagtgcgattcccaactttca

SEQ ID NO: 213301 - DNA, 25 bp, Mus musculus
atgtcagtggagcagcttacagatg

SEQ ID NO: 213302 - DNA, 25 bp, Mus musculus
atgtcagttctgtgaacagatgtga

SEQ ID NO: 213303 - DNA, 25 bp, Mus musculus
atgtcatagtgcatttctcatctac

SEQ ID NO: 213304 - DNA, 25 bp, Mus musculus
atgtcatattttggtttttgggaat

SEQ ID NO: 213305 - DNA, 25 bp, Mus musculus
atgtcatcaaagggaatgatgaaag

SEQ ID NO: 213306 - DNA, 25 bp, Mus musculus
atgtcatcaaagggtctgagtggca

SEQ ID NO: 213307 - DNA, 25 bp, Mus musculus
atgtcatcaggcagcctgatctctc

SEQ ID NO: 213308 - DNA, 25 bp, Mus musculus
atgtcatcatatgatttttggtgac

SEQ ID NO: 213309 - DNA, 25 bp, Mus musculus
atgtcatcattatcacttatgcctt

SEQ ID NO: 213310 - DNA, 25 bp, Mus musculus
atgtcatccaggaggtggagtatgt

SEQ ID NO: 213311 - DNA, 25 bp, Mus musculus
atgtcatccagttactgctgacctt

SEQ ID NO: 213312 - DNA, 25 bp, Mus musculus
atgtcatcctcagacaacattgtgc

SEQ ID NO: 213313 - DNA, 25 bp, Mus musculus
atgtcatcctcagctgggagggcat

SEQ ID NO: 213314 - DNA, 25 bp, Mus musculus
atgtcatcctcaggcacaccaagat

SEQ ID NO: 213315 - DNA, 25 bp, Mus musculus
atgtcatcctcaggcagtgccctga

SEQ ID NO: 213316 - DNA, 25 bp, Mus musculus
atgtcatctacatagaccagcccac

SEQ ID NO: 213317 - DNA, 25 bp, Mus musculus
atgtcatctacatagaccaggacga

SEQ ID NO: 213318 - DNA, 25 bp, Mus musculus
atgtcatgatggtgtttggccttgg

SEQ ID NO: 213319 - DNA, 25 bp, Mus musculus
atgtcatgcaagcatttgacatgct

SEQ ID NO: 213320 - DNA, 25 bp, Mus musculus
atgtcatgcaaggttcaaagggatc

SEQ ID NO: 213321 - DNA, 25 bp, Mus musculus
atgtcatgcaagtttgtatgccgga

SEQ ID NO: 213322 - DNA, 25 bp, Mus musculus
atgtcatgctgtgtgcaggagagat

SEQ ID NO: 213323 - DNA, 25 bp, Mus musculus
atgtcatgttgtgtgcaggagagat

SEQ ID NO: 213324 - DNA, 25 bp, Mus musculus
atgtcatttgaagctgaggaggatc

SEQ ID NO: 213325 - DNA, 25 bp, Mus musculus
atgtcatttgggaggactcagaagc

SEQ ID NO: 213326 - DNA, 25 bp, Mus musculus
atgtccaaagggctcccagaggcta

SEQ ID NO: 213327 - DNA, 25 bp, Mus musculus
atgtccaacctggggtttaagaggc

SEQ ID NO: 213328 - DNA, 25 bp, Mus musculus
atgtccaatgtcccatcaccatctc

SEQ ID NO: 213329 - DNA, 25 bp, Mus musculus
atgtccacaccggtgatcctaagag

SEQ ID NO: 213330 - DNA, 25 bp, Mus musculus
atgtccaccatggtaggtgagctcc

SEQ ID NO: 213331 - DNA, 25 bp, Mus musculus
atgtccacccgagtggcccatcctc

SEQ ID NO: 213332 - DNA, 25 bp, Mus musculus
atgtccacctcacagaatagcattc

SEQ ID NO: 213333 - DNA, 25 bp, Mus musculus
atgtccacctcacagaggagcaggg

SEQ ID NO: 213334 - DNA, 25 bp, Mus musculus
atgtccacctcacagattcccggtc

SEQ ID NO: 213335 - DNA, 25 bp, Mus musculus
atgtccactgaggaaacctcaccga

SEQ ID NO: 213336 - DNA, 25 bp, Mus musculus
atgtccactgagggtgtgctgattt

SEQ ID NO: 213337 - DNA, 25 bp, Mus musculus
atgtccagaacagtgtccccgatga

SEQ ID NO: 213338 - DNA, 25 bp, Mus musculus
atgtccagatcacagaatacagata

SEQ ID NO: 213339 - DNA, 25 bp, Mus musculus
atgtccagatcacagcctctgcaga

SEQ ID NO: 213340 - DNA, 25 bp, Mus musculus
atgtccagatgtccaggtgtggtgc

SEQ ID NO: 213341 - DNA, 25 bp, Mus musculus
atgtccagcaccaaagaaggcatgg

SEQ ID NO: 213342 - DNA, 25 bp, Mus musculus
atgtccaggagcagacacggatcat

SEQ ID NO: 213343 - DNA, 25 bp, Mus musculus
atgtccaggagcaggggggactccc

SEQ ID NO: 213344 - DNA, 25 bp, Mus musculus
atgtccaggcaagatcagctctgaa

SEQ ID NO: 213345 - DNA, 25 bp, Mus musculus
atgtccaggtcctttcctcttccct

SEQ ID NO: 213346 - DNA, 25 bp, Mus musculus
atgtccaggtggctgagctcccgcc

SEQ ID NO: 213347 - DNA, 25 bp, Mus musculus
atgtccaggtggctgccccagtgcg

SEQ ID NO: 213348 - DNA, 25 bp, Mus musculus
atgtccatacggctggctcggatgg

SEQ ID NO: 213349 - DNA, 25 bp, Mus musculus
atgtccatgaggcctgtcccaggct

SEQ ID NO: 213350 - DNA, 25 bp, Mus musculus
atgtccatggaagacagcagtgaca

SEQ ID NO: 213351 - DNA, 25 bp, Mus musculus
atgtcccaacaggccatccgctgca

SEQ ID NO: 213352 - DNA, 25 bp, Mus musculus
atgtcccacaattctcgactatctc

SEQ ID NO: 213353 - DNA, 25 bp, Mus musculus
atgtcccacagtaacccctctaaat

SEQ ID NO: 213354 - DNA, 25 bp, Mus musculus
atgtccccaagaggtacttttctca

SEQ ID NO: 213355 - DNA, 25 bp, Mus musculus
atgtccccacaggggcaggtgctga

SEQ ID NO: 213356 - DNA, 25 bp, Mus musculus
atgtccctggatgatattatcaaac

SEQ ID NO: 213357 - DNA, 25 bp, Mus musculus
atgtccctttaggagagaagataga

SEQ ID NO: 213358 - DNA, 25 bp, Mus musculus
atgtccgagaggtcattgctagaat

SEQ ID NO: 213359 - DNA, 25 bp, Mus musculus
atgtccgcaggcggctcaaagactt

SEQ ID NO: 213360 - DNA, 25 bp, Mus musculus
atgtccggaaggtctgcgctgccaa

SEQ ID NO: 213361 - DNA, 25 bp, Mus musculus
atgtccggggacgagatgatttttg

SEQ ID NO: 213362 - DNA, 25 bp, Mus musculus
atgtcctcaacaaggacctgatgca

SEQ ID NO: 213363 - DNA, 25 bp, Mus musculus
atgtcctcttgcaaggagtcagcat

SEQ ID NO: 213364 - DNA, 25 bp, Mus musculus
atgtcctgcagggtttcaaagataa

SEQ ID NO: 213365 - DNA, 25 bp, Mus musculus
atgtcctgcctgacctgcaggaaga

SEQ ID NO: 213366 - DNA, 25 bp, Mus musculus
atgtcctgtggaggaaattgtgtca

SEQ ID NO: 213367 - DNA, 25 bp, Mus musculus
atgtccttgtaacaagcttaaatcc

SEQ ID NO: 213368 - DNA, 25 bp, Mus musculus
atgtcgagtggcctcggatgtggaa

SEQ ID NO: 213369 - DNA, 25 bp, Mus musculus
atgtcgcagggacactgggttccct

SEQ ID NO: 213370 - DNA, 25 bp, Mus musculus
atgtcgccaaagcccatgaaatgat

SEQ ID NO: 213371 - DNA, 25 bp, Mus musculus
atgtcgccagcgcccctccagcagc

SEQ ID NO: 213372 - DNA, 25 bp, Mus musculus
atgtcggaggctccgtggaacactc

SEQ ID NO: 213373 - DNA, 25 bp, Mus musculus
atgtcggtgctatgagtgctctggg

SEQ ID NO: 213374 - DNA, 25 bp, Mus musculus
atgtcggtgctatggcctgtgctgc

SEQ ID NO: 213375 - DNA, 25 bp, Mus musculus
atgtctaataaaactggatggcttc

SEQ ID NO: 213376 - DNA, 25 bp, Mus musculus
atgtctacgagaagatctcaagaaa

SEQ ID NO: 213377 - DNA, 25 bp, Mus musculus
atgtctacgttaaggtcacctccaa

SEQ ID NO: 213378 - DNA, 25 bp, Mus musculus
atgtctacgttaagttccggcggga

SEQ ID NO: 213379 - DNA, 25 bp, Mus musculus
atgtctagaagctctaggaatgatt

SEQ ID NO: 213380 - DNA, 25 bp, Mus musculus
atgtctatacagaggctctccctac

SEQ ID NO: 213381 - DNA, 25 bp, Mus musculus
atgtctatggcagtcctgacttcct

SEQ ID NO: 213382 - DNA, 25 bp, Mus musculus
atgtctatttggagtgtctaaaacc

SEQ ID NO: 213383 - DNA, 25 bp, Mus musculus
atgtctcacaatgccatcaggtttg

SEQ ID NO: 213384 - DNA, 25 bp, Mus musculus
atgtctcacaatggagatcagaacc

SEQ ID NO: 213385 - DNA, 25 bp, Mus musculus
atgtctcacccgggtgctggggaca

SEQ ID NO: 213386 - DNA, 25 bp, Mus musculus
atgtctcagagcttggatctgtctg

SEQ ID NO: 213387 - DNA, 25 bp, Mus musculus
atgtctcagctggacaaaccatctt

SEQ ID NO: 213388 - DNA, 25 bp, Mus musculus
atgtctcagctgggtactctcaagt

SEQ ID NO: 213389 - DNA, 25 bp, Mus musculus
atgtctccaaaccggagtcctgttg

SEQ ID NO: 213390 - DNA, 25 bp, Mus musculus
atgtctccagaacacttcagttatg

SEQ ID NO: 213391 - DNA, 25 bp, Mus musculus
atgtctccatgtcttcctccaagag

SEQ ID NO: 213392 - DNA, 25 bp, Mus musculus
atgtctcctgcttggctcctgtagt

SEQ ID NO: 213393 - DNA, 25 bp, Mus musculus
atgtctcttgcacaagttgatgggc

SEQ ID NO: 213394 - DNA, 25 bp, Mus musculus
atgtctgaagtgcaggaactctgca

SEQ ID NO: 213395 - DNA, 25 bp, Mus musculus
atgtctgaagtgcaggtatcagggt

SEQ ID NO: 213396 - DNA, 25 bp, Mus musculus
atgtctgacctgtcaaactgggctc

SEQ ID NO: 213397 - DNA, 25 bp, Mus musculus
atgtctgacgaggtgttccacgaca

SEQ ID NO: 213398 - DNA, 25 bp, Mus musculus
atgtctgagagacaggacggggcgc

SEQ ID NO: 213399 - DNA, 25 bp, Mus musculus
atgtctgagagacaggccttctgta

SEQ ID NO: 213400 - DNA, 25 bp, Mus musculus
atgtctgagcaggtgctcctgtgtg

SEQ ID NO: 213401 - DNA, 25 bp, Mus musculus
atgtctgagtaaggagagtccttct

SEQ ID NO: 213402 - DNA, 25 bp, Mus musculus
atgtctgagtgtcaggatggtggtg

SEQ ID NO: 213403 - DNA, 25 bp, Mus musculus
atgtctgagtgtcaggctgtgagtc

SEQ ID NO: 213404 - DNA, 25 bp, Mus musculus
atgtctgcaaaaagaaatacgaaga

SEQ ID NO: 213405 - DNA, 25 bp, Mus musculus
atgtctgcaagcatcctggtcaaca

SEQ ID NO: 213406 - DNA, 25 bp, Mus musculus
atgtctgccagtgtgccccaggcta

SEQ ID NO: 213407 - DNA, 25 bp, Mus musculus
atgtctgccctggatgacttgaaag

SEQ ID NO: 213408 - DNA, 25 bp, Mus musculus
atgtctgcctcaaagctcattggct

SEQ ID NO: 213409 - DNA, 25 bp, Mus musculus
atgtctgcctttggaaaggagcacc

SEQ ID NO: 213410 - DNA, 25 bp, Mus musculus
atgtctggaagccatgactgttcca

SEQ ID NO: 213411 - DNA, 25 bp, Mus musculus
atgtctgtatgagaacaaagccagt

SEQ ID NO: 213412 - DNA, 25 bp, Mus musculus
atgtctgtatgagtggctgagaggg

SEQ ID NO: 213413 - DNA, 25 bp, Mus musculus
atgtctgtgagcagtctcgaatgga

SEQ ID NO: 213414 - DNA, 25 bp, Mus musculus
atgtcttagatcagaaaagattcgg

SEQ ID NO: 213415 - DNA, 25 bp, Mus musculus
atgtcttagatcagaggcggcagac

SEQ ID NO: 213416 - DNA, 25 bp, Mus musculus
atgtcttcaagtaaaggatctccct

SEQ ID NO: 213417 - DNA, 25 bp, Mus musculus
atgtcttccaggccaagttccttcc

SEQ ID NO: 213418 - DNA, 25 bp, Mus musculus
atgtctttaagaattctgtctttat

SEQ ID NO: 213419 - DNA, 25 bp, Mus musculus
atgtctttaaggtgtttgtggccag

SEQ ID NO: 213420 - DNA, 25 bp, Mus musculus
atgtctttgcaaggtattgtcgcct

SEQ ID NO: 213421 - DNA, 25 bp, Mus musculus
atgtcttttcttcggtgggtctcgg

SEQ ID NO: 213422 - DNA, 25 bp, Mus musculus
atgtcttttcttgccaatgaggcga

SEQ ID NO: 213423 - DNA, 25 bp, Mus musculus
atgtgaaaaagtattcaaacatagg

SEQ ID NO: 213424 - DNA, 25 bp, Mus musculus
atgtgaaaagagtgtcccagcagat

SEQ ID NO: 213425 - DNA, 25 bp, Mus musculus
atgtgaaagactaggccaatccctt

SEQ ID NO: 213426 - DNA, 25 bp, Mus musculus
atgtgaaagagaagcagtgaactta

SEQ ID NO: 213427 - DNA, 25 bp, Mus musculus
atgtgaaagtacatttgcaagaata

SEQ ID NO: 213428 - DNA, 25 bp, Mus musculus
atgtgaaataggtgagaagccagat

SEQ ID NO: 213429 - DNA, 25 bp, Mus musculus
atgtgaaatagttttgggattttgc

SEQ ID NO: 213430 - DNA, 25 bp, Mus musculus
atgtgaacaaagtgaattccaaggc

SEQ ID NO: 213431 - DNA, 25 bp, Mus musculus
atgtgaacaagatgacggtcagcgt

SEQ ID NO: 213432 - DNA, 25 bp, Mus musculus
atgtgaacccatcaggaaggatcat

SEQ ID NO: 213433 - DNA, 25 bp, Mus musculus
atgtgaacccatcaggctgacatca

SEQ ID NO: 213434 - DNA, 25 bp, Mus musculus
atgtgaacgtgttagactcccattt

SEQ ID NO: 213435 - DNA, 25 bp, Mus musculus
atgtgaagagctgctggagcaggca

SEQ ID NO: 213436 - DNA, 25 bp, Mus musculus
atgtgaagagctggttttggggtcc

SEQ ID NO: 213437 - DNA, 25 bp, Mus musculus
atgtgaagaggtttgttgtctcatg

SEQ ID NO: 213438 - DNA, 25 bp, Mus musculus
atgtgaatacatacacaaaggcatt

SEQ ID NO: 213439 - DNA, 25 bp, Mus musculus
atgtgaatatcagacatgtacatgg

SEQ ID NO: 213440 - DNA, 25 bp, Mus musculus
atgtgaatatcaggacaatgggctg

SEQ ID NO: 213441 - DNA, 25 bp, Mus musculus
atgtgaatcttctggacatgttgac

SEQ ID NO: 213442 - DNA, 25 bp, Mus musculus
atgtgaatttgggaggtcataagtg

SEQ ID NO: 213443 - DNA, 25 bp, Mus musculus
atgtgaatttgggcacctccgcacc

SEQ ID NO: 213444 - DNA, 25 bp, Mus musculus
atgtgacaagatcgtgaaccttata

SEQ ID NO: 213445 - DNA, 25 bp, Mus musculus
atgtgacaaggcatatctagatgag

SEQ ID NO: 213446 - DNA, 25 bp, Mus musculus
atgtgacatactggggtgagcatgc

SEQ ID NO: 213447 - DNA, 25 bp, Mus musculus
atgtgaccagatgcatattcctggt

SEQ ID NO: 213448 - DNA, 25 bp, Mus musculus
atgtgaccagctcattgcctgaggg

SEQ ID NO: 213449 - DNA, 25 bp, Mus musculus
atgtgaccaggagatggctggcaga

SEQ ID NO: 213450 - DNA, 25 bp, Mus musculus
atgtgaccaggcctgaagggaaaga

SEQ ID NO: 213451 - DNA, 25 bp, Mus musculus
atgtgaccaggtggccttgaactca

SEQ ID NO: 213452 - DNA, 25 bp, Mus musculus
atgtgaccatcaggtactgcagggt

SEQ ID NO: 213453 - DNA, 25 bp, Mus musculus
atgtgacctgaaggagccaacacag

SEQ ID NO: 213454 - DNA, 25 bp, Mus musculus
atgtgacctggactcagccttggaa

SEQ ID NO: 213455 - DNA, 25 bp, Mus musculus
atgtgactacatgaagtgccctccg

SEQ ID NO: 213456 - DNA, 25 bp, Mus musculus
atgtgactcaagctcgtgtggccag

SEQ ID NO: 213457 - DNA, 25 bp, Mus musculus
atgtgagacgtgggactccagtgat

SEQ ID NO: 213458 - DNA, 25 bp, Mus musculus
atgtgagcaacttgtcttcactctg

SEQ ID NO: 213459 - DNA, 25 bp, Mus musculus
atgtgagcacatccgtctcaggtga

SEQ ID NO: 213460 - DNA, 25 bp, Mus musculus
atgtgagcaggaggcctctgaagac

SEQ ID NO: 213461 - DNA, 25 bp, Mus musculus
atgtgagctggaggcccctggcgaa

SEQ ID NO: 213462 - DNA, 25 bp, Mus musculus
atgtgaggcacgtggacatcttcaa

SEQ ID NO: 213463 - DNA, 25 bp, Mus musculus
atgtgagtcaaaggtcacatgctgc

SEQ ID NO: 213464 - DNA, 25 bp, Mus musculus
atgtgagtggcgttatatgaatact

SEQ ID NO: 213465 - DNA, 25 bp, Mus musculus
atgtgatcaagcgagactccctcca

SEQ ID NO: 213466 - DNA, 25 bp, Mus musculus
atgtgatcaagcgagatggccgcca

SEQ ID NO: 213467 - DNA, 25 bp, Mus musculus
atgtgatctgcaggaccagtccatg

SEQ ID NO: 213468 - DNA, 25 bp, Mus musculus
atgtgatgacaggaaattgtttact

SEQ ID NO: 213469 - DNA, 25 bp, Mus musculus
atgtgatgcttgcggaatgcagccc

SEQ ID NO: 213470 - DNA, 25 bp, Mus musculus
atgtgatgcttgcgtgcaatgctca

SEQ ID NO: 213471 - DNA, 25 bp, Mus musculus
atgtgatggaggatgtggtggagga

SEQ ID NO: 213472 - DNA, 25 bp, Mus musculus
atgtgatgtacaagaaagggaagat

SEQ ID NO: 213473 - DNA, 25 bp, Mus musculus
atgtgattctcaagctgggaagtca

SEQ ID NO: 213474 - DNA, 25 bp, Mus musculus
atgtgattctggaggagcaaaaacc

SEQ ID NO: 213475 - DNA, 25 bp, Mus musculus
atgtgattgctctaagaagctgatg

SEQ ID NO: 213476 - DNA, 25 bp, Mus musculus
atgtgattgtcgagacgtgcgaccg

SEQ ID NO: 213477 - DNA, 25 bp, Mus musculus
atgtgattgtggtgacactgcaaat

SEQ ID NO: 213478 - DNA, 25 bp, Mus musculus
atgtgattttatgccagagatttca

SEQ ID NO: 213479 - DNA, 25 bp, Mus musculus
atgtgattttcaggaaaagtgcaag

SEQ ID NO: 213480 - DNA, 25 bp, Mus musculus
atgtgcaaagaagtttacaattcct

SEQ ID NO: 213481 - DNA, 25 bp, Mus musculus
atgtgcaaccacagggactggaaat

SEQ ID NO: 213482 - DNA, 25 bp, Mus musculus
atgtgcaacctgcaccatgggcttg

SEQ ID NO: 213483 - DNA, 25 bp, Mus musculus
atgtgcacaaagatagttttgagat

SEQ ID NO: 213484 - DNA, 25 bp, Mus musculus
atgtgcacaaagcactgtgtgaaga

SEQ ID NO: 213485 - DNA, 25 bp, Mus musculus
atgtgcacaggaaaggaagttcctt

SEQ ID NO: 213486 - DNA, 25 bp, Mus musculus
atgtgcacaggacattgccctaaaa

SEQ ID NO: 213487 - DNA, 25 bp, Mus musculus
atgtgcacaggctacattgctggct

SEQ ID NO: 213488 - DNA, 25 bp, Mus musculus
atgtgcacagggtcgggagaacagc

SEQ ID NO: 213489 - DNA, 25 bp, Mus musculus
atgtgcacatgctggtagctgagca

SEQ ID NO: 213490 - DNA, 25 bp, Mus musculus
atgtgcaccaggttggcagagttgg

SEQ ID NO: 213491 - DNA, 25 bp, Mus musculus
atgtgcagactctgtccagccagct

SEQ ID NO: 213492 - DNA, 25 bp, Mus musculus
atgtgcagaggtccctgctggagaa

SEQ ID NO: 213493 - DNA, 25 bp, Mus musculus
atgtgcagagtgctgatcagggcac

SEQ ID NO: 213494 - DNA, 25 bp, Mus musculus
atgtgcagcatgagaatggctatgc

SEQ ID NO: 213495 - DNA, 25 bp, Mus musculus
atgtgcagcatgcttttcccagtca

SEQ ID NO: 213496 - DNA, 25 bp, Mus musculus
atgtgcagccaagaagtccaggaag

SEQ ID NO: 213497 - DNA, 25 bp, Mus musculus
atgtgcagccgctaccccggaagac

SEQ ID NO: 213498 - DNA, 25 bp, Mus musculus
atgtgcagccgctacgaccccatcc

SEQ ID NO: 213499 - DNA, 25 bp, Mus musculus
atgtgcagtcacaggtggataccct

SEQ ID NO: 213500 - DNA, 25 bp, Mus musculus
atgtgcatatgtggcaaagtttata

SEQ ID NO: 213501 - DNA, 25 bp, Mus musculus
atgtgcattagtgggtttgatgacc

SEQ ID NO: 213502 - DNA, 25 bp, Mus musculus
atgtgccaagtaatgtatatttaca

SEQ ID NO: 213503 - DNA, 25 bp, Mus musculus
atgtgccagaaagctgccccacgag

SEQ ID NO: 213504 - DNA, 25 bp, Mus musculus
atgtgcccagaggagtaccctcacc

SEQ ID NO: 213505 - DNA, 25 bp, Mus musculus
atgtgcccattccagctgtcgcaga

SEQ ID NO: 213506 - DNA, 25 bp, Mus musculus
atgtgccctcagccccccagcactt

SEQ ID NO: 213507 - DNA, 25 bp, Mus musculus
atgtgccgtgtggtgtggattcgca

SEQ ID NO: 213508 - DNA, 25 bp, Mus musculus
atgtgccgttttgagaagattgctg

SEQ ID NO: 213509 - DNA, 25 bp, Mus musculus
atgtgccgttttgaggctttggaga

SEQ ID NO: 213510 - DNA, 25 bp, Mus musculus
atgtgcgcagacaaacccggaggct

SEQ ID NO: 213511 - DNA, 25 bp, Mus musculus
atgtgcgcagccgcctgggaaacca

SEQ ID NO: 213512 - DNA, 25 bp, Mus musculus
atgtgcggctcggtccgacgcacag

SEQ ID NO: 213513 - DNA, 25 bp, Mus musculus
atgtgctagaacagaaactgcagtt

SEQ ID NO: 213514 - DNA, 25 bp, Mus musculus
atgtgctatgcccagaacatcccaa

SEQ ID NO: 213515 - DNA, 25 bp, Mus musculus
atgtgctatttgaccatctgttctg

SEQ ID NO: 213516 - DNA, 25 bp, Mus musculus
atgtgctgcagactgaagtggccac

SEQ ID NO: 213517 - DNA, 25 bp, Mus musculus
atgtgctgcaggctacatgtgagcg

SEQ ID NO: 213518 - DNA, 25 bp, Mus musculus
atgtgctgccagtccctccacagac

SEQ ID NO: 213519 - DNA, 25 bp, Mus musculus
atgtgctggccatgcctttttattc

SEQ ID NO: 213520 - DNA, 25 bp, Mus musculus
atgtgcttacatgcatgtgtaatac

SEQ ID NO: 213521 - DNA, 25 bp, Mus musculus
atgtgcttacgagtctactgtgctt

SEQ ID NO: 213522 - DNA, 25 bp, Mus musculus
atgtgcttatccaggttatcttctc

SEQ ID NO: 213523 - DNA, 25 bp, Mus musculus
atgtgcttctgagaagaggccgaat

SEQ ID NO: 213524 - DNA, 25 bp, Mus musculus
atgtgcttctgatgatgagagtaac

SEQ ID NO: 213525 - DNA, 25 bp, Mus musculus
atgtgcttgtcaggaacaatccact

SEQ ID NO: 213526 - DNA, 25 bp, Mus musculus
atgtggaaagaggagaaccatcaag

SEQ ID NO: 213527 - DNA, 25 bp, Mus musculus
atgtggaaagaggtggcagtgggag

SEQ ID NO: 213528 - DNA, 25 bp, Mus musculus
atgtggaaaggaaaatagaaattgt

SEQ ID NO: 213529 - DNA, 25 bp, Mus musculus
atgtggaaatccccagaggagctct

SEQ ID NO: 213530 - DNA, 25 bp, Mus musculus
atgtggaaatctctcaggagaagta

SEQ ID NO: 213531 - DNA, 25 bp, Mus musculus
atgtggaaatgcagtccctgcagat

SEQ ID NO: 213532 - DNA, 25 bp, Mus musculus
atgtggaaatgtgttctgcccagtt

SEQ ID NO: 213533 - DNA, 25 bp, Mus musculus
atgtggaaattttatagaacaagga

SEQ ID NO: 213534 - DNA, 25 bp, Mus musculus
atgtggaacatcagaggatctgaga

SEQ ID NO: 213535 - DNA, 25 bp, Mus musculus
atgtggaacatggagggccctgctc

SEQ ID NO: 213536 - DNA, 25 bp, Mus musculus
atgtggaagaggaaccgggcaaatg

SEQ ID NO: 213537 - DNA, 25 bp, Mus musculus
atgtggaagcaccagctggaggaag

SEQ ID NO: 213538 - DNA, 25 bp, Mus musculus
atgtggaagccgtgccccggcagcc

SEQ ID NO: 213539 - DNA, 25 bp, Mus musculus
atgtggaaggtgtgaatctggcaac

SEQ ID NO: 213540 - DNA, 25 bp, Mus musculus
atgtggaagtcttcagtaacttgtg

SEQ ID NO: 213541 - DNA, 25 bp, Mus musculus
atgtggaataaagtatcaggagtgc

SEQ ID NO: 213542 - DNA, 25 bp, Mus musculus
atgtggacaaggtattctttgatct

SEQ ID NO: 213543 - DNA, 25 bp, Mus musculus
atgtggacaaggtcattgtgctcag

SEQ ID NO: 213544 - DNA, 25 bp, Mus musculus
atgtggactttgaagctgttaagaa

SEQ ID NO: 213545 - DNA, 25 bp, Mus musculus
atgtggagaaggtgaaatttatgaa

SEQ ID NO: 213546 - DNA, 25 bp, Mus musculus
atgtggagaagtctggtgcctctag

SEQ ID NO: 213547 - DNA, 25 bp, Mus musculus
atgtggagaatgcatttttcactct

SEQ ID NO: 213548 - DNA, 25 bp, Mus musculus
atgtggagactggcacccagctgga

SEQ ID NO: 213549 - DNA, 25 bp, Mus musculus
atgtggagaggtggagaatctaaag

SEQ ID NO: 213550 - DNA, 25 bp, Mus musculus
atgtggagatgacttggactgatga

SEQ ID NO: 213551 - DNA, 25 bp, Mus musculus
atgtggagatggagtatacaatgga

SEQ ID NO: 213552 - DNA, 25 bp, Mus musculus
atgtggagcggccaaccccaacaag

SEQ ID NO: 213553 - DNA, 25 bp, Mus musculus
atgtggaggctgggctgtacgggag

SEQ ID NO: 213554 - DNA, 25 bp, Mus musculus
atgtggaggtagagggtggagttta

SEQ ID NO: 213555 - DNA, 25 bp, Mus musculus
atgtggatcaggaatcctttctgcc

SEQ ID NO: 213556 - DNA, 25 bp, Mus musculus
atgtggatgacagacacccctgcac

SEQ ID NO: 213557 - DNA, 25 bp, Mus musculus
atgtggatgacagagcagagcctgc

SEQ ID NO: 213558 - DNA, 25 bp, Mus musculus
atgtggatggcgagaaataccagag

SEQ ID NO: 213559 - DNA, 25 bp, Mus musculus
atgtggatgggtgaacgagcgtcag

SEQ ID NO: 213560 - DNA, 25 bp, Mus musculus
atgtggatgggttgacgagcgtcag

SEQ ID NO: 213561 - DNA, 25 bp, Mus musculus
atgtggcaaccagaatggggaatgc

SEQ ID NO: 213562 - DNA, 25 bp, Mus musculus
atgtggcaaccaggctgacaggggc

SEQ ID NO: 213563 - DNA, 25 bp, Mus musculus
atgtggcagcacagatacctttatc

SEQ ID NO: 213564 - DNA, 25 bp, Mus musculus
atgtggccaggatcgaaagccagcc

SEQ ID NO: 213565 - DNA, 25 bp, Mus musculus
atgtggccaggcctgcaccacggag

SEQ ID NO: 213566 - DNA, 25 bp, Mus musculus
atgtggcccaagataaagactgagt

SEQ ID NO: 213567 - DNA, 25 bp, Mus musculus
atgtggcccaaggacactcctcctc

SEQ ID NO: 213568 - DNA, 25 bp, Mus musculus
atgtggcctcgctaggatgcttcat

SEQ ID NO: 213569 - DNA, 25 bp, Mus musculus
atgtggcctgcccagagtgacctcc

SEQ ID NO: 213570 - DNA, 25 bp, Mus musculus
atgtggctaccctggtcatctgact

SEQ ID NO: 213571 - DNA, 25 bp, Mus musculus
atgtggctagagaggctgccctggg

SEQ ID NO: 213572 - DNA, 25 bp, Mus musculus
atgtggctagctataaaaccattta

SEQ ID NO: 213573 - DNA, 25 bp, Mus musculus
atgtggctgagacaggcacataaga

SEQ ID NO: 213574 - DNA, 25 bp, Mus musculus
atgtggcttagcagatcatcagtgc

SEQ ID NO: 213575 - DNA, 25 bp, Mus musculus
atgtggctttgctggagtatattga

SEQ ID NO: 213576 - DNA, 25 bp, Mus musculus
atgtggctttgctgggttgctatga

SEQ ID NO: 213577 - DNA, 25 bp, Mus musculus
atgtgggaacaggtgtcacagcacg

SEQ ID NO: 213578 - DNA, 25 bp, Mus musculus
atgtgggagaccactgggacaccaa

SEQ ID NO: 213579 - DNA, 25 bp, Mus musculus
atgtgggagattgtgaccttggagt

SEQ ID NO: 213580 - DNA, 25 bp, Mus musculus
atgtgggcacctgaatccaccttga

SEQ ID NO: 213581 - DNA, 25 bp, Mus musculus
atgtgggcacctgctggggttggga

SEQ ID NO: 213582 - DNA, 25 bp, Mus musculus
atgtgggccagctacctgggtgctg

SEQ ID NO: 213583 - DNA, 25 bp, Mus musculus
atgtgggccgtttctgcttccctca

SEQ ID NO: 213584 - DNA, 25 bp, Mus musculus
atgtgggcgaggaatcttatggcaa

SEQ ID NO: 213585 - DNA, 25 bp, Mus musculus
atgtggggccaggtgtcctgtccat

SEQ ID NO: 213586 - DNA, 25 bp, Mus musculus
atgtggggctggcatggaaaataat

SEQ ID NO: 213587 - DNA, 25 bp, Mus musculus
atgtggggctggtgtcaggcatgga

SEQ ID NO: 213588 - DNA, 25 bp, Mus musculus
atgtgggtccaggctctggacctga

SEQ ID NO: 213589 - DNA, 25 bp, Mus musculus
atgtgggtggagtgctctctgaaaa

SEQ ID NO: 213590 - DNA, 25 bp, Mus musculus
atgtgggtggagtggtccattcgtt

SEQ ID NO: 213591 - DNA, 25 bp, Mus musculus
atgtgggttatgttcagggcatgtc

SEQ ID NO: 213592 - DNA, 25 bp, Mus musculus
atgtggtaaagggggagcacgagtg

SEQ ID NO: 213593 - DNA, 25 bp, Mus musculus
atgtggtacccttgtgaatacatca

SEQ ID NO: 213594 - DNA, 25 bp, Mus musculus
atgtggtaccggagtaaggaacgag

SEQ ID NO: 213595 - DNA, 25 bp, Mus musculus
atgtggtagagaaggcagaagaatg

SEQ ID NO: 213596 - DNA, 25 bp, Mus musculus
atgtggtatgcagaggttaaggagc

SEQ ID NO: 213597 - DNA, 25 bp, Mus musculus
atgtggtcaaggacttaatgggcat

SEQ ID NO: 213598 - DNA, 25 bp, Mus musculus
atgtggtcaaggttcttgcagaatc

SEQ ID NO: 213599 - DNA, 25 bp, Mus musculus
atgtggtcgagaaaagacaactgag

SEQ ID NO: 213600 - DNA, 25 bp, Mus musculus
atgtggtcgagttgcagtaatgtga

SEQ ID NO: 213601 - DNA, 25 bp, Mus musculus
atgtggtgatggtacaccaggggtt

SEQ ID NO: 213602 - DNA, 25 bp, Mus musculus
atgtggttcatcggctggactgtac

SEQ ID NO: 213603 - DNA, 25 bp, Mus musculus
atgtggttgccggacctacaacctg

SEQ ID NO: 213604 - DNA, 25 bp, Mus musculus
atgtggtttaaaaaactacatatgg

SEQ ID NO: 213605 - DNA, 25 bp, Mus musculus
atgtggtttaaaaactctgtgcacc

SEQ ID NO: 213606 - DNA, 25 bp, Mus musculus
atgtgtaaaatctgggggttacaac

SEQ ID NO: 213607 - DNA, 25 bp, Mus musculus
atgtgtaaaatctgtgcactgaggc

SEQ ID NO: 213608 - DNA, 25 bp, Mus musculus
atgtgtaagcggccatgtattctca

SEQ ID NO: 213609 - DNA, 25 bp, Mus musculus
atgtgtaagcggtatttggaggtag

SEQ ID NO: 213610 - DNA, 25 bp, Mus musculus
atgtgtaccagatgacagaaggcag

SEQ ID NO: 213611 - DNA, 25 bp, Mus musculus
atgtgtagcaggtttcaaagctgaa

SEQ ID NO: 213612 - DNA, 25 bp, Mus musculus
atgtgtagcctcaggatgcctggtg

SEQ ID NO: 213613 - DNA, 25 bp, Mus musculus
atgtgtaggggagctgtcccgacca

SEQ ID NO: 213614 - DNA, 25 bp, Mus musculus
atgtgtatagcgagatctttgcaag

SEQ ID NO: 213615 - DNA, 25 bp, Mus musculus
atgtgtattaagaggagtgtctcca

SEQ ID NO: 213616 - DNA, 25 bp, Mus musculus
atgtgtattaagagttccgaggtga

SEQ ID NO: 213617 - DNA, 25 bp, Mus musculus
atgtgtattgcaagacagatcggct

SEQ ID NO: 213618 - DNA, 25 bp, Mus musculus
atgtgtattggtgagaagccagatc

SEQ ID NO: 213619 - DNA, 25 bp, Mus musculus
atgtgtcacccattctaacggcaag

SEQ ID NO: 213620 - DNA, 25 bp, Mus musculus
atgtgtcatctttccaaagaacatt

SEQ ID NO: 213621 - DNA, 25 bp, Mus musculus
atgtgtccatcctgtcctcagcctg

SEQ ID NO: 213622 - DNA, 25 bp, Mus musculus
atgtgtccccagaaccaaggagagc

SEQ ID NO: 213623 - DNA, 25 bp, Mus musculus
atgtgtcctcagagtctcccattag

SEQ ID NO: 213624 - DNA, 25 bp, Mus musculus
atgtgtcctcgagagacccagccat

SEQ ID NO: 213625 - DNA, 25 bp, Mus musculus
atgtgtcctcgagttttactacaga

SEQ ID NO: 213626 - DNA, 25 bp, Mus musculus
atgtgtcctgattaccgacagcacc

SEQ ID NO: 213627 - DNA, 25 bp, Mus musculus
atgtgtcctgctaaggctagagcgc

SEQ ID NO: 213628 - DNA, 25 bp, Mus musculus
atgtgtcctgctaagtgttcttgag

SEQ ID NO: 213629 - DNA, 25 bp, Mus musculus
atgtgtcctgtcccacgctcaggag

SEQ ID NO: 213630 - DNA, 25 bp, Mus musculus
atgtgtcttcattaggtgctgacct

SEQ ID NO: 213631 - DNA, 25 bp, Mus musculus
atgtgtgaaaaccttgtcactagat

SEQ ID NO: 213632 - DNA, 25 bp, Mus musculus
atgtgtgagagaaaccttataagtg

SEQ ID NO: 213633 - DNA, 25 bp, Mus musculus
atgtgtgagcaaagaagatagagga

SEQ ID NO: 213634 - DNA, 25 bp, Mus musculus
atgtgtgagcaacttggcatcagca

SEQ ID NO: 213635 - DNA, 25 bp, Mus musculus
atgtgtgagccagagaagccatcct

SEQ ID NO: 213636 - DNA, 25 bp, Mus musculus
atgtgtgagccaggtacattctttg

SEQ ID NO: 213637 - DNA, 25 bp, Mus musculus
atgtgtgaggacgtgaatgagtgtg

SEQ ID NO: 213638 - DNA, 25 bp, Mus musculus
atgtgtgaggtcgtgaatgagtgtg

SEQ ID NO: 213639 - DNA, 25 bp, Mus musculus
atgtgtgcactggagatggcagtgc

SEQ ID NO: 213640 - DNA, 25 bp, Mus musculus
atgtgtgcagcttccattgaagatt

SEQ ID NO: 213641 - DNA, 25 bp, Mus musculus
atgtgtgcaggttgtacttgttttt

SEQ ID NO: 213642 - DNA, 25 bp, Mus musculus
atgtgtgcatagagtgttattgtaa

SEQ ID NO: 213643 - DNA, 25 bp, Mus musculus
atgtgtgcatagctaatgtctgcga

SEQ ID NO: 213644 - DNA, 25 bp, Mus musculus
atgtgtgccaagatattgatgagtg

SEQ ID NO: 213645 - DNA, 25 bp, Mus musculus
atgtgtgcctgtaatgaatggtatg

SEQ ID NO: 213646 - DNA, 25 bp, Mus musculus
atgtgtgctgactgcctgtttctgg

SEQ ID NO: 213647 - DNA, 25 bp, Mus musculus
atgtgtgcttgccagataaagtgca

SEQ ID NO: 213648 - DNA, 25 bp, Mus musculus
atgtgtggacatcaggatgtgatgg

SEQ ID NO: 213649 - DNA, 25 bp, Mus musculus
atgtgtggcaggggagccttctctg

SEQ ID NO: 213650 - DNA, 25 bp, Mus musculus
atgtgtgggaacagctggaaggtag

SEQ ID NO: 213651 - DNA, 25 bp, Mus musculus
atgtgtgtcacacagatccagctga

SEQ ID NO: 213652 - DNA, 25 bp, Mus musculus
atgtgtgtcacacagatttttggag

SEQ ID NO: 213653 - DNA, 25 bp, Mus musculus
atgtgtgtgaggaggttccccctgg

SEQ ID NO: 213654 - DNA, 25 bp, Mus musculus
atgtgtgttggcgctaccctgattg

SEQ ID NO: 213655 - DNA, 25 bp, Mus musculus
atgtgttaatgatgttgcttttctc

SEQ ID NO: 213656 - DNA, 25 bp, Mus musculus
atgtgttatgagtttgtgatgtctg

SEQ ID NO: 213657 - DNA, 25 bp, Mus musculus
atgtgttattgagctgggaggcacc

SEQ ID NO: 213658 - DNA, 25 bp, Mus musculus
atgtgttcaagaacaaggttggcca

SEQ ID NO: 213659 - DNA, 25 bp, Mus musculus
atgtgttcagaatgatgatgccaac

SEQ ID NO: 213660 - DNA, 25 bp, Mus musculus
atgtgttcagcccgcatgccctaca

SEQ ID NO: 213661 - DNA, 25 bp, Mus musculus
atgtgttcagtctgggtctcaccat

SEQ ID NO: 213662 - DNA, 25 bp, Mus musculus
atgtgttttcagtggataatgaaac

SEQ ID NO: 213663 - DNA, 25 bp, Mus musculus
atgttaaaaatattagcatcaaaaa

SEQ ID NO: 213664 - DNA, 25 bp, Mus musculus
atgttaaaatcaagatctctgctcc

SEQ ID NO: 213665 - DNA, 25 bp, Mus musculus
atgttaaaatcacagactcaccacc

SEQ ID NO: 213666 - DNA, 25 bp, Mus musculus
atgttaaaatgtgtcccctgcactt

SEQ ID NO: 213667 - DNA, 25 bp, Mus musculus
atgttaatgtccaagccatgtacat

SEQ ID NO: 213668 - DNA, 25 bp, Mus musculus
atgttacactgacagacagatgggg

SEQ ID NO: 213669 - DNA, 25 bp, Mus musculus
atgttacggaggacccgagtcagaa

SEQ ID NO: 213670 - DNA, 25 bp, Mus musculus
atgttactatcaaagtattctgcag

SEQ ID NO: 213671 - DNA, 25 bp, Mus musculus
atgttagaagatggctccgagcgat

SEQ ID NO: 213672 - DNA, 25 bp, Mus musculus
atgttagagagaatggactgctgtc

SEQ ID NO: 213673 - DNA, 25 bp, Mus musculus
atgttatacctccggcttatacaac

SEQ ID NO: 213674 - DNA, 25 bp, Mus musculus
atgttatcaagaaaaagaataaacc

SEQ ID NO: 213675 - DNA, 25 bp, Mus musculus
atgttatccaggccctggacctcag

SEQ ID NO: 213676 - DNA, 25 bp, Mus musculus
atgttatccaggctccctgtccatt

SEQ ID NO: 213677 - DNA, 25 bp, Mus musculus
atgttatctcactatcctttgtgag

SEQ ID NO: 213678 - DNA, 25 bp, Mus musculus
atgttatggagggagtgaagccagc

SEQ ID NO: 213679 - DNA, 25 bp, Mus musculus
atgttattcagaggaccagagttca

SEQ ID NO: 213680 - DNA, 25 bp, Mus musculus
atgttcaaaggagcctttgaccagc

SEQ ID NO: 213681 - DNA, 25 bp, Mus musculus
atgttcaaagttagcatattattac

SEQ ID NO: 213682 - DNA, 25 bp, Mus musculus
atgttcaacagtgcacagtgtgttc

SEQ ID NO: 213683 - DNA, 25 bp, Mus musculus
atgttcaagaaatccttttatcttg

SEQ ID NO: 213684 - DNA, 25 bp, Mus musculus
atgttcaagaaatctgatagacgca

SEQ ID NO: 213685 - DNA, 25 bp, Mus musculus
atgttcaagaaatttgatgaaaaag

SEQ ID NO: 213686 - DNA, 25 bp, Mus musculus
atgttcaagaaccatgaacacatag

SEQ ID NO: 213687 - DNA, 25 bp, Mus musculus
atgttcacaagagcgttataacctg

SEQ ID NO: 213688 - DNA, 25 bp, Mus musculus
atgttcacacctaagatggaacagc

SEQ ID NO: 213689 - DNA, 25 bp, Mus musculus
atgttcacacctaagattgagcagc

SEQ ID NO: 213690 - DNA, 25 bp, Mus musculus
atgttcacagggtacggattgctct

SEQ ID NO: 213691 - DNA, 25 bp, Mus musculus
atgttcaccagaaaccaggtggcct

SEQ ID NO: 213692 - DNA, 25 bp, Mus musculus
atgttcacttcaggtattgacctca

SEQ ID NO: 213693 - DNA, 25 bp, Mus musculus
atgttcacttcaggtgtggacctcg

SEQ ID NO: 213694 - DNA, 25 bp, Mus musculus
atgttcagaaaggagctcttaccaa

SEQ ID NO: 213695 - DNA, 25 bp, Mus musculus
atgttcatcgagccgagatgaaacc

SEQ ID NO: 213696 - DNA, 25 bp, Mus musculus
atgttcattttactgtgtggagagc

SEQ ID NO: 213697 - DNA, 25 bp, Mus musculus
atgttccaagtaccccagcaagaag

SEQ ID NO: 213698 - DNA, 25 bp, Mus musculus
atgttccactcgctctttgccattg

SEQ ID NO: 213699 - DNA, 25 bp, Mus musculus
atgttccactcggatcaagtttgtg

SEQ ID NO: 213700 - DNA, 25 bp, Mus musculus
atgttccagacgtgaagcccttctc

SEQ ID NO: 213701 - DNA, 25 bp, Mus musculus
atgttccagaggaggtactacaagc

SEQ ID NO: 213702 - DNA, 25 bp, Mus musculus
atgttccatacacaggctcatcagc

SEQ ID NO: 213703 - DNA, 25 bp, Mus musculus
atgttccgagaccagacccctgagc

SEQ ID NO: 213704 - DNA, 25 bp, Mus musculus
atgttcctagagtacaacaaagcca

SEQ ID NO: 213705 - DNA, 25 bp, Mus musculus
atgttcctccttgtagcaatgctgt

SEQ ID NO: 213706 - DNA, 25 bp, Mus musculus
atgttcgacttcaggtctgtggcca

SEQ ID NO: 213707 - DNA, 25 bp, Mus musculus
atgttcgtctttcagctacagcgga

SEQ ID NO: 213708 - DNA, 25 bp, Mus musculus
atgttcgtctttcaggctgatgccc

SEQ ID NO: 213709 - DNA, 25 bp, Mus musculus
atgttctaacactgctgcgaccatt

SEQ ID NO: 213710 - DNA, 25 bp, Mus musculus
atgttctatgctgggacggccttct

SEQ ID NO: 213711 - DNA, 25 bp, Mus musculus
atgttctcatccaaagcctttatcc

SEQ ID NO: 213712 - DNA, 25 bp, Mus musculus
atgttctcatccagagcctttatcc

SEQ ID NO: 213713 - DNA, 25 bp, Mus musculus
atgttctcctccgaggtccagtttg

SEQ ID NO: 213714 - DNA, 25 bp, Mus musculus
atgttcttctccacggtactacttg

SEQ ID NO: 213715 - DNA, 25 bp, Mus musculus
atgttcttctccacgttctaccacg

SEQ ID NO: 213716 - DNA, 25 bp, Mus musculus
atgttcttctcggacctactaaatt

SEQ ID NO: 213717 - DNA, 25 bp, Mus musculus
atgttcttcttcagaaacaaacata

SEQ ID NO: 213718 - DNA, 25 bp, Mus musculus
atgttcttggaaacctgatatctca

SEQ ID NO: 213719 - DNA, 25 bp, Mus musculus
atgttctttatagacagacgcctgc

SEQ ID NO: 213720 - DNA, 25 bp, Mus musculus
atgttctttatagtgaggctatggg

SEQ ID NO: 213721 - DNA, 25 bp, Mus musculus
atgttgaaagatgatgccacagaga

SEQ ID NO: 213722 - DNA, 25 bp, Mus musculus
atgttgaaatggaatacactatgga

SEQ ID NO: 213723 - DNA, 25 bp, Mus musculus
atgttgaagaaatgttgttatccga

SEQ ID NO: 213724 - DNA, 25 bp, Mus musculus
atgttgaagctatggtaaaagtttc

SEQ ID NO: 213725 - DNA, 25 bp, Mus musculus
atgttgactttaggaatgtgaagct

SEQ ID NO: 213726 - DNA, 25 bp, Mus musculus
atgttgactttagggtcttctcagt

SEQ ID NO: 213727 - DNA, 25 bp, Mus musculus
atgttgatacaaatggaaactataa

SEQ ID NO: 213728 - DNA, 25 bp, Mus musculus
atgttgatccgtggcttcagtggca

SEQ ID NO: 213729 - DNA, 25 bp, Mus musculus
atgttgcaactccttatgaagtggc

SEQ ID NO: 213730 - DNA, 25 bp, Mus musculus
atgttgcaattacccacggtctgaa

SEQ ID NO: 213731 - DNA, 25 bp, Mus musculus
atgttgcaattacgtttctactgca

SEQ ID NO: 213732 - DNA, 25 bp, Mus musculus
atgttgccaatggaggtcctgcacc

SEQ ID NO: 213733 - DNA, 25 bp, Mus musculus
atgttgccaatggagtggagattgt

SEQ ID NO: 213734 - DNA, 25 bp, Mus musculus
atgttgccagagaggcagatgaagg

SEQ ID NO: 213735 - DNA, 25 bp, Mus musculus
atgttgcgcgctctcaggctagagt

SEQ ID NO: 213736 - DNA, 25 bp, Mus musculus
atgttgcggctgaagaacgggaacc

SEQ ID NO: 213737 - DNA, 25 bp, Mus musculus
atgttgcggctgagtggagattcta

SEQ ID NO: 213738 - DNA, 25 bp, Mus musculus
atgttgctgaagcttcaaaagaaag

SEQ ID NO: 213739 - DNA, 25 bp, Mus musculus
atgttgctgaggggcggcctgagct

SEQ ID NO: 213740 - DNA, 25 bp, Mus musculus
atgttgcttgatggtgaaattgaag

SEQ ID NO: 213741 - DNA, 25 bp, Mus musculus
atgttggaaccaaagatatttccat

SEQ ID NO: 213742 - DNA, 25 bp, Mus musculus
atgttggaagttcccatggccggaa

SEQ ID NO: 213743 - DNA, 25 bp, Mus musculus
atgttggcccagaggcagcttccaa

SEQ ID NO: 213744 - DNA, 25 bp, Mus musculus
atgttggcccagtgtcaccagactg

SEQ ID NO: 213745 - DNA, 25 bp, Mus musculus
atgttggcctataggaagtttggtg

SEQ ID NO: 213746 - DNA, 25 bp, Mus musculus
atgttggctgaatgtttgttaactg

SEQ ID NO: 213747 - DNA, 25 bp, Mus musculus
atgttgggaatgtccggcggtttca

SEQ ID NO: 213748 - DNA, 25 bp, Mus musculus
atgttgggattgtaggtcacgctgg

SEQ ID NO: 213749 - DNA, 25 bp, Mus musculus
atgttgggcagatcctgctcatctc

SEQ ID NO: 213750 - DNA, 25 bp, Mus musculus
atgttgggcaggatgtttggatctg

SEQ ID NO: 213751 - DNA, 25 bp, Mus musculus
atgttgtacggctgatggatgtctg

SEQ ID NO: 213752 - DNA, 25 bp, Mus musculus
atgttgtacggtggttacgctctgg

SEQ ID NO: 213753 - DNA, 25 bp, Mus musculus
atgttgtcagggcctaagatcacca

SEQ ID NO: 213754 - DNA, 25 bp, Mus musculus
atgttgtcaggggaagagatggctg

SEQ ID NO: 213755 - DNA, 25 bp, Mus musculus
atgttgtccctgacaggtttggcca

SEQ ID NO: 213756 - DNA, 25 bp, Mus musculus
atgttgtccggcattggaagaagga

SEQ ID NO: 213757 - DNA, 25 bp, Mus musculus
atgttgtcgcaggacagtaatgatg

SEQ ID NO: 213758 - DNA, 25 bp, Mus musculus
atgttgtcggcgtaggaatgtgttt

SEQ ID NO: 213759 - DNA, 25 bp, Mus musculus
atgttgtgaagaacttcaagttgga

SEQ ID NO: 213760 - DNA, 25 bp, Mus musculus
atgttgtgaagctcttcaatgatgc

SEQ ID NO: 213761 - DNA, 25 bp, Mus musculus
atgttgtgaggctggtggaggaggt

SEQ ID NO: 213762 - DNA, 25 bp, Mus musculus
atgttgtgcaaatgaagaaaagcaa

SEQ ID NO: 213763 - DNA, 25 bp, Mus musculus
atgttgtgccacaggcttacagtgg

SEQ ID NO: 213764 - DNA, 25 bp, Mus musculus
atgttgtgccacaggtgtcttatgt

SEQ ID NO: 213765 - DNA, 25 bp, Mus musculus
atgttgttagatcaggctgctttct

SEQ ID NO: 213766 - DNA, 25 bp, Mus musculus
atgttgttagatcaggggggctttg

SEQ ID NO: 213767 - DNA, 25 bp, Mus musculus
atgttgttgctggagacaaccggat

SEQ ID NO: 213768 - DNA, 25 bp, Mus musculus
atgttgtttttcatctagataaaaa

SEQ ID NO: 213769 - DNA, 25 bp, Mus musculus
atgtttaacagtattgcagaaacgt

SEQ ID NO: 213770 - DNA, 25 bp, Mus musculus
atgtttaacattgggcctaacaggc

SEQ ID NO: 213771 - DNA, 25 bp, Mus musculus
atgtttaacattggggtggccttgc

SEQ ID NO: 213772 - DNA, 25 bp, Mus musculus
atgtttaattccatatttgatggta

SEQ ID NO: 213773 - DNA, 25 bp, Mus musculus
atgtttaattgttcctgctgctgtc

SEQ ID NO: 213774 - DNA, 25 bp, Mus musculus
atgtttacaagccaacaactatttg

SEQ ID NO: 213775 - DNA, 25 bp, Mus musculus
atgtttacaagtatgagaccagcgg

SEQ ID NO: 213776 - DNA, 25 bp, Mus musculus
atgtttacagtggccggcctcattg

SEQ ID NO: 213777 - DNA, 25 bp, Mus musculus
atgtttacagttaggtgacagcagg

SEQ ID NO: 213778 - DNA, 25 bp, Mus musculus
atgtttagagcttcccccacccagg

SEQ ID NO: 213779 - DNA, 25 bp, Mus musculus
atgtttagctacaggaagcagtttg

SEQ ID NO: 213780 - DNA, 25 bp, Mus musculus
atgtttagctacaggagcatctgga

SEQ ID NO: 213781 - DNA, 25 bp, Mus musculus
atgtttattagtggaatctttgggg

SEQ ID NO: 213782 - DNA, 25 bp, Mus musculus
atgtttcacagatagaagctttgga

SEQ ID NO: 213783 - DNA, 25 bp, Mus musculus
atgtttcacagttcttccagaaagg

SEQ ID NO: 213784 - DNA, 25 bp, Mus musculus
atgtttcaggtggtttgttgaagta

SEQ ID NO: 213785 - DNA, 25 bp, Mus musculus
atgtttcatttcctgcttcaacaga

SEQ ID NO: 213786 - DNA, 25 bp, Mus musculus
atgtttcatttcctgtcctaataaa

SEQ ID NO: 213787 - DNA, 25 bp, Mus musculus
atgtttccaagaaggtcacagaact

SEQ ID NO: 213788 - DNA, 25 bp, Mus musculus
atgtttccaaggatctgttaagatt

SEQ ID NO: 213789 - DNA, 25 bp, Mus musculus
atgtttccaagtgttcatggatgtg

SEQ ID NO: 213790 - DNA, 25 bp, Mus musculus
atgtttccaagtttggtgtgatttt

SEQ ID NO: 213791 - DNA, 25 bp, Mus musculus
atgtttccaggaaatgcccatggag

SEQ ID NO: 213792 - DNA, 25 bp, Mus musculus
atgtttccaggagccctgacatact

SEQ ID NO: 213793 - DNA, 25 bp, Mus musculus
atgtttccagggctgcacagagaac

SEQ ID NO: 213794 - DNA, 25 bp, Mus musculus
atgtttccagttggcctctattact

SEQ ID NO: 213795 - DNA, 25 bp, Mus musculus
atgtttcccagaatcatacgatgac

SEQ ID NO: 213796 - DNA, 25 bp, Mus musculus
atgtttcctgagatgtaaagaaagg

SEQ ID NO: 213797 - DNA, 25 bp, Mus musculus
atgtttcctgaggctactgaaagat

SEQ ID NO: 213798 - DNA, 25 bp, Mus musculus
atgtttcctgtctagtgagtgccaa

SEQ ID NO: 213799 - DNA, 25 bp, Mus musculus
atgtttcctgtctggtgagtgtcac

SEQ ID NO: 213800 - DNA, 25 bp, Mus musculus
atgtttctaaagagaaaccatgaag

SEQ ID NO: 213801 - DNA, 25 bp, Mus musculus
atgtttctgggctttcaggaggttg

SEQ ID NO: 213802 - DNA, 25 bp, Mus musculus
atgtttctgtgtgagtgcatgcggg

SEQ ID NO: 213803 - DNA, 25 bp, Mus musculus
atgtttgaagcgacagcagtctcca

SEQ ID NO: 213804 - DNA, 25 bp, Mus musculus
atgtttgagggccatgacaccacag

SEQ ID NO: 213805 - DNA, 25 bp, Mus musculus
atgtttgcagccagcagcaagtgaa

SEQ ID NO: 213806 - DNA, 25 bp, Mus musculus
atgtttgccaagggaaagaaggcaa

SEQ ID NO: 213807 - DNA, 25 bp, Mus musculus
atgtttgccaaggggaacttcccca

SEQ ID NO: 213808 - DNA, 25 bp, Mus musculus
atgtttgccagaaatgtgcaaactg

SEQ ID NO: 213809 - DNA, 25 bp, Mus musculus
atgtttgccagacacgcgaaaagaa

SEQ ID NO: 213810 - DNA, 25 bp, Mus musculus
atgtttgcctgggaaatgctcataa

SEQ ID NO: 213811 - DNA, 25 bp, Mus musculus
atgtttggaaaggatcgtgaactgg

SEQ ID NO: 213812 - DNA, 25 bp, Mus musculus
atgtttgtccttaagtgtgggaact

SEQ ID NO: 213813 - DNA, 25 bp, Mus musculus
atgtttgtgtgtggacaggccaaaa

SEQ ID NO: 213814 - DNA, 25 bp, Mus musculus
atgtttgttggattcagtccttctc

SEQ ID NO: 213815 - DNA, 25 bp, Mus musculus
atgttttaagttcctgaatgccacg

SEQ ID NO: 213816 - DNA, 25 bp, Mus musculus
atgttttacatattgcaagacgaca

SEQ ID NO: 213817 - DNA, 25 bp, Mus musculus
atgttttccagcaagtggaacacat

SEQ ID NO: 213818 - DNA, 25 bp, Mus musculus
atgttttccaggaggtggtgtggtc

SEQ ID NO: 213819 - DNA, 25 bp, Mus musculus
atgttttcgaaggcagtataattcg

SEQ ID NO: 213820 - DNA, 25 bp, Mus musculus
atgttttcgaaggcatgcttgtagt

SEQ ID NO: 213821 - DNA, 25 bp, Mus musculus
atgttttctctgacagctgtcatca

SEQ ID NO: 213822 - DNA, 25 bp, Mus musculus
atgttttctggagtgacactagcag

SEQ ID NO: 213823 - DNA, 25 bp, Mus musculus
atgttttgatacagtcaccaaggag

SEQ ID NO: 213824 - DNA, 25 bp, Mus musculus
atgttttgcctgtagagacagctgc

SEQ ID NO: 213825 - DNA, 25 bp, Mus musculus
atgtttttacaagagctaagtgatt

SEQ ID NO: 213826 - DNA, 25 bp, Mus musculus
atgtttttgtgctgttgcttcctgg

SEQ ID NO: 213827 - DNA, 25 bp, Mus musculus
attaaaaacaatctggaacttcctg

SEQ ID NO: 213828 - DNA, 25 bp, Mus musculus
attaaaaacctgcaactggattaca

SEQ ID NO: 213829 - DNA, 25 bp, Mus musculus
attaaaaaccttaggttgttctgca

SEQ ID NO: 213830 - DNA, 25 bp, Mus musculus
attaaaaagagcaacagtgtgaaga

SEQ ID NO: 213831 - DNA, 25 bp, Mus musculus
attaaaaatgatgtcttcatttgtg

SEQ ID NO: 213832 - DNA, 25 bp, Mus musculus
attaaaaattgagacctctgacagc

SEQ ID NO: 213833 - DNA, 25 bp, Mus musculus
attaaaaattgagagagagaagatt

SEQ ID NO: 213834 - DNA, 25 bp, Mus musculus
attaaaacaaagatgtctcatttcc

SEQ ID NO: 213835 - DNA, 25 bp, Mus musculus
attaaaacaaaggggaagcgtgcgg

SEQ ID NO: 213836 - DNA, 25 bp, Mus musculus
attaaaacacaggagctccttctgg

SEQ ID NO: 213837 - DNA, 25 bp, Mus musculus
attaaaagaatggaggtccgctggg

SEQ ID NO: 213838 - DNA, 25 bp, Mus musculus
attaaaagctaaacaagagcatgaa

SEQ ID NO: 213839 - DNA, 25 bp, Mus musculus
attaaaagtaaatggaagtacgact

SEQ ID NO: 213840 - DNA, 25 bp, Mus musculus
attaaaatccaagaggcggtggtgg

SEQ ID NO: 213841 - DNA, 25 bp, Mus musculus
attaaaattcagcctttagaaagga

SEQ ID NO: 213842 - DNA, 25 bp, Mus musculus
attaaaattcaggctgtagctgttt

SEQ ID NO: 213843 - DNA, 25 bp, Mus musculus
attaaacaagccgctgcgcctgtcg

SEQ ID NO: 213844 - DNA, 25 bp, Mus musculus
attaaacaaggctggagccagttag

SEQ ID NO: 213845 - DNA, 25 bp, Mus musculus
attaaacataaaagaaattgcatgt

SEQ ID NO: 213846 - DNA, 25 bp, Mus musculus
attaaacatgcccactgtcacgcac

SEQ ID NO: 213847 - DNA, 25 bp, Mus musculus
attaaaccaggtgctgtggaaagag

SEQ ID NO: 213848 - DNA, 25 bp, Mus musculus
attaaacctaatgcttgcattgggc

SEQ ID NO: 213849 - DNA, 25 bp, Mus musculus
attaaactaggcctgaggagcgatg

SEQ ID NO: 213850 - DNA, 25 bp, Mus musculus
attaaacttacatcaaaattatatt

SEQ ID NO: 213851 - DNA, 25 bp, Mus musculus
attaaacttacatgtttgaggattg

SEQ ID NO: 213852 - DNA, 25 bp, Mus musculus
attaaagaagtataataagcccagt

SEQ ID NO: 213853 - DNA, 25 bp, Mus musculus
attaaagacttaggaagaagactac

SEQ ID NO: 213854 - DNA, 25 bp, Mus musculus
attaaagacttaggtgggtcggtga

SEQ ID NO: 213855 - DNA, 25 bp, Mus musculus
attaaagcaaaaagtcaaagctttt

SEQ ID NO: 213856 - DNA, 25 bp, Mus musculus
attaaagcccagattcagtttgctg

SEQ ID NO: 213857 - DNA, 25 bp, Mus musculus
attaaagctcagagccggccacccc

SEQ ID NO: 213858 - DNA, 25 bp, Mus musculus
attaaagctcagtaccgcacaacca

SEQ ID NO: 213859 - DNA, 25 bp, Mus musculus
attaaaggaggcacttgactcaatg

SEQ ID NO: 213860 - DNA, 25 bp, Mus musculus
attaaagtgaagacgctgactggga

SEQ ID NO: 213861 - DNA, 25 bp, Mus musculus
attaaagtgaagtccaccacagaaa

SEQ ID NO: 213862 - DNA, 25 bp, Mus musculus
attaaagtgaggaataagactgtca

SEQ ID NO: 213863 - DNA, 25 bp, Mus musculus
attaaagtttaaccagctcaggaag

SEQ ID NO: 213864 - DNA, 25 bp, Mus musculus
attaaatcagcaagccccgcccaac

SEQ ID NO: 213865 - DNA, 25 bp, Mus musculus
attaaatctgaagtgcagcgtaagt

SEQ ID NO: 213866 - DNA, 25 bp, Mus musculus
attaaatgagaataaggctcaagga

SEQ ID NO: 213867 - DNA, 25 bp, Mus musculus
attaaatgccaaacacactggctct

SEQ ID NO: 213868 - DNA, 25 bp, Mus musculus
attaaatgccaatccttcccagttt

SEQ ID NO: 213869 - DNA, 25 bp, Mus musculus
attaaatgggccagatacaatttgt

SEQ ID NO: 213870 - DNA, 25 bp, Mus musculus
attaaatttccaaggcccgagaata

SEQ ID NO: 213871 - DNA, 25 bp, Mus musculus
attaacaaagtagcagacagtgtta

SEQ ID NO: 213872 - DNA, 25 bp, Mus musculus
attaacaagaagattgacctgaagt

SEQ ID NO: 213873 - DNA, 25 bp, Mus musculus
attaacaagaagatttacaagattg

SEQ ID NO: 213874 - DNA, 25 bp, Mus musculus
attaacacagatgctgctcagactc

SEQ ID NO: 213875 - DNA, 25 bp, Mus musculus
attaacacagcacggtgcaacagaa

SEQ ID NO: 213876 - DNA, 25 bp, Mus musculus
attaacacaggatcacactatggat

SEQ ID NO: 213877 - DNA, 25 bp, Mus musculus
attaacagataagccctccctgacc

SEQ ID NO: 213878 - DNA, 25 bp, Mus musculus
attaacatttacagctcccctctcc

SEQ ID NO: 213879 - DNA, 25 bp, Mus musculus
attaacccttggagtaaaaatggct

SEQ ID NO: 213880 - DNA, 25 bp, Mus musculus
attaactccatgtaatcgtgttcct

SEQ ID NO: 213881 - DNA, 25 bp, Mus musculus
attaacttaaaagatactgagagaa

SEQ ID NO: 213882 - DNA, 25 bp, Mus musculus
attaacttaaaagatgattcataat

SEQ ID NO: 213883 - DNA, 25 bp, Mus musculus
attaacttgaaggtagaagactttt

SEQ ID NO: 213884 - DNA, 25 bp, Mus musculus
attaactttagcccagaaactaggc

SEQ ID NO: 213885 - DNA, 25 bp, Mus musculus
attaactttaggtgctgctttcctg

SEQ ID NO: 213886 - DNA, 25 bp, Mus musculus
attaagaaacaaacggctcttgctg

SEQ ID NO: 213887 - DNA, 25 bp, Mus musculus
attaagaagaagacaaaaaagcgtc

SEQ ID NO: 213888 - DNA, 25 bp, Mus musculus
attaagaatgaggtggcgagtggga

SEQ ID NO: 213889 - DNA, 25 bp, Mus musculus
attaagaattccttgaatccgacgt

SEQ ID NO: 213890 - DNA, 25 bp, Mus musculus
attaagaattccttgatccaaacgc

SEQ ID NO: 213891 - DNA, 25 bp, Mus musculus
attaagacataggtggcaggatcca

SEQ ID NO: 213892 - DNA, 25 bp, Mus musculus
attaagacgaagatggccaagctgc

SEQ ID NO: 213893 - DNA, 25 bp, Mus musculus
attaagacgaagggcaaggaggccc

SEQ ID NO: 213894 - DNA, 25 bp, Mus musculus
attaagacgtcagataatcaaatta

SEQ ID NO: 213895 - DNA, 25 bp, Mus musculus
attaagagaaaaaagaatggaatgg

SEQ ID NO: 213896 - DNA, 25 bp, Mus musculus
attaagagaaaaaagatttgatgtt

SEQ ID NO: 213897 - DNA, 25 bp, Mus musculus
attaagcaagatgagaagccagctc

SEQ ID NO: 213898 - DNA, 25 bp, Mus musculus
attaagcaaggctgtggacttaagt

SEQ ID NO: 213899 - DNA, 25 bp, Mus musculus
attaagcaatgtcaggcgtccgacc

SEQ ID NO: 213900 - DNA, 25 bp, Mus musculus
attaagcagagcaagatctggtgct

SEQ ID NO: 213901 - DNA, 25 bp, Mus musculus
attaagccgtacagtaagcactacc

SEQ ID NO: 213902 - DNA, 25 bp, Mus musculus
attaaggaagttacaatgattttgg

SEQ ID NO: 213903 - DNA, 25 bp, Mus musculus
attaaggatggaaagaaagatctga

SEQ ID NO: 213904 - DNA, 25 bp, Mus musculus
attaaggatggaaagagcttaacaa

SEQ ID NO: 213905 - DNA, 25 bp, Mus musculus
attaaggccaaaaatgtcagcagct

SEQ ID NO: 213906 - DNA, 25 bp, Mus musculus
attaagggcgagatgagcaaccctg

SEQ ID NO: 213907 - DNA, 25 bp, Mus musculus
attaagtagaagaactatactatgc

SEQ ID NO: 213908 - DNA, 25 bp, Mus musculus
attaataaaaagacctcacagtgga

SEQ ID NO: 213909 - DNA, 25 bp, Mus musculus
attaataacagaagaaattaaagag

SEQ ID NO: 213910 - DNA, 25 bp, Mus musculus
attaataaccagctggttgatcaga

SEQ ID NO: 213911 - DNA, 25 bp, Mus musculus
attaatataaacaacttccattcga

SEQ ID NO: 213912 - DNA, 25 bp, Mus musculus
attaatatatgatcctgaaaaagcc

SEQ ID NO: 213913 - DNA, 25 bp, Mus musculus
attaatcaacagattcaaggcctct

SEQ ID NO: 213914 - DNA, 25 bp, Mus musculus
attaatccaggatccacagggtctg

SEQ ID NO: 213915 - DNA, 25 bp, Mus musculus
attaatcccacaggctctgttgtca

SEQ ID NO: 213916 - DNA, 25 bp, Mus musculus
attaatcccttctcctgagctacat

SEQ ID NO: 213917 - DNA, 25 bp, Mus musculus
attaatgaaggaatggtcacgatct

SEQ ID NO: 213918 - DNA, 25 bp, Mus musculus
attaatgacgctggtgaaatacagg

SEQ ID NO: 213919 - DNA, 25 bp, Mus musculus
attaatgccatttagttcgctacac

SEQ ID NO: 213920 - DNA, 25 bp, Mus musculus
attaatgctgtaggcaccagacctg

SEQ ID NO: 213921 - DNA, 25 bp, Mus musculus
attaatggaggccaggaaaacggca

SEQ ID NO: 213922 - DNA, 25 bp, Mus musculus
attaatggatgcaggggtcccaatt

SEQ ID NO: 213923 - DNA, 25 bp, Mus musculus
attaatggatgcaggtgtagcagtg

SEQ ID NO: 213924 - DNA, 25 bp, Mus musculus
attaatggcacagacgcagcctcct

SEQ ID NO: 213925 - DNA, 25 bp, Mus musculus
attaatgtggcagatatcattaatg

SEQ ID NO: 213926 - DNA, 25 bp, Mus musculus
attaattacagttctccaagccagc

SEQ ID NO: 213927 - DNA, 25 bp, Mus musculus
attaattagaggaggttcgccttcg

SEQ ID NO: 213928 - DNA, 25 bp, Mus musculus
attaattcaggagtgggaggtgctg

SEQ ID NO: 213929 - DNA, 25 bp, Mus musculus
attaatttgaagggtgattcagaag

SEQ ID NO: 213930 - DNA, 25 bp, Mus musculus
attacaaacagtggccagtttcact

SEQ ID NO: 213931 - DNA, 25 bp, Mus musculus
attacaaactgagtagcactcagca

SEQ ID NO: 213932 - DNA, 25 bp, Mus musculus
attacaaagcctcccagactacaac

SEQ ID NO: 213933 - DNA, 25 bp, Mus musculus
attacaaagtagctcaaccgaagaa

SEQ ID NO: 213934 - DNA, 25 bp, Mus musculus
attacaaatacgatacactaaagat

SEQ ID NO: 213935 - DNA, 25 bp, Mus musculus
attacaaatacggtacccatgtgaa

SEQ ID NO: 213936 - DNA, 25 bp, Mus musculus
attacaaccagagggcatgaagaga

SEQ ID NO: 213937 - DNA, 25 bp, Mus musculus
attacaaccagagttttcctccctc

SEQ ID NO: 213938 - DNA, 25 bp, Mus musculus
attacaacctcgaggaatcatgcac

SEQ ID NO: 213939 - DNA, 25 bp, Mus musculus
attacaactaccagaacaatgaaaa

SEQ ID NO: 213940 - DNA, 25 bp, Mus musculus
attacaactaccagattatccagct

SEQ ID NO: 213941 - DNA, 25 bp, Mus musculus
attacaactaccaggcaggacccga

SEQ ID NO: 213942 - DNA, 25 bp, Mus musculus
attacaagaccataccactctcctc

SEQ ID NO: 213943 - DNA, 25 bp, Mus musculus
attacaagaccatgtttatgtctgg

SEQ ID NO: 213944 - DNA, 25 bp, Mus musculus
attacaagactccactgcaaaattg

SEQ ID NO: 213945 - DNA, 25 bp, Mus musculus
attacaagatagcgggacacggctc

SEQ ID NO: 213946 - DNA, 25 bp, Mus musculus
attacaagcatgagggacaaagccc

SEQ ID NO: 213947 - DNA, 25 bp, Mus musculus
attacaagtgtaaagtagtcgccgg

SEQ ID NO: 213948 - DNA, 25 bp, Mus musculus
attacaatcttaaaggggcaagcgg

SEQ ID NO: 213949 - DNA, 25 bp, Mus musculus
attacaatgcaagaaatcctacctt

SEQ ID NO: 213950 - DNA, 25 bp, Mus musculus
attacaattgagaccaggccatgct

SEQ ID NO: 213951 - DNA, 25 bp, Mus musculus
attacacaagaaaaaagtgaaaaca

SEQ ID NO: 213952 - DNA, 25 bp, Mus musculus
attacacaataatggagtgatagaa

SEQ ID NO: 213953 - DNA, 25 bp, Mus musculus
attacacagctgaaggagagactag

SEQ ID NO: 213954 - DNA, 25 bp, Mus musculus
attacacatttttgttgtgaagtta

SEQ ID NO: 213955 - DNA, 25 bp, Mus musculus
attacaccgggtgaacctgaattta

SEQ ID NO: 213956 - DNA, 25 bp, Mus musculus
attacagaaaaagaggctcctcaac

SEQ ID NO: 213957 - DNA, 25 bp, Mus musculus
attacagaaaagggtgtgtttgacg

SEQ ID NO: 213958 - DNA, 25 bp, Mus musculus
attacagaaggtcaccagaaagacc

SEQ ID NO: 213959 - DNA, 25 bp, Mus musculus
attacagaatgaggccggggacgac

SEQ ID NO: 213960 - DNA, 25 bp, Mus musculus
attacagagcatgaaatgcattgat

SEQ ID NO: 213961 - DNA, 25 bp, Mus musculus
attacagagggagtttattcaaaag

SEQ ID NO: 213962 - DNA, 25 bp, Mus musculus
attacagagtgcaagggtagctaag

SEQ ID NO: 213963 - DNA, 25 bp, Mus musculus
attacagagtgcaaggtaaatcttt

SEQ ID NO: 213964 - DNA, 25 bp, Mus musculus
attacagataaggaactgctgaaga

SEQ ID NO: 213965 - DNA, 25 bp, Mus musculus
attacagataaggtgttctcattgt

SEQ ID NO: 213966 - DNA, 25 bp, Mus musculus
attacagatgaccgtgataaaggtg

SEQ ID NO: 213967 - DNA, 25 bp, Mus musculus
attacagcaaaataggaaacctcgt

SEQ ID NO: 213968 - DNA, 25 bp, Mus musculus
attacagcaaaataggacggaaagt

SEQ ID NO: 213969 - DNA, 25 bp, Mus musculus
attacagcagcaatattcacaacct

SEQ ID NO: 213970 - DNA, 25 bp, Mus musculus
attacaggaagggtctgcttggtga

SEQ ID NO: 213971 - DNA, 25 bp, Mus musculus
attacaggaaggtgtcagacaaaga

SEQ ID NO: 213972 - DNA, 25 bp, Mus musculus
attacaggatacaaggcaaaaacag

SEQ ID NO: 213973 - DNA, 25 bp, Mus musculus
attacaggatagagactaatgctca

SEQ ID NO: 213974 - DNA, 25 bp, Mus musculus
attacaggtaatgaagaaggatatt

SEQ ID NO: 213975 - DNA, 25 bp, Mus musculus
attacataaaagaggaactcattat

SEQ ID NO: 213976 - DNA, 25 bp, Mus musculus
attacataagcccatggatgggata

SEQ ID NO: 213977 - DNA, 25 bp, Mus musculus
attacatacagccagagaagtgaca

SEQ ID NO: 213978 - DNA, 25 bp, Mus musculus
attacatacagccaggaaacaaagc

SEQ ID NO: 213979 - DNA, 25 bp, Mus musculus
attacatacagccaggaaggaatct

SEQ ID NO: 213980 - DNA, 25 bp, Mus musculus
attacatacttctacactccagaag

SEQ ID NO: 213981 - DNA, 25 bp, Mus musculus
attacatcaaccatcaaacacagac

SEQ ID NO: 213982 - DNA, 25 bp, Mus musculus
attacatcaagaagtccaaggttgt

SEQ ID NO: 213983 - DNA, 25 bp, Mus musculus
attacatcacgaatccagttcactc

SEQ ID NO: 213984 - DNA, 25 bp, Mus musculus
attacatcagattacgagctcctct

SEQ ID NO: 213985 - DNA, 25 bp, Mus musculus
attacattccaaaggtgtgcaggat

SEQ ID NO: 213986 - DNA, 25 bp, Mus musculus
attaccaaagcagagttctcgtcat

SEQ ID NO: 213987 - DNA, 25 bp, Mus musculus
attaccaaagcaggcttcttccctt

SEQ ID NO: 213988 - DNA, 25 bp, Mus musculus
attaccaaattgttcccataacaac

SEQ ID NO: 213989 - DNA, 25 bp, Mus musculus
attaccaacgattgaaaaatgcaga

SEQ ID NO: 213990 - DNA, 25 bp, Mus musculus
attaccaactgcttgtggactaaag

SEQ ID NO: 213991 - DNA, 25 bp, Mus musculus
attaccacaaatactggatgtaaac

SEQ ID NO: 213992 - DNA, 25 bp, Mus musculus
attaccacccaagattcagtttgct

SEQ ID NO: 213993 - DNA, 25 bp, Mus musculus
attaccacctccaagaagccaaatc

SEQ ID NO: 213994 - DNA, 25 bp, Mus musculus
attaccagcctcagattcagcgttt

SEQ ID NO: 213995 - DNA, 25 bp, Mus musculus
attaccaggcataactcctggctct

SEQ ID NO: 213996 - DNA, 25 bp, Mus musculus
attaccatgtgctgcacaatcctgg

SEQ ID NO: 213997 - DNA, 25 bp, Mus musculus
attaccattaataaggaccaaaatg

SEQ ID NO: 213998 - DNA, 25 bp, Mus musculus
attacccactcagaaaagcggcctt

SEQ ID NO: 213999 - DNA, 25 bp, Mus musculus
attacccccaagtgctgcaggaggc

SEQ ID NO: 214000 - DNA, 25 bp, Mus musculus
attaccccggagcgagcccatccgt

SEQ ID NO: 214001 - DNA, 25 bp, Mus musculus
attaccctaagttatacattgatgg

SEQ ID NO: 214002 - DNA, 25 bp, Mus musculus
attaccctagattggtgctgatggg

SEQ ID NO: 214003 - DNA, 25 bp, Mus musculus
attaccctgatggaaactcccagta

SEQ ID NO: 214004 - DNA, 25 bp, Mus musculus
attaccctgatggtcataatgatta

SEQ ID NO: 214005 - DNA, 25 bp, Mus musculus
attaccctgcttcagcaacttgatt

SEQ ID NO: 214006 - DNA, 25 bp, Mus musculus
attaccgatggatctggtggccctc

SEQ ID NO: 214007 - DNA, 25 bp, Mus musculus
attaccgctctagccgcagccagag

SEQ ID NO: 214008 - DNA, 25 bp, Mus musculus
attacctaaatgactgataatggtc

SEQ ID NO: 214009 - DNA, 25 bp, Mus musculus
attacctaaatggacaggatccttg

SEQ ID NO: 214010 - DNA, 25 bp, Mus musculus
attacctcaatgagatccagagttt

SEQ ID NO: 214011 - DNA, 25 bp, Mus musculus
attacctcagagctgtggaacgacg

SEQ ID NO: 214012 - DNA, 25 bp, Mus musculus
attacctccaggctcggttgtccta

SEQ ID NO: 214013 - DNA, 25 bp, Mus musculus
attacctccagtgtgacaaatacaa

SEQ ID NO: 214014 - DNA, 25 bp, Mus musculus
attacctgaaggatgggccttacat

SEQ ID NO: 214015 - DNA, 25 bp, Mus musculus
attacctgaaggttgggccttacat

SEQ ID NO: 214016 - DNA, 25 bp, Mus musculus
attacctgagcacccagttgatgat

SEQ ID NO: 214017 - DNA, 25 bp, Mus musculus
attacctgcacaagctgactcatca

SEQ ID NO: 214018 - DNA, 25 bp, Mus musculus
attacctggaaagagctgttattag

SEQ ID NO: 214019 - DNA, 25 bp, Mus musculus
attacctggaaaggtggtggtggca

SEQ ID NO: 214020 - DNA, 25 bp, Mus musculus
attacctggagaagtgtgtctgggg

SEQ ID NO: 214021 - DNA, 25 bp, Mus musculus
attacctgtgatgtctcacaccatt

SEQ ID NO: 214022 - DNA, 25 bp, Mus musculus
attaccttaccagttttacaggaat

SEQ ID NO: 214023 - DNA, 25 bp, Mus musculus
attacgacaagaacatcatcaagaa

SEQ ID NO: 214024 - DNA, 25 bp, Mus musculus
attacgacaagacaccaagtggact

SEQ ID NO: 214025 - DNA, 25 bp, Mus musculus
attacgccacttatggatgtaggtc

SEQ ID NO: 214026 - DNA, 25 bp, Mus musculus
attacgccaggtggtgccacagagc

SEQ ID NO: 214027 - DNA, 25 bp, Mus musculus
attacgcctttgagatggctgtctc

SEQ ID NO: 214028 - DNA, 25 bp, Mus musculus
attacggcactacggatgatctgag

SEQ ID NO: 214029 - DNA, 25 bp, Mus musculus
attacggcactacgggttccaatat

SEQ ID NO: 214030 - DNA, 25 bp, Mus musculus
attacgtaatgaagtacttaagcag

SEQ ID NO: 214031 - DNA, 25 bp, Mus musculus
attacgtcatgccagatgtctctcc

SEQ ID NO: 214032 - DNA, 25 bp, Mus musculus
attacgtcatgtactatgagatgtc

SEQ ID NO: 214033 - DNA, 25 bp, Mus musculus
attacgtgaagagagggcacatctg

SEQ ID NO: 214034 - DNA, 25 bp, Mus musculus
attacgtggagaggtcaacagtctg

SEQ ID NO: 214035 - DNA, 25 bp, Mus musculus
attactaagtggaggttccatgttg

SEQ ID NO: 214036 - DNA, 25 bp, Mus musculus
attactaatcaaaatacgcctacta

SEQ ID NO: 214037 - DNA, 25 bp, Mus musculus
attactaatcaaagtggacccaaca

SEQ ID NO: 214038 - DNA, 25 bp, Mus musculus
attactacaagggccagtatatcct

SEQ ID NO: 214039 - DNA, 25 bp, Mus musculus
attactacattatatatgcaagttc

SEQ ID NO: 214040 - DNA, 25 bp, Mus musculus
attactacattatatctacatcaaa

SEQ ID NO: 214041 - DNA, 25 bp, Mus musculus
attactaccaagccccaggagatgg

SEQ ID NO: 214042 - DNA, 25 bp, Mus musculus
attactacgaaggaggaaactccca

SEQ ID NO: 214043 - DNA, 25 bp, Mus musculus
attactacgtcatgcagtgcccttc

SEQ ID NO: 214044 - DNA, 25 bp, Mus musculus
attactacgtcatggtcatctgcta

SEQ ID NO: 214045 - DNA, 25 bp, Mus musculus
attactactacatgatcatctccag

SEQ ID NO: 214046 - DNA, 25 bp, Mus musculus
attactactatggagacatttcgac

SEQ ID NO: 214047 - DNA, 25 bp, Mus musculus
attactactatggaggacagtggtt

SEQ ID NO: 214048 - DNA, 25 bp, Mus musculus
attactatagagaataggtcaaaga

SEQ ID NO: 214049 - DNA, 25 bp, Mus musculus
attactataggctgcagaagaggaa

SEQ ID NO: 214050 - DNA, 25 bp, Mus musculus
attactatcccgagaaagcctacat

SEQ ID NO: 214051 - DNA, 25 bp, Mus musculus
attactatcccgaggcccgagtccg

SEQ ID NO: 214052 - DNA, 25 bp, Mus musculus
attactatgaagtttctctgcccag

SEQ ID NO: 214053 - DNA, 25 bp, Mus musculus
attactatgaatacctctctgacgc

SEQ ID NO: 214054 - DNA, 25 bp, Mus musculus
attactcctcagcagagttacgtca

SEQ ID NO: 214055 - DNA, 25 bp, Mus musculus
attactcctcagcaggtatttgtca

SEQ ID NO: 214056 - DNA, 25 bp, Mus musculus
attactcgcagggcaacaaagaatc

SEQ ID NO: 214057 - DNA, 25 bp, Mus musculus
attactcgcagtgagatgagtcaga

SEQ ID NO: 214058 - DNA, 25 bp, Mus musculus
attactctaaggccttcctcctgca

SEQ ID NO: 214059 - DNA, 25 bp, Mus musculus
attactctgagagagtcagtccttc

SEQ ID NO: 214060 - DNA, 25 bp, Mus musculus
attactgaagcttaaaaagcaagct

SEQ ID NO: 214061 - DNA, 25 bp, Mus musculus
attactgactgcagcaccacagccg

SEQ ID NO: 214062 - DNA, 25 bp, Mus musculus
attactgcaacagctttttctaaaa

SEQ ID NO: 214063 - DNA, 25 bp, Mus musculus
attactgctaccgccatcttagaac

SEQ ID NO: 214064 - DNA, 25 bp, Mus musculus
attactgctaccgctgtggcaatgt

SEQ ID NO: 214065 - DNA, 25 bp, Mus musculus
attactgctgacctcaggatgtcag

SEQ ID NO: 214066 - DNA, 25 bp, Mus musculus
attactggcccggctgtgaagttga

SEQ ID NO: 214067 - DNA, 25 bp, Mus musculus
attactgtagcaaagacggtttaca

SEQ ID NO: 214068 - DNA, 25 bp, Mus musculus
attactgtagcaaggacaaatctgt

SEQ ID NO: 214069 - DNA, 25 bp, Mus musculus
attactgtcgagagaagggtttctc

SEQ ID NO: 214070 - DNA, 25 bp, Mus musculus
attactgtgcaagaattactacggt

SEQ ID NO: 214071 - DNA, 25 bp, Mus musculus
attacttaaaaagagtgtgtaagct

SEQ ID NO: 214072 - DNA, 25 bp, Mus musculus
attacttcataaatatccttttatc

SEQ ID NO: 214073 - DNA, 25 bp, Mus musculus
attacttctgtgtactgccttctga

SEQ ID NO: 214074 - DNA, 25 bp, Mus musculus
attacttctgtgtagtagtttacaa

SEQ ID NO: 214075 - DNA, 25 bp, Mus musculus
attacttgcacagggaacaagaatg

SEQ ID NO: 214076 - DNA, 25 bp, Mus musculus
attacttgtaaagatttgagaaacc

SEQ ID NO: 214077 - DNA, 25 bp, Mus musculus
attactttctggatgagcagaagct

SEQ ID NO: 214078 - DNA, 25 bp, Mus musculus
attactttgagcgtcgagcagaaca

SEQ ID NO: 214079 - DNA, 25 bp, Mus musculus
attactttgagtttgctgggggaag

SEQ ID NO: 214080 - DNA, 25 bp, Mus musculus
attagaaaaacataaatgcagttcc

SEQ ID NO: 214081 - DNA, 25 bp, Mus musculus
attagaaaaagtaagtgcttccttg

SEQ ID NO: 214082 - DNA, 25 bp, Mus musculus
attagaaaagaatctaaagggatgt

SEQ ID NO: 214083 - DNA, 25 bp, Mus musculus
attagaaaaggaaactgcattcaga

SEQ ID NO: 214084 - DNA, 25 bp, Mus musculus
attagaaaagtctctccagaggcgg

SEQ ID NO: 214085 - DNA, 25 bp, Mus musculus
attagaaccagcagatgacaccgta

SEQ ID NO: 214086 - DNA, 25 bp, Mus musculus
attagaagaatcagcagccgctctt

SEQ ID NO: 214087 - DNA, 25 bp, Mus musculus
attagaagctctcatctgaaaataa

SEQ ID NO: 214088 - DNA, 25 bp, Mus musculus
attagaaggacagaaaaaaagcaga

SEQ ID NO: 214089 - DNA, 25 bp, Mus musculus
attagaaggacagctcctgaattcg

SEQ ID NO: 214090 - DNA, 25 bp, Mus musculus
attagaatggcagggacggtcaaga

SEQ ID NO: 214091 - DNA, 25 bp, Mus musculus
attagacaagccctgacgtcaagac

SEQ ID NO: 214092 - DNA, 25 bp, Mus musculus
attagacctggttggctcaaaaaca

SEQ ID NO: 214093 - DNA, 25 bp, Mus musculus
attagagagaggcaggagtacgtgc

SEQ ID NO: 214094 - DNA, 25 bp, Mus musculus
attagagaggctgtgtcccattgta

SEQ ID NO: 214095 - DNA, 25 bp, Mus musculus
attagagagttcaaggggctgagat

SEQ ID NO: 214096 - DNA, 25 bp, Mus musculus
attagaggagtcgctaagattgttg

SEQ ID NO: 214097 - DNA, 25 bp, Mus musculus
attagagggcaggacaataagactg

SEQ ID NO: 214098 - DNA, 25 bp, Mus musculus
attagatatgactgaaatggcaaga

SEQ ID NO: 214099 - DNA, 25 bp, Mus musculus
attagatgaagaattcatcctacaa

SEQ ID NO: 214100 - DNA, 25 bp, Mus musculus
attagcaaaagtgcttggctgtctg

SEQ ID NO: 214101 - DNA, 25 bp, Mus musculus
attagcaaaggtggattgcactgcc

SEQ ID NO: 214102 - DNA, 25 bp, Mus musculus
attagcaccaggaatgtcactgtct

SEQ ID NO: 214103 - DNA, 25 bp, Mus musculus
attagcagaagctcacgctcgcctg

SEQ ID NO: 214104 - DNA, 25 bp, Mus musculus
attagcatactcagcgagagaagcg

SEQ ID NO: 214105 - DNA, 25 bp, Mus musculus
attagcatctgacattgagattctt

SEQ ID NO: 214106 - DNA, 25 bp, Mus musculus
attagccaccaaagcgatgttaaag

SEQ ID NO: 214107 - DNA, 25 bp, Mus musculus
attagcccaggtatccatgccagca

SEQ ID NO: 214108 - DNA, 25 bp, Mus musculus
attagcccatatgcaactgccccct

SEQ ID NO: 214109 - DNA, 25 bp, Mus musculus
attagccgaaggcagcttggagaag

SEQ ID NO: 214110 - DNA, 25 bp, Mus musculus
attagccgaaggcagtctttcagaa

SEQ ID NO: 214111 - DNA, 25 bp, Mus musculus
attagcctttgaggtgtgcctgcag

SEQ ID NO: 214112 - DNA, 25 bp, Mus musculus
attagcgccatcagcgaggctgctg

SEQ ID NO: 214113 - DNA, 25 bp, Mus musculus
attagctctgccccaggcctcctca

SEQ ID NO: 214114 - DNA, 25 bp, Mus musculus
attagcttttatggcgcgagcttca

SEQ ID NO: 214115 - DNA, 25 bp, Mus musculus
attaggaaccaaggtagcttctcca

SEQ ID NO: 214116 - DNA, 25 bp, Mus musculus
attaggacctcggggagaaagaggg

SEQ ID NO: 214117 - DNA, 25 bp, Mus musculus
attaggaggagagcaattatgaagc

SEQ ID NO: 214118 - DNA, 25 bp, Mus musculus
attaggagttgaatgcccaaaggat

SEQ ID NO: 214119 - DNA, 25 bp, Mus musculus
attaggcagcaaaacataaagaaca

SEQ ID NO: 214120 - DNA, 25 bp, Mus musculus
attaggccgcggaggtcacaggctc

SEQ ID NO: 214121 - DNA, 25 bp, Mus musculus
attaggctcccgagttctacacagc

SEQ ID NO: 214122 - DNA, 25 bp, Mus musculus
attagggcagaatatgcagacagac

SEQ ID NO: 214123 - DNA, 25 bp, Mus musculus
attaggggatggtgatgaacgagac

SEQ ID NO: 214124 - DNA, 25 bp, Mus musculus
attaggttctcaggctattgataca

SEQ ID NO: 214125 - DNA, 25 bp, Mus musculus
attagtattaaagataatcaaatac

SEQ ID NO: 214126 - DNA, 25 bp, Mus musculus
attagtctagaaaacataggagaca

SEQ ID NO: 214127 - DNA, 25 bp, Mus musculus
attagtctagaaaacgctaatcttt

SEQ ID NO: 214128 - DNA, 25 bp, Mus musculus
attagtgcaggaaaacccaaccacc

SEQ ID NO: 214129 - DNA, 25 bp, Mus musculus
attagtggccaggtcctgctctctc

SEQ ID NO: 214130 - DNA, 25 bp, Mus musculus
attagtgggaagcagctatactggg

SEQ ID NO: 214131 - DNA, 25 bp, Mus musculus
attagtgggatgcagctatactggg

SEQ ID NO: 214132 - DNA, 25 bp, Mus musculus
attagttaagctgagtgtcctggtt

SEQ ID NO: 214133 - DNA, 25 bp, Mus musculus
attagttgttcaagagaaaccattt

SEQ ID NO: 214134 - DNA, 25 bp, Mus musculus
attagttgttcaagatgggagaatg

SEQ ID NO: 214135 - DNA, 25 bp, Mus musculus
attagttttaaggccgaagtcaatt

SEQ ID NO: 214136 - DNA, 25 bp, Mus musculus
attagttttaagtatggcgcccaga

SEQ ID NO: 214137 - DNA, 25 bp, Mus musculus
attataaaaaggcacagaagaatga

SEQ ID NO: 214138 - DNA, 25 bp, Mus musculus
attataaatgctacaataaaagtca

SEQ ID NO: 214139 - DNA, 25 bp, Mus musculus
attataacaggtgagacgacaagaa

SEQ ID NO: 214140 - DNA, 25 bp, Mus musculus
attataactacaaggatcctgctgg

SEQ ID NO: 214141 - DNA, 25 bp, Mus musculus
attataacttgcagattctgcttcg

SEQ ID NO: 214142 - DNA, 25 bp, Mus musculus
attataagcaaattctacggtgaga

SEQ ID NO: 214143 - DNA, 25 bp, Mus musculus
attataatcaggctggccagctaag

SEQ ID NO: 214144 - DNA, 25 bp, Mus musculus
attataatgaaaaggtaatgtatgt

SEQ ID NO: 214145 - DNA, 25 bp, Mus musculus
attataattactgagacaacactgg

SEQ ID NO: 214146 - DNA, 25 bp, Mus musculus
attataatttcaaggttgattcttt

SEQ ID NO: 214147 - DNA, 25 bp, Mus musculus
attatacaaatgtcggagtcttcta

SEQ ID NO: 214148 - DNA, 25 bp, Mus musculus
attataccctagccggaaagccagt

SEQ ID NO: 214149 - DNA, 25 bp, Mus musculus
attataccctagccgtgtacaagtc

SEQ ID NO: 214150 - DNA, 25 bp, Mus musculus
attataccctctcctaccaccactg

SEQ ID NO: 214151 - DNA, 25 bp, Mus musculus
attataccggctgcagtacctcaga

SEQ ID NO: 214152 - DNA, 25 bp, Mus musculus
attataccggggcccagtcatttac

SEQ ID NO: 214153 - DNA, 25 bp, Mus musculus
attatactttaagaggctggattgt

SEQ ID NO: 214154 - DNA, 25 bp, Mus musculus
attatagaaaaggtcattttgagtg

SEQ ID NO: 214155 - DNA, 25 bp, Mus musculus
attatagatgcttatgtggatatgc

SEQ ID NO: 214156 - DNA, 25 bp, Mus musculus
attatagcagtgatcccgcttcgat

SEQ ID NO: 214157 - DNA, 25 bp, Mus musculus
attatataccaaaggttcaaaagag

SEQ ID NO: 214158 - DNA, 25 bp, Mus musculus
attatatatagcaaaaatgtgaatc

SEQ ID NO: 214159 - DNA, 25 bp, Mus musculus
attatatatagcaactttaaaggat

SEQ ID NO: 214160 - DNA, 25 bp, Mus musculus
attatatgaactatgatggattcaa

SEQ ID NO: 214161 - DNA, 25 bp, Mus musculus
attatcaacctgaccctctatggga

SEQ ID NO: 214162 - DNA, 25 bp, Mus musculus
attatcaacctggaggacggtgaga

SEQ ID NO: 214163 - DNA, 25 bp, Mus musculus
attatcaacgagtactgtattggca

SEQ ID NO: 214164 - DNA, 25 bp, Mus musculus
attatcaagaagaaggacttttccc

SEQ ID NO: 214165 - DNA, 25 bp, Mus musculus
attatcaagttctcagatgaatatc

SEQ ID NO: 214166 - DNA, 25 bp, Mus musculus
attatcacaatgaggttgacattgt

SEQ ID NO: 214167 - DNA, 25 bp, Mus musculus
attatcactcagataacccttcctc

SEQ ID NO: 214168 - DNA, 25 bp, Mus musculus
attatcactcaggcccaggcctggg

SEQ ID NO: 214169 - DNA, 25 bp, Mus musculus
attatcactgcgagatgagctttga

SEQ ID NO: 214170 - DNA, 25 bp, Mus musculus
attatcactgcgagctgcttgacat

SEQ ID NO: 214171 - DNA, 25 bp, Mus musculus
attatcactgtgggccccctccctt

SEQ ID NO: 214172 - DNA, 25 bp, Mus musculus
attatcagtctcagcatcctcatgt

SEQ ID NO: 214173 - DNA, 25 bp, Mus musculus
attatcatccaggccattccccagt

SEQ ID NO: 214174 - DNA, 25 bp, Mus musculus
attatccactcaattttaaagaaat

SEQ ID NO: 214175 - DNA, 25 bp, Mus musculus
attatccagagacagcccaaaactt

SEQ ID NO: 214176 - DNA, 25 bp, Mus musculus
attatccagaggagacagcactctg

SEQ ID NO: 214177 - DNA, 25 bp, Mus musculus
attatccagagtggagctgtaatag

SEQ ID NO: 214178 - DNA, 25 bp, Mus musculus
attatccaggacagttgtccacgta

SEQ ID NO: 214179 - DNA, 25 bp, Mus musculus
attatccattgcataaccccaaatc

SEQ ID NO: 214180 - DNA, 25 bp, Mus musculus
attatccccatggagaaaatccccc

SEQ ID NO: 214181 - DNA, 25 bp, Mus musculus
attatccccatgttagaattgcccc

SEQ ID NO: 214182 - DNA, 25 bp, Mus musculus
attatcctgagcaaaggctacaaca

SEQ ID NO: 214183 - DNA, 25 bp, Mus musculus
attatcctgcaagggagcccggtgg

SEQ ID NO: 214184 - DNA, 25 bp, Mus musculus
attatccttaagatgactgcttacg

SEQ ID NO: 214185 - DNA, 25 bp, Mus musculus
attatctactacaaggtttgaagag

SEQ ID NO: 214186 - DNA, 25 bp, Mus musculus
attatctgaagagcccagagcgttt

SEQ ID NO: 214187 - DNA, 25 bp, Mus musculus
attatctgaaggcctgggagctgcc

SEQ ID NO: 214188 - DNA, 25 bp, Mus musculus
attatctttataggctgaaggcggc

SEQ ID NO: 214189 - DNA, 25 bp, Mus musculus
attatgaaagaatcccagtaaacct

SEQ ID NO: 214190 - DNA, 25 bp, Mus musculus
attatgaaagctatcatgagaagtt

SEQ ID NO: 214191 - DNA, 25 bp, Mus musculus
attatgaacagattgatgacattgt

SEQ ID NO: 214192 - DNA, 25 bp, Mus musculus
attatgaatccagaggttggaatga

SEQ ID NO: 214193 - DNA, 25 bp, Mus musculus
attatgacactatttttgaagacta

SEQ ID NO: 214194 - DNA, 25 bp, Mus musculus
attatgacatccggatgctgacctt

SEQ ID NO: 214195 - DNA, 25 bp, Mus musculus
attatgacatccgggtcaaggctgg

SEQ ID NO: 214196 - DNA, 25 bp, Mus musculus
attatgaccaccactaccatcacgg

SEQ ID NO: 214197 - DNA, 25 bp, Mus musculus
attatgaccctgcctccacaggagt

SEQ ID NO: 214198 - DNA, 25 bp, Mus musculus
attatgaccctgctttttaaattgg

SEQ ID NO: 214199 - DNA, 25 bp, Mus musculus
attatgatattaagatgctaacatt

SEQ ID NO: 214200 - DNA, 25 bp, Mus musculus
attatgatgcatccgatgtcgtcct

SEQ ID NO: 214201 - DNA, 25 bp, Mus musculus
attatgatgcatcggatgtcgtcct

SEQ ID NO: 214202 - DNA, 25 bp, Mus musculus
attatgcaaatgaggatgcccctaa

SEQ ID NO: 214203 - DNA, 25 bp, Mus musculus
attatgcaaatgagttccagacagg

SEQ ID NO: 214204 - DNA, 25 bp, Mus musculus
attatgcagaaaaagcttcaaactc

SEQ ID NO: 214205 - DNA, 25 bp, Mus musculus
attatgcagagatgcacacaagcca

SEQ ID NO: 214206 - DNA, 25 bp, Mus musculus
attatgcagagcttctgaacaaggt

SEQ ID NO: 214207 - DNA, 25 bp, Mus musculus
attatgcagaggatgattctgacag

SEQ ID NO: 214208 - DNA, 25 bp, Mus musculus
attatgcagttgtggtatcccaagg

SEQ ID NO: 214209 - DNA, 25 bp, Mus musculus
attatgcagttgtgtgggtgaatgg

SEQ ID NO: 214210 - DNA, 25 bp, Mus musculus
attatgccaaagagatgaaggagtc

SEQ ID NO: 214211 - DNA, 25 bp, Mus musculus
attatgccctgcaggtcaatgtgat

SEQ ID NO: 214212 - DNA, 25 bp, Mus musculus
attatggaagagagtttcatgggat

SEQ ID NO: 214213 - DNA, 25 bp, Mus musculus
attatggactggcatgcacacaatc

SEQ ID NO: 214214 - DNA, 25 bp, Mus musculus
attatggagcagagaatgacggaca

SEQ ID NO: 214215 - DNA, 25 bp, Mus musculus
attatgggacctaatgacagcccat

SEQ ID NO: 214216 - DNA, 25 bp, Mus musculus
attatgggacctctcaatgaaagtg

SEQ ID NO: 214217 - DNA, 25 bp, Mus musculus
attatggtagcaagatctaaagggg

SEQ ID NO: 214218 - DNA, 25 bp, Mus musculus
attatgtgatggctgcaccccatca

SEQ ID NO: 214219 - DNA, 25 bp, Mus musculus
attatgtgatgtactacgagatgtc

SEQ ID NO: 214220 - DNA, 25 bp, Mus musculus
attattaaacggatggctcccagca

SEQ ID NO: 214221 - DNA, 25 bp, Mus musculus
attattaaagacacactttttaatg

SEQ ID NO: 214222 - DNA, 25 bp, Mus musculus
attattaaagataattgctgtgaag

SEQ ID NO: 214223 - DNA, 25 bp, Mus musculus
attattaaagtggttggctatgata

SEQ ID NO: 214224 - DNA, 25 bp, Mus musculus
attattaaagtttaaccagctcagg

SEQ ID NO: 214225 - DNA, 25 bp, Mus musculus
attattaatatggaaatgaaagtgc

SEQ ID NO: 214226 - DNA, 25 bp, Mus musculus
attattacaggtaatgaagaaggat

SEQ ID NO: 214227 - DNA, 25 bp, Mus musculus
attattcaagaacaggacgcgggtc

SEQ ID NO: 214228 - DNA, 25 bp, Mus musculus
attattcaagagatcatcgatgacc

SEQ ID NO: 214229 - DNA, 25 bp, Mus musculus
attattcacgacagtgttgaaggct

SEQ ID NO: 214230 - DNA, 25 bp, Mus musculus
attattccagtacttccaggtggcg

SEQ ID NO: 214231 - DNA, 25 bp, Mus musculus
attattcgagcccccaagctcttcc

SEQ ID NO: 214232 - DNA, 25 bp, Mus musculus
attattcgagctatcttcagacaca

SEQ ID NO: 214233 - DNA, 25 bp, Mus musculus
attattctatggctagaaaatgccc

SEQ ID NO: 214234 - DNA, 25 bp, Mus musculus
attattcttatccaggtaccattac

SEQ ID NO: 214235 - DNA, 25 bp, Mus musculus
attattgatacatccatggggtccc

SEQ ID NO: 214236 - DNA, 25 bp, Mus musculus
attattgatattgacccattgatcg

SEQ ID NO: 214237 - DNA, 25 bp, Mus musculus
attattgctaagatggcagttgggt

SEQ ID NO: 214238 - DNA, 25 bp, Mus musculus
attattggagatcgtggccttcaaa

SEQ ID NO: 214239 - DNA, 25 bp, Mus musculus
attattggagccccagaacgaggaa

SEQ ID NO: 214240 - DNA, 25 bp, Mus musculus
attattggaggtgctctgcccgtgt

SEQ ID NO: 214241 - DNA, 25 bp, Mus musculus
attattggcaggattgaaagctact

SEQ ID NO: 214242 - DNA, 25 bp, Mus musculus
attattggcagggcagaggagacca

SEQ ID NO: 214243 - DNA, 25 bp, Mus musculus
attattgtgctgctgatgaagagac

SEQ ID NO: 214244 - DNA, 25 bp, Mus musculus
attattgttaaaggaaattcgatag

SEQ ID NO: 214245 - DNA, 25 bp, Mus musculus
attatttcaaaatggagctgaagtt

SEQ ID NO: 214246 - DNA, 25 bp, Mus musculus
attatttcagagtgccagaaggctc

SEQ ID NO: 214247 - DNA, 25 bp, Mus musculus
attatttcaggtggatctaaagacc

SEQ ID NO: 214248 - DNA, 25 bp, Mus musculus
attatttccaactatgaaaagaaag

SEQ ID NO: 214249 - DNA, 25 bp, Mus musculus
attatttcggcaggaattagctctg

SEQ ID NO: 214250 - DNA, 25 bp, Mus musculus
attatttcggcaggcaatacggaat

SEQ ID NO: 214251 - DNA, 25 bp, Mus musculus
attattttatggatattcattagct

SEQ ID NO: 214252 - DNA, 25 bp, Mus musculus
attattttcaataatggacgctgta

SEQ ID NO: 214253 - DNA, 25 bp, Mus musculus
attattttcagagaagcagaagata

SEQ ID NO: 214254 - DNA, 25 bp, Mus musculus
attatttttaagaggcaagaaacaa

SEQ ID NO: 214255 - DNA, 25 bp, Mus musculus
attatttttttggccatattcccaa

SEQ ID NO: 214256 - DNA, 25 bp, Mus musculus
attcaaaaaaactggaagccaagta

SEQ ID NO: 214257 - DNA, 25 bp, Mus musculus
attcaaaaaaactggaagtcagcag

SEQ ID NO: 214258 - DNA, 25 bp, Mus musculus
attcaaaaacaacagaatcaagaca

SEQ ID NO: 214259 - DNA, 25 bp, Mus musculus
attcaaaaacaacaggctcctcaac

SEQ ID NO: 214260 - DNA, 25 bp, Mus musculus
attcaaaaaggtatctggaggagca

SEQ ID NO: 214261 - DNA, 25 bp, Mus musculus
attcaaaaagtatgtttcattatgt

SEQ ID NO: 214262 - DNA, 25 bp, Mus musculus
attcaaaaggaggtttccccagaag

SEQ ID NO: 214263 - DNA, 25 bp, Mus musculus
attcaaaagtatggcttagacttgt

SEQ ID NO: 214264 - DNA, 25 bp, Mus musculus
attcaaacaaggcaagcttctagcc

SEQ ID NO: 214265 - DNA, 25 bp, Mus musculus
attcaaacaagttcaaagaagaaga

SEQ ID NO: 214266 - DNA, 25 bp, Mus musculus
attcaaacctgaacgctggaaagag

SEQ ID NO: 214267 - DNA, 25 bp, Mus musculus
attcaaacctgtggtttgctctctt

SEQ ID NO: 214268 - DNA, 25 bp, Mus musculus
attcaaactaacagaaattgatgat

SEQ ID NO: 214269 - DNA, 25 bp, Mus musculus
attcaaactaacaggtcaaggaaaa

SEQ ID NO: 214270 - DNA, 25 bp, Mus musculus
attcaaagacaagaccggacaatac

SEQ ID NO: 214271 - DNA, 25 bp, Mus musculus
attcaaagacaagacgtggacacgc

SEQ ID NO: 214272 - DNA, 25 bp, Mus musculus
attcaaatctggaatgttccggaga

SEQ ID NO: 214273 - DNA, 25 bp, Mus musculus
attcaaatgaactaactacttgatg

SEQ ID NO: 214274 - DNA, 25 bp, Mus musculus
attcaaatgaactgggaaactagaa

SEQ ID NO: 214275 - DNA, 25 bp, Mus musculus
attcaaatgttgtggcagaatacca

SEQ ID NO: 214276 - DNA, 25 bp, Mus musculus
attcaaatgttgtgtcctctgttgt

SEQ ID NO: 214277 - DNA, 25 bp, Mus musculus
attcaaatttcatggctacctctgt

SEQ ID NO: 214278 - DNA, 25 bp, Mus musculus
attcaaattttgctacaaaaggcat

SEQ ID NO: 214279 - DNA, 25 bp, Mus musculus
attcaaattttggcacgcagctaca

SEQ ID NO: 214280 - DNA, 25 bp, Mus musculus
attcaacaagaatttggatgtatcc

SEQ ID NO: 214281 - DNA, 25 bp, Mus musculus
attcaacaaggtgtcggtgctgact

SEQ ID NO: 214282 - DNA, 25 bp, Mus musculus
attcaacaatggcaagattgagctc

SEQ ID NO: 214283 - DNA, 25 bp, Mus musculus
attcaacaatggcaatcatgaggca

SEQ ID NO: 214284 - DNA, 25 bp, Mus musculus
attcaacagacaagtcaagagcaat

SEQ ID NO: 214285 - DNA, 25 bp, Mus musculus
attcaacagagctgccttccgtctc

SEQ ID NO: 214286 - DNA, 25 bp, Mus musculus
attcaaccacaatgacggattccac

SEQ ID NO: 214287 - DNA, 25 bp, Mus musculus
attcaacgggggattcatcagttgg

SEQ ID NO: 214288 - DNA, 25 bp, Mus musculus
attcaagaagacaccctgatatctg

SEQ ID NO: 214289 - DNA, 25 bp, Mus musculus
attcaagaagtcctgagtttatcca

SEQ ID NO: 214290 - DNA, 25 bp, Mus musculus
attcaagaagtcctggtctttgcct

SEQ ID NO: 214291 - DNA, 25 bp, Mus musculus
attcaagaagtcctgtggaagtgtt

SEQ ID NO: 214292 - DNA, 25 bp, Mus musculus
attcaagacagtgaggggaaacagg

SEQ ID NO: 214293 - DNA, 25 bp, Mus musculus
attcaagagaaaagaaccaagaaag

SEQ ID NO: 214294 - DNA, 25 bp, Mus musculus
attcaagagtatggggaaaaagagg

SEQ ID NO: 214295 - DNA, 25 bp, Mus musculus
attcaagagtattcggggaaacctc

SEQ ID NO: 214296 - DNA, 25 bp, Mus musculus
attcaagcaaccatttaagaagacc

SEQ ID NO: 214297 - DNA, 25 bp, Mus musculus
attcaagcagaacagccttccagaa

SEQ ID NO: 214298 - DNA, 25 bp, Mus musculus
attcaagcagaacagggcggcagat

SEQ ID NO: 214299 - DNA, 25 bp, Mus musculus
attcaagcagaacaggtttgccaga

SEQ ID NO: 214300 - DNA, 25 bp, Mus musculus
attcaagcagagggttcgcaaagaa

SEQ ID NO: 214301 - DNA, 25 bp, Mus musculus
attcaagcagatttacaagggccct

SEQ ID NO: 214302 - DNA, 25 bp, Mus musculus
attcaagctatgatgaccagacctg

SEQ ID NO: 214303 - DNA, 25 bp, Mus musculus
attcaaggaaaacaggacccatcct

SEQ ID NO: 214304 - DNA, 25 bp, Mus musculus
attcaaggaaaacagtctataaagc

SEQ ID NO: 214305 - DNA, 25 bp, Mus musculus
attcaaggaatgtatgtgcatgaaa

SEQ ID NO: 214306 - DNA, 25 bp, Mus musculus
attcaaggagctgcaacaacatttt

SEQ ID NO: 214307 - DNA, 25 bp, Mus musculus
attcaaggaggcttggcaaattgtg

SEQ ID NO: 214308 - DNA, 25 bp, Mus musculus
attcaaggccagcagattgtgatat

SEQ ID NO: 214309 - DNA, 25 bp, Mus musculus
attcaaggccagcaggtctcataac

SEQ ID NO: 214310 - DNA, 25 bp, Mus musculus
attcaagtcctgagatgagccgcca

SEQ ID NO: 214311 - DNA, 25 bp, Mus musculus
attcaagtcctgctctacagaggga

SEQ ID NO: 214312 - DNA, 25 bp, Mus musculus
attcaagtcctggtgtggaggctga

SEQ ID NO: 214313 - DNA, 25 bp, Mus musculus
attcaagtgttggactggaacttcc

SEQ ID NO: 214314 - DNA, 25 bp, Mus musculus
attcaagtgttggcagcagtggtgg

SEQ ID NO: 214315 - DNA, 25 bp, Mus musculus
attcaagttagttgatctgcctgcc

SEQ ID NO: 214316 - DNA, 25 bp, Mus musculus
attcaagtttttataatgtaaagct

SEQ ID NO: 214317 - DNA, 25 bp, Mus musculus
attcaagttttttgatttgtctata

SEQ ID NO: 214318 - DNA, 25 bp, Mus musculus
attcaataaatggatggaaaccctt

SEQ ID NO: 214319 - DNA, 25 bp, Mus musculus
attcaatagaggatatccatgcatt

SEQ ID NO: 214320 - DNA, 25 bp, Mus musculus
attcaatcacgcagtcatgtttact

SEQ ID NO: 214321 - DNA, 25 bp, Mus musculus
attcaatcacgcagtggatcgtaga

SEQ ID NO: 214322 - DNA, 25 bp, Mus musculus
attcaatgaagagcggctgattgac

SEQ ID NO: 214323 - DNA, 25 bp, Mus musculus
attcaatgaagagggcatctcctcc

SEQ ID NO: 214324 - DNA, 25 bp, Mus musculus
attcaattttgaaatgtgctgctct

SEQ ID NO: 214325 - DNA, 25 bp, Mus musculus
attcacaaaagggaaggatctgtcc

SEQ ID NO: 214326 - DNA, 25 bp, Mus musculus
attcacaagttgagatgaagcccga

SEQ ID NO: 214327 - DNA, 25 bp, Mus musculus
attcacacagaagtgctgtcgactg

SEQ ID NO: 214328 - DNA, 25 bp, Mus musculus
attcacacagattctggaacaagaa

SEQ ID NO: 214329 - DNA, 25 bp, Mus musculus
attcacacaggccgatacaaagcag

SEQ ID NO: 214330 - DNA, 25 bp, Mus musculus
attcacaccgaaactatgttccaac

SEQ ID NO: 214331 - DNA, 25 bp, Mus musculus
attcacacgggaagagtcaccgaag

SEQ ID NO: 214332 - DNA, 25 bp, Mus musculus
attcacacgggatgaaattgttgat

SEQ ID NO: 214333 - DNA, 25 bp, Mus musculus
attcacagaagaacactcaaggctg

SEQ ID NO: 214334 - DNA, 25 bp, Mus musculus
attcacagaagggttgactacagtc

SEQ ID NO: 214335 - DNA, 25 bp, Mus musculus
attcacagctgccgggcccttcgac

SEQ ID NO: 214336 - DNA, 25 bp, Mus musculus
attcacatcgagaaagcctttgagt

SEQ ID NO: 214337 - DNA, 25 bp, Mus musculus
attcacatcgagctggagtacctca

SEQ ID NO: 214338 - DNA, 25 bp, Mus musculus
attcacatgagctgtttcagaaaga

SEQ ID NO: 214339 - DNA, 25 bp, Mus musculus
attcacattcagctatcacgtatgg

SEQ ID NO: 214340 - DNA, 25 bp, Mus musculus
attcacattcaggcacaccaagatg

SEQ ID NO: 214341 - DNA, 25 bp, Mus musculus
attcacattcaggtatcacgtatgg

SEQ ID NO: 214342 - DNA, 25 bp, Mus musculus
attcaccagtgcacggtgatatttt

SEQ ID NO: 214343 - DNA, 25 bp, Mus musculus
attcaccctcagaggagctggacta

SEQ ID NO: 214344 - DNA, 25 bp, Mus musculus
attcaccgatcagaaacctgatatc

SEQ ID NO: 214345 - DNA, 25 bp, Mus musculus
attcaccgatcaggacaacatccac

SEQ ID NO: 214346 - DNA, 25 bp, Mus musculus
attcaccgtatggctccatggtgta

SEQ ID NO: 214347 - DNA, 25 bp, Mus musculus
attcacctacgattaccacaccctg

SEQ ID NO: 214348 - DNA, 25 bp, Mus musculus
attcacctacggcaagagatgtcga

SEQ ID NO: 214349 - DNA, 25 bp, Mus musculus
attcacgacagtgttgaaggctccg

SEQ ID NO: 214350 - DNA, 25 bp, Mus musculus
attcacgacgggatgtttcggaagg

SEQ ID NO: 214351 - DNA, 25 bp, Mus musculus
attcacgcgccgcggccttagaaga

SEQ ID NO: 214352 - DNA, 25 bp, Mus musculus
attcacgcgccgcggctccatgttc

SEQ ID NO: 214353 - DNA, 25 bp, Mus musculus
attcacgtagggtgatatgggacct

SEQ ID NO: 214354 - DNA, 25 bp, Mus musculus
attcactattctgaggttggtgtca

SEQ ID NO: 214355 - DNA, 25 bp, Mus musculus
attcactgaaaggtcgttgctccag

SEQ ID NO: 214356 - DNA, 25 bp, Mus musculus
attcactgcaacaaggtgtcagctg

SEQ ID NO: 214357 - DNA, 25 bp, Mus musculus
attcactgcagctgctattggagcg

SEQ ID NO: 214358 - DNA, 25 bp, Mus musculus
attcactgcaggtccgagagaagcc

SEQ ID NO: 214359 - DNA, 25 bp, Mus musculus
attcactgcagtgcccaggtccgag

SEQ ID NO: 214360 - DNA, 25 bp, Mus musculus
attcactggaaagacatgcagctgt

SEQ ID NO: 214361 - DNA, 25 bp, Mus musculus
attcactggacatgggtgaagaagg

SEQ ID NO: 214362 - DNA, 25 bp, Mus musculus
attcactggtcaagattcatgaaaa

SEQ ID NO: 214363 - DNA, 25 bp, Mus musculus
attcactgtccagcttgccagtgca

SEQ ID NO: 214364 - DNA, 25 bp, Mus musculus
attcactgttcagcccacagtgaga

SEQ ID NO: 214365 - DNA, 25 bp, Mus musculus
attcactgttcaggcatccgaaggt

SEQ ID NO: 214366 - DNA, 25 bp, Mus musculus
attcacttagacagacttacaacag

SEQ ID NO: 214367 - DNA, 25 bp, Mus musculus
attcacttccaacgtgaaactcatc

SEQ ID NO: 214368 - DNA, 25 bp, Mus musculus
attcagaaacaggtggtgatgaagc

SEQ ID NO: 214369 - DNA, 25 bp, Mus musculus
attcagaaacagtggaagcatcagt

SEQ ID NO: 214370 - DNA, 25 bp, Mus musculus
attcagaaactgtacggacatggct

SEQ ID NO: 214371 - DNA, 25 bp, Mus musculus
attcagaaagagagtcctgttgaag

SEQ ID NO: 214372 - DNA, 25 bp, Mus musculus
attcagaaagattccaggttgactt

SEQ ID NO: 214373 - DNA, 25 bp, Mus musculus
attcagaaaggagttcgtgaagtga

SEQ ID NO: 214374 - DNA, 25 bp, Mus musculus
attcagaagaaatacgatgacagcg

SEQ ID NO: 214375 - DNA, 25 bp, Mus musculus
attcagaagaaatacggcttcttgg

SEQ ID NO: 214376 - DNA, 25 bp, Mus musculus
attcagaagatgcaaccctgagacc

SEQ ID NO: 214377 - DNA, 25 bp, Mus musculus
attcagaaggacattaacgagctga

SEQ ID NO: 214378 - DNA, 25 bp, Mus musculus
attcagaatgtctctcatgttacca

SEQ ID NO: 214379 - DNA, 25 bp, Mus musculus
attcagaatgttgttcagatgtcac

SEQ ID NO: 214380 - DNA, 25 bp, Mus musculus
attcagacaagattttcgaaaatac

SEQ ID NO: 214381 - DNA, 25 bp, Mus musculus
attcagacacaatggcctgtgagta

SEQ ID NO: 214382 - DNA, 25 bp, Mus musculus
attcagacccgattagtggagtacc

SEQ ID NO: 214383 - DNA, 25 bp, Mus musculus
attcagagcaggagcctttgaccag

SEQ ID NO: 214384 - DNA, 25 bp, Mus musculus
attcagagccaggttgtaaaagtta

SEQ ID NO: 214385 - DNA, 25 bp, Mus musculus
attcagagtttgaactctcttgctc

SEQ ID NO: 214386 - DNA, 25 bp, Mus musculus
attcagagtttgaatctgtcggggc

SEQ ID NO: 214387 - DNA, 25 bp, Mus musculus
attcagatgtaccctcctgaaaaga

SEQ ID NO: 214388 - DNA, 25 bp, Mus musculus
attcagcaacagcatccgccaccac

SEQ ID NO: 214389 - DNA, 25 bp, Mus musculus
attcagcactcggtaattcagagat

SEQ ID NO: 214390 - DNA, 25 bp, Mus musculus
attcagcagcaggtccaggggcagc

SEQ ID NO: 214391 - DNA, 25 bp, Mus musculus
attcagcaggaagcgtcccaggttc

SEQ ID NO: 214392 - DNA, 25 bp, Mus musculus
attcagcaggaagtaaaatctcttt

SEQ ID NO: 214393 - DNA, 25 bp, Mus musculus
attcagccagatgaactttcaagtt

SEQ ID NO: 214394 - DNA, 25 bp, Mus musculus
attcagctcaaggctgtcaagtcct

SEQ ID NO: 214395 - DNA, 25 bp, Mus musculus
attcagctcccaggttgaagaaatg

SEQ ID NO: 214396 - DNA, 25 bp, Mus musculus
attcagctctggtgattgttcagtc

SEQ ID NO: 214397 - DNA, 25 bp, Mus musculus
attcagctgcagagtgctgatccca

SEQ ID NO: 214398 - DNA, 25 bp, Mus musculus
attcaggaacttcagtttgaaaatg

SEQ ID NO: 214399 - DNA, 25 bp, Mus musculus
attcaggaagtgaagggggaggtga

SEQ ID NO: 214400 - DNA, 25 bp, Mus musculus
attcaggaagtgaagtgttgaagaa

SEQ ID NO: 214401 - DNA, 25 bp, Mus musculus
attcaggaatggagactttggagac

SEQ ID NO: 214402 - DNA, 25 bp, Mus musculus
attcaggagaaggatagagatggtt

SEQ ID NO: 214403 - DNA, 25 bp, Mus musculus
attcaggagctgctactcaggtgca

SEQ ID NO: 214404 - DNA, 25 bp, Mus musculus
attcaggataggggaatggtctagc

SEQ ID NO: 214405 - DNA, 25 bp, Mus musculus
attcaggccaacaaggtacgcacgc

SEQ ID NO: 214406 - DNA, 25 bp, Mus musculus
attcaggctcggtcttttccgggct

SEQ ID NO: 214407 - DNA, 25 bp, Mus musculus
attcaggctgctcatcctaaattga

SEQ ID NO: 214408 - DNA, 25 bp, Mus musculus
attcaggctggaaaggagctggagg

SEQ ID NO: 214409 - DNA, 25 bp, Mus musculus
attcaggctggtcatcctaaattga

SEQ ID NO: 214410 - DNA, 25 bp, Mus musculus
attcaggcttccagttcacgtggag

SEQ ID NO: 214411 - DNA, 25 bp, Mus musculus
attcaggggggaggatgacttgtgt

SEQ ID NO: 214412 - DNA, 25 bp, Mus musculus
attcagtaatgcaacgtttcagtct

SEQ ID NO: 214413 - DNA, 25 bp, Mus musculus
attcagtacaggaaggctgtgaagg

SEQ ID NO: 214414 - DNA, 25 bp, Mus musculus
attcagtacagggcttcttcgtgtc

SEQ ID NO: 214415 - DNA, 25 bp, Mus musculus
attcagtgaaggatttgaacttttt

SEQ ID NO: 214416 - DNA, 25 bp, Mus musculus
attcagtgaggccttggaaactggg

SEQ ID NO: 214417 - DNA, 25 bp, Mus musculus
attcagtgaggtcaaaggactggat

SEQ ID NO: 214418 - DNA, 25 bp, Mus musculus
attcagtgcttttaatcagcttaag

SEQ ID NO: 214419 - DNA, 25 bp, Mus musculus
attcagtggggctccacctgttccc

SEQ ID NO: 214420 - DNA, 25 bp, Mus musculus
attcagtgggggagtttgtgacatt

SEQ ID NO: 214421 - DNA, 25 bp, Mus musculus
attcagtgggggatttccaatttcg

SEQ ID NO: 214422 - DNA, 25 bp, Mus musculus
attcagttggccaaggtgtttccca

SEQ ID NO: 214423 - DNA, 25 bp, Mus musculus
attcataaagattgaggaagacaca

SEQ ID NO: 214424 - DNA, 25 bp, Mus musculus
attcataaaggtcagaaggctatga

SEQ ID NO: 214425 - DNA, 25 bp, Mus musculus
attcataaaggtctagagggcttta

SEQ ID NO: 214426 - DNA, 25 bp, Mus musculus
attcatacagattcatctgaaaact

SEQ ID NO: 214427 - DNA, 25 bp, Mus musculus
attcatacaggtcccatggcctcta

SEQ ID NO: 214428 - DNA, 25 bp, Mus musculus
attcataggagaagtatgagctggt

SEQ ID NO: 214429 - DNA, 25 bp, Mus musculus
attcatagtagttctcttcccatac

SEQ ID NO: 214430 - DNA, 25 bp, Mus musculus
attcatcacagagccggctgatctt

SEQ ID NO: 214431 - DNA, 25 bp, Mus musculus
attcatcagaacaggagtaagcatg

SEQ ID NO: 214432 - DNA, 25 bp, Mus musculus
attcatcagcaagagcttatttcct

SEQ ID NO: 214433 - DNA, 25 bp, Mus musculus
attcatccaaagatgactggtttac

SEQ ID NO: 214434 - DNA, 25 bp, Mus musculus
attcatccaggtcaagtggagaagt

SEQ ID NO: 214435 - DNA, 25 bp, Mus musculus
attcatccaggttcttaaattccta

SEQ ID NO: 214436 - DNA, 25 bp, Mus musculus
attcatccatggaccggcacgatgg

SEQ ID NO: 214437 - DNA, 25 bp, Mus musculus
attcatcccagaaggaagaattctg

SEQ ID NO: 214438 - DNA, 25 bp, Mus musculus
attcatctagaggttttacagacag

SEQ ID NO: 214439 - DNA, 25 bp, Mus musculus
attcatctagagtacaaaacaggag

SEQ ID NO: 214440 - DNA, 25 bp, Mus musculus
attcatctctggtcttgacgaagtg

SEQ ID NO: 214441 - DNA, 25 bp, Mus musculus
attcatcttaggtcgggatggtggc

SEQ ID NO: 214442 - DNA, 25 bp, Mus musculus
attcatcttatcaggagcacggcat

SEQ ID NO: 214443 - DNA, 25 bp, Mus musculus
attcatgaaagctccttgtgaacca

SEQ ID NO: 214444 - DNA, 25 bp, Mus musculus
attcatgaaaggaagaacaattgtg

SEQ ID NO: 214445 - DNA, 25 bp, Mus musculus
attcatgaaagtcctgaagtgtgag

SEQ ID NO: 214446 - DNA, 25 bp, Mus musculus
attcatgaacgagtttttcttaaat

SEQ ID NO: 214447 - DNA, 25 bp, Mus musculus
attcatgaagaaggctggataccag

SEQ ID NO: 214448 - DNA, 25 bp, Mus musculus
attcatgactcaggcccacaatgtg

SEQ ID NO: 214449 - DNA, 25 bp, Mus musculus
attcatgagtccagacttcttgtga

SEQ ID NO: 214450 - DNA, 25 bp, Mus musculus
attcatgagtccaggctagatatgg

SEQ ID NO: 214451 - DNA, 25 bp, Mus musculus
attcatgatgaccaggattacttac

SEQ ID NO: 214452 - DNA, 25 bp, Mus musculus
attcatgatttccagagagaagacc

SEQ ID NO: 214453 - DNA, 25 bp, Mus musculus
attcatgatttccagcctcatgtca

SEQ ID NO: 214454 - DNA, 25 bp, Mus musculus
attcatgcagatgaatgagaacagc

SEQ ID NO: 214455 - DNA, 25 bp, Mus musculus
attcatgcagcactatgccttcctc

SEQ ID NO: 214456 - DNA, 25 bp, Mus musculus
attcatgcaggtccacgcctcaaag

SEQ ID NO: 214457 - DNA, 25 bp, Mus musculus
attcatgccaggactactgttgaag

SEQ ID NO: 214458 - DNA, 25 bp, Mus musculus
attcatgcccagggtgttccatgag

SEQ ID NO: 214459 - DNA, 25 bp, Mus musculus
attcatgcggaaagacgtgcgagac

SEQ ID NO: 214460 - DNA, 25 bp, Mus musculus
attcatgcggatgcgttttgactta

SEQ ID NO: 214461 - DNA, 25 bp, Mus musculus
attcatggactagcgagccataaaa

SEQ ID NO: 214462 - DNA, 25 bp, Mus musculus
attcatggtactgctgtattttcat

SEQ ID NO: 214463 - DNA, 25 bp, Mus musculus
attcatggtgaaggacacatcttac

SEQ ID NO: 214464 - DNA, 25 bp, Mus musculus
attcatgtagccgcctcaaacatgt

SEQ ID NO: 214465 - DNA, 25 bp, Mus musculus
attcatgtccaaagggctcccagag

SEQ ID NO: 214466 - DNA, 25 bp, Mus musculus
attcattacgtaatgaagtacttaa

SEQ ID NO: 214467 - DNA, 25 bp, Mus musculus
attcattcattcccactatgggcct

SEQ ID NO: 214468 - DNA, 25 bp, Mus musculus
attcattctcatcgccgagctgaat

SEQ ID NO: 214469 - DNA, 25 bp, Mus musculus
attcattgctaacaggatgcccatc

SEQ ID NO: 214470 - DNA, 25 bp, Mus musculus
attcattgctaacaggggatcatga

SEQ ID NO: 214471 - DNA, 25 bp, Mus musculus
attcattgtggaggtcaacgtcctg

SEQ ID NO: 214472 - DNA, 25 bp, Mus musculus
attcatttagaaactccccaacttt

SEQ ID NO: 214473 - DNA, 25 bp, Mus musculus
attcatttagtatccgctccattca

SEQ ID NO: 214474 - DNA, 25 bp, Mus musculus
attcatttcagttgcctctctgcat

SEQ ID NO: 214475 - DNA, 25 bp, Mus musculus
attccaaaacactgtaacatggcac

SEQ ID NO: 214476 - DNA, 25 bp, Mus musculus
attccaaaatgccattctagttcgc

SEQ ID NO: 214477 - DNA, 25 bp, Mus musculus
attccaaacacagccagccaatgcc

SEQ ID NO: 214478 - DNA, 25 bp, Mus musculus
attccaaacacagcccacctgcatc

SEQ ID NO: 214479 - DNA, 25 bp, Mus musculus
attccaaacacagccccagccagcc

SEQ ID NO: 214480 - DNA, 25 bp, Mus musculus
attccaaagatactggcattgcccg

SEQ ID NO: 214481 - DNA, 25 bp, Mus musculus
attccaacctacaagggcaagatga

SEQ ID NO: 214482 - DNA, 25 bp, Mus musculus
attccaactaaaaataggaaatcta

SEQ ID NO: 214483 - DNA, 25 bp, Mus musculus
attccaactaagagttggccatgga

SEQ ID NO: 214484 - DNA, 25 bp, Mus musculus
attccaagcaattttcaacatggat

SEQ ID NO: 214485 - DNA, 25 bp, Mus musculus
attccaagcctgaggactgggacaa

SEQ ID NO: 214486 - DNA, 25 bp, Mus musculus
attccaagcctgaggactgggatga

SEQ ID NO: 214487 - DNA, 25 bp, Mus musculus
attccaagctaccacagtgaactgc

SEQ ID NO: 214488 - DNA, 25 bp, Mus musculus
attccaagctcctactactcagggc

SEQ ID NO: 214489 - DNA, 25 bp, Mus musculus
attccaaggagattgccctctatga

SEQ ID NO: 214490 - DNA, 25 bp, Mus musculus
attccaaggagccagaaatcatagt

SEQ ID NO: 214491 - DNA, 25 bp, Mus musculus
attccaatgtggaaaagaagaccag

SEQ ID NO: 214492 - DNA, 25 bp, Mus musculus
attccacagccagatttgaccaagc

SEQ ID NO: 214493 - DNA, 25 bp, Mus musculus
attccacatttggagcccttacaga

SEQ ID NO: 214494 - DNA, 25 bp, Mus musculus
attccaccaccaggtattccaataa

SEQ ID NO: 214495 - DNA, 25 bp, Mus musculus
attccaccagcaggttcagcagctc

SEQ ID NO: 214496 - DNA, 25 bp, Mus musculus
attccaccagcagtatgagccccgg

SEQ ID NO: 214497 - DNA, 25 bp, Mus musculus
attccaccccagactctgcagagga

SEQ ID NO: 214498 - DNA, 25 bp, Mus musculus
attccaccccggccccagctggagc

SEQ ID NO: 214499 - DNA, 25 bp, Mus musculus
attccacctccttaaaaatataact

SEQ ID NO: 214500 - DNA, 25 bp, Mus musculus
attccacgtgcgtgcttcttgccac

SEQ ID NO: 214501 - DNA, 25 bp, Mus musculus
attccactagggctattctcctgag

SEQ ID NO: 214502 - DNA, 25 bp, Mus musculus
attccacttgactgggacgtggaac

SEQ ID NO: 214503 - DNA, 25 bp, Mus musculus
attccagaaagatggaaccgccctg

SEQ ID NO: 214504 - DNA, 25 bp, Mus musculus
attccagaaagtatgcagccctgct

SEQ ID NO: 214505 - DNA, 25 bp, Mus musculus
attccagaaagtatgcagccctttg

SEQ ID NO: 214506 - DNA, 25 bp, Mus musculus
attccagaaagtgtctatcgcagcg

SEQ ID NO: 214507 - DNA, 25 bp, Mus musculus
attccagaacaagattcttttcgtc

SEQ ID NO: 214508 - DNA, 25 bp, Mus musculus
attccagaacaagtttccatagaac

SEQ ID NO: 214509 - DNA, 25 bp, Mus musculus
attccagaacttgccatcaatgcct

SEQ ID NO: 214510 - DNA, 25 bp, Mus musculus
attccagaaggagaaaaaaaagcaa

SEQ ID NO: 214511 - DNA, 25 bp, Mus musculus
attccagacacaagtacccaccatt

SEQ ID NO: 214512 - DNA, 25 bp, Mus musculus
attccagacagcttttcaagatctc

SEQ ID NO: 214513 - DNA, 25 bp, Mus musculus
attccagagaatcttataggattta

SEQ ID NO: 214514 - DNA, 25 bp, Mus musculus
attccagagatgaagaccacatagc

SEQ ID NO: 214515 - DNA, 25 bp, Mus musculus
attccagagatgagatcacatagca

SEQ ID NO: 214516 - DNA, 25 bp, Mus musculus
attccagcagaccgacttgtctcag

SEQ ID NO: 214517 - DNA, 25 bp, Mus musculus
attccagcagtcaggctgggacaac

SEQ ID NO: 214518 - DNA, 25 bp, Mus musculus
attccagccagaccagcggagtcgg

SEQ ID NO: 214519 - DNA, 25 bp, Mus musculus
attccagctgatggagacctgacat

SEQ ID NO: 214520 - DNA, 25 bp, Mus musculus
attccagctgggtgagtctgtaaag

SEQ ID NO: 214521 - DNA, 25 bp, Mus musculus
attccaggaaacagaaagctggtcc

SEQ ID NO: 214522 - DNA, 25 bp, Mus musculus
attccaggaaacaggaaggagtctt

SEQ ID NO: 214523 - DNA, 25 bp, Mus musculus
attccaggagaatgccaggaggtca

SEQ ID NO: 214524 - DNA, 25 bp, Mus musculus
attccagggagattccagacttctg

SEQ ID NO: 214525 - DNA, 25 bp, Mus musculus
attccagggagggtcccacctcctg

SEQ ID NO: 214526 - DNA, 25 bp, Mus musculus
attccaggtcagtgcttcgcaagat

SEQ ID NO: 214527 - DNA, 25 bp, Mus musculus
attccaggtgcagctggtgatcaag

SEQ ID NO: 214528 - DNA, 25 bp, Mus musculus
attccagtgaggagaaggacctcac

SEQ ID NO: 214529 - DNA, 25 bp, Mus musculus
attccataagatcatctttagatgg

SEQ ID NO: 214530 - DNA, 25 bp, Mus musculus
attccatagggatccaagcctattg

SEQ ID NO: 214531 - DNA, 25 bp, Mus musculus
attccatagggcatgccttcaggct

SEQ ID NO: 214532 - DNA, 25 bp, Mus musculus
attccatattattataaatgaggag

SEQ ID NO: 214533 - DNA, 25 bp, Mus musculus
attccatcggcttggtttggttcca

SEQ ID NO: 214534 - DNA, 25 bp, Mus musculus
attccatctgctcccagaattacct

SEQ ID NO: 214535 - DNA, 25 bp, Mus musculus
attccatgccgggttgcttcctaga

SEQ ID NO: 214536 - DNA, 25 bp, Mus musculus
attccatgtcatcatatgatttttg

SEQ ID NO: 214537 - DNA, 25 bp, Mus musculus
attccatgtcatcattatcacttat

SEQ ID NO: 214538 - DNA, 25 bp, Mus musculus
attccattagtaaccgtgtggaagc

SEQ ID NO: 214539 - DNA, 25 bp, Mus musculus
attccattctttgtggtcgctacac

SEQ ID NO: 214540 - DNA, 25 bp, Mus musculus
attccattcttttgttggggatgga

SEQ ID NO: 214541 - DNA, 25 bp, Mus musculus
attccatttaacgttctgatgaaca

SEQ ID NO: 214542 - DNA, 25 bp, Mus musculus
attccatttaattgtaaatgaagag

SEQ ID NO: 214543 - DNA, 25 bp, Mus musculus
attccatttcactccgcagatgacc

SEQ ID NO: 214544 - DNA, 25 bp, Mus musculus
attccatttccactctgcttccctg

SEQ ID NO: 214545 - DNA, 25 bp, Mus musculus
attcccaaatggatgacaagtggga

SEQ ID NO: 214546 - DNA, 25 bp, Mus musculus
attcccaaatggattttctctatat

SEQ ID NO: 214547 - DNA, 25 bp, Mus musculus
attcccaagagaaggatgggtagaa

SEQ ID NO: 214548 - DNA, 25 bp, Mus musculus
attcccaagggcacaagtgtaatgg

SEQ ID NO: 214549 - DNA, 25 bp, Mus musculus
attcccaataaaagataattggtta

SEQ ID NO: 214550 - DNA, 25 bp, Mus musculus
attcccaataaaaggctcccgtcca

SEQ ID NO: 214551 - DNA, 25 bp, Mus musculus
attcccaatgagttgccatataatg

SEQ ID NO: 214552 - DNA, 25 bp, Mus musculus
attcccaccaacaaggcctgtttcg

SEQ ID NO: 214553 - DNA, 25 bp, Mus musculus
attcccagcacgccgctttttagaa

SEQ ID NO: 214554 - DNA, 25 bp, Mus musculus
attcccagcctaggcgaaacctgac

SEQ ID NO: 214555 - DNA, 25 bp, Mus musculus
attcccataagtctgcgagtaaact

SEQ ID NO: 214556 - DNA, 25 bp, Mus musculus
attccccaaagtaatggactcatgg

SEQ ID NO: 214557 - DNA, 25 bp, Mus musculus
attccccaatggtccatttactcga

SEQ ID NO: 214558 - DNA, 25 bp, Mus musculus
attccccagagataagctgacgctg

SEQ ID NO: 214559 - DNA, 25 bp, Mus musculus
attccccaggctctgcagacctcgg

SEQ ID NO: 214560 - DNA, 25 bp, Mus musculus
attcccccccagctacccgtacagt

SEQ ID NO: 214561 - DNA, 25 bp, Mus musculus
attccccgctggaagtttgtgtgag

SEQ ID NO: 214562 - DNA, 25 bp, Mus musculus
attccccgctgtcctacagtctgct

SEQ ID NO: 214563 - DNA, 25 bp, Mus musculus
attccccggaagacgaagagccgga

SEQ ID NO: 214564 - DNA, 25 bp, Mus musculus
attccccggaagcactctgacacca

SEQ ID NO: 214565 - DNA, 25 bp, Mus musculus
attccccggataacgagcgaccgcc

SEQ ID NO: 214566 - DNA, 25 bp, Mus musculus
attccccggataacgtggaccatgt

SEQ ID NO: 214567 - DNA, 25 bp, Mus musculus
attccccgtgcccagtcgagaagcc

SEQ ID NO: 214568 - DNA, 25 bp, Mus musculus
attcccctagcacagcagagtcaat

SEQ ID NO: 214569 - DNA, 25 bp, Mus musculus
attcccctgagatctaaacctactg

SEQ ID NO: 214570 - DNA, 25 bp, Mus musculus
attccctacagaactcttgagccct

SEQ ID NO: 214571 - DNA, 25 bp, Mus musculus
attccctacagcctgcccactgaac

SEQ ID NO: 214572 - DNA, 25 bp, Mus musculus
attccctctgacaaaaggcttgatg

SEQ ID NO: 214573 - DNA, 25 bp, Mus musculus
attccctggacaagctgtggccagc

SEQ ID NO: 214574 - DNA, 25 bp, Mus musculus
attcccttaggaacctcctctggga

SEQ ID NO: 214575 - DNA, 25 bp, Mus musculus
attccctttaaggcatcaatacttg

SEQ ID NO: 214576 - DNA, 25 bp, Mus musculus
attccgaagatggaggagctggagt

SEQ ID NO: 214577 - DNA, 25 bp, Mus musculus
attccgaaggagcaggttgatatgt

SEQ ID NO: 214578 - DNA, 25 bp, Mus musculus
attccgaggccttcagaatctgagg

SEQ ID NO: 214579 - DNA, 25 bp, Mus musculus
attccgaggccttcaggtggttgag

SEQ ID NO: 214580 - DNA, 25 bp, Mus musculus
attccgagttcaaggtcgcttctcc

SEQ ID NO: 214581 - DNA, 25 bp, Mus musculus
attccgatttgggacgaggacctat

SEQ ID NO: 214582 - DNA, 25 bp, Mus musculus
attccgcggatcacgagtgaccgtc

SEQ ID NO: 214583 - DNA, 25 bp, Mus musculus
attccggagctggactgaacttttg

SEQ ID NO: 214584 - DNA, 25 bp, Mus musculus
attccggccgccaaggttcgcttat

SEQ ID NO: 214585 - DNA, 25 bp, Mus musculus
attccgggatgcctgatcgtaccga

SEQ ID NO: 214586 - DNA, 25 bp, Mus musculus
attccgggctcggaggtccctgacc

SEQ ID NO: 214587 - DNA, 25 bp, Mus musculus
attccgttcaaaggtctcaacatgg

SEQ ID NO: 214588 - DNA, 25 bp, Mus musculus
attcctaaaaaaagactgggctata

SEQ ID NO: 214589 - DNA, 25 bp, Mus musculus
attcctaaaaaaagtgccgtgatgc

SEQ ID NO: 214590 - DNA, 25 bp, Mus musculus
attcctaaaagcagccaacaagaag

SEQ ID NO: 214591 - DNA, 25 bp, Mus musculus
attcctaagaagacccagcactact

SEQ ID NO: 214592 - DNA, 25 bp, Mus musculus
attcctaagaaggccacagacccag

SEQ ID NO: 214593 - DNA, 25 bp, Mus musculus
attcctacccatgttcctgaatgtg

SEQ ID NO: 214594 - DNA, 25 bp, Mus musculus
attcctagacagacaaagtttctct

SEQ ID NO: 214595 - DNA, 25 bp, Mus musculus
attcctagacagtgttcctaggatc

SEQ ID NO: 214596 - DNA, 25 bp, Mus musculus
attcctaggaagaggatgtacatgc

SEQ ID NO: 214597 - DNA, 25 bp, Mus musculus
attcctagggacaagtcactgttct

SEQ ID NO: 214598 - DNA, 25 bp, Mus musculus
attcctaggtggtctcctagccctt

SEQ ID NO: 214599 - DNA, 25 bp, Mus musculus
attcctagtccaattcaggttattg

SEQ ID NO: 214600 - DNA, 25 bp, Mus musculus
attcctatcagcttgcgtgtgaact

SEQ ID NO: 214601 - DNA, 25 bp, Mus musculus
attcctatgaagcccacattcagtg

SEQ ID NO: 214602 - DNA, 25 bp, Mus musculus
attcctatgaaggaagagcagcatg

SEQ ID NO: 214603 - DNA, 25 bp, Mus musculus
attcctatgatcgtcatcttcttcc

SEQ ID NO: 214604 - DNA, 25 bp, Mus musculus
attcctcaaggagtcacctgggagc

SEQ ID NO: 214605 - DNA, 25 bp, Mus musculus
attcctcaaggcacttaggcagaag

SEQ ID NO: 214606 - DNA, 25 bp, Mus musculus
attcctcaagggggaggataagaaa

SEQ ID NO: 214607 - DNA, 25 bp, Mus musculus
attcctcacagacacactggatgcc

SEQ ID NO: 214608 - DNA, 25 bp, Mus musculus
attcctcacaggaaagcaaagattc

SEQ ID NO: 214609 - DNA, 25 bp, Mus musculus
attcctcactccagatgtgtttggg

SEQ ID NO: 214610 - DNA, 25 bp, Mus musculus
attcctcactgacctggcctctggg

SEQ ID NO: 214611 - DNA, 25 bp, Mus musculus
attcctcagaagcaaatggagacca

SEQ ID NO: 214612 - DNA, 25 bp, Mus musculus
attcctcagaagttgtggagtttga

SEQ ID NO: 214613 - DNA, 25 bp, Mus musculus
attcctcagacaggcttccatacac

SEQ ID NO: 214614 - DNA, 25 bp, Mus musculus
attcctcagacagtgaaaacaaaga

SEQ ID NO: 214615 - DNA, 25 bp, Mus musculus
attcctccaaaatactgttcagcca

SEQ ID NO: 214616 - DNA, 25 bp, Mus musculus
attcctccaaagtgtgacttatgag

SEQ ID NO: 214617 - DNA, 25 bp, Mus musculus
attcctccacaaaggtcagaagagg

SEQ ID NO: 214618 - DNA, 25 bp, Mus musculus
attcctccacaagagcctgagtttt

SEQ ID NO: 214619 - DNA, 25 bp, Mus musculus
attcctccactccagatcatgtcat

SEQ ID NO: 214620 - DNA, 25 bp, Mus musculus
attcctccaggaacaacaggcaatg

SEQ ID NO: 214621 - DNA, 25 bp, Mus musculus
attcctccaggagtacatcataaac

SEQ ID NO: 214622 - DNA, 25 bp, Mus musculus
attcctccaggtacatttgattcat

SEQ ID NO: 214623 - DNA, 25 bp, Mus musculus
attcctccaggtcatcgtcacggtc

SEQ ID NO: 214624 - DNA, 25 bp, Mus musculus
attcctccaggtcttgccgtcacta

SEQ ID NO: 214625 - DNA, 25 bp, Mus musculus
attcctccatacgaacagcaaggct

SEQ ID NO: 214626 - DNA, 25 bp, Mus musculus
attcctcccagatgatgggcgtcgg

SEQ ID NO: 214627 - DNA, 25 bp, Mus musculus
attcctcccctggctagagcatgga

SEQ ID NO: 214628 - DNA, 25 bp, Mus musculus
attcctcgcctgtgaactcatcagc

SEQ ID NO: 214629 - DNA, 25 bp, Mus musculus
attcctctacgctgagcggcagcct

SEQ ID NO: 214630 - DNA, 25 bp, Mus musculus
attcctctcagccaaaaagacttgg

SEQ ID NO: 214631 - DNA, 25 bp, Mus musculus
attcctctgaggatgacaaggagta

SEQ ID NO: 214632 - DNA, 25 bp, Mus musculus
attcctctggaaagccccggcagcc

SEQ ID NO: 214633 - DNA, 25 bp, Mus musculus
attcctctggaagggagagacgaca

SEQ ID NO: 214634 - DNA, 25 bp, Mus musculus
attcctcttcgccgccattgctcct

SEQ ID NO: 214635 - DNA, 25 bp, Mus musculus
attcctgaaacagagaagcccgtgc

SEQ ID NO: 214636 - DNA, 25 bp, Mus musculus
attcctgaacacagtaaggtagatt

SEQ ID NO: 214637 - DNA, 25 bp, Mus musculus
attcctgaagaaaggaactgtcgtc

SEQ ID NO: 214638 - DNA, 25 bp, Mus musculus
attcctgaagaaagtggtatcccgc

SEQ ID NO: 214639 - DNA, 25 bp, Mus musculus
attcctgaagcagaaccaccaatgg

SEQ ID NO: 214640 - DNA, 25 bp, Mus musculus
attcctgaaggaggctgtgaaagaa

SEQ ID NO: 214641 - DNA, 25 bp, Mus musculus
attcctgaggaacagcgcatcgcca

SEQ ID NO: 214642 - DNA, 25 bp, Mus musculus
attcctgatctccgcatctcttcgc

SEQ ID NO: 214643 - DNA, 25 bp, Mus musculus
attcctgcacagcgggctgacggct

SEQ ID NO: 214644 - DNA, 25 bp, Mus musculus
attcctgcatcttccttcctaggca

SEQ ID NO: 214645 - DNA, 25 bp, Mus musculus
attcctgccagggtgactctgatgg

SEQ ID NO: 214646 - DNA, 25 bp, Mus musculus
attcctgccagggtgactctggtgg

SEQ ID NO: 214647 - DNA, 25 bp, Mus musculus
attcctgccaggtgactctggtggc

SEQ ID NO: 214648 - DNA, 25 bp, Mus musculus
attcctgcctaaattttaagcggcg

SEQ ID NO: 214649 - DNA, 25 bp, Mus musculus
attcctgctctgaaagcttactgat

SEQ ID NO: 214650 - DNA, 25 bp, Mus musculus
attcctgctgctgaactaacctttg

SEQ ID NO: 214651 - DNA, 25 bp, Mus musculus
attcctggaacagactaaggctgga

SEQ ID NO: 214652 - DNA, 25 bp, Mus musculus
attcctggagggatcatgcctggcc

SEQ ID NO: 214653 - DNA, 25 bp, Mus musculus
attcctgggacctggtcactcctgt

SEQ ID NO: 214654 - DNA, 25 bp, Mus musculus
attcctgggactcagatggaccaca

SEQ ID NO: 214655 - DNA, 25 bp, Mus musculus
attcctgggtacaggcaaccaagaa

SEQ ID NO: 214656 - DNA, 25 bp, Mus musculus
attcctgggtacaggtcggccagtg

SEQ ID NO: 214657 - DNA, 25 bp, Mus musculus
attcctgggtgtggtcaacagctga

SEQ ID NO: 214658 - DNA, 25 bp, Mus musculus
attcctggtataactatggtatcgc

SEQ ID NO: 214659 - DNA, 25 bp, Mus musculus
attcctgtcagccggggcctccccc

SEQ ID NO: 214660 - DNA, 25 bp, Mus musculus
attcctgtcagccggtaacctccgt

SEQ ID NO: 214661 - DNA, 25 bp, Mus musculus
attcctgtgcaatgaccggggtcgc

SEQ ID NO: 214662 - DNA, 25 bp, Mus musculus
attccttaaacaagatccatgcata

SEQ ID NO: 214663 - DNA, 25 bp, Mus musculus
attccttaactcatgcagatgtcaa

SEQ ID NO: 214664 - DNA, 25 bp, Mus musculus
attccttaactgcaacaagtttttc

SEQ ID NO: 214665 - DNA, 25 bp, Mus musculus
attccttacagtgtcctagatgatg

SEQ ID NO: 214666 - DNA, 25 bp, Mus musculus
attccttagagcagaacatctggcc

SEQ ID NO: 214667 - DNA, 25 bp, Mus musculus
attccttatagtctgattcctttct

SEQ ID NO: 214668 - DNA, 25 bp, Mus musculus
attccttcagctacgaaccaaaaac

SEQ ID NO: 214669 - DNA, 25 bp, Mus musculus
attccttcaggtgcacgcctcctct

SEQ ID NO: 214670 - DNA, 25 bp, Mus musculus
attccttcatagaagatcaagatgt

SEQ ID NO: 214671 - DNA, 25 bp, Mus musculus
attccttcatagaaggtacttcaag

SEQ ID NO: 214672 - DNA, 25 bp, Mus musculus
attccttcatagaaggttctcattg

SEQ ID NO: 214673 - DNA, 25 bp, Mus musculus
attccttccaactcaggctgcttct

SEQ ID NO: 214674 - DNA, 25 bp, Mus musculus
attccttgaagaggagcagacagat

SEQ ID NO: 214675 - DNA, 25 bp, Mus musculus
attccttgaagaggttgcccacgga

SEQ ID NO: 214676 - DNA, 25 bp, Mus musculus
attccttggaggactcaaggaaatc

SEQ ID NO: 214677 - DNA, 25 bp, Mus musculus
attccttggaggttcattctgtggt

SEQ ID NO: 214678 - DNA, 25 bp, Mus musculus
attccttggctcatcagcagttatt

SEQ ID NO: 214679 - DNA, 25 bp, Mus musculus
attccttggggtaatgatgtgggcc

SEQ ID NO: 214680 - DNA, 25 bp, Mus musculus
attccttgtccagattatgaagtat

SEQ ID NO: 214681 - DNA, 25 bp, Mus musculus
attccttgtccagtggttttaggtg

SEQ ID NO: 214682 - DNA, 25 bp, Mus musculus
attcctttgcaaagtgcattgaggt

SEQ ID NO: 214683 - DNA, 25 bp, Mus musculus
attcctttggcttccctcatcagcg

SEQ ID NO: 214684 - DNA, 25 bp, Mus musculus
attccttttaaaactatcacttgtg

SEQ ID NO: 214685 - DNA, 25 bp, Mus musculus
attccttttttgaaggagcacatgg

SEQ ID NO: 214686 - DNA, 25 bp, Mus musculus
attccttttttgaaggattcactag

SEQ ID NO: 214687 - DNA, 25 bp, Mus musculus
attcgaaaaacaaggacactgctgg

SEQ ID NO: 214688 - DNA, 25 bp, Mus musculus
attcgaaaagagagtgtatctgtca

SEQ ID NO: 214689 - DNA, 25 bp, Mus musculus
attcgaactggtgttgatcagtgta

SEQ ID NO: 214690 - DNA, 25 bp, Mus musculus
attcgaagtttccagactcaaactg

SEQ ID NO: 214691 - DNA, 25 bp, Mus musculus
attcgaagtttccagcctcctctgg

SEQ ID NO: 214692 - DNA, 25 bp, Mus musculus
attcgaattgggcggcggccagcgc

SEQ ID NO: 214693 - DNA, 25 bp, Mus musculus
attcgacagggaagaagaaaaagcc

SEQ ID NO: 214694 - DNA, 25 bp, Mus musculus
attcgacaggggaatggtttggaac

SEQ ID NO: 214695 - DNA, 25 bp, Mus musculus
attcgagaaagaagcctcaggtaca

SEQ ID NO: 214696 - DNA, 25 bp, Mus musculus
attcgagaagtcaaccatccaaaac

SEQ ID NO: 214697 - DNA, 25 bp, Mus musculus
attcgagcacatgtaatagcgctca

SEQ ID NO: 214698 - DNA, 25 bp, Mus musculus
attcgagcacatgtttaggtaatag

SEQ ID NO: 214699 - DNA, 25 bp, Mus musculus
attcgagcaggtggggcgagctatg

SEQ ID NO: 214700 - DNA, 25 bp, Mus musculus
attcgaggagactcctgaggctttt

SEQ ID NO: 214701 - DNA, 25 bp, Mus musculus
attcgagggcacaggcggacctatg

SEQ ID NO: 214702 - DNA, 25 bp, Mus musculus
attcgatccaggctccccggctgtc

SEQ ID NO: 214703 - DNA, 25 bp, Mus musculus
attcgatccaggtgctaccaagtac

SEQ ID NO: 214704 - DNA, 25 bp, Mus musculus
attcgatgtcgccagcgcccctcca

SEQ ID NO: 214705 - DNA, 25 bp, Mus musculus
attcgcaaagactctcacccaggtg

SEQ ID NO: 214706 - DNA, 25 bp, Mus musculus
attcgcacagtggggtcggttacgg

SEQ ID NO: 214707 - DNA, 25 bp, Mus musculus
attcgcacagtgtgtgttttgtgcc

SEQ ID NO: 214708 - DNA, 25 bp, Mus musculus
attcgcataccggatggaaatgcag

SEQ ID NO: 214709 - DNA, 25 bp, Mus musculus
attcgccacccaagttggagtcatt

SEQ ID NO: 214710 - DNA, 25 bp, Mus musculus
attcgcccagagtttgggaaatgga

SEQ ID NO: 214711 - DNA, 25 bp, Mus musculus
attcgccgagcactagcgctgggga

SEQ ID NO: 214712 - DNA, 25 bp, Mus musculus
attcgccgagccgagatactactcg

SEQ ID NO: 214713 - DNA, 25 bp, Mus musculus
attcgcgacatgaatggaatgacct

SEQ ID NO: 214714 - DNA, 25 bp, Mus musculus
attcgcgacatgatctacttctcca

SEQ ID NO: 214715 - DNA, 25 bp, Mus musculus
attcgcgcctagtattttgttaaat

SEQ ID NO: 214716 - DNA, 25 bp, Mus musculus
attcgcgcctggagtctcactgtta

SEQ ID NO: 214717 - DNA, 25 bp, Mus musculus
attcgctccggtgtaatggataggt

SEQ ID NO: 214718 - DNA, 25 bp, Mus musculus
attcgctgctattctccactccaga

SEQ ID NO: 214719 - DNA, 25 bp, Mus musculus
attcggacccagtcgacctgataaa

SEQ ID NO: 214720 - DNA, 25 bp, Mus musculus
attcggactcaggaggatatttcca

SEQ ID NO: 214721 - DNA, 25 bp, Mus musculus
attcggcaaagatgacagaaggcag

SEQ ID NO: 214722 - DNA, 25 bp, Mus musculus
attcggctgaacaaaccttatatct

SEQ ID NO: 214723 - DNA, 25 bp, Mus musculus
attcggctgaacaagttggtgacac

SEQ ID NO: 214724 - DNA, 25 bp, Mus musculus
attcggctgcagacttgacatcgtc

SEQ ID NO: 214725 - DNA, 25 bp, Mus musculus
attcggctgccgactgcgaatcgcc

SEQ ID NO: 214726 - DNA, 25 bp, Mus musculus
attcgggagaggcattcagtggctc

SEQ ID NO: 214727 - DNA, 25 bp, Mus musculus
attcgggctctgtaggttgtgaacc

SEQ ID NO: 214728 - DNA, 25 bp, Mus musculus
attcgtaatgatttcattatgaaag

SEQ ID NO: 214729 - DNA, 25 bp, Mus musculus
attcgtcccctcaggatcgccacga

SEQ ID NO: 214730 - DNA, 25 bp, Mus musculus
attcgtctgaggaagaatgtttctt

SEQ ID NO: 214731 - DNA, 25 bp, Mus musculus
attcgtgagcgctctctgctctctg

SEQ ID NO: 214732 - DNA, 25 bp, Mus musculus
attcgtgagcggcaattcaaatgag

SEQ ID NO: 214733 - DNA, 25 bp, Mus musculus
attcgtgcaccgtaacgtacctgaa

SEQ ID NO: 214734 - DNA, 25 bp, Mus musculus
attcgtggaagaggtaaagagagat

SEQ ID NO: 214735 - DNA, 25 bp, Mus musculus
attcgtgggcgcccggcgcagcaag

SEQ ID NO: 214736 - DNA, 25 bp, Mus musculus
attcgttaagagaggagaactttga

SEQ ID NO: 214737 - DNA, 25 bp, Mus musculus
attcgttcacggctgctcagactgc

SEQ ID NO: 214738 - DNA, 25 bp, Mus musculus
attcgtttgtcagattttccactca

SEQ ID NO: 214739 - DNA, 25 bp, Mus musculus
attctaaaacaagaggagattaggt

SEQ ID NO: 214740 - DNA, 25 bp, Mus musculus
attctaaaaggaatattattggcgt

SEQ ID NO: 214741 - DNA, 25 bp, Mus musculus
attctaaacaatcagcccaggagtt

SEQ ID NO: 214742 - DNA, 25 bp, Mus musculus
attctaaactaggtcatgtggtaat

SEQ ID NO: 214743 - DNA, 25 bp, Mus musculus
attctaaagcagatactaaaatgga

SEQ ID NO: 214744 - DNA, 25 bp, Mus musculus
attctaacagagatataccgcattg

SEQ ID NO: 214745 - DNA, 25 bp, Mus musculus
attctaacagcctgcagactgcaga

SEQ ID NO: 214746 - DNA, 25 bp, Mus musculus
attctaagactcaggtaacagttca

SEQ ID NO: 214747 - DNA, 25 bp, Mus musculus
attctaagcagaagcaccgagtgga

SEQ ID NO: 214748 - DNA, 25 bp, Mus musculus
attctaataaggagtggagtcaaca

SEQ ID NO: 214749 - DNA, 25 bp, Mus musculus
attctacaaagctgggcatggaagg

SEQ ID NO: 214750 - DNA, 25 bp, Mus musculus
attctacaagcaagacccaagagtt

SEQ ID NO: 214751 - DNA, 25 bp, Mus musculus
attctacaagcaaggagttacaccc

SEQ ID NO: 214752 - DNA, 25 bp, Mus musculus
attctacaagcatggcctgattgtg

SEQ ID NO: 214753 - DNA, 25 bp, Mus musculus
attctacacagctcacatgagcccc

SEQ ID NO: 214754 - DNA, 25 bp, Mus musculus
attctacagccatgggcttctgctt

SEQ ID NO: 214755 - DNA, 25 bp, Mus musculus
attctacagggtcacagacaggaaa

SEQ ID NO: 214756 - DNA, 25 bp, Mus musculus
attctacccatttctcccaagtgct

SEQ ID NO: 214757 - DNA, 25 bp, Mus musculus
attctaccccagacaagaataaggt

SEQ ID NO: 214758 - DNA, 25 bp, Mus musculus
attctaccccagttcccaaagtggc

SEQ ID NO: 214759 - DNA, 25 bp, Mus musculus
attctaccgcaacgtggtctccatt

SEQ ID NO: 214760 - DNA, 25 bp, Mus musculus
attctaccgctcctggaggatgaaa

SEQ ID NO: 214761 - DNA, 25 bp, Mus musculus
attctaccgctgaaaaagcagttga

SEQ ID NO: 214762 - DNA, 25 bp, Mus musculus
attctaccgctttgatgcagcaatt

SEQ ID NO: 214763 - DNA, 25 bp, Mus musculus
attctacgatgagtgtaaacgaaga

SEQ ID NO: 214764 - DNA, 25 bp, Mus musculus
attctactactgggactcgtactgg

SEQ ID NO: 214765 - DNA, 25 bp, Mus musculus
attctactcagcttcagaggatgaa

SEQ ID NO: 214766 - DNA, 25 bp, Mus musculus
attctactgaggtgtaaactcttcc

SEQ ID NO: 214767 - DNA, 25 bp, Mus musculus
attctagaaggttttctgtccacac

SEQ ID NO: 214768 - DNA, 25 bp, Mus musculus
attctagctgtcgggacacagattg

SEQ ID NO: 214769 - DNA, 25 bp, Mus musculus
attctatacacaggtgattttcgat

SEQ ID NO: 214770 - DNA, 25 bp, Mus musculus
attctataggagctgagacccttcc

SEQ ID NO: 214771 - DNA, 25 bp, Mus musculus
attctatcacagagctgtttggatt

SEQ ID NO: 214772 - DNA, 25 bp, Mus musculus
attctatctcaaagcaagccccgcc

SEQ ID NO: 214773 - DNA, 25 bp, Mus musculus
attctatgccagacttggaggtaac

SEQ ID NO: 214774 - DNA, 25 bp, Mus musculus
attctatgctaataacatgtacctg

SEQ ID NO: 214775 - DNA, 25 bp, Mus musculus
attctatgctaggtattctctgaaa

SEQ ID NO: 214776 - DNA, 25 bp, Mus musculus
attctattgataaggctgcctttga

SEQ ID NO: 214777 - DNA, 25 bp, Mus musculus
attctattgataaggtaacaagccg

SEQ ID NO: 214778 - DNA, 25 bp, Mus musculus
attctcaaaaccagggatactggga

SEQ ID NO: 214779 - DNA, 25 bp, Mus musculus
attctcaaaacccaatgatgagtga

SEQ ID NO: 214780 - DNA, 25 bp, Mus musculus
attctcaaaatgttcaagccatatt

SEQ ID NO: 214781 - DNA, 25 bp, Mus musculus
attctcaaaattcaattgctgatag

SEQ ID NO: 214782 - DNA, 25 bp, Mus musculus
attctcaaaattcaatttctgttgc

SEQ ID NO: 214783 - DNA, 25 bp, Mus musculus
attctcaacaacctgagattcatat

SEQ ID NO: 214784 - DNA, 25 bp, Mus musculus
attctcaagaggtctgaatttcctg

SEQ ID NO: 214785 - DNA, 25 bp, Mus musculus
attctcaatggaaatatggaaacct

SEQ ID NO: 214786 - DNA, 25 bp, Mus musculus
attctcaatgggaaaaagagcttgt

SEQ ID NO: 214787 - DNA, 25 bp, Mus musculus
attctcacagagatgaggcttgagc

SEQ ID NO: 214788 - DNA, 25 bp, Mus musculus
attctcacagagtgttctccatggc

SEQ ID NO: 214789 - DNA, 25 bp, Mus musculus
attctcacataaaggctgaaggtga

SEQ ID NO: 214790 - DNA, 25 bp, Mus musculus
attctcaccgacatcactcagcact

SEQ ID NO: 214791 - DNA, 25 bp, Mus musculus
attctcacgcaagaccctgactgca

SEQ ID NO: 214792 - DNA, 25 bp, Mus musculus
attctcagagttctgaacttcagcc

SEQ ID NO: 214793 - DNA, 25 bp, Mus musculus
attctcagcaggccgcagatcatgc

SEQ ID NO: 214794 - DNA, 25 bp, Mus musculus
attctcagtcaggagagaattcaga

SEQ ID NO: 214795 - DNA, 25 bp, Mus musculus
attctcagttcagcgtcgccaacag

SEQ ID NO: 214796 - DNA, 25 bp, Mus musculus
attctcagttttcgcatcaaggtgt

SEQ ID NO: 214797 - DNA, 25 bp, Mus musculus
attctcatcaaggataacagcaagc

SEQ ID NO: 214798 - DNA, 25 bp, Mus musculus
attctcatcgccgagctgaatgtca

SEQ ID NO: 214799 - DNA, 25 bp, Mus musculus
attctcatcgcttttatgaaacaga

SEQ ID NO: 214800 - DNA, 25 bp, Mus musculus
attctccaagaatgggaaatgcacc

SEQ ID NO: 214801 - DNA, 25 bp, Mus musculus
attctccaaggtggctggacccgac

SEQ ID NO: 214802 - DNA, 25 bp, Mus musculus
attctccacagtcactggagagtca

SEQ ID NO: 214803 - DNA, 25 bp, Mus musculus
attctccacagtcgctggagagtca

SEQ ID NO: 214804 - DNA, 25 bp, Mus musculus
attctccactcttgaaagaaaaatg

SEQ ID NO: 214805 - DNA, 25 bp, Mus musculus
attctccagcaaggcatgatcacca

SEQ ID NO: 214806 - DNA, 25 bp, Mus musculus
attctccagcaagttacagtccctg

SEQ ID NO: 214807 - DNA, 25 bp, Mus musculus
attctccagccaatgctgactacca

SEQ ID NO: 214808 - DNA, 25 bp, Mus musculus
attctccatggagcttggagctgcc

SEQ ID NO: 214809 - DNA, 25 bp, Mus musculus
attctccatggaggcaagatgaata

SEQ ID NO: 214810 - DNA, 25 bp, Mus musculus
attctccattccatttctgggcttc

SEQ ID NO: 214811 - DNA, 25 bp, Mus musculus
attctccattgaaatgttgtccttc

SEQ ID NO: 214812 - DNA, 25 bp, Mus musculus
attctcccagagatcttcaaaattt

SEQ ID NO: 214813 - DNA, 25 bp, Mus musculus
attctccgcggaggaccctaggaaa

SEQ ID NO: 214814 - DNA, 25 bp, Mus musculus
attctccgcggaggtattacttgga

SEQ ID NO: 214815 - DNA, 25 bp, Mus musculus
attctcctgatggaggtgcttgtcc

SEQ ID NO: 214816 - DNA, 25 bp, Mus musculus
attctcgacatagatatcccaatgt

SEQ ID NO: 214817 - DNA, 25 bp, Mus musculus
attctcgacataggtgcactgcatc

SEQ ID NO: 214818 - DNA, 25 bp, Mus musculus
attctcgggaggatccgagcgtgcg

SEQ ID NO: 214819 - DNA, 25 bp, Mus musculus
attctcgggaggtggctgtctgccc

SEQ ID NO: 214820 - DNA, 25 bp, Mus musculus
attctcgtgaactggttaccaggcc

SEQ ID NO: 214821 - DNA, 25 bp, Mus musculus
attctctcaatgctgtatgcccagc

SEQ ID NO: 214822 - DNA, 25 bp, Mus musculus
attctctcaatggtgtatgcccagc

SEQ ID NO: 214823 - DNA, 25 bp, Mus musculus
attctctcatagggaactttcaagt

SEQ ID NO: 214824 - DNA, 25 bp, Mus musculus
attctctccagctctgggccccaga

SEQ ID NO: 214825 - DNA, 25 bp, Mus musculus
attctctggaagattaggtcagaga

SEQ ID NO: 214826 - DNA, 25 bp, Mus musculus
attctctggaagtcctagtcactcg

SEQ ID NO: 214827 - DNA, 25 bp, Mus musculus
attctcttaaggttgtgtggaggaa

SEQ ID NO: 214828 - DNA, 25 bp, Mus musculus
attctcttcagtaccgggaggtggc

SEQ ID NO: 214829 - DNA, 25 bp, Mus musculus
attctgaaaataaaggtgcctcgtc

SEQ ID NO: 214830 - DNA, 25 bp, Mus musculus
attctgaaatacgattcagatggtt

SEQ ID NO: 214831 - DNA, 25 bp, Mus musculus
attctgaagtagcttgccacaagct

SEQ ID NO: 214832 - DNA, 25 bp, Mus musculus
attctgacagctgtgaactgtgttc

SEQ ID NO: 214833 - DNA, 25 bp, Mus musculus
attctgacatcctgcagagcctatc

SEQ ID NO: 214834 - DNA, 25 bp, Mus musculus
attctgacattgatggcgaggctga

SEQ ID NO: 214835 - DNA, 25 bp, Mus musculus
attctgacgctgagctccaacagtg

SEQ ID NO: 214836 - DNA, 25 bp, Mus musculus
attctgagaaggggctcctgtttgt

SEQ ID NO: 214837 - DNA, 25 bp, Mus musculus
attctgagaaggttccctgtagccc

SEQ ID NO: 214838 - DNA, 25 bp, Mus musculus
attctgagccaggtatcatacagac

SEQ ID NO: 214839 - DNA, 25 bp, Mus musculus
attctgagcggtatcaagttatagc

SEQ ID NO: 214840 - DNA, 25 bp, Mus musculus
attctgagttttcgcgagaactttc

SEQ ID NO: 214841 - DNA, 25 bp, Mus musculus
attctgatcaacaggtctccatttt

SEQ ID NO: 214842 - DNA, 25 bp, Mus musculus
attctgatcctagtgtcaaaggtcc

SEQ ID NO: 214843 - DNA, 25 bp, Mus musculus
attctgatgatgttgctttcccctg

SEQ ID NO: 214844 - DNA, 25 bp, Mus musculus
attctgatgtactaaaaatcactgg

SEQ ID NO: 214845 - DNA, 25 bp, Mus musculus
attctgattgggactggaaaaggag

SEQ ID NO: 214846 - DNA, 25 bp, Mus musculus
attctgattggggtactggaaaagg

SEQ ID NO: 214847 - DNA, 25 bp, Mus musculus
attctgattgtggaagcttacccca

SEQ ID NO: 214848 - DNA, 25 bp, Mus musculus
attctgcaaaaacagatgtggaaag

SEQ ID NO: 214849 - DNA, 25 bp, Mus musculus
attctgcaaaaccttatgcacacat

SEQ ID NO: 214850 - DNA, 25 bp, Mus musculus
attctgcaaacttcaagcacaaatg

SEQ ID NO: 214851 - DNA, 25 bp, Mus musculus
attctgcaagtgggtgggaccatca

SEQ ID NO: 214852 - DNA, 25 bp, Mus musculus
attctgcactaggctccgcaggagg

SEQ ID NO: 214853 - DNA, 25 bp, Mus musculus
attctgcagaagataccgggacaca

SEQ ID NO: 214854 - DNA, 25 bp, Mus musculus
attctgcagaagggggactatgtat

SEQ ID NO: 214855 - DNA, 25 bp, Mus musculus
attctgcagcagatcgtgaacctta

SEQ ID NO: 214856 - DNA, 25 bp, Mus musculus
attctgcaggtcacgtacagtgctt

SEQ ID NO: 214857 - DNA, 25 bp, Mus musculus
attctgcatctgagtgggaactggt

SEQ ID NO: 214858 - DNA, 25 bp, Mus musculus
attctgcatggctgatccttccttg

SEQ ID NO: 214859 - DNA, 25 bp, Mus musculus
attctgccagataaaacacggacct

SEQ ID NO: 214860 - DNA, 25 bp, Mus musculus
attctgccagatactggatttatga

SEQ ID NO: 214861 - DNA, 25 bp, Mus musculus
attctgcctcaggacctcttcctga

SEQ ID NO: 214862 - DNA, 25 bp, Mus musculus
attctgcctttgaaacagacataat

SEQ ID NO: 214863 - DNA, 25 bp, Mus musculus
attctgcctttgaacatgattctgt

SEQ ID NO: 214864 - DNA, 25 bp, Mus musculus
attctgcctttgggctgtaccttgg

SEQ ID NO: 214865 - DNA, 25 bp, Mus musculus
attctgcgattcccaaggccttccc

SEQ ID NO: 214866 - DNA, 25 bp, Mus musculus
attctgcgcagagaggtccaggatg

SEQ ID NO: 214867 - DNA, 25 bp, Mus musculus
attctgcgggctttgcttaaatcca

SEQ ID NO: 214868 - DNA, 25 bp, Mus musculus
attctgctatagaaggtaattacac

SEQ ID NO: 214869 - DNA, 25 bp, Mus musculus
attctgctcggcagcacatcatgca

SEQ ID NO: 214870 - DNA, 25 bp, Mus musculus
attctgctcgtcagcacatcatgca

SEQ ID NO: 214871 - DNA, 25 bp, Mus musculus
attctgctggctgctgctgctgccg

SEQ ID NO: 214872 - DNA, 25 bp, Mus musculus
attctgctgtacgcgtcttgttgga

SEQ ID NO: 214873 - DNA, 25 bp, Mus musculus
attctgctgtacgcgtgccggaatt

SEQ ID NO: 214874 - DNA, 25 bp, Mus musculus
attctgcttagcctgctgaggcatt

SEQ ID NO: 214875 - DNA, 25 bp, Mus musculus
attctgcttagtgcctgcacgtctg

SEQ ID NO: 214876 - DNA, 25 bp, Mus musculus
attctgcttatggcgtgcgcaggga

SEQ ID NO: 214877 - DNA, 25 bp, Mus musculus
attctgcttatgtgcttctgggtcc

SEQ ID NO: 214878 - DNA, 25 bp, Mus musculus
attctggaaaacagatttattcttc

SEQ ID NO: 214879 - DNA, 25 bp, Mus musculus
attctggaagccaactgggtggtga

SEQ ID NO: 214880 - DNA, 25 bp, Mus musculus
attctggaagccaagaaagccctct

SEQ ID NO: 214881 - DNA, 25 bp, Mus musculus
attctggagcagtgccaataacttc

SEQ ID NO: 214882 - DNA, 25 bp, Mus musculus
attctggatgaagctgtagcaatgg

SEQ ID NO: 214883 - DNA, 25 bp, Mus musculus
attctggcaggaagcagtgaagcaa

SEQ ID NO: 214884 - DNA, 25 bp, Mus musculus
attctggcaggacatgaagctattg

SEQ ID NO: 214885 - DNA, 25 bp, Mus musculus
attctggcaggtagtgctgccctaa

SEQ ID NO: 214886 - DNA, 25 bp, Mus musculus
attctggcccataaatgctgttggc

SEQ ID NO: 214887 - DNA, 25 bp, Mus musculus
attctgggaggctccccagcacagg

SEQ ID NO: 214888 - DNA, 25 bp, Mus musculus
attctgggccaggagtctccaaaac

SEQ ID NO: 214889 - DNA, 25 bp, Mus musculus
attctggtgagtatgcagctgataa

SEQ ID NO: 214890 - DNA, 25 bp, Mus musculus
attctggtgttcggtagagctggtg

SEQ ID NO: 214891 - DNA, 25 bp, Mus musculus
attctggtgttcggtgaagatggtt

SEQ ID NO: 214892 - DNA, 25 bp, Mus musculus
attctggttgcccaggtgctgggct

SEQ ID NO: 214893 - DNA, 25 bp, Mus musculus
attctgtaacgtatgatggatcgaa

SEQ ID NO: 214894 - DNA, 25 bp, Mus musculus
attctgtaacgtatgatggattcaa

SEQ ID NO: 214895 - DNA, 25 bp, Mus musculus
attctgtagccctagatcctttaca

SEQ ID NO: 214896 - DNA, 25 bp, Mus musculus
attctgtggacgaagaaaatattcc

SEQ ID NO: 214897 - DNA, 25 bp, Mus musculus
attctgttagacagaatggcaatcc

SEQ ID NO: 214898 - DNA, 25 bp, Mus musculus
attctgttcaggaggaagcagaaat

SEQ ID NO: 214899 - DNA, 25 bp, Mus musculus
attctgtttcgatctatgtaagagc

SEQ ID NO: 214900 - DNA, 25 bp, Mus musculus
attctgtttcggacttgccatcaac

SEQ ID NO: 214901 - DNA, 25 bp, Mus musculus
attcttaagagaatacggacgggcc

SEQ ID NO: 214902 - DNA, 25 bp, Mus musculus
attcttaagagcatggataagaatg

SEQ ID NO: 214903 - DNA, 25 bp, Mus musculus
attcttaccaagaagtttgttcgca

SEQ ID NO: 214904 - DNA, 25 bp, Mus musculus
attcttactacaggaatgagtgcca

SEQ ID NO: 214905 - DNA, 25 bp, Mus musculus
attcttactgacagcttttttatta

SEQ ID NO: 214906 - DNA, 25 bp, Mus musculus
attcttactgacagtgtacactctt

SEQ ID NO: 214907 - DNA, 25 bp, Mus musculus
attcttactggaagattatcctgtc

SEQ ID NO: 214908 - DNA, 25 bp, Mus musculus
attcttagaaaacgcctccttggca

SEQ ID NO: 214909 - DNA, 25 bp, Mus musculus
attcttagaagggctggaaaaagga

SEQ ID NO: 214910 - DNA, 25 bp, Mus musculus
attcttagcaagggtctgtcaccgc

SEQ ID NO: 214911 - DNA, 25 bp, Mus musculus
attcttataaatgtttatgtctggg

SEQ ID NO: 214912 - DNA, 25 bp, Mus musculus
attcttatccaggtaccattactat

SEQ ID NO: 214913 - DNA, 25 bp, Mus musculus
attcttcaacgagcgggctgagcgg

SEQ ID NO: 214914 - DNA, 25 bp, Mus musculus
attcttcaagagtttatccatgctg

SEQ ID NO: 214915 - DNA, 25 bp, Mus musculus
attcttcaaggactggggatctcgg

SEQ ID NO: 214916 - DNA, 25 bp, Mus musculus
attcttcaaggtggtacctcatcag

SEQ ID NO: 214917 - DNA, 25 bp, Mus musculus
attcttcacactgctttggtgcggc

SEQ ID NO: 214918 - DNA, 25 bp, Mus musculus
attcttcacctactacagacaagta

SEQ ID NO: 214919 - DNA, 25 bp, Mus musculus
attcttcacctagtacagacaagta

SEQ ID NO: 214920 - DNA, 25 bp, Mus musculus
attcttcatttcaggccatcagctc

SEQ ID NO: 214921 - DNA, 25 bp, Mus musculus
attcttcccttagaccgtcacgacg

SEQ ID NO: 214922 - DNA, 25 bp, Mus musculus
attcttctaagggaatacagtgagt

SEQ ID NO: 214923 - DNA, 25 bp, Mus musculus
attcttctatacagaaactgcactt

SEQ ID NO: 214924 - DNA, 25 bp, Mus musculus
attcttctcaagcagatttcggagg

SEQ ID NO: 214925 - DNA, 25 bp, Mus musculus
attcttctcaagcagggtactggtc

SEQ ID NO: 214926 - DNA, 25 bp, Mus musculus
attcttctcaagcaggtggcccacg

SEQ ID NO: 214927 - DNA, 25 bp, Mus musculus
attcttctcaatgtaaatttaacac

SEQ ID NO: 214928 - DNA, 25 bp, Mus musculus
attcttctgatagaggtgccctggg

SEQ ID NO: 214929 - DNA, 25 bp, Mus musculus
attcttctgcaagcactgcagagag

SEQ ID NO: 214930 - DNA, 25 bp, Mus musculus
attcttctgggtcggatgctctggg

SEQ ID NO: 214931 - DNA, 25 bp, Mus musculus
attcttctgtctcccctgaggcctt

SEQ ID NO: 214932 - DNA, 25 bp, Mus musculus
attcttctttcctgactgatggcgc

SEQ ID NO: 214933 - DNA, 25 bp, Mus musculus
attcttgaatgcaccttatagccat

SEQ ID NO: 214934 - DNA, 25 bp, Mus musculus
attcttgacggacttaaaaggacaa

SEQ ID NO: 214935 - DNA, 25 bp, Mus musculus
attcttgactgggctgctggacctg

SEQ ID NO: 214936 - DNA, 25 bp, Mus musculus
attcttgatgagacctctttgacaa

SEQ ID NO: 214937 - DNA, 25 bp, Mus musculus
attcttgcaaaaagacacacctgca

SEQ ID NO: 214938 - DNA, 25 bp, Mus musculus
attcttgcaaaaagaggtctccaag

SEQ ID NO: 214939 - DNA, 25 bp, Mus musculus
attcttgcagacacctttgtcctgg

SEQ ID NO: 214940 - DNA, 25 bp, Mus musculus
attcttgcagatccgtctaccttga

SEQ ID NO: 214941 - DNA, 25 bp, Mus musculus
attcttggtactgcatagtgggaca

SEQ ID NO: 214942 - DNA, 25 bp, Mus musculus
attcttggtactggtgaacaccatg

SEQ ID NO: 214943 - DNA, 25 bp, Mus musculus
attcttgtcataaaaatatgacaga

SEQ ID NO: 214944 - DNA, 25 bp, Mus musculus
attctttaagttcaagtttggacga

SEQ ID NO: 214945 - DNA, 25 bp, Mus musculus
attctttcagcttggtgctgttaaa

SEQ ID NO: 214946 - DNA, 25 bp, Mus musculus
attctttcggctaagaaccaaaaat

SEQ ID NO: 214947 - DNA, 25 bp, Mus musculus
attctttcttttgggagcctcaatg

SEQ ID NO: 214948 - DNA, 25 bp, Mus musculus
attctttcttttgggagtgagtgtg

SEQ ID NO: 214949 - DNA, 25 bp, Mus musculus
attctttgaagatgttccctcagcc

SEQ ID NO: 214950 - DNA, 25 bp, Mus musculus
attctttgggaatgccctctacgcc

SEQ ID NO: 214951 - DNA, 25 bp, Mus musculus
attctttgtacacaatgccaaagaa

SEQ ID NO: 214952 - DNA, 25 bp, Mus musculus
attctttgtacacagcccactttta

SEQ ID NO: 214953 - DNA, 25 bp, Mus musculus
attctttgtagccggggacgatccg

SEQ ID NO: 214954 - DNA, 25 bp, Mus musculus
attcttttataaaagatctgcagtg

SEQ ID NO: 214955 - DNA, 25 bp, Mus musculus
attcttttggtctgtgagcatccct

SEQ ID NO: 214956 - DNA, 25 bp, Mus musculus
attcttttgtcaaggactgtgaatt

SEQ ID NO: 214957 - DNA, 25 bp, Mus musculus
attcttttgtcaaggatggtgagga

SEQ ID NO: 214958 - DNA, 25 bp, Mus musculus
attgaaaaacttaagtaaatttgat

SEQ ID NO: 214959 - DNA, 25 bp, Mus musculus
attgaaaactggtcagtacttggct

SEQ ID NO: 214960 - DNA, 25 bp, Mus musculus
attgaaaactggtctgtacttggct

SEQ ID NO: 214961 - DNA, 25 bp, Mus musculus
attgaaaagaaaatcaaagatgact

SEQ ID NO: 214962 - DNA, 25 bp, Mus musculus
attgaaaagaaattcaaagatgact

SEQ ID NO: 214963 - DNA, 25 bp, Mus musculus
attgaaaagaacgaaagtcagcgtg

SEQ ID NO: 214964 - DNA, 25 bp, Mus musculus
attgaaaatgcttcgagaacagaaa

SEQ ID NO: 214965 - DNA, 25 bp, Mus musculus
attgaaactggaagcatatattcaa

SEQ ID NO: 214966 - DNA, 25 bp, Mus musculus
attgaaagaaaagcgggtgccctcc

SEQ ID NO: 214967 - DNA, 25 bp, Mus musculus
attgaaagagaggtcttacttgttc

SEQ ID NO: 214968 - DNA, 25 bp, Mus musculus
attgaaagagcccattctgcactcc

SEQ ID NO: 214969 - DNA, 25 bp, Mus musculus
attgaaagctacgggaaagaaagca

SEQ ID NO: 214970 - DNA, 25 bp, Mus musculus
attgaaagctgaaaggaagttcttc

SEQ ID NO: 214971 - DNA, 25 bp, Mus musculus
attgaacaaagaccggcaactatcc

SEQ ID NO: 214972 - DNA, 25 bp, Mus musculus
attgaaccaagcacttgtttctagt

SEQ ID NO: 214973 - DNA, 25 bp, Mus musculus
attgaacctgcaggtactaacacca

SEQ ID NO: 214974 - DNA, 25 bp, Mus musculus
attgaacctgcaggtcttttcatgt

SEQ ID NO: 214975 - DNA, 25 bp, Mus musculus
attgaactaaaggagtcaaggagta

SEQ ID NO: 214976 - DNA, 25 bp, Mus musculus
attgaactcaggccatattcccaaa

SEQ ID NO: 214977 - DNA, 25 bp, Mus musculus
attgaactcatcaagatgtttgaca

SEQ ID NO: 214978 - DNA, 25 bp, Mus musculus
attgaactctggaaggaaaaaaatc

SEQ ID NO: 214979 - DNA, 25 bp, Mus musculus
attgaactctggaaggctgtcaaga

SEQ ID NO: 214980 - DNA, 25 bp, Mus musculus
attgaacttattcagagatttcctc

SEQ ID NO: 214981 - DNA, 25 bp, Mus musculus
attgaagaaagagcgagatggacag

SEQ ID NO: 214982 - DNA, 25 bp, Mus musculus
attgaagaaagagcgatacttggta

SEQ ID NO: 214983 - DNA, 25 bp, Mus musculus
attgaagacacaggattatgtactg

SEQ ID NO: 214984 - DNA, 25 bp, Mus musculus
attgaagacccaactccgaagtcaa

SEQ ID NO: 214985 - DNA, 25 bp, Mus musculus
attgaagagaagagccttgttgata

SEQ ID NO: 214986 - DNA, 25 bp, Mus musculus
attgaagctggaaagcaaagatatc

SEQ ID NO: 214987 - DNA, 25 bp, Mus musculus
attgaagctgggtgttgaccagatg

SEQ ID NO: 214988 - DNA, 25 bp, Mus musculus
attgaaggacagccaaatagaataa

SEQ ID NO: 214989 - DNA, 25 bp, Mus musculus
attgaaggtacaggagttaaagacc

SEQ ID NO: 214990 - DNA, 25 bp, Mus musculus
attgaagtagaggcaccagactccc

SEQ ID NO: 214991 - DNA, 25 bp, Mus musculus
attgaagtgaaagctgctcctgaca

SEQ ID NO: 214992 - DNA, 25 bp, Mus musculus
attgaagtgaaaggagatttctaat

SEQ ID NO: 214993 - DNA, 25 bp, Mus musculus
attgaagtgtatccctgggaagatg

SEQ ID NO: 214994 - DNA, 25 bp, Mus musculus
attgaatatactgttgaatcaaggg

SEQ ID NO: 214995 - DNA, 25 bp, Mus musculus
attgaatatagacctgaaaaccatc

SEQ ID NO: 214996 - DNA, 25 bp, Mus musculus
attgaatatgagatgtgcataatgc

SEQ ID NO: 214997 - DNA, 25 bp, Mus musculus
attgaatatgaggtgtcagctgtgc

SEQ ID NO: 214998 - DNA, 25 bp, Mus musculus
attgaatatgtggtgctgctgtttt

SEQ ID NO: 214999 - DNA, 25 bp, Mus musculus
attgaatcagctgaactggaccccg

SEQ ID NO: 215000 - DNA, 25 bp, Mus musculus
attgaatcaggtgaactggaccccg

SEQ ID NO: 215001 - DNA, 25 bp, Mus musculus
attgaattcttctatacagaaactg

SEQ ID NO: 215002 - DNA, 25 bp, Mus musculus
attgaattttagaatgattgaagat

SEQ ID NO: 215003 - DNA, 25 bp, Mus musculus
attgaattttagctggattcatcgc

SEQ ID NO: 215004 - DNA, 25 bp, Mus musculus
attgacaaccaatatcagtctctgc

SEQ ID NO: 215005 - DNA, 25 bp, Mus musculus
attgacaaccagacacgcataacta

SEQ ID NO: 215006 - DNA, 25 bp, Mus musculus
attgacacacatgcgggtggagtgc

SEQ ID NO: 215007 - DNA, 25 bp, Mus musculus
attgacacctcaggtggaccccttg

SEQ ID NO: 215008 - DNA, 25 bp, Mus musculus
attgacactgctgacagtgccacgg

SEQ ID NO: 215009 - DNA, 25 bp, Mus musculus
attgacactgctgatgccgagtgct

SEQ ID NO: 215010 - DNA, 25 bp, Mus musculus
attgacagagactctttcaagcatt

SEQ ID NO: 215011 - DNA, 25 bp, Mus musculus
attgacagagagccccttccaactt

SEQ ID NO: 215012 - DNA, 25 bp, Mus musculus
attgacagtaagggtgatgcccggt

SEQ ID NO: 215013 - DNA, 25 bp, Mus musculus
attgacagttgcttataggctcttg

SEQ ID NO: 215014 - DNA, 25 bp, Mus musculus
attgacataggctcgttcaggcctg

SEQ ID NO: 215015 - DNA, 25 bp, Mus musculus
attgacatagggaacgtctagctcg

SEQ ID NO: 215016 - DNA, 25 bp, Mus musculus
attgaccaatttagtattcgcctgg

SEQ ID NO: 215017 - DNA, 25 bp, Mus musculus
attgaccacaggaataactcaacct

SEQ ID NO: 215018 - DNA, 25 bp, Mus musculus
attgaccactcagctgctgcgctgc

SEQ ID NO: 215019 - DNA, 25 bp, Mus musculus
attgaccagatagagctggagctgg

SEQ ID NO: 215020 - DNA, 25 bp, Mus musculus
attgaccagcaccacctgcccctag

SEQ ID NO: 215021 - DNA, 25 bp, Mus musculus
attgaccatcagacaagctgcaacc

SEQ ID NO: 215022 - DNA, 25 bp, Mus musculus
attgaccatgaccaggaataactca

SEQ ID NO: 215023 - DNA, 25 bp, Mus musculus
attgaccatgaccaggcgctggctc

SEQ ID NO: 215024 - DNA, 25 bp, Mus musculus
attgacccaaagatcttggcatata

SEQ ID NO: 215025 - DNA, 25 bp, Mus musculus
attgacccaggtgctctcaccacca

SEQ ID NO: 215026 - DNA, 25 bp, Mus musculus
attgaccctgagacgatccagaacc

SEQ ID NO: 215027 - DNA, 25 bp, Mus musculus
attgacctaacaaatgtcgagtggc

SEQ ID NO: 215028 - DNA, 25 bp, Mus musculus
attgacctgtcccacaggcggaatg

SEQ ID NO: 215029 - DNA, 25 bp, Mus musculus
attgactacagaacacaagacttca

SEQ ID NO: 215030 - DNA, 25 bp, Mus musculus
attgactacagatttcatatataaa

SEQ ID NO: 215031 - DNA, 25 bp, Mus musculus
attgactacaggaaactataagtaa

SEQ ID NO: 215032 - DNA, 25 bp, Mus musculus
attgactctgtttcccacagtcaga

SEQ ID NO: 215033 - DNA, 25 bp, Mus musculus
attgactgagccaagtggtggcggg

SEQ ID NO: 215034 - DNA, 25 bp, Mus musculus
attgactgcaggtccctggaaacaa

SEQ ID NO: 215035 - DNA, 25 bp, Mus musculus
attgactgtgaatgggtgaatttgg

SEQ ID NO: 215036 - DNA, 25 bp, Mus musculus
attgactgtgaatgggttctaacgt

SEQ ID NO: 215037 - DNA, 25 bp, Mus musculus
attgacttaaaggaactagaggctg

SEQ ID NO: 215038 - DNA, 25 bp, Mus musculus
attgacttcatggtggcttgcatgc

SEQ ID NO: 215039 - DNA, 25 bp, Mus musculus
attgagaaccccagggtccattcac

SEQ ID NO: 215040 - DNA, 25 bp, Mus musculus
attgagaacctgtctccttaaagaa

SEQ ID NO: 215041 - DNA, 25 bp, Mus musculus
attgagaacttcaggtctgctgtaa

SEQ ID NO: 215042 - DNA, 25 bp, Mus musculus
attgagaacttcaggtttgctgtct

SEQ ID NO: 215043 - DNA, 25 bp, Mus musculus
attgagaagactgtgaacaggtatg

SEQ ID NO: 215044 - DNA, 25 bp, Mus musculus
attgagaaggtgggaggctggaata

SEQ ID NO: 215045 - DNA, 25 bp, Mus musculus
attgagaccctacatgtacccctca

SEQ ID NO: 215046 - DNA, 25 bp, Mus musculus
attgagactgacaatttatttcacc

SEQ ID NO: 215047 - DNA, 25 bp, Mus musculus
attgagactgccaaacaagaagccg

SEQ ID NO: 215048 - DNA, 25 bp, Mus musculus
attgagactgtgggatagtgtgctg

SEQ ID NO: 215049 - DNA, 25 bp, Mus musculus
attgagactgtggtgtgtctgcagg

SEQ ID NO: 215050 - DNA, 25 bp, Mus musculus
attgagactttctttggggtaggct

SEQ ID NO: 215051 - DNA, 25 bp, Mus musculus
attgagagaagtgatattgtggtcc

SEQ ID NO: 215052 - DNA, 25 bp, Mus musculus
attgagagagcgagagttactacct

SEQ ID NO: 215053 - DNA, 25 bp, Mus musculus
attgagagagcgaggttgcacatag

SEQ ID NO: 215054 - DNA, 25 bp, Mus musculus
attgagataaaagccagagttactt

SEQ ID NO: 215055 - DNA, 25 bp, Mus musculus
attgagatccggaggatccaaggac

SEQ ID NO: 215056 - DNA, 25 bp, Mus musculus
attgagcactccttctggagatcct

SEQ ID NO: 215057 - DNA, 25 bp, Mus musculus
attgagcagttggtaagtggagaaa

SEQ ID NO: 215058 - DNA, 25 bp, Mus musculus
attgagcatccttgcagctggccag

SEQ ID NO: 215059 - DNA, 25 bp, Mus musculus
attgagccgacccaggtctgtgcag

SEQ ID NO: 215060 - DNA, 25 bp, Mus musculus
attgagcctcgaagtctttacctgg

SEQ ID NO: 215061 - DNA, 25 bp, Mus musculus
attgagcgcaaggtaatagaacttc

SEQ ID NO: 215062 - DNA, 25 bp, Mus musculus
attgagctcaagaaaccacagtgca

SEQ ID NO: 215063 - DNA, 25 bp, Mus musculus
attgagctcacatgaaaccaaagat

SEQ ID NO: 215064 - DNA, 25 bp, Mus musculus
attgagctcccaaggtggatgaaga

SEQ ID NO: 215065 - DNA, 25 bp, Mus musculus
attgagctgccgactagaagttatt

SEQ ID NO: 215066 - DNA, 25 bp, Mus musculus
attgagctgccgactatactgaagc

SEQ ID NO: 215067 - DNA, 25 bp, Mus musculus
attgagctgccgactcctgatagag

SEQ ID NO: 215068 - DNA, 25 bp, Mus musculus
attgagctgccgacttaaccgtgtg

SEQ ID NO: 215069 - DNA, 25 bp, Mus musculus
attgaggaagagcaatgtggacttt

SEQ ID NO: 215070 - DNA, 25 bp, Mus musculus
attgaggaataggtacctggcagca

SEQ ID NO: 215071 - DNA, 25 bp, Mus musculus
attgaggacccggagctagaagcga

SEQ ID NO: 215072 - DNA, 25 bp, Mus musculus
attgaggaggaagagttaacactca

SEQ ID NO: 215073 - DNA, 25 bp, Mus musculus
attgaggatctggaagctcaagtga

SEQ ID NO: 215074 - DNA, 25 bp, Mus musculus
attgaggatgccagagcacagggca

SEQ ID NO: 215075 - DNA, 25 bp, Mus musculus
attgaggatgccaggagctccggcc

SEQ ID NO: 215076 - DNA, 25 bp, Mus musculus
attgaggcaaagaacctagccagct

SEQ ID NO: 215077 - DNA, 25 bp, Mus musculus
attgaggcagaagtgctgtgtggtc

SEQ ID NO: 215078 - DNA, 25 bp, Mus musculus
attgaggcagaagttgacccacctt

SEQ ID NO: 215079 - DNA, 25 bp, Mus musculus
attgaggccaagcacgataaataca

SEQ ID NO: 215080 - DNA, 25 bp, Mus musculus
attgaggccaagcacgtggacgaga

SEQ ID NO: 215081 - DNA, 25 bp, Mus musculus
attgaggctgggaggagtgggaggt

SEQ ID NO: 215082 - DNA, 25 bp, Mus musculus
attgagggaaggtccccaccctgca

SEQ ID NO: 215083 - DNA, 25 bp, Mus musculus
attgagggcaagaaggctgcgaaaa

SEQ ID NO: 215084 - DNA, 25 bp, Mus musculus
attgagggcagcctggacactgcaa

SEQ ID NO: 215085 - DNA, 25 bp, Mus musculus
attgagggcctcgagaatggctctg

SEQ ID NO: 215086 - DNA, 25 bp, Mus musculus
attgaggtctcactgctaataaaga

SEQ ID NO: 215087 - DNA, 25 bp, Mus musculus
attgaggtctcactggttggcgcat

SEQ ID NO: 215088 - DNA, 25 bp, Mus musculus
attgaggttcaaaaggatccagaag

SEQ ID NO: 215089 - DNA, 25 bp, Mus musculus
attgaggttcaaaaggcacagtgac

SEQ ID NO: 215090 - DNA, 25 bp, Mus musculus
attgaggttgagcaacattttgatg

SEQ ID NO: 215091 - DNA, 25 bp, Mus musculus
attgaggttgagggaatagccagag

SEQ ID NO: 215092 - DNA, 25 bp, Mus musculus
attgaggttgaggtgtcctcaacaa

SEQ ID NO: 215093 - DNA, 25 bp, Mus musculus
attgagtacatggccccagagattc

SEQ ID NO: 215094 - DNA, 25 bp, Mus musculus
attgagtattgggaatattacagcc

SEQ ID NO: 215095 - DNA, 25 bp, Mus musculus
attgagtcgttgaagagagttgtgg

SEQ ID NO: 215096 - DNA, 25 bp, Mus musculus
attgagtcgttgaaggtactagcaa

SEQ ID NO: 215097 - DNA, 25 bp, Mus musculus
attgagtctgccaaaattatggacc

SEQ ID NO: 215098 - DNA, 25 bp, Mus musculus
attgagtgcaggaatttgacgggca

SEQ ID NO: 215099 - DNA, 25 bp, Mus musculus
attgagtgcaggcttggctgttgtt

SEQ ID NO: 215100 - DNA, 25 bp, Mus musculus
attgagttcagctatgaactctcga

SEQ ID NO: 215101 - DNA, 25 bp, Mus musculus
attgagttgctgctgattttcattt

SEQ ID NO: 215102 - DNA, 25 bp, Mus musculus
attgagttgctgctggtgccagggt

SEQ ID NO: 215103 - DNA, 25 bp, Mus musculus
attgataaaatcaagatgtctgttg

SEQ ID NO: 215104 - DNA, 25 bp, Mus musculus
attgataataccaggattgtctaca

SEQ ID NO: 215105 - DNA, 25 bp, Mus musculus
attgataatccgctggctcgggcct

SEQ ID NO: 215106 - DNA, 25 bp, Mus musculus
attgataatcctgctaccagccgag

SEQ ID NO: 215107 - DNA, 25 bp, Mus musculus
attgatacagggacaagtgaccaga

SEQ ID NO: 215108 - DNA, 25 bp, Mus musculus
attgatactaaaaggagacagtgga

SEQ ID NO: 215109 - DNA, 25 bp, Mus musculus
attgatactaaaagtgaagcctgtc

SEQ ID NO: 215110 - DNA, 25 bp, Mus musculus
attgatagacagatcctacttctgg

SEQ ID NO: 215111 - DNA, 25 bp, Mus musculus
attgatcaaagtgccagtgaacccc

SEQ ID NO: 215112 - DNA, 25 bp, Mus musculus
attgatcaaagtggaaatggatcca

SEQ ID NO: 215113 - DNA, 25 bp, Mus musculus
attgatcaaggtctgaagaagattc

SEQ ID NO: 215114 - DNA, 25 bp, Mus musculus
attgatcacagttttcattgaaaaa

SEQ ID NO: 215115 - DNA, 25 bp, Mus musculus
attgatcatgggccctggggagagg

SEQ ID NO: 215116 - DNA, 25 bp, Mus musculus
attgatccagaaaagctctccgtaa

SEQ ID NO: 215117 - DNA, 25 bp, Mus musculus
attgatccagaaaagctgtcttcag

SEQ ID NO: 215118 - DNA, 25 bp, Mus musculus
attgatctttctcagattccttgta

SEQ ID NO: 215119 - DNA, 25 bp, Mus musculus
attgatgaaaagatttatttattca

SEQ ID NO: 215120 - DNA, 25 bp, Mus musculus
attgatgaaagagaaaaaaatctgg

SEQ ID NO: 215121 - DNA, 25 bp, Mus musculus
attgatgaaatagactctttcctac

SEQ ID NO: 215122 - DNA, 25 bp, Mus musculus
attgatgaagcgtcaggaactgtgt

SEQ ID NO: 215123 - DNA, 25 bp, Mus musculus
attgatgaccagagttacaagcacc

SEQ ID NO: 215124 - DNA, 25 bp, Mus musculus
attgatgagtgaagaggcgacgacg

SEQ ID NO: 215125 - DNA, 25 bp, Mus musculus
attgatgagtgacctgctgccgtct

SEQ ID NO: 215126 - DNA, 25 bp, Mus musculus
attgatgatgtgcctgatgacatta

SEQ ID NO: 215127 - DNA, 25 bp, Mus musculus
attgatgcatcattgtcgctgccca

SEQ ID NO: 215128 - DNA, 25 bp, Mus musculus
attgatgcgtgcagggcgacagtgg

SEQ ID NO: 215129 - DNA, 25 bp, Mus musculus
attgatgcgtgccagggcgacagtg

SEQ ID NO: 215130 - DNA, 25 bp, Mus musculus
attgatggaaaagggttcctttgat

SEQ ID NO: 215131 - DNA, 25 bp, Mus musculus
attgatggaaagggtccaattggtt

SEQ ID NO: 215132 - DNA, 25 bp, Mus musculus
attgatggcaagatcttctgtgtgc

SEQ ID NO: 215133 - DNA, 25 bp, Mus musculus
attgatgggaagaaccagcaagaga

SEQ ID NO: 215134 - DNA, 25 bp, Mus musculus
attgatgtacttcaggccacagact

SEQ ID NO: 215135 - DNA, 25 bp, Mus musculus
attgatgtcacgaagccagcgatct

SEQ ID NO: 215136 - DNA, 25 bp, Mus musculus
attgatgtcacgccgcataactcat

SEQ ID NO: 215137 - DNA, 25 bp, Mus musculus
attgatgtcacggtctattacaatg

SEQ ID NO: 215138 - DNA, 25 bp, Mus musculus
attgatgttgattgatgtgggtcgt

SEQ ID NO: 215139 - DNA, 25 bp, Mus musculus
attgatgttggaaactgtggctgtg

SEQ ID NO: 215140 - DNA, 25 bp, Mus musculus
attgattaagagtgtcaacaggaga

SEQ ID NO: 215141 - DNA, 25 bp, Mus musculus
attgattaaggcagtagagtgtcaa

SEQ ID NO: 215142 - DNA, 25 bp, Mus musculus
attgattcactgagctcctgcaaaa

SEQ ID NO: 215143 - DNA, 25 bp, Mus musculus
attgattctaaactaggtcatgtgg

SEQ ID NO: 215144 - DNA, 25 bp, Mus musculus
attgattctactgaggtgtaaactc

SEQ ID NO: 215145 - DNA, 25 bp, Mus musculus
attgattgaggactctcaaagaagg

SEQ ID NO: 215146 - DNA, 25 bp, Mus musculus
attgattgaggggtctcactctaac

SEQ ID NO: 215147 - DNA, 25 bp, Mus musculus
attgattgctgcagtgtgaaaaact

SEQ ID NO: 215148 - DNA, 25 bp, Mus musculus
attgattgtagagatcagctcgaac

SEQ ID NO: 215149 - DNA, 25 bp, Mus musculus
attgattgtagagttcaggatggct

SEQ ID NO: 215150 - DNA, 25 bp, Mus musculus
attgcaaatgctgaaaaaggagtga

SEQ ID NO: 215151 - DNA, 25 bp, Mus musculus
attgcaaatgctgagtgaattatat

SEQ ID NO: 215152 - DNA, 25 bp, Mus musculus
attgcaactttgcggagatgatgat

SEQ ID NO: 215153 - DNA, 25 bp, Mus musculus
attgcaactttgcgggtgagatgga

SEQ ID NO: 215154 - DNA, 25 bp, Mus musculus
attgcaagcaaggggaagggaggag

SEQ ID NO: 215155 - DNA, 25 bp, Mus musculus
attgcacaaacaggagagcaacctt

SEQ ID NO: 215156 - DNA, 25 bp, Mus musculus
attgcacaaacgggagagcaacctt

SEQ ID NO: 215157 - DNA, 25 bp, Mus musculus
attgcacaaagaaagcaactgggac

SEQ ID NO: 215158 - DNA, 25 bp, Mus musculus
attgcacacagaggaaagaaaatac

SEQ ID NO: 215159 - DNA, 25 bp, Mus musculus
attgcacacagttttggtttctccc

SEQ ID NO: 215160 - DNA, 25 bp, Mus musculus
attgcacatttgaagacatgctcca

SEQ ID NO: 215161 - DNA, 25 bp, Mus musculus
attgcaccagatcacagaactgtgt

SEQ ID NO: 215162 - DNA, 25 bp, Mus musculus
attgcaccaggatctttctcaagtg

SEQ ID NO: 215163 - DNA, 25 bp, Mus musculus
attgcaccaggtgatgttattgtag

SEQ ID NO: 215164 - DNA, 25 bp, Mus musculus
attgcacctatagatggcattcgct

SEQ ID NO: 215165 - DNA, 25 bp, Mus musculus
attgcacctatagtgtctataatat

SEQ ID NO: 215166 - DNA, 25 bp, Mus musculus
attgcacctgtccaggcgtttcttt

SEQ ID NO: 215167 - DNA, 25 bp, Mus musculus
attgcacggcagattacaaaagaag

SEQ ID NO: 215168 - DNA, 25 bp, Mus musculus
attgcagaaacagacatggcaagtg

SEQ ID NO: 215169 - DNA, 25 bp, Mus musculus
attgcagaagggagagagtggctag

SEQ ID NO: 215170 - DNA, 25 bp, Mus musculus
attgcagaaggtgcacatcagggag

SEQ ID NO: 215171 - DNA, 25 bp, Mus musculus
attgcagacctgggactggctgtga

SEQ ID NO: 215172 - DNA, 25 bp, Mus musculus
attgcagaggatttttgcagctcaa

SEQ ID NO: 215173 - DNA, 25 bp, Mus musculus
attgcagaggggctacatgacactg

SEQ ID NO: 215174 - DNA, 25 bp, Mus musculus
attgcagatctgataaaaagagcaa

SEQ ID NO: 215175 - DNA, 25 bp, Mus musculus
attgcagcagcattagattgtcttc

SEQ ID NO: 215176 - DNA, 25 bp, Mus musculus
attgcagtctgtgatgctcccaatg

SEQ ID NO: 215177 - DNA, 25 bp, Mus musculus
attgcatagggtaaatgagaaaaca

SEQ ID NO: 215178 - DNA, 25 bp, Mus musculus
attgcatctttatggaaagagtatg

SEQ ID NO: 215179 - DNA, 25 bp, Mus musculus
attgcattaggaaagaatgtttcca

SEQ ID NO: 215180 - DNA, 25 bp, Mus musculus
attgcattctacaggcggcagaaac

SEQ ID NO: 215181 - DNA, 25 bp, Mus musculus
attgccaaagaagattcccagcgac

SEQ ID NO: 215182 - DNA, 25 bp, Mus musculus
attgccaaagaagctcctatgctgt

SEQ ID NO: 215183 - DNA, 25 bp, Mus musculus
attgccaaagaggagatatttggac

SEQ ID NO: 215184 - DNA, 25 bp, Mus musculus
attgccaaagatactgatcaatggg

SEQ ID NO: 215185 - DNA, 25 bp, Mus musculus
attgccaaagctagttatgaacaat

SEQ ID NO: 215186 - DNA, 25 bp, Mus musculus
attgccaaagctgcgtctttgcctt

SEQ ID NO: 215187 - DNA, 25 bp, Mus musculus
attgccaaatgcaagctgtgcattg

SEQ ID NO: 215188 - DNA, 25 bp, Mus musculus
attgccaaccagacgtaccaccaga

SEQ ID NO: 215189 - DNA, 25 bp, Mus musculus
attgccaacccagtgaactccacca

SEQ ID NO: 215190 - DNA, 25 bp, Mus musculus
attgccaactggtgctctgttgccg

SEQ ID NO: 215191 - DNA, 25 bp, Mus musculus
attgccaagaacggtatttgaatat

SEQ ID NO: 215192 - DNA, 25 bp, Mus musculus
attgccaagcaaggaagcctgctga

SEQ ID NO: 215193 - DNA, 25 bp, Mus musculus
attgccaagtataaaggagaagaca

SEQ ID NO: 215194 - DNA, 25 bp, Mus musculus
attgccaataaagttctttgtgatg

SEQ ID NO: 215195 - DNA, 25 bp, Mus musculus
attgccaataaatcagagtcctcat

SEQ ID NO: 215196 - DNA, 25 bp, Mus musculus
attgccaatggtgcagccggatgtg

SEQ ID NO: 215197 - DNA, 25 bp, Mus musculus
attgccagaaagagaaatgctttga

SEQ ID NO: 215198 - DNA, 25 bp, Mus musculus
attgccagaatggaccatctgcgac

SEQ ID NO: 215199 - DNA, 25 bp, Mus musculus
attgccagagaaggaacatggcttc

SEQ ID NO: 215200 - DNA, 25 bp, Mus musculus
attgccagagatccttgtgtgtgtg

SEQ ID NO: 215201 - DNA, 25 bp, Mus musculus
attgccagaggcatgaatcctacaa

SEQ ID NO: 215202 - DNA, 25 bp, Mus musculus
attgccagcttcctgcttcagtaac

SEQ ID NO: 215203 - DNA, 25 bp, Mus musculus
attgccagtgactacaaatacaaag

SEQ ID NO: 215204 - DNA, 25 bp, Mus musculus
attgccagtgatatacatggagatg

SEQ ID NO: 215205 - DNA, 25 bp, Mus musculus
attgccataaaggtgacaaatggat

SEQ ID NO: 215206 - DNA, 25 bp, Mus musculus
attgccatggaccgctcctttgacg

SEQ ID NO: 215207 - DNA, 25 bp, Mus musculus
attgcccaagaacaaacctgtgatg

SEQ ID NO: 215208 - DNA, 25 bp, Mus musculus
attgcccaagagttaaccagcttat

SEQ ID NO: 215209 - DNA, 25 bp, Mus musculus
attgcccaaggacctgagcccaacc

SEQ ID NO: 215210 - DNA, 25 bp, Mus musculus
attgcccaaggtaataatcttcagt

SEQ ID NO: 215211 - DNA, 25 bp, Mus musculus
attgcccaagtcaaagtaaacaaat

SEQ ID NO: 215212 - DNA, 25 bp, Mus musculus
attgcccaatgagctgctaagtcgc

SEQ ID NO: 215213 - DNA, 25 bp, Mus musculus
attgcccatctcaaagaaaaaatgg

SEQ ID NO: 215214 - DNA, 25 bp, Mus musculus
attgcccatctcagagaggaaactg

SEQ ID NO: 215215 - DNA, 25 bp, Mus musculus
attgccccccgatctagtgttgaca

SEQ ID NO: 215216 - DNA, 25 bp, Mus musculus
attgccccctttcatacctgctact

SEQ ID NO: 215217 - DNA, 25 bp, Mus musculus
attgcccctgcaaagataccgaagc

SEQ ID NO: 215218 - DNA, 25 bp, Mus musculus
attgcccctgcaaaggttttccatc

SEQ ID NO: 215219 - DNA, 25 bp, Mus musculus
attgcccgcaattgggcagatgcac

SEQ ID NO: 215220 - DNA, 25 bp, Mus musculus
attgccctcacgatcaacaaggcag

SEQ ID NO: 215221 - DNA, 25 bp, Mus musculus
attgccctcacgcataaaaataaga

SEQ ID NO: 215222 - DNA, 25 bp, Mus musculus
attgccctcatttgagaacaagact

SEQ ID NO: 215223 - DNA, 25 bp, Mus musculus
attgccctgagaattcatataaacc

SEQ ID NO: 215224 - DNA, 25 bp, Mus musculus
attgccctgagagagaattctgtga

SEQ ID NO: 215225 - DNA, 25 bp, Mus musculus
attgccgatgccagatgagacatcg

SEQ ID NO: 215226 - DNA, 25 bp, Mus musculus
attgccgcaggaacaccccaattcc

SEQ ID NO: 215227 - DNA, 25 bp, Mus musculus
attgccgcaggggtgatgtttataa

SEQ ID NO: 215228 - DNA, 25 bp, Mus musculus
attgccgcccaggactgctcctgcc

SEQ ID NO: 215229 - DNA, 25 bp, Mus musculus
attgccggaacgagccatggaccct

SEQ ID NO: 215230 - DNA, 25 bp, Mus musculus
attgccggaacgaggcttcatctac

SEQ ID NO: 215231 - DNA, 25 bp, Mus musculus
attgccgggagccaccatgttcaac

SEQ ID NO: 215232 - DNA, 25 bp, Mus musculus
attgccgggagctgaccggaagaac

SEQ ID NO: 215233 - DNA, 25 bp, Mus musculus
attgccgtgaaagaaaccggctctg

SEQ ID NO: 215234 - DNA, 25 bp, Mus musculus
attgccgtgaaaggctcagcggctg

SEQ ID NO: 215235 - DNA, 25 bp, Mus musculus
attgccgtgcaggcagccagctcca

SEQ ID NO: 215236 - DNA, 25 bp, Mus musculus
attgcctacagattgtctgtgattg

SEQ ID NO: 215237 - DNA, 25 bp, Mus musculus
attgcctcagcaactatcagaccta

SEQ ID NO: 215238 - DNA, 25 bp, Mus musculus
attgcctcagcctctccaaccccgg

SEQ ID NO: 215239 - DNA, 25 bp, Mus musculus
attgcctccagatgccttacagcac

SEQ ID NO: 215240 - DNA, 25 bp, Mus musculus
attgcctcttctagtctcaacagat

SEQ ID NO: 215241 - DNA, 25 bp, Mus musculus
attgcctggaaggttgagattgaga

SEQ ID NO: 215242 - DNA, 25 bp, Mus musculus
attgccttagccaagagctgtcccg

SEQ ID NO: 215243 - DNA, 25 bp, Mus musculus
attgccttcaaagacctactgaaag

SEQ ID NO: 215244 - DNA, 25 bp, Mus musculus
attgccttcaaggacctactgaaag

SEQ ID NO: 215245 - DNA, 25 bp, Mus musculus
attgccttttcccagtgttgtgcag

SEQ ID NO: 215246 - DNA, 25 bp, Mus musculus
attgccttttgtcagggattcgata

SEQ ID NO: 215247 - DNA, 25 bp, Mus musculus
attgcgatttggaataattgatgtg

SEQ ID NO: 215248 - DNA, 25 bp, Mus musculus
attgcgatttggaatattcgatgtt

SEQ ID NO: 215249 - DNA, 25 bp, Mus musculus
attgcgctacaggggcgggacaaag

SEQ ID NO: 215250 - DNA, 25 bp, Mus musculus
attgcgggtctcacgatctttggca

SEQ ID NO: 215251 - DNA, 25 bp, Mus musculus
attgcgggtctcacggaactctgat

SEQ ID NO: 215252 - DNA, 25 bp, Mus musculus
attgcgtttctcccctgctcctctc

SEQ ID NO: 215253 - DNA, 25 bp, Mus musculus
attgctaacaggatgcccatcccag

SEQ ID NO: 215254 - DNA, 25 bp, Mus musculus
attgctaacaggggatcatgaggga

SEQ ID NO: 215255 - DNA, 25 bp, Mus musculus
attgctaactgaaatggcaaagaag

SEQ ID NO: 215256 - DNA, 25 bp, Mus musculus
attgctaactgccttgcagtgagag

SEQ ID NO: 215257 - DNA, 25 bp, Mus musculus
attgctaagaacaccagaaccgtgt

SEQ ID NO: 215258 - DNA, 25 bp, Mus musculus
attgctaagatggcagttgggttct

SEQ ID NO: 215259 - DNA, 25 bp, Mus musculus
attgctaagcccaaacttgcacgag

SEQ ID NO: 215260 - DNA, 25 bp, Mus musculus
attgctacaaaagatttaaagatga

SEQ ID NO: 215261 - DNA, 25 bp, Mus musculus
attgctacaaaagcagcagcaacag

SEQ ID NO: 215262 - DNA, 25 bp, Mus musculus
attgctacagagtacctgaactatg

SEQ ID NO: 215263 - DNA, 25 bp, Mus musculus
attgctacagctgcacagagcatcc

SEQ ID NO: 215264 - DNA, 25 bp, Mus musculus
attgctacagctgggctgggaggat

SEQ ID NO: 215265 - DNA, 25 bp, Mus musculus
attgctacaggaggatctaagatgt

SEQ ID NO: 215266 - DNA, 25 bp, Mus musculus
attgctacagggtggttatgctgcg

SEQ ID NO: 215267 - DNA, 25 bp, Mus musculus
attgctactgggggctacgggcgaa

SEQ ID NO: 215268 - DNA, 25 bp, Mus musculus
attgctatgaagttgaatctgcgtg

SEQ ID NO: 215269 - DNA, 25 bp, Mus musculus
attgctcaagaccccggcagcccaa

SEQ ID NO: 215270 - DNA, 25 bp, Mus musculus
attgctcaagagacattttaagtct

SEQ ID NO: 215271 - DNA, 25 bp, Mus musculus
attgctcaagagtcctaaacctgga

SEQ ID NO: 215272 - DNA, 25 bp, Mus musculus
attgctcaaggctgccttagacttg

SEQ ID NO: 215273 - DNA, 25 bp, Mus musculus
attgctcagaagaaacctgctcggt

SEQ ID NO: 215274 - DNA, 25 bp, Mus musculus
attgctcaggagcacagcgagctgg

SEQ ID NO: 215275 - DNA, 25 bp, Mus musculus
attgctcaggaggctttagaaaggc

SEQ ID NO: 215276 - DNA, 25 bp, Mus musculus
attgctccaagtaaggcccccatac

SEQ ID NO: 215277 - DNA, 25 bp, Mus musculus
attgctctaaagatgactgcttacg

SEQ ID NO: 215278 - DNA, 25 bp, Mus musculus
attgctctacagagtgagcctagga

SEQ ID NO: 215279 - DNA, 25 bp, Mus musculus
attgctctccagtccctgccgcctt

SEQ ID NO: 215280 - DNA, 25 bp, Mus musculus
attgctctgataagtatggaacaac

SEQ ID NO: 215281 - DNA, 25 bp, Mus musculus
attgctgaagatacgccaatgtcaa

SEQ ID NO: 215282 - DNA, 25 bp, Mus musculus
attgctgaaggaatttgagcagttt

SEQ ID NO: 215283 - DNA, 25 bp, Mus musculus
attgctgaccaaggagagagatggc

SEQ ID NO: 215284 - DNA, 25 bp, Mus musculus
attgctgaccaaggcattggaattg

SEQ ID NO: 215285 - DNA, 25 bp, Mus musculus
attgctgagcaagagatgcctgcct

SEQ ID NO: 215286 - DNA, 25 bp, Mus musculus
attgctgataagatctcccttgatc

SEQ ID NO: 215287 - DNA, 25 bp, Mus musculus
attgctgataagatgtctggtgaga

SEQ ID NO: 215288 - DNA, 25 bp, Mus musculus
attgctgatgctcggtgaaggaggt

SEQ ID NO: 215289 - DNA, 25 bp, Mus musculus
attgctgatgtaaagattttgctgg

SEQ ID NO: 215290 - DNA, 25 bp, Mus musculus
attgctgcagaaaatatggtggtca

SEQ ID NO: 215291 - DNA, 25 bp, Mus musculus
attgctgcagtgtgaaaaactcaaa

SEQ ID NO: 215292 - DNA, 25 bp, Mus musculus
attgctgccagcataagacagtgat

SEQ ID NO: 215293 - DNA, 25 bp, Mus musculus
attgctgcctgagggttaaaattct

SEQ ID NO: 215294 - DNA, 25 bp, Mus musculus
attgctgctcctagaagcgtgcaat

SEQ ID NO: 215295 - DNA, 25 bp, Mus musculus
attgctgctctgcgccaaggacact

SEQ ID NO: 215296 - DNA, 25 bp, Mus musculus
attgctgctgcaggttaccaacata

SEQ ID NO: 215297 - DNA, 25 bp, Mus musculus
attgctggggggaaaggctcaagcc

SEQ ID NO: 215298 - DNA, 25 bp, Mus musculus
attgctgtctctgaaaaatgaatct

SEQ ID NO: 215299 - DNA, 25 bp, Mus musculus
attgctgtggcactcagaaagaaga

SEQ ID NO: 215300 - DNA, 25 bp, Mus musculus
attgctgtgggagctgtgatggatg

SEQ ID NO: 215301 - DNA, 25 bp, Mus musculus
attgctgttaatactgtggatttct

SEQ ID NO: 215302 - DNA, 25 bp, Mus musculus
attgctgttaatagtgtcccttttc

SEQ ID NO: 215303 - DNA, 25 bp, Mus musculus
attgcttacaagattccgggcttta

SEQ ID NO: 215304 - DNA, 25 bp, Mus musculus
attgcttacaaggccacagtgaacg

SEQ ID NO: 215305 - DNA, 25 bp, Mus musculus
attgcttcaaccagggccagtccct

SEQ ID NO: 215306 - DNA, 25 bp, Mus musculus
attgcttccactctggtcagacatg

SEQ ID NO: 215307 - DNA, 25 bp, Mus musculus
attgcttctaatcaccaagccccgc

SEQ ID NO: 215308 - DNA, 25 bp, Mus musculus
attgcttctctgtggaataaatttg

SEQ ID NO: 215309 - DNA, 25 bp, Mus musculus
attgcttgccttccagacctatccc

SEQ ID NO: 215310 - DNA, 25 bp, Mus musculus
attgctttaaggacctgcaggaaga

SEQ ID NO: 215311 - DNA, 25 bp, Mus musculus
attgctttccagagacttcctgctt

SEQ ID NO: 215312 - DNA, 25 bp, Mus musculus
attgctttccagagcggaaacgggt

SEQ ID NO: 215313 - DNA, 25 bp, Mus musculus
attgctttcgtgaaggatgttttat

SEQ ID NO: 215314 - DNA, 25 bp, Mus musculus
attggaaaagaggtccttctgtagc

SEQ ID NO: 215315 - DNA, 25 bp, Mus musculus
attggaaaagataaataaagacaac

SEQ ID NO: 215316 - DNA, 25 bp, Mus musculus
attggaaaagatatgatgaggaatt

SEQ ID NO: 215317 - DNA, 25 bp, Mus musculus
attggaaaagcgcagcctggaggcc

SEQ ID NO: 215318 - DNA, 25 bp, Mus musculus
attggaaaaggaatcttctatttgg

SEQ ID NO: 215319 - DNA, 25 bp, Mus musculus
attggaaaatgaaagttgtaagcat

SEQ ID NO: 215320 - DNA, 25 bp, Mus musculus
attggaaacaagaatgcctacgaga

SEQ ID NO: 215321 - DNA, 25 bp, Mus musculus
attggaaacaggttcagacaatgaa

SEQ ID NO: 215322 - DNA, 25 bp, Mus musculus
attggaaagagaaaggtattaagtc

SEQ ID NO: 215323 - DNA, 25 bp, Mus musculus
attggaaatcaggtgattcgtaagg

SEQ ID NO: 215324 - DNA, 25 bp, Mus musculus
attggaaatggatctgctgcgaaag

SEQ ID NO: 215325 - DNA, 25 bp, Mus musculus
attggaacaaaattctcagatcgga

SEQ ID NO: 215326 - DNA, 25 bp, Mus musculus
attggaactgaggatttctcagctg

SEQ ID NO: 215327 - DNA, 25 bp, Mus musculus
attggaagaaaggtggtggtgtcaa

SEQ ID NO: 215328 - DNA, 25 bp, Mus musculus
attggaagaaatcaagaagttggtg

SEQ ID NO: 215329 - DNA, 25 bp, Mus musculus
attggaagaagaatgaagacctgaa

SEQ ID NO: 215330 - DNA, 25 bp, Mus musculus
attggaagagcaggggaaggaagcc

SEQ ID NO: 215331 - DNA, 25 bp, Mus musculus
attggaagagtgtatcctcagagat

SEQ ID NO: 215332 - DNA, 25 bp, Mus musculus
attggaagcatagaaggcctactca

SEQ ID NO: 215333 - DNA, 25 bp, Mus musculus
attggaagccaagatttcctggcca

SEQ ID NO: 215334 - DNA, 25 bp, Mus musculus
attggaagccaagggtgtaaattcc

SEQ ID NO: 215335 - DNA, 25 bp, Mus musculus
attggaatcaggtggacagcagcaa

SEQ ID NO: 215336 - DNA, 25 bp, Mus musculus
attggaatgaaggctcagatccgat

SEQ ID NO: 215337 - DNA, 25 bp, Mus musculus
attggaatgaccgagagtgggaccg

SEQ ID NO: 215338 - DNA, 25 bp, Mus musculus
attggaattggtggtgtgacaaacg

SEQ ID NO: 215339 - DNA, 25 bp, Mus musculus
attggacaagaggtgcaccatggag

SEQ ID NO: 215340 - DNA, 25 bp, Mus musculus
attggacacgctatggcaatcttta

SEQ ID NO: 215341 - DNA, 25 bp, Mus musculus
attggaccactcaaatgggcatagg

SEQ ID NO: 215342 - DNA, 25 bp, Mus musculus
attggaccagttttcagagctgaag

SEQ ID NO: 215343 - DNA, 25 bp, Mus musculus
attggactcaagcggatagccaagg

SEQ ID NO: 215344 - DNA, 25 bp, Mus musculus
attggactcgagctcagagctctgg

SEQ ID NO: 215345 - DNA, 25 bp, Mus musculus
attggactcgagtgtgacagttgtg

SEQ ID NO: 215346 - DNA, 25 bp, Mus musculus
attggactgcagactgccgaataca

SEQ ID NO: 215347 - DNA, 25 bp, Mus musculus
attggactgcagactggcatccgtc

SEQ ID NO: 215348 - DNA, 25 bp, Mus musculus
attggacttgcaagctctttacagt

SEQ ID NO: 215349 - DNA, 25 bp, Mus musculus
attggacttgcaagtctctttacag

SEQ ID NO: 215350 - DNA, 25 bp, Mus musculus
attggagccaggcaggtgcagtcta

SEQ ID NO: 215351 - DNA, 25 bp, Mus musculus
attggagccaggtacgtacagacgc

SEQ ID NO: 215352 - DNA, 25 bp, Mus musculus
attggagctcaaccacttcggatat

SEQ ID NO: 215353 - DNA, 25 bp, Mus musculus
attggagctcaaggagtgtctagcc

SEQ ID NO: 215354 - DNA, 25 bp, Mus musculus
attggagctgggaagccctggcaca

SEQ ID NO: 215355 - DNA, 25 bp, Mus musculus
attggaggaataaacattgctgagg

SEQ ID NO: 215356 - DNA, 25 bp, Mus musculus
attggaggagagagaatgactctgt

SEQ ID NO: 215357 - DNA, 25 bp, Mus musculus
attggaggagagaggtacaatttct

SEQ ID NO: 215358 - DNA, 25 bp, Mus musculus
attggaggatttgaggcctacctag

SEQ ID NO: 215359 - DNA, 25 bp, Mus musculus
attggaggctataaggtacgaaacc

SEQ ID NO: 215360 - DNA, 25 bp, Mus musculus
attggaggctataaggtccccaggg

SEQ ID NO: 215361 - DNA, 25 bp, Mus musculus
attggagtgacaggtcctttcccat

SEQ ID NO: 215362 - DNA, 25 bp, Mus musculus
attggataagaccaccgctcttgat

SEQ ID NO: 215363 - DNA, 25 bp, Mus musculus
attggataaggaggatttcagggtc

SEQ ID NO: 215364 - DNA, 25 bp, Mus musculus
attggatcccaaaattcccagttaa

SEQ ID NO: 215365 - DNA, 25 bp, Mus musculus
attggatccctctgtgcactgagca

SEQ ID NO: 215366 - DNA, 25 bp, Mus musculus
attggatccctctgttttgccattg

SEQ ID NO: 215367 - DNA, 25 bp, Mus musculus
attggatcttctgcgtgctggtcca

SEQ ID NO: 215368 - DNA, 25 bp, Mus musculus
attggatcttttgggatgactggct

SEQ ID NO: 215369 - DNA, 25 bp, Mus musculus
attggatgcacacgagtatgagttc

SEQ ID NO: 215370 - DNA, 25 bp, Mus musculus
attggatgcacaggagtatgagttc

SEQ ID NO: 215371 - DNA, 25 bp, Mus musculus
attggattccgccattgatcttatc

SEQ ID NO: 215372 - DNA, 25 bp, Mus musculus
attggatttgccaactgtttctata

SEQ ID NO: 215373 - DNA, 25 bp, Mus musculus
attggatttgccaagaggagctctg

SEQ ID NO: 215374 - DNA, 25 bp, Mus musculus
attggatttgccaatgcccagcaga

SEQ ID NO: 215375 - DNA, 25 bp, Mus musculus
attggcaaaaccaggtgcagatccc

SEQ ID NO: 215376 - DNA, 25 bp, Mus musculus
attggcaacagacctgcctggagtt

SEQ ID NO: 215377 - DNA, 25 bp, Mus musculus
attggcaacagttggaacgctatct

SEQ ID NO: 215378 - DNA, 25 bp, Mus musculus
attggcaagcagtggtgacgtatgc

SEQ ID NO: 215379 - DNA, 25 bp, Mus musculus
attggcacacactggttctggattt

SEQ ID NO: 215380 - DNA, 25 bp, Mus musculus
attggcacagaggctcagatccgat

SEQ ID NO: 215381 - DNA, 25 bp, Mus musculus
attggcacagcagttccgcagagga

SEQ ID NO: 215382 - DNA, 25 bp, Mus musculus
attggcacctggggtggaggcaggg

SEQ ID NO: 215383 - DNA, 25 bp, Mus musculus
attggcagacccgagttgaaaaatc

SEQ ID NO: 215384 - DNA, 25 bp, Mus musculus
attggcagacttcttctcctcggac

SEQ ID NO: 215385 - DNA, 25 bp, Mus musculus
attggcagagaagcttaagtgtgat

SEQ ID NO: 215386 - DNA, 25 bp, Mus musculus
attggcagagaaggcagtattgcaa

SEQ ID NO: 215387 - DNA, 25 bp, Mus musculus
attggcaggctgcaggagctcttag

SEQ ID NO: 215388 - DNA, 25 bp, Mus musculus
attggcaggctgcaggtaactagtt

SEQ ID NO: 215389 - DNA, 25 bp, Mus musculus
attggcagtgcaggggtacgcacgc

SEQ ID NO: 215390 - DNA, 25 bp, Mus musculus
attggccaacaaggtcgtatacaac

SEQ ID NO: 215391 - DNA, 25 bp, Mus musculus
attggccagcctggcacggatgctt

SEQ ID NO: 215392 - DNA, 25 bp, Mus musculus
attggccatgctctgcatgcccatg

SEQ ID NO: 215393 - DNA, 25 bp, Mus musculus
attggccatgtgttcaagcgctgtc

SEQ ID NO: 215394 - DNA, 25 bp, Mus musculus
attggccgagagatgaaaaatgata

SEQ ID NO: 215395 - DNA, 25 bp, Mus musculus
attggccgagaggcaagaagagagg

SEQ ID NO: 215396 - DNA, 25 bp, Mus musculus
attggccgggctggtccctctgtca

SEQ ID NO: 215397 - DNA, 25 bp, Mus musculus
attggccggtacaagcttcctgaca

SEQ ID NO: 215398 - DNA, 25 bp, Mus musculus
attggcctgctgaggactggctgcc

SEQ ID NO: 215399 - DNA, 25 bp, Mus musculus
attggcctggcaggcccttttagct

SEQ ID NO: 215400 - DNA, 25 bp, Mus musculus
attggccttcaaatctgcagaagaa

SEQ ID NO: 215401 - DNA, 25 bp, Mus musculus
attggccttcagaatacccggaggc

SEQ ID NO: 215402 - DNA, 25 bp, Mus musculus
attggcgaccttcagggaaaatgcc

SEQ ID NO: 215403 - DNA, 25 bp, Mus musculus
attggcgcaccactctcaagctgac

SEQ ID NO: 215404 - DNA, 25 bp, Mus musculus
attggcggaggagataggcgtttct

SEQ ID NO: 215405 - DNA, 25 bp, Mus musculus
attggcggaggtgtggacctcgttt

SEQ ID NO: 215406 - DNA, 25 bp, Mus musculus
attggcgtcccccatccacctgacg

SEQ ID NO: 215407 - DNA, 25 bp, Mus musculus
attggcgtgagcggaggctgctgaa

SEQ ID NO: 215408 - DNA, 25 bp, Mus musculus
attggcgttttagtgaacaacgtgg

SEQ ID NO: 215409 - DNA, 25 bp, Mus musculus
attggctactgccaggcaatgaaca

SEQ ID NO: 215410 - DNA, 25 bp, Mus musculus
attggctatcaggatgactttctgc

SEQ ID NO: 215411 - DNA, 25 bp, Mus musculus
attggctatgccagctcttctccta

SEQ ID NO: 215412 - DNA, 25 bp, Mus musculus
attggctatgccaggaacccatctc

SEQ ID NO: 215413 - DNA, 25 bp, Mus musculus
attggctattagagccagatcatct

SEQ ID NO: 215414 - DNA, 25 bp, Mus musculus
attggctattagagtgtgctcaaga

SEQ ID NO: 215415 - DNA, 25 bp, Mus musculus
attggctcaatacggttattactct

SEQ ID NO: 215416 - DNA, 25 bp, Mus musculus
attggctccagagctctctgtggtt

SEQ ID NO: 215417 - DNA, 25 bp, Mus musculus
attggctcctccagggtccggtact

SEQ ID NO: 215418 - DNA, 25 bp, Mus musculus
attggctcctccaggtgtttgtggt

SEQ ID NO: 215419 - DNA, 25 bp, Mus musculus
attggctcttaggtaagaagacaag

SEQ ID NO: 215420 - DNA, 25 bp, Mus musculus
attggctgagctccccttggctagg

SEQ ID NO: 215421 - DNA, 25 bp, Mus musculus
attggctgccagtagataaaagatc

SEQ ID NO: 215422 - DNA, 25 bp, Mus musculus
attggctgccagtcttcaattagtg

SEQ ID NO: 215423 - DNA, 25 bp, Mus musculus
attggctgctttgcggactttgaat

SEQ ID NO: 215424 - DNA, 25 bp, Mus musculus
attggctgctttgcggtactggaat

SEQ ID NO: 215425 - DNA, 25 bp, Mus musculus
attggctggaccagatgcggtgagc

SEQ ID NO: 215426 - DNA, 25 bp, Mus musculus
attggctgtagtttccagagtctga

SEQ ID NO: 215427 - DNA, 25 bp, Mus musculus
attggcttccctgagatcctgttca

SEQ ID NO: 215428 - DNA, 25 bp, Mus musculus
attggcttgaaggatgctcagattg

SEQ ID NO: 215429 - DNA, 25 bp, Mus musculus
attggcttgccccggggacagacca

SEQ ID NO: 215430 - DNA, 25 bp, Mus musculus
attgggaaggtggccttagtagaag

SEQ ID NO: 215431 - DNA, 25 bp, Mus musculus
attgggaatagaaggctatcctacc

SEQ ID NO: 215432 - DNA, 25 bp, Mus musculus
attgggacagacacaggaattgtgc

SEQ ID NO: 215433 - DNA, 25 bp, Mus musculus
attgggagatacagggcatggatgg

SEQ ID NO: 215434 - DNA, 25 bp, Mus musculus
attgggagctccagtggcagtgggg

SEQ ID NO: 215435 - DNA, 25 bp, Mus musculus
attgggataacagttcccaaagtgg

SEQ ID NO: 215436 - DNA, 25 bp, Mus musculus
attgggattccaggcatagtcagac

SEQ ID NO: 215437 - DNA, 25 bp, Mus musculus
attgggcacctcgagaagcctgtac

SEQ ID NO: 215438 - DNA, 25 bp, Mus musculus
attgggcacctcgattgcagcccgg

SEQ ID NO: 215439 - DNA, 25 bp, Mus musculus
attgggctaggaaggttctgtttgt

SEQ ID NO: 215440 - DNA, 25 bp, Mus musculus
attgggctctatgaaccagacttgg

SEQ ID NO: 215441 - DNA, 25 bp, Mus musculus
attgggctgccgaatgaaaaggtgc

SEQ ID NO: 215442 - DNA, 25 bp, Mus musculus
attgggctgccgactaggatgaagg

SEQ ID NO: 215443 - DNA, 25 bp, Mus musculus
attgggctgccgactatcaagaatg

SEQ ID NO: 215444 - DNA, 25 bp, Mus musculus
attgggctgccgactatggaaatcc

SEQ ID NO: 215445 - DNA, 25 bp, Mus musculus
attgggctgccgactggacccagct

SEQ ID NO: 215446 - DNA, 25 bp, Mus musculus
attgggctgccgactggtcaatata

SEQ ID NO: 215447 - DNA, 25 bp, Mus musculus
attgggctgccgactgtgtccatgt

SEQ ID NO: 215448 - DNA, 25 bp, Mus musculus
attgggctgctgactcctctgcagg

SEQ ID NO: 215449 - DNA, 25 bp, Mus musculus
attgggctgctgactgtgtcaacaa

SEQ ID NO: 215450 - DNA, 25 bp, Mus musculus
attggggaagcgagccctgaagaca

SEQ ID NO: 215451 - DNA, 25 bp, Mus musculus
attggggaagcggtaggtgcacgcc

SEQ ID NO: 215452 - DNA, 25 bp, Mus musculus
attggggacacggcatcctttgaag

SEQ ID NO: 215453 - DNA, 25 bp, Mus musculus
attggggagagtgaggctcaggcca

SEQ ID NO: 215454 - DNA, 25 bp, Mus musculus
attggggagggttttgaatcctgta

SEQ ID NO: 215455 - DNA, 25 bp, Mus musculus
attggggataaagtgtactggaatt

SEQ ID NO: 215456 - DNA, 25 bp, Mus musculus
attggggcaggaagtgtcgagtggc

SEQ ID NO: 215457 - DNA, 25 bp, Mus musculus
attgggggaggtcagatgtctctct

SEQ ID NO: 215458 - DNA, 25 bp, Mus musculus
attgggggcagcaactcttacaaag

SEQ ID NO: 215459 - DNA, 25 bp, Mus musculus
attgggtacccagttgcacaacctg

SEQ ID NO: 215460 - DNA, 25 bp, Mus musculus
attgggtacttaatgagttccgatc

SEQ ID NO: 215461 - DNA, 25 bp, Mus musculus
attggtaagttccctgctatcaatg

SEQ ID NO: 215462 - DNA, 25 bp, Mus musculus
attggtagcagatttcttagatttt

SEQ ID NO: 215463 - DNA, 25 bp, Mus musculus
attggtccctacagtcaagctgtgc

SEQ ID NO: 215464 - DNA, 25 bp, Mus musculus
attggtcctcatctctccaggcgtc

SEQ ID NO: 215465 - DNA, 25 bp, Mus musculus
attggtcctggctctgtctgtacaa

SEQ ID NO: 215466 - DNA, 25 bp, Mus musculus
attggtctcatctgccatggtgacc

SEQ ID NO: 215467 - DNA, 25 bp, Mus musculus
attggtctcatctgtctgcaatcct

SEQ ID NO: 215468 - DNA, 25 bp, Mus musculus
attggtgatgttatctatgcgggtg

SEQ ID NO: 215469 - DNA, 25 bp, Mus musculus
attggtgcaggagaatttggagaag

SEQ ID NO: 215470 - DNA, 25 bp, Mus musculus
attggtgccaagaagatgcacgacg

SEQ ID NO: 215471 - DNA, 25 bp, Mus musculus
attggtgttaaaaagacatgttttt

SEQ ID NO: 215472 - DNA, 25 bp, Mus musculus
attggtgttaaaaagtttatgatca

SEQ ID NO: 215473 - DNA, 25 bp, Mus musculus
attggttactttatctgcacaaaca

SEQ ID NO: 215474 - DNA, 25 bp, Mus musculus
attggttatgccagaaacccttcac

SEQ ID NO: 215475 - DNA, 25 bp, Mus musculus
attggttatgtcacaaacataaacc

SEQ ID NO: 215476 - DNA, 25 bp, Mus musculus
attggttatgtggcagcagaagaag

SEQ ID NO: 215477 - DNA, 25 bp, Mus musculus
attggttcaaggagtcctttgggag

SEQ ID NO: 215478 - DNA, 25 bp, Mus musculus
attggttgggataaactcgcatgtg

SEQ ID NO: 215479 - DNA, 25 bp, Mus musculus
attggttgtgcccatcttttgatac

SEQ ID NO: 215480 - DNA, 25 bp, Mus musculus
attggttgtggccatcttttgatac

SEQ ID NO: 215481 - DNA, 25 bp, Mus musculus
attggtttaagtgctgtgaagagct

SEQ ID NO: 215482 - DNA, 25 bp, Mus musculus
attggtttacagtccctggatgacg

SEQ ID NO: 215483 - DNA, 25 bp, Mus musculus
attggtttctcctgggctgcaagcc

SEQ ID NO: 215484 - DNA, 25 bp, Mus musculus
attgtaaaccggaagaagttcagag

SEQ ID NO: 215485 - DNA, 25 bp, Mus musculus
attgtaaagggtctcctgtgagcag

SEQ ID NO: 215486 - DNA, 25 bp, Mus musculus
attgtaacagaatccgaatcttgaa

SEQ ID NO: 215487 - DNA, 25 bp, Mus musculus
attgtaactctggttttcttatccg

SEQ ID NO: 215488 - DNA, 25 bp, Mus musculus
attgtaagaaaagtgatgctgcatc

SEQ ID NO: 215489 - DNA, 25 bp, Mus musculus
attgtaagcggacatcagaaaagtt

SEQ ID NO: 215490 - DNA, 25 bp, Mus musculus
attgtacagaagctgttgcaataca

SEQ ID NO: 215491 - DNA, 25 bp, Mus musculus
attgtacagaaggacctggtggcta

SEQ ID NO: 215492 - DNA, 25 bp, Mus musculus
attgtacagaggcctatggatttgt

SEQ ID NO: 215493 - DNA, 25 bp, Mus musculus
attgtacagagggatgaaatgcaga

SEQ ID NO: 215494 - DNA, 25 bp, Mus musculus
attgtagaaaactgtggtgtcatgg

SEQ ID NO: 215495 - DNA, 25 bp, Mus musculus
attgtagaacttcaatgcaggaggc

SEQ ID NO: 215496 - DNA, 25 bp, Mus musculus
attgtagaagctggtgggatgcagg

SEQ ID NO: 215497 - DNA, 25 bp, Mus musculus
attgtagacaggtactggcatagca

SEQ ID NO: 215498 - DNA, 25 bp, Mus musculus
attgtagcaaggtatggtgcggatg

SEQ ID NO: 215499 - DNA, 25 bp, Mus musculus
attgtagctgaggttcgttccacca

SEQ ID NO: 215500 - DNA, 25 bp, Mus musculus
attgtaggagcagtttctccacctg

SEQ ID NO: 215501 - DNA, 25 bp, Mus musculus
attgtatacaaaagcacaaaaggca

SEQ ID NO: 215502 - DNA, 25 bp, Mus musculus
attgtatacaaaagtcaggttttca

SEQ ID NO: 215503 - DNA, 25 bp, Mus musculus
attgtatcaaaatttctatgaggag

SEQ ID NO: 215504 - DNA, 25 bp, Mus musculus
attgtattagagggaattctgcctt

SEQ ID NO: 215505 - DNA, 25 bp, Mus musculus
attgtattagaggttcataagccag

SEQ ID NO: 215506 - DNA, 25 bp, Mus musculus
attgtattagaggttggcaggaagg

SEQ ID NO: 215507 - DNA, 25 bp, Mus musculus
attgtatttacagatttatgacatt

SEQ ID NO: 215508 - DNA, 25 bp, Mus musculus
attgtatttacaggatcttgctgca

SEQ ID NO: 215509 - DNA, 25 bp, Mus musculus
attgtattttaggtacattttatga

SEQ ID NO: 215510 - DNA, 25 bp, Mus musculus
attgtcaagtacgagctttatggcc

SEQ ID NO: 215511 - DNA, 25 bp, Mus musculus
attgtcacaagcagtcatgaaagtc

SEQ ID NO: 215512 - DNA, 25 bp, Mus musculus
attgtcacaagcagtctgaccaagg

SEQ ID NO: 215513 - DNA, 25 bp, Mus musculus
attgtcactggggtgcggctaccag

SEQ ID NO: 215514 - DNA, 25 bp, Mus musculus
attgtcactgggttttacctgctgc

SEQ ID NO: 215515 - DNA, 25 bp, Mus musculus
attgtcagcaagcttcaggagctct

SEQ ID NO: 215516 - DNA, 25 bp, Mus musculus
attgtcagcaggttgatgcaagttg

SEQ ID NO: 215517 - DNA, 25 bp, Mus musculus
attgtcagttgggaaattcctaaat

SEQ ID NO: 215518 - DNA, 25 bp, Mus musculus
attgtcatcggttcgatttggggat

SEQ ID NO: 215519 - DNA, 25 bp, Mus musculus
attgtcatcggttcggcgtaatagc

SEQ ID NO: 215520 - DNA, 25 bp, Mus musculus
attgtcattccagggatcttcattg

SEQ ID NO: 215521 - DNA, 25 bp, Mus musculus
attgtccacacccagatgaagttgc

SEQ ID NO: 215522 - DNA, 25 bp, Mus musculus
attgtccagatcaggatgactcttt

SEQ ID NO: 215523 - DNA, 25 bp, Mus musculus
attgtccagatcagtaggtgcaaac

SEQ ID NO: 215524 - DNA, 25 bp, Mus musculus
attgtcccagaacaatattgctgcc

SEQ ID NO: 215525 - DNA, 25 bp, Mus musculus
attgtccgaaatctgcttcttgcag

SEQ ID NO: 215526 - DNA, 25 bp, Mus musculus
attgtccgatgccatgaacacatag

SEQ ID NO: 215527 - DNA, 25 bp, Mus musculus
attgtccgtgcaaaactggtgaaca

SEQ ID NO: 215528 - DNA, 25 bp, Mus musculus
attgtccttgattggctctttgtgg

SEQ ID NO: 215529 - DNA, 25 bp, Mus musculus
attgtccttggcaggacctcagaag

SEQ ID NO: 215530 - DNA, 25 bp, Mus musculus
attgtccttgtttatgctgctggca

SEQ ID NO: 215531 - DNA, 25 bp, Mus musculus
attgtcctttcatgtaaatttacat

SEQ ID NO: 215532 - DNA, 25 bp, Mus musculus
attgtcgatgaggtccatgagagaa

SEQ ID NO: 215533 - DNA, 25 bp, Mus musculus
attgtcgcaaagagctcaccgagct

SEQ ID NO: 215534 - DNA, 25 bp, Mus musculus
attgtcgcaaagagggtttctctgt

SEQ ID NO: 215535 - DNA, 25 bp, Mus musculus
attgtcgcaaagagtgtggggagac

SEQ ID NO: 215536 - DNA, 25 bp, Mus musculus
attgtcgttggcttcctgcctggtg

SEQ ID NO: 215537 - DNA, 25 bp, Mus musculus
attgtctaccaacgataaaacaata

SEQ ID NO: 215538 - DNA, 25 bp, Mus musculus
attgtctactggtgcattgaagatc

SEQ ID NO: 215539 - DNA, 25 bp, Mus musculus
attgtctatgagtttctgatgtctg

SEQ ID NO: 215540 - DNA, 25 bp, Mus musculus
attgtctcaaagaacttttgagcag

SEQ ID NO: 215541 - DNA, 25 bp, Mus musculus
attgtctcatccctgctcctgtctc

SEQ ID NO: 215542 - DNA, 25 bp, Mus musculus
attgtctggagatggctgcagcaac

SEQ ID NO: 215543 - DNA, 25 bp, Mus musculus
attgtcttcagagattttcacagct

SEQ ID NO: 215544 - DNA, 25 bp, Mus musculus
attgtcttcctagccacgagtctag

SEQ ID NO: 215545 - DNA, 25 bp, Mus musculus
attgtcttctgggtgctgggagccc

SEQ ID NO: 215546 - DNA, 25 bp, Mus musculus
attgtcttctggttctctgtgttcc

SEQ ID NO: 215547 - DNA, 25 bp, Mus musculus
attgtcttgagctggaagccggttc

SEQ ID NO: 215548 - DNA, 25 bp, Mus musculus
attgtcttgagctggcccatcatgg

SEQ ID NO: 215549 - DNA, 25 bp, Mus musculus
attgtctttccagcttctcctggtc

SEQ ID NO: 215550 - DNA, 25 bp, Mus musculus
attgtctttccagggagctcccgtc

SEQ ID NO: 215551 - DNA, 25 bp, Mus musculus
attgtgaaaacattcgtatagctaa

SEQ ID NO: 215552 - DNA, 25 bp, Mus musculus
attgtgaaagaggtcctgtaataaa

SEQ ID NO: 215553 - DNA, 25 bp, Mus musculus
attgtgaaagctcgtccctgcccag

SEQ ID NO: 215554 - DNA, 25 bp, Mus musculus
attgtgaaagggcagcggagcctgc

SEQ ID NO: 215555 - DNA, 25 bp, Mus musculus
attgtgaagccaccagcatctgctc

SEQ ID NO: 215556 - DNA, 25 bp, Mus musculus
attgtgaagccagtattccccttcc

SEQ ID NO: 215557 - DNA, 25 bp, Mus musculus
attgtgaagtctcttattggtgcag

SEQ ID NO: 215558 - DNA, 25 bp, Mus musculus
attgtgacaagcagcctgacaaaag

SEQ ID NO: 215559 - DNA, 25 bp, Mus musculus
attgtgacaagcaggctgagtaatt

SEQ ID NO: 215560 - DNA, 25 bp, Mus musculus
attgtgacagagtgggacttggtat

SEQ ID NO: 215561 - DNA, 25 bp, Mus musculus
attgtgagcggaaaagtgtacctgt

SEQ ID NO: 215562 - DNA, 25 bp, Mus musculus
attgtgaggggagctgttgtggaaa

SEQ ID NO: 215563 - DNA, 25 bp, Mus musculus
attgtgaggggtgttctgtagtggc

SEQ ID NO: 215564 - DNA, 25 bp, Mus musculus
attgtgagtaccctgggaaaagagg

SEQ ID NO: 215565 - DNA, 25 bp, Mus musculus
attgtgatatcgtgtcccgagatgg

SEQ ID NO: 215566 - DNA, 25 bp, Mus musculus
attgtgccaaagataaatttgaaaa

SEQ ID NO: 215567 - DNA, 25 bp, Mus musculus
attgtgctaaagaaatgctctacta

SEQ ID NO: 215568 - DNA, 25 bp, Mus musculus
attgtgctaaagaaattgccaacaa

SEQ ID NO: 215569 - DNA, 25 bp, Mus musculus
attgtgctatagggattgtgccatc

SEQ ID NO: 215570 - DNA, 25 bp, Mus musculus
attgtgctcaagaccttcctggatg

SEQ ID NO: 215571 - DNA, 25 bp, Mus musculus
attgtgcttgatgttcaaatagata

SEQ ID NO: 215572 - DNA, 25 bp, Mus musculus
attgtgcttgctgcctttattgtct

SEQ ID NO: 215573 - DNA, 25 bp, Mus musculus
attgtgcttggtgcctttattgtct

SEQ ID NO: 215574 - DNA, 25 bp, Mus musculus
attgtgcttgttgttcaaatagata

SEQ ID NO: 215575 - DNA, 25 bp, Mus musculus
attgtggaagaataagaatgagcgg

SEQ ID NO: 215576 - DNA, 25 bp, Mus musculus
attgtggaaggatacgccaatgtca

SEQ ID NO: 215577 - DNA, 25 bp, Mus musculus
attgtggaaggggaggagcgctaca

SEQ ID NO: 215578 - DNA, 25 bp, Mus musculus
attgtggaggagggggatatgaaag

SEQ ID NO: 215579 - DNA, 25 bp, Mus musculus
attgtggataagcctgagtggcgac

SEQ ID NO: 215580 - DNA, 25 bp, Mus musculus
attgtggataaggactgaatcttgg

SEQ ID NO: 215581 - DNA, 25 bp, Mus musculus
attgtggataagtgctgctaaagtg

SEQ ID NO: 215582 - DNA, 25 bp, Mus musculus
attgtggcaggacgaagaatgacca

SEQ ID NO: 215583 - DNA, 25 bp, Mus musculus
attgtggcaggtatcacgagcattc

SEQ ID NO: 215584 - DNA, 25 bp, Mus musculus
attgtggcgaatcagaataatttaa

SEQ ID NO: 215585 - DNA, 25 bp, Mus musculus
attgtggctgatcagactccaacgc

SEQ ID NO: 215586 - DNA, 25 bp, Mus musculus
attgtgggagagccaggctactgcc

SEQ ID NO: 215587 - DNA, 25 bp, Mus musculus
attgtgggagtctgcagtgatgagc

SEQ ID NO: 215588 - DNA, 25 bp, Mus musculus
attgtgggcaggatatttgtgtttg

SEQ ID NO: 215589 - DNA, 25 bp, Mus musculus
attgtggggacaaaacacagaagtc

SEQ ID NO: 215590 - DNA, 25 bp, Mus musculus
attgtggggacaggttctggaaata

SEQ ID NO: 215591 - DNA, 25 bp, Mus musculus
attgtggtcaaggacggacccggct

SEQ ID NO: 215592 - DNA, 25 bp, Mus musculus
attgtggtgttacaggccgccctgc

SEQ ID NO: 215593 - DNA, 25 bp, Mus musculus
attgtggtgttacaggttagtgtca

SEQ ID NO: 215594 - DNA, 25 bp, Mus musculus
attgtgtaaagcctcctgtaccctg

SEQ ID NO: 215595 - DNA, 25 bp, Mus musculus
attgtgtaagcagaatattcaaggg

SEQ ID NO: 215596 - DNA, 25 bp, Mus musculus
attgtgtaggccaggttgactcttc

SEQ ID NO: 215597 - DNA, 25 bp, Mus musculus
attgtgtcagggacaggagttcaga

SEQ ID NO: 215598 - DNA, 25 bp, Mus musculus
attgtgtcagggctggacagtgcta

SEQ ID NO: 215599 - DNA, 25 bp, Mus musculus
attgtgtctgaggtcaactgaagct

SEQ ID NO: 215600 - DNA, 25 bp, Mus musculus
attgtgtgagagattggtgtccttt

SEQ ID NO: 215601 - DNA, 25 bp, Mus musculus
attgtgtggccaaagccaaacttgc

SEQ ID NO: 215602 - DNA, 25 bp, Mus musculus
attgtgtggccaaagggacagtact

SEQ ID NO: 215603 - DNA, 25 bp, Mus musculus
attgtgtggggtcaccgacaatgag

SEQ ID NO: 215604 - DNA, 25 bp, Mus musculus
attgtgtgtctggcttatggtagca

SEQ ID NO: 215605 - DNA, 25 bp, Mus musculus
attgtgtgtctgggagaagatgacc

SEQ ID NO: 215606 - DNA, 25 bp, Mus musculus
attgtgtttgtagacccatccctga

SEQ ID NO: 215607 - DNA, 25 bp, Mus musculus
attgtgttttcagatgtccctggta

SEQ ID NO: 215608 - DNA, 25 bp, Mus musculus
attgttaaaggaaattcgatagcag

SEQ ID NO: 215609 - DNA, 25 bp, Mus musculus
attgttaacaataaggacctccagt

SEQ ID NO: 215610 - DNA, 25 bp, Mus musculus
attgttacatgggtttatccatggc

SEQ ID NO: 215611 - DNA, 25 bp, Mus musculus
attgttacatgtgtatctccagagt

SEQ ID NO: 215612 - DNA, 25 bp, Mus musculus
attgttaccaaagtgtgcaactgcg

SEQ ID NO: 215613 - DNA, 25 bp, Mus musculus
attgttactgttacagatttgggac

SEQ ID NO: 215614 - DNA, 25 bp, Mus musculus
attgttatagccagagaatgtattc

SEQ ID NO: 215615 - DNA, 25 bp, Mus musculus
attgttatagccagataactggggt

SEQ ID NO: 215616 - DNA, 25 bp, Mus musculus
attgttatccagatggtttcaaggc

SEQ ID NO: 215617 - DNA, 25 bp, Mus musculus
attgttcaaaaggaggccacctatg

SEQ ID NO: 215618 - DNA, 25 bp, Mus musculus
attgttcaaaaggagtatgaaggct

SEQ ID NO: 215619 - DNA, 25 bp, Mus musculus
attgttcaaaaggagtttgttgaag

SEQ ID NO: 215620 - DNA, 25 bp, Mus musculus
attgttcagcaggtcagggtttgga

SEQ ID NO: 215621 - DNA, 25 bp, Mus musculus
attgttccactgtagtcacagtaat

SEQ ID NO: 215622 - DNA, 25 bp, Mus musculus
attgttcgaggaaatgctgtcattc

SEQ ID NO: 215623 - DNA, 25 bp, Mus musculus
attgttcggatgctgaatccctaca

SEQ ID NO: 215624 - DNA, 25 bp, Mus musculus
attgttctattaggtcatgacgcat

SEQ ID NO: 215625 - DNA, 25 bp, Mus musculus
attgttgcatcaggtactgtaatag

SEQ ID NO: 215626 - DNA, 25 bp, Mus musculus
attgttgctgtagaggttgctgcat

SEQ ID NO: 215627 - DNA, 25 bp, Mus musculus
attgttggaggacggaacctagctc

SEQ ID NO: 215628 - DNA, 25 bp, Mus musculus
attgttggaggagggaacctagctc

SEQ ID NO: 215629 - DNA, 25 bp, Mus musculus
attgttggataaaagcttataccca

SEQ ID NO: 215630 - DNA, 25 bp, Mus musculus
attgttgggttcagatacaggagcc

SEQ ID NO: 215631 - DNA, 25 bp, Mus musculus
attgttgtagaggatctgagaaatg

SEQ ID NO: 215632 - DNA, 25 bp, Mus musculus
attgttgtcaaggtttgatctcatt

SEQ ID NO: 215633 - DNA, 25 bp, Mus musculus
attgtttaaactacagaactttgtg

SEQ ID NO: 215634 - DNA, 25 bp, Mus musculus
attgtttaaactgcagaggtataca

SEQ ID NO: 215635 - DNA, 25 bp, Mus musculus
attgtttatagaaatacaatattct

SEQ ID NO: 215636 - DNA, 25 bp, Mus musculus
attgtttatagagatttgaagttgg

SEQ ID NO: 215637 - DNA, 25 bp, Mus musculus
attgtttatcagaagtttccagagt

SEQ ID NO: 215638 - DNA, 25 bp, Mus musculus
attgtttcccccaacttacagactg

SEQ ID NO: 215639 - DNA, 25 bp, Mus musculus
attgtttggttcttcgggcctgtgt

SEQ ID NO: 215640 - DNA, 25 bp, Mus musculus
attgtttgtaccaggcaacttgcca

SEQ ID NO: 215641 - DNA, 25 bp, Mus musculus
attgtttgtaccaggttcccaagag

SEQ ID NO: 215642 - DNA, 25 bp, Mus musculus
attgtttgtgcagttgctttattct

SEQ ID NO: 215643 - DNA, 25 bp, Mus musculus
attgtttttcctggtgtgacttatg

SEQ ID NO: 215644 - DNA, 25 bp, Mus musculus
attgtttttgctgatgggaactttt

SEQ ID NO: 215645 - DNA, 25 bp, Mus musculus
attgtttttgctgatttctaagtta

SEQ ID NO: 215646 - DNA, 25 bp, Mus musculus
atttaaaaagggagatgagtacgat

SEQ ID NO: 215647 - DNA, 25 bp, Mus musculus
atttaaaacaggcctcaaggctttg

SEQ ID NO: 215648 - DNA, 25 bp, Mus musculus
atttaaaacagttgccatccacacc

SEQ ID NO: 215649 - DNA, 25 bp, Mus musculus
atttaaaataccagtgtaagcggta

SEQ ID NO: 215650 - DNA, 25 bp, Mus musculus
atttaaaatggatgtgaaatgatct

SEQ ID NO: 215651 - DNA, 25 bp, Mus musculus
atttaaacaccagggtctcctagcc

SEQ ID NO: 215652 - DNA, 25 bp, Mus musculus
atttaaacctgagcattttaatctg

SEQ ID NO: 215653 - DNA, 25 bp, Mus musculus
atttaaagaacttgtgtagcttgta

SEQ ID NO: 215654 - DNA, 25 bp, Mus musculus
atttaaaggcacaggaagcggaaca

SEQ ID NO: 215655 - DNA, 25 bp, Mus musculus
atttaaataataggtggttagccag

SEQ ID NO: 215656 - DNA, 25 bp, Mus musculus
atttaaatatcacgaacacactaaa

SEQ ID NO: 215657 - DNA, 25 bp, Mus musculus
atttaaatgaagagatggttacgcc

SEQ ID NO: 215658 - DNA, 25 bp, Mus musculus
atttaaatgaagaggtgtttatgga

SEQ ID NO: 215659 - DNA, 25 bp, Mus musculus
atttaacaatagacatgaagcgcca

SEQ ID NO: 215660 - DNA, 25 bp, Mus musculus
atttaacacaggtgtgatcctgctg

SEQ ID NO: 215661 - DNA, 25 bp, Mus musculus
atttaacacagtgttgctggcggta

SEQ ID NO: 215662 - DNA, 25 bp, Mus musculus
atttaaccagagctgtctgtctagg

SEQ ID NO: 215663 - DNA, 25 bp, Mus musculus
atttaaccaggtgccagatttactg

SEQ ID NO: 215664 - DNA, 25 bp, Mus musculus
atttaaccattcaaaatgtaggccg

SEQ ID NO: 215665 - DNA, 25 bp, Mus musculus
atttaaccgtgagataccagagagc

SEQ ID NO: 215666 - DNA, 25 bp, Mus musculus
atttaacctgagaaatgccaaccaa

SEQ ID NO: 215667 - DNA, 25 bp, Mus musculus
atttaacgccaaggtaaacgatgat

SEQ ID NO: 215668 - DNA, 25 bp, Mus musculus
atttaagaagagaaggtggctgcag

SEQ ID NO: 215669 - DNA, 25 bp, Mus musculus
atttaagaagatgaaaccagatttc

SEQ ID NO: 215670 - DNA, 25 bp, Mus musculus
atttaagcagagatgacgtcagtga

SEQ ID NO: 215671 - DNA, 25 bp, Mus musculus
atttaagccagggtcagactcagtc

SEQ ID NO: 215672 - DNA, 25 bp, Mus musculus
atttaagccagggtttgcagagcag

SEQ ID NO: 215673 - DNA, 25 bp, Mus musculus
atttaaggagattaatagagacaga

SEQ ID NO: 215674 - DNA, 25 bp, Mus musculus
atttaaggagttcatcagcctccag

SEQ ID NO: 215675 - DNA, 25 bp, Mus musculus
atttaataaaggcctgtgatactcc

SEQ ID NO: 215676 - DNA, 25 bp, Mus musculus
atttaataactggcatcctcgtgta

SEQ ID NO: 215677 - DNA, 25 bp, Mus musculus
atttaatggttgctctctgaaaact

SEQ ID NO: 215678 - DNA, 25 bp, Mus musculus
atttaatgttggaggacctggataa

SEQ ID NO: 215679 - DNA, 25 bp, Mus musculus
atttaatgttggaggatttagacaa

SEQ ID NO: 215680 - DNA, 25 bp, Mus musculus
atttacacaaagcagagcaaaaagg

SEQ ID NO: 215681 - DNA, 25 bp, Mus musculus
atttacacaaagcagggctttggga

SEQ ID NO: 215682 - DNA, 25 bp, Mus musculus
atttacacccagcaatcccaggatc

SEQ ID NO: 215683 - DNA, 25 bp, Mus musculus
atttacacgaccagtgcagcccctg

SEQ ID NO: 215684 - DNA, 25 bp, Mus musculus
atttacagaagataacaaagttgtt

SEQ ID NO: 215685 - DNA, 25 bp, Mus musculus
atttacagaagtgctaggcctggtg

SEQ ID NO: 215686 - DNA, 25 bp, Mus musculus
atttacagaagtggacaagaagcct

SEQ ID NO: 215687 - DNA, 25 bp, Mus musculus
atttacagaattgcatactgggacc

SEQ ID NO: 215688 - DNA, 25 bp, Mus musculus
atttacagaattggagttcatagag

SEQ ID NO: 215689 - DNA, 25 bp, Mus musculus
atttacagagcccatggatgggata

SEQ ID NO: 215690 - DNA, 25 bp, Mus musculus
atttacagctagttcatcactattt

SEQ ID NO: 215691 - DNA, 25 bp, Mus musculus
atttacattggcatagctccttatt

SEQ ID NO: 215692 - DNA, 25 bp, Mus musculus
atttaccaagcgctgatcctgaccg

SEQ ID NO: 215693 - DNA, 25 bp, Mus musculus
atttaccaaggaggcatcctcatgt

SEQ ID NO: 215694 - DNA, 25 bp, Mus musculus
atttaccagggaagacagtgatcct

SEQ ID NO: 215695 - DNA, 25 bp, Mus musculus
atttaccagggtcggacaaatgaca

SEQ ID NO: 215696 - DNA, 25 bp, Mus musculus
atttacccaaaggaagcctcaaggc

SEQ ID NO: 215697 - DNA, 25 bp, Mus musculus
atttaccgctcccctgagaacacaa

SEQ ID NO: 215698 - DNA, 25 bp, Mus musculus
atttaccgctcccctggttctggtt

SEQ ID NO: 215699 - DNA, 25 bp, Mus musculus
atttacctctgggacaaggacaaag

SEQ ID NO: 215700 - DNA, 25 bp, Mus musculus
atttaccttccaggaatcctgctgc

SEQ ID NO: 215701 - DNA, 25 bp, Mus musculus
atttaccttggtgagaccatagccc

SEQ ID NO: 215702 - DNA, 25 bp, Mus musculus
atttacctttgcagaaagaagaatc

SEQ ID NO: 215703 - DNA, 25 bp, Mus musculus
atttacgacaaatgtgtgccaaaga

SEQ ID NO: 215704 - DNA, 25 bp, Mus musculus
atttactaagactctccttcccagc

SEQ ID NO: 215705 - DNA, 25 bp, Mus musculus
atttactaagggctacagagccccc

SEQ ID NO: 215706 - DNA, 25 bp, Mus musculus
atttactatttccatgatggccagt

SEQ ID NO: 215707 - DNA, 25 bp, Mus musculus
atttactcaaacccgcaacttgaat

SEQ ID NO: 215708 - DNA, 25 bp, Mus musculus
atttactgcccagacaagtgctgtt

SEQ ID NO: 215709 - DNA, 25 bp, Mus musculus
atttactgcccagaccgtgccagtg

SEQ ID NO: 215710 - DNA, 25 bp, Mus musculus
atttactttgggtcactgcccagcc

SEQ ID NO: 215711 - DNA, 25 bp, Mus musculus
atttagaagatcttttacaggatgg

SEQ ID NO: 215712 - DNA, 25 bp, Mus musculus
atttagaagatgatggtgaggatga

SEQ ID NO: 215713 - DNA, 25 bp, Mus musculus
atttagacaagtatgatgatgttct

SEQ ID NO: 215714 - DNA, 25 bp, Mus musculus
atttagacaattggtggccatttat

SEQ ID NO: 215715 - DNA, 25 bp, Mus musculus
atttagacttggagatcccttccag

SEQ ID NO: 215716 - DNA, 25 bp, Mus musculus
atttagataatccacttaaacattt

SEQ ID NO: 215717 - DNA, 25 bp, Mus musculus
atttagatctgaacaatgcccagcg

SEQ ID NO: 215718 - DNA, 25 bp, Mus musculus
atttagcaaaggtgtggtggcttaa

SEQ ID NO: 215719 - DNA, 25 bp, Mus musculus
atttagcatggctgttggaaagcct

SEQ ID NO: 215720 - DNA, 25 bp, Mus musculus
atttagctggggaggaagagacagc

SEQ ID NO: 215721 - DNA, 25 bp, Mus musculus
atttagctggggggccgaggggcag

SEQ ID NO: 215722 - DNA, 25 bp, Mus musculus
atttaggaaaacaataaatgcacct

SEQ ID NO: 215723 - DNA, 25 bp, Mus musculus
atttaggaaaacagtccttcacgtc

SEQ ID NO: 215724 - DNA, 25 bp, Mus musculus
atttaggcaagggaaggacatttgg

SEQ ID NO: 215725 - DNA, 25 bp, Mus musculus
atttagtatcaaaacttctctattc

SEQ ID NO: 215726 - DNA, 25 bp, Mus musculus
atttagtctggcgtgtgcagcctgg

SEQ ID NO: 215727 - DNA, 25 bp, Mus musculus
atttagtgagccacagtacacgaac

SEQ ID NO: 215728 - DNA, 25 bp, Mus musculus
atttagttaaaagctgtatcgacat

SEQ ID NO: 215729 - DNA, 25 bp, Mus musculus
atttataaaaatggtgtccttggac

SEQ ID NO: 215730 - DNA, 25 bp, Mus musculus
atttataaaaatggtgtcctttggc

SEQ ID NO: 215731 - DNA, 25 bp, Mus musculus
atttataagacaaaaaagaagagga

SEQ ID NO: 215732 - DNA, 25 bp, Mus musculus
atttataatatgaatgtctcaggtg

SEQ ID NO: 215733 - DNA, 25 bp, Mus musculus
atttatatgacagagtccgctcctg

SEQ ID NO: 215734 - DNA, 25 bp, Mus musculus
atttatatgacaggtcatggaggga

SEQ ID NO: 215735 - DNA, 25 bp, Mus musculus
atttatcaccaccacataagattgt

SEQ ID NO: 215736 - DNA, 25 bp, Mus musculus
atttatcactagaggtcgatcgcga

SEQ ID NO: 215737 - DNA, 25 bp, Mus musculus
atttatccaaaggtgttttacatga

SEQ ID NO: 215738 - DNA, 25 bp, Mus musculus
atttatccaggtgtgaaattgaaac

SEQ ID NO: 215739 - DNA, 25 bp, Mus musculus
atttatctatgatgaagctgctctt

SEQ ID NO: 215740 - DNA, 25 bp, Mus musculus
atttatctatggtcgaatatttccc

SEQ ID NO: 215741 - DNA, 25 bp, Mus musculus
atttatctctgttggggcttcacac

SEQ ID NO: 215742 - DNA, 25 bp, Mus musculus
atttatctgaggtgagaagtctggg

SEQ ID NO: 215743 - DNA, 25 bp, Mus musculus
atttatctgtaacagcgtggaagat

SEQ ID NO: 215744 - DNA, 25 bp, Mus musculus
atttatgacaaagatcagttcatgt

SEQ ID NO: 215745 - DNA, 25 bp, Mus musculus
atttatggagggttcctggtacagg

SEQ ID NO: 215746 - DNA, 25 bp, Mus musculus
atttatggagtgtttgatgagaaaa

SEQ ID NO: 215747 - DNA, 25 bp, Mus musculus
atttattattcggcatacccatgta

SEQ ID NO: 215748 - DNA, 25 bp, Mus musculus
atttattatttaggcttggctggtg

SEQ ID NO: 215749 - DNA, 25 bp, Mus musculus
atttattatttaggtcattttgagt

SEQ ID NO: 215750 - DNA, 25 bp, Mus musculus
atttattccagctacctggagaact

SEQ ID NO: 215751 - DNA, 25 bp, Mus musculus
atttattgatgaaaagatttattta

SEQ ID NO: 215752 - DNA, 25 bp, Mus musculus
atttattgggacagacacaggaatt

SEQ ID NO: 215753 - DNA, 25 bp, Mus musculus
atttattgttgattcttccaagaag

SEQ ID NO: 215754 - DNA, 25 bp, Mus musculus
atttcaaaaaatcagggcttgcggc

SEQ ID NO: 215755 - DNA, 25 bp, Mus musculus
atttcaaaaatgggaacttgacgag

SEQ ID NO: 215756 - DNA, 25 bp, Mus musculus
atttcaaaaatgggatagatgtgca

SEQ ID NO: 215757 - DNA, 25 bp, Mus musculus
atttcaaaagaaaggacctatgcgt

SEQ ID NO: 215758 - DNA, 25 bp, Mus musculus
atttcaaaagtttgatttccaggaa

SEQ ID NO: 215759 - DNA, 25 bp, Mus musculus
atttcaaaatggagctgaagttcct

SEQ ID NO: 215760 - DNA, 25 bp, Mus musculus
atttcaaactggaggagttcaggag

SEQ ID NO: 215761 - DNA, 25 bp, Mus musculus
atttcaaaggtattttaaccacatc

SEQ ID NO: 215762 - DNA, 25 bp, Mus musculus
atttcaacagacaggtggaggaaga

SEQ ID NO: 215763 - DNA, 25 bp, Mus musculus
atttcaacagctgaggaaggtgtct

SEQ ID NO: 215764 - DNA, 25 bp, Mus musculus
atttcaaccgaattggcaaggttgg

SEQ ID NO: 215765 - DNA, 25 bp, Mus musculus
atttcaacttccgcctggactagca

SEQ ID NO: 215766 - DNA, 25 bp, Mus musculus
atttcaactttggccaccagttcta

SEQ ID NO: 215767 - DNA, 25 bp, Mus musculus
atttcaactttggcctaccttcttg

SEQ ID NO: 215768 - DNA, 25 bp, Mus musculus
atttcaagaaaagagaaaattggag

SEQ ID NO: 215769 - DNA, 25 bp, Mus musculus
atttcaagaaaaggaaaatgtccct

SEQ ID NO: 215770 - DNA, 25 bp, Mus musculus
atttcaagagtgagaagcgccacct

SEQ ID NO: 215771 - DNA, 25 bp, Mus musculus
atttcaatacgcgctaccctgattg

SEQ ID NO: 215772 - DNA, 25 bp, Mus musculus
atttcaattaaggtattaagtcatg

SEQ ID NO: 215773 - DNA, 25 bp, Mus musculus
atttcacaaagctcggattgggaaa

SEQ ID NO: 215774 - DNA, 25 bp, Mus musculus
atttcacaatactacctgtctgctg

SEQ ID NO: 215775 - DNA, 25 bp, Mus musculus
atttcacagccccacttcacagcca

SEQ ID NO: 215776 - DNA, 25 bp, Mus musculus
atttcacagccccagttcacagcca

SEQ ID NO: 215777 - DNA, 25 bp, Mus musculus
atttcacagctctaggcttttcaga

SEQ ID NO: 215778 - DNA, 25 bp, Mus musculus
atttcacagggggttcaccgtctcc

SEQ ID NO: 215779 - DNA, 25 bp, Mus musculus
atttcacatacactgatcatagaac

SEQ ID NO: 215780 - DNA, 25 bp, Mus musculus
atttcacctcccagatcttctccct

SEQ ID NO: 215781 - DNA, 25 bp, Mus musculus
atttcaccttgcaaagcctttccca

SEQ ID NO: 215782 - DNA, 25 bp, Mus musculus
atttcactgaggttaatctataatt

SEQ ID NO: 215783 - DNA, 25 bp, Mus musculus
atttcagaaaatagccaggactatc

SEQ ID NO: 215784 - DNA, 25 bp, Mus musculus
atttcagaaaataggtattgaggct

SEQ ID NO: 215785 - DNA, 25 bp, Mus musculus
atttcagaatgctccccgggagaca

SEQ ID NO: 215786 - DNA, 25 bp, Mus musculus
atttcagacaggattggtagcttat

SEQ ID NO: 215787 - DNA, 25 bp, Mus musculus
atttcagacatagtcacagcccagc

SEQ ID NO: 215788 - DNA, 25 bp, Mus musculus
atttcagagacagaggtctcaaggg

SEQ ID NO: 215789 - DNA, 25 bp, Mus musculus
atttcagagctggaaccctgccaca

SEQ ID NO: 215790 - DNA, 25 bp, Mus musculus
atttcagagctggagagttgaagca

SEQ ID NO: 215791 - DNA, 25 bp, Mus musculus
atttcagattgccagatcagtatat

SEQ ID NO: 215792 - DNA, 25 bp, Mus musculus
atttcagattggtggaccttcctct

SEQ ID NO: 215793 - DNA, 25 bp, Mus musculus
atttcagcaagaggaatatcctccc

SEQ ID NO: 215794 - DNA, 25 bp, Mus musculus
atttcagcagagactaaaggagatc

SEQ ID NO: 215795 - DNA, 25 bp, Mus musculus
atttcagcaggatagtcattgcaac

SEQ ID NO: 215796 - DNA, 25 bp, Mus musculus
atttcagcaggttcaggcgcagctg

SEQ ID NO: 215797 - DNA, 25 bp, Mus musculus
atttcagcatcaggggttcggcatg

SEQ ID NO: 215798 - DNA, 25 bp, Mus musculus
atttcagcgcctctggagttagtga

SEQ ID NO: 215799 - DNA, 25 bp, Mus musculus
atttcagcgcctctggtgacagagt

SEQ ID NO: 215800 - DNA, 25 bp, Mus musculus
atttcagcgcctctgtcttgttttc

SEQ ID NO: 215801 - DNA, 25 bp, Mus musculus
atttcagctgaagtcaggaaagtca

SEQ ID NO: 215802 - DNA, 25 bp, Mus musculus
atttcaggccagggaccgagaacac

SEQ ID NO: 215803 - DNA, 25 bp, Mus musculus
atttcagggaaaacaggcagcacag

SEQ ID NO: 215804 - DNA, 25 bp, Mus musculus
atttcagggagactgctgggctgat

SEQ ID NO: 215805 - DNA, 25 bp, Mus musculus
atttcagtcaggaagtcctacctat

SEQ ID NO: 215806 - DNA, 25 bp, Mus musculus
atttcagtgtcagacttaaatggag

SEQ ID NO: 215807 - DNA, 25 bp, Mus musculus
atttcagttcagttagcccccaacc

SEQ ID NO: 215808 - DNA, 25 bp, Mus musculus
atttcagttcagttttgctaactgt

SEQ ID NO: 215809 - DNA, 25 bp, Mus musculus
atttcagttgacacgagccgtctac

SEQ ID NO: 215810 - DNA, 25 bp, Mus musculus
atttcagttgacacggaacagtcca

SEQ ID NO: 215811 - DNA, 25 bp, Mus musculus
atttcatacagacgcttgatcctgc

SEQ ID NO: 215812 - DNA, 25 bp, Mus musculus
atttcatacaggattcaatgttgga

SEQ ID NO: 215813 - DNA, 25 bp, Mus musculus
atttcatcaactatcatgcttcgga

SEQ ID NO: 215814 - DNA, 25 bp, Mus musculus
atttcatcaagctcctggttgaagc

SEQ ID NO: 215815 - DNA, 25 bp, Mus musculus
atttcatcaaggctatggcaatata

SEQ ID NO: 215816 - DNA, 25 bp, Mus musculus
atttcatctctcaggctctctaact

SEQ ID NO: 215817 - DNA, 25 bp, Mus musculus
atttcatgcatttggaggaactgcc

SEQ ID NO: 215818 - DNA, 25 bp, Mus musculus
atttcatgctggatgacctcaatgc

SEQ ID NO: 215819 - DNA, 25 bp, Mus musculus
atttcatggagagacgtgacactca

SEQ ID NO: 215820 - DNA, 25 bp, Mus musculus
atttcatggagagggaggggcggaa

SEQ ID NO: 215821 - DNA, 25 bp, Mus musculus
atttcatgtttgagatcagtcgtct

SEQ ID NO: 215822 - DNA, 25 bp, Mus musculus
atttcattaagacctggtcccaggg

SEQ ID NO: 215823 - DNA, 25 bp, Mus musculus
atttcattaagatcgggaagctgca

SEQ ID NO: 215824 - DNA, 25 bp, Mus musculus
atttcattgaggagtttgacaatta

SEQ ID NO: 215825 - DNA, 25 bp, Mus musculus
atttccaaaagagaacggacactct

SEQ ID NO: 215826 - DNA, 25 bp, Mus musculus
atttccaaaagcctgaaacatttga

SEQ ID NO: 215827 - DNA, 25 bp, Mus musculus
atttccaaccacggctcactccagc

SEQ ID NO: 215828 - DNA, 25 bp, Mus musculus
atttccaactatgaaaagaaagttg

SEQ ID NO: 215829 - DNA, 25 bp, Mus musculus
atttccaagcaatgtggtacacgga

SEQ ID NO: 215830 - DNA, 25 bp, Mus musculus
atttccacagtgatgctctagctag

SEQ ID NO: 215831 - DNA, 25 bp, Mus musculus
atttccacagtgttgctctagctag

SEQ ID NO: 215832 - DNA, 25 bp, Mus musculus
atttccacatagtgctggggatcga

SEQ ID NO: 215833 - DNA, 25 bp, Mus musculus
atttccacatagttcagcaatcagc

SEQ ID NO: 215834 - DNA, 25 bp, Mus musculus
atttccaccacctggatcgagaact

SEQ ID NO: 215835 - DNA, 25 bp, Mus musculus
atttccaccggtttgctgaggagca

SEQ ID NO: 215836 - DNA, 25 bp, Mus musculus
atttccacgatggggtccgagtggc

SEQ ID NO: 215837 - DNA, 25 bp, Mus musculus
atttccacggaggttaatctataat

SEQ ID NO: 215838 - DNA, 25 bp, Mus musculus
atttccactcatcctccttgtgagc

SEQ ID NO: 215839 - DNA, 25 bp, Mus musculus
atttccactctgcttccctgtgctg

SEQ ID NO: 215840 - DNA, 25 bp, Mus musculus
atttccagaagcaggtgtccccaga

SEQ ID NO: 215841 - DNA, 25 bp, Mus musculus
atttccagaggataacgaaaagagc

SEQ ID NO: 215842 - DNA, 25 bp, Mus musculus
atttccagattggtgccattcagtc

SEQ ID NO: 215843 - DNA, 25 bp, Mus musculus
atttccagcaagcttgagtctactg

SEQ ID NO: 215844 - DNA, 25 bp, Mus musculus
atttccagcaagtaccaggaatgtg

SEQ ID NO: 215845 - DNA, 25 bp, Mus musculus
atttccagcagggtgacatggagtc

SEQ ID NO: 215846 - DNA, 25 bp, Mus musculus
atttccagccgtggtcaagttcacc

SEQ ID NO: 215847 - DNA, 25 bp, Mus musculus
atttccaggcaggctcatggcagat

SEQ ID NO: 215848 - DNA, 25 bp, Mus musculus
atttccaggtatggtatgaaaccaa

SEQ ID NO: 215849 - DNA, 25 bp, Mus musculus
atttccagtgcaccagcagaacagt

SEQ ID NO: 215850 - DNA, 25 bp, Mus musculus
atttccagttaaacctgctgatctt

SEQ ID NO: 215851 - DNA, 25 bp, Mus musculus
atttccatttctgaaagattagaac

SEQ ID NO: 215852 - DNA, 25 bp, Mus musculus
atttcccaagtggatggagaccaag

SEQ ID NO: 215853 - DNA, 25 bp, Mus musculus
atttcccacagacctggatttggat

SEQ ID NO: 215854 - DNA, 25 bp, Mus musculus
atttcccactgaggccaatgtgctt

SEQ ID NO: 215855 - DNA, 25 bp, Mus musculus
atttcccagcagagcaagctgacga

SEQ ID NO: 215856 - DNA, 25 bp, Mus musculus
atttcccagcagtgcaagctgacga

SEQ ID NO: 215857 - DNA, 25 bp, Mus musculus
atttccccaagtgcgccgcagagct

SEQ ID NO: 215858 - DNA, 25 bp, Mus musculus
atttccccagccagatcttctggag

SEQ ID NO: 215859 - DNA, 25 bp, Mus musculus
atttcccctcagcaaatccagtttg

SEQ ID NO: 215860 - DNA, 25 bp, Mus musculus
atttcccctgcaaaaatctggaaga

SEQ ID NO: 215861 - DNA, 25 bp, Mus musculus
atttcccctgcaatactgccgaaac

SEQ ID NO: 215862 - DNA, 25 bp, Mus musculus
atttccccttggtgcaccatggagc

SEQ ID NO: 215863 - DNA, 25 bp, Mus musculus
atttccctcttggctgatggtgagg

SEQ ID NO: 215864 - DNA, 25 bp, Mus musculus
atttccctggcctcagaaacacttg

SEQ ID NO: 215865 - DNA, 25 bp, Mus musculus
atttccctggcttcccctccagcct

SEQ ID NO: 215866 - DNA, 25 bp, Mus musculus
atttccctgtctctcagaactgagg

SEQ ID NO: 215867 - DNA, 25 bp, Mus musculus
atttccctgtctctttggtcaagac

SEQ ID NO: 215868 - DNA, 25 bp, Mus musculus
atttcccttcccgagggcgctgtga

SEQ ID NO: 215869 - DNA, 25 bp, Mus musculus
atttccgaaggtacattttatactg

SEQ ID NO: 215870 - DNA, 25 bp, Mus musculus
atttccggaatgcaggtttcaaatg

SEQ ID NO: 215871 - DNA, 25 bp, Mus musculus
atttccggctgctcctgatgctgtg

SEQ ID NO: 215872 - DNA, 25 bp, Mus musculus
atttccgtcctacaaacctcatcca

SEQ ID NO: 215873 - DNA, 25 bp, Mus musculus
atttcctaaaggagatataatcagt

SEQ ID NO: 215874 - DNA, 25 bp, Mus musculus
atttcctacaagttggtcagtgaaa

SEQ ID NO: 215875 - DNA, 25 bp, Mus musculus
atttcctacagggaaatcagtcagc

SEQ ID NO: 215876 - DNA, 25 bp, Mus musculus
atttcctacaggtggggctttaatc

SEQ ID NO: 215877 - DNA, 25 bp, Mus musculus
atttcctataatgttgtgatgacga

SEQ ID NO: 215878 - DNA, 25 bp, Mus musculus
atttcctatcctggtgctactaaaa

SEQ ID NO: 215879 - DNA, 25 bp, Mus musculus
atttcctcctacaacacggtagagg

SEQ ID NO: 215880 - DNA, 25 bp, Mus musculus
atttcctcctacattgagcagacac

SEQ ID NO: 215881 - DNA, 25 bp, Mus musculus
atttcctctccaagcttttcatcct

SEQ ID NO: 215882 - DNA, 25 bp, Mus musculus
atttcctctccacccatctgctggc

SEQ ID NO: 215883 - DNA, 25 bp, Mus musculus
atttcctgaggctgtaagcaatggc

SEQ ID NO: 215884 - DNA, 25 bp, Mus musculus
atttcctggcagcactgtccatcca

SEQ ID NO: 215885 - DNA, 25 bp, Mus musculus
atttcctggcagcctcgggatggat

SEQ ID NO: 215886 - DNA, 25 bp, Mus musculus
atttccttaacctgggatcgcttac

SEQ ID NO: 215887 - DNA, 25 bp, Mus musculus
atttcctttcaggcaagtacattgc

SEQ ID NO: 215888 - DNA, 25 bp, Mus musculus
atttcctttgaggaaatggatccac

SEQ ID NO: 215889 - DNA, 25 bp, Mus musculus
atttcgaccaggaaaaaatcctgct

SEQ ID NO: 215890 - DNA, 25 bp, Mus musculus
atttcgaccagttaccttactctgg

SEQ ID NO: 215891 - DNA, 25 bp, Mus musculus
atttcgaggggagggagacgatgga

SEQ ID NO: 215892 - DNA, 25 bp, Mus musculus
atttcgataatttcaatgtccttgg

SEQ ID NO: 215893 - DNA, 25 bp, Mus musculus
atttcgatagcaatgcagttgctgg

SEQ ID NO: 215894 - DNA, 25 bp, Mus musculus
atttcggatgttcctgccttctctg

SEQ ID NO: 215895 - DNA, 25 bp, Mus musculus
atttcggcaggaattagctctgcgc

SEQ ID NO: 215896 - DNA, 25 bp, Mus musculus
atttcggcaggcaatacggaatatc

SEQ ID NO: 215897 - DNA, 25 bp, Mus musculus
atttcggctcagactcgcatgtgtg

SEQ ID NO: 215898 - DNA, 25 bp, Mus musculus
atttcggctcagggaagtgactttc

SEQ ID NO: 215899 - DNA, 25 bp, Mus musculus
atttcgtcttctggctggctggagg

SEQ ID NO: 215900 - DNA, 25 bp, Mus musculus
atttcgtgcacagcaaaactctttg

SEQ ID NO: 215901 - DNA, 25 bp, Mus musculus
atttcgtgcacatttttgcagcctg

SEQ ID NO: 215902 - DNA, 25 bp, Mus musculus
atttcgttctgtgatgccagcagag

SEQ ID NO: 215903 - DNA, 25 bp, Mus musculus
atttctaaacaggatttggtgagct

SEQ ID NO: 215904 - DNA, 25 bp, Mus musculus
atttctaaagaagttggcatcagac

SEQ ID NO: 215905 - DNA, 25 bp, Mus musculus
atttctaaattaaagactgagtgtg

SEQ ID NO: 215906 - DNA, 25 bp, Mus musculus
atttctaactgggttatgggtgcta

SEQ ID NO: 215907 - DNA, 25 bp, Mus musculus
atttctaactggtagtgtgaggaaa

SEQ ID NO: 215908 - DNA, 25 bp, Mus musculus
atttctaagcaggctgaggtctcta

SEQ ID NO: 215909 - DNA, 25 bp, Mus musculus
atttctaatgggggtcctgctccag

SEQ ID NO: 215910 - DNA, 25 bp, Mus musculus
atttctacaaaagattgatgtatcc

SEQ ID NO: 215911 - DNA, 25 bp, Mus musculus
atttctacaaaaggtacacaataaa

SEQ ID NO: 215912 - DNA, 25 bp, Mus musculus
atttctacagaacctgctttcagat

SEQ ID NO: 215913 - DNA, 25 bp, Mus musculus
atttctacatggtctcttcatgggg

SEQ ID NO: 215914 - DNA, 25 bp, Mus musculus
atttctaccagcaaggttggcccct

SEQ ID NO: 215915 - DNA, 25 bp, Mus musculus
atttctactgaaggcttccaaagga

SEQ ID NO: 215916 - DNA, 25 bp, Mus musculus
atttctagaagatcattgcaacgat

SEQ ID NO: 215917 - DNA, 25 bp, Mus musculus
atttctagcgtatatggaggaacgt

SEQ ID NO: 215918 - DNA, 25 bp, Mus musculus
atttctatcgcaggcacatcaatat

SEQ ID NO: 215919 - DNA, 25 bp, Mus musculus
atttctatcgcatgaagataagcag

SEQ ID NO: 215920 - DNA, 25 bp, Mus musculus
atttctatcgggttcatagtggcgc

SEQ ID NO: 215921 - DNA, 25 bp, Mus musculus
atttctatcggtatccgcccccaga

SEQ ID NO: 215922 - DNA, 25 bp, Mus musculus
atttctatgtggaaaggaaaataga

SEQ ID NO: 215923 - DNA, 25 bp, Mus musculus
atttctcacggaaacctaggcaggt

SEQ ID NO: 215924 - DNA, 25 bp, Mus musculus
atttctcacgggcacatctcatcat

SEQ ID NO: 215925 - DNA, 25 bp, Mus musculus
atttctcaggaaacacgatgggcag

SEQ ID NO: 215926 - DNA, 25 bp, Mus musculus
atttctcatgaagccattgatctta

SEQ ID NO: 215927 - DNA, 25 bp, Mus musculus
atttctccagagcaccgcctcctgg

SEQ ID NO: 215928 - DNA, 25 bp, Mus musculus
atttctccagagcgtgcccctggaa

SEQ ID NO: 215929 - DNA, 25 bp, Mus musculus
atttctccaggcttcacagagatca

SEQ ID NO: 215930 - DNA, 25 bp, Mus musculus
atttctccatcaaaccccggcagcc

SEQ ID NO: 215931 - DNA, 25 bp, Mus musculus
atttctcccaccagatacccataat

SEQ ID NO: 215932 - DNA, 25 bp, Mus musculus
atttctcccaccaggctcaatattg

SEQ ID NO: 215933 - DNA, 25 bp, Mus musculus
atttctcccagagcctggcaccccc

SEQ ID NO: 215934 - DNA, 25 bp, Mus musculus
atttctcccagaggcaaaatctcat

SEQ ID NO: 215935 - DNA, 25 bp, Mus musculus
atttctcctggaggttccaactatg

SEQ ID NO: 215936 - DNA, 25 bp, Mus musculus
atttctcggaggaagcaccactgcc

SEQ ID NO: 215937 - DNA, 25 bp, Mus musculus
atttctctctggcagggatggaaga

SEQ ID NO: 215938 - DNA, 25 bp, Mus musculus
atttctctgaccctgaatcgtcctt

SEQ ID NO: 215939 - DNA, 25 bp, Mus musculus
atttctctggccacaggaaatcgag

SEQ ID NO: 215940 - DNA, 25 bp, Mus musculus
atttctctggccacgggaaatcgag

SEQ ID NO: 215941 - DNA, 25 bp, Mus musculus
atttctcttgtgatgaggagactga

SEQ ID NO: 215942 - DNA, 25 bp, Mus musculus
atttctcttgtgctgccacaggtga

SEQ ID NO: 215943 - DNA, 25 bp, Mus musculus
atttctgaaacagcctcaaggagaa

SEQ ID NO: 215944 - DNA, 25 bp, Mus musculus
atttctgaaaggccagtgaatgtcc

SEQ ID NO: 215945 - DNA, 25 bp, Mus musculus
atttctgaacctagtctctgtccag

SEQ ID NO: 215946 - DNA, 25 bp, Mus musculus
atttctgaaggggcttgtcaatgag

SEQ ID NO: 215947 - DNA, 25 bp, Mus musculus
atttctgaattgaggattaagcttg

SEQ ID NO: 215948 - DNA, 25 bp, Mus musculus
atttctgacatggaggaaatgctgt

SEQ ID NO: 215949 - DNA, 25 bp, Mus musculus
atttctggaagctttgcaaaaaggt

SEQ ID NO: 215950 - DNA, 25 bp, Mus musculus
atttctggagccctgctttaaggct

SEQ ID NO: 215951 - DNA, 25 bp, Mus musculus
atttctggagcctatcttccagccc

SEQ ID NO: 215952 - DNA, 25 bp, Mus musculus
atttctggcaaaagatgcttgcatt

SEQ ID NO: 215953 - DNA, 25 bp, Mus musculus
atttcttaatcaggtatgtgtacat

SEQ ID NO: 215954 - DNA, 25 bp, Mus musculus
atttcttaatcaggtcttctcgtcc

SEQ ID NO: 215955 - DNA, 25 bp, Mus musculus
atttcttagctgagatagaagcttt

SEQ ID NO: 215956 - DNA, 25 bp, Mus musculus
atttcttcaagcacaagtatcagat

SEQ ID NO: 215957 - DNA, 25 bp, Mus musculus
atttcttcaaggccaagaagatagc

SEQ ID NO: 215958 - DNA, 25 bp, Mus musculus
atttcttcattgagactggacaatc

SEQ ID NO: 215959 - DNA, 25 bp, Mus musculus
atttcttccaaggcagaagagtggg

SEQ ID NO: 215960 - DNA, 25 bp, Mus musculus
atttcttcccaggagaaatatgaac

SEQ ID NO: 215961 - DNA, 25 bp, Mus musculus
atttcttgacaggcatcctcgtgta

SEQ ID NO: 215962 - DNA, 25 bp, Mus musculus
atttcttggatcggatgaagaagat

SEQ ID NO: 215963 - DNA, 25 bp, Mus musculus
atttctttaaaaggtgaggcatgaa

SEQ ID NO: 215964 - DNA, 25 bp, Mus musculus
atttctttacctgacaaagccaagg

SEQ ID NO: 215965 - DNA, 25 bp, Mus musculus
atttctttagcaagagcagtatata

SEQ ID NO: 215966 - DNA, 25 bp, Mus musculus
atttctttcatagatgaagcccgag

SEQ ID NO: 215967 - DNA, 25 bp, Mus musculus
atttctttccaagtccttctttgac

SEQ ID NO: 215968 - DNA, 25 bp, Mus musculus
atttcttttcctgggtgaaagacaa

SEQ ID NO: 215969 - DNA, 25 bp, Mus musculus
atttgaaaatcgaatctctagggct

SEQ ID NO: 215970 - DNA, 25 bp, Mus musculus
atttgaaaatcgatcttctttcaga

SEQ ID NO: 215971 - DNA, 25 bp, Mus musculus
atttgaaaatcggttagtccttcat

SEQ ID NO: 215972 - DNA, 25 bp, Mus musculus
atttgaaaatgatgccagaatttca

SEQ ID NO: 215973 - DNA, 25 bp, Mus musculus
atttgaaaatttggaggcagcaccg

SEQ ID NO: 215974 - DNA, 25 bp, Mus musculus
atttgaaagagccccggcagcccaa

SEQ ID NO: 215975 - DNA, 25 bp, Mus musculus
atttgaaagagctgaatgataagaa

SEQ ID NO: 215976 - DNA, 25 bp, Mus musculus
atttgaacactgatatagaaaatct

SEQ ID NO: 215977 - DNA, 25 bp, Mus musculus
atttgaacagccctgctttaaggct

SEQ ID NO: 215978 - DNA, 25 bp, Mus musculus
atttgaacagggcctgtctgagaaa

SEQ ID NO: 215979 - DNA, 25 bp, Mus musculus
atttgaacaggtcatgcagttgctg

SEQ ID NO: 215980 - DNA, 25 bp, Mus musculus
atttgaacaggtcttatgcaagcta

SEQ ID NO: 215981 - DNA, 25 bp, Mus musculus
atttgaagaattcagtgaacagagt

SEQ ID NO: 215982 - DNA, 25 bp, Mus musculus
atttgaaggatcaaggcagagatgc

SEQ ID NO: 215983 - DNA, 25 bp, Mus musculus
atttgacaaaaacagcttatagagc

SEQ ID NO: 215984 - DNA, 25 bp, Mus musculus
atttgacaagctaaggatttggagt

SEQ ID NO: 215985 - DNA, 25 bp, Mus musculus
atttgacagcaaaggcacccggatt

SEQ ID NO: 215986 - DNA, 25 bp, Mus musculus
atttgacatggcctctgaagaacac

SEQ ID NO: 215987 - DNA, 25 bp, Mus musculus
atttgaccaatcagttcatgcagaa

SEQ ID NO: 215988 - DNA, 25 bp, Mus musculus
atttgacgaaaacgacagaagatac

SEQ ID NO: 215989 - DNA, 25 bp, Mus musculus
atttgacgaaaacgagctgttgcgc

SEQ ID NO: 215990 - DNA, 25 bp, Mus musculus
atttgactctgagatggtagagatg

SEQ ID NO: 215991 - DNA, 25 bp, Mus musculus
atttgactctgaggtgctgtaggag

SEQ ID NO: 215992 - DNA, 25 bp, Mus musculus
atttgacttctgtagagtccaattg

SEQ ID NO: 215993 - DNA, 25 bp, Mus musculus
atttgacttctgtaggcataaactg

SEQ ID NO: 215994 - DNA, 25 bp, Mus musculus
atttgacttctttggtcttctaggg

SEQ ID NO: 215995 - DNA, 25 bp, Mus musculus
atttgagacagttccgacgagatat

SEQ ID NO: 215996 - DNA, 25 bp, Mus musculus
atttgagactctctgtgcaaagacc

SEQ ID NO: 215997 - DNA, 25 bp, Mus musculus
atttgagagagagaaggagagggaa

SEQ ID NO: 215998 - DNA, 25 bp, Mus musculus
atttgagaggtagtgatttaataca

SEQ ID NO: 215999 - DNA, 25 bp, Mus musculus
atttgagattaagaaatgtgacctt

SEQ ID NO: 216000 - DNA, 25 bp, Mus musculus
atttgagattaaggaagcctgctgc

SEQ ID NO: 216001 - DNA, 25 bp, Mus musculus
atttgagccgaggattaacacctgc

SEQ ID NO: 216002 - DNA, 25 bp, Mus musculus
atttgaggactgatgggatggctct

SEQ ID NO: 216003 - DNA, 25 bp, Mus musculus
atttgaggactttgaggacaatggt

SEQ ID NO: 216004 - DNA, 25 bp, Mus musculus
atttgagggggtcaggacaaagagg

SEQ ID NO: 216005 - DNA, 25 bp, Mus musculus
atttgaggtccaagctcggacctca

SEQ ID NO: 216006 - DNA, 25 bp, Mus musculus
atttgagtcctcaaactcactctgc

SEQ ID NO: 216007 - DNA, 25 bp, Mus musculus
atttgagtcctcaaagacaatgtgt

SEQ ID NO: 216008 - DNA, 25 bp, Mus musculus
atttgagtgacaaagtctacaggaa

SEQ ID NO: 216009 - DNA, 25 bp, Mus musculus
atttgagtggaatgcgctcttcgtg

SEQ ID NO: 216010 - DNA, 25 bp, Mus musculus
atttgataatgcaaacccgtggcag

SEQ ID NO: 216011 - DNA, 25 bp, Mus musculus
atttgatagacgtgaacgaagcttt

SEQ ID NO: 216012 - DNA, 25 bp, Mus musculus
atttgatcaacagacgtatgttgtc

SEQ ID NO: 216013 - DNA, 25 bp, Mus musculus
atttgatcaacagccaaaccactga

SEQ ID NO: 216014 - DNA, 25 bp, Mus musculus
atttgatgaggacagtggtgactac

SEQ ID NO: 216015 - DNA, 25 bp, Mus musculus
atttgatgcactagctgaaaaacat

SEQ ID NO: 216016 - DNA, 25 bp, Mus musculus
atttgatgctgtgcaaagtgcacac

SEQ ID NO: 216017 - DNA, 25 bp, Mus musculus
atttgatgctgtggacaaggtctct

SEQ ID NO: 216018 - DNA, 25 bp, Mus musculus
atttgatgctgtggactgtgtttga

SEQ ID NO: 216019 - DNA, 25 bp, Mus musculus
atttgatgtctggaagccatgactg

SEQ ID NO: 216020 - DNA, 25 bp, Mus musculus
atttgatttagacttggagatccct

SEQ ID NO: 216021 - DNA, 25 bp, Mus musculus
atttgattttcaggcagaaatttaa

SEQ ID NO: 216022 - DNA, 25 bp, Mus musculus
atttgattttcaggggctccaacac

SEQ ID NO: 216023 - DNA, 25 bp, Mus musculus
atttgcaaagtaaaaacaaatataa

SEQ ID NO: 216024 - DNA, 25 bp, Mus musculus
atttgcaagtggattgtcttgcctg

SEQ ID NO: 216025 - DNA, 25 bp, Mus musculus
atttgcacattcagaaacgcatccc

SEQ ID NO: 216026 - DNA, 25 bp, Mus musculus
atttgcacccctactctttctgacc

SEQ ID NO: 216027 - DNA, 25 bp, Mus musculus
atttgcacctgcggacggcatcgct

SEQ ID NO: 216028 - DNA, 25 bp, Mus musculus
atttgcacctgcggctctatcagaa

SEQ ID NO: 216029 - DNA, 25 bp, Mus musculus
atttgcacctgcgggtcagattatc

SEQ ID NO: 216030 - DNA, 25 bp, Mus musculus
atttgcactgtgtgaccagcccatc

SEQ ID NO: 216031 - DNA, 25 bp, Mus musculus
atttgcagaagcaagatcccaaaag

SEQ ID NO: 216032 - DNA, 25 bp, Mus musculus
atttgcagaagcaagtgttttgcct

SEQ ID NO: 216033 - DNA, 25 bp, Mus musculus
atttgcagaagtcgagtccctgcag

SEQ ID NO: 216034 - DNA, 25 bp, Mus musculus
atttgcagattcaaagttcacagtc

SEQ ID NO: 216035 - DNA, 25 bp, Mus musculus
atttgcagattcaaatgaccagcag

SEQ ID NO: 216036 - DNA, 25 bp, Mus musculus
atttgcagccaaggccacagaggat

SEQ ID NO: 216037 - DNA, 25 bp, Mus musculus
atttgcataaagactgaccatcatc

SEQ ID NO: 216038 - DNA, 25 bp, Mus musculus
atttgcatatgttcaatttgaggat

SEQ ID NO: 216039 - DNA, 25 bp, Mus musculus
atttgcatgcaaggcttgttccccc

SEQ ID NO: 216040 - DNA, 25 bp, Mus musculus
atttgcatgcaaggtacagaagaaa

SEQ ID NO: 216041 - DNA, 25 bp, Mus musculus
atttgccaataatccgtgccggcat

SEQ ID NO: 216042 - DNA, 25 bp, Mus musculus
atttgccaataatgcagaccagcag

SEQ ID NO: 216043 - DNA, 25 bp, Mus musculus
atttgcccttaaggccctggaattc

SEQ ID NO: 216044 - DNA, 25 bp, Mus musculus
atttgcccttaaggtccctgccctc

SEQ ID NO: 216045 - DNA, 25 bp, Mus musculus
atttgccgttaaacctgaagaatca

SEQ ID NO: 216046 - DNA, 25 bp, Mus musculus
atttgccgttaaatgtgggaacttc

SEQ ID NO: 216047 - DNA, 25 bp, Mus musculus
atttgcctttgcaggtgacagcagc

SEQ ID NO: 216048 - DNA, 25 bp, Mus musculus
atttgcgtagccgcctgtgtggtcc

SEQ ID NO: 216049 - DNA, 25 bp, Mus musculus
atttgcgttctcaggatccaaaggg

SEQ ID NO: 216050 - DNA, 25 bp, Mus musculus
atttgcgttctcgagcttcatgggg

SEQ ID NO: 216051 - DNA, 25 bp, Mus musculus
atttgctaaaggaagacttcgctga

SEQ ID NO: 216052 - DNA, 25 bp, Mus musculus
atttgctcaaaccagaacttgttcg

SEQ ID NO: 216053 - DNA, 25 bp, Mus musculus
atttgctcaaagccatcttcagagc

SEQ ID NO: 216054 - DNA, 25 bp, Mus musculus
atttgctcaaatggcctcctgggtg

SEQ ID NO: 216055 - DNA, 25 bp, Mus musculus
atttgctccgctttttgcaatgttt

SEQ ID NO: 216056 - DNA, 25 bp, Mus musculus
atttgctgagaggttttctcaagaa

SEQ ID NO: 216057 - DNA, 25 bp, Mus musculus
atttgctgagagtgctcacaggctg

SEQ ID NO: 216058 - DNA, 25 bp, Mus musculus
atttgctggtgaaggttcaattgtg

SEQ ID NO: 216059 - DNA, 25 bp, Mus musculus
atttgctggtgaagttatgtaatcc

SEQ ID NO: 216060 - DNA, 25 bp, Mus musculus
atttgctgtggagatcggcctggcc

SEQ ID NO: 216061 - DNA, 25 bp, Mus musculus
atttgctgtggagctccttcaaaaa

SEQ ID NO: 216062 - DNA, 25 bp, Mus musculus
atttgctgttctgtgattcttactg

SEQ ID NO: 216063 - DNA, 25 bp, Mus musculus
atttgcttctgaggtggtcctggac

SEQ ID NO: 216064 - DNA, 25 bp, Mus musculus
atttggaaccaagagatgcaccttg

SEQ ID NO: 216065 - DNA, 25 bp, Mus musculus
atttggaaccaagagtttctagctc

SEQ ID NO: 216066 - DNA, 25 bp, Mus musculus
atttggaagaagagaaccacaaact

SEQ ID NO: 216067 - DNA, 25 bp, Mus musculus
atttggaagaatttcagatgcccgt

SEQ ID NO: 216068 - DNA, 25 bp, Mus musculus
atttggaagaatttcagtgtctctg

SEQ ID NO: 216069 - DNA, 25 bp, Mus musculus
atttggaagagacctcaattattgt

SEQ ID NO: 216070 - DNA, 25 bp, Mus musculus
atttggaagctacgcttacacaacc

SEQ ID NO: 216071 - DNA, 25 bp, Mus musculus
atttggaaggaagttctcctcggac

SEQ ID NO: 216072 - DNA, 25 bp, Mus musculus
atttggaatctcaaggatgtcacag

SEQ ID NO: 216073 - DNA, 25 bp, Mus musculus
atttggaatgaagggtcctgtggct

SEQ ID NO: 216074 - DNA, 25 bp, Mus musculus
atttggacagcttccttgtgactcc

SEQ ID NO: 216075 - DNA, 25 bp, Mus musculus
atttggacagtttccagcaggagcc

SEQ ID NO: 216076 - DNA, 25 bp, Mus musculus
atttggacccatcagctatgtggtg

SEQ ID NO: 216077 - DNA, 25 bp, Mus musculus
atttggagaagaccaacctggtctt

SEQ ID NO: 216078 - DNA, 25 bp, Mus musculus
atttggagaaggatcttcaagctac

SEQ ID NO: 216079 - DNA, 25 bp, Mus musculus
atttggagaaggtacattattttgt

SEQ ID NO: 216080 - DNA, 25 bp, Mus musculus
atttggagaggtacaactgatgaga

SEQ ID NO: 216081 - DNA, 25 bp, Mus musculus
atttggagccagacacttgtctcct

SEQ ID NO: 216082 - DNA, 25 bp, Mus musculus
atttggagccagcgacccatacgtg

SEQ ID NO: 216083 - DNA, 25 bp, Mus musculus
atttggaggagtatagaacattgca

SEQ ID NO: 216084 - DNA, 25 bp, Mus musculus
atttggagtagatcaatccccttct

SEQ ID NO: 216085 - DNA, 25 bp, Mus musculus
atttggatgaggatggaagactgtg

SEQ ID NO: 216086 - DNA, 25 bp, Mus musculus
atttggcaatgatggaagcaatttt

SEQ ID NO: 216087 - DNA, 25 bp, Mus musculus
atttggcaatgatggtggctatggc

SEQ ID NO: 216088 - DNA, 25 bp, Mus musculus
atttggcaatgatggtggttatgga

SEQ ID NO: 216089 - DNA, 25 bp, Mus musculus
atttggcacatacgtgcagttctcc

SEQ ID NO: 216090 - DNA, 25 bp, Mus musculus
atttggcagagagcactccccatat

SEQ ID NO: 216091 - DNA, 25 bp, Mus musculus
atttggcataattccaagaaacaat

SEQ ID NO: 216092 - DNA, 25 bp, Mus musculus
atttggccgtaggtttagtctccac

SEQ ID NO: 216093 - DNA, 25 bp, Mus musculus
atttggctcatcaggaggactgaca

SEQ ID NO: 216094 - DNA, 25 bp, Mus musculus
atttggctcatcagttggcagttct

SEQ ID NO: 216095 - DNA, 25 bp, Mus musculus
atttggctccatgaagtacaaaggc

SEQ ID NO: 216096 - DNA, 25 bp, Mus musculus
atttggctgccatagcaaaaaagca

SEQ ID NO: 216097 - DNA, 25 bp, Mus musculus
atttggctgccataggagtcagtga

SEQ ID NO: 216098 - DNA, 25 bp, Mus musculus
atttggcttcaatactgggcggttg

SEQ ID NO: 216099 - DNA, 25 bp, Mus musculus
atttggcttcatactttatcttgtg

SEQ ID NO: 216100 - DNA, 25 bp, Mus musculus
atttggcttgactgctccttctggc

SEQ ID NO: 216101 - DNA, 25 bp, Mus musculus
atttggcttgcaaggctaccaaggc

SEQ ID NO: 216102 - DNA, 25 bp, Mus musculus
atttggctttatcaggcgttctgtc

SEQ ID NO: 216103 - DNA, 25 bp, Mus musculus
atttggctttatcaggggcgttcaa

SEQ ID NO: 216104 - DNA, 25 bp, Mus musculus
atttgggaaaaggactagcggacat

SEQ ID NO: 216105 - DNA, 25 bp, Mus musculus
atttgggaaaaggtgatgcctgctt

SEQ ID NO: 216106 - DNA, 25 bp, Mus musculus
atttgggagcgggggtccaactgag

SEQ ID NO: 216107 - DNA, 25 bp, Mus musculus
atttgggagtcaggacacctatatc

SEQ ID NO: 216108 - DNA, 25 bp, Mus musculus
atttgggagttatgcatatcccaaa

SEQ ID NO: 216109 - DNA, 25 bp, Mus musculus
atttgggcacgatgtataccaggtg

SEQ ID NO: 216110 - DNA, 25 bp, Mus musculus
atttgggcacggactgtcagggcag

SEQ ID NO: 216111 - DNA, 25 bp, Mus musculus
atttgggctgctggcaactatcgaa

SEQ ID NO: 216112 - DNA, 25 bp, Mus musculus
atttgggtcttctaattgtcaacag

SEQ ID NO: 216113 - DNA, 25 bp, Mus musculus
atttgggtgcaatgggtgaaagagc

SEQ ID NO: 216114 - DNA, 25 bp, Mus musculus
atttggtgcaacgtttgtgcttgtc

SEQ ID NO: 216115 - DNA, 25 bp, Mus musculus
atttggtggtggaggaggggaattt

SEQ ID NO: 216116 - DNA, 25 bp, Mus musculus
atttggtgttcccttgccaagaaac

SEQ ID NO: 216117 - DNA, 25 bp, Mus musculus
atttggttactcagggatgaacaag

SEQ ID NO: 216118 - DNA, 25 bp, Mus musculus
atttggttcagagtcttttacatgt

SEQ ID NO: 216119 - DNA, 25 bp, Mus musculus
atttggttcagagttgtcctgggga

SEQ ID NO: 216120 - DNA, 25 bp, Mus musculus
atttgtacaaaagccctatagtcgc

SEQ ID NO: 216121 - DNA, 25 bp, Mus musculus
atttgtacaaaaggttgaagaaatg

SEQ ID NO: 216122 - DNA, 25 bp, Mus musculus
atttgtaccattgggcagcaagaag

SEQ ID NO: 216123 - DNA, 25 bp, Mus musculus
atttgtagaactagtccttatcgga

SEQ ID NO: 216124 - DNA, 25 bp, Mus musculus
atttgtagaactatgcattttgcag

SEQ ID NO: 216125 - DNA, 25 bp, Mus musculus
atttgtataagagagttctggagtc

SEQ ID NO: 216126 - DNA, 25 bp, Mus musculus
atttgtataaggtactgggaagaat

SEQ ID NO: 216127 - DNA, 25 bp, Mus musculus
atttgtatgtataggctgttatgtt

SEQ ID NO: 216128 - DNA, 25 bp, Mus musculus
atttgtcaaagactgccttactaaa

SEQ ID NO: 216129 - DNA, 25 bp, Mus musculus
atttgtcaaataaaaatccatggag

SEQ ID NO: 216130 - DNA, 25 bp, Mus musculus
atttgtccagccccagcatctcacc

SEQ ID NO: 216131 - DNA, 25 bp, Mus musculus
atttgtcccatggccttctttctag

SEQ ID NO: 216132 - DNA, 25 bp, Mus musculus
atttgtccccgggaggtttcatggg

SEQ ID NO: 216133 - DNA, 25 bp, Mus musculus
atttgtcccgtggcccctctggttt

SEQ ID NO: 216134 - DNA, 25 bp, Mus musculus
atttgtcccgtgggcccaagaactc

SEQ ID NO: 216135 - DNA, 25 bp, Mus musculus
atttgtccgtatgttatatctcaac

SEQ ID NO: 216136 - DNA, 25 bp, Mus musculus
atttgtcctgggaacagaaattctt

SEQ ID NO: 216137 - DNA, 25 bp, Mus musculus
atttgtcctggtatgatcccaggct

SEQ ID NO: 216138 - DNA, 25 bp, Mus musculus
atttgtcgactggaaggataggtgc

SEQ ID NO: 216139 - DNA, 25 bp, Mus musculus
atttgtcgataatctgtatcgattc

SEQ ID NO: 216140 - DNA, 25 bp, Mus musculus
atttgtctgcaaggaatggaccggg

SEQ ID NO: 216141 - DNA, 25 bp, Mus musculus
atttgtctgcaaggatctctcctca

SEQ ID NO: 216142 - DNA, 25 bp, Mus musculus
atttgtgaaaggcactgaagatcca

SEQ ID NO: 216143 - DNA, 25 bp, Mus musculus
atttgtgaaccaaggaattcatcct

SEQ ID NO: 216144 - DNA, 25 bp, Mus musculus
atttgtgaagaaacccccagttgtt

SEQ ID NO: 216145 - DNA, 25 bp, Mus musculus
atttgtgaagatatagatgagtgca

SEQ ID NO: 216146 - DNA, 25 bp, Mus musculus
atttgtgaagatatcgatgagtgtg

SEQ ID NO: 216147 - DNA, 25 bp, Mus musculus
atttgtgaagatgaagatgaatgtg

SEQ ID NO: 216148 - DNA, 25 bp, Mus musculus
atttgtgaagcctccaggcatcttt

SEQ ID NO: 216149 - DNA, 25 bp, Mus musculus
atttgtgaagctggaagccgaagct

SEQ ID NO: 216150 - DNA, 25 bp, Mus musculus
atttgtgaaggtatccgcccccaga

SEQ ID NO: 216151 - DNA, 25 bp, Mus musculus
atttgtgaaggtttcagaggattaa

SEQ ID NO: 216152 - DNA, 25 bp, Mus musculus
atttgtgacaaagcccaatggcgcg

SEQ ID NO: 216153 - DNA, 25 bp, Mus musculus
atttgtgacgcgggatggtcactcg

SEQ ID NO: 216154 - DNA, 25 bp, Mus musculus
atttgtgagactcgccccacccatc

SEQ ID NO: 216155 - DNA, 25 bp, Mus musculus
atttgtgagcagaacatgttactaa

SEQ ID NO: 216156 - DNA, 25 bp, Mus musculus
atttgtgagcaggtgtccacaaagt

SEQ ID NO: 216157 - DNA, 25 bp, Mus musculus
atttgtgaggcgaacattgaggctt

SEQ ID NO: 216158 - DNA, 25 bp, Mus musculus
atttgtgcacaaggtggtccgagac

SEQ ID NO: 216159 - DNA, 25 bp, Mus musculus
atttgtggggcggatgtctgctcag

SEQ ID NO: 216160 - DNA, 25 bp, Mus musculus
atttgtggggtctcaaagcaagctg

SEQ ID NO: 216161 - DNA, 25 bp, Mus musculus
atttgtggtgataatgagtctaccc

SEQ ID NO: 216162 - DNA, 25 bp, Mus musculus
atttgtgtgctcgaaaattggagtt

SEQ ID NO: 216163 - DNA, 25 bp, Mus musculus
atttgttattgatgctgtaagaact

SEQ ID NO: 216164 - DNA, 25 bp, Mus musculus
atttgttcccaggcaaattccatca

SEQ ID NO: 216165 - DNA, 25 bp, Mus musculus
atttgttcgggaacctttgctcatt

SEQ ID NO: 216166 - DNA, 25 bp, Mus musculus
atttgttcgggcttacggtgaaggc

SEQ ID NO: 216167 - DNA, 25 bp, Mus musculus
atttgttcttaaggatacagaggaa

SEQ ID NO: 216168 - DNA, 25 bp, Mus musculus
atttgttcttaagtggccaaatgta

SEQ ID NO: 216169 - DNA, 25 bp, Mus musculus
atttgttgttcagagattgacggcg

SEQ ID NO: 216170 - DNA, 25 bp, Mus musculus
atttgttgttcagagccaccagtgg

SEQ ID NO: 216171 - DNA, 25 bp, Mus musculus
atttgtttgcaatcaattatactgg

SEQ ID NO: 216172 - DNA, 25 bp, Mus musculus
attttaaaaaagtcgagcctgttga

SEQ ID NO: 216173 - DNA, 25 bp, Mus musculus
attttaaaaggaaacagacagctga

SEQ ID NO: 216174 - DNA, 25 bp, Mus musculus
attttaaagacggctatggatgttg

SEQ ID NO: 216175 - DNA, 25 bp, Mus musculus
attttaaagagtattcaaattgcca

SEQ ID NO: 216176 - DNA, 25 bp, Mus musculus
attttaaagagttgattccagaatt

SEQ ID NO: 216177 - DNA, 25 bp, Mus musculus
attttaaagctgccatccatccaga

SEQ ID NO: 216178 - DNA, 25 bp, Mus musculus
attttaaataggttgtaggaagtgt

SEQ ID NO: 216179 - DNA, 25 bp, Mus musculus
attttaaatttcagattttatcatg

SEQ ID NO: 216180 - DNA, 25 bp, Mus musculus
attttaagatgaaaatacttggaaa

SEQ ID NO: 216181 - DNA, 25 bp, Mus musculus
attttaagccagaacgctttaccgt

SEQ ID NO: 216182 - DNA, 25 bp, Mus musculus
attttaagccagagttgtaagcttg

SEQ ID NO: 216183 - DNA, 25 bp, Mus musculus
attttaatagctcgatgacctcaca

SEQ ID NO: 216184 - DNA, 25 bp, Mus musculus
attttaatagtgctagccatcgctc

SEQ ID NO: 216185 - DNA, 25 bp, Mus musculus
attttaatgaatgcagctgccttgg

SEQ ID NO: 216186 - DNA, 25 bp, Mus musculus
attttactaagagatgtggctttgg

SEQ ID NO: 216187 - DNA, 25 bp, Mus musculus
attttactccagatggcagactttc

SEQ ID NO: 216188 - DNA, 25 bp, Mus musculus
attttactccagccctggctgtcct

SEQ ID NO: 216189 - DNA, 25 bp, Mus musculus
attttagaagataggttaagagcag

SEQ ID NO: 216190 - DNA, 25 bp, Mus musculus
attttagaaggccccaggacacatt

SEQ ID NO: 216191 - DNA, 25 bp, Mus musculus
attttagacatagtagcaacccagc

SEQ ID NO: 216192 - DNA, 25 bp, Mus musculus
attttagatctgcctcactagtagc

SEQ ID NO: 216193 - DNA, 25 bp, Mus musculus
attttagcagcttcttactgtgttt

SEQ ID NO: 216194 - DNA, 25 bp, Mus musculus
attttagcaggtgaatatgaccatc

SEQ ID NO: 216195 - DNA, 25 bp, Mus musculus
attttagccaccaggacacagaatg

SEQ ID NO: 216196 - DNA, 25 bp, Mus musculus
attttaggattatagatcctggcag

SEQ ID NO: 216197 - DNA, 25 bp, Mus musculus
attttaggtgtaagcccatctgctg

SEQ ID NO: 216198 - DNA, 25 bp, Mus musculus
attttagtaggaagggcatttgtgt

SEQ ID NO: 216199 - DNA, 25 bp, Mus musculus
attttatgatgagtgtaaaagaaga

SEQ ID NO: 216200 - DNA, 25 bp, Mus musculus
attttatgatgagtgtttatcacca

SEQ ID NO: 216201 - DNA, 25 bp, Mus musculus
attttatgccaaaggctttaacaga

SEQ ID NO: 216202 - DNA, 25 bp, Mus musculus
attttatgccagagatttcagaagc

SEQ ID NO: 216203 - DNA, 25 bp, Mus musculus
attttatgctttaggtgaaggcgat

SEQ ID NO: 216204 - DNA, 25 bp, Mus musculus
attttatggtccaacgacctgagcc

SEQ ID NO: 216205 - DNA, 25 bp, Mus musculus
attttatgtggggagagaaaagaaa

SEQ ID NO: 216206 - DNA, 25 bp, Mus musculus
attttattacgtttggcaaacatcg

SEQ ID NO: 216207 - DNA, 25 bp, Mus musculus
attttattcatccaacaactatttg

SEQ ID NO: 216208 - DNA, 25 bp, Mus musculus
attttattcatgcttaggtggagaa

SEQ ID NO: 216209 - DNA, 25 bp, Mus musculus
attttattcatttttctggatatgc

SEQ ID NO: 216210 - DNA, 25 bp, Mus musculus
attttcaagatcaagcttctcttgc

SEQ ID NO: 216211 - DNA, 25 bp, Mus musculus
attttcaagccctggtaacccatag

SEQ ID NO: 216212 - DNA, 25 bp, Mus musculus
attttcaagccctggtgtctcttgc

SEQ ID NO: 216213 - DNA, 25 bp, Mus musculus
attttcaataatggacgctgtagtg

SEQ ID NO: 216214 - DNA, 25 bp, Mus musculus
attttcaatgggaaagcgagcttgc

SEQ ID NO: 216215 - DNA, 25 bp, Mus musculus
attttcacagggaacaagtttacca

SEQ ID NO: 216216 - DNA, 25 bp, Mus musculus
attttcacgtctctggacaagccct

SEQ ID NO: 216217 - DNA, 25 bp, Mus musculus
attttcacgtggagcctgacagcag

SEQ ID NO: 216218 - DNA, 25 bp, Mus musculus
attttcacgtgggcgggccaggctg

SEQ ID NO: 216219 - DNA, 25 bp, Mus musculus
attttcaggcaaaagcgagcggagc

SEQ ID NO: 216220 - DNA, 25 bp, Mus musculus
attttcagggcattgtgcttcttct

SEQ ID NO: 216221 - DNA, 25 bp, Mus musculus
attttcagtcagatatactttatta

SEQ ID NO: 216222 - DNA, 25 bp, Mus musculus
attttcagtgatataccgatacttc

SEQ ID NO: 216223 - DNA, 25 bp, Mus musculus
attttcagtgtttgtgaggaaacag

SEQ ID NO: 216224 - DNA, 25 bp, Mus musculus
attttcatctctgagaacagaggcg

SEQ ID NO: 216225 - DNA, 25 bp, Mus musculus
attttcattataagaacaacaaaac

SEQ ID NO: 216226 - DNA, 25 bp, Mus musculus
attttcattataagcatgatcggga

SEQ ID NO: 216227 - DNA, 25 bp, Mus musculus
attttccaagcagggaccaggataa

SEQ ID NO: 216228 - DNA, 25 bp, Mus musculus
attttccaagcagttactgctgacc

SEQ ID NO: 216229 - DNA, 25 bp, Mus musculus
attttccaagctgatcatatgatgt

SEQ ID NO: 216230 - DNA, 25 bp, Mus musculus
attttccaatatggctttatcctct

SEQ ID NO: 216231 - DNA, 25 bp, Mus musculus
attttccacaatacgcgccccctgt

SEQ ID NO: 216232 - DNA, 25 bp, Mus musculus
attttccacacagttgaaaagggca

SEQ ID NO: 216233 - DNA, 25 bp, Mus musculus
attttccacggaagagtaaagacat

SEQ ID NO: 216234 - DNA, 25 bp, Mus musculus
attttccagcaaagaattgggatat

SEQ ID NO: 216235 - DNA, 25 bp, Mus musculus
attttccagcaaaggtttagaccct

SEQ ID NO: 216236 - DNA, 25 bp, Mus musculus
attttccatcaagatcagagacacc

SEQ ID NO: 216237 - DNA, 25 bp, Mus musculus
attttcccaccaagcccacaaggcc

SEQ ID NO: 216238 - DNA, 25 bp, Mus musculus
attttcctagctgggctatggagtt

SEQ ID NO: 216239 - DNA, 25 bp, Mus musculus
attttcctgaagataggacgggaga

SEQ ID NO: 216240 - DNA, 25 bp, Mus musculus
attttcgcaactgcgcaaaccatgc

SEQ ID NO: 216241 - DNA, 25 bp, Mus musculus
attttcggcaaggatgagccccaag

SEQ ID NO: 216242 - DNA, 25 bp, Mus musculus
attttcggcaagggcgtctactggg

SEQ ID NO: 216243 - DNA, 25 bp, Mus musculus
attttcggctggacgtcgactgtgt

SEQ ID NO: 216244 - DNA, 25 bp, Mus musculus
attttctacagctctcaacctacga

SEQ ID NO: 216245 - DNA, 25 bp, Mus musculus
attttctagcacttgtgcttccaat

SEQ ID NO: 216246 - DNA, 25 bp, Mus musculus
attttctcacaaacattaaccaggt

SEQ ID NO: 216247 - DNA, 25 bp, Mus musculus
attttctcacaataggtgaccttca

SEQ ID NO: 216248 - DNA, 25 bp, Mus musculus
attttctcacatcttggaggaggaa

SEQ ID NO: 216249 - DNA, 25 bp, Mus musculus
attttctcagcaagccccgcccaac

SEQ ID NO: 216250 - DNA, 25 bp, Mus musculus
attttctcagggaggcgccttgtct

SEQ ID NO: 216251 - DNA, 25 bp, Mus musculus
attttctcaggggccgatcaacagt

SEQ ID NO: 216252 - DNA, 25 bp, Mus musculus
attttctcaggtgtgcatgtagccg

SEQ ID NO: 216253 - DNA, 25 bp, Mus musculus
attttctccagaaggtcgcttatac

SEQ ID NO: 216254 - DNA, 25 bp, Mus musculus
attttctcctatggctgtcttcaga

SEQ ID NO: 216255 - DNA, 25 bp, Mus musculus
attttctcctatgggtatggccgaa

SEQ ID NO: 216256 - DNA, 25 bp, Mus musculus
attttctctgcgcagatgttgatga

SEQ ID NO: 216257 - DNA, 25 bp, Mus musculus
attttctgaagagacttgcctttca

SEQ ID NO: 216258 - DNA, 25 bp, Mus musculus
attttctgaagaggcttatccatga

SEQ ID NO: 216259 - DNA, 25 bp, Mus musculus
attttctgaatcacggagtcaaagt

SEQ ID NO: 216260 - DNA, 25 bp, Mus musculus
attttctgaatcacgtgtcgagtgt

SEQ ID NO: 216261 - DNA, 25 bp, Mus musculus
attttctggataagagtgcctcggg

SEQ ID NO: 216262 - DNA, 25 bp, Mus musculus
attttctggataagcccacctggaa

SEQ ID NO: 216263 - DNA, 25 bp, Mus musculus
attttctggataaggtgcttctgtg

SEQ ID NO: 216264 - DNA, 25 bp, Mus musculus
attttctggatgagaattggcaagg

SEQ ID NO: 216265 - DNA, 25 bp, Mus musculus
attttctggcattgatggtttgtct

SEQ ID NO: 216266 - DNA, 25 bp, Mus musculus
attttctggcattggatctactgct

SEQ ID NO: 216267 - DNA, 25 bp, Mus musculus
attttctggggaatgaattccacag

SEQ ID NO: 216268 - DNA, 25 bp, Mus musculus
attttctgtcagaagccacattgaa

SEQ ID NO: 216269 - DNA, 25 bp, Mus musculus
attttcttatatgggagagtcagtc

SEQ ID NO: 216270 - DNA, 25 bp, Mus musculus
attttcttggggacagtgaaatgct

SEQ ID NO: 216271 - DNA, 25 bp, Mus musculus
attttcttggggctccagccttccc

SEQ ID NO: 216272 - DNA, 25 bp, Mus musculus
attttctttgggcagctgctcgccc

SEQ ID NO: 216273 - DNA, 25 bp, Mus musculus
attttctttgttcaggagtttaatc

SEQ ID NO: 216274 - DNA, 25 bp, Mus musculus
attttgaaagatgtccttcaagaac

SEQ ID NO: 216275 - DNA, 25 bp, Mus musculus
attttgaagtaaaaggcaaccagat

SEQ ID NO: 216276 - DNA, 25 bp, Mus musculus
attttgacaaagagcctgactctga

SEQ ID NO: 216277 - DNA, 25 bp, Mus musculus
attttgacaagaagcagacaggcag

SEQ ID NO: 216278 - DNA, 25 bp, Mus musculus
attttgacaaggaccatggcggggc

SEQ ID NO: 216279 - DNA, 25 bp, Mus musculus
attttgacaccatttggaggtgtgg

SEQ ID NO: 216280 - DNA, 25 bp, Mus musculus
attttgaccttggacttcctggaca

SEQ ID NO: 216281 - DNA, 25 bp, Mus musculus
attttgagaaggtcatcttggaaga

SEQ ID NO: 216282 - DNA, 25 bp, Mus musculus
attttgagatgtccatatgtggttg

SEQ ID NO: 216283 - DNA, 25 bp, Mus musculus
attttgaggctaagacccttcggga

SEQ ID NO: 216284 - DNA, 25 bp, Mus musculus
attttgaggctatcagtgacgagga

SEQ ID NO: 216285 - DNA, 25 bp, Mus musculus
attttgagtctacaggtttgtacag

SEQ ID NO: 216286 - DNA, 25 bp, Mus musculus
attttgatataaaggttttaaatgc

SEQ ID NO: 216287 - DNA, 25 bp, Mus musculus
attttgatgactaccatcatcgaga

SEQ ID NO: 216288 - DNA, 25 bp, Mus musculus
attttgatggagcctgaaacatttg

SEQ ID NO: 216289 - DNA, 25 bp, Mus musculus
attttgcagagattgagaagcattg

SEQ ID NO: 216290 - DNA, 25 bp, Mus musculus
attttgcagagctttgggaccatct

SEQ ID NO: 216291 - DNA, 25 bp, Mus musculus
attttgcattctcagcatggtgaga

SEQ ID NO: 216292 - DNA, 25 bp, Mus musculus
attttgccaaaggtgttttacatga

SEQ ID NO: 216293 - DNA, 25 bp, Mus musculus
attttgcccccaaagatcatccagc

SEQ ID NO: 216294 - DNA, 25 bp, Mus musculus
attttgcccccaaagctcctgtgcc

SEQ ID NO: 216295 - DNA, 25 bp, Mus musculus
attttgccgatcagaaccagtttga

SEQ ID NO: 216296 - DNA, 25 bp, Mus musculus
attttgccgatcagctatatttctc

SEQ ID NO: 216297 - DNA, 25 bp, Mus musculus
attttgcctaatttggctgagtatg

SEQ ID NO: 216298 - DNA, 25 bp, Mus musculus
attttgcctgaatcgcccaagagcc

SEQ ID NO: 216299 - DNA, 25 bp, Mus musculus
attttgctcacctgcggcttgggtg

SEQ ID NO: 216300 - DNA, 25 bp, Mus musculus
attttgctctgatggttggcactgg

SEQ ID NO: 216301 - DNA, 25 bp, Mus musculus
attttggaactagagttggtgacac

SEQ ID NO: 216302 - DNA, 25 bp, Mus musculus
attttggaactaggtgcaagaatat

SEQ ID NO: 216303 - DNA, 25 bp, Mus musculus
attttggaaggaggccatgtcatga

SEQ ID NO: 216304 - DNA, 25 bp, Mus musculus
attttggaaggtgcctctcctttcc

SEQ ID NO: 216305 - DNA, 25 bp, Mus musculus
attttgggattttagttctcaaata

SEQ ID NO: 216306 - DNA, 25 bp, Mus musculus
attttgggattttatcgcatcatat

SEQ ID NO: 216307 - DNA, 25 bp, Mus musculus
attttgggttaccgagagcttttgc

SEQ ID NO: 216308 - DNA, 25 bp, Mus musculus
attttggtggcaagcttggcgcccg

SEQ ID NO: 216309 - DNA, 25 bp, Mus musculus
attttgtaagaggacaatgcgtatg

SEQ ID NO: 216310 - DNA, 25 bp, Mus musculus
attttgtaagtacaaacaggccatc

SEQ ID NO: 216311 - DNA, 25 bp, Mus musculus
attttgtagaggagctccaagtatg

SEQ ID NO: 216312 - DNA, 25 bp, Mus musculus
attttgtagctgggattgacttcta

SEQ ID NO: 216313 - DNA, 25 bp, Mus musculus
attttgtcgttcggtgctcgtagct

SEQ ID NO: 216314 - DNA, 25 bp, Mus musculus
attttgtgcagcttacctgtggttc

SEQ ID NO: 216315 - DNA, 25 bp, Mus musculus
attttgtgcaggatctgctgatgat

SEQ ID NO: 216316 - DNA, 25 bp, Mus musculus
attttgtgctcgattacgctcgatt

SEQ ID NO: 216317 - DNA, 25 bp, Mus musculus
attttgttaaaggctgatgaaccaa

SEQ ID NO: 216318 - DNA, 25 bp, Mus musculus
attttgttaaggaaattaagcgaga

SEQ ID NO: 216319 - DNA, 25 bp, Mus musculus
attttgttatgccagtcaggatttg

SEQ ID NO: 216320 - DNA, 25 bp, Mus musculus
attttgttcagaacgatcatccagc

SEQ ID NO: 216321 - DNA, 25 bp, Mus musculus
attttgtttcggaagacaacatggc

SEQ ID NO: 216322 - DNA, 25 bp, Mus musculus
attttgtttcggacaggccaggagg

SEQ ID NO: 216323 - DNA, 25 bp, Mus musculus
attttgtttcgggacaactgccact

SEQ ID NO: 216324 - DNA, 25 bp, Mus musculus
atttttaacagaagcaaacccaaag

SEQ ID NO: 216325 - DNA, 25 bp, Mus musculus
atttttaacagattagttcataaag

SEQ ID NO: 216326 - DNA, 25 bp, Mus musculus
atttttaagaggcaagaaacaaaag

SEQ ID NO: 216327 - DNA, 25 bp, Mus musculus
atttttaatagatggagagcatccc

SEQ ID NO: 216328 - DNA, 25 bp, Mus musculus
atttttaatcagtctgttatctcct

SEQ ID NO: 216329 - DNA, 25 bp, Mus musculus
atttttaatgagctacccatgacat

SEQ ID NO: 216330 - DNA, 25 bp, Mus musculus
atttttacaaggcatcaaggagtcc

SEQ ID NO: 216331 - DNA, 25 bp, Mus musculus
atttttacagggaggagcctcgatt

SEQ ID NO: 216332 - DNA, 25 bp, Mus musculus
atttttactaatcaggattgtcttg

SEQ ID NO: 216333 - DNA, 25 bp, Mus musculus
atttttagaaccccggtggcgacag

SEQ ID NO: 216334 - DNA, 25 bp, Mus musculus
atttttagatatgcttggcctgtgg

SEQ ID NO: 216335 - DNA, 25 bp, Mus musculus
atttttataaaggcagctgctggga

SEQ ID NO: 216336 - DNA, 25 bp, Mus musculus
atttttatgttgagctaccaatatg

SEQ ID NO: 216337 - DNA, 25 bp, Mus musculus
atttttcaaggaagagaagtggtgg

SEQ ID NO: 216338 - DNA, 25 bp, Mus musculus
atttttcaaggagaggtctggtcca

SEQ ID NO: 216339 - DNA, 25 bp, Mus musculus
atttttcaaggagaggttgctatgg

SEQ ID NO: 216340 - DNA, 25 bp, Mus musculus
atttttcagaaagtaaacgaagcaa

SEQ ID NO: 216341 - DNA, 25 bp, Mus musculus
atttttcagaaccagcctgggcccg

SEQ ID NO: 216342 - DNA, 25 bp, Mus musculus
atttttcagaaccagctttgaatgg

SEQ ID NO: 216343 - DNA, 25 bp, Mus musculus
atttttcagagctgcgttcagtttc

SEQ ID NO: 216344 - DNA, 25 bp, Mus musculus
atttttcaggcccaatgatgatcat

SEQ ID NO: 216345 - DNA, 25 bp, Mus musculus
atttttcaggggatgtttcggaagg

SEQ ID NO: 216346 - DNA, 25 bp, Mus musculus
atttttccactatagtgagttctct

SEQ ID NO: 216347 - DNA, 25 bp, Mus musculus
atttttcccccctcaagatcggctt

SEQ ID NO: 216348 - DNA, 25 bp, Mus musculus
atttttcggaagacagcgtggaaga

SEQ ID NO: 216349 - DNA, 25 bp, Mus musculus
atttttctagcaagttgcgaatcaa

SEQ ID NO: 216350 - DNA, 25 bp, Mus musculus
atttttctaggacatgtatgcatca

SEQ ID NO: 216351 - DNA, 25 bp, Mus musculus
atttttctcagtaccaacaaaagca

SEQ ID NO: 216352 - DNA, 25 bp, Mus musculus
atttttctgaattattttgataaga

SEQ ID NO: 216353 - DNA, 25 bp, Mus musculus
atttttctgggattgggtcgaaaag

SEQ ID NO: 216354 - DNA, 25 bp, Mus musculus
atttttctgggcccctgatgattgt

SEQ ID NO: 216355 - DNA, 25 bp, Mus musculus
atttttgaaggttaatatccttcca

SEQ ID NO: 216356 - DNA, 25 bp, Mus musculus
atttttgaagtatgcgagcattgaa

SEQ ID NO: 216357 - DNA, 25 bp, Mus musculus
atttttgacagagctgtcgcagctt

SEQ ID NO: 216358 - DNA, 25 bp, Mus musculus
atttttgcgacttggacctttgggc

SEQ ID NO: 216359 - DNA, 25 bp, Mus musculus
atttttgtgtggttcatttttataa

SEQ ID NO: 216360 - DNA, 25 bp, Mus musculus
attttttacaaatggtattctctga

SEQ ID NO: 216361 - DNA, 25 bp, Mus musculus
attttttacaaatgttatccaagca

SEQ ID NO: 216362 - DNA, 25 bp, Mus musculus
attttttatcagccatcgtctagag

SEQ ID NO: 216363 - DNA, 25 bp, Mus musculus
attttttgaacaaggaagctcggat

SEQ ID NO: 216364 - DNA, 25 bp, Mus musculus
attttttgagacaaaagatgtattc

SEQ ID NO: 216365 - DNA, 25 bp, Mus musculus
attttttgcaggcatcacagactgc

SEQ ID NO: 216366 - DNA, 25 bp, Mus musculus
atttttttactgatgaattcctggc

SEQ ID NO: 216367 - DNA, 25 bp, Mus musculus
atttttttactgatgggcatccaac

SEQ ID NO: 216368 - DNA, 25 bp, Mus musculus
atttttttattaagctctgattcaa

SEQ ID NO: 216369 - DNA, 25 bp, Mus musculus
atttttttattaaggtggccatgca

SEQ ID NO: 216370 - DNA, 25 bp, Mus musculus
atttttttctatctgcccgcggtat

SEQ ID NO: 216371 - DNA, 25 bp, Mus musculus
atttttttgcttaggtcttgtctgt

SEQ ID NO: 216372 - DNA, 25 bp, Mus musculus
caaaaaaaagctgctgatcactggt

SEQ ID NO: 216373 - DNA, 25 bp, Mus musculus
caaaaaaactggaagccaagtacaa

SEQ ID NO: 216374 - DNA, 25 bp, Mus musculus
caaaaaaactggaagtcagcagggg

SEQ ID NO: 216375 - DNA, 25 bp, Mus musculus
caaaaaaaggagctgggggacagct

SEQ ID NO: 216376 - DNA, 25 bp, Mus musculus
caaaaaacacagctgcctgccttgt

SEQ ID NO: 216377 - DNA, 25 bp, Mus musculus
caaaaaacagatcaaaaggtccctt

SEQ ID NO: 216378 - DNA, 25 bp, Mus musculus
caaaaaaccagtgcctccgaagcca

SEQ ID NO: 216379 - DNA, 25 bp, Mus musculus
caaaaaacttgagcccagcgggccc

SEQ ID NO: 216380 - DNA, 25 bp, Mus musculus
caaaaaagagctctcttacagggcc

SEQ ID NO: 216381 - DNA, 25 bp, Mus musculus
caaaaaagccaggcctctgatcctg

SEQ ID NO: 216382 - DNA, 25 bp, Mus musculus
caaaaaatcagggcttgcggcttat

SEQ ID NO: 216383 - DNA, 25 bp, Mus musculus
caaaaaatcagtggttagccagcgc

SEQ ID NO: 216384 - DNA, 25 bp, Mus musculus
caaaaaatcagttcccaagagttcc

SEQ ID NO: 216385 - DNA, 25 bp, Mus musculus
caaaaaatctccaggtcccgtcagg

SEQ ID NO: 216386 - DNA, 25 bp, Mus musculus
caaaaacaacagaatcaagacacat

SEQ ID NO: 216387 - DNA, 25 bp, Mus musculus
caaaaacaacaggctcctcaacttt

SEQ ID NO: 216388 - DNA, 25 bp, Mus musculus
caaaaacaacatcctgcggtattcc

SEQ ID NO: 216389 - DNA, 25 bp, Mus musculus
caaaaacaagctttacacagatttt

SEQ ID NO: 216390 - DNA, 25 bp, Mus musculus
caaaaacacagaatctgctggatga

SEQ ID NO: 216391 - DNA, 25 bp, Mus musculus
caaaaacacagagcttaccatctag

SEQ ID NO: 216392 - DNA, 25 bp, Mus musculus
caaaaacacaggcagagctcagata

SEQ ID NO: 216393 - DNA, 25 bp, Mus musculus
caaaaacacagggggaagagggcag

SEQ ID NO: 216394 - DNA, 25 bp, Mus musculus
caaaaacagtatgtgtgcagttatg

SEQ ID NO: 216395 - DNA, 25 bp, Mus musculus
caaaaaccaaagaatgacttcgctc

SEQ ID NO: 216396 - DNA, 25 bp, Mus musculus
caaaaaccaaaggccagcgtgacgg

SEQ ID NO: 216397 - DNA, 25 bp, Mus musculus
caaaaaccaagaatggattgtcgcc

SEQ ID NO: 216398 - DNA, 25 bp, Mus musculus
caaaaaccaagaggaaagcatagat

SEQ ID NO: 216399 - DNA, 25 bp, Mus musculus
caaaaaccatctttcaggacctgcc

SEQ ID NO: 216400 - DNA, 25 bp, Mus musculus
caaaaaccatgccttttgcctttcc

SEQ ID NO: 216401 - DNA, 25 bp, Mus musculus
caaaaaccatgtgtgagtgttatga

SEQ ID NO: 216402 - DNA, 25 bp, Mus musculus
caaaaaccgaagcgcagcagcagtt

SEQ ID NO: 216403 - DNA, 25 bp, Mus musculus
caaaaactgccagttggtggcacta

SEQ ID NO: 216404 - DNA, 25 bp, Mus musculus
caaaaactggagacctcaggaaagt

SEQ ID NO: 216405 - DNA, 25 bp, Mus musculus
caaaaacttcagtcccagaagccaa

SEQ ID NO: 216406 - DNA, 25 bp, Mus musculus
caaaaacttcccaaggcactgtgct

SEQ ID NO: 216407 - DNA, 25 bp, Mus musculus
caaaaacttctggaattattgaagc

SEQ ID NO: 216408 - DNA, 25 bp, Mus musculus
caaaaagaaaaacatcattccagaa

SEQ ID NO: 216409 - DNA, 25 bp, Mus musculus
caaaaagaaagactgccctcccggc

SEQ ID NO: 216410 - DNA, 25 bp, Mus musculus
caaaaagaaatggtgacattccaag

SEQ ID NO: 216411 - DNA, 25 bp, Mus musculus
caaaaagaaggctaatgcttctgtg

SEQ ID NO: 216412 - DNA, 25 bp, Mus musculus
caaaaagaatgatggtcgaatcgat

SEQ ID NO: 216413 - DNA, 25 bp, Mus musculus
caaaaagacaggttagaaagctgtc

SEQ ID NO: 216414 - DNA, 25 bp, Mus musculus
caaaaagaccaaaggccagcctttt

SEQ ID NO: 216415 - DNA, 25 bp, Mus musculus
caaaaagagagggagccccgcgcga

SEQ ID NO: 216416 - DNA, 25 bp, Mus musculus
caaaaagataaaaaaggctgcctca

SEQ ID NO: 216417 - DNA, 25 bp, Mus musculus
caaaaagataaaggagcgaatccgt

SEQ ID NO: 216418 - DNA, 25 bp, Mus musculus
caaaaagcacaacccaagaggcact

SEQ ID NO: 216419 - DNA, 25 bp, Mus musculus
caaaaagcacagaacaagcctgcca

SEQ ID NO: 216420 - DNA, 25 bp, Mus musculus
caaaaagcagatggagacacggaaa

SEQ ID NO: 216421 - DNA, 25 bp, Mus musculus
caaaaagcagattgtccatcccatg

SEQ ID NO: 216422 - DNA, 25 bp, Mus musculus
caaaaagcaggcctgttgctggggc

SEQ ID NO: 216423 - DNA, 25 bp, Mus musculus
caaaaagcagtcaggatgatgcagc

SEQ ID NO: 216424 - DNA, 25 bp, Mus musculus
caaaaagcagtcagggcaatggcag

SEQ ID NO: 216425 - DNA, 25 bp, Mus musculus
caaaaagccagcaccaagtgatctc

SEQ ID NO: 216426 - DNA, 25 bp, Mus musculus
caaaaagccagggatggctgtgtga

SEQ ID NO: 216427 - DNA, 25 bp, Mus musculus
caaaaaggagaactacctctcggaa

SEQ ID NO: 216428 - DNA, 25 bp, Mus musculus
caaaaaggaggtcctgagttcaaat

SEQ ID NO: 216429 - DNA, 25 bp, Mus musculus
caaaaagtatcaggaatacatccca

SEQ ID NO: 216430 - DNA, 25 bp, Mus musculus
caaaaagtgtgcaggtttcaactct

SEQ ID NO: 216431 - DNA, 25 bp, Mus musculus
caaaaagtgtgcagttcagaggttc

SEQ ID NO: 216432 - DNA, 25 bp, Mus musculus
caaaaataataaagcatattcaaaa

SEQ ID NO: 216433 - DNA, 25 bp, Mus musculus
caaaaataataaagggacagatatg

SEQ ID NO: 216434 - DNA, 25 bp, Mus musculus
caaaaataattggtttggattcagg

SEQ ID NO: 216435 - DNA, 25 bp, Mus musculus
caaaaatagccagccaagtctgaaa

SEQ ID NO: 216436 - DNA, 25 bp, Mus musculus
caaaaatagccagcctgtcaagact

SEQ ID NO: 216437 - DNA, 25 bp, Mus musculus
caaaaatcacggaaggtgtctcaga

SEQ ID NO: 216438 - DNA, 25 bp, Mus musculus
caaaaatcagataacaactattcca

SEQ ID NO: 216439 - DNA, 25 bp, Mus musculus
caaaaatcagataagaaacctgacc

SEQ ID NO: 216440 - DNA, 25 bp, Mus musculus
caaaaatcgagaatttatagctaaa

SEQ ID NO: 216441 - DNA, 25 bp, Mus musculus
caaaaatctaggcatggtctgccgg

SEQ ID NO: 216442 - DNA, 25 bp, Mus musculus
caaaaatctggtagtgcaacttcag

SEQ ID NO: 216443 - DNA, 25 bp, Mus musculus
caaaaatggaagaaggtatcaactg

SEQ ID NO: 216444 - DNA, 25 bp, Mus musculus
caaaaatgggaggcttactcaattc

SEQ ID NO: 216445 - DNA, 25 bp, Mus musculus
caaaaatgggagtgggtgaactcat

SEQ ID NO: 216446 - DNA, 25 bp, Mus musculus
caaaaattaagtgtctctgccaccc

SEQ ID NO: 216447 - DNA, 25 bp, Mus musculus
caaaaattaagttagctgacaaggt

SEQ ID NO: 216448 - DNA, 25 bp, Mus musculus
caaaaattataattgcttctacttc

SEQ ID NO: 216449 - DNA, 25 bp, Mus musculus
caaaaatttcaagtactcagactac

SEQ ID NO: 216450 - DNA, 25 bp, Mus musculus
caaaacaaaaacaacatggctgggc

SEQ ID NO: 216451 - DNA, 25 bp, Mus musculus
caaaacaaaagagatgtcttctcac

SEQ ID NO: 216452 - DNA, 25 bp, Mus musculus
caaaacaaaccaaggctactatgac

SEQ ID NO: 216453 - DNA, 25 bp, Mus musculus
caaaacaatagtatctttacggacg

SEQ ID NO: 216454 - DNA, 25 bp, Mus musculus
caaaacacacgaattgtcacaatgc

SEQ ID NO: 216455 - DNA, 25 bp, Mus musculus
caaaacagaaacgttcctgagactg

SEQ ID NO: 216456 - DNA, 25 bp, Mus musculus
caaaacagaagaggaacaagttgat

SEQ ID NO: 216457 - DNA, 25 bp, Mus musculus
caaaacagaagaggatgaaacaagt

SEQ ID NO: 216458 - DNA, 25 bp, Mus musculus
caaaacagactgagaatgaagccaa

SEQ ID NO: 216459 - DNA, 25 bp, Mus musculus
caaaacagaggtgcaaagaaatggc

SEQ ID NO: 216460 - DNA, 25 bp, Mus musculus
caaaacagcaagatccaccaatgtt

SEQ ID NO: 216461 - DNA, 25 bp, Mus musculus
caaaacaggccaggtggccttgcta

SEQ ID NO: 216462 - DNA, 25 bp, Mus musculus
caaaacattgacctggtgatctcct

SEQ ID NO: 216463 - DNA, 25 bp, Mus musculus
caaaacatttaaggagattactttg

SEQ ID NO: 216464 - DNA, 25 bp, Mus musculus
caaaacattttgagcgttggtgttg

SEQ ID NO: 216465 - DNA, 25 bp, Mus musculus
caaaacattttgaggactactgttg

SEQ ID NO: 216466 - DNA, 25 bp, Mus musculus
caaaaccaaaactgccttaggattc

SEQ ID NO: 216467 - DNA, 25 bp, Mus musculus
caaaaccaaacaatttgctcctatt

SEQ ID NO: 216468 - DNA, 25 bp, Mus musculus
caaaaccaaaggcagaccgaaggct

SEQ ID NO: 216469 - DNA, 25 bp, Mus musculus
caaaaccaagaaaccaagccgcaat

SEQ ID NO: 216470 - DNA, 25 bp, Mus musculus
caaaaccaagattaattgcctgagg

SEQ ID NO: 216471 - DNA, 25 bp, Mus musculus
caaaaccaaggactctgcttttgac

SEQ ID NO: 216472 - DNA, 25 bp, Mus musculus
caaaaccaaggagcgcttctgggaa

SEQ ID NO: 216473 - DNA, 25 bp, Mus musculus
caaaaccaaggatgtggagtacatg

SEQ ID NO: 216474 - DNA, 25 bp, Mus musculus
caaaaccaaggctgagccgagctac

SEQ ID NO: 216475 - DNA, 25 bp, Mus musculus
caaaaccaaggctgaggcgagccac

SEQ ID NO: 216476 - DNA, 25 bp, Mus musculus
caaaaccaagttcttgacatcttcc

SEQ ID NO: 216477 - DNA, 25 bp, Mus musculus
caaaaccagaagaagctcgagtgca

SEQ ID NO: 216478 - DNA, 25 bp, Mus musculus
caaaaccagatcaaattgacatcgc

SEQ ID NO: 216479 - DNA, 25 bp, Mus musculus
caaaaccagctgtggttcggggcca

SEQ ID NO: 216480 - DNA, 25 bp, Mus musculus
caaaaccagggatactgggaacctc

SEQ ID NO: 216481 - DNA, 25 bp, Mus musculus
caaaaccatcccaggtgacaccgct

SEQ ID NO: 216482 - DNA, 25 bp, Mus musculus
caaaaccatgaggaggaagtcaaca

SEQ ID NO: 216483 - DNA, 25 bp, Mus musculus
caaaacccaaagccctttgccatga

SEQ ID NO: 216484 - DNA, 25 bp, Mus musculus
caaaacccaaaggaagagcccagac

SEQ ID NO: 216485 - DNA, 25 bp, Mus musculus
caaaacccagagggccagtaagagc

SEQ ID NO: 216486 - DNA, 25 bp, Mus musculus
caaaacccaggcaagtgctctccag

SEQ ID NO: 216487 - DNA, 25 bp, Mus musculus
caaaacccaggcaagttctgcctgc

SEQ ID NO: 216488 - DNA, 25 bp, Mus musculus
caaaaccctgaggccacaagaagag

SEQ ID NO: 216489 - DNA, 25 bp, Mus musculus
caaaaccctgctatcttccagatca

SEQ ID NO: 216490 - DNA, 25 bp, Mus musculus
caaaaccgctatggcaacgtgatcg

SEQ ID NO: 216491 - DNA, 25 bp, Mus musculus
caaaacctatgaagggctgcaattt

SEQ ID NO: 216492 - DNA, 25 bp, Mus musculus
caaaacctttggtagatgccagcct

SEQ ID NO: 216493 - DNA, 25 bp, Mus musculus
caaaacgaaaatgcaaaattactaa

SEQ ID NO: 216494 - DNA, 25 bp, Mus musculus
caaaacgacagacagctattatctg

SEQ ID NO: 216495 - DNA, 25 bp, Mus musculus
caaaacgcagctgcagcactgggct

SEQ ID NO: 216496 - DNA, 25 bp, Mus musculus
caaaacgcaggaccatcagaatcca

SEQ ID NO: 216497 - DNA, 25 bp, Mus musculus
caaaacgctgagagagatgccaaag

SEQ ID NO: 216498 - DNA, 25 bp, Mus musculus
caaaacgctgtaagccgtgcctcag

SEQ ID NO: 216499 - DNA, 25 bp, Mus musculus
caaaacggaaggacctgcaatgacg

SEQ ID NO: 216500 - DNA, 25 bp, Mus musculus
caaaacggacctacgagcagaggaa

SEQ ID NO: 216501 - DNA, 25 bp, Mus musculus
caaaacggagagagcgtcgtataca

SEQ ID NO: 216502 - DNA, 25 bp, Mus musculus
caaaactactaaatggaaatgatca

SEQ ID NO: 216503 - DNA, 25 bp, Mus musculus
caaaactcaaaagattgctttattc

SEQ ID NO: 216504 - DNA, 25 bp, Mus musculus
caaaactcagggaccaagagcccta

SEQ ID NO: 216505 - DNA, 25 bp, Mus musculus
caaaactcttgacaggaaggagggg

SEQ ID NO: 216506 - DNA, 25 bp, Mus musculus
caaaactgaaggatctgaaccaatg

SEQ ID NO: 216507 - DNA, 25 bp, Mus musculus
caaaactgaaggatggcgtggttct

SEQ ID NO: 216508 - DNA, 25 bp, Mus musculus
caaaactgacattgggagaatcccg

SEQ ID NO: 216509 - DNA, 25 bp, Mus musculus
caaaactgagtgaccttcagaatgc

SEQ ID NO: 216510 - DNA, 25 bp, Mus musculus
caaaactgcaagttgcacccagctg

SEQ ID NO: 216511 - DNA, 25 bp, Mus musculus
caaaactggagccaccccaaatctg

SEQ ID NO: 216512 - DNA, 25 bp, Mus musculus
caaaagaaaagatgagaggctgtaa

SEQ ID NO: 216513 - DNA, 25 bp, Mus musculus
caaaagaaaataagtaccatgaaag

SEQ ID NO: 216514 - DNA, 25 bp, Mus musculus
caaaagaaagaagacccactgccac

SEQ ID NO: 216515 - DNA, 25 bp, Mus musculus
caaaagaaagaagagctgctgaatg

SEQ ID NO: 216516 - DNA, 25 bp, Mus musculus
caaaagaaagaattcctgagacaaa

SEQ ID NO: 216517 - DNA, 25 bp, Mus musculus
caaaagaaagatataagcatacaat

SEQ ID NO: 216518 - DNA, 25 bp, Mus musculus
caaaagaaagctgtattttaaatct

SEQ ID NO: 216519 - DNA, 25 bp, Mus musculus
caaaagaaagctgtggaaatcagtc

SEQ ID NO: 216520 - DNA, 25 bp, Mus musculus
caaaagaaagctgtggtaattccac

SEQ ID NO: 216521 - DNA, 25 bp, Mus musculus
caaaagaaaggctgaaggggatgct

SEQ ID NO: 216522 - DNA, 25 bp, Mus musculus
caaaagaagagcagggctgtgtctg

SEQ ID NO: 216523 - DNA, 25 bp, Mus musculus
caaaagaatttccattcgagcatca

SEQ ID NO: 216524 - DNA, 25 bp, Mus musculus
caaaagacaggagagatgagacacc

SEQ ID NO: 216525 - DNA, 25 bp, Mus musculus
caaaagacctccgtctggatttttc

SEQ ID NO: 216526 - DNA, 25 bp, Mus musculus
caaaagacgaactaggtcctgtgcc

SEQ ID NO: 216527 - DNA, 25 bp, Mus musculus
caaaagactgacacatgcagccgct

SEQ ID NO: 216528 - DNA, 25 bp, Mus musculus
caaaagagaaaaggaagcagtatgg

SEQ ID NO: 216529 - DNA, 25 bp, Mus musculus
caaaagagacgggaaaagaaggctg

SEQ ID NO: 216530 - DNA, 25 bp, Mus musculus
caaaagagacgggatcttatcctgt

SEQ ID NO: 216531 - DNA, 25 bp, Mus musculus
caaaagagcaccagcacagctgatg

SEQ ID NO: 216532 - DNA, 25 bp, Mus musculus
caaaagaggagagaagcagaaaaaa

SEQ ID NO: 216533 - DNA, 25 bp, Mus musculus
caaaagagggagtcggttctggccg

SEQ ID NO: 216534 - DNA, 25 bp, Mus musculus
caaaagatcaagggtgacaggaaag

SEQ ID NO: 216535 - DNA, 25 bp, Mus musculus
caaaagatcaaggtgatctacgttg

SEQ ID NO: 216536 - DNA, 25 bp, Mus musculus
caaaagatctgcaaaatcatggacc

SEQ ID NO: 216537 - DNA, 25 bp, Mus musculus
caaaagatgtaactgcttggaccct

SEQ ID NO: 216538 - DNA, 25 bp, Mus musculus
caaaagcaaggatgaagtggcccag

SEQ ID NO: 216539 - DNA, 25 bp, Mus musculus
caaaagcagagaatggagcctgtga

SEQ ID NO: 216540 - DNA, 25 bp, Mus musculus
caaaagcagagaatgtggacatctc

SEQ ID NO: 216541 - DNA, 25 bp, Mus musculus
caaaagccaaagatgtgtgccaaaa

SEQ ID NO: 216542 - DNA, 25 bp, Mus musculus
caaaagccaaaggtgtgtgccaaaa

SEQ ID NO: 216543 - DNA, 25 bp, Mus musculus
caaaagccacccgaatggctgttga

SEQ ID NO: 216544 - DNA, 25 bp, Mus musculus
caaaagccagaccaggatcaagtta

SEQ ID NO: 216545 - DNA, 25 bp, Mus musculus
caaaagccagaccagttccaagaat

SEQ ID NO: 216546 - DNA, 25 bp, Mus musculus
caaaagccagagcccaggctgtccc

SEQ ID NO: 216547 - DNA, 25 bp, Mus musculus
caaaagccagtgggaagagcatgga

SEQ ID NO: 216548 - DNA, 25 bp, Mus musculus
caaaagccagtgttggaggtgagct

SEQ ID NO: 216549 - DNA, 25 bp, Mus musculus
caaaagcccatctgggcttttctcc

SEQ ID NO: 216550 - DNA, 25 bp, Mus musculus
caaaagccctccaagaaagataaac

SEQ ID NO: 216551 - DNA, 25 bp, Mus musculus
caaaagccgaggctctgctaaggcc

SEQ ID NO: 216552 - DNA, 25 bp, Mus musculus
caaaagcgctgcagctattatctgg

SEQ ID NO: 216553 - DNA, 25 bp, Mus musculus
caaaagctaaggatgaccagactcc

SEQ ID NO: 216554 - DNA, 25 bp, Mus musculus
caaaagctcagaaagcctttcccta

SEQ ID NO: 216555 - DNA, 25 bp, Mus musculus
caaaagctcagaaagctgtgtatga

SEQ ID NO: 216556 - DNA, 25 bp, Mus musculus
caaaagctcagagggaagctcacaa

SEQ ID NO: 216557 - DNA, 25 bp, Mus musculus
caaaagctcagagggaattgaagtt

SEQ ID NO: 216558 - DNA, 25 bp, Mus musculus
caaaaggaaagaaccagatttctgc

SEQ ID NO: 216559 - DNA, 25 bp, Mus musculus
caaaaggaaagaatcttctcaaaac

SEQ ID NO: 216560 - DNA, 25 bp, Mus musculus
caaaaggaaccatggcacagcgatg

SEQ ID NO: 216561 - DNA, 25 bp, Mus musculus
caaaaggaatcaagttactggacag

SEQ ID NO: 216562 - DNA, 25 bp, Mus musculus
caaaaggacaggatgtagatatgat

SEQ ID NO: 216563 - DNA, 25 bp, Mus musculus
caaaaggacgacagatctatgtaag

SEQ ID NO: 216564 - DNA, 25 bp, Mus musculus
caaaaggagacaagggtgatatggg

SEQ ID NO: 216565 - DNA, 25 bp, Mus musculus
caaaaggagacacgggcttgccagg

SEQ ID NO: 216566 - DNA, 25 bp, Mus musculus
caaaaggagatgtgggagcgagagg

SEQ ID NO: 216567 - DNA, 25 bp, Mus musculus
caaaaggagcagcagcagcagcagc

SEQ ID NO: 216568 - DNA, 25 bp, Mus musculus
caaaaggagcaggtgcttttggata

SEQ ID NO: 216569 - DNA, 25 bp, Mus musculus
caaaaggatgattgatctgatggaa

SEQ ID NO: 216570 - DNA, 25 bp, Mus musculus
caaaaggatgcagaaaatgtaggcc

SEQ ID NO: 216571 - DNA, 25 bp, Mus musculus
caaaaggcaaagatgcagctgtgtc

SEQ ID NO: 216572 - DNA, 25 bp, Mus musculus
caaaaggcagagggacagttaaagg

SEQ ID NO: 216573 - DNA, 25 bp, Mus musculus
caaaaggccggtcatggtatggatc

SEQ ID NO: 216574 - DNA, 25 bp, Mus musculus
caaaaggcctgaagcacgtaacttc

SEQ ID NO: 216575 - DNA, 25 bp, Mus musculus
caaaaggctcaagggctttgctgag

SEQ ID NO: 216576 - DNA, 25 bp, Mus musculus
caaaaggctctgtggaggaagcaag

SEQ ID NO: 216577 - DNA, 25 bp, Mus musculus
caaaagggacaggttttcctagata

SEQ ID NO: 216578 - DNA, 25 bp, Mus musculus
caaaagggacagtgatggatgtggg

SEQ ID NO: 216579 - DNA, 25 bp, Mus musculus
caaaagggccaagaagtctacatgt

SEQ ID NO: 216580 - DNA, 25 bp, Mus musculus
caaaagtacttcctggtgggtgcag

SEQ ID NO: 216581 - DNA, 25 bp, Mus musculus
caaaagtaggagttaccattgagtg

SEQ ID NO: 216582 - DNA, 25 bp, Mus musculus
caaaagtatggcttagacttgtgtt

SEQ ID NO: 216583 - DNA, 25 bp, Mus musculus
caaaagtcaaatgtggatatgctac

SEQ ID NO: 216584 - DNA, 25 bp, Mus musculus
caaaagtcacaagggaacagcagtg

SEQ ID NO: 216585 - DNA, 25 bp, Mus musculus
caaaagtctattaaaatgaagcatt

SEQ ID NO: 216586 - DNA, 25 bp, Mus musculus
caaaagtgacgtgtgggcttttggc

SEQ ID NO: 216587 - DNA, 25 bp, Mus musculus
caaaagtgagtggagctcctctggg

SEQ ID NO: 216588 - DNA, 25 bp, Mus musculus
caaaataaaggattcacagaaatcc

SEQ ID NO: 216589 - DNA, 25 bp, Mus musculus
caaaataaaggtgagttcctcagaa

SEQ ID NO: 216590 - DNA, 25 bp, Mus musculus
caaaataaatggtctactgaaagtg

SEQ ID NO: 216591 - DNA, 25 bp, Mus musculus
caaaataacaaagagctactgcttt

SEQ ID NO: 216592 - DNA, 25 bp, Mus musculus
caaaataacaaagcggagtatgtcc

SEQ ID NO: 216593 - DNA, 25 bp, Mus musculus
caaaataatgacaccattctaatac

SEQ ID NO: 216594 - DNA, 25 bp, Mus musculus
caaaataccaccaagctcctcccca

SEQ ID NO: 216595 - DNA, 25 bp, Mus musculus
caaaataccccccggtgccacattc

SEQ ID NO: 216596 - DNA, 25 bp, Mus musculus
caaaataccttcaagatgctgggtg

SEQ ID NO: 216597 - DNA, 25 bp, Mus musculus
caaaataccttcaagccaccttcaa

SEQ ID NO: 216598 - DNA, 25 bp, Mus musculus
caaaataccttcgagatgctgggtg

SEQ ID NO: 216599 - DNA, 25 bp, Mus musculus
caaaataccttcgagccttcccaga

SEQ ID NO: 216600 - DNA, 25 bp, Mus musculus
caaaatactcacagaaagaagaatc

SEQ ID NO: 216601 - DNA, 25 bp, Mus musculus
caaaatactttccagaacacttcag

SEQ ID NO: 216602 - DNA, 25 bp, Mus musculus
caaaatagaagaggtagtagaagag

SEQ ID NO: 216603 - DNA, 25 bp, Mus musculus
caaaatagcgatgtctggaataaaa

SEQ ID NO: 216604 - DNA, 25 bp, Mus musculus
caaaatagcggtcacacaactggcc

SEQ ID NO: 216605 - DNA, 25 bp, Mus musculus
caaaataggccagagtgggtcatct

SEQ ID NO: 216606 - DNA, 25 bp, Mus musculus
caaaataggccagagtggtggttcc

SEQ ID NO: 216607 - DNA, 25 bp, Mus musculus
caaaatagttggtgtttggcacaga

SEQ ID NO: 216608 - DNA, 25 bp, Mus musculus
caaaatatagtgtcatcatgctgga

SEQ ID NO: 216609 - DNA, 25 bp, Mus musculus
caaaatatcagctggtggctggcat

SEQ ID NO: 216610 - DNA, 25 bp, Mus musculus
caaaatatcagtctagccgcagaca

SEQ ID NO: 216611 - DNA, 25 bp, Mus musculus
caaaatatgggccaaatgaaaattc

SEQ ID NO: 216612 - DNA, 25 bp, Mus musculus
caaaatatttggtgacttcacctgg

SEQ ID NO: 216613 - DNA, 25 bp, Mus musculus
caaaatcaaggatcatgggctctat

SEQ ID NO: 216614 - DNA, 25 bp, Mus musculus
caaaatcacagaataccacctcctc

SEQ ID NO: 216615 - DNA, 25 bp, Mus musculus
caaaatcacagagaagcagaacaag

SEQ ID NO: 216616 - DNA, 25 bp, Mus musculus
caaaatcatagagcccatccagtcc

SEQ ID NO: 216617 - DNA, 25 bp, Mus musculus
caaaatcatgctgacacccagtggg

SEQ ID NO: 216618 - DNA, 25 bp, Mus musculus
caaaatcatggacgcattcagctta

SEQ ID NO: 216619 - DNA, 25 bp, Mus musculus
caaaatcattagataacaactattc

SEQ ID NO: 216620 - DNA, 25 bp, Mus musculus
caaaatcccaagtagcatgctacaa

SEQ ID NO: 216621 - DNA, 25 bp, Mus musculus
caaaatccggcagagtgaccgtctt

SEQ ID NO: 216622 - DNA, 25 bp, Mus musculus
caaaatctaacaattctctacattt

SEQ ID NO: 216623 - DNA, 25 bp, Mus musculus
caaaatctcaaattgctcttaaact

SEQ ID NO: 216624 - DNA, 25 bp, Mus musculus
caaaatctcaagaaggtggattttt

SEQ ID NO: 216625 - DNA, 25 bp, Mus musculus
caaaatctcaagctgcgagcctgcg

SEQ ID NO: 216626 - DNA, 25 bp, Mus musculus
caaaatctcagaactcaagtgattg

SEQ ID NO: 216627 - DNA, 25 bp, Mus musculus
caaaatctcaggctggcctgtgagc

SEQ ID NO: 216628 - DNA, 25 bp, Mus musculus
caaaatctgagagaggtgaaccacc

SEQ ID NO: 216629 - DNA, 25 bp, Mus musculus
caaaatcttggtggaagatgagctc

SEQ ID NO: 216630 - DNA, 25 bp, Mus musculus
caaaatgaaaaatatggaattgcca

SEQ ID NO: 216631 - DNA, 25 bp, Mus musculus
caaaatgaaaaatggaatgactgta

SEQ ID NO: 216632 - DNA, 25 bp, Mus musculus
caaaatgaaaagatgaaaactttat

SEQ ID NO: 216633 - DNA, 25 bp, Mus musculus
caaaatgaaagtggatcagcatgga

SEQ ID NO: 216634 - DNA, 25 bp, Mus musculus
caaaatgaagaaagaacatgcatac

SEQ ID NO: 216635 - DNA, 25 bp, Mus musculus
caaaatgaagaagatgggcttaggt

SEQ ID NO: 216636 - DNA, 25 bp, Mus musculus
caaaatgaagaagtggaactatgga

SEQ ID NO: 216637 - DNA, 25 bp, Mus musculus
caaaatgaagccaatgctgaggcct

SEQ ID NO: 216638 - DNA, 25 bp, Mus musculus
caaaatgaaggaagctctgagttct

SEQ ID NO: 216639 - DNA, 25 bp, Mus musculus
caaaatgaaggcaaagggatgttga

SEQ ID NO: 216640 - DNA, 25 bp, Mus musculus
caaaatgagccgcacggaaggaaaa

SEQ ID NO: 216641 - DNA, 25 bp, Mus musculus
caaaatgatgaagaaaatactcagg

SEQ ID NO: 216642 - DNA, 25 bp, Mus musculus
caaaatgatggatgcatccctaatg

SEQ ID NO: 216643 - DNA, 25 bp, Mus musculus
caaaatgcagagcaggtttgacatg

SEQ ID NO: 216644 - DNA, 25 bp, Mus musculus
caaaatgcgactggaagaactaaag

SEQ ID NO: 216645 - DNA, 25 bp, Mus musculus
caaaatgcgactggtggcaattaac

SEQ ID NO: 216646 - DNA, 25 bp, Mus musculus
caaaatgctgcaagcaccttctagc

SEQ ID NO: 216647 - DNA, 25 bp, Mus musculus
caaaatgctgcaagtatagaacatt

SEQ ID NO: 216648 - DNA, 25 bp, Mus musculus
caaaatgcttcagggccgccttttt

SEQ ID NO: 216649 - DNA, 25 bp, Mus musculus
caaaatggacacgctccccagaggt

SEQ ID NO: 216650 - DNA, 25 bp, Mus musculus
caaaatggcaggagctcgacgccat

SEQ ID NO: 216651 - DNA, 25 bp, Mus musculus
caaaatggccatgtcagggatgaga

SEQ ID NO: 216652 - DNA, 25 bp, Mus musculus
caaaatgtaggtggatgaagactca

SEQ ID NO: 216653 - DNA, 25 bp, Mus musculus
caaaatgtattgaggaaaaggagaa

SEQ ID NO: 216654 - DNA, 25 bp, Mus musculus
caaaatgtcaggaattagctctgcg

SEQ ID NO: 216655 - DNA, 25 bp, Mus musculus
caaaatgtcaggttctggcaccccc

SEQ ID NO: 216656 - DNA, 25 bp, Mus musculus
caaaatgtggattttgttgacctca

SEQ ID NO: 216657 - DNA, 25 bp, Mus musculus
caaaatgtttctggtggaacaccag

SEQ ID NO: 216658 - DNA, 25 bp, Mus musculus
caaaattaccccaagcattcttgaa

SEQ ID NO: 216659 - DNA, 25 bp, Mus musculus
caaaattatgacactatttttgaag

SEQ ID NO: 216660 - DNA, 25 bp, Mus musculus
caaaattcaagttttttgatttgtc

SEQ ID NO: 216661 - DNA, 25 bp, Mus musculus
caaaattcaattgctgatagcccaa

SEQ ID NO: 216662 - DNA, 25 bp, Mus musculus
caaaattcaatttctgttgcccctc

SEQ ID NO: 216663 - DNA, 25 bp, Mus musculus
caaaattcagaatgggctgtatggg

SEQ ID NO: 216664 - DNA, 25 bp, Mus musculus
caaaattcagattgccttctcccag

SEQ ID NO: 216665 - DNA, 25 bp, Mus musculus
caaaattcaggtgattgacatttcg

SEQ ID NO: 216666 - DNA, 25 bp, Mus musculus
caaaattgaagagaatcaaaaggat

SEQ ID NO: 216667 - DNA, 25 bp, Mus musculus
caaaattgccaagcctgtctcgctg

SEQ ID NO: 216668 - DNA, 25 bp, Mus musculus
caaaattgccaaggcagaagaggag

SEQ ID NO: 216669 - DNA, 25 bp, Mus musculus
caaaattgctgtgatcgcctgcatc

SEQ ID NO: 216670 - DNA, 25 bp, Mus musculus
caaaattgctgtggcactcagaaag

SEQ ID NO: 216671 - DNA, 25 bp, Mus musculus
caaaattggccatgctctgcatgcc

SEQ ID NO: 216672 - DNA, 25 bp, Mus musculus
caaaattgtttatagaaatacaata

SEQ ID NO: 216673 - DNA, 25 bp, Mus musculus
caaaattgtttatagagatttgaag

SEQ ID NO: 216674 - DNA, 25 bp, Mus musculus
caaacaaaaaatgcagagagaaatt

SEQ ID NO: 216675 - DNA, 25 bp, Mus musculus
caaacaaaaagtactacaagaagtt

SEQ ID NO: 216676 - DNA, 25 bp, Mus musculus
caaacaaagagagctggaaagtctt

SEQ ID NO: 216677 - DNA, 25 bp, Mus musculus
caaacaaagcaattgcctgtacccc

SEQ ID NO: 216678 - DNA, 25 bp, Mus musculus
caaacaaatgacatgtttttcagta

SEQ ID NO: 216679 - DNA, 25 bp, Mus musculus
caaacaacaagacccctcctcctcg

SEQ ID NO: 216680 - DNA, 25 bp, Mus musculus
caaacaacagggcagcagaagaagc

SEQ ID NO: 216681 - DNA, 25 bp, Mus musculus
caaacaacagggtggcagacgaagc

SEQ ID NO: 216682 - DNA, 25 bp, Mus musculus
caaacaacatgccctgcctgcccca

SEQ ID NO: 216683 - DNA, 25 bp, Mus musculus
caaacaaccaagagaagcaattgga

SEQ ID NO: 216684 - DNA, 25 bp, Mus musculus
caaacaaccaagcacttgtttcagc

SEQ ID NO: 216685 - DNA, 25 bp, Mus musculus
caaacaagatgggaggcacctccaa

SEQ ID NO: 216686 - DNA, 25 bp, Mus musculus
caaacaagattacggccgaagactg

SEQ ID NO: 216687 - DNA, 25 bp, Mus musculus
caaacaagattacggtacagcaagg

SEQ ID NO: 216688 - DNA, 25 bp, Mus musculus
caaacaagcggagtttggtgaaagt

SEQ ID NO: 216689 - DNA, 25 bp, Mus musculus
caaacaaggggcaggtaccacagag

SEQ ID NO: 216690 - DNA, 25 bp, Mus musculus
caaacaaggttatatctgaagaacc

SEQ ID NO: 216691 - DNA, 25 bp, Mus musculus
caaacaagtgcgctctgaaaacctg

SEQ ID NO: 216692 - DNA, 25 bp, Mus musculus
caaacaagtgcggtaattaccctct

SEQ ID NO: 216693 - DNA, 25 bp, Mus musculus
caaacaagtgttcagagccggaaac

SEQ ID NO: 216694 - DNA, 25 bp, Mus musculus
caaacaagtgttcaggcctccttct

SEQ ID NO: 216695 - DNA, 25 bp, Mus musculus
caaacaataatgaagacaactggat

SEQ ID NO: 216696 - DNA, 25 bp, Mus musculus
caaacaatgtctttggtttcaacag

SEQ ID NO: 216697 - DNA, 25 bp, Mus musculus
caaacaatttcagcatctctgagtt

SEQ ID NO: 216698 - DNA, 25 bp, Mus musculus
caaacaatttcagtcatctcctgaa

SEQ ID NO: 216699 - DNA, 25 bp, Mus musculus
caaacacaaaaaatcttctctgatg

SEQ ID NO: 216700 - DNA, 25 bp, Mus musculus
caaacacaaagtgctgcagtcgcag

SEQ ID NO: 216701 - DNA, 25 bp, Mus musculus
caaacacaaggcgaaggagatgcag

SEQ ID NO: 216702 - DNA, 25 bp, Mus musculus
caaacacaagttggaaatctacatt

SEQ ID NO: 216703 - DNA, 25 bp, Mus musculus
caaacacacaccagtcatcttcagc

SEQ ID NO: 216704 - DNA, 25 bp, Mus musculus
caaacacatgaaggttcatgaatct

SEQ ID NO: 216705 - DNA, 25 bp, Mus musculus
caaacacatgaagtgttgtcctgct

SEQ ID NO: 216706 - DNA, 25 bp, Mus musculus
caaacacattgcaggctgcagatgt

SEQ ID NO: 216707 - DNA, 25 bp, Mus musculus
caaacacattgcagttggaacaaga

SEQ ID NO: 216708 - DNA, 25 bp, Mus musculus
caaacaccactgcagcagatccaca

SEQ ID NO: 216709 - DNA, 25 bp, Mus musculus
caaacaccatgaggcaaaagcaaaa

SEQ ID NO: 216710 - DNA, 25 bp, Mus musculus
caaacaccgtgcctaaattgtatag

SEQ ID NO: 216711 - DNA, 25 bp, Mus musculus
caaacacctccctctcccagtacag

SEQ ID NO: 216712 - DNA, 25 bp, Mus musculus
caaacactacaaatcccctagtgag

SEQ ID NO: 216713 - DNA, 25 bp, Mus musculus
caaacactgacagggatcaagtttg

SEQ ID NO: 216714 - DNA, 25 bp, Mus musculus
caaacactgagcaacagtccaactt

SEQ ID NO: 216715 - DNA, 25 bp, Mus musculus
caaacactgagcaagagtccaactt

SEQ ID NO: 216716 - DNA, 25 bp, Mus musculus
caaacactgtctagcaccatcaaaa

SEQ ID NO: 216717 - DNA, 25 bp, Mus musculus
caaacacttgaaacagttccctggc

SEQ ID NO: 216718 - DNA, 25 bp, Mus musculus
caaacacttgaaaccagcgtgcagg

SEQ ID NO: 216719 - DNA, 25 bp, Mus musculus
caaacacttggtgatgaagatgaat

SEQ ID NO: 216720 - DNA, 25 bp, Mus musculus
caaacacttggtggtgtgaatgagt

SEQ ID NO: 216721 - DNA, 25 bp, Mus musculus
caaacagaaaactcagaactttcgt

SEQ ID NO: 216722 - DNA, 25 bp, Mus musculus
caaacagaaatggtgaggacactcg

SEQ ID NO: 216723 - DNA, 25 bp, Mus musculus
caaacagaacagatgacacttctca

SEQ ID NO: 216724 - DNA, 25 bp, Mus musculus
caaacagaaccagccaacagccatc

SEQ ID NO: 216725 - DNA, 25 bp, Mus musculus
caaacagaaccagcccatcattcag

SEQ ID NO: 216726 - DNA, 25 bp, Mus musculus
caaacagactaaagactatgctgag

SEQ ID NO: 216727 - DNA, 25 bp, Mus musculus
caaacagagacaggcatccgtccct

SEQ ID NO: 216728 - DNA, 25 bp, Mus musculus
caaacagagagaggtgaaacctttg

SEQ ID NO: 216729 - DNA, 25 bp, Mus musculus
caaacagagctacagaatcatacga

SEQ ID NO: 216730 - DNA, 25 bp, Mus musculus
caaacagcaagcgcctgtgagagag

SEQ ID NO: 216731 - DNA, 25 bp, Mus musculus
caaacagcagaaggtagagcttgag

SEQ ID NO: 216732 - DNA, 25 bp, Mus musculus
caaacagcatgatgcagctgccttg

SEQ ID NO: 216733 - DNA, 25 bp, Mus musculus
caaacagcatggaactgacccgagg

SEQ ID NO: 216734 - DNA, 25 bp, Mus musculus
caaacagcggatcactgcagacctg

SEQ ID NO: 216735 - DNA, 25 bp, Mus musculus
caaacagctccaagatgagcgtgaa

SEQ ID NO: 216736 - DNA, 25 bp, Mus musculus
caaacagctggaaggtgatttcaat

SEQ ID NO: 216737 - DNA, 25 bp, Mus musculus
caaacaggaaagatcgcaaaagatg

SEQ ID NO: 216738 - DNA, 25 bp, Mus musculus
caaacaggaggaggcgaagaggatc

SEQ ID NO: 216739 - DNA, 25 bp, Mus musculus
caaacaggtaagctatgaaaaaaga

SEQ ID NO: 216740 - DNA, 25 bp, Mus musculus
caaacagtcagtgtgaatttgaaag

SEQ ID NO: 216741 - DNA, 25 bp, Mus musculus
caaacagttcagatttcaactattg

SEQ ID NO: 216742 - DNA, 25 bp, Mus musculus
caaacagttcagtcattgttctagg

SEQ ID NO: 216743 - DNA, 25 bp, Mus musculus
caaacagttcagtcttcctgtaagg

SEQ ID NO: 216744 - DNA, 25 bp, Mus musculus
caaacagttccaggaagggaacata

SEQ ID NO: 216745 - DNA, 25 bp, Mus musculus
caaacagttccagtcactattacct

SEQ ID NO: 216746 - DNA, 25 bp, Mus musculus
caaacataatgtgaccccatctctg

SEQ ID NO: 216747 - DNA, 25 bp, Mus musculus
caaacatatgctgagaaatccattg

SEQ ID NO: 216748 - DNA, 25 bp, Mus musculus
caaacatatggcacttcttggacag

SEQ ID NO: 216749 - DNA, 25 bp, Mus musculus
caaacatccaggtggctctggtcca

SEQ ID NO: 216750 - DNA, 25 bp, Mus musculus
caaacatcggaagaactctcagctg

SEQ ID NO: 216751 - DNA, 25 bp, Mus musculus
caaacatctgaaactgaactcggag

SEQ ID NO: 216752 - DNA, 25 bp, Mus musculus
caaacatctgaaacttttgttttcc

SEQ ID NO: 216753 - DNA, 25 bp, Mus musculus
caaacatgcagagagtagcagtgct

SEQ ID NO: 216754 - DNA, 25 bp, Mus musculus
caaacatgcagagtgctgtgtgttc

SEQ ID NO: 216755 - DNA, 25 bp, Mus musculus
caaacatggcagcagagtcactcgg

SEQ ID NO: 216756 - DNA, 25 bp, Mus musculus
caaacatggcaggctctacacagag

SEQ ID NO: 216757 - DNA, 25 bp, Mus musculus
caaacatggggtcccagcaacagat

SEQ ID NO: 216758 - DNA, 25 bp, Mus musculus
caaacatgggtttaggcaagagtac

SEQ ID NO: 216759 - DNA, 25 bp, Mus musculus
caaacatgtgcagataacaatcgaa

SEQ ID NO: 216760 - DNA, 25 bp, Mus musculus
caaacattatagccagtgatggtag

SEQ ID NO: 216761 - DNA, 25 bp, Mus musculus
caaacattataggatatcgtgcttt

SEQ ID NO: 216762 - DNA, 25 bp, Mus musculus
caaacattatcagcagcgtcgccaa

SEQ ID NO: 216763 - DNA, 25 bp, Mus musculus
caaacattgcataggtagccaagga

SEQ ID NO: 216764 - DNA, 25 bp, Mus musculus
caaacatttatggtgaagtatttgt

SEQ ID NO: 216765 - DNA, 25 bp, Mus musculus
caaaccaaaaggcatcatagctgcg

SEQ ID NO: 216766 - DNA, 25 bp, Mus musculus
caaaccaaaagttgatgtaggagtg

SEQ ID NO: 216767 - DNA, 25 bp, Mus musculus
caaaccaaaccctgtagctccctac

SEQ ID NO: 216768 - DNA, 25 bp, Mus musculus
caaaccaaatcagatgtcatggcac

SEQ ID NO: 216769 - DNA, 25 bp, Mus musculus
caaaccaacaggtgtgcccaaggtg

SEQ ID NO: 216770 - DNA, 25 bp, Mus musculus
caaaccaacagtatcacatctgccg

SEQ ID NO: 216771 - DNA, 25 bp, Mus musculus
caaaccaacagttccctgccgctca

SEQ ID NO: 216772 - DNA, 25 bp, Mus musculus
caaaccaacattcagcaggacttgg

SEQ ID NO: 216773 - DNA, 25 bp, Mus musculus
caaaccacaagcgagctaatgtctg

SEQ ID NO: 216774 - DNA, 25 bp, Mus musculus
caaaccacagaagacagttgctcag

SEQ ID NO: 216775 - DNA, 25 bp, Mus musculus
caaaccacagaaggccctgacccct

SEQ ID NO: 216776 - DNA, 25 bp, Mus musculus
caaaccacagaaggtgcagacctct

SEQ ID NO: 216777 - DNA, 25 bp, Mus musculus
caaaccacagctgcactggcgtctg

SEQ ID NO: 216778 - DNA, 25 bp, Mus musculus
caaaccacagtgagaagtctgtccc

SEQ ID NO: 216779 - DNA, 25 bp, Mus musculus
caaaccacattgggtgggtgcagga

SEQ ID NO: 216780 - DNA, 25 bp, Mus musculus
caaaccaccgctgaagacgatgacg

SEQ ID NO: 216781 - DNA, 25 bp, Mus musculus
caaaccaccgctgcagcccactaaa

SEQ ID NO: 216782 - DNA, 25 bp, Mus musculus
caaaccactggatatattgggttgg

SEQ ID NO: 216783 - DNA, 25 bp, Mus musculus
caaaccactggggagtagagcaagt

SEQ ID NO: 216784 - DNA, 25 bp, Mus musculus
caaaccactgtggattacgctcgat

SEQ ID NO: 216785 - DNA, 25 bp, Mus musculus
caaaccagagaggacctgagctgtc

SEQ ID NO: 216786 - DNA, 25 bp, Mus musculus
caaaccagcaagctcctgggcctgc

SEQ ID NO: 216787 - DNA, 25 bp, Mus musculus
caaaccagcaagtgcgactgtatct

SEQ ID NO: 216788 - DNA, 25 bp, Mus musculus
caaaccatagagagacactacgcac

SEQ ID NO: 216789 - DNA, 25 bp, Mus musculus
caaaccatctgatggcctgctggtg

SEQ ID NO: 216790 - DNA, 25 bp, Mus musculus
caaaccatgacatgtactatgcgtc

SEQ ID NO: 216791 - DNA, 25 bp, Mus musculus
caaaccatgttccggcttttcccca

SEQ ID NO: 216792 - DNA, 25 bp, Mus musculus
caaaccattcaaaatacaagtcctg

SEQ ID NO: 216793 - DNA, 25 bp, Mus musculus
caaaccattcaaatcctggttgaag

SEQ ID NO: 216794 - DNA, 25 bp, Mus musculus
caaaccattcagtttgcaggagaca

SEQ ID NO: 216795 - DNA, 25 bp, Mus musculus
caaaccattcatctgggaatgattt

SEQ ID NO: 216796 - DNA, 25 bp, Mus musculus
caaacccaaactggatcctctgaag

SEQ ID NO: 216797 - DNA, 25 bp, Mus musculus
caaacccaaagagatgtggttgctg

SEQ ID NO: 216798 - DNA, 25 bp, Mus musculus
caaacccaaccaggtgatgagacta

SEQ ID NO: 216799 - DNA, 25 bp, Mus musculus
caaacccaagaaaatgatctgaatt

SEQ ID NO: 216800 - DNA, 25 bp, Mus musculus
caaacccaaggaggcggatgagtcc

SEQ ID NO: 216801 - DNA, 25 bp, Mus musculus
caaacccaaggtatggaagacttgg

SEQ ID NO: 216802 - DNA, 25 bp, Mus musculus
caaacccaaggtgctacagtgggga

SEQ ID NO: 216803 - DNA, 25 bp, Mus musculus
caaaccccaagaatctcgagaagcc

SEQ ID NO: 216804 - DNA, 25 bp, Mus musculus
caaaccccaaggagcggctgcaaag

SEQ ID NO: 216805 - DNA, 25 bp, Mus musculus
caaaccccacagcagaaactgcagt

SEQ ID NO: 216806 - DNA, 25 bp, Mus musculus
caaaccccacagcaggagtggacag

SEQ ID NO: 216807 - DNA, 25 bp, Mus musculus
caaaccccagatatccagcttgtcc

SEQ ID NO: 216808 - DNA, 25 bp, Mus musculus
caaaccccgccaagctctcggggat

SEQ ID NO: 216809 - DNA, 25 bp, Mus musculus
caaacccctcatctccccggccgca

SEQ ID NO: 216810 - DNA, 25 bp, Mus musculus
caaacccctctgtggtttctcagcc

SEQ ID NO: 216811 - DNA, 25 bp, Mus musculus
caaaccctatgtttgatgaccctgt

SEQ ID NO: 216812 - DNA, 25 bp, Mus musculus
caaaccctgtccaggtagctctggc

SEQ ID NO: 216813 - DNA, 25 bp, Mus musculus
caaacccttgtgaactgaagaataa

SEQ ID NO: 216814 - DNA, 25 bp, Mus musculus
caaaccctttgcactgagcagcctg

SEQ ID NO: 216815 - DNA, 25 bp, Mus musculus
caaaccgaagagatacttggagatg

SEQ ID NO: 216816 - DNA, 25 bp, Mus musculus
caaaccgcaggcaatactagccagc

SEQ ID NO: 216817 - DNA, 25 bp, Mus musculus
caaaccgcaggtataatcaaaggat

SEQ ID NO: 216818 - DNA, 25 bp, Mus musculus
caaaccgcccagcggtcagagtaca

SEQ ID NO: 216819 - DNA, 25 bp, Mus musculus
caaaccgcctgaggcacagacccca

SEQ ID NO: 216820 - DNA, 25 bp, Mus musculus
caaaccgcctgagtcaaatcagaaa

SEQ ID NO: 216821 - DNA, 25 bp, Mus musculus
caaaccggagcacgggattcgagtt

SEQ ID NO: 216822 - DNA, 25 bp, Mus musculus
caaaccggcagaagagcctagattc

SEQ ID NO: 216823 - DNA, 25 bp, Mus musculus
caaaccggcagaagcttcaaactct

SEQ ID NO: 216824 - DNA, 25 bp, Mus musculus
caaaccggccaccagccccttcaca

SEQ ID NO: 216825 - DNA, 25 bp, Mus musculus
caaaccggccaccaggttatcctac

SEQ ID NO: 216826 - DNA, 25 bp, Mus musculus
caaaccgtaggcctgtagctcccta

SEQ ID NO: 216827 - DNA, 25 bp, Mus musculus
caaacctaacggcctatggtgatga

SEQ ID NO: 216828 - DNA, 25 bp, Mus musculus
caaacctaacggcctgatgggagcc

SEQ ID NO: 216829 - DNA, 25 bp, Mus musculus
caaacctacatctgataaggaagga

SEQ ID NO: 216830 - DNA, 25 bp, Mus musculus
caaacctaccaggagcctgccacca

SEQ ID NO: 216831 - DNA, 25 bp, Mus musculus
caaacctagagagagaaatacaaga

SEQ ID NO: 216832 - DNA, 25 bp, Mus musculus
caaacctatggggcctcagactcat

SEQ ID NO: 216833 - DNA, 25 bp, Mus musculus
caaacctccacgctgaatgaaaagt

SEQ ID NO: 216834 - DNA, 25 bp, Mus musculus
caaacctctcagtgaaaactgaacc

SEQ ID NO: 216835 - DNA, 25 bp, Mus musculus
caaacctctgaacctacactttcct

SEQ ID NO: 216836 - DNA, 25 bp, Mus musculus
caaacctctgaagagttacatgctg

SEQ ID NO: 216837 - DNA, 25 bp, Mus musculus
caaacctctgcggcggtatctgacc

SEQ ID NO: 216838 - DNA, 25 bp, Mus musculus
caaacctgcatgccatgatcaaagc

SEQ ID NO: 216839 - DNA, 25 bp, Mus musculus
caaacctgccatgggaaggagatgc

SEQ ID NO: 216840 - DNA, 25 bp, Mus musculus
caaacctgccatgggagctggactg

SEQ ID NO: 216841 - DNA, 25 bp, Mus musculus
caaaccttcccaggaaactccatgg

SEQ ID NO: 216842 - DNA, 25 bp, Mus musculus
caaaccttcccaggcacatctccct

SEQ ID NO: 216843 - DNA, 25 bp, Mus musculus
caaaccttgatcaggatcttcccaa

SEQ ID NO: 216844 - DNA, 25 bp, Mus musculus
caaacgaacaagactctgacaccac

SEQ ID NO: 216845 - DNA, 25 bp, Mus musculus
caaacgaacaagcaggttcaggaga

SEQ ID NO: 216846 - DNA, 25 bp, Mus musculus
caaacgaacaatagtagaaaatgag

SEQ ID NO: 216847 - DNA, 25 bp, Mus musculus
caaacgaagacatcaaaggctcttg

SEQ ID NO: 216848 - DNA, 25 bp, Mus musculus
caaacgcaccgatggagggtccgaa

SEQ ID NO: 216849 - DNA, 25 bp, Mus musculus
caaacgccagacgtgaaaaatgaag

SEQ ID NO: 216850 - DNA, 25 bp, Mus musculus
caaacgctataggtatgtgtatcac

SEQ ID NO: 216851 - DNA, 25 bp, Mus musculus
caaacggatgaaaaccgtcaaggaa

SEQ ID NO: 216852 - DNA, 25 bp, Mus musculus
caaacggcatgtatcctcctccacc

SEQ ID NO: 216853 - DNA, 25 bp, Mus musculus
caaacggcatgtgacctgacctagt

SEQ ID NO: 216854 - DNA, 25 bp, Mus musculus
caaacggggccatcgatgtgcagaa

SEQ ID NO: 216855 - DNA, 25 bp, Mus musculus
caaacggggccatcgtgattcgagt

SEQ ID NO: 216856 - DNA, 25 bp, Mus musculus
caaacggtcttccgacatagactga

SEQ ID NO: 216857 - DNA, 25 bp, Mus musculus
caaacgtccagcgtttggagcagga

SEQ ID NO: 216858 - DNA, 25 bp, Mus musculus
caaacgtccaggagcaggcctcgtg

SEQ ID NO: 216859 - DNA, 25 bp, Mus musculus
caaacgtgacaacagcactgtttga

SEQ ID NO: 216860 - DNA, 25 bp, Mus musculus
caaactaaaggctatggtcatgcgg

SEQ ID NO: 216861 - DNA, 25 bp, Mus musculus
caaactaacaaggacaatcagtacc

SEQ ID NO: 216862 - DNA, 25 bp, Mus musculus
caaactaacaaggatattacaaatg

SEQ ID NO: 216863 - DNA, 25 bp, Mus musculus
caaactaacagaaattgatgatgca

SEQ ID NO: 216864 - DNA, 25 bp, Mus musculus
caaactaacaggtcaaggaaaacgt

SEQ ID NO: 216865 - DNA, 25 bp, Mus musculus
caaactaattatagtcctattgtcg

SEQ ID NO: 216866 - DNA, 25 bp, Mus musculus
caaactacacggaagaaaagcaact

SEQ ID NO: 216867 - DNA, 25 bp, Mus musculus
caaactacattgccaaccgaggtcc

SEQ ID NO: 216868 - DNA, 25 bp, Mus musculus
caaactacattgttttcatcttcca

SEQ ID NO: 216869 - DNA, 25 bp, Mus musculus
caaactagacaagatgtcttgggaa

SEQ ID NO: 216870 - DNA, 25 bp, Mus musculus
caaactatactgagatcgccttaca

SEQ ID NO: 216871 - DNA, 25 bp, Mus musculus
caaactatcaggtactctatctaca

SEQ ID NO: 216872 - DNA, 25 bp, Mus musculus
caaactcaacatcgacagcatcaat

SEQ ID NO: 216873 - DNA, 25 bp, Mus musculus
caaactcaactctcgatccacactg

SEQ ID NO: 216874 - DNA, 25 bp, Mus musculus
caaactcaagatgctgatcatatga

SEQ ID NO: 216875 - DNA, 25 bp, Mus musculus
caaactcaagatgggaagtcattgc

SEQ ID NO: 216876 - DNA, 25 bp, Mus musculus
caaactcaaggaccaggcagctaag

SEQ ID NO: 216877 - DNA, 25 bp, Mus musculus
caaactcaaggccctcatcaaaaag

SEQ ID NO: 216878 - DNA, 25 bp, Mus musculus
caaactcaagttttggcaaggagct

SEQ ID NO: 216879 - DNA, 25 bp, Mus musculus
caaactcacaagaagaaacatgtca

SEQ ID NO: 216880 - DNA, 25 bp, Mus musculus
caaactcacaagaagacttccaact

SEQ ID NO: 216881 - DNA, 25 bp, Mus musculus
caaactcacaagaagtcgcaatgtg

SEQ ID NO: 216882 - DNA, 25 bp, Mus musculus
caaactcacaagagcaaagccaaag

SEQ ID NO: 216883 - DNA, 25 bp, Mus musculus
caaactcacaaggtatcgaagtgag

SEQ ID NO: 216884 - DNA, 25 bp, Mus musculus
caaactcacacagagcactggcctg

SEQ ID NO: 216885 - DNA, 25 bp, Mus musculus
caaactcacactcaagaataaattt

SEQ ID NO: 216886 - DNA, 25 bp, Mus musculus
caaactcacactcaaggataagttt

SEQ ID NO: 216887 - DNA, 25 bp, Mus musculus
caaactcaccgccataaaaagatgc

SEQ ID NO: 216888 - DNA, 25 bp, Mus musculus
caaactccatgactacctcatgagc

SEQ ID NO: 216889 - DNA, 25 bp, Mus musculus
caaactccgtcaggcccctgatttc

SEQ ID NO: 216890 - DNA, 25 bp, Mus musculus
caaactccgtcagtacctcttgtgt

SEQ ID NO: 216891 - DNA, 25 bp, Mus musculus
caaactcctaaaattatttcagctg

SEQ ID NO: 216892 - DNA, 25 bp, Mus musculus
caaactcctcaagggttggtggtcg

SEQ ID NO: 216893 - DNA, 25 bp, Mus musculus
caaactcgccacagagctcagcagt

SEQ ID NO: 216894 - DNA, 25 bp, Mus musculus
caaactctcagagaaccgagcccga

SEQ ID NO: 216895 - DNA, 25 bp, Mus musculus
caaactctccaaggccgacgtggaa

SEQ ID NO: 216896 - DNA, 25 bp, Mus musculus
caaactcttcctaagaaacctcacg

SEQ ID NO: 216897 - DNA, 25 bp, Mus musculus
caaactcttgcaaggtctggttttg

SEQ ID NO: 216898 - DNA, 25 bp, Mus musculus
caaactgaaactattaggcaggaac

SEQ ID NO: 216899 - DNA, 25 bp, Mus musculus
caaactgaacagagacactcctgag

SEQ ID NO: 216900 - DNA, 25 bp, Mus musculus
caaactgaacagagatgatgattct

SEQ ID NO: 216901 - DNA, 25 bp, Mus musculus
caaactgaagcaggaggaggagacg

SEQ ID NO: 216902 - DNA, 25 bp, Mus musculus
caaactgaagcaggtgtccatcctg

SEQ ID NO: 216903 - DNA, 25 bp, Mus musculus
caaactgaaggctcgatgagagaaa

SEQ ID NO: 216904 - DNA, 25 bp, Mus musculus
caaactgacccgaagggtcacagac

SEQ ID NO: 216905 - DNA, 25 bp, Mus musculus
caaactgactggttctgcagcattc

SEQ ID NO: 216906 - DNA, 25 bp, Mus musculus
caaactgcagctgcatggagcagcc

SEQ ID NO: 216907 - DNA, 25 bp, Mus musculus
caaactgcaggaatgggcaaaggac

SEQ ID NO: 216908 - DNA, 25 bp, Mus musculus
caaactgcctggaattacatgaatg

SEQ ID NO: 216909 - DNA, 25 bp, Mus musculus
caaactgcctgggtagtccatgatg

SEQ ID NO: 216910 - DNA, 25 bp, Mus musculus
caaactgctcaggaataaagctggc

SEQ ID NO: 216911 - DNA, 25 bp, Mus musculus
caaactggagcaggcagactgtttg

SEQ ID NO: 216912 - DNA, 25 bp, Mus musculus
caaactggaggaaagcacagacaac

SEQ ID NO: 216913 - DNA, 25 bp, Mus musculus
caaactggaggagttcaggaggggg

SEQ ID NO: 216914 - DNA, 25 bp, Mus musculus
caaactgtgtgcggagactgcggcc

SEQ ID NO: 216915 - DNA, 25 bp, Mus musculus
caaactgttcaggtagcaacaattg

SEQ ID NO: 216916 - DNA, 25 bp, Mus musculus
caaactgttctaaaggtgctttcca

SEQ ID NO: 216917 - DNA, 25 bp, Mus musculus
caaactgttctgcggtggagggaga

SEQ ID NO: 216918 - DNA, 25 bp, Mus musculus
caaactgttgattggtgctgatggg

SEQ ID NO: 216919 - DNA, 25 bp, Mus musculus
caaacttaaattgagtaggaagagt

SEQ ID NO: 216920 - DNA, 25 bp, Mus musculus
caaacttcaagaagcatacagtttc

SEQ ID NO: 216921 - DNA, 25 bp, Mus musculus
caaacttcaagaagtaccagtacat

SEQ ID NO: 216922 - DNA, 25 bp, Mus musculus
caaacttcagagtgaatgccatcca

SEQ ID NO: 216923 - DNA, 25 bp, Mus musculus
caaacttccagacctgaggtccaac

SEQ ID NO: 216924 - DNA, 25 bp, Mus musculus
caaacttccaggcacatctcaggcg

SEQ ID NO: 216925 - DNA, 25 bp, Mus musculus
caaacttcctccagacagcctggca

SEQ ID NO: 216926 - DNA, 25 bp, Mus musculus
caaacttcctccaggactggacagt

SEQ ID NO: 216927 - DNA, 25 bp, Mus musculus
caaacttgaaaagcaagaacgggag

SEQ ID NO: 216928 - DNA, 25 bp, Mus musculus
caaacttgcagtatgatgatggcag

SEQ ID NO: 216929 - DNA, 25 bp, Mus musculus
caaacttgtgggaagctcccctatt

SEQ ID NO: 216930 - DNA, 25 bp, Mus musculus
caaacttgtgggaagggcatttgtg

SEQ ID NO: 216931 - DNA, 25 bp, Mus musculus
caaactttagggactccagctaccc

SEQ ID NO: 216932 - DNA, 25 bp, Mus musculus
caaactttagggagtatagtcatgg

SEQ ID NO: 216933 - DNA, 25 bp, Mus musculus
caaactttatgatcctggggcagag

SEQ ID NO: 216934 - DNA, 25 bp, Mus musculus
caaacttttaggtagacatttgggc

SEQ ID NO: 216935 - DNA, 25 bp, Mus musculus
caaacttttatggccttgaactcag

SEQ ID NO: 216936 - DNA, 25 bp, Mus musculus
caaacttttccagtgtgtccattgt

SEQ ID NO: 216937 - DNA, 25 bp, Mus musculus
caaagaaaaacaaagggaatgtgac

SEQ ID NO: 216938 - DNA, 25 bp, Mus musculus
caaagaaaaaggaagactccacaaa

SEQ ID NO: 216939 - DNA, 25 bp, Mus musculus
caaagaaaacagatgatccagagga

SEQ ID NO: 216940 - DNA, 25 bp, Mus musculus
caaagaaaacagatggtacaaagaa

SEQ ID NO: 216941 - DNA, 25 bp, Mus musculus
caaagaaaatagctccggtacctcg

SEQ ID NO: 216942 - DNA, 25 bp, Mus musculus
caaagaaaatatggccaacagcagg

SEQ ID NO: 216943 - DNA, 25 bp, Mus musculus
caaagaaaatatggctttacaagat

SEQ ID NO: 216944 - DNA, 25 bp, Mus musculus
caaagaaagaagatgtcagcccagc

SEQ ID NO: 216945 - DNA, 25 bp, Mus musculus
caaagaaagagagaccagagggaca

SEQ ID NO: 216946 - DNA, 25 bp, Mus musculus
caaagaaagagagatggcagcagca

SEQ ID NO: 216947 - DNA, 25 bp, Mus musculus
caaagaaaggcgagtctacgtgaca

SEQ ID NO: 216948 - DNA, 25 bp, Mus musculus
caaagaaagtcaggtatgctgcaag

SEQ ID NO: 216949 - DNA, 25 bp, Mus musculus
caaagaaagttgcaaaaatcttggc

SEQ ID NO: 216950 - DNA, 25 bp, Mus musculus
caaagaaagttgcaaatgattcatt

SEQ ID NO: 216951 - DNA, 25 bp, Mus musculus
caaagaaatggcaaccagataaact

SEQ ID NO: 216952 - DNA, 25 bp, Mus musculus
caaagaacagaaaatcaatctttcc

SEQ ID NO: 216953 - DNA, 25 bp, Mus musculus
caaagaacaggtcctcagaatggtt

SEQ ID NO: 216954 - DNA, 25 bp, Mus musculus
caaagaacatggagccccctggtga

SEQ ID NO: 216955 - DNA, 25 bp, Mus musculus
caaagaacatggaggcccctggtga

SEQ ID NO: 216956 - DNA, 25 bp, Mus musculus
caaagaacggcgatgctttccgtca

SEQ ID NO: 216957 - DNA, 25 bp, Mus musculus
caaagaactcaagaatgatagattt

SEQ ID NO: 216958 - DNA, 25 bp, Mus musculus
caaagaactcaagattgatagattt

SEQ ID NO: 216959 - DNA, 25 bp, Mus musculus
caaagaagaaaaaagattataagag

SEQ ID NO: 216960 - DNA, 25 bp, Mus musculus
caaagaagaaaagctcaacagaggc

SEQ ID NO: 216961 - DNA, 25 bp, Mus musculus
caaagaagaaaaggaagagcatggc

SEQ ID NO: 216962 - DNA, 25 bp, Mus musculus
caaagaagaaaaggaatagtctcaa

SEQ ID NO: 216963 - DNA, 25 bp, Mus musculus
caaagaagaaaaggactgcatttac

SEQ ID NO: 216964 - DNA, 25 bp, Mus musculus
caaagaagacacccatataatgccc

SEQ ID NO: 216965 - DNA, 25 bp, Mus musculus
caaagaagacagccaaggacactgc

SEQ ID NO: 216966 - DNA, 25 bp, Mus musculus
caaagaagaggaatgagttcctgag

SEQ ID NO: 216967 - DNA, 25 bp, Mus musculus
caaagaagaggtgagtcctgagttg

SEQ ID NO: 216968 - DNA, 25 bp, Mus musculus
caaagaagcaaacgataaacaagct

SEQ ID NO: 216969 - DNA, 25 bp, Mus musculus
caaagaagcaaaggataaacaagct

SEQ ID NO: 216970 - DNA, 25 bp, Mus musculus
caaagaagccagcagggctgtggga

SEQ ID NO: 216971 - DNA, 25 bp, Mus musculus
caaagaagctcagagtctacagtgc

SEQ ID NO: 216972 - DNA, 25 bp, Mus musculus
caaagaagggacaggtgccattgac

SEQ ID NO: 216973 - DNA, 25 bp, Mus musculus
caaagaagggacaggtgtatcatcc

SEQ ID NO: 216974 - DNA, 25 bp, Mus musculus
caaagaaggggctggactgtaacag

SEQ ID NO: 216975 - DNA, 25 bp, Mus musculus
caaagaaggggctggggaacagaag

SEQ ID NO: 216976 - DNA, 25 bp, Mus musculus
caaagaagtgtggtgctgataatac

SEQ ID NO: 216977 - DNA, 25 bp, Mus musculus
caaagaagtgtggtggattgaacca

SEQ ID NO: 216978 - DNA, 25 bp, Mus musculus
caaagaagttttcagagattgctgg

SEQ ID NO: 216979 - DNA, 25 bp, Mus musculus
caaagaatcagagacaccagagaag

SEQ ID NO: 216980 - DNA, 25 bp, Mus musculus
caaagaatcagagagacaactggca

SEQ ID NO: 216981 - DNA, 25 bp, Mus musculus
caaagaatccagaaaatgtaaagca

SEQ ID NO: 216982 - DNA, 25 bp, Mus musculus
caaagaatgattctgttggctcatg

SEQ ID NO: 216983 - DNA, 25 bp, Mus musculus
caaagaatggggtaaccatagagat

SEQ ID NO: 216984 - DNA, 25 bp, Mus musculus
caaagaattccagaattcagtagct

SEQ ID NO: 216985 - DNA, 25 bp, Mus musculus
caaagacaacaaaaatgaaaagaaa

SEQ ID NO: 216986 - DNA, 25 bp, Mus musculus
caaagacaagacagagagtggagga

SEQ ID NO: 216987 - DNA, 25 bp, Mus musculus
caaagacaagacagggtgttgacga

SEQ ID NO: 216988 - DNA, 25 bp, Mus musculus
caaagacaagaccggacaatacact

SEQ ID NO: 216989 - DNA, 25 bp, Mus musculus
caaagacaagacgtggacacgcatc

SEQ ID NO: 216990 - DNA, 25 bp, Mus musculus
caaagacaagctcaaacatgtctgt

SEQ ID NO: 216991 - DNA, 25 bp, Mus musculus
caaagacaaggaggcagaagatggc

SEQ ID NO: 216992 - DNA, 25 bp, Mus musculus
caaagacaaggtgagggtggtgagc

SEQ ID NO: 216993 - DNA, 25 bp, Mus musculus
caaagacacgagcaccgggggtgga

SEQ ID NO: 216994 - DNA, 25 bp, Mus musculus
caaagacactcaggtccctccagct

SEQ ID NO: 216995 - DNA, 25 bp, Mus musculus
caaagacagacctgtcaagagaatc

SEQ ID NO: 216996 - DNA, 25 bp, Mus musculus
caaagacagacttaggcgctaactg

SEQ ID NO: 216997 - DNA, 25 bp, Mus musculus
caaagacagcaggctgcctttgata

SEQ ID NO: 216998 - DNA, 25 bp, Mus musculus
caaagacagcggcagacactctggg

SEQ ID NO: 216999 - DNA, 25 bp, Mus musculus
caaagacagcggcattgactcggga

SEQ ID NO: 217000 - DNA, 25 bp, Mus musculus
caaagacagcggccctggcccagcg

SEQ ID NO: 217001 - DNA, 25 bp, Mus musculus
caaagacaggagggagaaagagaga

SEQ ID NO: 217002 - DNA, 25 bp, Mus musculus
caaagaccacgtggatgaaggctga

SEQ ID NO: 217003 - DNA, 25 bp, Mus musculus
caaagacccaggagattagccgtcc

SEQ ID NO: 217004 - DNA, 25 bp, Mus musculus
caaagaccctatcgtcaacgtgtgg

SEQ ID NO: 217005 - DNA, 25 bp, Mus musculus
caaagacccttctggagaggtgttg

SEQ ID NO: 217006 - DNA, 25 bp, Mus musculus
caaagacctacagctgcaccaaagc

SEQ ID NO: 217007 - DNA, 25 bp, Mus musculus
caaagacctacaggaatcacaggtt

SEQ ID NO: 217008 - DNA, 25 bp, Mus musculus
caaagacctgatctccaagctgctg

SEQ ID NO: 217009 - DNA, 25 bp, Mus musculus
caaagacctggaggattacctgttg

SEQ ID NO: 217010 - DNA, 25 bp, Mus musculus
caaagacctggccaactgtaacaga

SEQ ID NO: 217011 - DNA, 25 bp, Mus musculus
caaagacctgtttctctagatctcc

SEQ ID NO: 217012 - DNA, 25 bp, Mus musculus
caaagaccttgagttgctggaactg

SEQ ID NO: 217013 - DNA, 25 bp, Mus musculus
caaagacgaggaaccttcagctgcc

SEQ ID NO: 217014 - DNA, 25 bp, Mus musculus
caaagacgaggagtggttccgatct

SEQ ID NO: 217015 - DNA, 25 bp, Mus musculus
caaagacgcaggaaaaggaagaaga

SEQ ID NO: 217016 - DNA, 25 bp, Mus musculus
caaagacggaaggactggaaatggc

SEQ ID NO: 217017 - DNA, 25 bp, Mus musculus
caaagactctaggatcaagtgagct

SEQ ID NO: 217018 - DNA, 25 bp, Mus musculus
caaagactctagtctttcaggttcc

SEQ ID NO: 217019 - DNA, 25 bp, Mus musculus
caaagactgcagagaacttcagagc

SEQ ID NO: 217020 - DNA, 25 bp, Mus musculus
caaagactgcagcaaatgaagctgg

SEQ ID NO: 217021 - DNA, 25 bp, Mus musculus
caaagagaaaacaggcatgtaatga

SEQ ID NO: 217022 - DNA, 25 bp, Mus musculus
caaagagaaaacaggtctcagcatc

SEQ ID NO: 217023 - DNA, 25 bp, Mus musculus
caaagagaaagaaaaatttcctatc

SEQ ID NO: 217024 - DNA, 25 bp, Mus musculus
caaagagaaagccagtgagaccgag

SEQ ID NO: 217025 - DNA, 25 bp, Mus musculus
caaagagaaagggaaaaactctcac

SEQ ID NO: 217026 - DNA, 25 bp, Mus musculus
caaagagaaatcaagggcttaagga

SEQ ID NO: 217027 - DNA, 25 bp, Mus musculus
caaagagaaatcaagtttgcttttc

SEQ ID NO: 217028 - DNA, 25 bp, Mus musculus
caaagagaacttggtctctgggcca

SEQ ID NO: 217029 - DNA, 25 bp, Mus musculus
caaagagaagaagaataacccatgg

SEQ ID NO: 217030 - DNA, 25 bp, Mus musculus
caaagagaagaagaattaactctgc

SEQ ID NO: 217031 - DNA, 25 bp, Mus musculus
caaagagaagaagaatttgggcttc

SEQ ID NO: 217032 - DNA, 25 bp, Mus musculus
caaagagaagcagcttgtgaaaaag

SEQ ID NO: 217033 - DNA, 25 bp, Mus musculus
caaagagaaggaaaagtgatagtgg

SEQ ID NO: 217034 - DNA, 25 bp, Mus musculus
caaagagaaggatgcatcttcctgg

SEQ ID NO: 217035 - DNA, 25 bp, Mus musculus
caaagagaaggatggcatccccatc

SEQ ID NO: 217036 - DNA, 25 bp, Mus musculus
caaagagaaggcaggtacaccgagg

SEQ ID NO: 217037 - DNA, 25 bp, Mus musculus
caaagagaagtgcagcccccttcct

SEQ ID NO: 217038 - DNA, 25 bp, Mus musculus
caaagagaatgatggatatatcttc

SEQ ID NO: 217039 - DNA, 25 bp, Mus musculus
caaagagagtgccaggaaatagcct

SEQ ID NO: 217040 - DNA, 25 bp, Mus musculus
caaagagagtgccaggctttgggga

SEQ ID NO: 217041 - DNA, 25 bp, Mus musculus
caaagagatggagtcatgcacttct

SEQ ID NO: 217042 - DNA, 25 bp, Mus musculus
caaagagatggtcagccgcctgact

SEQ ID NO: 217043 - DNA, 25 bp, Mus musculus
caaagagattgcaaggtacaaaaga

SEQ ID NO: 217044 - DNA, 25 bp, Mus musculus
caaagagattgcaagttctgattca

SEQ ID NO: 217045 - DNA, 25 bp, Mus musculus
caaagagcacttttgagcacaagtg

SEQ ID NO: 217046 - DNA, 25 bp, Mus musculus
caaagagcacttttggactacattg

SEQ ID NO: 217047 - DNA, 25 bp, Mus musculus
caaagagcagcaatgttaagtcttc

SEQ ID NO: 217048 - DNA, 25 bp, Mus musculus
caaagagcagcacctgacgttcacg

SEQ ID NO: 217049 - DNA, 25 bp, Mus musculus
caaagagccaagaaggtaaggcgag

SEQ ID NO: 217050 - DNA, 25 bp, Mus musculus
caaagagccagttccaagaattacc

SEQ ID NO: 217051 - DNA, 25 bp, Mus musculus
caaagagcccagcaaaggaagccac

SEQ ID NO: 217052 - DNA, 25 bp, Mus musculus
caaagagcctccagggacagtgtct

SEQ ID NO: 217053 - DNA, 25 bp, Mus musculus
caaagagcgcgcgatttctaacgag

SEQ ID NO: 217054 - DNA, 25 bp, Mus musculus
caaagagcgcgcgtggaaagaagaa

SEQ ID NO: 217055 - DNA, 25 bp, Mus musculus
caaagagctcaaggatgcaggagct

SEQ ID NO: 217056 - DNA, 25 bp, Mus musculus
caaagagctgggtctctccagtgtt

SEQ ID NO: 217057 - DNA, 25 bp, Mus musculus
caaagagcttgagttcatcacgctg

SEQ ID NO: 217058 - DNA, 25 bp, Mus musculus
caaagaggaaaagagtgtttgagca

SEQ ID NO: 217059 - DNA, 25 bp, Mus musculus
caaagaggaaaggagttctctgaac

SEQ ID NO: 217060 - DNA, 25 bp, Mus musculus
caaagaggagaagagcagccagcac

SEQ ID NO: 217061 - DNA, 25 bp, Mus musculus
caaagaggagaagagggtccacctg

SEQ ID NO: 217062 - DNA, 25 bp, Mus musculus
caaagaggagagccaggttctcgag

SEQ ID NO: 217063 - DNA, 25 bp, Mus musculus
caaagaggagatatttggaccagtg

SEQ ID NO: 217064 - DNA, 25 bp, Mus musculus
caaagaggtgcaggcggctggagga

SEQ ID NO: 217065 - DNA, 25 bp, Mus musculus
caaagaggtgcaggctggttcgagc

SEQ ID NO: 217066 - DNA, 25 bp, Mus musculus
caaagagtcagacatttacattgtt

SEQ ID NO: 217067 - DNA, 25 bp, Mus musculus
caaagagtctgaggatcctaaacac

SEQ ID NO: 217068 - DNA, 25 bp, Mus musculus
caaagagtgagttggcttcagctgt

SEQ ID NO: 217069 - DNA, 25 bp, Mus musculus
caaagagtgcagcatcgccctgagc

SEQ ID NO: 217070 - DNA, 25 bp, Mus musculus
caaagagtgcagttttggttctaac

SEQ ID NO: 217071 - DNA, 25 bp, Mus musculus
caaagatacccaagagccagaaact

SEQ ID NO: 217072 - DNA, 25 bp, Mus musculus
caaagatacgaaggaagaagttcta

SEQ ID NO: 217073 - DNA, 25 bp, Mus musculus
caaagatacgaagtgatgtcctggt

SEQ ID NO: 217074 - DNA, 25 bp, Mus musculus
caaagatactctcagagatgctgga

SEQ ID NO: 217075 - DNA, 25 bp, Mus musculus
caaagatattcaggtccttaaaatt

SEQ ID NO: 217076 - DNA, 25 bp, Mus musculus
caaagatattccagcctcactgcag

SEQ ID NO: 217077 - DNA, 25 bp, Mus musculus
caaagatcaaatatcatgtagaaga

SEQ ID NO: 217078 - DNA, 25 bp, Mus musculus
caaagatcaattatcatgtagaaga

SEQ ID NO: 217079 - DNA, 25 bp, Mus musculus
caaagatcagagatggagtctcatg

SEQ ID NO: 217080 - DNA, 25 bp, Mus musculus
caaagatcaggagatttgtacaccc

SEQ ID NO: 217081 - DNA, 25 bp, Mus musculus
caaagatccagacaaggagggcatc

SEQ ID NO: 217082 - DNA, 25 bp, Mus musculus
caaagatctgtgaagttcattcaaa

SEQ ID NO: 217083 - DNA, 25 bp, Mus musculus
caaagatgaagacagggaacagaca

SEQ ID NO: 217084 - DNA, 25 bp, Mus musculus
caaagatgaagacagttcagagtgc

SEQ ID NO: 217085 - DNA, 25 bp, Mus musculus
caaagatgacaaccccaagcatcca

SEQ ID NO: 217086 - DNA, 25 bp, Mus musculus
caaagatgacagcaaaaatgtattt

SEQ ID NO: 217087 - DNA, 25 bp, Mus musculus
caaagatgacagcaaacataaaggt

SEQ ID NO: 217088 - DNA, 25 bp, Mus musculus
caaagatgagattccatattaataa

SEQ ID NO: 217089 - DNA, 25 bp, Mus musculus
caaagatggaagaagccctctgggc

SEQ ID NO: 217090 - DNA, 25 bp, Mus musculus
caaagatgtacagctgggtccttgg

SEQ ID NO: 217091 - DNA, 25 bp, Mus musculus
caaagatgtacaggggtggcaaaat

SEQ ID NO: 217092 - DNA, 25 bp, Mus musculus
caaagatgtcagtgctctcttccct

SEQ ID NO: 217093 - DNA, 25 bp, Mus musculus
caaagattaaatttccaaggcccga

SEQ ID NO: 217094 - DNA, 25 bp, Mus musculus
caaagattaaggtacacaggtttct

SEQ ID NO: 217095 - DNA, 25 bp, Mus musculus
caaagattaagttgctcaggaaacc

SEQ ID NO: 217096 - DNA, 25 bp, Mus musculus
caaagattcaaggaagcctgggggg

SEQ ID NO: 217097 - DNA, 25 bp, Mus musculus
caaagattcaggctggacaatttgc

SEQ ID NO: 217098 - DNA, 25 bp, Mus musculus
caaagattcaggttctccccaatca

SEQ ID NO: 217099 - DNA, 25 bp, Mus musculus
caaagattcctgccaggtgactctg

SEQ ID NO: 217100 - DNA, 25 bp, Mus musculus
caaagattgccatggtggtgcaact

SEQ ID NO: 217101 - DNA, 25 bp, Mus musculus
caaagattggaaggagacttcaaaa

SEQ ID NO: 217102 - DNA, 25 bp, Mus musculus
caaagattggaaggtattcccatct

SEQ ID NO: 217103 - DNA, 25 bp, Mus musculus
caaagattggaagtggttctgtgta

SEQ ID NO: 217104 - DNA, 25 bp, Mus musculus
caaagattggaagttcctgtggaag

SEQ ID NO: 217105 - DNA, 25 bp, Mus musculus
caaagattgtgtgctgttccacctc

SEQ ID NO: 217106 - DNA, 25 bp, Mus musculus
caaagatttctgttttggtcgtgtg

SEQ ID NO: 217107 - DNA, 25 bp, Mus musculus
caaagcaaaaatgaggagtgggaag

SEQ ID NO: 217108 - DNA, 25 bp, Mus musculus
caaagcaaagacaaatgagcttgtg

SEQ ID NO: 217109 - DNA, 25 bp, Mus musculus
caaagcaaagatcattgcttgtctt

SEQ ID NO: 217110 - DNA, 25 bp, Mus musculus
caaagcaaagccagggcatagtcca

SEQ ID NO: 217111 - DNA, 25 bp, Mus musculus
caaagcaaagccagtgaaactgaaa

SEQ ID NO: 217112 - DNA, 25 bp, Mus musculus
caaagcaacaggaactttgcatcat

SEQ ID NO: 217113 - DNA, 25 bp, Mus musculus
caaagcaacaggtggaccgtacgga

SEQ ID NO: 217114 - DNA, 25 bp, Mus musculus
caaagcaacaggtttcagatagaag

SEQ ID NO: 217115 - DNA, 25 bp, Mus musculus
caaagcaagagattcgagtaagagt

SEQ ID NO: 217116 - DNA, 25 bp, Mus musculus
caaagcaattgcctgtaccccagta

SEQ ID NO: 217117 - DNA, 25 bp, Mus musculus
caaagcacagaaggaacagattctg

SEQ ID NO: 217118 - DNA, 25 bp, Mus musculus
caaagcacggggtagtgatccattg

SEQ ID NO: 217119 - DNA, 25 bp, Mus musculus
caaagcagaaatttacctaaagcct

SEQ ID NO: 217120 - DNA, 25 bp, Mus musculus
caaagcagaagagaatggaagtgag

SEQ ID NO: 217121 - DNA, 25 bp, Mus musculus
caaagcagacagaatttcagcatat

SEQ ID NO: 217122 - DNA, 25 bp, Mus musculus
caaagcagacaggttcagctcctaa

SEQ ID NO: 217123 - DNA, 25 bp, Mus musculus
caaagcagagacggtaacacggttc

SEQ ID NO: 217124 - DNA, 25 bp, Mus musculus
caaagcagatttaaagaacccaata

SEQ ID NO: 217125 - DNA, 25 bp, Mus musculus
caaagcagcaaataaccacatttta

SEQ ID NO: 217126 - DNA, 25 bp, Mus musculus
caaagcagcaatcccatatgacaag

SEQ ID NO: 217127 - DNA, 25 bp, Mus musculus
caaagcagcaccaaggaaacgtgtc

SEQ ID NO: 217128 - DNA, 25 bp, Mus musculus
caaagcagcaccaagtgtgggttgt

SEQ ID NO: 217129 - DNA, 25 bp, Mus musculus
caaagcagcaggagcagaccccctg

SEQ ID NO: 217130 - DNA, 25 bp, Mus musculus
caaagcaggagcccaacttgcaggt

SEQ ID NO: 217131 - DNA, 25 bp, Mus musculus
caaagcagtccggcatgaggatcgt

SEQ ID NO: 217132 - DNA, 25 bp, Mus musculus
caaagcatcatacagaccagaggga

SEQ ID NO: 217133 - DNA, 25 bp, Mus musculus
caaagcatggagggtgatgaggaag

SEQ ID NO: 217134 - DNA, 25 bp, Mus musculus
caaagcatggggacattcaatcctg

SEQ ID NO: 217135 - DNA, 25 bp, Mus musculus
caaagcattagaagtcttcccagag

SEQ ID NO: 217136 - DNA, 25 bp, Mus musculus
caaagcattcgctatggagttactg

SEQ ID NO: 217137 - DNA, 25 bp, Mus musculus
caaagccaaagctgctcagactgca

SEQ ID NO: 217138 - DNA, 25 bp, Mus musculus
caaagccaagatctccaagccagca

SEQ ID NO: 217139 - DNA, 25 bp, Mus musculus
caaagccaagatgtttgaagctagt

SEQ ID NO: 217140 - DNA, 25 bp, Mus musculus
caaagccaaggcaaagctgatgggg

SEQ ID NO: 217141 - DNA, 25 bp, Mus musculus
caaagccaaggctgcctacctgaaa

SEQ ID NO: 217142 - DNA, 25 bp, Mus musculus
caaagccacaagtgcctccaaaacc

SEQ ID NO: 217143 - DNA, 25 bp, Mus musculus
caaagccaccaagatcctgagacat

SEQ ID NO: 217144 - DNA, 25 bp, Mus musculus
caaagccagaaaaaaaatcagttcg

SEQ ID NO: 217145 - DNA, 25 bp, Mus musculus
caaagccagaaaatcactgtgagcc

SEQ ID NO: 217146 - DNA, 25 bp, Mus musculus
caaagccagagggagccgtgtgccc

SEQ ID NO: 217147 - DNA, 25 bp, Mus musculus
caaagccagcagaaaccacagatga

SEQ ID NO: 217148 - DNA, 25 bp, Mus musculus
caaagccagggcggttaaactcact

SEQ ID NO: 217149 - DNA, 25 bp, Mus musculus
caaagccataaagaggaaaccactg

SEQ ID NO: 217150 - DNA, 25 bp, Mus musculus
caaagccataaagaggaaccaggcc

SEQ ID NO: 217151 - DNA, 25 bp, Mus musculus
caaagccatggtttgactctgctga

SEQ ID NO: 217152 - DNA, 25 bp, Mus musculus
caaagcccaagaaatagcagacaag

SEQ ID NO: 217153 - DNA, 25 bp, Mus musculus
caaagcccaaggacatgggagaagg

SEQ ID NO: 217154 - DNA, 25 bp, Mus musculus
caaagcccactcagtgaatggcatt

SEQ ID NO: 217155 - DNA, 25 bp, Mus musculus
caaagcccaggagaagcgccccgag

SEQ ID NO: 217156 - DNA, 25 bp, Mus musculus
caaagcccaggtcaaactctggttc

SEQ ID NO: 217157 - DNA, 25 bp, Mus musculus
caaagcccgggtaacatccggatat

SEQ ID NO: 217158 - DNA, 25 bp, Mus musculus
caaagcccgggtatcatccggatat

SEQ ID NO: 217159 - DNA, 25 bp, Mus musculus
caaagccctcaagaaactccggagt

SEQ ID NO: 217160 - DNA, 25 bp, Mus musculus
caaagccctgaaggcactaagtgac

SEQ ID NO: 217161 - DNA, 25 bp, Mus musculus
caaagccctgaatggcttcacccct

SEQ ID NO: 217162 - DNA, 25 bp, Mus musculus
caaagccgaagagtgtaggcttgtg

SEQ ID NO: 217163 - DNA, 25 bp, Mus musculus
caaagccgtgcagagcaagccatac

SEQ ID NO: 217164 - DNA, 25 bp, Mus musculus
caaagccgtgcagagcatctactgc

SEQ ID NO: 217165 - DNA, 25 bp, Mus musculus
caaagcctacagacacagaggcccc

SEQ ID NO: 217166 - DNA, 25 bp, Mus musculus
caaagccttgctgattttcagaaag

SEQ ID NO: 217167 - DNA, 25 bp, Mus musculus
caaagcctttgctgcccagtttgaa

SEQ ID NO: 217168 - DNA, 25 bp, Mus musculus
caaagcctttgctggggacacccag

SEQ ID NO: 217169 - DNA, 25 bp, Mus musculus
caaagcgagaagactgagaaaagct

SEQ ID NO: 217170 - DNA, 25 bp, Mus musculus
caaagcgaggcagttgttctccatg

SEQ ID NO: 217171 - DNA, 25 bp, Mus musculus
caaagcgtagaatgagaagactttg

SEQ ID NO: 217172 - DNA, 25 bp, Mus musculus
caaagcgtagcttcatactagggat

SEQ ID NO: 217173 - DNA, 25 bp, Mus musculus
caaagcgtagcttgaagtcaatggc

SEQ ID NO: 217174 - DNA, 25 bp, Mus musculus
caaagcgtctggcagcagaagatgt

SEQ ID NO: 217175 - DNA, 25 bp, Mus musculus
caaagcgtggttgatctggtggctc

SEQ ID NO: 217176 - DNA, 25 bp, Mus musculus
caaagctaacagggacagttaaagg

SEQ ID NO: 217177 - DNA, 25 bp, Mus musculus
caaagctactccagaaaaatcttca

SEQ ID NO: 217178 - DNA, 25 bp, Mus musculus
caaagctaggaggactcacacacga

SEQ ID NO: 217179 - DNA, 25 bp, Mus musculus
caaagctcaggaacggcgagaagac

SEQ ID NO: 217180 - DNA, 25 bp, Mus musculus
caaagctcaggctctcatgcagccg

SEQ ID NO: 217181 - DNA, 25 bp, Mus musculus
caaagctcatagcgggatcctgccg

SEQ ID NO: 217182 - DNA, 25 bp, Mus musculus
caaagctccacaggggatctttcca

SEQ ID NO: 217183 - DNA, 25 bp, Mus musculus
caaagctcccaaagcaaatccagtt

SEQ ID NO: 217184 - DNA, 25 bp, Mus musculus
caaagctctgaccattcccggagca

SEQ ID NO: 217185 - DNA, 25 bp, Mus musculus
caaagctgaaggctccgagtaccag

SEQ ID NO: 217186 - DNA, 25 bp, Mus musculus
caaagctgaccagaaggaaaagagt

SEQ ID NO: 217187 - DNA, 25 bp, Mus musculus
caaagctgaggtacggcatccagaa

SEQ ID NO: 217188 - DNA, 25 bp, Mus musculus
caaagctgcagaggagcaactttca

SEQ ID NO: 217189 - DNA, 25 bp, Mus musculus
caaagctgcagagtttcatgatggc

SEQ ID NO: 217190 - DNA, 25 bp, Mus musculus
caaagctgcaggcatcgttctgcct

SEQ ID NO: 217191 - DNA, 25 bp, Mus musculus
caaagctgctatcgggggaggagtg

SEQ ID NO: 217192 - DNA, 25 bp, Mus musculus
caaagctggcaaggcttttgctgtt

SEQ ID NO: 217193 - DNA, 25 bp, Mus musculus
caaagctggcaaggtacggactcga

SEQ ID NO: 217194 - DNA, 25 bp, Mus musculus
caaagctggcaaggttcgaacctca

SEQ ID NO: 217195 - DNA, 25 bp, Mus musculus
caaagctggccttgcaggtctctct

SEQ ID NO: 217196 - DNA, 25 bp, Mus musculus
caaagctgtgttcagccctgacaga

SEQ ID NO: 217197 - DNA, 25 bp, Mus musculus
caaagctgtgttcaggctcttcaaa

SEQ ID NO: 217198 - DNA, 25 bp, Mus musculus
caaagcttctctggttctctgccat

SEQ ID NO: 217199 - DNA, 25 bp, Mus musculus
caaagcttctgtggttctctgccat

SEQ ID NO: 217200 - DNA, 25 bp, Mus musculus
caaagcttgagaaaaaccatggtga

SEQ ID NO: 217201 - DNA, 25 bp, Mus musculus
caaagctttggagggctccactcta

SEQ ID NO: 217202 - DNA, 25 bp, Mus musculus
caaaggaaacgatggatctggggag

SEQ ID NO: 217203 - DNA, 25 bp, Mus musculus
caaaggaaacggtgcctcctcctgg

SEQ ID NO: 217204 - DNA, 25 bp, Mus musculus
caaaggaaagatttctcgaatgctg

SEQ ID NO: 217205 - DNA, 25 bp, Mus musculus
caaaggaaaggcattagcaaaagca

SEQ ID NO: 217206 - DNA, 25 bp, Mus musculus
caaaggaaatctgaaaaaagacgag

SEQ ID NO: 217207 - DNA, 25 bp, Mus musculus
caaaggaaatctgccttaagaactg

SEQ ID NO: 217208 - DNA, 25 bp, Mus musculus
caaaggaacaaggacagggagattt

SEQ ID NO: 217209 - DNA, 25 bp, Mus musculus
caaaggaagaagatgtagaatgtgg

SEQ ID NO: 217210 - DNA, 25 bp, Mus musculus
caaaggaagaagttacagattcatg

SEQ ID NO: 217211 - DNA, 25 bp, Mus musculus
caaaggaagccaagatttctcagct

SEQ ID NO: 217212 - DNA, 25 bp, Mus musculus
caaaggaatatacagctggcaggga

SEQ ID NO: 217213 - DNA, 25 bp, Mus musculus
caaaggacagaacaactgagattcc

SEQ ID NO: 217214 - DNA, 25 bp, Mus musculus
caaaggacagaagaagaagaaagga

SEQ ID NO: 217215 - DNA, 25 bp, Mus musculus
caaaggacagaagagatctgctggc

SEQ ID NO: 217216 - DNA, 25 bp, Mus musculus
caaaggacagaagggctctgcgttt

SEQ ID NO: 217217 - DNA, 25 bp, Mus musculus
caaaggacagaagtcctccacagag

SEQ ID NO: 217218 - DNA, 25 bp, Mus musculus
caaaggacagaataatcctcaggtc

SEQ ID NO: 217219 - DNA, 25 bp, Mus musculus
caaaggacagaggacctgaaggctg

SEQ ID NO: 217220 - DNA, 25 bp, Mus musculus
caaaggacagagggtagacaaacac

SEQ ID NO: 217221 - DNA, 25 bp, Mus musculus
caaaggacagctggctgtataggat

SEQ ID NO: 217222 - DNA, 25 bp, Mus musculus
caaaggacatcgtcacgagctgagg

SEQ ID NO: 217223 - DNA, 25 bp, Mus musculus
caaaggaccatgatgatttctggct

SEQ ID NO: 217224 - DNA, 25 bp, Mus musculus
caaaggaccatggcatcaaccctag

SEQ ID NO: 217225 - DNA, 25 bp, Mus musculus
caaaggaccgatgtagcaggcctgt

SEQ ID NO: 217226 - DNA, 25 bp, Mus musculus
caaaggactgaagggagtggaaaat

SEQ ID NO: 217227 - DNA, 25 bp, Mus musculus
caaaggactgtggtcaatgtgcgga

SEQ ID NO: 217228 - DNA, 25 bp, Mus musculus
caaaggagaaaagggtgctcgggga

SEQ ID NO: 217229 - DNA, 25 bp, Mus musculus
caaaggagaagcaggtctccctggg

SEQ ID NO: 217230 - DNA, 25 bp, Mus musculus
caaaggagaccctggcttcaaaggt

SEQ ID NO: 217231 - DNA, 25 bp, Mus musculus
caaaggagagaaatgtcaacgtgtt

SEQ ID NO: 217232 - DNA, 25 bp, Mus musculus
caaaggagcggatttccatttccta

SEQ ID NO: 217233 - DNA, 25 bp, Mus musculus
caaaggaggaggatggcttccgcct

SEQ ID NO: 217234 - DNA, 25 bp, Mus musculus
caaaggagggaccgctgacaaagga

SEQ ID NO: 217235 - DNA, 25 bp, Mus musculus
caaaggagggcacaggctggcaaca

SEQ ID NO: 217236 - DNA, 25 bp, Mus musculus
caaaggaggtagaagaggaacgtac

SEQ ID NO: 217237 - DNA, 25 bp, Mus musculus
caaaggatccagatgcagaactctc

SEQ ID NO: 217238 - DNA, 25 bp, Mus musculus
caaaggatccagtttatttatatgg

SEQ ID NO: 217239 - DNA, 25 bp, Mus musculus
caaaggatccgctggtgctcctgga

SEQ ID NO: 217240 - DNA, 25 bp, Mus musculus
caaaggatctagatgagaatgaagt

SEQ ID NO: 217241 - DNA, 25 bp, Mus musculus
caaaggatgagcaagatgaacgaga

SEQ ID NO: 217242 - DNA, 25 bp, Mus musculus
caaaggatgagttgcttcagaggtt

SEQ ID NO: 217243 - DNA, 25 bp, Mus musculus
caaaggattatggtaccaagcgcct

SEQ ID NO: 217244 - DNA, 25 bp, Mus musculus
caaaggatttcccaggtaagcttca

SEQ ID NO: 217245 - DNA, 25 bp, Mus musculus
caaaggcaaaagcacgtacctgttt

SEQ ID NO: 217246 - DNA, 25 bp, Mus musculus
caaaggcaaaagcaggtacctgttt

SEQ ID NO: 217247 - DNA, 25 bp, Mus musculus
caaaggcaaaattcttccaagaagg

SEQ ID NO: 217248 - DNA, 25 bp, Mus musculus
caaaggcaaagcttccctggttgta

SEQ ID NO: 217249 - DNA, 25 bp, Mus musculus
caaaggcaatgaaggaagaagaaag

SEQ ID NO: 217250 - DNA, 25 bp, Mus musculus
caaaggcaatgaaggctccatatat

SEQ ID NO: 217251 - DNA, 25 bp, Mus musculus
caaaggcaatgaaggtaaatgatct

SEQ ID NO: 217252 - DNA, 25 bp, Mus musculus
caaaggcacgaaagtgagggaagac

SEQ ID NO: 217253 - DNA, 25 bp, Mus musculus
caaaggcagacgtattgcagactgt

SEQ ID NO: 217254 - DNA, 25 bp, Mus musculus
caaaggcagagtcagttgttcactg

SEQ ID NO: 217255 - DNA, 25 bp, Mus musculus
caaaggcagccctggccctgtgggc

SEQ ID NO: 217256 - DNA, 25 bp, Mus musculus
caaaggcatcagatttcgtggatat

SEQ ID NO: 217257 - DNA, 25 bp, Mus musculus
caaaggcatcatggctcacctgtgc

SEQ ID NO: 217258 - DNA, 25 bp, Mus musculus
caaaggccaaacaaaagccgaaata

SEQ ID NO: 217259 - DNA, 25 bp, Mus musculus
caaaggccaaacaaagagcacagtc

SEQ ID NO: 217260 - DNA, 25 bp, Mus musculus
caaaggccaaacaagttgtcaagtt

SEQ ID NO: 217261 - DNA, 25 bp, Mus musculus
caaaggccccacaggctctgcagga

SEQ ID NO: 217262 - DNA, 25 bp, Mus musculus
caaaggccctggggaatgtatcatt

SEQ ID NO: 217263 - DNA, 25 bp, Mus musculus
caaaggccctttatgaacaaaggaa

SEQ ID NO: 217264 - DNA, 25 bp, Mus musculus
caaaggccctttatggaacagacgg

SEQ ID NO: 217265 - DNA, 25 bp, Mus musculus
caaaggcctaacatttggaaggcta

SEQ ID NO: 217266 - DNA, 25 bp, Mus musculus
caaaggcctaacctccaaaagtatg

SEQ ID NO: 217267 - DNA, 25 bp, Mus musculus
caaaggcctgaatcaggtctgctgg

SEQ ID NO: 217268 - DNA, 25 bp, Mus musculus
caaaggccttggcaattatttgtat

SEQ ID NO: 217269 - DNA, 25 bp, Mus musculus
caaaggcgacgacctgctgccgtct

SEQ ID NO: 217270 - DNA, 25 bp, Mus musculus
caaaggcgacgatagggccagtgtt

SEQ ID NO: 217271 - DNA, 25 bp, Mus musculus
caaaggcgagcagggtcctcctggg

SEQ ID NO: 217272 - DNA, 25 bp, Mus musculus
caaaggctaaaggtctgtacacatg

SEQ ID NO: 217273 - DNA, 25 bp, Mus musculus
caaaggctatagggtcggtgatgga

SEQ ID NO: 217274 - DNA, 25 bp, Mus musculus
caaaggctcatcagatgtaaacaga

SEQ ID NO: 217275 - DNA, 25 bp, Mus musculus
caaaggctccgagcaaggccgtgca

SEQ ID NO: 217276 - DNA, 25 bp, Mus musculus
caaaggctctccaggcagtgctttt

SEQ ID NO: 217277 - DNA, 25 bp, Mus musculus
caaaggctctccaggtagcctttcc

SEQ ID NO: 217278 - DNA, 25 bp, Mus musculus
caaaggctctccaggtttgtgtaag

SEQ ID NO: 217279 - DNA, 25 bp, Mus musculus
caaaggctctccgggttcaatagga

SEQ ID NO: 217280 - DNA, 25 bp, Mus musculus
caaaggctgcagaacatgaagttcc

SEQ ID NO: 217281 - DNA, 25 bp, Mus musculus
caaaggctgcagatgcagccggtgg

SEQ ID NO: 217282 - DNA, 25 bp, Mus musculus
caaaggctgcagctcttaaccggct

SEQ ID NO: 217283 - DNA, 25 bp, Mus musculus
caaaggctgtctcaggtggcccctg

SEQ ID NO: 217284 - DNA, 25 bp, Mus musculus
caaaggcttacccaggtttggcata

SEQ ID NO: 217285 - DNA, 25 bp, Mus musculus
caaaggcttcaaagattacatgaaa

SEQ ID NO: 217286 - DNA, 25 bp, Mus musculus
caaaggcttcaaagttgcacctgct

SEQ ID NO: 217287 - DNA, 25 bp, Mus musculus
caaaggcttgctcaggtagctaaag

SEQ ID NO: 217288 - DNA, 25 bp, Mus musculus
caaaggctttaagctctggtgcaag

SEQ ID NO: 217289 - DNA, 25 bp, Mus musculus
caaaggcttttggggcaggggctga

SEQ ID NO: 217290 - DNA, 25 bp, Mus musculus
caaaggcttttggggctgactttgt

SEQ ID NO: 217291 - DNA, 25 bp, Mus musculus
caaagggaaggaaaacgcttgtgca

SEQ ID NO: 217292 - DNA, 25 bp, Mus musculus
caaagggaagggctccacctgtgcc

SEQ ID NO: 217293 - DNA, 25 bp, Mus musculus
caaagggacgctgtgctttcatgga

SEQ ID NO: 217294 - DNA, 25 bp, Mus musculus
caaagggatggttcaggctgtgcga

SEQ ID NO: 217295 - DNA, 25 bp, Mus musculus
caaagggatttctggacttggcagt

SEQ ID NO: 217296 - DNA, 25 bp, Mus musculus
caaagggcaagaccaaaaacctcat

SEQ ID NO: 217297 - DNA, 25 bp, Mus musculus
caaagggcaagcttctactcagacc

SEQ ID NO: 217298 - DNA, 25 bp, Mus musculus
caaagggcacaggctcgtcccctga

SEQ ID NO: 217299 - DNA, 25 bp, Mus musculus
caaagggcctagcagagctcctcag

SEQ ID NO: 217300 - DNA, 25 bp, Mus musculus
caaagggcctagcgccagccagagc

SEQ ID NO: 217301 - DNA, 25 bp, Mus musculus
caaaggggaagttccaggatccaga

SEQ ID NO: 217302 - DNA, 25 bp, Mus musculus
caaagggtgttgtagcatcttggtt

SEQ ID NO: 217303 - DNA, 25 bp, Mus musculus
caaagggtgttgtagctgctcctca

SEQ ID NO: 217304 - DNA, 25 bp, Mus musculus
caaaggtaccagtggctacctccct

SEQ ID NO: 217305 - DNA, 25 bp, Mus musculus
caaaggtcagaaagcctctccgacc

SEQ ID NO: 217306 - DNA, 25 bp, Mus musculus
caaaggtcaggcgggtgaacctggc

SEQ ID NO: 217307 - DNA, 25 bp, Mus musculus
caaaggtcatataagtgacattgaa

SEQ ID NO: 217308 - DNA, 25 bp, Mus musculus
caaaggtcatataatgtcatatttg

SEQ ID NO: 217309 - DNA, 25 bp, Mus musculus
caaaggtgaaattggaactcctggc

SEQ ID NO: 217310 - DNA, 25 bp, Mus musculus
caaaggtgccaacatctatttcaag

SEQ ID NO: 217311 - DNA, 25 bp, Mus musculus
caaaggtgccaacggcgagcctggc

SEQ ID NO: 217312 - DNA, 25 bp, Mus musculus
caaaggtggcgggcgagaactttgg

SEQ ID NO: 217313 - DNA, 25 bp, Mus musculus
caaaggtgtgccccagctcctggca

SEQ ID NO: 217314 - DNA, 25 bp, Mus musculus
caaaggttgtccggtccttcagacc

SEQ ID NO: 217315 - DNA, 25 bp, Mus musculus
caaaggtttcaagaattggaggcca

SEQ ID NO: 217316 - DNA, 25 bp, Mus musculus
caaaggtttggcttctccagttggc

SEQ ID NO: 217317 - DNA, 25 bp, Mus musculus
caaagtaaacaaacatggaagatgg

SEQ ID NO: 217318 - DNA, 25 bp, Mus musculus
caaagtaaacattttctatttaaat

SEQ ID NO: 217319 - DNA, 25 bp, Mus musculus
caaagtaatatctccatctctgttc

SEQ ID NO: 217320 - DNA, 25 bp, Mus musculus
caaagtacagcagggcttcctgaaa

SEQ ID NO: 217321 - DNA, 25 bp, Mus musculus
caaagtacaggtgttgctggaggaa

SEQ ID NO: 217322 - DNA, 25 bp, Mus musculus
caaagtaccaatacacgagaccagc

SEQ ID NO: 217323 - DNA, 25 bp, Mus musculus
caaagtaccaggaaaggacacagtt

SEQ ID NO: 217324 - DNA, 25 bp, Mus musculus
caaagtacgcaagatgaacactacc

SEQ ID NO: 217325 - DNA, 25 bp, Mus musculus
caaagtagaaggttacatccaggca

SEQ ID NO: 217326 - DNA, 25 bp, Mus musculus
caaagtagctcaaccgaagaacctt

SEQ ID NO: 217327 - DNA, 25 bp, Mus musculus
caaagtatgatgatataagcttacc

SEQ ID NO: 217328 - DNA, 25 bp, Mus musculus
caaagtattccaggctctgtgcaag

SEQ ID NO: 217329 - DNA, 25 bp, Mus musculus
caaagtcaaaggtggcagggctgag

SEQ ID NO: 217330 - DNA, 25 bp, Mus musculus
caaagtcaagaaaaaacaagaaggg

SEQ ID NO: 217331 - DNA, 25 bp, Mus musculus
caaagtcaagatctcaaaatgttga

SEQ ID NO: 217332 - DNA, 25 bp, Mus musculus
caaagtcaaggctctacccctggtc

SEQ ID NO: 217333 - DNA, 25 bp, Mus musculus
caaagtcaaggtgtatgagatggaa

SEQ ID NO: 217334 - DNA, 25 bp, Mus musculus
caaagtcagaagggcatcctggccc

SEQ ID NO: 217335 - DNA, 25 bp, Mus musculus
caaagtcagagaagtcctgcatgtc

SEQ ID NO: 217336 - DNA, 25 bp, Mus musculus
caaagtcagatactccatatcatag

SEQ ID NO: 217337 - DNA, 25 bp, Mus musculus
caaagtcagtcgaaacgttgaaagt

SEQ ID NO: 217338 - DNA, 25 bp, Mus musculus
caaagtcagtgaacttctgggtcaa

SEQ ID NO: 217339 - DNA, 25 bp, Mus musculus
caaagtcattcttgatattccagaa

SEQ ID NO: 217340 - DNA, 25 bp, Mus musculus
caaagtcattgttgatattccagaa

SEQ ID NO: 217341 - DNA, 25 bp, Mus musculus
caaagtccaagaactgatgtctact

SEQ ID NO: 217342 - DNA, 25 bp, Mus musculus
caaagtccaagattgcgctggctcc

SEQ ID NO: 217343 - DNA, 25 bp, Mus musculus
caaagtccaggatgttgtaccacaa

SEQ ID NO: 217344 - DNA, 25 bp, Mus musculus
caaagtcccagacagcagctgcagt

SEQ ID NO: 217345 - DNA, 25 bp, Mus musculus
caaagtcccagacagcttgcttgcc

SEQ ID NO: 217346 - DNA, 25 bp, Mus musculus
caaagtccctcacacacctgcacgt

SEQ ID NO: 217347 - DNA, 25 bp, Mus musculus
caaagtcgccaaggtgaccccaggc

SEQ ID NO: 217348 - DNA, 25 bp, Mus musculus
caaagtcttgtaatttgaactgtga

SEQ ID NO: 217349 - DNA, 25 bp, Mus musculus
caaagtgaaaaagtactgtctgatg

SEQ ID NO: 217350 - DNA, 25 bp, Mus musculus
caaagtgaaagttaatgaaatcatc

SEQ ID NO: 217351 - DNA, 25 bp, Mus musculus
caaagtgaagccgaagaagctgacc

SEQ ID NO: 217352 - DNA, 25 bp, Mus musculus
caaagtgaagtgctcaggagctgtc

SEQ ID NO: 217353 - DNA, 25 bp, Mus musculus
caaagtgaatgtactctattcttca

SEQ ID NO: 217354 - DNA, 25 bp, Mus musculus
caaagtgagaggttcagacagtaac

SEQ ID NO: 217355 - DNA, 25 bp, Mus musculus
caaagtgatagaaaagcttggcttt

SEQ ID NO: 217356 - DNA, 25 bp, Mus musculus
caaagtgatagtggcaatccagatc

SEQ ID NO: 217357 - DNA, 25 bp, Mus musculus
caaagtgatcctatcccatcaccct

SEQ ID NO: 217358 - DNA, 25 bp, Mus musculus
caaagtgcagagatccgtggacagc

SEQ ID NO: 217359 - DNA, 25 bp, Mus musculus
caaagtgcagaggattcctacgagg

SEQ ID NO: 217360 - DNA, 25 bp, Mus musculus
caaagtgcagaggttcaaggcaaca

SEQ ID NO: 217361 - DNA, 25 bp, Mus musculus
caaagtgcgatgcgctgttcctggg

SEQ ID NO: 217362 - DNA, 25 bp, Mus musculus
caaagtgcgatgcgtcgtcccccag

SEQ ID NO: 217363 - DNA, 25 bp, Mus musculus
caaagtgcgcgacaggctgtttggt

SEQ ID NO: 217364 - DNA, 25 bp, Mus musculus
caaagtgcgcgacaggttctggatg

SEQ ID NO: 217365 - DNA, 25 bp, Mus musculus
caaagtgctcaggaagtctaaagct

SEQ ID NO: 217366 - DNA, 25 bp, Mus musculus
caaagtgctgaggctgcctgctgtc

SEQ ID NO: 217367 - DNA, 25 bp, Mus musculus
caaagtgctgatggagtttgtggaa

SEQ ID NO: 217368 - DNA, 25 bp, Mus musculus
caaagtggacagtcccaccgtcaca

SEQ ID NO: 217369 - DNA, 25 bp, Mus musculus
caaagtggagaataagcgtgaagtg

SEQ ID NO: 217370 - DNA, 25 bp, Mus musculus
caaagtggagaataagtggtacagg

SEQ ID NO: 217371 - DNA, 25 bp, Mus musculus
caaagtggcaggccgcatccacgcc

SEQ ID NO: 217372 - DNA, 25 bp, Mus musculus
caaagtggccaggagcttgcaagtg

SEQ ID NO: 217373 - DNA, 25 bp, Mus musculus
caaagtgggggatcctgcagaggac

SEQ ID NO: 217374 - DNA, 25 bp, Mus musculus
caaagtggtggaggggatcctggac

SEQ ID NO: 217375 - DNA, 25 bp, Mus musculus
caaagtgtccgtcgatgaccatgta

SEQ ID NO: 217376 - DNA, 25 bp, Mus musculus
caaagtgtccgtcgtgaaccccaca

SEQ ID NO: 217377 - DNA, 25 bp, Mus musculus
caaagtgtccgtggatgaccatgta

SEQ ID NO: 217378 - DNA, 25 bp, Mus musculus
caaagtgtccgtggtgaaccccaca

SEQ ID NO: 217379 - DNA, 25 bp, Mus musculus
caaagtgtctcagaatgcaaagtat

SEQ ID NO: 217380 - DNA, 25 bp, Mus musculus
caaagtgtctcagccttcgtagtgc

SEQ ID NO: 217381 - DNA, 25 bp, Mus musculus
caaagtgtctgcttttcagaaaggc

SEQ ID NO: 217382 - DNA, 25 bp, Mus musculus
caaagtgttggacagattgtaggtg

SEQ ID NO: 217383 - DNA, 25 bp, Mus musculus
caaagttaaaaacagcctcaccatt

SEQ ID NO: 217384 - DNA, 25 bp, Mus musculus
caaagttaaaaatcgcctcaccatt

SEQ ID NO: 217385 - DNA, 25 bp, Mus musculus
caaagttaacccacagacaaggaat

SEQ ID NO: 217386 - DNA, 25 bp, Mus musculus
caaagttagcttgaacatcacaagt

SEQ ID NO: 217387 - DNA, 25 bp, Mus musculus
caaagttcagagtgcagagagcagt

SEQ ID NO: 217388 - DNA, 25 bp, Mus musculus
caaagttcagccctgaaaagtccca

SEQ ID NO: 217389 - DNA, 25 bp, Mus musculus
caaagttcagccctgagaagagcct

SEQ ID NO: 217390 - DNA, 25 bp, Mus musculus
caaagttcatggagtcgctggggag

SEQ ID NO: 217391 - DNA, 25 bp, Mus musculus
caaagttcatgggtgtttgccagct

SEQ ID NO: 217392 - DNA, 25 bp, Mus musculus
caaagttcccctggcctggggaaga

SEQ ID NO: 217393 - DNA, 25 bp, Mus musculus
caaagttgaaacaagggggagaagc

SEQ ID NO: 217394 - DNA, 25 bp, Mus musculus
caaagttgcagatactcagcctcag

SEQ ID NO: 217395 - DNA, 25 bp, Mus musculus
caaagtttcatccagggtcacaaac

SEQ ID NO: 217396 - DNA, 25 bp, Mus musculus
caaagtttgagagtggatgtaaagc

SEQ ID NO: 217397 - DNA, 25 bp, Mus musculus
caaagtttggaggccacctatgaaa

SEQ ID NO: 217398 - DNA, 25 bp, Mus musculus
caaagtttggagtttgttgaaggat

SEQ ID NO: 217399 - DNA, 25 bp, Mus musculus
caaagtttgggggagcattctctga

SEQ ID NO: 217400 - DNA, 25 bp, Mus musculus
caaataaaaaaattcatctacaggc

SEQ ID NO: 217401 - DNA, 25 bp, Mus musculus
caaataaaaactcaggtcctttgca

SEQ ID NO: 217402 - DNA, 25 bp, Mus musculus
caaataaaaaggtgcttgagcaggc

SEQ ID NO: 217403 - DNA, 25 bp, Mus musculus
caaataaaacaggtggcttcggtgc

SEQ ID NO: 217404 - DNA, 25 bp, Mus musculus
caaataaaacaggttcgggagcagc

SEQ ID NO: 217405 - DNA, 25 bp, Mus musculus
caaataactgggctgttttacctct

SEQ ID NO: 217406 - DNA, 25 bp, Mus musculus
caaataagaatgaagagcatggctc

SEQ ID NO: 217407 - DNA, 25 bp, Mus musculus
caaataatcagagctgagggaataa

SEQ ID NO: 217408 - DNA, 25 bp, Mus musculus
caaataatcagaggtatgccttcat

SEQ ID NO: 217409 - DNA, 25 bp, Mus musculus
caaataatgttgaaggaagccaaaa

SEQ ID NO: 217410 - DNA, 25 bp, Mus musculus
caaatacaacttcaggtgaaaattt

SEQ ID NO: 217411 - DNA, 25 bp, Mus musculus
caaatacaatgacccctgacaagct

SEQ ID NO: 217412 - DNA, 25 bp, Mus musculus
caaatacaatgccctcaagacccct

SEQ ID NO: 217413 - DNA, 25 bp, Mus musculus
caaatacacgccttccttcaggcaa

SEQ ID NO: 217414 - DNA, 25 bp, Mus musculus
caaatacacgctgatgttcctctgc

SEQ ID NO: 217415 - DNA, 25 bp, Mus musculus
caaatacattcaggaagccgaaatg

SEQ ID NO: 217416 - DNA, 25 bp, Mus musculus
caaataccggggtgaacctggagag

SEQ ID NO: 217417 - DNA, 25 bp, Mus musculus
caaataccgtaggtggtcaactatt

SEQ ID NO: 217418 - DNA, 25 bp, Mus musculus
caaatacctctcaaaaatagtgatc

SEQ ID NO: 217419 - DNA, 25 bp, Mus musculus
caaatacggtacccatgtgaaagcc

SEQ ID NO: 217420 - DNA, 25 bp, Mus musculus
caaatactgagctgactaagcccca

SEQ ID NO: 217421 - DNA, 25 bp, Mus musculus
caaatactgcttcaacttctcttgc

SEQ ID NO: 217422 - DNA, 25 bp, Mus musculus
caaatactggaattacaggctgacc

SEQ ID NO: 217423 - DNA, 25 bp, Mus musculus
caaatacttaacgtctcattcttgc

SEQ ID NO: 217424 - DNA, 25 bp, Mus musculus
caaatacttcttcatccacatctac

SEQ ID NO: 217425 - DNA, 25 bp, Mus musculus
caaatactttgctgccttctgatag

SEQ ID NO: 217426 - DNA, 25 bp, Mus musculus
caaatactttgttgaaccaagactc

SEQ ID NO: 217427 - DNA, 25 bp, Mus musculus
caaatagcagattttggagtaagcg

SEQ ID NO: 217428 - DNA, 25 bp, Mus musculus
caaatagctcctaggttgggagtct

SEQ ID NO: 217429 - DNA, 25 bp, Mus musculus
caaatagctcctatacctgactgtc

SEQ ID NO: 217430 - DNA, 25 bp, Mus musculus
caaatagtacaggcagtgggaactc

SEQ ID NO: 217431 - DNA, 25 bp, Mus musculus
caaatagtgaaagtcctcaggactc

SEQ ID NO: 217432 - DNA, 25 bp, Mus musculus
caaatatacaaggctcaaactcaga

SEQ ID NO: 217433 - DNA, 25 bp, Mus musculus
caaatatcagaggccacctatgaaa

SEQ ID NO: 217434 - DNA, 25 bp, Mus musculus
caaatatgaggagcaccagctagcc

SEQ ID NO: 217435 - DNA, 25 bp, Mus musculus
caaatatggttttgctgtacagaga

SEQ ID NO: 217436 - DNA, 25 bp, Mus musculus
caaatatgtggggatgatccttagt

SEQ ID NO: 217437 - DNA, 25 bp, Mus musculus
caaatatgtggggtacgatctttgc

SEQ ID NO: 217438 - DNA, 25 bp, Mus musculus
caaatattacatgggtcattcacat

SEQ ID NO: 217439 - DNA, 25 bp, Mus musculus
caaatattctcccagagatcttcaa

SEQ ID NO: 217440 - DNA, 25 bp, Mus musculus
caaatcaaaaggtgtgatccttgca

SEQ ID NO: 217441 - DNA, 25 bp, Mus musculus
caaatcaagatgtcattaaagcgat

SEQ ID NO: 217442 - DNA, 25 bp, Mus musculus
caaatcaagcagaaaatgagtccac

SEQ ID NO: 217443 - DNA, 25 bp, Mus musculus
caaatcacaggcatatgctatgatg

SEQ ID NO: 217444 - DNA, 25 bp, Mus musculus
caaatcacatgatggagcctcaagg

SEQ ID NO: 217445 - DNA, 25 bp, Mus musculus
caaatcaccgcactgattttggctc

SEQ ID NO: 217446 - DNA, 25 bp, Mus musculus
caaatcaccgcactgcttcaggacc

SEQ ID NO: 217447 - DNA, 25 bp, Mus musculus
caaatcagaatgagttgcaagcaca

SEQ ID NO: 217448 - DNA, 25 bp, Mus musculus
caaatcatagaggacattaaggacg

SEQ ID NO: 217449 - DNA, 25 bp, Mus musculus
caaatccaagtgggtattccatgtc

SEQ ID NO: 217450 - DNA, 25 bp, Mus musculus
caaatccacccgagaagacagcatg

SEQ ID NO: 217451 - DNA, 25 bp, Mus musculus
caaatccacccgagcactgtctatg

SEQ ID NO: 217452 - DNA, 25 bp, Mus musculus
caaatccaccgcggagatggatggc

SEQ ID NO: 217453 - DNA, 25 bp, Mus musculus
caaatccaccgcgggaccttctgtc

SEQ ID NO: 217454 - DNA, 25 bp, Mus musculus
caaatccagaattgattacaacaac

SEQ ID NO: 217455 - DNA, 25 bp, Mus musculus
caaatccagaggatctctctcaaca

SEQ ID NO: 217456 - DNA, 25 bp, Mus musculus
caaatccagaggtgaaaatccaggg

SEQ ID NO: 217457 - DNA, 25 bp, Mus musculus
caaatcccaagttccgtgaggagga

SEQ ID NO: 217458 - DNA, 25 bp, Mus musculus
caaatcccaggagcaagtgtcgttc

SEQ ID NO: 217459 - DNA, 25 bp, Mus musculus
caaatcccagttgtaggccatcgtt

SEQ ID NO: 217460 - DNA, 25 bp, Mus musculus
caaatccccagtgaatggaactccc

SEQ ID NO: 217461 - DNA, 25 bp, Mus musculus
caaatcctagagagcctttccacgt

SEQ ID NO: 217462 - DNA, 25 bp, Mus musculus
caaatcctccttcagctgataatac

SEQ ID NO: 217463 - DNA, 25 bp, Mus musculus
caaatcctgcaccaggaagagttgg

SEQ ID NO: 217464 - DNA, 25 bp, Mus musculus
caaatccttcctgaaacttcatggc

SEQ ID NO: 217465 - DNA, 25 bp, Mus musculus
caaatccttcgcgtctcagaataac

SEQ ID NO: 217466 - DNA, 25 bp, Mus musculus
caaatcgattcaaggatcgcattgt

SEQ ID NO: 217467 - DNA, 25 bp, Mus musculus
caaatcggggcggtgtgaatgacag

SEQ ID NO: 217468 - DNA, 25 bp, Mus musculus
caaatctaaactgacccccgtcaga

SEQ ID NO: 217469 - DNA, 25 bp, Mus musculus
caaatctaaactggatcgaagtaaa

SEQ ID NO: 217470 - DNA, 25 bp, Mus musculus
caaatctatcaaaggtgatttcaat

SEQ ID NO: 217471 - DNA, 25 bp, Mus musculus
caaatctattacaggtgaatacatt

SEQ ID NO: 217472 - DNA, 25 bp, Mus musculus
caaatctcagagccccaaggacgat

SEQ ID NO: 217473 - DNA, 25 bp, Mus musculus
caaatctgatagggaaaacatcaga

SEQ ID NO: 217474 - DNA, 25 bp, Mus musculus
caaatctgcagatctcataggatgg

SEQ ID NO: 217475 - DNA, 25 bp, Mus musculus
caaatctgcagatgtgaatcctaaa

SEQ ID NO: 217476 - DNA, 25 bp, Mus musculus
caaatctgtcaggtatacagatatg

SEQ ID NO: 217477 - DNA, 25 bp, Mus musculus
caaatcttacaggaggccacatggt

SEQ ID NO: 217478 - DNA, 25 bp, Mus musculus
caaatcttctcagatcatagcagaa

SEQ ID NO: 217479 - DNA, 25 bp, Mus musculus
caaatgaaattggacaggtccttca

SEQ ID NO: 217480 - DNA, 25 bp, Mus musculus
caaatgaacaagctgagtatgagtt

SEQ ID NO: 217481 - DNA, 25 bp, Mus musculus
caaatgaacagctctggagtgcaca

SEQ ID NO: 217482 - DNA, 25 bp, Mus musculus
caaatgaacaggcaccacgccccac

SEQ ID NO: 217483 - DNA, 25 bp, Mus musculus
caaatgaacaggcctattcctggcc

SEQ ID NO: 217484 - DNA, 25 bp, Mus musculus
caaatgaacaggtgtgcggaccaaa

SEQ ID NO: 217485 - DNA, 25 bp, Mus musculus
caaatgaactaactacttgatgaaa

SEQ ID NO: 217486 - DNA, 25 bp, Mus musculus
caaatgaactgggaaactagaacaa

SEQ ID NO: 217487 - DNA, 25 bp, Mus musculus
caaatgaaggaggaattttattgag

SEQ ID NO: 217488 - DNA, 25 bp, Mus musculus
caaatgaaggaggcaagtcttctgg

SEQ ID NO: 217489 - DNA, 25 bp, Mus musculus
caaatgacaatgaagaaaggaagtg

SEQ ID NO: 217490 - DNA, 25 bp, Mus musculus
caaatgaccactgagattccagtgc

SEQ ID NO: 217491 - DNA, 25 bp, Mus musculus
caaatgaccagagaacttcacctcc

SEQ ID NO: 217492 - DNA, 25 bp, Mus musculus
caaatgactaagtacctacagtcca

SEQ ID NO: 217493 - DNA, 25 bp, Mus musculus
caaatgactaagttacagtgctagc

SEQ ID NO: 217494 - DNA, 25 bp, Mus musculus
caaatgattcggatatcaggatagt

SEQ ID NO: 217495 - DNA, 25 bp, Mus musculus
caaatgattcgtccaaggcggttgg

SEQ ID NO: 217496 - DNA, 25 bp, Mus musculus
caaatgcacccaaattaaaacggcg

SEQ ID NO: 217497 - DNA, 25 bp, Mus musculus
caaatgcccagctcctaacctcgag

SEQ ID NO: 217498 - DNA, 25 bp, Mus musculus
caaatgcgaagggtatgtcggagac

SEQ ID NO: 217499 - DNA, 25 bp, Mus musculus
caaatgcgaagtgtgcaagtatgtt

SEQ ID NO: 217500 - DNA, 25 bp, Mus musculus
caaatgcgttcacagagtgcaaatt

SEQ ID NO: 217501 - DNA, 25 bp, Mus musculus
caaatgctggaccctcccaggccca

SEQ ID NO: 217502 - DNA, 25 bp, Mus musculus
caaatggaaggaaacttcatggctc

SEQ ID NO: 217503 - DNA, 25 bp, Mus musculus
caaatggagatataatcatgtgtgc

SEQ ID NO: 217504 - DNA, 25 bp, Mus musculus
caaatggaggaaaggttacagcagg

SEQ ID NO: 217505 - DNA, 25 bp, Mus musculus
caaatggatccttgctaatttgaaa

SEQ ID NO: 217506 - DNA, 25 bp, Mus musculus
caaatggcagaggtcacttttgtcc

SEQ ID NO: 217507 - DNA, 25 bp, Mus musculus
caaatggcagtatatatgttttgta

SEQ ID NO: 217508 - DNA, 25 bp, Mus musculus
caaatggccatgataacagctatct

SEQ ID NO: 217509 - DNA, 25 bp, Mus musculus
caaatgggacaggagacaattacaa

SEQ ID NO: 217510 - DNA, 25 bp, Mus musculus
caaatgggacaggagtgtctcttct

SEQ ID NO: 217511 - DNA, 25 bp, Mus musculus
caaatgggacctcacctacccaaag

SEQ ID NO: 217512 - DNA, 25 bp, Mus musculus
caaatgggacctcagagtaatataa

SEQ ID NO: 217513 - DNA, 25 bp, Mus musculus
caaatgggaggaggcacttgaatat

SEQ ID NO: 217514 - DNA, 25 bp, Mus musculus
caaatgggaggtgtgtcagaaatca

SEQ ID NO: 217515 - DNA, 25 bp, Mus musculus
caaatggtttgcgtttgcagtatga

SEQ ID NO: 217516 - DNA, 25 bp, Mus musculus
caaatgtaaggcaaatgaccatgga

SEQ ID NO: 217517 - DNA, 25 bp, Mus musculus
caaatgtacagagaaatttgtatga

SEQ ID NO: 217518 - DNA, 25 bp, Mus musculus
caaatgtacaggagctgaagttcct

SEQ ID NO: 217519 - DNA, 25 bp, Mus musculus
caaatgtcaaagctggcaagatgtc

SEQ ID NO: 217520 - DNA, 25 bp, Mus musculus
caaatgtcaaaggatgaccttgatc

SEQ ID NO: 217521 - DNA, 25 bp, Mus musculus
caaatgtcagaaagagtctactgta

SEQ ID NO: 217522 - DNA, 25 bp, Mus musculus
caaatgtcagaaagtgtctactgta

SEQ ID NO: 217523 - DNA, 25 bp, Mus musculus
caaatgtcagccatgcaagtgcaat

SEQ ID NO: 217524 - DNA, 25 bp, Mus musculus
caaatgtcccaggccgctagtcaga

SEQ ID NO: 217525 - DNA, 25 bp, Mus musculus
caaatgtcccagggcggcaatctgc

SEQ ID NO: 217526 - DNA, 25 bp, Mus musculus
caaatgtgaaaaagtattcaaacat

SEQ ID NO: 217527 - DNA, 25 bp, Mus musculus
caaatgtgaaacgctaccattgtgg

SEQ ID NO: 217528 - DNA, 25 bp, Mus musculus
caaatgtgaaaggctaccttggacc

SEQ ID NO: 217529 - DNA, 25 bp, Mus musculus
caaatgtgaaaggctggcacagaag

SEQ ID NO: 217530 - DNA, 25 bp, Mus musculus
caaatgtgagaatgaaactttgcta

SEQ ID NO: 217531 - DNA, 25 bp, Mus musculus
caaatgtgagttgtctgttgatgga

SEQ ID NO: 217532 - DNA, 25 bp, Mus musculus
caaatgtgatgcatgtggcatgaac

SEQ ID NO: 217533 - DNA, 25 bp, Mus musculus
caaatgtgttcaagaacaaggttgg

SEQ ID NO: 217534 - DNA, 25 bp, Mus musculus
caaatgttacaggcatcaaaaagtt

SEQ ID NO: 217535 - DNA, 25 bp, Mus musculus
caaatgttacaggtcatggaaaatg

SEQ ID NO: 217536 - DNA, 25 bp, Mus musculus
caaatgttgggcgaagatctgcaag

SEQ ID NO: 217537 - DNA, 25 bp, Mus musculus
caaatgttgggcgtgtgcatgtagc

SEQ ID NO: 217538 - DNA, 25 bp, Mus musculus
caaatgttgtggcagaataccagag

SEQ ID NO: 217539 - DNA, 25 bp, Mus musculus
caaatgttgtgtcctctgttgtgca

SEQ ID NO: 217540 - DNA, 25 bp, Mus musculus
caaatgtttggtcaatttggtaaaa

SEQ ID NO: 217541 - DNA, 25 bp, Mus musculus
caaattaaaaatgatgtcttcattt

SEQ ID NO: 217542 - DNA, 25 bp, Mus musculus
caaattaaagaagtataataagccc

SEQ ID NO: 217543 - DNA, 25 bp, Mus musculus
caaattaaatgccttgatgggaacc

SEQ ID NO: 217544 - DNA, 25 bp, Mus musculus
caaattaacagagtgtccaagcacg

SEQ ID NO: 217545 - DNA, 25 bp, Mus musculus
caaattaatgacaagaacggagagc

SEQ ID NO: 217546 - DNA, 25 bp, Mus musculus
caaattaatgagtacaaggagtgct

SEQ ID NO: 217547 - DNA, 25 bp, Mus musculus
caaattaatgtggatgatcttttca

SEQ ID NO: 217548 - DNA, 25 bp, Mus musculus
caaattacctgagcacccagttgat

SEQ ID NO: 217549 - DNA, 25 bp, Mus musculus
caaattagtgcaggaaaacccaacc

SEQ ID NO: 217550 - DNA, 25 bp, Mus musculus
caaattcaagtgctaaactgaaata

SEQ ID NO: 217551 - DNA, 25 bp, Mus musculus
caaattcacattcaggcacaccaag

SEQ ID NO: 217552 - DNA, 25 bp, Mus musculus
caaattcactgctttctgtgagact

SEQ ID NO: 217553 - DNA, 25 bp, Mus musculus
caaattcactgtatataaaatccta

SEQ ID NO: 217554 - DNA, 25 bp, Mus musculus
caaattccaagcaattttcaacatg

SEQ ID NO: 217555 - DNA, 25 bp, Mus musculus
caaattccaccccggccccagctgg

SEQ ID NO: 217556 - DNA, 25 bp, Mus musculus
caaattcccaggtgaagcctttgat

SEQ ID NO: 217557 - DNA, 25 bp, Mus musculus
caaattcccatctcatttgaaaatg

SEQ ID NO: 217558 - DNA, 25 bp, Mus musculus
caaattccttcaggtgcacgcctcc

SEQ ID NO: 217559 - DNA, 25 bp, Mus musculus
caaattcttcaacgagcgggctgag

SEQ ID NO: 217560 - DNA, 25 bp, Mus musculus
caaattgaaactggaagcatatatt

SEQ ID NO: 217561 - DNA, 25 bp, Mus musculus
caaattgaagctggaaagcaaagat

SEQ ID NO: 217562 - DNA, 25 bp, Mus musculus
caaattgaagctgggtgttgaccag

SEQ ID NO: 217563 - DNA, 25 bp, Mus musculus
caaattgacaaccaatatcagtctc

SEQ ID NO: 217564 - DNA, 25 bp, Mus musculus
caaattgacaaccagacacgcataa

SEQ ID NO: 217565 - DNA, 25 bp, Mus musculus
caaattgacaggtagctacatcaag

SEQ ID NO: 217566 - DNA, 25 bp, Mus musculus
caaattgagcaggccgcttggacat

SEQ ID NO: 217567 - DNA, 25 bp, Mus musculus
caaattgctttccagagacttcctg

SEQ ID NO: 217568 - DNA, 25 bp, Mus musculus
caaattggctgagctccccttggct

SEQ ID NO: 217569 - DNA, 25 bp, Mus musculus
caaatttacagagcagcatggccca

SEQ ID NO: 217570 - DNA, 25 bp, Mus musculus
caaatttatctgaggtgagaagtct

SEQ ID NO: 217571 - DNA, 25 bp, Mus musculus
caaatttcatggctacctctgtcgc

SEQ ID NO: 217572 - DNA, 25 bp, Mus musculus
caaatttccagaaatcaacactatt

SEQ ID NO: 217573 - DNA, 25 bp, Mus musculus
caaatttccagggctatgtgcttca

SEQ ID NO: 217574 - DNA, 25 bp, Mus musculus
caaatttctggagcctatcttccag

SEQ ID NO: 217575 - DNA, 25 bp, Mus musculus
caaatttgcaccccaggggtggctc

SEQ ID NO: 217576 - DNA, 25 bp, Mus musculus
caaatttgtcaaagaactactatcc

SEQ ID NO: 217577 - DNA, 25 bp, Mus musculus
caacaaaaaaagctccgactgattg

SEQ ID NO: 217578 - DNA, 25 bp, Mus musculus
caacaaaaaagacaggtgttcacaa

SEQ ID NO: 217579 - DNA, 25 bp, Mus musculus
caacaaaaatggctcaaactcagaa

SEQ ID NO: 217580 - DNA, 25 bp, Mus musculus
caacaaaacctttggtagatgccag

SEQ ID NO: 217581 - DNA, 25 bp, Mus musculus
caacaaaactcagggaccaagagcc

SEQ ID NO: 217582 - DNA, 25 bp, Mus musculus
caacaaacaattcctccatctgcta

SEQ ID NO: 217583 - DNA, 25 bp, Mus musculus
caacaaacagactaaagactatgct

SEQ ID NO: 217584 - DNA, 25 bp, Mus musculus
caacaaacgaacaagactctgacac

SEQ ID NO: 217585 - DNA, 25 bp, Mus musculus
caacaaacgaacaagcaggttcagg

SEQ ID NO: 217586 - DNA, 25 bp, Mus musculus
caacaaacgaacaatagtagaaaat

SEQ ID NO: 217587 - DNA, 25 bp, Mus musculus
caacaaactaattatagtcctattg

SEQ ID NO: 217588 - DNA, 25 bp, Mus musculus
caacaaagaagctcttagcccccca

SEQ ID NO: 217589 - DNA, 25 bp, Mus musculus
caacaaagaggaagcctgcactttc

SEQ ID NO: 217590 - DNA, 25 bp, Mus musculus
caacaaaggagctgacaaaccaagt

SEQ ID NO: 217591 - DNA, 25 bp, Mus musculus
caacaaaggatccagatgcagaact

SEQ ID NO: 217592 - DNA, 25 bp, Mus musculus
caacaaaggatccagtttatttata

SEQ ID NO: 217593 - DNA, 25 bp, Mus musculus
caacaaaggtggcgggcgagaactt

SEQ ID NO: 217594 - DNA, 25 bp, Mus musculus
caacaaagtgcgatgcgctgttcct

SEQ ID NO: 217595 - DNA, 25 bp, Mus musculus
caacaaagtgcgatgcgtcgtcccc

SEQ ID NO: 217596 - DNA, 25 bp, Mus musculus
caacaaatgtacagagaaatttgta

SEQ ID NO: 217597 - DNA, 25 bp, Mus musculus
caacaaatgtacaggagctgaagtt

SEQ ID NO: 217598 - DNA, 25 bp, Mus musculus
caacaacaaaaatggctcaaactca

SEQ ID NO: 217599 - DNA, 25 bp, Mus musculus
caacaacaagcatcaccctaccagg

SEQ ID NO: 217600 - DNA, 25 bp, Mus musculus
caacaacaaggagcactttagtgaa

SEQ ID NO: 217601 - DNA, 25 bp, Mus musculus
caacaacaagggaagtactccgcat

SEQ ID NO: 217602 - DNA, 25 bp, Mus musculus
caacaacaagggagctcactcagtg

SEQ ID NO: 217603 - DNA, 25 bp, Mus musculus
caacaacaatgagagtgctgcaaag

SEQ ID NO: 217604 - DNA, 25 bp, Mus musculus
caacaacactgaaaggggcatctga

SEQ ID NO: 217605 - DNA, 25 bp, Mus musculus
caacaacactgacaggggcatctga

SEQ ID NO: 217606 - DNA, 25 bp, Mus musculus
caacaacagaaatgtgaaaaactca

SEQ ID NO: 217607 - DNA, 25 bp, Mus musculus
caacaacatcaaagaaaaattcaac

SEQ ID NO: 217608 - DNA, 25 bp, Mus musculus
caacaacatcatgaacaacgtgggc

SEQ ID NO: 217609 - DNA, 25 bp, Mus musculus
caacaaccaggtagctaagtgggac

SEQ ID NO: 217610 - DNA, 25 bp, Mus musculus
caacaaccctctgggacaggtattc

SEQ ID NO: 217611 - DNA, 25 bp, Mus musculus
caacaacctagctcccgatggtcac

SEQ ID NO: 217612 - DNA, 25 bp, Mus musculus
caacaacctgaaagattttgataga

SEQ ID NO: 217613 - DNA, 25 bp, Mus musculus
caacaaccttgaccttattcaatcc

SEQ ID NO: 217614 - DNA, 25 bp, Mus musculus
caacaacgcagccactcttggggat

SEQ ID NO: 217615 - DNA, 25 bp, Mus musculus
caacaacgcagccctacaaaggctg

SEQ ID NO: 217616 - DNA, 25 bp, Mus musculus
caacaactccaggaagagctgatct

SEQ ID NO: 217617 - DNA, 25 bp, Mus musculus
caacaactggcactggacagagaga

SEQ ID NO: 217618 - DNA, 25 bp, Mus musculus
caacaactggcactggacaggtacc

SEQ ID NO: 217619 - DNA, 25 bp, Mus musculus
caacaacttgacaggcttagaatca

SEQ ID NO: 217620 - DNA, 25 bp, Mus musculus
caacaagaaaaatatgttccaagtg

SEQ ID NO: 217621 - DNA, 25 bp, Mus musculus
caacaagaacaaggagttgggagcg

SEQ ID NO: 217622 - DNA, 25 bp, Mus musculus
caacaagaacaaggtgctctgtttt

SEQ ID NO: 217623 - DNA, 25 bp, Mus musculus
caacaagaacattctcaagatcggc

SEQ ID NO: 217624 - DNA, 25 bp, Mus musculus
caacaagaaggtagaggcagtcatg

SEQ ID NO: 217625 - DNA, 25 bp, Mus musculus
caacaagaaggtgacactggccaag

SEQ ID NO: 217626 - DNA, 25 bp, Mus musculus
caacaagaagttaattatacccgac

SEQ ID NO: 217627 - DNA, 25 bp, Mus musculus
caacaagaatcagcttcagaggatt

SEQ ID NO: 217628 - DNA, 25 bp, Mus musculus
caacaagaatcaggttgtggagttg

SEQ ID NO: 217629 - DNA, 25 bp, Mus musculus
caacaagacacccagaatgggctac

SEQ ID NO: 217630 - DNA, 25 bp, Mus musculus
caacaagacccctcctcctcgatta

SEQ ID NO: 217631 - DNA, 25 bp, Mus musculus
caacaagaccttcaggatcaagatt

SEQ ID NO: 217632 - DNA, 25 bp, Mus musculus
caacaagagatggaatacgaccata

SEQ ID NO: 217633 - DNA, 25 bp, Mus musculus
caacaagagcaggagaacaaaatcc

SEQ ID NO: 217634 - DNA, 25 bp, Mus musculus
caacaagagcaggagcgcctttgac

SEQ ID NO: 217635 - DNA, 25 bp, Mus musculus
caacaagagccccagaaccaaggct

SEQ ID NO: 217636 - DNA, 25 bp, Mus musculus
caacaagaggaaatacagaagctta

SEQ ID NO: 217637 - DNA, 25 bp, Mus musculus
caacaagcaaaaagctattgacctt

SEQ ID NO: 217638 - DNA, 25 bp, Mus musculus
caacaagcacaagttctgcctatct

SEQ ID NO: 217639 - DNA, 25 bp, Mus musculus
caacaagcagcaacgtcggagtctt

SEQ ID NO: 217640 - DNA, 25 bp, Mus musculus
caacaagcaggatggacgacagagg

SEQ ID NO: 217641 - DNA, 25 bp, Mus musculus
caacaagcctccagaaatcgacatc

SEQ ID NO: 217642 - DNA, 25 bp, Mus musculus
caacaagctaacaactgtgccacca

SEQ ID NO: 217643 - DNA, 25 bp, Mus musculus
caacaaggaggacagctacaagccc

SEQ ID NO: 217644 - DNA, 25 bp, Mus musculus
caacaagtagcaggattgtctctca

SEQ ID NO: 217645 - DNA, 25 bp, Mus musculus
caacaagtgccagagaggagttttg

SEQ ID NO: 217646 - DNA, 25 bp, Mus musculus
caacaagtgccaggtacatattttt

SEQ ID NO: 217647 - DNA, 25 bp, Mus musculus
caacaagttcgacgccttaaaagat

SEQ ID NO: 217648 - DNA, 25 bp, Mus musculus
caacaatactcagggaggagactcc

SEQ ID NO: 217649 - DNA, 25 bp, Mus musculus
caacaatatcaaggaagtgcttctc

SEQ ID NO: 217650 - DNA, 25 bp, Mus musculus
caacaatcatggctgcttgtgcctc

SEQ ID NO: 217651 - DNA, 25 bp, Mus musculus
caacaatcctactccaggtctggtt

SEQ ID NO: 217652 - DNA, 25 bp, Mus musculus
caacaatccttacgggaaggtgcac

SEQ ID NO: 217653 - DNA, 25 bp, Mus musculus
caacaatccttacggtgataaaatt

SEQ ID NO: 217654 - DNA, 25 bp, Mus musculus
caacaatctagagcccttactccct

SEQ ID NO: 217655 - DNA, 25 bp, Mus musculus
caacaatctggctcttctgtcagtt

SEQ ID NO: 217656 - DNA, 25 bp, Mus musculus
caacaatgaaaaacttcagaagcag

SEQ ID NO: 217657 - DNA, 25 bp, Mus musculus
caacaatgaaaatcttcagaagcag

SEQ ID NO: 217658 - DNA, 25 bp, Mus musculus
caacaatgaagcaggtttagatgac

SEQ ID NO: 217659 - DNA, 25 bp, Mus musculus
caacaatgagagtgctgcaaagatg

SEQ ID NO: 217660 - DNA, 25 bp, Mus musculus
caacaatgcaggggttgacaacttc

SEQ ID NO: 217661 - DNA, 25 bp, Mus musculus
caacaatggcaagattgagctccgg

SEQ ID NO: 217662 - DNA, 25 bp, Mus musculus
caacaatggcaatcatgaggcagtg

SEQ ID NO: 217663 - DNA, 25 bp, Mus musculus
caacaatgtagagatcccctatttc

SEQ ID NO: 217664 - DNA, 25 bp, Mus musculus
caacaatgtgacagtccatatgttg

SEQ ID NO: 217665 - DNA, 25 bp, Mus musculus
caacaatgtggaagtcttcagtaac

SEQ ID NO: 217666 - DNA, 25 bp, Mus musculus
caacacaaaaacagatggatgagac

SEQ ID NO: 217667 - DNA, 25 bp, Mus musculus
caacacaaaaagcttcctagaggaa

SEQ ID NO: 217668 - DNA, 25 bp, Mus musculus
caacacaaaacaggttcagacagta

SEQ ID NO: 217669 - DNA, 25 bp, Mus musculus
caacacaaagatgggtgttacgagc

SEQ ID NO: 217670 - DNA, 25 bp, Mus musculus
caacacaagcccaaggaggataagc

SEQ ID NO: 217671 - DNA, 25 bp, Mus musculus
caacacaagcccaagtgcccacctt

SEQ ID NO: 217672 - DNA, 25 bp, Mus musculus
caacacaaggaggcatggtccaggt

SEQ ID NO: 217673 - DNA, 25 bp, Mus musculus
caacacaatggaagtcgatggcaat

SEQ ID NO: 217674 - DNA, 25 bp, Mus musculus
caacacaatttcaataacttacagt

SEQ ID NO: 217675 - DNA, 25 bp, Mus musculus
caacacaatttcaatgtgttacagc

SEQ ID NO: 217676 - DNA, 25 bp, Mus musculus
caacacaatttcagactacaaaagt

SEQ ID NO: 217677 - DNA, 25 bp, Mus musculus
caacacaccacaggctttgctactg

SEQ ID NO: 217678 - DNA, 25 bp, Mus musculus
caacacaccacagggaaaccaggaa

SEQ ID NO: 217679 - DNA, 25 bp, Mus musculus
caacacacgtgggaaggtggcgttt

SEQ ID NO: 217680 - DNA, 25 bp, Mus musculus
caacacacgtggtggtacccgggag

SEQ ID NO: 217681 - DNA, 25 bp, Mus musculus
caacacactgacggagcgcttctgg

SEQ ID NO: 217682 - DNA, 25 bp, Mus musculus
caacacagagcagaggaatgtctac

SEQ ID NO: 217683 - DNA, 25 bp, Mus musculus
caacacagagtttcaaggcaaacga

SEQ ID NO: 217684 - DNA, 25 bp, Mus musculus
caacacagcacccttatcttcaaag

SEQ ID NO: 217685 - DNA, 25 bp, Mus musculus
caacacagcagcaccataggttccc

SEQ ID NO: 217686 - DNA, 25 bp, Mus musculus
caacacagcaggtcatcaccatctt

SEQ ID NO: 217687 - DNA, 25 bp, Mus musculus
caacacagccatggatgtgcagcag

SEQ ID NO: 217688 - DNA, 25 bp, Mus musculus
caacacagccatggctgtgtgcaat

SEQ ID NO: 217689 - DNA, 25 bp, Mus musculus
caacacagtgccaggcaggtcggat

SEQ ID NO: 217690 - DNA, 25 bp, Mus musculus
caacacagtgccagggagcccagag

SEQ ID NO: 217691 - DNA, 25 bp, Mus musculus
caacacatataaggaggaatttggc

SEQ ID NO: 217692 - DNA, 25 bp, Mus musculus
caacacatcacttgtcttccccagg

SEQ ID NO: 217693 - DNA, 25 bp, Mus musculus
caacacatctgctctcctctgatga

SEQ ID NO: 217694 - DNA, 25 bp, Mus musculus
caacacatgtaaggtatcgcaaacg

SEQ ID NO: 217695 - DNA, 25 bp, Mus musculus
caacacatgtaagtccaacccctgt

SEQ ID NO: 217696 - DNA, 25 bp, Mus musculus
caacaccaaaaggccgaggggcaaa

SEQ ID NO: 217697 - DNA, 25 bp, Mus musculus
caacaccaaaagtgcccatggaggc

SEQ ID NO: 217698 - DNA, 25 bp, Mus musculus
caacaccaaaatctgtagattgttt

SEQ ID NO: 217699 - DNA, 25 bp, Mus musculus
caacaccaaagtggacatgacttgt

SEQ ID NO: 217700 - DNA, 25 bp, Mus musculus
caacaccaacagatgttctgatggc

SEQ ID NO: 217701 - DNA, 25 bp, Mus musculus
caacaccaacaggggtggtggattt

SEQ ID NO: 217702 - DNA, 25 bp, Mus musculus
caacaccaagagaggtattgtggcc

SEQ ID NO: 217703 - DNA, 25 bp, Mus musculus
caacaccaagagcttactggcggtt

SEQ ID NO: 217704 - DNA, 25 bp, Mus musculus
caacaccaggacttgcttgtgacga

SEQ ID NO: 217705 - DNA, 25 bp, Mus musculus
caacaccaggacttggactattttg

SEQ ID NO: 217706 - DNA, 25 bp, Mus musculus
caacaccatggacaaaagcttcaat

SEQ ID NO: 217707 - DNA, 25 bp, Mus musculus
caacaccatggtgtttcctggctct

SEQ ID NO: 217708 - DNA, 25 bp, Mus musculus
caacacccagcaagaagtctatgtg

SEQ ID NO: 217709 - DNA, 25 bp, Mus musculus
caacacccaggcctgcagtggggac

SEQ ID NO: 217710 - DNA, 25 bp, Mus musculus
caacacccatggacactccagcacg

SEQ ID NO: 217711 - DNA, 25 bp, Mus musculus
caacacccatgtgaagcctttgatc

SEQ ID NO: 217712 - DNA, 25 bp, Mus musculus
caacaccccgctgctgccttccttt

SEQ ID NO: 217713 - DNA, 25 bp, Mus musculus
caacaccccgcttctcttgcctctc

SEQ ID NO: 217714 - DNA, 25 bp, Mus musculus
caacacccctgtggatatgactccc

SEQ ID NO: 217715 - DNA, 25 bp, Mus musculus
caacacccctgtggattccactgta

SEQ ID NO: 217716 - DNA, 25 bp, Mus musculus
caacaccccttcagtgcctgtgctg

SEQ ID NO: 217717 - DNA, 25 bp, Mus musculus
caacaccctattttataggcaatgc

SEQ ID NO: 217718 - DNA, 25 bp, Mus musculus
caacaccctgggaaacaagggagca

SEQ ID NO: 217719 - DNA, 25 bp, Mus musculus
caacaccctgggaaatgtgtgtctg

SEQ ID NO: 217720 - DNA, 25 bp, Mus musculus
caacaccctgggcattggggctttc

SEQ ID NO: 217721 - DNA, 25 bp, Mus musculus
caacaccctgggttttagatgcctc

SEQ ID NO: 217722 - DNA, 25 bp, Mus musculus
caacaccgacgagtccatttcgggc

SEQ ID NO: 217723 - DNA, 25 bp, Mus musculus
caacaccgctgccaggcacaatgga

SEQ ID NO: 217724 - DNA, 25 bp, Mus musculus
caacaccgggaaaaagcaagaccac

SEQ ID NO: 217725 - DNA, 25 bp, Mus musculus
caacacctaacccggctggccaagg

SEQ ID NO: 217726 - DNA, 25 bp, Mus musculus
caacacctcgaaggaatggaagaaa

SEQ ID NO: 217727 - DNA, 25 bp, Mus musculus
caacacctcgaaggtacacaactgg

SEQ ID NO: 217728 - DNA, 25 bp, Mus musculus
caacacctctactgccgcccacgga

SEQ ID NO: 217729 - DNA, 25 bp, Mus musculus
caacacctggagagtgagaagatgc

SEQ ID NO: 217730 - DNA, 25 bp, Mus musculus
caacacgccctgaaccgcttgggtg

SEQ ID NO: 217731 - DNA, 25 bp, Mus musculus
caacacgccgcggggagaccatgag

SEQ ID NO: 217732 - DNA, 25 bp, Mus musculus
caacacgccgcggggatccacctga

SEQ ID NO: 217733 - DNA, 25 bp, Mus musculus
caacacggctcaagcaaggaccatg

SEQ ID NO: 217734 - DNA, 25 bp, Mus musculus
caacactcaaagattgacatggtac

SEQ ID NO: 217735 - DNA, 25 bp, Mus musculus
caacactcaaaggagttgcaagcac

SEQ ID NO: 217736 - DNA, 25 bp, Mus musculus
caacactcttcaaaggctttggaga

SEQ ID NO: 217737 - DNA, 25 bp, Mus musculus
caacactgaaaggggcatctgatga

SEQ ID NO: 217738 - DNA, 25 bp, Mus musculus
caacactgaatatctcctgggcttc

SEQ ID NO: 217739 - DNA, 25 bp, Mus musculus
caacactgagggcagggcctacgtc

SEQ ID NO: 217740 - DNA, 25 bp, Mus musculus
caacactggccgagggatggaattc

SEQ ID NO: 217741 - DNA, 25 bp, Mus musculus
caacactggccggacccacattgtg

SEQ ID NO: 217742 - DNA, 25 bp, Mus musculus
caacactgggcgcaggtttacctat

SEQ ID NO: 217743 - DNA, 25 bp, Mus musculus
caacactgttttgagagtggagtca

SEQ ID NO: 217744 - DNA, 25 bp, Mus musculus
caacacttcaacagttatcagagac

SEQ ID NO: 217745 - DNA, 25 bp, Mus musculus
caacactttgaagtcttgaagaacc

SEQ ID NO: 217746 - DNA, 25 bp, Mus musculus
caacagaaaaggcagccggagcata

SEQ ID NO: 217747 - DNA, 25 bp, Mus musculus
caacagaacaggatttgtgcaggaa

SEQ ID NO: 217748 - DNA, 25 bp, Mus musculus
caacagaacagtgctcttggctcca

SEQ ID NO: 217749 - DNA, 25 bp, Mus musculus
caacagaagcgagacggtgttctga

SEQ ID NO: 217750 - DNA, 25 bp, Mus musculus
caacagaagcgcaaggtgtcagaca

SEQ ID NO: 217751 - DNA, 25 bp, Mus musculus
caacagaagctgacatcatgttcat

SEQ ID NO: 217752 - DNA, 25 bp, Mus musculus
caacagaagctgcatgtctgctggt

SEQ ID NO: 217753 - DNA, 25 bp, Mus musculus
caacagaaggagctccatctgtagc

SEQ ID NO: 217754 - DNA, 25 bp, Mus musculus
caacagaaggcgacatcccaggcat

SEQ ID NO: 217755 - DNA, 25 bp, Mus musculus
caacagaagggatacttaccgcaga

SEQ ID NO: 217756 - DNA, 25 bp, Mus musculus
caacagaatgcacgtagaaaatcca

SEQ ID NO: 217757 - DNA, 25 bp, Mus musculus
caacagaatgcaggctggtgagatt

SEQ ID NO: 217758 - DNA, 25 bp, Mus musculus
caacagacaaaaattaactgaaaca

SEQ ID NO: 217759 - DNA, 25 bp, Mus musculus
caacagacaaaagccaaccatattc

SEQ ID NO: 217760 - DNA, 25 bp, Mus musculus
caacagacaagtcaagagcaatctg

SEQ ID NO: 217761 - DNA, 25 bp, Mus musculus
caacagacaggtggaggaagagcta

SEQ ID NO: 217762 - DNA, 25 bp, Mus musculus
caacagaccgcagaagttatatgag

SEQ ID NO: 217763 - DNA, 25 bp, Mus musculus
caacagacgaccttgttgccgctgg

SEQ ID NO: 217764 - DNA, 25 bp, Mus musculus
caacagagagaaggcttcgtgagct

SEQ ID NO: 217765 - DNA, 25 bp, Mus musculus
caacagagagaagggcccgagggct

SEQ ID NO: 217766 - DNA, 25 bp, Mus musculus
caacagagagagccgaagccgaaag

SEQ ID NO: 217767 - DNA, 25 bp, Mus musculus
caacagagagagccgaatattaatt

SEQ ID NO: 217768 - DNA, 25 bp, Mus musculus
caacagagagggcccccagcatggt

SEQ ID NO: 217769 - DNA, 25 bp, Mus musculus
caacagagaggtgataggtgcttgg

SEQ ID NO: 217770 - DNA, 25 bp, Mus musculus
caacagagaggtttatttcctgctg

SEQ ID NO: 217771 - DNA, 25 bp, Mus musculus
caacagagatggatggacagtctga

SEQ ID NO: 217772 - DNA, 25 bp, Mus musculus
caacagagcaagtgacaaatgacct

SEQ ID NO: 217773 - DNA, 25 bp, Mus musculus
caacagagcaatctctggcaaacat

SEQ ID NO: 217774 - DNA, 25 bp, Mus musculus
caacagaggctgtgggtctgcagct

SEQ ID NO: 217775 - DNA, 25 bp, Mus musculus
caacagagtcattgattaggttata

SEQ ID NO: 217776 - DNA, 25 bp, Mus musculus
caacagagtccatgagtttacagga

SEQ ID NO: 217777 - DNA, 25 bp, Mus musculus
caacagagtggatcacattccaggt

SEQ ID NO: 217778 - DNA, 25 bp, Mus musculus
caacagataagaaagatggcttgcc

SEQ ID NO: 217779 - DNA, 25 bp, Mus musculus
caacagatagcctaggttcaaccag

SEQ ID NO: 217780 - DNA, 25 bp, Mus musculus
caacagatcagtatggtccatattg

SEQ ID NO: 217781 - DNA, 25 bp, Mus musculus
caacagatccaggttcaggggcaca

SEQ ID NO: 217782 - DNA, 25 bp, Mus musculus
caacagatttcctctgcccctcagc

SEQ ID NO: 217783 - DNA, 25 bp, Mus musculus
caacagcaaggtgcacatgtatgag

SEQ ID NO: 217784 - DNA, 25 bp, Mus musculus
caacagcaagtgctgacagtagagt

SEQ ID NO: 217785 - DNA, 25 bp, Mus musculus
caacagcacaggcgtggtgactgtg

SEQ ID NO: 217786 - DNA, 25 bp, Mus musculus
caacagcagagaactggggaacccg

SEQ ID NO: 217787 - DNA, 25 bp, Mus musculus
caacagcagatctggatccctagcc

SEQ ID NO: 217788 - DNA, 25 bp, Mus musculus
caacagcagcagtgtgaggatgacc

SEQ ID NO: 217789 - DNA, 25 bp, Mus musculus
caacagcagccgcccctgccttaga

SEQ ID NO: 217790 - DNA, 25 bp, Mus musculus
caacagcataaacgatatgtgtcac

SEQ ID NO: 217791 - DNA, 25 bp, Mus musculus
caacagcatcaaacaatttgtcgtc

SEQ ID NO: 217792 - DNA, 25 bp, Mus musculus
caacagcatcaaacatggaggaatc

SEQ ID NO: 217793 - DNA, 25 bp, Mus musculus
caacagccaggaggctctgcagaag

SEQ ID NO: 217794 - DNA, 25 bp, Mus musculus
caacagccatctccagtggcttctg

SEQ ID NO: 217795 - DNA, 25 bp, Mus musculus
caacagccatctgcaatggctgctg

SEQ ID NO: 217796 - DNA, 25 bp, Mus musculus
caacagccatggcttctccatgatc

SEQ ID NO: 217797 - DNA, 25 bp, Mus musculus
caacagcccaatggtgcaggtttcg

SEQ ID NO: 217798 - DNA, 25 bp, Mus musculus
caacagcccaatggtttcgccacgt

SEQ ID NO: 217799 - DNA, 25 bp, Mus musculus
caacagcccgaaaagcgactcaagg

SEQ ID NO: 217800 - DNA, 25 bp, Mus musculus
caacagcccgacgtatgtttccttc

SEQ ID NO: 217801 - DNA, 25 bp, Mus musculus
caacagccctatgaggtgccattga

SEQ ID NO: 217802 - DNA, 25 bp, Mus musculus
caacagccctggaaatgtggactcc

SEQ ID NO: 217803 - DNA, 25 bp, Mus musculus
caacagccctggcactgaagatcca

SEQ ID NO: 217804 - DNA, 25 bp, Mus musculus
caacagccgcgcacactggagcggc

SEQ ID NO: 217805 - DNA, 25 bp, Mus musculus
caacagcctgggcatatggcctcca

SEQ ID NO: 217806 - DNA, 25 bp, Mus musculus
caacagcgatggtgagaaggccact

SEQ ID NO: 217807 - DNA, 25 bp, Mus musculus
caacagcgcgggatgggggcacagc

SEQ ID NO: 217808 - DNA, 25 bp, Mus musculus
caacagcgctacctccttctggccg

SEQ ID NO: 217809 - DNA, 25 bp, Mus musculus
caacagcgtttatggggcccagaca

SEQ ID NO: 217810 - DNA, 25 bp, Mus musculus
caacagctccagcagagtcagggga

SEQ ID NO: 217811 - DNA, 25 bp, Mus musculus
caacagctgaacctgaatctcctgg

SEQ ID NO: 217812 - DNA, 25 bp, Mus musculus
caacagctgaggaaggtgtcttgct

SEQ ID NO: 217813 - DNA, 25 bp, Mus musculus
caacagcttgcaaattacaggcctg

SEQ ID NO: 217814 - DNA, 25 bp, Mus musculus
caacagctttacgatcatcactccg

SEQ ID NO: 217815 - DNA, 25 bp, Mus musculus
caacagctttacgatcatcttgact

SEQ ID NO: 217816 - DNA, 25 bp, Mus musculus
caacaggaagcgtggaggatgagca

SEQ ID NO: 217817 - DNA, 25 bp, Mus musculus
caacaggaaggtgactgtggactct

SEQ ID NO: 217818 - DNA, 25 bp, Mus musculus
caacaggaatgatccaagcagcccc

SEQ ID NO: 217819 - DNA, 25 bp, Mus musculus
caacaggaggacttcaaggaggcat

SEQ ID NO: 217820 - DNA, 25 bp, Mus musculus
caacaggatgaccaggtagagacct

SEQ ID NO: 217821 - DNA, 25 bp, Mus musculus
caacaggatgaccagtttcagaaag

SEQ ID NO: 217822 - DNA, 25 bp, Mus musculus
caacaggccaggaaggaaaaacagg

SEQ ID NO: 217823 - DNA, 25 bp, Mus musculus
caacaggctaggtgctggtgttgat

SEQ ID NO: 217824 - DNA, 25 bp, Mus musculus
caacaggctaggttgcaggaagcag

SEQ ID NO: 217825 - DNA, 25 bp, Mus musculus
caacaggcttaggtgccacattctg

SEQ ID NO: 217826 - DNA, 25 bp, Mus musculus
caacaggggcagtcccaggacggcc

SEQ ID NO: 217827 - DNA, 25 bp, Mus musculus
caacaggggcagtgtttgccaagaa

SEQ ID NO: 217828 - DNA, 25 bp, Mus musculus
caacaggtaattggcacgggagaag

SEQ ID NO: 217829 - DNA, 25 bp, Mus musculus
caacaggtcaaaatgtcctgcaggt

SEQ ID NO: 217830 - DNA, 25 bp, Mus musculus
caacaggtgtgaacaggttccaccc

SEQ ID NO: 217831 - DNA, 25 bp, Mus musculus
caacagtaccctcggcgcttgttct

SEQ ID NO: 217832 - DNA, 25 bp, Mus musculus
caacagtccaaaccatagacagaag

SEQ ID NO: 217833 - DNA, 25 bp, Mus musculus
caacagtccagattccttctggaac

SEQ ID NO: 217834 - DNA, 25 bp, Mus musculus
caacagtcctgattctttaagaaat

SEQ ID NO: 217835 - DNA, 25 bp, Mus musculus
caacagtctcttcctctgctctgcc

SEQ ID NO: 217836 - DNA, 25 bp, Mus musculus
caacagtgagcaactgatggtgtcc

SEQ ID NO: 217837 - DNA, 25 bp, Mus musculus
caacagttaaaaggttttcagcaga

SEQ ID NO: 217838 - DNA, 25 bp, Mus musculus
caacagttcttccaatcccacatgt

SEQ ID NO: 217839 - DNA, 25 bp, Mus musculus
caacagttgataaagactccattag

SEQ ID NO: 217840 - DNA, 25 bp, Mus musculus
caacagtttgggggacatcctgcag

SEQ ID NO: 217841 - DNA, 25 bp, Mus musculus
caacataaacagaaagcttcacgga

SEQ ID NO: 217842 - DNA, 25 bp, Mus musculus
caacataatagcctgctttttctct

SEQ ID NO: 217843 - DNA, 25 bp, Mus musculus
caacataataggtgagcacatagat

SEQ ID NO: 217844 - DNA, 25 bp, Mus musculus
caacataatgcatgccaagtggcag

SEQ ID NO: 217845 - DNA, 25 bp, Mus musculus
caacatacaaagacgacgctcacct

SEQ ID NO: 217846 - DNA, 25 bp, Mus musculus
caacatacaaagctggcttaatggt

SEQ ID NO: 217847 - DNA, 25 bp, Mus musculus
caacatacaggataagaacaagaag

SEQ ID NO: 217848 - DNA, 25 bp, Mus musculus
caacatacaggttaccaaagtgacc

SEQ ID NO: 217849 - DNA, 25 bp, Mus musculus
caacatacattccagggccttattt

SEQ ID NO: 217850 - DNA, 25 bp, Mus musculus
caacataccagaatccacacaggcg

SEQ ID NO: 217851 - DNA, 25 bp, Mus musculus
caacataccagagtcctctgatggg

SEQ ID NO: 217852 - DNA, 25 bp, Mus musculus
caacatacgtgatggaccaagagtt

SEQ ID NO: 217853 - DNA, 25 bp, Mus musculus
caacatatggtactgagtactctct

SEQ ID NO: 217854 - DNA, 25 bp, Mus musculus
caacatcaaactgtgctcccttatg

SEQ ID NO: 217855 - DNA, 25 bp, Mus musculus
caacatcaaagccattggtgtcagc

SEQ ID NO: 217856 - DNA, 25 bp, Mus musculus
caacatcaaagtaatcccctccccg

SEQ ID NO: 217857 - DNA, 25 bp, Mus musculus
caacatcaaagtgtgctcccttatg

SEQ ID NO: 217858 - DNA, 25 bp, Mus musculus
caacatcaacgagaggacggcctgg

SEQ ID NO: 217859 - DNA, 25 bp, Mus musculus
caacatcaacttcaagccctccaac

SEQ ID NO: 217860 - DNA, 25 bp, Mus musculus
caacatcaacttcaagggccagcta

SEQ ID NO: 217861 - DNA, 25 bp, Mus musculus
caacatcaaggtgtctttggactcc

SEQ ID NO: 217862 - DNA, 25 bp, Mus musculus
caacatcaatagtggagattttgta

SEQ ID NO: 217863 - DNA, 25 bp, Mus musculus
caacatcaatagtgtaattattgag

SEQ ID NO: 217864 - DNA, 25 bp, Mus musculus
caacatcacactcaatgacgaggct

SEQ ID NO: 217865 - DNA, 25 bp, Mus musculus
caacatcacagagtcccacccagga

SEQ ID NO: 217866 - DNA, 25 bp, Mus musculus
caacatcacagatgtctcccaattg

SEQ ID NO: 217867 - DNA, 25 bp, Mus musculus
caacatcacagcaaagtctcgactg

SEQ ID NO: 217868 - DNA, 25 bp, Mus musculus
caacatcacaggtggtagcaggaac

SEQ ID NO: 217869 - DNA, 25 bp, Mus musculus
caacatcacagttcatagccagaga

SEQ ID NO: 217870 - DNA, 25 bp, Mus musculus
caacatcagaaagggtctgccgtca

SEQ ID NO: 217871 - DNA, 25 bp, Mus musculus
caacatcagaaagtgactcagaccc

SEQ ID NO: 217872 - DNA, 25 bp, Mus musculus
caacatcagaattggaaaagtcaga

SEQ ID NO: 217873 - DNA, 25 bp, Mus musculus
caacatcatcagacttgcgtgcggg

SEQ ID NO: 217874 - DNA, 25 bp, Mus musculus
caacatcatcagatagagactagct

SEQ ID NO: 217875 - DNA, 25 bp, Mus musculus
caacatcatcgctgtgttttctcgt

SEQ ID NO: 217876 - DNA, 25 bp, Mus musculus
caacatcatcttggtggagaggctt

SEQ ID NO: 217877 - DNA, 25 bp, Mus musculus
caacatcatgaaagccaagaagaag

SEQ ID NO: 217878 - DNA, 25 bp, Mus musculus
caacatccagagcaagcaccagaag

SEQ ID NO: 217879 - DNA, 25 bp, Mus musculus
caacatccagctttccaagctgttg

SEQ ID NO: 217880 - DNA, 25 bp, Mus musculus
caacatcccagccaaagcaaaatca

SEQ ID NO: 217881 - DNA, 25 bp, Mus musculus
caacatcctaggcttcatcgcctcc

SEQ ID NO: 217882 - DNA, 25 bp, Mus musculus
caacatccttcaagaaaccctgaag

SEQ ID NO: 217883 - DNA, 25 bp, Mus musculus
caacatccttcaagactgcaggcac

SEQ ID NO: 217884 - DNA, 25 bp, Mus musculus
caacatccttcaaggtctgtgattg

SEQ ID NO: 217885 - DNA, 25 bp, Mus musculus
caacatcggaacctctaccactaca

SEQ ID NO: 217886 - DNA, 25 bp, Mus musculus
caacatcgtagagggagattcattt

SEQ ID NO: 217887 - DNA, 25 bp, Mus musculus
caacatctgatggaacctgtaccat

SEQ ID NO: 217888 - DNA, 25 bp, Mus musculus
caacatctgatggtctatctccacg

SEQ ID NO: 217889 - DNA, 25 bp, Mus musculus
caacatctgcagctctcccttttct

SEQ ID NO: 217890 - DNA, 25 bp, Mus musculus
caacatctgcagtgggccggatgta

SEQ ID NO: 217891 - DNA, 25 bp, Mus musculus
caacatctggagagagacttgcctg

SEQ ID NO: 217892 - DNA, 25 bp, Mus musculus
caacatctgggacaagctggatggc

SEQ ID NO: 217893 - DNA, 25 bp, Mus musculus
caacatgaacaagcgattatacaca

SEQ ID NO: 217894 - DNA, 25 bp, Mus musculus
caacatgaacaagcgcttgtacaca

SEQ ID NO: 217895 - DNA, 25 bp, Mus musculus
caacatgaacagaagagagaggggg

SEQ ID NO: 217896 - DNA, 25 bp, Mus musculus
caacatgaaggtcatgtaggaaatt

SEQ ID NO: 217897 - DNA, 25 bp, Mus musculus
caacatgaatgtgaccgagataatc

SEQ ID NO: 217898 - DNA, 25 bp, Mus musculus
caacatgacagacagtttcgcattt

SEQ ID NO: 217899 - DNA, 25 bp, Mus musculus
caacatgacatagatcctataaggt

SEQ ID NO: 217900 - DNA, 25 bp, Mus musculus
caacatgacatagggtacatgtgga

SEQ ID NO: 217901 - DNA, 25 bp, Mus musculus
caacatgagcctcctgatgctgctc

SEQ ID NO: 217902 - DNA, 25 bp, Mus musculus
caacatgcacagcctatttaagagt

SEQ ID NO: 217903 - DNA, 25 bp, Mus musculus
caacatgcagatggtgtcagtggat

SEQ ID NO: 217904 - DNA, 25 bp, Mus musculus
caacatgcagggtgtgttggagagt

SEQ ID NO: 217905 - DNA, 25 bp, Mus musculus
caacatgcggacctcatgcctgaga

SEQ ID NO: 217906 - DNA, 25 bp, Mus musculus
caacatgcgggaattcatcctctcc

SEQ ID NO: 217907 - DNA, 25 bp, Mus musculus
caacatgctcaagccaaaccaacaa

SEQ ID NO: 217908 - DNA, 25 bp, Mus musculus
caacatgctcacaaggtgcagacct

SEQ ID NO: 217909 - DNA, 25 bp, Mus musculus
caacatgctcttcgtctgctgggat

SEQ ID NO: 217910 - DNA, 25 bp, Mus musculus
caacatgctcttcgtgttccgctac

SEQ ID NO: 217911 - DNA, 25 bp, Mus musculus
caacatggaagtgaaggatgcgaac

SEQ ID NO: 217912 - DNA, 25 bp, Mus musculus
caacatggagcatatccgtgtgggc

SEQ ID NO: 217913 - DNA, 25 bp, Mus musculus
caacatggagtacaggatcaataag

SEQ ID NO: 217914 - DNA, 25 bp, Mus musculus
caacatggcaatgggctacagggga

SEQ ID NO: 217915 - DNA, 25 bp, Mus musculus
caacatggcactgggtggtgaaagt

SEQ ID NO: 217916 - DNA, 25 bp, Mus musculus
caacatggcaggtaagaaagtgctc

SEQ ID NO: 217917 - DNA, 25 bp, Mus musculus
caacatggctgagcctttcagtgct

SEQ ID NO: 217918 - DNA, 25 bp, Mus musculus
caacatggctgagtgctacggagcc

SEQ ID NO: 217919 - DNA, 25 bp, Mus musculus
caacatggcttcaggttgatatcaa

SEQ ID NO: 217920 - DNA, 25 bp, Mus musculus
caacatgtcaggggagctgaaggac

SEQ ID NO: 217921 - DNA, 25 bp, Mus musculus
caacatgtggagtgaaaaatctctc

SEQ ID NO: 217922 - DNA, 25 bp, Mus musculus
caacatgttcaaaggagcctttgac

SEQ ID NO: 217923 - DNA, 25 bp, Mus musculus
caacatgttcaaagttagcatatta

SEQ ID NO: 217924 - DNA, 25 bp, Mus musculus
caacatgttcttctcggacctacta

SEQ ID NO: 217925 - DNA, 25 bp, Mus musculus
caacattattaaagacacacttttt

SEQ ID NO: 217926 - DNA, 25 bp, Mus musculus
caacattattaaagataattgctgt

SEQ ID NO: 217927 - DNA, 25 bp, Mus musculus
caacattcaaggaatgtatgtgcat

SEQ ID NO: 217928 - DNA, 25 bp, Mus musculus
caacattcaggagcagagcccagtc

SEQ ID NO: 217929 - DNA, 25 bp, Mus musculus
caacattcagggtctactgaaagtg

SEQ ID NO: 217930 - DNA, 25 bp, Mus musculus
caacattcagtacacactgcgctgt

SEQ ID NO: 217931 - DNA, 25 bp, Mus musculus
caacattgagcagagtctgcgagaa

SEQ ID NO: 217932 - DNA, 25 bp, Mus musculus
caacattgaggatcataaagacaca

SEQ ID NO: 217933 - DNA, 25 bp, Mus musculus
caacattgatgaagcgtcaggaact

SEQ ID NO: 217934 - DNA, 25 bp, Mus musculus
caacattgctggacatttcaatgat

SEQ ID NO: 217935 - DNA, 25 bp, Mus musculus
caacattgctggatcctctcccagt

SEQ ID NO: 217936 - DNA, 25 bp, Mus musculus
caaccaaaagctggcatctgacccg

SEQ ID NO: 217937 - DNA, 25 bp, Mus musculus
caaccaaaccctttgcactgagcag

SEQ ID NO: 217938 - DNA, 25 bp, Mus musculus
caaccaaatcaagggccgatgatgc

SEQ ID NO: 217939 - DNA, 25 bp, Mus musculus
caaccaacagcagagaactggggaa

SEQ ID NO: 217940 - DNA, 25 bp, Mus musculus
caaccaacagcctcctggactgcca

SEQ ID NO: 217941 - DNA, 25 bp, Mus musculus
caaccaacaggagctctttggaaga

SEQ ID NO: 217942 - DNA, 25 bp, Mus musculus
caaccaagaaaggggagatctttga

SEQ ID NO: 217943 - DNA, 25 bp, Mus musculus
caaccaagaaagtgctctcttccct

SEQ ID NO: 217944 - DNA, 25 bp, Mus musculus
caaccaaggagtcaaatattggaga

SEQ ID NO: 217945 - DNA, 25 bp, Mus musculus
caaccaaggataaggacaaagccaa

SEQ ID NO: 217946 - DNA, 25 bp, Mus musculus
caaccaatagaccaagacaacaaaa

SEQ ID NO: 217947 - DNA, 25 bp, Mus musculus
caaccaatgaggaatacttggacct

SEQ ID NO: 217948 - DNA, 25 bp, Mus musculus
caaccaatgaggaatacttggatct

SEQ ID NO: 217949 - DNA, 25 bp, Mus musculus
caaccacaagcaacgatgcctactt

SEQ ID NO: 217950 - DNA, 25 bp, Mus musculus
caaccacaagcgactcgtcctccca

SEQ ID NO: 217951 - DNA, 25 bp, Mus musculus
caaccacaagcgagcctagaagagg

SEQ ID NO: 217952 - DNA, 25 bp, Mus musculus
caaccacaagcgagttcacatgaga

SEQ ID NO: 217953 - DNA, 25 bp, Mus musculus
caaccacaaggcgctacagcaacgt

SEQ ID NO: 217954 - DNA, 25 bp, Mus musculus
caaccacagaaggttatagaagctg

SEQ ID NO: 217955 - DNA, 25 bp, Mus musculus
caaccacagactgcagttttcagat

SEQ ID NO: 217956 - DNA, 25 bp, Mus musculus
caaccacagatgactacagctgtgg

SEQ ID NO: 217957 - DNA, 25 bp, Mus musculus
caaccacagcttcacacagagaccc

SEQ ID NO: 217958 - DNA, 25 bp, Mus musculus
caaccacagggactggaaatggcag

SEQ ID NO: 217959 - DNA, 25 bp, Mus musculus
caaccaccaggggacctatgtgctg

SEQ ID NO: 217960 - DNA, 25 bp, Mus musculus
caaccaccagttcctggccttcacc

SEQ ID NO: 217961 - DNA, 25 bp, Mus musculus
caaccaccagttttggttcatcttg

SEQ ID NO: 217962 - DNA, 25 bp, Mus musculus
caaccacccccacgacccactgatg

SEQ ID NO: 217963 - DNA, 25 bp, Mus musculus
caaccaccctctgggcatggctatc

SEQ ID NO: 217964 - DNA, 25 bp, Mus musculus
caaccaccgaccaggcagccacctg

SEQ ID NO: 217965 - DNA, 25 bp, Mus musculus
caaccaccgaccaggtcgtccgtac

SEQ ID NO: 217966 - DNA, 25 bp, Mus musculus
caaccacctggagagcatcttcctg

SEQ ID NO: 217967 - DNA, 25 bp, Mus musculus
caaccacctggcgctggttacccgc

SEQ ID NO: 217968 - DNA, 25 bp, Mus musculus
caaccacgctgcagcaccacaaaga

SEQ ID NO: 217969 - DNA, 25 bp, Mus musculus
caaccacgctggggtctccaatgac

SEQ ID NO: 217970 - DNA, 25 bp, Mus musculus
caaccactcagggcttcacacctac

SEQ ID NO: 217971 - DNA, 25 bp, Mus musculus
caaccagaaagagtccaaagctgcc

SEQ ID NO: 217972 - DNA, 25 bp, Mus musculus
caaccagaaagatacctcagaatac

SEQ ID NO: 217973 - DNA, 25 bp, Mus musculus
caaccagaaagatatactgcaggca

SEQ ID NO: 217974 - DNA, 25 bp, Mus musculus
caaccagaagaaagagtgtgaggag

SEQ ID NO: 217975 - DNA, 25 bp, Mus musculus
caaccagacatgccatgtcggaccc

SEQ ID NO: 217976 - DNA, 25 bp, Mus musculus
caaccagaccgtggacatgcttctg

SEQ ID NO: 217977 - DNA, 25 bp, Mus musculus
caaccagacctgccccaggatccgg

SEQ ID NO: 217978 - DNA, 25 bp, Mus musculus
caaccagagcctggcagaagatgag

SEQ ID NO: 217979 - DNA, 25 bp, Mus musculus
caaccagagcctgggtcatacttcc

SEQ ID NO: 217980 - DNA, 25 bp, Mus musculus
caaccagcacgaagccccccagcac

SEQ ID NO: 217981 - DNA, 25 bp, Mus musculus
caaccagcagaaaacatggtggtag

SEQ ID NO: 217982 - DNA, 25 bp, Mus musculus
caaccagcagaatgtggctgctacc

SEQ ID NO: 217983 - DNA, 25 bp, Mus musculus
caaccagcagcccagggtcaggtac

SEQ ID NO: 217984 - DNA, 25 bp, Mus musculus
caaccagccagtaattgggtgctgt

SEQ ID NO: 217985 - DNA, 25 bp, Mus musculus
caaccagcctcaggaagcaggccag

SEQ ID NO: 217986 - DNA, 25 bp, Mus musculus
caaccagcgaccagatgaccaatgc

SEQ ID NO: 217987 - DNA, 25 bp, Mus musculus
caaccagcgaccagtcttgtgccat

SEQ ID NO: 217988 - DNA, 25 bp, Mus musculus
caaccagcggaaatgtgagcgtgtt

SEQ ID NO: 217989 - DNA, 25 bp, Mus musculus
caaccagctccaaccctttgcggaa

SEQ ID NO: 217990 - DNA, 25 bp, Mus musculus
caaccagctggctgaagccatcagt

SEQ ID NO: 217991 - DNA, 25 bp, Mus musculus
caaccaggacctaggctggcacgct

SEQ ID NO: 217992 - DNA, 25 bp, Mus musculus
caaccaggagccctacacaggtcct

SEQ ID NO: 217993 - DNA, 25 bp, Mus musculus
caaccaggataacacctgacactga

SEQ ID NO: 217994 - DNA, 25 bp, Mus musculus
caaccaggataacacgtccctagct

SEQ ID NO: 217995 - DNA, 25 bp, Mus musculus
caaccaggcaccaggcaccaacaga

SEQ ID NO: 217996 - DNA, 25 bp, Mus musculus
caaccaggggcaaggtttcagccac

SEQ ID NO: 217997 - DNA, 25 bp, Mus musculus
caaccaggtcaaggctctggataag

SEQ ID NO: 217998 - DNA, 25 bp, Mus musculus
caaccaggtcaagggcaagcctgac

SEQ ID NO: 217999 - DNA, 25 bp, Mus musculus
caaccagtataaccctttaatggct

SEQ ID NO: 218000 - DNA, 25 bp, Mus musculus
caaccagtctaagttctttcgagtt

SEQ ID NO: 218001 - DNA, 25 bp, Mus musculus
caaccagtctgcctaactctgtggc

SEQ ID NO: 218002 - DNA, 25 bp, Mus musculus
caaccagtgtgtggatgtggacgag

SEQ ID NO: 218003 - DNA, 25 bp, Mus musculus
caaccagtgtgtggcccgccacctc

SEQ ID NO: 218004 - DNA, 25 bp, Mus musculus
caaccatagggttctacagtgagtc

SEQ ID NO: 218005 - DNA, 25 bp, Mus musculus
caaccatatttggtcacctggagag

SEQ ID NO: 218006 - DNA, 25 bp, Mus musculus
caaccatcaaaaaggcaaacataaa

SEQ ID NO: 218007 - DNA, 25 bp, Mus musculus
caaccatcaggggctggtgtcattt

SEQ ID NO: 218008 - DNA, 25 bp, Mus musculus
caaccatcaggtctaggtggctgtg

SEQ ID NO: 218009 - DNA, 25 bp, Mus musculus
caaccatccggaagaaagcaaaaga

SEQ ID NO: 218010 - DNA, 25 bp, Mus musculus
caaccatctctaagatgtaaagaag

SEQ ID NO: 218011 - DNA, 25 bp, Mus musculus
caaccatggaaggctcacccacggg

SEQ ID NO: 218012 - DNA, 25 bp, Mus musculus
caaccatgggaagatcccaacgctg

SEQ ID NO: 218013 - DNA, 25 bp, Mus musculus
caaccattgtaaaacttatggaacg

SEQ ID NO: 218014 - DNA, 25 bp, Mus musculus
caaccatttgaacagccctgcttta

SEQ ID NO: 218015 - DNA, 25 bp, Mus musculus
caaccatttgaacaggtcttatgca

SEQ ID NO: 218016 - DNA, 25 bp, Mus musculus
caacccaaaccaggtgtatatcaac

SEQ ID NO: 218017 - DNA, 25 bp, Mus musculus
caacccaatccagagctaagctagg

SEQ ID NO: 218018 - DNA, 25 bp, Mus musculus
caacccaatccagcatacagagcta

SEQ ID NO: 218019 - DNA, 25 bp, Mus musculus
caacccacaaacaggtcagcccttc

SEQ ID NO: 218020 - DNA, 25 bp, Mus musculus
caacccaccatgtatgcttgagagt

SEQ ID NO: 218021 - DNA, 25 bp, Mus musculus
caacccacccaggaacaattgtgag

SEQ ID NO: 218022 - DNA, 25 bp, Mus musculus
caacccacgaagggcgaatcgccag

SEQ ID NO: 218023 - DNA, 25 bp, Mus musculus
caacccacgcaagatggctgccagc

SEQ ID NO: 218024 - DNA, 25 bp, Mus musculus
caacccactgggtggctttgtgcat

SEQ ID NO: 218025 - DNA, 25 bp, Mus musculus
caacccagaagttctcctgattctg

SEQ ID NO: 218026 - DNA, 25 bp, Mus musculus
caacccagagaagagtgacagcagc

SEQ ID NO: 218027 - DNA, 25 bp, Mus musculus
caacccagagaaggcccagcttggg

SEQ ID NO: 218028 - DNA, 25 bp, Mus musculus
caacccagagaccttccccttgcgg

SEQ ID NO: 218029 - DNA, 25 bp, Mus musculus
caacccagaggagatgctgtctatg

SEQ ID NO: 218030 - DNA, 25 bp, Mus musculus
caacccagaggagggagtgagctac

SEQ ID NO: 218031 - DNA, 25 bp, Mus musculus
caacccagatcccaaacctagagac

SEQ ID NO: 218032 - DNA, 25 bp, Mus musculus
caacccatacctgcacctcgcaccc

SEQ ID NO: 218033 - DNA, 25 bp, Mus musculus
caacccatcctggagggctcctgtg

SEQ ID NO: 218034 - DNA, 25 bp, Mus musculus
caacccatcctggagtgtacaactc

SEQ ID NO: 218035 - DNA, 25 bp, Mus musculus
caacccatgagcatccaggtgatcc

SEQ ID NO: 218036 - DNA, 25 bp, Mus musculus
caaccccaaatctgtgctgaagaga

SEQ ID NO: 218037 - DNA, 25 bp, Mus musculus
caaccccaaggattaaaccagaaga

SEQ ID NO: 218038 - DNA, 25 bp, Mus musculus
caaccccaagttctacagtgagtcg

SEQ ID NO: 218039 - DNA, 25 bp, Mus musculus
caaccccacagtaaactacattttg

SEQ ID NO: 218040 - DNA, 25 bp, Mus musculus
caaccccaccatcatgatttaagca

SEQ ID NO: 218041 - DNA, 25 bp, Mus musculus
caaccccacccaggtggaggatgcg

SEQ ID NO: 218042 - DNA, 25 bp, Mus musculus
caaccccacccagtttctgtgttgt

SEQ ID NO: 218043 - DNA, 25 bp, Mus musculus
caaccccagagcggctccggagttg

SEQ ID NO: 218044 - DNA, 25 bp, Mus musculus
caaccccagagcgggagctcttggc

SEQ ID NO: 218045 - DNA, 25 bp, Mus musculus
caaccccagagcggttttgctgtat

SEQ ID NO: 218046 - DNA, 25 bp, Mus musculus
caaccccaggcacagctgactttaa

SEQ ID NO: 218047 - DNA, 25 bp, Mus musculus
caaccccagggacagctgactttaa

SEQ ID NO: 218048 - DNA, 25 bp, Mus musculus
caaccccataggaggccgctacgac

SEQ ID NO: 218049 - DNA, 25 bp, Mus musculus
caaccccatggagacatatgaggac

SEQ ID NO: 218050 - DNA, 25 bp, Mus musculus
caacccccatacggtgcctcctgag

SEQ ID NO: 218051 - DNA, 25 bp, Mus musculus
caacccccggagtttcaagccacag

SEQ ID NO: 218052 - DNA, 25 bp, Mus musculus
caaccccctcttcaactctggctcc

SEQ ID NO: 218053 - DNA, 25 bp, Mus musculus
caaccccgggaggaagctatgctct

SEQ ID NO: 218054 - DNA, 25 bp, Mus musculus
caaccccgtcaaggtccgatctgac

SEQ ID NO: 218055 - DNA, 25 bp, Mus musculus
caaccccgttcagcagagagtactt

SEQ ID NO: 218056 - DNA, 25 bp, Mus musculus
caaccccgtttattagtgcttacag

SEQ ID NO: 218057 - DNA, 25 bp, Mus musculus
caacccctatggctggccacagatt

SEQ ID NO: 218058 - DNA, 25 bp, Mus musculus
caacccgaagcagaagcaggtattc

SEQ ID NO: 218059 - DNA, 25 bp, Mus musculus
caacccgcactcagctgtttgaaat

SEQ ID NO: 218060 - DNA, 25 bp, Mus musculus
caacccgcactcaggggaaggagcc

SEQ ID NO: 218061 - DNA, 25 bp, Mus musculus
caacccggaggaccaggactgagtc

SEQ ID NO: 218062 - DNA, 25 bp, Mus musculus
caacccggaggaggttctgctgcct

SEQ ID NO: 218063 - DNA, 25 bp, Mus musculus
caaccctaaagatcctgttgtctca

SEQ ID NO: 218064 - DNA, 25 bp, Mus musculus
caaccctcagagctttaataagatt

SEQ ID NO: 218065 - DNA, 25 bp, Mus musculus
caaccctcagaggtttaataagatt

SEQ ID NO: 218066 - DNA, 25 bp, Mus musculus
caaccctcaggaatccaaacgcttt

SEQ ID NO: 218067 - DNA, 25 bp, Mus musculus
caaccctccaaatccggccaaagat

SEQ ID NO: 218068 - DNA, 25 bp, Mus musculus
caaccctccaacatattcgattctt

SEQ ID NO: 218069 - DNA, 25 bp, Mus musculus
caaccctccagaaagccatcgatct

SEQ ID NO: 218070 - DNA, 25 bp, Mus musculus
caaccctccggagatggcgtcagac

SEQ ID NO: 218071 - DNA, 25 bp, Mus musculus
caaccctcgtctcttctgtcggaaa

SEQ ID NO: 218072 - DNA, 25 bp, Mus musculus
caaccctctcagtgtgtgactttct

SEQ ID NO: 218073 - DNA, 25 bp, Mus musculus
caaccctctccagcaggcacctcca

SEQ ID NO: 218074 - DNA, 25 bp, Mus musculus
caaccctctgagaagagatggcgtc

SEQ ID NO: 218075 - DNA, 25 bp, Mus musculus
caaccctctgccctgctataacgga

SEQ ID NO: 218076 - DNA, 25 bp, Mus musculus
caaccctctgcgaagatggaatgaa

SEQ ID NO: 218077 - DNA, 25 bp, Mus musculus
caaccctctgggacaggtattctct

SEQ ID NO: 218078 - DNA, 25 bp, Mus musculus
caaccctgaaattatatcattggat

SEQ ID NO: 218079 - DNA, 25 bp, Mus musculus
caaccctgaagatattgtgaacaag

SEQ ID NO: 218080 - DNA, 25 bp, Mus musculus
caaccctgacctgtgctgctccgca

SEQ ID NO: 218081 - DNA, 25 bp, Mus musculus
caaccctgacctgtggttcctgcac

SEQ ID NO: 218082 - DNA, 25 bp, Mus musculus
caaccctgactttactaggacctgg

SEQ ID NO: 218083 - DNA, 25 bp, Mus musculus
caaccctgactttgtggctgttcca

SEQ ID NO: 218084 - DNA, 25 bp, Mus musculus
caaccctgagacagctcttcttcaa

SEQ ID NO: 218085 - DNA, 25 bp, Mus musculus
caaccctgagtgccaggaccctggc

SEQ ID NO: 218086 - DNA, 25 bp, Mus musculus
caaccctgataatggcagcccagcc

SEQ ID NO: 218087 - DNA, 25 bp, Mus musculus
caaccctgccatcagatacaagcgg

SEQ ID NO: 218088 - DNA, 25 bp, Mus musculus
caaccctgcccacctgaggcaaaag

SEQ ID NO: 218089 - DNA, 25 bp, Mus musculus
caaccctgcccagctgaggcaaaag

SEQ ID NO: 218090 - DNA, 25 bp, Mus musculus
caaccctggagctgccgcagtggca

SEQ ID NO: 218091 - DNA, 25 bp, Mus musculus
caacccttcaagatcccgattcgct

SEQ ID NO: 218092 - DNA, 25 bp, Mus musculus
caacccttcgagaagcctggaaagg

SEQ ID NO: 218093 - DNA, 25 bp, Mus musculus
caacccttgtgatgtggtgaagact

SEQ ID NO: 218094 - DNA, 25 bp, Mus musculus
caaccgacccccaggctcaacagtg

SEQ ID NO: 218095 - DNA, 25 bp, Mus musculus
caaccgagaccagatcatcttcatg

SEQ ID NO: 218096 - DNA, 25 bp, Mus musculus
caaccgagtcacacgataagcccct

SEQ ID NO: 218097 - DNA, 25 bp, Mus musculus
caaccgagtcatttaaggctgcaag

SEQ ID NO: 218098 - DNA, 25 bp, Mus musculus
caaccgcagacaagggttctccaga

SEQ ID NO: 218099 - DNA, 25 bp, Mus musculus
caaccgcagagaggaactggcccaa

SEQ ID NO: 218100 - DNA, 25 bp, Mus musculus
caaccgcaggactactggtgcctag

SEQ ID NO: 218101 - DNA, 25 bp, Mus musculus
caaccgcatggaccagctccatttc

SEQ ID NO: 218102 - DNA, 25 bp, Mus musculus
caaccgccagattgggcctgtccca

SEQ ID NO: 218103 - DNA, 25 bp, Mus musculus
caaccgcgccatggtctgccaggaa

SEQ ID NO: 218104 - DNA, 25 bp, Mus musculus
caaccgcgccatgtgatctcagcgc

SEQ ID NO: 218105 - DNA, 25 bp, Mus musculus
caaccgcggttacagggcatctgac

SEQ ID NO: 218106 - DNA, 25 bp, Mus musculus
caaccgggacctgacgtgtgctgtg

SEQ ID NO: 218107 - DNA, 25 bp, Mus musculus
caaccgggagaggtctgctctgact

SEQ ID NO: 218108 - DNA, 25 bp, Mus musculus
caaccgggagcaggaggacaggaag

SEQ ID NO: 218109 - DNA, 25 bp, Mus musculus
caaccgggagcattctcagagcttc

SEQ ID NO: 218110 - DNA, 25 bp, Mus musculus
caaccgggattgacccaccgttctt

SEQ ID NO: 218111 - DNA, 25 bp, Mus musculus
caaccgggattggcagaattactac

SEQ ID NO: 218112 - DNA, 25 bp, Mus musculus
caaccggttcactgctcttccgaat

SEQ ID NO: 218113 - DNA, 25 bp, Mus musculus
caaccggtttgtatgaactccagtt

SEQ ID NO: 218114 - DNA, 25 bp, Mus musculus
caaccgtgcaggactagcctgagag

SEQ ID NO: 218115 - DNA, 25 bp, Mus musculus
caacctacaagggcaagatgaagag

SEQ ID NO: 218116 - DNA, 25 bp, Mus musculus
caacctagagaagaagcgagatgag

SEQ ID NO: 218117 - DNA, 25 bp, Mus musculus
caacctagagaagcgagatgagcgc

SEQ ID NO: 218118 - DNA, 25 bp, Mus musculus
caacctagaggccttgtctcacaaa

SEQ ID NO: 218119 - DNA, 25 bp, Mus musculus
caacctagcagaagcgctcctggag

SEQ ID NO: 218120 - DNA, 25 bp, Mus musculus
caacctagccaagtgcattgttggt

SEQ ID NO: 218121 - DNA, 25 bp, Mus musculus
caacctagcctcccgttgttctaca

SEQ ID NO: 218122 - DNA, 25 bp, Mus musculus
caacctagctacagaactgtgccgg

SEQ ID NO: 218123 - DNA, 25 bp, Mus musculus
caacctcaaataaagaagatacatt

SEQ ID NO: 218124 - DNA, 25 bp, Mus musculus
caacctcaacgtcatcctggccaga

SEQ ID NO: 218125 - DNA, 25 bp, Mus musculus
caacctcaactgtgtgtgcaacaga

SEQ ID NO: 218126 - DNA, 25 bp, Mus musculus
caacctcaagaacaagctcggaagt

SEQ ID NO: 218127 - DNA, 25 bp, Mus musculus
caacctcaagggctgtgaggtggtc

SEQ ID NO: 218128 - DNA, 25 bp, Mus musculus
caacctcagacgacaatttccaagg

SEQ ID NO: 218129 - DNA, 25 bp, Mus musculus
caacctcagcaaagccagtggccgc

SEQ ID NO: 218130 - DNA, 25 bp, Mus musculus
caacctcagcacttttctgtacttc

SEQ ID NO: 218131 - DNA, 25 bp, Mus musculus
caacctcataaaggttgacctatca

SEQ ID NO: 218132 - DNA, 25 bp, Mus musculus
caacctcatctctgatcgctggggt

SEQ ID NO: 218133 - DNA, 25 bp, Mus musculus
caacctcatctctgtgatgggtcac

SEQ ID NO: 218134 - DNA, 25 bp, Mus musculus
caacctccaaagatggaaaagccga

SEQ ID NO: 218135 - DNA, 25 bp, Mus musculus
caacctccaaagctcatttttccaa

SEQ ID NO: 218136 - DNA, 25 bp, Mus musculus
caacctccaaaggacacaccagcca

SEQ ID NO: 218137 - DNA, 25 bp, Mus musculus
caacctccaagcctgaagggcacga

SEQ ID NO: 218138 - DNA, 25 bp, Mus musculus
caacctccaaggagtgtctaaaacc

SEQ ID NO: 218139 - DNA, 25 bp, Mus musculus
caacctccaggccacaatcggctat

SEQ ID NO: 218140 - DNA, 25 bp, Mus musculus
caacctccagtctcaccagcgccag

SEQ ID NO: 218141 - DNA, 25 bp, Mus musculus
caacctcccaagactcctacaggaa

SEQ ID NO: 218142 - DNA, 25 bp, Mus musculus
caacctcccatcagcaagccccgcc

SEQ ID NO: 218143 - DNA, 25 bp, Mus musculus
caacctcccgagcaggcagcaaaca

SEQ ID NO: 218144 - DNA, 25 bp, Mus musculus
caacctcccttgtggtgtgaacatt

SEQ ID NO: 218145 - DNA, 25 bp, Mus musculus
caacctccgcaagaatggaatcatc

SEQ ID NO: 218146 - DNA, 25 bp, Mus musculus
caacctcctaggaaagctgtagagg

SEQ ID NO: 218147 - DNA, 25 bp, Mus musculus
caacctcctaggaataggtgaaggg

SEQ ID NO: 218148 - DNA, 25 bp, Mus musculus
caacctcgtgaggactctcattaga

SEQ ID NO: 218149 - DNA, 25 bp, Mus musculus
caacctcgtgagttacaggactctc

SEQ ID NO: 218150 - DNA, 25 bp, Mus musculus
caacctctcccagctccctggctga

SEQ ID NO: 218151 - DNA, 25 bp, Mus musculus
caacctctcccaggtgtgtgacggg

SEQ ID NO: 218152 - DNA, 25 bp, Mus musculus
caacctctctgcccactcagccagt

SEQ ID NO: 218153 - DNA, 25 bp, Mus musculus
caacctctgtctacccttatgagct

SEQ ID NO: 218154 - DNA, 25 bp, Mus musculus
caacctcttggaaaggtatgctgaa

SEQ ID NO: 218155 - DNA, 25 bp, Mus musculus
caacctgaaaaggacaagaagatgc

SEQ ID NO: 218156 - DNA, 25 bp, Mus musculus
caacctgaaagattttgatagactg

SEQ ID NO: 218157 - DNA, 25 bp, Mus musculus
caacctgaagattacgctcgatttg

SEQ ID NO: 218158 - DNA, 25 bp, Mus musculus
caacctgaagcggtgctcactcctg

SEQ ID NO: 218159 - DNA, 25 bp, Mus musculus
caacctgaatcagggcagcgctgta

SEQ ID NO: 218160 - DNA, 25 bp, Mus musculus
caacctgagcacagtgagcatgttt

SEQ ID NO: 218161 - DNA, 25 bp, Mus musculus
caacctgcagatggcagcagtgaca

SEQ ID NO: 218162 - DNA, 25 bp, Mus musculus
caacctgcagatggcagctcaacgg

SEQ ID NO: 218163 - DNA, 25 bp, Mus musculus
caacctgccagatgcagagaagaaa

SEQ ID NO: 218164 - DNA, 25 bp, Mus musculus
caacctgccaggatatgctctccat

SEQ ID NO: 218165 - DNA, 25 bp, Mus musculus
caacctgcccaaggagctggagggt

SEQ ID NO: 218166 - DNA, 25 bp, Mus musculus
caacctgccgaataaggccagcaga

SEQ ID NO: 218167 - DNA, 25 bp, Mus musculus
caacctgccgagaaacccttttgac

SEQ ID NO: 218168 - DNA, 25 bp, Mus musculus
caacctgctgaatttgttggagctg

SEQ ID NO: 218169 - DNA, 25 bp, Mus musculus
caacctgctggccgtggagactgca

SEQ ID NO: 218170 - DNA, 25 bp, Mus musculus
caacctggatgaaagtgaggcagca

SEQ ID NO: 218171 - DNA, 25 bp, Mus musculus
caacctggcagaggaaaactccagg

SEQ ID NO: 218172 - DNA, 25 bp, Mus musculus
caacctggctgtgggtggtgagaag

SEQ ID NO: 218173 - DNA, 25 bp, Mus musculus
caacctggctgttgctcgtcttggg

SEQ ID NO: 218174 - DNA, 25 bp, Mus musculus
caacctgggctttgctgggacccat

SEQ ID NO: 218175 - DNA, 25 bp, Mus musculus
caacctggggtttaagaggcgagtt

SEQ ID NO: 218176 - DNA, 25 bp, Mus musculus
caacctggtcacccatccctgacgg

SEQ ID NO: 218177 - DNA, 25 bp, Mus musculus
caacctggtctatgaaacaactgac

SEQ ID NO: 218178 - DNA, 25 bp, Mus musculus
caacctgtaagtgctgtgacccaat

SEQ ID NO: 218179 - DNA, 25 bp, Mus musculus
caacctgtaagttcacttgttcaaa

SEQ ID NO: 218180 - DNA, 25 bp, Mus musculus
caacctgtacctgcaaatgagcagt

SEQ ID NO: 218181 - DNA, 25 bp, Mus musculus
caacctgtcaggtgactcaagtgca

SEQ ID NO: 218182 - DNA, 25 bp, Mus musculus
caacctgtcaggtgactccaatgaa

SEQ ID NO: 218183 - DNA, 25 bp, Mus musculus
caacctgttcaagaaaattgaccta

SEQ ID NO: 218184 - DNA, 25 bp, Mus musculus
caacctgttggagagaagacacagt

SEQ ID NO: 218185 - DNA, 25 bp, Mus musculus
caaccttcacctgggcctaggctca

SEQ ID NO: 218186 - DNA, 25 bp, Mus musculus
caaccttcatgaaaggaatacagat

SEQ ID NO: 218187 - DNA, 25 bp, Mus musculus
caaccttcatgaaagttccgacgag

SEQ ID NO: 218188 - DNA, 25 bp, Mus musculus
caaccttctgttgccttgaagtttg

SEQ ID NO: 218189 - DNA, 25 bp, Mus musculus
caaccttgaaccagaatgtctgtaa

SEQ ID NO: 218190 - DNA, 25 bp, Mus musculus
caaccttgacgcatcgtggctgagg

SEQ ID NO: 218191 - DNA, 25 bp, Mus musculus
caaccttgcaggccctgtggttctc

SEQ ID NO: 218192 - DNA, 25 bp, Mus musculus
caaccttgctggcaccatcggtttc

SEQ ID NO: 218193 - DNA, 25 bp, Mus musculus
caacctttctagatgatttaagcca

SEQ ID NO: 218194 - DNA, 25 bp, Mus musculus
caacctttgacctgggaattcctca

SEQ ID NO: 218195 - DNA, 25 bp, Mus musculus
caaccttttgacaaggtcagggccc

SEQ ID NO: 218196 - DNA, 25 bp, Mus musculus
caacgaacctaacagcaaatgggaa

SEQ ID NO: 218197 - DNA, 25 bp, Mus musculus
caacgaagatgcctggtacggagtc

SEQ ID NO: 218198 - DNA, 25 bp, Mus musculus
caacgaaggcgagatctgcatcaaa

SEQ ID NO: 218199 - DNA, 25 bp, Mus musculus
caacgaatccttagtggccaatagg

SEQ ID NO: 218200 - DNA, 25 bp, Mus musculus
caacgaatcctttgtcatctacatc

SEQ ID NO: 218201 - DNA, 25 bp, Mus musculus
caacgacaaaactaatatccagggg

SEQ ID NO: 218202 - DNA, 25 bp, Mus musculus
caacgacaaaactgctaacccagta

SEQ ID NO: 218203 - DNA, 25 bp, Mus musculus
caacgacaaggtggcccagctgccc

SEQ ID NO: 218204 - DNA, 25 bp, Mus musculus
caacgacaagttctccaccccctcc

SEQ ID NO: 218205 - DNA, 25 bp, Mus musculus
caacgacacttggacgttcatgagg

SEQ ID NO: 218206 - DNA, 25 bp, Mus musculus
caacgacagctgatggttccagcat

SEQ ID NO: 218207 - DNA, 25 bp, Mus musculus
caacgacattgtgtacctcatccgt

SEQ ID NO: 218208 - DNA, 25 bp, Mus musculus
caacgacccccagggagaggcagag

SEQ ID NO: 218209 - DNA, 25 bp, Mus musculus
caacgagaaggatctggtgaaacta

SEQ ID NO: 218210 - DNA, 25 bp, Mus musculus
caacgagcagcaagtggtggaatct

SEQ ID NO: 218211 - DNA, 25 bp, Mus musculus
caacgagcaggatgaggtgttgatg

SEQ ID NO: 218212 - DNA, 25 bp, Mus musculus
caacgagcctggtgccttctggggc

SEQ ID NO: 218213 - DNA, 25 bp, Mus musculus
caacgagcgagtggtgacgtatgcc

SEQ ID NO: 218214 - DNA, 25 bp, Mus musculus
caacgagcgagttgggatggctacc

SEQ ID NO: 218215 - DNA, 25 bp, Mus musculus
caacgagcggaggaggtcccaggta

SEQ ID NO: 218216 - DNA, 25 bp, Mus musculus
caacgaggtcattctgtcagacccg

SEQ ID NO: 218217 - DNA, 25 bp, Mus musculus
caacgaggtgcactgccaacctagg

SEQ ID NO: 218218 - DNA, 25 bp, Mus musculus
caacgagtgcaaggctgatatagaa

SEQ ID NO: 218219 - DNA, 25 bp, Mus musculus
caacgagtgcaaggtttgacttttg

SEQ ID NO: 218220 - DNA, 25 bp, Mus musculus
caacgatagtatttttgacagtgaa

SEQ ID NO: 218221 - DNA, 25 bp, Mus musculus
caacgatgaccccagtgtcctttat

SEQ ID NO: 218222 - DNA, 25 bp, Mus musculus
caacgattcaagctcttgcttctag

SEQ ID NO: 218223 - DNA, 25 bp, Mus musculus
caacgattcaaggaggagccccgaa

SEQ ID NO: 218224 - DNA, 25 bp, Mus musculus
caacgcacgacgcagtggaagaacg

SEQ ID NO: 218225 - DNA, 25 bp, Mus musculus
caacgcagtaggtcccttcccactg

SEQ ID NO: 218226 - DNA, 25 bp, Mus musculus
caacgccaatgaaacttccatagag

SEQ ID NO: 218227 - DNA, 25 bp, Mus musculus
caacgccacttgaccaaatgtgatc

SEQ ID NO: 218228 - DNA, 25 bp, Mus musculus
caacgccatccagggtggagctttt

SEQ ID NO: 218229 - DNA, 25 bp, Mus musculus
caacgccatccaggtccctaagcct

SEQ ID NO: 218230 - DNA, 25 bp, Mus musculus
caacgcccagagagatgtcttcaac

SEQ ID NO: 218231 - DNA, 25 bp, Mus musculus
caacgccggagcagggtccccagaa

SEQ ID NO: 218232 - DNA, 25 bp, Mus musculus
caacgccggcccgtgtggatctgca

SEQ ID NO: 218233 - DNA, 25 bp, Mus musculus
caacgcctatcaccagctcctcagg

SEQ ID NO: 218234 - DNA, 25 bp, Mus musculus
caacgcctatcaccagttatcctac

SEQ ID NO: 218235 - DNA, 25 bp, Mus musculus
caacgcctctagtaaccctgacctc

SEQ ID NO: 218236 - DNA, 25 bp, Mus musculus
caacgcctgctgcagctggacccaa

SEQ ID NO: 218237 - DNA, 25 bp, Mus musculus
caacgcgccacacctggccgccgcc

SEQ ID NO: 218238 - DNA, 25 bp, Mus musculus
caacgcgttgctggtacaattacca

SEQ ID NO: 218239 - DNA, 25 bp, Mus musculus
caacgcgtttgggtctcttacaaag

SEQ ID NO: 218240 - DNA, 25 bp, Mus musculus
caacgctgaagaagatcggtcagca

SEQ ID NO: 218241 - DNA, 25 bp, Mus musculus
caacgctgaagaagattcgccggta

SEQ ID NO: 218242 - DNA, 25 bp, Mus musculus
caacgctgactttgagaagctgaag

SEQ ID NO: 218243 - DNA, 25 bp, Mus musculus
caacggaaatatcagttactactca

SEQ ID NO: 218244 - DNA, 25 bp, Mus musculus
caacggacagctcggattctgaagg

SEQ ID NO: 218245 - DNA, 25 bp, Mus musculus
caacggacaggagacctgaactata

SEQ ID NO: 218246 - DNA, 25 bp, Mus musculus
caacggacccaaagaggtctctcac

SEQ ID NO: 218247 - DNA, 25 bp, Mus musculus
caacggacccaaagaggtgtgaggt

SEQ ID NO: 218248 - DNA, 25 bp, Mus musculus
caacggatggaagtgtcatctgcca

SEQ ID NO: 218249 - DNA, 25 bp, Mus musculus
caacggcaaggtggttgctgtatac

SEQ ID NO: 218250 - DNA, 25 bp, Mus musculus
caacggcactgcgctcttggaattt

SEQ ID NO: 218251 - DNA, 25 bp, Mus musculus
caacggcagctggaaccaccatctg

SEQ ID NO: 218252 - DNA, 25 bp, Mus musculus
caacggcagctggcctcctatgctg

SEQ ID NO: 218253 - DNA, 25 bp, Mus musculus
caacggccccagaaattactgtgct

SEQ ID NO: 218254 - DNA, 25 bp, Mus musculus
caacggccccagaagctgactgcgg

SEQ ID NO: 218255 - DNA, 25 bp, Mus musculus
caacggccctgattgaagatatttt

SEQ ID NO: 218256 - DNA, 25 bp, Mus musculus
caacggcgagaagggagaagtcgga

SEQ ID NO: 218257 - DNA, 25 bp, Mus musculus
caacggcgcctcggctggacattgt

SEQ ID NO: 218258 - DNA, 25 bp, Mus musculus
caacggcgcctcggtggagtcttac

SEQ ID NO: 218259 - DNA, 25 bp, Mus musculus
caacggctctgcctgcagtggggac

SEQ ID NO: 218260 - DNA, 25 bp, Mus musculus
caacggctctgcgttgctgctctcc

SEQ ID NO: 218261 - DNA, 25 bp, Mus musculus
caacggcttgtctgtgccaccaaat

SEQ ID NO: 218262 - DNA, 25 bp, Mus musculus
caacgggcagagggaatccggagat

SEQ ID NO: 218263 - DNA, 25 bp, Mus musculus
caacgggctgagatctcttgatgct

SEQ ID NO: 218264 - DNA, 25 bp, Mus musculus
caacgggctgaggtctgtgcagacg

SEQ ID NO: 218265 - DNA, 25 bp, Mus musculus
caacggggagaagtactgcggtgag

SEQ ID NO: 218266 - DNA, 25 bp, Mus musculus
caacggtaagacaataaaattatgg

SEQ ID NO: 218267 - DNA, 25 bp, Mus musculus
caacggtgcggcagcgtgcttccgg

SEQ ID NO: 218268 - DNA, 25 bp, Mus musculus
caacggtgtaaagctggaccgtgta

SEQ ID NO: 218269 - DNA, 25 bp, Mus musculus
caacgtaatgcctcagttccactga

SEQ ID NO: 218270 - DNA, 25 bp, Mus musculus
caacgtacagagccattgtcactat

SEQ ID NO: 218271 - DNA, 25 bp, Mus musculus
caacgtatacgacacgggccggact

SEQ ID NO: 218272 - DNA, 25 bp, Mus musculus
caacgtcaacaagcttgctcaggac

SEQ ID NO: 218273 - DNA, 25 bp, Mus musculus
caacgtcaaccctccacgccatcaa

SEQ ID NO: 218274 - DNA, 25 bp, Mus musculus
caacgtcaacccttcagaaagccat

SEQ ID NO: 218275 - DNA, 25 bp, Mus musculus
caacgtcaagaagagtggtcttagg

SEQ ID NO: 218276 - DNA, 25 bp, Mus musculus
caacgtcaagaaggagatccagctg

SEQ ID NO: 218277 - DNA, 25 bp, Mus musculus
caacgtcacattagcctttggagct

SEQ ID NO: 218278 - DNA, 25 bp, Mus musculus
caacgtcacattagggtccgcaagc

SEQ ID NO: 218279 - DNA, 25 bp, Mus musculus
caacgtccacaagcttgtgacacag

SEQ ID NO: 218280 - DNA, 25 bp, Mus musculus
caacgtcctcaacgtgtattttgtt

SEQ ID NO: 218281 - DNA, 25 bp, Mus musculus
caacgtgataagaatttattctctc

SEQ ID NO: 218282 - DNA, 25 bp, Mus musculus
caacgtgatcaaaggtatgagggtg

SEQ ID NO: 218283 - DNA, 25 bp, Mus musculus
caacgtgatggagctggtggggagt

SEQ ID NO: 218284 - DNA, 25 bp, Mus musculus
caacgtgccggcagaggtggtttgt

SEQ ID NO: 218285 - DNA, 25 bp, Mus musculus
caacgtgccggcagcagagacttgc

SEQ ID NO: 218286 - DNA, 25 bp, Mus musculus
caacgtgccgtagcggggatgatga

SEQ ID NO: 218287 - DNA, 25 bp, Mus musculus
caacgtgctccccttctgctgcaga

SEQ ID NO: 218288 - DNA, 25 bp, Mus musculus
caacgtgctggaacttggcacacag

SEQ ID NO: 218289 - DNA, 25 bp, Mus musculus
caacgtgctggacctataagaacag

SEQ ID NO: 218290 - DNA, 25 bp, Mus musculus
caacgtggaaatacttcggatatca

SEQ ID NO: 218291 - DNA, 25 bp, Mus musculus
caacgtggaagcagcctgtgattct

SEQ ID NO: 218292 - DNA, 25 bp, Mus musculus
caacgtggaagccctctgctcatca

SEQ ID NO: 218293 - DNA, 25 bp, Mus musculus
caacgtggggttgagactcacacat

SEQ ID NO: 218294 - DNA, 25 bp, Mus musculus
caacgtgtcggaagtgatgggacca

SEQ ID NO: 218295 - DNA, 25 bp, Mus musculus
caacgtgtgcaccaggagcacctga

SEQ ID NO: 218296 - DNA, 25 bp, Mus musculus
caacgttaaaggatatcacttatac

SEQ ID NO: 218297 - DNA, 25 bp, Mus musculus
caacgttaatgtggttcgtctccaa

SEQ ID NO: 218298 - DNA, 25 bp, Mus musculus
caacgttcagaaccccaaatctcag

SEQ ID NO: 218299 - DNA, 25 bp, Mus musculus
caacgttgtcattgagcaagaagag

SEQ ID NO: 218300 - DNA, 25 bp, Mus musculus
caacgtttcagccagattctggctg

SEQ ID NO: 218301 - DNA, 25 bp, Mus musculus
caacgtttccaggtatgagatgtac

SEQ ID NO: 218302 - DNA, 25 bp, Mus musculus
caacgtttccagtgcaaacatactc

SEQ ID NO: 218303 - DNA, 25 bp, Mus musculus
caactaaaatcagcaccgtgcgagt

SEQ ID NO: 218304 - DNA, 25 bp, Mus musculus
caactaaacaggaatgcttcgtggc

SEQ ID NO: 218305 - DNA, 25 bp, Mus musculus
caactaacatgcaatgatcttccca

SEQ ID NO: 218306 - DNA, 25 bp, Mus musculus
caactaaggcccagggctgtaccat

SEQ ID NO: 218307 - DNA, 25 bp, Mus musculus
caactaaggcccaggtccctatttg

SEQ ID NO: 218308 - DNA, 25 bp, Mus musculus
caactaaggcggcaggaccctgagc

SEQ ID NO: 218309 - DNA, 25 bp, Mus musculus
caactacaagctgtatcttttcatt

SEQ ID NO: 218310 - DNA, 25 bp, Mus musculus
caactacaagggcccacccttcatg

SEQ ID NO: 218311 - DNA, 25 bp, Mus musculus
caactacacgagacctgtgttcctg

SEQ ID NO: 218312 - DNA, 25 bp, Mus musculus
caactacagcgagagtctatataaa

SEQ ID NO: 218313 - DNA, 25 bp, Mus musculus
caactacaggtcaccttgttggagt

SEQ ID NO: 218314 - DNA, 25 bp, Mus musculus
caactacatcgacatttggctgtac

SEQ ID NO: 218315 - DNA, 25 bp, Mus musculus
caactacatcgacggctaccagaga

SEQ ID NO: 218316 - DNA, 25 bp, Mus musculus
caactaccagaacaatgaaaaggag

SEQ ID NO: 218317 - DNA, 25 bp, Mus musculus
caactaccagattatccagctgatc

SEQ ID NO: 218318 - DNA, 25 bp, Mus musculus
caactaccaggcaggacccgacgcg

SEQ ID NO: 218319 - DNA, 25 bp, Mus musculus
caactacgattatccagataagtag

SEQ ID NO: 218320 - DNA, 25 bp, Mus musculus
caactacgattcatcccatcagatt

SEQ ID NO: 218321 - DNA, 25 bp, Mus musculus
caactacgattccatgtacacggct

SEQ ID NO: 218322 - DNA, 25 bp, Mus musculus
caactacggaaagaatgatgaagtg

SEQ ID NO: 218323 - DNA, 25 bp, Mus musculus
caactacggaaagatcagaaacatc

SEQ ID NO: 218324 - DNA, 25 bp, Mus musculus
caactacggaaaggtgactcagaac

SEQ ID NO: 218325 - DNA, 25 bp, Mus musculus
caactactgcgaggaggcggtggga

SEQ ID NO: 218326 - DNA, 25 bp, Mus musculus
caactactggcacgatcctcaccac

SEQ ID NO: 218327 - DNA, 25 bp, Mus musculus
caactagaatatgacttgggtcagc

SEQ ID NO: 218328 - DNA, 25 bp, Mus musculus
caactagaatatggtggcccatatt

SEQ ID NO: 218329 - DNA, 25 bp, Mus musculus
caactaggccagatttaccttatga

SEQ ID NO: 218330 - DNA, 25 bp, Mus musculus
caactaggccagctgctcagccatc

SEQ ID NO: 218331 - DNA, 25 bp, Mus musculus
caactagggaacatattcaaaagaa

SEQ ID NO: 218332 - DNA, 25 bp, Mus musculus
caactataaagccagagccatcgtg

SEQ ID NO: 218333 - DNA, 25 bp, Mus musculus
caactatatacaggctacagacaag

SEQ ID NO: 218334 - DNA, 25 bp, Mus musculus
caactatcagcccttgtttcttctt

SEQ ID NO: 218335 - DNA, 25 bp, Mus musculus
caactatcaggctcggaacttcctc

SEQ ID NO: 218336 - DNA, 25 bp, Mus musculus
caactatctcagcatcaagatgacc

SEQ ID NO: 218337 - DNA, 25 bp, Mus musculus
caactatgaaatgggtgggatgcta

SEQ ID NO: 218338 - DNA, 25 bp, Mus musculus
caactatgacgctgatttccaaaga

SEQ ID NO: 218339 - DNA, 25 bp, Mus musculus
caactatgacttttgccaaggagtg

SEQ ID NO: 218340 - DNA, 25 bp, Mus musculus
caactatgagtgaactccgggatag

SEQ ID NO: 218341 - DNA, 25 bp, Mus musculus
caactatgcagtaaagacgctcctt

SEQ ID NO: 218342 - DNA, 25 bp, Mus musculus
caactatgcttaactgcggatcccc

SEQ ID NO: 218343 - DNA, 25 bp, Mus musculus
caactatggaggaggaaattatgga

SEQ ID NO: 218344 - DNA, 25 bp, Mus musculus
caactatggcggagtgacaaagaat

SEQ ID NO: 218345 - DNA, 25 bp, Mus musculus
caactatggcggagtttcaacaccg

SEQ ID NO: 218346 - DNA, 25 bp, Mus musculus
caactattcacacctcctggaggac

SEQ ID NO: 218347 - DNA, 25 bp, Mus musculus
caactattcacaggctcagcagcag

SEQ ID NO: 218348 - DNA, 25 bp, Mus musculus
caactcaacatgtatggttttcgga

SEQ ID NO: 218349 - DNA, 25 bp, Mus musculus
caactcacaactttgctcggaaaac

SEQ ID NO: 218350 - DNA, 25 bp, Mus musculus
caactcagacaaagctaaaaatatc

SEQ ID NO: 218351 - DNA, 25 bp, Mus musculus
caactcagcagggcatctgaagttg

SEQ ID NO: 218352 - DNA, 25 bp, Mus musculus
caactcagcgggtggatacccttcg

SEQ ID NO: 218353 - DNA, 25 bp, Mus musculus
caactcagcgggttcttccagttct

SEQ ID NO: 218354 - DNA, 25 bp, Mus musculus
caactcagttgcagcgacaagttct

SEQ ID NO: 218355 - DNA, 25 bp, Mus musculus
caactcataaattatatgcaggaca

SEQ ID NO: 218356 - DNA, 25 bp, Mus musculus
caactcataaattgttggggtttct

SEQ ID NO: 218357 - DNA, 25 bp, Mus musculus
caactcatcagactgtgtcagaagt

SEQ ID NO: 218358 - DNA, 25 bp, Mus musculus
caactcatcagtctgtatatctgtg

SEQ ID NO: 218359 - DNA, 25 bp, Mus musculus
caactccaacctgaactctctctct

SEQ ID NO: 218360 - DNA, 25 bp, Mus musculus
caactccaacctggaacgagtggag

SEQ ID NO: 218361 - DNA, 25 bp, Mus musculus
caactccaagggctgggtcttcaat

SEQ ID NO: 218362 - DNA, 25 bp, Mus musculus
caactccaaggttacagagtcatca

SEQ ID NO: 218363 - DNA, 25 bp, Mus musculus
caactccacactctggtacatccaa

SEQ ID NO: 218364 - DNA, 25 bp, Mus musculus
caactccacagaccctgctcacact

SEQ ID NO: 218365 - DNA, 25 bp, Mus musculus
caactccacaggatctttggaagct

SEQ ID NO: 218366 - DNA, 25 bp, Mus musculus
caactccacagtcaggtgacactgc

SEQ ID NO: 218367 - DNA, 25 bp, Mus musculus
caactccaccctgaagagctttgac

SEQ ID NO: 218368 - DNA, 25 bp, Mus musculus
caactccacctctgcacagaagaat

SEQ ID NO: 218369 - DNA, 25 bp, Mus musculus
caactccagcagcatccacaggatt

SEQ ID NO: 218370 - DNA, 25 bp, Mus musculus
caactccagcaggtctcggacaaaa

SEQ ID NO: 218371 - DNA, 25 bp, Mus musculus
caactccagcccagtccaaggcgac

SEQ ID NO: 218372 - DNA, 25 bp, Mus musculus
caactccagcccccggcctccacct

SEQ ID NO: 218373 - DNA, 25 bp, Mus musculus
caactccaggaagagctgatctttt

SEQ ID NO: 218374 - DNA, 25 bp, Mus musculus
caactccatcaaggagctgaatgag

SEQ ID NO: 218375 - DNA, 25 bp, Mus musculus
caactccatctgcagggttatcaag

SEQ ID NO: 218376 - DNA, 25 bp, Mus musculus
caactccatctttggtctggctccc

SEQ ID NO: 218377 - DNA, 25 bp, Mus musculus
caactccatggtcagcaacatcaac

SEQ ID NO: 218378 - DNA, 25 bp, Mus musculus
caactccccagagcaccccttggga

SEQ ID NO: 218379 - DNA, 25 bp, Mus musculus
caactccccaggaagctacagggaa

SEQ ID NO: 218380 - DNA, 25 bp, Mus musculus
caactccctgttaagcatcaacatt

SEQ ID NO: 218381 - DNA, 25 bp, Mus musculus
caactccgacatcgatcctgcagta

SEQ ID NO: 218382 - DNA, 25 bp, Mus musculus
caactccgacatcggcagacagaca

SEQ ID NO: 218383 - DNA, 25 bp, Mus musculus
caactccgacatcgtgatccgggcc

SEQ ID NO: 218384 - DNA, 25 bp, Mus musculus
caactccgacgtgtggagaggatgc

SEQ ID NO: 218385 - DNA, 25 bp, Mus musculus
caactccgagtttgtggggacatcc

SEQ ID NO: 218386 - DNA, 25 bp, Mus musculus
caactccgcggatgtggtggaggac

SEQ ID NO: 218387 - DNA, 25 bp, Mus musculus
caactccgcgggctcagggacctct

SEQ ID NO: 218388 - DNA, 25 bp, Mus musculus
caactccgcgtctcttacatctctg

SEQ ID NO: 218389 - DNA, 25 bp, Mus musculus
caactcctagctacaggcggccact

SEQ ID NO: 218390 - DNA, 25 bp, Mus musculus
caactcctatataagtaactttgaa

SEQ ID NO: 218391 - DNA, 25 bp, Mus musculus
caactccttcagcgcatcatgactg

SEQ ID NO: 218392 - DNA, 25 bp, Mus musculus
caactccttcaggtccatctctgta

SEQ ID NO: 218393 - DNA, 25 bp, Mus musculus
caactccttccctgcacctccgcac

SEQ ID NO: 218394 - DNA, 25 bp, Mus musculus
caactcctttggactggtgcagtca

SEQ ID NO: 218395 - DNA, 25 bp, Mus musculus
caactcgaacagctctcgtggcgct

SEQ ID NO: 218396 - DNA, 25 bp, Mus musculus
caactcgaagctcctcccaaccttc

SEQ ID NO: 218397 - DNA, 25 bp, Mus musculus
caactcgcaaaccagctccttaatt

SEQ ID NO: 218398 - DNA, 25 bp, Mus musculus
caactcggacctggatgctaaaagg

SEQ ID NO: 218399 - DNA, 25 bp, Mus musculus
caactcggacctggtcataagggct

SEQ ID NO: 218400 - DNA, 25 bp, Mus musculus
caactcggctggggtcattctcaga

SEQ ID NO: 218401 - DNA, 25 bp, Mus musculus
caactcgtttgtagggacagtgatg

SEQ ID NO: 218402 - DNA, 25 bp, Mus musculus
caactctatcaagatctgggataaa

SEQ ID NO: 218403 - DNA, 25 bp, Mus musculus
caactctcatctgttctcagccaaa

SEQ ID NO: 218404 - DNA, 25 bp, Mus musculus
caactctccatcctacctcacgagc

SEQ ID NO: 218405 - DNA, 25 bp, Mus musculus
caactctcccagggctttctgaggg

SEQ ID NO: 218406 - DNA, 25 bp, Mus musculus
caactctcctctgctaagtatggtg

SEQ ID NO: 218407 - DNA, 25 bp, Mus musculus
caactctcgtggaagcacaagccca

SEQ ID NO: 218408 - DNA, 25 bp, Mus musculus
caactctcgtggaggctgctctgac

SEQ ID NO: 218409 - DNA, 25 bp, Mus musculus
caactctcttccatgcgccaatgat

SEQ ID NO: 218410 - DNA, 25 bp, Mus musculus
caactctgaaagatattaccaggag

SEQ ID NO: 218411 - DNA, 25 bp, Mus musculus
caactctgacgtccattacagaaga

SEQ ID NO: 218412 - DNA, 25 bp, Mus musculus
caactctgagtaccaaggcaaagac

SEQ ID NO: 218413 - DNA, 25 bp, Mus musculus
caactctgatcagagtgccagaagg

SEQ ID NO: 218414 - DNA, 25 bp, Mus musculus
caactctgcggcacatggtgatgag

SEQ ID NO: 218415 - DNA, 25 bp, Mus musculus
caactcttattgggctgtgcctaag

SEQ ID NO: 218416 - DNA, 25 bp, Mus musculus
caactcttattgttggaaatctaca

SEQ ID NO: 218417 - DNA, 25 bp, Mus musculus
caactcttgagggaggccttaacca

SEQ ID NO: 218418 - DNA, 25 bp, Mus musculus
caactcttggcattgaccttggccc

SEQ ID NO: 218419 - DNA, 25 bp, Mus musculus
caactctttcgatatgtcttgtcgt

SEQ ID NO: 218420 - DNA, 25 bp, Mus musculus
caactctttcgtctccttttaccag

SEQ ID NO: 218421 - DNA, 25 bp, Mus musculus
caactgaaaaaggacggctcctcta

SEQ ID NO: 218422 - DNA, 25 bp, Mus musculus
caactgaagactgtcactagatgca

SEQ ID NO: 218423 - DNA, 25 bp, Mus musculus
caactgaaggctgcccgagagattt

SEQ ID NO: 218424 - DNA, 25 bp, Mus musculus
caactgacaagatttagccttcaga

SEQ ID NO: 218425 - DNA, 25 bp, Mus musculus
caactgacaaggtattcatgctagc

SEQ ID NO: 218426 - DNA, 25 bp, Mus musculus
caactgacaggccataaaatcaggt

SEQ ID NO: 218427 - DNA, 25 bp, Mus musculus
caactgaccaggacaagagtgaagc

SEQ ID NO: 218428 - DNA, 25 bp, Mus musculus
caactgagaacaaagcaacaagcaa

SEQ ID NO: 218429 - DNA, 25 bp, Mus musculus
caactgagaacaaagcaacaataaa

SEQ ID NO: 218430 - DNA, 25 bp, Mus musculus
caactgagaattcaagtctgtcacc

SEQ ID NO: 218431 - DNA, 25 bp, Mus musculus
caactgagaggactggctgccccag

SEQ ID NO: 218432 - DNA, 25 bp, Mus musculus
caactgagaggggagcaaattttgc

SEQ ID NO: 218433 - DNA, 25 bp, Mus musculus
caactgagtgaagaaactgatctcc

SEQ ID NO: 218434 - DNA, 25 bp, Mus musculus
caactgagtgaagaggagatgcatg

SEQ ID NO: 218435 - DNA, 25 bp, Mus musculus
caactgagtgggagttgtgacacag

SEQ ID NO: 218436 - DNA, 25 bp, Mus musculus
caactgcaaacgggaggatatgatg

SEQ ID NO: 218437 - DNA, 25 bp, Mus musculus
caactgcaaacggtggttggcactt

SEQ ID NO: 218438 - DNA, 25 bp, Mus musculus
caactgcaagagcagtttgacaact

SEQ ID NO: 218439 - DNA, 25 bp, Mus musculus
caactgcaagatggccactgagatg

SEQ ID NO: 218440 - DNA, 25 bp, Mus musculus
caactgcaagattgcccagctgccc

SEQ ID NO: 218441 - DNA, 25 bp, Mus musculus
caactgcagaacggatcgagcgttt

SEQ ID NO: 218442 - DNA, 25 bp, Mus musculus
caactgcagatgacctcctcctggg

SEQ ID NO: 218443 - DNA, 25 bp, Mus musculus
caactgccaaatcaacatcaacgat

SEQ ID NO: 218444 - DNA, 25 bp, Mus musculus
caactgccaagagtctgacagcaaa

SEQ ID NO: 218445 - DNA, 25 bp, Mus musculus
caactgccagagggtaacatctgcc

SEQ ID NO: 218446 - DNA, 25 bp, Mus musculus
caactgccagagggttgcatctgat

SEQ ID NO: 218447 - DNA, 25 bp, Mus musculus
caactgccaggagaatcccagtgag

SEQ ID NO: 218448 - DNA, 25 bp, Mus musculus
caactgccttacagacgtggctctt

SEQ ID NO: 218449 - DNA, 25 bp, Mus musculus
caactgcgagatgaaatggaagggg

SEQ ID NO: 218450 - DNA, 25 bp, Mus musculus
caactgctacaggaggaaccccctc

SEQ ID NO: 218451 - DNA, 25 bp, Mus musculus
caactgctcacagagtcagtccgac

SEQ ID NO: 218452 - DNA, 25 bp, Mus musculus
caactgctgaagacgtgactgcgcc

SEQ ID NO: 218453 - DNA, 25 bp, Mus musculus
caactgctgcaacaccagcacagtg

SEQ ID NO: 218454 - DNA, 25 bp, Mus musculus
caactgcttggaaggctgcccacca

SEQ ID NO: 218455 - DNA, 25 bp, Mus musculus
caactgcttgtggactaaagaggat

SEQ ID NO: 218456 - DNA, 25 bp, Mus musculus
caactggaagcaggacaacaatcct

SEQ ID NO: 218457 - DNA, 25 bp, Mus musculus
caactggaatgaggccctgctccct

SEQ ID NO: 218458 - DNA, 25 bp, Mus musculus
caactggagcgtctggtgctacaag

SEQ ID NO: 218459 - DNA, 25 bp, Mus musculus
caactggaggacaagggcaggattc

SEQ ID NO: 218460 - DNA, 25 bp, Mus musculus
caactggaggacaaggtgactgcaa

SEQ ID NO: 218461 - DNA, 25 bp, Mus musculus
caactggcaagcctctatggaagga

SEQ ID NO: 218462 - DNA, 25 bp, Mus musculus
caactggcaagtttacaggctggtg

SEQ ID NO: 218463 - DNA, 25 bp, Mus musculus
caactggcactggacagagagagat

SEQ ID NO: 218464 - DNA, 25 bp, Mus musculus
caactggcactggacaggtacctct

SEQ ID NO: 218465 - DNA, 25 bp, Mus musculus
caactggcaggcgtgaagtgcagcc

SEQ ID NO: 218466 - DNA, 25 bp, Mus musculus
caactggcaggggacatgaagcagc

SEQ ID NO: 218467 - DNA, 25 bp, Mus musculus
caactggcaggtatttgacatacta

SEQ ID NO: 218468 - DNA, 25 bp, Mus musculus
caactggcctgaagacattgtcttt

SEQ ID NO: 218469 - DNA, 25 bp, Mus musculus
caactggcgacaggcccacatgcag

SEQ ID NO: 218470 - DNA, 25 bp, Mus musculus
caactggcgacaggctctgatgggc

SEQ ID NO: 218471 - DNA, 25 bp, Mus musculus
caactggctcatcagccacggcaag

SEQ ID NO: 218472 - DNA, 25 bp, Mus musculus
caactggctgatgcttgacttccct

SEQ ID NO: 218473 - DNA, 25 bp, Mus musculus
caactggggcacttccccactcctg

SEQ ID NO: 218474 - DNA, 25 bp, Mus musculus
caactggtttatcagagatttgaag

SEQ ID NO: 218475 - DNA, 25 bp, Mus musculus
caactggtttatcaggacccagcat

SEQ ID NO: 218476 - DNA, 25 bp, Mus musculus
caactgtacctatggagtaatggtt

SEQ ID NO: 218477 - DNA, 25 bp, Mus musculus
caactgtacctatggatgtgctggg

SEQ ID NO: 218478 - DNA, 25 bp, Mus musculus
caactgtacgcggagactgcggccc

SEQ ID NO: 218479 - DNA, 25 bp, Mus musculus
caactgtagacctggccttccctcc

SEQ ID NO: 218480 - DNA, 25 bp, Mus musculus
caactgtatgcagaaatttacacag

SEQ ID NO: 218481 - DNA, 25 bp, Mus musculus
caactgtatgcagcatctgtctgag

SEQ ID NO: 218482 - DNA, 25 bp, Mus musculus
caactgtccgggggcctcgcctgct

SEQ ID NO: 218483 - DNA, 25 bp, Mus musculus
caactgtctaaattgatcagggacc

SEQ ID NO: 218484 - DNA, 25 bp, Mus musculus
caactgtgacaactgtgatgatccg

SEQ ID NO: 218485 - DNA, 25 bp, Mus musculus
caactgtgaccatggtttgggatca

SEQ ID NO: 218486 - DNA, 25 bp, Mus musculus
caactgtgcaggctatgtggtggtt

SEQ ID NO: 218487 - DNA, 25 bp, Mus musculus
caactgtgcaggtgacagtaaccag

SEQ ID NO: 218488 - DNA, 25 bp, Mus musculus
caactgtggaagattcttgacaagt

SEQ ID NO: 218489 - DNA, 25 bp, Mus musculus
caactgtgtggacatcaacgaatgc

SEQ ID NO: 218490 - DNA, 25 bp, Mus musculus
caactgtttaaggaatcacgcctac

SEQ ID NO: 218491 - DNA, 25 bp, Mus musculus
caactgtttaaggaatccctcttcg

SEQ ID NO: 218492 - DNA, 25 bp, Mus musculus
caacttaaagactgaagtgttggaa

SEQ ID NO: 218493 - DNA, 25 bp, Mus musculus
caacttacagaactatgtagaagaa

SEQ ID NO: 218494 - DNA, 25 bp, Mus musculus
caacttacagcatctgctggtgacc

SEQ ID NO: 218495 - DNA, 25 bp, Mus musculus
caacttacaggaagttgtgccagcc

SEQ ID NO: 218496 - DNA, 25 bp, Mus musculus
caacttacaggaggttgtgccagcc

SEQ ID NO: 218497 - DNA, 25 bp, Mus musculus
caacttaccagacttggtggttctc

SEQ ID NO: 218498 - DNA, 25 bp, Mus musculus
caacttaccaggtggatcccactgc

SEQ ID NO: 218499 - DNA, 25 bp, Mus musculus
caacttaccatgaggatccagcaat

SEQ ID NO: 218500 - DNA, 25 bp, Mus musculus
caacttagaaactcctatcacgctc

SEQ ID NO: 218501 - DNA, 25 bp, Mus musculus
caacttaggcgtgtataagtgaggg

SEQ ID NO: 218502 - DNA, 25 bp, Mus musculus
caacttaggtgctggctacgccgag

SEQ ID NO: 218503 - DNA, 25 bp, Mus musculus
caacttataaagatgattatagatc

SEQ ID NO: 218504 - DNA, 25 bp, Mus musculus
caacttatccagagttgtttcttga

SEQ ID NO: 218505 - DNA, 25 bp, Mus musculus
caacttatccagatcacctcagcat

SEQ ID NO: 218506 - DNA, 25 bp, Mus musculus
caacttatgacatgatgatgcagtc

SEQ ID NO: 218507 - DNA, 25 bp, Mus musculus
caacttatggagcggcactggagca

SEQ ID NO: 218508 - DNA, 25 bp, Mus musculus
caacttatggagcggtcgtgtatca

SEQ ID NO: 218509 - DNA, 25 bp, Mus musculus
caacttcaaacccagctctgcatgc

SEQ ID NO: 218510 - DNA, 25 bp, Mus musculus
caacttcaaacccagggcaagacag

SEQ ID NO: 218511 - DNA, 25 bp, Mus musculus
caacttcaaccgaagtgagtccatt

SEQ ID NO: 218512 - DNA, 25 bp, Mus musculus
caacttcaaccgagttgagtccatt

SEQ ID NO: 218513 - DNA, 25 bp, Mus musculus
caacttcaaggaggtttgcggggag

SEQ ID NO: 218514 - DNA, 25 bp, Mus musculus
caacttcaagggtgctgctcaggct

SEQ ID NO: 218515 - DNA, 25 bp, Mus musculus
caacttcaatgaattcctgttccgc

SEQ ID NO: 218516 - DNA, 25 bp, Mus musculus
caacttcaccatagaaaacgggagt

SEQ ID NO: 218517 - DNA, 25 bp, Mus musculus
caacttcaccatgcttataggagac

SEQ ID NO: 218518 - DNA, 25 bp, Mus musculus
caacttcagaaccaggtgaccaacg

SEQ ID NO: 218519 - DNA, 25 bp, Mus musculus
caacttcatcaacagagctggcatg

SEQ ID NO: 218520 - DNA, 25 bp, Mus musculus
caacttccaaagtgggatccggcac

SEQ ID NO: 218521 - DNA, 25 bp, Mus musculus
caacttccccttcagctcttggggt

SEQ ID NO: 218522 - DNA, 25 bp, Mus musculus
caacttccccttcaggagtcgcttt

SEQ ID NO: 218523 - DNA, 25 bp, Mus musculus
caacttccccttcaggcctgccttt

SEQ ID NO: 218524 - DNA, 25 bp, Mus musculus
caacttccgcctggactagcaccca

SEQ ID NO: 218525 - DNA, 25 bp, Mus musculus
caacttcctccagctgcagaatctg

SEQ ID NO: 218526 - DNA, 25 bp, Mus musculus
caacttcctttcacgtgactgactt

SEQ ID NO: 218527 - DNA, 25 bp, Mus musculus
caacttcgccaggtcctagagtcgc

SEQ ID NO: 218528 - DNA, 25 bp, Mus musculus
caacttcgtagaagtgttaaatgaa

SEQ ID NO: 218529 - DNA, 25 bp, Mus musculus
caacttcgtcgttccgccgccacca

SEQ ID NO: 218530 - DNA, 25 bp, Mus musculus
caacttcgtgcaggtgacccggttt

SEQ ID NO: 218531 - DNA, 25 bp, Mus musculus
caacttctagccctgctgtcctcct

SEQ ID NO: 218532 - DNA, 25 bp, Mus musculus
caacttctcagatttactgaaacta

SEQ ID NO: 218533 - DNA, 25 bp, Mus musculus
caacttctcaggggcagatttactg

SEQ ID NO: 218534 - DNA, 25 bp, Mus musculus
caacttctcataaaaatggatgaga

SEQ ID NO: 218535 - DNA, 25 bp, Mus musculus
caacttctcataaaattcccatggc

SEQ ID NO: 218536 - DNA, 25 bp, Mus musculus
caacttctccagaaagcttccctgg

SEQ ID NO: 218537 - DNA, 25 bp, Mus musculus
caacttctccagaagcttccctgtt

SEQ ID NO: 218538 - DNA, 25 bp, Mus musculus
caacttctccaggtttggaggagac

SEQ ID NO: 218539 - DNA, 25 bp, Mus musculus
caacttctcctcagtgtttacaaaa

SEQ ID NO: 218540 - DNA, 25 bp, Mus musculus
caacttcttaactgacaggccaaca

SEQ ID NO: 218541 - DNA, 25 bp, Mus musculus
caacttcttccagagaatttgtttc

SEQ ID NO: 218542 - DNA, 25 bp, Mus musculus
caacttcttccagcttcacccctca

SEQ ID NO: 218543 - DNA, 25 bp, Mus musculus
caacttcttccaggctgaaggaagg

SEQ ID NO: 218544 - DNA, 25 bp, Mus musculus
caacttgaaagctatccttcaccag

SEQ ID NO: 218545 - DNA, 25 bp, Mus musculus
caacttgaaagcttatctgagtcca

SEQ ID NO: 218546 - DNA, 25 bp, Mus musculus
caacttgaacaatgattttgtggtg

SEQ ID NO: 218547 - DNA, 25 bp, Mus musculus
caacttgaacaatgttatgatggtt

SEQ ID NO: 218548 - DNA, 25 bp, Mus musculus
caacttgacaggcttagaatcagac

SEQ ID NO: 218549 - DNA, 25 bp, Mus musculus
caacttgagagctttggatatacaa

SEQ ID NO: 218550 - DNA, 25 bp, Mus musculus
caacttgctccctcgcttagcgctc

SEQ ID NO: 218551 - DNA, 25 bp, Mus musculus
caacttgtagctgttctagtaagca

SEQ ID NO: 218552 - DNA, 25 bp, Mus musculus
caacttgtccaatttcgaggactcc

SEQ ID NO: 218553 - DNA, 25 bp, Mus musculus
caacttgtcgaaccacactaaacaa

SEQ ID NO: 218554 - DNA, 25 bp, Mus musculus
caacttgttgttgagccaccttctc

SEQ ID NO: 218555 - DNA, 25 bp, Mus musculus
caacttgttgttgaggcagcatatt

SEQ ID NO: 218556 - DNA, 25 bp, Mus musculus
caactttaagatggagccagatcct

SEQ ID NO: 218557 - DNA, 25 bp, Mus musculus
caactttccagacccagcatgtagt

SEQ ID NO: 218558 - DNA, 25 bp, Mus musculus
caactttgaactctgcactttgttc

SEQ ID NO: 218559 - DNA, 25 bp, Mus musculus
caactttgatgtcctagcagggcgg

SEQ ID NO: 218560 - DNA, 25 bp, Mus musculus
caactttgcaggataaggtagctaa

SEQ ID NO: 218561 - DNA, 25 bp, Mus musculus
caactttgcggagatgatgatggac

SEQ ID NO: 218562 - DNA, 25 bp, Mus musculus
caactttgcgggtgagatggattct

SEQ ID NO: 218563 - DNA, 25 bp, Mus musculus
caactttgctagatgtgtcttccac

SEQ ID NO: 218564 - DNA, 25 bp, Mus musculus
caactttgctgtcatttctcaaaga

SEQ ID NO: 218565 - DNA, 25 bp, Mus musculus
caactttgcttcattacaggacgtg

SEQ ID NO: 218566 - DNA, 25 bp, Mus musculus
caactttgtaagagaaataaagaaa

SEQ ID NO: 218567 - DNA, 25 bp, Mus musculus
caactttgtggacctctgcagggcc

SEQ ID NO: 218568 - DNA, 25 bp, Mus musculus
caacttttccatgatcatcgatggc

SEQ ID NO: 218569 - DNA, 25 bp, Mus musculus
caagaaaaaaattgacatcctgctg

SEQ ID NO: 218570 - DNA, 25 bp, Mus musculus
caagaaaaacaagagacagaaccct

SEQ ID NO: 218571 - DNA, 25 bp, Mus musculus
caagaaaaacaagagagtctcacta

SEQ ID NO: 218572 - DNA, 25 bp, Mus musculus
caagaaaaacaagagcagtcagcac

SEQ ID NO: 218573 - DNA, 25 bp, Mus musculus
caagaaaaacaagagggtggagatg

SEQ ID NO: 218574 - DNA, 25 bp, Mus musculus
caagaaaaagacgctgggctgcggg

SEQ ID NO: 218575 - DNA, 25 bp, Mus musculus
caagaaaaagacttcaaggaggcat

SEQ ID NO: 218576 - DNA, 25 bp, Mus musculus
caagaaaaaggtgcgcatggtgaga

SEQ ID NO: 218577 - DNA, 25 bp, Mus musculus
caagaaaaagtctgatgccaacgca

SEQ ID NO: 218578 - DNA, 25 bp, Mus musculus
caagaaaaataaattcggagctgtc

SEQ ID NO: 218579 - DNA, 25 bp, Mus musculus
caagaaaaatatcgctgtagtgcct

SEQ ID NO: 218580 - DNA, 25 bp, Mus musculus
caagaaaaatatgttccaagtgata

SEQ ID NO: 218581 - DNA, 25 bp, Mus musculus
caagaaaacaaagaactgcggacat

SEQ ID NO: 218582 - DNA, 25 bp, Mus musculus
caagaaaactgttcattcgtatctt

SEQ ID NO: 218583 - DNA, 25 bp, Mus musculus
caagaaaagaaagaatgcgtccacc

SEQ ID NO: 218584 - DNA, 25 bp, Mus musculus
caagaaaagactatctaagctggaa

SEQ ID NO: 218585 - DNA, 25 bp, Mus musculus
caagaaaagaggagcgctggccgcc

SEQ ID NO: 218586 - DNA, 25 bp, Mus musculus
caagaaaaggcagcattctcataca

SEQ ID NO: 218587 - DNA, 25 bp, Mus musculus
caagaaaagtgatgggattcgaaga

SEQ ID NO: 218588 - DNA, 25 bp, Mus musculus
caagaaaatactgaattttctcagc

SEQ ID NO: 218589 - DNA, 25 bp, Mus musculus
caagaaaatatttcagatacaccac

SEQ ID NO: 218590 - DNA, 25 bp, Mus musculus
caagaaaatggaaggtcactacgtt

SEQ ID NO: 218591 - DNA, 25 bp, Mus musculus
caagaaaatggatgagtatgtggca

SEQ ID NO: 218592 - DNA, 25 bp, Mus musculus
caagaaaattgagcccagagtgccc

SEQ ID NO: 218593 - DNA, 25 bp, Mus musculus
caagaaaattgagcccagcgggccc

SEQ ID NO: 218594 - DNA, 25 bp, Mus musculus
caagaaaattgtgcccagggattgt

SEQ ID NO: 218595 - DNA, 25 bp, Mus musculus
caagaaacatccggcatttgtagaa

SEQ ID NO: 218596 - DNA, 25 bp, Mus musculus
caagaaacatgcactgataaagcag

SEQ ID NO: 218597 - DNA, 25 bp, Mus musculus
caagaaacatgggattactgctggg

SEQ ID NO: 218598 - DNA, 25 bp, Mus musculus
caagaaacgagagcttaaagaagcc

SEQ ID NO: 218599 - DNA, 25 bp, Mus musculus
caagaaactaatactctacaggctg

SEQ ID NO: 218600 - DNA, 25 bp, Mus musculus
caagaaactagaagatgaaatgaag

SEQ ID NO: 218601 - DNA, 25 bp, Mus musculus
caagaaactaggactaactgaagaa

SEQ ID NO: 218602 - DNA, 25 bp, Mus musculus
caagaaactccaggctgcgctggct

SEQ ID NO: 218603 - DNA, 25 bp, Mus musculus
caagaaagaaatggcaaaagatgtg

SEQ ID NO: 218604 - DNA, 25 bp, Mus musculus
caagaaagagctgaggatcatctgt

SEQ ID NO: 218605 - DNA, 25 bp, Mus musculus
caagaaagagggacgatgggtgatc

SEQ ID NO: 218606 - DNA, 25 bp, Mus musculus
caagaaagagggacggataccaagc

SEQ ID NO: 218607 - DNA, 25 bp, Mus musculus
caagaaagatgacagtgaacgtcct

SEQ ID NO: 218608 - DNA, 25 bp, Mus musculus
caagaaagcaaaagaggagtggttc

SEQ ID NO: 218609 - DNA, 25 bp, Mus musculus
caagaaagcaaaagggaagaaggat

SEQ ID NO: 218610 - DNA, 25 bp, Mus musculus
caagaaagccaacattctcaccgac

SEQ ID NO: 218611 - DNA, 25 bp, Mus musculus
caagaaagctcaggaagtggaggta

SEQ ID NO: 218612 - DNA, 25 bp, Mus musculus
caagaaagctgttcttcctaccagt

SEQ ID NO: 218613 - DNA, 25 bp, Mus musculus
caagaaagcttgatccggagcatct

SEQ ID NO: 218614 - DNA, 25 bp, Mus musculus
caagaaagcttttgaaataggacca

SEQ ID NO: 218615 - DNA, 25 bp, Mus musculus
caagaaagtctcaatcgtccttttt

SEQ ID NO: 218616 - DNA, 25 bp, Mus musculus
caagaaagtgaaagaccattgcagc

SEQ ID NO: 218617 - DNA, 25 bp, Mus musculus
caagaaatacgatgaggatgatgcc

SEQ ID NO: 218618 - DNA, 25 bp, Mus musculus
caagaaatacggtgaagctctgggc

SEQ ID NO: 218619 - DNA, 25 bp, Mus musculus
caagaaatatcacaggctaatgtta

SEQ ID NO: 218620 - DNA, 25 bp, Mus musculus
caagaaatcattcatcgacccagta

SEQ ID NO: 218621 - DNA, 25 bp, Mus musculus
caagaaatccagcgtgcgagaagat

SEQ ID NO: 218622 - DNA, 25 bp, Mus musculus
caagaaatccggcaacttgaattgg

SEQ ID NO: 218623 - DNA, 25 bp, Mus musculus
caagaaatccgggcagtttaggaca

SEQ ID NO: 218624 - DNA, 25 bp, Mus musculus
caagaaatctgcccttagtggggag

SEQ ID NO: 218625 - DNA, 25 bp, Mus musculus
caagaaatgattggtggcttccgga

SEQ ID NO: 218626 - DNA, 25 bp, Mus musculus
caagaaatgcaagattttgctggaa

SEQ ID NO: 218627 - DNA, 25 bp, Mus musculus
caagaaatggaaggtggtgtagtgg

SEQ ID NO: 218628 - DNA, 25 bp, Mus musculus
caagaaatggaagtggctaccaagg

SEQ ID NO: 218629 - DNA, 25 bp, Mus musculus
caagaaatgggaaccccaacagtga

SEQ ID NO: 218630 - DNA, 25 bp, Mus musculus
caagaaatgtatatgcccccaagcc

SEQ ID NO: 218631 - DNA, 25 bp, Mus musculus
caagaaattcagagactgcctcttt

SEQ ID NO: 218632 - DNA, 25 bp, Mus musculus
caagaaatttcaaagaggtaactca

SEQ ID NO: 218633 - DNA, 25 bp, Mus musculus
caagaaatttgccgaggccttggga

SEQ ID NO: 218634 - DNA, 25 bp, Mus musculus
caagaaatttggtgtccagggaagc

SEQ ID NO: 218635 - DNA, 25 bp, Mus musculus
caagaacaaaaaaggcctgatggaa

SEQ ID NO: 218636 - DNA, 25 bp, Mus musculus
caagaacaaacaagatacatttata

SEQ ID NO: 218637 - DNA, 25 bp, Mus musculus
caagaacaaacaagggaatggcgtt

SEQ ID NO: 218638 - DNA, 25 bp, Mus musculus
caagaacaaagatggctgcatgaga

SEQ ID NO: 218639 - DNA, 25 bp, Mus musculus
caagaacaacctggcttcctgctac

SEQ ID NO: 218640 - DNA, 25 bp, Mus musculus
caagaacaacgaagagcaagctgaa

SEQ ID NO: 218641 - DNA, 25 bp, Mus musculus
caagaacaacggctcggaagtggcc

SEQ ID NO: 218642 - DNA, 25 bp, Mus musculus
caagaacaactgaacgtttggatga

SEQ ID NO: 218643 - DNA, 25 bp, Mus musculus
caagaacaaggagttgggagcggta

SEQ ID NO: 218644 - DNA, 25 bp, Mus musculus
caagaacaaggcccagtctgtgcga

SEQ ID NO: 218645 - DNA, 25 bp, Mus musculus
caagaacaaggtgctctgttttggg

SEQ ID NO: 218646 - DNA, 25 bp, Mus musculus
caagaacaatggctcggaagtggcc

SEQ ID NO: 218647 - DNA, 25 bp, Mus musculus
caagaacaccttcagtgagatgatt

SEQ ID NO: 218648 - DNA, 25 bp, Mus musculus
caagaacactgatgaaatcatgcac

SEQ ID NO: 218649 - DNA, 25 bp, Mus musculus
caagaacatccagaacaactggcgg

SEQ ID NO: 218650 - DNA, 25 bp, Mus musculus
caagaacatccaggtcctgcctggc

SEQ ID NO: 218651 - DNA, 25 bp, Mus musculus
caagaacattgcgacgctccaggga

SEQ ID NO: 218652 - DNA, 25 bp, Mus musculus
caagaaccaccataggatacgactt

SEQ ID NO: 218653 - DNA, 25 bp, Mus musculus
caagaaccagacccgagtcagaact

SEQ ID NO: 218654 - DNA, 25 bp, Mus musculus
caagaaccaggcgctcaactccact

SEQ ID NO: 218655 - DNA, 25 bp, Mus musculus
caagaaccatgccgcctgctaagcc

SEQ ID NO: 218656 - DNA, 25 bp, Mus musculus
caagaacccaactgatccccagctc

SEQ ID NO: 218657 - DNA, 25 bp, Mus musculus
caagaacccaggtggaaagcacaag

SEQ ID NO: 218658 - DNA, 25 bp, Mus musculus
caagaacctccaggaggagatctca

SEQ ID NO: 218659 - DNA, 25 bp, Mus musculus
caagaacgaacccaggagttccgac

SEQ ID NO: 218660 - DNA, 25 bp, Mus musculus
caagaactccagtgtttcccgagag

SEQ ID NO: 218661 - DNA, 25 bp, Mus musculus
caagaactgacggcacaggcccgac

SEQ ID NO: 218662 - DNA, 25 bp, Mus musculus
caagaactgacggcactgatggagg

SEQ ID NO: 218663 - DNA, 25 bp, Mus musculus
caagaactgcagaattgagctcctt

SEQ ID NO: 218664 - DNA, 25 bp, Mus musculus
caagaactgctgtctattgcatctg

SEQ ID NO: 218665 - DNA, 25 bp, Mus musculus
caagaactggagcgctgctgggaac

SEQ ID NO: 218666 - DNA, 25 bp, Mus musculus
caagaactgtccagggccaaggaat

SEQ ID NO: 218667 - DNA, 25 bp, Mus musculus
caagaactgtccagggtgaccaacg

SEQ ID NO: 218668 - DNA, 25 bp, Mus musculus
caagaactgtgtttggagtaacaac

SEQ ID NO: 218669 - DNA, 25 bp, Mus musculus
caagaagaaaaagaacgtttgctga

SEQ ID NO: 218670 - DNA, 25 bp, Mus musculus
caagaagaaagagaagcagggtccc

SEQ ID NO: 218671 - DNA, 25 bp, Mus musculus
caagaagaacaaagctgtatgtgat

SEQ ID NO: 218672 - DNA, 25 bp, Mus musculus
caagaagaacaaggatgtccccgtg

SEQ ID NO: 218673 - DNA, 25 bp, Mus musculus
caagaagaactgagattcctactgg

SEQ ID NO: 218674 - DNA, 25 bp, Mus musculus
caagaagaactttcattttcagggg

SEQ ID NO: 218675 - DNA, 25 bp, Mus musculus
caagaagaagaagaggtctaagagt

SEQ ID NO: 218676 - DNA, 25 bp, Mus musculus
caagaagaagaaggcgtcccatgag

SEQ ID NO: 218677 - DNA, 25 bp, Mus musculus
caagaagaagaaggtgccatcagcc

SEQ ID NO: 218678 - DNA, 25 bp, Mus musculus
caagaagaagaaggttttcgcattt

SEQ ID NO: 218679 - DNA, 25 bp, Mus musculus
caagaagaagatgtgttacagcaca

SEQ ID NO: 218680 - DNA, 25 bp, Mus musculus
caagaagaagcaccccactggctat

SEQ ID NO: 218681 - DNA, 25 bp, Mus musculus
caagaagaaggacttttcccctgaa

SEQ ID NO: 218682 - DNA, 25 bp, Mus musculus
caagaagaaggattccaaggaaata

SEQ ID NO: 218683 - DNA, 25 bp, Mus musculus
caagaagaatacaagaagagggcag

SEQ ID NO: 218684 - DNA, 25 bp, Mus musculus
caagaagaatacaagatcaaatgcc

SEQ ID NO: 218685 - DNA, 25 bp, Mus musculus
caagaagaattctaatgttttgtga

SEQ ID NO: 218686 - DNA, 25 bp, Mus musculus
caagaagacaccctgatatctgcac

SEQ ID NO: 218687 - DNA, 25 bp, Mus musculus
caagaagacagagccaagtcagaac

SEQ ID NO: 218688 - DNA, 25 bp, Mus musculus
caagaagacagatgttaaggaagaa

SEQ ID NO: 218689 - DNA, 25 bp, Mus musculus
caagaagacaggtaaacacaagacg

SEQ ID NO: 218690 - DNA, 25 bp, Mus musculus
caagaagacatccctgaagtcagct

SEQ ID NO: 218691 - DNA, 25 bp, Mus musculus
caagaagatagatcctggatgactt

SEQ ID NO: 218692 - DNA, 25 bp, Mus musculus
caagaagatagcgaaacagagataa

SEQ ID NO: 218693 - DNA, 25 bp, Mus musculus
caagaagatcaaggaacgcatccga

SEQ ID NO: 218694 - DNA, 25 bp, Mus musculus
caagaagatgaccgcggagggcatc

SEQ ID NO: 218695 - DNA, 25 bp, Mus musculus
caagaagatggccctctctttcagc

SEQ ID NO: 218696 - DNA, 25 bp, Mus musculus
caagaagatggccgtggcaaccctg

SEQ ID NO: 218697 - DNA, 25 bp, Mus musculus
caagaagcaaggtgaaggctcctcg

SEQ ID NO: 218698 - DNA, 25 bp, Mus musculus
caagaagcacacagatcgcaagtcc

SEQ ID NO: 218699 - DNA, 25 bp, Mus musculus
caagaagcaccagagggtgtcttta

SEQ ID NO: 218700 - DNA, 25 bp, Mus musculus
caagaagcaccagaggtctgagttc

SEQ ID NO: 218701 - DNA, 25 bp, Mus musculus
caagaagcagccctcaggcactgta

SEQ ID NO: 218702 - DNA, 25 bp, Mus musculus
caagaagcagccgatcaaaatccag

SEQ ID NO: 218703 - DNA, 25 bp, Mus musculus
caagaagcaggctcgcagccttcag

SEQ ID NO: 218704 - DNA, 25 bp, Mus musculus
caagaagcaggttgcctagcagagc

SEQ ID NO: 218705 - DNA, 25 bp, Mus musculus
caagaagcagtcgttccccatcagg

SEQ ID NO: 218706 - DNA, 25 bp, Mus musculus
caagaagcagtgtgacgtgctggtg

SEQ ID NO: 218707 - DNA, 25 bp, Mus musculus
caagaagcagttactgccgccttgc

SEQ ID NO: 218708 - DNA, 25 bp, Mus musculus
caagaagccacaggaatcctgacct

SEQ ID NO: 218709 - DNA, 25 bp, Mus musculus
caagaagccacggctttctcagggc

SEQ ID NO: 218710 - DNA, 25 bp, Mus musculus
caagaagcgaccttcctatgaaagg

SEQ ID NO: 218711 - DNA, 25 bp, Mus musculus
caagaagctgctagagcactgggaa

SEQ ID NO: 218712 - DNA, 25 bp, Mus musculus
caagaaggaaaaggtagagcagatc

SEQ ID NO: 218713 - DNA, 25 bp, Mus musculus
caagaaggaaagattgaagactgag

SEQ ID NO: 218714 - DNA, 25 bp, Mus musculus
caagaaggaaagatttctaagctcc

SEQ ID NO: 218715 - DNA, 25 bp, Mus musculus
caagaaggaagcaggaggtgacttt

SEQ ID NO: 218716 - DNA, 25 bp, Mus musculus
caagaaggacctgagggaccgggag

SEQ ID NO: 218717 - DNA, 25 bp, Mus musculus
caagaaggagaacagagaaagcacg

SEQ ID NO: 218718 - DNA, 25 bp, Mus musculus
caagaaggagactggcttttcagtt

SEQ ID NO: 218719 - DNA, 25 bp, Mus musculus
caagaaggagctaattcgatgactg

SEQ ID NO: 218720 - DNA, 25 bp, Mus musculus
caagaaggaggaacaagaatttgtt

SEQ ID NO: 218721 - DNA, 25 bp, Mus musculus
caagaaggaggtggaactgacagag

SEQ ID NO: 218722 - DNA, 25 bp, Mus musculus
caagaaggaggttatgaatgaagtg

SEQ ID NO: 218723 - DNA, 25 bp, Mus musculus
caagaaggagtatggctgtaagaat

SEQ ID NO: 218724 - DNA, 25 bp, Mus musculus
caagaaggcaagattactgtgtagc

SEQ ID NO: 218725 - DNA, 25 bp, Mus musculus
caagaaggcacctgactttgtgttc

SEQ ID NO: 218726 - DNA, 25 bp, Mus musculus
caagaaggccgtcagaactcggtat

SEQ ID NO: 218727 - DNA, 25 bp, Mus musculus
caagaaggccgtcagatgggtttca

SEQ ID NO: 218728 - DNA, 25 bp, Mus musculus
caagaaggccgtcagtgcctgatgc

SEQ ID NO: 218729 - DNA, 25 bp, Mus musculus
caagaagggcaaagatgagtggttc

SEQ ID NO: 218730 - DNA, 25 bp, Mus musculus
caagaagggcagcgccctcggagcc

SEQ ID NO: 218731 - DNA, 25 bp, Mus musculus
caagaagggcagcgtggccaagcgg

SEQ ID NO: 218732 - DNA, 25 bp, Mus musculus
caagaaggtgaaagacactcgtaat

SEQ ID NO: 218733 - DNA, 25 bp, Mus musculus
caagaaggtgaaagtctcacacagg

SEQ ID NO: 218734 - DNA, 25 bp, Mus musculus
caagaagtagaaagatctaaagggg

SEQ ID NO: 218735 - DNA, 25 bp, Mus musculus
caagaagtcagactgtgttgtcaaa

SEQ ID NO: 218736 - DNA, 25 bp, Mus musculus
caagaagtcaggacaaaagactgtg

SEQ ID NO: 218737 - DNA, 25 bp, Mus musculus
caagaagtcctgagtttatccatgc

SEQ ID NO: 218738 - DNA, 25 bp, Mus musculus
caagaagtcctggtctttgcctgcc

SEQ ID NO: 218739 - DNA, 25 bp, Mus musculus
caagaagtcctgtggaagtgtttgt

SEQ ID NO: 218740 - DNA, 25 bp, Mus musculus
caagaagtctagaaattctgtgcaa

SEQ ID NO: 218741 - DNA, 25 bp, Mus musculus
caagaagtctagggcacttgatgca

SEQ ID NO: 218742 - DNA, 25 bp, Mus musculus
caagaagtgagaacggagcacctcc

SEQ ID NO: 218743 - DNA, 25 bp, Mus musculus
caagaagtgaggccgggagcaggct

SEQ ID NO: 218744 - DNA, 25 bp, Mus musculus
caagaagtgcatctggcctcgaact

SEQ ID NO: 218745 - DNA, 25 bp, Mus musculus
caagaagtggaggcaggactctgac

SEQ ID NO: 218746 - DNA, 25 bp, Mus musculus
caagaagttccaacctagatacttg

SEQ ID NO: 218747 - DNA, 25 bp, Mus musculus
caagaagttccaagaccccagatgg

SEQ ID NO: 218748 - DNA, 25 bp, Mus musculus
caagaataacctggcttcctgctac

SEQ ID NO: 218749 - DNA, 25 bp, Mus musculus
caagaatacagggaaaatggagaac

SEQ ID NO: 218750 - DNA, 25 bp, Mus musculus
caagaatacaggtatggttttctaa

SEQ ID NO: 218751 - DNA, 25 bp, Mus musculus
caagaatacatggcaaaagaaaaac

SEQ ID NO: 218752 - DNA, 25 bp, Mus musculus
caagaatatagtcaagttacaagtc

SEQ ID NO: 218753 - DNA, 25 bp, Mus musculus
caagaatatgttgttgatcacatag

SEQ ID NO: 218754 - DNA, 25 bp, Mus musculus
caagaatatttaaaaacatatgaca

SEQ ID NO: 218755 - DNA, 25 bp, Mus musculus
caagaatcaaacatttttaagacaa

SEQ ID NO: 218756 - DNA, 25 bp, Mus musculus
caagaatcacagacgcagtatgaga

SEQ ID NO: 218757 - DNA, 25 bp, Mus musculus
caagaatcacagctcgccaaatcca

SEQ ID NO: 218758 - DNA, 25 bp, Mus musculus
caagaatcagcttcagaggattatc

SEQ ID NO: 218759 - DNA, 25 bp, Mus musculus
caagaatcaggttgtggagttgaca

SEQ ID NO: 218760 - DNA, 25 bp, Mus musculus
caagaatcccaaaagatctagatcc

SEQ ID NO: 218761 - DNA, 25 bp, Mus musculus
caagaatctgaggcctgtgagaagc

SEQ ID NO: 218762 - DNA, 25 bp, Mus musculus
caagaatgaagtgtatcccctactc

SEQ ID NO: 218763 - DNA, 25 bp, Mus musculus
caagaatgacattggctcgtgagct

SEQ ID NO: 218764 - DNA, 25 bp, Mus musculus
caagaatgacatttttgccattggc

SEQ ID NO: 218765 - DNA, 25 bp, Mus musculus
caagaatgaggaaggcacttggtca

SEQ ID NO: 218766 - DNA, 25 bp, Mus musculus
caagaatgccgatggagctgtcttg

SEQ ID NO: 218767 - DNA, 25 bp, Mus musculus
caagaatgcggaaggcacttggtca

SEQ ID NO: 218768 - DNA, 25 bp, Mus musculus
caagaatgctggcagaaggagctaa

SEQ ID NO: 218769 - DNA, 25 bp, Mus musculus
caagaatggcatgattgaggactgg

SEQ ID NO: 218770 - DNA, 25 bp, Mus musculus
caagaatgggataatactgtgaatg

SEQ ID NO: 218771 - DNA, 25 bp, Mus musculus
caagaatgtacgccaggccagcgtc

SEQ ID NO: 218772 - DNA, 25 bp, Mus musculus
caagaatgtagcccggagccttctg

SEQ ID NO: 218773 - DNA, 25 bp, Mus musculus
caagaattaagtcagtggtgcagtc

SEQ ID NO: 218774 - DNA, 25 bp, Mus musculus
caagaattagccctctttgaaccct

SEQ ID NO: 218775 - DNA, 25 bp, Mus musculus
caagaattagccctgtcttcttccc

SEQ ID NO: 218776 - DNA, 25 bp, Mus musculus
caagaattaggactcagtggcaatg

SEQ ID NO: 218777 - DNA, 25 bp, Mus musculus
caagaattaggtaagtggagaaaga

SEQ ID NO: 218778 - DNA, 25 bp, Mus musculus
caagaattccagacacaagtaccca

SEQ ID NO: 218779 - DNA, 25 bp, Mus musculus
caagaattccagacagcttttcaag

SEQ ID NO: 218780 - DNA, 25 bp, Mus musculus
caagaattccattatgtgagctctc

SEQ ID NO: 218781 - DNA, 25 bp, Mus musculus
caagaattcgaagagccacctaaca

SEQ ID NO: 218782 - DNA, 25 bp, Mus musculus
caagaattgccaacagtagtcggaa

SEQ ID NO: 218783 - DNA, 25 bp, Mus musculus
caagaatttgtccagccccagcatc

SEQ ID NO: 218784 - DNA, 25 bp, Mus musculus
caagacaaaagatttgcaacagcat

SEQ ID NO: 218785 - DNA, 25 bp, Mus musculus
caagacaagcaagagtccggccaca

SEQ ID NO: 218786 - DNA, 25 bp, Mus musculus
caagacaagctgaccttcattgaca

SEQ ID NO: 218787 - DNA, 25 bp, Mus musculus
caagacaaggtttctacatgaagga

SEQ ID NO: 218788 - DNA, 25 bp, Mus musculus
caagacaatcattttctctgttgtt

SEQ ID NO: 218789 - DNA, 25 bp, Mus musculus
caagacacaattgaattaaacagac

SEQ ID NO: 218790 - DNA, 25 bp, Mus musculus
caagacacagataagccaggactga

SEQ ID NO: 218791 - DNA, 25 bp, Mus musculus
caagacacccacagggataaggaag

SEQ ID NO: 218792 - DNA, 25 bp, Mus musculus
caagacacccagaatgggctacaca

SEQ ID NO: 218793 - DNA, 25 bp, Mus musculus
caagacacccaggccagccacgctg

SEQ ID NO: 218794 - DNA, 25 bp, Mus musculus
caagacactgcagcggaccttacag

SEQ ID NO: 218795 - DNA, 25 bp, Mus musculus
caagacactgcagttcatcgtggca

SEQ ID NO: 218796 - DNA, 25 bp, Mus musculus
caagacagcacagaccggaagaaag

SEQ ID NO: 218797 - DNA, 25 bp, Mus musculus
caagacagcagcaaaggccgtttgg

SEQ ID NO: 218798 - DNA, 25 bp, Mus musculus
caagacagcagggagtgtgtgcctc

SEQ ID NO: 218799 - DNA, 25 bp, Mus musculus
caagacagcagggtttcaatgccct

SEQ ID NO: 218800 - DNA, 25 bp, Mus musculus
caagacagcgcatagaagctccaca

SEQ ID NO: 218801 - DNA, 25 bp, Mus musculus
caagacagcgcccatgcaggtgctc

SEQ ID NO: 218802 - DNA, 25 bp, Mus musculus
caagacagtgacagccctggagatg

SEQ ID NO: 218803 - DNA, 25 bp, Mus musculus
caagacagtgaggggaaacaggcac

SEQ ID NO: 218804 - DNA, 25 bp, Mus musculus
caagacataatgaaggtttatggag

SEQ ID NO: 218805 - DNA, 25 bp, Mus musculus
caagacatacaggtgtaaggtctgc

SEQ ID NO: 218806 - DNA, 25 bp, Mus musculus
caagacatagctcattctggagtca

SEQ ID NO: 218807 - DNA, 25 bp, Mus musculus
caagacatagtcttgccatgtagcc

SEQ ID NO: 218808 - DNA, 25 bp, Mus musculus
caagacatctatgcagtgaatggga

SEQ ID NO: 218809 - DNA, 25 bp, Mus musculus
caagacatcttcaggcgctttggcc

SEQ ID NO: 218810 - DNA, 25 bp, Mus musculus
caagacatgcagcctctatttaagg

SEQ ID NO: 218811 - DNA, 25 bp, Mus musculus
caagacatggaagggctgggactgc

SEQ ID NO: 218812 - DNA, 25 bp, Mus musculus
caagacattgagggtcacttttcat

SEQ ID NO: 218813 - DNA, 25 bp, Mus musculus
caagacattgatgacctttggcaag

SEQ ID NO: 218814 - DNA, 25 bp, Mus musculus
caagaccaagagaccacagcagttt

SEQ ID NO: 218815 - DNA, 25 bp, Mus musculus
caagaccaagaggttgaaaggaaat

SEQ ID NO: 218816 - DNA, 25 bp, Mus musculus
caagaccaagccccagctgcgatac

SEQ ID NO: 218817 - DNA, 25 bp, Mus musculus
caagaccacaacagcatgtagttca

SEQ ID NO: 218818 - DNA, 25 bp, Mus musculus
caagaccagcaggctagatatggat

SEQ ID NO: 218819 - DNA, 25 bp, Mus musculus
caagaccagcaggttacagtcgggc

SEQ ID NO: 218820 - DNA, 25 bp, Mus musculus
caagaccagggacggtctgactccg

SEQ ID NO: 218821 - DNA, 25 bp, Mus musculus
caagaccaggggttcaaggaaggtg

SEQ ID NO: 218822 - DNA, 25 bp, Mus musculus
caagaccaggtggcaggtatttccc

SEQ ID NO: 218823 - DNA, 25 bp, Mus musculus
caagaccatcaaggcactagatggg

SEQ ID NO: 218824 - DNA, 25 bp, Mus musculus
caagaccattggagaaggagaggaa

SEQ ID NO: 218825 - DNA, 25 bp, Mus musculus
caagacccaaacttactgctcctaa

SEQ ID NO: 218826 - DNA, 25 bp, Mus musculus
caagacccacatctggcaagttccg

SEQ ID NO: 218827 - DNA, 25 bp, Mus musculus
caagacccacgcaaactacagctga

SEQ ID NO: 218828 - DNA, 25 bp, Mus musculus
caagacccagatcctctcttctcca

SEQ ID NO: 218829 - DNA, 25 bp, Mus musculus
caagacccagcccagaacaagcctg

SEQ ID NO: 218830 - DNA, 25 bp, Mus musculus
caagacccagcccaggtgaggaatt

SEQ ID NO: 218831 - DNA, 25 bp, Mus musculus
caagacccagcccaggttccgagtc

SEQ ID NO: 218832 - DNA, 25 bp, Mus musculus
caagacccaggacctgttccgcagg

SEQ ID NO: 218833 - DNA, 25 bp, Mus musculus
caagaccccaggccagcgctcagcc

SEQ ID NO: 218834 - DNA, 25 bp, Mus musculus
caagacccccgctgcaggctttgct

SEQ ID NO: 218835 - DNA, 25 bp, Mus musculus
caagacccccgctggtctcagctat

SEQ ID NO: 218836 - DNA, 25 bp, Mus musculus
caagacccccgctgttggagacagg

SEQ ID NO: 218837 - DNA, 25 bp, Mus musculus
caagaccgactgaagcacggtgcaa

SEQ ID NO: 218838 - DNA, 25 bp, Mus musculus
caagaccggcttctcctcggaccag

SEQ ID NO: 218839 - DNA, 25 bp, Mus musculus
caagacctatccagcccaccagaac

SEQ ID NO: 218840 - DNA, 25 bp, Mus musculus
caagacctattcccgacataggagg

SEQ ID NO: 218841 - DNA, 25 bp, Mus musculus
caagacctccaagatctcctacctc

SEQ ID NO: 218842 - DNA, 25 bp, Mus musculus
caagacctccagagtggtggattgt

SEQ ID NO: 218843 - DNA, 25 bp, Mus musculus
caagacctgcaagccctacctgacc

SEQ ID NO: 218844 - DNA, 25 bp, Mus musculus
caagacctgcaaggaatctccggtt

SEQ ID NO: 218845 - DNA, 25 bp, Mus musculus
caagacctgcaaggtccccaaccct

SEQ ID NO: 218846 - DNA, 25 bp, Mus musculus
caagacctggaggaggtgatcacag

SEQ ID NO: 218847 - DNA, 25 bp, Mus musculus
caagacctggccagtatattattct

SEQ ID NO: 218848 - DNA, 25 bp, Mus musculus
caagaccttcaggatcaagattata

SEQ ID NO: 218849 - DNA, 25 bp, Mus musculus
caagacgaagaatggatacacagca

SEQ ID NO: 218850 - DNA, 25 bp, Mus musculus
caagacgcagctcggtgaggaccat

SEQ ID NO: 218851 - DNA, 25 bp, Mus musculus
caagacggactgaggaaaacaaaaa

SEQ ID NO: 218852 - DNA, 25 bp, Mus musculus
caagacgtcgtgtggcatgtgggca

SEQ ID NO: 218853 - DNA, 25 bp, Mus musculus
caagactaccaacagctcttcgcgg

SEQ ID NO: 218854 - DNA, 25 bp, Mus musculus
caagactaccaagctccacttcgaa

SEQ ID NO: 218855 - DNA, 25 bp, Mus musculus
caagactaccaagtgaacaccttta

SEQ ID NO: 218856 - DNA, 25 bp, Mus musculus
caagactatgactcagacaagctat

SEQ ID NO: 218857 - DNA, 25 bp, Mus musculus
caagactatgcgcaagaaaggaaag

SEQ ID NO: 218858 - DNA, 25 bp, Mus musculus
caagactcagaataagcctgcacga

SEQ ID NO: 218859 - DNA, 25 bp, Mus musculus
caagactccgccacctccgccttac

SEQ ID NO: 218860 - DNA, 25 bp, Mus musculus
caagactccgtgtgtcacattagct

SEQ ID NO: 218861 - DNA, 25 bp, Mus musculus
caagactctcagaccaaatacacac

SEQ ID NO: 218862 - DNA, 25 bp, Mus musculus
caagactgactccgtatgaggttga

SEQ ID NO: 218863 - DNA, 25 bp, Mus musculus
caagactgctccagggaaaatagag

SEQ ID NO: 218864 - DNA, 25 bp, Mus musculus
caagactgctccaggtcctggaggc

SEQ ID NO: 218865 - DNA, 25 bp, Mus musculus
caagactgctgacagaaatcttaaa

SEQ ID NO: 218866 - DNA, 25 bp, Mus musculus
caagactggatactgcctgtgcctc

SEQ ID NO: 218867 - DNA, 25 bp, Mus musculus
caagactggatactggtaacagcat

SEQ ID NO: 218868 - DNA, 25 bp, Mus musculus
caagactggcaaggttactttggag

SEQ ID NO: 218869 - DNA, 25 bp, Mus musculus
caagactggcacatgaggtcgggtg

SEQ ID NO: 218870 - DNA, 25 bp, Mus musculus
caagactgtccacagatacttggat

SEQ ID NO: 218871 - DNA, 25 bp, Mus musculus
caagactgtggagaccacagacagc

SEQ ID NO: 218872 - DNA, 25 bp, Mus musculus
caagactgtggaggtcttctgcgag

SEQ ID NO: 218873 - DNA, 25 bp, Mus musculus
caagacttcacactgttccaggctt

SEQ ID NO: 218874 - DNA, 25 bp, Mus musculus
caagacttcaccacagtgtttacaa

SEQ ID NO: 218875 - DNA, 25 bp, Mus musculus
caagacttgccgggtggagacagag

SEQ ID NO: 218876 - DNA, 25 bp, Mus musculus
caagagaaaagaaccaagaaagaag

SEQ ID NO: 218877 - DNA, 25 bp, Mus musculus
caagagaaagccttgtttgcagtcc

SEQ ID NO: 218878 - DNA, 25 bp, Mus musculus
caagagaaaggttcaattttatata

SEQ ID NO: 218879 - DNA, 25 bp, Mus musculus
caagagaaccggcatggagagtaga

SEQ ID NO: 218880 - DNA, 25 bp, Mus musculus
caagagaagagacactgcagcggaa

SEQ ID NO: 218881 - DNA, 25 bp, Mus musculus
caagagaagcccgagttcgtgagtg

SEQ ID NO: 218882 - DNA, 25 bp, Mus musculus
caagagaaggatgggtagaacaaga

SEQ ID NO: 218883 - DNA, 25 bp, Mus musculus
caagagaatcgagcctagaataccc

SEQ ID NO: 218884 - DNA, 25 bp, Mus musculus
caagagaatgagctgatgttcctgg

SEQ ID NO: 218885 - DNA, 25 bp, Mus musculus
caagagaatgtgctgatgttcctgg

SEQ ID NO: 218886 - DNA, 25 bp, Mus musculus
caagagacagaggctgcttggtgcg

SEQ ID NO: 218887 - DNA, 25 bp, Mus musculus
caagagacagaggctgctttgggag

SEQ ID NO: 218888 - DNA, 25 bp, Mus musculus
caagagacaggaggctgtcctttca

SEQ ID NO: 218889 - DNA, 25 bp, Mus musculus
caagagacatcaaggcagaagactt

SEQ ID NO: 218890 - DNA, 25 bp, Mus musculus
caagagaccaggtgaaaaaactgca

SEQ ID NO: 218891 - DNA, 25 bp, Mus musculus
caagagacgaaagacaatgcagggt

SEQ ID NO: 218892 - DNA, 25 bp, Mus musculus
caagagacgaaagctccggtctgat

SEQ ID NO: 218893 - DNA, 25 bp, Mus musculus
caagagactcacaaggtgaaactaa

SEQ ID NO: 218894 - DNA, 25 bp, Mus musculus
caagagagaaagaatctggaggtga

SEQ ID NO: 218895 - DNA, 25 bp, Mus musculus
caagagagcaaaggcttatttcaaa

SEQ ID NO: 218896 - DNA, 25 bp, Mus musculus
caagagagcaagctcatcattctgg

SEQ ID NO: 218897 - DNA, 25 bp, Mus musculus
caagagagcaggtgtaaaagaagag

SEQ ID NO: 218898 - DNA, 25 bp, Mus musculus
caagagagcatctgattgtggggaa

SEQ ID NO: 218899 - DNA, 25 bp, Mus musculus
caagagatggaatacgaccataagc

SEQ ID NO: 218900 - DNA, 25 bp, Mus musculus
caagagattacaaggagctagagga

SEQ ID NO: 218901 - DNA, 25 bp, Mus musculus
caagagattacaaggctctaaggga

SEQ ID NO: 218902 - DNA, 25 bp, Mus musculus
caagagcaaaatgtttcaaatgtat

SEQ ID NO: 218903 - DNA, 25 bp, Mus musculus
caagagcaaactcagagggcccccc

SEQ ID NO: 218904 - DNA, 25 bp, Mus musculus
caagagcaaactcaggagaggaaac

SEQ ID NO: 218905 - DNA, 25 bp, Mus musculus
caagagcaagaagaagcagaccatt

SEQ ID NO: 218906 - DNA, 25 bp, Mus musculus
caagagcaagaccaggtgctactac

SEQ ID NO: 218907 - DNA, 25 bp, Mus musculus
caagagcaagcagaaacacaggaaa

SEQ ID NO: 218908 - DNA, 25 bp, Mus musculus
caagagcaagcaggaaaaggaagtt

SEQ ID NO: 218909 - DNA, 25 bp, Mus musculus
caagagcaagctaacgcctactctg

SEQ ID NO: 218910 - DNA, 25 bp, Mus musculus
caagagcaaggcgacggtgtggatg

SEQ ID NO: 218911 - DNA, 25 bp, Mus musculus
caagagcaagtttggcgccgagttc

SEQ ID NO: 218912 - DNA, 25 bp, Mus musculus
caagagcacacattgaaaagggcag

SEQ ID NO: 218913 - DNA, 25 bp, Mus musculus
caagagcagaggaagctgaaccaat

SEQ ID NO: 218914 - DNA, 25 bp, Mus musculus
caagagcaggagaacaaaatccagt

SEQ ID NO: 218915 - DNA, 25 bp, Mus musculus
caagagcaggagcgcctttgacctg

SEQ ID NO: 218916 - DNA, 25 bp, Mus musculus
caagagcagggccagatgtagtgct

SEQ ID NO: 218917 - DNA, 25 bp, Mus musculus
caagagcagggccagtgctgagcag

SEQ ID NO: 218918 - DNA, 25 bp, Mus musculus
caagagcatcctggtgaccagccag

SEQ ID NO: 218919 - DNA, 25 bp, Mus musculus
caagagccagatggtccagcgctca

SEQ ID NO: 218920 - DNA, 25 bp, Mus musculus
caagagccagcagcagcagcagcag

SEQ ID NO: 218921 - DNA, 25 bp, Mus musculus
caagagcccacagtcgaaggatctc

SEQ ID NO: 218922 - DNA, 25 bp, Mus musculus
caagagccccagaaccaaggctctg

SEQ ID NO: 218923 - DNA, 25 bp, Mus musculus
caagagcgaggaagaggaagtagtc

SEQ ID NO: 218924 - DNA, 25 bp, Mus musculus
caagagcgagggtccagattataga

SEQ ID NO: 218925 - DNA, 25 bp, Mus musculus
caagagcgatatgagatcgtgggga

SEQ ID NO: 218926 - DNA, 25 bp, Mus musculus
caagagcgatgtggtatgccctgat

SEQ ID NO: 218927 - DNA, 25 bp, Mus musculus
caagagcgatgtgtggtccttcggt

SEQ ID NO: 218928 - DNA, 25 bp, Mus musculus
caagagcgcagatctcccctagcct

SEQ ID NO: 218929 - DNA, 25 bp, Mus musculus
caagagcgcaggtccaacttcagtg

SEQ ID NO: 218930 - DNA, 25 bp, Mus musculus
caagagctcagctttgggattccct

SEQ ID NO: 218931 - DNA, 25 bp, Mus musculus
caagagctccggctctgaagtgtcc

SEQ ID NO: 218932 - DNA, 25 bp, Mus musculus
caagagctccgggtctgaagtgtcc

SEQ ID NO: 218933 - DNA, 25 bp, Mus musculus
caagagctctcagcacgggggcgtg

SEQ ID NO: 218934 - DNA, 25 bp, Mus musculus
caagagctctcaggtactgtactga

SEQ ID NO: 218935 - DNA, 25 bp, Mus musculus
caagagctctcaggttcctcagtgg

SEQ ID NO: 218936 - DNA, 25 bp, Mus musculus
caagagctgaagtgggagaaaaaac

SEQ ID NO: 218937 - DNA, 25 bp, Mus musculus
caagagctgggagatcatcacagtt

SEQ ID NO: 218938 - DNA, 25 bp, Mus musculus
caagagctggggtctgatcttgctc

SEQ ID NO: 218939 - DNA, 25 bp, Mus musculus
caagagcttcctgagcctcctcttt

SEQ ID NO: 218940 - DNA, 25 bp, Mus musculus
caagagcttctactggtgcagtcag

SEQ ID NO: 218941 - DNA, 25 bp, Mus musculus
caagagcttctgagtctatcctgaa

SEQ ID NO: 218942 - DNA, 25 bp, Mus musculus
caagagcttgtcagaatcaggtctg

SEQ ID NO: 218943 - DNA, 25 bp, Mus musculus
caagagcttgtcagtatcaggtctg

SEQ ID NO: 218944 - DNA, 25 bp, Mus musculus
caagagctttctatccaaggagaca

SEQ ID NO: 218945 - DNA, 25 bp, Mus musculus
caagaggaaagacaaagtcagcata

SEQ ID NO: 218946 - DNA, 25 bp, Mus musculus
caagaggaaagacagctacaaccaa

SEQ ID NO: 218947 - DNA, 25 bp, Mus musculus
caagaggaaaggtaccagcagtgct

SEQ ID NO: 218948 - DNA, 25 bp, Mus musculus
caagaggaaatacagaagcttaaca

SEQ ID NO: 218949 - DNA, 25 bp, Mus musculus
caagaggaaattgatgagctccttc

SEQ ID NO: 218950 - DNA, 25 bp, Mus musculus
caagaggaagaagtccaggaggaag

SEQ ID NO: 218951 - DNA, 25 bp, Mus musculus
caagaggaagaggaagtccaagaag

SEQ ID NO: 218952 - DNA, 25 bp, Mus musculus
caagaggaaggcagtagagtccatc

SEQ ID NO: 218953 - DNA, 25 bp, Mus musculus
caagaggaaggccgaggatgagagc

SEQ ID NO: 218954 - DNA, 25 bp, Mus musculus
caagaggaaggctacgtgttctgta

SEQ ID NO: 218955 - DNA, 25 bp, Mus musculus
caagaggacggtgtgccgatgctct

SEQ ID NO: 218956 - DNA, 25 bp, Mus musculus
caagaggagccatgaatgtatcatt

SEQ ID NO: 218957 - DNA, 25 bp, Mus musculus
caagaggagggggcatgaatcctac

SEQ ID NO: 218958 - DNA, 25 bp, Mus musculus
caagaggaggggttatcatgctttt

SEQ ID NO: 218959 - DNA, 25 bp, Mus musculus
caagaggatctctgggtctgaaaag

SEQ ID NO: 218960 - DNA, 25 bp, Mus musculus
caagaggatgagatcgactggggtg

SEQ ID NO: 218961 - DNA, 25 bp, Mus musculus
caagaggcaagacctggggatctgg

SEQ ID NO: 218962 - DNA, 25 bp, Mus musculus
caagaggcacaggctcgaagcacca

SEQ ID NO: 218963 - DNA, 25 bp, Mus musculus
caagaggcagagggtgctctggcct

SEQ ID NO: 218964 - DNA, 25 bp, Mus musculus
caagaggcagatcagcagggatggc

SEQ ID NO: 218965 - DNA, 25 bp, Mus musculus
caagaggcagatgggcatatcaagt

SEQ ID NO: 218966 - DNA, 25 bp, Mus musculus
caagaggcagccaggagcccttgaa

SEQ ID NO: 218967 - DNA, 25 bp, Mus musculus
caagaggcagggtgctgaggggtgg

SEQ ID NO: 218968 - DNA, 25 bp, Mus musculus
caagaggcggctcaggtgttataga

SEQ ID NO: 218969 - DNA, 25 bp, Mus musculus
caagaggcggctcaggtttctccca

SEQ ID NO: 218970 - DNA, 25 bp, Mus musculus
caagaggctttggtcatccagcact

SEQ ID NO: 218971 - DNA, 25 bp, Mus musculus
caagagggagagaatatgctggctt

SEQ ID NO: 218972 - DNA, 25 bp, Mus musculus
caagagggagatccacttaaatgga

SEQ ID NO: 218973 - DNA, 25 bp, Mus musculus
caagagggcgaggcagaggtagagg

SEQ ID NO: 218974 - DNA, 25 bp, Mus musculus
caagaggtcagagacacctaccgct

SEQ ID NO: 218975 - DNA, 25 bp, Mus musculus
caagagtaaacgcaggtgacctggc

SEQ ID NO: 218976 - DNA, 25 bp, Mus musculus
caagagtaatgaggactctctgatt

SEQ ID NO: 218977 - DNA, 25 bp, Mus musculus
caagagtattcggggaaacctcaac

SEQ ID NO: 218978 - DNA, 25 bp, Mus musculus
caagagtcagacgaaggaagaacag

SEQ ID NO: 218979 - DNA, 25 bp, Mus musculus
caagagtcggacaataataaaagac

SEQ ID NO: 218980 - DNA, 25 bp, Mus musculus
caagagtcggccacaggttgtgttt

SEQ ID NO: 218981 - DNA, 25 bp, Mus musculus
caagagtctggacaacatgtgcatc

SEQ ID NO: 218982 - DNA, 25 bp, Mus musculus
caagagtcttctctggcttttctca

SEQ ID NO: 218983 - DNA, 25 bp, Mus musculus
caagagtcttctctgtcacttgcct

SEQ ID NO: 218984 - DNA, 25 bp, Mus musculus
caagagtgaccagccgtgggaatgg

SEQ ID NO: 218985 - DNA, 25 bp, Mus musculus
caagagtgagagtggatcatgaccc

SEQ ID NO: 218986 - DNA, 25 bp, Mus musculus
caagagtgagggtgatctgcaattc

SEQ ID NO: 218987 - DNA, 25 bp, Mus musculus
caagagtgccaggctgaacctgtgg

SEQ ID NO: 218988 - DNA, 25 bp, Mus musculus
caagagtttggcagagtatacgaag

SEQ ID NO: 218989 - DNA, 25 bp, Mus musculus
caagagtttggcagtgtcaaaggtc

SEQ ID NO: 218990 - DNA, 25 bp, Mus musculus
caagataaagctcacttcaattgct

SEQ ID NO: 218991 - DNA, 25 bp, Mus musculus
caagataaataggtgaggctgctgg

SEQ ID NO: 218992 - DNA, 25 bp, Mus musculus
caagataaatagttcaattatcaga

SEQ ID NO: 218993 - DNA, 25 bp, Mus musculus
caagataagagatatgccagaattt

SEQ ID NO: 218994 - DNA, 25 bp, Mus musculus
caagataaggatggtagaggtggca

SEQ ID NO: 218995 - DNA, 25 bp, Mus musculus
caagataaggcactcctgcagatgg

SEQ ID NO: 218996 - DNA, 25 bp, Mus musculus
caagataataaaggtagtggatggc

SEQ ID NO: 218997 - DNA, 25 bp, Mus musculus
caagataataaagtacaaaatggtt

SEQ ID NO: 218998 - DNA, 25 bp, Mus musculus
caagatacacggcatcatcgcagaa

SEQ ID NO: 218999 - DNA, 25 bp, Mus musculus
caagatacagccctgctggtagctg

SEQ ID NO: 219000 - DNA, 25 bp, Mus musculus
caagatacaggaagactccttctaa

SEQ ID NO: 219001 - DNA, 25 bp, Mus musculus
caagatactgggatctcgctggaaa

SEQ ID NO: 219002 - DNA, 25 bp, Mus musculus
caagatactggggtctcactatgca

SEQ ID NO: 219003 - DNA, 25 bp, Mus musculus
caagatagcgggacacggctcttaa

SEQ ID NO: 219004 - DNA, 25 bp, Mus musculus
caagatataaaattcacagaggaga

SEQ ID NO: 219005 - DNA, 25 bp, Mus musculus
caagatatcgactgatatcttctct

SEQ ID NO: 219006 - DNA, 25 bp, Mus musculus
caagatatggaggccaggaaacaag

SEQ ID NO: 219007 - DNA, 25 bp, Mus musculus
caagatatgtggtgacatccacggg

SEQ ID NO: 219008 - DNA, 25 bp, Mus musculus
caagatattggttctgaagactatt

SEQ ID NO: 219009 - DNA, 25 bp, Mus musculus
caagatcaaagcctcagcgttctca

SEQ ID NO: 219010 - DNA, 25 bp, Mus musculus
caagatcaagccccacctgatgagc

SEQ ID NO: 219011 - DNA, 25 bp, Mus musculus
caagatcaagcttctcttgcaggta

SEQ ID NO: 219012 - DNA, 25 bp, Mus musculus
caagatcaaggcattatgttatcac

SEQ ID NO: 219013 - DNA, 25 bp, Mus musculus
caagatcaatcaagatgactgtgat

SEQ ID NO: 219014 - DNA, 25 bp, Mus musculus
caagatcacttcaagtgggtaaagc

SEQ ID NO: 219015 - DNA, 25 bp, Mus musculus
caagatcagaggatcccactgacct

SEQ ID NO: 219016 - DNA, 25 bp, Mus musculus
caagatcagcaagcagcttcaggat

SEQ ID NO: 219017 - DNA, 25 bp, Mus musculus
caagatcagcaagctgattaccagg

SEQ ID NO: 219018 - DNA, 25 bp, Mus musculus
caagatcatccggaagaagattcct

SEQ ID NO: 219019 - DNA, 25 bp, Mus musculus
caagatcatgggtgtggctggaggg

SEQ ID NO: 219020 - DNA, 25 bp, Mus musculus
caagatccacaaagaggcggttaca

SEQ ID NO: 219021 - DNA, 25 bp, Mus musculus
caagatccagacaacggccccacct

SEQ ID NO: 219022 - DNA, 25 bp, Mus musculus
caagatccagatcttactctagcac

SEQ ID NO: 219023 - DNA, 25 bp, Mus musculus
caagatccagtccccgctgctgcct

SEQ ID NO: 219024 - DNA, 25 bp, Mus musculus
caagatccatctaaatgggtacaag

SEQ ID NO: 219025 - DNA, 25 bp, Mus musculus
caagatcccagtgattatagagcga

SEQ ID NO: 219026 - DNA, 25 bp, Mus musculus
caagatccctgcaaggaaagagtgc

SEQ ID NO: 219027 - DNA, 25 bp, Mus musculus
caagatccgagccttcatcctcccc

SEQ ID NO: 219028 - DNA, 25 bp, Mus musculus
caagatcctaaaaatactcttgcga

SEQ ID NO: 219029 - DNA, 25 bp, Mus musculus
caagatcctgcttgagaaaagcacg

SEQ ID NO: 219030 - DNA, 25 bp, Mus musculus
caagatcctggagcacttggaatct

SEQ ID NO: 219031 - DNA, 25 bp, Mus musculus
caagatccttctttgttgggtggga

SEQ ID NO: 219032 - DNA, 25 bp, Mus musculus
caagatcgaaataaattgaaaaaca

SEQ ID NO: 219033 - DNA, 25 bp, Mus musculus
caagatcgcctccagcctatttaag

SEQ ID NO: 219034 - DNA, 25 bp, Mus musculus
caagatcgcctccaggccagcagca

SEQ ID NO: 219035 - DNA, 25 bp, Mus musculus
caagatctcggtggatatgttctct

SEQ ID NO: 219036 - DNA, 25 bp, Mus musculus
caagatctgaaagttgggatggcta

SEQ ID NO: 219037 - DNA, 25 bp, Mus musculus
caagatctgacaaggacccacattg

SEQ ID NO: 219038 - DNA, 25 bp, Mus musculus
caagatctgcactgaacagtcaaat

SEQ ID NO: 219039 - DNA, 25 bp, Mus musculus
caagatctgcccagaggacgaggcg

SEQ ID NO: 219040 - DNA, 25 bp, Mus musculus
caagatctttaaaaggctactgaaa

SEQ ID NO: 219041 - DNA, 25 bp, Mus musculus
caagatgaagggcagagggaaggct

SEQ ID NO: 219042 - DNA, 25 bp, Mus musculus
caagatgaagggcaggctccggctt

SEQ ID NO: 219043 - DNA, 25 bp, Mus musculus
caagatgaaggtctcagatctgaca

SEQ ID NO: 219044 - DNA, 25 bp, Mus musculus
caagatgactaagatgctaaaagga

SEQ ID NO: 219045 - DNA, 25 bp, Mus musculus
caagatgagacaggagacaatcagg

SEQ ID NO: 219046 - DNA, 25 bp, Mus musculus
caagatgagcagctgtggcggcttt

SEQ ID NO: 219047 - DNA, 25 bp, Mus musculus
caagatgagtatgggaagagtcact

SEQ ID NO: 219048 - DNA, 25 bp, Mus musculus
caagatgagtctcaggaacctgaca

SEQ ID NO: 219049 - DNA, 25 bp, Mus musculus
caagatgagtctcaggttccacgag

SEQ ID NO: 219050 - DNA, 25 bp, Mus musculus
caagatgatagggatgcaaacttgg

SEQ ID NO: 219051 - DNA, 25 bp, Mus musculus
caagatgatctctgggacctggaat

SEQ ID NO: 219052 - DNA, 25 bp, Mus musculus
caagatgatgaggctgagaaggcag

SEQ ID NO: 219053 - DNA, 25 bp, Mus musculus
caagatgcagacgacctggaggaag

SEQ ID NO: 219054 - DNA, 25 bp, Mus musculus
caagatgcaggccccttcccagtga

SEQ ID NO: 219055 - DNA, 25 bp, Mus musculus
caagatgcagggttccaagcgtgtc

SEQ ID NO: 219056 - DNA, 25 bp, Mus musculus
caagatgcagtacccccacttcctg

SEQ ID NO: 219057 - DNA, 25 bp, Mus musculus
caagatgcagtatggtggggctccc

SEQ ID NO: 219058 - DNA, 25 bp, Mus musculus
caagatgcctttgacgtcctattac

SEQ ID NO: 219059 - DNA, 25 bp, Mus musculus
caagatgcgccagcgcactgccaac

SEQ ID NO: 219060 - DNA, 25 bp, Mus musculus
caagatgctaatggcccagatggag

SEQ ID NO: 219061 - DNA, 25 bp, Mus musculus
caagatgctaatggcctctttatgg

SEQ ID NO: 219062 - DNA, 25 bp, Mus musculus
caagatgctaatggcctggtccaga

SEQ ID NO: 219063 - DNA, 25 bp, Mus musculus
caagatgctaggcaagtcttggaag

SEQ ID NO: 219064 - DNA, 25 bp, Mus musculus
caagatggaagaaaatctgggtttg

SEQ ID NO: 219065 - DNA, 25 bp, Mus musculus
caagatggaagggctctctaaatac

SEQ ID NO: 219066 - DNA, 25 bp, Mus musculus
caagatggaggagatcgggcgcatc

SEQ ID NO: 219067 - DNA, 25 bp, Mus musculus
caagatggaggagattgggaggatt

SEQ ID NO: 219068 - DNA, 25 bp, Mus musculus
caagatggcagagctcgtcagtgtc

SEQ ID NO: 219069 - DNA, 25 bp, Mus musculus
caagatgggaggcacctccaagtgg

SEQ ID NO: 219070 - DNA, 25 bp, Mus musculus
caagatgtacagaagtttgcccggc

SEQ ID NO: 219071 - DNA, 25 bp, Mus musculus
caagatgtaccttgaaaccatgtag

SEQ ID NO: 219072 - DNA, 25 bp, Mus musculus
caagatgtaccttgaaaccatgtga

SEQ ID NO: 219073 - DNA, 25 bp, Mus musculus
caagatgtcgccctgatgattcggg

SEQ ID NO: 219074 - DNA, 25 bp, Mus musculus
caagatgtctgacagaacagtaaac

SEQ ID NO: 219075 - DNA, 25 bp, Mus musculus
caagatgtctgtatggggagagatt

SEQ ID NO: 219076 - DNA, 25 bp, Mus musculus
caagatgtggaaaaagccaaacctt

SEQ ID NO: 219077 - DNA, 25 bp, Mus musculus
caagatgtggaaaaagccacaaatg

SEQ ID NO: 219078 - DNA, 25 bp, Mus musculus
caagatgtggcaatccccagagagg

SEQ ID NO: 219079 - DNA, 25 bp, Mus musculus
caagatgttattgcttcaggagctc

SEQ ID NO: 219080 - DNA, 25 bp, Mus musculus
caagattaaagctaaggaatattgt

SEQ ID NO: 219081 - DNA, 25 bp, Mus musculus
caagattaaaggaaccaatgaagat

SEQ ID NO: 219082 - DNA, 25 bp, Mus musculus
caagattaagagctgggccagcaag

SEQ ID NO: 219083 - DNA, 25 bp, Mus musculus
caagattaatgaaccaccaaagcca

SEQ ID NO: 219084 - DNA, 25 bp, Mus musculus
caagattacggccgaagactgtact

SEQ ID NO: 219085 - DNA, 25 bp, Mus musculus
caagattacggtacagcaagggaga

SEQ ID NO: 219086 - DNA, 25 bp, Mus musculus
caagattagaaggacctcttcctga

SEQ ID NO: 219087 - DNA, 25 bp, Mus musculus
caagattatccagagtcctattgtc

SEQ ID NO: 219088 - DNA, 25 bp, Mus musculus
caagattatccagggaaaggaagat

SEQ ID NO: 219089 - DNA, 25 bp, Mus musculus
caagattcaaaaggataaaccagaa

SEQ ID NO: 219090 - DNA, 25 bp, Mus musculus
caagattccagaaggagaaaaaaaa

SEQ ID NO: 219091 - DNA, 25 bp, Mus musculus
caagattgcagagaacaatgaccta

SEQ ID NO: 219092 - DNA, 25 bp, Mus musculus
caagattgcagagtgaaccatgagc

SEQ ID NO: 219093 - DNA, 25 bp, Mus musculus
caagattgctccaagtaaggccccc

SEQ ID NO: 219094 - DNA, 25 bp, Mus musculus
caagatttggacgacagtgatcaca

SEQ ID NO: 219095 - DNA, 25 bp, Mus musculus
caagatttggattcaagtcaatctg

SEQ ID NO: 219096 - DNA, 25 bp, Mus musculus
caagattttagtttgggatcaaagc

SEQ ID NO: 219097 - DNA, 25 bp, Mus musculus
caagcaaaaagctattgaccttctg

SEQ ID NO: 219098 - DNA, 25 bp, Mus musculus
caagcaaaactgaaggatctgaacc

SEQ ID NO: 219099 - DNA, 25 bp, Mus musculus
caagcaaaactgaaggatggcgtgg

SEQ ID NO: 219100 - DNA, 25 bp, Mus musculus
caagcaaacccaggaagagcggtcg

SEQ ID NO: 219101 - DNA, 25 bp, Mus musculus
caagcaaacccaggagacacaccct

SEQ ID NO: 219102 - DNA, 25 bp, Mus musculus
caagcaaacccagttgagcaaaaag

SEQ ID NO: 219103 - DNA, 25 bp, Mus musculus
caagcaaagagaaagaaaaatttcc

SEQ ID NO: 219104 - DNA, 25 bp, Mus musculus
caagcaaatgatcaaacttcaagag

SEQ ID NO: 219105 - DNA, 25 bp, Mus musculus
caagcaacagcaaatgaagctggtg

SEQ ID NO: 219106 - DNA, 25 bp, Mus musculus
caagcaagaaggcacttgctatcag

SEQ ID NO: 219107 - DNA, 25 bp, Mus musculus
caagcaagcagacttgtccttctca

SEQ ID NO: 219108 - DNA, 25 bp, Mus musculus
caagcaagcagcaggagaaaaaaat

SEQ ID NO: 219109 - DNA, 25 bp, Mus musculus
caagcaagcagttgtttcttgagat

SEQ ID NO: 219110 - DNA, 25 bp, Mus musculus
caagcaagtcagaaggcttcggagt

SEQ ID NO: 219111 - DNA, 25 bp, Mus musculus
caagcaagtcagaagttttggggtt

SEQ ID NO: 219112 - DNA, 25 bp, Mus musculus
caagcaagtgcaaagaaacgatgac

SEQ ID NO: 219113 - DNA, 25 bp, Mus musculus
caagcaataaaattcatataaacct

SEQ ID NO: 219114 - DNA, 25 bp, Mus musculus
caagcaatacaaagcttcaagaaaa

SEQ ID NO: 219115 - DNA, 25 bp, Mus musculus
caagcaatacaaagtacctacgcat

SEQ ID NO: 219116 - DNA, 25 bp, Mus musculus
caagcaatcaaggctttacaagatg

SEQ ID NO: 219117 - DNA, 25 bp, Mus musculus
caagcacaaggtgagactgtggaga

SEQ ID NO: 219118 - DNA, 25 bp, Mus musculus
caagcacaatggcatctgtaagcac

SEQ ID NO: 219119 - DNA, 25 bp, Mus musculus
caagcacacagggttttggtaaaac

SEQ ID NO: 219120 - DNA, 25 bp, Mus musculus
caagcacacagttcctagtcactcg

SEQ ID NO: 219121 - DNA, 25 bp, Mus musculus
caagcacagacaaagtggacaccat

SEQ ID NO: 219122 - DNA, 25 bp, Mus musculus
caagcacatcaaggaacagagagac

SEQ ID NO: 219123 - DNA, 25 bp, Mus musculus
caagcacatcgtatggcgcccagaa

SEQ ID NO: 219124 - DNA, 25 bp, Mus musculus
caagcaccaagagcccgaccgtccg

SEQ ID NO: 219125 - DNA, 25 bp, Mus musculus
caagcaccagaatgcaagggtgtca

SEQ ID NO: 219126 - DNA, 25 bp, Mus musculus
caagcaccagctgcgatactatgac

SEQ ID NO: 219127 - DNA, 25 bp, Mus musculus
caagcacccaatgtcagaatacaag

SEQ ID NO: 219128 - DNA, 25 bp, Mus musculus
caagcaccccccaaggatcgtgaac

SEQ ID NO: 219129 - DNA, 25 bp, Mus musculus
caagcaccctcagcagtcccgtcta

SEQ ID NO: 219130 - DNA, 25 bp, Mus musculus
caagcaccctcagggaacagaagtc

SEQ ID NO: 219131 - DNA, 25 bp, Mus musculus
caagcaccggaacaggttcaagttc

SEQ ID NO: 219132 - DNA, 25 bp, Mus musculus
caagcacctatgagagtcatcagag

SEQ ID NO: 219133 - DNA, 25 bp, Mus musculus
caagcacctatgagtacttacagct

SEQ ID NO: 219134 - DNA, 25 bp, Mus musculus
caagcaccttggacaaagtctcgac

SEQ ID NO: 219135 - DNA, 25 bp, Mus musculus
caagcacgatctggagatgaaacca

SEQ ID NO: 219136 - DNA, 25 bp, Mus musculus
caagcacgatctggatatgatgaat

SEQ ID NO: 219137 - DNA, 25 bp, Mus musculus
caagcacgcacctggaagggtctgt

SEQ ID NO: 219138 - DNA, 25 bp, Mus musculus
caagcacgggaaagaaaacaaacat

SEQ ID NO: 219139 - DNA, 25 bp, Mus musculus
caagcacgggaaagaaacactcatc

SEQ ID NO: 219140 - DNA, 25 bp, Mus musculus
caagcacggggcgggggcagagatc

SEQ ID NO: 219141 - DNA, 25 bp, Mus musculus
caagcacgtggttgaagacttgatt

SEQ ID NO: 219142 - DNA, 25 bp, Mus musculus
caagcactatcccgctcgggcaaag

SEQ ID NO: 219143 - DNA, 25 bp, Mus musculus
caagcactctcaggctaccggctct

SEQ ID NO: 219144 - DNA, 25 bp, Mus musculus
caagcactggcaggtccaggaggtc

SEQ ID NO: 219145 - DNA, 25 bp, Mus musculus
caagcagaaaatgagtccactcgac

SEQ ID NO: 219146 - DNA, 25 bp, Mus musculus
caagcagaacagccttccagaaatg

SEQ ID NO: 219147 - DNA, 25 bp, Mus musculus
caagcagaacagggcggcagatcaa

SEQ ID NO: 219148 - DNA, 25 bp, Mus musculus
caagcagaacaggtttgccagatct

SEQ ID NO: 219149 - DNA, 25 bp, Mus musculus
caagcagaacctggattcagatggt

SEQ ID NO: 219150 - DNA, 25 bp, Mus musculus
caagcagaacctgggggctaaactc

SEQ ID NO: 219151 - DNA, 25 bp, Mus musculus
caagcagacagaccgtgcgagtcca

SEQ ID NO: 219152 - DNA, 25 bp, Mus musculus
caagcagactaggaatctcgatctg

SEQ ID NO: 219153 - DNA, 25 bp, Mus musculus
caagcagactgggattgtcttgaga

SEQ ID NO: 219154 - DNA, 25 bp, Mus musculus
caagcagagcaaaagactgggaacc

SEQ ID NO: 219155 - DNA, 25 bp, Mus musculus
caagcagagcaaaagggaagcagtg

SEQ ID NO: 219156 - DNA, 25 bp, Mus musculus
caagcagaggaggaggtcacgctca

SEQ ID NO: 219157 - DNA, 25 bp, Mus musculus
caagcagaggcgatgctttttaaat

SEQ ID NO: 219158 - DNA, 25 bp, Mus musculus
caagcagagggttcgcaaagaactt

SEQ ID NO: 219159 - DNA, 25 bp, Mus musculus
caagcagataccgggcccaacgaag

SEQ ID NO: 219160 - DNA, 25 bp, Mus musculus
caagcagataccgggtggggacgac

SEQ ID NO: 219161 - DNA, 25 bp, Mus musculus
caagcagatgaagatcatccatgaa

SEQ ID NO: 219162 - DNA, 25 bp, Mus musculus
caagcagatgggacagcaaagagcc

SEQ ID NO: 219163 - DNA, 25 bp, Mus musculus
caagcagcaacgtcggagtcttcta

SEQ ID NO: 219164 - DNA, 25 bp, Mus musculus
caagcagcagatgcatattgactct

SEQ ID NO: 219165 - DNA, 25 bp, Mus musculus
caagcagcagcccatacaatcctcc

SEQ ID NO: 219166 - DNA, 25 bp, Mus musculus
caagcagcaggagaaaaaaatgctg

SEQ ID NO: 219167 - DNA, 25 bp, Mus musculus
caagcagcaggagacagtgacccgc

SEQ ID NO: 219168 - DNA, 25 bp, Mus musculus
caagcagcaggagatgaggcccgcc

SEQ ID NO: 219169 - DNA, 25 bp, Mus musculus
caagcagcaggggaccagcctcatc

SEQ ID NO: 219170 - DNA, 25 bp, Mus musculus
caagcagcatgcactgcgcaatgag

SEQ ID NO: 219171 - DNA, 25 bp, Mus musculus
caagcagccaccaaggacggaatta

SEQ ID NO: 219172 - DNA, 25 bp, Mus musculus
caagcagccaccaagtgctgagggt

SEQ ID NO: 219173 - DNA, 25 bp, Mus musculus
caagcagccaggccccatgaagctc

SEQ ID NO: 219174 - DNA, 25 bp, Mus musculus
caagcagccaggggactctgatggt

SEQ ID NO: 219175 - DNA, 25 bp, Mus musculus
caagcagccagtctcaatggaaact

SEQ ID NO: 219176 - DNA, 25 bp, Mus musculus
caagcagccgagcctcgggatggat

SEQ ID NO: 219177 - DNA, 25 bp, Mus musculus
caagcagcctccgaaagagcccagt

SEQ ID NO: 219178 - DNA, 25 bp, Mus musculus
caagcagctgacccgactcagcctt

SEQ ID NO: 219179 - DNA, 25 bp, Mus musculus
caagcagctggacagggtccgcaag

SEQ ID NO: 219180 - DNA, 25 bp, Mus musculus
caagcaggaaagcagaaaaccgtca

SEQ ID NO: 219181 - DNA, 25 bp, Mus musculus
caagcaggacagagaagaaggtgca

SEQ ID NO: 219182 - DNA, 25 bp, Mus musculus
caagcaggagaactactttctccag

SEQ ID NO: 219183 - DNA, 25 bp, Mus musculus
caagcaggagccatgcagtggtgcc

SEQ ID NO: 219184 - DNA, 25 bp, Mus musculus
caagcaggaggcagacaaaaagtcc

SEQ ID NO: 219185 - DNA, 25 bp, Mus musculus
caagcaggaggttgaggtgagccgc

SEQ ID NO: 219186 - DNA, 25 bp, Mus musculus
caagcaggcaaggagacggaagagt

SEQ ID NO: 219187 - DNA, 25 bp, Mus musculus
caagcaggcaaggtgaccacattag

SEQ ID NO: 219188 - DNA, 25 bp, Mus musculus
caagcagggaccaggccctctgcca

SEQ ID NO: 219189 - DNA, 25 bp, Mus musculus
caagcagggaccatggttggggtgc

SEQ ID NO: 219190 - DNA, 25 bp, Mus musculus
caagcaggtttttctccaggagtga

SEQ ID NO: 219191 - DNA, 25 bp, Mus musculus
caagcagtcccggctgagtttgaat

SEQ ID NO: 219192 - DNA, 25 bp, Mus musculus
caagcagtgcaagacagcacaccct

SEQ ID NO: 219193 - DNA, 25 bp, Mus musculus
caagcagtgccgaaagtggctatgc

SEQ ID NO: 219194 - DNA, 25 bp, Mus musculus
caagcagtgctagttgggtgcaaag

SEQ ID NO: 219195 - DNA, 25 bp, Mus musculus
caagcagtggaggctctttgccgac

SEQ ID NO: 219196 - DNA, 25 bp, Mus musculus
caagcagtggcatcagaaatttcta

SEQ ID NO: 219197 - DNA, 25 bp, Mus musculus
caagcagtgggaacagcgcttctgc

SEQ ID NO: 219198 - DNA, 25 bp, Mus musculus
caagcagtgggtatatgcttgtcag

SEQ ID NO: 219199 - DNA, 25 bp, Mus musculus
caagcatagcgggtttggcttgtgc

SEQ ID NO: 219200 - DNA, 25 bp, Mus musculus
caagcatcagggggtccgcctacca

SEQ ID NO: 219201 - DNA, 25 bp, Mus musculus
caagcatcaggtgtggagggtgcag

SEQ ID NO: 219202 - DNA, 25 bp, Mus musculus
caagcatccaaatatccagggtatc

SEQ ID NO: 219203 - DNA, 25 bp, Mus musculus
caagcatccagaaggacattcccat

SEQ ID NO: 219204 - DNA, 25 bp, Mus musculus
caagcatccagagcaagaagagtat

SEQ ID NO: 219205 - DNA, 25 bp, Mus musculus
caagcatccagggcttatcagagca

SEQ ID NO: 219206 - DNA, 25 bp, Mus musculus
caagcatcccaggctgcgagacaaa

SEQ ID NO: 219207 - DNA, 25 bp, Mus musculus
caagcatcttctggtaaatccattt

SEQ ID NO: 219208 - DNA, 25 bp, Mus musculus
caagcatgacttaacctgtgtgaac

SEQ ID NO: 219209 - DNA, 25 bp, Mus musculus
caagcatgagggacaaagccccagg

SEQ ID NO: 219210 - DNA, 25 bp, Mus musculus
caagcatgagttatttgctggcgta

SEQ ID NO: 219211 - DNA, 25 bp, Mus musculus
caagcatggatgagttggcagagtt

SEQ ID NO: 219212 - DNA, 25 bp, Mus musculus
caagcatgtgaaagactggaagaag

SEQ ID NO: 219213 - DNA, 25 bp, Mus musculus
caagcatgtgaaagccctctcacca

SEQ ID NO: 219214 - DNA, 25 bp, Mus musculus
caagcattagatatgactgaaatgg

SEQ ID NO: 219215 - DNA, 25 bp, Mus musculus
caagcattcagctccctgcccccca

SEQ ID NO: 219216 - DNA, 25 bp, Mus musculus
caagcattccggagaaaacaacggg

SEQ ID NO: 219217 - DNA, 25 bp, Mus musculus
caagcattccggctactcctggatg

SEQ ID NO: 219218 - DNA, 25 bp, Mus musculus
caagcattgcaggaagaattctttc

SEQ ID NO: 219219 - DNA, 25 bp, Mus musculus
caagcattttctagaaaatggaact

SEQ ID NO: 219220 - DNA, 25 bp, Mus musculus
caagcattttctagatggaagctct

SEQ ID NO: 219221 - DNA, 25 bp, Mus musculus
caagccaaaaggtgaaacctcagga

SEQ ID NO: 219222 - DNA, 25 bp, Mus musculus
caagccaaaggcaccatggctggca

SEQ ID NO: 219223 - DNA, 25 bp, Mus musculus
caagccaactctcctctgctaagta

SEQ ID NO: 219224 - DNA, 25 bp, Mus musculus
caagccaagcccatgtaaaacagac

SEQ ID NO: 219225 - DNA, 25 bp, Mus musculus
caagccacagagcccaagatgattg

SEQ ID NO: 219226 - DNA, 25 bp, Mus musculus
caagccacagcaatgtggggctgga

SEQ ID NO: 219227 - DNA, 25 bp, Mus musculus
caagccacaggatggtgacattata

SEQ ID NO: 219228 - DNA, 25 bp, Mus musculus
caagccacgagaggtgagggagttt

SEQ ID NO: 219229 - DNA, 25 bp, Mus musculus
caagccactctagcagtgttccgaa

SEQ ID NO: 219230 - DNA, 25 bp, Mus musculus
caagccactgaagactgagatacca

SEQ ID NO: 219231 - DNA, 25 bp, Mus musculus
caagccactgacgtggacgacaacc

SEQ ID NO: 219232 - DNA, 25 bp, Mus musculus
caagccactgatgcttctctgcgag

SEQ ID NO: 219233 - DNA, 25 bp, Mus musculus
caagccagaacagcaccgggttgta

SEQ ID NO: 219234 - DNA, 25 bp, Mus musculus
caagccagagagccctggcacaaaa

SEQ ID NO: 219235 - DNA, 25 bp, Mus musculus
caagccagagagtgctcaacctcac

SEQ ID NO: 219236 - DNA, 25 bp, Mus musculus
caagccagagggcacccacaaaact

SEQ ID NO: 219237 - DNA, 25 bp, Mus musculus
caagccagaggtgtttgggaacaag

SEQ ID NO: 219238 - DNA, 25 bp, Mus musculus
caagccagatcgacagcaaagagcc

SEQ ID NO: 219239 - DNA, 25 bp, Mus musculus
caagccagatcgccctacatgaaga

SEQ ID NO: 219240 - DNA, 25 bp, Mus musculus
caagccagcctggagccatcgtggc

SEQ ID NO: 219241 - DNA, 25 bp, Mus musculus
caagccaggaacctctcagtcaaca

SEQ ID NO: 219242 - DNA, 25 bp, Mus musculus
caagccaggaacttctcagccagcc

SEQ ID NO: 219243 - DNA, 25 bp, Mus musculus
caagccagtctggagttggtgtgga

SEQ ID NO: 219244 - DNA, 25 bp, Mus musculus
caagccatcagaaggagtgaaaagg

SEQ ID NO: 219245 - DNA, 25 bp, Mus musculus
caagccatcaggaaatcccttgagg

SEQ ID NO: 219246 - DNA, 25 bp, Mus musculus
caagccatctaagcccagagtgacc

SEQ ID NO: 219247 - DNA, 25 bp, Mus musculus
caagccatgaggcaagaaactacat

SEQ ID NO: 219248 - DNA, 25 bp, Mus musculus
caagccatgatgaacagctcatgcg

SEQ ID NO: 219249 - DNA, 25 bp, Mus musculus
caagccatgctggccaagacggaag

SEQ ID NO: 219250 - DNA, 25 bp, Mus musculus
caagccatggtacactgtgggagca

SEQ ID NO: 219251 - DNA, 25 bp, Mus musculus
caagccattgctgcatgcctgtggt

SEQ ID NO: 219252 - DNA, 25 bp, Mus musculus
caagccattgcttttgggactcgct

SEQ ID NO: 219253 - DNA, 25 bp, Mus musculus
caagcccaacgcaaatctggtgcaa

SEQ ID NO: 219254 - DNA, 25 bp, Mus musculus
caagcccaaggaggataagctaaag

SEQ ID NO: 219255 - DNA, 25 bp, Mus musculus
caagcccaaggctgctgacaaggac

SEQ ID NO: 219256 - DNA, 25 bp, Mus musculus
caagcccaagtatgatcagggagtg

SEQ ID NO: 219257 - DNA, 25 bp, Mus musculus
caagcccaagtgcccaccttgtcct

SEQ ID NO: 219258 - DNA, 25 bp, Mus musculus
caagcccagaagcacagcaagaagg

SEQ ID NO: 219259 - DNA, 25 bp, Mus musculus
caagcccagcagctacattttctta

SEQ ID NO: 219260 - DNA, 25 bp, Mus musculus
caagcccagcagctctactgacagt

SEQ ID NO: 219261 - DNA, 25 bp, Mus musculus
caagcccagctactaaaggagatcc

SEQ ID NO: 219262 - DNA, 25 bp, Mus musculus
caagcccataggaacctggctgctg

SEQ ID NO: 219263 - DNA, 25 bp, Mus musculus
caagcccataggcctggtcagaaag

SEQ ID NO: 219264 - DNA, 25 bp, Mus musculus
caagcccataggttacaaggacagc

SEQ ID NO: 219265 - DNA, 25 bp, Mus musculus
caagcccatcagaaaatcaccgtgc

SEQ ID NO: 219266 - DNA, 25 bp, Mus musculus
caagcccatccaaggttactttgga

SEQ ID NO: 219267 - DNA, 25 bp, Mus musculus
caagcccatgaagtgcccccgcctg

SEQ ID NO: 219268 - DNA, 25 bp, Mus musculus
caagccccaagaggatgattattgg

SEQ ID NO: 219269 - DNA, 25 bp, Mus musculus
caagccccagcttatcaagtacggg

SEQ ID NO: 219270 - DNA, 25 bp, Mus musculus
caagccccagggcagtcctttacta

SEQ ID NO: 219271 - DNA, 25 bp, Mus musculus
caagccccagggtgccacctcctcc

SEQ ID NO: 219272 - DNA, 25 bp, Mus musculus
caagcccccaaaggttgctttcact

SEQ ID NO: 219273 - DNA, 25 bp, Mus musculus
caagccccctcttgaattttctgaa

SEQ ID NO: 219274 - DNA, 25 bp, Mus musculus
caagccccggagaagagccctaggc

SEQ ID NO: 219275 - DNA, 25 bp, Mus musculus
caagccccggagaaggagtgagaga

SEQ ID NO: 219276 - DNA, 25 bp, Mus musculus
caagcccctgccgacacccatcggc

SEQ ID NO: 219277 - DNA, 25 bp, Mus musculus
caagcccctgcgacacctgcggctc

SEQ ID NO: 219278 - DNA, 25 bp, Mus musculus
caagcccgaggccagagcatcccag

SEQ ID NO: 219279 - DNA, 25 bp, Mus musculus
caagcccgaggtctcctctgatgaa

SEQ ID NO: 219280 - DNA, 25 bp, Mus musculus
caagcccggcctcgggtgtttctgt

SEQ ID NO: 219281 - DNA, 25 bp, Mus musculus
caagccctatttcaggaaactccca

SEQ ID NO: 219282 - DNA, 25 bp, Mus musculus
caagccctatttcaggttgtctact

SEQ ID NO: 219283 - DNA, 25 bp, Mus musculus
caagccctcccaatgattttcagaa

SEQ ID NO: 219284 - DNA, 25 bp, Mus musculus
caagccctccgtctggctggttctt

SEQ ID NO: 219285 - DNA, 25 bp, Mus musculus
caagccctctacagtttcaggcctg

SEQ ID NO: 219286 - DNA, 25 bp, Mus musculus
caagccctgtgagcactctgactct

SEQ ID NO: 219287 - DNA, 25 bp, Mus musculus
caagccctgtgaggacctggaacga

SEQ ID NO: 219288 - DNA, 25 bp, Mus musculus
caagccctgtgaggttgaacttccg

SEQ ID NO: 219289 - DNA, 25 bp, Mus musculus
caagcccttcacagtggagattgtg

SEQ ID NO: 219290 - DNA, 25 bp, Mus musculus
caagccgactggcagcaccgagtgc

SEQ ID NO: 219291 - DNA, 25 bp, Mus musculus
caagccgattgccgacgtgttctta

SEQ ID NO: 219292 - DNA, 25 bp, Mus musculus
caagccgcagaccggactccagatt

SEQ ID NO: 219293 - DNA, 25 bp, Mus musculus
caagccgcaggcatgaggtgaacca

SEQ ID NO: 219294 - DNA, 25 bp, Mus musculus
caagccgccattaaggtgtctagtc

SEQ ID NO: 219295 - DNA, 25 bp, Mus musculus
caagccggcatcagctgatttccaa

SEQ ID NO: 219296 - DNA, 25 bp, Mus musculus
caagccgggaagcctatcctctact

SEQ ID NO: 219297 - DNA, 25 bp, Mus musculus
caagccggtctccagcttcctgcgc

SEQ ID NO: 219298 - DNA, 25 bp, Mus musculus
caagccggtctccagtgttcacacc

SEQ ID NO: 219299 - DNA, 25 bp, Mus musculus
caagccggtgccgggctttcaggta

SEQ ID NO: 219300 - DNA, 25 bp, Mus musculus
caagccggtggcccagcctgcagca

SEQ ID NO: 219301 - DNA, 25 bp, Mus musculus
caagccgtaaccgagccccaatcca

SEQ ID NO: 219302 - DNA, 25 bp, Mus musculus
caagcctaagaaacgagcaaaaaat

SEQ ID NO: 219303 - DNA, 25 bp, Mus musculus
caagcctaatatggcggtgtggcta

SEQ ID NO: 219304 - DNA, 25 bp, Mus musculus
caagcctacaaagaggcctttgcca

SEQ ID NO: 219305 - DNA, 25 bp, Mus musculus
caagcctatggagtggcaaaaacta

SEQ ID NO: 219306 - DNA, 25 bp, Mus musculus
caagcctatggagtgttggcagata

SEQ ID NO: 219307 - DNA, 25 bp, Mus musculus
caagcctcaagacgaaagtaggtgg

SEQ ID NO: 219308 - DNA, 25 bp, Mus musculus
caagcctcagcagggatcacatgca

SEQ ID NO: 219309 - DNA, 25 bp, Mus musculus
caagcctcagctgctgttgcaccca

SEQ ID NO: 219310 - DNA, 25 bp, Mus musculus
caagcctcaggattcctctattgaa

SEQ ID NO: 219311 - DNA, 25 bp, Mus musculus
caagcctccagaaatcgacatcacc

SEQ ID NO: 219312 - DNA, 25 bp, Mus musculus
caagcctccgctgggtggtaaatgc

SEQ ID NO: 219313 - DNA, 25 bp, Mus musculus
caagcctcgaaacagaggcgctcca

SEQ ID NO: 219314 - DNA, 25 bp, Mus musculus
caagcctcgaaacatgagcatgccc

SEQ ID NO: 219315 - DNA, 25 bp, Mus musculus
caagcctctctggaactgaaaagct

SEQ ID NO: 219316 - DNA, 25 bp, Mus musculus
caagcctctctggagtccatgtatc

SEQ ID NO: 219317 - DNA, 25 bp, Mus musculus
caagcctctgaactggaaatcccac

SEQ ID NO: 219318 - DNA, 25 bp, Mus musculus
caagcctgagcctgaagagacttgc

SEQ ID NO: 219319 - DNA, 25 bp, Mus musculus
caagcctgaggactgggacaagcca

SEQ ID NO: 219320 - DNA, 25 bp, Mus musculus
caagcctgaggactgggatgaagag

SEQ ID NO: 219321 - DNA, 25 bp, Mus musculus
caagcctgcaaaaggaggtgttcct

SEQ ID NO: 219322 - DNA, 25 bp, Mus musculus
caagcctgccaagaccctaccactg

SEQ ID NO: 219323 - DNA, 25 bp, Mus musculus
caagcctgcggacttgactgcgttg

SEQ ID NO: 219324 - DNA, 25 bp, Mus musculus
caagcctgcggggacttgactgcgt

SEQ ID NO: 219325 - DNA, 25 bp, Mus musculus
caagcctggaggttcatgtctcaac

SEQ ID NO: 219326 - DNA, 25 bp, Mus musculus
caagcctggagttatgcctcttgac

SEQ ID NO: 219327 - DNA, 25 bp, Mus musculus
caagcctggcaagtcacgtgacttc

SEQ ID NO: 219328 - DNA, 25 bp, Mus musculus
caagcctggcagcaaccttagtgtc

SEQ ID NO: 219329 - DNA, 25 bp, Mus musculus
caagcctggcagtgtcagcagctat

SEQ ID NO: 219330 - DNA, 25 bp, Mus musculus
caagcctgtcgcacgagtctgagat

SEQ ID NO: 219331 - DNA, 25 bp, Mus musculus
caagcctgtcggggtgaatcggcac

SEQ ID NO: 219332 - DNA, 25 bp, Mus musculus
caagccttattccagaactttgtgc

SEQ ID NO: 219333 - DNA, 25 bp, Mus musculus
caagccttcagaatctgggatacta

SEQ ID NO: 219334 - DNA, 25 bp, Mus musculus
caagccttcagacacctagatgttc

SEQ ID NO: 219335 - DNA, 25 bp, Mus musculus
caagccttctaagctacctgaacca

SEQ ID NO: 219336 - DNA, 25 bp, Mus musculus
caagcgactccgattctgacagtgg

SEQ ID NO: 219337 - DNA, 25 bp, Mus musculus
caagcgaggacgggctgtccttgtt

SEQ ID NO: 219338 - DNA, 25 bp, Mus musculus
caagcgcaaaggaaaatgactcagg

SEQ ID NO: 219339 - DNA, 25 bp, Mus musculus
caagcgcaaagggcccacatggtat

SEQ ID NO: 219340 - DNA, 25 bp, Mus musculus
caagcgcaagtattttccgccaaga

SEQ ID NO: 219341 - DNA, 25 bp, Mus musculus
caagcgcaccagagaatccgtgacc

SEQ ID NO: 219342 - DNA, 25 bp, Mus musculus
caagcgcagcgggagaacagttaac

SEQ ID NO: 219343 - DNA, 25 bp, Mus musculus
caagcgcatcgtgaaggagatgctc

SEQ ID NO: 219344 - DNA, 25 bp, Mus musculus
caagcgccattgaagtgtggggctt

SEQ ID NO: 219345 - DNA, 25 bp, Mus musculus
caagcgccccagcagatggtaacaa

SEQ ID NO: 219346 - DNA, 25 bp, Mus musculus
caagcgcgccctggccaacagcctc

SEQ ID NO: 219347 - DNA, 25 bp, Mus musculus
caagcgcgcctttaaagtgaaggac

SEQ ID NO: 219348 - DNA, 25 bp, Mus musculus
caagcgctacactcaagatgacagc

SEQ ID NO: 219349 - DNA, 25 bp, Mus musculus
caagcgctcaggctcagtttatgaa

SEQ ID NO: 219350 - DNA, 25 bp, Mus musculus
caagcgctcagtttagcgtgcaacg

SEQ ID NO: 219351 - DNA, 25 bp, Mus musculus
caagcgctctacaggggaggtggat

SEQ ID NO: 219352 - DNA, 25 bp, Mus musculus
caagcgctgagtgaaaatgtgctat

SEQ ID NO: 219353 - DNA, 25 bp, Mus musculus
caagcgctggacgggtggagtgtca

SEQ ID NO: 219354 - DNA, 25 bp, Mus musculus
caagcgctggagcgaccgccaggct

SEQ ID NO: 219355 - DNA, 25 bp, Mus musculus
caagcgctgggtgaaagtgttgaca

SEQ ID NO: 219356 - DNA, 25 bp, Mus musculus
caagcgctgtgcaggggagcaccgc

SEQ ID NO: 219357 - DNA, 25 bp, Mus musculus
caagcggaaggagcatagtgaaaag

SEQ ID NO: 219358 - DNA, 25 bp, Mus musculus
caagcggacaagtattccaccaaag

SEQ ID NO: 219359 - DNA, 25 bp, Mus musculus
caagcggagagaggtcttatcagct

SEQ ID NO: 219360 - DNA, 25 bp, Mus musculus
caagcggagtttggtgaaagtgaga

SEQ ID NO: 219361 - DNA, 25 bp, Mus musculus
caagcggcagattgtagacctggac

SEQ ID NO: 219362 - DNA, 25 bp, Mus musculus
caagcggccagggacgatccgtaag

SEQ ID NO: 219363 - DNA, 25 bp, Mus musculus
caagcggccagggagagacgacatg

SEQ ID NO: 219364 - DNA, 25 bp, Mus musculus
caagcggccgaccttgcacttgact

SEQ ID NO: 219365 - DNA, 25 bp, Mus musculus
caagcggccggcttcctttctgact

SEQ ID NO: 219366 - DNA, 25 bp, Mus musculus
caagcggcctcactagtgttcccag

SEQ ID NO: 219367 - DNA, 25 bp, Mus musculus
caagcggcctcactatcagacatgc

SEQ ID NO: 219368 - DNA, 25 bp, Mus musculus
caagcgggatctctaccagaagtgg

SEQ ID NO: 219369 - DNA, 25 bp, Mus musculus
caagcgggcagagatgaacgggctt

SEQ ID NO: 219370 - DNA, 25 bp, Mus musculus
caagcgggcagagtctgctcattga

SEQ ID NO: 219371 - DNA, 25 bp, Mus musculus
caagcgggcagagttttatctttaa

SEQ ID NO: 219372 - DNA, 25 bp, Mus musculus
caagcgggcaggtccatggagagac

SEQ ID NO: 219373 - DNA, 25 bp, Mus musculus
caagcgggtcaagttacagatttgg

SEQ ID NO: 219374 - DNA, 25 bp, Mus musculus
caagcgtctaaagcttcaagttata

SEQ ID NO: 219375 - DNA, 25 bp, Mus musculus
caagcgtctaaaggaaattgatggg

SEQ ID NO: 219376 - DNA, 25 bp, Mus musculus
caagcgtctttccagcccctgctgg

SEQ ID NO: 219377 - DNA, 25 bp, Mus musculus
caagcgtctttccaggtcatcctgt

SEQ ID NO: 219378 - DNA, 25 bp, Mus musculus
caagcgtgcatggttctgcagcttc

SEQ ID NO: 219379 - DNA, 25 bp, Mus musculus
caagcgtgttagatatcgatgagtg

SEQ ID NO: 219380 - DNA, 25 bp, Mus musculus
caagcgtttgcaggccatcgaagac

SEQ ID NO: 219381 - DNA, 25 bp, Mus musculus
caagctaaagacgggccagcaggcc

SEQ ID NO: 219382 - DNA, 25 bp, Mus musculus
caagctaaagatggagaaggagagg

SEQ ID NO: 219383 - DNA, 25 bp, Mus musculus
caagctaaaggagctgaatctgtcg

SEQ ID NO: 219384 - DNA, 25 bp, Mus musculus
caagctaacaactgtgccaccaaat

SEQ ID NO: 219385 - DNA, 25 bp, Mus musculus
caagctacagatatgggacacagca

SEQ ID NO: 219386 - DNA, 25 bp, Mus musculus
caagctaccggggagcattcagcct

SEQ ID NO: 219387 - DNA, 25 bp, Mus musculus
caagctaccggggagtaacaatgaa

SEQ ID NO: 219388 - DNA, 25 bp, Mus musculus
caagctagtgagcagtgggaagagc

SEQ ID NO: 219389 - DNA, 25 bp, Mus musculus
caagctatacaaggtgggcctgggt

SEQ ID NO: 219390 - DNA, 25 bp, Mus musculus
caagctatatcggagacacagcttc

SEQ ID NO: 219391 - DNA, 25 bp, Mus musculus
caagctatgatgaccagacctgctt

SEQ ID NO: 219392 - DNA, 25 bp, Mus musculus
caagctcaacaaggctctccagagc

SEQ ID NO: 219393 - DNA, 25 bp, Mus musculus
caagctcaatggctacacggatgca

SEQ ID NO: 219394 - DNA, 25 bp, Mus musculus
caagctcacgcctctcttctgtatt

SEQ ID NO: 219395 - DNA, 25 bp, Mus musculus
caagctcacgcctcttgaccagcag

SEQ ID NO: 219396 - DNA, 25 bp, Mus musculus
caagctcacttgaaggacacccagc

SEQ ID NO: 219397 - DNA, 25 bp, Mus musculus
caagctcatcctgagccttgagcca

SEQ ID NO: 219398 - DNA, 25 bp, Mus musculus
caagctcatcctgagttctccacac

SEQ ID NO: 219399 - DNA, 25 bp, Mus musculus
caagctcatggccagggcattgttc

SEQ ID NO: 219400 - DNA, 25 bp, Mus musculus
caagctcatgggccctgcacccttt

SEQ ID NO: 219401 - DNA, 25 bp, Mus musculus
caagctcatgggtacttccgccagc

SEQ ID NO: 219402 - DNA, 25 bp, Mus musculus
caagctccagcacaggatgcgggct

SEQ ID NO: 219403 - DNA, 25 bp, Mus musculus
caagctccaggagctgattcagaaa

SEQ ID NO: 219404 - DNA, 25 bp, Mus musculus
caagctccttaagaaggcagatgag

SEQ ID NO: 219405 - DNA, 25 bp, Mus musculus
caagctctacaaggtctccaacggt

SEQ ID NO: 219406 - DNA, 25 bp, Mus musculus
caagctctccccgatggctcattgc

SEQ ID NO: 219407 - DNA, 25 bp, Mus musculus
caagctctccccggattgacttggc

SEQ ID NO: 219408 - DNA, 25 bp, Mus musculus
caagctctccccgtctaaaagttgg

SEQ ID NO: 219409 - DNA, 25 bp, Mus musculus
caagctctgctgacagggcagtttc

SEQ ID NO: 219410 - DNA, 25 bp, Mus musculus
caagctctgctgactgtgcagaatc

SEQ ID NO: 219411 - DNA, 25 bp, Mus musculus
caagctctggaggttgctgaacgaa

SEQ ID NO: 219412 - DNA, 25 bp, Mus musculus
caagctcttatgtgagacgtggaat

SEQ ID NO: 219413 - DNA, 25 bp, Mus musculus
caagctcttgactcgagaagtcgtc

SEQ ID NO: 219414 - DNA, 25 bp, Mus musculus
caagctgaaccctcacctgtgccag

SEQ ID NO: 219415 - DNA, 25 bp, Mus musculus
caagctgaagagagagagaagacag

SEQ ID NO: 219416 - DNA, 25 bp, Mus musculus
caagctgaagagcatggagaagcac

SEQ ID NO: 219417 - DNA, 25 bp, Mus musculus
caagctgaaggaccaagtctccaag

SEQ ID NO: 219418 - DNA, 25 bp, Mus musculus
caagctgaatgccatcaaactacaa

SEQ ID NO: 219419 - DNA, 25 bp, Mus musculus
caagctgacaggaagactcttcaag

SEQ ID NO: 219420 - DNA, 25 bp, Mus musculus
caagctgacaggttgccatgccttt

SEQ ID NO: 219421 - DNA, 25 bp, Mus musculus
caagctgaccaaagcggagaagctg

SEQ ID NO: 219422 - DNA, 25 bp, Mus musculus
caagctgaccaagttacagtccatc

SEQ ID NO: 219423 - DNA, 25 bp, Mus musculus
caagctgacttgcaggttgatatgt

SEQ ID NO: 219424 - DNA, 25 bp, Mus musculus
caagctgaggcggggcatcgtgaag

SEQ ID NO: 219425 - DNA, 25 bp, Mus musculus
caagctgagtgtaagggttcccgag

SEQ ID NO: 219426 - DNA, 25 bp, Mus musculus
caagctgcaccaggaggcggtggga

SEQ ID NO: 219427 - DNA, 25 bp, Mus musculus
caagctgcacttcagacgaattatc

SEQ ID NO: 219428 - DNA, 25 bp, Mus musculus
caagctgcagcccacttcttagatg

SEQ ID NO: 219429 - DNA, 25 bp, Mus musculus
caagctgcaggaggaggcaaaaaac

SEQ ID NO: 219430 - DNA, 25 bp, Mus musculus
caagctgcaggcttctccagtggca

SEQ ID NO: 219431 - DNA, 25 bp, Mus musculus
caagctgcaggttgcttctataact

SEQ ID NO: 219432 - DNA, 25 bp, Mus musculus
caagctgccccccaggtcaagtggc

SEQ ID NO: 219433 - DNA, 25 bp, Mus musculus
caagctgccccccaggtcttgactc

SEQ ID NO: 219434 - DNA, 25 bp, Mus musculus
caagctgcggaaggatgatccagtc

SEQ ID NO: 219435 - DNA, 25 bp, Mus musculus
caagctgctcgactggctggtggac

SEQ ID NO: 219436 - DNA, 25 bp, Mus musculus
caagctgctgagactataagcggaa

SEQ ID NO: 219437 - DNA, 25 bp, Mus musculus
caagctgctgagactttccagttct

SEQ ID NO: 219438 - DNA, 25 bp, Mus musculus
caagctgctgagatggctccgagcg

SEQ ID NO: 219439 - DNA, 25 bp, Mus musculus
caagctgctgagtgaagagagactt

SEQ ID NO: 219440 - DNA, 25 bp, Mus musculus
caagctgcttagagagttttgtcaa

SEQ ID NO: 219441 - DNA, 25 bp, Mus musculus
caagctgctttctggcttgctggaa

SEQ ID NO: 219442 - DNA, 25 bp, Mus musculus
caagctggaaaacagctttcctagc

SEQ ID NO: 219443 - DNA, 25 bp, Mus musculus
caagctggaagaagagacttttcat

SEQ ID NO: 219444 - DNA, 25 bp, Mus musculus
caagctggaagaagctgggagggca

SEQ ID NO: 219445 - DNA, 25 bp, Mus musculus
caagctggaagctgaaattaaaaag

SEQ ID NO: 219446 - DNA, 25 bp, Mus musculus
caagctggaaggggctgcagtgcta

SEQ ID NO: 219447 - DNA, 25 bp, Mus musculus
caagctggagaatggcaaagcgcaa

SEQ ID NO: 219448 - DNA, 25 bp, Mus musculus
caagctggatcaggatgcgggctcc

SEQ ID NO: 219449 - DNA, 25 bp, Mus musculus
caagctgggcccaggggagaaatac

SEQ ID NO: 219450 - DNA, 25 bp, Mus musculus
caagctgggcccagtatcgttgatc

SEQ ID NO: 219451 - DNA, 25 bp, Mus musculus
caagctgggcgagtacatggagaag

SEQ ID NO: 219452 - DNA, 25 bp, Mus musculus
caagctggtgaagagcatattccgc

SEQ ID NO: 219453 - DNA, 25 bp, Mus musculus
caagctgtacaggttgggcttaggt

SEQ ID NO: 219454 - DNA, 25 bp, Mus musculus
caagctgtagatcaagtctccagtg

SEQ ID NO: 219455 - DNA, 25 bp, Mus musculus
caagctgtagcatagttttgggaag

SEQ ID NO: 219456 - DNA, 25 bp, Mus musculus
caagctgtgcggatgccgggagaca

SEQ ID NO: 219457 - DNA, 25 bp, Mus musculus
caagctgttaacagttcaaggcctg

SEQ ID NO: 219458 - DNA, 25 bp, Mus musculus
caagctgttgagcaagcaccagaag

SEQ ID NO: 219459 - DNA, 25 bp, Mus musculus
caagcttaagcaaagtgagaagaat

SEQ ID NO: 219460 - DNA, 25 bp, Mus musculus
caagcttaagctatgtacttaagca

SEQ ID NO: 219461 - DNA, 25 bp, Mus musculus
caagcttaaggccttggaagatcgt

SEQ ID NO: 219462 - DNA, 25 bp, Mus musculus
caagcttaccagtgattttgaggaa

SEQ ID NO: 219463 - DNA, 25 bp, Mus musculus
caagcttacttctacagtgatggag

SEQ ID NO: 219464 - DNA, 25 bp, Mus musculus
caagcttccctgtttttagcaacct

SEQ ID NO: 219465 - DNA, 25 bp, Mus musculus
caagcttcctgatgctccattgctg

SEQ ID NO: 219466 - DNA, 25 bp, Mus musculus
caagcttctgaggagctagaagcga

SEQ ID NO: 219467 - DNA, 25 bp, Mus musculus
caagcttgaagaagaccttccccag

SEQ ID NO: 219468 - DNA, 25 bp, Mus musculus
caagcttgcccagtatgtgggatcc

SEQ ID NO: 219469 - DNA, 25 bp, Mus musculus
caagcttgccccagcggggacgaag

SEQ ID NO: 219470 - DNA, 25 bp, Mus musculus
caagcttgccccagctgacgagatg

SEQ ID NO: 219471 - DNA, 25 bp, Mus musculus
caagcttgctgaggcctcttaagca

SEQ ID NO: 219472 - DNA, 25 bp, Mus musculus
caagcttggagttgactgtgttccc

SEQ ID NO: 219473 - DNA, 25 bp, Mus musculus
caagcttggagttgggaatgagcaa

SEQ ID NO: 219474 - DNA, 25 bp, Mus musculus
caagcttgggaggggtcatccttcg

SEQ ID NO: 219475 - DNA, 25 bp, Mus musculus
caagcttgtgaaggaatctgattgc

SEQ ID NO: 219476 - DNA, 25 bp, Mus musculus
caagctttccagcacctcctaccgg

SEQ ID NO: 219477 - DNA, 25 bp, Mus musculus
caagctttccaggtctttgactcag

SEQ ID NO: 219478 - DNA, 25 bp, Mus musculus
caagctttttagatgggagaccgtt

SEQ ID NO: 219479 - DNA, 25 bp, Mus musculus
caaggaaaacaaattgatgatgcaa

SEQ ID NO: 219480 - DNA, 25 bp, Mus musculus
caaggaaaacaggacccatcctctg

SEQ ID NO: 219481 - DNA, 25 bp, Mus musculus
caaggaaaacagtctataaagcacc

SEQ ID NO: 219482 - DNA, 25 bp, Mus musculus
caaggaaaagagttaccgtcaagtt

SEQ ID NO: 219483 - DNA, 25 bp, Mus musculus
caaggaaactcagactaaggctgga

SEQ ID NO: 219484 - DNA, 25 bp, Mus musculus
caaggaaagcaaggaatcttcaaag

SEQ ID NO: 219485 - DNA, 25 bp, Mus musculus
caaggaaagcaaggcatgccgcttt

SEQ ID NO: 219486 - DNA, 25 bp, Mus musculus
caaggaaagctgccttcaccttcca

SEQ ID NO: 219487 - DNA, 25 bp, Mus musculus
caaggaaagggatcttgctggacag

SEQ ID NO: 219488 - DNA, 25 bp, Mus musculus
caaggaaaggtaccgagcttatgaa

SEQ ID NO: 219489 - DNA, 25 bp, Mus musculus
caaggaaaggtacgacatgatggga

SEQ ID NO: 219490 - DNA, 25 bp, Mus musculus
caaggaaatccggacatctatgaca

SEQ ID NO: 219491 - DNA, 25 bp, Mus musculus
caaggaaatctatgatgattctttt

SEQ ID NO: 219492 - DNA, 25 bp, Mus musculus
caaggaaatctgggtcttcggatca

SEQ ID NO: 219493 - DNA, 25 bp, Mus musculus
caaggaaatgacaaatggttatgag

SEQ ID NO: 219494 - DNA, 25 bp, Mus musculus
caaggaaatggtggctgcgttgatg

SEQ ID NO: 219495 - DNA, 25 bp, Mus musculus
caaggaacaagctagtggggtagtg

SEQ ID NO: 219496 - DNA, 25 bp, Mus musculus
caaggaacagaacggagtgcaagat

SEQ ID NO: 219497 - DNA, 25 bp, Mus musculus
caaggaacagaacgggaggaactat

SEQ ID NO: 219498 - DNA, 25 bp, Mus musculus
caaggaacagatcctgaagctgcag

SEQ ID NO: 219499 - DNA, 25 bp, Mus musculus
caaggaaccaagaagagtttgtccc

SEQ ID NO: 219500 - DNA, 25 bp, Mus musculus
caaggaaccaagaaggcctcaggtc

SEQ ID NO: 219501 - DNA, 25 bp, Mus musculus
caaggaaccagaggaattctggaac

SEQ ID NO: 219502 - DNA, 25 bp, Mus musculus
caaggaacccacaggtgattcacat

SEQ ID NO: 219503 - DNA, 25 bp, Mus musculus
caaggaacccacagttacagatcaa

SEQ ID NO: 219504 - DNA, 25 bp, Mus musculus
caaggaactgtggaggcagctgtgt

SEQ ID NO: 219505 - DNA, 25 bp, Mus musculus
caaggaagaagcaggtgattaaagt

SEQ ID NO: 219506 - DNA, 25 bp, Mus musculus
caaggaagaaggagaaagcaagctg

SEQ ID NO: 219507 - DNA, 25 bp, Mus musculus
caaggaagaaggagagctcactact

SEQ ID NO: 219508 - DNA, 25 bp, Mus musculus
caaggaagacagaacctctggtttg

SEQ ID NO: 219509 - DNA, 25 bp, Mus musculus
caaggaagcagagatgcccggaacc

SEQ ID NO: 219510 - DNA, 25 bp, Mus musculus
caaggaagccaattaaaatgctctg

SEQ ID NO: 219511 - DNA, 25 bp, Mus musculus
caaggaagcctctgtgcctctgggc

SEQ ID NO: 219512 - DNA, 25 bp, Mus musculus
caaggaaggaatggtgagccttccc

SEQ ID NO: 219513 - DNA, 25 bp, Mus musculus
caaggaaggagaccggggaatcaag

SEQ ID NO: 219514 - DNA, 25 bp, Mus musculus
caaggaaggagggtctctaatctat

SEQ ID NO: 219515 - DNA, 25 bp, Mus musculus
caaggaagtgggaggcagttctgca

SEQ ID NO: 219516 - DNA, 25 bp, Mus musculus
caaggaagtggtataatggccggac

SEQ ID NO: 219517 - DNA, 25 bp, Mus musculus
caaggaagttgagaatgaaaagtcc

SEQ ID NO: 219518 - DNA, 25 bp, Mus musculus
caaggaagttgagaatttcaggaat

SEQ ID NO: 219519 - DNA, 25 bp, Mus musculus
caaggaagttgaggtttaatagtct

SEQ ID NO: 219520 - DNA, 25 bp, Mus musculus
caaggaatagtgtgataattggcct

SEQ ID NO: 219521 - DNA, 25 bp, Mus musculus
caaggaatagtgtgtgcagcttatg

SEQ ID NO: 219522 - DNA, 25 bp, Mus musculus
caaggaatgaatgcgggctttgaag

SEQ ID NO: 219523 - DNA, 25 bp, Mus musculus
caaggacaaccacgagatgtctgca

SEQ ID NO: 219524 - DNA, 25 bp, Mus musculus
caaggacaaccacgtcattcaccca

SEQ ID NO: 219525 - DNA, 25 bp, Mus musculus
caaggacaagaaacatctttctctg

SEQ ID NO: 219526 - DNA, 25 bp, Mus musculus
caaggacaagaacttagtgatgtgg

SEQ ID NO: 219527 - DNA, 25 bp, Mus musculus
caaggacaagaagaaagccggtggc

SEQ ID NO: 219528 - DNA, 25 bp, Mus musculus
caaggacaagaagaattaaagcacg

SEQ ID NO: 219529 - DNA, 25 bp, Mus musculus
caaggacaagagtttcttggatctg

SEQ ID NO: 219530 - DNA, 25 bp, Mus musculus
caaggacacaagggtgaagagggtg

SEQ ID NO: 219531 - DNA, 25 bp, Mus musculus
caaggacacagggtctcttacaaag

SEQ ID NO: 219532 - DNA, 25 bp, Mus musculus
caaggacagcaaggtggtgtgggac

SEQ ID NO: 219533 - DNA, 25 bp, Mus musculus
caaggacagtactctcccatggcta

SEQ ID NO: 219534 - DNA, 25 bp, Mus musculus
caaggaccacagagggtggctgtct

SEQ ID NO: 219535 - DNA, 25 bp, Mus musculus
caaggaccagactttgaagaatcag

SEQ ID NO: 219536 - DNA, 25 bp, Mus musculus
caaggaccaggagatccagactttg

SEQ ID NO: 219537 - DNA, 25 bp, Mus musculus
caaggaccattctggatgcagacca

SEQ ID NO: 219538 - DNA, 25 bp, Mus musculus
caaggacccaagcaaccgacgccga

SEQ ID NO: 219539 - DNA, 25 bp, Mus musculus
caaggacccccagagttgatggtgt

SEQ ID NO: 219540 - DNA, 25 bp, Mus musculus
caaggaccctaacagagtacacacg

SEQ ID NO: 219541 - DNA, 25 bp, Mus musculus
caaggaccctcaggtactaggcggc

SEQ ID NO: 219542 - DNA, 25 bp, Mus musculus
caaggaccgagagggttacacatca

SEQ ID NO: 219543 - DNA, 25 bp, Mus musculus
caaggaccgagaggtgagacgtgga

SEQ ID NO: 219544 - DNA, 25 bp, Mus musculus
caaggaccgagaggtgatctgtaaa

SEQ ID NO: 219545 - DNA, 25 bp, Mus musculus
caaggaccgcctgagattgtcgcag

SEQ ID NO: 219546 - DNA, 25 bp, Mus musculus
caaggaccgctacagctcccaagtg

SEQ ID NO: 219547 - DNA, 25 bp, Mus musculus
caaggacctactaagatcgagagcg

SEQ ID NO: 219548 - DNA, 25 bp, Mus musculus
caaggacctccaggacctcagggtc

SEQ ID NO: 219549 - DNA, 25 bp, Mus musculus
caaggaccttctcttggtcttcatg

SEQ ID NO: 219550 - DNA, 25 bp, Mus musculus
caaggacgaactcatcaagtagact

SEQ ID NO: 219551 - DNA, 25 bp, Mus musculus
caaggacgacagggccccaaaggag

SEQ ID NO: 219552 - DNA, 25 bp, Mus musculus
caaggacgagaaaacgcagaggtga

SEQ ID NO: 219553 - DNA, 25 bp, Mus musculus
caaggacgagaaggaccacttgatt

SEQ ID NO: 219554 - DNA, 25 bp, Mus musculus
caaggacgaggaacctagtaacaaa

SEQ ID NO: 219555 - DNA, 25 bp, Mus musculus
caaggacgatttggggctcatcaca

SEQ ID NO: 219556 - DNA, 25 bp, Mus musculus
caaggacgatttgggtgtcctgctc

SEQ ID NO: 219557 - DNA, 25 bp, Mus musculus
caaggacgcaaggaaatgcccggaa

SEQ ID NO: 219558 - DNA, 25 bp, Mus musculus
caaggacggtcctagcctcagcgtt

SEQ ID NO: 219559 - DNA, 25 bp, Mus musculus
caaggactatggcagcagtttttta

SEQ ID NO: 219560 - DNA, 25 bp, Mus musculus
caaggactccagaaaacatctcggg

SEQ ID NO: 219561 - DNA, 25 bp, Mus musculus
caaggactccaggcatgtcatgtta

SEQ ID NO: 219562 - DNA, 25 bp, Mus musculus
caaggactgaggcaggcagaagaag

SEQ ID NO: 219563 - DNA, 25 bp, Mus musculus
caaggactgggaaagggtgactgtg

SEQ ID NO: 219564 - DNA, 25 bp, Mus musculus
caaggagaaagtgaggacttttgct

SEQ ID NO: 219565 - DNA, 25 bp, Mus musculus
caaggagaacaaggctgaatcagag

SEQ ID NO: 219566 - DNA, 25 bp, Mus musculus
caaggagaacaagtgccagaaccag

SEQ ID NO: 219567 - DNA, 25 bp, Mus musculus
caaggagaacagcatgttgttttgc

SEQ ID NO: 219568 - DNA, 25 bp, Mus musculus
caaggagaaccaggagctctggtta

SEQ ID NO: 219569 - DNA, 25 bp, Mus musculus
caaggagaacgtggacttatggtct

SEQ ID NO: 219570 - DNA, 25 bp, Mus musculus
caaggagaacgttgacatttggtca

SEQ ID NO: 219571 - DNA, 25 bp, Mus musculus
caaggagaactgcaggcatcagaag

SEQ ID NO: 219572 - DNA, 25 bp, Mus musculus
caaggagaactgcaggttctcccat

SEQ ID NO: 219573 - DNA, 25 bp, Mus musculus
caaggagaagaagaaaaagtcagca

SEQ ID NO: 219574 - DNA, 25 bp, Mus musculus
caaggagaagaagaatttggaattt

SEQ ID NO: 219575 - DNA, 25 bp, Mus musculus
caaggagaagaagcaatgtctgacc

SEQ ID NO: 219576 - DNA, 25 bp, Mus musculus
caaggagaagaagggctccagcacc

SEQ ID NO: 219577 - DNA, 25 bp, Mus musculus
caaggagaagacaggagtgcgattc

SEQ ID NO: 219578 - DNA, 25 bp, Mus musculus
caaggagaagagaacagaaagcctt

SEQ ID NO: 219579 - DNA, 25 bp, Mus musculus
caaggagaagctggtccctccagga

SEQ ID NO: 219580 - DNA, 25 bp, Mus musculus
caaggagaatacacctctcattgaa

SEQ ID NO: 219581 - DNA, 25 bp, Mus musculus
caaggagaatgtcccttcagagaag

SEQ ID NO: 219582 - DNA, 25 bp, Mus musculus
caaggagacagcttggtcacatacc

SEQ ID NO: 219583 - DNA, 25 bp, Mus musculus
caaggagagaaaagattaatacaca

SEQ ID NO: 219584 - DNA, 25 bp, Mus musculus
caaggagagtcgggtgttaggagca

SEQ ID NO: 219585 - DNA, 25 bp, Mus musculus
caaggagatgctgtggggcctgtac

SEQ ID NO: 219586 - DNA, 25 bp, Mus musculus
caaggagatggaatccaagtgaata

SEQ ID NO: 219587 - DNA, 25 bp, Mus musculus
caaggagatggacagtacagacctc

SEQ ID NO: 219588 - DNA, 25 bp, Mus musculus
caaggagatggtggggctgcgacag

SEQ ID NO: 219589 - DNA, 25 bp, Mus musculus
caaggagatgttgtctgtaggtggg

SEQ ID NO: 219590 - DNA, 25 bp, Mus musculus
caaggagcagcccggacaccaagga

SEQ ID NO: 219591 - DNA, 25 bp, Mus musculus
caaggagcagcttggctatattgtc

SEQ ID NO: 219592 - DNA, 25 bp, Mus musculus
caaggagcaggacatggctgccaac

SEQ ID NO: 219593 - DNA, 25 bp, Mus musculus
caaggagcaggtcatgcttctcatc

SEQ ID NO: 219594 - DNA, 25 bp, Mus musculus
caaggagccaagaggagtgaatggt

SEQ ID NO: 219595 - DNA, 25 bp, Mus musculus
caaggagccaagaggggtctccaat

SEQ ID NO: 219596 - DNA, 25 bp, Mus musculus
caaggagccagatgagaaaaccaag

SEQ ID NO: 219597 - DNA, 25 bp, Mus musculus
caaggagccagcttcacttcttcct

SEQ ID NO: 219598 - DNA, 25 bp, Mus musculus
caaggagccagctttcttggattcc

SEQ ID NO: 219599 - DNA, 25 bp, Mus musculus
caaggagcccaggccggctcaacat

SEQ ID NO: 219600 - DNA, 25 bp, Mus musculus
caaggagcggcacatttgacctgct

SEQ ID NO: 219601 - DNA, 25 bp, Mus musculus
caaggagctagactctgaggaccaa

SEQ ID NO: 219602 - DNA, 25 bp, Mus musculus
caaggagctagactctgagtacagc

SEQ ID NO: 219603 - DNA, 25 bp, Mus musculus
caaggagctcccctcccacccacct

SEQ ID NO: 219604 - DNA, 25 bp, Mus musculus
caaggagctcttcctgggcctctcc

SEQ ID NO: 219605 - DNA, 25 bp, Mus musculus
caaggagctgcaacaacattttttc

SEQ ID NO: 219606 - DNA, 25 bp, Mus musculus
caaggagctgcaggagaagaggagg

SEQ ID NO: 219607 - DNA, 25 bp, Mus musculus
caaggagcttcaggcacgcatcgag

SEQ ID NO: 219608 - DNA, 25 bp, Mus musculus
caaggaggacagattaattgtggtg

SEQ ID NO: 219609 - DNA, 25 bp, Mus musculus
caaggaggacagctacaagcccatc

SEQ ID NO: 219610 - DNA, 25 bp, Mus musculus
caaggaggacaggacaaaagaggct

SEQ ID NO: 219611 - DNA, 25 bp, Mus musculus
caaggaggacggtgtgccgatgctc

SEQ ID NO: 219612 - DNA, 25 bp, Mus musculus
caaggaggagaagtataaagagcag

SEQ ID NO: 219613 - DNA, 25 bp, Mus musculus
caaggaggaggagggcagaaggctg

SEQ ID NO: 219614 - DNA, 25 bp, Mus musculus
caaggaggaggagtcaagttggacc

SEQ ID NO: 219615 - DNA, 25 bp, Mus musculus
caaggaggagtcatctctcatggat

SEQ ID NO: 219616 - DNA, 25 bp, Mus musculus
caaggaggagtgttgagtggagact

SEQ ID NO: 219617 - DNA, 25 bp, Mus musculus
caaggagggcaaaggtcccaatgct

SEQ ID NO: 219618 - DNA, 25 bp, Mus musculus
caaggagggggctgagaaaataaaa

SEQ ID NO: 219619 - DNA, 25 bp, Mus musculus
caaggaggtccagctgctcggcact

SEQ ID NO: 219620 - DNA, 25 bp, Mus musculus
caaggaggtccagctgttcatgact

SEQ ID NO: 219621 - DNA, 25 bp, Mus musculus
caaggaggtccggagtcaccggcct

SEQ ID NO: 219622 - DNA, 25 bp, Mus musculus
caaggagtatgagggagccgtctac

SEQ ID NO: 219623 - DNA, 25 bp, Mus musculus
caaggagtgggggtgggcttaggct

SEQ ID NO: 219624 - DNA, 25 bp, Mus musculus
caaggagttcaggaggacccgctct

SEQ ID NO: 219625 - DNA, 25 bp, Mus musculus
caaggagttgaaagattcccccaca

SEQ ID NO: 219626 - DNA, 25 bp, Mus musculus
caaggagttgaaaggagtgagcagc

SEQ ID NO: 219627 - DNA, 25 bp, Mus musculus
caaggataagaatgaagaagaagta

SEQ ID NO: 219628 - DNA, 25 bp, Mus musculus
caaggataaggacaaagccaaggtg

SEQ ID NO: 219629 - DNA, 25 bp, Mus musculus
caaggatatcgacgtgatcatgggt

SEQ ID NO: 219630 - DNA, 25 bp, Mus musculus
caaggatcacaaagacctgtgcccc

SEQ ID NO: 219631 - DNA, 25 bp, Mus musculus
caaggatcacaaagtgagtttcctg

SEQ ID NO: 219632 - DNA, 25 bp, Mus musculus
caaggatccagacttggagaagaac

SEQ ID NO: 219633 - DNA, 25 bp, Mus musculus
caaggatctgatttaaattagctcc

SEQ ID NO: 219634 - DNA, 25 bp, Mus musculus
caaggatgacctgggccttttgctc

SEQ ID NO: 219635 - DNA, 25 bp, Mus musculus
caaggatgaggaggagaaagaaaag

SEQ ID NO: 219636 - DNA, 25 bp, Mus musculus
caaggatgagtgggtggaagagcag

SEQ ID NO: 219637 - DNA, 25 bp, Mus musculus
caaggatgatgaggagaaagagaag

SEQ ID NO: 219638 - DNA, 25 bp, Mus musculus
caaggatgctgggaagtccgtgggc

SEQ ID NO: 219639 - DNA, 25 bp, Mus musculus
caaggatggaacggtgtggaccgtg

SEQ ID NO: 219640 - DNA, 25 bp, Mus musculus
caaggatggacacattcattacttc

SEQ ID NO: 219641 - DNA, 25 bp, Mus musculus
caaggatggtgagctccctgtggag

SEQ ID NO: 219642 - DNA, 25 bp, Mus musculus
caaggatgtacaggggagcagcgcg

SEQ ID NO: 219643 - DNA, 25 bp, Mus musculus
caaggattaattagaaaaggaggcg

SEQ ID NO: 219644 - DNA, 25 bp, Mus musculus
caaggattccaagctaccacagtga

SEQ ID NO: 219645 - DNA, 25 bp, Mus musculus
caaggattccaagctcctactactc

SEQ ID NO: 219646 - DNA, 25 bp, Mus musculus
caaggattccagccccagtctctgc

SEQ ID NO: 219647 - DNA, 25 bp, Mus musculus
caaggattcccaggtgctcctggct

SEQ ID NO: 219648 - DNA, 25 bp, Mus musculus
caaggatttttctagcaagttgcga

SEQ ID NO: 219649 - DNA, 25 bp, Mus musculus
caaggatttttctaggacatgtatg

SEQ ID NO: 219650 - DNA, 25 bp, Mus musculus
caaggatttttgtcctacttggagg

SEQ ID NO: 219651 - DNA, 25 bp, Mus musculus
caaggcaaaattggaaagagaactt

SEQ ID NO: 219652 - DNA, 25 bp, Mus musculus
caaggcaaaattgtctgtccactct

SEQ ID NO: 219653 - DNA, 25 bp, Mus musculus
caaggcaaagaggaacagagtgttt

SEQ ID NO: 219654 - DNA, 25 bp, Mus musculus
caaggcaaagatccagacaaggagg

SEQ ID NO: 219655 - DNA, 25 bp, Mus musculus
caaggcaaagccgacgcagtatgag

SEQ ID NO: 219656 - DNA, 25 bp, Mus musculus
caaggcaaagcggtcccaccagctt

SEQ ID NO: 219657 - DNA, 25 bp, Mus musculus
caaggcaaaggtgttgaacgaggag

SEQ ID NO: 219658 - DNA, 25 bp, Mus musculus
caaggcaaagtttgaaactgctctg

SEQ ID NO: 219659 - DNA, 25 bp, Mus musculus
caaggcaaatctcatataaaacagt

SEQ ID NO: 219660 - DNA, 25 bp, Mus musculus
caaggcaacggccacgtaccccatg

SEQ ID NO: 219661 - DNA, 25 bp, Mus musculus
caaggcaaggggatgaaagcttgcg

SEQ ID NO: 219662 - DNA, 25 bp, Mus musculus
caaggcaatacgtgtcatagaatgt

SEQ ID NO: 219663 - DNA, 25 bp, Mus musculus
caaggcacaggatctagataaaact

SEQ ID NO: 219664 - DNA, 25 bp, Mus musculus
caaggcactagagccccagatcctg

SEQ ID NO: 219665 - DNA, 25 bp, Mus musculus
caaggcactagggtgccacctacgc

SEQ ID NO: 219666 - DNA, 25 bp, Mus musculus
caaggcagaggttgtatggagagac

SEQ ID NO: 219667 - DNA, 25 bp, Mus musculus
caaggcagagtgctcgatccgactt

SEQ ID NO: 219668 - DNA, 25 bp, Mus musculus
caaggcagccttggctggtcgtttg

SEQ ID NO: 219669 - DNA, 25 bp, Mus musculus
caaggcagctagaatgcactggggc

SEQ ID NO: 219670 - DNA, 25 bp, Mus musculus
caaggcaggagatcgggaagctgca

SEQ ID NO: 219671 - DNA, 25 bp, Mus musculus
caaggcaggaggctggtcagatctc

SEQ ID NO: 219672 - DNA, 25 bp, Mus musculus
caaggcaggtgatttggagttcctg

SEQ ID NO: 219673 - DNA, 25 bp, Mus musculus
caaggcatcctcaaggacacccagt

SEQ ID NO: 219674 - DNA, 25 bp, Mus musculus
caaggcatctgagtgatataaaaac

SEQ ID NO: 219675 - DNA, 25 bp, Mus musculus
caaggcattgctaaaagaggcatcc

SEQ ID NO: 219676 - DNA, 25 bp, Mus musculus
caaggccaagaaagtattatgaggg

SEQ ID NO: 219677 - DNA, 25 bp, Mus musculus
caaggccaagagcacggacgagcag

SEQ ID NO: 219678 - DNA, 25 bp, Mus musculus
caaggccaagatccgggacttgcag

SEQ ID NO: 219679 - DNA, 25 bp, Mus musculus
caaggccaagctattacaagccaga

SEQ ID NO: 219680 - DNA, 25 bp, Mus musculus
caaggccaaggccaacctggagaaa

SEQ ID NO: 219681 - DNA, 25 bp, Mus musculus
caaggccaagggtctactataccac

SEQ ID NO: 219682 - DNA, 25 bp, Mus musculus
caaggccaagtaagtattatgaggg

SEQ ID NO: 219683 - DNA, 25 bp, Mus musculus
caaggccaagttgtgctggtaactc

SEQ ID NO: 219684 - DNA, 25 bp, Mus musculus
caaggccacagccaggagaaactgt

SEQ ID NO: 219685 - DNA, 25 bp, Mus musculus
caaggccagatgctgaaattacccc

SEQ ID NO: 219686 - DNA, 25 bp, Mus musculus
caaggccagatggatgctgttcgaa

SEQ ID NO: 219687 - DNA, 25 bp, Mus musculus
caaggccagatgtgatgctgttgtg

SEQ ID NO: 219688 - DNA, 25 bp, Mus musculus
caaggccagcagattgtgatatctt

SEQ ID NO: 219689 - DNA, 25 bp, Mus musculus
caaggccagcaggtctcataacaac

SEQ ID NO: 219690 - DNA, 25 bp, Mus musculus
caaggccaggaggaagaaaattatg

SEQ ID NO: 219691 - DNA, 25 bp, Mus musculus
caaggccaggaggaggacccaggtc

SEQ ID NO: 219692 - DNA, 25 bp, Mus musculus
caaggccaggcggaaaaagtggata

SEQ ID NO: 219693 - DNA, 25 bp, Mus musculus
caaggccaggcggaaggtgatgttc

SEQ ID NO: 219694 - DNA, 25 bp, Mus musculus
caaggccagtggatgcgcctatgta

SEQ ID NO: 219695 - DNA, 25 bp, Mus musculus
caaggccataaagactcactccgaa

SEQ ID NO: 219696 - DNA, 25 bp, Mus musculus
caaggccataaaggcttctggggat

SEQ ID NO: 219697 - DNA, 25 bp, Mus musculus
caaggccatcaccagggtgtttcca

SEQ ID NO: 219698 - DNA, 25 bp, Mus musculus
caaggccatgaacacggctctagat

SEQ ID NO: 219699 - DNA, 25 bp, Mus musculus
caaggccattggcaggttgtccgat

SEQ ID NO: 219700 - DNA, 25 bp, Mus musculus
caaggcccaacccagtgacaatgcc

SEQ ID NO: 219701 - DNA, 25 bp, Mus musculus
caaggcccaggtggtgaccatagaa

SEQ ID NO: 219702 - DNA, 25 bp, Mus musculus
caaggcccaggttgaccaaagaaat

SEQ ID NO: 219703 - DNA, 25 bp, Mus musculus
caaggcccatgtcttccctacacca

SEQ ID NO: 219704 - DNA, 25 bp, Mus musculus
caaggccccagccaagccgcaatga

SEQ ID NO: 219705 - DNA, 25 bp, Mus musculus
caaggcccccaacacggcgagcctc

SEQ ID NO: 219706 - DNA, 25 bp, Mus musculus
caaggcccctagccccatctcttct

SEQ ID NO: 219707 - DNA, 25 bp, Mus musculus
caaggcccggcttcgtgtatcctca

SEQ ID NO: 219708 - DNA, 25 bp, Mus musculus
caaggccctagcagatgaaaaacga

SEQ ID NO: 219709 - DNA, 25 bp, Mus musculus
caaggccctcagattgacaaggaac

SEQ ID NO: 219710 - DNA, 25 bp, Mus musculus
caaggccctggcagatgagcgtgaa

SEQ ID NO: 219711 - DNA, 25 bp, Mus musculus
caaggccggcatcgccgcttacaag

SEQ ID NO: 219712 - DNA, 25 bp, Mus musculus
caaggccgttcggaaggctgtggga

SEQ ID NO: 219713 - DNA, 25 bp, Mus musculus
caaggcctatgtcagcactttaatg

SEQ ID NO: 219714 - DNA, 25 bp, Mus musculus
caaggcctcaggtggagccagtgat

SEQ ID NO: 219715 - DNA, 25 bp, Mus musculus
caaggcctcctcaagctaaagaacg

SEQ ID NO: 219716 - DNA, 25 bp, Mus musculus
caaggcctcgaaccgccgtccctca

SEQ ID NO: 219717 - DNA, 25 bp, Mus musculus
caaggcctcgtcattgtgacagaaa

SEQ ID NO: 219718 - DNA, 25 bp, Mus musculus
caaggcctggacgaaaaccacgagc

SEQ ID NO: 219719 - DNA, 25 bp, Mus musculus
caaggcctggacgacgctgagcagg

SEQ ID NO: 219720 - DNA, 25 bp, Mus musculus
caaggcctgtggcatcctgcctgtt

SEQ ID NO: 219721 - DNA, 25 bp, Mus musculus
caaggcctgtggtatcctgcctgtt

SEQ ID NO: 219722 - DNA, 25 bp, Mus musculus
caaggcctgtgttgctacccctctg

SEQ ID NO: 219723 - DNA, 25 bp, Mus musculus
caaggccttagtctcctacatagcc

SEQ ID NO: 219724 - DNA, 25 bp, Mus musculus
caaggccttagtctgctacatagcc

SEQ ID NO: 219725 - DNA, 25 bp, Mus musculus
caaggcgacaatgttctcaaacagt

SEQ ID NO: 219726 - DNA, 25 bp, Mus musculus
caaggcgagagggtatcccaggagc

SEQ ID NO: 219727 - DNA, 25 bp, Mus musculus
caaggcgcaccgcaaagatgtgaaa

SEQ ID NO: 219728 - DNA, 25 bp, Mus musculus
caaggcggcagactttctgcactgg

SEQ ID NO: 219729 - DNA, 25 bp, Mus musculus
caaggcgggcagacgtatgtttcct

SEQ ID NO: 219730 - DNA, 25 bp, Mus musculus
caaggcggtggggtaagtgtggaca

SEQ ID NO: 219731 - DNA, 25 bp, Mus musculus
caaggctacaagcagtgccggctac

SEQ ID NO: 219732 - DNA, 25 bp, Mus musculus
caaggctacactggggcttacaggg

SEQ ID NO: 219733 - DNA, 25 bp, Mus musculus
caaggctacctagaaagtcccaagg

SEQ ID NO: 219734 - DNA, 25 bp, Mus musculus
caaggctacctagaacatcagaaac

SEQ ID NO: 219735 - DNA, 25 bp, Mus musculus
caaggctacggaggctatggggcat

SEQ ID NO: 219736 - DNA, 25 bp, Mus musculus
caaggctagactggctgcgaagctg

SEQ ID NO: 219737 - DNA, 25 bp, Mus musculus
caaggctcagacagcagtgacagtg

SEQ ID NO: 219738 - DNA, 25 bp, Mus musculus
caaggctctacattcccaaggtgat

SEQ ID NO: 219739 - DNA, 25 bp, Mus musculus
caaggctgagcagcacgcctccggt

SEQ ID NO: 219740 - DNA, 25 bp, Mus musculus
caaggctgagcagcaggctgacgag

SEQ ID NO: 219741 - DNA, 25 bp, Mus musculus
caaggctgagcagcaggtgaaccag

SEQ ID NO: 219742 - DNA, 25 bp, Mus musculus
caaggctgccgctctggcccacagg

SEQ ID NO: 219743 - DNA, 25 bp, Mus musculus
caaggctggagcggaagggtttgtt

SEQ ID NO: 219744 - DNA, 25 bp, Mus musculus
caaggctgggtgcagtgacccttac

SEQ ID NO: 219745 - DNA, 25 bp, Mus musculus
caaggctggtgctatttatattttg

SEQ ID NO: 219746 - DNA, 25 bp, Mus musculus
caaggctgtcccgagttgaggccgg

SEQ ID NO: 219747 - DNA, 25 bp, Mus musculus
caaggctgtgtctgatgtcctggaa

SEQ ID NO: 219748 - DNA, 25 bp, Mus musculus
caaggcttaggcatcgtcttcagca

SEQ ID NO: 219749 - DNA, 25 bp, Mus musculus
caagggaacccaaggcctggcagaa

SEQ ID NO: 219750 - DNA, 25 bp, Mus musculus
caagggaatccagagatcattgata

SEQ ID NO: 219751 - DNA, 25 bp, Mus musculus
caagggaatccagatcaaggttcca

SEQ ID NO: 219752 - DNA, 25 bp, Mus musculus
caagggaatccagatgactgcagtc

SEQ ID NO: 219753 - DNA, 25 bp, Mus musculus
caagggacaaccaggcaaccgaggg

SEQ ID NO: 219754 - DNA, 25 bp, Mus musculus
caagggacacgagggctccttcttc

SEQ ID NO: 219755 - DNA, 25 bp, Mus musculus
caagggacaggtgctgaagcatgtg

SEQ ID NO: 219756 - DNA, 25 bp, Mus musculus
caagggacatgaaggtagcatcgcc

SEQ ID NO: 219757 - DNA, 25 bp, Mus musculus
caagggaccaagcattcacagctct

SEQ ID NO: 219758 - DNA, 25 bp, Mus musculus
caagggagaaaagaacttcgcggct

SEQ ID NO: 219759 - DNA, 25 bp, Mus musculus
caagggagaaaagggtgcgcctgga

SEQ ID NO: 219760 - DNA, 25 bp, Mus musculus
caagggagacagaggcgatgttggc

SEQ ID NO: 219761 - DNA, 25 bp, Mus musculus
caagggagagactggacctgctggg

SEQ ID NO: 219762 - DNA, 25 bp, Mus musculus
caagggaggtgaggaggaagaagtg

SEQ ID NO: 219763 - DNA, 25 bp, Mus musculus
caagggatacccggcgtaatctcaa

SEQ ID NO: 219764 - DNA, 25 bp, Mus musculus
caagggatctgccagtgtgcccctg

SEQ ID NO: 219765 - DNA, 25 bp, Mus musculus
caagggatgttttgggtcgcagaca

SEQ ID NO: 219766 - DNA, 25 bp, Mus musculus
caagggattccagtactagtacttg

SEQ ID NO: 219767 - DNA, 25 bp, Mus musculus
caagggcaacagtcatcatctgact

SEQ ID NO: 219768 - DNA, 25 bp, Mus musculus
caagggcaacagtgaactaatgctg

SEQ ID NO: 219769 - DNA, 25 bp, Mus musculus
caagggcaagatcctatttatcttc

SEQ ID NO: 219770 - DNA, 25 bp, Mus musculus
caagggcaaggactacctggaccag

SEQ ID NO: 219771 - DNA, 25 bp, Mus musculus
caagggcaagggactccgagggagc

SEQ ID NO: 219772 - DNA, 25 bp, Mus musculus
caagggcaagggggagaagattaat

SEQ ID NO: 219773 - DNA, 25 bp, Mus musculus
caagggcaagggttcttggcccagc

SEQ ID NO: 219774 - DNA, 25 bp, Mus musculus
caagggcaaggtgctggctcagcaa

SEQ ID NO: 219775 - DNA, 25 bp, Mus musculus
caagggcacaagctcctgacgagca

SEQ ID NO: 219776 - DNA, 25 bp, Mus musculus
caagggcacaagctgagcggggccc

SEQ ID NO: 219777 - DNA, 25 bp, Mus musculus
caagggcagtgggtgctggtcttca

SEQ ID NO: 219778 - DNA, 25 bp, Mus musculus
caagggcatggtgggcagcaaagat

SEQ ID NO: 219779 - DNA, 25 bp, Mus musculus
caagggccaaagggttccattggat

SEQ ID NO: 219780 - DNA, 25 bp, Mus musculus
caagggccagatgctgcatattcca

SEQ ID NO: 219781 - DNA, 25 bp, Mus musculus
caagggccaggagactgttctggac

SEQ ID NO: 219782 - DNA, 25 bp, Mus musculus
caagggccttttggtctggaagctg

SEQ ID NO: 219783 - DNA, 25 bp, Mus musculus
caagggcggaggtgagtgcaggatc

SEQ ID NO: 219784 - DNA, 25 bp, Mus musculus
caagggctacagctccggaccaaaa

SEQ ID NO: 219785 - DNA, 25 bp, Mus musculus
caagggctatttccctgcagtctga

SEQ ID NO: 219786 - DNA, 25 bp, Mus musculus
caagggctcttgctgttccggggca

SEQ ID NO: 219787 - DNA, 25 bp, Mus musculus
caagggctcttgggcagcgctcacc

SEQ ID NO: 219788 - DNA, 25 bp, Mus musculus
caagggcttattctcagctctttga

SEQ ID NO: 219789 - DNA, 25 bp, Mus musculus
caagggcttcttaggtcgcaagtct

SEQ ID NO: 219790 - DNA, 25 bp, Mus musculus
caagggcttcttcagacgaacagtc

SEQ ID NO: 219791 - DNA, 25 bp, Mus musculus
caagggcttcttcagtgatactgtc

SEQ ID NO: 219792 - DNA, 25 bp, Mus musculus
caagggctttaccagaagagggcat

SEQ ID NO: 219793 - DNA, 25 bp, Mus musculus
caagggctttaccagtctattgcat

SEQ ID NO: 219794 - DNA, 25 bp, Mus musculus
caaggggaagactgccgtgagcatc

SEQ ID NO: 219795 - DNA, 25 bp, Mus musculus
caaggggaagactggcgcaagcggc

SEQ ID NO: 219796 - DNA, 25 bp, Mus musculus
caaggggaagactgggagatggaac

SEQ ID NO: 219797 - DNA, 25 bp, Mus musculus
caaggggaagactggtccctgtggc

SEQ ID NO: 219798 - DNA, 25 bp, Mus musculus
caaggggaagactggtctctaactg

SEQ ID NO: 219799 - DNA, 25 bp, Mus musculus
caaggggagaagaaccatttgacat

SEQ ID NO: 219800 - DNA, 25 bp, Mus musculus
caaggggcaggtaccacagagagaa

SEQ ID NO: 219801 - DNA, 25 bp, Mus musculus
caaggggcccagcaggtggagagca

SEQ ID NO: 219802 - DNA, 25 bp, Mus musculus
caagggggagaagggccacattggg

SEQ ID NO: 219803 - DNA, 25 bp, Mus musculus
caagggggtgcctgtgggccgaagc

SEQ ID NO: 219804 - DNA, 25 bp, Mus musculus
caagggtagtcactgactgtatcca

SEQ ID NO: 219805 - DNA, 25 bp, Mus musculus
caagggtatcgacaggtacaatcct

SEQ ID NO: 219806 - DNA, 25 bp, Mus musculus
caagggtatcgacaggtaccagttc

SEQ ID NO: 219807 - DNA, 25 bp, Mus musculus
caagggtcacagaggttacccaggc

SEQ ID NO: 219808 - DNA, 25 bp, Mus musculus
caagggtgaacagggtgcctctggt

SEQ ID NO: 219809 - DNA, 25 bp, Mus musculus
caagggtgcgcacagaactcagggg

SEQ ID NO: 219810 - DNA, 25 bp, Mus musculus
caagggtgcgcacagatgactggtt

SEQ ID NO: 219811 - DNA, 25 bp, Mus musculus
caagggttcacaggcacactggcaa

SEQ ID NO: 219812 - DNA, 25 bp, Mus musculus
caagggttgtgatgggaggctccta

SEQ ID NO: 219813 - DNA, 25 bp, Mus musculus
caagggttgtgatgggcggctccta

SEQ ID NO: 219814 - DNA, 25 bp, Mus musculus
caagggtttgaatgtatcgcaaacg

SEQ ID NO: 219815 - DNA, 25 bp, Mus musculus
caaggtaaactgcaggttgtcctgg

SEQ ID NO: 219816 - DNA, 25 bp, Mus musculus
caaggtaactacggagatcagcagg

SEQ ID NO: 219817 - DNA, 25 bp, Mus musculus
caaggtactcaagcgagctgcagcg

SEQ ID NO: 219818 - DNA, 25 bp, Mus musculus
caaggtactcaaggtaggctgcttt

SEQ ID NO: 219819 - DNA, 25 bp, Mus musculus
caaggtagaggcccctaacagctcc

SEQ ID NO: 219820 - DNA, 25 bp, Mus musculus
caaggtagcaaagggtgtggaatat

SEQ ID NO: 219821 - DNA, 25 bp, Mus musculus
caaggtaggctgtcagccatcttac

SEQ ID NO: 219822 - DNA, 25 bp, Mus musculus
caaggtcaaaagggagaacctggca

SEQ ID NO: 219823 - DNA, 25 bp, Mus musculus
caaggtcaacaggcgcaacctggtg

SEQ ID NO: 219824 - DNA, 25 bp, Mus musculus
caaggtcaagtcagtaggacaaagt

SEQ ID NO: 219825 - DNA, 25 bp, Mus musculus
caaggtcaggacccagctgtggcta

SEQ ID NO: 219826 - DNA, 25 bp, Mus musculus
caaggtcccgggcagcatccagcat

SEQ ID NO: 219827 - DNA, 25 bp, Mus musculus
caaggtcctacaagggcctgtggac

SEQ ID NO: 219828 - DNA, 25 bp, Mus musculus
caaggtcctgaagcactcggggata

SEQ ID NO: 219829 - DNA, 25 bp, Mus musculus
caaggtcctgaagcgcctgtgagag

SEQ ID NO: 219830 - DNA, 25 bp, Mus musculus
caaggtcctgaaggccgccggtgtt

SEQ ID NO: 219831 - DNA, 25 bp, Mus musculus
caaggtcgaacacatgggtcggagc

SEQ ID NO: 219832 - DNA, 25 bp, Mus musculus
caaggtcgagcaggagcatagaaga

SEQ ID NO: 219833 - DNA, 25 bp, Mus musculus
caaggtcgtccaatgccgagacccc

SEQ ID NO: 219834 - DNA, 25 bp, Mus musculus
caaggtcgtccagctgaagaacctg

SEQ ID NO: 219835 - DNA, 25 bp, Mus musculus
caaggtcgtccatgctggagttaca

SEQ ID NO: 219836 - DNA, 25 bp, Mus musculus
caaggtctggatattgaagtaatgg

SEQ ID NO: 219837 - DNA, 25 bp, Mus musculus
caaggtctggtgagaagctggatgg

SEQ ID NO: 219838 - DNA, 25 bp, Mus musculus
caaggtctttgcaaagcccaaaatc

SEQ ID NO: 219839 - DNA, 25 bp, Mus musculus
caaggtgaagcttggctgctgtgaa

SEQ ID NO: 219840 - DNA, 25 bp, Mus musculus
caaggtgaccagggtattcctggtg

SEQ ID NO: 219841 - DNA, 25 bp, Mus musculus
caaggtgacctgtgacatccggctc

SEQ ID NO: 219842 - DNA, 25 bp, Mus musculus
caaggtgacctgtgatggggaaaca

SEQ ID NO: 219843 - DNA, 25 bp, Mus musculus
caaggtgacgatgctgcttgttgtc

SEQ ID NO: 219844 - DNA, 25 bp, Mus musculus
caaggtgacgttgctgcttgttgtc

SEQ ID NO: 219845 - DNA, 25 bp, Mus musculus
caaggtgaggagtactgaaccttcc

SEQ ID NO: 219846 - DNA, 25 bp, Mus musculus
caaggtgcagcaacctcactttggc

SEQ ID NO: 219847 - DNA, 25 bp, Mus musculus
caaggtgcaggctttggttagaagt

SEQ ID NO: 219848 - DNA, 25 bp, Mus musculus
caaggtgccagaggaggatgactct

SEQ ID NO: 219849 - DNA, 25 bp, Mus musculus
caaggtgctacaagaaatgtctgaa

SEQ ID NO: 219850 - DNA, 25 bp, Mus musculus
caaggtggaaacaagcgcccaggcg

SEQ ID NO: 219851 - DNA, 25 bp, Mus musculus
caaggtggcctgtgagacagtgtgc

SEQ ID NO: 219852 - DNA, 25 bp, Mus musculus
caaggtggggccgagcaaccatgaa

SEQ ID NO: 219853 - DNA, 25 bp, Mus musculus
caaggtggtggaaggagctcaaggt

SEQ ID NO: 219854 - DNA, 25 bp, Mus musculus
caaggtggttctgaaacgaagtgag

SEQ ID NO: 219855 - DNA, 25 bp, Mus musculus
caaggtgtatgaaacgctgtcagcc

SEQ ID NO: 219856 - DNA, 25 bp, Mus musculus
caaggtgtatgaaaggctgtcagcc

SEQ ID NO: 219857 - DNA, 25 bp, Mus musculus
caaggtgtcatagacatgaaaaatg

SEQ ID NO: 219858 - DNA, 25 bp, Mus musculus
caaggtgttccaggagcgcatcaac

SEQ ID NO: 219859 - DNA, 25 bp, Mus musculus
caaggtgttccaggtaggtgcatga

SEQ ID NO: 219860 - DNA, 25 bp, Mus musculus
caaggttaaggctagatatggattt

SEQ ID NO: 219861 - DNA, 25 bp, Mus musculus
caaggttaccagagctgaaattagc

SEQ ID NO: 219862 - DNA, 25 bp, Mus musculus
caaggttaccagtatgcaaccgagg

SEQ ID NO: 219863 - DNA, 25 bp, Mus musculus
caaggttaccagtgtttgaaagacg

SEQ ID NO: 219864 - DNA, 25 bp, Mus musculus
caaggttacctttcagcctcccagt

SEQ ID NO: 219865 - DNA, 25 bp, Mus musculus
caaggttcagcaaggtttacagtag

SEQ ID NO: 219866 - DNA, 25 bp, Mus musculus
caaggttcaggtcttatatccagat

SEQ ID NO: 219867 - DNA, 25 bp, Mus musculus
caaggttccaggagagacatgctac

SEQ ID NO: 219868 - DNA, 25 bp, Mus musculus
caaggttcctgccgctaacgtcctg

SEQ ID NO: 219869 - DNA, 25 bp, Mus musculus
caaggttgcagcacgcagcagaact

SEQ ID NO: 219870 - DNA, 25 bp, Mus musculus
caaggtttacagcagatacagttgg

SEQ ID NO: 219871 - DNA, 25 bp, Mus musculus
caaggtttctacatgaaggaaggga

SEQ ID NO: 219872 - DNA, 25 bp, Mus musculus
caagtaactaactggtccagctgct

SEQ ID NO: 219873 - DNA, 25 bp, Mus musculus
caagtaagaagctgacatgccatat

SEQ ID NO: 219874 - DNA, 25 bp, Mus musculus
caagtaagagtcaaagcagtcctta

SEQ ID NO: 219875 - DNA, 25 bp, Mus musculus
caagtaagttatggttatcaccatt

SEQ ID NO: 219876 - DNA, 25 bp, Mus musculus
caagtaatacaagctatggtgaaat

SEQ ID NO: 219877 - DNA, 25 bp, Mus musculus
caagtaatcggagaggtattcttgc

SEQ ID NO: 219878 - DNA, 25 bp, Mus musculus
caagtaatcggtggcaattatggaa

SEQ ID NO: 219879 - DNA, 25 bp, Mus musculus
caagtaatgcaactgtggcaccttt

SEQ ID NO: 219880 - DNA, 25 bp, Mus musculus
caagtaatgcaagtgtggcaccttt

SEQ ID NO: 219881 - DNA, 25 bp, Mus musculus
caagtacaacatcttgattgccacg

SEQ ID NO: 219882 - DNA, 25 bp, Mus musculus
caagtacaatcaggcctggctgctg

SEQ ID NO: 219883 - DNA, 25 bp, Mus musculus
caagtacacagtgtgtgattcagtg

SEQ ID NO: 219884 - DNA, 25 bp, Mus musculus
caagtacaccaagtcaaaagtgaga

SEQ ID NO: 219885 - DNA, 25 bp, Mus musculus
caagtacaccaagtcggacttacgg

SEQ ID NO: 219886 - DNA, 25 bp, Mus musculus
caagtacacgacagacggcaaccac

SEQ ID NO: 219887 - DNA, 25 bp, Mus musculus
caagtacacggaaatgtgtcatgga

SEQ ID NO: 219888 - DNA, 25 bp, Mus musculus
caagtacactcaggctgaagctcta

SEQ ID NO: 219889 - DNA, 25 bp, Mus musculus
caagtacactcaggctgagggtaaa

SEQ ID NO: 219890 - DNA, 25 bp, Mus musculus
caagtacagcatggggcaaggagag

SEQ ID NO: 219891 - DNA, 25 bp, Mus musculus
caagtacagcatgggtatcaccagc

SEQ ID NO: 219892 - DNA, 25 bp, Mus musculus
caagtacagcttctggcctccaact

SEQ ID NO: 219893 - DNA, 25 bp, Mus musculus
caagtacaggagctttgtcatcccc

SEQ ID NO: 219894 - DNA, 25 bp, Mus musculus
caagtacaggaggccgagtgggttg

SEQ ID NO: 219895 - DNA, 25 bp, Mus musculus
caagtacaggtatgaactcaagcgg

SEQ ID NO: 219896 - DNA, 25 bp, Mus musculus
caagtacattcacttcttccctgtg

SEQ ID NO: 219897 - DNA, 25 bp, Mus musculus
caagtaccacagggagtccccccat

SEQ ID NO: 219898 - DNA, 25 bp, Mus musculus
caagtaccctgaaagagttaaacat

SEQ ID NO: 219899 - DNA, 25 bp, Mus musculus
caagtacccttgctgcaatgaagct

SEQ ID NO: 219900 - DNA, 25 bp, Mus musculus
caagtacctggcttcctgtgtccag

SEQ ID NO: 219901 - DNA, 25 bp, Mus musculus
caagtacctggtctggtcactcgag

SEQ ID NO: 219902 - DNA, 25 bp, Mus musculus
caagtaccttgggatcagagggctc

SEQ ID NO: 219903 - DNA, 25 bp, Mus musculus
caagtaccttgggggccggcacatg

SEQ ID NO: 219904 - DNA, 25 bp, Mus musculus
caagtacctttccaataccaaatat

SEQ ID NO: 219905 - DNA, 25 bp, Mus musculus
caagtacctttccagagctgcctta

SEQ ID NO: 219906 - DNA, 25 bp, Mus musculus
caagtacgactgaaggagaaaattt

SEQ ID NO: 219907 - DNA, 25 bp, Mus musculus
caagtacgagctttatggccacgct

SEQ ID NO: 219908 - DNA, 25 bp, Mus musculus
caagtacgtgctccaggcactacag

SEQ ID NO: 219909 - DNA, 25 bp, Mus musculus
caagtacgtgctctacaccctcgcc

SEQ ID NO: 219910 - DNA, 25 bp, Mus musculus
caagtacgtttactgtgagttcctt

SEQ ID NO: 219911 - DNA, 25 bp, Mus musculus
caagtactttgcccgagggctccgg

SEQ ID NO: 219912 - DNA, 25 bp, Mus musculus
caagtagcaaagactctgttacggc

SEQ ID NO: 219913 - DNA, 25 bp, Mus musculus
caagtagcaaaggtgattggatgtg

SEQ ID NO: 219914 - DNA, 25 bp, Mus musculus
caagtagcaatgaaggggtagagga

SEQ ID NO: 219915 - DNA, 25 bp, Mus musculus
caagtagccccagctgagaaaaaac

SEQ ID NO: 219916 - DNA, 25 bp, Mus musculus
caagtagctgatattgacgggcagt

SEQ ID NO: 219917 - DNA, 25 bp, Mus musculus
caagtaggctccgaggtggcgaaat

SEQ ID NO: 219918 - DNA, 25 bp, Mus musculus
caagtagtccaacagagaatgaagc

SEQ ID NO: 219919 - DNA, 25 bp, Mus musculus
caagtataaggtgatgttccctgtt

SEQ ID NO: 219920 - DNA, 25 bp, Mus musculus
caagtataaggtggctctcgagggc

SEQ ID NO: 219921 - DNA, 25 bp, Mus musculus
caagtataggacaacctcaagtctt

SEQ ID NO: 219922 - DNA, 25 bp, Mus musculus
caagtatctcagaaagacccaaatg

SEQ ID NO: 219923 - DNA, 25 bp, Mus musculus
caagtatctcagattgaagaccaaa

SEQ ID NO: 219924 - DNA, 25 bp, Mus musculus
caagtatgaacacaattttgaaata

SEQ ID NO: 219925 - DNA, 25 bp, Mus musculus
caagtatgacgccagctgtgactcc

SEQ ID NO: 219926 - DNA, 25 bp, Mus musculus
caagtatgagcccaattttgcccat

SEQ ID NO: 219927 - DNA, 25 bp, Mus musculus
caagtatgagcctgccatacagcgt

SEQ ID NO: 219928 - DNA, 25 bp, Mus musculus
caagtatgatttgaggacccagttc

SEQ ID NO: 219929 - DNA, 25 bp, Mus musculus
caagtatgcaggctgctcgtcagtg

SEQ ID NO: 219930 - DNA, 25 bp, Mus musculus
caagtatgcagtgctcgatgaagcc

SEQ ID NO: 219931 - DNA, 25 bp, Mus musculus
caagtatgtaccccaactgtgccat

SEQ ID NO: 219932 - DNA, 25 bp, Mus musculus
caagtattaccgtaataaaagagca

SEQ ID NO: 219933 - DNA, 25 bp, Mus musculus
caagtattcaaacaaggcaagcttc

SEQ ID NO: 219934 - DNA, 25 bp, Mus musculus
caagtcaaaaagattgataagtatc

SEQ ID NO: 219935 - DNA, 25 bp, Mus musculus
caagtcaaagaaatggcctccacct

SEQ ID NO: 219936 - DNA, 25 bp, Mus musculus
caagtcaaagaggcaaaagcaaaag

SEQ ID NO: 219937 - DNA, 25 bp, Mus musculus
caagtcaaagctgaggtacggcatc

SEQ ID NO: 219938 - DNA, 25 bp, Mus musculus
caagtcaaaggtttaacagaagaag

SEQ ID NO: 219939 - DNA, 25 bp, Mus musculus
caagtcaagaagaagatgtgttaca

SEQ ID NO: 219940 - DNA, 25 bp, Mus musculus
caagtcaatcaggcgacggtgtgga

SEQ ID NO: 219941 - DNA, 25 bp, Mus musculus
caagtcaatgcaaaatttccaggcc

SEQ ID NO: 219942 - DNA, 25 bp, Mus musculus
caagtcaatgcccagctaatgtatc

SEQ ID NO: 219943 - DNA, 25 bp, Mus musculus
caagtcaatggaaaatttccaggcc

SEQ ID NO: 219944 - DNA, 25 bp, Mus musculus
caagtcaatggccagctaatgtatc

SEQ ID NO: 219945 - DNA, 25 bp, Mus musculus
caagtcacaagagaatgcaggcatg

SEQ ID NO: 219946 - DNA, 25 bp, Mus musculus
caagtcacaagaggaactttgtggt

SEQ ID NO: 219947 - DNA, 25 bp, Mus musculus
caagtcacaagctcctcaggatccc

SEQ ID NO: 219948 - DNA, 25 bp, Mus musculus
caagtcacaaggacaaagtatagac

SEQ ID NO: 219949 - DNA, 25 bp, Mus musculus
caagtcacatggctgctgccacagg

SEQ ID NO: 219950 - DNA, 25 bp, Mus musculus
caagtcacgtcaaggtagccatccc

SEQ ID NO: 219951 - DNA, 25 bp, Mus musculus
caagtcactggaatttcttgatgga

SEQ ID NO: 219952 - DNA, 25 bp, Mus musculus
caagtcactgggaatctgtccttga

SEQ ID NO: 219953 - DNA, 25 bp, Mus musculus
caagtcagaaggcttcggagttggg

SEQ ID NO: 219954 - DNA, 25 bp, Mus musculus
caagtcagaagttttggggttacaa

SEQ ID NO: 219955 - DNA, 25 bp, Mus musculus
caagtcagggaaggttttggtcgtg

SEQ ID NO: 219956 - DNA, 25 bp, Mus musculus
caagtcatgtcattgtgcttcttct

SEQ ID NO: 219957 - DNA, 25 bp, Mus musculus
caagtcatttcctgtagaagaccct

SEQ ID NO: 219958 - DNA, 25 bp, Mus musculus
caagtccaaacagttcagatttcaa

SEQ ID NO: 219959 - DNA, 25 bp, Mus musculus
caagtccaagtccggtcagagcagc

SEQ ID NO: 219960 - DNA, 25 bp, Mus musculus
caagtccagaagaaatattatgggc

SEQ ID NO: 219961 - DNA, 25 bp, Mus musculus
caagtccagcaggaattgtctggga

SEQ ID NO: 219962 - DNA, 25 bp, Mus musculus
caagtccatcaacatcctaatcctg

SEQ ID NO: 219963 - DNA, 25 bp, Mus musculus
caagtccatgaagccatgtatgatc

SEQ ID NO: 219964 - DNA, 25 bp, Mus musculus
caagtccatgagtttaagatccatg

SEQ ID NO: 219965 - DNA, 25 bp, Mus musculus
caagtccatgattctgtaaccctga

SEQ ID NO: 219966 - DNA, 25 bp, Mus musculus
caagtccatgcaacagggagctgct

SEQ ID NO: 219967 - DNA, 25 bp, Mus musculus
caagtccatgttggagtttggattc

SEQ ID NO: 219968 - DNA, 25 bp, Mus musculus
caagtccattctcacatccatgaag

SEQ ID NO: 219969 - DNA, 25 bp, Mus musculus
caagtccccaggagaggagacaagg

SEQ ID NO: 219970 - DNA, 25 bp, Mus musculus
caagtccccaggccggggagcgtca

SEQ ID NO: 219971 - DNA, 25 bp, Mus musculus
caagtccctcagggtgatgtgaaca

SEQ ID NO: 219972 - DNA, 25 bp, Mus musculus
caagtccgagctctgaactcactga

SEQ ID NO: 219973 - DNA, 25 bp, Mus musculus
caagtccgaggcctacctccctttt

SEQ ID NO: 219974 - DNA, 25 bp, Mus musculus
caagtccgaggcctatgttgatcta

SEQ ID NO: 219975 - DNA, 25 bp, Mus musculus
caagtccgtgatcagaattgcattt

SEQ ID NO: 219976 - DNA, 25 bp, Mus musculus
caagtccgtgatcagttccgtatct

SEQ ID NO: 219977 - DNA, 25 bp, Mus musculus
caagtccttcagagaaacagcagca

SEQ ID NO: 219978 - DNA, 25 bp, Mus musculus
caagtccttggaaattagaaggatg

SEQ ID NO: 219979 - DNA, 25 bp, Mus musculus
caagtccttggaccatggtatctac

SEQ ID NO: 219980 - DNA, 25 bp, Mus musculus
caagtcctttcagtcttttgatgga

SEQ ID NO: 219981 - DNA, 25 bp, Mus musculus
caagtcctttccgggtggcaaggag

SEQ ID NO: 219982 - DNA, 25 bp, Mus musculus
caagtcctttgctagggaaagagaa

SEQ ID NO: 219983 - DNA, 25 bp, Mus musculus
caagtcgaaaagatatcccctgtat

SEQ ID NO: 219984 - DNA, 25 bp, Mus musculus
caagtcgcagggagagtctcttccg

SEQ ID NO: 219985 - DNA, 25 bp, Mus musculus
caagtcgcttcagcctttaccctcc

SEQ ID NO: 219986 - DNA, 25 bp, Mus musculus
caagtcgggacccttgcacaagcag

SEQ ID NO: 219987 - DNA, 25 bp, Mus musculus
caagtctacaaaagctcttcagaga

SEQ ID NO: 219988 - DNA, 25 bp, Mus musculus
caagtctacaaaaggtgaagtattt

SEQ ID NO: 219989 - DNA, 25 bp, Mus musculus
caagtctacaggtggtgtctaccat

SEQ ID NO: 219990 - DNA, 25 bp, Mus musculus
caagtctacctgcagcatcgaatcc

SEQ ID NO: 219991 - DNA, 25 bp, Mus musculus
caagtctacctgcaggagaccccat

SEQ ID NO: 219992 - DNA, 25 bp, Mus musculus
caagtctccaggtgctgctggggaa

SEQ ID NO: 219993 - DNA, 25 bp, Mus musculus
caagtctcgggtggatgaaactcag

SEQ ID NO: 219994 - DNA, 25 bp, Mus musculus
caagtctctcaagagtcaccatgta

SEQ ID NO: 219995 - DNA, 25 bp, Mus musculus
caagtctctcaagtatctcagcaat

SEQ ID NO: 219996 - DNA, 25 bp, Mus musculus
caagtctgagtgtggataagtcctg

SEQ ID NO: 219997 - DNA, 25 bp, Mus musculus
caagtctgctgccctgctgtcctcc

SEQ ID NO: 219998 - DNA, 25 bp, Mus musculus
caagtctgtgaggctgggacccacg

SEQ ID NO: 219999 - DNA, 25 bp, Mus musculus
caagtcttcacagagctgtgaaatc

SEQ ID NO: 220000 - DNA, 25 bp, Mus musculus
caagtgaaagaggtcaaccggatgc

SEQ ID NO: 220001 - DNA, 25 bp, Mus musculus
caagtgaacaagaactggaatgcac

SEQ ID NO: 220002 - DNA, 25 bp, Mus musculus
caagtgaacatccagatcatccaca

SEQ ID NO: 220003 - DNA, 25 bp, Mus musculus
caagtgaatgacgagccccacagga

SEQ ID NO: 220004 - DNA, 25 bp, Mus musculus
caagtgaatgacgagtgtggagagc

SEQ ID NO: 220005 - DNA, 25 bp, Mus musculus
caagtgaccatgcaagcgtatttga

SEQ ID NO: 220006 - DNA, 25 bp, Mus musculus
caagtgaccatggaagcgtatttga

SEQ ID NO: 220007 - DNA, 25 bp, Mus musculus
caagtgagaaccttacccacaggtc

SEQ ID NO: 220008 - DNA, 25 bp, Mus musculus
caagtgagaatgattggagcctgcc

SEQ ID NO: 220009 - DNA, 25 bp, Mus musculus
caagtgagaatgggttaactgctct

SEQ ID NO: 220010 - DNA, 25 bp, Mus musculus
caagtgagatacagattgctaataa

SEQ ID NO: 220011 - DNA, 25 bp, Mus musculus
caagtgagcagactcggagtgcggg

SEQ ID NO: 220012 - DNA, 25 bp, Mus musculus
caagtgagcagggacggcctcagga

SEQ ID NO: 220013 - DNA, 25 bp, Mus musculus
caagtgagtccgatgccttacggtc

SEQ ID NO: 220014 - DNA, 25 bp, Mus musculus
caagtgagtccgcaccttcagggtc

SEQ ID NO: 220015 - DNA, 25 bp, Mus musculus
caagtgagtcctccccttcaaagct

SEQ ID NO: 220016 - DNA, 25 bp, Mus musculus
caagtgagtgacagagcctccaggt

SEQ ID NO: 220017 - DNA, 25 bp, Mus musculus
caagtgagtgtgtgtgtcagcggtc

SEQ ID NO: 220018 - DNA, 25 bp, Mus musculus
caagtgatgaagaagccttcctgtt

SEQ ID NO: 220019 - DNA, 25 bp, Mus musculus
caagtgatgaaggagaggatgatgt

SEQ ID NO: 220020 - DNA, 25 bp, Mus musculus
caagtgatggagactcagaaagcct

SEQ ID NO: 220021 - DNA, 25 bp, Mus musculus
caagtgcaaccagacatccagaacc

SEQ ID NO: 220022 - DNA, 25 bp, Mus musculus
caagtgcaagatgatttaccttgct

SEQ ID NO: 220023 - DNA, 25 bp, Mus musculus
caagtgcaagcaatagctgtctgcc

SEQ ID NO: 220024 - DNA, 25 bp, Mus musculus
caagtgcaaggcaaaggcagagcaa

SEQ ID NO: 220025 - DNA, 25 bp, Mus musculus
caagtgcaaggtcatcttccatgat

SEQ ID NO: 220026 - DNA, 25 bp, Mus musculus
caagtgcaaggtttctgaaagacag

SEQ ID NO: 220027 - DNA, 25 bp, Mus musculus
caagtgcaatgaaattgaatcccac

SEQ ID NO: 220028 - DNA, 25 bp, Mus musculus
caagtgcaccggaagatggacgaca

SEQ ID NO: 220029 - DNA, 25 bp, Mus musculus
caagtgcaccggggtctgctgacag

SEQ ID NO: 220030 - DNA, 25 bp, Mus musculus
caagtgcagcgacggatcgaagcct

SEQ ID NO: 220031 - DNA, 25 bp, Mus musculus
caagtgcaggcggaacaagacaacc

SEQ ID NO: 220032 - DNA, 25 bp, Mus musculus
caagtgccaattcctgaatgccacg

SEQ ID NO: 220033 - DNA, 25 bp, Mus musculus
caagtgccacaaaggaacctacttg

SEQ ID NO: 220034 - DNA, 25 bp, Mus musculus
caagtgccagaacaccaagctggag

SEQ ID NO: 220035 - DNA, 25 bp, Mus musculus
caagtgccagagaggagttttgcct

SEQ ID NO: 220036 - DNA, 25 bp, Mus musculus
caagtgccaggtacaaccagcatcc

SEQ ID NO: 220037 - DNA, 25 bp, Mus musculus
caagtgccaggtacatatttttaca

SEQ ID NO: 220038 - DNA, 25 bp, Mus musculus
caagtgcctcagggcaccaccgtgg

SEQ ID NO: 220039 - DNA, 25 bp, Mus musculus
caagtgcgagaacatgtttgggatg

SEQ ID NO: 220040 - DNA, 25 bp, Mus musculus
caagtgcgagatcaaagaactgcaa

SEQ ID NO: 220041 - DNA, 25 bp, Mus musculus
caagtgcgagatgttgcatgtggct

SEQ ID NO: 220042 - DNA, 25 bp, Mus musculus
caagtgcgaggaaaaatccgctgca

SEQ ID NO: 220043 - DNA, 25 bp, Mus musculus
caagtgcgaggactgcgggaaggag

SEQ ID NO: 220044 - DNA, 25 bp, Mus musculus
caagtgctcaactggctgttggaaa

SEQ ID NO: 220045 - DNA, 25 bp, Mus musculus
caagtgctcaagtatgatgacttcc

SEQ ID NO: 220046 - DNA, 25 bp, Mus musculus
caagtgctcaggaagactcttcaat

SEQ ID NO: 220047 - DNA, 25 bp, Mus musculus
caagtgctcaggaggccatgacacc

SEQ ID NO: 220048 - DNA, 25 bp, Mus musculus
caagtgctccggccattccagcttc

SEQ ID NO: 220049 - DNA, 25 bp, Mus musculus
caagtgctgcaggaggctacttttt

SEQ ID NO: 220050 - DNA, 25 bp, Mus musculus
caagtggaaagctgcggctgctgta

SEQ ID NO: 220051 - DNA, 25 bp, Mus musculus
caagtggaataagagctcagtaagt

SEQ ID NO: 220052 - DNA, 25 bp, Mus musculus
caagtggaccagcagcagcagcagc

SEQ ID NO: 220053 - DNA, 25 bp, Mus musculus
caagtggaccaggactaccttattg

SEQ ID NO: 220054 - DNA, 25 bp, Mus musculus
caagtggagaaaggtttccttctct

SEQ ID NO: 220055 - DNA, 25 bp, Mus musculus
caagtggagaggagctctcctatgt

SEQ ID NO: 220056 - DNA, 25 bp, Mus musculus
caagtggatgaacagccagtcctac

SEQ ID NO: 220057 - DNA, 25 bp, Mus musculus
caagtggcaggattctgaatcagga

SEQ ID NO: 220058 - DNA, 25 bp, Mus musculus
caagtggctgagtatctccagacag

SEQ ID NO: 220059 - DNA, 25 bp, Mus musculus
caagtggctggcacccgatggcctc

SEQ ID NO: 220060 - DNA, 25 bp, Mus musculus
caagtgggagaaggtgcagcagctg

SEQ ID NO: 220061 - DNA, 25 bp, Mus musculus
caagtgggagaatccacctcattgc

SEQ ID NO: 220062 - DNA, 25 bp, Mus musculus
caagtggggacaccattaccatgca

SEQ ID NO: 220063 - DNA, 25 bp, Mus musculus
caagtggtcccagaatggaagccca

SEQ ID NO: 220064 - DNA, 25 bp, Mus musculus
caagtggtcccagggccagaaaaag

SEQ ID NO: 220065 - DNA, 25 bp, Mus musculus
caagtggtccctgagttcgtcaatg

SEQ ID NO: 220066 - DNA, 25 bp, Mus musculus
caagtggtggccaggacagcaacca

SEQ ID NO: 220067 - DNA, 25 bp, Mus musculus
caagtggttgcgaacaatttcgaag

SEQ ID NO: 220068 - DNA, 25 bp, Mus musculus
caagtggttgcggagaggtttgcag

SEQ ID NO: 220069 - DNA, 25 bp, Mus musculus
caagtggttgcggagcgagcccggc

SEQ ID NO: 220070 - DNA, 25 bp, Mus musculus
caagtgtaagagtgtgtttgacatc

SEQ ID NO: 220071 - DNA, 25 bp, Mus musculus
caagtgtcacaagatggagcaggaa

SEQ ID NO: 220072 - DNA, 25 bp, Mus musculus
caagtgtccatgaggttttggggcg

SEQ ID NO: 220073 - DNA, 25 bp, Mus musculus
caagtgtcccaagagggtgtattac

SEQ ID NO: 220074 - DNA, 25 bp, Mus musculus
caagtgtctcagaacgttttccaag

SEQ ID NO: 220075 - DNA, 25 bp, Mus musculus
caagtgtctcagaaggttttccaag

SEQ ID NO: 220076 - DNA, 25 bp, Mus musculus
caagtgtctgaacgagaagaactta

SEQ ID NO: 220077 - DNA, 25 bp, Mus musculus
caagtgtctggaatcccaggccaac

SEQ ID NO: 220078 - DNA, 25 bp, Mus musculus
caagtgtgacaaggtggtacaggat

SEQ ID NO: 220079 - DNA, 25 bp, Mus musculus
caagtgtgagaaaaaacaagaaggg

SEQ ID NO: 220080 - DNA, 25 bp, Mus musculus
caagtgtgaggactgtgggaaacct

SEQ ID NO: 220081 - DNA, 25 bp, Mus musculus
caagtgtgccagccaggtgggcatg

SEQ ID NO: 220082 - DNA, 25 bp, Mus musculus
caagtgtgccgatcccgtgcatggc

SEQ ID NO: 220083 - DNA, 25 bp, Mus musculus
caagtgtgccggagccagtgttacc

SEQ ID NO: 220084 - DNA, 25 bp, Mus musculus
caagtgtgtgtgcaacgatactgta

SEQ ID NO: 220085 - DNA, 25 bp, Mus musculus
caagtgttcaaagggctgaacgaca

SEQ ID NO: 220086 - DNA, 25 bp, Mus musculus
caagtgttcaagccgccccacgagg

SEQ ID NO: 220087 - DNA, 25 bp, Mus musculus
caagtgttcaaggtagccattgcgg

SEQ ID NO: 220088 - DNA, 25 bp, Mus musculus
caagtgttcagagccggaaacaact

SEQ ID NO: 220089 - DNA, 25 bp, Mus musculus
caagtgttcaggcctccttcttttt

SEQ ID NO: 220090 - DNA, 25 bp, Mus musculus
caagtgttgaaagtggagcaaaatg

SEQ ID NO: 220091 - DNA, 25 bp, Mus musculus
caagtgtttggcaggatgctcggga

SEQ ID NO: 220092 - DNA, 25 bp, Mus musculus
caagtgtttggcagtctccaaaacc

SEQ ID NO: 220093 - DNA, 25 bp, Mus musculus
caagttaaaaggaacttctgcaggt

SEQ ID NO: 220094 - DNA, 25 bp, Mus musculus
caagttaaagagaatgaaaatgtca

SEQ ID NO: 220095 - DNA, 25 bp, Mus musculus
caagttaactgctcttcagggcaaa

SEQ ID NO: 220096 - DNA, 25 bp, Mus musculus
caagttacaggaggcagtgacattc

SEQ ID NO: 220097 - DNA, 25 bp, Mus musculus
caagttacaggaggcagtgacgttc

SEQ ID NO: 220098 - DNA, 25 bp, Mus musculus
caagttacaggaggcagtgactttc

SEQ ID NO: 220099 - DNA, 25 bp, Mus musculus
caagttacaggtctcctgtttctgg

SEQ ID NO: 220100 - DNA, 25 bp, Mus musculus
caagttacgtaatcattgcaacgat

SEQ ID NO: 220101 - DNA, 25 bp, Mus musculus
caagttactcaggggtggatgagag

SEQ ID NO: 220102 - DNA, 25 bp, Mus musculus
caagttacttctgatggcctcgaac

SEQ ID NO: 220103 - DNA, 25 bp, Mus musculus
caagttagaccatggcacccgatgg

SEQ ID NO: 220104 - DNA, 25 bp, Mus musculus
caagttagaccatgtggtgaccatc

SEQ ID NO: 220105 - DNA, 25 bp, Mus musculus
caagttaggtgagaaagcagaagat

SEQ ID NO: 220106 - DNA, 25 bp, Mus musculus
caagttagttgatctgcctgcctct

SEQ ID NO: 220107 - DNA, 25 bp, Mus musculus
caagttatcaaagaggatgtctcgg

SEQ ID NO: 220108 - DNA, 25 bp, Mus musculus
caagttcaaatgagacatcctatga

SEQ ID NO: 220109 - DNA, 25 bp, Mus musculus
caagttcaacttcgctagttgattt

SEQ ID NO: 220110 - DNA, 25 bp, Mus musculus
caagttcaagagagcaggcaaggag

SEQ ID NO: 220111 - DNA, 25 bp, Mus musculus
caagttcaaggacagcagcctggcc

SEQ ID NO: 220112 - DNA, 25 bp, Mus musculus
caagttcaagggaatcaaagactcc

SEQ ID NO: 220113 - DNA, 25 bp, Mus musculus
caagttcacagatgtgaccttgagc

SEQ ID NO: 220114 - DNA, 25 bp, Mus musculus
caagttcaccaagatatttatcaac

SEQ ID NO: 220115 - DNA, 25 bp, Mus musculus
caagttcacttgcaggtgttgtttg

SEQ ID NO: 220116 - DNA, 25 bp, Mus musculus
caagttcacttgcagtcgagcaaaa

SEQ ID NO: 220117 - DNA, 25 bp, Mus musculus
caagttcaggacctctcctattaca

SEQ ID NO: 220118 - DNA, 25 bp, Mus musculus
caagttcaggtaacgcacagtggta

SEQ ID NO: 220119 - DNA, 25 bp, Mus musculus
caagttcatcagcgggcccctctcc

SEQ ID NO: 220120 - DNA, 25 bp, Mus musculus
caagttcatcaggtatttgtactgt

SEQ ID NO: 220121 - DNA, 25 bp, Mus musculus
caagttcatgaacacccagtatttt

SEQ ID NO: 220122 - DNA, 25 bp, Mus musculus
caagttcatgaggatctaccgttac

SEQ ID NO: 220123 - DNA, 25 bp, Mus musculus
caagttcatgatggattgggtcgaa

SEQ ID NO: 220124 - DNA, 25 bp, Mus musculus
caagttccagaacctgggtgtggtc

SEQ ID NO: 220125 - DNA, 25 bp, Mus musculus
caagttcccagaccttgtgaccgtg

SEQ ID NO: 220126 - DNA, 25 bp, Mus musculus
caagttcccagcaagccccgcccaa

SEQ ID NO: 220127 - DNA, 25 bp, Mus musculus
caagttcccgcctggtctctctggg

SEQ ID NO: 220128 - DNA, 25 bp, Mus musculus
caagttcctatgtcacctccaagta

SEQ ID NO: 220129 - DNA, 25 bp, Mus musculus
caagttcctgccccgtgaggagact

SEQ ID NO: 220130 - DNA, 25 bp, Mus musculus
caagttcgacgccttaaaagatgat

SEQ ID NO: 220131 - DNA, 25 bp, Mus musculus
caagttcgcagcctggacctgggga

SEQ ID NO: 220132 - DNA, 25 bp, Mus musculus
caagttcgcagcctgttcagaattg

SEQ ID NO: 220133 - DNA, 25 bp, Mus musculus
caagttctacaggcctgagaatacc

SEQ ID NO: 220134 - DNA, 25 bp, Mus musculus
caagttctacaggctgccacaggtg

SEQ ID NO: 220135 - DNA, 25 bp, Mus musculus
caagttctcagatgaatatctgaca

SEQ ID NO: 220136 - DNA, 25 bp, Mus musculus
caagttctcaggaacaatcctcaat

SEQ ID NO: 220137 - DNA, 25 bp, Mus musculus
caagttctcatgtctgcccaggacc

SEQ ID NO: 220138 - DNA, 25 bp, Mus musculus
caagttctcgcacacaagaagcagg

SEQ ID NO: 220139 - DNA, 25 bp, Mus musculus
caagttctcggcctatggctggtgt

SEQ ID NO: 220140 - DNA, 25 bp, Mus musculus
caagttctctgtcgggtaagcagct

SEQ ID NO: 220141 - DNA, 25 bp, Mus musculus
caagttctgcaaggatgaattgtct

SEQ ID NO: 220142 - DNA, 25 bp, Mus musculus
caagttgaaactgttatctgggagt

SEQ ID NO: 220143 - DNA, 25 bp, Mus musculus
caagttgaggaacaatacgaagagg

SEQ ID NO: 220144 - DNA, 25 bp, Mus musculus
caagttgaggaggaggcccaagagg

SEQ ID NO: 220145 - DNA, 25 bp, Mus musculus
caagttggcaggaacatcattcatg

SEQ ID NO: 220146 - DNA, 25 bp, Mus musculus
caagttgtcagggctccagtggctg

SEQ ID NO: 220147 - DNA, 25 bp, Mus musculus
caagttgtgagagaaggaagaggca

SEQ ID NO: 220148 - DNA, 25 bp, Mus musculus
caagttgtttaacggtagcgcctgg

SEQ ID NO: 220149 - DNA, 25 bp, Mus musculus
caagtttataagggtcgtcatgtca

SEQ ID NO: 220150 - DNA, 25 bp, Mus musculus
caagtttatacagatctttcatttg

SEQ ID NO: 220151 - DNA, 25 bp, Mus musculus
caagtttatacagggtgacatttgt

SEQ ID NO: 220152 - DNA, 25 bp, Mus musculus
caagtttattacagcactcaaatct

SEQ ID NO: 220153 - DNA, 25 bp, Mus musculus
caagtttattacagtgtgttcaaag

SEQ ID NO: 220154 - DNA, 25 bp, Mus musculus
caagtttcagcctcttagcaagtac

SEQ ID NO: 220155 - DNA, 25 bp, Mus musculus
caagtttcaggacacacaggaccag

SEQ ID NO: 220156 - DNA, 25 bp, Mus musculus
caagtttcttagacctctcacagcc

SEQ ID NO: 220157 - DNA, 25 bp, Mus musculus
caagtttgactggagacagcagtat

SEQ ID NO: 220158 - DNA, 25 bp, Mus musculus
caagtttgactgggccatgccgctg

SEQ ID NO: 220159 - DNA, 25 bp, Mus musculus
caagtttgagctgggaagatgccga

SEQ ID NO: 220160 - DNA, 25 bp, Mus musculus
caagtttgcaaagaagaaacagcat

SEQ ID NO: 220161 - DNA, 25 bp, Mus musculus
caagtttgcaaaggaaatatatccc

SEQ ID NO: 220162 - DNA, 25 bp, Mus musculus
caagtttgctattggccaggctggc

SEQ ID NO: 220163 - DNA, 25 bp, Mus musculus
caagtttgctattggggggctctgc

SEQ ID NO: 220164 - DNA, 25 bp, Mus musculus
caagtttgctattgtctaaatctca

SEQ ID NO: 220165 - DNA, 25 bp, Mus musculus
caagtttggaagataccaacatttt

SEQ ID NO: 220166 - DNA, 25 bp, Mus musculus
caagtttggcttcccgttgccctat

SEQ ID NO: 220167 - DNA, 25 bp, Mus musculus
caagtttggcttccggttgccctat

SEQ ID NO: 220168 - DNA, 25 bp, Mus musculus
caagtttgtccgcagaaatctgtct

SEQ ID NO: 220169 - DNA, 25 bp, Mus musculus
caagtttgtccgcaggaacctgaat

SEQ ID NO: 220170 - DNA, 25 bp, Mus musculus
caagtttgtgggtgaatccgtggac

SEQ ID NO: 220171 - DNA, 25 bp, Mus musculus
caagtttgtttgctcgctcgggcaa

SEQ ID NO: 220172 - DNA, 25 bp, Mus musculus
caagttttccagtgaagccatggca

SEQ ID NO: 220173 - DNA, 25 bp, Mus musculus
caagtttttataatgtaaagctgta

SEQ ID NO: 220174 - DNA, 25 bp, Mus musculus
caataaaacgggtaaaatgatccat

SEQ ID NO: 220175 - DNA, 25 bp, Mus musculus
caataaaagcaaagagtcttatcag

SEQ ID NO: 220176 - DNA, 25 bp, Mus musculus
caataaaagctcaggaagtctttaa

SEQ ID NO: 220177 - DNA, 25 bp, Mus musculus
caataaactacagactccatgaatt

SEQ ID NO: 220178 - DNA, 25 bp, Mus musculus
caataaagagcaggtgtcacaactg

SEQ ID NO: 220179 - DNA, 25 bp, Mus musculus
caataaagcagttttccacatcgat

SEQ ID NO: 220180 - DNA, 25 bp, Mus musculus
caataaatatgcttcatcttcagct

SEQ ID NO: 220181 - DNA, 25 bp, Mus musculus
caataaattaaagcaagcctgtggt

SEQ ID NO: 220182 - DNA, 25 bp, Mus musculus
caataacaaagctgcagtgttgaag

SEQ ID NO: 220183 - DNA, 25 bp, Mus musculus
caataacagtgactggtcctatttt

SEQ ID NO: 220184 - DNA, 25 bp, Mus musculus
caataaccagtctgtgaacctacac

SEQ ID NO: 220185 - DNA, 25 bp, Mus musculus
caataaccctaaaggccttgcatca

SEQ ID NO: 220186 - DNA, 25 bp, Mus musculus
caataacctccagggaggtatggac

SEQ ID NO: 220187 - DNA, 25 bp, Mus musculus
caataactatgcctgtggttgagcc

SEQ ID NO: 220188 - DNA, 25 bp, Mus musculus
caataagaagttgtgaagttatccg

SEQ ID NO: 220189 - DNA, 25 bp, Mus musculus
caataagactgggatgtttctttca

SEQ ID NO: 220190 - DNA, 25 bp, Mus musculus
caataagactgggtaaatttgatcc

SEQ ID NO: 220191 - DNA, 25 bp, Mus musculus
caataagagaagctggctgtatagg

SEQ ID NO: 220192 - DNA, 25 bp, Mus musculus
caataagcagctgacagagggtacc

SEQ ID NO: 220193 - DNA, 25 bp, Mus musculus
caataagcctggtggacccatggat

SEQ ID NO: 220194 - DNA, 25 bp, Mus musculus
caataagctacaggagcttcaagtc

SEQ ID NO: 220195 - DNA, 25 bp, Mus musculus
caataaggaacaggacggacggaat

SEQ ID NO: 220196 - DNA, 25 bp, Mus musculus
caataaggaacagtcagagctaaga

SEQ ID NO: 220197 - DNA, 25 bp, Mus musculus
caataaggacgggccaaggtggagc

SEQ ID NO: 220198 - DNA, 25 bp, Mus musculus
caataaggagaggatggctgtgctt

SEQ ID NO: 220199 - DNA, 25 bp, Mus musculus
caataaggatcgcctgaattctgcc

SEQ ID NO: 220200 - DNA, 25 bp, Mus musculus
caataataacaaaaactgaacgaac

SEQ ID NO: 220201 - DNA, 25 bp, Mus musculus
caataataacccaggtagtataact

SEQ ID NO: 220202 - DNA, 25 bp, Mus musculus
caataataacccagtgggtaagctg

SEQ ID NO: 220203 - DNA, 25 bp, Mus musculus
caataatcatcttcttcagggtgat

SEQ ID NO: 220204 - DNA, 25 bp, Mus musculus
caataatctgaagaccatggagcaa

SEQ ID NO: 220205 - DNA, 25 bp, Mus musculus
caataatctgtgaagatgtccagct

SEQ ID NO: 220206 - DNA, 25 bp, Mus musculus
caataatcttaacagtgtcttggct

SEQ ID NO: 220207 - DNA, 25 bp, Mus musculus
caataatgaaatggatataaccaag

SEQ ID NO: 220208 - DNA, 25 bp, Mus musculus
caataatgaaatggggattggtgtg

SEQ ID NO: 220209 - DNA, 25 bp, Mus musculus
caataatgaagacaactggattgct

SEQ ID NO: 220210 - DNA, 25 bp, Mus musculus
caataatggaagtgggaagagtgct

SEQ ID NO: 220211 - DNA, 25 bp, Mus musculus
caataatggacccacatgaaaaatg

SEQ ID NO: 220212 - DNA, 25 bp, Mus musculus
caataatggactcccttttatttga

SEQ ID NO: 220213 - DNA, 25 bp, Mus musculus
caataattatttggctgatgaagaa

SEQ ID NO: 220214 - DNA, 25 bp, Mus musculus
caataattctatactttctggcaag

SEQ ID NO: 220215 - DNA, 25 bp, Mus musculus
caataattcttatttgtagagtaac

SEQ ID NO: 220216 - DNA, 25 bp, Mus musculus
caatacaaagcttcaagaaaaattg

SEQ ID NO: 220217 - DNA, 25 bp, Mus musculus
caatacaaagtacctacgcatgctt

SEQ ID NO: 220218 - DNA, 25 bp, Mus musculus
caatacaaatacaggaagacatttc

SEQ ID NO: 220219 - DNA, 25 bp, Mus musculus
caatacaaccgggattgacccaccg

SEQ ID NO: 220220 - DNA, 25 bp, Mus musculus
caatacaaccgggattggcagaatt

SEQ ID NO: 220221 - DNA, 25 bp, Mus musculus
caatacaagaagagttatgaaaaga

SEQ ID NO: 220222 - DNA, 25 bp, Mus musculus
caatacaattgctgatactttgtgt

SEQ ID NO: 220223 - DNA, 25 bp, Mus musculus
caatacagatcagggagcctttgcc

SEQ ID NO: 220224 - DNA, 25 bp, Mus musculus
caatacagccaacagagcttggcca

SEQ ID NO: 220225 - DNA, 25 bp, Mus musculus
caatacagtagtctggacagaggat

SEQ ID NO: 220226 - DNA, 25 bp, Mus musculus
caatacagtgttatttctgctcagg

SEQ ID NO: 220227 - DNA, 25 bp, Mus musculus
caatacattcagcccacttggtgcc

SEQ ID NO: 220228 - DNA, 25 bp, Mus musculus
caataccaatagagggggctactga

SEQ ID NO: 220229 - DNA, 25 bp, Mus musculus
caataccaatatagggggctactga

SEQ ID NO: 220230 - DNA, 25 bp, Mus musculus
caataccagtgaaatgcctgcccag

SEQ ID NO: 220231 - DNA, 25 bp, Mus musculus
caatacccaaagatctttataagct

SEQ ID NO: 220232 - DNA, 25 bp, Mus musculus
caatacccagagatgtgaatacggc

SEQ ID NO: 220233 - DNA, 25 bp, Mus musculus
caataccctcacaaccccggctaca

SEQ ID NO: 220234 - DNA, 25 bp, Mus musculus
caatacctggagcacacatccattc

SEQ ID NO: 220235 - DNA, 25 bp, Mus musculus
caatacctggagtgtctggtcctgg

SEQ ID NO: 220236 - DNA, 25 bp, Mus musculus
caatacgaactgcctgatgtaaaga

SEQ ID NO: 220237 - DNA, 25 bp, Mus musculus
caatacgctacacgactggcccaga

SEQ ID NO: 220238 - DNA, 25 bp, Mus musculus
caatactacatttatgatctgcaga

SEQ ID NO: 220239 - DNA, 25 bp, Mus musculus
caatactcagggaggagactcccat

SEQ ID NO: 220240 - DNA, 25 bp, Mus musculus
caatacttctaccagaatcgagctc

SEQ ID NO: 220241 - DNA, 25 bp, Mus musculus
caatacttctatttttttattcata

SEQ ID NO: 220242 - DNA, 25 bp, Mus musculus
caatagaagaggagggactgatttg

SEQ ID NO: 220243 - DNA, 25 bp, Mus musculus
caatagaatacatggcccctgaaat

SEQ ID NO: 220244 - DNA, 25 bp, Mus musculus
caatagagaggttgatgttttggtc

SEQ ID NO: 220245 - DNA, 25 bp, Mus musculus
caatagagttgcttcacgtcttacc

SEQ ID NO: 220246 - DNA, 25 bp, Mus musculus
caatagcacaggaatgattggcagc

SEQ ID NO: 220247 - DNA, 25 bp, Mus musculus
caatagcagaaagttccctggctcc

SEQ ID NO: 220248 - DNA, 25 bp, Mus musculus
caatagcatagacatggactagggt

SEQ ID NO: 220249 - DNA, 25 bp, Mus musculus
caatagcatagacatggactttgta

SEQ ID NO: 220250 - DNA, 25 bp, Mus musculus
caatagcccctatggctgtagcagt

SEQ ID NO: 220251 - DNA, 25 bp, Mus musculus
caataggatccctggagtccctggc

SEQ ID NO: 220252 - DNA, 25 bp, Mus musculus
caataggattccaggagtccctggc

SEQ ID NO: 220253 - DNA, 25 bp, Mus musculus
caatagggcgctctgcctcacgtgt

SEQ ID NO: 220254 - DNA, 25 bp, Mus musculus
caatagggcggctatcctacctaca

SEQ ID NO: 220255 - DNA, 25 bp, Mus musculus
caatagggcggttatgggtgctaca

SEQ ID NO: 220256 - DNA, 25 bp, Mus musculus
caatagggcggtttatctgagcagg

SEQ ID NO: 220257 - DNA, 25 bp, Mus musculus
caataggggagcagccctggctgtc

SEQ ID NO: 220258 - DNA, 25 bp, Mus musculus
caataggggagcagggcatgaatct

SEQ ID NO: 220259 - DNA, 25 bp, Mus musculus
caatagtaaaggctggacccgacta

SEQ ID NO: 220260 - DNA, 25 bp, Mus musculus
caatagtcaaggtgaatatgaagaa

SEQ ID NO: 220261 - DNA, 25 bp, Mus musculus
caatagttcagacatcctacaggct

SEQ ID NO: 220262 - DNA, 25 bp, Mus musculus
caatataagtgaggtgttacatcct

SEQ ID NO: 220263 - DNA, 25 bp, Mus musculus
caatataatgctagataaatgggag

SEQ ID NO: 220264 - DNA, 25 bp, Mus musculus
caatatagcacagaacctatcaaca

SEQ ID NO: 220265 - DNA, 25 bp, Mus musculus
caatatatggagcagaagcaaatca

SEQ ID NO: 220266 - DNA, 25 bp, Mus musculus
caatatattacatagacatgcagaa

SEQ ID NO: 220267 - DNA, 25 bp, Mus musculus
caatatcaaggaagtgcttctcttt

SEQ ID NO: 220268 - DNA, 25 bp, Mus musculus
caatatcacgaggacaaagataatg

SEQ ID NO: 220269 - DNA, 25 bp, Mus musculus
caatatcatgattgaccccgtcctg

SEQ ID NO: 220270 - DNA, 25 bp, Mus musculus
caatatcatggggggatatccctgg

SEQ ID NO: 220271 - DNA, 25 bp, Mus musculus
caatatcgacttcaggctgatctct

SEQ ID NO: 220272 - DNA, 25 bp, Mus musculus
caatatctatctgcatgtccagatc

SEQ ID NO: 220273 - DNA, 25 bp, Mus musculus
caatatctcggacgtgagggtcaca

SEQ ID NO: 220274 - DNA, 25 bp, Mus musculus
caatatctcggagcggtttcctctg

SEQ ID NO: 220275 - DNA, 25 bp, Mus musculus
caatatctgacctgtgctgagccta

SEQ ID NO: 220276 - DNA, 25 bp, Mus musculus
caatatcttgggagccgaagaggcc

SEQ ID NO: 220277 - DNA, 25 bp, Mus musculus
caatatcttggtacagggagccgaa

SEQ ID NO: 220278 - DNA, 25 bp, Mus musculus
caatatgaagagtaaagatgggaaa

SEQ ID NO: 220279 - DNA, 25 bp, Mus musculus
caatatgaatatgtatgtgtttttc

SEQ ID NO: 220280 - DNA, 25 bp, Mus musculus
caatatgaatattagtgaacttatt

SEQ ID NO: 220281 - DNA, 25 bp, Mus musculus
caatatgaatattgctggcctataa

SEQ ID NO: 220282 - DNA, 25 bp, Mus musculus
caatatgactgaaacggcatggacc

SEQ ID NO: 220283 - DNA, 25 bp, Mus musculus
caatatgactgcccgaagcctttcc

SEQ ID NO: 220284 - DNA, 25 bp, Mus musculus
caatattaaagtaccaaccaaaaag

SEQ ID NO: 220285 - DNA, 25 bp, Mus musculus
caatattatccccatggagaaaatc

SEQ ID NO: 220286 - DNA, 25 bp, Mus musculus
caatattatccccatgttagaattg

SEQ ID NO: 220287 - DNA, 25 bp, Mus musculus
caatattcacaggtattcctttttt

SEQ ID NO: 220288 - DNA, 25 bp, Mus musculus
caatattccaaaggatggaggccag

SEQ ID NO: 220289 - DNA, 25 bp, Mus musculus
caatatttcagctaaactctgttca

SEQ ID NO: 220290 - DNA, 25 bp, Mus musculus
caatatttcaggtttcacagacatt

SEQ ID NO: 220291 - DNA, 25 bp, Mus musculus
caatattttcgagcattactgtatg

SEQ ID NO: 220292 - DNA, 25 bp, Mus musculus
caatatttttgaaggttaatatcct

SEQ ID NO: 220293 - DNA, 25 bp, Mus musculus
caatatttttgaagtatgcgagcat

SEQ ID NO: 220294 - DNA, 25 bp, Mus musculus
caatcaaaactagttggacaccccc

SEQ ID NO: 220295 - DNA, 25 bp, Mus musculus
caatcaaaagggaagttgtccttga

SEQ ID NO: 220296 - DNA, 25 bp, Mus musculus
caatcaaagacagagttgactcctg

SEQ ID NO: 220297 - DNA, 25 bp, Mus musculus
caatcaaagctctgaccattcccgg

SEQ ID NO: 220298 - DNA, 25 bp, Mus musculus
caatcaaatccaccgccatctccct

SEQ ID NO: 220299 - DNA, 25 bp, Mus musculus
caatcaaccaacagcctcctggact

SEQ ID NO: 220300 - DNA, 25 bp, Mus musculus
caatcaagcgcaaaggaaaatgact

SEQ ID NO: 220301 - DNA, 25 bp, Mus musculus
caatcaagcgcaaagggcccacatg

SEQ ID NO: 220302 - DNA, 25 bp, Mus musculus
caatcaataggtttccaggcaacaa

SEQ ID NO: 220303 - DNA, 25 bp, Mus musculus
caatcaattgaaatcaagcagaaga

SEQ ID NO: 220304 - DNA, 25 bp, Mus musculus
caatcaattttcaggaatgggacgg

SEQ ID NO: 220305 - DNA, 25 bp, Mus musculus
caatcaattttcaggtaataccaga

SEQ ID NO: 220306 - DNA, 25 bp, Mus musculus
caatcacagctctacctaggattcg

SEQ ID NO: 220307 - DNA, 25 bp, Mus musculus
caatcacatgtatgtctctgccctt

SEQ ID NO: 220308 - DNA, 25 bp, Mus musculus
caatcaccaccaaaggggagcgagg

SEQ ID NO: 220309 - DNA, 25 bp, Mus musculus
caatcacgacagcctgcctggcccc

SEQ ID NO: 220310 - DNA, 25 bp, Mus musculus
caatcacgcagtcatgtttactggt

SEQ ID NO: 220311 - DNA, 25 bp, Mus musculus
caatcacgcagtggatcgtagacat

SEQ ID NO: 220312 - DNA, 25 bp, Mus musculus
caatcactccccagccgtgggaatg

SEQ ID NO: 220313 - DNA, 25 bp, Mus musculus
caatcacttagcatgtgtgaactgt

SEQ ID NO: 220314 - DNA, 25 bp, Mus musculus
caatcacttggggaaaggcgaagct

SEQ ID NO: 220315 - DNA, 25 bp, Mus musculus
caatcagaatcacaaccagccagac

SEQ ID NO: 220316 - DNA, 25 bp, Mus musculus
caatcagagaaaggttctcaacgcc

SEQ ID NO: 220317 - DNA, 25 bp, Mus musculus
caatcagagaaaggtttaacatctc

SEQ ID NO: 220318 - DNA, 25 bp, Mus musculus
caatcagattctcagcttttaatat

SEQ ID NO: 220319 - DNA, 25 bp, Mus musculus
caatcagattctcaggtaagctctg

SEQ ID NO: 220320 - DNA, 25 bp, Mus musculus
caatcagcaggcccgtcaagtccac

SEQ ID NO: 220321 - DNA, 25 bp, Mus musculus
caatcagcaggggctgctggggcag

SEQ ID NO: 220322 - DNA, 25 bp, Mus musculus
caatcagcaggggtccttggactct

SEQ ID NO: 220323 - DNA, 25 bp, Mus musculus
caatcagcatagggatctgagaatt

SEQ ID NO: 220324 - DNA, 25 bp, Mus musculus
caatcagccaaggttactcctagaa

SEQ ID NO: 220325 - DNA, 25 bp, Mus musculus
caatcagcctgttgttgctcaccaa

SEQ ID NO: 220326 - DNA, 25 bp, Mus musculus
caatcagctacaagatgctgggtgc

SEQ ID NO: 220327 - DNA, 25 bp, Mus musculus
caatcagctgaaggaactcagagaa

SEQ ID NO: 220328 - DNA, 25 bp, Mus musculus
caatcagctgaagtgtgggagtatg

SEQ ID NO: 220329 - DNA, 25 bp, Mus musculus
caatcaggatgtgatcaaggcagta

SEQ ID NO: 220330 - DNA, 25 bp, Mus musculus
caatcataaggatgagaacaagttg

SEQ ID NO: 220331 - DNA, 25 bp, Mus musculus
caatcataagggcgagatgtgtgac

SEQ ID NO: 220332 - DNA, 25 bp, Mus musculus
caatcatcaggagcaaagagcccat

SEQ ID NO: 220333 - DNA, 25 bp, Mus musculus
caatcattagcaatcgtggaacagg

SEQ ID NO: 220334 - DNA, 25 bp, Mus musculus
caatcattagggagctgtccaggtt

SEQ ID NO: 220335 - DNA, 25 bp, Mus musculus
caatcattcccaagaatctgggtgt

SEQ ID NO: 220336 - DNA, 25 bp, Mus musculus
caatcattcccaagacaagcagtaa

SEQ ID NO: 220337 - DNA, 25 bp, Mus musculus
caatcattcccaagcatccagcgtc

SEQ ID NO: 220338 - DNA, 25 bp, Mus musculus
caatcattgatatgtcaactcagat

SEQ ID NO: 220339 - DNA, 25 bp, Mus musculus
caatccaacaccccgctgctgcctt

SEQ ID NO: 220340 - DNA, 25 bp, Mus musculus
caatccaacaccccgcttctcttgc

SEQ ID NO: 220341 - DNA, 25 bp, Mus musculus
caatccaatgaagccctcttattac

SEQ ID NO: 220342 - DNA, 25 bp, Mus musculus
caatccaatgaaggaaaaggtgcgg

SEQ ID NO: 220343 - DNA, 25 bp, Mus musculus
caatccacctgtgaggtttcaagtg

SEQ ID NO: 220344 - DNA, 25 bp, Mus musculus
caatccactttgtcaagtggattac

SEQ ID NO: 220345 - DNA, 25 bp, Mus musculus
caatccagcaggcatccagggcaga

SEQ ID NO: 220346 - DNA, 25 bp, Mus musculus
caatccagcggctcctggaggagaa

SEQ ID NO: 220347 - DNA, 25 bp, Mus musculus
caatccatgagatcagggcactgac

SEQ ID NO: 220348 - DNA, 25 bp, Mus musculus
caatccattatgaaattgaagacca

SEQ ID NO: 220349 - DNA, 25 bp, Mus musculus
caatccattatgaagaaacagggaa

SEQ ID NO: 220350 - DNA, 25 bp, Mus musculus
caatcccactgatgacactttcatg

SEQ ID NO: 220351 - DNA, 25 bp, Mus musculus
caatcccactgattttaggtgatgg

SEQ ID NO: 220352 - DNA, 25 bp, Mus musculus
caatcccactgtgcaaactctggcc

SEQ ID NO: 220353 - DNA, 25 bp, Mus musculus
caatcccatctgcttcgagagctgt

SEQ ID NO: 220354 - DNA, 25 bp, Mus musculus
caatcccatgcagctcggggtctgg

SEQ ID NO: 220355 - DNA, 25 bp, Mus musculus
caatccccaagaccctgaagaagaa

SEQ ID NO: 220356 - DNA, 25 bp, Mus musculus
caatccccaaggttcattctgtggt

SEQ ID NO: 220357 - DNA, 25 bp, Mus musculus
caatcccccaatgtgccttcaggat

SEQ ID NO: 220358 - DNA, 25 bp, Mus musculus
caatcccttaccgcgtcgagcagaa

SEQ ID NO: 220359 - DNA, 25 bp, Mus musculus
caatcccttccgggctgtggaagga

SEQ ID NO: 220360 - DNA, 25 bp, Mus musculus
caatcccttgctgatctgaataatg

SEQ ID NO: 220361 - DNA, 25 bp, Mus musculus
caatcctctagactttgagagtttt

SEQ ID NO: 220362 - DNA, 25 bp, Mus musculus
caatcctctagttttgacctgcctg

SEQ ID NO: 220363 - DNA, 25 bp, Mus musculus
caatcctgaaacaggtactacttgt

SEQ ID NO: 220364 - DNA, 25 bp, Mus musculus
caatcctgagaggaagatccaaaag

SEQ ID NO: 220365 - DNA, 25 bp, Mus musculus
caatcctgagcaggttgtggatgtg

SEQ ID NO: 220366 - DNA, 25 bp, Mus musculus
caatcctgaggtactgtactgatga

SEQ ID NO: 220367 - DNA, 25 bp, Mus musculus
caatcctgaggtgaagaggaagatc

SEQ ID NO: 220368 - DNA, 25 bp, Mus musculus
caatcctggcaagaggagcactcac

SEQ ID NO: 220369 - DNA, 25 bp, Mus musculus
caatcctgtcaggtgaaaatgctga

SEQ ID NO: 220370 - DNA, 25 bp, Mus musculus
caatccttacgggaaggtgcacact

SEQ ID NO: 220371 - DNA, 25 bp, Mus musculus
caatccttacggtgataaaattgcc

SEQ ID NO: 220372 - DNA, 25 bp, Mus musculus
caatccttcaccaatttatcaaaag

SEQ ID NO: 220373 - DNA, 25 bp, Mus musculus
caatccttctccagattatctgcaa

SEQ ID NO: 220374 - DNA, 25 bp, Mus musculus
caatcctttagcagctactccatcc

SEQ ID NO: 220375 - DNA, 25 bp, Mus musculus
caatcgacaccttggggcaacctat

SEQ ID NO: 220376 - DNA, 25 bp, Mus musculus
caatcgatcgatcgagtcagtccga

SEQ ID NO: 220377 - DNA, 25 bp, Mus musculus
caatcgcaagacggtgcctctggaa

SEQ ID NO: 220378 - DNA, 25 bp, Mus musculus
caatcgcaaggattcttcttctcag

SEQ ID NO: 220379 - DNA, 25 bp, Mus musculus
caatcgcagaggagaactgcggcac

SEQ ID NO: 220380 - DNA, 25 bp, Mus musculus
caatcgccactgtgttcacacgaga

SEQ ID NO: 220381 - DNA, 25 bp, Mus musculus
caatcggaagggtcctaaacaagac

SEQ ID NO: 220382 - DNA, 25 bp, Mus musculus
caatcggacagggatgagaccgggg

SEQ ID NO: 220383 - DNA, 25 bp, Mus musculus
caatctactgacagttgtccgtgta

SEQ ID NO: 220384 - DNA, 25 bp, Mus musculus
caatctagaaggtggtgacattcgt

SEQ ID NO: 220385 - DNA, 25 bp, Mus musculus
caatctatcagggcgtctaagaagc

SEQ ID NO: 220386 - DNA, 25 bp, Mus musculus
caatctatcagggtgaaggcgggaa

SEQ ID NO: 220387 - DNA, 25 bp, Mus musculus
caatctattaggcatcagaccatga

SEQ ID NO: 220388 - DNA, 25 bp, Mus musculus
caatctattagggaaagagatacca

SEQ ID NO: 220389 - DNA, 25 bp, Mus musculus
caatctcaaacaaagcatcgctgat

SEQ ID NO: 220390 - DNA, 25 bp, Mus musculus
caatctcaaacaaagcatctatcca

SEQ ID NO: 220391 - DNA, 25 bp, Mus musculus
caatctcaacaggacaagaaaagaa

SEQ ID NO: 220392 - DNA, 25 bp, Mus musculus
caatctcaacaggtttatttattta

SEQ ID NO: 220393 - DNA, 25 bp, Mus musculus
caatctcagggttttggcaaggagc

SEQ ID NO: 220394 - DNA, 25 bp, Mus musculus
caatctccaacaacaaagaagcctg

SEQ ID NO: 220395 - DNA, 25 bp, Mus musculus
caatctcgcacaggacctaaagatt

SEQ ID NO: 220396 - DNA, 25 bp, Mus musculus
caatctctccagccaggctgcttct

SEQ ID NO: 220397 - DNA, 25 bp, Mus musculus
caatctctccagccagtgaggatcc

SEQ ID NO: 220398 - DNA, 25 bp, Mus musculus
caatctctccagccatatctggcac

SEQ ID NO: 220399 - DNA, 25 bp, Mus musculus
caatctcttagtgagaagccagtgg

SEQ ID NO: 220400 - DNA, 25 bp, Mus musculus
caatctcttagtgataacaaagata

SEQ ID NO: 220401 - DNA, 25 bp, Mus musculus
caatctgaaagagttcttgcctctc

SEQ ID NO: 220402 - DNA, 25 bp, Mus musculus
caatctgaaaggtacccagaactta

SEQ ID NO: 220403 - DNA, 25 bp, Mus musculus
caatctgagctgccgaacaaaaaag

SEQ ID NO: 220404 - DNA, 25 bp, Mus musculus
caatctgcagaagcggcctctggag

SEQ ID NO: 220405 - DNA, 25 bp, Mus musculus
caatctgcagcgagcctatagtttg

SEQ ID NO: 220406 - DNA, 25 bp, Mus musculus
caatctgcagcgagtgcccttcgca

SEQ ID NO: 220407 - DNA, 25 bp, Mus musculus
caatctgcagcgagtttggccaagg

SEQ ID NO: 220408 - DNA, 25 bp, Mus musculus
caatctgcatgttaacaagcctgct

SEQ ID NO: 220409 - DNA, 25 bp, Mus musculus
caatctgccaagagacaaacagaag

SEQ ID NO: 220410 - DNA, 25 bp, Mus musculus
caatctgccaagtggtccagtgtga

SEQ ID NO: 220411 - DNA, 25 bp, Mus musculus
caatctgctgacgcttcgctgcggg

SEQ ID NO: 220412 - DNA, 25 bp, Mus musculus
caatctgctgacggatagcggcggc

SEQ ID NO: 220413 - DNA, 25 bp, Mus musculus
caatctggagacactagacctgaac

SEQ ID NO: 220414 - DNA, 25 bp, Mus musculus
caatctggctcttctgtcagtttgg

SEQ ID NO: 220415 - DNA, 25 bp, Mus musculus
caatctggggaactctgataagata

SEQ ID NO: 220416 - DNA, 25 bp, Mus musculus
caatctgtctgaaatactgatccag

SEQ ID NO: 220417 - DNA, 25 bp, Mus musculus
caatctgtctgaaatgagcatctgt

SEQ ID NO: 220418 - DNA, 25 bp, Mus musculus
caatctgtctttcagggtggtagga

SEQ ID NO: 220419 - DNA, 25 bp, Mus musculus
caatcttaaagatgaggtcctgtaa

SEQ ID NO: 220420 - DNA, 25 bp, Mus musculus
caatcttaaagatggaggcgccgag

SEQ ID NO: 220421 - DNA, 25 bp, Mus musculus
caatcttaaagatggcttgtccatg

SEQ ID NO: 220422 - DNA, 25 bp, Mus musculus
caatcttaaagatgggggctgaggc

SEQ ID NO: 220423 - DNA, 25 bp, Mus musculus
caatcttaaaggggcaagcggatct

SEQ ID NO: 220424 - DNA, 25 bp, Mus musculus
caatcttaacaattcaggccaaaca

SEQ ID NO: 220425 - DNA, 25 bp, Mus musculus
caatcttacaagaagtaaagcttag

SEQ ID NO: 220426 - DNA, 25 bp, Mus musculus
caatcttacaagaatgcagaaggct

SEQ ID NO: 220427 - DNA, 25 bp, Mus musculus
caatcttcaggtggctgtgaagaac

SEQ ID NO: 220428 - DNA, 25 bp, Mus musculus
caatcttccctggcacagaaacatc

SEQ ID NO: 220429 - DNA, 25 bp, Mus musculus
caatcttcctagtgacggctctgct

SEQ ID NO: 220430 - DNA, 25 bp, Mus musculus
caatcttcctagtgagccccgggtc

SEQ ID NO: 220431 - DNA, 25 bp, Mus musculus
caatcttctcagggacaggggcaga

SEQ ID NO: 220432 - DNA, 25 bp, Mus musculus
caatcttgatcgcagtaagagaaat

SEQ ID NO: 220433 - DNA, 25 bp, Mus musculus
caatctttttaaggtacagcaaggg

SEQ ID NO: 220434 - DNA, 25 bp, Mus musculus
caatgaaaaaaggctctggaatggc

SEQ ID NO: 220435 - DNA, 25 bp, Mus musculus
caatgaaaacaggcccagaggaact

SEQ ID NO: 220436 - DNA, 25 bp, Mus musculus
caatgaaaacagggcacctccgtct

SEQ ID NO: 220437 - DNA, 25 bp, Mus musculus
caatgaaaacctggatctgatggaa

SEQ ID NO: 220438 - DNA, 25 bp, Mus musculus
caatgaaaacctgtattttgaggaa

SEQ ID NO: 220439 - DNA, 25 bp, Mus musculus
caatgaaaacgtatccaacggttgt

SEQ ID NO: 220440 - DNA, 25 bp, Mus musculus
caatgaaaagggtgccttctcaggc

SEQ ID NO: 220441 - DNA, 25 bp, Mus musculus
caatgaaaagtgcggggaagcgctt

SEQ ID NO: 220442 - DNA, 25 bp, Mus musculus
caatgaaaatcttcagaagcagctg

SEQ ID NO: 220443 - DNA, 25 bp, Mus musculus
caatgaaaatgtcatggtttttaca

SEQ ID NO: 220444 - DNA, 25 bp, Mus musculus
caatgaaaatgttcagaagcagctg

SEQ ID NO: 220445 - DNA, 25 bp, Mus musculus
caatgaaagctcaaaacattcaagg

SEQ ID NO: 220446 - DNA, 25 bp, Mus musculus
caatgaaagctgacttaaaaacaag

SEQ ID NO: 220447 - DNA, 25 bp, Mus musculus
caatgaacaggttgataaagaaaaa

SEQ ID NO: 220448 - DNA, 25 bp, Mus musculus
caatgaagacagttgattcaggagt

SEQ ID NO: 220449 - DNA, 25 bp, Mus musculus
caatgaagaccctggtcttttgtgt

SEQ ID NO: 220450 - DNA, 25 bp, Mus musculus
caatgaagagaaagtacacactgcg

SEQ ID NO: 220451 - DNA, 25 bp, Mus musculus
caatgaagagcggctgattgacaag

SEQ ID NO: 220452 - DNA, 25 bp, Mus musculus
caatgaagagggcatctcctcccaa

SEQ ID NO: 220453 - DNA, 25 bp, Mus musculus
caatgaagatgaacagagcctccca

SEQ ID NO: 220454 - DNA, 25 bp, Mus musculus
caatgaagcaggtgaagatgacgat

SEQ ID NO: 220455 - DNA, 25 bp, Mus musculus
caatgaagcaggtttagatgacgat

SEQ ID NO: 220456 - DNA, 25 bp, Mus musculus
caatgaagctacgccaatcaaaacc

SEQ ID NO: 220457 - DNA, 25 bp, Mus musculus
caatgaagctacgtcgacgcataat

SEQ ID NO: 220458 - DNA, 25 bp, Mus musculus
caatgaagctctgatgcgctctgag

SEQ ID NO: 220459 - DNA, 25 bp, Mus musculus
caatgaaggagatgacaaatctagt

SEQ ID NO: 220460 - DNA, 25 bp, Mus musculus
caatgaaggagctgaaaggcctaat

SEQ ID NO: 220461 - DNA, 25 bp, Mus musculus
caatgaaggaggaatgtcaagtgaa

SEQ ID NO: 220462 - DNA, 25 bp, Mus musculus
caatgaaggaggtgactccaatgaa

SEQ ID NO: 220463 - DNA, 25 bp, Mus musculus
caatgaagtaaaacaagatactcat

SEQ ID NO: 220464 - DNA, 25 bp, Mus musculus
caatgaatgaacttgggggactgca

SEQ ID NO: 220465 - DNA, 25 bp, Mus musculus
caatgacaacttcatcgactgcttc

SEQ ID NO: 220466 - DNA, 25 bp, Mus musculus
caatgacacagaggggctggctgtg

SEQ ID NO: 220467 - DNA, 25 bp, Mus musculus
caatgacacagaggtggcggagaac

SEQ ID NO: 220468 - DNA, 25 bp, Mus musculus
caatgacactcagatcaaattgctt

SEQ ID NO: 220469 - DNA, 25 bp, Mus musculus
caatgacactgaggtcgcatcaaat

SEQ ID NO: 220470 - DNA, 25 bp, Mus musculus
caatgacagtgagaacacaaacctc

SEQ ID NO: 220471 - DNA, 25 bp, Mus musculus
caatgacattggtccctatggtgaa

SEQ ID NO: 220472 - DNA, 25 bp, Mus musculus
caatgaccaaacaggccatcgtgta

SEQ ID NO: 220473 - DNA, 25 bp, Mus musculus
caatgaccaaacaggcgctgctaag

SEQ ID NO: 220474 - DNA, 25 bp, Mus musculus
caatgaccaatatgagaaagtttgg

SEQ ID NO: 220475 - DNA, 25 bp, Mus musculus
caatgacccctatcctctctttgtg

SEQ ID NO: 220476 - DNA, 25 bp, Mus musculus
caatgacccgctgttcattccttgg

SEQ ID NO: 220477 - DNA, 25 bp, Mus musculus
caatgaccgtaaagtgttcgtgggt

SEQ ID NO: 220478 - DNA, 25 bp, Mus musculus
caatgacctaggaaggcccagcccc

SEQ ID NO: 220479 - DNA, 25 bp, Mus musculus
caatgacgatagaaagatcctcaac

SEQ ID NO: 220480 - DNA, 25 bp, Mus musculus
caatgacgattctgactgcccatac

SEQ ID NO: 220481 - DNA, 25 bp, Mus musculus
caatgacgcctgggtcctaaaggaa

SEQ ID NO: 220482 - DNA, 25 bp, Mus musculus
caatgacggtgccccctacagccag

SEQ ID NO: 220483 - DNA, 25 bp, Mus musculus
caatgactgggaaactactatagaa

SEQ ID NO: 220484 - DNA, 25 bp, Mus musculus
caatgacttcagagaatacctgtct

SEQ ID NO: 220485 - DNA, 25 bp, Mus musculus
caatgacttcagctgctgacctcac

SEQ ID NO: 220486 - DNA, 25 bp, Mus musculus
caatgactttaaggaggccacgcag

SEQ ID NO: 220487 - DNA, 25 bp, Mus musculus
caatgagaaatacggtgaggccctg

SEQ ID NO: 220488 - DNA, 25 bp, Mus musculus
caatgagaagatgagctcagcagtc

SEQ ID NO: 220489 - DNA, 25 bp, Mus musculus
caatgagaagatgagtcgggatata

SEQ ID NO: 220490 - DNA, 25 bp, Mus musculus
caatgagaagtgaacatgtatgagt

SEQ ID NO: 220491 - DNA, 25 bp, Mus musculus
caatgagaatgattcccttcaggcc

SEQ ID NO: 220492 - DNA, 25 bp, Mus musculus
caatgagacagccaagcagcacgaa

SEQ ID NO: 220493 - DNA, 25 bp, Mus musculus
caatgagacaggacatgggtcagcc

SEQ ID NO: 220494 - DNA, 25 bp, Mus musculus
caatgagagaggacacaatgtagga

SEQ ID NO: 220495 - DNA, 25 bp, Mus musculus
caatgagagcaggtcaaggaggcca

SEQ ID NO: 220496 - DNA, 25 bp, Mus musculus
caatgagagcagtgggagccggtga

SEQ ID NO: 220497 - DNA, 25 bp, Mus musculus
caatgagatcccagcccccgaaact

SEQ ID NO: 220498 - DNA, 25 bp, Mus musculus
caatgagatcccagctgagaaagcg

SEQ ID NO: 220499 - DNA, 25 bp, Mus musculus
caatgagatggagaggtgaggctgc

SEQ ID NO: 220500 - DNA, 25 bp, Mus musculus
caatgagattctgaccaagtgttgt

SEQ ID NO: 220501 - DNA, 25 bp, Mus musculus
caatgagattctgcacacttccaga

SEQ ID NO: 220502 - DNA, 25 bp, Mus musculus
caatgagcacaagactgacctaggt

SEQ ID NO: 220503 - DNA, 25 bp, Mus musculus
caatgagcacaagagctgcgaggag

SEQ ID NO: 220504 - DNA, 25 bp, Mus musculus
caatgagcagcaatggtaaatatgt

SEQ ID NO: 220505 - DNA, 25 bp, Mus musculus
caatgagcagggttggtttttgctc

SEQ ID NO: 220506 - DNA, 25 bp, Mus musculus
caatgagcaggtttcagcggacgtt

SEQ ID NO: 220507 - DNA, 25 bp, Mus musculus
caatgagctccaaggatgctctgga

SEQ ID NO: 220508 - DNA, 25 bp, Mus musculus
caatgaggccggcgtcctccgcccc

SEQ ID NO: 220509 - DNA, 25 bp, Mus musculus
caatgagggctggagtggcaaaacc

SEQ ID NO: 220510 - DNA, 25 bp, Mus musculus
caatgagtcctttggcttcaccgct

SEQ ID NO: 220511 - DNA, 25 bp, Mus musculus
caatgatattgacttagaaggtttt

SEQ ID NO: 220512 - DNA, 25 bp, Mus musculus
caatgatgaaagcagccatgtactc

SEQ ID NO: 220513 - DNA, 25 bp, Mus musculus
caatgatgaaagcagtggtccatgc

SEQ ID NO: 220514 - DNA, 25 bp, Mus musculus
caatgatgaagactctaaaatagag

SEQ ID NO: 220515 - DNA, 25 bp, Mus musculus
caatgatgaaggaaagaagaaagaa

SEQ ID NO: 220516 - DNA, 25 bp, Mus musculus
caatgatgaccaggatctgacacac

SEQ ID NO: 220517 - DNA, 25 bp, Mus musculus
caatgatgcaattcgggaggctttg

SEQ ID NO: 220518 - DNA, 25 bp, Mus musculus
caatgatgttgatgccctgctggca

SEQ ID NO: 220519 - DNA, 25 bp, Mus musculus
caatgattattgggtgtgcattatg

SEQ ID NO: 220520 - DNA, 25 bp, Mus musculus
caatgattcggcagacgggcctggg

SEQ ID NO: 220521 - DNA, 25 bp, Mus musculus
caatgcaaaacttgcagtaatgtga

SEQ ID NO: 220522 - DNA, 25 bp, Mus musculus
caatgcaaataagtgaaaaggaaga

SEQ ID NO: 220523 - DNA, 25 bp, Mus musculus
caatgcaaatgggaacaactgtata

SEQ ID NO: 220524 - DNA, 25 bp, Mus musculus
caatgcaattgtttacatgatagat

SEQ ID NO: 220525 - DNA, 25 bp, Mus musculus
caatgcacaggatgcagaagggaga

SEQ ID NO: 220526 - DNA, 25 bp, Mus musculus
caatgcacatcttcaagaaaaattg

SEQ ID NO: 220527 - DNA, 25 bp, Mus musculus
caatgcacatgtcagatactttggc

SEQ ID NO: 220528 - DNA, 25 bp, Mus musculus
caatgcacgactccgctctcactct

SEQ ID NO: 220529 - DNA, 25 bp, Mus musculus
caatgcagactcatggctgggctct

SEQ ID NO: 220530 - DNA, 25 bp, Mus musculus
caatgcagagaccgctacatcagaa

SEQ ID NO: 220531 - DNA, 25 bp, Mus musculus
caatgcagagactgatgaagtattt

SEQ ID NO: 220532 - DNA, 25 bp, Mus musculus
caatgcagagagtgacctcagttct

SEQ ID NO: 220533 - DNA, 25 bp, Mus musculus
caatgcagatgggtggcaagacatt

SEQ ID NO: 220534 - DNA, 25 bp, Mus musculus
caatgcagcccttttgatctcttgg

SEQ ID NO: 220535 - DNA, 25 bp, Mus musculus
caatgccaacgccacgccttctctc

SEQ ID NO: 220536 - DNA, 25 bp, Mus musculus
caatgccaacgtgagagtcattcag

SEQ ID NO: 220537 - DNA, 25 bp, Mus musculus
caatgccaacgtgagggagcctgta

SEQ ID NO: 220538 - DNA, 25 bp, Mus musculus
caatgccagaggagtctaagtctct

SEQ ID NO: 220539 - DNA, 25 bp, Mus musculus
caatgccagaggagtctaatgactt

SEQ ID NO: 220540 - DNA, 25 bp, Mus musculus
caatgccagagtctgttataatgcc

SEQ ID NO: 220541 - DNA, 25 bp, Mus musculus
caatgccattattgctttcgaggac

SEQ ID NO: 220542 - DNA, 25 bp, Mus musculus
caatgcccaggaaagagcccaagat

SEQ ID NO: 220543 - DNA, 25 bp, Mus musculus
caatgcccaggaaagtttctatgtt

SEQ ID NO: 220544 - DNA, 25 bp, Mus musculus
caatgcccccaagagatcccgtttc

SEQ ID NO: 220545 - DNA, 25 bp, Mus musculus
caatgcccccaaggacttaaaagag

SEQ ID NO: 220546 - DNA, 25 bp, Mus musculus
caatgcccctgttggaattcgacac

SEQ ID NO: 220547 - DNA, 25 bp, Mus musculus
caatgcctacagctcttaaccttta

SEQ ID NO: 220548 - DNA, 25 bp, Mus musculus
caatgcctacaggttcttcttcaca

SEQ ID NO: 220549 - DNA, 25 bp, Mus musculus
caatgcctagaagagtggttcttcg

SEQ ID NO: 220550 - DNA, 25 bp, Mus musculus
caatgcctagaaggggcaatgtcat

SEQ ID NO: 220551 - DNA, 25 bp, Mus musculus
caatgcctcagcttcggtagcccta

SEQ ID NO: 220552 - DNA, 25 bp, Mus musculus
caatgcctgcctgcaaatttcaggt

SEQ ID NO: 220553 - DNA, 25 bp, Mus musculus
caatgcgaacgacttcttcgccaag

SEQ ID NO: 220554 - DNA, 25 bp, Mus musculus
caatgcgatgcaaatcctctgggcc

SEQ ID NO: 220555 - DNA, 25 bp, Mus musculus
caatgcgatgctttggctcagcttt

SEQ ID NO: 220556 - DNA, 25 bp, Mus musculus
caatgcgtacagaaaagcggcatct

SEQ ID NO: 220557 - DNA, 25 bp, Mus musculus
caatgcgtacagccaggagtaggaa

SEQ ID NO: 220558 - DNA, 25 bp, Mus musculus
caatgcgtacagtagcatccgggct

SEQ ID NO: 220559 - DNA, 25 bp, Mus musculus
caatgctaaggttcactacaacatt

SEQ ID NO: 220560 - DNA, 25 bp, Mus musculus
caatgctaatgccagtgactcagaa

SEQ ID NO: 220561 - DNA, 25 bp, Mus musculus
caatgctatgtcagaaggcttatca

SEQ ID NO: 220562 - DNA, 25 bp, Mus musculus
caatgctatgtcaggaaaccatcca

SEQ ID NO: 220563 - DNA, 25 bp, Mus musculus
caatgctattggcttctcccatgat

SEQ ID NO: 220564 - DNA, 25 bp, Mus musculus
caatgctcaagagtatagtcatggc

SEQ ID NO: 220565 - DNA, 25 bp, Mus musculus
caatgctcaggtgcagtgtcttgag

SEQ ID NO: 220566 - DNA, 25 bp, Mus musculus
caatgctctccctctagagtgcaga

SEQ ID NO: 220567 - DNA, 25 bp, Mus musculus
caatgctgaagaaagcgaaatccgt

SEQ ID NO: 220568 - DNA, 25 bp, Mus musculus
caatgctgagagcaactgtgggtta

SEQ ID NO: 220569 - DNA, 25 bp, Mus musculus
caatgctgagagttgaaaaacatgt

SEQ ID NO: 220570 - DNA, 25 bp, Mus musculus
caatgctgaggatgcccaagaattc

SEQ ID NO: 220571 - DNA, 25 bp, Mus musculus
caatgctgtggtgacgctagagaac

SEQ ID NO: 220572 - DNA, 25 bp, Mus musculus
caatgcttatctagggtggaagaaa

SEQ ID NO: 220573 - DNA, 25 bp, Mus musculus
caatgcttcctatcgacatcccagg

SEQ ID NO: 220574 - DNA, 25 bp, Mus musculus
caatgcttcctatcggcctttcaga

SEQ ID NO: 220575 - DNA, 25 bp, Mus musculus
caatgcttctgattcttataaacag

SEQ ID NO: 220576 - DNA, 25 bp, Mus musculus
caatgcttctggtgaccttggggaa

SEQ ID NO: 220577 - DNA, 25 bp, Mus musculus
caatgctttcatcggctcggatgtg

SEQ ID NO: 220578 - DNA, 25 bp, Mus musculus
caatgctttgaatttaaaatctggc

SEQ ID NO: 220579 - DNA, 25 bp, Mus musculus
caatgctttgttcacagaggcgaag

SEQ ID NO: 220580 - DNA, 25 bp, Mus musculus
caatggaaatgaggaggctgctcag

SEQ ID NO: 220581 - DNA, 25 bp, Mus musculus
caatggaagagctggatgccttatt

SEQ ID NO: 220582 - DNA, 25 bp, Mus musculus
caatggaagcagaaaattgtgcaag

SEQ ID NO: 220583 - DNA, 25 bp, Mus musculus
caatggaatcctctggcaagcgcgc

SEQ ID NO: 220584 - DNA, 25 bp, Mus musculus
caatggacagatgtccactcccgag

SEQ ID NO: 220585 - DNA, 25 bp, Mus musculus
caatggacttcaggcaatccaaaag

SEQ ID NO: 220586 - DNA, 25 bp, Mus musculus
caatggagaaaaagtaaatataatc

SEQ ID NO: 220587 - DNA, 25 bp, Mus musculus
caatggagaaaacttctaaagatgg

SEQ ID NO: 220588 - DNA, 25 bp, Mus musculus
caatggagaaaatttgccttgaatt

SEQ ID NO: 220589 - DNA, 25 bp, Mus musculus
caatggagacaaggaacatggaata

SEQ ID NO: 220590 - DNA, 25 bp, Mus musculus
caatggaggaggtgactccaatgaa

SEQ ID NO: 220591 - DNA, 25 bp, Mus musculus
caatggagttctggggacaatggtg

SEQ ID NO: 220592 - DNA, 25 bp, Mus musculus
caatggagttgctggaaaatctgga

SEQ ID NO: 220593 - DNA, 25 bp, Mus musculus
caatggagttgctggaacagatttt

SEQ ID NO: 220594 - DNA, 25 bp, Mus musculus
caatggataaaggagccgggtgtgg

SEQ ID NO: 220595 - DNA, 25 bp, Mus musculus
caatggatacccagacctgattgtg

SEQ ID NO: 220596 - DNA, 25 bp, Mus musculus
caatggatacccaggcctgattgtg

SEQ ID NO: 220597 - DNA, 25 bp, Mus musculus
caatggatgaccagttggcaaagct

SEQ ID NO: 220598 - DNA, 25 bp, Mus musculus
caatggatttagaggaggatatgat

SEQ ID NO: 220599 - DNA, 25 bp, Mus musculus
caatggcaagggaggaccgggctca

SEQ ID NO: 220600 - DNA, 25 bp, Mus musculus
caatggcaagggagggcgtggacgg

SEQ ID NO: 220601 - DNA, 25 bp, Mus musculus
caatggccaaatcaaagaaatcggc

SEQ ID NO: 220602 - DNA, 25 bp, Mus musculus
caatggccaagaagtctacatgtgg

SEQ ID NO: 220603 - DNA, 25 bp, Mus musculus
caatggccagaagcaccaagaatga

SEQ ID NO: 220604 - DNA, 25 bp, Mus musculus
caatggccagcaggctccagcccac

SEQ ID NO: 220605 - DNA, 25 bp, Mus musculus
caatggccagcaggtgcttgtgtgt

SEQ ID NO: 220606 - DNA, 25 bp, Mus musculus
caatggccaggtcaggagtttactg

SEQ ID NO: 220607 - DNA, 25 bp, Mus musculus
caatggcctagaggtaatcaaggag

SEQ ID NO: 220608 - DNA, 25 bp, Mus musculus
caatggcctgatcacaactggctat

SEQ ID NO: 220609 - DNA, 25 bp, Mus musculus
caatggcgccagccaggacggcttc

SEQ ID NO: 220610 - DNA, 25 bp, Mus musculus
caatggcgtgatccaggaagccccg

SEQ ID NO: 220611 - DNA, 25 bp, Mus musculus
caatggctaaaactgtgcagttgta

SEQ ID NO: 220612 - DNA, 25 bp, Mus musculus
caatggctacatttgtcctctctaa

SEQ ID NO: 220613 - DNA, 25 bp, Mus musculus
caatggctatgttggaaatataaat

SEQ ID NO: 220614 - DNA, 25 bp, Mus musculus
caatggctcagggccatcgaagacg

SEQ ID NO: 220615 - DNA, 25 bp, Mus musculus
caatggcttcactgcgctggcattg

SEQ ID NO: 220616 - DNA, 25 bp, Mus musculus
caatggcttcgcaggctgcatgctc

SEQ ID NO: 220617 - DNA, 25 bp, Mus musculus
caatggctttgcgggctgcgtgcat

SEQ ID NO: 220618 - DNA, 25 bp, Mus musculus
caatgggaaaacggtatatgcacca

SEQ ID NO: 220619 - DNA, 25 bp, Mus musculus
caatgggaagtcattcagctggtca

SEQ ID NO: 220620 - DNA, 25 bp, Mus musculus
caatgggacaaatgcctggaatgat

SEQ ID NO: 220621 - DNA, 25 bp, Mus musculus
caatgggagaaaggggcgctcctgg

SEQ ID NO: 220622 - DNA, 25 bp, Mus musculus
caatgggataaaaagaatgctgcca

SEQ ID NO: 220623 - DNA, 25 bp, Mus musculus
caatgggatgttggcctgatgccct

SEQ ID NO: 220624 - DNA, 25 bp, Mus musculus
caatgggatgttgggtgtttgaagc

SEQ ID NO: 220625 - DNA, 25 bp, Mus musculus
caatgggccacgtctaaagagcctg

SEQ ID NO: 220626 - DNA, 25 bp, Mus musculus
caatggggaaggtctaaatgccatc

SEQ ID NO: 220627 - DNA, 25 bp, Mus musculus
caatggggctcctcctccaggcatg

SEQ ID NO: 220628 - DNA, 25 bp, Mus musculus
caatggggtacagggtgaagtactg

SEQ ID NO: 220629 - DNA, 25 bp, Mus musculus
caatgggtcccttttgcagtctggt

SEQ ID NO: 220630 - DNA, 25 bp, Mus musculus
caatgggtgaagaagaagctgactg

SEQ ID NO: 220631 - DNA, 25 bp, Mus musculus
caatggtactgtaggtggatagtcc

SEQ ID NO: 220632 - DNA, 25 bp, Mus musculus
caatggtatcgggctagccaaccat

SEQ ID NO: 220633 - DNA, 25 bp, Mus musculus
caatggtcctgagctgtttggggca

SEQ ID NO: 220634 - DNA, 25 bp, Mus musculus
caatggtcgaattcgccgcatgtct

SEQ ID NO: 220635 - DNA, 25 bp, Mus musculus
caatggtgtttgcaggagtgtaccc

SEQ ID NO: 220636 - DNA, 25 bp, Mus musculus
caatggttatggttatgcttcaaat

SEQ ID NO: 220637 - DNA, 25 bp, Mus musculus
caatggttgacaggcaatacccttt

SEQ ID NO: 220638 - DNA, 25 bp, Mus musculus
caatggttggctcaacttgatttct

SEQ ID NO: 220639 - DNA, 25 bp, Mus musculus
caatggttgggaaggaaaagggcta

SEQ ID NO: 220640 - DNA, 25 bp, Mus musculus
caatgtaaagaaccctgtgtattcc

SEQ ID NO: 220641 - DNA, 25 bp, Mus musculus
caatgtagagatcccctatttcact

SEQ ID NO: 220642 - DNA, 25 bp, Mus musculus
caatgtagccaacccttcactgaag

SEQ ID NO: 220643 - DNA, 25 bp, Mus musculus
caatgtatccaagggagcccaggaa

SEQ ID NO: 220644 - DNA, 25 bp, Mus musculus
caatgtatctggtgaccacattagt

SEQ ID NO: 220645 - DNA, 25 bp, Mus musculus
caatgtatgcagggacgcatcgttg

SEQ ID NO: 220646 - DNA, 25 bp, Mus musculus
caatgtatgcgcaaggcttcattct

SEQ ID NO: 220647 - DNA, 25 bp, Mus musculus
caatgtcaaatgtgactatgacaat

SEQ ID NO: 220648 - DNA, 25 bp, Mus musculus
caatgtcacctataattcacagaac

SEQ ID NO: 220649 - DNA, 25 bp, Mus musculus
caatgtcacgaacttgtttcctgcc

SEQ ID NO: 220650 - DNA, 25 bp, Mus musculus
caatgtcactcaggtgcggacattc

SEQ ID NO: 220651 - DNA, 25 bp, Mus musculus
caatgtccaggaccgcattggtcgc

SEQ ID NO: 220652 - DNA, 25 bp, Mus musculus
caatgtcctgatttcagagtgggtg

SEQ ID NO: 220653 - DNA, 25 bp, Mus musculus
caatgtctcagatgcactcccatcc

SEQ ID NO: 220654 - DNA, 25 bp, Mus musculus
caatgtctttgcaccctgtgacctg

SEQ ID NO: 220655 - DNA, 25 bp, Mus musculus
caatgtctttggtttcaacagctcc

SEQ ID NO: 220656 - DNA, 25 bp, Mus musculus
caatgtgaaagtacatttgcaagaa

SEQ ID NO: 220657 - DNA, 25 bp, Mus musculus
caatgtgaacaagcttgtgacacag

SEQ ID NO: 220658 - DNA, 25 bp, Mus musculus
caatgtgaagatatcaatgaatgct

SEQ ID NO: 220659 - DNA, 25 bp, Mus musculus
caatgtgaagatattgatgaatgcg

SEQ ID NO: 220660 - DNA, 25 bp, Mus musculus
caatgtgaaggctccagcctggcat

SEQ ID NO: 220661 - DNA, 25 bp, Mus musculus
caatgtgaatcttctggacatgttg

SEQ ID NO: 220662 - DNA, 25 bp, Mus musculus
caatgtgacagtccatatgttgtga

SEQ ID NO: 220663 - DNA, 25 bp, Mus musculus
caatgtgattttcaggaaaagtgca

SEQ ID NO: 220664 - DNA, 25 bp, Mus musculus
caatgtgcagcatgagaatggctat

SEQ ID NO: 220665 - DNA, 25 bp, Mus musculus
caatgtgcagcatgcttttcccagt

SEQ ID NO: 220666 - DNA, 25 bp, Mus musculus
caatgtgccaatattcaaggacaag

SEQ ID NO: 220667 - DNA, 25 bp, Mus musculus
caatgtgcttacatgcatgtgtaat

SEQ ID NO: 220668 - DNA, 25 bp, Mus musculus
caatgtgcttacgagtctactgtgc

SEQ ID NO: 220669 - DNA, 25 bp, Mus musculus
caatgtggaaatctctcaggagaag

SEQ ID NO: 220670 - DNA, 25 bp, Mus musculus
caatgtggaaatgtgttctgcccag

SEQ ID NO: 220671 - DNA, 25 bp, Mus musculus
caatgtggaaattttatagaacaag

SEQ ID NO: 220672 - DNA, 25 bp, Mus musculus
caatgtggaagtcttcagtaacttg

SEQ ID NO: 220673 - DNA, 25 bp, Mus musculus
caatgtggaataaagtatcaggagt

SEQ ID NO: 220674 - DNA, 25 bp, Mus musculus
caatgtggacaaggtattctttgat

SEQ ID NO: 220675 - DNA, 25 bp, Mus musculus
caatgtggacaaggtcattgtgctc

SEQ ID NO: 220676 - DNA, 25 bp, Mus musculus
caatgtggacctggccatgggcaag

SEQ ID NO: 220677 - DNA, 25 bp, Mus musculus
caatgtggagaaggtgaaatttatg

SEQ ID NO: 220678 - DNA, 25 bp, Mus musculus
caatgtggagaatgcatttttcact

SEQ ID NO: 220679 - DNA, 25 bp, Mus musculus
caatgtggatcaggaatcctttctg

SEQ ID NO: 220680 - DNA, 25 bp, Mus musculus
caatgtggctagctataaaaccatt

SEQ ID NO: 220681 - DNA, 25 bp, Mus musculus
caatgtggtacccttgtgaatacat

SEQ ID NO: 220682 - DNA, 25 bp, Mus musculus
caatgtggttgccggacctacaacc

SEQ ID NO: 220683 - DNA, 25 bp, Mus musculus
caatgtgtcacccattctaacggca

SEQ ID NO: 220684 - DNA, 25 bp, Mus musculus
caatgtgtccgacttcccggagagg

SEQ ID NO: 220685 - DNA, 25 bp, Mus musculus
caatgtgttcagcccgcatgcccta

SEQ ID NO: 220686 - DNA, 25 bp, Mus musculus
caatgtgttccttgcccagtctcga

SEQ ID NO: 220687 - DNA, 25 bp, Mus musculus
caatgtgttgcaacagaccaactgg

SEQ ID NO: 220688 - DNA, 25 bp, Mus musculus
caatgttaagggatcgcttacactt

SEQ ID NO: 220689 - DNA, 25 bp, Mus musculus
caatgttcaccagaaaccaggtggc

SEQ ID NO: 220690 - DNA, 25 bp, Mus musculus
caatgttgagctctctggcaagact

SEQ ID NO: 220691 - DNA, 25 bp, Mus musculus
caatgttggatagagatatgtccgg

SEQ ID NO: 220692 - DNA, 25 bp, Mus musculus
caatgttgggcagatcctgctcatc

SEQ ID NO: 220693 - DNA, 25 bp, Mus musculus
caatgttgggcaggatgtttggatc

SEQ ID NO: 220694 - DNA, 25 bp, Mus musculus
caatgttggtgggcttccaccactg

SEQ ID NO: 220695 - DNA, 25 bp, Mus musculus
caatgttgtacggctgatggatgtc

SEQ ID NO: 220696 - DNA, 25 bp, Mus musculus
caatgttgtacggtggttacgctct

SEQ ID NO: 220697 - DNA, 25 bp, Mus musculus
caatgttgtgaagaacttcaagttg

SEQ ID NO: 220698 - DNA, 25 bp, Mus musculus
caatgttgtgaagctcttcaatgat

SEQ ID NO: 220699 - DNA, 25 bp, Mus musculus
caatgtttcaggacagtcggcccaa

SEQ ID NO: 220700 - DNA, 25 bp, Mus musculus
caatgtttgcctgggaaatgctcat

SEQ ID NO: 220701 - DNA, 25 bp, Mus musculus
caatgtttgtgtgtggacaggccaa

SEQ ID NO: 220702 - DNA, 25 bp, Mus musculus
caattaaaaagacgctgaacccaaa

SEQ ID NO: 220703 - DNA, 25 bp, Mus musculus
caattacaaaggtggctttgacact

SEQ ID NO: 220704 - DNA, 25 bp, Mus musculus
caattacagaaggtcaccagaaaga

SEQ ID NO: 220705 - DNA, 25 bp, Mus musculus
caattacagataaggaactgctgaa

SEQ ID NO: 220706 - DNA, 25 bp, Mus musculus
caattacagataaggtgttctcatt

SEQ ID NO: 220707 - DNA, 25 bp, Mus musculus
caattacataagcccatggatggga

SEQ ID NO: 220708 - DNA, 25 bp, Mus musculus
caattacatcaagaagtccaaggtt

SEQ ID NO: 220709 - DNA, 25 bp, Mus musculus
caattaccagggtgaaagaattgac

SEQ ID NO: 220710 - DNA, 25 bp, Mus musculus
caattaccagtgatatgctgtggaa

SEQ ID NO: 220711 - DNA, 25 bp, Mus musculus
caattacctgaaggatgggccttac

SEQ ID NO: 220712 - DNA, 25 bp, Mus musculus
caattactacaagggccagtatatc

SEQ ID NO: 220713 - DNA, 25 bp, Mus musculus
caattactgagcaaattgctgttac

SEQ ID NO: 220714 - DNA, 25 bp, Mus musculus
caattagaatggcagggacggtcaa

SEQ ID NO: 220715 - DNA, 25 bp, Mus musculus
caattatacaactgctgacaagtaa

SEQ ID NO: 220716 - DNA, 25 bp, Mus musculus
caattatgaagagtttgtacagatg

SEQ ID NO: 220717 - DNA, 25 bp, Mus musculus
caattatgagggttcagctcctaat

SEQ ID NO: 220718 - DNA, 25 bp, Mus musculus
caattatgggacctaatgacagccc

SEQ ID NO: 220719 - DNA, 25 bp, Mus musculus
caattatgggacctctcaatgaaag

SEQ ID NO: 220720 - DNA, 25 bp, Mus musculus
caattattacaggtaatgaagaagg

SEQ ID NO: 220721 - DNA, 25 bp, Mus musculus
caattcaagctatgatgaccagacc

SEQ ID NO: 220722 - DNA, 25 bp, Mus musculus
caattcacaccgaaactatgttcca

SEQ ID NO: 220723 - DNA, 25 bp, Mus musculus
caattcagaaagagagtcctgttga

SEQ ID NO: 220724 - DNA, 25 bp, Mus musculus
caattcagaatgtctctcatgttac

SEQ ID NO: 220725 - DNA, 25 bp, Mus musculus
caattcagaatgttgttcagatgtc

SEQ ID NO: 220726 - DNA, 25 bp, Mus musculus
caattcaggaagcacagaccaagcg

SEQ ID NO: 220727 - DNA, 25 bp, Mus musculus
caattcagtgaggccttggaaactg

SEQ ID NO: 220728 - DNA, 25 bp, Mus musculus
caattcagtgaggtcaaaggactgg

SEQ ID NO: 220729 - DNA, 25 bp, Mus musculus
caattccaatgcaaacaagaatgcc

SEQ ID NO: 220730 - DNA, 25 bp, Mus musculus
caattccatctgctcccagaattac

SEQ ID NO: 220731 - DNA, 25 bp, Mus musculus
caattccatgccgggttgcttccta

SEQ ID NO: 220732 - DNA, 25 bp, Mus musculus
caattccatggctgcagaagaggaa

SEQ ID NO: 220733 - DNA, 25 bp, Mus musculus
caattccatggtactctttgatcat

SEQ ID NO: 220734 - DNA, 25 bp, Mus musculus
caattcccaccaaatatacgagccg

SEQ ID NO: 220735 - DNA, 25 bp, Mus musculus
caattcccggacggcctatgcaatc

SEQ ID NO: 220736 - DNA, 25 bp, Mus musculus
caattcccttaggaacctcctctgg

SEQ ID NO: 220737 - DNA, 25 bp, Mus musculus
caattcccttggatttcagtttttc

SEQ ID NO: 220738 - DNA, 25 bp, Mus musculus
caattcctccaggtcatcgtcacgg

SEQ ID NO: 220739 - DNA, 25 bp, Mus musculus
caattcctcccctggctagagcatg

SEQ ID NO: 220740 - DNA, 25 bp, Mus musculus
caattcctctacgctgagcggcagc

SEQ ID NO: 220741 - DNA, 25 bp, Mus musculus
caattccttggaggactcaaggaaa

SEQ ID NO: 220742 - DNA, 25 bp, Mus musculus
caattccttggaggttcattctgtg

SEQ ID NO: 220743 - DNA, 25 bp, Mus musculus
caattccttggggtaatgatgtggg

SEQ ID NO: 220744 - DNA, 25 bp, Mus musculus
caattcgagaagtcaaccatccaaa

SEQ ID NO: 220745 - DNA, 25 bp, Mus musculus
caattcgtgcaccgtaacgtacctg

SEQ ID NO: 220746 - DNA, 25 bp, Mus musculus
caattcgtggaagaggtaaagagag

SEQ ID NO: 220747 - DNA, 25 bp, Mus musculus
caattctaacagagatataccgcat

SEQ ID NO: 220748 - DNA, 25 bp, Mus musculus
caattctacccatttctcccaagtg

SEQ ID NO: 220749 - DNA, 25 bp, Mus musculus
caattctatacacaggtgattttcg

SEQ ID NO: 220750 - DNA, 25 bp, Mus musculus
caattctataggtcctgagggaggc

SEQ ID NO: 220751 - DNA, 25 bp, Mus musculus
caattctccagcaaggcatgatcac

SEQ ID NO: 220752 - DNA, 25 bp, Mus musculus
caattctccagcaagttacagtccc

SEQ ID NO: 220753 - DNA, 25 bp, Mus musculus
caattctccagccaatgctgactac

SEQ ID NO: 220754 - DNA, 25 bp, Mus musculus
caattctccccaggaaaatacagaa

SEQ ID NO: 220755 - DNA, 25 bp, Mus musculus
caattctgatgtactaaaaatcact

SEQ ID NO: 220756 - DNA, 25 bp, Mus musculus
caattctggcaggaagcagtgaagc

SEQ ID NO: 220757 - DNA, 25 bp, Mus musculus
caattctggcaggacatgaagctat

SEQ ID NO: 220758 - DNA, 25 bp, Mus musculus
caattctggcaggtagtgctgccct

SEQ ID NO: 220759 - DNA, 25 bp, Mus musculus
caattctgttcaggaggaagcagaa

SEQ ID NO: 220760 - DNA, 25 bp, Mus musculus
caattctgtttcgatctatgtaaga

SEQ ID NO: 220761 - DNA, 25 bp, Mus musculus
caattctgtttcggacttgccatca

SEQ ID NO: 220762 - DNA, 25 bp, Mus musculus
caattgaaatcacagctcccgaggg

SEQ ID NO: 220763 - DNA, 25 bp, Mus musculus
caattgaaatcagggaagctgctca

SEQ ID NO: 220764 - DNA, 25 bp, Mus musculus
caattgagaccaggccatgctcaga

SEQ ID NO: 220765 - DNA, 25 bp, Mus musculus
caattgatcatgggccctggggaga

SEQ ID NO: 220766 - DNA, 25 bp, Mus musculus
caattgcaaagaaaagacccaagtg

SEQ ID NO: 220767 - DNA, 25 bp, Mus musculus
caattgccaaggcaggtgcagtgaa

SEQ ID NO: 220768 - DNA, 25 bp, Mus musculus
caattgcccaagaacaaacctgtga

SEQ ID NO: 220769 - DNA, 25 bp, Mus musculus
caattgcccaagagttaaccagctt

SEQ ID NO: 220770 - DNA, 25 bp, Mus musculus
caattgcccaaggtaataatcttca

SEQ ID NO: 220771 - DNA, 25 bp, Mus musculus
caattgcgagctctgcaggagcggc

SEQ ID NO: 220772 - DNA, 25 bp, Mus musculus
caattgctcaggagcacagcgagct

SEQ ID NO: 220773 - DNA, 25 bp, Mus musculus
caattggaaaagaggtccttctgta

SEQ ID NO: 220774 - DNA, 25 bp, Mus musculus
caattggaaaagataaataaagaca

SEQ ID NO: 220775 - DNA, 25 bp, Mus musculus
caattggaaaagatatgatgaggaa

SEQ ID NO: 220776 - DNA, 25 bp, Mus musculus
caattggaaaaggaatcttctattt

SEQ ID NO: 220777 - DNA, 25 bp, Mus musculus
caattggaaagacagtgatgtgact

SEQ ID NO: 220778 - DNA, 25 bp, Mus musculus
caattggaaaggtatctggccagga

SEQ ID NO: 220779 - DNA, 25 bp, Mus musculus
caattggaaatcaggtgattcgtaa

SEQ ID NO: 220780 - DNA, 25 bp, Mus musculus
caattggaagaaaggtggtggtgtc

SEQ ID NO: 220781 - DNA, 25 bp, Mus musculus
caattggaagccaagatttcctggc

SEQ ID NO: 220782 - DNA, 25 bp, Mus musculus
caattggaagccaagggtgtaaatt

SEQ ID NO: 220783 - DNA, 25 bp, Mus musculus
caattggaatgaaggctcagatccg

SEQ ID NO: 220784 - DNA, 25 bp, Mus musculus
caattggactcaagcggatagccaa

SEQ ID NO: 220785 - DNA, 25 bp, Mus musculus
caattggcacacactggttctggat

SEQ ID NO: 220786 - DNA, 25 bp, Mus musculus
caattggcgaggactttgtgttgct

SEQ ID NO: 220787 - DNA, 25 bp, Mus musculus
caattgtcttgcttcattaaaaaaa

SEQ ID NO: 220788 - DNA, 25 bp, Mus musculus
caattgtcttgcttcattaacaatt

SEQ ID NO: 220789 - DNA, 25 bp, Mus musculus
caattgttatcccaactgtaaattt

SEQ ID NO: 220790 - DNA, 25 bp, Mus musculus
caatttagacaagtatgatgatgtt

SEQ ID NO: 220791 - DNA, 25 bp, Mus musculus
caatttagacaattggtggccattt

SEQ ID NO: 220792 - DNA, 25 bp, Mus musculus
caatttaggaaaacaataaatgcac

SEQ ID NO: 220793 - DNA, 25 bp, Mus musculus
caatttaggaaaacagtccttcacg

SEQ ID NO: 220794 - DNA, 25 bp, Mus musculus
caatttagtgagccacagtacacga

SEQ ID NO: 220795 - DNA, 25 bp, Mus musculus
caatttataagacaaaaaagaagag

SEQ ID NO: 220796 - DNA, 25 bp, Mus musculus
caatttcaaggcaactttccaccga

SEQ ID NO: 220797 - DNA, 25 bp, Mus musculus
caatttcaccctattagaaagaagc

SEQ ID NO: 220798 - DNA, 25 bp, Mus musculus
caatttcaccgtattagaaagaagc

SEQ ID NO: 220799 - DNA, 25 bp, Mus musculus
caatttcaggaaaatctgggtttgg

SEQ ID NO: 220800 - DNA, 25 bp, Mus musculus
caatttcaggatactggctcgaata

SEQ ID NO: 220801 - DNA, 25 bp, Mus musculus
caatttcaggggctctctaaataca

SEQ ID NO: 220802 - DNA, 25 bp, Mus musculus
caatttccaggtcatgagcatggtg

SEQ ID NO: 220803 - DNA, 25 bp, Mus musculus
caatttcctatcctggtgctactaa

SEQ ID NO: 220804 - DNA, 25 bp, Mus musculus
caatttcttaatcaggtatgtgtac

SEQ ID NO: 220805 - DNA, 25 bp, Mus musculus
caatttcttaatcaggtcttctcgt

SEQ ID NO: 220806 - DNA, 25 bp, Mus musculus
caatttctttccaagtccttctttg

SEQ ID NO: 220807 - DNA, 25 bp, Mus musculus
caatttgcataaagactgaccatca

SEQ ID NO: 220808 - DNA, 25 bp, Mus musculus
caatttggaagggaggtcctggcca

SEQ ID NO: 220809 - DNA, 25 bp, Mus musculus
caatttggagaaggtacattatttt

SEQ ID NO: 220810 - DNA, 25 bp, Mus musculus
caatttggcttcaatactgggcggt

SEQ ID NO: 220811 - DNA, 25 bp, Mus musculus
caatttggcttcatactttatcttg

SEQ ID NO: 220812 - DNA, 25 bp, Mus musculus
caatttgggagcgggggtccaactg

SEQ ID NO: 220813 - DNA, 25 bp, Mus musculus
caatttgggcaccctaagatgagtc

SEQ ID NO: 220814 - DNA, 25 bp, Mus musculus
caatttgggcactgcagcctgtcaa

SEQ ID NO: 220815 - DNA, 25 bp, Mus musculus
caatttgtcgataatctgtatcgat

SEQ ID NO: 220816 - DNA, 25 bp, Mus musculus
caatttgtgagcagaacatgttact

SEQ ID NO: 220817 - DNA, 25 bp, Mus musculus
caatttgtgagcaggtgtccacaaa

SEQ ID NO: 220818 - DNA, 25 bp, Mus musculus
caatttgtgcacaaggtggtccgag

SEQ ID NO: 220819 - DNA, 25 bp, Mus musculus
caattttaagatgaaaatacttgga

SEQ ID NO: 220820 - DNA, 25 bp, Mus musculus
caattttaaggcagtgtgtgaagaa

SEQ ID NO: 220821 - DNA, 25 bp, Mus musculus
caattttaatgaatgcagctgcctt

SEQ ID NO: 220822 - DNA, 25 bp, Mus musculus
caattttcaggaatgggacggctta

SEQ ID NO: 220823 - DNA, 25 bp, Mus musculus
caattttcaggtaataccagaagat

SEQ ID NO: 220824 - DNA, 25 bp, Mus musculus
caattttgaaatgtgctgctctggt

SEQ ID NO: 220825 - DNA, 25 bp, Mus musculus
caattttgggattttagttctcaaa

SEQ ID NO: 220826 - DNA, 25 bp, Mus musculus
caattttgggattttatcgcatcat

SEQ ID NO: 220827 - DNA, 25 bp, Mus musculus
caattttgttaaggaaattaagcga

SEQ ID NO: 220828 - DNA, 25 bp, Mus musculus
caatttttaggccccgtcattgtgg

SEQ ID NO: 220829 - DNA, 25 bp, Mus musculus
caatttttgtagtgccaggacatat

SEQ ID NO: 220830 - DNA, 25 bp, Mus musculus
cacaaaaaaagattttggagtaagc

SEQ ID NO: 220831 - DNA, 25 bp, Mus musculus
cacaaaaacagatggatgagacatc

SEQ ID NO: 220832 - DNA, 25 bp, Mus musculus
cacaaaaactgccagttggtggcac

SEQ ID NO: 220833 - DNA, 25 bp, Mus musculus
cacaaaaagaaagactgccctcccg

SEQ ID NO: 220834 - DNA, 25 bp, Mus musculus
cacaaaaagaaatggtgacattcca

SEQ ID NO: 220835 - DNA, 25 bp, Mus musculus
cacaaaaagccagcaccaagtgatc

SEQ ID NO: 220836 - DNA, 25 bp, Mus musculus
cacaaaaagccagggatggctgtgt

SEQ ID NO: 220837 - DNA, 25 bp, Mus musculus
cacaaaaatgggttctctgtctgta

SEQ ID NO: 220838 - DNA, 25 bp, Mus musculus
cacaaaacaaaaacaacatggctgg

SEQ ID NO: 220839 - DNA, 25 bp, Mus musculus
cacaaaacaaaccaaggctactatg

SEQ ID NO: 220840 - DNA, 25 bp, Mus musculus
cacaaaacaggagacatttgatgct

SEQ ID NO: 220841 - DNA, 25 bp, Mus musculus
cacaaaacaggctggccttgtggta

SEQ ID NO: 220842 - DNA, 25 bp, Mus musculus
cacaaaacaggttcagacagtaact

SEQ ID NO: 220843 - DNA, 25 bp, Mus musculus
cacaaaacgagatctggcagacctt

SEQ ID NO: 220844 - DNA, 25 bp, Mus musculus
cacaaaacgagtgacgagtatctgt

SEQ ID NO: 220845 - DNA, 25 bp, Mus musculus
cacaaaagagacgggaaaagaaggc

SEQ ID NO: 220846 - DNA, 25 bp, Mus musculus
cacaaaagagacgggatcttatcct

SEQ ID NO: 220847 - DNA, 25 bp, Mus musculus
cacaaaagcaaatcactgaaggacc

SEQ ID NO: 220848 - DNA, 25 bp, Mus musculus
cacaaaagcagctatgccccctcaa

SEQ ID NO: 220849 - DNA, 25 bp, Mus musculus
cacaaaagggacaggttttcctaga

SEQ ID NO: 220850 - DNA, 25 bp, Mus musculus
cacaaaagggacagtgatggatgtg

SEQ ID NO: 220851 - DNA, 25 bp, Mus musculus
cacaaaagtaggagttaccattgag

SEQ ID NO: 220852 - DNA, 25 bp, Mus musculus
cacaaaagtcaaatgtggatatgct

SEQ ID NO: 220853 - DNA, 25 bp, Mus musculus
cacaaaataacaaagagctactgct

SEQ ID NO: 220854 - DNA, 25 bp, Mus musculus
cacaaaataacaaagcggagtatgt

SEQ ID NO: 220855 - DNA, 25 bp, Mus musculus
cacaaaatatgggccaaatgaaaat

SEQ ID NO: 220856 - DNA, 25 bp, Mus musculus
cacaaaatcatggacgcattcagct

SEQ ID NO: 220857 - DNA, 25 bp, Mus musculus
cacaaaatcattagataacaactat

SEQ ID NO: 220858 - DNA, 25 bp, Mus musculus
cacaaaatgaaagtggatcagcatg

SEQ ID NO: 220859 - DNA, 25 bp, Mus musculus
cacaaaatgtaggtggatgaagact

SEQ ID NO: 220860 - DNA, 25 bp, Mus musculus
cacaaaatgtttctggtggaacacc

SEQ ID NO: 220861 - DNA, 25 bp, Mus musculus
cacaaacaaaagtgtttacaattga

SEQ ID NO: 220862 - DNA, 25 bp, Mus musculus
cacaaacaaatgacatgtttttcag

SEQ ID NO: 220863 - DNA, 25 bp, Mus musculus
cacaaacacagacattcccagctat

SEQ ID NO: 220864 - DNA, 25 bp, Mus musculus
cacaaacacagaggagcttaatttg

SEQ ID NO: 220865 - DNA, 25 bp, Mus musculus
cacaaacaccgtgcctaaattgtat

SEQ ID NO: 220866 - DNA, 25 bp, Mus musculus
cacaaacagaggcaaatattgtgga

SEQ ID NO: 220867 - DNA, 25 bp, Mus musculus
cacaaacatgcagagagtagcagtg

SEQ ID NO: 220868 - DNA, 25 bp, Mus musculus
cacaaacatgcagagtgctgtgtgt

SEQ ID NO: 220869 - DNA, 25 bp, Mus musculus
cacaaacgaagacatcaaaggctct

SEQ ID NO: 220870 - DNA, 25 bp, Mus musculus
cacaaacgagctccttatgtctcct

SEQ ID NO: 220871 - DNA, 25 bp, Mus musculus
cacaaacgaggggaatatattaaaa

SEQ ID NO: 220872 - DNA, 25 bp, Mus musculus
cacaaacgaggtataagtattgttt

SEQ ID NO: 220873 - DNA, 25 bp, Mus musculus
cacaaacgccagacgtgaaaaatga

SEQ ID NO: 220874 - DNA, 25 bp, Mus musculus
cacaaacgtgacaacagcactgttt

SEQ ID NO: 220875 - DNA, 25 bp, Mus musculus
cacaaacgtgcagttcagtcccaaa

SEQ ID NO: 220876 - DNA, 25 bp, Mus musculus
cacaaacgtggtgaatacatcaaga

SEQ ID NO: 220877 - DNA, 25 bp, Mus musculus
cacaaactacacggaagaaaagcaa

SEQ ID NO: 220878 - DNA, 25 bp, Mus musculus
cacaaactcttacgacatgatggga

SEQ ID NO: 220879 - DNA, 25 bp, Mus musculus
cacaaacttttaggtagacatttgg

SEQ ID NO: 220880 - DNA, 25 bp, Mus musculus
cacaaagaaagcaactgggacaaat

SEQ ID NO: 220881 - DNA, 25 bp, Mus musculus
cacaaagaaagtcaggtatgctgca

SEQ ID NO: 220882 - DNA, 25 bp, Mus musculus
cacaaagaagacagccaaggacact

SEQ ID NO: 220883 - DNA, 25 bp, Mus musculus
cacaaagaagcacagaccctggatt

SEQ ID NO: 220884 - DNA, 25 bp, Mus musculus
cacaaagaaggatggaaggtttgag

SEQ ID NO: 220885 - DNA, 25 bp, Mus musculus
cacaaagaattccagaattcagtag

SEQ ID NO: 220886 - DNA, 25 bp, Mus musculus
cacaaagactgcagcaaatgaagct

SEQ ID NO: 220887 - DNA, 25 bp, Mus musculus
cacaaagatgacaaccccaagcatc

SEQ ID NO: 220888 - DNA, 25 bp, Mus musculus
cacaaagcaaagacaaatgagcttg

SEQ ID NO: 220889 - DNA, 25 bp, Mus musculus
cacaaagcaaagccagggcatagtc

SEQ ID NO: 220890 - DNA, 25 bp, Mus musculus
cacaaagcaaagccagtgaaactga

SEQ ID NO: 220891 - DNA, 25 bp, Mus musculus
cacaaagcagagcaaaaaggggtgc

SEQ ID NO: 220892 - DNA, 25 bp, Mus musculus
cacaaagcagatttcaggtatatac

SEQ ID NO: 220893 - DNA, 25 bp, Mus musculus
cacaaagcagggctttgggaatcta

SEQ ID NO: 220894 - DNA, 25 bp, Mus musculus
cacaaagcagtgtggtcatcccacc

SEQ ID NO: 220895 - DNA, 25 bp, Mus musculus
cacaaagccctcaagaaactccgga

SEQ ID NO: 220896 - DNA, 25 bp, Mus musculus
cacaaagccttgctgattttcagaa

SEQ ID NO: 220897 - DNA, 25 bp, Mus musculus
cacaaagctcatagcgggatcctgc

SEQ ID NO: 220898 - DNA, 25 bp, Mus musculus
cacaaaggaaagatttctcgaatgc

SEQ ID NO: 220899 - DNA, 25 bp, Mus musculus
cacaaaggaaaggcattagcaaaag

SEQ ID NO: 220900 - DNA, 25 bp, Mus musculus
cacaaaggaccgatgtagcaggcct

SEQ ID NO: 220901 - DNA, 25 bp, Mus musculus
cacaaaggcagagtcagttgttcac

SEQ ID NO: 220902 - DNA, 25 bp, Mus musculus
cacaaaggtagctacttggtgagtg

SEQ ID NO: 220903 - DNA, 25 bp, Mus musculus
cacaaaggttgtccggtccttcaga

SEQ ID NO: 220904 - DNA, 25 bp, Mus musculus
cacaaagtcaaaggtggcagggctg

SEQ ID NO: 220905 - DNA, 25 bp, Mus musculus
cacaaagtcaaggctctacccctgg

SEQ ID NO: 220906 - DNA, 25 bp, Mus musculus
cacaaagtccaagaactgatgtcta

SEQ ID NO: 220907 - DNA, 25 bp, Mus musculus
cacaaagtccaagattgcgctggct

SEQ ID NO: 220908 - DNA, 25 bp, Mus musculus
cacaaagtgaatgtactctattctt

SEQ ID NO: 220909 - DNA, 25 bp, Mus musculus
cacaaagttcagagtgcagagagca

SEQ ID NO: 220910 - DNA, 25 bp, Mus musculus
cacaaagttcagtactagaagacac

SEQ ID NO: 220911 - DNA, 25 bp, Mus musculus
cacaaagtttgagagtggatgtaaa

SEQ ID NO: 220912 - DNA, 25 bp, Mus musculus
cacaaagtttggaggccacctatga

SEQ ID NO: 220913 - DNA, 25 bp, Mus musculus
cacaaagtttggagtttgttgaagg

SEQ ID NO: 220914 - DNA, 25 bp, Mus musculus
cacaaataaaaaaattcatctacag

SEQ ID NO: 220915 - DNA, 25 bp, Mus musculus
cacaaataatagtgcttacagacac

SEQ ID NO: 220916 - DNA, 25 bp, Mus musculus
cacaaatatcagaggccacctatga

SEQ ID NO: 220917 - DNA, 25 bp, Mus musculus
cacaaatcaaaaggtgtgatccttg

SEQ ID NO: 220918 - DNA, 25 bp, Mus musculus
cacaaatcaaggcatgctgtgagat

SEQ ID NO: 220919 - DNA, 25 bp, Mus musculus
cacaaatcaaggtgacaaaagaact

SEQ ID NO: 220920 - DNA, 25 bp, Mus musculus
cacaaatgaaggagcccattgaaga

SEQ ID NO: 220921 - DNA, 25 bp, Mus musculus
cacaaatgcccagctcctaacctcg

SEQ ID NO: 220922 - DNA, 25 bp, Mus musculus
cacaaatgggaggaggcacttgaat

SEQ ID NO: 220923 - DNA, 25 bp, Mus musculus
cacaaattaatcacaatatcgccat

SEQ ID NO: 220924 - DNA, 25 bp, Mus musculus
cacaaattatgtgagtgactggtgg

SEQ ID NO: 220925 - DNA, 25 bp, Mus musculus
cacaacaaagattatcagagactgc

SEQ ID NO: 220926 - DNA, 25 bp, Mus musculus
cacaacaacaagcatcaccctacca

SEQ ID NO: 220927 - DNA, 25 bp, Mus musculus
cacaacaacaaggagcactttagtg

SEQ ID NO: 220928 - DNA, 25 bp, Mus musculus
cacaacaatctagagcccttactcc

SEQ ID NO: 220929 - DNA, 25 bp, Mus musculus
cacaacacaaaaagcttcctagagg

SEQ ID NO: 220930 - DNA, 25 bp, Mus musculus
cacaacacaaaacaggttcagacag

SEQ ID NO: 220931 - DNA, 25 bp, Mus musculus
cacaacacaacaatcttgggatacg

SEQ ID NO: 220932 - DNA, 25 bp, Mus musculus
cacaacacaatggaagtcgatggca

SEQ ID NO: 220933 - DNA, 25 bp, Mus musculus
cacaacaccaaactttaagaagctt

SEQ ID NO: 220934 - DNA, 25 bp, Mus musculus
cacaacagaaggagctccatctgta

SEQ ID NO: 220935 - DNA, 25 bp, Mus musculus
cacaacagaatgcacgtagaaaatc

SEQ ID NO: 220936 - DNA, 25 bp, Mus musculus
cacaacagacaaaaattaactgaaa

SEQ ID NO: 220937 - DNA, 25 bp, Mus musculus
cacaacagacaaaagccaaccatat

SEQ ID NO: 220938 - DNA, 25 bp, Mus musculus
cacaacagaccgcagaagttatatg

SEQ ID NO: 220939 - DNA, 25 bp, Mus musculus
cacaacagagacacagtgtcgtaac

SEQ ID NO: 220940 - DNA, 25 bp, Mus musculus
cacaacagagatggatggacagtct

SEQ ID NO: 220941 - DNA, 25 bp, Mus musculus
cacaacaggtcaaaatgtcctgcag

SEQ ID NO: 220942 - DNA, 25 bp, Mus musculus
cacaacagtggggtgagtttaaggt

SEQ ID NO: 220943 - DNA, 25 bp, Mus musculus
cacaacagttaaaaggttttcagca

SEQ ID NO: 220944 - DNA, 25 bp, Mus musculus
cacaacatcacagagtcccacccag

SEQ ID NO: 220945 - DNA, 25 bp, Mus musculus
cacaacatctgggacaagctggatg

SEQ ID NO: 220946 - DNA, 25 bp, Mus musculus
cacaacatgtgggatcacatgcagt

SEQ ID NO: 220947 - DNA, 25 bp, Mus musculus
cacaaccaaaaatactgaagcagaa

SEQ ID NO: 220948 - DNA, 25 bp, Mus musculus
cacaaccaagaaaggggagatcttt

SEQ ID NO: 220949 - DNA, 25 bp, Mus musculus
cacaaccaagaaagtgctctcttcc

SEQ ID NO: 220950 - DNA, 25 bp, Mus musculus
cacaaccaatgaggaatacttggac

SEQ ID NO: 220951 - DNA, 25 bp, Mus musculus
cacaaccaatgaggaatacttggat

SEQ ID NO: 220952 - DNA, 25 bp, Mus musculus
cacaaccacagactggaaccagcca

SEQ ID NO: 220953 - DNA, 25 bp, Mus musculus
cacaaccacctggcgctggttaccc

SEQ ID NO: 220954 - DNA, 25 bp, Mus musculus
cacaaccacgctgcagcaccacaaa

SEQ ID NO: 220955 - DNA, 25 bp, Mus musculus
cacaaccagcagaaaacatggtggt

SEQ ID NO: 220956 - DNA, 25 bp, Mus musculus
cacaaccagcagaatgtggctgcta

SEQ ID NO: 220957 - DNA, 25 bp, Mus musculus
cacaaccatatttggtcacctggag

SEQ ID NO: 220958 - DNA, 25 bp, Mus musculus
cacaacccaggtggatcccactgct

SEQ ID NO: 220959 - DNA, 25 bp, Mus musculus
cacaacccagttcccacttggactt

SEQ ID NO: 220960 - DNA, 25 bp, Mus musculus
cacaaccccgttcagcagagagtac

SEQ ID NO: 220961 - DNA, 25 bp, Mus musculus
cacaacccctgaccataggtcaaag

SEQ ID NO: 220962 - DNA, 25 bp, Mus musculus
cacaacccctgggtggagtttacca

SEQ ID NO: 220963 - DNA, 25 bp, Mus musculus
cacaacccgcggggcgccctgcata

SEQ ID NO: 220964 - DNA, 25 bp, Mus musculus
cacaaccgcggaagaaaacggctca

SEQ ID NO: 220965 - DNA, 25 bp, Mus musculus
cacaacctcaacgtcatcctggcca

SEQ ID NO: 220966 - DNA, 25 bp, Mus musculus
cacaacctccgcaagaatggaatca

SEQ ID NO: 220967 - DNA, 25 bp, Mus musculus
cacaacctgttcaagaaaattgacc

SEQ ID NO: 220968 - DNA, 25 bp, Mus musculus
cacaaccttcgagtcctcaaatgcc

SEQ ID NO: 220969 - DNA, 25 bp, Mus musculus
cacaaccttgccagaaaaccttgct

SEQ ID NO: 220970 - DNA, 25 bp, Mus musculus
cacaaccttggtaccttcactcaaa

SEQ ID NO: 220971 - DNA, 25 bp, Mus musculus
cacaacgccggcccgtgtggatctg

SEQ ID NO: 220972 - DNA, 25 bp, Mus musculus
cacaacgctgcttctgaaccagctg

SEQ ID NO: 220973 - DNA, 25 bp, Mus musculus
cacaacggtgtaaagctggaccgtg

SEQ ID NO: 220974 - DNA, 25 bp, Mus musculus
cacaacgtcaacaagcttgctcagg

SEQ ID NO: 220975 - DNA, 25 bp, Mus musculus
cacaacgttaaaggatatcacttat

SEQ ID NO: 220976 - DNA, 25 bp, Mus musculus
cacaacgttcacccggccacacagc

SEQ ID NO: 220977 - DNA, 25 bp, Mus musculus
cacaactatgttcagcaggacttgg

SEQ ID NO: 220978 - DNA, 25 bp, Mus musculus
cacaactcaagcctaccaccactgg

SEQ ID NO: 220979 - DNA, 25 bp, Mus musculus
cacaactcaaggtgaaatttgaagc

SEQ ID NO: 220980 - DNA, 25 bp, Mus musculus
cacaactcacatccttgtctgtaag

SEQ ID NO: 220981 - DNA, 25 bp, Mus musculus
cacaactcatcagtctgtatatctg

SEQ ID NO: 220982 - DNA, 25 bp, Mus musculus
cacaactcctggtcatctagtagca

SEQ ID NO: 220983 - DNA, 25 bp, Mus musculus
cacaactctagagaagtttattgat

SEQ ID NO: 220984 - DNA, 25 bp, Mus musculus
cacaactgaccaggacaagagtgaa

SEQ ID NO: 220985 - DNA, 25 bp, Mus musculus
cacaactgcaggctgtttggtctcg

SEQ ID NO: 220986 - DNA, 25 bp, Mus musculus
cacaacttagtcttgacttctttga

SEQ ID NO: 220987 - DNA, 25 bp, Mus musculus
cacaacttagtgtcttcaagaggca

SEQ ID NO: 220988 - DNA, 25 bp, Mus musculus
cacaacttcaatgaattcctgttcc

SEQ ID NO: 220989 - DNA, 25 bp, Mus musculus
cacaacttcgtagaagtgttaaatg

SEQ ID NO: 220990 - DNA, 25 bp, Mus musculus
cacaacttctcctcagtgtttacaa

SEQ ID NO: 220991 - DNA, 25 bp, Mus musculus
cacaagaaaaggctgcagaagagga

SEQ ID NO: 220992 - DNA, 25 bp, Mus musculus
cacaagaaaagtcaggccctgctgg

SEQ ID NO: 220993 - DNA, 25 bp, Mus musculus
cacaagaaagaagagccaagtggag

SEQ ID NO: 220994 - DNA, 25 bp, Mus musculus
cacaagaacaggcaaggccctcaca

SEQ ID NO: 220995 - DNA, 25 bp, Mus musculus
cacaagaacatccagaacaactggc

SEQ ID NO: 220996 - DNA, 25 bp, Mus musculus
cacaagaacatccaggtcctgcctg

SEQ ID NO: 220997 - DNA, 25 bp, Mus musculus
cacaagaactgacggcacaggcccg

SEQ ID NO: 220998 - DNA, 25 bp, Mus musculus
cacaagaactgacggcactgatgga

SEQ ID NO: 220999 - DNA, 25 bp, Mus musculus
cacaagaagcagtcgttccccatca

SEQ ID NO: 221000 - DNA, 25 bp, Mus musculus
cacaagaaggaggtggaactgacag

SEQ ID NO: 221001 - DNA, 25 bp, Mus musculus
cacaagaaggctacatggatgcagc

SEQ ID NO: 221002 - DNA, 25 bp, Mus musculus
cacaagacaagatctggagcacccc

SEQ ID NO: 221003 - DNA, 25 bp, Mus musculus
cacaagagaatgagctgatgttcct

SEQ ID NO: 221004 - DNA, 25 bp, Mus musculus
cacaagagaatgtgctgatgttcct

SEQ ID NO: 221005 - DNA, 25 bp, Mus musculus
cacaagaggctttggtcatccagca

SEQ ID NO: 221006 - DNA, 25 bp, Mus musculus
cacaagagggagatccacttaaatg

SEQ ID NO: 221007 - DNA, 25 bp, Mus musculus
cacaagatatgtgagatagatggaa

SEQ ID NO: 221008 - DNA, 25 bp, Mus musculus
cacaagatattggttctgaagacta

SEQ ID NO: 221009 - DNA, 25 bp, Mus musculus
cacaagatccagtccccgctgctgc

SEQ ID NO: 221010 - DNA, 25 bp, Mus musculus
cacaagatccatctaaatgggtaca

SEQ ID NO: 221011 - DNA, 25 bp, Mus musculus
cacaagattttagtttgggatcaaa

SEQ ID NO: 221012 - DNA, 25 bp, Mus musculus
cacaagcaaagaccggtgtgtgata

SEQ ID NO: 221013 - DNA, 25 bp, Mus musculus
cacaagcaaaggaaagaggccgaga

SEQ ID NO: 221014 - DNA, 25 bp, Mus musculus
cacaagcaaagtggtagtgtgaagc

SEQ ID NO: 221015 - DNA, 25 bp, Mus musculus
cacaagcaagagtaaaaagaagaag

SEQ ID NO: 221016 - DNA, 25 bp, Mus musculus
cacaagcaagcagttgtttcttgag

SEQ ID NO: 221017 - DNA, 25 bp, Mus musculus
cacaagcacagcacggccctgccct

SEQ ID NO: 221018 - DNA, 25 bp, Mus musculus
cacaagcaccaagagcccgaccgtc

SEQ ID NO: 221019 - DNA, 25 bp, Mus musculus
cacaagcagccaggccccatgaagc

SEQ ID NO: 221020 - DNA, 25 bp, Mus musculus
cacaagcagtgctagttgggtgcaa

SEQ ID NO: 221021 - DNA, 25 bp, Mus musculus
cacaagccaagaaagctcgcttatc

SEQ ID NO: 221022 - DNA, 25 bp, Mus musculus
cacaagccaaggacctctaatttct

SEQ ID NO: 221023 - DNA, 25 bp, Mus musculus
cacaagccactgacgtggacgacaa

SEQ ID NO: 221024 - DNA, 25 bp, Mus musculus
cacaagccagggcccatcactctga

SEQ ID NO: 221025 - DNA, 25 bp, Mus musculus
cacaagcccaaggaggataagctaa

SEQ ID NO: 221026 - DNA, 25 bp, Mus musculus
cacaagcccaaggctgctgacaagg

SEQ ID NO: 221027 - DNA, 25 bp, Mus musculus
cacaagcccaagtgcccaccttgtc

SEQ ID NO: 221028 - DNA, 25 bp, Mus musculus
cacaagcccataggcctggtcagaa

SEQ ID NO: 221029 - DNA, 25 bp, Mus musculus
cacaagcctgaaatcaactccacca

SEQ ID NO: 221030 - DNA, 25 bp, Mus musculus
cacaagcctgagccaggagggccgt

SEQ ID NO: 221031 - DNA, 25 bp, Mus musculus
cacaagcctgtcgcacgagtctgag

SEQ ID NO: 221032 - DNA, 25 bp, Mus musculus
cacaagcctgtcggggtgaatcggc

SEQ ID NO: 221033 - DNA, 25 bp, Mus musculus
cacaagcgagctaatgtctgcgaca

SEQ ID NO: 221034 - DNA, 25 bp, Mus musculus
cacaagcgctgagtgaaaatgtgct

SEQ ID NO: 221035 - DNA, 25 bp, Mus musculus
cacaagctaaagacgggccagcagg

SEQ ID NO: 221036 - DNA, 25 bp, Mus musculus
cacaagctaaagatggagaaggaga

SEQ ID NO: 221037 - DNA, 25 bp, Mus musculus
cacaagctctgctgacagggcagtt

SEQ ID NO: 221038 - DNA, 25 bp, Mus musculus
cacaagctctgctgactgtgcagaa

SEQ ID NO: 221039 - DNA, 25 bp, Mus musculus
cacaagctgacaggaagactcttca

SEQ ID NO: 221040 - DNA, 25 bp, Mus musculus
cacaagctgacaggttgccatgcct

SEQ ID NO: 221041 - DNA, 25 bp, Mus musculus
cacaagctgaccaaagcggagaagc

SEQ ID NO: 221042 - DNA, 25 bp, Mus musculus
cacaagctgaccaagttacagtcca

SEQ ID NO: 221043 - DNA, 25 bp, Mus musculus
cacaagctgctgagactataagcgg

SEQ ID NO: 221044 - DNA, 25 bp, Mus musculus
cacaagctgctgagatggctccgag

SEQ ID NO: 221045 - DNA, 25 bp, Mus musculus
cacaagctgctgagtgaagagagac

SEQ ID NO: 221046 - DNA, 25 bp, Mus musculus
cacaaggaaggagcagctgcaagac

SEQ ID NO: 221047 - DNA, 25 bp, Mus musculus
cacaaggaagtaatgtgatttattg

SEQ ID NO: 221048 - DNA, 25 bp, Mus musculus
cacaaggaagtggatgatcttttca

SEQ ID NO: 221049 - DNA, 25 bp, Mus musculus
cacaaggagagtcgggtgttaggag

SEQ ID NO: 221050 - DNA, 25 bp, Mus musculus
cacaaggagccagaactacagctca

SEQ ID NO: 221051 - DNA, 25 bp, Mus musculus
cacaaggataggtcatgctgtgaac

SEQ ID NO: 221052 - DNA, 25 bp, Mus musculus
cacaaggcagccatggaatttcatg

SEQ ID NO: 221053 - DNA, 25 bp, Mus musculus
cacaaggcaggggcaagcggatctt

SEQ ID NO: 221054 - DNA, 25 bp, Mus musculus
cacaaggcatgtgaagccagtgaaa

SEQ ID NO: 221055 - DNA, 25 bp, Mus musculus
cacaaggccccgaaatgggaccctg

SEQ ID NO: 221056 - DNA, 25 bp, Mus musculus
cacaaggctcagacagcagtgacag

SEQ ID NO: 221057 - DNA, 25 bp, Mus musculus
cacaaggctggtgctatttatattt

SEQ ID NO: 221058 - DNA, 25 bp, Mus musculus
cacaaggtgggccgagacatcttgc

SEQ ID NO: 221059 - DNA, 25 bp, Mus musculus
cacaagtacaacatcttgattgcca

SEQ ID NO: 221060 - DNA, 25 bp, Mus musculus
cacaagtacacgacagacggcaacc

SEQ ID NO: 221061 - DNA, 25 bp, Mus musculus
cacaagtacacggaaatgtgtcatg

SEQ ID NO: 221062 - DNA, 25 bp, Mus musculus
cacaagtataaggtgatgttccctg

SEQ ID NO: 221063 - DNA, 25 bp, Mus musculus
cacaagtcaaaggtttaacagaaga

SEQ ID NO: 221064 - DNA, 25 bp, Mus musculus
cacaagtcaatgcaaaatttccagg

SEQ ID NO: 221065 - DNA, 25 bp, Mus musculus
cacaagtcaatgcccagctaatgta

SEQ ID NO: 221066 - DNA, 25 bp, Mus musculus
cacaagtcaatggaaaatttccagg

SEQ ID NO: 221067 - DNA, 25 bp, Mus musculus
cacaagtcaatggccagctaatgta

SEQ ID NO: 221068 - DNA, 25 bp, Mus musculus
cacaagtccaaacagttcagatttc

SEQ ID NO: 221069 - DNA, 25 bp, Mus musculus
cacaagtgcgaggactgcgggaagg

SEQ ID NO: 221070 - DNA, 25 bp, Mus musculus
cacaagtgctgagagctaagtgatt

SEQ ID NO: 221071 - DNA, 25 bp, Mus musculus
cacaagtgttcaagccgccccacga

SEQ ID NO: 221072 - DNA, 25 bp, Mus musculus
cacaagtgttcaaggtagccattgc

SEQ ID NO: 221073 - DNA, 25 bp, Mus musculus
cacaagttgagatgaagcccgaggc

SEQ ID NO: 221074 - DNA, 25 bp, Mus musculus
cacaagtttattacagcactcaaat

SEQ ID NO: 221075 - DNA, 25 bp, Mus musculus
cacaagtttattacagtgtgttcaa

SEQ ID NO: 221076 - DNA, 25 bp, Mus musculus
cacaataaagatctgggacataggc

SEQ ID NO: 221077 - DNA, 25 bp, Mus musculus
cacaataaaggtactagtacttgga

SEQ ID NO: 221078 - DNA, 25 bp, Mus musculus
cacaataatggagtgatagaaggaa

SEQ ID NO: 221079 - DNA, 25 bp, Mus musculus
cacaataattatttggctgatgaag

SEQ ID NO: 221080 - DNA, 25 bp, Mus musculus
cacaatagggcgctctgcctcacgt

SEQ ID NO: 221081 - DNA, 25 bp, Mus musculus
cacaatagggcggctatcctaccta

SEQ ID NO: 221082 - DNA, 25 bp, Mus musculus
cacaatagggcggttatgggtgcta

SEQ ID NO: 221083 - DNA, 25 bp, Mus musculus
cacaatagggcggtttatctgagca

SEQ ID NO: 221084 - DNA, 25 bp, Mus musculus
cacaatattccaacggtgcccctta

SEQ ID NO: 221085 - DNA, 25 bp, Mus musculus
cacaatcaaagacagagttgactcc

SEQ ID NO: 221086 - DNA, 25 bp, Mus musculus
cacaatcaaatccaccgccatctcc

SEQ ID NO: 221087 - DNA, 25 bp, Mus musculus
cacaatcaagcccccactgtgttcc

SEQ ID NO: 221088 - DNA, 25 bp, Mus musculus
cacaatcaaggcacttcggaggagg

SEQ ID NO: 221089 - DNA, 25 bp, Mus musculus
cacaatcaaggtccacaggatgatt

SEQ ID NO: 221090 - DNA, 25 bp, Mus musculus
cacaatcaagtctaaactagagtcc

SEQ ID NO: 221091 - DNA, 25 bp, Mus musculus
cacaatcaataggtttccaggcaac

SEQ ID NO: 221092 - DNA, 25 bp, Mus musculus
cacaatcaattgaaatcaagcagaa

SEQ ID NO: 221093 - DNA, 25 bp, Mus musculus
cacaatcctgagaggaagatccaaa

SEQ ID NO: 221094 - DNA, 25 bp, Mus musculus
cacaatcctgaggtgaagaggaaga

SEQ ID NO: 221095 - DNA, 25 bp, Mus musculus
cacaatcctttagcagctactccat

SEQ ID NO: 221096 - DNA, 25 bp, Mus musculus
cacaatcgagagcagcaaaagcgac

SEQ ID NO: 221097 - DNA, 25 bp, Mus musculus
cacaatcgagatcctgcctcagaga

SEQ ID NO: 221098 - DNA, 25 bp, Mus musculus
cacaatctcagaatggcttcacacc

SEQ ID NO: 221099 - DNA, 25 bp, Mus musculus
cacaatctgcatgttaacaagcctg

SEQ ID NO: 221100 - DNA, 25 bp, Mus musculus
cacaatctgctgacgcttcgctgcg

SEQ ID NO: 221101 - DNA, 25 bp, Mus musculus
cacaatctgctgacggatagcggcg

SEQ ID NO: 221102 - DNA, 25 bp, Mus musculus
cacaatcttacaagaagtaaagctt

SEQ ID NO: 221103 - DNA, 25 bp, Mus musculus
cacaatcttacaagaatgcagaagg

SEQ ID NO: 221104 - DNA, 25 bp, Mus musculus
cacaatgattcggcagacgggcctg

SEQ ID NO: 221105 - DNA, 25 bp, Mus musculus
cacaatgcagcccttttgatctctt

SEQ ID NO: 221106 - DNA, 25 bp, Mus musculus
cacaatgcccccaagagatcccgtt

SEQ ID NO: 221107 - DNA, 25 bp, Mus musculus
cacaatgcccccaaggacttaaaag

SEQ ID NO: 221108 - DNA, 25 bp, Mus musculus
cacaatgctgagagttgaaaaacat

SEQ ID NO: 221109 - DNA, 25 bp, Mus musculus
cacaatggagcatatccgtgtgggc

SEQ ID NO: 221110 - DNA, 25 bp, Mus musculus
cacaatggaggaagaacgagccatg

SEQ ID NO: 221111 - DNA, 25 bp, Mus musculus
cacaatggccaaagatgagagctgc

SEQ ID NO: 221112 - DNA, 25 bp, Mus musculus
cacaatggccagaaagaagactcag

SEQ ID NO: 221113 - DNA, 25 bp, Mus musculus
cacaatggcctccccttgctctgcc

SEQ ID NO: 221114 - DNA, 25 bp, Mus musculus
cacaatggtatcgggctagccaacc

SEQ ID NO: 221115 - DNA, 25 bp, Mus musculus
cacaatgttgagctctctggcaaga

SEQ ID NO: 221116 - DNA, 25 bp, Mus musculus
cacaattacctgaaggatgggcctt

SEQ ID NO: 221117 - DNA, 25 bp, Mus musculus
cacaattatgcctctgatgaagaat

SEQ ID NO: 221118 - DNA, 25 bp, Mus musculus
cacaattatggaatccccctacgtt

SEQ ID NO: 221119 - DNA, 25 bp, Mus musculus
cacaattattacaggtaatgaagaa

SEQ ID NO: 221120 - DNA, 25 bp, Mus musculus
cacaatttcaataacttacagtcct

SEQ ID NO: 221121 - DNA, 25 bp, Mus musculus
cacaatttcaatgtgttacagcaca

SEQ ID NO: 221122 - DNA, 25 bp, Mus musculus
cacaatttcaccctattagaaagaa

SEQ ID NO: 221123 - DNA, 25 bp, Mus musculus
cacaatttcaccgtattagaaagaa

SEQ ID NO: 221124 - DNA, 25 bp, Mus musculus
cacaatttcagactacaaaagtctg

SEQ ID NO: 221125 - DNA, 25 bp, Mus musculus
cacaatttggcttcaatactgggcg

SEQ ID NO: 221126 - DNA, 25 bp, Mus musculus
cacaatttggcttcatactttatct

SEQ ID NO: 221127 - DNA, 25 bp, Mus musculus
cacaattttcaggatgacgatcagg

SEQ ID NO: 221128 - DNA, 25 bp, Mus musculus
cacaatttttaggccccgtcattgt

SEQ ID NO: 221129 - DNA, 25 bp, Mus musculus
cacacaaaacaggctggccttgtgg

SEQ ID NO: 221130 - DNA, 25 bp, Mus musculus
cacacaaaagcaaatcactgaagga

SEQ ID NO: 221131 - DNA, 25 bp, Mus musculus
cacacaaaatgtaggtggatgaaga

SEQ ID NO: 221132 - DNA, 25 bp, Mus musculus
cacacaacccaggtggatcccactg

SEQ ID NO: 221133 - DNA, 25 bp, Mus musculus
cacacaactatgttcagcaggactt

SEQ ID NO: 221134 - DNA, 25 bp, Mus musculus
cacacaagaactgacggcacaggcc

SEQ ID NO: 221135 - DNA, 25 bp, Mus musculus
cacacaagaactgacggcactgatg

SEQ ID NO: 221136 - DNA, 25 bp, Mus musculus
cacacaagaatcgcagaatgcatcg

SEQ ID NO: 221137 - DNA, 25 bp, Mus musculus
cacacaagcggatgaaggttaagaa

SEQ ID NO: 221138 - DNA, 25 bp, Mus musculus
cacacaaggaggatacatctctact

SEQ ID NO: 221139 - DNA, 25 bp, Mus musculus
cacacaaggccaggagcatcatcgg

SEQ ID NO: 221140 - DNA, 25 bp, Mus musculus
cacacaagtataaggtgatgttccc

SEQ ID NO: 221141 - DNA, 25 bp, Mus musculus
cacacaatcaattgaaatcaagcag

SEQ ID NO: 221142 - DNA, 25 bp, Mus musculus
cacacaatctgccattatttgcatt

SEQ ID NO: 221143 - DNA, 25 bp, Mus musculus
cacacaatggcctccccttgctctg

SEQ ID NO: 221144 - DNA, 25 bp, Mus musculus
cacacaattggcggcggctgccccg

SEQ ID NO: 221145 - DNA, 25 bp, Mus musculus
cacacaattgggccggcggcggctg

SEQ ID NO: 221146 - DNA, 25 bp, Mus musculus
cacacaattggtggacgcagacgat

SEQ ID NO: 221147 - DNA, 25 bp, Mus musculus
cacacacaaggccaggagcatcatc

SEQ ID NO: 221148 - DNA, 25 bp, Mus musculus
cacacacaagggctgggtatggtcg

SEQ ID NO: 221149 - DNA, 25 bp, Mus musculus
cacacacacacacacacacacacac

SEQ ID NO: 221150 - DNA, 25 bp, Mus musculus
cacacacacactgcaagaacagaag

SEQ ID NO: 221151 - DNA, 25 bp, Mus musculus
cacacacactgcaagaacagaagca

SEQ ID NO: 221152 - DNA, 25 bp, Mus musculus
cacacacagggcgtgcgcagggacc

SEQ ID NO: 221153 - DNA, 25 bp, Mus musculus
cacacacagtaaggaaatgatatat

SEQ ID NO: 221154 - DNA, 25 bp, Mus musculus
cacacacagtaaggctttaccgcca

SEQ ID NO: 221155 - DNA, 25 bp, Mus musculus
cacacaccaagtttttcaagacaaa

SEQ ID NO: 221156 - DNA, 25 bp, Mus musculus
cacacaccaggggtgacagtccaaa

SEQ ID NO: 221157 - DNA, 25 bp, Mus musculus
cacacaccattcagctttctcccag

SEQ ID NO: 221158 - DNA, 25 bp, Mus musculus
cacacacccaaagagggctgtgacc

SEQ ID NO: 221159 - DNA, 25 bp, Mus musculus
cacacaccctaaggtaaaagttggc

SEQ ID NO: 221160 - DNA, 25 bp, Mus musculus
cacacaccctaagtatttagaaatg

SEQ ID NO: 221161 - DNA, 25 bp, Mus musculus
cacacacgaccttggacgtaccatg

SEQ ID NO: 221162 - DNA, 25 bp, Mus musculus
cacacacgaggtatgacgctgtggt

SEQ ID NO: 221163 - DNA, 25 bp, Mus musculus
cacacacggaagaagaacatcagaa

SEQ ID NO: 221164 - DNA, 25 bp, Mus musculus
cacacactccagaggtacaagcgcc

SEQ ID NO: 221165 - DNA, 25 bp, Mus musculus
cacacactgcgctaccctgtgaagc

SEQ ID NO: 221166 - DNA, 25 bp, Mus musculus
cacacactgtgccgggtgcacacag

SEQ ID NO: 221167 - DNA, 25 bp, Mus musculus
cacacactgttcagacggctccatc

SEQ ID NO: 221168 - DNA, 25 bp, Mus musculus
cacacacttgaagatcaagacataa

SEQ ID NO: 221169 - DNA, 25 bp, Mus musculus
cacacacttgaagatctttctgcaa

SEQ ID NO: 221170 - DNA, 25 bp, Mus musculus
cacacacttgatcgattatgaaaag

SEQ ID NO: 221171 - DNA, 25 bp, Mus musculus
cacacagaacggagattatcagctc

SEQ ID NO: 221172 - DNA, 25 bp, Mus musculus
cacacagaagtccctgagctcagcc

SEQ ID NO: 221173 - DNA, 25 bp, Mus musculus
cacacagaatgtcagaaccatcctc

SEQ ID NO: 221174 - DNA, 25 bp, Mus musculus
cacacagaatgtcagtctggagccc

SEQ ID NO: 221175 - DNA, 25 bp, Mus musculus
cacacagacacaagatggaatatag

SEQ ID NO: 221176 - DNA, 25 bp, Mus musculus
cacacagacttgtcccggccacaca

SEQ ID NO: 221177 - DNA, 25 bp, Mus musculus
cacacagagaaaacatcccaggcat

SEQ ID NO: 221178 - DNA, 25 bp, Mus musculus
cacacagagcaggtcatacctcact

SEQ ID NO: 221179 - DNA, 25 bp, Mus musculus
cacacagagcagtacctcaaatcgt

SEQ ID NO: 221180 - DNA, 25 bp, Mus musculus
cacacagcaatgtttgcagagacat

SEQ ID NO: 221181 - DNA, 25 bp, Mus musculus
cacacagcacaggtgtaacgagtaa

SEQ ID NO: 221182 - DNA, 25 bp, Mus musculus
cacacagcagaaagtgtcaccgtgg

SEQ ID NO: 221183 - DNA, 25 bp, Mus musculus
cacacagcagagattgtatgtttat

SEQ ID NO: 221184 - DNA, 25 bp, Mus musculus
cacacagcagatgcattacacggag

SEQ ID NO: 221185 - DNA, 25 bp, Mus musculus
cacacagcaggaggtcccaggtaat

SEQ ID NO: 221186 - DNA, 25 bp, Mus musculus
cacacagcatacaagacgagaagga

SEQ ID NO: 221187 - DNA, 25 bp, Mus musculus
cacacagcatacaagtcctcaaggg

SEQ ID NO: 221188 - DNA, 25 bp, Mus musculus
cacacagcattaaggctcggctatt

SEQ ID NO: 221189 - DNA, 25 bp, Mus musculus
cacacagcgacatgtgagggagcag

SEQ ID NO: 221190 - DNA, 25 bp, Mus musculus
cacacagctgaaaaagtctggtttt

SEQ ID NO: 221191 - DNA, 25 bp, Mus musculus
cacacaggacgggccaaaagatgca

SEQ ID NO: 221192 - DNA, 25 bp, Mus musculus
cacacaggacggtgtctttattgcc

SEQ ID NO: 221193 - DNA, 25 bp, Mus musculus
cacacaggcaggcagattgaccttg

SEQ ID NO: 221194 - DNA, 25 bp, Mus musculus
cacacagggagacaggatccttcct

SEQ ID NO: 221195 - DNA, 25 bp, Mus musculus
cacacagggcgaaacaaaggtccca

SEQ ID NO: 221196 - DNA, 25 bp, Mus musculus
cacacaggtaagggcagatgtcatc

SEQ ID NO: 221197 - DNA, 25 bp, Mus musculus
cacacagtaaggaaatgatatattg

SEQ ID NO: 221198 - DNA, 25 bp, Mus musculus
cacacagtaaggctttaccgccagc

SEQ ID NO: 221199 - DNA, 25 bp, Mus musculus
cacacagtagacactacttcatccg

SEQ ID NO: 221200 - DNA, 25 bp, Mus musculus
cacacagtcaagggatgaactgtga

SEQ ID NO: 221201 - DNA, 25 bp, Mus musculus
cacacagtggaggattaccaggcaa

SEQ ID NO: 221202 - DNA, 25 bp, Mus musculus
cacacagttctatggccaacaggct

SEQ ID NO: 221203 - DNA, 25 bp, Mus musculus
cacacatacacgcccgaatggctgg

SEQ ID NO: 221204 - DNA, 25 bp, Mus musculus
cacacatatgacgttcagaaactta

SEQ ID NO: 221205 - DNA, 25 bp, Mus musculus
cacacatcagcaggcccgggagatc

SEQ ID NO: 221206 - DNA, 25 bp, Mus musculus
cacacatcctcaggaaagctgtgga

SEQ ID NO: 221207 - DNA, 25 bp, Mus musculus
cacacatcctcaggagccagggaag

SEQ ID NO: 221208 - DNA, 25 bp, Mus musculus
cacacatgaaacagtttgtagtgca

SEQ ID NO: 221209 - DNA, 25 bp, Mus musculus
cacacatgatcggaacaccatggac

SEQ ID NO: 221210 - DNA, 25 bp, Mus musculus
cacacatggaagcatggaatcagag

SEQ ID NO: 221211 - DNA, 25 bp, Mus musculus
cacacatggaaggaaaggacttcat

SEQ ID NO: 221212 - DNA, 25 bp, Mus musculus
cacacatggacaggtgacgccatct

SEQ ID NO: 221213 - DNA, 25 bp, Mus musculus
cacacatggatgaaaattcaggacg

SEQ ID NO: 221214 - DNA, 25 bp, Mus musculus
cacaccaaaaacaagctttacacag

SEQ ID NO: 221215 - DNA, 25 bp, Mus musculus
cacaccaaaggagcagttcagggaa

SEQ ID NO: 221216 - DNA, 25 bp, Mus musculus
cacaccaaaggagtgccaggaggta

SEQ ID NO: 221217 - DNA, 25 bp, Mus musculus
cacaccaacctatgaaaactctcta

SEQ ID NO: 221218 - DNA, 25 bp, Mus musculus
cacaccaagaaccaggcgctcaact

SEQ ID NO: 221219 - DNA, 25 bp, Mus musculus
cacaccacaggctttgctactggag

SEQ ID NO: 221220 - DNA, 25 bp, Mus musculus
cacaccacagggaaaccaggaacac

SEQ ID NO: 221221 - DNA, 25 bp, Mus musculus
cacaccacagggctatgagaagttg

SEQ ID NO: 221222 - DNA, 25 bp, Mus musculus
cacaccacaggtcccaggagaaacc

SEQ ID NO: 221223 - DNA, 25 bp, Mus musculus
cacaccacagttgctaagggtactt

SEQ ID NO: 221224 - DNA, 25 bp, Mus musculus
cacaccaccacgggttggatcaggc

SEQ ID NO: 221225 - DNA, 25 bp, Mus musculus
cacaccacccagactatgaaatccc

SEQ ID NO: 221226 - DNA, 25 bp, Mus musculus
cacaccactgcagtgtttgtaagcg

SEQ ID NO: 221227 - DNA, 25 bp, Mus musculus
cacaccactggtgatccagcagccc

SEQ ID NO: 221228 - DNA, 25 bp, Mus musculus
cacaccagagagctatcattgaggc

SEQ ID NO: 221229 - DNA, 25 bp, Mus musculus
cacaccatgaaggaagccaaggaca

SEQ ID NO: 221230 - DNA, 25 bp, Mus musculus
cacaccattaccaaggtcccttcag

SEQ ID NO: 221231 - DNA, 25 bp, Mus musculus
cacaccattcagctttctcccagat

SEQ ID NO: 221232 - DNA, 25 bp, Mus musculus
cacacccaaagagggctgtgacccc

SEQ ID NO: 221233 - DNA, 25 bp, Mus musculus
cacacccaaggaggccaaaaaagtg

SEQ ID NO: 221234 - DNA, 25 bp, Mus musculus
cacacccaaggagggtcaaaaggca

SEQ ID NO: 221235 - DNA, 25 bp, Mus musculus
cacacccaatgaacttgtttttaat

SEQ ID NO: 221236 - DNA, 25 bp, Mus musculus
cacacccacagggctgtcccccagt

SEQ ID NO: 221237 - DNA, 25 bp, Mus musculus
cacacccaccaccccagtctacctc

SEQ ID NO: 221238 - DNA, 25 bp, Mus musculus
cacacccagcacaggtccctgtggc

SEQ ID NO: 221239 - DNA, 25 bp, Mus musculus
cacacccagcccaggtccctgtggc

SEQ ID NO: 221240 - DNA, 25 bp, Mus musculus
cacacccaggagcatgttaatgaaa

SEQ ID NO: 221241 - DNA, 25 bp, Mus musculus
cacacccatcaaggcgacctggcat

SEQ ID NO: 221242 - DNA, 25 bp, Mus musculus
cacaccccaggaagtcagaggcaaa

SEQ ID NO: 221243 - DNA, 25 bp, Mus musculus
cacaccccaggacaccatcttgctg

SEQ ID NO: 221244 - DNA, 25 bp, Mus musculus
cacaccccccggtcacccgctgcct

SEQ ID NO: 221245 - DNA, 25 bp, Mus musculus
cacaccccctacctatggagttcag

SEQ ID NO: 221246 - DNA, 25 bp, Mus musculus
cacacccctcaccaggaggcaccat

SEQ ID NO: 221247 - DNA, 25 bp, Mus musculus
cacacccctgaaatggcattatcca

SEQ ID NO: 221248 - DNA, 25 bp, Mus musculus
cacacccctgtctgcaggcattgct

SEQ ID NO: 221249 - DNA, 25 bp, Mus musculus
cacacccggacgatgacagctatat

SEQ ID NO: 221250 - DNA, 25 bp, Mus musculus
cacaccctaaggtaaaagttggcat

SEQ ID NO: 221251 - DNA, 25 bp, Mus musculus
cacaccctaagtatttagaaatgat

SEQ ID NO: 221252 - DNA, 25 bp, Mus musculus
cacaccctacagaggaggaacctga

SEQ ID NO: 221253 - DNA, 25 bp, Mus musculus
cacaccctacaggcaagattgagat

SEQ ID NO: 221254 - DNA, 25 bp, Mus musculus
cacaccctcccccagagtgctgacc

SEQ ID NO: 221255 - DNA, 25 bp, Mus musculus
cacacccttttcatgcctagtgacc

SEQ ID NO: 221256 - DNA, 25 bp, Mus musculus
cacaccgcagggagaaaactggtta

SEQ ID NO: 221257 - DNA, 25 bp, Mus musculus
cacaccggacggtgggattgtgctc

SEQ ID NO: 221258 - DNA, 25 bp, Mus musculus
cacaccggacgtgggaagctgctgc

SEQ ID NO: 221259 - DNA, 25 bp, Mus musculus
cacaccggagtgcaatcaaaaccaa

SEQ ID NO: 221260 - DNA, 25 bp, Mus musculus
cacaccggagtggtgacaaatggat

SEQ ID NO: 221261 - DNA, 25 bp, Mus musculus
cacaccgggtgtggagaagaacgct

SEQ ID NO: 221262 - DNA, 25 bp, Mus musculus
cacaccgtatgaaggtggaagatat

SEQ ID NO: 221263 - DNA, 25 bp, Mus musculus
cacacctaaagagcaatgcaagtgg

SEQ ID NO: 221264 - DNA, 25 bp, Mus musculus
cacacctaaagagtctgacacgtac

SEQ ID NO: 221265 - DNA, 25 bp, Mus musculus
cacacctaagatggaacagctagcc

SEQ ID NO: 221266 - DNA, 25 bp, Mus musculus
cacacctaagattgagcagctagcc

SEQ ID NO: 221267 - DNA, 25 bp, Mus musculus
cacacctagtcagtccccagttgta

SEQ ID NO: 221268 - DNA, 25 bp, Mus musculus
cacacctcagcagggacctcttgtc

SEQ ID NO: 221269 - DNA, 25 bp, Mus musculus
cacacctcatacagggtggcagtga

SEQ ID NO: 221270 - DNA, 25 bp, Mus musculus
cacacctcatgagctggctgcctga

SEQ ID NO: 221271 - DNA, 25 bp, Mus musculus
cacacctcatgccgagcaactgtgg

SEQ ID NO: 221272 - DNA, 25 bp, Mus musculus
cacacctccacaggttccagatgat

SEQ ID NO: 221273 - DNA, 25 bp, Mus musculus
cacacctctcacagacagctcagct

SEQ ID NO: 221274 - DNA, 25 bp, Mus musculus
cacacctctctctcaggagtgaaga

SEQ ID NO: 221275 - DNA, 25 bp, Mus musculus
cacacctcttccagacgctgaatcg

SEQ ID NO: 221276 - DNA, 25 bp, Mus musculus
cacacctctttaaggcgtaccttct

SEQ ID NO: 221277 - DNA, 25 bp, Mus musculus
cacacctctttaagtatgcagcaga

SEQ ID NO: 221278 - DNA, 25 bp, Mus musculus
cacacctgaaagcagaacctggtcc

SEQ ID NO: 221279 - DNA, 25 bp, Mus musculus
cacacctgaacctgatatctgtcat

SEQ ID NO: 221280 - DNA, 25 bp, Mus musculus
cacacctgacatctggcctacacag

SEQ ID NO: 221281 - DNA, 25 bp, Mus musculus
cacacctgacttatttattttggtt

SEQ ID NO: 221282 - DNA, 25 bp, Mus musculus
cacacctgcagcccggacaagtggg

SEQ ID NO: 221283 - DNA, 25 bp, Mus musculus
cacacctggatggatgctgcaagca

SEQ ID NO: 221284 - DNA, 25 bp, Mus musculus
cacacctggatggggttcatgttgt

SEQ ID NO: 221285 - DNA, 25 bp, Mus musculus
cacacctggctattgacaagaaggc

SEQ ID NO: 221286 - DNA, 25 bp, Mus musculus
cacacctggctattgactccacggc

SEQ ID NO: 221287 - DNA, 25 bp, Mus musculus
cacacctgggcacagcattgatctg

SEQ ID NO: 221288 - DNA, 25 bp, Mus musculus
cacaccttgcccgaaacaaccacaa

SEQ ID NO: 221289 - DNA, 25 bp, Mus musculus
cacacgaccttggacgtaccatgcg

SEQ ID NO: 221290 - DNA, 25 bp, Mus musculus
cacacgactgtgaagggaagacatg

SEQ ID NO: 221291 - DNA, 25 bp, Mus musculus
cacacgactgtgaagttagtagaaa

SEQ ID NO: 221292 - DNA, 25 bp, Mus musculus
cacacgaggtatgacgctgtggtac

SEQ ID NO: 221293 - DNA, 25 bp, Mus musculus
cacacgagttgggccattccagctt

SEQ ID NO: 221294 - DNA, 25 bp, Mus musculus
cacacgcagatgaggattgagctcc

SEQ ID NO: 221295 - DNA, 25 bp, Mus musculus
cacacgcatcgagggggctacccga

SEQ ID NO: 221296 - DNA, 25 bp, Mus musculus
cacacgcatgccaggttggcctgct

SEQ ID NO: 221297 - DNA, 25 bp, Mus musculus
cacacgcgccctcagatgtcacctg

SEQ ID NO: 221298 - DNA, 25 bp, Mus musculus
cacacgcgccctcagtgggaagatg

SEQ ID NO: 221299 - DNA, 25 bp, Mus musculus
cacacgctacttagccccaaccata

SEQ ID NO: 221300 - DNA, 25 bp, Mus musculus
cacacgctacttaggtgatgcaaga

SEQ ID NO: 221301 - DNA, 25 bp, Mus musculus
cacacgctcaccagctgatggttcc

SEQ ID NO: 221302 - DNA, 25 bp, Mus musculus
cacacgctgcccaagcgccggagta

SEQ ID NO: 221303 - DNA, 25 bp, Mus musculus
cacacgctgtgctgaatgagcaaca

SEQ ID NO: 221304 - DNA, 25 bp, Mus musculus
cacacgcttcttgccagtttattaa

SEQ ID NO: 221305 - DNA, 25 bp, Mus musculus
cacacggaagaagaacatcagaaag

SEQ ID NO: 221306 - DNA, 25 bp, Mus musculus
cacacggaagtgaatccagcagctt

SEQ ID NO: 221307 - DNA, 25 bp, Mus musculus
cacacggaagtgatcagctctgaat

SEQ ID NO: 221308 - DNA, 25 bp, Mus musculus
cacacggacaccgggattatgtccc

SEQ ID NO: 221309 - DNA, 25 bp, Mus musculus
cacacggacagcgcgctttggatcc

SEQ ID NO: 221310 - DNA, 25 bp, Mus musculus
cacacggacagcggcacagccgagc

SEQ ID NO: 221311 - DNA, 25 bp, Mus musculus
cacacggagcatgagccagatatac

SEQ ID NO: 221312 - DNA, 25 bp, Mus musculus
cacacggatatggaagagggatttc

SEQ ID NO: 221313 - DNA, 25 bp, Mus musculus
cacacggcaagtactgaaccttcca

SEQ ID NO: 221314 - DNA, 25 bp, Mus musculus
cacacggcagccggttgcctcttcc

SEQ ID NO: 221315 - DNA, 25 bp, Mus musculus
cacacggcagtgactgatcacacac

SEQ ID NO: 221316 - DNA, 25 bp, Mus musculus
cacacggctaagcaggtgaagtcca

SEQ ID NO: 221317 - DNA, 25 bp, Mus musculus
cacacggcttcagaaaagaagttgt

SEQ ID NO: 221318 - DNA, 25 bp, Mus musculus
cacacggcttcagaaggaagaggca

SEQ ID NO: 221319 - DNA, 25 bp, Mus musculus
cacacggcttcagtctttgcagttt

SEQ ID NO: 221320 - DNA, 25 bp, Mus musculus
cacacgggaccacagcctccaggat

SEQ ID NO: 221321 - DNA, 25 bp, Mus musculus
cacacgggctgctggaaagggataa

SEQ ID NO: 221322 - DNA, 25 bp, Mus musculus
cacacgggggagaggccatttgttt

SEQ ID NO: 221323 - DNA, 25 bp, Mus musculus
cacacggttggataaacctgactct

SEQ ID NO: 221324 - DNA, 25 bp, Mus musculus
cacacgtgacaaataaccctggcac

SEQ ID NO: 221325 - DNA, 25 bp, Mus musculus
cacacgtgaccagtatggcaagaag

SEQ ID NO: 221326 - DNA, 25 bp, Mus musculus
cacacgtgccaaaatatctactaga

SEQ ID NO: 221327 - DNA, 25 bp, Mus musculus
cacacgtgctcagagcagagcctct

SEQ ID NO: 221328 - DNA, 25 bp, Mus musculus
cacacgtgctcagccctttgttcag

SEQ ID NO: 221329 - DNA, 25 bp, Mus musculus
cacacgtggaagagccggctttcct

SEQ ID NO: 221330 - DNA, 25 bp, Mus musculus
cacacgtgtgcagataccccggtac

SEQ ID NO: 221331 - DNA, 25 bp, Mus musculus
cacacgtgtgcagcctttgcttttc

SEQ ID NO: 221332 - DNA, 25 bp, Mus musculus
cacacgtgtgcagttggcagatatt

SEQ ID NO: 221333 - DNA, 25 bp, Mus musculus
cacacgtttgccgctcctgagaaat

SEQ ID NO: 221334 - DNA, 25 bp, Mus musculus
cacactaatcttgtaaccaccaaag

SEQ ID NO: 221335 - DNA, 25 bp, Mus musculus
cacactacaggctccttcctgacat

SEQ ID NO: 221336 - DNA, 25 bp, Mus musculus
cacactacaggtctgtaactggttc

SEQ ID NO: 221337 - DNA, 25 bp, Mus musculus
cacactaccagctggcctataggtt

SEQ ID NO: 221338 - DNA, 25 bp, Mus musculus
cacactaccagctgggtaacgacat

SEQ ID NO: 221339 - DNA, 25 bp, Mus musculus
cacactagtgcctgataagccaaag

SEQ ID NO: 221340 - DNA, 25 bp, Mus musculus
cacactattgggatggaagactgtg

SEQ ID NO: 221341 - DNA, 25 bp, Mus musculus
cacactattggtcctgagttcaatt

SEQ ID NO: 221342 - DNA, 25 bp, Mus musculus
cacactcacagaaaggtgtccaccc

SEQ ID NO: 221343 - DNA, 25 bp, Mus musculus
cacactcaccaggcacttgtggaat

SEQ ID NO: 221344 - DNA, 25 bp, Mus musculus
cacactcaccctcaggctctgagtc

SEQ ID NO: 221345 - DNA, 25 bp, Mus musculus
cacactcacgataaaagctggcagg

SEQ ID NO: 221346 - DNA, 25 bp, Mus musculus
cacactcactgtatgcttccactga

SEQ ID NO: 221347 - DNA, 25 bp, Mus musculus
cacactcactgtttcttctagtatg

SEQ ID NO: 221348 - DNA, 25 bp, Mus musculus
cacactcagagacaggcctcaggat

SEQ ID NO: 221349 - DNA, 25 bp, Mus musculus
cacactcaggggacaattcaagctt

SEQ ID NO: 221350 - DNA, 25 bp, Mus musculus
cacactccagaggtacaagcgccat

SEQ ID NO: 221351 - DNA, 25 bp, Mus musculus
cacactccagtccagcaatcccagg

SEQ ID NO: 221352 - DNA, 25 bp, Mus musculus
cacactcccatgcccgtggctgttc

SEQ ID NO: 221353 - DNA, 25 bp, Mus musculus
cacactccctgtcctgttagcctga

SEQ ID NO: 221354 - DNA, 25 bp, Mus musculus
cacactccgacagctttccaccacc

SEQ ID NO: 221355 - DNA, 25 bp, Mus musculus
cacactccttaacactgtcataggc

SEQ ID NO: 221356 - DNA, 25 bp, Mus musculus
cacactccttttagaagcaattcta

SEQ ID NO: 221357 - DNA, 25 bp, Mus musculus
cacactcgcctgagactcgtcctcc

SEQ ID NO: 221358 - DNA, 25 bp, Mus musculus
cacactcgctggagctggtggagaa

SEQ ID NO: 221359 - DNA, 25 bp, Mus musculus
cacactctcatccctagcagaacat

SEQ ID NO: 221360 - DNA, 25 bp, Mus musculus
cacactctccaactggctttaaggg

SEQ ID NO: 221361 - DNA, 25 bp, Mus musculus
cacactctctcaaattgcctatcag

SEQ ID NO: 221362 - DNA, 25 bp, Mus musculus
cacactctgacagattcacctgcaa

SEQ ID NO: 221363 - DNA, 25 bp, Mus musculus
cacactctgacagtgagggtgcggg

SEQ ID NO: 221364 - DNA, 25 bp, Mus musculus
cacactcttcaaggtaaagtggatc

SEQ ID NO: 221365 - DNA, 25 bp, Mus musculus
cacactcttcagtgggcccgggatg

SEQ ID NO: 221366 - DNA, 25 bp, Mus musculus
cacactgaacaatggtttgctatct

SEQ ID NO: 221367 - DNA, 25 bp, Mus musculus
cacactgaagctcgcactggacacg

SEQ ID NO: 221368 - DNA, 25 bp, Mus musculus
cacactgaaggccgttcctcagtta

SEQ ID NO: 221369 - DNA, 25 bp, Mus musculus
cacactgacacaatatggagtctgg

SEQ ID NO: 221370 - DNA, 25 bp, Mus musculus
cacactgacggagcgcttctgggaa

SEQ ID NO: 221371 - DNA, 25 bp, Mus musculus
cacactgcagcaatgcacggctgtt

SEQ ID NO: 221372 - DNA, 25 bp, Mus musculus
cacactgcagcgagctcgcgagtac

SEQ ID NO: 221373 - DNA, 25 bp, Mus musculus
cacactgcagtggagttgtttaaga

SEQ ID NO: 221374 - DNA, 25 bp, Mus musculus
cacactgcccaagtgggctcacccg

SEQ ID NO: 221375 - DNA, 25 bp, Mus musculus
cacactgcgctaccctgtgaagcca

SEQ ID NO: 221376 - DNA, 25 bp, Mus musculus
cacactggaaacaaatgagatattc

SEQ ID NO: 221377 - DNA, 25 bp, Mus musculus
cacactggaaacaagataaaacaaa

SEQ ID NO: 221378 - DNA, 25 bp, Mus musculus
cacactggaaagggcagcctctttc

SEQ ID NO: 221379 - DNA, 25 bp, Mus musculus
cacactggaaggatttgccagtcca

SEQ ID NO: 221380 - DNA, 25 bp, Mus musculus
cacactggaagtatttttgaacaat

SEQ ID NO: 221381 - DNA, 25 bp, Mus musculus
cacactggagaatcgaggaaaactt

SEQ ID NO: 221382 - DNA, 25 bp, Mus musculus
cacactggccaatgactgtgaggtg

SEQ ID NO: 221383 - DNA, 25 bp, Mus musculus
cacactggccatgaacgtcctgttt

SEQ ID NO: 221384 - DNA, 25 bp, Mus musculus
cacactggccgccactgggaagcct

SEQ ID NO: 221385 - DNA, 25 bp, Mus musculus
cacactggtgcagaagagaagagca

SEQ ID NO: 221386 - DNA, 25 bp, Mus musculus
cacactgtccaaactagcctctgca

SEQ ID NO: 221387 - DNA, 25 bp, Mus musculus
cacactgtccaagatctccgaggct

SEQ ID NO: 221388 - DNA, 25 bp, Mus musculus
cacactgtctgaactcacgctcgcc

SEQ ID NO: 221389 - DNA, 25 bp, Mus musculus
cacactgtgatgtggtggaggtgga

SEQ ID NO: 221390 - DNA, 25 bp, Mus musculus
cacactgtgccgggtgcacacagtg

SEQ ID NO: 221391 - DNA, 25 bp, Mus musculus
cacactgtgggaggaccatccttgc

SEQ ID NO: 221392 - DNA, 25 bp, Mus musculus
cacactgtgggcatcctctacacat

SEQ ID NO: 221393 - DNA, 25 bp, Mus musculus
cacactgtgggccatccacgaaaat

SEQ ID NO: 221394 - DNA, 25 bp, Mus musculus
cacactgtggggtgcccaattacct

SEQ ID NO: 221395 - DNA, 25 bp, Mus musculus
cacacttacgaagatggctctgact

SEQ ID NO: 221396 - DNA, 25 bp, Mus musculus
cacacttcacaaggatggaatagag

SEQ ID NO: 221397 - DNA, 25 bp, Mus musculus
cacacttcgtcctggatcttcctgc

SEQ ID NO: 221398 - DNA, 25 bp, Mus musculus
cacacttcgtcctgtcagtggtgca

SEQ ID NO: 221399 - DNA, 25 bp, Mus musculus
cacacttcttcctgccttaaccatg

SEQ ID NO: 221400 - DNA, 25 bp, Mus musculus
cacacttgaagatcaagacataagt

SEQ ID NO: 221401 - DNA, 25 bp, Mus musculus
cacacttgaagatctttctgcaaga

SEQ ID NO: 221402 - DNA, 25 bp, Mus musculus
cacacttgatcgattatgaaaaggg

SEQ ID NO: 221403 - DNA, 25 bp, Mus musculus
cacacttgatcggttatgaaaagtc

SEQ ID NO: 221404 - DNA, 25 bp, Mus musculus
cacacttggaggtgaaatcgccctg

SEQ ID NO: 221405 - DNA, 25 bp, Mus musculus
cacacttgttcagggtgacagaagg

SEQ ID NO: 221406 - DNA, 25 bp, Mus musculus
cacacttgttgtttacctgctgcct

SEQ ID NO: 221407 - DNA, 25 bp, Mus musculus
cacacttgtttgatttatgaggaat

SEQ ID NO: 221408 - DNA, 25 bp, Mus musculus
cacacttgtttgcgtttcccaacag

SEQ ID NO: 221409 - DNA, 25 bp, Mus musculus
cacacttttccagttccccacactg

SEQ ID NO: 221410 - DNA, 25 bp, Mus musculus
cacagaaaaagagaagctgatggtc

SEQ ID NO: 221411 - DNA, 25 bp, Mus musculus
cacagaaaaagcctgaaaatgaatc

SEQ ID NO: 221412 - DNA, 25 bp, Mus musculus
cacagaaaaaggtctgcagaatgtc

SEQ ID NO: 221413 - DNA, 25 bp, Mus musculus
cacagaaaacaaagtggagcgaccc

SEQ ID NO: 221414 - DNA, 25 bp, Mus musculus
cacagaaaaccacagtgtcctgtgc

SEQ ID NO: 221415 - DNA, 25 bp, Mus musculus
cacagaaaagaaccggcactgtctt

SEQ ID NO: 221416 - DNA, 25 bp, Mus musculus
cacagaaaagaaggctggtgaggac

SEQ ID NO: 221417 - DNA, 25 bp, Mus musculus
cacagaaaagcctcatatagatcta

SEQ ID NO: 221418 - DNA, 25 bp, Mus musculus
cacagaaaagggaacagagagaccc

SEQ ID NO: 221419 - DNA, 25 bp, Mus musculus
cacagaaaataatacaatggattct

SEQ ID NO: 221420 - DNA, 25 bp, Mus musculus
cacagaaaccgatcatcccagcagc

SEQ ID NO: 221421 - DNA, 25 bp, Mus musculus
cacagaaaccggtgctcccttgcat

SEQ ID NO: 221422 - DNA, 25 bp, Mus musculus
cacagaaatgctgcacaatgtcacc

SEQ ID NO: 221423 - DNA, 25 bp, Mus musculus
cacagaaatttgaaatttcaacaag

SEQ ID NO: 221424 - DNA, 25 bp, Mus musculus
cacagaacaaataagatgttctcaa

SEQ ID NO: 221425 - DNA, 25 bp, Mus musculus
cacagaacaagcagacttccagcag

SEQ ID NO: 221426 - DNA, 25 bp, Mus musculus
cacagaacacggaatgacaaggtct

SEQ ID NO: 221427 - DNA, 25 bp, Mus musculus
cacagaacacgtgaaagcagagcct

SEQ ID NO: 221428 - DNA, 25 bp, Mus musculus
cacagaacagagggggaagaaaccg

SEQ ID NO: 221429 - DNA, 25 bp, Mus musculus
cacagaacattagctcaggtacctg

SEQ ID NO: 221430 - DNA, 25 bp, Mus musculus
cacagaacccgaagagcctcagctt

SEQ ID NO: 221431 - DNA, 25 bp, Mus musculus
cacagaacgagagcgccatctgtcc

SEQ ID NO: 221432 - DNA, 25 bp, Mus musculus
cacagaacggagattatcagctccg

SEQ ID NO: 221433 - DNA, 25 bp, Mus musculus
cacagaacttgacgtcagggccgtc

SEQ ID NO: 221434 - DNA, 25 bp, Mus musculus
cacagaacttgtgcaggtgttctta

SEQ ID NO: 221435 - DNA, 25 bp, Mus musculus
cacagaagacaatagcacccaggca

SEQ ID NO: 221436 - DNA, 25 bp, Mus musculus
cacagaagactacagctcgacatgg

SEQ ID NO: 221437 - DNA, 25 bp, Mus musculus
cacagaagactacagttgcagctcg

SEQ ID NO: 221438 - DNA, 25 bp, Mus musculus
cacagaagagaagagttgatacaaa

SEQ ID NO: 221439 - DNA, 25 bp, Mus musculus
cacagaagaggccagatatcacagc

SEQ ID NO: 221440 - DNA, 25 bp, Mus musculus
cacagaagatggcagaatagtgatt

SEQ ID NO: 221441 - DNA, 25 bp, Mus musculus
cacagaagcagtgagtacaacacat

SEQ ID NO: 221442 - DNA, 25 bp, Mus musculus
cacagaagcagtggtatttatgagc

SEQ ID NO: 221443 - DNA, 25 bp, Mus musculus
cacagaagcttccaagtatgaggat

SEQ ID NO: 221444 - DNA, 25 bp, Mus musculus
cacagaagggaaggtgggctacgaa

SEQ ID NO: 221445 - DNA, 25 bp, Mus musculus
cacagaagggactggacccatacaa

SEQ ID NO: 221446 - DNA, 25 bp, Mus musculus
cacagaagggactgtcaactcttgt

SEQ ID NO: 221447 - DNA, 25 bp, Mus musculus
cacagaaggggatcggtatcatgcc

SEQ ID NO: 221448 - DNA, 25 bp, Mus musculus
cacagaagtccctgagctcagcccc

SEQ ID NO: 221449 - DNA, 25 bp, Mus musculus
cacagaataattgcctgtcacctac

SEQ ID NO: 221450 - DNA, 25 bp, Mus musculus
cacagaatagttgatctttataagc

SEQ ID NO: 221451 - DNA, 25 bp, Mus musculus
cacagaatagttggtcaaaagaagc

SEQ ID NO: 221452 - DNA, 25 bp, Mus musculus
cacagaatcccagtctcctcactac

SEQ ID NO: 221453 - DNA, 25 bp, Mus musculus
cacagaatcccagtggggaaacggc

SEQ ID NO: 221454 - DNA, 25 bp, Mus musculus
cacagaatgcaagtcacacaaggac

SEQ ID NO: 221455 - DNA, 25 bp, Mus musculus
cacagaatgtcagaaccatcctcct

SEQ ID NO: 221456 - DNA, 25 bp, Mus musculus
cacagaatgtcagtctggagccccc

SEQ ID NO: 221457 - DNA, 25 bp, Mus musculus
cacagaattctcaggaacatcatga

SEQ ID NO: 221458 - DNA, 25 bp, Mus musculus
cacagacaaacttgggttctatggc

SEQ ID NO: 221459 - DNA, 25 bp, Mus musculus
cacagacaagacaggaaccctgacc

SEQ ID NO: 221460 - DNA, 25 bp, Mus musculus
cacagacaaggccaacatcaaagac

SEQ ID NO: 221461 - DNA, 25 bp, Mus musculus
cacagacaatcctatggtctttgcc

SEQ ID NO: 221462 - DNA, 25 bp, Mus musculus
cacagacacaaagctcaagttcatg

SEQ ID NO: 221463 - DNA, 25 bp, Mus musculus
cacagacacatgtagatctttcatt

SEQ ID NO: 221464 - DNA, 25 bp, Mus musculus
cacagacaccgctcgtgtcttatct

SEQ ID NO: 221465 - DNA, 25 bp, Mus musculus
cacagacacggacaatttgggtatc

SEQ ID NO: 221466 - DNA, 25 bp, Mus musculus
cacagacagactgtcagtgttcctg

SEQ ID NO: 221467 - DNA, 25 bp, Mus musculus
cacagacagattgagcagctctatg

SEQ ID NO: 221468 - DNA, 25 bp, Mus musculus
cacagacagcaaggcaaagatgcaa

SEQ ID NO: 221469 - DNA, 25 bp, Mus musculus
cacagacatccctgactaaggctgg

SEQ ID NO: 221470 - DNA, 25 bp, Mus musculus
cacagacatctcaggaggctgcggg

SEQ ID NO: 221471 - DNA, 25 bp, Mus musculus
cacagacatgatggtgggcattggg

SEQ ID NO: 221472 - DNA, 25 bp, Mus musculus
cacagacatggactgtctaactttc

SEQ ID NO: 221473 - DNA, 25 bp, Mus musculus
cacagacatggagtcagtgactttt

SEQ ID NO: 221474 - DNA, 25 bp, Mus musculus
cacagaccaggtgattgtgcagagg

SEQ ID NO: 221475 - DNA, 25 bp, Mus musculus
cacagaccaggtgggagcatgccgg

SEQ ID NO: 221476 - DNA, 25 bp, Mus musculus
cacagaccagtacatgacaatggat

SEQ ID NO: 221477 - DNA, 25 bp, Mus musculus
cacagaccgcctacacatccaggtg

SEQ ID NO: 221478 - DNA, 25 bp, Mus musculus
cacagacctcctgatcacttgtaca

SEQ ID NO: 221479 - DNA, 25 bp, Mus musculus
cacagacctgttagggatccttgtg

SEQ ID NO: 221480 - DNA, 25 bp, Mus musculus
cacagacgagctgttcaaggagagg

SEQ ID NO: 221481 - DNA, 25 bp, Mus musculus
cacagacgtgaaaagtgacgtgaac

SEQ ID NO: 221482 - DNA, 25 bp, Mus musculus
cacagacgtgaaaatgttctgcctg

SEQ ID NO: 221483 - DNA, 25 bp, Mus musculus
cacagactcccctgaatttaaggag

SEQ ID NO: 221484 - DNA, 25 bp, Mus musculus
cacagactgccacggcctcctcagc

SEQ ID NO: 221485 - DNA, 25 bp, Mus musculus
cacagactgccacggtcatctctca

SEQ ID NO: 221486 - DNA, 25 bp, Mus musculus
cacagactggaaggaacatgacatc

SEQ ID NO: 221487 - DNA, 25 bp, Mus musculus
cacagacttgtcccggccacacagc

SEQ ID NO: 221488 - DNA, 25 bp, Mus musculus
cacagagaaaacatcccaggcatcc

SEQ ID NO: 221489 - DNA, 25 bp, Mus musculus
cacagagaagccaggttacaaacta

SEQ ID NO: 221490 - DNA, 25 bp, Mus musculus
cacagagactaaggcaattccagta

SEQ ID NO: 221491 - DNA, 25 bp, Mus musculus
cacagagactaaggctgtgaaaaca

SEQ ID NO: 221492 - DNA, 25 bp, Mus musculus
cacagagagaattttgttcaggctg

SEQ ID NO: 221493 - DNA, 25 bp, Mus musculus
cacagagagcaaaacagaggcccag

SEQ ID NO: 221494 - DNA, 25 bp, Mus musculus
cacagagagcaaggtcgccgctgaa

SEQ ID NO: 221495 - DNA, 25 bp, Mus musculus
cacagagatccactgaggcttttct

SEQ ID NO: 221496 - DNA, 25 bp, Mus musculus
cacagagattcaggttctcccctat

SEQ ID NO: 221497 - DNA, 25 bp, Mus musculus
cacagagcaagaaggagagcgtggc

SEQ ID NO: 221498 - DNA, 25 bp, Mus musculus
cacagagcaatgcaggggggcttgg

SEQ ID NO: 221499 - DNA, 25 bp, Mus musculus
cacagagcacagctgtcccagaagc

SEQ ID NO: 221500 - DNA, 25 bp, Mus musculus
cacagagcaccgggcaagagtccat

SEQ ID NO: 221501 - DNA, 25 bp, Mus musculus
cacagagcaccggggactcctgaga

SEQ ID NO: 221502 - DNA, 25 bp, Mus musculus
cacagagcagaggaatgtctacaag

SEQ ID NO: 221503 - DNA, 25 bp, Mus musculus
cacagagcaggtcatacctcactcc

SEQ ID NO: 221504 - DNA, 25 bp, Mus musculus
cacagagcagtacctcaaatcgttt

SEQ ID NO: 221505 - DNA, 25 bp, Mus musculus
cacagagcagttttaataacccacg

SEQ ID NO: 221506 - DNA, 25 bp, Mus musculus
cacagagccagaagaccagtgaagt

SEQ ID NO: 221507 - DNA, 25 bp, Mus musculus
cacagagccatcaggtcctaatcaa

SEQ ID NO: 221508 - DNA, 25 bp, Mus musculus
cacagagctgacccaagccattttg

SEQ ID NO: 221509 - DNA, 25 bp, Mus musculus
cacagagctgtcccacattgggcta

SEQ ID NO: 221510 - DNA, 25 bp, Mus musculus
cacagagctgttgccaaaacaaaga

SEQ ID NO: 221511 - DNA, 25 bp, Mus musculus
cacagagcttcccaggtctctttga

SEQ ID NO: 221512 - DNA, 25 bp, Mus musculus
cacagaggaaaagattgataagtat

SEQ ID NO: 221513 - DNA, 25 bp, Mus musculus
cacagaggagcagtgaaatatttca

SEQ ID NO: 221514 - DNA, 25 bp, Mus musculus
cacagaggagcagtgaggtaatgac

SEQ ID NO: 221515 - DNA, 25 bp, Mus musculus
cacagagggtaaggatcctgtttga

SEQ ID NO: 221516 - DNA, 25 bp, Mus musculus
cacagaggtggaggagagcatggcc

SEQ ID NO: 221517 - DNA, 25 bp, Mus musculus
cacagagtccaccgatttactaaat

SEQ ID NO: 221518 - DNA, 25 bp, Mus musculus
cacagagtccaccgttatatttcag

SEQ ID NO: 221519 - DNA, 25 bp, Mus musculus
cacagagtgagagaatagaaccccc

SEQ ID NO: 221520 - DNA, 25 bp, Mus musculus
cacagagtgagttactagagcccgt

SEQ ID NO: 221521 - DNA, 25 bp, Mus musculus
cacagagtgcagagtaaatccctgt

SEQ ID NO: 221522 - DNA, 25 bp, Mus musculus
cacagagtttcaaggcaaacgaatg

SEQ ID NO: 221523 - DNA, 25 bp, Mus musculus
cacagagtttcaaggcagcagtgaa

SEQ ID NO: 221524 - DNA, 25 bp, Mus musculus
cacagagtttcaaggtgggatgtgt

SEQ ID NO: 221525 - DNA, 25 bp, Mus musculus
cacagataacccaaggtggctggat

SEQ ID NO: 221526 - DNA, 25 bp, Mus musculus
cacagataacccagaggatcacctt

SEQ ID NO: 221527 - DNA, 25 bp, Mus musculus
cacagataacccagtatcagtactt

SEQ ID NO: 221528 - DNA, 25 bp, Mus musculus
cacagatagagaaaccaactgaggt

SEQ ID NO: 221529 - DNA, 25 bp, Mus musculus
cacagatatctttccatctgtgtcc

SEQ ID NO: 221530 - DNA, 25 bp, Mus musculus
cacagatcaagagattggtgagctc

SEQ ID NO: 221531 - DNA, 25 bp, Mus musculus
cacagatcaagaggcctgggattga

SEQ ID NO: 221532 - DNA, 25 bp, Mus musculus
cacagatcatgaagacagtaaagac

SEQ ID NO: 221533 - DNA, 25 bp, Mus musculus
cacagatcatgaaggacatctgggt

SEQ ID NO: 221534 - DNA, 25 bp, Mus musculus
cacagatcatgaaggtacattttat

SEQ ID NO: 221535 - DNA, 25 bp, Mus musculus
cacagatcccagccctgtccctagg

SEQ ID NO: 221536 - DNA, 25 bp, Mus musculus
cacagatctcgctcaagaagtcctg

SEQ ID NO: 221537 - DNA, 25 bp, Mus musculus
cacagatcttcaaggcctgggctgt

SEQ ID NO: 221538 - DNA, 25 bp, Mus musculus
cacagatgaagagcaagtacagaac

SEQ ID NO: 221539 - DNA, 25 bp, Mus musculus
cacagatgaagatcttcaggattta

SEQ ID NO: 221540 - DNA, 25 bp, Mus musculus
cacagatgagacgggcatagaacaa

SEQ ID NO: 221541 - DNA, 25 bp, Mus musculus
cacagatgagacgggtattgaacgc

SEQ ID NO: 221542 - DNA, 25 bp, Mus musculus
cacagatggatacagccttccagag

SEQ ID NO: 221543 - DNA, 25 bp, Mus musculus
cacagatggccaagggcactcaacg

SEQ ID NO: 221544 - DNA, 25 bp, Mus musculus
cacagatggccaagtcaagctgtga

SEQ ID NO: 221545 - DNA, 25 bp, Mus musculus
cacagatgtcaggagccctgtcctg

SEQ ID NO: 221546 - DNA, 25 bp, Mus musculus
cacagatgtcagggttgtacctgac

SEQ ID NO: 221547 - DNA, 25 bp, Mus musculus
cacagatgtcaggtttatgcgcatg

SEQ ID NO: 221548 - DNA, 25 bp, Mus musculus
cacagatgtcagtcatcttcctctg

SEQ ID NO: 221549 - DNA, 25 bp, Mus musculus
cacagatgtgcagcttgaaggaggc

SEQ ID NO: 221550 - DNA, 25 bp, Mus musculus
cacagcaaacagagccctttgccat

SEQ ID NO: 221551 - DNA, 25 bp, Mus musculus
cacagcaaacggctgtccctcctcc

SEQ ID NO: 221552 - DNA, 25 bp, Mus musculus
cacagcaaagcgccaggctccgatg

SEQ ID NO: 221553 - DNA, 25 bp, Mus musculus
cacagcaacagccttctacttctac

SEQ ID NO: 221554 - DNA, 25 bp, Mus musculus
cacagcaacatcaggtctcggacaa

SEQ ID NO: 221555 - DNA, 25 bp, Mus musculus
cacagcaacgctaggttcggagcga

SEQ ID NO: 221556 - DNA, 25 bp, Mus musculus
cacagcaactaggcatgaagcacta

SEQ ID NO: 221557 - DNA, 25 bp, Mus musculus
cacagcacaggaggaagcaagggca

SEQ ID NO: 221558 - DNA, 25 bp, Mus musculus
cacagcacaggtgtaacgagtaatg

SEQ ID NO: 221559 - DNA, 25 bp, Mus musculus
cacagcacatttggtcagaaaacac

SEQ ID NO: 221560 - DNA, 25 bp, Mus musculus
cacagcaccaagatatcattaatgg

SEQ ID NO: 221561 - DNA, 25 bp, Mus musculus
cacagcacccaccatcccctgcccc

SEQ ID NO: 221562 - DNA, 25 bp, Mus musculus
cacagcacccagcatgaggagctga

SEQ ID NO: 221563 - DNA, 25 bp, Mus musculus
cacagcacccttatcttcaaagtgc

SEQ ID NO: 221564 - DNA, 25 bp, Mus musculus
cacagcacgccactggcagatcctg

SEQ ID NO: 221565 - DNA, 25 bp, Mus musculus
cacagcagaaagctggtttattgca

SEQ ID NO: 221566 - DNA, 25 bp, Mus musculus
cacagcagacacagtccggttctcc

SEQ ID NO: 221567 - DNA, 25 bp, Mus musculus
cacagcagagattgtatgtttatca

SEQ ID NO: 221568 - DNA, 25 bp, Mus musculus
cacagcagaggtggaaaatggttgg

SEQ ID NO: 221569 - DNA, 25 bp, Mus musculus
cacagcagcagcgcaacgaagttca

SEQ ID NO: 221570 - DNA, 25 bp, Mus musculus
cacagcagctgctgaccacactggg

SEQ ID NO: 221571 - DNA, 25 bp, Mus musculus
cacagcagctgctggcaggctgcat

SEQ ID NO: 221572 - DNA, 25 bp, Mus musculus
cacagcagctggaactcattataca

SEQ ID NO: 221573 - DNA, 25 bp, Mus musculus
cacagcaggagatagggtttcaagt

SEQ ID NO: 221574 - DNA, 25 bp, Mus musculus
cacagcaggagttcaagaacgccaa

SEQ ID NO: 221575 - DNA, 25 bp, Mus musculus
cacagcaggctacagtcagttctac

SEQ ID NO: 221576 - DNA, 25 bp, Mus musculus
cacagcaggctacagtgactttttc

SEQ ID NO: 221577 - DNA, 25 bp, Mus musculus
cacagcagggcaggatgagtacagc

SEQ ID NO: 221578 - DNA, 25 bp, Mus musculus
cacagcaggtggatgcagtgacctt

SEQ ID NO: 221579 - DNA, 25 bp, Mus musculus
cacagcagtccaagaaaacatcgct

SEQ ID NO: 221580 - DNA, 25 bp, Mus musculus
cacagcagtccaagatctgatgttt

SEQ ID NO: 221581 - DNA, 25 bp, Mus musculus
cacagcagtccaagcgctctctcag

SEQ ID NO: 221582 - DNA, 25 bp, Mus musculus
cacagcatacaagacgagaaggaca

SEQ ID NO: 221583 - DNA, 25 bp, Mus musculus
cacagcatacaagtcctcaagggcc

SEQ ID NO: 221584 - DNA, 25 bp, Mus musculus
cacagcatcaaagcctgctcccagt

SEQ ID NO: 221585 - DNA, 25 bp, Mus musculus
cacagcatcaaggtggcccggcaga

SEQ ID NO: 221586 - DNA, 25 bp, Mus musculus
cacagcatccgaacttttgtgagcc

SEQ ID NO: 221587 - DNA, 25 bp, Mus musculus
cacagcatgactgtgtgtccattgt

SEQ ID NO: 221588 - DNA, 25 bp, Mus musculus
cacagcatgcgggaggaggacttca

SEQ ID NO: 221589 - DNA, 25 bp, Mus musculus
cacagcattaaggctcggctattag

SEQ ID NO: 221590 - DNA, 25 bp, Mus musculus
cacagcattgcccaggtgcactgga

SEQ ID NO: 221591 - DNA, 25 bp, Mus musculus
cacagccaaagatcggaaccgctgg

SEQ ID NO: 221592 - DNA, 25 bp, Mus musculus
cacagccaacaaatgcctcaaggag

SEQ ID NO: 221593 - DNA, 25 bp, Mus musculus
cacagccaacaggtcagaccaagcc

SEQ ID NO: 221594 - DNA, 25 bp, Mus musculus
cacagccaaccagatacccataata

SEQ ID NO: 221595 - DNA, 25 bp, Mus musculus
cacagccaatcagataattctgaaa

SEQ ID NO: 221596 - DNA, 25 bp, Mus musculus
cacagccaccaaggtgacagcttcc

SEQ ID NO: 221597 - DNA, 25 bp, Mus musculus
cacagccaccaccacctcctcgccc

SEQ ID NO: 221598 - DNA, 25 bp, Mus musculus
cacagccaccgagactccagacctc

SEQ ID NO: 221599 - DNA, 25 bp, Mus musculus
cacagccaccgagccgtcaagctga

SEQ ID NO: 221600 - DNA, 25 bp, Mus musculus
cacagccagaagagatcctcagctc

SEQ ID NO: 221601 - DNA, 25 bp, Mus musculus
cacagccagaagagccatggcgagt

SEQ ID NO: 221602 - DNA, 25 bp, Mus musculus
cacagccagatttgaccaagctgca

SEQ ID NO: 221603 - DNA, 25 bp, Mus musculus
cacagccagtccagtagctccatca

SEQ ID NO: 221604 - DNA, 25 bp, Mus musculus
cacagccagtccgggaacccagtgc

SEQ ID NO: 221605 - DNA, 25 bp, Mus musculus
cacagccagtccgtaaaagctcttt

SEQ ID NO: 221606 - DNA, 25 bp, Mus musculus
cacagccatcttgcttcctcacaaa

SEQ ID NO: 221607 - DNA, 25 bp, Mus musculus
cacagccatgagcctcagggctaat

SEQ ID NO: 221608 - DNA, 25 bp, Mus musculus
cacagccatgctgtcaatcaactga

SEQ ID NO: 221609 - DNA, 25 bp, Mus musculus
cacagccatggatgtgcagcagccg

SEQ ID NO: 221610 - DNA, 25 bp, Mus musculus
cacagccatggctgtgtgcaatagc

SEQ ID NO: 221611 - DNA, 25 bp, Mus musculus
cacagccatggggaaccagcctgag

SEQ ID NO: 221612 - DNA, 25 bp, Mus musculus
cacagcccaaaggtcctctgacact

SEQ ID NO: 221613 - DNA, 25 bp, Mus musculus
cacagcccaaagtctgacactacaa

SEQ ID NO: 221614 - DNA, 25 bp, Mus musculus
cacagcccaaggaggctcgaagcac

SEQ ID NO: 221615 - DNA, 25 bp, Mus musculus
cacagcccagaaaagaaaaagtatg

SEQ ID NO: 221616 - DNA, 25 bp, Mus musculus
cacagccccaggccagcagaggagc

SEQ ID NO: 221617 - DNA, 25 bp, Mus musculus
cacagccccaggtggtgatgaagca

SEQ ID NO: 221618 - DNA, 25 bp, Mus musculus
cacagccccagtgctctctctgtgt

SEQ ID NO: 221619 - DNA, 25 bp, Mus musculus
cacagccccagttcacagccatgaa

SEQ ID NO: 221620 - DNA, 25 bp, Mus musculus
cacagcccccactatcttgcctcat

SEQ ID NO: 221621 - DNA, 25 bp, Mus musculus
cacagcccccactcactcgcctcgc

SEQ ID NO: 221622 - DNA, 25 bp, Mus musculus
cacagcccccactgtccaggtgctg

SEQ ID NO: 221623 - DNA, 25 bp, Mus musculus
cacagcccccagctcgtagtgcatg

SEQ ID NO: 221624 - DNA, 25 bp, Mus musculus
cacagccccgcagacactgggttcc

SEQ ID NO: 221625 - DNA, 25 bp, Mus musculus
cacagcccctttgacactcctcaga

SEQ ID NO: 221626 - DNA, 25 bp, Mus musculus
cacagcccgccggtggcagctgacc

SEQ ID NO: 221627 - DNA, 25 bp, Mus musculus
cacagccctctcaggttgtctcaac

SEQ ID NO: 221628 - DNA, 25 bp, Mus musculus
cacagccctgcctaccctaacccag

SEQ ID NO: 221629 - DNA, 25 bp, Mus musculus
cacagccctggctgggggatgggct

SEQ ID NO: 221630 - DNA, 25 bp, Mus musculus
cacagcccttcagccagtactgtcc

SEQ ID NO: 221631 - DNA, 25 bp, Mus musculus
cacagccgaggagggatccaagaac

SEQ ID NO: 221632 - DNA, 25 bp, Mus musculus
cacagccgaggagggtatttcctgg

SEQ ID NO: 221633 - DNA, 25 bp, Mus musculus
cacagccgagttcagattctccgag

SEQ ID NO: 221634 - DNA, 25 bp, Mus musculus
cacagccgagttcagggaacagatt

SEQ ID NO: 221635 - DNA, 25 bp, Mus musculus
cacagccgcagccttaccagccagc

SEQ ID NO: 221636 - DNA, 25 bp, Mus musculus
cacagccgcagcgtcctcagaatgg

SEQ ID NO: 221637 - DNA, 25 bp, Mus musculus
cacagccgcgaccatagtctgtgtg

SEQ ID NO: 221638 - DNA, 25 bp, Mus musculus
cacagccgcgcctggtgcagccaaa

SEQ ID NO: 221639 - DNA, 25 bp, Mus musculus
cacagccgctgaagatgtgcctcat

SEQ ID NO: 221640 - DNA, 25 bp, Mus musculus
cacagccgcttcggcattctggaat

SEQ ID NO: 221641 - DNA, 25 bp, Mus musculus
cacagccgtccagacggtgcagaga

SEQ ID NO: 221642 - DNA, 25 bp, Mus musculus
cacagccgtccagcacttccacgtg

SEQ ID NO: 221643 - DNA, 25 bp, Mus musculus
cacagcctaagatggtcactcggac

SEQ ID NO: 221644 - DNA, 25 bp, Mus musculus
cacagcctagcctgtgtttgtgatg

SEQ ID NO: 221645 - DNA, 25 bp, Mus musculus
cacagcctagcgggtgcaaagaaat

SEQ ID NO: 221646 - DNA, 25 bp, Mus musculus
cacagcctcatcattacagatggtt

SEQ ID NO: 221647 - DNA, 25 bp, Mus musculus
cacagcctcgactgaccctgactgc

SEQ ID NO: 221648 - DNA, 25 bp, Mus musculus
cacagcctctacccccttcctgccc

SEQ ID NO: 221649 - DNA, 25 bp, Mus musculus
cacagcctctccaggggaaaataag

SEQ ID NO: 221650 - DNA, 25 bp, Mus musculus
cacagcctctccagttcctttgtcc

SEQ ID NO: 221651 - DNA, 25 bp, Mus musculus
cacagcctgaggagacgcagaggca

SEQ ID NO: 221652 - DNA, 25 bp, Mus musculus
cacagcctgccacaggaagagagct

SEQ ID NO: 221653 - DNA, 25 bp, Mus musculus
cacagcctgggtgcctatagcatta

SEQ ID NO: 221654 - DNA, 25 bp, Mus musculus
cacagcctgtgaccatctttggaga

SEQ ID NO: 221655 - DNA, 25 bp, Mus musculus
cacagcctgtgctcattgcccactg

SEQ ID NO: 221656 - DNA, 25 bp, Mus musculus
cacagcctgtgtggctcaagtggcc

SEQ ID NO: 221657 - DNA, 25 bp, Mus musculus
cacagcctgtgtgggcctgggactt

SEQ ID NO: 221658 - DNA, 25 bp, Mus musculus
cacagccttactggggtttggaaat

SEQ ID NO: 221659 - DNA, 25 bp, Mus musculus
cacagccttcttttatgaggtctcc

SEQ ID NO: 221660 - DNA, 25 bp, Mus musculus
cacagccttcttttgacccacataa

SEQ ID NO: 221661 - DNA, 25 bp, Mus musculus
cacagcgacccagcgtctgatggct

SEQ ID NO: 221662 - DNA, 25 bp, Mus musculus
cacagcgcaaccaggcccaggaggg

SEQ ID NO: 221663 - DNA, 25 bp, Mus musculus
cacagcgcatgaaagggtctggtga

SEQ ID NO: 221664 - DNA, 25 bp, Mus musculus
cacagcggaaccgacaaaggttacc

SEQ ID NO: 221665 - DNA, 25 bp, Mus musculus
cacagcggaaccgcttcttcacttg

SEQ ID NO: 221666 - DNA, 25 bp, Mus musculus
cacagcggaaccggacgccctggcc

SEQ ID NO: 221667 - DNA, 25 bp, Mus musculus
cacagcggaggaaggagctaactct

SEQ ID NO: 221668 - DNA, 25 bp, Mus musculus
cacagcggaggaagtccttccgagg

SEQ ID NO: 221669 - DNA, 25 bp, Mus musculus
cacagcggtcgccggttcccactat

SEQ ID NO: 221670 - DNA, 25 bp, Mus musculus
cacagcgtacagatgaaaaggggtt

SEQ ID NO: 221671 - DNA, 25 bp, Mus musculus
cacagcgtacaggctcaggaaacat

SEQ ID NO: 221672 - DNA, 25 bp, Mus musculus
cacagcgtcctccgggtagctggga

SEQ ID NO: 221673 - DNA, 25 bp, Mus musculus
cacagcgtgctctcaatgaaggcaa

SEQ ID NO: 221674 - DNA, 25 bp, Mus musculus
cacagcgttcacaagatcatttcca

SEQ ID NO: 221675 - DNA, 25 bp, Mus musculus
cacagcgttcacaagtctgagttca

SEQ ID NO: 221676 - DNA, 25 bp, Mus musculus
cacagctaaagtgtatactcctgat

SEQ ID NO: 221677 - DNA, 25 bp, Mus musculus
cacagctaagatcacagccatgaac

SEQ ID NO: 221678 - DNA, 25 bp, Mus musculus
cacagctaagttcacagccatgaac

SEQ ID NO: 221679 - DNA, 25 bp, Mus musculus
cacagctaccgaggagagagtcaga

SEQ ID NO: 221680 - DNA, 25 bp, Mus musculus
cacagctaccgaggtgctgcaggag

SEQ ID NO: 221681 - DNA, 25 bp, Mus musculus
cacagctactgcgggggactcccca

SEQ ID NO: 221682 - DNA, 25 bp, Mus musculus
cacagctagctatgacctatgagga

SEQ ID NO: 221683 - DNA, 25 bp, Mus musculus
cacagctcacagaagcctgcagagc

SEQ ID NO: 221684 - DNA, 25 bp, Mus musculus
cacagctccagcaggaccttctacc

SEQ ID NO: 221685 - DNA, 25 bp, Mus musculus
cacagctccagcaggctcttgcttg

SEQ ID NO: 221686 - DNA, 25 bp, Mus musculus
cacagctccgggaggcctttgaaga

SEQ ID NO: 221687 - DNA, 25 bp, Mus musculus
cacagctcctgtccaggagatggca

SEQ ID NO: 221688 - DNA, 25 bp, Mus musculus
cacagctcggctcctgggcagcgaa

SEQ ID NO: 221689 - DNA, 25 bp, Mus musculus
cacagctctacctaggattcgagta

SEQ ID NO: 221690 - DNA, 25 bp, Mus musculus
cacagctctaggcttttcagatgtg

SEQ ID NO: 221691 - DNA, 25 bp, Mus musculus
cacagctcttaagaaggactgcagt

SEQ ID NO: 221692 - DNA, 25 bp, Mus musculus
cacagctgaaaaagtctggtttttg

SEQ ID NO: 221693 - DNA, 25 bp, Mus musculus
cacagctgaaggagagactagaaaa

SEQ ID NO: 221694 - DNA, 25 bp, Mus musculus
cacagctgaccccagagcaccagac

SEQ ID NO: 221695 - DNA, 25 bp, Mus musculus
cacagctgactcagcccggcaagct

SEQ ID NO: 221696 - DNA, 25 bp, Mus musculus
cacagctgcagcaggagcaaccaac

SEQ ID NO: 221697 - DNA, 25 bp, Mus musculus
cacagctgcaggtaaaaataaatgg

SEQ ID NO: 221698 - DNA, 25 bp, Mus musculus
cacagctgccgggcccttcgacaaa

SEQ ID NO: 221699 - DNA, 25 bp, Mus musculus
cacagctgcggatcaccagaccatc

SEQ ID NO: 221700 - DNA, 25 bp, Mus musculus
cacagctgctaactctcttctggcc

SEQ ID NO: 221701 - DNA, 25 bp, Mus musculus
cacagctggaacagtggccgcacga

SEQ ID NO: 221702 - DNA, 25 bp, Mus musculus
cacagctggcgaggtgttggcagcc

SEQ ID NO: 221703 - DNA, 25 bp, Mus musculus
cacagctggtggagatgattgcaga

SEQ ID NO: 221704 - DNA, 25 bp, Mus musculus
cacagctggtggagttgttgggaga

SEQ ID NO: 221705 - DNA, 25 bp, Mus musculus
cacagctgtctagctgtttcctctt

SEQ ID NO: 221706 - DNA, 25 bp, Mus musculus
cacagctgtctagtccccatggaca

SEQ ID NO: 221707 - DNA, 25 bp, Mus musculus
cacagctgttctgcccgaggacggt

SEQ ID NO: 221708 - DNA, 25 bp, Mus musculus
cacagcttatggcagctgctgtgtg

SEQ ID NO: 221709 - DNA, 25 bp, Mus musculus
cacagcttcacacagagaccctggt

SEQ ID NO: 221710 - DNA, 25 bp, Mus musculus
cacagcttcaccacgaccctggtga

SEQ ID NO: 221711 - DNA, 25 bp, Mus musculus
cacagcttcagaacaaaagtccaga

SEQ ID NO: 221712 - DNA, 25 bp, Mus musculus
cacagcttcagattccatcaatctc

SEQ ID NO: 221713 - DNA, 25 bp, Mus musculus
cacagcttcccaggagatgtacgac

SEQ ID NO: 221714 - DNA, 25 bp, Mus musculus
cacagcttcccagggggatatccgc

SEQ ID NO: 221715 - DNA, 25 bp, Mus musculus
cacagctttatacagaaagatgttg

SEQ ID NO: 221716 - DNA, 25 bp, Mus musculus
cacagctttccagaattcctcagag

SEQ ID NO: 221717 - DNA, 25 bp, Mus musculus
cacagctttccagacttacaacagc

SEQ ID NO: 221718 - DNA, 25 bp, Mus musculus
cacaggaaacaggagcagcgttgcc

SEQ ID NO: 221719 - DNA, 25 bp, Mus musculus
cacaggaaactggccaaggtggagc

SEQ ID NO: 221720 - DNA, 25 bp, Mus musculus
cacaggaaactggccaggtgctctc

SEQ ID NO: 221721 - DNA, 25 bp, Mus musculus
cacaggaaactggttggctgggaag

SEQ ID NO: 221722 - DNA, 25 bp, Mus musculus
cacaggaaagaagattcttgacaag

SEQ ID NO: 221723 - DNA, 25 bp, Mus musculus
cacaggaaaggggaatgtgactctg

SEQ ID NO: 221724 - DNA, 25 bp, Mus musculus
cacaggaaatgtttattggaaaagg

SEQ ID NO: 221725 - DNA, 25 bp, Mus musculus
cacaggaaatgtttgcatctggcca

SEQ ID NO: 221726 - DNA, 25 bp, Mus musculus
cacaggaaatgtttgtgacccccct

SEQ ID NO: 221727 - DNA, 25 bp, Mus musculus
cacaggaacaaatggggagaaactc

SEQ ID NO: 221728 - DNA, 25 bp, Mus musculus
cacaggaacaagatcctgcacaggg

SEQ ID NO: 221729 - DNA, 25 bp, Mus musculus
cacaggaacaaggtgtggccaaacg

SEQ ID NO: 221730 - DNA, 25 bp, Mus musculus
cacaggaacatcgtgactttatatg

SEQ ID NO: 221731 - DNA, 25 bp, Mus musculus
cacaggaaccagctgatggccagga

SEQ ID NO: 221732 - DNA, 25 bp, Mus musculus
cacaggaagactggtgggaacacag

SEQ ID NO: 221733 - DNA, 25 bp, Mus musculus
cacaggaagagctggattttgccat

SEQ ID NO: 221734 - DNA, 25 bp, Mus musculus
cacaggaagagctgggctctcccgc

SEQ ID NO: 221735 - DNA, 25 bp, Mus musculus
cacaggaagtcagctagcagccaca

SEQ ID NO: 221736 - DNA, 25 bp, Mus musculus
cacaggaatagatttcttatctgct

SEQ ID NO: 221737 - DNA, 25 bp, Mus musculus
cacaggacagagttcctgtagttgc

SEQ ID NO: 221738 - DNA, 25 bp, Mus musculus
cacaggacatcaggctctgtgtgag

SEQ ID NO: 221739 - DNA, 25 bp, Mus musculus
cacaggacatcccagacaattttgg

SEQ ID NO: 221740 - DNA, 25 bp, Mus musculus
cacaggacatcccagcaaagaaacg

SEQ ID NO: 221741 - DNA, 25 bp, Mus musculus
cacaggacccaagtacattcacctg

SEQ ID NO: 221742 - DNA, 25 bp, Mus musculus
cacaggacggaaagcgaatggaccc

SEQ ID NO: 221743 - DNA, 25 bp, Mus musculus
cacaggacggatggcgggtttccgc

SEQ ID NO: 221744 - DNA, 25 bp, Mus musculus
cacaggacgggccaaaagatgcagt

SEQ ID NO: 221745 - DNA, 25 bp, Mus musculus
cacaggacggtgtctttattgccat

SEQ ID NO: 221746 - DNA, 25 bp, Mus musculus
cacaggactcaagtcctccacagag

SEQ ID NO: 221747 - DNA, 25 bp, Mus musculus
cacaggagaacagataagccaaaga

SEQ ID NO: 221748 - DNA, 25 bp, Mus musculus
cacaggagaagggagttggcagtaa

SEQ ID NO: 221749 - DNA, 25 bp, Mus musculus
cacaggagaaggtgaaggagggaag

SEQ ID NO: 221750 - DNA, 25 bp, Mus musculus
cacaggagagaagcatcaagatgac

SEQ ID NO: 221751 - DNA, 25 bp, Mus musculus
cacaggagagaagggtcaccgctag

SEQ ID NO: 221752 - DNA, 25 bp, Mus musculus
cacaggagagatagacccagtgaca

SEQ ID NO: 221753 - DNA, 25 bp, Mus musculus
cacaggagccaagagctatgagcca

SEQ ID NO: 221754 - DNA, 25 bp, Mus musculus
cacaggagccaagagtgaagaacaa

SEQ ID NO: 221755 - DNA, 25 bp, Mus musculus
cacaggagtgccaacatatcgatga

SEQ ID NO: 221756 - DNA, 25 bp, Mus musculus
cacaggagtgccaagatatcgatga

SEQ ID NO: 221757 - DNA, 25 bp, Mus musculus
cacaggagtggtcccgtaggcctca

SEQ ID NO: 221758 - DNA, 25 bp, Mus musculus
cacaggataactttaaccagacaca

SEQ ID NO: 221759 - DNA, 25 bp, Mus musculus
cacaggataactttgatgtgtatgc

SEQ ID NO: 221760 - DNA, 25 bp, Mus musculus
cacaggatacaggattctcataatg

SEQ ID NO: 221761 - DNA, 25 bp, Mus musculus
cacaggatacagggttatacagggg

SEQ ID NO: 221762 - DNA, 25 bp, Mus musculus
cacaggatcagaggtcaccttccga

SEQ ID NO: 221763 - DNA, 25 bp, Mus musculus
cacaggatgaaggttaggcacgggc

SEQ ID NO: 221764 - DNA, 25 bp, Mus musculus
cacaggatgggtcccagcctgcagt

SEQ ID NO: 221765 - DNA, 25 bp, Mus musculus
cacaggattaccaccatgttcaacc

SEQ ID NO: 221766 - DNA, 25 bp, Mus musculus
cacaggattcagctctgtttcctag

SEQ ID NO: 221767 - DNA, 25 bp, Mus musculus
cacaggattcaggccactaaacctc

SEQ ID NO: 221768 - DNA, 25 bp, Mus musculus
cacaggattgaggtccagaaggatg

SEQ ID NO: 221769 - DNA, 25 bp, Mus musculus
cacaggattgtggcgacaaataaca

SEQ ID NO: 221770 - DNA, 25 bp, Mus musculus
cacaggattgtggtaacaaataaca

SEQ ID NO: 221771 - DNA, 25 bp, Mus musculus
cacaggattttctgtgcagcagatt

SEQ ID NO: 221772 - DNA, 25 bp, Mus musculus
cacaggattttctgtgcctttattg

SEQ ID NO: 221773 - DNA, 25 bp, Mus musculus
cacaggcaaacaggggcaattattg

SEQ ID NO: 221774 - DNA, 25 bp, Mus musculus
cacaggcaaacagggtacctttcac

SEQ ID NO: 221775 - DNA, 25 bp, Mus musculus
cacaggcaagaaggagaggaatact

SEQ ID NO: 221776 - DNA, 25 bp, Mus musculus
cacaggcacaccagggcaccctcag

SEQ ID NO: 221777 - DNA, 25 bp, Mus musculus
cacaggcaccagtcttggaggagga

SEQ ID NO: 221778 - DNA, 25 bp, Mus musculus
cacaggcagaacgaggcaaagacaa

SEQ ID NO: 221779 - DNA, 25 bp, Mus musculus
cacaggcagccggggcgagaagggt

SEQ ID NO: 221780 - DNA, 25 bp, Mus musculus
cacaggcaggcagattgaccttggc

SEQ ID NO: 221781 - DNA, 25 bp, Mus musculus
cacaggcataccaggctccagaaat

SEQ ID NO: 221782 - DNA, 25 bp, Mus musculus
cacaggccagccttcttgctaagga

SEQ ID NO: 221783 - DNA, 25 bp, Mus musculus
cacaggcccattaaggtgaacctcc

SEQ ID NO: 221784 - DNA, 25 bp, Mus musculus
cacaggcctgagtttcctgagctga

SEQ ID NO: 221785 - DNA, 25 bp, Mus musculus
cacaggcctgcagacatttttagcc

SEQ ID NO: 221786 - DNA, 25 bp, Mus musculus
cacaggcctgcagccaggtgatttt

SEQ ID NO: 221787 - DNA, 25 bp, Mus musculus
cacaggccttgggctggagcacccg

SEQ ID NO: 221788 - DNA, 25 bp, Mus musculus
cacaggcgcaagaaaagagaagcag

SEQ ID NO: 221789 - DNA, 25 bp, Mus musculus
cacaggcgggcggtgtatcctcaga

SEQ ID NO: 221790 - DNA, 25 bp, Mus musculus
cacaggcgtccaagctcccagcagc

SEQ ID NO: 221791 - DNA, 25 bp, Mus musculus
cacaggcgtccaaggccatcagctc

SEQ ID NO: 221792 - DNA, 25 bp, Mus musculus
cacaggctaggtatgacggagagag

SEQ ID NO: 221793 - DNA, 25 bp, Mus musculus
cacaggctccaggctgttggaaagc

SEQ ID NO: 221794 - DNA, 25 bp, Mus musculus
cacaggctcctgagcgcagccttgg

SEQ ID NO: 221795 - DNA, 25 bp, Mus musculus
cacaggctcctggccaggagcaaga

SEQ ID NO: 221796 - DNA, 25 bp, Mus musculus
cacaggctggcaaggtcaaacctgc

SEQ ID NO: 221797 - DNA, 25 bp, Mus musculus
cacagggacctgaagcctgagaatt

SEQ ID NO: 221798 - DNA, 25 bp, Mus musculus
cacagggactaagcccacaggagtt

SEQ ID NO: 221799 - DNA, 25 bp, Mus musculus
cacagggagaatgtttttcttactt

SEQ ID NO: 221800 - DNA, 25 bp, Mus musculus
cacagggagacaggatccttccttg

SEQ ID NO: 221801 - DNA, 25 bp, Mus musculus
cacagggaggcagtttgcagggaca

SEQ ID NO: 221802 - DNA, 25 bp, Mus musculus
cacagggatgttggatggaagaatt

SEQ ID NO: 221803 - DNA, 25 bp, Mus musculus
cacagggatttcagatgataaaggc

SEQ ID NO: 221804 - DNA, 25 bp, Mus musculus
cacagggatttcaggctgggaatgc

SEQ ID NO: 221805 - DNA, 25 bp, Mus musculus
cacagggatttcagtctggaaatgt

SEQ ID NO: 221806 - DNA, 25 bp, Mus musculus
cacagggcacccatgcatcagcatc

SEQ ID NO: 221807 - DNA, 25 bp, Mus musculus
cacagggcgaaacaaaggtcccacc

SEQ ID NO: 221808 - DNA, 25 bp, Mus musculus
cacagggctcttcaggtctacatgt

SEQ ID NO: 221809 - DNA, 25 bp, Mus musculus
cacagggctcttcaggtgctccaat

SEQ ID NO: 221810 - DNA, 25 bp, Mus musculus
cacaggggatgatgagacagaagac

SEQ ID NO: 221811 - DNA, 25 bp, Mus musculus
cacagggtgcaagatgatgacttct

SEQ ID NO: 221812 - DNA, 25 bp, Mus musculus
cacagggtgcaagccagcccttcag

SEQ ID NO: 221813 - DNA, 25 bp, Mus musculus
cacagggtgctcctggaaaacgggg

SEQ ID NO: 221814 - DNA, 25 bp, Mus musculus
cacagggtggagcatctgatgacat

SEQ ID NO: 221815 - DNA, 25 bp, Mus musculus
cacagggtggcatacacagagattg

SEQ ID NO: 221816 - DNA, 25 bp, Mus musculus
cacagggtggcatctacccagctgg

SEQ ID NO: 221817 - DNA, 25 bp, Mus musculus
cacaggtaaaaatggattagtcgta

SEQ ID NO: 221818 - DNA, 25 bp, Mus musculus
cacaggtaagggcagatgtcatcaa

SEQ ID NO: 221819 - DNA, 25 bp, Mus musculus
cacaggtagattctggtttacaatc

SEQ ID NO: 221820 - DNA, 25 bp, Mus musculus
cacaggtccagagcatgggggggaa

SEQ ID NO: 221821 - DNA, 25 bp, Mus musculus
cacaggtccagttgtactgcagcca

SEQ ID NO: 221822 - DNA, 25 bp, Mus musculus
cacaggtcggaaggctgcctctcgc

SEQ ID NO: 221823 - DNA, 25 bp, Mus musculus
cacaggtgacaggttttactgcaat

SEQ ID NO: 221824 - DNA, 25 bp, Mus musculus
cacaggtgcctcggttccagggtcc

SEQ ID NO: 221825 - DNA, 25 bp, Mus musculus
cacaggtggcaaagaaccagcattt

SEQ ID NO: 221826 - DNA, 25 bp, Mus musculus
cacaggtgtagcttactaccagcca

SEQ ID NO: 221827 - DNA, 25 bp, Mus musculus
cacaggtgtagggcagaggagactg

SEQ ID NO: 221828 - DNA, 25 bp, Mus musculus
cacaggtgtaggggttgtgctgggc

SEQ ID NO: 221829 - DNA, 25 bp, Mus musculus
cacaggtttgccctgagagtgggcc

SEQ ID NO: 221830 - DNA, 25 bp, Mus musculus
cacagtaaaagctgaaaataatgat

SEQ ID NO: 221831 - DNA, 25 bp, Mus musculus
cacagtaaaggacagtctcatcgat

SEQ ID NO: 221832 - DNA, 25 bp, Mus musculus
cacagtaaaggtctgtggaggaagc

SEQ ID NO: 221833 - DNA, 25 bp, Mus musculus
cacagtaaaggttacagatatactt

SEQ ID NO: 221834 - DNA, 25 bp, Mus musculus
cacagtaaggtcacgaagttgggag

SEQ ID NO: 221835 - DNA, 25 bp, Mus musculus
cacagtacccatcaactaattgtca

SEQ ID NO: 221836 - DNA, 25 bp, Mus musculus
cacagtacccatcaagccaccctgt

SEQ ID NO: 221837 - DNA, 25 bp, Mus musculus
cacagtaccgtcacctccaagtaaa

SEQ ID NO: 221838 - DNA, 25 bp, Mus musculus
cacagtagacactacttcatccgtt

SEQ ID NO: 221839 - DNA, 25 bp, Mus musculus
cacagtataaaacccatacaatttg

SEQ ID NO: 221840 - DNA, 25 bp, Mus musculus
cacagtataaaacccatccagaatg

SEQ ID NO: 221841 - DNA, 25 bp, Mus musculus
cacagtcaaatcagatgcccccacg

SEQ ID NO: 221842 - DNA, 25 bp, Mus musculus
cacagtcaaggagctgggcaacagc

SEQ ID NO: 221843 - DNA, 25 bp, Mus musculus
cacagtcaagggatgaactgtgaaa

SEQ ID NO: 221844 - DNA, 25 bp, Mus musculus
cacagtcacatttacagactcctag

SEQ ID NO: 221845 - DNA, 25 bp, Mus musculus
cacagtcaccgagagtggggagtag

SEQ ID NO: 221846 - DNA, 25 bp, Mus musculus
cacagtcactggacccaaagtcatt

SEQ ID NO: 221847 - DNA, 25 bp, Mus musculus
cacagtcagttcagcttcaattagt

SEQ ID NO: 221848 - DNA, 25 bp, Mus musculus
cacagtcatggccttccctccgggt

SEQ ID NO: 221849 - DNA, 25 bp, Mus musculus
cacagtccaaggtcacacggttatc

SEQ ID NO: 221850 - DNA, 25 bp, Mus musculus
cacagtccagctccaagttatctcc

SEQ ID NO: 221851 - DNA, 25 bp, Mus musculus
cacagtcctcggaggagtatatatc

SEQ ID NO: 221852 - DNA, 25 bp, Mus musculus
cacagtcgagagctaagatgcgagt

SEQ ID NO: 221853 - DNA, 25 bp, Mus musculus
cacagtctcagaaaccattgaatcc

SEQ ID NO: 221854 - DNA, 25 bp, Mus musculus
cacagtctcagccacagagaaccag

SEQ ID NO: 221855 - DNA, 25 bp, Mus musculus
cacagtctcagctgccacccgatgc

SEQ ID NO: 221856 - DNA, 25 bp, Mus musculus
cacagtctcagctgcctcctggtca

SEQ ID NO: 221857 - DNA, 25 bp, Mus musculus
cacagtctcctcagagagtcagtcc

SEQ ID NO: 221858 - DNA, 25 bp, Mus musculus
cacagtctcctcagagtctgcgaga

SEQ ID NO: 221859 - DNA, 25 bp, Mus musculus
cacagtctcctcagccaaaacaaca

SEQ ID NO: 221860 - DNA, 25 bp, Mus musculus
cacagtctcctcagccaaaacgaca

SEQ ID NO: 221861 - DNA, 25 bp, Mus musculus
cacagtctcctcagctacaacaaca

SEQ ID NO: 221862 - DNA, 25 bp, Mus musculus
cacagtctctgcccttcaggatgag

SEQ ID NO: 221863 - DNA, 25 bp, Mus musculus
cacagtgaaggcagtcggagcagtg

SEQ ID NO: 221864 - DNA, 25 bp, Mus musculus
cacagtgaagtcccctcctggccag

SEQ ID NO: 221865 - DNA, 25 bp, Mus musculus
cacagtgaatcagcctcaccttcag

SEQ ID NO: 221866 - DNA, 25 bp, Mus musculus
cacagtgacagggcccaatgtaaag

SEQ ID NO: 221867 - DNA, 25 bp, Mus musculus
cacagtgagcaggggtgactacttt

SEQ ID NO: 221868 - DNA, 25 bp, Mus musculus
cacagtgattatagttgattgaatc

SEQ ID NO: 221869 - DNA, 25 bp, Mus musculus
cacagtgattatagtttcagagcca

SEQ ID NO: 221870 - DNA, 25 bp, Mus musculus
cacagtgcaagccccatgtcactgc

SEQ ID NO: 221871 - DNA, 25 bp, Mus musculus
cacagtgccaagatttttttcgtat

SEQ ID NO: 221872 - DNA, 25 bp, Mus musculus
cacagtgccaaggtcaaaattgcag

SEQ ID NO: 221873 - DNA, 25 bp, Mus musculus
cacagtgccaggcaggtcggataac

SEQ ID NO: 221874 - DNA, 25 bp, Mus musculus
cacagtgccagggagcccagaggaa

SEQ ID NO: 221875 - DNA, 25 bp, Mus musculus
cacagtgccattaggttttcttaaa

SEQ ID NO: 221876 - DNA, 25 bp, Mus musculus
cacagtgcccacccatcactcagca

SEQ ID NO: 221877 - DNA, 25 bp, Mus musculus
cacagtgcccctgcttgttctccag

SEQ ID NO: 221878 - DNA, 25 bp, Mus musculus
cacagtgcccgtgcgcagttctgtg

SEQ ID NO: 221879 - DNA, 25 bp, Mus musculus
cacagtgcctggacaggtcctggaa

SEQ ID NO: 221880 - DNA, 25 bp, Mus musculus
cacagtgcctggtgtcgaggaggcg

SEQ ID NO: 221881 - DNA, 25 bp, Mus musculus
cacagtgctgccacgacccttccca

SEQ ID NO: 221882 - DNA, 25 bp, Mus musculus
cacagtggagatccagacaggcgct

SEQ ID NO: 221883 - DNA, 25 bp, Mus musculus
cacagtggaggattaccaggcaatt

SEQ ID NO: 221884 - DNA, 25 bp, Mus musculus
cacagtggataaatagatgcccgtg

SEQ ID NO: 221885 - DNA, 25 bp, Mus musculus
cacagtggatgttcctccatttgga

SEQ ID NO: 221886 - DNA, 25 bp, Mus musculus
cacagtggtgacaggctccatccaa

SEQ ID NO: 221887 - DNA, 25 bp, Mus musculus
cacagtgtaaaaacagaaagtgtgg

SEQ ID NO: 221888 - DNA, 25 bp, Mus musculus
cacagtgtaaagctctatgtcagaa

SEQ ID NO: 221889 - DNA, 25 bp, Mus musculus
cacagtgtcccaggtccctgtggcc

SEQ ID NO: 221890 - DNA, 25 bp, Mus musculus
cacagtgtcccaggtctctaactgg

SEQ ID NO: 221891 - DNA, 25 bp, Mus musculus
cacagtgtgcgaagatgtggatgag

SEQ ID NO: 221892 - DNA, 25 bp, Mus musculus
cacagtgtgtcaggcattcggggca

SEQ ID NO: 221893 - DNA, 25 bp, Mus musculus
cacagtgttaccagcaccaccaaaa

SEQ ID NO: 221894 - DNA, 25 bp, Mus musculus
cacagttacatgcaggtcataaatg

SEQ ID NO: 221895 - DNA, 25 bp, Mus musculus
cacagttatgaacatcagaaagcct

SEQ ID NO: 221896 - DNA, 25 bp, Mus musculus
cacagttatggtgtgggagatcccg

SEQ ID NO: 221897 - DNA, 25 bp, Mus musculus
cacagttatgtatgcaattggcagt

SEQ ID NO: 221898 - DNA, 25 bp, Mus musculus
cacagttcagaaactgtgaagttcc

SEQ ID NO: 221899 - DNA, 25 bp, Mus musculus
cacagttcctgcgaggctgctccac

SEQ ID NO: 221900 - DNA, 25 bp, Mus musculus
cacagttcgcagatacacttttggc

SEQ ID NO: 221901 - DNA, 25 bp, Mus musculus
cacagttcgcaggaggcagagtaag

SEQ ID NO: 221902 - DNA, 25 bp, Mus musculus
cacagttctatggccaacaggctat

SEQ ID NO: 221903 - DNA, 25 bp, Mus musculus
cacagttggccgatatgaaaatcca

SEQ ID NO: 221904 - DNA, 25 bp, Mus musculus
cacagttggttttgaagaaaggctt

SEQ ID NO: 221905 - DNA, 25 bp, Mus musculus
cacagttgtagaggatctgagaaat

SEQ ID NO: 221906 - DNA, 25 bp, Mus musculus
cacagttgtctacgtcacagagctg

SEQ ID NO: 221907 - DNA, 25 bp, Mus musculus
cacagttgttcatgtcctgaagggg

SEQ ID NO: 221908 - DNA, 25 bp, Mus musculus
cacagtttaggaactggtatgtgga

SEQ ID NO: 221909 - DNA, 25 bp, Mus musculus
cacagtttagtggctgacctactgg

SEQ ID NO: 221910 - DNA, 25 bp, Mus musculus
cacagtttagtgtagcacttactag

SEQ ID NO: 221911 - DNA, 25 bp, Mus musculus
cacagtttagtgtagcttgaacttt

SEQ ID NO: 221912 - DNA, 25 bp, Mus musculus
cacagtttagtgtagttccctcctt

SEQ ID NO: 221913 - DNA, 25 bp, Mus musculus
cacagtttcgtcaagatcaaggtca

SEQ ID NO: 221914 - DNA, 25 bp, Mus musculus
cacagtttcgtcaaggtcaccaagg

SEQ ID NO: 221915 - DNA, 25 bp, Mus musculus
cacagtttctcccatccccacctgt

SEQ ID NO: 221916 - DNA, 25 bp, Mus musculus
cacagtttctgctgcagttctcaga

SEQ ID NO: 221917 - DNA, 25 bp, Mus musculus
cacagtttcttggtctggaataaaa

SEQ ID NO: 221918 - DNA, 25 bp, Mus musculus
cacataaaaaggagacagagtcaga

SEQ ID NO: 221919 - DNA, 25 bp, Mus musculus
cacataaaaaggctgagaaggcaga

SEQ ID NO: 221920 - DNA, 25 bp, Mus musculus
cacataaagaaaatataaacaccag

SEQ ID NO: 221921 - DNA, 25 bp, Mus musculus
cacataaagaaaatgcagcgttcct

SEQ ID NO: 221922 - DNA, 25 bp, Mus musculus
cacataaatattgaaatcgcatcat

SEQ ID NO: 221923 - DNA, 25 bp, Mus musculus
cacataactggctgggtggaaccag

SEQ ID NO: 221924 - DNA, 25 bp, Mus musculus
cacataagtaaccaaatgagtaaga

SEQ ID NO: 221925 - DNA, 25 bp, Mus musculus
cacataagtaaccaacacagatcca

SEQ ID NO: 221926 - DNA, 25 bp, Mus musculus
cacataatggaagggccatgccacc

SEQ ID NO: 221927 - DNA, 25 bp, Mus musculus
cacatacaagagaggtgactacggg

SEQ ID NO: 221928 - DNA, 25 bp, Mus musculus
cacatacaagggacagtggcacagt

SEQ ID NO: 221929 - DNA, 25 bp, Mus musculus
cacatacacagggagcatgacttcg

SEQ ID NO: 221930 - DNA, 25 bp, Mus musculus
cacatacacgatattgatgagtgca

SEQ ID NO: 221931 - DNA, 25 bp, Mus musculus
cacatacacgcaatgcaccgatgga

SEQ ID NO: 221932 - DNA, 25 bp, Mus musculus
cacatacactgatcatagaactcaa

SEQ ID NO: 221933 - DNA, 25 bp, Mus musculus
cacatacagggagcctgctttggta

SEQ ID NO: 221934 - DNA, 25 bp, Mus musculus
cacatacattaaaagttttcagcag

SEQ ID NO: 221935 - DNA, 25 bp, Mus musculus
cacataccacacagcaaggggacgg

SEQ ID NO: 221936 - DNA, 25 bp, Mus musculus
cacataccacacagcaagggggaag

SEQ ID NO: 221937 - DNA, 25 bp, Mus musculus
cacataccaggggctgcgatggacc

SEQ ID NO: 221938 - DNA, 25 bp, Mus musculus
cacataccaggttacaaggacagca

SEQ ID NO: 221939 - DNA, 25 bp, Mus musculus
cacatacccaggatcaaaaccctat

SEQ ID NO: 221940 - DNA, 25 bp, Mus musculus
cacatacccaggttgctgccttgat

SEQ ID NO: 221941 - DNA, 25 bp, Mus musculus
cacatacggacctcaaacctgaaaa

SEQ ID NO: 221942 - DNA, 25 bp, Mus musculus
cacatactatatatgccgttcctat

SEQ ID NO: 221943 - DNA, 25 bp, Mus musculus
cacatactggctacccaggcggctt

SEQ ID NO: 221944 - DNA, 25 bp, Mus musculus
cacatagaaggctctcagcaccatg

SEQ ID NO: 221945 - DNA, 25 bp, Mus musculus
cacatagaccagcgctcctccagac

SEQ ID NO: 221946 - DNA, 25 bp, Mus musculus
cacatagagaaggtgacagatgtca

SEQ ID NO: 221947 - DNA, 25 bp, Mus musculus
cacatagcagataaacttctgcact

SEQ ID NO: 221948 - DNA, 25 bp, Mus musculus
cacatagcccagaaggcgggcagga

SEQ ID NO: 221949 - DNA, 25 bp, Mus musculus
cacataggctatgggcacgtgcggc

SEQ ID NO: 221950 - DNA, 25 bp, Mus musculus
cacatataaggaggaatttggctat

SEQ ID NO: 221951 - DNA, 25 bp, Mus musculus
cacatatcatccaggtgtgttatcc

SEQ ID NO: 221952 - DNA, 25 bp, Mus musculus
cacatatgaaaaagggggccacatt

SEQ ID NO: 221953 - DNA, 25 bp, Mus musculus
cacatatgacgttcagaaacttagt

SEQ ID NO: 221954 - DNA, 25 bp, Mus musculus
cacatatgagaaaatttccaggacc

SEQ ID NO: 221955 - DNA, 25 bp, Mus musculus
cacatatgaggtgcttgagcaggcc

SEQ ID NO: 221956 - DNA, 25 bp, Mus musculus
cacatatgagtgttttaaaatgcct

SEQ ID NO: 221957 - DNA, 25 bp, Mus musculus
cacatattgaaaagagagccaagcc

SEQ ID NO: 221958 - DNA, 25 bp, Mus musculus
cacatattgaaaaggcggcaaagtg

SEQ ID NO: 221959 - DNA, 25 bp, Mus musculus
cacatcaaaatcttggtggaagatg

SEQ ID NO: 221960 - DNA, 25 bp, Mus musculus
cacatcaactacgggtatttggctc

SEQ ID NO: 221961 - DNA, 25 bp, Mus musculus
cacatcaattgccagtctgcaagcc

SEQ ID NO: 221962 - DNA, 25 bp, Mus musculus
cacatcacagtttaggaactggtat

SEQ ID NO: 221963 - DNA, 25 bp, Mus musculus
cacatcacagtttagtggctgacct

SEQ ID NO: 221964 - DNA, 25 bp, Mus musculus
cacatcaccagggaattcgtaccag

SEQ ID NO: 221965 - DNA, 25 bp, Mus musculus
cacatcaccaggtctcattattctc

SEQ ID NO: 221966 - DNA, 25 bp, Mus musculus
cacatcacttgtcttccccagggaa

SEQ ID NO: 221967 - DNA, 25 bp, Mus musculus
cacatcagagagtgtccaggttatg

SEQ ID NO: 221968 - DNA, 25 bp, Mus musculus
cacatcagcaggaacgtcatccatg

SEQ ID NO: 221969 - DNA, 25 bp, Mus musculus
cacatcagcaggcccgggagatcaa

SEQ ID NO: 221970 - DNA, 25 bp, Mus musculus
cacatcagcagtgcctgcagaagcc

SEQ ID NO: 221971 - DNA, 25 bp, Mus musculus
cacatcagcgacacgcgggcgtccg

SEQ ID NO: 221972 - DNA, 25 bp, Mus musculus
cacatcagctgcacctcagtcccct

SEQ ID NO: 221973 - DNA, 25 bp, Mus musculus
cacatcagctggtcctatgtatggc

SEQ ID NO: 221974 - DNA, 25 bp, Mus musculus
cacatcagctgtcagtgcactgatg

SEQ ID NO: 221975 - DNA, 25 bp, Mus musculus
cacatcagctgtcagttctttgcca

SEQ ID NO: 221976 - DNA, 25 bp, Mus musculus
cacatcataaagaggctcacaactc

SEQ ID NO: 221977 - DNA, 25 bp, Mus musculus
cacatcatgacttcttgttcagtca

SEQ ID NO: 221978 - DNA, 25 bp, Mus musculus
cacatccaaagacacttcctctctc

SEQ ID NO: 221979 - DNA, 25 bp, Mus musculus
cacatccaacagagcccagcagcag

SEQ ID NO: 221980 - DNA, 25 bp, Mus musculus
cacatccactggtggagctgcccga

SEQ ID NO: 221981 - DNA, 25 bp, Mus musculus
cacatccagcagcaggaccagtgtg

SEQ ID NO: 221982 - DNA, 25 bp, Mus musculus
cacatccagcagcagtttgtgcagt

SEQ ID NO: 221983 - DNA, 25 bp, Mus musculus
cacatccatggaaagaaaggagagg

SEQ ID NO: 221984 - DNA, 25 bp, Mus musculus
cacatccatggtcctattaaactta

SEQ ID NO: 221985 - DNA, 25 bp, Mus musculus
cacatcccagacagacggtggcgcc

SEQ ID NO: 221986 - DNA, 25 bp, Mus musculus
cacatcccagacagagatgctgcct

SEQ ID NO: 221987 - DNA, 25 bp, Mus musculus
cacatccctgttcactcaacagacc

SEQ ID NO: 221988 - DNA, 25 bp, Mus musculus
cacatccgagatgatgggcgtcggg

SEQ ID NO: 221989 - DNA, 25 bp, Mus musculus
cacatccgagtagtgtgtgacggaa

SEQ ID NO: 221990 - DNA, 25 bp, Mus musculus
cacatccgtcctgcctctgcctctc

SEQ ID NO: 221991 - DNA, 25 bp, Mus musculus
cacatcctaagccaacatgccatat

SEQ ID NO: 221992 - DNA, 25 bp, Mus musculus
cacatcctagaaatgacttctgaat

SEQ ID NO: 221993 - DNA, 25 bp, Mus musculus
cacatcctagaaatgcagaccagga

SEQ ID NO: 221994 - DNA, 25 bp, Mus musculus
cacatcctagaaatgccttctccct

SEQ ID NO: 221995 - DNA, 25 bp, Mus musculus
cacatcctcaggaaagctgtggaga

SEQ ID NO: 221996 - DNA, 25 bp, Mus musculus
cacatcctcaggagccagggaagga

SEQ ID NO: 221997 - DNA, 25 bp, Mus musculus
cacatcctccggactctaatgagct

SEQ ID NO: 221998 - DNA, 25 bp, Mus musculus
cacatcctctgatcggttaagcata

SEQ ID NO: 221999 - DNA, 25 bp, Mus musculus
cacatcctgtccgaggatggatgcc

SEQ ID NO: 222000 - DNA, 25 bp, Mus musculus
cacatcctgtgtgaggtccctccag

SEQ ID NO: 222001 - DNA, 25 bp, Mus musculus
cacatcctgtgtggaccagcagaga

SEQ ID NO: 222002 - DNA, 25 bp, Mus musculus
cacatcgataaggctcctgagggtt

SEQ ID NO: 222003 - DNA, 25 bp, Mus musculus
cacatcgataaggttgaagaacagt

SEQ ID NO: 222004 - DNA, 25 bp, Mus musculus
cacatcgcaaggggctccacgggcc

SEQ ID NO: 222005 - DNA, 25 bp, Mus musculus
cacatcgctcgaggaatcaaaagtc

SEQ ID NO: 222006 - DNA, 25 bp, Mus musculus
cacatcgctgcccaggtccgcacgc

SEQ ID NO: 222007 - DNA, 25 bp, Mus musculus
cacatctcacagactgtggatattc

SEQ ID NO: 222008 - DNA, 25 bp, Mus musculus
cacatctcccaccagaggctgatcc

SEQ ID NO: 222009 - DNA, 25 bp, Mus musculus
cacatctcctaacagatgaacagtg

SEQ ID NO: 222010 - DNA, 25 bp, Mus musculus
cacatctcctaacagctatgaaagg

SEQ ID NO: 222011 - DNA, 25 bp, Mus musculus
cacatctcctcagaggcagcatcct

SEQ ID NO: 222012 - DNA, 25 bp, Mus musculus
cacatctctgatgtggaaggggagt

SEQ ID NO: 222013 - DNA, 25 bp, Mus musculus
cacatctgaccccagtacatggaga

SEQ ID NO: 222014 - DNA, 25 bp, Mus musculus
cacatctgctctcctctgatgaaga

SEQ ID NO: 222015 - DNA, 25 bp, Mus musculus
cacatcttcaggactcggaaggtga

SEQ ID NO: 222016 - DNA, 25 bp, Mus musculus
cacatcttggtcaagaactgtactc

SEQ ID NO: 222017 - DNA, 25 bp, Mus musculus
cacatcttggtcaaggtacaactgt

SEQ ID NO: 222018 - DNA, 25 bp, Mus musculus
cacatgaaacagtttgtagtgcatc

SEQ ID NO: 222019 - DNA, 25 bp, Mus musculus
cacatgaacaggagtccttgccatc

SEQ ID NO: 222020 - DNA, 25 bp, Mus musculus
cacatgaccagtgatcggcgccagt

SEQ ID NO: 222021 - DNA, 25 bp, Mus musculus
cacatgaccagtggaaatgatgtac

SEQ ID NO: 222022 - DNA, 25 bp, Mus musculus
cacatgaccagtgtcgttaggagag

SEQ ID NO: 222023 - DNA, 25 bp, Mus musculus
cacatgagagaaagaatcccaagag

SEQ ID NO: 222024 - DNA, 25 bp, Mus musculus
cacatgagagaaagaatgcccagat

SEQ ID NO: 222025 - DNA, 25 bp, Mus musculus
cacatgagccaggacgacctggcga

SEQ ID NO: 222026 - DNA, 25 bp, Mus musculus
cacatgagctgggctgtagcagtgg

SEQ ID NO: 222027 - DNA, 25 bp, Mus musculus
cacatgaggcgtgggcttcgggaca

SEQ ID NO: 222028 - DNA, 25 bp, Mus musculus
cacatgagtaaggtagcctccaaga

SEQ ID NO: 222029 - DNA, 25 bp, Mus musculus
cacatgagttgtgcctgccgacata

SEQ ID NO: 222030 - DNA, 25 bp, Mus musculus
cacatgataggctatgatagaaggt

SEQ ID NO: 222031 - DNA, 25 bp, Mus musculus
cacatgatcggaacaccatggacgc

SEQ ID NO: 222032 - DNA, 25 bp, Mus musculus
cacatgcagatgacctagagctcgg

SEQ ID NO: 222033 - DNA, 25 bp, Mus musculus
cacatgcagatgagctcggatttct

SEQ ID NO: 222034 - DNA, 25 bp, Mus musculus
cacatgcagatgatcgagtgcttca

SEQ ID NO: 222035 - DNA, 25 bp, Mus musculus
cacatgcagcagggtggaagcccaa

SEQ ID NO: 222036 - DNA, 25 bp, Mus musculus
cacatgccaggggatgccccatact

SEQ ID NO: 222037 - DNA, 25 bp, Mus musculus
cacatgcctgctgagcaagcgtttt

SEQ ID NO: 222038 - DNA, 25 bp, Mus musculus
cacatgcctgtctggaaacaacctg

SEQ ID NO: 222039 - DNA, 25 bp, Mus musculus
cacatgctaacaggggctaccagcc

SEQ ID NO: 222040 - DNA, 25 bp, Mus musculus
cacatgctaggtggagagagccagc

SEQ ID NO: 222041 - DNA, 25 bp, Mus musculus
cacatgctattgatctgatggaggc

SEQ ID NO: 222042 - DNA, 25 bp, Mus musculus
cacatgctattgatgcttgctttaa

SEQ ID NO: 222043 - DNA, 25 bp, Mus musculus
cacatgctcaggacccatagatgaa

SEQ ID NO: 222044 - DNA, 25 bp, Mus musculus
cacatgctctgtgatgaccaagatc

SEQ ID NO: 222045 - DNA, 25 bp, Mus musculus
cacatggaagatctcaggcccatgg

SEQ ID NO: 222046 - DNA, 25 bp, Mus musculus
cacatggaagcatggaatcagagcc

SEQ ID NO: 222047 - DNA, 25 bp, Mus musculus
cacatggaagccgaggtctgcatta

SEQ ID NO: 222048 - DNA, 25 bp, Mus musculus
cacatggaaggaaaggacttcatct

SEQ ID NO: 222049 - DNA, 25 bp, Mus musculus
cacatggaaggcctgggagggtacc

SEQ ID NO: 222050 - DNA, 25 bp, Mus musculus
cacatggacaggtgacgccatctgg

SEQ ID NO: 222051 - DNA, 25 bp, Mus musculus
cacatggaccagttggaggtgggca

SEQ ID NO: 222052 - DNA, 25 bp, Mus musculus
cacatggagaggaaactgtcagcag

SEQ ID NO: 222053 - DNA, 25 bp, Mus musculus
cacatggagagggctcctcgctgtt

SEQ ID NO: 222054 - DNA, 25 bp, Mus musculus
cacatggatctttgggcttgtgatg

SEQ ID NO: 222055 - DNA, 25 bp, Mus musculus
cacatggatctttgggtctgaacgg

SEQ ID NO: 222056 - DNA, 25 bp, Mus musculus
cacatggatgaaaaaaaggacctga

SEQ ID NO: 222057 - DNA, 25 bp, Mus musculus
cacatggatgaaaattcaggacgcc

SEQ ID NO: 222058 - DNA, 25 bp, Mus musculus
cacatggatggtgttctcgggacat

SEQ ID NO: 222059 - DNA, 25 bp, Mus musculus
cacatggattcttggcacttgatgc

SEQ ID NO: 222060 - DNA, 25 bp, Mus musculus
cacatggcaacaggtttatggtcgg

SEQ ID NO: 222061 - DNA, 25 bp, Mus musculus
cacatggccaaggaaaattgtccag

SEQ ID NO: 222062 - DNA, 25 bp, Mus musculus
cacatggccaagggactaaagaaga

SEQ ID NO: 222063 - DNA, 25 bp, Mus musculus
cacatggctgctgccacaggtgaca

SEQ ID NO: 222064 - DNA, 25 bp, Mus musculus
cacatgggaaggagctgtcagtaga

SEQ ID NO: 222065 - DNA, 25 bp, Mus musculus
cacatggggagagagggcaatgcga

SEQ ID NO: 222066 - DNA, 25 bp, Mus musculus
cacatggggagcccaggtccggtga

SEQ ID NO: 222067 - DNA, 25 bp, Mus musculus
cacatgggtggccatgtgcccagcc

SEQ ID NO: 222068 - DNA, 25 bp, Mus musculus
cacatggtgacagtccctctgaggc

SEQ ID NO: 222069 - DNA, 25 bp, Mus musculus
cacatggtgcagtggtggagcaaag

SEQ ID NO: 222070 - DNA, 25 bp, Mus musculus
cacatgtaaggtatcgcaaacgctg

SEQ ID NO: 222071 - DNA, 25 bp, Mus musculus
cacatgtaagtccaacccctgtcat

SEQ ID NO: 222072 - DNA, 25 bp, Mus musculus
cacatgtacaaggactcacacacga

SEQ ID NO: 222073 - DNA, 25 bp, Mus musculus
cacatgtacatatgaaacctgccat

SEQ ID NO: 222074 - DNA, 25 bp, Mus musculus
cacatgtacatatggtcgaccccat

SEQ ID NO: 222075 - DNA, 25 bp, Mus musculus
cacatgtcacagctaaagtccagga

SEQ ID NO: 222076 - DNA, 25 bp, Mus musculus
cacatgtcagatactttggcaaaag

SEQ ID NO: 222077 - DNA, 25 bp, Mus musculus
cacatgtgctgccagtccctccaca

SEQ ID NO: 222078 - DNA, 25 bp, Mus musculus
cacatgtgtagggtgtgtgaggacg

SEQ ID NO: 222079 - DNA, 25 bp, Mus musculus
cacatgtgtggcaggggagccttct

SEQ ID NO: 222080 - DNA, 25 bp, Mus musculus
cacatgttcactatgaggagagagc

SEQ ID NO: 222081 - DNA, 25 bp, Mus musculus
cacatgttcttggcattgggagaga

SEQ ID NO: 222082 - DNA, 25 bp, Mus musculus
cacatgtttcagaaatgaagcagat

SEQ ID NO: 222083 - DNA, 25 bp, Mus musculus
cacatgtttcagccggataccaaca

SEQ ID NO: 222084 - DNA, 25 bp, Mus musculus
cacattaaccagtgcacttaaggac

SEQ ID NO: 222085 - DNA, 25 bp, Mus musculus
cacattacaaggacatgggcaagtt

SEQ ID NO: 222086 - DNA, 25 bp, Mus musculus
cacattacagatgaccgtgataaag

SEQ ID NO: 222087 - DNA, 25 bp, Mus musculus
cacattaccccggagcgagcccatc

SEQ ID NO: 222088 - DNA, 25 bp, Mus musculus
cacattagcccaggtatccatgcca

SEQ ID NO: 222089 - DNA, 25 bp, Mus musculus
cacattagctcggttatgtacaaag

SEQ ID NO: 222090 - DNA, 25 bp, Mus musculus
cacattagctcggttttgtacaaag

SEQ ID NO: 222091 - DNA, 25 bp, Mus musculus
cacattattaaacggatggctccca

SEQ ID NO: 222092 - DNA, 25 bp, Mus musculus
cacattcaacgggggattcatcagt

SEQ ID NO: 222093 - DNA, 25 bp, Mus musculus
cacattcaaggacatcgaggaagtg

SEQ ID NO: 222094 - DNA, 25 bp, Mus musculus
cacattcaaggactgggctgacgcc

SEQ ID NO: 222095 - DNA, 25 bp, Mus musculus
cacattcaccaggtgcactgcctgt

SEQ ID NO: 222096 - DNA, 25 bp, Mus musculus
cacattcactgcagctgctattgga

SEQ ID NO: 222097 - DNA, 25 bp, Mus musculus
cacattcactgcaggtccgagagaa

SEQ ID NO: 222098 - DNA, 25 bp, Mus musculus
cacattcactgcagtgcccaggtcc

SEQ ID NO: 222099 - DNA, 25 bp, Mus musculus
cacattcaggtccaacaaagttcct

SEQ ID NO: 222100 - DNA, 25 bp, Mus musculus
cacattcataaaggtcagaaggcta

SEQ ID NO: 222101 - DNA, 25 bp, Mus musculus
cacattcataaaggtctagagggct

SEQ ID NO: 222102 - DNA, 25 bp, Mus musculus
cacattcatttagaaactccccaac

SEQ ID NO: 222103 - DNA, 25 bp, Mus musculus
cacattcatttagtatccgctccat

SEQ ID NO: 222104 - DNA, 25 bp, Mus musculus
cacattccaaagtatagcacatttg

SEQ ID NO: 222105 - DNA, 25 bp, Mus musculus
cacattccaaagtttatgttttgtg

SEQ ID NO: 222106 - DNA, 25 bp, Mus musculus
cacattccagggccctctgcctccc

SEQ ID NO: 222107 - DNA, 25 bp, Mus musculus
cacattcccaagggcacaagtgtaa

SEQ ID NO: 222108 - DNA, 25 bp, Mus musculus
cacattccccagcctctgcagacct

SEQ ID NO: 222109 - DNA, 25 bp, Mus musculus
cacattccccaggctctgcagacct

SEQ ID NO: 222110 - DNA, 25 bp, Mus musculus
cacattcgagatggtggagtatatc

SEQ ID NO: 222111 - DNA, 25 bp, Mus musculus
cacattcgagatgttcctcctgcgg

SEQ ID NO: 222112 - DNA, 25 bp, Mus musculus
cacattctacagggtcacagacagg

SEQ ID NO: 222113 - DNA, 25 bp, Mus musculus
cacattctcaataacctgtgtgaac

SEQ ID NO: 222114 - DNA, 25 bp, Mus musculus
cacattctgcagcagatcgtgaacc

SEQ ID NO: 222115 - DNA, 25 bp, Mus musculus
cacattctggagcagtgccaataac

SEQ ID NO: 222116 - DNA, 25 bp, Mus musculus
cacattctgggccaggagtctccaa

SEQ ID NO: 222117 - DNA, 25 bp, Mus musculus
cacattgaagcaataccttctgaca

SEQ ID NO: 222118 - DNA, 25 bp, Mus musculus
cacattgatgagaaaaagaaatcca

SEQ ID NO: 222119 - DNA, 25 bp, Mus musculus
cacattgatgagtatgcacctgagg

SEQ ID NO: 222120 - DNA, 25 bp, Mus musculus
cacattgatgagtgaagaggcgacg

SEQ ID NO: 222121 - DNA, 25 bp, Mus musculus
cacattgatgagtgacctgctgccg

SEQ ID NO: 222122 - DNA, 25 bp, Mus musculus
cacattgcacggcagattacaaaag

SEQ ID NO: 222123 - DNA, 25 bp, Mus musculus
cacattgcaggctgcagatgtgttt

SEQ ID NO: 222124 - DNA, 25 bp, Mus musculus
cacattgcagttggaacaagaggac

SEQ ID NO: 222125 - DNA, 25 bp, Mus musculus
cacattgcggatagagacatcggcg

SEQ ID NO: 222126 - DNA, 25 bp, Mus musculus
cacattggcggctttcttgatcatg

SEQ ID NO: 222127 - DNA, 25 bp, Mus musculus
cacattgtcagatctcagggcagtt

SEQ ID NO: 222128 - DNA, 25 bp, Mus musculus
cacattgtcagatgtccattcagcc

SEQ ID NO: 222129 - DNA, 25 bp, Mus musculus
cacattgtcggtgtacttgggagat

SEQ ID NO: 222130 - DNA, 25 bp, Mus musculus
cacattgttgtcaaggtttgatctc

SEQ ID NO: 222131 - DNA, 25 bp, Mus musculus
cacatttcaagttcatggcatctca

SEQ ID NO: 222132 - DNA, 25 bp, Mus musculus
cacatttcacaaagctcggattggg

SEQ ID NO: 222133 - DNA, 25 bp, Mus musculus
cacatttcagggagactgctgggct

SEQ ID NO: 222134 - DNA, 25 bp, Mus musculus
cacatttccagcgttcccaggctcc

SEQ ID NO: 222135 - DNA, 25 bp, Mus musculus
cacatttccagcgttcccatgcccc

SEQ ID NO: 222136 - DNA, 25 bp, Mus musculus
cacatttcctttcaggcaagtacat

SEQ ID NO: 222137 - DNA, 25 bp, Mus musculus
cacatttgaagacatgctccagctc

SEQ ID NO: 222138 - DNA, 25 bp, Mus musculus
cacatttgagaacggccggtttgtg

SEQ ID NO: 222139 - DNA, 25 bp, Mus musculus
cacatttgagtgtgaagtgagggga

SEQ ID NO: 222140 - DNA, 25 bp, Mus musculus
cacatttggagcccttacagaggaa

SEQ ID NO: 222141 - DNA, 25 bp, Mus musculus
cacatttgggtcttctaattgtcaa

SEQ ID NO: 222142 - DNA, 25 bp, Mus musculus
cacattttaagccagaacgctttac

SEQ ID NO: 222143 - DNA, 25 bp, Mus musculus
cacattttaagccagagttgtaagc

SEQ ID NO: 222144 - DNA, 25 bp, Mus musculus
cacattttgcagagattgagaagca

SEQ ID NO: 222145 - DNA, 25 bp, Mus musculus
cacattttgcagagctttgggacca

SEQ ID NO: 222146 - DNA, 25 bp, Mus musculus
cacattttggaaggtgcctctcctt

SEQ ID NO: 222147 - DNA, 25 bp, Mus musculus
cacatttttcgacatccgcagacat

SEQ ID NO: 222148 - DNA, 25 bp, Mus musculus
cacatttttctgaattattttgata

SEQ ID NO: 222149 - DNA, 25 bp, Mus musculus
cacatttttgttgtgaagttatccg

SEQ ID NO: 222150 - DNA, 25 bp, Mus musculus
caccaaaaacaagctttacacagat

SEQ ID NO: 222151 - DNA, 25 bp, Mus musculus
caccaaaaaccgaagcgcagcagca

SEQ ID NO: 222152 - DNA, 25 bp, Mus musculus
caccaaaaagcacaacccaagaggc

SEQ ID NO: 222153 - DNA, 25 bp, Mus musculus
caccaaaaaggaatcactgggccac

SEQ ID NO: 222154 - DNA, 25 bp, Mus musculus
caccaaaaagggaactacaagaatc

SEQ ID NO: 222155 - DNA, 25 bp, Mus musculus
caccaaaatgaaggaagctctgagt

SEQ ID NO: 222156 - DNA, 25 bp, Mus musculus
caccaaacagacaccaactttttgg

SEQ ID NO: 222157 - DNA, 25 bp, Mus musculus
caccaaacagagttattggaagcca

SEQ ID NO: 222158 - DNA, 25 bp, Mus musculus
caccaaacaggaaggtaccaggtga

SEQ ID NO: 222159 - DNA, 25 bp, Mus musculus
caccaaacaggaggaggcgaagagg

SEQ ID NO: 222160 - DNA, 25 bp, Mus musculus
caccaaacaggcaccatcacaggga

SEQ ID NO: 222161 - DNA, 25 bp, Mus musculus
caccaaaccaaaccctgtagctccc

SEQ ID NO: 222162 - DNA, 25 bp, Mus musculus
caccaaaccggattgagtttatctc

SEQ ID NO: 222163 - DNA, 25 bp, Mus musculus
caccaaaccgggtgaggcacagagt

SEQ ID NO: 222164 - DNA, 25 bp, Mus musculus
caccaaacggcatgtatcctcctcc

SEQ ID NO: 222165 - DNA, 25 bp, Mus musculus
caccaaacggcatgtgacctgacct

SEQ ID NO: 222166 - DNA, 25 bp, Mus musculus
caccaaactgcagctgcatggagca

SEQ ID NO: 222167 - DNA, 25 bp, Mus musculus
caccaaactgcaggaatgggcaaag

SEQ ID NO: 222168 - DNA, 25 bp, Mus musculus
caccaaagaccgtggggcagttaat

SEQ ID NO: 222169 - DNA, 25 bp, Mus musculus
caccaaagagagacctcctaagcca

SEQ ID NO: 222170 - DNA, 25 bp, Mus musculus
caccaaagcacagtgtcctcaacaa

SEQ ID NO: 222171 - DNA, 25 bp, Mus musculus
caccaaagctcccaaagcaaatcca

SEQ ID NO: 222172 - DNA, 25 bp, Mus musculus
caccaaagttaaaaacagcctcacc

SEQ ID NO: 222173 - DNA, 25 bp, Mus musculus
caccaaatagtacaggcagtgggaa

SEQ ID NO: 222174 - DNA, 25 bp, Mus musculus
caccaaatgttgggcgaagatctgc

SEQ ID NO: 222175 - DNA, 25 bp, Mus musculus
caccaaatgttgggcgtgtgcatgt

SEQ ID NO: 222176 - DNA, 25 bp, Mus musculus
caccaacaaaaaaagctccgactga

SEQ ID NO: 222177 - DNA, 25 bp, Mus musculus
caccaacaaaaaagacaggtgttca

SEQ ID NO: 222178 - DNA, 25 bp, Mus musculus
caccaacaaagggcgagaactttgg

SEQ ID NO: 222179 - DNA, 25 bp, Mus musculus
caccaacaaagttattcatggtgga

SEQ ID NO: 222180 - DNA, 25 bp, Mus musculus
caccaacaaggcctgtttcgattgt

SEQ ID NO: 222181 - DNA, 25 bp, Mus musculus
caccaacacacgtgggaaggtggcg

SEQ ID NO: 222182 - DNA, 25 bp, Mus musculus
caccaacacacgtggtggtacccgg

SEQ ID NO: 222183 - DNA, 25 bp, Mus musculus
caccaacacaggttccttcctccac

SEQ ID NO: 222184 - DNA, 25 bp, Mus musculus
caccaacacccaggcctgcagtggg

SEQ ID NO: 222185 - DNA, 25 bp, Mus musculus
caccaacatccagagcaagcaccag

SEQ ID NO: 222186 - DNA, 25 bp, Mus musculus
caccaacatccagctttccaagctg

SEQ ID NO: 222187 - DNA, 25 bp, Mus musculus
caccaaccaccaggggacctatgtg

SEQ ID NO: 222188 - DNA, 25 bp, Mus musculus
caccaaccaccagttcctggccttc

SEQ ID NO: 222189 - DNA, 25 bp, Mus musculus
caccaaccagattctcagccaccgg

SEQ ID NO: 222190 - DNA, 25 bp, Mus musculus
caccaacctatgaaaactctctact

SEQ ID NO: 222191 - DNA, 25 bp, Mus musculus
caccaacctgcagatggcagcagtg

SEQ ID NO: 222192 - DNA, 25 bp, Mus musculus
caccaacctgcagatggcagctcaa

SEQ ID NO: 222193 - DNA, 25 bp, Mus musculus
caccaaccttcacctgggcctaggc

SEQ ID NO: 222194 - DNA, 25 bp, Mus musculus
caccaacgccagaaggaagaggcaa

SEQ ID NO: 222195 - DNA, 25 bp, Mus musculus
caccaactcaagaggcccaggagac

SEQ ID NO: 222196 - DNA, 25 bp, Mus musculus
caccaactcagctctctgctctctg

SEQ ID NO: 222197 - DNA, 25 bp, Mus musculus
caccaactccacagaccctgctcac

SEQ ID NO: 222198 - DNA, 25 bp, Mus musculus
caccaactccacaggatctttggaa

SEQ ID NO: 222199 - DNA, 25 bp, Mus musculus
caccaactccgcggatgtggtggag

SEQ ID NO: 222200 - DNA, 25 bp, Mus musculus
caccaactccgcgggctcagggacc

SEQ ID NO: 222201 - DNA, 25 bp, Mus musculus
caccaactccgcgtctcttacatct

SEQ ID NO: 222202 - DNA, 25 bp, Mus musculus
caccaacttcaccatagaaaacggg

SEQ ID NO: 222203 - DNA, 25 bp, Mus musculus
caccaacttcaccatgcttatagga

SEQ ID NO: 222204 - DNA, 25 bp, Mus musculus
caccaacttctcagatttactgaaa

SEQ ID NO: 222205 - DNA, 25 bp, Mus musculus
caccaacttctcaggggcagattta

SEQ ID NO: 222206 - DNA, 25 bp, Mus musculus
caccaacttttccatgatcatcgat

SEQ ID NO: 222207 - DNA, 25 bp, Mus musculus
caccaagaaaaaaattgacatcctg

SEQ ID NO: 222208 - DNA, 25 bp, Mus musculus
caccaagaaatgattggtggcttcc

SEQ ID NO: 222209 - DNA, 25 bp, Mus musculus
caccaagaaccaggcgctcaactcc

SEQ ID NO: 222210 - DNA, 25 bp, Mus musculus
caccaagaagcagccctcaggcact

SEQ ID NO: 222211 - DNA, 25 bp, Mus musculus
caccaagaagcagttactgccgcct

SEQ ID NO: 222212 - DNA, 25 bp, Mus musculus
caccaagaagctgcagcaatacccg

SEQ ID NO: 222213 - DNA, 25 bp, Mus musculus
caccaagaataaagcgctaactgat

SEQ ID NO: 222214 - DNA, 25 bp, Mus musculus
caccaagacacacccgcagtggtat

SEQ ID NO: 222215 - DNA, 25 bp, Mus musculus
caccaagacacaggggaagtccctg

SEQ ID NO: 222216 - DNA, 25 bp, Mus musculus
caccaagaccccaggccagcgctca

SEQ ID NO: 222217 - DNA, 25 bp, Mus musculus
caccaagagagcaggtgtaaaagaa

SEQ ID NO: 222218 - DNA, 25 bp, Mus musculus
caccaagatatcgactgatatcttc

SEQ ID NO: 222219 - DNA, 25 bp, Mus musculus
caccaagatcccagtgattatagag

SEQ ID NO: 222220 - DNA, 25 bp, Mus musculus
caccaagatctcggtggatatgttc

SEQ ID NO: 222221 - DNA, 25 bp, Mus musculus
caccaagcaagaatgtgaaactccg

SEQ ID NO: 222222 - DNA, 25 bp, Mus musculus
caccaagcaagatcgacatcaggat

SEQ ID NO: 222223 - DNA, 25 bp, Mus musculus
caccaagcagaaacagcacctcttc

SEQ ID NO: 222224 - DNA, 25 bp, Mus musculus
caccaagcagccttctctccgtgga

SEQ ID NO: 222225 - DNA, 25 bp, Mus musculus
caccaagcaggagattacctggagc

SEQ ID NO: 222226 - DNA, 25 bp, Mus musculus
caccaagccacagcaatgtggggct

SEQ ID NO: 222227 - DNA, 25 bp, Mus musculus
caccaagccacaggatggtgacatt

SEQ ID NO: 222228 - DNA, 25 bp, Mus musculus
caccaagccaggatcctgtccccat

SEQ ID NO: 222229 - DNA, 25 bp, Mus musculus
caccaagccaggtggacttgtttgt

SEQ ID NO: 222230 - DNA, 25 bp, Mus musculus
caccaagcgggtcaaaaatgctgct

SEQ ID NO: 222231 - DNA, 25 bp, Mus musculus
caccaagctgctgtccagagtcagc

SEQ ID NO: 222232 - DNA, 25 bp, Mus musculus
caccaagctttccagcacctcctac

SEQ ID NO: 222233 - DNA, 25 bp, Mus musculus
caccaagctttccaggtctttgact

SEQ ID NO: 222234 - DNA, 25 bp, Mus musculus
caccaaggaccttctcttggtcttc

SEQ ID NO: 222235 - DNA, 25 bp, Mus musculus
caccaaggagcaggtcatgcttctc

SEQ ID NO: 222236 - DNA, 25 bp, Mus musculus
caccaaggaggagacagcctgtgca

SEQ ID NO: 222237 - DNA, 25 bp, Mus musculus
caccaaggagttcaggaggacccgc

SEQ ID NO: 222238 - DNA, 25 bp, Mus musculus
caccaaggccagcttttcctagatg

SEQ ID NO: 222239 - DNA, 25 bp, Mus musculus
caccaaggggcccagcaggtggaga

SEQ ID NO: 222240 - DNA, 25 bp, Mus musculus
caccaagtccagcaggaattgtctg

SEQ ID NO: 222241 - DNA, 25 bp, Mus musculus
caccaagtccatgaagccatgtatg

SEQ ID NO: 222242 - DNA, 25 bp, Mus musculus
caccaagtccatgagtttaagatcc

SEQ ID NO: 222243 - DNA, 25 bp, Mus musculus
caccaagtccatgattctgtaaccc

SEQ ID NO: 222244 - DNA, 25 bp, Mus musculus
caccaagtccatgcaacagggagct

SEQ ID NO: 222245 - DNA, 25 bp, Mus musculus
caccaagtcgcagggagagtctctt

SEQ ID NO: 222246 - DNA, 25 bp, Mus musculus
caccaagtgcaatgaaattgaatcc

SEQ ID NO: 222247 - DNA, 25 bp, Mus musculus
caccaagttctcatgtctgcccagg

SEQ ID NO: 222248 - DNA, 25 bp, Mus musculus
caccaataaaatggatcttcattgc

SEQ ID NO: 222249 - DNA, 25 bp, Mus musculus
caccaataaaattggtgttccccca

SEQ ID NO: 222250 - DNA, 25 bp, Mus musculus
caccaataaagcccacagaagctgt

SEQ ID NO: 222251 - DNA, 25 bp, Mus musculus
caccaataaaggcaaatcctcctcc

SEQ ID NO: 222252 - DNA, 25 bp, Mus musculus
caccaataagagaagctggctgtat

SEQ ID NO: 222253 - DNA, 25 bp, Mus musculus
caccaatcaaagcaagctcatgttg

SEQ ID NO: 222254 - DNA, 25 bp, Mus musculus
caccaatcaaggctggcttcaaact

SEQ ID NO: 222255 - DNA, 25 bp, Mus musculus
caccaatcaagtcaccggaagaaga

SEQ ID NO: 222256 - DNA, 25 bp, Mus musculus
caccaatcagcatagggatctgaga

SEQ ID NO: 222257 - DNA, 25 bp, Mus musculus
caccaatcttgatcgcagtaagaga

SEQ ID NO: 222258 - DNA, 25 bp, Mus musculus
caccaatgacccctatcctctcttt

SEQ ID NO: 222259 - DNA, 25 bp, Mus musculus
caccaatgtagccaacccttcactg

SEQ ID NO: 222260 - DNA, 25 bp, Mus musculus
caccaatgtcaggttgaaaactgta

SEQ ID NO: 222261 - DNA, 25 bp, Mus musculus
caccaatgtcagtgtgcgggatgac

SEQ ID NO: 222262 - DNA, 25 bp, Mus musculus
caccaatgtgagaggagagacggca

SEQ ID NO: 222263 - DNA, 25 bp, Mus musculus
caccaatgtgagatctggcgggagc

SEQ ID NO: 222264 - DNA, 25 bp, Mus musculus
caccaatgtgagcacacagcatgta

SEQ ID NO: 222265 - DNA, 25 bp, Mus musculus
caccaatgtgcttacatgcatgtgt

SEQ ID NO: 222266 - DNA, 25 bp, Mus musculus
caccaatgtgcttacgagtctactg

SEQ ID NO: 222267 - DNA, 25 bp, Mus musculus
caccaattacataagcccatggatg

SEQ ID NO: 222268 - DNA, 25 bp, Mus musculus
caccaattttaatgaatgcagctgc

SEQ ID NO: 222269 - DNA, 25 bp, Mus musculus
caccacaaccagctaaagaacgctt

SEQ ID NO: 222270 - DNA, 25 bp, Mus musculus
caccacaaggggaggcaaaattcca

SEQ ID NO: 222271 - DNA, 25 bp, Mus musculus
caccacacactgttcagacggctcc

SEQ ID NO: 222272 - DNA, 25 bp, Mus musculus
caccacacagacagaggagctgaac

SEQ ID NO: 222273 - DNA, 25 bp, Mus musculus
caccacacagacagaggagttgaac

SEQ ID NO: 222274 - DNA, 25 bp, Mus musculus
caccacacaggacgggccaaaagat

SEQ ID NO: 222275 - DNA, 25 bp, Mus musculus
caccacacaggacggtgtctttatt

SEQ ID NO: 222276 - DNA, 25 bp, Mus musculus
caccacacaggccagacccatgggc

SEQ ID NO: 222277 - DNA, 25 bp, Mus musculus
caccacacaggtatcagtgagcaaa

SEQ ID NO: 222278 - DNA, 25 bp, Mus musculus
caccacacagtcttaggcaacccct

SEQ ID NO: 222279 - DNA, 25 bp, Mus musculus
caccacacccgagcagtatataaag

SEQ ID NO: 222280 - DNA, 25 bp, Mus musculus
caccacaccctacagaggaggaacc

SEQ ID NO: 222281 - DNA, 25 bp, Mus musculus
caccacaccctacaggcaagattga

SEQ ID NO: 222282 - DNA, 25 bp, Mus musculus
caccacacctcagcagggacctctt

SEQ ID NO: 222283 - DNA, 25 bp, Mus musculus
caccacacctgtctcctccttcaca

SEQ ID NO: 222284 - DNA, 25 bp, Mus musculus
caccacagacagatgccctttgaag

SEQ ID NO: 222285 - DNA, 25 bp, Mus musculus
caccacagaggcctcaggatgacta

SEQ ID NO: 222286 - DNA, 25 bp, Mus musculus
caccacagcaggcactacagactcg

SEQ ID NO: 222287 - DNA, 25 bp, Mus musculus
caccacagctgcagcaggagcaacc

SEQ ID NO: 222288 - DNA, 25 bp, Mus musculus
caccacagctgcaggtaaaaataaa

SEQ ID NO: 222289 - DNA, 25 bp, Mus musculus
caccacaggctcctgagcgcagcct

SEQ ID NO: 222290 - DNA, 25 bp, Mus musculus
caccacaggctcctggccaggagca

SEQ ID NO: 222291 - DNA, 25 bp, Mus musculus
caccacagtcacatttacagactcc

SEQ ID NO: 222292 - DNA, 25 bp, Mus musculus
caccacagtgactcatctgcccctc

SEQ ID NO: 222293 - DNA, 25 bp, Mus musculus
caccaccaaaggggagcgaggacag

SEQ ID NO: 222294 - DNA, 25 bp, Mus musculus
caccaccaagatcccatggtttcca

SEQ ID NO: 222295 - DNA, 25 bp, Mus musculus
caccaccaaggaaaagttgtatggc

SEQ ID NO: 222296 - DNA, 25 bp, Mus musculus
caccaccaagggaacttaatacaga

SEQ ID NO: 222297 - DNA, 25 bp, Mus musculus
caccaccaatcaaggctggcttcaa

SEQ ID NO: 222298 - DNA, 25 bp, Mus musculus
caccaccaatcaagtcaccggaaga

SEQ ID NO: 222299 - DNA, 25 bp, Mus musculus
caccaccaatgtgagaggagagacg

SEQ ID NO: 222300 - DNA, 25 bp, Mus musculus
caccaccacagcaggcactacagac

SEQ ID NO: 222301 - DNA, 25 bp, Mus musculus
caccaccacgggttggatcaggcct

SEQ ID NO: 222302 - DNA, 25 bp, Mus musculus
caccaccactagtgtgtcacatcaa

SEQ ID NO: 222303 - DNA, 25 bp, Mus musculus
caccaccagagccctgcaggccctg

SEQ ID NO: 222304 - DNA, 25 bp, Mus musculus
caccaccaggaagggtgttaggagt

SEQ ID NO: 222305 - DNA, 25 bp, Mus musculus
caccaccaggcaagggttgcccttc

SEQ ID NO: 222306 - DNA, 25 bp, Mus musculus
caccaccatcatttttgatgacttc

SEQ ID NO: 222307 - DNA, 25 bp, Mus musculus
caccaccatcggctatggtcatgcg

SEQ ID NO: 222308 - DNA, 25 bp, Mus musculus
caccacccagaaggaatacacagac

SEQ ID NO: 222309 - DNA, 25 bp, Mus musculus
caccacccagactatgaaatccctg

SEQ ID NO: 222310 - DNA, 25 bp, Mus musculus
caccacccaggcctcccaagaccaa

SEQ ID NO: 222311 - DNA, 25 bp, Mus musculus
caccaccccaggcccagagtctact

SEQ ID NO: 222312 - DNA, 25 bp, Mus musculus
caccacccccacccgagttctatcc

SEQ ID NO: 222313 - DNA, 25 bp, Mus musculus
caccacccccggaaggtatcatccg

SEQ ID NO: 222314 - DNA, 25 bp, Mus musculus
caccaccccttgggggctcgctccc

SEQ ID NO: 222315 - DNA, 25 bp, Mus musculus
caccaccctgaggcaaagaaatgtc

SEQ ID NO: 222316 - DNA, 25 bp, Mus musculus
caccaccctgagtccagacagaagc

SEQ ID NO: 222317 - DNA, 25 bp, Mus musculus
caccaccgccactggcataaatgca

SEQ ID NO: 222318 - DNA, 25 bp, Mus musculus
caccaccgctgacgatgcagatctt

SEQ ID NO: 222319 - DNA, 25 bp, Mus musculus
caccaccgctggatgcagatctttg

SEQ ID NO: 222320 - DNA, 25 bp, Mus musculus
caccaccgggtcaaacagaggacag

SEQ ID NO: 222321 - DNA, 25 bp, Mus musculus
caccacctcggcctctccatccgtt

SEQ ID NO: 222322 - DNA, 25 bp, Mus musculus
caccacctggatcgagaactcgcca

SEQ ID NO: 222323 - DNA, 25 bp, Mus musculus
caccacctgtagcaccactctcgct

SEQ ID NO: 222324 - DNA, 25 bp, Mus musculus
caccacctgttccagaagttggcat

SEQ ID NO: 222325 - DNA, 25 bp, Mus musculus
caccacctgttgtgcagagttgtct

SEQ ID NO: 222326 - DNA, 25 bp, Mus musculus
caccacgaaaatctccttcgggctg

SEQ ID NO: 222327 - DNA, 25 bp, Mus musculus
caccacgacgaaggaccccttctcc

SEQ ID NO: 222328 - DNA, 25 bp, Mus musculus
caccacgactggtggaaaaattcca

SEQ ID NO: 222329 - DNA, 25 bp, Mus musculus
caccacgagcagataagaggagtcc

SEQ ID NO: 222330 - DNA, 25 bp, Mus musculus
caccacgagcagttgttccaagttg

SEQ ID NO: 222331 - DNA, 25 bp, Mus musculus
caccacgaggccagatacctgactg

SEQ ID NO: 222332 - DNA, 25 bp, Mus musculus
caccacgcagaatggtggcatctac

SEQ ID NO: 222333 - DNA, 25 bp, Mus musculus
caccacgcagcccccacatcgacat

SEQ ID NO: 222334 - DNA, 25 bp, Mus musculus
caccacggatacttgtaagcggtaa

SEQ ID NO: 222335 - DNA, 25 bp, Mus musculus
caccacgtagagagttccctcagta

SEQ ID NO: 222336 - DNA, 25 bp, Mus musculus
caccactaacgactctgacaccacc

SEQ ID NO: 222337 - DNA, 25 bp, Mus musculus
caccactaacgggactcagaagaag

SEQ ID NO: 222338 - DNA, 25 bp, Mus musculus
caccactacatggaaaaaagataaa

SEQ ID NO: 222339 - DNA, 25 bp, Mus musculus
caccactagtgtgtcacatcaagtt

SEQ ID NO: 222340 - DNA, 25 bp, Mus musculus
caccactcaggagcccttgcccaga

SEQ ID NO: 222341 - DNA, 25 bp, Mus musculus
caccactcaggtgttttctctggct

SEQ ID NO: 222342 - DNA, 25 bp, Mus musculus
caccactccctaggtgttgggagcc

SEQ ID NO: 222343 - DNA, 25 bp, Mus musculus
caccactcctctggatcccagagtg

SEQ ID NO: 222344 - DNA, 25 bp, Mus musculus
caccactcgcagaggaccgccttca

SEQ ID NO: 222345 - DNA, 25 bp, Mus musculus
caccactctcgggaagttattggag

SEQ ID NO: 222346 - DNA, 25 bp, Mus musculus
caccactgcagcagatccacagatg

SEQ ID NO: 222347 - DNA, 25 bp, Mus musculus
caccactgcagtgtttgtaagcggt

SEQ ID NO: 222348 - DNA, 25 bp, Mus musculus
caccactgctgcgcaaggtatacct

SEQ ID NO: 222349 - DNA, 25 bp, Mus musculus
caccactgctgtgagtgcccgctat

SEQ ID NO: 222350 - DNA, 25 bp, Mus musculus
caccactggcaagatgtgctagttg

SEQ ID NO: 222351 - DNA, 25 bp, Mus musculus
caccactggcaaggctggtacaagg

SEQ ID NO: 222352 - DNA, 25 bp, Mus musculus
caccactggcacaggagacactgca

SEQ ID NO: 222353 - DNA, 25 bp, Mus musculus
caccactggctatgaggacgtagca

SEQ ID NO: 222354 - DNA, 25 bp, Mus musculus
caccactgtccgccgggagcagcaa

SEQ ID NO: 222355 - DNA, 25 bp, Mus musculus
caccactgtgtcaggtgtggcccat

SEQ ID NO: 222356 - DNA, 25 bp, Mus musculus
caccacttcgtggaggtcctggtgg

SEQ ID NO: 222357 - DNA, 25 bp, Mus musculus
caccacttttgatcttgattctgat

SEQ ID NO: 222358 - DNA, 25 bp, Mus musculus
caccagaaactatggtggccctgtt

SEQ ID NO: 222359 - DNA, 25 bp, Mus musculus
caccagaaccaggttatgtagtaac

SEQ ID NO: 222360 - DNA, 25 bp, Mus musculus
caccagaagagatcctggctaagaa

SEQ ID NO: 222361 - DNA, 25 bp, Mus musculus
caccagaagcagccaggcttctctt

SEQ ID NO: 222362 - DNA, 25 bp, Mus musculus
caccagaagcagccatggaccctct

SEQ ID NO: 222363 - DNA, 25 bp, Mus musculus
caccagaatcaagttccttacagat

SEQ ID NO: 222364 - DNA, 25 bp, Mus musculus
caccagaatggcatccaggtgatcc

SEQ ID NO: 222365 - DNA, 25 bp, Mus musculus
caccagaattgttgtttattcatgg

SEQ ID NO: 222366 - DNA, 25 bp, Mus musculus
caccagacaagatgatagtagctga

SEQ ID NO: 222367 - DNA, 25 bp, Mus musculus
caccagacagaacttctgtgggaag

SEQ ID NO: 222368 - DNA, 25 bp, Mus musculus
caccagacagggcacgttctcagca

SEQ ID NO: 222369 - DNA, 25 bp, Mus musculus
caccagacttcccagagaatgttgc

SEQ ID NO: 222370 - DNA, 25 bp, Mus musculus
caccagagaatagccatgatgctgg

SEQ ID NO: 222371 - DNA, 25 bp, Mus musculus
caccagagaatgtgcccacagacca

SEQ ID NO: 222372 - DNA, 25 bp, Mus musculus
caccagagacaaggtccactgggca

SEQ ID NO: 222373 - DNA, 25 bp, Mus musculus
caccagagaccttaaccgaaggtgt

SEQ ID NO: 222374 - DNA, 25 bp, Mus musculus
caccagagagctatcattgaggcgg

SEQ ID NO: 222375 - DNA, 25 bp, Mus musculus
caccagagagctgtcattgaggcgg

SEQ ID NO: 222376 - DNA, 25 bp, Mus musculus
caccagagcaagaaaattgtgcaag

SEQ ID NO: 222377 - DNA, 25 bp, Mus musculus
caccagagcaagatatggcgtgatc

SEQ ID NO: 222378 - DNA, 25 bp, Mus musculus
caccagagcaaggtatggcgtgatc

SEQ ID NO: 222379 - DNA, 25 bp, Mus musculus
caccagagcagcgtcatctccgaac

SEQ ID NO: 222380 - DNA, 25 bp, Mus musculus
caccagagccctgcaggccctggta

SEQ ID NO: 222381 - DNA, 25 bp, Mus musculus
caccagagcgatgtgtggtcttttg

SEQ ID NO: 222382 - DNA, 25 bp, Mus musculus
caccagatcagaatttcagcatatg

SEQ ID NO: 222383 - DNA, 25 bp, Mus musculus
caccagatgcagcatccctggagct

SEQ ID NO: 222384 - DNA, 25 bp, Mus musculus
caccagatgcaggagagaagatggg

SEQ ID NO: 222385 - DNA, 25 bp, Mus musculus
caccagatgcagtgttgtggtcctc

SEQ ID NO: 222386 - DNA, 25 bp, Mus musculus
caccagatgtgtcggtgtcccgatg

SEQ ID NO: 222387 - DNA, 25 bp, Mus musculus
caccagatgtgtcgtaacatatcgc

SEQ ID NO: 222388 - DNA, 25 bp, Mus musculus
caccagatgttcagccagtatccgc

SEQ ID NO: 222389 - DNA, 25 bp, Mus musculus
caccagcaacaacaggtgactgtgg

SEQ ID NO: 222390 - DNA, 25 bp, Mus musculus
caccagcaagctgagttcctacccc

SEQ ID NO: 222391 - DNA, 25 bp, Mus musculus
caccagcagacggtgcaaccaggta

SEQ ID NO: 222392 - DNA, 25 bp, Mus musculus
caccagcagacggtggaaattgaca

SEQ ID NO: 222393 - DNA, 25 bp, Mus musculus
caccagcagatcaagaattttctga

SEQ ID NO: 222394 - DNA, 25 bp, Mus musculus
caccagcagctgaacagaaaatgta

SEQ ID NO: 222395 - DNA, 25 bp, Mus musculus
caccagcagctgaagtccgcacaga

SEQ ID NO: 222396 - DNA, 25 bp, Mus musculus
caccagcagctgaatggttaccaca

SEQ ID NO: 222397 - DNA, 25 bp, Mus musculus
caccagcaggccgaggaaagcagaa

SEQ ID NO: 222398 - DNA, 25 bp, Mus musculus
caccagcatttggtataggagggat

SEQ ID NO: 222399 - DNA, 25 bp, Mus musculus
caccagccaacagaacctgagccag

SEQ ID NO: 222400 - DNA, 25 bp, Mus musculus
caccagccaacagtgcaacatagat

SEQ ID NO: 222401 - DNA, 25 bp, Mus musculus
caccagccaacccagatcaggcgtc

SEQ ID NO: 222402 - DNA, 25 bp, Mus musculus
caccagccagccagagaaagaagtg

SEQ ID NO: 222403 - DNA, 25 bp, Mus musculus
caccagccagccagctttcagctgg

SEQ ID NO: 222404 - DNA, 25 bp, Mus musculus
caccagcccagagagaggtcttttg

SEQ ID NO: 222405 - DNA, 25 bp, Mus musculus
caccagcccataaaaacgtcaacgt

SEQ ID NO: 222406 - DNA, 25 bp, Mus musculus
caccagcccgaggacaagaaaagaa

SEQ ID NO: 222407 - DNA, 25 bp, Mus musculus
caccagcccgtaagtttggtgagcg

SEQ ID NO: 222408 - DNA, 25 bp, Mus musculus
caccagccctttgcttatgggacac

SEQ ID NO: 222409 - DNA, 25 bp, Mus musculus
caccagccttaactaactccacgga

SEQ ID NO: 222410 - DNA, 25 bp, Mus musculus
caccagccttaactggctccatagg

SEQ ID NO: 222411 - DNA, 25 bp, Mus musculus
caccagcgaaggatgggacaaggcc

SEQ ID NO: 222412 - DNA, 25 bp, Mus musculus
caccagcgaaggatggtggaagaaa

SEQ ID NO: 222413 - DNA, 25 bp, Mus musculus
caccagcgcagggaatggatacggc

SEQ ID NO: 222414 - DNA, 25 bp, Mus musculus
caccagcgccaccccctgctcctgc

SEQ ID NO: 222415 - DNA, 25 bp, Mus musculus
caccagcgcgaaggtgatgctagaa

SEQ ID NO: 222416 - DNA, 25 bp, Mus musculus
caccagcgctaagaggatccagaag

SEQ ID NO: 222417 - DNA, 25 bp, Mus musculus
caccagcggccacagccccactcca

SEQ ID NO: 222418 - DNA, 25 bp, Mus musculus
caccagcgtacagattgcatctggg

SEQ ID NO: 222419 - DNA, 25 bp, Mus musculus
caccagcgtcaagcaggtgtcttct

SEQ ID NO: 222420 - DNA, 25 bp, Mus musculus
caccagctacaaagtgtctttgcca

SEQ ID NO: 222421 - DNA, 25 bp, Mus musculus
caccagctatagacccatgcttgta

SEQ ID NO: 222422 - DNA, 25 bp, Mus musculus
caccagctcagttaatggaacccct

SEQ ID NO: 222423 - DNA, 25 bp, Mus musculus
caccagctccaacatagtttgtgat

SEQ ID NO: 222424 - DNA, 25 bp, Mus musculus
caccagctccaatttttcaagacaa

SEQ ID NO: 222425 - DNA, 25 bp, Mus musculus
caccagctgacagaaccagcagata

SEQ ID NO: 222426 - DNA, 25 bp, Mus musculus
caccagctgatcctgataccgctat

SEQ ID NO: 222427 - DNA, 25 bp, Mus musculus
caccagctgcaaggtgtgaggttaa

SEQ ID NO: 222428 - DNA, 25 bp, Mus musculus
caccagcttcagtaaagagggctgg

SEQ ID NO: 222429 - DNA, 25 bp, Mus musculus
caccagcttcagtgaatggaactcc

SEQ ID NO: 222430 - DNA, 25 bp, Mus musculus
caccagcttcccagccggaacccag

SEQ ID NO: 222431 - DNA, 25 bp, Mus musculus
caccagctttttgctgccccttacc

SEQ ID NO: 222432 - DNA, 25 bp, Mus musculus
caccaggaaagattaattgcctgag

SEQ ID NO: 222433 - DNA, 25 bp, Mus musculus
caccaggaaagttcaaatagcccgt

SEQ ID NO: 222434 - DNA, 25 bp, Mus musculus
caccaggaaagttctcaatctcaca

SEQ ID NO: 222435 - DNA, 25 bp, Mus musculus
caccaggaacacctgctgacctctg

SEQ ID NO: 222436 - DNA, 25 bp, Mus musculus
caccaggaacacctttatctgaatt

SEQ ID NO: 222437 - DNA, 25 bp, Mus musculus
caccaggaacagagagaacattata

SEQ ID NO: 222438 - DNA, 25 bp, Mus musculus
caccaggaagcacctgccattgtgg

SEQ ID NO: 222439 - DNA, 25 bp, Mus musculus
caccaggaagggtgttaggagtgga

SEQ ID NO: 222440 - DNA, 25 bp, Mus musculus
caccaggaagtacccagcgagccag

SEQ ID NO: 222441 - DNA, 25 bp, Mus musculus
caccaggactcaaatattctccttc

SEQ ID NO: 222442 - DNA, 25 bp, Mus musculus
caccaggacttgcttgtgacgaatg

SEQ ID NO: 222443 - DNA, 25 bp, Mus musculus
caccaggacttggactattttgaaa

SEQ ID NO: 222444 - DNA, 25 bp, Mus musculus
caccaggacttggagagctgtcacc

SEQ ID NO: 222445 - DNA, 25 bp, Mus musculus
caccaggatatgagtgttttatggc

SEQ ID NO: 222446 - DNA, 25 bp, Mus musculus
caccaggatcccctcctgtgcccct

SEQ ID NO: 222447 - DNA, 25 bp, Mus musculus
caccaggatcccctggcctcgctgg

SEQ ID NO: 222448 - DNA, 25 bp, Mus musculus
caccaggatggctgatatagacaga

SEQ ID NO: 222449 - DNA, 25 bp, Mus musculus
caccaggcaagggttgcccttcacc

SEQ ID NO: 222450 - DNA, 25 bp, Mus musculus
caccaggcaaggtactggtgaggtt

SEQ ID NO: 222451 - DNA, 25 bp, Mus musculus
caccaggcaccaggtcctgtttatt

SEQ ID NO: 222452 - DNA, 25 bp, Mus musculus
caccaggcaccagtacagaaagcaa

SEQ ID NO: 222453 - DNA, 25 bp, Mus musculus
caccaggcacccatggctcaaacta

SEQ ID NO: 222454 - DNA, 25 bp, Mus musculus
caccaggcagaaggcgacagactta

SEQ ID NO: 222455 - DNA, 25 bp, Mus musculus
caccaggcagagagatcgccttaca

SEQ ID NO: 222456 - DNA, 25 bp, Mus musculus
caccaggcagcatctgaggacctgc

SEQ ID NO: 222457 - DNA, 25 bp, Mus musculus
caccaggcaggcagtacaggccagt

SEQ ID NO: 222458 - DNA, 25 bp, Mus musculus
caccaggcaggtaagcttcaagctg

SEQ ID NO: 222459 - DNA, 25 bp, Mus musculus
caccaggcagtgagatgtccctaga

SEQ ID NO: 222460 - DNA, 25 bp, Mus musculus
caccaggcagttgcccatggaggcc

SEQ ID NO: 222461 - DNA, 25 bp, Mus musculus
caccaggcatgcagtaaaggccaaa

SEQ ID NO: 222462 - DNA, 25 bp, Mus musculus
caccaggccaaagattatttgtata

SEQ ID NO: 222463 - DNA, 25 bp, Mus musculus
caccaggcctggaagcaccagccta

SEQ ID NO: 222464 - DNA, 25 bp, Mus musculus
caccaggcctggggtccccttcctc

SEQ ID NO: 222465 - DNA, 25 bp, Mus musculus
caccaggctcccgagggatcatgcc

SEQ ID NO: 222466 - DNA, 25 bp, Mus musculus
caccaggctgagtgtttatcatggc

SEQ ID NO: 222467 - DNA, 25 bp, Mus musculus
caccaggctgcaggcctgtgggccg

SEQ ID NO: 222468 - DNA, 25 bp, Mus musculus
caccagggaagccagggtctttgtg

SEQ ID NO: 222469 - DNA, 25 bp, Mus musculus
caccagggcaagaagcatcctcctc

SEQ ID NO: 222470 - DNA, 25 bp, Mus musculus
caccagggcaagaaggtgggaatcc

SEQ ID NO: 222471 - DNA, 25 bp, Mus musculus
caccagggtagtgggagccctcgta

SEQ ID NO: 222472 - DNA, 25 bp, Mus musculus
caccaggtcctgcgggttctccagg

SEQ ID NO: 222473 - DNA, 25 bp, Mus musculus
caccaggtgccacacggccatggct

SEQ ID NO: 222474 - DNA, 25 bp, Mus musculus
caccaggtggagagcatatccgagg

SEQ ID NO: 222475 - DNA, 25 bp, Mus musculus
caccaggtggagataagtcattgtg

SEQ ID NO: 222476 - DNA, 25 bp, Mus musculus
caccaggtgtttcagggctaccagt

SEQ ID NO: 222477 - DNA, 25 bp, Mus musculus
caccaggtttgagaatttgacttcg

SEQ ID NO: 222478 - DNA, 25 bp, Mus musculus
caccagtacttggggccttttgctc

SEQ ID NO: 222479 - DNA, 25 bp, Mus musculus
caccagtacttgggtctgacaagat

SEQ ID NO: 222480 - DNA, 25 bp, Mus musculus
caccagtagcagtgtcagtgtgcac

SEQ ID NO: 222481 - DNA, 25 bp, Mus musculus
caccagtatgggagtcaagctgtgc

SEQ ID NO: 222482 - DNA, 25 bp, Mus musculus
caccagtcacagtttgtggggacat

SEQ ID NO: 222483 - DNA, 25 bp, Mus musculus
caccagtcctaacacttccagaaac

SEQ ID NO: 222484 - DNA, 25 bp, Mus musculus
caccagtcgcggacagtggcaaccc

SEQ ID NO: 222485 - DNA, 25 bp, Mus musculus
caccagtctcacagccgagggttga

SEQ ID NO: 222486 - DNA, 25 bp, Mus musculus
caccagtgaggagattcccccccta

SEQ ID NO: 222487 - DNA, 25 bp, Mus musculus
caccagtgataaactcgatgacctc

SEQ ID NO: 222488 - DNA, 25 bp, Mus musculus
caccagtgcacggtgatatttttga

SEQ ID NO: 222489 - DNA, 25 bp, Mus musculus
caccagtgccgcacagtctggaata

SEQ ID NO: 222490 - DNA, 25 bp, Mus musculus
caccagtggaaggcaaaggctgcga

SEQ ID NO: 222491 - DNA, 25 bp, Mus musculus
caccagtggtatgaggttgaacgga

SEQ ID NO: 222492 - DNA, 25 bp, Mus musculus
caccagtggtatgagtggttcagaa

SEQ ID NO: 222493 - DNA, 25 bp, Mus musculus
caccagtgtttatggcttgaagatg

SEQ ID NO: 222494 - DNA, 25 bp, Mus musculus
caccagttccgttggcgtctccaag

SEQ ID NO: 222495 - DNA, 25 bp, Mus musculus
caccagttccgttgggatccgcgcg

SEQ ID NO: 222496 - DNA, 25 bp, Mus musculus
caccagttcgagggggctgaagaat

SEQ ID NO: 222497 - DNA, 25 bp, Mus musculus
caccagtttgacaggacacagagct

SEQ ID NO: 222498 - DNA, 25 bp, Mus musculus
caccagtttgggctcaagagtgtca

SEQ ID NO: 222499 - DNA, 25 bp, Mus musculus
caccataaaaaaaccgacaagctgg

SEQ ID NO: 222500 - DNA, 25 bp, Mus musculus
caccatacagaaatatgatcctcca

SEQ ID NO: 222501 - DNA, 25 bp, Mus musculus
caccatacaggatactgggaacctc

SEQ ID NO: 222502 - DNA, 25 bp, Mus musculus
caccatacttcagactagcttcctt

SEQ ID NO: 222503 - DNA, 25 bp, Mus musculus
caccatacttcaggtcttcagcaat

SEQ ID NO: 222504 - DNA, 25 bp, Mus musculus
caccatagcagaccggatcctcttc

SEQ ID NO: 222505 - DNA, 25 bp, Mus musculus
caccatagccatgctttctggcata

SEQ ID NO: 222506 - DNA, 25 bp, Mus musculus
caccatatcagccattgaagccatg

SEQ ID NO: 222507 - DNA, 25 bp, Mus musculus
caccatattcttttgaatatgtaga

SEQ ID NO: 222508 - DNA, 25 bp, Mus musculus
caccatatttgaaaatgctgtggat

SEQ ID NO: 222509 - DNA, 25 bp, Mus musculus
caccatatttgaatcatttccaccc

SEQ ID NO: 222510 - DNA, 25 bp, Mus musculus
caccatatttgacgcggaaaaggat

SEQ ID NO: 222511 - DNA, 25 bp, Mus musculus
caccatcaacacaccctttggggcg

SEQ ID NO: 222512 - DNA, 25 bp, Mus musculus
caccatcaagaaccatgagtttatt

SEQ ID NO: 222513 - DNA, 25 bp, Mus musculus
caccatcaagagcaccccatctgga

SEQ ID NO: 222514 - DNA, 25 bp, Mus musculus
caccatcaagcacccaggaggtact

SEQ ID NO: 222515 - DNA, 25 bp, Mus musculus
caccatcaatggtgcagtgcagttg

SEQ ID NO: 222516 - DNA, 25 bp, Mus musculus
caccatcaatgttgcctaatgggaa

SEQ ID NO: 222517 - DNA, 25 bp, Mus musculus
caccatcacacagcctcggcccaca

SEQ ID NO: 222518 - DNA, 25 bp, Mus musculus
caccatcacaccaccagtcccgctc

SEQ ID NO: 222519 - DNA, 25 bp, Mus musculus
caccatcacagaatacactgtaagt

SEQ ID NO: 222520 - DNA, 25 bp, Mus musculus
caccatcacagtgttccttcctgcc

SEQ ID NO: 222521 - DNA, 25 bp, Mus musculus
caccatcaccaaaaatgggtacaag

SEQ ID NO: 222522 - DNA, 25 bp, Mus musculus
caccatcaccaagctcctccagaca

SEQ ID NO: 222523 - DNA, 25 bp, Mus musculus
caccatcaccaagtcggatgctctg

SEQ ID NO: 222524 - DNA, 25 bp, Mus musculus
caccatcagggtatatccgaatagt

SEQ ID NO: 222525 - DNA, 25 bp, Mus musculus
caccatcagtgatgatttcctatta

SEQ ID NO: 222526 - DNA, 25 bp, Mus musculus
caccatcagtgatgctctccttaca

SEQ ID NO: 222527 - DNA, 25 bp, Mus musculus
caccatcatcagagagcttcatgga

SEQ ID NO: 222528 - DNA, 25 bp, Mus musculus
caccatcatcaggcaaacaggcatg

SEQ ID NO: 222529 - DNA, 25 bp, Mus musculus
caccatcatcagtgtcccttgggaa

SEQ ID NO: 222530 - DNA, 25 bp, Mus musculus
caccatcatccgggccatccgaacc

SEQ ID NO: 222531 - DNA, 25 bp, Mus musculus
caccatccaaccgaggagagtcaac

SEQ ID NO: 222532 - DNA, 25 bp, Mus musculus
caccatccagagagatgccaaaggc

SEQ ID NO: 222533 - DNA, 25 bp, Mus musculus
caccatccagcacgtgcaggctctg

SEQ ID NO: 222534 - DNA, 25 bp, Mus musculus
caccatccatagtgaccatgagggt

SEQ ID NO: 222535 - DNA, 25 bp, Mus musculus
caccatccccaaagatggacaaaag

SEQ ID NO: 222536 - DNA, 25 bp, Mus musculus
caccatccccttaaaggatcctctg

SEQ ID NO: 222537 - DNA, 25 bp, Mus musculus
caccatcctctggagacaggttttc

SEQ ID NO: 222538 - DNA, 25 bp, Mus musculus
caccatcctctggagggtctggaat

SEQ ID NO: 222539 - DNA, 25 bp, Mus musculus
caccatcctggtatccgtggtcacc

SEQ ID NO: 222540 - DNA, 25 bp, Mus musculus
caccatcgggaaacgtctctggagc

SEQ ID NO: 222541 - DNA, 25 bp, Mus musculus
caccatcgtaggttctgtacctcac

SEQ ID NO: 222542 - DNA, 25 bp, Mus musculus
caccatcgtgtctagaccttaaact

SEQ ID NO: 222543 - DNA, 25 bp, Mus musculus
caccatcgtgtctagagccttgcac

SEQ ID NO: 222544 - DNA, 25 bp, Mus musculus
caccatctagtgaatagtggaggag

SEQ ID NO: 222545 - DNA, 25 bp, Mus musculus
caccatctgaaggacaaggagctcc

SEQ ID NO: 222546 - DNA, 25 bp, Mus musculus
caccatctggtgagtgaacccccac

SEQ ID NO: 222547 - DNA, 25 bp, Mus musculus
caccatcttcaccatggaaaagaac

SEQ ID NO: 222548 - DNA, 25 bp, Mus musculus
caccatctttgcacccaggattcaa

SEQ ID NO: 222549 - DNA, 25 bp, Mus musculus
caccatctttgcatgaaagcccctt

SEQ ID NO: 222550 - DNA, 25 bp, Mus musculus
caccatctttggattcaattttttg

SEQ ID NO: 222551 - DNA, 25 bp, Mus musculus
caccatgaaggaagccaaggacatg

SEQ ID NO: 222552 - DNA, 25 bp, Mus musculus
caccatgagagacttccagacagaa

SEQ ID NO: 222553 - DNA, 25 bp, Mus musculus
caccatgagagggtgtggaccgtgt

SEQ ID NO: 222554 - DNA, 25 bp, Mus musculus
caccatgagttcaaagaaaatccct

SEQ ID NO: 222555 - DNA, 25 bp, Mus musculus
caccatgatattggaccatgtgttt

SEQ ID NO: 222556 - DNA, 25 bp, Mus musculus
caccatgatgcatatcttcctcctg

SEQ ID NO: 222557 - DNA, 25 bp, Mus musculus
caccatgatgggaagaaaggaaaga

SEQ ID NO: 222558 - DNA, 25 bp, Mus musculus
caccatgcaggctgtcttctcgtct

SEQ ID NO: 222559 - DNA, 25 bp, Mus musculus
caccatgcataggaagcaccttcag

SEQ ID NO: 222560 - DNA, 25 bp, Mus musculus
caccatgccagtcttcccaccagat

SEQ ID NO: 222561 - DNA, 25 bp, Mus musculus
caccatgcccctggctagagatctg

SEQ ID NO: 222562 - DNA, 25 bp, Mus musculus
caccatgccgatcaataagtcggag

SEQ ID NO: 222563 - DNA, 25 bp, Mus musculus
caccatgccggcccgcaggcccaag

SEQ ID NO: 222564 - DNA, 25 bp, Mus musculus
caccatgccgggtggataccttggc

SEQ ID NO: 222565 - DNA, 25 bp, Mus musculus
caccatgctgaaaagagcaaggaac

SEQ ID NO: 222566 - DNA, 25 bp, Mus musculus
caccatgcttctgtggacgcagacg

SEQ ID NO: 222567 - DNA, 25 bp, Mus musculus
caccatggaaaccagaagcgaatgg

SEQ ID NO: 222568 - DNA, 25 bp, Mus musculus
caccatggaaaccagtattgcagca

SEQ ID NO: 222569 - DNA, 25 bp, Mus musculus
caccatggacttggcatctgggtgt

SEQ ID NO: 222570 - DNA, 25 bp, Mus musculus
caccatggacttgggaacacaccag

SEQ ID NO: 222571 - DNA, 25 bp, Mus musculus
caccatggagaacaagcattgatga

SEQ ID NO: 222572 - DNA, 25 bp, Mus musculus
caccatggagcgatggttgtcggtg

SEQ ID NO: 222573 - DNA, 25 bp, Mus musculus
caccatggagcgatgtacctgacct

SEQ ID NO: 222574 - DNA, 25 bp, Mus musculus
caccatggagcgatgtggacagaag

SEQ ID NO: 222575 - DNA, 25 bp, Mus musculus
caccatggcagaacctgcaactgca

SEQ ID NO: 222576 - DNA, 25 bp, Mus musculus
caccatggctctggggttggttctg

SEQ ID NO: 222577 - DNA, 25 bp, Mus musculus
caccatggctgatcatcactccgtt

SEQ ID NO: 222578 - DNA, 25 bp, Mus musculus
caccatgggaaggatcatgcgtcca

SEQ ID NO: 222579 - DNA, 25 bp, Mus musculus
caccatggtgaagatttacccaata

SEQ ID NO: 222580 - DNA, 25 bp, Mus musculus
caccatggtgaagctaatctggaaa

SEQ ID NO: 222581 - DNA, 25 bp, Mus musculus
caccattaaaagggggaggagtgtc

SEQ ID NO: 222582 - DNA, 25 bp, Mus musculus
caccattaactttagcccagaaact

SEQ ID NO: 222583 - DNA, 25 bp, Mus musculus
caccattaactttaggtgctgcttt

SEQ ID NO: 222584 - DNA, 25 bp, Mus musculus
caccattaaggactctgcaggactg

SEQ ID NO: 222585 - DNA, 25 bp, Mus musculus
caccattaaggactgcaggctgtcg

SEQ ID NO: 222586 - DNA, 25 bp, Mus musculus
caccattaaggacttcctgaagacc

SEQ ID NO: 222587 - DNA, 25 bp, Mus musculus
caccattaatctgtacccgcttacc

SEQ ID NO: 222588 - DNA, 25 bp, Mus musculus
caccattaccaaggtcccttcagag

SEQ ID NO: 222589 - DNA, 25 bp, Mus musculus
caccattactctacggctggcccgc

SEQ ID NO: 222590 - DNA, 25 bp, Mus musculus
caccattagacaagccctgacgtca

SEQ ID NO: 222591 - DNA, 25 bp, Mus musculus
caccattcacacgggaagagtcacc

SEQ ID NO: 222592 - DNA, 25 bp, Mus musculus
caccattcacacgggatgaaattgt

SEQ ID NO: 222593 - DNA, 25 bp, Mus musculus
caccattcagctttctcccagatgg

SEQ ID NO: 222594 - DNA, 25 bp, Mus musculus
caccattccggagtgagaacaatct

SEQ ID NO: 222595 - DNA, 25 bp, Mus musculus
caccattcctccaggaacaacaggc

SEQ ID NO: 222596 - DNA, 25 bp, Mus musculus
caccattcctccaggtacatttgat

SEQ ID NO: 222597 - DNA, 25 bp, Mus musculus
caccattcctccaggtcttgccgtc

SEQ ID NO: 222598 - DNA, 25 bp, Mus musculus
caccattgaaatcccagcctgcagt

SEQ ID NO: 222599 - DNA, 25 bp, Mus musculus
caccattgaaggtcctcaactttga

SEQ ID NO: 222600 - DNA, 25 bp, Mus musculus
caccattgagtacatggccccagag

SEQ ID NO: 222601 - DNA, 25 bp, Mus musculus
caccattgcccgcaattgggcagat

SEQ ID NO: 222602 - DNA, 25 bp, Mus musculus
caccattgctggggtggagaccatc

SEQ ID NO: 222603 - DNA, 25 bp, Mus musculus
caccattgctggtcaacgtcctgca

SEQ ID NO: 222604 - DNA, 25 bp, Mus musculus
caccattggaggaataaacattgct

SEQ ID NO: 222605 - DNA, 25 bp, Mus musculus
caccattggcaagggcacagtcagt

SEQ ID NO: 222606 - DNA, 25 bp, Mus musculus
caccattggctggattgctgctgga

SEQ ID NO: 222607 - DNA, 25 bp, Mus musculus
caccattggggctgtgcatttgggt

SEQ ID NO: 222608 - DNA, 25 bp, Mus musculus
caccattgggttcacaggctgtgca

SEQ ID NO: 222609 - DNA, 25 bp, Mus musculus
caccattggtctgcaggcaccgctc

SEQ ID NO: 222610 - DNA, 25 bp, Mus musculus
caccatttaagttgctttctgattc

SEQ ID NO: 222611 - DNA, 25 bp, Mus musculus
caccatttcagacctcaagtggaac

SEQ ID NO: 222612 - DNA, 25 bp, Mus musculus
caccatttcagagtcagcttgcgaa

SEQ ID NO: 222613 - DNA, 25 bp, Mus musculus
caccatttcagtcaggaagtcctac

SEQ ID NO: 222614 - DNA, 25 bp, Mus musculus
caccatttgcagaggcaggcaggtt

SEQ ID NO: 222615 - DNA, 25 bp, Mus musculus
caccatttggcttcattaaaaaaac

SEQ ID NO: 222616 - DNA, 25 bp, Mus musculus
caccatttgtggggcggatgtctgc

SEQ ID NO: 222617 - DNA, 25 bp, Mus musculus
caccatttgtggggtctcaaagcaa

SEQ ID NO: 222618 - DNA, 25 bp, Mus musculus
cacccaaaagagaaaaggaagcagt

SEQ ID NO: 222619 - DNA, 25 bp, Mus musculus
cacccaaaagatttttgaatgtcat

SEQ ID NO: 222620 - DNA, 25 bp, Mus musculus
cacccaaaagcaaggatgaagtggc

SEQ ID NO: 222621 - DNA, 25 bp, Mus musculus
cacccaaaaggtcactccattctca

SEQ ID NO: 222622 - DNA, 25 bp, Mus musculus
cacccaaacatagtgaagttgttcg

SEQ ID NO: 222623 - DNA, 25 bp, Mus musculus
cacccaaacattatagccagtgatg

SEQ ID NO: 222624 - DNA, 25 bp, Mus musculus
cacccaaatagcgctggcgtggatg

SEQ ID NO: 222625 - DNA, 25 bp, Mus musculus
cacccaaatgcctggggaggataaa

SEQ ID NO: 222626 - DNA, 25 bp, Mus musculus
cacccaaatgttgataaaaatggtg

SEQ ID NO: 222627 - DNA, 25 bp, Mus musculus
cacccaaccaatggcttcgagctgt

SEQ ID NO: 222628 - DNA, 25 bp, Mus musculus
cacccaactatactgtcactgccct

SEQ ID NO: 222629 - DNA, 25 bp, Mus musculus
cacccaagaagtgagaacggagcac

SEQ ID NO: 222630 - DNA, 25 bp, Mus musculus
cacccaagaagtgaggccgggagca

SEQ ID NO: 222631 - DNA, 25 bp, Mus musculus
cacccaagagcagagagatcatctc

SEQ ID NO: 222632 - DNA, 25 bp, Mus musculus
cacccaaggaggccaaaaaagtgga

SEQ ID NO: 222633 - DNA, 25 bp, Mus musculus
cacccaaggagggtcaaaaggcaag

SEQ ID NO: 222634 - DNA, 25 bp, Mus musculus
cacccaagtgcgagatgttgcatgt

SEQ ID NO: 222635 - DNA, 25 bp, Mus musculus
cacccaagtgcgaggaaaaatccgc

SEQ ID NO: 222636 - DNA, 25 bp, Mus musculus
cacccaagttacgtaatcattgcaa

SEQ ID NO: 222637 - DNA, 25 bp, Mus musculus
cacccaataggcaactccgaagatg

SEQ ID NO: 222638 - DNA, 25 bp, Mus musculus
cacccaatgaacttgtttttaatct

SEQ ID NO: 222639 - DNA, 25 bp, Mus musculus
cacccacaaaagcagctatgccccc

SEQ ID NO: 222640 - DNA, 25 bp, Mus musculus
cacccacaaggtggagaaatggggc

SEQ ID NO: 222641 - DNA, 25 bp, Mus musculus
cacccacagagaaatgatctcctgt

SEQ ID NO: 222642 - DNA, 25 bp, Mus musculus
cacccacagaggacgacaatgagga

SEQ ID NO: 222643 - DNA, 25 bp, Mus musculus
cacccaccaccccagtctacctcgg

SEQ ID NO: 222644 - DNA, 25 bp, Mus musculus
cacccaccaggaagtacccagcgag

SEQ ID NO: 222645 - DNA, 25 bp, Mus musculus
cacccaccaggcaaggtactggtga

SEQ ID NO: 222646 - DNA, 25 bp, Mus musculus
cacccacgaaatggcaaatcccaaa

SEQ ID NO: 222647 - DNA, 25 bp, Mus musculus
cacccacgcacgaaaaacactctgt

SEQ ID NO: 222648 - DNA, 25 bp, Mus musculus
cacccacgtctcttcaacagactcc

SEQ ID NO: 222649 - DNA, 25 bp, Mus musculus
cacccactccaggcagcttcttcgg

SEQ ID NO: 222650 - DNA, 25 bp, Mus musculus
cacccactgaagatgatgcttctgt

SEQ ID NO: 222651 - DNA, 25 bp, Mus musculus
cacccactgaagatggactggaaac

SEQ ID NO: 222652 - DNA, 25 bp, Mus musculus
cacccacttacacaggccgccccgg

SEQ ID NO: 222653 - DNA, 25 bp, Mus musculus
cacccacttactggtgcccggcgcc

SEQ ID NO: 222654 - DNA, 25 bp, Mus musculus
cacccacttctcttagagtgtgggg

SEQ ID NO: 222655 - DNA, 25 bp, Mus musculus
cacccagaaggcaagatcctcatca

SEQ ID NO: 222656 - DNA, 25 bp, Mus musculus
cacccagacaagggaggatctcctt

SEQ ID NO: 222657 - DNA, 25 bp, Mus musculus
cacccagacaagggccctctggtgg

SEQ ID NO: 222658 - DNA, 25 bp, Mus musculus
cacccagacaagtaggtatcgcagg

SEQ ID NO: 222659 - DNA, 25 bp, Mus musculus
cacccagacagtcaggatggtgtca

SEQ ID NO: 222660 - DNA, 25 bp, Mus musculus
cacccagagaagagtaaactggtgc

SEQ ID NO: 222661 - DNA, 25 bp, Mus musculus
cacccagagaagatgtgagcccacc

SEQ ID NO: 222662 - DNA, 25 bp, Mus musculus
cacccagagctaaggttcccgagga

SEQ ID NO: 222663 - DNA, 25 bp, Mus musculus
cacccagaggcatcagaaaagttcc

SEQ ID NO: 222664 - DNA, 25 bp, Mus musculus
cacccagagggaagtgggctaaagc

SEQ ID NO: 222665 - DNA, 25 bp, Mus musculus
cacccagataaccaggtgattgttc

SEQ ID NO: 222666 - DNA, 25 bp, Mus musculus
cacccagatcccagaacactgcggc

SEQ ID NO: 222667 - DNA, 25 bp, Mus musculus
cacccagatcccaggcctctatggc

SEQ ID NO: 222668 - DNA, 25 bp, Mus musculus
cacccagcaagaaaaagccacaaat

SEQ ID NO: 222669 - DNA, 25 bp, Mus musculus
cacccagcaagccaagctgatctat

SEQ ID NO: 222670 - DNA, 25 bp, Mus musculus
cacccagcagcaccctcagcgccac

SEQ ID NO: 222671 - DNA, 25 bp, Mus musculus
cacccagccatgcctatggaggcca

SEQ ID NO: 222672 - DNA, 25 bp, Mus musculus
cacccagccatgctatcccaataga

SEQ ID NO: 222673 - DNA, 25 bp, Mus musculus
cacccagcccaggtccctgtggccc

SEQ ID NO: 222674 - DNA, 25 bp, Mus musculus
cacccagcctggccgcagaagagcg

SEQ ID NO: 222675 - DNA, 25 bp, Mus musculus
cacccagctcagtggatctggcgag

SEQ ID NO: 222676 - DNA, 25 bp, Mus musculus
cacccagctccaggactcccctgag

SEQ ID NO: 222677 - DNA, 25 bp, Mus musculus
cacccagctccagttaacctgtgga

SEQ ID NO: 222678 - DNA, 25 bp, Mus musculus
cacccagctcccagctaaatgtggt

SEQ ID NO: 222679 - DNA, 25 bp, Mus musculus
cacccagcttcagctgtttgttcag

SEQ ID NO: 222680 - DNA, 25 bp, Mus musculus
cacccaggaaagagacatggcaagt

SEQ ID NO: 222681 - DNA, 25 bp, Mus musculus
cacccaggaaagaggtgcccactca

SEQ ID NO: 222682 - DNA, 25 bp, Mus musculus
cacccaggaatatattccaatgcaa

SEQ ID NO: 222683 - DNA, 25 bp, Mus musculus
cacccaggaatattggcagtgctgt

SEQ ID NO: 222684 - DNA, 25 bp, Mus musculus
cacccaggagatcttcagaacaaaa

SEQ ID NO: 222685 - DNA, 25 bp, Mus musculus
cacccaggagatggagttccagaag

SEQ ID NO: 222686 - DNA, 25 bp, Mus musculus
cacccaggagcatgttaatgaaaag

SEQ ID NO: 222687 - DNA, 25 bp, Mus musculus
cacccaggctgccggaaccagctgt

SEQ ID NO: 222688 - DNA, 25 bp, Mus musculus
cacccagggaaaagttattaaatgc

SEQ ID NO: 222689 - DNA, 25 bp, Mus musculus
cacccagggtcctcactgcagtggg

SEQ ID NO: 222690 - DNA, 25 bp, Mus musculus
cacccagggtcctgtttgggcttcc

SEQ ID NO: 222691 - DNA, 25 bp, Mus musculus
cacccaggttcaggaataagactgt

SEQ ID NO: 222692 - DNA, 25 bp, Mus musculus
cacccagtcatcttgatcgactgcg

SEQ ID NO: 222693 - DNA, 25 bp, Mus musculus
cacccagttaaatcatcgggttata

SEQ ID NO: 222694 - DNA, 25 bp, Mus musculus
cacccatacaggtagtgctgcccta

SEQ ID NO: 222695 - DNA, 25 bp, Mus musculus
cacccatagtgggccaaagagatgt

SEQ ID NO: 222696 - DNA, 25 bp, Mus musculus
cacccatcaaggcgacctggcattc

SEQ ID NO: 222697 - DNA, 25 bp, Mus musculus
cacccatcagaagcaagacgaccgt

SEQ ID NO: 222698 - DNA, 25 bp, Mus musculus
cacccatcccagaaccaggcagata

SEQ ID NO: 222699 - DNA, 25 bp, Mus musculus
cacccatgagaagctgcccatggtg

SEQ ID NO: 222700 - DNA, 25 bp, Mus musculus
cacccatgctaagaggggatgtgaa

SEQ ID NO: 222701 - DNA, 25 bp, Mus musculus
cacccatgctttctggatcattccc

SEQ ID NO: 222702 - DNA, 25 bp, Mus musculus
cacccatggaagacaaagtctggag

SEQ ID NO: 222703 - DNA, 25 bp, Mus musculus
cacccatggaagcaccccccattgg

SEQ ID NO: 222704 - DNA, 25 bp, Mus musculus
cacccatggacactccagcacggaa

SEQ ID NO: 222705 - DNA, 25 bp, Mus musculus
cacccatgtactaagacctgttccc

SEQ ID NO: 222706 - DNA, 25 bp, Mus musculus
cacccatgtactaagggatacagtg

SEQ ID NO: 222707 - DNA, 25 bp, Mus musculus
cacccatgtactaaggtatacagtt

SEQ ID NO: 222708 - DNA, 25 bp, Mus musculus
cacccatgtactaagtttccccctg

SEQ ID NO: 222709 - DNA, 25 bp, Mus musculus
cacccattgagaatcctataaggag

SEQ ID NO: 222710 - DNA, 25 bp, Mus musculus
cacccattgaggcccaaacacgagt

SEQ ID NO: 222711 - DNA, 25 bp, Mus musculus
cacccattggctggcaaggtcagcc

SEQ ID NO: 222712 - DNA, 25 bp, Mus musculus
cacccattggctggttttcccatca

SEQ ID NO: 222713 - DNA, 25 bp, Mus musculus
caccccaaacagtgtcaccccgccc

SEQ ID NO: 222714 - DNA, 25 bp, Mus musculus
caccccaagatgctttgtgacgaca

SEQ ID NO: 222715 - DNA, 25 bp, Mus musculus
caccccaagtaagaagactagcagt

SEQ ID NO: 222716 - DNA, 25 bp, Mus musculus
caccccaagtaagataccaaggtat

SEQ ID NO: 222717 - DNA, 25 bp, Mus musculus
caccccaatagagataatgcagggg

SEQ ID NO: 222718 - DNA, 25 bp, Mus musculus
caccccaatagagatggcttgccag

SEQ ID NO: 222719 - DNA, 25 bp, Mus musculus
caccccacaaacctgacgagatgac

SEQ ID NO: 222720 - DNA, 25 bp, Mus musculus
caccccacacagcaggaggtcccag

SEQ ID NO: 222721 - DNA, 25 bp, Mus musculus
caccccacagctgaacaatgtgggt

SEQ ID NO: 222722 - DNA, 25 bp, Mus musculus
caccccacaggtatatacggtgctg

SEQ ID NO: 222723 - DNA, 25 bp, Mus musculus
caccccacaggtgcgactggaccta

SEQ ID NO: 222724 - DNA, 25 bp, Mus musculus
caccccagaagagggctacagggga

SEQ ID NO: 222725 - DNA, 25 bp, Mus musculus
caccccagaagagtttgtggcagct

SEQ ID NO: 222726 - DNA, 25 bp, Mus musculus
caccccagagcgaagaggagcatag

SEQ ID NO: 222727 - DNA, 25 bp, Mus musculus
caccccagagcgaatggcggaggct

SEQ ID NO: 222728 - DNA, 25 bp, Mus musculus
caccccagaggtgtggccaaacgta

SEQ ID NO: 222729 - DNA, 25 bp, Mus musculus
caccccagatgcagggctgtagcag

SEQ ID NO: 222730 - DNA, 25 bp, Mus musculus
caccccagatgcaggttctgcattt

SEQ ID NO: 222731 - DNA, 25 bp, Mus musculus
caccccagcaacaaacatctctcca

SEQ ID NO: 222732 - DNA, 25 bp, Mus musculus
caccccagcaacaaagtcacttaga

SEQ ID NO: 222733 - DNA, 25 bp, Mus musculus
caccccaggaattagtgtcggagct

SEQ ID NO: 222734 - DNA, 25 bp, Mus musculus
caccccagtcactgcttgtctctta

SEQ ID NO: 222735 - DNA, 25 bp, Mus musculus
caccccagtggaaatcacggttatc

SEQ ID NO: 222736 - DNA, 25 bp, Mus musculus
caccccatccagaaaatgaggaaga

SEQ ID NO: 222737 - DNA, 25 bp, Mus musculus
caccccatcggtgtagcccggatcc

SEQ ID NO: 222738 - DNA, 25 bp, Mus musculus
caccccattcaagaaattggcacca

SEQ ID NO: 222739 - DNA, 25 bp, Mus musculus
cacccccaagaccagtgacagtggg

SEQ ID NO: 222740 - DNA, 25 bp, Mus musculus
cacccccaagaccatgtgtgccgac

SEQ ID NO: 222741 - DNA, 25 bp, Mus musculus
cacccccaagttcaatctcatccct

SEQ ID NO: 222742 - DNA, 25 bp, Mus musculus
cacccccacccgagttctatccagg

SEQ ID NO: 222743 - DNA, 25 bp, Mus musculus
cacccccagaccgatatgacagcct

SEQ ID NO: 222744 - DNA, 25 bp, Mus musculus
cacccccagcccctgatacgacccg

SEQ ID NO: 222745 - DNA, 25 bp, Mus musculus
cacccccagcccctgtcctgcactt

SEQ ID NO: 222746 - DNA, 25 bp, Mus musculus
cacccccatgtatggctgtaagaat

SEQ ID NO: 222747 - DNA, 25 bp, Mus musculus
caccccccaaggatcgtgaactggg

SEQ ID NO: 222748 - DNA, 25 bp, Mus musculus
caccccccagcaagagccagaggga

SEQ ID NO: 222749 - DNA, 25 bp, Mus musculus
caccccccaggacatgacagatgac

SEQ ID NO: 222750 - DNA, 25 bp, Mus musculus
caccccccatggcttttcaagatct

SEQ ID NO: 222751 - DNA, 25 bp, Mus musculus
cacccccgagtacagaaatgctgag

SEQ ID NO: 222752 - DNA, 25 bp, Mus musculus
cacccccgcttcggtactctaacaa

SEQ ID NO: 222753 - DNA, 25 bp, Mus musculus
cacccccgcttcggtatgactcaat

SEQ ID NO: 222754 - DNA, 25 bp, Mus musculus
cacccccggaaggtatcatccggat

SEQ ID NO: 222755 - DNA, 25 bp, Mus musculus
caccccctaacaaggtcccaggcag

SEQ ID NO: 222756 - DNA, 25 bp, Mus musculus
caccccctcagtggccacagttaag

SEQ ID NO: 222757 - DNA, 25 bp, Mus musculus
caccccctcccagagctctcttccg

SEQ ID NO: 222758 - DNA, 25 bp, Mus musculus
caccccctgctccaccttctcgaga

SEQ ID NO: 222759 - DNA, 25 bp, Mus musculus
caccccgctggcaaatctcatgcat

SEQ ID NO: 222760 - DNA, 25 bp, Mus musculus
caccccgcttccgagcctcgattga

SEQ ID NO: 222761 - DNA, 25 bp, Mus musculus
caccccggccccagctgagtgatcg

SEQ ID NO: 222762 - DNA, 25 bp, Mus musculus
caccccggccccagggctggctgtg

SEQ ID NO: 222763 - DNA, 25 bp, Mus musculus
caccccggtccctccgagccatctc

SEQ ID NO: 222764 - DNA, 25 bp, Mus musculus
caccccggtgcatagagaaatccaa

SEQ ID NO: 222765 - DNA, 25 bp, Mus musculus
caccccgtgacgctgcggatttatt

SEQ ID NO: 222766 - DNA, 25 bp, Mus musculus
cacccctacagccccagctaaccag

SEQ ID NO: 222767 - DNA, 25 bp, Mus musculus
cacccctacaggatggtcagaacac

SEQ ID NO: 222768 - DNA, 25 bp, Mus musculus
cacccctacaggtctgtctgacctg

SEQ ID NO: 222769 - DNA, 25 bp, Mus musculus
cacccctacagtcagggtttctatt

SEQ ID NO: 222770 - DNA, 25 bp, Mus musculus
cacccctacagtgttctcaacatta

SEQ ID NO: 222771 - DNA, 25 bp, Mus musculus
cacccctactctttctgacctgtga

SEQ ID NO: 222772 - DNA, 25 bp, Mus musculus
cacccctatatttcgcacatcttca

SEQ ID NO: 222773 - DNA, 25 bp, Mus musculus
cacccctatctgagctgctgttgca

SEQ ID NO: 222774 - DNA, 25 bp, Mus musculus
cacccctcaagacggaggaggacta

SEQ ID NO: 222775 - DNA, 25 bp, Mus musculus
cacccctcaagcatgaccagtgtcc

SEQ ID NO: 222776 - DNA, 25 bp, Mus musculus
cacccctcaaggagcacttcaatta

SEQ ID NO: 222777 - DNA, 25 bp, Mus musculus
cacccctcaagttcacagctcccag

SEQ ID NO: 222778 - DNA, 25 bp, Mus musculus
cacccctcaccaggaggcaccatgt

SEQ ID NO: 222779 - DNA, 25 bp, Mus musculus
cacccctcaggtgttacatgtagac

SEQ ID NO: 222780 - DNA, 25 bp, Mus musculus
cacccctctccatatcgctgtattg

SEQ ID NO: 222781 - DNA, 25 bp, Mus musculus
cacccctgaaatggcattatccaat

SEQ ID NO: 222782 - DNA, 25 bp, Mus musculus
cacccctgagtacttggctccagaa

SEQ ID NO: 222783 - DNA, 25 bp, Mus musculus
cacccctgccagataatcagccttt

SEQ ID NO: 222784 - DNA, 25 bp, Mus musculus
cacccctgccagtctcctggctgct

SEQ ID NO: 222785 - DNA, 25 bp, Mus musculus
cacccctggccctgaaggcagccca

SEQ ID NO: 222786 - DNA, 25 bp, Mus musculus
cacccctgggactagctcaggccct

SEQ ID NO: 222787 - DNA, 25 bp, Mus musculus
cacccctgggcaggtgttttagctc

SEQ ID NO: 222788 - DNA, 25 bp, Mus musculus
cacccctgggtgtcagatgatgcat

SEQ ID NO: 222789 - DNA, 25 bp, Mus musculus
cacccctgtggatatgactccctgc

SEQ ID NO: 222790 - DNA, 25 bp, Mus musculus
cacccctgtggattccactgtatca

SEQ ID NO: 222791 - DNA, 25 bp, Mus musculus
caccccttcaggcagagagccagct

SEQ ID NO: 222792 - DNA, 25 bp, Mus musculus
caccccttcagtgcctgtgctgacc

SEQ ID NO: 222793 - DNA, 25 bp, Mus musculus
caccccttccttacagccctcaagt

SEQ ID NO: 222794 - DNA, 25 bp, Mus musculus
caccccttgggggctcgctcccacc

SEQ ID NO: 222795 - DNA, 25 bp, Mus musculus
cacccgaaacgcgcacgcggctgga

SEQ ID NO: 222796 - DNA, 25 bp, Mus musculus
cacccgacagggccgcagcctcgtg

SEQ ID NO: 222797 - DNA, 25 bp, Mus musculus
cacccgacccagttaatctctcagt

SEQ ID NO: 222798 - DNA, 25 bp, Mus musculus
cacccgagacgtgatcgtccgcgct

SEQ ID NO: 222799 - DNA, 25 bp, Mus musculus
cacccgagcaagatcaacgaggatc

SEQ ID NO: 222800 - DNA, 25 bp, Mus musculus
cacccgagctaggggaagacaccca

SEQ ID NO: 222801 - DNA, 25 bp, Mus musculus
cacccgagtcccctgagggatctga

SEQ ID NO: 222802 - DNA, 25 bp, Mus musculus
cacccgcaagcccattacttcacag

SEQ ID NO: 222803 - DNA, 25 bp, Mus musculus
cacccgcccgccgtgaaagccggcg

SEQ ID NO: 222804 - DNA, 25 bp, Mus musculus
cacccgccgaggtatttcaacaatc

SEQ ID NO: 222805 - DNA, 25 bp, Mus musculus
cacccgccgctcgccggccctgctg

SEQ ID NO: 222806 - DNA, 25 bp, Mus musculus
cacccgccgctcggttacctgcctt

SEQ ID NO: 222807 - DNA, 25 bp, Mus musculus
cacccgcctctggaggaaagagcca

SEQ ID NO: 222808 - DNA, 25 bp, Mus musculus
cacccgcctctggaggctccatctc

SEQ ID NO: 222809 - DNA, 25 bp, Mus musculus
cacccgcgagggtggcccgaggcag

SEQ ID NO: 222810 - DNA, 25 bp, Mus musculus
cacccgctcagcagcacaaaggcat

SEQ ID NO: 222811 - DNA, 25 bp, Mus musculus
cacccggaacaaggatgtatttata

SEQ ID NO: 222812 - DNA, 25 bp, Mus musculus
cacccggaacaaggtcctacatctc

SEQ ID NO: 222813 - DNA, 25 bp, Mus musculus
cacccggaaggccctcaatgacata

SEQ ID NO: 222814 - DNA, 25 bp, Mus musculus
cacccggacaaggactggttccacc

SEQ ID NO: 222815 - DNA, 25 bp, Mus musculus
cacccggacgatgacagctatattg

SEQ ID NO: 222816 - DNA, 25 bp, Mus musculus
cacccggactcagatcatctttaga

SEQ ID NO: 222817 - DNA, 25 bp, Mus musculus
cacccggagccgttatcctaggcgt

SEQ ID NO: 222818 - DNA, 25 bp, Mus musculus
cacccggaggagtgccggcattggc

SEQ ID NO: 222819 - DNA, 25 bp, Mus musculus
cacccggcatgaccaaactccgatg

SEQ ID NO: 222820 - DNA, 25 bp, Mus musculus
cacccggcatgaccagtgtcagcgc

SEQ ID NO: 222821 - DNA, 25 bp, Mus musculus
cacccggccccatgggtcctccagg

SEQ ID NO: 222822 - DNA, 25 bp, Mus musculus
cacccggggatacagaacatctccc

SEQ ID NO: 222823 - DNA, 25 bp, Mus musculus
cacccggggatacagctttggggcg

SEQ ID NO: 222824 - DNA, 25 bp, Mus musculus
cacccgtaggacagattgcatctgg

SEQ ID NO: 222825 - DNA, 25 bp, Mus musculus
cacccgtcaaatatgaatacccaga

SEQ ID NO: 222826 - DNA, 25 bp, Mus musculus
cacccgtcctgaggagatcatcttt

SEQ ID NO: 222827 - DNA, 25 bp, Mus musculus
caccctaaaaggaagtgctgcatgg

SEQ ID NO: 222828 - DNA, 25 bp, Mus musculus
caccctaaaggagcggttccagttt

SEQ ID NO: 222829 - DNA, 25 bp, Mus musculus
caccctaatatgaggaactgtactg

SEQ ID NO: 222830 - DNA, 25 bp, Mus musculus
caccctacagaggaggaacctgagc

SEQ ID NO: 222831 - DNA, 25 bp, Mus musculus
caccctacaggcaagattgagatca

SEQ ID NO: 222832 - DNA, 25 bp, Mus musculus
caccctaccctaagaacacagatct

SEQ ID NO: 222833 - DNA, 25 bp, Mus musculus
caccctagatgtgctcctggaggtc

SEQ ID NO: 222834 - DNA, 25 bp, Mus musculus
caccctatgacaagaaaaagcggat

SEQ ID NO: 222835 - DNA, 25 bp, Mus musculus
caccctcaaaccaggtgatcatgct

SEQ ID NO: 222836 - DNA, 25 bp, Mus musculus
caccctcagaagacccccgtcagag

SEQ ID NO: 222837 - DNA, 25 bp, Mus musculus
caccctcagaggagctggactacag

SEQ ID NO: 222838 - DNA, 25 bp, Mus musculus
caccctcatgcctggtggggcagtg

SEQ ID NO: 222839 - DNA, 25 bp, Mus musculus
caccctcatgttatgaaagagaatg

SEQ ID NO: 222840 - DNA, 25 bp, Mus musculus
caccctcatgttatgactcaacaag

SEQ ID NO: 222841 - DNA, 25 bp, Mus musculus
caccctcatgttatggttcctccat

SEQ ID NO: 222842 - DNA, 25 bp, Mus musculus
caccctccagggatacggacagaac

SEQ ID NO: 222843 - DNA, 25 bp, Mus musculus
caccctcccccagagtgctgaccta

SEQ ID NO: 222844 - DNA, 25 bp, Mus musculus
caccctctatcagcaggaatccagc

SEQ ID NO: 222845 - DNA, 25 bp, Mus musculus
caccctctctggactctatagctgc

SEQ ID NO: 222846 - DNA, 25 bp, Mus musculus
caccctctgatactccagatccaac

SEQ ID NO: 222847 - DNA, 25 bp, Mus musculus
caccctctgattgctaaagaagaag

SEQ ID NO: 222848 - DNA, 25 bp, Mus musculus
caccctctgggcatggctatcttct

SEQ ID NO: 222849 - DNA, 25 bp, Mus musculus
caccctctggtcagtcaatcccatg

SEQ ID NO: 222850 - DNA, 25 bp, Mus musculus
caccctctgtggatttcctgaaaaa

SEQ ID NO: 222851 - DNA, 25 bp, Mus musculus
caccctgaaaagtgcaggtgtgcat

SEQ ID NO: 222852 - DNA, 25 bp, Mus musculus
caccctgaagcaatcccacagggac

SEQ ID NO: 222853 - DNA, 25 bp, Mus musculus
caccctgacaggatgcaagctgttg

SEQ ID NO: 222854 - DNA, 25 bp, Mus musculus
caccctgacaggcaggtaccaccat

SEQ ID NO: 222855 - DNA, 25 bp, Mus musculus
caccctgacaggggcataaggacag

SEQ ID NO: 222856 - DNA, 25 bp, Mus musculus
caccctgacctaagtcgaatggtat

SEQ ID NO: 222857 - DNA, 25 bp, Mus musculus
caccctgaggagcaccactcccata

SEQ ID NO: 222858 - DNA, 25 bp, Mus musculus
caccctgaggcagaagctccaagat

SEQ ID NO: 222859 - DNA, 25 bp, Mus musculus
caccctgatgaaaacgttgtatcag

SEQ ID NO: 222860 - DNA, 25 bp, Mus musculus
caccctgcacctggtccttcgcctc

SEQ ID NO: 222861 - DNA, 25 bp, Mus musculus
caccctgccacccaggttctgattg

SEQ ID NO: 222862 - DNA, 25 bp, Mus musculus
caccctgcgcctggagcaggaaggg

SEQ ID NO: 222863 - DNA, 25 bp, Mus musculus
caccctgcggccacgaaacgatcag

SEQ ID NO: 222864 - DNA, 25 bp, Mus musculus
caccctgcttatgaaagccatcacc

SEQ ID NO: 222865 - DNA, 25 bp, Mus musculus
caccctgcttatgagtcagcagtgt

SEQ ID NO: 222866 - DNA, 25 bp, Mus musculus
caccctggacagccccggcagccca

SEQ ID NO: 222867 - DNA, 25 bp, Mus musculus
caccctggacggcaggtgaagtgga

SEQ ID NO: 222868 - DNA, 25 bp, Mus musculus
caccctggagacgactctagagaag

SEQ ID NO: 222869 - DNA, 25 bp, Mus musculus
caccctggagctagcatctcgctct

SEQ ID NO: 222870 - DNA, 25 bp, Mus musculus
caccctggagctagcatgctcacgc

SEQ ID NO: 222871 - DNA, 25 bp, Mus musculus
caccctggatctggtcttctagggg

SEQ ID NO: 222872 - DNA, 25 bp, Mus musculus
caccctggcgggaggcgcaacagcg

SEQ ID NO: 222873 - DNA, 25 bp, Mus musculus
caccctggcgggagggctcaggatc

SEQ ID NO: 222874 - DNA, 25 bp, Mus musculus
caccctgtaaaagatttctaacgag

SEQ ID NO: 222875 - DNA, 25 bp, Mus musculus
caccctgtactgcattaacttcagc

SEQ ID NO: 222876 - DNA, 25 bp, Mus musculus
caccctgtactgtgacaagggcact

SEQ ID NO: 222877 - DNA, 25 bp, Mus musculus
caccctgtcagaagcccagaggaca

SEQ ID NO: 222878 - DNA, 25 bp, Mus musculus
caccctgtcaggccttgccagcaca

SEQ ID NO: 222879 - DNA, 25 bp, Mus musculus
caccctgtccttcgggtactatggg

SEQ ID NO: 222880 - DNA, 25 bp, Mus musculus
caccctgtgaacctgaaaaatcatg

SEQ ID NO: 222881 - DNA, 25 bp, Mus musculus
caccctgtgaacctgacgtggccat

SEQ ID NO: 222882 - DNA, 25 bp, Mus musculus
caccctgtgataaagaccagaatat

SEQ ID NO: 222883 - DNA, 25 bp, Mus musculus
caccctgtgataaaggtgtccccaa

SEQ ID NO: 222884 - DNA, 25 bp, Mus musculus
caccctgtgcaccaggtacaagcag

SEQ ID NO: 222885 - DNA, 25 bp, Mus musculus
caccctgtgcacctctcctcttgtg

SEQ ID NO: 222886 - DNA, 25 bp, Mus musculus
caccctgtgtgagagtgtggctatc

SEQ ID NO: 222887 - DNA, 25 bp, Mus musculus
caccctgtgtgtgttttgggaagaa

SEQ ID NO: 222888 - DNA, 25 bp, Mus musculus
cacccttacaaaggtgaccgggctg

SEQ ID NO: 222889 - DNA, 25 bp, Mus musculus
cacccttacccagatgaggctctgt

SEQ ID NO: 222890 - DNA, 25 bp, Mus musculus
cacccttacccagcccagagcccgg

SEQ ID NO: 222891 - DNA, 25 bp, Mus musculus
cacccttcagtacaagcccaccacc

SEQ ID NO: 222892 - DNA, 25 bp, Mus musculus
cacccttcccgctggctgtaattca

SEQ ID NO: 222893 - DNA, 25 bp, Mus musculus
cacccttccctgagacaatgtctat

SEQ ID NO: 222894 - DNA, 25 bp, Mus musculus
cacccttccctggaaaatctggatg

SEQ ID NO: 222895 - DNA, 25 bp, Mus musculus
cacccttcttagtatcctttagccc

SEQ ID NO: 222896 - DNA, 25 bp, Mus musculus
cacccttcttagtgggtcctgtgtc

SEQ ID NO: 222897 - DNA, 25 bp, Mus musculus
cacccttgaaggtgaacaaggcaag

SEQ ID NO: 222898 - DNA, 25 bp, Mus musculus
cacccttgagtcaagtccatcatct

SEQ ID NO: 222899 - DNA, 25 bp, Mus musculus
cacccttgcagcatacgaaggacaa

SEQ ID NO: 222900 - DNA, 25 bp, Mus musculus
cacccttgcatcctctaccccctca

SEQ ID NO: 222901 - DNA, 25 bp, Mus musculus
cacccttgcgagagcaatctgatga

SEQ ID NO: 222902 - DNA, 25 bp, Mus musculus
caccctttgggaagcgcctgctgaa

SEQ ID NO: 222903 - DNA, 25 bp, Mus musculus
cacccttttcatgcctagtgacctg

SEQ ID NO: 222904 - DNA, 25 bp, Mus musculus
caccgaaaaccccagatctgtgccg

SEQ ID NO: 222905 - DNA, 25 bp, Mus musculus
caccgaaaagaggactaggaaaaga

SEQ ID NO: 222906 - DNA, 25 bp, Mus musculus
caccgaacacagtgaggatgccatg

SEQ ID NO: 222907 - DNA, 25 bp, Mus musculus
caccgaagagagtgtgaacatggct

SEQ ID NO: 222908 - DNA, 25 bp, Mus musculus
caccgaagaggctaaccattttgaa

SEQ ID NO: 222909 - DNA, 25 bp, Mus musculus
caccgaatgcagaggtgaggcatga

SEQ ID NO: 222910 - DNA, 25 bp, Mus musculus
caccgacaaggtacaaccacgttga

SEQ ID NO: 222911 - DNA, 25 bp, Mus musculus
caccgacagcatcaaaatgccaggc

SEQ ID NO: 222912 - DNA, 25 bp, Mus musculus
caccgacagcatcaaggacaattca

SEQ ID NO: 222913 - DNA, 25 bp, Mus musculus
caccgacagcatcaaggcctgggag

SEQ ID NO: 222914 - DNA, 25 bp, Mus musculus
caccgacaggcttcaagagtggtct

SEQ ID NO: 222915 - DNA, 25 bp, Mus musculus
caccgacaggcttcacttcatcttc

SEQ ID NO: 222916 - DNA, 25 bp, Mus musculus
caccgacatggtaaagaacttgtct

SEQ ID NO: 222917 - DNA, 25 bp, Mus musculus
caccgaccaggcagccacctggaca

SEQ ID NO: 222918 - DNA, 25 bp, Mus musculus
caccgaccaggtcgtccgtactgcc

SEQ ID NO: 222919 - DNA, 25 bp, Mus musculus
caccgaccagtggccacagttaagc

SEQ ID NO: 222920 - DNA, 25 bp, Mus musculus
caccgacccacagagaggccgtgag

SEQ ID NO: 222921 - DNA, 25 bp, Mus musculus
caccgacccacagagggagcatgac

SEQ ID NO: 222922 - DNA, 25 bp, Mus musculus
caccgacctgaaagctttacaactc

SEQ ID NO: 222923 - DNA, 25 bp, Mus musculus
caccgacctgatcaagggatcaaca

SEQ ID NO: 222924 - DNA, 25 bp, Mus musculus
caccgacgagtccatttcgggcttc

SEQ ID NO: 222925 - DNA, 25 bp, Mus musculus
caccgactcagacagagtctttcta

SEQ ID NO: 222926 - DNA, 25 bp, Mus musculus
caccgactcagctgactcaagagac

SEQ ID NO: 222927 - DNA, 25 bp, Mus musculus
caccgacttcctcgctgcacctggt

SEQ ID NO: 222928 - DNA, 25 bp, Mus musculus
caccgagaggcttcattaacaaaac

SEQ ID NO: 222929 - DNA, 25 bp, Mus musculus
caccgagcaggtgacattcccactg

SEQ ID NO: 222930 - DNA, 25 bp, Mus musculus
caccgagcggagggcaagaggctgt

SEQ ID NO: 222931 - DNA, 25 bp, Mus musculus
caccgaggagagcactgcctgcaca

SEQ ID NO: 222932 - DNA, 25 bp, Mus musculus
caccgaggagagccggatggcgcag

SEQ ID NO: 222933 - DNA, 25 bp, Mus musculus
caccgaggcaaatacctcgctattg

SEQ ID NO: 222934 - DNA, 25 bp, Mus musculus
caccgaggcaaatcctggatggtat

SEQ ID NO: 222935 - DNA, 25 bp, Mus musculus
caccgaggcaatctacgggctggtg

SEQ ID NO: 222936 - DNA, 25 bp, Mus musculus
caccgaggccagggactcagcgatg

SEQ ID NO: 222937 - DNA, 25 bp, Mus musculus
caccgaggtaagaaatggcgctcaa

SEQ ID NO: 222938 - DNA, 25 bp, Mus musculus
caccgagtgatagggtaaaatttat

SEQ ID NO: 222939 - DNA, 25 bp, Mus musculus
caccgagtggcagtgatcatgggca

SEQ ID NO: 222940 - DNA, 25 bp, Mus musculus
caccgatcagaaacctgatatctca

SEQ ID NO: 222941 - DNA, 25 bp, Mus musculus
caccgatcaggacaacatccacgct

SEQ ID NO: 222942 - DNA, 25 bp, Mus musculus
caccgatcgtgtatgacggagagag

SEQ ID NO: 222943 - DNA, 25 bp, Mus musculus
caccgatgaagaacgagccctcgtg

SEQ ID NO: 222944 - DNA, 25 bp, Mus musculus
caccgcaaatgagagtcagtccttc

SEQ ID NO: 222945 - DNA, 25 bp, Mus musculus
caccgcacagacaccaagtggactg

SEQ ID NO: 222946 - DNA, 25 bp, Mus musculus
caccgcacggaatgacatcactccc

SEQ ID NO: 222947 - DNA, 25 bp, Mus musculus
caccgcactgattttggctctgggg

SEQ ID NO: 222948 - DNA, 25 bp, Mus musculus
caccgcactgcttcaggaccccagc

SEQ ID NO: 222949 - DNA, 25 bp, Mus musculus
caccgcagacagacctcaagtacta

SEQ ID NO: 222950 - DNA, 25 bp, Mus musculus
caccgcagctgagatcgattatatt

SEQ ID NO: 222951 - DNA, 25 bp, Mus musculus
caccgcaggaggaagcaactgatgg

SEQ ID NO: 222952 - DNA, 25 bp, Mus musculus
caccgcagtgtcctggccaagggcc

SEQ ID NO: 222953 - DNA, 25 bp, Mus musculus
caccgccaaagcagcttcctgccag

SEQ ID NO: 222954 - DNA, 25 bp, Mus musculus
caccgccaagagaataaagactcgg

SEQ ID NO: 222955 - DNA, 25 bp, Mus musculus
caccgccaagatggattcatgggtg

SEQ ID NO: 222956 - DNA, 25 bp, Mus musculus
caccgccacacagacagatgatgca

SEQ ID NO: 222957 - DNA, 25 bp, Mus musculus
caccgccactggcataaatgcagtt

SEQ ID NO: 222958 - DNA, 25 bp, Mus musculus
caccgccagaaagacagggtttcat

SEQ ID NO: 222959 - DNA, 25 bp, Mus musculus
caccgccagaaaggaacacccctgg

SEQ ID NO: 222960 - DNA, 25 bp, Mus musculus
caccgccagctctgctgtggctgga

SEQ ID NO: 222961 - DNA, 25 bp, Mus musculus
caccgccgcggcatggatgggcaga

SEQ ID NO: 222962 - DNA, 25 bp, Mus musculus
caccgccgtcaggatctggaagttg

SEQ ID NO: 222963 - DNA, 25 bp, Mus musculus
caccgccgtcatctgcaaagcagaa

SEQ ID NO: 222964 - DNA, 25 bp, Mus musculus
caccgccgtcatctgctatagacat

SEQ ID NO: 222965 - DNA, 25 bp, Mus musculus
caccgccgtctacagaaaacaagca

SEQ ID NO: 222966 - DNA, 25 bp, Mus musculus
caccgcgcagatctcaagcatacac

SEQ ID NO: 222967 - DNA, 25 bp, Mus musculus
caccgcgcaggcttgacatctaggg

SEQ ID NO: 222968 - DNA, 25 bp, Mus musculus
caccgcgcggcgaagtcaatgaaag

SEQ ID NO: 222969 - DNA, 25 bp, Mus musculus
caccgcggaggctctgcagaagctc

SEQ ID NO: 222970 - DNA, 25 bp, Mus musculus
caccgcggccgtgcagttggaattg

SEQ ID NO: 222971 - DNA, 25 bp, Mus musculus
caccgcggtgggtgatgtcttccca

SEQ ID NO: 222972 - DNA, 25 bp, Mus musculus
caccgcgtaggatctttctcaagtg

SEQ ID NO: 222973 - DNA, 25 bp, Mus musculus
caccgctacagggcattaggagact

SEQ ID NO: 222974 - DNA, 25 bp, Mus musculus
caccgctagtctgaaagaaagactg

SEQ ID NO: 222975 - DNA, 25 bp, Mus musculus
caccgctcaacaggtttgatggcta

SEQ ID NO: 222976 - DNA, 25 bp, Mus musculus
caccgctcaacagttcccttcttcg

SEQ ID NO: 222977 - DNA, 25 bp, Mus musculus
caccgctcaacgaaacggaaggtgg

SEQ ID NO: 222978 - DNA, 25 bp, Mus musculus
caccgctcgaggtggccaggcagac

SEQ ID NO: 222979 - DNA, 25 bp, Mus musculus
caccgctcgtttctggtccatacat

SEQ ID NO: 222980 - DNA, 25 bp, Mus musculus
caccgctctccctacagccttgcaa

SEQ ID NO: 222981 - DNA, 25 bp, Mus musculus
caccgctgatttaggaggacaggtg

SEQ ID NO: 222982 - DNA, 25 bp, Mus musculus
caccgctgccaggcacaatggaagg

SEQ ID NO: 222983 - DNA, 25 bp, Mus musculus
caccgctgcctcttccaccttccag

SEQ ID NO: 222984 - DNA, 25 bp, Mus musculus
caccgctggaagatttatacaaaag

SEQ ID NO: 222985 - DNA, 25 bp, Mus musculus
caccgctgtccccaggaggccccac

SEQ ID NO: 222986 - DNA, 25 bp, Mus musculus
caccgcttcatgtttctctgccgat

SEQ ID NO: 222987 - DNA, 25 bp, Mus musculus
caccggaacaggttcaagttctttc

SEQ ID NO: 222988 - DNA, 25 bp, Mus musculus
caccggaactccatggtccccagtg

SEQ ID NO: 222989 - DNA, 25 bp, Mus musculus
caccggaagccaggactccccgcgg

SEQ ID NO: 222990 - DNA, 25 bp, Mus musculus
caccggaagccaggctgggtcctag

SEQ ID NO: 222991 - DNA, 25 bp, Mus musculus
caccggaagttaaagcacggtttgc

SEQ ID NO: 222992 - DNA, 25 bp, Mus musculus
caccggaatacacagcctgcatacc

SEQ ID NO: 222993 - DNA, 25 bp, Mus musculus
caccggaatacacaggtgaactgtg

SEQ ID NO: 222994 - DNA, 25 bp, Mus musculus
caccggacagcattcacaacgacag

SEQ ID NO: 222995 - DNA, 25 bp, Mus musculus
caccggacagcccaacggtagcggc

SEQ ID NO: 222996 - DNA, 25 bp, Mus musculus
caccggacctcttgtctacccagct

SEQ ID NO: 222997 - DNA, 25 bp, Mus musculus
caccggacgccgagatgctccagac

SEQ ID NO: 222998 - DNA, 25 bp, Mus musculus
caccggagctgcgagaatgtctgaa

SEQ ID NO: 222999 - DNA, 25 bp, Mus musculus
caccggagctgcgagcagagggacc

SEQ ID NO: 223000 - DNA, 25 bp, Mus musculus
caccggagctgcgaggactgatgac

SEQ ID NO: 223001 - DNA, 25 bp, Mus musculus
caccggagctgcgagttacagaatg

SEQ ID NO: 223002 - DNA, 25 bp, Mus musculus
caccggagctgcgagttacagattt

SEQ ID NO: 223003 - DNA, 25 bp, Mus musculus
caccggagctttgagttgctggttg

SEQ ID NO: 223004 - DNA, 25 bp, Mus musculus
caccggagtcatgggggtctgctgc

SEQ ID NO: 223005 - DNA, 25 bp, Mus musculus
caccggagtgcaatcaaaaccaata

SEQ ID NO: 223006 - DNA, 25 bp, Mus musculus
caccggagtggtgacaaatggatac

SEQ ID NO: 223007 - DNA, 25 bp, Mus musculus
caccggattcagtgcaggtttggat

SEQ ID NO: 223008 - DNA, 25 bp, Mus musculus
caccggattcagtggcattgaatcc

SEQ ID NO: 223009 - DNA, 25 bp, Mus musculus
caccggattcggtgtatcctgctgt

SEQ ID NO: 223010 - DNA, 25 bp, Mus musculus
caccggcaagatagttgaagtattg

SEQ ID NO: 223011 - DNA, 25 bp, Mus musculus
caccggcaaggtgatgcttcttgga

SEQ ID NO: 223012 - DNA, 25 bp, Mus musculus
caccggcacactcgatctgatttgt

SEQ ID NO: 223013 - DNA, 25 bp, Mus musculus
caccggcagaaagagtaaataacag

SEQ ID NO: 223014 - DNA, 25 bp, Mus musculus
caccggcatcggaagcctggacaaa

SEQ ID NO: 223015 - DNA, 25 bp, Mus musculus
caccggccaggggcgcaagaagttc

SEQ ID NO: 223016 - DNA, 25 bp, Mus musculus
caccggccaggtgctctcaccacca

SEQ ID NO: 223017 - DNA, 25 bp, Mus musculus
caccggccatgaaaggcgttaagca

SEQ ID NO: 223018 - DNA, 25 bp, Mus musculus
caccggcctgacggaatgtatcctg

SEQ ID NO: 223019 - DNA, 25 bp, Mus musculus
caccggcctgacgttatacaaaagg

SEQ ID NO: 223020 - DNA, 25 bp, Mus musculus
caccggcgaggagtctgcaggtgct

SEQ ID NO: 223021 - DNA, 25 bp, Mus musculus
caccggcgcgtaagcaatggcttcg

SEQ ID NO: 223022 - DNA, 25 bp, Mus musculus
caccggctctgtggggctgctgccg

SEQ ID NO: 223023 - DNA, 25 bp, Mus musculus
caccggctgcacagcccatctctga

SEQ ID NO: 223024 - DNA, 25 bp, Mus musculus
caccggctgcacaggagcaacacgt

SEQ ID NO: 223025 - DNA, 25 bp, Mus musculus
caccggctgcacagtgacatgaaat

SEQ ID NO: 223026 - DNA, 25 bp, Mus musculus
caccggctggaggcatcatgacacc

SEQ ID NO: 223027 - DNA, 25 bp, Mus musculus
caccggcttctgccccccactgcct

SEQ ID NO: 223028 - DNA, 25 bp, Mus musculus
caccggcttctggaagtcacctggg

SEQ ID NO: 223029 - DNA, 25 bp, Mus musculus
caccgggaaaaagcaagaccacacc

SEQ ID NO: 223030 - DNA, 25 bp, Mus musculus
caccgggattcagaggaagccaagg

SEQ ID NO: 223031 - DNA, 25 bp, Mus musculus
caccgggcagatcctgccccgtccc

SEQ ID NO: 223032 - DNA, 25 bp, Mus musculus
caccggggaaaggaatggatggctg

SEQ ID NO: 223033 - DNA, 25 bp, Mus musculus
caccggggaaagggatgattctgag

SEQ ID NO: 223034 - DNA, 25 bp, Mus musculus
caccggggagaagaactggagaatt

SEQ ID NO: 223035 - DNA, 25 bp, Mus musculus
caccggggagaagacctgtgtagat

SEQ ID NO: 223036 - DNA, 25 bp, Mus musculus
caccgggggtctaaggaacgctggc

SEQ ID NO: 223037 - DNA, 25 bp, Mus musculus
caccgggggtctaaggatcgagagc

SEQ ID NO: 223038 - DNA, 25 bp, Mus musculus
caccgggtacttaggtgctggaaag

SEQ ID NO: 223039 - DNA, 25 bp, Mus musculus
caccgggtcaaacagaggacagtgt

SEQ ID NO: 223040 - DNA, 25 bp, Mus musculus
caccgggtgtggagaagaacgctgt

SEQ ID NO: 223041 - DNA, 25 bp, Mus musculus
caccggtaaaggtagctggagttag

SEQ ID NO: 223042 - DNA, 25 bp, Mus musculus
caccggtcagatctggcactcgctc

SEQ ID NO: 223043 - DNA, 25 bp, Mus musculus
caccggtcagatctgtcagtggtgc

SEQ ID NO: 223044 - DNA, 25 bp, Mus musculus
caccggttgtggcggttcccgagga

SEQ ID NO: 223045 - DNA, 25 bp, Mus musculus
caccgtacatcaggtacttcgtgag

SEQ ID NO: 223046 - DNA, 25 bp, Mus musculus
caccgtacgaggcagctgtggccct

SEQ ID NO: 223047 - DNA, 25 bp, Mus musculus
caccgtatgaaggtggaagatatca

SEQ ID NO: 223048 - DNA, 25 bp, Mus musculus
caccgtcacagagccccctgtgcgg

SEQ ID NO: 223049 - DNA, 25 bp, Mus musculus
caccgtcacagagtcataccaaagt

SEQ ID NO: 223050 - DNA, 25 bp, Mus musculus
caccgtcaccaccaccagagagtcg

SEQ ID NO: 223051 - DNA, 25 bp, Mus musculus
caccgtcagtcagatcccattgtta

SEQ ID NO: 223052 - DNA, 25 bp, Mus musculus
caccgtcattgtcagctggattgtc

SEQ ID NO: 223053 - DNA, 25 bp, Mus musculus
caccgtccagatccccaccctcagc

SEQ ID NO: 223054 - DNA, 25 bp, Mus musculus
caccgtccaggtctgggtggccaga

SEQ ID NO: 223055 - DNA, 25 bp, Mus musculus
caccgtccggcaggggttcatggca

SEQ ID NO: 223056 - DNA, 25 bp, Mus musculus
caccgtccggcagtgttctcccgcc

SEQ ID NO: 223057 - DNA, 25 bp, Mus musculus
caccgtcggtgctgcgatccggagg

SEQ ID NO: 223058 - DNA, 25 bp, Mus musculus
caccgtcggtgctggccttcccaga

SEQ ID NO: 223059 - DNA, 25 bp, Mus musculus
caccgtctcctcagagagtcagtcc

SEQ ID NO: 223060 - DNA, 25 bp, Mus musculus
caccgtctcctcagagtctgcgaga

SEQ ID NO: 223061 - DNA, 25 bp, Mus musculus
caccgtctcctcagccaaaacaaca

SEQ ID NO: 223062 - DNA, 25 bp, Mus musculus
caccgtctcctcagccaaaacgaca

SEQ ID NO: 223063 - DNA, 25 bp, Mus musculus
caccgtctcctcagcctctatcagg

SEQ ID NO: 223064 - DNA, 25 bp, Mus musculus
caccgtcttcctctggaatcaacat

SEQ ID NO: 223065 - DNA, 25 bp, Mus musculus
caccgtgaaaatcagatgggatcag

SEQ ID NO: 223066 - DNA, 25 bp, Mus musculus
caccgtgaaggtctggacatgctaa

SEQ ID NO: 223067 - DNA, 25 bp, Mus musculus
caccgtgacaagggtgaagatgggc

SEQ ID NO: 223068 - DNA, 25 bp, Mus musculus
caccgtgacatggggggatggacag

SEQ ID NO: 223069 - DNA, 25 bp, Mus musculus
caccgtgagcaagtgtgggacccaa

SEQ ID NO: 223070 - DNA, 25 bp, Mus musculus
caccgtgagcgcctatgacttggtg

SEQ ID NO: 223071 - DNA, 25 bp, Mus musculus
caccgtgcacccagaaatgtatgag

SEQ ID NO: 223072 - DNA, 25 bp, Mus musculus
caccgtgcacccaggggggaagccc

SEQ ID NO: 223073 - DNA, 25 bp, Mus musculus
caccgtgcctccaggaataacaggc

SEQ ID NO: 223074 - DNA, 25 bp, Mus musculus
caccgtgcctccaggagacacaaag

SEQ ID NO: 223075 - DNA, 25 bp, Mus musculus
caccgtggaagaagggagcagcatc

SEQ ID NO: 223076 - DNA, 25 bp, Mus musculus
caccgtggaagaaggtgctccttca

SEQ ID NO: 223077 - DNA, 25 bp, Mus musculus
caccgtggacatcgttaaccagaat

SEQ ID NO: 223078 - DNA, 25 bp, Mus musculus
caccgtggagacaggacctcacgca

SEQ ID NO: 223079 - DNA, 25 bp, Mus musculus
caccgtggagacagtttgaagagga

SEQ ID NO: 223080 - DNA, 25 bp, Mus musculus
caccgtggaggcccccgtcctgcgg

SEQ ID NO: 223081 - DNA, 25 bp, Mus musculus
caccgtggccagaggcggaggcagc

SEQ ID NO: 223082 - DNA, 25 bp, Mus musculus
caccgtgggaggttctccagtggtc

SEQ ID NO: 223083 - DNA, 25 bp, Mus musculus
caccgtgggagtggattttgctctc

SEQ ID NO: 223084 - DNA, 25 bp, Mus musculus
caccgtggtacagcgccccgggatg

SEQ ID NO: 223085 - DNA, 25 bp, Mus musculus
caccgtgtcgcgtcaagatggggtt

SEQ ID NO: 223086 - DNA, 25 bp, Mus musculus
caccgtgtcgcgtgagatctccaga

SEQ ID NO: 223087 - DNA, 25 bp, Mus musculus
caccgtgtgacttctcagacttttc

SEQ ID NO: 223088 - DNA, 25 bp, Mus musculus
caccgtgttcggggcgggccaatga

SEQ ID NO: 223089 - DNA, 25 bp, Mus musculus
caccgtgtttgaggccttattcagg

SEQ ID NO: 223090 - DNA, 25 bp, Mus musculus
caccgttaagacagtgggttgtatc

SEQ ID NO: 223091 - DNA, 25 bp, Mus musculus
caccgttattctcgatgaaacggac

SEQ ID NO: 223092 - DNA, 25 bp, Mus musculus
caccgttcgttcaaggggcagaatc

SEQ ID NO: 223093 - DNA, 25 bp, Mus musculus
caccgttggcttcattttaggttta

SEQ ID NO: 223094 - DNA, 25 bp, Mus musculus
caccgtttgtagtggtgacactcga

SEQ ID NO: 223095 - DNA, 25 bp, Mus musculus
caccgttttcagatagcggccattg

SEQ ID NO: 223096 - DNA, 25 bp, Mus musculus
caccgttttcaggctttctggctca

SEQ ID NO: 223097 - DNA, 25 bp, Mus musculus
caccgttttcagttatttgccagga

SEQ ID NO: 223098 - DNA, 25 bp, Mus musculus
cacctaaacacaagatcttctgccc

SEQ ID NO: 223099 - DNA, 25 bp, Mus musculus
cacctaaagagcaatgcaagtggtg

SEQ ID NO: 223100 - DNA, 25 bp, Mus musculus
cacctaaagagtctgacacgtactt

SEQ ID NO: 223101 - DNA, 25 bp, Mus musculus
cacctaaagcatgcgaggtccttcc

SEQ ID NO: 223102 - DNA, 25 bp, Mus musculus
cacctaaagcatgtttctctagagg

SEQ ID NO: 223103 - DNA, 25 bp, Mus musculus
cacctaaataagggccacacctagt

SEQ ID NO: 223104 - DNA, 25 bp, Mus musculus
cacctaacccggctggccaaggtcg

SEQ ID NO: 223105 - DNA, 25 bp, Mus musculus
cacctaagacagcgaaggtgtccga

SEQ ID NO: 223106 - DNA, 25 bp, Mus musculus
cacctacaaaaaagtctgttgcaag

SEQ ID NO: 223107 - DNA, 25 bp, Mus musculus
cacctacaaagagaaaaaactggcc

SEQ ID NO: 223108 - DNA, 25 bp, Mus musculus
cacctacaaagaggtcttctgggag

SEQ ID NO: 223109 - DNA, 25 bp, Mus musculus
cacctacaaccaagggtacttcgag

SEQ ID NO: 223110 - DNA, 25 bp, Mus musculus
cacctacaaccataggtacttcgag

SEQ ID NO: 223111 - DNA, 25 bp, Mus musculus
cacctacaagtggccatggatcggt

SEQ ID NO: 223112 - DNA, 25 bp, Mus musculus
cacctacaagtgggcccgtgatttg

SEQ ID NO: 223113 - DNA, 25 bp, Mus musculus
cacctacaatttccccgccgactgg

SEQ ID NO: 223114 - DNA, 25 bp, Mus musculus
cacctacacccaaaaacacagatac

SEQ ID NO: 223115 - DNA, 25 bp, Mus musculus
cacctacacccaatacaagcagctc

SEQ ID NO: 223116 - DNA, 25 bp, Mus musculus
cacctacagagaggaggcttctcag

SEQ ID NO: 223117 - DNA, 25 bp, Mus musculus
cacctacatccgcaggctgctggtc

SEQ ID NO: 223118 - DNA, 25 bp, Mus musculus
cacctacatcctcctgagcggagcg

SEQ ID NO: 223119 - DNA, 25 bp, Mus musculus
cacctaccaggaccctgtcctgctg

SEQ ID NO: 223120 - DNA, 25 bp, Mus musculus
cacctaccaggagaactatgagcag

SEQ ID NO: 223121 - DNA, 25 bp, Mus musculus
cacctaccagtgaaatcaactcttt

SEQ ID NO: 223122 - DNA, 25 bp, Mus musculus
cacctacccacctatgtgctcccaa

SEQ ID NO: 223123 - DNA, 25 bp, Mus musculus
cacctacccagaaggacggcactag

SEQ ID NO: 223124 - DNA, 25 bp, Mus musculus
cacctacccagaaggacggcattag

SEQ ID NO: 223125 - DNA, 25 bp, Mus musculus
cacctacctggcaggccatggctct

SEQ ID NO: 223126 - DNA, 25 bp, Mus musculus
cacctacgggccctatgccgtcaat

SEQ ID NO: 223127 - DNA, 25 bp, Mus musculus
cacctacgtgctgaagtatgccgcc

SEQ ID NO: 223128 - DNA, 25 bp, Mus musculus
cacctactgaagctcctgcagactg

SEQ ID NO: 223129 - DNA, 25 bp, Mus musculus
cacctactgaagctgtggggattgc

SEQ ID NO: 223130 - DNA, 25 bp, Mus musculus
cacctactgtgccatggaagggtct

SEQ ID NO: 223131 - DNA, 25 bp, Mus musculus
cacctacttgctggggcttcacggt

SEQ ID NO: 223132 - DNA, 25 bp, Mus musculus
cacctaggcgtgcagataaagggag

SEQ ID NO: 223133 - DNA, 25 bp, Mus musculus
cacctaggcgtgcagtgggagattt

SEQ ID NO: 223134 - DNA, 25 bp, Mus musculus
cacctaggggctacctcacttacat

SEQ ID NO: 223135 - DNA, 25 bp, Mus musculus
cacctagtcagtccccagttgtagg

SEQ ID NO: 223136 - DNA, 25 bp, Mus musculus
cacctagttcagagcaagaacagaa

SEQ ID NO: 223137 - DNA, 25 bp, Mus musculus
cacctatacaaactatatatttgtc

SEQ ID NO: 223138 - DNA, 25 bp, Mus musculus
cacctatatcgagcttcttcctcca

SEQ ID NO: 223139 - DNA, 25 bp, Mus musculus
cacctatccacccatgaacccaatt

SEQ ID NO: 223140 - DNA, 25 bp, Mus musculus
cacctatccctgagagctgctcctt

SEQ ID NO: 223141 - DNA, 25 bp, Mus musculus
cacctatgacgagtccatgctggac

SEQ ID NO: 223142 - DNA, 25 bp, Mus musculus
cacctatgagacactaaagtacata

SEQ ID NO: 223143 - DNA, 25 bp, Mus musculus
cacctatgagagcggagaagctgca

SEQ ID NO: 223144 - DNA, 25 bp, Mus musculus
cacctatgagagtcatcagagagtg

SEQ ID NO: 223145 - DNA, 25 bp, Mus musculus
cacctatgagatggtagaagagagt

SEQ ID NO: 223146 - DNA, 25 bp, Mus musculus
cacctatgagtacttacagctacga

SEQ ID NO: 223147 - DNA, 25 bp, Mus musculus
cacctatgatgaggactaccagcag

SEQ ID NO: 223148 - DNA, 25 bp, Mus musculus
cacctatgatggacaagaagctgat

SEQ ID NO: 223149 - DNA, 25 bp, Mus musculus
cacctattatggtaactttcggcct

SEQ ID NO: 223150 - DNA, 25 bp, Mus musculus
cacctcaaagagttgaaaagagcgg

SEQ ID NO: 223151 - DNA, 25 bp, Mus musculus
cacctcaaaggccacgagacccaaa

SEQ ID NO: 223152 - DNA, 25 bp, Mus musculus
cacctcaaaggtctgtgttggaatg

SEQ ID NO: 223153 - DNA, 25 bp, Mus musculus
cacctcaactgatgggaccctgcca

SEQ ID NO: 223154 - DNA, 25 bp, Mus musculus
cacctcaagagggagagaaaatgaa

SEQ ID NO: 223155 - DNA, 25 bp, Mus musculus
cacctcaagaggtacctaagagtaa

SEQ ID NO: 223156 - DNA, 25 bp, Mus musculus
cacctcaaggttaaggctagatatg

SEQ ID NO: 223157 - DNA, 25 bp, Mus musculus
cacctcaatgaggacaataatactc

SEQ ID NO: 223158 - DNA, 25 bp, Mus musculus
cacctcacagaatagcattcctttc

SEQ ID NO: 223159 - DNA, 25 bp, Mus musculus
cacctcacagaggagcagggacatg

SEQ ID NO: 223160 - DNA, 25 bp, Mus musculus
cacctcacagattcccggtcgggtg

SEQ ID NO: 223161 - DNA, 25 bp, Mus musculus
cacctcacgaggttcctggacatca

SEQ ID NO: 223162 - DNA, 25 bp, Mus musculus
cacctcagaggatacaagcagcagc

SEQ ID NO: 223163 - DNA, 25 bp, Mus musculus
cacctcagccaacactgatagggct

SEQ ID NO: 223164 - DNA, 25 bp, Mus musculus
cacctcagccaagtaccaaaggctt

SEQ ID NO: 223165 - DNA, 25 bp, Mus musculus
cacctcagccggcaggctcatagtg

SEQ ID NO: 223166 - DNA, 25 bp, Mus musculus
cacctcaggtaaaccccttgacctc

SEQ ID NO: 223167 - DNA, 25 bp, Mus musculus
cacctcagtgtatgccgcttacaag

SEQ ID NO: 223168 - DNA, 25 bp, Mus musculus
cacctcatacagggtggcagtgagc

SEQ ID NO: 223169 - DNA, 25 bp, Mus musculus
cacctcatcatccagctggatagca

SEQ ID NO: 223170 - DNA, 25 bp, Mus musculus
cacctcatgagctggctgcctgagt

SEQ ID NO: 223171 - DNA, 25 bp, Mus musculus
cacctcatgcagaaggtgattacca

SEQ ID NO: 223172 - DNA, 25 bp, Mus musculus
cacctcatgcaggagtatgcaaacc

SEQ ID NO: 223173 - DNA, 25 bp, Mus musculus
cacctcatgccgagcaactgtgggt

SEQ ID NO: 223174 - DNA, 25 bp, Mus musculus
cacctcatggagatacattggtcaa

SEQ ID NO: 223175 - DNA, 25 bp, Mus musculus
cacctcatggtgatacattggtcaa

SEQ ID NO: 223176 - DNA, 25 bp, Mus musculus
cacctccaaacagaagctccctgag

SEQ ID NO: 223177 - DNA, 25 bp, Mus musculus
cacctccaaacagtgaaggtgagca

SEQ ID NO: 223178 - DNA, 25 bp, Mus musculus
cacctccaagaagccaaatcttatc

SEQ ID NO: 223179 - DNA, 25 bp, Mus musculus
cacctccaagaatggtggcatctac

SEQ ID NO: 223180 - DNA, 25 bp, Mus musculus
cacctccacagcacaagagcaagat

SEQ ID NO: 223181 - DNA, 25 bp, Mus musculus
cacctccacaggttccagatgatga

SEQ ID NO: 223182 - DNA, 25 bp, Mus musculus
cacctccagctcttggcagaagact

SEQ ID NO: 223183 - DNA, 25 bp, Mus musculus
cacctccaggacgtgtctcccactc

SEQ ID NO: 223184 - DNA, 25 bp, Mus musculus
cacctccaggacgtttctaagctga

SEQ ID NO: 223185 - DNA, 25 bp, Mus musculus
cacctccagtgctgcgccattttgg

SEQ ID NO: 223186 - DNA, 25 bp, Mus musculus
cacctccagtgctgtaaccctccac

SEQ ID NO: 223187 - DNA, 25 bp, Mus musculus
cacctccatcccaagcgcctgtgtc

SEQ ID NO: 223188 - DNA, 25 bp, Mus musculus
cacctccattgggcacatgaccgat

SEQ ID NO: 223189 - DNA, 25 bp, Mus musculus
cacctccattttggattcgtaaact

SEQ ID NO: 223190 - DNA, 25 bp, Mus musculus
cacctcccaagattccactttgaag

SEQ ID NO: 223191 - DNA, 25 bp, Mus musculus
cacctcccacacaggcgctctgaaa

SEQ ID NO: 223192 - DNA, 25 bp, Mus musculus
cacctcccagatcttctccctgggt

SEQ ID NO: 223193 - DNA, 25 bp, Mus musculus
cacctcccaggaccccaagacactc

SEQ ID NO: 223194 - DNA, 25 bp, Mus musculus
cacctcccagtggcaccaccgaggg

SEQ ID NO: 223195 - DNA, 25 bp, Mus musculus
cacctccctcagcagcaggtcctgg

SEQ ID NO: 223196 - DNA, 25 bp, Mus musculus
cacctccctcttcatgacacccctg

SEQ ID NO: 223197 - DNA, 25 bp, Mus musculus
cacctccctgccttcagccatctgc

SEQ ID NO: 223198 - DNA, 25 bp, Mus musculus
cacctccgactgctctttgtcacca

SEQ ID NO: 223199 - DNA, 25 bp, Mus musculus
cacctccgactgggaggagaaggag

SEQ ID NO: 223200 - DNA, 25 bp, Mus musculus
cacctccggttatggtacaaattct

SEQ ID NO: 223201 - DNA, 25 bp, Mus musculus
cacctcctaacccagttccgcagag

SEQ ID NO: 223202 - DNA, 25 bp, Mus musculus
cacctcctccacggagcaggagcga

SEQ ID NO: 223203 - DNA, 25 bp, Mus musculus
cacctcctccacggagcgagagggg

SEQ ID NO: 223204 - DNA, 25 bp, Mus musculus
cacctcctccagggagtgagtgctg

SEQ ID NO: 223205 - DNA, 25 bp, Mus musculus
cacctcctgagaaattagaaggatg

SEQ ID NO: 223206 - DNA, 25 bp, Mus musculus
cacctcctgagaccatggtatctac

SEQ ID NO: 223207 - DNA, 25 bp, Mus musculus
cacctcctgagtctagccgccggtg

SEQ ID NO: 223208 - DNA, 25 bp, Mus musculus
cacctcctgctctggtggctccttg

SEQ ID NO: 223209 - DNA, 25 bp, Mus musculus
cacctcctgctggggtagacagcaa

SEQ ID NO: 223210 - DNA, 25 bp, Mus musculus
cacctcctgtctgagcgggaggaag

SEQ ID NO: 223211 - DNA, 25 bp, Mus musculus
cacctcctgtctgagctctttcctg

SEQ ID NO: 223212 - DNA, 25 bp, Mus musculus
cacctcctgtctgagtggacgagcg

SEQ ID NO: 223213 - DNA, 25 bp, Mus musculus
cacctcctgtgctttcgttggggca

SEQ ID NO: 223214 - DNA, 25 bp, Mus musculus
cacctccttcctggcattggaggcg

SEQ ID NO: 223215 - DNA, 25 bp, Mus musculus
cacctcgaaggaatggaagaaagca

SEQ ID NO: 223216 - DNA, 25 bp, Mus musculus
cacctcgaaggtacacaactggagc

SEQ ID NO: 223217 - DNA, 25 bp, Mus musculus
cacctcgcaaattacgtccacagca

SEQ ID NO: 223218 - DNA, 25 bp, Mus musculus
cacctcgccacggcccagttcaatt

SEQ ID NO: 223219 - DNA, 25 bp, Mus musculus
cacctcgccaggctgcctaaaccac

SEQ ID NO: 223220 - DNA, 25 bp, Mus musculus
cacctcgccagggtgcactcgtgaa

SEQ ID NO: 223221 - DNA, 25 bp, Mus musculus
cacctcgccaggtggaggtgggaaa

SEQ ID NO: 223222 - DNA, 25 bp, Mus musculus
cacctcgctggccagtatgtggcct

SEQ ID NO: 223223 - DNA, 25 bp, Mus musculus
cacctcgctgtgttggacttccttg

SEQ ID NO: 223224 - DNA, 25 bp, Mus musculus
cacctcggaggtcccacccaggagt

SEQ ID NO: 223225 - DNA, 25 bp, Mus musculus
cacctcggcctctccatccgttccg

SEQ ID NO: 223226 - DNA, 25 bp, Mus musculus
cacctcggtgcaggctatctatgtg

SEQ ID NO: 223227 - DNA, 25 bp, Mus musculus
cacctctaaaggaggaagatgaggt

SEQ ID NO: 223228 - DNA, 25 bp, Mus musculus
cacctctaagagacgtggagctatt

SEQ ID NO: 223229 - DNA, 25 bp, Mus musculus
cacctctacaagtgacatcttgaaa

SEQ ID NO: 223230 - DNA, 25 bp, Mus musculus
cacctctacagatttcctccctcct

SEQ ID NO: 223231 - DNA, 25 bp, Mus musculus
cacctctagaggcctataccattca

SEQ ID NO: 223232 - DNA, 25 bp, Mus musculus
cacctctagagttgaccaagctgca

SEQ ID NO: 223233 - DNA, 25 bp, Mus musculus
cacctctcacagacagctcagctct

SEQ ID NO: 223234 - DNA, 25 bp, Mus musculus
cacctctcagaaaagttgtatggcg

SEQ ID NO: 223235 - DNA, 25 bp, Mus musculus
cacctctccagattcactaaaaact

SEQ ID NO: 223236 - DNA, 25 bp, Mus musculus
cacctctccagcgttccctgctggc

SEQ ID NO: 223237 - DNA, 25 bp, Mus musculus
cacctctccagtctctagataaggt

SEQ ID NO: 223238 - DNA, 25 bp, Mus musculus
cacctctcctggagtgtctgtgagg

SEQ ID NO: 223239 - DNA, 25 bp, Mus musculus
cacctctcctgggcctctgatacct

SEQ ID NO: 223240 - DNA, 25 bp, Mus musculus
cacctctcgggacggagatactact

SEQ ID NO: 223241 - DNA, 25 bp, Mus musculus
cacctctcgggacgggccctggtgg

SEQ ID NO: 223242 - DNA, 25 bp, Mus musculus
cacctctcgggacggttcaatgtat

SEQ ID NO: 223243 - DNA, 25 bp, Mus musculus
cacctctcgtcagatgtcgtcaccg

SEQ ID NO: 223244 - DNA, 25 bp, Mus musculus
cacctctcgtcaggactgcaagagg

SEQ ID NO: 223245 - DNA, 25 bp, Mus musculus
cacctctgagatacttggagatgaa

SEQ ID NO: 223246 - DNA, 25 bp, Mus musculus
cacctctgcaaaagattcacagtct

SEQ ID NO: 223247 - DNA, 25 bp, Mus musculus
cacctctgcaaaagcaatgtcttca

SEQ ID NO: 223248 - DNA, 25 bp, Mus musculus
cacctctgcagttacggacgagttt

SEQ ID NO: 223249 - DNA, 25 bp, Mus musculus
cacctctgctccgaggtctccaaaa

SEQ ID NO: 223250 - DNA, 25 bp, Mus musculus
cacctctggaaggggcgtatgatcc

SEQ ID NO: 223251 - DNA, 25 bp, Mus musculus
cacctctggaggctcctgctcctca

SEQ ID NO: 223252 - DNA, 25 bp, Mus musculus
cacctctgggaggacactgtgtggg

SEQ ID NO: 223253 - DNA, 25 bp, Mus musculus
cacctctgggagtttgtcctgggca

SEQ ID NO: 223254 - DNA, 25 bp, Mus musculus
cacctctgtccaccattccaaggaa

SEQ ID NO: 223255 - DNA, 25 bp, Mus musculus
cacctctgtggaggaaatcctgaag

SEQ ID NO: 223256 - DNA, 25 bp, Mus musculus
cacctcttccagacgctgaatcgca

SEQ ID NO: 223257 - DNA, 25 bp, Mus musculus
cacctcttccgaggacccacactca

SEQ ID NO: 223258 - DNA, 25 bp, Mus musculus
cacctcttctgtggttggagactag

SEQ ID NO: 223259 - DNA, 25 bp, Mus musculus
cacctcttctgttggccgtgtttac

SEQ ID NO: 223260 - DNA, 25 bp, Mus musculus
cacctcttgaaaatgtggagtgtga

SEQ ID NO: 223261 - DNA, 25 bp, Mus musculus
cacctcttgcaaaggtgacccttac

SEQ ID NO: 223262 - DNA, 25 bp, Mus musculus
cacctctttaaggcgtaccttctca

SEQ ID NO: 223263 - DNA, 25 bp, Mus musculus
cacctctttaagtatgcagcagatc

SEQ ID NO: 223264 - DNA, 25 bp, Mus musculus
cacctctttactctcagatagcctt

SEQ ID NO: 223265 - DNA, 25 bp, Mus musculus
cacctctttgcagatcttgatatgg

SEQ ID NO: 223266 - DNA, 25 bp, Mus musculus
cacctgaaaacagcaatgcagggac

SEQ ID NO: 223267 - DNA, 25 bp, Mus musculus
cacctgaaagcagaacctggtccac

SEQ ID NO: 223268 - DNA, 25 bp, Mus musculus
cacctgaacagtgagacggtttaag

SEQ ID NO: 223269 - DNA, 25 bp, Mus musculus
cacctgaacctgatatctgtcatga

SEQ ID NO: 223270 - DNA, 25 bp, Mus musculus
cacctgaaccttggcatgaataggt

SEQ ID NO: 223271 - DNA, 25 bp, Mus musculus
cacctgaaccttgggtggcttgtcc

SEQ ID NO: 223272 - DNA, 25 bp, Mus musculus
cacctgaatgcagattgaggatggg

SEQ ID NO: 223273 - DNA, 25 bp, Mus musculus
cacctgaatgcagtgacaagcatca

SEQ ID NO: 223274 - DNA, 25 bp, Mus musculus
cacctgacaaaggttctgggagagg

SEQ ID NO: 223275 - DNA, 25 bp, Mus musculus
cacctgacaggtcacaaccatgtcg

SEQ ID NO: 223276 - DNA, 25 bp, Mus musculus
cacctgacagtgaggatccaaagga

SEQ ID NO: 223277 - DNA, 25 bp, Mus musculus
cacctgacatctggcctacacagag

SEQ ID NO: 223278 - DNA, 25 bp, Mus musculus
cacctgacctgagataccatggcca

SEQ ID NO: 223279 - DNA, 25 bp, Mus musculus
cacctgagagccagagctgttctgc

SEQ ID NO: 223280 - DNA, 25 bp, Mus musculus
cacctgagagccagatatccattga

SEQ ID NO: 223281 - DNA, 25 bp, Mus musculus
cacctgagcctgctgctccagcctc

SEQ ID NO: 223282 - DNA, 25 bp, Mus musculus
cacctgagctggatgtaccctctgg

SEQ ID NO: 223283 - DNA, 25 bp, Mus musculus
cacctgataaaaagtatgtctacgt

SEQ ID NO: 223284 - DNA, 25 bp, Mus musculus
cacctgatagcatgtggcatgaacg

SEQ ID NO: 223285 - DNA, 25 bp, Mus musculus
cacctgatctaaggagattacctgg

SEQ ID NO: 223286 - DNA, 25 bp, Mus musculus
cacctgatgaatcccaaaggccctg

SEQ ID NO: 223287 - DNA, 25 bp, Mus musculus
cacctgatgagagtgttcgaggaat

SEQ ID NO: 223288 - DNA, 25 bp, Mus musculus
cacctgatgagccaggtctggacag

SEQ ID NO: 223289 - DNA, 25 bp, Mus musculus
cacctgcaagacagccccggattat

SEQ ID NO: 223290 - DNA, 25 bp, Mus musculus
cacctgcaagattctggtgctaaga

SEQ ID NO: 223291 - DNA, 25 bp, Mus musculus
cacctgcaagctacagacagccccg

SEQ ID NO: 223292 - DNA, 25 bp, Mus musculus
cacctgcaaggaatattgaagagat

SEQ ID NO: 223293 - DNA, 25 bp, Mus musculus
cacctgcaaggcatggcccagttca

SEQ ID NO: 223294 - DNA, 25 bp, Mus musculus
cacctgcaaggttcactttaattga

SEQ ID NO: 223295 - DNA, 25 bp, Mus musculus
cacctgcaagtctacagagagccag

SEQ ID NO: 223296 - DNA, 25 bp, Mus musculus
cacctgcacacataacaccaatgac

SEQ ID NO: 223297 - DNA, 25 bp, Mus musculus
cacctgcaccatcgccaagaacagc

SEQ ID NO: 223298 - DNA, 25 bp, Mus musculus
cacctgcaccccggagtatgatccc

SEQ ID NO: 223299 - DNA, 25 bp, Mus musculus
cacctgcagatgtccctgtccattg

SEQ ID NO: 223300 - DNA, 25 bp, Mus musculus
cacctgcagcccggacaagtgggcc

SEQ ID NO: 223301 - DNA, 25 bp, Mus musculus
cacctgcagctgcacgggcaggtgg

SEQ ID NO: 223302 - DNA, 25 bp, Mus musculus
cacctgcatgctgaccctgttggcc

SEQ ID NO: 223303 - DNA, 25 bp, Mus musculus
cacctgcatgctggctcttcatagc

SEQ ID NO: 223304 - DNA, 25 bp, Mus musculus
cacctgccaagactgtggccgcagg

SEQ ID NO: 223305 - DNA, 25 bp, Mus musculus
cacctgccaagcatgatgtcaaagt

SEQ ID NO: 223306 - DNA, 25 bp, Mus musculus
cacctgccaagcattgtggcagatg

SEQ ID NO: 223307 - DNA, 25 bp, Mus musculus
cacctgccaagcatttccctccagg

SEQ ID NO: 223308 - DNA, 25 bp, Mus musculus
cacctgccaatgttctctcgggagc

SEQ ID NO: 223309 - DNA, 25 bp, Mus musculus
cacctgccacgctccagtggcttct

SEQ ID NO: 223310 - DNA, 25 bp, Mus musculus
cacctgccagacgcacagccgagcc

SEQ ID NO: 223311 - DNA, 25 bp, Mus musculus
cacctgccaggccacagacctcccc

SEQ ID NO: 223312 - DNA, 25 bp, Mus musculus
cacctgccaggtaagaagaaaatac

SEQ ID NO: 223313 - DNA, 25 bp, Mus musculus
cacctgccccaaagacattctgccc

SEQ ID NO: 223314 - DNA, 25 bp, Mus musculus
cacctgccggctgcgaccgagggcc

SEQ ID NO: 223315 - DNA, 25 bp, Mus musculus
cacctgccgggcagcgagtcatcct

SEQ ID NO: 223316 - DNA, 25 bp, Mus musculus
cacctgcctcctcagaagactcaga

SEQ ID NO: 223317 - DNA, 25 bp, Mus musculus
cacctgcctgccgagcaatgccaag

SEQ ID NO: 223318 - DNA, 25 bp, Mus musculus
cacctgcctgttacaggtctgcagc

SEQ ID NO: 223319 - DNA, 25 bp, Mus musculus
cacctgccttccagtgtgtggacag

SEQ ID NO: 223320 - DNA, 25 bp, Mus musculus
cacctgccttccagtgtgtggtgtc

SEQ ID NO: 223321 - DNA, 25 bp, Mus musculus
cacctgcgagcaagggtctctgata

SEQ ID NO: 223322 - DNA, 25 bp, Mus musculus
cacctgcgagcaaggtccttccata

SEQ ID NO: 223323 - DNA, 25 bp, Mus musculus
cacctgcgcgacaggttttggctcg

SEQ ID NO: 223324 - DNA, 25 bp, Mus musculus
cacctgctaccccggcaaagctgtt

SEQ ID NO: 223325 - DNA, 25 bp, Mus musculus
cacctgctccagcggggactctggc

SEQ ID NO: 223326 - DNA, 25 bp, Mus musculus
cacctgctctatgtgctgatggagc

SEQ ID NO: 223327 - DNA, 25 bp, Mus musculus
cacctgctgcagaatcaagctatag

SEQ ID NO: 223328 - DNA, 25 bp, Mus musculus
cacctgctgctccaggaaattgcca

SEQ ID NO: 223329 - DNA, 25 bp, Mus musculus
cacctgcttgcagacctgatgcaac

SEQ ID NO: 223330 - DNA, 25 bp, Mus musculus
cacctgcttgcaggcgatcctaaag

SEQ ID NO: 223331 - DNA, 25 bp, Mus musculus
cacctgcttgcaggtggctttgctg

SEQ ID NO: 223332 - DNA, 25 bp, Mus musculus
cacctgcttggagtacaaggttctg

SEQ ID NO: 223333 - DNA, 25 bp, Mus musculus
cacctggaagaaggtcaagcactct

SEQ ID NO: 223334 - DNA, 25 bp, Mus musculus
cacctggaagaagtgcatgctttct

SEQ ID NO: 223335 - DNA, 25 bp, Mus musculus
cacctggaagacaaggggctgcact

SEQ ID NO: 223336 - DNA, 25 bp, Mus musculus
cacctggaagacaagtgcctggagc

SEQ ID NO: 223337 - DNA, 25 bp, Mus musculus
cacctggaagacaagttgctgtctc

SEQ ID NO: 223338 - DNA, 25 bp, Mus musculus
cacctggaagaccgatgctgtgacc

SEQ ID NO: 223339 - DNA, 25 bp, Mus musculus
cacctggaagatgctggagaccatc

SEQ ID NO: 223340 - DNA, 25 bp, Mus musculus
cacctggaagctgaactcccacctc

SEQ ID NO: 223341 - DNA, 25 bp, Mus musculus
cacctggaagctgtggtgtacctgc

SEQ ID NO: 223342 - DNA, 25 bp, Mus musculus
cacctggaaggcagccagagtaaca

SEQ ID NO: 223343 - DNA, 25 bp, Mus musculus
cacctggaaggcctccccaggagaa

SEQ ID NO: 223344 - DNA, 25 bp, Mus musculus
cacctggaaggtatgacattatgaa

SEQ ID NO: 223345 - DNA, 25 bp, Mus musculus
cacctggaagtcccctcctggccag

SEQ ID NO: 223346 - DNA, 25 bp, Mus musculus
cacctggaagtcttccccaggccaa

SEQ ID NO: 223347 - DNA, 25 bp, Mus musculus
cacctggacaagcctccattaacct

SEQ ID NO: 223348 - DNA, 25 bp, Mus musculus
cacctggacaagctgatgccttcac

SEQ ID NO: 223349 - DNA, 25 bp, Mus musculus
cacctggacaggacaatgtatcttc

SEQ ID NO: 223350 - DNA, 25 bp, Mus musculus
cacctggacaggtcggaagctggtc

SEQ ID NO: 223351 - DNA, 25 bp, Mus musculus
cacctggaccagatggcttcctgtt

SEQ ID NO: 223352 - DNA, 25 bp, Mus musculus
cacctggacctaaagcctgagaata

SEQ ID NO: 223353 - DNA, 25 bp, Mus musculus
cacctggacgcacaggcctcctgtg

SEQ ID NO: 223354 - DNA, 25 bp, Mus musculus
cacctggagacaagctacgcatgga

SEQ ID NO: 223355 - DNA, 25 bp, Mus musculus
cacctggagacaatacgcatggagt

SEQ ID NO: 223356 - DNA, 25 bp, Mus musculus
cacctggagacgagagctggcattc

SEQ ID NO: 223357 - DNA, 25 bp, Mus musculus
cacctggagagcatcttcctggtca

SEQ ID NO: 223358 - DNA, 25 bp, Mus musculus
cacctggagatctgcctgtcaatga

SEQ ID NO: 223359 - DNA, 25 bp, Mus musculus
cacctggatggatgctgcaagcaga

SEQ ID NO: 223360 - DNA, 25 bp, Mus musculus
cacctggatggggttcatgttgttt

SEQ ID NO: 223361 - DNA, 25 bp, Mus musculus
cacctggattcagtggcgccgacat

SEQ ID NO: 223362 - DNA, 25 bp, Mus musculus
cacctggattcagtgggcagagcca

SEQ ID NO: 223363 - DNA, 25 bp, Mus musculus
cacctggcaagagaaatgtctcagg

SEQ ID NO: 223364 - DNA, 25 bp, Mus musculus
cacctggcaagcttcacatggagtg

SEQ ID NO: 223365 - DNA, 25 bp, Mus musculus
cacctggcagccagatgaggatgat

SEQ ID NO: 223366 - DNA, 25 bp, Mus musculus
cacctggcataaggccactcagaag

SEQ ID NO: 223367 - DNA, 25 bp, Mus musculus
cacctggccaaagggtcattatcgt

SEQ ID NO: 223368 - DNA, 25 bp, Mus musculus
cacctggccaaaggtcagcctccaa

SEQ ID NO: 223369 - DNA, 25 bp, Mus musculus
cacctggccaaaggtcggacatcaa

SEQ ID NO: 223370 - DNA, 25 bp, Mus musculus
cacctggcgctcgagcacgggtcgt

SEQ ID NO: 223371 - DNA, 25 bp, Mus musculus
cacctggctattgacaagaaggctt

SEQ ID NO: 223372 - DNA, 25 bp, Mus musculus
cacctggctattgactccacggctg

SEQ ID NO: 223373 - DNA, 25 bp, Mus musculus
cacctggctgagttcactcacgtgg

SEQ ID NO: 223374 - DNA, 25 bp, Mus musculus
cacctgggactgaagactcggatga

SEQ ID NO: 223375 - DNA, 25 bp, Mus musculus
cacctgggagaacagatacaaagga

SEQ ID NO: 223376 - DNA, 25 bp, Mus musculus
cacctgggcacagcattgatctggt

SEQ ID NO: 223377 - DNA, 25 bp, Mus musculus
cacctggggcagggaagaggtgcca

SEQ ID NO: 223378 - DNA, 25 bp, Mus musculus
cacctggtatctggttggcagatat

SEQ ID NO: 223379 - DNA, 25 bp, Mus musculus
cacctggtcagtgagcctggaggcc

SEQ ID NO: 223380 - DNA, 25 bp, Mus musculus
cacctggtgctaagggtgaagctgg

SEQ ID NO: 223381 - DNA, 25 bp, Mus musculus
cacctggtgggcaccccaggtgaaa

SEQ ID NO: 223382 - DNA, 25 bp, Mus musculus
cacctgtaaggtagaaatttacaag

SEQ ID NO: 223383 - DNA, 25 bp, Mus musculus
cacctgtaaggtctctagcatcaac

SEQ ID NO: 223384 - DNA, 25 bp, Mus musculus
cacctgtagcaccactctcgctcac

SEQ ID NO: 223385 - DNA, 25 bp, Mus musculus
cacctgtagcacccctctactcaat

SEQ ID NO: 223386 - DNA, 25 bp, Mus musculus
cacctgtcagaaccacccccgccag

SEQ ID NO: 223387 - DNA, 25 bp, Mus musculus
cacctgtcagacaccactaactgta

SEQ ID NO: 223388 - DNA, 25 bp, Mus musculus
cacctgtcagacccgccaggagttg

SEQ ID NO: 223389 - DNA, 25 bp, Mus musculus
cacctgtcagacgagaagaacgggc

SEQ ID NO: 223390 - DNA, 25 bp, Mus musculus
cacctgtcaggagaacagccagtcc

SEQ ID NO: 223391 - DNA, 25 bp, Mus musculus
cacctgtcaggagatcttcctgtgg

SEQ ID NO: 223392 - DNA, 25 bp, Mus musculus
cacctgtccaggcgtttcttttgaa

SEQ ID NO: 223393 - DNA, 25 bp, Mus musculus
cacctgtcgcccatattttaatatc

SEQ ID NO: 223394 - DNA, 25 bp, Mus musculus
cacctgtcgcccctgagtgcaatat

SEQ ID NO: 223395 - DNA, 25 bp, Mus musculus
cacctgtctgcttggagccctgcac

SEQ ID NO: 223396 - DNA, 25 bp, Mus musculus
cacctgtgagcaggagccagaggaa

SEQ ID NO: 223397 - DNA, 25 bp, Mus musculus
cacctgtgaggtttcaagtgcccca

SEQ ID NO: 223398 - DNA, 25 bp, Mus musculus
cacctgtgccactaccccacagcgg

SEQ ID NO: 223399 - DNA, 25 bp, Mus musculus
cacctgtgcctcagggtgacagaac

SEQ ID NO: 223400 - DNA, 25 bp, Mus musculus
cacctgtgcctcagggttgcagtaa

SEQ ID NO: 223401 - DNA, 25 bp, Mus musculus
cacctgtgcctcaggttgccctctg

SEQ ID NO: 223402 - DNA, 25 bp, Mus musculus
cacctgtgctcaagttactgggcct

SEQ ID NO: 223403 - DNA, 25 bp, Mus musculus
cacctgttacctgggcccccagatt

SEQ ID NO: 223404 - DNA, 25 bp, Mus musculus
cacctgttaggaaagaatcttcaag

SEQ ID NO: 223405 - DNA, 25 bp, Mus musculus
cacctgttccagaagttggcatcgc

SEQ ID NO: 223406 - DNA, 25 bp, Mus musculus
cacctgttgcaggcatgatgggtgg

SEQ ID NO: 223407 - DNA, 25 bp, Mus musculus
cacctgttgtgcagagttgtcttgg

SEQ ID NO: 223408 - DNA, 25 bp, Mus musculus
cacctgtttgtaaaagtaaaggagt

SEQ ID NO: 223409 - DNA, 25 bp, Mus musculus
cacctgtttgtaaaattccttctga

SEQ ID NO: 223410 - DNA, 25 bp, Mus musculus
caccttaaaactctgcgaggcagag

SEQ ID NO: 223411 - DNA, 25 bp, Mus musculus
caccttaaagagcatgaaagccaaa

SEQ ID NO: 223412 - DNA, 25 bp, Mus musculus
caccttaaagagcatggacggagat

SEQ ID NO: 223413 - DNA, 25 bp, Mus musculus
caccttaacgctgttggtcagaaaa

SEQ ID NO: 223414 - DNA, 25 bp, Mus musculus
caccttaaggatgtggtccttctgg

SEQ ID NO: 223415 - DNA, 25 bp, Mus musculus
caccttacagttaaggaagctgtgc

SEQ ID NO: 223416 - DNA, 25 bp, Mus musculus
caccttagagctggtgtgtctccag

SEQ ID NO: 223417 - DNA, 25 bp, Mus musculus
caccttagatgatgtgaacgagatt

SEQ ID NO: 223418 - DNA, 25 bp, Mus musculus
caccttagccagtccaaactgaaga

SEQ ID NO: 223419 - DNA, 25 bp, Mus musculus
caccttaggagtgtaaagagctggc

SEQ ID NO: 223420 - DNA, 25 bp, Mus musculus
caccttatcaagcactggagggcag

SEQ ID NO: 223421 - DNA, 25 bp, Mus musculus
caccttatcaaggctcagaggcaca

SEQ ID NO: 223422 - DNA, 25 bp, Mus musculus
caccttatgaacatggtgaagtatt

SEQ ID NO: 223423 - DNA, 25 bp, Mus musculus
caccttcaagctggatcttctatcg

SEQ ID NO: 223424 - DNA, 25 bp, Mus musculus
caccttcaagctgggtgcgcatggt

SEQ ID NO: 223425 - DNA, 25 bp, Mus musculus
caccttcaagtacagagatgaactc

SEQ ID NO: 223426 - DNA, 25 bp, Mus musculus
caccttcagcagagcaggaagatcc

SEQ ID NO: 223427 - DNA, 25 bp, Mus musculus
caccttcatggagaaggtgcaccgt

SEQ ID NO: 223428 - DNA, 25 bp, Mus musculus
caccttccagaactctgcagcccct

SEQ ID NO: 223429 - DNA, 25 bp, Mus musculus
caccttccagactcagaactttcgt

SEQ ID NO: 223430 - DNA, 25 bp, Mus musculus
caccttccaggctcaaactaccatc

SEQ ID NO: 223431 - DNA, 25 bp, Mus musculus
caccttccatcctatatagtctaca

SEQ ID NO: 223432 - DNA, 25 bp, Mus musculus
caccttcccacagcatcgccaaatg

SEQ ID NO: 223433 - DNA, 25 bp, Mus musculus
caccttcccacaggtctgcctctct

SEQ ID NO: 223434 - DNA, 25 bp, Mus musculus
caccttcccttacatgaagtcgatg

SEQ ID NO: 223435 - DNA, 25 bp, Mus musculus
caccttccgagaactccgtgcaaga

SEQ ID NO: 223436 - DNA, 25 bp, Mus musculus
caccttccgccagtttcgtgatcct

SEQ ID NO: 223437 - DNA, 25 bp, Mus musculus
caccttccggcagaaaggtgttgga

SEQ ID NO: 223438 - DNA, 25 bp, Mus musculus
caccttccgtgagaagtttatgcag

SEQ ID NO: 223439 - DNA, 25 bp, Mus musculus
caccttcctccggcatgagatcgcc

SEQ ID NO: 223440 - DNA, 25 bp, Mus musculus
caccttcctcctgcaacagaatggg

SEQ ID NO: 223441 - DNA, 25 bp, Mus musculus
caccttcctcctggcaggccaaaag

SEQ ID NO: 223442 - DNA, 25 bp, Mus musculus
caccttccttggcggcagaacccgg

SEQ ID NO: 223443 - DNA, 25 bp, Mus musculus
caccttctaacagtgctgctgaagc

SEQ ID NO: 223444 - DNA, 25 bp, Mus musculus
caccttctacaattcccagcgacac

SEQ ID NO: 223445 - DNA, 25 bp, Mus musculus
caccttctacagaaaaccgtcaagg

SEQ ID NO: 223446 - DNA, 25 bp, Mus musculus
caccttctacgacggggtggagtcg

SEQ ID NO: 223447 - DNA, 25 bp, Mus musculus
caccttctacgctgtggaggtgagt

SEQ ID NO: 223448 - DNA, 25 bp, Mus musculus
caccttctcagagagacctgcttct

SEQ ID NO: 223449 - DNA, 25 bp, Mus musculus
caccttctctctcttcctcctggcc

SEQ ID NO: 223450 - DNA, 25 bp, Mus musculus
caccttctgaagattccgagaggca

SEQ ID NO: 223451 - DNA, 25 bp, Mus musculus
caccttctgcagcaaatctcccgga

SEQ ID NO: 223452 - DNA, 25 bp, Mus musculus
caccttctgtcagacatgtgtaatt

SEQ ID NO: 223453 - DNA, 25 bp, Mus musculus
caccttctgtcagctggcatgtggc

SEQ ID NO: 223454 - DNA, 25 bp, Mus musculus
caccttctgtcaggtccccctggcc

SEQ ID NO: 223455 - DNA, 25 bp, Mus musculus
caccttcttaacaaggcacctaatt

SEQ ID NO: 223456 - DNA, 25 bp, Mus musculus
caccttcttaacaaggtgcagatca

SEQ ID NO: 223457 - DNA, 25 bp, Mus musculus
caccttcttgaaccaccaggcctca

SEQ ID NO: 223458 - DNA, 25 bp, Mus musculus
caccttctttaagagaagaatgtgg

SEQ ID NO: 223459 - DNA, 25 bp, Mus musculus
caccttcttttgcttctgcagtgag

SEQ ID NO: 223460 - DNA, 25 bp, Mus musculus
caccttcttttggcgtgcccacact

SEQ ID NO: 223461 - DNA, 25 bp, Mus musculus
caccttgaagatccttcgtacctac

SEQ ID NO: 223462 - DNA, 25 bp, Mus musculus
caccttgaagcactgagccctccag

SEQ ID NO: 223463 - DNA, 25 bp, Mus musculus
caccttgaagcactgagccctcccc

SEQ ID NO: 223464 - DNA, 25 bp, Mus musculus
caccttgaccatcaggactcttccc

SEQ ID NO: 223465 - DNA, 25 bp, Mus musculus
caccttgactcagtacgtcaagtgg

SEQ ID NO: 223466 - DNA, 25 bp, Mus musculus
caccttgagagggttttatggacac

SEQ ID NO: 223467 - DNA, 25 bp, Mus musculus
caccttgaggcctttcttccaggtc

SEQ ID NO: 223468 - DNA, 25 bp, Mus musculus
caccttgagggaagtaaccaggagc

SEQ ID NO: 223469 - DNA, 25 bp, Mus musculus
caccttgagggtcctgagtccccta

SEQ ID NO: 223470 - DNA, 25 bp, Mus musculus
caccttgatcagagtattgttacag

SEQ ID NO: 223471 - DNA, 25 bp, Mus musculus
caccttgcaaagcctttcccaactg

SEQ ID NO: 223472 - DNA, 25 bp, Mus musculus
caccttgccaggttctgccttagat

SEQ ID NO: 223473 - DNA, 25 bp, Mus musculus
caccttgcccgaaacaaccacaaca

SEQ ID NO: 223474 - DNA, 25 bp, Mus musculus
caccttgctgtgccctcacgctcca

SEQ ID NO: 223475 - DNA, 25 bp, Mus musculus
caccttggagaagataaaaatatat

SEQ ID NO: 223476 - DNA, 25 bp, Mus musculus
caccttggagaagattgctggcctc

SEQ ID NO: 223477 - DNA, 25 bp, Mus musculus
caccttggagagaatatgtttgaca

SEQ ID NO: 223478 - DNA, 25 bp, Mus musculus
caccttggagccgggagttgataca

SEQ ID NO: 223479 - DNA, 25 bp, Mus musculus
caccttggccaccacacagagtcat

SEQ ID NO: 223480 - DNA, 25 bp, Mus musculus
caccttggccaccactcctaatagt

SEQ ID NO: 223481 - DNA, 25 bp, Mus musculus
caccttggccaccagagatcgagac

SEQ ID NO: 223482 - DNA, 25 bp, Mus musculus
caccttggccaccattgcaagtact

SEQ ID NO: 223483 - DNA, 25 bp, Mus musculus
caccttggccaccattgcctcaact

SEQ ID NO: 223484 - DNA, 25 bp, Mus musculus
caccttgggccagattgtgtcacaa

SEQ ID NO: 223485 - DNA, 25 bp, Mus musculus
caccttgggccaggctgctgtagaa

SEQ ID NO: 223486 - DNA, 25 bp, Mus musculus
caccttggtggaacactctggacgt

SEQ ID NO: 223487 - DNA, 25 bp, Mus musculus
caccttgtgtcaagggaaaagatgc

SEQ ID NO: 223488 - DNA, 25 bp, Mus musculus
caccttgttagtaagcacagtacag

SEQ ID NO: 223489 - DNA, 25 bp, Mus musculus
cacctttaccagcggcactcagtcc

SEQ ID NO: 223490 - DNA, 25 bp, Mus musculus
cacctttagagggtctgatatgccg

SEQ ID NO: 223491 - DNA, 25 bp, Mus musculus
cacctttcagggaagccagctgcac

SEQ ID NO: 223492 - DNA, 25 bp, Mus musculus
cacctttccaaaggagttgaagcag

SEQ ID NO: 223493 - DNA, 25 bp, Mus musculus
cacctttcctcagatttcctccctc

SEQ ID NO: 223494 - DNA, 25 bp, Mus musculus
cacctttcctgcagtatcaggagtg

SEQ ID NO: 223495 - DNA, 25 bp, Mus musculus
cacctttctcagtacattcgctcag

SEQ ID NO: 223496 - DNA, 25 bp, Mus musculus
cacctttctgtccttggggatgggc

SEQ ID NO: 223497 - DNA, 25 bp, Mus musculus
cacctttgaagactcggtgtggaag

SEQ ID NO: 223498 - DNA, 25 bp, Mus musculus
cacctttgagatgacagagacacag

SEQ ID NO: 223499 - DNA, 25 bp, Mus musculus
cacctttgaggaaaccaggaaaatg

SEQ ID NO: 223500 - DNA, 25 bp, Mus musculus
cacctttgagtgactgccaggatct

SEQ ID NO: 223501 - DNA, 25 bp, Mus musculus
cacctttgatgagatatgtgtcaca

SEQ ID NO: 223502 - DNA, 25 bp, Mus musculus
cacctttgcaatcgatggcagctca

SEQ ID NO: 223503 - DNA, 25 bp, Mus musculus
cacctttgctttccagaatgggcaa

SEQ ID NO: 223504 - DNA, 25 bp, Mus musculus
cacctttgctttccatgggtcccac

SEQ ID NO: 223505 - DNA, 25 bp, Mus musculus
cacctttggaaggttattatgttgt

SEQ ID NO: 223506 - DNA, 25 bp, Mus musculus
caccttttaaaggctgctggcaccc

SEQ ID NO: 223507 - DNA, 25 bp, Mus musculus
caccttttattctctcttgcctaga

SEQ ID NO: 223508 - DNA, 25 bp, Mus musculus
caccttttttcaagctatcagagat

SEQ ID NO: 223509 - DNA, 25 bp, Mus musculus
caccttttttcaaggatgttaatta

SEQ ID NO: 223510 - DNA, 25 bp, Mus musculus
cacgaaacaccagctgcgatactat

SEQ ID NO: 223511 - DNA, 25 bp, Mus musculus
cacgaaagaaaggccagagggagga

SEQ ID NO: 223512 - DNA, 25 bp, Mus musculus
cacgaaagttgcaggatgtgtttga

SEQ ID NO: 223513 - DNA, 25 bp, Mus musculus
cacgaaatgaggacaagctactgca

SEQ ID NO: 223514 - DNA, 25 bp, Mus musculus
cacgaacgcagggcactgcagaagt

SEQ ID NO: 223515 - DNA, 25 bp, Mus musculus
cacgaactacaggaagagagagtca

SEQ ID NO: 223516 - DNA, 25 bp, Mus musculus
cacgaactgggtgactttgccatgc

SEQ ID NO: 223517 - DNA, 25 bp, Mus musculus
cacgaactgggtgcagccctggggg

SEQ ID NO: 223518 - DNA, 25 bp, Mus musculus
cacgaagaagactggaaacagcaaa

SEQ ID NO: 223519 - DNA, 25 bp, Mus musculus
cacgaagaagcctcagcaaaagaag

SEQ ID NO: 223520 - DNA, 25 bp, Mus musculus
cacgaagagataggtgatttcagac

SEQ ID NO: 223521 - DNA, 25 bp, Mus musculus
cacgaagatgtgcagaaagacgctc

SEQ ID NO: 223522 - DNA, 25 bp, Mus musculus
cacgaagatgtgcaggtcttgcctc

SEQ ID NO: 223523 - DNA, 25 bp, Mus musculus
cacgaagcaataagtcctatgaatc

SEQ ID NO: 223524 - DNA, 25 bp, Mus musculus
cacgaagcacagctgtgacgagctg

SEQ ID NO: 223525 - DNA, 25 bp, Mus musculus
cacgaagccagaaggaggctcgcat

SEQ ID NO: 223526 - DNA, 25 bp, Mus musculus
cacgaagctgctgagggccttgcgg

SEQ ID NO: 223527 - DNA, 25 bp, Mus musculus
cacgaaggatcttaccaatcctggg

SEQ ID NO: 223528 - DNA, 25 bp, Mus musculus
cacgaaggatcttttttgctccaga

SEQ ID NO: 223529 - DNA, 25 bp, Mus musculus
cacgaaggccagcagctctgcggag

SEQ ID NO: 223530 - DNA, 25 bp, Mus musculus
cacgaagggagatgatgatgaggaa

SEQ ID NO: 223531 - DNA, 25 bp, Mus musculus
cacgaagtagtttttgacagaaaat

SEQ ID NO: 223532 - DNA, 25 bp, Mus musculus
cacgaagtcacgagcttcgttaccc

SEQ ID NO: 223533 - DNA, 25 bp, Mus musculus
cacgaattgcagcatttgctgatgc

SEQ ID NO: 223534 - DNA, 25 bp, Mus musculus
cacgacaggaaatgcttgcccctaa

SEQ ID NO: 223535 - DNA, 25 bp, Mus musculus
cacgacaggaaatggctctctgcta

SEQ ID NO: 223536 - DNA, 25 bp, Mus musculus
cacgaccaagaagcttcgttacact

SEQ ID NO: 223537 - DNA, 25 bp, Mus musculus
cacgacccaaggaggcaagtgttta

SEQ ID NO: 223538 - DNA, 25 bp, Mus musculus
cacgacccaagtggcagcaatgttc

SEQ ID NO: 223539 - DNA, 25 bp, Mus musculus
cacgaccgtccggtgcgtataactg

SEQ ID NO: 223540 - DNA, 25 bp, Mus musculus
cacgaccgtccggtgttctggctga

SEQ ID NO: 223541 - DNA, 25 bp, Mus musculus
cacgaccttggacgtaccatgcggg

SEQ ID NO: 223542 - DNA, 25 bp, Mus musculus
cacgacgaaggaccccttctcctcc

SEQ ID NO: 223543 - DNA, 25 bp, Mus musculus
cacgacgacgacagtttcagccctc

SEQ ID NO: 223544 - DNA, 25 bp, Mus musculus
cacgacggcacagagctcctggcca

SEQ ID NO: 223545 - DNA, 25 bp, Mus musculus
cacgactccgtgaacgctctcactc

SEQ ID NO: 223546 - DNA, 25 bp, Mus musculus
cacgactgctgatgaagtgactgag

SEQ ID NO: 223547 - DNA, 25 bp, Mus musculus
cacgactgtgaagggaagacatgtg

SEQ ID NO: 223548 - DNA, 25 bp, Mus musculus
cacgactgtgaagttagtagaaaaa

SEQ ID NO: 223549 - DNA, 25 bp, Mus musculus
cacgacttcgagcaggacaatccca

SEQ ID NO: 223550 - DNA, 25 bp, Mus musculus
cacgacttggctctgctgcgcctgc

SEQ ID NO: 223551 - DNA, 25 bp, Mus musculus
cacgagaaatgaaggactgcagtaa

SEQ ID NO: 223552 - DNA, 25 bp, Mus musculus
cacgagaacagcgactactgtgaag

SEQ ID NO: 223553 - DNA, 25 bp, Mus musculus
cacgagaagaagagctgaagggtct

SEQ ID NO: 223554 - DNA, 25 bp, Mus musculus
cacgagaagaaggtgatggatgggg

SEQ ID NO: 223555 - DNA, 25 bp, Mus musculus
cacgagaaggagctgatcgaagcgt

SEQ ID NO: 223556 - DNA, 25 bp, Mus musculus
cacgagaaggagctgccaaggcggc

SEQ ID NO: 223557 - DNA, 25 bp, Mus musculus
cacgagaattctcaggtcctctttc

SEQ ID NO: 223558 - DNA, 25 bp, Mus musculus
cacgagacagaagcaccattgcaag

SEQ ID NO: 223559 - DNA, 25 bp, Mus musculus
cacgagaggacaatagccttaaaga

SEQ ID NO: 223560 - DNA, 25 bp, Mus musculus
cacgagagtgagttccaggacagcc

SEQ ID NO: 223561 - DNA, 25 bp, Mus musculus
cacgagatgatggattatctattat

SEQ ID NO: 223562 - DNA, 25 bp, Mus musculus
cacgagcaagagtactgtttggcag

SEQ ID NO: 223563 - DNA, 25 bp, Mus musculus
cacgagcacacagatggagtgatca

SEQ ID NO: 223564 - DNA, 25 bp, Mus musculus
cacgagcacacaggagagaccttct

SEQ ID NO: 223565 - DNA, 25 bp, Mus musculus
cacgagcgctcaggagaaatatgaa

SEQ ID NO: 223566 - DNA, 25 bp, Mus musculus
cacgagctggagtgagcaaaccaac

SEQ ID NO: 223567 - DNA, 25 bp, Mus musculus
cacgaggaacctttcacgatgacag

SEQ ID NO: 223568 - DNA, 25 bp, Mus musculus
cacgaggaccctcaggtttgatgaa

SEQ ID NO: 223569 - DNA, 25 bp, Mus musculus
cacgaggagctgggccaggagctga

SEQ ID NO: 223570 - DNA, 25 bp, Mus musculus
cacgaggagtcttcctgtagaaatg

SEQ ID NO: 223571 - DNA, 25 bp, Mus musculus
cacgaggatcccaggaaagaaaagt

SEQ ID NO: 223572 - DNA, 25 bp, Mus musculus
cacgaggatcccagtcaggaaccag

SEQ ID NO: 223573 - DNA, 25 bp, Mus musculus
cacgaggcaatcaagtattctgaga

SEQ ID NO: 223574 - DNA, 25 bp, Mus musculus
cacgaggccagatacctgactgtca

SEQ ID NO: 223575 - DNA, 25 bp, Mus musculus
cacgaggctcttcaggtgctccaat

SEQ ID NO: 223576 - DNA, 25 bp, Mus musculus
cacgagggcgaggctcggctattag

SEQ ID NO: 223577 - DNA, 25 bp, Mus musculus
cacgagggcgcggtgtggacaaatg

SEQ ID NO: 223578 - DNA, 25 bp, Mus musculus
cacgagtccggggaagtgtgtttaa

SEQ ID NO: 223579 - DNA, 25 bp, Mus musculus
cacgagtgccaaaggtgtgactgca

SEQ ID NO: 223580 - DNA, 25 bp, Mus musculus
cacgagtgcctgcaggatcggaacg

SEQ ID NO: 223581 - DNA, 25 bp, Mus musculus
cacgagtttcaggctccatttggaa

SEQ ID NO: 223582 - DNA, 25 bp, Mus musculus
cacgatagcatacctgtatgaccgg

SEQ ID NO: 223583 - DNA, 25 bp, Mus musculus
cacgatccaggtcagagcagcaggg

SEQ ID NO: 223584 - DNA, 25 bp, Mus musculus
cacgatccaggtgttcactggggcc

SEQ ID NO: 223585 - DNA, 25 bp, Mus musculus
cacgatcctgacatgactgacttac

SEQ ID NO: 223586 - DNA, 25 bp, Mus musculus
cacgatctggagatgaaaccaataa

SEQ ID NO: 223587 - DNA, 25 bp, Mus musculus
cacgatctggatatgatgaatggat

SEQ ID NO: 223588 - DNA, 25 bp, Mus musculus
cacgatgaacttggtaagttctcgt

SEQ ID NO: 223589 - DNA, 25 bp, Mus musculus
cacgatgagcactctagttctgaca

SEQ ID NO: 223590 - DNA, 25 bp, Mus musculus
cacgatgagcactcttgtcccttta

SEQ ID NO: 223591 - DNA, 25 bp, Mus musculus
cacgatgataaagagaaacttttag

SEQ ID NO: 223592 - DNA, 25 bp, Mus musculus
cacgatgataaagagatgagacctg

SEQ ID NO: 223593 - DNA, 25 bp, Mus musculus
cacgatgctccagattctgtcccct

SEQ ID NO: 223594 - DNA, 25 bp, Mus musculus
cacgatgctccaggaggagcctgat

SEQ ID NO: 223595 - DNA, 25 bp, Mus musculus
cacgatggaagcagaaaccagtgac

SEQ ID NO: 223596 - DNA, 25 bp, Mus musculus
cacgatggaagctcagctgccaact

SEQ ID NO: 223597 - DNA, 25 bp, Mus musculus
cacgatgtaaccagcctcaggagtt

SEQ ID NO: 223598 - DNA, 25 bp, Mus musculus
cacgatgtgctggatttccacttaa

SEQ ID NO: 223599 - DNA, 25 bp, Mus musculus
cacgatgtgtggaaattctctgcac

SEQ ID NO: 223600 - DNA, 25 bp, Mus musculus
cacgatgttaaagctgtctgctccc

SEQ ID NO: 223601 - DNA, 25 bp, Mus musculus
cacgattcacgaggtcctgtaataa

SEQ ID NO: 223602 - DNA, 25 bp, Mus musculus
cacgatttgtgaagatatagatgag

SEQ ID NO: 223603 - DNA, 25 bp, Mus musculus
cacgcaactgatttagatgaaaaaa

SEQ ID NO: 223604 - DNA, 25 bp, Mus musculus
cacgcacaggaaatcccaatggcaa

SEQ ID NO: 223605 - DNA, 25 bp, Mus musculus
cacgcaccagtggtatgtgtgcaac

SEQ ID NO: 223606 - DNA, 25 bp, Mus musculus
cacgcaccatacaggatactgggaa

SEQ ID NO: 223607 - DNA, 25 bp, Mus musculus
cacgcacgaaaaacactctgtttcc

SEQ ID NO: 223608 - DNA, 25 bp, Mus musculus
cacgcactcactgtcctgagagggt

SEQ ID NO: 223609 - DNA, 25 bp, Mus musculus
cacgcactgcaagaaaacgaggagg

SEQ ID NO: 223610 - DNA, 25 bp, Mus musculus
cacgcactgcaagatctagatggcg

SEQ ID NO: 223611 - DNA, 25 bp, Mus musculus
cacgcagacagtggacatttggtcc

SEQ ID NO: 223612 - DNA, 25 bp, Mus musculus
cacgcagactagcatttcagatctg

SEQ ID NO: 223613 - DNA, 25 bp, Mus musculus
cacgcagatgaggattgagctccgg

SEQ ID NO: 223614 - DNA, 25 bp, Mus musculus
cacgcagcatgcttccctagcgttt

SEQ ID NO: 223615 - DNA, 25 bp, Mus musculus
cacgcagcatgggctccggctggaa

SEQ ID NO: 223616 - DNA, 25 bp, Mus musculus
cacgcagccgcaaagaatggctata

SEQ ID NO: 223617 - DNA, 25 bp, Mus musculus
cacgcagcctccaggaggcaaggat

SEQ ID NO: 223618 - DNA, 25 bp, Mus musculus
cacgcagccttcaggctcagttctg

SEQ ID NO: 223619 - DNA, 25 bp, Mus musculus
cacgcagcgctcgaaagaatagact

SEQ ID NO: 223620 - DNA, 25 bp, Mus musculus
cacgcaggatcatgtgttcaacatg

SEQ ID NO: 223621 - DNA, 25 bp, Mus musculus
cacgcaggatggacctctctacgtc

SEQ ID NO: 223622 - DNA, 25 bp, Mus musculus
cacgcaggatgtgtatccatcgaga

SEQ ID NO: 223623 - DNA, 25 bp, Mus musculus
cacgcagtccgaggtcgccatggat

SEQ ID NO: 223624 - DNA, 25 bp, Mus musculus
cacgcagtgtggcttgacctcagag

SEQ ID NO: 223625 - DNA, 25 bp, Mus musculus
cacgcatcgagggggctacccgact

SEQ ID NO: 223626 - DNA, 25 bp, Mus musculus
cacgcatgccaggttggcctgcttg

SEQ ID NO: 223627 - DNA, 25 bp, Mus musculus
cacgcatggtgacatggtcccggaa

SEQ ID NO: 223628 - DNA, 25 bp, Mus musculus
cacgcattttgccggaacccagata

SEQ ID NO: 223629 - DNA, 25 bp, Mus musculus
cacgccaaactctggtggataccct

SEQ ID NO: 223630 - DNA, 25 bp, Mus musculus
cacgccaaactctggttcttctggt

SEQ ID NO: 223631 - DNA, 25 bp, Mus musculus
cacgccaaagagtggagttggagaa

SEQ ID NO: 223632 - DNA, 25 bp, Mus musculus
cacgccaaagagtggtgggcttatg

SEQ ID NO: 223633 - DNA, 25 bp, Mus musculus
cacgccacaggactacagtgggagt

SEQ ID NO: 223634 - DNA, 25 bp, Mus musculus
cacgccacttgtcggcagctctgct

SEQ ID NO: 223635 - DNA, 25 bp, Mus musculus
cacgccagagtttctcaggaatatc

SEQ ID NO: 223636 - DNA, 25 bp, Mus musculus
cacgccagataacacaactggaggg

SEQ ID NO: 223637 - DNA, 25 bp, Mus musculus
cacgccagcctctgaaactagacac

SEQ ID NO: 223638 - DNA, 25 bp, Mus musculus
cacgccagcttagagtgcgatgcgg

SEQ ID NO: 223639 - DNA, 25 bp, Mus musculus
cacgccaggtcgtggggttgtgctg

SEQ ID NO: 223640 - DNA, 25 bp, Mus musculus
cacgccagtggctgtttacctgatg

SEQ ID NO: 223641 - DNA, 25 bp, Mus musculus
cacgccagtgggttcttctgtgacc

SEQ ID NO: 223642 - DNA, 25 bp, Mus musculus
cacgccagtttagaggtctttcagc

SEQ ID NO: 223643 - DNA, 25 bp, Mus musculus
cacgccagtttagaggttatctgga

SEQ ID NO: 223644 - DNA, 25 bp, Mus musculus
cacgccatgtatgtttccaccggct

SEQ ID NO: 223645 - DNA, 25 bp, Mus musculus
cacgcccaagaaaggtggcaggaga

SEQ ID NO: 223646 - DNA, 25 bp, Mus musculus
cacgcccacccaggaaatcctgaag

SEQ ID NO: 223647 - DNA, 25 bp, Mus musculus
cacgcccacccaggaatccatcagc

SEQ ID NO: 223648 - DNA, 25 bp, Mus musculus
cacgcccattcaggtgcgctgctca

SEQ ID NO: 223649 - DNA, 25 bp, Mus musculus
cacgccccacaaagaattccagagg

SEQ ID NO: 223650 - DNA, 25 bp, Mus musculus
cacgccccatggtgtggacattgta

SEQ ID NO: 223651 - DNA, 25 bp, Mus musculus
cacgcccccggatgatggtcacttt

SEQ ID NO: 223652 - DNA, 25 bp, Mus musculus
cacgcccttccaggtgactggttat

SEQ ID NO: 223653 - DNA, 25 bp, Mus musculus
cacgccgatccggtaatatccttgt

SEQ ID NO: 223654 - DNA, 25 bp, Mus musculus
cacgccgccagagacggcaaagagg

SEQ ID NO: 223655 - DNA, 25 bp, Mus musculus
cacgccgcggggagaccatgagaag

SEQ ID NO: 223656 - DNA, 25 bp, Mus musculus
cacgccgcggggatccacctgatgg

SEQ ID NO: 223657 - DNA, 25 bp, Mus musculus
cacgccggccgccgtccccagtgac

SEQ ID NO: 223658 - DNA, 25 bp, Mus musculus
cacgccgggcaggcctcagcattta

SEQ ID NO: 223659 - DNA, 25 bp, Mus musculus
cacgccgggcctcaggcctcagcat

SEQ ID NO: 223660 - DNA, 25 bp, Mus musculus
cacgccgggcctcagtcttatgacc

SEQ ID NO: 223661 - DNA, 25 bp, Mus musculus
cacgccgtccaagaggccattgtga

SEQ ID NO: 223662 - DNA, 25 bp, Mus musculus
cacgccgtggtgcgcagttcctggt

SEQ ID NO: 223663 - DNA, 25 bp, Mus musculus
cacgcctacagcttcctggtggctg

SEQ ID NO: 223664 - DNA, 25 bp, Mus musculus
cacgcctctgctcagcctgaaggac

SEQ ID NO: 223665 - DNA, 25 bp, Mus musculus
cacgcctctgggaaacctaaatgtt

SEQ ID NO: 223666 - DNA, 25 bp, Mus musculus
cacgcctgaagaggacatggatgac

SEQ ID NO: 223667 - DNA, 25 bp, Mus musculus
cacgcctgacattatcctggatgac

SEQ ID NO: 223668 - DNA, 25 bp, Mus musculus
cacgcctgcatcatggtatttgatg

SEQ ID NO: 223669 - DNA, 25 bp, Mus musculus
cacgcctgcctggggaatgaattcc

SEQ ID NO: 223670 - DNA, 25 bp, Mus musculus
cacgccttcaggaaggcagcctcct

SEQ ID NO: 223671 - DNA, 25 bp, Mus musculus
cacgcgaggagcatgtcatgttgcc

SEQ ID NO: 223672 - DNA, 25 bp, Mus musculus
cacgcgaggtcttcgaaagaaccaa

SEQ ID NO: 223673 - DNA, 25 bp, Mus musculus
cacgcgaggtcttcggccttcccag

SEQ ID NO: 223674 - DNA, 25 bp, Mus musculus
cacgcgcaagccctgaggtgcgcac

SEQ ID NO: 223675 - DNA, 25 bp, Mus musculus
cacgcgcacaagaaatatggggtgt

SEQ ID NO: 223676 - DNA, 25 bp, Mus musculus
cacgcgcagctctacccactccgag

SEQ ID NO: 223677 - DNA, 25 bp, Mus musculus
cacgcgccagggaatggacctgtca

SEQ ID NO: 223678 - DNA, 25 bp, Mus musculus
cacgcgccctcagatgtcacctgta

SEQ ID NO: 223679 - DNA, 25 bp, Mus musculus
cacgcgccctcagtgggaagatgcc

SEQ ID NO: 223680 - DNA, 25 bp, Mus musculus
cacgcgccgcggccttagaagaaat

SEQ ID NO: 223681 - DNA, 25 bp, Mus musculus
cacgcgccgcggctccatgttctac

SEQ ID NO: 223682 - DNA, 25 bp, Mus musculus
cacgcgcctcagagtttgctattgc

SEQ ID NO: 223683 - DNA, 25 bp, Mus musculus
cacgcgcctcaggtagcactttgta

SEQ ID NO: 223684 - DNA, 25 bp, Mus musculus
cacgcgcctctgtaaaacccagaac

SEQ ID NO: 223685 - DNA, 25 bp, Mus musculus
cacgcgcgtagtgattgaggatggt

SEQ ID NO: 223686 - DNA, 25 bp, Mus musculus
cacgcgcttgccgacccttcccggc

SEQ ID NO: 223687 - DNA, 25 bp, Mus musculus
cacgcggaaagagaactagatcagt

SEQ ID NO: 223688 - DNA, 25 bp, Mus musculus
cacgcggcacagcccatgcagcctg

SEQ ID NO: 223689 - DNA, 25 bp, Mus musculus
cacgcggcacagccccctgcgggtg

SEQ ID NO: 223690 - DNA, 25 bp, Mus musculus
cacgcggcataggccttcagaagta

SEQ ID NO: 223691 - DNA, 25 bp, Mus musculus
cacgcggcggcccgacgctgcggcc

SEQ ID NO: 223692 - DNA, 25 bp, Mus musculus
cacgcggctggttggcgagaatctg

SEQ ID NO: 223693 - DNA, 25 bp, Mus musculus
cacgcggctggttgggaatgtgact

SEQ ID NO: 223694 - DNA, 25 bp, Mus musculus
cacgcgggagaggtaaggctgacct

SEQ ID NO: 223695 - DNA, 25 bp, Mus musculus
cacgcgggagagttttctctgtcat

SEQ ID NO: 223696 - DNA, 25 bp, Mus musculus
cacgcgggattccggtcacagtttg

SEQ ID NO: 223697 - DNA, 25 bp, Mus musculus
cacgcgggcactcaggttcgagtga

SEQ ID NO: 223698 - DNA, 25 bp, Mus musculus
cacgcgggccatcctggccctcatc

SEQ ID NO: 223699 - DNA, 25 bp, Mus musculus
cacgcggtcagaactgtgccggatc

SEQ ID NO: 223700 - DNA, 25 bp, Mus musculus
cacgcggttgcaggaattggccaac

SEQ ID NO: 223701 - DNA, 25 bp, Mus musculus
cacgcgtcagaggtccctctgtcac

SEQ ID NO: 223702 - DNA, 25 bp, Mus musculus
cacgcgtgagcatgcgctacgtcgc

SEQ ID NO: 223703 - DNA, 25 bp, Mus musculus
cacgcgttcattccggctagccctg

SEQ ID NO: 223704 - DNA, 25 bp, Mus musculus
cacgctacggaatgaagctacccag

SEQ ID NO: 223705 - DNA, 25 bp, Mus musculus
cacgctactcagggatgttcccttc

SEQ ID NO: 223706 - DNA, 25 bp, Mus musculus
cacgctactctgggcctcaggagtt

SEQ ID NO: 223707 - DNA, 25 bp, Mus musculus
cacgctacttagccccaaccatact

SEQ ID NO: 223708 - DNA, 25 bp, Mus musculus
cacgctacttaggtgatgcaagaag

SEQ ID NO: 223709 - DNA, 25 bp, Mus musculus
cacgctattgtgaggatgaagtttc

SEQ ID NO: 223710 - DNA, 25 bp, Mus musculus
cacgctcaagcagcccacacaccct

SEQ ID NO: 223711 - DNA, 25 bp, Mus musculus
cacgctcaaggtgaccctgccctca

SEQ ID NO: 223712 - DNA, 25 bp, Mus musculus
cacgctcaccagctgatggttcctg

SEQ ID NO: 223713 - DNA, 25 bp, Mus musculus
cacgctccagaggctttgctgacgg

SEQ ID NO: 223714 - DNA, 25 bp, Mus musculus
cacgctccagagtgtgcactctcct

SEQ ID NO: 223715 - DNA, 25 bp, Mus musculus
cacgctccagcatagccccacggcc

SEQ ID NO: 223716 - DNA, 25 bp, Mus musculus
cacgctccaggagaggcgggagatt

SEQ ID NO: 223717 - DNA, 25 bp, Mus musculus
cacgctccccaaggaggtattcccc

SEQ ID NO: 223718 - DNA, 25 bp, Mus musculus
cacgctctaatacagactcagccat

SEQ ID NO: 223719 - DNA, 25 bp, Mus musculus
cacgctctaatacagtggcttcttt

SEQ ID NO: 223720 - DNA, 25 bp, Mus musculus
cacgctctcaaggccgagtacaaca

SEQ ID NO: 223721 - DNA, 25 bp, Mus musculus
cacgctctcaaggtatagtcctagc

SEQ ID NO: 223722 - DNA, 25 bp, Mus musculus
cacgctctgtcatccgaaaactcca

SEQ ID NO: 223723 - DNA, 25 bp, Mus musculus
cacgctctgtcatccgccctagcac

SEQ ID NO: 223724 - DNA, 25 bp, Mus musculus
cacgctgaagcaggcttccagccag

SEQ ID NO: 223725 - DNA, 25 bp, Mus musculus
cacgctgaagcaggtcataaagccc

SEQ ID NO: 223726 - DNA, 25 bp, Mus musculus
cacgctgatgaccctgactatatag

SEQ ID NO: 223727 - DNA, 25 bp, Mus musculus
cacgctgatgaccgacccttgggta

SEQ ID NO: 223728 - DNA, 25 bp, Mus musculus
cacgctgatgtgggtgtagcactcc

SEQ ID NO: 223729 - DNA, 25 bp, Mus musculus
cacgctgcatgaactggagaatttg

SEQ ID NO: 223730 - DNA, 25 bp, Mus musculus
cacgctgccataatgaagaagaagt

SEQ ID NO: 223731 - DNA, 25 bp, Mus musculus
cacgctgcccaagcgccggagtact

SEQ ID NO: 223732 - DNA, 25 bp, Mus musculus
cacgctgcctcagcaagccccgccc

SEQ ID NO: 223733 - DNA, 25 bp, Mus musculus
cacgctgctgtgcagctttttagaa

SEQ ID NO: 223734 - DNA, 25 bp, Mus musculus
cacgctggcactgaggtttgggaac

SEQ ID NO: 223735 - DNA, 25 bp, Mus musculus
cacgctggccagacagctgcagcac

SEQ ID NO: 223736 - DNA, 25 bp, Mus musculus
cacgctggccagataaggctagccc

SEQ ID NO: 223737 - DNA, 25 bp, Mus musculus
cacgctggccagctgcctcaccctg

SEQ ID NO: 223738 - DNA, 25 bp, Mus musculus
cacgctggccaggtattgttagaac

SEQ ID NO: 223739 - DNA, 25 bp, Mus musculus
cacgctgtgctgaatgagcaacata

SEQ ID NO: 223740 - DNA, 25 bp, Mus musculus
cacgctgtggtgcggctgtgtggca

SEQ ID NO: 223741 - DNA, 25 bp, Mus musculus
cacgcttcaaatggatagtcacatg

SEQ ID NO: 223742 - DNA, 25 bp, Mus musculus
cacgcttcaaggcgcaacctggtgg

SEQ ID NO: 223743 - DNA, 25 bp, Mus musculus
cacgcttcccggagagccttacgag

SEQ ID NO: 223744 - DNA, 25 bp, Mus musculus
cacgcttcccggagcacttggaatc

SEQ ID NO: 223745 - DNA, 25 bp, Mus musculus
cacgcttctataaacctgactctag

SEQ ID NO: 223746 - DNA, 25 bp, Mus musculus
cacgcttctattaaaccgggaggcc

SEQ ID NO: 223747 - DNA, 25 bp, Mus musculus
cacgcttcttgccagtttattaaca

SEQ ID NO: 223748 - DNA, 25 bp, Mus musculus
cacgcttgatgtggggcctgcgcgc

SEQ ID NO: 223749 - DNA, 25 bp, Mus musculus
cacgcttggaaagcaaatgcaatag

SEQ ID NO: 223750 - DNA, 25 bp, Mus musculus
cacgcttggaaagttgtccagtctg

SEQ ID NO: 223751 - DNA, 25 bp, Mus musculus
cacggaaaaaggttttgacgcatct

SEQ ID NO: 223752 - DNA, 25 bp, Mus musculus
cacggaaccaaggtggctatggcgg

SEQ ID NO: 223753 - DNA, 25 bp, Mus musculus
cacggaactacagggtccaactgag

SEQ ID NO: 223754 - DNA, 25 bp, Mus musculus
cacggaactcgctaagccgggcaag

SEQ ID NO: 223755 - DNA, 25 bp, Mus musculus
cacggaactcgtgaatgataccaat

SEQ ID NO: 223756 - DNA, 25 bp, Mus musculus
cacggaagaagaacatcagaaagcc

SEQ ID NO: 223757 - DNA, 25 bp, Mus musculus
cacggaagatgcaagatgcagagag

SEQ ID NO: 223758 - DNA, 25 bp, Mus musculus
cacggaagatgtcagttcatatgga

SEQ ID NO: 223759 - DNA, 25 bp, Mus musculus
cacggaagtgaatccagcagcttta

SEQ ID NO: 223760 - DNA, 25 bp, Mus musculus
cacggaagtgatcagctctgaatgg

SEQ ID NO: 223761 - DNA, 25 bp, Mus musculus
cacggaatccagatggtgaactgaa

SEQ ID NO: 223762 - DNA, 25 bp, Mus musculus
cacggaatccaggagtacaagaact

SEQ ID NO: 223763 - DNA, 25 bp, Mus musculus
cacggaatccaggcacatggataca

SEQ ID NO: 223764 - DNA, 25 bp, Mus musculus
cacggacaccgggattatgtccctg

SEQ ID NO: 223765 - DNA, 25 bp, Mus musculus
cacggacagcgcgctttggatccgc

SEQ ID NO: 223766 - DNA, 25 bp, Mus musculus
cacggacagcggcacagccgagcct

SEQ ID NO: 223767 - DNA, 25 bp, Mus musculus
cacggacattcagggcttcctgaag

SEQ ID NO: 223768 - DNA, 25 bp, Mus musculus
cacggaccaccagagcctgtactcc

SEQ ID NO: 223769 - DNA, 25 bp, Mus musculus
cacggaccgaaagtgagaagcaacg

SEQ ID NO: 223770 - DNA, 25 bp, Mus musculus
cacggacggttcagaccatgacacc

SEQ ID NO: 223771 - DNA, 25 bp, Mus musculus
cacggactggaggcgccagcccctc

SEQ ID NO: 223772 - DNA, 25 bp, Mus musculus
cacggagacgaccatgccgtccatc

SEQ ID NO: 223773 - DNA, 25 bp, Mus musculus
cacggagacttcagaatcaagatgt

SEQ ID NO: 223774 - DNA, 25 bp, Mus musculus
cacggagagaagattaaggacagag

SEQ ID NO: 223775 - DNA, 25 bp, Mus musculus
cacggagaggagggagggagccatc

SEQ ID NO: 223776 - DNA, 25 bp, Mus musculus
cacggagatgctgagagctctggtg

SEQ ID NO: 223777 - DNA, 25 bp, Mus musculus
cacggagatgctgagctgtcgatgc

SEQ ID NO: 223778 - DNA, 25 bp, Mus musculus
cacggagattagcggagccaggtat

SEQ ID NO: 223779 - DNA, 25 bp, Mus musculus
cacggagcagcccaccttgggacac

SEQ ID NO: 223780 - DNA, 25 bp, Mus musculus
cacggagcaggaaggcaaatactac

SEQ ID NO: 223781 - DNA, 25 bp, Mus musculus
cacggagcatgagccagatatactg

SEQ ID NO: 223782 - DNA, 25 bp, Mus musculus
cacggagccagcatgaatcagctgc

SEQ ID NO: 223783 - DNA, 25 bp, Mus musculus
cacggagccagcatgccttcctggg

SEQ ID NO: 223784 - DNA, 25 bp, Mus musculus
cacggagccagcatgctcgtcaagg

SEQ ID NO: 223785 - DNA, 25 bp, Mus musculus
cacggagctcgtaccctacgggctg

SEQ ID NO: 223786 - DNA, 25 bp, Mus musculus
cacggaggagtaagacgtcgcctca

SEQ ID NO: 223787 - DNA, 25 bp, Mus musculus
cacggaggatgaggatgaggaagag

SEQ ID NO: 223788 - DNA, 25 bp, Mus musculus
cacggaggatgtcccgcatggttcg

SEQ ID NO: 223789 - DNA, 25 bp, Mus musculus
cacggagggcatgagcctcaagatg

SEQ ID NO: 223790 - DNA, 25 bp, Mus musculus
cacggagggcatgagcgggactcgc

SEQ ID NO: 223791 - DNA, 25 bp, Mus musculus
cacggagtaagtgaggtccagggag

SEQ ID NO: 223792 - DNA, 25 bp, Mus musculus
cacggagtaagtgagtcctttcagg

SEQ ID NO: 223793 - DNA, 25 bp, Mus musculus
cacggagtagcaaaggaatgggaca

SEQ ID NO: 223794 - DNA, 25 bp, Mus musculus
cacggagtagcaaaggttcagccta

SEQ ID NO: 223795 - DNA, 25 bp, Mus musculus
cacggagtcagaactgggctcttca

SEQ ID NO: 223796 - DNA, 25 bp, Mus musculus
cacggagtctggcaggagtgctcac

SEQ ID NO: 223797 - DNA, 25 bp, Mus musculus
cacggagtggactgctggatccctc

SEQ ID NO: 223798 - DNA, 25 bp, Mus musculus
cacggagtgtctcgctgtcactgag

SEQ ID NO: 223799 - DNA, 25 bp, Mus musculus
cacggagtgtgatcgtttggaaaac

SEQ ID NO: 223800 - DNA, 25 bp, Mus musculus
cacggagttctggaagaccgctgcc

SEQ ID NO: 223801 - DNA, 25 bp, Mus musculus
cacggatacttgtaagcggtaacca

SEQ ID NO: 223802 - DNA, 25 bp, Mus musculus
cacggatagcagacactacaagaag

SEQ ID NO: 223803 - DNA, 25 bp, Mus musculus
cacggatgattcagagccccagggc

SEQ ID NO: 223804 - DNA, 25 bp, Mus musculus
cacggatggaggaggagacaacaag

SEQ ID NO: 223805 - DNA, 25 bp, Mus musculus
cacggatgttcaagacgcaagtggg

SEQ ID NO: 223806 - DNA, 25 bp, Mus musculus
cacggattccttatggatcgcagct

SEQ ID NO: 223807 - DNA, 25 bp, Mus musculus
cacggcaaaatgagccgcacggaag

SEQ ID NO: 223808 - DNA, 25 bp, Mus musculus
cacggcaacagatttctttctttct

SEQ ID NO: 223809 - DNA, 25 bp, Mus musculus
cacggcaacaggcctgatgggattg

SEQ ID NO: 223810 - DNA, 25 bp, Mus musculus
cacggcaagtgctggaacacctgct

SEQ ID NO: 223811 - DNA, 25 bp, Mus musculus
cacggcacaggtcagacgggaacac

SEQ ID NO: 223812 - DNA, 25 bp, Mus musculus
cacggcaccaaactactaaaggtgt

SEQ ID NO: 223813 - DNA, 25 bp, Mus musculus
cacggcaccaaactccatagattgt

SEQ ID NO: 223814 - DNA, 25 bp, Mus musculus
cacggcaccaaactgcttgatttaa

SEQ ID NO: 223815 - DNA, 25 bp, Mus musculus
cacggcactgccactgattccagga

SEQ ID NO: 223816 - DNA, 25 bp, Mus musculus
cacggcagagcaggatgcccggggc

SEQ ID NO: 223817 - DNA, 25 bp, Mus musculus
cacggcatagatttcaccgagatga

SEQ ID NO: 223818 - DNA, 25 bp, Mus musculus
cacggcataggaccactgcaaagcc

SEQ ID NO: 223819 - DNA, 25 bp, Mus musculus
cacggcataggagctggtggccacc

SEQ ID NO: 223820 - DNA, 25 bp, Mus musculus
cacggcatcacaaggccatcgccac

SEQ ID NO: 223821 - DNA, 25 bp, Mus musculus
cacggcatcacactatggagtgttc

SEQ ID NO: 223822 - DNA, 25 bp, Mus musculus
cacggcatctataatgtcacccaga

SEQ ID NO: 223823 - DNA, 25 bp, Mus musculus
cacggcatctatgcggagctgaccc

SEQ ID NO: 223824 - DNA, 25 bp, Mus musculus
cacggcatctatgtacgtgccctgg

SEQ ID NO: 223825 - DNA, 25 bp, Mus musculus
cacggcatgcagaggaatctggggt

SEQ ID NO: 223826 - DNA, 25 bp, Mus musculus
cacggcatgcagggtgtgtctgcag

SEQ ID NO: 223827 - DNA, 25 bp, Mus musculus
cacggccagcgggagaccgggtccc

SEQ ID NO: 223828 - DNA, 25 bp, Mus musculus
cacggccatcccagccaatggcagc

SEQ ID NO: 223829 - DNA, 25 bp, Mus musculus
cacggccatcccagccaccctgggc

SEQ ID NO: 223830 - DNA, 25 bp, Mus musculus
cacggccatcctcaggtgagacttt

SEQ ID NO: 223831 - DNA, 25 bp, Mus musculus
cacggccatcctcaggtgtgtggta

SEQ ID NO: 223832 - DNA, 25 bp, Mus musculus
cacggccatggggtctgtgacagca

SEQ ID NO: 223833 - DNA, 25 bp, Mus musculus
cacggcccaaggggtttcctgagat

SEQ ID NO: 223834 - DNA, 25 bp, Mus musculus
cacggcccaggccgcccaaacccaa

SEQ ID NO: 223835 - DNA, 25 bp, Mus musculus
cacggccctcccagagccgtactgg

SEQ ID NO: 223836 - DNA, 25 bp, Mus musculus
cacggcccttctggcgacccccagg

SEQ ID NO: 223837 - DNA, 25 bp, Mus musculus
cacggccgcgaacaagaccccctct

SEQ ID NO: 223838 - DNA, 25 bp, Mus musculus
cacggcctccagtgacctgacagtg

SEQ ID NO: 223839 - DNA, 25 bp, Mus musculus
cacggcctccagtgactgccgggta

SEQ ID NO: 223840 - DNA, 25 bp, Mus musculus
cacggcctctggactgccatcagtc

SEQ ID NO: 223841 - DNA, 25 bp, Mus musculus
cacggcctctggtgtttgcagagac

SEQ ID NO: 223842 - DNA, 25 bp, Mus musculus
cacggcctggaggaggacagtggtc

SEQ ID NO: 223843 - DNA, 25 bp, Mus musculus
cacggcctggaggttgcagaggaca

SEQ ID NO: 223844 - DNA, 25 bp, Mus musculus
cacggcctgtgagctggatctcatg

SEQ ID NO: 223845 - DNA, 25 bp, Mus musculus
cacggcggaaggcaagattgagatc

SEQ ID NO: 223846 - DNA, 25 bp, Mus musculus
cacggcgggagggagcccagaggag

SEQ ID NO: 223847 - DNA, 25 bp, Mus musculus
cacggctaagcaggtgaagtccacg

SEQ ID NO: 223848 - DNA, 25 bp, Mus musculus
cacggctaccacagaagctgaaccg

SEQ ID NO: 223849 - DNA, 25 bp, Mus musculus
cacggctaccacagaggccttgccc

SEQ ID NO: 223850 - DNA, 25 bp, Mus musculus
cacggctcaagcaaggaccatggtg

SEQ ID NO: 223851 - DNA, 25 bp, Mus musculus
cacggctccaaggatgccaacaagg

SEQ ID NO: 223852 - DNA, 25 bp, Mus musculus
cacggctccagaaagatgacaggaa

SEQ ID NO: 223853 - DNA, 25 bp, Mus musculus
cacggctcgggacggagatgaaacc

SEQ ID NO: 223854 - DNA, 25 bp, Mus musculus
cacggctcgggacggttcagtgtat

SEQ ID NO: 223855 - DNA, 25 bp, Mus musculus
cacggctgatggagtatggtgatga

SEQ ID NO: 223856 - DNA, 25 bp, Mus musculus
cacggctgatggagtgatgggagcc

SEQ ID NO: 223857 - DNA, 25 bp, Mus musculus
cacggctgctgacctcctgcagatt

SEQ ID NO: 223858 - DNA, 25 bp, Mus musculus
cacggctgggaagaccctgtttggg

SEQ ID NO: 223859 - DNA, 25 bp, Mus musculus
cacggcttcagaaaagaagttgtga

SEQ ID NO: 223860 - DNA, 25 bp, Mus musculus
cacggcttcagaaggaagaggcaaa

SEQ ID NO: 223861 - DNA, 25 bp, Mus musculus
cacggcttcagtctttgcagtttaa

SEQ ID NO: 223862 - DNA, 25 bp, Mus musculus
cacgggaaagaaaacaaacattaca

SEQ ID NO: 223863 - DNA, 25 bp, Mus musculus
cacgggaaagaaacactcatcattg

SEQ ID NO: 223864 - DNA, 25 bp, Mus musculus
cacgggaaaggccggatggaccaag

SEQ ID NO: 223865 - DNA, 25 bp, Mus musculus
cacgggaacggagtgtgcaattctc

SEQ ID NO: 223866 - DNA, 25 bp, Mus musculus
cacgggaattccaggtctcaaggga

SEQ ID NO: 223867 - DNA, 25 bp, Mus musculus
cacgggacaaggtcccatctgcagg

SEQ ID NO: 223868 - DNA, 25 bp, Mus musculus
cacgggacaagttaattcaggacaa

SEQ ID NO: 223869 - DNA, 25 bp, Mus musculus
cacgggaccacagcctccaggatca

SEQ ID NO: 223870 - DNA, 25 bp, Mus musculus
cacgggacctcgagactgccactct

SEQ ID NO: 223871 - DNA, 25 bp, Mus musculus
cacgggagacgaaggcctggagccc

SEQ ID NO: 223872 - DNA, 25 bp, Mus musculus
cacgggagacgaagggcagaggtga

SEQ ID NO: 223873 - DNA, 25 bp, Mus musculus
cacgggatatatttgttaatggagt

SEQ ID NO: 223874 - DNA, 25 bp, Mus musculus
cacgggcacagaaatggaagcccag

SEQ ID NO: 223875 - DNA, 25 bp, Mus musculus
cacgggcaccccagctggagtcctt

SEQ ID NO: 223876 - DNA, 25 bp, Mus musculus
cacgggcaccccaggaatgcaccat

SEQ ID NO: 223877 - DNA, 25 bp, Mus musculus
cacgggccagctggctctggaatca

SEQ ID NO: 223878 - DNA, 25 bp, Mus musculus
cacgggcgaccagccaggtcccagt

SEQ ID NO: 223879 - DNA, 25 bp, Mus musculus
cacgggcgaccaggacctataagaa

SEQ ID NO: 223880 - DNA, 25 bp, Mus musculus
cacgggcgaggacctatatccagac

SEQ ID NO: 223881 - DNA, 25 bp, Mus musculus
cacgggctacaggttgcgttacagt

SEQ ID NO: 223882 - DNA, 25 bp, Mus musculus
cacgggctatgagccaacttccatg

SEQ ID NO: 223883 - DNA, 25 bp, Mus musculus
cacgggctgctggaaagggataaac

SEQ ID NO: 223884 - DNA, 25 bp, Mus musculus
cacgggctgcttagttcaaaccgga

SEQ ID NO: 223885 - DNA, 25 bp, Mus musculus
cacgggctggcctacattctaaggt

SEQ ID NO: 223886 - DNA, 25 bp, Mus musculus
cacggggacaggcaagtacattgcc

SEQ ID NO: 223887 - DNA, 25 bp, Mus musculus
cacggggcaatacaatgaggagact

SEQ ID NO: 223888 - DNA, 25 bp, Mus musculus
cacggggcaatacattgctatagct

SEQ ID NO: 223889 - DNA, 25 bp, Mus musculus
cacggggctgcaggtcacagcggag

SEQ ID NO: 223890 - DNA, 25 bp, Mus musculus
cacgggggagaggccatttgtttgc

SEQ ID NO: 223891 - DNA, 25 bp, Mus musculus
cacgggggctggcacaggtgatgaa

SEQ ID NO: 223892 - DNA, 25 bp, Mus musculus
cacggggtagtgatccattgtaggt

SEQ ID NO: 223893 - DNA, 25 bp, Mus musculus
cacgggtgagtttcacggagaaatc

SEQ ID NO: 223894 - DNA, 25 bp, Mus musculus
cacgggtgatgctggacaagtggga

SEQ ID NO: 223895 - DNA, 25 bp, Mus musculus
cacggtacccttatttgaccagatc

SEQ ID NO: 223896 - DNA, 25 bp, Mus musculus
cacggtagatctagccttttctgat

SEQ ID NO: 223897 - DNA, 25 bp, Mus musculus
cacggtagatctagttacaacctgc

SEQ ID NO: 223898 - DNA, 25 bp, Mus musculus
cacggtattgagttggtcacaatgg

SEQ ID NO: 223899 - DNA, 25 bp, Mus musculus
cacggtcaccaggccattccaagga

SEQ ID NO: 223900 - DNA, 25 bp, Mus musculus
cacggtccaagtgtgggacttgacg

SEQ ID NO: 223901 - DNA, 25 bp, Mus musculus
cacggtccagaaaaacctccagcgt

SEQ ID NO: 223902 - DNA, 25 bp, Mus musculus
cacggtccagcagcaaccctatcat

SEQ ID NO: 223903 - DNA, 25 bp, Mus musculus
cacggtccagctgcccaccattctc

SEQ ID NO: 223904 - DNA, 25 bp, Mus musculus
cacggtccaggaagaatgtttcttg

SEQ ID NO: 223905 - DNA, 25 bp, Mus musculus
cacggtccaggatgagagtcattca

SEQ ID NO: 223906 - DNA, 25 bp, Mus musculus
cacggtcctgaggtccacctccacc

SEQ ID NO: 223907 - DNA, 25 bp, Mus musculus
cacggtctggaggtcctgggccttg

SEQ ID NO: 223908 - DNA, 25 bp, Mus musculus
cacggtgaagatctggaacaacgac

SEQ ID NO: 223909 - DNA, 25 bp, Mus musculus
cacggtgaatccaggtttgatctgt

SEQ ID NO: 223910 - DNA, 25 bp, Mus musculus
cacggtgaggatcaggttggtacac

SEQ ID NO: 223911 - DNA, 25 bp, Mus musculus
cacggtggattgattcgttctcccc

SEQ ID NO: 223912 - DNA, 25 bp, Mus musculus
cacggtgggggacccctgtgcagca

SEQ ID NO: 223913 - DNA, 25 bp, Mus musculus
cacggtgggggattgctgctggaca

SEQ ID NO: 223914 - DNA, 25 bp, Mus musculus
cacggtggtttgaggtcctccagag

SEQ ID NO: 223915 - DNA, 25 bp, Mus musculus
cacggtgtgctggaggacttcatca

SEQ ID NO: 223916 - DNA, 25 bp, Mus musculus
cacggttactatctgggtgacaata

SEQ ID NO: 223917 - DNA, 25 bp, Mus musculus
cacggttagtgctggattcgagttc

SEQ ID NO: 223918 - DNA, 25 bp, Mus musculus
cacggttcagatcctgagggaagag

SEQ ID NO: 223919 - DNA, 25 bp, Mus musculus
cacggttcagcaactgcgctccaat

SEQ ID NO: 223920 - DNA, 25 bp, Mus musculus
cacggttgcccaggtgacagattat

SEQ ID NO: 223921 - DNA, 25 bp, Mus musculus
cacggttggataaacctgactctag

SEQ ID NO: 223922 - DNA, 25 bp, Mus musculus
cacgtaagcagagagtggctgaagt

SEQ ID NO: 223923 - DNA, 25 bp, Mus musculus
cacgtaagcagggtcttgacaatgt

SEQ ID NO: 223924 - DNA, 25 bp, Mus musculus
cacgtaagcagggtcttggagagcc

SEQ ID NO: 223925 - DNA, 25 bp, Mus musculus
cacgtacaagagagaaatgtcttca

SEQ ID NO: 223926 - DNA, 25 bp, Mus musculus
cacgtacctagaacaccacgctgca

SEQ ID NO: 223927 - DNA, 25 bp, Mus musculus
cacgtacctcaggctcatgtacagt

SEQ ID NO: 223928 - DNA, 25 bp, Mus musculus
cacgtacctcagtacaagcccacca

SEQ ID NO: 223929 - DNA, 25 bp, Mus musculus
cacgtacctcagttctggctcaagg

SEQ ID NO: 223930 - DNA, 25 bp, Mus musculus
cacgtagagagttccctcagtaccg

SEQ ID NO: 223931 - DNA, 25 bp, Mus musculus
cacgtatgcaggctctgcctggtac

SEQ ID NO: 223932 - DNA, 25 bp, Mus musculus
cacgtatgtcagcagatcaacttct

SEQ ID NO: 223933 - DNA, 25 bp, Mus musculus
cacgtatttaccgcagaaacagtat

SEQ ID NO: 223934 - DNA, 25 bp, Mus musculus
cacgtcaaagaagtcttctaaacag

SEQ ID NO: 223935 - DNA, 25 bp, Mus musculus
cacgtcaaagacctaactaccgtaa

SEQ ID NO: 223936 - DNA, 25 bp, Mus musculus
cacgtcaaccaggaaaccaaaaaga

SEQ ID NO: 223937 - DNA, 25 bp, Mus musculus
cacgtcacaatgatttctatgggaa

SEQ ID NO: 223938 - DNA, 25 bp, Mus musculus
cacgtcatgagtgagattgataaca

SEQ ID NO: 223939 - DNA, 25 bp, Mus musculus
cacgtcatgagtgagggtacaagaa

SEQ ID NO: 223940 - DNA, 25 bp, Mus musculus
cacgtccaagaatttcacccacctg

SEQ ID NO: 223941 - DNA, 25 bp, Mus musculus
cacgtccaaggtggctgtgcctggg

SEQ ID NO: 223942 - DNA, 25 bp, Mus musculus
cacgtccagtgcggctgctcctggc

SEQ ID NO: 223943 - DNA, 25 bp, Mus musculus
cacgtccagtgcgggctgatgcatg

SEQ ID NO: 223944 - DNA, 25 bp, Mus musculus
cacgtcccaggctgatagagacatc

SEQ ID NO: 223945 - DNA, 25 bp, Mus musculus
cacgtcccaggctggacagagattt

SEQ ID NO: 223946 - DNA, 25 bp, Mus musculus
cacgtcccaggctggagaaagctgt

SEQ ID NO: 223947 - DNA, 25 bp, Mus musculus
cacgtcccgtggccaggaaggacag

SEQ ID NO: 223948 - DNA, 25 bp, Mus musculus
cacgtccggaaggtgaatcggttta

SEQ ID NO: 223949 - DNA, 25 bp, Mus musculus
cacgtccgtcaggtatttgtcaagt

SEQ ID NO: 223950 - DNA, 25 bp, Mus musculus
cacgtcctgccccacgggcttcagc

SEQ ID NO: 223951 - DNA, 25 bp, Mus musculus
cacgtcctggggagtgaggacagaa

SEQ ID NO: 223952 - DNA, 25 bp, Mus musculus
cacgtcgacgacagggaacgaatgg

SEQ ID NO: 223953 - DNA, 25 bp, Mus musculus
cacgtcggctcagctggacagaggg

SEQ ID NO: 223954 - DNA, 25 bp, Mus musculus
cacgtctacaagacgctgaaggact

SEQ ID NO: 223955 - DNA, 25 bp, Mus musculus
cacgtctacaaggccatgacgttga

SEQ ID NO: 223956 - DNA, 25 bp, Mus musculus
cacgtctcagaaggtggacactgca

SEQ ID NO: 223957 - DNA, 25 bp, Mus musculus
cacgtctctggacaagccctcagtg

SEQ ID NO: 223958 - DNA, 25 bp, Mus musculus
cacgtctctgtggacacagaagcca

SEQ ID NO: 223959 - DNA, 25 bp, Mus musculus
cacgtctgcagctggtgagccgcgg

SEQ ID NO: 223960 - DNA, 25 bp, Mus musculus
cacgtctgcatcgaggtggacaaca

SEQ ID NO: 223961 - DNA, 25 bp, Mus musculus
cacgtctgccagtgcgaccagtacc

SEQ ID NO: 223962 - DNA, 25 bp, Mus musculus
cacgtctgcccgtgtgctgatgtca

SEQ ID NO: 223963 - DNA, 25 bp, Mus musculus
cacgtctgtgaagatcactgttaag

SEQ ID NO: 223964 - DNA, 25 bp, Mus musculus
cacgtctgtgacaggtgacacggct

SEQ ID NO: 223965 - DNA, 25 bp, Mus musculus
cacgtctgtgacagtggagatctca

SEQ ID NO: 223966 - DNA, 25 bp, Mus musculus
cacgtctttgaccatccatgggaaa

SEQ ID NO: 223967 - DNA, 25 bp, Mus musculus
cacgtctttgacttattggtgcagc

SEQ ID NO: 223968 - DNA, 25 bp, Mus musculus
cacgtgacaaataaccctggcactg

SEQ ID NO: 223969 - DNA, 25 bp, Mus musculus
cacgtgacagtgggctccctgctgg

SEQ ID NO: 223970 - DNA, 25 bp, Mus musculus
cacgtgaccagtatggcaagaagaa

SEQ ID NO: 223971 - DNA, 25 bp, Mus musculus
cacgtgagagggtcgttgctccaga

SEQ ID NO: 223972 - DNA, 25 bp, Mus musculus
cacgtgagaggttggtactaagaag

SEQ ID NO: 223973 - DNA, 25 bp, Mus musculus
cacgtgaggaacaaagacaaagcca

SEQ ID NO: 223974 - DNA, 25 bp, Mus musculus
cacgtgcagatggtggacccagtgc

SEQ ID NO: 223975 - DNA, 25 bp, Mus musculus
cacgtgccaaaatatctactagaaa

SEQ ID NO: 223976 - DNA, 25 bp, Mus musculus
cacgtgcctatactagtgagcatca

SEQ ID NO: 223977 - DNA, 25 bp, Mus musculus
cacgtgctcagagcagagcctctaa

SEQ ID NO: 223978 - DNA, 25 bp, Mus musculus
cacgtgctcagccctttgttcaggc

SEQ ID NO: 223979 - DNA, 25 bp, Mus musculus
cacgtgctgcaaggtgatgaagtct

SEQ ID NO: 223980 - DNA, 25 bp, Mus musculus
cacgtgctgggcctggccaggagtg

SEQ ID NO: 223981 - DNA, 25 bp, Mus musculus
cacgtggaacaagtgctagccattg

SEQ ID NO: 223982 - DNA, 25 bp, Mus musculus
cacgtggaagagccggctttcctcc

SEQ ID NO: 223983 - DNA, 25 bp, Mus musculus
cacgtggagcccttgacgcctcctt

SEQ ID NO: 223984 - DNA, 25 bp, Mus musculus
cacgtggagttcagcagcacttgga

SEQ ID NO: 223985 - DNA, 25 bp, Mus musculus
cacgtggatctgcagccatgtcata

SEQ ID NO: 223986 - DNA, 25 bp, Mus musculus
cacgtggcctccagaagccaccatg

SEQ ID NO: 223987 - DNA, 25 bp, Mus musculus
cacgtggctgttttgcccattggac

SEQ ID NO: 223988 - DNA, 25 bp, Mus musculus
cacgtggcttaggattgtctaaagc

SEQ ID NO: 223989 - DNA, 25 bp, Mus musculus
cacgtgggaccggcccttggtgctg

SEQ ID NO: 223990 - DNA, 25 bp, Mus musculus
cacgtgggaccggggtgttgtgcta

SEQ ID NO: 223991 - DNA, 25 bp, Mus musculus
cacgtggggaatgggagaagagtta

SEQ ID NO: 223992 - DNA, 25 bp, Mus musculus
cacgtggggaatgggagaagatgct

SEQ ID NO: 223993 - DNA, 25 bp, Mus musculus
cacgtggtacaaccacttccagctg

SEQ ID NO: 223994 - DNA, 25 bp, Mus musculus
cacgtggtacaacccaagtaatgaa

SEQ ID NO: 223995 - DNA, 25 bp, Mus musculus
cacgtggtggaaagataaggaattg

SEQ ID NO: 223996 - DNA, 25 bp, Mus musculus
cacgtggttcagacagctgtcatca

SEQ ID NO: 223997 - DNA, 25 bp, Mus musculus
cacgtggttcagggtctggagacat

SEQ ID NO: 223998 - DNA, 25 bp, Mus musculus
cacgtggttggaaattgatggaaaa

SEQ ID NO: 223999 - DNA, 25 bp, Mus musculus
cacgtggttggaatgtggtgtttgc

SEQ ID NO: 224000 - DNA, 25 bp, Mus musculus
cacgtgtgagattccctgctccagt

SEQ ID NO: 224001 - DNA, 25 bp, Mus musculus
cacgtgtgcagataccccggtaccc

SEQ ID NO: 224002 - DNA, 25 bp, Mus musculus
cacgtgtgcagcctttgcttttctc

SEQ ID NO: 224003 - DNA, 25 bp, Mus musculus
cacgtgtgcagggtcctgtgggcac

SEQ ID NO: 224004 - DNA, 25 bp, Mus musculus
cacgtgtgcagttggcagatattcc

SEQ ID NO: 224005 - DNA, 25 bp, Mus musculus
cacgtgttcatttgtgattcatggc

SEQ ID NO: 224006 - DNA, 25 bp, Mus musculus
cacgttccctgacctcctgtaccct

SEQ ID NO: 224007 - DNA, 25 bp, Mus musculus
cacgttcctttaaaagatcagcatg

SEQ ID NO: 224008 - DNA, 25 bp, Mus musculus
cacgttgccgacttcctggtggctg

SEQ ID NO: 224009 - DNA, 25 bp, Mus musculus
cacgttgccgagaacctgccagatg

SEQ ID NO: 224010 - DNA, 25 bp, Mus musculus
cacgttgccgattttgtcctggatg

SEQ ID NO: 224011 - DNA, 25 bp, Mus musculus
cacgttgctctggtcgaatggtatg

SEQ ID NO: 224012 - DNA, 25 bp, Mus musculus
cacgttggggttcagttctgatacc

SEQ ID NO: 224013 - DNA, 25 bp, Mus musculus
cacgttggttggcttttgtttgtca

SEQ ID NO: 224014 - DNA, 25 bp, Mus musculus
cacgttgttcatggggcagtaaatg

SEQ ID NO: 224015 - DNA, 25 bp, Mus musculus
cacgtttctcaggttattactctgg

SEQ ID NO: 224016 - DNA, 25 bp, Mus musculus
cacgtttgccgctcctgagaaatgc

SEQ ID NO: 224017 - DNA, 25 bp, Mus musculus
cacgttttctcctcagagctgcgca

SEQ ID NO: 224018 - DNA, 25 bp, Mus musculus
cacgttttttgccattggtgtcagc

SEQ ID NO: 224019 - DNA, 25 bp, Mus musculus
cactaaaacggatggctctccaacc

SEQ ID NO: 224020 - DNA, 25 bp, Mus musculus
cactaaaagaagtgctcagagttct

SEQ ID NO: 224021 - DNA, 25 bp, Mus musculus
cactaaaaggcagagatgctgattc

SEQ ID NO: 224022 - DNA, 25 bp, Mus musculus
cactaaaaggcagagtatgtttgat

SEQ ID NO: 224023 - DNA, 25 bp, Mus musculus
cactaaaataaatatccatgggaaa

SEQ ID NO: 224024 - DNA, 25 bp, Mus musculus
cactaaaataaatcatacctgcggt

SEQ ID NO: 224025 - DNA, 25 bp, Mus musculus
cactaaaatactctcctgggttgtg

SEQ ID NO: 224026 - DNA, 25 bp, Mus musculus
cactaaacaagacctcctaagccat

SEQ ID NO: 224027 - DNA, 25 bp, Mus musculus
cactaaagacgtaagttgaagatgt

SEQ ID NO: 224028 - DNA, 25 bp, Mus musculus
cactaaagactgacacgtttagggt

SEQ ID NO: 224029 - DNA, 25 bp, Mus musculus
cactaaagcagaggtgaaagacaag

SEQ ID NO: 224030 - DNA, 25 bp, Mus musculus
cactaaagtagagactcagggtgac

SEQ ID NO: 224031 - DNA, 25 bp, Mus musculus
cactaaatagtgaggatgacccggc

SEQ ID NO: 224032 - DNA, 25 bp, Mus musculus
cactaaatccgagaggtcgaaggat

SEQ ID NO: 224033 - DNA, 25 bp, Mus musculus
cactaacaaggataagaagcatttg

SEQ ID NO: 224034 - DNA, 25 bp, Mus musculus
cactaacaccaaggtcacaaagcac

SEQ ID NO: 224035 - DNA, 25 bp, Mus musculus
cactaacacctagagagttgcttca

SEQ ID NO: 224036 - DNA, 25 bp, Mus musculus
cactaacatctaaggtgccaagtgc

SEQ ID NO: 224037 - DNA, 25 bp, Mus musculus
cactaaccctgagctcttggctaga

SEQ ID NO: 224038 - DNA, 25 bp, Mus musculus
cactaactgctcaatagtgaaattc

SEQ ID NO: 224039 - DNA, 25 bp, Mus musculus
cactaacttctgggccaacaaatta

SEQ ID NO: 224040 - DNA, 25 bp, Mus musculus
cactaagaacaagaaaacagataaa

SEQ ID NO: 224041 - DNA, 25 bp, Mus musculus
cactaagaagacccagagtgatatc

SEQ ID NO: 224042 - DNA, 25 bp, Mus musculus
cactaagaaggagaagaccaccaga

SEQ ID NO: 224043 - DNA, 25 bp, Mus musculus
cactaagagcccaggttgtctgttc

SEQ ID NO: 224044 - DNA, 25 bp, Mus musculus
cactaagagcccagtgccatgtcgg

SEQ ID NO: 224045 - DNA, 25 bp, Mus musculus
cactaagataggctgagcatcccag

SEQ ID NO: 224046 - DNA, 25 bp, Mus musculus
cactaagataggctggagtcccctc

SEQ ID NO: 224047 - DNA, 25 bp, Mus musculus
cactaagcaaggtaacccagcatgt

SEQ ID NO: 224048 - DNA, 25 bp, Mus musculus
cactaaggaaacaggtctggaacca

SEQ ID NO: 224049 - DNA, 25 bp, Mus musculus
cactaaggcaaagattattggattt

SEQ ID NO: 224050 - DNA, 25 bp, Mus musculus
cactaagggggcagccttgcagcag

SEQ ID NO: 224051 - DNA, 25 bp, Mus musculus
cactaagggggcagctttgtcgaaa

SEQ ID NO: 224052 - DNA, 25 bp, Mus musculus
cactaagttcaaacaggcagctgag

SEQ ID NO: 224053 - DNA, 25 bp, Mus musculus
cactaagttcaaacagtcgagagct

SEQ ID NO: 224054 - DNA, 25 bp, Mus musculus
cactaagttgaaacactaattaccc

SEQ ID NO: 224055 - DNA, 25 bp, Mus musculus
cactaagttgtcccgagtttatgtt

SEQ ID NO: 224056 - DNA, 25 bp, Mus musculus
cactaataaagaagtgtgctggtgt

SEQ ID NO: 224057 - DNA, 25 bp, Mus musculus
cactaatatctttgggagacgctct

SEQ ID NO: 224058 - DNA, 25 bp, Mus musculus
cactaatatctttggtctgtccgaa

SEQ ID NO: 224059 - DNA, 25 bp, Mus musculus
cactaatcacatccgctgcgagcct

SEQ ID NO: 224060 - DNA, 25 bp, Mus musculus
cactaatcaggaaaatggcagacag

SEQ ID NO: 224061 - DNA, 25 bp, Mus musculus
cactaatcttgtaaccaccaaagac

SEQ ID NO: 224062 - DNA, 25 bp, Mus musculus
cactaatgagatggatcccccggat

SEQ ID NO: 224063 - DNA, 25 bp, Mus musculus
cactaatgtcgaaagagatgacatc

SEQ ID NO: 224064 - DNA, 25 bp, Mus musculus
cactaatgtcggcacaccattcccc

SEQ ID NO: 224065 - DNA, 25 bp, Mus musculus
cactacaaatcccctagtgagctgc

SEQ ID NO: 224066 - DNA, 25 bp, Mus musculus
cactacaagatgaggatgataatga

SEQ ID NO: 224067 - DNA, 25 bp, Mus musculus
cactacaagatgcagtatggtgggg

SEQ ID NO: 224068 - DNA, 25 bp, Mus musculus
cactacaagttgtcagggctccagt

SEQ ID NO: 224069 - DNA, 25 bp, Mus musculus
cactacacagcagcgtaccccgcag

SEQ ID NO: 224070 - DNA, 25 bp, Mus musculus
cactacacagccattaggaaccagc

SEQ ID NO: 224071 - DNA, 25 bp, Mus musculus
cactacacagcctccagccctggtt

SEQ ID NO: 224072 - DNA, 25 bp, Mus musculus
cactacacaggacaccaaggacttc

SEQ ID NO: 224073 - DNA, 25 bp, Mus musculus
cactacacccccatgtatggctgta

SEQ ID NO: 224074 - DNA, 25 bp, Mus musculus
cactacacgtacgtgaaggaattcc

SEQ ID NO: 224075 - DNA, 25 bp, Mus musculus
cactacacttctcaggttcctgtcc

SEQ ID NO: 224076 - DNA, 25 bp, Mus musculus
cactacataagcgaagctctggggt

SEQ ID NO: 224077 - DNA, 25 bp, Mus musculus
cactacatacgatctcctccacaac

SEQ ID NO: 224078 - DNA, 25 bp, Mus musculus
cactacatgaagtattacaatgact

SEQ ID NO: 224079 - DNA, 25 bp, Mus musculus
cactaccaccaccaccacggcgacg

SEQ ID NO: 224080 - DNA, 25 bp, Mus musculus
cactaccagaatgttgaccccaaca

SEQ ID NO: 224081 - DNA, 25 bp, Mus musculus
cactaccagctggcctataggttgc

SEQ ID NO: 224082 - DNA, 25 bp, Mus musculus
cactaccagctgggtaacgacattg

SEQ ID NO: 224083 - DNA, 25 bp, Mus musculus
cactaccatcacagagtcaaatcca

SEQ ID NO: 224084 - DNA, 25 bp, Mus musculus
cactaccatcggctatggcaatata

SEQ ID NO: 224085 - DNA, 25 bp, Mus musculus
cactacccaggaaaatggcagacag

SEQ ID NO: 224086 - DNA, 25 bp, Mus musculus
cactaccccgggaggcaccaggatc

SEQ ID NO: 224087 - DNA, 25 bp, Mus musculus
cactaccctcccaaactggcctcag

SEQ ID NO: 224088 - DNA, 25 bp, Mus musculus
cactaccctggctgtatcaacctct

SEQ ID NO: 224089 - DNA, 25 bp, Mus musculus
cactaccgcatgaggttctacttta

SEQ ID NO: 224090 - DNA, 25 bp, Mus musculus
cactacctacagcggcagaacccgg

SEQ ID NO: 224091 - DNA, 25 bp, Mus musculus
cactacctctatttcgccatgagct

SEQ ID NO: 224092 - DNA, 25 bp, Mus musculus
cactacgagctcagaaacaaataca

SEQ ID NO: 224093 - DNA, 25 bp, Mus musculus
cactacgagctcagaatattattgg

SEQ ID NO: 224094 - DNA, 25 bp, Mus musculus
cactacgagctcaggtcctgaactt

SEQ ID NO: 224095 - DNA, 25 bp, Mus musculus
cactacgagtaccggcatgtcatgt

SEQ ID NO: 224096 - DNA, 25 bp, Mus musculus
cactacgcaggaggattacaaccag

SEQ ID NO: 224097 - DNA, 25 bp, Mus musculus
cactacgcagttaccgtgacggtgg

SEQ ID NO: 224098 - DNA, 25 bp, Mus musculus
cactacgctgtggaactgtttgaag

SEQ ID NO: 224099 - DNA, 25 bp, Mus musculus
cactacggaggtgcatcctgagctc

SEQ ID NO: 224100 - DNA, 25 bp, Mus musculus
cactacgggcagtgatgatgactgt

SEQ ID NO: 224101 - DNA, 25 bp, Mus musculus
cactacgtgcaaaaggtaactttcg

SEQ ID NO: 224102 - DNA, 25 bp, Mus musculus
cactacgttcaacaggcaaagcgag

SEQ ID NO: 224103 - DNA, 25 bp, Mus musculus
cactactcacctggttcaaccagat

SEQ ID NO: 224104 - DNA, 25 bp, Mus musculus
cactactcactcagggatgactatg

SEQ ID NO: 224105 - DNA, 25 bp, Mus musculus
cactactgaccacgatgatgccagg

SEQ ID NO: 224106 - DNA, 25 bp, Mus musculus
cactactgactccatgcctgcaacc

SEQ ID NO: 224107 - DNA, 25 bp, Mus musculus
cactactgattttagctctgatctc

SEQ ID NO: 224108 - DNA, 25 bp, Mus musculus
cactactgtttcaacttctactact

SEQ ID NO: 224109 - DNA, 25 bp, Mus musculus
cactagaattaaaggtttgggatca

SEQ ID NO: 224110 - DNA, 25 bp, Mus musculus
cactagacgaaggaaacagcaagac

SEQ ID NO: 224111 - DNA, 25 bp, Mus musculus
cactagagaagagttggttgatcgt

SEQ ID NO: 224112 - DNA, 25 bp, Mus musculus
cactagaggtaaaggtcgatcgcga

SEQ ID NO: 224113 - DNA, 25 bp, Mus musculus
cactagaggtgggccaaggattctc

SEQ ID NO: 224114 - DNA, 25 bp, Mus musculus
cactagatatcaaaatcgggtcatg

SEQ ID NO: 224115 - DNA, 25 bp, Mus musculus
cactagatatcaatctgtggttctc

SEQ ID NO: 224116 - DNA, 25 bp, Mus musculus
cactagcacgaaagagaccagctat

SEQ ID NO: 224117 - DNA, 25 bp, Mus musculus
cactagccagtgagcgcatgagcta

SEQ ID NO: 224118 - DNA, 25 bp, Mus musculus
cactagccagtgcctaaggaagaac

SEQ ID NO: 224119 - DNA, 25 bp, Mus musculus
cactagcggtccttggacttcagga

SEQ ID NO: 224120 - DNA, 25 bp, Mus musculus
cactagctagaggcaactcgccatg

SEQ ID NO: 224121 - DNA, 25 bp, Mus musculus
cactagctagagggtacaaaggatt

SEQ ID NO: 224122 - DNA, 25 bp, Mus musculus
cactagctagtccgtgtactttgtg

SEQ ID NO: 224123 - DNA, 25 bp, Mus musculus
cactagctcttcagctctggggaca

SEQ ID NO: 224124 - DNA, 25 bp, Mus musculus
cactagctcttcaggactgggcagc

SEQ ID NO: 224125 - DNA, 25 bp, Mus musculus
cactagctgggtacctcttgtgtcc

SEQ ID NO: 224126 - DNA, 25 bp, Mus musculus
cactaggaacatgatgaactttcaa

SEQ ID NO: 224127 - DNA, 25 bp, Mus musculus
cactaggaacatggtgtccatcctg

SEQ ID NO: 224128 - DNA, 25 bp, Mus musculus
cactaggaagggtgagtggggcagc

SEQ ID NO: 224129 - DNA, 25 bp, Mus musculus
cactaggataacaggtccagttgtc

SEQ ID NO: 224130 - DNA, 25 bp, Mus musculus
cactaggattgcgattttctacctt

SEQ ID NO: 224131 - DNA, 25 bp, Mus musculus
cactaggcctcgtctaggtgccgcc

SEQ ID NO: 224132 - DNA, 25 bp, Mus musculus
cactagggaaggtcccggatgttgc

SEQ ID NO: 224133 - DNA, 25 bp, Mus musculus
cactaggttgcagacagtaaccagt

SEQ ID NO: 224134 - DNA, 25 bp, Mus musculus
cactagtcgataaggttgaaagaca

SEQ ID NO: 224135 - DNA, 25 bp, Mus musculus
cactagtcggaggtgtatcgttact

SEQ ID NO: 224136 - DNA, 25 bp, Mus musculus
cactagtcggagttacagccgctgt

SEQ ID NO: 224137 - DNA, 25 bp, Mus musculus
cactagtgccagcttcggtggtgta

SEQ ID NO: 224138 - DNA, 25 bp, Mus musculus
cactagtgcctgataagccaaagag

SEQ ID NO: 224139 - DNA, 25 bp, Mus musculus
cactagtggcaccggtttacatctc

SEQ ID NO: 224140 - DNA, 25 bp, Mus musculus
cactagtggctcctggcactttgaa

SEQ ID NO: 224141 - DNA, 25 bp, Mus musculus
cactataaagggagttggaaagaga

SEQ ID NO: 224142 - DNA, 25 bp, Mus musculus
cactataaaggggtgctggtgttga

SEQ ID NO: 224143 - DNA, 25 bp, Mus musculus
cactataaagtcgtaaaatatgaaa

SEQ ID NO: 224144 - DNA, 25 bp, Mus musculus
cactatagtgaagcccctggtcata

SEQ ID NO: 224145 - DNA, 25 bp, Mus musculus
cactatagtgaaggtgtttcctact

SEQ ID NO: 224146 - DNA, 25 bp, Mus musculus
cactatcacagacacgtgcgaccgc

SEQ ID NO: 224147 - DNA, 25 bp, Mus musculus
cactatcacagacgatctagaagca

SEQ ID NO: 224148 - DNA, 25 bp, Mus musculus
cactatcacctccagaacaatgagc

SEQ ID NO: 224149 - DNA, 25 bp, Mus musculus
cactatcacctccagctaattgcct

SEQ ID NO: 224150 - DNA, 25 bp, Mus musculus
cactatcagttggtttacctgctgc

SEQ ID NO: 224151 - DNA, 25 bp, Mus musculus
cactatccaggtcaggctgctacac

SEQ ID NO: 224152 - DNA, 25 bp, Mus musculus
cactatccagtgggatctgccgcga

SEQ ID NO: 224153 - DNA, 25 bp, Mus musculus
cactatcgaagttgagaataccact

SEQ ID NO: 224154 - DNA, 25 bp, Mus musculus
cactatcgacagagtcccagatcct

SEQ ID NO: 224155 - DNA, 25 bp, Mus musculus
cactatcgacagtttttgtggttct

SEQ ID NO: 224156 - DNA, 25 bp, Mus musculus
cactatgaaacaaagagttcaacta

SEQ ID NO: 224157 - DNA, 25 bp, Mus musculus
cactatgaagattcacagacacagt

SEQ ID NO: 224158 - DNA, 25 bp, Mus musculus
cactatgatatcctcttgtttgcca

SEQ ID NO: 224159 - DNA, 25 bp, Mus musculus
cactatgatgcctgttcctgccaac

SEQ ID NO: 224160 - DNA, 25 bp, Mus musculus
cactatgatgtacaggtcatagatg

SEQ ID NO: 224161 - DNA, 25 bp, Mus musculus
cactatgcagcaaagagttccaaca

SEQ ID NO: 224162 - DNA, 25 bp, Mus musculus
cactatgcagcaaaggaaggacaga

SEQ ID NO: 224163 - DNA, 25 bp, Mus musculus
cactatgccaaaaataaagcagttg

SEQ ID NO: 224164 - DNA, 25 bp, Mus musculus
cactatgctgctgtgtgctgctctg

SEQ ID NO: 224165 - DNA, 25 bp, Mus musculus
cactatgggaaagagattctgaaaa

SEQ ID NO: 224166 - DNA, 25 bp, Mus musculus
cactatgggagaaataccgacagta

SEQ ID NO: 224167 - DNA, 25 bp, Mus musculus
cactatgtgcaagacggcccccttg

SEQ ID NO: 224168 - DNA, 25 bp, Mus musculus
cactattaaaagagggtgcctcaga

SEQ ID NO: 224169 - DNA, 25 bp, Mus musculus
cactattaaggaggccttgtcagtt

SEQ ID NO: 224170 - DNA, 25 bp, Mus musculus
cactattattcccggtgtggaatat

SEQ ID NO: 224171 - DNA, 25 bp, Mus musculus
cactattctgaggttggtgtcattg

SEQ ID NO: 224172 - DNA, 25 bp, Mus musculus
cactattgagcatgacctcctgctc

SEQ ID NO: 224173 - DNA, 25 bp, Mus musculus
cactattgagcctcgaagtctttac

SEQ ID NO: 224174 - DNA, 25 bp, Mus musculus
cactattggctgggcaatgaatgca

SEQ ID NO: 224175 - DNA, 25 bp, Mus musculus
cactcaaatgaacatggttggtgca

SEQ ID NO: 224176 - DNA, 25 bp, Mus musculus
cactcaactggctcgggagcctttt

SEQ ID NO: 224177 - DNA, 25 bp, Mus musculus
cactcaacttcagccactggaactc

SEQ ID NO: 224178 - DNA, 25 bp, Mus musculus
cactcaacttcaggagggcctgggg

SEQ ID NO: 224179 - DNA, 25 bp, Mus musculus
cactcaagatatgtggtgacatcca

SEQ ID NO: 224180 - DNA, 25 bp, Mus musculus
cactcaagcaacagcaaatgaagct

SEQ ID NO: 224181 - DNA, 25 bp, Mus musculus
cactcaaggcagcccctgttacagt

SEQ ID NO: 224182 - DNA, 25 bp, Mus musculus
cactcacaactcacatccttgtctg

SEQ ID NO: 224183 - DNA, 25 bp, Mus musculus
cactcacaaggaagtaatgtgattt

SEQ ID NO: 224184 - DNA, 25 bp, Mus musculus
cactcacaaggaagtggatgatctt

SEQ ID NO: 224185 - DNA, 25 bp, Mus musculus
cactcacaccaaaggagcagttcag

SEQ ID NO: 224186 - DNA, 25 bp, Mus musculus
cactcacaccaaaggagtgccagga

SEQ ID NO: 224187 - DNA, 25 bp, Mus musculus
cactcacagaaaggtgtccacccag

SEQ ID NO: 224188 - DNA, 25 bp, Mus musculus
cactcacagaaggtggcttaaaaac

SEQ ID NO: 224189 - DNA, 25 bp, Mus musculus
cactcacagaaggtgtaacacggct

SEQ ID NO: 224190 - DNA, 25 bp, Mus musculus
cactcacatctgtgtctgataacaa

SEQ ID NO: 224191 - DNA, 25 bp, Mus musculus
cactcacatcttcttccctttcaag

SEQ ID NO: 224192 - DNA, 25 bp, Mus musculus
cactcaccactttgccctgttcttc

SEQ ID NO: 224193 - DNA, 25 bp, Mus musculus
cactcaccaggcacttgtggaatgg

SEQ ID NO: 224194 - DNA, 25 bp, Mus musculus
cactcaccctcaggctctgagtcag

SEQ ID NO: 224195 - DNA, 25 bp, Mus musculus
cactcacctcgccaggtggaggtgg

SEQ ID NO: 224196 - DNA, 25 bp, Mus musculus
cactcacgacggctccagggaactg

SEQ ID NO: 224197 - DNA, 25 bp, Mus musculus
cactcactgtcctgagagggttgta

SEQ ID NO: 224198 - DNA, 25 bp, Mus musculus
cactcactgtgacgagggtggctca

SEQ ID NO: 224199 - DNA, 25 bp, Mus musculus
cactcactgtgagcacagcggctac

SEQ ID NO: 224200 - DNA, 25 bp, Mus musculus
cactcacttccccaaattcctgtcc

SEQ ID NO: 224201 - DNA, 25 bp, Mus musculus
cactcagaaagaagctagacgaaag

SEQ ID NO: 224202 - DNA, 25 bp, Mus musculus
cactcagaattccccctcctcaggt

SEQ ID NO: 224203 - DNA, 25 bp, Mus musculus
cactcagaattccgggagtgatcga

SEQ ID NO: 224204 - DNA, 25 bp, Mus musculus
cactcagacagatggtgcagaggag

SEQ ID NO: 224205 - DNA, 25 bp, Mus musculus
cactcagagacaggcctcaggatat

SEQ ID NO: 224206 - DNA, 25 bp, Mus musculus
cactcagcacacatggaaccatgaa

SEQ ID NO: 224207 - DNA, 25 bp, Mus musculus
cactcagcagcgaatgagcatgctg

SEQ ID NO: 224208 - DNA, 25 bp, Mus musculus
cactcagcccacagaaaccactcac

SEQ ID NO: 224209 - DNA, 25 bp, Mus musculus
cactcagcccacagctccccatagg

SEQ ID NO: 224210 - DNA, 25 bp, Mus musculus
cactcagcctggaggacacagagct

SEQ ID NO: 224211 - DNA, 25 bp, Mus musculus
cactcagctaacagtggtaccagtg

SEQ ID NO: 224212 - DNA, 25 bp, Mus musculus
cactcaggaaacaacagatccccca

SEQ ID NO: 224213 - DNA, 25 bp, Mus musculus
cactcaggaccctggaaccctcaca

SEQ ID NO: 224214 - DNA, 25 bp, Mus musculus
cactcaggagaagccctcgaagggt

SEQ ID NO: 224215 - DNA, 25 bp, Mus musculus
cactcaggagacagggaagaagcca

SEQ ID NO: 224216 - DNA, 25 bp, Mus musculus
cactcaggagccgttgcccacggac

SEQ ID NO: 224217 - DNA, 25 bp, Mus musculus
cactcaggaggttctgacgggaaca

SEQ ID NO: 224218 - DNA, 25 bp, Mus musculus
cactcaggagttgcagctccacccc

SEQ ID NO: 224219 - DNA, 25 bp, Mus musculus
cactcagtggaagttctggatgatt

SEQ ID NO: 224220 - DNA, 25 bp, Mus musculus
cactcatatgatacagatttcaacc

SEQ ID NO: 224221 - DNA, 25 bp, Mus musculus
cactcatatgatttcaaccagttgg

SEQ ID NO: 224222 - DNA, 25 bp, Mus musculus
cactcatatggaccacagccacctg

SEQ ID NO: 224223 - DNA, 25 bp, Mus musculus
cactcatcaccaaggaggatataaa

SEQ ID NO: 224224 - DNA, 25 bp, Mus musculus
cactcatcatggtggacaatgccaa

SEQ ID NO: 224225 - DNA, 25 bp, Mus musculus
cactcatccagctcttcttacatct

SEQ ID NO: 224226 - DNA, 25 bp, Mus musculus
cactcatctaagggagatgaaggag

SEQ ID NO: 224227 - DNA, 25 bp, Mus musculus
cactcatctttgtgggcggggcctg

SEQ ID NO: 224228 - DNA, 25 bp, Mus musculus
cactcatgcaggttgctgatgcccc

SEQ ID NO: 224229 - DNA, 25 bp, Mus musculus
cactcattcagggagtgttgtgaag

SEQ ID NO: 224230 - DNA, 25 bp, Mus musculus
cactcattcccagacccagtgatta

SEQ ID NO: 224231 - DNA, 25 bp, Mus musculus
cactccaaagacaaatatgaaacat

SEQ ID NO: 224232 - DNA, 25 bp, Mus musculus
cactccaaagtccccagtcttcatt

SEQ ID NO: 224233 - DNA, 25 bp, Mus musculus
cactccaatcagcaggcccgtcaag

SEQ ID NO: 224234 - DNA, 25 bp, Mus musculus
cactccaatcagcaggggctgctgg

SEQ ID NO: 224235 - DNA, 25 bp, Mus musculus
cactccaatcagcaggggtccttgg

SEQ ID NO: 224236 - DNA, 25 bp, Mus musculus
cactccacacgagaggctcacaata

SEQ ID NO: 224237 - DNA, 25 bp, Mus musculus
cactccacacgaggagccagatgtt

SEQ ID NO: 224238 - DNA, 25 bp, Mus musculus
cactccaccatctggtgagtgaacc

SEQ ID NO: 224239 - DNA, 25 bp, Mus musculus
cactccactccagggtctagagatt

SEQ ID NO: 224240 - DNA, 25 bp, Mus musculus
cactccactggttcgtcgcctgcag

SEQ ID NO: 224241 - DNA, 25 bp, Mus musculus
cactccagagaaattcccaacattc

SEQ ID NO: 224242 - DNA, 25 bp, Mus musculus
cactccagaggccacaaaagaagta

SEQ ID NO: 224243 - DNA, 25 bp, Mus musculus
cactccagaggtaaaagcgccattc

SEQ ID NO: 224244 - DNA, 25 bp, Mus musculus
cactccagaggtacaagcgccattc

SEQ ID NO: 224245 - DNA, 25 bp, Mus musculus
cactccagccaaaggactgcaggct

SEQ ID NO: 224246 - DNA, 25 bp, Mus musculus
cactccagcccagaattaaccctga

SEQ ID NO: 224247 - DNA, 25 bp, Mus musculus
cactccagcccagatggaggatgag

SEQ ID NO: 224248 - DNA, 25 bp, Mus musculus
cactccagcccagcagacaggagga

SEQ ID NO: 224249 - DNA, 25 bp, Mus musculus
cactccagcccagctggagatggag

SEQ ID NO: 224250 - DNA, 25 bp, Mus musculus
cactccagcccaggccctccttgtc

SEQ ID NO: 224251 - DNA, 25 bp, Mus musculus
cactccagctgcagcagttctatgc

SEQ ID NO: 224252 - DNA, 25 bp, Mus musculus
cactccagctgcaggatgaagtggc

SEQ ID NO: 224253 - DNA, 25 bp, Mus musculus
cactccaggcagcttcttcggcttc

SEQ ID NO: 224254 - DNA, 25 bp, Mus musculus
cactccagggcaagccccaggactg

SEQ ID NO: 224255 - DNA, 25 bp, Mus musculus
cactccagtaaagactccttgttgc

SEQ ID NO: 224256 - DNA, 25 bp, Mus musculus
cactccagtccagcaatcccaggat

SEQ ID NO: 224257 - DNA, 25 bp, Mus musculus
cactccatggattgccggaacttgt

SEQ ID NO: 224258 - DNA, 25 bp, Mus musculus
cactcccaagacaagtgtcagcgga

SEQ ID NO: 224259 - DNA, 25 bp, Mus musculus
cactcccaatgacggtcaagatgct

SEQ ID NO: 224260 - DNA, 25 bp, Mus musculus
cactcccacagaaggacccagaaat

SEQ ID NO: 224261 - DNA, 25 bp, Mus musculus
cactcccactgggtgtggagtgtgc

SEQ ID NO: 224262 - DNA, 25 bp, Mus musculus
cactcccatgcccgtggctgttcga

SEQ ID NO: 224263 - DNA, 25 bp, Mus musculus
cactccccagagcctcaagtcagat

SEQ ID NO: 224264 - DNA, 25 bp, Mus musculus
cactccccagccgtgggaatggtgt

SEQ ID NO: 224265 - DNA, 25 bp, Mus musculus
cactcccccgcacttctagacagct

SEQ ID NO: 224266 - DNA, 25 bp, Mus musculus
cactccctacaagtccctgagttgg

SEQ ID NO: 224267 - DNA, 25 bp, Mus musculus
cactccctaccgaggatgcttgagg

SEQ ID NO: 224268 - DNA, 25 bp, Mus musculus
cactccctaggtgttgggagccctt

SEQ ID NO: 224269 - DNA, 25 bp, Mus musculus
cactccctctggctctctcaaaaga

SEQ ID NO: 224270 - DNA, 25 bp, Mus musculus
cactccgacaagatgaaagaaacaa

SEQ ID NO: 224271 - DNA, 25 bp, Mus musculus
cactccgacagctttccaccaccag

SEQ ID NO: 224272 - DNA, 25 bp, Mus musculus
cactccgccaagtggtttgctggtg

SEQ ID NO: 224273 - DNA, 25 bp, Mus musculus
cactccgcgtgcggtttctagagca

SEQ ID NO: 224274 - DNA, 25 bp, Mus musculus
cactccggacacagaatatccagtt

SEQ ID NO: 224275 - DNA, 25 bp, Mus musculus
cactccggcggccccgcaatctgtg

SEQ ID NO: 224276 - DNA, 25 bp, Mus musculus
cactccgtagtggtgctgacctgga

SEQ ID NO: 224277 - DNA, 25 bp, Mus musculus
cactccgtagtggtggtcttatgct

SEQ ID NO: 224278 - DNA, 25 bp, Mus musculus
cactcctaagcaccaaggaacccgg

SEQ ID NO: 224279 - DNA, 25 bp, Mus musculus
cactcctaagcggttaatttctaat

SEQ ID NO: 224280 - DNA, 25 bp, Mus musculus
cactcctattcagaccctcagtgct

SEQ ID NO: 224281 - DNA, 25 bp, Mus musculus
cactcctctggatcccagagtgctt

SEQ ID NO: 224282 - DNA, 25 bp, Mus musculus
cactcctcttgcagatactggagtg

SEQ ID NO: 224283 - DNA, 25 bp, Mus musculus
cactcctgactccgttcaacacaca

SEQ ID NO: 224284 - DNA, 25 bp, Mus musculus
cactcctggagcaggcagcacccga

SEQ ID NO: 224285 - DNA, 25 bp, Mus musculus
cactcctggagtagaaaaagacatt

SEQ ID NO: 224286 - DNA, 25 bp, Mus musculus
cactcctgggagtccttttgtcctc

SEQ ID NO: 224287 - DNA, 25 bp, Mus musculus
cactcctggtggtgaccgcagggag

SEQ ID NO: 224288 - DNA, 25 bp, Mus musculus
cactcctggtggtgcgtcttctggg

SEQ ID NO: 224289 - DNA, 25 bp, Mus musculus
cactcctgtacttgcgaaagcagtt

SEQ ID NO: 224290 - DNA, 25 bp, Mus musculus
cactcctgtacttggttcgtcaatg

SEQ ID NO: 224291 - DNA, 25 bp, Mus musculus
cactccttaacactgtcataggcct

SEQ ID NO: 224292 - DNA, 25 bp, Mus musculus
cactccttatgacaggttctgtcca

SEQ ID NO: 224293 - DNA, 25 bp, Mus musculus
cactccttccaggatcccctgccgt

SEQ ID NO: 224294 - DNA, 25 bp, Mus musculus
cactccttttagaagcaattctaca

SEQ ID NO: 224295 - DNA, 25 bp, Mus musculus
cactcgaaacattctattcactggc

SEQ ID NO: 224296 - DNA, 25 bp, Mus musculus
cactcgaagtgagattgaccttgtt

SEQ ID NO: 224297 - DNA, 25 bp, Mus musculus
cactcgaccacaggaagaagagctg

SEQ ID NO: 224298 - DNA, 25 bp, Mus musculus
cactcgaccaggttctgggctgaca

SEQ ID NO: 224299 - DNA, 25 bp, Mus musculus
cactcgagaagcagagattttattc

SEQ ID NO: 224300 - DNA, 25 bp, Mus musculus
cactcgagacgggccattgctcctg

SEQ ID NO: 224301 - DNA, 25 bp, Mus musculus
cactcgcacaccgagagaacaacca

SEQ ID NO: 224302 - DNA, 25 bp, Mus musculus
cactcgcagaggaccgccttcaaca

SEQ ID NO: 224303 - DNA, 25 bp, Mus musculus
cactcgcctgagactcgtcctccca

SEQ ID NO: 224304 - DNA, 25 bp, Mus musculus
cactcggatcaaacagggttcctct

SEQ ID NO: 224305 - DNA, 25 bp, Mus musculus
cactcggatcaatgcacaaagaaga

SEQ ID NO: 224306 - DNA, 25 bp, Mus musculus
cactcggctgcacatcgcaacgagc

SEQ ID NO: 224307 - DNA, 25 bp, Mus musculus
cactcggctgcagatcgcaacgagc

SEQ ID NO: 224308 - DNA, 25 bp, Mus musculus
cactcgggaaacaggacccagccac

SEQ ID NO: 224309 - DNA, 25 bp, Mus musculus
cactcgggaggcagaggcaggcgga

SEQ ID NO: 224310 - DNA, 25 bp, Mus musculus
cactcggttcccttctctgggtcct

SEQ ID NO: 224311 - DNA, 25 bp, Mus musculus
cactcgtgcagcgactgcaggacct

SEQ ID NO: 224312 - DNA, 25 bp, Mus musculus
cactcgtgcagctcagagagccgat

SEQ ID NO: 224313 - DNA, 25 bp, Mus musculus
cactcgtgcagtgccaccgtgccac

SEQ ID NO: 224314 - DNA, 25 bp, Mus musculus
cactcgtgtccgacttcagaggatg

SEQ ID NO: 224315 - DNA, 25 bp, Mus musculus
cactcgtgtccgatttattaacctt

SEQ ID NO: 224316 - DNA, 25 bp, Mus musculus
cactcgttcaaacaaagtctggttt

SEQ ID NO: 224317 - DNA, 25 bp, Mus musculus
cactctaaccggtcatttggcagaa

SEQ ID NO: 224318 - DNA, 25 bp, Mus musculus
cactctaagaaacattccctgtgtg

SEQ ID NO: 224319 - DNA, 25 bp, Mus musculus
cactctacagcttggccagcaaagc

SEQ ID NO: 224320 - DNA, 25 bp, Mus musculus
cactctacaggttcacctggtcatc

SEQ ID NO: 224321 - DNA, 25 bp, Mus musculus
cactctactaagtgccctgcattga

SEQ ID NO: 224322 - DNA, 25 bp, Mus musculus
cactctagcagtgttccgaatgcca

SEQ ID NO: 224323 - DNA, 25 bp, Mus musculus
cactctcaacatggaaaagtataac

SEQ ID NO: 224324 - DNA, 25 bp, Mus musculus
cactctcaacctgctgtcgctacag

SEQ ID NO: 224325 - DNA, 25 bp, Mus musculus
cactctcagctgagcagcaagaaca

SEQ ID NO: 224326 - DNA, 25 bp, Mus musculus
cactctcagctgctttgctgctgct

SEQ ID NO: 224327 - DNA, 25 bp, Mus musculus
cactctcaggttttggctaccggct

SEQ ID NO: 224328 - DNA, 25 bp, Mus musculus
cactctcagtcaggtttggacgtca

SEQ ID NO: 224329 - DNA, 25 bp, Mus musculus
cactctcagtgctgggttttcagag

SEQ ID NO: 224330 - DNA, 25 bp, Mus musculus
cactctcatccctagcagaacatca

SEQ ID NO: 224331 - DNA, 25 bp, Mus musculus
cactctccaaccagccaatagttac

SEQ ID NO: 224332 - DNA, 25 bp, Mus musculus
cactctccaaccagttacagttagt

SEQ ID NO: 224333 - DNA, 25 bp, Mus musculus
cactctccaactggctttaagggaa

SEQ ID NO: 224334 - DNA, 25 bp, Mus musculus
cactctcctccaggcacaactgtgc

SEQ ID NO: 224335 - DNA, 25 bp, Mus musculus
cactctcctctcaactccacgtcag

SEQ ID NO: 224336 - DNA, 25 bp, Mus musculus
cactctcctctcaagcaagctatag

SEQ ID NO: 224337 - DNA, 25 bp, Mus musculus
cactctcctctcagaggctctggag

SEQ ID NO: 224338 - DNA, 25 bp, Mus musculus
cactctcctgaacttccaggtcctg

SEQ ID NO: 224339 - DNA, 25 bp, Mus musculus
cactctcctgggctgcaactggacg

SEQ ID NO: 224340 - DNA, 25 bp, Mus musculus
cactctcctggtcctgagtcagaaa

SEQ ID NO: 224341 - DNA, 25 bp, Mus musculus
cactctcgggaagttattggagact

SEQ ID NO: 224342 - DNA, 25 bp, Mus musculus
cactctctcaaattgcctatcagag

SEQ ID NO: 224343 - DNA, 25 bp, Mus musculus
cactctctcatgaggagccccagga

SEQ ID NO: 224344 - DNA, 25 bp, Mus musculus
cactctgaacttaacatctctgaaa

SEQ ID NO: 224345 - DNA, 25 bp, Mus musculus
cactctgacagattcacctgcaaga

SEQ ID NO: 224346 - DNA, 25 bp, Mus musculus
cactctgacagtgagggtgcggggt

SEQ ID NO: 224347 - DNA, 25 bp, Mus musculus
cactctgcaaagtgacccagactac

SEQ ID NO: 224348 - DNA, 25 bp, Mus musculus
cactctgcaaagtggcctatgagga

SEQ ID NO: 224349 - DNA, 25 bp, Mus musculus
cactctgcaaattagatgttctttg

SEQ ID NO: 224350 - DNA, 25 bp, Mus musculus
cactctgccagcaaggtgtagctac

SEQ ID NO: 224351 - DNA, 25 bp, Mus musculus
cactctgcgaagggaaatgctcata

SEQ ID NO: 224352 - DNA, 25 bp, Mus musculus
cactctgctggatggctctgcctta

SEQ ID NO: 224353 - DNA, 25 bp, Mus musculus
cactctgctgtcaggtacaggtcaa

SEQ ID NO: 224354 - DNA, 25 bp, Mus musculus
cactctggaaataaggccgttgact

SEQ ID NO: 224355 - DNA, 25 bp, Mus musculus
cactctggacaccgatgactttgtg

SEQ ID NO: 224356 - DNA, 25 bp, Mus musculus
cactctggacaccgccacagtacat

SEQ ID NO: 224357 - DNA, 25 bp, Mus musculus
cactctggagccccatgtggaaccc

SEQ ID NO: 224358 - DNA, 25 bp, Mus musculus
cactctggccgtcgcggctggactg

SEQ ID NO: 224359 - DNA, 25 bp, Mus musculus
cactctggctgggcgctcaccctcc

SEQ ID NO: 224360 - DNA, 25 bp, Mus musculus
cactctgggacccgaacaatttcga

SEQ ID NO: 224361 - DNA, 25 bp, Mus musculus
cactctgggaggagcctgagttttc

SEQ ID NO: 224362 - DNA, 25 bp, Mus musculus
cactctgtcaaggcccgagaccaga

SEQ ID NO: 224363 - DNA, 25 bp, Mus musculus
cactctgtcgcagattggaagaatt

SEQ ID NO: 224364 - DNA, 25 bp, Mus musculus
cactctgttcagtgaacctaacact

SEQ ID NO: 224365 - DNA, 25 bp, Mus musculus
cactcttacccagaccaacagcaac

SEQ ID NO: 224366 - DNA, 25 bp, Mus musculus
cactcttacccagcatatatttggt

SEQ ID NO: 224367 - DNA, 25 bp, Mus musculus
cactcttacccaggtttttgtgcgt

SEQ ID NO: 224368 - DNA, 25 bp, Mus musculus
cactcttaccgatcagcaccagtga

SEQ ID NO: 224369 - DNA, 25 bp, Mus musculus
cactcttcaaaggctttggagacag

SEQ ID NO: 224370 - DNA, 25 bp, Mus musculus
cactcttcaaggtaaagtggatctt

SEQ ID NO: 224371 - DNA, 25 bp, Mus musculus
cactcttcagtattcctgtcttgac

SEQ ID NO: 224372 - DNA, 25 bp, Mus musculus
cactcttcagtgggcccgggatgaa

SEQ ID NO: 224373 - DNA, 25 bp, Mus musculus
cactcttcagttctgagaagaagta

SEQ ID NO: 224374 - DNA, 25 bp, Mus musculus
cactcttcatggcgaagaagaagac

SEQ ID NO: 224375 - DNA, 25 bp, Mus musculus
cactcttccagacccatgaaaatag

SEQ ID NO: 224376 - DNA, 25 bp, Mus musculus
cactcttccctcctatcccctgctt

SEQ ID NO: 224377 - DNA, 25 bp, Mus musculus
cactcttccttggtactctcaagtt

SEQ ID NO: 224378 - DNA, 25 bp, Mus musculus
cactcttctaaaacgttaccacctg

SEQ ID NO: 224379 - DNA, 25 bp, Mus musculus
cactcttctaaagatccactatggg

SEQ ID NO: 224380 - DNA, 25 bp, Mus musculus
cactcttgaagatgccgagatgttt

SEQ ID NO: 224381 - DNA, 25 bp, Mus musculus
cactcttgaaggatgcccaccaccg

SEQ ID NO: 224382 - DNA, 25 bp, Mus musculus
cactcttgtaaagtaccagtgctgt

SEQ ID NO: 224383 - DNA, 25 bp, Mus musculus
cactcttgtaaagttacaagcccaa

SEQ ID NO: 224384 - DNA, 25 bp, Mus musculus
cactctttcctcccttggagttcca

SEQ ID NO: 224385 - DNA, 25 bp, Mus musculus
cactctttgtcttcttgtctgggga

SEQ ID NO: 224386 - DNA, 25 bp, Mus musculus
cactgaaaaatgggatgggttggag

SEQ ID NO: 224387 - DNA, 25 bp, Mus musculus
cactgaaaaatgtagttcctaatat

SEQ ID NO: 224388 - DNA, 25 bp, Mus musculus
cactgaaaagaggacagaactagag

SEQ ID NO: 224389 - DNA, 25 bp, Mus musculus
cactgaaaagcgccatggctactta

SEQ ID NO: 224390 - DNA, 25 bp, Mus musculus
cactgaaaagggttcccagccccac

SEQ ID NO: 224391 - DNA, 25 bp, Mus musculus
cactgaaacattttaacagtgatgt

SEQ ID NO: 224392 - DNA, 25 bp, Mus musculus
cactgaaaccaaggctggtctgctc

SEQ ID NO: 224393 - DNA, 25 bp, Mus musculus
cactgaaagtacttgaaaactggtg

SEQ ID NO: 224394 - DNA, 25 bp, Mus musculus
cactgaacaatggtttgctatcttc

SEQ ID NO: 224395 - DNA, 25 bp, Mus musculus
cactgaacagacagctccgaagatt

SEQ ID NO: 224396 - DNA, 25 bp, Mus musculus
cactgaacaggttgctccaggacct

SEQ ID NO: 224397 - DNA, 25 bp, Mus musculus
cactgaacccaaccagaatcgagct

SEQ ID NO: 224398 - DNA, 25 bp, Mus musculus
cactgaaccgctggttgggtgaaca

SEQ ID NO: 224399 - DNA, 25 bp, Mus musculus
cactgaagaagatggatgcagattc

SEQ ID NO: 224400 - DNA, 25 bp, Mus musculus
cactgaagaagatgggcctgacgga

SEQ ID NO: 224401 - DNA, 25 bp, Mus musculus
cactgaagaagtggactctcgaaaa

SEQ ID NO: 224402 - DNA, 25 bp, Mus musculus
cactgaagatgaaccggaagtatga

SEQ ID NO: 224403 - DNA, 25 bp, Mus musculus
cactgaagatgatgcttctgtgaag

SEQ ID NO: 224404 - DNA, 25 bp, Mus musculus
cactgaagatggactggaaacatac

SEQ ID NO: 224405 - DNA, 25 bp, Mus musculus
cactgaaggagctggtacagactta

SEQ ID NO: 224406 - DNA, 25 bp, Mus musculus
cactgaaggtcgtgccagaaggaat

SEQ ID NO: 224407 - DNA, 25 bp, Mus musculus
cactgaagtggactgcctgcgagcc

SEQ ID NO: 224408 - DNA, 25 bp, Mus musculus
cactgaagttatgagagagattcag

SEQ ID NO: 224409 - DNA, 25 bp, Mus musculus
cactgaagttatgcagggatggcaa

SEQ ID NO: 224410 - DNA, 25 bp, Mus musculus
cactgaatcctgagcaatggaagag

SEQ ID NO: 224411 - DNA, 25 bp, Mus musculus
cactgaatcctgaggtgcagcgtgg

SEQ ID NO: 224412 - DNA, 25 bp, Mus musculus
cactgaattcaaaggaggttcatga

SEQ ID NO: 224413 - DNA, 25 bp, Mus musculus
cactgaatttatcgtcagatacaga

SEQ ID NO: 224414 - DNA, 25 bp, Mus musculus
cactgacaagcaaggaaagactgcc

SEQ ID NO: 224415 - DNA, 25 bp, Mus musculus
cactgacacaatatggagtctggag

SEQ ID NO: 224416 - DNA, 25 bp, Mus musculus
cactgacagaaacaaataaaacctc

SEQ ID NO: 224417 - DNA, 25 bp, Mus musculus
cactgacagaaaccgtaatcctcca

SEQ ID NO: 224418 - DNA, 25 bp, Mus musculus
cactgacatggttcctgccatctcc

SEQ ID NO: 224419 - DNA, 25 bp, Mus musculus
cactgacattgagagggaatgaggt

SEQ ID NO: 224420 - DNA, 25 bp, Mus musculus
cactgacattgagagggagagtgtg

SEQ ID NO: 224421 - DNA, 25 bp, Mus musculus
cactgaccaaagatgagaaagtatt

SEQ ID NO: 224422 - DNA, 25 bp, Mus musculus
cactgacccagactctcaggtggac

SEQ ID NO: 224423 - DNA, 25 bp, Mus musculus
cactgaccctcagatagtgtttcta

SEQ ID NO: 224424 - DNA, 25 bp, Mus musculus
cactgaccgagaagtgcccccgcct

SEQ ID NO: 224425 - DNA, 25 bp, Mus musculus
cactgacctggtgttgctgcaccta

SEQ ID NO: 224426 - DNA, 25 bp, Mus musculus
cactgacctggtgtttacagtgttg

SEQ ID NO: 224427 - DNA, 25 bp, Mus musculus
cactgacggacagatcttcttggaa

SEQ ID NO: 224428 - DNA, 25 bp, Mus musculus
cactgactacaggcactggcagatc

SEQ ID NO: 224429 - DNA, 25 bp, Mus musculus
cactgactcctgagatcatgaagga

SEQ ID NO: 224430 - DNA, 25 bp, Mus musculus
cactgacttcaatggggttgcggcc

SEQ ID NO: 224431 - DNA, 25 bp, Mus musculus
cactgactttgccttcaatctcaca

SEQ ID NO: 224432 - DNA, 25 bp, Mus musculus
cactgagaagaaggtgtttctcctg

SEQ ID NO: 224433 - DNA, 25 bp, Mus musculus
cactgagaaggtgtccttggtgctg

SEQ ID NO: 224434 - DNA, 25 bp, Mus musculus
cactgagacagggctttctgagggt

SEQ ID NO: 224435 - DNA, 25 bp, Mus musculus
cactgagacccaagggcctgatttg

SEQ ID NO: 224436 - DNA, 25 bp, Mus musculus
cactgagaccccgagtggaaagctg

SEQ ID NO: 224437 - DNA, 25 bp, Mus musculus
cactgagagcaggagatctggaaca

SEQ ID NO: 224438 - DNA, 25 bp, Mus musculus
cactgagagcattccagtgtcagat

SEQ ID NO: 224439 - DNA, 25 bp, Mus musculus
cactgagccaacatggtcgtgaaaa

SEQ ID NO: 224440 - DNA, 25 bp, Mus musculus
cactgagcccatggttccaggatgg

SEQ ID NO: 224441 - DNA, 25 bp, Mus musculus
cactgagcgaccagagatgtggctt

SEQ ID NO: 224442 - DNA, 25 bp, Mus musculus
cactgagcgaccaggacaggattcc

SEQ ID NO: 224443 - DNA, 25 bp, Mus musculus
cactgagctcaagcccccggaagcc

SEQ ID NO: 224444 - DNA, 25 bp, Mus musculus
cactgagctctgggatcagtttgac

SEQ ID NO: 224445 - DNA, 25 bp, Mus musculus
cactgaggatgacatccgtggacag

SEQ ID NO: 224446 - DNA, 25 bp, Mus musculus
cactgaggtgagggaaccagacctt

SEQ ID NO: 224447 - DNA, 25 bp, Mus musculus
cactgaggtgccagacgacctggag

SEQ ID NO: 224448 - DNA, 25 bp, Mus musculus
cactgaggtgccaggctggacccat

SEQ ID NO: 224449 - DNA, 25 bp, Mus musculus
cactgagtaggcagaaaacttcttc

SEQ ID NO: 224450 - DNA, 25 bp, Mus musculus
cactgagtctctgggcacggaggtg

SEQ ID NO: 224451 - DNA, 25 bp, Mus musculus
cactgagtgagcaggctcctgcaaa

SEQ ID NO: 224452 - DNA, 25 bp, Mus musculus
cactgataccatcctcatccctttt

SEQ ID NO: 224453 - DNA, 25 bp, Mus musculus
cactgatatcaggaggagccatggg

SEQ ID NO: 224454 - DNA, 25 bp, Mus musculus
cactgatcaagaaaatcttgttgga

SEQ ID NO: 224455 - DNA, 25 bp, Mus musculus
cactgatccccacaggagaaatgct

SEQ ID NO: 224456 - DNA, 25 bp, Mus musculus
cactgatccccacaggtgatggaca

SEQ ID NO: 224457 - DNA, 25 bp, Mus musculus
cactgatccggaacggtctgaaggt

SEQ ID NO: 224458 - DNA, 25 bp, Mus musculus
cactgatccggaacggtggttgtgg

SEQ ID NO: 224459 - DNA, 25 bp, Mus musculus
cactgatcctggaggctgttcatca

SEQ ID NO: 224460 - DNA, 25 bp, Mus musculus
cactgatgagagaggtcctccgggt

SEQ ID NO: 224461 - DNA, 25 bp, Mus musculus
cactgatgaggacagctcagatgga

SEQ ID NO: 224462 - DNA, 25 bp, Mus musculus
cactgatgaggattctcaggacagc

SEQ ID NO: 224463 - DNA, 25 bp, Mus musculus
cactgatgaggcatcaatacttgtg

SEQ ID NO: 224464 - DNA, 25 bp, Mus musculus
cactgatgcaaagttccaggtgttc

SEQ ID NO: 224465 - DNA, 25 bp, Mus musculus
cactgatggaggagacacgggccag

SEQ ID NO: 224466 - DNA, 25 bp, Mus musculus
cactgatggccggggacctgaagac

SEQ ID NO: 224467 - DNA, 25 bp, Mus musculus
cactgatgggaaggtggcagtgaac

SEQ ID NO: 224468 - DNA, 25 bp, Mus musculus
cactgcaaaaacagctcaatgacag

SEQ ID NO: 224469 - DNA, 25 bp, Mus musculus
cactgcaaaaacagctctgtccaaa

SEQ ID NO: 224470 - DNA, 25 bp, Mus musculus
cactgcaaaaacctggagccagaat

SEQ ID NO: 224471 - DNA, 25 bp, Mus musculus
cactgcaaaatgaacccacagcttc

SEQ ID NO: 224472 - DNA, 25 bp, Mus musculus
cactgcaaagctggaatgaagtatt

SEQ ID NO: 224473 - DNA, 25 bp, Mus musculus
cactgcaaaggaagctcaatgacag

SEQ ID NO: 224474 - DNA, 25 bp, Mus musculus
cactgcaacaacgggatcccggaga

SEQ ID NO: 224475 - DNA, 25 bp, Mus musculus
cactgcaacaaggtgtcagctgatg

SEQ ID NO: 224476 - DNA, 25 bp, Mus musculus
cactgcaacccatgagcatccaggt

SEQ ID NO: 224477 - DNA, 25 bp, Mus musculus
cactgcacaattgagggttgccccg

SEQ ID NO: 224478 - DNA, 25 bp, Mus musculus
cactgcacaattgctcactatttgg

SEQ ID NO: 224479 - DNA, 25 bp, Mus musculus
cactgcacagattgcatctgggtat

SEQ ID NO: 224480 - DNA, 25 bp, Mus musculus
cactgcacagcccatcgtttctgaa

SEQ ID NO: 224481 - DNA, 25 bp, Mus musculus
cactgcacagcgaccagcagccagt

SEQ ID NO: 224482 - DNA, 25 bp, Mus musculus
cactgcaccatcgagggctgtcctg

SEQ ID NO: 224483 - DNA, 25 bp, Mus musculus
cactgcaccatcgctcactatctgg

SEQ ID NO: 224484 - DNA, 25 bp, Mus musculus
cactgcactgggtgggctgaaggct

SEQ ID NO: 224485 - DNA, 25 bp, Mus musculus
cactgcagaaggctctgaaggacct

SEQ ID NO: 224486 - DNA, 25 bp, Mus musculus
cactgcagaggaggagggtggacgg

SEQ ID NO: 224487 - DNA, 25 bp, Mus musculus
cactgcagagtaatgctccaagtat

SEQ ID NO: 224488 - DNA, 25 bp, Mus musculus
cactgcagcaggggccctccctgac

SEQ ID NO: 224489 - DNA, 25 bp, Mus musculus
cactgcagccaaagggtggataccc

SEQ ID NO: 224490 - DNA, 25 bp, Mus musculus
cactgcagcgacggctccgggtgcg

SEQ ID NO: 224491 - DNA, 25 bp, Mus musculus
cactgcagcgagctcgcgagtacaa

SEQ ID NO: 224492 - DNA, 25 bp, Mus musculus
cactgcagcgctgctgtggctggaa

SEQ ID NO: 224493 - DNA, 25 bp, Mus musculus
cactgcagcttcaggatttctacca

SEQ ID NO: 224494 - DNA, 25 bp, Mus musculus
cactgcaggacaggaggattacaac

SEQ ID NO: 224495 - DNA, 25 bp, Mus musculus
cactgcagtggagttgtttaagaat

SEQ ID NO: 224496 - DNA, 25 bp, Mus musculus
cactgcatcaacacaaacttgacct

SEQ ID NO: 224497 - DNA, 25 bp, Mus musculus
cactgcatgtgacctctctatcacg

SEQ ID NO: 224498 - DNA, 25 bp, Mus musculus
cactgcattgaaaaaatcccatgtt

SEQ ID NO: 224499 - DNA, 25 bp, Mus musculus
cactgcattggacttccttgtggac

SEQ ID NO: 224500 - DNA, 25 bp, Mus musculus
cactgcatttggtggagtgtgacaa

SEQ ID NO: 224501 - DNA, 25 bp, Mus musculus
cactgccaacagatctacacacaat

SEQ ID NO: 224502 - DNA, 25 bp, Mus musculus
cactgccaacagggtgcatcgcttt

SEQ ID NO: 224503 - DNA, 25 bp, Mus musculus
cactgccaagaccaggaacagcctc

SEQ ID NO: 224504 - DNA, 25 bp, Mus musculus
cactgccaagaccagtgaggtctgg

SEQ ID NO: 224505 - DNA, 25 bp, Mus musculus
cactgccaaggacgaaaagggggtg

SEQ ID NO: 224506 - DNA, 25 bp, Mus musculus
cactgccaaggagtgtggggccgac

SEQ ID NO: 224507 - DNA, 25 bp, Mus musculus
cactgccaaggggacaatgacggcc

SEQ ID NO: 224508 - DNA, 25 bp, Mus musculus
cactgccaaggtgaaagcagccatt

SEQ ID NO: 224509 - DNA, 25 bp, Mus musculus
cactgccaaggtttcctgcctttgg

SEQ ID NO: 224510 - DNA, 25 bp, Mus musculus
cactgccaccaccaggaacttcctg

SEQ ID NO: 224511 - DNA, 25 bp, Mus musculus
cactgccaccgcgttcacattctct

SEQ ID NO: 224512 - DNA, 25 bp, Mus musculus
cactgccaccgctcacgaagttggg

SEQ ID NO: 224513 - DNA, 25 bp, Mus musculus
cactgccactcagcttgatactcat

SEQ ID NO: 224514 - DNA, 25 bp, Mus musculus
cactgccagaaacagcatgccagaa

SEQ ID NO: 224515 - DNA, 25 bp, Mus musculus
cactgccaggtgtggcgctaatgtg

SEQ ID NO: 224516 - DNA, 25 bp, Mus musculus
cactgccagtagggggtacagtcct

SEQ ID NO: 224517 - DNA, 25 bp, Mus musculus
cactgccataatgacaagtaccagg

SEQ ID NO: 224518 - DNA, 25 bp, Mus musculus
cactgccatgagagctgtttgacaa

SEQ ID NO: 224519 - DNA, 25 bp, Mus musculus
cactgccatgtcagccagtataatg

SEQ ID NO: 224520 - DNA, 25 bp, Mus musculus
cactgccatgtcccagtatgaggtt

SEQ ID NO: 224521 - DNA, 25 bp, Mus musculus
cactgcccaagtgggctcacccgag

SEQ ID NO: 224522 - DNA, 25 bp, Mus musculus
cactgcccagattttcactgtaact

SEQ ID NO: 224523 - DNA, 25 bp, Mus musculus
cactgcccaggtggaagaactaagt

SEQ ID NO: 224524 - DNA, 25 bp, Mus musculus
cactgcccaggtggagcaactagag

SEQ ID NO: 224525 - DNA, 25 bp, Mus musculus
cactgcccatagaactagatcagtt

SEQ ID NO: 224526 - DNA, 25 bp, Mus musculus
cactgccccaaggtgaagaactgat

SEQ ID NO: 224527 - DNA, 25 bp, Mus musculus
cactgccccaggaaagggtcacgaa

SEQ ID NO: 224528 - DNA, 25 bp, Mus musculus
cactgcccttccgagctatccgggt

SEQ ID NO: 224529 - DNA, 25 bp, Mus musculus
cactgcccttccgaggaagtctgcc

SEQ ID NO: 224530 - DNA, 25 bp, Mus musculus
cactgccgcagacagagtgccctgg

SEQ ID NO: 224531 - DNA, 25 bp, Mus musculus
cactgcctagagacttcctgcttgg

SEQ ID NO: 224532 - DNA, 25 bp, Mus musculus
cactgcctccaggtctggagagctg

SEQ ID NO: 224533 - DNA, 25 bp, Mus musculus
cactgcctcgcaaagagttataccc

SEQ ID NO: 224534 - DNA, 25 bp, Mus musculus
cactgcctgataaatacaacaccag

SEQ ID NO: 224535 - DNA, 25 bp, Mus musculus
cactgcctgatgttgtccaggaagc

SEQ ID NO: 224536 - DNA, 25 bp, Mus musculus
cactgcctggctaagagggaaggct

SEQ ID NO: 224537 - DNA, 25 bp, Mus musculus
cactgccttacccatatctgtcagg

SEQ ID NO: 224538 - DNA, 25 bp, Mus musculus
cactgcgacccccagcccagtaggc

SEQ ID NO: 224539 - DNA, 25 bp, Mus musculus
cactgcgccacaggaaagcactgcc

SEQ ID NO: 224540 - DNA, 25 bp, Mus musculus
cactgcgctaccctgtgaagccaga

SEQ ID NO: 224541 - DNA, 25 bp, Mus musculus
cactgcgctccaggtgccacatcat

SEQ ID NO: 224542 - DNA, 25 bp, Mus musculus
cactgcggaaactgaaacctttgtc

SEQ ID NO: 224543 - DNA, 25 bp, Mus musculus
cactgcggagctcggaattagctga

SEQ ID NO: 224544 - DNA, 25 bp, Mus musculus
cactgcggcaagtttgatggtgaca

SEQ ID NO: 224545 - DNA, 25 bp, Mus musculus
cactgcgggaccaggatgggctcag

SEQ ID NO: 224546 - DNA, 25 bp, Mus musculus
cactgcgggcccagttgctgatagc

SEQ ID NO: 224547 - DNA, 25 bp, Mus musculus
cactgcgtctcttggcctgtggaga

SEQ ID NO: 224548 - DNA, 25 bp, Mus musculus
cactgcgtgggcccagtgggcagcg

SEQ ID NO: 224549 - DNA, 25 bp, Mus musculus
cactgctaagatttgaattctgtga

SEQ ID NO: 224550 - DNA, 25 bp, Mus musculus
cactgctaatgagactcagtccgct

SEQ ID NO: 224551 - DNA, 25 bp, Mus musculus
cactgctacagctgctcctacacac

SEQ ID NO: 224552 - DNA, 25 bp, Mus musculus
cactgctacccaagcagggtggcca

SEQ ID NO: 224553 - DNA, 25 bp, Mus musculus
cactgctataggatacaaattggaa

SEQ ID NO: 224554 - DNA, 25 bp, Mus musculus
cactgctataggttgatcagatcca

SEQ ID NO: 224555 - DNA, 25 bp, Mus musculus
cactgctatggcaaccagtataatg

SEQ ID NO: 224556 - DNA, 25 bp, Mus musculus
cactgctatggcaatgacaccagcc

SEQ ID NO: 224557 - DNA, 25 bp, Mus musculus
cactgctatgtcgaccagtatgagg

SEQ ID NO: 224558 - DNA, 25 bp, Mus musculus
cactgctcaggttgaaggtttgaaa

SEQ ID NO: 224559 - DNA, 25 bp, Mus musculus
cactgctcatgggggcacctatgag

SEQ ID NO: 224560 - DNA, 25 bp, Mus musculus
cactgctccagggatccagaaggag

SEQ ID NO: 224561 - DNA, 25 bp, Mus musculus
cactgctccatgctggcagaagacg

SEQ ID NO: 224562 - DNA, 25 bp, Mus musculus
cactgctccgacaatatgcacctat

SEQ ID NO: 224563 - DNA, 25 bp, Mus musculus
cactgctccgacaatgtagatttag

SEQ ID NO: 224564 - DNA, 25 bp, Mus musculus
cactgctctaccagtccttcgtgaa

SEQ ID NO: 224565 - DNA, 25 bp, Mus musculus
cactgctctcaaaggtcttcctgca

SEQ ID NO: 224566 - DNA, 25 bp, Mus musculus
cactgctctcaatgcaggtcaatgg

SEQ ID NO: 224567 - DNA, 25 bp, Mus musculus
cactgctctggctcgacttcggatg

SEQ ID NO: 224568 - DNA, 25 bp, Mus musculus
cactgctgaggcggacaaatcagca

SEQ ID NO: 224569 - DNA, 25 bp, Mus musculus
cactgctgatggagcatctgggtgg

SEQ ID NO: 224570 - DNA, 25 bp, Mus musculus
cactgctgatggagctatatacgcc

SEQ ID NO: 224571 - DNA, 25 bp, Mus musculus
cactgctgccgttaggctactacat

SEQ ID NO: 224572 - DNA, 25 bp, Mus musculus
cactgctgctctggcaaggccagac

SEQ ID NO: 224573 - DNA, 25 bp, Mus musculus
cactgctgctctgggtaaccaaggc

SEQ ID NO: 224574 - DNA, 25 bp, Mus musculus
cactgctggtcagagaattgacctt

SEQ ID NO: 224575 - DNA, 25 bp, Mus musculus
cactgctggtcagctctgcaatctg

SEQ ID NO: 224576 - DNA, 25 bp, Mus musculus
cactgctggtcaggcagagttcacg

SEQ ID NO: 224577 - DNA, 25 bp, Mus musculus
cactgctgtgagtgcccgctatgga

SEQ ID NO: 224578 - DNA, 25 bp, Mus musculus
cactgctgtgcttatggcaaacccc

SEQ ID NO: 224579 - DNA, 25 bp, Mus musculus
cactgcttaagagggttcagtaaca

SEQ ID NO: 224580 - DNA, 25 bp, Mus musculus
cactgcttccccagagaacacagca

SEQ ID NO: 224581 - DNA, 25 bp, Mus musculus
cactgcttctctgggtctgtgaact

SEQ ID NO: 224582 - DNA, 25 bp, Mus musculus
cactgcttgcccaagtgtgcctgct

SEQ ID NO: 224583 - DNA, 25 bp, Mus musculus
cactgctttaccagaccatagaatc

SEQ ID NO: 224584 - DNA, 25 bp, Mus musculus
cactgctttaccagagcaaggctta

SEQ ID NO: 224585 - DNA, 25 bp, Mus musculus
cactgctttgcctgtaccccagtag

SEQ ID NO: 224586 - DNA, 25 bp, Mus musculus
cactgcttttctccttccgcaacac

SEQ ID NO: 224587 - DNA, 25 bp, Mus musculus
cactggaaaacgaagaaatgattct

SEQ ID NO: 224588 - DNA, 25 bp, Mus musculus
cactggaaaatggtggtggcttggt

SEQ ID NO: 224589 - DNA, 25 bp, Mus musculus
cactggaaacaaatgagatattctc

SEQ ID NO: 224590 - DNA, 25 bp, Mus musculus
cactggaaacaagataaaacaaaat

SEQ ID NO: 224591 - DNA, 25 bp, Mus musculus
cactggaaagacatgcagctgtttt

SEQ ID NO: 224592 - DNA, 25 bp, Mus musculus
cactggaaagggcagcctctttcca

SEQ ID NO: 224593 - DNA, 25 bp, Mus musculus
cactggaagagccgcccgcacccgg

SEQ ID NO: 224594 - DNA, 25 bp, Mus musculus
cactggaagagcctcagaaacactt

SEQ ID NO: 224595 - DNA, 25 bp, Mus musculus
cactggaaggtccagagaaggcaag

SEQ ID NO: 224596 - DNA, 25 bp, Mus musculus
cactggaaggtccaggacctcagac

SEQ ID NO: 224597 - DNA, 25 bp, Mus musculus
cactggaagtaaagcttgttttcag

SEQ ID NO: 224598 - DNA, 25 bp, Mus musculus
cactggacatgggtgaagaagggga

SEQ ID NO: 224599 - DNA, 25 bp, Mus musculus
cactggacccaagggaaagcgtgga

SEQ ID NO: 224600 - DNA, 25 bp, Mus musculus
cactggacgagaggatggctgtgct

SEQ ID NO: 224601 - DNA, 25 bp, Mus musculus
cactggacgagtccgttagatcggg

SEQ ID NO: 224602 - DNA, 25 bp, Mus musculus
cactggactgcatggtctgagacgg

SEQ ID NO: 224603 - DNA, 25 bp, Mus musculus
cactggacttgctgaaacctggtcc

SEQ ID NO: 224604 - DNA, 25 bp, Mus musculus
cactggagaatcgaggaaaacttcc

SEQ ID NO: 224605 - DNA, 25 bp, Mus musculus
cactggagagaaacttgatgggaag

SEQ ID NO: 224606 - DNA, 25 bp, Mus musculus
cactggagagaccagccacgatgcc

SEQ ID NO: 224607 - DNA, 25 bp, Mus musculus
cactggagagcacaggattcagtaa

SEQ ID NO: 224608 - DNA, 25 bp, Mus musculus
cactggagagccagaagtacctgca

SEQ ID NO: 224609 - DNA, 25 bp, Mus musculus
cactggagaggaactgtccgactgg

SEQ ID NO: 224610 - DNA, 25 bp, Mus musculus
cactggagatgtggctcaccatgcc

SEQ ID NO: 224611 - DNA, 25 bp, Mus musculus
cactggagcagctaaatgagatgct

SEQ ID NO: 224612 - DNA, 25 bp, Mus musculus
cactggagcaggccttatgacctgt

SEQ ID NO: 224613 - DNA, 25 bp, Mus musculus
cactggagcagggtcggtgatggag

SEQ ID NO: 224614 - DNA, 25 bp, Mus musculus
cactggagctacaggctggtaagaa

SEQ ID NO: 224615 - DNA, 25 bp, Mus musculus
cactggagggaggttgtgtagcctg

SEQ ID NO: 224616 - DNA, 25 bp, Mus musculus
cactggagggcagaggctcagaggc

SEQ ID NO: 224617 - DNA, 25 bp, Mus musculus
cactggagggtgaggctctgggtgc

SEQ ID NO: 224618 - DNA, 25 bp, Mus musculus
cactggaggtggcagagtataaagg

SEQ ID NO: 224619 - DNA, 25 bp, Mus musculus
cactggatcgccgcccttcactgca

SEQ ID NO: 224620 - DNA, 25 bp, Mus musculus
cactggcaaccagcatctgatgaca

SEQ ID NO: 224621 - DNA, 25 bp, Mus musculus
cactggcaaccaggaagctgccctc

SEQ ID NO: 224622 - DNA, 25 bp, Mus musculus
cactggcaagatgtgctagttggct

SEQ ID NO: 224623 - DNA, 25 bp, Mus musculus
cactggcaaggctggtacaaggaca

SEQ ID NO: 224624 - DNA, 25 bp, Mus musculus
cactggcacaggagacactgcagga

SEQ ID NO: 224625 - DNA, 25 bp, Mus musculus
cactggcacgaaatcctagtttcgt

SEQ ID NO: 224626 - DNA, 25 bp, Mus musculus
cactggcactacagatgctcatgac

SEQ ID NO: 224627 - DNA, 25 bp, Mus musculus
cactggcagaagctcttggcatttg

SEQ ID NO: 224628 - DNA, 25 bp, Mus musculus
cactggcagaggtacggagtttgaa

SEQ ID NO: 224629 - DNA, 25 bp, Mus musculus
cactggcagtgagatccgccatcgc

SEQ ID NO: 224630 - DNA, 25 bp, Mus musculus
cactggcatagttggagcgataggt

SEQ ID NO: 224631 - DNA, 25 bp, Mus musculus
cactggcatcatgggagcaggctgc

SEQ ID NO: 224632 - DNA, 25 bp, Mus musculus
cactggcatcatggtcaaaaatgct

SEQ ID NO: 224633 - DNA, 25 bp, Mus musculus
cactggccaaaatttatgagaagat

SEQ ID NO: 224634 - DNA, 25 bp, Mus musculus
cactggccaaaatttcctctgtgaa

SEQ ID NO: 224635 - DNA, 25 bp, Mus musculus
cactggccaagtactgtgaggtgct

SEQ ID NO: 224636 - DNA, 25 bp, Mus musculus
cactggccaatgactgtgaggtgct

SEQ ID NO: 224637 - DNA, 25 bp, Mus musculus
cactggccagaaggatgtcaatggg

SEQ ID NO: 224638 - DNA, 25 bp, Mus musculus
cactggccagtaaggcccgaatggc

SEQ ID NO: 224639 - DNA, 25 bp, Mus musculus
cactggccccgggccctcagcatcc

SEQ ID NO: 224640 - DNA, 25 bp, Mus musculus
cactggcccgcccggattgatgaac

SEQ ID NO: 224641 - DNA, 25 bp, Mus musculus
cactggcccgcccggtgcatttcta

SEQ ID NO: 224642 - DNA, 25 bp, Mus musculus
cactggccctctctggggggtcacc

SEQ ID NO: 224643 - DNA, 25 bp, Mus musculus
cactggccgagggatggaattcgaa

SEQ ID NO: 224644 - DNA, 25 bp, Mus musculus
cactggccggcccggattgatgaca

SEQ ID NO: 224645 - DNA, 25 bp, Mus musculus
cactggccgtaaatggttcagactg

SEQ ID NO: 224646 - DNA, 25 bp, Mus musculus
cactggcctagcctatgctgctggg

SEQ ID NO: 224647 - DNA, 25 bp, Mus musculus
cactggcctcgatctactccccgga

SEQ ID NO: 224648 - DNA, 25 bp, Mus musculus
cactggcctctgagagctgtcggcc

SEQ ID NO: 224649 - DNA, 25 bp, Mus musculus
cactggccttcgagtttgatcctga

SEQ ID NO: 224650 - DNA, 25 bp, Mus musculus
cactggcgagaagaccaccatgcgg

SEQ ID NO: 224651 - DNA, 25 bp, Mus musculus
cactggctaagagctgcttttagaa

SEQ ID NO: 224652 - DNA, 25 bp, Mus musculus
cactggctatgaggacgtagcaaat

SEQ ID NO: 224653 - DNA, 25 bp, Mus musculus
cactggctgaaggtaccttaacatg

SEQ ID NO: 224654 - DNA, 25 bp, Mus musculus
cactggctgacaaggcacccacatc

SEQ ID NO: 224655 - DNA, 25 bp, Mus musculus
cactggctgatctgcatccccaaaa

SEQ ID NO: 224656 - DNA, 25 bp, Mus musculus
cactggctttcagggacttcctgga

SEQ ID NO: 224657 - DNA, 25 bp, Mus musculus
cactgggaaaaggtaaatgttggag

SEQ ID NO: 224658 - DNA, 25 bp, Mus musculus
cactgggaaaaggtggcagtggggg

SEQ ID NO: 224659 - DNA, 25 bp, Mus musculus
cactgggaaaagtgagccccaggcc

SEQ ID NO: 224660 - DNA, 25 bp, Mus musculus
cactgggacaggacctctggaagca

SEQ ID NO: 224661 - DNA, 25 bp, Mus musculus
cactgggacagggatcatagacgat

SEQ ID NO: 224662 - DNA, 25 bp, Mus musculus
cactgggacgcggccatccatggct

SEQ ID NO: 224663 - DNA, 25 bp, Mus musculus
cactgggacgcgttctgtggatcta

SEQ ID NO: 224664 - DNA, 25 bp, Mus musculus
cactgggactacagggatccgtgaa

SEQ ID NO: 224665 - DNA, 25 bp, Mus musculus
cactgggagtgaggcccagcctgca

SEQ ID NO: 224666 - DNA, 25 bp, Mus musculus
cactgggattaaaaagaatggaatc

SEQ ID NO: 224667 - DNA, 25 bp, Mus musculus
cactgggattaaagggcatgaatct

SEQ ID NO: 224668 - DNA, 25 bp, Mus musculus
cactgggcctggttgtggagttgac

SEQ ID NO: 224669 - DNA, 25 bp, Mus musculus
cactgggcgcaggtttacctatttc

SEQ ID NO: 224670 - DNA, 25 bp, Mus musculus
cactgggctataagacccagttgta

SEQ ID NO: 224671 - DNA, 25 bp, Mus musculus
cactgggctataaggatgtctcccg

SEQ ID NO: 224672 - DNA, 25 bp, Mus musculus
cactgggctataggtcggatatgaa

SEQ ID NO: 224673 - DNA, 25 bp, Mus musculus
cactgggctctacgggtgacaccag

SEQ ID NO: 224674 - DNA, 25 bp, Mus musculus
cactggggaaaagggaaagcttggc

SEQ ID NO: 224675 - DNA, 25 bp, Mus musculus
cactggggttttaaggtgtctggct

SEQ ID NO: 224676 - DNA, 25 bp, Mus musculus
cactgggtatctctctttctctttt

SEQ ID NO: 224677 - DNA, 25 bp, Mus musculus
cactgggtattttcttgttacctcc

SEQ ID NO: 224678 - DNA, 25 bp, Mus musculus
cactggtaatgatgaccattaatta

SEQ ID NO: 224679 - DNA, 25 bp, Mus musculus
cactggtaccaactgtgtaaggaga

SEQ ID NO: 224680 - DNA, 25 bp, Mus musculus
cactggtatcaactgtgtaaggaga

SEQ ID NO: 224681 - DNA, 25 bp, Mus musculus
cactggtcaagattcatgaaaaact

SEQ ID NO: 224682 - DNA, 25 bp, Mus musculus
cactggtcaaggcaactattggcct

SEQ ID NO: 224683 - DNA, 25 bp, Mus musculus
cactggtccccaggcctggctgctg

SEQ ID NO: 224684 - DNA, 25 bp, Mus musculus
cactggtgaagaagcaggccagcag

SEQ ID NO: 224685 - DNA, 25 bp, Mus musculus
cactggtgagccatcttttctgggg

SEQ ID NO: 224686 - DNA, 25 bp, Mus musculus
cactggtgcagaagagaagagcagc

SEQ ID NO: 224687 - DNA, 25 bp, Mus musculus
cactggtgcagtatgatctgaagag

SEQ ID NO: 224688 - DNA, 25 bp, Mus musculus
cactggtgcgaacaaagtctcccct

SEQ ID NO: 224689 - DNA, 25 bp, Mus musculus
cactggtgtaagaaatgaagctcaa

SEQ ID NO: 224690 - DNA, 25 bp, Mus musculus
cactggttatgctttccatgaagtg

SEQ ID NO: 224691 - DNA, 25 bp, Mus musculus
cactggttatggatccatctgttgg

SEQ ID NO: 224692 - DNA, 25 bp, Mus musculus
cactggttccataggtgcggctctg

SEQ ID NO: 224693 - DNA, 25 bp, Mus musculus
cactggttgagatcctctttaggag

SEQ ID NO: 224694 - DNA, 25 bp, Mus musculus
cactggttgagggcaatggcatctc

SEQ ID NO: 224695 - DNA, 25 bp, Mus musculus
cactggtttatcgggaccagaataa

SEQ ID NO: 224696 - DNA, 25 bp, Mus musculus
cactggtttgtacagtgtctaccca

SEQ ID NO: 224697 - DNA, 25 bp, Mus musculus
cactgtaaaccaggtcactcctgtc

SEQ ID NO: 224698 - DNA, 25 bp, Mus musculus
cactgtaaaggtgcgagaagatgta

SEQ ID NO: 224699 - DNA, 25 bp, Mus musculus
cactgtaaatggagatcgctctgga

SEQ ID NO: 224700 - DNA, 25 bp, Mus musculus
cactgtaacgagcgcttgtacaggt

SEQ ID NO: 224701 - DNA, 25 bp, Mus musculus
cactgtaaggcccatcctttgtgag

SEQ ID NO: 224702 - DNA, 25 bp, Mus musculus
cactgtacaacatcagccatgcaca

SEQ ID NO: 224703 - DNA, 25 bp, Mus musculus
cactgtacaacttgactggtctgag

SEQ ID NO: 224704 - DNA, 25 bp, Mus musculus
cactgtacagacagtggatttggag

SEQ ID NO: 224705 - DNA, 25 bp, Mus musculus
cactgtaccaaggcagctcaggctg

SEQ ID NO: 224706 - DNA, 25 bp, Mus musculus
cactgtaccaagtgcagctcagtcc

SEQ ID NO: 224707 - DNA, 25 bp, Mus musculus
cactgtactacacagttcaacggga

SEQ ID NO: 224708 - DNA, 25 bp, Mus musculus
cactgtactcaagactgcaggcgct

SEQ ID NO: 224709 - DNA, 25 bp, Mus musculus
cactgtactcaagtcctggatcagt

SEQ ID NO: 224710 - DNA, 25 bp, Mus musculus
cactgtagagccaaacatccagaac

SEQ ID NO: 224711 - DNA, 25 bp, Mus musculus
cactgtagtggaagaagaatgactg

SEQ ID NO: 224712 - DNA, 25 bp, Mus musculus
cactgtagtggaagagaaatcactg

SEQ ID NO: 224713 - DNA, 25 bp, Mus musculus
cactgtatcaaacgctacctggggg

SEQ ID NO: 224714 - DNA, 25 bp, Mus musculus
cactgtatcaaaggctacctggggg

SEQ ID NO: 224715 - DNA, 25 bp, Mus musculus
cactgtatcacttgatattaaacta

SEQ ID NO: 224716 - DNA, 25 bp, Mus musculus
cactgtatcggttccatgtaagtct

SEQ ID NO: 224717 - DNA, 25 bp, Mus musculus
cactgtattctcagttcctgtagtt

SEQ ID NO: 224718 - DNA, 25 bp, Mus musculus
cactgtcaagcgcagggtcaaagat

SEQ ID NO: 224719 - DNA, 25 bp, Mus musculus
cactgtcaagcggaagatggagaac

SEQ ID NO: 224720 - DNA, 25 bp, Mus musculus
cactgtcaagctgagactgttggtg

SEQ ID NO: 224721 - DNA, 25 bp, Mus musculus
cactgtcaagcttctcatgctgcct

SEQ ID NO: 224722 - DNA, 25 bp, Mus musculus
cactgtcaaggatgtgtttgagttt

SEQ ID NO: 224723 - DNA, 25 bp, Mus musculus
cactgtcaagggcagggtcaaagat

SEQ ID NO: 224724 - DNA, 25 bp, Mus musculus
cactgtcaagtcaagactgttggtg

SEQ ID NO: 224725 - DNA, 25 bp, Mus musculus
cactgtcaatatgagaagaacaaac

SEQ ID NO: 224726 - DNA, 25 bp, Mus musculus
cactgtcaatatgatataaatgaat

SEQ ID NO: 224727 - DNA, 25 bp, Mus musculus
cactgtcaccgactatttgcatcag

SEQ ID NO: 224728 - DNA, 25 bp, Mus musculus
cactgtcaccgagtttgtctctgtc

SEQ ID NO: 224729 - DNA, 25 bp, Mus musculus
cactgtcaccgatgtggataagtcc

SEQ ID NO: 224730 - DNA, 25 bp, Mus musculus
cactgtcacggtctgtctgacactc

SEQ ID NO: 224731 - DNA, 25 bp, Mus musculus
cactgtcactttgcagtgccctgct

SEQ ID NO: 224732 - DNA, 25 bp, Mus musculus
cactgtcagagctaaacagaaagaa

SEQ ID NO: 224733 - DNA, 25 bp, Mus musculus
cactgtcaggaattccttaactcca

SEQ ID NO: 224734 - DNA, 25 bp, Mus musculus
cactgtcatcgccacctgcggcccc

SEQ ID NO: 224735 - DNA, 25 bp, Mus musculus
cactgtcattagaccatttccagga

SEQ ID NO: 224736 - DNA, 25 bp, Mus musculus
cactgtccaaactagcctctgcagg

SEQ ID NO: 224737 - DNA, 25 bp, Mus musculus
cactgtccaacactggccagtgttc

SEQ ID NO: 224738 - DNA, 25 bp, Mus musculus
cactgtccaagacccagcaactaca

SEQ ID NO: 224739 - DNA, 25 bp, Mus musculus
cactgtccaagagttgtttgcagcc

SEQ ID NO: 224740 - DNA, 25 bp, Mus musculus
cactgtccaagatctccgaggctgc

SEQ ID NO: 224741 - DNA, 25 bp, Mus musculus
cactgtccaaggatggaaggtcact

SEQ ID NO: 224742 - DNA, 25 bp, Mus musculus
cactgtccaagtggacacgggcctt

SEQ ID NO: 224743 - DNA, 25 bp, Mus musculus
cactgtccacacaagctttgaacca

SEQ ID NO: 224744 - DNA, 25 bp, Mus musculus
cactgtccacacaaggtttcacgac

SEQ ID NO: 224745 - DNA, 25 bp, Mus musculus
cactgtccagcttgccagtgcaacg

SEQ ID NO: 224746 - DNA, 25 bp, Mus musculus
cactgtccagtgcttctacttctca

SEQ ID NO: 224747 - DNA, 25 bp, Mus musculus
cactgtccagttaatgtgttaagaa

SEQ ID NO: 224748 - DNA, 25 bp, Mus musculus
cactgtccgccgggagcagcaacct

SEQ ID NO: 224749 - DNA, 25 bp, Mus musculus
cactgtcctcactatgcccgaccct

SEQ ID NO: 224750 - DNA, 25 bp, Mus musculus
cactgtccttcgggacctgctagaa

SEQ ID NO: 224751 - DNA, 25 bp, Mus musculus
cactgtcgacccgacaaaacttacc

SEQ ID NO: 224752 - DNA, 25 bp, Mus musculus
cactgtcgacccggaggaggaggag

SEQ ID NO: 224753 - DNA, 25 bp, Mus musculus
cactgtctagcaccatcaaaaagga

SEQ ID NO: 224754 - DNA, 25 bp, Mus musculus
cactgtctctgcagaacaacactga

SEQ ID NO: 224755 - DNA, 25 bp, Mus musculus
cactgtctctgcagagagtcagtcc

SEQ ID NO: 224756 - DNA, 25 bp, Mus musculus
cactgtctctgcagagtctgcgaga

SEQ ID NO: 224757 - DNA, 25 bp, Mus musculus
cactgtctctgcagccaaaacaaca

SEQ ID NO: 224758 - DNA, 25 bp, Mus musculus
cactgtctctgcaggtaatgaaaag

SEQ ID NO: 224759 - DNA, 25 bp, Mus musculus
cactgtctgaactcacgctcgcctg

SEQ ID NO: 224760 - DNA, 25 bp, Mus musculus
cactgtctttgcccggaacacacgc

SEQ ID NO: 224761 - DNA, 25 bp, Mus musculus
cactgtcttttctgcccccagctat

SEQ ID NO: 224762 - DNA, 25 bp, Mus musculus
cactgtgaaaccgagaccaactact

SEQ ID NO: 224763 - DNA, 25 bp, Mus musculus
cactgtgaaaccggttgttctacac

SEQ ID NO: 224764 - DNA, 25 bp, Mus musculus
cactgtgaatggttaccataccaca

SEQ ID NO: 224765 - DNA, 25 bp, Mus musculus
cactgtgaccactcgtcctgaggtt

SEQ ID NO: 224766 - DNA, 25 bp, Mus musculus
cactgtgacgagggtggctcacact

SEQ ID NO: 224767 - DNA, 25 bp, Mus musculus
cactgtgaggatatcaatgaatgct

SEQ ID NO: 224768 - DNA, 25 bp, Mus musculus
cactgtgattaaagccatcatgtta

SEQ ID NO: 224769 - DNA, 25 bp, Mus musculus
cactgtgcagctcattctctttggg

SEQ ID NO: 224770 - DNA, 25 bp, Mus musculus
cactgtgcagttccgctcgctgtcc

SEQ ID NO: 224771 - DNA, 25 bp, Mus musculus
cactgtgccactcctgcctggaatg

SEQ ID NO: 224772 - DNA, 25 bp, Mus musculus
cactgtgccagcaccagaccctagt

SEQ ID NO: 224773 - DNA, 25 bp, Mus musculus
cactgtgccgggtgcacacagtgag

SEQ ID NO: 224774 - DNA, 25 bp, Mus musculus
cactgtgccttcaggctcacccagg

SEQ ID NO: 224775 - DNA, 25 bp, Mus musculus
cactgtgcgagaaaaagcggatggt

SEQ ID NO: 224776 - DNA, 25 bp, Mus musculus
cactgtgcgaggcatgctgccccac

SEQ ID NO: 224777 - DNA, 25 bp, Mus musculus
cactgtgcggcgagaaggactccat

SEQ ID NO: 224778 - DNA, 25 bp, Mus musculus
cactgtgcggcgagacacaccagaa

SEQ ID NO: 224779 - DNA, 25 bp, Mus musculus
cactgtgcggcgagatcccacgggt

SEQ ID NO: 224780 - DNA, 25 bp, Mus musculus
cactgtgctaagaggtccagcatgc

SEQ ID NO: 224781 - DNA, 25 bp, Mus musculus
cactgtgctaagtgacattgaccag

SEQ ID NO: 224782 - DNA, 25 bp, Mus musculus
cactgtggaaggaagtttggcacct

SEQ ID NO: 224783 - DNA, 25 bp, Mus musculus
cactgtggaagtggtcccaaccgag

SEQ ID NO: 224784 - DNA, 25 bp, Mus musculus
cactgtggacctagattcatcagcc

SEQ ID NO: 224785 - DNA, 25 bp, Mus musculus
cactgtggacctagggtttctctgt

SEQ ID NO: 224786 - DNA, 25 bp, Mus musculus
cactgtggacgatgctcagaccagt

SEQ ID NO: 224787 - DNA, 25 bp, Mus musculus
cactgtggaggagctgaagttcaac

SEQ ID NO: 224788 - DNA, 25 bp, Mus musculus
cactgtggataaaaatatgcccaaa

SEQ ID NO: 224789 - DNA, 25 bp, Mus musculus
cactgtggatggaccagggaaagag

SEQ ID NO: 224790 - DNA, 25 bp, Mus musculus
cactgtggatgggtcagggaaagag

SEQ ID NO: 224791 - DNA, 25 bp, Mus musculus
cactgtggcaggtgttcttctggac

SEQ ID NO: 224792 - DNA, 25 bp, Mus musculus
cactgtggccaggtccttcattcca

SEQ ID NO: 224793 - DNA, 25 bp, Mus musculus
cactgtgggaaagaaggttaacctc

SEQ ID NO: 224794 - DNA, 25 bp, Mus musculus
cactgtgggaacaggaacagaatgg

SEQ ID NO: 224795 - DNA, 25 bp, Mus musculus
cactgtgggaacaggtattgaagcc

SEQ ID NO: 224796 - DNA, 25 bp, Mus musculus
cactgtgggaggaccatccttgctg

SEQ ID NO: 224797 - DNA, 25 bp, Mus musculus
cactgtgggccagatctgccacctc

SEQ ID NO: 224798 - DNA, 25 bp, Mus musculus
cactgtgggcccagaccattcccct

SEQ ID NO: 224799 - DNA, 25 bp, Mus musculus
cactgtggtccgagggctgctggac

SEQ ID NO: 224800 - DNA, 25 bp, Mus musculus
cactgtggtgacaggcattgagatg

SEQ ID NO: 224801 - DNA, 25 bp, Mus musculus
cactgtggttggctgggacccacga

SEQ ID NO: 224802 - DNA, 25 bp, Mus musculus
cactgtggttggtgagcggggcaca

SEQ ID NO: 224803 - DNA, 25 bp, Mus musculus
cactgtgtaaaaggccttaaccatg

SEQ ID NO: 224804 - DNA, 25 bp, Mus musculus
cactgtgtaacccagagatttattt

SEQ ID NO: 224805 - DNA, 25 bp, Mus musculus
cactgtgtacccaggaataaaaccc

SEQ ID NO: 224806 - DNA, 25 bp, Mus musculus
cactgtgtacccaggttgtgactac

SEQ ID NO: 224807 - DNA, 25 bp, Mus musculus
cactgtgtatatggacatctggatt

SEQ ID NO: 224808 - DNA, 25 bp, Mus musculus
cactgtgtcaggtgtggcccataga

SEQ ID NO: 224809 - DNA, 25 bp, Mus musculus
cactgtgtcttcagtaaatgaagca

SEQ ID NO: 224810 - DNA, 25 bp, Mus musculus
cactgtgtgatgcgggtgcctggct

SEQ ID NO: 224811 - DNA, 25 bp, Mus musculus
cactgtgtggaagaacccctcagca

SEQ ID NO: 224812 - DNA, 25 bp, Mus musculus
cactgtgtgtctgcctcgtgcctca

SEQ ID NO: 224813 - DNA, 25 bp, Mus musculus
cactgtgtgtggagtgctgacagag

SEQ ID NO: 224814 - DNA, 25 bp, Mus musculus
cactgtgtgtggcatattctcatct

SEQ ID NO: 224815 - DNA, 25 bp, Mus musculus
cactgtgttgagcacatcgagtcac

SEQ ID NO: 224816 - DNA, 25 bp, Mus musculus
cactgtgttgaggtcctgagttcaa

SEQ ID NO: 224817 - DNA, 25 bp, Mus musculus
cactgtgttgccagaaaaagatctt

SEQ ID NO: 224818 - DNA, 25 bp, Mus musculus
cactgttaacaggcagcaaacagaa

SEQ ID NO: 224819 - DNA, 25 bp, Mus musculus
cactgttcagcccacagtgagaatc

SEQ ID NO: 224820 - DNA, 25 bp, Mus musculus
cactgttcaggcatccgaaggtgtc

SEQ ID NO: 224821 - DNA, 25 bp, Mus musculus
cactgttccatgtctccaggaaacc

SEQ ID NO: 224822 - DNA, 25 bp, Mus musculus
cactgttccgcaaggaggtgctggc

SEQ ID NO: 224823 - DNA, 25 bp, Mus musculus
cactgttctacaggctgcggctgtg

SEQ ID NO: 224824 - DNA, 25 bp, Mus musculus
cactgttctcttggagttctgacgg

SEQ ID NO: 224825 - DNA, 25 bp, Mus musculus
cactgttctgcaggcttgcgagaag

SEQ ID NO: 224826 - DNA, 25 bp, Mus musculus
cactgttgagggatgacctgccatt

SEQ ID NO: 224827 - DNA, 25 bp, Mus musculus
cactgttgatccacagggatggcca

SEQ ID NO: 224828 - DNA, 25 bp, Mus musculus
cactgtttccgagaagagtagcagc

SEQ ID NO: 224829 - DNA, 25 bp, Mus musculus
cactgtttccgagggtcagataaca

SEQ ID NO: 224830 - DNA, 25 bp, Mus musculus
cactgtttggagaaatcttcaagac

SEQ ID NO: 224831 - DNA, 25 bp, Mus musculus
cactgttttgagagtggagtcaaca

SEQ ID NO: 224832 - DNA, 25 bp, Mus musculus
cacttaacaggacaagctctgactc

SEQ ID NO: 224833 - DNA, 25 bp, Mus musculus
cacttaacaggtccccaggcaagaa

SEQ ID NO: 224834 - DNA, 25 bp, Mus musculus
cacttacaagagcctcaggacagca

SEQ ID NO: 224835 - DNA, 25 bp, Mus musculus
cacttacaagagggggaaggacttg

SEQ ID NO: 224836 - DNA, 25 bp, Mus musculus
cacttacaatgggagatgatggccc

SEQ ID NO: 224837 - DNA, 25 bp, Mus musculus
cacttacaatgggaggtgctggata

SEQ ID NO: 224838 - DNA, 25 bp, Mus musculus
cacttacaatgggagtgaacacgga

SEQ ID NO: 224839 - DNA, 25 bp, Mus musculus
cacttacacaaacagatctttgagg

SEQ ID NO: 224840 - DNA, 25 bp, Mus musculus
cacttacacaaacagtcaaagcagt

SEQ ID NO: 224841 - DNA, 25 bp, Mus musculus
cacttacacaggccgccccgggact

SEQ ID NO: 224842 - DNA, 25 bp, Mus musculus
cacttacattcaatgctcagtgctg

SEQ ID NO: 224843 - DNA, 25 bp, Mus musculus
cacttaccagacactaatctgaccc

SEQ ID NO: 224844 - DNA, 25 bp, Mus musculus
cacttaccagacactgcacaagggc

SEQ ID NO: 224845 - DNA, 25 bp, Mus musculus
cacttaccaggtctttgacagaata

SEQ ID NO: 224846 - DNA, 25 bp, Mus musculus
cacttaccatagaagtacctcaaat

SEQ ID NO: 224847 - DNA, 25 bp, Mus musculus
cacttaccatagaagttgctccttt

SEQ ID NO: 224848 - DNA, 25 bp, Mus musculus
cacttacgaagatggctctgactcc

SEQ ID NO: 224849 - DNA, 25 bp, Mus musculus
cacttactacaatttctgaagtgaa

SEQ ID NO: 224850 - DNA, 25 bp, Mus musculus
cacttactgaactgatggctgccca

SEQ ID NO: 224851 - DNA, 25 bp, Mus musculus
cacttagacagacttacaacagctg

SEQ ID NO: 224852 - DNA, 25 bp, Mus musculus
cacttagcaaaaaagggtctcgtag

SEQ ID NO: 224853 - DNA, 25 bp, Mus musculus
cacttagcaaaaaaggtgttcctca

SEQ ID NO: 224854 - DNA, 25 bp, Mus musculus
cacttaggagcagttctccgacctg

SEQ ID NO: 224855 - DNA, 25 bp, Mus musculus
cacttaggaggcacatagacatttt

SEQ ID NO: 224856 - DNA, 25 bp, Mus musculus
cacttagttggtcgaccgcccctgc

SEQ ID NO: 224857 - DNA, 25 bp, Mus musculus
cacttatccaggctgaataaaaatc

SEQ ID NO: 224858 - DNA, 25 bp, Mus musculus
cacttatccagggtgtattgagaat

SEQ ID NO: 224859 - DNA, 25 bp, Mus musculus
cacttatcggaaatggtgaagcaaa

SEQ ID NO: 224860 - DNA, 25 bp, Mus musculus
cacttatgaagatcccacataccat

SEQ ID NO: 224861 - DNA, 25 bp, Mus musculus
cacttatgaaggtccttcagtagcc

SEQ ID NO: 224862 - DNA, 25 bp, Mus musculus
cacttatgacctgatggccaactta

SEQ ID NO: 224863 - DNA, 25 bp, Mus musculus
cacttatgacctggcagaacagctt

SEQ ID NO: 224864 - DNA, 25 bp, Mus musculus
cacttatgtgatccgtgatgagtgg

SEQ ID NO: 224865 - DNA, 25 bp, Mus musculus
cacttcaaaaaagatggtttttgat

SEQ ID NO: 224866 - DNA, 25 bp, Mus musculus
cacttcaaagagcagcctctattaa

SEQ ID NO: 224867 - DNA, 25 bp, Mus musculus
cacttcaaaggagtgtcactactcc

SEQ ID NO: 224868 - DNA, 25 bp, Mus musculus
cacttcaaatggacccataactggt

SEQ ID NO: 224869 - DNA, 25 bp, Mus musculus
cacttcaaatgggaagaagatggac

SEQ ID NO: 224870 - DNA, 25 bp, Mus musculus
cacttcaaatggggagggtagacct

SEQ ID NO: 224871 - DNA, 25 bp, Mus musculus
cacttcaacaggactcatttcacct

SEQ ID NO: 224872 - DNA, 25 bp, Mus musculus
cacttcaacagttatcagagactgc

SEQ ID NO: 224873 - DNA, 25 bp, Mus musculus
cacttcaaccagcgaattcagcttg

SEQ ID NO: 224874 - DNA, 25 bp, Mus musculus
cacttcaaccagtgtttgtcagcag

SEQ ID NO: 224875 - DNA, 25 bp, Mus musculus
cacttcacaagaaattaccatggtt

SEQ ID NO: 224876 - DNA, 25 bp, Mus musculus
cacttcacaaggatggaatagagtt

SEQ ID NO: 224877 - DNA, 25 bp, Mus musculus
cacttcactccctgaaaaatcgagt

SEQ ID NO: 224878 - DNA, 25 bp, Mus musculus
cacttcactccctgcagtctcgaat

SEQ ID NO: 224879 - DNA, 25 bp, Mus musculus
cacttcagaagataccatctatgtc

SEQ ID NO: 224880 - DNA, 25 bp, Mus musculus
cacttcagaggctgggcaaagtcct

SEQ ID NO: 224881 - DNA, 25 bp, Mus musculus
cacttcagcaagatgaagacatccc

SEQ ID NO: 224882 - DNA, 25 bp, Mus musculus
cacttcagcaagatgagtcgaaagg

SEQ ID NO: 224883 - DNA, 25 bp, Mus musculus
cacttcagcaccagatccctgctgt

SEQ ID NO: 224884 - DNA, 25 bp, Mus musculus
cacttcaggaagctgatgaagagtt

SEQ ID NO: 224885 - DNA, 25 bp, Mus musculus
cacttcatcaaagagtgtggcctgc

SEQ ID NO: 224886 - DNA, 25 bp, Mus musculus
cacttcatcaataggaagaagagag

SEQ ID NO: 224887 - DNA, 25 bp, Mus musculus
cacttcatcaatatgaagagtgtca

SEQ ID NO: 224888 - DNA, 25 bp, Mus musculus
cacttcatgtcaacaaagtccaagg

SEQ ID NO: 224889 - DNA, 25 bp, Mus musculus
cacttcattccccagactaggctgt

SEQ ID NO: 224890 - DNA, 25 bp, Mus musculus
cacttcattggccccagagcagcag

SEQ ID NO: 224891 - DNA, 25 bp, Mus musculus
cacttccaaaatgataaactttata

SEQ ID NO: 224892 - DNA, 25 bp, Mus musculus
cacttccaacaagaggaaaaagcta

SEQ ID NO: 224893 - DNA, 25 bp, Mus musculus
cacttccaacgtgaaactcatccgg

SEQ ID NO: 224894 - DNA, 25 bp, Mus musculus
cacttccaaggtagcgttggtatat

SEQ ID NO: 224895 - DNA, 25 bp, Mus musculus
cacttccaatgcagcctgtggcatc

SEQ ID NO: 224896 - DNA, 25 bp, Mus musculus
cacttccacagatctgcagactctc

SEQ ID NO: 224897 - DNA, 25 bp, Mus musculus
cacttccagcccaggtgctggggcc

SEQ ID NO: 224898 - DNA, 25 bp, Mus musculus
cacttccatgaaggcattgtcgcca

SEQ ID NO: 224899 - DNA, 25 bp, Mus musculus
cacttccatgaaggcctgcgggccc

SEQ ID NO: 224900 - DNA, 25 bp, Mus musculus
cacttccatgaaggcgagcctgtca

SEQ ID NO: 224901 - DNA, 25 bp, Mus musculus
cacttccatgtccaggttttcccat

SEQ ID NO: 224902 - DNA, 25 bp, Mus musculus
cacttccattatcggaatgtgcggg

SEQ ID NO: 224903 - DNA, 25 bp, Mus musculus
cacttcccaaaaagaagattataaa

SEQ ID NO: 224904 - DNA, 25 bp, Mus musculus
cacttcccacagaggttgaaatggg

SEQ ID NO: 224905 - DNA, 25 bp, Mus musculus
cacttcccagggaggtcagcacctc

SEQ ID NO: 224906 - DNA, 25 bp, Mus musculus
cacttccccaaattcctgtccatgc

SEQ ID NO: 224907 - DNA, 25 bp, Mus musculus
cacttcccctcctgaagctgattgg

SEQ ID NO: 224908 - DNA, 25 bp, Mus musculus
cacttccggcagctccgtaaccgcc

SEQ ID NO: 224909 - DNA, 25 bp, Mus musculus
cacttcctaaaaggtaaagcaccgt

SEQ ID NO: 224910 - DNA, 25 bp, Mus musculus
cacttcctccagaagaagactccta

SEQ ID NO: 224911 - DNA, 25 bp, Mus musculus
cacttcctgaaagatgatggcgtga

SEQ ID NO: 224912 - DNA, 25 bp, Mus musculus
cacttcctgaagatcaaagacgcct

SEQ ID NO: 224913 - DNA, 25 bp, Mus musculus
cacttcctgagctttctatcggaag

SEQ ID NO: 224914 - DNA, 25 bp, Mus musculus
cacttcctgaggatgttgatccagg

SEQ ID NO: 224915 - DNA, 25 bp, Mus musculus
cacttcctgctgcaggctctggtcc

SEQ ID NO: 224916 - DNA, 25 bp, Mus musculus
cacttcgcataggagagcgggctga

SEQ ID NO: 224917 - DNA, 25 bp, Mus musculus
cacttcggcaagttggagtgcttaa

SEQ ID NO: 224918 - DNA, 25 bp, Mus musculus
cacttcgggaccaggtctcctgttc

SEQ ID NO: 224919 - DNA, 25 bp, Mus musculus
cacttcgggcactgagcaccagttt

SEQ ID NO: 224920 - DNA, 25 bp, Mus musculus
cacttcggggaggacagggtaacag

SEQ ID NO: 224921 - DNA, 25 bp, Mus musculus
cacttcggggaggtggccaagcagg

SEQ ID NO: 224922 - DNA, 25 bp, Mus musculus
cacttcggtgggctcggatggcgtc

SEQ ID NO: 224923 - DNA, 25 bp, Mus musculus
cacttcgtcctggatcttcctgccc

SEQ ID NO: 224924 - DNA, 25 bp, Mus musculus
cacttcgtcctgtcagtggtgcagt

SEQ ID NO: 224925 - DNA, 25 bp, Mus musculus
cacttcgtggaggtcctggaccttt

SEQ ID NO: 224926 - DNA, 25 bp, Mus musculus
cacttcgtggaggtcctggtggccc

SEQ ID NO: 224927 - DNA, 25 bp, Mus musculus
cacttctaaacagaattctgatttt

SEQ ID NO: 224928 - DNA, 25 bp, Mus musculus
cacttctaaacagatggatttactg

SEQ ID NO: 224929 - DNA, 25 bp, Mus musculus
cacttctaaggcggcgacagcagcg

SEQ ID NO: 224930 - DNA, 25 bp, Mus musculus
cacttctaggtcgtttcagctctgc

SEQ ID NO: 224931 - DNA, 25 bp, Mus musculus
cacttctcaactcagtttgacccat

SEQ ID NO: 224932 - DNA, 25 bp, Mus musculus
cacttctcacccggaaaatgactcc

SEQ ID NO: 224933 - DNA, 25 bp, Mus musculus
cacttctcaggcctacagggtggac

SEQ ID NO: 224934 - DNA, 25 bp, Mus musculus
cacttctcaggttcctgtcccacca

SEQ ID NO: 224935 - DNA, 25 bp, Mus musculus
cacttctctcaggcaggcaaccttc

SEQ ID NO: 224936 - DNA, 25 bp, Mus musculus
cacttctcttagagtgtggggccga

SEQ ID NO: 224937 - DNA, 25 bp, Mus musculus
cacttctgaccgccctgctgctcat

SEQ ID NO: 224938 - DNA, 25 bp, Mus musculus
cacttctgacgatcttgaccggccc

SEQ ID NO: 224939 - DNA, 25 bp, Mus musculus
cacttctgagtcaagagcttggatt

SEQ ID NO: 224940 - DNA, 25 bp, Mus musculus
cacttctgatggaggaatcaaaaat

SEQ ID NO: 224941 - DNA, 25 bp, Mus musculus
cacttctggagaccacatgtgtcgc

SEQ ID NO: 224942 - DNA, 25 bp, Mus musculus
cacttctggaggaaaatatgtcgta

SEQ ID NO: 224943 - DNA, 25 bp, Mus musculus
cacttctgggaggcctggccttgat

SEQ ID NO: 224944 - DNA, 25 bp, Mus musculus
cacttctgtaacattgccattatcc

SEQ ID NO: 224945 - DNA, 25 bp, Mus musculus
cacttctgtctgagatcgtcagtgg

SEQ ID NO: 224946 - DNA, 25 bp, Mus musculus
cacttctgttcaggaaactggagac

SEQ ID NO: 224947 - DNA, 25 bp, Mus musculus
cacttcttcctgccttaaccatggc

SEQ ID NO: 224948 - DNA, 25 bp, Mus musculus
cacttcttctcagaaaagaggccag

SEQ ID NO: 224949 - DNA, 25 bp, Mus musculus
cacttcttctcagataaggatgaat

SEQ ID NO: 224950 - DNA, 25 bp, Mus musculus
cacttcttgagtgagccctgaatct

SEQ ID NO: 224951 - DNA, 25 bp, Mus musculus
cacttcttgagtgagggtatcctgt

SEQ ID NO: 224952 - DNA, 25 bp, Mus musculus
cacttctttacaaggattttcacct

SEQ ID NO: 224953 - DNA, 25 bp, Mus musculus
cacttgaaacagttccctggcagcc

SEQ ID NO: 224954 - DNA, 25 bp, Mus musculus
cacttgaaaccagcgtgcagggtcg

SEQ ID NO: 224955 - DNA, 25 bp, Mus musculus
cacttgaacagatggggtgtttgtt

SEQ ID NO: 224956 - DNA, 25 bp, Mus musculus
cacttgaacagattcattatgtctt

SEQ ID NO: 224957 - DNA, 25 bp, Mus musculus
cacttgaccagactcgcgctctcca

SEQ ID NO: 224958 - DNA, 25 bp, Mus musculus
cacttgaccagactggcgctctcca

SEQ ID NO: 224959 - DNA, 25 bp, Mus musculus
cacttgataccctgggcaggattcc

SEQ ID NO: 224960 - DNA, 25 bp, Mus musculus
cacttgatcgattatgaaaagggcg

SEQ ID NO: 224961 - DNA, 25 bp, Mus musculus
cacttgatcggttatgaaaagtctg

SEQ ID NO: 224962 - DNA, 25 bp, Mus musculus
cacttgcaaaagaggccatgacgat

SEQ ID NO: 224963 - DNA, 25 bp, Mus musculus
cacttgcaaggccataccttctggg

SEQ ID NO: 224964 - DNA, 25 bp, Mus musculus
cacttgcaggagttcgaggaggggt

SEQ ID NO: 224965 - DNA, 25 bp, Mus musculus
cacttgcaggctgtggggtcgtgcc

SEQ ID NO: 224966 - DNA, 25 bp, Mus musculus
cacttgccaaaggaaagcgagcttg

SEQ ID NO: 224967 - DNA, 25 bp, Mus musculus
cacttgccaaaggcagtttgatgtt

SEQ ID NO: 224968 - DNA, 25 bp, Mus musculus
cacttgccagctcctgtgcggcaca

SEQ ID NO: 224969 - DNA, 25 bp, Mus musculus
cacttgccgccgtaggaactgaccc

SEQ ID NO: 224970 - DNA, 25 bp, Mus musculus
cacttgcgaaggggcttcgcctcta

SEQ ID NO: 224971 - DNA, 25 bp, Mus musculus
cacttgctacaagtgtggtgagaaa

SEQ ID NO: 224972 - DNA, 25 bp, Mus musculus
cacttgctacaagtgtggtgggcta

SEQ ID NO: 224973 - DNA, 25 bp, Mus musculus
cacttgctcagccttcctgatcacc

SEQ ID NO: 224974 - DNA, 25 bp, Mus musculus
cacttgcttagcaaggcacaacacg

SEQ ID NO: 224975 - DNA, 25 bp, Mus musculus
cacttgcttcagccagagtaacagt

SEQ ID NO: 224976 - DNA, 25 bp, Mus musculus
cacttggcagaatcgtatggaagct

SEQ ID NO: 224977 - DNA, 25 bp, Mus musculus
cacttggccttgatgaagaacaacg

SEQ ID NO: 224978 - DNA, 25 bp, Mus musculus
cacttggctagctgcacatccctac

SEQ ID NO: 224979 - DNA, 25 bp, Mus musculus
cacttggctatgggagaggagagaa

SEQ ID NO: 224980 - DNA, 25 bp, Mus musculus
cacttggctatgggggcggggcccg

SEQ ID NO: 224981 - DNA, 25 bp, Mus musculus
cacttgggaggccatggaggacctg

SEQ ID NO: 224982 - DNA, 25 bp, Mus musculus
cacttgggcatgatccagagcaatg

SEQ ID NO: 224983 - DNA, 25 bp, Mus musculus
cacttgggcatgctttggtggcccc

SEQ ID NO: 224984 - DNA, 25 bp, Mus musculus
cacttggggaagcctgagatggggg

SEQ ID NO: 224985 - DNA, 25 bp, Mus musculus
cacttggtgagagccctgaagacaa

SEQ ID NO: 224986 - DNA, 25 bp, Mus musculus
cacttggtgcatcgggagcaatcat

SEQ ID NO: 224987 - DNA, 25 bp, Mus musculus
cacttggttatgaggaggatgttag

SEQ ID NO: 224988 - DNA, 25 bp, Mus musculus
cacttgtacatggaggctttgctga

SEQ ID NO: 224989 - DNA, 25 bp, Mus musculus
cacttgtacatggtgctctagacta

SEQ ID NO: 224990 - DNA, 25 bp, Mus musculus
cacttgtgacagagccctgcttcaa

SEQ ID NO: 224991 - DNA, 25 bp, Mus musculus
cacttgtgccggtcccgcctggcag

SEQ ID NO: 224992 - DNA, 25 bp, Mus musculus
cacttgtgcggaggcccactgatct

SEQ ID NO: 224993 - DNA, 25 bp, Mus musculus
cacttgtgcgggtgactcaggaggc

SEQ ID NO: 224994 - DNA, 25 bp, Mus musculus
cacttgtgctgcttctcaggatgga

SEQ ID NO: 224995 - DNA, 25 bp, Mus musculus
cacttgtggaaaagatattctcatg

SEQ ID NO: 224996 - DNA, 25 bp, Mus musculus
cacttgttatcagttgaatctggag

SEQ ID NO: 224997 - DNA, 25 bp, Mus musculus
cacttgttcagggtgacagaaggtg

SEQ ID NO: 224998 - DNA, 25 bp, Mus musculus
cacttgttgccagaaagcagcagct

SEQ ID NO: 224999 - DNA, 25 bp, Mus musculus
cacttgttgccaggtgaacagctgc

SEQ ID NO: 225000 - DNA, 25 bp, Mus musculus
cacttgtttgatttatgaggaatcc

SEQ ID NO: 225001 - DNA, 25 bp, Mus musculus
cacttgtttgcgtttcccaacagag

SEQ ID NO: 225002 - DNA, 25 bp, Mus musculus
cacttgtttggttgtggcctacggt

SEQ ID NO: 225003 - DNA, 25 bp, Mus musculus
cactttaaaacggctaggacttctc

SEQ ID NO: 225004 - DNA, 25 bp, Mus musculus
cactttacaggtggctttgcagctg

SEQ ID NO: 225005 - DNA, 25 bp, Mus musculus
cactttagatcttgggaacctggtg

SEQ ID NO: 225006 - DNA, 25 bp, Mus musculus
cactttaggagaagacataatgtca

SEQ ID NO: 225007 - DNA, 25 bp, Mus musculus
cactttaggagaaggttgtggagtt

SEQ ID NO: 225008 - DNA, 25 bp, Mus musculus
cactttataatgtgtctgacttctt

SEQ ID NO: 225009 - DNA, 25 bp, Mus musculus
cactttatgcatcaacgctgtaaga

SEQ ID NO: 225010 - DNA, 25 bp, Mus musculus
cactttcaaacttccaaaggaattc

SEQ ID NO: 225011 - DNA, 25 bp, Mus musculus
cactttcaaaggcatctagtcttgc

SEQ ID NO: 225012 - DNA, 25 bp, Mus musculus
cactttcagagcaccccccggcccc

SEQ ID NO: 225013 - DNA, 25 bp, Mus musculus
cactttcagagccctccaactccct

SEQ ID NO: 225014 - DNA, 25 bp, Mus musculus
cactttcataagattcggctccttt

SEQ ID NO: 225015 - DNA, 25 bp, Mus musculus
cactttccaaggaatttgaagccta

SEQ ID NO: 225016 - DNA, 25 bp, Mus musculus
cactttccacagagcctttgatatg

SEQ ID NO: 225017 - DNA, 25 bp, Mus musculus
cactttccacagagctctggagacc

SEQ ID NO: 225018 - DNA, 25 bp, Mus musculus
cactttccagccttccccgaggtgc

SEQ ID NO: 225019 - DNA, 25 bp, Mus musculus
cactttccaggtgacatatcagctg

SEQ ID NO: 225020 - DNA, 25 bp, Mus musculus
cactttcgatgacgattgtggtggg

SEQ ID NO: 225021 - DNA, 25 bp, Mus musculus
cactttcgtgggagccacatataga

SEQ ID NO: 225022 - DNA, 25 bp, Mus musculus
cactttctacaagactatggcgaca

SEQ ID NO: 225023 - DNA, 25 bp, Mus musculus
cactttctacaaggtcatggaggcc

SEQ ID NO: 225024 - DNA, 25 bp, Mus musculus
cactttctacaaggtcattcccaaa

SEQ ID NO: 225025 - DNA, 25 bp, Mus musculus
cactttctacaagtctcgcctgctg

SEQ ID NO: 225026 - DNA, 25 bp, Mus musculus
cactttctgggcaaggagcacttca

SEQ ID NO: 225027 - DNA, 25 bp, Mus musculus
cactttctgtccacttcagtccagc

SEQ ID NO: 225028 - DNA, 25 bp, Mus musculus
cactttcttgggtctttggggctgc

SEQ ID NO: 225029 - DNA, 25 bp, Mus musculus
cactttgaaaaggctgtcacccttg

SEQ ID NO: 225030 - DNA, 25 bp, Mus musculus
cactttgaaagggagaagacaccca

SEQ ID NO: 225031 - DNA, 25 bp, Mus musculus
cactttgaaagtattgagcaagtga

SEQ ID NO: 225032 - DNA, 25 bp, Mus musculus
cactttgaagagaattgttgtgtga

SEQ ID NO: 225033 - DNA, 25 bp, Mus musculus
cactttgaagaggtgtgagtgttga

SEQ ID NO: 225034 - DNA, 25 bp, Mus musculus
cactttgaagagtatcacagacatt

SEQ ID NO: 225035 - DNA, 25 bp, Mus musculus
cactttgaagtcttgaagaaccaca

SEQ ID NO: 225036 - DNA, 25 bp, Mus musculus
cactttgaccggaagaagacgggca

SEQ ID NO: 225037 - DNA, 25 bp, Mus musculus
cactttgaccgggatcactccggca

SEQ ID NO: 225038 - DNA, 25 bp, Mus musculus
cactttgagaaaggtttgcagctag

SEQ ID NO: 225039 - DNA, 25 bp, Mus musculus
cactttgagattgtaaaagctggca

SEQ ID NO: 225040 - DNA, 25 bp, Mus musculus
cactttgatcacaaggtcacacttg

SEQ ID NO: 225041 - DNA, 25 bp, Mus musculus
cactttgcaaaggcaaaatcatggg

SEQ ID NO: 225042 - DNA, 25 bp, Mus musculus
cactttggaacagattcaagtcaat

SEQ ID NO: 225043 - DNA, 25 bp, Mus musculus
cactttggaagagctcattgcccac

SEQ ID NO: 225044 - DNA, 25 bp, Mus musculus
cactttggacagagttgcaatgttt

SEQ ID NO: 225045 - DNA, 25 bp, Mus musculus
cactttggacagtgttgcaatgttt

SEQ ID NO: 225046 - DNA, 25 bp, Mus musculus
cactttggagaagtattgaggctcc

SEQ ID NO: 225047 - DNA, 25 bp, Mus musculus
cactttggaggaatgggagggcagc

SEQ ID NO: 225048 - DNA, 25 bp, Mus musculus
cactttgggaggggggatcgcagcc

SEQ ID NO: 225049 - DNA, 25 bp, Mus musculus
cactttggtaaacttcctacagcgt

SEQ ID NO: 225050 - DNA, 25 bp, Mus musculus
cactttgtgctggaaggcgcttttg

SEQ ID NO: 225051 - DNA, 25 bp, Mus musculus
cactttgtgctgggaaagagtatgg

SEQ ID NO: 225052 - DNA, 25 bp, Mus musculus
cacttttactgtataagtcttgctt

SEQ ID NO: 225053 - DNA, 25 bp, Mus musculus
cacttttcaacagattttgttcctg

SEQ ID NO: 225054 - DNA, 25 bp, Mus musculus
cacttttcatgcagatcctgtgtgc

SEQ ID NO: 225055 - DNA, 25 bp, Mus musculus
cacttttccagttccccacactgct

SEQ ID NO: 225056 - DNA, 25 bp, Mus musculus
cacttttcctactttcactctactc

SEQ ID NO: 225057 - DNA, 25 bp, Mus musculus
cacttttcctttgatcgctgccaga

SEQ ID NO: 225058 - DNA, 25 bp, Mus musculus
cacttttcctttgatctctgaccag

SEQ ID NO: 225059 - DNA, 25 bp, Mus musculus
cacttttcgcggattctttgggagc

SEQ ID NO: 225060 - DNA, 25 bp, Mus musculus
cacttttgaaatggccatgaagaag

SEQ ID NO: 225061 - DNA, 25 bp, Mus musculus
cacttttgaacgggacagctttgag

SEQ ID NO: 225062 - DNA, 25 bp, Mus musculus
cacttttgatcttgattctgatttc

SEQ ID NO: 225063 - DNA, 25 bp, Mus musculus
cacttttggagattggggcctgtgt

SEQ ID NO: 225064 - DNA, 25 bp, Mus musculus
cagaaaaaaaggtttatgaagctga

SEQ ID NO: 225065 - DNA, 25 bp, Mus musculus
cagaaaaaaattgaggagacttctg

SEQ ID NO: 225066 - DNA, 25 bp, Mus musculus
cagaaaaagaatgcggctggcgcat

SEQ ID NO: 225067 - DNA, 25 bp, Mus musculus
cagaaaaagaggctcctcaactttc

SEQ ID NO: 225068 - DNA, 25 bp, Mus musculus
cagaaaaatacccaaagcacctcat

SEQ ID NO: 225069 - DNA, 25 bp, Mus musculus
cagaaaaatgaaactgtgaagttcc

SEQ ID NO: 225070 - DNA, 25 bp, Mus musculus
cagaaaaatgcatcaaagagatgtc

SEQ ID NO: 225071 - DNA, 25 bp, Mus musculus
cagaaaacaaagtggagcgaccctg

SEQ ID NO: 225072 - DNA, 25 bp, Mus musculus
cagaaaacagcatcaaggatgaaga

SEQ ID NO: 225073 - DNA, 25 bp, Mus musculus
cagaaaacaggtaaaggctattaaa

SEQ ID NO: 225074 - DNA, 25 bp, Mus musculus
cagaaaacattccgtgcagtaaacc

SEQ ID NO: 225075 - DNA, 25 bp, Mus musculus
cagaaaaccacagtgtcctgtgcat

SEQ ID NO: 225076 - DNA, 25 bp, Mus musculus
cagaaaacccaaggaatatggttga

SEQ ID NO: 225077 - DNA, 25 bp, Mus musculus
cagaaaaccggttgctgtggttcca

SEQ ID NO: 225078 - DNA, 25 bp, Mus musculus
cagaaaacctgcagtgtcttaaaac

SEQ ID NO: 225079 - DNA, 25 bp, Mus musculus
cagaaaacggaggatggacagtcat

SEQ ID NO: 225080 - DNA, 25 bp, Mus musculus
cagaaaacggtttcaggcaccagta

SEQ ID NO: 225081 - DNA, 25 bp, Mus musculus
cagaaaagaaggctggtgaggactt

SEQ ID NO: 225082 - DNA, 25 bp, Mus musculus
cagaaaagaaggtctctggtaagaa

SEQ ID NO: 225083 - DNA, 25 bp, Mus musculus
cagaaaagagctctgtcttccccgg

SEQ ID NO: 225084 - DNA, 25 bp, Mus musculus
cagaaaagccaggcctgtgatcctg

SEQ ID NO: 225085 - DNA, 25 bp, Mus musculus
cagaaaagcccagtggctttgggtg

SEQ ID NO: 225086 - DNA, 25 bp, Mus musculus
cagaaaagcccagttctaattcaga

SEQ ID NO: 225087 - DNA, 25 bp, Mus musculus
cagaaaagcctcctgctcctgagtc

SEQ ID NO: 225088 - DNA, 25 bp, Mus musculus
cagaaaataatacaatggattctga

SEQ ID NO: 225089 - DNA, 25 bp, Mus musculus
cagaaaatactttccgtccagatcg

SEQ ID NO: 225090 - DNA, 25 bp, Mus musculus
cagaaaatagccaggactatcaaca

SEQ ID NO: 225091 - DNA, 25 bp, Mus musculus
cagaaaataggtattgaggctctga

SEQ ID NO: 225092 - DNA, 25 bp, Mus musculus
cagaaaatcaaactgcagcttgctg

SEQ ID NO: 225093 - DNA, 25 bp, Mus musculus
cagaaaatcctgcaggactacaaat

SEQ ID NO: 225094 - DNA, 25 bp, Mus musculus
cagaaaatccttgccagagatcctc

SEQ ID NO: 225095 - DNA, 25 bp, Mus musculus
cagaaaatccttgctagagaaaatg

SEQ ID NO: 225096 - DNA, 25 bp, Mus musculus
cagaaaatctcagcctccttccctg

SEQ ID NO: 225097 - DNA, 25 bp, Mus musculus
cagaaaatgaacaatcactttttaa

SEQ ID NO: 225098 - DNA, 25 bp, Mus musculus
cagaaaatgagctctgttaaggaag

SEQ ID NO: 225099 - DNA, 25 bp, Mus musculus
cagaaaatgcacgagcctggttacc

SEQ ID NO: 225100 - DNA, 25 bp, Mus musculus
cagaaaatggaagagacctgtgggt

SEQ ID NO: 225101 - DNA, 25 bp, Mus musculus
cagaaaatggacggacaaaggagac

SEQ ID NO: 225102 - DNA, 25 bp, Mus musculus
cagaaaatggacggaggaagtgtga

SEQ ID NO: 225103 - DNA, 25 bp, Mus musculus
cagaaaatttcaggccctcagtacc

SEQ ID NO: 225104 - DNA, 25 bp, Mus musculus
cagaaacaagaagctcaggcgaaag

SEQ ID NO: 225105 - DNA, 25 bp, Mus musculus
cagaaacaagctccttgctcggatt

SEQ ID NO: 225106 - DNA, 25 bp, Mus musculus
cagaaacacacaggcagatgtcatc

SEQ ID NO: 225107 - DNA, 25 bp, Mus musculus
cagaaacacagatttaccttatgag

SEQ ID NO: 225108 - DNA, 25 bp, Mus musculus
cagaaacacagggggtgcagctttt

SEQ ID NO: 225109 - DNA, 25 bp, Mus musculus
cagaaacagaagactctattcttca

SEQ ID NO: 225110 - DNA, 25 bp, Mus musculus
cagaaacagacagctctgtcttccc

SEQ ID NO: 225111 - DNA, 25 bp, Mus musculus
cagaaacagagatagccagcaggaa

SEQ ID NO: 225112 - DNA, 25 bp, Mus musculus
cagaaacagagtgctactgtctaag

SEQ ID NO: 225113 - DNA, 25 bp, Mus musculus
cagaaacagcttgagcccgcacagc

SEQ ID NO: 225114 - DNA, 25 bp, Mus musculus
cagaaacaggagaatccaaatggga

SEQ ID NO: 225115 - DNA, 25 bp, Mus musculus
cagaaacaggagttattaaaatgtg

SEQ ID NO: 225116 - DNA, 25 bp, Mus musculus
cagaaacatcgagacctttgccact

SEQ ID NO: 225117 - DNA, 25 bp, Mus musculus
cagaaacatcgagagatccggggtt

SEQ ID NO: 225118 - DNA, 25 bp, Mus musculus
cagaaacatgtaggcctcattcaca

SEQ ID NO: 225119 - DNA, 25 bp, Mus musculus
cagaaaccaaaccatatggagaagg

SEQ ID NO: 225120 - DNA, 25 bp, Mus musculus
cagaaaccaaaccggataagctgga

SEQ ID NO: 225121 - DNA, 25 bp, Mus musculus
cagaaaccaagaccaaaaacactgg

SEQ ID NO: 225122 - DNA, 25 bp, Mus musculus
cagaaaccaagtgctaaactgaaat

SEQ ID NO: 225123 - DNA, 25 bp, Mus musculus
cagaaaccaggacaggattccccct

SEQ ID NO: 225124 - DNA, 25 bp, Mus musculus
cagaaaccatggtcgcttataccaa

SEQ ID NO: 225125 - DNA, 25 bp, Mus musculus
cagaaaccatgtctcgaagatatga

SEQ ID NO: 225126 - DNA, 25 bp, Mus musculus
cagaaacccatgtgagcatgcccac

SEQ ID NO: 225127 - DNA, 25 bp, Mus musculus
cagaaacccccagcctccagtgatg

SEQ ID NO: 225128 - DNA, 25 bp, Mus musculus
cagaaaccgtggatgatgaaaacaa

SEQ ID NO: 225129 - DNA, 25 bp, Mus musculus
cagaaacctgaacctgtggacaaag

SEQ ID NO: 225130 - DNA, 25 bp, Mus musculus
cagaaacctgatattcagacacacc

SEQ ID NO: 225131 - DNA, 25 bp, Mus musculus
cagaaaccttacataaactatacta

SEQ ID NO: 225132 - DNA, 25 bp, Mus musculus
cagaaacgaagaaagacccaggaga

SEQ ID NO: 225133 - DNA, 25 bp, Mus musculus
cagaaacgagaagaagcagaccatt

SEQ ID NO: 225134 - DNA, 25 bp, Mus musculus
cagaaacgattccatacctgtgttg

SEQ ID NO: 225135 - DNA, 25 bp, Mus musculus
cagaaacgattccatgtatggcatt

SEQ ID NO: 225136 - DNA, 25 bp, Mus musculus
cagaaacgattccattgtgacacca

SEQ ID NO: 225137 - DNA, 25 bp, Mus musculus
cagaaacgcttcctcagactgctgt

SEQ ID NO: 225138 - DNA, 25 bp, Mus musculus
cagaaacggtatctgcagagtttcc

SEQ ID NO: 225139 - DNA, 25 bp, Mus musculus
cagaaacgtaaagagctacaagaaa

SEQ ID NO: 225140 - DNA, 25 bp, Mus musculus
cagaaactactgcggctcaggatac

SEQ ID NO: 225141 - DNA, 25 bp, Mus musculus
cagaaactcaaggctcctgactatg

SEQ ID NO: 225142 - DNA, 25 bp, Mus musculus
cagaaactccaggaccaggaggatg

SEQ ID NO: 225143 - DNA, 25 bp, Mus musculus
cagaaactctcccctcgtaccagta

SEQ ID NO: 225144 - DNA, 25 bp, Mus musculus
cagaaactctcccctgtcctggagt

SEQ ID NO: 225145 - DNA, 25 bp, Mus musculus
cagaaactgaacagtaaccgatttc

SEQ ID NO: 225146 - DNA, 25 bp, Mus musculus
cagaaactgaacagtgtaccatcta

SEQ ID NO: 225147 - DNA, 25 bp, Mus musculus
cagaaactgaagaagaggttaggaa

SEQ ID NO: 225148 - DNA, 25 bp, Mus musculus
cagaaactggccagcaagcctgcct

SEQ ID NO: 225149 - DNA, 25 bp, Mus musculus
cagaaacttcaggaggagttagagt

SEQ ID NO: 225150 - DNA, 25 bp, Mus musculus
cagaaagaaaagcccttatgttagc

SEQ ID NO: 225151 - DNA, 25 bp, Mus musculus
cagaaagaagagaggagaaggggac

SEQ ID NO: 225152 - DNA, 25 bp, Mus musculus
cagaaagaagctagacgaaagggaa

SEQ ID NO: 225153 - DNA, 25 bp, Mus musculus
cagaaagacctaatgaaagctgcac

SEQ ID NO: 225154 - DNA, 25 bp, Mus musculus
cagaaagacctaatgcgcctagaaa

SEQ ID NO: 225155 - DNA, 25 bp, Mus musculus
cagaaagaccttgattcagatggtc

SEQ ID NO: 225156 - DNA, 25 bp, Mus musculus
cagaaagactggagagaagctgaag

SEQ ID NO: 225157 - DNA, 25 bp, Mus musculus
cagaaagagacagtgcattctgtga

SEQ ID NO: 225158 - DNA, 25 bp, Mus musculus
cagaaagagacagtgtgggacttct

SEQ ID NO: 225159 - DNA, 25 bp, Mus musculus
cagaaagataaggtgaccatagctg

SEQ ID NO: 225160 - DNA, 25 bp, Mus musculus
cagaaagataccaagctaatgagcg

SEQ ID NO: 225161 - DNA, 25 bp, Mus musculus
cagaaagatctgcatccaaagacaa

SEQ ID NO: 225162 - DNA, 25 bp, Mus musculus
cagaaagatctggccaacatagctg

SEQ ID NO: 225163 - DNA, 25 bp, Mus musculus
cagaaagcaaaaaattgcaaattca

SEQ ID NO: 225164 - DNA, 25 bp, Mus musculus
cagaaagcaacagggatgaagtaca

SEQ ID NO: 225165 - DNA, 25 bp, Mus musculus
cagaaagcaagatttgtcttcggca

SEQ ID NO: 225166 - DNA, 25 bp, Mus musculus
cagaaagcagaatgctggcagaaga

SEQ ID NO: 225167 - DNA, 25 bp, Mus musculus
cagaaagcagatttcaacaagaaaa

SEQ ID NO: 225168 - DNA, 25 bp, Mus musculus
cagaaagcaggattcctctactacg

SEQ ID NO: 225169 - DNA, 25 bp, Mus musculus
cagaaagcaggccgtctactgtgtg

SEQ ID NO: 225170 - DNA, 25 bp, Mus musculus
cagaaagcagggctgactgtgaatg

SEQ ID NO: 225171 - DNA, 25 bp, Mus musculus
cagaaagcaggtcatccgggtggtc

SEQ ID NO: 225172 - DNA, 25 bp, Mus musculus
cagaaagcagtgagtacggctccac

SEQ ID NO: 225173 - DNA, 25 bp, Mus musculus
cagaaagcataaaggaacatgcctc

SEQ ID NO: 225174 - DNA, 25 bp, Mus musculus
cagaaagccaaagcggaggaagaag

SEQ ID NO: 225175 - DNA, 25 bp, Mus musculus
cagaaagccaagaacagagagtacc

SEQ ID NO: 225176 - DNA, 25 bp, Mus musculus
cagaaagcccctggggtgtccgatc

SEQ ID NO: 225177 - DNA, 25 bp, Mus musculus
cagaaagccttgagggtgtttcttg

SEQ ID NO: 225178 - DNA, 25 bp, Mus musculus
cagaaagctggcgggtagaatcatt

SEQ ID NO: 225179 - DNA, 25 bp, Mus musculus
cagaaaggaagagatcaaagatgag

SEQ ID NO: 225180 - DNA, 25 bp, Mus musculus
cagaaaggagattaacaagtggtgg

SEQ ID NO: 225181 - DNA, 25 bp, Mus musculus
cagaaaggaggcatcatagctgcga

SEQ ID NO: 225182 - DNA, 25 bp, Mus musculus
cagaaaggagttcgtgaagtgactg

SEQ ID NO: 225183 - DNA, 25 bp, Mus musculus
cagaaaggccaggttctgggagaag

SEQ ID NO: 225184 - DNA, 25 bp, Mus musculus
cagaaaggcggaacagagtgttctg

SEQ ID NO: 225185 - DNA, 25 bp, Mus musculus
cagaaaggcgggaaagggctgtgag

SEQ ID NO: 225186 - DNA, 25 bp, Mus musculus
cagaaagggactcggagaatcatca

SEQ ID NO: 225187 - DNA, 25 bp, Mus musculus
cagaaagggtcataggcacagacca

SEQ ID NO: 225188 - DNA, 25 bp, Mus musculus
cagaaaggtggatatgtccgacccc

SEQ ID NO: 225189 - DNA, 25 bp, Mus musculus
cagaaagtactggatccactggact

SEQ ID NO: 225190 - DNA, 25 bp, Mus musculus
cagaaagtgaaaaggttgtccagga

SEQ ID NO: 225191 - DNA, 25 bp, Mus musculus
cagaaagtggcgaaggtcttccatg

SEQ ID NO: 225192 - DNA, 25 bp, Mus musculus
cagaaagttactcaggtggctggtg

SEQ ID NO: 225193 - DNA, 25 bp, Mus musculus
cagaaatatcttcagagactggaag

SEQ ID NO: 225194 - DNA, 25 bp, Mus musculus
cagaaatatgatatcaccaccctca

SEQ ID NO: 225195 - DNA, 25 bp, Mus musculus
cagaaatatgatatcatgactgtcc

SEQ ID NO: 225196 - DNA, 25 bp, Mus musculus
cagaaatatgatcagcaagaaggcc

SEQ ID NO: 225197 - DNA, 25 bp, Mus musculus
cagaaatccaagaaaatgtacaggc

SEQ ID NO: 225198 - DNA, 25 bp, Mus musculus
cagaaatccactagactctggaact

SEQ ID NO: 225199 - DNA, 25 bp, Mus musculus
cagaaatccactaggagacttaatg

SEQ ID NO: 225200 - DNA, 25 bp, Mus musculus
cagaaatcccgcaaggtcccgcaca

SEQ ID NO: 225201 - DNA, 25 bp, Mus musculus
cagaaatcgaagcagaaaatgaaca

SEQ ID NO: 225202 - DNA, 25 bp, Mus musculus
cagaaatcgagctgaggaaacgtgt

SEQ ID NO: 225203 - DNA, 25 bp, Mus musculus
cagaaatctgttggtgttctggctg

SEQ ID NO: 225204 - DNA, 25 bp, Mus musculus
cagaaatgaaagtatcaagcactga

SEQ ID NO: 225205 - DNA, 25 bp, Mus musculus
cagaaatgaaggctccagccaggct

SEQ ID NO: 225206 - DNA, 25 bp, Mus musculus
cagaaatgacacacttttgtgtaat

SEQ ID NO: 225207 - DNA, 25 bp, Mus musculus
cagaaatgctgagatggtgcagtca

SEQ ID NO: 225208 - DNA, 25 bp, Mus musculus
cagaaatggatacacaactattgtc

SEQ ID NO: 225209 - DNA, 25 bp, Mus musculus
cagaaatgtgacaggctaaactgtg

SEQ ID NO: 225210 - DNA, 25 bp, Mus musculus
cagaaattccaaggtccccctggag

SEQ ID NO: 225211 - DNA, 25 bp, Mus musculus
cagaaattccaaggtgtgagactgc

SEQ ID NO: 225212 - DNA, 25 bp, Mus musculus
cagaaattccaggatgtctgtgtta

SEQ ID NO: 225213 - DNA, 25 bp, Mus musculus
cagaaattccaggattgctgtgtct

SEQ ID NO: 225214 - DNA, 25 bp, Mus musculus
cagaaattcctgctgctgaactaac

SEQ ID NO: 225215 - DNA, 25 bp, Mus musculus
cagaaattgaagagaaacttcatga

SEQ ID NO: 225216 - DNA, 25 bp, Mus musculus
cagaaattgaagagagagaagcgct

SEQ ID NO: 225217 - DNA, 25 bp, Mus musculus
cagaaattgagtgctcctgtgctgt

SEQ ID NO: 225218 - DNA, 25 bp, Mus musculus
cagaaattgagtgggacgacttggc

SEQ ID NO: 225219 - DNA, 25 bp, Mus musculus
cagaaattgctcaggaaaatggaca

SEQ ID NO: 225220 - DNA, 25 bp, Mus musculus
cagaaattgctcagtgagcaaccct

SEQ ID NO: 225221 - DNA, 25 bp, Mus musculus
cagaaattggggttgatcgccttag

SEQ ID NO: 225222 - DNA, 25 bp, Mus musculus
cagaaatttacctaaagcctttcat

SEQ ID NO: 225223 - DNA, 25 bp, Mus musculus
cagaaatttgaaatttcaacaagaa

SEQ ID NO: 225224 - DNA, 25 bp, Mus musculus
cagaacaaataagatgttctcaaac

SEQ ID NO: 225225 - DNA, 25 bp, Mus musculus
cagaacaacactgaatatctcctgg

SEQ ID NO: 225226 - DNA, 25 bp, Mus musculus
cagaacaagactgagaatcagagtt

SEQ ID NO: 225227 - DNA, 25 bp, Mus musculus
cagaacaagagccccttcctctgcc

SEQ ID NO: 225228 - DNA, 25 bp, Mus musculus
cagaacaagattactactcaactac

SEQ ID NO: 225229 - DNA, 25 bp, Mus musculus
cagaacaatcgattggaagaattgt

SEQ ID NO: 225230 - DNA, 25 bp, Mus musculus
cagaacaatcgggaacagactgctt

SEQ ID NO: 225231 - DNA, 25 bp, Mus musculus
cagaacaatggcctagaggtaatca

SEQ ID NO: 225232 - DNA, 25 bp, Mus musculus
cagaacacaagatggcccgcagagg

SEQ ID NO: 225233 - DNA, 25 bp, Mus musculus
cagaacacaagggcaagatcatcat

SEQ ID NO: 225234 - DNA, 25 bp, Mus musculus
cagaacacagcggagatccagcact

SEQ ID NO: 225235 - DNA, 25 bp, Mus musculus
cagaacacaggctgggaagatgccg

SEQ ID NO: 225236 - DNA, 25 bp, Mus musculus
cagaacacaggtgttgaatcataaa

SEQ ID NO: 225237 - DNA, 25 bp, Mus musculus
cagaacaccctgtgtgtgttttggg

SEQ ID NO: 225238 - DNA, 25 bp, Mus musculus
cagaacacctaaagccttagggtca

SEQ ID NO: 225239 - DNA, 25 bp, Mus musculus
cagaacacctaaagcggactcctct

SEQ ID NO: 225240 - DNA, 25 bp, Mus musculus
cagaacagaagcccacaaggagata

SEQ ID NO: 225241 - DNA, 25 bp, Mus musculus
cagaacagaaggagtgtgtaagctt

SEQ ID NO: 225242 - DNA, 25 bp, Mus musculus
cagaacagaccagagatgggcagca

SEQ ID NO: 225243 - DNA, 25 bp, Mus musculus
cagaacagagggggaagaaaccgat

SEQ ID NO: 225244 - DNA, 25 bp, Mus musculus
cagaacagattcagagcctctctcc

SEQ ID NO: 225245 - DNA, 25 bp, Mus musculus
cagaacagattcagcagcagcaaca

SEQ ID NO: 225246 - DNA, 25 bp, Mus musculus
cagaacagctatggatttgccagct

SEQ ID NO: 225247 - DNA, 25 bp, Mus musculus
cagaacagctgttcctaaggcttac

SEQ ID NO: 225248 - DNA, 25 bp, Mus musculus
cagaacataatggactccctggaac

SEQ ID NO: 225249 - DNA, 25 bp, Mus musculus
cagaacataatggatggagaggaga

SEQ ID NO: 225250 - DNA, 25 bp, Mus musculus
cagaacataattagcttgaagtcaa

SEQ ID NO: 225251 - DNA, 25 bp, Mus musculus
cagaacatcccagattgctgaagct

SEQ ID NO: 225252 - DNA, 25 bp, Mus musculus
cagaacatcccagcccactggtttg

SEQ ID NO: 225253 - DNA, 25 bp, Mus musculus
cagaacatctctgatgtggatgcct

SEQ ID NO: 225254 - DNA, 25 bp, Mus musculus
cagaacattagctcaggtacctgac

SEQ ID NO: 225255 - DNA, 25 bp, Mus musculus
cagaacattggagccatgtcaagct

SEQ ID NO: 225256 - DNA, 25 bp, Mus musculus
cagaacatttccaggttcagctcct

SEQ ID NO: 225257 - DNA, 25 bp, Mus musculus
cagaaccaactgataaccaagctga

SEQ ID NO: 225258 - DNA, 25 bp, Mus musculus
cagaaccaactggagagacttccag

SEQ ID NO: 225259 - DNA, 25 bp, Mus musculus
cagaaccaccacctggggccaggtc

SEQ ID NO: 225260 - DNA, 25 bp, Mus musculus
cagaaccacgtcacctctcacatct

SEQ ID NO: 225261 - DNA, 25 bp, Mus musculus
cagaaccagccaacagccatcattc

SEQ ID NO: 225262 - DNA, 25 bp, Mus musculus
cagaaccagcccatcattcaggtcg

SEQ ID NO: 225263 - DNA, 25 bp, Mus musculus
cagaaccaggcccctaatcaaggta

SEQ ID NO: 225264 - DNA, 25 bp, Mus musculus
cagaaccaggttatgtagtaacaag

SEQ ID NO: 225265 - DNA, 25 bp, Mus musculus
cagaaccatactatgcattatccaa

SEQ ID NO: 225266 - DNA, 25 bp, Mus musculus
cagaaccatactatttgcttttgcc

SEQ ID NO: 225267 - DNA, 25 bp, Mus musculus
cagaaccatcctgaggcctgactac

SEQ ID NO: 225268 - DNA, 25 bp, Mus musculus
cagaacccaagaggctggggtctca

SEQ ID NO: 225269 - DNA, 25 bp, Mus musculus
cagaacccacacatagagagactga

SEQ ID NO: 225270 - DNA, 25 bp, Mus musculus
cagaacccagctaacagagaagtcc

SEQ ID NO: 225271 - DNA, 25 bp, Mus musculus
cagaacccgaaaagggccctgtaga

SEQ ID NO: 225272 - DNA, 25 bp, Mus musculus
cagaacccgaagagcctcagcttaa

SEQ ID NO: 225273 - DNA, 25 bp, Mus musculus
cagaacccgagctgcctgccgacac

SEQ ID NO: 225274 - DNA, 25 bp, Mus musculus
cagaacccgagggtttctctgccga

SEQ ID NO: 225275 - DNA, 25 bp, Mus musculus
cagaacccgatggagggaccttgcc

SEQ ID NO: 225276 - DNA, 25 bp, Mus musculus
cagaacccggaggctgtttactttg

SEQ ID NO: 225277 - DNA, 25 bp, Mus musculus
cagaaccctcagtgattgtgtgtcg

SEQ ID NO: 225278 - DNA, 25 bp, Mus musculus
cagaaccctttcagatctcgctgcc

SEQ ID NO: 225279 - DNA, 25 bp, Mus musculus
cagaaccctttcagccgttaaccac

SEQ ID NO: 225280 - DNA, 25 bp, Mus musculus
cagaaccgacttaaaacttcaggtt

SEQ ID NO: 225281 - DNA, 25 bp, Mus musculus
cagaaccgaggtagtcaagaacaac

SEQ ID NO: 225282 - DNA, 25 bp, Mus musculus
cagaaccgcaagacaggagcccggc

SEQ ID NO: 225283 - DNA, 25 bp, Mus musculus
cagaaccgcaagcttccatacgaca

SEQ ID NO: 225284 - DNA, 25 bp, Mus musculus
cagaaccgcctggctgaagagaggg

SEQ ID NO: 225285 - DNA, 25 bp, Mus musculus
cagaaccgcgtgttgatcgtgtcct

SEQ ID NO: 225286 - DNA, 25 bp, Mus musculus
cagaaccgtcggcgagctgaagcgc

SEQ ID NO: 225287 - DNA, 25 bp, Mus musculus
cagaacctcagcatcatgatccagg

SEQ ID NO: 225288 - DNA, 25 bp, Mus musculus
cagaacctgaggcactgaaagaaag

SEQ ID NO: 225289 - DNA, 25 bp, Mus musculus
cagaacctggattcagatggtccag

SEQ ID NO: 225290 - DNA, 25 bp, Mus musculus
cagaacctggccaagatcctgcgcc

SEQ ID NO: 225291 - DNA, 25 bp, Mus musculus
cagaacctgggccgcatgtatctct

SEQ ID NO: 225292 - DNA, 25 bp, Mus musculus
cagaacctgggggctaaactctcag

SEQ ID NO: 225293 - DNA, 25 bp, Mus musculus
cagaacctgtcaggaccaccaatga

SEQ ID NO: 225294 - DNA, 25 bp, Mus musculus
cagaacctgtcaggatataaatgaa

SEQ ID NO: 225295 - DNA, 25 bp, Mus musculus
cagaaccttaaaagaatgctgatgc

SEQ ID NO: 225296 - DNA, 25 bp, Mus musculus
cagaaccttcctgacctgggcggcc

SEQ ID NO: 225297 - DNA, 25 bp, Mus musculus
cagaaccttcctggggtctgtgatg

SEQ ID NO: 225298 - DNA, 25 bp, Mus musculus
cagaacctttgaggtctcagagctt

SEQ ID NO: 225299 - DNA, 25 bp, Mus musculus
cagaacctttgagttcctcatgaag

SEQ ID NO: 225300 - DNA, 25 bp, Mus musculus
cagaacgacgtaggtcaccccttct

SEQ ID NO: 225301 - DNA, 25 bp, Mus musculus
cagaacgagcagcttttgaaatcct

SEQ ID NO: 225302 - DNA, 25 bp, Mus musculus
cagaacgagcaggcgaaggagatgc

SEQ ID NO: 225303 - DNA, 25 bp, Mus musculus
cagaacgatgaggacaatctcctca

SEQ ID NO: 225304 - DNA, 25 bp, Mus musculus
cagaacgatgtggaacagggaaagg

SEQ ID NO: 225305 - DNA, 25 bp, Mus musculus
cagaacgcaccggtagctggagtta

SEQ ID NO: 225306 - DNA, 25 bp, Mus musculus
cagaacgcatcccacagctggtggg

SEQ ID NO: 225307 - DNA, 25 bp, Mus musculus
cagaacgctgctcatttgaagacat

SEQ ID NO: 225308 - DNA, 25 bp, Mus musculus
cagaacgctgcttgtgaatggctgc

SEQ ID NO: 225309 - DNA, 25 bp, Mus musculus
cagaacggagattatcagctccgga

SEQ ID NO: 225310 - DNA, 25 bp, Mus musculus
cagaacgtcaaggcaatccttaggt

SEQ ID NO: 225311 - DNA, 25 bp, Mus musculus
cagaacgtcaagggtgagtcagcac

SEQ ID NO: 225312 - DNA, 25 bp, Mus musculus
cagaactaaagaatgaagtcttaca

SEQ ID NO: 225313 - DNA, 25 bp, Mus musculus
cagaactaaagggcttgttgtcatc

SEQ ID NO: 225314 - DNA, 25 bp, Mus musculus
cagaactacccagccacttactgga

SEQ ID NO: 225315 - DNA, 25 bp, Mus musculus
cagaactacccaggctccttctaga

SEQ ID NO: 225316 - DNA, 25 bp, Mus musculus
cagaactacctggacttccaccgct

SEQ ID NO: 225317 - DNA, 25 bp, Mus musculus
cagaactacctgggtctcagcctgg

SEQ ID NO: 225318 - DNA, 25 bp, Mus musculus
cagaactagctaaggctcaaactca

SEQ ID NO: 225319 - DNA, 25 bp, Mus musculus
cagaactatcccgtggtctccattg

SEQ ID NO: 225320 - DNA, 25 bp, Mus musculus
cagaactcaagcagctggtggcccg

SEQ ID NO: 225321 - DNA, 25 bp, Mus musculus
cagaactcagaaatgattcccgttg

SEQ ID NO: 225322 - DNA, 25 bp, Mus musculus
cagaactcaggtttaacagaagaag

SEQ ID NO: 225323 - DNA, 25 bp, Mus musculus
cagaactgagtacacaaacaagttc

SEQ ID NO: 225324 - DNA, 25 bp, Mus musculus
cagaactgcagttggagctgcactg

SEQ ID NO: 225325 - DNA, 25 bp, Mus musculus
cagaactggatgaaggacattgatg

SEQ ID NO: 225326 - DNA, 25 bp, Mus musculus
cagaactggcaccagctggagaaca

SEQ ID NO: 225327 - DNA, 25 bp, Mus musculus
cagaactggccagacaccttgttgc

SEQ ID NO: 225328 - DNA, 25 bp, Mus musculus
cagaactggccagatccgtctacct

SEQ ID NO: 225329 - DNA, 25 bp, Mus musculus
cagaactggccagccccctgccttt

SEQ ID NO: 225330 - DNA, 25 bp, Mus musculus
cagaactggtgaagcttatgtgcga

SEQ ID NO: 225331 - DNA, 25 bp, Mus musculus
cagaacttacgagagtatttggagg

SEQ ID NO: 225332 - DNA, 25 bp, Mus musculus
cagaacttctcagacaattgacata

SEQ ID NO: 225333 - DNA, 25 bp, Mus musculus
cagaacttctgatgtttcttccagc

SEQ ID NO: 225334 - DNA, 25 bp, Mus musculus
cagaacttgatgaagaagatgaagt

SEQ ID NO: 225335 - DNA, 25 bp, Mus musculus
cagaacttgatgaagagtcagaaga

SEQ ID NO: 225336 - DNA, 25 bp, Mus musculus
cagaacttgccatcaatgccttctt

SEQ ID NO: 225337 - DNA, 25 bp, Mus musculus
cagaacttgcggtcttagagccttc

SEQ ID NO: 225338 - DNA, 25 bp, Mus musculus
cagaacttgggagacgactgcacaa

SEQ ID NO: 225339 - DNA, 25 bp, Mus musculus
cagaagaaaaattcatcgttaaagc

SEQ ID NO: 225340 - DNA, 25 bp, Mus musculus
cagaagaaaagactggacaatctgt

SEQ ID NO: 225341 - DNA, 25 bp, Mus musculus
cagaagaaaatggatgtcattgcta

SEQ ID NO: 225342 - DNA, 25 bp, Mus musculus
cagaagaaaatggatgttaccattg

SEQ ID NO: 225343 - DNA, 25 bp, Mus musculus
cagaagaaagaggaagtttgtttgc

SEQ ID NO: 225344 - DNA, 25 bp, Mus musculus
cagaagaaagaggttatggctttca

SEQ ID NO: 225345 - DNA, 25 bp, Mus musculus
cagaagaaagagtgcagcagctgcc

SEQ ID NO: 225346 - DNA, 25 bp, Mus musculus
cagaagaaagagtgtgaggagatca

SEQ ID NO: 225347 - DNA, 25 bp, Mus musculus
cagaagaaaggggctcgctcccacc

SEQ ID NO: 225348 - DNA, 25 bp, Mus musculus
cagaagaaatacgatgacagcgatg

SEQ ID NO: 225349 - DNA, 25 bp, Mus musculus
cagaagaaatacggcttcttggtaa

SEQ ID NO: 225350 - DNA, 25 bp, Mus musculus
cagaagaaatgaatgcagcagcagc

SEQ ID NO: 225351 - DNA, 25 bp, Mus musculus
cagaagaaatgttgctgcccaggtt

SEQ ID NO: 225352 - DNA, 25 bp, Mus musculus
cagaagaacagatggaggcctttaa

SEQ ID NO: 225353 - DNA, 25 bp, Mus musculus
cagaagaacagtgtcccagcagatg

SEQ ID NO: 225354 - DNA, 25 bp, Mus musculus
cagaagaagaaaagctcaacagagg

SEQ ID NO: 225355 - DNA, 25 bp, Mus musculus
cagaagaagagcagagaaacttttc

SEQ ID NO: 225356 - DNA, 25 bp, Mus musculus
cagaagaatacgcgggtcagataac

SEQ ID NO: 225357 - DNA, 25 bp, Mus musculus
cagaagaatatgctggaccgcttcg

SEQ ID NO: 225358 - DNA, 25 bp, Mus musculus
cagaagaatatggtggcctgggcct

SEQ ID NO: 225359 - DNA, 25 bp, Mus musculus
cagaagaattgtgtctggaattctc

SEQ ID NO: 225360 - DNA, 25 bp, Mus musculus
cagaagacaaaggaaacagaggcta

SEQ ID NO: 225361 - DNA, 25 bp, Mus musculus
cagaagacaatagcacccaggcaga

SEQ ID NO: 225362 - DNA, 25 bp, Mus musculus
cagaagacacgaaggcaaccaaggc

SEQ ID NO: 225363 - DNA, 25 bp, Mus musculus
cagaagacacggatactgagaactc

SEQ ID NO: 225364 - DNA, 25 bp, Mus musculus
cagaagacaggactcagctgagaga

SEQ ID NO: 225365 - DNA, 25 bp, Mus musculus
cagaagacagtgatggcgactggta

SEQ ID NO: 225366 - DNA, 25 bp, Mus musculus
cagaagacagtgcatttgcagggcc

SEQ ID NO: 225367 - DNA, 25 bp, Mus musculus
cagaagacagtgctcttactggccc

SEQ ID NO: 225368 - DNA, 25 bp, Mus musculus
cagaagacagttacggtaaattcta

SEQ ID NO: 225369 - DNA, 25 bp, Mus musculus
cagaagacagttacggtatgcttcc

SEQ ID NO: 225370 - DNA, 25 bp, Mus musculus
cagaagacagttgccctctatacct

SEQ ID NO: 225371 - DNA, 25 bp, Mus musculus
cagaagacatcaagtgctgtaacag

SEQ ID NO: 225372 - DNA, 25 bp, Mus musculus
cagaagacatcgctgaccctgtctc

SEQ ID NO: 225373 - DNA, 25 bp, Mus musculus
cagaagacatctactaaaccgccca

SEQ ID NO: 225374 - DNA, 25 bp, Mus musculus
cagaagacatgtcagcttctctgtc

SEQ ID NO: 225375 - DNA, 25 bp, Mus musculus
cagaagaccaggcagggtctcctgg

SEQ ID NO: 225376 - DNA, 25 bp, Mus musculus
cagaagacccaaagcgtctgatggc

SEQ ID NO: 225377 - DNA, 25 bp, Mus musculus
cagaagacccaagcttggatctagc

SEQ ID NO: 225378 - DNA, 25 bp, Mus musculus
cagaagaccgaatttatctctgagc

SEQ ID NO: 225379 - DNA, 25 bp, Mus musculus
cagaagactacagctcgacatgggt

SEQ ID NO: 225380 - DNA, 25 bp, Mus musculus
cagaagactacagttgcagctcgac

SEQ ID NO: 225381 - DNA, 25 bp, Mus musculus
cagaagactagattgaggaggagga

SEQ ID NO: 225382 - DNA, 25 bp, Mus musculus
cagaagactagccgccgtgccacgt

SEQ ID NO: 225383 - DNA, 25 bp, Mus musculus
cagaagactgcgctgagtggaccag

SEQ ID NO: 225384 - DNA, 25 bp, Mus musculus
cagaagactttggtggcacgcggtg

SEQ ID NO: 225385 - DNA, 25 bp, Mus musculus
cagaagagaaagaaagaccagagag

SEQ ID NO: 225386 - DNA, 25 bp, Mus musculus
cagaagagaaatatattgagcggtt

SEQ ID NO: 225387 - DNA, 25 bp, Mus musculus
cagaagagaaattttgaaatgccct

SEQ ID NO: 225388 - DNA, 25 bp, Mus musculus
cagaagagaagagttgatacaaaat

SEQ ID NO: 225389 - DNA, 25 bp, Mus musculus
cagaagagatcctggctaagaatcc

SEQ ID NO: 225390 - DNA, 25 bp, Mus musculus
cagaagagatggcagatactttggc

SEQ ID NO: 225391 - DNA, 25 bp, Mus musculus
cagaagagatggcaggtgtatggtg

SEQ ID NO: 225392 - DNA, 25 bp, Mus musculus
cagaagagcaagaacctgggagcag

SEQ ID NO: 225393 - DNA, 25 bp, Mus musculus
cagaagagcaagttaagtttgaaag

SEQ ID NO: 225394 - DNA, 25 bp, Mus musculus
cagaagaggaggagggtccggaccg

SEQ ID NO: 225395 - DNA, 25 bp, Mus musculus
cagaagaggccagatatcacagccg

SEQ ID NO: 225396 - DNA, 25 bp, Mus musculus
cagaagaggctcagaacactgggga

SEQ ID NO: 225397 - DNA, 25 bp, Mus musculus
cagaagaggctctccctgaagtcac

SEQ ID NO: 225398 - DNA, 25 bp, Mus musculus
cagaagagggggacctacacactgc

SEQ ID NO: 225399 - DNA, 25 bp, Mus musculus
cagaagagtgaccaaatgacccagt

SEQ ID NO: 225400 - DNA, 25 bp, Mus musculus
cagaagagtgggacggctgttctca

SEQ ID NO: 225401 - DNA, 25 bp, Mus musculus
cagaagataccatctatgtcttttt

SEQ ID NO: 225402 - DNA, 25 bp, Mus musculus
cagaagatatctcagcaaagctacc

SEQ ID NO: 225403 - DNA, 25 bp, Mus musculus
cagaagatcattaaggaacgagaac

SEQ ID NO: 225404 - DNA, 25 bp, Mus musculus
cagaagatctagatcccgctcaagg

SEQ ID NO: 225405 - DNA, 25 bp, Mus musculus
cagaagatctatctaagtaagaagt

SEQ ID NO: 225406 - DNA, 25 bp, Mus musculus
cagaagatgaaaaagggttcaaaga

SEQ ID NO: 225407 - DNA, 25 bp, Mus musculus
cagaagatgaagatgtctggtgaga

SEQ ID NO: 225408 - DNA, 25 bp, Mus musculus
cagaagatgagtgatgaaaacaacg

SEQ ID NO: 225409 - DNA, 25 bp, Mus musculus
cagaagatgagtgatgctgcaggtg

SEQ ID NO: 225410 - DNA, 25 bp, Mus musculus
cagaagatgctaggagttaaccagc

SEQ ID NO: 225411 - DNA, 25 bp, Mus musculus
cagaagatgctagggtaataatctt

SEQ ID NO: 225412 - DNA, 25 bp, Mus musculus
cagaagatggcagaatagtgattga

SEQ ID NO: 225413 - DNA, 25 bp, Mus musculus
cagaagatgtacagattttccaggg

SEQ ID NO: 225414 - DNA, 25 bp, Mus musculus
cagaagattaaggacctggagcaga

SEQ ID NO: 225415 - DNA, 25 bp, Mus musculus
cagaagattcagatggggctgagga

SEQ ID NO: 225416 - DNA, 25 bp, Mus musculus
cagaagcaaaagcaggcggaacatg

SEQ ID NO: 225417 - DNA, 25 bp, Mus musculus
cagaagcaaagagaaccaacttctt

SEQ ID NO: 225418 - DNA, 25 bp, Mus musculus
cagaagcaaagagcgtgctaatgcg

SEQ ID NO: 225419 - DNA, 25 bp, Mus musculus
cagaagcaaagagggaagaagacat

SEQ ID NO: 225420 - DNA, 25 bp, Mus musculus
cagaagcaaaggtctcagccagtct

SEQ ID NO: 225421 - DNA, 25 bp, Mus musculus
cagaagcaaattgtggaccgggtca

SEQ ID NO: 225422 - DNA, 25 bp, Mus musculus
cagaagcaacagcagaagcaggtat

SEQ ID NO: 225423 - DNA, 25 bp, Mus musculus
cagaagcaacaggaggctgatcgaa

SEQ ID NO: 225424 - DNA, 25 bp, Mus musculus
cagaagcaacaggagtgcaggagga

SEQ ID NO: 225425 - DNA, 25 bp, Mus musculus
cagaagcaagacgcgggcgatccag

SEQ ID NO: 225426 - DNA, 25 bp, Mus musculus
cagaagcaagaggaagaggagcaga

SEQ ID NO: 225427 - DNA, 25 bp, Mus musculus
cagaagcaagatcccaaaaggataa

SEQ ID NO: 225428 - DNA, 25 bp, Mus musculus
cagaagcaagggaaaatacagaaga

SEQ ID NO: 225429 - DNA, 25 bp, Mus musculus
cagaagcaagggaacctgcaactgc

SEQ ID NO: 225430 - DNA, 25 bp, Mus musculus
cagaagcaaggggtggatgagaggg

SEQ ID NO: 225431 - DNA, 25 bp, Mus musculus
cagaagcaaggttttcgggttgcat

SEQ ID NO: 225432 - DNA, 25 bp, Mus musculus
cagaagcaagtgttttgcctgtgtg

SEQ ID NO: 225433 - DNA, 25 bp, Mus musculus
cagaagcacagaactgctgagtgcc

SEQ ID NO: 225434 - DNA, 25 bp, Mus musculus
cagaagcacagatccatgcatgacc

SEQ ID NO: 225435 - DNA, 25 bp, Mus musculus
cagaagcacagggcatctgttatgc

SEQ ID NO: 225436 - DNA, 25 bp, Mus musculus
cagaagcacggtactacaagaagtt

SEQ ID NO: 225437 - DNA, 25 bp, Mus musculus
cagaagcactccataaactaaagct

SEQ ID NO: 225438 - DNA, 25 bp, Mus musculus
cagaagcactccatgtgtgtctgaa

SEQ ID NO: 225439 - DNA, 25 bp, Mus musculus
cagaagcagaagtcgacagagcaca

SEQ ID NO: 225440 - DNA, 25 bp, Mus musculus
cagaagcagagcagcagaccacagt

SEQ ID NO: 225441 - DNA, 25 bp, Mus musculus
cagaagcaggcagtgaggccaggtt

SEQ ID NO: 225442 - DNA, 25 bp, Mus musculus
cagaagcagtgagtacaacacatgg

SEQ ID NO: 225443 - DNA, 25 bp, Mus musculus
cagaagcagtggctctagtctggcc

SEQ ID NO: 225444 - DNA, 25 bp, Mus musculus
cagaagcagtgggtacaaacaaatt

SEQ ID NO: 225445 - DNA, 25 bp, Mus musculus
cagaagcagtggtatttatgagcct

SEQ ID NO: 225446 - DNA, 25 bp, Mus musculus
cagaagcatcaagatgacttacaag

SEQ ID NO: 225447 - DNA, 25 bp, Mus musculus
cagaagcatggaagaaaaagagaga

SEQ ID NO: 225448 - DNA, 25 bp, Mus musculus
cagaagcatggaaggatttagacaa

SEQ ID NO: 225449 - DNA, 25 bp, Mus musculus
cagaagcatggaaggtggaaaaaac

SEQ ID NO: 225450 - DNA, 25 bp, Mus musculus
cagaagcattagcagcattcacagc

SEQ ID NO: 225451 - DNA, 25 bp, Mus musculus
cagaagcattagcagggttggtttc

SEQ ID NO: 225452 - DNA, 25 bp, Mus musculus
cagaagccaagctgctgcatttttt

SEQ ID NO: 225453 - DNA, 25 bp, Mus musculus
cagaagccacacaggttcctttggt

SEQ ID NO: 225454 - DNA, 25 bp, Mus musculus
cagaagccatggctcggatggcgtc

SEQ ID NO: 225455 - DNA, 25 bp, Mus musculus
cagaagccatgggactcgtggggaa

SEQ ID NO: 225456 - DNA, 25 bp, Mus musculus
cagaagcccagatggtgcagtcact

SEQ ID NO: 225457 - DNA, 25 bp, Mus musculus
cagaagcccagcaagattctgtgat

SEQ ID NO: 225458 - DNA, 25 bp, Mus musculus
cagaagccgaaagcgaatattaatt

SEQ ID NO: 225459 - DNA, 25 bp, Mus musculus
cagaagccggggagtcccatggtct

SEQ ID NO: 225460 - DNA, 25 bp, Mus musculus
cagaagccgtcaccccaaaattttg

SEQ ID NO: 225461 - DNA, 25 bp, Mus musculus
cagaagcctaaaaagacggcacaaa

SEQ ID NO: 225462 - DNA, 25 bp, Mus musculus
cagaagcctaaaaaggtggtgctgt

SEQ ID NO: 225463 - DNA, 25 bp, Mus musculus
cagaagcgcaaggtgtcagacaaag

SEQ ID NO: 225464 - DNA, 25 bp, Mus musculus
cagaagctaggacctacagactaca

SEQ ID NO: 225465 - DNA, 25 bp, Mus musculus
cagaagctatgaggtaactgtggag

SEQ ID NO: 225466 - DNA, 25 bp, Mus musculus
cagaagctatgaggtcatggaggga

SEQ ID NO: 225467 - DNA, 25 bp, Mus musculus
cagaagctcaagacatgaagcgcca

SEQ ID NO: 225468 - DNA, 25 bp, Mus musculus
cagaagctctgcaaggacatccagg

SEQ ID NO: 225469 - DNA, 25 bp, Mus musculus
cagaagctgaagcctgcaggtctcc

SEQ ID NO: 225470 - DNA, 25 bp, Mus musculus
cagaagctggaagatgaagaaaaga

SEQ ID NO: 225471 - DNA, 25 bp, Mus musculus
cagaagctggagcagcttgaacttg

SEQ ID NO: 225472 - DNA, 25 bp, Mus musculus
cagaagctggaggaggccaagcaca

SEQ ID NO: 225473 - DNA, 25 bp, Mus musculus
cagaagctgtggctataatgtgcaa

SEQ ID NO: 225474 - DNA, 25 bp, Mus musculus
cagaagcttccaagtatgaggatga

SEQ ID NO: 225475 - DNA, 25 bp, Mus musculus
cagaaggaagaagaaaagacaccga

SEQ ID NO: 225476 - DNA, 25 bp, Mus musculus
cagaaggaagaagaggaaaggattt

SEQ ID NO: 225477 - DNA, 25 bp, Mus musculus
cagaaggaatccaacgatgcagatc

SEQ ID NO: 225478 - DNA, 25 bp, Mus musculus
cagaaggaatgcggcctccttccct

SEQ ID NO: 225479 - DNA, 25 bp, Mus musculus
cagaaggaattacagccgaagaagc

SEQ ID NO: 225480 - DNA, 25 bp, Mus musculus
cagaaggacaaaatggcagtggcag

SEQ ID NO: 225481 - DNA, 25 bp, Mus musculus
cagaaggacaagataaacttgatgg

SEQ ID NO: 225482 - DNA, 25 bp, Mus musculus
cagaaggacaagatatatctcacag

SEQ ID NO: 225483 - DNA, 25 bp, Mus musculus
cagaaggacaagatgtatatcactt

SEQ ID NO: 225484 - DNA, 25 bp, Mus musculus
cagaaggaccagctaaccctgaggg

SEQ ID NO: 225485 - DNA, 25 bp, Mus musculus
cagaaggactcagatacctgatggc

SEQ ID NO: 225486 - DNA, 25 bp, Mus musculus
cagaaggactcaggctcaaaatgga

SEQ ID NO: 225487 - DNA, 25 bp, Mus musculus
cagaaggagaagaataccaggaaaa

SEQ ID NO: 225488 - DNA, 25 bp, Mus musculus
cagaaggagaaggaaagcggtacaa

SEQ ID NO: 225489 - DNA, 25 bp, Mus musculus
cagaaggagacaggagtcatccagg

SEQ ID NO: 225490 - DNA, 25 bp, Mus musculus
cagaaggagaccagagcctcagctt

SEQ ID NO: 225491 - DNA, 25 bp, Mus musculus
cagaaggagatgaagaaatccatgc

SEQ ID NO: 225492 - DNA, 25 bp, Mus musculus
cagaaggagatgaagggttggtgaa

SEQ ID NO: 225493 - DNA, 25 bp, Mus musculus
cagaaggagatggaggcaaccaaac

SEQ ID NO: 225494 - DNA, 25 bp, Mus musculus
cagaaggcaacacagtgctgctctt

SEQ ID NO: 225495 - DNA, 25 bp, Mus musculus
cagaaggcaaggttcggctcctggc

SEQ ID NO: 225496 - DNA, 25 bp, Mus musculus
cagaaggcaatgaaggaaaccaaag

SEQ ID NO: 225497 - DNA, 25 bp, Mus musculus
cagaaggcaatggaatgatctcatt

SEQ ID NO: 225498 - DNA, 25 bp, Mus musculus
cagaaggcacagatggacagatgga

SEQ ID NO: 225499 - DNA, 25 bp, Mus musculus
cagaaggcacaggtgaaggagacaa

SEQ ID NO: 225500 - DNA, 25 bp, Mus musculus
cagaaggcaccttgggtcctgggcc

SEQ ID NO: 225501 - DNA, 25 bp, Mus musculus
cagaaggcagagaactgtgccaagt

SEQ ID NO: 225502 - DNA, 25 bp, Mus musculus
cagaaggcccagctctgataagata

SEQ ID NO: 225503 - DNA, 25 bp, Mus musculus
cagaaggcccaggtcgtggacttcc

SEQ ID NO: 225504 - DNA, 25 bp, Mus musculus
cagaaggcccaggtggctttcatga

SEQ ID NO: 225505 - DNA, 25 bp, Mus musculus
cagaaggcctggcagtgtgtctcca

SEQ ID NO: 225506 - DNA, 25 bp, Mus musculus
cagaaggctcggggaacctccgctt

SEQ ID NO: 225507 - DNA, 25 bp, Mus musculus
cagaaggctgaaggcttaactccgg

SEQ ID NO: 225508 - DNA, 25 bp, Mus musculus
cagaagggaaggtgggctacgaact

SEQ ID NO: 225509 - DNA, 25 bp, Mus musculus
cagaagggacaactgcttcggccca

SEQ ID NO: 225510 - DNA, 25 bp, Mus musculus
cagaagggactggacccatacaata

SEQ ID NO: 225511 - DNA, 25 bp, Mus musculus
cagaagggactgtcaactcttgtct

SEQ ID NO: 225512 - DNA, 25 bp, Mus musculus
cagaagggagagacgggtatcccag

SEQ ID NO: 225513 - DNA, 25 bp, Mus musculus
cagaagggagtaaaggaaacagaca

SEQ ID NO: 225514 - DNA, 25 bp, Mus musculus
cagaagggagtaaaggcagtctaaa

SEQ ID NO: 225515 - DNA, 25 bp, Mus musculus
cagaaggggatcggtatcatgccaa

SEQ ID NO: 225516 - DNA, 25 bp, Mus musculus
cagaagggtgaaaagggtgacatag

SEQ ID NO: 225517 - DNA, 25 bp, Mus musculus
cagaagggttaggatgatgctgttg

SEQ ID NO: 225518 - DNA, 25 bp, Mus musculus
cagaaggtattgtcatcactagcct

SEQ ID NO: 225519 - DNA, 25 bp, Mus musculus
cagaaggtgatgtgggtcctccccc

SEQ ID NO: 225520 - DNA, 25 bp, Mus musculus
cagaagtaagattggcctgttcgac

SEQ ID NO: 225521 - DNA, 25 bp, Mus musculus
cagaagtaatgggggcctgcatcct

SEQ ID NO: 225522 - DNA, 25 bp, Mus musculus
cagaagtacgtgggacctcttaaag

SEQ ID NO: 225523 - DNA, 25 bp, Mus musculus
cagaagtatccatcatcagaagtac

SEQ ID NO: 225524 - DNA, 25 bp, Mus musculus
cagaagtatccatcttctgtatctc

SEQ ID NO: 225525 - DNA, 25 bp, Mus musculus
cagaagtcagaaattacacttgtga

SEQ ID NO: 225526 - DNA, 25 bp, Mus musculus
cagaagtcagaggccttgctcctaa

SEQ ID NO: 225527 - DNA, 25 bp, Mus musculus
cagaagtcccaggactctcggctct

SEQ ID NO: 225528 - DNA, 25 bp, Mus musculus
cagaagtcccaggttgttcagatgt

SEQ ID NO: 225529 - DNA, 25 bp, Mus musculus
cagaagtccctaaatcaaaaagttg

SEQ ID NO: 225530 - DNA, 25 bp, Mus musculus
cagaagtccctactccggaccaaaa

SEQ ID NO: 225531 - DNA, 25 bp, Mus musculus
cagaagtcctcagggctgaactgaa

SEQ ID NO: 225532 - DNA, 25 bp, Mus musculus
cagaagtcggaaagtgtggagcaaa

SEQ ID NO: 225533 - DNA, 25 bp, Mus musculus
cagaagtctgagaactcagatgatt

SEQ ID NO: 225534 - DNA, 25 bp, Mus musculus
cagaagtctgagatgattgggagaa

SEQ ID NO: 225535 - DNA, 25 bp, Mus musculus
cagaagtctgcagagataaagccac

SEQ ID NO: 225536 - DNA, 25 bp, Mus musculus
cagaagtgatcaagattagacgtgg

SEQ ID NO: 225537 - DNA, 25 bp, Mus musculus
cagaagtgatcaagattcaaaataa

SEQ ID NO: 225538 - DNA, 25 bp, Mus musculus
cagaagtgcaggtattggttttcgc

SEQ ID NO: 225539 - DNA, 25 bp, Mus musculus
cagaagtgcattgagaaagaagtca

SEQ ID NO: 225540 - DNA, 25 bp, Mus musculus
cagaagtgcattgagagctgtctgt

SEQ ID NO: 225541 - DNA, 25 bp, Mus musculus
cagaagtgcctgacagaggagggcg

SEQ ID NO: 225542 - DNA, 25 bp, Mus musculus
cagaagtgcctgctcttgctcccag

SEQ ID NO: 225543 - DNA, 25 bp, Mus musculus
cagaagtggaagagacaatgaatat

SEQ ID NO: 225544 - DNA, 25 bp, Mus musculus
cagaagtggacttgatccctgctgt

SEQ ID NO: 225545 - DNA, 25 bp, Mus musculus
cagaagttaaggaaacatattcaag

SEQ ID NO: 225546 - DNA, 25 bp, Mus musculus
cagaagttcctgggtttgatgaaga

SEQ ID NO: 225547 - DNA, 25 bp, Mus musculus
cagaagttgaagaagagcctggaag

SEQ ID NO: 225548 - DNA, 25 bp, Mus musculus
cagaagttgaagaagtgggaatccg

SEQ ID NO: 225549 - DNA, 25 bp, Mus musculus
cagaagttgcagcggcaatatggtt

SEQ ID NO: 225550 - DNA, 25 bp, Mus musculus
cagaagttgcaggaattattgaagc

SEQ ID NO: 225551 - DNA, 25 bp, Mus musculus
cagaagttgctcaagatgctgagtc

SEQ ID NO: 225552 - DNA, 25 bp, Mus musculus
cagaagttgctgtgaaaccgggctc

SEQ ID NO: 225553 - DNA, 25 bp, Mus musculus
cagaagttggcttggcttgagattt

SEQ ID NO: 225554 - DNA, 25 bp, Mus musculus
cagaagtttggcaaggaagcagaac

SEQ ID NO: 225555 - DNA, 25 bp, Mus musculus
cagaataaaaggtgccacaggcacc

SEQ ID NO: 225556 - DNA, 25 bp, Mus musculus
cagaataaacagactgtgacagagc

SEQ ID NO: 225557 - DNA, 25 bp, Mus musculus
cagaataaacagtctgtgacagagc

SEQ ID NO: 225558 - DNA, 25 bp, Mus musculus
cagaataaaccagaactgagcagtg

SEQ ID NO: 225559 - DNA, 25 bp, Mus musculus
cagaataaccaggtgaggaaaacca

SEQ ID NO: 225560 - DNA, 25 bp, Mus musculus
cagaataagacaagagtttgggaaa

SEQ ID NO: 225561 - DNA, 25 bp, Mus musculus
cagaataaggaagcggggagtgagg

SEQ ID NO: 225562 - DNA, 25 bp, Mus musculus
cagaataattgcctgtcacctactc

SEQ ID NO: 225563 - DNA, 25 bp, Mus musculus
cagaataccaaccacagccacagtg

SEQ ID NO: 225564 - DNA, 25 bp, Mus musculus
cagaatacgtgtcgtcagcagcctt

SEQ ID NO: 225565 - DNA, 25 bp, Mus musculus
cagaatactgaacttcgtgtatttc

SEQ ID NO: 225566 - DNA, 25 bp, Mus musculus
cagaatactgacaaaaaaagccctc

SEQ ID NO: 225567 - DNA, 25 bp, Mus musculus
cagaatagaaggccgttgactactt

SEQ ID NO: 225568 - DNA, 25 bp, Mus musculus
cagaatagttgatctttataagcta

SEQ ID NO: 225569 - DNA, 25 bp, Mus musculus
cagaatagttggtcaaaagaagccg

SEQ ID NO: 225570 - DNA, 25 bp, Mus musculus
cagaatataacatctttaactacaa

SEQ ID NO: 225571 - DNA, 25 bp, Mus musculus
cagaatatcaccggattcatggttg

SEQ ID NO: 225572 - DNA, 25 bp, Mus musculus
cagaatatcgaacaaaagacgaggc

SEQ ID NO: 225573 - DNA, 25 bp, Mus musculus
cagaatatcgaacctcacatgagcc

SEQ ID NO: 225574 - DNA, 25 bp, Mus musculus
cagaatatgaagagcgggcagctaa

SEQ ID NO: 225575 - DNA, 25 bp, Mus musculus
cagaatatgaaggcatgatgggtgg

SEQ ID NO: 225576 - DNA, 25 bp, Mus musculus
cagaatatgaaggtgtgatgaatca

SEQ ID NO: 225577 - DNA, 25 bp, Mus musculus
cagaatatgatggaccccagagaga

SEQ ID NO: 225578 - DNA, 25 bp, Mus musculus
cagaatattctaagatgctcctgcc

SEQ ID NO: 225579 - DNA, 25 bp, Mus musculus
cagaatatttaatacgaacagaaca

SEQ ID NO: 225580 - DNA, 25 bp, Mus musculus
cagaatcaaaaggtggcagatgagg

SEQ ID NO: 225581 - DNA, 25 bp, Mus musculus
cagaatcaagttccttacagatggc

SEQ ID NO: 225582 - DNA, 25 bp, Mus musculus
cagaatcacaaccagccagaccact

SEQ ID NO: 225583 - DNA, 25 bp, Mus musculus
cagaatcacagatggaacaatgttg

SEQ ID NO: 225584 - DNA, 25 bp, Mus musculus
cagaatcagacaggaatctgcttga

SEQ ID NO: 225585 - DNA, 25 bp, Mus musculus
cagaatcagacaggtgatttgaact

SEQ ID NO: 225586 - DNA, 25 bp, Mus musculus
cagaatcatagggagaggcggtgag

SEQ ID NO: 225587 - DNA, 25 bp, Mus musculus
cagaatcatcgagaaacctgaaaaa

SEQ ID NO: 225588 - DNA, 25 bp, Mus musculus
cagaatcattcaggtctgtctatcc

SEQ ID NO: 225589 - DNA, 25 bp, Mus musculus
cagaatcattcagtcttccgtgtct

SEQ ID NO: 225590 - DNA, 25 bp, Mus musculus
cagaatccagctcagttctgcgctc

SEQ ID NO: 225591 - DNA, 25 bp, Mus musculus
cagaatccagtatctcttgctcctc

SEQ ID NO: 225592 - DNA, 25 bp, Mus musculus
cagaatccagtttcagatacaccac

SEQ ID NO: 225593 - DNA, 25 bp, Mus musculus
cagaatcccagtctcctcactactt

SEQ ID NO: 225594 - DNA, 25 bp, Mus musculus
cagaatcccagtggggaaacggcat

SEQ ID NO: 225595 - DNA, 25 bp, Mus musculus
cagaatcgaggtacaaccagcatcc

SEQ ID NO: 225596 - DNA, 25 bp, Mus musculus
cagaatcgggttaaggttgaggagc

SEQ ID NO: 225597 - DNA, 25 bp, Mus musculus
cagaatcgtcactgacaccaattct

SEQ ID NO: 225598 - DNA, 25 bp, Mus musculus
cagaatcgtcactgatgcccttccc

SEQ ID NO: 225599 - DNA, 25 bp, Mus musculus
cagaatcgtcactgatgtatgacct

SEQ ID NO: 225600 - DNA, 25 bp, Mus musculus
cagaatctctcaagacctcttctag

SEQ ID NO: 225601 - DNA, 25 bp, Mus musculus
cagaatctggaggctggtgaggcag

SEQ ID NO: 225602 - DNA, 25 bp, Mus musculus
cagaatctggatggctatggtcaag

SEQ ID NO: 225603 - DNA, 25 bp, Mus musculus
cagaatctgtggctgaattacacag

SEQ ID NO: 225604 - DNA, 25 bp, Mus musculus
cagaatgaagaaagagctgtgcaac

SEQ ID NO: 225605 - DNA, 25 bp, Mus musculus
cagaatgaggccggggacgaccata

SEQ ID NO: 225606 - DNA, 25 bp, Mus musculus
cagaatgcaagtcacacaaggacca

SEQ ID NO: 225607 - DNA, 25 bp, Mus musculus
cagaatgcagagtacagttgtgaat

SEQ ID NO: 225608 - DNA, 25 bp, Mus musculus
cagaatgcagcagtttgcaaagcac

SEQ ID NO: 225609 - DNA, 25 bp, Mus musculus
cagaatgcaggctggtgagattggg

SEQ ID NO: 225610 - DNA, 25 bp, Mus musculus
cagaatgcaggtggaccctcagaag

SEQ ID NO: 225611 - DNA, 25 bp, Mus musculus
cagaatgcaggtgtaatgtctttgc

SEQ ID NO: 225612 - DNA, 25 bp, Mus musculus
cagaatgccaaactccgtgtcgacc

SEQ ID NO: 225613 - DNA, 25 bp, Mus musculus
cagaatgcgcacggtagcactcagc

SEQ ID NO: 225614 - DNA, 25 bp, Mus musculus
cagaatgctggtggacaagaagcct

SEQ ID NO: 225615 - DNA, 25 bp, Mus musculus
cagaatggaagcagatcctgcctct

SEQ ID NO: 225616 - DNA, 25 bp, Mus musculus
cagaatggatcccgggcgtccatgc

SEQ ID NO: 225617 - DNA, 25 bp, Mus musculus
cagaatgtcagaaccatcctcctga

SEQ ID NO: 225618 - DNA, 25 bp, Mus musculus
cagaatgtcagtctggagcccccag

SEQ ID NO: 225619 - DNA, 25 bp, Mus musculus
cagaatgtgataggtttgccagatc

SEQ ID NO: 225620 - DNA, 25 bp, Mus musculus
cagaattactgcatctcccctcaac

SEQ ID NO: 225621 - DNA, 25 bp, Mus musculus
cagaattagcaaaagtgcttggctg

SEQ ID NO: 225622 - DNA, 25 bp, Mus musculus
cagaattagggaacctgctggtagc

SEQ ID NO: 225623 - DNA, 25 bp, Mus musculus
cagaattcaagcagatttacaaggg

SEQ ID NO: 225624 - DNA, 25 bp, Mus musculus
cagaattcagggaagctaccttgat

SEQ ID NO: 225625 - DNA, 25 bp, Mus musculus
cagaattcaggtgttccatgagcag

SEQ ID NO: 225626 - DNA, 25 bp, Mus musculus
cagaattccaggacagagatttcct

SEQ ID NO: 225627 - DNA, 25 bp, Mus musculus
cagaattccaggtctatggaaatgc

SEQ ID NO: 225628 - DNA, 25 bp, Mus musculus
cagaattccatttaacgttctgatg

SEQ ID NO: 225629 - DNA, 25 bp, Mus musculus
cagaattccccctcctcaggtacag

SEQ ID NO: 225630 - DNA, 25 bp, Mus musculus
cagaattccgggagtgatcgagttc

SEQ ID NO: 225631 - DNA, 25 bp, Mus musculus
cagaattctcaggaacatcatgaca

SEQ ID NO: 225632 - DNA, 25 bp, Mus musculus
cagaattctcatcaaggataacagc

SEQ ID NO: 225633 - DNA, 25 bp, Mus musculus
cagaattctgaagaggacagctctt

SEQ ID NO: 225634 - DNA, 25 bp, Mus musculus
cagaattctgagatcttgagttcaa

SEQ ID NO: 225635 - DNA, 25 bp, Mus musculus
cagaattctggttttggtaaaacta

SEQ ID NO: 225636 - DNA, 25 bp, Mus musculus
cagaattgaaaagtttctagatgtt

SEQ ID NO: 225637 - DNA, 25 bp, Mus musculus
cagaattgctagattagtggagtac

SEQ ID NO: 225638 - DNA, 25 bp, Mus musculus
cagaattggccttcaaatctgcaga

SEQ ID NO: 225639 - DNA, 25 bp, Mus musculus
cagaattggccttcagaatacccgg

SEQ ID NO: 225640 - DNA, 25 bp, Mus musculus
cagaattgtggagattgaagaagtt

SEQ ID NO: 225641 - DNA, 25 bp, Mus musculus
cagaattgtggaggttgacgttgat

SEQ ID NO: 225642 - DNA, 25 bp, Mus musculus
cagaattgttgtttattcatggtgg

SEQ ID NO: 225643 - DNA, 25 bp, Mus musculus
cagaatttgaggtctttaagtggac

SEQ ID NO: 225644 - DNA, 25 bp, Mus musculus
cagaattttccagttccagtgcaga

SEQ ID NO: 225645 - DNA, 25 bp, Mus musculus
cagacaaaagattcgcctaaaactg

SEQ ID NO: 225646 - DNA, 25 bp, Mus musculus
cagacaaaatcatagagcccatcca

SEQ ID NO: 225647 - DNA, 25 bp, Mus musculus
cagacaaacatggggtcccagcaac

SEQ ID NO: 225648 - DNA, 25 bp, Mus musculus
cagacaaacatgggtttaggcaaga

SEQ ID NO: 225649 - DNA, 25 bp, Mus musculus
cagacaaacttgggttctatggcct

SEQ ID NO: 225650 - DNA, 25 bp, Mus musculus
cagacaaagacgaggaaccttcagc

SEQ ID NO: 225651 - DNA, 25 bp, Mus musculus
cagacaaagatggggcaaatctact

SEQ ID NO: 225652 - DNA, 25 bp, Mus musculus
cagacaaagcaagctaccaagagca

SEQ ID NO: 225653 - DNA, 25 bp, Mus musculus
cagacaaagcaaggagtaatataaa

SEQ ID NO: 225654 - DNA, 25 bp, Mus musculus
cagacaaatgtcagtgagatcgagc

SEQ ID NO: 225655 - DNA, 25 bp, Mus musculus
cagacaaccaggtcagaaaacccag

SEQ ID NO: 225656 - DNA, 25 bp, Mus musculus
cagacaaccccaaggattaaaccag

SEQ ID NO: 225657 - DNA, 25 bp, Mus musculus
cagacaaccccaagttctacagtga

SEQ ID NO: 225658 - DNA, 25 bp, Mus musculus
cagacaacctgacagatcgttacga

SEQ ID NO: 225659 - DNA, 25 bp, Mus musculus
cagacaactcaacagcacagtcagc

SEQ ID NO: 225660 - DNA, 25 bp, Mus musculus
cagacaactcaattagcaatagcga

SEQ ID NO: 225661 - DNA, 25 bp, Mus musculus
cagacaactgaaggctgcccgagag

SEQ ID NO: 225662 - DNA, 25 bp, Mus musculus
cagacaactggaggagttggaagag

SEQ ID NO: 225663 - DNA, 25 bp, Mus musculus
cagacaagaaaagtgaagaactggt

SEQ ID NO: 225664 - DNA, 25 bp, Mus musculus
cagacaagaaagggatctgtgtggc

SEQ ID NO: 225665 - DNA, 25 bp, Mus musculus
cagacaagacaggaaccctgaccca

SEQ ID NO: 225666 - DNA, 25 bp, Mus musculus
cagacaagagagatgcctcaggaac

SEQ ID NO: 225667 - DNA, 25 bp, Mus musculus
cagacaagaggtaaagaagaagaat

SEQ ID NO: 225668 - DNA, 25 bp, Mus musculus
cagacaagccaagaatgtgctgatc

SEQ ID NO: 225669 - DNA, 25 bp, Mus musculus
cagacaaggagccagatgagaaaac

SEQ ID NO: 225670 - DNA, 25 bp, Mus musculus
cagacaaggagccagcttcacttct

SEQ ID NO: 225671 - DNA, 25 bp, Mus musculus
cagacaaggagccagctttcttgga

SEQ ID NO: 225672 - DNA, 25 bp, Mus musculus
cagacaatacccagagatgtgaata

SEQ ID NO: 225673 - DNA, 25 bp, Mus musculus
cagacaatcctatggtctttgccag

SEQ ID NO: 225674 - DNA, 25 bp, Mus musculus
cagacaatgaagataaaattgctac

SEQ ID NO: 225675 - DNA, 25 bp, Mus musculus
cagacaatgaagtgtttgctggtgt

SEQ ID NO: 225676 - DNA, 25 bp, Mus musculus
cagacaatgagaggccttcagttta

SEQ ID NO: 225677 - DNA, 25 bp, Mus musculus
cagacacaaaccaaatgaacacaca

SEQ ID NO: 225678 - DNA, 25 bp, Mus musculus
cagacacaaagctcaagttcatgtg

SEQ ID NO: 225679 - DNA, 25 bp, Mus musculus
cagacacaagcaggtcagatgtacc

SEQ ID NO: 225680 - DNA, 25 bp, Mus musculus
cagacacaagcattcccactatgtc

SEQ ID NO: 225681 - DNA, 25 bp, Mus musculus
cagacacaagttttgagaaatggtg

SEQ ID NO: 225682 - DNA, 25 bp, Mus musculus
cagacacagaaagggtgcttcgagt

SEQ ID NO: 225683 - DNA, 25 bp, Mus musculus
cagacacagaccaggtgggagcatg

SEQ ID NO: 225684 - DNA, 25 bp, Mus musculus
cagacacagcacctgcagtggctac

SEQ ID NO: 225685 - DNA, 25 bp, Mus musculus
cagacacagctagacctttggatga

SEQ ID NO: 225686 - DNA, 25 bp, Mus musculus
cagacacagctagagctttggatga

SEQ ID NO: 225687 - DNA, 25 bp, Mus musculus
cagacacatgaggtgcacgcctcct

SEQ ID NO: 225688 - DNA, 25 bp, Mus musculus
cagacacatgtagatctttcatttg

SEQ ID NO: 225689 - DNA, 25 bp, Mus musculus
cagacacattgatttgaaaccactc

SEQ ID NO: 225690 - DNA, 25 bp, Mus musculus
cagacacattgtcataacttcctca

SEQ ID NO: 225691 - DNA, 25 bp, Mus musculus
cagacacattgtgaactgccctcaa

SEQ ID NO: 225692 - DNA, 25 bp, Mus musculus
cagacaccaggaagcccctgaggaa

SEQ ID NO: 225693 - DNA, 25 bp, Mus musculus
cagacaccatgccagcccactcaag

SEQ ID NO: 225694 - DNA, 25 bp, Mus musculus
cagacacccaagagacacagtctgt

SEQ ID NO: 225695 - DNA, 25 bp, Mus musculus
cagacacccacagagaaatgatctc

SEQ ID NO: 225696 - DNA, 25 bp, Mus musculus
cagacacccacagaggacgacaatg

SEQ ID NO: 225697 - DNA, 25 bp, Mus musculus
cagacacccagaggctggtccagga

SEQ ID NO: 225698 - DNA, 25 bp, Mus musculus
cagacaccgctcgtgtcttatctag

SEQ ID NO: 225699 - DNA, 25 bp, Mus musculus
cagacaccggcaggtgggtaatgct

SEQ ID NO: 225700 - DNA, 25 bp, Mus musculus
cagacaccggccaggggcgcaagaa

SEQ ID NO: 225701 - DNA, 25 bp, Mus musculus
cagacaccggccaggtgctctcacc

SEQ ID NO: 225702 - DNA, 25 bp, Mus musculus
cagacacctgctcaacatggcgccg

SEQ ID NO: 225703 - DNA, 25 bp, Mus musculus
cagacacctggcagtgcttaatttc

SEQ ID NO: 225704 - DNA, 25 bp, Mus musculus
cagacaccttgagagggttttatgg

SEQ ID NO: 225705 - DNA, 25 bp, Mus musculus
cagacacgattcacgaggtcctgta

SEQ ID NO: 225706 - DNA, 25 bp, Mus musculus
cagacacgcggagcctctgacctcc

SEQ ID NO: 225707 - DNA, 25 bp, Mus musculus
cagacacggacaatttgggtatccg

SEQ ID NO: 225708 - DNA, 25 bp, Mus musculus
cagacactacagggctcccagtttg

SEQ ID NO: 225709 - DNA, 25 bp, Mus musculus
cagacactacaggtaacaggattga

SEQ ID NO: 225710 - DNA, 25 bp, Mus musculus
cagacactgggcctggttgtggagt

SEQ ID NO: 225711 - DNA, 25 bp, Mus musculus
cagacacttctgacgatcttgaccg

SEQ ID NO: 225712 - DNA, 25 bp, Mus musculus
cagacagaaacgggacttatctgca

SEQ ID NO: 225713 - DNA, 25 bp, Mus musculus
cagacagaacagtctaagagtgtca

SEQ ID NO: 225714 - DNA, 25 bp, Mus musculus
cagacagaacggtcattgattacaa

SEQ ID NO: 225715 - DNA, 25 bp, Mus musculus
cagacagaacggttgattacaacgg

SEQ ID NO: 225716 - DNA, 25 bp, Mus musculus
cagacagaattagggaacctgctgg

SEQ ID NO: 225717 - DNA, 25 bp, Mus musculus
cagacagacaggcttttgaggctcc

SEQ ID NO: 225718 - DNA, 25 bp, Mus musculus
cagacagacgggtccacctcaggaa

SEQ ID NO: 225719 - DNA, 25 bp, Mus musculus
cagacagactgggaaaacatcgatt

SEQ ID NO: 225720 - DNA, 25 bp, Mus musculus
cagacagagaacggggagttggcta

SEQ ID NO: 225721 - DNA, 25 bp, Mus musculus
cagacagagaatggggagctgtccc

SEQ ID NO: 225722 - DNA, 25 bp, Mus musculus
cagacagagaggctccgcaggaggc

SEQ ID NO: 225723 - DNA, 25 bp, Mus musculus
cagacagataccagaccttcctgcg

SEQ ID NO: 225724 - DNA, 25 bp, Mus musculus
cagacagatgccccaacaagggaga

SEQ ID NO: 225725 - DNA, 25 bp, Mus musculus
cagacagattgagcagctctatgcc

SEQ ID NO: 225726 - DNA, 25 bp, Mus musculus
cagacagcaacgcagtacttcatcc

SEQ ID NO: 225727 - DNA, 25 bp, Mus musculus
cagacagcaagacaaacgagggcct

SEQ ID NO: 225728 - DNA, 25 bp, Mus musculus
cagacagcaaggcaaagatgcaatt

SEQ ID NO: 225729 - DNA, 25 bp, Mus musculus
cagacagcagtgggaccaggatgga

SEQ ID NO: 225730 - DNA, 25 bp, Mus musculus
cagacagcatcaggattgctgaaag

SEQ ID NO: 225731 - DNA, 25 bp, Mus musculus
cagacagccaagggatttgaattaa

SEQ ID NO: 225732 - DNA, 25 bp, Mus musculus
cagacagccctgcgggataagaagt

SEQ ID NO: 225733 - DNA, 25 bp, Mus musculus
cagacagctcttgctgtttccaaat

SEQ ID NO: 225734 - DNA, 25 bp, Mus musculus
cagacagctgcagtgcttacagaca

SEQ ID NO: 225735 - DNA, 25 bp, Mus musculus
cagacaggcctagtgccaaaccaga

SEQ ID NO: 225736 - DNA, 25 bp, Mus musculus
cagacagggaagtaggctgaacctt

SEQ ID NO: 225737 - DNA, 25 bp, Mus musculus
cagacaggtaacagtgtcagctgac

SEQ ID NO: 225738 - DNA, 25 bp, Mus musculus
cagacagtacagaggctttttcagg

SEQ ID NO: 225739 - DNA, 25 bp, Mus musculus
cagacagtacagaggtctatggcca

SEQ ID NO: 225740 - DNA, 25 bp, Mus musculus
cagacagtagcttagcatggtttat

SEQ ID NO: 225741 - DNA, 25 bp, Mus musculus
cagacagtcaggatggtgtcacatt

SEQ ID NO: 225742 - DNA, 25 bp, Mus musculus
cagacagtcttcggacatagactga

SEQ ID NO: 225743 - DNA, 25 bp, Mus musculus
cagacagtgacccagttgacatccg

SEQ ID NO: 225744 - DNA, 25 bp, Mus musculus
cagacagtgggaagtctgttgttgg

SEQ ID NO: 225745 - DNA, 25 bp, Mus musculus
cagacagtgggtgtccacccagctg

SEQ ID NO: 225746 - DNA, 25 bp, Mus musculus
cagacatagagacctaccttctgga

SEQ ID NO: 225747 - DNA, 25 bp, Mus musculus
cagacataggaagatcaccagcaaa

SEQ ID NO: 225748 - DNA, 25 bp, Mus musculus
cagacatcagaaaccttacaatcta

SEQ ID NO: 225749 - DNA, 25 bp, Mus musculus
cagacatcagataatggaggtgact

SEQ ID NO: 225750 - DNA, 25 bp, Mus musculus
cagacatcagcagcccagtggtact

SEQ ID NO: 225751 - DNA, 25 bp, Mus musculus
cagacatccatccgcgaggaaatct

SEQ ID NO: 225752 - DNA, 25 bp, Mus musculus
cagacatccctgactaaggctggac

SEQ ID NO: 225753 - DNA, 25 bp, Mus musculus
cagacatcctcatgatctcggacct

SEQ ID NO: 225754 - DNA, 25 bp, Mus musculus
cagacatcctcatgtatgtggtcat

SEQ ID NO: 225755 - DNA, 25 bp, Mus musculus
cagacatctcagagcctgggacctg

SEQ ID NO: 225756 - DNA, 25 bp, Mus musculus
cagacatctcaggaggctgcggggc

SEQ ID NO: 225757 - DNA, 25 bp, Mus musculus
cagacatctcatgggtttgtggatg

SEQ ID NO: 225758 - DNA, 25 bp, Mus musculus
cagacatcttacatgctctgaagat

SEQ ID NO: 225759 - DNA, 25 bp, Mus musculus
cagacatgaaggcctttgttgaaaa

SEQ ID NO: 225760 - DNA, 25 bp, Mus musculus
cagacatgctcgcagaaaaagcagc

SEQ ID NO: 225761 - DNA, 25 bp, Mus musculus
cagacatgctggatagtctcactac

SEQ ID NO: 225762 - DNA, 25 bp, Mus musculus
cagacatggcggagtcttctgagtc

SEQ ID NO: 225763 - DNA, 25 bp, Mus musculus
cagacattacaaagcctcccagact

SEQ ID NO: 225764 - DNA, 25 bp, Mus musculus
cagacattaccaatggacgcatcgt

SEQ ID NO: 225765 - DNA, 25 bp, Mus musculus
cagacattcagagccacaggcacca

SEQ ID NO: 225766 - DNA, 25 bp, Mus musculus
cagacattccagatgtctggccagt

SEQ ID NO: 225767 - DNA, 25 bp, Mus musculus
cagacattccaggtttcgtcttgat

SEQ ID NO: 225768 - DNA, 25 bp, Mus musculus
cagacattgaggcaccacctaccct

SEQ ID NO: 225769 - DNA, 25 bp, Mus musculus
cagacattgcagaggatttttgcag

SEQ ID NO: 225770 - DNA, 25 bp, Mus musculus
cagacattgcagaggggctacatga

SEQ ID NO: 225771 - DNA, 25 bp, Mus musculus
cagacattgccagccttggggagtt

SEQ ID NO: 225772 - DNA, 25 bp, Mus musculus
cagacattggacggaagaagtccca

SEQ ID NO: 225773 - DNA, 25 bp, Mus musculus
cagacattgtggagacattgagaaa

SEQ ID NO: 225774 - DNA, 25 bp, Mus musculus
cagacattgtggaggcattgaacaa

SEQ ID NO: 225775 - DNA, 25 bp, Mus musculus
cagacatttatggtggttatgctgc

SEQ ID NO: 225776 - DNA, 25 bp, Mus musculus
cagacatttctggggacacccagaa

SEQ ID NO: 225777 - DNA, 25 bp, Mus musculus
cagacattttagcaggttttctgat

SEQ ID NO: 225778 - DNA, 25 bp, Mus musculus
cagaccaaaagcccttgccagagtg

SEQ ID NO: 225779 - DNA, 25 bp, Mus musculus
cagaccaaactgttgattggtgctg

SEQ ID NO: 225780 - DNA, 25 bp, Mus musculus
cagaccaaagaagagagggaacttc

SEQ ID NO: 225781 - DNA, 25 bp, Mus musculus
cagaccaaagatgggttaatatcct

SEQ ID NO: 225782 - DNA, 25 bp, Mus musculus
cagaccaacttgagaattggacagc

SEQ ID NO: 225783 - DNA, 25 bp, Mus musculus
cagaccaacttgagagtgacttctg

SEQ ID NO: 225784 - DNA, 25 bp, Mus musculus
cagaccaagatcctaaaaatactct

SEQ ID NO: 225785 - DNA, 25 bp, Mus musculus
cagaccaagatggaggagatcgggc

SEQ ID NO: 225786 - DNA, 25 bp, Mus musculus
cagaccaagatggaggagattggga

SEQ ID NO: 225787 - DNA, 25 bp, Mus musculus
cagaccaaggaccagactttgaaga

SEQ ID NO: 225788 - DNA, 25 bp, Mus musculus
cagaccaaggaccaggagatccaga

SEQ ID NO: 225789 - DNA, 25 bp, Mus musculus
cagaccacaaagctagggaagaaga

SEQ ID NO: 225790 - DNA, 25 bp, Mus musculus
cagaccacaggaaaggggaatgtga

SEQ ID NO: 225791 - DNA, 25 bp, Mus musculus
cagaccacagggatcacccatcatt

SEQ ID NO: 225792 - DNA, 25 bp, Mus musculus
cagaccacaggtccctgtggaaaag

SEQ ID NO: 225793 - DNA, 25 bp, Mus musculus
cagaccacaggttctcccctatggg

SEQ ID NO: 225794 - DNA, 25 bp, Mus musculus
cagaccacaggtttgtccagagggg

SEQ ID NO: 225795 - DNA, 25 bp, Mus musculus
cagaccacccaggctttaaagatcc

SEQ ID NO: 225796 - DNA, 25 bp, Mus musculus
cagaccactgatgagagaggtcctc

SEQ ID NO: 225797 - DNA, 25 bp, Mus musculus
cagaccagaaacggatgggctgtat

SEQ ID NO: 225798 - DNA, 25 bp, Mus musculus
cagaccagcagaacgagatggtgcg

SEQ ID NO: 225799 - DNA, 25 bp, Mus musculus
cagaccagcagactgtaaaacagac

SEQ ID NO: 225800 - DNA, 25 bp, Mus musculus
cagaccagcagactttctcctgtct

SEQ ID NO: 225801 - DNA, 25 bp, Mus musculus
cagaccagcagagacgttcacagcc

SEQ ID NO: 225802 - DNA, 25 bp, Mus musculus
cagaccagcggcaagcctgagactg

SEQ ID NO: 225803 - DNA, 25 bp, Mus musculus
cagaccaggcagcgagtactaacag

SEQ ID NO: 225804 - DNA, 25 bp, Mus musculus
cagaccagtcactatgtgctgtgag

SEQ ID NO: 225805 - DNA, 25 bp, Mus musculus
cagaccatacagtcgtttacccttc

SEQ ID NO: 225806 - DNA, 25 bp, Mus musculus
cagaccatcatgcacatccaggacc

SEQ ID NO: 225807 - DNA, 25 bp, Mus musculus
cagaccatccaggtgagcctcatgt

SEQ ID NO: 225808 - DNA, 25 bp, Mus musculus
cagaccatctccggtcctggcttaa

SEQ ID NO: 225809 - DNA, 25 bp, Mus musculus
cagaccatgcaagtgaacgaagctt

SEQ ID NO: 225810 - DNA, 25 bp, Mus musculus
cagaccatgcaagtggaaagtacgc

SEQ ID NO: 225811 - DNA, 25 bp, Mus musculus
cagaccatggggccgaggaggacaa

SEQ ID NO: 225812 - DNA, 25 bp, Mus musculus
cagaccatggtgagcccattggccg

SEQ ID NO: 225813 - DNA, 25 bp, Mus musculus
cagacccaagacaagttcgagaaat

SEQ ID NO: 225814 - DNA, 25 bp, Mus musculus
cagacccacagacttccaaattgag

SEQ ID NO: 225815 - DNA, 25 bp, Mus musculus
cagacccacagaggctcccaaacac

SEQ ID NO: 225816 - DNA, 25 bp, Mus musculus
cagacccacaggaaacaccagctgg

SEQ ID NO: 225817 - DNA, 25 bp, Mus musculus
cagacccagtctaaaatcgatgtcc

SEQ ID NO: 225818 - DNA, 25 bp, Mus musculus
cagacccagtctaacacagaggaga

SEQ ID NO: 225819 - DNA, 25 bp, Mus musculus
cagaccccaaaggagccaagtcaga

SEQ ID NO: 225820 - DNA, 25 bp, Mus musculus
cagaccccagcctatggtatcgctg

SEQ ID NO: 225821 - DNA, 25 bp, Mus musculus
cagaccccagcctccgcatgagcat

SEQ ID NO: 225822 - DNA, 25 bp, Mus musculus
cagaccccaggtatgcgagaccacc

SEQ ID NO: 225823 - DNA, 25 bp, Mus musculus
cagaccccaggttccagtgccccca

SEQ ID NO: 225824 - DNA, 25 bp, Mus musculus
cagaccccatttgggttccagtgca

SEQ ID NO: 225825 - DNA, 25 bp, Mus musculus
cagaccccgcagctcttggcaagta

SEQ ID NO: 225826 - DNA, 25 bp, Mus musculus
cagaccccgcaggagacatatgaaa

SEQ ID NO: 225827 - DNA, 25 bp, Mus musculus
cagaccccttccaaggtgatccttt

SEQ ID NO: 225828 - DNA, 25 bp, Mus musculus
cagacccgagttgaaaaatctggat

SEQ ID NO: 225829 - DNA, 25 bp, Mus musculus
cagacccgcgcggcccgcgcagccg

SEQ ID NO: 225830 - DNA, 25 bp, Mus musculus
cagacccgcgcgggcccacactcgc

SEQ ID NO: 225831 - DNA, 25 bp, Mus musculus
cagacccggccccagcatctgggtg

SEQ ID NO: 225832 - DNA, 25 bp, Mus musculus
cagaccctcatccagcatttccaag

SEQ ID NO: 225833 - DNA, 25 bp, Mus musculus
cagaccctccaggtagtccaggggc

SEQ ID NO: 225834 - DNA, 25 bp, Mus musculus
cagaccctccccacagagcgcacgc

SEQ ID NO: 225835 - DNA, 25 bp, Mus musculus
cagaccctgaaggagctgcctctgc

SEQ ID NO: 225836 - DNA, 25 bp, Mus musculus
cagaccctggacatcaacatggctg

SEQ ID NO: 225837 - DNA, 25 bp, Mus musculus
cagaccctggagccaccccgctggg

SEQ ID NO: 225838 - DNA, 25 bp, Mus musculus
cagaccctgggacagcaggtgcccg

SEQ ID NO: 225839 - DNA, 25 bp, Mus musculus
cagaccctgggctccaccctcatcc

SEQ ID NO: 225840 - DNA, 25 bp, Mus musculus
cagaccctggtcactcatcaggcca

SEQ ID NO: 225841 - DNA, 25 bp, Mus musculus
cagaccctggtcaggcagttccagg

SEQ ID NO: 225842 - DNA, 25 bp, Mus musculus
cagaccctggttcctgtctgcagct

SEQ ID NO: 225843 - DNA, 25 bp, Mus musculus
cagaccctgtacagagagctccaag

SEQ ID NO: 225844 - DNA, 25 bp, Mus musculus
cagaccctgtacagagccaccttgt

SEQ ID NO: 225845 - DNA, 25 bp, Mus musculus
cagacccttgaactgaggaacgggc

SEQ ID NO: 225846 - DNA, 25 bp, Mus musculus
cagaccgcagaagttatatgagtgt

SEQ ID NO: 225847 - DNA, 25 bp, Mus musculus
cagaccgcctacacatccaggtggc

SEQ ID NO: 225848 - DNA, 25 bp, Mus musculus
cagaccgtcacggacaattgttcca

SEQ ID NO: 225849 - DNA, 25 bp, Mus musculus
cagaccgtggatgggagggccccaa

SEQ ID NO: 225850 - DNA, 25 bp, Mus musculus
cagaccgtgggggagattttctacc

SEQ ID NO: 225851 - DNA, 25 bp, Mus musculus
cagaccgtgggggaggatcccatag

SEQ ID NO: 225852 - DNA, 25 bp, Mus musculus
cagaccgtgggggaggtgacagatt

SEQ ID NO: 225853 - DNA, 25 bp, Mus musculus
cagacctaaccattcaggccacagt

SEQ ID NO: 225854 - DNA, 25 bp, Mus musculus
cagacctaacgattcaggccacagt

SEQ ID NO: 225855 - DNA, 25 bp, Mus musculus
cagacctaccgagtgaccctgagca

SEQ ID NO: 225856 - DNA, 25 bp, Mus musculus
cagacctacgataaccacttccgat

SEQ ID NO: 225857 - DNA, 25 bp, Mus musculus
cagacctactgtgtctctggaccaa

SEQ ID NO: 225858 - DNA, 25 bp, Mus musculus
cagacctatgagatggtagacaaac

SEQ ID NO: 225859 - DNA, 25 bp, Mus musculus
cagacctcaccgacacactggatgc

SEQ ID NO: 225860 - DNA, 25 bp, Mus musculus
cagacctcaccttcctcacaggtct

SEQ ID NO: 225861 - DNA, 25 bp, Mus musculus
cagacctcagaaactgtggcccgag

SEQ ID NO: 225862 - DNA, 25 bp, Mus musculus
cagacctcagatcagaaccagtctt

SEQ ID NO: 225863 - DNA, 25 bp, Mus musculus
cagacctcaggtttaacacacaaag

SEQ ID NO: 225864 - DNA, 25 bp, Mus musculus
cagacctcatccagaccagagggcc

SEQ ID NO: 225865 - DNA, 25 bp, Mus musculus
cagacctcatccagcttactggcgg

SEQ ID NO: 225866 - DNA, 25 bp, Mus musculus
cagacctccaagggcaccatgaaca

SEQ ID NO: 225867 - DNA, 25 bp, Mus musculus
cagacctcctgatcacttgtacagc

SEQ ID NO: 225868 - DNA, 25 bp, Mus musculus
cagacctcgcaggaaattctacaga

SEQ ID NO: 225869 - DNA, 25 bp, Mus musculus
cagacctcgcaggaagacagatctt

SEQ ID NO: 225870 - DNA, 25 bp, Mus musculus
cagacctcgcggaaaactgtccttg

SEQ ID NO: 225871 - DNA, 25 bp, Mus musculus
cagacctcgcgggcccatcctcccg

SEQ ID NO: 225872 - DNA, 25 bp, Mus musculus
cagacctcggcgcgggaactggcat

SEQ ID NO: 225873 - DNA, 25 bp, Mus musculus
cagacctcggcgcgggtgaacacca

SEQ ID NO: 225874 - DNA, 25 bp, Mus musculus
cagacctcggcgcgggtgagcccta

SEQ ID NO: 225875 - DNA, 25 bp, Mus musculus
cagacctctgacaaacagttgctca

SEQ ID NO: 225876 - DNA, 25 bp, Mus musculus
cagacctctgacaaggatgagagcg

SEQ ID NO: 225877 - DNA, 25 bp, Mus musculus
cagacctctgagcgaacatcccaac

SEQ ID NO: 225878 - DNA, 25 bp, Mus musculus
cagacctgagtgaggtagataaaga

SEQ ID NO: 225879 - DNA, 25 bp, Mus musculus
cagacctgccaggacgctgagcctg

SEQ ID NO: 225880 - DNA, 25 bp, Mus musculus
cagacctgccaggtgtcaccatgct

SEQ ID NO: 225881 - DNA, 25 bp, Mus musculus
cagacctgctggggtgacagtccaa

SEQ ID NO: 225882 - DNA, 25 bp, Mus musculus
cagacctggccaagcctaccaggta

SEQ ID NO: 225883 - DNA, 25 bp, Mus musculus
cagacctggccaaggtaccacggtt

SEQ ID NO: 225884 - DNA, 25 bp, Mus musculus
cagacctggctccagtctgttctcc

SEQ ID NO: 225885 - DNA, 25 bp, Mus musculus
cagacctggctccattccatgaggc

SEQ ID NO: 225886 - DNA, 25 bp, Mus musculus
cagacctgttagggatccttgtggg

SEQ ID NO: 225887 - DNA, 25 bp, Mus musculus
cagaccttaagggatagagaaggct

SEQ ID NO: 225888 - DNA, 25 bp, Mus musculus
cagaccttaggggacttacttctaa

SEQ ID NO: 225889 - DNA, 25 bp, Mus musculus
cagaccttcacgcatcatgactgat

SEQ ID NO: 225890 - DNA, 25 bp, Mus musculus
cagacgaagttccgacagcagccca

SEQ ID NO: 225891 - DNA, 25 bp, Mus musculus
cagacgaattggaatcccagtcaga

SEQ ID NO: 225892 - DNA, 25 bp, Mus musculus
cagacgacacttacgagcatacatc

SEQ ID NO: 225893 - DNA, 25 bp, Mus musculus
cagacgacacttacgataaacttta

SEQ ID NO: 225894 - DNA, 25 bp, Mus musculus
cagacgaccagaagagagccaagcc

SEQ ID NO: 225895 - DNA, 25 bp, Mus musculus
cagacgacctagagatgtggtcagc

SEQ ID NO: 225896 - DNA, 25 bp, Mus musculus
cagacgaccttgttgccgctggtgg

SEQ ID NO: 225897 - DNA, 25 bp, Mus musculus
cagacgagacgagagtgatctcagc

SEQ ID NO: 225898 - DNA, 25 bp, Mus musculus
cagacgataatgaagaaaacgggag

SEQ ID NO: 225899 - DNA, 25 bp, Mus musculus
cagacgatgaaggtgaagatgccat

SEQ ID NO: 225900 - DNA, 25 bp, Mus musculus
cagacgatgaagtaaggaaagccag

SEQ ID NO: 225901 - DNA, 25 bp, Mus musculus
cagacgatgagatggaactggagga

SEQ ID NO: 225902 - DNA, 25 bp, Mus musculus
cagacgatgcacaggccatagaagc

SEQ ID NO: 225903 - DNA, 25 bp, Mus musculus
cagacgcaagaccattctttaaaga

SEQ ID NO: 225904 - DNA, 25 bp, Mus musculus
cagacgcaccagctcccttccccga

SEQ ID NO: 225905 - DNA, 25 bp, Mus musculus
cagacgcaccagggggactccctgg

SEQ ID NO: 225906 - DNA, 25 bp, Mus musculus
cagacgcaccaggtcacacacacat

SEQ ID NO: 225907 - DNA, 25 bp, Mus musculus
cagacgctaacccaggagaacgtca

SEQ ID NO: 225908 - DNA, 25 bp, Mus musculus
cagacgctcagatatgctgaaggac

SEQ ID NO: 225909 - DNA, 25 bp, Mus musculus
cagacgcttccattgtctaaagcca

SEQ ID NO: 225910 - DNA, 25 bp, Mus musculus
cagacggccatggaaccacaaacca

SEQ ID NO: 225911 - DNA, 25 bp, Mus musculus
cagacggcggccagcatcaggaaga

SEQ ID NO: 225912 - DNA, 25 bp, Mus musculus
cagacggctccagattactacaagg

SEQ ID NO: 225913 - DNA, 25 bp, Mus musculus
cagacgggagctgcaggagatgcgg

SEQ ID NO: 225914 - DNA, 25 bp, Mus musculus
cagacggtgaagaaggtgataaatg

SEQ ID NO: 225915 - DNA, 25 bp, Mus musculus
cagacgtatgatgacatcgactatg

SEQ ID NO: 225916 - DNA, 25 bp, Mus musculus
cagacgtcactggagttcttttcaa

SEQ ID NO: 225917 - DNA, 25 bp, Mus musculus
cagacgtctgaggacacagactcag

SEQ ID NO: 225918 - DNA, 25 bp, Mus musculus
cagacgtctgaggcagcgggagccc

SEQ ID NO: 225919 - DNA, 25 bp, Mus musculus
cagacgtctgaggtggcttggtttg

SEQ ID NO: 225920 - DNA, 25 bp, Mus musculus
cagacgtgaaaagtgacgtgaacac

SEQ ID NO: 225921 - DNA, 25 bp, Mus musculus
cagacgtgaaaatgttctgcctgca

SEQ ID NO: 225922 - DNA, 25 bp, Mus musculus
cagacgtgggtgcaggtctcaggag

SEQ ID NO: 225923 - DNA, 25 bp, Mus musculus
cagacgtgttcaattttcacagctg

SEQ ID NO: 225924 - DNA, 25 bp, Mus musculus
cagacgtgttcacattctggtggta

SEQ ID NO: 225925 - DNA, 25 bp, Mus musculus
cagacgtgttcagattccagcattc

SEQ ID NO: 225926 - DNA, 25 bp, Mus musculus
cagactaaagaagtttccagaactg

SEQ ID NO: 225927 - DNA, 25 bp, Mus musculus
cagactaaaggcatgcagtatggtg

SEQ ID NO: 225928 - DNA, 25 bp, Mus musculus
cagactaaaggtgttgacagctctt

SEQ ID NO: 225929 - DNA, 25 bp, Mus musculus
cagactaagcaggtggaagaactaa

SEQ ID NO: 225930 - DNA, 25 bp, Mus musculus
cagactacagcggtcagcagagcac

SEQ ID NO: 225931 - DNA, 25 bp, Mus musculus
cagactacatggaatatgctcagag

SEQ ID NO: 225932 - DNA, 25 bp, Mus musculus
cagactacctccaggtcggagtgac

SEQ ID NO: 225933 - DNA, 25 bp, Mus musculus
cagactacctccaggtggttgttgg

SEQ ID NO: 225934 - DNA, 25 bp, Mus musculus
cagactacctgaagaaacagcaagt

SEQ ID NO: 225935 - DNA, 25 bp, Mus musculus
cagactacctgacctcatctttgag

SEQ ID NO: 225936 - DNA, 25 bp, Mus musculus
cagactacctgactctttgagataa

SEQ ID NO: 225937 - DNA, 25 bp, Mus musculus
cagactactccacggattacctcac

SEQ ID NO: 225938 - DNA, 25 bp, Mus musculus
cagactatgaaatggtccaccaggc

SEQ ID NO: 225939 - DNA, 25 bp, Mus musculus
cagactatgaaatggttttactggg

SEQ ID NO: 225940 - DNA, 25 bp, Mus musculus
cagactatgggcaggtgttcaccta

SEQ ID NO: 225941 - DNA, 25 bp, Mus musculus
cagactcaagcaagacctgcaggcg

SEQ ID NO: 225942 - DNA, 25 bp, Mus musculus
cagactcaatgaggccctgctggag

SEQ ID NO: 225943 - DNA, 25 bp, Mus musculus
cagactcagattaagggtttcaaaa

SEQ ID NO: 225944 - DNA, 25 bp, Mus musculus
cagactcagcccgtcacaatcatta

SEQ ID NO: 225945 - DNA, 25 bp, Mus musculus
cagactcatggctgggctctacaac

SEQ ID NO: 225946 - DNA, 25 bp, Mus musculus
cagactcattaaaggaaaaggatat

SEQ ID NO: 225947 - DNA, 25 bp, Mus musculus
cagactccccagtttctcaagggag

SEQ ID NO: 225948 - DNA, 25 bp, Mus musculus
cagactcccctgaatttaaggagca

SEQ ID NO: 225949 - DNA, 25 bp, Mus musculus
cagactcccgcaaagacaggtggtg

SEQ ID NO: 225950 - DNA, 25 bp, Mus musculus
cagactcccgcaagacgcttaaagg

SEQ ID NO: 225951 - DNA, 25 bp, Mus musculus
cagactccggaagaacctcagctat

SEQ ID NO: 225952 - DNA, 25 bp, Mus musculus
cagactccggtgaagaatgctatca

SEQ ID NO: 225953 - DNA, 25 bp, Mus musculus
cagactctagctgggcgaggacccg

SEQ ID NO: 225954 - DNA, 25 bp, Mus musculus
cagactctctcccagatgacagtca

SEQ ID NO: 225955 - DNA, 25 bp, Mus musculus
cagactctgaagcagattcgctgcc

SEQ ID NO: 225956 - DNA, 25 bp, Mus musculus
cagactctgccaaggagttaatcag

SEQ ID NO: 225957 - DNA, 25 bp, Mus musculus
cagactctgtccagccagctggcgg

SEQ ID NO: 225958 - DNA, 25 bp, Mus musculus
cagactcttagagaacatgctggat

SEQ ID NO: 225959 - DNA, 25 bp, Mus musculus
cagactcttagagaagatccatctg

SEQ ID NO: 225960 - DNA, 25 bp, Mus musculus
cagactcttcatttgatgcagcaat

SEQ ID NO: 225961 - DNA, 25 bp, Mus musculus
cagactcttggagaaaatccaagtt

SEQ ID NO: 225962 - DNA, 25 bp, Mus musculus
cagactcttggagctggaagagaaa

SEQ ID NO: 225963 - DNA, 25 bp, Mus musculus
cagactgaaggacagggtggcctgc

SEQ ID NO: 225964 - DNA, 25 bp, Mus musculus
cagactgaggaacctgagaagaagg

SEQ ID NO: 225965 - DNA, 25 bp, Mus musculus
cagactgcaaaggtgaccagagcga

SEQ ID NO: 225966 - DNA, 25 bp, Mus musculus
cagactgcacttgtggtttgctatc

SEQ ID NO: 225967 - DNA, 25 bp, Mus musculus
cagactgcagactcacgcccactgg

SEQ ID NO: 225968 - DNA, 25 bp, Mus musculus
cagactgcagcctaggatgtcaggc

SEQ ID NO: 225969 - DNA, 25 bp, Mus musculus
cagactgcaggaaactacaaccttt

SEQ ID NO: 225970 - DNA, 25 bp, Mus musculus
cagactgcagtttcaggtcagagtt

SEQ ID NO: 225971 - DNA, 25 bp, Mus musculus
cagactgcatggaactacatgaatg

SEQ ID NO: 225972 - DNA, 25 bp, Mus musculus
cagactgccacggcctcctcagcag

SEQ ID NO: 225973 - DNA, 25 bp, Mus musculus
cagactgccacggtcatctctcatg

SEQ ID NO: 225974 - DNA, 25 bp, Mus musculus
cagactgcgacttggataagaaaac

SEQ ID NO: 225975 - DNA, 25 bp, Mus musculus
cagactgcgacttgggcttcctgta

SEQ ID NO: 225976 - DNA, 25 bp, Mus musculus
cagactgctctacgaagcgctgcgc

SEQ ID NO: 225977 - DNA, 25 bp, Mus musculus
cagactgctgacaggcaccacacag

SEQ ID NO: 225978 - DNA, 25 bp, Mus musculus
cagactgctgccaggtggagagagc

SEQ ID NO: 225979 - DNA, 25 bp, Mus musculus
cagactgcttctaagactctgaatt

SEQ ID NO: 225980 - DNA, 25 bp, Mus musculus
cagactgctttttaggaccttgttc

SEQ ID NO: 225981 - DNA, 25 bp, Mus musculus
cagactgctttttagtggtgatcat

SEQ ID NO: 225982 - DNA, 25 bp, Mus musculus
cagactggaaggaacatgacatcga

SEQ ID NO: 225983 - DNA, 25 bp, Mus musculus
cagactggactcaagcggatagcca

SEQ ID NO: 225984 - DNA, 25 bp, Mus musculus
cagactggagaggctcccccaccga

SEQ ID NO: 225985 - DNA, 25 bp, Mus musculus
cagactggaggacggaaaccactga

SEQ ID NO: 225986 - DNA, 25 bp, Mus musculus
cagactggaggagttgaaagaattt

SEQ ID NO: 225987 - DNA, 25 bp, Mus musculus
cagactggaggcattctggaattta

SEQ ID NO: 225988 - DNA, 25 bp, Mus musculus
cagactggttaacgcttatttcctc

SEQ ID NO: 225989 - DNA, 25 bp, Mus musculus
cagactgtaacctgtcctggttatg

SEQ ID NO: 225990 - DNA, 25 bp, Mus musculus
cagactgtcctcccgggtaaatagc

SEQ ID NO: 225991 - DNA, 25 bp, Mus musculus
cagactgtgcagagccaatatgaag

SEQ ID NO: 225992 - DNA, 25 bp, Mus musculus
cagactgtgcagaggttcacctggt

SEQ ID NO: 225993 - DNA, 25 bp, Mus musculus
cagacttaaagatttcacaggtcta

SEQ ID NO: 225994 - DNA, 25 bp, Mus musculus
cagacttaaagtggcccagacgtca

SEQ ID NO: 225995 - DNA, 25 bp, Mus musculus
cagacttcagatctgttgaacagga

SEQ ID NO: 225996 - DNA, 25 bp, Mus musculus
cagacttccacacgcgcacggacca

SEQ ID NO: 225997 - DNA, 25 bp, Mus musculus
cagacttcccagagaatgttgctga

SEQ ID NO: 225998 - DNA, 25 bp, Mus musculus
cagacttcccagctctcttctcctt

SEQ ID NO: 225999 - DNA, 25 bp, Mus musculus
cagacttcccagggctatacatcct

SEQ ID NO: 226000 - DNA, 25 bp, Mus musculus
cagacttctaaggcctctcctgcag

SEQ ID NO: 226001 - DNA, 25 bp, Mus musculus
cagacttctacctgtgtcttcctgg

SEQ ID NO: 226002 - DNA, 25 bp, Mus musculus
cagacttctcaaggctcagaaatcc

SEQ ID NO: 226003 - DNA, 25 bp, Mus musculus
cagacttctcagaggctccatctcc

SEQ ID NO: 226004 - DNA, 25 bp, Mus musculus
cagacttctctcagctacagcggaa

SEQ ID NO: 226005 - DNA, 25 bp, Mus musculus
cagacttgctggtacaagtatgaat

SEQ ID NO: 226006 - DNA, 25 bp, Mus musculus
cagactttgacgagatcatcagtga

SEQ ID NO: 226007 - DNA, 25 bp, Mus musculus
cagactttgacgagtgaggagagat

SEQ ID NO: 226008 - DNA, 25 bp, Mus musculus
cagactttgcaaagacgtgtgtgtc

SEQ ID NO: 226009 - DNA, 25 bp, Mus musculus
cagactttggaccaaagacccagcc

SEQ ID NO: 226010 - DNA, 25 bp, Mus musculus
cagactttggaccaactgttctcag

SEQ ID NO: 226011 - DNA, 25 bp, Mus musculus
cagactttgggcaggaaacaagtta

SEQ ID NO: 226012 - DNA, 25 bp, Mus musculus
cagagaaaaacggctcttgcttctt

SEQ ID NO: 226013 - DNA, 25 bp, Mus musculus
cagagaaaaatggaatctctacgaa

SEQ ID NO: 226014 - DNA, 25 bp, Mus musculus
cagagaaaagcaagtgctgtcttcc

SEQ ID NO: 226015 - DNA, 25 bp, Mus musculus
cagagaaaagcacagccttcacagg

SEQ ID NO: 226016 - DNA, 25 bp, Mus musculus
cagagaaaagcacaggctgctgagg

SEQ ID NO: 226017 - DNA, 25 bp, Mus musculus
cagagaaaaggtggagcttttgtgg

SEQ ID NO: 226018 - DNA, 25 bp, Mus musculus
cagagaaagaggatggaggcctcct

SEQ ID NO: 226019 - DNA, 25 bp, Mus musculus
cagagaaagatatgctggcatcgcc

SEQ ID NO: 226020 - DNA, 25 bp, Mus musculus
cagagaaagatatggcagtgaaaat

SEQ ID NO: 226021 - DNA, 25 bp, Mus musculus
cagagaaagatgtgcactaggcctt

SEQ ID NO: 226022 - DNA, 25 bp, Mus musculus
cagagaaagcaccagcaccaggtct

SEQ ID NO: 226023 - DNA, 25 bp, Mus musculus
cagagaaagcaggttcatgttttat

SEQ ID NO: 226024 - DNA, 25 bp, Mus musculus
cagagaaagccgagtccatctaccg

SEQ ID NO: 226025 - DNA, 25 bp, Mus musculus
cagagaaaggttctcaacgcctgct

SEQ ID NO: 226026 - DNA, 25 bp, Mus musculus
cagagaaatggagagaagcccggga

SEQ ID NO: 226027 - DNA, 25 bp, Mus musculus
cagagaacaagatttctccttatta

SEQ ID NO: 226028 - DNA, 25 bp, Mus musculus
cagagaacaaggtccttccatagtg

SEQ ID NO: 226029 - DNA, 25 bp, Mus musculus
cagagaacactgtggctctccagag

SEQ ID NO: 226030 - DNA, 25 bp, Mus musculus
cagagaacaggctgtgaaaacagag

SEQ ID NO: 226031 - DNA, 25 bp, Mus musculus
cagagaacatggatgtcagcaattg

SEQ ID NO: 226032 - DNA, 25 bp, Mus musculus
cagagaaccaaaggacttcaggaac

SEQ ID NO: 226033 - DNA, 25 bp, Mus musculus
cagagaacgtcccagggtgatgtga

SEQ ID NO: 226034 - DNA, 25 bp, Mus musculus
cagagaactacttgtctacccacag

SEQ ID NO: 226035 - DNA, 25 bp, Mus musculus
cagagaactggccggttctgcggtg

SEQ ID NO: 226036 - DNA, 25 bp, Mus musculus
cagagaagaaaaggagttggaaccc

SEQ ID NO: 226037 - DNA, 25 bp, Mus musculus
cagagaagaaggcagataaggaaaa

SEQ ID NO: 226038 - DNA, 25 bp, Mus musculus
cagagaagaaggcagcccagatact

SEQ ID NO: 226039 - DNA, 25 bp, Mus musculus
cagagaagaaggcaggcctccactt

SEQ ID NO: 226040 - DNA, 25 bp, Mus musculus
cagagaagaagtgtttgaaagacgt

SEQ ID NO: 226041 - DNA, 25 bp, Mus musculus
cagagaagccaggttacaaactacc

SEQ ID NO: 226042 - DNA, 25 bp, Mus musculus
cagagaagctcaagacatactttga

SEQ ID NO: 226043 - DNA, 25 bp, Mus musculus
cagagaaggaaaaggaaacacaacc

SEQ ID NO: 226044 - DNA, 25 bp, Mus musculus
cagagaaggaagacaccaaatccta

SEQ ID NO: 226045 - DNA, 25 bp, Mus musculus
cagagaaggaaggaatgtcactgtc

SEQ ID NO: 226046 - DNA, 25 bp, Mus musculus
cagagaaggaaggtatttccaaact

SEQ ID NO: 226047 - DNA, 25 bp, Mus musculus
cagagaaggaccaggacaaaggcct

SEQ ID NO: 226048 - DNA, 25 bp, Mus musculus
cagagaaggaggccgcatccacgcc

SEQ ID NO: 226049 - DNA, 25 bp, Mus musculus
cagagaaggatcagctgaagaataa

SEQ ID NO: 226050 - DNA, 25 bp, Mus musculus
cagagaaggctcagtgccatggaga

SEQ ID NO: 226051 - DNA, 25 bp, Mus musculus
cagagaaggctcagtgctgtatgcc

SEQ ID NO: 226052 - DNA, 25 bp, Mus musculus
cagagaaggtgatcatctgtctgga

SEQ ID NO: 226053 - DNA, 25 bp, Mus musculus
cagagaagtcagagcagcagcaagt

SEQ ID NO: 226054 - DNA, 25 bp, Mus musculus
cagagaagtcagagtgaaagtagaa

SEQ ID NO: 226055 - DNA, 25 bp, Mus musculus
cagagaagtcagcctggaaactgcc

SEQ ID NO: 226056 - DNA, 25 bp, Mus musculus
cagagaagtcagcctggcgcaagat

SEQ ID NO: 226057 - DNA, 25 bp, Mus musculus
cagagaagtccaggaagatgggctc

SEQ ID NO: 226058 - DNA, 25 bp, Mus musculus
cagagaagtttgaccctgaggcttt

SEQ ID NO: 226059 - DNA, 25 bp, Mus musculus
cagagaatagtcagacttctgccag

SEQ ID NO: 226060 - DNA, 25 bp, Mus musculus
cagagaatcttataggatttaaacg

SEQ ID NO: 226061 - DNA, 25 bp, Mus musculus
cagagaatgaaaagtgaagctgagg

SEQ ID NO: 226062 - DNA, 25 bp, Mus musculus
cagagaatgacactgtctctggctt

SEQ ID NO: 226063 - DNA, 25 bp, Mus musculus
cagagaatgagaaaatgaaaattga

SEQ ID NO: 226064 - DNA, 25 bp, Mus musculus
cagagaattattctgctcttcctcc

SEQ ID NO: 226065 - DNA, 25 bp, Mus musculus
cagagacaaaggaacaagttgatct

SEQ ID NO: 226066 - DNA, 25 bp, Mus musculus
cagagacaagggtaggtccctgtat

SEQ ID NO: 226067 - DNA, 25 bp, Mus musculus
cagagacaaggtccactgggcagcc

SEQ ID NO: 226068 - DNA, 25 bp, Mus musculus
cagagacaaggttctccccacccac

SEQ ID NO: 226069 - DNA, 25 bp, Mus musculus
cagagacaatctcatttgagatgct

SEQ ID NO: 226070 - DNA, 25 bp, Mus musculus
cagagacaatctcgctgcgaaaaga

SEQ ID NO: 226071 - DNA, 25 bp, Mus musculus
cagagacacaggaacctgaggagaa

SEQ ID NO: 226072 - DNA, 25 bp, Mus musculus
cagagacaccagcttgggggcccca

SEQ ID NO: 226073 - DNA, 25 bp, Mus musculus
cagagacagaggaggccatgtcagg

SEQ ID NO: 226074 - DNA, 25 bp, Mus musculus
cagagacagaggtctcaagggagct

SEQ ID NO: 226075 - DNA, 25 bp, Mus musculus
cagagacagcaggattttcgaaaat

SEQ ID NO: 226076 - DNA, 25 bp, Mus musculus
cagagacaggcagtcatttgaagac

SEQ ID NO: 226077 - DNA, 25 bp, Mus musculus
cagagacatggagttcttttcaaag

SEQ ID NO: 226078 - DNA, 25 bp, Mus musculus
cagagacatgtatgcactgaagaaa

SEQ ID NO: 226079 - DNA, 25 bp, Mus musculus
cagagaccaggtctttggccagtat

SEQ ID NO: 226080 - DNA, 25 bp, Mus musculus
cagagacccaagtgcataagtaaag

SEQ ID NO: 226081 - DNA, 25 bp, Mus musculus
cagagacccacaccacgactactgt

SEQ ID NO: 226082 - DNA, 25 bp, Mus musculus
cagagaccccgatcctcgtgggact

SEQ ID NO: 226083 - DNA, 25 bp, Mus musculus
cagagaccccggaccaatctccgct

SEQ ID NO: 226084 - DNA, 25 bp, Mus musculus
cagagaccccgggtccagcaccaag

SEQ ID NO: 226085 - DNA, 25 bp, Mus musculus
cagagacccctttaggtgttccgaa

SEQ ID NO: 226086 - DNA, 25 bp, Mus musculus
cagagaccctgaggaaatggggatt

SEQ ID NO: 226087 - DNA, 25 bp, Mus musculus
cagagaccgagggagggagccatca

SEQ ID NO: 226088 - DNA, 25 bp, Mus musculus
cagagaccgcaatctcactggtctg

SEQ ID NO: 226089 - DNA, 25 bp, Mus musculus
cagagaccgcaatgtgtatgtcgac

SEQ ID NO: 226090 - DNA, 25 bp, Mus musculus
cagagacgcaggctggctcaccatc

SEQ ID NO: 226091 - DNA, 25 bp, Mus musculus
cagagactaaggcaattccagtaaa

SEQ ID NO: 226092 - DNA, 25 bp, Mus musculus
cagagactaaggctgtgaaaacaga

SEQ ID NO: 226093 - DNA, 25 bp, Mus musculus
cagagactcaggattgaaaagatga

SEQ ID NO: 226094 - DNA, 25 bp, Mus musculus
cagagactggggccgtcatcatagc

SEQ ID NO: 226095 - DNA, 25 bp, Mus musculus
cagagactggggctgcaggatgacc

SEQ ID NO: 226096 - DNA, 25 bp, Mus musculus
cagagactgtgagccaaaaagcagg

SEQ ID NO: 226097 - DNA, 25 bp, Mus musculus
cagagactttgctggatgcttttgt

SEQ ID NO: 226098 - DNA, 25 bp, Mus musculus
cagagagaaataatgaagcattgga

SEQ ID NO: 226099 - DNA, 25 bp, Mus musculus
cagagagaacaacgtttccctcagt

SEQ ID NO: 226100 - DNA, 25 bp, Mus musculus
cagagagaacactgtgatctgctct

SEQ ID NO: 226101 - DNA, 25 bp, Mus musculus
cagagagaacactgttttcatgaac

SEQ ID NO: 226102 - DNA, 25 bp, Mus musculus
cagagagaagaatgaaagtaacaag

SEQ ID NO: 226103 - DNA, 25 bp, Mus musculus
cagagagaagccggcctctggtgct

SEQ ID NO: 226104 - DNA, 25 bp, Mus musculus
cagagagaagccggttatacaatgg

SEQ ID NO: 226105 - DNA, 25 bp, Mus musculus
cagagagaaggcagattctcattgc

SEQ ID NO: 226106 - DNA, 25 bp, Mus musculus
cagagagaaggcttcgtgagcttcg

SEQ ID NO: 226107 - DNA, 25 bp, Mus musculus
cagagagaagggcccgagggctgta

SEQ ID NO: 226108 - DNA, 25 bp, Mus musculus
cagagagacaattgggttcatagtg

SEQ ID NO: 226109 - DNA, 25 bp, Mus musculus
cagagagacacagtgccctctcccc

SEQ ID NO: 226110 - DNA, 25 bp, Mus musculus
cagagagacagcagccttcccagtc

SEQ ID NO: 226111 - DNA, 25 bp, Mus musculus
cagagagacagcagggtccaccaac

SEQ ID NO: 226112 - DNA, 25 bp, Mus musculus
cagagagagccgaagccgaaagcgg

SEQ ID NO: 226113 - DNA, 25 bp, Mus musculus
cagagagagccgaatattaattaac

SEQ ID NO: 226114 - DNA, 25 bp, Mus musculus
cagagagataagaaggttgtgacaa

SEQ ID NO: 226115 - DNA, 25 bp, Mus musculus
cagagagatacgaaagggcgagagg

SEQ ID NO: 226116 - DNA, 25 bp, Mus musculus
cagagagatgactggtctggttcag

SEQ ID NO: 226117 - DNA, 25 bp, Mus musculus
cagagagatgagcatccagctcagc

SEQ ID NO: 226118 - DNA, 25 bp, Mus musculus
cagagagatgcaggtaacccctcta

SEQ ID NO: 226119 - DNA, 25 bp, Mus musculus
cagagagatgcagtatgacttctcc

SEQ ID NO: 226120 - DNA, 25 bp, Mus musculus
cagagagatgggtgtgattgctgcc

SEQ ID NO: 226121 - DNA, 25 bp, Mus musculus
cagagagcaaaacagaggcccagag

SEQ ID NO: 226122 - DNA, 25 bp, Mus musculus
cagagagcaacaggagcaccaggca

SEQ ID NO: 226123 - DNA, 25 bp, Mus musculus
cagagagcaaggtcgccgctgaaga

SEQ ID NO: 226124 - DNA, 25 bp, Mus musculus
cagagagcagatcttgagtgcacca

SEQ ID NO: 226125 - DNA, 25 bp, Mus musculus
cagagagcagattctgccctttcct

SEQ ID NO: 226126 - DNA, 25 bp, Mus musculus
cagagagcccaggcttacagtgatt

SEQ ID NO: 226127 - DNA, 25 bp, Mus musculus
cagagagccccggtgccaaagcctg

SEQ ID NO: 226128 - DNA, 25 bp, Mus musculus
cagagagctcaggtttggaggagac

SEQ ID NO: 226129 - DNA, 25 bp, Mus musculus
cagagagctctggcgcaacagcgtg

SEQ ID NO: 226130 - DNA, 25 bp, Mus musculus
cagagagctgacacgctggagatgg

SEQ ID NO: 226131 - DNA, 25 bp, Mus musculus
cagagagctgtcattgaggcggaaa

SEQ ID NO: 226132 - DNA, 25 bp, Mus musculus
cagagaggaagaaacttcaccctta

SEQ ID NO: 226133 - DNA, 25 bp, Mus musculus
cagagaggaagatgtttgagacaga

SEQ ID NO: 226134 - DNA, 25 bp, Mus musculus
cagagaggaagattacaacaaccct

SEQ ID NO: 226135 - DNA, 25 bp, Mus musculus
cagagaggagcttggctttgatctg

SEQ ID NO: 226136 - DNA, 25 bp, Mus musculus
cagagaggaggagacacggtctctc

SEQ ID NO: 226137 - DNA, 25 bp, Mus musculus
cagagaggagggccaaggaggctga

SEQ ID NO: 226138 - DNA, 25 bp, Mus musculus
cagagaggcagagacagggcagggc

SEQ ID NO: 226139 - DNA, 25 bp, Mus musculus
cagagaggccggagacagtataaca

SEQ ID NO: 226140 - DNA, 25 bp, Mus musculus
cagagaggcgtcccagccaagcggg

SEQ ID NO: 226141 - DNA, 25 bp, Mus musculus
cagagaggggagaccggtttccaag

SEQ ID NO: 226142 - DNA, 25 bp, Mus musculus
cagagagtaagaactgtgccaagtg

SEQ ID NO: 226143 - DNA, 25 bp, Mus musculus
cagagagtcaggaacgtggaagtga

SEQ ID NO: 226144 - DNA, 25 bp, Mus musculus
cagagagtcggcgtccctacagccg

SEQ ID NO: 226145 - DNA, 25 bp, Mus musculus
cagagagtcgggtctgagtgcccgg

SEQ ID NO: 226146 - DNA, 25 bp, Mus musculus
cagagagtgatgcatggagcagtgc

SEQ ID NO: 226147 - DNA, 25 bp, Mus musculus
cagagagttaggctgccaacagcta

SEQ ID NO: 226148 - DNA, 25 bp, Mus musculus
cagagagttgccggctgaatttgac

SEQ ID NO: 226149 - DNA, 25 bp, Mus musculus
cagagataagcagagtccagttcag

SEQ ID NO: 226150 - DNA, 25 bp, Mus musculus
cagagatacatcaggaagtggcaag

SEQ ID NO: 226151 - DNA, 25 bp, Mus musculus
cagagatacatcagggtcttggggc

SEQ ID NO: 226152 - DNA, 25 bp, Mus musculus
cagagatacccaggggccatactgt

SEQ ID NO: 226153 - DNA, 25 bp, Mus musculus
cagagatacttttggactgaccaag

SEQ ID NO: 226154 - DNA, 25 bp, Mus musculus
cagagatagagaaggtaaaggggaa

SEQ ID NO: 226155 - DNA, 25 bp, Mus musculus
cagagatagccgactgcagatgaca

SEQ ID NO: 226156 - DNA, 25 bp, Mus musculus
cagagatagccgggcatcagcagta

SEQ ID NO: 226157 - DNA, 25 bp, Mus musculus
cagagatcagaggatgcagcaccga

SEQ ID NO: 226158 - DNA, 25 bp, Mus musculus
cagagatcagatagtgccggcattg

SEQ ID NO: 226159 - DNA, 25 bp, Mus musculus
cagagatccaaggacaccacttcag

SEQ ID NO: 226160 - DNA, 25 bp, Mus musculus
cagagatccaaggttgaccacaagg

SEQ ID NO: 226161 - DNA, 25 bp, Mus musculus
cagagatcccccaggcccggctcta

SEQ ID NO: 226162 - DNA, 25 bp, Mus musculus
cagagatcctgaaaaatgtgggggt

SEQ ID NO: 226163 - DNA, 25 bp, Mus musculus
cagagatcctgaaaagtattgataa

SEQ ID NO: 226164 - DNA, 25 bp, Mus musculus
cagagatcggcaggatgactgactt

SEQ ID NO: 226165 - DNA, 25 bp, Mus musculus
cagagatcgggttctgcggggagtg

SEQ ID NO: 226166 - DNA, 25 bp, Mus musculus
cagagatctcggcacaacggtcgtc

SEQ ID NO: 226167 - DNA, 25 bp, Mus musculus
cagagatctcgggtgagcacctgcg

SEQ ID NO: 226168 - DNA, 25 bp, Mus musculus
cagagatgaagaccacatagcccac

SEQ ID NO: 226169 - DNA, 25 bp, Mus musculus
cagagatgacatcgggaggaatgct

SEQ ID NO: 226170 - DNA, 25 bp, Mus musculus
cagagatgatcaatggtcgtagtta

SEQ ID NO: 226171 - DNA, 25 bp, Mus musculus
cagagatgatcaattcgtagttatg

SEQ ID NO: 226172 - DNA, 25 bp, Mus musculus
cagagatggaatggataatcaagga

SEQ ID NO: 226173 - DNA, 25 bp, Mus musculus
cagagatggccaaaacaagagttca

SEQ ID NO: 226174 - DNA, 25 bp, Mus musculus
cagagatggctagcctatgtctcag

SEQ ID NO: 226175 - DNA, 25 bp, Mus musculus
cagagatggctaggtacaaatggat

SEQ ID NO: 226176 - DNA, 25 bp, Mus musculus
cagagatgggtcatggaactcatct

SEQ ID NO: 226177 - DNA, 25 bp, Mus musculus
cagagatggttctaggctttgatga

SEQ ID NO: 226178 - DNA, 25 bp, Mus musculus
cagagatgtcaagaaaaatcaggaa

SEQ ID NO: 226179 - DNA, 25 bp, Mus musculus
cagagatgtcaaggggagagacctt

SEQ ID NO: 226180 - DNA, 25 bp, Mus musculus
cagagattcaggttctcccctatgg

SEQ ID NO: 226181 - DNA, 25 bp, Mus musculus
cagagattgagaaggtcatagaaga

SEQ ID NO: 226182 - DNA, 25 bp, Mus musculus
cagagattgcccaggttcgcggcaa

SEQ ID NO: 226183 - DNA, 25 bp, Mus musculus
cagagatttgctggatctcatggag

SEQ ID NO: 226184 - DNA, 25 bp, Mus musculus
cagagatttgtctcaatggaaactt

SEQ ID NO: 226185 - DNA, 25 bp, Mus musculus
cagagattttgactttgtcttcggc

SEQ ID NO: 226186 - DNA, 25 bp, Mus musculus
cagagcaaaagactgggaacctacc

SEQ ID NO: 226187 - DNA, 25 bp, Mus musculus
cagagcaaaagggaagcagtgcttc

SEQ ID NO: 226188 - DNA, 25 bp, Mus musculus
cagagcaaagatttctgctggaccg

SEQ ID NO: 226189 - DNA, 25 bp, Mus musculus
cagagcaaaggggggctctactaca

SEQ ID NO: 226190 - DNA, 25 bp, Mus musculus
cagagcaaccggtgaaaaaagccaa

SEQ ID NO: 226191 - DNA, 25 bp, Mus musculus
cagagcaaccgtcaagtaaacaacc

SEQ ID NO: 226192 - DNA, 25 bp, Mus musculus
cagagcaaccgtttctatggcgtta

SEQ ID NO: 226193 - DNA, 25 bp, Mus musculus
cagagcaagaaggagagcgtggcaa

SEQ ID NO: 226194 - DNA, 25 bp, Mus musculus
cagagcaagaaggtcagtcaggaga

SEQ ID NO: 226195 - DNA, 25 bp, Mus musculus
cagagcaagcatcgctgccatgaag

SEQ ID NO: 226196 - DNA, 25 bp, Mus musculus
cagagcaagcctggctgttttgaca

SEQ ID NO: 226197 - DNA, 25 bp, Mus musculus
cagagcaagggcgattccccaaagg

SEQ ID NO: 226198 - DNA, 25 bp, Mus musculus
cagagcaaggtatggcgtgatcatt

SEQ ID NO: 226199 - DNA, 25 bp, Mus musculus
cagagcaatagactgatgatgcttc

SEQ ID NO: 226200 - DNA, 25 bp, Mus musculus
cagagcaatgagtccagatccgaaa

SEQ ID NO: 226201 - DNA, 25 bp, Mus musculus
cagagcaatgcaggggggcttggtg

SEQ ID NO: 226202 - DNA, 25 bp, Mus musculus
cagagcaatggcacggaatgctgcc

SEQ ID NO: 226203 - DNA, 25 bp, Mus musculus
cagagcacacagagccatgaggctg

SEQ ID NO: 226204 - DNA, 25 bp, Mus musculus
cagagcacagaaaggagcttgaagg

SEQ ID NO: 226205 - DNA, 25 bp, Mus musculus
cagagcacagaggcgccgagcgcgg

SEQ ID NO: 226206 - DNA, 25 bp, Mus musculus
cagagcacagatacctgactgtcag

SEQ ID NO: 226207 - DNA, 25 bp, Mus musculus
cagagcacaggctcagaaatcctgg

SEQ ID NO: 226208 - DNA, 25 bp, Mus musculus
cagagcacaggggcctggatcgtca

SEQ ID NO: 226209 - DNA, 25 bp, Mus musculus
cagagcacatgctgattttgggcat

SEQ ID NO: 226210 - DNA, 25 bp, Mus musculus
cagagcacccagaggtccatggctg

SEQ ID NO: 226211 - DNA, 25 bp, Mus musculus
cagagcacccaggcttccactgctg

SEQ ID NO: 226212 - DNA, 25 bp, Mus musculus
cagagcaccctgctgctgaataatg

SEQ ID NO: 226213 - DNA, 25 bp, Mus musculus
cagagcaccctggactacattgcag

SEQ ID NO: 226214 - DNA, 25 bp, Mus musculus
cagagcaccgggcaagagtccatcc

SEQ ID NO: 226215 - DNA, 25 bp, Mus musculus
cagagcaccggggactcctgagaca

SEQ ID NO: 226216 - DNA, 25 bp, Mus musculus
cagagcactagtgggactctgtaag

SEQ ID NO: 226217 - DNA, 25 bp, Mus musculus
cagagcactatgacccctcccagtc

SEQ ID NO: 226218 - DNA, 25 bp, Mus musculus
cagagcactgctagggctctgtgcc

SEQ ID NO: 226219 - DNA, 25 bp, Mus musculus
cagagcagagaggaggtggaccacc

SEQ ID NO: 226220 - DNA, 25 bp, Mus musculus
cagagcagaggaatgtctacaagga

SEQ ID NO: 226221 - DNA, 25 bp, Mus musculus
cagagcagatgggatgagccggcag

SEQ ID NO: 226222 - DNA, 25 bp, Mus musculus
cagagcagcagaaaattgtccagcg

SEQ ID NO: 226223 - DNA, 25 bp, Mus musculus
cagagcagcagaaactagacaccat

SEQ ID NO: 226224 - DNA, 25 bp, Mus musculus
cagagcagcagacaccatgtgcgac

SEQ ID NO: 226225 - DNA, 25 bp, Mus musculus
cagagcagcagactcctccctcccc

SEQ ID NO: 226226 - DNA, 25 bp, Mus musculus
cagagcagcaggaggatatggctcg

SEQ ID NO: 226227 - DNA, 25 bp, Mus musculus
cagagcagcagggccctgttctccg

SEQ ID NO: 226228 - DNA, 25 bp, Mus musculus
cagagcagcaggtttccaggcaaca

SEQ ID NO: 226229 - DNA, 25 bp, Mus musculus
cagagcagcctccggctggcttaac

SEQ ID NO: 226230 - DNA, 25 bp, Mus musculus
cagagcagcctccgggacccccgag

SEQ ID NO: 226231 - DNA, 25 bp, Mus musculus
cagagcagctacgagacgctctgtc

SEQ ID NO: 226232 - DNA, 25 bp, Mus musculus
cagagcagctactaagcgactctcg

SEQ ID NO: 226233 - DNA, 25 bp, Mus musculus
cagagcaggcgggactgtcctgtgc

SEQ ID NO: 226234 - DNA, 25 bp, Mus musculus
cagagcagtgagcagtgggagacat

SEQ ID NO: 226235 - DNA, 25 bp, Mus musculus
cagagcagtgaggataccgctattg

SEQ ID NO: 226236 - DNA, 25 bp, Mus musculus
cagagcagttaagctaccttaaggg

SEQ ID NO: 226237 - DNA, 25 bp, Mus musculus
cagagcatcacgaaatagatatgat

SEQ ID NO: 226238 - DNA, 25 bp, Mus musculus
cagagcatcacgccagtagaaatag

SEQ ID NO: 226239 - DNA, 25 bp, Mus musculus
cagagcatcagcaaggtactgccct

SEQ ID NO: 226240 - DNA, 25 bp, Mus musculus
cagagcatcccagaggaattcaagg

SEQ ID NO: 226241 - DNA, 25 bp, Mus musculus
cagagcatggggctctctttggaac

SEQ ID NO: 226242 - DNA, 25 bp, Mus musculus
cagagcatgggtcaggttttctact

SEQ ID NO: 226243 - DNA, 25 bp, Mus musculus
cagagcatggtctagtctcctgaga

SEQ ID NO: 226244 - DNA, 25 bp, Mus musculus
cagagcattctggctgcagcagtga

SEQ ID NO: 226245 - DNA, 25 bp, Mus musculus
cagagccaaaagattcttcagtttg

SEQ ID NO: 226246 - DNA, 25 bp, Mus musculus
cagagccaagcacttacgcctggtg

SEQ ID NO: 226247 - DNA, 25 bp, Mus musculus
cagagccacgaaggagattctggga

SEQ ID NO: 226248 - DNA, 25 bp, Mus musculus
cagagccacggtcaagatgctgaat

SEQ ID NO: 226249 - DNA, 25 bp, Mus musculus
cagagccagaagaccagtgaagtca

SEQ ID NO: 226250 - DNA, 25 bp, Mus musculus
cagagccaggccaaggcatactttg

SEQ ID NO: 226251 - DNA, 25 bp, Mus musculus
cagagccagggaagggcaatgcgag

SEQ ID NO: 226252 - DNA, 25 bp, Mus musculus
cagagccagtgagccctgcctagcc

SEQ ID NO: 226253 - DNA, 25 bp, Mus musculus
cagagccatagaggtggagtacatg

SEQ ID NO: 226254 - DNA, 25 bp, Mus musculus
cagagccatcacccgaaacaggcca

SEQ ID NO: 226255 - DNA, 25 bp, Mus musculus
cagagccatcaggtcctaatcaaag

SEQ ID NO: 226256 - DNA, 25 bp, Mus musculus
cagagccatctacttgcaccggaag

SEQ ID NO: 226257 - DNA, 25 bp, Mus musculus
cagagccatggacaaggaatatgtg

SEQ ID NO: 226258 - DNA, 25 bp, Mus musculus
cagagccatggggaagctctttgtg

SEQ ID NO: 226259 - DNA, 25 bp, Mus musculus
cagagccatgtagaaccaggcccaa

SEQ ID NO: 226260 - DNA, 25 bp, Mus musculus
cagagcccacttaaactccgaggtg

SEQ ID NO: 226261 - DNA, 25 bp, Mus musculus
cagagcccagacagagaagagccat

SEQ ID NO: 226262 - DNA, 25 bp, Mus musculus
cagagcccaggagcacctcaactat

SEQ ID NO: 226263 - DNA, 25 bp, Mus musculus
cagagcccaggtctgctgccttgct

SEQ ID NO: 226264 - DNA, 25 bp, Mus musculus
cagagcccagtctcagatctcggtg

SEQ ID NO: 226265 - DNA, 25 bp, Mus musculus
cagagcccattgatgtcacagctaa

SEQ ID NO: 226266 - DNA, 25 bp, Mus musculus
cagagcccgcggcagatgaggaaac

SEQ ID NO: 226267 - DNA, 25 bp, Mus musculus
cagagcccgcggcagggaatgattt

SEQ ID NO: 226268 - DNA, 25 bp, Mus musculus
cagagcccggcagatgcccccacga

SEQ ID NO: 226269 - DNA, 25 bp, Mus musculus
cagagcccggcagtcaggagtggca

SEQ ID NO: 226270 - DNA, 25 bp, Mus musculus
cagagccctgggcccttcctgtccc

SEQ ID NO: 226271 - DNA, 25 bp, Mus musculus
cagagccctttggatccagccatat

SEQ ID NO: 226272 - DNA, 25 bp, Mus musculus
cagagccgacagagcaagtgtttgc

SEQ ID NO: 226273 - DNA, 25 bp, Mus musculus
cagagccgacagagcttcgtccaca

SEQ ID NO: 226274 - DNA, 25 bp, Mus musculus
cagagcctactgaagatcgacttgg

SEQ ID NO: 226275 - DNA, 25 bp, Mus musculus
cagagcctactgaaggcctcctcaa

SEQ ID NO: 226276 - DNA, 25 bp, Mus musculus
cagagcctcagaattgctcagccac

SEQ ID NO: 226277 - DNA, 25 bp, Mus musculus
cagagcctcagggggcctgtggcag

SEQ ID NO: 226278 - DNA, 25 bp, Mus musculus
cagagcctccggggaccttcctggt

SEQ ID NO: 226279 - DNA, 25 bp, Mus musculus
cagagcctccgggggtgtctctttg

SEQ ID NO: 226280 - DNA, 25 bp, Mus musculus
cagagcctctaggccctaggaccat

SEQ ID NO: 226281 - DNA, 25 bp, Mus musculus
cagagcctctcagagataaaatcaa

SEQ ID NO: 226282 - DNA, 25 bp, Mus musculus
cagagcctgagatctggtggctctg

SEQ ID NO: 226283 - DNA, 25 bp, Mus musculus
cagagcctgaggcccaggatgggtg

SEQ ID NO: 226284 - DNA, 25 bp, Mus musculus
cagagcctgatgaatgaggtgtgta

SEQ ID NO: 226285 - DNA, 25 bp, Mus musculus
cagagcctggatttatcgaattatc

SEQ ID NO: 226286 - DNA, 25 bp, Mus musculus
cagagcctggctggcacgttttgtg

SEQ ID NO: 226287 - DNA, 25 bp, Mus musculus
cagagcctggtgctgatgggaacca

SEQ ID NO: 226288 - DNA, 25 bp, Mus musculus
cagagcctgtgagaaaactaactgc

SEQ ID NO: 226289 - DNA, 25 bp, Mus musculus
cagagcctgtgagcttcaaactgga

SEQ ID NO: 226290 - DNA, 25 bp, Mus musculus
cagagccttcaagaagttgctctgg

SEQ ID NO: 226291 - DNA, 25 bp, Mus musculus
cagagccttctcctgaaacactgtg

SEQ ID NO: 226292 - DNA, 25 bp, Mus musculus
cagagccttggagagtctccaagga

SEQ ID NO: 226293 - DNA, 25 bp, Mus musculus
cagagcgaagacgggagcgggagca

SEQ ID NO: 226294 - DNA, 25 bp, Mus musculus
cagagcgacaggctccgtgaagact

SEQ ID NO: 226295 - DNA, 25 bp, Mus musculus
cagagcgaggggtccgtctcccagg

SEQ ID NO: 226296 - DNA, 25 bp, Mus musculus
cagagcgaggtaaagaaatccaccg

SEQ ID NO: 226297 - DNA, 25 bp, Mus musculus
cagagcgatgtctggtccttcgggg

SEQ ID NO: 226298 - DNA, 25 bp, Mus musculus
cagagcgatgtgtgatcttttggag

SEQ ID NO: 226299 - DNA, 25 bp, Mus musculus
cagagcgatgtgtggtcttttggag

SEQ ID NO: 226300 - DNA, 25 bp, Mus musculus
cagagcgcattaggcggtgggtctc

SEQ ID NO: 226301 - DNA, 25 bp, Mus musculus
cagagcgcattagggccaatgaggc

SEQ ID NO: 226302 - DNA, 25 bp, Mus musculus
cagagcgcctcatcgggggcacaga

SEQ ID NO: 226303 - DNA, 25 bp, Mus musculus
cagagcgggcgatactgcagcctct

SEQ ID NO: 226304 - DNA, 25 bp, Mus musculus
cagagcgtcaaggtgtgggataaga

SEQ ID NO: 226305 - DNA, 25 bp, Mus musculus
cagagcgtctcatgatggagagaag

SEQ ID NO: 226306 - DNA, 25 bp, Mus musculus
cagagcgtcttggggggtgtgaaga

SEQ ID NO: 226307 - DNA, 25 bp, Mus musculus
cagagcgtgcgccaggtgtcttctg

SEQ ID NO: 226308 - DNA, 25 bp, Mus musculus
cagagcgtttggaacacctttccca

SEQ ID NO: 226309 - DNA, 25 bp, Mus musculus
cagagctaaacaagaatttaaagag

SEQ ID NO: 226310 - DNA, 25 bp, Mus musculus
cagagctaaagggtttggatccagc

SEQ ID NO: 226311 - DNA, 25 bp, Mus musculus
cagagctaaggttcccgaggagact

SEQ ID NO: 226312 - DNA, 25 bp, Mus musculus
cagagctacagaatcatacgatgac

SEQ ID NO: 226313 - DNA, 25 bp, Mus musculus
cagagctacagtggcacctgacaaa

SEQ ID NO: 226314 - DNA, 25 bp, Mus musculus
cagagctagaaaagaaagtgagttc

SEQ ID NO: 226315 - DNA, 25 bp, Mus musculus
cagagctagaggatgtggagaaaga

SEQ ID NO: 226316 - DNA, 25 bp, Mus musculus
cagagctagaggtcacctggaggaa

SEQ ID NO: 226317 - DNA, 25 bp, Mus musculus
cagagctaggaagaggtcagccatg

SEQ ID NO: 226318 - DNA, 25 bp, Mus musculus
cagagctattgcacggatggtgaac

SEQ ID NO: 226319 - DNA, 25 bp, Mus musculus
cagagctcaaggagcgaatctgcat

SEQ ID NO: 226320 - DNA, 25 bp, Mus musculus
cagagctcaaggctaaccctttcaa

SEQ ID NO: 226321 - DNA, 25 bp, Mus musculus
cagagctcactcaaggtaatagcgc

SEQ ID NO: 226322 - DNA, 25 bp, Mus musculus
cagagctcagaggagaattctgtgg

SEQ ID NO: 226323 - DNA, 25 bp, Mus musculus
cagagctcagagggtgctctgtgtg

SEQ ID NO: 226324 - DNA, 25 bp, Mus musculus
cagagctcaggatttctggtaggtc

SEQ ID NO: 226325 - DNA, 25 bp, Mus musculus
cagagctcccagacttcttcgaggg

SEQ ID NO: 226326 - DNA, 25 bp, Mus musculus
cagagctccgggctcaagtccaccc

SEQ ID NO: 226327 - DNA, 25 bp, Mus musculus
cagagctcgggaggtacagtggtcc

SEQ ID NO: 226328 - DNA, 25 bp, Mus musculus
cagagctcgggaggttcccgtgaga

SEQ ID NO: 226329 - DNA, 25 bp, Mus musculus
cagagctctcgtgacagccttgaga

SEQ ID NO: 226330 - DNA, 25 bp, Mus musculus
cagagctctttgatgacttgggtgt

SEQ ID NO: 226331 - DNA, 25 bp, Mus musculus
cagagctgaagaaggttatgagaac

SEQ ID NO: 226332 - DNA, 25 bp, Mus musculus
cagagctgaagagccagatgaagtc

SEQ ID NO: 226333 - DNA, 25 bp, Mus musculus
cagagctgaagccagcaagcctgcc

SEQ ID NO: 226334 - DNA, 25 bp, Mus musculus
cagagctgaaggctattctagactc

SEQ ID NO: 226335 - DNA, 25 bp, Mus musculus
cagagctgacccaagccattttgag

SEQ ID NO: 226336 - DNA, 25 bp, Mus musculus
cagagctgagatactagtgactgct

SEQ ID NO: 226337 - DNA, 25 bp, Mus musculus
cagagctgagtgcaagtgtcctgca

SEQ ID NO: 226338 - DNA, 25 bp, Mus musculus
cagagctgcccagagacccttcgga

SEQ ID NO: 226339 - DNA, 25 bp, Mus musculus
cagagctgccccggttcagaaactt

SEQ ID NO: 226340 - DNA, 25 bp, Mus musculus
cagagctgctctagcaccacatctg

SEQ ID NO: 226341 - DNA, 25 bp, Mus musculus
cagagctggaaccctgccacatgga

SEQ ID NO: 226342 - DNA, 25 bp, Mus musculus
cagagctggacacggctgtccaggg

SEQ ID NO: 226343 - DNA, 25 bp, Mus musculus
cagagctggagagttgaagcagaag

SEQ ID NO: 226344 - DNA, 25 bp, Mus musculus
cagagctggagcagaggagataatc

SEQ ID NO: 226345 - DNA, 25 bp, Mus musculus
cagagctggagcagaggagatcatc

SEQ ID NO: 226346 - DNA, 25 bp, Mus musculus
cagagctgggtgcagaaactggaaa

SEQ ID NO: 226347 - DNA, 25 bp, Mus musculus
cagagctggtacagtatgctgtgtc

SEQ ID NO: 226348 - DNA, 25 bp, Mus musculus
cagagctgtaaggccgtggcagagc

SEQ ID NO: 226349 - DNA, 25 bp, Mus musculus
cagagctgtcagtgacccaccctct

SEQ ID NO: 226350 - DNA, 25 bp, Mus musculus
cagagcttaagccaatccatggcca

SEQ ID NO: 226351 - DNA, 25 bp, Mus musculus
cagagcttcaggaggaatttggcta

SEQ ID NO: 226352 - DNA, 25 bp, Mus musculus
cagagcttcccaggtctctttgagc

SEQ ID NO: 226353 - DNA, 25 bp, Mus musculus
cagagcttcctgcagccaggtggga

SEQ ID NO: 226354 - DNA, 25 bp, Mus musculus
cagagcttcgagcttccattaagga

SEQ ID NO: 226355 - DNA, 25 bp, Mus musculus
cagagcttctcagtagtgatcaagc

SEQ ID NO: 226356 - DNA, 25 bp, Mus musculus
cagagcttctcggtgtggatcatat

SEQ ID NO: 226357 - DNA, 25 bp, Mus musculus
cagaggaaaaagttgccaggaaaca

SEQ ID NO: 226358 - DNA, 25 bp, Mus musculus
cagaggaaaagattgataagtatct

SEQ ID NO: 226359 - DNA, 25 bp, Mus musculus
cagaggaaatccaacagcttcccct

SEQ ID NO: 226360 - DNA, 25 bp, Mus musculus
cagaggaaattacacctgctcctga

SEQ ID NO: 226361 - DNA, 25 bp, Mus musculus
cagaggaaggaagaggtttatggga

SEQ ID NO: 226362 - DNA, 25 bp, Mus musculus
cagaggaagtagacaatcctcctga

SEQ ID NO: 226363 - DNA, 25 bp, Mus musculus
cagaggaatggagaacatcccaacc

SEQ ID NO: 226364 - DNA, 25 bp, Mus musculus
cagaggaatggaggtggacattgca

SEQ ID NO: 226365 - DNA, 25 bp, Mus musculus
cagaggaatggcgtactcagttcgt

SEQ ID NO: 226366 - DNA, 25 bp, Mus musculus
cagaggaattttatgctcgacgcca

SEQ ID NO: 226367 - DNA, 25 bp, Mus musculus
cagaggacaagaaggcacatgcaac

SEQ ID NO: 226368 - DNA, 25 bp, Mus musculus
cagaggacaggctcacaactcagtg

SEQ ID NO: 226369 - DNA, 25 bp, Mus musculus
cagaggaccaaggaagccgtgaagg

SEQ ID NO: 226370 - DNA, 25 bp, Mus musculus
cagaggacccacagcgacccatacg

SEQ ID NO: 226371 - DNA, 25 bp, Mus musculus
cagaggaccccgggttccagtgaca

SEQ ID NO: 226372 - DNA, 25 bp, Mus musculus
cagaggactaacactgtgtccgtgc

SEQ ID NO: 226373 - DNA, 25 bp, Mus musculus
cagaggactgggccccacaggatcg

SEQ ID NO: 226374 - DNA, 25 bp, Mus musculus
cagaggactgtatgaacgaggctct

SEQ ID NO: 226375 - DNA, 25 bp, Mus musculus
cagaggagaaagagatgaaaccggc

SEQ ID NO: 226376 - DNA, 25 bp, Mus musculus
cagaggagaaattgtgaaaatgtcc

SEQ ID NO: 226377 - DNA, 25 bp, Mus musculus
cagaggagaacagtgccaggtcacc

SEQ ID NO: 226378 - DNA, 25 bp, Mus musculus
cagaggagaacgcggtgtgtgagtc

SEQ ID NO: 226379 - DNA, 25 bp, Mus musculus
cagaggagacgaaacagcttggatt

SEQ ID NO: 226380 - DNA, 25 bp, Mus musculus
cagaggagaggctggtgcacaaggt

SEQ ID NO: 226381 - DNA, 25 bp, Mus musculus
cagaggagaggtggtgaaggcattt

SEQ ID NO: 226382 - DNA, 25 bp, Mus musculus
cagaggagaggtgtgaaggcatttg

SEQ ID NO: 226383 - DNA, 25 bp, Mus musculus
cagaggagatgggtggtggaagata

SEQ ID NO: 226384 - DNA, 25 bp, Mus musculus
cagaggagcaacagcggcaaccttt

SEQ ID NO: 226385 - DNA, 25 bp, Mus musculus
cagaggagcaagatatctgttgctt

SEQ ID NO: 226386 - DNA, 25 bp, Mus musculus
cagaggagcagtgaaatatttcagc

SEQ ID NO: 226387 - DNA, 25 bp, Mus musculus
cagaggagcagtgaggtaatgacag

SEQ ID NO: 226388 - DNA, 25 bp, Mus musculus
cagaggagcctcgagcatttagctc

SEQ ID NO: 226389 - DNA, 25 bp, Mus musculus
cagaggagcctggccccttcatggc

SEQ ID NO: 226390 - DNA, 25 bp, Mus musculus
cagaggaggacaaagaaatggtcct

SEQ ID NO: 226391 - DNA, 25 bp, Mus musculus
cagaggaggagatacttctgacact

SEQ ID NO: 226392 - DNA, 25 bp, Mus musculus
cagaggaggagggaaaaagagagag

SEQ ID NO: 226393 - DNA, 25 bp, Mus musculus
cagaggaggaggtcacgctcacgct

SEQ ID NO: 226394 - DNA, 25 bp, Mus musculus
cagaggaggagtattccaccaaaga

SEQ ID NO: 226395 - DNA, 25 bp, Mus musculus
cagaggagggcacagcatttgacat

SEQ ID NO: 226396 - DNA, 25 bp, Mus musculus
cagaggagggctcagatctggagct

SEQ ID NO: 226397 - DNA, 25 bp, Mus musculus
cagaggagtgtgaggaggtaaatga

SEQ ID NO: 226398 - DNA, 25 bp, Mus musculus
cagaggagtgtgagggaggagatag

SEQ ID NO: 226399 - DNA, 25 bp, Mus musculus
cagaggataagtactctcagaagga

SEQ ID NO: 226400 - DNA, 25 bp, Mus musculus
cagaggatcacaagctgaagattcc

SEQ ID NO: 226401 - DNA, 25 bp, Mus musculus
cagaggatcatcagtttgttttctt

SEQ ID NO: 226402 - DNA, 25 bp, Mus musculus
cagaggatccagcaaccagacctca

SEQ ID NO: 226403 - DNA, 25 bp, Mus musculus
cagaggatccaggagctcgaacagt

SEQ ID NO: 226404 - DNA, 25 bp, Mus musculus
cagaggatgaagtgaaacgcttcgt

SEQ ID NO: 226405 - DNA, 25 bp, Mus musculus
cagaggatggctccccttccaatga

SEQ ID NO: 226406 - DNA, 25 bp, Mus musculus
cagaggatggctgttttaaaatcag

SEQ ID NO: 226407 - DNA, 25 bp, Mus musculus
cagaggattcccaagccatgtattc

SEQ ID NO: 226408 - DNA, 25 bp, Mus musculus
cagaggcaagacatgtaccagtgct

SEQ ID NO: 226409 - DNA, 25 bp, Mus musculus
cagaggcaagctgagtcaaagcagc

SEQ ID NO: 226410 - DNA, 25 bp, Mus musculus
cagaggcacagagaaagaatcatag

SEQ ID NO: 226411 - DNA, 25 bp, Mus musculus
cagaggcacagagatcaaaggcaca

SEQ ID NO: 226412 - DNA, 25 bp, Mus musculus
cagaggcaccgcgatgtgctggctg

SEQ ID NO: 226413 - DNA, 25 bp, Mus musculus
cagaggcaccgcggaccgtctgggc

SEQ ID NO: 226414 - DNA, 25 bp, Mus musculus
cagaggcagaagaacctgtgctggc

SEQ ID NO: 226415 - DNA, 25 bp, Mus musculus
cagaggcagagcaggtgacggtgtg

SEQ ID NO: 226416 - DNA, 25 bp, Mus musculus
cagaggcagataaagataatggagg

SEQ ID NO: 226417 - DNA, 25 bp, Mus musculus
cagaggcagcagagaaccatgtgtg

SEQ ID NO: 226418 - DNA, 25 bp, Mus musculus
cagaggccagaagacaccagtgcaa

SEQ ID NO: 226419 - DNA, 25 bp, Mus musculus
cagaggccagagctattaagaatgg

SEQ ID NO: 226420 - DNA, 25 bp, Mus musculus
cagaggccagatgagctcctcttgc

SEQ ID NO: 226421 - DNA, 25 bp, Mus musculus
cagaggccaggaccatccttgctgc

SEQ ID NO: 226422 - DNA, 25 bp, Mus musculus
cagaggcccaggcctctctttctga

SEQ ID NO: 226423 - DNA, 25 bp, Mus musculus
cagaggccgaagcccccagttgtac

SEQ ID NO: 226424 - DNA, 25 bp, Mus musculus
cagaggccgtgcggagctcttggat

SEQ ID NO: 226425 - DNA, 25 bp, Mus musculus
cagaggcctgcctcaaaatgcagcc

SEQ ID NO: 226426 - DNA, 25 bp, Mus musculus
cagaggccttcagccacatcccaga

SEQ ID NO: 226427 - DNA, 25 bp, Mus musculus
cagaggccttcagccggtttcaccg

SEQ ID NO: 226428 - DNA, 25 bp, Mus musculus
cagaggcgatgctttttaaattggc

SEQ ID NO: 226429 - DNA, 25 bp, Mus musculus
cagaggcgcagcccgggtgcaatta

SEQ ID NO: 226430 - DNA, 25 bp, Mus musculus
cagaggcggacccaccctcagcgcc

SEQ ID NO: 226431 - DNA, 25 bp, Mus musculus
cagaggcggcgccacgagctggtga

SEQ ID NO: 226432 - DNA, 25 bp, Mus musculus
cagaggcgtaacgtgatgtcctctt

SEQ ID NO: 226433 - DNA, 25 bp, Mus musculus
cagaggcgtctaaagccattgaaaa

SEQ ID NO: 226434 - DNA, 25 bp, Mus musculus
cagaggcgtctaaagccgccctcac

SEQ ID NO: 226435 - DNA, 25 bp, Mus musculus
cagaggcgtgcagatccaagcaagc

SEQ ID NO: 226436 - DNA, 25 bp, Mus musculus
cagaggctagtgggtcatcttggaa

SEQ ID NO: 226437 - DNA, 25 bp, Mus musculus
cagaggctagtggttacttacacat

SEQ ID NO: 226438 - DNA, 25 bp, Mus musculus
cagaggctagtggttacttacagtt

SEQ ID NO: 226439 - DNA, 25 bp, Mus musculus
cagaggctatggaattggaagcctg

SEQ ID NO: 226440 - DNA, 25 bp, Mus musculus
cagaggctcagggtccggaccgctg

SEQ ID NO: 226441 - DNA, 25 bp, Mus musculus
cagaggctcctgaggaagaagctga

SEQ ID NO: 226442 - DNA, 25 bp, Mus musculus
cagaggctctgcagactgcacagaa

SEQ ID NO: 226443 - DNA, 25 bp, Mus musculus
cagaggctctgcagcatctcagctg

SEQ ID NO: 226444 - DNA, 25 bp, Mus musculus
cagaggctctgcagcctgaagaaca

SEQ ID NO: 226445 - DNA, 25 bp, Mus musculus
cagaggctgaatcagctcaaatcta

SEQ ID NO: 226446 - DNA, 25 bp, Mus musculus
cagaggctgacaaggctacagcgga

SEQ ID NO: 226447 - DNA, 25 bp, Mus musculus
cagaggctgacaggcggaacttgcc

SEQ ID NO: 226448 - DNA, 25 bp, Mus musculus
cagaggctgactgggtttaccagcc

SEQ ID NO: 226449 - DNA, 25 bp, Mus musculus
cagaggctgagaaaataatgttgag

SEQ ID NO: 226450 - DNA, 25 bp, Mus musculus
cagaggctgaggacaaatgagaagc

SEQ ID NO: 226451 - DNA, 25 bp, Mus musculus
cagaggctgtgggtctgcagctgtg

SEQ ID NO: 226452 - DNA, 25 bp, Mus musculus
cagaggcttccagatgggaaccagg

SEQ ID NO: 226453 - DNA, 25 bp, Mus musculus
cagaggcttccaggtcagaagcctt

SEQ ID NO: 226454 - DNA, 25 bp, Mus musculus
cagagggaaaaatgccagatctcta

SEQ ID NO: 226455 - DNA, 25 bp, Mus musculus
cagagggaactggtggaaactgaag

SEQ ID NO: 226456 - DNA, 25 bp, Mus musculus
cagagggaaggcctggccttgatga

SEQ ID NO: 226457 - DNA, 25 bp, Mus musculus
cagagggaaggtgaccaaccacttg

SEQ ID NO: 226458 - DNA, 25 bp, Mus musculus
cagagggagcaggaacctgtcacag

SEQ ID NO: 226459 - DNA, 25 bp, Mus musculus
cagagggaggaccagcatttaagaa

SEQ ID NO: 226460 - DNA, 25 bp, Mus musculus
cagagggaggaccaggagggcactc

SEQ ID NO: 226461 - DNA, 25 bp, Mus musculus
cagagggatcggcattgcctgcagg

SEQ ID NO: 226462 - DNA, 25 bp, Mus musculus
cagagggattcagcacccggagcgt

SEQ ID NO: 226463 - DNA, 25 bp, Mus musculus
cagagggattcaggggttccagtgt

SEQ ID NO: 226464 - DNA, 25 bp, Mus musculus
cagagggcattcaaagggatgggat

SEQ ID NO: 226465 - DNA, 25 bp, Mus musculus
cagagggcattgacctagagactga

SEQ ID NO: 226466 - DNA, 25 bp, Mus musculus
cagagggctagatgtggaagatgtg

SEQ ID NO: 226467 - DNA, 25 bp, Mus musculus
cagagggctgaagagaatatccggt

SEQ ID NO: 226468 - DNA, 25 bp, Mus musculus
cagagggctgaagagtgatgacatt

SEQ ID NO: 226469 - DNA, 25 bp, Mus musculus
cagagggctggccgcattggtggag

SEQ ID NO: 226470 - DNA, 25 bp, Mus musculus
cagagggctggccggattggtggag

SEQ ID NO: 226471 - DNA, 25 bp, Mus musculus
cagagggcttccaaaccctgctcac

SEQ ID NO: 226472 - DNA, 25 bp, Mus musculus
cagagggcttccaaagggtcctctg

SEQ ID NO: 226473 - DNA, 25 bp, Mus musculus
cagaggggcaggagctccgggtcat

SEQ ID NO: 226474 - DNA, 25 bp, Mus musculus
cagaggggccggggcctgtgcaggt

SEQ ID NO: 226475 - DNA, 25 bp, Mus musculus
cagagggggaggaagaaattgtcac

SEQ ID NO: 226476 - DNA, 25 bp, Mus musculus
cagagggtaaggatcctgtttgaag

SEQ ID NO: 226477 - DNA, 25 bp, Mus musculus
cagagggtcagagagatggcacata

SEQ ID NO: 226478 - DNA, 25 bp, Mus musculus
cagagggtcagttccaggaagacag

SEQ ID NO: 226479 - DNA, 25 bp, Mus musculus
cagagggtccgagattgtctaaagc

SEQ ID NO: 226480 - DNA, 25 bp, Mus musculus
cagagggtcgaatcaacacctttgt

SEQ ID NO: 226481 - DNA, 25 bp, Mus musculus
cagaggtaaacagaaagaatttact

SEQ ID NO: 226482 - DNA, 25 bp, Mus musculus
cagaggtaggaagatgaggacctag

SEQ ID NO: 226483 - DNA, 25 bp, Mus musculus
cagaggtccagacgtcgcctcatct

SEQ ID NO: 226484 - DNA, 25 bp, Mus musculus
cagaggtcggcctcgatgtggaggc

SEQ ID NO: 226485 - DNA, 25 bp, Mus musculus
cagaggtcggcctcgcaatacttcg

SEQ ID NO: 226486 - DNA, 25 bp, Mus musculus
cagaggtcttccagatcacagacct

SEQ ID NO: 226487 - DNA, 25 bp, Mus musculus
cagaggtgaagggaagacaaaggtc

SEQ ID NO: 226488 - DNA, 25 bp, Mus musculus
cagaggtgacagatcccacaacgtc

SEQ ID NO: 226489 - DNA, 25 bp, Mus musculus
cagaggtgagcacctgaagatggaa

SEQ ID NO: 226490 - DNA, 25 bp, Mus musculus
cagaggtgcagaaggtttttcaaga

SEQ ID NO: 226491 - DNA, 25 bp, Mus musculus
cagaggtgccaggtatgcaaagtgc

SEQ ID NO: 226492 - DNA, 25 bp, Mus musculus
cagaggtgccaggtctgcaaagtgc

SEQ ID NO: 226493 - DNA, 25 bp, Mus musculus
cagaggtgccgagtaacttgtcgta

SEQ ID NO: 226494 - DNA, 25 bp, Mus musculus
cagaggtgccgcaccatggccagcc

SEQ ID NO: 226495 - DNA, 25 bp, Mus musculus
cagaggtgctgcccgagcacgcatg

SEQ ID NO: 226496 - DNA, 25 bp, Mus musculus
cagaggtgctgcccggaataacaga

SEQ ID NO: 226497 - DNA, 25 bp, Mus musculus
cagaggtggtaaaagagaagtccac

SEQ ID NO: 226498 - DNA, 25 bp, Mus musculus
cagaggtggtcagtgctcaagaacc

SEQ ID NO: 226499 - DNA, 25 bp, Mus musculus
cagaggtgtcccaggaagtcacccg

SEQ ID NO: 226500 - DNA, 25 bp, Mus musculus
cagaggtgtggacacgttggtcaga

SEQ ID NO: 226501 - DNA, 25 bp, Mus musculus
cagaggttaaagataacagtggaat

SEQ ID NO: 226502 - DNA, 25 bp, Mus musculus
cagaggttcagaagggccagctgac

SEQ ID NO: 226503 - DNA, 25 bp, Mus musculus
cagaggttccccagcagagatgaac

SEQ ID NO: 226504 - DNA, 25 bp, Mus musculus
cagaggttccccagtcaatcgcagg

SEQ ID NO: 226505 - DNA, 25 bp, Mus musculus
cagaggttgagaaaggaactcaaca

SEQ ID NO: 226506 - DNA, 25 bp, Mus musculus
cagaggttgagacagcaacggtgga

SEQ ID NO: 226507 - DNA, 25 bp, Mus musculus
cagaggtttcacagagatgctgatg

SEQ ID NO: 226508 - DNA, 25 bp, Mus musculus
cagaggtttgagatggaagctctat

SEQ ID NO: 226509 - DNA, 25 bp, Mus musculus
cagagtaaaagtgaaatgactgttc

SEQ ID NO: 226510 - DNA, 25 bp, Mus musculus
cagagtaatgctccaagtatgttag

SEQ ID NO: 226511 - DNA, 25 bp, Mus musculus
cagagtacaaagctcccaggaggca

SEQ ID NO: 226512 - DNA, 25 bp, Mus musculus
cagagtacaaaggcgtggtttctgt

SEQ ID NO: 226513 - DNA, 25 bp, Mus musculus
cagagtacaaggtggtaaatctgta

SEQ ID NO: 226514 - DNA, 25 bp, Mus musculus
cagagtacagaggtccctcggttgg

SEQ ID NO: 226515 - DNA, 25 bp, Mus musculus
cagagtacaggtggagtttcgatga

SEQ ID NO: 226516 - DNA, 25 bp, Mus musculus
cagagtaccactcattcggcgacgg

SEQ ID NO: 226517 - DNA, 25 bp, Mus musculus
cagagtacgggcgtcctagtgtgtc

SEQ ID NO: 226518 - DNA, 25 bp, Mus musculus
cagagtactgcagaaatatgccgag

SEQ ID NO: 226519 - DNA, 25 bp, Mus musculus
cagagtacttgggaatcatgaccaa

SEQ ID NO: 226520 - DNA, 25 bp, Mus musculus
cagagtacttgggagctaggagacc

SEQ ID NO: 226521 - DNA, 25 bp, Mus musculus
cagagtagctatggacgtggaggac

SEQ ID NO: 226522 - DNA, 25 bp, Mus musculus
cagagtaggaggtggtgcccatggt

SEQ ID NO: 226523 - DNA, 25 bp, Mus musculus
cagagtatacaggatcccaaactgt

SEQ ID NO: 226524 - DNA, 25 bp, Mus musculus
cagagtatacaggtctgtgagtttc

SEQ ID NO: 226525 - DNA, 25 bp, Mus musculus
cagagtatagataaggtgaagaaac

SEQ ID NO: 226526 - DNA, 25 bp, Mus musculus
cagagtatagataagtgtcatattt

SEQ ID NO: 226527 - DNA, 25 bp, Mus musculus
cagagtatctaagagtgcttggctg

SEQ ID NO: 226528 - DNA, 25 bp, Mus musculus
cagagtatctttaccttctacttcc

SEQ ID NO: 226529 - DNA, 25 bp, Mus musculus
cagagtatgagaaaataaaggactc

SEQ ID NO: 226530 - DNA, 25 bp, Mus musculus
cagagtatgagaggctgttatgttt

SEQ ID NO: 226531 - DNA, 25 bp, Mus musculus
cagagtatgaggaagaagattccag

SEQ ID NO: 226532 - DNA, 25 bp, Mus musculus
cagagtatgagtttctcctcatcta

SEQ ID NO: 226533 - DNA, 25 bp, Mus musculus
cagagtatgtgtcttcaccctgctg

SEQ ID NO: 226534 - DNA, 25 bp, Mus musculus
cagagtattaaaaatgatacatcca

SEQ ID NO: 226535 - DNA, 25 bp, Mus musculus
cagagtcaaaacagcagtgacagca

SEQ ID NO: 226536 - DNA, 25 bp, Mus musculus
cagagtcaaagatgttgatcctgtc

SEQ ID NO: 226537 - DNA, 25 bp, Mus musculus
cagagtcaaagccagggtctcttgt

SEQ ID NO: 226538 - DNA, 25 bp, Mus musculus
cagagtcaaagccaggtgccagctg

SEQ ID NO: 226539 - DNA, 25 bp, Mus musculus
cagagtcaccaaatgaccccaaggg

SEQ ID NO: 226540 - DNA, 25 bp, Mus musculus
cagagtcagaaaagttgtcctctct

SEQ ID NO: 226541 - DNA, 25 bp, Mus musculus
cagagtcaggagcgcagggcagaga

SEQ ID NO: 226542 - DNA, 25 bp, Mus musculus
cagagtcagggaccaggactgagtc

SEQ ID NO: 226543 - DNA, 25 bp, Mus musculus
cagagtcatgcccagcttcccatca

SEQ ID NO: 226544 - DNA, 25 bp, Mus musculus
cagagtcatgcccagggagtccccc

SEQ ID NO: 226545 - DNA, 25 bp, Mus musculus
cagagtcattgattaggttatacct

SEQ ID NO: 226546 - DNA, 25 bp, Mus musculus
cagagtccaccgatttactaaatta

SEQ ID NO: 226547 - DNA, 25 bp, Mus musculus
cagagtccaccgttatatttcagag

SEQ ID NO: 226548 - DNA, 25 bp, Mus musculus
cagagtccatgagtttacaggaaca

SEQ ID NO: 226549 - DNA, 25 bp, Mus musculus
cagagtccgggagactcgatctgcc

SEQ ID NO: 226550 - DNA, 25 bp, Mus musculus
cagagtccggggaaaacagtaagaa

SEQ ID NO: 226551 - DNA, 25 bp, Mus musculus
cagagtcggagtcttattttagtca

SEQ ID NO: 226552 - DNA, 25 bp, Mus musculus
cagagtctagccaccaagatccagg

SEQ ID NO: 226553 - DNA, 25 bp, Mus musculus
cagagtctgtactcccacaatctaa

SEQ ID NO: 226554 - DNA, 25 bp, Mus musculus
cagagtctgtgcggtgaccacacac

SEQ ID NO: 226555 - DNA, 25 bp, Mus musculus
cagagtgaaaacacttcagctaatg

SEQ ID NO: 226556 - DNA, 25 bp, Mus musculus
cagagtgaagaagaactcctacctg

SEQ ID NO: 226557 - DNA, 25 bp, Mus musculus
cagagtgaagaagcgagatcatcag

SEQ ID NO: 226558 - DNA, 25 bp, Mus musculus
cagagtgaattagatataatgttta

SEQ ID NO: 226559 - DNA, 25 bp, Mus musculus
cagagtgacatggaagctatggata

SEQ ID NO: 226560 - DNA, 25 bp, Mus musculus
cagagtgacatggccgcagccacgc

SEQ ID NO: 226561 - DNA, 25 bp, Mus musculus
cagagtgacatgtgcgaccaagacc

SEQ ID NO: 226562 - DNA, 25 bp, Mus musculus
cagagtgactgtatacgacatttca

SEQ ID NO: 226563 - DNA, 25 bp, Mus musculus
cagagtgagaaggagttgatgtgcc

SEQ ID NO: 226564 - DNA, 25 bp, Mus musculus
cagagtgagatcatcatccaagtct

SEQ ID NO: 226565 - DNA, 25 bp, Mus musculus
cagagtgagcagccccacagtgaac

SEQ ID NO: 226566 - DNA, 25 bp, Mus musculus
cagagtgattgacagggagggtgtg

SEQ ID NO: 226567 - DNA, 25 bp, Mus musculus
cagagtgcaagggtagctaagaaaa

SEQ ID NO: 226568 - DNA, 25 bp, Mus musculus
cagagtgcaaggtaaatctttattt

SEQ ID NO: 226569 - DNA, 25 bp, Mus musculus
cagagtgcagagtaaatccctgtct

SEQ ID NO: 226570 - DNA, 25 bp, Mus musculus
cagagtgcagcattattgattgtgg

SEQ ID NO: 226571 - DNA, 25 bp, Mus musculus
cagagtgcagtattgtggaatgtgg

SEQ ID NO: 226572 - DNA, 25 bp, Mus musculus
cagagtgctgatcagggcactgaca

SEQ ID NO: 226573 - DNA, 25 bp, Mus musculus
cagagtggaagtgtgatcaggtgta

SEQ ID NO: 226574 - DNA, 25 bp, Mus musculus
cagagtggcagcacgatggtcctac

SEQ ID NO: 226575 - DNA, 25 bp, Mus musculus
cagagtggcatggaaggtgaaggag

SEQ ID NO: 226576 - DNA, 25 bp, Mus musculus
cagagtggcctcgcatggtcatggt

SEQ ID NO: 226577 - DNA, 25 bp, Mus musculus
cagagtggccttgaacaggacaggc

SEQ ID NO: 226578 - DNA, 25 bp, Mus musculus
cagagtgggtacagagtataaagga

SEQ ID NO: 226579 - DNA, 25 bp, Mus musculus
cagagtggtaaaaagagctgtaata

SEQ ID NO: 226580 - DNA, 25 bp, Mus musculus
cagagtgtacagcgaccctagggta

SEQ ID NO: 226581 - DNA, 25 bp, Mus musculus
cagagtgtacagggaccctagggta

SEQ ID NO: 226582 - DNA, 25 bp, Mus musculus
cagagtgtatgagggccagaacgtc

SEQ ID NO: 226583 - DNA, 25 bp, Mus musculus
cagagtgtcagccagggcggagcta

SEQ ID NO: 226584 - DNA, 25 bp, Mus musculus
cagagtgtgtggaggagtgatgggc

SEQ ID NO: 226585 - DNA, 25 bp, Mus musculus
cagagtgtgtgtcgtgctggtctgt

SEQ ID NO: 226586 - DNA, 25 bp, Mus musculus
cagagtgttttcagaatggcttcct

SEQ ID NO: 226587 - DNA, 25 bp, Mus musculus
cagagttaacaaacatgatcagggg

SEQ ID NO: 226588 - DNA, 25 bp, Mus musculus
cagagttaacaggtggctggatcca

SEQ ID NO: 226589 - DNA, 25 bp, Mus musculus
cagagttacaggaacgtcatccatg

SEQ ID NO: 226590 - DNA, 25 bp, Mus musculus
cagagttacaggggcccagactgat

SEQ ID NO: 226591 - DNA, 25 bp, Mus musculus
cagagttacagggtatttttcttac

SEQ ID NO: 226592 - DNA, 25 bp, Mus musculus
cagagttaggaaaggaaagcactgc

SEQ ID NO: 226593 - DNA, 25 bp, Mus musculus
cagagttattttggggaaggatatt

SEQ ID NO: 226594 - DNA, 25 bp, Mus musculus
cagagttcagcagaggagacagcag

SEQ ID NO: 226595 - DNA, 25 bp, Mus musculus
cagagttcccagatgaagaaactga

SEQ ID NO: 226596 - DNA, 25 bp, Mus musculus
cagagttctctctaaacctttgaca

SEQ ID NO: 226597 - DNA, 25 bp, Mus musculus
cagagttggaatcagggctacggct

SEQ ID NO: 226598 - DNA, 25 bp, Mus musculus
cagagtttagggaggagcaaaaacc

SEQ ID NO: 226599 - DNA, 25 bp, Mus musculus
cagagtttcaaggcaaacgaatgca

SEQ ID NO: 226600 - DNA, 25 bp, Mus musculus
cagagtttcaaggcagcagtgaatg

SEQ ID NO: 226601 - DNA, 25 bp, Mus musculus
cagagtttcaaggtgggatgtgtgt

SEQ ID NO: 226602 - DNA, 25 bp, Mus musculus
cagagtttccaaaagctcctggcta

SEQ ID NO: 226603 - DNA, 25 bp, Mus musculus
cagagtttgaactctcttgctctct

SEQ ID NO: 226604 - DNA, 25 bp, Mus musculus
cagagtttgaatctgtcggggctgc

SEQ ID NO: 226605 - DNA, 25 bp, Mus musculus
cagagttttgttttgttatgaatgc

SEQ ID NO: 226606 - DNA, 25 bp, Mus musculus
cagataaagaggactcacggagctc

SEQ ID NO: 226607 - DNA, 25 bp, Mus musculus
cagataaagaggtgctaggacctca

SEQ ID NO: 226608 - DNA, 25 bp, Mus musculus
cagataaagagtgtgactggctcaa

SEQ ID NO: 226609 - DNA, 25 bp, Mus musculus
cagataaatcagatgttttcggtgc

SEQ ID NO: 226610 - DNA, 25 bp, Mus musculus
cagataaatcagcttctctccacga

SEQ ID NO: 226611 - DNA, 25 bp, Mus musculus
cagataacaagaacactccagggtt

SEQ ID NO: 226612 - DNA, 25 bp, Mus musculus
cagataaccaggtgattgttcagtc

SEQ ID NO: 226613 - DNA, 25 bp, Mus musculus
cagataacccaaggtggctggatcc

SEQ ID NO: 226614 - DNA, 25 bp, Mus musculus
cagataacccagaggatcaccttac

SEQ ID NO: 226615 - DNA, 25 bp, Mus musculus
cagataacccagtatcagtactttt

SEQ ID NO: 226616 - DNA, 25 bp, Mus musculus
cagataactcaatgggatttggtgc

SEQ ID NO: 226617 - DNA, 25 bp, Mus musculus
cagataagaaagatggcttgccagt

SEQ ID NO: 226618 - DNA, 25 bp, Mus musculus
cagataagaagggcaggattctggg

SEQ ID NO: 226619 - DNA, 25 bp, Mus musculus
cagataaggaaaaggggctgtctac

SEQ ID NO: 226620 - DNA, 25 bp, Mus musculus
cagataatggcagtggtcctacggc

SEQ ID NO: 226621 - DNA, 25 bp, Mus musculus
cagatacaaaagcacaaccagtgcc

SEQ ID NO: 226622 - DNA, 25 bp, Mus musculus
cagatacaaaagtaagaagttgttt

SEQ ID NO: 226623 - DNA, 25 bp, Mus musculus
cagatacaatttctggaaatgatat

SEQ ID NO: 226624 - DNA, 25 bp, Mus musculus
cagatacaccagttgtgacacagga

SEQ ID NO: 226625 - DNA, 25 bp, Mus musculus
cagatacactataaggtttgctatg

SEQ ID NO: 226626 - DNA, 25 bp, Mus musculus
cagatacagatatggagtaacaact

SEQ ID NO: 226627 - DNA, 25 bp, Mus musculus
cagatacagatatggagtatacaat

SEQ ID NO: 226628 - DNA, 25 bp, Mus musculus
cagatacaggatcacttctgtatgt

SEQ ID NO: 226629 - DNA, 25 bp, Mus musculus
cagataccacggccagagatcctca

SEQ ID NO: 226630 - DNA, 25 bp, Mus musculus
cagataccagaccttcctgcgagtg

SEQ ID NO: 226631 - DNA, 25 bp, Mus musculus
cagataccaggttgctggtgaccag

SEQ ID NO: 226632 - DNA, 25 bp, Mus musculus
cagataccctaactcagattagccc

SEQ ID NO: 226633 - DNA, 25 bp, Mus musculus
cagataccgggcccaacgaaggagc

SEQ ID NO: 226634 - DNA, 25 bp, Mus musculus
cagataccgggtggggacgacgagc

SEQ ID NO: 226635 - DNA, 25 bp, Mus musculus
cagatacgaagaggaatcttttgtg

SEQ ID NO: 226636 - DNA, 25 bp, Mus musculus
cagatactgttacagccctgccctg

SEQ ID NO: 226637 - DNA, 25 bp, Mus musculus
cagatacttcactcgctcgaagagc

SEQ ID NO: 226638 - DNA, 25 bp, Mus musculus
cagatacttctgtgagtgcaaagag

SEQ ID NO: 226639 - DNA, 25 bp, Mus musculus
cagatagaagaagaaaagcagcaaa

SEQ ID NO: 226640 - DNA, 25 bp, Mus musculus
cagatagaagatcaacaacccctcc

SEQ ID NO: 226641 - DNA, 25 bp, Mus musculus
cagatagagaaaaagtaaagacatt

SEQ ID NO: 226642 - DNA, 25 bp, Mus musculus
cagatagagaaaagtacaacagaat

SEQ ID NO: 226643 - DNA, 25 bp, Mus musculus
cagatagagaaaccaactgaggtga

SEQ ID NO: 226644 - DNA, 25 bp, Mus musculus
cagatagcaaggagaaagaaaagtc

SEQ ID NO: 226645 - DNA, 25 bp, Mus musculus
cagatagcaaggagggattttgaac

SEQ ID NO: 226646 - DNA, 25 bp, Mus musculus
cagatagcagtagtcctaccgggat

SEQ ID NO: 226647 - DNA, 25 bp, Mus musculus
cagatagcctaggttcaaccaggcc

SEQ ID NO: 226648 - DNA, 25 bp, Mus musculus
cagatagccttctgcaccaaggaga

SEQ ID NO: 226649 - DNA, 25 bp, Mus musculus
cagataggtgacaaggaaggagctt

SEQ ID NO: 226650 - DNA, 25 bp, Mus musculus
cagatagtttctgaattagtgtcct

SEQ ID NO: 226651 - DNA, 25 bp, Mus musculus
cagatagtttgctgtagtaattctt

SEQ ID NO: 226652 - DNA, 25 bp, Mus musculus
cagatatcagaatggtcatttatca

SEQ ID NO: 226653 - DNA, 25 bp, Mus musculus
cagatatcctcagtgtttgtgcctg

SEQ ID NO: 226654 - DNA, 25 bp, Mus musculus
cagatatcctgagcagaggggcagg

SEQ ID NO: 226655 - DNA, 25 bp, Mus musculus
cagatatcggcacaacgatggccag

SEQ ID NO: 226656 - DNA, 25 bp, Mus musculus
cagatatctcagcaggtaaatgaga

SEQ ID NO: 226657 - DNA, 25 bp, Mus musculus
cagatatctcagcaggtggcagcta

SEQ ID NO: 226658 - DNA, 25 bp, Mus musculus
cagatatctcttcaggtgccagcct

SEQ ID NO: 226659 - DNA, 25 bp, Mus musculus
cagatatgacttgggagaagagact

SEQ ID NO: 226660 - DNA, 25 bp, Mus musculus
cagatatgacttgtttggatttagg

SEQ ID NO: 226661 - DNA, 25 bp, Mus musculus
cagatatgcaaaccatgtttcctga

SEQ ID NO: 226662 - DNA, 25 bp, Mus musculus
cagatatgctcggactcaaccgtga

SEQ ID NO: 226663 - DNA, 25 bp, Mus musculus
cagatattcagcaagccccgcccaa

SEQ ID NO: 226664 - DNA, 25 bp, Mus musculus
cagatattgttgttgttacagatct

SEQ ID NO: 226665 - DNA, 25 bp, Mus musculus
cagatatttgcgaacaaggagcaag

SEQ ID NO: 226666 - DNA, 25 bp, Mus musculus
cagatattttgcttttagatactct

SEQ ID NO: 226667 - DNA, 25 bp, Mus musculus
cagatcaagagattggtgagctcct

SEQ ID NO: 226668 - DNA, 25 bp, Mus musculus
cagatcaagaggcctgggattgatc

SEQ ID NO: 226669 - DNA, 25 bp, Mus musculus
cagatcacaagggttctcttggaac

SEQ ID NO: 226670 - DNA, 25 bp, Mus musculus
cagatcacagaatacagatatggtc

SEQ ID NO: 226671 - DNA, 25 bp, Mus musculus
cagatcacagacactgcagaaggaa

SEQ ID NO: 226672 - DNA, 25 bp, Mus musculus
cagatcacagcctctgcagaatgtt

SEQ ID NO: 226673 - DNA, 25 bp, Mus musculus
cagatcaccatcaatgagatcagtg

SEQ ID NO: 226674 - DNA, 25 bp, Mus musculus
cagatcactcaggagaagccctcga

SEQ ID NO: 226675 - DNA, 25 bp, Mus musculus
cagatcactcaggaggttctgacgg

SEQ ID NO: 226676 - DNA, 25 bp, Mus musculus
cagatcactcaggagttgcagctcc

SEQ ID NO: 226677 - DNA, 25 bp, Mus musculus
cagatcagaaagcctaggacctgcc

SEQ ID NO: 226678 - DNA, 25 bp, Mus musculus
cagatcagaaaggcagtttgtgcac

SEQ ID NO: 226679 - DNA, 25 bp, Mus musculus
cagatcagaaagggtgtgtgggatg

SEQ ID NO: 226680 - DNA, 25 bp, Mus musculus
cagatcagaagaacagtctatccgt

SEQ ID NO: 226681 - DNA, 25 bp, Mus musculus
cagatcagaagaccaggaacccacg

SEQ ID NO: 226682 - DNA, 25 bp, Mus musculus
cagatcagaagagctctgcaggtcc

SEQ ID NO: 226683 - DNA, 25 bp, Mus musculus
cagatcagaagcacaattatatgaa

SEQ ID NO: 226684 - DNA, 25 bp, Mus musculus
cagatcagaaggcttatggtagcat

SEQ ID NO: 226685 - DNA, 25 bp, Mus musculus
cagatcagacagaggactactgttg

SEQ ID NO: 226686 - DNA, 25 bp, Mus musculus
cagatcagagattgttattgacgga

SEQ ID NO: 226687 - DNA, 25 bp, Mus musculus
cagatcagaggttgagcttgttcag

SEQ ID NO: 226688 - DNA, 25 bp, Mus musculus
cagatcagccctgagggcagagcag

SEQ ID NO: 226689 - DNA, 25 bp, Mus musculus
cagatcaggaagaagactgcccgtg

SEQ ID NO: 226690 - DNA, 25 bp, Mus musculus
cagatcagtatggtccatattgtgg

SEQ ID NO: 226691 - DNA, 25 bp, Mus musculus
cagatcatgaagacagtaaagactg

SEQ ID NO: 226692 - DNA, 25 bp, Mus musculus
cagatcatgaaggacatctgggttc

SEQ ID NO: 226693 - DNA, 25 bp, Mus musculus
cagatcatgaaggtacattttatac

SEQ ID NO: 226694 - DNA, 25 bp, Mus musculus
cagatcatggttgcccccaaggtct

SEQ ID NO: 226695 - DNA, 25 bp, Mus musculus
cagatccaaatcagacccggcactg

SEQ ID NO: 226696 - DNA, 25 bp, Mus musculus
cagatccaatactgcagcaatggca

SEQ ID NO: 226697 - DNA, 25 bp, Mus musculus
cagatccaatcacgagaccaggcct

SEQ ID NO: 226698 - DNA, 25 bp, Mus musculus
cagatccagcagttacacctggagc

SEQ ID NO: 226699 - DNA, 25 bp, Mus musculus
cagatccaggagctggtggaagcca

SEQ ID NO: 226700 - DNA, 25 bp, Mus musculus
cagatccaggaggacttcttcctgg

SEQ ID NO: 226701 - DNA, 25 bp, Mus musculus
cagatccatagggatttgaaagctg

SEQ ID NO: 226702 - DNA, 25 bp, Mus musculus
cagatccattcaaaggcattggcca

SEQ ID NO: 226703 - DNA, 25 bp, Mus musculus
cagatcccaaacctagagactgatg

SEQ ID NO: 226704 - DNA, 25 bp, Mus musculus
cagatcccaccaaggtgaaggccca

SEQ ID NO: 226705 - DNA, 25 bp, Mus musculus
cagatcccagaacactgcggcccca

SEQ ID NO: 226706 - DNA, 25 bp, Mus musculus
cagatcccagacttggagagagacc

SEQ ID NO: 226707 - DNA, 25 bp, Mus musculus
cagatcccagcagcattctgcagac

SEQ ID NO: 226708 - DNA, 25 bp, Mus musculus
cagatcccagccctgtccctaggag

SEQ ID NO: 226709 - DNA, 25 bp, Mus musculus
cagatcccaggaagccatgacattc

SEQ ID NO: 226710 - DNA, 25 bp, Mus musculus
cagatcccaggcctctatggcccag

SEQ ID NO: 226711 - DNA, 25 bp, Mus musculus
cagatcccagtatatttgtgtctta

SEQ ID NO: 226712 - DNA, 25 bp, Mus musculus
cagatcccagtgctgcacatgatgg

SEQ ID NO: 226713 - DNA, 25 bp, Mus musculus
cagatcccagtgctgggtctctttt

SEQ ID NO: 226714 - DNA, 25 bp, Mus musculus
cagatccctctcagccccctggtgc

SEQ ID NO: 226715 - DNA, 25 bp, Mus musculus
cagatccctctcaggtttacagccc

SEQ ID NO: 226716 - DNA, 25 bp, Mus musculus
cagatccggagtagcccctggaact

SEQ ID NO: 226717 - DNA, 25 bp, Mus musculus
cagatccgtttacaggtgctgggcg

SEQ ID NO: 226718 - DNA, 25 bp, Mus musculus
cagatccgtttacaggtggtggtcg

SEQ ID NO: 226719 - DNA, 25 bp, Mus musculus
cagatcctaagcaaaaggctgagga

SEQ ID NO: 226720 - DNA, 25 bp, Mus musculus
cagatcctcggcctggtcaccgaag

SEQ ID NO: 226721 - DNA, 25 bp, Mus musculus
cagatcctctgatggagccagagaa

SEQ ID NO: 226722 - DNA, 25 bp, Mus musculus
cagatcctgaagactgctggagtta

SEQ ID NO: 226723 - DNA, 25 bp, Mus musculus
cagatcctgaagcattcgggaatta

SEQ ID NO: 226724 - DNA, 25 bp, Mus musculus
cagatcctgaagctgcgacaagggt

SEQ ID NO: 226725 - DNA, 25 bp, Mus musculus
cagatcctgacaagggcacgtggag

SEQ ID NO: 226726 - DNA, 25 bp, Mus musculus
cagatcctgccggcgagtgaggaag

SEQ ID NO: 226727 - DNA, 25 bp, Mus musculus
cagatcctgccggcgctctgaaatc

SEQ ID NO: 226728 - DNA, 25 bp, Mus musculus
cagatcctttcacaggtgctgggcg

SEQ ID NO: 226729 - DNA, 25 bp, Mus musculus
cagatcgaagttaaaattgaagagc

SEQ ID NO: 226730 - DNA, 25 bp, Mus musculus
cagatcgcgcgcgaggcggaggcca

SEQ ID NO: 226731 - DNA, 25 bp, Mus musculus
cagatcgtccaaccttctgtgttag

SEQ ID NO: 226732 - DNA, 25 bp, Mus musculus
cagatcgtccaagttgaaaggccac

SEQ ID NO: 226733 - DNA, 25 bp, Mus musculus
cagatctactaagaaatgtcataaa

SEQ ID NO: 226734 - DNA, 25 bp, Mus musculus
cagatctcaaaggaaaaccagtggc

SEQ ID NO: 226735 - DNA, 25 bp, Mus musculus
cagatctccatgctggagaacatag

SEQ ID NO: 226736 - DNA, 25 bp, Mus musculus
cagatctcccaggagattggagacc

SEQ ID NO: 226737 - DNA, 25 bp, Mus musculus
cagatctcctgagccacagcctgcc

SEQ ID NO: 226738 - DNA, 25 bp, Mus musculus
cagatctcctgggccctcaccagag

SEQ ID NO: 226739 - DNA, 25 bp, Mus musculus
cagatctcgctcaagaagtcctgac

SEQ ID NO: 226740 - DNA, 25 bp, Mus musculus
cagatctctatggtcccttttggat

SEQ ID NO: 226741 - DNA, 25 bp, Mus musculus
cagatctctcaggggagacccagcg

SEQ ID NO: 226742 - DNA, 25 bp, Mus musculus
cagatctctcaggggatcatgaggg

SEQ ID NO: 226743 - DNA, 25 bp, Mus musculus
cagatctctgtggcaaggattaatg

SEQ ID NO: 226744 - DNA, 25 bp, Mus musculus
cagatctctgtgtggagctggcctg

SEQ ID NO: 226745 - DNA, 25 bp, Mus musculus
cagatctgcagggcgacactccccg

SEQ ID NO: 226746 - DNA, 25 bp, Mus musculus
cagatctgccggatcatgcgtccag

SEQ ID NO: 226747 - DNA, 25 bp, Mus musculus
cagatctgccgggctgcctctagct

SEQ ID NO: 226748 - DNA, 25 bp, Mus musculus
cagatctgccttcagaaaaaatgct

SEQ ID NO: 226749 - DNA, 25 bp, Mus musculus
cagatctgtgcacagactgactttg

SEQ ID NO: 226750 - DNA, 25 bp, Mus musculus
cagatcttattccagtcccactcac

SEQ ID NO: 226751 - DNA, 25 bp, Mus musculus
cagatcttcaaggcctgggctgtgg

SEQ ID NO: 226752 - DNA, 25 bp, Mus musculus
cagatcttccaagattagaacacct

SEQ ID NO: 226753 - DNA, 25 bp, Mus musculus
cagatcttgatctaggccttcctat

SEQ ID NO: 226754 - DNA, 25 bp, Mus musculus
cagatcttgcttagatggcaggttc

SEQ ID NO: 226755 - DNA, 25 bp, Mus musculus
cagatcttggaggactccctgcagt

SEQ ID NO: 226756 - DNA, 25 bp, Mus musculus
cagatgaaatcccaggtgatgacac

SEQ ID NO: 226757 - DNA, 25 bp, Mus musculus
cagatgaacagggagcattggcggc

SEQ ID NO: 226758 - DNA, 25 bp, Mus musculus
cagatgaacagttaatgtctgattg

SEQ ID NO: 226759 - DNA, 25 bp, Mus musculus
cagatgaacctgtcctaaaggaaat

SEQ ID NO: 226760 - DNA, 25 bp, Mus musculus
cagatgacaagacagttcccttcag

SEQ ID NO: 226761 - DNA, 25 bp, Mus musculus
cagatgacagcaacttcaaagctgt

SEQ ID NO: 226762 - DNA, 25 bp, Mus musculus
cagatgacagggcggaacttgccaa

SEQ ID NO: 226763 - DNA, 25 bp, Mus musculus
cagatgacatccctttcttgagatg

SEQ ID NO: 226764 - DNA, 25 bp, Mus musculus
cagatgaccagcaaactcacccagg

SEQ ID NO: 226765 - DNA, 25 bp, Mus musculus
cagatgaccggaagtcactggtgac

SEQ ID NO: 226766 - DNA, 25 bp, Mus musculus
cagatgacgacaagactggccaggt

SEQ ID NO: 226767 - DNA, 25 bp, Mus musculus
cagatgagacgggcatagaacaatt

SEQ ID NO: 226768 - DNA, 25 bp, Mus musculus
cagatgagacgggtattgaacgcct

SEQ ID NO: 226769 - DNA, 25 bp, Mus musculus
cagatgagagaaaacttttatccat

SEQ ID NO: 226770 - DNA, 25 bp, Mus musculus
cagatgagagaaaaggcctgctggt

SEQ ID NO: 226771 - DNA, 25 bp, Mus musculus
cagatgagaggatgcctcctggaac

SEQ ID NO: 226772 - DNA, 25 bp, Mus musculus
cagatgagagggaagagtggatgcg

SEQ ID NO: 226773 - DNA, 25 bp, Mus musculus
cagatgagagggaagagtgtattgg

SEQ ID NO: 226774 - DNA, 25 bp, Mus musculus
cagatgagctacttgaaaagtaaag

SEQ ID NO: 226775 - DNA, 25 bp, Mus musculus
cagatgaggagaaaaagttacgtcg

SEQ ID NO: 226776 - DNA, 25 bp, Mus musculus
cagatgagttcaaggccttgctgta

SEQ ID NO: 226777 - DNA, 25 bp, Mus musculus
cagatgagttcaaggtggtggtcgt

SEQ ID NO: 226778 - DNA, 25 bp, Mus musculus
cagatgataatgagtattctagtca

SEQ ID NO: 226779 - DNA, 25 bp, Mus musculus
cagatgatatgctggacaaatttgc

SEQ ID NO: 226780 - DNA, 25 bp, Mus musculus
cagatgatcaggagttagtgagctt

SEQ ID NO: 226781 - DNA, 25 bp, Mus musculus
cagatgatctttaagaatggtcctc

SEQ ID NO: 226782 - DNA, 25 bp, Mus musculus
cagatgatctttaagaatggtgaca

SEQ ID NO: 226783 - DNA, 25 bp, Mus musculus
cagatgatgaaaaacgtgaagcttc

SEQ ID NO: 226784 - DNA, 25 bp, Mus musculus
cagatgatggaacaagacttgattt

SEQ ID NO: 226785 - DNA, 25 bp, Mus musculus
cagatgatggaacaagtgcatggag

SEQ ID NO: 226786 - DNA, 25 bp, Mus musculus
cagatgatggacaggaaacagacag

SEQ ID NO: 226787 - DNA, 25 bp, Mus musculus
cagatgatggaccatgaagcaaagc

SEQ ID NO: 226788 - DNA, 25 bp, Mus musculus
cagatgatggcgagtcattcgacgt

SEQ ID NO: 226789 - DNA, 25 bp, Mus musculus
cagatgatggctctgtggccttgtg

SEQ ID NO: 226790 - DNA, 25 bp, Mus musculus
cagatgatgggagaattctgtggct

SEQ ID NO: 226791 - DNA, 25 bp, Mus musculus
cagatgatgggtgcagtttgagagt

SEQ ID NO: 226792 - DNA, 25 bp, Mus musculus
cagatgcaaagttctgctttcactt

SEQ ID NO: 226793 - DNA, 25 bp, Mus musculus
cagatgcacagatttgacataattg

SEQ ID NO: 226794 - DNA, 25 bp, Mus musculus
cagatgcacatatggatgcatctgg

SEQ ID NO: 226795 - DNA, 25 bp, Mus musculus
cagatgcacatcctcttctagaaaa

SEQ ID NO: 226796 - DNA, 25 bp, Mus musculus
cagatgcagacaggcttcgccggca

SEQ ID NO: 226797 - DNA, 25 bp, Mus musculus
cagatgcagacagtgtggcatcagc

SEQ ID NO: 226798 - DNA, 25 bp, Mus musculus
cagatgcaggatgccaggcagatcc

SEQ ID NO: 226799 - DNA, 25 bp, Mus musculus
cagatgccaaatagaccttctggac

SEQ ID NO: 226800 - DNA, 25 bp, Mus musculus
cagatgccaaattggatgaatatat

SEQ ID NO: 226801 - DNA, 25 bp, Mus musculus
cagatgccagcgccgctttcccgaa

SEQ ID NO: 226802 - DNA, 25 bp, Mus musculus
cagatgcccagcaccccttggggaa

SEQ ID NO: 226803 - DNA, 25 bp, Mus musculus
cagatgccccaaatattcttacaag

SEQ ID NO: 226804 - DNA, 25 bp, Mus musculus
cagatgccccaacaagggagaagca

SEQ ID NO: 226805 - DNA, 25 bp, Mus musculus
cagatgcccgacactccagaagaag

SEQ ID NO: 226806 - DNA, 25 bp, Mus musculus
cagatgcccggatgctgatgtacca

SEQ ID NO: 226807 - DNA, 25 bp, Mus musculus
cagatgccgacttggacattgctgt

SEQ ID NO: 226808 - DNA, 25 bp, Mus musculus
cagatgcctgggccgatgatgcacc

SEQ ID NO: 226809 - DNA, 25 bp, Mus musculus
cagatgcctgggcctaaccatatgc

SEQ ID NO: 226810 - DNA, 25 bp, Mus musculus
cagatgccttacaagaggagtggta

SEQ ID NO: 226811 - DNA, 25 bp, Mus musculus
cagatgcgggcgtcggttgggtttc

SEQ ID NO: 226812 - DNA, 25 bp, Mus musculus
cagatgctaaatatgttctagaagc

SEQ ID NO: 226813 - DNA, 25 bp, Mus musculus
cagatgctaaggatgatctgatgat

SEQ ID NO: 226814 - DNA, 25 bp, Mus musculus
cagatgctaggcatgaggtgaacca

SEQ ID NO: 226815 - DNA, 25 bp, Mus musculus
cagatgctcagcaaccagacctcat

SEQ ID NO: 226816 - DNA, 25 bp, Mus musculus
cagatgctcaggtatgggcttattt

SEQ ID NO: 226817 - DNA, 25 bp, Mus musculus
cagatgctcgggctgtcatttcgct

SEQ ID NO: 226818 - DNA, 25 bp, Mus musculus
cagatgctgaaattggatgcaaaac

SEQ ID NO: 226819 - DNA, 25 bp, Mus musculus
cagatgctgacaaagcaaatgaaaa

SEQ ID NO: 226820 - DNA, 25 bp, Mus musculus
cagatgctgacatggtcaaccagta

SEQ ID NO: 226821 - DNA, 25 bp, Mus musculus
cagatgctgtctatgtactgtgcta

SEQ ID NO: 226822 - DNA, 25 bp, Mus musculus
cagatgcttgtcccctgctctgccg

SEQ ID NO: 226823 - DNA, 25 bp, Mus musculus
cagatggaaaccagcaggtgcagca

SEQ ID NO: 226824 - DNA, 25 bp, Mus musculus
cagatggaaaccaggacaagaagac

SEQ ID NO: 226825 - DNA, 25 bp, Mus musculus
cagatggaaagatgacatcgttctg

SEQ ID NO: 226826 - DNA, 25 bp, Mus musculus
cagatggaaaggtcgtgtcttatgc

SEQ ID NO: 226827 - DNA, 25 bp, Mus musculus
cagatggaagaaaagttcctagtct

SEQ ID NO: 226828 - DNA, 25 bp, Mus musculus
cagatggaatctgtctctctcctct

SEQ ID NO: 226829 - DNA, 25 bp, Mus musculus
cagatggaattataagtactattaa

SEQ ID NO: 226830 - DNA, 25 bp, Mus musculus
cagatggaattcctgggcatccagg

SEQ ID NO: 226831 - DNA, 25 bp, Mus musculus
cagatggagcaagtgatgacagact

SEQ ID NO: 226832 - DNA, 25 bp, Mus musculus
cagatggagccagagaacctacaac

SEQ ID NO: 226833 - DNA, 25 bp, Mus musculus
cagatggatacagccttccagagat

SEQ ID NO: 226834 - DNA, 25 bp, Mus musculus
cagatggatccctctatgctgtggg

SEQ ID NO: 226835 - DNA, 25 bp, Mus musculus
cagatggatgaggaagacatgggga

SEQ ID NO: 226836 - DNA, 25 bp, Mus musculus
cagatggcaaagcaacagaaaagta

SEQ ID NO: 226837 - DNA, 25 bp, Mus musculus
cagatggcaaaggaagactccctga

SEQ ID NO: 226838 - DNA, 25 bp, Mus musculus
cagatggcaaggagctttggaacct

SEQ ID NO: 226839 - DNA, 25 bp, Mus musculus
cagatggcagagagtgcagcagctg

SEQ ID NO: 226840 - DNA, 25 bp, Mus musculus
cagatggcagcacacgccaaagatg

SEQ ID NO: 226841 - DNA, 25 bp, Mus musculus
cagatggcaggaccccacaggccca

SEQ ID NO: 226842 - DNA, 25 bp, Mus musculus
cagatggcaggcccaagtatctggt

SEQ ID NO: 226843 - DNA, 25 bp, Mus musculus
cagatggccaagggcactcaacgct

SEQ ID NO: 226844 - DNA, 25 bp, Mus musculus
cagatggccaagtcaagctgtgata

SEQ ID NO: 226845 - DNA, 25 bp, Mus musculus
cagatggcccaggtacttcaattta

SEQ ID NO: 226846 - DNA, 25 bp, Mus musculus
cagatggcctcacagatccgtgaag

SEQ ID NO: 226847 - DNA, 25 bp, Mus musculus
cagatggctaggagtaaaaatggct

SEQ ID NO: 226848 - DNA, 25 bp, Mus musculus
cagatggctagggaatgtggagctg

SEQ ID NO: 226849 - DNA, 25 bp, Mus musculus
cagatggctcagtgggctccgtgaa

SEQ ID NO: 226850 - DNA, 25 bp, Mus musculus
cagatggctcatcagctggctctgt

SEQ ID NO: 226851 - DNA, 25 bp, Mus musculus
cagatggctgacagatctcggcaaa

SEQ ID NO: 226852 - DNA, 25 bp, Mus musculus
cagatggctgacagcttggatctgt

SEQ ID NO: 226853 - DNA, 25 bp, Mus musculus
cagatggcttcacctgggagaagag

SEQ ID NO: 226854 - DNA, 25 bp, Mus musculus
cagatgggacccaggctgccctgcc

SEQ ID NO: 226855 - DNA, 25 bp, Mus musculus
cagatgggagcctctttttcctgca

SEQ ID NO: 226856 - DNA, 25 bp, Mus musculus
cagatgggagtgaggtgacttctgt

SEQ ID NO: 226857 - DNA, 25 bp, Mus musculus
cagatgggattcagaagataattgg

SEQ ID NO: 226858 - DNA, 25 bp, Mus musculus
cagatgggcaagggtgaggaggggt

SEQ ID NO: 226859 - DNA, 25 bp, Mus musculus
cagatgggcaaggtatcaatctatt

SEQ ID NO: 226860 - DNA, 25 bp, Mus musculus
cagatggggtaaagataaacaacaa

SEQ ID NO: 226861 - DNA, 25 bp, Mus musculus
cagatggggtaaaggagtcaactga

SEQ ID NO: 226862 - DNA, 25 bp, Mus musculus
cagatggtctggtgtagccgtcctc

SEQ ID NO: 226863 - DNA, 25 bp, Mus musculus
cagatgtcaagaaagcgtgtacctt

SEQ ID NO: 226864 - DNA, 25 bp, Mus musculus
cagatgtcaagatatctgtttcaaa

SEQ ID NO: 226865 - DNA, 25 bp, Mus musculus
cagatgtcacaggttaaagaaactc

SEQ ID NO: 226866 - DNA, 25 bp, Mus musculus
cagatgtcacttgtgactgaggctc

SEQ ID NO: 226867 - DNA, 25 bp, Mus musculus
cagatgtcaggagccctgtcctggt

SEQ ID NO: 226868 - DNA, 25 bp, Mus musculus
cagatgtcagggttgtacctgacta

SEQ ID NO: 226869 - DNA, 25 bp, Mus musculus
cagatgtcaggtttatgcgcatgag

SEQ ID NO: 226870 - DNA, 25 bp, Mus musculus
cagatgtcagtcatcttcctctgtc

SEQ ID NO: 226871 - DNA, 25 bp, Mus musculus
cagatgtcatgctgtgtgcaggaga

SEQ ID NO: 226872 - DNA, 25 bp, Mus musculus
cagatgtcatgttgtgtgcaggaga

SEQ ID NO: 226873 - DNA, 25 bp, Mus musculus
cagatgtccaagcccccaccttctg

SEQ ID NO: 226874 - DNA, 25 bp, Mus musculus
cagatgtccaaggtcagagtacacc

SEQ ID NO: 226875 - DNA, 25 bp, Mus musculus
cagatgtccaagtttggcaatgagg

SEQ ID NO: 226876 - DNA, 25 bp, Mus musculus
cagatgtccagatctgctggaacga

SEQ ID NO: 226877 - DNA, 25 bp, Mus musculus
cagatgtccaggtgtggtgcacaca

SEQ ID NO: 226878 - DNA, 25 bp, Mus musculus
cagatgtcctgcctgacctgcagga

SEQ ID NO: 226879 - DNA, 25 bp, Mus musculus
cagatgtctccagaacacttcagtt

SEQ ID NO: 226880 - DNA, 25 bp, Mus musculus
cagatgtctgatacatatctgagtt

SEQ ID NO: 226881 - DNA, 25 bp, Mus musculus
cagatgtctggagtggatgaccatc

SEQ ID NO: 226882 - DNA, 25 bp, Mus musculus
cagatgtgaaagatgcaggtgatga

SEQ ID NO: 226883 - DNA, 25 bp, Mus musculus
cagatgtgaaaggtgatgaaaggga

SEQ ID NO: 226884 - DNA, 25 bp, Mus musculus
cagatgtgaccagctcattgcctga

SEQ ID NO: 226885 - DNA, 25 bp, Mus musculus
cagatgtgaccaggcctgaagggaa

SEQ ID NO: 226886 - DNA, 25 bp, Mus musculus
cagatgtgagcaggaggcctctgaa

SEQ ID NO: 226887 - DNA, 25 bp, Mus musculus
cagatgtgcacaggacattgcccta

SEQ ID NO: 226888 - DNA, 25 bp, Mus musculus
cagatgtgcacaggctacattgctg

SEQ ID NO: 226889 - DNA, 25 bp, Mus musculus
cagatgtgcagcgccgagtacaaca

SEQ ID NO: 226890 - DNA, 25 bp, Mus musculus
cagatgtgcagcttgaaggaggctg

SEQ ID NO: 226891 - DNA, 25 bp, Mus musculus
cagatgtggagatgacttggactga

SEQ ID NO: 226892 - DNA, 25 bp, Mus musculus
cagatgtggagatggagtatacaat

SEQ ID NO: 226893 - DNA, 25 bp, Mus musculus
cagatgtggtcgagaaaagacaact

SEQ ID NO: 226894 - DNA, 25 bp, Mus musculus
cagatgtggtcgagttgcagtaatg

SEQ ID NO: 226895 - DNA, 25 bp, Mus musculus
cagatgtgtcggtgtcccgatgctg

SEQ ID NO: 226896 - DNA, 25 bp, Mus musculus
cagatgtgtcgtaacatatcgcagc

SEQ ID NO: 226897 - DNA, 25 bp, Mus musculus
cagatgtgttcagaatgatgatgcc

SEQ ID NO: 226898 - DNA, 25 bp, Mus musculus
cagatgtgttcagtctgggtctcac

SEQ ID NO: 226899 - DNA, 25 bp, Mus musculus
cagatgttagaagatgtagctaaaa

SEQ ID NO: 226900 - DNA, 25 bp, Mus musculus
cagatgttagcactagcaacaagcg

SEQ ID NO: 226901 - DNA, 25 bp, Mus musculus
cagatgttcagccagtatccgcctc

SEQ ID NO: 226902 - DNA, 25 bp, Mus musculus
cagatgttcatgataggagacaaat

SEQ ID NO: 226903 - DNA, 25 bp, Mus musculus
cagatgttcatgggactttcagtta

SEQ ID NO: 226904 - DNA, 25 bp, Mus musculus
cagatgttccagaagaagctggtta

SEQ ID NO: 226905 - DNA, 25 bp, Mus musculus
cagatgttccaggagggagtatgat

SEQ ID NO: 226906 - DNA, 25 bp, Mus musculus
cagatgttctgcgccccactcaccg

SEQ ID NO: 226907 - DNA, 25 bp, Mus musculus
cagatgttctggccaacctctccct

SEQ ID NO: 226908 - DNA, 25 bp, Mus musculus
cagatgtttccaagaaggtcacaga

SEQ ID NO: 226909 - DNA, 25 bp, Mus musculus
cagatgttttaatggctgttagcgt

SEQ ID NO: 226910 - DNA, 25 bp, Mus musculus
cagatgttttccaggaggtggtgtg

SEQ ID NO: 226911 - DNA, 25 bp, Mus musculus
cagatgttttcgaaggcagtataat

SEQ ID NO: 226912 - DNA, 25 bp, Mus musculus
cagatgttttcgaaggcatgcttgt

SEQ ID NO: 226913 - DNA, 25 bp, Mus musculus
cagattaaacaagccgctgcgcctg

SEQ ID NO: 226914 - DNA, 25 bp, Mus musculus
cagattaaacaaggctggagccagt

SEQ ID NO: 226915 - DNA, 25 bp, Mus musculus
cagattaaagtcaaataatttagta

SEQ ID NO: 226916 - DNA, 25 bp, Mus musculus
cagattaacagagactctgcagatt

SEQ ID NO: 226917 - DNA, 25 bp, Mus musculus
cagattaagacataggtggcaggat

SEQ ID NO: 226918 - DNA, 25 bp, Mus musculus
cagattacagatcccaggcaggcac

SEQ ID NO: 226919 - DNA, 25 bp, Mus musculus
cagattacagatttctgctcctaat

SEQ ID NO: 226920 - DNA, 25 bp, Mus musculus
cagattactaaggacaacatagaaa

SEQ ID NO: 226921 - DNA, 25 bp, Mus musculus
cagattagctctgccccaggcctcc

SEQ ID NO: 226922 - DNA, 25 bp, Mus musculus
cagattagttttaaggccgaagtca

SEQ ID NO: 226923 - DNA, 25 bp, Mus musculus
cagattagttttaagtatggcgccc

SEQ ID NO: 226924 - DNA, 25 bp, Mus musculus
cagattatcactcagataacccttc

SEQ ID NO: 226925 - DNA, 25 bp, Mus musculus
cagattatcactcaggcccaggcct

SEQ ID NO: 226926 - DNA, 25 bp, Mus musculus
cagattatccagaggagacagcact

SEQ ID NO: 226927 - DNA, 25 bp, Mus musculus
cagattatctttataggctgaaggc

SEQ ID NO: 226928 - DNA, 25 bp, Mus musculus
cagattcaaactgccgtggtgagaa

SEQ ID NO: 226929 - DNA, 25 bp, Mus musculus
cagattcaaagttcacagtcagacc

SEQ ID NO: 226930 - DNA, 25 bp, Mus musculus
cagattcaaatgaccagcagttatt

SEQ ID NO: 226931 - DNA, 25 bp, Mus musculus
cagattcagatgtaccctcctgaaa

SEQ ID NO: 226932 - DNA, 25 bp, Mus musculus
cagattcagcagcaggtccaggggc

SEQ ID NO: 226933 - DNA, 25 bp, Mus musculus
cagattcaggagctgctactcaggt

SEQ ID NO: 226934 - DNA, 25 bp, Mus musculus
cagattcaggcttccagttcacgtg

SEQ ID NO: 226935 - DNA, 25 bp, Mus musculus
cagattccagagacactgtactaca

SEQ ID NO: 226936 - DNA, 25 bp, Mus musculus
cagattccaggataacataaatgtt

SEQ ID NO: 226937 - DNA, 25 bp, Mus musculus
cagattccccgctgtcctacagtct

SEQ ID NO: 226938 - DNA, 25 bp, Mus musculus
cagattcctcagttccaccagagga

SEQ ID NO: 226939 - DNA, 25 bp, Mus musculus
cagattcgcagaatagcagagaaag

SEQ ID NO: 226940 - DNA, 25 bp, Mus musculus
cagattctactcagcttcagaggat

SEQ ID NO: 226941 - DNA, 25 bp, Mus musculus
cagattctcagcttttaatatattt

SEQ ID NO: 226942 - DNA, 25 bp, Mus musculus
cagattctcaggtaagctctgatgg

SEQ ID NO: 226943 - DNA, 25 bp, Mus musculus
cagattctcgaggctaaaaagaaaa

SEQ ID NO: 226944 - DNA, 25 bp, Mus musculus
cagattctgagagtctgctagtctg

SEQ ID NO: 226945 - DNA, 25 bp, Mus musculus
cagattctgagtctgatatcctttt

SEQ ID NO: 226946 - DNA, 25 bp, Mus musculus
cagattctgagtggggacctcatca

SEQ ID NO: 226947 - DNA, 25 bp, Mus musculus
cagattcttggataaggaattggaa

SEQ ID NO: 226948 - DNA, 25 bp, Mus musculus
cagattgaaaagcttactaagcacc

SEQ ID NO: 226949 - DNA, 25 bp, Mus musculus
cagattgaacgcaagggggaagcat

SEQ ID NO: 226950 - DNA, 25 bp, Mus musculus
cagattgaaggtcagatgtaccagc

SEQ ID NO: 226951 - DNA, 25 bp, Mus musculus
cagattgcagagttcaaagaagctt

SEQ ID NO: 226952 - DNA, 25 bp, Mus musculus
cagattgcccaatgagctgctaagt

SEQ ID NO: 226953 - DNA, 25 bp, Mus musculus
cagattgccctggatcgtgcagaaa

SEQ ID NO: 226954 - DNA, 25 bp, Mus musculus
cagattgccgacttcaaggaggcat

SEQ ID NO: 226955 - DNA, 25 bp, Mus musculus
cagattgccgatcgagttctctaag

SEQ ID NO: 226956 - DNA, 25 bp, Mus musculus
cagattgctaaaagtactattaatc

SEQ ID NO: 226957 - DNA, 25 bp, Mus musculus
cagattgctaaagaccagagtaatg

SEQ ID NO: 226958 - DNA, 25 bp, Mus musculus
cagattgctaaagcagtgggaactc

SEQ ID NO: 226959 - DNA, 25 bp, Mus musculus
cagattgctcacgtatcacgacatc

SEQ ID NO: 226960 - DNA, 25 bp, Mus musculus
cagattgctctgccatcacctgttt

SEQ ID NO: 226961 - DNA, 25 bp, Mus musculus
cagattgctttggcctggagagaga

SEQ ID NO: 226962 - DNA, 25 bp, Mus musculus
cagattggactcgagctcagagctc

SEQ ID NO: 226963 - DNA, 25 bp, Mus musculus
cagattggactcgagtgtgacagtt

SEQ ID NO: 226964 - DNA, 25 bp, Mus musculus
cagattgggggcagcaactcttaca

SEQ ID NO: 226965 - DNA, 25 bp, Mus musculus
cagattggttcaaggagtcctttgg

SEQ ID NO: 226966 - DNA, 25 bp, Mus musculus
cagattggttgtcgccatcttttga

SEQ ID NO: 226967 - DNA, 25 bp, Mus musculus
cagattggttgtggccatcttttga

SEQ ID NO: 226968 - DNA, 25 bp, Mus musculus
cagattgtaaagcgtgaagacagct

SEQ ID NO: 226969 - DNA, 25 bp, Mus musculus
cagattgtaaagtgatggttcatga

SEQ ID NO: 226970 - DNA, 25 bp, Mus musculus
cagatttaaaggttatagttatgag

SEQ ID NO: 226971 - DNA, 25 bp, Mus musculus
cagatttaagagtttgtttctaatg

SEQ ID NO: 226972 - DNA, 25 bp, Mus musculus
cagatttaagattattaaaaactgg

SEQ ID NO: 226973 - DNA, 25 bp, Mus musculus
cagatttaagcttccttccactgta

SEQ ID NO: 226974 - DNA, 25 bp, Mus musculus
cagatttaataactggcatcctcgt

SEQ ID NO: 226975 - DNA, 25 bp, Mus musculus
cagatttacaaagttgcttcagatc

SEQ ID NO: 226976 - DNA, 25 bp, Mus musculus
cagatttacctctgggacaaggaca

SEQ ID NO: 226977 - DNA, 25 bp, Mus musculus
cagatttagctggggaggaagagac

SEQ ID NO: 226978 - DNA, 25 bp, Mus musculus
cagatttagctggggggccgagggg

SEQ ID NO: 226979 - DNA, 25 bp, Mus musculus
cagatttatggagtgtttgatgaga

SEQ ID NO: 226980 - DNA, 25 bp, Mus musculus
cagatttcacagagacagccattct

SEQ ID NO: 226981 - DNA, 25 bp, Mus musculus
cagatttcacgtgtcaccatgctgt

SEQ ID NO: 226982 - DNA, 25 bp, Mus musculus
cagatttcattgaggagtttgacaa

SEQ ID NO: 226983 - DNA, 25 bp, Mus musculus
cagatttccacagtcttgctctagc

SEQ ID NO: 226984 - DNA, 25 bp, Mus musculus
cagatttccacagtgttgctctagc

SEQ ID NO: 226985 - DNA, 25 bp, Mus musculus
cagatttccagccgtggtcaagttc

SEQ ID NO: 226986 - DNA, 25 bp, Mus musculus
cagatttccctggcctcagaaacac

SEQ ID NO: 226987 - DNA, 25 bp, Mus musculus
cagatttccctggcttcccctccag

SEQ ID NO: 226988 - DNA, 25 bp, Mus musculus
cagatttccgaaggtacattttata

SEQ ID NO: 226989 - DNA, 25 bp, Mus musculus
cagatttgagccgaggattaacacc

SEQ ID NO: 226990 - DNA, 25 bp, Mus musculus
cagatttgcaagacagttcggcatg

SEQ ID NO: 226991 - DNA, 25 bp, Mus musculus
cagatttgcaagggagttgatttac

SEQ ID NO: 226992 - DNA, 25 bp, Mus musculus
cagatttggacagcttccttgtgac

SEQ ID NO: 226993 - DNA, 25 bp, Mus musculus
cagatttggacagtttccagcagga

SEQ ID NO: 226994 - DNA, 25 bp, Mus musculus
cagatttggggccaggaccctgcct

SEQ ID NO: 226995 - DNA, 25 bp, Mus musculus
cagattttaaactgtttcagaaaga

SEQ ID NO: 226996 - DNA, 25 bp, Mus musculus
cagattttagcagcttcttactgtg

SEQ ID NO: 226997 - DNA, 25 bp, Mus musculus
cagattttagcaggtgaatatgacc

SEQ ID NO: 226998 - DNA, 25 bp, Mus musculus
cagattttcagggcattgtgcttct

SEQ ID NO: 226999 - DNA, 25 bp, Mus musculus
cagattttgaggtattcgtggagtg

SEQ ID NO: 227000 - DNA, 25 bp, Mus musculus
cagattttgaggtcttgccgtggaa

SEQ ID NO: 227001 - DNA, 25 bp, Mus musculus
cagatttttctgggattgggtcgaa

SEQ ID NO: 227002 - DNA, 25 bp, Mus musculus
cagatttttctgggcccctgatgat

SEQ ID NO: 227003 - DNA, 25 bp, Mus musculus
cagatttttttctatctgcccgcgg

SEQ ID NO: 227004 - DNA, 25 bp, Mus musculus
cagcaaaaacaaatcattgcaacga

SEQ ID NO: 227005 - DNA, 25 bp, Mus musculus
cagcaaaaagcctaagaaagttgtc

SEQ ID NO: 227006 - DNA, 25 bp, Mus musculus
cagcaaaagaaaagatgagaggctg

SEQ ID NO: 227007 - DNA, 25 bp, Mus musculus
cagcaaaataggaaacctcgtgttg

SEQ ID NO: 227008 - DNA, 25 bp, Mus musculus
cagcaaaataggacggaaagttata

SEQ ID NO: 227009 - DNA, 25 bp, Mus musculus
cagcaaaatggcccaccaagaaaac

SEQ ID NO: 227010 - DNA, 25 bp, Mus musculus
cagcaaaatggtaaccctggcactg

SEQ ID NO: 227011 - DNA, 25 bp, Mus musculus
cagcaaaatgtggattttgttgacc

SEQ ID NO: 227012 - DNA, 25 bp, Mus musculus
cagcaaacagagccctttgccatga

SEQ ID NO: 227013 - DNA, 25 bp, Mus musculus
cagcaaacagatactctgtcaaagg

SEQ ID NO: 227014 - DNA, 25 bp, Mus musculus
cagcaaacagatgcgtgtacatcca

SEQ ID NO: 227015 - DNA, 25 bp, Mus musculus
cagcaaacagccaaagttgttacat

SEQ ID NO: 227016 - DNA, 25 bp, Mus musculus
cagcaaacagccatttcgtagagtg

SEQ ID NO: 227017 - DNA, 25 bp, Mus musculus
cagcaaacataatgtgaccccatct

SEQ ID NO: 227018 - DNA, 25 bp, Mus musculus
cagcaaacatggcagcagagtcact

SEQ ID NO: 227019 - DNA, 25 bp, Mus musculus
cagcaaacatggcaggctctacaca

SEQ ID NO: 227020 - DNA, 25 bp, Mus musculus
cagcaaaccacgactagacaaggct

SEQ ID NO: 227021 - DNA, 25 bp, Mus musculus
cagcaaaccagaagagcccttggtt

SEQ ID NO: 227022 - DNA, 25 bp, Mus musculus
cagcaaaccaggactagacaaggct

SEQ ID NO: 227023 - DNA, 25 bp, Mus musculus
cagcaaaccattcagtttgcaggag

SEQ ID NO: 227024 - DNA, 25 bp, Mus musculus
cagcaaacgaggcctaagtcacccc

SEQ ID NO: 227025 - DNA, 25 bp, Mus musculus
cagcaaacggctgtccctcctccca

SEQ ID NO: 227026 - DNA, 25 bp, Mus musculus
cagcaaactgcctactcgcccagcc

SEQ ID NO: 227027 - DNA, 25 bp, Mus musculus
cagcaaactgcggggactgaagcct

SEQ ID NO: 227028 - DNA, 25 bp, Mus musculus
cagcaaactggcaccgacagcccga

SEQ ID NO: 227029 - DNA, 25 bp, Mus musculus
cagcaaagaaaggcctcctggaaca

SEQ ID NO: 227030 - DNA, 25 bp, Mus musculus
cagcaaagccgaagagtgtaggctt

SEQ ID NO: 227031 - DNA, 25 bp, Mus musculus
cagcaaagcgcaggctatgaagttg

SEQ ID NO: 227032 - DNA, 25 bp, Mus musculus
cagcaaagtacaggtgttgctggag

SEQ ID NO: 227033 - DNA, 25 bp, Mus musculus
cagcaaagtgctcaggaagtctaaa

SEQ ID NO: 227034 - DNA, 25 bp, Mus musculus
cagcaaataaggagacagtgatggc

SEQ ID NO: 227035 - DNA, 25 bp, Mus musculus
cagcaaatagatcagagccactggc

SEQ ID NO: 227036 - DNA, 25 bp, Mus musculus
cagcaaatagtgaaagtcctcagga

SEQ ID NO: 227037 - DNA, 25 bp, Mus musculus
cagcaaatagttccagggtcacatc

SEQ ID NO: 227038 - DNA, 25 bp, Mus musculus
cagcaaatccagaggatctctctca

SEQ ID NO: 227039 - DNA, 25 bp, Mus musculus
cagcaaatccagaggtgaaaatcca

SEQ ID NO: 227040 - DNA, 25 bp, Mus musculus
cagcaaatctcactggaagctcctg

SEQ ID NO: 227041 - DNA, 25 bp, Mus musculus
cagcaaatgagggcgaacagctaat

SEQ ID NO: 227042 - DNA, 25 bp, Mus musculus
cagcaaatgattcggatatcaggat

SEQ ID NO: 227043 - DNA, 25 bp, Mus musculus
cagcaaatgattcgtccaaggcggt

SEQ ID NO: 227044 - DNA, 25 bp, Mus musculus
cagcaaatgcacccaaattaaaacg

SEQ ID NO: 227045 - DNA, 25 bp, Mus musculus
cagcaaatgcgaagggtatgtcgga

SEQ ID NO: 227046 - DNA, 25 bp, Mus musculus
cagcaaatgcgaagtgtgcaagtat

SEQ ID NO: 227047 - DNA, 25 bp, Mus musculus
cagcaaatgtcccagggcggcaatc

SEQ ID NO: 227048 - DNA, 25 bp, Mus musculus
cagcaaattcaactacagtgggagt

SEQ ID NO: 227049 - DNA, 25 bp, Mus musculus
cagcaacaaacatctctccaactcc

SEQ ID NO: 227050 - DNA, 25 bp, Mus musculus
cagcaacaaagtcacttagaaacgt

SEQ ID NO: 227051 - DNA, 25 bp, Mus musculus
cagcaacaacaggtgactgtggtct

SEQ ID NO: 227052 - DNA, 25 bp, Mus musculus
cagcaacaactgtcccaggtcttta

SEQ ID NO: 227053 - DNA, 25 bp, Mus musculus
cagcaacaaggcgggaggaagcact

SEQ ID NO: 227054 - DNA, 25 bp, Mus musculus
cagcaacaatagaattttcatttct

SEQ ID NO: 227055 - DNA, 25 bp, Mus musculus
cagcaacaataggtgttgactttaa

SEQ ID NO: 227056 - DNA, 25 bp, Mus musculus
cagcaacaatgcaggggttgacaac

SEQ ID NO: 227057 - DNA, 25 bp, Mus musculus
cagcaacacaaggaggcatggtcca

SEQ ID NO: 227058 - DNA, 25 bp, Mus musculus
cagcaacagatccaggttcaggggc

SEQ ID NO: 227059 - DNA, 25 bp, Mus musculus
cagcaacagcaggcccagcctgcag

SEQ ID NO: 227060 - DNA, 25 bp, Mus musculus
cagcaacagccttctacttctacat

SEQ ID NO: 227061 - DNA, 25 bp, Mus musculus
cagcaacaggtgtgaacaggttcca

SEQ ID NO: 227062 - DNA, 25 bp, Mus musculus
cagcaacagttggcatccagcattc

SEQ ID NO: 227063 - DNA, 25 bp, Mus musculus
cagcaacagttgggttctccccagg

SEQ ID NO: 227064 - DNA, 25 bp, Mus musculus
cagcaacagttggtcccatgcatca

SEQ ID NO: 227065 - DNA, 25 bp, Mus musculus
cagcaacataccagaatccacacag

SEQ ID NO: 227066 - DNA, 25 bp, Mus musculus
cagcaacataccagagtcctctgat

SEQ ID NO: 227067 - DNA, 25 bp, Mus musculus
cagcaacatacgtgatggaccaaga

SEQ ID NO: 227068 - DNA, 25 bp, Mus musculus
cagcaacatcaggtctcggacaaaa

SEQ ID NO: 227069 - DNA, 25 bp, Mus musculus
cagcaacatgaaatgtgtctaaacc

SEQ ID NO: 227070 - DNA, 25 bp, Mus musculus
cagcaacatgcacagcctatttaag

SEQ ID NO: 227071 - DNA, 25 bp, Mus musculus
cagcaaccaagctgtgattggactg

SEQ ID NO: 227072 - DNA, 25 bp, Mus musculus
cagcaaccaaggagacagtgatggc

SEQ ID NO: 227073 - DNA, 25 bp, Mus musculus
cagcaaccaaggagtcaaatattgg

SEQ ID NO: 227074 - DNA, 25 bp, Mus musculus
cagcaaccagaatttcagcttcctg

SEQ ID NO: 227075 - DNA, 25 bp, Mus musculus
cagcaaccagcacccggcagtgcca

SEQ ID NO: 227076 - DNA, 25 bp, Mus musculus
cagcaaccaggagctggagccctgt

SEQ ID NO: 227077 - DNA, 25 bp, Mus musculus
cagcaaccatgcgtgagtgcatctc

SEQ ID NO: 227078 - DNA, 25 bp, Mus musculus
cagcaaccccagattccagaggggt

SEQ ID NO: 227079 - DNA, 25 bp, Mus musculus
cagcaacctcatacattaaagtgat

SEQ ID NO: 227080 - DNA, 25 bp, Mus musculus
cagcaacctcatccctggcagcccc

SEQ ID NO: 227081 - DNA, 25 bp, Mus musculus
cagcaacctcatttccctgactgaa

SEQ ID NO: 227082 - DNA, 25 bp, Mus musculus
cagcaacctccaagcctgaagggca

SEQ ID NO: 227083 - DNA, 25 bp, Mus musculus
cagcaacctccaaggagtgtctaaa

SEQ ID NO: 227084 - DNA, 25 bp, Mus musculus
cagcaacctgctgaatttgttggag

SEQ ID NO: 227085 - DNA, 25 bp, Mus musculus
cagcaacctgctggccgtggagact

SEQ ID NO: 227086 - DNA, 25 bp, Mus musculus
cagcaaccttgacgcatcgtggctg

SEQ ID NO: 227087 - DNA, 25 bp, Mus musculus
cagcaacgaccctgaggacggggcc

SEQ ID NO: 227088 - DNA, 25 bp, Mus musculus
cagcaacgcccagagagatgtcttc

SEQ ID NO: 227089 - DNA, 25 bp, Mus musculus
cagcaacgctaggttcggagcgacc

SEQ ID NO: 227090 - DNA, 25 bp, Mus musculus
cagcaacggtgcggcagcgtgcttc

SEQ ID NO: 227091 - DNA, 25 bp, Mus musculus
cagcaacgtggaaatacttcggata

SEQ ID NO: 227092 - DNA, 25 bp, Mus musculus
cagcaactaggcatgaagcactacc

SEQ ID NO: 227093 - DNA, 25 bp, Mus musculus
cagcaactgagaggggagcaaattt

SEQ ID NO: 227094 - DNA, 25 bp, Mus musculus
cagcaactgcaggacagtctccgta

SEQ ID NO: 227095 - DNA, 25 bp, Mus musculus
cagcaactgcaggtggaagagctgt

SEQ ID NO: 227096 - DNA, 25 bp, Mus musculus
cagcaactgccaagagtctgacagc

SEQ ID NO: 227097 - DNA, 25 bp, Mus musculus
cagcaacttatccagatcacctcag

SEQ ID NO: 227098 - DNA, 25 bp, Mus musculus
cagcaacttgaggctcctgagcatc

SEQ ID NO: 227099 - DNA, 25 bp, Mus musculus
cagcaagaaagatgttattcttcaa

SEQ ID NO: 227100 - DNA, 25 bp, Mus musculus
cagcaagaaagctgcaggaatgagc

SEQ ID NO: 227101 - DNA, 25 bp, Mus musculus
cagcaagaacaccttcagtgagatg

SEQ ID NO: 227102 - DNA, 25 bp, Mus musculus
cagcaagacatgcagcctctattta

SEQ ID NO: 227103 - DNA, 25 bp, Mus musculus
cagcaagatacagccctgctggtag

SEQ ID NO: 227104 - DNA, 25 bp, Mus musculus
cagcaagatactgggatctcgctgg

SEQ ID NO: 227105 - DNA, 25 bp, Mus musculus
cagcaagatactggggtctcactat

SEQ ID NO: 227106 - DNA, 25 bp, Mus musculus
cagcaagatcaaggcattatgttat

SEQ ID NO: 227107 - DNA, 25 bp, Mus musculus
cagcaagatccaccaatgtttcccc

SEQ ID NO: 227108 - DNA, 25 bp, Mus musculus
cagcaagatccgagccttcatcctc

SEQ ID NO: 227109 - DNA, 25 bp, Mus musculus
cagcaagatcctgcttgagaaaagc

SEQ ID NO: 227110 - DNA, 25 bp, Mus musculus
cagcaagatgaagacatcccggcac

SEQ ID NO: 227111 - DNA, 25 bp, Mus musculus
cagcaagatgagtcgaaaggacaaa

SEQ ID NO: 227112 - DNA, 25 bp, Mus musculus
cagcaagatgatgactctgctgcag

SEQ ID NO: 227113 - DNA, 25 bp, Mus musculus
cagcaagcacatcgtatggcgccca

SEQ ID NO: 227114 - DNA, 25 bp, Mus musculus
cagcaagcaggaggcagacaaaaag

SEQ ID NO: 227115 - DNA, 25 bp, Mus musculus
cagcaagccaagctgatctataagt

SEQ ID NO: 227116 - DNA, 25 bp, Mus musculus
cagcaagccagagggcacccacaaa

SEQ ID NO: 227117 - DNA, 25 bp, Mus musculus
cagcaagccagaggtgtttgggaac

SEQ ID NO: 227118 - DNA, 25 bp, Mus musculus
cagcaagcgactccgattctgacag

SEQ ID NO: 227119 - DNA, 25 bp, Mus musculus
cagcaagcgcaccagagaatccgtg

SEQ ID NO: 227120 - DNA, 25 bp, Mus musculus
cagcaagcggaatatctccatgcat

SEQ ID NO: 227121 - DNA, 25 bp, Mus musculus
cagcaagcggatttcccttttctac

SEQ ID NO: 227122 - DNA, 25 bp, Mus musculus
cagcaagcggccgaccttgcacttg

SEQ ID NO: 227123 - DNA, 25 bp, Mus musculus
cagcaagcggccggcttcctttctg

SEQ ID NO: 227124 - DNA, 25 bp, Mus musculus
cagcaagcggttcagcagaggacag

SEQ ID NO: 227125 - DNA, 25 bp, Mus musculus
cagcaagctagtgagcagtgggaag

SEQ ID NO: 227126 - DNA, 25 bp, Mus musculus
cagcaagctgctcgactggctggtg

SEQ ID NO: 227127 - DNA, 25 bp, Mus musculus
cagcaagcttcggaggggaaaatgg

SEQ ID NO: 227128 - DNA, 25 bp, Mus musculus
cagcaaggacccaagcaaccgacgc

SEQ ID NO: 227129 - DNA, 25 bp, Mus musculus
cagcaaggagattcttccaagaagg

SEQ ID NO: 227130 - DNA, 25 bp, Mus musculus
cagcaaggagctggaagacatgaac

SEQ ID NO: 227131 - DNA, 25 bp, Mus musculus
cagcaaggcctcaagttgggatatc

SEQ ID NO: 227132 - DNA, 25 bp, Mus musculus
cagcaagggtattcttcagtatgac

SEQ ID NO: 227133 - DNA, 25 bp, Mus musculus
cagcaagttccagaacctgggtgtg

SEQ ID NO: 227134 - DNA, 25 bp, Mus musculus
cagcaatccatgagatcagggcact

SEQ ID NO: 227135 - DNA, 25 bp, Mus musculus
cagcaatcccatctgcttcgagagc

SEQ ID NO: 227136 - DNA, 25 bp, Mus musculus
cagcaatctcagggttttggcaagg

SEQ ID NO: 227137 - DNA, 25 bp, Mus musculus
cagcaatgaggtaccatggttgttc

SEQ ID NO: 227138 - DNA, 25 bp, Mus musculus
cagcaatgaggtggctcacaactcc

SEQ ID NO: 227139 - DNA, 25 bp, Mus musculus
cagcaatgatattgacttagaaggt

SEQ ID NO: 227140 - DNA, 25 bp, Mus musculus
cagcaatgccagtgccttcgtgcat

SEQ ID NO: 227141 - DNA, 25 bp, Mus musculus
cagcaatgccagttttcccatgacc

SEQ ID NO: 227142 - DNA, 25 bp, Mus musculus
cagcaatgcttctgattcttataaa

SEQ ID NO: 227143 - DNA, 25 bp, Mus musculus
cagcaatgcttctggtgaccttggg

SEQ ID NO: 227144 - DNA, 25 bp, Mus musculus
cagcaatggaagggcagcagagctt

SEQ ID NO: 227145 - DNA, 25 bp, Mus musculus
cagcaatggagcttggcatggatcc

SEQ ID NO: 227146 - DNA, 25 bp, Mus musculus
cagcaatggaggaattttgacaact

SEQ ID NO: 227147 - DNA, 25 bp, Mus musculus
cagcaatggaggcaggtggaagagc

SEQ ID NO: 227148 - DNA, 25 bp, Mus musculus
cagcaatggtgacctgctccagtgt

SEQ ID NO: 227149 - DNA, 25 bp, Mus musculus
cagcaatggtgtgaacaacccagac

SEQ ID NO: 227150 - DNA, 25 bp, Mus musculus
cagcaatgtggaaatctctcaggag

SEQ ID NO: 227151 - DNA, 25 bp, Mus musculus
cagcaatgtggaaatgtgttctgcc

SEQ ID NO: 227152 - DNA, 25 bp, Mus musculus
cagcaatgtggaaattttatagaac

SEQ ID NO: 227153 - DNA, 25 bp, Mus musculus
cagcaatgtggacctggccatgggc

SEQ ID NO: 227154 - DNA, 25 bp, Mus musculus
cagcaatgtgtgggttgaatttact

SEQ ID NO: 227155 - DNA, 25 bp, Mus musculus
cagcaattacagaaggtcaccagaa

SEQ ID NO: 227156 - DNA, 25 bp, Mus musculus
cagcaattggcacacactggttctg

SEQ ID NO: 227157 - DNA, 25 bp, Mus musculus
cagcacaaacaggccaaactcaaag

SEQ ID NO: 227158 - DNA, 25 bp, Mus musculus
cagcacaaagcagatttcaggtata

SEQ ID NO: 227159 - DNA, 25 bp, Mus musculus
cagcacaaagcagtgtggtcatccc

SEQ ID NO: 227160 - DNA, 25 bp, Mus musculus
cagcacaaataatagtgcttacaga

SEQ ID NO: 227161 - DNA, 25 bp, Mus musculus
cagcacaacaatgcagatagactgt

SEQ ID NO: 227162 - DNA, 25 bp, Mus musculus
cagcacaacacaatggaagtcgatg

SEQ ID NO: 227163 - DNA, 25 bp, Mus musculus
cagcacaacatgggaaaacccagga

SEQ ID NO: 227164 - DNA, 25 bp, Mus musculus
cagcacaaccagcagaaaacatggt

SEQ ID NO: 227165 - DNA, 25 bp, Mus musculus
cagcacaaccagcagaatgtggctg

SEQ ID NO: 227166 - DNA, 25 bp, Mus musculus
cagcacaagcgagggaagctaacag

SEQ ID NO: 227167 - DNA, 25 bp, Mus musculus
cagcacaatattccaacggtgcccc

SEQ ID NO: 227168 - DNA, 25 bp, Mus musculus
cagcacaatcgagagcagcaaaagc

SEQ ID NO: 227169 - DNA, 25 bp, Mus musculus
cagcacaatcgagatcctgcctcag

SEQ ID NO: 227170 - DNA, 25 bp, Mus musculus
cagcacacagacctatgcttggatg

SEQ ID NO: 227171 - DNA, 25 bp, Mus musculus
cagcacacaggaggtctggcattct

SEQ ID NO: 227172 - DNA, 25 bp, Mus musculus
cagcacacaggcagaggtgttaaag

SEQ ID NO: 227173 - DNA, 25 bp, Mus musculus
cagcacacatggaaccatgaatttg

SEQ ID NO: 227174 - DNA, 25 bp, Mus musculus
cagcacaccagaactatgccgagtg

SEQ ID NO: 227175 - DNA, 25 bp, Mus musculus
cagcacacccagcagcccgagcaac

SEQ ID NO: 227176 - DNA, 25 bp, Mus musculus
cagcacacctggagcctgttattct

SEQ ID NO: 227177 - DNA, 25 bp, Mus musculus
cagcacacgagatttttatcaccgt

SEQ ID NO: 227178 - DNA, 25 bp, Mus musculus
cagcacacggcagccggttgcctct

SEQ ID NO: 227179 - DNA, 25 bp, Mus musculus
cagcacacggcagtgactgatcaca

SEQ ID NO: 227180 - DNA, 25 bp, Mus musculus
cagcacacttgtatggggatcctgc

SEQ ID NO: 227181 - DNA, 25 bp, Mus musculus
cagcacacttgtccaacaaagttcc

SEQ ID NO: 227182 - DNA, 25 bp, Mus musculus
cagcacagcaaagcgccaggctccg

SEQ ID NO: 227183 - DNA, 25 bp, Mus musculus
cagcacagcaagagtgctgtcgact

SEQ ID NO: 227184 - DNA, 25 bp, Mus musculus
cagcacagcagatttaggaccgata

SEQ ID NO: 227185 - DNA, 25 bp, Mus musculus
cagcacagcagggacagggtggtgg

SEQ ID NO: 227186 - DNA, 25 bp, Mus musculus
cagcacagcatgagaaactctctgg

SEQ ID NO: 227187 - DNA, 25 bp, Mus musculus
cagcacagcctctacccccttcctg

SEQ ID NO: 227188 - DNA, 25 bp, Mus musculus
cagcacagcttcagaacaaaagtcc

SEQ ID NO: 227189 - DNA, 25 bp, Mus musculus
cagcacagcttcagattccatcaat

SEQ ID NO: 227190 - DNA, 25 bp, Mus musculus
cagcacagggtggagcatctgatga

SEQ ID NO: 227191 - DNA, 25 bp, Mus musculus
cagcacagtcggagccagggagagc

SEQ ID NO: 227192 - DNA, 25 bp, Mus musculus
cagcacagtgaaggcagtcggagca

SEQ ID NO: 227193 - DNA, 25 bp, Mus musculus
cagcacatcagctgcacctcagtcc

SEQ ID NO: 227194 - DNA, 25 bp, Mus musculus
cagcacatcagctggtcctatgtat

SEQ ID NO: 227195 - DNA, 25 bp, Mus musculus
cagcacatctcagccagtgaggagg

SEQ ID NO: 227196 - DNA, 25 bp, Mus musculus
cagcacattatagtggaacaccagt

SEQ ID NO: 227197 - DNA, 25 bp, Mus musculus
cagcaccaagatatcattaatggag

SEQ ID NO: 227198 - DNA, 25 bp, Mus musculus
cagcaccaaggaaacgtgtccccga

SEQ ID NO: 227199 - DNA, 25 bp, Mus musculus
cagcaccaaggaggagacagcctgt

SEQ ID NO: 227200 - DNA, 25 bp, Mus musculus
cagcaccaagtgtgggttgtttttt

SEQ ID NO: 227201 - DNA, 25 bp, Mus musculus
cagcaccagatcagaatttcagcat

SEQ ID NO: 227202 - DNA, 25 bp, Mus musculus
cagcaccagtacctcatgcctgaga

SEQ ID NO: 227203 - DNA, 25 bp, Mus musculus
cagcaccatcaatggtgcagtgcag

SEQ ID NO: 227204 - DNA, 25 bp, Mus musculus
cagcaccatcaatgttgcctaatgg

SEQ ID NO: 227205 - DNA, 25 bp, Mus musculus
cagcaccatcagggtatatccgaat

SEQ ID NO: 227206 - DNA, 25 bp, Mus musculus
cagcaccatgcaggctgtcttctcg

SEQ ID NO: 227207 - DNA, 25 bp, Mus musculus
cagcaccatgtcaaatcctctgggc

SEQ ID NO: 227208 - DNA, 25 bp, Mus musculus
cagcacccagcatgaggagctgaag

SEQ ID NO: 227209 - DNA, 25 bp, Mus musculus
cagcacccaggccctgtccagcagc

SEQ ID NO: 227210 - DNA, 25 bp, Mus musculus
cagcacccctgccagataatcagcc

SEQ ID NO: 227211 - DNA, 25 bp, Mus musculus
cagcacccctgccagtctcctggct

SEQ ID NO: 227212 - DNA, 25 bp, Mus musculus
cagcacccctttgagcccgctgtga

SEQ ID NO: 227213 - DNA, 25 bp, Mus musculus
cagcacccctttgtactatgcctgc

SEQ ID NO: 227214 - DNA, 25 bp, Mus musculus
cagcaccctgaagcaatcccacagg

SEQ ID NO: 227215 - DNA, 25 bp, Mus musculus
cagcaccctgacacccagggctcag

SEQ ID NO: 227216 - DNA, 25 bp, Mus musculus
cagcaccctgccagtggcccagctg

SEQ ID NO: 227217 - DNA, 25 bp, Mus musculus
cagcacccttatcttcaaagtgcag

SEQ ID NO: 227218 - DNA, 25 bp, Mus musculus
cagcacccttgcatcctctaccccc

SEQ ID NO: 227219 - DNA, 25 bp, Mus musculus
cagcaccctttcacaccggaacttg

SEQ ID NO: 227220 - DNA, 25 bp, Mus musculus
cagcaccggcgcgtaagcaatggct

SEQ ID NO: 227221 - DNA, 25 bp, Mus musculus
cagcaccggcgtgttgcccaccaac

SEQ ID NO: 227222 - DNA, 25 bp, Mus musculus
cagcacctacgtttgttgaaggagc

SEQ ID NO: 227223 - DNA, 25 bp, Mus musculus
cagcacctcagggatttgcaaatca

SEQ ID NO: 227224 - DNA, 25 bp, Mus musculus
cagcacctcagggccaataataaga

SEQ ID NO: 227225 - DNA, 25 bp, Mus musculus
cagcacctcagtgccttcccagacc

SEQ ID NO: 227226 - DNA, 25 bp, Mus musculus
cagcacctcatgctgatacattggt

SEQ ID NO: 227227 - DNA, 25 bp, Mus musculus
cagcacctcatggtgatacattggt

SEQ ID NO: 227228 - DNA, 25 bp, Mus musculus
cagcacctcctccagggagtgagtg

SEQ ID NO: 227229 - DNA, 25 bp, Mus musculus
cagcacctctggaggctcctgctcc

SEQ ID NO: 227230 - DNA, 25 bp, Mus musculus
cagcacctgcctcctcagaagactc

SEQ ID NO: 227231 - DNA, 25 bp, Mus musculus
cagcacctgcgcttagatccggctg

SEQ ID NO: 227232 - DNA, 25 bp, Mus musculus
cagcacctgcggaaaatttcccttt

SEQ ID NO: 227233 - DNA, 25 bp, Mus musculus
cagcacctgtcagaaccacccccgc

SEQ ID NO: 227234 - DNA, 25 bp, Mus musculus
cagcacctgtcagacaccactaact

SEQ ID NO: 227235 - DNA, 25 bp, Mus musculus
cagcacctgtcagacgagaagaacg

SEQ ID NO: 227236 - DNA, 25 bp, Mus musculus
cagcacctgtgaataaaagctgtgg

SEQ ID NO: 227237 - DNA, 25 bp, Mus musculus
cagcaccttaggagtgtaaagagct

SEQ ID NO: 227238 - DNA, 25 bp, Mus musculus
cagcaccttcagctatctaacttca

SEQ ID NO: 227239 - DNA, 25 bp, Mus musculus
cagcacctttagagggtctgatatg

SEQ ID NO: 227240 - DNA, 25 bp, Mus musculus
cagcacctttcagggaagccagctg

SEQ ID NO: 227241 - DNA, 25 bp, Mus musculus
cagcacgaagtcacgagcttcgtta

SEQ ID NO: 227242 - DNA, 25 bp, Mus musculus
cagcacgaatggtgcagtctttgtc

SEQ ID NO: 227243 - DNA, 25 bp, Mus musculus
cagcacgacttggctctgctgcgcc

SEQ ID NO: 227244 - DNA, 25 bp, Mus musculus
cagcacgagaacagcgactactgtg

SEQ ID NO: 227245 - DNA, 25 bp, Mus musculus
cagcacgcaactgatttagatgaaa

SEQ ID NO: 227246 - DNA, 25 bp, Mus musculus
cagcacgcagctttacatggtgaga

SEQ ID NO: 227247 - DNA, 25 bp, Mus musculus
cagcacgccgctttttagaacttca

SEQ ID NO: 227248 - DNA, 25 bp, Mus musculus
cagcacgccgggcaggcctcagcat

SEQ ID NO: 227249 - DNA, 25 bp, Mus musculus
cagcacgctcaggaacaagaatttg

SEQ ID NO: 227250 - DNA, 25 bp, Mus musculus
cagcacgcttgatgtggggcctgcg

SEQ ID NO: 227251 - DNA, 25 bp, Mus musculus
cagcacggatgatgttgcctccaga

SEQ ID NO: 227252 - DNA, 25 bp, Mus musculus
cagcacgggctacaggttgcgttac

SEQ ID NO: 227253 - DNA, 25 bp, Mus musculus
cagcacgtacaagagagaaatgtct

SEQ ID NO: 227254 - DNA, 25 bp, Mus musculus
cagcacgtgaggacaagtttttact

SEQ ID NO: 227255 - DNA, 25 bp, Mus musculus
cagcactaacaggaatgcagaaaca

SEQ ID NO: 227256 - DNA, 25 bp, Mus musculus
cagcactacacagcagcgtaccccg

SEQ ID NO: 227257 - DNA, 25 bp, Mus musculus
cagcactacacagcctccagccctg

SEQ ID NO: 227258 - DNA, 25 bp, Mus musculus
cagcactacacgtacctgaaggaat

SEQ ID NO: 227259 - DNA, 25 bp, Mus musculus
cagcactaccctggctgtatcaacc

SEQ ID NO: 227260 - DNA, 25 bp, Mus musculus
cagcactattaaggaggccttgtca

SEQ ID NO: 227261 - DNA, 25 bp, Mus musculus
cagcactcgggaggcagaggcaggc

SEQ ID NO: 227262 - DNA, 25 bp, Mus musculus
cagcactctggctgggcgctcaccc

SEQ ID NO: 227263 - DNA, 25 bp, Mus musculus
cagcactgaggttcaagaatttgga

SEQ ID NO: 227264 - DNA, 25 bp, Mus musculus
cagcactgcaggagcctgtgacctt

SEQ ID NO: 227265 - DNA, 25 bp, Mus musculus
cagcactgcatgagaaactctctgg

SEQ ID NO: 227266 - DNA, 25 bp, Mus musculus
cagcactgccaacagatctacacac

SEQ ID NO: 227267 - DNA, 25 bp, Mus musculus
cagcactgccaacagggtgcatcgc

SEQ ID NO: 227268 - DNA, 25 bp, Mus musculus
cagcactgcggagagccagctgctc

SEQ ID NO: 227269 - DNA, 25 bp, Mus musculus
cagcactgcggagttgagagctgct

SEQ ID NO: 227270 - DNA, 25 bp, Mus musculus
cagcactggagagaaacttgatggg

SEQ ID NO: 227271 - DNA, 25 bp, Mus musculus
cagcactggagagaccagccacgat

SEQ ID NO: 227272 - DNA, 25 bp, Mus musculus
cagcactggcaggctgaagatggaa

SEQ ID NO: 227273 - DNA, 25 bp, Mus musculus
cagcactggcaggtgcaggacgttg

SEQ ID NO: 227274 - DNA, 25 bp, Mus musculus
cagcactggcaggtgtcagcggaaa

SEQ ID NO: 227275 - DNA, 25 bp, Mus musculus
cagcactggctgaaggtaccttaac

SEQ ID NO: 227276 - DNA, 25 bp, Mus musculus
cagcactggggatgtccagctcgcc

SEQ ID NO: 227277 - DNA, 25 bp, Mus musculus
cagcactgtcaagcggaagatggag

SEQ ID NO: 227278 - DNA, 25 bp, Mus musculus
cagcactgtcaagcttctcatgctg

SEQ ID NO: 227279 - DNA, 25 bp, Mus musculus
cagcactgtcaaggatgtgtttgag

SEQ ID NO: 227280 - DNA, 25 bp, Mus musculus
cagcactgtcagacatagatatttc

SEQ ID NO: 227281 - DNA, 25 bp, Mus musculus
cagcactgtggttggctgggaccca

SEQ ID NO: 227282 - DNA, 25 bp, Mus musculus
cagcactgtggttggtgagcggggc

SEQ ID NO: 227283 - DNA, 25 bp, Mus musculus
cagcactgtgtcgaccccctcaccc

SEQ ID NO: 227284 - DNA, 25 bp, Mus musculus
cagcactgtgtgtcaccgtgccgtg

SEQ ID NO: 227285 - DNA, 25 bp, Mus musculus
cagcacttatgtgatccgtgatgag

SEQ ID NO: 227286 - DNA, 25 bp, Mus musculus
cagcacttcaagatgtatcgcctga

SEQ ID NO: 227287 - DNA, 25 bp, Mus musculus
cagcacttcagtgctgtcttcctgc

SEQ ID NO: 227288 - DNA, 25 bp, Mus musculus
cagcacttggcagaatcgtatggaa

SEQ ID NO: 227289 - DNA, 25 bp, Mus musculus
cagcactttgaaagggagaagacac

SEQ ID NO: 227290 - DNA, 25 bp, Mus musculus
cagcactttgaaagtattgagcaag

SEQ ID NO: 227291 - DNA, 25 bp, Mus musculus
cagcacttttcctttgatcgctgcc

SEQ ID NO: 227292 - DNA, 25 bp, Mus musculus
cagcacttttcctttgatctctgac

SEQ ID NO: 227293 - DNA, 25 bp, Mus musculus
cagcagaaaaccggttgctgtggtt

SEQ ID NO: 227294 - DNA, 25 bp, Mus musculus
cagcagaaacagagatagccagcag

SEQ ID NO: 227295 - DNA, 25 bp, Mus musculus
cagcagaaacagagtgctactgtct

SEQ ID NO: 227296 - DNA, 25 bp, Mus musculus
cagcagaaaccgtaaaagccttgat

SEQ ID NO: 227297 - DNA, 25 bp, Mus musculus
cagcagaaagagactaacggttatg

SEQ ID NO: 227298 - DNA, 25 bp, Mus musculus
cagcagaaagagatctatcaagtcc

SEQ ID NO: 227299 - DNA, 25 bp, Mus musculus
cagcagaaagagcacagagaacccc

SEQ ID NO: 227300 - DNA, 25 bp, Mus musculus
cagcagaaagaggagttcgtgagtg

SEQ ID NO: 227301 - DNA, 25 bp, Mus musculus
cagcagaaagaggtagaagaaagac

SEQ ID NO: 227302 - DNA, 25 bp, Mus musculus
cagcagaaagatagaagctagaaac

SEQ ID NO: 227303 - DNA, 25 bp, Mus musculus
cagcagaaagctggtttattgcagc

SEQ ID NO: 227304 - DNA, 25 bp, Mus musculus
cagcagaacctggaagctatgctct

SEQ ID NO: 227305 - DNA, 25 bp, Mus musculus
cagcagaacgctgctcatttgaaga

SEQ ID NO: 227306 - DNA, 25 bp, Mus musculus
cagcagaacgctgcttgtgaatggc

SEQ ID NO: 227307 - DNA, 25 bp, Mus musculus
cagcagaagaggaccacgacttctt

SEQ ID NO: 227308 - DNA, 25 bp, Mus musculus
cagcagaagcaacagcagaagcagg

SEQ ID NO: 227309 - DNA, 25 bp, Mus musculus
cagcagaagctgggtgccattgtgg

SEQ ID NO: 227310 - DNA, 25 bp, Mus musculus
cagcagaagtgcaggtattggtttt

SEQ ID NO: 227311 - DNA, 25 bp, Mus musculus
cagcagaattctgagatcttgagtt

SEQ ID NO: 227312 - DNA, 25 bp, Mus musculus
cagcagaattctggttttggtaaaa

SEQ ID NO: 227313 - DNA, 25 bp, Mus musculus
cagcagacacagattcaaaataaac

SEQ ID NO: 227314 - DNA, 25 bp, Mus musculus
cagcagacacagtccggttctccac

SEQ ID NO: 227315 - DNA, 25 bp, Mus musculus
cagcagacacccaagagacacagtc

SEQ ID NO: 227316 - DNA, 25 bp, Mus musculus
cagcagacactcatcagcctgaagt

SEQ ID NO: 227317 - DNA, 25 bp, Mus musculus
cagcagacagaagtgggagcagatc

SEQ ID NO: 227318 - DNA, 25 bp, Mus musculus
cagcagacagcaacgcagtacttca

SEQ ID NO: 227319 - DNA, 25 bp, Mus musculus
cagcagacagctcccaacccctcca

SEQ ID NO: 227320 - DNA, 25 bp, Mus musculus
cagcagaccaaaatcacccaggaca

SEQ ID NO: 227321 - DNA, 25 bp, Mus musculus
cagcagaccacaaagctagggaaga

SEQ ID NO: 227322 - DNA, 25 bp, Mus musculus
cagcagacggtgcaaccaggtacac

SEQ ID NO: 227323 - DNA, 25 bp, Mus musculus
cagcagacggtggaaattgacaact

SEQ ID NO: 227324 - DNA, 25 bp, Mus musculus
cagcagactcgtctcaaggagctgg

SEQ ID NO: 227325 - DNA, 25 bp, Mus musculus
cagcagactgagtcgtggtcctgcc

SEQ ID NO: 227326 - DNA, 25 bp, Mus musculus
cagcagagaagaaagcccgctgggt

SEQ ID NO: 227327 - DNA, 25 bp, Mus musculus
cagcagagaagagtccagacagaag

SEQ ID NO: 227328 - DNA, 25 bp, Mus musculus
cagcagagaagggcggtgctggtgg

SEQ ID NO: 227329 - DNA, 25 bp, Mus musculus
cagcagagaaggtgacagaaggtga

SEQ ID NO: 227330 - DNA, 25 bp, Mus musculus
cagcagagactggacgcggattctg

SEQ ID NO: 227331 - DNA, 25 bp, Mus musculus
cagcagagactggactacgagagta

SEQ ID NO: 227332 - DNA, 25 bp, Mus musculus
cagcagagagagggagttgaggata

SEQ ID NO: 227333 - DNA, 25 bp, Mus musculus
cagcagagagagttggatgaaaaat

SEQ ID NO: 227334 - DNA, 25 bp, Mus musculus
cagcagagagctcaggtttggagga

SEQ ID NO: 227335 - DNA, 25 bp, Mus musculus
cagcagagattgtatgtttatcatt

SEQ ID NO: 227336 - DNA, 25 bp, Mus musculus
cagcagagcaagaaggtcagtcagg

SEQ ID NO: 227337 - DNA, 25 bp, Mus musculus
cagcagagcaagagacgaattatca

SEQ ID NO: 227338 - DNA, 25 bp, Mus musculus
cagcagagcagctacgagacgctct

SEQ ID NO: 227339 - DNA, 25 bp, Mus musculus
cagcagagcagctactaagcgactc

SEQ ID NO: 227340 - DNA, 25 bp, Mus musculus
cagcagagcaggtgaagagaaggag

SEQ ID NO: 227341 - DNA, 25 bp, Mus musculus
cagcagagccatggacaaggaatat

SEQ ID NO: 227342 - DNA, 25 bp, Mus musculus
cagcagaggaagacgttcacagcct

SEQ ID NO: 227343 - DNA, 25 bp, Mus musculus
cagcagagggaaggcctggccttga

SEQ ID NO: 227344 - DNA, 25 bp, Mus musculus
cagcagagggaaggtgaccaaccac

SEQ ID NO: 227345 - DNA, 25 bp, Mus musculus
cagcagagggtcgaatcaacacctt

SEQ ID NO: 227346 - DNA, 25 bp, Mus musculus
cagcagagtgaaaacacttcagcta

SEQ ID NO: 227347 - DNA, 25 bp, Mus musculus
cagcagagtggaagtgtgatcaggt

SEQ ID NO: 227348 - DNA, 25 bp, Mus musculus
cagcagatagtttctgaattagtgt

SEQ ID NO: 227349 - DNA, 25 bp, Mus musculus
cagcagatattttgcttttagatac

SEQ ID NO: 227350 - DNA, 25 bp, Mus musculus
cagcagatcaagaattttctgaatt

SEQ ID NO: 227351 - DNA, 25 bp, Mus musculus
cagcagatctctcaggggagaccca

SEQ ID NO: 227352 - DNA, 25 bp, Mus musculus
cagcagatctctcaggggatcatga

SEQ ID NO: 227353 - DNA, 25 bp, Mus musculus
cagcagatctggatccctagcccct

SEQ ID NO: 227354 - DNA, 25 bp, Mus musculus
cagcagatgaccagcaaactcaccc

SEQ ID NO: 227355 - DNA, 25 bp, Mus musculus
cagcagatgctggacatccaggcag

SEQ ID NO: 227356 - DNA, 25 bp, Mus musculus
cagcagattaacagagactctgcag

SEQ ID NO: 227357 - DNA, 25 bp, Mus musculus
cagcagattctcgaggctaaaaaga

SEQ ID NO: 227358 - DNA, 25 bp, Mus musculus
cagcagattgccctggatcgtgcag

SEQ ID NO: 227359 - DNA, 25 bp, Mus musculus
cagcagcaacagcaggcccagcctg

SEQ ID NO: 227360 - DNA, 25 bp, Mus musculus
cagcagcaacagttggcatccagca

SEQ ID NO: 227361 - DNA, 25 bp, Mus musculus
cagcagcaacagttgggttctcccc

SEQ ID NO: 227362 - DNA, 25 bp, Mus musculus
cagcagcaacagttggtcccatgca

SEQ ID NO: 227363 - DNA, 25 bp, Mus musculus
cagcagcaaccccagattccagagg

SEQ ID NO: 227364 - DNA, 25 bp, Mus musculus
cagcagcaagaaggtgacgggccgc

SEQ ID NO: 227365 - DNA, 25 bp, Mus musculus
cagcagcaaggcctcaagttgggat

SEQ ID NO: 227366 - DNA, 25 bp, Mus musculus
cagcagcaagtgggcagaagttccc

SEQ ID NO: 227367 - DNA, 25 bp, Mus musculus
cagcagcaccagatttcaatgggag

SEQ ID NO: 227368 - DNA, 25 bp, Mus musculus
cagcagcaccagggcctgtccacca

SEQ ID NO: 227369 - DNA, 25 bp, Mus musculus
cagcagcacctggctgactgccttc

SEQ ID NO: 227370 - DNA, 25 bp, Mus musculus
cagcagcacggatgatgttgcctcc

SEQ ID NO: 227371 - DNA, 25 bp, Mus musculus
cagcagcacttctcctctctgaccg

SEQ ID NO: 227372 - DNA, 25 bp, Mus musculus
cagcagcagactcgtctcaaggagc

SEQ ID NO: 227373 - DNA, 25 bp, Mus musculus
cagcagcagatagtttcttaatgag

SEQ ID NO: 227374 - DNA, 25 bp, Mus musculus
cagcagcagatcccagagtcccagg

SEQ ID NO: 227375 - DNA, 25 bp, Mus musculus
cagcagcagattttgtggccctaat

SEQ ID NO: 227376 - DNA, 25 bp, Mus musculus
cagcagcagcaacagcaacagcaac

SEQ ID NO: 227377 - DNA, 25 bp, Mus musculus
cagcagcagcagaaacagcccccac

SEQ ID NO: 227378 - DNA, 25 bp, Mus musculus
cagcagcagcagactcaagaatgaa

SEQ ID NO: 227379 - DNA, 25 bp, Mus musculus
cagcagcagcagcaacagcaacagc

SEQ ID NO: 227380 - DNA, 25 bp, Mus musculus
cagcagcagcagcagaaacagcccc

SEQ ID NO: 227381 - DNA, 25 bp, Mus musculus
cagcagcagcagcagcagcagcagc

SEQ ID NO: 227382 - DNA, 25 bp, Mus musculus
cagcagcagcagcagccagtttctg

SEQ ID NO: 227383 - DNA, 25 bp, Mus musculus
cagcagcagcagcagggatggctcg

SEQ ID NO: 227384 - DNA, 25 bp, Mus musculus
cagcagcagcagcagggctctacca

SEQ ID NO: 227385 - DNA, 25 bp, Mus musculus
cagcagcagcagccagtttctgatg

SEQ ID NO: 227386 - DNA, 25 bp, Mus musculus
cagcagcagcagggatggctcggat

SEQ ID NO: 227387 - DNA, 25 bp, Mus musculus
cagcagcagcagggctctaccactc

SEQ ID NO: 227388 - DNA, 25 bp, Mus musculus
cagcagcagcgcaacgaagttcagc

SEQ ID NO: 227389 - DNA, 25 bp, Mus musculus
cagcagcagcggcaggaaaagccca

SEQ ID NO: 227390 - DNA, 25 bp, Mus musculus
cagcagcaggagaggctacagcagg

SEQ ID NO: 227391 - DNA, 25 bp, Mus musculus
cagcagcaggatcagatgcgataca

SEQ ID NO: 227392 - DNA, 25 bp, Mus musculus
cagcagcaggatcaggagctggtgg

SEQ ID NO: 227393 - DNA, 25 bp, Mus musculus
cagcagcagtcccgttctgcagacc

SEQ ID NO: 227394 - DNA, 25 bp, Mus musculus
cagcagcagtgtgaggatgacccgg

SEQ ID NO: 227395 - DNA, 25 bp, Mus musculus
cagcagcagttgcaggaatctcagc

SEQ ID NO: 227396 - DNA, 25 bp, Mus musculus
cagcagcatccagtgttgcctgtgc

SEQ ID NO: 227397 - DNA, 25 bp, Mus musculus
cagcagcatccagttcgtgaagaga

SEQ ID NO: 227398 - DNA, 25 bp, Mus musculus
cagcagcatcttcggcttcagtgtg

SEQ ID NO: 227399 - DNA, 25 bp, Mus musculus
cagcagcatgcagggctttcagata

SEQ ID NO: 227400 - DNA, 25 bp, Mus musculus
cagcagcatgcagggtaagcgcaaa

SEQ ID NO: 227401 - DNA, 25 bp, Mus musculus
cagcagcatggaactaagctctggg

SEQ ID NO: 227402 - DNA, 25 bp, Mus musculus
cagcagcatggaagtgtgattttaa

SEQ ID NO: 227403 - DNA, 25 bp, Mus musculus
cagcagcatggaagtgttctgtacc

SEQ ID NO: 227404 - DNA, 25 bp, Mus musculus
cagcagcatggctacaaaatgcaca

SEQ ID NO: 227405 - DNA, 25 bp, Mus musculus
cagcagcattagattgtcttcgatc

SEQ ID NO: 227406 - DNA, 25 bp, Mus musculus
cagcagccaaggacacttagcctgt

SEQ ID NO: 227407 - DNA, 25 bp, Mus musculus
cagcagccacagagggagggagctt

SEQ ID NO: 227408 - DNA, 25 bp, Mus musculus
cagcagccacagcgggcagctcagt

SEQ ID NO: 227409 - DNA, 25 bp, Mus musculus
cagcagccagaaatctcataagcgc

SEQ ID NO: 227410 - DNA, 25 bp, Mus musculus
cagcagccagaatgaaggcttgact

SEQ ID NO: 227411 - DNA, 25 bp, Mus musculus
cagcagccagatgaaggtctgacag

SEQ ID NO: 227412 - DNA, 25 bp, Mus musculus
cagcagccagggccggccctcgaac

SEQ ID NO: 227413 - DNA, 25 bp, Mus musculus
cagcagccagggtcggccctcgaac

SEQ ID NO: 227414 - DNA, 25 bp, Mus musculus
cagcagccattaaagatttcattat

SEQ ID NO: 227415 - DNA, 25 bp, Mus musculus
cagcagcccagaccctacaagtacc

SEQ ID NO: 227416 - DNA, 25 bp, Mus musculus
cagcagcccagagcaatcaggtggt

SEQ ID NO: 227417 - DNA, 25 bp, Mus musculus
cagcagcccagatctactcttcagc

SEQ ID NO: 227418 - DNA, 25 bp, Mus musculus
cagcagcccagcccactgagtgttt

SEQ ID NO: 227419 - DNA, 25 bp, Mus musculus
cagcagcccagggtcaggtacctgg

SEQ ID NO: 227420 - DNA, 25 bp, Mus musculus
cagcagcccagggttggaagctgtg

SEQ ID NO: 227421 - DNA, 25 bp, Mus musculus
cagcagcccagtgtcacgagcaaga

SEQ ID NO: 227422 - DNA, 25 bp, Mus musculus
cagcagcccatacaatcctcctgat

SEQ ID NO: 227423 - DNA, 25 bp, Mus musculus
cagcagccctggtgtctgagagcaa

SEQ ID NO: 227424 - DNA, 25 bp, Mus musculus
cagcagccctgtttgatctgtggat

SEQ ID NO: 227425 - DNA, 25 bp, Mus musculus
cagcagccgagagtacaaacaggcc

SEQ ID NO: 227426 - DNA, 25 bp, Mus musculus
cagcagccgcccctgccttagactt

SEQ ID NO: 227427 - DNA, 25 bp, Mus musculus
cagcagccggaggggcacacaaaga

SEQ ID NO: 227428 - DNA, 25 bp, Mus musculus
cagcagccggaggtgtgtttcatag

SEQ ID NO: 227429 - DNA, 25 bp, Mus musculus
cagcagccggagtttgaagaggaca

SEQ ID NO: 227430 - DNA, 25 bp, Mus musculus
cagcagcctaaaaaagggcaagaaa

SEQ ID NO: 227431 - DNA, 25 bp, Mus musculus
cagcagcctaaataagggcaagaaa

SEQ ID NO: 227432 - DNA, 25 bp, Mus musculus
cagcagcctgaaaatgccacctcgg

SEQ ID NO: 227433 - DNA, 25 bp, Mus musculus
cagcagcctttaccagccctttggg

SEQ ID NO: 227434 - DNA, 25 bp, Mus musculus
cagcagcctttggcctctctgtccc

SEQ ID NO: 227435 - DNA, 25 bp, Mus musculus
cagcagcctttggtgcgcccggcat

SEQ ID NO: 227436 - DNA, 25 bp, Mus musculus
cagcagcgaaatgaccagcccatca

SEQ ID NO: 227437 - DNA, 25 bp, Mus musculus
cagcagcgaaatggttgtactttcc

SEQ ID NO: 227438 - DNA, 25 bp, Mus musculus
cagcagcgaaatggttgtactttct

SEQ ID NO: 227439 - DNA, 25 bp, Mus musculus
cagcagcgagcagatgtctcatttc

SEQ ID NO: 227440 - DNA, 25 bp, Mus musculus
cagcagcgagtcagtaccatctgcc

SEQ ID NO: 227441 - DNA, 25 bp, Mus musculus
cagcagcgcaagaccttcacagcct

SEQ ID NO: 227442 - DNA, 25 bp, Mus musculus
cagcagcgcagcctcaggctggcta

SEQ ID NO: 227443 - DNA, 25 bp, Mus musculus
cagcagcgcccggacgtcctcccca

SEQ ID NO: 227444 - DNA, 25 bp, Mus musculus
cagcagcggcaggaggatgagtctg

SEQ ID NO: 227445 - DNA, 25 bp, Mus musculus
cagcagcggcgagagatgctcagag

SEQ ID NO: 227446 - DNA, 25 bp, Mus musculus
cagcagcgggtttgggtctgtacac

SEQ ID NO: 227447 - DNA, 25 bp, Mus musculus
cagcagcgtcatggagatgctcaga

SEQ ID NO: 227448 - DNA, 25 bp, Mus musculus
cagcagctcagggactcagcgatgt

SEQ ID NO: 227449 - DNA, 25 bp, Mus musculus
cagcagctccacacaatatgacgtg

SEQ ID NO: 227450 - DNA, 25 bp, Mus musculus
cagcagctcccaggaggttcatgag

SEQ ID NO: 227451 - DNA, 25 bp, Mus musculus
cagcagctctattggctaatgggcc

SEQ ID NO: 227452 - DNA, 25 bp, Mus musculus
cagcagctctgacagttccaggagg

SEQ ID NO: 227453 - DNA, 25 bp, Mus musculus
cagcagctgaacagaaaatgtatcc

SEQ ID NO: 227454 - DNA, 25 bp, Mus musculus
cagcagctgaagtccgcacagagtg

SEQ ID NO: 227455 - DNA, 25 bp, Mus musculus
cagcagctgaatggttaccacaagc

SEQ ID NO: 227456 - DNA, 25 bp, Mus musculus
cagcagctgacccagatatatttgt

SEQ ID NO: 227457 - DNA, 25 bp, Mus musculus
cagcagctgacccaggacatttgac

SEQ ID NO: 227458 - DNA, 25 bp, Mus musculus
cagcagctgacccagtttgctgaga

SEQ ID NO: 227459 - DNA, 25 bp, Mus musculus
cagcagctgaggcagagaaaaggca

SEQ ID NO: 227460 - DNA, 25 bp, Mus musculus
cagcagctgaggcagggtcagaaag

SEQ ID NO: 227461 - DNA, 25 bp, Mus musculus
cagcagctgctgaccacactgggtc

SEQ ID NO: 227462 - DNA, 25 bp, Mus musculus
cagcagctgctggcaggctgcatgc

SEQ ID NO: 227463 - DNA, 25 bp, Mus musculus
cagcagctggcccaggcctccagga

SEQ ID NO: 227464 - DNA, 25 bp, Mus musculus
cagcagctgggaaagggagccttta

SEQ ID NO: 227465 - DNA, 25 bp, Mus musculus
cagcagctgtaaggagcttcaccct

SEQ ID NO: 227466 - DNA, 25 bp, Mus musculus
cagcagctgtcaaggaactgaatgc

SEQ ID NO: 227467 - DNA, 25 bp, Mus musculus
cagcagcttagagaagctgatggtc

SEQ ID NO: 227468 - DNA, 25 bp, Mus musculus
cagcagcttagatggcaggcatgcc

SEQ ID NO: 227469 - DNA, 25 bp, Mus musculus
cagcagcttagggatacaagttgat

SEQ ID NO: 227470 - DNA, 25 bp, Mus musculus
cagcagcttcatcaggaatggcctt

SEQ ID NO: 227471 - DNA, 25 bp, Mus musculus
cagcagcttcatcaggagcaagagc

SEQ ID NO: 227472 - DNA, 25 bp, Mus musculus
cagcagcttccagaaccacgtcaac

SEQ ID NO: 227473 - DNA, 25 bp, Mus musculus
cagcagcttccagatttgtctcaaa

SEQ ID NO: 227474 - DNA, 25 bp, Mus musculus
cagcagcttccaggcgtccgcgagt

SEQ ID NO: 227475 - DNA, 25 bp, Mus musculus
cagcagcttggtctgggaacgtaat

SEQ ID NO: 227476 - DNA, 25 bp, Mus musculus
cagcaggaacgattcaatcccaaga

SEQ ID NO: 227477 - DNA, 25 bp, Mus musculus
cagcaggaacgtatatgactgctgc

SEQ ID NO: 227478 - DNA, 25 bp, Mus musculus
cagcaggaagaatttcagcatatgt

SEQ ID NO: 227479 - DNA, 25 bp, Mus musculus
cagcaggaagacaggaagatctgtg

SEQ ID NO: 227480 - DNA, 25 bp, Mus musculus
cagcaggaagcctgtgcccagtata

SEQ ID NO: 227481 - DNA, 25 bp, Mus musculus
cagcaggaagcgcatccagtatgga

SEQ ID NO: 227482 - DNA, 25 bp, Mus musculus
cagcaggaagcgtcccaggttcctg

SEQ ID NO: 227483 - DNA, 25 bp, Mus musculus
cagcaggaaggaaagaaaggagagg

SEQ ID NO: 227484 - DNA, 25 bp, Mus musculus
cagcaggaaggaggatgctgtcctt

SEQ ID NO: 227485 - DNA, 25 bp, Mus musculus
cagcaggaagggtgagtttttctca

SEQ ID NO: 227486 - DNA, 25 bp, Mus musculus
cagcaggaaggtgctgtataatgtg

SEQ ID NO: 227487 - DNA, 25 bp, Mus musculus
cagcaggaagtaaaatctctttgtg

SEQ ID NO: 227488 - DNA, 25 bp, Mus musculus
cagcaggaagtatggaagcttctct

SEQ ID NO: 227489 - DNA, 25 bp, Mus musculus
cagcaggaagtgaggtggaagaaaa

SEQ ID NO: 227490 - DNA, 25 bp, Mus musculus
cagcaggaatgaaagatttatgata

SEQ ID NO: 227491 - DNA, 25 bp, Mus musculus
cagcaggaatgaaaggtttcaacag

SEQ ID NO: 227492 - DNA, 25 bp, Mus musculus
cagcaggacaaagaccaaggattac

SEQ ID NO: 227493 - DNA, 25 bp, Mus musculus
cagcaggacaaagagactgcatcga

SEQ ID NO: 227494 - DNA, 25 bp, Mus musculus
cagcaggacgtggtgacagagttag

SEQ ID NO: 227495 - DNA, 25 bp, Mus musculus
cagcaggactccagagatcccgatg

SEQ ID NO: 227496 - DNA, 25 bp, Mus musculus
cagcaggactcggatgaggccatcc

SEQ ID NO: 227497 - DNA, 25 bp, Mus musculus
cagcaggagccagggatgccctgct

SEQ ID NO: 227498 - DNA, 25 bp, Mus musculus
cagcaggagcgcaggttcctcatga

SEQ ID NO: 227499 - DNA, 25 bp, Mus musculus
cagcaggaggagcagacgggcagcg

SEQ ID NO: 227500 - DNA, 25 bp, Mus musculus
cagcaggaggagcaggatatcctca

SEQ ID NO: 227501 - DNA, 25 bp, Mus musculus
cagcaggagttgaggacctgtttac

SEQ ID NO: 227502 - DNA, 25 bp, Mus musculus
cagcaggataaaggcataatcaacc

SEQ ID NO: 227503 - DNA, 25 bp, Mus musculus
cagcaggatcagatgcgatacaacc

SEQ ID NO: 227504 - DNA, 25 bp, Mus musculus
cagcaggatcaggagctggtgggga

SEQ ID NO: 227505 - DNA, 25 bp, Mus musculus
cagcaggatcgcatgggctaccagc

SEQ ID NO: 227506 - DNA, 25 bp, Mus musculus
cagcaggatggaagagaagctgaag

SEQ ID NO: 227507 - DNA, 25 bp, Mus musculus
cagcaggatggccagacgggcagcg

SEQ ID NO: 227508 - DNA, 25 bp, Mus musculus
cagcaggatggccagctaccatatt

SEQ ID NO: 227509 - DNA, 25 bp, Mus musculus
cagcaggatggccaggatatcctca

SEQ ID NO: 227510 - DNA, 25 bp, Mus musculus
cagcaggatggccagtttgtccctt

SEQ ID NO: 227511 - DNA, 25 bp, Mus musculus
cagcaggatgtcgatcagatgtttt

SEQ ID NO: 227512 - DNA, 25 bp, Mus musculus
cagcaggcacgcagggcagaagtcg

SEQ ID NO: 227513 - DNA, 25 bp, Mus musculus
cagcaggcagccagcccagtgggca

SEQ ID NO: 227514 - DNA, 25 bp, Mus musculus
cagcaggcagctgccagaccctcta

SEQ ID NO: 227515 - DNA, 25 bp, Mus musculus
cagcaggcatgggtaggatttgcgg

SEQ ID NO: 227516 - DNA, 25 bp, Mus musculus
cagcaggccaactctacaatggctt

SEQ ID NO: 227517 - DNA, 25 bp, Mus musculus
cagcaggccacaggcaatgtgagca

SEQ ID NO: 227518 - DNA, 25 bp, Mus musculus
cagcaggccgcgctagaaaatgcta

SEQ ID NO: 227519 - DNA, 25 bp, Mus musculus
cagcaggccgggggacagtaaatcc

SEQ ID NO: 227520 - DNA, 25 bp, Mus musculus
cagcaggcggaggtgcgtggtccaa

SEQ ID NO: 227521 - DNA, 25 bp, Mus musculus
cagcaggctacagtcagttctacag

SEQ ID NO: 227522 - DNA, 25 bp, Mus musculus
cagcaggctacagtgactttttcac

SEQ ID NO: 227523 - DNA, 25 bp, Mus musculus
cagcaggctctattcccaactttca

SEQ ID NO: 227524 - DNA, 25 bp, Mus musculus
cagcaggctcttgcatcccctcagc

SEQ ID NO: 227525 - DNA, 25 bp, Mus musculus
cagcagggaagttggggggactctg

SEQ ID NO: 227526 - DNA, 25 bp, Mus musculus
cagcagggacgcccgaggagctcac

SEQ ID NO: 227527 - DNA, 25 bp, Mus musculus
cagcagggagagcagagacggtaag

SEQ ID NO: 227528 - DNA, 25 bp, Mus musculus
cagcagggagcaggatatggttact

SEQ ID NO: 227529 - DNA, 25 bp, Mus musculus
cagcagggcaggatgagtacagcat

SEQ ID NO: 227530 - DNA, 25 bp, Mus musculus
cagcagggcatcaagaagtcaacaa

SEQ ID NO: 227531 - DNA, 25 bp, Mus musculus
cagcagggcatcaagtattggctgg

SEQ ID NO: 227532 - DNA, 25 bp, Mus musculus
cagcagggcttgctgttctcctctt

SEQ ID NO: 227533 - DNA, 25 bp, Mus musculus
cagcaggggtttcaggcagaaaatg

SEQ ID NO: 227534 - DNA, 25 bp, Mus musculus
cagcaggggtttcaggtctgcatta

SEQ ID NO: 227535 - DNA, 25 bp, Mus musculus
cagcagggtcagaccacacccgtga

SEQ ID NO: 227536 - DNA, 25 bp, Mus musculus
cagcagggtcagggactcatgcagt

SEQ ID NO: 227537 - DNA, 25 bp, Mus musculus
cagcaggtaattaacgagatggtgc

SEQ ID NO: 227538 - DNA, 25 bp, Mus musculus
cagcaggtaattagtgaaatggtta

SEQ ID NO: 227539 - DNA, 25 bp, Mus musculus
cagcaggtcccagttgtactgcagc

SEQ ID NO: 227540 - DNA, 25 bp, Mus musculus
cagcaggtccttgaaatcaagatgc

SEQ ID NO: 227541 - DNA, 25 bp, Mus musculus
cagcaggtgagaggccacgattgct

SEQ ID NO: 227542 - DNA, 25 bp, Mus musculus
cagcaggtgcgagaacgcaacctga

SEQ ID NO: 227543 - DNA, 25 bp, Mus musculus
cagcaggtgctgcaggttcttctga

SEQ ID NO: 227544 - DNA, 25 bp, Mus musculus
cagcaggtgctgcagtctcaggact

SEQ ID NO: 227545 - DNA, 25 bp, Mus musculus
cagcaggtggatgatctggagggat

SEQ ID NO: 227546 - DNA, 25 bp, Mus musculus
cagcaggtggcagagaaggaagcca

SEQ ID NO: 227547 - DNA, 25 bp, Mus musculus
cagcaggtggctgaggtaccacgta

SEQ ID NO: 227548 - DNA, 25 bp, Mus musculus
cagcaggttcctgtgtggtggggac

SEQ ID NO: 227549 - DNA, 25 bp, Mus musculus
cagcagtaacaacggcctcagcatc

SEQ ID NO: 227550 - DNA, 25 bp, Mus musculus
cagcagtacagacgaaatgcctgga

SEQ ID NO: 227551 - DNA, 25 bp, Mus musculus
cagcagtacaggccggccacgaaga

SEQ ID NO: 227552 - DNA, 25 bp, Mus musculus
cagcagtacctgaagggaaccccaa

SEQ ID NO: 227553 - DNA, 25 bp, Mus musculus
cagcagtacctgaaggtggagagct

SEQ ID NO: 227554 - DNA, 25 bp, Mus musculus
cagcagtagatgaagtgccagaacc

SEQ ID NO: 227555 - DNA, 25 bp, Mus musculus
cagcagtagcggaaagctgagcagc

SEQ ID NO: 227556 - DNA, 25 bp, Mus musculus
cagcagtatggaaatagtttcttgg

SEQ ID NO: 227557 - DNA, 25 bp, Mus musculus
cagcagtatggaaatgtcctaccct

SEQ ID NO: 227558 - DNA, 25 bp, Mus musculus
cagcagtatggaagtggcttggctg

SEQ ID NO: 227559 - DNA, 25 bp, Mus musculus
cagcagtatggaagtgtttgccgaa

SEQ ID NO: 227560 - DNA, 25 bp, Mus musculus
cagcagtatggaattcttcctttgc

SEQ ID NO: 227561 - DNA, 25 bp, Mus musculus
cagcagtattcctcctgcttctaac

SEQ ID NO: 227562 - DNA, 25 bp, Mus musculus
cagcagtcactgctggggttcgaac

SEQ ID NO: 227563 - DNA, 25 bp, Mus musculus
cagcagtcagagccggcttcggagt

SEQ ID NO: 227564 - DNA, 25 bp, Mus musculus
cagcagtcagcatcaggggcgcatg

SEQ ID NO: 227565 - DNA, 25 bp, Mus musculus
cagcagtcagggcatctgttatgca

SEQ ID NO: 227566 - DNA, 25 bp, Mus musculus
cagcagtccaagaaaacatcgctct

SEQ ID NO: 227567 - DNA, 25 bp, Mus musculus
cagcagtccaagatctgatgttttg

SEQ ID NO: 227568 - DNA, 25 bp, Mus musculus
cagcagtccaagcgctctctcagat

SEQ ID NO: 227569 - DNA, 25 bp, Mus musculus
cagcagtcccgttctgcagacctcc

SEQ ID NO: 227570 - DNA, 25 bp, Mus musculus
cagcagtccctgcaggtgaagaaga

SEQ ID NO: 227571 - DNA, 25 bp, Mus musculus
cagcagtctaaggtgtctgaacaca

SEQ ID NO: 227572 - DNA, 25 bp, Mus musculus
cagcagtctcaccttgtctgtctgc

SEQ ID NO: 227573 - DNA, 25 bp, Mus musculus
cagcagtctgtatgaggattgtggc

SEQ ID NO: 227574 - DNA, 25 bp, Mus musculus
cagcagtgacagtgagagcgggtcc

SEQ ID NO: 227575 - DNA, 25 bp, Mus musculus
cagcagtgcaggaagaacagaggcg

SEQ ID NO: 227576 - DNA, 25 bp, Mus musculus
cagcagtgcccgaattgagagaaaa

SEQ ID NO: 227577 - DNA, 25 bp, Mus musculus
cagcagtgctaattcaggtcttgcc

SEQ ID NO: 227578 - DNA, 25 bp, Mus musculus
cagcagtggaggaagcacctcccac

SEQ ID NO: 227579 - DNA, 25 bp, Mus musculus
cagcagtggaggaagctcatctacg

SEQ ID NO: 227580 - DNA, 25 bp, Mus musculus
cagcagtgggaccaggatggaaaca

SEQ ID NO: 227581 - DNA, 25 bp, Mus musculus
cagcagtgtaaagatattgatgaat

SEQ ID NO: 227582 - DNA, 25 bp, Mus musculus
cagcagtgtgaagggctcaggatgc

SEQ ID NO: 227583 - DNA, 25 bp, Mus musculus
cagcagtgtggaagtctggtcatct

SEQ ID NO: 227584 - DNA, 25 bp, Mus musculus
cagcagtgtggaagttctgcaactg

SEQ ID NO: 227585 - DNA, 25 bp, Mus musculus
cagcagttaagtcaggaaaccaagc

SEQ ID NO: 227586 - DNA, 25 bp, Mus musculus
cagcagttcacgattctcgagcagg

SEQ ID NO: 227587 - DNA, 25 bp, Mus musculus
cagcagttcagtagctatgagccag

SEQ ID NO: 227588 - DNA, 25 bp, Mus musculus
cagcagttgaaaggagaggatgctt

SEQ ID NO: 227589 - DNA, 25 bp, Mus musculus
cagcagttgagaatcccagctggct

SEQ ID NO: 227590 - DNA, 25 bp, Mus musculus
cagcagttgcaaggactggaccagt

SEQ ID NO: 227591 - DNA, 25 bp, Mus musculus
cagcagttgcaaggtaacctccgtg

SEQ ID NO: 227592 - DNA, 25 bp, Mus musculus
cagcagttgcaggaatctcagcaaa

SEQ ID NO: 227593 - DNA, 25 bp, Mus musculus
cagcagtttccggagggactcaaag

SEQ ID NO: 227594 - DNA, 25 bp, Mus musculus
cagcagtttgaaagggtacagtaag

SEQ ID NO: 227595 - DNA, 25 bp, Mus musculus
cagcataaacgatatgtgtcacaaa

SEQ ID NO: 227596 - DNA, 25 bp, Mus musculus
cagcataaagaaggaatcacccact

SEQ ID NO: 227597 - DNA, 25 bp, Mus musculus
cagcataaagatagatgtgctaacg

SEQ ID NO: 227598 - DNA, 25 bp, Mus musculus
cagcataagaggcggtgactccata

SEQ ID NO: 227599 - DNA, 25 bp, Mus musculus
cagcataatattacgcaacatatga

SEQ ID NO: 227600 - DNA, 25 bp, Mus musculus
cagcataatgctaaagaagtaaaca

SEQ ID NO: 227601 - DNA, 25 bp, Mus musculus
cagcatacaagacgagaaggacata

SEQ ID NO: 227602 - DNA, 25 bp, Mus musculus
cagcatacaagggagactctggagg

SEQ ID NO: 227603 - DNA, 25 bp, Mus musculus
cagcatacaaggtcaacatggccat

SEQ ID NO: 227604 - DNA, 25 bp, Mus musculus
cagcatacaagtcctcaagggccct

SEQ ID NO: 227605 - DNA, 25 bp, Mus musculus
cagcatacgggcaccttgttgtgac

SEQ ID NO: 227606 - DNA, 25 bp, Mus musculus
cagcatagaaagtcctcgcgtgtcg

SEQ ID NO: 227607 - DNA, 25 bp, Mus musculus
cagcatagaagtttaccgacaagac

SEQ ID NO: 227608 - DNA, 25 bp, Mus musculus
cagcatagagggactcatgggccgc

SEQ ID NO: 227609 - DNA, 25 bp, Mus musculus
cagcataggacattttccttcccgt

SEQ ID NO: 227610 - DNA, 25 bp, Mus musculus
cagcatagtgaagggcgagcttcac

SEQ ID NO: 227611 - DNA, 25 bp, Mus musculus
cagcatataacaggaacggtcatca

SEQ ID NO: 227612 - DNA, 25 bp, Mus musculus
cagcatataacaggaatttctcttg

SEQ ID NO: 227613 - DNA, 25 bp, Mus musculus
cagcatataattcattttgaccagc

SEQ ID NO: 227614 - DNA, 25 bp, Mus musculus
cagcatattccagatgttctgatgg

SEQ ID NO: 227615 - DNA, 25 bp, Mus musculus
cagcatcaaacaatttgtcgtccta

SEQ ID NO: 227616 - DNA, 25 bp, Mus musculus
cagcatcaaacatggaggaatcgtc

SEQ ID NO: 227617 - DNA, 25 bp, Mus musculus
cagcatcaaagcctgctcccagtga

SEQ ID NO: 227618 - DNA, 25 bp, Mus musculus
cagcatcaaggtggcccggcagatc

SEQ ID NO: 227619 - DNA, 25 bp, Mus musculus
cagcatcacaggaggcacctcacca

SEQ ID NO: 227620 - DNA, 25 bp, Mus musculus
cagcatcaccagcagtgcccggggt

SEQ ID NO: 227621 - DNA, 25 bp, Mus musculus
cagcatcactcaaggagaagctgtg

SEQ ID NO: 227622 - DNA, 25 bp, Mus musculus
cagcatcaggactctcaggtaaatg

SEQ ID NO: 227623 - DNA, 25 bp, Mus musculus
cagcatcaggattgctgaaagacag

SEQ ID NO: 227624 - DNA, 25 bp, Mus musculus
cagcatcagggagccataattccac

SEQ ID NO: 227625 - DNA, 25 bp, Mus musculus
cagcatcagggattgttacagaggg

SEQ ID NO: 227626 - DNA, 25 bp, Mus musculus
cagcatcaggtctccttcccttgaa

SEQ ID NO: 227627 - DNA, 25 bp, Mus musculus
cagcatcatattgaacgagaaaaag

SEQ ID NO: 227628 - DNA, 25 bp, Mus musculus
cagcatcatgatatccgagtggtga

SEQ ID NO: 227629 - DNA, 25 bp, Mus musculus
cagcatcatttaatggtcaggggag

SEQ ID NO: 227630 - DNA, 25 bp, Mus musculus
cagcatccacgcacatgaggaagca

SEQ ID NO: 227631 - DNA, 25 bp, Mus musculus
cagcatccagcagaggaaaggagag

SEQ ID NO: 227632 - DNA, 25 bp, Mus musculus
cagcatccagcagaggtgcagttaa

SEQ ID NO: 227633 - DNA, 25 bp, Mus musculus
cagcatccagtgttgcctgtgcctg

SEQ ID NO: 227634 - DNA, 25 bp, Mus musculus
cagcatccagttcgtgaagagagtg

SEQ ID NO: 227635 - DNA, 25 bp, Mus musculus
cagcatcccctaggacccccactca

SEQ ID NO: 227636 - DNA, 25 bp, Mus musculus
cagcatcccctagggagctccggga

SEQ ID NO: 227637 - DNA, 25 bp, Mus musculus
cagcatcctcagctctgggccccag

SEQ ID NO: 227638 - DNA, 25 bp, Mus musculus
cagcatcctctctgaggtgacccct

SEQ ID NO: 227639 - DNA, 25 bp, Mus musculus
cagcatcctgagcgcgagaactttc

SEQ ID NO: 227640 - DNA, 25 bp, Mus musculus
cagcatcctgccagccaggagacac

SEQ ID NO: 227641 - DNA, 25 bp, Mus musculus
cagcatcgatttgactttattgact

SEQ ID NO: 227642 - DNA, 25 bp, Mus musculus
cagcatcgcaaggaaactcattttc

SEQ ID NO: 227643 - DNA, 25 bp, Mus musculus
cagcatcgcaaggcctctgcaggtg

SEQ ID NO: 227644 - DNA, 25 bp, Mus musculus
cagcatcgcaagggtactggcggag

SEQ ID NO: 227645 - DNA, 25 bp, Mus musculus
cagcatcggtggcggaagctggaat

SEQ ID NO: 227646 - DNA, 25 bp, Mus musculus
cagcatcgtcaagagccgcctgcac

SEQ ID NO: 227647 - DNA, 25 bp, Mus musculus
cagcatcgtggccaagatggacaac

SEQ ID NO: 227648 - DNA, 25 bp, Mus musculus
cagcatcgtgggagggaatagccag

SEQ ID NO: 227649 - DNA, 25 bp, Mus musculus
cagcatctatcaagggagcaccatc

SEQ ID NO: 227650 - DNA, 25 bp, Mus musculus
cagcatctgagagcaaccaggacct

SEQ ID NO: 227651 - DNA, 25 bp, Mus musculus
cagcatctgagaggtggactctgtg

SEQ ID NO: 227652 - DNA, 25 bp, Mus musculus
cagcatctgaggaacaagcaatggc

SEQ ID NO: 227653 - DNA, 25 bp, Mus musculus
cagcatctgaggaagactcttcaat

SEQ ID NO: 227654 - DNA, 25 bp, Mus musculus
cagcatctgatgatggtcgggtgag

SEQ ID NO: 227655 - DNA, 25 bp, Mus musculus
cagcatctgtaatagcaggatgctg

SEQ ID NO: 227656 - DNA, 25 bp, Mus musculus
cagcatctgtaataggtgtgtgctg

SEQ ID NO: 227657 - DNA, 25 bp, Mus musculus
cagcatcttccagtcaaaagaatcc

SEQ ID NO: 227658 - DNA, 25 bp, Mus musculus
cagcatcttcggcttcagtgtgtga

SEQ ID NO: 227659 - DNA, 25 bp, Mus musculus
cagcatcttgacaagacagaggagg

SEQ ID NO: 227660 - DNA, 25 bp, Mus musculus
cagcatcttgctcctgcactggtgc

SEQ ID NO: 227661 - DNA, 25 bp, Mus musculus
cagcatgaaaggatcttctacctgc

SEQ ID NO: 227662 - DNA, 25 bp, Mus musculus
cagcatgactgtgtgtccattgtcc

SEQ ID NO: 227663 - DNA, 25 bp, Mus musculus
cagcatgagagctggattgtcattg

SEQ ID NO: 227664 - DNA, 25 bp, Mus musculus
cagcatgagaggaaccatttgtaac

SEQ ID NO: 227665 - DNA, 25 bp, Mus musculus
cagcatgagttctgaatgtgatgtt

SEQ ID NO: 227666 - DNA, 25 bp, Mus musculus
cagcatgatgttcaaacacttcgac

SEQ ID NO: 227667 - DNA, 25 bp, Mus musculus
cagcatgcaaaattctaaagataaa

SEQ ID NO: 227668 - DNA, 25 bp, Mus musculus
cagcatgcaagagactctgcagatt

SEQ ID NO: 227669 - DNA, 25 bp, Mus musculus
cagcatgcactaggaggaatttggc

SEQ ID NO: 227670 - DNA, 25 bp, Mus musculus
cagcatgcagaacagtcacagcgga

SEQ ID NO: 227671 - DNA, 25 bp, Mus musculus
cagcatgcagggctttcagataaac

SEQ ID NO: 227672 - DNA, 25 bp, Mus musculus
cagcatgcagggtaagcgcaaagca

SEQ ID NO: 227673 - DNA, 25 bp, Mus musculus
cagcatgccgagatggcacgttttg

SEQ ID NO: 227674 - DNA, 25 bp, Mus musculus
cagcatgcgggaggaggacttcatc

SEQ ID NO: 227675 - DNA, 25 bp, Mus musculus
cagcatggaactaagctctggggtc

SEQ ID NO: 227676 - DNA, 25 bp, Mus musculus
cagcatggaagtgtgattttaaaaa

SEQ ID NO: 227677 - DNA, 25 bp, Mus musculus
cagcatggaagtgttctgtacctca

SEQ ID NO: 227678 - DNA, 25 bp, Mus musculus
cagcatggcagaggctcctcttcca

SEQ ID NO: 227679 - DNA, 25 bp, Mus musculus
cagcatggcctcagaagctcgaagc

SEQ ID NO: 227680 - DNA, 25 bp, Mus musculus
cagcatggctcaggaattttattga

SEQ ID NO: 227681 - DNA, 25 bp, Mus musculus
cagcatggctcaggcaagtcttctg

SEQ ID NO: 227682 - DNA, 25 bp, Mus musculus
cagcatgggagagttgcagcttcat

SEQ ID NO: 227683 - DNA, 25 bp, Mus musculus
cagcatgtccagctgcccgagagat

SEQ ID NO: 227684 - DNA, 25 bp, Mus musculus
cagcatgtggtcaaggacttaatgg

SEQ ID NO: 227685 - DNA, 25 bp, Mus musculus
cagcatgtggtcaaggttcttgcag

SEQ ID NO: 227686 - DNA, 25 bp, Mus musculus
cagcatgtgtcatctttccaaagaa

SEQ ID NO: 227687 - DNA, 25 bp, Mus musculus
cagcattaacaggagaagggaagaa

SEQ ID NO: 227688 - DNA, 25 bp, Mus musculus
cagcattaaggctcggctattagcc

SEQ ID NO: 227689 - DNA, 25 bp, Mus musculus
cagcattactcagagaaagctgatg

SEQ ID NO: 227690 - DNA, 25 bp, Mus musculus
cagcattactcagagagagccgcag

SEQ ID NO: 227691 - DNA, 25 bp, Mus musculus
cagcattagaggagctgaccaaggc

SEQ ID NO: 227692 - DNA, 25 bp, Mus musculus
cagcattcagaagatgacttacaag

SEQ ID NO: 227693 - DNA, 25 bp, Mus musculus
cagcattcagacaagattttcgaaa

SEQ ID NO: 227694 - DNA, 25 bp, Mus musculus
cagcattcaggtcaaggaagctgac

SEQ ID NO: 227695 - DNA, 25 bp, Mus musculus
cagcattctcctggtgcagatcact

SEQ ID NO: 227696 - DNA, 25 bp, Mus musculus
cagcattcttaatttaccgagagaa

SEQ ID NO: 227697 - DNA, 25 bp, Mus musculus
cagcattgcccaggtgcactggagt

SEQ ID NO: 227698 - DNA, 25 bp, Mus musculus
cagcattgctgaggttgaaaatgag

SEQ ID NO: 227699 - DNA, 25 bp, Mus musculus
cagcattggaagagtgtatcctcag

SEQ ID NO: 227700 - DNA, 25 bp, Mus musculus
cagcattggatcttctgcgtgctgg

SEQ ID NO: 227701 - DNA, 25 bp, Mus musculus
cagcattggatcttttgggatgact

SEQ ID NO: 227702 - DNA, 25 bp, Mus musculus
cagcattgtaggagcagtttctcca

SEQ ID NO: 227703 - DNA, 25 bp, Mus musculus
cagcattgtccaggagcgccccttg

SEQ ID NO: 227704 - DNA, 25 bp, Mus musculus
cagcattgtgaaagctcgtccctgc

SEQ ID NO: 227705 - DNA, 25 bp, Mus musculus
cagcattgtgaaagggcagcggagc

SEQ ID NO: 227706 - DNA, 25 bp, Mus musculus
cagcattgtgagagctgtggaacga

SEQ ID NO: 227707 - DNA, 25 bp, Mus musculus
cagcattgtgagagtgaaaagcttt

SEQ ID NO: 227708 - DNA, 25 bp, Mus musculus
cagcatttctcaaaaactgttctgc

SEQ ID NO: 227709 - DNA, 25 bp, Mus musculus
cagcatttctcaaatcatctgaaaa

SEQ ID NO: 227710 - DNA, 25 bp, Mus musculus
cagcatttgattaaagcaccgtgaa

SEQ ID NO: 227711 - DNA, 25 bp, Mus musculus
cagcatttggcagagagcactcccc

SEQ ID NO: 227712 - DNA, 25 bp, Mus musculus
cagcatttgggggagagcacggtca

SEQ ID NO: 227713 - DNA, 25 bp, Mus musculus
cagcatttgtcctgggaacagaaat

SEQ ID NO: 227714 - DNA, 25 bp, Mus musculus
cagcattttctggggaatgaattcc

SEQ ID NO: 227715 - DNA, 25 bp, Mus musculus
cagcattttcttggggctccagcct

SEQ ID NO: 227716 - DNA, 25 bp, Mus musculus
cagcatttttcaggtcacctgccct

SEQ ID NO: 227717 - DNA, 25 bp, Mus musculus
cagcatttttcagtccaaagaatca

SEQ ID NO: 227718 - DNA, 25 bp, Mus musculus
cagccaaacagcccatcacggtgca

SEQ ID NO: 227719 - DNA, 25 bp, Mus musculus
cagccaaacatgatactggatgatg

SEQ ID NO: 227720 - DNA, 25 bp, Mus musculus
cagccaaagaccttgagttgctgga

SEQ ID NO: 227721 - DNA, 25 bp, Mus musculus
cagccaaagctgaatcgcggctgga

SEQ ID NO: 227722 - DNA, 25 bp, Mus musculus
cagccaaagctgagagacacagaag

SEQ ID NO: 227723 - DNA, 25 bp, Mus musculus
cagccaaatccccagtgaatggaac

SEQ ID NO: 227724 - DNA, 25 bp, Mus musculus
cagccaacaaatgcctcaaggagaa

SEQ ID NO: 227725 - DNA, 25 bp, Mus musculus
cagccaacaagatgtcatggcaccc

SEQ ID NO: 227726 - DNA, 25 bp, Mus musculus
cagccaacaaggacaaagtcggtgt

SEQ ID NO: 227727 - DNA, 25 bp, Mus musculus
cagccaacagaacctgagccagtca

SEQ ID NO: 227728 - DNA, 25 bp, Mus musculus
cagccaacagagcttggccagagtc

SEQ ID NO: 227729 - DNA, 25 bp, Mus musculus
cagccaacaggtcagaccaagccac

SEQ ID NO: 227730 - DNA, 25 bp, Mus musculus
cagccaacagtgcaacatagattcc

SEQ ID NO: 227731 - DNA, 25 bp, Mus musculus
cagccaaccagacatgccatgtcgg

SEQ ID NO: 227732 - DNA, 25 bp, Mus musculus
cagccaaccagatacccataatatc

SEQ ID NO: 227733 - DNA, 25 bp, Mus musculus
cagccaaccagcggaaatgtgagcg

SEQ ID NO: 227734 - DNA, 25 bp, Mus musculus
cagccaacccagatcaggcgtcaga

SEQ ID NO: 227735 - DNA, 25 bp, Mus musculus
cagccaacggaggccggctggcatc

SEQ ID NO: 227736 - DNA, 25 bp, Mus musculus
cagccaacgggattggtcgcctggt

SEQ ID NO: 227737 - DNA, 25 bp, Mus musculus
cagccaagaagaccaccaagttttt

SEQ ID NO: 227738 - DNA, 25 bp, Mus musculus
cagccaagaaggccagcaccctgcg

SEQ ID NO: 227739 - DNA, 25 bp, Mus musculus
cagccaagaagtcagactgtgttgt

SEQ ID NO: 227740 - DNA, 25 bp, Mus musculus
cagccaagaagtcaggacaaaagac

SEQ ID NO: 227741 - DNA, 25 bp, Mus musculus
cagccaagcatccaaatatccaggg

SEQ ID NO: 227742 - DNA, 25 bp, Mus musculus
cagccaagcatccagaaggacattc

SEQ ID NO: 227743 - DNA, 25 bp, Mus musculus
cagccaagccgcaggcatgaggtga

SEQ ID NO: 227744 - DNA, 25 bp, Mus musculus
cagccaagccgctgcccagactaca

SEQ ID NO: 227745 - DNA, 25 bp, Mus musculus
cagccaagctcagagtgcctgctca

SEQ ID NO: 227746 - DNA, 25 bp, Mus musculus
cagccaaggaaaggtaccgagctta

SEQ ID NO: 227747 - DNA, 25 bp, Mus musculus
cagccaaggaaggagggtctctaat

SEQ ID NO: 227748 - DNA, 25 bp, Mus musculus
cagccaaggcaggatggaaccgcgc

SEQ ID NO: 227749 - DNA, 25 bp, Mus musculus
cagccaaggcatgagacactgcccc

SEQ ID NO: 227750 - DNA, 25 bp, Mus musculus
cagccaaggcatggtcttttcccta

SEQ ID NO: 227751 - DNA, 25 bp, Mus musculus
cagccaaggcttaggcatcgtcttc

SEQ ID NO: 227752 - DNA, 25 bp, Mus musculus
cagccaagggcaggcatcagaaaca

SEQ ID NO: 227753 - DNA, 25 bp, Mus musculus
cagccaagtggaccattgacctgaa

SEQ ID NO: 227754 - DNA, 25 bp, Mus musculus
cagccaagtggaccccacagagcag

SEQ ID NO: 227755 - DNA, 25 bp, Mus musculus
cagccaatcagataattctgaaata

SEQ ID NO: 227756 - DNA, 25 bp, Mus musculus
cagccaatgagaaagagaaaactgc

SEQ ID NO: 227757 - DNA, 25 bp, Mus musculus
cagccaatgccaacgccacgccttc

SEQ ID NO: 227758 - DNA, 25 bp, Mus musculus
cagccaatgctgagagcaactgtgg

SEQ ID NO: 227759 - DNA, 25 bp, Mus musculus
cagccaatgctgaggatgcccaaga

SEQ ID NO: 227760 - DNA, 25 bp, Mus musculus
cagccaattgcctgtgatggtgtgg

SEQ ID NO: 227761 - DNA, 25 bp, Mus musculus
cagccacaacaccaaactttaagaa

SEQ ID NO: 227762 - DNA, 25 bp, Mus musculus
cagccacacagagccagacctagaa

SEQ ID NO: 227763 - DNA, 25 bp, Mus musculus
cagccacaccggacggtgggattgt

SEQ ID NO: 227764 - DNA, 25 bp, Mus musculus
cagccacaccggacgtgggaagctg

SEQ ID NO: 227765 - DNA, 25 bp, Mus musculus
cagccacacgaatctgcagaagaag

SEQ ID NO: 227766 - DNA, 25 bp, Mus musculus
cagccacacggaatacccggaggcc

SEQ ID NO: 227767 - DNA, 25 bp, Mus musculus
cagccacacggtgcagcacagtgcc

SEQ ID NO: 227768 - DNA, 25 bp, Mus musculus
cagccacactcagggcaggaggacc

SEQ ID NO: 227769 - DNA, 25 bp, Mus musculus
cagccacactcagggcgcttattcg

SEQ ID NO: 227770 - DNA, 25 bp, Mus musculus
cagccacagccgcgaccatagtctg

SEQ ID NO: 227771 - DNA, 25 bp, Mus musculus
cagccacagccgcgcctggtgcagc

SEQ ID NO: 227772 - DNA, 25 bp, Mus musculus
cagccacatcgcaaggggctccacg

SEQ ID NO: 227773 - DNA, 25 bp, Mus musculus
cagccaccaaggacggaattaaagc

SEQ ID NO: 227774 - DNA, 25 bp, Mus musculus
cagccaccaaggtgacagcttcctc

SEQ ID NO: 227775 - DNA, 25 bp, Mus musculus
cagccaccaagtgctgagggttatc

SEQ ID NO: 227776 - DNA, 25 bp, Mus musculus
cagccaccaccacctcctcgccctc

SEQ ID NO: 227777 - DNA, 25 bp, Mus musculus
cagccaccagaggatgacagaggag

SEQ ID NO: 227778 - DNA, 25 bp, Mus musculus
cagccaccagaggtgatccaacagt

SEQ ID NO: 227779 - DNA, 25 bp, Mus musculus
cagccaccagcccctgcccggatgg

SEQ ID NO: 227780 - DNA, 25 bp, Mus musculus
cagccaccccgaggtcaggacgacc

SEQ ID NO: 227781 - DNA, 25 bp, Mus musculus
cagccaccctccagggatacggaca

SEQ ID NO: 227782 - DNA, 25 bp, Mus musculus
cagccaccgagactccagacctcga

SEQ ID NO: 227783 - DNA, 25 bp, Mus musculus
cagccaccgagccgtcaagctgaac

SEQ ID NO: 227784 - DNA, 25 bp, Mus musculus
cagccaccgcacctgcgggaggcaa

SEQ ID NO: 227785 - DNA, 25 bp, Mus musculus
cagccaccgcgctcatgcgtgctcc

SEQ ID NO: 227786 - DNA, 25 bp, Mus musculus
cagccacctattgacccaaggatgt

SEQ ID NO: 227787 - DNA, 25 bp, Mus musculus
cagccacgatgagtgaacagagtat

SEQ ID NO: 227788 - DNA, 25 bp, Mus musculus
cagccactagacggttcttcatgag

SEQ ID NO: 227789 - DNA, 25 bp, Mus musculus
cagccactccagctcccggcaactt

SEQ ID NO: 227790 - DNA, 25 bp, Mus musculus
cagccactgaaagactcgccagtga

SEQ ID NO: 227791 - DNA, 25 bp, Mus musculus
cagccactgcaaggggagcagcgcg

SEQ ID NO: 227792 - DNA, 25 bp, Mus musculus
cagccactgggttgccaagaagttg

SEQ ID NO: 227793 - DNA, 25 bp, Mus musculus
cagccacttactacaatttctgaag

SEQ ID NO: 227794 - DNA, 25 bp, Mus musculus
cagccagaacccagctaacagagaa

SEQ ID NO: 227795 - DNA, 25 bp, Mus musculus
cagccagaacccgattcatcagtgg

SEQ ID NO: 227796 - DNA, 25 bp, Mus musculus
cagccagaacccgcctagtgatgag

SEQ ID NO: 227797 - DNA, 25 bp, Mus musculus
cagccagaacccgtcttttcatctc

SEQ ID NO: 227798 - DNA, 25 bp, Mus musculus
cagccagaagaatatccagttatgg

SEQ ID NO: 227799 - DNA, 25 bp, Mus musculus
cagccagaagaattggctggacccc

SEQ ID NO: 227800 - DNA, 25 bp, Mus musculus
cagccagaagagatcctcagctctc

SEQ ID NO: 227801 - DNA, 25 bp, Mus musculus
cagccagaagagccatggcgagtgc

SEQ ID NO: 227802 - DNA, 25 bp, Mus musculus
cagccagaagcaaacgatggaggct

SEQ ID NO: 227803 - DNA, 25 bp, Mus musculus
cagccagaagcaaagggtgtgagtt

SEQ ID NO: 227804 - DNA, 25 bp, Mus musculus
cagccagaaggtagcccctggaact

SEQ ID NO: 227805 - DNA, 25 bp, Mus musculus
cagccagacagagtccggccacaag

SEQ ID NO: 227806 - DNA, 25 bp, Mus musculus
cagccagagaccgagggagggagcc

SEQ ID NO: 227807 - DNA, 25 bp, Mus musculus
cagccagagcaaagtaaagacattt

SEQ ID NO: 227808 - DNA, 25 bp, Mus musculus
cagccagaggcagagtgaagaaatc

SEQ ID NO: 227809 - DNA, 25 bp, Mus musculus
cagccagatgaacagggagcattgg

SEQ ID NO: 227810 - DNA, 25 bp, Mus musculus
cagccagatgaacagttaatgtctg

SEQ ID NO: 227811 - DNA, 25 bp, Mus musculus
cagccagcaagaaaccgaagaaaac

SEQ ID NO: 227812 - DNA, 25 bp, Mus musculus
cagccagcaagtggatctggcgagt

SEQ ID NO: 227813 - DNA, 25 bp, Mus musculus
cagccagcacatctcagccagtgag

SEQ ID NO: 227814 - DNA, 25 bp, Mus musculus
cagccagcaccagcactgcccccca

SEQ ID NO: 227815 - DNA, 25 bp, Mus musculus
cagccagcagcagatcccagagtcc

SEQ ID NO: 227816 - DNA, 25 bp, Mus musculus
cagccagcagcagattttgtggccc

SEQ ID NO: 227817 - DNA, 25 bp, Mus musculus
cagccagcagcatggctacaaaatg

SEQ ID NO: 227818 - DNA, 25 bp, Mus musculus
cagccagcagcatgtgtttcagtgt

SEQ ID NO: 227819 - DNA, 25 bp, Mus musculus
cagccagcagccagaaatctcataa

SEQ ID NO: 227820 - DNA, 25 bp, Mus musculus
cagccagcatagagggactcatggg

SEQ ID NO: 227821 - DNA, 25 bp, Mus musculus
cagccagccagagaaagaagtggcg

SEQ ID NO: 227822 - DNA, 25 bp, Mus musculus
cagccagccagctttcagctggccg

SEQ ID NO: 227823 - DNA, 25 bp, Mus musculus
cagccagccaggcctgtccaccatc

SEQ ID NO: 227824 - DNA, 25 bp, Mus musculus
cagccagccagggtcccaaaggccg

SEQ ID NO: 227825 - DNA, 25 bp, Mus musculus
cagccagcccaggtgcatacacaga

SEQ ID NO: 227826 - DNA, 25 bp, Mus musculus
cagccagcccaggttttacttgggg

SEQ ID NO: 227827 - DNA, 25 bp, Mus musculus
cagccagccgaccaggaactaggaa

SEQ ID NO: 227828 - DNA, 25 bp, Mus musculus
cagccagcctattcttttacttttg

SEQ ID NO: 227829 - DNA, 25 bp, Mus musculus
cagccagcctcctgggtgttctctt

SEQ ID NO: 227830 - DNA, 25 bp, Mus musculus
cagccagcctcctgggttggctgca

SEQ ID NO: 227831 - DNA, 25 bp, Mus musculus
cagccagcgtagaagatccaggtgc

SEQ ID NO: 227832 - DNA, 25 bp, Mus musculus
cagccagctacagatgcagactcag

SEQ ID NO: 227833 - DNA, 25 bp, Mus musculus
cagccagctcgctgagcctgttcct

SEQ ID NO: 227834 - DNA, 25 bp, Mus musculus
cagccagctgacgctgagagggcct

SEQ ID NO: 227835 - DNA, 25 bp, Mus musculus
cagccagctggctttttctaaaagc

SEQ ID NO: 227836 - DNA, 25 bp, Mus musculus
cagccagctgggagggcgtggagct

SEQ ID NO: 227837 - DNA, 25 bp, Mus musculus
cagccagctgttgaggaccctgtcc

SEQ ID NO: 227838 - DNA, 25 bp, Mus musculus
cagccaggaagaaaggaaaatcaga

SEQ ID NO: 227839 - DNA, 25 bp, Mus musculus
cagccaggaatgccatttatgtcgt

SEQ ID NO: 227840 - DNA, 25 bp, Mus musculus
cagccaggacacagaccgtgctgga

SEQ ID NO: 227841 - DNA, 25 bp, Mus musculus
cagccaggagacacgagattccggg

SEQ ID NO: 227842 - DNA, 25 bp, Mus musculus
cagccaggagacacgggacgctgta

SEQ ID NO: 227843 - DNA, 25 bp, Mus musculus
cagccaggagagaatctgggagcag

SEQ ID NO: 227844 - DNA, 25 bp, Mus musculus
cagccaggagcacagatctgggagc

SEQ ID NO: 227845 - DNA, 25 bp, Mus musculus
cagccaggagctatcctctgaactc

SEQ ID NO: 227846 - DNA, 25 bp, Mus musculus
cagccaggaggctctgcagaagctc

SEQ ID NO: 227847 - DNA, 25 bp, Mus musculus
cagccaggagggagcggacatggac

SEQ ID NO: 227848 - DNA, 25 bp, Mus musculus
cagccaggatctgagtgttcgagag

SEQ ID NO: 227849 - DNA, 25 bp, Mus musculus
cagccaggatgaggtagatgacttc

SEQ ID NO: 227850 - DNA, 25 bp, Mus musculus
cagccaggcccttcgggagcagatg

SEQ ID NO: 227851 - DNA, 25 bp, Mus musculus
cagccaggccgcaggcatcaatact

SEQ ID NO: 227852 - DNA, 25 bp, Mus musculus
cagccaggcctgtccaccatcacag

SEQ ID NO: 227853 - DNA, 25 bp, Mus musculus
cagccaggcgatgacgtggtctcca

SEQ ID NO: 227854 - DNA, 25 bp, Mus musculus
cagccaggcgcaacctgcgggaggc

SEQ ID NO: 227855 - DNA, 25 bp, Mus musculus
cagccaggcgcggcgggatatgtgg

SEQ ID NO: 227856 - DNA, 25 bp, Mus musculus
cagccaggcgtcccaaaaagcctct

SEQ ID NO: 227857 - DNA, 25 bp, Mus musculus
cagccaggggcgagagggagctgct

SEQ ID NO: 227858 - DNA, 25 bp, Mus musculus
cagccagggtcggccctcgaacatg

SEQ ID NO: 227859 - DNA, 25 bp, Mus musculus
cagccaggtaagaatctacccagca

SEQ ID NO: 227860 - DNA, 25 bp, Mus musculus
cagccaggtaccaggatttccaatt

SEQ ID NO: 227861 - DNA, 25 bp, Mus musculus
cagccaggtaccaggcatacttctc

SEQ ID NO: 227862 - DNA, 25 bp, Mus musculus
cagccaggtacctgatgtgatggtg

SEQ ID NO: 227863 - DNA, 25 bp, Mus musculus
cagccagtaacagcacccaggcaga

SEQ ID NO: 227864 - DNA, 25 bp, Mus musculus
cagccagtaattgggtgctgtacct

SEQ ID NO: 227865 - DNA, 25 bp, Mus musculus
cagccagtatttcaggagcctcttt

SEQ ID NO: 227866 - DNA, 25 bp, Mus musculus
cagccagtatttcaggcaggcaacc

SEQ ID NO: 227867 - DNA, 25 bp, Mus musculus
cagccagtcagccaggttcaataag

SEQ ID NO: 227868 - DNA, 25 bp, Mus musculus
cagccagtccaggcgcctctagcag

SEQ ID NO: 227869 - DNA, 25 bp, Mus musculus
cagccagtccagtagctccatcaac

SEQ ID NO: 227870 - DNA, 25 bp, Mus musculus
cagccagtccgggaacccagtgcac

SEQ ID NO: 227871 - DNA, 25 bp, Mus musculus
cagccagtccgtaaaagctctttgt

SEQ ID NO: 227872 - DNA, 25 bp, Mus musculus
cagccatacatccggggactgagtg

SEQ ID NO: 227873 - DNA, 25 bp, Mus musculus
cagccatacggacacatgtgctgaa

SEQ ID NO: 227874 - DNA, 25 bp, Mus musculus
cagccatacggagtgagcctgtgac

SEQ ID NO: 227875 - DNA, 25 bp, Mus musculus
cagccatcaactggaccctcattca

SEQ ID NO: 227876 - DNA, 25 bp, Mus musculus
cagccatcagggaagatacattgtg

SEQ ID NO: 227877 - DNA, 25 bp, Mus musculus
cagccatcagggaagcttccctgtt

SEQ ID NO: 227878 - DNA, 25 bp, Mus musculus
cagccatcatcacaggtattccagc

SEQ ID NO: 227879 - DNA, 25 bp, Mus musculus
cagccatccaaggatgaggccatcc

SEQ ID NO: 227880 - DNA, 25 bp, Mus musculus
cagccatcccccgcttgaaagatgc

SEQ ID NO: 227881 - DNA, 25 bp, Mus musculus
cagccatcgttaaggtcttccatgg

SEQ ID NO: 227882 - DNA, 25 bp, Mus musculus
cagccatctgtactgtgtacagtgc

SEQ ID NO: 227883 - DNA, 25 bp, Mus musculus
cagccatctttgaaatgcccatttg

SEQ ID NO: 227884 - DNA, 25 bp, Mus musculus
cagccatgagcctcagggctaattg

SEQ ID NO: 227885 - DNA, 25 bp, Mus musculus
cagccatgagcgagacggtcatctg

SEQ ID NO: 227886 - DNA, 25 bp, Mus musculus
cagccatgatgattgtgggttctgt

SEQ ID NO: 227887 - DNA, 25 bp, Mus musculus
cagccatgcggcttctccatgatca

SEQ ID NO: 227888 - DNA, 25 bp, Mus musculus
cagccatgctgagcaagctcatgtt

SEQ ID NO: 227889 - DNA, 25 bp, Mus musculus
cagccatgctgagcttcttgatgct

SEQ ID NO: 227890 - DNA, 25 bp, Mus musculus
cagccatgctgtcaatcaactgaaa

SEQ ID NO: 227891 - DNA, 25 bp, Mus musculus
cagccatggcggccaggaggacaca

SEQ ID NO: 227892 - DNA, 25 bp, Mus musculus
cagccatggcgggcaggaggacaca

SEQ ID NO: 227893 - DNA, 25 bp, Mus musculus
cagccatggggaaccagcctgaggc

SEQ ID NO: 227894 - DNA, 25 bp, Mus musculus
cagccatggtgaaggtgtttagctc

SEQ ID NO: 227895 - DNA, 25 bp, Mus musculus
cagccatgtataaagatgtggtgaa

SEQ ID NO: 227896 - DNA, 25 bp, Mus musculus
cagccatgtataaagttctagatgt

SEQ ID NO: 227897 - DNA, 25 bp, Mus musculus
cagccatgtctccatgtcttcctcc

SEQ ID NO: 227898 - DNA, 25 bp, Mus musculus
cagccattaaagatttcattatgaa

SEQ ID NO: 227899 - DNA, 25 bp, Mus musculus
cagccattcacaagaattggcctac

SEQ ID NO: 227900 - DNA, 25 bp, Mus musculus
cagccattcacaagctaattctgat

SEQ ID NO: 227901 - DNA, 25 bp, Mus musculus
cagccattgttcaggctccaggccg

SEQ ID NO: 227902 - DNA, 25 bp, Mus musculus
cagcccaaaggatgactcaaagcca

SEQ ID NO: 227903 - DNA, 25 bp, Mus musculus
cagcccaaaggtcctctgacactac

SEQ ID NO: 227904 - DNA, 25 bp, Mus musculus
cagcccaaagtcagtcgaaacgttg

SEQ ID NO: 227905 - DNA, 25 bp, Mus musculus
cagcccaaagtcagtgaacttctgg

SEQ ID NO: 227906 - DNA, 25 bp, Mus musculus
cagcccaaagtctgacactacaacc

SEQ ID NO: 227907 - DNA, 25 bp, Mus musculus
cagcccaacaaaaagttgattcacc

SEQ ID NO: 227908 - DNA, 25 bp, Mus musculus
cagcccaaccatgctgctgaaccga

SEQ ID NO: 227909 - DNA, 25 bp, Mus musculus
cagcccaacctggctcggaagagga

SEQ ID NO: 227910 - DNA, 25 bp, Mus musculus
cagcccaagaagaaccaagagccgg

SEQ ID NO: 227911 - DNA, 25 bp, Mus musculus
cagcccaagaagacgcaaatccaga

SEQ ID NO: 227912 - DNA, 25 bp, Mus musculus
cagcccaagcagctggagattcacg

SEQ ID NO: 227913 - DNA, 25 bp, Mus musculus
cagcccaagcgaaccccagctgaaa

SEQ ID NO: 227914 - DNA, 25 bp, Mus musculus
cagcccaaggaggctcgaagcacca

SEQ ID NO: 227915 - DNA, 25 bp, Mus musculus
cagcccaatgaatccccagcttcac

SEQ ID NO: 227916 - DNA, 25 bp, Mus musculus
cagcccaatggtgcaggtttcgcca

SEQ ID NO: 227917 - DNA, 25 bp, Mus musculus
cagcccaatggtttcgccacgtttg

SEQ ID NO: 227918 - DNA, 25 bp, Mus musculus
cagcccacacaggtgatccagcagc

SEQ ID NO: 227919 - DNA, 25 bp, Mus musculus
cagcccacaccaggatgcaggcagc

SEQ ID NO: 227920 - DNA, 25 bp, Mus musculus
cagcccacagaaaccactcactctc

SEQ ID NO: 227921 - DNA, 25 bp, Mus musculus
cagcccacagctccccataggtgca

SEQ ID NO: 227922 - DNA, 25 bp, Mus musculus
cagcccacctgcaagacagccccgg

SEQ ID NO: 227923 - DNA, 25 bp, Mus musculus
cagcccacctgcaagctacagacag

SEQ ID NO: 227924 - DNA, 25 bp, Mus musculus
cagcccactgccagacccaggcacc

SEQ ID NO: 227925 - DNA, 25 bp, Mus musculus
cagcccactggatcaaacaacatca

SEQ ID NO: 227926 - DNA, 25 bp, Mus musculus
cagcccactggcctcttcaggtgga

SEQ ID NO: 227927 - DNA, 25 bp, Mus musculus
cagcccagaaaagcggtttccaact

SEQ ID NO: 227928 - DNA, 25 bp, Mus musculus
cagcccagaaaagcttccgtagtgt

SEQ ID NO: 227929 - DNA, 25 bp, Mus musculus
cagcccagaagggtgtgcagattat

SEQ ID NO: 227930 - DNA, 25 bp, Mus musculus
cagcccagaagtaccattcccggag

SEQ ID NO: 227931 - DNA, 25 bp, Mus musculus
cagcccagacccaagaccatttccc

SEQ ID NO: 227932 - DNA, 25 bp, Mus musculus
cagcccagacccaagactctccctc

SEQ ID NO: 227933 - DNA, 25 bp, Mus musculus
cagcccagaccctacaagtacccca

SEQ ID NO: 227934 - DNA, 25 bp, Mus musculus
cagcccagagagaggtcttttggct

SEQ ID NO: 227935 - DNA, 25 bp, Mus musculus
cagcccagagatacattgttgcaat

SEQ ID NO: 227936 - DNA, 25 bp, Mus musculus
cagcccagagctagatttgtcaaat

SEQ ID NO: 227937 - DNA, 25 bp, Mus musculus
cagcccagatgttctccgccatgag

SEQ ID NO: 227938 - DNA, 25 bp, Mus musculus
cagcccagcagggcatcctggccca

SEQ ID NO: 227939 - DNA, 25 bp, Mus musculus
cagcccagcccctggttccacaccc

SEQ ID NO: 227940 - DNA, 25 bp, Mus musculus
cagcccagcccctgtgccgggagcc

SEQ ID NO: 227941 - DNA, 25 bp, Mus musculus
cagcccagcctcaagctcccagggc

SEQ ID NO: 227942 - DNA, 25 bp, Mus musculus
cagcccagcctcaagggcttgccaa

SEQ ID NO: 227943 - DNA, 25 bp, Mus musculus
cagcccagcctcaaggtgagcaaag

SEQ ID NO: 227944 - DNA, 25 bp, Mus musculus
cagcccagctctggacgctatgctg

SEQ ID NO: 227945 - DNA, 25 bp, Mus musculus
cagcccagctctggggagaatgtac

SEQ ID NO: 227946 - DNA, 25 bp, Mus musculus
cagcccaggggttagtgtggagagg

SEQ ID NO: 227947 - DNA, 25 bp, Mus musculus
cagcccagtgaccaatgggaacagt

SEQ ID NO: 227948 - DNA, 25 bp, Mus musculus
cagcccagtgcaggcctgccaacat

SEQ ID NO: 227949 - DNA, 25 bp, Mus musculus
cagcccagtgcaggcctgccactgg

SEQ ID NO: 227950 - DNA, 25 bp, Mus musculus
cagcccagtggtatgacctgatgga

SEQ ID NO: 227951 - DNA, 25 bp, Mus musculus
cagcccagtgttctggtacccactg

SEQ ID NO: 227952 - DNA, 25 bp, Mus musculus
cagcccagtgttctggtacgctccg

SEQ ID NO: 227953 - DNA, 25 bp, Mus musculus
cagcccatcaccaagaacaagaaaa

SEQ ID NO: 227954 - DNA, 25 bp, Mus musculus
cagcccatcagaagttttcctgact

SEQ ID NO: 227955 - DNA, 25 bp, Mus musculus
cagcccatcagagagccctctccag

SEQ ID NO: 227956 - DNA, 25 bp, Mus musculus
cagcccatccgctgagttcctgagc

SEQ ID NO: 227957 - DNA, 25 bp, Mus musculus
cagcccatgaagcaagcttgggcaa

SEQ ID NO: 227958 - DNA, 25 bp, Mus musculus
cagcccatgagcagatgaacgaatt

SEQ ID NO: 227959 - DNA, 25 bp, Mus musculus
cagcccattcttaagattcctttga

SEQ ID NO: 227960 - DNA, 25 bp, Mus musculus
cagccccaatcaggaaattaccgga

SEQ ID NO: 227961 - DNA, 25 bp, Mus musculus
cagccccacaggaaaggaatggaga

SEQ ID NO: 227962 - DNA, 25 bp, Mus musculus
cagccccacaggaaagtacctggcc

SEQ ID NO: 227963 - DNA, 25 bp, Mus musculus
cagccccacattcaacccatggggc

SEQ ID NO: 227964 - DNA, 25 bp, Mus musculus
cagccccacattcaactccagcgcc

SEQ ID NO: 227965 - DNA, 25 bp, Mus musculus
cagccccaccaagctcagtaacaag

SEQ ID NO: 227966 - DNA, 25 bp, Mus musculus
cagccccacgccaggattacatctt

SEQ ID NO: 227967 - DNA, 25 bp, Mus musculus
cagccccacgggtctcagaggtggg

SEQ ID NO: 227968 - DNA, 25 bp, Mus musculus
cagccccactagagtgcggccaagg

SEQ ID NO: 227969 - DNA, 25 bp, Mus musculus
cagccccactattggcttaagtttg

SEQ ID NO: 227970 - DNA, 25 bp, Mus musculus
cagccccactattggggcatctttc

SEQ ID NO: 227971 - DNA, 25 bp, Mus musculus
cagccccagagcacagaggacatca

SEQ ID NO: 227972 - DNA, 25 bp, Mus musculus
cagccccagagctgaactcccacct

SEQ ID NO: 227973 - DNA, 25 bp, Mus musculus
cagccccagaggtctcagcaatctg

SEQ ID NO: 227974 - DNA, 25 bp, Mus musculus
cagccccagcctggtagggatgcag

SEQ ID NO: 227975 - DNA, 25 bp, Mus musculus
cagccccagcgagacagaggcttac

SEQ ID NO: 227976 - DNA, 25 bp, Mus musculus
cagccccagcgagagctagctgagc

SEQ ID NO: 227977 - DNA, 25 bp, Mus musculus
cagccccagcgagtccttcggggag

SEQ ID NO: 227978 - DNA, 25 bp, Mus musculus
cagccccagctctcgggacagtccc

SEQ ID NO: 227979 - DNA, 25 bp, Mus musculus
cagccccagctgctgcccccttatc

SEQ ID NO: 227980 - DNA, 25 bp, Mus musculus
cagccccagctggtgcccccttatc

SEQ ID NO: 227981 - DNA, 25 bp, Mus musculus
cagccccagggaagaggaacagctc

SEQ ID NO: 227982 - DNA, 25 bp, Mus musculus
cagccccatgatgatactgaggaca

SEQ ID NO: 227983 - DNA, 25 bp, Mus musculus
cagccccatgatgatcgcaaaagat

SEQ ID NO: 227984 - DNA, 25 bp, Mus musculus
cagccccatgatggcttcttttctt

SEQ ID NO: 227985 - DNA, 25 bp, Mus musculus
cagcccccaaccatcaaatcgggac

SEQ ID NO: 227986 - DNA, 25 bp, Mus musculus
cagcccccactatcttgcctcatct

SEQ ID NO: 227987 - DNA, 25 bp, Mus musculus
cagcccccactcactcgcctcgcta

SEQ ID NO: 227988 - DNA, 25 bp, Mus musculus
cagcccccactgtccaggtgctgtg

SEQ ID NO: 227989 - DNA, 25 bp, Mus musculus
cagcccccagatctccttgtcagct

SEQ ID NO: 227990 - DNA, 25 bp, Mus musculus
cagcccccagcccagtgcactaagg

SEQ ID NO: 227991 - DNA, 25 bp, Mus musculus
cagcccccagctcgtagtgcatgtt

SEQ ID NO: 227992 - DNA, 25 bp, Mus musculus
cagcccccatttgaataagactgtc

SEQ ID NO: 227993 - DNA, 25 bp, Mus musculus
cagcccccgcagggagctccgcttt

SEQ ID NO: 227994 - DNA, 25 bp, Mus musculus
cagccccctgaaagcctctggagat

SEQ ID NO: 227995 - DNA, 25 bp, Mus musculus
cagccccctggcaggttcagagcat

SEQ ID NO: 227996 - DNA, 25 bp, Mus musculus
cagccccgaggataatagaatctgt

SEQ ID NO: 227997 - DNA, 25 bp, Mus musculus
cagccccgcagacactgggttccct

SEQ ID NO: 227998 - DNA, 25 bp, Mus musculus
cagccccgcgaatgctgctgctagg

SEQ ID NO: 227999 - DNA, 25 bp, Mus musculus
cagccccgcgagttgcacgatttca

SEQ ID NO: 228000 - DNA, 25 bp, Mus musculus
cagccccgcgatgtggccgtggctg

SEQ ID NO: 228001 - DNA, 25 bp, Mus musculus
cagccccgggtgacgttgcacaggc

SEQ ID NO: 228002 - DNA, 25 bp, Mus musculus
cagccccggtagaggtatggatgga

SEQ ID NO: 228003 - DNA, 25 bp, Mus musculus
cagccccggtcagagaaaatgtcaa

SEQ ID NO: 228004 - DNA, 25 bp, Mus musculus
cagccccgtctgagggcagtccttt

SEQ ID NO: 228005 - DNA, 25 bp, Mus musculus
cagcccctaaaggtctcagaggtgg

SEQ ID NO: 228006 - DNA, 25 bp, Mus musculus
cagcccctcctcctccctccctcag

SEQ ID NO: 228007 - DNA, 25 bp, Mus musculus
cagcccctctgcacctaccctgtgc

SEQ ID NO: 228008 - DNA, 25 bp, Mus musculus
cagcccctgaccagttagtcctcta

SEQ ID NO: 228009 - DNA, 25 bp, Mus musculus
cagcccctgttctggtgattgaggc

SEQ ID NO: 228010 - DNA, 25 bp, Mus musculus
cagccccttcagaacctgtctgtcc

SEQ ID NO: 228011 - DNA, 25 bp, Mus musculus
cagccccttcagctgtgcagaacct

SEQ ID NO: 228012 - DNA, 25 bp, Mus musculus
cagccccttgagtatggcaagaaga

SEQ ID NO: 228013 - DNA, 25 bp, Mus musculus
cagccccttgtatagctgtcagggt

SEQ ID NO: 228014 - DNA, 25 bp, Mus musculus
cagcccgaaagaccacaactcgacg

SEQ ID NO: 228015 - DNA, 25 bp, Mus musculus
cagcccgatgccaaaatccaacaaa

SEQ ID NO: 228016 - DNA, 25 bp, Mus musculus
cagcccgatgccaaaattccaccaa

SEQ ID NO: 228017 - DNA, 25 bp, Mus musculus
cagcccgccgctcgaaacctcgacc

SEQ ID NO: 228018 - DNA, 25 bp, Mus musculus
cagcccgccggtggcagctgaccat

SEQ ID NO: 228019 - DNA, 25 bp, Mus musculus
cagcccgcctttggctcccatccaa

SEQ ID NO: 228020 - DNA, 25 bp, Mus musculus
cagcccggatgaggtggctctggtc

SEQ ID NO: 228021 - DNA, 25 bp, Mus musculus
cagcccggcagccacatgttcccaa

SEQ ID NO: 228022 - DNA, 25 bp, Mus musculus
cagcccgggaaagaacgcacagtgg

SEQ ID NO: 228023 - DNA, 25 bp, Mus musculus
cagcccgtaagtttggtgagcggcc

SEQ ID NO: 228024 - DNA, 25 bp, Mus musculus
cagcccgtgttccagcaccacctct

SEQ ID NO: 228025 - DNA, 25 bp, Mus musculus
cagccctatgaggtgccattgacat

SEQ ID NO: 228026 - DNA, 25 bp, Mus musculus
cagccctcacctcctgtctcacaca

SEQ ID NO: 228027 - DNA, 25 bp, Mus musculus
cagccctcatcaatgaggaactcta

SEQ ID NO: 228028 - DNA, 25 bp, Mus musculus
cagccctcccaaaacatgactttgg

SEQ ID NO: 228029 - DNA, 25 bp, Mus musculus
cagccctctcaggttgtctcaactg

SEQ ID NO: 228030 - DNA, 25 bp, Mus musculus
cagccctctgccagagcacaagaga

SEQ ID NO: 228031 - DNA, 25 bp, Mus musculus
cagccctgaagccgaacaaaaaagg

SEQ ID NO: 228032 - DNA, 25 bp, Mus musculus
cagccctgagagggagattcgtaat

SEQ ID NO: 228033 - DNA, 25 bp, Mus musculus
cagccctgagcaggagtctgcaggt

SEQ ID NO: 228034 - DNA, 25 bp, Mus musculus
cagccctgagggcagagcagccatg

SEQ ID NO: 228035 - DNA, 25 bp, Mus musculus
cagccctgagggccatggcggactc

SEQ ID NO: 228036 - DNA, 25 bp, Mus musculus
cagccctgaggtgagagcagccatg

SEQ ID NO: 228037 - DNA, 25 bp, Mus musculus
cagccctgaggttatttcgtcatca

SEQ ID NO: 228038 - DNA, 25 bp, Mus musculus
cagccctgattccacgcttcttgcc

SEQ ID NO: 228039 - DNA, 25 bp, Mus musculus
cagccctgcacaggctagccctgct

SEQ ID NO: 228040 - DNA, 25 bp, Mus musculus
cagccctgcaccagagaaatcataa

SEQ ID NO: 228041 - DNA, 25 bp, Mus musculus
cagccctgcaccaggcctgtattga

SEQ ID NO: 228042 - DNA, 25 bp, Mus musculus
cagccctgccccagcaccacctacc

SEQ ID NO: 228043 - DNA, 25 bp, Mus musculus
cagccctgcctaccctaacccagaa

SEQ ID NO: 228044 - DNA, 25 bp, Mus musculus
cagccctgcgcagatggtggacctg

SEQ ID NO: 228045 - DNA, 25 bp, Mus musculus
cagccctgcggagagtaagcggagg

SEQ ID NO: 228046 - DNA, 25 bp, Mus musculus
cagccctgcgggataagaagtatgc

SEQ ID NO: 228047 - DNA, 25 bp, Mus musculus
cagccctgctgctagtaacgaaggc

SEQ ID NO: 228048 - DNA, 25 bp, Mus musculus
cagccctgctgctggctgtcatcta

SEQ ID NO: 228049 - DNA, 25 bp, Mus musculus
cagccctgctgctgtggtgaaagga

SEQ ID NO: 228050 - DNA, 25 bp, Mus musculus
cagccctggctgggggatgggctcc

SEQ ID NO: 228051 - DNA, 25 bp, Mus musculus
cagccctggggtacttgttgactga

SEQ ID NO: 228052 - DNA, 25 bp, Mus musculus
cagccctgtaaatggcttgctgaaa

SEQ ID NO: 228053 - DNA, 25 bp, Mus musculus
cagccctgtacaaaggggcagccac

SEQ ID NO: 228054 - DNA, 25 bp, Mus musculus
cagccctgtgcagtatcgtaccgag

SEQ ID NO: 228055 - DNA, 25 bp, Mus musculus
cagcccttcactggccccttcatgg

SEQ ID NO: 228056 - DNA, 25 bp, Mus musculus
cagcccttcagaaagtactgtccct

SEQ ID NO: 228057 - DNA, 25 bp, Mus musculus
cagcccttcagccagtactgtccct

SEQ ID NO: 228058 - DNA, 25 bp, Mus musculus
cagcccttcccttggtatgtctacg

SEQ ID NO: 228059 - DNA, 25 bp, Mus musculus
cagcccttgcccaaggagtctctct

SEQ ID NO: 228060 - DNA, 25 bp, Mus musculus
cagcccttgcccaaggatctgggaa

SEQ ID NO: 228061 - DNA, 25 bp, Mus musculus
cagcccttgtgcagcacttagctag

SEQ ID NO: 228062 - DNA, 25 bp, Mus musculus
cagcccttgtgcaggaagcatgcat

SEQ ID NO: 228063 - DNA, 25 bp, Mus musculus
cagcccttgttccaagaagaacgtt

SEQ ID NO: 228064 - DNA, 25 bp, Mus musculus
cagcccttgttccaagtatctccat

SEQ ID NO: 228065 - DNA, 25 bp, Mus musculus
cagccctttaaggcctccagcataa

SEQ ID NO: 228066 - DNA, 25 bp, Mus musculus
cagccgaaagtttaagaggcgagtt

SEQ ID NO: 228067 - DNA, 25 bp, Mus musculus
cagccgaaggacgcgctatgaagtc

SEQ ID NO: 228068 - DNA, 25 bp, Mus musculus
cagccgacagcagctcctgagaaat

SEQ ID NO: 228069 - DNA, 25 bp, Mus musculus
cagccgacagcagtaatctacagta

SEQ ID NO: 228070 - DNA, 25 bp, Mus musculus
cagccgaccaggaactaggaagtaa

SEQ ID NO: 228071 - DNA, 25 bp, Mus musculus
cagccgaccgaggatttggagtttc

SEQ ID NO: 228072 - DNA, 25 bp, Mus musculus
cagccgagagtacaaacaggccatc

SEQ ID NO: 228073 - DNA, 25 bp, Mus musculus
cagccgaggagggatccaagaacct

SEQ ID NO: 228074 - DNA, 25 bp, Mus musculus
cagccgaggagggtatttcctggtg

SEQ ID NO: 228075 - DNA, 25 bp, Mus musculus
cagccgagggagaggcaatacagag

SEQ ID NO: 228076 - DNA, 25 bp, Mus musculus
cagccgagttcagattctccgagtc

SEQ ID NO: 228077 - DNA, 25 bp, Mus musculus
cagccgagttcagggaacagattct

SEQ ID NO: 228078 - DNA, 25 bp, Mus musculus
cagccgatccagggagaagtcaata

SEQ ID NO: 228079 - DNA, 25 bp, Mus musculus
cagccgatccaggtcccggtccttc

SEQ ID NO: 228080 - DNA, 25 bp, Mus musculus
cagccgatggaaaggtcaatttaca

SEQ ID NO: 228081 - DNA, 25 bp, Mus musculus
cagccgcaaacagggcctggatcct

SEQ ID NO: 228082 - DNA, 25 bp, Mus musculus
cagccgcaaagaatggctatacacc

SEQ ID NO: 228083 - DNA, 25 bp, Mus musculus
cagccgcacaggcagcatatctagt

SEQ ID NO: 228084 - DNA, 25 bp, Mus musculus
cagccgcacctacgagctcctggaa

SEQ ID NO: 228085 - DNA, 25 bp, Mus musculus
cagccgcagagagaggttaccctgc

SEQ ID NO: 228086 - DNA, 25 bp, Mus musculus
cagccgcagccttaccagccagccc

SEQ ID NO: 228087 - DNA, 25 bp, Mus musculus
cagccgcagcgtcctcagaatggtt

SEQ ID NO: 228088 - DNA, 25 bp, Mus musculus
cagccgcatcgctctgaagaaagag

SEQ ID NO: 228089 - DNA, 25 bp, Mus musculus
cagccgccacaggaactggtgtgcc

SEQ ID NO: 228090 - DNA, 25 bp, Mus musculus
cagccgccacaggtcctgttgagtc

SEQ ID NO: 228091 - DNA, 25 bp, Mus musculus
cagccgccagaagcggctttagcct

SEQ ID NO: 228092 - DNA, 25 bp, Mus musculus
cagccgccaggccagaagcggactc

SEQ ID NO: 228093 - DNA, 25 bp, Mus musculus
cagccgccccacggcggagcctgac

SEQ ID NO: 228094 - DNA, 25 bp, Mus musculus
cagccgccccacgggccatggagga

SEQ ID NO: 228095 - DNA, 25 bp, Mus musculus
cagccgcccgcacggagcggcggca

SEQ ID NO: 228096 - DNA, 25 bp, Mus musculus
cagccgcccgcctggacaggatgtt

SEQ ID NO: 228097 - DNA, 25 bp, Mus musculus
cagccgcccgcgcagagccggctga

SEQ ID NO: 228098 - DNA, 25 bp, Mus musculus
cagccgcccgcgcaggttggtggga

SEQ ID NO: 228099 - DNA, 25 bp, Mus musculus
cagccgcccgcgcaggtttggacgt

SEQ ID NO: 228100 - DNA, 25 bp, Mus musculus
cagccgcccggccatctgcttcacc

SEQ ID NO: 228101 - DNA, 25 bp, Mus musculus
cagccgcccgggacaggccatctgc

SEQ ID NO: 228102 - DNA, 25 bp, Mus musculus
cagccgccgcggaggtctttggcca

SEQ ID NO: 228103 - DNA, 25 bp, Mus musculus
cagccgccttgctaggcccggtcgg

SEQ ID NO: 228104 - DNA, 25 bp, Mus musculus
cagccgcgtccagaccatttttgcc

SEQ ID NO: 228105 - DNA, 25 bp, Mus musculus
cagccgctaccccggaagaccagca

SEQ ID NO: 228106 - DNA, 25 bp, Mus musculus
cagccgctacgaccccatccctgtg

SEQ ID NO: 228107 - DNA, 25 bp, Mus musculus
cagccgctatggagatggaaacccc

SEQ ID NO: 228108 - DNA, 25 bp, Mus musculus
cagccgctcatgtgggatatgagcc

SEQ ID NO: 228109 - DNA, 25 bp, Mus musculus
cagccgctctgaggtcgaatggtat

SEQ ID NO: 228110 - DNA, 25 bp, Mus musculus
cagccgctgaagatgtgcctcatcc

SEQ ID NO: 228111 - DNA, 25 bp, Mus musculus
cagccgctgtggtgatgagatggac

SEQ ID NO: 228112 - DNA, 25 bp, Mus musculus
cagccgcttatcattaccagttcaa

SEQ ID NO: 228113 - DNA, 25 bp, Mus musculus
cagccgcttcggcattctggaattt

SEQ ID NO: 228114 - DNA, 25 bp, Mus musculus
cagccggagtgcccatgaacgggaa

SEQ ID NO: 228115 - DNA, 25 bp, Mus musculus
cagccggatactggacatgctggtg

SEQ ID NO: 228116 - DNA, 25 bp, Mus musculus
cagccggatactggatgaagacagc

SEQ ID NO: 228117 - DNA, 25 bp, Mus musculus
cagccggatcccagggcctagtaac

SEQ ID NO: 228118 - DNA, 25 bp, Mus musculus
cagccggatgctgagatggtttttg

SEQ ID NO: 228119 - DNA, 25 bp, Mus musculus
cagccggcaggaccagtggctgctc

SEQ ID NO: 228120 - DNA, 25 bp, Mus musculus
cagccggcaggctcatagtggcagc

SEQ ID NO: 228121 - DNA, 25 bp, Mus musculus
cagccggcatatcattgcttattcc

SEQ ID NO: 228122 - DNA, 25 bp, Mus musculus
cagccggcatatccctgattgtccc

SEQ ID NO: 228123 - DNA, 25 bp, Mus musculus
cagccggcggcacgatgccggtgca

SEQ ID NO: 228124 - DNA, 25 bp, Mus musculus
cagccgggaagaggtgctgagctat

SEQ ID NO: 228125 - DNA, 25 bp, Mus musculus
cagccgggatacaggtgtgaatgag

SEQ ID NO: 228126 - DNA, 25 bp, Mus musculus
cagccgggatgctgtccaggccccc

SEQ ID NO: 228127 - DNA, 25 bp, Mus musculus
cagccgggcaggtttgccaagctgc

SEQ ID NO: 228128 - DNA, 25 bp, Mus musculus
cagccgggctatgagatattactac

SEQ ID NO: 228129 - DNA, 25 bp, Mus musculus
cagccgtccagacggtgcagagact

SEQ ID NO: 228130 - DNA, 25 bp, Mus musculus
cagccgtccagcacttccacgtgct

SEQ ID NO: 228131 - DNA, 25 bp, Mus musculus
cagccgtcctcaaagcctatgaaga

SEQ ID NO: 228132 - DNA, 25 bp, Mus musculus
cagccgtgacggagatttcttgacc

SEQ ID NO: 228133 - DNA, 25 bp, Mus musculus
cagccgtgcagagaaaatttcctga

SEQ ID NO: 228134 - DNA, 25 bp, Mus musculus
cagccgtgcagagatcctgtacatt

SEQ ID NO: 228135 - DNA, 25 bp, Mus musculus
cagccgtggccccagggttgtgagc

SEQ ID NO: 228136 - DNA, 25 bp, Mus musculus
cagccgtgggcagagttctctgaac

SEQ ID NO: 228137 - DNA, 25 bp, Mus musculus
cagccgtgtagtttccatttatttc

SEQ ID NO: 228138 - DNA, 25 bp, Mus musculus
cagcctaaaaaagcattcaactcgg

SEQ ID NO: 228139 - DNA, 25 bp, Mus musculus
cagcctaaaaaagggcaagaaatgc

SEQ ID NO: 228140 - DNA, 25 bp, Mus musculus
cagcctaaaatagggcaagaaatgc

SEQ ID NO: 228141 - DNA, 25 bp, Mus musculus
cagcctaaggactaacggttatgac

SEQ ID NO: 228142 - DNA, 25 bp, Mus musculus
cagcctaagggaggaatttggctat

SEQ ID NO: 228143 - DNA, 25 bp, Mus musculus
cagcctaagggcacagcccgagctg

SEQ ID NO: 228144 - DNA, 25 bp, Mus musculus
cagcctaccaggtacaaccacgttg

SEQ ID NO: 228145 - DNA, 25 bp, Mus musculus
cagcctacccaaggaaactgccagg

SEQ ID NO: 228146 - DNA, 25 bp, Mus musculus
cagcctacctgccgcaaatctccca

SEQ ID NO: 228147 - DNA, 25 bp, Mus musculus
cagcctacggtggatcatgggctct

SEQ ID NO: 228148 - DNA, 25 bp, Mus musculus
cagcctagaacaggcagcagaagaa

SEQ ID NO: 228149 - DNA, 25 bp, Mus musculus
cagcctagaagagctccgaggttgc

SEQ ID NO: 228150 - DNA, 25 bp, Mus musculus
cagcctagaagagtatgagcccaga

SEQ ID NO: 228151 - DNA, 25 bp, Mus musculus
cagcctagcgggtgcaaagaaatgg

SEQ ID NO: 228152 - DNA, 25 bp, Mus musculus
cagcctatacaaggctggacgtaaa

SEQ ID NO: 228153 - DNA, 25 bp, Mus musculus
cagcctatctgtttgtctctagata

SEQ ID NO: 228154 - DNA, 25 bp, Mus musculus
cagcctcaagctcccagggcttgcc

SEQ ID NO: 228155 - DNA, 25 bp, Mus musculus
cagcctcaagggcttgccaacacag

SEQ ID NO: 228156 - DNA, 25 bp, Mus musculus
cagcctcaaggtgagcaaagcaacc

SEQ ID NO: 228157 - DNA, 25 bp, Mus musculus
cagcctcactctagggtgaagcctg

SEQ ID NO: 228158 - DNA, 25 bp, Mus musculus
cagcctcagaacgcgagcactttca

SEQ ID NO: 228159 - DNA, 25 bp, Mus musculus
cagcctcagaggccagaaaggacac

SEQ ID NO: 228160 - DNA, 25 bp, Mus musculus
cagcctcagaggccagaagaaggca

SEQ ID NO: 228161 - DNA, 25 bp, Mus musculus
cagcctcaggaagaaactatcaata

SEQ ID NO: 228162 - DNA, 25 bp, Mus musculus
cagcctcaggaatacatcatggaat

SEQ ID NO: 228163 - DNA, 25 bp, Mus musculus
cagcctccaaaagccctgcccttcg

SEQ ID NO: 228164 - DNA, 25 bp, Mus musculus
cagcctccaacaaagcaaagtaaca

SEQ ID NO: 228165 - DNA, 25 bp, Mus musculus
cagcctccaacaaaggtcgtcctcc

SEQ ID NO: 228166 - DNA, 25 bp, Mus musculus
cagcctccacctcctcagtggcatg

SEQ ID NO: 228167 - DNA, 25 bp, Mus musculus
cagcctccagaaccgcaaagatgct

SEQ ID NO: 228168 - DNA, 25 bp, Mus musculus
cagcctccaggaggcaaggatcggg

SEQ ID NO: 228169 - DNA, 25 bp, Mus musculus
cagcctcccactggttatagcactc

SEQ ID NO: 228170 - DNA, 25 bp, Mus musculus
cagcctcccactgtagaagggacca

SEQ ID NO: 228171 - DNA, 25 bp, Mus musculus
cagcctcccagagatcctcttccca

SEQ ID NO: 228172 - DNA, 25 bp, Mus musculus
cagcctcccaggtccacttgaagac

SEQ ID NO: 228173 - DNA, 25 bp, Mus musculus
cagcctccccgactcggccatcgac

SEQ ID NO: 228174 - DNA, 25 bp, Mus musculus
cagcctccggctggcttaactctct

SEQ ID NO: 228175 - DNA, 25 bp, Mus musculus
cagcctccgggacccccgaggctgc

SEQ ID NO: 228176 - DNA, 25 bp, Mus musculus
cagcctcctccatgaagcttcgtgg

SEQ ID NO: 228177 - DNA, 25 bp, Mus musculus
cagcctcctccgagaattatatcag

SEQ ID NO: 228178 - DNA, 25 bp, Mus musculus
cagcctcctcgaggctgtgtgactc

SEQ ID NO: 228179 - DNA, 25 bp, Mus musculus
cagcctcctgggtgttctcttccac

SEQ ID NO: 228180 - DNA, 25 bp, Mus musculus
cagcctcctgggttggctgcaagct

SEQ ID NO: 228181 - DNA, 25 bp, Mus musculus
cagcctcgactgaccctgactgcac

SEQ ID NO: 228182 - DNA, 25 bp, Mus musculus
cagcctcgtgcccagcagcaggagt

SEQ ID NO: 228183 - DNA, 25 bp, Mus musculus
cagcctctaccccctgctgaatgag

SEQ ID NO: 228184 - DNA, 25 bp, Mus musculus
cagcctctacccccttcctgcccag

SEQ ID NO: 228185 - DNA, 25 bp, Mus musculus
cagcctctactcaatagtcaaggag

SEQ ID NO: 228186 - DNA, 25 bp, Mus musculus
cagcctctcaacgattcccacgcct

SEQ ID NO: 228187 - DNA, 25 bp, Mus musculus
cagcctctcaatgggtgttcaggat

SEQ ID NO: 228188 - DNA, 25 bp, Mus musculus
cagcctctccagggccctgacgtca

SEQ ID NO: 228189 - DNA, 25 bp, Mus musculus
cagcctctccaggggaaaataagtc

SEQ ID NO: 228190 - DNA, 25 bp, Mus musculus
cagcctctccagttcctttgtccct

SEQ ID NO: 228191 - DNA, 25 bp, Mus musculus
cagcctctctggtacatggcttctt

SEQ ID NO: 228192 - DNA, 25 bp, Mus musculus
cagcctctgcagatgcctgagcact

SEQ ID NO: 228193 - DNA, 25 bp, Mus musculus
cagcctctgcagcactgccagagtt

SEQ ID NO: 228194 - DNA, 25 bp, Mus musculus
cagcctctggatttatcacttttta

SEQ ID NO: 228195 - DNA, 25 bp, Mus musculus
cagcctctggggccctggcccagct

SEQ ID NO: 228196 - DNA, 25 bp, Mus musculus
cagcctctgtacacgtccggatagc

SEQ ID NO: 228197 - DNA, 25 bp, Mus musculus
cagcctcttcaagccctctccaggc

SEQ ID NO: 228198 - DNA, 25 bp, Mus musculus
cagcctcttctctgagtttctcagt

SEQ ID NO: 228199 - DNA, 25 bp, Mus musculus
cagcctcttctctgtgcctttcttc

SEQ ID NO: 228200 - DNA, 25 bp, Mus musculus
cagcctctttgactatgaacaacat

SEQ ID NO: 228201 - DNA, 25 bp, Mus musculus
cagcctctttgggttcgtttccatt

SEQ ID NO: 228202 - DNA, 25 bp, Mus musculus
cagcctgaaaatgccacctcggctc

SEQ ID NO: 228203 - DNA, 25 bp, Mus musculus
cagcctgacatgggattctctccaa

SEQ ID NO: 228204 - DNA, 25 bp, Mus musculus
cagcctgacatgggcctccttgaat

SEQ ID NO: 228205 - DNA, 25 bp, Mus musculus
cagcctgaccaaggagcaggcggag

SEQ ID NO: 228206 - DNA, 25 bp, Mus musculus
cagcctgacgggaggaaaactttac

SEQ ID NO: 228207 - DNA, 25 bp, Mus musculus
cagcctgacgtttctcttcagcaac

SEQ ID NO: 228208 - DNA, 25 bp, Mus musculus
cagcctgactggttgtgtcaccaac

SEQ ID NO: 228209 - DNA, 25 bp, Mus musculus
cagcctgagacccaacagaaaaatg

SEQ ID NO: 228210 - DNA, 25 bp, Mus musculus
cagcctgagcctcgttccagggtca

SEQ ID NO: 228211 - DNA, 25 bp, Mus musculus
cagcctgagcgagccagaggaagag

SEQ ID NO: 228212 - DNA, 25 bp, Mus musculus
cagcctgaggagacgcagaggcagg

SEQ ID NO: 228213 - DNA, 25 bp, Mus musculus
cagcctgagtacgaggaggaaatct

SEQ ID NO: 228214 - DNA, 25 bp, Mus musculus
cagcctgatgaaaatgcctttgagt

SEQ ID NO: 228215 - DNA, 25 bp, Mus musculus
cagcctgatgaaagcatctgtggca

SEQ ID NO: 228216 - DNA, 25 bp, Mus musculus
cagcctgcaagccaggccattcccc

SEQ ID NO: 228217 - DNA, 25 bp, Mus musculus
cagcctgcaagccaggtggagcagc

SEQ ID NO: 228218 - DNA, 25 bp, Mus musculus
cagcctgcaagccaggttccttaaa

SEQ ID NO: 228219 - DNA, 25 bp, Mus musculus
cagcctgcacgtggaccacagtgaa

SEQ ID NO: 228220 - DNA, 25 bp, Mus musculus
cagcctgcacgtgggtccctggagg

SEQ ID NO: 228221 - DNA, 25 bp, Mus musculus
cagcctgcagccacgatggacagtc

SEQ ID NO: 228222 - DNA, 25 bp, Mus musculus
cagcctgcagccagccaggaccccc

SEQ ID NO: 228223 - DNA, 25 bp, Mus musculus
cagcctgcaggatgctttgctgagc

SEQ ID NO: 228224 - DNA, 25 bp, Mus musculus
cagcctgcagttctgtttctctctg

SEQ ID NO: 228225 - DNA, 25 bp, Mus musculus
cagcctgcagttcttccacttgatc

SEQ ID NO: 228226 - DNA, 25 bp, Mus musculus
cagcctgcataaggctgcggagaag

SEQ ID NO: 228227 - DNA, 25 bp, Mus musculus
cagcctgccaactctgaaaagaaga

SEQ ID NO: 228228 - DNA, 25 bp, Mus musculus
cagcctgccaagtttgatgaagcgg

SEQ ID NO: 228229 - DNA, 25 bp, Mus musculus
cagcctgccacaggaagagagctca

SEQ ID NO: 228230 - DNA, 25 bp, Mus musculus
cagcctgctgctgcctccaggtgga

SEQ ID NO: 228231 - DNA, 25 bp, Mus musculus
cagcctggaaaccagggatcctggt

SEQ ID NO: 228232 - DNA, 25 bp, Mus musculus
cagcctggacagaaggtctgtgtgt

SEQ ID NO: 228233 - DNA, 25 bp, Mus musculus
cagcctggagaaggtcccacctgct

SEQ ID NO: 228234 - DNA, 25 bp, Mus musculus
cagcctggagaggtccatatcctgt

SEQ ID NO: 228235 - DNA, 25 bp, Mus musculus
cagcctggagcattgctgaatatgc

SEQ ID NO: 228236 - DNA, 25 bp, Mus musculus
cagcctggaggacacagagctgcag

SEQ ID NO: 228237 - DNA, 25 bp, Mus musculus
cagcctggccagcattcaggagctt

SEQ ID NO: 228238 - DNA, 25 bp, Mus musculus
cagcctgggcatatggcctccatcc

SEQ ID NO: 228239 - DNA, 25 bp, Mus musculus
cagcctgggccacggagcagctgaa

SEQ ID NO: 228240 - DNA, 25 bp, Mus musculus
cagcctgggcctcaagtccccaaga

SEQ ID NO: 228241 - DNA, 25 bp, Mus musculus
cagcctgggcttcaggtgctgtggg

SEQ ID NO: 228242 - DNA, 25 bp, Mus musculus
cagcctggtacccccttgcagaagc

SEQ ID NO: 228243 - DNA, 25 bp, Mus musculus
cagcctgtaagcccagcactatggt

SEQ ID NO: 228244 - DNA, 25 bp, Mus musculus
cagcctgtaagcccagcatgtgcag

SEQ ID NO: 228245 - DNA, 25 bp, Mus musculus
cagcctgtaagttcttgcagataca

SEQ ID NO: 228246 - DNA, 25 bp, Mus musculus
cagcctgtataagagccctgaagac

SEQ ID NO: 228247 - DNA, 25 bp, Mus musculus
cagcctgtataaggtaggtgcacgc

SEQ ID NO: 228248 - DNA, 25 bp, Mus musculus
cagcctgtcaacaatggctcaacaa

SEQ ID NO: 228249 - DNA, 25 bp, Mus musculus
cagcctgtcaagaatatcgccaaca

SEQ ID NO: 228250 - DNA, 25 bp, Mus musculus
cagcctgtccagcaccatggctggc

SEQ ID NO: 228251 - DNA, 25 bp, Mus musculus
cagcctgtctgccccatgtccatca

SEQ ID NO: 228252 - DNA, 25 bp, Mus musculus
cagcctgtgcagtggcactccaaag

SEQ ID NO: 228253 - DNA, 25 bp, Mus musculus
cagcctgtgtggctcaagtggcctt

SEQ ID NO: 228254 - DNA, 25 bp, Mus musculus
cagcctgtgtgggcctgggactttg

SEQ ID NO: 228255 - DNA, 25 bp, Mus musculus
cagcctgttcaagaaatcaacatgc

SEQ ID NO: 228256 - DNA, 25 bp, Mus musculus
cagcctgttcaaggttcgcccagag

SEQ ID NO: 228257 - DNA, 25 bp, Mus musculus
cagccttaactaactccacggacaa

SEQ ID NO: 228258 - DNA, 25 bp, Mus musculus
cagccttaactggctccataggaat

SEQ ID NO: 228259 - DNA, 25 bp, Mus musculus
cagccttacactacttctaaagatg

SEQ ID NO: 228260 - DNA, 25 bp, Mus musculus
cagccttaccctgattaacctggcc

SEQ ID NO: 228261 - DNA, 25 bp, Mus musculus
cagccttactggggtttggaaatag

SEQ ID NO: 228262 - DNA, 25 bp, Mus musculus
cagccttagaacaagatttaccgga

SEQ ID NO: 228263 - DNA, 25 bp, Mus musculus
cagccttagctaccgccaccagaag

SEQ ID NO: 228264 - DNA, 25 bp, Mus musculus
cagccttagtcctgtcccccagctc

SEQ ID NO: 228265 - DNA, 25 bp, Mus musculus
cagccttatgccctggttccacggc

SEQ ID NO: 228266 - DNA, 25 bp, Mus musculus
cagccttcaaaagaatggcagtctg

SEQ ID NO: 228267 - DNA, 25 bp, Mus musculus
cagccttcaaaagtgtgctggggaa

SEQ ID NO: 228268 - DNA, 25 bp, Mus musculus
cagccttcaaagaatgtctgtaagg

SEQ ID NO: 228269 - DNA, 25 bp, Mus musculus
cagccttcaccgtatggtgtggaag

SEQ ID NO: 228270 - DNA, 25 bp, Mus musculus
cagccttcaggagcgggcctgtgtg

SEQ ID NO: 228271 - DNA, 25 bp, Mus musculus
cagccttcaggaggtatgctgcttg

SEQ ID NO: 228272 - DNA, 25 bp, Mus musculus
cagccttccagaccggtggcagaca

SEQ ID NO: 228273 - DNA, 25 bp, Mus musculus
cagccttcctggagcatgcagacgg

SEQ ID NO: 228274 - DNA, 25 bp, Mus musculus
cagccttcctttgaggagagtacta

SEQ ID NO: 228275 - DNA, 25 bp, Mus musculus
cagccttcgccatgtccttatgtgg

SEQ ID NO: 228276 - DNA, 25 bp, Mus musculus
cagccttcttttatgaggtctcccg

SEQ ID NO: 228277 - DNA, 25 bp, Mus musculus
cagccttcttttgacccacataata

SEQ ID NO: 228278 - DNA, 25 bp, Mus musculus
cagccttgaaagcagccgctaacgt

SEQ ID NO: 228279 - DNA, 25 bp, Mus musculus
cagccttgaggtcccactggaagat

SEQ ID NO: 228280 - DNA, 25 bp, Mus musculus
cagccttgagtgagcataatgaagc

SEQ ID NO: 228281 - DNA, 25 bp, Mus musculus
cagccttgagtgaggcatttcatga

SEQ ID NO: 228282 - DNA, 25 bp, Mus musculus
cagccttggcgcggactggtatccg

SEQ ID NO: 228283 - DNA, 25 bp, Mus musculus
cagccttggtacaggcagcagttat

SEQ ID NO: 228284 - DNA, 25 bp, Mus musculus
cagccttggtggaggaaccagagtc

SEQ ID NO: 228285 - DNA, 25 bp, Mus musculus
cagccttgtaaaaaggtatatcatg

SEQ ID NO: 228286 - DNA, 25 bp, Mus musculus
cagcctttacaagcccttgtcccag

SEQ ID NO: 228287 - DNA, 25 bp, Mus musculus
cagcctttacaggacgcctttgatg

SEQ ID NO: 228288 - DNA, 25 bp, Mus musculus
cagcctttaccagccctttgggaga

SEQ ID NO: 228289 - DNA, 25 bp, Mus musculus
cagcctttagcaccagttcctcttt

SEQ ID NO: 228290 - DNA, 25 bp, Mus musculus
cagcctttgctttgacactggccaa

SEQ ID NO: 228291 - DNA, 25 bp, Mus musculus
cagcgaaaccaggtccacaggatga

SEQ ID NO: 228292 - DNA, 25 bp, Mus musculus
cagcgaaatggttgtactttcccca

SEQ ID NO: 228293 - DNA, 25 bp, Mus musculus
cagcgaacatgctcactgttggtat

SEQ ID NO: 228294 - DNA, 25 bp, Mus musculus
cagcgaacatggcctcaggagttca

SEQ ID NO: 228295 - DNA, 25 bp, Mus musculus
cagcgaagccgaagtcttactccta

SEQ ID NO: 228296 - DNA, 25 bp, Mus musculus
cagcgaagccggagactatctggta

SEQ ID NO: 228297 - DNA, 25 bp, Mus musculus
cagcgaaggatgggacaaggcctgg

SEQ ID NO: 228298 - DNA, 25 bp, Mus musculus
cagcgaaggatggtggaagaaaagt

SEQ ID NO: 228299 - DNA, 25 bp, Mus musculus
cagcgaatcaaagaggatgtatata

SEQ ID NO: 228300 - DNA, 25 bp, Mus musculus
cagcgacaagatgcctggccgagtg

SEQ ID NO: 228301 - DNA, 25 bp, Mus musculus
cagcgacacttgtccttcacacacc

SEQ ID NO: 228302 - DNA, 25 bp, Mus musculus
cagcgacagagagcacctaaaggaa

SEQ ID NO: 228303 - DNA, 25 bp, Mus musculus
cagcgacagccaggtatgccatcat

SEQ ID NO: 228304 - DNA, 25 bp, Mus musculus
cagcgacatcgatggagatgggtgt

SEQ ID NO: 228305 - DNA, 25 bp, Mus musculus
cagcgacatcgctgacttcagggac

SEQ ID NO: 228306 - DNA, 25 bp, Mus musculus
cagcgaccagatgaccaatgcaagg

SEQ ID NO: 228307 - DNA, 25 bp, Mus musculus
cagcgaccagtcttgtgccattgac

SEQ ID NO: 228308 - DNA, 25 bp, Mus musculus
cagcgacccagcgtctgatggctat

SEQ ID NO: 228309 - DNA, 25 bp, Mus musculus
cagcgacgaggttcagattctggag

SEQ ID NO: 228310 - DNA, 25 bp, Mus musculus
cagcgacgcagaaaaccaacagaac

SEQ ID NO: 228311 - DNA, 25 bp, Mus musculus
cagcgacgcagaggagcctttggga

SEQ ID NO: 228312 - DNA, 25 bp, Mus musculus
cagcgacgtctggagaatgctggga

SEQ ID NO: 228313 - DNA, 25 bp, Mus musculus
cagcgacgtctggagcttcggggtt

SEQ ID NO: 228314 - DNA, 25 bp, Mus musculus
cagcgactaagcaggaagggatgga

SEQ ID NO: 228315 - DNA, 25 bp, Mus musculus
cagcgagaaaggagacaccgtggcc

SEQ ID NO: 228316 - DNA, 25 bp, Mus musculus
cagcgagacctgtatagcagaacat

SEQ ID NO: 228317 - DNA, 25 bp, Mus musculus
cagcgagacgtggaggtactatgcc

SEQ ID NO: 228318 - DNA, 25 bp, Mus musculus
cagcgagacttgcaaaaggtgctgg

SEQ ID NO: 228319 - DNA, 25 bp, Mus musculus
cagcgagagggtggtccggtgagca

SEQ ID NO: 228320 - DNA, 25 bp, Mus musculus
cagcgagcagatgtctcatttccgt

SEQ ID NO: 228321 - DNA, 25 bp, Mus musculus
cagcgagcagccatgatgagtctcc

SEQ ID NO: 228322 - DNA, 25 bp, Mus musculus
cagcgagcagccctgcaactcccac

SEQ ID NO: 228323 - DNA, 25 bp, Mus musculus
cagcgagcgagtggtgatcatgtgt

SEQ ID NO: 228324 - DNA, 25 bp, Mus musculus
cagcgagcggagagtcatggatgct

SEQ ID NO: 228325 - DNA, 25 bp, Mus musculus
cagcgagcggggtgctgagttctgt

SEQ ID NO: 228326 - DNA, 25 bp, Mus musculus
cagcgagctgaaattctgtcccctc

SEQ ID NO: 228327 - DNA, 25 bp, Mus musculus
cagcgagcttaaagatcgatcccgc

SEQ ID NO: 228328 - DNA, 25 bp, Mus musculus
cagcgaggaaacaggcactctcgat

SEQ ID NO: 228329 - DNA, 25 bp, Mus musculus
cagcgaggaagatgaggacgatgtg

SEQ ID NO: 228330 - DNA, 25 bp, Mus musculus
cagcgaggagagagtgtatatggtg

SEQ ID NO: 228331 - DNA, 25 bp, Mus musculus
cagcgaggagggctaccagttccca

SEQ ID NO: 228332 - DNA, 25 bp, Mus musculus
cagcgaggccgagatctgtcgcttt

SEQ ID NO: 228333 - DNA, 25 bp, Mus musculus
cagcgaggctggaggcaccatgagc

SEQ ID NO: 228334 - DNA, 25 bp, Mus musculus
cagcgagggcgaggatcatctgtct

SEQ ID NO: 228335 - DNA, 25 bp, Mus musculus
cagcgaggggtgagctgaacccccg

SEQ ID NO: 228336 - DNA, 25 bp, Mus musculus
cagcgagtcagtaccatctgccagc

SEQ ID NO: 228337 - DNA, 25 bp, Mus musculus
cagcgagtggcagagttgcacagca

SEQ ID NO: 228338 - DNA, 25 bp, Mus musculus
cagcgagttattaggatgcctggtg

SEQ ID NO: 228339 - DNA, 25 bp, Mus musculus
cagcgagttattaggcacatgactc

SEQ ID NO: 228340 - DNA, 25 bp, Mus musculus
cagcgatacgcttgcctggttccaa

SEQ ID NO: 228341 - DNA, 25 bp, Mus musculus
cagcgatacggctttggaccttgaa

SEQ ID NO: 228342 - DNA, 25 bp, Mus musculus
cagcgatcaggatatgacattacaa

SEQ ID NO: 228343 - DNA, 25 bp, Mus musculus
cagcgatcaggtaatagtgcagcgg

SEQ ID NO: 228344 - DNA, 25 bp, Mus musculus
cagcgatcgcaggattgaaattcca

SEQ ID NO: 228345 - DNA, 25 bp, Mus musculus
cagcgatctggagccccgcaagtgc

SEQ ID NO: 228346 - DNA, 25 bp, Mus musculus
cagcgatctggagctgcagcgctca

SEQ ID NO: 228347 - DNA, 25 bp, Mus musculus
cagcgatgacgatagtggttccgga

SEQ ID NO: 228348 - DNA, 25 bp, Mus musculus
cagcgatgagaaagatgtctcaacc

SEQ ID NO: 228349 - DNA, 25 bp, Mus musculus
cagcgatgagatggtacagaacttc

SEQ ID NO: 228350 - DNA, 25 bp, Mus musculus
cagcgatgaggtagttttgagctgc

SEQ ID NO: 228351 - DNA, 25 bp, Mus musculus
cagcgattcaagaatttgcatcatg

SEQ ID NO: 228352 - DNA, 25 bp, Mus musculus
cagcgattcaagagtgcactcttcc

SEQ ID NO: 228353 - DNA, 25 bp, Mus musculus
cagcgattctgaaggtgaagagatt

SEQ ID NO: 228354 - DNA, 25 bp, Mus musculus
cagcgattggaagaaatcaagaagt

SEQ ID NO: 228355 - DNA, 25 bp, Mus musculus
cagcgattggaagaagaatgaagac

SEQ ID NO: 228356 - DNA, 25 bp, Mus musculus
cagcgcaaactgggcaaacgctaca

SEQ ID NO: 228357 - DNA, 25 bp, Mus musculus
cagcgcaaccaggcccaggagggtg

SEQ ID NO: 228358 - DNA, 25 bp, Mus musculus
cagcgcaactcagatggctccagat

SEQ ID NO: 228359 - DNA, 25 bp, Mus musculus
cagcgcaactcaggctgactcccct

SEQ ID NO: 228360 - DNA, 25 bp, Mus musculus
cagcgcacctacgggctgactcctc

SEQ ID NO: 228361 - DNA, 25 bp, Mus musculus
cagcgcacgtgcatagatacctgct

SEQ ID NO: 228362 - DNA, 25 bp, Mus musculus
cagcgcactctgagatcttggcata

SEQ ID NO: 228363 - DNA, 25 bp, Mus musculus
cagcgcactgtcagatgtagaaatc

SEQ ID NO: 228364 - DNA, 25 bp, Mus musculus
cagcgcactgtcaggtaaatccatt

SEQ ID NO: 228365 - DNA, 25 bp, Mus musculus
cagcgcagccatggagccccgcgcg

SEQ ID NO: 228366 - DNA, 25 bp, Mus musculus
cagcgcatgaaagggtctggtgaga

SEQ ID NO: 228367 - DNA, 25 bp, Mus musculus
cagcgccaagtgagagtcagcttgc

SEQ ID NO: 228368 - DNA, 25 bp, Mus musculus
cagcgccaccccctgctcctgctgc

SEQ ID NO: 228369 - DNA, 25 bp, Mus musculus
cagcgccacgcttagactagctgtg

SEQ ID NO: 228370 - DNA, 25 bp, Mus musculus
cagcgccagaggcaggcaatgatac

SEQ ID NO: 228371 - DNA, 25 bp, Mus musculus
cagcgccagaggcaggtaacctcgg

SEQ ID NO: 228372 - DNA, 25 bp, Mus musculus
cagcgccatcatcagatggcaaggt

SEQ ID NO: 228373 - DNA, 25 bp, Mus musculus
cagcgccatcatcagctctaggagt

SEQ ID NO: 228374 - DNA, 25 bp, Mus musculus
cagcgcccgcgatgactgccactct

SEQ ID NO: 228375 - DNA, 25 bp, Mus musculus
cagcgcccgcgcgggtcgcccaatg

SEQ ID NO: 228376 - DNA, 25 bp, Mus musculus
cagcgccctgagctggacaagtgac

SEQ ID NO: 228377 - DNA, 25 bp, Mus musculus
cagcgccgcacaggtcccacacagc

SEQ ID NO: 228378 - DNA, 25 bp, Mus musculus
cagcgccgccgctggagagatgtct

SEQ ID NO: 228379 - DNA, 25 bp, Mus musculus
cagcgccggggactctgatggggaa

SEQ ID NO: 228380 - DNA, 25 bp, Mus musculus
cagcgcctacaacagccggagagac

SEQ ID NO: 228381 - DNA, 25 bp, Mus musculus
cagcgcctctggagttagtgagctt

SEQ ID NO: 228382 - DNA, 25 bp, Mus musculus
cagcgcctctggtgacagagtgcca

SEQ ID NO: 228383 - DNA, 25 bp, Mus musculus
cagcgcctctgtcttgttttcagac

SEQ ID NO: 228384 - DNA, 25 bp, Mus musculus
cagcgcctgcaggcttttgaggctc

SEQ ID NO: 228385 - DNA, 25 bp, Mus musculus
cagcgcctgcaggggctccctccag

SEQ ID NO: 228386 - DNA, 25 bp, Mus musculus
cagcgcctggagcatgcagccaagc

SEQ ID NO: 228387 - DNA, 25 bp, Mus musculus
cagcgcgaaggtgatgctagaagat

SEQ ID NO: 228388 - DNA, 25 bp, Mus musculus
cagcgcgcagacgggtccagtgaag

SEQ ID NO: 228389 - DNA, 25 bp, Mus musculus
cagcgcgcagcccctggaggaagtc

SEQ ID NO: 228390 - DNA, 25 bp, Mus musculus
cagcgcgcggacagagacactgtac

SEQ ID NO: 228391 - DNA, 25 bp, Mus musculus
cagcgcgcggccaggtgagttggag

SEQ ID NO: 228392 - DNA, 25 bp, Mus musculus
cagcgcgctcaagaatttgtcttcg

SEQ ID NO: 228393 - DNA, 25 bp, Mus musculus
cagcgcggcaggccgcggtagcggg

SEQ ID NO: 228394 - DNA, 25 bp, Mus musculus
cagcgcggcgaaagaaagatcacag

SEQ ID NO: 228395 - DNA, 25 bp, Mus musculus
cagcgcggcggaggttgccccggag

SEQ ID NO: 228396 - DNA, 25 bp, Mus musculus
cagcgcgggccggtgtacattggtg

SEQ ID NO: 228397 - DNA, 25 bp, Mus musculus
cagcgcggggagatggtggcctgga

SEQ ID NO: 228398 - DNA, 25 bp, Mus musculus
cagcgcggggcaaggaggaggagtt

SEQ ID NO: 228399 - DNA, 25 bp, Mus musculus
cagcgcggggcaagtgtggtccccg

SEQ ID NO: 228400 - DNA, 25 bp, Mus musculus
cagcgctaagaggatccagaaggag

SEQ ID NO: 228401 - DNA, 25 bp, Mus musculus
cagcgctacctccttctggccgggg

SEQ ID NO: 228402 - DNA, 25 bp, Mus musculus
cagcgctatgagaaaattattttcg

SEQ ID NO: 228403 - DNA, 25 bp, Mus musculus
cagcgctatgagaaattactcttct

SEQ ID NO: 228404 - DNA, 25 bp, Mus musculus
cagcgctcacgggaaccagtgacct

SEQ ID NO: 228405 - DNA, 25 bp, Mus musculus
cagcgctcagatccgtatgtaaaga

SEQ ID NO: 228406 - DNA, 25 bp, Mus musculus
cagcgctccggaccctggctgggca

SEQ ID NO: 228407 - DNA, 25 bp, Mus musculus
cagcgctccggtggaatgaacctta

SEQ ID NO: 228408 - DNA, 25 bp, Mus musculus
cagcgctctctgctgacctatgagg

SEQ ID NO: 228409 - DNA, 25 bp, Mus musculus
cagcgctctctgctgagtctgaaga

SEQ ID NO: 228410 - DNA, 25 bp, Mus musculus
cagcgctcttctgttatgttcttgc

SEQ ID NO: 228411 - DNA, 25 bp, Mus musculus
cagcgctgacaggtacagagctatc

SEQ ID NO: 228412 - DNA, 25 bp, Mus musculus
cagcgctgactttgagaaacggaag

SEQ ID NO: 228413 - DNA, 25 bp, Mus musculus
cagcgctgactttggcctgcatgag

SEQ ID NO: 228414 - DNA, 25 bp, Mus musculus
cagcgctgagcttcacctggttcac

SEQ ID NO: 228415 - DNA, 25 bp, Mus musculus
cagcgctgcttcagagatgagtgaa

SEQ ID NO: 228416 - DNA, 25 bp, Mus musculus
cagcgctgcttcagcacctctggga

SEQ ID NO: 228417 - DNA, 25 bp, Mus musculus
cagcgctgggtggagaaaaatgttt

SEQ ID NO: 228418 - DNA, 25 bp, Mus musculus
cagcgcttagcccggaagaccagca

SEQ ID NO: 228419 - DNA, 25 bp, Mus musculus
cagcgcttcaacagggccatggagg

SEQ ID NO: 228420 - DNA, 25 bp, Mus musculus
cagcgcttcagcaccgcacagtgtg

SEQ ID NO: 228421 - DNA, 25 bp, Mus musculus
cagcgcttcagggagcgacaggcag

SEQ ID NO: 228422 - DNA, 25 bp, Mus musculus
cagcgcttggaaaagcacttggagc

SEQ ID NO: 228423 - DNA, 25 bp, Mus musculus
cagcgcttggaaaagtgctcatgac

SEQ ID NO: 228424 - DNA, 25 bp, Mus musculus
cagcgctttggagctgtgtggacag

SEQ ID NO: 228425 - DNA, 25 bp, Mus musculus
cagcgctttggagctgtgtgtggga

SEQ ID NO: 228426 - DNA, 25 bp, Mus musculus
cagcggaaccgacaaaggttacctg

SEQ ID NO: 228427 - DNA, 25 bp, Mus musculus
cagcggaaccgcttcttcacttgtc

SEQ ID NO: 228428 - DNA, 25 bp, Mus musculus
cagcggaaccggacgccctggcctc

SEQ ID NO: 228429 - DNA, 25 bp, Mus musculus
cagcggaagcatggaaactagagag

SEQ ID NO: 228430 - DNA, 25 bp, Mus musculus
cagcggaagcgagtgggcgtgtgga

SEQ ID NO: 228431 - DNA, 25 bp, Mus musculus
cagcggacatgtcagtggaaacctc

SEQ ID NO: 228432 - DNA, 25 bp, Mus musculus
cagcggactctgggagtctgtccca

SEQ ID NO: 228433 - DNA, 25 bp, Mus musculus
cagcggagaagagaatacagacaga

SEQ ID NO: 228434 - DNA, 25 bp, Mus musculus
cagcggagaagaggaattcatgaag

SEQ ID NO: 228435 - DNA, 25 bp, Mus musculus
cagcggagaagtggatgtcgcgtgg

SEQ ID NO: 228436 - DNA, 25 bp, Mus musculus
cagcggagaagtggtgaaggccttg

SEQ ID NO: 228437 - DNA, 25 bp, Mus musculus
cagcggagcaactgaagactcagga

SEQ ID NO: 228438 - DNA, 25 bp, Mus musculus
cagcggaggaaggagctaactctcc

SEQ ID NO: 228439 - DNA, 25 bp, Mus musculus
cagcggaggaagtccttccgaggtt

SEQ ID NO: 228440 - DNA, 25 bp, Mus musculus
cagcggaggaggttgtaagcatcaa

SEQ ID NO: 228441 - DNA, 25 bp, Mus musculus
cagcggaggggtatctgctatagaa

SEQ ID NO: 228442 - DNA, 25 bp, Mus musculus
cagcggataccaaactgttttctgg

SEQ ID NO: 228443 - DNA, 25 bp, Mus musculus
cagcggatccgggagcctgagcctt

SEQ ID NO: 228444 - DNA, 25 bp, Mus musculus
cagcggatcctgagagaaggctttg

SEQ ID NO: 228445 - DNA, 25 bp, Mus musculus
cagcggcaaaatagtgtttctagaa

SEQ ID NO: 228446 - DNA, 25 bp, Mus musculus
cagcggcaacctggcctctagacgt

SEQ ID NO: 228447 - DNA, 25 bp, Mus musculus
cagcggcaagatgtcattgatcaga

SEQ ID NO: 228448 - DNA, 25 bp, Mus musculus
cagcggcaagcctgagactggtgtt

SEQ ID NO: 228449 - DNA, 25 bp, Mus musculus
cagcggcaaggtgcgccgtcatgag

SEQ ID NO: 228450 - DNA, 25 bp, Mus musculus
cagcggcacggcggagggaggaaat

SEQ ID NO: 228451 - DNA, 25 bp, Mus musculus
cagcggcacggcgggagtcagcatt

SEQ ID NO: 228452 - DNA, 25 bp, Mus musculus
cagcggcacggcggggatcccactg

SEQ ID NO: 228453 - DNA, 25 bp, Mus musculus
cagcggcacggcgggtttcaaatga

SEQ ID NO: 228454 - DNA, 25 bp, Mus musculus
cagcggcagcaggaacggagcacct

SEQ ID NO: 228455 - DNA, 25 bp, Mus musculus
cagcggcagcagggccgggagcagg

SEQ ID NO: 228456 - DNA, 25 bp, Mus musculus
cagcggcagccagcaccagctgctc

SEQ ID NO: 228457 - DNA, 25 bp, Mus musculus
cagcggcagctgctgaccctgagca

SEQ ID NO: 228458 - DNA, 25 bp, Mus musculus
cagcggcaggaggatgagtctgagg

SEQ ID NO: 228459 - DNA, 25 bp, Mus musculus
cagcggcatgaagatgagctaagaa

SEQ ID NO: 228460 - DNA, 25 bp, Mus musculus
cagcggcatggtgatgaatctttct

SEQ ID NO: 228461 - DNA, 25 bp, Mus musculus
cagcggccacagccccactccacag

SEQ ID NO: 228462 - DNA, 25 bp, Mus musculus
cagcggccacaggccactgcagagc

SEQ ID NO: 228463 - DNA, 25 bp, Mus musculus
cagcggcccagcgtccgatgcaagc

SEQ ID NO: 228464 - DNA, 25 bp, Mus musculus
cagcggccgggggaacacacccgtg

SEQ ID NO: 228465 - DNA, 25 bp, Mus musculus
cagcggcctcaaggtctgaggcgtc

SEQ ID NO: 228466 - DNA, 25 bp, Mus musculus
cagcggcctcaaggttggagaccag

SEQ ID NO: 228467 - DNA, 25 bp, Mus musculus
cagcggcctcaagtgaccttgcaag

SEQ ID NO: 228468 - DNA, 25 bp, Mus musculus
cagcggcctcaggtccattcagaag

SEQ ID NO: 228469 - DNA, 25 bp, Mus musculus
cagcggcgagtgggaaagacaagaa

SEQ ID NO: 228470 - DNA, 25 bp, Mus musculus
cagcggcgcagaaacatctgtggcc

SEQ ID NO: 228471 - DNA, 25 bp, Mus musculus
cagcggcgcaggtgattcctcctaa

SEQ ID NO: 228472 - DNA, 25 bp, Mus musculus
cagcggcgcaggttgccccggaggc

SEQ ID NO: 228473 - DNA, 25 bp, Mus musculus
cagcggcgctggtacaaagtaagaa

SEQ ID NO: 228474 - DNA, 25 bp, Mus musculus
cagcggcggacagggagaatcccgt

SEQ ID NO: 228475 - DNA, 25 bp, Mus musculus
cagcggcggcagaaatgatggaaga

SEQ ID NO: 228476 - DNA, 25 bp, Mus musculus
cagcggctcagagcaatcaggaccg

SEQ ID NO: 228477 - DNA, 25 bp, Mus musculus
cagcggctcagaggaaagaataccc

SEQ ID NO: 228478 - DNA, 25 bp, Mus musculus
cagcggctcaggatggcctcaggca

SEQ ID NO: 228479 - DNA, 25 bp, Mus musculus
cagcggctcaggccctgcccatttc

SEQ ID NO: 228480 - DNA, 25 bp, Mus musculus
cagcggctgctcagagtatagaaat

SEQ ID NO: 228481 - DNA, 25 bp, Mus musculus
cagcggctgctcaggtccaatcagc

SEQ ID NO: 228482 - DNA, 25 bp, Mus musculus
cagcggctggtaaagctgtcctgcc

SEQ ID NO: 228483 - DNA, 25 bp, Mus musculus
cagcggcttcctctggggggtcacc

SEQ ID NO: 228484 - DNA, 25 bp, Mus musculus
cagcgggaacaagagaataaaggcc

SEQ ID NO: 228485 - DNA, 25 bp, Mus musculus
cagcgggaacaagagataaaactat

SEQ ID NO: 228486 - DNA, 25 bp, Mus musculus
cagcgggaagaatggaaaatgttta

SEQ ID NO: 228487 - DNA, 25 bp, Mus musculus
cagcgggacaggtggtgtccctcag

SEQ ID NO: 228488 - DNA, 25 bp, Mus musculus
cagcgggacagtgacgttgcccgcc

SEQ ID NO: 228489 - DNA, 25 bp, Mus musculus
cagcgggaccaagactccacttcag

SEQ ID NO: 228490 - DNA, 25 bp, Mus musculus
cagcgggaccaaggttatttcgtca

SEQ ID NO: 228491 - DNA, 25 bp, Mus musculus
cagcgggagaagatggttggtaaag

SEQ ID NO: 228492 - DNA, 25 bp, Mus musculus
cagcgggagaaggctctgcaccccg

SEQ ID NO: 228493 - DNA, 25 bp, Mus musculus
cagcgggagaaggttgatccaaaag

SEQ ID NO: 228494 - DNA, 25 bp, Mus musculus
cagcgggcaccagtgagatcccatt

SEQ ID NO: 228495 - DNA, 25 bp, Mus musculus
cagcgggcagaggcggatcttagac

SEQ ID NO: 228496 - DNA, 25 bp, Mus musculus
cagcgggcaggtcatgttagcggct

SEQ ID NO: 228497 - DNA, 25 bp, Mus musculus
cagcgggcattgcagatggaaggat

SEQ ID NO: 228498 - DNA, 25 bp, Mus musculus
cagcgggcattgcagcgtgcaatga

SEQ ID NO: 228499 - DNA, 25 bp, Mus musculus
cagcgggccagctacgaatacatgc

SEQ ID NO: 228500 - DNA, 25 bp, Mus musculus
cagcgggccaggaatgagatcagga

SEQ ID NO: 228501 - DNA, 25 bp, Mus musculus
cagcgggccctgacgatctgctggt

SEQ ID NO: 228502 - DNA, 25 bp, Mus musculus
cagcgggcgacaggaagaactagga

SEQ ID NO: 228503 - DNA, 25 bp, Mus musculus
cagcgggcgacaggtggtttcactc

SEQ ID NO: 228504 - DNA, 25 bp, Mus musculus
cagcgggcgactcaggcaccatgag

SEQ ID NO: 228505 - DNA, 25 bp, Mus musculus
cagcgggcgggattcccgaagccca

SEQ ID NO: 228506 - DNA, 25 bp, Mus musculus
cagcgggctagcgcatttcagatct

SEQ ID NO: 228507 - DNA, 25 bp, Mus musculus
cagcggggagaggggcgtagtggca

SEQ ID NO: 228508 - DNA, 25 bp, Mus musculus
cagcgggtcaggtaaaacatcagag

SEQ ID NO: 228509 - DNA, 25 bp, Mus musculus
cagcgggtcaggtatatgcaccatc

SEQ ID NO: 228510 - DNA, 25 bp, Mus musculus
cagcgggtcaggtatggatgagcgt

SEQ ID NO: 228511 - DNA, 25 bp, Mus musculus
cagcgggtcattcagtacctcagta

SEQ ID NO: 228512 - DNA, 25 bp, Mus musculus
cagcgggtcattcagtagtaacaga

SEQ ID NO: 228513 - DNA, 25 bp, Mus musculus
cagcgggtttcgacttctcgccgag

SEQ ID NO: 228514 - DNA, 25 bp, Mus musculus
cagcgggtttgggtctgtacacatg

SEQ ID NO: 228515 - DNA, 25 bp, Mus musculus
cagcggtaactcgatcccgtactct

SEQ ID NO: 228516 - DNA, 25 bp, Mus musculus
cagcggtcgccggttcccactatgt

SEQ ID NO: 228517 - DNA, 25 bp, Mus musculus
cagcggtgatctcagacgggtcacc

SEQ ID NO: 228518 - DNA, 25 bp, Mus musculus
cagcggtgatctcagccttgccgga

SEQ ID NO: 228519 - DNA, 25 bp, Mus musculus
cagcggtggcaacggggaggcacac

SEQ ID NO: 228520 - DNA, 25 bp, Mus musculus
cagcggttacaggatgagctgagtg

SEQ ID NO: 228521 - DNA, 25 bp, Mus musculus
cagcggttacagggtcttacttatt

SEQ ID NO: 228522 - DNA, 25 bp, Mus musculus
cagcggttttgcgaaggatgcacct

SEQ ID NO: 228523 - DNA, 25 bp, Mus musculus
cagcggttttgcgccccctcctctc

SEQ ID NO: 228524 - DNA, 25 bp, Mus musculus
cagcgtacagatgaaaaggggttct

SEQ ID NO: 228525 - DNA, 25 bp, Mus musculus
cagcgtacagattgcatctgggtat

SEQ ID NO: 228526 - DNA, 25 bp, Mus musculus
cagcgtacaggctcaggaaacatca

SEQ ID NO: 228527 - DNA, 25 bp, Mus musculus
cagcgtagaagatccaggtgctgtg

SEQ ID NO: 228528 - DNA, 25 bp, Mus musculus
cagcgtagagaaggctggcaagaga

SEQ ID NO: 228529 - DNA, 25 bp, Mus musculus
cagcgtattaacaagtaagtgtgga

SEQ ID NO: 228530 - DNA, 25 bp, Mus musculus
cagcgtcaagcaggtgtcttctgca

SEQ ID NO: 228531 - DNA, 25 bp, Mus musculus
cagcgtcagtctgaaggtgcttcct

SEQ ID NO: 228532 - DNA, 25 bp, Mus musculus
cagcgtcagtctgcctttgcctgat

SEQ ID NO: 228533 - DNA, 25 bp, Mus musculus
cagcgtcatggagatgctcagaccc

SEQ ID NO: 228534 - DNA, 25 bp, Mus musculus
cagcgtcatgtgcagagacaggctt

SEQ ID NO: 228535 - DNA, 25 bp, Mus musculus
cagcgtcatgtgcaggctttgatat

SEQ ID NO: 228536 - DNA, 25 bp, Mus musculus
cagcgtccagcgtgcgcccctccag

SEQ ID NO: 228537 - DNA, 25 bp, Mus musculus
cagcgtcccatggcctagccgcccg

SEQ ID NO: 228538 - DNA, 25 bp, Mus musculus
cagcgtccccaactcttcctcccct

SEQ ID NO: 228539 - DNA, 25 bp, Mus musculus
cagcgtccccggtggaatgcaagac

SEQ ID NO: 228540 - DNA, 25 bp, Mus musculus
cagcgtcctaacgggcaatgtcatc

SEQ ID NO: 228541 - DNA, 25 bp, Mus musculus
cagcgtcctccgcagcctctactca

SEQ ID NO: 228542 - DNA, 25 bp, Mus musculus
cagcgtcctccgcaggttcgtggta

SEQ ID NO: 228543 - DNA, 25 bp, Mus musculus
cagcgtcctccgggtagctgggagt

SEQ ID NO: 228544 - DNA, 25 bp, Mus musculus
cagcgtccttgagctgaggctgcag

SEQ ID NO: 228545 - DNA, 25 bp, Mus musculus
cagcgtcgagcccaggaggaagaag

SEQ ID NO: 228546 - DNA, 25 bp, Mus musculus
cagcgtcgatcccagatgtagaact

SEQ ID NO: 228547 - DNA, 25 bp, Mus musculus
cagcgtcgatcccaggtgcacctcc

SEQ ID NO: 228548 - DNA, 25 bp, Mus musculus
cagcgtcgatcccaggtgcttgtcc

SEQ ID NO: 228549 - DNA, 25 bp, Mus musculus
cagcgtcgccaccatgaccaccgcg

SEQ ID NO: 228550 - DNA, 25 bp, Mus musculus
cagcgtctaaggttcctgtgtccgc

SEQ ID NO: 228551 - DNA, 25 bp, Mus musculus
cagcgtctgggaaagaagaggttac

SEQ ID NO: 228552 - DNA, 25 bp, Mus musculus
cagcgtgaacacagaaatcccttca

SEQ ID NO: 228553 - DNA, 25 bp, Mus musculus
cagcgtgaacacagggggcttccga

SEQ ID NO: 228554 - DNA, 25 bp, Mus musculus
cagcgtgaacacagtaacctcagtc

SEQ ID NO: 228555 - DNA, 25 bp, Mus musculus
cagcgtgaagatgtactggttccgc

SEQ ID NO: 228556 - DNA, 25 bp, Mus musculus
cagcgtgaaggaaatggaatttatc

SEQ ID NO: 228557 - DNA, 25 bp, Mus musculus
cagcgtgaatgggggcaatggcatc

SEQ ID NO: 228558 - DNA, 25 bp, Mus musculus
cagcgtgactgtttggtgctgcaga

SEQ ID NO: 228559 - DNA, 25 bp, Mus musculus
cagcgtgagcggagagtgaagtgtg

SEQ ID NO: 228560 - DNA, 25 bp, Mus musculus
cagcgtgatcgcaatgagaggtatg

SEQ ID NO: 228561 - DNA, 25 bp, Mus musculus
cagcgtgccaatgcgcttaagaaaa

SEQ ID NO: 228562 - DNA, 25 bp, Mus musculus
cagcgtgccaatgcgtgcatgtcct

SEQ ID NO: 228563 - DNA, 25 bp, Mus musculus
cagcgtgcgcatcacccagaacaca

SEQ ID NO: 228564 - DNA, 25 bp, Mus musculus
cagcgtggagcccttggatgaagca

SEQ ID NO: 228565 - DNA, 25 bp, Mus musculus
cagcgtggagctgcagcccttggat

SEQ ID NO: 228566 - DNA, 25 bp, Mus musculus
cagcgtggctggtcttgagaccatc

SEQ ID NO: 228567 - DNA, 25 bp, Mus musculus
cagcgtggggaaacctgctcggtac

SEQ ID NO: 228568 - DNA, 25 bp, Mus musculus
cagcgtggggtctgagatcccaagt

SEQ ID NO: 228569 - DNA, 25 bp, Mus musculus
cagcgtgtcctatgactggccactg

SEQ ID NO: 228570 - DNA, 25 bp, Mus musculus
cagcgtgtcctatgactggctgatc

SEQ ID NO: 228571 - DNA, 25 bp, Mus musculus
cagcgtgtctcatactacaaggaac

SEQ ID NO: 228572 - DNA, 25 bp, Mus musculus
cagcgttacagccaggcatgctgag

SEQ ID NO: 228573 - DNA, 25 bp, Mus musculus
cagcgttcacaagatcatttccatg

SEQ ID NO: 228574 - DNA, 25 bp, Mus musculus
cagcgttcacaagtctgagttcact

SEQ ID NO: 228575 - DNA, 25 bp, Mus musculus
cagcgttccaaaagctgccgcagtg

SEQ ID NO: 228576 - DNA, 25 bp, Mus musculus
cagcgttcgaggagcgacacaacgc

SEQ ID NO: 228577 - DNA, 25 bp, Mus musculus
cagcgttcgaggtcgtgagtcagct

SEQ ID NO: 228578 - DNA, 25 bp, Mus musculus
cagcgttggtttttcagaagatatg

SEQ ID NO: 228579 - DNA, 25 bp, Mus musculus
cagcgttggtttttctaggaaatca

SEQ ID NO: 228580 - DNA, 25 bp, Mus musculus
cagcgttggtttttgtctccctgca

SEQ ID NO: 228581 - DNA, 25 bp, Mus musculus
cagcgttgtcagtcttatggggccc

SEQ ID NO: 228582 - DNA, 25 bp, Mus musculus
cagcgtttgcttcatgactttatat

SEQ ID NO: 228583 - DNA, 25 bp, Mus musculus
cagctaaaaagtgggaaatgaaagc

SEQ ID NO: 228584 - DNA, 25 bp, Mus musculus
cagctaaaatttccacctgctgatc

SEQ ID NO: 228585 - DNA, 25 bp, Mus musculus
cagctaaacaacaagatctgtgata

SEQ ID NO: 228586 - DNA, 25 bp, Mus musculus
cagctaaactcagcccaaggcttgc

SEQ ID NO: 228587 - DNA, 25 bp, Mus musculus
cagctaaagactgtttttgttaatt

SEQ ID NO: 228588 - DNA, 25 bp, Mus musculus
cagctaaagagaatggactcgctac

SEQ ID NO: 228589 - DNA, 25 bp, Mus musculus
cagctaaagagaggatcaccttaca

SEQ ID NO: 228590 - DNA, 25 bp, Mus musculus
cagctaaaggaggctgtgaggggaa

SEQ ID NO: 228591 - DNA, 25 bp, Mus musculus
cagctaaaggcagaccattccacat

SEQ ID NO: 228592 - DNA, 25 bp, Mus musculus
cagctaaagtgtatactcctgatca

SEQ ID NO: 228593 - DNA, 25 bp, Mus musculus
cagctaacaggattggtatcattga

SEQ ID NO: 228594 - DNA, 25 bp, Mus musculus
cagctaacagtggtaccagtggggg

SEQ ID NO: 228595 - DNA, 25 bp, Mus musculus
cagctaaccaaggaagggatgctac

SEQ ID NO: 228596 - DNA, 25 bp, Mus musculus
cagctaaccaaggtttgcccacagg

SEQ ID NO: 228597 - DNA, 25 bp, Mus musculus
cagctaagagccaggtaatttctaa

SEQ ID NO: 228598 - DNA, 25 bp, Mus musculus
cagctaagcaggtctgaagaaaggt

SEQ ID NO: 228599 - DNA, 25 bp, Mus musculus
cagctaaggaaaggtacaaaaatat

SEQ ID NO: 228600 - DNA, 25 bp, Mus musculus
cagctaagggtgtcagggtcactgt

SEQ ID NO: 228601 - DNA, 25 bp, Mus musculus
cagctaatgatactgtcggccagtg

SEQ ID NO: 228602 - DNA, 25 bp, Mus musculus
cagctacaaaggcaacatctgggag

SEQ ID NO: 228603 - DNA, 25 bp, Mus musculus
cagctacaaagtgtctttgccatga

SEQ ID NO: 228604 - DNA, 25 bp, Mus musculus
cagctacaagaggaatcattgacct

SEQ ID NO: 228605 - DNA, 25 bp, Mus musculus
cagctacaagatgctgggtgccctg

SEQ ID NO: 228606 - DNA, 25 bp, Mus musculus
cagctacacatgcaactgtgttatt

SEQ ID NO: 228607 - DNA, 25 bp, Mus musculus
cagctacacctgccggtcagggatc

SEQ ID NO: 228608 - DNA, 25 bp, Mus musculus
cagctacacctgccggtccaaccgt

SEQ ID NO: 228609 - DNA, 25 bp, Mus musculus
cagctacatctcaggccagggcttt

SEQ ID NO: 228610 - DNA, 25 bp, Mus musculus
cagctacatctcaggcccctggttt

SEQ ID NO: 228611 - DNA, 25 bp, Mus musculus
cagctaccagtgtccaaatgatgag

SEQ ID NO: 228612 - DNA, 25 bp, Mus musculus
cagctacccaggttgaggctgagga

SEQ ID NO: 228613 - DNA, 25 bp, Mus musculus
cagctaccccaacaatgcaccttcc

SEQ ID NO: 228614 - DNA, 25 bp, Mus musculus
cagctaccccaacaggccccgggtg

SEQ ID NO: 228615 - DNA, 25 bp, Mus musculus
cagctacccccagatccctgcagcc

SEQ ID NO: 228616 - DNA, 25 bp, Mus musculus
cagctacccttcctgcacccaggac

SEQ ID NO: 228617 - DNA, 25 bp, Mus musculus
cagctaccgaggagagagtcagaaa

SEQ ID NO: 228618 - DNA, 25 bp, Mus musculus
cagctaccgaggtgctgcaggagtt

SEQ ID NO: 228619 - DNA, 25 bp, Mus musculus
cagctaccggagttggatcggtcat

SEQ ID NO: 228620 - DNA, 25 bp, Mus musculus
cagctacctagcatgtccaaaattc

SEQ ID NO: 228621 - DNA, 25 bp, Mus musculus
cagctacctcggtaccagtacttga

SEQ ID NO: 228622 - DNA, 25 bp, Mus musculus
cagctacgcatcatgccactgcctt

SEQ ID NO: 228623 - DNA, 25 bp, Mus musculus
cagctacgccaggcacaaatatgcc

SEQ ID NO: 228624 - DNA, 25 bp, Mus musculus
cagctactatgagaagctccataag

SEQ ID NO: 228625 - DNA, 25 bp, Mus musculus
cagctactcaggcagatccgttttg

SEQ ID NO: 228626 - DNA, 25 bp, Mus musculus
cagctactcaggcagtatctccagg

SEQ ID NO: 228627 - DNA, 25 bp, Mus musculus
cagctactgcgggggactccccact

SEQ ID NO: 228628 - DNA, 25 bp, Mus musculus
cagctactggagaagaagtcttgga

SEQ ID NO: 228629 - DNA, 25 bp, Mus musculus
cagctactggagaaggtgcaaaaca

SEQ ID NO: 228630 - DNA, 25 bp, Mus musculus
cagctacttcgtaagaatgtcttcc

SEQ ID NO: 228631 - DNA, 25 bp, Mus musculus
cagctacttctcaaggaaacttcat

SEQ ID NO: 228632 - DNA, 25 bp, Mus musculus
cagctacttctcaaggaggcgcttc

SEQ ID NO: 228633 - DNA, 25 bp, Mus musculus
cagctacttggttccctgccgctca

SEQ ID NO: 228634 - DNA, 25 bp, Mus musculus
cagctagaaacgagatgtccctgct

SEQ ID NO: 228635 - DNA, 25 bp, Mus musculus
cagctagaaacttctcctctgttcc

SEQ ID NO: 228636 - DNA, 25 bp, Mus musculus
cagctagaagggaagtctcagcgct

SEQ ID NO: 228637 - DNA, 25 bp, Mus musculus
cagctagaatgcactggggctgctg

SEQ ID NO: 228638 - DNA, 25 bp, Mus musculus
cagctagagaccaaaaccaacaaaa

SEQ ID NO: 228639 - DNA, 25 bp, Mus musculus
cagctagagagaattccagaattgg

SEQ ID NO: 228640 - DNA, 25 bp, Mus musculus
cagctagagaggacccttatggtgt

SEQ ID NO: 228641 - DNA, 25 bp, Mus musculus
cagctagagcgacagcagttggaaa

SEQ ID NO: 228642 - DNA, 25 bp, Mus musculus
cagctagaggaagcctccatttaca

SEQ ID NO: 228643 - DNA, 25 bp, Mus musculus
cagctagaggaaggcagagcatggg

SEQ ID NO: 228644 - DNA, 25 bp, Mus musculus
cagctagcaaagcactgctgttctt

SEQ ID NO: 228645 - DNA, 25 bp, Mus musculus
cagctagcaggtgccttccaacctt

SEQ ID NO: 228646 - DNA, 25 bp, Mus musculus
cagctagcagtaatggtaagtatac

SEQ ID NO: 228647 - DNA, 25 bp, Mus musculus
cagctagcagtaatggtccatcctg

SEQ ID NO: 228648 - DNA, 25 bp, Mus musculus
cagctagctatgacctatgaggaga

SEQ ID NO: 228649 - DNA, 25 bp, Mus musculus
cagctagctggatcaccgacaacca

SEQ ID NO: 228650 - DNA, 25 bp, Mus musculus
cagctagctggttgcagaggttttg

SEQ ID NO: 228651 - DNA, 25 bp, Mus musculus
cagctagctgtgcgcagttcctggt

SEQ ID NO: 228652 - DNA, 25 bp, Mus musculus
cagctagggaatgaaggtgaagaga

SEQ ID NO: 228653 - DNA, 25 bp, Mus musculus
cagctagtcttttaatggagaatgg

SEQ ID NO: 228654 - DNA, 25 bp, Mus musculus
cagctagtcttttaggtaagaagta

SEQ ID NO: 228655 - DNA, 25 bp, Mus musculus
cagctagtgaccagatactgttaaa

SEQ ID NO: 228656 - DNA, 25 bp, Mus musculus
cagctagtgaccaggatcgactgcg

SEQ ID NO: 228657 - DNA, 25 bp, Mus musculus
cagctatagcctggacctgctctcc

SEQ ID NO: 228658 - DNA, 25 bp, Mus musculus
cagctatagcctggtgcttgagaag

SEQ ID NO: 228659 - DNA, 25 bp, Mus musculus
cagctatagctcagctgcctcatat

SEQ ID NO: 228660 - DNA, 25 bp, Mus musculus
cagctatcccaggaccgggacttca

SEQ ID NO: 228661 - DNA, 25 bp, Mus musculus
cagctatcccaggcccctctgcccc

SEQ ID NO: 228662 - DNA, 25 bp, Mus musculus
cagctatctccggtccaaatatcac

SEQ ID NO: 228663 - DNA, 25 bp, Mus musculus
cagctatgacattgcctcccacccg

SEQ ID NO: 228664 - DNA, 25 bp, Mus musculus
cagctatgagaagcaacaggccacc

SEQ ID NO: 228665 - DNA, 25 bp, Mus musculus
cagctatgagcctggagtactcgga

SEQ ID NO: 228666 - DNA, 25 bp, Mus musculus
cagctatgccccaagattcagtccc

SEQ ID NO: 228667 - DNA, 25 bp, Mus musculus
cagctatgccccaaggaaagagtgc

SEQ ID NO: 228668 - DNA, 25 bp, Mus musculus
cagctatgcccggaattgaaagaat

SEQ ID NO: 228669 - DNA, 25 bp, Mus musculus
cagctatggtttaagacgcttaaag

SEQ ID NO: 228670 - DNA, 25 bp, Mus musculus
cagctcaaagctgctgagagcctct

SEQ ID NO: 228671 - DNA, 25 bp, Mus musculus
cagctcaaagctgtgtgtcaaccac

SEQ ID NO: 228672 - DNA, 25 bp, Mus musculus
cagctcaaagggaaggaaaacgctt

SEQ ID NO: 228673 - DNA, 25 bp, Mus musculus
cagctcaacaaggagctggtgattg

SEQ ID NO: 228674 - DNA, 25 bp, Mus musculus
cagctcaacatgtatggcttccgaa

SEQ ID NO: 228675 - DNA, 25 bp, Mus musculus
cagctcaacatgtctcattcagttc

SEQ ID NO: 228676 - DNA, 25 bp, Mus musculus
cagctcaaggaggctcaacgcacag

SEQ ID NO: 228677 - DNA, 25 bp, Mus musculus
cagctcaatacttctaccagaatcg

SEQ ID NO: 228678 - DNA, 25 bp, Mus musculus
cagctcaatacttctatttttttat

SEQ ID NO: 228679 - DNA, 25 bp, Mus musculus
cagctcaatgcacatcttcaagaaa

SEQ ID NO: 228680 - DNA, 25 bp, Mus musculus
cagctcacagaagcctgcagagcct

SEQ ID NO: 228681 - DNA, 25 bp, Mus musculus
cagctcacagaaggacatggctttc

SEQ ID NO: 228682 - DNA, 25 bp, Mus musculus
cagctcaccaagcgggtcaaaaatg

SEQ ID NO: 228683 - DNA, 25 bp, Mus musculus
cagctcaccaccctgaggcaaagaa

SEQ ID NO: 228684 - DNA, 25 bp, Mus musculus
cagctcaccaccctgagtccagaca

SEQ ID NO: 228685 - DNA, 25 bp, Mus musculus
cagctcacctccgctgcctgccttg

SEQ ID NO: 228686 - DNA, 25 bp, Mus musculus
cagctcacgatccaggtcagagcag

SEQ ID NO: 228687 - DNA, 25 bp, Mus musculus
cagctcacgatccaggtgttcactg

SEQ ID NO: 228688 - DNA, 25 bp, Mus musculus
cagctcagagagaatccaccttgac

SEQ ID NO: 228689 - DNA, 25 bp, Mus musculus
cagctcagagcagctttgacctcga

SEQ ID NO: 228690 - DNA, 25 bp, Mus musculus
cagctcagaggcaggtttttccctt

SEQ ID NO: 228691 - DNA, 25 bp, Mus musculus
cagctcagcatcagggagccataat

SEQ ID NO: 228692 - DNA, 25 bp, Mus musculus
cagctcagcatcagggattgttaca

SEQ ID NO: 228693 - DNA, 25 bp, Mus musculus
cagctcagcatgaaagcatccctgg

SEQ ID NO: 228694 - DNA, 25 bp, Mus musculus
cagctcagccctgcccacctcaaac

SEQ ID NO: 228695 - DNA, 25 bp, Mus musculus
cagctcagcctggaagacctgccag

SEQ ID NO: 228696 - DNA, 25 bp, Mus musculus
cagctcaggagcgccccacccatcc

SEQ ID NO: 228697 - DNA, 25 bp, Mus musculus
cagctcagtcactcagctgcagcag

SEQ ID NO: 228698 - DNA, 25 bp, Mus musculus
cagctcatattaaggaggccttgtc

SEQ ID NO: 228699 - DNA, 25 bp, Mus musculus
cagctcatcctggaccctgcatgct

SEQ ID NO: 228700 - DNA, 25 bp, Mus musculus
cagctcattgtgggaaactccaaac

SEQ ID NO: 228701 - DNA, 25 bp, Mus musculus
cagctcattgtggggaccagcggga

SEQ ID NO: 228702 - DNA, 25 bp, Mus musculus
cagctcatttcaggttgctcaccac

SEQ ID NO: 228703 - DNA, 25 bp, Mus musculus
cagctccaacgatgtgaaagagttc

SEQ ID NO: 228704 - DNA, 25 bp, Mus musculus
cagctccaagaaaagcaccttcatc

SEQ ID NO: 228705 - DNA, 25 bp, Mus musculus
cagctccaagatgagcgtgaagctg

SEQ ID NO: 228706 - DNA, 25 bp, Mus musculus
cagctccacacaatatgacgtgttc

SEQ ID NO: 228707 - DNA, 25 bp, Mus musculus
cagctccacagcaggtggctggatt

SEQ ID NO: 228708 - DNA, 25 bp, Mus musculus
cagctccaccccctactccccgagc

SEQ ID NO: 228709 - DNA, 25 bp, Mus musculus
cagctccacctggaaatgttctgcg

SEQ ID NO: 228710 - DNA, 25 bp, Mus musculus
cagctccacctgttatttggccggt

SEQ ID NO: 228711 - DNA, 25 bp, Mus musculus
cagctccaccttcagacccaggcct

SEQ ID NO: 228712 - DNA, 25 bp, Mus musculus
cagctccagagccggggaatggtct

SEQ ID NO: 228713 - DNA, 25 bp, Mus musculus
cagctccagagccggtttagtctcc

SEQ ID NO: 228714 - DNA, 25 bp, Mus musculus
cagctccagcaggaccttctaccgt

SEQ ID NO: 228715 - DNA, 25 bp, Mus musculus
cagctccagcaggctcttgcttgat

SEQ ID NO: 228716 - DNA, 25 bp, Mus musculus
cagctccagccagggatagagaagg

SEQ ID NO: 228717 - DNA, 25 bp, Mus musculus
cagctccagccccctgaagacgatg

SEQ ID NO: 228718 - DNA, 25 bp, Mus musculus
cagctccaggaagcagtcatgacaa

SEQ ID NO: 228719 - DNA, 25 bp, Mus musculus
cagctccagtttttcagccgtgcca

SEQ ID NO: 228720 - DNA, 25 bp, Mus musculus
cagctccatcaacaggatcattcgg

SEQ ID NO: 228721 - DNA, 25 bp, Mus musculus
cagctcccaacccctccaaggcccg

SEQ ID NO: 228722 - DNA, 25 bp, Mus musculus
cagctcccaccgcagcccagggaga

SEQ ID NO: 228723 - DNA, 25 bp, Mus musculus
cagctcccaccgcaggtatcatccg

SEQ ID NO: 228724 - DNA, 25 bp, Mus musculus
cagctcccagctaaatgtggtcaac

SEQ ID NO: 228725 - DNA, 25 bp, Mus musculus
cagctcccaggactggtcaatgtgg

SEQ ID NO: 228726 - DNA, 25 bp, Mus musculus
cagctcccaggaggttcatgagtta

SEQ ID NO: 228727 - DNA, 25 bp, Mus musculus
cagctcccaggttgaagaaatggta

SEQ ID NO: 228728 - DNA, 25 bp, Mus musculus
cagctccccctcagatccaacactc

SEQ ID NO: 228729 - DNA, 25 bp, Mus musculus
cagctccccctcagggatccgtgaa

SEQ ID NO: 228730 - DNA, 25 bp, Mus musculus
cagctccccgttaggccagcaggtg

SEQ ID NO: 228731 - DNA, 25 bp, Mus musculus
cagctcccctcgaagcagcaccggg

SEQ ID NO: 228732 - DNA, 25 bp, Mus musculus
cagctcccggaaagtgaattatact

SEQ ID NO: 228733 - DNA, 25 bp, Mus musculus
cagctccctagaagatggattcatg

SEQ ID NO: 228734 - DNA, 25 bp, Mus musculus
cagctccctagaagggcaacaaccc

SEQ ID NO: 228735 - DNA, 25 bp, Mus musculus
cagctccctcaaagatgaacgagac

SEQ ID NO: 228736 - DNA, 25 bp, Mus musculus
cagctccctgacagaggatggtttg

SEQ ID NO: 228737 - DNA, 25 bp, Mus musculus
cagctccctgacagctatattgtct

SEQ ID NO: 228738 - DNA, 25 bp, Mus musculus
cagctccctgctccggcaagacatt

SEQ ID NO: 228739 - DNA, 25 bp, Mus musculus
cagctccgagagcaggtctggggat

SEQ ID NO: 228740 - DNA, 25 bp, Mus musculus
cagctccgagaggtcctggcccaga

SEQ ID NO: 228741 - DNA, 25 bp, Mus musculus
cagctccggcgggcggcctcattgc

SEQ ID NO: 228742 - DNA, 25 bp, Mus musculus
cagctccggcgggcggtggtacagg

SEQ ID NO: 228743 - DNA, 25 bp, Mus musculus
cagctccgggctgagtcaagtccat

SEQ ID NO: 228744 - DNA, 25 bp, Mus musculus
cagctcctaacttatctacactgac

SEQ ID NO: 228745 - DNA, 25 bp, Mus musculus
cagctcctacctccttcttcagagc

SEQ ID NO: 228746 - DNA, 25 bp, Mus musculus
cagctcctattcaggccatgtggct

SEQ ID NO: 228747 - DNA, 25 bp, Mus musculus
cagctcctcaccgcagcacccccac

SEQ ID NO: 228748 - DNA, 25 bp, Mus musculus
cagctcctcaccggaacaaggagcc

SEQ ID NO: 228749 - DNA, 25 bp, Mus musculus
cagctcctccgacgtggtgacgtat

SEQ ID NO: 228750 - DNA, 25 bp, Mus musculus
cagctcctccggcactttgacacag

SEQ ID NO: 228751 - DNA, 25 bp, Mus musculus
cagctcctccggtacaaggttctgc

SEQ ID NO: 228752 - DNA, 25 bp, Mus musculus
cagctcctgaatgtacccctctaga

SEQ ID NO: 228753 - DNA, 25 bp, Mus musculus
cagctcctgacaaacgtcctggaaa

SEQ ID NO: 228754 - DNA, 25 bp, Mus musculus
cagctcctgcagccggatgtatgga

SEQ ID NO: 228755 - DNA, 25 bp, Mus musculus
cagctcctggaactatgtcttcagt

SEQ ID NO: 228756 - DNA, 25 bp, Mus musculus
cagctcctggaactgaataaaagct

SEQ ID NO: 228757 - DNA, 25 bp, Mus musculus
cagctcctggaactgtgttacatcc

SEQ ID NO: 228758 - DNA, 25 bp, Mus musculus
cagctcctggagcagcctgactctg

SEQ ID NO: 228759 - DNA, 25 bp, Mus musculus
cagctcctggctgttggagacagga

SEQ ID NO: 228760 - DNA, 25 bp, Mus musculus
cagctcctgggatacgtattatcag

SEQ ID NO: 228761 - DNA, 25 bp, Mus musculus
cagctcctgtccaggagatggcagc

SEQ ID NO: 228762 - DNA, 25 bp, Mus musculus
cagctcgaacgatcgccggggctct

SEQ ID NO: 228763 - DNA, 25 bp, Mus musculus
cagctcgacagatgccaaagtctga

SEQ ID NO: 228764 - DNA, 25 bp, Mus musculus
cagctcgacaggtgcagggccctgt

SEQ ID NO: 228765 - DNA, 25 bp, Mus musculus
cagctcgagcaggacttccaatagt

SEQ ID NO: 228766 - DNA, 25 bp, Mus musculus
cagctcgagcaggttaggagaagga

SEQ ID NO: 228767 - DNA, 25 bp, Mus musculus
cagctcgagccagacagattccctc

SEQ ID NO: 228768 - DNA, 25 bp, Mus musculus
cagctcgagtgccatccgtgagcgc

SEQ ID NO: 228769 - DNA, 25 bp, Mus musculus
cagctcgcacagtgatgatgtgctg

SEQ ID NO: 228770 - DNA, 25 bp, Mus musculus
cagctcgcacagtgggctgttggtg

SEQ ID NO: 228771 - DNA, 25 bp, Mus musculus
cagctcgcacagtggtttcaagtgc

SEQ ID NO: 228772 - DNA, 25 bp, Mus musculus
cagctcgcccaacttcatcaagcca

SEQ ID NO: 228773 - DNA, 25 bp, Mus musculus
cagctcgctgagcctgttcctgcgc

SEQ ID NO: 228774 - DNA, 25 bp, Mus musculus
cagctcggaggacaggtcaatggcc

SEQ ID NO: 228775 - DNA, 25 bp, Mus musculus
cagctcgtaaagctcaatgtcgaca

SEQ ID NO: 228776 - DNA, 25 bp, Mus musculus
cagctcgtttcaagagaacggcagg

SEQ ID NO: 228777 - DNA, 25 bp, Mus musculus
cagctctaaagcgagacctagatgc

SEQ ID NO: 228778 - DNA, 25 bp, Mus musculus
cagctctaattggtttcaaatgtat

SEQ ID NO: 228779 - DNA, 25 bp, Mus musculus
cagctctacctaggcacaaaaggca

SEQ ID NO: 228780 - DNA, 25 bp, Mus musculus
cagctctattggctaatgggccaat

SEQ ID NO: 228781 - DNA, 25 bp, Mus musculus
cagctctcaccgagcgcagccttgg

SEQ ID NO: 228782 - DNA, 25 bp, Mus musculus
cagctctcagacaggaacagaaatt

SEQ ID NO: 228783 - DNA, 25 bp, Mus musculus
cagctctcagacaggtttggtcgca

SEQ ID NO: 228784 - DNA, 25 bp, Mus musculus
cagctctccagatcatggctccttg

SEQ ID NO: 228785 - DNA, 25 bp, Mus musculus
cagctctccagtgtggatgccacct

SEQ ID NO: 228786 - DNA, 25 bp, Mus musculus
cagctctcctgcaaaggctgaggag

SEQ ID NO: 228787 - DNA, 25 bp, Mus musculus
cagctctcctgcaaatgtccaaacg

SEQ ID NO: 228788 - DNA, 25 bp, Mus musculus
cagctctcctgcaagtgtcctgtgg

SEQ ID NO: 228789 - DNA, 25 bp, Mus musculus
cagctctcctgttaggcgtctcttt

SEQ ID NO: 228790 - DNA, 25 bp, Mus musculus
cagctctcgcagagacgtggagcta

SEQ ID NO: 228791 - DNA, 25 bp, Mus musculus
cagctctcggggatcttgaaacagg

SEQ ID NO: 228792 - DNA, 25 bp, Mus musculus
cagctctctatgatcttaccaatat

SEQ ID NO: 228793 - DNA, 25 bp, Mus musculus
cagctctctcaggagttaaaaataa

SEQ ID NO: 228794 - DNA, 25 bp, Mus musculus
cagctctctccccatgactgacttg

SEQ ID NO: 228795 - DNA, 25 bp, Mus musculus
cagctctgaaaaagtcaccttaatt

SEQ ID NO: 228796 - DNA, 25 bp, Mus musculus
cagctctgacagttccaggaggcag

SEQ ID NO: 228797 - DNA, 25 bp, Mus musculus
cagctctgagaggatgtgcccgata

SEQ ID NO: 228798 - DNA, 25 bp, Mus musculus
cagctctgcaagagaagctgatggt

SEQ ID NO: 228799 - DNA, 25 bp, Mus musculus
cagctctgcaagtacggttagaaca

SEQ ID NO: 228800 - DNA, 25 bp, Mus musculus
cagctctgcaccagagattgtgcac

SEQ ID NO: 228801 - DNA, 25 bp, Mus musculus
cagctctgcaccaggtctacctggg

SEQ ID NO: 228802 - DNA, 25 bp, Mus musculus
cagctctgcagccccatgtgcatgc

SEQ ID NO: 228803 - DNA, 25 bp, Mus musculus
cagctctgcatacggtagtctttta

SEQ ID NO: 228804 - DNA, 25 bp, Mus musculus
cagctctgccctggattggtagctt

SEQ ID NO: 228805 - DNA, 25 bp, Mus musculus
cagctctgcctatttgatcaagagg

SEQ ID NO: 228806 - DNA, 25 bp, Mus musculus
cagctctgcggaggtgctgctgggg

SEQ ID NO: 228807 - DNA, 25 bp, Mus musculus
cagctctgggatgtcacagccgcag

SEQ ID NO: 228808 - DNA, 25 bp, Mus musculus
cagctctggggaagccttggccacg

SEQ ID NO: 228809 - DNA, 25 bp, Mus musculus
cagctctggggaagctgctgcccag

SEQ ID NO: 228810 - DNA, 25 bp, Mus musculus
cagctctggtcgaggaagatgggct

SEQ ID NO: 228811 - DNA, 25 bp, Mus musculus
cagctctggttagaggtgaagaata

SEQ ID NO: 228812 - DNA, 25 bp, Mus musculus
cagctctgtgctgtattttcatctg

SEQ ID NO: 228813 - DNA, 25 bp, Mus musculus
cagctctgtggaatcaccctgcccc

SEQ ID NO: 228814 - DNA, 25 bp, Mus musculus
cagctctgtggtttgggctcagttt

SEQ ID NO: 228815 - DNA, 25 bp, Mus musculus
cagctcttaagaaggactgcagtga

SEQ ID NO: 228816 - DNA, 25 bp, Mus musculus
cagctcttagagattcccaccctgc

SEQ ID NO: 228817 - DNA, 25 bp, Mus musculus
cagctcttcacggcactggttctaa

SEQ ID NO: 228818 - DNA, 25 bp, Mus musculus
cagctcttcaggttgatcgccttag

SEQ ID NO: 228819 - DNA, 25 bp, Mus musculus
cagctcttgggagagcgcattaaag

SEQ ID NO: 228820 - DNA, 25 bp, Mus musculus
cagctctttagggttctactttacc

SEQ ID NO: 228821 - DNA, 25 bp, Mus musculus
cagctctttaggtctgaacggcgtt

SEQ ID NO: 228822 - DNA, 25 bp, Mus musculus
cagctcttttccaggcatggtttat

SEQ ID NO: 228823 - DNA, 25 bp, Mus musculus
cagctgaaaaacattggattgcaat

SEQ ID NO: 228824 - DNA, 25 bp, Mus musculus
cagctgaaactgaaggctggcaaca

SEQ ID NO: 228825 - DNA, 25 bp, Mus musculus
cagctgaaccagctcaaaggcaaat

SEQ ID NO: 228826 - DNA, 25 bp, Mus musculus
cagctgaacctaaggctgctgactt

SEQ ID NO: 228827 - DNA, 25 bp, Mus musculus
cagctgaagtcaggaaagtcagcag

SEQ ID NO: 228828 - DNA, 25 bp, Mus musculus
cagctgacagaaccagcagatagac

SEQ ID NO: 228829 - DNA, 25 bp, Mus musculus
cagctgacagatggcgttgacgttg

SEQ ID NO: 228830 - DNA, 25 bp, Mus musculus
cagctgacaggattcagtttgcctg

SEQ ID NO: 228831 - DNA, 25 bp, Mus musculus
cagctgacccactgaagctgggggc

SEQ ID NO: 228832 - DNA, 25 bp, Mus musculus
cagctgacccagatatatttgtatg

SEQ ID NO: 228833 - DNA, 25 bp, Mus musculus
cagctgacccaggacatttgacacc

SEQ ID NO: 228834 - DNA, 25 bp, Mus musculus
cagctgacccagtttgctgagaagt

SEQ ID NO: 228835 - DNA, 25 bp, Mus musculus
cagctgaccccagagcaccagactg

SEQ ID NO: 228836 - DNA, 25 bp, Mus musculus
cagctgacccgactcagccttatgg

SEQ ID NO: 228837 - DNA, 25 bp, Mus musculus
cagctgactcagcaaatggaacttc

SEQ ID NO: 228838 - DNA, 25 bp, Mus musculus
cagctgactcagcccggcaagctga

SEQ ID NO: 228839 - DNA, 25 bp, Mus musculus
cagctgactcatatgagtccaacac

SEQ ID NO: 228840 - DNA, 25 bp, Mus musculus
cagctgactcatatgccctggtgtg

SEQ ID NO: 228841 - DNA, 25 bp, Mus musculus
cagctgactgagcacactctgcaga

SEQ ID NO: 228842 - DNA, 25 bp, Mus musculus
cagctgactgagcacgcggtggagg

SEQ ID NO: 228843 - DNA, 25 bp, Mus musculus
cagctgagcacgttgagccacgtgg

SEQ ID NO: 228844 - DNA, 25 bp, Mus musculus
cagctgagcctccccctgcaggagg

SEQ ID NO: 228845 - DNA, 25 bp, Mus musculus
cagctgagcggcagccgccacctag

SEQ ID NO: 228846 - DNA, 25 bp, Mus musculus
cagctgagcggtcaaagcagccgcc

SEQ ID NO: 228847 - DNA, 25 bp, Mus musculus
cagctgaggaatgtgatggttctcc

SEQ ID NO: 228848 - DNA, 25 bp, Mus musculus
cagctgaggaatgtgcccctgtccc

SEQ ID NO: 228849 - DNA, 25 bp, Mus musculus
cagctgaggcagagaaaaggcagga

SEQ ID NO: 228850 - DNA, 25 bp, Mus musculus
cagctgaggcagggtcagaaagcat

SEQ ID NO: 228851 - DNA, 25 bp, Mus musculus
cagctgagttcacagaaacttcgtg

SEQ ID NO: 228852 - DNA, 25 bp, Mus musculus
cagctgagttcacagagttctcagt

SEQ ID NO: 228853 - DNA, 25 bp, Mus musculus
cagctgagtttacaatccaagagaa

SEQ ID NO: 228854 - DNA, 25 bp, Mus musculus
cagctgagtttacaattttctaatg

SEQ ID NO: 228855 - DNA, 25 bp, Mus musculus
cagctgagtttagaatccaagagaa

SEQ ID NO: 228856 - DNA, 25 bp, Mus musculus
cagctgagtttagaattttctaatg

SEQ ID NO: 228857 - DNA, 25 bp, Mus musculus
cagctgatcaagaggcctgccaagc

SEQ ID NO: 228858 - DNA, 25 bp, Mus musculus
cagctgatcaagccagccatctccc

SEQ ID NO: 228859 - DNA, 25 bp, Mus musculus
cagctgatcctgataccgctattgt

SEQ ID NO: 228860 - DNA, 25 bp, Mus musculus
cagctgatcgagaaaacataaagaa

SEQ ID NO: 228861 - DNA, 25 bp, Mus musculus
cagctgatgagggttctggggacat

SEQ ID NO: 228862 - DNA, 25 bp, Mus musculus
cagctgatggagagaggtgccagcg

SEQ ID NO: 228863 - DNA, 25 bp, Mus musculus
cagctgatggagagttatttgcttg

SEQ ID NO: 228864 - DNA, 25 bp, Mus musculus
cagctgcaaaggagggctgctggcc

SEQ ID NO: 228865 - DNA, 25 bp, Mus musculus
cagctgcaaggcaggttggcgtggg

SEQ ID NO: 228866 - DNA, 25 bp, Mus musculus
cagctgcaatggcagaacacaagaa

SEQ ID NO: 228867 - DNA, 25 bp, Mus musculus
cagctgcaatggcagcctggactgc

SEQ ID NO: 228868 - DNA, 25 bp, Mus musculus
cagctgcaatggcaggttttactgc

SEQ ID NO: 228869 - DNA, 25 bp, Mus musculus
cagctgcaatggggactctggcgga

SEQ ID NO: 228870 - DNA, 25 bp, Mus musculus
cagctgcactcaaaagtcagcgtgg

SEQ ID NO: 228871 - DNA, 25 bp, Mus musculus
cagctgcactcaggaagaggagaca

SEQ ID NO: 228872 - DNA, 25 bp, Mus musculus
cagctgcagaaaggtcagacgggaa

SEQ ID NO: 228873 - DNA, 25 bp, Mus musculus
cagctgcagaaccaggtggagaatc

SEQ ID NO: 228874 - DNA, 25 bp, Mus musculus
cagctgcagactctgatactaccac

SEQ ID NO: 228875 - DNA, 25 bp, Mus musculus
cagctgcagagtgatgtcaagtaca

SEQ ID NO: 228876 - DNA, 25 bp, Mus musculus
cagctgcagcaataccctgcagcaa

SEQ ID NO: 228877 - DNA, 25 bp, Mus musculus
cagctgcagcagggctcatggcaga

SEQ ID NO: 228878 - DNA, 25 bp, Mus musculus
cagctgcagcccctgtccaggtgat

SEQ ID NO: 228879 - DNA, 25 bp, Mus musculus
cagctgcagcctctgtccggatagc

SEQ ID NO: 228880 - DNA, 25 bp, Mus musculus
cagctgcagctgctgaaggaagcaa

SEQ ID NO: 228881 - DNA, 25 bp, Mus musculus
cagctgcaggaatagtgattgacgg

SEQ ID NO: 228882 - DNA, 25 bp, Mus musculus
cagctgcagggcaagatccggactc

SEQ ID NO: 228883 - DNA, 25 bp, Mus musculus
cagctgcagtcccacttgttcggcc

SEQ ID NO: 228884 - DNA, 25 bp, Mus musculus
cagctgcatatctaggggagtatgt

SEQ ID NO: 228885 - DNA, 25 bp, Mus musculus
cagctgcatgtgctccctctctata

SEQ ID NO: 228886 - DNA, 25 bp, Mus musculus
cagctgccaaacgtcaaactccgtg

SEQ ID NO: 228887 - DNA, 25 bp, Mus musculus
cagctgccaatgggattggtcgcct

SEQ ID NO: 228888 - DNA, 25 bp, Mus musculus
cagctgccagactctgatagacttg

SEQ ID NO: 228889 - DNA, 25 bp, Mus musculus
cagctgccagcaggtagatcatgat

SEQ ID NO: 228890 - DNA, 25 bp, Mus musculus
cagctgccagcaggtctccccctcc

SEQ ID NO: 228891 - DNA, 25 bp, Mus musculus
cagctgccatccctggatgtcagtg

SEQ ID NO: 228892 - DNA, 25 bp, Mus musculus
cagctgccatcggacaaggctgtct

SEQ ID NO: 228893 - DNA, 25 bp, Mus musculus
cagctgccatgactcagtcggctgt

SEQ ID NO: 228894 - DNA, 25 bp, Mus musculus
cagctgccatgggaattcctcaagc

SEQ ID NO: 228895 - DNA, 25 bp, Mus musculus
cagctgccatgggacaaggctgtct

SEQ ID NO: 228896 - DNA, 25 bp, Mus musculus
cagctgccgataagtacgccctgga

SEQ ID NO: 228897 - DNA, 25 bp, Mus musculus
cagctgcctgagggtacaagttcag

SEQ ID NO: 228898 - DNA, 25 bp, Mus musculus
cagctgccttgaaagatttacaagg

SEQ ID NO: 228899 - DNA, 25 bp, Mus musculus
cagctgccttgaaagcccccaaaat

SEQ ID NO: 228900 - DNA, 25 bp, Mus musculus
cagctgcgaccttgccctcctgcgt

SEQ ID NO: 228901 - DNA, 25 bp, Mus musculus
cagctgcgaggctctacacagagag

SEQ ID NO: 228902 - DNA, 25 bp, Mus musculus
cagctgcgatgagcttaaaagatga

SEQ ID NO: 228903 - DNA, 25 bp, Mus musculus
cagctgcgcagactactttactgga

SEQ ID NO: 228904 - DNA, 25 bp, Mus musculus
cagctgcgctgggttgtggcagcat

SEQ ID NO: 228905 - DNA, 25 bp, Mus musculus
cagctgcggccacacgtgacactgg

SEQ ID NO: 228906 - DNA, 25 bp, Mus musculus
cagctgcggccacacgttctgcggg

SEQ ID NO: 228907 - DNA, 25 bp, Mus musculus
cagctgcgtgcccagggcctagtgc

SEQ ID NO: 228908 - DNA, 25 bp, Mus musculus
cagctgcgtgcccaggttgtgtagc

SEQ ID NO: 228909 - DNA, 25 bp, Mus musculus
cagctgctcaaggactcggagactc

SEQ ID NO: 228910 - DNA, 25 bp, Mus musculus
cagctgctcaaggtactccaggact

SEQ ID NO: 228911 - DNA, 25 bp, Mus musculus
cagctgctcccggcaggaaaaggaa

SEQ ID NO: 228912 - DNA, 25 bp, Mus musculus
cagctgctgacagtatccctggaag

SEQ ID NO: 228913 - DNA, 25 bp, Mus musculus
cagctgctgacccaggtcctgagga

SEQ ID NO: 228914 - DNA, 25 bp, Mus musculus
cagctgctgagcagctgcagcagcc

SEQ ID NO: 228915 - DNA, 25 bp, Mus musculus
cagctgctgagcaggttcaatttta

SEQ ID NO: 228916 - DNA, 25 bp, Mus musculus
cagctgctgaggttatttaaactga

SEQ ID NO: 228917 - DNA, 25 bp, Mus musculus
cagctgctgattgggaacaagtcag

SEQ ID NO: 228918 - DNA, 25 bp, Mus musculus
cagctgctgcgcagaagaagagctg

SEQ ID NO: 228919 - DNA, 25 bp, Mus musculus
cagctgctgctgagtgagcgggtga

SEQ ID NO: 228920 - DNA, 25 bp, Mus musculus
cagctgctggaaattagagcgctcc

SEQ ID NO: 228921 - DNA, 25 bp, Mus musculus
cagctgctggagaggttatcaatgc

SEQ ID NO: 228922 - DNA, 25 bp, Mus musculus
cagctgctggctgagggtgggatct

SEQ ID NO: 228923 - DNA, 25 bp, Mus musculus
cagctgctgggactccgaggtgact

SEQ ID NO: 228924 - DNA, 25 bp, Mus musculus
cagctgcttcttgaaaggaactctg

SEQ ID NO: 228925 - DNA, 25 bp, Mus musculus
cagctgcttgcaaaggtggtacccg

SEQ ID NO: 228926 - DNA, 25 bp, Mus musculus
cagctggaacagtggccgcacgagg

SEQ ID NO: 228927 - DNA, 25 bp, Mus musculus
cagctggaagaggacaagctgggct

SEQ ID NO: 228928 - DNA, 25 bp, Mus musculus
cagctggaagaggactagtgtctgt

SEQ ID NO: 228929 - DNA, 25 bp, Mus musculus
cagctggaagagtaccgttccccag

SEQ ID NO: 228930 - DNA, 25 bp, Mus musculus
cagctggaaggaggaagatgggctc

SEQ ID NO: 228931 - DNA, 25 bp, Mus musculus
cagctggaaggggagtgggctcacc

SEQ ID NO: 228932 - DNA, 25 bp, Mus musculus
cagctggaaggtgatttcaatctca

SEQ ID NO: 228933 - DNA, 25 bp, Mus musculus
cagctggaagtaaaggtcaccttgg

SEQ ID NO: 228934 - DNA, 25 bp, Mus musculus
cagctggaagtgaagaacccagatt

SEQ ID NO: 228935 - DNA, 25 bp, Mus musculus
cagctggaagtgaaggcctgaacca

SEQ ID NO: 228936 - DNA, 25 bp, Mus musculus
cagctggacaaaatggggtggatgg

SEQ ID NO: 228937 - DNA, 25 bp, Mus musculus
cagctggacagagagttaattgaca

SEQ ID NO: 228938 - DNA, 25 bp, Mus musculus
cagctggacagggtccgcaagcagg

SEQ ID NO: 228939 - DNA, 25 bp, Mus musculus
cagctggacgcgggagagaagatgg

SEQ ID NO: 228940 - DNA, 25 bp, Mus musculus
cagctggactgcctgaacagggaca

SEQ ID NO: 228941 - DNA, 25 bp, Mus musculus
cagctggagaagctccatttctgac

SEQ ID NO: 228942 - DNA, 25 bp, Mus musculus
cagctggagaaggtggacggtatcc

SEQ ID NO: 228943 - DNA, 25 bp, Mus musculus
cagctggagaagttgtgtgactccc

SEQ ID NO: 228944 - DNA, 25 bp, Mus musculus
cagctggagagtaggtggcattgac

SEQ ID NO: 228945 - DNA, 25 bp, Mus musculus
cagctggagcaaagattgcgccagg

SEQ ID NO: 228946 - DNA, 25 bp, Mus musculus
cagctggagcaaagtgaaaaagatt

SEQ ID NO: 228947 - DNA, 25 bp, Mus musculus
cagctggagcagaggatttcagcgt

SEQ ID NO: 228948 - DNA, 25 bp, Mus musculus
cagctggagcccacgaaccttcttt

SEQ ID NO: 228949 - DNA, 25 bp, Mus musculus
cagctggagtcaagggagatcgtgg

SEQ ID NO: 228950 - DNA, 25 bp, Mus musculus
cagctggatgaagatgggtttgtgg

SEQ ID NO: 228951 - DNA, 25 bp, Mus musculus
cagctggcaacacccaaggccctgt

SEQ ID NO: 228952 - DNA, 25 bp, Mus musculus
cagctggcaagaccggggttcgatt

SEQ ID NO: 228953 - DNA, 25 bp, Mus musculus
cagctggcaaggttatgaaaactac

SEQ ID NO: 228954 - DNA, 25 bp, Mus musculus
cagctggcagaactcaacaaaaatc

SEQ ID NO: 228955 - DNA, 25 bp, Mus musculus
cagctggcatggaagatgaaagaga

SEQ ID NO: 228956 - DNA, 25 bp, Mus musculus
cagctggccactgagctcaccctcg

SEQ ID NO: 228957 - DNA, 25 bp, Mus musculus
cagctggccactgaggacccctata

SEQ ID NO: 228958 - DNA, 25 bp, Mus musculus
cagctggcccaggcctccaggactg

SEQ ID NO: 228959 - DNA, 25 bp, Mus musculus
cagctggccgagaaaaacgggtatg

SEQ ID NO: 228960 - DNA, 25 bp, Mus musculus
cagctggccgaggaacacctgctga

SEQ ID NO: 228961 - DNA, 25 bp, Mus musculus
cagctggcgaggtgttggcagccga

SEQ ID NO: 228962 - DNA, 25 bp, Mus musculus
cagctggctaagaatgtgactgtgg

SEQ ID NO: 228963 - DNA, 25 bp, Mus musculus
cagctggcttttctgattcacccca

SEQ ID NO: 228964 - DNA, 25 bp, Mus musculus
cagctggcttttctgattttcagaa

SEQ ID NO: 228965 - DNA, 25 bp, Mus musculus
cagctgggaaagggagcctttactt

SEQ ID NO: 228966 - DNA, 25 bp, Mus musculus
cagctgggacacaaggtgtcccaaa

SEQ ID NO: 228967 - DNA, 25 bp, Mus musculus
cagctgggagagacttcataagggc

SEQ ID NO: 228968 - DNA, 25 bp, Mus musculus
cagctgggagggcgtggagctggtg

SEQ ID NO: 228969 - DNA, 25 bp, Mus musculus
cagctgggaggtggagatgtcatca

SEQ ID NO: 228970 - DNA, 25 bp, Mus musculus
cagctgggccaatgaaaaccaactc

SEQ ID NO: 228971 - DNA, 25 bp, Mus musculus
cagctgggcccagaccctggcctat

SEQ ID NO: 228972 - DNA, 25 bp, Mus musculus
cagctgggcgctcagcagttctccg

SEQ ID NO: 228973 - DNA, 25 bp, Mus musculus
cagctggggcagaagtggcagtgtg

SEQ ID NO: 228974 - DNA, 25 bp, Mus musculus
cagctggggccttggtgttgggagc

SEQ ID NO: 228975 - DNA, 25 bp, Mus musculus
cagctgggtccagcggctggaggaa

SEQ ID NO: 228976 - DNA, 25 bp, Mus musculus
cagctgggtgataggtgaccatgga

SEQ ID NO: 228977 - DNA, 25 bp, Mus musculus
cagctggtcatcgaggtcttccaga

SEQ ID NO: 228978 - DNA, 25 bp, Mus musculus
cagctggtgaagcacctcctggacc

SEQ ID NO: 228979 - DNA, 25 bp, Mus musculus
cagctggtggagatgattgcagacc

SEQ ID NO: 228980 - DNA, 25 bp, Mus musculus
cagctggtggagcactacaccacag

SEQ ID NO: 228981 - DNA, 25 bp, Mus musculus
cagctggtggaggaggaagtgaaca

SEQ ID NO: 228982 - DNA, 25 bp, Mus musculus
cagctggtggaggcatggctggaaa

SEQ ID NO: 228983 - DNA, 25 bp, Mus musculus
cagctggtggagttgttgggagaat

SEQ ID NO: 228984 - DNA, 25 bp, Mus musculus
cagctggttctgcaggagcagagcc

SEQ ID NO: 228985 - DNA, 25 bp, Mus musculus
cagctggttgaagagggtgctgata

SEQ ID NO: 228986 - DNA, 25 bp, Mus musculus
cagctggttgaagaggtgcacactt

SEQ ID NO: 228987 - DNA, 25 bp, Mus musculus
cagctggtttcccgggtatgcatgg

SEQ ID NO: 228988 - DNA, 25 bp, Mus musculus
cagctgtaaggagcttcaccctgat

SEQ ID NO: 228989 - DNA, 25 bp, Mus musculus
cagctgtaatgaaggaaaatatctg

SEQ ID NO: 228990 - DNA, 25 bp, Mus musculus
cagctgtaatggtgcgtctaatgct

SEQ ID NO: 228991 - DNA, 25 bp, Mus musculus
cagctgtaccagataacatgtttag

SEQ ID NO: 228992 - DNA, 25 bp, Mus musculus
cagctgtaccccgggagggacattg

SEQ ID NO: 228993 - DNA, 25 bp, Mus musculus
cagctgtatccttcaggagcccaag

SEQ ID NO: 228994 - DNA, 25 bp, Mus musculus
cagctgtcaacaaggtctaggaaac

SEQ ID NO: 228995 - DNA, 25 bp, Mus musculus
cagctgtcaaggaactgaatgccag

SEQ ID NO: 228996 - DNA, 25 bp, Mus musculus
cagctgtcaccaacattaccacagc

SEQ ID NO: 228997 - DNA, 25 bp, Mus musculus
cagctgtcaccatcattaccacagc

SEQ ID NO: 228998 - DNA, 25 bp, Mus musculus
cagctgtcagtgcactgatgtctgt

SEQ ID NO: 228999 - DNA, 25 bp, Mus musculus
cagctgtcagttctttgccagaact

SEQ ID NO: 229000 - DNA, 25 bp, Mus musculus
cagctgtccagcaggccacgattgc

SEQ ID NO: 229001 - DNA, 25 bp, Mus musculus
cagctgtcccagatgaacgggcttg

SEQ ID NO: 229002 - DNA, 25 bp, Mus musculus
cagctgtcccaggggtgactttcct

SEQ ID NO: 229003 - DNA, 25 bp, Mus musculus
cagctgtctagctgtttcctcttga

SEQ ID NO: 229004 - DNA, 25 bp, Mus musculus
cagctgtctagtccccatggacacc

SEQ ID NO: 229005 - DNA, 25 bp, Mus musculus
cagctgtcttgcaggtggaatgcca

SEQ ID NO: 229006 - DNA, 25 bp, Mus musculus
cagctgtcttggtcgatgggatgct

SEQ ID NO: 229007 - DNA, 25 bp, Mus musculus
cagctgtcttggtcggaggtggcta

SEQ ID NO: 229008 - DNA, 25 bp, Mus musculus
cagctgtgaaaagccattggcacag

SEQ ID NO: 229009 - DNA, 25 bp, Mus musculus
cagctgtgaaaagggtcaagcagtg

SEQ ID NO: 229010 - DNA, 25 bp, Mus musculus
cagctgtgacaaaggggaggaaatc

SEQ ID NO: 229011 - DNA, 25 bp, Mus musculus
cagctgtgagacagacattgacgag

SEQ ID NO: 229012 - DNA, 25 bp, Mus musculus
cagctgtgagacagactcttcctga

SEQ ID NO: 229013 - DNA, 25 bp, Mus musculus
cagctgtgcagacagcccctgcagg

SEQ ID NO: 229014 - DNA, 25 bp, Mus musculus
cagctgtggggttccacagcactgg

SEQ ID NO: 229015 - DNA, 25 bp, Mus musculus
cagctgtggtagtcaggagttcagg

SEQ ID NO: 229016 - DNA, 25 bp, Mus musculus
cagctgtggtattcaggctgaacaa

SEQ ID NO: 229017 - DNA, 25 bp, Mus musculus
cagctgtgtgatgattgaagattat

SEQ ID NO: 229018 - DNA, 25 bp, Mus musculus
cagctgttatgtcagtatatgactg

SEQ ID NO: 229019 - DNA, 25 bp, Mus musculus
cagctgttctgcccgaggacggtga

SEQ ID NO: 229020 - DNA, 25 bp, Mus musculus
cagctgttcttgcgacatttgtgac

SEQ ID NO: 229021 - DNA, 25 bp, Mus musculus
cagctgttgcagtcttcgcataagg

SEQ ID NO: 229022 - DNA, 25 bp, Mus musculus
cagctgttttaaaaggattgcgggc

SEQ ID NO: 229023 - DNA, 25 bp, Mus musculus
cagctgttttaaagcaaacggtgct

SEQ ID NO: 229024 - DNA, 25 bp, Mus musculus
cagctgtttttgttgtacggacatt

SEQ ID NO: 229025 - DNA, 25 bp, Mus musculus
cagcttaccaaaaggatatccaggt

SEQ ID NO: 229026 - DNA, 25 bp, Mus musculus
cagcttaccaaaaggtacctgtgtg

SEQ ID NO: 229027 - DNA, 25 bp, Mus musculus
cagcttaccattgatcatgctacta

SEQ ID NO: 229028 - DNA, 25 bp, Mus musculus
cagcttacggacatgctcccaaatg

SEQ ID NO: 229029 - DNA, 25 bp, Mus musculus
cagcttagaaggctgtgaatgaagt

SEQ ID NO: 229030 - DNA, 25 bp, Mus musculus
cagcttagatggcaggcatgccccg

SEQ ID NO: 229031 - DNA, 25 bp, Mus musculus
cagcttatcaggtgcccagatagat

SEQ ID NO: 229032 - DNA, 25 bp, Mus musculus
cagcttatcttcctgagatgctgtc

SEQ ID NO: 229033 - DNA, 25 bp, Mus musculus
cagcttatggcagctgctgtgtgga

SEQ ID NO: 229034 - DNA, 25 bp, Mus musculus
cagcttattccagaggcatttggat

SEQ ID NO: 229035 - DNA, 25 bp, Mus musculus
cagcttcaaggtggacagcagcaaa

SEQ ID NO: 229036 - DNA, 25 bp, Mus musculus
cagcttcaccacgaccctggtgaac

SEQ ID NO: 229037 - DNA, 25 bp, Mus musculus
cagcttcacgctgtccctgaagtgt

SEQ ID NO: 229038 - DNA, 25 bp, Mus musculus
cagcttcagagagatggtgtcttgt

SEQ ID NO: 229039 - DNA, 25 bp, Mus musculus
cagcttcagagagctgccaggccgc

SEQ ID NO: 229040 - DNA, 25 bp, Mus musculus
cagcttcagagagtgtttaattcct

SEQ ID NO: 229041 - DNA, 25 bp, Mus musculus
cagcttcagcagcatctacaggggc

SEQ ID NO: 229042 - DNA, 25 bp, Mus musculus
cagcttcagcagctctagccaagag

SEQ ID NO: 229043 - DNA, 25 bp, Mus musculus
cagcttcaggttaggattcccagga

SEQ ID NO: 229044 - DNA, 25 bp, Mus musculus
cagcttcatcaggaatggccttgat

SEQ ID NO: 229045 - DNA, 25 bp, Mus musculus
cagcttcatcaggagcaagagcagc

SEQ ID NO: 229046 - DNA, 25 bp, Mus musculus
cagcttcatgaagaacatatgacat

SEQ ID NO: 229047 - DNA, 25 bp, Mus musculus
cagcttcattgatgaagcccgctcc

SEQ ID NO: 229048 - DNA, 25 bp, Mus musculus
cagcttcattggggttccttggaga

SEQ ID NO: 229049 - DNA, 25 bp, Mus musculus
cagcttcatttcaggctcctgtggc

SEQ ID NO: 229050 - DNA, 25 bp, Mus musculus
cagcttccacagaaactcaagtcaa

SEQ ID NO: 229051 - DNA, 25 bp, Mus musculus
cagcttccacagaccatgccttaag

SEQ ID NO: 229052 - DNA, 25 bp, Mus musculus
cagcttccacaggtttcctttggat

SEQ ID NO: 229053 - DNA, 25 bp, Mus musculus
cagcttccactaaagattcagagtc

SEQ ID NO: 229054 - DNA, 25 bp, Mus musculus
cagcttccagaaccacgtcaacctt

SEQ ID NO: 229055 - DNA, 25 bp, Mus musculus
cagcttccagatacctcagtccatt

SEQ ID NO: 229056 - DNA, 25 bp, Mus musculus
cagcttccagatttgtctcaaagta

SEQ ID NO: 229057 - DNA, 25 bp, Mus musculus
cagcttccagccctacgttcttcca

SEQ ID NO: 229058 - DNA, 25 bp, Mus musculus
cagcttccaggcatgctcagggtat

SEQ ID NO: 229059 - DNA, 25 bp, Mus musculus
cagcttccaggcgtccgcgagttca

SEQ ID NO: 229060 - DNA, 25 bp, Mus musculus
cagcttcccagccggaacccagact

SEQ ID NO: 229061 - DNA, 25 bp, Mus musculus
cagcttcccaggagatgtacgacta

SEQ ID NO: 229062 - DNA, 25 bp, Mus musculus
cagcttcccagggggatatccgcct

SEQ ID NO: 229063 - DNA, 25 bp, Mus musculus
cagcttccctcgcaacctcctgacc

SEQ ID NO: 229064 - DNA, 25 bp, Mus musculus
cagcttccctcgcggggctgcggtc

SEQ ID NO: 229065 - DNA, 25 bp, Mus musculus
cagcttccctgcccgaagggacagt

SEQ ID NO: 229066 - DNA, 25 bp, Mus musculus
cagcttcctgaatgttttggctggt

SEQ ID NO: 229067 - DNA, 25 bp, Mus musculus
cagcttcctgagtggtatccttggc

SEQ ID NO: 229068 - DNA, 25 bp, Mus musculus
cagcttcctgatgaggagtctctgt

SEQ ID NO: 229069 - DNA, 25 bp, Mus musculus
cagcttcctgcttcagtaacttgtg

SEQ ID NO: 229070 - DNA, 25 bp, Mus musculus
cagcttcgagaagtacgatgaagac

SEQ ID NO: 229071 - DNA, 25 bp, Mus musculus
cagcttcggacccacatggtggacc

SEQ ID NO: 229072 - DNA, 25 bp, Mus musculus
cagcttcgggcccagctctccagtc

SEQ ID NO: 229073 - DNA, 25 bp, Mus musculus
cagcttctagagatcatgagggccc

SEQ ID NO: 229074 - DNA, 25 bp, Mus musculus
cagcttctagagcctgtttctctct

SEQ ID NO: 229075 - DNA, 25 bp, Mus musculus
cagcttctcagtgaatttgacaaac

SEQ ID NO: 229076 - DNA, 25 bp, Mus musculus
cagcttctcatgctcatctttcctt

SEQ ID NO: 229077 - DNA, 25 bp, Mus musculus
cagcttctcatgtgcaggctgagcg

SEQ ID NO: 229078 - DNA, 25 bp, Mus musculus
cagcttctcctgggagggtcatcta

SEQ ID NO: 229079 - DNA, 25 bp, Mus musculus
cagcttctcctgggttggattgatc

SEQ ID NO: 229080 - DNA, 25 bp, Mus musculus
cagcttctcctggtggaccacagac

SEQ ID NO: 229081 - DNA, 25 bp, Mus musculus
cagcttctctccttggtcacgcccg

SEQ ID NO: 229082 - DNA, 25 bp, Mus musculus
cagcttctgcaaaagaaatacaaag

SEQ ID NO: 229083 - DNA, 25 bp, Mus musculus
cagcttctgcaaaagagctgcaggg

SEQ ID NO: 229084 - DNA, 25 bp, Mus musculus
cagcttctgggaggttgggaactac

SEQ ID NO: 229085 - DNA, 25 bp, Mus musculus
cagcttctttctttgaaggtgacgg

SEQ ID NO: 229086 - DNA, 25 bp, Mus musculus
cagcttgaaaatgcagaacagcttt

SEQ ID NO: 229087 - DNA, 25 bp, Mus musculus
cagcttgaagaacctaaggcccgtg

SEQ ID NO: 229088 - DNA, 25 bp, Mus musculus
cagcttgaagcatggcaatgaaatc

SEQ ID NO: 229089 - DNA, 25 bp, Mus musculus
cagcttgaagcatggccagaagaca

SEQ ID NO: 229090 - DNA, 25 bp, Mus musculus
cagcttgaaggtactaaagaaatat

SEQ ID NO: 229091 - DNA, 25 bp, Mus musculus
cagcttgagtgcaagaggcaagtgc

SEQ ID NO: 229092 - DNA, 25 bp, Mus musculus
cagcttgagtgcaaggcaccccggc

SEQ ID NO: 229093 - DNA, 25 bp, Mus musculus
cagcttgatgcaaggactcgtgggg

SEQ ID NO: 229094 - DNA, 25 bp, Mus musculus
cagcttgcaaattacaggcctgagc

SEQ ID NO: 229095 - DNA, 25 bp, Mus musculus
cagcttgcaagaagaacatccagag

SEQ ID NO: 229096 - DNA, 25 bp, Mus musculus
cagcttgcaagaaggggaccagctg

SEQ ID NO: 229097 - DNA, 25 bp, Mus musculus
cagcttgccagcgtttttcgttgga

SEQ ID NO: 229098 - DNA, 25 bp, Mus musculus
cagcttgctgccacagctgccacag

SEQ ID NO: 229099 - DNA, 25 bp, Mus musculus
cagcttgcttgaaactttgggaacg

SEQ ID NO: 229100 - DNA, 25 bp, Mus musculus
cagcttgcttggctgaagccaaccc

SEQ ID NO: 229101 - DNA, 25 bp, Mus musculus
cagcttggagccggaagctggactg

SEQ ID NO: 229102 - DNA, 25 bp, Mus musculus
cagcttggaggcgaatgaagtgtat

SEQ ID NO: 229103 - DNA, 25 bp, Mus musculus
cagcttggatcacacagtgagaccc

SEQ ID NO: 229104 - DNA, 25 bp, Mus musculus
cagcttggatggagaggttggtaca

SEQ ID NO: 229105 - DNA, 25 bp, Mus musculus
cagcttggatggagcgtcagtgagt

SEQ ID NO: 229106 - DNA, 25 bp, Mus musculus
cagcttggcagaacacatgtcggag

SEQ ID NO: 229107 - DNA, 25 bp, Mus musculus
cagcttgggagccagccccagcagt

SEQ ID NO: 229108 - DNA, 25 bp, Mus musculus
cagcttggggaatctggagcaattc

SEQ ID NO: 229109 - DNA, 25 bp, Mus musculus
cagcttggggaatcttgctctttga

SEQ ID NO: 229110 - DNA, 25 bp, Mus musculus
cagcttgtacaagcttcaaaaccgc

SEQ ID NO: 229111 - DNA, 25 bp, Mus musculus
cagcttgtacaagtctgcagatggc

SEQ ID NO: 229112 - DNA, 25 bp, Mus musculus
cagcttgtagatgtggaatggacag

SEQ ID NO: 229113 - DNA, 25 bp, Mus musculus
cagcttgtagatgtggatgaaaaga

SEQ ID NO: 229114 - DNA, 25 bp, Mus musculus
cagcttgtctggaacctctcaggag

SEQ ID NO: 229115 - DNA, 25 bp, Mus musculus
cagcttgtgaggttcttgtttcctg

SEQ ID NO: 229116 - DNA, 25 bp, Mus musculus
cagcttgtgcggctagaagaggaac

SEQ ID NO: 229117 - DNA, 25 bp, Mus musculus
cagcttgtgcgtgatattgtggtcc

SEQ ID NO: 229118 - DNA, 25 bp, Mus musculus
cagcttgtgtctgaaggtgcttcct

SEQ ID NO: 229119 - DNA, 25 bp, Mus musculus
cagctttacgatcatcactccgttc

SEQ ID NO: 229120 - DNA, 25 bp, Mus musculus
cagctttacgatcatcttgactgct

SEQ ID NO: 229121 - DNA, 25 bp, Mus musculus
cagctttacttttggtatatcatgt

SEQ ID NO: 229122 - DNA, 25 bp, Mus musculus
cagctttagaaggcatggatgatac

SEQ ID NO: 229123 - DNA, 25 bp, Mus musculus
cagctttagtcctcaaaggccagtt

SEQ ID NO: 229124 - DNA, 25 bp, Mus musculus
cagctttagtgataggctctctcct

SEQ ID NO: 229125 - DNA, 25 bp, Mus musculus
cagctttagtgatagggttcactgt

SEQ ID NO: 229126 - DNA, 25 bp, Mus musculus
cagctttatacagaaagatgttgga

SEQ ID NO: 229127 - DNA, 25 bp, Mus musculus
cagctttatcaggtccacagagttg

SEQ ID NO: 229128 - DNA, 25 bp, Mus musculus
cagctttatgtcagtcagccccagc

SEQ ID NO: 229129 - DNA, 25 bp, Mus musculus
cagctttccagaattcctcagagag

SEQ ID NO: 229130 - DNA, 25 bp, Mus musculus
cagctttccagacttacaacagctg

SEQ ID NO: 229131 - DNA, 25 bp, Mus musculus
cagctttcgacccgaggactatctc

SEQ ID NO: 229132 - DNA, 25 bp, Mus musculus
cagctttcgacccggattctcaaaa

SEQ ID NO: 229133 - DNA, 25 bp, Mus musculus
cagctttctcccaggtgctcaccat

SEQ ID NO: 229134 - DNA, 25 bp, Mus musculus
cagctttgaacgctgtgtgagaatt

SEQ ID NO: 229135 - DNA, 25 bp, Mus musculus
cagctttgagatggctatgaacggc

SEQ ID NO: 229136 - DNA, 25 bp, Mus musculus
cagctttgaggaagattgcaagccc

SEQ ID NO: 229137 - DNA, 25 bp, Mus musculus
cagctttgaggaagcgagtctccag

SEQ ID NO: 229138 - DNA, 25 bp, Mus musculus
cagctttgcagcatgctcacgcaca

SEQ ID NO: 229139 - DNA, 25 bp, Mus musculus
cagctttgctcagtatgggtgagag

SEQ ID NO: 229140 - DNA, 25 bp, Mus musculus
cagctttgctcttggcactaaacaa

SEQ ID NO: 229141 - DNA, 25 bp, Mus musculus
cagctttgctcttggggagatgcga

SEQ ID NO: 229142 - DNA, 25 bp, Mus musculus
cagctttggggggctggctgtgggc

SEQ ID NO: 229143 - DNA, 25 bp, Mus musculus
cagctttggggtggtaatactggag

SEQ ID NO: 229144 - DNA, 25 bp, Mus musculus
cagctttgggtctcggcaaccaaac

SEQ ID NO: 229145 - DNA, 25 bp, Mus musculus
cagctttgtcaagggatacctcctt

SEQ ID NO: 229146 - DNA, 25 bp, Mus musculus
cagctttgttgagaaggagcgccag

SEQ ID NO: 229147 - DNA, 25 bp, Mus musculus
cagctttgtttctcccaggactcat

SEQ ID NO: 229148 - DNA, 25 bp, Mus musculus
cagcttttaattcagttgaaaaggg

SEQ ID NO: 229149 - DNA, 25 bp, Mus musculus
cagcttttactcggaccaacatatg

SEQ ID NO: 229150 - DNA, 25 bp, Mus musculus
cagcttttatcaaaggtgtgccatt

SEQ ID NO: 229151 - DNA, 25 bp, Mus musculus
cagcttttatcccagaaatgtgaat

SEQ ID NO: 229152 - DNA, 25 bp, Mus musculus
cagcttttatcccaggtgtgccatt

SEQ ID NO: 229153 - DNA, 25 bp, Mus musculus
cagcttttctaaggcatcaatactt

SEQ ID NO: 229154 - DNA, 25 bp, Mus musculus
cagcttttgcagatgaatatgaagg

SEQ ID NO: 229155 - DNA, 25 bp, Mus musculus
cagcttttgcagggggcaccctccc

SEQ ID NO: 229156 - DNA, 25 bp, Mus musculus
cagcttttgcagtggacatcccaga

SEQ ID NO: 229157 - DNA, 25 bp, Mus musculus
cagctttttaacaaggtgaactgaa

SEQ ID NO: 229158 - DNA, 25 bp, Mus musculus
cagctttttgctgccccttaccggg

SEQ ID NO: 229159 - DNA, 25 bp, Mus musculus
cagcttttttacaggagaaaccctg

SEQ ID NO: 229160 - DNA, 25 bp, Mus musculus
caggaaaaagtcaagccgagatgac

SEQ ID NO: 229161 - DNA, 25 bp, Mus musculus
caggaaaaagtcaaggaactcaaca

SEQ ID NO: 229162 - DNA, 25 bp, Mus musculus
caggaaaacaaattagtgacagatc

SEQ ID NO: 229163 - DNA, 25 bp, Mus musculus
caggaaaacaggtttcaagtgcccc

SEQ ID NO: 229164 - DNA, 25 bp, Mus musculus
caggaaaacattgctgatagcccaa

SEQ ID NO: 229165 - DNA, 25 bp, Mus musculus
caggaaaaccaggttgctggtgacc

SEQ ID NO: 229166 - DNA, 25 bp, Mus musculus
caggaaaagaaggtgggcgactgct

SEQ ID NO: 229167 - DNA, 25 bp, Mus musculus
caggaaaagaagttctgggagtcag

SEQ ID NO: 229168 - DNA, 25 bp, Mus musculus
caggaaaagaggaccccaggacttc

SEQ ID NO: 229169 - DNA, 25 bp, Mus musculus
caggaaaagaggagtgggagctcaa

SEQ ID NO: 229170 - DNA, 25 bp, Mus musculus
caggaaaataagcaaaaattcccag

SEQ ID NO: 229171 - DNA, 25 bp, Mus musculus
caggaaaataaggtgttttcacgtc

SEQ ID NO: 229172 - DNA, 25 bp, Mus musculus
caggaaaataagttctgaaaatcaa

SEQ ID NO: 229173 - DNA, 25 bp, Mus musculus
caggaaaatatgggctggcgctgca

SEQ ID NO: 229174 - DNA, 25 bp, Mus musculus
caggaaaatcagtgtctttacatcc

SEQ ID NO: 229175 - DNA, 25 bp, Mus musculus
caggaaaatgggaagacagatgtct

SEQ ID NO: 229176 - DNA, 25 bp, Mus musculus
caggaaaattggaacaatccacttt

SEQ ID NO: 229177 - DNA, 25 bp, Mus musculus
caggaaacaaaccagactgacctcg

SEQ ID NO: 229178 - DNA, 25 bp, Mus musculus
caggaaacaaaccagatcccccacc

SEQ ID NO: 229179 - DNA, 25 bp, Mus musculus
caggaaacaacagatcccccacctg

SEQ ID NO: 229180 - DNA, 25 bp, Mus musculus
caggaaacaagaacgtatctcctcg

SEQ ID NO: 229181 - DNA, 25 bp, Mus musculus
caggaaacaagattatccagctgat

SEQ ID NO: 229182 - DNA, 25 bp, Mus musculus
caggaaacagaaagctggtccaaag

SEQ ID NO: 229183 - DNA, 25 bp, Mus musculus
caggaaacagcagattcctcagaca

SEQ ID NO: 229184 - DNA, 25 bp, Mus musculus
caggaaacagcagggaaggatctgt

SEQ ID NO: 229185 - DNA, 25 bp, Mus musculus
caggaaacaggaaggagtcttcacc

SEQ ID NO: 229186 - DNA, 25 bp, Mus musculus
caggaaacaggagcagcgttgcccc

SEQ ID NO: 229187 - DNA, 25 bp, Mus musculus
caggaaacagttacctgcagaatgt

SEQ ID NO: 229188 - DNA, 25 bp, Mus musculus
caggaaacatggaaataagcagcaa

SEQ ID NO: 229189 - DNA, 25 bp, Mus musculus
caggaaaccaggaatgacacgggat

SEQ ID NO: 229190 - DNA, 25 bp, Mus musculus
caggaaactggagtgtgggttcgca

SEQ ID NO: 229191 - DNA, 25 bp, Mus musculus
caggaaactggccaggtgctctcct

SEQ ID NO: 229192 - DNA, 25 bp, Mus musculus
caggaaactggttggctgggaagac

SEQ ID NO: 229193 - DNA, 25 bp, Mus musculus
caggaaacttcaggacccctgtgca

SEQ ID NO: 229194 - DNA, 25 bp, Mus musculus
caggaaagaacaagagacatgtttg

SEQ ID NO: 229195 - DNA, 25 bp, Mus musculus
caggaaagaagaagacctgtctgaa

SEQ ID NO: 229196 - DNA, 25 bp, Mus musculus
caggaaagaaggtggtggaagatac

SEQ ID NO: 229197 - DNA, 25 bp, Mus musculus
caggaaagagacatggcaagtgtcc

SEQ ID NO: 229198 - DNA, 25 bp, Mus musculus
caggaaagaggtgcccactcatgat

SEQ ID NO: 229199 - DNA, 25 bp, Mus musculus
caggaaagcagaaaaccgtcaagga

SEQ ID NO: 229200 - DNA, 25 bp, Mus musculus
caggaaagcgaggatgagaagcagc

SEQ ID NO: 229201 - DNA, 25 bp, Mus musculus
caggaaagctttcatagtgcctgca

SEQ ID NO: 229202 - DNA, 25 bp, Mus musculus
caggaaaggccgttttggactacat

SEQ ID NO: 229203 - DNA, 25 bp, Mus musculus
caggaaagttcaaatagcccgtccc

SEQ ID NO: 229204 - DNA, 25 bp, Mus musculus
caggaaagttccaggggaacatagc

SEQ ID NO: 229205 - DNA, 25 bp, Mus musculus
caggaaagttctcaatctcacaggc

SEQ ID NO: 229206 - DNA, 25 bp, Mus musculus
caggaaatacatcctgtctgtgctt

SEQ ID NO: 229207 - DNA, 25 bp, Mus musculus
caggaaatacatgctgtctgtgctt

SEQ ID NO: 229208 - DNA, 25 bp, Mus musculus
caggaaatgaccgaggtgaaggcag

SEQ ID NO: 229209 - DNA, 25 bp, Mus musculus
caggaaatgagtccacagatgattt

SEQ ID NO: 229210 - DNA, 25 bp, Mus musculus
caggaaatgcaggttttccttactg

SEQ ID NO: 229211 - DNA, 25 bp, Mus musculus
caggaaatgtttattggaaaaggaa

SEQ ID NO: 229212 - DNA, 25 bp, Mus musculus
caggaaatgtttgcatctggccatc

SEQ ID NO: 229213 - DNA, 25 bp, Mus musculus
caggaaatgtttgtgacccccctcc

SEQ ID NO: 229214 - DNA, 25 bp, Mus musculus
caggaaattcagcctcaagtacctg

SEQ ID NO: 229215 - DNA, 25 bp, Mus musculus
caggaaattcaggcgatgctgggcc

SEQ ID NO: 229216 - DNA, 25 bp, Mus musculus
caggaaattgtgaaggccctgtctc

SEQ ID NO: 229217 - DNA, 25 bp, Mus musculus
caggaaattgtgaaggtttgtctgg

SEQ ID NO: 229218 - DNA, 25 bp, Mus musculus
caggaacaaacattcaggccaaaca

SEQ ID NO: 229219 - DNA, 25 bp, Mus musculus
caggaacaaatggggagaaactcct

SEQ ID NO: 229220 - DNA, 25 bp, Mus musculus
caggaacaagatcctgcacagggac

SEQ ID NO: 229221 - DNA, 25 bp, Mus musculus
caggaacaaggtgtggccaaacgta

SEQ ID NO: 229222 - DNA, 25 bp, Mus musculus
caggaacacaaaggtaagaaagcac

SEQ ID NO: 229223 - DNA, 25 bp, Mus musculus
caggaacacacagtggggaggggag

SEQ ID NO: 229224 - DNA, 25 bp, Mus musculus
caggaacacctgctgacctctgtgt

SEQ ID NO: 229225 - DNA, 25 bp, Mus musculus
caggaacacctttatctgaattatg

SEQ ID NO: 229226 - DNA, 25 bp, Mus musculus
caggaacacgggggcttcttcacat

SEQ ID NO: 229227 - DNA, 25 bp, Mus musculus
caggaacagcgctcatccactgcaa

SEQ ID NO: 229228 - DNA, 25 bp, Mus musculus
caggaacagcggaaaatacagaagt

SEQ ID NO: 229229 - DNA, 25 bp, Mus musculus
caggaacatcgtgactttatatgga

SEQ ID NO: 229230 - DNA, 25 bp, Mus musculus
caggaacattttccctcctgtcctt

SEQ ID NO: 229231 - DNA, 25 bp, Mus musculus
caggaaccaagaatgcttttgggtc

SEQ ID NO: 229232 - DNA, 25 bp, Mus musculus
caggaaccaatgagacaccatgatt

SEQ ID NO: 229233 - DNA, 25 bp, Mus musculus
caggaaccaatggagccattccgta

SEQ ID NO: 229234 - DNA, 25 bp, Mus musculus
caggaaccagctgatggccaggagg

SEQ ID NO: 229235 - DNA, 25 bp, Mus musculus
caggaaccaggttggtctggggtgg

SEQ ID NO: 229236 - DNA, 25 bp, Mus musculus
caggaaccagtaattccacgatggc

SEQ ID NO: 229237 - DNA, 25 bp, Mus musculus
caggaaccagttggaaggacctggc

SEQ ID NO: 229238 - DNA, 25 bp, Mus musculus
caggaaccatatcctaggcaatgca

SEQ ID NO: 229239 - DNA, 25 bp, Mus musculus
caggaaccatatgactgcttacggg

SEQ ID NO: 229240 - DNA, 25 bp, Mus musculus
caggaaccatattctgttttatttt

SEQ ID NO: 229241 - DNA, 25 bp, Mus musculus
caggaacccaagaatttattgccaa

SEQ ID NO: 229242 - DNA, 25 bp, Mus musculus
caggaaccgcaggctgttgccgcac

SEQ ID NO: 229243 - DNA, 25 bp, Mus musculus
caggaaccgccaaagccgagggttg

SEQ ID NO: 229244 - DNA, 25 bp, Mus musculus
caggaaccgccaaaggctttctcct

SEQ ID NO: 229245 - DNA, 25 bp, Mus musculus
caggaaccgcgtctcttgcaaaacc

SEQ ID NO: 229246 - DNA, 25 bp, Mus musculus
caggaacctggttggcaaagtgatc

SEQ ID NO: 229247 - DNA, 25 bp, Mus musculus
caggaacgaccgtgctatgtttcag

SEQ ID NO: 229248 - DNA, 25 bp, Mus musculus
caggaacggagggcatggctgccag

SEQ ID NO: 229249 - DNA, 25 bp, Mus musculus
caggaacggagttatggcattcctt

SEQ ID NO: 229250 - DNA, 25 bp, Mus musculus
caggaactaaatcttccatccgaga

SEQ ID NO: 229251 - DNA, 25 bp, Mus musculus
caggaactacgagcgcgaggtagat

SEQ ID NO: 229252 - DNA, 25 bp, Mus musculus
caggaactcaaggaatgactattcc

SEQ ID NO: 229253 - DNA, 25 bp, Mus musculus
caggaactcaagggagctaagaaga

SEQ ID NO: 229254 - DNA, 25 bp, Mus musculus
caggaactcaagttgaccgccttgc

SEQ ID NO: 229255 - DNA, 25 bp, Mus musculus
caggaactcaggtggccactctagc

SEQ ID NO: 229256 - DNA, 25 bp, Mus musculus
caggaactcgaggctcctggaggaa

SEQ ID NO: 229257 - DNA, 25 bp, Mus musculus
caggaactctgcgggaccttctgtc

SEQ ID NO: 229258 - DNA, 25 bp, Mus musculus
caggaactgaggctccggagggtgt

SEQ ID NO: 229259 - DNA, 25 bp, Mus musculus
caggaactggcggtcttctgttccc

SEQ ID NO: 229260 - DNA, 25 bp, Mus musculus
caggaactgtgtggacgaccccccg

SEQ ID NO: 229261 - DNA, 25 bp, Mus musculus
caggaacttaaaaaggtgattgaag

SEQ ID NO: 229262 - DNA, 25 bp, Mus musculus
caggaacttaaaaaggtgtcctcag

SEQ ID NO: 229263 - DNA, 25 bp, Mus musculus
caggaacttcagtttgaaaatgaaa

SEQ ID NO: 229264 - DNA, 25 bp, Mus musculus
caggaacttttcagctgccaaaagc

SEQ ID NO: 229265 - DNA, 25 bp, Mus musculus
caggaacttttcagttggcaggcag

SEQ ID NO: 229266 - DNA, 25 bp, Mus musculus
caggaacttttttgtaagaagacaa

SEQ ID NO: 229267 - DNA, 25 bp, Mus musculus
caggaagaaaggaaaatcagaggct

SEQ ID NO: 229268 - DNA, 25 bp, Mus musculus
caggaagaaaggtcaggatcgcagc

SEQ ID NO: 229269 - DNA, 25 bp, Mus musculus
caggaagaacgcggagggagctatg

SEQ ID NO: 229270 - DNA, 25 bp, Mus musculus
caggaagactggtgggaacacaggc

SEQ ID NO: 229271 - DNA, 25 bp, Mus musculus
caggaagagaaggcttcagatgcta

SEQ ID NO: 229272 - DNA, 25 bp, Mus musculus
caggaagagacttcacagctcaggc

SEQ ID NO: 229273 - DNA, 25 bp, Mus musculus
caggaagagcaacatgaccatgtgg

SEQ ID NO: 229274 - DNA, 25 bp, Mus musculus
caggaagagctggattttgccatgc

SEQ ID NO: 229275 - DNA, 25 bp, Mus musculus
caggaagagctgggctctcccgcaa

SEQ ID NO: 229276 - DNA, 25 bp, Mus musculus
caggaagaggaaagagatgagccgc

SEQ ID NO: 229277 - DNA, 25 bp, Mus musculus
caggaagaggcggtgacagaggcct

SEQ ID NO: 229278 - DNA, 25 bp, Mus musculus
caggaagatccactcctatgtgttc

SEQ ID NO: 229279 - DNA, 25 bp, Mus musculus
caggaagatgcccaggaaatagcag

SEQ ID NO: 229280 - DNA, 25 bp, Mus musculus
caggaagatgcccaggtggctgctg

SEQ ID NO: 229281 - DNA, 25 bp, Mus musculus
caggaagatttccgaactgaaagac

SEQ ID NO: 229282 - DNA, 25 bp, Mus musculus
caggaagcacctgccattgtggctg

SEQ ID NO: 229283 - DNA, 25 bp, Mus musculus
caggaagcacgggggtaccattccc

SEQ ID NO: 229284 - DNA, 25 bp, Mus musculus
caggaagcacgggtggctgcaagaa

SEQ ID NO: 229285 - DNA, 25 bp, Mus musculus
caggaagcagagaggagaaaaggag

SEQ ID NO: 229286 - DNA, 25 bp, Mus musculus
caggaagcaggtgtctagtcacatt

SEQ ID NO: 229287 - DNA, 25 bp, Mus musculus
caggaagcaggtgtctagtcatata

SEQ ID NO: 229288 - DNA, 25 bp, Mus musculus
caggaagccagatatctcacagaca

SEQ ID NO: 229289 - DNA, 25 bp, Mus musculus
caggaagccagcgagtcatcctcca

SEQ ID NO: 229290 - DNA, 25 bp, Mus musculus
caggaagccaggtctttggccagta

SEQ ID NO: 229291 - DNA, 25 bp, Mus musculus
caggaagcccagcaggaggagactg

SEQ ID NO: 229292 - DNA, 25 bp, Mus musculus
caggaagcccagcagggcagccaat

SEQ ID NO: 229293 - DNA, 25 bp, Mus musculus
caggaagccctgaggtcacttggtc

SEQ ID NO: 229294 - DNA, 25 bp, Mus musculus
caggaagccctgaggtgtggttccc

SEQ ID NO: 229295 - DNA, 25 bp, Mus musculus
caggaagcctgtgcccagtatagtg

SEQ ID NO: 229296 - DNA, 25 bp, Mus musculus
caggaagcgagaagagaaaaggaac

SEQ ID NO: 229297 - DNA, 25 bp, Mus musculus
caggaagcgccacacccccagagga

SEQ ID NO: 229298 - DNA, 25 bp, Mus musculus
caggaagcgtggaggatgagcatgc

SEQ ID NO: 229299 - DNA, 25 bp, Mus musculus
caggaagctaagctgtggtcctcta

SEQ ID NO: 229300 - DNA, 25 bp, Mus musculus
caggaagctactgggccgcgttggc

SEQ ID NO: 229301 - DNA, 25 bp, Mus musculus
caggaagctcagatgctgcagttcg

SEQ ID NO: 229302 - DNA, 25 bp, Mus musculus
caggaagctggagaaggggtggaag

SEQ ID NO: 229303 - DNA, 25 bp, Mus musculus
caggaagctgggccggcacatgggt

SEQ ID NO: 229304 - DNA, 25 bp, Mus musculus
caggaagctggtccagctcagcttg

SEQ ID NO: 229305 - DNA, 25 bp, Mus musculus
caggaagcttcagattataccgaaa

SEQ ID NO: 229306 - DNA, 25 bp, Mus musculus
caggaagcttcaggctatgtctttc

SEQ ID NO: 229307 - DNA, 25 bp, Mus musculus
caggaagctttgcagatctgaacga

SEQ ID NO: 229308 - DNA, 25 bp, Mus musculus
caggaaggaaaagaggccttggaag

SEQ ID NO: 229309 - DNA, 25 bp, Mus musculus
caggaaggaggatgctgtccttact

SEQ ID NO: 229310 - DNA, 25 bp, Mus musculus
caggaaggcaaattcgtgattactg

SEQ ID NO: 229311 - DNA, 25 bp, Mus musculus
caggaagggactatattgatcagtg

SEQ ID NO: 229312 - DNA, 25 bp, Mus musculus
caggaaggggaaggtgatctgagca

SEQ ID NO: 229313 - DNA, 25 bp, Mus musculus
caggaagtaacagacctgaccaaag

SEQ ID NO: 229314 - DNA, 25 bp, Mus musculus
caggaagtcagctagcagccacata

SEQ ID NO: 229315 - DNA, 25 bp, Mus musculus
caggaagtgaagggggaggtgacca

SEQ ID NO: 229316 - DNA, 25 bp, Mus musculus
caggaagtgaagtgttgaagaaagt

SEQ ID NO: 229317 - DNA, 25 bp, Mus musculus
caggaagtgaggtggaagaaaagtg

SEQ ID NO: 229318 - DNA, 25 bp, Mus musculus
caggaagtgcataggaggagcttcc

SEQ ID NO: 229319 - DNA, 25 bp, Mus musculus
caggaagtgcataggagtggctgct

SEQ ID NO: 229320 - DNA, 25 bp, Mus musculus
caggaagtgcttctgtttcctgcca

SEQ ID NO: 229321 - DNA, 25 bp, Mus musculus
caggaagtgtactggataagaacaa

SEQ ID NO: 229322 - DNA, 25 bp, Mus musculus
caggaagttacaatccaagtaaacg

SEQ ID NO: 229323 - DNA, 25 bp, Mus musculus
caggaagttcacaagataaccaaca

SEQ ID NO: 229324 - DNA, 25 bp, Mus musculus
caggaagttcacaaggaatgtatca

SEQ ID NO: 229325 - DNA, 25 bp, Mus musculus
caggaatacagagaccgtctcgaca

SEQ ID NO: 229326 - DNA, 25 bp, Mus musculus
caggaatacaggattttggttccag

SEQ ID NO: 229327 - DNA, 25 bp, Mus musculus
caggaatacgagaaagccctgcagg

SEQ ID NO: 229328 - DNA, 25 bp, Mus musculus
caggaatactgtttggcatggctgc

SEQ ID NO: 229329 - DNA, 25 bp, Mus musculus
caggaatatgtagatttgggtatcc

SEQ ID NO: 229330 - DNA, 25 bp, Mus musculus
caggaatcagccatgcatcatcaag

SEQ ID NO: 229331 - DNA, 25 bp, Mus musculus
caggaatccccatgatgaatcagca

SEQ ID NO: 229332 - DNA, 25 bp, Mus musculus
caggaatcctttttgtgttcttggg

SEQ ID NO: 229333 - DNA, 25 bp, Mus musculus
caggaatgaaagatttatgataaat

SEQ ID NO: 229334 - DNA, 25 bp, Mus musculus
caggaatgaaaggtttcaacagctc

SEQ ID NO: 229335 - DNA, 25 bp, Mus musculus
caggaatgaggctgctgcagagcct

SEQ ID NO: 229336 - DNA, 25 bp, Mus musculus
caggaatgcttgggaattgaatcca

SEQ ID NO: 229337 - DNA, 25 bp, Mus musculus
caggaatgcttgggagagttaacct

SEQ ID NO: 229338 - DNA, 25 bp, Mus musculus
caggaatggagactttggagactat

SEQ ID NO: 229339 - DNA, 25 bp, Mus musculus
caggaatgggagctgatgttcaggt

SEQ ID NO: 229340 - DNA, 25 bp, Mus musculus
caggaatgggagctggtaaatgatg

SEQ ID NO: 229341 - DNA, 25 bp, Mus musculus
caggaatgtctcctgaacttcgagg

SEQ ID NO: 229342 - DNA, 25 bp, Mus musculus
caggaatgtctcctgtctgtggtgc

SEQ ID NO: 229343 - DNA, 25 bp, Mus musculus
caggaattagtgtcggagctccaac

SEQ ID NO: 229344 - DNA, 25 bp, Mus musculus
caggaattcagcaccccatgaacaa

SEQ ID NO: 229345 - DNA, 25 bp, Mus musculus
caggaattcaggaaatattttcaag

SEQ ID NO: 229346 - DNA, 25 bp, Mus musculus
caggaattccgggtcagctgctaca

SEQ ID NO: 229347 - DNA, 25 bp, Mus musculus
caggacaaaaacagtacaacgtaga

SEQ ID NO: 229348 - DNA, 25 bp, Mus musculus
caggacaaagaccaaggattactgc

SEQ ID NO: 229349 - DNA, 25 bp, Mus musculus
caggacaaagagaaagccagtgaga

SEQ ID NO: 229350 - DNA, 25 bp, Mus musculus
caggacaaagagactgcatcgacgt

SEQ ID NO: 229351 - DNA, 25 bp, Mus musculus
caggacaaagcatgtggggcagtgg

SEQ ID NO: 229352 - DNA, 25 bp, Mus musculus
caggacaaaggagtctcacctgaac

SEQ ID NO: 229353 - DNA, 25 bp, Mus musculus
caggacaagcaggtcccatgcatca

SEQ ID NO: 229354 - DNA, 25 bp, Mus musculus
caggacaatgcagcttcacttggtt

SEQ ID NO: 229355 - DNA, 25 bp, Mus musculus
caggacaatgcagtgctgaaaggag

SEQ ID NO: 229356 - DNA, 25 bp, Mus musculus
caggacacaagaaaagtcaggccct

SEQ ID NO: 229357 - DNA, 25 bp, Mus musculus
caggacacacaattgggccggcggc

SEQ ID NO: 229358 - DNA, 25 bp, Mus musculus
caggacacacaattggtggacgcag

SEQ ID NO: 229359 - DNA, 25 bp, Mus musculus
caggacacacagacactgtcctgtt

SEQ ID NO: 229360 - DNA, 25 bp, Mus musculus
caggacacactccacgcagtatgag

SEQ ID NO: 229361 - DNA, 25 bp, Mus musculus
caggacacagaccgtgctggaatct

SEQ ID NO: 229362 - DNA, 25 bp, Mus musculus
caggacacagagatgactcgttggc

SEQ ID NO: 229363 - DNA, 25 bp, Mus musculus
caggacaccaagagggaagctgctc

SEQ ID NO: 229364 - DNA, 25 bp, Mus musculus
caggacaccagctgaggagggcagg

SEQ ID NO: 229365 - DNA, 25 bp, Mus musculus
caggacacccctcatgtttctgcag

SEQ ID NO: 229366 - DNA, 25 bp, Mus musculus
caggacactgccactgcacagcctg

SEQ ID NO: 229367 - DNA, 25 bp, Mus musculus
caggacactgcgtgggcccagtggg

SEQ ID NO: 229368 - DNA, 25 bp, Mus musculus
caggacactggagatgatccttaca

SEQ ID NO: 229369 - DNA, 25 bp, Mus musculus
caggacactgtatcggttccatgta

SEQ ID NO: 229370 - DNA, 25 bp, Mus musculus
caggacagagagattgtgacacggg

SEQ ID NO: 229371 - DNA, 25 bp, Mus musculus
caggacagaggattccctgtctcct

SEQ ID NO: 229372 - DNA, 25 bp, Mus musculus
caggacagaggcttccccacctccc

SEQ ID NO: 229373 - DNA, 25 bp, Mus musculus
caggacagagggactgctgcagagc

SEQ ID NO: 229374 - DNA, 25 bp, Mus musculus
caggacagagttcctgtagttgctg

SEQ ID NO: 229375 - DNA, 25 bp, Mus musculus
caggacagcaaggccctcctttttc

SEQ ID NO: 229376 - DNA, 25 bp, Mus musculus
caggacagcagggtgtgcaggggcc

SEQ ID NO: 229377 - DNA, 25 bp, Mus musculus
caggacagccagggtctctggaact

SEQ ID NO: 229378 - DNA, 25 bp, Mus musculus
caggacagccagggtgagtccagtg

SEQ ID NO: 229379 - DNA, 25 bp, Mus musculus
caggacagctgtggagctggcctga

SEQ ID NO: 229380 - DNA, 25 bp, Mus musculus
caggacaggaagaggacgccctacc

SEQ ID NO: 229381 - DNA, 25 bp, Mus musculus
caggacaggaaggtacttctccata

SEQ ID NO: 229382 - DNA, 25 bp, Mus musculus
caggacaggccattggtggctatgg

SEQ ID NO: 229383 - DNA, 25 bp, Mus musculus
caggacagggaggtactgatactaa

SEQ ID NO: 229384 - DNA, 25 bp, Mus musculus
caggacagggaggttccagaatacc

SEQ ID NO: 229385 - DNA, 25 bp, Mus musculus
caggacagtcatggtggaccagcac

SEQ ID NO: 229386 - DNA, 25 bp, Mus musculus
caggacagtgacagcatcacggctg

SEQ ID NO: 229387 - DNA, 25 bp, Mus musculus
caggacatagaaattgcttttctag

SEQ ID NO: 229388 - DNA, 25 bp, Mus musculus
caggacatagagaccatagaatcca

SEQ ID NO: 229389 - DNA, 25 bp, Mus musculus
caggacataggttgaatgctatgtt

SEQ ID NO: 229390 - DNA, 25 bp, Mus musculus
caggacatcaggctctgtgtgagtg

SEQ ID NO: 229391 - DNA, 25 bp, Mus musculus
caggacatcccagacaattttggaa

SEQ ID NO: 229392 - DNA, 25 bp, Mus musculus
caggacatcccagcaaagaaacgat

SEQ ID NO: 229393 - DNA, 25 bp, Mus musculus
caggacatctgcaggatctgccact

SEQ ID NO: 229394 - DNA, 25 bp, Mus musculus
caggacatgaaacagtacctttgac

SEQ ID NO: 229395 - DNA, 25 bp, Mus musculus
caggacatgaagctacagtcgttgt

SEQ ID NO: 229396 - DNA, 25 bp, Mus musculus
caggacatgagctactatagaaaac

SEQ ID NO: 229397 - DNA, 25 bp, Mus musculus
caggacatgatagacggcttgaagc

SEQ ID NO: 229398 - DNA, 25 bp, Mus musculus
caggaccaaaggagccaaaccagca

SEQ ID NO: 229399 - DNA, 25 bp, Mus musculus
caggaccaaagggaccactttccac

SEQ ID NO: 229400 - DNA, 25 bp, Mus musculus
caggaccaagcccttcccctgggga

SEQ ID NO: 229401 - DNA, 25 bp, Mus musculus
caggaccaagctggcaagcgcgccc

SEQ ID NO: 229402 - DNA, 25 bp, Mus musculus
caggaccaaggatcagacaagggtg

SEQ ID NO: 229403 - DNA, 25 bp, Mus musculus
caggaccacagaactacagctgaat

SEQ ID NO: 229404 - DNA, 25 bp, Mus musculus
caggaccacagttatatatcttcag

SEQ ID NO: 229405 - DNA, 25 bp, Mus musculus
caggaccaccaagacatccaggagc

SEQ ID NO: 229406 - DNA, 25 bp, Mus musculus
caggaccaccaagactcacacccta

SEQ ID NO: 229407 - DNA, 25 bp, Mus musculus
caggaccacgatgtccctggtagat

SEQ ID NO: 229408 - DNA, 25 bp, Mus musculus
caggaccactgctctgctgcctgca

SEQ ID NO: 229409 - DNA, 25 bp, Mus musculus
caggaccactggttctacgggtgcc

SEQ ID NO: 229410 - DNA, 25 bp, Mus musculus
caggaccagagggtcctcctggtga

SEQ ID NO: 229411 - DNA, 25 bp, Mus musculus
caggaccaggcaggagtacctggag

SEQ ID NO: 229412 - DNA, 25 bp, Mus musculus
caggaccaggcagtacacctatggc

SEQ ID NO: 229413 - DNA, 25 bp, Mus musculus
caggaccaggcggttgtggatctcc

SEQ ID NO: 229414 - DNA, 25 bp, Mus musculus
caggaccatgcgcaatcaggattca

SEQ ID NO: 229415 - DNA, 25 bp, Mus musculus
caggaccatgcgcctgcggagttct

SEQ ID NO: 229416 - DNA, 25 bp, Mus musculus
caggaccatgctccccacccccgat

SEQ ID NO: 229417 - DNA, 25 bp, Mus musculus
caggaccattaaagtgtggagcacg

SEQ ID NO: 229418 - DNA, 25 bp, Mus musculus
caggacccaagtacattcacctgca

SEQ ID NO: 229419 - DNA, 25 bp, Mus musculus
caggacccacagggccctgtgtgct

SEQ ID NO: 229420 - DNA, 25 bp, Mus musculus
caggacccagaaagcatctgcatct

SEQ ID NO: 229421 - DNA, 25 bp, Mus musculus
caggacccagagcaagtccacatgc

SEQ ID NO: 229422 - DNA, 25 bp, Mus musculus
caggacccagtggaacaattggatt

SEQ ID NO: 229423 - DNA, 25 bp, Mus musculus
caggaccccaaggtcatgatgctag

SEQ ID NO: 229424 - DNA, 25 bp, Mus musculus
caggaccccacctggattccgagct

SEQ ID NO: 229425 - DNA, 25 bp, Mus musculus
caggaccccagctctgtcagcatcc

SEQ ID NO: 229426 - DNA, 25 bp, Mus musculus
caggaccccaggaccttgccacact

SEQ ID NO: 229427 - DNA, 25 bp, Mus musculus
caggacccccaccaggagagaaagg

SEQ ID NO: 229428 - DNA, 25 bp, Mus musculus
caggacccccaggtgatgctggcgc

SEQ ID NO: 229429 - DNA, 25 bp, Mus musculus
caggacccccgaggtgattcatggc

SEQ ID NO: 229430 - DNA, 25 bp, Mus musculus
caggacccccgagtgtccaggttat

SEQ ID NO: 229431 - DNA, 25 bp, Mus musculus
caggacccgctcagatcttgacagt

SEQ ID NO: 229432 - DNA, 25 bp, Mus musculus
caggacccgctcagggaaacagatc

SEQ ID NO: 229433 - DNA, 25 bp, Mus musculus
caggacccggaactgaaagcaaaat

SEQ ID NO: 229434 - DNA, 25 bp, Mus musculus
caggaccctatgaagttgaaaacac

SEQ ID NO: 229435 - DNA, 25 bp, Mus musculus
caggaccctcgaccgtttccaggat

SEQ ID NO: 229436 - DNA, 25 bp, Mus musculus
caggaccctcgacgccttattcagg

SEQ ID NO: 229437 - DNA, 25 bp, Mus musculus
caggaccctgtgagctcggtcgagg

SEQ ID NO: 229438 - DNA, 25 bp, Mus musculus
caggaccgacgagcccttgctgctc

SEQ ID NO: 229439 - DNA, 25 bp, Mus musculus
caggaccgagacagctccttccgct

SEQ ID NO: 229440 - DNA, 25 bp, Mus musculus
caggaccgcagcacttcatccacca

SEQ ID NO: 229441 - DNA, 25 bp, Mus musculus
caggaccgcttggctctacagaggg

SEQ ID NO: 229442 - DNA, 25 bp, Mus musculus
caggacctaggctggcacgcttcag

SEQ ID NO: 229443 - DNA, 25 bp, Mus musculus
caggacctcaaggacggtatttata

SEQ ID NO: 229444 - DNA, 25 bp, Mus musculus
caggacctgaaaggattaataggca

SEQ ID NO: 229445 - DNA, 25 bp, Mus musculus
caggacctgaaatttcagattggag

SEQ ID NO: 229446 - DNA, 25 bp, Mus musculus
caggacctgactcagagaggaagaa

SEQ ID NO: 229447 - DNA, 25 bp, Mus musculus
caggacctgcagctcttatgctcta

SEQ ID NO: 229448 - DNA, 25 bp, Mus musculus
caggacctgcaggccccccaggatc

SEQ ID NO: 229449 - DNA, 25 bp, Mus musculus
caggacctgcagtgctcccaccacc

SEQ ID NO: 229450 - DNA, 25 bp, Mus musculus
caggacctggaaaccaacctgacct

SEQ ID NO: 229451 - DNA, 25 bp, Mus musculus
caggacctggaaaccactaagaaac

SEQ ID NO: 229452 - DNA, 25 bp, Mus musculus
caggaccttacacaggtcaccactc

SEQ ID NO: 229453 - DNA, 25 bp, Mus musculus
caggaccttatcaggtttgcacaga

SEQ ID NO: 229454 - DNA, 25 bp, Mus musculus
caggaccttgctgcaggcacctttt

SEQ ID NO: 229455 - DNA, 25 bp, Mus musculus
caggaccttggcaggggaatcaaag

SEQ ID NO: 229456 - DNA, 25 bp, Mus musculus
caggaccttgtgcaggcaccttttg

SEQ ID NO: 229457 - DNA, 25 bp, Mus musculus
caggaccttttcggactgggtgaaa

SEQ ID NO: 229458 - DNA, 25 bp, Mus musculus
caggaccttttcggatcaagattat

SEQ ID NO: 229459 - DNA, 25 bp, Mus musculus
caggaccttttcgtgggagccaaga

SEQ ID NO: 229460 - DNA, 25 bp, Mus musculus
caggacgaagggtcctgtgcgcagg

SEQ ID NO: 229461 - DNA, 25 bp, Mus musculus
caggacgacggcccttcaaattggc

SEQ ID NO: 229462 - DNA, 25 bp, Mus musculus
caggacgagctgaattctttataca

SEQ ID NO: 229463 - DNA, 25 bp, Mus musculus
caggacgaggagcaggttgctatcg

SEQ ID NO: 229464 - DNA, 25 bp, Mus musculus
caggacgatgagcgaggctgctgcg

SEQ ID NO: 229465 - DNA, 25 bp, Mus musculus
caggacgcagagaagggcccagtgt

SEQ ID NO: 229466 - DNA, 25 bp, Mus musculus
caggacgcccaggaactgtatgagg

SEQ ID NO: 229467 - DNA, 25 bp, Mus musculus
caggacgcccaggtctttcaacact

SEQ ID NO: 229468 - DNA, 25 bp, Mus musculus
caggacggaaagcgaatggacccgc

SEQ ID NO: 229469 - DNA, 25 bp, Mus musculus
caggacggaataggaaccaagatga

SEQ ID NO: 229470 - DNA, 25 bp, Mus musculus
caggacggagatgaacatctgcaac

SEQ ID NO: 229471 - DNA, 25 bp, Mus musculus
caggacggagcatggttggagcctc

SEQ ID NO: 229472 - DNA, 25 bp, Mus musculus
caggacggatggcgggtttccgctt

SEQ ID NO: 229473 - DNA, 25 bp, Mus musculus
caggacggggagacccatataatgc

SEQ ID NO: 229474 - DNA, 25 bp, Mus musculus
caggacgtgacagaaaagatcaagg

SEQ ID NO: 229475 - DNA, 25 bp, Mus musculus
caggacgtgacagggaggcccggat

SEQ ID NO: 229476 - DNA, 25 bp, Mus musculus
caggacgtggctccttccagcctgg

SEQ ID NO: 229477 - DNA, 25 bp, Mus musculus
caggacgttctaaagaccaaggaca

SEQ ID NO: 229478 - DNA, 25 bp, Mus musculus
caggactaagagggtgtttcttgaa

SEQ ID NO: 229479 - DNA, 25 bp, Mus musculus
caggactaaggggaagactgtcacg

SEQ ID NO: 229480 - DNA, 25 bp, Mus musculus
caggactacacagcatcctgcctct

SEQ ID NO: 229481 - DNA, 25 bp, Mus musculus
caggactacatgctcacagttacgt

SEQ ID NO: 229482 - DNA, 25 bp, Mus musculus
caggactagagaaagtgtgcaatgt

SEQ ID NO: 229483 - DNA, 25 bp, Mus musculus
caggactcaagtcctccacagagca

SEQ ID NO: 229484 - DNA, 25 bp, Mus musculus
caggactcaggtagatgagaggcca

SEQ ID NO: 229485 - DNA, 25 bp, Mus musculus
caggactcaggtaggttgatggaaa

SEQ ID NO: 229486 - DNA, 25 bp, Mus musculus
caggactccagagatcccgatgtgt

SEQ ID NO: 229487 - DNA, 25 bp, Mus musculus
caggactccatttacaacttcaggg

SEQ ID NO: 229488 - DNA, 25 bp, Mus musculus
caggactcccccaagcaggcggacg

SEQ ID NO: 229489 - DNA, 25 bp, Mus musculus
caggactcggaagtggacagtggca

SEQ ID NO: 229490 - DNA, 25 bp, Mus musculus
caggactctgacatagcctaggaag

SEQ ID NO: 229491 - DNA, 25 bp, Mus musculus
caggactctgacatatggggcatca

SEQ ID NO: 229492 - DNA, 25 bp, Mus musculus
caggactctttgatgtaacccacgg

SEQ ID NO: 229493 - DNA, 25 bp, Mus musculus
caggactgaggaagccagctttgta

SEQ ID NO: 229494 - DNA, 25 bp, Mus musculus
caggactgaggtcctctttcagctc

SEQ ID NO: 229495 - DNA, 25 bp, Mus musculus
caggactgcacagtgtacaaggcag

SEQ ID NO: 229496 - DNA, 25 bp, Mus musculus
caggactggcgcaaggttcccaatc

SEQ ID NO: 229497 - DNA, 25 bp, Mus musculus
caggactgggaaaggacccagctgt

SEQ ID NO: 229498 - DNA, 25 bp, Mus musculus
caggactgggaaaggagtgtgctcg

SEQ ID NO: 229499 - DNA, 25 bp, Mus musculus
caggactgggaaaggatcatcgggt

SEQ ID NO: 229500 - DNA, 25 bp, Mus musculus
caggacttcactacacaacatgcct

SEQ ID NO: 229501 - DNA, 25 bp, Mus musculus
caggacttcttcaagggtggggtaa

SEQ ID NO: 229502 - DNA, 25 bp, Mus musculus
caggacttggacatgtcatctcctg

SEQ ID NO: 229503 - DNA, 25 bp, Mus musculus
caggacttttttgagacagaaacca

SEQ ID NO: 229504 - DNA, 25 bp, Mus musculus
caggagaaaagaataaatgaagaag

SEQ ID NO: 229505 - DNA, 25 bp, Mus musculus
caggagaaagctattacaagccaga

SEQ ID NO: 229506 - DNA, 25 bp, Mus musculus
caggagaaaggctggagctggaacc

SEQ ID NO: 229507 - DNA, 25 bp, Mus musculus
caggagaaaggctgggtgaagaccc

SEQ ID NO: 229508 - DNA, 25 bp, Mus musculus
caggagaacagataagccaaagagc

SEQ ID NO: 229509 - DNA, 25 bp, Mus musculus
caggagaacagcagtaccactagcc

SEQ ID NO: 229510 - DNA, 25 bp, Mus musculus
caggagaacctggagagatgctgtc

SEQ ID NO: 229511 - DNA, 25 bp, Mus musculus
caggagaagaaaatgaccctgccac

SEQ ID NO: 229512 - DNA, 25 bp, Mus musculus
caggagaagaaaatgctttacacag

SEQ ID NO: 229513 - DNA, 25 bp, Mus musculus
caggagaagaaaatggagttgaagc

SEQ ID NO: 229514 - DNA, 25 bp, Mus musculus
caggagaagatattgacacagcagt

SEQ ID NO: 229515 - DNA, 25 bp, Mus musculus
caggagaagatcacaagagggaagt

SEQ ID NO: 229516 - DNA, 25 bp, Mus musculus
caggagaagatggtggatcgcactc

SEQ ID NO: 229517 - DNA, 25 bp, Mus musculus
caggagaagcaaaacttttaatcca

SEQ ID NO: 229518 - DNA, 25 bp, Mus musculus
caggagaaggatagagatggttgtc

SEQ ID NO: 229519 - DNA, 25 bp, Mus musculus
caggagaagtggtgcatggatgttt

SEQ ID NO: 229520 - DNA, 25 bp, Mus musculus
caggagaagtggtggcctgcttgat

SEQ ID NO: 229521 - DNA, 25 bp, Mus musculus
caggagaataaaggacctttttcag

SEQ ID NO: 229522 - DNA, 25 bp, Mus musculus
caggagaatactataaggcaagaag

SEQ ID NO: 229523 - DNA, 25 bp, Mus musculus
caggagaatactatatgtggagacg

SEQ ID NO: 229524 - DNA, 25 bp, Mus musculus
caggagaatactattgagtcagacg

SEQ ID NO: 229525 - DNA, 25 bp, Mus musculus
caggagaatgactggtgggtgtgca

SEQ ID NO: 229526 - DNA, 25 bp, Mus musculus
caggagaatggtccgtctcccaggg

SEQ ID NO: 229527 - DNA, 25 bp, Mus musculus
caggagaatgtgtatggcctgcagg

SEQ ID NO: 229528 - DNA, 25 bp, Mus musculus
caggagacaaattgagacctacagg

SEQ ID NO: 229529 - DNA, 25 bp, Mus musculus
caggagacaagaacttcatcactgc

SEQ ID NO: 229530 - DNA, 25 bp, Mus musculus
caggagacaagcatctaatgatgac

SEQ ID NO: 229531 - DNA, 25 bp, Mus musculus
caggagacacatcaagttggaccca

SEQ ID NO: 229532 - DNA, 25 bp, Mus musculus
caggagacacgagattccggggatg

SEQ ID NO: 229533 - DNA, 25 bp, Mus musculus
caggagacacgggacgctgtatcaa

SEQ ID NO: 229534 - DNA, 25 bp, Mus musculus
caggagacagagggcatggtggcag

SEQ ID NO: 229535 - DNA, 25 bp, Mus musculus
caggagacagcctgccccgcgagaa

SEQ ID NO: 229536 - DNA, 25 bp, Mus musculus
caggagacagcctgccgagggagcg

SEQ ID NO: 229537 - DNA, 25 bp, Mus musculus
caggagacagggaagaagccagctg

SEQ ID NO: 229538 - DNA, 25 bp, Mus musculus
caggagaccagggagagaaatacat

SEQ ID NO: 229539 - DNA, 25 bp, Mus musculus
caggagacccacagtatcagaaatt

SEQ ID NO: 229540 - DNA, 25 bp, Mus musculus
caggagacccaggctaggttatcaa

SEQ ID NO: 229541 - DNA, 25 bp, Mus musculus
caggagacctggtgggtgtgaacaa

SEQ ID NO: 229542 - DNA, 25 bp, Mus musculus
caggagactaagccttctgatgatg

SEQ ID NO: 229543 - DNA, 25 bp, Mus musculus
caggagactctaaagttgcagcaga

SEQ ID NO: 229544 - DNA, 25 bp, Mus musculus
caggagactctgtcttcctgtgttt

SEQ ID NO: 229545 - DNA, 25 bp, Mus musculus
caggagagaagcatcaagatgacct

SEQ ID NO: 229546 - DNA, 25 bp, Mus musculus
caggagagaaggatgtgcgggcgct

SEQ ID NO: 229547 - DNA, 25 bp, Mus musculus
caggagagaaggattggaagaaaga

SEQ ID NO: 229548 - DNA, 25 bp, Mus musculus
caggagagaaggcattggaagaagg

SEQ ID NO: 229549 - DNA, 25 bp, Mus musculus
caggagagaagggtcaccgctagaa

SEQ ID NO: 229550 - DNA, 25 bp, Mus musculus
caggagagaggggagaaaggggaga

SEQ ID NO: 229551 - DNA, 25 bp, Mus musculus
caggagagaggtacaaagaagaccc

SEQ ID NO: 229552 - DNA, 25 bp, Mus musculus
caggagagatgacttgtaccagaga

SEQ ID NO: 229553 - DNA, 25 bp, Mus musculus
caggagagatgagagcaatcacctc

SEQ ID NO: 229554 - DNA, 25 bp, Mus musculus
caggagagattgttgacgctgctga

SEQ ID NO: 229555 - DNA, 25 bp, Mus musculus
caggagagcaagctgatcatcctgg

SEQ ID NO: 229556 - DNA, 25 bp, Mus musculus
caggagagcaggtcggcagctctgc

SEQ ID NO: 229557 - DNA, 25 bp, Mus musculus
caggagagccaggcttagaatcaga

SEQ ID NO: 229558 - DNA, 25 bp, Mus musculus
caggagagcgagatttcaacaagaa

SEQ ID NO: 229559 - DNA, 25 bp, Mus musculus
caggagagcgagtctgcggtgtggg

SEQ ID NO: 229560 - DNA, 25 bp, Mus musculus
caggagagcgtgaaagagttcctag

SEQ ID NO: 229561 - DNA, 25 bp, Mus musculus
caggagagctgggtcgcccaatgag

SEQ ID NO: 229562 - DNA, 25 bp, Mus musculus
caggagaggtttggagaagcctgaa

SEQ ID NO: 229563 - DNA, 25 bp, Mus musculus
caggagaggtttgggaaaagcttgt

SEQ ID NO: 229564 - DNA, 25 bp, Mus musculus
caggagagtgagccaaggagatgga

SEQ ID NO: 229565 - DNA, 25 bp, Mus musculus
caggagagtgaggtgctggtaactc

SEQ ID NO: 229566 - DNA, 25 bp, Mus musculus
caggagatataccaggtgaacctga

SEQ ID NO: 229567 - DNA, 25 bp, Mus musculus
caggagatataccagtccggttctc

SEQ ID NO: 229568 - DNA, 25 bp, Mus musculus
caggagatatgagcaacaaaagcgg

SEQ ID NO: 229569 - DNA, 25 bp, Mus musculus
caggagatatgcgcaacaaaagcgg

SEQ ID NO: 229570 - DNA, 25 bp, Mus musculus
caggagatcagggtctgatgtttgg

SEQ ID NO: 229571 - DNA, 25 bp, Mus musculus
caggagatcatgcctcccgcagcaa

SEQ ID NO: 229572 - DNA, 25 bp, Mus musculus
caggagatcctcctagcccacagac

SEQ ID NO: 229573 - DNA, 25 bp, Mus musculus
caggagatcgcaggggtgccttctg

SEQ ID NO: 229574 - DNA, 25 bp, Mus musculus
caggagatgaagtgataattatggt

SEQ ID NO: 229575 - DNA, 25 bp, Mus musculus
caggagatgagattagcattaagaa

SEQ ID NO: 229576 - DNA, 25 bp, Mus musculus
caggagatgagattgactgggaaac

SEQ ID NO: 229577 - DNA, 25 bp, Mus musculus
caggagatgcctgatcaacatgaca

SEQ ID NO: 229578 - DNA, 25 bp, Mus musculus
caggagatgcttggtactacatgag

SEQ ID NO: 229579 - DNA, 25 bp, Mus musculus
caggagatggacttccagctgcccc

SEQ ID NO: 229580 - DNA, 25 bp, Mus musculus
caggagattctgagaccttgctaca

SEQ ID NO: 229581 - DNA, 25 bp, Mus musculus
caggagattctgaggcgaatggacc

SEQ ID NO: 229582 - DNA, 25 bp, Mus musculus
caggagattgcagaggcccagcagc

SEQ ID NO: 229583 - DNA, 25 bp, Mus musculus
caggagattttgaaagacaagaagc

SEQ ID NO: 229584 - DNA, 25 bp, Mus musculus
caggagcaaccagagagcaccgtac

SEQ ID NO: 229585 - DNA, 25 bp, Mus musculus
caggagcaaccagagcacctgtctc

SEQ ID NO: 229586 - DNA, 25 bp, Mus musculus
caggagcaacgtcagggctacacat

SEQ ID NO: 229587 - DNA, 25 bp, Mus musculus
caggagcaacgtcaggtaagaatga

SEQ ID NO: 229588 - DNA, 25 bp, Mus musculus
caggagcaagaagcagcaaagctgg

SEQ ID NO: 229589 - DNA, 25 bp, Mus musculus
caggagcaagattgccaagggatca

SEQ ID NO: 229590 - DNA, 25 bp, Mus musculus
caggagcaagtttcaggttagtccg

SEQ ID NO: 229591 - DNA, 25 bp, Mus musculus
caggagcacagatctgggagccgca

SEQ ID NO: 229592 - DNA, 25 bp, Mus musculus
caggagcacaggaagattcatgaga

SEQ ID NO: 229593 - DNA, 25 bp, Mus musculus
caggagcacatcaaggaacttctag

SEQ ID NO: 229594 - DNA, 25 bp, Mus musculus
caggagcacatcaagttacaacagg

SEQ ID NO: 229595 - DNA, 25 bp, Mus musculus
caggagcagaaggtatatgtggttg

SEQ ID NO: 229596 - DNA, 25 bp, Mus musculus
caggagcagagagtgacaacagtgc

SEQ ID NO: 229597 - DNA, 25 bp, Mus musculus
caggagcagagatcatagcagtctg

SEQ ID NO: 229598 - DNA, 25 bp, Mus musculus
caggagcagaggctcatctacctgc

SEQ ID NO: 229599 - DNA, 25 bp, Mus musculus
caggagcagagggggatgccccata

SEQ ID NO: 229600 - DNA, 25 bp, Mus musculus
caggagcagcgggtttattgcctag

SEQ ID NO: 229601 - DNA, 25 bp, Mus musculus
caggagcagctgacaggtctgatcc

SEQ ID NO: 229602 - DNA, 25 bp, Mus musculus
caggagcagctggctgcagagctgg

SEQ ID NO: 229603 - DNA, 25 bp, Mus musculus
caggagcatcctggtccagggctaa

SEQ ID NO: 229604 - DNA, 25 bp, Mus musculus
caggagccaagagctatgagccaga

SEQ ID NO: 229605 - DNA, 25 bp, Mus musculus
caggagccaagagtgaagaacaatc

SEQ ID NO: 229606 - DNA, 25 bp, Mus musculus
caggagccaaggagatcgttgtcca

SEQ ID NO: 229607 - DNA, 25 bp, Mus musculus
caggagccagcaggtctattttgtg

SEQ ID NO: 229608 - DNA, 25 bp, Mus musculus
caggagccagcaggtggagcacgcc

SEQ ID NO: 229609 - DNA, 25 bp, Mus musculus
caggagccagggatgccctgctggc

SEQ ID NO: 229610 - DNA, 25 bp, Mus musculus
caggagccaggtggtgtccctcagg

SEQ ID NO: 229611 - DNA, 25 bp, Mus musculus
caggagcccaacttgcaggtggacc

SEQ ID NO: 229612 - DNA, 25 bp, Mus musculus
caggagccctgccacattgtccaag

SEQ ID NO: 229613 - DNA, 25 bp, Mus musculus
caggagccctgtgcttgatgggcgg

SEQ ID NO: 229614 - DNA, 25 bp, Mus musculus
caggagccggaaagaagagacgcct

SEQ ID NO: 229615 - DNA, 25 bp, Mus musculus
caggagccggaaaggcggaggccag

SEQ ID NO: 229616 - DNA, 25 bp, Mus musculus
caggagccgggcattcaactcggag

SEQ ID NO: 229617 - DNA, 25 bp, Mus musculus
caggagcctgaaccgcccgttgacc

SEQ ID NO: 229618 - DNA, 25 bp, Mus musculus
caggagcgaaagtgacaccagcagt

SEQ ID NO: 229619 - DNA, 25 bp, Mus musculus
caggagcgcagaaggctgagaccgc

SEQ ID NO: 229620 - DNA, 25 bp, Mus musculus
caggagcgcaggttcctcatgaggg

SEQ ID NO: 229621 - DNA, 25 bp, Mus musculus
caggagcgcatgaggagccgagagg

SEQ ID NO: 229622 - DNA, 25 bp, Mus musculus
caggagcggcaggtaactgtagctg

SEQ ID NO: 229623 - DNA, 25 bp, Mus musculus
caggagcggcagtctcagagagaag

SEQ ID NO: 229624 - DNA, 25 bp, Mus musculus
caggagcgtggattggtgaccaggc

SEQ ID NO: 229625 - DNA, 25 bp, Mus musculus
caggagctacggaggaggcaaaaaa

SEQ ID NO: 229626 - DNA, 25 bp, Mus musculus
caggagctacggatagcgaggttgc

SEQ ID NO: 229627 - DNA, 25 bp, Mus musculus
caggagctagtgcaaaactgccagt

SEQ ID NO: 229628 - DNA, 25 bp, Mus musculus
caggagctcaacgagctggactact

SEQ ID NO: 229629 - DNA, 25 bp, Mus musculus
caggagctcacacgagagaaggaga

SEQ ID NO: 229630 - DNA, 25 bp, Mus musculus
caggagctcacaggagagaaggaga

SEQ ID NO: 229631 - DNA, 25 bp, Mus musculus
caggagctcatgaaggctctggtct

SEQ ID NO: 229632 - DNA, 25 bp, Mus musculus
caggagctcgagaacttcaagttgg

SEQ ID NO: 229633 - DNA, 25 bp, Mus musculus
caggagctgacaggcagtatctgaa

SEQ ID NO: 229634 - DNA, 25 bp, Mus musculus
caggagctgagctgtagccctcatg

SEQ ID NO: 229635 - DNA, 25 bp, Mus musculus
caggagctgctccagagaatgacgg

SEQ ID NO: 229636 - DNA, 25 bp, Mus musculus
caggagctgctggagtgggaactgg

SEQ ID NO: 229637 - DNA, 25 bp, Mus musculus
caggagctgctgttccaggtgctgc

SEQ ID NO: 229638 - DNA, 25 bp, Mus musculus
caggagctggagagaaaaatatcag

SEQ ID NO: 229639 - DNA, 25 bp, Mus musculus
caggagctggagaggaaagccatag

SEQ ID NO: 229640 - DNA, 25 bp, Mus musculus
caggaggaaaaggaggagtcagaca

SEQ ID NO: 229641 - DNA, 25 bp, Mus musculus
caggaggaaaggacccaggagagca

SEQ ID NO: 229642 - DNA, 25 bp, Mus musculus
caggaggaacttaaggtgagggtgg

SEQ ID NO: 229643 - DNA, 25 bp, Mus musculus
caggaggaagaagactcagaaagtg

SEQ ID NO: 229644 - DNA, 25 bp, Mus musculus
caggaggaagaggaagtccaagaag

SEQ ID NO: 229645 - DNA, 25 bp, Mus musculus
caggaggaagatgctgtcgccgagg

SEQ ID NO: 229646 - DNA, 25 bp, Mus musculus
caggaggaagcaactgatggtgtcc

SEQ ID NO: 229647 - DNA, 25 bp, Mus musculus
caggaggacagatcttctatcgggc

SEQ ID NO: 229648 - DNA, 25 bp, Mus musculus
caggaggacagcgagacggtcatct

SEQ ID NO: 229649 - DNA, 25 bp, Mus musculus
caggaggaccctggggtcaagagtg

SEQ ID NO: 229650 - DNA, 25 bp, Mus musculus
caggaggacctggggtcagacagct

SEQ ID NO: 229651 - DNA, 25 bp, Mus musculus
caggaggacgaggtgctgctggtga

SEQ ID NO: 229652 - DNA, 25 bp, Mus musculus
caggaggagatccaggagtggtacg

SEQ ID NO: 229653 - DNA, 25 bp, Mus musculus
caggaggagcagacgggcagcgggc

SEQ ID NO: 229654 - DNA, 25 bp, Mus musculus
caggaggagcaggatatcctcactc

SEQ ID NO: 229655 - DNA, 25 bp, Mus musculus
caggaggaggagcatatgctggtat

SEQ ID NO: 229656 - DNA, 25 bp, Mus musculus
caggaggatcaaggaactgcattgg

SEQ ID NO: 229657 - DNA, 25 bp, Mus musculus
caggaggattactgtccagtttgat

SEQ ID NO: 229658 - DNA, 25 bp, Mus musculus
caggaggcagaaaggatgagcgcag

SEQ ID NO: 229659 - DNA, 25 bp, Mus musculus
caggaggcagagagtgctacaataa

SEQ ID NO: 229660 - DNA, 25 bp, Mus musculus
caggaggcagaggtaagaaagtgct

SEQ ID NO: 229661 - DNA, 25 bp, Mus musculus
caggaggcagaggtccctggctgca

SEQ ID NO: 229662 - DNA, 25 bp, Mus musculus
caggaggcaggtcattcattcaaca

SEQ ID NO: 229663 - DNA, 25 bp, Mus musculus
caggaggccacaagatatcagtatt

SEQ ID NO: 229664 - DNA, 25 bp, Mus musculus
caggaggccacaagcctacttggag

SEQ ID NO: 229665 - DNA, 25 bp, Mus musculus
caggaggccatggttaaaccatatg

SEQ ID NO: 229666 - DNA, 25 bp, Mus musculus
caggaggcccaagcctttccacgtc

SEQ ID NO: 229667 - DNA, 25 bp, Mus musculus
caggaggcccaatgattagcattta

SEQ ID NO: 229668 - DNA, 25 bp, Mus musculus
caggaggcgcgaggggacaaaggcg

SEQ ID NO: 229669 - DNA, 25 bp, Mus musculus
caggaggctcaggattcagactcgg

SEQ ID NO: 229670 - DNA, 25 bp, Mus musculus
caggaggctggagagtccttagcca

SEQ ID NO: 229671 - DNA, 25 bp, Mus musculus
caggagggaagatatgaatctgaaa

SEQ ID NO: 229672 - DNA, 25 bp, Mus musculus
caggagggacagcgtccgatgcaag

SEQ ID NO: 229673 - DNA, 25 bp, Mus musculus
caggagggacaggaggtcagtggag

SEQ ID NO: 229674 - DNA, 25 bp, Mus musculus
caggagggacccaggcattttcccg

SEQ ID NO: 229675 - DNA, 25 bp, Mus musculus
caggagggacgattctgacgttggg

SEQ ID NO: 229676 - DNA, 25 bp, Mus musculus
caggagggtatgagcgaagagaaag

SEQ ID NO: 229677 - DNA, 25 bp, Mus musculus
caggaggtcaagattcgggaagaag

SEQ ID NO: 229678 - DNA, 25 bp, Mus musculus
caggaggtgacgggtctcactctag

SEQ ID NO: 229679 - DNA, 25 bp, Mus musculus
caggaggtgacggtgcagcggaact

SEQ ID NO: 229680 - DNA, 25 bp, Mus musculus
caggaggtgacgttgctgtcccaga

SEQ ID NO: 229681 - DNA, 25 bp, Mus musculus
caggaggtggcaaggtgcaaatagt

SEQ ID NO: 229682 - DNA, 25 bp, Mus musculus
caggaggtggcaaggtgcagataat

SEQ ID NO: 229683 - DNA, 25 bp, Mus musculus
caggaggttatcggcagcggagcaa

SEQ ID NO: 229684 - DNA, 25 bp, Mus musculus
caggaggttatcggtaaggcgagtt

SEQ ID NO: 229685 - DNA, 25 bp, Mus musculus
caggaggtttactgccggctcctgt

SEQ ID NO: 229686 - DNA, 25 bp, Mus musculus
caggagtacaagagccagatgaagt

SEQ ID NO: 229687 - DNA, 25 bp, Mus musculus
caggagtacaaggccaagctacaag

SEQ ID NO: 229688 - DNA, 25 bp, Mus musculus
caggagtacagacagcacccttgtg

SEQ ID NO: 229689 - DNA, 25 bp, Mus musculus
caggagtacgcagtggaagcccact

SEQ ID NO: 229690 - DNA, 25 bp, Mus musculus
caggagtagcaactggtctctggac

SEQ ID NO: 229691 - DNA, 25 bp, Mus musculus
caggagtcaaaggtccacgaaccag

SEQ ID NO: 229692 - DNA, 25 bp, Mus musculus
caggagtcccagatccagtatgtac

SEQ ID NO: 229693 - DNA, 25 bp, Mus musculus
caggagtcccagtgtcttgctgcat

SEQ ID NO: 229694 - DNA, 25 bp, Mus musculus
caggagtcccagttcttgcttcagc

SEQ ID NO: 229695 - DNA, 25 bp, Mus musculus
caggagtctgagagcccaccttctc

SEQ ID NO: 229696 - DNA, 25 bp, Mus musculus
caggagtctgagaggcggaagaagc

SEQ ID NO: 229697 - DNA, 25 bp, Mus musculus
caggagtgaacagtccctggatgac

SEQ ID NO: 229698 - DNA, 25 bp, Mus musculus
caggagtgaagaccttgcacttgac

SEQ ID NO: 229699 - DNA, 25 bp, Mus musculus
caggagtgagcacggttatttttga

SEQ ID NO: 229700 - DNA, 25 bp, Mus musculus
caggagtgatcacaggattgctgct

SEQ ID NO: 229701 - DNA, 25 bp, Mus musculus
caggagtgatcacaggcctgggcat

SEQ ID NO: 229702 - DNA, 25 bp, Mus musculus
caggagtgatcacagggccaaaggc

SEQ ID NO: 229703 - DNA, 25 bp, Mus musculus
caggagtgcaagaacctgatcctcc

SEQ ID NO: 229704 - DNA, 25 bp, Mus musculus
caggagtgcaagggctccagcataa

SEQ ID NO: 229705 - DNA, 25 bp, Mus musculus
caggagtgcagtatctctcctctct

SEQ ID NO: 229706 - DNA, 25 bp, Mus musculus
caggagtgccaacatatcgatgagt

SEQ ID NO: 229707 - DNA, 25 bp, Mus musculus
caggagtgccaagatatcgatgagt

SEQ ID NO: 229708 - DNA, 25 bp, Mus musculus
caggagtgcccaggcgaccacctcc

SEQ ID NO: 229709 - DNA, 25 bp, Mus musculus
caggagtgtgaggcatgggtgtcag

SEQ ID NO: 229710 - DNA, 25 bp, Mus musculus
caggagttagagaaggctcatacaa

SEQ ID NO: 229711 - DNA, 25 bp, Mus musculus
caggagttcaaacatacagctttgt

SEQ ID NO: 229712 - DNA, 25 bp, Mus musculus
caggagttcgggactctgctgacag

SEQ ID NO: 229713 - DNA, 25 bp, Mus musculus
caggagttctaggaaacagctcaaa

SEQ ID NO: 229714 - DNA, 25 bp, Mus musculus
caggagttctagggtatccctccta

SEQ ID NO: 229715 - DNA, 25 bp, Mus musculus
caggagttgacacatggtttgggac

SEQ ID NO: 229716 - DNA, 25 bp, Mus musculus
caggagttgaggacctgtttactgg

SEQ ID NO: 229717 - DNA, 25 bp, Mus musculus
caggagttggttcaggtggaacatc

SEQ ID NO: 229718 - DNA, 25 bp, Mus musculus
caggagttggttcagtatcctgtgg

SEQ ID NO: 229719 - DNA, 25 bp, Mus musculus
caggagtttgaaaggatgtcttcca

SEQ ID NO: 229720 - DNA, 25 bp, Mus musculus
caggagtttgggttaatatttgcca

SEQ ID NO: 229721 - DNA, 25 bp, Mus musculus
caggataacacctgacactgaagat

SEQ ID NO: 229722 - DNA, 25 bp, Mus musculus
caggataacacgtccctagctgttg

SEQ ID NO: 229723 - DNA, 25 bp, Mus musculus
caggataactttaaccagacacacc

SEQ ID NO: 229724 - DNA, 25 bp, Mus musculus
caggataactttgatgtgtatgctg

SEQ ID NO: 229725 - DNA, 25 bp, Mus musculus
caggataagatgaaggctcacagcg

SEQ ID NO: 229726 - DNA, 25 bp, Mus musculus
caggatacaaggcaaaaacagctct

SEQ ID NO: 229727 - DNA, 25 bp, Mus musculus
caggatacaggattctcataatgaa

SEQ ID NO: 229728 - DNA, 25 bp, Mus musculus
caggatacagggttatacaggggac

SEQ ID NO: 229729 - DNA, 25 bp, Mus musculus
caggataccaaggctcctgtgatgc

SEQ ID NO: 229730 - DNA, 25 bp, Mus musculus
caggatacctcacaggacctggagt

SEQ ID NO: 229731 - DNA, 25 bp, Mus musculus
caggatactatgtatataacaggca

SEQ ID NO: 229732 - DNA, 25 bp, Mus musculus
caggatactggagcttgcctctcca

SEQ ID NO: 229733 - DNA, 25 bp, Mus musculus
caggatagagactaatgctcatact

SEQ ID NO: 229734 - DNA, 25 bp, Mus musculus
caggatagcagcctggcccatctcc

SEQ ID NO: 229735 - DNA, 25 bp, Mus musculus
caggatagtgacagtgacgatgggg

SEQ ID NO: 229736 - DNA, 25 bp, Mus musculus
caggatataaagaaaccagaccgtg

SEQ ID NO: 229737 - DNA, 25 bp, Mus musculus
caggatataaagaccgtgatgactg

SEQ ID NO: 229738 - DNA, 25 bp, Mus musculus
caggatatcaaggcctctgtgtcca

SEQ ID NO: 229739 - DNA, 25 bp, Mus musculus
caggatatcagctcttgcactgcga

SEQ ID NO: 229740 - DNA, 25 bp, Mus musculus
caggatatgacagaagtctgcgtgg

SEQ ID NO: 229741 - DNA, 25 bp, Mus musculus
caggatatgagtgttttatggctat

SEQ ID NO: 229742 - DNA, 25 bp, Mus musculus
caggatattgagaccctacacttat

SEQ ID NO: 229743 - DNA, 25 bp, Mus musculus
caggatcaccaggtgctcgaggctt

SEQ ID NO: 229744 - DNA, 25 bp, Mus musculus
caggatcacgctcctcctaggtgct

SEQ ID NO: 229745 - DNA, 25 bp, Mus musculus
caggatcacggcaaaatgaaggatc

SEQ ID NO: 229746 - DNA, 25 bp, Mus musculus
caggatcagaggtcaccttccgaac

SEQ ID NO: 229747 - DNA, 25 bp, Mus musculus
caggatcagataaagcaaattaaaa

SEQ ID NO: 229748 - DNA, 25 bp, Mus musculus
caggatcagttatgagacttcagac

SEQ ID NO: 229749 - DNA, 25 bp, Mus musculus
caggatcagttatggcagtaatgga

SEQ ID NO: 229750 - DNA, 25 bp, Mus musculus
caggatcagttatgtttttatttca

SEQ ID NO: 229751 - DNA, 25 bp, Mus musculus
caggatcatgagaaggctgctttga

SEQ ID NO: 229752 - DNA, 25 bp, Mus musculus
caggatccacacagcaggacagttg

SEQ ID NO: 229753 - DNA, 25 bp, Mus musculus
caggatccacacaggcgagaagcct

SEQ ID NO: 229754 - DNA, 25 bp, Mus musculus
caggatccaggcgccaggcagcacg

SEQ ID NO: 229755 - DNA, 25 bp, Mus musculus
caggatccaggttttatccagaggg

SEQ ID NO: 229756 - DNA, 25 bp, Mus musculus
caggatcccagcgaaaagcccattg

SEQ ID NO: 229757 - DNA, 25 bp, Mus musculus
caggatccccaggctgcccttgggg

SEQ ID NO: 229758 - DNA, 25 bp, Mus musculus
caggatcccctcctgtgcccctggc

SEQ ID NO: 229759 - DNA, 25 bp, Mus musculus
caggatcccctggcctcgctggacc

SEQ ID NO: 229760 - DNA, 25 bp, Mus musculus
caggatcctaccctctagacgtcct

SEQ ID NO: 229761 - DNA, 25 bp, Mus musculus
caggatcctccagtgtctccagaac

SEQ ID NO: 229762 - DNA, 25 bp, Mus musculus
caggatcctccgagagttctgtcct

SEQ ID NO: 229763 - DNA, 25 bp, Mus musculus
caggatcctccggggcaacattttg

SEQ ID NO: 229764 - DNA, 25 bp, Mus musculus
caggatcctccggggcatccaggga

SEQ ID NO: 229765 - DNA, 25 bp, Mus musculus
caggatcgcagaggggacaatgcca

SEQ ID NO: 229766 - DNA, 25 bp, Mus musculus
caggatcgcatgggctaccagctgc

SEQ ID NO: 229767 - DNA, 25 bp, Mus musculus
caggatcggaacaagtctgggacct

SEQ ID NO: 229768 - DNA, 25 bp, Mus musculus
caggatcggaacaattggtaccctt

SEQ ID NO: 229769 - DNA, 25 bp, Mus musculus
caggatcggactaggtctgcctggg

SEQ ID NO: 229770 - DNA, 25 bp, Mus musculus
caggatcggactagtggccacagtt

SEQ ID NO: 229771 - DNA, 25 bp, Mus musculus
caggatcggggcaggatggcagcca

SEQ ID NO: 229772 - DNA, 25 bp, Mus musculus
caggatctatgaggaaatgaataac

SEQ ID NO: 229773 - DNA, 25 bp, Mus musculus
caggatctatgagttaaacgccaag

SEQ ID NO: 229774 - DNA, 25 bp, Mus musculus
caggatctcttgcctcaatcaagac

SEQ ID NO: 229775 - DNA, 25 bp, Mus musculus
caggatcttaaagagcaaatcccat

SEQ ID NO: 229776 - DNA, 25 bp, Mus musculus
caggatcttgagactaccaaaggag

SEQ ID NO: 229777 - DNA, 25 bp, Mus musculus
caggatcttgagtttaccaaattac

SEQ ID NO: 229778 - DNA, 25 bp, Mus musculus
caggatctttccagttacaaatttc

SEQ ID NO: 229779 - DNA, 25 bp, Mus musculus
caggatgaagaactacaaagcaatt

SEQ ID NO: 229780 - DNA, 25 bp, Mus musculus
caggatgaagaggagaagacaccca

SEQ ID NO: 229781 - DNA, 25 bp, Mus musculus
caggatgaaggttaggcacgggcag

SEQ ID NO: 229782 - DNA, 25 bp, Mus musculus
caggatgaccaggtagagacctttt

SEQ ID NO: 229783 - DNA, 25 bp, Mus musculus
caggatgaccagtttcagaaagctc

SEQ ID NO: 229784 - DNA, 25 bp, Mus musculus
caggatgactatcgatgatgtgatg

SEQ ID NO: 229785 - DNA, 25 bp, Mus musculus
caggatgagaataatctttgtgcgc

SEQ ID NO: 229786 - DNA, 25 bp, Mus musculus
caggatgagaataatgtttgctttg

SEQ ID NO: 229787 - DNA, 25 bp, Mus musculus
caggatgagattctggtcattcgaa

SEQ ID NO: 229788 - DNA, 25 bp, Mus musculus
caggatgagcggcaggttgggtcgg

SEQ ID NO: 229789 - DNA, 25 bp, Mus musculus
caggatgaggtccaggagatacttc

SEQ ID NO: 229790 - DNA, 25 bp, Mus musculus
caggatgaggtccaggtgacaataa

SEQ ID NO: 229791 - DNA, 25 bp, Mus musculus
caggatgagtacgccatgaacgaca

SEQ ID NO: 229792 - DNA, 25 bp, Mus musculus
caggatgagtacggtgggaatgctg

SEQ ID NO: 229793 - DNA, 25 bp, Mus musculus
caggatgagtgggatgcagtcatgc

SEQ ID NO: 229794 - DNA, 25 bp, Mus musculus
caggatgagtggggttggccgaatt

SEQ ID NO: 229795 - DNA, 25 bp, Mus musculus
caggatgattgaggatgcaattcga

SEQ ID NO: 229796 - DNA, 25 bp, Mus musculus
caggatgcagagggacgccctgact

SEQ ID NO: 229797 - DNA, 25 bp, Mus musculus
caggatgcagaggttcgccatcgat

SEQ ID NO: 229798 - DNA, 25 bp, Mus musculus
caggatgcaggagcctccagacagg

SEQ ID NO: 229799 - DNA, 25 bp, Mus musculus
caggatgcaggagttcctcaggtcc

SEQ ID NO: 229800 - DNA, 25 bp, Mus musculus
caggatgcaggctggggctgtctct

SEQ ID NO: 229801 - DNA, 25 bp, Mus musculus
caggatgcaggtcaactgaagctgt

SEQ ID NO: 229802 - DNA, 25 bp, Mus musculus
caggatgccacgaaagcgctaactg

SEQ ID NO: 229803 - DNA, 25 bp, Mus musculus
caggatgccacggatccttttgtgg

SEQ ID NO: 229804 - DNA, 25 bp, Mus musculus
caggatgcctcggcggtgttcacct

SEQ ID NO: 229805 - DNA, 25 bp, Mus musculus
caggatgcgaagaaagccttcaatg

SEQ ID NO: 229806 - DNA, 25 bp, Mus musculus
caggatgcggggtaccgaatgtata

SEQ ID NO: 229807 - DNA, 25 bp, Mus musculus
caggatgctggcaggtatctgtgtg

SEQ ID NO: 229808 - DNA, 25 bp, Mus musculus
caggatgcttaggacctgatatttg

SEQ ID NO: 229809 - DNA, 25 bp, Mus musculus
caggatggaaccgggcgcagcgcgt

SEQ ID NO: 229810 - DNA, 25 bp, Mus musculus
caggatggaagagaagctgaagaag

SEQ ID NO: 229811 - DNA, 25 bp, Mus musculus
caggatggaccttcccctgtctctg

SEQ ID NO: 229812 - DNA, 25 bp, Mus musculus
caggatggcatcacctttattgaca

SEQ ID NO: 229813 - DNA, 25 bp, Mus musculus
caggatggccagacgggcagcgggc

SEQ ID NO: 229814 - DNA, 25 bp, Mus musculus
caggatggccagctaccatatttgc

SEQ ID NO: 229815 - DNA, 25 bp, Mus musculus
caggatggccaggatatcctcactc

SEQ ID NO: 229816 - DNA, 25 bp, Mus musculus
caggatggccaggtactgcagggtg

SEQ ID NO: 229817 - DNA, 25 bp, Mus musculus
caggatggccagtcgtggggcctgt

SEQ ID NO: 229818 - DNA, 25 bp, Mus musculus
caggatggccagtttgtccctttat

SEQ ID NO: 229819 - DNA, 25 bp, Mus musculus
caggatggcgacgatttccagagca

SEQ ID NO: 229820 - DNA, 25 bp, Mus musculus
caggatggctgatatagacagaatc

SEQ ID NO: 229821 - DNA, 25 bp, Mus musculus
caggatgggccgaaagaattcagta

SEQ ID NO: 229822 - DNA, 25 bp, Mus musculus
caggatggtctccgacatcaacaat

SEQ ID NO: 229823 - DNA, 25 bp, Mus musculus
caggatggtgcttcggtacctgggc

SEQ ID NO: 229824 - DNA, 25 bp, Mus musculus
caggatggtggccacctgggtgcag

SEQ ID NO: 229825 - DNA, 25 bp, Mus musculus
caggatgtcgagatgcagatctctt

SEQ ID NO: 229826 - DNA, 25 bp, Mus musculus
caggatgtcgaggtacggtcagaat

SEQ ID NO: 229827 - DNA, 25 bp, Mus musculus
caggatgtctagaagctctaggaat

SEQ ID NO: 229828 - DNA, 25 bp, Mus musculus
caggatgtgccagaacaagctgttt

SEQ ID NO: 229829 - DNA, 25 bp, Mus musculus
caggatgttatggagggagtgaagc

SEQ ID NO: 229830 - DNA, 25 bp, Mus musculus
caggatgttgacctaaagattgtct

SEQ ID NO: 229831 - DNA, 25 bp, Mus musculus
caggatgttgagaaagcaactagtg

SEQ ID NO: 229832 - DNA, 25 bp, Mus musculus
caggattacaggactggatcctgta

SEQ ID NO: 229833 - DNA, 25 bp, Mus musculus
caggattacaggcgaccccctcggc

SEQ ID NO: 229834 - DNA, 25 bp, Mus musculus
caggattcaagggagccccgggcgt

SEQ ID NO: 229835 - DNA, 25 bp, Mus musculus
caggattcaccatgactctgctgca

SEQ ID NO: 229836 - DNA, 25 bp, Mus musculus
caggattcacgttggtgaccagatc

SEQ ID NO: 229837 - DNA, 25 bp, Mus musculus
caggattcagctctgtttcctaggc

SEQ ID NO: 229838 - DNA, 25 bp, Mus musculus
caggattcaggccactaaacctcgg

SEQ ID NO: 229839 - DNA, 25 bp, Mus musculus
caggattccagccagaccagcggag

SEQ ID NO: 229840 - DNA, 25 bp, Mus musculus
caggattctcgatccagagacaatg

SEQ ID NO: 229841 - DNA, 25 bp, Mus musculus
caggattctgaagtgagtaatagtt

SEQ ID NO: 229842 - DNA, 25 bp, Mus musculus
caggattgaggtccagaaggatgca

SEQ ID NO: 229843 - DNA, 25 bp, Mus musculus
caggattgcattaggaaagaatgtt

SEQ ID NO: 229844 - DNA, 25 bp, Mus musculus
caggattggaaaggttccaggatgg

SEQ ID NO: 229845 - DNA, 25 bp, Mus musculus
caggattggaagatcgaagcctgtt

SEQ ID NO: 229846 - DNA, 25 bp, Mus musculus
caggattgggaagaaaaagaagagg

SEQ ID NO: 229847 - DNA, 25 bp, Mus musculus
caggattgggaagggctcctgtgct

SEQ ID NO: 229848 - DNA, 25 bp, Mus musculus
caggattgtagcctctatcacacgg

SEQ ID NO: 229849 - DNA, 25 bp, Mus musculus
caggattgtggcgacaaataacaaa

SEQ ID NO: 229850 - DNA, 25 bp, Mus musculus
caggattgtggtaacaaataacaaa

SEQ ID NO: 229851 - DNA, 25 bp, Mus musculus
caggatttaaccctgagataccaga

SEQ ID NO: 229852 - DNA, 25 bp, Mus musculus
caggatttcatgtttgagatcagtc

SEQ ID NO: 229853 - DNA, 25 bp, Mus musculus
caggatttctaagcattccatattg

SEQ ID NO: 229854 - DNA, 25 bp, Mus musculus
caggatttctaaggcttcagaagag

SEQ ID NO: 229855 - DNA, 25 bp, Mus musculus
caggatttggagtctgtctccaagg

SEQ ID NO: 229856 - DNA, 25 bp, Mus musculus
caggatttgggagccaaagactctg

SEQ ID NO: 229857 - DNA, 25 bp, Mus musculus
caggatttggggtggtatcacggca

SEQ ID NO: 229858 - DNA, 25 bp, Mus musculus
caggatttgtgaagaaacccccagt

SEQ ID NO: 229859 - DNA, 25 bp, Mus musculus
caggatttgtgaaggtatccgcccc

SEQ ID NO: 229860 - DNA, 25 bp, Mus musculus
caggatttgtgaaggtttcagagga

SEQ ID NO: 229861 - DNA, 25 bp, Mus musculus
caggattttctcacaaacattaacc

SEQ ID NO: 229862 - DNA, 25 bp, Mus musculus
caggattttctcacaataggtgacc

SEQ ID NO: 229863 - DNA, 25 bp, Mus musculus
caggattttctcacatcttggagga

SEQ ID NO: 229864 - DNA, 25 bp, Mus musculus
caggattttctgtgcagcagattta

SEQ ID NO: 229865 - DNA, 25 bp, Mus musculus
caggattttctgtgcctttattgct

SEQ ID NO: 229866 - DNA, 25 bp, Mus musculus
caggcaaaactgagtgaccttcaga

SEQ ID NO: 229867 - DNA, 25 bp, Mus musculus
caggcaaaagcagattttatcatgt

SEQ ID NO: 229868 - DNA, 25 bp, Mus musculus
caggcaaaagtgagtggagctcctc

SEQ ID NO: 229869 - DNA, 25 bp, Mus musculus
caggcaaacaggggcaattattgct

SEQ ID NO: 229870 - DNA, 25 bp, Mus musculus
caggcaaacagggtacctttcacag

SEQ ID NO: 229871 - DNA, 25 bp, Mus musculus
caggcaaagagaaagggaaaaactc

SEQ ID NO: 229872 - DNA, 25 bp, Mus musculus
caggcaaagatacagagtcagggga

SEQ ID NO: 229873 - DNA, 25 bp, Mus musculus
caggcaaaggtgtgccccagctcct

SEQ ID NO: 229874 - DNA, 25 bp, Mus musculus
caggcaacagatcagcacggcccct

SEQ ID NO: 229875 - DNA, 25 bp, Mus musculus
caggcaacatgaaattgatgggaaa

SEQ ID NO: 229876 - DNA, 25 bp, Mus musculus
caggcaacgggggtctctttaggtg

SEQ ID NO: 229877 - DNA, 25 bp, Mus musculus
caggcaactaggaggctggattgtc

SEQ ID NO: 229878 - DNA, 25 bp, Mus musculus
caggcaactagggtttcaactctga

SEQ ID NO: 229879 - DNA, 25 bp, Mus musculus
caggcaactccgagtttgtggggac

SEQ ID NO: 229880 - DNA, 25 bp, Mus musculus
caggcaagaaccggagacaatcagg

SEQ ID NO: 229881 - DNA, 25 bp, Mus musculus
caggcaagaaccgttctcaagaacc

SEQ ID NO: 229882 - DNA, 25 bp, Mus musculus
caggcaagcagctccagtcagtctc

SEQ ID NO: 229883 - DNA, 25 bp, Mus musculus
caggcaaggcgggcatctcctccca

SEQ ID NO: 229884 - DNA, 25 bp, Mus musculus
caggcaaggcgttcacagacgagga

SEQ ID NO: 229885 - DNA, 25 bp, Mus musculus
caggcaagtggaggatccattttct

SEQ ID NO: 229886 - DNA, 25 bp, Mus musculus
caggcaagttaactgctcttcaggg

SEQ ID NO: 229887 - DNA, 25 bp, Mus musculus
caggcaattctagtggctgcggctt

SEQ ID NO: 229888 - DNA, 25 bp, Mus musculus
caggcacaagcctccattgagggcg

SEQ ID NO: 229889 - DNA, 25 bp, Mus musculus
caggcacaccagggcaccctcagat

SEQ ID NO: 229890 - DNA, 25 bp, Mus musculus
caggcacacgcaggtgcctcctcct

SEQ ID NO: 229891 - DNA, 25 bp, Mus musculus
caggcacagcaggagatagggtttc

SEQ ID NO: 229892 - DNA, 25 bp, Mus musculus
caggcacagcaggagttcaagaacg

SEQ ID NO: 229893 - DNA, 25 bp, Mus musculus
caggcaccagaaacctcatccagct

SEQ ID NO: 229894 - DNA, 25 bp, Mus musculus
caggcaccagccagtaagtgctccc

SEQ ID NO: 229895 - DNA, 25 bp, Mus musculus
caggcaccagcgcagggaatggata

SEQ ID NO: 229896 - DNA, 25 bp, Mus musculus
caggcaccaggcaccaacagagaga

SEQ ID NO: 229897 - DNA, 25 bp, Mus musculus
caggcaccaggtcctgtttattgct

SEQ ID NO: 229898 - DNA, 25 bp, Mus musculus
caggcaccaggttcctccaacaccg

SEQ ID NO: 229899 - DNA, 25 bp, Mus musculus
caggcaccaggttgctccaggacct

SEQ ID NO: 229900 - DNA, 25 bp, Mus musculus
caggcaccagtacagaaagcaagct

SEQ ID NO: 229901 - DNA, 25 bp, Mus musculus
caggcaccagtcttggaggaggaac

SEQ ID NO: 229902 - DNA, 25 bp, Mus musculus
caggcaccagtgtgtccattgtcca

SEQ ID NO: 229903 - DNA, 25 bp, Mus musculus
caggcaccatgggaccctctagagt

SEQ ID NO: 229904 - DNA, 25 bp, Mus musculus
caggcaccatggggtgcagggaagg

SEQ ID NO: 229905 - DNA, 25 bp, Mus musculus
caggcacccagagttttgctctgca

SEQ ID NO: 229906 - DNA, 25 bp, Mus musculus
caggcacccatggctcaaactacca

SEQ ID NO: 229907 - DNA, 25 bp, Mus musculus
caggcaccgcaaatgagagtcagtc

SEQ ID NO: 229908 - DNA, 25 bp, Mus musculus
caggcacgagctgcaggtcctggtg

SEQ ID NO: 229909 - DNA, 25 bp, Mus musculus
caggcacgcagggcagaagtcgtgt

SEQ ID NO: 229910 - DNA, 25 bp, Mus musculus
caggcactcaaatgaacatggttgg

SEQ ID NO: 229911 - DNA, 25 bp, Mus musculus
caggcactcagagaatgggacaccc

SEQ ID NO: 229912 - DNA, 25 bp, Mus musculus
caggcactcagtttttcagttctac

SEQ ID NO: 229913 - DNA, 25 bp, Mus musculus
caggcactcggggtcctgagaagca

SEQ ID NO: 229914 - DNA, 25 bp, Mus musculus
caggcactgaagtggactgcctgcg

SEQ ID NO: 229915 - DNA, 25 bp, Mus musculus
caggcacttaaggaaattggggatg

SEQ ID NO: 229916 - DNA, 25 bp, Mus musculus
caggcagaacgaggcaaagacaaga

SEQ ID NO: 229917 - DNA, 25 bp, Mus musculus
caggcagaagctgggaagtcatcaa

SEQ ID NO: 229918 - DNA, 25 bp, Mus musculus
caggcagaaggcaaggttcggctcc

SEQ ID NO: 229919 - DNA, 25 bp, Mus musculus
caggcagaaggcgacagacttatta

SEQ ID NO: 229920 - DNA, 25 bp, Mus musculus
caggcagacgatgttgaatgacaaa

SEQ ID NO: 229921 - DNA, 25 bp, Mus musculus
caggcagagacgatagattgctaac

SEQ ID NO: 229922 - DNA, 25 bp, Mus musculus
caggcagagctggaaaaggtgcagc

SEQ ID NO: 229923 - DNA, 25 bp, Mus musculus
caggcagagctggcaccagaaacca

SEQ ID NO: 229924 - DNA, 25 bp, Mus musculus
caggcagatacaacagcacaaccag

SEQ ID NO: 229925 - DNA, 25 bp, Mus musculus
caggcagatgatgtgtgttaaagga

SEQ ID NO: 229926 - DNA, 25 bp, Mus musculus
caggcagatgcccgacactccagaa

SEQ ID NO: 229927 - DNA, 25 bp, Mus musculus
caggcagatgcccggatgctgatgt

SEQ ID NO: 229928 - DNA, 25 bp, Mus musculus
caggcagatttaagattattaaaaa

SEQ ID NO: 229929 - DNA, 25 bp, Mus musculus
caggcagcaaaaggtctccatagaa

SEQ ID NO: 229930 - DNA, 25 bp, Mus musculus
caggcagcagctccggtctgatatc

SEQ ID NO: 229931 - DNA, 25 bp, Mus musculus
caggcagcattagaggagctgacca

SEQ ID NO: 229932 - DNA, 25 bp, Mus musculus
caggcagccagcccagtgggcagcg

SEQ ID NO: 229933 - DNA, 25 bp, Mus musculus
caggcagccggggcgagaagggtac

SEQ ID NO: 229934 - DNA, 25 bp, Mus musculus
caggcagctccaggtataatggccg

SEQ ID NO: 229935 - DNA, 25 bp, Mus musculus
caggcagctgggtaccgggtgctgc

SEQ ID NO: 229936 - DNA, 25 bp, Mus musculus
caggcagcttattgatgtcctcgaa

SEQ ID NO: 229937 - DNA, 25 bp, Mus musculus
caggcagcttgatcagtggaccatc

SEQ ID NO: 229938 - DNA, 25 bp, Mus musculus
caggcagcttggaggaagagtcact

SEQ ID NO: 229939 - DNA, 25 bp, Mus musculus
caggcaggacaagaaggcaaattag

SEQ ID NO: 229940 - DNA, 25 bp, Mus musculus
caggcaggagctgctttttaaattg

SEQ ID NO: 229941 - DNA, 25 bp, Mus musculus
caggcaggaggtggtggagttgttg

SEQ ID NO: 229942 - DNA, 25 bp, Mus musculus
caggcaggcagattgaccttggccc

SEQ ID NO: 229943 - DNA, 25 bp, Mus musculus
caggcaggctaggttcctccggttt

SEQ ID NO: 229944 - DNA, 25 bp, Mus musculus
caggcaggggggacctgaaccacga

SEQ ID NO: 229945 - DNA, 25 bp, Mus musculus
caggcagtcagagaatttaagaagt

SEQ ID NO: 229946 - DNA, 25 bp, Mus musculus
caggcagtcagagatttgattgagc

SEQ ID NO: 229947 - DNA, 25 bp, Mus musculus
caggcagtctctgggttcagacaat

SEQ ID NO: 229948 - DNA, 25 bp, Mus musculus
caggcagtgaaggaccgtgcaggca

SEQ ID NO: 229949 - DNA, 25 bp, Mus musculus
caggcagtgaaggcccttgctgctg

SEQ ID NO: 229950 - DNA, 25 bp, Mus musculus
caggcagtgagatgtccctagacat

SEQ ID NO: 229951 - DNA, 25 bp, Mus musculus
caggcagtgtccccaccttcaaaca

SEQ ID NO: 229952 - DNA, 25 bp, Mus musculus
caggcagttaaagaggtgaactgcc

SEQ ID NO: 229953 - DNA, 25 bp, Mus musculus
caggcagttcaaggcaataaaagcg

SEQ ID NO: 229954 - DNA, 25 bp, Mus musculus
caggcagttcaagggctaacttaaa

SEQ ID NO: 229955 - DNA, 25 bp, Mus musculus
caggcatacaggcaaagcgagtgga

SEQ ID NO: 229956 - DNA, 25 bp, Mus musculus
caggcatacaggcctagctctgcta

SEQ ID NO: 229957 - DNA, 25 bp, Mus musculus
caggcataccaggctccagaaatgt

SEQ ID NO: 229958 - DNA, 25 bp, Mus musculus
caggcatagtggagtcccagaggca

SEQ ID NO: 229959 - DNA, 25 bp, Mus musculus
caggcatatgcttccttggggactg

SEQ ID NO: 229960 - DNA, 25 bp, Mus musculus
caggcatatgcttcggagactcggg

SEQ ID NO: 229961 - DNA, 25 bp, Mus musculus
caggcatattttggaaaccagtaaa

SEQ ID NO: 229962 - DNA, 25 bp, Mus musculus
caggcatattttggttcttcatgct

SEQ ID NO: 229963 - DNA, 25 bp, Mus musculus
caggcatcaagcacggcacagtttg

SEQ ID NO: 229964 - DNA, 25 bp, Mus musculus
caggcatcaatgctgttttctacta

SEQ ID NO: 229965 - DNA, 25 bp, Mus musculus
caggcatcacagagctctgcaggtc

SEQ ID NO: 229966 - DNA, 25 bp, Mus musculus
caggcatcacatgaccagtggctgc

SEQ ID NO: 229967 - DNA, 25 bp, Mus musculus
caggcatccaagagcaactggtggt

SEQ ID NO: 229968 - DNA, 25 bp, Mus musculus
caggcatccaagcaagcgaagatgt

SEQ ID NO: 229969 - DNA, 25 bp, Mus musculus
caggcatccaagcatttgtggtcct

SEQ ID NO: 229970 - DNA, 25 bp, Mus musculus
caggcatccagggccttttgctcga

SEQ ID NO: 229971 - DNA, 25 bp, Mus musculus
caggcatccagtgagctgcttatca

SEQ ID NO: 229972 - DNA, 25 bp, Mus musculus
caggcatccgggtgatcatggtgac

SEQ ID NO: 229973 - DNA, 25 bp, Mus musculus
caggcatcctggtcatttgaagact

SEQ ID NO: 229974 - DNA, 25 bp, Mus musculus
caggcatctctcccttctgcatgca

SEQ ID NO: 229975 - DNA, 25 bp, Mus musculus
caggcatgaactatgaagatgactg

SEQ ID NO: 229976 - DNA, 25 bp, Mus musculus
caggcatgacaggagctggagaagc

SEQ ID NO: 229977 - DNA, 25 bp, Mus musculus
caggcatgaggggccataaaggggc

SEQ ID NO: 229978 - DNA, 25 bp, Mus musculus
caggcatgaggtgttctggctgatg

SEQ ID NO: 229979 - DNA, 25 bp, Mus musculus
caggcatgagtggagccagagaaca

SEQ ID NO: 229980 - DNA, 25 bp, Mus musculus
caggcatgcagtaaaggccaaaaat

SEQ ID NO: 229981 - DNA, 25 bp, Mus musculus
caggcatgctccctgacctcagctc

SEQ ID NO: 229982 - DNA, 25 bp, Mus musculus
caggcatggattcagaaaattaatg

SEQ ID NO: 229983 - DNA, 25 bp, Mus musculus
caggcatggtttggatttgcgggaa

SEQ ID NO: 229984 - DNA, 25 bp, Mus musculus
caggcatgttggaagttcccatggc

SEQ ID NO: 229985 - DNA, 25 bp, Mus musculus
caggcattcatgcggaaagacgtgc

SEQ ID NO: 229986 - DNA, 25 bp, Mus musculus
caggcattcatgcggatgcgttttg

SEQ ID NO: 229987 - DNA, 25 bp, Mus musculus
caggcattgacccttcttggagctt

SEQ ID NO: 229988 - DNA, 25 bp, Mus musculus
caggcattgaccgctcatcctaaag

SEQ ID NO: 229989 - DNA, 25 bp, Mus musculus
caggcattgtggactctagaaaaag

SEQ ID NO: 229990 - DNA, 25 bp, Mus musculus
caggcattgtggattatcagactct

SEQ ID NO: 229991 - DNA, 25 bp, Mus musculus
caggccaaactcaaggaccaggcag

SEQ ID NO: 229992 - DNA, 25 bp, Mus musculus
caggccaaactcaagttttggcaag

SEQ ID NO: 229993 - DNA, 25 bp, Mus musculus
caggccaaagattatttgtataact

SEQ ID NO: 229994 - DNA, 25 bp, Mus musculus
caggccaacaaggtacgcacgcggt

SEQ ID NO: 229995 - DNA, 25 bp, Mus musculus
caggccaagaagggggatggaaatc

SEQ ID NO: 229996 - DNA, 25 bp, Mus musculus
caggccaagacatgcccggaaccgc

SEQ ID NO: 229997 - DNA, 25 bp, Mus musculus
caggccaagacgcccacagattaaa

SEQ ID NO: 229998 - DNA, 25 bp, Mus musculus
caggccaagactaaggggtccccag

SEQ ID NO: 229999 - DNA, 25 bp, Mus musculus
caggccaagcaggcttgtgatgcct

SEQ ID NO: 230000 - DNA, 25 bp, Mus musculus
caggccaattgttcctgtaccaggc

SEQ ID NO: 230001 - DNA, 25 bp, Mus musculus
caggccacaggaaagcacagacaac

SEQ ID NO: 230002 - DNA, 25 bp, Mus musculus
caggccacaggcaatgtgagcatct

SEQ ID NO: 230003 - DNA, 25 bp, Mus musculus
caggccaccaaccagattctcagcc

SEQ ID NO: 230004 - DNA, 25 bp, Mus musculus
caggccaccccttaaatgtaggtat

SEQ ID NO: 230005 - DNA, 25 bp, Mus musculus
caggccaccccttcctgcaaggcca

SEQ ID NO: 230006 - DNA, 25 bp, Mus musculus
caggccaccggacagcattcacaac

SEQ ID NO: 230007 - DNA, 25 bp, Mus musculus
caggccaccggacagcccaacggta

SEQ ID NO: 230008 - DNA, 25 bp, Mus musculus
caggccacctcgggcaaggtggctg

SEQ ID NO: 230009 - DNA, 25 bp, Mus musculus
caggccacgccagagtttctcagga

SEQ ID NO: 230010 - DNA, 25 bp, Mus musculus
caggccactcaggatcggaacgtca

SEQ ID NO: 230011 - DNA, 25 bp, Mus musculus
caggccactgagtcttctggccgaa

SEQ ID NO: 230012 - DNA, 25 bp, Mus musculus
caggccagaaatcacaaacttcgtg

SEQ ID NO: 230013 - DNA, 25 bp, Mus musculus
caggccagagcagagaggaggtgga

SEQ ID NO: 230014 - DNA, 25 bp, Mus musculus
caggccagatattcagaaaccctga

SEQ ID NO: 230015 - DNA, 25 bp, Mus musculus
caggccagatcaaaaaagggaaaaa

SEQ ID NO: 230016 - DNA, 25 bp, Mus musculus
caggccagcagacacacaacctttt

SEQ ID NO: 230017 - DNA, 25 bp, Mus musculus
caggccagcagccctagctagcatg

SEQ ID NO: 230018 - DNA, 25 bp, Mus musculus
caggccagcagccctgtctccagga

SEQ ID NO: 230019 - DNA, 25 bp, Mus musculus
caggccagcagcttcaccaatcttc

SEQ ID NO: 230020 - DNA, 25 bp, Mus musculus
caggccagcaggtgtacagtgggct

SEQ ID NO: 230021 - DNA, 25 bp, Mus musculus
caggccagcagtgggctctggcaag

SEQ ID NO: 230022 - DNA, 25 bp, Mus musculus
caggccagcttgcttgaaactttgg

SEQ ID NO: 230023 - DNA, 25 bp, Mus musculus
caggccagcttgcttggctgaagcc

SEQ ID NO: 230024 - DNA, 25 bp, Mus musculus
caggccaggagggctcgctcgaaga

SEQ ID NO: 230025 - DNA, 25 bp, Mus musculus
caggccagggaagagagagagagag

SEQ ID NO: 230026 - DNA, 25 bp, Mus musculus
caggccagtaggagttaaagggaat

SEQ ID NO: 230027 - DNA, 25 bp, Mus musculus
caggccagttgggctgtgactcgag

SEQ ID NO: 230028 - DNA, 25 bp, Mus musculus
caggccatcactgacaaaagaaaga

SEQ ID NO: 230029 - DNA, 25 bp, Mus musculus
caggccatcctgggttgctcttctg

SEQ ID NO: 230030 - DNA, 25 bp, Mus musculus
caggccatgatccagagtcaggtgt

SEQ ID NO: 230031 - DNA, 25 bp, Mus musculus
caggccatgtggactggcaggctgt

SEQ ID NO: 230032 - DNA, 25 bp, Mus musculus
caggccatgttactgcacgaccaca

SEQ ID NO: 230033 - DNA, 25 bp, Mus musculus
caggccatgttactggagtgccgat

SEQ ID NO: 230034 - DNA, 25 bp, Mus musculus
caggccattggtgagtatggcccac

SEQ ID NO: 230035 - DNA, 25 bp, Mus musculus
caggccattggtggctatggcccac

SEQ ID NO: 230036 - DNA, 25 bp, Mus musculus
caggccattgtggaaagccccccta

SEQ ID NO: 230037 - DNA, 25 bp, Mus musculus
caggccatttccaagcgcctgagaa

SEQ ID NO: 230038 - DNA, 25 bp, Mus musculus
caggcccaagacatccaggccagcc

SEQ ID NO: 230039 - DNA, 25 bp, Mus musculus
caggcccaagcctccattgagggtg

SEQ ID NO: 230040 - DNA, 25 bp, Mus musculus
caggcccaaggtctccatggtgggt

SEQ ID NO: 230041 - DNA, 25 bp, Mus musculus
caggcccagcagtgcatcctgcctc

SEQ ID NO: 230042 - DNA, 25 bp, Mus musculus
caggcccagccctgctcctgccatg

SEQ ID NO: 230043 - DNA, 25 bp, Mus musculus
caggcccaggaagaaacatgtatca

SEQ ID NO: 230044 - DNA, 25 bp, Mus musculus
caggcccaggaagaagaatgtccct

SEQ ID NO: 230045 - DNA, 25 bp, Mus musculus
caggcccattaaggtgaacctcctc

SEQ ID NO: 230046 - DNA, 25 bp, Mus musculus
caggccccacaggtgccaaaggcgt

SEQ ID NO: 230047 - DNA, 25 bp, Mus musculus
caggccccagctttggtggccccaa

SEQ ID NO: 230048 - DNA, 25 bp, Mus musculus
caggcccccacagccgtgtttgacc

SEQ ID NO: 230049 - DNA, 25 bp, Mus musculus
caggcccccacagtttgtatctact

SEQ ID NO: 230050 - DNA, 25 bp, Mus musculus
caggccccgcaggtcaagacggccc

SEQ ID NO: 230051 - DNA, 25 bp, Mus musculus
caggccccgcccgaggcactagagc

SEQ ID NO: 230052 - DNA, 25 bp, Mus musculus
caggccccggaaggaaaagcgcaat

SEQ ID NO: 230053 - DNA, 25 bp, Mus musculus
caggcccctaccaggcgggatggag

SEQ ID NO: 230054 - DNA, 25 bp, Mus musculus
caggcccctagccaccttctagctg

SEQ ID NO: 230055 - DNA, 25 bp, Mus musculus
caggcccgcctatcaaccgtggcct

SEQ ID NO: 230056 - DNA, 25 bp, Mus musculus
caggcccggaaaaggagtcaggcgg

SEQ ID NO: 230057 - DNA, 25 bp, Mus musculus
caggcccggaagttcctgttcctct

SEQ ID NO: 230058 - DNA, 25 bp, Mus musculus
caggcccggtctccgcccggcagaa

SEQ ID NO: 230059 - DNA, 25 bp, Mus musculus
caggcccggtctccgtttgcagcgg

SEQ ID NO: 230060 - DNA, 25 bp, Mus musculus
caggcccgtatcctgaagctgtttg

SEQ ID NO: 230061 - DNA, 25 bp, Mus musculus
caggcccgtgaccacctctctggcc

SEQ ID NO: 230062 - DNA, 25 bp, Mus musculus
caggccctactgggggtgaacctgg

SEQ ID NO: 230063 - DNA, 25 bp, Mus musculus
caggccctcagtggctcccacagat

SEQ ID NO: 230064 - DNA, 25 bp, Mus musculus
caggccctcagtggtcccctttacc

SEQ ID NO: 230065 - DNA, 25 bp, Mus musculus
caggccctccggaggacctggcgca

SEQ ID NO: 230066 - DNA, 25 bp, Mus musculus
caggccctgccccagctctgggcgt

SEQ ID NO: 230067 - DNA, 25 bp, Mus musculus
caggccctgccccaggtggggaacc

SEQ ID NO: 230068 - DNA, 25 bp, Mus musculus
caggccctgctggagctccaggacc

SEQ ID NO: 230069 - DNA, 25 bp, Mus musculus
caggccctggtaaaagcagaagcag

SEQ ID NO: 230070 - DNA, 25 bp, Mus musculus
caggccctgttggtccccctggaag

SEQ ID NO: 230071 - DNA, 25 bp, Mus musculus
caggcccttcgggagcagatggtga

SEQ ID NO: 230072 - DNA, 25 bp, Mus musculus
caggcccttgcagaaaaaaagatgc

SEQ ID NO: 230073 - DNA, 25 bp, Mus musculus
caggccgaaccagtggctgcagcac

SEQ ID NO: 230074 - DNA, 25 bp, Mus musculus
caggccgagaagttgacctcctcct

SEQ ID NO: 230075 - DNA, 25 bp, Mus musculus
caggccgagaagttgacctcgtcct

SEQ ID NO: 230076 - DNA, 25 bp, Mus musculus
caggccgaggcaagtttccttttag

SEQ ID NO: 230077 - DNA, 25 bp, Mus musculus
caggccgcaggcatcaatacttgtg

SEQ ID NO: 230078 - DNA, 25 bp, Mus musculus
caggccgcaggcctctctgtcccta

SEQ ID NO: 230079 - DNA, 25 bp, Mus musculus
caggccgcattaggaggaagagacc

SEQ ID NO: 230080 - DNA, 25 bp, Mus musculus
caggccgcattgctgctcagaggaa

SEQ ID NO: 230081 - DNA, 25 bp, Mus musculus
caggccgccacagcgtggtgtcctt

SEQ ID NO: 230082 - DNA, 25 bp, Mus musculus
caggccgcggagcaaccgaagaacc

SEQ ID NO: 230083 - DNA, 25 bp, Mus musculus
caggccgctgtctgagcgcaggctg

SEQ ID NO: 230084 - DNA, 25 bp, Mus musculus
caggccggaggctcctgtagtttca

SEQ ID NO: 230085 - DNA, 25 bp, Mus musculus
caggccggcccgcaagctataagcg

SEQ ID NO: 230086 - DNA, 25 bp, Mus musculus
caggccggcccgcagactttgtgtt

SEQ ID NO: 230087 - DNA, 25 bp, Mus musculus
caggccgggaggcccagatggggga

SEQ ID NO: 230088 - DNA, 25 bp, Mus musculus
caggccgggcccgaaccctcttggc

SEQ ID NO: 230089 - DNA, 25 bp, Mus musculus
caggccgggcccgggccaccaagca

SEQ ID NO: 230090 - DNA, 25 bp, Mus musculus
caggccgtacttccgcacctcctct

SEQ ID NO: 230091 - DNA, 25 bp, Mus musculus
caggcctaaaggctttgatgacagt

SEQ ID NO: 230092 - DNA, 25 bp, Mus musculus
caggcctaagcacaggcagcagagc

SEQ ID NO: 230093 - DNA, 25 bp, Mus musculus
caggcctaagtgtccaccatcacag

SEQ ID NO: 230094 - DNA, 25 bp, Mus musculus
caggcctagctcaagtcttttattc

SEQ ID NO: 230095 - DNA, 25 bp, Mus musculus
caggcctaggagatgcaagttgttc

SEQ ID NO: 230096 - DNA, 25 bp, Mus musculus
caggcctaggaggggcgtccaaaga

SEQ ID NO: 230097 - DNA, 25 bp, Mus musculus
caggcctccagttctcccaggcctt

SEQ ID NO: 230098 - DNA, 25 bp, Mus musculus
caggcctccccaggtccccctgact

SEQ ID NO: 230099 - DNA, 25 bp, Mus musculus
caggcctccgaatcacatgggtgtt

SEQ ID NO: 230100 - DNA, 25 bp, Mus musculus
caggcctctgaggccttcttgctaa

SEQ ID NO: 230101 - DNA, 25 bp, Mus musculus
caggcctctggcagagcctgcccca

SEQ ID NO: 230102 - DNA, 25 bp, Mus musculus
caggcctgcagacatttttagccag

SEQ ID NO: 230103 - DNA, 25 bp, Mus musculus
caggcctgcagccaggtgattttgt

SEQ ID NO: 230104 - DNA, 25 bp, Mus musculus
caggcctgcgggtggacaaatcctt

SEQ ID NO: 230105 - DNA, 25 bp, Mus musculus
caggcctgcttacaggaagccgaga

SEQ ID NO: 230106 - DNA, 25 bp, Mus musculus
caggcctggtggatgactatgggct

SEQ ID NO: 230107 - DNA, 25 bp, Mus musculus
caggcctgtcttcagtcccctaacc

SEQ ID NO: 230108 - DNA, 25 bp, Mus musculus
caggcctgtgataagacgctgtccg

SEQ ID NO: 230109 - DNA, 25 bp, Mus musculus
caggcctgtgctcatatgaaatcct

SEQ ID NO: 230110 - DNA, 25 bp, Mus musculus
caggcctgttaagaccactgttccc

SEQ ID NO: 230111 - DNA, 25 bp, Mus musculus
caggccttaaggctgccctgccctc

SEQ ID NO: 230112 - DNA, 25 bp, Mus musculus
caggccttccagggctgaccagttt

SEQ ID NO: 230113 - DNA, 25 bp, Mus musculus
caggccttgggctggagcacccgga

SEQ ID NO: 230114 - DNA, 25 bp, Mus musculus
caggcctttcagagacgaagagagt

SEQ ID NO: 230115 - DNA, 25 bp, Mus musculus
caggcctttgagttgtccagggaag

SEQ ID NO: 230116 - DNA, 25 bp, Mus musculus
caggcctttgctggagcatgttcgg

SEQ ID NO: 230117 - DNA, 25 bp, Mus musculus
caggcctttgggaaggaatgttcct

SEQ ID NO: 230118 - DNA, 25 bp, Mus musculus
caggcgagcgggctaaccattttga

SEQ ID NO: 230119 - DNA, 25 bp, Mus musculus
caggcgatatccgtaaagaacttgt

SEQ ID NO: 230120 - DNA, 25 bp, Mus musculus
caggcgcaagaaaagagaagcagct

SEQ ID NO: 230121 - DNA, 25 bp, Mus musculus
caggcgcatcaggtgaagaagagtc

SEQ ID NO: 230122 - DNA, 25 bp, Mus musculus
caggcgccagggcaaggaggtcaga

SEQ ID NO: 230123 - DNA, 25 bp, Mus musculus
caggcgccgaacagcagcgggcggg

SEQ ID NO: 230124 - DNA, 25 bp, Mus musculus
caggcgcgaccccagctctatttca

SEQ ID NO: 230125 - DNA, 25 bp, Mus musculus
caggcgcgaccccaggaccagctct

SEQ ID NO: 230126 - DNA, 25 bp, Mus musculus
caggcgcgaggagctccagaaatct

SEQ ID NO: 230127 - DNA, 25 bp, Mus musculus
caggcgcgaggttctgcagaccccg

SEQ ID NO: 230128 - DNA, 25 bp, Mus musculus
caggcgcgcagtgaaagccggcggg

SEQ ID NO: 230129 - DNA, 25 bp, Mus musculus
caggcgcgcgagaagctcgcgctgt

SEQ ID NO: 230130 - DNA, 25 bp, Mus musculus
caggcgcggcgggatatgtggtaca

SEQ ID NO: 230131 - DNA, 25 bp, Mus musculus
caggcgcgggaggcggagagtgtca

SEQ ID NO: 230132 - DNA, 25 bp, Mus musculus
caggcgcgggaggcggctctagatg

SEQ ID NO: 230133 - DNA, 25 bp, Mus musculus
caggcgcgggaggcgtacgagatga

SEQ ID NO: 230134 - DNA, 25 bp, Mus musculus
caggcgcggggtgatggcaggagaa

SEQ ID NO: 230135 - DNA, 25 bp, Mus musculus
caggcgcgtcagtgggtacccagaa

SEQ ID NO: 230136 - DNA, 25 bp, Mus musculus
caggcgctagagctagtctacccaa

SEQ ID NO: 230137 - DNA, 25 bp, Mus musculus
caggcgctagaggtgacccttccct

SEQ ID NO: 230138 - DNA, 25 bp, Mus musculus
caggcgctagggtctgggaacgtaa

SEQ ID NO: 230139 - DNA, 25 bp, Mus musculus
caggcgctatgggtcatctgttccg

SEQ ID NO: 230140 - DNA, 25 bp, Mus musculus
caggcgctgtacgaggctccagcat

SEQ ID NO: 230141 - DNA, 25 bp, Mus musculus
caggcgcttgcagaaggggcgccta

SEQ ID NO: 230142 - DNA, 25 bp, Mus musculus
caggcgcttgcaggcatgacgagtg

SEQ ID NO: 230143 - DNA, 25 bp, Mus musculus
caggcggaaagatggcgtaccttct

SEQ ID NO: 230144 - DNA, 25 bp, Mus musculus
caggcggaaagtatccattatgatg

SEQ ID NO: 230145 - DNA, 25 bp, Mus musculus
caggcggagaagtactctcaaaaag

SEQ ID NO: 230146 - DNA, 25 bp, Mus musculus
caggcggagagagcaacttcttcgg

SEQ ID NO: 230147 - DNA, 25 bp, Mus musculus
caggcggatggcacccttatcacat

SEQ ID NO: 230148 - DNA, 25 bp, Mus musculus
caggcggattcgggttcgggagcag

SEQ ID NO: 230149 - DNA, 25 bp, Mus musculus
caggcggcttctgctgcaggagtca

SEQ ID NO: 230150 - DNA, 25 bp, Mus musculus
caggcgggagatgagacgtgacttg

SEQ ID NO: 230151 - DNA, 25 bp, Mus musculus
caggcgggcggtgtatcctcagaga

SEQ ID NO: 230152 - DNA, 25 bp, Mus musculus
caggcgggctgcgtggcattgtcgc

SEQ ID NO: 230153 - DNA, 25 bp, Mus musculus
caggcggggaacggtaatcccgctc

SEQ ID NO: 230154 - DNA, 25 bp, Mus musculus
caggcggggcgcagctgggcaccac

SEQ ID NO: 230155 - DNA, 25 bp, Mus musculus
caggcggtgcgtaaaaaaatatttc

SEQ ID NO: 230156 - DNA, 25 bp, Mus musculus
caggcgtatttcagatgatgacact

SEQ ID NO: 230157 - DNA, 25 bp, Mus musculus
caggcgtccaagctcccagcagcaa

SEQ ID NO: 230158 - DNA, 25 bp, Mus musculus
caggcgtccaaggccatcagctcca

SEQ ID NO: 230159 - DNA, 25 bp, Mus musculus
caggcgtcccaaaaagcctctaaga

SEQ ID NO: 230160 - DNA, 25 bp, Mus musculus
caggcgtcgggattatcgtggccgt

SEQ ID NO: 230161 - DNA, 25 bp, Mus musculus
caggcgtgaggaaactgctgtcatt

SEQ ID NO: 230162 - DNA, 25 bp, Mus musculus
caggcgtggagcagggccgactgat

SEQ ID NO: 230163 - DNA, 25 bp, Mus musculus
caggcgtggcggacccaggcacccc

SEQ ID NO: 230164 - DNA, 25 bp, Mus musculus
caggcgtggggccgcagcctcgtgt

SEQ ID NO: 230165 - DNA, 25 bp, Mus musculus
caggctacaaagaacccaagagatg

SEQ ID NO: 230166 - DNA, 25 bp, Mus musculus
caggctacaggagatcgctctggac

SEQ ID NO: 230167 - DNA, 25 bp, Mus musculus
caggctacatggggttgacctgtag

SEQ ID NO: 230168 - DNA, 25 bp, Mus musculus
caggctaccggacagctttcttcgg

SEQ ID NO: 230169 - DNA, 25 bp, Mus musculus
caggctacgacgtgctgtgtgcagc

SEQ ID NO: 230170 - DNA, 25 bp, Mus musculus
caggctacgacgtggttgcgcagac

SEQ ID NO: 230171 - DNA, 25 bp, Mus musculus
caggctacgaggaagtaccatttag

SEQ ID NO: 230172 - DNA, 25 bp, Mus musculus
caggctacttctgcgacagtgacag

SEQ ID NO: 230173 - DNA, 25 bp, Mus musculus
caggctacttcttctggatctcttt

SEQ ID NO: 230174 - DNA, 25 bp, Mus musculus
caggctaggtatctccggtttaggc

SEQ ID NO: 230175 - DNA, 25 bp, Mus musculus
caggctataatctggtatgtgtatc

SEQ ID NO: 230176 - DNA, 25 bp, Mus musculus
caggctatcctgaggttgcaggtca

SEQ ID NO: 230177 - DNA, 25 bp, Mus musculus
caggctatgaggtacatccctgagg

SEQ ID NO: 230178 - DNA, 25 bp, Mus musculus
caggctatggagagagtatgctgga

SEQ ID NO: 230179 - DNA, 25 bp, Mus musculus
caggctcaagaaatagccagacaag

SEQ ID NO: 230180 - DNA, 25 bp, Mus musculus
caggctcacaagaaataccattctc

SEQ ID NO: 230181 - DNA, 25 bp, Mus musculus
caggctcacaaggcagaaaaaaaaa

SEQ ID NO: 230182 - DNA, 25 bp, Mus musculus
caggctcacagaagagagctgtgaa

SEQ ID NO: 230183 - DNA, 25 bp, Mus musculus
caggctcacagaaggctgttcattt

SEQ ID NO: 230184 - DNA, 25 bp, Mus musculus
caggctcacgctctcaccactgagg

SEQ ID NO: 230185 - DNA, 25 bp, Mus musculus
caggctcagagatgggcccagtgca

SEQ ID NO: 230186 - DNA, 25 bp, Mus musculus
caggctcagctacaggctcagaaag

SEQ ID NO: 230187 - DNA, 25 bp, Mus musculus
caggctcaggccaccccacatcatg

SEQ ID NO: 230188 - DNA, 25 bp, Mus musculus
caggctcaggctaccgagtctattg

SEQ ID NO: 230189 - DNA, 25 bp, Mus musculus
caggctccacagattgcagcccggg

SEQ ID NO: 230190 - DNA, 25 bp, Mus musculus
caggctccacggcaatagacccagt

SEQ ID NO: 230191 - DNA, 25 bp, Mus musculus
caggctccagaatggagctgcgacc

SEQ ID NO: 230192 - DNA, 25 bp, Mus musculus
caggctccagatgatgagaagctgt

SEQ ID NO: 230193 - DNA, 25 bp, Mus musculus
caggctccagatgctgtggccagcg

SEQ ID NO: 230194 - DNA, 25 bp, Mus musculus
caggctccaggctgttggaaagcct

SEQ ID NO: 230195 - DNA, 25 bp, Mus musculus
caggctccaggtacacctggtgagc

SEQ ID NO: 230196 - DNA, 25 bp, Mus musculus
caggctccagtctttcaccccttca

SEQ ID NO: 230197 - DNA, 25 bp, Mus musculus
caggctcccgagggatcatgcctgg

SEQ ID NO: 230198 - DNA, 25 bp, Mus musculus
caggctccgtcaagcccccggaagc

SEQ ID NO: 230199 - DNA, 25 bp, Mus musculus
caggctcctccagatgtcaacttgt

SEQ ID NO: 230200 - DNA, 25 bp, Mus musculus
caggctcctgagcgcagccttgggt

SEQ ID NO: 230201 - DNA, 25 bp, Mus musculus
caggctcctggccaggagcaagacc

SEQ ID NO: 230202 - DNA, 25 bp, Mus musculus
caggctcgagcagagtccgtctccc

SEQ ID NO: 230203 - DNA, 25 bp, Mus musculus
caggctcgccaggctggaacgcttt

SEQ ID NO: 230204 - DNA, 25 bp, Mus musculus
caggctcgccagggaagtctactga

SEQ ID NO: 230205 - DNA, 25 bp, Mus musculus
caggctcgccagggtggctgtctgc

SEQ ID NO: 230206 - DNA, 25 bp, Mus musculus
caggctcgcgctgacgcagtatgag

SEQ ID NO: 230207 - DNA, 25 bp, Mus musculus
caggctcgcgctgggtgcatgtacc

SEQ ID NO: 230208 - DNA, 25 bp, Mus musculus
caggctcgcgctgtatttcagggtg

SEQ ID NO: 230209 - DNA, 25 bp, Mus musculus
caggctcggaaacgaatacctccac

SEQ ID NO: 230210 - DNA, 25 bp, Mus musculus
caggctcggaagaaattgataatta

SEQ ID NO: 230211 - DNA, 25 bp, Mus musculus
caggctcgggaaaagttagctttat

SEQ ID NO: 230212 - DNA, 25 bp, Mus musculus
caggctcgggggctgcccctggaga

SEQ ID NO: 230213 - DNA, 25 bp, Mus musculus
caggctcggggggaaagaggaggag

SEQ ID NO: 230214 - DNA, 25 bp, Mus musculus
caggctctcattgaggcttatgtaa

SEQ ID NO: 230215 - DNA, 25 bp, Mus musculus
caggctctccaaaagtaaagcaccg

SEQ ID NO: 230216 - DNA, 25 bp, Mus musculus
caggctctctgaccgggactttgaa

SEQ ID NO: 230217 - DNA, 25 bp, Mus musculus
caggctctgggagttggaaccctgt

SEQ ID NO: 230218 - DNA, 25 bp, Mus musculus
caggctctgtctaggtatcttttgg

SEQ ID NO: 230219 - DNA, 25 bp, Mus musculus
caggctctgtgatcgtggccttcaa

SEQ ID NO: 230220 - DNA, 25 bp, Mus musculus
caggctctgttgctaacggacatgg

SEQ ID NO: 230221 - DNA, 25 bp, Mus musculus
caggctcttgggtgacaattggtgc

SEQ ID NO: 230222 - DNA, 25 bp, Mus musculus
caggctgaaagtttggcttttcatg

SEQ ID NO: 230223 - DNA, 25 bp, Mus musculus
caggctgacaaggcccttttagcta

SEQ ID NO: 230224 - DNA, 25 bp, Mus musculus
caggctgacattgattctgggctga

SEQ ID NO: 230225 - DNA, 25 bp, Mus musculus
caggctgacgggtatcaccacagct

SEQ ID NO: 230226 - DNA, 25 bp, Mus musculus
caggctgagaagtactctcagaagg

SEQ ID NO: 230227 - DNA, 25 bp, Mus musculus
caggctgagcagaagggccttcttg

SEQ ID NO: 230228 - DNA, 25 bp, Mus musculus
caggctgaggagggaggagcaggcc

SEQ ID NO: 230229 - DNA, 25 bp, Mus musculus
caggctgagtgtttatcatggcttc

SEQ ID NO: 230230 - DNA, 25 bp, Mus musculus
caggctgatggcagcctctccaggc

SEQ ID NO: 230231 - DNA, 25 bp, Mus musculus
caggctgcaatgaggtcaactccgt

SEQ ID NO: 230232 - DNA, 25 bp, Mus musculus
caggctgcactcagaaccattgttg

SEQ ID NO: 230233 - DNA, 25 bp, Mus musculus
caggctgcactcagctgccaactcc

SEQ ID NO: 230234 - DNA, 25 bp, Mus musculus
caggctgcagctgcccaggccaagc

SEQ ID NO: 230235 - DNA, 25 bp, Mus musculus
caggctgcaggagctcttagggaag

SEQ ID NO: 230236 - DNA, 25 bp, Mus musculus
caggctgcaggcctgtgggccgaag

SEQ ID NO: 230237 - DNA, 25 bp, Mus musculus
caggctgcaggtaactagttctccc

SEQ ID NO: 230238 - DNA, 25 bp, Mus musculus
caggctgcctcgaatcttaggtgcc

SEQ ID NO: 230239 - DNA, 25 bp, Mus musculus
caggctgcgctgaggctccagcctt

SEQ ID NO: 230240 - DNA, 25 bp, Mus musculus
caggctgctcccagcgtttcccaac

SEQ ID NO: 230241 - DNA, 25 bp, Mus musculus
caggctgctgcgagtctgttgctgt

SEQ ID NO: 230242 - DNA, 25 bp, Mus musculus
caggctgctggccagggtttaacgt

SEQ ID NO: 230243 - DNA, 25 bp, Mus musculus
caggctggaaaggagctggaggaac

SEQ ID NO: 230244 - DNA, 25 bp, Mus musculus
caggctggagtgacgagtatctgtc

SEQ ID NO: 230245 - DNA, 25 bp, Mus musculus
caggctggatacagttaccagtaag

SEQ ID NO: 230246 - DNA, 25 bp, Mus musculus
caggctggatgaccggttctaatca

SEQ ID NO: 230247 - DNA, 25 bp, Mus musculus
caggctggcaaggtcaaacctgcga

SEQ ID NO: 230248 - DNA, 25 bp, Mus musculus
caggctggcaggaaccacacagagc

SEQ ID NO: 230249 - DNA, 25 bp, Mus musculus
caggctggcaggtgctcaccgagtc

SEQ ID NO: 230250 - DNA, 25 bp, Mus musculus
caggctggcatgaaatcctggggca

SEQ ID NO: 230251 - DNA, 25 bp, Mus musculus
caggctggccctctggtgtgccaca

SEQ ID NO: 230252 - DNA, 25 bp, Mus musculus
caggctggctcagaggtgtctgcct

SEQ ID NO: 230253 - DNA, 25 bp, Mus musculus
caggctggggaagaccttgcacttg

SEQ ID NO: 230254 - DNA, 25 bp, Mus musculus
caggctggtaaaggagagaatgaag

SEQ ID NO: 230255 - DNA, 25 bp, Mus musculus
caggctggtggaggaacatggccac

SEQ ID NO: 230256 - DNA, 25 bp, Mus musculus
caggctgtatgggtctgacagaagt

SEQ ID NO: 230257 - DNA, 25 bp, Mus musculus
caggctgtcaaaggggagaagctgc

SEQ ID NO: 230258 - DNA, 25 bp, Mus musculus
caggctgtcagaaaaagatgcaaga

SEQ ID NO: 230259 - DNA, 25 bp, Mus musculus
caggctgtcagatttatgcaggact

SEQ ID NO: 230260 - DNA, 25 bp, Mus musculus
caggctgtcagctcgttcgtgtctt

SEQ ID NO: 230261 - DNA, 25 bp, Mus musculus
caggctgtcaggcagaatgggctta

SEQ ID NO: 230262 - DNA, 25 bp, Mus musculus
caggctgtcagtctagtctcctgag

SEQ ID NO: 230263 - DNA, 25 bp, Mus musculus
caggctgtgaaagctgtccagcaga

SEQ ID NO: 230264 - DNA, 25 bp, Mus musculus
caggctgtgaatgaaataatagcta

SEQ ID NO: 230265 - DNA, 25 bp, Mus musculus
caggctgtgagatatctgtttcaaa

SEQ ID NO: 230266 - DNA, 25 bp, Mus musculus
caggctgtggggtccctggctcctg

SEQ ID NO: 230267 - DNA, 25 bp, Mus musculus
caggctgtgggtcctcccaggaagg

SEQ ID NO: 230268 - DNA, 25 bp, Mus musculus
caggctgttcagaaggctgtgggct

SEQ ID NO: 230269 - DNA, 25 bp, Mus musculus
caggctgttcagagtcatgcagttg

SEQ ID NO: 230270 - DNA, 25 bp, Mus musculus
caggctgttcaggtcctgctctccc

SEQ ID NO: 230271 - DNA, 25 bp, Mus musculus
caggcttaaagggtatgtccctgaa

SEQ ID NO: 230272 - DNA, 25 bp, Mus musculus
caggcttaacagagccatcgtgact

SEQ ID NO: 230273 - DNA, 25 bp, Mus musculus
caggcttaatatcagaaaggaacat

SEQ ID NO: 230274 - DNA, 25 bp, Mus musculus
caggcttaatatgagaaaggaacat

SEQ ID NO: 230275 - DNA, 25 bp, Mus musculus
caggcttactcagactctaaggagg

SEQ ID NO: 230276 - DNA, 25 bp, Mus musculus
caggcttcaagcaagtaaaggccgg

SEQ ID NO: 230277 - DNA, 25 bp, Mus musculus
caggcttcaagccagaagcctgcct

SEQ ID NO: 230278 - DNA, 25 bp, Mus musculus
caggcttcaccccaggagaaagaaa

SEQ ID NO: 230279 - DNA, 25 bp, Mus musculus
caggcttcaccccaggtgaacacct

SEQ ID NO: 230280 - DNA, 25 bp, Mus musculus
caggcttcaccccaggtttgtatgg

SEQ ID NO: 230281 - DNA, 25 bp, Mus musculus
caggcttcaggaagtgtgccatgat

SEQ ID NO: 230282 - DNA, 25 bp, Mus musculus
caggcttcaggtgcaggtcctgcca

SEQ ID NO: 230283 - DNA, 25 bp, Mus musculus
caggcttcctggtagtcccatatta

SEQ ID NO: 230284 - DNA, 25 bp, Mus musculus
caggcttcgagaacgaagaaagaaa

SEQ ID NO: 230285 - DNA, 25 bp, Mus musculus
caggcttcgagaacgtgactacgag

SEQ ID NO: 230286 - DNA, 25 bp, Mus musculus
caggcttcgtggcgaagcagcagga

SEQ ID NO: 230287 - DNA, 25 bp, Mus musculus
caggcttcgtggcgatcaagaagaa

SEQ ID NO: 230288 - DNA, 25 bp, Mus musculus
caggcttctagggacagaacaacag

SEQ ID NO: 230289 - DNA, 25 bp, Mus musculus
caggcttctctgcaagagctgtggg

SEQ ID NO: 230290 - DNA, 25 bp, Mus musculus
caggcttgaaacagccgctgcagga

SEQ ID NO: 230291 - DNA, 25 bp, Mus musculus
caggcttgaaacaggccggtagtgg

SEQ ID NO: 230292 - DNA, 25 bp, Mus musculus
caggcttgcctccggaggtgtatgc

SEQ ID NO: 230293 - DNA, 25 bp, Mus musculus
caggcttggtgtctggatgatgcat

SEQ ID NO: 230294 - DNA, 25 bp, Mus musculus
caggctttccccaggccctccatga

SEQ ID NO: 230295 - DNA, 25 bp, Mus musculus
caggctttctaatagcagcgtcccc

SEQ ID NO: 230296 - DNA, 25 bp, Mus musculus
caggctttggaggaagtggccagat

SEQ ID NO: 230297 - DNA, 25 bp, Mus musculus
caggctttggagtaggccagactcc

SEQ ID NO: 230298 - DNA, 25 bp, Mus musculus
caggcttttgagagctgtctctctt

SEQ ID NO: 230299 - DNA, 25 bp, Mus musculus
caggctttttcccaggcttggattt

SEQ ID NO: 230300 - DNA, 25 bp, Mus musculus
cagggaaaactgtccggccaggtat

SEQ ID NO: 230301 - DNA, 25 bp, Mus musculus
cagggaaaagcacagagctgatgag

SEQ ID NO: 230302 - DNA, 25 bp, Mus musculus
cagggaaaaggaacaccatggacgc

SEQ ID NO: 230303 - DNA, 25 bp, Mus musculus
cagggaaaaggtacaactgatgaga

SEQ ID NO: 230304 - DNA, 25 bp, Mus musculus
cagggaaaaggtcattaaaggggca

SEQ ID NO: 230305 - DNA, 25 bp, Mus musculus
cagggaaacacagaaatatgccgag

SEQ ID NO: 230306 - DNA, 25 bp, Mus musculus
cagggaaaccataacgtcaaactcc

SEQ ID NO: 230307 - DNA, 25 bp, Mus musculus
cagggaaactgggatctgttggcag

SEQ ID NO: 230308 - DNA, 25 bp, Mus musculus
cagggaaagcagctgcagaggcatt

SEQ ID NO: 230309 - DNA, 25 bp, Mus musculus
cagggaaagcagctggtcaaccctc

SEQ ID NO: 230310 - DNA, 25 bp, Mus musculus
cagggaaatacagttattcatggtg

SEQ ID NO: 230311 - DNA, 25 bp, Mus musculus
cagggaaatcaaggaacttaatgag

SEQ ID NO: 230312 - DNA, 25 bp, Mus musculus
cagggaaatcaaggactcgctggcc

SEQ ID NO: 230313 - DNA, 25 bp, Mus musculus
cagggaaatggaaacacttgcagaa

SEQ ID NO: 230314 - DNA, 25 bp, Mus musculus
cagggaaatggaaagtccctgacag

SEQ ID NO: 230315 - DNA, 25 bp, Mus musculus
cagggaacaagcccaggactgtggc

SEQ ID NO: 230316 - DNA, 25 bp, Mus musculus
cagggaacaaggtcagtgacatcaa

SEQ ID NO: 230317 - DNA, 25 bp, Mus musculus
cagggaacacagagcagctgcagga

SEQ ID NO: 230318 - DNA, 25 bp, Mus musculus
cagggaacacagagttcttcttgct

SEQ ID NO: 230319 - DNA, 25 bp, Mus musculus
cagggaacacttgggggagaagcga

SEQ ID NO: 230320 - DNA, 25 bp, Mus musculus
cagggaacagccaggaggatgttgg

SEQ ID NO: 230321 - DNA, 25 bp, Mus musculus
cagggaaccaggatgagattctggt

SEQ ID NO: 230322 - DNA, 25 bp, Mus musculus
cagggaacccaagcaccccttggga

SEQ ID NO: 230323 - DNA, 25 bp, Mus musculus
cagggaacgccaattctaacggcaa

SEQ ID NO: 230324 - DNA, 25 bp, Mus musculus
cagggaacgcctcgggggtgtctga

SEQ ID NO: 230325 - DNA, 25 bp, Mus musculus
cagggaacggcaggccgatctgtcc

SEQ ID NO: 230326 - DNA, 25 bp, Mus musculus
cagggaagagaataggagaaagcat

SEQ ID NO: 230327 - DNA, 25 bp, Mus musculus
cagggaagagagagagagagagaga

SEQ ID NO: 230328 - DNA, 25 bp, Mus musculus
cagggaagccagggtctttgtgaac

SEQ ID NO: 230329 - DNA, 25 bp, Mus musculus
cagggaaggcttgccactttcctaa

SEQ ID NO: 230330 - DNA, 25 bp, Mus musculus
cagggaagtaggctgaaccttcggg

SEQ ID NO: 230331 - DNA, 25 bp, Mus musculus
cagggaagttaggcacaatcacttc

SEQ ID NO: 230332 - DNA, 25 bp, Mus musculus
cagggaataagcagcctcaaaatgc

SEQ ID NO: 230333 - DNA, 25 bp, Mus musculus
cagggaatggactatttgcatgcaa

SEQ ID NO: 230334 - DNA, 25 bp, Mus musculus
cagggaatgtgagatacctttatca

SEQ ID NO: 230335 - DNA, 25 bp, Mus musculus
cagggacaatttaagaccctgctca

SEQ ID NO: 230336 - DNA, 25 bp, Mus musculus
cagggacaatttaagccacaagatc

SEQ ID NO: 230337 - DNA, 25 bp, Mus musculus
cagggacacatgcagaaaagtaaag

SEQ ID NO: 230338 - DNA, 25 bp, Mus musculus
cagggacacatgcagctggtgaatg

SEQ ID NO: 230339 - DNA, 25 bp, Mus musculus
cagggacacatgcaggcgcatacct

SEQ ID NO: 230340 - DNA, 25 bp, Mus musculus
cagggacactttacagggagactcc

SEQ ID NO: 230341 - DNA, 25 bp, Mus musculus
cagggacaggccttgccagagccat

SEQ ID NO: 230342 - DNA, 25 bp, Mus musculus
cagggacagggtcagctggtcactt

SEQ ID NO: 230343 - DNA, 25 bp, Mus musculus
cagggacatcagttccagacacgag

SEQ ID NO: 230344 - DNA, 25 bp, Mus musculus
cagggacattccttatcataacaga

SEQ ID NO: 230345 - DNA, 25 bp, Mus musculus
cagggaccactgagaggcctacgtg

SEQ ID NO: 230346 - DNA, 25 bp, Mus musculus
cagggaccactgagcctgagcagat

SEQ ID NO: 230347 - DNA, 25 bp, Mus musculus
cagggaccagcctgcactggatggc

SEQ ID NO: 230348 - DNA, 25 bp, Mus musculus
cagggaccagtagaacaacagttac

SEQ ID NO: 230349 - DNA, 25 bp, Mus musculus
cagggaccatggagaccatagtctg

SEQ ID NO: 230350 - DNA, 25 bp, Mus musculus
cagggaccatggaggtgtgtgtaca

SEQ ID NO: 230351 - DNA, 25 bp, Mus musculus
cagggacccagaagatgatttttga

SEQ ID NO: 230352 - DNA, 25 bp, Mus musculus
cagggaccccactgaggcttctcaa

SEQ ID NO: 230353 - DNA, 25 bp, Mus musculus
cagggaccccactgcactgctgtta

SEQ ID NO: 230354 - DNA, 25 bp, Mus musculus
cagggacctgaagcctgagaatttg

SEQ ID NO: 230355 - DNA, 25 bp, Mus musculus
cagggacctgagggtacagtcctca

SEQ ID NO: 230356 - DNA, 25 bp, Mus musculus
cagggacgaaaggagtctgagggtg

SEQ ID NO: 230357 - DNA, 25 bp, Mus musculus
cagggacgcgcggtgagccccaggt

SEQ ID NO: 230358 - DNA, 25 bp, Mus musculus
cagggactaagcccacaggagtttt

SEQ ID NO: 230359 - DNA, 25 bp, Mus musculus
cagggactccttgtgggaccgacgt

SEQ ID NO: 230360 - DNA, 25 bp, Mus musculus
cagggactgggctgcaggtcctggt

SEQ ID NO: 230361 - DNA, 25 bp, Mus musculus
cagggactggtccagcacctgctac

SEQ ID NO: 230362 - DNA, 25 bp, Mus musculus
cagggactgtgggctgggattcttc

SEQ ID NO: 230363 - DNA, 25 bp, Mus musculus
cagggacttacaaagagctttctga

SEQ ID NO: 230364 - DNA, 25 bp, Mus musculus
cagggagaaagagcctggcccaact

SEQ ID NO: 230365 - DNA, 25 bp, Mus musculus
cagggagaatcggggtgcaccttcg

SEQ ID NO: 230366 - DNA, 25 bp, Mus musculus
cagggagaatcgggttggaggggtg

SEQ ID NO: 230367 - DNA, 25 bp, Mus musculus
cagggagaatgtttttcttacttat

SEQ ID NO: 230368 - DNA, 25 bp, Mus musculus
cagggagacaaggcggactatttca

SEQ ID NO: 230369 - DNA, 25 bp, Mus musculus
cagggagacaggatccttccttgtt

SEQ ID NO: 230370 - DNA, 25 bp, Mus musculus
cagggagaccctggtctccctggtc

SEQ ID NO: 230371 - DNA, 25 bp, Mus musculus
cagggagacgaaggaggcgttcttc

SEQ ID NO: 230372 - DNA, 25 bp, Mus musculus
cagggagacgcacaggcatatctgc

SEQ ID NO: 230373 - DNA, 25 bp, Mus musculus
cagggagagaaggtgtcttaccact

SEQ ID NO: 230374 - DNA, 25 bp, Mus musculus
cagggagagacgcaggtcatacctc

SEQ ID NO: 230375 - DNA, 25 bp, Mus musculus
cagggagatcggctttgaattcatg

SEQ ID NO: 230376 - DNA, 25 bp, Mus musculus
cagggagcacagaacctttgacatg

SEQ ID NO: 230377 - DNA, 25 bp, Mus musculus
cagggagcacagctcatcctgtgct

SEQ ID NO: 230378 - DNA, 25 bp, Mus musculus
cagggagcaggatatggttactgga

SEQ ID NO: 230379 - DNA, 25 bp, Mus musculus
cagggagcaggtaagcagctgctcc

SEQ ID NO: 230380 - DNA, 25 bp, Mus musculus
cagggagccagcttggtctgacaga

SEQ ID NO: 230381 - DNA, 25 bp, Mus musculus
cagggagcccagaaccaaggcaaga

SEQ ID NO: 230382 - DNA, 25 bp, Mus musculus
cagggagccgcagggtagaggcagt

SEQ ID NO: 230383 - DNA, 25 bp, Mus musculus
cagggagcgagagtgtgaacatggc

SEQ ID NO: 230384 - DNA, 25 bp, Mus musculus
cagggagcgcacctgaggggaagat

SEQ ID NO: 230385 - DNA, 25 bp, Mus musculus
cagggagcgcacctggtgattttac

SEQ ID NO: 230386 - DNA, 25 bp, Mus musculus
cagggaggatggctgatcatatgat

SEQ ID NO: 230387 - DNA, 25 bp, Mus musculus
cagggaggatgggaaaacctggaga

SEQ ID NO: 230388 - DNA, 25 bp, Mus musculus
cagggaggcaatggcagctacaatt

SEQ ID NO: 230389 - DNA, 25 bp, Mus musculus
cagggaggcagtttgcagggacatg

SEQ ID NO: 230390 - DNA, 25 bp, Mus musculus
cagggaggggatatggcatccagcc

SEQ ID NO: 230391 - DNA, 25 bp, Mus musculus
cagggagggggcaaggctctgctcc

SEQ ID NO: 230392 - DNA, 25 bp, Mus musculus
cagggaggttccagatcacacaaga

SEQ ID NO: 230393 - DNA, 25 bp, Mus musculus
cagggaggttccaggtgtgtgtgac

SEQ ID NO: 230394 - DNA, 25 bp, Mus musculus
cagggagtaaagggacatctctaca

SEQ ID NO: 230395 - DNA, 25 bp, Mus musculus
cagggagtgggagattactacaagg

SEQ ID NO: 230396 - DNA, 25 bp, Mus musculus
cagggagtgggaggtagtgtcggtg

SEQ ID NO: 230397 - DNA, 25 bp, Mus musculus
cagggagtgtggtcttctcagttac

SEQ ID NO: 230398 - DNA, 25 bp, Mus musculus
cagggatcagtgggcgagcttcaca

SEQ ID NO: 230399 - DNA, 25 bp, Mus musculus
cagggatcagtggtaccgggctttc

SEQ ID NO: 230400 - DNA, 25 bp, Mus musculus
cagggatccacgaggacccgcctcg

SEQ ID NO: 230401 - DNA, 25 bp, Mus musculus
cagggatcccaggtcttcctggccg

SEQ ID NO: 230402 - DNA, 25 bp, Mus musculus
cagggatctccaagacctcactatc

SEQ ID NO: 230403 - DNA, 25 bp, Mus musculus
cagggatctccaaggaccacaatgc

SEQ ID NO: 230404 - DNA, 25 bp, Mus musculus
cagggatctttaatgcctctccagc

SEQ ID NO: 230405 - DNA, 25 bp, Mus musculus
cagggatgaaggacacagggactga

SEQ ID NO: 230406 - DNA, 25 bp, Mus musculus
cagggatgaaggtctgtcagtttgt

SEQ ID NO: 230407 - DNA, 25 bp, Mus musculus
cagggatgagactttgaagagaaag

SEQ ID NO: 230408 - DNA, 25 bp, Mus musculus
cagggatgagctagttaaaggcctt

SEQ ID NO: 230409 - DNA, 25 bp, Mus musculus
cagggatggaggcaaattccacccc

SEQ ID NO: 230410 - DNA, 25 bp, Mus musculus
cagggatgtaggagatgagccgctc

SEQ ID NO: 230411 - DNA, 25 bp, Mus musculus
cagggattacagtgctgtgctccat

SEQ ID NO: 230412 - DNA, 25 bp, Mus musculus
cagggattcatgctgtattttcatc

SEQ ID NO: 230413 - DNA, 25 bp, Mus musculus
cagggattcccgtcttctccctcct

SEQ ID NO: 230414 - DNA, 25 bp, Mus musculus
cagggattcttcaggaacaagatcc

SEQ ID NO: 230415 - DNA, 25 bp, Mus musculus
cagggatttcagatgataaaggcag

SEQ ID NO: 230416 - DNA, 25 bp, Mus musculus
cagggatttcaggctgggaatgcgt

SEQ ID NO: 230417 - DNA, 25 bp, Mus musculus
cagggatttcagtctggaaatgtct

SEQ ID NO: 230418 - DNA, 25 bp, Mus musculus
cagggatttgcttcaacctggctct

SEQ ID NO: 230419 - DNA, 25 bp, Mus musculus
cagggatttgtttcgcctgcagctg

SEQ ID NO: 230420 - DNA, 25 bp, Mus musculus
cagggcaaaggggtttcctgagatg

SEQ ID NO: 230421 - DNA, 25 bp, Mus musculus
cagggcaacaggctgaaccattagt

SEQ ID NO: 230422 - DNA, 25 bp, Mus musculus
cagggcaacgtgatggagctggtgg

SEQ ID NO: 230423 - DNA, 25 bp, Mus musculus
cagggcaagaagcatcctcctcctt

SEQ ID NO: 230424 - DNA, 25 bp, Mus musculus
cagggcaagaaggtgggaatcctag

SEQ ID NO: 230425 - DNA, 25 bp, Mus musculus
cagggcacaggaataacagaagccc

SEQ ID NO: 230426 - DNA, 25 bp, Mus musculus
cagggcaccaaggctgctttggcag

SEQ ID NO: 230427 - DNA, 25 bp, Mus musculus
cagggcaccaagttctccagccaac

SEQ ID NO: 230428 - DNA, 25 bp, Mus musculus
cagggcacccgccaacatgagtctg

SEQ ID NO: 230429 - DNA, 25 bp, Mus musculus
cagggcagagaagctggcttgctgg

SEQ ID NO: 230430 - DNA, 25 bp, Mus musculus
cagggcagagccaagcacttacgcc

SEQ ID NO: 230431 - DNA, 25 bp, Mus musculus
cagggcagcagagaatcagctgttc

SEQ ID NO: 230432 - DNA, 25 bp, Mus musculus
cagggcagcgaggttgtaagtgtct

SEQ ID NO: 230433 - DNA, 25 bp, Mus musculus
cagggcagcgattgtaagtgtctta

SEQ ID NO: 230434 - DNA, 25 bp, Mus musculus
cagggcagctagctggatcaccgac

SEQ ID NO: 230435 - DNA, 25 bp, Mus musculus
cagggcagggaagaagtacgagaaa

SEQ ID NO: 230436 - DNA, 25 bp, Mus musculus
cagggcataggagaacattctggct

SEQ ID NO: 230437 - DNA, 25 bp, Mus musculus
cagggcataggaggtaacaacaaca

SEQ ID NO: 230438 - DNA, 25 bp, Mus musculus
cagggcatatcagatacgagggcac

SEQ ID NO: 230439 - DNA, 25 bp, Mus musculus
cagggcatatcaggtcaggggtcac

SEQ ID NO: 230440 - DNA, 25 bp, Mus musculus
cagggcatcaagaagtcaacaaaag

SEQ ID NO: 230441 - DNA, 25 bp, Mus musculus
cagggcatcaagtattggctggatc

SEQ ID NO: 230442 - DNA, 25 bp, Mus musculus
cagggcatcagtgatatgtcaagaa

SEQ ID NO: 230443 - DNA, 25 bp, Mus musculus
cagggcatcagtgctaatggaggtt

SEQ ID NO: 230444 - DNA, 25 bp, Mus musculus
cagggcatcggatgctggggctgca

SEQ ID NO: 230445 - DNA, 25 bp, Mus musculus
cagggcatggacaagtccagttcag

SEQ ID NO: 230446 - DNA, 25 bp, Mus musculus
cagggcatggcagagcaccttaagg

SEQ ID NO: 230447 - DNA, 25 bp, Mus musculus
cagggcatggcagagctccaggccg

SEQ ID NO: 230448 - DNA, 25 bp, Mus musculus
cagggccaatcagggtccctgagtt

SEQ ID NO: 230449 - DNA, 25 bp, Mus musculus
cagggccacaaggtgaccgaggctt

SEQ ID NO: 230450 - DNA, 25 bp, Mus musculus
cagggccacactggtgctgtgacat

SEQ ID NO: 230451 - DNA, 25 bp, Mus musculus
cagggccagaaggagctcccagcga

SEQ ID NO: 230452 - DNA, 25 bp, Mus musculus
cagggccagaaggtgatggtgcagg

SEQ ID NO: 230453 - DNA, 25 bp, Mus musculus
cagggccagcattgagattgaccag

SEQ ID NO: 230454 - DNA, 25 bp, Mus musculus
cagggccatgtcttccctctcatgg

SEQ ID NO: 230455 - DNA, 25 bp, Mus musculus
cagggccattgtgacttcttcgtct

SEQ ID NO: 230456 - DNA, 25 bp, Mus musculus
cagggcccagagggtcgttgctcca

SEQ ID NO: 230457 - DNA, 25 bp, Mus musculus
cagggcccagccaggtagccatccc

SEQ ID NO: 230458 - DNA, 25 bp, Mus musculus
cagggcccagccaggttttcaggct

SEQ ID NO: 230459 - DNA, 25 bp, Mus musculus
cagggcccaggaattgcattgggca

SEQ ID NO: 230460 - DNA, 25 bp, Mus musculus
cagggcccagtgggaggagtgaagg

SEQ ID NO: 230461 - DNA, 25 bp, Mus musculus
cagggcccctgggcccacctggcct

SEQ ID NO: 230462 - DNA, 25 bp, Mus musculus
cagggcccgccacagctgagctgct

SEQ ID NO: 230463 - DNA, 25 bp, Mus musculus
cagggcccgccacaggctggagcag

SEQ ID NO: 230464 - DNA, 25 bp, Mus musculus
cagggcccgcccaaccagcagaggc

SEQ ID NO: 230465 - DNA, 25 bp, Mus musculus
cagggccctcaggaacaatggccca

SEQ ID NO: 230466 - DNA, 25 bp, Mus musculus
cagggccctcaggccagggggaagg

SEQ ID NO: 230467 - DNA, 25 bp, Mus musculus
cagggccctccgggcagagcgccga

SEQ ID NO: 230468 - DNA, 25 bp, Mus musculus
cagggccctgaagagcatgacgttc

SEQ ID NO: 230469 - DNA, 25 bp, Mus musculus
cagggccgaggaagaactccagttc

SEQ ID NO: 230470 - DNA, 25 bp, Mus musculus
cagggccgaggcccgatttcccgcc

SEQ ID NO: 230471 - DNA, 25 bp, Mus musculus
cagggccggagataatagaatctgt

SEQ ID NO: 230472 - DNA, 25 bp, Mus musculus
cagggccggctgcacaatctgcctg

SEQ ID NO: 230473 - DNA, 25 bp, Mus musculus
cagggccggctgtgtggcctcttcc

SEQ ID NO: 230474 - DNA, 25 bp, Mus musculus
cagggccgtaagagtgcagaccata

SEQ ID NO: 230475 - DNA, 25 bp, Mus musculus
cagggcctgccagggacatcacagt

SEQ ID NO: 230476 - DNA, 25 bp, Mus musculus
cagggcctgctcaggctgtggctta

SEQ ID NO: 230477 - DNA, 25 bp, Mus musculus
cagggccttcaagaaaattacaaca

SEQ ID NO: 230478 - DNA, 25 bp, Mus musculus
cagggccttgaggacctgctctcct

SEQ ID NO: 230479 - DNA, 25 bp, Mus musculus
cagggcctttgctggggacagtaaa

SEQ ID NO: 230480 - DNA, 25 bp, Mus musculus
cagggcgacttcgagaagccccggc

SEQ ID NO: 230481 - DNA, 25 bp, Mus musculus
cagggcgagaacctggagacggacc

SEQ ID NO: 230482 - DNA, 25 bp, Mus musculus
cagggcgagcccaagatctataaca

SEQ ID NO: 230483 - DNA, 25 bp, Mus musculus
cagggcgagcccaggatgggctcta

SEQ ID NO: 230484 - DNA, 25 bp, Mus musculus
cagggcgcaagtgtgagccactgct

SEQ ID NO: 230485 - DNA, 25 bp, Mus musculus
cagggcgccgggcttcttcacaaaa

SEQ ID NO: 230486 - DNA, 25 bp, Mus musculus
cagggcgcctagcgctttgagcttc

SEQ ID NO: 230487 - DNA, 25 bp, Mus musculus
cagggcggccagagggttggtcctg

SEQ ID NO: 230488 - DNA, 25 bp, Mus musculus
cagggcgtggccatagtgaacagaa

SEQ ID NO: 230489 - DNA, 25 bp, Mus musculus
cagggctaacttcccgctcggcccc

SEQ ID NO: 230490 - DNA, 25 bp, Mus musculus
cagggctaccgtcatacctcactac

SEQ ID NO: 230491 - DNA, 25 bp, Mus musculus
cagggctacggcaaatactggtaac

SEQ ID NO: 230492 - DNA, 25 bp, Mus musculus
cagggctatattcagggctacaaca

SEQ ID NO: 230493 - DNA, 25 bp, Mus musculus
cagggctatattcaggtgacagact

SEQ ID NO: 230494 - DNA, 25 bp, Mus musculus
cagggctcaaggaggtagatgactt

SEQ ID NO: 230495 - DNA, 25 bp, Mus musculus
cagggctcaggagctccttcctgat

SEQ ID NO: 230496 - DNA, 25 bp, Mus musculus
cagggctctccgaacctagctagca

SEQ ID NO: 230497 - DNA, 25 bp, Mus musculus
cagggctctccgagaccgaagcccc

SEQ ID NO: 230498 - DNA, 25 bp, Mus musculus
cagggctctccggcgcatctcccaa

SEQ ID NO: 230499 - DNA, 25 bp, Mus musculus
cagggctcttcaggtctacatgtgg

SEQ ID NO: 230500 - DNA, 25 bp, Mus musculus
cagggctcttcaggtgctccaatga

SEQ ID NO: 230501 - DNA, 25 bp, Mus musculus
cagggctgagagatgggaaagaggt

SEQ ID NO: 230502 - DNA, 25 bp, Mus musculus
cagggctgaggcttgttccccctgt

SEQ ID NO: 230503 - DNA, 25 bp, Mus musculus
cagggctgcctcaggtcgcataggg

SEQ ID NO: 230504 - DNA, 25 bp, Mus musculus
cagggctgctaaccccgagatgccc

SEQ ID NO: 230505 - DNA, 25 bp, Mus musculus
cagggctgctctagaagtcaagagg

SEQ ID NO: 230506 - DNA, 25 bp, Mus musculus
cagggctgtggcctggagatgccca

SEQ ID NO: 230507 - DNA, 25 bp, Mus musculus
cagggcttaccaggtgtccctggaa

SEQ ID NO: 230508 - DNA, 25 bp, Mus musculus
cagggcttccaaggcccttgtccac

SEQ ID NO: 230509 - DNA, 25 bp, Mus musculus
cagggcttcccagacactccgtggt

SEQ ID NO: 230510 - DNA, 25 bp, Mus musculus
cagggcttcccagagaagcgatgtc

SEQ ID NO: 230511 - DNA, 25 bp, Mus musculus
cagggcttcccaggatctggagact

SEQ ID NO: 230512 - DNA, 25 bp, Mus musculus
cagggcttgctgttctcctcttgcc

SEQ ID NO: 230513 - DNA, 25 bp, Mus musculus
cagggctttctggagggagttggtg

SEQ ID NO: 230514 - DNA, 25 bp, Mus musculus
caggggaatatggctctggcccaca

SEQ ID NO: 230515 - DNA, 25 bp, Mus musculus
caggggaatcaaagttgctacaact

SEQ ID NO: 230516 - DNA, 25 bp, Mus musculus
caggggacaagatcacctttgtgga

SEQ ID NO: 230517 - DNA, 25 bp, Mus musculus
caggggacgatgaggacctcgacct

SEQ ID NO: 230518 - DNA, 25 bp, Mus musculus
caggggaggcaggtatggatgtatt

SEQ ID NO: 230519 - DNA, 25 bp, Mus musculus
caggggaggccagtggtgagaaacc

SEQ ID NO: 230520 - DNA, 25 bp, Mus musculus
caggggagtgcgagacaaagctggc

SEQ ID NO: 230521 - DNA, 25 bp, Mus musculus
caggggatccaggaccagatgtaaa

SEQ ID NO: 230522 - DNA, 25 bp, Mus musculus
caggggattgattatgagaagatct

SEQ ID NO: 230523 - DNA, 25 bp, Mus musculus
caggggcaagctggacccccaaacc

SEQ ID NO: 230524 - DNA, 25 bp, Mus musculus
caggggcaaggtttcagccacaaag

SEQ ID NO: 230525 - DNA, 25 bp, Mus musculus
caggggcacaaggcattgccacagg

SEQ ID NO: 230526 - DNA, 25 bp, Mus musculus
caggggcacaatctgcagctcagtg

SEQ ID NO: 230527 - DNA, 25 bp, Mus musculus
caggggcacctggcgaggaggaagc

SEQ ID NO: 230528 - DNA, 25 bp, Mus musculus
caggggcacctggtctcccttccat

SEQ ID NO: 230529 - DNA, 25 bp, Mus musculus
caggggccagctccaggtcacagga

SEQ ID NO: 230530 - DNA, 25 bp, Mus musculus
caggggccccagcccctctggtttc

SEQ ID NO: 230531 - DNA, 25 bp, Mus musculus
caggggcccgggcttccgtgacctc

SEQ ID NO: 230532 - DNA, 25 bp, Mus musculus
caggggccctaaataaaagcctgac

SEQ ID NO: 230533 - DNA, 25 bp, Mus musculus
caggggcctcaggtggatgaaactc

SEQ ID NO: 230534 - DNA, 25 bp, Mus musculus
caggggcgagagggagctgctgcag

SEQ ID NO: 230535 - DNA, 25 bp, Mus musculus
caggggcggaggatcaacgaggatc

SEQ ID NO: 230536 - DNA, 25 bp, Mus musculus
caggggcgtcctgaagcgctgtgct

SEQ ID NO: 230537 - DNA, 25 bp, Mus musculus
caggggcgttcaacgctccagttat

SEQ ID NO: 230538 - DNA, 25 bp, Mus musculus
caggggcgttcagtatgcctgtgtc

SEQ ID NO: 230539 - DNA, 25 bp, Mus musculus
caggggctgcaggggacacccgtca

SEQ ID NO: 230540 - DNA, 25 bp, Mus musculus
caggggctgccggggtagctcgcgg

SEQ ID NO: 230541 - DNA, 25 bp, Mus musculus
caggggctgcctgcctacagactac

SEQ ID NO: 230542 - DNA, 25 bp, Mus musculus
caggggctgcggcagcaagaacaga

SEQ ID NO: 230543 - DNA, 25 bp, Mus musculus
caggggctgcggcagcacgtctgac

SEQ ID NO: 230544 - DNA, 25 bp, Mus musculus
caggggctggctgaatcatgatgaa

SEQ ID NO: 230545 - DNA, 25 bp, Mus musculus
caggggcttcagagatcatgtgtgc

SEQ ID NO: 230546 - DNA, 25 bp, Mus musculus
caggggctttcagggggactgcagg

SEQ ID NO: 230547 - DNA, 25 bp, Mus musculus
cagggggacaagaggttgcctgcag

SEQ ID NO: 230548 - DNA, 25 bp, Mus musculus
cagggggacaaggttggggaggcga

SEQ ID NO: 230549 - DNA, 25 bp, Mus musculus
cagggggcaaagccaggaggaagcc

SEQ ID NO: 230550 - DNA, 25 bp, Mus musculus
cagggggcaggcagccactcccgag

SEQ ID NO: 230551 - DNA, 25 bp, Mus musculus
cagggggccaggtgagttggagtga

SEQ ID NO: 230552 - DNA, 25 bp, Mus musculus
cagggggctgacggacgagtccggc

SEQ ID NO: 230553 - DNA, 25 bp, Mus musculus
cagggggctgacggtcgaagaaagc

SEQ ID NO: 230554 - DNA, 25 bp, Mus musculus
caggggggaggacctgtgtcatgtc

SEQ ID NO: 230555 - DNA, 25 bp, Mus musculus
caggggggcccagattcacaacatc

SEQ ID NO: 230556 - DNA, 25 bp, Mus musculus
cagggggtaaatgtgattagtgtta

SEQ ID NO: 230557 - DNA, 25 bp, Mus musculus
caggggtaagcacagctctgcccac

SEQ ID NO: 230558 - DNA, 25 bp, Mus musculus
caggggtaagcacaggatcacgtgg

SEQ ID NO: 230559 - DNA, 25 bp, Mus musculus
caggggtcaggaggcgggagccttg

SEQ ID NO: 230560 - DNA, 25 bp, Mus musculus
caggggtgccctgtggtaagcgaga

SEQ ID NO: 230561 - DNA, 25 bp, Mus musculus
caggggtggcagactctcttctgca

SEQ ID NO: 230562 - DNA, 25 bp, Mus musculus
caggggtggcaggcgcaccaaccct

SEQ ID NO: 230563 - DNA, 25 bp, Mus musculus
caggggtggtcgggctcagaaagtg

SEQ ID NO: 230564 - DNA, 25 bp, Mus musculus
caggggtggtcggtggatggcttgc

SEQ ID NO: 230565 - DNA, 25 bp, Mus musculus
caggggttagtgtggagaggatgcc

SEQ ID NO: 230566 - DNA, 25 bp, Mus musculus
caggggttcagatgccccatatagg

SEQ ID NO: 230567 - DNA, 25 bp, Mus musculus
caggggttcagccaacaattctctt

SEQ ID NO: 230568 - DNA, 25 bp, Mus musculus
caggggttgaagacgttgatgtcag

SEQ ID NO: 230569 - DNA, 25 bp, Mus musculus
caggggttgcacaggatttccctag

SEQ ID NO: 230570 - DNA, 25 bp, Mus musculus
caggggttgcacaggtgaagatcat

SEQ ID NO: 230571 - DNA, 25 bp, Mus musculus
caggggtttcaggcagaaaatgtaa

SEQ ID NO: 230572 - DNA, 25 bp, Mus musculus
caggggtttcaggtctgcattacat

SEQ ID NO: 230573 - DNA, 25 bp, Mus musculus
cagggtaccgcgagatactactcgt

SEQ ID NO: 230574 - DNA, 25 bp, Mus musculus
cagggtaggagggtgggatggagat

SEQ ID NO: 230575 - DNA, 25 bp, Mus musculus
cagggtagtgggagccctcgtagac

SEQ ID NO: 230576 - DNA, 25 bp, Mus musculus
cagggtatttgtaaagatgagccca

SEQ ID NO: 230577 - DNA, 25 bp, Mus musculus
cagggtcaaagccatctgtccctca

SEQ ID NO: 230578 - DNA, 25 bp, Mus musculus
cagggtcaaaggataattccttaag

SEQ ID NO: 230579 - DNA, 25 bp, Mus musculus
cagggtcaaaggccacattgaattt

SEQ ID NO: 230580 - DNA, 25 bp, Mus musculus
cagggtcaagacaaatcttcctatc

SEQ ID NO: 230581 - DNA, 25 bp, Mus musculus
cagggtcaaggttgtagttccccca

SEQ ID NO: 230582 - DNA, 25 bp, Mus musculus
cagggtcacagaaaccggcgatgag

SEQ ID NO: 230583 - DNA, 25 bp, Mus musculus
cagggtcacaggctctgtgggtgag

SEQ ID NO: 230584 - DNA, 25 bp, Mus musculus
cagggtcacctctggaagcaaagct

SEQ ID NO: 230585 - DNA, 25 bp, Mus musculus
cagggtcacctctggggcccaggat

SEQ ID NO: 230586 - DNA, 25 bp, Mus musculus
cagggtcacctctgttggcgaatgc

SEQ ID NO: 230587 - DNA, 25 bp, Mus musculus
cagggtcactacagtgacagagatt

SEQ ID NO: 230588 - DNA, 25 bp, Mus musculus
cagggtcactgtgactccagctccg

SEQ ID NO: 230589 - DNA, 25 bp, Mus musculus
cagggtcagcttcggtttgctgcca

SEQ ID NO: 230590 - DNA, 25 bp, Mus musculus
cagggtcaggtgcaaaatggaacac

SEQ ID NO: 230591 - DNA, 25 bp, Mus musculus
cagggtcaggtgcaagtgcagaatg

SEQ ID NO: 230592 - DNA, 25 bp, Mus musculus
cagggtccacctggtgctacagggt

SEQ ID NO: 230593 - DNA, 25 bp, Mus musculus
cagggtccagagtgggtcatatcgg

SEQ ID NO: 230594 - DNA, 25 bp, Mus musculus
cagggtcccagaagggtcagaaagc

SEQ ID NO: 230595 - DNA, 25 bp, Mus musculus
cagggtccctttgcacttggaatct

SEQ ID NO: 230596 - DNA, 25 bp, Mus musculus
cagggtcctggcaggaagatttatt

SEQ ID NO: 230597 - DNA, 25 bp, Mus musculus
cagggtcctggcaggggcagtaatt

SEQ ID NO: 230598 - DNA, 25 bp, Mus musculus
cagggtcctgtttgggcttcctgta

SEQ ID NO: 230599 - DNA, 25 bp, Mus musculus
cagggtctcaataggtcttgtgtga

SEQ ID NO: 230600 - DNA, 25 bp, Mus musculus
cagggtctgtacaaggttttgaatc

SEQ ID NO: 230601 - DNA, 25 bp, Mus musculus
cagggtcttatctcgagttgggaac

SEQ ID NO: 230602 - DNA, 25 bp, Mus musculus
cagggtcttatctcgatgaggtctc

SEQ ID NO: 230603 - DNA, 25 bp, Mus musculus
cagggtcttatctcggttacacctg

SEQ ID NO: 230604 - DNA, 25 bp, Mus musculus
cagggtcttcctggtgcagtgggga

SEQ ID NO: 230605 - DNA, 25 bp, Mus musculus
cagggtgaaaggggaacatctcaag

SEQ ID NO: 230606 - DNA, 25 bp, Mus musculus
cagggtgaaagggtgggatgctatg

SEQ ID NO: 230607 - DNA, 25 bp, Mus musculus
cagggtgatcgaggggctgacatgg

SEQ ID NO: 230608 - DNA, 25 bp, Mus musculus
cagggtgatgctctcccagtgtcta

SEQ ID NO: 230609 - DNA, 25 bp, Mus musculus
cagggtgcaagatgatgacttctgg

SEQ ID NO: 230610 - DNA, 25 bp, Mus musculus
cagggtgcaagccagcccttcagca

SEQ ID NO: 230611 - DNA, 25 bp, Mus musculus
cagggtgcacaggaaatactggggc

SEQ ID NO: 230612 - DNA, 25 bp, Mus musculus
cagggtgcatgaaaggccgcaccat

SEQ ID NO: 230613 - DNA, 25 bp, Mus musculus
cagggtgcccagtgctaggagacca

SEQ ID NO: 230614 - DNA, 25 bp, Mus musculus
cagggtgctcctggaaaacggggtg

SEQ ID NO: 230615 - DNA, 25 bp, Mus musculus
cagggtgctggttggtggcactaag

SEQ ID NO: 230616 - DNA, 25 bp, Mus musculus
cagggtggaagaaaggcttggggca

SEQ ID NO: 230617 - DNA, 25 bp, Mus musculus
cagggtggagcatctgatgacatgt

SEQ ID NO: 230618 - DNA, 25 bp, Mus musculus
cagggtggagttctagtttggatta

SEQ ID NO: 230619 - DNA, 25 bp, Mus musculus
cagggtggcaaaggtgatgttcgtc

SEQ ID NO: 230620 - DNA, 25 bp, Mus musculus
cagggtggcatacacagagattgac

SEQ ID NO: 230621 - DNA, 25 bp, Mus musculus
cagggtggcatctacccagctgggt

SEQ ID NO: 230622 - DNA, 25 bp, Mus musculus
cagggtggtcaggaaggtctatatg

SEQ ID NO: 230623 - DNA, 25 bp, Mus musculus
cagggtgtaccagcctccagctcaa

SEQ ID NO: 230624 - DNA, 25 bp, Mus musculus
cagggtgtgcaagggcgaccagggc

SEQ ID NO: 230625 - DNA, 25 bp, Mus musculus
cagggtgtggtgggccgagccgcca

SEQ ID NO: 230626 - DNA, 25 bp, Mus musculus
cagggttacagacagggtttctctg

SEQ ID NO: 230627 - DNA, 25 bp, Mus musculus
cagggttacagatgctctctgatgc

SEQ ID NO: 230628 - DNA, 25 bp, Mus musculus
cagggttcaccagataaatttaaca

SEQ ID NO: 230629 - DNA, 25 bp, Mus musculus
cagggttccagggacttcctggccc

SEQ ID NO: 230630 - DNA, 25 bp, Mus musculus
cagggttccggaaggttccatgatg

SEQ ID NO: 230631 - DNA, 25 bp, Mus musculus
cagggttctccaagtgttgaatcat

SEQ ID NO: 230632 - DNA, 25 bp, Mus musculus
cagggtttacaaaggagcagccatg

SEQ ID NO: 230633 - DNA, 25 bp, Mus musculus
caggtaaaaatggattagtcgtatc

SEQ ID NO: 230634 - DNA, 25 bp, Mus musculus
caggtaagaaggctcagcggaacct

SEQ ID NO: 230635 - DNA, 25 bp, Mus musculus
caggtaagagagatctggagctgct

SEQ ID NO: 230636 - DNA, 25 bp, Mus musculus
caggtaaggtaagatctcaagcata

SEQ ID NO: 230637 - DNA, 25 bp, Mus musculus
caggtaattgcgctccagatgaaaa

SEQ ID NO: 230638 - DNA, 25 bp, Mus musculus
caggtacaagacgaactggagaaac

SEQ ID NO: 230639 - DNA, 25 bp, Mus musculus
caggtacaagatcaagtctccagtg

SEQ ID NO: 230640 - DNA, 25 bp, Mus musculus
caggtacaagattgagaaatggcat

SEQ ID NO: 230641 - DNA, 25 bp, Mus musculus
caggtacaaggaaggaaaagatggc

SEQ ID NO: 230642 - DNA, 25 bp, Mus musculus
caggtacagatcatattgatcagtg

SEQ ID NO: 230643 - DNA, 25 bp, Mus musculus
caggtacaggcaggcaaaggctcgg

SEQ ID NO: 230644 - DNA, 25 bp, Mus musculus
caggtacatacctagggatgccctg

SEQ ID NO: 230645 - DNA, 25 bp, Mus musculus
caggtaccaggatttccaatttcga

SEQ ID NO: 230646 - DNA, 25 bp, Mus musculus
caggtaccaggcatacttctccgcc

SEQ ID NO: 230647 - DNA, 25 bp, Mus musculus
caggtaccagttgcggatgagtaca

SEQ ID NO: 230648 - DNA, 25 bp, Mus musculus
caggtaccataaacagtatggcggc

SEQ ID NO: 230649 - DNA, 25 bp, Mus musculus
caggtacctaccaggtgaaaccttt

SEQ ID NO: 230650 - DNA, 25 bp, Mus musculus
caggtacctgggagcccgaaccaac

SEQ ID NO: 230651 - DNA, 25 bp, Mus musculus
caggtactacagtgtctaatgcact

SEQ ID NO: 230652 - DNA, 25 bp, Mus musculus
caggtactccaccgaacagtggcca

SEQ ID NO: 230653 - DNA, 25 bp, Mus musculus
caggtactgtcggaccagcagtgcc

SEQ ID NO: 230654 - DNA, 25 bp, Mus musculus
caggtagaaaagagaagcccgtgct

SEQ ID NO: 230655 - DNA, 25 bp, Mus musculus
caggtagagtcacagaaatcactca

SEQ ID NO: 230656 - DNA, 25 bp, Mus musculus
caggtagatgctgagaggaaaacca

SEQ ID NO: 230657 - DNA, 25 bp, Mus musculus
caggtagattctggtttacaatcta

SEQ ID NO: 230658 - DNA, 25 bp, Mus musculus
caggtagcagatcagatgtggcagg

SEQ ID NO: 230659 - DNA, 25 bp, Mus musculus
caggtagcagatcaggctcctggag

SEQ ID NO: 230660 - DNA, 25 bp, Mus musculus
caggtagccaagcttgaggcggccc

SEQ ID NO: 230661 - DNA, 25 bp, Mus musculus
caggtaggcaaaggtggaggaagag

SEQ ID NO: 230662 - DNA, 25 bp, Mus musculus
caggtaggcctcgggacggcctcag

SEQ ID NO: 230663 - DNA, 25 bp, Mus musculus
caggtataaaagcttatgcactgga

SEQ ID NO: 230664 - DNA, 25 bp, Mus musculus
caggtatccatgcggctgtgtggag

SEQ ID NO: 230665 - DNA, 25 bp, Mus musculus
caggtatcgaggaattctatacctt

SEQ ID NO: 230666 - DNA, 25 bp, Mus musculus
caggtatctctgaagcactgcgcaa

SEQ ID NO: 230667 - DNA, 25 bp, Mus musculus
caggtatcttgatgtcagcccatca

SEQ ID NO: 230668 - DNA, 25 bp, Mus musculus
caggtcaaaatgtcctgcaggtctt

SEQ ID NO: 230669 - DNA, 25 bp, Mus musculus
caggtcaaagtgattgtgtgtcgct

SEQ ID NO: 230670 - DNA, 25 bp, Mus musculus
caggtcaaccagggaaaatgccaag

SEQ ID NO: 230671 - DNA, 25 bp, Mus musculus
caggtcaaggaaaacaaattgatga

SEQ ID NO: 230672 - DNA, 25 bp, Mus musculus
caggtcaaggatgataatgggggat

SEQ ID NO: 230673 - DNA, 25 bp, Mus musculus
caggtcacctgcagatactttatgc

SEQ ID NO: 230674 - DNA, 25 bp, Mus musculus
caggtcactaggggcttcagaagag

SEQ ID NO: 230675 - DNA, 25 bp, Mus musculus
caggtcacttgccagctcctgtgcg

SEQ ID NO: 230676 - DNA, 25 bp, Mus musculus
caggtcagagtcggagtcttatttt

SEQ ID NO: 230677 - DNA, 25 bp, Mus musculus
caggtcagattgaaggtcagatgta

SEQ ID NO: 230678 - DNA, 25 bp, Mus musculus
caggtcagcaggcgctttgccctgt

SEQ ID NO: 230679 - DNA, 25 bp, Mus musculus
caggtcagggccagggattctgggc

SEQ ID NO: 230680 - DNA, 25 bp, Mus musculus
caggtcagggccaggtgtctccagt

SEQ ID NO: 230681 - DNA, 25 bp, Mus musculus
caggtcagtaagggggtccaaggct

SEQ ID NO: 230682 - DNA, 25 bp, Mus musculus
caggtcagtcaggacttgctagacc

SEQ ID NO: 230683 - DNA, 25 bp, Mus musculus
caggtcagtcctgggctgggccgtc

SEQ ID NO: 230684 - DNA, 25 bp, Mus musculus
caggtcagtgcttcgcaagatggaa

SEQ ID NO: 230685 - DNA, 25 bp, Mus musculus
caggtcatcaagatgaacaggatgt

SEQ ID NO: 230686 - DNA, 25 bp, Mus musculus
caggtcatcaaggacttcccatgga

SEQ ID NO: 230687 - DNA, 25 bp, Mus musculus
caggtcatcaccaccggcgcctgtt

SEQ ID NO: 230688 - DNA, 25 bp, Mus musculus
caggtcattggcgacagggttcccc

SEQ ID NO: 230689 - DNA, 25 bp, Mus musculus
caggtcattggggttccccagtggg

SEQ ID NO: 230690 - DNA, 25 bp, Mus musculus
caggtccaagagtctgaaggaaggc

SEQ ID NO: 230691 - DNA, 25 bp, Mus musculus
caggtccaaggcttgagatttttaa

SEQ ID NO: 230692 - DNA, 25 bp, Mus musculus
caggtccaagtccgtaattgagcag

SEQ ID NO: 230693 - DNA, 25 bp, Mus musculus
caggtccacccaagggtacagcatg

SEQ ID NO: 230694 - DNA, 25 bp, Mus musculus
caggtccacgtgagacatggcacaa

SEQ ID NO: 230695 - DNA, 25 bp, Mus musculus
caggtccacgtgagatccttcttac

SEQ ID NO: 230696 - DNA, 25 bp, Mus musculus
caggtccagagcatgggggggaaag

SEQ ID NO: 230697 - DNA, 25 bp, Mus musculus
caggtccaggcagaggacagctcct

SEQ ID NO: 230698 - DNA, 25 bp, Mus musculus
caggtccagttggaaatgaaatgtt

SEQ ID NO: 230699 - DNA, 25 bp, Mus musculus
caggtccatgaccgaaatgcgactg

SEQ ID NO: 230700 - DNA, 25 bp, Mus musculus
caggtccatggtaccaaccaaaaag

SEQ ID NO: 230701 - DNA, 25 bp, Mus musculus
caggtccattgggcatcatgaagca

SEQ ID NO: 230702 - DNA, 25 bp, Mus musculus
caggtcccaaccaagctgctggaag

SEQ ID NO: 230703 - DNA, 25 bp, Mus musculus
caggtcccaaccaaggaatcactga

SEQ ID NO: 230704 - DNA, 25 bp, Mus musculus
caggtcccaagggtgcccctggaga

SEQ ID NO: 230705 - DNA, 25 bp, Mus musculus
caggtcccacgccctggcacatctt

SEQ ID NO: 230706 - DNA, 25 bp, Mus musculus
caggtcccagagaccagagggtttt

SEQ ID NO: 230707 - DNA, 25 bp, Mus musculus
caggtcccagctggggtcggagctt

SEQ ID NO: 230708 - DNA, 25 bp, Mus musculus
caggtcccaggctgtgtcccactgc

SEQ ID NO: 230709 - DNA, 25 bp, Mus musculus
caggtcccaggtatgaataccactg

SEQ ID NO: 230710 - DNA, 25 bp, Mus musculus
caggtcccccggtatagaacgtgtg

SEQ ID NO: 230711 - DNA, 25 bp, Mus musculus
caggtcccctctggatcataaagac

SEQ ID NO: 230712 - DNA, 25 bp, Mus musculus
caggtccctcactaaaagcaccttc

SEQ ID NO: 230713 - DNA, 25 bp, Mus musculus
caggtccgaagcaggctcctggagt

SEQ ID NO: 230714 - DNA, 25 bp, Mus musculus
caggtccgaagtgctgactggtcac

SEQ ID NO: 230715 - DNA, 25 bp, Mus musculus
caggtccgagagcaggtctgcctgg

SEQ ID NO: 230716 - DNA, 25 bp, Mus musculus
caggtccgagagcagtggccacagt

SEQ ID NO: 230717 - DNA, 25 bp, Mus musculus
caggtccgcaaagagaaaagatgag

SEQ ID NO: 230718 - DNA, 25 bp, Mus musculus
caggtccgcaaagctccttctggcc

SEQ ID NO: 230719 - DNA, 25 bp, Mus musculus
caggtccgcaaagtggcatggatgg

SEQ ID NO: 230720 - DNA, 25 bp, Mus musculus
caggtcctaaaaggtgcaactacat

SEQ ID NO: 230721 - DNA, 25 bp, Mus musculus
caggtcctctacaagacaatgttct

SEQ ID NO: 230722 - DNA, 25 bp, Mus musculus
caggtcctctacaagactgtgtaca

SEQ ID NO: 230723 - DNA, 25 bp, Mus musculus
caggtcctgacagaaatccatgcga

SEQ ID NO: 230724 - DNA, 25 bp, Mus musculus
caggtcctgcgggttctccagggga

SEQ ID NO: 230725 - DNA, 25 bp, Mus musculus
caggtcctggatgaacgagaccgtg

SEQ ID NO: 230726 - DNA, 25 bp, Mus musculus
caggtccttgaaatcaagatgctgt

SEQ ID NO: 230727 - DNA, 25 bp, Mus musculus
caggtcgagggaagctaaagaagta

SEQ ID NO: 230728 - DNA, 25 bp, Mus musculus
caggtcgctcaggacatcagcaact

SEQ ID NO: 230729 - DNA, 25 bp, Mus musculus
caggtcgctcaggcttgcagatggg

SEQ ID NO: 230730 - DNA, 25 bp, Mus musculus
caggtcggaaggctgcctctcgctg

SEQ ID NO: 230731 - DNA, 25 bp, Mus musculus
caggtcgtaaggaggtgcctgcagg

SEQ ID NO: 230732 - DNA, 25 bp, Mus musculus
caggtctcaaaagcgctcctggagc

SEQ ID NO: 230733 - DNA, 25 bp, Mus musculus
caggtctccagggcctggaatgtcc

SEQ ID NO: 230734 - DNA, 25 bp, Mus musculus
caggtctccttcaggctccatgttg

SEQ ID NO: 230735 - DNA, 25 bp, Mus musculus
caggtctccttcagttaaagctagt

SEQ ID NO: 230736 - DNA, 25 bp, Mus musculus
caggtctctactgcctacaagaaga

SEQ ID NO: 230737 - DNA, 25 bp, Mus musculus
caggtctctactgcctatgtgaaaa

SEQ ID NO: 230738 - DNA, 25 bp, Mus musculus
caggtctctgaaggaacagtctgag

SEQ ID NO: 230739 - DNA, 25 bp, Mus musculus
caggtctctgcaagaaaaggcaaga

SEQ ID NO: 230740 - DNA, 25 bp, Mus musculus
caggtctctgcaagaggtgttgtcg

SEQ ID NO: 230741 - DNA, 25 bp, Mus musculus
caggtctgagagcccaacatgcaaa

SEQ ID NO: 230742 - DNA, 25 bp, Mus musculus
caggtctgaggatatgacattacaa

SEQ ID NO: 230743 - DNA, 25 bp, Mus musculus
caggtctgatccaggggcaggtgag

SEQ ID NO: 230744 - DNA, 25 bp, Mus musculus
caggtctgatccagtctgcctggag

SEQ ID NO: 230745 - DNA, 25 bp, Mus musculus
caggtctgtaaaaaagcaacacgtt

SEQ ID NO: 230746 - DNA, 25 bp, Mus musculus
caggtctgttctgactgctgcagct

SEQ ID NO: 230747 - DNA, 25 bp, Mus musculus
caggtcttaaatctggggaaggaag

SEQ ID NO: 230748 - DNA, 25 bp, Mus musculus
caggtcttaaatctggttaactatt

SEQ ID NO: 230749 - DNA, 25 bp, Mus musculus
caggtcttaaatctgttcacacaga

SEQ ID NO: 230750 - DNA, 25 bp, Mus musculus
caggtcttccaggcccaaagggtga

SEQ ID NO: 230751 - DNA, 25 bp, Mus musculus
caggtcttgccaaggtgattcctcc

SEQ ID NO: 230752 - DNA, 25 bp, Mus musculus
caggtcttgtgagtaacatttcact

SEQ ID NO: 230753 - DNA, 25 bp, Mus musculus
caggtgaaaagaagaccttgtcctg

SEQ ID NO: 230754 - DNA, 25 bp, Mus musculus
caggtgaacaatgcagcagcaagtc

SEQ ID NO: 230755 - DNA, 25 bp, Mus musculus
caggtgaagcatgatcagcaagtcg

SEQ ID NO: 230756 - DNA, 25 bp, Mus musculus
caggtgaagcatggggccactgtct

SEQ ID NO: 230757 - DNA, 25 bp, Mus musculus
caggtgaagctcagaaacttgattg

SEQ ID NO: 230758 - DNA, 25 bp, Mus musculus
caggtgacaaagcaggtaaacactg

SEQ ID NO: 230759 - DNA, 25 bp, Mus musculus
caggtgacagacacatctggtcact

SEQ ID NO: 230760 - DNA, 25 bp, Mus musculus
caggtgacaggttgctttgaaggaa

SEQ ID NO: 230761 - DNA, 25 bp, Mus musculus
caggtgacaggttttactgcaatca

SEQ ID NO: 230762 - DNA, 25 bp, Mus musculus
caggtgaccttggaggatttgaggc

SEQ ID NO: 230763 - DNA, 25 bp, Mus musculus
caggtgacgctgggttgccccggag

SEQ ID NO: 230764 - DNA, 25 bp, Mus musculus
caggtgactccaggagcagttcctc

SEQ ID NO: 230765 - DNA, 25 bp, Mus musculus
caggtgactggttgcaatcaggatt

SEQ ID NO: 230766 - DNA, 25 bp, Mus musculus
caggtgactggttgttaaatgaagc

SEQ ID NO: 230767 - DNA, 25 bp, Mus musculus
caggtgagaggccacgattgctgcc

SEQ ID NO: 230768 - DNA, 25 bp, Mus musculus
caggtgagcaggatcggaacgtcaa

SEQ ID NO: 230769 - DNA, 25 bp, Mus musculus
caggtgagcatgcaggctctgctct

SEQ ID NO: 230770 - DNA, 25 bp, Mus musculus
caggtgagccaggcaccttttgtgt

SEQ ID NO: 230771 - DNA, 25 bp, Mus musculus
caggtgagtcagcagattcacaaca

SEQ ID NO: 230772 - DNA, 25 bp, Mus musculus
caggtgagtgatcagggcaccctca

SEQ ID NO: 230773 - DNA, 25 bp, Mus musculus
caggtgagtggatgatcacttgatt

SEQ ID NO: 230774 - DNA, 25 bp, Mus musculus
caggtgatcacgctcaccatcatgg

SEQ ID NO: 230775 - DNA, 25 bp, Mus musculus
caggtgatccagagaagagtttagc

SEQ ID NO: 230776 - DNA, 25 bp, Mus musculus
caggtgatgacagaggacaaaggtg

SEQ ID NO: 230777 - DNA, 25 bp, Mus musculus
caggtgatgacagtcacctctcctc

SEQ ID NO: 230778 - DNA, 25 bp, Mus musculus
caggtgcaaagagctgaggacctgg

SEQ ID NO: 230779 - DNA, 25 bp, Mus musculus
caggtgcaaagaggaaaacaccata

SEQ ID NO: 230780 - DNA, 25 bp, Mus musculus
caggtgcaaccagagctgcctgcca

SEQ ID NO: 230781 - DNA, 25 bp, Mus musculus
caggtgcaccagcgagcctgtcaca

SEQ ID NO: 230782 - DNA, 25 bp, Mus musculus
caggtgcagagggcagctgagacac

SEQ ID NO: 230783 - DNA, 25 bp, Mus musculus
caggtgcagctggtgatcaaggaca

SEQ ID NO: 230784 - DNA, 25 bp, Mus musculus
caggtgccacacggccatggctacc

SEQ ID NO: 230785 - DNA, 25 bp, Mus musculus
caggtgccagagcagaagtcagcat

SEQ ID NO: 230786 - DNA, 25 bp, Mus musculus
caggtgccaggaagtggtcatattc

SEQ ID NO: 230787 - DNA, 25 bp, Mus musculus
caggtgccccaagatgaggacgctc

SEQ ID NO: 230788 - DNA, 25 bp, Mus musculus
caggtgccccagataagccaaagag

SEQ ID NO: 230789 - DNA, 25 bp, Mus musculus
caggtgccccaggtgttccatgagc

SEQ ID NO: 230790 - DNA, 25 bp, Mus musculus
caggtgccccaggtttcttgaactc

SEQ ID NO: 230791 - DNA, 25 bp, Mus musculus
caggtgcctcggttccagggtccct

SEQ ID NO: 230792 - DNA, 25 bp, Mus musculus
caggtgcctcgtacgggtattccca

SEQ ID NO: 230793 - DNA, 25 bp, Mus musculus
caggtgcctgaaaggttgcaggaat

SEQ ID NO: 230794 - DNA, 25 bp, Mus musculus
caggtgcgagaacgcaacctgaacc

SEQ ID NO: 230795 - DNA, 25 bp, Mus musculus
caggtgctaatggcaatcctggacc

SEQ ID NO: 230796 - DNA, 25 bp, Mus musculus
caggtgctaggttaaagatcgaggt

SEQ ID NO: 230797 - DNA, 25 bp, Mus musculus
caggtgctcaggtgtgtgtgacggc

SEQ ID NO: 230798 - DNA, 25 bp, Mus musculus
caggtgctgaaaggtattcccaagc

SEQ ID NO: 230799 - DNA, 25 bp, Mus musculus
caggtgctgcaggttcttctgaatt

SEQ ID NO: 230800 - DNA, 25 bp, Mus musculus
caggtgctgcagtctcaggactcac

SEQ ID NO: 230801 - DNA, 25 bp, Mus musculus
caggtgcttcagaagatggttacgg

SEQ ID NO: 230802 - DNA, 25 bp, Mus musculus
caggtgcttcagaaggcacctcttc

SEQ ID NO: 230803 - DNA, 25 bp, Mus musculus
caggtgcttctggtaacccagggac

SEQ ID NO: 230804 - DNA, 25 bp, Mus musculus
caggtggaaagcaagcagaacacag

SEQ ID NO: 230805 - DNA, 25 bp, Mus musculus
caggtggaacggcagacccagtttc

SEQ ID NO: 230806 - DNA, 25 bp, Mus musculus
caggtggaactaagggactttgaat

SEQ ID NO: 230807 - DNA, 25 bp, Mus musculus
caggtggaagaactatatcagtctc

SEQ ID NO: 230808 - DNA, 25 bp, Mus musculus
caggtggaaggtacagttaaagaat

SEQ ID NO: 230809 - DNA, 25 bp, Mus musculus
caggtggacacctccctttcctcgt

SEQ ID NO: 230810 - DNA, 25 bp, Mus musculus
caggtggacatgacagtggccgagg

SEQ ID NO: 230811 - DNA, 25 bp, Mus musculus
caggtggacattgaggcactgcaag

SEQ ID NO: 230812 - DNA, 25 bp, Mus musculus
caggtggacccaggtttgccgaaga

SEQ ID NO: 230813 - DNA, 25 bp, Mus musculus
caggtggagacagcccacaggatga

SEQ ID NO: 230814 - DNA, 25 bp, Mus musculus
caggtggagcagggctcaaactcag

SEQ ID NO: 230815 - DNA, 25 bp, Mus musculus
caggtggagctgcctctgtacaacc

SEQ ID NO: 230816 - DNA, 25 bp, Mus musculus
caggtggaggctgcctccacttcca

SEQ ID NO: 230817 - DNA, 25 bp, Mus musculus
caggtggagtgcaggccctgcaggt

SEQ ID NO: 230818 - DNA, 25 bp, Mus musculus
caggtggatctgttacccacaggtc

SEQ ID NO: 230819 - DNA, 25 bp, Mus musculus
caggtggatgatctggagggatccc

SEQ ID NO: 230820 - DNA, 25 bp, Mus musculus
caggtggatggagtgggtaacttca

SEQ ID NO: 230821 - DNA, 25 bp, Mus musculus
caggtggatggagttcgacagaaca

SEQ ID NO: 230822 - DNA, 25 bp, Mus musculus
caggtggatttgaaagaaactgcca

SEQ ID NO: 230823 - DNA, 25 bp, Mus musculus
caggtggcaaagaaccagcattttg

SEQ ID NO: 230824 - DNA, 25 bp, Mus musculus
caggtggcaacgctgacagagcggc

SEQ ID NO: 230825 - DNA, 25 bp, Mus musculus
caggtggcagaggacctggtggcta

SEQ ID NO: 230826 - DNA, 25 bp, Mus musculus
caggtggcagttttaggttctgatc

SEQ ID NO: 230827 - DNA, 25 bp, Mus musculus
caggtggcccggcttctgcaggcac

SEQ ID NO: 230828 - DNA, 25 bp, Mus musculus
caggtggccgagaagctgtttgact

SEQ ID NO: 230829 - DNA, 25 bp, Mus musculus
caggtggctctctgatgcaagctgt

SEQ ID NO: 230830 - DNA, 25 bp, Mus musculus
caggtggctgagctcccgccagtga

SEQ ID NO: 230831 - DNA, 25 bp, Mus musculus
caggtggctgaggtaccacgtacac

SEQ ID NO: 230832 - DNA, 25 bp, Mus musculus
caggtggctgccccagtgcgggtag

SEQ ID NO: 230833 - DNA, 25 bp, Mus musculus
caggtggctggtaccaattctattt

SEQ ID NO: 230834 - DNA, 25 bp, Mus musculus
caggtgggattggaattgtacccat

SEQ ID NO: 230835 - DNA, 25 bp, Mus musculus
caggtggggtttaggtcacaatcag

SEQ ID NO: 230836 - DNA, 25 bp, Mus musculus
caggtgggttagccaaccccaccag

SEQ ID NO: 230837 - DNA, 25 bp, Mus musculus
caggtggtcaggacaggtacagcac

SEQ ID NO: 230838 - DNA, 25 bp, Mus musculus
caggtggtcaggcctataccattca

SEQ ID NO: 230839 - DNA, 25 bp, Mus musculus
caggtggtcagttgaccaagctgca

SEQ ID NO: 230840 - DNA, 25 bp, Mus musculus
caggtggtcatcaacggctcagagg

SEQ ID NO: 230841 - DNA, 25 bp, Mus musculus
caggtggtgagcgccgagcagaagc

SEQ ID NO: 230842 - DNA, 25 bp, Mus musculus
caggtggtgatctgcgaccagtacc

SEQ ID NO: 230843 - DNA, 25 bp, Mus musculus
caggtggttcgccctagtcgaggga

SEQ ID NO: 230844 - DNA, 25 bp, Mus musculus
caggtgtactcctccctttcctcgt

SEQ ID NO: 230845 - DNA, 25 bp, Mus musculus
caggtgtactcctctcttttcatct

SEQ ID NO: 230846 - DNA, 25 bp, Mus musculus
caggtgtactgtggttcactacaac

SEQ ID NO: 230847 - DNA, 25 bp, Mus musculus
caggtgtctagtggtaaagcgggct

SEQ ID NO: 230848 - DNA, 25 bp, Mus musculus
caggtgtgaacaggttccacccgac

SEQ ID NO: 230849 - DNA, 25 bp, Mus musculus
caggtgtggaccaagtttgttgcat

SEQ ID NO: 230850 - DNA, 25 bp, Mus musculus
caggtgtgtatgctaatgggaatga

SEQ ID NO: 230851 - DNA, 25 bp, Mus musculus
caggtgttaggggatgctggcaagg

SEQ ID NO: 230852 - DNA, 25 bp, Mus musculus
caggtgtttcacagggtcaggtacc

SEQ ID NO: 230853 - DNA, 25 bp, Mus musculus
caggtgtttcagggctaccagtggc

SEQ ID NO: 230854 - DNA, 25 bp, Mus musculus
caggttacgatgaagactgccaaag

SEQ ID NO: 230855 - DNA, 25 bp, Mus musculus
caggttacgatgaaggctgtcatgg

SEQ ID NO: 230856 - DNA, 25 bp, Mus musculus
caggttagcaataggagaagatgga

SEQ ID NO: 230857 - DNA, 25 bp, Mus musculus
caggttatacaggacattgccctaa

SEQ ID NO: 230858 - DNA, 25 bp, Mus musculus
caggttcaagacgatctggctgaaa

SEQ ID NO: 230859 - DNA, 25 bp, Mus musculus
caggttccagacaatcctcctgatc

SEQ ID NO: 230860 - DNA, 25 bp, Mus musculus
caggttccagctctcccaggaaacc

SEQ ID NO: 230861 - DNA, 25 bp, Mus musculus
caggttcccaaagagatgcacggga

SEQ ID NO: 230862 - DNA, 25 bp, Mus musculus
caggttcccagtttagccaggccct

SEQ ID NO: 230863 - DNA, 25 bp, Mus musculus
caggttcctgcctaccactgttccc

SEQ ID NO: 230864 - DNA, 25 bp, Mus musculus
caggttcctgcctgtgacatggaca

SEQ ID NO: 230865 - DNA, 25 bp, Mus musculus
caggttctaccagaggctgtgtaca

SEQ ID NO: 230866 - DNA, 25 bp, Mus musculus
caggttctcagagccatcgtggctg

SEQ ID NO: 230867 - DNA, 25 bp, Mus musculus
caggttctgagaaaacctatccttg

SEQ ID NO: 230868 - DNA, 25 bp, Mus musculus
caggttctgccgcctcctgatgacg

SEQ ID NO: 230869 - DNA, 25 bp, Mus musculus
caggttctgccggggacccctgtgg

SEQ ID NO: 230870 - DNA, 25 bp, Mus musculus
caggttcttgagaggccacagacct

SEQ ID NO: 230871 - DNA, 25 bp, Mus musculus
caggttgccaagcaacacgtgcagg

SEQ ID NO: 230872 - DNA, 25 bp, Mus musculus
caggttgccaaggccttaatccagg

SEQ ID NO: 230873 - DNA, 25 bp, Mus musculus
caggttgccaccaacacctgtacat

SEQ ID NO: 230874 - DNA, 25 bp, Mus musculus
caggttgccaccaagacctgtacat

SEQ ID NO: 230875 - DNA, 25 bp, Mus musculus
caggttgcgtcaagagcctcagctt

SEQ ID NO: 230876 - DNA, 25 bp, Mus musculus
caggttggaagagcaattctacaga

SEQ ID NO: 230877 - DNA, 25 bp, Mus musculus
caggttggaataaaggaaacaagct

SEQ ID NO: 230878 - DNA, 25 bp, Mus musculus
caggttgtagcaaatgacaagattg

SEQ ID NO: 230879 - DNA, 25 bp, Mus musculus
caggttgtaggttatcttgacgaat

SEQ ID NO: 230880 - DNA, 25 bp, Mus musculus
caggttgttcctcaatgtctgcttt

SEQ ID NO: 230881 - DNA, 25 bp, Mus musculus
caggtttagaagacagcgtggaaga

SEQ ID NO: 230882 - DNA, 25 bp, Mus musculus
caggtttaggtctggatcccacgca

SEQ ID NO: 230883 - DNA, 25 bp, Mus musculus
caggtttatcaaaagacttccaact

SEQ ID NO: 230884 - DNA, 25 bp, Mus musculus
caggtttccaaggtggcgacagaca

SEQ ID NO: 230885 - DNA, 25 bp, Mus musculus
caggtttctttcagccttttatgtc

SEQ ID NO: 230886 - DNA, 25 bp, Mus musculus
caggtttgagaatttgacttcggag

SEQ ID NO: 230887 - DNA, 25 bp, Mus musculus
caggtttgagatgttctcaaacagt

SEQ ID NO: 230888 - DNA, 25 bp, Mus musculus
caggtttgccagaaggaacctgaat

SEQ ID NO: 230889 - DNA, 25 bp, Mus musculus
caggtttgccctgagagtgggccat

SEQ ID NO: 230890 - DNA, 25 bp, Mus musculus
caggtttggtaaaagccatggccat

SEQ ID NO: 230891 - DNA, 25 bp, Mus musculus
caggtttgtcaaaaataaggccagc

SEQ ID NO: 230892 - DNA, 25 bp, Mus musculus
caggttttatggactacagatttgg

SEQ ID NO: 230893 - DNA, 25 bp, Mus musculus
caggtttttctaagagaacggtcat

SEQ ID NO: 230894 - DNA, 25 bp, Mus musculus
cagtaaaaaccagaatgacccattg

SEQ ID NO: 230895 - DNA, 25 bp, Mus musculus
cagtaaaaaccagaccgacgtgaca

SEQ ID NO: 230896 - DNA, 25 bp, Mus musculus
cagtaaacactccaggtcgcagaca

SEQ ID NO: 230897 - DNA, 25 bp, Mus musculus
cagtaaaccatgaaggggactcctc

SEQ ID NO: 230898 - DNA, 25 bp, Mus musculus
cagtaaaccatgaagtttctctgtg

SEQ ID NO: 230899 - DNA, 25 bp, Mus musculus
cagtaaacccagtgatcaggtgtaa

SEQ ID NO: 230900 - DNA, 25 bp, Mus musculus
cagtaaagattgctgctagagcatg

SEQ ID NO: 230901 - DNA, 25 bp, Mus musculus
cagtaaagcagtggtggcagcaata

SEQ ID NO: 230902 - DNA, 25 bp, Mus musculus
cagtaaagcagttttcctttggaat

SEQ ID NO: 230903 - DNA, 25 bp, Mus musculus
cagtaaagcttgtgaaggcgctggt

SEQ ID NO: 230904 - DNA, 25 bp, Mus musculus
cagtaaatccaaactttatgatggt

SEQ ID NO: 230905 - DNA, 25 bp, Mus musculus
cagtaaatggaagatcaagatcgcg

SEQ ID NO: 230906 - DNA, 25 bp, Mus musculus
cagtaacaacggcctcagcatcctc

SEQ ID NO: 230907 - DNA, 25 bp, Mus musculus
cagtaacaagaggcttcccgaggag

SEQ ID NO: 230908 - DNA, 25 bp, Mus musculus
cagtaacaagcaaggaatccaagtg

SEQ ID NO: 230909 - DNA, 25 bp, Mus musculus
cagtaacaagcttcttaaccccaac

SEQ ID NO: 230910 - DNA, 25 bp, Mus musculus
cagtaacagaggtgataagatttcc

SEQ ID NO: 230911 - DNA, 25 bp, Mus musculus
cagtaacagagttgacagttcctca

SEQ ID NO: 230912 - DNA, 25 bp, Mus musculus
cagtaaccacatccctccctccaaa

SEQ ID NO: 230913 - DNA, 25 bp, Mus musculus
cagtaaccatccttcttgctttgta

SEQ ID NO: 230914 - DNA, 25 bp, Mus musculus
cagtaacgtgtgctgccatgctttc

SEQ ID NO: 230915 - DNA, 25 bp, Mus musculus
cagtaactgaaggtgtccactccca

SEQ ID NO: 230916 - DNA, 25 bp, Mus musculus
cagtaagaaccgggacactcttctc

SEQ ID NO: 230917 - DNA, 25 bp, Mus musculus
cagtaagaaggaattagaaagtaaa

SEQ ID NO: 230918 - DNA, 25 bp, Mus musculus
cagtaagaaggaggataaaattcag

SEQ ID NO: 230919 - DNA, 25 bp, Mus musculus
cagtaagaaggtggaggagcctgcg

SEQ ID NO: 230920 - DNA, 25 bp, Mus musculus
cagtaagaaggtggagtacctctac

SEQ ID NO: 230921 - DNA, 25 bp, Mus musculus
cagtaagaccgtggtaaatgtttca

SEQ ID NO: 230922 - DNA, 25 bp, Mus musculus
cagtaagcagataaggatgaatgtt

SEQ ID NO: 230923 - DNA, 25 bp, Mus musculus
cagtaagcagcttaacaggagcatt

SEQ ID NO: 230924 - DNA, 25 bp, Mus musculus
cagtaagcatcagttcagaaaccaa

SEQ ID NO: 230925 - DNA, 25 bp, Mus musculus
cagtaagccagaccactgagcaagt

SEQ ID NO: 230926 - DNA, 25 bp, Mus musculus
cagtaagcggtgggtacagtcctca

SEQ ID NO: 230927 - DNA, 25 bp, Mus musculus
cagtaaggaaactctcggtgccatg

SEQ ID NO: 230928 - DNA, 25 bp, Mus musculus
cagtaagggacaagcctacacaggt

SEQ ID NO: 230929 - DNA, 25 bp, Mus musculus
cagtaagtacagttgatacactaaa

SEQ ID NO: 230930 - DNA, 25 bp, Mus musculus
cagtaagtacttgaagcatgcctca

SEQ ID NO: 230931 - DNA, 25 bp, Mus musculus
cagtaagtatgataggctgggcttc

SEQ ID NO: 230932 - DNA, 25 bp, Mus musculus
cagtaagtcaggaggatcgcaagtc

SEQ ID NO: 230933 - DNA, 25 bp, Mus musculus
cagtaagtctatatggagacaccaa

SEQ ID NO: 230934 - DNA, 25 bp, Mus musculus
cagtaataagtgcgtgaagactcta

SEQ ID NO: 230935 - DNA, 25 bp, Mus musculus
cagtaatacattcaaactacaactc

SEQ ID NO: 230936 - DNA, 25 bp, Mus musculus
cagtaatataccaagtgtcctggtt

SEQ ID NO: 230937 - DNA, 25 bp, Mus musculus
cagtaatataccaatgtctcttgga

SEQ ID NO: 230938 - DNA, 25 bp, Mus musculus
cagtaatcctccaatcactgttaag

SEQ ID NO: 230939 - DNA, 25 bp, Mus musculus
cagtaatgcaacgtttcagtctaca

SEQ ID NO: 230940 - DNA, 25 bp, Mus musculus
cagtaatgcaacgtttcagtctgaa

SEQ ID NO: 230941 - DNA, 25 bp, Mus musculus
cagtaatgtgaagctgcagcctgtc

SEQ ID NO: 230942 - DNA, 25 bp, Mus musculus
cagtaatgtgaaggcaaagcccatg

SEQ ID NO: 230943 - DNA, 25 bp, Mus musculus
cagtaattatggatgggatcagtca

SEQ ID NO: 230944 - DNA, 25 bp, Mus musculus
cagtaattccgaaatcaacatgcag

SEQ ID NO: 230945 - DNA, 25 bp, Mus musculus
cagtaattccgagtcctgaagaaag

SEQ ID NO: 230946 - DNA, 25 bp, Mus musculus
cagtacaaacctctttctcatcatt

SEQ ID NO: 230947 - DNA, 25 bp, Mus musculus
cagtacaaagcccagcacctcaccc

SEQ ID NO: 230948 - DNA, 25 bp, Mus musculus
cagtacaaagctgtcttgatatttg

SEQ ID NO: 230949 - DNA, 25 bp, Mus musculus
cagtacaaaggacaaagccaaagtt

SEQ ID NO: 230950 - DNA, 25 bp, Mus musculus
cagtacaaagggaagtgtggtcccc

SEQ ID NO: 230951 - DNA, 25 bp, Mus musculus
cagtacaaaggggaagttccaggat

SEQ ID NO: 230952 - DNA, 25 bp, Mus musculus
cagtacaaaggggaccatggaactg

SEQ ID NO: 230953 - DNA, 25 bp, Mus musculus
cagtacaaaggtgtctcttgctcaa

SEQ ID NO: 230954 - DNA, 25 bp, Mus musculus
cagtacaaaggtgtggtatcagtac

SEQ ID NO: 230955 - DNA, 25 bp, Mus musculus
cagtacaaatagcagattttggagt

SEQ ID NO: 230956 - DNA, 25 bp, Mus musculus
cagtacaaggagcttcctccaatgc

SEQ ID NO: 230957 - DNA, 25 bp, Mus musculus
cagtacaatcctgatttgtactgtg

SEQ ID NO: 230958 - DNA, 25 bp, Mus musculus
cagtacaatgagaaaaaaagacatg

SEQ ID NO: 230959 - DNA, 25 bp, Mus musculus
cagtacaatgagattctgatatctg

SEQ ID NO: 230960 - DNA, 25 bp, Mus musculus
cagtacaatgagattctgcacactt

SEQ ID NO: 230961 - DNA, 25 bp, Mus musculus
cagtacacagtgagagttcgatgcc

SEQ ID NO: 230962 - DNA, 25 bp, Mus musculus
cagtacagaagagacaggtgagaac

SEQ ID NO: 230963 - DNA, 25 bp, Mus musculus
cagtacagaatactgtaataccaga

SEQ ID NO: 230964 - DNA, 25 bp, Mus musculus
cagtacagaggctttttcagggctg

SEQ ID NO: 230965 - DNA, 25 bp, Mus musculus
cagtacagaggtctatggccagcct

SEQ ID NO: 230966 - DNA, 25 bp, Mus musculus
cagtacagccaggtgaccgagctga

SEQ ID NO: 230967 - DNA, 25 bp, Mus musculus
cagtacaggattagtttccttttag

SEQ ID NO: 230968 - DNA, 25 bp, Mus musculus
cagtacattacgatgagactgaggc

SEQ ID NO: 230969 - DNA, 25 bp, Mus musculus
cagtacattacggctgagcgggagc

SEQ ID NO: 230970 - DNA, 25 bp, Mus musculus
cagtaccaagacaaagcctatttct

SEQ ID NO: 230971 - DNA, 25 bp, Mus musculus
cagtaccaaggacctgtgttacatt

SEQ ID NO: 230972 - DNA, 25 bp, Mus musculus
cagtaccaaggtgagactctgctgc

SEQ ID NO: 230973 - DNA, 25 bp, Mus musculus
cagtaccacttgcagacaaatgaat

SEQ ID NO: 230974 - DNA, 25 bp, Mus musculus
cagtaccagttgtcgccctttaacc

SEQ ID NO: 230975 - DNA, 25 bp, Mus musculus
cagtaccatgtgcaggacccaaggc

SEQ ID NO: 230976 - DNA, 25 bp, Mus musculus
cagtacccaggacactgtggtcacc

SEQ ID NO: 230977 - DNA, 25 bp, Mus musculus
cagtacccaggtctgtgaactcgtc

SEQ ID NO: 230978 - DNA, 25 bp, Mus musculus
cagtacccatcaactaattgtcaac

SEQ ID NO: 230979 - DNA, 25 bp, Mus musculus
cagtacccatcaagccaccctgtat

SEQ ID NO: 230980 - DNA, 25 bp, Mus musculus
cagtaccctcggcgcttgttctcta

SEQ ID NO: 230981 - DNA, 25 bp, Mus musculus
cagtaccgagaggtcgactcatgga

SEQ ID NO: 230982 - DNA, 25 bp, Mus musculus
cagtacctcccaagccggccgttga

SEQ ID NO: 230983 - DNA, 25 bp, Mus musculus
cagtacctcccagtactgggtacag

SEQ ID NO: 230984 - DNA, 25 bp, Mus musculus
cagtacctgaagggaaccccaatat

SEQ ID NO: 230985 - DNA, 25 bp, Mus musculus
cagtacctgaaggtggagagctgtg

SEQ ID NO: 230986 - DNA, 25 bp, Mus musculus
cagtacctggaccagaggagcccca

SEQ ID NO: 230987 - DNA, 25 bp, Mus musculus
cagtacctggaccagcaacagtatc

SEQ ID NO: 230988 - DNA, 25 bp, Mus musculus
cagtacctggagcaatcaaagtatc

SEQ ID NO: 230989 - DNA, 25 bp, Mus musculus
cagtacctggagggcctgttcttct

SEQ ID NO: 230990 - DNA, 25 bp, Mus musculus
cagtaccttcgctaggtatatatgg

SEQ ID NO: 230991 - DNA, 25 bp, Mus musculus
cagtactagttaagtgcctgaagac

SEQ ID NO: 230992 - DNA, 25 bp, Mus musculus
cagtactatggggatgtctgtgtta

SEQ ID NO: 230993 - DNA, 25 bp, Mus musculus
cagtactcacccaagctatgagctt

SEQ ID NO: 230994 - DNA, 25 bp, Mus musculus
cagtactcacctagagtggaccaga

SEQ ID NO: 230995 - DNA, 25 bp, Mus musculus
cagtactcgatggcggagaggtgtc

SEQ ID NO: 230996 - DNA, 25 bp, Mus musculus
cagtactcgatggcggagagtgagg

SEQ ID NO: 230997 - DNA, 25 bp, Mus musculus
cagtactgactcaggctctggggga

SEQ ID NO: 230998 - DNA, 25 bp, Mus musculus
cagtactgactcagtatgaagagcg

SEQ ID NO: 230999 - DNA, 25 bp, Mus musculus
cagtactgctgtacggtagcagata

SEQ ID NO: 231000 - DNA, 25 bp, Mus musculus
cagtactgctgtacgtgagtcagcc

SEQ ID NO: 231001 - DNA, 25 bp, Mus musculus
cagtactgtcacagatgcaggagac

SEQ ID NO: 231002 - DNA, 25 bp, Mus musculus
cagtactgtcacaggtctggggctt

SEQ ID NO: 231003 - DNA, 25 bp, Mus musculus
cagtactgtgaaagagttgttattt

SEQ ID NO: 231004 - DNA, 25 bp, Mus musculus
cagtactgtgaaagatatgaatttg

SEQ ID NO: 231005 - DNA, 25 bp, Mus musculus
cagtacttagcactcctacagcaga

SEQ ID NO: 231006 - DNA, 25 bp, Mus musculus
cagtacttagcactttatttgcagc

SEQ ID NO: 231007 - DNA, 25 bp, Mus musculus
cagtacttcaagagcctgcacaggt

SEQ ID NO: 231008 - DNA, 25 bp, Mus musculus
cagtacttgacaggttcttgtctgg

SEQ ID NO: 231009 - DNA, 25 bp, Mus musculus
cagtacttggggccttttgctcgag

SEQ ID NO: 231010 - DNA, 25 bp, Mus musculus
cagtacttgggtctgacaagatgta

SEQ ID NO: 231011 - DNA, 25 bp, Mus musculus
cagtactttgtgacaggtgtgtgcg

SEQ ID NO: 231012 - DNA, 25 bp, Mus musculus
cagtacttttgaattaggacgagtc

SEQ ID NO: 231013 - DNA, 25 bp, Mus musculus
cagtacttttgaattgttcctgtga

SEQ ID NO: 231014 - DNA, 25 bp, Mus musculus
cagtacttttgggggagctgaagaa

SEQ ID NO: 231015 - DNA, 25 bp, Mus musculus
cagtagaacaagagactaagtctgg

SEQ ID NO: 231016 - DNA, 25 bp, Mus musculus
cagtagaacaagtatcatctcagag

SEQ ID NO: 231017 - DNA, 25 bp, Mus musculus
cagtagaagagctgccctctgaagc

SEQ ID NO: 231018 - DNA, 25 bp, Mus musculus
cagtagagcagccaggacaatccca

SEQ ID NO: 231019 - DNA, 25 bp, Mus musculus
cagtagagctatcttataatctgga

SEQ ID NO: 231020 - DNA, 25 bp, Mus musculus
cagtagatgaagtgccagaaccagc

SEQ ID NO: 231021 - DNA, 25 bp, Mus musculus
cagtagcaacaagctgcgcaaacca

SEQ ID NO: 231022 - DNA, 25 bp, Mus musculus
cagtagcaagatggactgtaacaaa

SEQ ID NO: 231023 - DNA, 25 bp, Mus musculus
cagtagcaaggaggccaatgcccag

SEQ ID NO: 231024 - DNA, 25 bp, Mus musculus
cagtagcaagttgcaggaggccaat

SEQ ID NO: 231025 - DNA, 25 bp, Mus musculus
cagtagcagcccatacaatcctcct

SEQ ID NO: 231026 - DNA, 25 bp, Mus musculus
cagtagcagtgtcagtgtgcactca

SEQ ID NO: 231027 - DNA, 25 bp, Mus musculus
cagtagccaattacagaatctggga

SEQ ID NO: 231028 - DNA, 25 bp, Mus musculus
cagtagcccagggcagcgagatgat

SEQ ID NO: 231029 - DNA, 25 bp, Mus musculus
cagtagcgagccacaggttgtgttt

SEQ ID NO: 231030 - DNA, 25 bp, Mus musculus
cagtagcggaaagctgagcagcaag

SEQ ID NO: 231031 - DNA, 25 bp, Mus musculus
cagtagctcagcttcttcagctgac

SEQ ID NO: 231032 - DNA, 25 bp, Mus musculus
cagtagctcaggaatgtcaagtgaa

SEQ ID NO: 231033 - DNA, 25 bp, Mus musculus
cagtagcttaatagttgaaccaaga

SEQ ID NO: 231034 - DNA, 25 bp, Mus musculus
cagtagcttagcatggtttattgaa

SEQ ID NO: 231035 - DNA, 25 bp, Mus musculus
cagtagctttgaagaatgaagagga

SEQ ID NO: 231036 - DNA, 25 bp, Mus musculus
cagtaggcatcgagggcttcttcgg

SEQ ID NO: 231037 - DNA, 25 bp, Mus musculus
cagtaggctaccggtgatggtgtgg

SEQ ID NO: 231038 - DNA, 25 bp, Mus musculus
cagtagggaccaaggaagctcgaag

SEQ ID NO: 231039 - DNA, 25 bp, Mus musculus
cagtaggggtgggagatccgaattc

SEQ ID NO: 231040 - DNA, 25 bp, Mus musculus
cagtaggtatcagggtggactcagt

SEQ ID NO: 231041 - DNA, 25 bp, Mus musculus
cagtaggtcccttcccactgacctc

SEQ ID NO: 231042 - DNA, 25 bp, Mus musculus
cagtaggtttgtagtgagcttagcc

SEQ ID NO: 231043 - DNA, 25 bp, Mus musculus
cagtagtactagatgccaaatccga

SEQ ID NO: 231044 - DNA, 25 bp, Mus musculus
cagtagtactagttgccaaatccga

SEQ ID NO: 231045 - DNA, 25 bp, Mus musculus
cagtagtccaagagattagaatttt

SEQ ID NO: 231046 - DNA, 25 bp, Mus musculus
cagtagtccaagatgcctttgagtg

SEQ ID NO: 231047 - DNA, 25 bp, Mus musculus
cagtagtccaagtgattagaatttt

SEQ ID NO: 231048 - DNA, 25 bp, Mus musculus
cagtagtccaagttgcctttgagtg

SEQ ID NO: 231049 - DNA, 25 bp, Mus musculus
cagtagtctttcagatcctgcctca

SEQ ID NO: 231050 - DNA, 25 bp, Mus musculus
cagtagttctaaagtgtcatatttg

SEQ ID NO: 231051 - DNA, 25 bp, Mus musculus
cagtagtttgatgagtcttgattgg

SEQ ID NO: 231052 - DNA, 25 bp, Mus musculus
cagtataaaacccatacaatttgtt

SEQ ID NO: 231053 - DNA, 25 bp, Mus musculus
cagtataaaacccatccagaatgaa

SEQ ID NO: 231054 - DNA, 25 bp, Mus musculus
cagtataaccctttaatggctactg

SEQ ID NO: 231055 - DNA, 25 bp, Mus musculus
cagtataattcacagaactgggaag

SEQ ID NO: 231056 - DNA, 25 bp, Mus musculus
cagtatacatgggagactctggagg

SEQ ID NO: 231057 - DNA, 25 bp, Mus musculus
cagtatacgacaaacctgaggtctg

SEQ ID NO: 231058 - DNA, 25 bp, Mus musculus
cagtatagatgtaggcaaaagaaag

SEQ ID NO: 231059 - DNA, 25 bp, Mus musculus
cagtatagatgttggcaaaagaaag

SEQ ID NO: 231060 - DNA, 25 bp, Mus musculus
cagtatagccaggtcatccacaggt

SEQ ID NO: 231061 - DNA, 25 bp, Mus musculus
cagtatagctccccgaaagaaaagt

SEQ ID NO: 231062 - DNA, 25 bp, Mus musculus
cagtatattcttggggaacttagca

SEQ ID NO: 231063 - DNA, 25 bp, Mus musculus
cagtatattcttggggttgaatctc

SEQ ID NO: 231064 - DNA, 25 bp, Mus musculus
cagtatcacaacaagattgaggaag

SEQ ID NO: 231065 - DNA, 25 bp, Mus musculus
cagtatcacaacaaggcccatctgc

SEQ ID NO: 231066 - DNA, 25 bp, Mus musculus
cagtatcacagcctgaagctggagt

SEQ ID NO: 231067 - DNA, 25 bp, Mus musculus
cagtatcacgtgcagcacctggcca

SEQ ID NO: 231068 - DNA, 25 bp, Mus musculus
cagtatcacgtgcagggtctttcag

SEQ ID NO: 231069 - DNA, 25 bp, Mus musculus
cagtatcactgtggaatatcgttca

SEQ ID NO: 231070 - DNA, 25 bp, Mus musculus
cagtatcactgtggcaatagtaatt

SEQ ID NO: 231071 - DNA, 25 bp, Mus musculus
cagtatcagagagacaagattgagg

SEQ ID NO: 231072 - DNA, 25 bp, Mus musculus
cagtatccaaaggagtgtgcagcaa

SEQ ID NO: 231073 - DNA, 25 bp, Mus musculus
cagtatccaaagttcaattttgtgg

SEQ ID NO: 231074 - DNA, 25 bp, Mus musculus
cagtatccacaacaggtgtgagcag

SEQ ID NO: 231075 - DNA, 25 bp, Mus musculus
cagtatccacaacaggttccacccg

SEQ ID NO: 231076 - DNA, 25 bp, Mus musculus
cagtatcctgatcacatttgacaat

SEQ ID NO: 231077 - DNA, 25 bp, Mus musculus
cagtatcgaggagaaagaaaagaaa

SEQ ID NO: 231078 - DNA, 25 bp, Mus musculus
cagtatcggtaactgtgaatgcttc

SEQ ID NO: 231079 - DNA, 25 bp, Mus musculus
cagtatcggtaagtgttattgtaac

SEQ ID NO: 231080 - DNA, 25 bp, Mus musculus
cagtatcggtactaatgtctgcgac

SEQ ID NO: 231081 - DNA, 25 bp, Mus musculus
cagtatcggtactcctccaaagttt

SEQ ID NO: 231082 - DNA, 25 bp, Mus musculus
cagtatctatgcagggtgacaaggg

SEQ ID NO: 231083 - DNA, 25 bp, Mus musculus
cagtatctcctcgctcttcgaacgg

SEQ ID NO: 231084 - DNA, 25 bp, Mus musculus
cagtatcttcagtcaagacctttgg

SEQ ID NO: 231085 - DNA, 25 bp, Mus musculus
cagtatgaagttttcaggggctctc

SEQ ID NO: 231086 - DNA, 25 bp, Mus musculus
cagtatgacgttcgcctggctctca

SEQ ID NO: 231087 - DNA, 25 bp, Mus musculus
cagtatgagatgggggaatgcaccc

SEQ ID NO: 231088 - DNA, 25 bp, Mus musculus
cagtatgagatggggtcacctccaa

SEQ ID NO: 231089 - DNA, 25 bp, Mus musculus
cagtatgagcaagatccagtatgta

SEQ ID NO: 231090 - DNA, 25 bp, Mus musculus
cagtatgcaggtgtcactgaactga

SEQ ID NO: 231091 - DNA, 25 bp, Mus musculus
cagtatgcaggttgtccttgttccc

SEQ ID NO: 231092 - DNA, 25 bp, Mus musculus
cagtatggaaatagtttcttggatc

SEQ ID NO: 231093 - DNA, 25 bp, Mus musculus
cagtatggaaatgtcctaccctagg

SEQ ID NO: 231094 - DNA, 25 bp, Mus musculus
cagtatggaagtggcttggctgagt

SEQ ID NO: 231095 - DNA, 25 bp, Mus musculus
cagtatggaagtgtttgccgaagat

SEQ ID NO: 231096 - DNA, 25 bp, Mus musculus
cagtatggaagttcccagaaatcct

SEQ ID NO: 231097 - DNA, 25 bp, Mus musculus
cagtatggaattcttcctttgcagc

SEQ ID NO: 231098 - DNA, 25 bp, Mus musculus
cagtatggaccgatgggtcccaccc

SEQ ID NO: 231099 - DNA, 25 bp, Mus musculus
cagtatggaccggtgtgttcctctt

SEQ ID NO: 231100 - DNA, 25 bp, Mus musculus
cagtatggagaacaggtgagtgaaa

SEQ ID NO: 231101 - DNA, 25 bp, Mus musculus
cagtatggagacacggactatttga

SEQ ID NO: 231102 - DNA, 25 bp, Mus musculus
cagtatggagagcatcgagattgac

SEQ ID NO: 231103 - DNA, 25 bp, Mus musculus
cagtatggagatcctcaccacgatg

SEQ ID NO: 231104 - DNA, 25 bp, Mus musculus
cagtatggcatcacgggagacaatg

SEQ ID NO: 231105 - DNA, 25 bp, Mus musculus
cagtatggctgcaaaaaagcactgg

SEQ ID NO: 231106 - DNA, 25 bp, Mus musculus
cagtatggctgcaaacactcagagt

SEQ ID NO: 231107 - DNA, 25 bp, Mus musculus
cagtatggctgcaaagttgcagata

SEQ ID NO: 231108 - DNA, 25 bp, Mus musculus
cagtatgggagtcaagctgtgcaag

SEQ ID NO: 231109 - DNA, 25 bp, Mus musculus
cagtatgtattacagagtgatggcg

SEQ ID NO: 231110 - DNA, 25 bp, Mus musculus
cagtatgtattggatatgatggtta

SEQ ID NO: 231111 - DNA, 25 bp, Mus musculus
cagtatgtctcaggctgaatttgac

SEQ ID NO: 231112 - DNA, 25 bp, Mus musculus
cagtatgttgatgcaacgtgtaaca

SEQ ID NO: 231113 - DNA, 25 bp, Mus musculus
cagtatgttgatggagatcagtgtg

SEQ ID NO: 231114 - DNA, 25 bp, Mus musculus
cagtattaaaccaggtgctgtggaa

SEQ ID NO: 231115 - DNA, 25 bp, Mus musculus
cagtattacccttctagctgggggc

SEQ ID NO: 231116 - DNA, 25 bp, Mus musculus
cagtattcagatggaaaactacaga

SEQ ID NO: 231117 - DNA, 25 bp, Mus musculus
cagtattccctacagaactcttgag

SEQ ID NO: 231118 - DNA, 25 bp, Mus musculus
cagtattccctacagcctgcccact

SEQ ID NO: 231119 - DNA, 25 bp, Mus musculus
cagtattcctgggggttcggcagac

SEQ ID NO: 231120 - DNA, 25 bp, Mus musculus
cagtattctacagcccaggagtgtt

SEQ ID NO: 231121 - DNA, 25 bp, Mus musculus
cagtattctacagctcaagactgca

SEQ ID NO: 231122 - DNA, 25 bp, Mus musculus
cagtattctacagctgaggaatgtg

SEQ ID NO: 231123 - DNA, 25 bp, Mus musculus
cagtattgaggagaaacgaaaccca

SEQ ID NO: 231124 - DNA, 25 bp, Mus musculus
cagtattggcaagaaccgagctcaa

SEQ ID NO: 231125 - DNA, 25 bp, Mus musculus
cagtattggcaagagtccagaaaac

SEQ ID NO: 231126 - DNA, 25 bp, Mus musculus
cagtatttaccaagcgctgatcctg

SEQ ID NO: 231127 - DNA, 25 bp, Mus musculus
cagtatttaccaaggaggcatcctc

SEQ ID NO: 231128 - DNA, 25 bp, Mus musculus
cagtatttcaggagcctctttcaga

SEQ ID NO: 231129 - DNA, 25 bp, Mus musculus
cagtatttcaggcaggcaaccttca

SEQ ID NO: 231130 - DNA, 25 bp, Mus musculus
cagtatttcccaggtgcggggtcct

SEQ ID NO: 231131 - DNA, 25 bp, Mus musculus
cagtcaaaaatctggtagtgcaact

SEQ ID NO: 231132 - DNA, 25 bp, Mus musculus
cagtcaaaatgtcaggttctggcac

SEQ ID NO: 231133 - DNA, 25 bp, Mus musculus
cagtcaaacagtggcttgcattgtt

SEQ ID NO: 231134 - DNA, 25 bp, Mus musculus
cagtcaaacagtggtattttaacag

SEQ ID NO: 231135 - DNA, 25 bp, Mus musculus
cagtcaaagaatgtcccctatatat

SEQ ID NO: 231136 - DNA, 25 bp, Mus musculus
cagtcaaagagaaacaaagcaaacc

SEQ ID NO: 231137 - DNA, 25 bp, Mus musculus
cagtcaaatcagatgcccccacgac

SEQ ID NO: 231138 - DNA, 25 bp, Mus musculus
cagtcaacagcccgaaaagcgactc

SEQ ID NO: 231139 - DNA, 25 bp, Mus musculus
cagtcaacagcccgacgtatgtttc

SEQ ID NO: 231140 - DNA, 25 bp, Mus musculus
cagtcaacttacagaactatgtaga

SEQ ID NO: 231141 - DNA, 25 bp, Mus musculus
cagtcaacttacagcatctgctggt

SEQ ID NO: 231142 - DNA, 25 bp, Mus musculus
cagtcaagaaagcctgtaccccagt

SEQ ID NO: 231143 - DNA, 25 bp, Mus musculus
cagtcaagaaaggacatctgatttg

SEQ ID NO: 231144 - DNA, 25 bp, Mus musculus
cagtcaagaaagtcatcagcaggaa

SEQ ID NO: 231145 - DNA, 25 bp, Mus musculus
cagtcaagccggtgtcctgggtcat

SEQ ID NO: 231146 - DNA, 25 bp, Mus musculus
cagtcaaggaaaagagttaccgtca

SEQ ID NO: 231147 - DNA, 25 bp, Mus musculus
cagtcaaggttccaggagagacatg

SEQ ID NO: 231148 - DNA, 25 bp, Mus musculus
cagtcaagtgccgtgcagctggcct

SEQ ID NO: 231149 - DNA, 25 bp, Mus musculus
cagtcaatcagaatcagatagtaat

SEQ ID NO: 231150 - DNA, 25 bp, Mus musculus
cagtcaatcaggaatgtcaagtgaa

SEQ ID NO: 231151 - DNA, 25 bp, Mus musculus
cagtcaatcaggtacatccaaacga

SEQ ID NO: 231152 - DNA, 25 bp, Mus musculus
cagtcacactgcgagttacacttcc

SEQ ID NO: 231153 - DNA, 25 bp, Mus musculus
cagtcacactgcgggagaaagcaag

SEQ ID NO: 231154 - DNA, 25 bp, Mus musculus
cagtcacagaatgatgtgagccctg

SEQ ID NO: 231155 - DNA, 25 bp, Mus musculus
cagtcacagccccaggtggtgatga

SEQ ID NO: 231156 - DNA, 25 bp, Mus musculus
cagtcacaggttggatgaaaaatct

SEQ ID NO: 231157 - DNA, 25 bp, Mus musculus
cagtcacatccatggaaagaaagga

SEQ ID NO: 231158 - DNA, 25 bp, Mus musculus
cagtcacatccatggtcctattaaa

SEQ ID NO: 231159 - DNA, 25 bp, Mus musculus
cagtcaccagagaatagccatgatg

SEQ ID NO: 231160 - DNA, 25 bp, Mus musculus
cagtcaccagagaatgtgcccacag

SEQ ID NO: 231161 - DNA, 25 bp, Mus musculus
cagtcaccgacatgtgagccactgc

SEQ ID NO: 231162 - DNA, 25 bp, Mus musculus
cagtcaccgagagtggggagtagtc

SEQ ID NO: 231163 - DNA, 25 bp, Mus musculus
cagtcaccgccaccccgggacccac

SEQ ID NO: 231164 - DNA, 25 bp, Mus musculus
cagtcaccgccggcccagtgctcca

SEQ ID NO: 231165 - DNA, 25 bp, Mus musculus
cagtcaccgcctaatagggcccagt

SEQ ID NO: 231166 - DNA, 25 bp, Mus musculus
cagtcacgctcaatgagaagccctt

SEQ ID NO: 231167 - DNA, 25 bp, Mus musculus
cagtcacggaggcctcctctgtcac

SEQ ID NO: 231168 - DNA, 25 bp, Mus musculus
cagtcacggcccaaggggtttcctg

SEQ ID NO: 231169 - DNA, 25 bp, Mus musculus
cagtcactaagttgaaacactaatt

SEQ ID NO: 231170 - DNA, 25 bp, Mus musculus
cagtcactaagttgtcccgagttta

SEQ ID NO: 231171 - DNA, 25 bp, Mus musculus
cagtcactaccaggtgcagacccac

SEQ ID NO: 231172 - DNA, 25 bp, Mus musculus
cagtcactatgtgctgtgagtggct

SEQ ID NO: 231173 - DNA, 25 bp, Mus musculus
cagtcactcacatctgtgtctgata

SEQ ID NO: 231174 - DNA, 25 bp, Mus musculus
cagtcactcacatcttcttcccttt

SEQ ID NO: 231175 - DNA, 25 bp, Mus musculus
cagtcactgcacagcccatcgtttc

SEQ ID NO: 231176 - DNA, 25 bp, Mus musculus
cagtcactgcaggaagtatttgtag

SEQ ID NO: 231177 - DNA, 25 bp, Mus musculus
cagtcactgctaggtatggcactgc

SEQ ID NO: 231178 - DNA, 25 bp, Mus musculus
cagtcacttgtacatggtgctctag

SEQ ID NO: 231179 - DNA, 25 bp, Mus musculus
cagtcactttcctaaccgcacagac

SEQ ID NO: 231180 - DNA, 25 bp, Mus musculus
cagtcactttcctaccagcaatgcc

SEQ ID NO: 231181 - DNA, 25 bp, Mus musculus
cagtcactttcgtgggagccacata

SEQ ID NO: 231182 - DNA, 25 bp, Mus musculus
cagtcagaagccggagcctggcgac

SEQ ID NO: 231183 - DNA, 25 bp, Mus musculus
cagtcagacgatgagatggaactgg

SEQ ID NO: 231184 - DNA, 25 bp, Mus musculus
cagtcagagagaacgtgaggctaag

SEQ ID NO: 231185 - DNA, 25 bp, Mus musculus
cagtcagagagactcaagaacgtga

SEQ ID NO: 231186 - DNA, 25 bp, Mus musculus
cagtcagagcaagcatcgctgccat

SEQ ID NO: 231187 - DNA, 25 bp, Mus musculus
cagtcagagcaagcctggctgtttt

SEQ ID NO: 231188 - DNA, 25 bp, Mus musculus
cagtcagagccacgaaggagattct

SEQ ID NO: 231189 - DNA, 25 bp, Mus musculus
cagtcagagccggcttcggagttgg

SEQ ID NO: 231190 - DNA, 25 bp, Mus musculus
cagtcagcaaacaaaaccgggggtg

SEQ ID NO: 231191 - DNA, 25 bp, Mus musculus
cagtcagcaaccaccctcccctgat

SEQ ID NO: 231192 - DNA, 25 bp, Mus musculus
cagtcagcaagggtattcttcagta

SEQ ID NO: 231193 - DNA, 25 bp, Mus musculus
cagtcagcacaaactacagctgtgg

SEQ ID NO: 231194 - DNA, 25 bp, Mus musculus
cagtcagcacaactcctccagtgcc

SEQ ID NO: 231195 - DNA, 25 bp, Mus musculus
cagtcagccaggttcaataagcact

SEQ ID NO: 231196 - DNA, 25 bp, Mus musculus
cagtcagccccaacatccagaaccc

SEQ ID NO: 231197 - DNA, 25 bp, Mus musculus
cagtcagctcagaccctgctggaca

SEQ ID NO: 231198 - DNA, 25 bp, Mus musculus
cagtcagctcagctttgcggagcct

SEQ ID NO: 231199 - DNA, 25 bp, Mus musculus
cagtcagctgacactgtagctcagt

SEQ ID NO: 231200 - DNA, 25 bp, Mus musculus
cagtcaggacttgctagacctgatg

SEQ ID NO: 231201 - DNA, 25 bp, Mus musculus
cagtcaggctggagtgacgagtatc

SEQ ID NO: 231202 - DNA, 25 bp, Mus musculus
cagtcaggtggaggctgcctccact

SEQ ID NO: 231203 - DNA, 25 bp, Mus musculus
cagtcagtacagcaaacaattggga

SEQ ID NO: 231204 - DNA, 25 bp, Mus musculus
cagtcagtacaggttcatcgttttt

SEQ ID NO: 231205 - DNA, 25 bp, Mus musculus
cagtcagtacctaccgtgctgtgcg

SEQ ID NO: 231206 - DNA, 25 bp, Mus musculus
cagtcagtacctagatcgacagctg

SEQ ID NO: 231207 - DNA, 25 bp, Mus musculus
cagtcagtattacccttctagctgg

SEQ ID NO: 231208 - DNA, 25 bp, Mus musculus
cagtcagtcttacaatacggactct

SEQ ID NO: 231209 - DNA, 25 bp, Mus musculus
cagtcagttaaaagaaggtaccagg

SEQ ID NO: 231210 - DNA, 25 bp, Mus musculus
cagtcagttcagcttcaattagtgg

SEQ ID NO: 231211 - DNA, 25 bp, Mus musculus
cagtcagttgggagaccgtaccacc

SEQ ID NO: 231212 - DNA, 25 bp, Mus musculus
cagtcagttgggagcttgcactagc

SEQ ID NO: 231213 - DNA, 25 bp, Mus musculus
cagtcatacagaaccatgaccatcc

SEQ ID NO: 231214 - DNA, 25 bp, Mus musculus
cagtcatacagtccagacaagacat

SEQ ID NO: 231215 - DNA, 25 bp, Mus musculus
cagtcatccccgatgatcatcccct

SEQ ID NO: 231216 - DNA, 25 bp, Mus musculus
cagtcatcctgtgagttgggtgcaa

SEQ ID NO: 231217 - DNA, 25 bp, Mus musculus
cagtcatcttgatcgactgcgggct

SEQ ID NO: 231218 - DNA, 25 bp, Mus musculus
cagtcatgagaacacaaattgaagt

SEQ ID NO: 231219 - DNA, 25 bp, Mus musculus
cagtcattgggaagactcttcaaga

SEQ ID NO: 231220 - DNA, 25 bp, Mus musculus
cagtcatttgttcgggaacctttgc

SEQ ID NO: 231221 - DNA, 25 bp, Mus musculus
cagtcatttgttcgggcttacggtg

SEQ ID NO: 231222 - DNA, 25 bp, Mus musculus
cagtccaaaagagtacacacgaagg

SEQ ID NO: 231223 - DNA, 25 bp, Mus musculus
cagtccaaagctgctcagccatctc

SEQ ID NO: 231224 - DNA, 25 bp, Mus musculus
cagtccaacgaaaggtaacatttca

SEQ ID NO: 231225 - DNA, 25 bp, Mus musculus
cagtccaagatatgagaaccacagt

SEQ ID NO: 231226 - DNA, 25 bp, Mus musculus
cagtccaagattgcccaatgatcca

SEQ ID NO: 231227 - DNA, 25 bp, Mus musculus
cagtccaagcacgccgcagcagcct

SEQ ID NO: 231228 - DNA, 25 bp, Mus musculus
cagtccaagcacggggacagcttcg

SEQ ID NO: 231229 - DNA, 25 bp, Mus musculus
cagtccaagctgaaggaccaagtct

SEQ ID NO: 231230 - DNA, 25 bp, Mus musculus
cagtccaagtataaggtggctctcg

SEQ ID NO: 231231 - DNA, 25 bp, Mus musculus
cagtccaattcagccaccagcacag

SEQ ID NO: 231232 - DNA, 25 bp, Mus musculus
cagtccaattcaggcatggtccagg

SEQ ID NO: 231233 - DNA, 25 bp, Mus musculus
cagtccacacccagcacaggtccct

SEQ ID NO: 231234 - DNA, 25 bp, Mus musculus
cagtccacagccattcctgcgccca

SEQ ID NO: 231235 - DNA, 25 bp, Mus musculus
cagtccaccatgctgatggggattg

SEQ ID NO: 231236 - DNA, 25 bp, Mus musculus
cagtccactgactttaactggtaca

SEQ ID NO: 231237 - DNA, 25 bp, Mus musculus
cagtccagagcgcctccccatctgc

SEQ ID NO: 231238 - DNA, 25 bp, Mus musculus
cagtccagcgagtgtgctagaggct

SEQ ID NO: 231239 - DNA, 25 bp, Mus musculus
cagtccagctccaagttatctccag

SEQ ID NO: 231240 - DNA, 25 bp, Mus musculus
cagtccagttcgataccgttcctgt

SEQ ID NO: 231241 - DNA, 25 bp, Mus musculus
cagtccagttcgatttgatatcctt

SEQ ID NO: 231242 - DNA, 25 bp, Mus musculus
cagtccatcaccaagaacaagaaaa

SEQ ID NO: 231243 - DNA, 25 bp, Mus musculus
cagtccatgcaaacggtgttcaata

SEQ ID NO: 231244 - DNA, 25 bp, Mus musculus
cagtccatggagagattgatcctgt

SEQ ID NO: 231245 - DNA, 25 bp, Mus musculus
cagtccattaggctcttctgcgatg

SEQ ID NO: 231246 - DNA, 25 bp, Mus musculus
cagtccattccagaggcattaaaag

SEQ ID NO: 231247 - DNA, 25 bp, Mus musculus
cagtccattgaggcgcccttgacag

SEQ ID NO: 231248 - DNA, 25 bp, Mus musculus
cagtccattgtaatctcagatggaa

SEQ ID NO: 231249 - DNA, 25 bp, Mus musculus
cagtcccagaatatgaccccagcag

SEQ ID NO: 231250 - DNA, 25 bp, Mus musculus
cagtcccagaatatgcgatgatccc

SEQ ID NO: 231251 - DNA, 25 bp, Mus musculus
cagtcccagcagactgagcaagagc

SEQ ID NO: 231252 - DNA, 25 bp, Mus musculus
cagtcccagcagagtgatggttgcc

SEQ ID NO: 231253 - DNA, 25 bp, Mus musculus
cagtcccagcaggacatggatttga

SEQ ID NO: 231254 - DNA, 25 bp, Mus musculus
cagtcccaggaggatctcccagaag

SEQ ID NO: 231255 - DNA, 25 bp, Mus musculus
cagtccccacgggcactatgaacga

SEQ ID NO: 231256 - DNA, 25 bp, Mus musculus
cagtcccccctagccagcggaaggt

SEQ ID NO: 231257 - DNA, 25 bp, Mus musculus
cagtcccccctcaggacattcagag

SEQ ID NO: 231258 - DNA, 25 bp, Mus musculus
cagtcccccctgaatgggtccctat

SEQ ID NO: 231259 - DNA, 25 bp, Mus musculus
cagtcccccgcaagcctcctggagg

SEQ ID NO: 231260 - DNA, 25 bp, Mus musculus
cagtccccctactgtgacagatacg

SEQ ID NO: 231261 - DNA, 25 bp, Mus musculus
cagtcccgaagatccgcctccgact

SEQ ID NO: 231262 - DNA, 25 bp, Mus musculus
cagtcccgatgaagaactaagtgga

SEQ ID NO: 231263 - DNA, 25 bp, Mus musculus
cagtcccgatgaagaatggataacg

SEQ ID NO: 231264 - DNA, 25 bp, Mus musculus
cagtccctgcaggtgaagaagactc

SEQ ID NO: 231265 - DNA, 25 bp, Mus musculus
cagtccctggcggttcacaagagca

SEQ ID NO: 231266 - DNA, 25 bp, Mus musculus
cagtccgcaggtctttggccagtat

SEQ ID NO: 231267 - DNA, 25 bp, Mus musculus
cagtccggggaccgaaagtctcctg

SEQ ID NO: 231268 - DNA, 25 bp, Mus musculus
cagtccgtgctcaaatgagaaaagt

SEQ ID NO: 231269 - DNA, 25 bp, Mus musculus
cagtccgtgctcaagatcaaagaag

SEQ ID NO: 231270 - DNA, 25 bp, Mus musculus
cagtcctaaatggtggccctccgag

SEQ ID NO: 231271 - DNA, 25 bp, Mus musculus
cagtcctaacacttccagaaactca

SEQ ID NO: 231272 - DNA, 25 bp, Mus musculus
cagtcctacaggtttgttaagaagt

SEQ ID NO: 231273 - DNA, 25 bp, Mus musculus
cagtcctacagtgtctacagctacc

SEQ ID NO: 231274 - DNA, 25 bp, Mus musculus
cagtcctagaaaaccaaactgcagc

SEQ ID NO: 231275 - DNA, 25 bp, Mus musculus
cagtcctagaggccgggataactgg

SEQ ID NO: 231276 - DNA, 25 bp, Mus musculus
cagtcctatggcagtaccagtgaca

SEQ ID NO: 231277 - DNA, 25 bp, Mus musculus
cagtcctcagaagagcatggcagaa

SEQ ID NO: 231278 - DNA, 25 bp, Mus musculus
cagtcctcagaagcatggtgtgctc

SEQ ID NO: 231279 - DNA, 25 bp, Mus musculus
cagtcctcagatgcggtgagcaccc

SEQ ID NO: 231280 - DNA, 25 bp, Mus musculus
cagtcctcaggttctaagcgcagca

SEQ ID NO: 231281 - DNA, 25 bp, Mus musculus
cagtcctccccagaaatagatgaag

SEQ ID NO: 231282 - DNA, 25 bp, Mus musculus
cagtcctcctaaggtgatcttagtg

SEQ ID NO: 231283 - DNA, 25 bp, Mus musculus
cagtcctcctaagtggagggcagca

SEQ ID NO: 231284 - DNA, 25 bp, Mus musculus
cagtcctcgaggagatcccagccat

SEQ ID NO: 231285 - DNA, 25 bp, Mus musculus
cagtcctcggaggagtatatatcct

SEQ ID NO: 231286 - DNA, 25 bp, Mus musculus
cagtcctgactatgccacctgctcc

SEQ ID NO: 231287 - DNA, 25 bp, Mus musculus
cagtcctgaggacagagaaagagct

SEQ ID NO: 231288 - DNA, 25 bp, Mus musculus
cagtcctgattctttaagaaataga

SEQ ID NO: 231289 - DNA, 25 bp, Mus musculus
cagtcctgcagagtagagctctggc

SEQ ID NO: 231290 - DNA, 25 bp, Mus musculus
cagtcctgcagatcgtcctgcttct

SEQ ID NO: 231291 - DNA, 25 bp, Mus musculus
cagtcctgcagccctctctccttct

SEQ ID NO: 231292 - DNA, 25 bp, Mus musculus
cagtcctgcccagctcaatggtggc

SEQ ID NO: 231293 - DNA, 25 bp, Mus musculus
cagtcctgcccaggatggcagtacc

SEQ ID NO: 231294 - DNA, 25 bp, Mus musculus
cagtcctggcagactgtaccatcaa

SEQ ID NO: 231295 - DNA, 25 bp, Mus musculus
cagtcctggcagagacagagatggg

SEQ ID NO: 231296 - DNA, 25 bp, Mus musculus
cagtcctggccgccaagttgaagtt

SEQ ID NO: 231297 - DNA, 25 bp, Mus musculus
cagtcctgggttaaggagagcacac

SEQ ID NO: 231298 - DNA, 25 bp, Mus musculus
cagtcctggtgaactgtccatccaa

SEQ ID NO: 231299 - DNA, 25 bp, Mus musculus
cagtcctggtggtccccagcaggcc

SEQ ID NO: 231300 - DNA, 25 bp, Mus musculus
cagtcctgtcctcagggaccgcagc

SEQ ID NO: 231301 - DNA, 25 bp, Mus musculus
cagtcctgtcctcagggccttcagg

SEQ ID NO: 231302 - DNA, 25 bp, Mus musculus
cagtcctgtggtagaagaaagacca

SEQ ID NO: 231303 - DNA, 25 bp, Mus musculus
cagtcctgttcagcaccaacaccac

SEQ ID NO: 231304 - DNA, 25 bp, Mus musculus
cagtcctgttcagcaccatcagcac

SEQ ID NO: 231305 - DNA, 25 bp, Mus musculus
cagtccttggcagcaggaggagcca

SEQ ID NO: 231306 - DNA, 25 bp, Mus musculus
cagtcctttctggtgtccgccgatg

SEQ ID NO: 231307 - DNA, 25 bp, Mus musculus
cagtcctttgagattgagcgtcacg

SEQ ID NO: 231308 - DNA, 25 bp, Mus musculus
cagtcgaaagaggcagacatcgact

SEQ ID NO: 231309 - DNA, 25 bp, Mus musculus
cagtcgaaaggcaagaagcgaaacc

SEQ ID NO: 231310 - DNA, 25 bp, Mus musculus
cagtcgcagcagaaactggaggtac

SEQ ID NO: 231311 - DNA, 25 bp, Mus musculus
cagtcgcagcagctaacagagaagt

SEQ ID NO: 231312 - DNA, 25 bp, Mus musculus
cagtcgcattcgaagagccaccgaa

SEQ ID NO: 231313 - DNA, 25 bp, Mus musculus
cagtcgcattcgatgaaatcgtgga

SEQ ID NO: 231314 - DNA, 25 bp, Mus musculus
cagtcgcccaaaagacctagtggtt

SEQ ID NO: 231315 - DNA, 25 bp, Mus musculus
cagtcgcccctgaagatggagagaa

SEQ ID NO: 231316 - DNA, 25 bp, Mus musculus
cagtcgcccgggaggcgctggcggt

SEQ ID NO: 231317 - DNA, 25 bp, Mus musculus
cagtcgctcctatggcatgtgggca

SEQ ID NO: 231318 - DNA, 25 bp, Mus musculus
cagtcgctgttacggaggcgaagag

SEQ ID NO: 231319 - DNA, 25 bp, Mus musculus
cagtcgctgttacgggctgtgacaa

SEQ ID NO: 231320 - DNA, 25 bp, Mus musculus
cagtcgcttgcaaggttcctgtccc

SEQ ID NO: 231321 - DNA, 25 bp, Mus musculus
cagtcgcttgcaagtgtgacttgga

SEQ ID NO: 231322 - DNA, 25 bp, Mus musculus
cagtcggaccagatggtgacttgcc

SEQ ID NO: 231323 - DNA, 25 bp, Mus musculus
cagtcggagaaaagggagaacctgg

SEQ ID NO: 231324 - DNA, 25 bp, Mus musculus
cagtcggagccatgcctcttcgact

SEQ ID NO: 231325 - DNA, 25 bp, Mus musculus
cagtcggagccatggagcatttcac

SEQ ID NO: 231326 - DNA, 25 bp, Mus musculus
cagtcggatgaggaagggcccgggg

SEQ ID NO: 231327 - DNA, 25 bp, Mus musculus
cagtcggtttaaagcggggatctga

SEQ ID NO: 231328 - DNA, 25 bp, Mus musculus
cagtcgtctcctggccagagttcca

SEQ ID NO: 231329 - DNA, 25 bp, Mus musculus
cagtcgtctcctgggacagaagatg

SEQ ID NO: 231330 - DNA, 25 bp, Mus musculus
cagtcgtgaagcgactccggccctc

SEQ ID NO: 231331 - DNA, 25 bp, Mus musculus
cagtcgtgaggtaccgaaagaaggc

SEQ ID NO: 231332 - DNA, 25 bp, Mus musculus
cagtcgttgactctggtagagcaga

SEQ ID NO: 231333 - DNA, 25 bp, Mus musculus
cagtcgtttggacttcaaatctcag

SEQ ID NO: 231334 - DNA, 25 bp, Mus musculus
cagtctaaaaaccagtcggcagacc

SEQ ID NO: 231335 - DNA, 25 bp, Mus musculus
cagtctacaatcggtggagacacag

SEQ ID NO: 231336 - DNA, 25 bp, Mus musculus
cagtctactcacaggagaaaatgct

SEQ ID NO: 231337 - DNA, 25 bp, Mus musculus
cagtctaggaaggtccttttgatag

SEQ ID NO: 231338 - DNA, 25 bp, Mus musculus
cagtctatagcacgaccccttatcc

SEQ ID NO: 231339 - DNA, 25 bp, Mus musculus
cagtctatagcacggtaacacaagt

SEQ ID NO: 231340 - DNA, 25 bp, Mus musculus
cagtctatcttggaaaagatgacga

SEQ ID NO: 231341 - DNA, 25 bp, Mus musculus
cagtctcacagccgagggttgatgc

SEQ ID NO: 231342 - DNA, 25 bp, Mus musculus
cagtctcacctggcaagatgaatat

SEQ ID NO: 231343 - DNA, 25 bp, Mus musculus
cagtctcaccttgtctgtctgcagg

SEQ ID NO: 231344 - DNA, 25 bp, Mus musculus
cagtctcagaagtcagcggctgcgt

SEQ ID NO: 231345 - DNA, 25 bp, Mus musculus
cagtctcagcagaggtggaaagtac

SEQ ID NO: 231346 - DNA, 25 bp, Mus musculus
cagtctccaagatggcggtaaatga

SEQ ID NO: 231347 - DNA, 25 bp, Mus musculus
cagtctccaggtgattggatgtgtc

SEQ ID NO: 231348 - DNA, 25 bp, Mus musculus
cagtctcccagtggtactgccaccg

SEQ ID NO: 231349 - DNA, 25 bp, Mus musculus
cagtctccgtccccagaacccgagc

SEQ ID NO: 231350 - DNA, 25 bp, Mus musculus
cagtctcctcagagagtcagtcctt

SEQ ID NO: 231351 - DNA, 25 bp, Mus musculus
cagtctcctcagagtctgcgagaaa

SEQ ID NO: 231352 - DNA, 25 bp, Mus musculus
cagtctcctcagccaaaacaacacc

SEQ ID NO: 231353 - DNA, 25 bp, Mus musculus
cagtctcctcagccaaaacaacagc

SEQ ID NO: 231354 - DNA, 25 bp, Mus musculus
cagtctcctcagccaaaacgacacc

SEQ ID NO: 231355 - DNA, 25 bp, Mus musculus
cagtctcctcagctacaacaacagc

SEQ ID NO: 231356 - DNA, 25 bp, Mus musculus
cagtctcctctcagcaaagctgttg

SEQ ID NO: 231357 - DNA, 25 bp, Mus musculus
cagtctcctggcagccaaccaatgg

SEQ ID NO: 231358 - DNA, 25 bp, Mus musculus
cagtctcctgtcagatgggattgat

SEQ ID NO: 231359 - DNA, 25 bp, Mus musculus
cagtctccttgcagagcaggcaagg

SEQ ID NO: 231360 - DNA, 25 bp, Mus musculus
cagtctcgtcacagataacatctgg

SEQ ID NO: 231361 - DNA, 25 bp, Mus musculus
cagtctcgtcacaggaatggcggcc

SEQ ID NO: 231362 - DNA, 25 bp, Mus musculus
cagtctctatcaaaggttgccgagg

SEQ ID NO: 231363 - DNA, 25 bp, Mus musculus
cagtctctcagtgcctgtgctgacc

SEQ ID NO: 231364 - DNA, 25 bp, Mus musculus
cagtctctgccaaacacaccagaag

SEQ ID NO: 231365 - DNA, 25 bp, Mus musculus
cagtctctgccaacattgtcctcgt

SEQ ID NO: 231366 - DNA, 25 bp, Mus musculus
cagtctctgcccttcaggatgagct

SEQ ID NO: 231367 - DNA, 25 bp, Mus musculus
cagtctctgggttcagacaatgaat

SEQ ID NO: 231368 - DNA, 25 bp, Mus musculus
cagtctcttcctctgctctgccttc

SEQ ID NO: 231369 - DNA, 25 bp, Mus musculus
cagtctgaaaggctccagatacctg

SEQ ID NO: 231370 - DNA, 25 bp, Mus musculus
cagtctgaatggtgggtgcaagtcc

SEQ ID NO: 231371 - DNA, 25 bp, Mus musculus
cagtctgacacagcaattaccaagg

SEQ ID NO: 231372 - DNA, 25 bp, Mus musculus
cagtctgaccgagtcagcaggacca

SEQ ID NO: 231373 - DNA, 25 bp, Mus musculus
cagtctgacctctacaagaagactc

SEQ ID NO: 231374 - DNA, 25 bp, Mus musculus
cagtctgagccgaatccaccttgac

SEQ ID NO: 231375 - DNA, 25 bp, Mus musculus
cagtctgaggaagcctaacctgacc

SEQ ID NO: 231376 - DNA, 25 bp, Mus musculus
cagtctgaggtgtcttcagaagcct

SEQ ID NO: 231377 - DNA, 25 bp, Mus musculus
cagtctgcaacagttgtttaatgaa

SEQ ID NO: 231378 - DNA, 25 bp, Mus musculus
cagtctgcagcaagccccgcccaac

SEQ ID NO: 231379 - DNA, 25 bp, Mus musculus
cagtctgcagcatgtgtgaactgtg

SEQ ID NO: 231380 - DNA, 25 bp, Mus musculus
cagtctgcataaggctgcggagaag

SEQ ID NO: 231381 - DNA, 25 bp, Mus musculus
cagtctgcggggcggttgccgctgg

SEQ ID NO: 231382 - DNA, 25 bp, Mus musculus
cagtctgctcactgggggaatgcgg

SEQ ID NO: 231383 - DNA, 25 bp, Mus musculus
cagtctggcaaaggccaaggaagta

SEQ ID NO: 231384 - DNA, 25 bp, Mus musculus
cagtctggcaggatcttgtgctgaa

SEQ ID NO: 231385 - DNA, 25 bp, Mus musculus
cagtctgggggaggaaagaccacag

SEQ ID NO: 231386 - DNA, 25 bp, Mus musculus
cagtctgtacaggttcctgcagaca

SEQ ID NO: 231387 - DNA, 25 bp, Mus musculus
cagtctgtcaagggggtggcaccga

SEQ ID NO: 231388 - DNA, 25 bp, Mus musculus
cagtctgtcctcaagtgagccccag

SEQ ID NO: 231389 - DNA, 25 bp, Mus musculus
cagtctgtgcacttagtagaaaatg

SEQ ID NO: 231390 - DNA, 25 bp, Mus musculus
cagtctgtgtccaggcttcagaaga

SEQ ID NO: 231391 - DNA, 25 bp, Mus musculus
cagtctgttagcgagttccagaata

SEQ ID NO: 231392 - DNA, 25 bp, Mus musculus
cagtcttacaatacggactctgacg

SEQ ID NO: 231393 - DNA, 25 bp, Mus musculus
cagtcttcaaaagagtgttgaagtc

SEQ ID NO: 231394 - DNA, 25 bp, Mus musculus
cagtcttcaaaagtgaggaagaaaa

SEQ ID NO: 231395 - DNA, 25 bp, Mus musculus
cagtcttcatctgactctggctcct

SEQ ID NO: 231396 - DNA, 25 bp, Mus musculus
cagtcttcccagagtttccagagtc

SEQ ID NO: 231397 - DNA, 25 bp, Mus musculus
cagtcttcctaaatctgcagaagaa

SEQ ID NO: 231398 - DNA, 25 bp, Mus musculus
cagtcttcctcagaattatctggga

SEQ ID NO: 231399 - DNA, 25 bp, Mus musculus
cagtcttcggacatagactgactct

SEQ ID NO: 231400 - DNA, 25 bp, Mus musculus
cagtcttctcgatctttgggaccat

SEQ ID NO: 231401 - DNA, 25 bp, Mus musculus
cagtcttgaactttaagaaaagatg

SEQ ID NO: 231402 - DNA, 25 bp, Mus musculus
cagtcttgaactttgcaaattgaag

SEQ ID NO: 231403 - DNA, 25 bp, Mus musculus
cagtcttgcagggtcagtcatatca

SEQ ID NO: 231404 - DNA, 25 bp, Mus musculus
cagtcttgctagcagcaatcatctg

SEQ ID NO: 231405 - DNA, 25 bp, Mus musculus
cagtcttggcagagttttgcctgtt

SEQ ID NO: 231406 - DNA, 25 bp, Mus musculus
cagtcttggctgttccttcttggag

SEQ ID NO: 231407 - DNA, 25 bp, Mus musculus
cagtcttgtggtgctagacctgaac

SEQ ID NO: 231408 - DNA, 25 bp, Mus musculus
cagtcttgtggtgctgcatctacat

SEQ ID NO: 231409 - DNA, 25 bp, Mus musculus
cagtctttaagtgccttcagtcaag

SEQ ID NO: 231410 - DNA, 25 bp, Mus musculus
cagtctttacccagcctccatagac

SEQ ID NO: 231411 - DNA, 25 bp, Mus musculus
cagtctttccgaagtctggggctat

SEQ ID NO: 231412 - DNA, 25 bp, Mus musculus
cagtgaaaaatcagggggcctgtgg

SEQ ID NO: 231413 - DNA, 25 bp, Mus musculus
cagtgaaaacctgcttgtttctggg

SEQ ID NO: 231414 - DNA, 25 bp, Mus musculus
cagtgaaacagctgggtgttaaccc

SEQ ID NO: 231415 - DNA, 25 bp, Mus musculus
cagtgaaatgtcagaaaatcaagag

SEQ ID NO: 231416 - DNA, 25 bp, Mus musculus
cagtgaaatgtctgcccagaaaaat

SEQ ID NO: 231417 - DNA, 25 bp, Mus musculus
cagtgaaccagacagctgtgccacc

SEQ ID NO: 231418 - DNA, 25 bp, Mus musculus
cagtgaaccagacaggcacctgtgc

SEQ ID NO: 231419 - DNA, 25 bp, Mus musculus
cagtgaaccggttccacttgaaaaa

SEQ ID NO: 231420 - DNA, 25 bp, Mus musculus
cagtgaactaggtggccttagacat

SEQ ID NO: 231421 - DNA, 25 bp, Mus musculus
cagtgaactgggccgctctctgcct

SEQ ID NO: 231422 - DNA, 25 bp, Mus musculus
cagtgaagagcgagatgttgaactt

SEQ ID NO: 231423 - DNA, 25 bp, Mus musculus
cagtgaagaggaggtcccccagagg

SEQ ID NO: 231424 - DNA, 25 bp, Mus musculus
cagtgaagagtcacatactcaccaa

SEQ ID NO: 231425 - DNA, 25 bp, Mus musculus
cagtgaagcaccaggtttggaaaca

SEQ ID NO: 231426 - DNA, 25 bp, Mus musculus
cagtgaagcaggcagggcattttcc

SEQ ID NO: 231427 - DNA, 25 bp, Mus musculus
cagtgaagtgataagttgcaaggtt

SEQ ID NO: 231428 - DNA, 25 bp, Mus musculus
cagtgaatcagcctcaccttcagcc

SEQ ID NO: 231429 - DNA, 25 bp, Mus musculus
cagtgaattcttggacctgagttca

SEQ ID NO: 231430 - DNA, 25 bp, Mus musculus
cagtgacaactccacagagtcattc

SEQ ID NO: 231431 - DNA, 25 bp, Mus musculus
cagtgacaagggagaattcggtggc

SEQ ID NO: 231432 - DNA, 25 bp, Mus musculus
cagtgacaagggagggaaaattgaa

SEQ ID NO: 231433 - DNA, 25 bp, Mus musculus
cagtgacaagtccagtagaggaagc

SEQ ID NO: 231434 - DNA, 25 bp, Mus musculus
cagtgacactccacacttggatgct

SEQ ID NO: 231435 - DNA, 25 bp, Mus musculus
cagtgacactccacagaagtgtaca

SEQ ID NO: 231436 - DNA, 25 bp, Mus musculus
cagtgacagtgacctggctgaagaa

SEQ ID NO: 231437 - DNA, 25 bp, Mus musculus
cagtgacagtgagagcgggtccgga

SEQ ID NO: 231438 - DNA, 25 bp, Mus musculus
cagtgaccaaccagattgagagcca

SEQ ID NO: 231439 - DNA, 25 bp, Mus musculus
cagtgaccaaccaggtcgagtgtca

SEQ ID NO: 231440 - DNA, 25 bp, Mus musculus
cagtgaccacaggacaggattatgg

SEQ ID NO: 231441 - DNA, 25 bp, Mus musculus
cagtgaccacccagatgttgccgca

SEQ ID NO: 231442 - DNA, 25 bp, Mus musculus
cagtgaccacgctgtgttgacatcc

SEQ ID NO: 231443 - DNA, 25 bp, Mus musculus
cagtgaccacggggtaaaggccgag

SEQ ID NO: 231444 - DNA, 25 bp, Mus musculus
cagtgaccagaacatcaaactgaag

SEQ ID NO: 231445 - DNA, 25 bp, Mus musculus
cagtgaccagggtgccacaactcac

SEQ ID NO: 231446 - DNA, 25 bp, Mus musculus
cagtgaccccctggcaggacactac

SEQ ID NO: 231447 - DNA, 25 bp, Mus musculus
cagtgacccggctaagcatggggag

SEQ ID NO: 231448 - DNA, 25 bp, Mus musculus
cagtgacccggtgaagacttttggc

SEQ ID NO: 231449 - DNA, 25 bp, Mus musculus
cagtgacggccctggagatggaagc

SEQ ID NO: 231450 - DNA, 25 bp, Mus musculus
cagtgacgtgggctggcgcttgttt

SEQ ID NO: 231451 - DNA, 25 bp, Mus musculus
cagtgacgtggtgggaagaggtgcc

SEQ ID NO: 231452 - DNA, 25 bp, Mus musculus
cagtgactaaaagtagtagaaggag

SEQ ID NO: 231453 - DNA, 25 bp, Mus musculus
cagtgactactttagggccatgttc

SEQ ID NO: 231454 - DNA, 25 bp, Mus musculus
cagtgactactttagtgctgaggtg

SEQ ID NO: 231455 - DNA, 25 bp, Mus musculus
cagtgactcagacatggaaaccaga

SEQ ID NO: 231456 - DNA, 25 bp, Mus musculus
cagtgactcagctattcgtcttcat

SEQ ID NO: 231457 - DNA, 25 bp, Mus musculus
cagtgactcatgagaaaagagaagc

SEQ ID NO: 231458 - DNA, 25 bp, Mus musculus
cagtgactcatgaggctcatccaga

SEQ ID NO: 231459 - DNA, 25 bp, Mus musculus
cagtgactgcagaaccaagggccag

SEQ ID NO: 231460 - DNA, 25 bp, Mus musculus
cagtgactgcaggctcatgagcagc

SEQ ID NO: 231461 - DNA, 25 bp, Mus musculus
cagtgactgtaagttgtctgacatc

SEQ ID NO: 231462 - DNA, 25 bp, Mus musculus
cagtgactgtagtctgacatctctc

SEQ ID NO: 231463 - DNA, 25 bp, Mus musculus
cagtgactgtgttagatgctcctga

SEQ ID NO: 231464 - DNA, 25 bp, Mus musculus
cagtgactgtgttagttgaacccac

SEQ ID NO: 231465 - DNA, 25 bp, Mus musculus
cagtgacttcagtggggcgtctccg

SEQ ID NO: 231466 - DNA, 25 bp, Mus musculus
cagtgacttccgtggtgggattttc

SEQ ID NO: 231467 - DNA, 25 bp, Mus musculus
cagtgagaaccagagcatcgtgctg

SEQ ID NO: 231468 - DNA, 25 bp, Mus musculus
cagtgagaaccagagggacagcatc

SEQ ID NO: 231469 - DNA, 25 bp, Mus musculus
cagtgagaatgagacgtccagcgtg

SEQ ID NO: 231470 - DNA, 25 bp, Mus musculus
cagtgagaatgaggaaggcaagcgc

SEQ ID NO: 231471 - DNA, 25 bp, Mus musculus
cagtgagacagtcatcgctccaccc

SEQ ID NO: 231472 - DNA, 25 bp, Mus musculus
cagtgagacagtgggggatcttcga

SEQ ID NO: 231473 - DNA, 25 bp, Mus musculus
cagtgagactaatagtgcagaggag

SEQ ID NO: 231474 - DNA, 25 bp, Mus musculus
cagtgagactaatccagctgaacat

SEQ ID NO: 231475 - DNA, 25 bp, Mus musculus
cagtgagagcgagcaaccttcaaac

SEQ ID NO: 231476 - DNA, 25 bp, Mus musculus
cagtgagaggctcaggcagaagatc

SEQ ID NO: 231477 - DNA, 25 bp, Mus musculus
cagtgagagttaagggcacagagaa

SEQ ID NO: 231478 - DNA, 25 bp, Mus musculus
cagtgagcaggggtgactactttgg

SEQ ID NO: 231479 - DNA, 25 bp, Mus musculus
cagtgagcatcctctaccacacccg

SEQ ID NO: 231480 - DNA, 25 bp, Mus musculus
cagtgagccaccaggagaggaaacg

SEQ ID NO: 231481 - DNA, 25 bp, Mus musculus
cagtgagcgaaagactttactggaa

SEQ ID NO: 231482 - DNA, 25 bp, Mus musculus
cagtgagcgagatgcagcaccgagg

SEQ ID NO: 231483 - DNA, 25 bp, Mus musculus
cagtgagcgggggctgagtgtcagt

SEQ ID NO: 231484 - DNA, 25 bp, Mus musculus
cagtgaggaaaggagggcggaaatg

SEQ ID NO: 231485 - DNA, 25 bp, Mus musculus
cagtgaggaaccccggaagcacaaa

SEQ ID NO: 231486 - DNA, 25 bp, Mus musculus
cagtgaggacacagagaagctcatt

SEQ ID NO: 231487 - DNA, 25 bp, Mus musculus
cagtgaggactgggttgactgtggg

SEQ ID NO: 231488 - DNA, 25 bp, Mus musculus
cagtgaggacttacagaagctcatt

SEQ ID NO: 231489 - DNA, 25 bp, Mus musculus
cagtgaggagaaggacctcaccatc

SEQ ID NO: 231490 - DNA, 25 bp, Mus musculus
cagtgaggagattccccccctaggg

SEQ ID NO: 231491 - DNA, 25 bp, Mus musculus
cagtgaggatggattcctgaaagga

SEQ ID NO: 231492 - DNA, 25 bp, Mus musculus
cagtgaggcagaggtcccgtcagga

SEQ ID NO: 231493 - DNA, 25 bp, Mus musculus
cagtgaggccccagggcaactgggt

SEQ ID NO: 231494 - DNA, 25 bp, Mus musculus
cagtgaggtgtgttgaggtcattgc

SEQ ID NO: 231495 - DNA, 25 bp, Mus musculus
cagtgagtagcaccaatgggcatag

SEQ ID NO: 231496 - DNA, 25 bp, Mus musculus
cagtgagtcggcagggctctgagtc

SEQ ID NO: 231497 - DNA, 25 bp, Mus musculus
cagtgagtcggcagttgaaagtggg

SEQ ID NO: 231498 - DNA, 25 bp, Mus musculus
cagtgagtgccagcgaatggctatt

SEQ ID NO: 231499 - DNA, 25 bp, Mus musculus
cagtgagtggctggattcctatcta

SEQ ID NO: 231500 - DNA, 25 bp, Mus musculus
cagtgataaactcgatgacctcaca

SEQ ID NO: 231501 - DNA, 25 bp, Mus musculus
cagtgatactagtcgacaattagaa

SEQ ID NO: 231502 - DNA, 25 bp, Mus musculus
cagtgatactagtttaaaagccgcc

SEQ ID NO: 231503 - DNA, 25 bp, Mus musculus
cagtgatatacaggtggaatgacat

SEQ ID NO: 231504 - DNA, 25 bp, Mus musculus
cagtgatcaggttcagcgtcctctc

SEQ ID NO: 231505 - DNA, 25 bp, Mus musculus
cagtgatctctcaggtgccaacagg

SEQ ID NO: 231506 - DNA, 25 bp, Mus musculus
cagtgatgaaaagcttgttcggcca

SEQ ID NO: 231507 - DNA, 25 bp, Mus musculus
cagtgatgaaaaggaagtaccattg

SEQ ID NO: 231508 - DNA, 25 bp, Mus musculus
cagtgatgatgtttttccctaggca

SEQ ID NO: 231509 - DNA, 25 bp, Mus musculus
cagtgatgctacaggtaaagtcctt

SEQ ID NO: 231510 - DNA, 25 bp, Mus musculus
cagtgatgctcacagagaacagtac

SEQ ID NO: 231511 - DNA, 25 bp, Mus musculus
cagtgatgctcacaggaagttcatt

SEQ ID NO: 231512 - DNA, 25 bp, Mus musculus
cagtgatgctgatgagtgccttgct

SEQ ID NO: 231513 - DNA, 25 bp, Mus musculus
cagtgatgctggacaccgccttagg

SEQ ID NO: 231514 - DNA, 25 bp, Mus musculus
cagtgatggacaggtttttggtgca

SEQ ID NO: 231515 - DNA, 25 bp, Mus musculus
cagtgatggtaagcttctctctaac

SEQ ID NO: 231516 - DNA, 25 bp, Mus musculus
cagtgatgtgtttggactcacacac

SEQ ID NO: 231517 - DNA, 25 bp, Mus musculus
cagtgatgtgtttggggaggcagat

SEQ ID NO: 231518 - DNA, 25 bp, Mus musculus
cagtgattatagttgattgaatcaa

SEQ ID NO: 231519 - DNA, 25 bp, Mus musculus
cagtgattatagtttcagagccatc

SEQ ID NO: 231520 - DNA, 25 bp, Mus musculus
cagtgatttgctgtcagaagctatc

SEQ ID NO: 231521 - DNA, 25 bp, Mus musculus
cagtgcaaaggtaatgctgatggct

SEQ ID NO: 231522 - DNA, 25 bp, Mus musculus
cagtgcaaaggtgattcttactggg

SEQ ID NO: 231523 - DNA, 25 bp, Mus musculus
cagtgcaagacagcacaccctaaag

SEQ ID NO: 231524 - DNA, 25 bp, Mus musculus
cagtgcaagccaaggtgaaacttca

SEQ ID NO: 231525 - DNA, 25 bp, Mus musculus
cagtgcaagccaaggttacctctgg

SEQ ID NO: 231526 - DNA, 25 bp, Mus musculus
cagtgcaagccccatgtcactgcct

SEQ ID NO: 231527 - DNA, 25 bp, Mus musculus
cagtgcaatggatcagttggagaat

SEQ ID NO: 231528 - DNA, 25 bp, Mus musculus
cagtgcaatggcttccatacgacag

SEQ ID NO: 231529 - DNA, 25 bp, Mus musculus
cagtgcacaagtgcacttaatgcag

SEQ ID NO: 231530 - DNA, 25 bp, Mus musculus
cagtgcacagaacctcgttgccatt

SEQ ID NO: 231531 - DNA, 25 bp, Mus musculus
cagtgcacagagcatatgaaacttc

SEQ ID NO: 231532 - DNA, 25 bp, Mus musculus
cagtgcacagctggtatgcatggac

SEQ ID NO: 231533 - DNA, 25 bp, Mus musculus
cagtgcaccaagaagctgcagcaat

SEQ ID NO: 231534 - DNA, 25 bp, Mus musculus
cagtgcaccagcaagctgagttcct

SEQ ID NO: 231535 - DNA, 25 bp, Mus musculus
cagtgcaccctggaacagcttcaga

SEQ ID NO: 231536 - DNA, 25 bp, Mus musculus
cagtgcagaagctgtagctatctct

SEQ ID NO: 231537 - DNA, 25 bp, Mus musculus
cagtgcagacgtagagggatttaaa

SEQ ID NO: 231538 - DNA, 25 bp, Mus musculus
cagtgcagcaggttcaccgtctccc

SEQ ID NO: 231539 - DNA, 25 bp, Mus musculus
cagtgcagctttgttgagaaggagc

SEQ ID NO: 231540 - DNA, 25 bp, Mus musculus
cagtgcaggaaagacatggaaggcc

SEQ ID NO: 231541 - DNA, 25 bp, Mus musculus
cagtgcaggaaagatggccctgcat

SEQ ID NO: 231542 - DNA, 25 bp, Mus musculus
cagtgcaggaagaacagaggcgtga

SEQ ID NO: 231543 - DNA, 25 bp, Mus musculus
cagtgcaggctccagaatggagctg

SEQ ID NO: 231544 - DNA, 25 bp, Mus musculus
cagtgcaggctccaggtacacctgg

SEQ ID NO: 231545 - DNA, 25 bp, Mus musculus
cagtgcagggctggaagccattcag

SEQ ID NO: 231546 - DNA, 25 bp, Mus musculus
cagtgcaggggtacgcacgcggtcc

SEQ ID NO: 231547 - DNA, 25 bp, Mus musculus
cagtgcagtgaccagaacatcaaac

SEQ ID NO: 231548 - DNA, 25 bp, Mus musculus
cagtgcagtgaccagggtgccacaa

SEQ ID NO: 231549 - DNA, 25 bp, Mus musculus
cagtgccaaaagaattcagaaggag

SEQ ID NO: 231550 - DNA, 25 bp, Mus musculus
cagtgccaaaagtgctggacccaaa

SEQ ID NO: 231551 - DNA, 25 bp, Mus musculus
cagtgccaacatttaaacgagtgtg

SEQ ID NO: 231552 - DNA, 25 bp, Mus musculus
cagtgccaacctggagaaggcgcag

SEQ ID NO: 231553 - DNA, 25 bp, Mus musculus
cagtgccaacctgtgtgtcaaccac

SEQ ID NO: 231554 - DNA, 25 bp, Mus musculus
cagtgccaacctttctacgtcttaa

SEQ ID NO: 231555 - DNA, 25 bp, Mus musculus
cagtgccaacctttttgcccagacc

SEQ ID NO: 231556 - DNA, 25 bp, Mus musculus
cagtgccaagaagggttgagattga

SEQ ID NO: 231557 - DNA, 25 bp, Mus musculus
cagtgccaagatttttttcgtatct

SEQ ID NO: 231558 - DNA, 25 bp, Mus musculus
cagtgccaaggtcaaaattgcagaa

SEQ ID NO: 231559 - DNA, 25 bp, Mus musculus
cagtgccacagtgaaaaaagcaact

SEQ ID NO: 231560 - DNA, 25 bp, Mus musculus
cagtgccacagtgaaggagcagatt

SEQ ID NO: 231561 - DNA, 25 bp, Mus musculus
cagtgccacggaggatctagataaa

SEQ ID NO: 231562 - DNA, 25 bp, Mus musculus
cagtgccacggagtcggaccaggag

SEQ ID NO: 231563 - DNA, 25 bp, Mus musculus
cagtgccacggctgagttaagaatc

SEQ ID NO: 231564 - DNA, 25 bp, Mus musculus
cagtgccagcccaggcctccagccc

SEQ ID NO: 231565 - DNA, 25 bp, Mus musculus
cagtgccagccggactcctccaccc

SEQ ID NO: 231566 - DNA, 25 bp, Mus musculus
cagtgccagggaggtgtgaatgagg

SEQ ID NO: 231567 - DNA, 25 bp, Mus musculus
cagtgccattaggttttcttaaaga

SEQ ID NO: 231568 - DNA, 25 bp, Mus musculus
cagtgcccacccatcactcagcact

SEQ ID NO: 231569 - DNA, 25 bp, Mus musculus
cagtgcccacccgagtcattcgacg

SEQ ID NO: 231570 - DNA, 25 bp, Mus musculus
cagtgcccagacctgtgttacattg

SEQ ID NO: 231571 - DNA, 25 bp, Mus musculus
cagtgcccccaccggatgcagaaga

SEQ ID NO: 231572 - DNA, 25 bp, Mus musculus
cagtgcccccaggcttccccccaat

SEQ ID NO: 231573 - DNA, 25 bp, Mus musculus
cagtgccccgggagagacggagatt

SEQ ID NO: 231574 - DNA, 25 bp, Mus musculus
cagtgcccgcccaggttgtcttgac

SEQ ID NO: 231575 - DNA, 25 bp, Mus musculus
cagtgccgaaagtggctatgcaatg

SEQ ID NO: 231576 - DNA, 25 bp, Mus musculus
cagtgccgcacagtctggaataaaa

SEQ ID NO: 231577 - DNA, 25 bp, Mus musculus
cagtgccgctgcttgcaaggagaag

SEQ ID NO: 231578 - DNA, 25 bp, Mus musculus
cagtgcctaccaggtgctgaggatc

SEQ ID NO: 231579 - DNA, 25 bp, Mus musculus
cagtgcctaccaggtgtccgtaaat

SEQ ID NO: 231580 - DNA, 25 bp, Mus musculus
cagtgcctcatcttttgctggaatt

SEQ ID NO: 231581 - DNA, 25 bp, Mus musculus
cagtgcctctgactaggtctgcgaa

SEQ ID NO: 231582 - DNA, 25 bp, Mus musculus
cagtgcctgacaccgatggcagact

SEQ ID NO: 231583 - DNA, 25 bp, Mus musculus
cagtgcctgccacgtgagaagccat

SEQ ID NO: 231584 - DNA, 25 bp, Mus musculus
cagtgcctgccaggtgagaagccat

SEQ ID NO: 231585 - DNA, 25 bp, Mus musculus
cagtgcctggggttctgcagcttcc

SEQ ID NO: 231586 - DNA, 25 bp, Mus musculus
cagtgccttcagagtgatccacctt

SEQ ID NO: 231587 - DNA, 25 bp, Mus musculus
cagtgccttcaggtgccttggagca

SEQ ID NO: 231588 - DNA, 25 bp, Mus musculus
cagtgcctttgaggtcaatcttgga

SEQ ID NO: 231589 - DNA, 25 bp, Mus musculus
cagtgcgaaagagaacctgctcctc

SEQ ID NO: 231590 - DNA, 25 bp, Mus musculus
cagtgcgaaagagattacaggacag

SEQ ID NO: 231591 - DNA, 25 bp, Mus musculus
cagtgcgactgaagcgaaggctgat

SEQ ID NO: 231592 - DNA, 25 bp, Mus musculus
cagtgcgcacgccggaccctgagcc

SEQ ID NO: 231593 - DNA, 25 bp, Mus musculus
cagtgcgcctccgccggtgagctcc

SEQ ID NO: 231594 - DNA, 25 bp, Mus musculus
cagtgcgcgcgatgaggctgtagag

SEQ ID NO: 231595 - DNA, 25 bp, Mus musculus
cagtgcgcgggtggtgtaagaataa

SEQ ID NO: 231596 - DNA, 25 bp, Mus musculus
cagtgcggacctaaataacgagcct

SEQ ID NO: 231597 - DNA, 25 bp, Mus musculus
cagtgcggaccttcactacttcgat

SEQ ID NO: 231598 - DNA, 25 bp, Mus musculus
cagtgcggcagccgtggtcatagtc

SEQ ID NO: 231599 - DNA, 25 bp, Mus musculus
cagtgcgttatcgagcctactagtt

SEQ ID NO: 231600 - DNA, 25 bp, Mus musculus
cagtgcgttatcgaggaaagcatgt

SEQ ID NO: 231601 - DNA, 25 bp, Mus musculus
cagtgcgttatcgaggtaatatata

SEQ ID NO: 231602 - DNA, 25 bp, Mus musculus
cagtgctaatctaggtcttgccgtg

SEQ ID NO: 231603 - DNA, 25 bp, Mus musculus
cagtgctaattcaggtcttgccgtg

SEQ ID NO: 231604 - DNA, 25 bp, Mus musculus
cagtgctcagaagtttgcagggaca

SEQ ID NO: 231605 - DNA, 25 bp, Mus musculus
cagtgctcagcaggtttgggaaaaa

SEQ ID NO: 231606 - DNA, 25 bp, Mus musculus
cagtgctcagggtttaagtcttgaa

SEQ ID NO: 231607 - DNA, 25 bp, Mus musculus
cagtgctcagtgtggctgaggaagc

SEQ ID NO: 231608 - DNA, 25 bp, Mus musculus
cagtgctcataggaattcactgtga

SEQ ID NO: 231609 - DNA, 25 bp, Mus musculus
cagtgctcccaggggtgatctgctt

SEQ ID NO: 231610 - DNA, 25 bp, Mus musculus
cagtgctctgttgcatatgacatgg

SEQ ID NO: 231611 - DNA, 25 bp, Mus musculus
cagtgctctgttgcgctgacccctg

SEQ ID NO: 231612 - DNA, 25 bp, Mus musculus
cagtgctgaatggggctttcccgct

SEQ ID NO: 231613 - DNA, 25 bp, Mus musculus
cagtgctgctgaagaggcagaggag

SEQ ID NO: 231614 - DNA, 25 bp, Mus musculus
cagtgctgttcagggtgactcatat

SEQ ID NO: 231615 - DNA, 25 bp, Mus musculus
cagtgcttagagaacgatgtggaca

SEQ ID NO: 231616 - DNA, 25 bp, Mus musculus
cagtgcttagctcttctgtcggaaa

SEQ ID NO: 231617 - DNA, 25 bp, Mus musculus
cagtgcttagtgtggatctgttaag

SEQ ID NO: 231618 - DNA, 25 bp, Mus musculus
cagtgcttattatgctggataataa

SEQ ID NO: 231619 - DNA, 25 bp, Mus musculus
cagtgcttccaaagcacaggctggc

SEQ ID NO: 231620 - DNA, 25 bp, Mus musculus
cagtgcttccaaagccaggtgtcag

SEQ ID NO: 231621 - DNA, 25 bp, Mus musculus
cagtgcttcctcgagaagccaacag

SEQ ID NO: 231622 - DNA, 25 bp, Mus musculus
cagtgcttcctcgatgagatcgtgg

SEQ ID NO: 231623 - DNA, 25 bp, Mus musculus
cagtgcttctgtgaaagaattgaat

SEQ ID NO: 231624 - DNA, 25 bp, Mus musculus
cagtgcttttaatcagcttaagatg

SEQ ID NO: 231625 - DNA, 25 bp, Mus musculus
cagtggaaaggttgagttatttgaa

SEQ ID NO: 231626 - DNA, 25 bp, Mus musculus
cagtggaactacaggtgaccccaaa

SEQ ID NO: 231627 - DNA, 25 bp, Mus musculus
cagtggaagacagagaatttcatct

SEQ ID NO: 231628 - DNA, 25 bp, Mus musculus
cagtggaagacagagttcctctgct

SEQ ID NO: 231629 - DNA, 25 bp, Mus musculus
cagtggaagcagagtcggagcagaa

SEQ ID NO: 231630 - DNA, 25 bp, Mus musculus
cagtggaagccagctttttgatcac

SEQ ID NO: 231631 - DNA, 25 bp, Mus musculus
cagtggaattatagccacaatcaca

SEQ ID NO: 231632 - DNA, 25 bp, Mus musculus
cagtggacagaagatttcctctgag

SEQ ID NO: 231633 - DNA, 25 bp, Mus musculus
cagtggacatgaagctgtttgtatg

SEQ ID NO: 231634 - DNA, 25 bp, Mus musculus
cagtggacatgaaggtgcctcagcc

SEQ ID NO: 231635 - DNA, 25 bp, Mus musculus
cagtggaccaaattttcaggatggc

SEQ ID NO: 231636 - DNA, 25 bp, Mus musculus
cagtggaccagccttcgtggtgaag

SEQ ID NO: 231637 - DNA, 25 bp, Mus musculus
cagtggacgcgaggtacaacgccta

SEQ ID NO: 231638 - DNA, 25 bp, Mus musculus
cagtggacgcgagtttcggacccag

SEQ ID NO: 231639 - DNA, 25 bp, Mus musculus
cagtggacgctcaggggaggggcga

SEQ ID NO: 231640 - DNA, 25 bp, Mus musculus
cagtggagaagatctcttcactggt

SEQ ID NO: 231641 - DNA, 25 bp, Mus musculus
cagtggagactgagcaaatcggcca

SEQ ID NO: 231642 - DNA, 25 bp, Mus musculus
cagtggagactggtcttgctttgtg

SEQ ID NO: 231643 - DNA, 25 bp, Mus musculus
cagtggagagatgaataagttgccc

SEQ ID NO: 231644 - DNA, 25 bp, Mus musculus
cagtggagcagcttacagatgtcct

SEQ ID NO: 231645 - DNA, 25 bp, Mus musculus
cagtggaggaagcacctcccactaa

SEQ ID NO: 231646 - DNA, 25 bp, Mus musculus
cagtggaggaagctcatctacggac

SEQ ID NO: 231647 - DNA, 25 bp, Mus musculus
cagtggagggccctgtctgtactgt

SEQ ID NO: 231648 - DNA, 25 bp, Mus musculus
cagtggaggtgaaggccaatacata

SEQ ID NO: 231649 - DNA, 25 bp, Mus musculus
cagtggagtccgtcacgctggcggt

SEQ ID NO: 231650 - DNA, 25 bp, Mus musculus
cagtggataaatagatgcccgtgtg

SEQ ID NO: 231651 - DNA, 25 bp, Mus musculus
cagtggatccagatctcggacgctg

SEQ ID NO: 231652 - DNA, 25 bp, Mus musculus
cagtggatcggaaaaggcctactgg

SEQ ID NO: 231653 - DNA, 25 bp, Mus musculus
cagtggatctctcagcaccatatcc

SEQ ID NO: 231654 - DNA, 25 bp, Mus musculus
cagtggattctgaccacctcatcct

SEQ ID NO: 231655 - DNA, 25 bp, Mus musculus
cagtggcaaaccgggaataattctc

SEQ ID NO: 231656 - DNA, 25 bp, Mus musculus
cagtggcaattcaggttcattttgc

SEQ ID NO: 231657 - DNA, 25 bp, Mus musculus
cagtggcaattcaggttcccaggtg

SEQ ID NO: 231658 - DNA, 25 bp, Mus musculus
cagtggcaattcaggttctcttgcc

SEQ ID NO: 231659 - DNA, 25 bp, Mus musculus
cagtggcacagatgccctaggtcta

SEQ ID NO: 231660 - DNA, 25 bp, Mus musculus
cagtggcacaggtctccaccgctat

SEQ ID NO: 231661 - DNA, 25 bp, Mus musculus
cagtggcaccttcagaggcagagag

SEQ ID NO: 231662 - DNA, 25 bp, Mus musculus
cagtggcaccttcagctacatcagg

SEQ ID NO: 231663 - DNA, 25 bp, Mus musculus
cagtggcactgtcctcccagtggca

SEQ ID NO: 231664 - DNA, 25 bp, Mus musculus
cagtggcagagaagggcaaacattg

SEQ ID NO: 231665 - DNA, 25 bp, Mus musculus
cagtggcatgaaaaggcccttgctg

SEQ ID NO: 231666 - DNA, 25 bp, Mus musculus
cagtggccagacaggtggagtcact

SEQ ID NO: 231667 - DNA, 25 bp, Mus musculus
cagtggcccagctgctgtcaacaac

SEQ ID NO: 231668 - DNA, 25 bp, Mus musculus
cagtggccccgaggtctcagatctg

SEQ ID NO: 231669 - DNA, 25 bp, Mus musculus
cagtggccccgagtgccagttgcca

SEQ ID NO: 231670 - DNA, 25 bp, Mus musculus
cagtggccctggcagagaacacagc

SEQ ID NO: 231671 - DNA, 25 bp, Mus musculus
cagtggcctacagggctggctgtgg

SEQ ID NO: 231672 - DNA, 25 bp, Mus musculus
cagtggcgaaggcgaatctggtttt

SEQ ID NO: 231673 - DNA, 25 bp, Mus musculus
cagtggcgagaccggggcatggaac

SEQ ID NO: 231674 - DNA, 25 bp, Mus musculus
cagtggcgagactgaaacagtcccc

SEQ ID NO: 231675 - DNA, 25 bp, Mus musculus
cagtggcgaggagtccgctcagaat

SEQ ID NO: 231676 - DNA, 25 bp, Mus musculus
cagtggcgaggccatggtggcgtgt

SEQ ID NO: 231677 - DNA, 25 bp, Mus musculus
cagtggcgaggtgagccatgatggg

SEQ ID NO: 231678 - DNA, 25 bp, Mus musculus
cagtggcgcaggatggcgcagaaga

SEQ ID NO: 231679 - DNA, 25 bp, Mus musculus
cagtggcgcagttttactttcaagg

SEQ ID NO: 231680 - DNA, 25 bp, Mus musculus
cagtggcggagcaggggaagagaca

SEQ ID NO: 231681 - DNA, 25 bp, Mus musculus
cagtggctcaagaccctgaaggcta

SEQ ID NO: 231682 - DNA, 25 bp, Mus musculus
cagtggctcaaggctatcgaggagg

SEQ ID NO: 231683 - DNA, 25 bp, Mus musculus
cagtggctcagctctgccatttcct

SEQ ID NO: 231684 - DNA, 25 bp, Mus musculus
cagtggctcggatgttcagcacaag

SEQ ID NO: 231685 - DNA, 25 bp, Mus musculus
cagtggctgcaaaaacttgagaatt

SEQ ID NO: 231686 - DNA, 25 bp, Mus musculus
cagtggctgcaaaaaggtcctggtc

SEQ ID NO: 231687 - DNA, 25 bp, Mus musculus
cagtggctggcatgctacaaatgaa

SEQ ID NO: 231688 - DNA, 25 bp, Mus musculus
cagtgggaaagggagtcatgtggct

SEQ ID NO: 231689 - DNA, 25 bp, Mus musculus
cagtgggaagttggtacagagcatc

SEQ ID NO: 231690 - DNA, 25 bp, Mus musculus
cagtgggaccaagaacacggtacaa

SEQ ID NO: 231691 - DNA, 25 bp, Mus musculus
cagtgggacccagcatgctggcgac

SEQ ID NO: 231692 - DNA, 25 bp, Mus musculus
cagtgggacctcaggctgactgctg

SEQ ID NO: 231693 - DNA, 25 bp, Mus musculus
cagtgggagaaagtgagagcaccac

SEQ ID NO: 231694 - DNA, 25 bp, Mus musculus
cagtgggagcactggctcacccatg

SEQ ID NO: 231695 - DNA, 25 bp, Mus musculus
cagtgggaggaggaatttgacaaga

SEQ ID NO: 231696 - DNA, 25 bp, Mus musculus
cagtgggatggagctcctggtgaac

SEQ ID NO: 231697 - DNA, 25 bp, Mus musculus
cagtgggcagatgcacatgcagaac

SEQ ID NO: 231698 - DNA, 25 bp, Mus musculus
cagtgggcagtacactgcctcaggc

SEQ ID NO: 231699 - DNA, 25 bp, Mus musculus
cagtgggcagtacattgccattacc

SEQ ID NO: 231700 - DNA, 25 bp, Mus musculus
cagtgggcccccaagccttggaaat

SEQ ID NO: 231701 - DNA, 25 bp, Mus musculus
cagtgggctccagcagcccaagccc

SEQ ID NO: 231702 - DNA, 25 bp, Mus musculus
cagtggggcggcccctgcccggatg

SEQ ID NO: 231703 - DNA, 25 bp, Mus musculus
cagtgggggaacaggttgagtgatg

SEQ ID NO: 231704 - DNA, 25 bp, Mus musculus
cagtgggggaacagtttctctaata

SEQ ID NO: 231705 - DNA, 25 bp, Mus musculus
cagtggtatgaggttgaacggacag

SEQ ID NO: 231706 - DNA, 25 bp, Mus musculus
cagtggtatgagtggttcagaaatt

SEQ ID NO: 231707 - DNA, 25 bp, Mus musculus
cagtggtccagaccctcagtgctca

SEQ ID NO: 231708 - DNA, 25 bp, Mus musculus
cagtggtccagggatgaactgtgaa

SEQ ID NO: 231709 - DNA, 25 bp, Mus musculus
cagtggtccaggttctaagcgcagc

SEQ ID NO: 231710 - DNA, 25 bp, Mus musculus
cagtggtgaacattagcaacaagac

SEQ ID NO: 231711 - DNA, 25 bp, Mus musculus
cagtggtgaagggacacgcctgcga

SEQ ID NO: 231712 - DNA, 25 bp, Mus musculus
cagtggtgacaggctccatccaacc

SEQ ID NO: 231713 - DNA, 25 bp, Mus musculus
cagtggtgaggtgtatggctggggc

SEQ ID NO: 231714 - DNA, 25 bp, Mus musculus
cagtggtgatgctgtcatcaaggct

SEQ ID NO: 231715 - DNA, 25 bp, Mus musculus
cagtggtggaagaggagaactttga

SEQ ID NO: 231716 - DNA, 25 bp, Mus musculus
cagtggtggaagtcgtgttcaagga

SEQ ID NO: 231717 - DNA, 25 bp, Mus musculus
cagtggtggagccttcccatcaggg

SEQ ID NO: 231718 - DNA, 25 bp, Mus musculus
cagtggtggaggtcagagtcagagt

SEQ ID NO: 231719 - DNA, 25 bp, Mus musculus
cagtggtggaggtcagggtagtaca

SEQ ID NO: 231720 - DNA, 25 bp, Mus musculus
cagtggtggccctgtctctctggac

SEQ ID NO: 231721 - DNA, 25 bp, Mus musculus
cagtggtggctttggtggcatatcc

SEQ ID NO: 231722 - DNA, 25 bp, Mus musculus
cagtggtgtcggcattgctagcttg

SEQ ID NO: 231723 - DNA, 25 bp, Mus musculus
cagtggtgtcggtgttgccagtgtt

SEQ ID NO: 231724 - DNA, 25 bp, Mus musculus
cagtggtgtgttagagtggattgaa

SEQ ID NO: 231725 - DNA, 25 bp, Mus musculus
cagtggtgtgttaggtatggctttc

SEQ ID NO: 231726 - DNA, 25 bp, Mus musculus
cagtggtgtgttaggtgcggtggct

SEQ ID NO: 231727 - DNA, 25 bp, Mus musculus
cagtggttcttcaggcgtggctccc

SEQ ID NO: 231728 - DNA, 25 bp, Mus musculus
cagtggttcttcaggtacatggctt

SEQ ID NO: 231729 - DNA, 25 bp, Mus musculus
cagtggttcttcaggtcagaaggag

SEQ ID NO: 231730 - DNA, 25 bp, Mus musculus
cagtggttgctatggaacatcattc

SEQ ID NO: 231731 - DNA, 25 bp, Mus musculus
cagtggttgctatggtctgggaggg

SEQ ID NO: 231732 - DNA, 25 bp, Mus musculus
cagtgtaaaaacagaaagtgtggag

SEQ ID NO: 231733 - DNA, 25 bp, Mus musculus
cagtgtaaacaattagatttagagc

SEQ ID NO: 231734 - DNA, 25 bp, Mus musculus
cagtgtaaagatattgatgaatgtg

SEQ ID NO: 231735 - DNA, 25 bp, Mus musculus
cagtgtaaagattgcaaattcaact

SEQ ID NO: 231736 - DNA, 25 bp, Mus musculus
cagtgtaaagctctatgtcagaaac

SEQ ID NO: 231737 - DNA, 25 bp, Mus musculus
cagtgtaaccaaagatgtcgcactg

SEQ ID NO: 231738 - DNA, 25 bp, Mus musculus
cagtgtaacccagtgtggtgaactc

SEQ ID NO: 231739 - DNA, 25 bp, Mus musculus
cagtgtaatcagcagctgttctcat

SEQ ID NO: 231740 - DNA, 25 bp, Mus musculus
cagtgtaatgatcgatgaagatatg

SEQ ID NO: 231741 - DNA, 25 bp, Mus musculus
cagtgtacagtgcttctcagacaca

SEQ ID NO: 231742 - DNA, 25 bp, Mus musculus
cagtgtatacagtggcccatcatgg

SEQ ID NO: 231743 - DNA, 25 bp, Mus musculus
cagtgtatcaggatgatgctgttga

SEQ ID NO: 231744 - DNA, 25 bp, Mus musculus
cagtgtatgccacatgagtctttca

SEQ ID NO: 231745 - DNA, 25 bp, Mus musculus
cagtgtatgtcttggtggtcactaa

SEQ ID NO: 231746 - DNA, 25 bp, Mus musculus
cagtgtattcccaggacccacattg

SEQ ID NO: 231747 - DNA, 25 bp, Mus musculus
cagtgtcaaccagtgctcagagttc

SEQ ID NO: 231748 - DNA, 25 bp, Mus musculus
cagtgtcaaccatcttgctctacaa

SEQ ID NO: 231749 - DNA, 25 bp, Mus musculus
cagtgtcaagttctgtggatctacc

SEQ ID NO: 231750 - DNA, 25 bp, Mus musculus
cagtgtcaatcaatggtgtcccaga

SEQ ID NO: 231751 - DNA, 25 bp, Mus musculus
cagtgtcaggagcagattgccaggg

SEQ ID NO: 231752 - DNA, 25 bp, Mus musculus
cagtgtcagtatgtggtccagtgtg

SEQ ID NO: 231753 - DNA, 25 bp, Mus musculus
cagtgtcagtgggttatttcgctgc

SEQ ID NO: 231754 - DNA, 25 bp, Mus musculus
cagtgtcatcaaggtctttccggac

SEQ ID NO: 231755 - DNA, 25 bp, Mus musculus
cagtgtccaccagggtttgacctgc

SEQ ID NO: 231756 - DNA, 25 bp, Mus musculus
cagtgtccatgctcttttgtgactg

SEQ ID NO: 231757 - DNA, 25 bp, Mus musculus
cagtgtcccaatccgggctgtggaa

SEQ ID NO: 231758 - DNA, 25 bp, Mus musculus
cagtgtcccaggtccctgtggcccc

SEQ ID NO: 231759 - DNA, 25 bp, Mus musculus
cagtgtcccaggtctctaactggtt

SEQ ID NO: 231760 - DNA, 25 bp, Mus musculus
cagtgtcctagcagattgtccttct

SEQ ID NO: 231761 - DNA, 25 bp, Mus musculus
cagtgtcctcttctagttctttgta

SEQ ID NO: 231762 - DNA, 25 bp, Mus musculus
cagtgtcctggaaggtggtttgctc

SEQ ID NO: 231763 - DNA, 25 bp, Mus musculus
cagtgtcctggcagcccaaacgatg

SEQ ID NO: 231764 - DNA, 25 bp, Mus musculus
cagtgtcctggccaagggccggaat

SEQ ID NO: 231765 - DNA, 25 bp, Mus musculus
cagtgtctcaggaatgtcaagtgaa

SEQ ID NO: 231766 - DNA, 25 bp, Mus musculus
cagtgtctcaggcggcttggatttt

SEQ ID NO: 231767 - DNA, 25 bp, Mus musculus
cagtgtctcaggtgactcaagtaca

SEQ ID NO: 231768 - DNA, 25 bp, Mus musculus
cagtgtctcaggtgactccaatgaa

SEQ ID NO: 231769 - DNA, 25 bp, Mus musculus
cagtgtctccctccaagccacacca

SEQ ID NO: 231770 - DNA, 25 bp, Mus musculus
cagtgtctgaaatgacacggagagc

SEQ ID NO: 231771 - DNA, 25 bp, Mus musculus
cagtgtctgcgagcccagatgccca

SEQ ID NO: 231772 - DNA, 25 bp, Mus musculus
cagtgtctgcgatggttgtgagcta

SEQ ID NO: 231773 - DNA, 25 bp, Mus musculus
cagtgtctggatgccagccactgct

SEQ ID NO: 231774 - DNA, 25 bp, Mus musculus
cagtgtgaacagaggcagaaacttt

SEQ ID NO: 231775 - DNA, 25 bp, Mus musculus
cagtgtgaagacgtgagcaagatgg

SEQ ID NO: 231776 - DNA, 25 bp, Mus musculus
cagtgtgaagacgtggaggcatcca

SEQ ID NO: 231777 - DNA, 25 bp, Mus musculus
cagtgtgaagatctgctttcccagg

SEQ ID NO: 231778 - DNA, 25 bp, Mus musculus
cagtgtgaagggctcaggatgctac

SEQ ID NO: 231779 - DNA, 25 bp, Mus musculus
cagtgtgaccgtaccgacccttgac

SEQ ID NO: 231780 - DNA, 25 bp, Mus musculus
cagtgtgactggtttcatatgtccc

SEQ ID NO: 231781 - DNA, 25 bp, Mus musculus
cagtgtgagtatatacacttctgat

SEQ ID NO: 231782 - DNA, 25 bp, Mus musculus
cagtgtgattgggagaaaccactgg

SEQ ID NO: 231783 - DNA, 25 bp, Mus musculus
cagtgtgcagatttgtgaataaaca

SEQ ID NO: 231784 - DNA, 25 bp, Mus musculus
cagtgtgcgaagatgtggatgagtg

SEQ ID NO: 231785 - DNA, 25 bp, Mus musculus
cagtgtgcgcagcctggaagggcgt

SEQ ID NO: 231786 - DNA, 25 bp, Mus musculus
cagtgtgcgcagcttgcttctccag

SEQ ID NO: 231787 - DNA, 25 bp, Mus musculus
cagtgtggaagagctcccgccagtg

SEQ ID NO: 231788 - DNA, 25 bp, Mus musculus
cagtgtggaagtctggtcatctgac

SEQ ID NO: 231789 - DNA, 25 bp, Mus musculus
cagtgtggaagttctgcaactgtgt

SEQ ID NO: 231790 - DNA, 25 bp, Mus musculus
cagtgtggagcggcagtctctggat

SEQ ID NO: 231791 - DNA, 25 bp, Mus musculus
cagtgtggaggggcagtctctggat

SEQ ID NO: 231792 - DNA, 25 bp, Mus musculus
cagtgtggctagcaagctgcctcgt

SEQ ID NO: 231793 - DNA, 25 bp, Mus musculus
cagtgtggtgactgttggtcctgtg

SEQ ID NO: 231794 - DNA, 25 bp, Mus musculus
cagtgtgtcaaatctctcatggaac

SEQ ID NO: 231795 - DNA, 25 bp, Mus musculus
cagtgtgtcaggcattcggggcacg

SEQ ID NO: 231796 - DNA, 25 bp, Mus musculus
cagtgtgtgaagcaaggagaactca

SEQ ID NO: 231797 - DNA, 25 bp, Mus musculus
cagtgtgtggatgtggacgagtgtg

SEQ ID NO: 231798 - DNA, 25 bp, Mus musculus
cagtgtgtggcccgccacctctagt

SEQ ID NO: 231799 - DNA, 25 bp, Mus musculus
cagtgtgtgttattggactctgggc

SEQ ID NO: 231800 - DNA, 25 bp, Mus musculus
cagtgtgttaagccaaatttacgga

SEQ ID NO: 231801 - DNA, 25 bp, Mus musculus
cagtgtgttaagtattttggaaata

SEQ ID NO: 231802 - DNA, 25 bp, Mus musculus
cagtgttaccagcaccaccaaaaaa

SEQ ID NO: 231803 - DNA, 25 bp, Mus musculus
cagtgttcaaacatgcccagttgca

SEQ ID NO: 231804 - DNA, 25 bp, Mus musculus
cagtgttcaagggtctcttgtggta

SEQ ID NO: 231805 - DNA, 25 bp, Mus musculus
cagtgttcacactacctttctgatt

SEQ ID NO: 231806 - DNA, 25 bp, Mus musculus
cagtgttcacatcaacaggaacgtc

SEQ ID NO: 231807 - DNA, 25 bp, Mus musculus
cagtgttccaaggagaccccctcct

SEQ ID NO: 231808 - DNA, 25 bp, Mus musculus
cagtgttccaaggtttggtgccgtg

SEQ ID NO: 231809 - DNA, 25 bp, Mus musculus
cagtgttctggtacccactgtgggg

SEQ ID NO: 231810 - DNA, 25 bp, Mus musculus
cagtgttctggtacgctccggaatg

SEQ ID NO: 231811 - DNA, 25 bp, Mus musculus
cagtgttgcatgatcaaaaggaaaa

SEQ ID NO: 231812 - DNA, 25 bp, Mus musculus
cagtgttgctgagattgccaaaatg

SEQ ID NO: 231813 - DNA, 25 bp, Mus musculus
cagtgttggtgccatggtggcttca

SEQ ID NO: 231814 - DNA, 25 bp, Mus musculus
cagtgttgtgcagagactgccttgt

SEQ ID NO: 231815 - DNA, 25 bp, Mus musculus
cagtgttgtgcagaggcggccatgc

SEQ ID NO: 231816 - DNA, 25 bp, Mus musculus
cagtgttgtgtccggtataagtgct

SEQ ID NO: 231817 - DNA, 25 bp, Mus musculus
cagtgtttatggcttgaagatgcag

SEQ ID NO: 231818 - DNA, 25 bp, Mus musculus
cagtgtttctagaggcctcaaacag

SEQ ID NO: 231819 - DNA, 25 bp, Mus musculus
cagtgtttctgcaagatgaacgaga

SEQ ID NO: 231820 - DNA, 25 bp, Mus musculus
cagtgtttgaatgaccttcttttgg

SEQ ID NO: 231821 - DNA, 25 bp, Mus musculus
cagtgttttcagggccctcagccga

SEQ ID NO: 231822 - DNA, 25 bp, Mus musculus
cagtgtttttgcagaatgtgtgctg

SEQ ID NO: 231823 - DNA, 25 bp, Mus musculus
cagttaaaaaacaaggtgagacagt

SEQ ID NO: 231824 - DNA, 25 bp, Mus musculus
cagttaaaaaatcttgcccagtccc

SEQ ID NO: 231825 - DNA, 25 bp, Mus musculus
cagttaaaaggttttcagcagactc

SEQ ID NO: 231826 - DNA, 25 bp, Mus musculus
cagttaaagaggtgaactgccctca

SEQ ID NO: 231827 - DNA, 25 bp, Mus musculus
cagttaaagtttcagcaacccagca

SEQ ID NO: 231828 - DNA, 25 bp, Mus musculus
cagttaaccagtgctgagcctacca

SEQ ID NO: 231829 - DNA, 25 bp, Mus musculus
cagttaagagaacagcacattagtt

SEQ ID NO: 231830 - DNA, 25 bp, Mus musculus
cagttaagagagaacagagtttccg

SEQ ID NO: 231831 - DNA, 25 bp, Mus musculus
cagttaagaggatcgctgcagagca

SEQ ID NO: 231832 - DNA, 25 bp, Mus musculus
cagttaaggaacaggctttcatgct

SEQ ID NO: 231833 - DNA, 25 bp, Mus musculus
cagttaagtagtcttttcacagagc

SEQ ID NO: 231834 - DNA, 25 bp, Mus musculus
cagttaagtcaggaaaccaagcgcc

SEQ ID NO: 231835 - DNA, 25 bp, Mus musculus
cagttaatagcagagggctaccgtg

SEQ ID NO: 231836 - DNA, 25 bp, Mus musculus
cagttaattgagtgtgttctcaggg

SEQ ID NO: 231837 - DNA, 25 bp, Mus musculus
cagttaattgctggccttcgttttc

SEQ ID NO: 231838 - DNA, 25 bp, Mus musculus
cagttacaagcaacaacaacaaaac

SEQ ID NO: 231839 - DNA, 25 bp, Mus musculus
cagttacaaggcaatgtatgtgaag

SEQ ID NO: 231840 - DNA, 25 bp, Mus musculus
cagttacatgcaggtcataaatgaa

SEQ ID NO: 231841 - DNA, 25 bp, Mus musculus
cagttaccaggaccgctcctttgac

SEQ ID NO: 231842 - DNA, 25 bp, Mus musculus
cagttaccaggggcacgaccagttc

SEQ ID NO: 231843 - DNA, 25 bp, Mus musculus
cagttacctagatattgctgttgga

SEQ ID NO: 231844 - DNA, 25 bp, Mus musculus
cagttacctaggcttttcactggac

SEQ ID NO: 231845 - DNA, 25 bp, Mus musculus
cagttacggagggcagtaaatcgtc

SEQ ID NO: 231846 - DNA, 25 bp, Mus musculus
cagttacggagggctgtaaatcgtc

SEQ ID NO: 231847 - DNA, 25 bp, Mus musculus
cagttacgtaggtctggtcagctac

SEQ ID NO: 231848 - DNA, 25 bp, Mus musculus
cagttactctacatcccctcctctc

SEQ ID NO: 231849 - DNA, 25 bp, Mus musculus
cagttactctacttcatctactctg

SEQ ID NO: 231850 - DNA, 25 bp, Mus musculus
cagttagaactcaggcaggaagagg

SEQ ID NO: 231851 - DNA, 25 bp, Mus musculus
cagttagaagctcttaaaaaacagt

SEQ ID NO: 231852 - DNA, 25 bp, Mus musculus
cagttagacgaggaggtggagttgt

SEQ ID NO: 231853 - DNA, 25 bp, Mus musculus
cagttagacttgcaagcacctttct

SEQ ID NO: 231854 - DNA, 25 bp, Mus musculus
cagttagcaaccgctatggaattgc

SEQ ID NO: 231855 - DNA, 25 bp, Mus musculus
cagttagcagtcaaactcagcaaca

SEQ ID NO: 231856 - DNA, 25 bp, Mus musculus
cagttagcagtcaatatatggacta

SEQ ID NO: 231857 - DNA, 25 bp, Mus musculus
cagttagctgagacacttgtgagcc

SEQ ID NO: 231858 - DNA, 25 bp, Mus musculus
cagttagctgagtcggctgcacggc

SEQ ID NO: 231859 - DNA, 25 bp, Mus musculus
cagttatagccaggatttcccagcc

SEQ ID NO: 231860 - DNA, 25 bp, Mus musculus
cagttatagccaggtctccagcaga

SEQ ID NO: 231861 - DNA, 25 bp, Mus musculus
cagttatatcaggggtcggcacaag

SEQ ID NO: 231862 - DNA, 25 bp, Mus musculus
cagttatatggtggtgacgtatgcc

SEQ ID NO: 231863 - DNA, 25 bp, Mus musculus
cagttatctgacccttcctatctgc

SEQ ID NO: 231864 - DNA, 25 bp, Mus musculus
cagttatctgcagaatgtgtatgca

SEQ ID NO: 231865 - DNA, 25 bp, Mus musculus
cagttatgcagaacttgtcacaaac

SEQ ID NO: 231866 - DNA, 25 bp, Mus musculus
cagttatgtcaggagttcacctttt

SEQ ID NO: 231867 - DNA, 25 bp, Mus musculus
cagttattcagtggttctgggaagt

SEQ ID NO: 231868 - DNA, 25 bp, Mus musculus
cagttattcagttcgttactggcag

SEQ ID NO: 231869 - DNA, 25 bp, Mus musculus
cagttatttctccagagcgtgcccc

SEQ ID NO: 231870 - DNA, 25 bp, Mus musculus
cagttatttctccaggcttcacaga

SEQ ID NO: 231871 - DNA, 25 bp, Mus musculus
cagttcaaagatctaaatgcaaatg

SEQ ID NO: 231872 - DNA, 25 bp, Mus musculus
cagttcaaatcccaagttccgtgag

SEQ ID NO: 231873 - DNA, 25 bp, Mus musculus
cagttcaacaaacggtgtttgcctg

SEQ ID NO: 231874 - DNA, 25 bp, Mus musculus
cagttcaacaaacgttgacttgctg

SEQ ID NO: 231875 - DNA, 25 bp, Mus musculus
cagttcaagcaaatggtattcatgc

SEQ ID NO: 231876 - DNA, 25 bp, Mus musculus
cagttcaaggagatgccagaccagt

SEQ ID NO: 231877 - DNA, 25 bp, Mus musculus
cagttcaagtccttggaaattagaa

SEQ ID NO: 231878 - DNA, 25 bp, Mus musculus
cagttcaagtccttggaccatggta

SEQ ID NO: 231879 - DNA, 25 bp, Mus musculus
cagttcacagcagatgtaaagaaca

SEQ ID NO: 231880 - DNA, 25 bp, Mus musculus
cagttcacagcaggtttaaaaaata

SEQ ID NO: 231881 - DNA, 25 bp, Mus musculus
cagttcacagggaaccccaatatac

SEQ ID NO: 231882 - DNA, 25 bp, Mus musculus
cagttcactaccctcccaaactggc

SEQ ID NO: 231883 - DNA, 25 bp, Mus musculus
cagttcactcaagagttcacaagcc

SEQ ID NO: 231884 - DNA, 25 bp, Mus musculus
cagttcactcaaggagctctgtgaa

SEQ ID NO: 231885 - DNA, 25 bp, Mus musculus
cagttcactgtcaagtcaagactgt

SEQ ID NO: 231886 - DNA, 25 bp, Mus musculus
cagttcagcagcctgcagcagggca

SEQ ID NO: 231887 - DNA, 25 bp, Mus musculus
cagttcagcagggcacctacgcccg

SEQ ID NO: 231888 - DNA, 25 bp, Mus musculus
cagttcagccaggagggagcggaca

SEQ ID NO: 231889 - DNA, 25 bp, Mus musculus
cagttcagggaagaatcggtttctg

SEQ ID NO: 231890 - DNA, 25 bp, Mus musculus
cagttcagggtgatgctctcccagt

SEQ ID NO: 231891 - DNA, 25 bp, Mus musculus
cagttcaggtacaagattgagaaat

SEQ ID NO: 231892 - DNA, 25 bp, Mus musculus
cagttcagtagctatgagccagaat

SEQ ID NO: 231893 - DNA, 25 bp, Mus musculus
cagttcagttagcccccaaccatca

SEQ ID NO: 231894 - DNA, 25 bp, Mus musculus
cagttcataaacaagatgaaattat

SEQ ID NO: 231895 - DNA, 25 bp, Mus musculus
cagttcataaacaaggtcgctggtc

SEQ ID NO: 231896 - DNA, 25 bp, Mus musculus
cagttcataatcaaggcgtatgggc

SEQ ID NO: 231897 - DNA, 25 bp, Mus musculus
cagttcatcagaggagaaatgggtc

SEQ ID NO: 231898 - DNA, 25 bp, Mus musculus
cagttcatgaaatcttttgagcata

SEQ ID NO: 231899 - DNA, 25 bp, Mus musculus
cagttcatgaggttacgtccccatt

SEQ ID NO: 231900 - DNA, 25 bp, Mus musculus
cagttccaagaaaggtgcttacaga

SEQ ID NO: 231901 - DNA, 25 bp, Mus musculus
cagttccaagaggtgggatgctatg

SEQ ID NO: 231902 - DNA, 25 bp, Mus musculus
cagttccactcctagctccaccccc

SEQ ID NO: 231903 - DNA, 25 bp, Mus musculus
cagttccagaaagtgatcacagaat

SEQ ID NO: 231904 - DNA, 25 bp, Mus musculus
cagttccatagtgatgttaattatc

SEQ ID NO: 231905 - DNA, 25 bp, Mus musculus
cagttccattgactaggccagggtc

SEQ ID NO: 231906 - DNA, 25 bp, Mus musculus
cagttcccaggtctttcatagtact

SEQ ID NO: 231907 - DNA, 25 bp, Mus musculus
cagttccccgaattccgtgtagagc

SEQ ID NO: 231908 - DNA, 25 bp, Mus musculus
cagttccccggtatccctctcacgg

SEQ ID NO: 231909 - DNA, 25 bp, Mus musculus
cagttcccgatccaggtctctgagt

SEQ ID NO: 231910 - DNA, 25 bp, Mus musculus
cagttcccttcaaggcatgagagaa

SEQ ID NO: 231911 - DNA, 25 bp, Mus musculus
cagttccgggtccaggcactttcta

SEQ ID NO: 231912 - DNA, 25 bp, Mus musculus
cagttccgttggcgtctccaaggcc

SEQ ID NO: 231913 - DNA, 25 bp, Mus musculus
cagttccgttgggatccgcgcgggc

SEQ ID NO: 231914 - DNA, 25 bp, Mus musculus
cagttcctgagcggcatcccagaga

SEQ ID NO: 231915 - DNA, 25 bp, Mus musculus
cagttcctgcgaggctgctccacta

SEQ ID NO: 231916 - DNA, 25 bp, Mus musculus
cagttcctggaaatccactgcagct

SEQ ID NO: 231917 - DNA, 25 bp, Mus musculus
cagttcctggaaatgcacggggaga

SEQ ID NO: 231918 - DNA, 25 bp, Mus musculus
cagttcctggaccctgtattgggct

SEQ ID NO: 231919 - DNA, 25 bp, Mus musculus
cagttcgagggggctgaagaatact

SEQ ID NO: 231920 - DNA, 25 bp, Mus musculus
cagttcgcaccacccctgccactgc

SEQ ID NO: 231921 - DNA, 25 bp, Mus musculus
cagttcgcagaacagaaactggacg

SEQ ID NO: 231922 - DNA, 25 bp, Mus musculus
cagttcgcagatacacttttggcgt

SEQ ID NO: 231923 - DNA, 25 bp, Mus musculus
cagttcgcaggaggcagagtaagaa

SEQ ID NO: 231924 - DNA, 25 bp, Mus musculus
cagttcggagaggctctgtctgccc

SEQ ID NO: 231925 - DNA, 25 bp, Mus musculus
cagttcggagaggtggttctggaat

SEQ ID NO: 231926 - DNA, 25 bp, Mus musculus
cagttcggcaaagagacttctggtg

SEQ ID NO: 231927 - DNA, 25 bp, Mus musculus
cagttcggcaaaggtgacatttgca

SEQ ID NO: 231928 - DNA, 25 bp, Mus musculus
cagttcggctacaggagatccagtc

SEQ ID NO: 231929 - DNA, 25 bp, Mus musculus
cagttctaattgtaatcgtgttcct

SEQ ID NO: 231930 - DNA, 25 bp, Mus musculus
cagttctatatgctgtctcctaaga

SEQ ID NO: 231931 - DNA, 25 bp, Mus musculus
cagttctatatgttcgcatggacgc

SEQ ID NO: 231932 - DNA, 25 bp, Mus musculus
cagttctatgatggagaatccgggc

SEQ ID NO: 231933 - DNA, 25 bp, Mus musculus
cagttctatggccaacaggctatgg

SEQ ID NO: 231934 - DNA, 25 bp, Mus musculus
cagttctcagagccccgtattcgag

SEQ ID NO: 231935 - DNA, 25 bp, Mus musculus
cagttctcaggaggggtcatctcca

SEQ ID NO: 231936 - DNA, 25 bp, Mus musculus
cagttctcccaggttgttcctcaaa

SEQ ID NO: 231937 - DNA, 25 bp, Mus musculus
cagttctctgagactcgtctgccag

SEQ ID NO: 231938 - DNA, 25 bp, Mus musculus
cagttctctgttcagcccttcccac

SEQ ID NO: 231939 - DNA, 25 bp, Mus musculus
cagttctctgttcaggatatgcagt

SEQ ID NO: 231940 - DNA, 25 bp, Mus musculus
cagttctgaaacataatcacagaac

SEQ ID NO: 231941 - DNA, 25 bp, Mus musculus
cagttctgcaccagcaggaagtgat

SEQ ID NO: 231942 - DNA, 25 bp, Mus musculus
cagttctgcaccaggcatagcagga

SEQ ID NO: 231943 - DNA, 25 bp, Mus musculus
cagttctgccagcgcctgtgagaga

SEQ ID NO: 231944 - DNA, 25 bp, Mus musculus
cagttctggaatatcctggaccatg

SEQ ID NO: 231945 - DNA, 25 bp, Mus musculus
cagttctgggaagcttccagcttta

SEQ ID NO: 231946 - DNA, 25 bp, Mus musculus
cagttctgggaagtctccaggcttt

SEQ ID NO: 231947 - DNA, 25 bp, Mus musculus
cagttctgtgactgatgaagtattt

SEQ ID NO: 231948 - DNA, 25 bp, Mus musculus
cagttcttaacaggcacgtgacaca

SEQ ID NO: 231949 - DNA, 25 bp, Mus musculus
cagttcttaccagaacttgatcacc

SEQ ID NO: 231950 - DNA, 25 bp, Mus musculus
cagttcttaccagagttctggccag

SEQ ID NO: 231951 - DNA, 25 bp, Mus musculus
cagttcttaccagatgacaaatcat

SEQ ID NO: 231952 - DNA, 25 bp, Mus musculus
cagttcttcaccagcccagagaact

SEQ ID NO: 231953 - DNA, 25 bp, Mus musculus
cagttcttcagtgctgagcctacca

SEQ ID NO: 231954 - DNA, 25 bp, Mus musculus
cagttcttctcaggggaggagtacg

SEQ ID NO: 231955 - DNA, 25 bp, Mus musculus
cagttcttctcagggttggaaatcg

SEQ ID NO: 231956 - DNA, 25 bp, Mus musculus
cagttcttctcaggtatattgaaat

SEQ ID NO: 231957 - DNA, 25 bp, Mus musculus
cagttcttgcatggggatgatgact

SEQ ID NO: 231958 - DNA, 25 bp, Mus musculus
cagttcttgtttctgactctaaaac

SEQ ID NO: 231959 - DNA, 25 bp, Mus musculus
cagttcttgtttctggatccttgac

SEQ ID NO: 231960 - DNA, 25 bp, Mus musculus
cagttcttttaggaagctcaataaa

SEQ ID NO: 231961 - DNA, 25 bp, Mus musculus
cagttgaaaggagaggatgcttaaa

SEQ ID NO: 231962 - DNA, 25 bp, Mus musculus
cagttgaagggccttcagtggggct

SEQ ID NO: 231963 - DNA, 25 bp, Mus musculus
cagttgaatcaggagcttacagatg

SEQ ID NO: 231964 - DNA, 25 bp, Mus musculus
cagttgacacgagccgtctaccctg

SEQ ID NO: 231965 - DNA, 25 bp, Mus musculus
cagttgacacggaacagtccaattt

SEQ ID NO: 231966 - DNA, 25 bp, Mus musculus
cagttgacatccgacttcgccctca

SEQ ID NO: 231967 - DNA, 25 bp, Mus musculus
cagttgaccccaggccctgcaggtc

SEQ ID NO: 231968 - DNA, 25 bp, Mus musculus
cagttgataaagactccattagcag

SEQ ID NO: 231969 - DNA, 25 bp, Mus musculus
cagttgatttgagggatggagagtc

SEQ ID NO: 231970 - DNA, 25 bp, Mus musculus
cagttgcaaggactggaccagtttg

SEQ ID NO: 231971 - DNA, 25 bp, Mus musculus
cagttgcaaggtaacctccgtgctt

SEQ ID NO: 231972 - DNA, 25 bp, Mus musculus
cagttgccacaccatataccgaagc

SEQ ID NO: 231973 - DNA, 25 bp, Mus musculus
cagttgccacaccatatataaacta

SEQ ID NO: 231974 - DNA, 25 bp, Mus musculus
cagttgcctcaagacatttgaggga

SEQ ID NO: 231975 - DNA, 25 bp, Mus musculus
cagttgcctcaaggtcctctgtctc

SEQ ID NO: 231976 - DNA, 25 bp, Mus musculus
cagttgcctcagcaccaaggagatc

SEQ ID NO: 231977 - DNA, 25 bp, Mus musculus
cagttgcctcggagtttcagcctca

SEQ ID NO: 231978 - DNA, 25 bp, Mus musculus
cagttgcctgactcgctcggaagct

SEQ ID NO: 231979 - DNA, 25 bp, Mus musculus
cagttgcctttccccggaggaattc

SEQ ID NO: 231980 - DNA, 25 bp, Mus musculus
cagttgctaaacagcatccagggaa

SEQ ID NO: 231981 - DNA, 25 bp, Mus musculus
cagttgctcaggcagtgcttttaca

SEQ ID NO: 231982 - DNA, 25 bp, Mus musculus
cagttgctccccagccctgaggtgc

SEQ ID NO: 231983 - DNA, 25 bp, Mus musculus
cagttgctgttatcggaaataaaga

SEQ ID NO: 231984 - DNA, 25 bp, Mus musculus
cagttgcttagaggctcttgaaatg

SEQ ID NO: 231985 - DNA, 25 bp, Mus musculus
cagttgctttctgtgaggccaggtt

SEQ ID NO: 231986 - DNA, 25 bp, Mus musculus
cagttgctttctgtttctaatcctg

SEQ ID NO: 231987 - DNA, 25 bp, Mus musculus
cagttggaaatcagcaagaagagaa

SEQ ID NO: 231988 - DNA, 25 bp, Mus musculus
cagttggaaatcaggggtctgcaac

SEQ ID NO: 231989 - DNA, 25 bp, Mus musculus
cagttggagatgacatgtttcattg

SEQ ID NO: 231990 - DNA, 25 bp, Mus musculus
cagttggagcaggccctgcaggaaa

SEQ ID NO: 231991 - DNA, 25 bp, Mus musculus
cagttggatgaaaattccaagttgt

SEQ ID NO: 231992 - DNA, 25 bp, Mus musculus
cagttggcatccaaggtccagggag

SEQ ID NO: 231993 - DNA, 25 bp, Mus musculus
cagttggccaaggtgtttcccagcc

SEQ ID NO: 231994 - DNA, 25 bp, Mus musculus
cagttggccaggaaggggagccagg

SEQ ID NO: 231995 - DNA, 25 bp, Mus musculus
cagttggccgatatgaaaatccatg

SEQ ID NO: 231996 - DNA, 25 bp, Mus musculus
cagttggctggagggaaggtggctg

SEQ ID NO: 231997 - DNA, 25 bp, Mus musculus
cagttggctttaacaatctccattc

SEQ ID NO: 231998 - DNA, 25 bp, Mus musculus
cagttgggaaattcctaaatgcaat

SEQ ID NO: 231999 - DNA, 25 bp, Mus musculus
cagttggtggctacctgaagctgat

SEQ ID NO: 232000 - DNA, 25 bp, Mus musculus
cagttggttttgaagaaaggctttg

SEQ ID NO: 232001 - DNA, 25 bp, Mus musculus
cagttgtaattccaactctggttga

SEQ ID NO: 232002 - DNA, 25 bp, Mus musculus
cagttgtagagggcatctcctccca

SEQ ID NO: 232003 - DNA, 25 bp, Mus musculus
cagttgtccagagccaccagccatg

SEQ ID NO: 232004 - DNA, 25 bp, Mus musculus
cagttgtcgggcagaactgtgtctg

SEQ ID NO: 232005 - DNA, 25 bp, Mus musculus
cagttgtcgggcagccagccattca

SEQ ID NO: 232006 - DNA, 25 bp, Mus musculus
cagttgtctacgtcacagagctgct

SEQ ID NO: 232007 - DNA, 25 bp, Mus musculus
cagttgtgagatgtggtgatctacc

SEQ ID NO: 232008 - DNA, 25 bp, Mus musculus
cagttgtgtgactatgcaagctgcg

SEQ ID NO: 232009 - DNA, 25 bp, Mus musculus
cagttgttcatgtcctgaaggggaa

SEQ ID NO: 232010 - DNA, 25 bp, Mus musculus
cagttgttgagctctgaactcactg

SEQ ID NO: 232011 - DNA, 25 bp, Mus musculus
cagttgtttgacttaccatgctcgc

SEQ ID NO: 232012 - DNA, 25 bp, Mus musculus
cagtttaaaaacggcgtggagccca

SEQ ID NO: 232013 - DNA, 25 bp, Mus musculus
cagtttaaagcaaggtgaatgtttg

SEQ ID NO: 232014 - DNA, 25 bp, Mus musculus
cagtttaaatgcagacttaattcag

SEQ ID NO: 232015 - DNA, 25 bp, Mus musculus
cagtttaaatgcaggtctcagccag

SEQ ID NO: 232016 - DNA, 25 bp, Mus musculus
cagtttaacaagacagtggagcatg

SEQ ID NO: 232017 - DNA, 25 bp, Mus musculus
cagtttaacacacaagattcttcca

SEQ ID NO: 232018 - DNA, 25 bp, Mus musculus
cagtttaattatgatggagaagaaa

SEQ ID NO: 232019 - DNA, 25 bp, Mus musculus
cagtttaattatggtatgcagccac

SEQ ID NO: 232020 - DNA, 25 bp, Mus musculus
cagtttacagccacagccacaacct

SEQ ID NO: 232021 - DNA, 25 bp, Mus musculus
cagtttacctaccaggacctgatct

SEQ ID NO: 232022 - DNA, 25 bp, Mus musculus
cagtttacgggggaggctgctctga

SEQ ID NO: 232023 - DNA, 25 bp, Mus musculus
cagtttagaggtctttcagcaagca

SEQ ID NO: 232024 - DNA, 25 bp, Mus musculus
cagtttagaggttatctggaataca

SEQ ID NO: 232025 - DNA, 25 bp, Mus musculus
cagtttagtgtagcacttactagtg

SEQ ID NO: 232026 - DNA, 25 bp, Mus musculus
cagtttagtgtagcttgaactttcc

SEQ ID NO: 232027 - DNA, 25 bp, Mus musculus
cagtttagtgtagttccctccttta

SEQ ID NO: 232028 - DNA, 25 bp, Mus musculus
cagtttatagattctgattcttcgt

SEQ ID NO: 232029 - DNA, 25 bp, Mus musculus
cagtttatagattctttcttgaaca

SEQ ID NO: 232030 - DNA, 25 bp, Mus musculus
cagtttatcaaagtcatgtaggaaa

SEQ ID NO: 232031 - DNA, 25 bp, Mus musculus
cagtttatgatgagtttgtgactta

SEQ ID NO: 232032 - DNA, 25 bp, Mus musculus
cagtttcagagtttctaagctgact

SEQ ID NO: 232033 - DNA, 25 bp, Mus musculus
cagtttcagcgtgcgggaggtgctg

SEQ ID NO: 232034 - DNA, 25 bp, Mus musculus
cagtttccacaccgacactgcaaat

SEQ ID NO: 232035 - DNA, 25 bp, Mus musculus
cagtttccacagaatggactcgcta

SEQ ID NO: 232036 - DNA, 25 bp, Mus musculus
cagtttccatagaaccagtcttcag

SEQ ID NO: 232037 - DNA, 25 bp, Mus musculus
cagtttccggagggactcaaagctg

SEQ ID NO: 232038 - DNA, 25 bp, Mus musculus
cagtttccgtgcctttgaagatgag

SEQ ID NO: 232039 - DNA, 25 bp, Mus musculus
cagtttcgagctggggttattccca

SEQ ID NO: 232040 - DNA, 25 bp, Mus musculus
cagtttcgtcaagatcaaggtcacc

SEQ ID NO: 232041 - DNA, 25 bp, Mus musculus
cagtttcgtcaaggtcaccaaggct

SEQ ID NO: 232042 - DNA, 25 bp, Mus musculus
cagtttctcaagggttgagctccat

SEQ ID NO: 232043 - DNA, 25 bp, Mus musculus
cagtttctcagaatcccctggttga

SEQ ID NO: 232044 - DNA, 25 bp, Mus musculus
cagtttctcgcagagtgttcctgac

SEQ ID NO: 232045 - DNA, 25 bp, Mus musculus
cagtttctcgcagatatattaccaa

SEQ ID NO: 232046 - DNA, 25 bp, Mus musculus
cagtttctctaccaggtctgtcacc

SEQ ID NO: 232047 - DNA, 25 bp, Mus musculus
cagtttctctagatttcaccaacgt

SEQ ID NO: 232048 - DNA, 25 bp, Mus musculus
cagtttctgcagacttgtactggtt

SEQ ID NO: 232049 - DNA, 25 bp, Mus musculus
cagtttctgctctgaaggaaagaga

SEQ ID NO: 232050 - DNA, 25 bp, Mus musculus
cagtttctgctctgcatggtgacat

SEQ ID NO: 232051 - DNA, 25 bp, Mus musculus
cagtttctgctctggcccgtgggat

SEQ ID NO: 232052 - DNA, 25 bp, Mus musculus
cagtttcttggtctggaataaaagc

SEQ ID NO: 232053 - DNA, 25 bp, Mus musculus
cagtttgaaagggtacagtaagcga

SEQ ID NO: 232054 - DNA, 25 bp, Mus musculus
cagtttgaaatcattgctatgtcca

SEQ ID NO: 232055 - DNA, 25 bp, Mus musculus
cagtttgaaatctgatggttaccac

SEQ ID NO: 232056 - DNA, 25 bp, Mus musculus
cagtttgaataataggaatatccga

SEQ ID NO: 232057 - DNA, 25 bp, Mus musculus
cagtttgaataatatttccctcatg

SEQ ID NO: 232058 - DNA, 25 bp, Mus musculus
cagtttgacaaaggaaaaagaggcc

SEQ ID NO: 232059 - DNA, 25 bp, Mus musculus
cagtttgacaggacacagagctgca

SEQ ID NO: 232060 - DNA, 25 bp, Mus musculus
cagtttgactatcagcatggggctg

SEQ ID NO: 232061 - DNA, 25 bp, Mus musculus
cagtttgactatcaggacctccagg

SEQ ID NO: 232062 - DNA, 25 bp, Mus musculus
cagtttgataccggatggtggatta

SEQ ID NO: 232063 - DNA, 25 bp, Mus musculus
cagtttgcaggagcattaagaagaa

SEQ ID NO: 232064 - DNA, 25 bp, Mus musculus
cagtttgcatttaggaggactgaca

SEQ ID NO: 232065 - DNA, 25 bp, Mus musculus
cagtttgccatgaagcggctgctgc

SEQ ID NO: 232066 - DNA, 25 bp, Mus musculus
cagtttgctaagaactttgttgcct

SEQ ID NO: 232067 - DNA, 25 bp, Mus musculus
cagtttgctatgaacctgcagccag

SEQ ID NO: 232068 - DNA, 25 bp, Mus musculus
cagtttgctgaccagaatttttcag

SEQ ID NO: 232069 - DNA, 25 bp, Mus musculus
cagtttgctgaccagctgtatatct

SEQ ID NO: 232070 - DNA, 25 bp, Mus musculus
cagtttggagagtgtgacttgctgg

SEQ ID NO: 232071 - DNA, 25 bp, Mus musculus
cagtttggaggacgtaccatgcggg

SEQ ID NO: 232072 - DNA, 25 bp, Mus musculus
cagtttggaggctcacccgggtggc

SEQ ID NO: 232073 - DNA, 25 bp, Mus musculus
cagtttggagggtttctctgtgtag

SEQ ID NO: 232074 - DNA, 25 bp, Mus musculus
cagtttggcatgctggtttcaccat

SEQ ID NO: 232075 - DNA, 25 bp, Mus musculus
cagtttggctgacaggattgtccgg

SEQ ID NO: 232076 - DNA, 25 bp, Mus musculus
cagtttggctgacagtcatgagagc

SEQ ID NO: 232077 - DNA, 25 bp, Mus musculus
cagtttgggatgaatgccagctcta

SEQ ID NO: 232078 - DNA, 25 bp, Mus musculus
cagttttaaaagcaagtctgcgtgg

SEQ ID NO: 232079 - DNA, 25 bp, Mus musculus
cagttttaaaagcctggctccgtgg

SEQ ID NO: 232080 - DNA, 25 bp, Mus musculus
cagttttaaaagtccagccatttca

SEQ ID NO: 232081 - DNA, 25 bp, Mus musculus
cagttttaagagagattcctttctc

SEQ ID NO: 232082 - DNA, 25 bp, Mus musculus
cagttttaagagaggatttaacagt

SEQ ID NO: 232083 - DNA, 25 bp, Mus musculus
cagttttaagagaggtggctttgca

SEQ ID NO: 232084 - DNA, 25 bp, Mus musculus
cagttttacaggaatctgggcaaat

SEQ ID NO: 232085 - DNA, 25 bp, Mus musculus
cagttttagtgcattgcagaagttg

SEQ ID NO: 232086 - DNA, 25 bp, Mus musculus
cagttttagtggcatcccctgtgag

SEQ ID NO: 232087 - DNA, 25 bp, Mus musculus
cagttttccattgggtcaggatcat

SEQ ID NO: 232088 - DNA, 25 bp, Mus musculus
cagttttccccaaggcaagtcttgg

SEQ ID NO: 232089 - DNA, 25 bp, Mus musculus
cagttttccccaaggctagcttccg

SEQ ID NO: 232090 - DNA, 25 bp, Mus musculus
cagttttcggagtctattgcatctg

SEQ ID NO: 232091 - DNA, 25 bp, Mus musculus
cagttttctcaggaaattgggcttg

SEQ ID NO: 232092 - DNA, 25 bp, Mus musculus
cagttttgaaaaagaatatatttga

SEQ ID NO: 232093 - DNA, 25 bp, Mus musculus
cagttttgaaaaaggtgactcattt

SEQ ID NO: 232094 - DNA, 25 bp, Mus musculus
cagttttgaaggctctgctaaggcc

SEQ ID NO: 232095 - DNA, 25 bp, Mus musculus
cagttttgaggcaagaaatctcaag

SEQ ID NO: 232096 - DNA, 25 bp, Mus musculus
cagttttgctgagaatggaatcatc

SEQ ID NO: 232097 - DNA, 25 bp, Mus musculus
cagttttgggggctcgccatacgac

SEQ ID NO: 232098 - DNA, 25 bp, Mus musculus
cagttttggtagagggacagtgtct

SEQ ID NO: 232099 - DNA, 25 bp, Mus musculus
cagtttttagcgttctccacccatg

SEQ ID NO: 232100 - DNA, 25 bp, Mus musculus
cagtttttccaccgctctccagccc

SEQ ID NO: 232101 - DNA, 25 bp, Mus musculus
cagtttttcgatgagatggcggatc

SEQ ID NO: 232102 - DNA, 25 bp, Mus musculus
cagtttttcgatgaggctgaattgc

SEQ ID NO: 232103 - DNA, 25 bp, Mus musculus
cagtttttggaggcaactgtgccca

SEQ ID NO: 232104 - DNA, 25 bp, Mus musculus
cagtttttgttggaaatacagttgg

SEQ ID NO: 232105 - DNA, 25 bp, Mus musculus
cagtttttttgcattttgttcccaa

SEQ ID NO: 232106 - DNA, 25 bp, Mus musculus
cataaaaaaaccgacaagctgggct

SEQ ID NO: 232107 - DNA, 25 bp, Mus musculus
cataaaaaagaggacgaggcggaag

SEQ ID NO: 232108 - DNA, 25 bp, Mus musculus
cataaaaaagcttgcacacacaatg

SEQ ID NO: 232109 - DNA, 25 bp, Mus musculus
cataaaaacattgcaaagaactgac

SEQ ID NO: 232110 - DNA, 25 bp, Mus musculus
cataaaactacgagctcctgcttcc

SEQ ID NO: 232111 - DNA, 25 bp, Mus musculus
cataaaactacgaggtgttctgccc

SEQ ID NO: 232112 - DNA, 25 bp, Mus musculus
cataaaactacgagtcacaccagaa

SEQ ID NO: 232113 - DNA, 25 bp, Mus musculus
cataaaactacgagtttatagaaca

SEQ ID NO: 232114 - DNA, 25 bp, Mus musculus
cataaaagaatgatgccagcatgtc

SEQ ID NO: 232115 - DNA, 25 bp, Mus musculus
cataaaagaggaactcattatacaa

SEQ ID NO: 232116 - DNA, 25 bp, Mus musculus
cataaaagcattaaagcccagtgcc

SEQ ID NO: 232117 - DNA, 25 bp, Mus musculus
cataaaagtcaagtgatcaaccgga

SEQ ID NO: 232118 - DNA, 25 bp, Mus musculus
cataaacacggcttttttcacaggg

SEQ ID NO: 232119 - DNA, 25 bp, Mus musculus
cataaacagaaagcttcacggaaac

SEQ ID NO: 232120 - DNA, 25 bp, Mus musculus
cataaacagcaagcctgtcattcct

SEQ ID NO: 232121 - DNA, 25 bp, Mus musculus
cataaacagcaaggggagatgttgc

SEQ ID NO: 232122 - DNA, 25 bp, Mus musculus
cataaacaggctgagatttgagata

SEQ ID NO: 232123 - DNA, 25 bp, Mus musculus
cataaacatgctcagcaaagaagtc

SEQ ID NO: 232124 - DNA, 25 bp, Mus musculus
cataaacatggaataccaaattgat

SEQ ID NO: 232125 - DNA, 25 bp, Mus musculus
cataaacatggacttgaattttatg

SEQ ID NO: 232126 - DNA, 25 bp, Mus musculus
cataaacgacaggtgtgtggaggtc

SEQ ID NO: 232127 - DNA, 25 bp, Mus musculus
cataaacgacaggtgtgttgaaagc

SEQ ID NO: 232128 - DNA, 25 bp, Mus musculus
cataaagaaaatataaacaccagtt

SEQ ID NO: 232129 - DNA, 25 bp, Mus musculus
cataaagaaaatgcagcgttcctgc

SEQ ID NO: 232130 - DNA, 25 bp, Mus musculus
cataaagaaggaatcacccacttgc

SEQ ID NO: 232131 - DNA, 25 bp, Mus musculus
cataaagaatttgggagggctggag

SEQ ID NO: 232132 - DNA, 25 bp, Mus musculus
cataaagacagaggttcttgcagcc

SEQ ID NO: 232133 - DNA, 25 bp, Mus musculus
cataaagagcagatcaaattgctta

SEQ ID NO: 232134 - DNA, 25 bp, Mus musculus
cataaagagcagttctcctatttca

SEQ ID NO: 232135 - DNA, 25 bp, Mus musculus
cataaagatagatgtgctaacgaaa

SEQ ID NO: 232136 - DNA, 25 bp, Mus musculus
cataaagccaggcagtgaagcagat

SEQ ID NO: 232137 - DNA, 25 bp, Mus musculus
cataaagcccaaactcccacaatct

SEQ ID NO: 232138 - DNA, 25 bp, Mus musculus
cataaagcccaagtggaacggctgc

SEQ ID NO: 232139 - DNA, 25 bp, Mus musculus
cataaataaggtgcgagaagatgta

SEQ ID NO: 232140 - DNA, 25 bp, Mus musculus
cataaataaggttgtgcatttttgg

SEQ ID NO: 232141 - DNA, 25 bp, Mus musculus
cataaatacaaaacctgggcattcc

SEQ ID NO: 232142 - DNA, 25 bp, Mus musculus
cataaatacactctgattactacaa

SEQ ID NO: 232143 - DNA, 25 bp, Mus musculus
cataaatataaaaagaggaaactgc

SEQ ID NO: 232144 - DNA, 25 bp, Mus musculus
cataaatataaaaaggtaacaactg

SEQ ID NO: 232145 - DNA, 25 bp, Mus musculus
cataaatattgaaatcgcatcatat

SEQ ID NO: 232146 - DNA, 25 bp, Mus musculus
cataaatgatgtatgtcgcactggc

SEQ ID NO: 232147 - DNA, 25 bp, Mus musculus
cataaatggaaaaacagctctcctc

SEQ ID NO: 232148 - DNA, 25 bp, Mus musculus
cataaattgcaccaggatctttctc

SEQ ID NO: 232149 - DNA, 25 bp, Mus musculus
cataacaacaaagaagggattcacc

SEQ ID NO: 232150 - DNA, 25 bp, Mus musculus
cataacaaggatatagtgcacagag

SEQ ID NO: 232151 - DNA, 25 bp, Mus musculus
cataacaattgaagtcagaaggaga

SEQ ID NO: 232152 - DNA, 25 bp, Mus musculus
cataacacgacaaggtgtccaggcc

SEQ ID NO: 232153 - DNA, 25 bp, Mus musculus
cataacagagatttgctggatctca

SEQ ID NO: 232154 - DNA, 25 bp, Mus musculus
cataacagagatttgtctcaatgga

SEQ ID NO: 232155 - DNA, 25 bp, Mus musculus
cataacatagactgaaacagtcccc

SEQ ID NO: 232156 - DNA, 25 bp, Mus musculus
cataacccggcagaactacacatac

SEQ ID NO: 232157 - DNA, 25 bp, Mus musculus
cataacccttcggtgacccaccctc

SEQ ID NO: 232158 - DNA, 25 bp, Mus musculus
cataacctacaagctaccacatttg

SEQ ID NO: 232159 - DNA, 25 bp, Mus musculus
cataacctacaagttgttatccgat

SEQ ID NO: 232160 - DNA, 25 bp, Mus musculus
cataacctacacagcgtacggcatg

SEQ ID NO: 232161 - DNA, 25 bp, Mus musculus
cataacctgcaaacactgcccccca

SEQ ID NO: 232162 - DNA, 25 bp, Mus musculus
cataacgctaacaggatgagattgt

SEQ ID NO: 232163 - DNA, 25 bp, Mus musculus
cataacgctaagtgtgatgaatgca

SEQ ID NO: 232164 - DNA, 25 bp, Mus musculus
cataacggtggggtttgcaatagca

SEQ ID NO: 232165 - DNA, 25 bp, Mus musculus
cataactatcgcgaacgagagaggg

SEQ ID NO: 232166 - DNA, 25 bp, Mus musculus
cataactgaagatgaaaaaggtcat

SEQ ID NO: 232167 - DNA, 25 bp, Mus musculus
cataactggctgggtggaaccaggc

SEQ ID NO: 232168 - DNA, 25 bp, Mus musculus
cataacttcagaaggaataaaagct

SEQ ID NO: 232169 - DNA, 25 bp, Mus musculus
cataacttccagagaatctcagtat

SEQ ID NO: 232170 - DNA, 25 bp, Mus musculus
cataacttccagatccaggccttca

SEQ ID NO: 232171 - DNA, 25 bp, Mus musculus
cataacttcctgagaaggacttgat

SEQ ID NO: 232172 - DNA, 25 bp, Mus musculus
cataactttcagccgatcaacttct

SEQ ID NO: 232173 - DNA, 25 bp, Mus musculus
cataagaacgggagaggctccatca

SEQ ID NO: 232174 - DNA, 25 bp, Mus musculus
cataagaagtgtttccacgatgatg

SEQ ID NO: 232175 - DNA, 25 bp, Mus musculus
cataagaggcggtgactccatacca

SEQ ID NO: 232176 - DNA, 25 bp, Mus musculus
cataagatggtggtgagtgcctatg

SEQ ID NO: 232177 - DNA, 25 bp, Mus musculus
cataagcaaacatgtttccttttag

SEQ ID NO: 232178 - DNA, 25 bp, Mus musculus
cataagcactgtgttttcagtaaat

SEQ ID NO: 232179 - DNA, 25 bp, Mus musculus
cataagcatgtgtaggacccagcca

SEQ ID NO: 232180 - DNA, 25 bp, Mus musculus
cataaggacattagattgatcaggg

SEQ ID NO: 232181 - DNA, 25 bp, Mus musculus
cataaggaccaggatacaaattgga

SEQ ID NO: 232182 - DNA, 25 bp, Mus musculus
cataaggcaagacagattacaaaag

SEQ ID NO: 232183 - DNA, 25 bp, Mus musculus
cataaggccaaggtttcctttgcca

SEQ ID NO: 232184 - DNA, 25 bp, Mus musculus
cataaggccacatgttttatggcta

SEQ ID NO: 232185 - DNA, 25 bp, Mus musculus
cataagggctgagaggcaggaaatg

SEQ ID NO: 232186 - DNA, 25 bp, Mus musculus
cataaggtataaggcttgctcttca

SEQ ID NO: 232187 - DNA, 25 bp, Mus musculus
cataagtaaaggagaggagccaaaa

SEQ ID NO: 232188 - DNA, 25 bp, Mus musculus
cataagtaaccaaatgagtaagaaa

SEQ ID NO: 232189 - DNA, 25 bp, Mus musculus
cataagtaaccaacacagatccagt

SEQ ID NO: 232190 - DNA, 25 bp, Mus musculus
cataagtaccaggctggtaagaaca

SEQ ID NO: 232191 - DNA, 25 bp, Mus musculus
cataagtgaagagagaagtttattg

SEQ ID NO: 232192 - DNA, 25 bp, Mus musculus
cataagtggttctagctttaaggac

SEQ ID NO: 232193 - DNA, 25 bp, Mus musculus
cataagtggttctaggagctcagac

SEQ ID NO: 232194 - DNA, 25 bp, Mus musculus
cataagttcaaacctctaggactcc

SEQ ID NO: 232195 - DNA, 25 bp, Mus musculus
cataagttcaaacggcaacaggtcc

SEQ ID NO: 232196 - DNA, 25 bp, Mus musculus
cataagttcaaagctctaggactcc

SEQ ID NO: 232197 - DNA, 25 bp, Mus musculus
cataagttcaaagggcaacaggtcc

SEQ ID NO: 232198 - DNA, 25 bp, Mus musculus
cataagtttggatgatttaccttgc

SEQ ID NO: 232199 - DNA, 25 bp, Mus musculus
cataatattacgcaacatatgaaag

SEQ ID NO: 232200 - DNA, 25 bp, Mus musculus
cataatcaaactacgaccccagcag

SEQ ID NO: 232201 - DNA, 25 bp, Mus musculus
cataatcaaggcgtatgggcaagtc

SEQ ID NO: 232202 - DNA, 25 bp, Mus musculus
cataatccagccctctaataaagct

SEQ ID NO: 232203 - DNA, 25 bp, Mus musculus
cataatcgaaggttggctgctgagc

SEQ ID NO: 232204 - DNA, 25 bp, Mus musculus
cataatcgcaaaaacatcaaactga

SEQ ID NO: 232205 - DNA, 25 bp, Mus musculus
cataatcttggtggagaaactcttc

SEQ ID NO: 232206 - DNA, 25 bp, Mus musculus
cataatgaaggtttatggaggtgat

SEQ ID NO: 232207 - DNA, 25 bp, Mus musculus
cataatgagtttgagatactaagca

SEQ ID NO: 232208 - DNA, 25 bp, Mus musculus
cataatgcagggcacaccaagagcc

SEQ ID NO: 232209 - DNA, 25 bp, Mus musculus
cataatgcatgccaagtggcagcac

SEQ ID NO: 232210 - DNA, 25 bp, Mus musculus
cataatggaagggccatgccacctc

SEQ ID NO: 232211 - DNA, 25 bp, Mus musculus
cataatggagatggttctgccgatc

SEQ ID NO: 232212 - DNA, 25 bp, Mus musculus
cataatgttcattttactgtgtgga

SEQ ID NO: 232213 - DNA, 25 bp, Mus musculus
cataattcagaaaatcagaaaatgc

SEQ ID NO: 232214 - DNA, 25 bp, Mus musculus
cataattccccagaaattgatgaga

SEQ ID NO: 232215 - DNA, 25 bp, Mus musculus
cataattccccaggcgttaagcatc

SEQ ID NO: 232216 - DNA, 25 bp, Mus musculus
cataattgcccaggactcgttaatg

SEQ ID NO: 232217 - DNA, 25 bp, Mus musculus
cataattgcccagtatttaacagac

SEQ ID NO: 232218 - DNA, 25 bp, Mus musculus
cataattttattacgtttggcaaac

SEQ ID NO: 232219 - DNA, 25 bp, Mus musculus
catacaacatgctgttgtgaacttg

SEQ ID NO: 232220 - DNA, 25 bp, Mus musculus
catacaagagaggtgactacggggg

SEQ ID NO: 232221 - DNA, 25 bp, Mus musculus
catacaagtatgaacacaattttga

SEQ ID NO: 232222 - DNA, 25 bp, Mus musculus
catacacaaggccagctgttgccag

SEQ ID NO: 232223 - DNA, 25 bp, Mus musculus
catacacatatggaggggcttttta

SEQ ID NO: 232224 - DNA, 25 bp, Mus musculus
catacacattctcaataacctgtgt

SEQ ID NO: 232225 - DNA, 25 bp, Mus musculus
catacaccagcaactctgatgatca

SEQ ID NO: 232226 - DNA, 25 bp, Mus musculus
catacaccatcacagaatacactgt

SEQ ID NO: 232227 - DNA, 25 bp, Mus musculus
catacaccatcacagtgttccttcc

SEQ ID NO: 232228 - DNA, 25 bp, Mus musculus
catacagaaagagtatgaaaagaca

SEQ ID NO: 232229 - DNA, 25 bp, Mus musculus
catacagaaccatgaccatccacaa

SEQ ID NO: 232230 - DNA, 25 bp, Mus musculus
catacagaaccgaggtagtcaagaa

SEQ ID NO: 232231 - DNA, 25 bp, Mus musculus
catacagaatatttaatacgaacag

SEQ ID NO: 232232 - DNA, 25 bp, Mus musculus
catacagcagaagaggaccacgact

SEQ ID NO: 232233 - DNA, 25 bp, Mus musculus
catacagccaaggccaggtagctga

SEQ ID NO: 232234 - DNA, 25 bp, Mus musculus
catacagccagagaagtgacaggga

SEQ ID NO: 232235 - DNA, 25 bp, Mus musculus
catacagccaggaaacaaagcttag

SEQ ID NO: 232236 - DNA, 25 bp, Mus musculus
catacagccaggaaggaatctgcta

SEQ ID NO: 232237 - DNA, 25 bp, Mus musculus
catacagctggtaaacaccagagaa

SEQ ID NO: 232238 - DNA, 25 bp, Mus musculus
catacagggagcctgctttggtact

SEQ ID NO: 232239 - DNA, 25 bp, Mus musculus
catacaggtatgtcatcaggcagcg

SEQ ID NO: 232240 - DNA, 25 bp, Mus musculus
catacatcaaaagctgcagaatctg

SEQ ID NO: 232241 - DNA, 25 bp, Mus musculus
catacatcagccctcgtggtagctg

SEQ ID NO: 232242 - DNA, 25 bp, Mus musculus
catacatcagttttgcaggtgacga

SEQ ID NO: 232243 - DNA, 25 bp, Mus musculus
catacatccggggactgagtggggt

SEQ ID NO: 232244 - DNA, 25 bp, Mus musculus
catacatctagtggcagagagttga

SEQ ID NO: 232245 - DNA, 25 bp, Mus musculus
catacattaaaagttttcagcagac

SEQ ID NO: 232246 - DNA, 25 bp, Mus musculus
catacattccagggccttattttgg

SEQ ID NO: 232247 - DNA, 25 bp, Mus musculus
cataccaaaaagcagatggagacac

SEQ ID NO: 232248 - DNA, 25 bp, Mus musculus
cataccaaaaagcagattgtccatc

SEQ ID NO: 232249 - DNA, 25 bp, Mus musculus
cataccaaatcagcagaaatggagg

SEQ ID NO: 232250 - DNA, 25 bp, Mus musculus
cataccaatggcctgatcacaactg

SEQ ID NO: 232251 - DNA, 25 bp, Mus musculus
cataccaatttaagctccagctcca

SEQ ID NO: 232252 - DNA, 25 bp, Mus musculus
cataccacacagcaaggggacgggg

SEQ ID NO: 232253 - DNA, 25 bp, Mus musculus
cataccacacagcaagggggaagca

SEQ ID NO: 232254 - DNA, 25 bp, Mus musculus
cataccagcgaggggtcccgtagcc

SEQ ID NO: 232255 - DNA, 25 bp, Mus musculus
cataccagcttcagatctacccaaa

SEQ ID NO: 232256 - DNA, 25 bp, Mus musculus
cataccagcttcaggttgcatcagt

SEQ ID NO: 232257 - DNA, 25 bp, Mus musculus
cataccatacacaaggccagctgtt

SEQ ID NO: 232258 - DNA, 25 bp, Mus musculus
catacccaaaggtatcacagccaca

SEQ ID NO: 232259 - DNA, 25 bp, Mus musculus
catacccaatcagggggagatcttg

SEQ ID NO: 232260 - DNA, 25 bp, Mus musculus
catacccaatcaggtgatccgcagg

SEQ ID NO: 232261 - DNA, 25 bp, Mus musculus
catacccagcctggtctatacagag

SEQ ID NO: 232262 - DNA, 25 bp, Mus musculus
catacccagtgccttgccatctctc

SEQ ID NO: 232263 - DNA, 25 bp, Mus musculus
catacccagtgtgtcatcaataaac

SEQ ID NO: 232264 - DNA, 25 bp, Mus musculus
catacccatgtctgaccttctgccc

SEQ ID NO: 232265 - DNA, 25 bp, Mus musculus
cataccccatgcagctatctaactt

SEQ ID NO: 232266 - DNA, 25 bp, Mus musculus
cataccccatgtcagggagacagct

SEQ ID NO: 232267 - DNA, 25 bp, Mus musculus
cataccctctgtggtgagcatcaga

SEQ ID NO: 232268 - DNA, 25 bp, Mus musculus
cataccctctgtgtgacagctcaac

SEQ ID NO: 232269 - DNA, 25 bp, Mus musculus
cataccctgttgtggcctcttcctg

SEQ ID NO: 232270 - DNA, 25 bp, Mus musculus
cataccgcaagagacagataaatcc

SEQ ID NO: 232271 - DNA, 25 bp, Mus musculus
cataccgcaagatcgtctacttcat

SEQ ID NO: 232272 - DNA, 25 bp, Mus musculus
cataccggccaggtgtatgatgaaa

SEQ ID NO: 232273 - DNA, 25 bp, Mus musculus
catacctaaggtggagattctagac

SEQ ID NO: 232274 - DNA, 25 bp, Mus musculus
catacctcaatcaaggtcagtcgta

SEQ ID NO: 232275 - DNA, 25 bp, Mus musculus
catacctcaatcaaggtgtggtccc

SEQ ID NO: 232276 - DNA, 25 bp, Mus musculus
catacctcgagaattatagtgaaca

SEQ ID NO: 232277 - DNA, 25 bp, Mus musculus
catacctgacaggagtggggatact

SEQ ID NO: 232278 - DNA, 25 bp, Mus musculus
catacctgagctcgatgtcggttgg

SEQ ID NO: 232279 - DNA, 25 bp, Mus musculus
catacctgagctcgctggcttctcc

SEQ ID NO: 232280 - DNA, 25 bp, Mus musculus
catacctgctgagggacccagggtc

SEQ ID NO: 232281 - DNA, 25 bp, Mus musculus
catacctgctgctccagcacggaag

SEQ ID NO: 232282 - DNA, 25 bp, Mus musculus
catacctggggacagaattgcccta

SEQ ID NO: 232283 - DNA, 25 bp, Mus musculus
catacctgtggcagcaccgggactc

SEQ ID NO: 232284 - DNA, 25 bp, Mus musculus
catacctgtggtctcaccagctcag

SEQ ID NO: 232285 - DNA, 25 bp, Mus musculus
catacgacagctgcctcctagcttt

SEQ ID NO: 232286 - DNA, 25 bp, Mus musculus
catacgacagctgggctacttgatt

SEQ ID NO: 232287 - DNA, 25 bp, Mus musculus
catacgatcacaagatgtctggtca

SEQ ID NO: 232288 - DNA, 25 bp, Mus musculus
catacgatcacaagattggcgaaag

SEQ ID NO: 232289 - DNA, 25 bp, Mus musculus
catacgatcacagataactatgcta

SEQ ID NO: 232290 - DNA, 25 bp, Mus musculus
catacgatcacagggatctcgattg

SEQ ID NO: 232291 - DNA, 25 bp, Mus musculus
catacgccttttatgcatcttggca

SEQ ID NO: 232292 - DNA, 25 bp, Mus musculus
catacggacacataactggctctgt

SEQ ID NO: 232293 - DNA, 25 bp, Mus musculus
catacggacataaatattcttgtag

SEQ ID NO: 232294 - DNA, 25 bp, Mus musculus
catacggacatatagattcttgtag

SEQ ID NO: 232295 - DNA, 25 bp, Mus musculus
catacggacttggacattaaggccc

SEQ ID NO: 232296 - DNA, 25 bp, Mus musculus
catacggcacctcgacacgtgtgca

SEQ ID NO: 232297 - DNA, 25 bp, Mus musculus
catacggcacctcggctggaaccct

SEQ ID NO: 232298 - DNA, 25 bp, Mus musculus
catacggcctttattaagtacagtc

SEQ ID NO: 232299 - DNA, 25 bp, Mus musculus
catacggtggtgcaatctgccagct

SEQ ID NO: 232300 - DNA, 25 bp, Mus musculus
catacggtggtgcacctcgcctgca

SEQ ID NO: 232301 - DNA, 25 bp, Mus musculus
catacggtggtgcaggctctccttc

SEQ ID NO: 232302 - DNA, 25 bp, Mus musculus
catacgtttttcagaatgccggaca

SEQ ID NO: 232303 - DNA, 25 bp, Mus musculus
catactaactaaaggatgacagtcc

SEQ ID NO: 232304 - DNA, 25 bp, Mus musculus
catactacaggatctatgggcaggc

SEQ ID NO: 232305 - DNA, 25 bp, Mus musculus
catactacaggtgagcgtcctcaca

SEQ ID NO: 232306 - DNA, 25 bp, Mus musculus
catactacgttgatcacctcaacca

SEQ ID NO: 232307 - DNA, 25 bp, Mus musculus
catactatatatgccgttcctatga

SEQ ID NO: 232308 - DNA, 25 bp, Mus musculus
catactatctatgcaaaagtagaca

SEQ ID NO: 232309 - DNA, 25 bp, Mus musculus
catactatggtaaagatccctcaag

SEQ ID NO: 232310 - DNA, 25 bp, Mus musculus
catactcaagctaccactacccctg

SEQ ID NO: 232311 - DNA, 25 bp, Mus musculus
catactcacgtgaatgatggcactg

SEQ ID NO: 232312 - DNA, 25 bp, Mus musculus
catactcagcgagagaagcgggact

SEQ ID NO: 232313 - DNA, 25 bp, Mus musculus
catactctgagtgacagcttcctct

SEQ ID NO: 232314 - DNA, 25 bp, Mus musculus
catactctgtgccagacatcctgca

SEQ ID NO: 232315 - DNA, 25 bp, Mus musculus
catactctgtgccagccatgaatgt

SEQ ID NO: 232316 - DNA, 25 bp, Mus musculus
catactgaagctgacattatctcta

SEQ ID NO: 232317 - DNA, 25 bp, Mus musculus
catactgatagaccctgttgactga

SEQ ID NO: 232318 - DNA, 25 bp, Mus musculus
catactgcaggcagagaggtggctc

SEQ ID NO: 232319 - DNA, 25 bp, Mus musculus
catactgcagtctggacagaggatc

SEQ ID NO: 232320 - DNA, 25 bp, Mus musculus
catactgcatgacatcaacagtgat

SEQ ID NO: 232321 - DNA, 25 bp, Mus musculus
catactgccatttgatcacagccga

SEQ ID NO: 232322 - DNA, 25 bp, Mus musculus
catactgctcaatccatcgagacac

SEQ ID NO: 232323 - DNA, 25 bp, Mus musculus
catactggaaaaggtgtactttgtg

SEQ ID NO: 232324 - DNA, 25 bp, Mus musculus
catactgtagaggaatgcctccaat

SEQ ID NO: 232325 - DNA, 25 bp, Mus musculus
catactgtagaggagaatccttcct

SEQ ID NO: 232326 - DNA, 25 bp, Mus musculus
catactgtctactggtgccctccca

SEQ ID NO: 232327 - DNA, 25 bp, Mus musculus
catactgtctactgttccaccaagg

SEQ ID NO: 232328 - DNA, 25 bp, Mus musculus
catactgtgagctggcccagtcctc

SEQ ID NO: 232329 - DNA, 25 bp, Mus musculus
catactgtgagctggttcacccacc

SEQ ID NO: 232330 - DNA, 25 bp, Mus musculus
catactgttgagcctgagaaatgcc

SEQ ID NO: 232331 - DNA, 25 bp, Mus musculus
catacttcagactagcttcctttta

SEQ ID NO: 232332 - DNA, 25 bp, Mus musculus
catacttcaggtcttcagcaatatc

SEQ ID NO: 232333 - DNA, 25 bp, Mus musculus
catacttccatgaaacaatcccacg

SEQ ID NO: 232334 - DNA, 25 bp, Mus musculus
catacttccatggccgtaattaaca

SEQ ID NO: 232335 - DNA, 25 bp, Mus musculus
catacttcccaagacagcattttcc

SEQ ID NO: 232336 - DNA, 25 bp, Mus musculus
catacttgcacaccgctggtttgtc

SEQ ID NO: 232337 - DNA, 25 bp, Mus musculus
catagaacagaactcatgggaagat

SEQ ID NO: 232338 - DNA, 25 bp, Mus musculus
catagaacaggccaaagtagaagag

SEQ ID NO: 232339 - DNA, 25 bp, Mus musculus
catagaaggagaaggtctcaggagc

SEQ ID NO: 232340 - DNA, 25 bp, Mus musculus
catagaatccgttgaagactttctg

SEQ ID NO: 232341 - DNA, 25 bp, Mus musculus
catagacaaaggagagaagagaggc

SEQ ID NO: 232342 - DNA, 25 bp, Mus musculus
catagacagtagaggctccgcagga

SEQ ID NO: 232343 - DNA, 25 bp, Mus musculus
catagaccagcgctcctccagacaa

SEQ ID NO: 232344 - DNA, 25 bp, Mus musculus
catagaccaggtgagacggaaggcc

SEQ ID NO: 232345 - DNA, 25 bp, Mus musculus
catagacctcatcttcagtccctaa

SEQ ID NO: 232346 - DNA, 25 bp, Mus musculus
catagacctcatggcctctacaagc

SEQ ID NO: 232347 - DNA, 25 bp, Mus musculus
catagacctcattgggcaagagctt

SEQ ID NO: 232348 - DNA, 25 bp, Mus musculus
catagacgagaggctcagagccctg

SEQ ID NO: 232349 - DNA, 25 bp, Mus musculus
catagactagatatggaacgggagc

SEQ ID NO: 232350 - DNA, 25 bp, Mus musculus
catagactatacatgtgaatgaact

SEQ ID NO: 232351 - DNA, 25 bp, Mus musculus
catagactgtgaagtatttcggcgg

SEQ ID NO: 232352 - DNA, 25 bp, Mus musculus
catagacttcaggaataaagtggtg

SEQ ID NO: 232353 - DNA, 25 bp, Mus musculus
catagagaaggtgacagatgtcatg

SEQ ID NO: 232354 - DNA, 25 bp, Mus musculus
catagagaatcaggctgtcaccaac

SEQ ID NO: 232355 - DNA, 25 bp, Mus musculus
catagagacctaccttctggagaag

SEQ ID NO: 232356 - DNA, 25 bp, Mus musculus
catagatgcaggaggattggaagct

SEQ ID NO: 232357 - DNA, 25 bp, Mus musculus
catagatgcaggagtgagattatat

SEQ ID NO: 232358 - DNA, 25 bp, Mus musculus
catagatgtaggtgaaaaatctctc

SEQ ID NO: 232359 - DNA, 25 bp, Mus musculus
catagattcacttgctgtaagaact

SEQ ID NO: 232360 - DNA, 25 bp, Mus musculus
catagattcacttggcttgttacat

SEQ ID NO: 232361 - DNA, 25 bp, Mus musculus
catagattccaactaaaaataggaa

SEQ ID NO: 232362 - DNA, 25 bp, Mus musculus
catagattccaactaagagttggcc

SEQ ID NO: 232363 - DNA, 25 bp, Mus musculus
catagcaacaacagccatgggttct

SEQ ID NO: 232364 - DNA, 25 bp, Mus musculus
catagcaacatgaaggtcatgtagg

SEQ ID NO: 232365 - DNA, 25 bp, Mus musculus
catagcaattaaggaactagaggct

SEQ ID NO: 232366 - DNA, 25 bp, Mus musculus
catagcaattaagggagtggccagg

SEQ ID NO: 232367 - DNA, 25 bp, Mus musculus
catagcagaccggatcctcttcagc

SEQ ID NO: 232368 - DNA, 25 bp, Mus musculus
catagcagagctacccagctgggtt

SEQ ID NO: 232369 - DNA, 25 bp, Mus musculus
catagcatcaggcactgttgtaggc

SEQ ID NO: 232370 - DNA, 25 bp, Mus musculus
catagccaaggaaggtggggttgta

SEQ ID NO: 232371 - DNA, 25 bp, Mus musculus
catagccaaggtggacggtatcctg

SEQ ID NO: 232372 - DNA, 25 bp, Mus musculus
catagccagatgaggaagctggaag

SEQ ID NO: 232373 - DNA, 25 bp, Mus musculus
catagccatgctttctggcatatgc

SEQ ID NO: 232374 - DNA, 25 bp, Mus musculus
catagcccagaaggcgggcaggaag

SEQ ID NO: 232375 - DNA, 25 bp, Mus musculus
catagcccagcaggaagcaacttct

SEQ ID NO: 232376 - DNA, 25 bp, Mus musculus
catagcccagcaggtgaccaaccac

SEQ ID NO: 232377 - DNA, 25 bp, Mus musculus
catagcctgctgggtccaccataag

SEQ ID NO: 232378 - DNA, 25 bp, Mus musculus
catagcgacagcgaaggacgaacgt

SEQ ID NO: 232379 - DNA, 25 bp, Mus musculus
catagctccacatgaactcacagaa

SEQ ID NO: 232380 - DNA, 25 bp, Mus musculus
catagctccacatgacattctctgg

SEQ ID NO: 232381 - DNA, 25 bp, Mus musculus
catagctccacatgccatttaccaa

SEQ ID NO: 232382 - DNA, 25 bp, Mus musculus
catagctccagtgacccaccgttct

SEQ ID NO: 232383 - DNA, 25 bp, Mus musculus
catagctgcttggaagttggcagta

SEQ ID NO: 232384 - DNA, 25 bp, Mus musculus
catagctgtctggtttgtggacagt

SEQ ID NO: 232385 - DNA, 25 bp, Mus musculus
catagcttacatacccttcgcaggt

SEQ ID NO: 232386 - DNA, 25 bp, Mus musculus
cataggaaagcaagggaacctagta

SEQ ID NO: 232387 - DNA, 25 bp, Mus musculus
cataggaaatgcagaccagcagaac

SEQ ID NO: 232388 - DNA, 25 bp, Mus musculus
cataggaacaaagacaggaaatctg

SEQ ID NO: 232389 - DNA, 25 bp, Mus musculus
cataggaacagattgagaaatggca

SEQ ID NO: 232390 - DNA, 25 bp, Mus musculus
cataggacagtctcccatggctatt

SEQ ID NO: 232391 - DNA, 25 bp, Mus musculus
cataggacattttccttcccgtcga

SEQ ID NO: 232392 - DNA, 25 bp, Mus musculus
cataggagaagtatgagctggtgtc

SEQ ID NO: 232393 - DNA, 25 bp, Mus musculus
cataggattaccgaaggcaaatgga

SEQ ID NO: 232394 - DNA, 25 bp, Mus musculus
cataggcaaggatagttcatgcaga

SEQ ID NO: 232395 - DNA, 25 bp, Mus musculus
cataggcagatccggcgaatacagg

SEQ ID NO: 232396 - DNA, 25 bp, Mus musculus
cataggctatgcaagggctacagag

SEQ ID NO: 232397 - DNA, 25 bp, Mus musculus
cataggctatgggcacgtgcggcat

SEQ ID NO: 232398 - DNA, 25 bp, Mus musculus
cataggctttgccaatgctcagcag

SEQ ID NO: 232399 - DNA, 25 bp, Mus musculus
cataggcttttggccactcttgggg

SEQ ID NO: 232400 - DNA, 25 bp, Mus musculus
catagggagaggagccgccgccatg

SEQ ID NO: 232401 - DNA, 25 bp, Mus musculus
catagggagaggagccgcctgtcca

SEQ ID NO: 232402 - DNA, 25 bp, Mus musculus
catagggcggtcagctcactaaggt

SEQ ID NO: 232403 - DNA, 25 bp, Mus musculus
cataggtcctacagctataggccgt

SEQ ID NO: 232404 - DNA, 25 bp, Mus musculus
catagtactagattcatcccagggg

SEQ ID NO: 232405 - DNA, 25 bp, Mus musculus
catagtactttccgttgtgtccaga

SEQ ID NO: 232406 - DNA, 25 bp, Mus musculus
catagtagttctcttcccatactgg

SEQ ID NO: 232407 - DNA, 25 bp, Mus musculus
catagtcacaggacgtccagcagga

SEQ ID NO: 232408 - DNA, 25 bp, Mus musculus
catagtcacccagacctggagcctg

SEQ ID NO: 232409 - DNA, 25 bp, Mus musculus
catagtcactaaggagatgttagat

SEQ ID NO: 232410 - DNA, 25 bp, Mus musculus
catagtctctaggatgctccagacc

SEQ ID NO: 232411 - DNA, 25 bp, Mus musculus
catagtgaacgagccacctcccaag

SEQ ID NO: 232412 - DNA, 25 bp, Mus musculus
catagtgaagggcgagcttcacaag

SEQ ID NO: 232413 - DNA, 25 bp, Mus musculus
catagtgaccatggtggtgatgacc

SEQ ID NO: 232414 - DNA, 25 bp, Mus musculus
catagtgataagcaccctgtgacct

SEQ ID NO: 232415 - DNA, 25 bp, Mus musculus
catagtgcagtaagtctggagccaa

SEQ ID NO: 232416 - DNA, 25 bp, Mus musculus
catagtgcatttctcatctacatta

SEQ ID NO: 232417 - DNA, 25 bp, Mus musculus
catagtggaaaagaaccaaagaatt

SEQ ID NO: 232418 - DNA, 25 bp, Mus musculus
catagtggagtcccagaggcaccag

SEQ ID NO: 232419 - DNA, 25 bp, Mus musculus
catagtggctgcagagaatgatgtc

SEQ ID NO: 232420 - DNA, 25 bp, Mus musculus
catagtggctgcggctgttaagaag

SEQ ID NO: 232421 - DNA, 25 bp, Mus musculus
catagtggctgcgggtattcccagg

SEQ ID NO: 232422 - DNA, 25 bp, Mus musculus
catagtgggacaatatcccagcccc

SEQ ID NO: 232423 - DNA, 25 bp, Mus musculus
catagttgctgcagacccgtggatt

SEQ ID NO: 232424 - DNA, 25 bp, Mus musculus
catagtttagggtgtctagcccaca

SEQ ID NO: 232425 - DNA, 25 bp, Mus musculus
catagtttaggtattgctttcaccg

SEQ ID NO: 232426 - DNA, 25 bp, Mus musculus
catagtttttctgatggtctgcaga

SEQ ID NO: 232427 - DNA, 25 bp, Mus musculus
catataaaatagaaatgtgaatcct

SEQ ID NO: 232428 - DNA, 25 bp, Mus musculus
catataaactcaagccaggaaccat

SEQ ID NO: 232429 - DNA, 25 bp, Mus musculus
catataaactcaagggctcgggcca

SEQ ID NO: 232430 - DNA, 25 bp, Mus musculus
catataaactggcgagatgtccctg

SEQ ID NO: 232431 - DNA, 25 bp, Mus musculus
catataaagtctctgaaactcaagt

SEQ ID NO: 232432 - DNA, 25 bp, Mus musculus
catataacaggaacggtcatcaaag

SEQ ID NO: 232433 - DNA, 25 bp, Mus musculus
catataacaggaatttctcttggaa

SEQ ID NO: 232434 - DNA, 25 bp, Mus musculus
catataaggagaagtgcccggctca

SEQ ID NO: 232435 - DNA, 25 bp, Mus musculus
catataaggagcttttcatccttag

SEQ ID NO: 232436 - DNA, 25 bp, Mus musculus
catataataagaacctatgggctaa

SEQ ID NO: 232437 - DNA, 25 bp, Mus musculus
catataattcatattacaggcctga

SEQ ID NO: 232438 - DNA, 25 bp, Mus musculus
catataattcattttgaccagcctc

SEQ ID NO: 232439 - DNA, 25 bp, Mus musculus
catatacatggtggtacaccatgag

SEQ ID NO: 232440 - DNA, 25 bp, Mus musculus
catatacatttcaaggcacagaaga

SEQ ID NO: 232441 - DNA, 25 bp, Mus musculus
catatacatttcaagtcttcaggaa

SEQ ID NO: 232442 - DNA, 25 bp, Mus musculus
catatactaggtcctgtgggaatgg

SEQ ID NO: 232443 - DNA, 25 bp, Mus musculus
catatacttagacaggtatccatta

SEQ ID NO: 232444 - DNA, 25 bp, Mus musculus
catatagagcagtaccaaatatgcc

SEQ ID NO: 232445 - DNA, 25 bp, Mus musculus
catatagcatttcaggatggaaccg

SEQ ID NO: 232446 - DNA, 25 bp, Mus musculus
catatagcttcactgataaaacacg

SEQ ID NO: 232447 - DNA, 25 bp, Mus musculus
catataggcatagactacttttaag

SEQ ID NO: 232448 - DNA, 25 bp, Mus musculus
catatatcagtgagatttcaccgag

SEQ ID NO: 232449 - DNA, 25 bp, Mus musculus
catatatcttcaatgaaattacact

SEQ ID NO: 232450 - DNA, 25 bp, Mus musculus
catatatcttcaatggtctgacagt

SEQ ID NO: 232451 - DNA, 25 bp, Mus musculus
catatatgcagagatgagccgccag

SEQ ID NO: 232452 - DNA, 25 bp, Mus musculus
catatatgtggggccgagcaatatg

SEQ ID NO: 232453 - DNA, 25 bp, Mus musculus
catatcaaaatcagagccagaaact

SEQ ID NO: 232454 - DNA, 25 bp, Mus musculus
catatcaaaatcaggagatggagtt

SEQ ID NO: 232455 - DNA, 25 bp, Mus musculus
catatcaagaagccctggctgtcct

SEQ ID NO: 232456 - DNA, 25 bp, Mus musculus
catatcaagaaggagtttgacaaga

SEQ ID NO: 232457 - DNA, 25 bp, Mus musculus
catatcactactggggaaacaggca

SEQ ID NO: 232458 - DNA, 25 bp, Mus musculus
catatcactactgtggtcgtgcaga

SEQ ID NO: 232459 - DNA, 25 bp, Mus musculus
catatcagcacggacgattccggag

SEQ ID NO: 232460 - DNA, 25 bp, Mus musculus
catatcagcacgggtcacccagaag

SEQ ID NO: 232461 - DNA, 25 bp, Mus musculus
catatcatccaggtgtgttatccac

SEQ ID NO: 232462 - DNA, 25 bp, Mus musculus
catatcatctcagatggaggctgca

SEQ ID NO: 232463 - DNA, 25 bp, Mus musculus
catatccaggagagagtctccgctg

SEQ ID NO: 232464 - DNA, 25 bp, Mus musculus
catatccaggaggtgacccacaacc

SEQ ID NO: 232465 - DNA, 25 bp, Mus musculus
catatccaggagttgatctttatag

SEQ ID NO: 232466 - DNA, 25 bp, Mus musculus
catatcccaagtgtctgataacaag

SEQ ID NO: 232467 - DNA, 25 bp, Mus musculus
catatcccagatctctctggctttt

SEQ ID NO: 232468 - DNA, 25 bp, Mus musculus
catatcccagatgctcatctttggg

SEQ ID NO: 232469 - DNA, 25 bp, Mus musculus
catatcctcagattcagaaaaacca

SEQ ID NO: 232470 - DNA, 25 bp, Mus musculus
catatcctcagcctctccagcttct

SEQ ID NO: 232471 - DNA, 25 bp, Mus musculus
catatccttcaggatggaacagact

SEQ ID NO: 232472 - DNA, 25 bp, Mus musculus
catatccttccagatgtatcgggat

SEQ ID NO: 232473 - DNA, 25 bp, Mus musculus
catatccttccagatgtatctggat

SEQ ID NO: 232474 - DNA, 25 bp, Mus musculus
catatccttccaggagtttatcatg

SEQ ID NO: 232475 - DNA, 25 bp, Mus musculus
catatctaccaggtaagattaaaag

SEQ ID NO: 232476 - DNA, 25 bp, Mus musculus
catatctaccgtcgacttaaaacac

SEQ ID NO: 232477 - DNA, 25 bp, Mus musculus
catatctgagattcagtttgctgac

SEQ ID NO: 232478 - DNA, 25 bp, Mus musculus
catatctgctaaggctttggagttt

SEQ ID NO: 232479 - DNA, 25 bp, Mus musculus
catatctggccagaaatggcctcca

SEQ ID NO: 232480 - DNA, 25 bp, Mus musculus
catatctgtaccagggtgtacattg

SEQ ID NO: 232481 - DNA, 25 bp, Mus musculus
catatctgtgtacagggttcggcag

SEQ ID NO: 232482 - DNA, 25 bp, Mus musculus
catatctgtgtatagagttcgaaat

SEQ ID NO: 232483 - DNA, 25 bp, Mus musculus
catatctgtgtatagatgatgagga

SEQ ID NO: 232484 - DNA, 25 bp, Mus musculus
catatctttcagaggagcctatcac

SEQ ID NO: 232485 - DNA, 25 bp, Mus musculus
catatctttcaggtggtatagctgt

SEQ ID NO: 232486 - DNA, 25 bp, Mus musculus
catatgaaaaagggggccacattat

SEQ ID NO: 232487 - DNA, 25 bp, Mus musculus
catatgaaagagtagtttcaagaac

SEQ ID NO: 232488 - DNA, 25 bp, Mus musculus
catatgaacttggcatggaacattg

SEQ ID NO: 232489 - DNA, 25 bp, Mus musculus
catatgaatatcaagatggatgctg

SEQ ID NO: 232490 - DNA, 25 bp, Mus musculus
catatgacatagcttgtgacgaatg

SEQ ID NO: 232491 - DNA, 25 bp, Mus musculus
catatgagaaaatttccaggacctt

SEQ ID NO: 232492 - DNA, 25 bp, Mus musculus
catatgagcagatgaaacggcttgt

SEQ ID NO: 232493 - DNA, 25 bp, Mus musculus
catatgaggctttggttttgttgag

SEQ ID NO: 232494 - DNA, 25 bp, Mus musculus
catatgatacaggtctaccgcagcc

SEQ ID NO: 232495 - DNA, 25 bp, Mus musculus
catatgcagaagagaagaaaaattc

SEQ ID NO: 232496 - DNA, 25 bp, Mus musculus
catatgcagaagagttagcaaaacg

SEQ ID NO: 232497 - DNA, 25 bp, Mus musculus
catatgcagcagatttttatcatta

SEQ ID NO: 232498 - DNA, 25 bp, Mus musculus
catatgcagcaggggggagcaccgt

SEQ ID NO: 232499 - DNA, 25 bp, Mus musculus
catatgccaatggctggaagctaaa

SEQ ID NO: 232500 - DNA, 25 bp, Mus musculus
catatgccaccatccgtgactgtcc

SEQ ID NO: 232501 - DNA, 25 bp, Mus musculus
catatgcgctggtggacgcagacga

SEQ ID NO: 232502 - DNA, 25 bp, Mus musculus
catatgcgctggttccagatgcctg

SEQ ID NO: 232503 - DNA, 25 bp, Mus musculus
catatgctgaaggagttattcctga

SEQ ID NO: 232504 - DNA, 25 bp, Mus musculus
catatgctgaagtatttcatggttc

SEQ ID NO: 232505 - DNA, 25 bp, Mus musculus
catatgcttccttggggactgatcc

SEQ ID NO: 232506 - DNA, 25 bp, Mus musculus
catatgcttcggagactcgggcggc

SEQ ID NO: 232507 - DNA, 25 bp, Mus musculus
catatggaaaaaggaaatatatgaa

SEQ ID NO: 232508 - DNA, 25 bp, Mus musculus
catatggaaaatgattcaaggcctc

SEQ ID NO: 232509 - DNA, 25 bp, Mus musculus
catatggaaaatggtgttgctgtca

SEQ ID NO: 232510 - DNA, 25 bp, Mus musculus
catatggaaaatgtttcaacctgga

SEQ ID NO: 232511 - DNA, 25 bp, Mus musculus
catatggaagactcggagatcaaag

SEQ ID NO: 232512 - DNA, 25 bp, Mus musculus
catatggaagtgctccttccgcttc

SEQ ID NO: 232513 - DNA, 25 bp, Mus musculus
catatggaataaatttcaagaattg

SEQ ID NO: 232514 - DNA, 25 bp, Mus musculus
catatggaatgcaaattgaagaatg

SEQ ID NO: 232515 - DNA, 25 bp, Mus musculus
catatggaccacagccacctgggcc

SEQ ID NO: 232516 - DNA, 25 bp, Mus musculus
catatggagagacgtgtcctgggct

SEQ ID NO: 232517 - DNA, 25 bp, Mus musculus
catatggagagtatgctattaagaa

SEQ ID NO: 232518 - DNA, 25 bp, Mus musculus
catatggagggagcctggaggatga

SEQ ID NO: 232519 - DNA, 25 bp, Mus musculus
catatggccagaatgaccatactca

SEQ ID NO: 232520 - DNA, 25 bp, Mus musculus
catatggctctggtcgtggacgcag

SEQ ID NO: 232521 - DNA, 25 bp, Mus musculus
catatggtactgagtactctctgag

SEQ ID NO: 232522 - DNA, 25 bp, Mus musculus
catatgtacaggcagaccgaaggct

SEQ ID NO: 232523 - DNA, 25 bp, Mus musculus
catatgtacagtcccagaagtatca

SEQ ID NO: 232524 - DNA, 25 bp, Mus musculus
catatgtagcagctgtggcagacct

SEQ ID NO: 232525 - DNA, 25 bp, Mus musculus
catatgtgaaggaagaagaaatcga

SEQ ID NO: 232526 - DNA, 25 bp, Mus musculus
catatgttcaatttgaggatgttcg

SEQ ID NO: 232527 - DNA, 25 bp, Mus musculus
catattaaatcctgaagtccacaat

SEQ ID NO: 232528 - DNA, 25 bp, Mus musculus
catattaccctagattggtgctgat

SEQ ID NO: 232529 - DNA, 25 bp, Mus musculus
catattactgaagatgagctaagaa

SEQ ID NO: 232530 - DNA, 25 bp, Mus musculus
catattactggtgatgaatctttct

SEQ ID NO: 232531 - DNA, 25 bp, Mus musculus
catattactgtatcatccagataaa

SEQ ID NO: 232532 - DNA, 25 bp, Mus musculus
catattattggcaggattgaaagct

SEQ ID NO: 232533 - DNA, 25 bp, Mus musculus
catattattggcagggcagaggaga

SEQ ID NO: 232534 - DNA, 25 bp, Mus musculus
catattcaaaaaggtatctggagga

SEQ ID NO: 232535 - DNA, 25 bp, Mus musculus
catattcaaaaagtatgtttcatta

SEQ ID NO: 232536 - DNA, 25 bp, Mus musculus
catattcaaatctggaatgttccgg

SEQ ID NO: 232537 - DNA, 25 bp, Mus musculus
catattcaagcaaccatttaagaag

SEQ ID NO: 232538 - DNA, 25 bp, Mus musculus
catattcagcaacagcatccgccac

SEQ ID NO: 232539 - DNA, 25 bp, Mus musculus
catattcagcagatttgtgaaaaca

SEQ ID NO: 232540 - DNA, 25 bp, Mus musculus
catattcagggtgacggcctctctc

SEQ ID NO: 232541 - DNA, 25 bp, Mus musculus
catattccagatgttctgatggcaa

SEQ ID NO: 232542 - DNA, 25 bp, Mus musculus
catattcccagcttctccagttggc

SEQ ID NO: 232543 - DNA, 25 bp, Mus musculus
catattcccgtggcatctttcttac

SEQ ID NO: 232544 - DNA, 25 bp, Mus musculus
catattcggtggatttctttattca

SEQ ID NO: 232545 - DNA, 25 bp, Mus musculus
catattcttcatcgtcatttacttc

SEQ ID NO: 232546 - DNA, 25 bp, Mus musculus
catattcttctaagggaatacagtg

SEQ ID NO: 232547 - DNA, 25 bp, Mus musculus
catattgaaaagagagccaagcctc

SEQ ID NO: 232548 - DNA, 25 bp, Mus musculus
catattgaaaaggcggcaaagtgcg

SEQ ID NO: 232549 - DNA, 25 bp, Mus musculus
catattgacacacatgcgggtggag

SEQ ID NO: 232550 - DNA, 25 bp, Mus musculus
catattgccaatggtgcagccggat

SEQ ID NO: 232551 - DNA, 25 bp, Mus musculus
catattgcccaaggacctgagccca

SEQ ID NO: 232552 - DNA, 25 bp, Mus musculus
catattgcccaagtcaaagtaaaca

SEQ ID NO: 232553 - DNA, 25 bp, Mus musculus
catattggacaagaagttgttcaag

SEQ ID NO: 232554 - DNA, 25 bp, Mus musculus
catattggacaagtagaggggacca

SEQ ID NO: 232555 - DNA, 25 bp, Mus musculus
catattggcgcaccactctcaagct

SEQ ID NO: 232556 - DNA, 25 bp, Mus musculus
catattgggaacgaccaaggactca

SEQ ID NO: 232557 - DNA, 25 bp, Mus musculus
catattgttcggatgctgaatccct

SEQ ID NO: 232558 - DNA, 25 bp, Mus musculus
catatttattgcatccgatatcaag

SEQ ID NO: 232559 - DNA, 25 bp, Mus musculus
catatttattggatgactaggaccc

SEQ ID NO: 232560 - DNA, 25 bp, Mus musculus
catatttattggtgaagccgagctt

SEQ ID NO: 232561 - DNA, 25 bp, Mus musculus
catatttccggctgctcctgatgct

SEQ ID NO: 232562 - DNA, 25 bp, Mus musculus
catatttcttccaaggcagaagagt

SEQ ID NO: 232563 - DNA, 25 bp, Mus musculus
catatttgagaagatagatgaagag

SEQ ID NO: 232564 - DNA, 25 bp, Mus musculus
catatttgagggattttatatatgt

SEQ ID NO: 232565 - DNA, 25 bp, Mus musculus
catatttgcagaagtcgagtccctg

SEQ ID NO: 232566 - DNA, 25 bp, Mus musculus
catatttgcaggtgtcctccaccag

SEQ ID NO: 232567 - DNA, 25 bp, Mus musculus
catatttggagccagcgacccatac

SEQ ID NO: 232568 - DNA, 25 bp, Mus musculus
catatttggccacagccttcgtgtc

SEQ ID NO: 232569 - DNA, 25 bp, Mus musculus
catatttgtccgtatgttatatctc

SEQ ID NO: 232570 - DNA, 25 bp, Mus musculus
catattttggaaaccagtaaagtgg

SEQ ID NO: 232571 - DNA, 25 bp, Mus musculus
catattttggttcttcatgctttgg

SEQ ID NO: 232572 - DNA, 25 bp, Mus musculus
catattttggtttttgggaataacg

SEQ ID NO: 232573 - DNA, 25 bp, Mus musculus
catattttgtgagttcaaaattggg

SEQ ID NO: 232574 - DNA, 25 bp, Mus musculus
catatttttaagtaggaaaatgaca

SEQ ID NO: 232575 - DNA, 25 bp, Mus musculus
catatttttaagtgtgatcccacca

SEQ ID NO: 232576 - DNA, 25 bp, Mus musculus
catcaaaaagcacagaacaagcctg

SEQ ID NO: 232577 - DNA, 25 bp, Mus musculus
catcaaaaaggcaaacataaatggc

SEQ ID NO: 232578 - DNA, 25 bp, Mus musculus
catcaaaactggaagtttggtgagc

SEQ ID NO: 232579 - DNA, 25 bp, Mus musculus
catcaaaaggagaagaaatgcttat

SEQ ID NO: 232580 - DNA, 25 bp, Mus musculus
catcaaaaggaggaagctggctaag

SEQ ID NO: 232581 - DNA, 25 bp, Mus musculus
catcaaaatcttggtggaagatgag

SEQ ID NO: 232582 - DNA, 25 bp, Mus musculus
catcaaaattcagattgccttctcc

SEQ ID NO: 232583 - DNA, 25 bp, Mus musculus
catcaaacaggtaagctatgaaaaa

SEQ ID NO: 232584 - DNA, 25 bp, Mus musculus
catcaaacaggttactatgaaaaaa

SEQ ID NO: 232585 - DNA, 25 bp, Mus musculus
catcaaacagtcaaaatatctgtgt

SEQ ID NO: 232586 - DNA, 25 bp, Mus musculus
catcaaacccctctgtggtttctca

SEQ ID NO: 232587 - DNA, 25 bp, Mus musculus
catcaaactatcaggtactctatct

SEQ ID NO: 232588 - DNA, 25 bp, Mus musculus
catcaaagaaacccatcttcatgcg

SEQ ID NO: 232589 - DNA, 25 bp, Mus musculus
catcaaagggatggttcaggctgtg

SEQ ID NO: 232590 - DNA, 25 bp, Mus musculus
catcaaaggtttggcttctccagtt

SEQ ID NO: 232591 - DNA, 25 bp, Mus musculus
catcaacaacagaaatgtgaaaaac

SEQ ID NO: 232592 - DNA, 25 bp, Mus musculus
catcaacaacgcagccactcttggg

SEQ ID NO: 232593 - DNA, 25 bp, Mus musculus
catcaacaacgcagccctacaaagg

SEQ ID NO: 232594 - DNA, 25 bp, Mus musculus
catcaacaaggtgtttgagtttggc

SEQ ID NO: 232595 - DNA, 25 bp, Mus musculus
catcaacacaccctttggggcgatg

SEQ ID NO: 232596 - DNA, 25 bp, Mus musculus
catcaacacagactttcctgccccc

SEQ ID NO: 232597 - DNA, 25 bp, Mus musculus
catcaacagagaggtgataggtgct

SEQ ID NO: 232598 - DNA, 25 bp, Mus musculus
catcaacagagaggtttatttcctg

SEQ ID NO: 232599 - DNA, 25 bp, Mus musculus
catcaacagggctgatatccctgtg

SEQ ID NO: 232600 - DNA, 25 bp, Mus musculus
catcaaccaaaagctggcatctgac

SEQ ID NO: 232601 - DNA, 25 bp, Mus musculus
catcaaccagcatggcgaggagacc

SEQ ID NO: 232602 - DNA, 25 bp, Mus musculus
catcaaccagctccaaccctttgcg

SEQ ID NO: 232603 - DNA, 25 bp, Mus musculus
catcaaccaggaaagccgggtgagt

SEQ ID NO: 232604 - DNA, 25 bp, Mus musculus
catcaaccaggatggcgaggagacc

SEQ ID NO: 232605 - DNA, 25 bp, Mus musculus
catcaaccatagggttctacagtga

SEQ ID NO: 232606 - DNA, 25 bp, Mus musculus
catcaacccactgggtggctttgtg

SEQ ID NO: 232607 - DNA, 25 bp, Mus musculus
catcaaccctctcagtgtgtgactt

SEQ ID NO: 232608 - DNA, 25 bp, Mus musculus
catcaaccctgagacagctcttctt

SEQ ID NO: 232609 - DNA, 25 bp, Mus musculus
catcaaccctgagtgccaggaccct

SEQ ID NO: 232610 - DNA, 25 bp, Mus musculus
catcaacgagaggacggcctgggtc

SEQ ID NO: 232611 - DNA, 25 bp, Mus musculus
catcaacgtgctggaacttggcaca

SEQ ID NO: 232612 - DNA, 25 bp, Mus musculus
catcaacgtgctggacctataagaa

SEQ ID NO: 232613 - DNA, 25 bp, Mus musculus
catcaactaaccaatactggagtaa

SEQ ID NO: 232614 - DNA, 25 bp, Mus musculus
catcaactacaagctgtatcttttc

SEQ ID NO: 232615 - DNA, 25 bp, Mus musculus
catcaactacaagggcccacccttc

SEQ ID NO: 232616 - DNA, 25 bp, Mus musculus
catcaactacgggtatttggctccc

SEQ ID NO: 232617 - DNA, 25 bp, Mus musculus
catcaactccagcagcatccacagg

SEQ ID NO: 232618 - DNA, 25 bp, Mus musculus
catcaactccagcaggtctcggaca

SEQ ID NO: 232619 - DNA, 25 bp, Mus musculus
catcaactctatattagctcaatca

SEQ ID NO: 232620 - DNA, 25 bp, Mus musculus
catcaactgcagccaggctatgctg

SEQ ID NO: 232621 - DNA, 25 bp, Mus musculus
catcaacttaggcgtgtataagtga

SEQ ID NO: 232622 - DNA, 25 bp, Mus musculus
catcaacttcaagccctccaaccac

SEQ ID NO: 232623 - DNA, 25 bp, Mus musculus
catcaacttcaagggccagctagag

SEQ ID NO: 232624 - DNA, 25 bp, Mus musculus
catcaactttgatgtcctagcaggg

SEQ ID NO: 232625 - DNA, 25 bp, Mus musculus
catcaagaaaggctccgtgctgcca

SEQ ID NO: 232626 - DNA, 25 bp, Mus musculus
catcaagaaagggtacacccagcag

SEQ ID NO: 232627 - DNA, 25 bp, Mus musculus
catcaagaagagcctccccaggtgt

SEQ ID NO: 232628 - DNA, 25 bp, Mus musculus
catcaagaaggcgtaccgaaagaag

SEQ ID NO: 232629 - DNA, 25 bp, Mus musculus
catcaagaagggagaagaaatgggt

SEQ ID NO: 232630 - DNA, 25 bp, Mus musculus
catcaagaaggtgcaggtggttcag

SEQ ID NO: 232631 - DNA, 25 bp, Mus musculus
catcaagaatgaagtgtatccccta

SEQ ID NO: 232632 - DNA, 25 bp, Mus musculus
catcaagactgccaaggttactttg

SEQ ID NO: 232633 - DNA, 25 bp, Mus musculus
catcaagcacggcacagtttgtctt

SEQ ID NO: 232634 - DNA, 25 bp, Mus musculus
catcaagcagggtttcaaagataac

SEQ ID NO: 232635 - DNA, 25 bp, Mus musculus
catcaagcagtgctatcaagatcac

SEQ ID NO: 232636 - DNA, 25 bp, Mus musculus
catcaagccagagagccctggcaca

SEQ ID NO: 232637 - DNA, 25 bp, Mus musculus
catcaagccagagagtgctcaacct

SEQ ID NO: 232638 - DNA, 25 bp, Mus musculus
catcaagcctcagcagggatcacat

SEQ ID NO: 232639 - DNA, 25 bp, Mus musculus
catcaagcctggtacttgctacagc

SEQ ID NO: 232640 - DNA, 25 bp, Mus musculus
catcaagcgcgccaacagcctcgct

SEQ ID NO: 232641 - DNA, 25 bp, Mus musculus
catcaagcggccagggacgatccgt

SEQ ID NO: 232642 - DNA, 25 bp, Mus musculus
catcaagcggccagggagagacgac

SEQ ID NO: 232643 - DNA, 25 bp, Mus musculus
catcaaggagcaggacatcaacaag

SEQ ID NO: 232644 - DNA, 25 bp, Mus musculus
catcaaggagctcccctcccaccca

SEQ ID NO: 232645 - DNA, 25 bp, Mus musculus
catcaaggcagagtgctcgatccga

SEQ ID NO: 232646 - DNA, 25 bp, Mus musculus
catcaaggccaaggccaacctggag

SEQ ID NO: 232647 - DNA, 25 bp, Mus musculus
catcaaggccgttcggaaggctgtg

SEQ ID NO: 232648 - DNA, 25 bp, Mus musculus
catcaaggcctcaggtggagccagt

SEQ ID NO: 232649 - DNA, 25 bp, Mus musculus
catcaaggtacttgtgtcagatgcc

SEQ ID NO: 232650 - DNA, 25 bp, Mus musculus
catcaaggtagaggcccctaacagc

SEQ ID NO: 232651 - DNA, 25 bp, Mus musculus
catcaaggtgctctcgtcagttcct

SEQ ID NO: 232652 - DNA, 25 bp, Mus musculus
catcaagtcaggctcagatgaggtg

SEQ ID NO: 232653 - DNA, 25 bp, Mus musculus
catcaagtgaggaatctgaggaagc

SEQ ID NO: 232654 - DNA, 25 bp, Mus musculus
catcaagtgggttcatgtactggac

SEQ ID NO: 232655 - DNA, 25 bp, Mus musculus
catcaagtttctcccctaccactga

SEQ ID NO: 232656 - DNA, 25 bp, Mus musculus
catcaagtttctgccctaccactga

SEQ ID NO: 232657 - DNA, 25 bp, Mus musculus
catcaataaggactgcatcgacgta

SEQ ID NO: 232658 - DNA, 25 bp, Mus musculus
catcaataatgacaccacctactgc

SEQ ID NO: 232659 - DNA, 25 bp, Mus musculus
catcaatagtcaaggtgaatatgaa

SEQ ID NO: 232660 - DNA, 25 bp, Mus musculus
catcaatatcacagaaaagtgtgta

SEQ ID NO: 232661 - DNA, 25 bp, Mus musculus
catcaatatcacgaggacaaagata

SEQ ID NO: 232662 - DNA, 25 bp, Mus musculus
catcaatcaggtgaatcccccggag

SEQ ID NO: 232663 - DNA, 25 bp, Mus musculus
catcaatcaggtgactgtgacgagt

SEQ ID NO: 232664 - DNA, 25 bp, Mus musculus
catcaatcatggaaaggatttggtt

SEQ ID NO: 232665 - DNA, 25 bp, Mus musculus
catcaatcccagggctccgggatct

SEQ ID NO: 232666 - DNA, 25 bp, Mus musculus
catcaatcccccaatgtgccttcag

SEQ ID NO: 232667 - DNA, 25 bp, Mus musculus
catcaatctagaaggtggtgacatt

SEQ ID NO: 232668 - DNA, 25 bp, Mus musculus
catcaatctgcagaagcggcctctg

SEQ ID NO: 232669 - DNA, 25 bp, Mus musculus
catcaatgcaggaaaggaaacagtt

SEQ ID NO: 232670 - DNA, 25 bp, Mus musculus
catcaatgccaaccgtcctgggctc

SEQ ID NO: 232671 - DNA, 25 bp, Mus musculus
catcaatgccagtcccatcccatcc

SEQ ID NO: 232672 - DNA, 25 bp, Mus musculus
catcaatgctgttttctactattca

SEQ ID NO: 232673 - DNA, 25 bp, Mus musculus
catcaatgctttgaatttaaaatct

SEQ ID NO: 232674 - DNA, 25 bp, Mus musculus
catcaatgctttgttcacagaggcg

SEQ ID NO: 232675 - DNA, 25 bp, Mus musculus
catcaatgggtcccttttgcagtct

SEQ ID NO: 232676 - DNA, 25 bp, Mus musculus
catcaatgtgccaatattcaaggac

SEQ ID NO: 232677 - DNA, 25 bp, Mus musculus
catcaatgtgttccttgcccagtct

SEQ ID NO: 232678 - DNA, 25 bp, Mus musculus
catcaatgttggccccacgggtacc

SEQ ID NO: 232679 - DNA, 25 bp, Mus musculus
catcaatgttggtgggcttccacca

SEQ ID NO: 232680 - DNA, 25 bp, Mus musculus
catcaatgttggtggtggcttccac

SEQ ID NO: 232681 - DNA, 25 bp, Mus musculus
catcaattgccagtctgcaagccag

SEQ ID NO: 232682 - DNA, 25 bp, Mus musculus
catcacaaacacagacattcccagc

SEQ ID NO: 232683 - DNA, 25 bp, Mus musculus
catcacaaacacagaggagcttaat

SEQ ID NO: 232684 - DNA, 25 bp, Mus musculus
catcacaaggtctgatactcttggt

SEQ ID NO: 232685 - DNA, 25 bp, Mus musculus
catcacaatagggcgctctgcctca

SEQ ID NO: 232686 - DNA, 25 bp, Mus musculus
catcacaatagggcggctatcctac

SEQ ID NO: 232687 - DNA, 25 bp, Mus musculus
catcacaatagggcggttatgggtg

SEQ ID NO: 232688 - DNA, 25 bp, Mus musculus
catcacaatagggcggtttatctga

SEQ ID NO: 232689 - DNA, 25 bp, Mus musculus
catcacacaacccaggtggatccca

SEQ ID NO: 232690 - DNA, 25 bp, Mus musculus
catcacacacacttccttcccatcc

SEQ ID NO: 232691 - DNA, 25 bp, Mus musculus
catcacacacagatctcagtaagag

SEQ ID NO: 232692 - DNA, 25 bp, Mus musculus
catcacacagcctcggcccacactg

SEQ ID NO: 232693 - DNA, 25 bp, Mus musculus
catcacaccaccagtcccgctcggc

SEQ ID NO: 232694 - DNA, 25 bp, Mus musculus
catcacaccagatgctgccagccct

SEQ ID NO: 232695 - DNA, 25 bp, Mus musculus
catcacaccagggagcaggatcacc

SEQ ID NO: 232696 - DNA, 25 bp, Mus musculus
catcacaccggtgttttggccaggt

SEQ ID NO: 232697 - DNA, 25 bp, Mus musculus
catcacactcaatgacgaggctgca

SEQ ID NO: 232698 - DNA, 25 bp, Mus musculus
catcacactgttgaagagaaggagg

SEQ ID NO: 232699 - DNA, 25 bp, Mus musculus
catcacagatgccgcaatgatggct

SEQ ID NO: 232700 - DNA, 25 bp, Mus musculus
catcacagatggcctgcaatgcctc

SEQ ID NO: 232701 - DNA, 25 bp, Mus musculus
catcacagcaatccgccacttgagg

SEQ ID NO: 232702 - DNA, 25 bp, Mus musculus
catcacagcacaggaggaagcaagg

SEQ ID NO: 232703 - DNA, 25 bp, Mus musculus
catcacagccaggaagtcacctggg

SEQ ID NO: 232704 - DNA, 25 bp, Mus musculus
catcacagcctggcaccctcctgcc

SEQ ID NO: 232705 - DNA, 25 bp, Mus musculus
catcacagcctgtaaaaagaacccg

SEQ ID NO: 232706 - DNA, 25 bp, Mus musculus
catcacaggagcatctcaatgggag

SEQ ID NO: 232707 - DNA, 25 bp, Mus musculus
catcacaggcaagaaggagaggaat

SEQ ID NO: 232708 - DNA, 25 bp, Mus musculus
catcacagggcacccatgcatcagc

SEQ ID NO: 232709 - DNA, 25 bp, Mus musculus
catcacagtgacagggcccaatgta

SEQ ID NO: 232710 - DNA, 25 bp, Mus musculus
catcacagtttaggaactggtatgt

SEQ ID NO: 232711 - DNA, 25 bp, Mus musculus
catcacagtttagtggctgacctac

SEQ ID NO: 232712 - DNA, 25 bp, Mus musculus
catcacatacacgatattgatgagt

SEQ ID NO: 232713 - DNA, 25 bp, Mus musculus
catcacatacacgcaatgcaccgat

SEQ ID NO: 232714 - DNA, 25 bp, Mus musculus
catcacattaaagtttcactagaag

SEQ ID NO: 232715 - DNA, 25 bp, Mus musculus
catcacattggcgtcttctgggacc

SEQ ID NO: 232716 - DNA, 25 bp, Mus musculus
catcaccaaagccccccatcaacac

SEQ ID NO: 232717 - DNA, 25 bp, Mus musculus
catcaccaactttccaagattacct

SEQ ID NO: 232718 - DNA, 25 bp, Mus musculus
catcaccaagaacaagaaaacagtg

SEQ ID NO: 232719 - DNA, 25 bp, Mus musculus
catcaccaagatgacacttgggagg

SEQ ID NO: 232720 - DNA, 25 bp, Mus musculus
catcaccaagcccccgaggcatggc

SEQ ID NO: 232721 - DNA, 25 bp, Mus musculus
catcaccaagctcctccagacaacc

SEQ ID NO: 232722 - DNA, 25 bp, Mus musculus
catcaccaaggaagatttggaaaat

SEQ ID NO: 232723 - DNA, 25 bp, Mus musculus
catcaccaaggaggatataaatgct

SEQ ID NO: 232724 - DNA, 25 bp, Mus musculus
catcaccaaggatcagttcatgtgt

SEQ ID NO: 232725 - DNA, 25 bp, Mus musculus
catcaccaagtcagaaggtcagttt

SEQ ID NO: 232726 - DNA, 25 bp, Mus musculus
catcaccaccatcggctatggtcat

SEQ ID NO: 232727 - DNA, 25 bp, Mus musculus
catcaccacgaaaatctccttcggg

SEQ ID NO: 232728 - DNA, 25 bp, Mus musculus
catcaccacgatcagagtgatgtgc

SEQ ID NO: 232729 - DNA, 25 bp, Mus musculus
catcaccagaagacaagactggcag

SEQ ID NO: 232730 - DNA, 25 bp, Mus musculus
catcaccagcagtgcccggggtctg

SEQ ID NO: 232731 - DNA, 25 bp, Mus musculus
catcaccagccaccatcgagacaca

SEQ ID NO: 232732 - DNA, 25 bp, Mus musculus
catcaccagccagtgtggggcaggc

SEQ ID NO: 232733 - DNA, 25 bp, Mus musculus
catcaccaggagctcggacggcgcc

SEQ ID NO: 232734 - DNA, 25 bp, Mus musculus
catcaccaggagctctcctcccaag

SEQ ID NO: 232735 - DNA, 25 bp, Mus musculus
catcaccaggagtatgcttgagagt

SEQ ID NO: 232736 - DNA, 25 bp, Mus musculus
catcaccatgatctgtgccattgcc

SEQ ID NO: 232737 - DNA, 25 bp, Mus musculus
catcacccaagatcatcatgcacga

SEQ ID NO: 232738 - DNA, 25 bp, Mus musculus
catcacccaggctgccggaaccagc

SEQ ID NO: 232739 - DNA, 25 bp, Mus musculus
catcacccagggcaccccactcaag

SEQ ID NO: 232740 - DNA, 25 bp, Mus musculus
catcaccccagaggtgtggccaaac

SEQ ID NO: 232741 - DNA, 25 bp, Mus musculus
catcacccccgccactggcttggca

SEQ ID NO: 232742 - DNA, 25 bp, Mus musculus
catcacccccggtggtgaagggcag

SEQ ID NO: 232743 - DNA, 25 bp, Mus musculus
catcacccccgtgctccccctgcag

SEQ ID NO: 232744 - DNA, 25 bp, Mus musculus
catcaccctgacaaaggagacaaca

SEQ ID NO: 232745 - DNA, 25 bp, Mus musculus
catcaccctgacctgcaactcctca

SEQ ID NO: 232746 - DNA, 25 bp, Mus musculus
catcacccttccctgagacaatgtc

SEQ ID NO: 232747 - DNA, 25 bp, Mus musculus
catcacccttccctggaaaatctgg

SEQ ID NO: 232748 - DNA, 25 bp, Mus musculus
catcacccttgcagcatacgaagga

SEQ ID NO: 232749 - DNA, 25 bp, Mus musculus
catcaccgcggtgggtgatgtcttc

SEQ ID NO: 232750 - DNA, 25 bp, Mus musculus
catcaccggggcttgcgacaaggac

SEQ ID NO: 232751 - DNA, 25 bp, Mus musculus
catcaccggggttccattttggggg

SEQ ID NO: 232752 - DNA, 25 bp, Mus musculus
catcaccgtcacagagccccctgtg

SEQ ID NO: 232753 - DNA, 25 bp, Mus musculus
catcaccgtcacagagtcataccaa

SEQ ID NO: 232754 - DNA, 25 bp, Mus musculus
catcaccgtgagcaagtgtgggacc

SEQ ID NO: 232755 - DNA, 25 bp, Mus musculus
catcacctacatccgcaggctgctg

SEQ ID NO: 232756 - DNA, 25 bp, Mus musculus
catcacctacatcctcctgagcgga

SEQ ID NO: 232757 - DNA, 25 bp, Mus musculus
catcacctatgacgagtccatgctg

SEQ ID NO: 232758 - DNA, 25 bp, Mus musculus
catcacctatgagacactaaagtac

SEQ ID NO: 232759 - DNA, 25 bp, Mus musculus
catcacctatgagagcggagaagct

SEQ ID NO: 232760 - DNA, 25 bp, Mus musculus
catcacctatgagatggtagaagag

SEQ ID NO: 232761 - DNA, 25 bp, Mus musculus
catcacctcatgcagaaggtgatta

SEQ ID NO: 232762 - DNA, 25 bp, Mus musculus
catcacctcatgcaggagtatgcaa

SEQ ID NO: 232763 - DNA, 25 bp, Mus musculus
catcacctctggaacttagcccagc

SEQ ID NO: 232764 - DNA, 25 bp, Mus musculus
catcacctgagggccaacgaggtga

SEQ ID NO: 232765 - DNA, 25 bp, Mus musculus
catcacctggacaagcctccattaa

SEQ ID NO: 232766 - DNA, 25 bp, Mus musculus
catcacctggacaagctgatgcctt

SEQ ID NO: 232767 - DNA, 25 bp, Mus musculus
catcaccttggatggcaaggtcagc

SEQ ID NO: 232768 - DNA, 25 bp, Mus musculus
catcaccttggcatttagtaagaag

SEQ ID NO: 232769 - DNA, 25 bp, Mus musculus
catcacgaactacaggaagagagag

SEQ ID NO: 232770 - DNA, 25 bp, Mus musculus
catcacgaagaaacttgtggaaaca

SEQ ID NO: 232771 - DNA, 25 bp, Mus musculus
catcacgaaggctttacaatgtggg

SEQ ID NO: 232772 - DNA, 25 bp, Mus musculus
catcacgaatccagttcactctgaa

SEQ ID NO: 232773 - DNA, 25 bp, Mus musculus
catcacgagtttcaggctccatttg

SEQ ID NO: 232774 - DNA, 25 bp, Mus musculus
catcacgcaaggcatcccgaggtcc

SEQ ID NO: 232775 - DNA, 25 bp, Mus musculus
catcacgcagtgtggcttgacctca

SEQ ID NO: 232776 - DNA, 25 bp, Mus musculus
catcacggaactcgctaagccgggc

SEQ ID NO: 232777 - DNA, 25 bp, Mus musculus
catcacggaactcgtgaatgatacc

SEQ ID NO: 232778 - DNA, 25 bp, Mus musculus
catcacggcagatggcagtgaaatt

SEQ ID NO: 232779 - DNA, 25 bp, Mus musculus
catcactaaaagaagtgctcagagt

SEQ ID NO: 232780 - DNA, 25 bp, Mus musculus
catcactaccatcggctatggcaat

SEQ ID NO: 232781 - DNA, 25 bp, Mus musculus
catcactaggaagggtgagtggggc

SEQ ID NO: 232782 - DNA, 25 bp, Mus musculus
catcactataaagggagttggaaag

SEQ ID NO: 232783 - DNA, 25 bp, Mus musculus
catcactataaaggggtgctggtgt

SEQ ID NO: 232784 - DNA, 25 bp, Mus musculus
catcactcaaggagaagctgtgtga

SEQ ID NO: 232785 - DNA, 25 bp, Mus musculus
catcactcacgagctctttgacatc

SEQ ID NO: 232786 - DNA, 25 bp, Mus musculus
catcactcagctggagcaattcaac

SEQ ID NO: 232787 - DNA, 25 bp, Mus musculus
catcactcagctttccactgccaag

SEQ ID NO: 232788 - DNA, 25 bp, Mus musculus
catcactcagggaaaccttagccct

SEQ ID NO: 232789 - DNA, 25 bp, Mus musculus
catcactcagggcgttcccttggat

SEQ ID NO: 232790 - DNA, 25 bp, Mus musculus
catcactcaggtcgctgttattcct

SEQ ID NO: 232791 - DNA, 25 bp, Mus musculus
catcactcagtgcatgaggaagcag

SEQ ID NO: 232792 - DNA, 25 bp, Mus musculus
catcactcctaagcaccaaggaacc

SEQ ID NO: 232793 - DNA, 25 bp, Mus musculus
catcactcctaagcggttaatttct

SEQ ID NO: 232794 - DNA, 25 bp, Mus musculus
catcactcgagcttctagggaccta

SEQ ID NO: 232795 - DNA, 25 bp, Mus musculus
catcactctcaacctgctgtcgcta

SEQ ID NO: 232796 - DNA, 25 bp, Mus musculus
catcactctccggatgttgggaagt

SEQ ID NO: 232797 - DNA, 25 bp, Mus musculus
catcactggagcaggccttatgacc

SEQ ID NO: 232798 - DNA, 25 bp, Mus musculus
catcactgtcatccaggacatggaa

SEQ ID NO: 232799 - DNA, 25 bp, Mus musculus
catcactgtccaagacccagcaact

SEQ ID NO: 232800 - DNA, 25 bp, Mus musculus
catcactgtccaagtggacacgggc

SEQ ID NO: 232801 - DNA, 25 bp, Mus musculus
catcactgtggataaaaatatgccc

SEQ ID NO: 232802 - DNA, 25 bp, Mus musculus
catcactgttgctcacctttcaaca

SEQ ID NO: 232803 - DNA, 25 bp, Mus musculus
catcactttgaaaaggctgtcaccc

SEQ ID NO: 232804 - DNA, 25 bp, Mus musculus
catcagaaaaggtgactaataaaca

SEQ ID NO: 232805 - DNA, 25 bp, Mus musculus
catcagaaaattagaccgattcaaa

SEQ ID NO: 232806 - DNA, 25 bp, Mus musculus
catcagaaaggcaacatgtcggcag

SEQ ID NO: 232807 - DNA, 25 bp, Mus musculus
catcagaaagggtctgccgtcatcc

SEQ ID NO: 232808 - DNA, 25 bp, Mus musculus
catcagaacagcgcaagaagagagc

SEQ ID NO: 232809 - DNA, 25 bp, Mus musculus
catcagaacaggagtaagcatggaa

SEQ ID NO: 232810 - DNA, 25 bp, Mus musculus
catcagaagatgaaaaagggttcaa

SEQ ID NO: 232811 - DNA, 25 bp, Mus musculus
catcagaagccggggagtcccatgg

SEQ ID NO: 232812 - DNA, 25 bp, Mus musculus
catcagacactggtgaggagcatgt

SEQ ID NO: 232813 - DNA, 25 bp, Mus musculus
catcagacagggcaacgtttcatac

SEQ ID NO: 232814 - DNA, 25 bp, Mus musculus
catcagacatggattgcagtgctcc

SEQ ID NO: 232815 - DNA, 25 bp, Mus musculus
catcagaccagaagctgaccacctt

SEQ ID NO: 232816 - DNA, 25 bp, Mus musculus
catcagaccaggccagctgttgcca

SEQ ID NO: 232817 - DNA, 25 bp, Mus musculus
catcagacgctcagatatgctgaag

SEQ ID NO: 232818 - DNA, 25 bp, Mus musculus
catcagacggctggaagaggcccag

SEQ ID NO: 232819 - DNA, 25 bp, Mus musculus
catcagactgtgtcagaagtttggg

SEQ ID NO: 232820 - DNA, 25 bp, Mus musculus
catcagacttctacctgtgtcttcc

SEQ ID NO: 232821 - DNA, 25 bp, Mus musculus
catcagagagacatcttctctgtca

SEQ ID NO: 232822 - DNA, 25 bp, Mus musculus
catcagagagccctctccaggccat

SEQ ID NO: 232823 - DNA, 25 bp, Mus musculus
catcagagaggatgtaacttatccg

SEQ ID NO: 232824 - DNA, 25 bp, Mus musculus
catcagagagggaagaaaatggaga

SEQ ID NO: 232825 - DNA, 25 bp, Mus musculus
catcagagagtgtccaggttatgga

SEQ ID NO: 232826 - DNA, 25 bp, Mus musculus
catcagagcgatgtctggtccttcg

SEQ ID NO: 232827 - DNA, 25 bp, Mus musculus
catcagaggagagcccagaggctca

SEQ ID NO: 232828 - DNA, 25 bp, Mus musculus
catcagaggagattgaagggcggat

SEQ ID NO: 232829 - DNA, 25 bp, Mus musculus
catcagagtaggtttgattggcagc

SEQ ID NO: 232830 - DNA, 25 bp, Mus musculus
catcagatgcccagcaccccttggg

SEQ ID NO: 232831 - DNA, 25 bp, Mus musculus
catcagcaaatgacatctggattat

SEQ ID NO: 232832 - DNA, 25 bp, Mus musculus
catcagcaagagcttatttcctcaa

SEQ ID NO: 232833 - DNA, 25 bp, Mus musculus
catcagcaagccaccaccacgaaaa

SEQ ID NO: 232834 - DNA, 25 bp, Mus musculus
catcagcaaggtactgccctttcca

SEQ ID NO: 232835 - DNA, 25 bp, Mus musculus
catcagcaatggaagggcagcagag

SEQ ID NO: 232836 - DNA, 25 bp, Mus musculus
catcagcacagaccggggagctctg

SEQ ID NO: 232837 - DNA, 25 bp, Mus musculus
catcagcaccagggacccagggtcc

SEQ ID NO: 232838 - DNA, 25 bp, Mus musculus
catcagcaccctccagcacggaagc

SEQ ID NO: 232839 - DNA, 25 bp, Mus musculus
catcagcaccggccccccacttcct

SEQ ID NO: 232840 - DNA, 25 bp, Mus musculus
catcagcacgaatggtgcagtcttt

SEQ ID NO: 232841 - DNA, 25 bp, Mus musculus
catcagcaggccaactctacaatgg

SEQ ID NO: 232842 - DNA, 25 bp, Mus musculus
catcagcagtacagacgaaatgcct

SEQ ID NO: 232843 - DNA, 25 bp, Mus musculus
catcagcagtacaggccggccacga

SEQ ID NO: 232844 - DNA, 25 bp, Mus musculus
catcagcatccagtcctggcttaac

SEQ ID NO: 232845 - DNA, 25 bp, Mus musculus
catcagcatcgtgtttactccagac

SEQ ID NO: 232846 - DNA, 25 bp, Mus musculus
catcagccagaccacagatgacatc

SEQ ID NO: 232847 - DNA, 25 bp, Mus musculus
catcagccaggagccagtcctgttt

SEQ ID NO: 232848 - DNA, 25 bp, Mus musculus
catcagccaggtaagaatctaccca

SEQ ID NO: 232849 - DNA, 25 bp, Mus musculus
catcagccaggtcaggaatctaccc

SEQ ID NO: 232850 - DNA, 25 bp, Mus musculus
catcagcccaggatgctatctccca

SEQ ID NO: 232851 - DNA, 25 bp, Mus musculus
catcagcccaggcgattaaatcccc

SEQ ID NO: 232852 - DNA, 25 bp, Mus musculus
catcagccctcccaaaacatgactt

SEQ ID NO: 232853 - DNA, 25 bp, Mus musculus
catcagccctggttcaggcagctgc

SEQ ID NO: 232854 - DNA, 25 bp, Mus musculus
catcagccgagatgaacctctagtc

SEQ ID NO: 232855 - DNA, 25 bp, Mus musculus
catcagccgtggatgaacaggccga

SEQ ID NO: 232856 - DNA, 25 bp, Mus musculus
catcagcctctgcagatgcctgagc

SEQ ID NO: 232857 - DNA, 25 bp, Mus musculus
catcagcctctgcagcactgccaga

SEQ ID NO: 232858 - DNA, 25 bp, Mus musculus
catcagcgacacgcgggcgtccgaa

SEQ ID NO: 232859 - DNA, 25 bp, Mus musculus
catcagcgatgagatggtacagaac

SEQ ID NO: 232860 - DNA, 25 bp, Mus musculus
catcagcgatgaggtagttttgagc

SEQ ID NO: 232861 - DNA, 25 bp, Mus musculus
catcagctctgagtggtgggacgac

SEQ ID NO: 232862 - DNA, 25 bp, Mus musculus
catcagctctgggcgtcagtgttca

SEQ ID NO: 232863 - DNA, 25 bp, Mus musculus
catcagctgactacccaggcggctt

SEQ ID NO: 232864 - DNA, 25 bp, Mus musculus
catcagctgagtgactgtggagacc

SEQ ID NO: 232865 - DNA, 25 bp, Mus musculus
catcagctggagaaggtggacggta

SEQ ID NO: 232866 - DNA, 25 bp, Mus musculus
catcagctgtcagtgcactgatgtc

SEQ ID NO: 232867 - DNA, 25 bp, Mus musculus
catcagctgtcagttctttgccaga

SEQ ID NO: 232868 - DNA, 25 bp, Mus musculus
catcagcttcattgatgaagcccgc

SEQ ID NO: 232869 - DNA, 25 bp, Mus musculus
catcagcttcattggggttccttgg

SEQ ID NO: 232870 - DNA, 25 bp, Mus musculus
catcagcttccacagaaactcaagt

SEQ ID NO: 232871 - DNA, 25 bp, Mus musculus
catcagcttccacagaccatgcctt

SEQ ID NO: 232872 - DNA, 25 bp, Mus musculus
catcagcttccacaggtttcctttg

SEQ ID NO: 232873 - DNA, 25 bp, Mus musculus
catcagcttctcagtgaatttgaca

SEQ ID NO: 232874 - DNA, 25 bp, Mus musculus
catcaggaagggatgcggtaaaaac

SEQ ID NO: 232875 - DNA, 25 bp, Mus musculus
catcaggaccaagcccttcccctgg

SEQ ID NO: 232876 - DNA, 25 bp, Mus musculus
catcaggactctcaggtaaatgcat

SEQ ID NO: 232877 - DNA, 25 bp, Mus musculus
catcaggagtagcaactggtctctg

SEQ ID NO: 232878 - DNA, 25 bp, Mus musculus
catcaggctccacagattgcagccc

SEQ ID NO: 232879 - DNA, 25 bp, Mus musculus
catcagggaagatacattgtgtgtg

SEQ ID NO: 232880 - DNA, 25 bp, Mus musculus
catcagggaagcttccctgttgaaa

SEQ ID NO: 232881 - DNA, 25 bp, Mus musculus
catcagggtcacagaaaccggcgat

SEQ ID NO: 232882 - DNA, 25 bp, Mus musculus
catcagggtcacaggctctgtgggt

SEQ ID NO: 232883 - DNA, 25 bp, Mus musculus
catcagggtgtaccagcctccagct

SEQ ID NO: 232884 - DNA, 25 bp, Mus musculus
catcagggttccagggacttcctgg

SEQ ID NO: 232885 - DNA, 25 bp, Mus musculus
catcaggtccaagagtctgaaggaa

SEQ ID NO: 232886 - DNA, 25 bp, Mus musculus
catcaggtccaagtccgtaattgag

SEQ ID NO: 232887 - DNA, 25 bp, Mus musculus
catcaggtcccccggtatagaacgt

SEQ ID NO: 232888 - DNA, 25 bp, Mus musculus
catcaggtcctggatgaacgagacc

SEQ ID NO: 232889 - DNA, 25 bp, Mus musculus
catcaggtctccttcccttgaacaa

SEQ ID NO: 232890 - DNA, 25 bp, Mus musculus
catcagtacagggagcagatcaagc

SEQ ID NO: 232891 - DNA, 25 bp, Mus musculus
catcagtacagtcatgcctgcagcc

SEQ ID NO: 232892 - DNA, 25 bp, Mus musculus
catcagtatacatgggagactctgg

SEQ ID NO: 232893 - DNA, 25 bp, Mus musculus
catcagtcaaagaatgtcccctata

SEQ ID NO: 232894 - DNA, 25 bp, Mus musculus
catcagtcaaagagaaacaaagcaa

SEQ ID NO: 232895 - DNA, 25 bp, Mus musculus
catcagtcctcagatgcggtgagca

SEQ ID NO: 232896 - DNA, 25 bp, Mus musculus
catcagtcctctacgaatgtccacc

SEQ ID NO: 232897 - DNA, 25 bp, Mus musculus
catcagtcgcattcgaagagccacc

SEQ ID NO: 232898 - DNA, 25 bp, Mus musculus
catcagtcgcattcgatgaaatcgt

SEQ ID NO: 232899 - DNA, 25 bp, Mus musculus
catcagtgactgtagtctgacatct

SEQ ID NO: 232900 - DNA, 25 bp, Mus musculus
catcagtgagaaagtggacaccatg

SEQ ID NO: 232901 - DNA, 25 bp, Mus musculus
catcagtgatgatttcctattatga

SEQ ID NO: 232902 - DNA, 25 bp, Mus musculus
catcagtgatgctctccttacagac

SEQ ID NO: 232903 - DNA, 25 bp, Mus musculus
catcagtggatcgatatcaacaaca

SEQ ID NO: 232904 - DNA, 25 bp, Mus musculus
catcagttctgtgctcaaagatcca

SEQ ID NO: 232905 - DNA, 25 bp, Mus musculus
catcagtttagtgctgacagtagag

SEQ ID NO: 232906 - DNA, 25 bp, Mus musculus
catcataaagaggctcacaactcag

SEQ ID NO: 232907 - DNA, 25 bp, Mus musculus
catcataaagccaggcagtgaagca

SEQ ID NO: 232908 - DNA, 25 bp, Mus musculus
catcataaatgttaaaattctgtgt

SEQ ID NO: 232909 - DNA, 25 bp, Mus musculus
catcatacaagtttgtgtggccatc

SEQ ID NO: 232910 - DNA, 25 bp, Mus musculus
catcatacagaccagagggattata

SEQ ID NO: 232911 - DNA, 25 bp, Mus musculus
catcatacttgcacaccgctggttt

SEQ ID NO: 232912 - DNA, 25 bp, Mus musculus
catcatagatatcacaaccaccttc

SEQ ID NO: 232913 - DNA, 25 bp, Mus musculus
catcatagatgacttccatagtttg

SEQ ID NO: 232914 - DNA, 25 bp, Mus musculus
catcatagccaaggaaggtggggtt

SEQ ID NO: 232915 - DNA, 25 bp, Mus musculus
catcatagccaaggtggacggtatc

SEQ ID NO: 232916 - DNA, 25 bp, Mus musculus
catcatagccaagttcctgtacggg

SEQ ID NO: 232917 - DNA, 25 bp, Mus musculus
catcatatctttcagaggagcctat

SEQ ID NO: 232918 - DNA, 25 bp, Mus musculus
catcatatggagagacgtgtcctgg

SEQ ID NO: 232919 - DNA, 25 bp, Mus musculus
catcatatggagagtatgctattaa

SEQ ID NO: 232920 - DNA, 25 bp, Mus musculus
catcatattgaacgagaaaaagacc

SEQ ID NO: 232921 - DNA, 25 bp, Mus musculus
catcatcaactctatattagctcaa

SEQ ID NO: 232922 - DNA, 25 bp, Mus musculus
catcatcaagaagagcctccccagg

SEQ ID NO: 232923 - DNA, 25 bp, Mus musculus
catcatcaagaaggtgcaggtggtt

SEQ ID NO: 232924 - DNA, 25 bp, Mus musculus
catcatcaaggtctttcgcttcctc

SEQ ID NO: 232925 - DNA, 25 bp, Mus musculus
catcatcaatccaaacatctgtggc

SEQ ID NO: 232926 - DNA, 25 bp, Mus musculus
catcatcaatggcattgtggaggat

SEQ ID NO: 232927 - DNA, 25 bp, Mus musculus
catcatcacagacaccacggcgacg

SEQ ID NO: 232928 - DNA, 25 bp, Mus musculus
catcatcacagatcttcggaaccag

SEQ ID NO: 232929 - DNA, 25 bp, Mus musculus
catcatcacagattctcgagcaggt

SEQ ID NO: 232930 - DNA, 25 bp, Mus musculus
catcatcacagcaatccgccacttg

SEQ ID NO: 232931 - DNA, 25 bp, Mus musculus
catcatcacagcctggcaccctcct

SEQ ID NO: 232932 - DNA, 25 bp, Mus musculus
catcatcacagcctgtaaaaagaac

SEQ ID NO: 232933 - DNA, 25 bp, Mus musculus
catcatcacaggagcgaggcacgga

SEQ ID NO: 232934 - DNA, 25 bp, Mus musculus
catcatcacaggtattccagcatct

SEQ ID NO: 232935 - DNA, 25 bp, Mus musculus
catcatcacagtgctgaagacagtg

SEQ ID NO: 232936 - DNA, 25 bp, Mus musculus
catcatcacccaagatcatcatgca

SEQ ID NO: 232937 - DNA, 25 bp, Mus musculus
catcatcacgaaactgaggctcctt

SEQ ID NO: 232938 - DNA, 25 bp, Mus musculus
catcatcacggcagatggcagtgaa

SEQ ID NO: 232939 - DNA, 25 bp, Mus musculus
catcatcacggtcttctggccacct

SEQ ID NO: 232940 - DNA, 25 bp, Mus musculus
catcatcataaatgttaaaattctg

SEQ ID NO: 232941 - DNA, 25 bp, Mus musculus
catcatcatggaaggcgtcacctcg

SEQ ID NO: 232942 - DNA, 25 bp, Mus musculus
catcatccacaagactgcgggaagg

SEQ ID NO: 232943 - DNA, 25 bp, Mus musculus
catcatccacgcagtgattgacgag

SEQ ID NO: 232944 - DNA, 25 bp, Mus musculus
catcatccagctggatagcagtgtg

SEQ ID NO: 232945 - DNA, 25 bp, Mus musculus
catcatccaggcagatgaagaggtc

SEQ ID NO: 232946 - DNA, 25 bp, Mus musculus
catcatccaggcaggtataaaagag

SEQ ID NO: 232947 - DNA, 25 bp, Mus musculus
catcatcccaggagtgttactagat

SEQ ID NO: 232948 - DNA, 25 bp, Mus musculus
catcatcccagtcttcatcagctgc

SEQ ID NO: 232949 - DNA, 25 bp, Mus musculus
catcatccccaggcgctttgccctg

SEQ ID NO: 232950 - DNA, 25 bp, Mus musculus
catcatccggcagaagcgcctgtct

SEQ ID NO: 232951 - DNA, 25 bp, Mus musculus
catcatccgggccatccgaaccatt

SEQ ID NO: 232952 - DNA, 25 bp, Mus musculus
catcatcctgacaggtgctgagttc

SEQ ID NO: 232953 - DNA, 25 bp, Mus musculus
catcatcctggtgttcctgctggca

SEQ ID NO: 232954 - DNA, 25 bp, Mus musculus
catcatccttagcagggagaagaaa

SEQ ID NO: 232955 - DNA, 25 bp, Mus musculus
catcatcgaacagactcaccacctc

SEQ ID NO: 232956 - DNA, 25 bp, Mus musculus
catcatcgaacagttcatgcaacag

SEQ ID NO: 232957 - DNA, 25 bp, Mus musculus
catcatcgaagctcccatctccagg

SEQ ID NO: 232958 - DNA, 25 bp, Mus musculus
catcatcgaagtggaaaacatggcg

SEQ ID NO: 232959 - DNA, 25 bp, Mus musculus
catcatcgagaccctgaggaagaag

SEQ ID NO: 232960 - DNA, 25 bp, Mus musculus
catcatcgaggcgctgcacaagaag

SEQ ID NO: 232961 - DNA, 25 bp, Mus musculus
catcatcgctgtgttttctcgtgac

SEQ ID NO: 232962 - DNA, 25 bp, Mus musculus
catcatcgggaagttctgattcaaa

SEQ ID NO: 232963 - DNA, 25 bp, Mus musculus
catcatctaccctgaggagaatgaa

SEQ ID NO: 232964 - DNA, 25 bp, Mus musculus
catcatctctcattactcgggtttc

SEQ ID NO: 232965 - DNA, 25 bp, Mus musculus
catcatctgacccaggtgtccccat

SEQ ID NO: 232966 - DNA, 25 bp, Mus musculus
catcatctggccagaaccagacttg

SEQ ID NO: 232967 - DNA, 25 bp, Mus musculus
catcatctggccaggatactcacag

SEQ ID NO: 232968 - DNA, 25 bp, Mus musculus
catcatcttggtggagaggcttcga

SEQ ID NO: 232969 - DNA, 25 bp, Mus musculus
catcatgaacctgctcctggccgtg

SEQ ID NO: 232970 - DNA, 25 bp, Mus musculus
catcatgaacggacccaagtgtgca

SEQ ID NO: 232971 - DNA, 25 bp, Mus musculus
catcatgaatcccagcccggagggc

SEQ ID NO: 232972 - DNA, 25 bp, Mus musculus
catcatgaatgtgaaagagtttcta

SEQ ID NO: 232973 - DNA, 25 bp, Mus musculus
catcatgacttcttgttcagtcacc

SEQ ID NO: 232974 - DNA, 25 bp, Mus musculus
catcatgagccaggactgctagaca

SEQ ID NO: 232975 - DNA, 25 bp, Mus musculus
catcatgagccaggtggctgtgggc

SEQ ID NO: 232976 - DNA, 25 bp, Mus musculus
catcatgcaggatccaaacgaagat

SEQ ID NO: 232977 - DNA, 25 bp, Mus musculus
catcatgcagttaaaccatatgaga

SEQ ID NO: 232978 - DNA, 25 bp, Mus musculus
catcatgcatgctaagtggcagtgc

SEQ ID NO: 232979 - DNA, 25 bp, Mus musculus
catcatgccaagacaactcctgagg

SEQ ID NO: 232980 - DNA, 25 bp, Mus musculus
catcatgccaagcctgttcattaaa

SEQ ID NO: 232981 - DNA, 25 bp, Mus musculus
catcatgccaaggactctggaggaa

SEQ ID NO: 232982 - DNA, 25 bp, Mus musculus
catcatgcgcccgaatgacagtcct

SEQ ID NO: 232983 - DNA, 25 bp, Mus musculus
catcatgctatagagctgtcatagc

SEQ ID NO: 232984 - DNA, 25 bp, Mus musculus
catcatgctatagagtcgacaagca

SEQ ID NO: 232985 - DNA, 25 bp, Mus musculus
catcatgctatagagtctggatttt

SEQ ID NO: 232986 - DNA, 25 bp, Mus musculus
catcatgctgagcacttttgtgtaa

SEQ ID NO: 232987 - DNA, 25 bp, Mus musculus
catcatgctggggaaacaactggaa

SEQ ID NO: 232988 - DNA, 25 bp, Mus musculus
catcatgctgggtggaagtgagagg

SEQ ID NO: 232989 - DNA, 25 bp, Mus musculus
catcatggaattcgtactgcgtttg

SEQ ID NO: 232990 - DNA, 25 bp, Mus musculus
catcatggagaatatccggagacaa

SEQ ID NO: 232991 - DNA, 25 bp, Mus musculus
catcatggtcgttggccagagtgga

SEQ ID NO: 232992 - DNA, 25 bp, Mus musculus
catcatgtttggacctgatatttgt

SEQ ID NO: 232993 - DNA, 25 bp, Mus musculus
catcattagaagaatcagcagccgc

SEQ ID NO: 232994 - DNA, 25 bp, Mus musculus
catcattcagaaatggcaaaatgct

SEQ ID NO: 232995 - DNA, 25 bp, Mus musculus
catcattcagaatctgtccgtgtgt

SEQ ID NO: 232996 - DNA, 25 bp, Mus musculus
catcattcagggctgcaaaataaat

SEQ ID NO: 232997 - DNA, 25 bp, Mus musculus
catcattcaggtttttcctgatgag

SEQ ID NO: 232998 - DNA, 25 bp, Mus musculus
catcattccaatgtggaaaagaaga

SEQ ID NO: 232999 - DNA, 25 bp, Mus musculus
catcattccattagtaaccgtgtgg

SEQ ID NO: 233000 - DNA, 25 bp, Mus musculus
catcattcccataagtctgcgagta

SEQ ID NO: 233001 - DNA, 25 bp, Mus musculus
catcattcctatcagcttgcgtgtg

SEQ ID NO: 233002 - DNA, 25 bp, Mus musculus
catcattgaagagaagagccttgtt

SEQ ID NO: 233003 - DNA, 25 bp, Mus musculus
catcattgaccagcaccacctgccc

SEQ ID NO: 233004 - DNA, 25 bp, Mus musculus
catcattgatgggaatccggaaacc

SEQ ID NO: 233005 - DNA, 25 bp, Mus musculus
catcattgatggtcctgcttggcga

SEQ ID NO: 233006 - DNA, 25 bp, Mus musculus
catcattgcaaaggatgaagtcgcc

SEQ ID NO: 233007 - DNA, 25 bp, Mus musculus
catcattgcaatctccacatggtct

SEQ ID NO: 233008 - DNA, 25 bp, Mus musculus
catcattgcagctgtgatcactgct

SEQ ID NO: 233009 - DNA, 25 bp, Mus musculus
catcattgcaggctcaaacatactg

SEQ ID NO: 233010 - DNA, 25 bp, Mus musculus
catcattgcatatgatcactctcgg

SEQ ID NO: 233011 - DNA, 25 bp, Mus musculus
catcattgcatccatgccgagctcc

SEQ ID NO: 233012 - DNA, 25 bp, Mus musculus
catcattgctacagagtacctgaac

SEQ ID NO: 233013 - DNA, 25 bp, Mus musculus
catcattggcgattccggggtgcac

SEQ ID NO: 233014 - DNA, 25 bp, Mus musculus
catcattggcggtgcccagatcatt

SEQ ID NO: 233015 - DNA, 25 bp, Mus musculus
catcatttaatggtcaggggagtac

SEQ ID NO: 233016 - DNA, 25 bp, Mus musculus
catcatttcagaagcatgtaatgag

SEQ ID NO: 233017 - DNA, 25 bp, Mus musculus
catcatttgtaccatctgtaccgtg

SEQ ID NO: 233018 - DNA, 25 bp, Mus musculus
catccaaaatgaagccaatgctgag

SEQ ID NO: 233019 - DNA, 25 bp, Mus musculus
catccaaaatgaaggcaaagggatg

SEQ ID NO: 233020 - DNA, 25 bp, Mus musculus
catccaaacattgtgcgtctccatg

SEQ ID NO: 233021 - DNA, 25 bp, Mus musculus
catccaaacattgtgttaccggagg

SEQ ID NO: 233022 - DNA, 25 bp, Mus musculus
catccaaagacacttcctctctctg

SEQ ID NO: 233023 - DNA, 25 bp, Mus musculus
catccaaagagcagcacctgacgtt

SEQ ID NO: 233024 - DNA, 25 bp, Mus musculus
catccaacagagcccagcagcagct

SEQ ID NO: 233025 - DNA, 25 bp, Mus musculus
catccaacatcaatagtggagattt

SEQ ID NO: 233026 - DNA, 25 bp, Mus musculus
catccaacatcaatagtgtaattat

SEQ ID NO: 233027 - DNA, 25 bp, Mus musculus
catccaaccgaggagagtcaacagt

SEQ ID NO: 233028 - DNA, 25 bp, Mus musculus
catccaagaaagatcgctcctttga

SEQ ID NO: 233029 - DNA, 25 bp, Mus musculus
catccaagaatatagtcaagttaca

SEQ ID NO: 233030 - DNA, 25 bp, Mus musculus
catccaagggccaggagactgttct

SEQ ID NO: 233031 - DNA, 25 bp, Mus musculus
catccaagtgccaggtacaaccagc

SEQ ID NO: 233032 - DNA, 25 bp, Mus musculus
catccaagttggcaggaacatcatt

SEQ ID NO: 233033 - DNA, 25 bp, Mus musculus
catccacaacccagccaccaatgaa

SEQ ID NO: 233034 - DNA, 25 bp, Mus musculus
catccacaccgccgtgacgtcttac

SEQ ID NO: 233035 - DNA, 25 bp, Mus musculus
catccacaccgcttgcttgggtcct

SEQ ID NO: 233036 - DNA, 25 bp, Mus musculus
catccacagaatcctagactttggc

SEQ ID NO: 233037 - DNA, 25 bp, Mus musculus
catccacagagacttgaagcctggc

SEQ ID NO: 233038 - DNA, 25 bp, Mus musculus
catccacagagcttggctgaagagg

SEQ ID NO: 233039 - DNA, 25 bp, Mus musculus
catccacagcagttgagtggtgatt

SEQ ID NO: 233040 - DNA, 25 bp, Mus musculus
catccacagtggagatccagacagg

SEQ ID NO: 233041 - DNA, 25 bp, Mus musculus
catccacattgagagcaccaagacc

SEQ ID NO: 233042 - DNA, 25 bp, Mus musculus
catccaccatcaagagcaccccatc

SEQ ID NO: 233043 - DNA, 25 bp, Mus musculus
catccacccagcaagaaaaagccac

SEQ ID NO: 233044 - DNA, 25 bp, Mus musculus
catccacccggctgccaataactat

SEQ ID NO: 233045 - DNA, 25 bp, Mus musculus
catccaccctgaaacgatcagcaga

SEQ ID NO: 233046 - DNA, 25 bp, Mus musculus
catccacgcacatgaggaagcagcc

SEQ ID NO: 233047 - DNA, 25 bp, Mus musculus
catccacgcagtgattgacgagaga

SEQ ID NO: 233048 - DNA, 25 bp, Mus musculus
catccacggaggaggagctgatcca

SEQ ID NO: 233049 - DNA, 25 bp, Mus musculus
catccacggaggccctgcccaggaa

SEQ ID NO: 233050 - DNA, 25 bp, Mus musculus
catccacggagtcagaactgggctc

SEQ ID NO: 233051 - DNA, 25 bp, Mus musculus
catccacggagtcaggacggggctc

SEQ ID NO: 233052 - DNA, 25 bp, Mus musculus
catccacttatcacttcattgtatc

SEQ ID NO: 233053 - DNA, 25 bp, Mus musculus
catccacttatctcttcattgtatc

SEQ ID NO: 233054 - DNA, 25 bp, Mus musculus
catccagaaacgagaagaagcagac

SEQ ID NO: 233055 - DNA, 25 bp, Mus musculus
catccagaacaatggagacaccaag

SEQ ID NO: 233056 - DNA, 25 bp, Mus musculus
catccagaagtttggggacctggaa

SEQ ID NO: 233057 - DNA, 25 bp, Mus musculus
catccagaatggtggccacttggat

SEQ ID NO: 233058 - DNA, 25 bp, Mus musculus
catccagaatgtggatcggtcatgg

SEQ ID NO: 233059 - DNA, 25 bp, Mus musculus
catccagaccccatttgggttccag

SEQ ID NO: 233060 - DNA, 25 bp, Mus musculus
catccagactcggggttctctggaa

SEQ ID NO: 233061 - DNA, 25 bp, Mus musculus
catccagaggcagctgcgagcttcc

SEQ ID NO: 233062 - DNA, 25 bp, Mus musculus
catccagatctgccggatcatgcgt

SEQ ID NO: 233063 - DNA, 25 bp, Mus musculus
catccagatctgccgggctgcctct

SEQ ID NO: 233064 - DNA, 25 bp, Mus musculus
catccagcaccagtacctcatgcct

SEQ ID NO: 233065 - DNA, 25 bp, Mus musculus
catccagcagaaaaaagatggattt

SEQ ID NO: 233066 - DNA, 25 bp, Mus musculus
catccagcagacgtcccccgccaca

SEQ ID NO: 233067 - DNA, 25 bp, Mus musculus
catccagcagaggaaaggagagtgt

SEQ ID NO: 233068 - DNA, 25 bp, Mus musculus
catccagcagaggtgcagttaaaaa

SEQ ID NO: 233069 - DNA, 25 bp, Mus musculus
catccagcagcacttctcctctctg

SEQ ID NO: 233070 - DNA, 25 bp, Mus musculus
catccagcagcaggaccagtgtgtg

SEQ ID NO: 233071 - DNA, 25 bp, Mus musculus
catccagcagcagtttgtgcagtgg

SEQ ID NO: 233072 - DNA, 25 bp, Mus musculus
catccagcatgtgtctaacaagcac

SEQ ID NO: 233073 - DNA, 25 bp, Mus musculus
catccagccctacatccagaaccca

SEQ ID NO: 233074 - DNA, 25 bp, Mus musculus
catccagctcactactgtaacagaa

SEQ ID NO: 233075 - DNA, 25 bp, Mus musculus
catccagctgttgcacaaacagcgc

SEQ ID NO: 233076 - DNA, 25 bp, Mus musculus
catccaggaacctctcctcctggct

SEQ ID NO: 233077 - DNA, 25 bp, Mus musculus
catccaggacacgtttctgtgttgt

SEQ ID NO: 233078 - DNA, 25 bp, Mus musculus
catccaggacctcatgtggcaggcc

SEQ ID NO: 233079 - DNA, 25 bp, Mus musculus
catccaggagtcccagtgtcttgct

SEQ ID NO: 233080 - DNA, 25 bp, Mus musculus
catccaggcagatgaagaggtcggc

SEQ ID NO: 233081 - DNA, 25 bp, Mus musculus
catccaggcagctgggtaccgggtg

SEQ ID NO: 233082 - DNA, 25 bp, Mus musculus
catccaggcaggtataaaagaggtt

SEQ ID NO: 233083 - DNA, 25 bp, Mus musculus
catccaggccaggctgggcagcatc

SEQ ID NO: 233084 - DNA, 25 bp, Mus musculus
catccaggccaggtacatctatggg

SEQ ID NO: 233085 - DNA, 25 bp, Mus musculus
catccaggcttgccctctgttttct

SEQ ID NO: 233086 - DNA, 25 bp, Mus musculus
catccaggttgtagcaaatgacaag

SEQ ID NO: 233087 - DNA, 25 bp, Mus musculus
catccagtgagaaaattgtacaatc

SEQ ID NO: 233088 - DNA, 25 bp, Mus musculus
catccagtgaggaatcttccgagga

SEQ ID NO: 233089 - DNA, 25 bp, Mus musculus
catccataaacatgctcagcaaaga

SEQ ID NO: 233090 - DNA, 25 bp, Mus musculus
catccataaacatggaataccaaat

SEQ ID NO: 233091 - DNA, 25 bp, Mus musculus
catccatagaacagaactcatggga

SEQ ID NO: 233092 - DNA, 25 bp, Mus musculus
catccatagaacaggccaaagtaga

SEQ ID NO: 233093 - DNA, 25 bp, Mus musculus
catccatcaactaaccaatactgga

SEQ ID NO: 233094 - DNA, 25 bp, Mus musculus
catccatcaggcgtggtttctgtct

SEQ ID NO: 233095 - DNA, 25 bp, Mus musculus
catccatcagtacagggagcagatc

SEQ ID NO: 233096 - DNA, 25 bp, Mus musculus
catccatcagtacagtcatgcctgc

SEQ ID NO: 233097 - DNA, 25 bp, Mus musculus
catccatccgcgaggaaatctcaga

SEQ ID NO: 233098 - DNA, 25 bp, Mus musculus
catccatcgcaagtccacttgatcc

SEQ ID NO: 233099 - DNA, 25 bp, Mus musculus
catccatctacaggcctgtccactg

SEQ ID NO: 233100 - DNA, 25 bp, Mus musculus
catccatgacaaggagtatgtcagg

SEQ ID NO: 233101 - DNA, 25 bp, Mus musculus
catccatgcagtattcaagagacag

SEQ ID NO: 233102 - DNA, 25 bp, Mus musculus
catccatgttcgacaccacgcccca

SEQ ID NO: 233103 - DNA, 25 bp, Mus musculus
catccatgttcgagtgctaaggata

SEQ ID NO: 233104 - DNA, 25 bp, Mus musculus
catccattcaggcgtccgcgagttc

SEQ ID NO: 233105 - DNA, 25 bp, Mus musculus
catccattttcagtgatataccgat

SEQ ID NO: 233106 - DNA, 25 bp, Mus musculus
catccattttcagtgtttgtgagga

SEQ ID NO: 233107 - DNA, 25 bp, Mus musculus
catcccaaagaaccatggatcggtt

SEQ ID NO: 233108 - DNA, 25 bp, Mus musculus
catcccaaccgagatcctatgattg

SEQ ID NO: 233109 - DNA, 25 bp, Mus musculus
catcccaacgtacagagccattgtc

SEQ ID NO: 233110 - DNA, 25 bp, Mus musculus
catcccaagggaagggaggaagaga

SEQ ID NO: 233111 - DNA, 25 bp, Mus musculus
catcccaagggaaggggagaggcct

SEQ ID NO: 233112 - DNA, 25 bp, Mus musculus
catcccacagggtggtcatgatcac

SEQ ID NO: 233113 - DNA, 25 bp, Mus musculus
catcccaccaattcccacagagaac

SEQ ID NO: 233114 - DNA, 25 bp, Mus musculus
catcccaccaccgggtgtgatgaat

SEQ ID NO: 233115 - DNA, 25 bp, Mus musculus
catcccactattggctttggacctt

SEQ ID NO: 233116 - DNA, 25 bp, Mus musculus
catcccagacagacggtggcgcctc

SEQ ID NO: 233117 - DNA, 25 bp, Mus musculus
catcccagacagagatgctgcctgg

SEQ ID NO: 233118 - DNA, 25 bp, Mus musculus
catcccagccggagtgttcttttgt

SEQ ID NO: 233119 - DNA, 25 bp, Mus musculus
catcccagctggaagcaggagagga

SEQ ID NO: 233120 - DNA, 25 bp, Mus musculus
catcccagctgtcgctgactcccct

SEQ ID NO: 233121 - DNA, 25 bp, Mus musculus
catcccaggaaaggtgattgatgag

SEQ ID NO: 233122 - DNA, 25 bp, Mus musculus
catcccaggagatcttcccacggtg

SEQ ID NO: 233123 - DNA, 25 bp, Mus musculus
catcccaggtgacaccgcttggctc

SEQ ID NO: 233124 - DNA, 25 bp, Mus musculus
catcccatcacctggaacaacctga

SEQ ID NO: 233125 - DNA, 25 bp, Mus musculus
catcccatgcccctgtttcactggc

SEQ ID NO: 233126 - DNA, 25 bp, Mus musculus
catccccaaagatggacaaaagaga

SEQ ID NO: 233127 - DNA, 25 bp, Mus musculus
catccccaaggccgcagatcatgcc

SEQ ID NO: 233128 - DNA, 25 bp, Mus musculus
catccccaaggggacaaatgtaata

SEQ ID NO: 233129 - DNA, 25 bp, Mus musculus
catccccaaggggtcaatcctcatc

SEQ ID NO: 233130 - DNA, 25 bp, Mus musculus
catccccaatacctgtcctagcctg

SEQ ID NO: 233131 - DNA, 25 bp, Mus musculus
catccccacagataattctgaaata

SEQ ID NO: 233132 - DNA, 25 bp, Mus musculus
catccccacagggtcagttttgtgc

SEQ ID NO: 233133 - DNA, 25 bp, Mus musculus
catccccacagtacccatgatgcac

SEQ ID NO: 233134 - DNA, 25 bp, Mus musculus
catccccaccgtctttgacaactat

SEQ ID NO: 233135 - DNA, 25 bp, Mus musculus
catccccaccgtgacgtgttcttaa

SEQ ID NO: 233136 - DNA, 25 bp, Mus musculus
catccccagagagaaccttcttcca

SEQ ID NO: 233137 - DNA, 25 bp, Mus musculus
catccccagagagatgaggaaagtg

SEQ ID NO: 233138 - DNA, 25 bp, Mus musculus
catccccagagagcatttctggctg

SEQ ID NO: 233139 - DNA, 25 bp, Mus musculus
catccccagaggattatcacaaaat

SEQ ID NO: 233140 - DNA, 25 bp, Mus musculus
catccccagccctattcaggttatt

SEQ ID NO: 233141 - DNA, 25 bp, Mus musculus
catccccagccctcaacttaatgag

SEQ ID NO: 233142 - DNA, 25 bp, Mus musculus
catccccagttgtccccaaggtcag

SEQ ID NO: 233143 - DNA, 25 bp, Mus musculus
catccccatcaagaaatctgaccct

SEQ ID NO: 233144 - DNA, 25 bp, Mus musculus
catccccatcaggccaaccagagga

SEQ ID NO: 233145 - DNA, 25 bp, Mus musculus
catccccatgaagagtctttgcagt

SEQ ID NO: 233146 - DNA, 25 bp, Mus musculus
catcccccacgctgacagccctgtg

SEQ ID NO: 233147 - DNA, 25 bp, Mus musculus
catccccccagccaggatgatgtct

SEQ ID NO: 233148 - DNA, 25 bp, Mus musculus
catcccccgctgcacaacacccccg

SEQ ID NO: 233149 - DNA, 25 bp, Mus musculus
catcccccggaatggtgaagtgtgt

SEQ ID NO: 233150 - DNA, 25 bp, Mus musculus
catccccctggttggttttatcaac

SEQ ID NO: 233151 - DNA, 25 bp, Mus musculus
catccccctgtgtgcatcagcatca

SEQ ID NO: 233152 - DNA, 25 bp, Mus musculus
catccccgagcccggaagagaaaag

SEQ ID NO: 233153 - DNA, 25 bp, Mus musculus
catccccgatgatcatcccctctgg

SEQ ID NO: 233154 - DNA, 25 bp, Mus musculus
catccccggctccaggactactacg

SEQ ID NO: 233155 - DNA, 25 bp, Mus musculus
catccccggggatgagtcctcaaat

SEQ ID NO: 233156 - DNA, 25 bp, Mus musculus
catccccgtggccctgttgcatcga

SEQ ID NO: 233157 - DNA, 25 bp, Mus musculus
catcccctaggacccccactcagga

SEQ ID NO: 233158 - DNA, 25 bp, Mus musculus
catcccctagggagctccgggagca

SEQ ID NO: 233159 - DNA, 25 bp, Mus musculus
catcccctcagctaacaatgaagag

SEQ ID NO: 233160 - DNA, 25 bp, Mus musculus
catcccctcccaagtttcagattac

SEQ ID NO: 233161 - DNA, 25 bp, Mus musculus
catcccctctgcagtgtatgtggct

SEQ ID NO: 233162 - DNA, 25 bp, Mus musculus
catccccttaaaggatcctctgaag

SEQ ID NO: 233163 - DNA, 25 bp, Mus musculus
catcccgaccattgggtttaatgtg

SEQ ID NO: 233164 - DNA, 25 bp, Mus musculus
catcccgactgtgatctgtgagtct

SEQ ID NO: 233165 - DNA, 25 bp, Mus musculus
catcccgaggcagaaatgtctgcgg

SEQ ID NO: 233166 - DNA, 25 bp, Mus musculus
catcccgagggagaaatgtctgcgg

SEQ ID NO: 233167 - DNA, 25 bp, Mus musculus
catcccggatttttgttgaagtact

SEQ ID NO: 233168 - DNA, 25 bp, Mus musculus
catcccgtttcaagaaagtatgagt

SEQ ID NO: 233169 - DNA, 25 bp, Mus musculus
catccctaaaggtgtcataagccga

SEQ ID NO: 233170 - DNA, 25 bp, Mus musculus
catccctaccattctgtccggtcgg

SEQ ID NO: 233171 - DNA, 25 bp, Mus musculus
catccctaggcaatgacaccctgta

SEQ ID NO: 233172 - DNA, 25 bp, Mus musculus
catccctaggcaatgcactactctc

SEQ ID NO: 233173 - DNA, 25 bp, Mus musculus
catccctcctcaggtggggctccca

SEQ ID NO: 233174 - DNA, 25 bp, Mus musculus
catccctcctgaggggatcccaggt

SEQ ID NO: 233175 - DNA, 25 bp, Mus musculus
catccctcctgaggggatgcttgag

SEQ ID NO: 233176 - DNA, 25 bp, Mus musculus
catccctctggaagtgccgaattcg

SEQ ID NO: 233177 - DNA, 25 bp, Mus musculus
catccctctggatcggttaagcata

SEQ ID NO: 233178 - DNA, 25 bp, Mus musculus
catccctctggtgaattccaaggct

SEQ ID NO: 233179 - DNA, 25 bp, Mus musculus
catccctgaactgcacacgccaaag

SEQ ID NO: 233180 - DNA, 25 bp, Mus musculus
catccctgactcatggtggcccgag

SEQ ID NO: 233181 - DNA, 25 bp, Mus musculus
catccctgagaacacaccagtgggg

SEQ ID NO: 233182 - DNA, 25 bp, Mus musculus
catccctgaggtcttccacacccag

SEQ ID NO: 233183 - DNA, 25 bp, Mus musculus
catccctgcaggggcctgtgtatgc

SEQ ID NO: 233184 - DNA, 25 bp, Mus musculus
catccctgccaaatttccaagcaag

SEQ ID NO: 233185 - DNA, 25 bp, Mus musculus
catccctgccaacaagaacctgaag

SEQ ID NO: 233186 - DNA, 25 bp, Mus musculus
catccctgcccgcctgtaagttcca

SEQ ID NO: 233187 - DNA, 25 bp, Mus musculus
catccctgcccgcctgtcgccttga

SEQ ID NO: 233188 - DNA, 25 bp, Mus musculus
catccctgctcattattcccccaga

SEQ ID NO: 233189 - DNA, 25 bp, Mus musculus
catccctgctctgttgtgtatccag

SEQ ID NO: 233190 - DNA, 25 bp, Mus musculus
catccctgctgtgggcctccctgag

SEQ ID NO: 233191 - DNA, 25 bp, Mus musculus
catccctggaaaagcctgaaaatca

SEQ ID NO: 233192 - DNA, 25 bp, Mus musculus
catccctggaccaggtgaaaaaagc

SEQ ID NO: 233193 - DNA, 25 bp, Mus musculus
catccctggcaaaaggtgcccgagg

SEQ ID NO: 233194 - DNA, 25 bp, Mus musculus
catccctggcctatctccctggagt

SEQ ID NO: 233195 - DNA, 25 bp, Mus musculus
catccctgtgcgggccatcaattac

SEQ ID NO: 233196 - DNA, 25 bp, Mus musculus
catccctgtgcgggttgccgatgct

SEQ ID NO: 233197 - DNA, 25 bp, Mus musculus
catccctgtggcaggtgaccttgga

SEQ ID NO: 233198 - DNA, 25 bp, Mus musculus
catccctgtggcagtggaggtgaag

SEQ ID NO: 233199 - DNA, 25 bp, Mus musculus
catccctgttcactcaacagacctg

SEQ ID NO: 233200 - DNA, 25 bp, Mus musculus
catcccttcagaatacacatgccaa

SEQ ID NO: 233201 - DNA, 25 bp, Mus musculus
catcccttgaggagttaccaaataa

SEQ ID NO: 233202 - DNA, 25 bp, Mus musculus
catccgaaaaagccggagcctcaac

SEQ ID NO: 233203 - DNA, 25 bp, Mus musculus
catccgaaaggcacagtgttccttc

SEQ ID NO: 233204 - DNA, 25 bp, Mus musculus
catccgaaagggactcctctagccc

SEQ ID NO: 233205 - DNA, 25 bp, Mus musculus
catccgaagtatcctggagaacact

SEQ ID NO: 233206 - DNA, 25 bp, Mus musculus
catccgacagcccgccggagtcctg

SEQ ID NO: 233207 - DNA, 25 bp, Mus musculus
catccgaccagacagatggatacca

SEQ ID NO: 233208 - DNA, 25 bp, Mus musculus
catccgaccagcttttttaaacagc

SEQ ID NO: 233209 - DNA, 25 bp, Mus musculus
catccgaccaggatggcttccccat

SEQ ID NO: 233210 - DNA, 25 bp, Mus musculus
catccgacttctaggcgtgtgtata

SEQ ID NO: 233211 - DNA, 25 bp, Mus musculus
catccgagagctagcccaccagggc

SEQ ID NO: 233212 - DNA, 25 bp, Mus musculus
catccgagaggccatcaaaaacaat

SEQ ID NO: 233213 - DNA, 25 bp, Mus musculus
catccgagcagtggcaaagcaacag

SEQ ID NO: 233214 - DNA, 25 bp, Mus musculus
catccgagctgatgtgtggagcctg

SEQ ID NO: 233215 - DNA, 25 bp, Mus musculus
catccgagggcggtggaggaacaga

SEQ ID NO: 233216 - DNA, 25 bp, Mus musculus
catccgagtagtgtgtgacggaatg

SEQ ID NO: 233217 - DNA, 25 bp, Mus musculus
catccgcaacactgaccgaggcaat

SEQ ID NO: 233218 - DNA, 25 bp, Mus musculus
catccgcatccagaggatgctgccc

SEQ ID NO: 233219 - DNA, 25 bp, Mus musculus
catccgcattgcagatgaacgagac

SEQ ID NO: 233220 - DNA, 25 bp, Mus musculus
catccgccaccaggccaaccatatt

SEQ ID NO: 233221 - DNA, 25 bp, Mus musculus
catccgccacgccgtctgggtacat

SEQ ID NO: 233222 - DNA, 25 bp, Mus musculus
catccgcgccaagaacatttaaaag

SEQ ID NO: 233223 - DNA, 25 bp, Mus musculus
catccgctgagacccatgcggactg

SEQ ID NO: 233224 - DNA, 25 bp, Mus musculus
catccgctgagatgctggtggactg

SEQ ID NO: 233225 - DNA, 25 bp, Mus musculus
catccgctgtgctttgacctcgaaa

SEQ ID NO: 233226 - DNA, 25 bp, Mus musculus
catccggaaccaggtgtcaccctga

SEQ ID NO: 233227 - DNA, 25 bp, Mus musculus
catccggaagaaagcaaaagagaag

SEQ ID NO: 233228 - DNA, 25 bp, Mus musculus
catccggaagctggcaaaaacgcag

SEQ ID NO: 233229 - DNA, 25 bp, Mus musculus
catccggaaggctgtggcagtttcc

SEQ ID NO: 233230 - DNA, 25 bp, Mus musculus
catccggaagtgtgtccctccagca

SEQ ID NO: 233231 - DNA, 25 bp, Mus musculus
catccggacagccagcgatggggat

SEQ ID NO: 233232 - DNA, 25 bp, Mus musculus
catccggacaggctgacgatgctca

SEQ ID NO: 233233 - DNA, 25 bp, Mus musculus
catccggagccagaatgacagccaa

SEQ ID NO: 233234 - DNA, 25 bp, Mus musculus
catccggagccaggtcatccacgcc

SEQ ID NO: 233235 - DNA, 25 bp, Mus musculus
catccggatagacaagcgtgagaat

SEQ ID NO: 233236 - DNA, 25 bp, Mus musculus
catccggcagaagcgcctgtctcac

SEQ ID NO: 233237 - DNA, 25 bp, Mus musculus
catccggccaggacctagggaaggg

SEQ ID NO: 233238 - DNA, 25 bp, Mus musculus
catccgggaagggaaactgcccgtg

SEQ ID NO: 233239 - DNA, 25 bp, Mus musculus
catccgggacaacgaggagaacatt

SEQ ID NO: 233240 - DNA, 25 bp, Mus musculus
catccgggactaggctctgtaggcc

SEQ ID NO: 233241 - DNA, 25 bp, Mus musculus
catccgggaggaactgcacgggcgc

SEQ ID NO: 233242 - DNA, 25 bp, Mus musculus
catccgggccgtggaagcatcagtt

SEQ ID NO: 233243 - DNA, 25 bp, Mus musculus
catccggttgttgccgaatacacca

SEQ ID NO: 233244 - DNA, 25 bp, Mus musculus
catccgtaagggcaccagcgtctat

SEQ ID NO: 233245 - DNA, 25 bp, Mus musculus
catccgtatcaactcaacaaggaca

SEQ ID NO: 233246 - DNA, 25 bp, Mus musculus
catccgtatcaagacatgttcagca

SEQ ID NO: 233247 - DNA, 25 bp, Mus musculus
catccgtatcaagacatgttcagta

SEQ ID NO: 233248 - DNA, 25 bp, Mus musculus
catccgtatccaggattccctggag

SEQ ID NO: 233249 - DNA, 25 bp, Mus musculus
catccgtgaggtatttgaatatcat

SEQ ID NO: 233250 - DNA, 25 bp, Mus musculus
catccgtgcctctgagatcccgttt

SEQ ID NO: 233251 - DNA, 25 bp, Mus musculus
catccgtgggctagcccatgccatt

SEQ ID NO: 233252 - DNA, 25 bp, Mus musculus
catccgtgtagaggagcaggcgagc

SEQ ID NO: 233253 - DNA, 25 bp, Mus musculus
catcctaaatcagctgctgaaatcg

SEQ ID NO: 233254 - DNA, 25 bp, Mus musculus
catcctaaatcaggtcatggttttt

SEQ ID NO: 233255 - DNA, 25 bp, Mus musculus
catcctaagccaacatgccatatga

SEQ ID NO: 233256 - DNA, 25 bp, Mus musculus
catcctacaggaacttctgggtcaa

SEQ ID NO: 233257 - DNA, 25 bp, Mus musculus
catcctacaggtatttcgaactcaa

SEQ ID NO: 233258 - DNA, 25 bp, Mus musculus
catcctaccacggctcgccagaggc

SEQ ID NO: 233259 - DNA, 25 bp, Mus musculus
catcctaccacggctctacttcccc

SEQ ID NO: 233260 - DNA, 25 bp, Mus musculus
catcctaccagttcgcagaccagtg

SEQ ID NO: 233261 - DNA, 25 bp, Mus musculus
catcctaccatatctgtctcggaca

SEQ ID NO: 233262 - DNA, 25 bp, Mus musculus
catcctagaaatgacttctgaataa

SEQ ID NO: 233263 - DNA, 25 bp, Mus musculus
catcctagaaatgcagaccaggaat

SEQ ID NO: 233264 - DNA, 25 bp, Mus musculus
catcctagaaatgccttctccctag

SEQ ID NO: 233265 - DNA, 25 bp, Mus musculus
catcctagcggtttgcctgagaata

SEQ ID NO: 233266 - DNA, 25 bp, Mus musculus
catcctaggccagtctccctatgag

SEQ ID NO: 233267 - DNA, 25 bp, Mus musculus
catcctatgaatctgttgatgacat

SEQ ID NO: 233268 - DNA, 25 bp, Mus musculus
catcctcaaagcgacccctgaacag

SEQ ID NO: 233269 - DNA, 25 bp, Mus musculus
catcctcaaaggatacaacttctct

SEQ ID NO: 233270 - DNA, 25 bp, Mus musculus
catcctcaacagcttgtgaccttgt

SEQ ID NO: 233271 - DNA, 25 bp, Mus musculus
catcctcaaccacagtgtggacaag

SEQ ID NO: 233272 - DNA, 25 bp, Mus musculus
catcctcaagaggaagcccgtgctt

SEQ ID NO: 233273 - DNA, 25 bp, Mus musculus
catcctcaagcgcggtttccgtgag

SEQ ID NO: 233274 - DNA, 25 bp, Mus musculus
catcctcaaggacacccagttgcac

SEQ ID NO: 233275 - DNA, 25 bp, Mus musculus
catcctcaatagttgaactttctag

SEQ ID NO: 233276 - DNA, 25 bp, Mus musculus
catcctcacaaaagcacttgcaaga

SEQ ID NO: 233277 - DNA, 25 bp, Mus musculus
catcctcacgcagacagtgtccatt

SEQ ID NO: 233278 - DNA, 25 bp, Mus musculus
catcctcagagatggccgccaagag

SEQ ID NO: 233279 - DNA, 25 bp, Mus musculus
catcctcatcaccggagaatccgga

SEQ ID NO: 233280 - DNA, 25 bp, Mus musculus
catcctcatcagatgttttaaggat

SEQ ID NO: 233281 - DNA, 25 bp, Mus musculus
catcctcatgatctcggacctaatc

SEQ ID NO: 233282 - DNA, 25 bp, Mus musculus
catcctcatgcctggataagagtaa

SEQ ID NO: 233283 - DNA, 25 bp, Mus musculus
catcctcatgtatgtggtcatcccc

SEQ ID NO: 233284 - DNA, 25 bp, Mus musculus
catcctcattgagacccccgatggc

SEQ ID NO: 233285 - DNA, 25 bp, Mus musculus
catcctccaagaggcggagtcgccg

SEQ ID NO: 233286 - DNA, 25 bp, Mus musculus
catcctccatgagtgaacccacagc

SEQ ID NO: 233287 - DNA, 25 bp, Mus musculus
catcctcccaacagatgcagcgaag

SEQ ID NO: 233288 - DNA, 25 bp, Mus musculus
catcctccccctcaagttcaaaagc

SEQ ID NO: 233289 - DNA, 25 bp, Mus musculus
catcctccgagtacatcaccaagct

SEQ ID NO: 233290 - DNA, 25 bp, Mus musculus
catcctcctcctggcaatcccctgg

SEQ ID NO: 233291 - DNA, 25 bp, Mus musculus
catcctcctcctggcagtaagatcc

SEQ ID NO: 233292 - DNA, 25 bp, Mus musculus
catcctcgaccagagagaagcaacc

SEQ ID NO: 233293 - DNA, 25 bp, Mus musculus
catcctcgcccaaggagagctctct

SEQ ID NO: 233294 - DNA, 25 bp, Mus musculus
catcctctcctggtggagagagcca

SEQ ID NO: 233295 - DNA, 25 bp, Mus musculus
catcctctctgaggtgacccctaca

SEQ ID NO: 233296 - DNA, 25 bp, Mus musculus
catcctctgagcccctccccccgcc

SEQ ID NO: 233297 - DNA, 25 bp, Mus musculus
catcctctggagacaggttttctct

SEQ ID NO: 233298 - DNA, 25 bp, Mus musculus
catcctctggagggtctggaatccc

SEQ ID NO: 233299 - DNA, 25 bp, Mus musculus
catcctctgtgaagctgtttgttca

SEQ ID NO: 233300 - DNA, 25 bp, Mus musculus
catcctcttctatgcggcaggccag

SEQ ID NO: 233301 - DNA, 25 bp, Mus musculus
catcctcttctgagcattccggctg

SEQ ID NO: 233302 - DNA, 25 bp, Mus musculus
catcctgaaactcaggttatgaggt

SEQ ID NO: 233303 - DNA, 25 bp, Mus musculus
catcctgaaagatcttggtgggctg

SEQ ID NO: 233304 - DNA, 25 bp, Mus musculus
catcctgaaagggctgtgcggacag

SEQ ID NO: 233305 - DNA, 25 bp, Mus musculus
catcctgaacatgccaggcacgagc

SEQ ID NO: 233306 - DNA, 25 bp, Mus musculus
catcctgaagaagcacgcccactgg

SEQ ID NO: 233307 - DNA, 25 bp, Mus musculus
catcctgaagaattacctggcaacc

SEQ ID NO: 233308 - DNA, 25 bp, Mus musculus
catcctgaagacgcatttagtaaag

SEQ ID NO: 233309 - DNA, 25 bp, Mus musculus
catcctgaagtccctgctatgtgga

SEQ ID NO: 233310 - DNA, 25 bp, Mus musculus
catcctgaagtgtcttatctgtcct

SEQ ID NO: 233311 - DNA, 25 bp, Mus musculus
catcctgaagtttatcccgatgcct

SEQ ID NO: 233312 - DNA, 25 bp, Mus musculus
catcctgacagaaacacataaacct

SEQ ID NO: 233313 - DNA, 25 bp, Mus musculus
catcctgacagaagatgattctgag

SEQ ID NO: 233314 - DNA, 25 bp, Mus musculus
catcctgacaggtgctgagttccct

SEQ ID NO: 233315 - DNA, 25 bp, Mus musculus
catcctgaccagagagcttctgtgt

SEQ ID NO: 233316 - DNA, 25 bp, Mus musculus
catcctgagcgcgagaactttcaaa

SEQ ID NO: 233317 - DNA, 25 bp, Mus musculus
catcctgaggaccgtgttcgtaagc

SEQ ID NO: 233318 - DNA, 25 bp, Mus musculus
catcctgagtgacatggaaataggg

SEQ ID NO: 233319 - DNA, 25 bp, Mus musculus
catcctgagtgacgtcatccactgg

SEQ ID NO: 233320 - DNA, 25 bp, Mus musculus
catcctgagtgagatggaaataggg

SEQ ID NO: 233321 - DNA, 25 bp, Mus musculus
catcctgagtgagcagaaaatgcga

SEQ ID NO: 233322 - DNA, 25 bp, Mus musculus
catcctgagtgaggtcatccactgg

SEQ ID NO: 233323 - DNA, 25 bp, Mus musculus
catcctgatcacaggacagctccct

SEQ ID NO: 233324 - DNA, 25 bp, Mus musculus
catcctgatcttaggacagctccct

SEQ ID NO: 233325 - DNA, 25 bp, Mus musculus
catcctgcactcaggtagtgacatg

SEQ ID NO: 233326 - DNA, 25 bp, Mus musculus
catcctgcagaagcaccctaggata

SEQ ID NO: 233327 - DNA, 25 bp, Mus musculus
catcctgcagaccttatgtgagcag

SEQ ID NO: 233328 - DNA, 25 bp, Mus musculus
catcctgcaggggctggcgagatgg

SEQ ID NO: 233329 - DNA, 25 bp, Mus musculus
catcctgccacaggtactactgggc

SEQ ID NO: 233330 - DNA, 25 bp, Mus musculus
catcctgccagccaggagacacaaa

SEQ ID NO: 233331 - DNA, 25 bp, Mus musculus
catcctgccctatgaccactctaga

SEQ ID NO: 233332 - DNA, 25 bp, Mus musculus
catcctgccctttctctctttagct

SEQ ID NO: 233333 - DNA, 25 bp, Mus musculus
catcctggacaggccaaccaggatc

SEQ ID NO: 233334 - DNA, 25 bp, Mus musculus
catcctggacagtctgcacctgtct

SEQ ID NO: 233335 - DNA, 25 bp, Mus musculus
catcctggacatggcccgtgtggtt

SEQ ID NO: 233336 - DNA, 25 bp, Mus musculus
catcctggaccctgcatgctgatgc

SEQ ID NO: 233337 - DNA, 25 bp, Mus musculus
catcctggagatgagaaataaagat

SEQ ID NO: 233338 - DNA, 25 bp, Mus musculus
catcctggagatgagtcacagccca

SEQ ID NO: 233339 - DNA, 25 bp, Mus musculus
catcctggagctagcatctagtgct

SEQ ID NO: 233340 - DNA, 25 bp, Mus musculus
catcctggagctaggtcattttacc

SEQ ID NO: 233341 - DNA, 25 bp, Mus musculus
catcctggagggctcctgtgatgcc

SEQ ID NO: 233342 - DNA, 25 bp, Mus musculus
catcctggagtgtacaactctactg

SEQ ID NO: 233343 - DNA, 25 bp, Mus musculus
catcctggcaggggacccagccgta

SEQ ID NO: 233344 - DNA, 25 bp, Mus musculus
catcctggcgatcattacaggggaa

SEQ ID NO: 233345 - DNA, 25 bp, Mus musculus
catcctggcggggaattctaccgga

SEQ ID NO: 233346 - DNA, 25 bp, Mus musculus
catcctggctcaaggctttggctcc

SEQ ID NO: 233347 - DNA, 25 bp, Mus musculus
catcctgggttccagaccagccacg

SEQ ID NO: 233348 - DNA, 25 bp, Mus musculus
catcctggtgcgagacaccccccag

SEQ ID NO: 233349 - DNA, 25 bp, Mus musculus
catcctggtgcgagagtcacccagc

SEQ ID NO: 233350 - DNA, 25 bp, Mus musculus
catcctggtggcgggagcctttttc

SEQ ID NO: 233351 - DNA, 25 bp, Mus musculus
catcctggtggcggggaaggcagat

SEQ ID NO: 233352 - DNA, 25 bp, Mus musculus
catcctggtgttcctgctggcagag

SEQ ID NO: 233353 - DNA, 25 bp, Mus musculus
catcctggtttgaagatcccaatac

SEQ ID NO: 233354 - DNA, 25 bp, Mus musculus
catcctggtttgaaggtttggagtc

SEQ ID NO: 233355 - DNA, 25 bp, Mus musculus
catcctggtttgggtccgtgttcac

SEQ ID NO: 233356 - DNA, 25 bp, Mus musculus
catcctgtactgcgtggtgacatct

SEQ ID NO: 233357 - DNA, 25 bp, Mus musculus
catcctgtcccgaaacaagccttca

SEQ ID NO: 233358 - DNA, 25 bp, Mus musculus
catcctgtccgaggatggatgccct

SEQ ID NO: 233359 - DNA, 25 bp, Mus musculus
catcctgtctatggagaaaataagt

SEQ ID NO: 233360 - DNA, 25 bp, Mus musculus
catcctgtgagttgggtgcaaagct

SEQ ID NO: 233361 - DNA, 25 bp, Mus musculus
catcctgtgctacaaaaaactgaga

SEQ ID NO: 233362 - DNA, 25 bp, Mus musculus
catcctgtgctacaagtccacacac

SEQ ID NO: 233363 - DNA, 25 bp, Mus musculus
catcctgtgtgaggtccctccagct

SEQ ID NO: 233364 - DNA, 25 bp, Mus musculus
catcctgtgtggaccagcagagaac

SEQ ID NO: 233365 - DNA, 25 bp, Mus musculus
catcctgttgcgcagcgtctcctgt

SEQ ID NO: 233366 - DNA, 25 bp, Mus musculus
catcctgttgtacgtggtgatccca

SEQ ID NO: 233367 - DNA, 25 bp, Mus musculus
catccttaagtggccaaatgtaaat

SEQ ID NO: 233368 - DNA, 25 bp, Mus musculus
catccttacagcaggtggccccttc

SEQ ID NO: 233369 - DNA, 25 bp, Mus musculus
catccttaccctatccagcaatctg

SEQ ID NO: 233370 - DNA, 25 bp, Mus musculus
catccttagtcagacgcgcacggac

SEQ ID NO: 233371 - DNA, 25 bp, Mus musculus
catccttatcagacgaaagagcctg

SEQ ID NO: 233372 - DNA, 25 bp, Mus musculus
catccttcaagaaaccctgaagctg

SEQ ID NO: 233373 - DNA, 25 bp, Mus musculus
catccttcaagactgcaggcaccat

SEQ ID NO: 233374 - DNA, 25 bp, Mus musculus
catccttcaaggtctgtgattgctg

SEQ ID NO: 233375 - DNA, 25 bp, Mus musculus
catccttcacgaaagaacttatttg

SEQ ID NO: 233376 - DNA, 25 bp, Mus musculus
catccttcaggctggtggctggtgg

SEQ ID NO: 233377 - DNA, 25 bp, Mus musculus
catccttcaggtctccagatgaggc

SEQ ID NO: 233378 - DNA, 25 bp, Mus musculus
catccttcgaatgctgactcccttt

SEQ ID NO: 233379 - DNA, 25 bp, Mus musculus
catccttcgaggatgtctcggaact

SEQ ID NO: 233380 - DNA, 25 bp, Mus musculus
catccttcgaggcttgctttgcttc

SEQ ID NO: 233381 - DNA, 25 bp, Mus musculus
catccttgactccaagcggggctct

SEQ ID NO: 233382 - DNA, 25 bp, Mus musculus
catccttgcatgatatggcataaga

SEQ ID NO: 233383 - DNA, 25 bp, Mus musculus
catccttgctatgaacacccctggc

SEQ ID NO: 233384 - DNA, 25 bp, Mus musculus
catccttgctattgctcctgggcct

SEQ ID NO: 233385 - DNA, 25 bp, Mus musculus
catccttgtcaaagatcgactgtgc

SEQ ID NO: 233386 - DNA, 25 bp, Mus musculus
catccttgtcaaagtctacaaaata

SEQ ID NO: 233387 - DNA, 25 bp, Mus musculus
catccttgtcgctgcggatgggaca

SEQ ID NO: 233388 - DNA, 25 bp, Mus musculus
catccttgttaggtgccgcattgca

SEQ ID NO: 233389 - DNA, 25 bp, Mus musculus
catcctttgcatgtgtctaaggatg

SEQ ID NO: 233390 - DNA, 25 bp, Mus musculus
catcctttggagaattgcagtactg

SEQ ID NO: 233391 - DNA, 25 bp, Mus musculus
catcctttgttgatggtattgcgcg

SEQ ID NO: 233392 - DNA, 25 bp, Mus musculus
catccttttccagacagtccaggat

SEQ ID NO: 233393 - DNA, 25 bp, Mus musculus
catcctttttataatcatgctgctt

SEQ ID NO: 233394 - DNA, 25 bp, Mus musculus
catcgaaagaacttgtcaatgtccc

SEQ ID NO: 233395 - DNA, 25 bp, Mus musculus
catcgaaagcaagtctcgttacatc

SEQ ID NO: 233396 - DNA, 25 bp, Mus musculus
catcgaaagtcaggaaactgaagct

SEQ ID NO: 233397 - DNA, 25 bp, Mus musculus
catcgaaatgaagattggataacca

SEQ ID NO: 233398 - DNA, 25 bp, Mus musculus
catcgaaatgatgccagaatttcag

SEQ ID NO: 233399 - DNA, 25 bp, Mus musculus
catcgaaatggaaatcagagatggc

SEQ ID NO: 233400 - DNA, 25 bp, Mus musculus
catcgaacagactcaccacctccac

SEQ ID NO: 233401 - DNA, 25 bp, Mus musculus
catcgaacagttcatgcaacagaaa

SEQ ID NO: 233402 - DNA, 25 bp, Mus musculus
catcgaagagctggaccgtgctgga

SEQ ID NO: 233403 - DNA, 25 bp, Mus musculus
catcgaagcgtttgatgactccgga

SEQ ID NO: 233404 - DNA, 25 bp, Mus musculus
catcgaagcgtttgcaatcccggaa

SEQ ID NO: 233405 - DNA, 25 bp, Mus musculus
catcgaagcgtttggctccttccgc

SEQ ID NO: 233406 - DNA, 25 bp, Mus musculus
catcgaatacccgactcagccctag

SEQ ID NO: 233407 - DNA, 25 bp, Mus musculus
catcgaatacccgagttggattgtc

SEQ ID NO: 233408 - DNA, 25 bp, Mus musculus
catcgacaaagacaacactgcttat

SEQ ID NO: 233409 - DNA, 25 bp, Mus musculus
catcgacaaggtgcgcttcctggag

SEQ ID NO: 233410 - DNA, 25 bp, Mus musculus
catcgacaatgagcaccgggggctg

SEQ ID NO: 233411 - DNA, 25 bp, Mus musculus
catcgacaatggttcaggggtgatc

SEQ ID NO: 233412 - DNA, 25 bp, Mus musculus
catcgacactgtagccacgcgagtt

SEQ ID NO: 233413 - DNA, 25 bp, Mus musculus
catcgacagaggatgagggtgagga

SEQ ID NO: 233414 - DNA, 25 bp, Mus musculus
catcgacatcaagatcatcgccccc

SEQ ID NO: 233415 - DNA, 25 bp, Mus musculus
catcgacccccttttgcaatggcca

SEQ ID NO: 233416 - DNA, 25 bp, Mus musculus
catcgaccctgagactggtatgggc

SEQ ID NO: 233417 - DNA, 25 bp, Mus musculus
catcgaccctgagcttgcaagatac

SEQ ID NO: 233418 - DNA, 25 bp, Mus musculus
catcgaccgcaaggtcaactcctgg

SEQ ID NO: 233419 - DNA, 25 bp, Mus musculus
catcgacctacaggacagctataca

SEQ ID NO: 233420 - DNA, 25 bp, Mus musculus
catcgacctacaggaggggcccggc

SEQ ID NO: 233421 - DNA, 25 bp, Mus musculus
catcgacctggctgctgcaagaacc

SEQ ID NO: 233422 - DNA, 25 bp, Mus musculus
catcgaccttccaggagatcctgaa

SEQ ID NO: 233423 - DNA, 25 bp, Mus musculus
catcgaccttccaggttttgggaac

SEQ ID NO: 233424 - DNA, 25 bp, Mus musculus
catcgacttcaaggacacagcaggc

SEQ ID NO: 233425 - DNA, 25 bp, Mus musculus
catcgactttgaaggacaaattgca

SEQ ID NO: 233426 - DNA, 25 bp, Mus musculus
catcgactttgaaggtccttgctgc

SEQ ID NO: 233427 - DNA, 25 bp, Mus musculus
catcgactttgccagaaagtgagcc

SEQ ID NO: 233428 - DNA, 25 bp, Mus musculus
catcgagaagcaactgcgctccaat

SEQ ID NO: 233429 - DNA, 25 bp, Mus musculus
catcgagaagccaggagaaactaca

SEQ ID NO: 233430 - DNA, 25 bp, Mus musculus
catcgagaagccaggtggtgaccat

SEQ ID NO: 233431 - DNA, 25 bp, Mus musculus
catcgagaagcccatgggcatcatg

SEQ ID NO: 233432 - DNA, 25 bp, Mus musculus
catcgagaagtatcagcggtgcaga

SEQ ID NO: 233433 - DNA, 25 bp, Mus musculus
catcgagaggagtggctcaggagtt

SEQ ID NO: 233434 - DNA, 25 bp, Mus musculus
catcgagatgcacaaccaggcggaa

SEQ ID NO: 233435 - DNA, 25 bp, Mus musculus
catcgagcaatggctaggagaccat

SEQ ID NO: 233436 - DNA, 25 bp, Mus musculus
catcgagcacctccgggacctgttt

SEQ ID NO: 233437 - DNA, 25 bp, Mus musculus
catcgagcaggccctttccgatctc

SEQ ID NO: 233438 - DNA, 25 bp, Mus musculus
catcgagcaggtattcccaagccag

SEQ ID NO: 233439 - DNA, 25 bp, Mus musculus
catcgagcaggtgtcaccggatgaa

SEQ ID NO: 233440 - DNA, 25 bp, Mus musculus
catcgagctcatgaacacttcagtt

SEQ ID NO: 233441 - DNA, 25 bp, Mus musculus
catcgagctcatgatcagtaatgga

SEQ ID NO: 233442 - DNA, 25 bp, Mus musculus
catcgagctcatgtgttctgtgcca

SEQ ID NO: 233443 - DNA, 25 bp, Mus musculus
catcgagctcatgttaccgaagtgc

SEQ ID NO: 233444 - DNA, 25 bp, Mus musculus
catcgagctggaatacgtctacaaa

SEQ ID NO: 233445 - DNA, 25 bp, Mus musculus
catcgaggaggtgtaccacagcagc

SEQ ID NO: 233446 - DNA, 25 bp, Mus musculus
catcgagggatacagatgtatgagt

SEQ ID NO: 233447 - DNA, 25 bp, Mus musculus
catcgagggatacaggatggtgttg

SEQ ID NO: 233448 - DNA, 25 bp, Mus musculus
catcgaggtggcaggccccactgaa

SEQ ID NO: 233449 - DNA, 25 bp, Mus musculus
catcgagtaaaatcgataaacaacc

SEQ ID NO: 233450 - DNA, 25 bp, Mus musculus
catcgagtgtcaagactgtgattta

SEQ ID NO: 233451 - DNA, 25 bp, Mus musculus
catcgagttctgggagaacaaagta

SEQ ID NO: 233452 - DNA, 25 bp, Mus musculus
catcgagtttgaaattcctatcaca

SEQ ID NO: 233453 - DNA, 25 bp, Mus musculus
catcgataaggctcctgagggttca

SEQ ID NO: 233454 - DNA, 25 bp, Mus musculus
catcgataaggttgaagaacagtca

SEQ ID NO: 233455 - DNA, 25 bp, Mus musculus
catcgataccgtgatgcaattgctg

SEQ ID NO: 233456 - DNA, 25 bp, Mus musculus
catcgatataaagactcggtacccc

SEQ ID NO: 233457 - DNA, 25 bp, Mus musculus
catcgatataaagattgccctgacc

SEQ ID NO: 233458 - DNA, 25 bp, Mus musculus
catcgatcagatgttgctttgtgtt

SEQ ID NO: 233459 - DNA, 25 bp, Mus musculus
catcgatcaggcccaatgatgatca

SEQ ID NO: 233460 - DNA, 25 bp, Mus musculus
catcgatcaggtcaactttgtagtg

SEQ ID NO: 233461 - DNA, 25 bp, Mus musculus
catcgatgacgtgaaaagacaccga

SEQ ID NO: 233462 - DNA, 25 bp, Mus musculus
catcgatgagacaagaagactgctg

SEQ ID NO: 233463 - DNA, 25 bp, Mus musculus
catcgatgagacaagatcttcaagc

SEQ ID NO: 233464 - DNA, 25 bp, Mus musculus
catcgatgcagtgaagcctggtgtt

SEQ ID NO: 233465 - DNA, 25 bp, Mus musculus
catcgatggcgtgacctcctcttgc

SEQ ID NO: 233466 - DNA, 25 bp, Mus musculus
catcgatgtgcgagattgtgaaggg

SEQ ID NO: 233467 - DNA, 25 bp, Mus musculus
catcgatgtgcgagggaaggttgtg

SEQ ID NO: 233468 - DNA, 25 bp, Mus musculus
catcgatttcgggacctaccccttt

SEQ ID NO: 233469 - DNA, 25 bp, Mus musculus
catcgcaaggaaactcattttcagc

SEQ ID NO: 233470 - DNA, 25 bp, Mus musculus
catcgcaaggcctctgcaggtgtca

SEQ ID NO: 233471 - DNA, 25 bp, Mus musculus
catcgcaagggtactggcggaggac

SEQ ID NO: 233472 - DNA, 25 bp, Mus musculus
catcgcacagacgattcctcagatg

SEQ ID NO: 233473 - DNA, 25 bp, Mus musculus
catcgcacagctctatggtatcgct

SEQ ID NO: 233474 - DNA, 25 bp, Mus musculus
catcgcacaggaagggactgagact

SEQ ID NO: 233475 - DNA, 25 bp, Mus musculus
catcgcactgcagacaattgcctat

SEQ ID NO: 233476 - DNA, 25 bp, Mus musculus
catcgcagaccattgcccagactcg

SEQ ID NO: 233477 - DNA, 25 bp, Mus musculus
catcgcagagttgacatcctgctga

SEQ ID NO: 233478 - DNA, 25 bp, Mus musculus
catcgcaggacacgaaaactgtcct

SEQ ID NO: 233479 - DNA, 25 bp, Mus musculus
catcgcagtgctcagtgtggctgag

SEQ ID NO: 233480 - DNA, 25 bp, Mus musculus
catcgccaatgctgacttggagctg

SEQ ID NO: 233481 - DNA, 25 bp, Mus musculus
catcgccagctcaggcaccttaagg

SEQ ID NO: 233482 - DNA, 25 bp, Mus musculus
catcgccatcgacctggaactggta

SEQ ID NO: 233483 - DNA, 25 bp, Mus musculus
catcgcccacagcagagtctgtgcg

SEQ ID NO: 233484 - DNA, 25 bp, Mus musculus
catcgcccaggttctcggactcccc

SEQ ID NO: 233485 - DNA, 25 bp, Mus musculus
catcgccccagctccaaggaaacgc

SEQ ID NO: 233486 - DNA, 25 bp, Mus musculus
catcgccctggtggggttggtggct

SEQ ID NO: 233487 - DNA, 25 bp, Mus musculus
catcgccctggtgggtccaagtaca

SEQ ID NO: 233488 - DNA, 25 bp, Mus musculus
catcgccgaaaagaaatggaagata

SEQ ID NO: 233489 - DNA, 25 bp, Mus musculus
catcgcctactgcagtcagctggcc

SEQ ID NO: 233490 - DNA, 25 bp, Mus musculus
catcgcctcagagaacttctgcagc

SEQ ID NO: 233491 - DNA, 25 bp, Mus musculus
catcgcctcagagatactacggagg

SEQ ID NO: 233492 - DNA, 25 bp, Mus musculus
catcgcctcttggattctgtgtctt

SEQ ID NO: 233493 - DNA, 25 bp, Mus musculus
catcgcctgcagggcatggaacaag

SEQ ID NO: 233494 - DNA, 25 bp, Mus musculus
catcgcgcagcgacaatggaggtga

SEQ ID NO: 233495 - DNA, 25 bp, Mus musculus
catcgcgcagcgacattgtgtgttc

SEQ ID NO: 233496 - DNA, 25 bp, Mus musculus
catcgcggaggatcggtcatgggac

SEQ ID NO: 233497 - DNA, 25 bp, Mus musculus
catcgcggcgtccggacactgcaga

SEQ ID NO: 233498 - DNA, 25 bp, Mus musculus
catcgctacagatactttatgcatg

SEQ ID NO: 233499 - DNA, 25 bp, Mus musculus
catcgctcgaggaatcaaaagtcag

SEQ ID NO: 233500 - DNA, 25 bp, Mus musculus
catcgctgcccaggtccgcacgctc

SEQ ID NO: 233501 - DNA, 25 bp, Mus musculus
catcgctgggactaatggcaattct

SEQ ID NO: 233502 - DNA, 25 bp, Mus musculus
catcgctggtgaggaaccacagcga

SEQ ID NO: 233503 - DNA, 25 bp, Mus musculus
catcgctggtgggggcgctcctggg

SEQ ID NO: 233504 - DNA, 25 bp, Mus musculus
catcgcttagcagacgcttaaagga

SEQ ID NO: 233505 - DNA, 25 bp, Mus musculus
catcgctttcaactgtatggtcttg

SEQ ID NO: 233506 - DNA, 25 bp, Mus musculus
catcggaaccatggctagcctctgc

SEQ ID NO: 233507 - DNA, 25 bp, Mus musculus
catcggaaccatgtgaaaccttcca

SEQ ID NO: 233508 - DNA, 25 bp, Mus musculus
catcggaacctctaccactacagcc

SEQ ID NO: 233509 - DNA, 25 bp, Mus musculus
catcggaccccgaggagccaacatg

SEQ ID NO: 233510 - DNA, 25 bp, Mus musculus
catcggacctgatttcaagtccaac

SEQ ID NO: 233511 - DNA, 25 bp, Mus musculus
catcggacctgctatctgatgtcca

SEQ ID NO: 233512 - DNA, 25 bp, Mus musculus
catcggacttttgatcctcacttcc

SEQ ID NO: 233513 - DNA, 25 bp, Mus musculus
catcggacttttggacagtttcttg

SEQ ID NO: 233514 - DNA, 25 bp, Mus musculus
catcggagagaatgggttcaatgta

SEQ ID NO: 233515 - DNA, 25 bp, Mus musculus
catcggagagaccaggtaggcgacg

SEQ ID NO: 233516 - DNA, 25 bp, Mus musculus
catcggagccggggggacctcgggc

SEQ ID NO: 233517 - DNA, 25 bp, Mus musculus
catcggatcaatggctctgcctggt

SEQ ID NO: 233518 - DNA, 25 bp, Mus musculus
catcggatgagcagagaccactgct

SEQ ID NO: 233519 - DNA, 25 bp, Mus musculus
catcggcaaggttcagaagaagagc

SEQ ID NO: 233520 - DNA, 25 bp, Mus musculus
catcggcaccggcttttcctagatg

SEQ ID NO: 233521 - DNA, 25 bp, Mus musculus
catcggcagaaagctaaaaagatct

SEQ ID NO: 233522 - DNA, 25 bp, Mus musculus
catcggcagccagctggaggagccc

SEQ ID NO: 233523 - DNA, 25 bp, Mus musculus
catcggcatgaaccacaagacctgc

SEQ ID NO: 233524 - DNA, 25 bp, Mus musculus
catcggccaggtttggccgtcgtgg

SEQ ID NO: 233525 - DNA, 25 bp, Mus musculus
catcggccagtgggatctggtgtgt

SEQ ID NO: 233526 - DNA, 25 bp, Mus musculus
catcggcgggctcctggccttgtgc

SEQ ID NO: 233527 - DNA, 25 bp, Mus musculus
catcggcggggaagtttggtgagcg

SEQ ID NO: 233528 - DNA, 25 bp, Mus musculus
catcggctcagggtcttggaggagg

SEQ ID NO: 233529 - DNA, 25 bp, Mus musculus
catcggcttcagatatttatcaaca

SEQ ID NO: 233530 - DNA, 25 bp, Mus musculus
catcggcttggtttggttccagtgt

SEQ ID NO: 233531 - DNA, 25 bp, Mus musculus
catcggctttgcaaaagtacgatca

SEQ ID NO: 233532 - DNA, 25 bp, Mus musculus
catcggctttgcaaagtgattcgta

SEQ ID NO: 233533 - DNA, 25 bp, Mus musculus
catcggctttgcaaatgctcagcag

SEQ ID NO: 233534 - DNA, 25 bp, Mus musculus
catcgggaaacgtctctggagctgg

SEQ ID NO: 233535 - DNA, 25 bp, Mus musculus
catcgggaagctgaggaaaccaatg

SEQ ID NO: 233536 - DNA, 25 bp, Mus musculus
catcgggaagctgaggtctaatctc

SEQ ID NO: 233537 - DNA, 25 bp, Mus musculus
catcgggaagttctgattcaaagga

SEQ ID NO: 233538 - DNA, 25 bp, Mus musculus
catcgggacagcataagcagtacgc

SEQ ID NO: 233539 - DNA, 25 bp, Mus musculus
catcgggacctaaagcctgagaatt

SEQ ID NO: 233540 - DNA, 25 bp, Mus musculus
catcgggatggcagcataggtggca

SEQ ID NO: 233541 - DNA, 25 bp, Mus musculus
catcgggatggcaggatccaagtga

SEQ ID NO: 233542 - DNA, 25 bp, Mus musculus
catcgggctgcagatgggcaccaac

SEQ ID NO: 233543 - DNA, 25 bp, Mus musculus
catcggggacaagggtgacaaggga

SEQ ID NO: 233544 - DNA, 25 bp, Mus musculus
catcggggcagaagagattgtggat

SEQ ID NO: 233545 - DNA, 25 bp, Mus musculus
catcggggcgcgcggtgtgaagaaa

SEQ ID NO: 233546 - DNA, 25 bp, Mus musculus
catcgggtcgtaggtctcaaaagat

SEQ ID NO: 233547 - DNA, 25 bp, Mus musculus
catcgggtgacagggccctggatgt

SEQ ID NO: 233548 - DNA, 25 bp, Mus musculus
catcggtacaggacagctttgcaaa

SEQ ID NO: 233549 - DNA, 25 bp, Mus musculus
catcggtacagggactgagactatg

SEQ ID NO: 233550 - DNA, 25 bp, Mus musculus
catcggtacagtggcaggacagctt

SEQ ID NO: 233551 - DNA, 25 bp, Mus musculus
catcggtgcccctgaccccatgact

SEQ ID NO: 233552 - DNA, 25 bp, Mus musculus
catcggtggcggaagctggaatgcc

SEQ ID NO: 233553 - DNA, 25 bp, Mus musculus
catcggttcgatttggggatattcc

SEQ ID NO: 233554 - DNA, 25 bp, Mus musculus
catcggttcggcgtaatagcttgga

SEQ ID NO: 233555 - DNA, 25 bp, Mus musculus
catcggttctggcgctccggcactc

SEQ ID NO: 233556 - DNA, 25 bp, Mus musculus
catcggttctggcgggattcctctg

SEQ ID NO: 233557 - DNA, 25 bp, Mus musculus
catcgtcaagagccgcctgcaccag

SEQ ID NO: 233558 - DNA, 25 bp, Mus musculus
catcgtcacatgatcatggatatac

SEQ ID NO: 233559 - DNA, 25 bp, Mus musculus
catcgtcacggattccacactacgc

SEQ ID NO: 233560 - DNA, 25 bp, Mus musculus
catcgtcagacagcacatcgtcagc

SEQ ID NO: 233561 - DNA, 25 bp, Mus musculus
catcgtcagacagctacagcacatc

SEQ ID NO: 233562 - DNA, 25 bp, Mus musculus
catcgtcagcaagctgtgggccaca

SEQ ID NO: 233563 - DNA, 25 bp, Mus musculus
catcgtcatacgtccctggaggctg

SEQ ID NO: 233564 - DNA, 25 bp, Mus musculus
catcgtcccagcggctgaccaaggc

SEQ ID NO: 233565 - DNA, 25 bp, Mus musculus
catcgtccgccagactcagtccgct

SEQ ID NO: 233566 - DNA, 25 bp, Mus musculus
catcgtccgccagagtacagttgac

SEQ ID NO: 233567 - DNA, 25 bp, Mus musculus
catcgtcgcagaaagtaagccccaa

SEQ ID NO: 233568 - DNA, 25 bp, Mus musculus
catcgtcgcagacagctgagtagat

SEQ ID NO: 233569 - DNA, 25 bp, Mus musculus
catcgtcgcctgcaggatactttgg

SEQ ID NO: 233570 - DNA, 25 bp, Mus musculus
catcgtcgcctgcaggtgattttcg

SEQ ID NO: 233571 - DNA, 25 bp, Mus musculus
catcgtcgcctgcaggtgtctaagc

SEQ ID NO: 233572 - DNA, 25 bp, Mus musculus
catcgtcgggagcattactgtatgg

SEQ ID NO: 233573 - DNA, 25 bp, Mus musculus
catcgtcggggccagtgactatcat

SEQ ID NO: 233574 - DNA, 25 bp, Mus musculus
catcgtctctgagccacctgcgcaa

SEQ ID NO: 233575 - DNA, 25 bp, Mus musculus
catcgtctctttcaaattaattgtg

SEQ ID NO: 233576 - DNA, 25 bp, Mus musculus
catcgtgaagagcctccccaggtgt

SEQ ID NO: 233577 - DNA, 25 bp, Mus musculus
catcgtgacagagatggtcaagaga

SEQ ID NO: 233578 - DNA, 25 bp, Mus musculus
catcgtgacagaggaacagaaattc

SEQ ID NO: 233579 - DNA, 25 bp, Mus musculus
catcgtgacagaggcgttctctgcg

SEQ ID NO: 233580 - DNA, 25 bp, Mus musculus
catcgtgacagagtggaatctggtg

SEQ ID NO: 233581 - DNA, 25 bp, Mus musculus
catcgtgacagagtgggacctggtg

SEQ ID NO: 233582 - DNA, 25 bp, Mus musculus
catcgtgactgagtggaaccttgtg

SEQ ID NO: 233583 - DNA, 25 bp, Mus musculus
catcgtgatcggcaagaagccagtt

SEQ ID NO: 233584 - DNA, 25 bp, Mus musculus
catcgtgatcggtgagaaggaccga

SEQ ID NO: 233585 - DNA, 25 bp, Mus musculus
catcgtgcaccgcctgacccccagc

SEQ ID NO: 233586 - DNA, 25 bp, Mus musculus
catcgtgcaccgggatttaaagttg

SEQ ID NO: 233587 - DNA, 25 bp, Mus musculus
catcgtgcactagcgggacttggtg

SEQ ID NO: 233588 - DNA, 25 bp, Mus musculus
catcgtgcactagcggtctcaaaag

SEQ ID NO: 233589 - DNA, 25 bp, Mus musculus
catcgtgctccagtgtggcgctgac

SEQ ID NO: 233590 - DNA, 25 bp, Mus musculus
catcgtggaagccttgccatgcagt

SEQ ID NO: 233591 - DNA, 25 bp, Mus musculus
catcgtggaagtggaaaacccaggt

SEQ ID NO: 233592 - DNA, 25 bp, Mus musculus
catcgtggacctccactccaggcag

SEQ ID NO: 233593 - DNA, 25 bp, Mus musculus
catcgtggagcacatatcgacttgg

SEQ ID NO: 233594 - DNA, 25 bp, Mus musculus
catcgtgggagggaatagccagagc

SEQ ID NO: 233595 - DNA, 25 bp, Mus musculus
catcgtggtggacagtgaacttttg

SEQ ID NO: 233596 - DNA, 25 bp, Mus musculus
catcgtggtgtatgttgtatgggca

SEQ ID NO: 233597 - DNA, 25 bp, Mus musculus
catcgtgtctagaccttaaactaca

SEQ ID NO: 233598 - DNA, 25 bp, Mus musculus
catcgtgtctagagccttgcacatt

SEQ ID NO: 233599 - DNA, 25 bp, Mus musculus
catcgtgtctatcggccgctcaccc

SEQ ID NO: 233600 - DNA, 25 bp, Mus musculus
catcgttaaggtcttccatggtgcc

SEQ ID NO: 233601 - DNA, 25 bp, Mus musculus
catcgttagaagcaaaatctacatc

SEQ ID NO: 233602 - DNA, 25 bp, Mus musculus
catcgttagaagctgaaggaagagg

SEQ ID NO: 233603 - DNA, 25 bp, Mus musculus
catcgttcttgctggtgcactgcct

SEQ ID NO: 233604 - DNA, 25 bp, Mus musculus
catcgttgccaagagagtacacggt

SEQ ID NO: 233605 - DNA, 25 bp, Mus musculus
catcgttgccaagaggaaaatagct

SEQ ID NO: 233606 - DNA, 25 bp, Mus musculus
catcgtttatagagacttaaaacct

SEQ ID NO: 233607 - DNA, 25 bp, Mus musculus
catcgtttctattgaaatctcacag

SEQ ID NO: 233608 - DNA, 25 bp, Mus musculus
catcgtttctattgaatacaggcta

SEQ ID NO: 233609 - DNA, 25 bp, Mus musculus
catctaacatatttgaggcggaggc

SEQ ID NO: 233610 - DNA, 25 bp, Mus musculus
catctaagcagccttcctgcagcag

SEQ ID NO: 233611 - DNA, 25 bp, Mus musculus
catctaagcaggtggcccgacggga

SEQ ID NO: 233612 - DNA, 25 bp, Mus musculus
catctaatatgaaggaagtacttaa

SEQ ID NO: 233613 - DNA, 25 bp, Mus musculus
catctaatccaggatgctgggcagt

SEQ ID NO: 233614 - DNA, 25 bp, Mus musculus
catctaattcagatcatgattctgg

SEQ ID NO: 233615 - DNA, 25 bp, Mus musculus
catctacaaggctcacttgtatagt

SEQ ID NO: 233616 - DNA, 25 bp, Mus musculus
catctacaagggcgccaaagcatgc

SEQ ID NO: 233617 - DNA, 25 bp, Mus musculus
catctacacaatttgggagtgagct

SEQ ID NO: 233618 - DNA, 25 bp, Mus musculus
catctacacagaaccagagcatgac

SEQ ID NO: 233619 - DNA, 25 bp, Mus musculus
catctacacccaggtgattcgagtc

SEQ ID NO: 233620 - DNA, 25 bp, Mus musculus
catctacactggaattacactatca

SEQ ID NO: 233621 - DNA, 25 bp, Mus musculus
catctaccaaaacaaccctggccta

SEQ ID NO: 233622 - DNA, 25 bp, Mus musculus
catctaccactacacccagctgccc

SEQ ID NO: 233623 - DNA, 25 bp, Mus musculus
catctaccaggaaataatccttgct

SEQ ID NO: 233624 - DNA, 25 bp, Mus musculus
catctaccctgaggagaatgaagtc

SEQ ID NO: 233625 - DNA, 25 bp, Mus musculus
catctacctaccagccctgggtcct

SEQ ID NO: 233626 - DNA, 25 bp, Mus musculus
catctacctaccaggatggtccacc

SEQ ID NO: 233627 - DNA, 25 bp, Mus musculus
catctacgacaggctcatcagcggc

SEQ ID NO: 233628 - DNA, 25 bp, Mus musculus
catctacgagcagggcacaactgtg

SEQ ID NO: 233629 - DNA, 25 bp, Mus musculus
catctacgaggtagatgcacgggaa

SEQ ID NO: 233630 - DNA, 25 bp, Mus musculus
catctacgaggttcccaaagaggta

SEQ ID NO: 233631 - DNA, 25 bp, Mus musculus
catctactatatctctgctcatgtc

SEQ ID NO: 233632 - DNA, 25 bp, Mus musculus
catctactcttggttcttcattgag

SEQ ID NO: 233633 - DNA, 25 bp, Mus musculus
catctacttaaacgctttatcttct

SEQ ID NO: 233634 - DNA, 25 bp, Mus musculus
catctacttaaaggctttatcttct

SEQ ID NO: 233635 - DNA, 25 bp, Mus musculus
catctactttaaaggcaaatggaag

SEQ ID NO: 233636 - DNA, 25 bp, Mus musculus
catctactttgactgcagcagaagt

SEQ ID NO: 233637 - DNA, 25 bp, Mus musculus
catctactttgctcagcagatatct

SEQ ID NO: 233638 - DNA, 25 bp, Mus musculus
catctagacagttcgaacctcagat

SEQ ID NO: 233639 - DNA, 25 bp, Mus musculus
catctagagacacggaagcctgtgc

SEQ ID NO: 233640 - DNA, 25 bp, Mus musculus
catctagcaagcagctatggccggt

SEQ ID NO: 233641 - DNA, 25 bp, Mus musculus
catctagcaagcaggcatgacttgc

SEQ ID NO: 233642 - DNA, 25 bp, Mus musculus
catctagcattacaaggaggtgccc

SEQ ID NO: 233643 - DNA, 25 bp, Mus musculus
catctagctaatggggtagctggga

SEQ ID NO: 233644 - DNA, 25 bp, Mus musculus
catctaggaggctttgatgaggcct

SEQ ID NO: 233645 - DNA, 25 bp, Mus musculus
catctaggctaaaggacacagctgc

SEQ ID NO: 233646 - DNA, 25 bp, Mus musculus
catctagtaatgacaagccctcatc

SEQ ID NO: 233647 - DNA, 25 bp, Mus musculus
catctagtgaatagtggaggagtgt

SEQ ID NO: 233648 - DNA, 25 bp, Mus musculus
catctagtgcaggtgagtgcaggat

SEQ ID NO: 233649 - DNA, 25 bp, Mus musculus
catctagtttgactaccaaaggagc

SEQ ID NO: 233650 - DNA, 25 bp, Mus musculus
catctataacccgataatcccctat

SEQ ID NO: 233651 - DNA, 25 bp, Mus musculus
catctataacccgattccaggttga

SEQ ID NO: 233652 - DNA, 25 bp, Mus musculus
catctataacttcaaaaagcagcct

SEQ ID NO: 233653 - DNA, 25 bp, Mus musculus
catctataacttcaatgtctttaac

SEQ ID NO: 233654 - DNA, 25 bp, Mus musculus
catctataagcagcctgctgtggag

SEQ ID NO: 233655 - DNA, 25 bp, Mus musculus
catctataagcagtgtgctgtgaga

SEQ ID NO: 233656 - DNA, 25 bp, Mus musculus
catctatacaggtgacctcttggtt

SEQ ID NO: 233657 - DNA, 25 bp, Mus musculus
catctatagcctggctcggttctct

SEQ ID NO: 233658 - DNA, 25 bp, Mus musculus
catctatattggaaggtcctcagaa

SEQ ID NO: 233659 - DNA, 25 bp, Mus musculus
catctatcaagggagcaccatcatg

SEQ ID NO: 233660 - DNA, 25 bp, Mus musculus
catctatcaatcaatctatctacct

SEQ ID NO: 233661 - DNA, 25 bp, Mus musculus
catctatcacaaaagctgcatagac

SEQ ID NO: 233662 - DNA, 25 bp, Mus musculus
catctatcagccatggcgagtgccc

SEQ ID NO: 233663 - DNA, 25 bp, Mus musculus
catctatcgagtacgaagtgggcta

SEQ ID NO: 233664 - DNA, 25 bp, Mus musculus
catctatctcggtacggacattgct

SEQ ID NO: 233665 - DNA, 25 bp, Mus musculus
catctatctcgtttttcaaaacata

SEQ ID NO: 233666 - DNA, 25 bp, Mus musculus
catctatctgaaggccctgtccacg

SEQ ID NO: 233667 - DNA, 25 bp, Mus musculus
catctatgagagaatatcaaagaat

SEQ ID NO: 233668 - DNA, 25 bp, Mus musculus
catctatgaggaccggcacgatggc

SEQ ID NO: 233669 - DNA, 25 bp, Mus musculus
catctatgaggagaaccatggctcc

SEQ ID NO: 233670 - DNA, 25 bp, Mus musculus
catctatgagggctacgagggcctt

SEQ ID NO: 233671 - DNA, 25 bp, Mus musculus
catctatgcagtgaatgggattgcc

SEQ ID NO: 233672 - DNA, 25 bp, Mus musculus
catctatgctaccctaggaaggagt

SEQ ID NO: 233673 - DNA, 25 bp, Mus musculus
catctatgtgattggttaccaggag

SEQ ID NO: 233674 - DNA, 25 bp, Mus musculus
catctatgtgccagctgcaacggaa

SEQ ID NO: 233675 - DNA, 25 bp, Mus musculus
catctatgtgccaggctgcccgccc

SEQ ID NO: 233676 - DNA, 25 bp, Mus musculus
catctattagggcttatttcaaaac

SEQ ID NO: 233677 - DNA, 25 bp, Mus musculus
catctattatgtagatgtgcagaaa

SEQ ID NO: 233678 - DNA, 25 bp, Mus musculus
catctattcctgaataaacactgaa

SEQ ID NO: 233679 - DNA, 25 bp, Mus musculus
catctattgattagtacaaacaggc

SEQ ID NO: 233680 - DNA, 25 bp, Mus musculus
catctattttcaggatgtcagtggg

SEQ ID NO: 233681 - DNA, 25 bp, Mus musculus
catctattttcaggggtttcgtgtt

SEQ ID NO: 233682 - DNA, 25 bp, Mus musculus
catctcaaaacctgacaagacattt

SEQ ID NO: 233683 - DNA, 25 bp, Mus musculus
catctcaaaccaacagtatcacatc

SEQ ID NO: 233684 - DNA, 25 bp, Mus musculus
catctcaaaccaacagttccctgcc

SEQ ID NO: 233685 - DNA, 25 bp, Mus musculus
catctcaaaccaacattcagcagga

SEQ ID NO: 233686 - DNA, 25 bp, Mus musculus
catctcaaccaggatgcgtacactg

SEQ ID NO: 233687 - DNA, 25 bp, Mus musculus
catctcaacttgaggccatccgctg

SEQ ID NO: 233688 - DNA, 25 bp, Mus musculus
catctcaacttgagtcagaagaggc

SEQ ID NO: 233689 - DNA, 25 bp, Mus musculus
catctcaagcaaaacgaagagatgg

SEQ ID NO: 233690 - DNA, 25 bp, Mus musculus
catctcaagcccaagcagtagctgg

SEQ ID NO: 233691 - DNA, 25 bp, Mus musculus
catctcacaaaaaacatcggaccag

SEQ ID NO: 233692 - DNA, 25 bp, Mus musculus
catctcacaagttagccctagaacc

SEQ ID NO: 233693 - DNA, 25 bp, Mus musculus
catctcacaattttacgcagataga

SEQ ID NO: 233694 - DNA, 25 bp, Mus musculus
catctcacaattttctggactgaag

SEQ ID NO: 233695 - DNA, 25 bp, Mus musculus
catctcacagactgtggatattcat

SEQ ID NO: 233696 - DNA, 25 bp, Mus musculus
catctcacaggttcaaaagaggaat

SEQ ID NO: 233697 - DNA, 25 bp, Mus musculus
catctcacagtctgttgcagggaat

SEQ ID NO: 233698 - DNA, 25 bp, Mus musculus
catctcacagtggagatgaatctgg

SEQ ID NO: 233699 - DNA, 25 bp, Mus musculus
catctcaccaaggattacacagtgc

SEQ ID NO: 233700 - DNA, 25 bp, Mus musculus
catctcactgcaatgcctgtcaccc

SEQ ID NO: 233701 - DNA, 25 bp, Mus musculus
catctcactgcagacactccactct

SEQ ID NO: 233702 - DNA, 25 bp, Mus musculus
catctcactggtggagctggcaaca

SEQ ID NO: 233703 - DNA, 25 bp, Mus musculus
catctcagagatgggctttgctgga

SEQ ID NO: 233704 - DNA, 25 bp, Mus musculus
catctcagaggctggtgtttgcttt

SEQ ID NO: 233705 - DNA, 25 bp, Mus musculus
catctcagcaagatggagcgggtag

SEQ ID NO: 233706 - DNA, 25 bp, Mus musculus
catctcagcaaggtgatctggggaa

SEQ ID NO: 233707 - DNA, 25 bp, Mus musculus
catctcagctgcctttggcaacctc

SEQ ID NO: 233708 - DNA, 25 bp, Mus musculus
catctcaggcttcaggaagtgtgcc

SEQ ID NO: 233709 - DNA, 25 bp, Mus musculus
catctcagtgaaaggtaaaccagat

SEQ ID NO: 233710 - DNA, 25 bp, Mus musculus
catctcataaataaggtgcgagaag

SEQ ID NO: 233711 - DNA, 25 bp, Mus musculus
catctcataaataaggttgtgcatt

SEQ ID NO: 233712 - DNA, 25 bp, Mus musculus
catctcattcagaacccattccaag

SEQ ID NO: 233713 - DNA, 25 bp, Mus musculus
catctcattgctaagaatgtggctg

SEQ ID NO: 233714 - DNA, 25 bp, Mus musculus
catctccaagagtgaatgtgggctg

SEQ ID NO: 233715 - DNA, 25 bp, Mus musculus
catctccaagatgcacatgatcctg

SEQ ID NO: 233716 - DNA, 25 bp, Mus musculus
catctccaagcaggggtattttgcc

SEQ ID NO: 233717 - DNA, 25 bp, Mus musculus
catctccaagcagtatgtctggatt

SEQ ID NO: 233718 - DNA, 25 bp, Mus musculus
catctccaaggttggtgacacatcc

SEQ ID NO: 233719 - DNA, 25 bp, Mus musculus
catctccaagtccttccagggcagt

SEQ ID NO: 233720 - DNA, 25 bp, Mus musculus
catctccacagctgcggtgctctta

SEQ ID NO: 233721 - DNA, 25 bp, Mus musculus
catctccagacagataccagaagct

SEQ ID NO: 233722 - DNA, 25 bp, Mus musculus
catctccagcccaggtgaacaccat

SEQ ID NO: 233723 - DNA, 25 bp, Mus musculus
catctccattccaacctggtcttga

SEQ ID NO: 233724 - DNA, 25 bp, Mus musculus
catctcccaccagaggctgatcccc

SEQ ID NO: 233725 - DNA, 25 bp, Mus musculus
catctcccagactgataatggtctt

SEQ ID NO: 233726 - DNA, 25 bp, Mus musculus
catctcccagggactgcgcagctgc

SEQ ID NO: 233727 - DNA, 25 bp, Mus musculus
catctccctggaaggggagccccgc

SEQ ID NO: 233728 - DNA, 25 bp, Mus musculus
catctccgagctgatccacaccgac

SEQ ID NO: 233729 - DNA, 25 bp, Mus musculus
catctcctaacagatgaacagtgtt

SEQ ID NO: 233730 - DNA, 25 bp, Mus musculus
catctcctaacagctatgaaaggac

SEQ ID NO: 233731 - DNA, 25 bp, Mus musculus
catctcctcagaggcagcatcctgt

SEQ ID NO: 233732 - DNA, 25 bp, Mus musculus
catctcctccccagatcagcaccga

SEQ ID NO: 233733 - DNA, 25 bp, Mus musculus
catctcctgccaggaatgaagaaag

SEQ ID NO: 233734 - DNA, 25 bp, Mus musculus
catctcctggagctcagcttttcca

SEQ ID NO: 233735 - DNA, 25 bp, Mus musculus
catctccttccacagacttcccaag

SEQ ID NO: 233736 - DNA, 25 bp, Mus musculus
catctccttccacagctgctccgaa

SEQ ID NO: 233737 - DNA, 25 bp, Mus musculus
catctcgacagcgcggagacgcgtg

SEQ ID NO: 233738 - DNA, 25 bp, Mus musculus
catctctaagatgtaaagaaggaaa

SEQ ID NO: 233739 - DNA, 25 bp, Mus musculus
catctctacagattcctgcggaaca

SEQ ID NO: 233740 - DNA, 25 bp, Mus musculus
catctctcaggctctctaactgatg

SEQ ID NO: 233741 - DNA, 25 bp, Mus musculus
catctctcatcagcatccgccacca

SEQ ID NO: 233742 - DNA, 25 bp, Mus musculus
catctctcattactcgggtttcata

SEQ ID NO: 233743 - DNA, 25 bp, Mus musculus
catctctcggattgggctatcccat

SEQ ID NO: 233744 - DNA, 25 bp, Mus musculus
catctctgaaagttctcctgtctat

SEQ ID NO: 233745 - DNA, 25 bp, Mus musculus
catctctgagaacagaggcgtgaga

SEQ ID NO: 233746 - DNA, 25 bp, Mus musculus
catctctgagctcatgacccatatg

SEQ ID NO: 233747 - DNA, 25 bp, Mus musculus
catctctgaggtccgatctgaccgg

SEQ ID NO: 233748 - DNA, 25 bp, Mus musculus
catctctggcgttattgctgtctcc

SEQ ID NO: 233749 - DNA, 25 bp, Mus musculus
catctctgggattaacctggatcct

SEQ ID NO: 233750 - DNA, 25 bp, Mus musculus
catctctggtaacagaagaaaagat

SEQ ID NO: 233751 - DNA, 25 bp, Mus musculus
catctctgtatgtgactgtcctaga

SEQ ID NO: 233752 - DNA, 25 bp, Mus musculus
catctctgtgagagggtatgtctcc

SEQ ID NO: 233753 - DNA, 25 bp, Mus musculus
catctctgtggaagagacctctgct

SEQ ID NO: 233754 - DNA, 25 bp, Mus musculus
catctcttcccccagatgcctgtcg

SEQ ID NO: 233755 - DNA, 25 bp, Mus musculus
catctcttgtggatggcttcaagcc

SEQ ID NO: 233756 - DNA, 25 bp, Mus musculus
catctcttttaggatggacgacaga

SEQ ID NO: 233757 - DNA, 25 bp, Mus musculus
catctgaaacatggtggtaagagaa

SEQ ID NO: 233758 - DNA, 25 bp, Mus musculus
catctgaaaccagagtccagcttgg

SEQ ID NO: 233759 - DNA, 25 bp, Mus musculus
catctgaaaccaggagattggccgg

SEQ ID NO: 233760 - DNA, 25 bp, Mus musculus
catctgaaactgaactcggagagta

SEQ ID NO: 233761 - DNA, 25 bp, Mus musculus
catctgaaacttttgttttcctgaa

SEQ ID NO: 233762 - DNA, 25 bp, Mus musculus
catctgaaagctgggttgcaggcct

SEQ ID NO: 233763 - DNA, 25 bp, Mus musculus
catctgaagaaatcaaaggctcttg

SEQ ID NO: 233764 - DNA, 25 bp, Mus musculus
catctgaaggagatggcaattccgg

SEQ ID NO: 233765 - DNA, 25 bp, Mus musculus
catctgacaaaagaaagaatatgta

SEQ ID NO: 233766 - DNA, 25 bp, Mus musculus
catctgacaacagccaagagaaaca

SEQ ID NO: 233767 - DNA, 25 bp, Mus musculus
catctgacaacaggtcaccttcgtc

SEQ ID NO: 233768 - DNA, 25 bp, Mus musculus
catctgaccatacaggctgggccgg

SEQ ID NO: 233769 - DNA, 25 bp, Mus musculus
catctgacccaggtgtccccatgac

SEQ ID NO: 233770 - DNA, 25 bp, Mus musculus
catctgaccccagtacatggagaac

SEQ ID NO: 233771 - DNA, 25 bp, Mus musculus
catctgactcaagggaagtaagcaa

SEQ ID NO: 233772 - DNA, 25 bp, Mus musculus
catctgagaacggtgatgctagcga

SEQ ID NO: 233773 - DNA, 25 bp, Mus musculus
catctgagagcaaccaggacctgaa

SEQ ID NO: 233774 - DNA, 25 bp, Mus musculus
catctgagaggtggactctgtgcct

SEQ ID NO: 233775 - DNA, 25 bp, Mus musculus
catctgagccttctaggaaagatgt

SEQ ID NO: 233776 - DNA, 25 bp, Mus musculus
catctgagtgatataaaaacaactg

SEQ ID NO: 233777 - DNA, 25 bp, Mus musculus
catctgatctgagaggcctctcctg

SEQ ID NO: 233778 - DNA, 25 bp, Mus musculus
catctgatgatggtcgggtgagagc

SEQ ID NO: 233779 - DNA, 25 bp, Mus musculus
catctgattccagctgaccagggtg

SEQ ID NO: 233780 - DNA, 25 bp, Mus musculus
catctgcaaacagaagcgatgtcct

SEQ ID NO: 233781 - DNA, 25 bp, Mus musculus
catctgcaaagaaatcctacgaaca

SEQ ID NO: 233782 - DNA, 25 bp, Mus musculus
catctgcaaggaaggttggcagcgt

SEQ ID NO: 233783 - DNA, 25 bp, Mus musculus
catctgcaaggatgctacggaagag

SEQ ID NO: 233784 - DNA, 25 bp, Mus musculus
catctgcaaggatggagaatacatt

SEQ ID NO: 233785 - DNA, 25 bp, Mus musculus
catctgcagaaaaatatcgtttgcc

SEQ ID NO: 233786 - DNA, 25 bp, Mus musculus
catctgcagaaagtggaagaaaatg

SEQ ID NO: 233787 - DNA, 25 bp, Mus musculus
catctgcaggagcaggccaacgagg

SEQ ID NO: 233788 - DNA, 25 bp, Mus musculus
catctgcatcagactccgtgcttct

SEQ ID NO: 233789 - DNA, 25 bp, Mus musculus
catctgcatggactcttactcgatg

SEQ ID NO: 233790 - DNA, 25 bp, Mus musculus
catctgccaacagacccagtgttga

SEQ ID NO: 233791 - DNA, 25 bp, Mus musculus
catctgccaacaggaatgggtagga

SEQ ID NO: 233792 - DNA, 25 bp, Mus musculus
catctgccacgagagagctgcaaga

SEQ ID NO: 233793 - DNA, 25 bp, Mus musculus
catctgccagaaagtgacagcatcc

SEQ ID NO: 233794 - DNA, 25 bp, Mus musculus
catctgccagtgtcctggcataacc

SEQ ID NO: 233795 - DNA, 25 bp, Mus musculus
catctgcccctcgcgagagctggct

SEQ ID NO: 233796 - DNA, 25 bp, Mus musculus
catctgccgagaggggtcccacaga

SEQ ID NO: 233797 - DNA, 25 bp, Mus musculus
catctgccggctgccgttccgagcc

SEQ ID NO: 233798 - DNA, 25 bp, Mus musculus
catctgcctcaagaaatttgtcaag

SEQ ID NO: 233799 - DNA, 25 bp, Mus musculus
catctgcctcaggtcttcggatcag

SEQ ID NO: 233800 - DNA, 25 bp, Mus musculus
catctgcctcattgtacaagtctcc

SEQ ID NO: 233801 - DNA, 25 bp, Mus musculus
catctgcctgcaccgtactagctgt

SEQ ID NO: 233802 - DNA, 25 bp, Mus musculus
catctgcctgctgggctcagtggcc

SEQ ID NO: 233803 - DNA, 25 bp, Mus musculus
catctgcgcgggagagtcctttcaa

SEQ ID NO: 233804 - DNA, 25 bp, Mus musculus
catctgcggaagggaaacaacctga

SEQ ID NO: 233805 - DNA, 25 bp, Mus musculus
catctgcgtgtgagcgtggcacaag

SEQ ID NO: 233806 - DNA, 25 bp, Mus musculus
catctgctaccacagccgctagtca

SEQ ID NO: 233807 - DNA, 25 bp, Mus musculus
catctgctaccacaggagccgaaag

SEQ ID NO: 233808 - DNA, 25 bp, Mus musculus
catctgctagagaagggcaagtctg

SEQ ID NO: 233809 - DNA, 25 bp, Mus musculus
catctgctagagactggctctccaa

SEQ ID NO: 233810 - DNA, 25 bp, Mus musculus
catctgctagagctctggtgttcta

SEQ ID NO: 233811 - DNA, 25 bp, Mus musculus
catctgctagaggttcacaacaaag

SEQ ID NO: 233812 - DNA, 25 bp, Mus musculus
catctgctagagtaggtgcttcccg

SEQ ID NO: 233813 - DNA, 25 bp, Mus musculus
catctgctcagatggtttagacacg

SEQ ID NO: 233814 - DNA, 25 bp, Mus musculus
catctgctgggaccagagtgagggc

SEQ ID NO: 233815 - DNA, 25 bp, Mus musculus
catctgcttataagactgaagaggg

SEQ ID NO: 233816 - DNA, 25 bp, Mus musculus
catctgcttataaggacccatagat

SEQ ID NO: 233817 - DNA, 25 bp, Mus musculus
catctggaaagacaggagcttatca

SEQ ID NO: 233818 - DNA, 25 bp, Mus musculus
catctggaaaggtttccaaaatgcc

SEQ ID NO: 233819 - DNA, 25 bp, Mus musculus
catctggaaggtatctcagacgagg

SEQ ID NO: 233820 - DNA, 25 bp, Mus musculus
catctggaagtaacttgaatcccac

SEQ ID NO: 233821 - DNA, 25 bp, Mus musculus
catctggaagtgagagttcattgtt

SEQ ID NO: 233822 - DNA, 25 bp, Mus musculus
catctggagaccaggttctctgcca

SEQ ID NO: 233823 - DNA, 25 bp, Mus musculus
catctggagacctggtacggagcag

SEQ ID NO: 233824 - DNA, 25 bp, Mus musculus
catctggcaaagggtatacctggcc

SEQ ID NO: 233825 - DNA, 25 bp, Mus musculus
catctggcacagaagctgattggcg

SEQ ID NO: 233826 - DNA, 25 bp, Mus musculus
catctggccacaggggcattgttgt

SEQ ID NO: 233827 - DNA, 25 bp, Mus musculus
catctggccagaaccagacttggga

SEQ ID NO: 233828 - DNA, 25 bp, Mus musculus
catctggccaggatactcacaggct

SEQ ID NO: 233829 - DNA, 25 bp, Mus musculus
catctggctttcaagggaacaaaga

SEQ ID NO: 233830 - DNA, 25 bp, Mus musculus
catctggctttcaagttgtggagct

SEQ ID NO: 233831 - DNA, 25 bp, Mus musculus
catctgggaagaagccaccatgggg

SEQ ID NO: 233832 - DNA, 25 bp, Mus musculus
catctgggaccctggtacctcatca

SEQ ID NO: 233833 - DNA, 25 bp, Mus musculus
catctgggattcagtcattaggatt

SEQ ID NO: 233834 - DNA, 25 bp, Mus musculus
catctgggcatgtggccattatgtt

SEQ ID NO: 233835 - DNA, 25 bp, Mus musculus
catctgggcatgtggggtgatcctg

SEQ ID NO: 233836 - DNA, 25 bp, Mus musculus
catctggggtcctgctcctgcaaaa

SEQ ID NO: 233837 - DNA, 25 bp, Mus musculus
catctggtgtggcagtagaaacaga

SEQ ID NO: 233838 - DNA, 25 bp, Mus musculus
catctggtgtggcattttttggacc

SEQ ID NO: 233839 - DNA, 25 bp, Mus musculus
catctggttttaggtccagcgagca

SEQ ID NO: 233840 - DNA, 25 bp, Mus musculus
catctgtaacaacaggaggcccagc

SEQ ID NO: 233841 - DNA, 25 bp, Mus musculus
catctgtaacatcttctcacatcat

SEQ ID NO: 233842 - DNA, 25 bp, Mus musculus
catctgtaaccagaatggattgaat

SEQ ID NO: 233843 - DNA, 25 bp, Mus musculus
catctgtaagaaggtcccaggtaaa

SEQ ID NO: 233844 - DNA, 25 bp, Mus musculus
catctgtaatagcaggatgctggtc

SEQ ID NO: 233845 - DNA, 25 bp, Mus musculus
catctgtaataggtgtgtgctgaag

SEQ ID NO: 233846 - DNA, 25 bp, Mus musculus
catctgtaccagccgtgactgtccc

SEQ ID NO: 233847 - DNA, 25 bp, Mus musculus
catctgtaccaggtgcgcaaggacc

SEQ ID NO: 233848 - DNA, 25 bp, Mus musculus
catctgtactagggaatattggcag

SEQ ID NO: 233849 - DNA, 25 bp, Mus musculus
catctgtactgtgtacagtgcttct

SEQ ID NO: 233850 - DNA, 25 bp, Mus musculus
catctgtagggctgcctctctggat

SEQ ID NO: 233851 - DNA, 25 bp, Mus musculus
catctgtagggctgttgccaaggca

SEQ ID NO: 233852 - DNA, 25 bp, Mus musculus
catctgtatgagtggcctcgaactc

SEQ ID NO: 233853 - DNA, 25 bp, Mus musculus
catctgtccacatgcccctgtgatg

SEQ ID NO: 233854 - DNA, 25 bp, Mus musculus
catctgtccacatgcgtttgatatc

SEQ ID NO: 233855 - DNA, 25 bp, Mus musculus
catctgtcctgaggagtgtgcagcc

SEQ ID NO: 233856 - DNA, 25 bp, Mus musculus
catctgtctgcaaggatccagcaat

SEQ ID NO: 233857 - DNA, 25 bp, Mus musculus
catctgtgagatggcagcctacttc

SEQ ID NO: 233858 - DNA, 25 bp, Mus musculus
catctgtgcactgctgaagaaggac

SEQ ID NO: 233859 - DNA, 25 bp, Mus musculus
catctgtgcagggtgatagcacact

SEQ ID NO: 233860 - DNA, 25 bp, Mus musculus
catctgtgcaggtcctacggctctg

SEQ ID NO: 233861 - DNA, 25 bp, Mus musculus
catctgtgcctcgatggcactgcct

SEQ ID NO: 233862 - DNA, 25 bp, Mus musculus
catctgtgctggctgcaaccaagtg

SEQ ID NO: 233863 - DNA, 25 bp, Mus musculus
catctgtggataagctatatccacc

SEQ ID NO: 233864 - DNA, 25 bp, Mus musculus
catctgtgggagtatgtcatggcca

SEQ ID NO: 233865 - DNA, 25 bp, Mus musculus
catctgtggggaagctcctgactat

SEQ ID NO: 233866 - DNA, 25 bp, Mus musculus
catctgtggtggttctttcagctac

SEQ ID NO: 233867 - DNA, 25 bp, Mus musculus
catctgtgtgacaccaacgacctgc

SEQ ID NO: 233868 - DNA, 25 bp, Mus musculus
catctgtgtgacaccattcattgat

SEQ ID NO: 233869 - DNA, 25 bp, Mus musculus
catctgtgtgggaacgtgttccggt

SEQ ID NO: 233870 - DNA, 25 bp, Mus musculus
catctgttggcctggtacaggaccc

SEQ ID NO: 233871 - DNA, 25 bp, Mus musculus
catctgtttcaaatcccagaaaccg

SEQ ID NO: 233872 - DNA, 25 bp, Mus musculus
catctgtttcaagaagatctgcctc

SEQ ID NO: 233873 - DNA, 25 bp, Mus musculus
catctgttttttagcacaatggaag

SEQ ID NO: 233874 - DNA, 25 bp, Mus musculus
catcttaagaaagaggaagcagaaa

SEQ ID NO: 233875 - DNA, 25 bp, Mus musculus
catcttaagactggcctgctgcaaa

SEQ ID NO: 233876 - DNA, 25 bp, Mus musculus
catcttaattaagaacattacttca

SEQ ID NO: 233877 - DNA, 25 bp, Mus musculus
catcttacatgctctgaagatggct

SEQ ID NO: 233878 - DNA, 25 bp, Mus musculus
catcttaccgatcaagaagctactc

SEQ ID NO: 233879 - DNA, 25 bp, Mus musculus
catcttactgctttgactgtactcc

SEQ ID NO: 233880 - DNA, 25 bp, Mus musculus
catcttagaacatcctttactgtga

SEQ ID NO: 233881 - DNA, 25 bp, Mus musculus
catcttagttcgttgtgatgacgac

SEQ ID NO: 233882 - DNA, 25 bp, Mus musculus
catcttatcaggagcacggcatccc

SEQ ID NO: 233883 - DNA, 25 bp, Mus musculus
catcttatctctgtgtgtgccgaca

SEQ ID NO: 233884 - DNA, 25 bp, Mus musculus
catcttattccatagtagtgggcag

SEQ ID NO: 233885 - DNA, 25 bp, Mus musculus
catcttcaaaaactgcacctactat

SEQ ID NO: 233886 - DNA, 25 bp, Mus musculus
catcttcaaagggattaacatcctt

SEQ ID NO: 233887 - DNA, 25 bp, Mus musculus
catcttcaaccgcatctccctgact

SEQ ID NO: 233888 - DNA, 25 bp, Mus musculus
catcttcaaccggatctccctgact

SEQ ID NO: 233889 - DNA, 25 bp, Mus musculus
catcttcaactccgagctggaattc

SEQ ID NO: 233890 - DNA, 25 bp, Mus musculus
catcttcaagccttctgtggatgag

SEQ ID NO: 233891 - DNA, 25 bp, Mus musculus
catcttcaaggacctgccgctgccc

SEQ ID NO: 233892 - DNA, 25 bp, Mus musculus
catcttcaaggccacaggaccctcg

SEQ ID NO: 233893 - DNA, 25 bp, Mus musculus
catcttcaaggtgttcgacgccatc

SEQ ID NO: 233894 - DNA, 25 bp, Mus musculus
catcttcaatgtggctcactttagt

SEQ ID NO: 233895 - DNA, 25 bp, Mus musculus
catcttcaccactgaccggggggtg

SEQ ID NO: 233896 - DNA, 25 bp, Mus musculus
catcttcaccaggtccagctagctg

SEQ ID NO: 233897 - DNA, 25 bp, Mus musculus
catcttcaccagtctaaatccagtg

SEQ ID NO: 233898 - DNA, 25 bp, Mus musculus
catcttcaccatggaaaagaacaaa

SEQ ID NO: 233899 - DNA, 25 bp, Mus musculus
catcttcacgctaatgaaccggagg

SEQ ID NO: 233900 - DNA, 25 bp, Mus musculus
catcttcacgtctcgaaaaggtgct

SEQ ID NO: 233901 - DNA, 25 bp, Mus musculus
catcttcagcctggcagaaaacttc

SEQ ID NO: 233902 - DNA, 25 bp, Mus musculus
catcttcaggactcggaaggtgaac

SEQ ID NO: 233903 - DNA, 25 bp, Mus musculus
catcttcaggcgctttggccgtgag

SEQ ID NO: 233904 - DNA, 25 bp, Mus musculus
catcttcaggggtcagcaggaagaa

SEQ ID NO: 233905 - DNA, 25 bp, Mus musculus
catcttccagagaggaggctcacat

SEQ ID NO: 233906 - DNA, 25 bp, Mus musculus
catcttccaggagaaccacaatgtg

SEQ ID NO: 233907 - DNA, 25 bp, Mus musculus
catcttccagtcaaaagaatcctca

SEQ ID NO: 233908 - DNA, 25 bp, Mus musculus
catcttccccaggttctccaagcca

SEQ ID NO: 233909 - DNA, 25 bp, Mus musculus
catcttccctggcaccgggcactga

SEQ ID NO: 233910 - DNA, 25 bp, Mus musculus
catcttccgggagatccccactcct

SEQ ID NO: 233911 - DNA, 25 bp, Mus musculus
catcttcctgaggaatgtcacagcg

SEQ ID NO: 233912 - DNA, 25 bp, Mus musculus
catcttcctggacacatcttacctg

SEQ ID NO: 233913 - DNA, 25 bp, Mus musculus
catcttcctgtccaccctgttggca

SEQ ID NO: 233914 - DNA, 25 bp, Mus musculus
catcttcgccataggtagcattgcc

SEQ ID NO: 233915 - DNA, 25 bp, Mus musculus
catcttcgtctcctgccgtggatgc

SEQ ID NO: 233916 - DNA, 25 bp, Mus musculus
catcttctcccagatgaccaagatg

SEQ ID NO: 233917 - DNA, 25 bp, Mus musculus
catcttctctgcagaccggcccaac

SEQ ID NO: 233918 - DNA, 25 bp, Mus musculus
catcttctggggggcagctggcatc

SEQ ID NO: 233919 - DNA, 25 bp, Mus musculus
catcttctgggtattcggcaccaac

SEQ ID NO: 233920 - DNA, 25 bp, Mus musculus
catcttcttcctgacagctatcctc

SEQ ID NO: 233921 - DNA, 25 bp, Mus musculus
catcttgaaggtaagtgacctgcga

SEQ ID NO: 233922 - DNA, 25 bp, Mus musculus
catcttgacaagacagaggagggcg

SEQ ID NO: 233923 - DNA, 25 bp, Mus musculus
catcttgactcggaggaagacgatg

SEQ ID NO: 233924 - DNA, 25 bp, Mus musculus
catcttgactcggtggacaccatga

SEQ ID NO: 233925 - DNA, 25 bp, Mus musculus
catcttgatttggggttcccagcag

SEQ ID NO: 233926 - DNA, 25 bp, Mus musculus
catcttgcagaagaacatgtttggg

SEQ ID NO: 233927 - DNA, 25 bp, Mus musculus
catcttgcagaagagtcaggagctg

SEQ ID NO: 233928 - DNA, 25 bp, Mus musculus
catcttgcagaccatgctcaagctg

SEQ ID NO: 233929 - DNA, 25 bp, Mus musculus
catcttgcagaggaggatgactctg

SEQ ID NO: 233930 - DNA, 25 bp, Mus musculus
catcttgctcctgcactggtgcagg

SEQ ID NO: 233931 - DNA, 25 bp, Mus musculus
catcttgcttagcctcaaagagttg

SEQ ID NO: 233932 - DNA, 25 bp, Mus musculus
catcttggaacctaggtcctgtcat

SEQ ID NO: 233933 - DNA, 25 bp, Mus musculus
catcttggacttcagccctagtctg

SEQ ID NO: 233934 - DNA, 25 bp, Mus musculus
catcttggccaaatgtaccgtctaa

SEQ ID NO: 233935 - DNA, 25 bp, Mus musculus
catcttggccctggtggatcagaac

SEQ ID NO: 233936 - DNA, 25 bp, Mus musculus
catcttggctggtggctaccaagga

SEQ ID NO: 233937 - DNA, 25 bp, Mus musculus
catcttgggagaagtatgcttccac

SEQ ID NO: 233938 - DNA, 25 bp, Mus musculus
catcttgggagaagtttcttctagt

SEQ ID NO: 233939 - DNA, 25 bp, Mus musculus
catcttggtcaagaactgtactctt

SEQ ID NO: 233940 - DNA, 25 bp, Mus musculus
catcttggtcaaggtacaactgtaa

SEQ ID NO: 233941 - DNA, 25 bp, Mus musculus
catcttggtccaggatctttctcaa

SEQ ID NO: 233942 - DNA, 25 bp, Mus musculus
catcttggtccaggtcatcccagtg

SEQ ID NO: 233943 - DNA, 25 bp, Mus musculus
catcttggtgaataagtacaacaaa

SEQ ID NO: 233944 - DNA, 25 bp, Mus musculus
catcttgtactcagccagaagcacc

SEQ ID NO: 233945 - DNA, 25 bp, Mus musculus
catcttgtatgctagttcactttaa

SEQ ID NO: 233946 - DNA, 25 bp, Mus musculus
catcttgtggggatctacttcaccg

SEQ ID NO: 233947 - DNA, 25 bp, Mus musculus
catcttgtgggggtcttctgggtag

SEQ ID NO: 233948 - DNA, 25 bp, Mus musculus
catctttaaaagatgttcctcctgc

SEQ ID NO: 233949 - DNA, 25 bp, Mus musculus
catctttacatatctacgcctgcaa

SEQ ID NO: 233950 - DNA, 25 bp, Mus musculus
catctttacatctggctgagcatcc

SEQ ID NO: 233951 - DNA, 25 bp, Mus musculus
catctttagaagaagtgctctggat

SEQ ID NO: 233952 - DNA, 25 bp, Mus musculus
catctttagagcaggtttaaacgca

SEQ ID NO: 233953 - DNA, 25 bp, Mus musculus
catctttatcagcaatgctggtggt

SEQ ID NO: 233954 - DNA, 25 bp, Mus musculus
catctttatctcaaattctggaatt

SEQ ID NO: 233955 - DNA, 25 bp, Mus musculus
catctttatctcacacgccggtgga

SEQ ID NO: 233956 - DNA, 25 bp, Mus musculus
catctttattaagcatgtgaagtac

SEQ ID NO: 233957 - DNA, 25 bp, Mus musculus
catctttattaagtacaaatcgaag

SEQ ID NO: 233958 - DNA, 25 bp, Mus musculus
catctttcagatggtgatatacatg

SEQ ID NO: 233959 - DNA, 25 bp, Mus musculus
catctttcatgataaaggtgatcac

SEQ ID NO: 233960 - DNA, 25 bp, Mus musculus
catctttccctcagagccagcccag

SEQ ID NO: 233961 - DNA, 25 bp, Mus musculus
catctttccttcggacgctgaaccc

SEQ ID NO: 233962 - DNA, 25 bp, Mus musculus
catctttgaaatgcccatttgggga

SEQ ID NO: 233963 - DNA, 25 bp, Mus musculus
catctttgaaggtctgggacacctc

SEQ ID NO: 233964 - DNA, 25 bp, Mus musculus
catctttgatcgggtgctgacagag

SEQ ID NO: 233965 - DNA, 25 bp, Mus musculus
catctttgatcggtccctctccagg

SEQ ID NO: 233966 - DNA, 25 bp, Mus musculus
catctttgcccattgatttaggtcg

SEQ ID NO: 233967 - DNA, 25 bp, Mus musculus
catctttggaatgcacaagcccagg

SEQ ID NO: 233968 - DNA, 25 bp, Mus musculus
catctttgtgggcggggcctgccgg

SEQ ID NO: 233969 - DNA, 25 bp, Mus musculus
catcttttccaaacatcaacatggc

SEQ ID NO: 233970 - DNA, 25 bp, Mus musculus
catcttttccaggtgcagagtggtg

SEQ ID NO: 233971 - DNA, 25 bp, Mus musculus
catcttttctgcggttgatccaaaa

SEQ ID NO: 233972 - DNA, 25 bp, Mus musculus
catcttttggatcactggtgttatc

SEQ ID NO: 233973 - DNA, 25 bp, Mus musculus
catcttttttttattgagtctcatg

SEQ ID NO: 233974 - DNA, 25 bp, Mus musculus
catgaaaaaactaaggagttttgga

SEQ ID NO: 233975 - DNA, 25 bp, Mus musculus
catgaaaaaacttttgcactccttc

SEQ ID NO: 233976 - DNA, 25 bp, Mus musculus
catgaaaaaataggttttcctgcag

SEQ ID NO: 233977 - DNA, 25 bp, Mus musculus
catgaaaatctcaagacaaaaagat

SEQ ID NO: 233978 - DNA, 25 bp, Mus musculus
catgaaaatctcaaggtctatccta

SEQ ID NO: 233979 - DNA, 25 bp, Mus musculus
catgaaacccaattccaaatctatg

SEQ ID NO: 233980 - DNA, 25 bp, Mus musculus
catgaaacccagcagccatccttgc

SEQ ID NO: 233981 - DNA, 25 bp, Mus musculus
catgaaacccagcagtatgaatatt

SEQ ID NO: 233982 - DNA, 25 bp, Mus musculus
catgaaactcgactccagggaagtt

SEQ ID NO: 233983 - DNA, 25 bp, Mus musculus
catgaaactgcagatccaggtggat

SEQ ID NO: 233984 - DNA, 25 bp, Mus musculus
catgaaactgcagtgctggcagaag

SEQ ID NO: 233985 - DNA, 25 bp, Mus musculus
catgaaagagaaaggtgttgacctg

SEQ ID NO: 233986 - DNA, 25 bp, Mus musculus
catgaaagagacaggtgttgacctg

SEQ ID NO: 233987 - DNA, 25 bp, Mus musculus
catgaaagaggcgccagccacctgg

SEQ ID NO: 233988 - DNA, 25 bp, Mus musculus
catgaaagaggctaccttaagggcg

SEQ ID NO: 233989 - DNA, 25 bp, Mus musculus
catgaaaggcacatacttggtacat

SEQ ID NO: 233990 - DNA, 25 bp, Mus musculus
catgaaagtctgtctagagtttcaa

SEQ ID NO: 233991 - DNA, 25 bp, Mus musculus
catgaaagtgagatgagcatcagga

SEQ ID NO: 233992 - DNA, 25 bp, Mus musculus
catgaaatccttcctggaaggccgg

SEQ ID NO: 233993 - DNA, 25 bp, Mus musculus
catgaaatgagtttctctaatagca

SEQ ID NO: 233994 - DNA, 25 bp, Mus musculus
catgaaatgattgactctggtgtga

SEQ ID NO: 233995 - DNA, 25 bp, Mus musculus
catgaaattcaaggatccagtgaaa

SEQ ID NO: 233996 - DNA, 25 bp, Mus musculus
catgaacaacgcaggactaaattcg

SEQ ID NO: 233997 - DNA, 25 bp, Mus musculus
catgaacaagaagtcctaccctagg

SEQ ID NO: 233998 - DNA, 25 bp, Mus musculus
catgaacaagcgattatacacagag

SEQ ID NO: 233999 - DNA, 25 bp, Mus musculus
catgaacaagcgcttgtacacagaa

SEQ ID NO: 234000 - DNA, 25 bp, Mus musculus
catgaacacagctatcgcggtaaag

SEQ ID NO: 234001 - DNA, 25 bp, Mus musculus
catgaacacagctttttgccttcga

SEQ ID NO: 234002 - DNA, 25 bp, Mus musculus
catgaacacgctcagaaatgacctg

SEQ ID NO: 234003 - DNA, 25 bp, Mus musculus
catgaacagaagagagagggggaga

SEQ ID NO: 234004 - DNA, 25 bp, Mus musculus
catgaacagcaaaggtcaatatcca

SEQ ID NO: 234005 - DNA, 25 bp, Mus musculus
catgaacatccagtaataatatctt

SEQ ID NO: 234006 - DNA, 25 bp, Mus musculus
catgaaccaagatgaatgagcgcca

SEQ ID NO: 234007 - DNA, 25 bp, Mus musculus
catgaaccaagatgctgtgcagaat

SEQ ID NO: 234008 - DNA, 25 bp, Mus musculus
catgaaccgaggcatcaaggcctgc

SEQ ID NO: 234009 - DNA, 25 bp, Mus musculus
catgaaccgcacttgctagtgtgcc

SEQ ID NO: 234010 - DNA, 25 bp, Mus musculus
catgaacctcagcattgtgatgacc

SEQ ID NO: 234011 - DNA, 25 bp, Mus musculus
catgaacctgctcctggccgtggtg

SEQ ID NO: 234012 - DNA, 25 bp, Mus musculus
catgaacctggaaaacactggccaa

SEQ ID NO: 234013 - DNA, 25 bp, Mus musculus
catgaacgcaaagaggtaaatgatc

SEQ ID NO: 234014 - DNA, 25 bp, Mus musculus
catgaacgcaaagagtaacttgttt

SEQ ID NO: 234015 - DNA, 25 bp, Mus musculus
catgaacgcaaggactttgaatcca

SEQ ID NO: 234016 - DNA, 25 bp, Mus musculus
catgaacgcaatgtggaccatcttc

SEQ ID NO: 234017 - DNA, 25 bp, Mus musculus
catgaacgcccgggcctggaagcgc

SEQ ID NO: 234018 - DNA, 25 bp, Mus musculus
catgaacgggtgtgactctcttttg

SEQ ID NO: 234019 - DNA, 25 bp, Mus musculus
catgaactaccagtccggcttcagc

SEQ ID NO: 234020 - DNA, 25 bp, Mus musculus
catgaactagcctggcatcccagcc

SEQ ID NO: 234021 - DNA, 25 bp, Mus musculus
catgaactcagtgagagttgtagtg

SEQ ID NO: 234022 - DNA, 25 bp, Mus musculus
catgaactgttggcccttgattgtg

SEQ ID NO: 234023 - DNA, 25 bp, Mus musculus
catgaagaaaaaagatgttggatcc

SEQ ID NO: 234024 - DNA, 25 bp, Mus musculus
catgaagaaatattatcacaaagat

SEQ ID NO: 234025 - DNA, 25 bp, Mus musculus
catgaagaacaattgccagccatgt

SEQ ID NO: 234026 - DNA, 25 bp, Mus musculus
catgaagaacgtgaccgagctgaac

SEQ ID NO: 234027 - DNA, 25 bp, Mus musculus
catgaagaacttccacaggagagcg

SEQ ID NO: 234028 - DNA, 25 bp, Mus musculus
catgaagaaggctggataccaggac

SEQ ID NO: 234029 - DNA, 25 bp, Mus musculus
catgaagaagtcaagccaggtgccc

SEQ ID NO: 234030 - DNA, 25 bp, Mus musculus
catgaagaagtcaagggaaaagtat

SEQ ID NO: 234031 - DNA, 25 bp, Mus musculus
catgaagacaaatcagagcgagaga

SEQ ID NO: 234032 - DNA, 25 bp, Mus musculus
catgaagacacgggtgatgtcccgc

SEQ ID NO: 234033 - DNA, 25 bp, Mus musculus
catgaagacataccgacgcttgctg

SEQ ID NO: 234034 - DNA, 25 bp, Mus musculus
catgaagaccaacagaacttgacga

SEQ ID NO: 234035 - DNA, 25 bp, Mus musculus
catgaagaccccgggtcttgttgca

SEQ ID NO: 234036 - DNA, 25 bp, Mus musculus
catgaagatcaagatcattgctcct

SEQ ID NO: 234037 - DNA, 25 bp, Mus musculus
catgaagatcaagcagatgtggatc

SEQ ID NO: 234038 - DNA, 25 bp, Mus musculus
catgaagatggcgaaattgggaaag

SEQ ID NO: 234039 - DNA, 25 bp, Mus musculus
catgaagatggcgaatcaccgcctc

SEQ ID NO: 234040 - DNA, 25 bp, Mus musculus
catgaagattgagagccagcgggcc

SEQ ID NO: 234041 - DNA, 25 bp, Mus musculus
catgaagcaggtggcaggtaccatg

SEQ ID NO: 234042 - DNA, 25 bp, Mus musculus
catgaagccttagaggacgtagaga

SEQ ID NO: 234043 - DNA, 25 bp, Mus musculus
catgaagccttctcaggccagattt

SEQ ID NO: 234044 - DNA, 25 bp, Mus musculus
catgaagcggtgttcgaggaatatg

SEQ ID NO: 234045 - DNA, 25 bp, Mus musculus
catgaagctgagtgaagatggcacc

SEQ ID NO: 234046 - DNA, 25 bp, Mus musculus
catgaagctgtagtgcagttgaaca

SEQ ID NO: 234047 - DNA, 25 bp, Mus musculus
catgaagctgtagtgccaactactc

SEQ ID NO: 234048 - DNA, 25 bp, Mus musculus
catgaaggaaagactcaggcagctg

SEQ ID NO: 234049 - DNA, 25 bp, Mus musculus
catgaaggaaagttacccagcatgc

SEQ ID NO: 234050 - DNA, 25 bp, Mus musculus
catgaaggatcaggatgacgatgct

SEQ ID NO: 234051 - DNA, 25 bp, Mus musculus
catgaaggatcaggcccttaaggat

SEQ ID NO: 234052 - DNA, 25 bp, Mus musculus
catgaaggcaccaatttcgttgtgg

SEQ ID NO: 234053 - DNA, 25 bp, Mus musculus
catgaaggcagagttctttgcagat

SEQ ID NO: 234054 - DNA, 25 bp, Mus musculus
catgaaggtcaacaccatcaccacc

SEQ ID NO: 234055 - DNA, 25 bp, Mus musculus
catgaaggtgccggttttggcacgt

SEQ ID NO: 234056 - DNA, 25 bp, Mus musculus
catgaaggtgctgagttcatgcaaa

SEQ ID NO: 234057 - DNA, 25 bp, Mus musculus
catgaagtacaggctggacattgtg

SEQ ID NO: 234058 - DNA, 25 bp, Mus musculus
catgaagtacctgaacgtgctggcc

SEQ ID NO: 234059 - DNA, 25 bp, Mus musculus
catgaagtagagaccatccatgtgg

SEQ ID NO: 234060 - DNA, 25 bp, Mus musculus
catgaagtagagaggcattttcttg

SEQ ID NO: 234061 - DNA, 25 bp, Mus musculus
catgaagtagagtccatccatgtgg

SEQ ID NO: 234062 - DNA, 25 bp, Mus musculus
catgaagtcactcggtgtgggcttt

SEQ ID NO: 234063 - DNA, 25 bp, Mus musculus
catgaagtcccagtggccagtgaag

SEQ ID NO: 234064 - DNA, 25 bp, Mus musculus
catgaagttgcaagaagacaccctg

SEQ ID NO: 234065 - DNA, 25 bp, Mus musculus
catgaagttgccagaaggagaagca

SEQ ID NO: 234066 - DNA, 25 bp, Mus musculus
catgaagttggtgagcccgagttcc

SEQ ID NO: 234067 - DNA, 25 bp, Mus musculus
catgaataagcagttccgggcttgc

SEQ ID NO: 234068 - DNA, 25 bp, Mus musculus
catgaatacgtcagacatctggcag

SEQ ID NO: 234069 - DNA, 25 bp, Mus musculus
catgaatcaggatgatctcaaagcc

SEQ ID NO: 234070 - DNA, 25 bp, Mus musculus
catgaatcaggatgtgtctctctcc

SEQ ID NO: 234071 - DNA, 25 bp, Mus musculus
catgaatcccagcccggagggccca

SEQ ID NO: 234072 - DNA, 25 bp, Mus musculus
catgaatcctatcagggtgaaggag

SEQ ID NO: 234073 - DNA, 25 bp, Mus musculus
catgaatcttcaggggctggctgtg

SEQ ID NO: 234074 - DNA, 25 bp, Mus musculus
catgaatgtgaccgagataatcatg

SEQ ID NO: 234075 - DNA, 25 bp, Mus musculus
catgaattttccaggtctctttaag

SEQ ID NO: 234076 - DNA, 25 bp, Mus musculus
catgaattttccagttcaaaaggac

SEQ ID NO: 234077 - DNA, 25 bp, Mus musculus
catgacaaaaaagagctctcttaca

SEQ ID NO: 234078 - DNA, 25 bp, Mus musculus
catgacaaccagggtggtgccccca

SEQ ID NO: 234079 - DNA, 25 bp, Mus musculus
catgacaacctagaggccttgtctc

SEQ ID NO: 234080 - DNA, 25 bp, Mus musculus
catgacaacgtcaggtatggcattt

SEQ ID NO: 234081 - DNA, 25 bp, Mus musculus
catgacaagagaaagcgccaaggga

SEQ ID NO: 234082 - DNA, 25 bp, Mus musculus
catgacaccaggacttcctccatca

SEQ ID NO: 234083 - DNA, 25 bp, Mus musculus
catgacaccatgcctgctgacaagg

SEQ ID NO: 234084 - DNA, 25 bp, Mus musculus
catgacactaaacatggagtggatg

SEQ ID NO: 234085 - DNA, 25 bp, Mus musculus
catgacactgcttttctccttccgc

SEQ ID NO: 234086 - DNA, 25 bp, Mus musculus
catgacagaagctgattggccattc

SEQ ID NO: 234087 - DNA, 25 bp, Mus musculus
catgacagacagtttcgcatttggc

SEQ ID NO: 234088 - DNA, 25 bp, Mus musculus
catgacagtgtctcggttattccca

SEQ ID NO: 234089 - DNA, 25 bp, Mus musculus
catgacagtgtggctcagactcctg

SEQ ID NO: 234090 - DNA, 25 bp, Mus musculus
catgacatagatcctataaggtgga

SEQ ID NO: 234091 - DNA, 25 bp, Mus musculus
catgacatagggtacatgtggatgc

SEQ ID NO: 234092 - DNA, 25 bp, Mus musculus
catgacatcagcagcggacagttct

SEQ ID NO: 234093 - DNA, 25 bp, Mus musculus
catgacatccttggcagcactgcag

SEQ ID NO: 234094 - DNA, 25 bp, Mus musculus
catgacattcgcttcaaaatccagc

SEQ ID NO: 234095 - DNA, 25 bp, Mus musculus
catgaccaaaggactctgatcactg

SEQ ID NO: 234096 - DNA, 25 bp, Mus musculus
catgaccaagaggtcgctcgcattc

SEQ ID NO: 234097 - DNA, 25 bp, Mus musculus
catgaccaagatgccaaagacccgg

SEQ ID NO: 234098 - DNA, 25 bp, Mus musculus
catgaccaaggacaaacagaagatt

SEQ ID NO: 234099 - DNA, 25 bp, Mus musculus
catgaccaaggatgaacagcaactt

SEQ ID NO: 234100 - DNA, 25 bp, Mus musculus
catgaccaaggtacttcctggactc

SEQ ID NO: 234101 - DNA, 25 bp, Mus musculus
catgaccaagttcatgaagcctgga

SEQ ID NO: 234102 - DNA, 25 bp, Mus musculus
catgaccaatggctggaagctaaac

SEQ ID NO: 234103 - DNA, 25 bp, Mus musculus
catgaccacagctgttggtctgata

SEQ ID NO: 234104 - DNA, 25 bp, Mus musculus
catgaccagtgatcggcgccagtgg

SEQ ID NO: 234105 - DNA, 25 bp, Mus musculus
catgaccagtggaaatgatgtacgt

SEQ ID NO: 234106 - DNA, 25 bp, Mus musculus
catgaccagtgtcgttaggagagga

SEQ ID NO: 234107 - DNA, 25 bp, Mus musculus
catgaccatacagatcatgtcatca

SEQ ID NO: 234108 - DNA, 25 bp, Mus musculus
catgacccagaggcaaaactcccaa

SEQ ID NO: 234109 - DNA, 25 bp, Mus musculus
catgacccaggtatacaagagacta

SEQ ID NO: 234110 - DNA, 25 bp, Mus musculus
catgaccccagtgaccgtctggttc

SEQ ID NO: 234111 - DNA, 25 bp, Mus musculus
catgacccgtaagaccaagcgccca

SEQ ID NO: 234112 - DNA, 25 bp, Mus musculus
catgaccctggaggtgagaaagtct

SEQ ID NO: 234113 - DNA, 25 bp, Mus musculus
catgacccttggcagacagggtccc

SEQ ID NO: 234114 - DNA, 25 bp, Mus musculus
catgacctcaccgactctgcaaagc

SEQ ID NO: 234115 - DNA, 25 bp, Mus musculus
catgacctcaccgtgatcaactttt

SEQ ID NO: 234116 - DNA, 25 bp, Mus musculus
catgacctcgaaaacgggctgtaaa

SEQ ID NO: 234117 - DNA, 25 bp, Mus musculus
catgacctctatagcgtctctacag

SEQ ID NO: 234118 - DNA, 25 bp, Mus musculus
catgacctctatataaactgaagtg

SEQ ID NO: 234119 - DNA, 25 bp, Mus musculus
catgaccttggaagggcctggttct

SEQ ID NO: 234120 - DNA, 25 bp, Mus musculus
catgacgcagagctgctcagggtgc

SEQ ID NO: 234121 - DNA, 25 bp, Mus musculus
catgacgcagagctggctcccgcgt

SEQ ID NO: 234122 - DNA, 25 bp, Mus musculus
catgacgccaggatcccattttcag

SEQ ID NO: 234123 - DNA, 25 bp, Mus musculus
catgacggagcgaaatacttaagga

SEQ ID NO: 234124 - DNA, 25 bp, Mus musculus
catgacgtccaccagtgaaaatgtg

SEQ ID NO: 234125 - DNA, 25 bp, Mus musculus
catgacgtgttcgagaaccgttacg

SEQ ID NO: 234126 - DNA, 25 bp, Mus musculus
catgactattctcccggggccgcct

SEQ ID NO: 234127 - DNA, 25 bp, Mus musculus
catgactcctgacggtgaccctaaa

SEQ ID NO: 234128 - DNA, 25 bp, Mus musculus
catgactctagccagcagggcctca

SEQ ID NO: 234129 - DNA, 25 bp, Mus musculus
catgactctcaggcaaggccagctg

SEQ ID NO: 234130 - DNA, 25 bp, Mus musculus
catgactgaaatctcgagatctttg

SEQ ID NO: 234131 - DNA, 25 bp, Mus musculus
catgactgaagggcatccgtctctt

SEQ ID NO: 234132 - DNA, 25 bp, Mus musculus
catgactgccaagattcatgaataa

SEQ ID NO: 234133 - DNA, 25 bp, Mus musculus
catgactgtctatacaactaaaatt

SEQ ID NO: 234134 - DNA, 25 bp, Mus musculus
catgactgtctatagacctgcaatg

SEQ ID NO: 234135 - DNA, 25 bp, Mus musculus
catgacttcttgttcagtcaccagt

SEQ ID NO: 234136 - DNA, 25 bp, Mus musculus
catgactttctctgtaccgtcagaa

SEQ ID NO: 234137 - DNA, 25 bp, Mus musculus
catgactttctgaagcttcttcaca

SEQ ID NO: 234138 - DNA, 25 bp, Mus musculus
catgactttggatggaagacttcga

SEQ ID NO: 234139 - DNA, 25 bp, Mus musculus
catgactttggcaccaggaagcctg

SEQ ID NO: 234140 - DNA, 25 bp, Mus musculus
catgacttttgtacaaacaaatttg

SEQ ID NO: 234141 - DNA, 25 bp, Mus musculus
catgagaaagagccactggcaagct

SEQ ID NO: 234142 - DNA, 25 bp, Mus musculus
catgagaaagcatgctctctgttgg

SEQ ID NO: 234143 - DNA, 25 bp, Mus musculus
catgagaaataaagacaaaaggctt

SEQ ID NO: 234144 - DNA, 25 bp, Mus musculus
catgagaagaggaagcttcttgatg

SEQ ID NO: 234145 - DNA, 25 bp, Mus musculus
catgagaatgatccagctacatcaa

SEQ ID NO: 234146 - DNA, 25 bp, Mus musculus
catgagacaattgaggaaccaacac

SEQ ID NO: 234147 - DNA, 25 bp, Mus musculus
catgagacacacgcgcttgttctct

SEQ ID NO: 234148 - DNA, 25 bp, Mus musculus
catgagacccagctttccctgctgc

SEQ ID NO: 234149 - DNA, 25 bp, Mus musculus
catgagaccctggacatgaacaagc

SEQ ID NO: 234150 - DNA, 25 bp, Mus musculus
catgagaccctgtacatgggctgtg

SEQ ID NO: 234151 - DNA, 25 bp, Mus musculus
catgagacgggaagctgtacagaga

SEQ ID NO: 234152 - DNA, 25 bp, Mus musculus
catgagacttagaatccttctgaag

SEQ ID NO: 234153 - DNA, 25 bp, Mus musculus
catgagacttagtagctagaagaat

SEQ ID NO: 234154 - DNA, 25 bp, Mus musculus
catgagagaaagaatcccaagaggt

SEQ ID NO: 234155 - DNA, 25 bp, Mus musculus
catgagagaaagaatgcccagatgt

SEQ ID NO: 234156 - DNA, 25 bp, Mus musculus
catgagagacttccagacagaactc

SEQ ID NO: 234157 - DNA, 25 bp, Mus musculus
catgagagagatcccatggtttcca

SEQ ID NO: 234158 - DNA, 25 bp, Mus musculus
catgagagaggactgcctccagagc

SEQ ID NO: 234159 - DNA, 25 bp, Mus musculus
catgagagaggtatatgctatgatg

SEQ ID NO: 234160 - DNA, 25 bp, Mus musculus
catgagagcattaagcatccagcat

SEQ ID NO: 234161 - DNA, 25 bp, Mus musculus
catgagaggccagatcctaaatttg

SEQ ID NO: 234162 - DNA, 25 bp, Mus musculus
catgagagttgactctgtgcagatt

SEQ ID NO: 234163 - DNA, 25 bp, Mus musculus
catgagagttgggcacttgctggat

SEQ ID NO: 234164 - DNA, 25 bp, Mus musculus
catgagatccagctgtaggagactt

SEQ ID NO: 234165 - DNA, 25 bp, Mus musculus
catgagatggattctgacgttgggt

SEQ ID NO: 234166 - DNA, 25 bp, Mus musculus
catgagcaaaagctggtgcaacacg

SEQ ID NO: 234167 - DNA, 25 bp, Mus musculus
catgagcaaagaggtgcaagatctc

SEQ ID NO: 234168 - DNA, 25 bp, Mus musculus
catgagcaaagggccacaataccca

SEQ ID NO: 234169 - DNA, 25 bp, Mus musculus
catgagcaagcacgtcgcgtttgga

SEQ ID NO: 234170 - DNA, 25 bp, Mus musculus
catgagcaaggtctttgaagtaatc

SEQ ID NO: 234171 - DNA, 25 bp, Mus musculus
catgagcagaaagatcagtatgcat

SEQ ID NO: 234172 - DNA, 25 bp, Mus musculus
catgagcagaaaggacaaagcccag

SEQ ID NO: 234173 - DNA, 25 bp, Mus musculus
catgagcagaacctcaggttctccc

SEQ ID NO: 234174 - DNA, 25 bp, Mus musculus
catgagcagctctgcagtatgctga

SEQ ID NO: 234175 - DNA, 25 bp, Mus musculus
catgagcagggtgtccctgtataaa

SEQ ID NO: 234176 - DNA, 25 bp, Mus musculus
catgagcatcagcgggcaaatcatt

SEQ ID NO: 234177 - DNA, 25 bp, Mus musculus
catgagcattgctgagcagatgggc

SEQ ID NO: 234178 - DNA, 25 bp, Mus musculus
catgagcattgctgcggtgacagag

SEQ ID NO: 234179 - DNA, 25 bp, Mus musculus
catgagccactgccagcgttccatg

SEQ ID NO: 234180 - DNA, 25 bp, Mus musculus
catgagccaggacgacctggcgaga

SEQ ID NO: 234181 - DNA, 25 bp, Mus musculus
catgagccaggactgctagacacac

SEQ ID NO: 234182 - DNA, 25 bp, Mus musculus
catgagccaggtggctgtgggcaca

SEQ ID NO: 234183 - DNA, 25 bp, Mus musculus
catgagccgggtgaacctgaattta

SEQ ID NO: 234184 - DNA, 25 bp, Mus musculus
catgagcctcagggccccttaggcc

SEQ ID NO: 234185 - DNA, 25 bp, Mus musculus
catgagcctcctgatgctgctccgc

SEQ ID NO: 234186 - DNA, 25 bp, Mus musculus
catgagcctgcctttaccccagccc

SEQ ID NO: 234187 - DNA, 25 bp, Mus musculus
catgagccttgagatggcgttgacg

SEQ ID NO: 234188 - DNA, 25 bp, Mus musculus
catgagcggatatgaccaagtttta

SEQ ID NO: 234189 - DNA, 25 bp, Mus musculus
catgagcggatatggtagccaagga

SEQ ID NO: 234190 - DNA, 25 bp, Mus musculus
catgagctacttcccacccctgcct

SEQ ID NO: 234191 - DNA, 25 bp, Mus musculus
catgagctagggcacgttctcagca

SEQ ID NO: 234192 - DNA, 25 bp, Mus musculus
catgagctccaagagctgttagctg

SEQ ID NO: 234193 - DNA, 25 bp, Mus musculus
catgagctttcccgagacagcctgc

SEQ ID NO: 234194 - DNA, 25 bp, Mus musculus
catgaggaaacccagtcgcataggg

SEQ ID NO: 234195 - DNA, 25 bp, Mus musculus
catgaggaaagacatgatactgtca

SEQ ID NO: 234196 - DNA, 25 bp, Mus musculus
catgaggaacaagattcgagagcaa

SEQ ID NO: 234197 - DNA, 25 bp, Mus musculus
catgaggagaagcctatgggaaggt

SEQ ID NO: 234198 - DNA, 25 bp, Mus musculus
catgaggagctgaggagagaacatt

SEQ ID NO: 234199 - DNA, 25 bp, Mus musculus
catgaggatttgggatttagaattc

SEQ ID NO: 234200 - DNA, 25 bp, Mus musculus
catgaggcaagtcagaggccaaaat

SEQ ID NO: 234201 - DNA, 25 bp, Mus musculus
catgaggcccgagaaactgaaggag

SEQ ID NO: 234202 - DNA, 25 bp, Mus musculus
catgaggcgtgggcttcgggacaca

SEQ ID NO: 234203 - DNA, 25 bp, Mus musculus
catgaggctgctggcgttccccgag

SEQ ID NO: 234204 - DNA, 25 bp, Mus musculus
catgagggaggagtgtgtgctgtca

SEQ ID NO: 234205 - DNA, 25 bp, Mus musculus
catgaggtcacgtaaacagagagtg

SEQ ID NO: 234206 - DNA, 25 bp, Mus musculus
catgaggtcggcagattcagagcag

SEQ ID NO: 234207 - DNA, 25 bp, Mus musculus
catgaggttggcaggccccctgcgc

SEQ ID NO: 234208 - DNA, 25 bp, Mus musculus
catgagtaaggtagcctccaagaaa

SEQ ID NO: 234209 - DNA, 25 bp, Mus musculus
catgagtactacagcatgggcgcat

SEQ ID NO: 234210 - DNA, 25 bp, Mus musculus
catgagtagcgaaagcaaatcagaa

SEQ ID NO: 234211 - DNA, 25 bp, Mus musculus
catgagtcagaagcccatctcggtc

SEQ ID NO: 234212 - DNA, 25 bp, Mus musculus
catgagtcagaaggtgttgcagccc

SEQ ID NO: 234213 - DNA, 25 bp, Mus musculus
catgagtccagacttcttgtgaaga

SEQ ID NO: 234214 - DNA, 25 bp, Mus musculus
catgagtccaggctagatatggatt

SEQ ID NO: 234215 - DNA, 25 bp, Mus musculus
catgagtctggcgaacactctgcac

SEQ ID NO: 234216 - DNA, 25 bp, Mus musculus
catgagtgagattgataacaacaaa

SEQ ID NO: 234217 - DNA, 25 bp, Mus musculus
catgagtgagggtacaagaaggtag

SEQ ID NO: 234218 - DNA, 25 bp, Mus musculus
catgagtgcagaggggaacctgcac

SEQ ID NO: 234219 - DNA, 25 bp, Mus musculus
catgagtggagccagagaacagctt

SEQ ID NO: 234220 - DNA, 25 bp, Mus musculus
catgagtggagctggtctgggactg

SEQ ID NO: 234221 - DNA, 25 bp, Mus musculus
catgagtgttggaatggtcagcctc

SEQ ID NO: 234222 - DNA, 25 bp, Mus musculus
catgagttaaggcgtcgaggtggaa

SEQ ID NO: 234223 - DNA, 25 bp, Mus musculus
catgagttcaaagaaaatccctgag

SEQ ID NO: 234224 - DNA, 25 bp, Mus musculus
catgagttcatcgatggctaaagta

SEQ ID NO: 234225 - DNA, 25 bp, Mus musculus
catgagttcatcgatgtctacttca

SEQ ID NO: 234226 - DNA, 25 bp, Mus musculus
catgagttcgagcccgccggagtcc

SEQ ID NO: 234227 - DNA, 25 bp, Mus musculus
catgagttctgaatgtgatgttgga

SEQ ID NO: 234228 - DNA, 25 bp, Mus musculus
catgagttgtgcctgccgacataag

SEQ ID NO: 234229 - DNA, 25 bp, Mus musculus
catgagtttaaggttaaatgagcag

SEQ ID NO: 234230 - DNA, 25 bp, Mus musculus
catgataaatgaggacatagcattg

SEQ ID NO: 234231 - DNA, 25 bp, Mus musculus
catgataggagacgattgcagggat

SEQ ID NO: 234232 - DNA, 25 bp, Mus musculus
catgatatagataccaagtggtaga

SEQ ID NO: 234233 - DNA, 25 bp, Mus musculus
catgatataggacagaaattgggag

SEQ ID NO: 234234 - DNA, 25 bp, Mus musculus
catgatatgaggagtcagtacaggc

SEQ ID NO: 234235 - DNA, 25 bp, Mus musculus
catgatatggacaggggatagccca

SEQ ID NO: 234236 - DNA, 25 bp, Mus musculus
catgatcaacaacaccaaggagttt

SEQ ID NO: 234237 - DNA, 25 bp, Mus musculus
catgatcacaggacacctatatcaa

SEQ ID NO: 234238 - DNA, 25 bp, Mus musculus
catgatcacaggtgacaatcttcag

SEQ ID NO: 234239 - DNA, 25 bp, Mus musculus
catgatcaccagtgattcaggccaa

SEQ ID NO: 234240 - DNA, 25 bp, Mus musculus
catgatccagagaggtgctcggtct

SEQ ID NO: 234241 - DNA, 25 bp, Mus musculus
catgatccagagtcaggtgtggctc

SEQ ID NO: 234242 - DNA, 25 bp, Mus musculus
catgatccaggcgtctcttttctcc

SEQ ID NO: 234243 - DNA, 25 bp, Mus musculus
catgatccccaatgtggaaaccatc

SEQ ID NO: 234244 - DNA, 25 bp, Mus musculus
catgatcctcatcggggtacttttg

SEQ ID NO: 234245 - DNA, 25 bp, Mus musculus
catgatccttctgagagctgtccag

SEQ ID NO: 234246 - DNA, 25 bp, Mus musculus
catgatccttctgagccaatagtaa

SEQ ID NO: 234247 - DNA, 25 bp, Mus musculus
catgatcgacacaaatgaagaaaaa

SEQ ID NO: 234248 - DNA, 25 bp, Mus musculus
catgatcgacacaataaaattgaag

SEQ ID NO: 234249 - DNA, 25 bp, Mus musculus
catgatctccacatcttatccttca

SEQ ID NO: 234250 - DNA, 25 bp, Mus musculus
catgatctgtcacttgggagtttgc

SEQ ID NO: 234251 - DNA, 25 bp, Mus musculus
catgatctgtgccatgccaggtggt

SEQ ID NO: 234252 - DNA, 25 bp, Mus musculus
catgatcttcctggacaaaccaatt

SEQ ID NO: 234253 - DNA, 25 bp, Mus musculus
catgatcttgctattgaagtggacc

SEQ ID NO: 234254 - DNA, 25 bp, Mus musculus
catgatctttagaagactgctggac

SEQ ID NO: 234255 - DNA, 25 bp, Mus musculus
catgatgaaaacggaacaccagatg

SEQ ID NO: 234256 - DNA, 25 bp, Mus musculus
catgatgaacatggaagggttatta

SEQ ID NO: 234257 - DNA, 25 bp, Mus musculus
catgatgaacatggtgaagattcct

SEQ ID NO: 234258 - DNA, 25 bp, Mus musculus
catgatgaagaatagaattgctgaa

SEQ ID NO: 234259 - DNA, 25 bp, Mus musculus
catgatgacaggtttctactgcact

SEQ ID NO: 234260 - DNA, 25 bp, Mus musculus
catgatgaccaggattacttacact

SEQ ID NO: 234261 - DNA, 25 bp, Mus musculus
catgatgagaaaggggaggagcgct

SEQ ID NO: 234262 - DNA, 25 bp, Mus musculus
catgatgatcgtggaccctgccatc

SEQ ID NO: 234263 - DNA, 25 bp, Mus musculus
catgatgatcgtggcgggatccgca

SEQ ID NO: 234264 - DNA, 25 bp, Mus musculus
catgatgatcgtggtttggcctgga

SEQ ID NO: 234265 - DNA, 25 bp, Mus musculus
catgatgatgaacttgttcctagcg

SEQ ID NO: 234266 - DNA, 25 bp, Mus musculus
catgatgcagaggccaagaagatag

SEQ ID NO: 234267 - DNA, 25 bp, Mus musculus
catgatgcaggtgaagacttttggc

SEQ ID NO: 234268 - DNA, 25 bp, Mus musculus
catgatgcatatcttcctcctggcc

SEQ ID NO: 234269 - DNA, 25 bp, Mus musculus
catgatgcggagaatataggcaaag

SEQ ID NO: 234270 - DNA, 25 bp, Mus musculus
catgatggcggagtgtctggaaaaa

SEQ ID NO: 234271 - DNA, 25 bp, Mus musculus
catgatggctgaccatgatgtgcct

SEQ ID NO: 234272 - DNA, 25 bp, Mus musculus
catgatgtacgcaccagttgaattt

SEQ ID NO: 234273 - DNA, 25 bp, Mus musculus
catgatgtacgccagtgaattcatc

SEQ ID NO: 234274 - DNA, 25 bp, Mus musculus
catgatgtcagcgtcaatactatca

SEQ ID NO: 234275 - DNA, 25 bp, Mus musculus
catgatgtgaccctggacaaactgt

SEQ ID NO: 234276 - DNA, 25 bp, Mus musculus
catgatgtgaggcactaagtgaccg

SEQ ID NO: 234277 - DNA, 25 bp, Mus musculus
catgatgtggaagattttaattcct

SEQ ID NO: 234278 - DNA, 25 bp, Mus musculus
catgatgttcaaacacttcgacaag

SEQ ID NO: 234279 - DNA, 25 bp, Mus musculus
catgattagagggggacatgtcaat

SEQ ID NO: 234280 - DNA, 25 bp, Mus musculus
catgattattggagccccagaacga

SEQ ID NO: 234281 - DNA, 25 bp, Mus musculus
catgattcagaagatgatttttggt

SEQ ID NO: 234282 - DNA, 25 bp, Mus musculus
catgattccacaggcaatccagatc

SEQ ID NO: 234283 - DNA, 25 bp, Mus musculus
catgattccgaagcacctttgggga

SEQ ID NO: 234284 - DNA, 25 bp, Mus musculus
catgattgacaatgagacgctgcca

SEQ ID NO: 234285 - DNA, 25 bp, Mus musculus
catgattgtgggcaggatatttgtg

SEQ ID NO: 234286 - DNA, 25 bp, Mus musculus
catgatttatgggctcattgttgga

SEQ ID NO: 234287 - DNA, 25 bp, Mus musculus
catgatttatgtttgagattgctga

SEQ ID NO: 234288 - DNA, 25 bp, Mus musculus
catgatttccagagagaagacctga

SEQ ID NO: 234289 - DNA, 25 bp, Mus musculus
catgatttccagcctcatgtcatag

SEQ ID NO: 234290 - DNA, 25 bp, Mus musculus
catgcaaaatagcggtcacacaact

SEQ ID NO: 234291 - DNA, 25 bp, Mus musculus
catgcaaacagaacatgttggagca

SEQ ID NO: 234292 - DNA, 25 bp, Mus musculus
catgcaaaccccagatatccagctt

SEQ ID NO: 234293 - DNA, 25 bp, Mus musculus
catgcaaacggtgttcaatatgaat

SEQ ID NO: 234294 - DNA, 25 bp, Mus musculus
catgcaaactcgccctgggcagtga

SEQ ID NO: 234295 - DNA, 25 bp, Mus musculus
catgcaaatgaacaagctgagtatg

SEQ ID NO: 234296 - DNA, 25 bp, Mus musculus
catgcaacaacaagggaagtactcc

SEQ ID NO: 234297 - DNA, 25 bp, Mus musculus
catgcaacaacaagggagctcactc

SEQ ID NO: 234298 - DNA, 25 bp, Mus musculus
catgcaacgtaatgcctcagttcca

SEQ ID NO: 234299 - DNA, 25 bp, Mus musculus
catgcaagtaatcggagaggtattc

SEQ ID NO: 234300 - DNA, 25 bp, Mus musculus
catgcaagtaatcggtggcaattat

SEQ ID NO: 234301 - DNA, 25 bp, Mus musculus
catgcaatagaaatgatcaaaacag

SEQ ID NO: 234302 - DNA, 25 bp, Mus musculus
catgcaatagttccagttcagacat

SEQ ID NO: 234303 - DNA, 25 bp, Mus musculus
catgcaatcaatgtttgcaaaaaat

SEQ ID NO: 234304 - DNA, 25 bp, Mus musculus
catgcacaaggttcacctgctgtgc

SEQ ID NO: 234305 - DNA, 25 bp, Mus musculus
catgcacagaccagtacatgacaat

SEQ ID NO: 234306 - DNA, 25 bp, Mus musculus
catgcacaggaaaagttattgatgc

SEQ ID NO: 234307 - DNA, 25 bp, Mus musculus
catgcacatgtctcgaattatcaag

SEQ ID NO: 234308 - DNA, 25 bp, Mus musculus
catgcaccaaatgactcgaccgatc

SEQ ID NO: 234309 - DNA, 25 bp, Mus musculus
catgcacggagttgtgggaccgtac

SEQ ID NO: 234310 - DNA, 25 bp, Mus musculus
catgcactaggaggaatttggctat

SEQ ID NO: 234311 - DNA, 25 bp, Mus musculus
catgcagaacagtcacagcggagtg

SEQ ID NO: 234312 - DNA, 25 bp, Mus musculus
catgcagaagtcgatgcagaaccat

SEQ ID NO: 234313 - DNA, 25 bp, Mus musculus
catgcagagacagatttgatcaaaa

SEQ ID NO: 234314 - DNA, 25 bp, Mus musculus
catgcagagcgagatcaagaaatcc

SEQ ID NO: 234315 - DNA, 25 bp, Mus musculus
catgcagatgacctagagctcggat

SEQ ID NO: 234316 - DNA, 25 bp, Mus musculus
catgcagatgagctcggatttctat

SEQ ID NO: 234317 - DNA, 25 bp, Mus musculus
catgcagatgatcgagtgcttcagg

SEQ ID NO: 234318 - DNA, 25 bp, Mus musculus
catgcagatggagatgcagccttat

SEQ ID NO: 234319 - DNA, 25 bp, Mus musculus
catgcagatgggggcagagatgcag

SEQ ID NO: 234320 - DNA, 25 bp, Mus musculus
catgcagatggtgtcagtggattcc

SEQ ID NO: 234321 - DNA, 25 bp, Mus musculus
catgcagcacaacccttccaggcag

SEQ ID NO: 234322 - DNA, 25 bp, Mus musculus
catgcagcaccctgacacccagggc

SEQ ID NO: 234323 - DNA, 25 bp, Mus musculus
catgcagcaccctgccagtggccca

SEQ ID NO: 234324 - DNA, 25 bp, Mus musculus
catgcagcacctgatagctcgggag

SEQ ID NO: 234325 - DNA, 25 bp, Mus musculus
catgcagcagattcaagtcaatctg

SEQ ID NO: 234326 - DNA, 25 bp, Mus musculus
catgcagcagggtggaagcccaact

SEQ ID NO: 234327 - DNA, 25 bp, Mus musculus
catgcagcagtatgccttcctcaag

SEQ ID NO: 234328 - DNA, 25 bp, Mus musculus
catgcagccaggcgatgacgtggtc

SEQ ID NO: 234329 - DNA, 25 bp, Mus musculus
catgcagcgactggctctggtcctt

SEQ ID NO: 234330 - DNA, 25 bp, Mus musculus
catgcaggaatatttaaggctgcaa

SEQ ID NO: 234331 - DNA, 25 bp, Mus musculus
catgcaggaggaggagcatatgctg

SEQ ID NO: 234332 - DNA, 25 bp, Mus musculus
catgcaggatgccagccccgccttc

SEQ ID NO: 234333 - DNA, 25 bp, Mus musculus
catgcaggcactgcacgagtctgag

SEQ ID NO: 234334 - DNA, 25 bp, Mus musculus
catgcaggctgtcagatttatgcag

SEQ ID NO: 234335 - DNA, 25 bp, Mus musculus
catgcaggctgtcagctcgttcgtg

SEQ ID NO: 234336 - DNA, 25 bp, Mus musculus
catgcagggcagcgattgtaagtgt

SEQ ID NO: 234337 - DNA, 25 bp, Mus musculus
catgcagtattagtgctacagcctg

SEQ ID NO: 234338 - DNA, 25 bp, Mus musculus
catgcagtcagacttctccaaggtg

SEQ ID NO: 234339 - DNA, 25 bp, Mus musculus
catgcagtcagtgcagcccttcgcc

SEQ ID NO: 234340 - DNA, 25 bp, Mus musculus
catgcagtgtgtggcacctctgcag

SEQ ID NO: 234341 - DNA, 25 bp, Mus musculus
catgcagttaagagaacagcacatt

SEQ ID NO: 234342 - DNA, 25 bp, Mus musculus
catgcagttaagaggatcgctgcag

SEQ ID NO: 234343 - DNA, 25 bp, Mus musculus
catgcataaattgaatctgtataaa

SEQ ID NO: 234344 - DNA, 25 bp, Mus musculus
catgcatgcatgtggtcaacctgtt

SEQ ID NO: 234345 - DNA, 25 bp, Mus musculus
catgcatgccaggttcccactatgt

SEQ ID NO: 234346 - DNA, 25 bp, Mus musculus
catgcatgggcagacacagccctgg

SEQ ID NO: 234347 - DNA, 25 bp, Mus musculus
catgcatgtccaggttctcacgcgg

SEQ ID NO: 234348 - DNA, 25 bp, Mus musculus
catgcattaaatcagcaagccccgc

SEQ ID NO: 234349 - DNA, 25 bp, Mus musculus
catgcattaattcaaaaaagatcat

SEQ ID NO: 234350 - DNA, 25 bp, Mus musculus
catgcatttcaggttaatatccttc

SEQ ID NO: 234351 - DNA, 25 bp, Mus musculus
catgcatttggaggaactgccatcc

SEQ ID NO: 234352 - DNA, 25 bp, Mus musculus
catgcattttcacgacatccatggg

SEQ ID NO: 234353 - DNA, 25 bp, Mus musculus
catgccaaaatcatgctgacaccca

SEQ ID NO: 234354 - DNA, 25 bp, Mus musculus
catgccaaacagagcatgctggaga

SEQ ID NO: 234355 - DNA, 25 bp, Mus musculus
catgccaaacagctgcagagaaaag

SEQ ID NO: 234356 - DNA, 25 bp, Mus musculus
catgccaaaggcctctggctgtacc

SEQ ID NO: 234357 - DNA, 25 bp, Mus musculus
catgccaaaggtcagttcaccggga

SEQ ID NO: 234358 - DNA, 25 bp, Mus musculus
catgccaaagtctttgaaaccatca

SEQ ID NO: 234359 - DNA, 25 bp, Mus musculus
catgccaaattagtgcatgaagttg

SEQ ID NO: 234360 - DNA, 25 bp, Mus musculus
catgccaaggaggagtcagacacag

SEQ ID NO: 234361 - DNA, 25 bp, Mus musculus
catgccaaggaggtgagacggaagg

SEQ ID NO: 234362 - DNA, 25 bp, Mus musculus
catgccaattgaggtcatgatgaat

SEQ ID NO: 234363 - DNA, 25 bp, Mus musculus
catgccagaaggaggcggcgctctc

SEQ ID NO: 234364 - DNA, 25 bp, Mus musculus
catgccagcatcagggagcctgtat

SEQ ID NO: 234365 - DNA, 25 bp, Mus musculus
catgccagcccactggaagccgaag

SEQ ID NO: 234366 - DNA, 25 bp, Mus musculus
catgccaggcaagaaaaggaacacc

SEQ ID NO: 234367 - DNA, 25 bp, Mus musculus
catgccagtgaagtgataagttgca

SEQ ID NO: 234368 - DNA, 25 bp, Mus musculus
catgccataaggaaatcctaccttg

SEQ ID NO: 234369 - DNA, 25 bp, Mus musculus
catgccatcaagaatgaggagattg

SEQ ID NO: 234370 - DNA, 25 bp, Mus musculus
catgccatcactggccgagctctgc

SEQ ID NO: 234371 - DNA, 25 bp, Mus musculus
catgccatcgctgcattctgctctg

SEQ ID NO: 234372 - DNA, 25 bp, Mus musculus
catgccatgccaggaactccatggc

SEQ ID NO: 234373 - DNA, 25 bp, Mus musculus
catgccatgccaggaggaaagggga

SEQ ID NO: 234374 - DNA, 25 bp, Mus musculus
catgcccagggtgttccatgagcag

SEQ ID NO: 234375 - DNA, 25 bp, Mus musculus
catgcccagtgcctatgcttgtggt

SEQ ID NO: 234376 - DNA, 25 bp, Mus musculus
catgcccatccggttccagtggtgg

SEQ ID NO: 234377 - DNA, 25 bp, Mus musculus
catgcccatccgttcaattccacgc

SEQ ID NO: 234378 - DNA, 25 bp, Mus musculus
catgcccatgatgggcctggtttgg

SEQ ID NO: 234379 - DNA, 25 bp, Mus musculus
catgcccatgccctgtgatcagacc

SEQ ID NO: 234380 - DNA, 25 bp, Mus musculus
catgccccccaggagagtgtgctgg

SEQ ID NO: 234381 - DNA, 25 bp, Mus musculus
catgcccccgcaaggagatggagtt

SEQ ID NO: 234382 - DNA, 25 bp, Mus musculus
catgcccggcttagaactctccgct

SEQ ID NO: 234383 - DNA, 25 bp, Mus musculus
catgccctctttagcagatatattt

SEQ ID NO: 234384 - DNA, 25 bp, Mus musculus
catgccctggccgaggaagccgaga

SEQ ID NO: 234385 - DNA, 25 bp, Mus musculus
catgccctgggagacggggttgacc

SEQ ID NO: 234386 - DNA, 25 bp, Mus musculus
catgccctgtggctatattgctgcc

SEQ ID NO: 234387 - DNA, 25 bp, Mus musculus
catgccctgtggcttcattttccag

SEQ ID NO: 234388 - DNA, 25 bp, Mus musculus
catgcccttagatttctacacgaga

SEQ ID NO: 234389 - DNA, 25 bp, Mus musculus
catgccgagatggcacgttttgtgc

SEQ ID NO: 234390 - DNA, 25 bp, Mus musculus
catgccgcttgcgtggctcggatgg

SEQ ID NO: 234391 - DNA, 25 bp, Mus musculus
catgcctctaggttccagcagcact

SEQ ID NO: 234392 - DNA, 25 bp, Mus musculus
catgcctctcttggaattaaaggac

SEQ ID NO: 234393 - DNA, 25 bp, Mus musculus
catgcctctgcagacgtggagaaga

SEQ ID NO: 234394 - DNA, 25 bp, Mus musculus
catgcctgaaaaagaggcggcgggc

SEQ ID NO: 234395 - DNA, 25 bp, Mus musculus
catgcctgaaaaaggtactgttgga

SEQ ID NO: 234396 - DNA, 25 bp, Mus musculus
catgcctgaagacgttattgctcgg

SEQ ID NO: 234397 - DNA, 25 bp, Mus musculus
catgcctgaaggctctggtgtcctc

SEQ ID NO: 234398 - DNA, 25 bp, Mus musculus
catgcctgatctttaggaggagcag

SEQ ID NO: 234399 - DNA, 25 bp, Mus musculus
catgcctgctatgagaaactcccca

SEQ ID NO: 234400 - DNA, 25 bp, Mus musculus
catgcctgctgagcaagcgttttgg

SEQ ID NO: 234401 - DNA, 25 bp, Mus musculus
catgcctggatcaggaagcatatat

SEQ ID NO: 234402 - DNA, 25 bp, Mus musculus
catgcctgtctggaaacaacctgat

SEQ ID NO: 234403 - DNA, 25 bp, Mus musculus
catgcctgtgctagacagtgtgctc

SEQ ID NO: 234404 - DNA, 25 bp, Mus musculus
catgcctgtggggctgcgaggcctg

SEQ ID NO: 234405 - DNA, 25 bp, Mus musculus
catgccttagtgggctgggtgggtg

SEQ ID NO: 234406 - DNA, 25 bp, Mus musculus
catgccttcagacagaaaacgaagt

SEQ ID NO: 234407 - DNA, 25 bp, Mus musculus
catgccttcctgtcgatccccagcc

SEQ ID NO: 234408 - DNA, 25 bp, Mus musculus
catgccttcttactgtgtcctactg

SEQ ID NO: 234409 - DNA, 25 bp, Mus musculus
catgccttgtgcctacttgagcatc

SEQ ID NO: 234410 - DNA, 25 bp, Mus musculus
catgcctttgggcttggaagtgttt

SEQ ID NO: 234411 - DNA, 25 bp, Mus musculus
catgcgagccaagatggacaacgga

SEQ ID NO: 234412 - DNA, 25 bp, Mus musculus
catgcgagctgatggctttgtgccc

SEQ ID NO: 234413 - DNA, 25 bp, Mus musculus
catgcgagctggtccctgagttgga

SEQ ID NO: 234414 - DNA, 25 bp, Mus musculus
catgcgccatgacaagatcgtgatt

SEQ ID NO: 234415 - DNA, 25 bp, Mus musculus
catgcgcccgaatgacagtccttac

SEQ ID NO: 234416 - DNA, 25 bp, Mus musculus
catgcgctataaccgagactggtac

SEQ ID NO: 234417 - DNA, 25 bp, Mus musculus
catgcgctataaccgggctgggcct

SEQ ID NO: 234418 - DNA, 25 bp, Mus musculus
catgcgctgtggggatggaaatgca

SEQ ID NO: 234419 - DNA, 25 bp, Mus musculus
catgcggacaggcctgagtacttct

SEQ ID NO: 234420 - DNA, 25 bp, Mus musculus
catgcggacaggccttgttttcatg

SEQ ID NO: 234421 - DNA, 25 bp, Mus musculus
catgcggagagactgggatgagcac

SEQ ID NO: 234422 - DNA, 25 bp, Mus musculus
catgcgtacggctggcctcaaacat

SEQ ID NO: 234423 - DNA, 25 bp, Mus musculus
catgcgtcagtggtcgcagacactt

SEQ ID NO: 234424 - DNA, 25 bp, Mus musculus
catgcgtccaagctgtttcctctgc

SEQ ID NO: 234425 - DNA, 25 bp, Mus musculus
catgcgtccaaggcaaatttcaggt

SEQ ID NO: 234426 - DNA, 25 bp, Mus musculus
catgcgtccaagtatctagcattca

SEQ ID NO: 234427 - DNA, 25 bp, Mus musculus
catgcgtgatctgggtactgtggca

SEQ ID NO: 234428 - DNA, 25 bp, Mus musculus
catgcgtgccacagttcttgctgct

SEQ ID NO: 234429 - DNA, 25 bp, Mus musculus
catgctaacaggaaaaattctccct

SEQ ID NO: 234430 - DNA, 25 bp, Mus musculus
catgctaacaggggctaccagccaa

SEQ ID NO: 234431 - DNA, 25 bp, Mus musculus
catgctaagaggggatgtgaagtgt

SEQ ID NO: 234432 - DNA, 25 bp, Mus musculus
catgctaatagaagtagtccccacc

SEQ ID NO: 234433 - DNA, 25 bp, Mus musculus
catgctaataggccaggtggttgca

SEQ ID NO: 234434 - DNA, 25 bp, Mus musculus
catgctaatagggaagaccgggcca

SEQ ID NO: 234435 - DNA, 25 bp, Mus musculus
catgctaccaacaagtatgaggtag

SEQ ID NO: 234436 - DNA, 25 bp, Mus musculus
catgctaccagaagccagatgagag

SEQ ID NO: 234437 - DNA, 25 bp, Mus musculus
catgctaccagcatttgatgaccag

SEQ ID NO: 234438 - DNA, 25 bp, Mus musculus
catgctaggcaatggtcactcggac

SEQ ID NO: 234439 - DNA, 25 bp, Mus musculus
catgctatagagctgtcatagcctg

SEQ ID NO: 234440 - DNA, 25 bp, Mus musculus
catgctatagagtcgacaagcagtg

SEQ ID NO: 234441 - DNA, 25 bp, Mus musculus
catgctatagagtctggattttcct

SEQ ID NO: 234442 - DNA, 25 bp, Mus musculus
catgctataggaggatctcccagaa

SEQ ID NO: 234443 - DNA, 25 bp, Mus musculus
catgctattaaagctggtgagaaat

SEQ ID NO: 234444 - DNA, 25 bp, Mus musculus
catgctattgatctgatggaggcac

SEQ ID NO: 234445 - DNA, 25 bp, Mus musculus
catgctattgatgcttgctttaaat

SEQ ID NO: 234446 - DNA, 25 bp, Mus musculus
catgctcaaattcggggcttcctcg

SEQ ID NO: 234447 - DNA, 25 bp, Mus musculus
catgctcaaattcggtgcagcccgg

SEQ ID NO: 234448 - DNA, 25 bp, Mus musculus
catgctcaagccaaaccaacaactt

SEQ ID NO: 234449 - DNA, 25 bp, Mus musculus
catgctcaaggacatggcagactcc

SEQ ID NO: 234450 - DNA, 25 bp, Mus musculus
catgctcacaaggtgcagacctgaa

SEQ ID NO: 234451 - DNA, 25 bp, Mus musculus
catgctcagccagctgagggagtat

SEQ ID NO: 234452 - DNA, 25 bp, Mus musculus
catgctcatggtgggcagcaatgct

SEQ ID NO: 234453 - DNA, 25 bp, Mus musculus
catgctcattgtgattatgtgggta

SEQ ID NO: 234454 - DNA, 25 bp, Mus musculus
catgctcattgtggtactgataggt

SEQ ID NO: 234455 - DNA, 25 bp, Mus musculus
catgctccgaaagcatgtggaattc

SEQ ID NO: 234456 - DNA, 25 bp, Mus musculus
catgctccgagccgctggtttgtcc

SEQ ID NO: 234457 - DNA, 25 bp, Mus musculus
catgctccgagggtctgactacaga

SEQ ID NO: 234458 - DNA, 25 bp, Mus musculus
catgctcgcagaaaaagcagcgatg

SEQ ID NO: 234459 - DNA, 25 bp, Mus musculus
catgctcggcttcagagcactaaag

SEQ ID NO: 234460 - DNA, 25 bp, Mus musculus
catgctcggcttcagctggaaaggc

SEQ ID NO: 234461 - DNA, 25 bp, Mus musculus
catgctcggcttcaggtgaagctga

SEQ ID NO: 234462 - DNA, 25 bp, Mus musculus
catgctcggggggaaggcccaaaca

SEQ ID NO: 234463 - DNA, 25 bp, Mus musculus
catgctctacgagaaataccgacag

SEQ ID NO: 234464 - DNA, 25 bp, Mus musculus
catgctctataaggatgttcgcaac

SEQ ID NO: 234465 - DNA, 25 bp, Mus musculus
catgctctcctgcaggaagtggaca

SEQ ID NO: 234466 - DNA, 25 bp, Mus musculus
catgctctctggtcttgtgcaactg

SEQ ID NO: 234467 - DNA, 25 bp, Mus musculus
catgctctgcaggcttcgagtacct

SEQ ID NO: 234468 - DNA, 25 bp, Mus musculus
catgctctgtgatgaccaagatctt

SEQ ID NO: 234469 - DNA, 25 bp, Mus musculus
catgctcttcgtctgctgggattcc

SEQ ID NO: 234470 - DNA, 25 bp, Mus musculus
catgctcttcgtgttccgctactgc

SEQ ID NO: 234471 - DNA, 25 bp, Mus musculus
catgctgaaaagagcaaggaacccc

SEQ ID NO: 234472 - DNA, 25 bp, Mus musculus
catgctgaacgctgagatcatcttt

SEQ ID NO: 234473 - DNA, 25 bp, Mus musculus
catgctgaataggtatctgatcaac

SEQ ID NO: 234474 - DNA, 25 bp, Mus musculus
catgctgaataggtgaattgagacc

SEQ ID NO: 234475 - DNA, 25 bp, Mus musculus
catgctgaatgctaggtagaagccc

SEQ ID NO: 234476 - DNA, 25 bp, Mus musculus
catgctgacagatcgggagaatcag

SEQ ID NO: 234477 - DNA, 25 bp, Mus musculus
catgctgactcggctgaaagcaaaa

SEQ ID NO: 234478 - DNA, 25 bp, Mus musculus
catgctgactcgggttatcttctct

SEQ ID NO: 234479 - DNA, 25 bp, Mus musculus
catgctgatcaaactggattcagaa

SEQ ID NO: 234480 - DNA, 25 bp, Mus musculus
catgctgatgccattctatttattt

SEQ ID NO: 234481 - DNA, 25 bp, Mus musculus
catgctgatgccttagacttgcagc

SEQ ID NO: 234482 - DNA, 25 bp, Mus musculus
catgctgcagataagtgattgacat

SEQ ID NO: 234483 - DNA, 25 bp, Mus musculus
catgctgcagataagttactctcag

SEQ ID NO: 234484 - DNA, 25 bp, Mus musculus
catgctgcagctgctgttgatgctg

SEQ ID NO: 234485 - DNA, 25 bp, Mus musculus
catgctgcaggtgctgggccccaag

SEQ ID NO: 234486 - DNA, 25 bp, Mus musculus
catgctgcagttggtgcttcccgag

SEQ ID NO: 234487 - DNA, 25 bp, Mus musculus
catgctgccagggcaccagcgtcta

SEQ ID NO: 234488 - DNA, 25 bp, Mus musculus
catgctgccccagggttcttttagg

SEQ ID NO: 234489 - DNA, 25 bp, Mus musculus
catgctgccccaggttgtgtggagg

SEQ ID NO: 234490 - DNA, 25 bp, Mus musculus
catgctgcccctcagcagcagcaac

SEQ ID NO: 234491 - DNA, 25 bp, Mus musculus
catgctggacccgctgcggctgctg

SEQ ID NO: 234492 - DNA, 25 bp, Mus musculus
catgctggacccgtccattggagaa

SEQ ID NO: 234493 - DNA, 25 bp, Mus musculus
catgctggagaatcttctctgtcca

SEQ ID NO: 234494 - DNA, 25 bp, Mus musculus
catgctggaggtacgctggatcgcg

SEQ ID NO: 234495 - DNA, 25 bp, Mus musculus
catgctggatgatactatcgtggag

SEQ ID NO: 234496 - DNA, 25 bp, Mus musculus
catgctggcaaagagtgatggcgtg

SEQ ID NO: 234497 - DNA, 25 bp, Mus musculus
catgctggcaaaggcgggttccagc

SEQ ID NO: 234498 - DNA, 25 bp, Mus musculus
catgctggcagcgaacatgcgccgg

SEQ ID NO: 234499 - DNA, 25 bp, Mus musculus
catgctggccatgagtactttgtgt

SEQ ID NO: 234500 - DNA, 25 bp, Mus musculus
catgctggccctggagcctggttac

SEQ ID NO: 234501 - DNA, 25 bp, Mus musculus
catgctggccctgggtattgacttt

SEQ ID NO: 234502 - DNA, 25 bp, Mus musculus
catgctggccttatgtccagccatt

SEQ ID NO: 234503 - DNA, 25 bp, Mus musculus
catgctggcgatgcccctagacctg

SEQ ID NO: 234504 - DNA, 25 bp, Mus musculus
catgctgggaggaggtggcccagag

SEQ ID NO: 234505 - DNA, 25 bp, Mus musculus
catgctggtaagcattcactaatcc

SEQ ID NO: 234506 - DNA, 25 bp, Mus musculus
catgctggtaaggattcactaatcc

SEQ ID NO: 234507 - DNA, 25 bp, Mus musculus
catgctggtcaaagatgacctggat

SEQ ID NO: 234508 - DNA, 25 bp, Mus musculus
catgctgtcagccgttgactacttt

SEQ ID NO: 234509 - DNA, 25 bp, Mus musculus
catgctgtccagagatgggtggctg

SEQ ID NO: 234510 - DNA, 25 bp, Mus musculus
catgctgtgcaaatggcaagctgtg

SEQ ID NO: 234511 - DNA, 25 bp, Mus musculus
catgctgtgcaaatggtacaatcag

SEQ ID NO: 234512 - DNA, 25 bp, Mus musculus
catgctgtgccttgcacaacccggt

SEQ ID NO: 234513 - DNA, 25 bp, Mus musculus
catgctgtggagattcatgacttgc

SEQ ID NO: 234514 - DNA, 25 bp, Mus musculus
catgctgtgtgcaggagagatgggt

SEQ ID NO: 234515 - DNA, 25 bp, Mus musculus
catgctgttctgaatgaagggacct

SEQ ID NO: 234516 - DNA, 25 bp, Mus musculus
catgctgttcttttcaggggagttt

SEQ ID NO: 234517 - DNA, 25 bp, Mus musculus
catgcttaagctgaagtggtgtgct

SEQ ID NO: 234518 - DNA, 25 bp, Mus musculus
catgcttaaggctctctatctccgc

SEQ ID NO: 234519 - DNA, 25 bp, Mus musculus
catgcttacacatgtgcacatttta

SEQ ID NO: 234520 - DNA, 25 bp, Mus musculus
catgcttcactagaaagaaaaatga

SEQ ID NO: 234521 - DNA, 25 bp, Mus musculus
catgcttcggaaagtccttcaggct

SEQ ID NO: 234522 - DNA, 25 bp, Mus musculus
catgcttctgcccaggtgagaggtg

SEQ ID NO: 234523 - DNA, 25 bp, Mus musculus
catgcttggagtgttcctaactttg

SEQ ID NO: 234524 - DNA, 25 bp, Mus musculus
catgcttgtcatctgagtcaacggt

SEQ ID NO: 234525 - DNA, 25 bp, Mus musculus
catgcttgtgagcatactctcctct

SEQ ID NO: 234526 - DNA, 25 bp, Mus musculus
catgcttgtgaggatactctcctct

SEQ ID NO: 234527 - DNA, 25 bp, Mus musculus
catgctttaccaggaacatttcaga

SEQ ID NO: 234528 - DNA, 25 bp, Mus musculus
catgctttaccaggatatgactgcg

SEQ ID NO: 234529 - DNA, 25 bp, Mus musculus
catgctttagagtgatgatgactgt

SEQ ID NO: 234530 - DNA, 25 bp, Mus musculus
catgctttcagaaattccctgcggt

SEQ ID NO: 234531 - DNA, 25 bp, Mus musculus
catgctttcagaagacctggcggtg

SEQ ID NO: 234532 - DNA, 25 bp, Mus musculus
catgctttcatgagcatgtttttga

SEQ ID NO: 234533 - DNA, 25 bp, Mus musculus
catgctttgatgtcccgcatggttc

SEQ ID NO: 234534 - DNA, 25 bp, Mus musculus
catggaaaagaaaatagatatcacc

SEQ ID NO: 234535 - DNA, 25 bp, Mus musculus
catggaaaagatatcaccagtaaag

SEQ ID NO: 234536 - DNA, 25 bp, Mus musculus
catggaaaagtctaagggcagttta

SEQ ID NO: 234537 - DNA, 25 bp, Mus musculus
catggaaacaggtttaatcttgttc

SEQ ID NO: 234538 - DNA, 25 bp, Mus musculus
catggaaacagtcaccaaggagctg

SEQ ID NO: 234539 - DNA, 25 bp, Mus musculus
catggaaaccagaagcgaatggaag

SEQ ID NO: 234540 - DNA, 25 bp, Mus musculus
catggaaaccagtattgcagcaccc

SEQ ID NO: 234541 - DNA, 25 bp, Mus musculus
catggaaacccagcgctaactgtcc

SEQ ID NO: 234542 - DNA, 25 bp, Mus musculus
catggaaactaaggcattactcatc

SEQ ID NO: 234543 - DNA, 25 bp, Mus musculus
catggaaactaaggctggccttgtg

SEQ ID NO: 234544 - DNA, 25 bp, Mus musculus
catggaaagcaatcactctgtggag

SEQ ID NO: 234545 - DNA, 25 bp, Mus musculus
catggaaaggcatgtataatgcctg

SEQ ID NO: 234546 - DNA, 25 bp, Mus musculus
catggaacaccccatgcttaccgcg

SEQ ID NO: 234547 - DNA, 25 bp, Mus musculus
catggaacaggaggaagtgaacatc

SEQ ID NO: 234548 - DNA, 25 bp, Mus musculus
catggaacaggtgagaggctatgac

SEQ ID NO: 234549 - DNA, 25 bp, Mus musculus
catggaaccagaaaatgagaaaata

SEQ ID NO: 234550 - DNA, 25 bp, Mus musculus
catggaaccagctctgttaaggaag

SEQ ID NO: 234551 - DNA, 25 bp, Mus musculus
catggaacctggcgcccaatgaacc

SEQ ID NO: 234552 - DNA, 25 bp, Mus musculus
catggaacctggcgcggcactccta

SEQ ID NO: 234553 - DNA, 25 bp, Mus musculus
catggaagacagagctgcatgagtg

SEQ ID NO: 234554 - DNA, 25 bp, Mus musculus
catggaagagatctgtgaaggttcc

SEQ ID NO: 234555 - DNA, 25 bp, Mus musculus
catggaagagggtagcacattacgg

SEQ ID NO: 234556 - DNA, 25 bp, Mus musculus
catggaagaggtccagaaagtctgc

SEQ ID NO: 234557 - DNA, 25 bp, Mus musculus
catggaagaggttcaaaccttgtac

SEQ ID NO: 234558 - DNA, 25 bp, Mus musculus
catggaagaggtttattaacaaaac

SEQ ID NO: 234559 - DNA, 25 bp, Mus musculus
catggaagccaaggtgaaagccgcc

SEQ ID NO: 234560 - DNA, 25 bp, Mus musculus
catggaagccgaggtctgcattaca

SEQ ID NO: 234561 - DNA, 25 bp, Mus musculus
catggaaggcatgggtcccgagcat

SEQ ID NO: 234562 - DNA, 25 bp, Mus musculus
catggaaggcctgggagggtaccct

SEQ ID NO: 234563 - DNA, 25 bp, Mus musculus
catggaatcagctgctctgccctgt

SEQ ID NO: 234564 - DNA, 25 bp, Mus musculus
catggaatcaggcggccccctttca

SEQ ID NO: 234565 - DNA, 25 bp, Mus musculus
catggaatcagggtgcgactggacc

SEQ ID NO: 234566 - DNA, 25 bp, Mus musculus
catggaatcaggtgccaacaggctg

SEQ ID NO: 234567 - DNA, 25 bp, Mus musculus
catggaatccacagttgatgatgaa

SEQ ID NO: 234568 - DNA, 25 bp, Mus musculus
catggaatccctttcagaaatcagc

SEQ ID NO: 234569 - DNA, 25 bp, Mus musculus
catggaatccgataaagataaagtt

SEQ ID NO: 234570 - DNA, 25 bp, Mus musculus
catggaattcgtactgcgtttggtt

SEQ ID NO: 234571 - DNA, 25 bp, Mus musculus
catggacaagatgcaatcactgtat

SEQ ID NO: 234572 - DNA, 25 bp, Mus musculus
catggacaagattaatgccgctgct

SEQ ID NO: 234573 - DNA, 25 bp, Mus musculus
catggacaatgaagattacgaacat

SEQ ID NO: 234574 - DNA, 25 bp, Mus musculus
catggacacaggtatacaaggagca

SEQ ID NO: 234575 - DNA, 25 bp, Mus musculus
catggacatagaagggcttggctga

SEQ ID NO: 234576 - DNA, 25 bp, Mus musculus
catggacatccgtggctccattgtc

SEQ ID NO: 234577 - DNA, 25 bp, Mus musculus
catggacatcctgaactactttgag

SEQ ID NO: 234578 - DNA, 25 bp, Mus musculus
catggacatcctgcctccttccttg

SEQ ID NO: 234579 - DNA, 25 bp, Mus musculus
catggacatgatgttgacggcatgg

SEQ ID NO: 234580 - DNA, 25 bp, Mus musculus
catggacatgcacaatatcgccatg

SEQ ID NO: 234581 - DNA, 25 bp, Mus musculus
catggacattgccaagttaaaagga

SEQ ID NO: 234582 - DNA, 25 bp, Mus musculus
catggaccagctgcactatgtgacg

SEQ ID NO: 234583 - DNA, 25 bp, Mus musculus
catggaccatggtggagtttgggag

SEQ ID NO: 234584 - DNA, 25 bp, Mus musculus
catggacccgatagcctcggccctg

SEQ ID NO: 234585 - DNA, 25 bp, Mus musculus
catggacctagtccaaggcggttgg

SEQ ID NO: 234586 - DNA, 25 bp, Mus musculus
catggacgacctgcaactttttgaa

SEQ ID NO: 234587 - DNA, 25 bp, Mus musculus
catggacgagatggcagttgagttt

SEQ ID NO: 234588 - DNA, 25 bp, Mus musculus
catggacggggcatttggcacaata

SEQ ID NO: 234589 - DNA, 25 bp, Mus musculus
catggactagcgagccataaaagag

SEQ ID NO: 234590 - DNA, 25 bp, Mus musculus
catggactagcggcctggtctcagc

SEQ ID NO: 234591 - DNA, 25 bp, Mus musculus
catggactagcgtttcaggcctggt

SEQ ID NO: 234592 - DNA, 25 bp, Mus musculus
catggactatgccctcagctggggc

SEQ ID NO: 234593 - DNA, 25 bp, Mus musculus
catggacttggcatctgggtgtttg

SEQ ID NO: 234594 - DNA, 25 bp, Mus musculus
catggacttgggaacacaccagtgg

SEQ ID NO: 234595 - DNA, 25 bp, Mus musculus
catggactttggaggacagaaaaat

SEQ ID NO: 234596 - DNA, 25 bp, Mus musculus
catggactttggagtctgaatatgc

SEQ ID NO: 234597 - DNA, 25 bp, Mus musculus
catggagaaaacctgaagactgagc

SEQ ID NO: 234598 - DNA, 25 bp, Mus musculus
catggagaacaggtgcttttacaac

SEQ ID NO: 234599 - DNA, 25 bp, Mus musculus
catggagaacgagagtctccatcat

SEQ ID NO: 234600 - DNA, 25 bp, Mus musculus
catggagaacgagcctggaattgtg

SEQ ID NO: 234601 - DNA, 25 bp, Mus musculus
catggagaacttcttaacatatgac

SEQ ID NO: 234602 - DNA, 25 bp, Mus musculus
catggagaatatccggagacaaacc

SEQ ID NO: 234603 - DNA, 25 bp, Mus musculus
catggagacgatctatgacatgctg

SEQ ID NO: 234604 - DNA, 25 bp, Mus musculus
catggagagggctcctcgctgttaa

SEQ ID NO: 234605 - DNA, 25 bp, Mus musculus
catggagatggagcagttgaccttc

SEQ ID NO: 234606 - DNA, 25 bp, Mus musculus
catggagcaggtgcaccgtggcatt

SEQ ID NO: 234607 - DNA, 25 bp, Mus musculus
catggagcagttaacgcggggggac

SEQ ID NO: 234608 - DNA, 25 bp, Mus musculus
catggagccagaccactcggccctg

SEQ ID NO: 234609 - DNA, 25 bp, Mus musculus
catggagcgatggttgtcggtgcct

SEQ ID NO: 234610 - DNA, 25 bp, Mus musculus
catggagcgatgtacctgacctctg

SEQ ID NO: 234611 - DNA, 25 bp, Mus musculus
catggagcgatgtggacagaagtac

SEQ ID NO: 234612 - DNA, 25 bp, Mus musculus
catggagcggagcctctctgccttt

SEQ ID NO: 234613 - DNA, 25 bp, Mus musculus
catggagcggaggtctcattgggag

SEQ ID NO: 234614 - DNA, 25 bp, Mus musculus
catggagctctttctacctccagtg

SEQ ID NO: 234615 - DNA, 25 bp, Mus musculus
catggaggaagacagggttccagtg

SEQ ID NO: 234616 - DNA, 25 bp, Mus musculus
catggaggaatgtctataacaataa

SEQ ID NO: 234617 - DNA, 25 bp, Mus musculus
catggaggaggagagtataaaggag

SEQ ID NO: 234618 - DNA, 25 bp, Mus musculus
catggaggaggattgtccggagcag

SEQ ID NO: 234619 - DNA, 25 bp, Mus musculus
catggaggaggctacgcaagggcag

SEQ ID NO: 234620 - DNA, 25 bp, Mus musculus
catggaggaggggccttcatgatcc

SEQ ID NO: 234621 - DNA, 25 bp, Mus musculus
catggaggaggtgcggcggcagcac

SEQ ID NO: 234622 - DNA, 25 bp, Mus musculus
catggaggccggagaggagccgctg

SEQ ID NO: 234623 - DNA, 25 bp, Mus musculus
catggagtaactgagttggcagata

SEQ ID NO: 234624 - DNA, 25 bp, Mus musculus
catggagtacaggatcaataagcca

SEQ ID NO: 234625 - DNA, 25 bp, Mus musculus
catggagtacgtgtttgactacgag

SEQ ID NO: 234626 - DNA, 25 bp, Mus musculus
catggagtatacaaaaaagcctgag

SEQ ID NO: 234627 - DNA, 25 bp, Mus musculus
catggagtatcaggatgctgtgcgc

SEQ ID NO: 234628 - DNA, 25 bp, Mus musculus
catggagttaagcacggaaataacc

SEQ ID NO: 234629 - DNA, 25 bp, Mus musculus
catggagttaagtggctaaaagcca

SEQ ID NO: 234630 - DNA, 25 bp, Mus musculus
catggagtttaaagatgtcattgtc

SEQ ID NO: 234631 - DNA, 25 bp, Mus musculus
catggagtttaaagtgtcgtgttct

SEQ ID NO: 234632 - DNA, 25 bp, Mus musculus
catggataaaggtgctggagagtct

SEQ ID NO: 234633 - DNA, 25 bp, Mus musculus
catggatacaatgagcagcacctcc

SEQ ID NO: 234634 - DNA, 25 bp, Mus musculus
catggatatgaggtccagagattca

SEQ ID NO: 234635 - DNA, 25 bp, Mus musculus
catggatcaggaagatcctggcccg

SEQ ID NO: 234636 - DNA, 25 bp, Mus musculus
catggatctgcctgcgatctagggc

SEQ ID NO: 234637 - DNA, 25 bp, Mus musculus
catggatctgcctggtacaactgta

SEQ ID NO: 234638 - DNA, 25 bp, Mus musculus
catggatctggtgtgagtgttgagt

SEQ ID NO: 234639 - DNA, 25 bp, Mus musculus
catggatctttgggcttgtgatgcc

SEQ ID NO: 234640 - DNA, 25 bp, Mus musculus
catggatctttgggtctgaacggga

SEQ ID NO: 234641 - DNA, 25 bp, Mus musculus
catggatgaaacagcatcaaaagac

SEQ ID NO: 234642 - DNA, 25 bp, Mus musculus
catggatgaagaactcgacagcccg

SEQ ID NO: 234643 - DNA, 25 bp, Mus musculus
catggatgaattgaagccccacagg

SEQ ID NO: 234644 - DNA, 25 bp, Mus musculus
catggatgaatttgctggactcttg

SEQ ID NO: 234645 - DNA, 25 bp, Mus musculus
catggatgctgtgtccaccacggcc

SEQ ID NO: 234646 - DNA, 25 bp, Mus musculus
catggatggagggatcgcttacact

SEQ ID NO: 234647 - DNA, 25 bp, Mus musculus
catggatggagtgacggatgacgac

SEQ ID NO: 234648 - DNA, 25 bp, Mus musculus
catggatgtccagctggctaacctc

SEQ ID NO: 234649 - DNA, 25 bp, Mus musculus
catggatgttggcaaggcccgaggc

SEQ ID NO: 234650 - DNA, 25 bp, Mus musculus
catggattacaagactccactgcaa

SEQ ID NO: 234651 - DNA, 25 bp, Mus musculus
catggattaccatctagatgttggc

SEQ ID NO: 234652 - DNA, 25 bp, Mus musculus
catggattcactagggaaggaaaag

SEQ ID NO: 234653 - DNA, 25 bp, Mus musculus
catggattcagaaaattaatgagtt

SEQ ID NO: 234654 - DNA, 25 bp, Mus musculus
catggattcagagtccagaactttc

SEQ ID NO: 234655 - DNA, 25 bp, Mus musculus
catggattctgattgtggaagctta

SEQ ID NO: 234656 - DNA, 25 bp, Mus musculus
catggattcttggcacttgatgcac

SEQ ID NO: 234657 - DNA, 25 bp, Mus musculus
catggattggcttccaggaggcagg

SEQ ID NO: 234658 - DNA, 25 bp, Mus musculus
catggattttaaaaggaaacagaca

SEQ ID NO: 234659 - DNA, 25 bp, Mus musculus
catggcaaaagatgccagtctaatt

SEQ ID NO: 234660 - DNA, 25 bp, Mus musculus
catggcaaaagatgtgtggtatctc

SEQ ID NO: 234661 - DNA, 25 bp, Mus musculus
catggcaacagactccaagccccct

SEQ ID NO: 234662 - DNA, 25 bp, Mus musculus
catggcaacaggtttatggtcggct

SEQ ID NO: 234663 - DNA, 25 bp, Mus musculus
catggcaatgggctacaggggaaga

SEQ ID NO: 234664 - DNA, 25 bp, Mus musculus
catggcaatgtccaggaccgcattg

SEQ ID NO: 234665 - DNA, 25 bp, Mus musculus
catggcaatttcaaggcaactttcc

SEQ ID NO: 234666 - DNA, 25 bp, Mus musculus
catggcacagagaagccatcctggc

SEQ ID NO: 234667 - DNA, 25 bp, Mus musculus
catggcaccaggattttaattcctg

SEQ ID NO: 234668 - DNA, 25 bp, Mus musculus
catggcacccaggcacggagggagt

SEQ ID NO: 234669 - DNA, 25 bp, Mus musculus
catggcacccaggcgcgaagggagc

SEQ ID NO: 234670 - DNA, 25 bp, Mus musculus
catggcacccaggtacgcagggaat

SEQ ID NO: 234671 - DNA, 25 bp, Mus musculus
catggcactgggtggtgaaagtgaa

SEQ ID NO: 234672 - DNA, 25 bp, Mus musculus
catggcagagcacctgacccagcct

SEQ ID NO: 234673 - DNA, 25 bp, Mus musculus
catggcagagcgatggcagcacctg

SEQ ID NO: 234674 - DNA, 25 bp, Mus musculus
catggcagaggctcctcttccagag

SEQ ID NO: 234675 - DNA, 25 bp, Mus musculus
catggcagcaaacccctccccctcc

SEQ ID NO: 234676 - DNA, 25 bp, Mus musculus
catggcagcaaagatccctccccgc

SEQ ID NO: 234677 - DNA, 25 bp, Mus musculus
catggcagcagcttctaggtgcgcc

SEQ ID NO: 234678 - DNA, 25 bp, Mus musculus
catggcaggcagtgtggattgtctg

SEQ ID NO: 234679 - DNA, 25 bp, Mus musculus
catggcaggggagtcctcatggaaa

SEQ ID NO: 234680 - DNA, 25 bp, Mus musculus
catggcagtgaagcggatacgggcc

SEQ ID NO: 234681 - DNA, 25 bp, Mus musculus
catggcagttgcgggagtgggaggt

SEQ ID NO: 234682 - DNA, 25 bp, Mus musculus
catggcatcagaacggggctcttta

SEQ ID NO: 234683 - DNA, 25 bp, Mus musculus
catggcatcaggacgggcctcttca

SEQ ID NO: 234684 - DNA, 25 bp, Mus musculus
catggccaagatggagttccagaag

SEQ ID NO: 234685 - DNA, 25 bp, Mus musculus
catggccaaggaaaattgtccagcg

SEQ ID NO: 234686 - DNA, 25 bp, Mus musculus
catggccaagggactaaagaagatg

SEQ ID NO: 234687 - DNA, 25 bp, Mus musculus
catggccactgtggcctcctgagtg

SEQ ID NO: 234688 - DNA, 25 bp, Mus musculus
catggccactgtggtctctgtgatg

SEQ ID NO: 234689 - DNA, 25 bp, Mus musculus
catggccagtaactctgaatgtgaa

SEQ ID NO: 234690 - DNA, 25 bp, Mus musculus
catggccatccagaagcctccccag

SEQ ID NO: 234691 - DNA, 25 bp, Mus musculus
catggcccgtattcggaaactaagg

SEQ ID NO: 234692 - DNA, 25 bp, Mus musculus
catggcccgtgatgcttcatttcta

SEQ ID NO: 234693 - DNA, 25 bp, Mus musculus
catggcccgtgtgtcagtggtgttc

SEQ ID NO: 234694 - DNA, 25 bp, Mus musculus
catggccctggggctgggtccttgg

SEQ ID NO: 234695 - DNA, 25 bp, Mus musculus
catggccgaccgcattccagaggat

SEQ ID NO: 234696 - DNA, 25 bp, Mus musculus
catggccggagcagagtctggccac

SEQ ID NO: 234697 - DNA, 25 bp, Mus musculus
catggcctaccagagcaatttttat

SEQ ID NO: 234698 - DNA, 25 bp, Mus musculus
catggcctcagaagctcgaagcggt

SEQ ID NO: 234699 - DNA, 25 bp, Mus musculus
catggcctcagcaatgtgaagctga

SEQ ID NO: 234700 - DNA, 25 bp, Mus musculus
catggcctcaggtggcccggcagat

SEQ ID NO: 234701 - DNA, 25 bp, Mus musculus
catggcctttaagcctggaaaggaa

SEQ ID NO: 234702 - DNA, 25 bp, Mus musculus
catggcctttcaggtgatctgtctg

SEQ ID NO: 234703 - DNA, 25 bp, Mus musculus
catggcctttttgcctccagcgtct

SEQ ID NO: 234704 - DNA, 25 bp, Mus musculus
catggcgaaccaggtgatcaggtgt

SEQ ID NO: 234705 - DNA, 25 bp, Mus musculus
catggcgaaggaggatgaggaacct

SEQ ID NO: 234706 - DNA, 25 bp, Mus musculus
catggcgaaggagggtggccggact

SEQ ID NO: 234707 - DNA, 25 bp, Mus musculus
catggcgacagaaaggaatcccaat

SEQ ID NO: 234708 - DNA, 25 bp, Mus musculus
catggcgaccagtacaaggccacag

SEQ ID NO: 234709 - DNA, 25 bp, Mus musculus
catggcgacctggtgactccatacc

SEQ ID NO: 234710 - DNA, 25 bp, Mus musculus
catggcgcctgtgaaaaagcttgtg

SEQ ID NO: 234711 - DNA, 25 bp, Mus musculus
catggcgctccagactgtacccaca

SEQ ID NO: 234712 - DNA, 25 bp, Mus musculus
catggcgctccagaggctggaggag

SEQ ID NO: 234713 - DNA, 25 bp, Mus musculus
catggcgctccagggacctctgagc

SEQ ID NO: 234714 - DNA, 25 bp, Mus musculus
catggcgctccaggtgcccatcagc

SEQ ID NO: 234715 - DNA, 25 bp, Mus musculus
catggcggctctacagccagaatgt

SEQ ID NO: 234716 - DNA, 25 bp, Mus musculus
catggcggctctaggctccagcagc

SEQ ID NO: 234717 - DNA, 25 bp, Mus musculus
catggcggctgggaccctgtacaca

SEQ ID NO: 234718 - DNA, 25 bp, Mus musculus
catggcgtcgccggggatagaagtg

SEQ ID NO: 234719 - DNA, 25 bp, Mus musculus
catggctaacccaggaactggtgct

SEQ ID NO: 234720 - DNA, 25 bp, Mus musculus
catggctactggggatgcacaaaaa

SEQ ID NO: 234721 - DNA, 25 bp, Mus musculus
catggctactggttcaagatggctt

SEQ ID NO: 234722 - DNA, 25 bp, Mus musculus
catggctagctcgtgtgccgtgcag

SEQ ID NO: 234723 - DNA, 25 bp, Mus musculus
catggctatactgatcatttcaatg

SEQ ID NO: 234724 - DNA, 25 bp, Mus musculus
catggctattgagcatgcaccattg

SEQ ID NO: 234725 - DNA, 25 bp, Mus musculus
catggctcactggtcctgcgactgg

SEQ ID NO: 234726 - DNA, 25 bp, Mus musculus
catggctcagactccgtggtttccg

SEQ ID NO: 234727 - DNA, 25 bp, Mus musculus
catggctcagcaagcttccctgcta

SEQ ID NO: 234728 - DNA, 25 bp, Mus musculus
catggctcagcaagcttccctggca

SEQ ID NO: 234729 - DNA, 25 bp, Mus musculus
catggctcaggaattttattgagct

SEQ ID NO: 234730 - DNA, 25 bp, Mus musculus
catggctcaggcaagtcttctggct

SEQ ID NO: 234731 - DNA, 25 bp, Mus musculus
catggctccctgcatgtacccctca

SEQ ID NO: 234732 - DNA, 25 bp, Mus musculus
catggctcgcaggtttgcctgcaat

SEQ ID NO: 234733 - DNA, 25 bp, Mus musculus
catggctctgcaggtagccagaaat

SEQ ID NO: 234734 - DNA, 25 bp, Mus musculus
catggctctggggttggttctggac

SEQ ID NO: 234735 - DNA, 25 bp, Mus musculus
catggctgacacgcttccaggtccg

SEQ ID NO: 234736 - DNA, 25 bp, Mus musculus
catggctgacacggtccgaggagac

SEQ ID NO: 234737 - DNA, 25 bp, Mus musculus
catggctgagactctgaagactctg

SEQ ID NO: 234738 - DNA, 25 bp, Mus musculus
catggctgagcctttcagtgctacg

SEQ ID NO: 234739 - DNA, 25 bp, Mus musculus
catggctgagtgctacggagcccaa

SEQ ID NO: 234740 - DNA, 25 bp, Mus musculus
catggctgcaagaaaatgccagaaa

SEQ ID NO: 234741 - DNA, 25 bp, Mus musculus
catggctgcgtttgagcctgagcct

SEQ ID NO: 234742 - DNA, 25 bp, Mus musculus
catggctggaggggatgccaacaag

SEQ ID NO: 234743 - DNA, 25 bp, Mus musculus
catggctggaggggtgatggtaatg

SEQ ID NO: 234744 - DNA, 25 bp, Mus musculus
catggctggcaatgtccacagacaa

SEQ ID NO: 234745 - DNA, 25 bp, Mus musculus
catggctggtccatcctctggaccg

SEQ ID NO: 234746 - DNA, 25 bp, Mus musculus
catggctgtgtgattgatcctgtta

SEQ ID NO: 234747 - DNA, 25 bp, Mus musculus
catggcttaaaagagtctcccccac

SEQ ID NO: 234748 - DNA, 25 bp, Mus musculus
catggcttaaaagccgaagaagcag

SEQ ID NO: 234749 - DNA, 25 bp, Mus musculus
catggcttaaaagctcgtgtggcca

SEQ ID NO: 234750 - DNA, 25 bp, Mus musculus
catggcttaaacgccataacccaga

SEQ ID NO: 234751 - DNA, 25 bp, Mus musculus
catggcttcaggttgatatcaaaat

SEQ ID NO: 234752 - DNA, 25 bp, Mus musculus
catggcttcctgcggcagagagtac

SEQ ID NO: 234753 - DNA, 25 bp, Mus musculus
catggcttgctgaagctcaggtacc

SEQ ID NO: 234754 - DNA, 25 bp, Mus musculus
catggcttgctgaagtggcttttca

SEQ ID NO: 234755 - DNA, 25 bp, Mus musculus
catggctttacaggaaatctgacgt

SEQ ID NO: 234756 - DNA, 25 bp, Mus musculus
catggcttttgcaggtctgacagcg

SEQ ID NO: 234757 - DNA, 25 bp, Mus musculus
catgggaaacctgaatctgtatcga

SEQ ID NO: 234758 - DNA, 25 bp, Mus musculus
catgggaaggagctgtcagtagaag

SEQ ID NO: 234759 - DNA, 25 bp, Mus musculus
catgggaaggatgggtaacaaagga

SEQ ID NO: 234760 - DNA, 25 bp, Mus musculus
catgggaaggatgtcctttcaacag

SEQ ID NO: 234761 - DNA, 25 bp, Mus musculus
catgggaatctgatccgctgtactc

SEQ ID NO: 234762 - DNA, 25 bp, Mus musculus
catgggacagaagggtgaccagggc

SEQ ID NO: 234763 - DNA, 25 bp, Mus musculus
catgggacaggtgaacacctttatg

SEQ ID NO: 234764 - DNA, 25 bp, Mus musculus
catgggacatgccaggtcctacatc

SEQ ID NO: 234765 - DNA, 25 bp, Mus musculus
catgggaccggtccaacgggcgctc

SEQ ID NO: 234766 - DNA, 25 bp, Mus musculus
catgggactaggatgatgtctacag

SEQ ID NO: 234767 - DNA, 25 bp, Mus musculus
catgggactggagggtgacagaaga

SEQ ID NO: 234768 - DNA, 25 bp, Mus musculus
catgggacttaatttgagcataagg

SEQ ID NO: 234769 - DNA, 25 bp, Mus musculus
catgggagatgagaaattatgcttc

SEQ ID NO: 234770 - DNA, 25 bp, Mus musculus
catgggaggaagggagatataaaca

SEQ ID NO: 234771 - DNA, 25 bp, Mus musculus
catgggatacaaagtcctctcagca

SEQ ID NO: 234772 - DNA, 25 bp, Mus musculus
catgggatacaagaacaatttttat

SEQ ID NO: 234773 - DNA, 25 bp, Mus musculus
catgggatacatgccttctgccagc

SEQ ID NO: 234774 - DNA, 25 bp, Mus musculus
catgggatagacaagaacggagagc

SEQ ID NO: 234775 - DNA, 25 bp, Mus musculus
catgggatatgaggtgcagcagaaa

SEQ ID NO: 234776 - DNA, 25 bp, Mus musculus
catgggatggagagtctgtattgtc

SEQ ID NO: 234777 - DNA, 25 bp, Mus musculus
catgggatgggaaaggtgactctgg

SEQ ID NO: 234778 - DNA, 25 bp, Mus musculus
catgggatgggggacagctgttgta

SEQ ID NO: 234779 - DNA, 25 bp, Mus musculus
catgggatttcaggataacctcttt

SEQ ID NO: 234780 - DNA, 25 bp, Mus musculus
catgggcaaaggaagatttgatgaa

SEQ ID NO: 234781 - DNA, 25 bp, Mus musculus
catgggcaaatcaggaaaggatgtg

SEQ ID NO: 234782 - DNA, 25 bp, Mus musculus
catgggcaacgctggacgtaaagaa

SEQ ID NO: 234783 - DNA, 25 bp, Mus musculus
catgggcaatgacacgtccccatct

SEQ ID NO: 234784 - DNA, 25 bp, Mus musculus
catgggcacagtgaccccagttttg

SEQ ID NO: 234785 - DNA, 25 bp, Mus musculus
catgggcagacacagccctggacca

SEQ ID NO: 234786 - DNA, 25 bp, Mus musculus
catgggcagaggtatatgtggttgc

SEQ ID NO: 234787 - DNA, 25 bp, Mus musculus
catgggcccgattgacgacagtgtg

SEQ ID NO: 234788 - DNA, 25 bp, Mus musculus
catgggcgagacacattgcgctggc

SEQ ID NO: 234789 - DNA, 25 bp, Mus musculus
catgggcgagtgcggtttcgtggtg

SEQ ID NO: 234790 - DNA, 25 bp, Mus musculus
catgggcgtgcggattgtcgcagca

SEQ ID NO: 234791 - DNA, 25 bp, Mus musculus
catgggctacatgccctcagccagc

SEQ ID NO: 234792 - DNA, 25 bp, Mus musculus
catgggctacatggcctcttcctgc

SEQ ID NO: 234793 - DNA, 25 bp, Mus musculus
catgggctacattgcacacttgaag

SEQ ID NO: 234794 - DNA, 25 bp, Mus musculus
catgggctcccggccccgtggggcg

SEQ ID NO: 234795 - DNA, 25 bp, Mus musculus
catgggctctttgggtatgtgcagc

SEQ ID NO: 234796 - DNA, 25 bp, Mus musculus
catgggcttcactggtaaacaggtg

SEQ ID NO: 234797 - DNA, 25 bp, Mus musculus
catgggcttgtcaaaccagtccagt

SEQ ID NO: 234798 - DNA, 25 bp, Mus musculus
catggggaaaagtgcgcaaacttct

SEQ ID NO: 234799 - DNA, 25 bp, Mus musculus
catggggagagagggcaatgcgagc

SEQ ID NO: 234800 - DNA, 25 bp, Mus musculus
catggggagcccaggtccggtgagc

SEQ ID NO: 234801 - DNA, 25 bp, Mus musculus
catggggagtttgagatcccactga

SEQ ID NO: 234802 - DNA, 25 bp, Mus musculus
catggggcagccaggctggggatga

SEQ ID NO: 234803 - DNA, 25 bp, Mus musculus
catggggcagccagtcttcctgtcc

SEQ ID NO: 234804 - DNA, 25 bp, Mus musculus
catggggcaggcagtgacgcgccgc

SEQ ID NO: 234805 - DNA, 25 bp, Mus musculus
catggggcctttagatgggaaagtt

SEQ ID NO: 234806 - DNA, 25 bp, Mus musculus
catggggtatttcagggattctcct

SEQ ID NO: 234807 - DNA, 25 bp, Mus musculus
catggggtttttcaggatgccacag

SEQ ID NO: 234808 - DNA, 25 bp, Mus musculus
catgggtacaagggcaagctccaga

SEQ ID NO: 234809 - DNA, 25 bp, Mus musculus
catgggtattggtccagaacacagc

SEQ ID NO: 234810 - DNA, 25 bp, Mus musculus
catgggtattggtccagtccctgct

SEQ ID NO: 234811 - DNA, 25 bp, Mus musculus
catgggtcaggttttctactattca

SEQ ID NO: 234812 - DNA, 25 bp, Mus musculus
catgggtgatgctggggagatggtg

SEQ ID NO: 234813 - DNA, 25 bp, Mus musculus
catgggtggccatgggaaatggagc

SEQ ID NO: 234814 - DNA, 25 bp, Mus musculus
catgggtggccatgtgcccagcccc

SEQ ID NO: 234815 - DNA, 25 bp, Mus musculus
catgggtttcaagcctggggaaaaa

SEQ ID NO: 234816 - DNA, 25 bp, Mus musculus
catgggtttcaagtcttgtgatgga

SEQ ID NO: 234817 - DNA, 25 bp, Mus musculus
catgggtttgtcaaaccagtccagt

SEQ ID NO: 234818 - DNA, 25 bp, Mus musculus
catggtaaagggaatgcagtggtgt

SEQ ID NO: 234819 - DNA, 25 bp, Mus musculus
catggtaacaggcctgatggaatcg

SEQ ID NO: 234820 - DNA, 25 bp, Mus musculus
catggtaacagtcaacaaatgcatg

SEQ ID NO: 234821 - DNA, 25 bp, Mus musculus
catggtactgctgtattttcatctg

SEQ ID NO: 234822 - DNA, 25 bp, Mus musculus
catggtagaaagatctaaaggggtg

SEQ ID NO: 234823 - DNA, 25 bp, Mus musculus
catggtagaaaggcctttgtagatt

SEQ ID NO: 234824 - DNA, 25 bp, Mus musculus
catggtagaagtctttatagatacc

SEQ ID NO: 234825 - DNA, 25 bp, Mus musculus
catggtagattacgctcacaacaac

SEQ ID NO: 234826 - DNA, 25 bp, Mus musculus
catggtagccccagaacccatgtga

SEQ ID NO: 234827 - DNA, 25 bp, Mus musculus
catggtagccccagataaggaatat

SEQ ID NO: 234828 - DNA, 25 bp, Mus musculus
catggtagttacagccaacggtaac

SEQ ID NO: 234829 - DNA, 25 bp, Mus musculus
catggtagttacaggtcataaaagg

SEQ ID NO: 234830 - DNA, 25 bp, Mus musculus
catggtataaggatgacatcgttct

SEQ ID NO: 234831 - DNA, 25 bp, Mus musculus
catggtatccacatgggtctcctgg

SEQ ID NO: 234832 - DNA, 25 bp, Mus musculus
catggtcaagacgtccgtcctcgtg

SEQ ID NO: 234833 - DNA, 25 bp, Mus musculus
catggtcacacaaagaaacaggtat

SEQ ID NO: 234834 - DNA, 25 bp, Mus musculus
catggtcacacaaaggtatgtgatg

SEQ ID NO: 234835 - DNA, 25 bp, Mus musculus
catggtcagcaatggggctggagag

SEQ ID NO: 234836 - DNA, 25 bp, Mus musculus
catggtcagcaatgggttcagacct

SEQ ID NO: 234837 - DNA, 25 bp, Mus musculus
catggtcatcggaaattaccggacg

SEQ ID NO: 234838 - DNA, 25 bp, Mus musculus
catggtcatcggcaactatcgaact

SEQ ID NO: 234839 - DNA, 25 bp, Mus musculus
catggtcccgggtgaacagagtatc

SEQ ID NO: 234840 - DNA, 25 bp, Mus musculus
catggtcctagtcaagagaatccat

SEQ ID NO: 234841 - DNA, 25 bp, Mus musculus
catggtcgttggccagagtggactg

SEQ ID NO: 234842 - DNA, 25 bp, Mus musculus
catggtctagagctttatggatttc

SEQ ID NO: 234843 - DNA, 25 bp, Mus musculus
catggtctcttcccatacatggcct

SEQ ID NO: 234844 - DNA, 25 bp, Mus musculus
catggtctgtggaatgtgacaaacg

SEQ ID NO: 234845 - DNA, 25 bp, Mus musculus
catggtgaacgcttctagggaccta

SEQ ID NO: 234846 - DNA, 25 bp, Mus musculus
catggtgaacgggacctattaaaag

SEQ ID NO: 234847 - DNA, 25 bp, Mus musculus
catggtgaagagcaggtatctcaga

SEQ ID NO: 234848 - DNA, 25 bp, Mus musculus
catggtgaagatttacccaataaag

SEQ ID NO: 234849 - DNA, 25 bp, Mus musculus
catggtgaagctaatctggaaatgg

SEQ ID NO: 234850 - DNA, 25 bp, Mus musculus
catggtgaaggaagatgaggctcgc

SEQ ID NO: 234851 - DNA, 25 bp, Mus musculus
catggtgaaggacacatcttacctg

SEQ ID NO: 234852 - DNA, 25 bp, Mus musculus
catggtgaagggaatgtacggcatt

SEQ ID NO: 234853 - DNA, 25 bp, Mus musculus
catggtgaaggtgtttagctctgag

SEQ ID NO: 234854 - DNA, 25 bp, Mus musculus
catggtgacagtccctctgaggctc

SEQ ID NO: 234855 - DNA, 25 bp, Mus musculus
catggtgacatggtcccggaagatg

SEQ ID NO: 234856 - DNA, 25 bp, Mus musculus
catggtgactgatggtggaatgtac

SEQ ID NO: 234857 - DNA, 25 bp, Mus musculus
catggtgagcaagttgagctctgag

SEQ ID NO: 234858 - DNA, 25 bp, Mus musculus
catggtgagtcatctccatccacgt

SEQ ID NO: 234859 - DNA, 25 bp, Mus musculus
catggtgcagtaccatgcactagga

SEQ ID NO: 234860 - DNA, 25 bp, Mus musculus
catggtgcagtctgttgtctactgc

SEQ ID NO: 234861 - DNA, 25 bp, Mus musculus
catggtgcagtgctgttgaattttc

SEQ ID NO: 234862 - DNA, 25 bp, Mus musculus
catggtgcagtggtggagcaaagcc

SEQ ID NO: 234863 - DNA, 25 bp, Mus musculus
catggtggagcactacaccaaggac

SEQ ID NO: 234864 - DNA, 25 bp, Mus musculus
catggtggagctggctggctactcg

SEQ ID NO: 234865 - DNA, 25 bp, Mus musculus
catggtggatttaggagaggatgaa

SEQ ID NO: 234866 - DNA, 25 bp, Mus musculus
catggtggccaaggttccctaccgc

SEQ ID NO: 234867 - DNA, 25 bp, Mus musculus
catggtggccgacaaagttccacag

SEQ ID NO: 234868 - DNA, 25 bp, Mus musculus
catggtggctctcagcttgcagaca

SEQ ID NO: 234869 - DNA, 25 bp, Mus musculus
catggtggctctcaggagcgcggcc

SEQ ID NO: 234870 - DNA, 25 bp, Mus musculus
catggtgggacagggcaagaccgtg

SEQ ID NO: 234871 - DNA, 25 bp, Mus musculus
catggtggtctccgggttctgcagg

SEQ ID NO: 234872 - DNA, 25 bp, Mus musculus
catggtgtgaggggtcccacagagg

SEQ ID NO: 234873 - DNA, 25 bp, Mus musculus
catggtgttatcaagctgaggattg

SEQ ID NO: 234874 - DNA, 25 bp, Mus musculus
catggtgtttaaggccaagcatctg

SEQ ID NO: 234875 - DNA, 25 bp, Mus musculus
catggttaaccagagtcctggatgc

SEQ ID NO: 234876 - DNA, 25 bp, Mus musculus
catggttaataatgatgctgtggtt

SEQ ID NO: 234877 - DNA, 25 bp, Mus musculus
catggttcataccaggttgtaagca

SEQ ID NO: 234878 - DNA, 25 bp, Mus musculus
catggttctgggggcaaactggaag

SEQ ID NO: 234879 - DNA, 25 bp, Mus musculus
catggttgcaggtctgcaataattt

SEQ ID NO: 234880 - DNA, 25 bp, Mus musculus
catggttggcaggtgaatttggaag

SEQ ID NO: 234881 - DNA, 25 bp, Mus musculus
catggtttaacttattagtacttgt

SEQ ID NO: 234882 - DNA, 25 bp, Mus musculus
catgtaaaaagatggatcagtttga

SEQ ID NO: 234883 - DNA, 25 bp, Mus musculus
catgtaagcagctgtccggcagaga

SEQ ID NO: 234884 - DNA, 25 bp, Mus musculus
catgtaagttaccatgcctgtctcc

SEQ ID NO: 234885 - DNA, 25 bp, Mus musculus
catgtaataaaaagaagctgaagtc

SEQ ID NO: 234886 - DNA, 25 bp, Mus musculus
catgtaataaaaagatgccagcaga

SEQ ID NO: 234887 - DNA, 25 bp, Mus musculus
catgtacaacagaatgaccagtgcc

SEQ ID NO: 234888 - DNA, 25 bp, Mus musculus
catgtacaaggactcacacacgaga

SEQ ID NO: 234889 - DNA, 25 bp, Mus musculus
catgtacactaaggtaagaaatcca

SEQ ID NO: 234890 - DNA, 25 bp, Mus musculus
catgtacactaggaagtcagaggca

SEQ ID NO: 234891 - DNA, 25 bp, Mus musculus
catgtacatatgaaacctgccatat

SEQ ID NO: 234892 - DNA, 25 bp, Mus musculus
catgtacatatggtcgaccccatcc

SEQ ID NO: 234893 - DNA, 25 bp, Mus musculus
catgtaccaaggagacaaaattcta

SEQ ID NO: 234894 - DNA, 25 bp, Mus musculus
catgtaccaagtgtccccaaggaat

SEQ ID NO: 234895 - DNA, 25 bp, Mus musculus
catgtacccaagagttgtcttggac

SEQ ID NO: 234896 - DNA, 25 bp, Mus musculus
catgtacgagctggtggtgattttt

SEQ ID NO: 234897 - DNA, 25 bp, Mus musculus
catgtacgcaaaataataggaagaa

SEQ ID NO: 234898 - DNA, 25 bp, Mus musculus
catgtacgcaaaatagttgaaaaac

SEQ ID NO: 234899 - DNA, 25 bp, Mus musculus
catgtacgccaagaaatccaggaag

SEQ ID NO: 234900 - DNA, 25 bp, Mus musculus
catgtactaagacctgttcccgtct

SEQ ID NO: 234901 - DNA, 25 bp, Mus musculus
catgtactaagggatacagtggaat

SEQ ID NO: 234902 - DNA, 25 bp, Mus musculus
catgtactaaggtatacagttttgc

SEQ ID NO: 234903 - DNA, 25 bp, Mus musculus
catgtactaagtttccccctgctct

SEQ ID NO: 234904 - DNA, 25 bp, Mus musculus
catgtagaaacgaaacgttgacaaa

SEQ ID NO: 234905 - DNA, 25 bp, Mus musculus
catgtagagcaaggaaagaccgtag

SEQ ID NO: 234906 - DNA, 25 bp, Mus musculus
catgtagatatggcagacgaggcat

SEQ ID NO: 234907 - DNA, 25 bp, Mus musculus
catgtagccgcctcaaacatgtcct

SEQ ID NO: 234908 - DNA, 25 bp, Mus musculus
catgtagggagcaacatcctttgta

SEQ ID NO: 234909 - DNA, 25 bp, Mus musculus
catgtagggagtatgaaggtcaaaa

SEQ ID NO: 234910 - DNA, 25 bp, Mus musculus
catgtagtgaggacagtagaatttt

SEQ ID NO: 234911 - DNA, 25 bp, Mus musculus
catgtagtgaggcagcagagtgaag

SEQ ID NO: 234912 - DNA, 25 bp, Mus musculus
catgtataaagatgtggtgaaggct

SEQ ID NO: 234913 - DNA, 25 bp, Mus musculus
catgtataaagttctagatgtggtg

SEQ ID NO: 234914 - DNA, 25 bp, Mus musculus
catgtatatcagacactgtcctgtt

SEQ ID NO: 234915 - DNA, 25 bp, Mus musculus
catgtatatccacagtcaagccctg

SEQ ID NO: 234916 - DNA, 25 bp, Mus musculus
catgtatccaaaagaaatccagaga

SEQ ID NO: 234917 - DNA, 25 bp, Mus musculus
catgtatccaaaagcaaatttcgca

SEQ ID NO: 234918 - DNA, 25 bp, Mus musculus
catgtatccagaggatgttgggcag

SEQ ID NO: 234919 - DNA, 25 bp, Mus musculus
catgtatgagctggatagagagatg

SEQ ID NO: 234920 - DNA, 25 bp, Mus musculus
catgtatgccaagagcaagaaagta

SEQ ID NO: 234921 - DNA, 25 bp, Mus musculus
catgtatgccaagaggaataaaagg

SEQ ID NO: 234922 - DNA, 25 bp, Mus musculus
catgtatgccagcatgtctgattgc

SEQ ID NO: 234923 - DNA, 25 bp, Mus musculus
catgtatggcaaggatttaattaaa

SEQ ID NO: 234924 - DNA, 25 bp, Mus musculus
catgtatggcaaggctggccttcta

SEQ ID NO: 234925 - DNA, 25 bp, Mus musculus
catgtattccagcatccagaattca

SEQ ID NO: 234926 - DNA, 25 bp, Mus musculus
catgtattccaggcgttacaatatt

SEQ ID NO: 234927 - DNA, 25 bp, Mus musculus
catgtattccatagggatccaagcc

SEQ ID NO: 234928 - DNA, 25 bp, Mus musculus
catgtattccatagggcatgccttc

SEQ ID NO: 234929 - DNA, 25 bp, Mus musculus
catgtattccccgtgaatcccttgt

SEQ ID NO: 234930 - DNA, 25 bp, Mus musculus
catgtcaaaaaggtatggttccgac

SEQ ID NO: 234931 - DNA, 25 bp, Mus musculus
catgtcaacaaagtccaaggttgtg

SEQ ID NO: 234932 - DNA, 25 bp, Mus musculus
catgtcaacagcgtgagcaccactc

SEQ ID NO: 234933 - DNA, 25 bp, Mus musculus
catgtcaagaccaaacggccccctt

SEQ ID NO: 234934 - DNA, 25 bp, Mus musculus
catgtcaagaggcctcacaccttga

SEQ ID NO: 234935 - DNA, 25 bp, Mus musculus
catgtcacacagcactcatgaacac

SEQ ID NO: 234936 - DNA, 25 bp, Mus musculus
catgtcacagagcacttttaataac

SEQ ID NO: 234937 - DNA, 25 bp, Mus musculus
catgtcacagagcagaatgattggc

SEQ ID NO: 234938 - DNA, 25 bp, Mus musculus
catgtcacagagcagttttaataac

SEQ ID NO: 234939 - DNA, 25 bp, Mus musculus
catgtcacagcgtctgttgacattt

SEQ ID NO: 234940 - DNA, 25 bp, Mus musculus
catgtcacagctaaagtccaggaag

SEQ ID NO: 234941 - DNA, 25 bp, Mus musculus
catgtcacagggcagcaagttcatt

SEQ ID NO: 234942 - DNA, 25 bp, Mus musculus
catgtcaccctgatggtgccccttc

SEQ ID NO: 234943 - DNA, 25 bp, Mus musculus
catgtcactcacccccaattccagg

SEQ ID NO: 234944 - DNA, 25 bp, Mus musculus
catgtcagcagataggatctgtact

SEQ ID NO: 234945 - DNA, 25 bp, Mus musculus
catgtcagcaggaaatgatggatgt

SEQ ID NO: 234946 - DNA, 25 bp, Mus musculus
catgtcagcaggctggcgcattgga

SEQ ID NO: 234947 - DNA, 25 bp, Mus musculus
catgtcatcaggcagcctgatctct

SEQ ID NO: 234948 - DNA, 25 bp, Mus musculus
catgtcatcatatgatttttggtga

SEQ ID NO: 234949 - DNA, 25 bp, Mus musculus
catgtcatcattatcacttatgcct

SEQ ID NO: 234950 - DNA, 25 bp, Mus musculus
catgtcatccagttactgctgacct

SEQ ID NO: 234951 - DNA, 25 bp, Mus musculus
catgtcatctacatagaccagccca

SEQ ID NO: 234952 - DNA, 25 bp, Mus musculus
catgtcatctacatagaccaggacg

SEQ ID NO: 234953 - DNA, 25 bp, Mus musculus
catgtccaaagggctcccagaggct

SEQ ID NO: 234954 - DNA, 25 bp, Mus musculus
catgtccaagcggggtgccacggct

SEQ ID NO: 234955 - DNA, 25 bp, Mus musculus
catgtccaatgtcccatcaccatct

SEQ ID NO: 234956 - DNA, 25 bp, Mus musculus
catgtccacccgagtggcccatcct

SEQ ID NO: 234957 - DNA, 25 bp, Mus musculus
catgtccactgaggaaacctcaccg

SEQ ID NO: 234958 - DNA, 25 bp, Mus musculus
catgtccactgagggtgtgctgatt

SEQ ID NO: 234959 - DNA, 25 bp, Mus musculus
catgtccagaacagtgtccccgatg

SEQ ID NO: 234960 - DNA, 25 bp, Mus musculus
catgtccagcaccaaagaaggcatg

SEQ ID NO: 234961 - DNA, 25 bp, Mus musculus
catgtccaggagcagacacggatca

SEQ ID NO: 234962 - DNA, 25 bp, Mus musculus
catgtccaggagcaggggggactcc

SEQ ID NO: 234963 - DNA, 25 bp, Mus musculus
catgtccaggcaagatcagctctga

SEQ ID NO: 234964 - DNA, 25 bp, Mus musculus
catgtccatacggctggctcggatg

SEQ ID NO: 234965 - DNA, 25 bp, Mus musculus
catgtccatggaagacagcagtgac

SEQ ID NO: 234966 - DNA, 25 bp, Mus musculus
catgtcccacaattctcgactatct

SEQ ID NO: 234967 - DNA, 25 bp, Mus musculus
catgtcccacagtaacccctctaaa

SEQ ID NO: 234968 - DNA, 25 bp, Mus musculus
catgtcccagcttacataattggca

SEQ ID NO: 234969 - DNA, 25 bp, Mus musculus
catgtcccagtttgacccattgata

SEQ ID NO: 234970 - DNA, 25 bp, Mus musculus
catgtccgcaggcggctcaaagact

SEQ ID NO: 234971 - DNA, 25 bp, Mus musculus
catgtccggaaggtctgcgctgcca

SEQ ID NO: 234972 - DNA, 25 bp, Mus musculus
catgtcgagtggcctcggatgtgga

SEQ ID NO: 234973 - DNA, 25 bp, Mus musculus
catgtcggctaccttgagaggcagt

SEQ ID NO: 234974 - DNA, 25 bp, Mus musculus
catgtctaagccaatcaaagttgtt

SEQ ID NO: 234975 - DNA, 25 bp, Mus musculus
catgtctacaagcatttgtcaaggc

SEQ ID NO: 234976 - DNA, 25 bp, Mus musculus
catgtctcacccgggtgctggggac

SEQ ID NO: 234977 - DNA, 25 bp, Mus musculus
catgtctcagagcttggatctgtct

SEQ ID NO: 234978 - DNA, 25 bp, Mus musculus
catgtctccatgtcttcctccaaga

SEQ ID NO: 234979 - DNA, 25 bp, Mus musculus
catgtctcttgcacaagttgatggg

SEQ ID NO: 234980 - DNA, 25 bp, Mus musculus
catgtctgacctgtcaaactgggct

SEQ ID NO: 234981 - DNA, 25 bp, Mus musculus
catgtctgagcaggtgctcctgtgt

SEQ ID NO: 234982 - DNA, 25 bp, Mus musculus
catgtctgcaaaaagaaatacgaag

SEQ ID NO: 234983 - DNA, 25 bp, Mus musculus
catgtctgcaagcatcctggtcaac

SEQ ID NO: 234984 - DNA, 25 bp, Mus musculus
catgtcttcaagtaaaggatctccc

SEQ ID NO: 234985 - DNA, 25 bp, Mus musculus
catgtctttaagaattctgtcttta

SEQ ID NO: 234986 - DNA, 25 bp, Mus musculus
catgtctttaaggtgtttgtggcca

SEQ ID NO: 234987 - DNA, 25 bp, Mus musculus
catgtcttttcttcggtgggtctcg

SEQ ID NO: 234988 - DNA, 25 bp, Mus musculus
catgtcttttcttgccaatgaggcg

SEQ ID NO: 234989 - DNA, 25 bp, Mus musculus
catgtgaaagactggaagaagcgct

SEQ ID NO: 234990 - DNA, 25 bp, Mus musculus
catgtgaaagccctctcaccagcac

SEQ ID NO: 234991 - DNA, 25 bp, Mus musculus
catgtgacagacctcactcacagcc

SEQ ID NO: 234992 - DNA, 25 bp, Mus musculus
catgtgacagataattcacagaact

SEQ ID NO: 234993 - DNA, 25 bp, Mus musculus
catgtgacctctctatcacggactc

SEQ ID NO: 234994 - DNA, 25 bp, Mus musculus
catgtgactcaagctcgtgtggcca

SEQ ID NO: 234995 - DNA, 25 bp, Mus musculus
catgtgaggcacgtggacatcttca

SEQ ID NO: 234996 - DNA, 25 bp, Mus musculus
catgtgattctggaggagcaaaaac

SEQ ID NO: 234997 - DNA, 25 bp, Mus musculus
catgtgcaaagaagtttacaattcc

SEQ ID NO: 234998 - DNA, 25 bp, Mus musculus
catgtgcaacctgcaccatgggctt

SEQ ID NO: 234999 - DNA, 25 bp, Mus musculus
catgtgcacaaagatagttttgaga

SEQ ID NO: 235000 - DNA, 25 bp, Mus musculus
catgtgcacaaagcactgtgtgaag

SEQ ID NO: 235001 - DNA, 25 bp, Mus musculus
catgtgcatgtccatgctgtggaga

SEQ ID NO: 235002 - DNA, 25 bp, Mus musculus
catgtgcatgttcatgacttgcaga

SEQ ID NO: 235003 - DNA, 25 bp, Mus musculus
catgtgccaggctggcgacttcacc

SEQ ID NO: 235004 - DNA, 25 bp, Mus musculus
catgtgccagggaaaccgtgacgag

SEQ ID NO: 235005 - DNA, 25 bp, Mus musculus
catgtgccgtgtggtgtggattcgc

SEQ ID NO: 235006 - DNA, 25 bp, Mus musculus
catgtgcgcagacaaacccggaggc

SEQ ID NO: 235007 - DNA, 25 bp, Mus musculus
catgtgcgcagccgcctgggaaacc

SEQ ID NO: 235008 - DNA, 25 bp, Mus musculus
catgtgctgccagtccctccacaga

SEQ ID NO: 235009 - DNA, 25 bp, Mus musculus
catgtggaaagaggagaaccatcaa

SEQ ID NO: 235010 - DNA, 25 bp, Mus musculus
catgtggaaagaggtggcagtggga

SEQ ID NO: 235011 - DNA, 25 bp, Mus musculus
catgtggaaatccccagaggagctc

SEQ ID NO: 235012 - DNA, 25 bp, Mus musculus
catgtggaaggtgtgaatctggcaa

SEQ ID NO: 235013 - DNA, 25 bp, Mus musculus
catgtggagaagtctggtgcctcta

SEQ ID NO: 235014 - DNA, 25 bp, Mus musculus
catgtggaggctgggctgtacggga

SEQ ID NO: 235015 - DNA, 25 bp, Mus musculus
catgtggaggtagagggtggagttt

SEQ ID NO: 235016 - DNA, 25 bp, Mus musculus
catgtggcagtggtccccagtgctg

SEQ ID NO: 235017 - DNA, 25 bp, Mus musculus
catgtggctcgacatgaacgaaccg

SEQ ID NO: 235018 - DNA, 25 bp, Mus musculus
catgtgggagattgtgaccttggag

SEQ ID NO: 235019 - DNA, 25 bp, Mus musculus
catgtgggcacctgaatccaccttg

SEQ ID NO: 235020 - DNA, 25 bp, Mus musculus
catgtgggcacctgctggggttggg

SEQ ID NO: 235021 - DNA, 25 bp, Mus musculus
catgtgggccgtttctgcttccctc

SEQ ID NO: 235022 - DNA, 25 bp, Mus musculus
catgtggggccaggtgtcctgtcca

SEQ ID NO: 235023 - DNA, 25 bp, Mus musculus
catgtggtaaagggggagcacgagt

SEQ ID NO: 235024 - DNA, 25 bp, Mus musculus
catgtggtaccggagtaaggaacga

SEQ ID NO: 235025 - DNA, 25 bp, Mus musculus
catgtggtcaaggacttaatgggca

SEQ ID NO: 235026 - DNA, 25 bp, Mus musculus
catgtggtcaaggttcttgcagaat

SEQ ID NO: 235027 - DNA, 25 bp, Mus musculus
catgtggttcatcggctggactgta

SEQ ID NO: 235028 - DNA, 25 bp, Mus musculus
catgtggtttaaaaaactacatatg

SEQ ID NO: 235029 - DNA, 25 bp, Mus musculus
catgtggtttaaaaactctgtgcac

SEQ ID NO: 235030 - DNA, 25 bp, Mus musculus
catgtgtagcaggtttcaaagctga

SEQ ID NO: 235031 - DNA, 25 bp, Mus musculus
catgtgtagggtgtgtgaggacgag

SEQ ID NO: 235032 - DNA, 25 bp, Mus musculus
catgtgtattgcaagacagatcggc

SEQ ID NO: 235033 - DNA, 25 bp, Mus musculus
catgtgtattggtgagaagccagat

SEQ ID NO: 235034 - DNA, 25 bp, Mus musculus
catgtgtcatctttccaaagaacat

SEQ ID NO: 235035 - DNA, 25 bp, Mus musculus
catgtgtccatcctgtcctcagcct

SEQ ID NO: 235036 - DNA, 25 bp, Mus musculus
catgtgtcctcgagagacccagcca

SEQ ID NO: 235037 - DNA, 25 bp, Mus musculus
catgtgtcctcgagttttactacag

SEQ ID NO: 235038 - DNA, 25 bp, Mus musculus
catgtgtgaaaaccttgtcactaga

SEQ ID NO: 235039 - DNA, 25 bp, Mus musculus
catgtgtgagggctgccggtcactt

SEQ ID NO: 235040 - DNA, 25 bp, Mus musculus
catgtgtgcagcttccattgaagat

SEQ ID NO: 235041 - DNA, 25 bp, Mus musculus
catgtgtgcaggttgtacttgtttt

SEQ ID NO: 235042 - DNA, 25 bp, Mus musculus
catgtgtggcaggggagccttctct

SEQ ID NO: 235043 - DNA, 25 bp, Mus musculus
catgtgtgtgaggaggttccccctg

SEQ ID NO: 235044 - DNA, 25 bp, Mus musculus
catgtgtttgagatcctgtcaaacc

SEQ ID NO: 235045 - DNA, 25 bp, Mus musculus
catgttacactgacagacagatggg

SEQ ID NO: 235046 - DNA, 25 bp, Mus musculus
catgttactgcacgaccacaggagg

SEQ ID NO: 235047 - DNA, 25 bp, Mus musculus
catgttactggagtgccgatggcgg

SEQ ID NO: 235048 - DNA, 25 bp, Mus musculus
catgttcaaaggagcctttgaccag

SEQ ID NO: 235049 - DNA, 25 bp, Mus musculus
catgttcaaagttagcatattatta

SEQ ID NO: 235050 - DNA, 25 bp, Mus musculus
catgttcaagaaatccttttatctt

SEQ ID NO: 235051 - DNA, 25 bp, Mus musculus
catgttcaagaaatctgatagacgc

SEQ ID NO: 235052 - DNA, 25 bp, Mus musculus
catgttcaagaaatttgatgaaaaa

SEQ ID NO: 235053 - DNA, 25 bp, Mus musculus
catgttcaagaaccatgaacacata

SEQ ID NO: 235054 - DNA, 25 bp, Mus musculus
catgttcaaggtaattcagagatct

SEQ ID NO: 235055 - DNA, 25 bp, Mus musculus
catgttcacagggtacggattgctc

SEQ ID NO: 235056 - DNA, 25 bp, Mus musculus
catgttcagaaaggagctcttacca

SEQ ID NO: 235057 - DNA, 25 bp, Mus musculus
catgttcatcgagccgagatgaaac

SEQ ID NO: 235058 - DNA, 25 bp, Mus musculus
catgttcctagagtacaacaaagcc

SEQ ID NO: 235059 - DNA, 25 bp, Mus musculus
catgttcctccttgtagcaatgctg

SEQ ID NO: 235060 - DNA, 25 bp, Mus musculus
catgttcgtgattgtgctgtcctcc

SEQ ID NO: 235061 - DNA, 25 bp, Mus musculus
catgttcttctcggacctactaaat

SEQ ID NO: 235062 - DNA, 25 bp, Mus musculus
catgttcttcttcagaaacaaacat

SEQ ID NO: 235063 - DNA, 25 bp, Mus musculus
catgttcttggaaacctgatatctc

SEQ ID NO: 235064 - DNA, 25 bp, Mus musculus
catgttcttggcattgggagagaca

SEQ ID NO: 235065 - DNA, 25 bp, Mus musculus
catgttgaagagactttcaacagca

SEQ ID NO: 235066 - DNA, 25 bp, Mus musculus
catgttgaagatggtaaaagctata

SEQ ID NO: 235067 - DNA, 25 bp, Mus musculus
catgttgaagctcatctacggaccc

SEQ ID NO: 235068 - DNA, 25 bp, Mus musculus
catgttgaaggtgttggctgccctg

SEQ ID NO: 235069 - DNA, 25 bp, Mus musculus
catgttgactttaggaatgtgaagc

SEQ ID NO: 235070 - DNA, 25 bp, Mus musculus
catgttgactttagggtcttctcag

SEQ ID NO: 235071 - DNA, 25 bp, Mus musculus
catgttgatccgtggcttcagtggc

SEQ ID NO: 235072 - DNA, 25 bp, Mus musculus
catgttgcagaggttctcaggacag

SEQ ID NO: 235073 - DNA, 25 bp, Mus musculus
catgttgccagagaggcagatgaag

SEQ ID NO: 235074 - DNA, 25 bp, Mus musculus
catgttgcgcgctctcaggctagag

SEQ ID NO: 235075 - DNA, 25 bp, Mus musculus
catgttgcggctgaagaacgggaac

SEQ ID NO: 235076 - DNA, 25 bp, Mus musculus
catgttgcggctgagtggagattct

SEQ ID NO: 235077 - DNA, 25 bp, Mus musculus
catgttgctgaagcttcaaaagaaa

SEQ ID NO: 235078 - DNA, 25 bp, Mus musculus
catgttggaagttcccatggccgga

SEQ ID NO: 235079 - DNA, 25 bp, Mus musculus
catgttggagcctgctatgggatgg

SEQ ID NO: 235080 - DNA, 25 bp, Mus musculus
catgttggagcttcaaggagaaacc

SEQ ID NO: 235081 - DNA, 25 bp, Mus musculus
catgttggaggacaagacatttcaa

SEQ ID NO: 235082 - DNA, 25 bp, Mus musculus
catgttggagggagttaaatacctg

SEQ ID NO: 235083 - DNA, 25 bp, Mus musculus
catgttggaggtaataaagctctta

SEQ ID NO: 235084 - DNA, 25 bp, Mus musculus
catgttgtcagggcctaagatcacc

SEQ ID NO: 235085 - DNA, 25 bp, Mus musculus
catgttgtcaggggaagagatggct

SEQ ID NO: 235086 - DNA, 25 bp, Mus musculus
catgttgtccggcattggaagaagg

SEQ ID NO: 235087 - DNA, 25 bp, Mus musculus
catgttgtcgcaggacagtaatgat

SEQ ID NO: 235088 - DNA, 25 bp, Mus musculus
catgttgtgcaaatgaagaaaagca

SEQ ID NO: 235089 - DNA, 25 bp, Mus musculus
catgtttaagaaggtgcccactagt

SEQ ID NO: 235090 - DNA, 25 bp, Mus musculus
catgtttaattgttcctgctgctgt

SEQ ID NO: 235091 - DNA, 25 bp, Mus musculus
catgtttacagtggccggcctcatt

SEQ ID NO: 235092 - DNA, 25 bp, Mus musculus
catgtttacagttaggtgacagcag

SEQ ID NO: 235093 - DNA, 25 bp, Mus musculus
catgtttagctacaggaagcagttt

SEQ ID NO: 235094 - DNA, 25 bp, Mus musculus
catgtttagctacaggagcatctgg

SEQ ID NO: 235095 - DNA, 25 bp, Mus musculus
catgtttattagtggaatctttggg

SEQ ID NO: 235096 - DNA, 25 bp, Mus musculus
catgtttcagaaatgaagcagatga

SEQ ID NO: 235097 - DNA, 25 bp, Mus musculus
catgtttcagccggataccaacatt

SEQ ID NO: 235098 - DNA, 25 bp, Mus musculus
catgtttcaggtggtttgttgaagt

SEQ ID NO: 235099 - DNA, 25 bp, Mus musculus
catgtttccagttggcctctattac

SEQ ID NO: 235100 - DNA, 25 bp, Mus musculus
catgtttctaaagagaaaccatgaa

SEQ ID NO: 235101 - DNA, 25 bp, Mus musculus
catgtttctgggctttcaggaggtt

SEQ ID NO: 235102 - DNA, 25 bp, Mus musculus
catgtttgagggccatgacaccaca

SEQ ID NO: 235103 - DNA, 25 bp, Mus musculus
catgtttgcagccagcagcaagtga

SEQ ID NO: 235104 - DNA, 25 bp, Mus musculus
catgtttgccaagggaaagaaggca

SEQ ID NO: 235105 - DNA, 25 bp, Mus musculus
catgtttggaaaggatcgtgaactg

SEQ ID NO: 235106 - DNA, 25 bp, Mus musculus
catgtttttacaagagctaagtgat

SEQ ID NO: 235107 - DNA, 25 bp, Mus musculus
cattaaaaacctgcaactggattac

SEQ ID NO: 235108 - DNA, 25 bp, Mus musculus
cattaaaaaccttaggttgttctgc

SEQ ID NO: 235109 - DNA, 25 bp, Mus musculus
cattaaaaagagcaacagtgtgaag

SEQ ID NO: 235110 - DNA, 25 bp, Mus musculus
cattaaaaagcctcaagcccaaggc

SEQ ID NO: 235111 - DNA, 25 bp, Mus musculus
cattaaaaagctcactctgcagagc

SEQ ID NO: 235112 - DNA, 25 bp, Mus musculus
cattaaaacaaagatgtctcatttc

SEQ ID NO: 235113 - DNA, 25 bp, Mus musculus
cattaaaacaaaggggaagcgtgcg

SEQ ID NO: 235114 - DNA, 25 bp, Mus musculus
cattaaacaggacattcaccttgca

SEQ ID NO: 235115 - DNA, 25 bp, Mus musculus
cattaaacatgcccactgtcacgca

SEQ ID NO: 235116 - DNA, 25 bp, Mus musculus
cattaaacccaacaaacctgtgatg

SEQ ID NO: 235117 - DNA, 25 bp, Mus musculus
cattaaagctcagagccggccaccc

SEQ ID NO: 235118 - DNA, 25 bp, Mus musculus
cattaaagctcagtaccgcacaacc

SEQ ID NO: 235119 - DNA, 25 bp, Mus musculus
cattaaaggaggcacttgactcaat

SEQ ID NO: 235120 - DNA, 25 bp, Mus musculus
cattaaagtgacatatgacatccaa

SEQ ID NO: 235121 - DNA, 25 bp, Mus musculus
cattaaagtgcccagccacagctgg

SEQ ID NO: 235122 - DNA, 25 bp, Mus musculus
cattaaatcagcaagccccgcccaa

SEQ ID NO: 235123 - DNA, 25 bp, Mus musculus
cattaaatctgaagtgcagcgtaag

SEQ ID NO: 235124 - DNA, 25 bp, Mus musculus
cattaaatgccaaacacactggctc

SEQ ID NO: 235125 - DNA, 25 bp, Mus musculus
cattaaatgccaatccttcccagtt

SEQ ID NO: 235126 - DNA, 25 bp, Mus musculus
cattaaatgggccagatacaatttg

SEQ ID NO: 235127 - DNA, 25 bp, Mus musculus
cattaacaaagtagcagacagtgtt

SEQ ID NO: 235128 - DNA, 25 bp, Mus musculus
cattaacaaggaccctgcagtggga

SEQ ID NO: 235129 - DNA, 25 bp, Mus musculus
cattaacaaggagacgactgcacaa

SEQ ID NO: 235130 - DNA, 25 bp, Mus musculus
cattaaccagtgcacttaaggacag

SEQ ID NO: 235131 - DNA, 25 bp, Mus musculus
cattaacgtggttcattatgatgga

SEQ ID NO: 235132 - DNA, 25 bp, Mus musculus
cattaactacgtggaaaaggcagtg

SEQ ID NO: 235133 - DNA, 25 bp, Mus musculus
cattaactccatgtaatcgtgttcc

SEQ ID NO: 235134 - DNA, 25 bp, Mus musculus
cattaacttgaaggtagaagacttt

SEQ ID NO: 235135 - DNA, 25 bp, Mus musculus
cattaactttagcccagaaactagg

SEQ ID NO: 235136 - DNA, 25 bp, Mus musculus
cattaactttaggtgctgctttcct

SEQ ID NO: 235137 - DNA, 25 bp, Mus musculus
cattaagaagaacaatcaccatgag

SEQ ID NO: 235138 - DNA, 25 bp, Mus musculus
cattaagacgtcagataatcaaatt

SEQ ID NO: 235139 - DNA, 25 bp, Mus musculus
cattaagcagaggtgacagctgcct

SEQ ID NO: 235140 - DNA, 25 bp, Mus musculus
cattaagccgtacagtaagcactac

SEQ ID NO: 235141 - DNA, 25 bp, Mus musculus
cattaaggccaaaaatgtcagcagc

SEQ ID NO: 235142 - DNA, 25 bp, Mus musculus
cattaataacagaagaaattaaaga

SEQ ID NO: 235143 - DNA, 25 bp, Mus musculus
cattaataaggaccaaaatgtcttt

SEQ ID NO: 235144 - DNA, 25 bp, Mus musculus
cattaatcaacagattcaaggcctc

SEQ ID NO: 235145 - DNA, 25 bp, Mus musculus
cattaatccaggatccacagggtct

SEQ ID NO: 235146 - DNA, 25 bp, Mus musculus
cattaatcccacaggctctgttgtc

SEQ ID NO: 235147 - DNA, 25 bp, Mus musculus
cattaatgagcgccttaaagctgct

SEQ ID NO: 235148 - DNA, 25 bp, Mus musculus
cattaatgagggccttaaagctgct

SEQ ID NO: 235149 - DNA, 25 bp, Mus musculus
cattaatgccaccctgcaggcattg

SEQ ID NO: 235150 - DNA, 25 bp, Mus musculus
cattaatgccatttagttcgctaca

SEQ ID NO: 235151 - DNA, 25 bp, Mus musculus
cattaatggatgcaggggtcccaat

SEQ ID NO: 235152 - DNA, 25 bp, Mus musculus
cattaatggatgcaggtgtagcagt

SEQ ID NO: 235153 - DNA, 25 bp, Mus musculus
cattaattcaaaaaagatcattcag

SEQ ID NO: 235154 - DNA, 25 bp, Mus musculus
cattacaaacagtggccagtttcac

SEQ ID NO: 235155 - DNA, 25 bp, Mus musculus
cattacaaagcctcccagactacaa

SEQ ID NO: 235156 - DNA, 25 bp, Mus musculus
cattacaaagtagctcaaccgaaga

SEQ ID NO: 235157 - DNA, 25 bp, Mus musculus
cattacaaccagagggcatgaagag

SEQ ID NO: 235158 - DNA, 25 bp, Mus musculus
cattacaaccagagttttcctccct

SEQ ID NO: 235159 - DNA, 25 bp, Mus musculus
cattacacaagaaaaaagtgaaaac

SEQ ID NO: 235160 - DNA, 25 bp, Mus musculus
cattacagaaaagggtgtgtttgac

SEQ ID NO: 235161 - DNA, 25 bp, Mus musculus
cattacagaatgaggccggggacga

SEQ ID NO: 235162 - DNA, 25 bp, Mus musculus
cattacagagggagtttattcaaaa

SEQ ID NO: 235163 - DNA, 25 bp, Mus musculus
cattacagatgaccgtgataaaggt

SEQ ID NO: 235164 - DNA, 25 bp, Mus musculus
cattacaggaagggtctgcttggtg

SEQ ID NO: 235165 - DNA, 25 bp, Mus musculus
cattacaggaaggtgtcagacaaag

SEQ ID NO: 235166 - DNA, 25 bp, Mus musculus
cattacatcagattacgagctcctc

SEQ ID NO: 235167 - DNA, 25 bp, Mus musculus
cattacattccaaaggtgtgcagga

SEQ ID NO: 235168 - DNA, 25 bp, Mus musculus
cattaccaaagcagagttctcgtca

SEQ ID NO: 235169 - DNA, 25 bp, Mus musculus
cattaccaaagcaggcttcttccct

SEQ ID NO: 235170 - DNA, 25 bp, Mus musculus
cattaccaaattgttcccataacaa

SEQ ID NO: 235171 - DNA, 25 bp, Mus musculus
cattaccaaggtcccttcagagaag

SEQ ID NO: 235172 - DNA, 25 bp, Mus musculus
cattaccaatggacgcatcgttgat

SEQ ID NO: 235173 - DNA, 25 bp, Mus musculus
cattaccacccaagattcagtttgc

SEQ ID NO: 235174 - DNA, 25 bp, Mus musculus
cattaccaggcataactcctggctc

SEQ ID NO: 235175 - DNA, 25 bp, Mus musculus
cattaccccggagcgagcccatccg

SEQ ID NO: 235176 - DNA, 25 bp, Mus musculus
cattacctaaatgactgataatggt

SEQ ID NO: 235177 - DNA, 25 bp, Mus musculus
cattacctaaatggacaggatcctt

SEQ ID NO: 235178 - DNA, 25 bp, Mus musculus
cattacctcagagctgtggaacgac

SEQ ID NO: 235179 - DNA, 25 bp, Mus musculus
cattacctccaggctcggttgtcct

SEQ ID NO: 235180 - DNA, 25 bp, Mus musculus
cattacctccagtgtgacaaataca

SEQ ID NO: 235181 - DNA, 25 bp, Mus musculus
cattacctgcacaagctgactcatc

SEQ ID NO: 235182 - DNA, 25 bp, Mus musculus
cattacctggagaagtgtgtctggg

SEQ ID NO: 235183 - DNA, 25 bp, Mus musculus
cattacctggttcataagccagaaa

SEQ ID NO: 235184 - DNA, 25 bp, Mus musculus
cattaccttggttctgaccagaaag

SEQ ID NO: 235185 - DNA, 25 bp, Mus musculus
cattacgtaatgaagtacttaagca

SEQ ID NO: 235186 - DNA, 25 bp, Mus musculus
cattacgtcatgtactatgagatgt

SEQ ID NO: 235187 - DNA, 25 bp, Mus musculus
cattactaatcaaaatacgcctact

SEQ ID NO: 235188 - DNA, 25 bp, Mus musculus
cattactaatcaaagtggacccaac

SEQ ID NO: 235189 - DNA, 25 bp, Mus musculus
cattactacactgctctgctcagag

SEQ ID NO: 235190 - DNA, 25 bp, Mus musculus
cattactacgtcatgcagtgccctt

SEQ ID NO: 235191 - DNA, 25 bp, Mus musculus
cattactacgtcatggtcatctgct

SEQ ID NO: 235192 - DNA, 25 bp, Mus musculus
cattactactacatgatcatctcca

SEQ ID NO: 235193 - DNA, 25 bp, Mus musculus
cattactcagagaaagctgatggtt

SEQ ID NO: 235194 - DNA, 25 bp, Mus musculus
cattactcagagagagccgcaggtc

SEQ ID NO: 235195 - DNA, 25 bp, Mus musculus
cattactcgcagggcaacaaagaat

SEQ ID NO: 235196 - DNA, 25 bp, Mus musculus
cattactcgcagtgagatgagtcag

SEQ ID NO: 235197 - DNA, 25 bp, Mus musculus
cattactgctgacctcaggatgtca

SEQ ID NO: 235198 - DNA, 25 bp, Mus musculus
cattagaaaaacataaatgcagttc

SEQ ID NO: 235199 - DNA, 25 bp, Mus musculus
cattagaaaaagtaagtgcttcctt

SEQ ID NO: 235200 - DNA, 25 bp, Mus musculus
cattagaaaagaatctaaagggatg

SEQ ID NO: 235201 - DNA, 25 bp, Mus musculus
cattagaaacaagccacggaagagg

SEQ ID NO: 235202 - DNA, 25 bp, Mus musculus
cattagaaaccacctaccctcaggc

SEQ ID NO: 235203 - DNA, 25 bp, Mus musculus
cattagaaccagcagatgacaccgt

SEQ ID NO: 235204 - DNA, 25 bp, Mus musculus
cattagaagaatcagcagccgctct

SEQ ID NO: 235205 - DNA, 25 bp, Mus musculus
cattagacaagccctgacgtcaaga

SEQ ID NO: 235206 - DNA, 25 bp, Mus musculus
cattagagagaggcaggagtacgtg

SEQ ID NO: 235207 - DNA, 25 bp, Mus musculus
cattagagggcaggacaataagact

SEQ ID NO: 235208 - DNA, 25 bp, Mus musculus
cattagatatgactgaaatggcaag

SEQ ID NO: 235209 - DNA, 25 bp, Mus musculus
cattagatgaagaattcatcctaca

SEQ ID NO: 235210 - DNA, 25 bp, Mus musculus
cattagcaaaggtggattgcactgc

SEQ ID NO: 235211 - DNA, 25 bp, Mus musculus
cattagcccaggtatccatgccagc

SEQ ID NO: 235212 - DNA, 25 bp, Mus musculus
cattagcgccatcagcgaggctgct

SEQ ID NO: 235213 - DNA, 25 bp, Mus musculus
cattagctcggttatgtacaaagaa

SEQ ID NO: 235214 - DNA, 25 bp, Mus musculus
cattagctcggttttgtacaaagaa

SEQ ID NO: 235215 - DNA, 25 bp, Mus musculus
cattaggaaattagataggttttct

SEQ ID NO: 235216 - DNA, 25 bp, Mus musculus
cattaggaaccaaggtagcttctcc

SEQ ID NO: 235217 - DNA, 25 bp, Mus musculus
cattaggaagatcaaaggcacagct

SEQ ID NO: 235218 - DNA, 25 bp, Mus musculus
cattaggacctcggggagaaagagg

SEQ ID NO: 235219 - DNA, 25 bp, Mus musculus
cattagggcagaatatgcagacaga

SEQ ID NO: 235220 - DNA, 25 bp, Mus musculus
cattaggggatggtgatgaacgaga

SEQ ID NO: 235221 - DNA, 25 bp, Mus musculus
cattagtatagcaagaagccagttg

SEQ ID NO: 235222 - DNA, 25 bp, Mus musculus
cattagtcagagaattgtaagtgct

SEQ ID NO: 235223 - DNA, 25 bp, Mus musculus
cattagttaagctgagtgtcctggt

SEQ ID NO: 235224 - DNA, 25 bp, Mus musculus
cattataaatgctacaataaaagtc

SEQ ID NO: 235225 - DNA, 25 bp, Mus musculus
cattataacaggtgagacgacaaga

SEQ ID NO: 235226 - DNA, 25 bp, Mus musculus
cattatacaaatgtcggagtcttct

SEQ ID NO: 235227 - DNA, 25 bp, Mus musculus
cattataccctctcctaccaccact

SEQ ID NO: 235228 - DNA, 25 bp, Mus musculus
cattatcaacgagtactgtattggc

SEQ ID NO: 235229 - DNA, 25 bp, Mus musculus
cattatcaagttctcagatgaatat

SEQ ID NO: 235230 - DNA, 25 bp, Mus musculus
cattatcactgtgggccccctccct

SEQ ID NO: 235231 - DNA, 25 bp, Mus musculus
cattatcagtctcagcatcctcatg

SEQ ID NO: 235232 - DNA, 25 bp, Mus musculus
cattatccactcaattttaaagaaa

SEQ ID NO: 235233 - DNA, 25 bp, Mus musculus
cattatccaggacagttgtccacgt

SEQ ID NO: 235234 - DNA, 25 bp, Mus musculus
cattatccattgcataaccccaaat

SEQ ID NO: 235235 - DNA, 25 bp, Mus musculus
cattatgacatccggatgctgacct

SEQ ID NO: 235236 - DNA, 25 bp, Mus musculus
cattatgacatccgggtcaaggctg

SEQ ID NO: 235237 - DNA, 25 bp, Mus musculus
cattatgaccctgcctccacaggag

SEQ ID NO: 235238 - DNA, 25 bp, Mus musculus
cattatgaccctgctttttaaattg

SEQ ID NO: 235239 - DNA, 25 bp, Mus musculus
cattatgatattaagatgctaacat

SEQ ID NO: 235240 - DNA, 25 bp, Mus musculus
cattatgcaaatgaggatgccccta

SEQ ID NO: 235241 - DNA, 25 bp, Mus musculus
cattatgcaaatgagttccagacag

SEQ ID NO: 235242 - DNA, 25 bp, Mus musculus
cattatgcagagatgcacacaagcc

SEQ ID NO: 235243 - DNA, 25 bp, Mus musculus
cattatgcagagcttctgaacaagg

SEQ ID NO: 235244 - DNA, 25 bp, Mus musculus
cattatgcagaggatgattctgaca

SEQ ID NO: 235245 - DNA, 25 bp, Mus musculus
cattatgccaaagagatgaaggagt

SEQ ID NO: 235246 - DNA, 25 bp, Mus musculus
cattatggactggcatgcacacaat

SEQ ID NO: 235247 - DNA, 25 bp, Mus musculus
cattatggagcagagaatgacggac

SEQ ID NO: 235248 - DNA, 25 bp, Mus musculus
cattatggaggacactatcgaagac

SEQ ID NO: 235249 - DNA, 25 bp, Mus musculus
cattatgtgatggctgcaccccatc

SEQ ID NO: 235250 - DNA, 25 bp, Mus musculus
cattatgtgatgtactacgagatgt

SEQ ID NO: 235251 - DNA, 25 bp, Mus musculus
cattattaaacggatggctcccagc

SEQ ID NO: 235252 - DNA, 25 bp, Mus musculus
cattattaaagacacactttttaat

SEQ ID NO: 235253 - DNA, 25 bp, Mus musculus
cattattaaagataattgctgtgaa

SEQ ID NO: 235254 - DNA, 25 bp, Mus musculus
cattattcagggattgcttacattg

SEQ ID NO: 235255 - DNA, 25 bp, Mus musculus
cattattcagttgtttgttgctggt

SEQ ID NO: 235256 - DNA, 25 bp, Mus musculus
cattattcgagcccccaagctcttc

SEQ ID NO: 235257 - DNA, 25 bp, Mus musculus
cattattcgagctatcttcagacac

SEQ ID NO: 235258 - DNA, 25 bp, Mus musculus
cattattctatggctagaaaatgcc

SEQ ID NO: 235259 - DNA, 25 bp, Mus musculus
cattattgagatgacacagagacca

SEQ ID NO: 235260 - DNA, 25 bp, Mus musculus
cattattgaggccactgcagatgac

SEQ ID NO: 235261 - DNA, 25 bp, Mus musculus
cattattggagatcgtggccttcaa

SEQ ID NO: 235262 - DNA, 25 bp, Mus musculus
cattattggaggtgctctgcccgtg

SEQ ID NO: 235263 - DNA, 25 bp, Mus musculus
cattattgtgctgctgatgaagaga

SEQ ID NO: 235264 - DNA, 25 bp, Mus musculus
cattattttagacacagaatgttct

SEQ ID NO: 235265 - DNA, 25 bp, Mus musculus
cattcaaaaggaggtttccccagaa

SEQ ID NO: 235266 - DNA, 25 bp, Mus musculus
cattcaaaagtatggcttagacttg

SEQ ID NO: 235267 - DNA, 25 bp, Mus musculus
cattcaaacctgaacgctggaaaga

SEQ ID NO: 235268 - DNA, 25 bp, Mus musculus
cattcaaacctgtggtttgctctct

SEQ ID NO: 235269 - DNA, 25 bp, Mus musculus
cattcaacagagctgccttccgtct

SEQ ID NO: 235270 - DNA, 25 bp, Mus musculus
cattcaacgggggattcatcagttg

SEQ ID NO: 235271 - DNA, 25 bp, Mus musculus
cattcaagaggtaatcagccagtca

SEQ ID NO: 235272 - DNA, 25 bp, Mus musculus
cattcaaggaatgtatgtgcatgaa

SEQ ID NO: 235273 - DNA, 25 bp, Mus musculus
cattcaataaatggatggaaaccct

SEQ ID NO: 235274 - DNA, 25 bp, Mus musculus
cattcaatagaggatatccatgcat

SEQ ID NO: 235275 - DNA, 25 bp, Mus musculus
cattcacaagaattggcctacaggg

SEQ ID NO: 235276 - DNA, 25 bp, Mus musculus
cattcacaagctaattctgatcagt

SEQ ID NO: 235277 - DNA, 25 bp, Mus musculus
cattcacaaggattcagggaatatc

SEQ ID NO: 235278 - DNA, 25 bp, Mus musculus
cattcacacaggccgatacaaagca

SEQ ID NO: 235279 - DNA, 25 bp, Mus musculus
cattcacacgggaagagtcaccgaa

SEQ ID NO: 235280 - DNA, 25 bp, Mus musculus
cattcacacgggatgaaattgttga

SEQ ID NO: 235281 - DNA, 25 bp, Mus musculus
cattcacactgagaccagacttctt

SEQ ID NO: 235282 - DNA, 25 bp, Mus musculus
cattcacactgagagcagacttctt

SEQ ID NO: 235283 - DNA, 25 bp, Mus musculus
cattcaccaggtgcactgcctgttg

SEQ ID NO: 235284 - DNA, 25 bp, Mus musculus
cattcacctacgattaccacaccct

SEQ ID NO: 235285 - DNA, 25 bp, Mus musculus
cattcacctacggcaagagatgtcg

SEQ ID NO: 235286 - DNA, 25 bp, Mus musculus
cattcactgcagctgctattggagc

SEQ ID NO: 235287 - DNA, 25 bp, Mus musculus
cattcactgcaggtccgagagaagc

SEQ ID NO: 235288 - DNA, 25 bp, Mus musculus
cattcactgcagtgcccaggtccga

SEQ ID NO: 235289 - DNA, 25 bp, Mus musculus
cattcactggaaagacatgcagctg

SEQ ID NO: 235290 - DNA, 25 bp, Mus musculus
cattcactggtcaagattcatgaaa

SEQ ID NO: 235291 - DNA, 25 bp, Mus musculus
cattcactgtccagcttgccagtgc

SEQ ID NO: 235292 - DNA, 25 bp, Mus musculus
cattcagaaacaggtggtgatgaag

SEQ ID NO: 235293 - DNA, 25 bp, Mus musculus
cattcagaacccattccaagcttgg

SEQ ID NO: 235294 - DNA, 25 bp, Mus musculus
cattcagaagatgacttacaagatg

SEQ ID NO: 235295 - DNA, 25 bp, Mus musculus
cattcagaagatgcaaccctgagac

SEQ ID NO: 235296 - DNA, 25 bp, Mus musculus
cattcagaaggcctctctcttgtgg

SEQ ID NO: 235297 - DNA, 25 bp, Mus musculus
cattcagacaagattttcgaaaata

SEQ ID NO: 235298 - DNA, 25 bp, Mus musculus
cattcagagcaggagcctttgacca

SEQ ID NO: 235299 - DNA, 25 bp, Mus musculus
cattcagcactcggtaattcagaga

SEQ ID NO: 235300 - DNA, 25 bp, Mus musculus
cattcagcccacttggtgcctcctt

SEQ ID NO: 235301 - DNA, 25 bp, Mus musculus
cattcagcctttggctacaatggag

SEQ ID NO: 235302 - DNA, 25 bp, Mus musculus
cattcagctctggtgattgttcagt

SEQ ID NO: 235303 - DNA, 25 bp, Mus musculus
cattcagctgcagagtgctgatccc

SEQ ID NO: 235304 - DNA, 25 bp, Mus musculus
cattcaggataggggaatggtctag

SEQ ID NO: 235305 - DNA, 25 bp, Mus musculus
cattcagtgaaggatttgaactttt

SEQ ID NO: 235306 - DNA, 25 bp, Mus musculus
cattcataaagattgaggaagacac

SEQ ID NO: 235307 - DNA, 25 bp, Mus musculus
cattcataaaggtcagaaggctatg

SEQ ID NO: 235308 - DNA, 25 bp, Mus musculus
cattcataaaggtctagagggcttt

SEQ ID NO: 235309 - DNA, 25 bp, Mus musculus
cattcataggagaagtatgagctgg

SEQ ID NO: 235310 - DNA, 25 bp, Mus musculus
cattcatcaggaagcaggtgtgcaa

SEQ ID NO: 235311 - DNA, 25 bp, Mus musculus
cattcatctctggtcttgacgaagt

SEQ ID NO: 235312 - DNA, 25 bp, Mus musculus
cattcatctgggaatgattttgcat

SEQ ID NO: 235313 - DNA, 25 bp, Mus musculus
cattcatcttatcaggagcacggca

SEQ ID NO: 235314 - DNA, 25 bp, Mus musculus
cattcatgaaagctccttgtgaacc

SEQ ID NO: 235315 - DNA, 25 bp, Mus musculus
cattcatgaaaggaagaacaattgt

SEQ ID NO: 235316 - DNA, 25 bp, Mus musculus
cattcatgagtccagacttcttgtg

SEQ ID NO: 235317 - DNA, 25 bp, Mus musculus
cattcatgagtccaggctagatatg

SEQ ID NO: 235318 - DNA, 25 bp, Mus musculus
cattcatgcccagggtgttccatga

SEQ ID NO: 235319 - DNA, 25 bp, Mus musculus
cattcatgcggaaagacgtgcgaga

SEQ ID NO: 235320 - DNA, 25 bp, Mus musculus
cattcatgcggatgcgttttgactt

SEQ ID NO: 235321 - DNA, 25 bp, Mus musculus
cattcatggtgaaggacacatctta

SEQ ID NO: 235322 - DNA, 25 bp, Mus musculus
cattcatgtagccgcctcaaacatg

SEQ ID NO: 235323 - DNA, 25 bp, Mus musculus
cattcattcattcccactatgggcc

SEQ ID NO: 235324 - DNA, 25 bp, Mus musculus
cattcattcgatattacacaaggac

SEQ ID NO: 235325 - DNA, 25 bp, Mus musculus
cattcattctcatcgccgagctgaa

SEQ ID NO: 235326 - DNA, 25 bp, Mus musculus
cattcatttagaaactccccaactt

SEQ ID NO: 235327 - DNA, 25 bp, Mus musculus
cattcatttagtatccgctccattc

SEQ ID NO: 235328 - DNA, 25 bp, Mus musculus
cattcatttcagttgcctctctgca

SEQ ID NO: 235329 - DNA, 25 bp, Mus musculus
cattccaaaggtgtgcaggattttt

SEQ ID NO: 235330 - DNA, 25 bp, Mus musculus
cattccaaagtatagcacatttggg

SEQ ID NO: 235331 - DNA, 25 bp, Mus musculus
cattccaaagtttatgttttgtgcc

SEQ ID NO: 235332 - DNA, 25 bp, Mus musculus
cattccaacctacaagggcaagatg

SEQ ID NO: 235333 - DNA, 25 bp, Mus musculus
cattccaagaagaagcccgggacgg

SEQ ID NO: 235334 - DNA, 25 bp, Mus musculus
cattccaatgtggaaaagaagacca

SEQ ID NO: 235335 - DNA, 25 bp, Mus musculus
cattccaccaccaggtattccaata

SEQ ID NO: 235336 - DNA, 25 bp, Mus musculus
cattccaccccagactctgcagagg

SEQ ID NO: 235337 - DNA, 25 bp, Mus musculus
cattccacctccttaaaaatataac

SEQ ID NO: 235338 - DNA, 25 bp, Mus musculus
cattccagaaagtatgcagccctgc

SEQ ID NO: 235339 - DNA, 25 bp, Mus musculus
cattccagaaagtatgcagcccttt

SEQ ID NO: 235340 - DNA, 25 bp, Mus musculus
cattccagaggcattaaaagctggg

SEQ ID NO: 235341 - DNA, 25 bp, Mus musculus
cattccagaggtgatggtggcccca

SEQ ID NO: 235342 - DNA, 25 bp, Mus musculus
cattccagcagaccgacttgtctca

SEQ ID NO: 235343 - DNA, 25 bp, Mus musculus
cattccaggagaatgccaggaggtc

SEQ ID NO: 235344 - DNA, 25 bp, Mus musculus
cattccagggagattccagacttct

SEQ ID NO: 235345 - DNA, 25 bp, Mus musculus
cattccagggagggtcccacctcct

SEQ ID NO: 235346 - DNA, 25 bp, Mus musculus
cattccattagtaaccgtgtggaag

SEQ ID NO: 235347 - DNA, 25 bp, Mus musculus
cattccatttcactccgcagatgac

SEQ ID NO: 235348 - DNA, 25 bp, Mus musculus
cattcccaagggcacaagtgtaatg

SEQ ID NO: 235349 - DNA, 25 bp, Mus musculus
cattcccaataaaagataattggtt

SEQ ID NO: 235350 - DNA, 25 bp, Mus musculus
cattcccaataaaaggctcccgtcc

SEQ ID NO: 235351 - DNA, 25 bp, Mus musculus
cattcccataagtctgcgagtaaac

SEQ ID NO: 235352 - DNA, 25 bp, Mus musculus
cattccccaaagtaatggactcatg

SEQ ID NO: 235353 - DNA, 25 bp, Mus musculus
cattccccaatggtccatttactcg

SEQ ID NO: 235354 - DNA, 25 bp, Mus musculus
cattccccagactaggctgtcctgg

SEQ ID NO: 235355 - DNA, 25 bp, Mus musculus
cattccccagcctctgcagacctcg

SEQ ID NO: 235356 - DNA, 25 bp, Mus musculus
cattccccaggattgggtttccttc

SEQ ID NO: 235357 - DNA, 25 bp, Mus musculus
cattccccaggctctgcagacctcg

SEQ ID NO: 235358 - DNA, 25 bp, Mus musculus
cattcccccccagctacccgtacag

SEQ ID NO: 235359 - DNA, 25 bp, Mus musculus
cattccccggaagacgaagagccgg

SEQ ID NO: 235360 - DNA, 25 bp, Mus musculus
cattccccggaagcactctgacacc

SEQ ID NO: 235361 - DNA, 25 bp, Mus musculus
cattccgagttcaaggtcgcttctc

SEQ ID NO: 235362 - DNA, 25 bp, Mus musculus
cattccggagtgagaacaatctcca

SEQ ID NO: 235363 - DNA, 25 bp, Mus musculus
cattccggcgcccatggcgaattgt

SEQ ID NO: 235364 - DNA, 25 bp, Mus musculus
cattccgttcaaaggtctcaacatg

SEQ ID NO: 235365 - DNA, 25 bp, Mus musculus
cattcctaaaaaaagactgggctat

SEQ ID NO: 235366 - DNA, 25 bp, Mus musculus
cattcctaaaaaaagtgccgtgatg

SEQ ID NO: 235367 - DNA, 25 bp, Mus musculus
cattcctaagaagacccagcactac

SEQ ID NO: 235368 - DNA, 25 bp, Mus musculus
cattcctaagaaggccacagaccca

SEQ ID NO: 235369 - DNA, 25 bp, Mus musculus
cattcctaggtggtctcctagccct

SEQ ID NO: 235370 - DNA, 25 bp, Mus musculus
cattcctagtccaattcaggttatt

SEQ ID NO: 235371 - DNA, 25 bp, Mus musculus
cattcctatcagcttgcgtgtgaac

SEQ ID NO: 235372 - DNA, 25 bp, Mus musculus
cattcctatgaagcccacattcagt

SEQ ID NO: 235373 - DNA, 25 bp, Mus musculus
cattcctatgaaggaagagcagcat

SEQ ID NO: 235374 - DNA, 25 bp, Mus musculus
cattcctatgatcgtcatcttcttc

SEQ ID NO: 235375 - DNA, 25 bp, Mus musculus
cattcctcactccagatgtgtttgg

SEQ ID NO: 235376 - DNA, 25 bp, Mus musculus
cattcctcactgacctggcctctgg

SEQ ID NO: 235377 - DNA, 25 bp, Mus musculus
cattcctcagggaactgaaaccaaa

SEQ ID NO: 235378 - DNA, 25 bp, Mus musculus
cattcctccacaaaggtcagaagag

SEQ ID NO: 235379 - DNA, 25 bp, Mus musculus
cattcctccacaagagcctgagttt

SEQ ID NO: 235380 - DNA, 25 bp, Mus musculus
cattcctccagctacactcctctcc

SEQ ID NO: 235381 - DNA, 25 bp, Mus musculus
cattcctccaggaacaacaggcaat

SEQ ID NO: 235382 - DNA, 25 bp, Mus musculus
cattcctccaggtacatttgattca

SEQ ID NO: 235383 - DNA, 25 bp, Mus musculus
cattcctccaggtcttgccgtcact

SEQ ID NO: 235384 - DNA, 25 bp, Mus musculus
cattcctctcagccaaaaagacttg

SEQ ID NO: 235385 - DNA, 25 bp, Mus musculus
cattcctctggaagggagagacgac

SEQ ID NO: 235386 - DNA, 25 bp, Mus musculus
cattcctcttcgccgccattgctcc

SEQ ID NO: 235387 - DNA, 25 bp, Mus musculus
cattcctgaacacagtaaggtagat

SEQ ID NO: 235388 - DNA, 25 bp, Mus musculus
cattcctgcctaaattttaagcggc

SEQ ID NO: 235389 - DNA, 25 bp, Mus musculus
cattcctggaacagactaaggctgg

SEQ ID NO: 235390 - DNA, 25 bp, Mus musculus
cattcctggagggatcatgcctggc

SEQ ID NO: 235391 - DNA, 25 bp, Mus musculus
cattcctgggtacaggcaaccaaga

SEQ ID NO: 235392 - DNA, 25 bp, Mus musculus
cattcctgggtacaggtcggccagt

SEQ ID NO: 235393 - DNA, 25 bp, Mus musculus
cattcctgggtgtggtcaacagctg

SEQ ID NO: 235394 - DNA, 25 bp, Mus musculus
cattcctgtcagccggggcctcccc

SEQ ID NO: 235395 - DNA, 25 bp, Mus musculus
cattcctgtcagccggtaacctccg

SEQ ID NO: 235396 - DNA, 25 bp, Mus musculus
cattccttgaagaggagcagacaga

SEQ ID NO: 235397 - DNA, 25 bp, Mus musculus
cattccttgaagaggttgcccacgg

SEQ ID NO: 235398 - DNA, 25 bp, Mus musculus
cattcctttgcaaagtgcattgagg

SEQ ID NO: 235399 - DNA, 25 bp, Mus musculus
cattcctttggcttccctcatcagc

SEQ ID NO: 235400 - DNA, 25 bp, Mus musculus
cattcgaaaaacaaggacactgctg

SEQ ID NO: 235401 - DNA, 25 bp, Mus musculus
cattcgaattgggcggcggccagcg

SEQ ID NO: 235402 - DNA, 25 bp, Mus musculus
cattcgacagggaagaagaaaaagc

SEQ ID NO: 235403 - DNA, 25 bp, Mus musculus
cattcgacagggaagggaacaaaac

SEQ ID NO: 235404 - DNA, 25 bp, Mus musculus
cattcgacaggggaatggtttggaa

SEQ ID NO: 235405 - DNA, 25 bp, Mus musculus
cattcgagggcacaggcggacctat

SEQ ID NO: 235406 - DNA, 25 bp, Mus musculus
cattcgcaaagactctcacccaggt

SEQ ID NO: 235407 - DNA, 25 bp, Mus musculus
cattcgcaaaggaacgggagatgga

SEQ ID NO: 235408 - DNA, 25 bp, Mus musculus
cattcgcaaaggacgcatggaatat

SEQ ID NO: 235409 - DNA, 25 bp, Mus musculus
cattcgcataccggatggaaatgca

SEQ ID NO: 235410 - DNA, 25 bp, Mus musculus
cattcgccacccaagttggagtcat

SEQ ID NO: 235411 - DNA, 25 bp, Mus musculus
cattcgccgagcactagcgctgggg

SEQ ID NO: 235412 - DNA, 25 bp, Mus musculus
cattcgccgagccgagatactactc

SEQ ID NO: 235413 - DNA, 25 bp, Mus musculus
cattcgcgcctagtattttgttaaa

SEQ ID NO: 235414 - DNA, 25 bp, Mus musculus
cattcgctgctattctccactccag

SEQ ID NO: 235415 - DNA, 25 bp, Mus musculus
cattcggacccagatgacccagggg

SEQ ID NO: 235416 - DNA, 25 bp, Mus musculus
cattcggacccagtcgacctgataa

SEQ ID NO: 235417 - DNA, 25 bp, Mus musculus
cattcggcaaagatgacagaaggca

SEQ ID NO: 235418 - DNA, 25 bp, Mus musculus
cattcggctgaacaaaccttatatc

SEQ ID NO: 235419 - DNA, 25 bp, Mus musculus
cattcggctgaacaagttggtgaca

SEQ ID NO: 235420 - DNA, 25 bp, Mus musculus
cattcgggagaggcattcagtggct

SEQ ID NO: 235421 - DNA, 25 bp, Mus musculus
cattcgttcacggctgctcagactg

SEQ ID NO: 235422 - DNA, 25 bp, Mus musculus
cattctaaagcagatactaaaatgg

SEQ ID NO: 235423 - DNA, 25 bp, Mus musculus
cattctaacagcctgcagactgcag

SEQ ID NO: 235424 - DNA, 25 bp, Mus musculus
cattctaataaggagtggagtcaac

SEQ ID NO: 235425 - DNA, 25 bp, Mus musculus
cattctacacagctcacatgagccc

SEQ ID NO: 235426 - DNA, 25 bp, Mus musculus
cattctacagccatgggcttctgct

SEQ ID NO: 235427 - DNA, 25 bp, Mus musculus
cattctacaggcggcagaaacagca

SEQ ID NO: 235428 - DNA, 25 bp, Mus musculus
cattctacagggtcacagacaggaa

SEQ ID NO: 235429 - DNA, 25 bp, Mus musculus
cattctaccccagacaagaataagg

SEQ ID NO: 235430 - DNA, 25 bp, Mus musculus
cattctaccccagttcccaaagtgg

SEQ ID NO: 235431 - DNA, 25 bp, Mus musculus
cattctaccgctcctggaggatgaa

SEQ ID NO: 235432 - DNA, 25 bp, Mus musculus
cattctaccgctgaaaaagcagttg

SEQ ID NO: 235433 - DNA, 25 bp, Mus musculus
cattctaccgctttgatgcagcaat

SEQ ID NO: 235434 - DNA, 25 bp, Mus musculus
cattctattgataaggctgcctttg

SEQ ID NO: 235435 - DNA, 25 bp, Mus musculus
cattctattgataaggtaacaagcc

SEQ ID NO: 235436 - DNA, 25 bp, Mus musculus
cattctcaaaaatttcaaaggccat

SEQ ID NO: 235437 - DNA, 25 bp, Mus musculus
cattctcaacaacctgagattcata

SEQ ID NO: 235438 - DNA, 25 bp, Mus musculus
cattctcaagaggtctgaatttcct

SEQ ID NO: 235439 - DNA, 25 bp, Mus musculus
cattctcaaggtttcttttacagct

SEQ ID NO: 235440 - DNA, 25 bp, Mus musculus
cattctcaatggaaatatggaaacc

SEQ ID NO: 235441 - DNA, 25 bp, Mus musculus
cattctcaatgggaaaaagagcttg

SEQ ID NO: 235442 - DNA, 25 bp, Mus musculus
cattctcacagagatgaggcttgag

SEQ ID NO: 235443 - DNA, 25 bp, Mus musculus
cattctcacagagtgttctccatgg

SEQ ID NO: 235444 - DNA, 25 bp, Mus musculus
cattctcaccgacatcactcagcac

SEQ ID NO: 235445 - DNA, 25 bp, Mus musculus
cattctcagcaggccgcagatcatg

SEQ ID NO: 235446 - DNA, 25 bp, Mus musculus
cattctcagcatcatgctgggagat

SEQ ID NO: 235447 - DNA, 25 bp, Mus musculus
cattctcatcgccgagctgaatgtc

SEQ ID NO: 235448 - DNA, 25 bp, Mus musculus
cattctccactcttgaaagaaaaat

SEQ ID NO: 235449 - DNA, 25 bp, Mus musculus
cattctccattccatttctgggctt

SEQ ID NO: 235450 - DNA, 25 bp, Mus musculus
cattctcctggtgcagatcactgga

SEQ ID NO: 235451 - DNA, 25 bp, Mus musculus
cattctcgaggtggctgttatctat

SEQ ID NO: 235452 - DNA, 25 bp, Mus musculus
cattctctcaatcgtgtatgcccag

SEQ ID NO: 235453 - DNA, 25 bp, Mus musculus
cattctctcaatggtgtatgcccag

SEQ ID NO: 235454 - DNA, 25 bp, Mus musculus
cattctctcatagggaactttcaag

SEQ ID NO: 235455 - DNA, 25 bp, Mus musculus
cattctctccagctctgggccccag

SEQ ID NO: 235456 - DNA, 25 bp, Mus musculus
cattctctggaagattaggtcagag

SEQ ID NO: 235457 - DNA, 25 bp, Mus musculus
cattctctggaagtcctagtcactc

SEQ ID NO: 235458 - DNA, 25 bp, Mus musculus
cattctcttaaggttgtgtggagga

SEQ ID NO: 235459 - DNA, 25 bp, Mus musculus
cattctgaagatactaagcaaccag

SEQ ID NO: 235460 - DNA, 25 bp, Mus musculus
cattctgaagatgtgggcacatgct

SEQ ID NO: 235461 - DNA, 25 bp, Mus musculus
cattctgaaggatttgacgttggtt

SEQ ID NO: 235462 - DNA, 25 bp, Mus musculus
cattctgacagctgtgaactgtgtt

SEQ ID NO: 235463 - DNA, 25 bp, Mus musculus
cattctgatcctagtgtcaaaggtc

SEQ ID NO: 235464 - DNA, 25 bp, Mus musculus
cattctgattgggactggaaaagga

SEQ ID NO: 235465 - DNA, 25 bp, Mus musculus
cattctgattggggtactggaaaag

SEQ ID NO: 235466 - DNA, 25 bp, Mus musculus
cattctgcaagtgggtgggaccatc

SEQ ID NO: 235467 - DNA, 25 bp, Mus musculus
cattctgcagcagatcgtgaacctt

SEQ ID NO: 235468 - DNA, 25 bp, Mus musculus
cattctgcgattcccaaggccttcc

SEQ ID NO: 235469 - DNA, 25 bp, Mus musculus
cattctgctggctgctgctgctgcc

SEQ ID NO: 235470 - DNA, 25 bp, Mus musculus
cattctgcttagcctgctgaggcat

SEQ ID NO: 235471 - DNA, 25 bp, Mus musculus
cattctgcttagtgcctgcacgtct

SEQ ID NO: 235472 - DNA, 25 bp, Mus musculus
cattctggagcagtgccaataactt

SEQ ID NO: 235473 - DNA, 25 bp, Mus musculus
cattctggagccagcagggcctcaa

SEQ ID NO: 235474 - DNA, 25 bp, Mus musculus
cattctggagggatgagacacctcc

SEQ ID NO: 235475 - DNA, 25 bp, Mus musculus
cattctggcccataaatgctgttgg

SEQ ID NO: 235476 - DNA, 25 bp, Mus musculus
cattctggctgcagcagtgaaggct

SEQ ID NO: 235477 - DNA, 25 bp, Mus musculus
cattctgggccaggagtctccaaaa

SEQ ID NO: 235478 - DNA, 25 bp, Mus musculus
cattctggtgttcggtagagctggt

SEQ ID NO: 235479 - DNA, 25 bp, Mus musculus
cattctggtgttcggtgaagatggt

SEQ ID NO: 235480 - DNA, 25 bp, Mus musculus
cattcttaagattcctttgagagac

SEQ ID NO: 235481 - DNA, 25 bp, Mus musculus
cattcttaatttaccgagagaaagc

SEQ ID NO: 235482 - DNA, 25 bp, Mus musculus
cattcttaccaagaagtttgttcgc

SEQ ID NO: 235483 - DNA, 25 bp, Mus musculus
cattcttactgacagcttttttatt

SEQ ID NO: 235484 - DNA, 25 bp, Mus musculus
cattcttactgacagtgtacactct

SEQ ID NO: 235485 - DNA, 25 bp, Mus musculus
cattcttactggaagattatcctgt

SEQ ID NO: 235486 - DNA, 25 bp, Mus musculus
cattcttagaaaacgcctccttggc

SEQ ID NO: 235487 - DNA, 25 bp, Mus musculus
cattcttcaagagtttatccatgct

SEQ ID NO: 235488 - DNA, 25 bp, Mus musculus
cattcttcaggtgttgggaaaccac

SEQ ID NO: 235489 - DNA, 25 bp, Mus musculus
cattcttcatttcaggccatcagct

SEQ ID NO: 235490 - DNA, 25 bp, Mus musculus
cattcttcccttagaccgtcacgac

SEQ ID NO: 235491 - DNA, 25 bp, Mus musculus
cattcttctgggtcggatgctctgg

SEQ ID NO: 235492 - DNA, 25 bp, Mus musculus
cattcttctgtctcccctgaggcct

SEQ ID NO: 235493 - DNA, 25 bp, Mus musculus
cattcttgactgggctgctggacct

SEQ ID NO: 235494 - DNA, 25 bp, Mus musculus
cattcttgaggtggagtctttcatt

SEQ ID NO: 235495 - DNA, 25 bp, Mus musculus
cattcttggtactgcatagtgggac

SEQ ID NO: 235496 - DNA, 25 bp, Mus musculus
cattcttggtactggtgaacaccat

SEQ ID NO: 235497 - DNA, 25 bp, Mus musculus
cattgaaagagcccattctgcactc

SEQ ID NO: 235498 - DNA, 25 bp, Mus musculus
cattgaaagaggcttcatcactgta

SEQ ID NO: 235499 - DNA, 25 bp, Mus musculus
cattgaactaaaggagtcaaggagt

SEQ ID NO: 235500 - DNA, 25 bp, Mus musculus
cattgaagacccaactccgaagtca

SEQ ID NO: 235501 - DNA, 25 bp, Mus musculus
cattgaagagaagagccttgttgat

SEQ ID NO: 235502 - DNA, 25 bp, Mus musculus
cattgaagagcatgcctctgcagac

SEQ ID NO: 235503 - DNA, 25 bp, Mus musculus
cattgaagagcatgcctctggagcc

SEQ ID NO: 235504 - DNA, 25 bp, Mus musculus
cattgaaggacagccaaatagaata

SEQ ID NO: 235505 - DNA, 25 bp, Mus musculus
cattgaaggtacaggagttaaagac

SEQ ID NO: 235506 - DNA, 25 bp, Mus musculus
cattgaagtgaaagctgctcctgac

SEQ ID NO: 235507 - DNA, 25 bp, Mus musculus
cattgaagtgaaaggagatttctaa

SEQ ID NO: 235508 - DNA, 25 bp, Mus musculus
cattgaatatactgttgaatcaagg

SEQ ID NO: 235509 - DNA, 25 bp, Mus musculus
cattgaatatagacctgaaaaccat

SEQ ID NO: 235510 - DNA, 25 bp, Mus musculus
cattgaatatgagatgtgcataatg

SEQ ID NO: 235511 - DNA, 25 bp, Mus musculus
cattgaatatgaggtgtcagctgtg

SEQ ID NO: 235512 - DNA, 25 bp, Mus musculus
cattgaattttagaatgattgaaga

SEQ ID NO: 235513 - DNA, 25 bp, Mus musculus
cattgaattttagctggattcatcg

SEQ ID NO: 235514 - DNA, 25 bp, Mus musculus
cattgacactgctgacagtgccacg

SEQ ID NO: 235515 - DNA, 25 bp, Mus musculus
cattgacactgctgatgccgagtgc

SEQ ID NO: 235516 - DNA, 25 bp, Mus musculus
cattgacataggctcgttcaggcct

SEQ ID NO: 235517 - DNA, 25 bp, Mus musculus
cattgacatagggaacgtctagctc

SEQ ID NO: 235518 - DNA, 25 bp, Mus musculus
cattgaccaatttagtattcgcctg

SEQ ID NO: 235519 - DNA, 25 bp, Mus musculus
cattgaccactcagctgctgcgctg

SEQ ID NO: 235520 - DNA, 25 bp, Mus musculus
cattgaccagaccaccgctcttgat

SEQ ID NO: 235521 - DNA, 25 bp, Mus musculus
cattgaccagcaccacctgccccta

SEQ ID NO: 235522 - DNA, 25 bp, Mus musculus
cattgaccagcaggaatccagccat

SEQ ID NO: 235523 - DNA, 25 bp, Mus musculus
cattgaccatcagacaagctgcaac

SEQ ID NO: 235524 - DNA, 25 bp, Mus musculus
cattgacccaggtgctctcaccacc

SEQ ID NO: 235525 - DNA, 25 bp, Mus musculus
cattgacctggtgatctccttcttt

SEQ ID NO: 235526 - DNA, 25 bp, Mus musculus
cattgactgagccaagtggtggcgg

SEQ ID NO: 235527 - DNA, 25 bp, Mus musculus
cattgactgcaggtccctggaaaca

SEQ ID NO: 235528 - DNA, 25 bp, Mus musculus
cattgacttaaaggaactagaggct

SEQ ID NO: 235529 - DNA, 25 bp, Mus musculus
cattgacttcatggtggcttgcatg

SEQ ID NO: 235530 - DNA, 25 bp, Mus musculus
cattgagaacctgtctccttaaaga

SEQ ID NO: 235531 - DNA, 25 bp, Mus musculus
cattgagaacttcaggtctgctgta

SEQ ID NO: 235532 - DNA, 25 bp, Mus musculus
cattgagaacttcaggtttgctgtc

SEQ ID NO: 235533 - DNA, 25 bp, Mus musculus
cattgagaagtgccccaagccagtg

SEQ ID NO: 235534 - DNA, 25 bp, Mus musculus
cattgagaagtgcctgtgacattcg

SEQ ID NO: 235535 - DNA, 25 bp, Mus musculus
cattgagactgacaatttatttcac

SEQ ID NO: 235536 - DNA, 25 bp, Mus musculus
cattgagactgccaaacaagaagcc

SEQ ID NO: 235537 - DNA, 25 bp, Mus musculus
cattgagactttctttggggtaggc

SEQ ID NO: 235538 - DNA, 25 bp, Mus musculus
cattgagagaagtgatattgtggtc

SEQ ID NO: 235539 - DNA, 25 bp, Mus musculus
cattgagatccggaggatccaagga

SEQ ID NO: 235540 - DNA, 25 bp, Mus musculus
cattgagcagagtctgcgagaaatc

SEQ ID NO: 235541 - DNA, 25 bp, Mus musculus
cattgagcaggcatacaaatgctct

SEQ ID NO: 235542 - DNA, 25 bp, Mus musculus
cattgagcagttggtaagtggagaa

SEQ ID NO: 235543 - DNA, 25 bp, Mus musculus
cattgagctcaagaaaccacagtgc

SEQ ID NO: 235544 - DNA, 25 bp, Mus musculus
cattgaggaataggtacctggcagc

SEQ ID NO: 235545 - DNA, 25 bp, Mus musculus
cattgaggacccggagctagaagcg

SEQ ID NO: 235546 - DNA, 25 bp, Mus musculus
cattgaggatctggaagctcaagtg

SEQ ID NO: 235547 - DNA, 25 bp, Mus musculus
cattgaggatgccagagcacagggc

SEQ ID NO: 235548 - DNA, 25 bp, Mus musculus
cattgaggatgccaggagctccggc

SEQ ID NO: 235549 - DNA, 25 bp, Mus musculus
cattgaggcaaagaacctagccagc

SEQ ID NO: 235550 - DNA, 25 bp, Mus musculus
cattgaggcagaagtgctgtgtggt

SEQ ID NO: 235551 - DNA, 25 bp, Mus musculus
cattgaggcagaagttgacccacct

SEQ ID NO: 235552 - DNA, 25 bp, Mus musculus
cattgagggcagcctggacactgca

SEQ ID NO: 235553 - DNA, 25 bp, Mus musculus
cattgaggttgagcaacattttgat

SEQ ID NO: 235554 - DNA, 25 bp, Mus musculus
cattgaggttgagggaatagccaga

SEQ ID NO: 235555 - DNA, 25 bp, Mus musculus
cattgaggttgaggtgtcctcaaca

SEQ ID NO: 235556 - DNA, 25 bp, Mus musculus
cattgagtacatggccccagagatt

SEQ ID NO: 235557 - DNA, 25 bp, Mus musculus
cattgagtagatttgaaagaagcgg

SEQ ID NO: 235558 - DNA, 25 bp, Mus musculus
cattgagtaggtggacccatgcttt

SEQ ID NO: 235559 - DNA, 25 bp, Mus musculus
cattgagtctgccaaaattatggac

SEQ ID NO: 235560 - DNA, 25 bp, Mus musculus
cattgagtgcaggaatttgacgggc

SEQ ID NO: 235561 - DNA, 25 bp, Mus musculus
cattgagtgcaggcttggctgttgt

SEQ ID NO: 235562 - DNA, 25 bp, Mus musculus
cattgataatccgctggctcgggcc

SEQ ID NO: 235563 - DNA, 25 bp, Mus musculus
cattgatagacagatcctacttctg

SEQ ID NO: 235564 - DNA, 25 bp, Mus musculus
cattgatcaaggtctgaagaagatt

SEQ ID NO: 235565 - DNA, 25 bp, Mus musculus
cattgatctggttatccaggccgtg

SEQ ID NO: 235566 - DNA, 25 bp, Mus musculus
cattgatgaaagagaaaaaaatctg

SEQ ID NO: 235567 - DNA, 25 bp, Mus musculus
cattgatgaagcgtcaggaactgtg

SEQ ID NO: 235568 - DNA, 25 bp, Mus musculus
cattgatgaccagagttacaagcac

SEQ ID NO: 235569 - DNA, 25 bp, Mus musculus
cattgatgacctttggcaagaagac

SEQ ID NO: 235570 - DNA, 25 bp, Mus musculus
cattgatgagaaaaagaaatccaat

SEQ ID NO: 235571 - DNA, 25 bp, Mus musculus
cattgatgagtatgcacctgaggat

SEQ ID NO: 235572 - DNA, 25 bp, Mus musculus
cattgatgagtgaagaggcgacgac

SEQ ID NO: 235573 - DNA, 25 bp, Mus musculus
cattgatgagtgacctgctgccgtc

SEQ ID NO: 235574 - DNA, 25 bp, Mus musculus
cattgatgcgtgcagggcgacagtg

SEQ ID NO: 235575 - DNA, 25 bp, Mus musculus
cattgatggcaagatcttctgtgtg

SEQ ID NO: 235576 - DNA, 25 bp, Mus musculus
cattgatgggaagaaccagcaagag

SEQ ID NO: 235577 - DNA, 25 bp, Mus musculus
cattgatgtcacgaagccagcgatc

SEQ ID NO: 235578 - DNA, 25 bp, Mus musculus
cattgatgtcacgccgcataactca

SEQ ID NO: 235579 - DNA, 25 bp, Mus musculus
cattgatgtcacggtctattacaat

SEQ ID NO: 235580 - DNA, 25 bp, Mus musculus
cattgattaagagtgtcaacaggag

SEQ ID NO: 235581 - DNA, 25 bp, Mus musculus
cattgattaaggcagtagagtgtca

SEQ ID NO: 235582 - DNA, 25 bp, Mus musculus
cattgattaatggaccacagaccag

SEQ ID NO: 235583 - DNA, 25 bp, Mus musculus
cattgattgtagagatcagctcgaa

SEQ ID NO: 235584 - DNA, 25 bp, Mus musculus
cattgattgtagagttcaggatggc

SEQ ID NO: 235585 - DNA, 25 bp, Mus musculus
cattgcaaagattctgaaaggcctg

SEQ ID NO: 235586 - DNA, 25 bp, Mus musculus
cattgcaaaggatgaagtcgcccac

SEQ ID NO: 235587 - DNA, 25 bp, Mus musculus
cattgcaaaggctgggatcatctgt

SEQ ID NO: 235588 - DNA, 25 bp, Mus musculus
cattgcaaatgctgaaaaaggagtg

SEQ ID NO: 235589 - DNA, 25 bp, Mus musculus
cattgcaaatgctgagtgaattata

SEQ ID NO: 235590 - DNA, 25 bp, Mus musculus
cattgcaagcaaggggaagggagga

SEQ ID NO: 235591 - DNA, 25 bp, Mus musculus
cattgcaatctccacatggtctatg

SEQ ID NO: 235592 - DNA, 25 bp, Mus musculus
cattgcaatggatgagtttcatcct

SEQ ID NO: 235593 - DNA, 25 bp, Mus musculus
cattgcacaaacaggagagcaacct

SEQ ID NO: 235594 - DNA, 25 bp, Mus musculus
cattgcacaaacgggagagcaacct

SEQ ID NO: 235595 - DNA, 25 bp, Mus musculus
cattgcacaagaaaagaaggctgca

SEQ ID NO: 235596 - DNA, 25 bp, Mus musculus
cattgcacacagaggaaagaaaata

SEQ ID NO: 235597 - DNA, 25 bp, Mus musculus
cattgcacacagttttggtttctcc

SEQ ID NO: 235598 - DNA, 25 bp, Mus musculus
cattgcaccagatcacagaactgtg

SEQ ID NO: 235599 - DNA, 25 bp, Mus musculus
cattgcacctatagatggcattcgc

SEQ ID NO: 235600 - DNA, 25 bp, Mus musculus
cattgcacctatagtgtctataata

SEQ ID NO: 235601 - DNA, 25 bp, Mus musculus
cattgcacggcagattacaaaagaa

SEQ ID NO: 235602 - DNA, 25 bp, Mus musculus
cattgcagaaacagacatggcaagt

SEQ ID NO: 235603 - DNA, 25 bp, Mus musculus
cattgcagacctgggactggctgtg

SEQ ID NO: 235604 - DNA, 25 bp, Mus musculus
cattgcagaggatttttgcagctca

SEQ ID NO: 235605 - DNA, 25 bp, Mus musculus
cattgcagaggggctacatgacact

SEQ ID NO: 235606 - DNA, 25 bp, Mus musculus
cattgcataggtagccaaggagcag

SEQ ID NO: 235607 - DNA, 25 bp, Mus musculus
cattgccaaagaagattcccagcga

SEQ ID NO: 235608 - DNA, 25 bp, Mus musculus
cattgccaaagaagctcctatgctg

SEQ ID NO: 235609 - DNA, 25 bp, Mus musculus
cattgccaaatgcaagctgtgcatt

SEQ ID NO: 235610 - DNA, 25 bp, Mus musculus
cattgccaacccagtgaactccacc

SEQ ID NO: 235611 - DNA, 25 bp, Mus musculus
cattgccaagcaaggaagcctgctg

SEQ ID NO: 235612 - DNA, 25 bp, Mus musculus
cattgccaaggcgttcgtgcctccc

SEQ ID NO: 235613 - DNA, 25 bp, Mus musculus
cattgccaagtataaaggagaagac

SEQ ID NO: 235614 - DNA, 25 bp, Mus musculus
cattgccaataaagttctttgtgat

SEQ ID NO: 235615 - DNA, 25 bp, Mus musculus
cattgccaataaatcagagtcctca

SEQ ID NO: 235616 - DNA, 25 bp, Mus musculus
cattgccagaaagagaaatgctttg

SEQ ID NO: 235617 - DNA, 25 bp, Mus musculus
cattgccagaatggaccatctgcga

SEQ ID NO: 235618 - DNA, 25 bp, Mus musculus
cattgccagagatccttgtgtgtgt

SEQ ID NO: 235619 - DNA, 25 bp, Mus musculus
cattgccataaaggtgacaaatgga

SEQ ID NO: 235620 - DNA, 25 bp, Mus musculus
cattgccatggaccgctcctttgac

SEQ ID NO: 235621 - DNA, 25 bp, Mus musculus
cattgcccaggtgaaaatccagggc

SEQ ID NO: 235622 - DNA, 25 bp, Mus musculus
cattgcccaggtgcactggagtgga

SEQ ID NO: 235623 - DNA, 25 bp, Mus musculus
cattgcccatctcaaagaaaaaatg

SEQ ID NO: 235624 - DNA, 25 bp, Mus musculus
cattgcccatctcagagaggaaact

SEQ ID NO: 235625 - DNA, 25 bp, Mus musculus
cattgccccctttcatacctgctac

SEQ ID NO: 235626 - DNA, 25 bp, Mus musculus
cattgcccgcaattgggcagatgca

SEQ ID NO: 235627 - DNA, 25 bp, Mus musculus
cattgccgagcgtgagagccaagcg

SEQ ID NO: 235628 - DNA, 25 bp, Mus musculus
cattgccgagctcggcttcatgacg

SEQ ID NO: 235629 - DNA, 25 bp, Mus musculus
cattgccgatgccagatgagacatc

SEQ ID NO: 235630 - DNA, 25 bp, Mus musculus
cattgccgcaggaacaccccaattc

SEQ ID NO: 235631 - DNA, 25 bp, Mus musculus
cattgccgcaggggtgatgtttata

SEQ ID NO: 235632 - DNA, 25 bp, Mus musculus
cattgccgcccaggactgctcctgc

SEQ ID NO: 235633 - DNA, 25 bp, Mus musculus
cattgccggaacgagccatggaccc

SEQ ID NO: 235634 - DNA, 25 bp, Mus musculus
cattgccggaacgaggcttcatcta

SEQ ID NO: 235635 - DNA, 25 bp, Mus musculus
cattgccgtgcaggcagccagctcc

SEQ ID NO: 235636 - DNA, 25 bp, Mus musculus
cattgcctacagattgtctgtgatt

SEQ ID NO: 235637 - DNA, 25 bp, Mus musculus
cattgcctcagcaactatcagacct

SEQ ID NO: 235638 - DNA, 25 bp, Mus musculus
cattgcctcagcctctccaaccccg

SEQ ID NO: 235639 - DNA, 25 bp, Mus musculus
cattgcgctacaggggcgggacaaa

SEQ ID NO: 235640 - DNA, 25 bp, Mus musculus
cattgcgtttctcccctgctcctct

SEQ ID NO: 235641 - DNA, 25 bp, Mus musculus
cattgctaaaagaggcatccaccat

SEQ ID NO: 235642 - DNA, 25 bp, Mus musculus
cattgctaacaggatgcccatccca

SEQ ID NO: 235643 - DNA, 25 bp, Mus musculus
cattgctaacaggggatcatgaggg

SEQ ID NO: 235644 - DNA, 25 bp, Mus musculus
cattgctaactgaaatggcaaagaa

SEQ ID NO: 235645 - DNA, 25 bp, Mus musculus
cattgctaactgccttgcagtgaga

SEQ ID NO: 235646 - DNA, 25 bp, Mus musculus
cattgctacagagtacctgaactat

SEQ ID NO: 235647 - DNA, 25 bp, Mus musculus
cattgctacagctgcacagagcatc

SEQ ID NO: 235648 - DNA, 25 bp, Mus musculus
cattgctcaagaccccggcagccca

SEQ ID NO: 235649 - DNA, 25 bp, Mus musculus
cattgctcaaggctgccttagactt

SEQ ID NO: 235650 - DNA, 25 bp, Mus musculus
cattgctcagaagaaacctgctcgg

SEQ ID NO: 235651 - DNA, 25 bp, Mus musculus
cattgctcagacggccagagcagag

SEQ ID NO: 235652 - DNA, 25 bp, Mus musculus
cattgctcagcatgagaatgatata

SEQ ID NO: 235653 - DNA, 25 bp, Mus musculus
cattgctctccagtccctgccgcct

SEQ ID NO: 235654 - DNA, 25 bp, Mus musculus
cattgctgaagatacgccaatgtca

SEQ ID NO: 235655 - DNA, 25 bp, Mus musculus
cattgctgaaggaatttgagcagtt

SEQ ID NO: 235656 - DNA, 25 bp, Mus musculus
cattgctgaccaaggagagagatgg

SEQ ID NO: 235657 - DNA, 25 bp, Mus musculus
cattgctgaccaaggcattggaatt

SEQ ID NO: 235658 - DNA, 25 bp, Mus musculus
cattgctgaggttgaaaatgaggag

SEQ ID NO: 235659 - DNA, 25 bp, Mus musculus
cattgctgatgctcggtgaaggagg

SEQ ID NO: 235660 - DNA, 25 bp, Mus musculus
cattgctgcctgagggttaaaattc

SEQ ID NO: 235661 - DNA, 25 bp, Mus musculus
cattgctgctcctagaagcgtgcaa

SEQ ID NO: 235662 - DNA, 25 bp, Mus musculus
cattgctggggggaaaggctcaagc

SEQ ID NO: 235663 - DNA, 25 bp, Mus musculus
cattgctgtctctgaaaaatgaatc

SEQ ID NO: 235664 - DNA, 25 bp, Mus musculus
cattgctgtgggagctgtgatggat

SEQ ID NO: 235665 - DNA, 25 bp, Mus musculus
cattgcttacaagattccgggcttt

SEQ ID NO: 235666 - DNA, 25 bp, Mus musculus
cattgcttacaaggccacagtgaac

SEQ ID NO: 235667 - DNA, 25 bp, Mus musculus
cattgcttcaaccagggccagtccc

SEQ ID NO: 235668 - DNA, 25 bp, Mus musculus
cattgcttctctgtggaataaattt

SEQ ID NO: 235669 - DNA, 25 bp, Mus musculus
cattgctttaaggacctgcaggaag

SEQ ID NO: 235670 - DNA, 25 bp, Mus musculus
cattgctttccagagcggaaacggg

SEQ ID NO: 235671 - DNA, 25 bp, Mus musculus
cattggaaacaagaatgcctacgag

SEQ ID NO: 235672 - DNA, 25 bp, Mus musculus
cattggaaacaggttcagacaatga

SEQ ID NO: 235673 - DNA, 25 bp, Mus musculus
cattggaaagatggtggaaccaggg

SEQ ID NO: 235674 - DNA, 25 bp, Mus musculus
cattggaacaaaattctcagatcgg

SEQ ID NO: 235675 - DNA, 25 bp, Mus musculus
cattggaactgaggatttctcagct

SEQ ID NO: 235676 - DNA, 25 bp, Mus musculus
cattggaagagtgtatcctcagaga

SEQ ID NO: 235677 - DNA, 25 bp, Mus musculus
cattggaattggtggtgtgacaaac

SEQ ID NO: 235678 - DNA, 25 bp, Mus musculus
cattggacagattgtccttctgaag

SEQ ID NO: 235679 - DNA, 25 bp, Mus musculus
cattggaccagttttcagagctgaa

SEQ ID NO: 235680 - DNA, 25 bp, Mus musculus
cattggagccaggcaggtgcagtct

SEQ ID NO: 235681 - DNA, 25 bp, Mus musculus
cattggagccaggtacgtacagacg

SEQ ID NO: 235682 - DNA, 25 bp, Mus musculus
cattggaggaataaacattgctgag

SEQ ID NO: 235683 - DNA, 25 bp, Mus musculus
cattggatcttctgcgtgctggtcc

SEQ ID NO: 235684 - DNA, 25 bp, Mus musculus
cattggatcttttgggatgactggc

SEQ ID NO: 235685 - DNA, 25 bp, Mus musculus
cattggattccgccattgatcttat

SEQ ID NO: 235686 - DNA, 25 bp, Mus musculus
cattggatttgccaactgtttctat

SEQ ID NO: 235687 - DNA, 25 bp, Mus musculus
cattggatttgccaagaggagctct

SEQ ID NO: 235688 - DNA, 25 bp, Mus musculus
cattggatttgccaatgcccagcag

SEQ ID NO: 235689 - DNA, 25 bp, Mus musculus
cattggcaaaaccaggtgcagatcc

SEQ ID NO: 235690 - DNA, 25 bp, Mus musculus
cattggcaagggcacagtcagtggc

SEQ ID NO: 235691 - DNA, 25 bp, Mus musculus
cattggcacagaggctcagatccga

SEQ ID NO: 235692 - DNA, 25 bp, Mus musculus
cattggcacagcagttccgcagagg

SEQ ID NO: 235693 - DNA, 25 bp, Mus musculus
cattggcggaggtgtggacctcgtt

SEQ ID NO: 235694 - DNA, 25 bp, Mus musculus
cattggcgtcccccatccacctgac

SEQ ID NO: 235695 - DNA, 25 bp, Mus musculus
cattggctatcaggatgactttctg

SEQ ID NO: 235696 - DNA, 25 bp, Mus musculus
cattggctattagagccagatcatc

SEQ ID NO: 235697 - DNA, 25 bp, Mus musculus
cattggctattagagtgtgctcaag

SEQ ID NO: 235698 - DNA, 25 bp, Mus musculus
cattggcttgaaggatgctcagatt

SEQ ID NO: 235699 - DNA, 25 bp, Mus musculus
cattggcttgccccggggacagacc

SEQ ID NO: 235700 - DNA, 25 bp, Mus musculus
cattggctttatctcggacctaatc

SEQ ID NO: 235701 - DNA, 25 bp, Mus musculus
cattgggataacagttcccaaagtg

SEQ ID NO: 235702 - DNA, 25 bp, Mus musculus
cattgggattccaggcatagtcaga

SEQ ID NO: 235703 - DNA, 25 bp, Mus musculus
cattggggcaggaagtgtcgagtgg

SEQ ID NO: 235704 - DNA, 25 bp, Mus musculus
cattggtccctacagtcaagctgtg

SEQ ID NO: 235705 - DNA, 25 bp, Mus musculus
cattggtctaatctctgaccgcctc

SEQ ID NO: 235706 - DNA, 25 bp, Mus musculus
cattggtctcatctgccatggtgac

SEQ ID NO: 235707 - DNA, 25 bp, Mus musculus
cattggtctcatctgtctgcaatcc

SEQ ID NO: 235708 - DNA, 25 bp, Mus musculus
cattggtctgcaggcaccgctcctc

SEQ ID NO: 235709 - DNA, 25 bp, Mus musculus
cattggtgagctgaaaaatgaatct

SEQ ID NO: 235710 - DNA, 25 bp, Mus musculus
cattggtgagtatggcccaccccct

SEQ ID NO: 235711 - DNA, 25 bp, Mus musculus
cattggtgatgttatctatgcgggt

SEQ ID NO: 235712 - DNA, 25 bp, Mus musculus
cattggtgccaagaagatgcacgac

SEQ ID NO: 235713 - DNA, 25 bp, Mus musculus
cattggttatgccagaaacccttca

SEQ ID NO: 235714 - DNA, 25 bp, Mus musculus
cattggttgggataaactcgcatgt

SEQ ID NO: 235715 - DNA, 25 bp, Mus musculus
cattggtttacagtccctggatgac

SEQ ID NO: 235716 - DNA, 25 bp, Mus musculus
cattgtaactctggttttcttatcc

SEQ ID NO: 235717 - DNA, 25 bp, Mus musculus
cattgtaatcgattggtatcattga

SEQ ID NO: 235718 - DNA, 25 bp, Mus musculus
cattgtacagaagctgttgcaatac

SEQ ID NO: 235719 - DNA, 25 bp, Mus musculus
cattgtacagaaggacctggtggct

SEQ ID NO: 235720 - DNA, 25 bp, Mus musculus
cattgtacagaggcctatggatttg

SEQ ID NO: 235721 - DNA, 25 bp, Mus musculus
cattgtacagagggatgaaatgcag

SEQ ID NO: 235722 - DNA, 25 bp, Mus musculus
cattgtagaaaaaatcgatgcccaa

SEQ ID NO: 235723 - DNA, 25 bp, Mus musculus
cattgtagaagctggtgggatgcag

SEQ ID NO: 235724 - DNA, 25 bp, Mus musculus
cattgtaggagcagtttctccacct

SEQ ID NO: 235725 - DNA, 25 bp, Mus musculus
cattgtcacaagcagtcatgaaagt

SEQ ID NO: 235726 - DNA, 25 bp, Mus musculus
cattgtcacaagcagtctgaccaag

SEQ ID NO: 235727 - DNA, 25 bp, Mus musculus
cattgtcattccagggatcttcatt

SEQ ID NO: 235728 - DNA, 25 bp, Mus musculus
cattgtccagatcaggatgactctt

SEQ ID NO: 235729 - DNA, 25 bp, Mus musculus
cattgtccagatcagtaggtgcaaa

SEQ ID NO: 235730 - DNA, 25 bp, Mus musculus
cattgtccaggagcgccccttgtgg

SEQ ID NO: 235731 - DNA, 25 bp, Mus musculus
cattgtcccagaacaatattgctgc

SEQ ID NO: 235732 - DNA, 25 bp, Mus musculus
cattgtccgtgcaaaactggtgaac

SEQ ID NO: 235733 - DNA, 25 bp, Mus musculus
cattgtccttgattggctctttgtg

SEQ ID NO: 235734 - DNA, 25 bp, Mus musculus
cattgtccttggcaggacctcagaa

SEQ ID NO: 235735 - DNA, 25 bp, Mus musculus
cattgtccttgtttatgctgctggc

SEQ ID NO: 235736 - DNA, 25 bp, Mus musculus
cattgtcgagggggtggcaccgaaa

SEQ ID NO: 235737 - DNA, 25 bp, Mus musculus
cattgtcgaggtgtcaagctctcct

SEQ ID NO: 235738 - DNA, 25 bp, Mus musculus
cattgtcgatgaggtccatgagaga

SEQ ID NO: 235739 - DNA, 25 bp, Mus musculus
cattgtcggtgtacttgggagatgt

SEQ ID NO: 235740 - DNA, 25 bp, Mus musculus
cattgtctatgagtttctgatgtct

SEQ ID NO: 235741 - DNA, 25 bp, Mus musculus
cattgtcttctgggtgctgggagcc

SEQ ID NO: 235742 - DNA, 25 bp, Mus musculus
cattgtcttctggttctctgtgttc

SEQ ID NO: 235743 - DNA, 25 bp, Mus musculus
cattgtctttccagcttctcctggt

SEQ ID NO: 235744 - DNA, 25 bp, Mus musculus
cattgtctttccagggagctcccgt

SEQ ID NO: 235745 - DNA, 25 bp, Mus musculus
cattgtgaaagctcgtccctgccca

SEQ ID NO: 235746 - DNA, 25 bp, Mus musculus
cattgtgaaagggcagcggagcctg

SEQ ID NO: 235747 - DNA, 25 bp, Mus musculus
cattgtgaagtctcttattggtgca

SEQ ID NO: 235748 - DNA, 25 bp, Mus musculus
cattgtgacaagcagcctgacaaaa

SEQ ID NO: 235749 - DNA, 25 bp, Mus musculus
cattgtgacaagcaggctgagtaat

SEQ ID NO: 235750 - DNA, 25 bp, Mus musculus
cattgtgacagagtgggacttggta

SEQ ID NO: 235751 - DNA, 25 bp, Mus musculus
cattgtgaggggagctgttgtggaa

SEQ ID NO: 235752 - DNA, 25 bp, Mus musculus
cattgtgaggggtgttctgtagtgg

SEQ ID NO: 235753 - DNA, 25 bp, Mus musculus
cattgtgcaggcggctctcctagca

SEQ ID NO: 235754 - DNA, 25 bp, Mus musculus
cattgtgcagttctgtgccaatgac

SEQ ID NO: 235755 - DNA, 25 bp, Mus musculus
cattgtgctatagggattgtgccat

SEQ ID NO: 235756 - DNA, 25 bp, Mus musculus
cattgtgctcaagaccttcctggat

SEQ ID NO: 235757 - DNA, 25 bp, Mus musculus
cattgtggagacattgagaaagaag

SEQ ID NO: 235758 - DNA, 25 bp, Mus musculus
cattgtggaggcattgaacaagaaa

SEQ ID NO: 235759 - DNA, 25 bp, Mus musculus
cattgtggaggtcaacgtcctgcat

SEQ ID NO: 235760 - DNA, 25 bp, Mus musculus
cattgtggataagtgctgctaaagt

SEQ ID NO: 235761 - DNA, 25 bp, Mus musculus
cattgtggctgatcagactccaacg

SEQ ID NO: 235762 - DNA, 25 bp, Mus musculus
cattgtgggagagccaggctactgc

SEQ ID NO: 235763 - DNA, 25 bp, Mus musculus
cattgtggggacaaaacacagaagt

SEQ ID NO: 235764 - DNA, 25 bp, Mus musculus
cattgtggggacaggttctggaaat

SEQ ID NO: 235765 - DNA, 25 bp, Mus musculus
cattgtggtcaaggacggacccggc

SEQ ID NO: 235766 - DNA, 25 bp, Mus musculus
cattgtgtaaagcctcctgtaccct

SEQ ID NO: 235767 - DNA, 25 bp, Mus musculus
cattgtgtaggccaggttgactctt

SEQ ID NO: 235768 - DNA, 25 bp, Mus musculus
cattgtgtcagggacaggagttcag

SEQ ID NO: 235769 - DNA, 25 bp, Mus musculus
cattgtgtcagggctggacagtgct

SEQ ID NO: 235770 - DNA, 25 bp, Mus musculus
cattgtgtggggtcaccgacaatga

SEQ ID NO: 235771 - DNA, 25 bp, Mus musculus
cattgtgttttcagatgtccctggt

SEQ ID NO: 235772 - DNA, 25 bp, Mus musculus
cattgttaagaccgagaattcatgg

SEQ ID NO: 235773 - DNA, 25 bp, Mus musculus
cattgttacagaattgaattagaaa

SEQ ID NO: 235774 - DNA, 25 bp, Mus musculus
cattgttactgttacagatttggga

SEQ ID NO: 235775 - DNA, 25 bp, Mus musculus
cattgttatccagatggtttcaagg

SEQ ID NO: 235776 - DNA, 25 bp, Mus musculus
cattgttcaggctccaggccgggcc

SEQ ID NO: 235777 - DNA, 25 bp, Mus musculus
cattgttcgaggaaatgctgtcatt

SEQ ID NO: 235778 - DNA, 25 bp, Mus musculus
cattgttgtagaggatctgagaaat

SEQ ID NO: 235779 - DNA, 25 bp, Mus musculus
cattgttgtcaaggtttgatctcat

SEQ ID NO: 235780 - DNA, 25 bp, Mus musculus
cattgtttgtaccaggcaacttgcc

SEQ ID NO: 235781 - DNA, 25 bp, Mus musculus
cattgtttgtaccaggttcccaaga

SEQ ID NO: 235782 - DNA, 25 bp, Mus musculus
cattgtttgtgcagttgctttattc

SEQ ID NO: 235783 - DNA, 25 bp, Mus musculus
catttaaaacagttgccatccacac

SEQ ID NO: 235784 - DNA, 25 bp, Mus musculus
catttaaaagctatgacttcacacc

SEQ ID NO: 235785 - DNA, 25 bp, Mus musculus
catttaaaaggccatatcaatattg

SEQ ID NO: 235786 - DNA, 25 bp, Mus musculus
catttaaaatggatgtgaaatgatc

SEQ ID NO: 235787 - DNA, 25 bp, Mus musculus
catttaaacctgagcattttaatct

SEQ ID NO: 235788 - DNA, 25 bp, Mus musculus
catttaaaggcacaggaagcggaac

SEQ ID NO: 235789 - DNA, 25 bp, Mus musculus
catttaacaatagacatgaagcgcc

SEQ ID NO: 235790 - DNA, 25 bp, Mus musculus
catttaacctgagaaatgccaacca

SEQ ID NO: 235791 - DNA, 25 bp, Mus musculus
catttaagccagggtcagactcagt

SEQ ID NO: 235792 - DNA, 25 bp, Mus musculus
catttaagccagggtttgcagagca

SEQ ID NO: 235793 - DNA, 25 bp, Mus musculus
catttacacccagcaatcccaggat

SEQ ID NO: 235794 - DNA, 25 bp, Mus musculus
catttacagaattgcatactgggac

SEQ ID NO: 235795 - DNA, 25 bp, Mus musculus
catttacagaattggagttcataga

SEQ ID NO: 235796 - DNA, 25 bp, Mus musculus
catttacattggcatagctccttat

SEQ ID NO: 235797 - DNA, 25 bp, Mus musculus
catttaccagggaagacagtgatcc

SEQ ID NO: 235798 - DNA, 25 bp, Mus musculus
catttaccatatgacttttccaact

SEQ ID NO: 235799 - DNA, 25 bp, Mus musculus
catttaccgctcccctgagaacaca

SEQ ID NO: 235800 - DNA, 25 bp, Mus musculus
catttaccgctcccctggttctggt

SEQ ID NO: 235801 - DNA, 25 bp, Mus musculus
catttaccttccaggaatcctgctg

SEQ ID NO: 235802 - DNA, 25 bp, Mus musculus
catttactaagactctccttcccag

SEQ ID NO: 235803 - DNA, 25 bp, Mus musculus
catttactaagggctacagagcccc

SEQ ID NO: 235804 - DNA, 25 bp, Mus musculus
catttactatttccatgatggccag

SEQ ID NO: 235805 - DNA, 25 bp, Mus musculus
catttactgcccagacaagtgctgt

SEQ ID NO: 235806 - DNA, 25 bp, Mus musculus
catttactgcccagaccgtgccagt

SEQ ID NO: 235807 - DNA, 25 bp, Mus musculus
catttactttgggtcactgcccagc

SEQ ID NO: 235808 - DNA, 25 bp, Mus musculus
catttagaaggtgtgccgatgctct

SEQ ID NO: 235809 - DNA, 25 bp, Mus musculus
catttagatctgaacaatgcccagc

SEQ ID NO: 235810 - DNA, 25 bp, Mus musculus
catttagcaaaggtgtggtggctta

SEQ ID NO: 235811 - DNA, 25 bp, Mus musculus
catttagcatggctgttggaaagcc

SEQ ID NO: 235812 - DNA, 25 bp, Mus musculus
catttagtcaattggatccagtgtg

SEQ ID NO: 235813 - DNA, 25 bp, Mus musculus
catttatatgacagagtccgctcct

SEQ ID NO: 235814 - DNA, 25 bp, Mus musculus
catttatatgacaggtcatggaggg

SEQ ID NO: 235815 - DNA, 25 bp, Mus musculus
catttatctgtaacagcgtggaaga

SEQ ID NO: 235816 - DNA, 25 bp, Mus musculus
catttatggagggttcctggtacag

SEQ ID NO: 235817 - DNA, 25 bp, Mus musculus
catttcaaaagaaaggacctatgcg

SEQ ID NO: 235818 - DNA, 25 bp, Mus musculus
catttcaaaagtttgatttccagga

SEQ ID NO: 235819 - DNA, 25 bp, Mus musculus
catttcaaaggtaccaaagcagtca

SEQ ID NO: 235820 - DNA, 25 bp, Mus musculus
catttcaaaggtattttaaccacat

SEQ ID NO: 235821 - DNA, 25 bp, Mus musculus
catttcaaaggttagcgatgcaact

SEQ ID NO: 235822 - DNA, 25 bp, Mus musculus
catttcaaccgaattggcaaggttg

SEQ ID NO: 235823 - DNA, 25 bp, Mus musculus
catttcaagagtgagaagcgccacc

SEQ ID NO: 235824 - DNA, 25 bp, Mus musculus
catttcaatacgcgctaccctgatt

SEQ ID NO: 235825 - DNA, 25 bp, Mus musculus
catttcacaaagctcggattgggaa

SEQ ID NO: 235826 - DNA, 25 bp, Mus musculus
catttcacagctattgtccagggag

SEQ ID NO: 235827 - DNA, 25 bp, Mus musculus
catttcacagggagcccgaaccaac

SEQ ID NO: 235828 - DNA, 25 bp, Mus musculus
catttcacatacactgatcatagaa

SEQ ID NO: 235829 - DNA, 25 bp, Mus musculus
catttcaccttgcaaagcctttccc

SEQ ID NO: 235830 - DNA, 25 bp, Mus musculus
catttcagaaaatagccaggactat

SEQ ID NO: 235831 - DNA, 25 bp, Mus musculus
catttcagaaaataggtattgaggc

SEQ ID NO: 235832 - DNA, 25 bp, Mus musculus
catttcagagacagaggtctcaagg

SEQ ID NO: 235833 - DNA, 25 bp, Mus musculus
catttcagcagagactaaaggagat

SEQ ID NO: 235834 - DNA, 25 bp, Mus musculus
catttcagcaggatagtcattgcaa

SEQ ID NO: 235835 - DNA, 25 bp, Mus musculus
catttcagcaggttcaggcgcagct

SEQ ID NO: 235836 - DNA, 25 bp, Mus musculus
catttcagggagactgctgggctga

SEQ ID NO: 235837 - DNA, 25 bp, Mus musculus
catttcaggttgctcaccacaatgc

SEQ ID NO: 235838 - DNA, 25 bp, Mus musculus
catttcagtcaggaagtcctaccta

SEQ ID NO: 235839 - DNA, 25 bp, Mus musculus
catttcagttcagttagcccccaac

SEQ ID NO: 235840 - DNA, 25 bp, Mus musculus
catttccaagcgcctgagaagaagt

SEQ ID NO: 235841 - DNA, 25 bp, Mus musculus
catttccaaggctggtcttgaactc

SEQ ID NO: 235842 - DNA, 25 bp, Mus musculus
catttccaagtccttccagggaagt

SEQ ID NO: 235843 - DNA, 25 bp, Mus musculus
catttccacatagtgctggggatcg

SEQ ID NO: 235844 - DNA, 25 bp, Mus musculus
catttccacatagttcagcaatcag

SEQ ID NO: 235845 - DNA, 25 bp, Mus musculus
catttccactcatcctccttgtgag

SEQ ID NO: 235846 - DNA, 25 bp, Mus musculus
catttccactctgcttccctgtgct

SEQ ID NO: 235847 - DNA, 25 bp, Mus musculus
catttccagcgttcccaggctcctg

SEQ ID NO: 235848 - DNA, 25 bp, Mus musculus
catttccagcgttcccatgcccctg

SEQ ID NO: 235849 - DNA, 25 bp, Mus musculus
catttcccacagacctggatttgga

SEQ ID NO: 235850 - DNA, 25 bp, Mus musculus
catttcccagggcacaccaataaaa

SEQ ID NO: 235851 - DNA, 25 bp, Mus musculus
catttccccaagtgcgccgcagagc

SEQ ID NO: 235852 - DNA, 25 bp, Mus musculus
catttccccttggtgcaccatggag

SEQ ID NO: 235853 - DNA, 25 bp, Mus musculus
catttccctgatagattgctaacaa

SEQ ID NO: 235854 - DNA, 25 bp, Mus musculus
catttccctggcaggttcaccggac

SEQ ID NO: 235855 - DNA, 25 bp, Mus musculus
catttccgctgcccgtatggtggct

SEQ ID NO: 235856 - DNA, 25 bp, Mus musculus
catttccggaatgcaggtttcaaat

SEQ ID NO: 235857 - DNA, 25 bp, Mus musculus
catttccgtcctacaaacctcatcc

SEQ ID NO: 235858 - DNA, 25 bp, Mus musculus
catttcctataatgttgtgatgacg

SEQ ID NO: 235859 - DNA, 25 bp, Mus musculus
catttcctcacaacaaacaattgtg

SEQ ID NO: 235860 - DNA, 25 bp, Mus musculus
catttcctcacctccatctgctaag

SEQ ID NO: 235861 - DNA, 25 bp, Mus musculus
catttcctcctacaacacggtagag

SEQ ID NO: 235862 - DNA, 25 bp, Mus musculus
catttcctcctacattgagcagaca

SEQ ID NO: 235863 - DNA, 25 bp, Mus musculus
catttcctggcagcactgtccatcc

SEQ ID NO: 235864 - DNA, 25 bp, Mus musculus
catttcctggcagcctcgggatgga

SEQ ID NO: 235865 - DNA, 25 bp, Mus musculus
catttccttaacctgggatcgctta

SEQ ID NO: 235866 - DNA, 25 bp, Mus musculus
catttcctttcaggcaagtacattg

SEQ ID NO: 235867 - DNA, 25 bp, Mus musculus
catttcctttgaggaaatggatcca

SEQ ID NO: 235868 - DNA, 25 bp, Mus musculus
catttcggatgttcctgccttctct

SEQ ID NO: 235869 - DNA, 25 bp, Mus musculus
catttcggctcagactcgcatgtgt

SEQ ID NO: 235870 - DNA, 25 bp, Mus musculus
catttcggctcagggaagtgacttt

SEQ ID NO: 235871 - DNA, 25 bp, Mus musculus
catttctaactgggttatgggtgct

SEQ ID NO: 235872 - DNA, 25 bp, Mus musculus
catttctaactggtagtgtgaggaa

SEQ ID NO: 235873 - DNA, 25 bp, Mus musculus
catttctaagcaggctgaggtctct

SEQ ID NO: 235874 - DNA, 25 bp, Mus musculus
catttctacaaaagattgatgtatc

SEQ ID NO: 235875 - DNA, 25 bp, Mus musculus
catttctacaaaaggtacacaataa

SEQ ID NO: 235876 - DNA, 25 bp, Mus musculus
catttctacagaacctgctttcaga

SEQ ID NO: 235877 - DNA, 25 bp, Mus musculus
catttctatcgcaggcacatcaata

SEQ ID NO: 235878 - DNA, 25 bp, Mus musculus
catttctatcgcatgaagataagca

SEQ ID NO: 235879 - DNA, 25 bp, Mus musculus
catttctatcgggttcatagtggcg

SEQ ID NO: 235880 - DNA, 25 bp, Mus musculus
catttctatcggtatccgcccccag

SEQ ID NO: 235881 - DNA, 25 bp, Mus musculus
catttctcaaaaactgttctgcaag

SEQ ID NO: 235882 - DNA, 25 bp, Mus musculus
catttctcaaatcatctgaaaagga

SEQ ID NO: 235883 - DNA, 25 bp, Mus musculus
catttctcacggaaacctaggcagg

SEQ ID NO: 235884 - DNA, 25 bp, Mus musculus
catttctcacgggcacatctcatca

SEQ ID NO: 235885 - DNA, 25 bp, Mus musculus
catttctcaggaaacacgatgggca

SEQ ID NO: 235886 - DNA, 25 bp, Mus musculus
catttctcccaccagatacccataa

SEQ ID NO: 235887 - DNA, 25 bp, Mus musculus
catttctcccaccaggctcaatatt

SEQ ID NO: 235888 - DNA, 25 bp, Mus musculus
catttctcctggaggttccaactat

SEQ ID NO: 235889 - DNA, 25 bp, Mus musculus
catttctctgaccctgaatcgtcct

SEQ ID NO: 235890 - DNA, 25 bp, Mus musculus
catttctctggccacgggaaatcga

SEQ ID NO: 235891 - DNA, 25 bp, Mus musculus
catttctcttgtgatgaggagactg

SEQ ID NO: 235892 - DNA, 25 bp, Mus musculus
catttctcttgtgctgccacaggtg

SEQ ID NO: 235893 - DNA, 25 bp, Mus musculus
catttctgaaagattagaacaccta

SEQ ID NO: 235894 - DNA, 25 bp, Mus musculus
catttctgaaaggccagtgaatgtc

SEQ ID NO: 235895 - DNA, 25 bp, Mus musculus
catttctggggacacccagaaagca

SEQ ID NO: 235896 - DNA, 25 bp, Mus musculus
catttctttcatagatgaagcccga

SEQ ID NO: 235897 - DNA, 25 bp, Mus musculus
catttgaaaatgatgccagaatttc

SEQ ID NO: 235898 - DNA, 25 bp, Mus musculus
catttgaaagagccccggcagccca

SEQ ID NO: 235899 - DNA, 25 bp, Mus musculus
catttgaacagccctgctttaaggc

SEQ ID NO: 235900 - DNA, 25 bp, Mus musculus
catttgaacaggtcttatgcaagct

SEQ ID NO: 235901 - DNA, 25 bp, Mus musculus
catttgaccaatcagttcatgcaga

SEQ ID NO: 235902 - DNA, 25 bp, Mus musculus
catttgacttctttggtcttctagg

SEQ ID NO: 235903 - DNA, 25 bp, Mus musculus
catttgagacagttccgacgagata

SEQ ID NO: 235904 - DNA, 25 bp, Mus musculus
catttgagactctctgtgcaaagac

SEQ ID NO: 235905 - DNA, 25 bp, Mus musculus
catttgagagagagaaggagaggga

SEQ ID NO: 235906 - DNA, 25 bp, Mus musculus
catttgagattaagaaatgtgacct

SEQ ID NO: 235907 - DNA, 25 bp, Mus musculus
catttgagattaaggaagcctgctg

SEQ ID NO: 235908 - DNA, 25 bp, Mus musculus
catttgagggggtcaggacaaagag

SEQ ID NO: 235909 - DNA, 25 bp, Mus musculus
catttgagtgacaaagtctacagga

SEQ ID NO: 235910 - DNA, 25 bp, Mus musculus
catttgcacattcagaaacgcatcc

SEQ ID NO: 235911 - DNA, 25 bp, Mus musculus
catttgcgttctcaggatccaaagg

SEQ ID NO: 235912 - DNA, 25 bp, Mus musculus
catttgcgttctcgagcttcatggg

SEQ ID NO: 235913 - DNA, 25 bp, Mus musculus
catttgctgttctgtgattcttact

SEQ ID NO: 235914 - DNA, 25 bp, Mus musculus
catttggaatctcaaggatgtcaca

SEQ ID NO: 235915 - DNA, 25 bp, Mus musculus
catttggaggagtatagaacattgc

SEQ ID NO: 235916 - DNA, 25 bp, Mus musculus
catttggatgaggatggaagactgt

SEQ ID NO: 235917 - DNA, 25 bp, Mus musculus
catttggatggcaccacccctgtgt

SEQ ID NO: 235918 - DNA, 25 bp, Mus musculus
catttggcagagagcactccccata

SEQ ID NO: 235919 - DNA, 25 bp, Mus musculus
catttggcataattccaagaaacaa

SEQ ID NO: 235920 - DNA, 25 bp, Mus musculus
catttggccgtaggtttagtctcca

SEQ ID NO: 235921 - DNA, 25 bp, Mus musculus
catttggcttgactgctccttctgg

SEQ ID NO: 235922 - DNA, 25 bp, Mus musculus
catttgggagtcaggacacctatat

SEQ ID NO: 235923 - DNA, 25 bp, Mus musculus
catttgggtcttctaattgtcaaca

SEQ ID NO: 235924 - DNA, 25 bp, Mus musculus
catttggtgcaacgtttgtgcttgt

SEQ ID NO: 235925 - DNA, 25 bp, Mus musculus
catttggtgttcccttgccaagaaa

SEQ ID NO: 235926 - DNA, 25 bp, Mus musculus
catttggttactcagggatgaacaa

SEQ ID NO: 235927 - DNA, 25 bp, Mus musculus
catttgtaccattgggcagcaagaa

SEQ ID NO: 235928 - DNA, 25 bp, Mus musculus
catttgtataagagagttctggagt

SEQ ID NO: 235929 - DNA, 25 bp, Mus musculus
catttgtataaggtactgggaagaa

SEQ ID NO: 235930 - DNA, 25 bp, Mus musculus
catttgtatgtataggctgttatgt

SEQ ID NO: 235931 - DNA, 25 bp, Mus musculus
catttgtcaaataaaaatccatgga

SEQ ID NO: 235932 - DNA, 25 bp, Mus musculus
catttgtcctgggaacagaaattct

SEQ ID NO: 235933 - DNA, 25 bp, Mus musculus
catttgtgaagatatcgatgagtgt

SEQ ID NO: 235934 - DNA, 25 bp, Mus musculus
catttgtgaagatgaagatgaatgt

SEQ ID NO: 235935 - DNA, 25 bp, Mus musculus
catttgtgaagcctccaggcatctt

SEQ ID NO: 235936 - DNA, 25 bp, Mus musculus
catttgtgaagctggaagccgaagc

SEQ ID NO: 235937 - DNA, 25 bp, Mus musculus
catttgtgacaaagcccaatggcgc

SEQ ID NO: 235938 - DNA, 25 bp, Mus musculus
catttgtgagactcgccccacccat

SEQ ID NO: 235939 - DNA, 25 bp, Mus musculus
catttgtgggagatcaagttcttga

SEQ ID NO: 235940 - DNA, 25 bp, Mus musculus
catttgtggggaacagacaagtctt

SEQ ID NO: 235941 - DNA, 25 bp, Mus musculus
catttgtggggcggatgtctgctca

SEQ ID NO: 235942 - DNA, 25 bp, Mus musculus
catttgtggggtctcaaagcaagct

SEQ ID NO: 235943 - DNA, 25 bp, Mus musculus
catttgttattgatgctgtaagaac

SEQ ID NO: 235944 - DNA, 25 bp, Mus musculus
catttgttcgggaacctttgctcat

SEQ ID NO: 235945 - DNA, 25 bp, Mus musculus
catttgttcgggcttacggtgaagg

SEQ ID NO: 235946 - DNA, 25 bp, Mus musculus
catttgtttgcaatcaattatactg

SEQ ID NO: 235947 - DNA, 25 bp, Mus musculus
cattttaaaaaagtcgagcctgttg

SEQ ID NO: 235948 - DNA, 25 bp, Mus musculus
cattttaaagacatttgagaacttc

SEQ ID NO: 235949 - DNA, 25 bp, Mus musculus
cattttaaagctgccatccatccag

SEQ ID NO: 235950 - DNA, 25 bp, Mus musculus
cattttaaataggttgtaggaagtg

SEQ ID NO: 235951 - DNA, 25 bp, Mus musculus
cattttaagccagaacgctttaccg

SEQ ID NO: 235952 - DNA, 25 bp, Mus musculus
cattttaagccagagttgtaagctt

SEQ ID NO: 235953 - DNA, 25 bp, Mus musculus
cattttacagaactgtatgaggctg

SEQ ID NO: 235954 - DNA, 25 bp, Mus musculus
cattttactaagagatgtggctttg

SEQ ID NO: 235955 - DNA, 25 bp, Mus musculus
cattttactccagatggcagacttt

SEQ ID NO: 235956 - DNA, 25 bp, Mus musculus
cattttactccagccctggctgtcc

SEQ ID NO: 235957 - DNA, 25 bp, Mus musculus
cattttagatctgcctcactagtag

SEQ ID NO: 235958 - DNA, 25 bp, Mus musculus
cattttagcaggttttctgattaac

SEQ ID NO: 235959 - DNA, 25 bp, Mus musculus
cattttagtaggaagggcatttgtg

SEQ ID NO: 235960 - DNA, 25 bp, Mus musculus
cattttatgccaaaggctttaacag

SEQ ID NO: 235961 - DNA, 25 bp, Mus musculus
cattttattcatccaacaactattt

SEQ ID NO: 235962 - DNA, 25 bp, Mus musculus
cattttattcatgcttaggtggaga

SEQ ID NO: 235963 - DNA, 25 bp, Mus musculus
cattttattcatttttctggatatg

SEQ ID NO: 235964 - DNA, 25 bp, Mus musculus
cattttcaatgggaaagcgagcttg

SEQ ID NO: 235965 - DNA, 25 bp, Mus musculus
cattttcacagggaacaagtttacc

SEQ ID NO: 235966 - DNA, 25 bp, Mus musculus
cattttcacgtggagcctgacagca

SEQ ID NO: 235967 - DNA, 25 bp, Mus musculus
cattttcacgtgggcgggccaggct

SEQ ID NO: 235968 - DNA, 25 bp, Mus musculus
cattttcagtcagatatactttatt

SEQ ID NO: 235969 - DNA, 25 bp, Mus musculus
cattttcagtgatataccgatactt

SEQ ID NO: 235970 - DNA, 25 bp, Mus musculus
cattttcagtgtttgtgaggaaaca

SEQ ID NO: 235971 - DNA, 25 bp, Mus musculus
cattttcatgatcacaaaatttgtt

SEQ ID NO: 235972 - DNA, 25 bp, Mus musculus
cattttccaatatggctttatcctc

SEQ ID NO: 235973 - DNA, 25 bp, Mus musculus
cattttccacaatacgcgccccctg

SEQ ID NO: 235974 - DNA, 25 bp, Mus musculus
cattttccacacagttgaaaagggc

SEQ ID NO: 235975 - DNA, 25 bp, Mus musculus
cattttccagcaaagaattgggata

SEQ ID NO: 235976 - DNA, 25 bp, Mus musculus
cattttccagcaaaggtttagaccc

SEQ ID NO: 235977 - DNA, 25 bp, Mus musculus
cattttccatcaagatcagagacac

SEQ ID NO: 235978 - DNA, 25 bp, Mus musculus
cattttcctgaagataggacgggag

SEQ ID NO: 235979 - DNA, 25 bp, Mus musculus
cattttcggctggacgtcgactgtg

SEQ ID NO: 235980 - DNA, 25 bp, Mus musculus
cattttctagaaaatggaactatcc

SEQ ID NO: 235981 - DNA, 25 bp, Mus musculus
cattttctagatggaagctctatcc

SEQ ID NO: 235982 - DNA, 25 bp, Mus musculus
cattttctaggaaacctcgtgttgc

SEQ ID NO: 235983 - DNA, 25 bp, Mus musculus
cattttctctatgagtattggagaa

SEQ ID NO: 235984 - DNA, 25 bp, Mus musculus
cattttctggggaatgaattccaca

SEQ ID NO: 235985 - DNA, 25 bp, Mus musculus
cattttcttatatgggagagtcagt

SEQ ID NO: 235986 - DNA, 25 bp, Mus musculus
cattttcttggggctccagccttcc

SEQ ID NO: 235987 - DNA, 25 bp, Mus musculus
cattttgaaacacgagaagccctgc

SEQ ID NO: 235988 - DNA, 25 bp, Mus musculus
cattttgaaagatgtccttcaagaa

SEQ ID NO: 235989 - DNA, 25 bp, Mus musculus
cattttgacaagaagcagacaggca

SEQ ID NO: 235990 - DNA, 25 bp, Mus musculus
cattttgacaaggaccatggcgggg

SEQ ID NO: 235991 - DNA, 25 bp, Mus musculus
cattttgacaccatttggaggtgtg

SEQ ID NO: 235992 - DNA, 25 bp, Mus musculus
cattttgaggctaagacccttcggg

SEQ ID NO: 235993 - DNA, 25 bp, Mus musculus
cattttgaggctatcagtgacgagg

SEQ ID NO: 235994 - DNA, 25 bp, Mus musculus
cattttgatggagcctgaaacattt

SEQ ID NO: 235995 - DNA, 25 bp, Mus musculus
cattttgcagagattgagaagcatt

SEQ ID NO: 235996 - DNA, 25 bp, Mus musculus
cattttgcagagctttgggaccatc

SEQ ID NO: 235997 - DNA, 25 bp, Mus musculus
cattttgccggaacccagataatga

SEQ ID NO: 235998 - DNA, 25 bp, Mus musculus
cattttggaactagagttggtgaca

SEQ ID NO: 235999 - DNA, 25 bp, Mus musculus
cattttggaactaggtgcaagaata

SEQ ID NO: 236000 - DNA, 25 bp, Mus musculus
cattttggaaggtgcctctcctttc

SEQ ID NO: 236001 - DNA, 25 bp, Mus musculus
cattttgggttaccgagagcttttg

SEQ ID NO: 236002 - DNA, 25 bp, Mus musculus
cattttggtggcaagcttggcgccc

SEQ ID NO: 236003 - DNA, 25 bp, Mus musculus
cattttgtgcagcttacctgtggtt

SEQ ID NO: 236004 - DNA, 25 bp, Mus musculus
cattttgtgcaggatctgctgatga

SEQ ID NO: 236005 - DNA, 25 bp, Mus musculus
cattttgttaaaggctgatgaacca

SEQ ID NO: 236006 - DNA, 25 bp, Mus musculus
catttttaacagaagcaaacccaaa

SEQ ID NO: 236007 - DNA, 25 bp, Mus musculus
catttttaacagattagttcataaa

SEQ ID NO: 236008 - DNA, 25 bp, Mus musculus
catttttaagaggcaagaaacaaaa

SEQ ID NO: 236009 - DNA, 25 bp, Mus musculus
catttttaatcagtctgttatctcc

SEQ ID NO: 236010 - DNA, 25 bp, Mus musculus
catttttacaaggcatcaaggagtc

SEQ ID NO: 236011 - DNA, 25 bp, Mus musculus
catttttcaaggaagagaagtggtg

SEQ ID NO: 236012 - DNA, 25 bp, Mus musculus
catttttcaataatgtatatttaca

SEQ ID NO: 236013 - DNA, 25 bp, Mus musculus
catttttcagagctgcgttcagttt

SEQ ID NO: 236014 - DNA, 25 bp, Mus musculus
catttttcaggtcacctgccctgga

SEQ ID NO: 236015 - DNA, 25 bp, Mus musculus
catttttcagtccaaagaatcatct

SEQ ID NO: 236016 - DNA, 25 bp, Mus musculus
catttttcgacatccgcagacatcc

SEQ ID NO: 236017 - DNA, 25 bp, Mus musculus
catttttctgaattattttgataag

SEQ ID NO: 236018 - DNA, 25 bp, Mus musculus
catttttctgacaagcaggtggtcg

SEQ ID NO: 236019 - DNA, 25 bp, Mus musculus
catttttctggtgtgatcctgctgt

SEQ ID NO: 236020 - DNA, 25 bp, Mus musculus
catttttgacagagctgtcgcagct

SEQ ID NO: 236021 - DNA, 25 bp, Mus musculus
cattttttatcagccatcgtctaga

SEQ ID NO: 236022 - DNA, 25 bp, Mus musculus
ccaaaaaaaggagctgggggacagc

SEQ ID NO: 236023 - DNA, 25 bp, Mus musculus
ccaaaaaacagatcaaaaggtccct

SEQ ID NO: 236024 - DNA, 25 bp, Mus musculus
ccaaaaacaagctttacacagattt

SEQ ID NO: 236025 - DNA, 25 bp, Mus musculus
ccaaaaaccgaagcgcagcagcagt

SEQ ID NO: 236026 - DNA, 25 bp, Mus musculus
ccaaaaagaaaaacatcattccaga

SEQ ID NO: 236027 - DNA, 25 bp, Mus musculus
ccaaaaagagagggagccccgcgcg

SEQ ID NO: 236028 - DNA, 25 bp, Mus musculus
ccaaaaagagcttggacagagtgga

SEQ ID NO: 236029 - DNA, 25 bp, Mus musculus
ccaaaaagagtgtgcaaagacccac

SEQ ID NO: 236030 - DNA, 25 bp, Mus musculus
ccaaaaagcacaacccaagaggcac

SEQ ID NO: 236031 - DNA, 25 bp, Mus musculus
ccaaaaagcagatggagacacggaa

SEQ ID NO: 236032 - DNA, 25 bp, Mus musculus
ccaaaaagcagattgtccatcccat

SEQ ID NO: 236033 - DNA, 25 bp, Mus musculus
ccaaaaaggagaactacctctcgga

SEQ ID NO: 236034 - DNA, 25 bp, Mus musculus
ccaaaaaggaggtcctgagttcaaa

SEQ ID NO: 236035 - DNA, 25 bp, Mus musculus
ccaaaaataaggtacaagttcagta

SEQ ID NO: 236036 - DNA, 25 bp, Mus musculus
ccaaaaataataaagcatattcaaa

SEQ ID NO: 236037 - DNA, 25 bp, Mus musculus
ccaaaaataataaagggacagatat

SEQ ID NO: 236038 - DNA, 25 bp, Mus musculus
ccaaaaatcgagaatttatagctaa

SEQ ID NO: 236039 - DNA, 25 bp, Mus musculus
ccaaaacaaaagagatgtcttctca

SEQ ID NO: 236040 - DNA, 25 bp, Mus musculus
ccaaaacaagctaatgtctgcgaca

SEQ ID NO: 236041 - DNA, 25 bp, Mus musculus
ccaaaacaagttgctcccaaattag

SEQ ID NO: 236042 - DNA, 25 bp, Mus musculus
ccaaaacaatagtatctttacggac

SEQ ID NO: 236043 - DNA, 25 bp, Mus musculus
ccaaaacagaagaggaacaagttga

SEQ ID NO: 236044 - DNA, 25 bp, Mus musculus
ccaaaacagaagaggatgaaacaag

SEQ ID NO: 236045 - DNA, 25 bp, Mus musculus
ccaaaacagactgagaatgaagcca

SEQ ID NO: 236046 - DNA, 25 bp, Mus musculus
ccaaaaccaaaggcagaccgaaggc

SEQ ID NO: 236047 - DNA, 25 bp, Mus musculus
ccaaaaccagcaccgtcttctaatg

SEQ ID NO: 236048 - DNA, 25 bp, Mus musculus
ccaaaaccagtgtcgtcaccagcac

SEQ ID NO: 236049 - DNA, 25 bp, Mus musculus
ccaaaaccctgaggccacaagaaga

SEQ ID NO: 236050 - DNA, 25 bp, Mus musculus
ccaaaaccctgctatcttccagatc

SEQ ID NO: 236051 - DNA, 25 bp, Mus musculus
ccaaaacgaaaatgcaaaattacta

SEQ ID NO: 236052 - DNA, 25 bp, Mus musculus
ccaaaacgcagctgcagcactgggc

SEQ ID NO: 236053 - DNA, 25 bp, Mus musculus
ccaaaacgcaggaccatcagaatcc

SEQ ID NO: 236054 - DNA, 25 bp, Mus musculus
ccaaaacggacctacgagcagagga

SEQ ID NO: 236055 - DNA, 25 bp, Mus musculus
ccaaaagaaaggctgaaggggatgc

SEQ ID NO: 236056 - DNA, 25 bp, Mus musculus
ccaaaagacctccgtctggattttt

SEQ ID NO: 236057 - DNA, 25 bp, Mus musculus
ccaaaagagaaaaggaagcagtatg

SEQ ID NO: 236058 - DNA, 25 bp, Mus musculus
ccaaaagcaaggatgaagtggccca

SEQ ID NO: 236059 - DNA, 25 bp, Mus musculus
ccaaaagccaaagatgtgtgccaaa

SEQ ID NO: 236060 - DNA, 25 bp, Mus musculus
ccaaaagccaaaggtgtgtgccaaa

SEQ ID NO: 236061 - DNA, 25 bp, Mus musculus
ccaaaagcccatctgggcttttctc

SEQ ID NO: 236062 - DNA, 25 bp, Mus musculus
ccaaaagccctccaagaaagataaa

SEQ ID NO: 236063 - DNA, 25 bp, Mus musculus
ccaaaagccggaaggagaaggggtg

SEQ ID NO: 236064 - DNA, 25 bp, Mus musculus
ccaaaagccggtgaagatcgtatcg

SEQ ID NO: 236065 - DNA, 25 bp, Mus musculus
ccaaaaggacgacagatctatgtaa

SEQ ID NO: 236066 - DNA, 25 bp, Mus musculus
ccaaaaggagacaagggtgatatgg

SEQ ID NO: 236067 - DNA, 25 bp, Mus musculus
ccaaaaggagacacgggcttgccag

SEQ ID NO: 236068 - DNA, 25 bp, Mus musculus
ccaaaaggagactttctgcactggc

SEQ ID NO: 236069 - DNA, 25 bp, Mus musculus
ccaaaaggagatgtgggagcgagag

SEQ ID NO: 236070 - DNA, 25 bp, Mus musculus
ccaaaaggagcagcagcagcagcag

SEQ ID NO: 236071 - DNA, 25 bp, Mus musculus
ccaaaataaaggattcacagaaatc

SEQ ID NO: 236072 - DNA, 25 bp, Mus musculus
ccaaaataaaggtgagttcctcaga

SEQ ID NO: 236073 - DNA, 25 bp, Mus musculus
ccaaaataatgacaccattctaata

SEQ ID NO: 236074 - DNA, 25 bp, Mus musculus
ccaaaataccaccaagctcctcccc

SEQ ID NO: 236075 - DNA, 25 bp, Mus musculus
ccaaaataccccccggtgccacatt

SEQ ID NO: 236076 - DNA, 25 bp, Mus musculus
ccaaaatagttggtgtttggcacag

SEQ ID NO: 236077 - DNA, 25 bp, Mus musculus
ccaaaatcacagaataccacctcct

SEQ ID NO: 236078 - DNA, 25 bp, Mus musculus
ccaaaatcacagagaagcagaacaa

SEQ ID NO: 236079 - DNA, 25 bp, Mus musculus
ccaaaatcaggaacccactggttga

SEQ ID NO: 236080 - DNA, 25 bp, Mus musculus
ccaaaatcaggcaccccgtggcatc

SEQ ID NO: 236081 - DNA, 25 bp, Mus musculus
ccaaaatcagggccctgtggacaat

SEQ ID NO: 236082 - DNA, 25 bp, Mus musculus
ccaaaatcaggttgctggctcttgc

SEQ ID NO: 236083 - DNA, 25 bp, Mus musculus
ccaaaatcatgctgacacccagtgg

SEQ ID NO: 236084 - DNA, 25 bp, Mus musculus
ccaaaatctcaagaaggtggatttt

SEQ ID NO: 236085 - DNA, 25 bp, Mus musculus
ccaaaatctcaagctgcgagcctgc

SEQ ID NO: 236086 - DNA, 25 bp, Mus musculus
ccaaaatctcagaactcaagtgatt

SEQ ID NO: 236087 - DNA, 25 bp, Mus musculus
ccaaaatctcaggctggcctgtgag

SEQ ID NO: 236088 - DNA, 25 bp, Mus musculus
ccaaaatgaagaagatgggcttagg

SEQ ID NO: 236089 - DNA, 25 bp, Mus musculus
ccaaaatgaagaagtggaactatgg

SEQ ID NO: 236090 - DNA, 25 bp, Mus musculus
ccaaaatgaagccaatgctgaggcc

SEQ ID NO: 236091 - DNA, 25 bp, Mus musculus
ccaaaatgaaggaagctctgagttc

SEQ ID NO: 236092 - DNA, 25 bp, Mus musculus
ccaaaatgaaggcaaagggatgttg

SEQ ID NO: 236093 - DNA, 25 bp, Mus musculus
ccaaaatgatgaagaaaatactcag

SEQ ID NO: 236094 - DNA, 25 bp, Mus musculus
ccaaaatgatggatgcatccctaat

SEQ ID NO: 236095 - DNA, 25 bp, Mus musculus
ccaaaatggacacgctccccagagg

SEQ ID NO: 236096 - DNA, 25 bp, Mus musculus
ccaaaatggccatgtcagggatgag

SEQ ID NO: 236097 - DNA, 25 bp, Mus musculus
ccaaaatgtattgaggaaaaggaga

SEQ ID NO: 236098 - DNA, 25 bp, Mus musculus
ccaaaatgtcaggaattagctctgc

SEQ ID NO: 236099 - DNA, 25 bp, Mus musculus
ccaaaattagatcatagcagtctgc

SEQ ID NO: 236100 - DNA, 25 bp, Mus musculus
ccaaaattaggctgcgggacaaagg

SEQ ID NO: 236101 - DNA, 25 bp, Mus musculus
ccaaaattcaagttttttgatttgt

SEQ ID NO: 236102 - DNA, 25 bp, Mus musculus
ccaaaattcaggtgattgacatttc

SEQ ID NO: 236103 - DNA, 25 bp, Mus musculus
ccaaaattgaagagaatcaaaagga

SEQ ID NO: 236104 - DNA, 25 bp, Mus musculus
ccaaaattgccaagcctgtctcgct

SEQ ID NO: 236105 - DNA, 25 bp, Mus musculus
ccaaaattgccaaggcagaagagga

SEQ ID NO: 236106 - DNA, 25 bp, Mus musculus
ccaaaattgctgtgatcgcctgcat

SEQ ID NO: 236107 - DNA, 25 bp, Mus musculus
ccaaacaaagagagctggaaagtct

SEQ ID NO: 236108 - DNA, 25 bp, Mus musculus
ccaaacaaccaagagaagcaattgg

SEQ ID NO: 236109 - DNA, 25 bp, Mus musculus
ccaaacaaccaagcacttgtttcag

SEQ ID NO: 236110 - DNA, 25 bp, Mus musculus
ccaaacaaggttatatctgaagaac

SEQ ID NO: 236111 - DNA, 25 bp, Mus musculus
ccaaacaagtgcgctctgaaaacct

SEQ ID NO: 236112 - DNA, 25 bp, Mus musculus
ccaaacaagtgcggtaattaccctc

SEQ ID NO: 236113 - DNA, 25 bp, Mus musculus
ccaaacaatttcagcatctctgagt

SEQ ID NO: 236114 - DNA, 25 bp, Mus musculus
ccaaacaatttcagtcatctcctga

SEQ ID NO: 236115 - DNA, 25 bp, Mus musculus
ccaaacacaaggcgaaggagatgca

SEQ ID NO: 236116 - DNA, 25 bp, Mus musculus
ccaaacacacaccagtcatcttcag

SEQ ID NO: 236117 - DNA, 25 bp, Mus musculus
ccaaacacagatccgagtggtgaat

SEQ ID NO: 236118 - DNA, 25 bp, Mus musculus
ccaaacacagatggatgtagtgaat

SEQ ID NO: 236119 - DNA, 25 bp, Mus musculus
ccaaacacagccagccaatgccaac

SEQ ID NO: 236120 - DNA, 25 bp, Mus musculus
ccaaacacagcccacctgcatctgt

SEQ ID NO: 236121 - DNA, 25 bp, Mus musculus
ccaaacacagccccagccagccaat

SEQ ID NO: 236122 - DNA, 25 bp, Mus musculus
ccaaacaccagtatttctctgagtc

SEQ ID NO: 236123 - DNA, 25 bp, Mus musculus
ccaaacaccatgaggcaaaagcaaa

SEQ ID NO: 236124 - DNA, 25 bp, Mus musculus
ccaaacactacaaatcccctagtga

SEQ ID NO: 236125 - DNA, 25 bp, Mus musculus
ccaaacactgacagggatcaagttt

SEQ ID NO: 236126 - DNA, 25 bp, Mus musculus
ccaaacagaacagatgacacttctc

SEQ ID NO: 236127 - DNA, 25 bp, Mus musculus
ccaaacagaaccagccaacagccat

SEQ ID NO: 236128 - DNA, 25 bp, Mus musculus
ccaaacagaaccagcccatcattca

SEQ ID NO: 236129 - DNA, 25 bp, Mus musculus
ccaaacagagagaggtgaaaccttt

SEQ ID NO: 236130 - DNA, 25 bp, Mus musculus
ccaaacagagtctccttaaagaatc

SEQ ID NO: 236131 - DNA, 25 bp, Mus musculus
ccaaacagcaagcgcctgtgagaga

SEQ ID NO: 236132 - DNA, 25 bp, Mus musculus
ccaaacagcagaaggtagagcttga

SEQ ID NO: 236133 - DNA, 25 bp, Mus musculus
ccaaacaggaggaggcgaagaggat

SEQ ID NO: 236134 - DNA, 25 bp, Mus musculus
ccaaacagttcagatttcaactatt

SEQ ID NO: 236135 - DNA, 25 bp, Mus musculus
ccaaacagttcagtcattgttctag

SEQ ID NO: 236136 - DNA, 25 bp, Mus musculus
ccaaacagttcagtcttcctgtaag

SEQ ID NO: 236137 - DNA, 25 bp, Mus musculus
ccaaacatagtgaagttgttcgaag

SEQ ID NO: 236138 - DNA, 25 bp, Mus musculus
ccaaacattatagccagtgatggta

SEQ ID NO: 236139 - DNA, 25 bp, Mus musculus
ccaaacattataggatatcgtgctt

SEQ ID NO: 236140 - DNA, 25 bp, Mus musculus
ccaaacattgtgcgtctccatgaca

SEQ ID NO: 236141 - DNA, 25 bp, Mus musculus
ccaaacattgtgttaccggagggga

SEQ ID NO: 236142 - DNA, 25 bp, Mus musculus
ccaaaccaaaagttgatgtaggagt

SEQ ID NO: 236143 - DNA, 25 bp, Mus musculus
ccaaaccaaaccctgtagctcccta

SEQ ID NO: 236144 - DNA, 25 bp, Mus musculus
ccaaaccaacaggtgtgcccaaggt

SEQ ID NO: 236145 - DNA, 25 bp, Mus musculus
ccaaaccaagcagtcctatgcacca

SEQ ID NO: 236146 - DNA, 25 bp, Mus musculus
ccaaaccaccctgctgagacagtga

SEQ ID NO: 236147 - DNA, 25 bp, Mus musculus
ccaaaccaccgctgaagacgatgac

SEQ ID NO: 236148 - DNA, 25 bp, Mus musculus
ccaaaccaccgctgcagcccactaa

SEQ ID NO: 236149 - DNA, 25 bp, Mus musculus
ccaaaccactgtggattacgctcga

SEQ ID NO: 236150 - DNA, 25 bp, Mus musculus
ccaaaccaggaaaaagtttacatga

SEQ ID NO: 236151 - DNA, 25 bp, Mus musculus
ccaaaccaggaaaatgtttacatga

SEQ ID NO: 236152 - DNA, 25 bp, Mus musculus
ccaaaccatagagagacactacgca

SEQ ID NO: 236153 - DNA, 25 bp, Mus musculus
ccaaacccaaactggatcctctgaa

SEQ ID NO: 236154 - DNA, 25 bp, Mus musculus
ccaaacccaagaaaatgatctgaat

SEQ ID NO: 236155 - DNA, 25 bp, Mus musculus
ccaaacccaaggaggcggatgagtc

SEQ ID NO: 236156 - DNA, 25 bp, Mus musculus
ccaaacccaaggtgctacagtgggg

SEQ ID NO: 236157 - DNA, 25 bp, Mus musculus
ccaaacccagacttacagctctgag

SEQ ID NO: 236158 - DNA, 25 bp, Mus musculus
ccaaacccagatcagtggaccatcc

SEQ ID NO: 236159 - DNA, 25 bp, Mus musculus
ccaaacccaggtctggaggtgactg

SEQ ID NO: 236160 - DNA, 25 bp, Mus musculus
ccaaaccccaagaatctcgagaagc

SEQ ID NO: 236161 - DNA, 25 bp, Mus musculus
ccaaaccccaaggagcggctgcaaa

SEQ ID NO: 236162 - DNA, 25 bp, Mus musculus
ccaaaccccgccaagctctcgggga

SEQ ID NO: 236163 - DNA, 25 bp, Mus musculus
ccaaaccctttgcactgagcagcct

SEQ ID NO: 236164 - DNA, 25 bp, Mus musculus
ccaaaccgcaggcaatactagccag

SEQ ID NO: 236165 - DNA, 25 bp, Mus musculus
ccaaaccgcaggtataatcaaagga

SEQ ID NO: 236166 - DNA, 25 bp, Mus musculus
ccaaaccgcccagcggtcagagtac

SEQ ID NO: 236167 - DNA, 25 bp, Mus musculus
ccaaaccgtaggcctgtagctccct

SEQ ID NO: 236168 - DNA, 25 bp, Mus musculus
ccaaacctagagagagaaatacaag

SEQ ID NO: 236169 - DNA, 25 bp, Mus musculus
ccaaacctctcagtgaaaactgaac

SEQ ID NO: 236170 - DNA, 25 bp, Mus musculus
ccaaaccttcccaggaaactccatg

SEQ ID NO: 236171 - DNA, 25 bp, Mus musculus
ccaaaccttcccaggcacatctccc

SEQ ID NO: 236172 - DNA, 25 bp, Mus musculus
ccaaacgcagaagcttgcaggaaaa

SEQ ID NO: 236173 - DNA, 25 bp, Mus musculus
ccaaacgctataggtatgtgtatca

SEQ ID NO: 236174 - DNA, 25 bp, Mus musculus
ccaaacggatgaaaaccgtcaagga

SEQ ID NO: 236175 - DNA, 25 bp, Mus musculus
ccaaacggcatgtatcctcctccac

SEQ ID NO: 236176 - DNA, 25 bp, Mus musculus
ccaaacggcatgtgacctgacctag

SEQ ID NO: 236177 - DNA, 25 bp, Mus musculus
ccaaactacattgccaaccgaggtc

SEQ ID NO: 236178 - DNA, 25 bp, Mus musculus
ccaaactacattgttttcatcttcc

SEQ ID NO: 236179 - DNA, 25 bp, Mus musculus
ccaaactcaaggaccaggcagctaa

SEQ ID NO: 236180 - DNA, 25 bp, Mus musculus
ccaaactcaagttttggcaaggagc

SEQ ID NO: 236181 - DNA, 25 bp, Mus musculus
ccaaactcctaaaattatttcagct

SEQ ID NO: 236182 - DNA, 25 bp, Mus musculus
ccaaactctggtggataccctccgt

SEQ ID NO: 236183 - DNA, 25 bp, Mus musculus
ccaaactctggttcttctggttctt

SEQ ID NO: 236184 - DNA, 25 bp, Mus musculus
ccaaactgagatttgcaacagcatg

SEQ ID NO: 236185 - DNA, 25 bp, Mus musculus
ccaaactgcagctgcatggagcagc

SEQ ID NO: 236186 - DNA, 25 bp, Mus musculus
ccaaactgcaggaatgggcaaagga

SEQ ID NO: 236187 - DNA, 25 bp, Mus musculus
ccaaactgctcaggaataaagctgg

SEQ ID NO: 236188 - DNA, 25 bp, Mus musculus
ccaaactgtgtgcggagactgcggc

SEQ ID NO: 236189 - DNA, 25 bp, Mus musculus
ccaaactgttgattggtgctgatgg

SEQ ID NO: 236190 - DNA, 25 bp, Mus musculus
ccaaacttaaattgagtaggaagag

SEQ ID NO: 236191 - DNA, 25 bp, Mus musculus
ccaaacttcaagaagcatacagttt

SEQ ID NO: 236192 - DNA, 25 bp, Mus musculus
ccaaacttcaagaagtaccagtaca

SEQ ID NO: 236193 - DNA, 25 bp, Mus musculus
ccaaacttccagacctgaggtccaa

SEQ ID NO: 236194 - DNA, 25 bp, Mus musculus
ccaaacttccaggcacatctcaggc

SEQ ID NO: 236195 - DNA, 25 bp, Mus musculus
ccaaacttcctccagacagcctggc

SEQ ID NO: 236196 - DNA, 25 bp, Mus musculus
ccaaacttcctccaggactggacag

SEQ ID NO: 236197 - DNA, 25 bp, Mus musculus
ccaaacttgaaaagcaagaacggga

SEQ ID NO: 236198 - DNA, 25 bp, Mus musculus
ccaaacttttccagtgtgtccattg

SEQ ID NO: 236199 - DNA, 25 bp, Mus musculus
ccaaagaaaaaggaagactccacaa

SEQ ID NO: 236200 - DNA, 25 bp, Mus musculus
ccaaagaaaatatggccaacagcag

SEQ ID NO: 236201 - DNA, 25 bp, Mus musculus
ccaaagaaaatatggctttacaaga

SEQ ID NO: 236202 - DNA, 25 bp, Mus musculus
ccaaagaaagaagatgtcagcccag

SEQ ID NO: 236203 - DNA, 25 bp, Mus musculus
ccaaagaaaggtcaaatggttagca

SEQ ID NO: 236204 - DNA, 25 bp, Mus musculus
ccaaagaacagaaaatcaatctttc

SEQ ID NO: 236205 - DNA, 25 bp, Mus musculus
ccaaagaacaggtcctcagaatggt

SEQ ID NO: 236206 - DNA, 25 bp, Mus musculus
ccaaagaagacacccatataatgcc

SEQ ID NO: 236207 - DNA, 25 bp, Mus musculus
ccaaagaagaggaatgagttcctga

SEQ ID NO: 236208 - DNA, 25 bp, Mus musculus
ccaaagaagaggtgagtcctgagtt

SEQ ID NO: 236209 - DNA, 25 bp, Mus musculus
ccaaagacacgagcaccgggggtgg

SEQ ID NO: 236210 - DNA, 25 bp, Mus musculus
ccaaagacagacctgtcaagagaat

SEQ ID NO: 236211 - DNA, 25 bp, Mus musculus
ccaaagaccacgtggatgaaggctg

SEQ ID NO: 236212 - DNA, 25 bp, Mus musculus
ccaaagaccctatcgtcaacgtgtg

SEQ ID NO: 236213 - DNA, 25 bp, Mus musculus
ccaaagacccttctggagaggtgtt

SEQ ID NO: 236214 - DNA, 25 bp, Mus musculus
ccaaagacctggccaactgtaacag

SEQ ID NO: 236215 - DNA, 25 bp, Mus musculus
ccaaagaccttgagttgctggaact

SEQ ID NO: 236216 - DNA, 25 bp, Mus musculus
ccaaagacgcaggaaaaggaagaag

SEQ ID NO: 236217 - DNA, 25 bp, Mus musculus
ccaaagactgcagagaacttcagag

SEQ ID NO: 236218 - DNA, 25 bp, Mus musculus
ccaaagagaagcagcttgtgaaaaa

SEQ ID NO: 236219 - DNA, 25 bp, Mus musculus
ccaaagagaaggaaaagtgatagtg

SEQ ID NO: 236220 - DNA, 25 bp, Mus musculus
ccaaagagaaggcaggtacaccgag

SEQ ID NO: 236221 - DNA, 25 bp, Mus musculus
ccaaagagagacctcctaagccatg

SEQ ID NO: 236222 - DNA, 25 bp, Mus musculus
ccaaagagatggtcagccgcctgac

SEQ ID NO: 236223 - DNA, 25 bp, Mus musculus
ccaaagagcagcacctgacgttcac

SEQ ID NO: 236224 - DNA, 25 bp, Mus musculus
ccaaagagcccagcaaaggaagcca

SEQ ID NO: 236225 - DNA, 25 bp, Mus musculus
ccaaagagctcaaggatgcaggagc

SEQ ID NO: 236226 - DNA, 25 bp, Mus musculus
ccaaagaggagatatttggaccagt

SEQ ID NO: 236227 - DNA, 25 bp, Mus musculus
ccaaagagtggagttggagaaaact

SEQ ID NO: 236228 - DNA, 25 bp, Mus musculus
ccaaagagtggtgggcttatgctat

SEQ ID NO: 236229 - DNA, 25 bp, Mus musculus
ccaaagatcagagatggagtctcat

SEQ ID NO: 236230 - DNA, 25 bp, Mus musculus
ccaaagatcaggagatttgtacacc

SEQ ID NO: 236231 - DNA, 25 bp, Mus musculus
ccaaagatggaagaagccctctggg

SEQ ID NO: 236232 - DNA, 25 bp, Mus musculus
ccaaagatgggttaatatccttcca

SEQ ID NO: 236233 - DNA, 25 bp, Mus musculus
ccaaagattaaggtacacaggtttc

SEQ ID NO: 236234 - DNA, 25 bp, Mus musculus
ccaaagattaagttgctcaggaaac

SEQ ID NO: 236235 - DNA, 25 bp, Mus musculus
ccaaagattgccatggtggtgcaac

SEQ ID NO: 236236 - DNA, 25 bp, Mus musculus
ccaaagcaaaaatgaggagtgggaa

SEQ ID NO: 236237 - DNA, 25 bp, Mus musculus
ccaaagcaagagtgaagtgtgtcag

SEQ ID NO: 236238 - DNA, 25 bp, Mus musculus
ccaaagcaaggacgtccacgtctgg

SEQ ID NO: 236239 - DNA, 25 bp, Mus musculus
ccaaagcacagtgtcctcaacaatg

SEQ ID NO: 236240 - DNA, 25 bp, Mus musculus
ccaaagcatggaaataaatgccttg

SEQ ID NO: 236241 - DNA, 25 bp, Mus musculus
ccaaagcatggagggtgatgaggaa

SEQ ID NO: 236242 - DNA, 25 bp, Mus musculus
ccaaagcatggcaatgcttggcaaa

SEQ ID NO: 236243 - DNA, 25 bp, Mus musculus
ccaaagccagggcggttaaactcac

SEQ ID NO: 236244 - DNA, 25 bp, Mus musculus
ccaaagccctgaatggcttcacccc

SEQ ID NO: 236245 - DNA, 25 bp, Mus musculus
ccaaagcctacagacacagaggccc

SEQ ID NO: 236246 - DNA, 25 bp, Mus musculus
ccaaagcctgaaaccaaaattctca

SEQ ID NO: 236247 - DNA, 25 bp, Mus musculus
ccaaagcctgatgaggatgatgcca

SEQ ID NO: 236248 - DNA, 25 bp, Mus musculus
ccaaagcctttgctgcccagtttga

SEQ ID NO: 236249 - DNA, 25 bp, Mus musculus
ccaaagcctttgctggggacaccca

SEQ ID NO: 236250 - DNA, 25 bp, Mus musculus
ccaaagcgagaagactgagaaaagc

SEQ ID NO: 236251 - DNA, 25 bp, Mus musculus
ccaaagctaacagggacagttaaag

SEQ ID NO: 236252 - DNA, 25 bp, Mus musculus
ccaaagctcccaaagcaaatccagt

SEQ ID NO: 236253 - DNA, 25 bp, Mus musculus
ccaaagctgaatcgcggctggagtg

SEQ ID NO: 236254 - DNA, 25 bp, Mus musculus
ccaaagctgagagacacagaaggag

SEQ ID NO: 236255 - DNA, 25 bp, Mus musculus
ccaaagctggccttgcaggtctctc

SEQ ID NO: 236256 - DNA, 25 bp, Mus musculus
ccaaaggaacaaggacagggagatt

SEQ ID NO: 236257 - DNA, 25 bp, Mus musculus
ccaaaggacagaacaactgagattc

SEQ ID NO: 236258 - DNA, 25 bp, Mus musculus
ccaaaggacagaagaagaagaaagg

SEQ ID NO: 236259 - DNA, 25 bp, Mus musculus
ccaaaggacagaataatcctcaggt

SEQ ID NO: 236260 - DNA, 25 bp, Mus musculus
ccaaaggacagaggacctgaaggct

SEQ ID NO: 236261 - DNA, 25 bp, Mus musculus
ccaaaggacagagggtagacaaaca

SEQ ID NO: 236262 - DNA, 25 bp, Mus musculus
ccaaaggacagctggctgtatagga

SEQ ID NO: 236263 - DNA, 25 bp, Mus musculus
ccaaaggagggaccgctgacaaagg

SEQ ID NO: 236264 - DNA, 25 bp, Mus musculus
ccaaaggatccgctggtgctcctgg

SEQ ID NO: 236265 - DNA, 25 bp, Mus musculus
ccaaaggatggctccatctccattc

SEQ ID NO: 236266 - DNA, 25 bp, Mus musculus
ccaaaggcaatgaaggaagaagaaa

SEQ ID NO: 236267 - DNA, 25 bp, Mus musculus
ccaaaggcaatgaaggctccatata

SEQ ID NO: 236268 - DNA, 25 bp, Mus musculus
ccaaaggcaatgaaggtaaatgatc

SEQ ID NO: 236269 - DNA, 25 bp, Mus musculus
ccaaaggcagccctggccctgtggg

SEQ ID NO: 236270 - DNA, 25 bp, Mus musculus
ccaaaggcatcagatttcgtggata

SEQ ID NO: 236271 - DNA, 25 bp, Mus musculus
ccaaaggccccacaggctctgcagg

SEQ ID NO: 236272 - DNA, 25 bp, Mus musculus
ccaaaggccttggcaattatttgta

SEQ ID NO: 236273 - DNA, 25 bp, Mus musculus
ccaaaggctatagggtcggtgatgg

SEQ ID NO: 236274 - DNA, 25 bp, Mus musculus
ccaaaggctccgagcaaggccgtgc

SEQ ID NO: 236275 - DNA, 25 bp, Mus musculus
ccaaaggctctccgggttcaatagg

SEQ ID NO: 236276 - DNA, 25 bp, Mus musculus
ccaaaggctgcagatgcagccggtg

SEQ ID NO: 236277 - DNA, 25 bp, Mus musculus
ccaaaggctgcagctcttaaccggc

SEQ ID NO: 236278 - DNA, 25 bp, Mus musculus
ccaaagggaagggctccacctgtgc

SEQ ID NO: 236279 - DNA, 25 bp, Mus musculus
ccaaaggtaccagtggctacctccc

SEQ ID NO: 236280 - DNA, 25 bp, Mus musculus
ccaaaggtcaaggcaccaatgagga

SEQ ID NO: 236281 - DNA, 25 bp, Mus musculus
ccaaaggtcaaggctccaatgagga

SEQ ID NO: 236282 - DNA, 25 bp, Mus musculus
ccaaaggtcaggcgggtgaacctgg

SEQ ID NO: 236283 - DNA, 25 bp, Mus musculus
ccaaaggtcatataagtgacattga

SEQ ID NO: 236284 - DNA, 25 bp, Mus musculus
ccaaaggtcatataatgtcatattt

SEQ ID NO: 236285 - DNA, 25 bp, Mus musculus
ccaaaggtgaaattggaactcctgg

SEQ ID NO: 236286 - DNA, 25 bp, Mus musculus
ccaaaggtgccaacggcgagcctgg

SEQ ID NO: 236287 - DNA, 25 bp, Mus musculus
ccaaagtacagcagggcttcctgaa

SEQ ID NO: 236288 - DNA, 25 bp, Mus musculus
ccaaagtaccaatacacgagaccag

SEQ ID NO: 236289 - DNA, 25 bp, Mus musculus
ccaaagtattccaggctctgtgcaa

SEQ ID NO: 236290 - DNA, 25 bp, Mus musculus
ccaaagtcagagaagtcctgcatgt

SEQ ID NO: 236291 - DNA, 25 bp, Mus musculus
ccaaagtcagtcgaaacgttgaaag

SEQ ID NO: 236292 - DNA, 25 bp, Mus musculus
ccaaagtcagtgaacttctgggtca

SEQ ID NO: 236293 - DNA, 25 bp, Mus musculus
ccaaagtccaggatgttgtaccaca

SEQ ID NO: 236294 - DNA, 25 bp, Mus musculus
ccaaagtcttgtaatttgaactgtg

SEQ ID NO: 236295 - DNA, 25 bp, Mus musculus
ccaaagtcttgtgatttgaactgtg

SEQ ID NO: 236296 - DNA, 25 bp, Mus musculus
ccaaagtgaaaaagtactgtctgat

SEQ ID NO: 236297 - DNA, 25 bp, Mus musculus
ccaaagtgaagccgaagaagctgac

SEQ ID NO: 236298 - DNA, 25 bp, Mus musculus
ccaaagtgaggaacttctgcaggtg

SEQ ID NO: 236299 - DNA, 25 bp, Mus musculus
ccaaagtgatcctatcccatcaccc

SEQ ID NO: 236300 - DNA, 25 bp, Mus musculus
ccaaagttaaaaacagcctcaccat

SEQ ID NO: 236301 - DNA, 25 bp, Mus musculus
ccaaataaaacaggtggcttcggtg

SEQ ID NO: 236302 - DNA, 25 bp, Mus musculus
ccaaataaaacaggttcgggagcag

SEQ ID NO: 236303 - DNA, 25 bp, Mus musculus
ccaaataatgacctagccctcatca

SEQ ID NO: 236304 - DNA, 25 bp, Mus musculus
ccaaataatgatgtctatactcttc

SEQ ID NO: 236305 - DNA, 25 bp, Mus musculus
ccaaatacaatgacccctgacaagc

SEQ ID NO: 236306 - DNA, 25 bp, Mus musculus
ccaaatacaatgccctcaagacccc

SEQ ID NO: 236307 - DNA, 25 bp, Mus musculus
ccaaatacctctcaaaaatagtgat

SEQ ID NO: 236308 - DNA, 25 bp, Mus musculus
ccaaatagtacaggcagtgggaact

SEQ ID NO: 236309 - DNA, 25 bp, Mus musculus
ccaaatatacaaggctcaaactcag

SEQ ID NO: 236310 - DNA, 25 bp, Mus musculus
ccaaatcaagggccgatgatgcacc

SEQ ID NO: 236311 - DNA, 25 bp, Mus musculus
ccaaatcacaggcatatgctatgat

SEQ ID NO: 236312 - DNA, 25 bp, Mus musculus
ccaaatcacatgatggagcctcaag

SEQ ID NO: 236313 - DNA, 25 bp, Mus musculus
ccaaatccaagtgggtattccatgt

SEQ ID NO: 236314 - DNA, 25 bp, Mus musculus
ccaaatccagaattgattacaacaa

SEQ ID NO: 236315 - DNA, 25 bp, Mus musculus
ccaaatccccagtgaatggaactcc

SEQ ID NO: 236316 - DNA, 25 bp, Mus musculus
ccaaatccttcgcgtctcagaataa

SEQ ID NO: 236317 - DNA, 25 bp, Mus musculus
ccaaatctaaactgacccccgtcag

SEQ ID NO: 236318 - DNA, 25 bp, Mus musculus
ccaaatctaaactggatcgaagtaa

SEQ ID NO: 236319 - DNA, 25 bp, Mus musculus
ccaaatctgcagatctcataggatg

SEQ ID NO: 236320 - DNA, 25 bp, Mus musculus
ccaaatctgcagatgtgaatcctaa

SEQ ID NO: 236321 - DNA, 25 bp, Mus musculus
ccaaatcttacaggaggccacatgg

SEQ ID NO: 236322 - DNA, 25 bp, Mus musculus
ccaaatcttctcagatcatagcaga

SEQ ID NO: 236323 - DNA, 25 bp, Mus musculus
ccaaatgaccactgagattccagtg

SEQ ID NO: 236324 - DNA, 25 bp, Mus musculus
ccaaatgaccagagaacttcacctc

SEQ ID NO: 236325 - DNA, 25 bp, Mus musculus
ccaaatgactaagtacctacagtcc

SEQ ID NO: 236326 - DNA, 25 bp, Mus musculus
ccaaatgactaagttacagtgctag

SEQ ID NO: 236327 - DNA, 25 bp, Mus musculus
ccaaatgctggaccctcccaggccc

SEQ ID NO: 236328 - DNA, 25 bp, Mus musculus
ccaaatggagatataatcatgtgtg

SEQ ID NO: 236329 - DNA, 25 bp, Mus musculus
ccaaatggccatgataacagctatc

SEQ ID NO: 236330 - DNA, 25 bp, Mus musculus
ccaaatgggaggtgtgtcagaaatc

SEQ ID NO: 236331 - DNA, 25 bp, Mus musculus
ccaaatgtgttcaagaacaaggttg

SEQ ID NO: 236332 - DNA, 25 bp, Mus musculus
ccaaatgttgggcgaagatctgcaa

SEQ ID NO: 236333 - DNA, 25 bp, Mus musculus
ccaaatgttgggcgtgtgcatgtag

SEQ ID NO: 236334 - DNA, 25 bp, Mus musculus
ccaaattaaatgccttgatgggaac

SEQ ID NO: 236335 - DNA, 25 bp, Mus musculus
ccaaattaatgacaagaacggagag

SEQ ID NO: 236336 - DNA, 25 bp, Mus musculus
ccaaattaatgagtacaaggagtgc

SEQ ID NO: 236337 - DNA, 25 bp, Mus musculus
ccaaattaatgtggatgatcttttc

SEQ ID NO: 236338 - DNA, 25 bp, Mus musculus
ccaaattagtgcaggaaaacccaac

SEQ ID NO: 236339 - DNA, 25 bp, Mus musculus
ccaaattagtgcatgaagttgccag

SEQ ID NO: 236340 - DNA, 25 bp, Mus musculus
ccaaattcactgctttctgtgagac

SEQ ID NO: 236341 - DNA, 25 bp, Mus musculus
ccaaattcactgtatataaaatcct

SEQ ID NO: 236342 - DNA, 25 bp, Mus musculus
ccaaattccaagcaattttcaacat

SEQ ID NO: 236343 - DNA, 25 bp, Mus musculus
ccaaattccttcaggtgcacgcctc

SEQ ID NO: 236344 - DNA, 25 bp, Mus musculus
ccaaattgacaggtagctacatcaa

SEQ ID NO: 236345 - DNA, 25 bp, Mus musculus
ccaacaaaaaaagctccgactgatt

SEQ ID NO: 236346 - DNA, 25 bp, Mus musculus
ccaacaaaaaagacaggtgttcaca

SEQ ID NO: 236347 - DNA, 25 bp, Mus musculus
ccaacaaaaagttgattcaccaaag

SEQ ID NO: 236348 - DNA, 25 bp, Mus musculus
ccaacaaacgaacaagactctgaca

SEQ ID NO: 236349 - DNA, 25 bp, Mus musculus
ccaacaaacgaacaagcaggttcag

SEQ ID NO: 236350 - DNA, 25 bp, Mus musculus
ccaacaaacgaacaatagtagaaaa

SEQ ID NO: 236351 - DNA, 25 bp, Mus musculus
ccaacaaaggagctgacaaaccaag

SEQ ID NO: 236352 - DNA, 25 bp, Mus musculus
ccaacaaaggtggcgggcgagaact

SEQ ID NO: 236353 - DNA, 25 bp, Mus musculus
ccaacaaatgcctcaaggagaagct

SEQ ID NO: 236354 - DNA, 25 bp, Mus musculus
ccaacaaatgtacagagaaatttgt

SEQ ID NO: 236355 - DNA, 25 bp, Mus musculus
ccaacaaatgtacaggagctgaagt

SEQ ID NO: 236356 - DNA, 25 bp, Mus musculus
ccaacaacaatgagagtgctgcaaa

SEQ ID NO: 236357 - DNA, 25 bp, Mus musculus
ccaacaacactgacaggggcatctg

SEQ ID NO: 236358 - DNA, 25 bp, Mus musculus
ccaacaacatcaaagaaaaattcaa

SEQ ID NO: 236359 - DNA, 25 bp, Mus musculus
ccaacaacatcatgaacaacgtggg

SEQ ID NO: 236360 - DNA, 25 bp, Mus musculus
ccaacaaccaggtagctaagtggga

SEQ ID NO: 236361 - DNA, 25 bp, Mus musculus
ccaacaacctagctcccgatggtca

SEQ ID NO: 236362 - DNA, 25 bp, Mus musculus
ccaacaacttgacaggcttagaatc

SEQ ID NO: 236363 - DNA, 25 bp, Mus musculus
ccaacaagcaggatggacgacagag

SEQ ID NO: 236364 - DNA, 25 bp, Mus musculus
ccaacaagtagcaggattgtctctc

SEQ ID NO: 236365 - DNA, 25 bp, Mus musculus
ccaacaagtgccagagaggagtttt

SEQ ID NO: 236366 - DNA, 25 bp, Mus musculus
ccaacaagtgccaggtacatatttt

SEQ ID NO: 236367 - DNA, 25 bp, Mus musculus
ccaacaatatcaaggaagtgcttct

SEQ ID NO: 236368 - DNA, 25 bp, Mus musculus
ccaacaatcctactccaggtctggt

SEQ ID NO: 236369 - DNA, 25 bp, Mus musculus
ccaacaatgtagagatcccctattt

SEQ ID NO: 236370 - DNA, 25 bp, Mus musculus
ccaacacaaaaacagatggatgaga

SEQ ID NO: 236371 - DNA, 25 bp, Mus musculus
ccaacacaaagatgggtgttacgag

SEQ ID NO: 236372 - DNA, 25 bp, Mus musculus
ccaacacaccacaggctttgctact

SEQ ID NO: 236373 - DNA, 25 bp, Mus musculus
ccaacacaccacagggaaaccagga

SEQ ID NO: 236374 - DNA, 25 bp, Mus musculus
ccaacacacgtgggaaggtggcgtt

SEQ ID NO: 236375 - DNA, 25 bp, Mus musculus
ccaacacacgtggtggtacccggga

SEQ ID NO: 236376 - DNA, 25 bp, Mus musculus
ccaacacagcagcaccataggttcc

SEQ ID NO: 236377 - DNA, 25 bp, Mus musculus
ccaacacagcaggtcatcaccatct

SEQ ID NO: 236378 - DNA, 25 bp, Mus musculus
ccaacaccaaaagtgcccatggagg

SEQ ID NO: 236379 - DNA, 25 bp, Mus musculus
ccaacaccaaaatctgtagattgtt

SEQ ID NO: 236380 - DNA, 25 bp, Mus musculus
ccaacaccaaagtggacatgacttg

SEQ ID NO: 236381 - DNA, 25 bp, Mus musculus
ccaacaccaacagatgttctgatgg

SEQ ID NO: 236382 - DNA, 25 bp, Mus musculus
ccaacaccaacaggggtggtggatt

SEQ ID NO: 236383 - DNA, 25 bp, Mus musculus
ccaacaccagaactattgtcccaga

SEQ ID NO: 236384 - DNA, 25 bp, Mus musculus
ccaacaccatggacaaaagcttcaa

SEQ ID NO: 236385 - DNA, 25 bp, Mus musculus
ccaacaccatggtgtttcctggctc

SEQ ID NO: 236386 - DNA, 25 bp, Mus musculus
ccaacacccagcaagaagtctatgt

SEQ ID NO: 236387 - DNA, 25 bp, Mus musculus
ccaacacccaggcctgcagtgggga

SEQ ID NO: 236388 - DNA, 25 bp, Mus musculus
ccaacaccccgctgctgccttcctt

SEQ ID NO: 236389 - DNA, 25 bp, Mus musculus
ccaacaccccgcttctcttgcctct

SEQ ID NO: 236390 - DNA, 25 bp, Mus musculus
ccaacaccccttcagtgcctgtgct

SEQ ID NO: 236391 - DNA, 25 bp, Mus musculus
ccaacaccctgggaaacaagggagc

SEQ ID NO: 236392 - DNA, 25 bp, Mus musculus
ccaacactgagggcagggcctacgt

SEQ ID NO: 236393 - DNA, 25 bp, Mus musculus
ccaacacttcaacagttatcagaga

SEQ ID NO: 236394 - DNA, 25 bp, Mus musculus
ccaacactttgaagtcttgaagaac

SEQ ID NO: 236395 - DNA, 25 bp, Mus musculus
ccaacagaagctgacatcatgttca

SEQ ID NO: 236396 - DNA, 25 bp, Mus musculus
ccaacagaagctgcatgtctgctgg

SEQ ID NO: 236397 - DNA, 25 bp, Mus musculus
ccaacagaaggcgacatcccaggca

SEQ ID NO: 236398 - DNA, 25 bp, Mus musculus
ccaacagaatgcaggctggtgagat

SEQ ID NO: 236399 - DNA, 25 bp, Mus musculus
ccaacagagagggcccccagcatgg

SEQ ID NO: 236400 - DNA, 25 bp, Mus musculus
ccaacagagcaagtgacaaatgacc

SEQ ID NO: 236401 - DNA, 25 bp, Mus musculus
ccaacagagcaatctctggcaaaca

SEQ ID NO: 236402 - DNA, 25 bp, Mus musculus
ccaacagcagagaactggggaaccc

SEQ ID NO: 236403 - DNA, 25 bp, Mus musculus
ccaacagcagatctggatccctagc

SEQ ID NO: 236404 - DNA, 25 bp, Mus musculus
ccaacagccaggaggctctgcagaa

SEQ ID NO: 236405 - DNA, 25 bp, Mus musculus
ccaacagccgcgcacactggagcgg

SEQ ID NO: 236406 - DNA, 25 bp, Mus musculus
ccaacagctccagcagagtcagggg

SEQ ID NO: 236407 - DNA, 25 bp, Mus musculus
ccaacagctgaacctgaatctcctg

SEQ ID NO: 236408 - DNA, 25 bp, Mus musculus
ccaacaggaatgatccaagcagccc

SEQ ID NO: 236409 - DNA, 25 bp, Mus musculus
ccaacaggtaattggcacgggagaa

SEQ ID NO: 236410 - DNA, 25 bp, Mus musculus
ccaacagtccaaaccatagacagaa

SEQ ID NO: 236411 - DNA, 25 bp, Mus musculus
ccaacagttcttccaatcccacatg

SEQ ID NO: 236412 - DNA, 25 bp, Mus musculus
ccaacataatgcatgccaagtggca

SEQ ID NO: 236413 - DNA, 25 bp, Mus musculus
ccaacatacaaagacgacgctcacc

SEQ ID NO: 236414 - DNA, 25 bp, Mus musculus
ccaacatacaaagctggcttaatgg

SEQ ID NO: 236415 - DNA, 25 bp, Mus musculus
ccaacatcaaagccattggtgtcag

SEQ ID NO: 236416 - DNA, 25 bp, Mus musculus
ccaacatcaatagtggagattttgt

SEQ ID NO: 236417 - DNA, 25 bp, Mus musculus
ccaacatcaatagtgtaattattga

SEQ ID NO: 236418 - DNA, 25 bp, Mus musculus
ccaacatcacagatgtctcccaatt

SEQ ID NO: 236419 - DNA, 25 bp, Mus musculus
ccaacatcagaaagggtctgccgtc

SEQ ID NO: 236420 - DNA, 25 bp, Mus musculus
ccaacatcatgaaagccaagaagaa

SEQ ID NO: 236421 - DNA, 25 bp, Mus musculus
ccaacatccagagcaagcaccagaa

SEQ ID NO: 236422 - DNA, 25 bp, Mus musculus
ccaacatccagctttccaagctgtt

SEQ ID NO: 236423 - DNA, 25 bp, Mus musculus
ccaacatccttcaagaaaccctgaa

SEQ ID NO: 236424 - DNA, 25 bp, Mus musculus
ccaacatcggaacctctaccactac

SEQ ID NO: 236425 - DNA, 25 bp, Mus musculus
ccaacatctgagcagctcaaagatg

SEQ ID NO: 236426 - DNA, 25 bp, Mus musculus
ccaacatctgcagctctcccttttc

SEQ ID NO: 236427 - DNA, 25 bp, Mus musculus
ccaacatctgcagtgggccggatgt

SEQ ID NO: 236428 - DNA, 25 bp, Mus musculus
ccaacatgcggacctcatgcctgag

SEQ ID NO: 236429 - DNA, 25 bp, Mus musculus
ccaacatgcgggaattcatcctctc

SEQ ID NO: 236430 - DNA, 25 bp, Mus musculus
ccaacatggcaatgggctacagggg

SEQ ID NO: 236431 - DNA, 25 bp, Mus musculus
ccaacatggcaggtaagaaagtgct

SEQ ID NO: 236432 - DNA, 25 bp, Mus musculus
ccaacatgtcaggggagctgaagga

SEQ ID NO: 236433 - DNA, 25 bp, Mus musculus
ccaacatgtggagtgaaaaatctct

SEQ ID NO: 236434 - DNA, 25 bp, Mus musculus
ccaacattattaaagacacactttt

SEQ ID NO: 236435 - DNA, 25 bp, Mus musculus
ccaacattattaaagataattgctg

SEQ ID NO: 236436 - DNA, 25 bp, Mus musculus
ccaacattcagggtctactgaaagt

SEQ ID NO: 236437 - DNA, 25 bp, Mus musculus
ccaacattgctggacatttcaatga

SEQ ID NO: 236438 - DNA, 25 bp, Mus musculus
ccaacattgctggatcctctcccag

SEQ ID NO: 236439 - DNA, 25 bp, Mus musculus
ccaaccaaagccagacccacacttg

SEQ ID NO: 236440 - DNA, 25 bp, Mus musculus
ccaaccaatggcttcgagctgtatt

SEQ ID NO: 236441 - DNA, 25 bp, Mus musculus
ccaaccacaagcgactcgtcctccc

SEQ ID NO: 236442 - DNA, 25 bp, Mus musculus
ccaaccacaagcgagcctagaagag

SEQ ID NO: 236443 - DNA, 25 bp, Mus musculus
ccaaccacaagcgagttcacatgag

SEQ ID NO: 236444 - DNA, 25 bp, Mus musculus
ccaaccacagatgactacagctgtg

SEQ ID NO: 236445 - DNA, 25 bp, Mus musculus
ccaaccacaggggccagctagagat

SEQ ID NO: 236446 - DNA, 25 bp, Mus musculus
ccaaccaccaggggacctatgtgct

SEQ ID NO: 236447 - DNA, 25 bp, Mus musculus
ccaaccaccagttcctggccttcac

SEQ ID NO: 236448 - DNA, 25 bp, Mus musculus
ccaaccaccagttttggttcatctt

SEQ ID NO: 236449 - DNA, 25 bp, Mus musculus
ccaaccacgctggggtctccaatga

SEQ ID NO: 236450 - DNA, 25 bp, Mus musculus
ccaaccagaaagagtccaaagctgc

SEQ ID NO: 236451 - DNA, 25 bp, Mus musculus
ccaaccagaaagatacctcagaata

SEQ ID NO: 236452 - DNA, 25 bp, Mus musculus
ccaaccagaaagatatactgcaggc

SEQ ID NO: 236453 - DNA, 25 bp, Mus musculus
ccaaccagaagaaagagtgtgagga

SEQ ID NO: 236454 - DNA, 25 bp, Mus musculus
ccaaccagacatgccatgtcggacc

SEQ ID NO: 236455 - DNA, 25 bp, Mus musculus
ccaaccagaccgtggacatgcttct

SEQ ID NO: 236456 - DNA, 25 bp, Mus musculus
ccaaccagacctgccccaggatccg

SEQ ID NO: 236457 - DNA, 25 bp, Mus musculus
ccaaccagcctcaggaagcaggcca

SEQ ID NO: 236458 - DNA, 25 bp, Mus musculus
ccaaccagcggaaatgtgagcgtgt

SEQ ID NO: 236459 - DNA, 25 bp, Mus musculus
ccaaccagctggctgaagccatcag

SEQ ID NO: 236460 - DNA, 25 bp, Mus musculus
ccaaccaggggccttggccttacac

SEQ ID NO: 236461 - DNA, 25 bp, Mus musculus
ccaaccagggtcatgccattgccaa

SEQ ID NO: 236462 - DNA, 25 bp, Mus musculus
ccaaccaggtcaaggctctggataa

SEQ ID NO: 236463 - DNA, 25 bp, Mus musculus
ccaaccaggtcaagggcaagcctga

SEQ ID NO: 236464 - DNA, 25 bp, Mus musculus
ccaaccagtctgcctaactctgtgg

SEQ ID NO: 236465 - DNA, 25 bp, Mus musculus
ccaaccatccggaagaaagcaaaag

SEQ ID NO: 236466 - DNA, 25 bp, Mus musculus
ccaaccattgtaaaacttatggaac

SEQ ID NO: 236467 - DNA, 25 bp, Mus musculus
ccaacccaagctcttttgtgactgg

SEQ ID NO: 236468 - DNA, 25 bp, Mus musculus
ccaacccaatccagagctaagctag

SEQ ID NO: 236469 - DNA, 25 bp, Mus musculus
ccaacccaatccagcatacagagct

SEQ ID NO: 236470 - DNA, 25 bp, Mus musculus
ccaacccacgaagggcgaatcgcca

SEQ ID NO: 236471 - DNA, 25 bp, Mus musculus
ccaacccagagaagagtgacagcag

SEQ ID NO: 236472 - DNA, 25 bp, Mus musculus
ccaacccagagaaggcccagcttgg

SEQ ID NO: 236473 - DNA, 25 bp, Mus musculus
ccaacccagaggagatgctgtctat

SEQ ID NO: 236474 - DNA, 25 bp, Mus musculus
ccaacccagaggagggagtgagcta

SEQ ID NO: 236475 - DNA, 25 bp, Mus musculus
ccaaccccaccatcatgatttaagc

SEQ ID NO: 236476 - DNA, 25 bp, Mus musculus
ccaaccccagagcggctccggagtt

SEQ ID NO: 236477 - DNA, 25 bp, Mus musculus
ccaaccccagagcgggagctcttgg

SEQ ID NO: 236478 - DNA, 25 bp, Mus musculus
ccaaccccagagcggttttgctgta

SEQ ID NO: 236479 - DNA, 25 bp, Mus musculus
ccaaccccaggcacagctgacttta

SEQ ID NO: 236480 - DNA, 25 bp, Mus musculus
ccaaccccataggaggccgctacga

SEQ ID NO: 236481 - DNA, 25 bp, Mus musculus
ccaaccccccggccctgcctgcctg

SEQ ID NO: 236482 - DNA, 25 bp, Mus musculus
ccaacccctatggctggccacagat

SEQ ID NO: 236483 - DNA, 25 bp, Mus musculus
ccaacccgcactcagctgtttgaaa

SEQ ID NO: 236484 - DNA, 25 bp, Mus musculus
ccaacccgcactcaggggaaggagc

SEQ ID NO: 236485 - DNA, 25 bp, Mus musculus
ccaacccggaggaccaggactgagt

SEQ ID NO: 236486 - DNA, 25 bp, Mus musculus
ccaaccctaaagatcctgttgtctc

SEQ ID NO: 236487 - DNA, 25 bp, Mus musculus
ccaaccctcagacgtttaataagat

SEQ ID NO: 236488 - DNA, 25 bp, Mus musculus
ccaaccctcagaggtttaataagat

SEQ ID NO: 236489 - DNA, 25 bp, Mus musculus
ccaaccctcgaatcaacctaccgac

SEQ ID NO: 236490 - DNA, 25 bp, Mus musculus
ccaaccgagtcatttaaggctgcaa

SEQ ID NO: 236491 - DNA, 25 bp, Mus musculus
ccaaccgcagagaggaactggccca

SEQ ID NO: 236492 - DNA, 25 bp, Mus musculus
ccaacctacaagggcaagatgaaga

SEQ ID NO: 236493 - DNA, 25 bp, Mus musculus
ccaacctatgaaaactctctacttc

SEQ ID NO: 236494 - DNA, 25 bp, Mus musculus
ccaacctcagacgacaatttccaag

SEQ ID NO: 236495 - DNA, 25 bp, Mus musculus
ccaacctcagcaaagccagtggccg

SEQ ID NO: 236496 - DNA, 25 bp, Mus musculus
ccaacctcagcacttttctgtactt

SEQ ID NO: 236497 - DNA, 25 bp, Mus musculus
ccaacctcagctttctgacctgtga

SEQ ID NO: 236498 - DNA, 25 bp, Mus musculus
ccaacctcatctctgatcgctgggg

SEQ ID NO: 236499 - DNA, 25 bp, Mus musculus
ccaacctcatctctgtgatgggtca

SEQ ID NO: 236500 - DNA, 25 bp, Mus musculus
ccaacctccaaagctcatttttcca

SEQ ID NO: 236501 - DNA, 25 bp, Mus musculus
ccaacctccaaaggacacaccagcc

SEQ ID NO: 236502 - DNA, 25 bp, Mus musculus
ccaacctccagtctcaccagcgcca

SEQ ID NO: 236503 - DNA, 25 bp, Mus musculus
ccaacctcctaggaaagctgtagag

SEQ ID NO: 236504 - DNA, 25 bp, Mus musculus
ccaacctcctaggaataggtgaagg

SEQ ID NO: 236505 - DNA, 25 bp, Mus musculus
ccaacctcgggctcaaaaaattgct

SEQ ID NO: 236506 - DNA, 25 bp, Mus musculus
ccaacctcgtgaggactctcattag

SEQ ID NO: 236507 - DNA, 25 bp, Mus musculus
ccaacctcgtgagttacaggactct

SEQ ID NO: 236508 - DNA, 25 bp, Mus musculus
ccaacctgcagatggcagcagtgac

SEQ ID NO: 236509 - DNA, 25 bp, Mus musculus
ccaacctgcagatggcagctcaacg

SEQ ID NO: 236510 - DNA, 25 bp, Mus musculus
ccaacctggctgttgctcgtcttgg

SEQ ID NO: 236511 - DNA, 25 bp, Mus musculus
ccaacctggggtttaagaggcgagt

SEQ ID NO: 236512 - DNA, 25 bp, Mus musculus
ccaaccttcacctgggcctaggctc

SEQ ID NO: 236513 - DNA, 25 bp, Mus musculus
ccaaccttctgttgccttgaagttt

SEQ ID NO: 236514 - DNA, 25 bp, Mus musculus
ccaaccttgaaccagaatgtctgta

SEQ ID NO: 236515 - DNA, 25 bp, Mus musculus
ccaacctttgccatgggccttgcca

SEQ ID NO: 236516 - DNA, 25 bp, Mus musculus
ccaaccttttgacaaggtcagggcc

SEQ ID NO: 236517 - DNA, 25 bp, Mus musculus
ccaacgaaaggtaacatttcacttg

SEQ ID NO: 236518 - DNA, 25 bp, Mus musculus
ccaacgacaaaactaatatccaggg

SEQ ID NO: 236519 - DNA, 25 bp, Mus musculus
ccaacgacaaaactgctaacccagt

SEQ ID NO: 236520 - DNA, 25 bp, Mus musculus
ccaacgacattgtgtacctcatccg

SEQ ID NO: 236521 - DNA, 25 bp, Mus musculus
ccaacgccagaaggaagaggcaaat

SEQ ID NO: 236522 - DNA, 25 bp, Mus musculus
ccaacgcctctagtaaccctgacct

SEQ ID NO: 236523 - DNA, 25 bp, Mus musculus
ccaacgctagaacatacaacatcag

SEQ ID NO: 236524 - DNA, 25 bp, Mus musculus
ccaacggacccaaagaggtctctca

SEQ ID NO: 236525 - DNA, 25 bp, Mus musculus
ccaacggacccaaagaggtgtgagg

SEQ ID NO: 236526 - DNA, 25 bp, Mus musculus
ccaacggatggaagtgtcatctgcc

SEQ ID NO: 236527 - DNA, 25 bp, Mus musculus
ccaacggcgagaagggagaagtcgg

SEQ ID NO: 236528 - DNA, 25 bp, Mus musculus
ccaacggctctgcctgcagtgggga

SEQ ID NO: 236529 - DNA, 25 bp, Mus musculus
ccaacggctctgcgttgctgctctc

SEQ ID NO: 236530 - DNA, 25 bp, Mus musculus
ccaacggtaagacaataaaattatg

SEQ ID NO: 236531 - DNA, 25 bp, Mus musculus
ccaacgtacagagccattgtcacta

SEQ ID NO: 236532 - DNA, 25 bp, Mus musculus
ccaacgtcaagaagagtggtcttag

SEQ ID NO: 236533 - DNA, 25 bp, Mus musculus
ccaacgtcaagaaggagatccagct

SEQ ID NO: 236534 - DNA, 25 bp, Mus musculus
ccaacgtcacattagcctttggagc

SEQ ID NO: 236535 - DNA, 25 bp, Mus musculus
ccaacgtcacattagggtccgcaag

SEQ ID NO: 236536 - DNA, 25 bp, Mus musculus
ccaacgtgagagtcattcagaatta

SEQ ID NO: 236537 - DNA, 25 bp, Mus musculus
ccaacgtgagggagcctgtatatgg

SEQ ID NO: 236538 - DNA, 25 bp, Mus musculus
ccaacgtgccggcagaggtggtttg

SEQ ID NO: 236539 - DNA, 25 bp, Mus musculus
ccaacgtgccggcagcagagacttg

SEQ ID NO: 236540 - DNA, 25 bp, Mus musculus
ccaacgtggaagcagcctgtgattc

SEQ ID NO: 236541 - DNA, 25 bp, Mus musculus
ccaacgtggaagccctctgctcatc

SEQ ID NO: 236542 - DNA, 25 bp, Mus musculus
ccaacgtgtcggaagtgatgggacc

SEQ ID NO: 236543 - DNA, 25 bp, Mus musculus
ccaacgttcagaaccccaaatctca

SEQ ID NO: 236544 - DNA, 25 bp, Mus musculus
ccaactacacgagacctgtgttcct

SEQ ID NO: 236545 - DNA, 25 bp, Mus musculus
ccaactacagaaaagcagtcagctg

SEQ ID NO: 236546 - DNA, 25 bp, Mus musculus
ccaactacaggtcaccttgttggag

SEQ ID NO: 236547 - DNA, 25 bp, Mus musculus
ccaactacatcgacatttggctgta

SEQ ID NO: 236548 - DNA, 25 bp, Mus musculus
ccaactacatcgacggctaccagag

SEQ ID NO: 236549 - DNA, 25 bp, Mus musculus
ccaactatgacttttgccaaggagt

SEQ ID NO: 236550 - DNA, 25 bp, Mus musculus
ccaactattcacacctcctggagga

SEQ ID NO: 236551 - DNA, 25 bp, Mus musculus
ccaactattcacaggctcagcagca

SEQ ID NO: 236552 - DNA, 25 bp, Mus musculus
ccaactattgtgaccagatgggaaa

SEQ ID NO: 236553 - DNA, 25 bp, Mus musculus
ccaactcaacatgtatggttttcgg

SEQ ID NO: 236554 - DNA, 25 bp, Mus musculus
ccaactcaagaggcccaggagacta

SEQ ID NO: 236555 - DNA, 25 bp, Mus musculus
ccaactcaaggtctgatccggatgc

SEQ ID NO: 236556 - DNA, 25 bp, Mus musculus
ccaactcaaggtgctgtcccacaac

SEQ ID NO: 236557 - DNA, 25 bp, Mus musculus
ccaactcagcagggcatctgaagtt

SEQ ID NO: 236558 - DNA, 25 bp, Mus musculus
ccaactcagcgggtggatacccttc

SEQ ID NO: 236559 - DNA, 25 bp, Mus musculus
ccaactcagcgggttcttccagttc

SEQ ID NO: 236560 - DNA, 25 bp, Mus musculus
ccaactcagttgcagcgacaagttc

SEQ ID NO: 236561 - DNA, 25 bp, Mus musculus
ccaactcataaattatatgcaggac

SEQ ID NO: 236562 - DNA, 25 bp, Mus musculus
ccaactcataaattgttggggtttc

SEQ ID NO: 236563 - DNA, 25 bp, Mus musculus
ccaactccaacctgaactctctctc

SEQ ID NO: 236564 - DNA, 25 bp, Mus musculus
ccaactccaacctggaacgagtgga

SEQ ID NO: 236565 - DNA, 25 bp, Mus musculus
ccaactccaagggctgggtcttcaa

SEQ ID NO: 236566 - DNA, 25 bp, Mus musculus
ccaactccaaggttacagagtcatc

SEQ ID NO: 236567 - DNA, 25 bp, Mus musculus
ccaactccacagaccctgctcacac

SEQ ID NO: 236568 - DNA, 25 bp, Mus musculus
ccaactccacaggatctttggaagc

SEQ ID NO: 236569 - DNA, 25 bp, Mus musculus
ccaactccacctctgcacagaagaa

SEQ ID NO: 236570 - DNA, 25 bp, Mus musculus
ccaactccagcccagtccaaggcga

SEQ ID NO: 236571 - DNA, 25 bp, Mus musculus
ccaactccagcccccggcctccacc

SEQ ID NO: 236572 - DNA, 25 bp, Mus musculus
ccaactccctgttaagcatcaacat

SEQ ID NO: 236573 - DNA, 25 bp, Mus musculus
ccaactccgacgtgtggagaggatg

SEQ ID NO: 236574 - DNA, 25 bp, Mus musculus
ccaactccgcggatgtggtggagga

SEQ ID NO: 236575 - DNA, 25 bp, Mus musculus
ccaactccgcgggctcagggacctc

SEQ ID NO: 236576 - DNA, 25 bp, Mus musculus
ccaactccgcgtctcttacatctct

SEQ ID NO: 236577 - DNA, 25 bp, Mus musculus
ccaactcctagctacaggcggccac

SEQ ID NO: 236578 - DNA, 25 bp, Mus musculus
ccaactccttcagcgcatcatgact

SEQ ID NO: 236579 - DNA, 25 bp, Mus musculus
ccaactccttcaggtccatctctgt

SEQ ID NO: 236580 - DNA, 25 bp, Mus musculus
ccaactccttccctgcacctccgca

SEQ ID NO: 236581 - DNA, 25 bp, Mus musculus
ccaactcctttggactggtgcagtc

SEQ ID NO: 236582 - DNA, 25 bp, Mus musculus
ccaactcgaacagctctcgtggcgc

SEQ ID NO: 236583 - DNA, 25 bp, Mus musculus
ccaactcgtttgtagggacagtgat

SEQ ID NO: 236584 - DNA, 25 bp, Mus musculus
ccaactctcctctgctaagtatggt

SEQ ID NO: 236585 - DNA, 25 bp, Mus musculus
ccaactctcgtggaagcacaagccc

SEQ ID NO: 236586 - DNA, 25 bp, Mus musculus
ccaactctcttccatgcgccaatga

SEQ ID NO: 236587 - DNA, 25 bp, Mus musculus
ccaactcttggcattgaccttggcc

SEQ ID NO: 236588 - DNA, 25 bp, Mus musculus
ccaactgagaggactggctgcccca

SEQ ID NO: 236589 - DNA, 25 bp, Mus musculus
ccaactgcaaacgggaggatatgat

SEQ ID NO: 236590 - DNA, 25 bp, Mus musculus
ccaactgcaaacggtggttggcact

SEQ ID NO: 236591 - DNA, 25 bp, Mus musculus
ccaactgcgggaaggagctaactgc

SEQ ID NO: 236592 - DNA, 25 bp, Mus musculus
ccaactgctacaggaggaaccccct

SEQ ID NO: 236593 - DNA, 25 bp, Mus musculus
ccaactgctgaagacgtgactgcgc

SEQ ID NO: 236594 - DNA, 25 bp, Mus musculus
ccaactgctgcaacaccagcacagt

SEQ ID NO: 236595 - DNA, 25 bp, Mus musculus
ccaactgcttggaaggctgcccacc

SEQ ID NO: 236596 - DNA, 25 bp, Mus musculus
ccaactgcttgtggactaaagagga

SEQ ID NO: 236597 - DNA, 25 bp, Mus musculus
ccaactggcaggggacatgaagcag

SEQ ID NO: 236598 - DNA, 25 bp, Mus musculus
ccaactggcaggtatttgacatact

SEQ ID NO: 236599 - DNA, 25 bp, Mus musculus
ccaactggcgacaggcccacatgca

SEQ ID NO: 236600 - DNA, 25 bp, Mus musculus
ccaactggcgacaggctctgatggg

SEQ ID NO: 236601 - DNA, 25 bp, Mus musculus
ccaactggggcacttccccactcct

SEQ ID NO: 236602 - DNA, 25 bp, Mus musculus
ccaactgtaccatccctgagatctg

SEQ ID NO: 236603 - DNA, 25 bp, Mus musculus
ccaactgtaccatcgctgagatctg

SEQ ID NO: 236604 - DNA, 25 bp, Mus musculus
ccaactgtacgcggagactgcggcc

SEQ ID NO: 236605 - DNA, 25 bp, Mus musculus
ccaactgtagtgctggacccaaagg

SEQ ID NO: 236606 - DNA, 25 bp, Mus musculus
ccaactgtatgcagaaatttacaca

SEQ ID NO: 236607 - DNA, 25 bp, Mus musculus
ccaactgtatgcagcatctgtctga

SEQ ID NO: 236608 - DNA, 25 bp, Mus musculus
ccaactgtctaaattgatcagggac

SEQ ID NO: 236609 - DNA, 25 bp, Mus musculus
ccaactgtgaccatggtttgggatc

SEQ ID NO: 236610 - DNA, 25 bp, Mus musculus
ccaacttaaagactgaagtgttgga

SEQ ID NO: 236611 - DNA, 25 bp, Mus musculus
ccaacttaccatgaggatccagcaa

SEQ ID NO: 236612 - DNA, 25 bp, Mus musculus
ccaacttataaagatgattatagat

SEQ ID NO: 236613 - DNA, 25 bp, Mus musculus
ccaacttatggagcggcactggagc

SEQ ID NO: 236614 - DNA, 25 bp, Mus musculus
ccaacttatggagcggtcgtgtatc

SEQ ID NO: 236615 - DNA, 25 bp, Mus musculus
ccaacttcaagggtgctgctcaggc

SEQ ID NO: 236616 - DNA, 25 bp, Mus musculus
ccaacttcaccatagaaaacgggag

SEQ ID NO: 236617 - DNA, 25 bp, Mus musculus
ccaacttcaccatgcttataggaga

SEQ ID NO: 236618 - DNA, 25 bp, Mus musculus
ccaacttcaggtaccaatggggatc

SEQ ID NO: 236619 - DNA, 25 bp, Mus musculus
ccaacttcctccagctgcagaatct

SEQ ID NO: 236620 - DNA, 25 bp, Mus musculus
ccaacttcgccaggtcctagagtcg

SEQ ID NO: 236621 - DNA, 25 bp, Mus musculus
ccaacttctcagatttactgaaact

SEQ ID NO: 236622 - DNA, 25 bp, Mus musculus
ccaacttctcaggggcagatttact

SEQ ID NO: 236623 - DNA, 25 bp, Mus musculus
ccaacttctccagaaagcttccctg

SEQ ID NO: 236624 - DNA, 25 bp, Mus musculus
ccaacttctccagaagcttccctgt

SEQ ID NO: 236625 - DNA, 25 bp, Mus musculus
ccaacttctcggtctactataccac

SEQ ID NO: 236626 - DNA, 25 bp, Mus musculus
ccaacttcttaactgacaggccaac

SEQ ID NO: 236627 - DNA, 25 bp, Mus musculus
ccaacttgagaattggacagcggac

SEQ ID NO: 236628 - DNA, 25 bp, Mus musculus
ccaacttgagagtgacttctgcgat

SEQ ID NO: 236629 - DNA, 25 bp, Mus musculus
ccaactttgctagatgtgtcttcca

SEQ ID NO: 236630 - DNA, 25 bp, Mus musculus
ccaactttgctgtcatttctcaaag

SEQ ID NO: 236631 - DNA, 25 bp, Mus musculus
ccaactttgcttcattacaggacgt

SEQ ID NO: 236632 - DNA, 25 bp, Mus musculus
ccaacttttccatgatcatcgatgg

SEQ ID NO: 236633 - DNA, 25 bp, Mus musculus
ccaagaaaaaaattgacatcctgct

SEQ ID NO: 236634 - DNA, 25 bp, Mus musculus
ccaagaaaaagacgctgggctgcgg

SEQ ID NO: 236635 - DNA, 25 bp, Mus musculus
ccaagaaaaagacttcaaggaggca

SEQ ID NO: 236636 - DNA, 25 bp, Mus musculus
ccaagaaaaaggtgcgcatggtgag

SEQ ID NO: 236637 - DNA, 25 bp, Mus musculus
ccaagaaaaggcagcattctcatac

SEQ ID NO: 236638 - DNA, 25 bp, Mus musculus
ccaagaaaatatttcagatacacca

SEQ ID NO: 236639 - DNA, 25 bp, Mus musculus
ccaagaaaatggatgagtatgtggc

SEQ ID NO: 236640 - DNA, 25 bp, Mus musculus
ccaagaaacatgcactgataaagca

SEQ ID NO: 236641 - DNA, 25 bp, Mus musculus
ccaagaaacatgggattactgctgg

SEQ ID NO: 236642 - DNA, 25 bp, Mus musculus
ccaagaaacgagagcttaaagaagc

SEQ ID NO: 236643 - DNA, 25 bp, Mus musculus
ccaagaaactaggactaactgaaga

SEQ ID NO: 236644 - DNA, 25 bp, Mus musculus
ccaagaaactccaggctgcgctggc

SEQ ID NO: 236645 - DNA, 25 bp, Mus musculus
ccaagaaagcttttgaaataggacc

SEQ ID NO: 236646 - DNA, 25 bp, Mus musculus
ccaagaaagtgaaagaccattgcag

SEQ ID NO: 236647 - DNA, 25 bp, Mus musculus
ccaagaaatcattcatcgacccagt

SEQ ID NO: 236648 - DNA, 25 bp, Mus musculus
ccaagaaatgattggtggcttccgg

SEQ ID NO: 236649 - DNA, 25 bp, Mus musculus
ccaagaaattcagagactgcctctt

SEQ ID NO: 236650 - DNA, 25 bp, Mus musculus
ccaagaacaaacaagatacatttat

SEQ ID NO: 236651 - DNA, 25 bp, Mus musculus
ccaagaacaaacaagggaatggcgt

SEQ ID NO: 236652 - DNA, 25 bp, Mus musculus
ccaagaacaacctggcttcctgcta

SEQ ID NO: 236653 - DNA, 25 bp, Mus musculus
ccaagaacactgatgaaatcatgca

SEQ ID NO: 236654 - DNA, 25 bp, Mus musculus
ccaagaaccagacccgagtcagaac

SEQ ID NO: 236655 - DNA, 25 bp, Mus musculus
ccaagaaccaggcgctcaactccac

SEQ ID NO: 236656 - DNA, 25 bp, Mus musculus
ccaagaaccatgccgcctgctaagc

SEQ ID NO: 236657 - DNA, 25 bp, Mus musculus
ccaagaacccaggtggaaagcacaa

SEQ ID NO: 236658 - DNA, 25 bp, Mus musculus
ccaagaactgcagaattgagctcct

SEQ ID NO: 236659 - DNA, 25 bp, Mus musculus
ccaagaactgctgtctattgcatct

SEQ ID NO: 236660 - DNA, 25 bp, Mus musculus
ccaagaactggagcgctgctgggaa

SEQ ID NO: 236661 - DNA, 25 bp, Mus musculus
ccaagaagaacaaagctgtatgtga

SEQ ID NO: 236662 - DNA, 25 bp, Mus musculus
ccaagaagaactgagattcctactg

SEQ ID NO: 236663 - DNA, 25 bp, Mus musculus
ccaagaagaactttcattttcaggg

SEQ ID NO: 236664 - DNA, 25 bp, Mus musculus
ccaagaagacatccctgaagtcagc

SEQ ID NO: 236665 - DNA, 25 bp, Mus musculus
ccaagaagaggttctcccagatggt

SEQ ID NO: 236666 - DNA, 25 bp, Mus musculus
ccaagaagatagatcctggatgact

SEQ ID NO: 236667 - DNA, 25 bp, Mus musculus
ccaagaagcaaggtgaaggctcctc

SEQ ID NO: 236668 - DNA, 25 bp, Mus musculus
ccaagaagcacacagatcgcaagtc

SEQ ID NO: 236669 - DNA, 25 bp, Mus musculus
ccaagaagcagccctcaggcactgt

SEQ ID NO: 236670 - DNA, 25 bp, Mus musculus
ccaagaagcagccgatcaaaatcca

SEQ ID NO: 236671 - DNA, 25 bp, Mus musculus
ccaagaagcaggctcgcagccttca

SEQ ID NO: 236672 - DNA, 25 bp, Mus musculus
ccaagaagcagtcgttccccatcag

SEQ ID NO: 236673 - DNA, 25 bp, Mus musculus
ccaagaagcagttactgccgccttg

SEQ ID NO: 236674 - DNA, 25 bp, Mus musculus
ccaagaagccacggctttctcaggg

SEQ ID NO: 236675 - DNA, 25 bp, Mus musculus
ccaagaagcgtgggaccttcattga

SEQ ID NO: 236676 - DNA, 25 bp, Mus musculus
ccaagaaggaaaaggtagagcagat

SEQ ID NO: 236677 - DNA, 25 bp, Mus musculus
ccaagaagggcaaagatgagtggtt

SEQ ID NO: 236678 - DNA, 25 bp, Mus musculus
ccaagaagggcagcgccctcggagc

SEQ ID NO: 236679 - DNA, 25 bp, Mus musculus
ccaagaagggcagcgtggccaagcg

SEQ ID NO: 236680 - DNA, 25 bp, Mus musculus
ccaagaaggggatgaggtgttgatg

SEQ ID NO: 236681 - DNA, 25 bp, Mus musculus
ccaagaagtagaaagatctaaaggg

SEQ ID NO: 236682 - DNA, 25 bp, Mus musculus
ccaagaagtcagactgtgttgtcaa

SEQ ID NO: 236683 - DNA, 25 bp, Mus musculus
ccaagaagtcaggacaaaagactgt

SEQ ID NO: 236684 - DNA, 25 bp, Mus musculus
ccaagaagtctagaaattctgtgca

SEQ ID NO: 236685 - DNA, 25 bp, Mus musculus
ccaagaagtctagggcacttgatgc

SEQ ID NO: 236686 - DNA, 25 bp, Mus musculus
ccaagaagtgagaacggagcacctc

SEQ ID NO: 236687 - DNA, 25 bp, Mus musculus
ccaagaagtgaggccgggagcaggc

SEQ ID NO: 236688 - DNA, 25 bp, Mus musculus
ccaagaagttccaacctagatactt

SEQ ID NO: 236689 - DNA, 25 bp, Mus musculus
ccaagaagttccaagaccccagatg

SEQ ID NO: 236690 - DNA, 25 bp, Mus musculus
ccaagaataacctggcttcctgcta

SEQ ID NO: 236691 - DNA, 25 bp, Mus musculus
ccaagaatatagtcaagttacaagt

SEQ ID NO: 236692 - DNA, 25 bp, Mus musculus
ccaagaatcacagacgcagtatgag

SEQ ID NO: 236693 - DNA, 25 bp, Mus musculus
ccaagaatcacagctcgccaaatcc

SEQ ID NO: 236694 - DNA, 25 bp, Mus musculus
ccaagaattcgaagagccacctaac

SEQ ID NO: 236695 - DNA, 25 bp, Mus musculus
ccaagacaaaagatttgcaacagca

SEQ ID NO: 236696 - DNA, 25 bp, Mus musculus
ccaagacacaattgaattaaacaga

SEQ ID NO: 236697 - DNA, 25 bp, Mus musculus
ccaagacacagataagccaggactg

SEQ ID NO: 236698 - DNA, 25 bp, Mus musculus
ccaagacacccaggccagccacgct

SEQ ID NO: 236699 - DNA, 25 bp, Mus musculus
ccaagacactgcagcggaccttaca

SEQ ID NO: 236700 - DNA, 25 bp, Mus musculus
ccaagacagcagggagtgtgtgcct

SEQ ID NO: 236701 - DNA, 25 bp, Mus musculus
ccaagacagcagggtttcaatgccc

SEQ ID NO: 236702 - DNA, 25 bp, Mus musculus
ccaagacagcgcatagaagctccac

SEQ ID NO: 236703 - DNA, 25 bp, Mus musculus
ccaagacagcgcccatgcaggtgct

SEQ ID NO: 236704 - DNA, 25 bp, Mus musculus
ccaagacatagctcattctggagtc

SEQ ID NO: 236705 - DNA, 25 bp, Mus musculus
ccaagacatagtcttgccatgtagc

SEQ ID NO: 236706 - DNA, 25 bp, Mus musculus
ccaagacatggaagggctgggactg

SEQ ID NO: 236707 - DNA, 25 bp, Mus musculus
ccaagacattgagggtcacttttca

SEQ ID NO: 236708 - DNA, 25 bp, Mus musculus
ccaagaccagctcacggatgattga

SEQ ID NO: 236709 - DNA, 25 bp, Mus musculus
ccaagaccaggaacagcctcatgca

SEQ ID NO: 236710 - DNA, 25 bp, Mus musculus
ccaagaccagggacggtctgactcc

SEQ ID NO: 236711 - DNA, 25 bp, Mus musculus
ccaagaccaggtggcaggtatttcc

SEQ ID NO: 236712 - DNA, 25 bp, Mus musculus
ccaagaccagtgaggtctggtatga

SEQ ID NO: 236713 - DNA, 25 bp, Mus musculus
ccaagacccaaacttactgctccta

SEQ ID NO: 236714 - DNA, 25 bp, Mus musculus
ccaagacccacatctggcaagttcc

SEQ ID NO: 236715 - DNA, 25 bp, Mus musculus
ccaagaccccaggccagcgctcagc

SEQ ID NO: 236716 - DNA, 25 bp, Mus musculus
ccaagacccgggcctggttctcaga

SEQ ID NO: 236717 - DNA, 25 bp, Mus musculus
ccaagaccggacagggtctcatgga

SEQ ID NO: 236718 - DNA, 25 bp, Mus musculus
ccaagaccggggatcccaacaagcc

SEQ ID NO: 236719 - DNA, 25 bp, Mus musculus
ccaagacctgcaagccctacctgac

SEQ ID NO: 236720 - DNA, 25 bp, Mus musculus
ccaagacctgcaaggaatctccggt

SEQ ID NO: 236721 - DNA, 25 bp, Mus musculus
ccaagacctgcaaggtccccaaccc

SEQ ID NO: 236722 - DNA, 25 bp, Mus musculus
ccaagacctggaggaggtgatcaca

SEQ ID NO: 236723 - DNA, 25 bp, Mus musculus
ccaagacgaagaatggatacacagc

SEQ ID NO: 236724 - DNA, 25 bp, Mus musculus
ccaagactatgcgcaagaaaggaaa

SEQ ID NO: 236725 - DNA, 25 bp, Mus musculus
ccaagactccgccacctccgcctta

SEQ ID NO: 236726 - DNA, 25 bp, Mus musculus
ccaagactctcagaccaaatacaca

SEQ ID NO: 236727 - DNA, 25 bp, Mus musculus
ccaagagaaccggcatggagagtag

SEQ ID NO: 236728 - DNA, 25 bp, Mus musculus
ccaagagaagagcgcctccctgcag

SEQ ID NO: 236729 - DNA, 25 bp, Mus musculus
ccaagagaagagtgcttccctgcag

SEQ ID NO: 236730 - DNA, 25 bp, Mus musculus
ccaagagaagagtgcttcgctgcag

SEQ ID NO: 236731 - DNA, 25 bp, Mus musculus
ccaagagaaggatgggtagaacaag

SEQ ID NO: 236732 - DNA, 25 bp, Mus musculus
ccaagagaaggtggacctggcagtg

SEQ ID NO: 236733 - DNA, 25 bp, Mus musculus
ccaagagacagaggctgcttggtgc

SEQ ID NO: 236734 - DNA, 25 bp, Mus musculus
ccaagagacagaggctgctttggga

SEQ ID NO: 236735 - DNA, 25 bp, Mus musculus
ccaagagacaggaggctgtcctttc

SEQ ID NO: 236736 - DNA, 25 bp, Mus musculus
ccaagagacgaaagacaatgcaggg

SEQ ID NO: 236737 - DNA, 25 bp, Mus musculus
ccaagagacgaaagctccggtctga

SEQ ID NO: 236738 - DNA, 25 bp, Mus musculus
ccaagagagcaaaggcttatttcaa

SEQ ID NO: 236739 - DNA, 25 bp, Mus musculus
ccaagagagcaggtgtaaaagaaga

SEQ ID NO: 236740 - DNA, 25 bp, Mus musculus
ccaagagagcatctgattgtgggga

SEQ ID NO: 236741 - DNA, 25 bp, Mus musculus
ccaagagcaagaccaggtgctacta

SEQ ID NO: 236742 - DNA, 25 bp, Mus musculus
ccaagagcaaggcgacggtgtggat

SEQ ID NO: 236743 - DNA, 25 bp, Mus musculus
ccaagagcacacattgaaaagggca

SEQ ID NO: 236744 - DNA, 25 bp, Mus musculus
ccaagagcagagagatcatctcctt

SEQ ID NO: 236745 - DNA, 25 bp, Mus musculus
ccaagagcaggtcaccgacaatgag

SEQ ID NO: 236746 - DNA, 25 bp, Mus musculus
ccaagagccagatggtccagcgctc

SEQ ID NO: 236747 - DNA, 25 bp, Mus musculus
ccaagagcccacagtcgaaggatct

SEQ ID NO: 236748 - DNA, 25 bp, Mus musculus
ccaagagcgatatgagatcgtgggg

SEQ ID NO: 236749 - DNA, 25 bp, Mus musculus
ccaagagctcagctttgggattccc

SEQ ID NO: 236750 - DNA, 25 bp, Mus musculus
ccaagagctgggagatcatcacagt

SEQ ID NO: 236751 - DNA, 25 bp, Mus musculus
ccaagagctggggtctgatcttgct

SEQ ID NO: 236752 - DNA, 25 bp, Mus musculus
ccaagagcttcctgagcctcctctt

SEQ ID NO: 236753 - DNA, 25 bp, Mus musculus
ccaagaggaaagacaaagtcagcat

SEQ ID NO: 236754 - DNA, 25 bp, Mus musculus
ccaagaggaaagacagctacaacca

SEQ ID NO: 236755 - DNA, 25 bp, Mus musculus
ccaagaggaaaggtaccagcagtgc

SEQ ID NO: 236756 - DNA, 25 bp, Mus musculus
ccaagaggaagaagtccaggaggaa

SEQ ID NO: 236757 - DNA, 25 bp, Mus musculus
ccaagaggaagaggaagtccaagaa

SEQ ID NO: 236758 - DNA, 25 bp, Mus musculus
ccaagaggacggtgtgccgatgctc

SEQ ID NO: 236759 - DNA, 25 bp, Mus musculus
ccaagaggagggggcatgaatccta

SEQ ID NO: 236760 - DNA, 25 bp, Mus musculus
ccaagaggaggggttatcatgcttt

SEQ ID NO: 236761 - DNA, 25 bp, Mus musculus
ccaagaggcagagggtgctctggcc

SEQ ID NO: 236762 - DNA, 25 bp, Mus musculus
ccaagagggggaatacctccacggg

SEQ ID NO: 236763 - DNA, 25 bp, Mus musculus
ccaagaggtcagagacacctaccgc

SEQ ID NO: 236764 - DNA, 25 bp, Mus musculus
ccaagagtcggccacaggttgtgtt

SEQ ID NO: 236765 - DNA, 25 bp, Mus musculus
ccaagagtgagagtggatcatgacc

SEQ ID NO: 236766 - DNA, 25 bp, Mus musculus
ccaagagtgccaggctgaacctgtg

SEQ ID NO: 236767 - DNA, 25 bp, Mus musculus
ccaagataaataggtgaggctgctg

SEQ ID NO: 236768 - DNA, 25 bp, Mus musculus
ccaagataaatagttcaattatcag

SEQ ID NO: 236769 - DNA, 25 bp, Mus musculus
ccaagataaggatggtagaggtggc

SEQ ID NO: 236770 - DNA, 25 bp, Mus musculus
ccaagataaggcactcctgcagatg

SEQ ID NO: 236771 - DNA, 25 bp, Mus musculus
ccaagatacaggaagactccttcta

SEQ ID NO: 236772 - DNA, 25 bp, Mus musculus
ccaagatatcgactgatatcttctc

SEQ ID NO: 236773 - DNA, 25 bp, Mus musculus
ccaagatcaatcaagatgactgtga

SEQ ID NO: 236774 - DNA, 25 bp, Mus musculus
ccaagatcagcaagcagcttcagga

SEQ ID NO: 236775 - DNA, 25 bp, Mus musculus
ccaagatcagcaagctgattaccag

SEQ ID NO: 236776 - DNA, 25 bp, Mus musculus
ccaagatcatgggtgtggctggagg

SEQ ID NO: 236777 - DNA, 25 bp, Mus musculus
ccaagatccagatcttactctagca

SEQ ID NO: 236778 - DNA, 25 bp, Mus musculus
ccaagatcccagtgattatagagcg

SEQ ID NO: 236779 - DNA, 25 bp, Mus musculus
ccaagatcctaaaaatactcttgcg

SEQ ID NO: 236780 - DNA, 25 bp, Mus musculus
ccaagatcctggagcacttggaatc

SEQ ID NO: 236781 - DNA, 25 bp, Mus musculus
ccaagatccttctttgttgggtggg

SEQ ID NO: 236782 - DNA, 25 bp, Mus musculus
ccaagatctcggtggatatgttctc

SEQ ID NO: 236783 - DNA, 25 bp, Mus musculus
ccaagatctgaaagttgggatggct

SEQ ID NO: 236784 - DNA, 25 bp, Mus musculus
ccaagatgagacaggagacaatcag

SEQ ID NO: 236785 - DNA, 25 bp, Mus musculus
ccaagatgagcagctgtggcggctt

SEQ ID NO: 236786 - DNA, 25 bp, Mus musculus
ccaagatgatagggatgcaaacttg

SEQ ID NO: 236787 - DNA, 25 bp, Mus musculus
ccaagatgcagacgacctggaggaa

SEQ ID NO: 236788 - DNA, 25 bp, Mus musculus
ccaagatgctaatggcccagatgga

SEQ ID NO: 236789 - DNA, 25 bp, Mus musculus
ccaagatgctaatggcctctttatg

SEQ ID NO: 236790 - DNA, 25 bp, Mus musculus
ccaagatgctaatggcctggtccag

SEQ ID NO: 236791 - DNA, 25 bp, Mus musculus
ccaagatggaggagatcgggcgcat

SEQ ID NO: 236792 - DNA, 25 bp, Mus musculus
ccaagatggaggagattgggaggat

SEQ ID NO: 236793 - DNA, 25 bp, Mus musculus
ccaagatggcagagctcgtcagtgt

SEQ ID NO: 236794 - DNA, 25 bp, Mus musculus
ccaagatgtaccttgaaaccatgta

SEQ ID NO: 236795 - DNA, 25 bp, Mus musculus
ccaagatgtaccttgaaaccatgtg

SEQ ID NO: 236796 - DNA, 25 bp, Mus musculus
ccaagatgtcgccctgatgattcgg

SEQ ID NO: 236797 - DNA, 25 bp, Mus musculus
ccaagatgtctgacagaacagtaaa

SEQ ID NO: 236798 - DNA, 25 bp, Mus musculus
ccaagatgtctgtatggggagagat

SEQ ID NO: 236799 - DNA, 25 bp, Mus musculus
ccaagatgttattgcttcaggagct

SEQ ID NO: 236800 - DNA, 25 bp, Mus musculus
ccaagattaagagctgggccagcaa

SEQ ID NO: 236801 - DNA, 25 bp, Mus musculus
ccaagattagaaggacctcttcctg

SEQ ID NO: 236802 - DNA, 25 bp, Mus musculus
ccaagattagattgctttattcacc

SEQ ID NO: 236803 - DNA, 25 bp, Mus musculus
ccaagatttggattcaagtcaatct

SEQ ID NO: 236804 - DNA, 25 bp, Mus musculus
ccaagcaataaaattcatataaacc

SEQ ID NO: 236805 - DNA, 25 bp, Mus musculus
ccaagcaatcaaggctttacaagat

SEQ ID NO: 236806 - DNA, 25 bp, Mus musculus
ccaagcaatgtggtacacggatgaa

SEQ ID NO: 236807 - DNA, 25 bp, Mus musculus
ccaagcacaaggtgagactgtggag

SEQ ID NO: 236808 - DNA, 25 bp, Mus musculus
ccaagcacaatggcatctgtaagca

SEQ ID NO: 236809 - DNA, 25 bp, Mus musculus
ccaagcacacagttcctagtcactc

SEQ ID NO: 236810 - DNA, 25 bp, Mus musculus
ccaagcacatcaaggaacagagaga

SEQ ID NO: 236811 - DNA, 25 bp, Mus musculus
ccaagcaccagaatgcaagggtgtc

SEQ ID NO: 236812 - DNA, 25 bp, Mus musculus
ccaagcaccagctgcgatactatga

SEQ ID NO: 236813 - DNA, 25 bp, Mus musculus
ccaagcaccctcagcagtcccgtct

SEQ ID NO: 236814 - DNA, 25 bp, Mus musculus
ccaagcaccctcagggaacagaagt

SEQ ID NO: 236815 - DNA, 25 bp, Mus musculus
ccaagcactggcaggtccaggaggt

SEQ ID NO: 236816 - DNA, 25 bp, Mus musculus
ccaagcagacagaccgtgcgagtcc

SEQ ID NO: 236817 - DNA, 25 bp, Mus musculus
ccaagcagactgggattgtcttgag

SEQ ID NO: 236818 - DNA, 25 bp, Mus musculus
ccaagcagaggacaaaatcacaaag

SEQ ID NO: 236819 - DNA, 25 bp, Mus musculus
ccaagcagaggtatgtgcaggcagt

SEQ ID NO: 236820 - DNA, 25 bp, Mus musculus
ccaagcagcagatgcatattgactc

SEQ ID NO: 236821 - DNA, 25 bp, Mus musculus
ccaagcagcatgcactgcgcaatga

SEQ ID NO: 236822 - DNA, 25 bp, Mus musculus
ccaagcagccaggggactctgatgg

SEQ ID NO: 236823 - DNA, 25 bp, Mus musculus
ccaagcaggacagagaagaaggtgc

SEQ ID NO: 236824 - DNA, 25 bp, Mus musculus
ccaagcaggagaactactttctcca

SEQ ID NO: 236825 - DNA, 25 bp, Mus musculus
ccaagcaggaggttgaggtgagccg

SEQ ID NO: 236826 - DNA, 25 bp, Mus musculus
ccaagcagggactggaatacgctaa

SEQ ID NO: 236827 - DNA, 25 bp, Mus musculus
ccaagcaggggtttgatttcctctg

SEQ ID NO: 236828 - DNA, 25 bp, Mus musculus
ccaagcagtggaggctctttgccga

SEQ ID NO: 236829 - DNA, 25 bp, Mus musculus
ccaagcatcaggtgtggagggtgca

SEQ ID NO: 236830 - DNA, 25 bp, Mus musculus
ccaagcatccaaatatccagggtat

SEQ ID NO: 236831 - DNA, 25 bp, Mus musculus
ccaagcatccagaaggacattccca

SEQ ID NO: 236832 - DNA, 25 bp, Mus musculus
ccaagcatgagttatttgctggcgt

SEQ ID NO: 236833 - DNA, 25 bp, Mus musculus
ccaagcattccggagaaaacaacgg

SEQ ID NO: 236834 - DNA, 25 bp, Mus musculus
ccaagcattccggctactcctggat

SEQ ID NO: 236835 - DNA, 25 bp, Mus musculus
ccaagcattttctagaaaatggaac

SEQ ID NO: 236836 - DNA, 25 bp, Mus musculus
ccaagcattttctagatggaagctc

SEQ ID NO: 236837 - DNA, 25 bp, Mus musculus
ccaagccaagcccatgtaaaacaga

SEQ ID NO: 236838 - DNA, 25 bp, Mus musculus
ccaagccacagcaatgtggggctgg

SEQ ID NO: 236839 - DNA, 25 bp, Mus musculus
ccaagccacaggatggtgacattat

SEQ ID NO: 236840 - DNA, 25 bp, Mus musculus
ccaagccagatcgacagcaaagagc

SEQ ID NO: 236841 - DNA, 25 bp, Mus musculus
ccaagccagatcgccctacatgaag

SEQ ID NO: 236842 - DNA, 25 bp, Mus musculus
ccaagccagcctggagccatcgtgg

SEQ ID NO: 236843 - DNA, 25 bp, Mus musculus
ccaagccaggaacctctcagtcaac

SEQ ID NO: 236844 - DNA, 25 bp, Mus musculus
ccaagccaggaacttctcagccagc

SEQ ID NO: 236845 - DNA, 25 bp, Mus musculus
ccaagccatgaggcaagaaactaca

SEQ ID NO: 236846 - DNA, 25 bp, Mus musculus
ccaagccatgctggccaagacggaa

SEQ ID NO: 236847 - DNA, 25 bp, Mus musculus
ccaagccatggtacactgtgggagc

SEQ ID NO: 236848 - DNA, 25 bp, Mus musculus
ccaagcccagaagcacagcaagaag

SEQ ID NO: 236849 - DNA, 25 bp, Mus musculus
ccaagcccagcatgtgagggagcag

SEQ ID NO: 236850 - DNA, 25 bp, Mus musculus
ccaagcccaggacaccgtgcattaa

SEQ ID NO: 236851 - DNA, 25 bp, Mus musculus
ccaagcccaggtaactgttcagtcc

SEQ ID NO: 236852 - DNA, 25 bp, Mus musculus
ccaagcccagttccacaagaggaaa

SEQ ID NO: 236853 - DNA, 25 bp, Mus musculus
ccaagcccatccaaggttactttgg

SEQ ID NO: 236854 - DNA, 25 bp, Mus musculus
ccaagcccatgtaaaacagactagc

SEQ ID NO: 236855 - DNA, 25 bp, Mus musculus
ccaagccccctcttgaattttctga

SEQ ID NO: 236856 - DNA, 25 bp, Mus musculus
ccaagcccgaggtctcctctgatga

SEQ ID NO: 236857 - DNA, 25 bp, Mus musculus
ccaagccctctacagtttcaggcct

SEQ ID NO: 236858 - DNA, 25 bp, Mus musculus
ccaagccgaggtatctccagacagg

SEQ ID NO: 236859 - DNA, 25 bp, Mus musculus
ccaagccgagtgccaggtcaccaga

SEQ ID NO: 236860 - DNA, 25 bp, Mus musculus
ccaagccgcagaccggactccagat

SEQ ID NO: 236861 - DNA, 25 bp, Mus musculus
ccaagccgcaggcatgaggtgaacc

SEQ ID NO: 236862 - DNA, 25 bp, Mus musculus
ccaagccgctgcccagactacagca

SEQ ID NO: 236863 - DNA, 25 bp, Mus musculus
ccaagccggcatcagctgatttcca

SEQ ID NO: 236864 - DNA, 25 bp, Mus musculus
ccaagccggtgccgggctttcaggt

SEQ ID NO: 236865 - DNA, 25 bp, Mus musculus
ccaagcctaatatggcggtgtggct

SEQ ID NO: 236866 - DNA, 25 bp, Mus musculus
ccaagcctagtgctaccaagggaac

SEQ ID NO: 236867 - DNA, 25 bp, Mus musculus
ccaagcctcagctgctgttgcaccc

SEQ ID NO: 236868 - DNA, 25 bp, Mus musculus
ccaagcctcaggattcctctattga

SEQ ID NO: 236869 - DNA, 25 bp, Mus musculus
ccaagcctccgctgggtggtaaatg

SEQ ID NO: 236870 - DNA, 25 bp, Mus musculus
ccaagcctctctggaactgaaaagc

SEQ ID NO: 236871 - DNA, 25 bp, Mus musculus
ccaagcctctctggagtccatgtat

SEQ ID NO: 236872 - DNA, 25 bp, Mus musculus
ccaagcctctgaactggaaatccca

SEQ ID NO: 236873 - DNA, 25 bp, Mus musculus
ccaagcctgaggactgggacaagcc

SEQ ID NO: 236874 - DNA, 25 bp, Mus musculus
ccaagcctgaggactgggatgaaga

SEQ ID NO: 236875 - DNA, 25 bp, Mus musculus
ccaagcgaagagacagggcagggca

SEQ ID NO: 236876 - DNA, 25 bp, Mus musculus
ccaagcgaggacgggctgtccttgt

SEQ ID NO: 236877 - DNA, 25 bp, Mus musculus
ccaagcgctacactcaagatgacag

SEQ ID NO: 236878 - DNA, 25 bp, Mus musculus
ccaagcgctcaggctcagtttatga

SEQ ID NO: 236879 - DNA, 25 bp, Mus musculus
ccaagcgctcagtttagcgtgcaac

SEQ ID NO: 236880 - DNA, 25 bp, Mus musculus
ccaagcggaaggagcatagtgaaaa

SEQ ID NO: 236881 - DNA, 25 bp, Mus musculus
ccaagcggacaagtattccaccaaa

SEQ ID NO: 236882 - DNA, 25 bp, Mus musculus
ccaagcggagagaggtcttatcagc

SEQ ID NO: 236883 - DNA, 25 bp, Mus musculus
ccaagcggcctcactagtgttccca

SEQ ID NO: 236884 - DNA, 25 bp, Mus musculus
ccaagcggcctcactatcagacatg

SEQ ID NO: 236885 - DNA, 25 bp, Mus musculus
ccaagcgtgcatggttctgcagctt

SEQ ID NO: 236886 - DNA, 25 bp, Mus musculus
ccaagctaaaggagctgaatctgtc

SEQ ID NO: 236887 - DNA, 25 bp, Mus musculus
ccaagctatacaaggtgggcctggg

SEQ ID NO: 236888 - DNA, 25 bp, Mus musculus
ccaagctatggtccttcccaaactc

SEQ ID NO: 236889 - DNA, 25 bp, Mus musculus
ccaagctatgtttttgaggacaagt

SEQ ID NO: 236890 - DNA, 25 bp, Mus musculus
ccaagctcaagcaggtgttgcaggc

SEQ ID NO: 236891 - DNA, 25 bp, Mus musculus
ccaagctcaatggctacacggatgc

SEQ ID NO: 236892 - DNA, 25 bp, Mus musculus
ccaagctcagagtgcctgctcactg

SEQ ID NO: 236893 - DNA, 25 bp, Mus musculus
ccaagctcagcctcctcttagacaa

SEQ ID NO: 236894 - DNA, 25 bp, Mus musculus
ccaagctcatggccagggcattgtt

SEQ ID NO: 236895 - DNA, 25 bp, Mus musculus
ccaagctcatgggccctgcaccctt

SEQ ID NO: 236896 - DNA, 25 bp, Mus musculus
ccaagctcatgggtacttccgccag

SEQ ID NO: 236897 - DNA, 25 bp, Mus musculus
ccaagctctacaaggtctccaacgg

SEQ ID NO: 236898 - DNA, 25 bp, Mus musculus
ccaagctgaaggaccaagtctccaa

SEQ ID NO: 236899 - DNA, 25 bp, Mus musculus
ccaagctgaggcggggcatcgtgaa

SEQ ID NO: 236900 - DNA, 25 bp, Mus musculus
ccaagctgcaccaggaggcggtggg

SEQ ID NO: 236901 - DNA, 25 bp, Mus musculus
ccaagctgctgagactttccagttc

SEQ ID NO: 236902 - DNA, 25 bp, Mus musculus
ccaagctgctttctggcttgctgga

SEQ ID NO: 236903 - DNA, 25 bp, Mus musculus
ccaagctggagaatggcaaagcgca

SEQ ID NO: 236904 - DNA, 25 bp, Mus musculus
ccaagctgggcccaggggagaaata

SEQ ID NO: 236905 - DNA, 25 bp, Mus musculus
ccaagctgggcccagtatcgttgat

SEQ ID NO: 236906 - DNA, 25 bp, Mus musculus
ccaagctgtacaggttgggcttagg

SEQ ID NO: 236907 - DNA, 25 bp, Mus musculus
ccaagctgtagatcaagtctccagt

SEQ ID NO: 236908 - DNA, 25 bp, Mus musculus
ccaagctgtagcatagttttgggaa

SEQ ID NO: 236909 - DNA, 25 bp, Mus musculus
ccaagctgtgcggatgccgggagac

SEQ ID NO: 236910 - DNA, 25 bp, Mus musculus
ccaagctgttgagcaagcaccagaa

SEQ ID NO: 236911 - DNA, 25 bp, Mus musculus
ccaagcttaagcaaagtgagaagaa

SEQ ID NO: 236912 - DNA, 25 bp, Mus musculus
ccaagcttaagctatgtacttaagc

SEQ ID NO: 236913 - DNA, 25 bp, Mus musculus
ccaagcttaaggccttggaagatcg

SEQ ID NO: 236914 - DNA, 25 bp, Mus musculus
ccaagcttcctgatgctccattgct

SEQ ID NO: 236915 - DNA, 25 bp, Mus musculus
ccaagcttctgaggagctagaagcg

SEQ ID NO: 236916 - DNA, 25 bp, Mus musculus
ccaagcttgcccagtatgtgggatc

SEQ ID NO: 236917 - DNA, 25 bp, Mus musculus
ccaagcttgggaggggtcatccttc

SEQ ID NO: 236918 - DNA, 25 bp, Mus musculus
ccaagctttccagcacctcctaccg

SEQ ID NO: 236919 - DNA, 25 bp, Mus musculus
ccaagctttccaggtctttgactca

SEQ ID NO: 236920 - DNA, 25 bp, Mus musculus
ccaaggaaactcagactaaggctgg

SEQ ID NO: 236921 - DNA, 25 bp, Mus musculus
ccaaggaaagcaaggaatcttcaaa

SEQ ID NO: 236922 - DNA, 25 bp, Mus musculus
ccaaggaaagcaaggcatgccgctt

SEQ ID NO: 236923 - DNA, 25 bp, Mus musculus
ccaaggaaaggtaccgagcttatga

SEQ ID NO: 236924 - DNA, 25 bp, Mus musculus
ccaaggaaatctatgatgattcttt

SEQ ID NO: 236925 - DNA, 25 bp, Mus musculus
ccaaggaacagatcctgaagctgca

SEQ ID NO: 236926 - DNA, 25 bp, Mus musculus
ccaaggaacccacaggtgattcaca

SEQ ID NO: 236927 - DNA, 25 bp, Mus musculus
ccaaggaacccacagttacagatca

SEQ ID NO: 236928 - DNA, 25 bp, Mus musculus
ccaaggaagccaattaaaatgctct

SEQ ID NO: 236929 - DNA, 25 bp, Mus musculus
ccaaggaaggagggtctctaatcta

SEQ ID NO: 236930 - DNA, 25 bp, Mus musculus
ccaaggaatgattcccgttgcgcag

SEQ ID NO: 236931 - DNA, 25 bp, Mus musculus
ccaaggacaaccacgagatgtctgc

SEQ ID NO: 236932 - DNA, 25 bp, Mus musculus
ccaaggacaaccacgtcattcaccc

SEQ ID NO: 236933 - DNA, 25 bp, Mus musculus
ccaaggacaagaaacatctttctct

SEQ ID NO: 236934 - DNA, 25 bp, Mus musculus
ccaaggacaagagtttcttggatct

SEQ ID NO: 236935 - DNA, 25 bp, Mus musculus
ccaaggacaggctgagggtatcgcc

SEQ ID NO: 236936 - DNA, 25 bp, Mus musculus
ccaaggacagtttagagacgtggag

SEQ ID NO: 236937 - DNA, 25 bp, Mus musculus
ccaaggaccagactttgaagaatca

SEQ ID NO: 236938 - DNA, 25 bp, Mus musculus
ccaaggaccaggagatccagacttt

SEQ ID NO: 236939 - DNA, 25 bp, Mus musculus
ccaaggaccattctggatgcagacc

SEQ ID NO: 236940 - DNA, 25 bp, Mus musculus
ccaaggaccctcaggtactaggcgg

SEQ ID NO: 236941 - DNA, 25 bp, Mus musculus
ccaaggaccttctcttggtcttcat

SEQ ID NO: 236942 - DNA, 25 bp, Mus musculus
ccaaggacgaggaacctagtaacaa

SEQ ID NO: 236943 - DNA, 25 bp, Mus musculus
ccaaggactgctacaccttacaact

SEQ ID NO: 236944 - DNA, 25 bp, Mus musculus
ccaaggactggccttctcagtattt

SEQ ID NO: 236945 - DNA, 25 bp, Mus musculus
ccaaggagaacagcatgttgttttg

SEQ ID NO: 236946 - DNA, 25 bp, Mus musculus
ccaaggagaaccaggagctctggtt

SEQ ID NO: 236947 - DNA, 25 bp, Mus musculus
ccaaggagaagaagaatttggaatt

SEQ ID NO: 236948 - DNA, 25 bp, Mus musculus
ccaaggagaagaagggctccagcac

SEQ ID NO: 236949 - DNA, 25 bp, Mus musculus
ccaaggagaggtcaatactatcaat

SEQ ID NO: 236950 - DNA, 25 bp, Mus musculus
ccaaggagaggttttccttactgct

SEQ ID NO: 236951 - DNA, 25 bp, Mus musculus
ccaaggagcagcccggacaccaagg

SEQ ID NO: 236952 - DNA, 25 bp, Mus musculus
ccaaggagcagcttggctatattgt

SEQ ID NO: 236953 - DNA, 25 bp, Mus musculus
ccaaggagcaggtcatgcttctcat

SEQ ID NO: 236954 - DNA, 25 bp, Mus musculus
ccaaggagccaagaggagtgaatgg

SEQ ID NO: 236955 - DNA, 25 bp, Mus musculus
ccaaggagccaagaggggtctccaa

SEQ ID NO: 236956 - DNA, 25 bp, Mus musculus
ccaaggagcccaggccggctcaaca

SEQ ID NO: 236957 - DNA, 25 bp, Mus musculus
ccaaggagctcttcctgggcctctc

SEQ ID NO: 236958 - DNA, 25 bp, Mus musculus
ccaaggaggagaagtataaagagca

SEQ ID NO: 236959 - DNA, 25 bp, Mus musculus
ccaaggagggcaaaggtcccaatgc

SEQ ID NO: 236960 - DNA, 25 bp, Mus musculus
ccaaggagggggctgagaaaataaa

SEQ ID NO: 236961 - DNA, 25 bp, Mus musculus
ccaaggaggtccagctgctcggcac

SEQ ID NO: 236962 - DNA, 25 bp, Mus musculus
ccaaggaggtccagctgttcatgac

SEQ ID NO: 236963 - DNA, 25 bp, Mus musculus
ccaaggagtatgagggagccgtcta

SEQ ID NO: 236964 - DNA, 25 bp, Mus musculus
ccaaggagtgggggtgggcttaggc

SEQ ID NO: 236965 - DNA, 25 bp, Mus musculus
ccaaggagtgggtatggaggagcgt

SEQ ID NO: 236966 - DNA, 25 bp, Mus musculus
ccaaggagttcaggaggacccgctc

SEQ ID NO: 236967 - DNA, 25 bp, Mus musculus
ccaaggataaggacaaagccaaggt

SEQ ID NO: 236968 - DNA, 25 bp, Mus musculus
ccaaggatccagacttggagaagaa

SEQ ID NO: 236969 - DNA, 25 bp, Mus musculus
ccaaggatgacctgggccttttgct

SEQ ID NO: 236970 - DNA, 25 bp, Mus musculus
ccaaggatgagtgggtggaagagca

SEQ ID NO: 236971 - DNA, 25 bp, Mus musculus
ccaaggatgctgggaagtccgtggg

SEQ ID NO: 236972 - DNA, 25 bp, Mus musculus
ccaaggatgtacaggggagcagcgc

SEQ ID NO: 236973 - DNA, 25 bp, Mus musculus
ccaaggattcccaggtgctcctggc

SEQ ID NO: 236974 - DNA, 25 bp, Mus musculus
ccaaggatttttgtcctacttggag

SEQ ID NO: 236975 - DNA, 25 bp, Mus musculus
ccaaggcaaaggtgttgaacgagga

SEQ ID NO: 236976 - DNA, 25 bp, Mus musculus
ccaaggcaacggccacgtaccccat

SEQ ID NO: 236977 - DNA, 25 bp, Mus musculus
ccaaggcaaggggatgaaagcttgc

SEQ ID NO: 236978 - DNA, 25 bp, Mus musculus
ccaaggcactagagccccagatcct

SEQ ID NO: 236979 - DNA, 25 bp, Mus musculus
ccaaggcactagggtgccacctacg

SEQ ID NO: 236980 - DNA, 25 bp, Mus musculus
ccaaggcagaggttgtatggagaga

SEQ ID NO: 236981 - DNA, 25 bp, Mus musculus
ccaaggcagccttggctggtcgttt

SEQ ID NO: 236982 - DNA, 25 bp, Mus musculus
ccaaggcaggtgatttggagttcct

SEQ ID NO: 236983 - DNA, 25 bp, Mus musculus
ccaaggcatgagacactgccccagg

SEQ ID NO: 236984 - DNA, 25 bp, Mus musculus
ccaaggcatggtcttttccctaggc

SEQ ID NO: 236985 - DNA, 25 bp, Mus musculus
ccaaggccacagccaggagaaactg

SEQ ID NO: 236986 - DNA, 25 bp, Mus musculus
ccaaggccagcttttcctagatgac

SEQ ID NO: 236987 - DNA, 25 bp, Mus musculus
ccaaggccatgaacacggctctaga

SEQ ID NO: 236988 - DNA, 25 bp, Mus musculus
ccaaggcccaggtggtgaccataga

SEQ ID NO: 236989 - DNA, 25 bp, Mus musculus
ccaaggcccaggttgaccaaagaaa

SEQ ID NO: 236990 - DNA, 25 bp, Mus musculus
ccaaggcccccaacacggcgagcct

SEQ ID NO: 236991 - DNA, 25 bp, Mus musculus
ccaaggcctgtggcatcctgcctgt

SEQ ID NO: 236992 - DNA, 25 bp, Mus musculus
ccaaggcctgtggtatcctgcctgt

SEQ ID NO: 236993 - DNA, 25 bp, Mus musculus
ccaaggcgggcagacgtatgtttcc

SEQ ID NO: 236994 - DNA, 25 bp, Mus musculus
ccaaggcgtgattaaggttgaggaa

SEQ ID NO: 236995 - DNA, 25 bp, Mus musculus
ccaaggctacactggggcttacagg

SEQ ID NO: 236996 - DNA, 25 bp, Mus musculus
ccaaggctgccgctctggcccacag

SEQ ID NO: 236997 - DNA, 25 bp, Mus musculus
ccaaggctgggcgcgggctgggagc

SEQ ID NO: 236998 - DNA, 25 bp, Mus musculus
ccaaggcttaggcatcgtcttcagc

SEQ ID NO: 236999 - DNA, 25 bp, Mus musculus
ccaagggaagggaggaagagacagc

SEQ ID NO: 237000 - DNA, 25 bp, Mus musculus
ccaagggaaggggagaggcctgtcc

SEQ ID NO: 237001 - DNA, 25 bp, Mus musculus
ccaagggaatccagagatcattgat

SEQ ID NO: 237002 - DNA, 25 bp, Mus musculus
ccaagggaatccagatcaaggttcc

SEQ ID NO: 237003 - DNA, 25 bp, Mus musculus
ccaagggaatccagatgactgcagt

SEQ ID NO: 237004 - DNA, 25 bp, Mus musculus
ccaagggacaaccaggcaaccgagg

SEQ ID NO: 237005 - DNA, 25 bp, Mus musculus
ccaagggagacagaggcgatgttgg

SEQ ID NO: 237006 - DNA, 25 bp, Mus musculus
ccaagggagagactggacctgctgg

SEQ ID NO: 237007 - DNA, 25 bp, Mus musculus
ccaagggaggtgaggaggaagaagt

SEQ ID NO: 237008 - DNA, 25 bp, Mus musculus
ccaagggcaagggactccgagggag

SEQ ID NO: 237009 - DNA, 25 bp, Mus musculus
ccaagggcaagggggagaagattaa

SEQ ID NO: 237010 - DNA, 25 bp, Mus musculus
ccaagggcacaagctcctgacgagc

SEQ ID NO: 237011 - DNA, 25 bp, Mus musculus
ccaagggcacaagctgagcggggcc

SEQ ID NO: 237012 - DNA, 25 bp, Mus musculus
ccaagggcaggcatcagaaacacaa

SEQ ID NO: 237013 - DNA, 25 bp, Mus musculus
ccaagggccaggagactgttctgga

SEQ ID NO: 237014 - DNA, 25 bp, Mus musculus
ccaagggccttttggtctggaagct

SEQ ID NO: 237015 - DNA, 25 bp, Mus musculus
ccaagggcttattctcagctctttg

SEQ ID NO: 237016 - DNA, 25 bp, Mus musculus
ccaagggcttcttaggtcgcaagtc

SEQ ID NO: 237017 - DNA, 25 bp, Mus musculus
ccaaggggcccagcaggtggagagc

SEQ ID NO: 237018 - DNA, 25 bp, Mus musculus
ccaagggggagaagggccacattgg

SEQ ID NO: 237019 - DNA, 25 bp, Mus musculus
ccaagggggtgcctgtgggccgaag

SEQ ID NO: 237020 - DNA, 25 bp, Mus musculus
ccaagggtgaacagggtgcctctgg

SEQ ID NO: 237021 - DNA, 25 bp, Mus musculus
ccaagggttgtgatgggaggctcct

SEQ ID NO: 237022 - DNA, 25 bp, Mus musculus
ccaagggttgtgatgggcggctcct

SEQ ID NO: 237023 - DNA, 25 bp, Mus musculus
ccaaggtcctacaagggcctgtgga

SEQ ID NO: 237024 - DNA, 25 bp, Mus musculus
ccaaggtcgagcaggagcatagaag

SEQ ID NO: 237025 - DNA, 25 bp, Mus musculus
ccaaggtcgtccaatgccgagaccc

SEQ ID NO: 237026 - DNA, 25 bp, Mus musculus
ccaaggtcgtccagctgaagaacct

SEQ ID NO: 237027 - DNA, 25 bp, Mus musculus
ccaaggtcgtccatgctggagttac

SEQ ID NO: 237028 - DNA, 25 bp, Mus musculus
ccaaggtgaagcttggctgctgtga

SEQ ID NO: 237029 - DNA, 25 bp, Mus musculus
ccaaggtgagactctgctgctaaat

SEQ ID NO: 237030 - DNA, 25 bp, Mus musculus
ccaaggtgcagcaacctcactttgg

SEQ ID NO: 237031 - DNA, 25 bp, Mus musculus
ccaaggtgcaggctttggttagaag

SEQ ID NO: 237032 - DNA, 25 bp, Mus musculus
ccaaggtgccagaggaggatgactc

SEQ ID NO: 237033 - DNA, 25 bp, Mus musculus
ccaaggtgctacaagaaatgtctga

SEQ ID NO: 237034 - DNA, 25 bp, Mus musculus
ccaaggtggcctgtgagacagtgtg

SEQ ID NO: 237035 - DNA, 25 bp, Mus musculus
ccaaggtgtcatagacatgaaaaat

SEQ ID NO: 237036 - DNA, 25 bp, Mus musculus
ccaaggttaccagagctgaaattag

SEQ ID NO: 237037 - DNA, 25 bp, Mus musculus
ccaaggttaccagtatgcaaccgag

SEQ ID NO: 237038 - DNA, 25 bp, Mus musculus
ccaaggttaccagtgtttgaaagac

SEQ ID NO: 237039 - DNA, 25 bp, Mus musculus
ccaaggttcagcaaggtttacagta

SEQ ID NO: 237040 - DNA, 25 bp, Mus musculus
ccaagtaactaactggtccagctgc

SEQ ID NO: 237041 - DNA, 25 bp, Mus musculus
ccaagtaagagtcaaagcagtcctt

SEQ ID NO: 237042 - DNA, 25 bp, Mus musculus
ccaagtaatgagaggaagacgactg

SEQ ID NO: 237043 - DNA, 25 bp, Mus musculus
ccaagtaatgcaagtgtggcacctt

SEQ ID NO: 237044 - DNA, 25 bp, Mus musculus
ccaagtaatgcatgtgtggcacctt

SEQ ID NO: 237045 - DNA, 25 bp, Mus musculus
ccaagtacacagtgtgtgattcagt

SEQ ID NO: 237046 - DNA, 25 bp, Mus musculus
ccaagtacagacttctggaggattg

SEQ ID NO: 237047 - DNA, 25 bp, Mus musculus
ccaagtacagcatggggcaaggaga

SEQ ID NO: 237048 - DNA, 25 bp, Mus musculus
ccaagtacagcatgggtatcaccag

SEQ ID NO: 237049 - DNA, 25 bp, Mus musculus
ccaagtacattcacttcttccctgt

SEQ ID NO: 237050 - DNA, 25 bp, Mus musculus
ccaagtaccacagggagtcccccca

SEQ ID NO: 237051 - DNA, 25 bp, Mus musculus
ccaagtacccgcctacagtttcaat

SEQ ID NO: 237052 - DNA, 25 bp, Mus musculus
ccaagtacgtgctccaggcactaca

SEQ ID NO: 237053 - DNA, 25 bp, Mus musculus
ccaagtacgtgctctacaccctcgc

SEQ ID NO: 237054 - DNA, 25 bp, Mus musculus
ccaagtagccccagctgagaaaaaa

SEQ ID NO: 237055 - DNA, 25 bp, Mus musculus
ccaagtataaggtggctctcgaggg

SEQ ID NO: 237056 - DNA, 25 bp, Mus musculus
ccaagtatctcagaaagacccaaat

SEQ ID NO: 237057 - DNA, 25 bp, Mus musculus
ccaagtatctcagattgaagaccaa

SEQ ID NO: 237058 - DNA, 25 bp, Mus musculus
ccaagtatgagcccaattttgccca

SEQ ID NO: 237059 - DNA, 25 bp, Mus musculus
ccaagtatgcaggctgctcgtcagt

SEQ ID NO: 237060 - DNA, 25 bp, Mus musculus
ccaagtatgcagtgctcgatgaagc

SEQ ID NO: 237061 - DNA, 25 bp, Mus musculus
ccaagtcaaaaagattgataagtat

SEQ ID NO: 237062 - DNA, 25 bp, Mus musculus
ccaagtcactggaatttcttgatgg

SEQ ID NO: 237063 - DNA, 25 bp, Mus musculus
ccaagtcactgggaatctgtccttg

SEQ ID NO: 237064 - DNA, 25 bp, Mus musculus
ccaagtcagggaaggttttggtcgt

SEQ ID NO: 237065 - DNA, 25 bp, Mus musculus
ccaagtccaagtccggtcagagcag

SEQ ID NO: 237066 - DNA, 25 bp, Mus musculus
ccaagtccagagtcccggccaccca

SEQ ID NO: 237067 - DNA, 25 bp, Mus musculus
ccaagtccagcaggaattgtctggg

SEQ ID NO: 237068 - DNA, 25 bp, Mus musculus
ccaagtccatgaagccatgtatgat

SEQ ID NO: 237069 - DNA, 25 bp, Mus musculus
ccaagtccatgagtttaagatccat

SEQ ID NO: 237070 - DNA, 25 bp, Mus musculus
ccaagtccatgattctgtaaccctg

SEQ ID NO: 237071 - DNA, 25 bp, Mus musculus
ccaagtccatgcaacagggagctgc

SEQ ID NO: 237072 - DNA, 25 bp, Mus musculus
ccaagtccattctcacatccatgaa

SEQ ID NO: 237073 - DNA, 25 bp, Mus musculus
ccaagtccccaggagaggagacaag

SEQ ID NO: 237074 - DNA, 25 bp, Mus musculus
ccaagtccccaggccggggagcgtc

SEQ ID NO: 237075 - DNA, 25 bp, Mus musculus
ccaagtccgagctctgaactcactg

SEQ ID NO: 237076 - DNA, 25 bp, Mus musculus
ccaagtcgcagggagagtctcttcc

SEQ ID NO: 237077 - DNA, 25 bp, Mus musculus
ccaagtcgcttcagcctttaccctc

SEQ ID NO: 237078 - DNA, 25 bp, Mus musculus
ccaagtcgggacccttgcacaagca

SEQ ID NO: 237079 - DNA, 25 bp, Mus musculus
ccaagtctacaggtggtgtctacca

SEQ ID NO: 237080 - DNA, 25 bp, Mus musculus
ccaagtctcgggtggatgaaactca

SEQ ID NO: 237081 - DNA, 25 bp, Mus musculus
ccaagtctctcaagagtcaccatgt

SEQ ID NO: 237082 - DNA, 25 bp, Mus musculus
ccaagtctctcaagtatctcagcaa

SEQ ID NO: 237083 - DNA, 25 bp, Mus musculus
ccaagtctgagtgtggataagtcct

SEQ ID NO: 237084 - DNA, 25 bp, Mus musculus
ccaagtctgctgccctgctgtcctc

SEQ ID NO: 237085 - DNA, 25 bp, Mus musculus
ccaagtctgtgaggctgggacccac

SEQ ID NO: 237086 - DNA, 25 bp, Mus musculus
ccaagtgaacaagaactggaatgca

SEQ ID NO: 237087 - DNA, 25 bp, Mus musculus
ccaagtgagaaccttacccacaggt

SEQ ID NO: 237088 - DNA, 25 bp, Mus musculus
ccaagtgcaatgaaattgaatccca

SEQ ID NO: 237089 - DNA, 25 bp, Mus musculus
ccaagtgcaccggaagatggacgac

SEQ ID NO: 237090 - DNA, 25 bp, Mus musculus
ccaagtgcaccggggtctgctgaca

SEQ ID NO: 237091 - DNA, 25 bp, Mus musculus
ccaagtgcaggcggaacaagacaac

SEQ ID NO: 237092 - DNA, 25 bp, Mus musculus
ccaagtgccacaaaggaacctactt

SEQ ID NO: 237093 - DNA, 25 bp, Mus musculus
ccaagtgccagaacaccaagctgga

SEQ ID NO: 237094 - DNA, 25 bp, Mus musculus
ccaagtgccaggtacaaccagcatc

SEQ ID NO: 237095 - DNA, 25 bp, Mus musculus
ccaagtgcgagatgttgcatgtggc

SEQ ID NO: 237096 - DNA, 25 bp, Mus musculus
ccaagtgcgaggaaaaatccgctgc

SEQ ID NO: 237097 - DNA, 25 bp, Mus musculus
ccaagtgctcaagtatgatgacttc

SEQ ID NO: 237098 - DNA, 25 bp, Mus musculus
ccaagtgctgcaggaggctactttt

SEQ ID NO: 237099 - DNA, 25 bp, Mus musculus
ccaagtggaaagctgcggctgctgt

SEQ ID NO: 237100 - DNA, 25 bp, Mus musculus
ccaagtggagaaaggtttccttctc

SEQ ID NO: 237101 - DNA, 25 bp, Mus musculus
ccaagtggagaggagctctcctatg

SEQ ID NO: 237102 - DNA, 25 bp, Mus musculus
ccaagtgggagaaggtgcagcagct

SEQ ID NO: 237103 - DNA, 25 bp, Mus musculus
ccaagtggtggccaggacagcaacc

SEQ ID NO: 237104 - DNA, 25 bp, Mus musculus
ccaagtgtccatgaggttttggggc

SEQ ID NO: 237105 - DNA, 25 bp, Mus musculus
ccaagtgtgacaaggtggtacagga

SEQ ID NO: 237106 - DNA, 25 bp, Mus musculus
ccaagtgtgccgatcccgtgcatgg

SEQ ID NO: 237107 - DNA, 25 bp, Mus musculus
ccaagtgtgccggagccagtgttac

SEQ ID NO: 237108 - DNA, 25 bp, Mus musculus
ccaagttacaggaggcagtgacatt

SEQ ID NO: 237109 - DNA, 25 bp, Mus musculus
ccaagttacaggaggcagtgacgtt

SEQ ID NO: 237110 - DNA, 25 bp, Mus musculus
ccaagttacaggaggcagtgacttt

SEQ ID NO: 237111 - DNA, 25 bp, Mus musculus
ccaagttacaggtctcctgtttctg

SEQ ID NO: 237112 - DNA, 25 bp, Mus musculus
ccaagttacgtaatcattgcaacga

SEQ ID NO: 237113 - DNA, 25 bp, Mus musculus
ccaagttcaaatgagacatcctatg

SEQ ID NO: 237114 - DNA, 25 bp, Mus musculus
ccaagttcaacttcgctagttgatt

SEQ ID NO: 237115 - DNA, 25 bp, Mus musculus
ccaagttcaagagagcaggcaagga

SEQ ID NO: 237116 - DNA, 25 bp, Mus musculus
ccaagttcaagcggtatgaatatca

SEQ ID NO: 237117 - DNA, 25 bp, Mus musculus
ccaagttcaaggacagcagcctggc

SEQ ID NO: 237118 - DNA, 25 bp, Mus musculus
ccaagttcaagggaatcaaagactc

SEQ ID NO: 237119 - DNA, 25 bp, Mus musculus
ccaagttcaggaagaagcacacaga

SEQ ID NO: 237120 - DNA, 25 bp, Mus musculus
ccaagttcaggagctctgcacaccc

SEQ ID NO: 237121 - DNA, 25 bp, Mus musculus
ccaagttcatgaacacccagtattt

SEQ ID NO: 237122 - DNA, 25 bp, Mus musculus
ccaagttcatgatggattgggtcga

SEQ ID NO: 237123 - DNA, 25 bp, Mus musculus
ccaagttcccagaccttgtgaccgt

SEQ ID NO: 237124 - DNA, 25 bp, Mus musculus
ccaagttcccagcaagccccgccca

SEQ ID NO: 237125 - DNA, 25 bp, Mus musculus
ccaagttctcatgtctgcccaggac

SEQ ID NO: 237126 - DNA, 25 bp, Mus musculus
ccaagttgaaactgttatctgggag

SEQ ID NO: 237127 - DNA, 25 bp, Mus musculus
ccaagttgagttcatggcatctcat

SEQ ID NO: 237128 - DNA, 25 bp, Mus musculus
ccaagttggcaggaacatcattcat

SEQ ID NO: 237129 - DNA, 25 bp, Mus musculus
ccaagtttggaagataccaacattt

SEQ ID NO: 237130 - DNA, 25 bp, Mus musculus
ccaataaaagataattggttaaggg

SEQ ID NO: 237131 - DNA, 25 bp, Mus musculus
ccaataaaaggctcccgtccacctt

SEQ ID NO: 237132 - DNA, 25 bp, Mus musculus
ccaataaaatggatcttcattgcct

SEQ ID NO: 237133 - DNA, 25 bp, Mus musculus
ccaataaaattggtgttcccccagg

SEQ ID NO: 237134 - DNA, 25 bp, Mus musculus
ccaataactatgcctgtggttgagc

SEQ ID NO: 237135 - DNA, 25 bp, Mus musculus
ccaataagaagttgtgaagttatcc

SEQ ID NO: 237136 - DNA, 25 bp, Mus musculus
ccaataagagaagctggctgtatag

SEQ ID NO: 237137 - DNA, 25 bp, Mus musculus
ccaataagctacaggagcttcaagt

SEQ ID NO: 237138 - DNA, 25 bp, Mus musculus
ccaataaggatcgcctgaattctgc

SEQ ID NO: 237139 - DNA, 25 bp, Mus musculus
ccaataatgaaatggatataaccaa

SEQ ID NO: 237140 - DNA, 25 bp, Mus musculus
ccaataatgaaatggggattggtgt

SEQ ID NO: 237141 - DNA, 25 bp, Mus musculus
ccaataattctatactttctggcaa

SEQ ID NO: 237142 - DNA, 25 bp, Mus musculus
ccaataattcttatttgtagagtaa

SEQ ID NO: 237143 - DNA, 25 bp, Mus musculus
ccaatacaagcacaggggagtatac

SEQ ID NO: 237144 - DNA, 25 bp, Mus musculus
ccaatacagtgttatttctgctcag

SEQ ID NO: 237145 - DNA, 25 bp, Mus musculus
ccaatagaagaggagggactgattt

SEQ ID NO: 237146 - DNA, 25 bp, Mus musculus
ccaatagaccaagacaacaaaacaa

SEQ ID NO: 237147 - DNA, 25 bp, Mus musculus
ccaatagagaggttgatgttttggt

SEQ ID NO: 237148 - DNA, 25 bp, Mus musculus
ccaatagagttgcttcacgtcttac

SEQ ID NO: 237149 - DNA, 25 bp, Mus musculus
ccaataggggagcagccctggctgt

SEQ ID NO: 237150 - DNA, 25 bp, Mus musculus
ccaataggggagcagggcatgaatc

SEQ ID NO: 237151 - DNA, 25 bp, Mus musculus
ccaatagttcagacatcctacaggc

SEQ ID NO: 237152 - DNA, 25 bp, Mus musculus
ccaatataagtgaggtgttacatcc

SEQ ID NO: 237153 - DNA, 25 bp, Mus musculus
ccaatatcatggggggatatccctg

SEQ ID NO: 237154 - DNA, 25 bp, Mus musculus
ccaatatctgacctgtgctgagcct

SEQ ID NO: 237155 - DNA, 25 bp, Mus musculus
ccaatatgaatatgtatgtgttttt

SEQ ID NO: 237156 - DNA, 25 bp, Mus musculus
ccaatatgaatattagtgaacttat

SEQ ID NO: 237157 - DNA, 25 bp, Mus musculus
ccaatatgaatattgctggcctata

SEQ ID NO: 237158 - DNA, 25 bp, Mus musculus
ccaatattcacaggtattccttttt

SEQ ID NO: 237159 - DNA, 25 bp, Mus musculus
ccaatattccaaaggatggaggcca

SEQ ID NO: 237160 - DNA, 25 bp, Mus musculus
ccaatatttcagctaaactctgttc

SEQ ID NO: 237161 - DNA, 25 bp, Mus musculus
ccaatatttcaggtttcacagacat

SEQ ID NO: 237162 - DNA, 25 bp, Mus musculus
ccaatattttcgagcattactgtat

SEQ ID NO: 237163 - DNA, 25 bp, Mus musculus
ccaatcaaaactagttggacacccc

SEQ ID NO: 237164 - DNA, 25 bp, Mus musculus
ccaatcaaagcaagctcatgttggg

SEQ ID NO: 237165 - DNA, 25 bp, Mus musculus
ccaatcaaagctctgaccattcccg

SEQ ID NO: 237166 - DNA, 25 bp, Mus musculus
ccaatcaaccaacagcctcctggac

SEQ ID NO: 237167 - DNA, 25 bp, Mus musculus
ccaatcaattttcaggaatgggacg

SEQ ID NO: 237168 - DNA, 25 bp, Mus musculus
ccaatcaattttcaggtaataccag

SEQ ID NO: 237169 - DNA, 25 bp, Mus musculus
ccaatcagaatcacaaccagccaga

SEQ ID NO: 237170 - DNA, 25 bp, Mus musculus
ccaatcagagtgcggagatccaagg

SEQ ID NO: 237171 - DNA, 25 bp, Mus musculus
ccaatcagcaggcccgtcaagtcca

SEQ ID NO: 237172 - DNA, 25 bp, Mus musculus
ccaatcagcaggggctgctggggca

SEQ ID NO: 237173 - DNA, 25 bp, Mus musculus
ccaatcagcaggggtccttggactc

SEQ ID NO: 237174 - DNA, 25 bp, Mus musculus
ccaatcagcatagggatctgagaat

SEQ ID NO: 237175 - DNA, 25 bp, Mus musculus
ccaatcaggatgtgatcaaggcagt

SEQ ID NO: 237176 - DNA, 25 bp, Mus musculus
ccaatcattagcaatcgtggaacag

SEQ ID NO: 237177 - DNA, 25 bp, Mus musculus
ccaatcattagggagctgtccaggt

SEQ ID NO: 237178 - DNA, 25 bp, Mus musculus
ccaatccaatgaagccctcttatta

SEQ ID NO: 237179 - DNA, 25 bp, Mus musculus
ccaatccaatgaaggaaaaggtgcg

SEQ ID NO: 237180 - DNA, 25 bp, Mus musculus
ccaatccagcaggcatccagggcag

SEQ ID NO: 237181 - DNA, 25 bp, Mus musculus
ccaatcccactgatgacactttcat

SEQ ID NO: 237182 - DNA, 25 bp, Mus musculus
ccaatcccactgattttaggtgatg

SEQ ID NO: 237183 - DNA, 25 bp, Mus musculus
ccaatcccagtgactctggacgtgg

SEQ ID NO: 237184 - DNA, 25 bp, Mus musculus
ccaatcccttaccgcgtcgagcaga

SEQ ID NO: 237185 - DNA, 25 bp, Mus musculus
ccaatcccttccgggctgtggaagg

SEQ ID NO: 237186 - DNA, 25 bp, Mus musculus
ccaatcccttgctgatctgaataat

SEQ ID NO: 237187 - DNA, 25 bp, Mus musculus
ccaatcctgtcaggtgaaaatgctg

SEQ ID NO: 237188 - DNA, 25 bp, Mus musculus
ccaatccttctccagattatctgca

SEQ ID NO: 237189 - DNA, 25 bp, Mus musculus
ccaatcgatcgatcgagtcagtccg

SEQ ID NO: 237190 - DNA, 25 bp, Mus musculus
ccaatcgcaagacggtgcctctgga

SEQ ID NO: 237191 - DNA, 25 bp, Mus musculus
ccaatcgcaaggattcttcttctca

SEQ ID NO: 237192 - DNA, 25 bp, Mus musculus
ccaatcgccactgtgttcacacgag

SEQ ID NO: 237193 - DNA, 25 bp, Mus musculus
ccaatcggaagggtcctaaacaaga

SEQ ID NO: 237194 - DNA, 25 bp, Mus musculus
ccaatctactgacagttgtccgtgt

SEQ ID NO: 237195 - DNA, 25 bp, Mus musculus
ccaatctatcagggcgtctaagaag

SEQ ID NO: 237196 - DNA, 25 bp, Mus musculus
ccaatctatcagggtgaaggcggga

SEQ ID NO: 237197 - DNA, 25 bp, Mus musculus
ccaatctattaggcatcagaccatg

SEQ ID NO: 237198 - DNA, 25 bp, Mus musculus
ccaatctattagggaaagagatacc

SEQ ID NO: 237199 - DNA, 25 bp, Mus musculus
ccaatctcgcacaggacctaaagat

SEQ ID NO: 237200 - DNA, 25 bp, Mus musculus
ccaatctgcagcgagcctatagttt

SEQ ID NO: 237201 - DNA, 25 bp, Mus musculus
ccaatctgcagcgagtgcccttcgc

SEQ ID NO: 237202 - DNA, 25 bp, Mus musculus
ccaatctgcagcgagtttggccaag

SEQ ID NO: 237203 - DNA, 25 bp, Mus musculus
ccaatctgccaagagacaaacagaa

SEQ ID NO: 237204 - DNA, 25 bp, Mus musculus
ccaatctgccaagtggtccagtgtg

SEQ ID NO: 237205 - DNA, 25 bp, Mus musculus
ccaatctggggaactctgataagat

SEQ ID NO: 237206 - DNA, 25 bp, Mus musculus
ccaatcttgatcgcagtaagagaaa

SEQ ID NO: 237207 - DNA, 25 bp, Mus musculus
ccaatgaaaaaaggctctggaatgg

SEQ ID NO: 237208 - DNA, 25 bp, Mus musculus
ccaatgaaaacaggcccagaggaac

SEQ ID NO: 237209 - DNA, 25 bp, Mus musculus
ccaatgaaaacagggcacctccgtc

SEQ ID NO: 237210 - DNA, 25 bp, Mus musculus
ccaatgaaaacctggatctgatgga

SEQ ID NO: 237211 - DNA, 25 bp, Mus musculus
ccaatgaaaacctgtattttgagga

SEQ ID NO: 237212 - DNA, 25 bp, Mus musculus
ccaatgaaaagggtgccttctcagg

SEQ ID NO: 237213 - DNA, 25 bp, Mus musculus
ccaatgaaagctcaaaacattcaag

SEQ ID NO: 237214 - DNA, 25 bp, Mus musculus
ccaatgaaagctgacttaaaaacaa

SEQ ID NO: 237215 - DNA, 25 bp, Mus musculus
ccaatgaagacagttgattcaggag

SEQ ID NO: 237216 - DNA, 25 bp, Mus musculus
ccaatgaagaccctggtcttttgtg

SEQ ID NO: 237217 - DNA, 25 bp, Mus musculus
ccaatgaagatgaacagagcctccc

SEQ ID NO: 237218 - DNA, 25 bp, Mus musculus
ccaatgaagctctgatgcgctctga

SEQ ID NO: 237219 - DNA, 25 bp, Mus musculus
ccaatgaaggagatgacaaatctag

SEQ ID NO: 237220 - DNA, 25 bp, Mus musculus
ccaatgaaggagctgaaaggcctaa

SEQ ID NO: 237221 - DNA, 25 bp, Mus musculus
ccaatgaaggaggaatgtcaagtga

SEQ ID NO: 237222 - DNA, 25 bp, Mus musculus
ccaatgaaggaggtgactccaatga

SEQ ID NO: 237223 - DNA, 25 bp, Mus musculus
ccaatgaatccccagcttcacacca

SEQ ID NO: 237224 - DNA, 25 bp, Mus musculus
ccaatgacacagaggggctggctgt

SEQ ID NO: 237225 - DNA, 25 bp, Mus musculus
ccaatgacacagaggtggcggagaa

SEQ ID NO: 237226 - DNA, 25 bp, Mus musculus
ccaatgacaggttcattttgctggc

SEQ ID NO: 237227 - DNA, 25 bp, Mus musculus
ccaatgacccctatcctctctttgt

SEQ ID NO: 237228 - DNA, 25 bp, Mus musculus
ccaatgacctaggaaggcccagccc

SEQ ID NO: 237229 - DNA, 25 bp, Mus musculus
ccaatgagaagatgagctcagcagt

SEQ ID NO: 237230 - DNA, 25 bp, Mus musculus
ccaatgagaagatgagtcgggatat

SEQ ID NO: 237231 - DNA, 25 bp, Mus musculus
ccaatgagagaggacacaatgtagg

SEQ ID NO: 237232 - DNA, 25 bp, Mus musculus
ccaatgcagagaccgctacatcaga

SEQ ID NO: 237233 - DNA, 25 bp, Mus musculus
ccaatgccaacgccacgccttctct

SEQ ID NO: 237234 - DNA, 25 bp, Mus musculus
ccaatgcgaacgacttcttcgccaa

SEQ ID NO: 237235 - DNA, 25 bp, Mus musculus
ccaatgcgatgcaaatcctctgggc

SEQ ID NO: 237236 - DNA, 25 bp, Mus musculus
ccaatgcgatgctttggctcagctt

SEQ ID NO: 237237 - DNA, 25 bp, Mus musculus
ccaatgctaatgccagtgactcaga

SEQ ID NO: 237238 - DNA, 25 bp, Mus musculus
ccaatgctcggtccgcggaggggct

SEQ ID NO: 237239 - DNA, 25 bp, Mus musculus
ccaatgctctccctctagagtgcag

SEQ ID NO: 237240 - DNA, 25 bp, Mus musculus
ccaatgctgagagcaactgtgggtt

SEQ ID NO: 237241 - DNA, 25 bp, Mus musculus
ccaatgctgaggatgcccaagaatt

SEQ ID NO: 237242 - DNA, 25 bp, Mus musculus
ccaatgctttcatcggctcggatgt

SEQ ID NO: 237243 - DNA, 25 bp, Mus musculus
ccaatggaagcagaaaattgtgcaa

SEQ ID NO: 237244 - DNA, 25 bp, Mus musculus
ccaatggaggaggtgactccaatga

SEQ ID NO: 237245 - DNA, 25 bp, Mus musculus
ccaatggatgaccagttggcaaagc

SEQ ID NO: 237246 - DNA, 25 bp, Mus musculus
ccaatggatttagaggaggatatga

SEQ ID NO: 237247 - DNA, 25 bp, Mus musculus
ccaatggccaaatcaaagaaatcgg

SEQ ID NO: 237248 - DNA, 25 bp, Mus musculus
ccaatggccagcaggctccagccca

SEQ ID NO: 237249 - DNA, 25 bp, Mus musculus
ccaatggccagcaggtgcttgtgtg

SEQ ID NO: 237250 - DNA, 25 bp, Mus musculus
ccaatggcctgatcacaactggcta

SEQ ID NO: 237251 - DNA, 25 bp, Mus musculus
ccaatggctacatttgtcctctcta

SEQ ID NO: 237252 - DNA, 25 bp, Mus musculus
ccaatgggacaaatgcctggaatga

SEQ ID NO: 237253 - DNA, 25 bp, Mus musculus
ccaatgggagaaaggggcgctcctg

SEQ ID NO: 237254 - DNA, 25 bp, Mus musculus
ccaatggggaaggtctaaatgccat

SEQ ID NO: 237255 - DNA, 25 bp, Mus musculus
ccaatggggctcctcctccaggcat

SEQ ID NO: 237256 - DNA, 25 bp, Mus musculus
ccaatggggtacagggtgaagtact

SEQ ID NO: 237257 - DNA, 25 bp, Mus musculus
ccaatggtcctgagctgtttggggc

SEQ ID NO: 237258 - DNA, 25 bp, Mus musculus
ccaatggttgacaggcaataccctt

SEQ ID NO: 237259 - DNA, 25 bp, Mus musculus
ccaatggttggctcaacttgatttc

SEQ ID NO: 237260 - DNA, 25 bp, Mus musculus
ccaatgtagccaacccttcactgaa

SEQ ID NO: 237261 - DNA, 25 bp, Mus musculus
ccaatgtatctggtgaccacattag

SEQ ID NO: 237262 - DNA, 25 bp, Mus musculus
ccaatgtatgcagggacgcatcgtt

SEQ ID NO: 237263 - DNA, 25 bp, Mus musculus
ccaatgtcaaatgtgactatgacaa

SEQ ID NO: 237264 - DNA, 25 bp, Mus musculus
ccaatgtcaggttgaaaactgtaag

SEQ ID NO: 237265 - DNA, 25 bp, Mus musculus
ccaatgtcagtgtgcgggatgacag

SEQ ID NO: 237266 - DNA, 25 bp, Mus musculus
ccaatgtcccatcaccatctcagtg

SEQ ID NO: 237267 - DNA, 25 bp, Mus musculus
ccaatgtcctgatttcagagtgggt

SEQ ID NO: 237268 - DNA, 25 bp, Mus musculus
ccaatgtctttgcaccctgtgacct

SEQ ID NO: 237269 - DNA, 25 bp, Mus musculus
ccaatgtgaagatatcaatgaatgc

SEQ ID NO: 237270 - DNA, 25 bp, Mus musculus
ccaatgtgaagatattgatgaatgc

SEQ ID NO: 237271 - DNA, 25 bp, Mus musculus
ccaatgtgaaggctccagcctggca

SEQ ID NO: 237272 - DNA, 25 bp, Mus musculus
ccaatgtgagatctggcgggagctc

SEQ ID NO: 237273 - DNA, 25 bp, Mus musculus
ccaatgtgagcacacagcatgtact

SEQ ID NO: 237274 - DNA, 25 bp, Mus musculus
ccaatgtgcttacatgcatgtgtaa

SEQ ID NO: 237275 - DNA, 25 bp, Mus musculus
ccaatgtgcttacgagtctactgtg

SEQ ID NO: 237276 - DNA, 25 bp, Mus musculus
ccaatgtggacaaggtattctttga

SEQ ID NO: 237277 - DNA, 25 bp, Mus musculus
ccaatgtggacaaggtcattgtgct

SEQ ID NO: 237278 - DNA, 25 bp, Mus musculus
ccaatgtggctagctataaaaccat

SEQ ID NO: 237279 - DNA, 25 bp, Mus musculus
ccaatgtgtcacccattctaacggc

SEQ ID NO: 237280 - DNA, 25 bp, Mus musculus
ccaatgtgtccgacttcccggagag

SEQ ID NO: 237281 - DNA, 25 bp, Mus musculus
ccaatgttgtacggctgatggatgt

SEQ ID NO: 237282 - DNA, 25 bp, Mus musculus
ccaatgttgtacggtggttacgctc

SEQ ID NO: 237283 - DNA, 25 bp, Mus musculus
ccaatgttgtgaagaacttcaagtt

SEQ ID NO: 237284 - DNA, 25 bp, Mus musculus
ccaatgttgtgaagctcttcaatga

SEQ ID NO: 237285 - DNA, 25 bp, Mus musculus
ccaattacataagcccatggatggg

SEQ ID NO: 237286 - DNA, 25 bp, Mus musculus
ccaattactgagcaaattgctgtta

SEQ ID NO: 237287 - DNA, 25 bp, Mus musculus
ccaattatacaactgctgacaagta

SEQ ID NO: 237288 - DNA, 25 bp, Mus musculus
ccaattcaggaagcacagaccaagc

SEQ ID NO: 237289 - DNA, 25 bp, Mus musculus
ccaattccatgccgggttgcttcct

SEQ ID NO: 237290 - DNA, 25 bp, Mus musculus
ccaattcccttggatttcagttttt

SEQ ID NO: 237291 - DNA, 25 bp, Mus musculus
ccaattcctccaggtcatcgtcacg

SEQ ID NO: 237292 - DNA, 25 bp, Mus musculus
ccaattcctcccctggctagagcat

SEQ ID NO: 237293 - DNA, 25 bp, Mus musculus
ccaattccttggaggactcaaggaa

SEQ ID NO: 237294 - DNA, 25 bp, Mus musculus
ccaattccttggaggttcattctgt

SEQ ID NO: 237295 - DNA, 25 bp, Mus musculus
ccaattcgagaagtcaaccatccaa

SEQ ID NO: 237296 - DNA, 25 bp, Mus musculus
ccaattctaggatgtggttagaacc

SEQ ID NO: 237297 - DNA, 25 bp, Mus musculus
ccaattctataggtcctgagggagg

SEQ ID NO: 237298 - DNA, 25 bp, Mus musculus
ccaattctggaccaccaaggccttt

SEQ ID NO: 237299 - DNA, 25 bp, Mus musculus
ccaattctggcaggaagcagtgaag

SEQ ID NO: 237300 - DNA, 25 bp, Mus musculus
ccaattctggcaggacatgaagcta

SEQ ID NO: 237301 - DNA, 25 bp, Mus musculus
ccaattctggcaggtagtgctgccc

SEQ ID NO: 237302 - DNA, 25 bp, Mus musculus
ccaattctgggacactcactcttac

SEQ ID NO: 237303 - DNA, 25 bp, Mus musculus
ccaattgatcatgggccctggggag

SEQ ID NO: 237304 - DNA, 25 bp, Mus musculus
ccaattgcccaagaacaaacctgtg

SEQ ID NO: 237305 - DNA, 25 bp, Mus musculus
ccaattgcccaagagttaaccagct

SEQ ID NO: 237306 - DNA, 25 bp, Mus musculus
ccaattgcccaaggtaataatcttc

SEQ ID NO: 237307 - DNA, 25 bp, Mus musculus
ccaattgcctgtgatggtgtggatc

SEQ ID NO: 237308 - DNA, 25 bp, Mus musculus
ccaattgtcttgcttcattaaaaaa

SEQ ID NO: 237309 - DNA, 25 bp, Mus musculus
ccaattgtcttgcttcattaacaat

SEQ ID NO: 237310 - DNA, 25 bp, Mus musculus
ccaatttaagctccagctccagatg

SEQ ID NO: 237311 - DNA, 25 bp, Mus musculus
ccaatttcaggctcacccatgacat

SEQ ID NO: 237312 - DNA, 25 bp, Mus musculus
ccaatttgaaattgcagactgtgct

SEQ ID NO: 237313 - DNA, 25 bp, Mus musculus
ccaatttgggcaccctaagatgagt

SEQ ID NO: 237314 - DNA, 25 bp, Mus musculus
ccaatttgggcactgcagcctgtca

SEQ ID NO: 237315 - DNA, 25 bp, Mus musculus
ccaattttaatgaatgcagctgcct

SEQ ID NO: 237316 - DNA, 25 bp, Mus musculus
ccaatttttgtagtgccaggacata

SEQ ID NO: 237317 - DNA, 25 bp, Mus musculus
ccacaaaaagaaagactgccctccc

SEQ ID NO: 237318 - DNA, 25 bp, Mus musculus
ccacaaaaagccagcaccaagtgat

SEQ ID NO: 237319 - DNA, 25 bp, Mus musculus
ccacaaaaagccagggatggctgtg

SEQ ID NO: 237320 - DNA, 25 bp, Mus musculus
ccacaaaagcagctatgccccctca

SEQ ID NO: 237321 - DNA, 25 bp, Mus musculus
ccacaaaagggacaggttttcctag

SEQ ID NO: 237322 - DNA, 25 bp, Mus musculus
ccacaaaagggacagtgatggatgt

SEQ ID NO: 237323 - DNA, 25 bp, Mus musculus
ccacaaacaaaagtgtttacaattg

SEQ ID NO: 237324 - DNA, 25 bp, Mus musculus
ccacaaacaggtcagcccttcttaa

SEQ ID NO: 237325 - DNA, 25 bp, Mus musculus
ccacaaacgaagacatcaaaggctc

SEQ ID NO: 237326 - DNA, 25 bp, Mus musculus
ccacaaacgtgcagttcagtcccaa

SEQ ID NO: 237327 - DNA, 25 bp, Mus musculus
ccacaaacgtggtgaatacatcaag

SEQ ID NO: 237328 - DNA, 25 bp, Mus musculus
ccacaaagaagacagccaaggacac

SEQ ID NO: 237329 - DNA, 25 bp, Mus musculus
ccacaaagactgcagcaaatgaagc

SEQ ID NO: 237330 - DNA, 25 bp, Mus musculus
ccacaaagagcgcctggccatcgcc

SEQ ID NO: 237331 - DNA, 25 bp, Mus musculus
ccacaaagaggaaatgcaggctctg

SEQ ID NO: 237332 - DNA, 25 bp, Mus musculus
ccacaaagccctcaagaaactccgg

SEQ ID NO: 237333 - DNA, 25 bp, Mus musculus
ccacaaaggtagctacttggtgagt

SEQ ID NO: 237334 - DNA, 25 bp, Mus musculus
ccacaaagtcaaaggtggcagggct

SEQ ID NO: 237335 - DNA, 25 bp, Mus musculus
ccacaaagtcaaggctctacccctg

SEQ ID NO: 237336 - DNA, 25 bp, Mus musculus
ccacaaagtgaatgtactctattct

SEQ ID NO: 237337 - DNA, 25 bp, Mus musculus
ccacaaatgaaggagcccattgaag

SEQ ID NO: 237338 - DNA, 25 bp, Mus musculus
ccacaaattatgtgagtgactggtg

SEQ ID NO: 237339 - DNA, 25 bp, Mus musculus
ccacaacacaacaatcttgggatac

SEQ ID NO: 237340 - DNA, 25 bp, Mus musculus
ccacaacaccaaactttaagaagct

SEQ ID NO: 237341 - DNA, 25 bp, Mus musculus
ccacaacagacaaaaattaactgaa

SEQ ID NO: 237342 - DNA, 25 bp, Mus musculus
ccacaacagacaaaagccaaccata

SEQ ID NO: 237343 - DNA, 25 bp, Mus musculus
ccacaacatcacagagtcccaccca

SEQ ID NO: 237344 - DNA, 25 bp, Mus musculus
ccacaacatctgggacaagctggat

SEQ ID NO: 237345 - DNA, 25 bp, Mus musculus
ccacaaccaagaaaggggagatctt

SEQ ID NO: 237346 - DNA, 25 bp, Mus musculus
ccacaaccaagaaagtgctctcttc

SEQ ID NO: 237347 - DNA, 25 bp, Mus musculus
ccacaaccacagactggaaccagcc

SEQ ID NO: 237348 - DNA, 25 bp, Mus musculus
ccacaaccacctggcgctggttacc

SEQ ID NO: 237349 - DNA, 25 bp, Mus musculus
ccacaaccagaaaagccagctcata

SEQ ID NO: 237350 - DNA, 25 bp, Mus musculus
ccacaaccagccctcagcggcatcc

SEQ ID NO: 237351 - DNA, 25 bp, Mus musculus
ccacaaccagctaaagaacgcttct

SEQ ID NO: 237352 - DNA, 25 bp, Mus musculus
ccacaaccaggctcccaccacctcc

SEQ ID NO: 237353 - DNA, 25 bp, Mus musculus
ccacaacccagccaccaatgaagtt

SEQ ID NO: 237354 - DNA, 25 bp, Mus musculus
ccacaaccgcggaagaaaacggctc

SEQ ID NO: 237355 - DNA, 25 bp, Mus musculus
ccacaacctcaacgtcatcctggcc

SEQ ID NO: 237356 - DNA, 25 bp, Mus musculus
ccacaacctccgcaagaatggaatc

SEQ ID NO: 237357 - DNA, 25 bp, Mus musculus
ccacaacgctgcttctgaaccagct

SEQ ID NO: 237358 - DNA, 25 bp, Mus musculus
ccacaacgttcacccggccacacag

SEQ ID NO: 237359 - DNA, 25 bp, Mus musculus
ccacaactcatcagtctgtatatct

SEQ ID NO: 237360 - DNA, 25 bp, Mus musculus
ccacaactgaccaggacaagagtga

SEQ ID NO: 237361 - DNA, 25 bp, Mus musculus
ccacaactgcaggctgtttggtctc

SEQ ID NO: 237362 - DNA, 25 bp, Mus musculus
ccacaagaagacccactccgaggag

SEQ ID NO: 237363 - DNA, 25 bp, Mus musculus
ccacaagaaggttgtggatcattat

SEQ ID NO: 237364 - DNA, 25 bp, Mus musculus
ccacaagagggagatccacttaaat

SEQ ID NO: 237365 - DNA, 25 bp, Mus musculus
ccacaagatatgtgagatagatgga

SEQ ID NO: 237366 - DNA, 25 bp, Mus musculus
ccacaagatattggttctgaagact

SEQ ID NO: 237367 - DNA, 25 bp, Mus musculus
ccacaagatccagtccccgctgctg

SEQ ID NO: 237368 - DNA, 25 bp, Mus musculus
ccacaagatccatctaaatgggtac

SEQ ID NO: 237369 - DNA, 25 bp, Mus musculus
ccacaagccaagaaagctcgcttat

SEQ ID NO: 237370 - DNA, 25 bp, Mus musculus
ccacaagccaaggacctctaatttc

SEQ ID NO: 237371 - DNA, 25 bp, Mus musculus
ccacaagccactgacgtggacgaca

SEQ ID NO: 237372 - DNA, 25 bp, Mus musculus
ccacaagcctgaaatcaactccacc

SEQ ID NO: 237373 - DNA, 25 bp, Mus musculus
ccacaagcctgagccaggagggccg

SEQ ID NO: 237374 - DNA, 25 bp, Mus musculus
ccacaagcctgtcgcacgagtctga

SEQ ID NO: 237375 - DNA, 25 bp, Mus musculus
ccacaagcctgtcggggtgaatcgg

SEQ ID NO: 237376 - DNA, 25 bp, Mus musculus
ccacaagcgagctaatgtctgcgac

SEQ ID NO: 237377 - DNA, 25 bp, Mus musculus
ccacaagcgctgagtgaaaatgtgc

SEQ ID NO: 237378 - DNA, 25 bp, Mus musculus
ccacaagctgaccaaagcggagaag

SEQ ID NO: 237379 - DNA, 25 bp, Mus musculus
ccacaagctgaccaagttacagtcc

SEQ ID NO: 237380 - DNA, 25 bp, Mus musculus
ccacaaggagagaactgcccagcaa

SEQ ID NO: 237381 - DNA, 25 bp, Mus musculus
ccacaaggagccagaactacagctc

SEQ ID NO: 237382 - DNA, 25 bp, Mus musculus
ccacaaggataggtcatgctgtgaa

SEQ ID NO: 237383 - DNA, 25 bp, Mus musculus
ccacaaggcgctacagcaacgtttt

SEQ ID NO: 237384 - DNA, 25 bp, Mus musculus
ccacaaggctcagacagcagtgaca

SEQ ID NO: 237385 - DNA, 25 bp, Mus musculus
ccacaagtacaacatcttgattgcc

SEQ ID NO: 237386 - DNA, 25 bp, Mus musculus
ccacaagtgcgaggactgcgggaag

SEQ ID NO: 237387 - DNA, 25 bp, Mus musculus
ccacaagtgttcaagccgccccacg

SEQ ID NO: 237388 - DNA, 25 bp, Mus musculus
ccacaagtgttcaaggtagccattg

SEQ ID NO: 237389 - DNA, 25 bp, Mus musculus
ccacaatcaataggtttccaggcaa

SEQ ID NO: 237390 - DNA, 25 bp, Mus musculus
ccacaatctgcatgttaacaagcct

SEQ ID NO: 237391 - DNA, 25 bp, Mus musculus
ccacaatgattcggcagacgggcct

SEQ ID NO: 237392 - DNA, 25 bp, Mus musculus
ccacaatgctgagagttgaaaaaca

SEQ ID NO: 237393 - DNA, 25 bp, Mus musculus
ccacaatggtatcgggctagccaac

SEQ ID NO: 237394 - DNA, 25 bp, Mus musculus
ccacaattatgcctctgatgaagaa

SEQ ID NO: 237395 - DNA, 25 bp, Mus musculus
ccacaattatggaatccccctacgt

SEQ ID NO: 237396 - DNA, 25 bp, Mus musculus
ccacaattttcaggatgacgatcag

SEQ ID NO: 237397 - DNA, 25 bp, Mus musculus
ccacacaatcaattgaaatcaagca

SEQ ID NO: 237398 - DNA, 25 bp, Mus musculus
ccacacaatggcctccccttgctct

SEQ ID NO: 237399 - DNA, 25 bp, Mus musculus
ccacacacacactgcaagaacagaa

SEQ ID NO: 237400 - DNA, 25 bp, Mus musculus
ccacacacccaaagagggctgtgac

SEQ ID NO: 237401 - DNA, 25 bp, Mus musculus
ccacacactgcgctaccctgtgaag

SEQ ID NO: 237402 - DNA, 25 bp, Mus musculus
ccacacactgttcagacggctccat

SEQ ID NO: 237403 - DNA, 25 bp, Mus musculus
ccacacagagacttgaaaatcgaac

SEQ ID NO: 237404 - DNA, 25 bp, Mus musculus
ccacacagagtttatggttcactta

SEQ ID NO: 237405 - DNA, 25 bp, Mus musculus
ccacacagcaatgtttgcagagaca

SEQ ID NO: 237406 - DNA, 25 bp, Mus musculus
ccacacagcacaggtgtaacgagta

SEQ ID NO: 237407 - DNA, 25 bp, Mus musculus
ccacacagcaggaggtcccaggtaa

SEQ ID NO: 237408 - DNA, 25 bp, Mus musculus
ccacacagcggggagaaggttgcta

SEQ ID NO: 237409 - DNA, 25 bp, Mus musculus
ccacacagcggtcgctatgcatttc

SEQ ID NO: 237410 - DNA, 25 bp, Mus musculus
ccacacaggacgggccaaaagatgc

SEQ ID NO: 237411 - DNA, 25 bp, Mus musculus
ccacacaggacggtgtctttattgc

SEQ ID NO: 237412 - DNA, 25 bp, Mus musculus
ccacacagtcaagggatgaactgtg

SEQ ID NO: 237413 - DNA, 25 bp, Mus musculus
ccacacagtggaggattaccaggca

SEQ ID NO: 237414 - DNA, 25 bp, Mus musculus
ccacacatatgacgttcagaaactt

SEQ ID NO: 237415 - DNA, 25 bp, Mus musculus
ccacacatgatcggaacaccatgga

SEQ ID NO: 237416 - DNA, 25 bp, Mus musculus
ccacacatggaagcatggaatcaga

SEQ ID NO: 237417 - DNA, 25 bp, Mus musculus
ccacacatggaaggaaaggacttca

SEQ ID NO: 237418 - DNA, 25 bp, Mus musculus
ccacaccaaggtgttcttcaaggcg

SEQ ID NO: 237419 - DNA, 25 bp, Mus musculus
ccacaccacccagactatgaaatcc

SEQ ID NO: 237420 - DNA, 25 bp, Mus musculus
ccacaccactggtgatccagcagcc

SEQ ID NO: 237421 - DNA, 25 bp, Mus musculus
ccacaccaggatgcaggcagcctct

SEQ ID NO: 237422 - DNA, 25 bp, Mus musculus
ccacacccaaggaggccaaaaaagt

SEQ ID NO: 237423 - DNA, 25 bp, Mus musculus
ccacacccaaggagggtcaaaaggc

SEQ ID NO: 237424 - DNA, 25 bp, Mus musculus
ccacacccaatgaacttgtttttaa

SEQ ID NO: 237425 - DNA, 25 bp, Mus musculus
ccacacccacagggctgtcccccag

SEQ ID NO: 237426 - DNA, 25 bp, Mus musculus
ccacacccaccaccccagtctacct

SEQ ID NO: 237427 - DNA, 25 bp, Mus musculus
ccacacccagatgaagttgctgccc

SEQ ID NO: 237428 - DNA, 25 bp, Mus musculus
ccacacccagcacaggtccctgtgg

SEQ ID NO: 237429 - DNA, 25 bp, Mus musculus
ccacacccagcccaggtccctgtgg

SEQ ID NO: 237430 - DNA, 25 bp, Mus musculus
ccacacccaggagcatgttaatgaa

SEQ ID NO: 237431 - DNA, 25 bp, Mus musculus
ccacacccaggttctgattggaacg

SEQ ID NO: 237432 - DNA, 25 bp, Mus musculus
ccacaccccaggaagtcagaggcaa

SEQ ID NO: 237433 - DNA, 25 bp, Mus musculus
ccacaccctacagaggaggaacctg

SEQ ID NO: 237434 - DNA, 25 bp, Mus musculus
ccacaccctacaggcaagattgaga

SEQ ID NO: 237435 - DNA, 25 bp, Mus musculus
ccacaccctgttcttgcttcagcat

SEQ ID NO: 237436 - DNA, 25 bp, Mus musculus
ccacaccggacggtgggattgtgct

SEQ ID NO: 237437 - DNA, 25 bp, Mus musculus
ccacaccggacgtgggaagctgctg

SEQ ID NO: 237438 - DNA, 25 bp, Mus musculus
ccacaccgggacaaccatcatggca

SEQ ID NO: 237439 - DNA, 25 bp, Mus musculus
ccacacctcagcagggacctcttgt

SEQ ID NO: 237440 - DNA, 25 bp, Mus musculus
ccacacctcatgccgagcaactgtg

SEQ ID NO: 237441 - DNA, 25 bp, Mus musculus
ccacacctctctctcaggagtgaag

SEQ ID NO: 237442 - DNA, 25 bp, Mus musculus
ccacacctctttaaggcgtaccttc

SEQ ID NO: 237443 - DNA, 25 bp, Mus musculus
ccacacctctttaagtatgcagcag

SEQ ID NO: 237444 - DNA, 25 bp, Mus musculus
ccacacctggatggatgctgcaagc

SEQ ID NO: 237445 - DNA, 25 bp, Mus musculus
ccacacctggatggggttcatgttg

SEQ ID NO: 237446 - DNA, 25 bp, Mus musculus
ccacacgctacttagccccaaccat

SEQ ID NO: 237447 - DNA, 25 bp, Mus musculus
ccacacgctacttaggtgatgcaag

SEQ ID NO: 237448 - DNA, 25 bp, Mus musculus
ccacacggacagcgcgctttggatc

SEQ ID NO: 237449 - DNA, 25 bp, Mus musculus
ccacacggacagcggcacagccgag

SEQ ID NO: 237450 - DNA, 25 bp, Mus musculus
ccacacggatatggaagagggattt

SEQ ID NO: 237451 - DNA, 25 bp, Mus musculus
ccacacggcttcagaaaagaagttg

SEQ ID NO: 237452 - DNA, 25 bp, Mus musculus
ccacacggcttcagaaggaagaggc

SEQ ID NO: 237453 - DNA, 25 bp, Mus musculus
ccacacggcttcagtctttgcagtt

SEQ ID NO: 237454 - DNA, 25 bp, Mus musculus
ccacacgtgaccagtatggcaagaa

SEQ ID NO: 237455 - DNA, 25 bp, Mus musculus
ccacacgtgccaaaatatctactag

SEQ ID NO: 237456 - DNA, 25 bp, Mus musculus
ccacacgtttgccgctcctgagaaa

SEQ ID NO: 237457 - DNA, 25 bp, Mus musculus
ccacactacaggctccttcctgaca

SEQ ID NO: 237458 - DNA, 25 bp, Mus musculus
ccacactacaggtctgtaactggtt

SEQ ID NO: 237459 - DNA, 25 bp, Mus musculus
ccacactcaccaggcacttgtggaa

SEQ ID NO: 237460 - DNA, 25 bp, Mus musculus
ccacactcagggcaggaggacctgt

SEQ ID NO: 237461 - DNA, 25 bp, Mus musculus
ccacactcagggcgcttattcggcc

SEQ ID NO: 237462 - DNA, 25 bp, Mus musculus
ccacactcgctggagctggtggaga

SEQ ID NO: 237463 - DNA, 25 bp, Mus musculus
ccacactctctcaaattgcctatca

SEQ ID NO: 237464 - DNA, 25 bp, Mus musculus
ccacactctgacagattcacctgca

SEQ ID NO: 237465 - DNA, 25 bp, Mus musculus
ccacactctgacagtgagggtgcgg

SEQ ID NO: 237466 - DNA, 25 bp, Mus musculus
ccacactctggtacatccaaacgaa

SEQ ID NO: 237467 - DNA, 25 bp, Mus musculus
ccacactgacacaatatggagtctg

SEQ ID NO: 237468 - DNA, 25 bp, Mus musculus
ccacactgaggtgcactggcacgag

SEQ ID NO: 237469 - DNA, 25 bp, Mus musculus
ccacactgcccaagtgggctcaccc

SEQ ID NO: 237470 - DNA, 25 bp, Mus musculus
ccacactgctatcatccagcaggtg

SEQ ID NO: 237471 - DNA, 25 bp, Mus musculus
ccacactggaaagggcagcctcttt

SEQ ID NO: 237472 - DNA, 25 bp, Mus musculus
ccacactggcagccaccaccaaggg

SEQ ID NO: 237473 - DNA, 25 bp, Mus musculus
ccacactggccgccactgggaagcc

SEQ ID NO: 237474 - DNA, 25 bp, Mus musculus
ccacactggggtagcctttgtgaaa

SEQ ID NO: 237475 - DNA, 25 bp, Mus musculus
ccacactggtgcagaagagaagagc

SEQ ID NO: 237476 - DNA, 25 bp, Mus musculus
ccacactgtctgaactcacgctcgc

SEQ ID NO: 237477 - DNA, 25 bp, Mus musculus
ccacactgtgggaggaccatccttg

SEQ ID NO: 237478 - DNA, 25 bp, Mus musculus
ccacacttaggcatcctacatcaat

SEQ ID NO: 237479 - DNA, 25 bp, Mus musculus
ccacacttcacaaggatggaataga

SEQ ID NO: 237480 - DNA, 25 bp, Mus musculus
ccacacttcgtcctggatcttcctg

SEQ ID NO: 237481 - DNA, 25 bp, Mus musculus
ccacacttcgtcctgtcagtggtgc

SEQ ID NO: 237482 - DNA, 25 bp, Mus musculus
ccacacttcttcctgccttaaccat

SEQ ID NO: 237483 - DNA, 25 bp, Mus musculus
ccacacttggaggtgaaatcgccct

SEQ ID NO: 237484 - DNA, 25 bp, Mus musculus
ccacacttgtttgatttatgaggaa

SEQ ID NO: 237485 - DNA, 25 bp, Mus musculus
ccacacttgtttgcgtttcccaaca

SEQ ID NO: 237486 - DNA, 25 bp, Mus musculus
ccacagaaaacaaagtggagcgacc

SEQ ID NO: 237487 - DNA, 25 bp, Mus musculus
ccacagaaatgctgcacaatgtcac

SEQ ID NO: 237488 - DNA, 25 bp, Mus musculus
ccacagaacacggaatgacaaggtc

SEQ ID NO: 237489 - DNA, 25 bp, Mus musculus
ccacagaacacgtgaaagcagagcc

SEQ ID NO: 237490 - DNA, 25 bp, Mus musculus
ccacagaacagagggggaagaaacc

SEQ ID NO: 237491 - DNA, 25 bp, Mus musculus
ccacagaacgagagcgccatctgtc

SEQ ID NO: 237492 - DNA, 25 bp, Mus musculus
ccacagaagaggccagatatcacag

SEQ ID NO: 237493 - DNA, 25 bp, Mus musculus
ccacagaagcagtgagtacaacaca

SEQ ID NO: 237494 - DNA, 25 bp, Mus musculus
ccacagaagcagtggtatttatgag

SEQ ID NO: 237495 - DNA, 25 bp, Mus musculus
ccacagacaaacttgggttctatgg

SEQ ID NO: 237496 - DNA, 25 bp, Mus musculus
ccacagacaaggccaacatcaaaga

SEQ ID NO: 237497 - DNA, 25 bp, Mus musculus
ccacagacaatcctatggtctttgc

SEQ ID NO: 237498 - DNA, 25 bp, Mus musculus
ccacagacagatgccctttgaagcg

SEQ ID NO: 237499 - DNA, 25 bp, Mus musculus
ccacagacagcaaggcaaagatgca

SEQ ID NO: 237500 - DNA, 25 bp, Mus musculus
ccacagacagggccactgccggtgg

SEQ ID NO: 237501 - DNA, 25 bp, Mus musculus
ccacagacaggtggtggctggcctg

SEQ ID NO: 237502 - DNA, 25 bp, Mus musculus
ccacagactgcagttttcagatatg

SEQ ID NO: 237503 - DNA, 25 bp, Mus musculus
ccacagagactaaggcaattccagt

SEQ ID NO: 237504 - DNA, 25 bp, Mus musculus
ccacagagactaaggctgtgaaaac

SEQ ID NO: 237505 - DNA, 25 bp, Mus musculus
ccacagagagcaaggtcgccgctga

SEQ ID NO: 237506 - DNA, 25 bp, Mus musculus
ccacagagagttctccagatttgga

SEQ ID NO: 237507 - DNA, 25 bp, Mus musculus
ccacagagatccactgaggcttttc

SEQ ID NO: 237508 - DNA, 25 bp, Mus musculus
ccacagagcaagaaggagagcgtgg

SEQ ID NO: 237509 - DNA, 25 bp, Mus musculus
ccacagagccagaagaccagtgaag

SEQ ID NO: 237510 - DNA, 25 bp, Mus musculus
ccacagagccatcaggtcctaatca

SEQ ID NO: 237511 - DNA, 25 bp, Mus musculus
ccacagagctgacccaagccatttt

SEQ ID NO: 237512 - DNA, 25 bp, Mus musculus
ccacagagtccaccgatttactaaa

SEQ ID NO: 237513 - DNA, 25 bp, Mus musculus
ccacagagtccaccgttatatttca

SEQ ID NO: 237514 - DNA, 25 bp, Mus musculus
ccacagagtgagagaatagaacccc

SEQ ID NO: 237515 - DNA, 25 bp, Mus musculus
ccacagagtgagttactagagcccg

SEQ ID NO: 237516 - DNA, 25 bp, Mus musculus
ccacagataacccaaggtggctgga

SEQ ID NO: 237517 - DNA, 25 bp, Mus musculus
ccacagataacccagaggatcacct

SEQ ID NO: 237518 - DNA, 25 bp, Mus musculus
ccacagataacccagtatcagtact

SEQ ID NO: 237519 - DNA, 25 bp, Mus musculus
ccacagatcccagccctgtccctag

SEQ ID NO: 237520 - DNA, 25 bp, Mus musculus
ccacagatgaagagcaagtacagaa

SEQ ID NO: 237521 - DNA, 25 bp, Mus musculus
ccacagatgaagatcttcaggattt

SEQ ID NO: 237522 - DNA, 25 bp, Mus musculus
ccacagatttattctgtgatgagga

SEQ ID NO: 237523 - DNA, 25 bp, Mus musculus
ccacagatttcacctgggccactgg

SEQ ID NO: 237524 - DNA, 25 bp, Mus musculus
ccacagcaacagccttctacttcta

SEQ ID NO: 237525 - DNA, 25 bp, Mus musculus
ccacagcacatttggtcagaaaaca

SEQ ID NO: 237526 - DNA, 25 bp, Mus musculus
ccacagcaccaagatatcattaatg

SEQ ID NO: 237527 - DNA, 25 bp, Mus musculus
ccacagcacccaccatcccctgccc

SEQ ID NO: 237528 - DNA, 25 bp, Mus musculus
ccacagcacccagcatgaggagctg

SEQ ID NO: 237529 - DNA, 25 bp, Mus musculus
ccacagcacgccactggcagatcct

SEQ ID NO: 237530 - DNA, 25 bp, Mus musculus
ccacagcacggagctcgaagacgat

SEQ ID NO: 237531 - DNA, 25 bp, Mus musculus
ccacagcagaaagctggtttattgc

SEQ ID NO: 237532 - DNA, 25 bp, Mus musculus
ccacagcagcagcgcaacgaagttc

SEQ ID NO: 237533 - DNA, 25 bp, Mus musculus
ccacagcagctgctgaccacactgg

SEQ ID NO: 237534 - DNA, 25 bp, Mus musculus
ccacagcagctgctggcaggctgca

SEQ ID NO: 237535 - DNA, 25 bp, Mus musculus
ccacagcaggctacagtcagttcta

SEQ ID NO: 237536 - DNA, 25 bp, Mus musculus
ccacagcaggctacagtgacttttt

SEQ ID NO: 237537 - DNA, 25 bp, Mus musculus
ccacagcagtccaagaaaacatcgc

SEQ ID NO: 237538 - DNA, 25 bp, Mus musculus
ccacagcagtccaagatctgatgtt

SEQ ID NO: 237539 - DNA, 25 bp, Mus musculus
ccacagcagtccaagcgctctctca

SEQ ID NO: 237540 - DNA, 25 bp, Mus musculus
ccacagcatcaaagcctgctcccag

SEQ ID NO: 237541 - DNA, 25 bp, Mus musculus
ccacagcatccgaacttttgtgagc

SEQ ID NO: 237542 - DNA, 25 bp, Mus musculus
ccacagcatgcgggaggaggacttc

SEQ ID NO: 237543 - DNA, 25 bp, Mus musculus
ccacagccaacaggtcagaccaagc

SEQ ID NO: 237544 - DNA, 25 bp, Mus musculus
ccacagccaaccagatacccataat

SEQ ID NO: 237545 - DNA, 25 bp, Mus musculus
ccacagccaactttccagatgtcat

SEQ ID NO: 237546 - DNA, 25 bp, Mus musculus
ccacagccaatcagataattctgaa

SEQ ID NO: 237547 - DNA, 25 bp, Mus musculus
ccacagccaccaaggtgacagcttc

SEQ ID NO: 237548 - DNA, 25 bp, Mus musculus
ccacagccaccgagactccagacct

SEQ ID NO: 237549 - DNA, 25 bp, Mus musculus
ccacagccaccgagccgtcaagctg

SEQ ID NO: 237550 - DNA, 25 bp, Mus musculus
ccacagccagaagagatcctcagct

SEQ ID NO: 237551 - DNA, 25 bp, Mus musculus
ccacagccagaagagccatggcgag

SEQ ID NO: 237552 - DNA, 25 bp, Mus musculus
ccacagccagatttgaccaagctgc

SEQ ID NO: 237553 - DNA, 25 bp, Mus musculus
ccacagccaggatatccctgtgatc

SEQ ID NO: 237554 - DNA, 25 bp, Mus musculus
ccacagcccagaaaagaaaaagtat

SEQ ID NO: 237555 - DNA, 25 bp, Mus musculus
ccacagccccgcagacactgggttc

SEQ ID NO: 237556 - DNA, 25 bp, Mus musculus
ccacagcccctttgacactcctcag

SEQ ID NO: 237557 - DNA, 25 bp, Mus musculus
ccacagcccgccggtggcagctgac

SEQ ID NO: 237558 - DNA, 25 bp, Mus musculus
ccacagccctctcaggttgtctcaa

SEQ ID NO: 237559 - DNA, 25 bp, Mus musculus
ccacagcccttcagccagtactgtc

SEQ ID NO: 237560 - DNA, 25 bp, Mus musculus
ccacagccgcagccttaccagccag

SEQ ID NO: 237561 - DNA, 25 bp, Mus musculus
ccacagccgcagcgtcctcagaatg

SEQ ID NO: 237562 - DNA, 25 bp, Mus musculus
ccacagccgcgaccatagtctgtgt

SEQ ID NO: 237563 - DNA, 25 bp, Mus musculus
ccacagccgcgcctggtgcagccaa

SEQ ID NO: 237564 - DNA, 25 bp, Mus musculus
ccacagccgctgaagatgtgcctca

SEQ ID NO: 237565 - DNA, 25 bp, Mus musculus
ccacagccgcttcggcattctggaa

SEQ ID NO: 237566 - DNA, 25 bp, Mus musculus
ccacagcctcgactgaccctgactg

SEQ ID NO: 237567 - DNA, 25 bp, Mus musculus
ccacagcctgaggagacgcagaggc

SEQ ID NO: 237568 - DNA, 25 bp, Mus musculus
ccacagcctgggtgcctatagcatt

SEQ ID NO: 237569 - DNA, 25 bp, Mus musculus
ccacagcctgtgctcattgcccact

SEQ ID NO: 237570 - DNA, 25 bp, Mus musculus
ccacagccttcttttatgaggtctc

SEQ ID NO: 237571 - DNA, 25 bp, Mus musculus
ccacagccttcttttgacccacata

SEQ ID NO: 237572 - DNA, 25 bp, Mus musculus
ccacagcgagggggcgctcctgggc

SEQ ID NO: 237573 - DNA, 25 bp, Mus musculus
ccacagcgcaaccaggcccaggagg

SEQ ID NO: 237574 - DNA, 25 bp, Mus musculus
ccacagcggaaccgacaaaggttac

SEQ ID NO: 237575 - DNA, 25 bp, Mus musculus
ccacagcggaaccgcttcttcactt

SEQ ID NO: 237576 - DNA, 25 bp, Mus musculus
ccacagcggaaccggacgccctggc

SEQ ID NO: 237577 - DNA, 25 bp, Mus musculus
ccacagcgtcctccgggtagctggg

SEQ ID NO: 237578 - DNA, 25 bp, Mus musculus
ccacagcgtgctctcaatgaaggca

SEQ ID NO: 237579 - DNA, 25 bp, Mus musculus
ccacagctagctatgacctatgagg

SEQ ID NO: 237580 - DNA, 25 bp, Mus musculus
ccacagctaggctttcagtctctgg

SEQ ID NO: 237581 - DNA, 25 bp, Mus musculus
ccacagctccagcaggaccttctac

SEQ ID NO: 237582 - DNA, 25 bp, Mus musculus
ccacagctccagcaggctcttgctt

SEQ ID NO: 237583 - DNA, 25 bp, Mus musculus
ccacagctcggctcctgggcagcga

SEQ ID NO: 237584 - DNA, 25 bp, Mus musculus
ccacagctcggtcgtccagtccttg

SEQ ID NO: 237585 - DNA, 25 bp, Mus musculus
ccacagctgaccccagagcaccaga

SEQ ID NO: 237586 - DNA, 25 bp, Mus musculus
ccacagctgactcagcccggcaagc

SEQ ID NO: 237587 - DNA, 25 bp, Mus musculus
ccacagctgcagcaggagcaaccaa

SEQ ID NO: 237588 - DNA, 25 bp, Mus musculus
ccacagctgcaggtaaaaataaatg

SEQ ID NO: 237589 - DNA, 25 bp, Mus musculus
ccacagctgctaactctcttctggc

SEQ ID NO: 237590 - DNA, 25 bp, Mus musculus
ccacagctggcgaggtgttggcagc

SEQ ID NO: 237591 - DNA, 25 bp, Mus musculus
ccacagctggtggagatgattgcag

SEQ ID NO: 237592 - DNA, 25 bp, Mus musculus
ccacagctggtggagttgttgggag

SEQ ID NO: 237593 - DNA, 25 bp, Mus musculus
ccacagctgtctagctgtttcctct

SEQ ID NO: 237594 - DNA, 25 bp, Mus musculus
ccacagcttcacacagagaccctgg

SEQ ID NO: 237595 - DNA, 25 bp, Mus musculus
ccacagcttcaccacgaccctggtg

SEQ ID NO: 237596 - DNA, 25 bp, Mus musculus
ccacagcttcccaggagatgtacga

SEQ ID NO: 237597 - DNA, 25 bp, Mus musculus
ccacaggaaacaggagcagcgttgc

SEQ ID NO: 237598 - DNA, 25 bp, Mus musculus
ccacaggaaaggaatggagagtctg

SEQ ID NO: 237599 - DNA, 25 bp, Mus musculus
ccacaggaaaggggaatgtgactct

SEQ ID NO: 237600 - DNA, 25 bp, Mus musculus
ccacaggaaagtacctggccagtgg

SEQ ID NO: 237601 - DNA, 25 bp, Mus musculus
ccacaggaacaagatcctgcacagg

SEQ ID NO: 237602 - DNA, 25 bp, Mus musculus
ccacaggaacaaggtgtggccaaac

SEQ ID NO: 237603 - DNA, 25 bp, Mus musculus
ccacaggaaccagctgatggccagg

SEQ ID NO: 237604 - DNA, 25 bp, Mus musculus
ccacaggaagactggtgggaacaca

SEQ ID NO: 237605 - DNA, 25 bp, Mus musculus
ccacaggaagtcagctagcagccac

SEQ ID NO: 237606 - DNA, 25 bp, Mus musculus
ccacaggacagagttcctgtagttg

SEQ ID NO: 237607 - DNA, 25 bp, Mus musculus
ccacaggacggatggcgggtttccg

SEQ ID NO: 237608 - DNA, 25 bp, Mus musculus
ccacaggagagaagcatcaagatga

SEQ ID NO: 237609 - DNA, 25 bp, Mus musculus
ccacaggagagaagggtcaccgcta

SEQ ID NO: 237610 - DNA, 25 bp, Mus musculus
ccacaggagtggtcccgtaggcctc

SEQ ID NO: 237611 - DNA, 25 bp, Mus musculus
ccacaggatacaggattctcataat

SEQ ID NO: 237612 - DNA, 25 bp, Mus musculus
ccacaggatacagggttatacaggg

SEQ ID NO: 237613 - DNA, 25 bp, Mus musculus
ccacaggatgaaataacagttactt

SEQ ID NO: 237614 - DNA, 25 bp, Mus musculus
ccacaggatgaaggttaggcacggg

SEQ ID NO: 237615 - DNA, 25 bp, Mus musculus
ccacaggatgatggcagtgaaattc

SEQ ID NO: 237616 - DNA, 25 bp, Mus musculus
ccacaggatgggtcccagcctgcag

SEQ ID NO: 237617 - DNA, 25 bp, Mus musculus
ccacaggattaccaccatgttcaac

SEQ ID NO: 237618 - DNA, 25 bp, Mus musculus
ccacaggcagatgaacacaatgatg

SEQ ID NO: 237619 - DNA, 25 bp, Mus musculus
ccacaggcagtgaggaatggtgaga

SEQ ID NO: 237620 - DNA, 25 bp, Mus musculus
ccacaggcataccaggctccagaaa

SEQ ID NO: 237621 - DNA, 25 bp, Mus musculus
ccacaggccagccttcttgctaagg

SEQ ID NO: 237622 - DNA, 25 bp, Mus musculus
ccacaggcctgagtttcctgagctg

SEQ ID NO: 237623 - DNA, 25 bp, Mus musculus
ccacaggcgcaagaaaagagaagca

SEQ ID NO: 237624 - DNA, 25 bp, Mus musculus
ccacaggcgggcggtgtatcctcag

SEQ ID NO: 237625 - DNA, 25 bp, Mus musculus
ccacaggcgtccaagctcccagcag

SEQ ID NO: 237626 - DNA, 25 bp, Mus musculus
ccacaggcgtccaaggccatcagct

SEQ ID NO: 237627 - DNA, 25 bp, Mus musculus
ccacaggctcctgagcgcagccttg

SEQ ID NO: 237628 - DNA, 25 bp, Mus musculus
ccacaggctcctggccaggagcaag

SEQ ID NO: 237629 - DNA, 25 bp, Mus musculus
ccacaggctggcaaggtcaaacctg

SEQ ID NO: 237630 - DNA, 25 bp, Mus musculus
ccacagggactaagcccacaggagt

SEQ ID NO: 237631 - DNA, 25 bp, Mus musculus
ccacagggatgttggatggaagaat

SEQ ID NO: 237632 - DNA, 25 bp, Mus musculus
ccacagggatttcagatgataaagg

SEQ ID NO: 237633 - DNA, 25 bp, Mus musculus
ccacagggatttcaggctgggaatg

SEQ ID NO: 237634 - DNA, 25 bp, Mus musculus
ccacagggatttcagtctggaaatg

SEQ ID NO: 237635 - DNA, 25 bp, Mus musculus
ccacagggtgcaagatgatgacttc

SEQ ID NO: 237636 - DNA, 25 bp, Mus musculus
ccacagggtgcaagccagcccttca

SEQ ID NO: 237637 - DNA, 25 bp, Mus musculus
ccacagggtgctcctggaaaacggg

SEQ ID NO: 237638 - DNA, 25 bp, Mus musculus
ccacaggtcggaaggctgcctctcg

SEQ ID NO: 237639 - DNA, 25 bp, Mus musculus
ccacaggtgcctcggttccagggtc

SEQ ID NO: 237640 - DNA, 25 bp, Mus musculus
ccacagtaaaagctgaaaataatga

SEQ ID NO: 237641 - DNA, 25 bp, Mus musculus
ccacagtaaaggacagtctcatcga

SEQ ID NO: 237642 - DNA, 25 bp, Mus musculus
ccacagtaaaggttacagatatact

SEQ ID NO: 237643 - DNA, 25 bp, Mus musculus
ccacagtaaggtcacgaagttggga

SEQ ID NO: 237644 - DNA, 25 bp, Mus musculus
ccacagtaaggtgtaacacggctag

SEQ ID NO: 237645 - DNA, 25 bp, Mus musculus
ccacagtcacatttacagactccta

SEQ ID NO: 237646 - DNA, 25 bp, Mus musculus
ccacagtcaccgagagtggggagta

SEQ ID NO: 237647 - DNA, 25 bp, Mus musculus
ccacagtcactggacccaaagtcat

SEQ ID NO: 237648 - DNA, 25 bp, Mus musculus
ccacagtcagccttttatgtcaccg

SEQ ID NO: 237649 - DNA, 25 bp, Mus musculus
ccacagtcaggtgacactgctgagc

SEQ ID NO: 237650 - DNA, 25 bp, Mus musculus
ccacagtcatggccttccctccggg

SEQ ID NO: 237651 - DNA, 25 bp, Mus musculus
ccacagtcgagagctaagatgcgag

SEQ ID NO: 237652 - DNA, 25 bp, Mus musculus
ccacagtgaaaaaagcaactatagc

SEQ ID NO: 237653 - DNA, 25 bp, Mus musculus
ccacagtgaaggagcagattataaa

SEQ ID NO: 237654 - DNA, 25 bp, Mus musculus
ccacagtgactcatctgcccctcct

SEQ ID NO: 237655 - DNA, 25 bp, Mus musculus
ccacagtgcaagccccatgtcactg

SEQ ID NO: 237656 - DNA, 25 bp, Mus musculus
ccacagtgccaagatttttttcgta

SEQ ID NO: 237657 - DNA, 25 bp, Mus musculus
ccacagtgccaaggtcaaaattgca

SEQ ID NO: 237658 - DNA, 25 bp, Mus musculus
ccacagtggagatccagacaggcgc

SEQ ID NO: 237659 - DNA, 25 bp, Mus musculus
ccacagtgtaaagctctatgtcaga

SEQ ID NO: 237660 - DNA, 25 bp, Mus musculus
ccacagtgtgtcaggcattcggggc

SEQ ID NO: 237661 - DNA, 25 bp, Mus musculus
ccacagttcagaaactgtgaagttc

SEQ ID NO: 237662 - DNA, 25 bp, Mus musculus
ccacagttcgcagatacacttttgg

SEQ ID NO: 237663 - DNA, 25 bp, Mus musculus
ccacagttcgcaggaggcagagtaa

SEQ ID NO: 237664 - DNA, 25 bp, Mus musculus
ccacagttgttcatgtcctgaaggg

SEQ ID NO: 237665 - DNA, 25 bp, Mus musculus
ccacagtttctcccatccccacctg

SEQ ID NO: 237666 - DNA, 25 bp, Mus musculus
ccacagtttctgctgcagttctcag

SEQ ID NO: 237667 - DNA, 25 bp, Mus musculus
ccacagtttcttggtctggaataaa

SEQ ID NO: 237668 - DNA, 25 bp, Mus musculus
ccacataaaaggaaattgtgggaaa

SEQ ID NO: 237669 - DNA, 25 bp, Mus musculus
ccacatacaagggacagtggcacag

SEQ ID NO: 237670 - DNA, 25 bp, Mus musculus
ccacatactatatatgccgttccta

SEQ ID NO: 237671 - DNA, 25 bp, Mus musculus
ccacatagaaggctctcagcaccat

SEQ ID NO: 237672 - DNA, 25 bp, Mus musculus
ccacatagagaaggtgacagatgtc

SEQ ID NO: 237673 - DNA, 25 bp, Mus musculus
ccacatatcatccaggtgtgttatc

SEQ ID NO: 237674 - DNA, 25 bp, Mus musculus
ccacatcaactacgggtatttggct

SEQ ID NO: 237675 - DNA, 25 bp, Mus musculus
ccacatcaaggtggtggtcggcgga

SEQ ID NO: 237676 - DNA, 25 bp, Mus musculus
ccacatcaattgccagtctgcaagc

SEQ ID NO: 237677 - DNA, 25 bp, Mus musculus
ccacatcagagagtgtccaggttat

SEQ ID NO: 237678 - DNA, 25 bp, Mus musculus
ccacatccactggtggagctgcccg

SEQ ID NO: 237679 - DNA, 25 bp, Mus musculus
ccacatcccagacagacggtggcgc

SEQ ID NO: 237680 - DNA, 25 bp, Mus musculus
ccacatcccagacagagatgctgcc

SEQ ID NO: 237681 - DNA, 25 bp, Mus musculus
ccacatcctctgatcggttaagcat

SEQ ID NO: 237682 - DNA, 25 bp, Mus musculus
ccacatcctgtgccaataacttcgc

SEQ ID NO: 237683 - DNA, 25 bp, Mus musculus
ccacatcgcaaggggctccacgggc

SEQ ID NO: 237684 - DNA, 25 bp, Mus musculus
ccacatctgtcaaattatcacacaa

SEQ ID NO: 237685 - DNA, 25 bp, Mus musculus
ccacatgcagaatcacagcgaggtt

SEQ ID NO: 237686 - DNA, 25 bp, Mus musculus
ccacatgcagcagggtggaagccca

SEQ ID NO: 237687 - DNA, 25 bp, Mus musculus
ccacatgcaggagagattttgggct

SEQ ID NO: 237688 - DNA, 25 bp, Mus musculus
ccacatgcaggcttcccgaggaggt

SEQ ID NO: 237689 - DNA, 25 bp, Mus musculus
ccacatgcaggtgtggtacatccag

SEQ ID NO: 237690 - DNA, 25 bp, Mus musculus
ccacatgctaacaggggctaccagc

SEQ ID NO: 237691 - DNA, 25 bp, Mus musculus
ccacatggcaacaggtttatggtcg

SEQ ID NO: 237692 - DNA, 25 bp, Mus musculus
ccacatggccaaggaaaattgtcca

SEQ ID NO: 237693 - DNA, 25 bp, Mus musculus
ccacatggccaagggactaaagaag

SEQ ID NO: 237694 - DNA, 25 bp, Mus musculus
ccacatgtacaaggactcacacacg

SEQ ID NO: 237695 - DNA, 25 bp, Mus musculus
ccacatgtacatatgaaacctgcca

SEQ ID NO: 237696 - DNA, 25 bp, Mus musculus
ccacatgtacatatggtcgacccca

SEQ ID NO: 237697 - DNA, 25 bp, Mus musculus
ccacatgtcacagctaaagtccagg

SEQ ID NO: 237698 - DNA, 25 bp, Mus musculus
ccacatgtgctgccagtccctccac

SEQ ID NO: 237699 - DNA, 25 bp, Mus musculus
ccacatgttcactatgaggagagag

SEQ ID NO: 237700 - DNA, 25 bp, Mus musculus
ccacattagcccaggtatccatgcc

SEQ ID NO: 237701 - DNA, 25 bp, Mus musculus
ccacattcaggtccaacaaagttcc

SEQ ID NO: 237702 - DNA, 25 bp, Mus musculus
ccacattccagggccctctgcctcc

SEQ ID NO: 237703 - DNA, 25 bp, Mus musculus
ccacattcccaagggcacaagtgta

SEQ ID NO: 237704 - DNA, 25 bp, Mus musculus
ccacattccccagcctctgcagacc

SEQ ID NO: 237705 - DNA, 25 bp, Mus musculus
ccacattccccaggctctgcagacc

SEQ ID NO: 237706 - DNA, 25 bp, Mus musculus
ccacattcgagatggtggagtatat

SEQ ID NO: 237707 - DNA, 25 bp, Mus musculus
ccacattcgagatgttcctcctgcg

SEQ ID NO: 237708 - DNA, 25 bp, Mus musculus
ccacattctgattcaaagaatacag

SEQ ID NO: 237709 - DNA, 25 bp, Mus musculus
ccacattctgtaccaaggaagagaa

SEQ ID NO: 237710 - DNA, 25 bp, Mus musculus
ccacattgagagcaccaagaccggc

SEQ ID NO: 237711 - DNA, 25 bp, Mus musculus
ccacattgatgagtgaagaggcgac

SEQ ID NO: 237712 - DNA, 25 bp, Mus musculus
ccacattgatgagtgacctgctgcc

SEQ ID NO: 237713 - DNA, 25 bp, Mus musculus
ccacatttaaatgattatagatctt

SEQ ID NO: 237714 - DNA, 25 bp, Mus musculus
ccacatttaagtcagattatcgccc

SEQ ID NO: 237715 - DNA, 25 bp, Mus musculus
ccacatttcacaaagctcggattgg

SEQ ID NO: 237716 - DNA, 25 bp, Mus musculus
ccacatttgagaacggccggtttgt

SEQ ID NO: 237717 - DNA, 25 bp, Mus musculus
ccacatttgagtgtgaagtgagggg

SEQ ID NO: 237718 - DNA, 25 bp, Mus musculus
ccacatttggagcccttacagagga

SEQ ID NO: 237719 - DNA, 25 bp, Mus musculus
ccacattttgctatgagcttggata

SEQ ID NO: 237720 - DNA, 25 bp, Mus musculus
ccacattttggtgtgatggagtctt

SEQ ID NO: 237721 - DNA, 25 bp, Mus musculus
ccacatttttctgaattattttgat

SEQ ID NO: 237722 - DNA, 25 bp, Mus musculus
ccaccaaaaaggaatcactgggcca

SEQ ID NO: 237723 - DNA, 25 bp, Mus musculus
ccaccaaaatgaaggaagctctgag

SEQ ID NO: 237724 - DNA, 25 bp, Mus musculus
ccaccaaagagagacctcctaagcc

SEQ ID NO: 237725 - DNA, 25 bp, Mus musculus
ccaccaaagcacagtgtcctcaaca

SEQ ID NO: 237726 - DNA, 25 bp, Mus musculus
ccaccaacaaggcctgtttcgattg

SEQ ID NO: 237727 - DNA, 25 bp, Mus musculus
ccaccaacacacgtgggaaggtggc

SEQ ID NO: 237728 - DNA, 25 bp, Mus musculus
ccaccaacacacgtggtggtacccg

SEQ ID NO: 237729 - DNA, 25 bp, Mus musculus
ccaccaacacccaggcctgcagtgg

SEQ ID NO: 237730 - DNA, 25 bp, Mus musculus
ccaccaacatccagagcaagcacca

SEQ ID NO: 237731 - DNA, 25 bp, Mus musculus
ccaccaacatccagctttccaagct

SEQ ID NO: 237732 - DNA, 25 bp, Mus musculus
ccaccaaccagattctcagccaccg

SEQ ID NO: 237733 - DNA, 25 bp, Mus musculus
ccaccaactcaagaggcccaggaga

SEQ ID NO: 237734 - DNA, 25 bp, Mus musculus
ccaccaagaataaagcgctaactga

SEQ ID NO: 237735 - DNA, 25 bp, Mus musculus
ccaccaagatcccagtgattataga

SEQ ID NO: 237736 - DNA, 25 bp, Mus musculus
ccaccaagcagaaacagcacctctt

SEQ ID NO: 237737 - DNA, 25 bp, Mus musculus
ccaccaagcaggagattacctggag

SEQ ID NO: 237738 - DNA, 25 bp, Mus musculus
ccaccaagggaacttaatacagaag

SEQ ID NO: 237739 - DNA, 25 bp, Mus musculus
ccaccaagtccagcaggaattgtct

SEQ ID NO: 237740 - DNA, 25 bp, Mus musculus
ccaccaatcaaagcaagctcatgtt

SEQ ID NO: 237741 - DNA, 25 bp, Mus musculus
ccaccaatcaaggctggcttcaaac

SEQ ID NO: 237742 - DNA, 25 bp, Mus musculus
ccaccaatcaagtcaccggaagaag

SEQ ID NO: 237743 - DNA, 25 bp, Mus musculus
ccaccaatgtcaggttgaaaactgt

SEQ ID NO: 237744 - DNA, 25 bp, Mus musculus
ccaccaatgtcagtgtgcgggatga

SEQ ID NO: 237745 - DNA, 25 bp, Mus musculus
ccaccaatgtgagaggagagacggc

SEQ ID NO: 237746 - DNA, 25 bp, Mus musculus
ccaccaattcccacagagaaccagg

SEQ ID NO: 237747 - DNA, 25 bp, Mus musculus
ccaccacacactgttcagacggctc

SEQ ID NO: 237748 - DNA, 25 bp, Mus musculus
ccaccacacaggccagacccatggg

SEQ ID NO: 237749 - DNA, 25 bp, Mus musculus
ccaccacacccgagcagtatataaa

SEQ ID NO: 237750 - DNA, 25 bp, Mus musculus
ccaccacacctgtctcctccttcac

SEQ ID NO: 237751 - DNA, 25 bp, Mus musculus
ccaccacagaggcctcaggatgact

SEQ ID NO: 237752 - DNA, 25 bp, Mus musculus
ccaccacagcaggcactacagactc

SEQ ID NO: 237753 - DNA, 25 bp, Mus musculus
ccaccacagtgactcatctgcccct

SEQ ID NO: 237754 - DNA, 25 bp, Mus musculus
ccaccaccaccacggcgacgacaga

SEQ ID NO: 237755 - DNA, 25 bp, Mus musculus
ccaccaccacctcctcgccctcatg

SEQ ID NO: 237756 - DNA, 25 bp, Mus musculus
ccaccaccaggaacttcctgtagaa

SEQ ID NO: 237757 - DNA, 25 bp, Mus musculus
ccaccaccaggtattccaataactg

SEQ ID NO: 237758 - DNA, 25 bp, Mus musculus
ccaccaccccaggcccagagtctac

SEQ ID NO: 237759 - DNA, 25 bp, Mus musculus
ccaccaccgctgacgatgcagatct

SEQ ID NO: 237760 - DNA, 25 bp, Mus musculus
ccaccaccgctggatgcagatcttt

SEQ ID NO: 237761 - DNA, 25 bp, Mus musculus
ccaccaccgggtgtgatgaatcaag

SEQ ID NO: 237762 - DNA, 25 bp, Mus musculus
ccaccacctggaactggtgagcaga

SEQ ID NO: 237763 - DNA, 25 bp, Mus musculus
ccaccacctggatcgagaactcgcc

SEQ ID NO: 237764 - DNA, 25 bp, Mus musculus
ccaccacctgttgtgcagagttgtc

SEQ ID NO: 237765 - DNA, 25 bp, Mus musculus
ccaccacgacgaaggaccccttctc

SEQ ID NO: 237766 - DNA, 25 bp, Mus musculus
ccaccacgaggccagatacctgact

SEQ ID NO: 237767 - DNA, 25 bp, Mus musculus
ccaccacggatacttgtaagcggta

SEQ ID NO: 237768 - DNA, 25 bp, Mus musculus
ccaccacgggttggatcaggcctga

SEQ ID NO: 237769 - DNA, 25 bp, Mus musculus
ccaccactagtgtgtcacatcaagt

SEQ ID NO: 237770 - DNA, 25 bp, Mus musculus
ccaccactcaggagcccttgcccag

SEQ ID NO: 237771 - DNA, 25 bp, Mus musculus
ccaccactcaggtgttttctctggc

SEQ ID NO: 237772 - DNA, 25 bp, Mus musculus
ccaccactccctaggtgttgggagc

SEQ ID NO: 237773 - DNA, 25 bp, Mus musculus
ccaccactcctctggatcccagagt

SEQ ID NO: 237774 - DNA, 25 bp, Mus musculus
ccaccactggcacaggagacactgc

SEQ ID NO: 237775 - DNA, 25 bp, Mus musculus
ccaccactggctatgaggacgtagc

SEQ ID NO: 237776 - DNA, 25 bp, Mus musculus
ccaccagaagattcagaatgtgtac

SEQ ID NO: 237777 - DNA, 25 bp, Mus musculus
ccaccagaaggaccctgctctggac

SEQ ID NO: 237778 - DNA, 25 bp, Mus musculus
ccaccagaaggtggtagccaattct

SEQ ID NO: 237779 - DNA, 25 bp, Mus musculus
ccaccagaatcaagttccttacaga

SEQ ID NO: 237780 - DNA, 25 bp, Mus musculus
ccaccagaattgttgtttattcatg

SEQ ID NO: 237781 - DNA, 25 bp, Mus musculus
ccaccagagacaaggtccactgggc

SEQ ID NO: 237782 - DNA, 25 bp, Mus musculus
ccaccagagccctgcaggccctggt

SEQ ID NO: 237783 - DNA, 25 bp, Mus musculus
ccaccagatgcagcatccctggagc

SEQ ID NO: 237784 - DNA, 25 bp, Mus musculus
ccaccagatgcaggagagaagatgg

SEQ ID NO: 237785 - DNA, 25 bp, Mus musculus
ccaccagatgcagtgttgtggtcct

SEQ ID NO: 237786 - DNA, 25 bp, Mus musculus
ccaccagatgctgagcaactacatc

SEQ ID NO: 237787 - DNA, 25 bp, Mus musculus
ccaccagcagccaggccaaaaaagt

SEQ ID NO: 237788 - DNA, 25 bp, Mus musculus
ccaccagcagctgaacagaaaatgt

SEQ ID NO: 237789 - DNA, 25 bp, Mus musculus
ccaccagcagctgaagtccgcacag

SEQ ID NO: 237790 - DNA, 25 bp, Mus musculus
ccaccagcagctgaatggttaccac

SEQ ID NO: 237791 - DNA, 25 bp, Mus musculus
ccaccagcaggccgaggaaagcaga

SEQ ID NO: 237792 - DNA, 25 bp, Mus musculus
ccaccagcaggttcagcagctccac

SEQ ID NO: 237793 - DNA, 25 bp, Mus musculus
ccaccagccaacagaacctgagcca

SEQ ID NO: 237794 - DNA, 25 bp, Mus musculus
ccaccagccaacagtgcaacataga

SEQ ID NO: 237795 - DNA, 25 bp, Mus musculus
ccaccagccagccagagaaagaagt

SEQ ID NO: 237796 - DNA, 25 bp, Mus musculus
ccaccagccagccagctttcagctg

SEQ ID NO: 237797 - DNA, 25 bp, Mus musculus
ccaccagccttaactaactccacgg

SEQ ID NO: 237798 - DNA, 25 bp, Mus musculus
ccaccagccttaactggctccatag

SEQ ID NO: 237799 - DNA, 25 bp, Mus musculus
ccaccagctacaaagtgtctttgcc

SEQ ID NO: 237800 - DNA, 25 bp, Mus musculus
ccaccagctcagttaatggaacccc

SEQ ID NO: 237801 - DNA, 25 bp, Mus musculus
ccaccagcttcccagccggaaccca

SEQ ID NO: 237802 - DNA, 25 bp, Mus musculus
ccaccaggaacagagagaacattat

SEQ ID NO: 237803 - DNA, 25 bp, Mus musculus
ccaccaggaagggtgttaggagtgg

SEQ ID NO: 237804 - DNA, 25 bp, Mus musculus
ccaccaggaagtacccagcgagcca

SEQ ID NO: 237805 - DNA, 25 bp, Mus musculus
ccaccaggatggctgatatagacag

SEQ ID NO: 237806 - DNA, 25 bp, Mus musculus
ccaccaggcaagggttgcccttcac

SEQ ID NO: 237807 - DNA, 25 bp, Mus musculus
ccaccaggcaaggtactggtgaggt

SEQ ID NO: 237808 - DNA, 25 bp, Mus musculus
ccaccaggcagaaggcgacagactt

SEQ ID NO: 237809 - DNA, 25 bp, Mus musculus
ccaccaggcagcatctgaggacctg

SEQ ID NO: 237810 - DNA, 25 bp, Mus musculus
ccaccaggccaaagattatttgtat

SEQ ID NO: 237811 - DNA, 25 bp, Mus musculus
ccaccaggtcctgcgggttctccag

SEQ ID NO: 237812 - DNA, 25 bp, Mus musculus
ccaccaggtgccacacggccatggc

SEQ ID NO: 237813 - DNA, 25 bp, Mus musculus
ccaccagtacttggggccttttgct

SEQ ID NO: 237814 - DNA, 25 bp, Mus musculus
ccaccagtacttgggtctgacaaga

SEQ ID NO: 237815 - DNA, 25 bp, Mus musculus
ccaccagtcggtgttgactttaaga

SEQ ID NO: 237816 - DNA, 25 bp, Mus musculus
ccaccatacttcagactagcttcct

SEQ ID NO: 237817 - DNA, 25 bp, Mus musculus
ccaccatacttcaggtcttcagcaa

SEQ ID NO: 237818 - DNA, 25 bp, Mus musculus
ccaccatatcagccattgaagccat

SEQ ID NO: 237819 - DNA, 25 bp, Mus musculus
ccaccatattcttttgaatatgtag

SEQ ID NO: 237820 - DNA, 25 bp, Mus musculus
ccaccatatttgaaaatgctgtgga

SEQ ID NO: 237821 - DNA, 25 bp, Mus musculus
ccaccatatttgaatcatttccacc

SEQ ID NO: 237822 - DNA, 25 bp, Mus musculus
ccaccatatttgacgcggaaaagga

SEQ ID NO: 237823 - DNA, 25 bp, Mus musculus
ccaccatcaagaaccatgagtttat

SEQ ID NO: 237824 - DNA, 25 bp, Mus musculus
ccaccatcaagagcaccccatctgg

SEQ ID NO: 237825 - DNA, 25 bp, Mus musculus
ccaccatcatcagagagcttcatgg

SEQ ID NO: 237826 - DNA, 25 bp, Mus musculus
ccaccatcatcaggcaaacaggcat

SEQ ID NO: 237827 - DNA, 25 bp, Mus musculus
ccaccatcatcagtgtcccttggga

SEQ ID NO: 237828 - DNA, 25 bp, Mus musculus
ccaccatcatctggctatgtataaa

SEQ ID NO: 237829 - DNA, 25 bp, Mus musculus
ccaccatcgtaggttctgtacctca

SEQ ID NO: 237830 - DNA, 25 bp, Mus musculus
ccaccatctggtgagtgaaccccca

SEQ ID NO: 237831 - DNA, 25 bp, Mus musculus
ccaccatgaatttgtggccctaata

SEQ ID NO: 237832 - DNA, 25 bp, Mus musculus
ccaccatgagagacttccagacaga

SEQ ID NO: 237833 - DNA, 25 bp, Mus musculus
ccaccatgatattggaccatgtgtt

SEQ ID NO: 237834 - DNA, 25 bp, Mus musculus
ccaccatgatgggaagaaaggaaag

SEQ ID NO: 237835 - DNA, 25 bp, Mus musculus
ccaccatgccgatcaataagtcgga

SEQ ID NO: 237836 - DNA, 25 bp, Mus musculus
ccaccatggagaacaagcattgatg

SEQ ID NO: 237837 - DNA, 25 bp, Mus musculus
ccaccatggtgaagatttacccaat

SEQ ID NO: 237838 - DNA, 25 bp, Mus musculus
ccaccatggtgaagctaatctggaa

SEQ ID NO: 237839 - DNA, 25 bp, Mus musculus
ccaccattactctacggctggcccg

SEQ ID NO: 237840 - DNA, 25 bp, Mus musculus
ccaccattccggagtgagaacaatc

SEQ ID NO: 237841 - DNA, 25 bp, Mus musculus
ccaccattcctccaggaacaacagg

SEQ ID NO: 237842 - DNA, 25 bp, Mus musculus
ccaccattcctccaggtacatttga

SEQ ID NO: 237843 - DNA, 25 bp, Mus musculus
ccaccattcctccaggtcttgccgt

SEQ ID NO: 237844 - DNA, 25 bp, Mus musculus
ccaccattggctggattgctgctgg

SEQ ID NO: 237845 - DNA, 25 bp, Mus musculus
ccaccatttcagagtcagcttgcga

SEQ ID NO: 237846 - DNA, 25 bp, Mus musculus
ccaccatttggcttcattaaaaaaa

SEQ ID NO: 237847 - DNA, 25 bp, Mus musculus
ccacccaaaagcaaggatgaagtgg

SEQ ID NO: 237848 - DNA, 25 bp, Mus musculus
ccacccaagtgcgagatgttgcatg

SEQ ID NO: 237849 - DNA, 25 bp, Mus musculus
ccacccaagtgcgaggaaaaatccg

SEQ ID NO: 237850 - DNA, 25 bp, Mus musculus
ccacccacctctcactccccatgga

SEQ ID NO: 237851 - DNA, 25 bp, Mus musculus
ccacccacttacacaggccgccccg

SEQ ID NO: 237852 - DNA, 25 bp, Mus musculus
ccacccagagaagatgtgagcccac

SEQ ID NO: 237853 - DNA, 25 bp, Mus musculus
ccacccagcaagaaaaagccacaaa

SEQ ID NO: 237854 - DNA, 25 bp, Mus musculus
ccacccagctccaggactcccctga

SEQ ID NO: 237855 - DNA, 25 bp, Mus musculus
ccacccagctccagttaacctgtgg

SEQ ID NO: 237856 - DNA, 25 bp, Mus musculus
ccacccagctcccagctaaatgtgg

SEQ ID NO: 237857 - DNA, 25 bp, Mus musculus
ccacccagctgtggctgcgaccctc

SEQ ID NO: 237858 - DNA, 25 bp, Mus musculus
ccacccaggaaagagacatggcaag

SEQ ID NO: 237859 - DNA, 25 bp, Mus musculus
ccacccaggaaagaggtgcccactc

SEQ ID NO: 237860 - DNA, 25 bp, Mus musculus
ccacccatagtgggccaaagagatg

SEQ ID NO: 237861 - DNA, 25 bp, Mus musculus
ccacccatgagaagctgcccatggt

SEQ ID NO: 237862 - DNA, 25 bp, Mus musculus
ccacccatgctttctggatcattcc

SEQ ID NO: 237863 - DNA, 25 bp, Mus musculus
ccacccattggctggcaaggtcagc

SEQ ID NO: 237864 - DNA, 25 bp, Mus musculus
ccacccattggctggttttcccatc

SEQ ID NO: 237865 - DNA, 25 bp, Mus musculus
ccaccccaaacagtgtcaccccgcc

SEQ ID NO: 237866 - DNA, 25 bp, Mus musculus
ccaccccaagaaaaagctccctgtg

SEQ ID NO: 237867 - DNA, 25 bp, Mus musculus
ccaccccaagtaagaagactagcag

SEQ ID NO: 237868 - DNA, 25 bp, Mus musculus
ccaccccaagtaagataccaaggta

SEQ ID NO: 237869 - DNA, 25 bp, Mus musculus
ccaccccacaaacctgacgagatga

SEQ ID NO: 237870 - DNA, 25 bp, Mus musculus
ccaccccacaggtatatacggtgct

SEQ ID NO: 237871 - DNA, 25 bp, Mus musculus
ccaccccagatgcagggctgtagca

SEQ ID NO: 237872 - DNA, 25 bp, Mus musculus
ccaccccagatgcaggttctgcatt

SEQ ID NO: 237873 - DNA, 25 bp, Mus musculus
ccaccccagtcactgcttgtctctt

SEQ ID NO: 237874 - DNA, 25 bp, Mus musculus
ccaccccagtggaaatcacggttat

SEQ ID NO: 237875 - DNA, 25 bp, Mus musculus
ccaccccatccagaaaatgaggaag

SEQ ID NO: 237876 - DNA, 25 bp, Mus musculus
ccaccccattcaagaaattggcacc

SEQ ID NO: 237877 - DNA, 25 bp, Mus musculus
ccacccccacccgagttctatccag

SEQ ID NO: 237878 - DNA, 25 bp, Mus musculus
ccacccccacgacccactgatgttc

SEQ ID NO: 237879 - DNA, 25 bp, Mus musculus
ccacccccagaaacgtgtgccgtca

SEQ ID NO: 237880 - DNA, 25 bp, Mus musculus
ccaccccccagcaagagccagaggg

SEQ ID NO: 237881 - DNA, 25 bp, Mus musculus
ccaccccccaggacatgacagatga

SEQ ID NO: 237882 - DNA, 25 bp, Mus musculus
ccacccccgcctcccagacagacaa

SEQ ID NO: 237883 - DNA, 25 bp, Mus musculus
ccacccccggaaggtatcatccgga

SEQ ID NO: 237884 - DNA, 25 bp, Mus musculus
ccaccccctaacaaggtcccaggca

SEQ ID NO: 237885 - DNA, 25 bp, Mus musculus
ccaccccctcccagagctctcttcc

SEQ ID NO: 237886 - DNA, 25 bp, Mus musculus
ccaccccctgtatccctctgaagaa

SEQ ID NO: 237887 - DNA, 25 bp, Mus musculus
ccaccccgaggtcaggacgaccaca

SEQ ID NO: 237888 - DNA, 25 bp, Mus musculus
ccaccccgctggcaaatctcatgca

SEQ ID NO: 237889 - DNA, 25 bp, Mus musculus
ccaccccgtgtcctatgcaccagct

SEQ ID NO: 237890 - DNA, 25 bp, Mus musculus
ccacccctcaagacggaggaggact

SEQ ID NO: 237891 - DNA, 25 bp, Mus musculus
ccacccctcaagcatgaccagtgtc

SEQ ID NO: 237892 - DNA, 25 bp, Mus musculus
ccacccctcaaggagcacttcaatt

SEQ ID NO: 237893 - DNA, 25 bp, Mus musculus
ccacccctcaagttcacagctccca

SEQ ID NO: 237894 - DNA, 25 bp, Mus musculus
ccacccctcaggtgttacatgtaga

SEQ ID NO: 237895 - DNA, 25 bp, Mus musculus
ccacccctgggactagctcaggccc

SEQ ID NO: 237896 - DNA, 25 bp, Mus musculus
ccacccctgggcaggtgttttagct

SEQ ID NO: 237897 - DNA, 25 bp, Mus musculus
ccaccccttcaggcagagagccagc

SEQ ID NO: 237898 - DNA, 25 bp, Mus musculus
ccaccccttgggggctcgctcccac

SEQ ID NO: 237899 - DNA, 25 bp, Mus musculus
ccacccgacagggccgcagcctcgt

SEQ ID NO: 237900 - DNA, 25 bp, Mus musculus
ccacccgacccagttaatctctcag

SEQ ID NO: 237901 - DNA, 25 bp, Mus musculus
ccacccgagcaagatcaacgaggat

SEQ ID NO: 237902 - DNA, 25 bp, Mus musculus
ccacccgcaagcccattacttcaca

SEQ ID NO: 237903 - DNA, 25 bp, Mus musculus
ccacccgcgagggtggcccgaggca

SEQ ID NO: 237904 - DNA, 25 bp, Mus musculus
ccacccgcgggggccctagctgctg

SEQ ID NO: 237905 - DNA, 25 bp, Mus musculus
ccacccgctcagcagcacaaaggca

SEQ ID NO: 237906 - DNA, 25 bp, Mus musculus
ccacccggacaaggactggttccac

SEQ ID NO: 237907 - DNA, 25 bp, Mus musculus
ccacccggagccgttatcctaggcg

SEQ ID NO: 237908 - DNA, 25 bp, Mus musculus
ccacccggaggagtgccggcattgg

SEQ ID NO: 237909 - DNA, 25 bp, Mus musculus
ccacccggccccatgggtcctccag

SEQ ID NO: 237910 - DNA, 25 bp, Mus musculus
ccaccctaaaaggaagtgctgcatg

SEQ ID NO: 237911 - DNA, 25 bp, Mus musculus
ccaccctaaaggagcggttccagtt

SEQ ID NO: 237912 - DNA, 25 bp, Mus musculus
ccaccctatgacaagaaaaagcgga

SEQ ID NO: 237913 - DNA, 25 bp, Mus musculus
ccaccctccagggatacggacagaa

SEQ ID NO: 237914 - DNA, 25 bp, Mus musculus
ccaccctctatcagcaggaatccag

SEQ ID NO: 237915 - DNA, 25 bp, Mus musculus
ccaccctctgggcatggctatcttc

SEQ ID NO: 237916 - DNA, 25 bp, Mus musculus
ccaccctctgtggatttcctgaaaa

SEQ ID NO: 237917 - DNA, 25 bp, Mus musculus
ccaccctgaaaagtgcaggtgtgca

SEQ ID NO: 237918 - DNA, 25 bp, Mus musculus
ccaccctgacaggatgcaagctgtt

SEQ ID NO: 237919 - DNA, 25 bp, Mus musculus
ccaccctgacaggcaggtaccacca

SEQ ID NO: 237920 - DNA, 25 bp, Mus musculus
ccaccctgacaggggcataaggaca

SEQ ID NO: 237921 - DNA, 25 bp, Mus musculus
ccaccctgcacctggtccttcgcct

SEQ ID NO: 237922 - DNA, 25 bp, Mus musculus
ccaccctgcggccacgaaacgatca

SEQ ID NO: 237923 - DNA, 25 bp, Mus musculus
ccaccctggagctagcatctcgctc

SEQ ID NO: 237924 - DNA, 25 bp, Mus musculus
ccaccctggagctagcatgctcacg

SEQ ID NO: 237925 - DNA, 25 bp, Mus musculus
ccaccctgtactgcattaacttcag

SEQ ID NO: 237926 - DNA, 25 bp, Mus musculus
ccaccctgtactgtgacaagggcac

SEQ ID NO: 237927 - DNA, 25 bp, Mus musculus
ccaccctgtcagaagcccagaggac

SEQ ID NO: 237928 - DNA, 25 bp, Mus musculus
ccaccctgtcaggccttgccagcac

SEQ ID NO: 237929 - DNA, 25 bp, Mus musculus
ccacccttgaaggtgaacaaggcaa

SEQ ID NO: 237930 - DNA, 25 bp, Mus musculus
ccacccttgagtcaagtccatcatc

SEQ ID NO: 237931 - DNA, 25 bp, Mus musculus
ccaccgaacacagtgaggatgccat

SEQ ID NO: 237932 - DNA, 25 bp, Mus musculus
ccaccgacaaggtacaaccacgttg

SEQ ID NO: 237933 - DNA, 25 bp, Mus musculus
ccaccgacatggtaaagaacttgtc

SEQ ID NO: 237934 - DNA, 25 bp, Mus musculus
ccaccgaccaggcagccacctggac

SEQ ID NO: 237935 - DNA, 25 bp, Mus musculus
ccaccgaccaggtcgtccgtactgc

SEQ ID NO: 237936 - DNA, 25 bp, Mus musculus
ccaccgaccagtggccacagttaag

SEQ ID NO: 237937 - DNA, 25 bp, Mus musculus
ccaccgacctgaaagctttacaact

SEQ ID NO: 237938 - DNA, 25 bp, Mus musculus
ccaccgacctgatcaagggatcaac

SEQ ID NO: 237939 - DNA, 25 bp, Mus musculus
ccaccgagcaggtgacattcccact

SEQ ID NO: 237940 - DNA, 25 bp, Mus musculus
ccaccgaggccagggactcagcgat

SEQ ID NO: 237941 - DNA, 25 bp, Mus musculus
ccaccgcagctgagatcgattatat

SEQ ID NO: 237942 - DNA, 25 bp, Mus musculus
ccaccgccaagagaataaagactcg

SEQ ID NO: 237943 - DNA, 25 bp, Mus musculus
ccaccgccaagatggattcatgggt

SEQ ID NO: 237944 - DNA, 25 bp, Mus musculus
ccaccgccactggcataaatgcagt

SEQ ID NO: 237945 - DNA, 25 bp, Mus musculus
ccaccgccatgcctgtctcctccct

SEQ ID NO: 237946 - DNA, 25 bp, Mus musculus
ccaccgccgcggcatggatgggcag

SEQ ID NO: 237947 - DNA, 25 bp, Mus musculus
ccaccgcgcaggcttgacatctagg

SEQ ID NO: 237948 - DNA, 25 bp, Mus musculus
ccaccgcggccgtgcagttggaatt

SEQ ID NO: 237949 - DNA, 25 bp, Mus musculus
ccaccgcgtaggatctttctcaagt

SEQ ID NO: 237950 - DNA, 25 bp, Mus musculus
ccaccgctagtctgaaagaaagact

SEQ ID NO: 237951 - DNA, 25 bp, Mus musculus
ccaccgctcaacaggtttgatggct

SEQ ID NO: 237952 - DNA, 25 bp, Mus musculus
ccaccgctcaacagttcccttcttc

SEQ ID NO: 237953 - DNA, 25 bp, Mus musculus
ccaccgctcaacgaaacggaaggtg

SEQ ID NO: 237954 - DNA, 25 bp, Mus musculus
ccaccgcttgaatctccccgaggtg

SEQ ID NO: 237955 - DNA, 25 bp, Mus musculus
ccaccggaactccatggtccccagt

SEQ ID NO: 237956 - DNA, 25 bp, Mus musculus
ccaccggaagccaggactccccgcg

SEQ ID NO: 237957 - DNA, 25 bp, Mus musculus
ccaccggaagccaggctgggtccta

SEQ ID NO: 237958 - DNA, 25 bp, Mus musculus
ccaccggacagcattcacaacgaca

SEQ ID NO: 237959 - DNA, 25 bp, Mus musculus
ccaccggacagcccaacggtagcgg

SEQ ID NO: 237960 - DNA, 25 bp, Mus musculus
ccaccggcacactcgatctgatttg

SEQ ID NO: 237961 - DNA, 25 bp, Mus musculus
ccaccggcaggggactttgtgcagc

SEQ ID NO: 237962 - DNA, 25 bp, Mus musculus
ccaccggctgcacagcccatctctg

SEQ ID NO: 237963 - DNA, 25 bp, Mus musculus
ccaccggctgcacaggagcaacacg

SEQ ID NO: 237964 - DNA, 25 bp, Mus musculus
ccaccggctgcacagtgacatgaaa

SEQ ID NO: 237965 - DNA, 25 bp, Mus musculus
ccaccggctggaggcatcatgacac

SEQ ID NO: 237966 - DNA, 25 bp, Mus musculus
ccaccgggcagatcctgccccgtcc

SEQ ID NO: 237967 - DNA, 25 bp, Mus musculus
ccaccggggaaaggaatggatggct

SEQ ID NO: 237968 - DNA, 25 bp, Mus musculus
ccaccggggaaagggatgattctga

SEQ ID NO: 237969 - DNA, 25 bp, Mus musculus
ccaccggggagaagaactggagaat

SEQ ID NO: 237970 - DNA, 25 bp, Mus musculus
ccaccggggagaagacctgtgtaga

SEQ ID NO: 237971 - DNA, 25 bp, Mus musculus
ccaccgggtcaaacagaggacagtg

SEQ ID NO: 237972 - DNA, 25 bp, Mus musculus
ccaccgtccggcaggggttcatggc

SEQ ID NO: 237973 - DNA, 25 bp, Mus musculus
ccaccgtccggcagtgttctcccgc

SEQ ID NO: 237974 - DNA, 25 bp, Mus musculus
ccaccgtcggtgctgcgatccggag

SEQ ID NO: 237975 - DNA, 25 bp, Mus musculus
ccaccgtcggtgctggccttcccag

SEQ ID NO: 237976 - DNA, 25 bp, Mus musculus
ccaccgtgcacccagaaatgtatga

SEQ ID NO: 237977 - DNA, 25 bp, Mus musculus
ccaccgtgcacccaggggggaagcc

SEQ ID NO: 237978 - DNA, 25 bp, Mus musculus
ccaccgtggacatcgttaaccagaa

SEQ ID NO: 237979 - DNA, 25 bp, Mus musculus
ccaccgtgggaggttctccagtggt

SEQ ID NO: 237980 - DNA, 25 bp, Mus musculus
ccaccgtgggagtggattttgctct

SEQ ID NO: 237981 - DNA, 25 bp, Mus musculus
ccaccgtggtacagcgccccgggat

SEQ ID NO: 237982 - DNA, 25 bp, Mus musculus
ccaccgtgtgacttctcagactttt

SEQ ID NO: 237983 - DNA, 25 bp, Mus musculus
ccaccgtgttcggggcgggccaatg

SEQ ID NO: 237984 - DNA, 25 bp, Mus musculus
ccaccgttattctcgatgaaacgga

SEQ ID NO: 237985 - DNA, 25 bp, Mus musculus
ccacctaaagagccactggacatgg

SEQ ID NO: 237986 - DNA, 25 bp, Mus musculus
ccacctaaagtactgaccaagtgcc

SEQ ID NO: 237987 - DNA, 25 bp, Mus musculus
ccacctaagacagcgaaggtgtccg

SEQ ID NO: 237988 - DNA, 25 bp, Mus musculus
ccacctacaaagagaaaaaactggc

SEQ ID NO: 237989 - DNA, 25 bp, Mus musculus
ccacctacaaagaggtcttctggga

SEQ ID NO: 237990 - DNA, 25 bp, Mus musculus
ccacctacaaccataggtacttcga

SEQ ID NO: 237991 - DNA, 25 bp, Mus musculus
ccacctacaatttccccgccgactg

SEQ ID NO: 237992 - DNA, 25 bp, Mus musculus
ccacctacagagaggaggcttctca

SEQ ID NO: 237993 - DNA, 25 bp, Mus musculus
ccacctacaggatgtcaatcgggag

SEQ ID NO: 237994 - DNA, 25 bp, Mus musculus
ccacctaccaggagaactatgagca

SEQ ID NO: 237995 - DNA, 25 bp, Mus musculus
ccacctaccagtgaaatcaactctt

SEQ ID NO: 237996 - DNA, 25 bp, Mus musculus
ccacctacccagaaggacggcacta

SEQ ID NO: 237997 - DNA, 25 bp, Mus musculus
ccacctacccagaaggacggcatta

SEQ ID NO: 237998 - DNA, 25 bp, Mus musculus
ccacctactgagctggtctgtaaca

SEQ ID NO: 237999 - DNA, 25 bp, Mus musculus
ccacctactggacccttttgtggaa

SEQ ID NO: 238000 - DNA, 25 bp, Mus musculus
ccacctactgggaccagcgggaagg

SEQ ID NO: 238001 - DNA, 25 bp, Mus musculus
ccacctactggggacttctggtccc

SEQ ID NO: 238002 - DNA, 25 bp, Mus musculus
ccacctacttgctggggcttcacgg

SEQ ID NO: 238003 - DNA, 25 bp, Mus musculus
ccacctatacaaactatatatttgt

SEQ ID NO: 238004 - DNA, 25 bp, Mus musculus
ccacctatccacccatgaacccaat

SEQ ID NO: 238005 - DNA, 25 bp, Mus musculus
ccacctcaaagagttgaaaagagcg

SEQ ID NO: 238006 - DNA, 25 bp, Mus musculus
ccacctcaaaggtctgtgttggaat

SEQ ID NO: 238007 - DNA, 25 bp, Mus musculus
ccacctcacagaatagcattccttt

SEQ ID NO: 238008 - DNA, 25 bp, Mus musculus
ccacctcacagaggagcagggacat

SEQ ID NO: 238009 - DNA, 25 bp, Mus musculus
ccacctcacagattcccggtcgggt

SEQ ID NO: 238010 - DNA, 25 bp, Mus musculus
ccacctcacgaggttcctggacatc

SEQ ID NO: 238011 - DNA, 25 bp, Mus musculus
ccacctccaaacagaagctccctga

SEQ ID NO: 238012 - DNA, 25 bp, Mus musculus
ccacctccaaacagtgaaggtgagc

SEQ ID NO: 238013 - DNA, 25 bp, Mus musculus
ccacctccaagaagccaaatcttat

SEQ ID NO: 238014 - DNA, 25 bp, Mus musculus
ccacctccaagaatggtggcatcta

SEQ ID NO: 238015 - DNA, 25 bp, Mus musculus
ccacctccaagtcagcctccaagac

SEQ ID NO: 238016 - DNA, 25 bp, Mus musculus
ccacctccacagcacaagagcaaga

SEQ ID NO: 238017 - DNA, 25 bp, Mus musculus
ccacctccagggtgaagttgattcc

SEQ ID NO: 238018 - DNA, 25 bp, Mus musculus
ccacctccagtcgcagatatggcca

SEQ ID NO: 238019 - DNA, 25 bp, Mus musculus
ccacctccagtgctgcgccattttg

SEQ ID NO: 238020 - DNA, 25 bp, Mus musculus
ccacctccagtgctgtaaccctcca

SEQ ID NO: 238021 - DNA, 25 bp, Mus musculus
ccacctccatcccaagcgcctgtgt

SEQ ID NO: 238022 - DNA, 25 bp, Mus musculus
ccacctccattttggattcgtaaac

SEQ ID NO: 238023 - DNA, 25 bp, Mus musculus
ccacctcccaagattccactttgaa

SEQ ID NO: 238024 - DNA, 25 bp, Mus musculus
ccacctcctccacggagcaggagcg

SEQ ID NO: 238025 - DNA, 25 bp, Mus musculus
ccacctcctccacggagcgagaggg

SEQ ID NO: 238026 - DNA, 25 bp, Mus musculus
ccacctcctgagaaattagaaggat

SEQ ID NO: 238027 - DNA, 25 bp, Mus musculus
ccacctcctgagaccatggtatcta

SEQ ID NO: 238028 - DNA, 25 bp, Mus musculus
ccacctcctgagtctagccgccggt

SEQ ID NO: 238029 - DNA, 25 bp, Mus musculus
ccacctcctgctctggtggctcctt

SEQ ID NO: 238030 - DNA, 25 bp, Mus musculus
ccacctcctgctggggtagacagca

SEQ ID NO: 238031 - DNA, 25 bp, Mus musculus
ccacctccttaaaaatataactgtc

SEQ ID NO: 238032 - DNA, 25 bp, Mus musculus
ccacctccttcctggcattggaggc

SEQ ID NO: 238033 - DNA, 25 bp, Mus musculus
ccacctcggcctctccatccgttcc

SEQ ID NO: 238034 - DNA, 25 bp, Mus musculus
ccacctctaaaggaggaagatgagg

SEQ ID NO: 238035 - DNA, 25 bp, Mus musculus
ccacctctacaagtgacatcttgaa

SEQ ID NO: 238036 - DNA, 25 bp, Mus musculus
ccacctctagaggcctataccattc

SEQ ID NO: 238037 - DNA, 25 bp, Mus musculus
ccacctctagagttgaccaagctgc

SEQ ID NO: 238038 - DNA, 25 bp, Mus musculus
ccacctctgcaaaagattcacagtc

SEQ ID NO: 238039 - DNA, 25 bp, Mus musculus
ccacctctgcaaaagcaatgtcttc

SEQ ID NO: 238040 - DNA, 25 bp, Mus musculus
ccacctctgcgatgctcaaaacatt

SEQ ID NO: 238041 - DNA, 25 bp, Mus musculus
ccacctcttccgaggacccacactc

SEQ ID NO: 238042 - DNA, 25 bp, Mus musculus
ccacctcttctgtggttggagacta

SEQ ID NO: 238043 - DNA, 25 bp, Mus musculus
ccacctcttctgttggccgtgttta

SEQ ID NO: 238044 - DNA, 25 bp, Mus musculus
ccacctctttactctcagatagcct

SEQ ID NO: 238045 - DNA, 25 bp, Mus musculus
ccacctgacaggtcacaaccatgtc

SEQ ID NO: 238046 - DNA, 25 bp, Mus musculus
ccacctgagagccagagctgttctg

SEQ ID NO: 238047 - DNA, 25 bp, Mus musculus
ccacctgagagccagatatccattg

SEQ ID NO: 238048 - DNA, 25 bp, Mus musculus
ccacctgagcctgctgctccagcct

SEQ ID NO: 238049 - DNA, 25 bp, Mus musculus
ccacctgagctggatgtaccctctg

SEQ ID NO: 238050 - DNA, 25 bp, Mus musculus
ccacctgatgaatcccaaaggccct

SEQ ID NO: 238051 - DNA, 25 bp, Mus musculus
ccacctgatgagccaggtctggaca

SEQ ID NO: 238052 - DNA, 25 bp, Mus musculus
ccacctgcaagacagccccggatta

SEQ ID NO: 238053 - DNA, 25 bp, Mus musculus
ccacctgcaagattctggtgctaag

SEQ ID NO: 238054 - DNA, 25 bp, Mus musculus
ccacctgcaagctacagacagcccc

SEQ ID NO: 238055 - DNA, 25 bp, Mus musculus
ccacctgcaaggttcactttaattg

SEQ ID NO: 238056 - DNA, 25 bp, Mus musculus
ccacctgcaagtctacagagagcca

SEQ ID NO: 238057 - DNA, 25 bp, Mus musculus
ccacctgcagctgcacgggcaggtg

SEQ ID NO: 238058 - DNA, 25 bp, Mus musculus
ccacctgccaagactgtggccgcag

SEQ ID NO: 238059 - DNA, 25 bp, Mus musculus
ccacctgccaagcatgatgtcaaag

SEQ ID NO: 238060 - DNA, 25 bp, Mus musculus
ccacctgccaagcattgtggcagat

SEQ ID NO: 238061 - DNA, 25 bp, Mus musculus
ccacctgccaagcatttccctccag

SEQ ID NO: 238062 - DNA, 25 bp, Mus musculus
ccacctgccagacgcacagccgagc

SEQ ID NO: 238063 - DNA, 25 bp, Mus musculus
ccacctgccccaaagacattctgcc

SEQ ID NO: 238064 - DNA, 25 bp, Mus musculus
ccacctgccttccagtgtgtggaca

SEQ ID NO: 238065 - DNA, 25 bp, Mus musculus
ccacctgccttccagtgtgtggtgt

SEQ ID NO: 238066 - DNA, 25 bp, Mus musculus
ccacctgcgcgacaggttttggctc

SEQ ID NO: 238067 - DNA, 25 bp, Mus musculus
ccacctgctccagcggggactctgg

SEQ ID NO: 238068 - DNA, 25 bp, Mus musculus
ccacctgcttgcagacctgatgcaa

SEQ ID NO: 238069 - DNA, 25 bp, Mus musculus
ccacctgcttgcaggcgatcctaaa

SEQ ID NO: 238070 - DNA, 25 bp, Mus musculus
ccacctgcttgcaggtggctttgct

SEQ ID NO: 238071 - DNA, 25 bp, Mus musculus
ccacctggacaggacaatgtatctt

SEQ ID NO: 238072 - DNA, 25 bp, Mus musculus
ccacctggacaggtcggaagctggt

SEQ ID NO: 238073 - DNA, 25 bp, Mus musculus
ccacctggagagcatcttcctggtc

SEQ ID NO: 238074 - DNA, 25 bp, Mus musculus
ccacctggagctacattgcctccct

SEQ ID NO: 238075 - DNA, 25 bp, Mus musculus
ccacctggcaagagaaatgtctcag

SEQ ID NO: 238076 - DNA, 25 bp, Mus musculus
ccacctggcgctcgagcacgggtcg

SEQ ID NO: 238077 - DNA, 25 bp, Mus musculus
ccacctgtagcaccactctcgctca

SEQ ID NO: 238078 - DNA, 25 bp, Mus musculus
ccacctgtagcacccctctactcaa

SEQ ID NO: 238079 - DNA, 25 bp, Mus musculus
ccacctgtcagacccgccaggagtt

SEQ ID NO: 238080 - DNA, 25 bp, Mus musculus
ccacctgtgaggtttcaagtgcccc

SEQ ID NO: 238081 - DNA, 25 bp, Mus musculus
ccacctgtgggtccttgctgccaaa

SEQ ID NO: 238082 - DNA, 25 bp, Mus musculus
ccacctgttccagaagttggcatcg

SEQ ID NO: 238083 - DNA, 25 bp, Mus musculus
ccacctgttgtgcagagttgtcttg

SEQ ID NO: 238084 - DNA, 25 bp, Mus musculus
ccaccttcagaatgaagaggaataa

SEQ ID NO: 238085 - DNA, 25 bp, Mus musculus
ccaccttcagacccaggcctgctcc

SEQ ID NO: 238086 - DNA, 25 bp, Mus musculus
ccaccttcagcaacaacacttgatt

SEQ ID NO: 238087 - DNA, 25 bp, Mus musculus
ccaccttcagtgattttataggtca

SEQ ID NO: 238088 - DNA, 25 bp, Mus musculus
ccaccttcctcctggcaggccaaaa

SEQ ID NO: 238089 - DNA, 25 bp, Mus musculus
ccaccttcggcactgcagtaacttc

SEQ ID NO: 238090 - DNA, 25 bp, Mus musculus
ccaccttctaacagtgctgctgaag

SEQ ID NO: 238091 - DNA, 25 bp, Mus musculus
ccaccttctacaattcccagcgaca

SEQ ID NO: 238092 - DNA, 25 bp, Mus musculus
ccaccttctctctcttcctcctggc

SEQ ID NO: 238093 - DNA, 25 bp, Mus musculus
ccaccttctgaagattccgagaggc

SEQ ID NO: 238094 - DNA, 25 bp, Mus musculus
ccaccttctgtcagacatgtgtaat

SEQ ID NO: 238095 - DNA, 25 bp, Mus musculus
ccaccttctgtcagctggcatgtgg

SEQ ID NO: 238096 - DNA, 25 bp, Mus musculus
ccaccttctgtcaggtccccctggc

SEQ ID NO: 238097 - DNA, 25 bp, Mus musculus
ccaccttgactcagtacgtcaagtg

SEQ ID NO: 238098 - DNA, 25 bp, Mus musculus
ccaccttgaggcctttcttccaggt

SEQ ID NO: 238099 - DNA, 25 bp, Mus musculus
ccaccttgagggaagtaaccaggag

SEQ ID NO: 238100 - DNA, 25 bp, Mus musculus
ccaccttgagggtcctgagtcccct

SEQ ID NO: 238101 - DNA, 25 bp, Mus musculus
ccaccttgatcagagtattgttaca

SEQ ID NO: 238102 - DNA, 25 bp, Mus musculus
ccaccttgccaggttctgccttaga

SEQ ID NO: 238103 - DNA, 25 bp, Mus musculus
ccaccttggagaagataaaaatata

SEQ ID NO: 238104 - DNA, 25 bp, Mus musculus
ccacctttcctgcagtatcaggagt

SEQ ID NO: 238105 - DNA, 25 bp, Mus musculus
ccacctttgaagactcggtgtggaa

SEQ ID NO: 238106 - DNA, 25 bp, Mus musculus
ccacctttgagatgacagagacaca

SEQ ID NO: 238107 - DNA, 25 bp, Mus musculus
ccacctttgaggaaaccaggaaaat

SEQ ID NO: 238108 - DNA, 25 bp, Mus musculus
ccacctttgagtgactgccaggatc

SEQ ID NO: 238109 - DNA, 25 bp, Mus musculus
ccacctttgatgagatatgtgtcac

SEQ ID NO: 238110 - DNA, 25 bp, Mus musculus
ccaccttttattctctcttgcctag

SEQ ID NO: 238111 - DNA, 25 bp, Mus musculus
ccacgaaaatctccttcgggctgat

SEQ ID NO: 238112 - DNA, 25 bp, Mus musculus
ccacgaactgggtgactttgccatg

SEQ ID NO: 238113 - DNA, 25 bp, Mus musculus
ccacgaactgggtgcagccctgggg

SEQ ID NO: 238114 - DNA, 25 bp, Mus musculus
ccacgaagaggaaatgcaggctctg

SEQ ID NO: 238115 - DNA, 25 bp, Mus musculus
ccacgaagccagaaggaggctcgca

SEQ ID NO: 238116 - DNA, 25 bp, Mus musculus
ccacgaaggatcttaccaatcctgg

SEQ ID NO: 238117 - DNA, 25 bp, Mus musculus
ccacgaaggatcttttttgctccag

SEQ ID NO: 238118 - DNA, 25 bp, Mus musculus
ccacgacgaaggaccccttctcctc

SEQ ID NO: 238119 - DNA, 25 bp, Mus musculus
ccacgacgacgacagtttcagccct

SEQ ID NO: 238120 - DNA, 25 bp, Mus musculus
ccacgacggcacagagctcctggcc

SEQ ID NO: 238121 - DNA, 25 bp, Mus musculus
ccacgagaaatgaaggactgcagta

SEQ ID NO: 238122 - DNA, 25 bp, Mus musculus
ccacgagaacgtcattgggctactg

SEQ ID NO: 238123 - DNA, 25 bp, Mus musculus
ccacgagaactggacatttggtccg

SEQ ID NO: 238124 - DNA, 25 bp, Mus musculus
ccacgagagtgagttccaggacagc

SEQ ID NO: 238125 - DNA, 25 bp, Mus musculus
ccacgagcagataagaggagtcctc

SEQ ID NO: 238126 - DNA, 25 bp, Mus musculus
ccacgagcagcccgaggagctcacc

SEQ ID NO: 238127 - DNA, 25 bp, Mus musculus
ccacgagcagttgttccaagttgcc

SEQ ID NO: 238128 - DNA, 25 bp, Mus musculus
ccacgagcgctcaggagaaatatga

SEQ ID NO: 238129 - DNA, 25 bp, Mus musculus
ccacgaggaacctttcacgatgaca

SEQ ID NO: 238130 - DNA, 25 bp, Mus musculus
ccacgaggagctgaaggaccagcct

SEQ ID NO: 238131 - DNA, 25 bp, Mus musculus
ccacgaggaggaaatgcaggctctg

SEQ ID NO: 238132 - DNA, 25 bp, Mus musculus
ccacgaggaggaaatggcctccatg

SEQ ID NO: 238133 - DNA, 25 bp, Mus musculus
ccacgaggaggtggccaccaacagc

SEQ ID NO: 238134 - DNA, 25 bp, Mus musculus
ccacgaggatcccaggaaagaaaag

SEQ ID NO: 238135 - DNA, 25 bp, Mus musculus
ccacgaggatcccagtcaggaacca

SEQ ID NO: 238136 - DNA, 25 bp, Mus musculus
ccacgaggccagatacctgactgtc

SEQ ID NO: 238137 - DNA, 25 bp, Mus musculus
ccacgagtgccaaaggtgtgactgc

SEQ ID NO: 238138 - DNA, 25 bp, Mus musculus
ccacgatgagtgaacagagtatctg

SEQ ID NO: 238139 - DNA, 25 bp, Mus musculus
ccacgatgctccagattctgtcccc

SEQ ID NO: 238140 - DNA, 25 bp, Mus musculus
ccacgatgctccaggaggagcctga

SEQ ID NO: 238141 - DNA, 25 bp, Mus musculus
ccacgatgtgtggaaattctctgca

SEQ ID NO: 238142 - DNA, 25 bp, Mus musculus
ccacgcacgaaaaacactctgtttc

SEQ ID NO: 238143 - DNA, 25 bp, Mus musculus
ccacgcactgcaagaaaacgaggag

SEQ ID NO: 238144 - DNA, 25 bp, Mus musculus
ccacgcactgcaagatctagatggc

SEQ ID NO: 238145 - DNA, 25 bp, Mus musculus
ccacgcagactagcatttcagatct

SEQ ID NO: 238146 - DNA, 25 bp, Mus musculus
ccacgcagaggaaagatggtccaga

SEQ ID NO: 238147 - DNA, 25 bp, Mus musculus
ccacgcagagggaaggtgtgaacct

SEQ ID NO: 238148 - DNA, 25 bp, Mus musculus
ccacgcagagggtctggagacatgg

SEQ ID NO: 238149 - DNA, 25 bp, Mus musculus
ccacgcagcctccaggaggcaagga

SEQ ID NO: 238150 - DNA, 25 bp, Mus musculus
ccacgcagcgctcgaaagaatagac

SEQ ID NO: 238151 - DNA, 25 bp, Mus musculus
ccacgcaggatcatgtgttcaacat

SEQ ID NO: 238152 - DNA, 25 bp, Mus musculus
ccacgcatcctccacctgtccctca

SEQ ID NO: 238153 - DNA, 25 bp, Mus musculus
ccacgcattttgccggaacccagat

SEQ ID NO: 238154 - DNA, 25 bp, Mus musculus
ccacgccaaactctggtggataccc

SEQ ID NO: 238155 - DNA, 25 bp, Mus musculus
ccacgccaaactctggttcttctgg

SEQ ID NO: 238156 - DNA, 25 bp, Mus musculus
ccacgccaaagagtggagttggaga

SEQ ID NO: 238157 - DNA, 25 bp, Mus musculus
ccacgccaaagagtggtgggcttat

SEQ ID NO: 238158 - DNA, 25 bp, Mus musculus
ccacgccacttgtcggcagctctgc

SEQ ID NO: 238159 - DNA, 25 bp, Mus musculus
ccacgccagagtttctcaggaatat

SEQ ID NO: 238160 - DNA, 25 bp, Mus musculus
ccacgccagcttagagtgcgatgcg

SEQ ID NO: 238161 - DNA, 25 bp, Mus musculus
ccacgccatggatgcagtgacctat

SEQ ID NO: 238162 - DNA, 25 bp, Mus musculus
ccacgccccatggtgtggacattgt

SEQ ID NO: 238163 - DNA, 25 bp, Mus musculus
ccacgcccccggatgatggtcactt

SEQ ID NO: 238164 - DNA, 25 bp, Mus musculus
ccacgcccttccaggtgactggtta

SEQ ID NO: 238165 - DNA, 25 bp, Mus musculus
ccacgccgatccggtaatatccttg

SEQ ID NO: 238166 - DNA, 25 bp, Mus musculus
ccacgcctgacattatcctggatga

SEQ ID NO: 238167 - DNA, 25 bp, Mus musculus
ccacgcctgattctggcaggtgatc

SEQ ID NO: 238168 - DNA, 25 bp, Mus musculus
ccacgcctgcctggggaatgaattc

SEQ ID NO: 238169 - DNA, 25 bp, Mus musculus
ccacgcctggcctctgccttcgggg

SEQ ID NO: 238170 - DNA, 25 bp, Mus musculus
ccacgcgcacaagaaatatggggtg

SEQ ID NO: 238171 - DNA, 25 bp, Mus musculus
ccacgcgcagcaacacctccagaag

SEQ ID NO: 238172 - DNA, 25 bp, Mus musculus
ccacgcgcagcgctgtgtagttctg

SEQ ID NO: 238173 - DNA, 25 bp, Mus musculus
ccacgcgccagggaatggacctgtc

SEQ ID NO: 238174 - DNA, 25 bp, Mus musculus
ccacgcgcctcagagtttgctattg

SEQ ID NO: 238175 - DNA, 25 bp, Mus musculus
ccacgcgcctcaggtagcactttgt

SEQ ID NO: 238176 - DNA, 25 bp, Mus musculus
ccacgcggcacagcccatgcagcct

SEQ ID NO: 238177 - DNA, 25 bp, Mus musculus
ccacgcggcacagccccctgcgggt

SEQ ID NO: 238178 - DNA, 25 bp, Mus musculus
ccacgcgggattccggtcacagttt

SEQ ID NO: 238179 - DNA, 25 bp, Mus musculus
ccacgcgggccatcctggccctcat

SEQ ID NO: 238180 - DNA, 25 bp, Mus musculus
ccacgcgtcagaggtccctctgtca

SEQ ID NO: 238181 - DNA, 25 bp, Mus musculus
ccacgctaagatgcccctagacctg

SEQ ID NO: 238182 - DNA, 25 bp, Mus musculus
ccacgctactcagggatgttccctt

SEQ ID NO: 238183 - DNA, 25 bp, Mus musculus
ccacgctactctgggcctcaggagt

SEQ ID NO: 238184 - DNA, 25 bp, Mus musculus
ccacgctatggacgcactgacatat

SEQ ID NO: 238185 - DNA, 25 bp, Mus musculus
ccacgctatgggattccaacctcca

SEQ ID NO: 238186 - DNA, 25 bp, Mus musculus
ccacgctcaagcagcccacacaccc

SEQ ID NO: 238187 - DNA, 25 bp, Mus musculus
ccacgctcaaggtgaccctgccctc

SEQ ID NO: 238188 - DNA, 25 bp, Mus musculus
ccacgctccagaggctttgctgacg

SEQ ID NO: 238189 - DNA, 25 bp, Mus musculus
ccacgctccagagtgtgcactctcc

SEQ ID NO: 238190 - DNA, 25 bp, Mus musculus
ccacgctccaggagaggcgggagat

SEQ ID NO: 238191 - DNA, 25 bp, Mus musculus
ccacgctctcaaggccgagtacaac

SEQ ID NO: 238192 - DNA, 25 bp, Mus musculus
ccacgctctcaaggtatagtcctag

SEQ ID NO: 238193 - DNA, 25 bp, Mus musculus
ccacgctgaagcaggcttccagcca

SEQ ID NO: 238194 - DNA, 25 bp, Mus musculus
ccacgctgaagcaggtcataaagcc

SEQ ID NO: 238195 - DNA, 25 bp, Mus musculus
ccacgctgcagcaccacaaagatga

SEQ ID NO: 238196 - DNA, 25 bp, Mus musculus
ccacgctgccataatgaagaagaag

SEQ ID NO: 238197 - DNA, 25 bp, Mus musculus
ccacgctgcctcagcaagccccgcc

SEQ ID NO: 238198 - DNA, 25 bp, Mus musculus
ccacgctggccagacagctgcagca

SEQ ID NO: 238199 - DNA, 25 bp, Mus musculus
ccacgctggccagataaggctagcc

SEQ ID NO: 238200 - DNA, 25 bp, Mus musculus
ccacgctggccagctgcctcaccct

SEQ ID NO: 238201 - DNA, 25 bp, Mus musculus
ccacgctggccaggtattgttagaa

SEQ ID NO: 238202 - DNA, 25 bp, Mus musculus
ccacgctgtggtgcggctgtgtggc

SEQ ID NO: 238203 - DNA, 25 bp, Mus musculus
ccacgcttagactagctgtgttact

SEQ ID NO: 238204 - DNA, 25 bp, Mus musculus
ccacgcttcaaggcgcaacctggtg

SEQ ID NO: 238205 - DNA, 25 bp, Mus musculus
ccacgcttcccggagagccttacga

SEQ ID NO: 238206 - DNA, 25 bp, Mus musculus
ccacgcttcccggagcacttggaat

SEQ ID NO: 238207 - DNA, 25 bp, Mus musculus
ccacgcttggaaagcaaatgcaata

SEQ ID NO: 238208 - DNA, 25 bp, Mus musculus
ccacgcttggaaagttgtccagtct

SEQ ID NO: 238209 - DNA, 25 bp, Mus musculus
ccacggaaccaaggtggctatggcg

SEQ ID NO: 238210 - DNA, 25 bp, Mus musculus
ccacggaactacagggtccaactga

SEQ ID NO: 238211 - DNA, 25 bp, Mus musculus
ccacggaagtgacacaatgaatcgc

SEQ ID NO: 238212 - DNA, 25 bp, Mus musculus
ccacggaagtgacagaatgaatcgc

SEQ ID NO: 238213 - DNA, 25 bp, Mus musculus
ccacggaatccagatggtgaactga

SEQ ID NO: 238214 - DNA, 25 bp, Mus musculus
ccacggaatccaggagtacaagaac

SEQ ID NO: 238215 - DNA, 25 bp, Mus musculus
ccacggaatccaggcacatggatac

SEQ ID NO: 238216 - DNA, 25 bp, Mus musculus
ccacggacggttcagaccatgacac

SEQ ID NO: 238217 - DNA, 25 bp, Mus musculus
ccacggagaggagggagggagccat

SEQ ID NO: 238218 - DNA, 25 bp, Mus musculus
ccacggagattagcggagccaggta

SEQ ID NO: 238219 - DNA, 25 bp, Mus musculus
ccacggagctcgtaccctacgggct

SEQ ID NO: 238220 - DNA, 25 bp, Mus musculus
ccacggaggatgaggatgaggaaga

SEQ ID NO: 238221 - DNA, 25 bp, Mus musculus
ccacggaggatgtcccgcatggttc

SEQ ID NO: 238222 - DNA, 25 bp, Mus musculus
ccacggagtcagaactgggctcttc

SEQ ID NO: 238223 - DNA, 25 bp, Mus musculus
ccacggagttctggaagaccgctgc

SEQ ID NO: 238224 - DNA, 25 bp, Mus musculus
ccacggatacttgtaagcggtaacc

SEQ ID NO: 238225 - DNA, 25 bp, Mus musculus
ccacggatgattcagagccccaggg

SEQ ID NO: 238226 - DNA, 25 bp, Mus musculus
ccacggatggaggaggagacaacaa

SEQ ID NO: 238227 - DNA, 25 bp, Mus musculus
ccacggatgttcaagacgcaagtgg

SEQ ID NO: 238228 - DNA, 25 bp, Mus musculus
ccacggcatcacaaggccatcgcca

SEQ ID NO: 238229 - DNA, 25 bp, Mus musculus
ccacggcatcacactatggagtgtt

SEQ ID NO: 238230 - DNA, 25 bp, Mus musculus
ccacggcatgcagaggaatctgggg

SEQ ID NO: 238231 - DNA, 25 bp, Mus musculus
ccacggcatgcagggtgtgtctgca

SEQ ID NO: 238232 - DNA, 25 bp, Mus musculus
ccacggccatcccagccaatggcag

SEQ ID NO: 238233 - DNA, 25 bp, Mus musculus
ccacggccatcccagccaccctggg

SEQ ID NO: 238234 - DNA, 25 bp, Mus musculus
ccacggccatggggtctgtgacagc

SEQ ID NO: 238235 - DNA, 25 bp, Mus musculus
ccacggcctctggactgccatcagt

SEQ ID NO: 238236 - DNA, 25 bp, Mus musculus
ccacggcctctggtgtttgcagaga

SEQ ID NO: 238237 - DNA, 25 bp, Mus musculus
ccacggcctggaggaggacagtggt

SEQ ID NO: 238238 - DNA, 25 bp, Mus musculus
ccacggcctggaggttgcagaggac

SEQ ID NO: 238239 - DNA, 25 bp, Mus musculus
ccacggcctgtgagctggatctcat

SEQ ID NO: 238240 - DNA, 25 bp, Mus musculus
ccacggcggtgcaagttgctccccg

SEQ ID NO: 238241 - DNA, 25 bp, Mus musculus
ccacggcggtgcctggagagcatgg

SEQ ID NO: 238242 - DNA, 25 bp, Mus musculus
ccacggctaccacagaagctgaacc

SEQ ID NO: 238243 - DNA, 25 bp, Mus musculus
ccacggctaccacagaggccttgcc

SEQ ID NO: 238244 - DNA, 25 bp, Mus musculus
ccacggctccaaggatgccaacaag

SEQ ID NO: 238245 - DNA, 25 bp, Mus musculus
ccacggctgctgacctcctgcagat

SEQ ID NO: 238246 - DNA, 25 bp, Mus musculus
ccacgggaacggagtgtgcaattct

SEQ ID NO: 238247 - DNA, 25 bp, Mus musculus
ccacgggatatatttgttaatggag

SEQ ID NO: 238248 - DNA, 25 bp, Mus musculus
ccacgggcagagacttaaagttctt

SEQ ID NO: 238249 - DNA, 25 bp, Mus musculus
ccacgggcagtgacttaaagttctt

SEQ ID NO: 238250 - DNA, 25 bp, Mus musculus
ccacgggcgaggacctatatccaga

SEQ ID NO: 238251 - DNA, 25 bp, Mus musculus
ccacggggacaggcaagtacattgc

SEQ ID NO: 238252 - DNA, 25 bp, Mus musculus
ccacggtattgagttggtcacaatg

SEQ ID NO: 238253 - DNA, 25 bp, Mus musculus
ccacggtccaggaagaatgtttctt

SEQ ID NO: 238254 - DNA, 25 bp, Mus musculus
ccacggtcctgaggtccacctccac

SEQ ID NO: 238255 - DNA, 25 bp, Mus musculus
ccacggtctggaggtcctgggcctt

SEQ ID NO: 238256 - DNA, 25 bp, Mus musculus
ccacggtgagagtctgggatgtgaa

SEQ ID NO: 238257 - DNA, 25 bp, Mus musculus
ccacggtgggggacccctgtgcagc

SEQ ID NO: 238258 - DNA, 25 bp, Mus musculus
ccacggtgggggattgctgctggac

SEQ ID NO: 238259 - DNA, 25 bp, Mus musculus
ccacgtacctagaacaccacgctgc

SEQ ID NO: 238260 - DNA, 25 bp, Mus musculus
ccacgtacctcaggctcatgtacag

SEQ ID NO: 238261 - DNA, 25 bp, Mus musculus
ccacgtacctcagtacaagcccacc

SEQ ID NO: 238262 - DNA, 25 bp, Mus musculus
ccacgtacctcagttctggctcaag

SEQ ID NO: 238263 - DNA, 25 bp, Mus musculus
ccacgtagagagttccctcagtacc

SEQ ID NO: 238264 - DNA, 25 bp, Mus musculus
ccacgtatgcaggctctgcctggta

SEQ ID NO: 238265 - DNA, 25 bp, Mus musculus
ccacgtcaagactctggaagctgtc

SEQ ID NO: 238266 - DNA, 25 bp, Mus musculus
ccacgtcaagatgtcacgtgaccag

SEQ ID NO: 238267 - DNA, 25 bp, Mus musculus
ccacgtcaccctggtcttcctcctc

SEQ ID NO: 238268 - DNA, 25 bp, Mus musculus
ccacgtcagtcctcgttgccattcc

SEQ ID NO: 238269 - DNA, 25 bp, Mus musculus
ccacgtccagtgcggctgctcctgg

SEQ ID NO: 238270 - DNA, 25 bp, Mus musculus
ccacgtccagtgcgggctgatgcat

SEQ ID NO: 238271 - DNA, 25 bp, Mus musculus
ccacgtccgtcaggtatttgtcaag

SEQ ID NO: 238272 - DNA, 25 bp, Mus musculus
ccacgtcctggggagtgaggacaga

SEQ ID NO: 238273 - DNA, 25 bp, Mus musculus
ccacgtcggctcagctggacagagg

SEQ ID NO: 238274 - DNA, 25 bp, Mus musculus
ccacgtctctgtggacacagaagcc

SEQ ID NO: 238275 - DNA, 25 bp, Mus musculus
ccacgtctgtgacaggtgacacggc

SEQ ID NO: 238276 - DNA, 25 bp, Mus musculus
ccacgtctgtgacagtggagatctc

SEQ ID NO: 238277 - DNA, 25 bp, Mus musculus
ccacgtgagagggtcgttgctccag

SEQ ID NO: 238278 - DNA, 25 bp, Mus musculus
ccacgtgagaggttggtactaagaa

SEQ ID NO: 238279 - DNA, 25 bp, Mus musculus
ccacgtgaggaacaaagacaaagcc

SEQ ID NO: 238280 - DNA, 25 bp, Mus musculus
ccacgtgatggagtatcccggcaag

SEQ ID NO: 238281 - DNA, 25 bp, Mus musculus
ccacgtgcaggaaacatccgagcct

SEQ ID NO: 238282 - DNA, 25 bp, Mus musculus
ccacgtgcgtgcttcttgccacctg

SEQ ID NO: 238283 - DNA, 25 bp, Mus musculus
ccacgtgctcctggcccagaatcct

SEQ ID NO: 238284 - DNA, 25 bp, Mus musculus
ccacgtgctgggcctggccaggagt

SEQ ID NO: 238285 - DNA, 25 bp, Mus musculus
ccacgtggagttcagcagcacttgg

SEQ ID NO: 238286 - DNA, 25 bp, Mus musculus
ccacgtggcctccagaagccaccat

SEQ ID NO: 238287 - DNA, 25 bp, Mus musculus
ccacgtggtggaaagataaggaatt

SEQ ID NO: 238288 - DNA, 25 bp, Mus musculus
ccacgtggttcagacagctgtcatc

SEQ ID NO: 238289 - DNA, 25 bp, Mus musculus
ccacgtggttcagggtctggagaca

SEQ ID NO: 238290 - DNA, 25 bp, Mus musculus
ccacgtgtgagattccctgctccag

SEQ ID NO: 238291 - DNA, 25 bp, Mus musculus
ccacgtgtgcagggtcctgtgggca

SEQ ID NO: 238292 - DNA, 25 bp, Mus musculus
ccacgttccctgacctcctgtaccc

SEQ ID NO: 238293 - DNA, 25 bp, Mus musculus
ccacgttctagattggccgtttgat

SEQ ID NO: 238294 - DNA, 25 bp, Mus musculus
ccacgttctaggctcctgtgctagt

SEQ ID NO: 238295 - DNA, 25 bp, Mus musculus
ccacgttgccgacttcctggtggct

SEQ ID NO: 238296 - DNA, 25 bp, Mus musculus
ccacgttgccgagaacctgccagat

SEQ ID NO: 238297 - DNA, 25 bp, Mus musculus
ccacgttgccgattttgtcctggat

SEQ ID NO: 238298 - DNA, 25 bp, Mus musculus
ccacgttgctctggtcgaatggtat

SEQ ID NO: 238299 - DNA, 25 bp, Mus musculus
ccacgttgttcatggggcagtaaat

SEQ ID NO: 238300 - DNA, 25 bp, Mus musculus
ccacgttttctcctcagagctgcgc

SEQ ID NO: 238301 - DNA, 25 bp, Mus musculus
ccactaaacgattggtgacccagaa

SEQ ID NO: 238302 - DNA, 25 bp, Mus musculus
ccactaaagacgtaagttgaagatg

SEQ ID NO: 238303 - DNA, 25 bp, Mus musculus
ccactaaagactgacacgtttaggg

SEQ ID NO: 238304 - DNA, 25 bp, Mus musculus
ccactaaatagtgaggatgacccgg

SEQ ID NO: 238305 - DNA, 25 bp, Mus musculus
ccactaacagctctatttcagtgct

SEQ ID NO: 238306 - DNA, 25 bp, Mus musculus
ccactaacagtgcttctctcctccc

SEQ ID NO: 238307 - DNA, 25 bp, Mus musculus
ccactaacatctaaggtgccaagtg

SEQ ID NO: 238308 - DNA, 25 bp, Mus musculus
ccactaacttctgggccaacaaatt

SEQ ID NO: 238309 - DNA, 25 bp, Mus musculus
ccactaagagcccaggttgtctgtt

SEQ ID NO: 238310 - DNA, 25 bp, Mus musculus
ccactaagagcccagtgccatgtcg

SEQ ID NO: 238311 - DNA, 25 bp, Mus musculus
ccactaagggggcagccttgcagca

SEQ ID NO: 238312 - DNA, 25 bp, Mus musculus
ccactaagggggcagctttgtcgaa

SEQ ID NO: 238313 - DNA, 25 bp, Mus musculus
ccactaatgtcgaaagagatgacat

SEQ ID NO: 238314 - DNA, 25 bp, Mus musculus
ccactaatgtcggcacaccattccc

SEQ ID NO: 238315 - DNA, 25 bp, Mus musculus
ccactacaagatgaggtctcaatat

SEQ ID NO: 238316 - DNA, 25 bp, Mus musculus
ccactaccagaatgttgaccccaac

SEQ ID NO: 238317 - DNA, 25 bp, Mus musculus
ccactaccatcacagagtcaaatcc

SEQ ID NO: 238318 - DNA, 25 bp, Mus musculus
ccactaccccgggaggcaccaggat

SEQ ID NO: 238319 - DNA, 25 bp, Mus musculus
ccactaccgcatgaggttctacttt

SEQ ID NO: 238320 - DNA, 25 bp, Mus musculus
ccactacctacagcggcagaacccg

SEQ ID NO: 238321 - DNA, 25 bp, Mus musculus
ccactacgcaggaggattacaacca

SEQ ID NO: 238322 - DNA, 25 bp, Mus musculus
ccactacgcagttaccgtgacggtg

SEQ ID NO: 238323 - DNA, 25 bp, Mus musculus
ccactacgggcagtgatgatgactg

SEQ ID NO: 238324 - DNA, 25 bp, Mus musculus
ccactactcacctggttcaaccaga

SEQ ID NO: 238325 - DNA, 25 bp, Mus musculus
ccactactgtttcaacttctactac

SEQ ID NO: 238326 - DNA, 25 bp, Mus musculus
ccactagacgaaggaaacagcaaga

SEQ ID NO: 238327 - DNA, 25 bp, Mus musculus
ccactagacggttcttcatgagaag

SEQ ID NO: 238328 - DNA, 25 bp, Mus musculus
ccactagaggtgggccaaggattct

SEQ ID NO: 238329 - DNA, 25 bp, Mus musculus
ccactagcacgaaagagaccagcta

SEQ ID NO: 238330 - DNA, 25 bp, Mus musculus
ccactagtcgataaggttgaaagac

SEQ ID NO: 238331 - DNA, 25 bp, Mus musculus
ccactagtcggaggtgtatcgttac

SEQ ID NO: 238332 - DNA, 25 bp, Mus musculus
ccactagtcggagttacagccgctg

SEQ ID NO: 238333 - DNA, 25 bp, Mus musculus
ccactatgatatcctcttgtttgcc

SEQ ID NO: 238334 - DNA, 25 bp, Mus musculus
ccactatgctgctgtgtgctgctct

SEQ ID NO: 238335 - DNA, 25 bp, Mus musculus
ccactattaaaagagggtgcctcag

SEQ ID NO: 238336 - DNA, 25 bp, Mus musculus
ccactattgagcatgacctcctgct

SEQ ID NO: 238337 - DNA, 25 bp, Mus musculus
ccactattggctgggcaatgaatgc

SEQ ID NO: 238338 - DNA, 25 bp, Mus musculus
ccactattggcttaagtttgctgtg

SEQ ID NO: 238339 - DNA, 25 bp, Mus musculus
ccactattggggcatctttcatgac

SEQ ID NO: 238340 - DNA, 25 bp, Mus musculus
ccactcacaactcacatccttgtct

SEQ ID NO: 238341 - DNA, 25 bp, Mus musculus
ccactcacaccaaaggagtgccagg

SEQ ID NO: 238342 - DNA, 25 bp, Mus musculus
ccactcacgacggctccagggaact

SEQ ID NO: 238343 - DNA, 25 bp, Mus musculus
ccactcaggaaacaacagatccccc

SEQ ID NO: 238344 - DNA, 25 bp, Mus musculus
ccactcaggaccctggaaccctcac

SEQ ID NO: 238345 - DNA, 25 bp, Mus musculus
ccactcatatgatacagatttcaac

SEQ ID NO: 238346 - DNA, 25 bp, Mus musculus
ccactcatatgatttcaaccagttg

SEQ ID NO: 238347 - DNA, 25 bp, Mus musculus
ccactcatcaccaaggaggatataa

SEQ ID NO: 238348 - DNA, 25 bp, Mus musculus
ccactcatctttgtgggcggggcct

SEQ ID NO: 238349 - DNA, 25 bp, Mus musculus
ccactcattcagggagtgttgtgaa

SEQ ID NO: 238350 - DNA, 25 bp, Mus musculus
ccactccagctgcagcagttctatg

SEQ ID NO: 238351 - DNA, 25 bp, Mus musculus
ccactccagctgcaggatgaagtgg

SEQ ID NO: 238352 - DNA, 25 bp, Mus musculus
ccactccaggcagcttcttcggctt

SEQ ID NO: 238353 - DNA, 25 bp, Mus musculus
ccactccatggattgccggaacttg

SEQ ID NO: 238354 - DNA, 25 bp, Mus musculus
ccactcccaatgacggtcaagatgc

SEQ ID NO: 238355 - DNA, 25 bp, Mus musculus
ccactccccagagcctcaagtcaga

SEQ ID NO: 238356 - DNA, 25 bp, Mus musculus
ccactccctacaagtccctgagttg

SEQ ID NO: 238357 - DNA, 25 bp, Mus musculus
ccactccctaccgaggatgcttgag

SEQ ID NO: 238358 - DNA, 25 bp, Mus musculus
ccactccctaggtgttgggagccct

SEQ ID NO: 238359 - DNA, 25 bp, Mus musculus
ccactccctctggctctctcaaaag

SEQ ID NO: 238360 - DNA, 25 bp, Mus musculus
ccactccgacaagatgaaagaaaca

SEQ ID NO: 238361 - DNA, 25 bp, Mus musculus
ccactccggacacagaatatccagt

SEQ ID NO: 238362 - DNA, 25 bp, Mus musculus
ccactccggcggccccgcaatctgt

SEQ ID NO: 238363 - DNA, 25 bp, Mus musculus
ccactcctagctccaccccccgggc

SEQ ID NO: 238364 - DNA, 25 bp, Mus musculus
ccactcctctggatcccagagtgct

SEQ ID NO: 238365 - DNA, 25 bp, Mus musculus
ccactcctcttgcagatactggagt

SEQ ID NO: 238366 - DNA, 25 bp, Mus musculus
ccactcctgactccgttcaacacac

SEQ ID NO: 238367 - DNA, 25 bp, Mus musculus
ccactccttccaggatcccctgccg

SEQ ID NO: 238368 - DNA, 25 bp, Mus musculus
ccactcgaccaggttctgggctgac

SEQ ID NO: 238369 - DNA, 25 bp, Mus musculus
ccactcgcacaccgagagaacaacc

SEQ ID NO: 238370 - DNA, 25 bp, Mus musculus
ccactcgcagaggaccgccttcaac

SEQ ID NO: 238371 - DNA, 25 bp, Mus musculus
ccactctacagcttggccagcaaag

SEQ ID NO: 238372 - DNA, 25 bp, Mus musculus
ccactctacaggttcacctggtcat

SEQ ID NO: 238373 - DNA, 25 bp, Mus musculus
ccactctagcagtgttccgaatgcc

SEQ ID NO: 238374 - DNA, 25 bp, Mus musculus
ccactctcagagttttgtacactcc

SEQ ID NO: 238375 - DNA, 25 bp, Mus musculus
ccactctcctgaacttccaggtcct

SEQ ID NO: 238376 - DNA, 25 bp, Mus musculus
ccactctcctgggctgcaactggac

SEQ ID NO: 238377 - DNA, 25 bp, Mus musculus
ccactctcctggtcctgagtcagaa

SEQ ID NO: 238378 - DNA, 25 bp, Mus musculus
ccactctcgggaagttattggagac

SEQ ID NO: 238379 - DNA, 25 bp, Mus musculus
ccactctgaacttaacatctctgaa

SEQ ID NO: 238380 - DNA, 25 bp, Mus musculus
ccactctgaggagaagaattgagcc

SEQ ID NO: 238381 - DNA, 25 bp, Mus musculus
ccactctgaggtccagagttcaaat

SEQ ID NO: 238382 - DNA, 25 bp, Mus musculus
ccactctgcaaagtgacccagacta

SEQ ID NO: 238383 - DNA, 25 bp, Mus musculus
ccactctgcaaagtggcctatgagg

SEQ ID NO: 238384 - DNA, 25 bp, Mus musculus
ccactctggacaccgatgactttgt

SEQ ID NO: 238385 - DNA, 25 bp, Mus musculus
ccactctggacaccgccacagtaca

SEQ ID NO: 238386 - DNA, 25 bp, Mus musculus
ccactctggagccccatgtggaacc

SEQ ID NO: 238387 - DNA, 25 bp, Mus musculus
ccactctgggaggagcctgagtttt

SEQ ID NO: 238388 - DNA, 25 bp, Mus musculus
ccactctgtcaaggcccgagaccag

SEQ ID NO: 238389 - DNA, 25 bp, Mus musculus
ccactcttaccgatcagcaccagtg

SEQ ID NO: 238390 - DNA, 25 bp, Mus musculus
ccactcttcagttctgagaagaagt

SEQ ID NO: 238391 - DNA, 25 bp, Mus musculus
ccactcttccctcctatcccctgct

SEQ ID NO: 238392 - DNA, 25 bp, Mus musculus
ccactcttgaagatgccgagatgtt

SEQ ID NO: 238393 - DNA, 25 bp, Mus musculus
ccactcttgaaggatgcccaccacc

SEQ ID NO: 238394 - DNA, 25 bp, Mus musculus
ccactcttgtaaagtaccagtgctg

SEQ ID NO: 238395 - DNA, 25 bp, Mus musculus
ccactcttgtaaagttacaagccca

SEQ ID NO: 238396 - DNA, 25 bp, Mus musculus
ccactctttcctcccttggagttcc

SEQ ID NO: 238397 - DNA, 25 bp, Mus musculus
ccactgaaacattttaacagtgatg

SEQ ID NO: 238398 - DNA, 25 bp, Mus musculus
ccactgaaaccaaggctggtctgct

SEQ ID NO: 238399 - DNA, 25 bp, Mus musculus
ccactgaaagactcgccagtgatgg

SEQ ID NO: 238400 - DNA, 25 bp, Mus musculus
ccactgaagactgagataccagaga

SEQ ID NO: 238401 - DNA, 25 bp, Mus musculus
ccactgaagatgatgcttctgtgaa

SEQ ID NO: 238402 - DNA, 25 bp, Mus musculus
ccactgaagatggactggaaacata

SEQ ID NO: 238403 - DNA, 25 bp, Mus musculus
ccactgaatcctgagcaatggaaga

SEQ ID NO: 238404 - DNA, 25 bp, Mus musculus
ccactgaatcctgaggtgcagcgtg

SEQ ID NO: 238405 - DNA, 25 bp, Mus musculus
ccactgacagaaacaaataaaacct

SEQ ID NO: 238406 - DNA, 25 bp, Mus musculus
ccactgacagaaaccgtaatcctcc

SEQ ID NO: 238407 - DNA, 25 bp, Mus musculus
ccactgacccagactctcaggtgga

SEQ ID NO: 238408 - DNA, 25 bp, Mus musculus
ccactgaccgagaagtgcccccgcc

SEQ ID NO: 238409 - DNA, 25 bp, Mus musculus
ccactgagaccccgagtggaaagct

SEQ ID NO: 238410 - DNA, 25 bp, Mus musculus
ccactgagagcaggagatctggaac

SEQ ID NO: 238411 - DNA, 25 bp, Mus musculus
ccactgagagcattccagtgtcaga

SEQ ID NO: 238412 - DNA, 25 bp, Mus musculus
ccactgagcccatggttccaggatg

SEQ ID NO: 238413 - DNA, 25 bp, Mus musculus
ccactgagcgaccagagatgtggct

SEQ ID NO: 238414 - DNA, 25 bp, Mus musculus
ccactgagcgaccaggacaggattc

SEQ ID NO: 238415 - DNA, 25 bp, Mus musculus
ccactgaggatgacatccgtggaca

SEQ ID NO: 238416 - DNA, 25 bp, Mus musculus
ccactgataccatcctcatcccttt

SEQ ID NO: 238417 - DNA, 25 bp, Mus musculus
ccactgatcctggaggctgttcatc

SEQ ID NO: 238418 - DNA, 25 bp, Mus musculus
ccactgatgagagaggtcctccggg

SEQ ID NO: 238419 - DNA, 25 bp, Mus musculus
ccactgcaaggggagcagcgcggtg

SEQ ID NO: 238420 - DNA, 25 bp, Mus musculus
ccactgcaaggtgctgagacgtgag

SEQ ID NO: 238421 - DNA, 25 bp, Mus musculus
ccactgcacagattgcatctgggta

SEQ ID NO: 238422 - DNA, 25 bp, Mus musculus
ccactgcacagcgaccagcagccag

SEQ ID NO: 238423 - DNA, 25 bp, Mus musculus
ccactgcagcaggggccctccctga

SEQ ID NO: 238424 - DNA, 25 bp, Mus musculus
ccactgcagccaaagggtggatacc

SEQ ID NO: 238425 - DNA, 25 bp, Mus musculus
ccactgcaggatttctggcaccaga

SEQ ID NO: 238426 - DNA, 25 bp, Mus musculus
ccactgcatcaacacaaacttgacc

SEQ ID NO: 238427 - DNA, 25 bp, Mus musculus
ccactgcattgaacagcgtctgttg

SEQ ID NO: 238428 - DNA, 25 bp, Mus musculus
ccactgccagacccaggcaccccgc

SEQ ID NO: 238429 - DNA, 25 bp, Mus musculus
ccactgccaggtcagatgctgctga

SEQ ID NO: 238430 - DNA, 25 bp, Mus musculus
ccactgccagtggccaaacgaaaga

SEQ ID NO: 238431 - DNA, 25 bp, Mus musculus
ccactgccataatgacaagtaccag

SEQ ID NO: 238432 - DNA, 25 bp, Mus musculus
ccactgccatgagagctgtttgaca

SEQ ID NO: 238433 - DNA, 25 bp, Mus musculus
ccactgccatgtcagccagtataat

SEQ ID NO: 238434 - DNA, 25 bp, Mus musculus
ccactgccatgtcccagtatgaggt

SEQ ID NO: 238435 - DNA, 25 bp, Mus musculus
ccactgcccagattttcactgtaac

SEQ ID NO: 238436 - DNA, 25 bp, Mus musculus
ccactgccggatcctaataactatt

SEQ ID NO: 238437 - DNA, 25 bp, Mus musculus
ccactgcgcgccggagcctggcgac

SEQ ID NO: 238438 - DNA, 25 bp, Mus musculus
ccactgcgcgcgcccggcatgcctg

SEQ ID NO: 238439 - DNA, 25 bp, Mus musculus
ccactgcgctccaggtgccacatca

SEQ ID NO: 238440 - DNA, 25 bp, Mus musculus
ccactgcggcaagtttgatggtgac

SEQ ID NO: 238441 - DNA, 25 bp, Mus musculus
ccactgcgggcccagttgctgatag

SEQ ID NO: 238442 - DNA, 25 bp, Mus musculus
ccactgcgtctcttggcctgtggag

SEQ ID NO: 238443 - DNA, 25 bp, Mus musculus
ccactgctaagatttgaattctgtg

SEQ ID NO: 238444 - DNA, 25 bp, Mus musculus
ccactgctacagctgctcctacaca

SEQ ID NO: 238445 - DNA, 25 bp, Mus musculus
ccactgctacccaagcagggtggcc

SEQ ID NO: 238446 - DNA, 25 bp, Mus musculus
ccactgctatggcaaccagtataat

SEQ ID NO: 238447 - DNA, 25 bp, Mus musculus
ccactgctatggcaatgacaccagc

SEQ ID NO: 238448 - DNA, 25 bp, Mus musculus
ccactgctatgtcgaccagtatgag

SEQ ID NO: 238449 - DNA, 25 bp, Mus musculus
ccactgctcaggttgaaggtttgaa

SEQ ID NO: 238450 - DNA, 25 bp, Mus musculus
ccactgctccagggatccagaagga

SEQ ID NO: 238451 - DNA, 25 bp, Mus musculus
ccactgctctggctcgacttcggat

SEQ ID NO: 238452 - DNA, 25 bp, Mus musculus
ccactgctgaggcggacaaatcagc

SEQ ID NO: 238453 - DNA, 25 bp, Mus musculus
ccactgctgatggagcatctgggtg

SEQ ID NO: 238454 - DNA, 25 bp, Mus musculus
ccactgctgatggagctatatacgc

SEQ ID NO: 238455 - DNA, 25 bp, Mus musculus
ccactgctgtgagtgcccgctatgg

SEQ ID NO: 238456 - DNA, 25 bp, Mus musculus
ccactgcttctctgggtctgtgaac

SEQ ID NO: 238457 - DNA, 25 bp, Mus musculus
ccactgcttggcctgtccactggga

SEQ ID NO: 238458 - DNA, 25 bp, Mus musculus
ccactgctttgcctgtaccccagta

SEQ ID NO: 238459 - DNA, 25 bp, Mus musculus
ccactggactgcatggtctgagacg

SEQ ID NO: 238460 - DNA, 25 bp, Mus musculus
ccactggagaggaactgtccgactg

SEQ ID NO: 238461 - DNA, 25 bp, Mus musculus
ccactggagcagctaaatgagatgc

SEQ ID NO: 238462 - DNA, 25 bp, Mus musculus
ccactggagcagggtcggtgatgga

SEQ ID NO: 238463 - DNA, 25 bp, Mus musculus
ccactggcaagatgtgctagttggc

SEQ ID NO: 238464 - DNA, 25 bp, Mus musculus
ccactggcaaggctggtacaaggac

SEQ ID NO: 238465 - DNA, 25 bp, Mus musculus
ccactggcacaggagacactgcagg

SEQ ID NO: 238466 - DNA, 25 bp, Mus musculus
ccactggcactacagatgctcatga

SEQ ID NO: 238467 - DNA, 25 bp, Mus musculus
ccactggcctctcggacctcaggca

SEQ ID NO: 238468 - DNA, 25 bp, Mus musculus
ccactggccttcgagtttgatcctg

SEQ ID NO: 238469 - DNA, 25 bp, Mus musculus
ccactggctatgaggacgtagcaaa

SEQ ID NO: 238470 - DNA, 25 bp, Mus musculus
ccactggctttcagggacttcctgg

SEQ ID NO: 238471 - DNA, 25 bp, Mus musculus
ccactgggacaggacctctggaagc

SEQ ID NO: 238472 - DNA, 25 bp, Mus musculus
ccactgggacagggatcatagacga

SEQ ID NO: 238473 - DNA, 25 bp, Mus musculus
ccactgggacgcggccatccatggc

SEQ ID NO: 238474 - DNA, 25 bp, Mus musculus
ccactgggacgcgttctgtggatct

SEQ ID NO: 238475 - DNA, 25 bp, Mus musculus
ccactgggagtgaggcccagcctgc

SEQ ID NO: 238476 - DNA, 25 bp, Mus musculus
ccactggggaaaagggaaagcttgg

SEQ ID NO: 238477 - DNA, 25 bp, Mus musculus
ccactggtcaacacaaaacacagat

SEQ ID NO: 238478 - DNA, 25 bp, Mus musculus
ccactggtcaacactaaacacagat

SEQ ID NO: 238479 - DNA, 25 bp, Mus musculus
ccactggtcaaggcaactattggcc

SEQ ID NO: 238480 - DNA, 25 bp, Mus musculus
ccactggtgaagaagcaggccagca

SEQ ID NO: 238481 - DNA, 25 bp, Mus musculus
ccactggtgcgaacaaagtctcccc

SEQ ID NO: 238482 - DNA, 25 bp, Mus musculus
ccactggttgagatcctctttagga

SEQ ID NO: 238483 - DNA, 25 bp, Mus musculus
ccactggttgagggcaatggcatct

SEQ ID NO: 238484 - DNA, 25 bp, Mus musculus
ccactgtaaatggagatcgctctgg

SEQ ID NO: 238485 - DNA, 25 bp, Mus musculus
ccactgtacaacatcagccatgcac

SEQ ID NO: 238486 - DNA, 25 bp, Mus musculus
ccactgtacaacttgactggtctga

SEQ ID NO: 238487 - DNA, 25 bp, Mus musculus
ccactgtaccaaggcagctcaggct

SEQ ID NO: 238488 - DNA, 25 bp, Mus musculus
ccactgtaccaagtgcagctcagtc

SEQ ID NO: 238489 - DNA, 25 bp, Mus musculus
ccactgtatcacttgatattaaact

SEQ ID NO: 238490 - DNA, 25 bp, Mus musculus
ccactgtcaatatgagaagaacaaa

SEQ ID NO: 238491 - DNA, 25 bp, Mus musculus
ccactgtcaatatgatataaatgaa

SEQ ID NO: 238492 - DNA, 25 bp, Mus musculus
ccactgtcacggtctgtctgacact

SEQ ID NO: 238493 - DNA, 25 bp, Mus musculus
ccactgtcagaagagaaaactgcca

SEQ ID NO: 238494 - DNA, 25 bp, Mus musculus
ccactgtcagagctaaacagaaaga

SEQ ID NO: 238495 - DNA, 25 bp, Mus musculus
ccactgtccgccgggagcagcaacc

SEQ ID NO: 238496 - DNA, 25 bp, Mus musculus
ccactgtcctcactatgcccgaccc

SEQ ID NO: 238497 - DNA, 25 bp, Mus musculus
ccactgtcgacccgacaaaacttac

SEQ ID NO: 238498 - DNA, 25 bp, Mus musculus
ccactgtcgacccggaggaggagga

SEQ ID NO: 238499 - DNA, 25 bp, Mus musculus
ccactgtgaaaccgagaccaactac

SEQ ID NO: 238500 - DNA, 25 bp, Mus musculus
ccactgtgaaaccggttgttctaca

SEQ ID NO: 238501 - DNA, 25 bp, Mus musculus
ccactgtgagcttcaacctggctct

SEQ ID NO: 238502 - DNA, 25 bp, Mus musculus
ccactgtgaggatatcaatgaatgc

SEQ ID NO: 238503 - DNA, 25 bp, Mus musculus
ccactgtgccactcctgcctggaat

SEQ ID NO: 238504 - DNA, 25 bp, Mus musculus
ccactgtgccagcaccagaccctag

SEQ ID NO: 238505 - DNA, 25 bp, Mus musculus
ccactgtgctaagaggtccagcatg

SEQ ID NO: 238506 - DNA, 25 bp, Mus musculus
ccactgtgctaagtgacattgacca

SEQ ID NO: 238507 - DNA, 25 bp, Mus musculus
ccactgtggaaggaagtttggcacc

SEQ ID NO: 238508 - DNA, 25 bp, Mus musculus
ccactgtggccaggtccttcattcc

SEQ ID NO: 238509 - DNA, 25 bp, Mus musculus
ccactgtgtacccaggaataaaacc

SEQ ID NO: 238510 - DNA, 25 bp, Mus musculus
ccactgtgtacccaggttgtgacta

SEQ ID NO: 238511 - DNA, 25 bp, Mus musculus
ccactgtgtatatggacatctggat

SEQ ID NO: 238512 - DNA, 25 bp, Mus musculus
ccactgtgtcaggtgtggcccatag

SEQ ID NO: 238513 - DNA, 25 bp, Mus musculus
ccactgtgtggaagaacccctcagc

SEQ ID NO: 238514 - DNA, 25 bp, Mus musculus
ccactgtgtgtctgcctcgtgcctc

SEQ ID NO: 238515 - DNA, 25 bp, Mus musculus
ccactgtgttgagcacatcgagtca

SEQ ID NO: 238516 - DNA, 25 bp, Mus musculus
ccactgtgttgaggtcctgagttca

SEQ ID NO: 238517 - DNA, 25 bp, Mus musculus
ccactgtgttgccagaaaaagatct

SEQ ID NO: 238518 - DNA, 25 bp, Mus musculus
ccactgttccatgtctccaggaaac

SEQ ID NO: 238519 - DNA, 25 bp, Mus musculus
ccactgttctacaggctgcggctgt

SEQ ID NO: 238520 - DNA, 25 bp, Mus musculus
ccactgttctgcaggcttgcgagaa

SEQ ID NO: 238521 - DNA, 25 bp, Mus musculus
ccactgtttccgagaagagtagcag

SEQ ID NO: 238522 - DNA, 25 bp, Mus musculus
ccactgtttccgagggtcagataac

SEQ ID NO: 238523 - DNA, 25 bp, Mus musculus
ccactgtttggagaaatcttcaaga

SEQ ID NO: 238524 - DNA, 25 bp, Mus musculus
ccacttacacaggccgccccgggac

SEQ ID NO: 238525 - DNA, 25 bp, Mus musculus
ccacttactacaatttctgaagtga

SEQ ID NO: 238526 - DNA, 25 bp, Mus musculus
ccacttactgaactgatggctgccc

SEQ ID NO: 238527 - DNA, 25 bp, Mus musculus
ccacttactggtgcccggcgcccct

SEQ ID NO: 238528 - DNA, 25 bp, Mus musculus
ccacttaggaggcacatagacattt

SEQ ID NO: 238529 - DNA, 25 bp, Mus musculus
ccacttatcacttcattgtatctgg

SEQ ID NO: 238530 - DNA, 25 bp, Mus musculus
ccacttatcagttcattgtatctgg

SEQ ID NO: 238531 - DNA, 25 bp, Mus musculus
ccacttcaaatggacccataactgg

SEQ ID NO: 238532 - DNA, 25 bp, Mus musculus
ccacttcaaatgggaagaagatgga

SEQ ID NO: 238533 - DNA, 25 bp, Mus musculus
ccacttcaaatggggagggtagacc

SEQ ID NO: 238534 - DNA, 25 bp, Mus musculus
ccacttcaacaggactcatttcacc

SEQ ID NO: 238535 - DNA, 25 bp, Mus musculus
ccacttcagcaccagatccctgctg

SEQ ID NO: 238536 - DNA, 25 bp, Mus musculus
ccacttccaaggtagcgttggtata

SEQ ID NO: 238537 - DNA, 25 bp, Mus musculus
ccacttccagcccaggtgctggggc

SEQ ID NO: 238538 - DNA, 25 bp, Mus musculus
ccacttcctaaaaggtaaagcaccg

SEQ ID NO: 238539 - DNA, 25 bp, Mus musculus
ccacttcctccagaagaagactcct

SEQ ID NO: 238540 - DNA, 25 bp, Mus musculus
ccacttcgggcactgagcaccagtt

SEQ ID NO: 238541 - DNA, 25 bp, Mus musculus
ccacttcgtggaggtcctggacctt

SEQ ID NO: 238542 - DNA, 25 bp, Mus musculus
ccacttcgtggaggtcctggtggcc

SEQ ID NO: 238543 - DNA, 25 bp, Mus musculus
ccacttctaaacagaattctgattt

SEQ ID NO: 238544 - DNA, 25 bp, Mus musculus
ccacttctaaacagatggatttact

SEQ ID NO: 238545 - DNA, 25 bp, Mus musculus
ccacttctaaggcggcgacagcagc

SEQ ID NO: 238546 - DNA, 25 bp, Mus musculus
ccacttctcacccggaaaatgactc

SEQ ID NO: 238547 - DNA, 25 bp, Mus musculus
ccacttctcaggcctacagggtgga

SEQ ID NO: 238548 - DNA, 25 bp, Mus musculus
ccacttctcttagagtgtggggccg

SEQ ID NO: 238549 - DNA, 25 bp, Mus musculus
ccacttctgatggaggaatcaaaaa

SEQ ID NO: 238550 - DNA, 25 bp, Mus musculus
ccacttctgggaggcctggccttga

SEQ ID NO: 238551 - DNA, 25 bp, Mus musculus
ccacttctgtctgagatcgtcagtg

SEQ ID NO: 238552 - DNA, 25 bp, Mus musculus
ccacttcttctcagaaaagaggcca

SEQ ID NO: 238553 - DNA, 25 bp, Mus musculus
ccacttcttctcagataaggatgaa

SEQ ID NO: 238554 - DNA, 25 bp, Mus musculus
ccacttgactgggacgtggaacacc

SEQ ID NO: 238555 - DNA, 25 bp, Mus musculus
ccacttgcaaaagaggccatgacga

SEQ ID NO: 238556 - DNA, 25 bp, Mus musculus
ccacttgcagacaaatgaattcctt

SEQ ID NO: 238557 - DNA, 25 bp, Mus musculus
ccacttgcaggagttcgaggagggg

SEQ ID NO: 238558 - DNA, 25 bp, Mus musculus
ccacttgcaggctgtggggtcgtgc

SEQ ID NO: 238559 - DNA, 25 bp, Mus musculus
ccacttgcgaaggggcttcgcctct

SEQ ID NO: 238560 - DNA, 25 bp, Mus musculus
ccacttgctcagccttcctgatcac

SEQ ID NO: 238561 - DNA, 25 bp, Mus musculus
ccacttggctatgggagaggagaga

SEQ ID NO: 238562 - DNA, 25 bp, Mus musculus
ccacttggctatgggggcggggccc

SEQ ID NO: 238563 - DNA, 25 bp, Mus musculus
ccacttggggaagcctgagatgggg

SEQ ID NO: 238564 - DNA, 25 bp, Mus musculus
ccacttgtgccggtcccgcctggca

SEQ ID NO: 238565 - DNA, 25 bp, Mus musculus
ccacttgtggaaaagatattctcat

SEQ ID NO: 238566 - DNA, 25 bp, Mus musculus
ccacttgtttggttgtggcctacgg

SEQ ID NO: 238567 - DNA, 25 bp, Mus musculus
ccactttcagacctagatacttgtt

SEQ ID NO: 238568 - DNA, 25 bp, Mus musculus
ccactttcagagcaccccccggccc

SEQ ID NO: 238569 - DNA, 25 bp, Mus musculus
ccactttcagagccctccaactccc

SEQ ID NO: 238570 - DNA, 25 bp, Mus musculus
ccactttcaggaccatggtatctac

SEQ ID NO: 238571 - DNA, 25 bp, Mus musculus
ccactttcataagattcggctcctt

SEQ ID NO: 238572 - DNA, 25 bp, Mus musculus
ccactttccaaggaatttgaagcct

SEQ ID NO: 238573 - DNA, 25 bp, Mus musculus
ccactttccagccttccccgaggtg

SEQ ID NO: 238574 - DNA, 25 bp, Mus musculus
ccactttccaggtgacatatcagct

SEQ ID NO: 238575 - DNA, 25 bp, Mus musculus
ccactttcttgggtctttggggctg

SEQ ID NO: 238576 - DNA, 25 bp, Mus musculus
ccactttgaccggaagaagacgggc

SEQ ID NO: 238577 - DNA, 25 bp, Mus musculus
ccactttgaccgggatcactccggc

SEQ ID NO: 238578 - DNA, 25 bp, Mus musculus
ccactttgatcacaaggtcacactt

SEQ ID NO: 238579 - DNA, 25 bp, Mus musculus
ccactttgggaggggggatcgcagc

SEQ ID NO: 238580 - DNA, 25 bp, Mus musculus
ccacttttgaacgggacagctttga

SEQ ID NO: 238581 - DNA, 25 bp, Mus musculus
ccacttttgatcttgattctgattt

SEQ ID NO: 238582 - DNA, 25 bp, Mus musculus
ccagaaaaatgaaactgtgaagttc

SEQ ID NO: 238583 - DNA, 25 bp, Mus musculus
ccagaaaaatgcatcaaagagatgt

SEQ ID NO: 238584 - DNA, 25 bp, Mus musculus
ccagaaaacccaaggaatatggttg

SEQ ID NO: 238585 - DNA, 25 bp, Mus musculus
ccagaaaacggtttcaggcaccagt

SEQ ID NO: 238586 - DNA, 25 bp, Mus musculus
ccagaaaagaaggtctctggtaaga

SEQ ID NO: 238587 - DNA, 25 bp, Mus musculus
ccagaaaagcccagtggctttgggt

SEQ ID NO: 238588 - DNA, 25 bp, Mus musculus
ccagaaaatccttgccagagatcct

SEQ ID NO: 238589 - DNA, 25 bp, Mus musculus
ccagaaaatccttgctagagaaaat

SEQ ID NO: 238590 - DNA, 25 bp, Mus musculus
ccagaaaatctcagcctccttccct

SEQ ID NO: 238591 - DNA, 25 bp, Mus musculus
ccagaaaatgaacaatcacttttta

SEQ ID NO: 238592 - DNA, 25 bp, Mus musculus
ccagaaaatttcaggccctcagtac

SEQ ID NO: 238593 - DNA, 25 bp, Mus musculus
ccagaaacaagaagctcaggcgaaa

SEQ ID NO: 238594 - DNA, 25 bp, Mus musculus
ccagaaacacagatttaccttatga

SEQ ID NO: 238595 - DNA, 25 bp, Mus musculus
ccagaaacacagggggtgcagcttt

SEQ ID NO: 238596 - DNA, 25 bp, Mus musculus
ccagaaacagacagctctgtcttcc

SEQ ID NO: 238597 - DNA, 25 bp, Mus musculus
ccagaaacagatctggagaattgaa

SEQ ID NO: 238598 - DNA, 25 bp, Mus musculus
ccagaaacagcatgccagaattcca

SEQ ID NO: 238599 - DNA, 25 bp, Mus musculus
ccagaaacagcttgagcccgcacag

SEQ ID NO: 238600 - DNA, 25 bp, Mus musculus
ccagaaacatgtaggcctcattcac

SEQ ID NO: 238601 - DNA, 25 bp, Mus musculus
ccagaaacgagaagaagcagaccat

SEQ ID NO: 238602 - DNA, 25 bp, Mus musculus
ccagaaacggatgggctgtatgggg

SEQ ID NO: 238603 - DNA, 25 bp, Mus musculus
ccagaaacttcaggaggagttagag

SEQ ID NO: 238604 - DNA, 25 bp, Mus musculus
ccagaaagaagagaggagaagggga

SEQ ID NO: 238605 - DNA, 25 bp, Mus musculus
ccagaaagaccttgattcagatggt

SEQ ID NO: 238606 - DNA, 25 bp, Mus musculus
ccagaaagaggcgccctgtgctttg

SEQ ID NO: 238607 - DNA, 25 bp, Mus musculus
ccagaaagaggtgggtcttctcagt

SEQ ID NO: 238608 - DNA, 25 bp, Mus musculus
ccagaaagatacctcagaatacatt

SEQ ID NO: 238609 - DNA, 25 bp, Mus musculus
ccagaaagatatactgcaggcaaac

SEQ ID NO: 238610 - DNA, 25 bp, Mus musculus
ccagaaagatctgcatccaaagaca

SEQ ID NO: 238611 - DNA, 25 bp, Mus musculus
ccagaaagatctggccaacatagct

SEQ ID NO: 238612 - DNA, 25 bp, Mus musculus
ccagaaagcagaatgctggcagaag

SEQ ID NO: 238613 - DNA, 25 bp, Mus musculus
ccagaaagccaaagcggaggaagaa

SEQ ID NO: 238614 - DNA, 25 bp, Mus musculus
ccagaaagccaagaacagagagtac

SEQ ID NO: 238615 - DNA, 25 bp, Mus musculus
ccagaaagctggcgggtagaatcat

SEQ ID NO: 238616 - DNA, 25 bp, Mus musculus
ccagaaagtactggatccactggac

SEQ ID NO: 238617 - DNA, 25 bp, Mus musculus
ccagaaagtgatcacagaatacctg

SEQ ID NO: 238618 - DNA, 25 bp, Mus musculus
ccagaaagtgcttctctccttggta

SEQ ID NO: 238619 - DNA, 25 bp, Mus musculus
ccagaaagtgctttgcatgggttct

SEQ ID NO: 238620 - DNA, 25 bp, Mus musculus
ccagaaagtggtatcccataaataa

SEQ ID NO: 238621 - DNA, 25 bp, Mus musculus
ccagaaagtggtcacgcccgggtct

SEQ ID NO: 238622 - DNA, 25 bp, Mus musculus
ccagaaataggagcagttgaccttc

SEQ ID NO: 238623 - DNA, 25 bp, Mus musculus
ccagaaatccaagaaaatgtacagg

SEQ ID NO: 238624 - DNA, 25 bp, Mus musculus
ccagaaatctgttggtgttctggct

SEQ ID NO: 238625 - DNA, 25 bp, Mus musculus
ccagaaatgtgacaggctaaactgt

SEQ ID NO: 238626 - DNA, 25 bp, Mus musculus
ccagaaattccaaggtccccctgga

SEQ ID NO: 238627 - DNA, 25 bp, Mus musculus
ccagaaattccaaggtgtgagactg

SEQ ID NO: 238628 - DNA, 25 bp, Mus musculus
ccagaaattccaggatgtctgtgtt

SEQ ID NO: 238629 - DNA, 25 bp, Mus musculus
ccagaaattccaggattgctgtgtc

SEQ ID NO: 238630 - DNA, 25 bp, Mus musculus
ccagaaattgaagagaaacttcatg

SEQ ID NO: 238631 - DNA, 25 bp, Mus musculus
ccagaaattggggttgatcgcctta

SEQ ID NO: 238632 - DNA, 25 bp, Mus musculus
ccagaacaagactgagaatcagagt

SEQ ID NO: 238633 - DNA, 25 bp, Mus musculus
ccagaacaagagctgaggctgcagc

SEQ ID NO: 238634 - DNA, 25 bp, Mus musculus
ccagaacaagattactactcaacta

SEQ ID NO: 238635 - DNA, 25 bp, Mus musculus
ccagaacaagattcttttcgtcctg

SEQ ID NO: 238636 - DNA, 25 bp, Mus musculus
ccagaacaagtttccatagaaccca

SEQ ID NO: 238637 - DNA, 25 bp, Mus musculus
ccagaacaatcgattggaagaattg

SEQ ID NO: 238638 - DNA, 25 bp, Mus musculus
ccagaacaatcgggaacagactgct

SEQ ID NO: 238639 - DNA, 25 bp, Mus musculus
ccagaacacaggctgggaagatgcc

SEQ ID NO: 238640 - DNA, 25 bp, Mus musculus
ccagaacacgagcccaagatgattg

SEQ ID NO: 238641 - DNA, 25 bp, Mus musculus
ccagaacagctatggatttgccagc

SEQ ID NO: 238642 - DNA, 25 bp, Mus musculus
ccagaacagctgttcctaaggctta

SEQ ID NO: 238643 - DNA, 25 bp, Mus musculus
ccagaaccaactgataaccaagctg

SEQ ID NO: 238644 - DNA, 25 bp, Mus musculus
ccagaaccaactggagagacttcca

SEQ ID NO: 238645 - DNA, 25 bp, Mus musculus
ccagaaccaccacctggggccaggt

SEQ ID NO: 238646 - DNA, 25 bp, Mus musculus
ccagaaccacgtcacctctcacatc

SEQ ID NO: 238647 - DNA, 25 bp, Mus musculus
ccagaaccagaaccggagtgttttg

SEQ ID NO: 238648 - DNA, 25 bp, Mus musculus
ccagaaccagataattagcaccatg

SEQ ID NO: 238649 - DNA, 25 bp, Mus musculus
ccagaaccaggccaagaaaggagag

SEQ ID NO: 238650 - DNA, 25 bp, Mus musculus
ccagaaccaggcccctaatcaaggt

SEQ ID NO: 238651 - DNA, 25 bp, Mus musculus
ccagaaccagggcaaaaaggcagag

SEQ ID NO: 238652 - DNA, 25 bp, Mus musculus
ccagaaccaggttatgtagtaacaa

SEQ ID NO: 238653 - DNA, 25 bp, Mus musculus
ccagaaccagtgtctgacagttcca

SEQ ID NO: 238654 - DNA, 25 bp, Mus musculus
ccagaacccacacatagagagactg

SEQ ID NO: 238655 - DNA, 25 bp, Mus musculus
ccagaacccagctaacagagaagtc

SEQ ID NO: 238656 - DNA, 25 bp, Mus musculus
ccagaacccgattcatcagtgggaa

SEQ ID NO: 238657 - DNA, 25 bp, Mus musculus
ccagaacccgcctagtgatgaggaa

SEQ ID NO: 238658 - DNA, 25 bp, Mus musculus
ccagaacccgtcttttcatctcagc

SEQ ID NO: 238659 - DNA, 25 bp, Mus musculus
ccagaacctggagaatgtggttgaa

SEQ ID NO: 238660 - DNA, 25 bp, Mus musculus
ccagaacgacgtaggtcaccccttc

SEQ ID NO: 238661 - DNA, 25 bp, Mus musculus
ccagaacgatgtggaacagggaaag

SEQ ID NO: 238662 - DNA, 25 bp, Mus musculus
ccagaacgtcaaggcaatccttagg

SEQ ID NO: 238663 - DNA, 25 bp, Mus musculus
ccagaacgtcaagggtgagtcagca

SEQ ID NO: 238664 - DNA, 25 bp, Mus musculus
ccagaactaaagaatgaagtcttac

SEQ ID NO: 238665 - DNA, 25 bp, Mus musculus
ccagaactaaagggcttgttgtcat

SEQ ID NO: 238666 - DNA, 25 bp, Mus musculus
ccagaactacccagccacttactgg

SEQ ID NO: 238667 - DNA, 25 bp, Mus musculus
ccagaactacccaggctccttctag

SEQ ID NO: 238668 - DNA, 25 bp, Mus musculus
ccagaactatcccgtggtctccatt

SEQ ID NO: 238669 - DNA, 25 bp, Mus musculus
ccagaactggtgaagcttatgtgcg

SEQ ID NO: 238670 - DNA, 25 bp, Mus musculus
ccagaacttctcagacaattgacat

SEQ ID NO: 238671 - DNA, 25 bp, Mus musculus
ccagaacttgccatcaatgccttct

SEQ ID NO: 238672 - DNA, 25 bp, Mus musculus
ccagaagaaagagtgtgaggagatc

SEQ ID NO: 238673 - DNA, 25 bp, Mus musculus
ccagaagaagagtcgaaaggacaaa

SEQ ID NO: 238674 - DNA, 25 bp, Mus musculus
ccagaagaagcgagtacttactctt

SEQ ID NO: 238675 - DNA, 25 bp, Mus musculus
ccagaagaatacgcgggtcagataa

SEQ ID NO: 238676 - DNA, 25 bp, Mus musculus
ccagaagaatatgctggaccgcttc

SEQ ID NO: 238677 - DNA, 25 bp, Mus musculus
ccagaagaatatggtggcctgggcc

SEQ ID NO: 238678 - DNA, 25 bp, Mus musculus
ccagaagaattgtgtctggaattct

SEQ ID NO: 238679 - DNA, 25 bp, Mus musculus
ccagaagacacgaaggcaaccaagg

SEQ ID NO: 238680 - DNA, 25 bp, Mus musculus
ccagaagacacggatactgagaact

SEQ ID NO: 238681 - DNA, 25 bp, Mus musculus
ccagaagacaggactcagctgagag

SEQ ID NO: 238682 - DNA, 25 bp, Mus musculus
ccagaagacagtgatggcgactggt

SEQ ID NO: 238683 - DNA, 25 bp, Mus musculus
ccagaagacagttgccctctatacc

SEQ ID NO: 238684 - DNA, 25 bp, Mus musculus
ccagaagacccaaagcgtctgatgg

SEQ ID NO: 238685 - DNA, 25 bp, Mus musculus
ccagaagaccgaatttatctctgag

SEQ ID NO: 238686 - DNA, 25 bp, Mus musculus
ccagaagacctcatcgggaaccaga

SEQ ID NO: 238687 - DNA, 25 bp, Mus musculus
ccagaagactagattgaggaggagg

SEQ ID NO: 238688 - DNA, 25 bp, Mus musculus
ccagaagactagccgccgtgccacg

SEQ ID NO: 238689 - DNA, 25 bp, Mus musculus
ccagaagactgcgctgagtggacca

SEQ ID NO: 238690 - DNA, 25 bp, Mus musculus
ccagaagactttggtggcacgcggt

SEQ ID NO: 238691 - DNA, 25 bp, Mus musculus
ccagaagagatcctggctaagaatc

SEQ ID NO: 238692 - DNA, 25 bp, Mus musculus
ccagaagagcaagaacctgggagca

SEQ ID NO: 238693 - DNA, 25 bp, Mus musculus
ccagaagagcaagttaagtttgaaa

SEQ ID NO: 238694 - DNA, 25 bp, Mus musculus
ccagaagatcgtgattttaaaaatg

SEQ ID NO: 238695 - DNA, 25 bp, Mus musculus
ccagaagcaaacgatggaggctctg

SEQ ID NO: 238696 - DNA, 25 bp, Mus musculus
ccagaagcaaagggtgtgagttcag

SEQ ID NO: 238697 - DNA, 25 bp, Mus musculus
ccagaagcaagacgcgggcgatcca

SEQ ID NO: 238698 - DNA, 25 bp, Mus musculus
ccagaagcaaggggtggatgagagg

SEQ ID NO: 238699 - DNA, 25 bp, Mus musculus
ccagaagcagaggacgttcgtaagt

SEQ ID NO: 238700 - DNA, 25 bp, Mus musculus
ccagaagcagccaggcttctcttct

SEQ ID NO: 238701 - DNA, 25 bp, Mus musculus
ccagaagcagccatggaccctctct

SEQ ID NO: 238702 - DNA, 25 bp, Mus musculus
ccagaagcagcccactgagtctctc

SEQ ID NO: 238703 - DNA, 25 bp, Mus musculus
ccagaagcagctggtgaatgagcaa

SEQ ID NO: 238704 - DNA, 25 bp, Mus musculus
ccagaagcagggaaaaggctctagg

SEQ ID NO: 238705 - DNA, 25 bp, Mus musculus
ccagaagcaggtactctatctacaa

SEQ ID NO: 238706 - DNA, 25 bp, Mus musculus
ccagaagcaggtgtccccagaactg

SEQ ID NO: 238707 - DNA, 25 bp, Mus musculus
ccagaagcagtaccccaccccaggt

SEQ ID NO: 238708 - DNA, 25 bp, Mus musculus
ccagaagcagtgcgatgactttgtg

SEQ ID NO: 238709 - DNA, 25 bp, Mus musculus
ccagaagccacacaggttcctttgg

SEQ ID NO: 238710 - DNA, 25 bp, Mus musculus
ccagaagccatgggactcgtgggga

SEQ ID NO: 238711 - DNA, 25 bp, Mus musculus
ccagaagctaggacctacagactac

SEQ ID NO: 238712 - DNA, 25 bp, Mus musculus
ccagaagctgaacttcactggacca

SEQ ID NO: 238713 - DNA, 25 bp, Mus musculus
ccagaagctggaatcctttctgccc

SEQ ID NO: 238714 - DNA, 25 bp, Mus musculus
ccagaaggacaagataaacttgatg

SEQ ID NO: 238715 - DNA, 25 bp, Mus musculus
ccagaaggacaagatatatctcaca

SEQ ID NO: 238716 - DNA, 25 bp, Mus musculus
ccagaaggacaagatgtatatcact

SEQ ID NO: 238717 - DNA, 25 bp, Mus musculus
ccagaaggaccagctaaccctgagg

SEQ ID NO: 238718 - DNA, 25 bp, Mus musculus
ccagaaggactcagatacctgatgg

SEQ ID NO: 238719 - DNA, 25 bp, Mus musculus
ccagaaggactcaggctcaaaatgg

SEQ ID NO: 238720 - DNA, 25 bp, Mus musculus
ccagaaggagatccttaagctgttg

SEQ ID NO: 238721 - DNA, 25 bp, Mus musculus
ccagaaggaggcggcgctctcgcag

SEQ ID NO: 238722 - DNA, 25 bp, Mus musculus
ccagaaggaggtcaagatggggttt

SEQ ID NO: 238723 - DNA, 25 bp, Mus musculus
ccagaaggcagagaactgtgccaag

SEQ ID NO: 238724 - DNA, 25 bp, Mus musculus
ccagaaggctgaaggcttaactccg

SEQ ID NO: 238725 - DNA, 25 bp, Mus musculus
ccagaagtaagattggcctgttcga

SEQ ID NO: 238726 - DNA, 25 bp, Mus musculus
ccagaagtaatgggggcctgcatcc

SEQ ID NO: 238727 - DNA, 25 bp, Mus musculus
ccagaagtacgtgggacctcttaaa

SEQ ID NO: 238728 - DNA, 25 bp, Mus musculus
ccagaagtatccatcatcagaagta

SEQ ID NO: 238729 - DNA, 25 bp, Mus musculus
ccagaagtatccatcttctgtatct

SEQ ID NO: 238730 - DNA, 25 bp, Mus musculus
ccagaagtcccaggactctcggctc

SEQ ID NO: 238731 - DNA, 25 bp, Mus musculus
ccagaagtcccaggttgttcagatg

SEQ ID NO: 238732 - DNA, 25 bp, Mus musculus
ccagaagtcctcagggctgaactga

SEQ ID NO: 238733 - DNA, 25 bp, Mus musculus
ccagaagtcggaaagtgtggagcaa

SEQ ID NO: 238734 - DNA, 25 bp, Mus musculus
ccagaagtgatcaagattagacgtg

SEQ ID NO: 238735 - DNA, 25 bp, Mus musculus
ccagaagtgatcaagattcaaaata

SEQ ID NO: 238736 - DNA, 25 bp, Mus musculus
ccagaagtgcctgacagaggagggc

SEQ ID NO: 238737 - DNA, 25 bp, Mus musculus
ccagaagtgcctgctcttgctccca

SEQ ID NO: 238738 - DNA, 25 bp, Mus musculus
ccagaagttcctgggtttgatgaag

SEQ ID NO: 238739 - DNA, 25 bp, Mus musculus
ccagaataaccaggtgaggaaaacc

SEQ ID NO: 238740 - DNA, 25 bp, Mus musculus
ccagaataagacaagagtttgggaa

SEQ ID NO: 238741 - DNA, 25 bp, Mus musculus
ccagaataagctgaactcccacctc

SEQ ID NO: 238742 - DNA, 25 bp, Mus musculus
ccagaataaggaagcggggagtgag

SEQ ID NO: 238743 - DNA, 25 bp, Mus musculus
ccagaatacaatattggccagcctg

SEQ ID NO: 238744 - DNA, 25 bp, Mus musculus
ccagaatactgaacttcgtgtattt

SEQ ID NO: 238745 - DNA, 25 bp, Mus musculus
ccagaatactgacaaaaaaagccct

SEQ ID NO: 238746 - DNA, 25 bp, Mus musculus
ccagaatagaaggccgttgactact

SEQ ID NO: 238747 - DNA, 25 bp, Mus musculus
ccagaatatgaccccagcagcgaca

SEQ ID NO: 238748 - DNA, 25 bp, Mus musculus
ccagaatatgatggaccccagagag

SEQ ID NO: 238749 - DNA, 25 bp, Mus musculus
ccagaatatgcgatgatccctccta

SEQ ID NO: 238750 - DNA, 25 bp, Mus musculus
ccagaatcaagttccttacagatgg

SEQ ID NO: 238751 - DNA, 25 bp, Mus musculus
ccagaatcagaacattgtccttaga

SEQ ID NO: 238752 - DNA, 25 bp, Mus musculus
ccagaatcagacaggaatctgcttg

SEQ ID NO: 238753 - DNA, 25 bp, Mus musculus
ccagaatcagacaggtgatttgaac

SEQ ID NO: 238754 - DNA, 25 bp, Mus musculus
ccagaatcagagctgatcataagcc

SEQ ID NO: 238755 - DNA, 25 bp, Mus musculus
ccagaatccagtatctcttgctcct

SEQ ID NO: 238756 - DNA, 25 bp, Mus musculus
ccagaatccagtttcagatacacca

SEQ ID NO: 238757 - DNA, 25 bp, Mus musculus
ccagaatcctgggccaccaattcat

SEQ ID NO: 238758 - DNA, 25 bp, Mus musculus
ccagaatcgtcactgacaccaattc

SEQ ID NO: 238759 - DNA, 25 bp, Mus musculus
ccagaatcgtcactgatgcccttcc

SEQ ID NO: 238760 - DNA, 25 bp, Mus musculus
ccagaatcgtcactgatgtatgacc

SEQ ID NO: 238761 - DNA, 25 bp, Mus musculus
ccagaatctggatggctatggtcaa

SEQ ID NO: 238762 - DNA, 25 bp, Mus musculus
ccagaatgaggatcccagaaagctt

SEQ ID NO: 238763 - DNA, 25 bp, Mus musculus
ccagaatgtggatcggtcatgggac

SEQ ID NO: 238764 - DNA, 25 bp, Mus musculus
ccagaattactgcatctcccctcaa

SEQ ID NO: 238765 - DNA, 25 bp, Mus musculus
ccagaattaggtatcgaagtgagaa

SEQ ID NO: 238766 - DNA, 25 bp, Mus musculus
ccagaattgtggagattgaagaagt

SEQ ID NO: 238767 - DNA, 25 bp, Mus musculus
ccagaattgtggaggttgacgttga

SEQ ID NO: 238768 - DNA, 25 bp, Mus musculus
ccagaattgttgtttattcatggtg

SEQ ID NO: 238769 - DNA, 25 bp, Mus musculus
ccagaatttgaggtctttaagtgga

SEQ ID NO: 238770 - DNA, 25 bp, Mus musculus
ccagacaaagacatggaccctacca

SEQ ID NO: 238771 - DNA, 25 bp, Mus musculus
ccagacaaagccgaccctttccgtg

SEQ ID NO: 238772 - DNA, 25 bp, Mus musculus
ccagacaaccaggtcagaaaaccca

SEQ ID NO: 238773 - DNA, 25 bp, Mus musculus
ccagacaagggaggatctccttata

SEQ ID NO: 238774 - DNA, 25 bp, Mus musculus
ccagacaagggccctctggtggaag

SEQ ID NO: 238775 - DNA, 25 bp, Mus musculus
ccagacaagtaggtatcgcagggtg

SEQ ID NO: 238776 - DNA, 25 bp, Mus musculus
ccagacaatgagaggccttcagttt

SEQ ID NO: 238777 - DNA, 25 bp, Mus musculus
ccagacacaagcattcccactatgt

SEQ ID NO: 238778 - DNA, 25 bp, Mus musculus
ccagacacagaccaggtgggagcat

SEQ ID NO: 238779 - DNA, 25 bp, Mus musculus
ccagacacagatggaggtagtgagt

SEQ ID NO: 238780 - DNA, 25 bp, Mus musculus
ccagacacagcacctgcagtggcta

SEQ ID NO: 238781 - DNA, 25 bp, Mus musculus
ccagacacaggcaactggcccgatt

SEQ ID NO: 238782 - DNA, 25 bp, Mus musculus
ccagacacattgatttgaaaccact

SEQ ID NO: 238783 - DNA, 25 bp, Mus musculus
ccagacacattgtcataacttcctc

SEQ ID NO: 238784 - DNA, 25 bp, Mus musculus
ccagacacattgtgaactgccctca

SEQ ID NO: 238785 - DNA, 25 bp, Mus musculus
ccagacaccatgccagcccactcaa

SEQ ID NO: 238786 - DNA, 25 bp, Mus musculus
ccagacacccagaggctggtccagg

SEQ ID NO: 238787 - DNA, 25 bp, Mus musculus
ccagacactacagggctcccagttt

SEQ ID NO: 238788 - DNA, 25 bp, Mus musculus
ccagacactacaggtaacaggattg

SEQ ID NO: 238789 - DNA, 25 bp, Mus musculus
ccagacagaaacgggacttatctgc

SEQ ID NO: 238790 - DNA, 25 bp, Mus musculus
ccagacagacaggcttttgaggctc

SEQ ID NO: 238791 - DNA, 25 bp, Mus musculus
ccagacagacgggtccacctcagga

SEQ ID NO: 238792 - DNA, 25 bp, Mus musculus
ccagacaggcctagtgccaaaccag

SEQ ID NO: 238793 - DNA, 25 bp, Mus musculus
ccagacagtacagaggctttttcag

SEQ ID NO: 238794 - DNA, 25 bp, Mus musculus
ccagacagtacagaggtctatggcc

SEQ ID NO: 238795 - DNA, 25 bp, Mus musculus
ccagacagtcaggatggtgtcacat

SEQ ID NO: 238796 - DNA, 25 bp, Mus musculus
ccagacatcagcagcccagtggtac

SEQ ID NO: 238797 - DNA, 25 bp, Mus musculus
ccagacatctcagagcctgggacct

SEQ ID NO: 238798 - DNA, 25 bp, Mus musculus
ccagacatctcatgggtttgtggat

SEQ ID NO: 238799 - DNA, 25 bp, Mus musculus
ccagacattcagagccacaggcacc

SEQ ID NO: 238800 - DNA, 25 bp, Mus musculus
ccagacattgaggcaccacctaccc

SEQ ID NO: 238801 - DNA, 25 bp, Mus musculus
ccagacattgccagccttggggagt

SEQ ID NO: 238802 - DNA, 25 bp, Mus musculus
ccagacattggacggaagaagtccc

SEQ ID NO: 238803 - DNA, 25 bp, Mus musculus
ccagaccaaagaagagagggaactt

SEQ ID NO: 238804 - DNA, 25 bp, Mus musculus
ccagaccacagggatcacccatcat

SEQ ID NO: 238805 - DNA, 25 bp, Mus musculus
ccagaccacaggtccctgtggaaaa

SEQ ID NO: 238806 - DNA, 25 bp, Mus musculus
ccagaccagtatcacagagcagcag

SEQ ID NO: 238807 - DNA, 25 bp, Mus musculus
ccagaccagtcgtgttgaggagacg

SEQ ID NO: 238808 - DNA, 25 bp, Mus musculus
ccagacccaagaccatttcccagcc

SEQ ID NO: 238809 - DNA, 25 bp, Mus musculus
ccagacccaagactctccctctgca

SEQ ID NO: 238810 - DNA, 25 bp, Mus musculus
ccagacccacagacttccaaattga

SEQ ID NO: 238811 - DNA, 25 bp, Mus musculus
ccagacccacagaggctcccaaaca

SEQ ID NO: 238812 - DNA, 25 bp, Mus musculus
ccagaccccagcctatggtatcgct

SEQ ID NO: 238813 - DNA, 25 bp, Mus musculus
ccagaccccagcctccgcatgagca

SEQ ID NO: 238814 - DNA, 25 bp, Mus musculus
ccagaccccaggtatgcgagaccac

SEQ ID NO: 238815 - DNA, 25 bp, Mus musculus
ccagaccccaggttccagtgccccc

SEQ ID NO: 238816 - DNA, 25 bp, Mus musculus
ccagaccccatttgggttccagtgc

SEQ ID NO: 238817 - DNA, 25 bp, Mus musculus
ccagaccccttccaaggtgatcctt

SEQ ID NO: 238818 - DNA, 25 bp, Mus musculus
ccagacccggcatcaggaagatgat

SEQ ID NO: 238819 - DNA, 25 bp, Mus musculus
ccagaccctgaaggagctgcctctg

SEQ ID NO: 238820 - DNA, 25 bp, Mus musculus
ccagaccctggtcaggcagttccag

SEQ ID NO: 238821 - DNA, 25 bp, Mus musculus
ccagaccctgtacagagagctccaa

SEQ ID NO: 238822 - DNA, 25 bp, Mus musculus
ccagaccctgtacagagccaccttg

SEQ ID NO: 238823 - DNA, 25 bp, Mus musculus
ccagaccgagatgccttggatgagt

SEQ ID NO: 238824 - DNA, 25 bp, Mus musculus
ccagaccgaggatcaaccattcctg

SEQ ID NO: 238825 - DNA, 25 bp, Mus musculus
ccagaccgatatgacagcctggacc

SEQ ID NO: 238826 - DNA, 25 bp, Mus musculus
ccagaccgcggcgggcaggaagacc

SEQ ID NO: 238827 - DNA, 25 bp, Mus musculus
ccagaccgcgggcagcgtggacatt

SEQ ID NO: 238828 - DNA, 25 bp, Mus musculus
ccagacctacgataaccacttccga

SEQ ID NO: 238829 - DNA, 25 bp, Mus musculus
ccagacctcaggtttaacacacaaa

SEQ ID NO: 238830 - DNA, 25 bp, Mus musculus
ccagacctcatccagaccagagggc

SEQ ID NO: 238831 - DNA, 25 bp, Mus musculus
ccagacctcatccagcttactggcg

SEQ ID NO: 238832 - DNA, 25 bp, Mus musculus
ccagacctcgggacagattgtgatg

SEQ ID NO: 238833 - DNA, 25 bp, Mus musculus
ccagacctggccaagcctaccaggt

SEQ ID NO: 238834 - DNA, 25 bp, Mus musculus
ccagacctggccaaggtaccacggt

SEQ ID NO: 238835 - DNA, 25 bp, Mus musculus
ccagacctggctccagtctgttctc

SEQ ID NO: 238836 - DNA, 25 bp, Mus musculus
ccagacctggctccattccatgagg

SEQ ID NO: 238837 - DNA, 25 bp, Mus musculus
ccagacctggctgcccagacccctc

SEQ ID NO: 238838 - DNA, 25 bp, Mus musculus
ccagaccttcacgcatcatgactga

SEQ ID NO: 238839 - DNA, 25 bp, Mus musculus
ccagacgaattggaatcccagtcag

SEQ ID NO: 238840 - DNA, 25 bp, Mus musculus
ccagacgatgcacaggccatagaag

SEQ ID NO: 238841 - DNA, 25 bp, Mus musculus
ccagacgcacgaagctctttgtgtt

SEQ ID NO: 238842 - DNA, 25 bp, Mus musculus
ccagacgtctgaggacacagactca

SEQ ID NO: 238843 - DNA, 25 bp, Mus musculus
ccagacgtctgaggcagcgggagcc

SEQ ID NO: 238844 - DNA, 25 bp, Mus musculus
ccagacgtctgaggtggcttggttt

SEQ ID NO: 238845 - DNA, 25 bp, Mus musculus
ccagactacctgaagaaacagcaag

SEQ ID NO: 238846 - DNA, 25 bp, Mus musculus
ccagactacctgacctcatctttga

SEQ ID NO: 238847 - DNA, 25 bp, Mus musculus
ccagactacctgactctttgagata

SEQ ID NO: 238848 - DNA, 25 bp, Mus musculus
ccagactatgaaatggtccaccagg

SEQ ID NO: 238849 - DNA, 25 bp, Mus musculus
ccagactatgaaatggttttactgg

SEQ ID NO: 238850 - DNA, 25 bp, Mus musculus
ccagactcaatgaggccctgctgga

SEQ ID NO: 238851 - DNA, 25 bp, Mus musculus
ccagactcagacacaacaacagatt

SEQ ID NO: 238852 - DNA, 25 bp, Mus musculus
ccagactcaggtatctgctatagaa

SEQ ID NO: 238853 - DNA, 25 bp, Mus musculus
ccagactcccgcaagacgcttaaag

SEQ ID NO: 238854 - DNA, 25 bp, Mus musculus
ccagactcggggccctgttctccgg

SEQ ID NO: 238855 - DNA, 25 bp, Mus musculus
ccagactcggggttctctggaaacc

SEQ ID NO: 238856 - DNA, 25 bp, Mus musculus
ccagactctctcccagatgacagtc

SEQ ID NO: 238857 - DNA, 25 bp, Mus musculus
ccagactgagatggaccacacagcc

SEQ ID NO: 238858 - DNA, 25 bp, Mus musculus
ccagactgaggaacctgagaagaag

SEQ ID NO: 238859 - DNA, 25 bp, Mus musculus
ccagactgaggctgtgtttcaaatc

SEQ ID NO: 238860 - DNA, 25 bp, Mus musculus
ccagactgcaaaggtgaccagagcg

SEQ ID NO: 238861 - DNA, 25 bp, Mus musculus
ccagactgcagactcacgcccactg

SEQ ID NO: 238862 - DNA, 25 bp, Mus musculus
ccagactgcatggaactacatgaat

SEQ ID NO: 238863 - DNA, 25 bp, Mus musculus
ccagacttaaagatttcacaggtct

SEQ ID NO: 238864 - DNA, 25 bp, Mus musculus
ccagacttaaagtggcccagacgtc

SEQ ID NO: 238865 - DNA, 25 bp, Mus musculus
ccagacttccacacgcgcacggacc

SEQ ID NO: 238866 - DNA, 25 bp, Mus musculus
ccagacttcccagagaatgttgctg

SEQ ID NO: 238867 - DNA, 25 bp, Mus musculus
ccagacttctcagaggctccatctc

SEQ ID NO: 238868 - DNA, 25 bp, Mus musculus
ccagacttctctcagctacagcgga

SEQ ID NO: 238869 - DNA, 25 bp, Mus musculus
ccagagaaaaatggaatctctacga

SEQ ID NO: 238870 - DNA, 25 bp, Mus musculus
ccagagaaaaggtggagcttttgtg

SEQ ID NO: 238871 - DNA, 25 bp, Mus musculus
ccagagaaagaggatggaggcctcc

SEQ ID NO: 238872 - DNA, 25 bp, Mus musculus
ccagagaaaggatgcaagctgttgc

SEQ ID NO: 238873 - DNA, 25 bp, Mus musculus
ccagagaacaaggtccttccatagt

SEQ ID NO: 238874 - DNA, 25 bp, Mus musculus
ccagagaacactgtggctctccaga

SEQ ID NO: 238875 - DNA, 25 bp, Mus musculus
ccagagaacaggctgtgaaaacaga

SEQ ID NO: 238876 - DNA, 25 bp, Mus musculus
ccagagaacatggatgtcagcaatt

SEQ ID NO: 238877 - DNA, 25 bp, Mus musculus
ccagagaaccaaaggacttcaggaa

SEQ ID NO: 238878 - DNA, 25 bp, Mus musculus
ccagagaagagtaaactggtgcagg

SEQ ID NO: 238879 - DNA, 25 bp, Mus musculus
ccagagaaggaaaaggaaacacaac

SEQ ID NO: 238880 - DNA, 25 bp, Mus musculus
ccagagaaggaagacaccaaatcct

SEQ ID NO: 238881 - DNA, 25 bp, Mus musculus
ccagagaaggaaggaatgtcactgt

SEQ ID NO: 238882 - DNA, 25 bp, Mus musculus
ccagagaaggaaggtatttccaaac

SEQ ID NO: 238883 - DNA, 25 bp, Mus musculus
ccagagaaggatcagctgaagaata

SEQ ID NO: 238884 - DNA, 25 bp, Mus musculus
ccagagaaggtgatcatctgtctgg

SEQ ID NO: 238885 - DNA, 25 bp, Mus musculus
ccagagaagtccaggaagatgggct

SEQ ID NO: 238886 - DNA, 25 bp, Mus musculus
ccagagaagtttgaccctgaggctt

SEQ ID NO: 238887 - DNA, 25 bp, Mus musculus
ccagagaatcttataggatttaaac

SEQ ID NO: 238888 - DNA, 25 bp, Mus musculus
ccagagacaaggtccactgggcagc

SEQ ID NO: 238889 - DNA, 25 bp, Mus musculus
ccagagacaatctcatttgagatgc

SEQ ID NO: 238890 - DNA, 25 bp, Mus musculus
ccagagacaatctcgctgcgaaaag

SEQ ID NO: 238891 - DNA, 25 bp, Mus musculus
ccagagacacaggaacctgaggaga

SEQ ID NO: 238892 - DNA, 25 bp, Mus musculus
ccagagacaggcagtcatttgaaga

SEQ ID NO: 238893 - DNA, 25 bp, Mus musculus
ccagagaccctgaggaaatggggat

SEQ ID NO: 238894 - DNA, 25 bp, Mus musculus
ccagagaccgagggagggagccatc

SEQ ID NO: 238895 - DNA, 25 bp, Mus musculus
ccagagagacagcagccttcccagt

SEQ ID NO: 238896 - DNA, 25 bp, Mus musculus
ccagagagacagcagggtccaccaa

SEQ ID NO: 238897 - DNA, 25 bp, Mus musculus
ccagagagagaaccttcacacctgt

SEQ ID NO: 238898 - DNA, 25 bp, Mus musculus
ccagagagaggtcatcttccatgat

SEQ ID NO: 238899 - DNA, 25 bp, Mus musculus
ccagagagatgggtgtgattgctgc

SEQ ID NO: 238900 - DNA, 25 bp, Mus musculus
ccagagagcccaggcttacagtgat

SEQ ID NO: 238901 - DNA, 25 bp, Mus musculus
ccagagagctatcattgaggcggaa

SEQ ID NO: 238902 - DNA, 25 bp, Mus musculus
ccagagagctgtcattgaggcggaa

SEQ ID NO: 238903 - DNA, 25 bp, Mus musculus
ccagagaggcagagacagggcaggg

SEQ ID NO: 238904 - DNA, 25 bp, Mus musculus
ccagagaggccggagacagtataac

SEQ ID NO: 238905 - DNA, 25 bp, Mus musculus
ccagagagttgccggctgaatttga

SEQ ID NO: 238906 - DNA, 25 bp, Mus musculus
ccagagataagctgacgctgggcaa

SEQ ID NO: 238907 - DNA, 25 bp, Mus musculus
ccagagatacccaggggccatactg

SEQ ID NO: 238908 - DNA, 25 bp, Mus musculus
ccagagatagagacaaaagactgtt

SEQ ID NO: 238909 - DNA, 25 bp, Mus musculus
ccagagatagccgactgcagatgac

SEQ ID NO: 238910 - DNA, 25 bp, Mus musculus
ccagagatagccgggcatcagcagt

SEQ ID NO: 238911 - DNA, 25 bp, Mus musculus
ccagagatcagaggatgcagcaccg

SEQ ID NO: 238912 - DNA, 25 bp, Mus musculus
ccagagatgaagaccacatagccca

SEQ ID NO: 238913 - DNA, 25 bp, Mus musculus
ccagagatgagatcacatagcattg

SEQ ID NO: 238914 - DNA, 25 bp, Mus musculus
ccagagatgatcaattcgtagttat

SEQ ID NO: 238915 - DNA, 25 bp, Mus musculus
ccagagatggctagcctatgtctca

SEQ ID NO: 238916 - DNA, 25 bp, Mus musculus
ccagagatggctaggtacaaatgga

SEQ ID NO: 238917 - DNA, 25 bp, Mus musculus
ccagagatgtcaagaaaaatcagga

SEQ ID NO: 238918 - DNA, 25 bp, Mus musculus
ccagagatgtcaaggggagagacct

SEQ ID NO: 238919 - DNA, 25 bp, Mus musculus
ccagagattgagaaggtcatagaag

SEQ ID NO: 238920 - DNA, 25 bp, Mus musculus
ccagagcaaattcagaaatggattc

SEQ ID NO: 238921 - DNA, 25 bp, Mus musculus
ccagagcaaccggtgaaaaaagcca

SEQ ID NO: 238922 - DNA, 25 bp, Mus musculus
ccagagcaaccgtcaagtaaacaac

SEQ ID NO: 238923 - DNA, 25 bp, Mus musculus
ccagagcaaccgtttctatggcgtt

SEQ ID NO: 238924 - DNA, 25 bp, Mus musculus
ccagagcaagaaaattgtgcaagca

SEQ ID NO: 238925 - DNA, 25 bp, Mus musculus
ccagagcaagatatggcgtgatcat

SEQ ID NO: 238926 - DNA, 25 bp, Mus musculus
ccagagcaagggcgattccccaaag

SEQ ID NO: 238927 - DNA, 25 bp, Mus musculus
ccagagcaaggtatggcgtgatcat

SEQ ID NO: 238928 - DNA, 25 bp, Mus musculus
ccagagcaaggttgctcttctggtg

SEQ ID NO: 238929 - DNA, 25 bp, Mus musculus
ccagagcaatagactgatgatgctt

SEQ ID NO: 238930 - DNA, 25 bp, Mus musculus
ccagagcaatgagtccagatccgaa

SEQ ID NO: 238931 - DNA, 25 bp, Mus musculus
ccagagcaatggcacggaatgctgc

SEQ ID NO: 238932 - DNA, 25 bp, Mus musculus
ccagagcacagaaaggagcttgaag

SEQ ID NO: 238933 - DNA, 25 bp, Mus musculus
ccagagcacagaggcgccgagcgcg

SEQ ID NO: 238934 - DNA, 25 bp, Mus musculus
ccagagcacagatacctgactgtca

SEQ ID NO: 238935 - DNA, 25 bp, Mus musculus
ccagagcacaggggcctggatcgtc

SEQ ID NO: 238936 - DNA, 25 bp, Mus musculus
ccagagcacccaggcttccactgct

SEQ ID NO: 238937 - DNA, 25 bp, Mus musculus
ccagagcaccctgctgctgaataat

SEQ ID NO: 238938 - DNA, 25 bp, Mus musculus
ccagagcaccctggactacattgca

SEQ ID NO: 238939 - DNA, 25 bp, Mus musculus
ccagagcactatgacccctcccagt

SEQ ID NO: 238940 - DNA, 25 bp, Mus musculus
ccagagcactgctagggctctgtgc

SEQ ID NO: 238941 - DNA, 25 bp, Mus musculus
ccagagcagagaggaggtggaccac

SEQ ID NO: 238942 - DNA, 25 bp, Mus musculus
ccagagcagagtgccagctggacct

SEQ ID NO: 238943 - DNA, 25 bp, Mus musculus
ccagagcagcagggccctgttctcc

SEQ ID NO: 238944 - DNA, 25 bp, Mus musculus
ccagagcagcgtcatctccgaacct

SEQ ID NO: 238945 - DNA, 25 bp, Mus musculus
ccagagcagttaagctaccttaagg

SEQ ID NO: 238946 - DNA, 25 bp, Mus musculus
ccagagcatcacgaaatagatatga

SEQ ID NO: 238947 - DNA, 25 bp, Mus musculus
ccagagcatcacgccagtagaaata

SEQ ID NO: 238948 - DNA, 25 bp, Mus musculus
ccagagcatggggctctctttggaa

SEQ ID NO: 238949 - DNA, 25 bp, Mus musculus
ccagagccaaaaaccaaagatgacc

SEQ ID NO: 238950 - DNA, 25 bp, Mus musculus
ccagagccaaaacttccacggaatc

SEQ ID NO: 238951 - DNA, 25 bp, Mus musculus
ccagagccagatgaagagctagagg

SEQ ID NO: 238952 - DNA, 25 bp, Mus musculus
ccagagccagcagcaatgctactgc

SEQ ID NO: 238953 - DNA, 25 bp, Mus musculus
ccagagccaggagcaatgctactgc

SEQ ID NO: 238954 - DNA, 25 bp, Mus musculus
ccagagccaggctccccagcacagg

SEQ ID NO: 238955 - DNA, 25 bp, Mus musculus
ccagagccagggaagggcaatgcga

SEQ ID NO: 238956 - DNA, 25 bp, Mus musculus
ccagagccatgagggatcttaaaga

SEQ ID NO: 238957 - DNA, 25 bp, Mus musculus
ccagagccatgcggtgctcttagca

SEQ ID NO: 238958 - DNA, 25 bp, Mus musculus
ccagagccatgtagaaccaggccca

SEQ ID NO: 238959 - DNA, 25 bp, Mus musculus
ccagagccatgtggaaccaggccca

SEQ ID NO: 238960 - DNA, 25 bp, Mus musculus
ccagagcccagacagagaagagcca

SEQ ID NO: 238961 - DNA, 25 bp, Mus musculus
ccagagcccggcagatgcccccacg

SEQ ID NO: 238962 - DNA, 25 bp, Mus musculus
ccagagcccggcagtcaggagtggc

SEQ ID NO: 238963 - DNA, 25 bp, Mus musculus
ccagagccctttggatccagccata

SEQ ID NO: 238964 - DNA, 25 bp, Mus musculus
ccagagccgacagagcaagtgtttg

SEQ ID NO: 238965 - DNA, 25 bp, Mus musculus
ccagagccgacagagcttcgtccac

SEQ ID NO: 238966 - DNA, 25 bp, Mus musculus
ccagagcctctaggccctaggacca

SEQ ID NO: 238967 - DNA, 25 bp, Mus musculus
ccagagcctggcagaagatgagttt

SEQ ID NO: 238968 - DNA, 25 bp, Mus musculus
ccagagcctgggtcatacttccatc

SEQ ID NO: 238969 - DNA, 25 bp, Mus musculus
ccagagcgatgtgtggtcttttgga

SEQ ID NO: 238970 - DNA, 25 bp, Mus musculus
ccagagcgcattaggcggtgggtct

SEQ ID NO: 238971 - DNA, 25 bp, Mus musculus
ccagagcgcattagggccaatgagg

SEQ ID NO: 238972 - DNA, 25 bp, Mus musculus
ccagagcgtttggaacacctttccc

SEQ ID NO: 238973 - DNA, 25 bp, Mus musculus
ccagagctaaggttcccgaggagac

SEQ ID NO: 238974 - DNA, 25 bp, Mus musculus
ccagagctagatttgtcaaatcctg

SEQ ID NO: 238975 - DNA, 25 bp, Mus musculus
ccagagctcaaggagcgaatctgca

SEQ ID NO: 238976 - DNA, 25 bp, Mus musculus
ccagagctcaaggctaaccctttca

SEQ ID NO: 238977 - DNA, 25 bp, Mus musculus
ccagagctcccagacttcttcgagg

SEQ ID NO: 238978 - DNA, 25 bp, Mus musculus
ccagagctccgggctcaagtccacc

SEQ ID NO: 238979 - DNA, 25 bp, Mus musculus
ccagagctgccccggttcagaaact

SEQ ID NO: 238980 - DNA, 25 bp, Mus musculus
ccagagcttcaggaggaatttggct

SEQ ID NO: 238981 - DNA, 25 bp, Mus musculus
ccagagcttctcggtgtggatcata

SEQ ID NO: 238982 - DNA, 25 bp, Mus musculus
ccagaggaaaaagttgccaggaaac

SEQ ID NO: 238983 - DNA, 25 bp, Mus musculus
ccagaggaagtagacaatcctcctg

SEQ ID NO: 238984 - DNA, 25 bp, Mus musculus
ccagaggacaagaaggcacatgcaa

SEQ ID NO: 238985 - DNA, 25 bp, Mus musculus
ccagaggacccacagcgacccatac

SEQ ID NO: 238986 - DNA, 25 bp, Mus musculus
ccagaggactaacactgtgtccgtg

SEQ ID NO: 238987 - DNA, 25 bp, Mus musculus
ccagaggagaaagagatgaaaccgg

SEQ ID NO: 238988 - DNA, 25 bp, Mus musculus
ccagaggagaaattgtgaaaatgtc

SEQ ID NO: 238989 - DNA, 25 bp, Mus musculus
ccagaggagaacagtgccaggtcac

SEQ ID NO: 238990 - DNA, 25 bp, Mus musculus
ccagaggagaggtggtgaaggcatt

SEQ ID NO: 238991 - DNA, 25 bp, Mus musculus
ccagaggagaggtgtgaaggcattt

SEQ ID NO: 238992 - DNA, 25 bp, Mus musculus
ccagaggagcaacagcggcaacctt

SEQ ID NO: 238993 - DNA, 25 bp, Mus musculus
ccagaggagcaagatatctgttgct

SEQ ID NO: 238994 - DNA, 25 bp, Mus musculus
ccagaggagtgtgaggaggtaaatg

SEQ ID NO: 238995 - DNA, 25 bp, Mus musculus
ccagaggagtgtgagggaggagata

SEQ ID NO: 238996 - DNA, 25 bp, Mus musculus
ccagaggatcatcagtttgttttct

SEQ ID NO: 238997 - DNA, 25 bp, Mus musculus
ccagaggcaagctgagtcaaagcag

SEQ ID NO: 238998 - DNA, 25 bp, Mus musculus
ccagaggcagagtgaagaaatcgaa

SEQ ID NO: 238999 - DNA, 25 bp, Mus musculus
ccagaggcagcaagaaaagcagaga

SEQ ID NO: 239000 - DNA, 25 bp, Mus musculus
ccagaggcagcagagaaccatgtgt

SEQ ID NO: 239001 - DNA, 25 bp, Mus musculus
ccagaggcagctgcgagcttccata

SEQ ID NO: 239002 - DNA, 25 bp, Mus musculus
ccagaggcaggcaatgatacaggaa

SEQ ID NO: 239003 - DNA, 25 bp, Mus musculus
ccagaggcaggtaacctcggccggg

SEQ ID NO: 239004 - DNA, 25 bp, Mus musculus
ccagaggcagttagccttacaagag

SEQ ID NO: 239005 - DNA, 25 bp, Mus musculus
ccagaggcggacccaccctcagcgc

SEQ ID NO: 239006 - DNA, 25 bp, Mus musculus
ccagaggctagtgggtcatcttgga

SEQ ID NO: 239007 - DNA, 25 bp, Mus musculus
ccagaggctagtggttacttacaca

SEQ ID NO: 239008 - DNA, 25 bp, Mus musculus
ccagaggctagtggttacttacagt

SEQ ID NO: 239009 - DNA, 25 bp, Mus musculus
ccagaggctcagggtccggaccgct

SEQ ID NO: 239010 - DNA, 25 bp, Mus musculus
ccagaggctcctgaggaagaagctg

SEQ ID NO: 239011 - DNA, 25 bp, Mus musculus
ccagagggaactggtggaaactgaa

SEQ ID NO: 239012 - DNA, 25 bp, Mus musculus
ccagagggagccgtgtgcccagcca

SEQ ID NO: 239013 - DNA, 25 bp, Mus musculus
ccagagggaggcttcagttgtgttt

SEQ ID NO: 239014 - DNA, 25 bp, Mus musculus
ccagagggattcagcacccggagcg

SEQ ID NO: 239015 - DNA, 25 bp, Mus musculus
ccagagggattcaggggttccagtg

SEQ ID NO: 239016 - DNA, 25 bp, Mus musculus
ccagagggcattcaaagggatggga

SEQ ID NO: 239017 - DNA, 25 bp, Mus musculus
ccagagggcattgacctagagactg

SEQ ID NO: 239018 - DNA, 25 bp, Mus musculus
ccagagggctagatgtggaagatgt

SEQ ID NO: 239019 - DNA, 25 bp, Mus musculus
ccagagggcttccaaaccctgctca

SEQ ID NO: 239020 - DNA, 25 bp, Mus musculus
ccagagggcttccaaagggtcctct

SEQ ID NO: 239021 - DNA, 25 bp, Mus musculus
ccagaggtaaaagcgccattccagc

SEQ ID NO: 239022 - DNA, 25 bp, Mus musculus
ccagaggtgagcacctgaagatgga

SEQ ID NO: 239023 - DNA, 25 bp, Mus musculus
ccagaggtgccaggtctgcaaagtg

SEQ ID NO: 239024 - DNA, 25 bp, Mus musculus
ccagaggtgccgagtaacttgtcgt

SEQ ID NO: 239025 - DNA, 25 bp, Mus musculus
ccagaggtgccgcaccatggccagc

SEQ ID NO: 239026 - DNA, 25 bp, Mus musculus
ccagaggttaaagataacagtggaa

SEQ ID NO: 239027 - DNA, 25 bp, Mus musculus
ccagagtacaaagctcccaggaggc

SEQ ID NO: 239028 - DNA, 25 bp, Mus musculus
ccagagtacaaaggcgtggtttctg

SEQ ID NO: 239029 - DNA, 25 bp, Mus musculus
ccagagtacgggcgtcctagtgtgt

SEQ ID NO: 239030 - DNA, 25 bp, Mus musculus
ccagagtaggaggtggtgcccatgg

SEQ ID NO: 239031 - DNA, 25 bp, Mus musculus
ccagagtatacaggatcccaaactg

SEQ ID NO: 239032 - DNA, 25 bp, Mus musculus
ccagagtatacaggtctgtgagttt

SEQ ID NO: 239033 - DNA, 25 bp, Mus musculus
ccagagtcaccaaatgaccccaagg

SEQ ID NO: 239034 - DNA, 25 bp, Mus musculus
ccagagtcagaaaaatataactgtc

SEQ ID NO: 239035 - DNA, 25 bp, Mus musculus
ccagagtcagaaaagttgtcctctc

SEQ ID NO: 239036 - DNA, 25 bp, Mus musculus
ccagagtcatgagtcgaaggagtct

SEQ ID NO: 239037 - DNA, 25 bp, Mus musculus
ccagagtcatgagtggaaggagtct

SEQ ID NO: 239038 - DNA, 25 bp, Mus musculus
ccagagtgagaaggagttgatgtgc

SEQ ID NO: 239039 - DNA, 25 bp, Mus musculus
ccagagtgataatgtgtacaagtca

SEQ ID NO: 239040 - DNA, 25 bp, Mus musculus
ccagagtgattgacagggagggtgt

SEQ ID NO: 239041 - DNA, 25 bp, Mus musculus
ccagagtgcagcattattgattgtg

SEQ ID NO: 239042 - DNA, 25 bp, Mus musculus
ccagagtggtaaaaagagctgtaat

SEQ ID NO: 239043 - DNA, 25 bp, Mus musculus
ccagagttacaggaacgtcatccat

SEQ ID NO: 239044 - DNA, 25 bp, Mus musculus
ccagagttcccagatgaagaaactg

SEQ ID NO: 239045 - DNA, 25 bp, Mus musculus
ccagataaaggatgccccaggtgac

SEQ ID NO: 239046 - DNA, 25 bp, Mus musculus
ccagataaccaggtgattgttcagt

SEQ ID NO: 239047 - DNA, 25 bp, Mus musculus
ccagataactcaatgggatttggtg

SEQ ID NO: 239048 - DNA, 25 bp, Mus musculus
ccagatacaccagttgtgacacagg

SEQ ID NO: 239049 - DNA, 25 bp, Mus musculus
ccagataccagattaagcttgcaat

SEQ ID NO: 239050 - DNA, 25 bp, Mus musculus
ccagataccaggttgctggtgacca

SEQ ID NO: 239051 - DNA, 25 bp, Mus musculus
ccagataccattaaaaagagaaata

SEQ ID NO: 239052 - DNA, 25 bp, Mus musculus
ccagataccctaactcagattagcc

SEQ ID NO: 239053 - DNA, 25 bp, Mus musculus
ccagatacttcactcgctcgaagag

SEQ ID NO: 239054 - DNA, 25 bp, Mus musculus
ccagatagagctcgccgcctgcagc

SEQ ID NO: 239055 - DNA, 25 bp, Mus musculus
ccagatagagctggagctggccaca

SEQ ID NO: 239056 - DNA, 25 bp, Mus musculus
ccagatagaggctgatcttaaattc

SEQ ID NO: 239057 - DNA, 25 bp, Mus musculus
ccagatagaggtctccctgtgtatc

SEQ ID NO: 239058 - DNA, 25 bp, Mus musculus
ccagatagagtcccaggtaaagatg

SEQ ID NO: 239059 - DNA, 25 bp, Mus musculus
ccagatatcagaatggtcatttatc

SEQ ID NO: 239060 - DNA, 25 bp, Mus musculus
ccagatatcctgagcagaggggcag

SEQ ID NO: 239061 - DNA, 25 bp, Mus musculus
ccagatatgcaaaccatgtttcctg

SEQ ID NO: 239062 - DNA, 25 bp, Mus musculus
ccagatatttgcgaacaaggagcaa

SEQ ID NO: 239063 - DNA, 25 bp, Mus musculus
ccagatcaaggtggttgaagatggc

SEQ ID NO: 239064 - DNA, 25 bp, Mus musculus
ccagatcacagaatacagatatggt

SEQ ID NO: 239065 - DNA, 25 bp, Mus musculus
ccagatcacagcctctgcagaatgt

SEQ ID NO: 239066 - DNA, 25 bp, Mus musculus
ccagatcacggaccaggagggaaag

SEQ ID NO: 239067 - DNA, 25 bp, Mus musculus
ccagatcagaaagcctaggacctgc

SEQ ID NO: 239068 - DNA, 25 bp, Mus musculus
ccagatcagaaaggcagtttgtgca

SEQ ID NO: 239069 - DNA, 25 bp, Mus musculus
ccagatcagaaagggtgtgtgggat

SEQ ID NO: 239070 - DNA, 25 bp, Mus musculus
ccagatcagaagaacagtctatccg

SEQ ID NO: 239071 - DNA, 25 bp, Mus musculus
ccagatcagaagaccaggaacccac

SEQ ID NO: 239072 - DNA, 25 bp, Mus musculus
ccagatcagaagagctctgcaggtc

SEQ ID NO: 239073 - DNA, 25 bp, Mus musculus
ccagatcatggttgcccccaaggtc

SEQ ID NO: 239074 - DNA, 25 bp, Mus musculus
ccagatcccaaacctagagactgat

SEQ ID NO: 239075 - DNA, 25 bp, Mus musculus
ccagatcccaccaaggtgaaggccc

SEQ ID NO: 239076 - DNA, 25 bp, Mus musculus
ccagatcccagaacactgcggcccc

SEQ ID NO: 239077 - DNA, 25 bp, Mus musculus
ccagatcccaggcctctatggccca

SEQ ID NO: 239078 - DNA, 25 bp, Mus musculus
ccagatcctgaagactgctggagtt

SEQ ID NO: 239079 - DNA, 25 bp, Mus musculus
ccagatcctgaagcattcgggaatt

SEQ ID NO: 239080 - DNA, 25 bp, Mus musculus
ccagatcctgccggcgagtgaggaa

SEQ ID NO: 239081 - DNA, 25 bp, Mus musculus
ccagatcctgccggcgctctgaaat

SEQ ID NO: 239082 - DNA, 25 bp, Mus musculus
ccagatctaggcagtgcacagccgt

SEQ ID NO: 239083 - DNA, 25 bp, Mus musculus
ccagatctagtgctcacatggtctt

SEQ ID NO: 239084 - DNA, 25 bp, Mus musculus
ccagatctcaaaggaaaaccagtgg

SEQ ID NO: 239085 - DNA, 25 bp, Mus musculus
ccagatctccatgctggagaacata

SEQ ID NO: 239086 - DNA, 25 bp, Mus musculus
ccagatctctatggtcccttttgga

SEQ ID NO: 239087 - DNA, 25 bp, Mus musculus
ccagatctgccggatcatgcgtcca

SEQ ID NO: 239088 - DNA, 25 bp, Mus musculus
ccagatctgccgggctgcctctagc

SEQ ID NO: 239089 - DNA, 25 bp, Mus musculus
ccagatgaacagggagcattggcgg

SEQ ID NO: 239090 - DNA, 25 bp, Mus musculus
ccagatgaacagttaatgtctgatt

SEQ ID NO: 239091 - DNA, 25 bp, Mus musculus
ccagatgaagatccaggaggatcct

SEQ ID NO: 239092 - DNA, 25 bp, Mus musculus
ccagatgaagatgactgtcagatta

SEQ ID NO: 239093 - DNA, 25 bp, Mus musculus
ccagatgaagtcaggaggcaagagg

SEQ ID NO: 239094 - DNA, 25 bp, Mus musculus
ccagatgacagcaacttcaaagctg

SEQ ID NO: 239095 - DNA, 25 bp, Mus musculus
ccagatgacatccctttcttgagat

SEQ ID NO: 239096 - DNA, 25 bp, Mus musculus
ccagatgagagggaagagtggatgc

SEQ ID NO: 239097 - DNA, 25 bp, Mus musculus
ccagatgagagggaagagtgtattg

SEQ ID NO: 239098 - DNA, 25 bp, Mus musculus
ccagatgagcagcctaacatccact

SEQ ID NO: 239099 - DNA, 25 bp, Mus musculus
ccagatgagcaggctaacatccact

SEQ ID NO: 239100 - DNA, 25 bp, Mus musculus
ccagatgcaaagttctgctttcact

SEQ ID NO: 239101 - DNA, 25 bp, Mus musculus
ccagatgcagcatccctggagctgg

SEQ ID NO: 239102 - DNA, 25 bp, Mus musculus
ccagatgcaggagagaagatggggc

SEQ ID NO: 239103 - DNA, 25 bp, Mus musculus
ccagatgcagggctgtagcagtggc

SEQ ID NO: 239104 - DNA, 25 bp, Mus musculus
ccagatgcaggttctgcatttcaac

SEQ ID NO: 239105 - DNA, 25 bp, Mus musculus
ccagatgcagtgttgtggtcctcaa

SEQ ID NO: 239106 - DNA, 25 bp, Mus musculus
ccagatgccaaatagaccttctgga

SEQ ID NO: 239107 - DNA, 25 bp, Mus musculus
ccagatgccaaattggatgaatata

SEQ ID NO: 239108 - DNA, 25 bp, Mus musculus
ccagatgccaggatgttgatgaatg

SEQ ID NO: 239109 - DNA, 25 bp, Mus musculus
ccagatgccaggttgttgatgaatg

SEQ ID NO: 239110 - DNA, 25 bp, Mus musculus
ccagatgcctgggccgatgatgcac

SEQ ID NO: 239111 - DNA, 25 bp, Mus musculus
ccagatgcctgggcctaaccatatg

SEQ ID NO: 239112 - DNA, 25 bp, Mus musculus
ccagatgccttacaagaggagtggt

SEQ ID NO: 239113 - DNA, 25 bp, Mus musculus
ccagatgctaggcatgaggtgaacc

SEQ ID NO: 239114 - DNA, 25 bp, Mus musculus
ccagatgctgacaaagcaaatgaaa

SEQ ID NO: 239115 - DNA, 25 bp, Mus musculus
ccagatggatccctctatgctgtgg

SEQ ID NO: 239116 - DNA, 25 bp, Mus musculus
ccagatggcagcacacgccaaagat

SEQ ID NO: 239117 - DNA, 25 bp, Mus musculus
ccagatggcccaggtacttcaattt

SEQ ID NO: 239118 - DNA, 25 bp, Mus musculus
ccagatggcttcacctgggagaaga

SEQ ID NO: 239119 - DNA, 25 bp, Mus musculus
ccagatgggcaagggtgaggagggg

SEQ ID NO: 239120 - DNA, 25 bp, Mus musculus
ccagatgggcaaggtatcaatctat

SEQ ID NO: 239121 - DNA, 25 bp, Mus musculus
ccagatggggtaaagataaacaaca

SEQ ID NO: 239122 - DNA, 25 bp, Mus musculus
ccagatggggtaaaggagtcaactg

SEQ ID NO: 239123 - DNA, 25 bp, Mus musculus
ccagatgtaagtgccctggaacttc

SEQ ID NO: 239124 - DNA, 25 bp, Mus musculus
ccagatgtcaagaaagcgtgtacct

SEQ ID NO: 239125 - DNA, 25 bp, Mus musculus
ccagatgtcaagatatctgtttcaa

SEQ ID NO: 239126 - DNA, 25 bp, Mus musculus
ccagatgtccagatctgctggaacg

SEQ ID NO: 239127 - DNA, 25 bp, Mus musculus
ccagatgtccaggtgtggtgcacac

SEQ ID NO: 239128 - DNA, 25 bp, Mus musculus
ccagatgtcctgcctgacctgcagg

SEQ ID NO: 239129 - DNA, 25 bp, Mus musculus
ccagatgtctgatacatatctgagt

SEQ ID NO: 239130 - DNA, 25 bp, Mus musculus
ccagatgtctggagtggatgaccat

SEQ ID NO: 239131 - DNA, 25 bp, Mus musculus
ccagatgtgaaagatgcaggtgatg

SEQ ID NO: 239132 - DNA, 25 bp, Mus musculus
ccagatgtgaaaggtgatgaaaggg

SEQ ID NO: 239133 - DNA, 25 bp, Mus musculus
ccagatgtgaccagctcattgcctg

SEQ ID NO: 239134 - DNA, 25 bp, Mus musculus
ccagatgtgaccaggcctgaaggga

SEQ ID NO: 239135 - DNA, 25 bp, Mus musculus
ccagatgtgagcaggaggcctctga

SEQ ID NO: 239136 - DNA, 25 bp, Mus musculus
ccagatgtgcagcgccgagtacaac

SEQ ID NO: 239137 - DNA, 25 bp, Mus musculus
ccagatgtgtcggtgtcccgatgct

SEQ ID NO: 239138 - DNA, 25 bp, Mus musculus
ccagatgtgtcgtaacatatcgcag

SEQ ID NO: 239139 - DNA, 25 bp, Mus musculus
ccagatgttcagccagtatccgcct

SEQ ID NO: 239140 - DNA, 25 bp, Mus musculus
ccagatgttccagaagaagctggtt

SEQ ID NO: 239141 - DNA, 25 bp, Mus musculus
ccagatgttccaggagggagtatga

SEQ ID NO: 239142 - DNA, 25 bp, Mus musculus
ccagatgttttaatggctgttagcg

SEQ ID NO: 239143 - DNA, 25 bp, Mus musculus
ccagattaaagtcaaataatttagt

SEQ ID NO: 239144 - DNA, 25 bp, Mus musculus
ccagattaagtctcctgaaaggtgt

SEQ ID NO: 239145 - DNA, 25 bp, Mus musculus
ccagattactaaggacaacatagaa

SEQ ID NO: 239146 - DNA, 25 bp, Mus musculus
ccagattagctctgccccaggcctc

SEQ ID NO: 239147 - DNA, 25 bp, Mus musculus
ccagattcaaactgccgtggtgaga

SEQ ID NO: 239148 - DNA, 25 bp, Mus musculus
ccagattcaggcgacaactggccaa

SEQ ID NO: 239149 - DNA, 25 bp, Mus musculus
ccagattccaggataacataaatgt

SEQ ID NO: 239150 - DNA, 25 bp, Mus musculus
ccagattctactcagcttcagagga

SEQ ID NO: 239151 - DNA, 25 bp, Mus musculus
ccagattcttggataaggaattgga

SEQ ID NO: 239152 - DNA, 25 bp, Mus musculus
ccagattgccgacttcaaggaggca

SEQ ID NO: 239153 - DNA, 25 bp, Mus musculus
ccagattgccgatcgagttctctaa

SEQ ID NO: 239154 - DNA, 25 bp, Mus musculus
ccagattgctttggcctggagagag

SEQ ID NO: 239155 - DNA, 25 bp, Mus musculus
ccagattgggggcagcaactcttac

SEQ ID NO: 239156 - DNA, 25 bp, Mus musculus
ccagattgtaaagcgtgaagacagc

SEQ ID NO: 239157 - DNA, 25 bp, Mus musculus
ccagattgtaaagtgatggttcatg

SEQ ID NO: 239158 - DNA, 25 bp, Mus musculus
ccagatttccagccgtggtcaagtt

SEQ ID NO: 239159 - DNA, 25 bp, Mus musculus
ccagatttgcaagacagttcggcat

SEQ ID NO: 239160 - DNA, 25 bp, Mus musculus
ccagatttgcaagggagttgattta

SEQ ID NO: 239161 - DNA, 25 bp, Mus musculus
ccagattttcagggcattgtgcttc

SEQ ID NO: 239162 - DNA, 25 bp, Mus musculus
ccagcaaaagaaaagatgagaggct

SEQ ID NO: 239163 - DNA, 25 bp, Mus musculus
ccagcaaaatgtggattttgttgac

SEQ ID NO: 239164 - DNA, 25 bp, Mus musculus
ccagcaaacagatactctgtcaaag

SEQ ID NO: 239165 - DNA, 25 bp, Mus musculus
ccagcaaacagccaaagttgttaca

SEQ ID NO: 239166 - DNA, 25 bp, Mus musculus
ccagcaaaccagaagagcccttggt

SEQ ID NO: 239167 - DNA, 25 bp, Mus musculus
ccagcaaactgcctactcgcccagc

SEQ ID NO: 239168 - DNA, 25 bp, Mus musculus
ccagcaaactgcggggactgaagcc

SEQ ID NO: 239169 - DNA, 25 bp, Mus musculus
ccagcaaactggcaccgacagcccg

SEQ ID NO: 239170 - DNA, 25 bp, Mus musculus
ccagcaaatagatcagagccactgg

SEQ ID NO: 239171 - DNA, 25 bp, Mus musculus
ccagcaaatagttccagggtcacat

SEQ ID NO: 239172 - DNA, 25 bp, Mus musculus
ccagcaaatctcactggaagctcct

SEQ ID NO: 239173 - DNA, 25 bp, Mus musculus
ccagcaaatgagggcgaacagctaa

SEQ ID NO: 239174 - DNA, 25 bp, Mus musculus
ccagcaaatgcacccaaattaaaac

SEQ ID NO: 239175 - DNA, 25 bp, Mus musculus
ccagcaaatgcgaagggtatgtcgg

SEQ ID NO: 239176 - DNA, 25 bp, Mus musculus
ccagcaaatgcgaagtgtgcaagta

SEQ ID NO: 239177 - DNA, 25 bp, Mus musculus
ccagcaacaaacatctctccaactc

SEQ ID NO: 239178 - DNA, 25 bp, Mus musculus
ccagcaacaaagtcacttagaaacg

SEQ ID NO: 239179 - DNA, 25 bp, Mus musculus
ccagcaacaacaggtgactgtggtc

SEQ ID NO: 239180 - DNA, 25 bp, Mus musculus
ccagcaacagctcctgaggaagcgt

SEQ ID NO: 239181 - DNA, 25 bp, Mus musculus
ccagcaacataccagaatccacaca

SEQ ID NO: 239182 - DNA, 25 bp, Mus musculus
ccagcaacataccagagtcctctga

SEQ ID NO: 239183 - DNA, 25 bp, Mus musculus
ccagcaacatacgtgatggaccaag

SEQ ID NO: 239184 - DNA, 25 bp, Mus musculus
ccagcaaccagaatttcagcttcct

SEQ ID NO: 239185 - DNA, 25 bp, Mus musculus
ccagcaaccagcacccggcagtgcc

SEQ ID NO: 239186 - DNA, 25 bp, Mus musculus
ccagcaaccaggagctggagccctg

SEQ ID NO: 239187 - DNA, 25 bp, Mus musculus
ccagcaacttgaggctcctgagcat

SEQ ID NO: 239188 - DNA, 25 bp, Mus musculus
ccagcaagatccgagccttcatcct

SEQ ID NO: 239189 - DNA, 25 bp, Mus musculus
ccagcaagatgatgactctgctgca

SEQ ID NO: 239190 - DNA, 25 bp, Mus musculus
ccagcaagccaagctgatctataag

SEQ ID NO: 239191 - DNA, 25 bp, Mus musculus
ccagcaagctgctcgactggctggt

SEQ ID NO: 239192 - DNA, 25 bp, Mus musculus
ccagcaagcttcggaggggaaaatg

SEQ ID NO: 239193 - DNA, 25 bp, Mus musculus
ccagcaaggacccaagcaaccgacg

SEQ ID NO: 239194 - DNA, 25 bp, Mus musculus
ccagcaaggagattcttccaagaag

SEQ ID NO: 239195 - DNA, 25 bp, Mus musculus
ccagcaatccatgagatcagggcac

SEQ ID NO: 239196 - DNA, 25 bp, Mus musculus
ccagcaatctcagggttttggcaag

SEQ ID NO: 239197 - DNA, 25 bp, Mus musculus
ccagcaatgaggtaccatggttgtt

SEQ ID NO: 239198 - DNA, 25 bp, Mus musculus
ccagcaatgaggtggctcacaactc

SEQ ID NO: 239199 - DNA, 25 bp, Mus musculus
ccagcaatgccagtgccttcgtgca

SEQ ID NO: 239200 - DNA, 25 bp, Mus musculus
ccagcaatgccagttttcccatgac

SEQ ID NO: 239201 - DNA, 25 bp, Mus musculus
ccagcacaaacaggccaaactcaaa

SEQ ID NO: 239202 - DNA, 25 bp, Mus musculus
ccagcacaagaaccaggcagataaa

SEQ ID NO: 239203 - DNA, 25 bp, Mus musculus
ccagcacacagacctatgcttggat

SEQ ID NO: 239204 - DNA, 25 bp, Mus musculus
ccagcacacaggaggtctggcattc

SEQ ID NO: 239205 - DNA, 25 bp, Mus musculus
ccagcacacccagcagcccgagcaa

SEQ ID NO: 239206 - DNA, 25 bp, Mus musculus
ccagcacacggcagccggttgcctc

SEQ ID NO: 239207 - DNA, 25 bp, Mus musculus
ccagcacacggcagtgactgatcac

SEQ ID NO: 239208 - DNA, 25 bp, Mus musculus
ccagcacacttgtatggggatcctg

SEQ ID NO: 239209 - DNA, 25 bp, Mus musculus
ccagcacacttgtccaacaaagttc

SEQ ID NO: 239210 - DNA, 25 bp, Mus musculus
ccagcacagcaaagcgccaggctcc

SEQ ID NO: 239211 - DNA, 25 bp, Mus musculus
ccagcacagcatgagaaactctctg

SEQ ID NO: 239212 - DNA, 25 bp, Mus musculus
ccagcacagtcggagccagggagag

SEQ ID NO: 239213 - DNA, 25 bp, Mus musculus
ccagcacatctcagccagtgaggag

SEQ ID NO: 239214 - DNA, 25 bp, Mus musculus
ccagcacatctgcagagaaaaccga

SEQ ID NO: 239215 - DNA, 25 bp, Mus musculus
ccagcaccagcactgccccccaaac

SEQ ID NO: 239216 - DNA, 25 bp, Mus musculus
ccagcaccagctcttttgatatagt

SEQ ID NO: 239217 - DNA, 25 bp, Mus musculus
ccagcaccagcttgctttctcttaa

SEQ ID NO: 239218 - DNA, 25 bp, Mus musculus
ccagcaccagtacctcatgcctgag

SEQ ID NO: 239219 - DNA, 25 bp, Mus musculus
ccagcacccaggccctgtccagcag

SEQ ID NO: 239220 - DNA, 25 bp, Mus musculus
ccagcacccgccgccgctcctcttc

SEQ ID NO: 239221 - DNA, 25 bp, Mus musculus
ccagcacccggctacctgaggacat

SEQ ID NO: 239222 - DNA, 25 bp, Mus musculus
ccagcacccgggctgtggctgtact

SEQ ID NO: 239223 - DNA, 25 bp, Mus musculus
ccagcaccctgaagcaatcccacag

SEQ ID NO: 239224 - DNA, 25 bp, Mus musculus
ccagcaccggcgcgtaagcaatggc

SEQ ID NO: 239225 - DNA, 25 bp, Mus musculus
ccagcacctacgtttgttgaaggag

SEQ ID NO: 239226 - DNA, 25 bp, Mus musculus
ccagcacctcagggatttgcaaatc

SEQ ID NO: 239227 - DNA, 25 bp, Mus musculus
ccagcacctcagggccaataataag

SEQ ID NO: 239228 - DNA, 25 bp, Mus musculus
ccagcacctcagtgccttcccagac

SEQ ID NO: 239229 - DNA, 25 bp, Mus musculus
ccagcacctgcgcttagatccggct

SEQ ID NO: 239230 - DNA, 25 bp, Mus musculus
ccagcacctgcggaaaatttccctt

SEQ ID NO: 239231 - DNA, 25 bp, Mus musculus
ccagcacctggctgacagcctacgt

SEQ ID NO: 239232 - DNA, 25 bp, Mus musculus
ccagcacctgtcagaaccacccccg

SEQ ID NO: 239233 - DNA, 25 bp, Mus musculus
ccagcacctgtcagacaccactaac

SEQ ID NO: 239234 - DNA, 25 bp, Mus musculus
ccagcacctgtcagacgagaagaac

SEQ ID NO: 239235 - DNA, 25 bp, Mus musculus
ccagcacctgtccctcactctcccc

SEQ ID NO: 239236 - DNA, 25 bp, Mus musculus
ccagcacctgtgaataaaagctgtg

SEQ ID NO: 239237 - DNA, 25 bp, Mus musculus
ccagcaccttaggagtgtaaagagc

SEQ ID NO: 239238 - DNA, 25 bp, Mus musculus
ccagcaccttcagctatctaacttc

SEQ ID NO: 239239 - DNA, 25 bp, Mus musculus
ccagcaccttctgcttcccggactc

SEQ ID NO: 239240 - DNA, 25 bp, Mus musculus
ccagcacgacttggctctgctgcgc

SEQ ID NO: 239241 - DNA, 25 bp, Mus musculus
ccagcacgcagctttacatggtgag

SEQ ID NO: 239242 - DNA, 25 bp, Mus musculus
ccagcacgccgctttttagaacttc

SEQ ID NO: 239243 - DNA, 25 bp, Mus musculus
ccagcacgctcaggaacaagaattt

SEQ ID NO: 239244 - DNA, 25 bp, Mus musculus
ccagcacgtacaagagagaaatgtc

SEQ ID NO: 239245 - DNA, 25 bp, Mus musculus
ccagcacgtgaggacaagtttttac

SEQ ID NO: 239246 - DNA, 25 bp, Mus musculus
ccagcactagggctccttctcctac

SEQ ID NO: 239247 - DNA, 25 bp, Mus musculus
ccagcactattaaggaggccttgtc

SEQ ID NO: 239248 - DNA, 25 bp, Mus musculus
ccagcactcgggaggcagaggcagg

SEQ ID NO: 239249 - DNA, 25 bp, Mus musculus
ccagcactctggctgggcgctcacc

SEQ ID NO: 239250 - DNA, 25 bp, Mus musculus
ccagcactgcatgagaaactctctg

SEQ ID NO: 239251 - DNA, 25 bp, Mus musculus
ccagcactggagagaaacttgatgg

SEQ ID NO: 239252 - DNA, 25 bp, Mus musculus
ccagcactggcaggctgaagatgga

SEQ ID NO: 239253 - DNA, 25 bp, Mus musculus
ccagcactggggatgtccagctcgc

SEQ ID NO: 239254 - DNA, 25 bp, Mus musculus
ccagcactgtgtcgaccccctcacc

SEQ ID NO: 239255 - DNA, 25 bp, Mus musculus
ccagcagaaaaccggttgctgtggt

SEQ ID NO: 239256 - DNA, 25 bp, Mus musculus
ccagcagaagatgatgactattctc

SEQ ID NO: 239257 - DNA, 25 bp, Mus musculus
ccagcagaagattctactcaacatg

SEQ ID NO: 239258 - DNA, 25 bp, Mus musculus
ccagcagaagtacgatggaatcatc

SEQ ID NO: 239259 - DNA, 25 bp, Mus musculus
ccagcagaattctgagatcttgagt

SEQ ID NO: 239260 - DNA, 25 bp, Mus musculus
ccagcagaattctggttttggtaaa

SEQ ID NO: 239261 - DNA, 25 bp, Mus musculus
ccagcagacagctcccaacccctcc

SEQ ID NO: 239262 - DNA, 25 bp, Mus musculus
ccagcagacggtgcaaccaggtaca

SEQ ID NO: 239263 - DNA, 25 bp, Mus musculus
ccagcagacggtggaaattgacaac

SEQ ID NO: 239264 - DNA, 25 bp, Mus musculus
ccagcagacgtcccccgccacaggc

SEQ ID NO: 239265 - DNA, 25 bp, Mus musculus
ccagcagactgtaaaacagactagc

SEQ ID NO: 239266 - DNA, 25 bp, Mus musculus
ccagcagactttctcctgtctatct

SEQ ID NO: 239267 - DNA, 25 bp, Mus musculus
ccagcagagaagagtccagacagaa

SEQ ID NO: 239268 - DNA, 25 bp, Mus musculus
ccagcagagaaggtgacagaaggtg

SEQ ID NO: 239269 - DNA, 25 bp, Mus musculus
ccagcagagccatggacaaggaata

SEQ ID NO: 239270 - DNA, 25 bp, Mus musculus
ccagcagagggtcgaatcaacacct

SEQ ID NO: 239271 - DNA, 25 bp, Mus musculus
ccagcagatcaagaattttctgaat

SEQ ID NO: 239272 - DNA, 25 bp, Mus musculus
ccagcagatgaccagcaaactcacc

SEQ ID NO: 239273 - DNA, 25 bp, Mus musculus
ccagcagcaagaaggtgacgggccg

SEQ ID NO: 239274 - DNA, 25 bp, Mus musculus
ccagcagcaagtgggcagaagttcc

SEQ ID NO: 239275 - DNA, 25 bp, Mus musculus
ccagcagcacggaggacttccctga

SEQ ID NO: 239276 - DNA, 25 bp, Mus musculus
ccagcagcacggtggacttccctga

SEQ ID NO: 239277 - DNA, 25 bp, Mus musculus
ccagcagcacttctcctctctgacc

SEQ ID NO: 239278 - DNA, 25 bp, Mus musculus
ccagcagcagaatcggaagactctt

SEQ ID NO: 239279 - DNA, 25 bp, Mus musculus
ccagcagcagactcgtctcaaggag

SEQ ID NO: 239280 - DNA, 25 bp, Mus musculus
ccagcagcagatagtttcttaatga

SEQ ID NO: 239281 - DNA, 25 bp, Mus musculus
ccagcagcagatcccagagtcccag

SEQ ID NO: 239282 - DNA, 25 bp, Mus musculus
ccagcagcagattttgtggccctaa

SEQ ID NO: 239283 - DNA, 25 bp, Mus musculus
ccagcagcaggaccagtgtgtggcg

SEQ ID NO: 239284 - DNA, 25 bp, Mus musculus
ccagcagcagtcccgttctgcagac

SEQ ID NO: 239285 - DNA, 25 bp, Mus musculus
ccagcagcagtttgtgcagtgggat

SEQ ID NO: 239286 - DNA, 25 bp, Mus musculus
ccagcagcatccagtgttgcctgtg

SEQ ID NO: 239287 - DNA, 25 bp, Mus musculus
ccagcagcatggctacaaaatgcac

SEQ ID NO: 239288 - DNA, 25 bp, Mus musculus
ccagcagccacagagggagggagct

SEQ ID NO: 239289 - DNA, 25 bp, Mus musculus
ccagcagccacagcgggcagctcag

SEQ ID NO: 239290 - DNA, 25 bp, Mus musculus
ccagcagccagaaatctcataagcg

SEQ ID NO: 239291 - DNA, 25 bp, Mus musculus
ccagcagccagaatgaaggcttgac

SEQ ID NO: 239292 - DNA, 25 bp, Mus musculus
ccagcagccagatgaaggtctgaca

SEQ ID NO: 239293 - DNA, 25 bp, Mus musculus
ccagcagcccagagcaatcaggtgg

SEQ ID NO: 239294 - DNA, 25 bp, Mus musculus
ccagcagcccagatctactcttcag

SEQ ID NO: 239295 - DNA, 25 bp, Mus musculus
ccagcagcccagcccactgagtgtt

SEQ ID NO: 239296 - DNA, 25 bp, Mus musculus
ccagcagcccagggtcaggtacctg

SEQ ID NO: 239297 - DNA, 25 bp, Mus musculus
ccagcagcccagggttggaagctgt

SEQ ID NO: 239298 - DNA, 25 bp, Mus musculus
ccagcagccgagagtacaaacaggc

SEQ ID NO: 239299 - DNA, 25 bp, Mus musculus
ccagcagcctttaccagccctttgg

SEQ ID NO: 239300 - DNA, 25 bp, Mus musculus
ccagcagctcagggactcagcgatg

SEQ ID NO: 239301 - DNA, 25 bp, Mus musculus
ccagcagctgaacagaaaatgtatc

SEQ ID NO: 239302 - DNA, 25 bp, Mus musculus
ccagcagctgaagtccgcacagagt

SEQ ID NO: 239303 - DNA, 25 bp, Mus musculus
ccagcagctgaatggttaccacaag

SEQ ID NO: 239304 - DNA, 25 bp, Mus musculus
ccagcagctgtcaaggaactgaatg

SEQ ID NO: 239305 - DNA, 25 bp, Mus musculus
ccagcagcttagatggcaggcatgc

SEQ ID NO: 239306 - DNA, 25 bp, Mus musculus
ccagcaggactcggatgaggccatc

SEQ ID NO: 239307 - DNA, 25 bp, Mus musculus
ccagcaggagcgcaggttcctcatg

SEQ ID NO: 239308 - DNA, 25 bp, Mus musculus
ccagcaggcacgcagggcagaagtc

SEQ ID NO: 239309 - DNA, 25 bp, Mus musculus
ccagcaggcagctgccagaccctct

SEQ ID NO: 239310 - DNA, 25 bp, Mus musculus
ccagcaggcatccagggcagaagtc

SEQ ID NO: 239311 - DNA, 25 bp, Mus musculus
ccagcaggcatgggtaggatttgcg

SEQ ID NO: 239312 - DNA, 25 bp, Mus musculus
ccagcaggccacaggcaatgtgagc

SEQ ID NO: 239313 - DNA, 25 bp, Mus musculus
ccagcaggcggaggtgcgtggtcca

SEQ ID NO: 239314 - DNA, 25 bp, Mus musculus
ccagcagggagagcagagacggtaa

SEQ ID NO: 239315 - DNA, 25 bp, Mus musculus
ccagcagggtcagggactcatgcag

SEQ ID NO: 239316 - DNA, 25 bp, Mus musculus
ccagcaggtaattaacgagatggtg

SEQ ID NO: 239317 - DNA, 25 bp, Mus musculus
ccagcaggtcccagttgtactgcag

SEQ ID NO: 239318 - DNA, 25 bp, Mus musculus
ccagcaggtgagaggccacgattgc

SEQ ID NO: 239319 - DNA, 25 bp, Mus musculus
ccagcagtagggagtgccgcgtctt

SEQ ID NO: 239320 - DNA, 25 bp, Mus musculus
ccagcagtaggggaacaaagatgat

SEQ ID NO: 239321 - DNA, 25 bp, Mus musculus
ccagcagtattcctcctgcttctaa

SEQ ID NO: 239322 - DNA, 25 bp, Mus musculus
ccagcagtcagggcatctgttatgc

SEQ ID NO: 239323 - DNA, 25 bp, Mus musculus
ccagcagtctaaggtgtctgaacac

SEQ ID NO: 239324 - DNA, 25 bp, Mus musculus
ccagcagtctgtatgaggattgtgg

SEQ ID NO: 239325 - DNA, 25 bp, Mus musculus
ccagcagtgcccgaattgagagaaa

SEQ ID NO: 239326 - DNA, 25 bp, Mus musculus
ccagcagtggataaaatattttgac

SEQ ID NO: 239327 - DNA, 25 bp, Mus musculus
ccagcagttacacctggagcactcc

SEQ ID NO: 239328 - DNA, 25 bp, Mus musculus
ccagcagttcacgattctcgagcag

SEQ ID NO: 239329 - DNA, 25 bp, Mus musculus
ccagcagttcagtagctatgagcca

SEQ ID NO: 239330 - DNA, 25 bp, Mus musculus
ccagcataaagaaggaatcacccac

SEQ ID NO: 239331 - DNA, 25 bp, Mus musculus
ccagcataaagatagatgtgctaac

SEQ ID NO: 239332 - DNA, 25 bp, Mus musculus
ccagcataagaggcggtgactccat

SEQ ID NO: 239333 - DNA, 25 bp, Mus musculus
ccagcatacgggcaccttgttgtga

SEQ ID NO: 239334 - DNA, 25 bp, Mus musculus
ccagcatagagggactcatgggccg

SEQ ID NO: 239335 - DNA, 25 bp, Mus musculus
ccagcatcagggagcctgtatatgg

SEQ ID NO: 239336 - DNA, 25 bp, Mus musculus
ccagcatcaggtctccttcccttga

SEQ ID NO: 239337 - DNA, 25 bp, Mus musculus
ccagcatcatgatatccgagtggtg

SEQ ID NO: 239338 - DNA, 25 bp, Mus musculus
ccagcatccacgcacatgaggaagc

SEQ ID NO: 239339 - DNA, 25 bp, Mus musculus
ccagcatcctcagctctgggcccca

SEQ ID NO: 239340 - DNA, 25 bp, Mus musculus
ccagcatcctctctgaggtgacccc

SEQ ID NO: 239341 - DNA, 25 bp, Mus musculus
ccagcatcgatttgactttattgac

SEQ ID NO: 239342 - DNA, 25 bp, Mus musculus
ccagcatcgcaaggaaactcatttt

SEQ ID NO: 239343 - DNA, 25 bp, Mus musculus
ccagcatcgcaaggcctctgcaggt

SEQ ID NO: 239344 - DNA, 25 bp, Mus musculus
ccagcatcgcaagggtactggcgga

SEQ ID NO: 239345 - DNA, 25 bp, Mus musculus
ccagcatcgtggccaagatggacaa

SEQ ID NO: 239346 - DNA, 25 bp, Mus musculus
ccagcatctgagagcaaccaggacc

SEQ ID NO: 239347 - DNA, 25 bp, Mus musculus
ccagcatctgagaggtggactctgt

SEQ ID NO: 239348 - DNA, 25 bp, Mus musculus
ccagcatcttccagtcaaaagaatc

SEQ ID NO: 239349 - DNA, 25 bp, Mus musculus
ccagcatgagttctgaatgtgatgt

SEQ ID NO: 239350 - DNA, 25 bp, Mus musculus
ccagcatgcactaggaggaatttgg

SEQ ID NO: 239351 - DNA, 25 bp, Mus musculus
ccagcatgcagaacagtcacagcgg

SEQ ID NO: 239352 - DNA, 25 bp, Mus musculus
ccagcatgggagagttgcagcttca

SEQ ID NO: 239353 - DNA, 25 bp, Mus musculus
ccagcatgtccagctgcccgagaga

SEQ ID NO: 239354 - DNA, 25 bp, Mus musculus
ccagcattcagaagatgacttacaa

SEQ ID NO: 239355 - DNA, 25 bp, Mus musculus
ccagcattggaagagtgtatcctca

SEQ ID NO: 239356 - DNA, 25 bp, Mus musculus
ccagcattgtgaaagctcgtccctg

SEQ ID NO: 239357 - DNA, 25 bp, Mus musculus
ccagcattgtgaaagggcagcggag

SEQ ID NO: 239358 - DNA, 25 bp, Mus musculus
ccagcatttctcaaaaactgttctg

SEQ ID NO: 239359 - DNA, 25 bp, Mus musculus
ccagcatttctcaaatcatctgaaa

SEQ ID NO: 239360 - DNA, 25 bp, Mus musculus
ccagcatttgattaaagcaccgtga

SEQ ID NO: 239361 - DNA, 25 bp, Mus musculus
ccagcatttgggggagagcacggtc

SEQ ID NO: 239362 - DNA, 25 bp, Mus musculus
ccagcatttggtataggagggattg

SEQ ID NO: 239363 - DNA, 25 bp, Mus musculus
ccagcatttttcaggtcacctgccc

SEQ ID NO: 239364 - DNA, 25 bp, Mus musculus
ccagcatttttcagtccaaagaatc

SEQ ID NO: 239365 - DNA, 25 bp, Mus musculus
ccagccaaagctgaatcgcggctgg

SEQ ID NO: 239366 - DNA, 25 bp, Mus musculus
ccagccaaagctgagagacacagaa

SEQ ID NO: 239367 - DNA, 25 bp, Mus musculus
ccagccaaaggactgcaggctacaa

SEQ ID NO: 239368 - DNA, 25 bp, Mus musculus
ccagccaacagaacctgagccagtc

SEQ ID NO: 239369 - DNA, 25 bp, Mus musculus
ccagccaacagtgcaacatagattc

SEQ ID NO: 239370 - DNA, 25 bp, Mus musculus
ccagccaaccagcggaaatgtgagc

SEQ ID NO: 239371 - DNA, 25 bp, Mus musculus
ccagccaacccagatcaggcgtcag

SEQ ID NO: 239372 - DNA, 25 bp, Mus musculus
ccagccaacggaggccggctggcat

SEQ ID NO: 239373 - DNA, 25 bp, Mus musculus
ccagccaaggcaggatggaaccgcg

SEQ ID NO: 239374 - DNA, 25 bp, Mus musculus
ccagccaaggcttaggcatcgtctt

SEQ ID NO: 239375 - DNA, 25 bp, Mus musculus
ccagccaagggcaggcatcagaaac

SEQ ID NO: 239376 - DNA, 25 bp, Mus musculus
ccagccaatgagaaagagaaaactg

SEQ ID NO: 239377 - DNA, 25 bp, Mus musculus
ccagccaatgccaacgccacgcctt

SEQ ID NO: 239378 - DNA, 25 bp, Mus musculus
ccagccacagatgaacgagaccgtg

SEQ ID NO: 239379 - DNA, 25 bp, Mus musculus
ccagccacaggagctcttagggaag

SEQ ID NO: 239380 - DNA, 25 bp, Mus musculus
ccagccacaggcccaggccttgtca

SEQ ID NO: 239381 - DNA, 25 bp, Mus musculus
ccagccaccagcccctgcccggatg

SEQ ID NO: 239382 - DNA, 25 bp, Mus musculus
ccagccacctattgacccaaggatg

SEQ ID NO: 239383 - DNA, 25 bp, Mus musculus
ccagccactcagaacccctggcctc

SEQ ID NO: 239384 - DNA, 25 bp, Mus musculus
ccagccactcagtacccctggcctc

SEQ ID NO: 239385 - DNA, 25 bp, Mus musculus
ccagccactccagctcccggcaact

SEQ ID NO: 239386 - DNA, 25 bp, Mus musculus
ccagccagaacccgcctagtgatga

SEQ ID NO: 239387 - DNA, 25 bp, Mus musculus
ccagccagaacccgtcttttcatct

SEQ ID NO: 239388 - DNA, 25 bp, Mus musculus
ccagccagaagcaaacgatggaggc

SEQ ID NO: 239389 - DNA, 25 bp, Mus musculus
ccagccagaagcaaagggtgtgagt

SEQ ID NO: 239390 - DNA, 25 bp, Mus musculus
ccagccagccagagaaagaagtggc

SEQ ID NO: 239391 - DNA, 25 bp, Mus musculus
ccagccagccagctttcagctggcc

SEQ ID NO: 239392 - DNA, 25 bp, Mus musculus
ccagccagccagggtcccaaaggcc

SEQ ID NO: 239393 - DNA, 25 bp, Mus musculus
ccagccagcccaggtgcatacacag

SEQ ID NO: 239394 - DNA, 25 bp, Mus musculus
ccagccagcccaggttttacttggg

SEQ ID NO: 239395 - DNA, 25 bp, Mus musculus
ccagccagctcgctgagcctgttcc

SEQ ID NO: 239396 - DNA, 25 bp, Mus musculus
ccagccagctgggagggcgtggagc

SEQ ID NO: 239397 - DNA, 25 bp, Mus musculus
ccagccaggaatgccatttatgtcg

SEQ ID NO: 239398 - DNA, 25 bp, Mus musculus
ccagccaggagagaatctgggagca

SEQ ID NO: 239399 - DNA, 25 bp, Mus musculus
ccagccaggagctatcctctgaact

SEQ ID NO: 239400 - DNA, 25 bp, Mus musculus
ccagccaggccgcaggcatcaatac

SEQ ID NO: 239401 - DNA, 25 bp, Mus musculus
ccagccaggcctgtccaccatcaca

SEQ ID NO: 239402 - DNA, 25 bp, Mus musculus
ccagccaggtacctgatgtgatggt

SEQ ID NO: 239403 - DNA, 25 bp, Mus musculus
ccagccagtaattgggtgctgtacc

SEQ ID NO: 239404 - DNA, 25 bp, Mus musculus
ccagccatcccccgcttgaaagatg

SEQ ID NO: 239405 - DNA, 25 bp, Mus musculus
ccagccatcgttaaggtcttccatg

SEQ ID NO: 239406 - DNA, 25 bp, Mus musculus
ccagccatctttgaaatgcccattt

SEQ ID NO: 239407 - DNA, 25 bp, Mus musculus
ccagccatgctgagcaagctcatgt

SEQ ID NO: 239408 - DNA, 25 bp, Mus musculus
ccagccattcacaagaattggccta

SEQ ID NO: 239409 - DNA, 25 bp, Mus musculus
ccagccattcacaagctaattctga

SEQ ID NO: 239410 - DNA, 25 bp, Mus musculus
ccagcccaaagaggatctaagccac

SEQ ID NO: 239411 - DNA, 25 bp, Mus musculus
ccagcccaacaaaaagttgattcac

SEQ ID NO: 239412 - DNA, 25 bp, Mus musculus
ccagcccaaccatgctgctgaaccg

SEQ ID NO: 239413 - DNA, 25 bp, Mus musculus
ccagcccaacctggctcggaagagg

SEQ ID NO: 239414 - DNA, 25 bp, Mus musculus
ccagcccaagttccaaagaacattc

SEQ ID NO: 239415 - DNA, 25 bp, Mus musculus
ccagcccacaccaggatgcaggcag

SEQ ID NO: 239416 - DNA, 25 bp, Mus musculus
ccagcccactgccagacccaggcac

SEQ ID NO: 239417 - DNA, 25 bp, Mus musculus
ccagcccagaaaagcggtttccaac

SEQ ID NO: 239418 - DNA, 25 bp, Mus musculus
ccagcccagaaaagcttccgtagtg

SEQ ID NO: 239419 - DNA, 25 bp, Mus musculus
ccagcccagaagtaccattcccgga

SEQ ID NO: 239420 - DNA, 25 bp, Mus musculus
ccagcccagagagaggtcttttggc

SEQ ID NO: 239421 - DNA, 25 bp, Mus musculus
ccagcccagagatacattgttgcaa

SEQ ID NO: 239422 - DNA, 25 bp, Mus musculus
ccagcccagagctagatttgtcaaa

SEQ ID NO: 239423 - DNA, 25 bp, Mus musculus
ccagcccagcccctggttccacacc

SEQ ID NO: 239424 - DNA, 25 bp, Mus musculus
ccagcccagcccctgtgccgggagc

SEQ ID NO: 239425 - DNA, 25 bp, Mus musculus
ccagcccagctctggacgctatgct

SEQ ID NO: 239426 - DNA, 25 bp, Mus musculus
ccagcccagctctggggagaatgta

SEQ ID NO: 239427 - DNA, 25 bp, Mus musculus
ccagcccagtgaccaatgggaacag

SEQ ID NO: 239428 - DNA, 25 bp, Mus musculus
ccagcccataaaaacgtcaacgtcc

SEQ ID NO: 239429 - DNA, 25 bp, Mus musculus
ccagccccaatcaggaaattaccgg

SEQ ID NO: 239430 - DNA, 25 bp, Mus musculus
ccagccccacgggtctcagaggtgg

SEQ ID NO: 239431 - DNA, 25 bp, Mus musculus
ccagccccagaacaaggaattgaag

SEQ ID NO: 239432 - DNA, 25 bp, Mus musculus
ccagccccagcagcctggtagattg

SEQ ID NO: 239433 - DNA, 25 bp, Mus musculus
ccagccccagtccttcaggctcccg

SEQ ID NO: 239434 - DNA, 25 bp, Mus musculus
ccagccccatgatgatactgaggac

SEQ ID NO: 239435 - DNA, 25 bp, Mus musculus
ccagccccatgatgatcgcaaaaga

SEQ ID NO: 239436 - DNA, 25 bp, Mus musculus
ccagccccatgatggcttcttttct

SEQ ID NO: 239437 - DNA, 25 bp, Mus musculus
ccagcccccaaccatcaaatcggga

SEQ ID NO: 239438 - DNA, 25 bp, Mus musculus
ccagcccccagatctccttgtcagc

SEQ ID NO: 239439 - DNA, 25 bp, Mus musculus
ccagccccggtagaggtatggatgg

SEQ ID NO: 239440 - DNA, 25 bp, Mus musculus
ccagcccctaaaggtctcagaggtg

SEQ ID NO: 239441 - DNA, 25 bp, Mus musculus
ccagcccctgatacgacccggacag

SEQ ID NO: 239442 - DNA, 25 bp, Mus musculus
ccagcccctggttccacaccctctg

SEQ ID NO: 239443 - DNA, 25 bp, Mus musculus
ccagcccctgtcctgcacttcttcc

SEQ ID NO: 239444 - DNA, 25 bp, Mus musculus
ccagcccctgtgccgggagcccgtg

SEQ ID NO: 239445 - DNA, 25 bp, Mus musculus
ccagccccttcagaacctgtctgtc

SEQ ID NO: 239446 - DNA, 25 bp, Mus musculus
ccagccccttcagctgtgcagaacc

SEQ ID NO: 239447 - DNA, 25 bp, Mus musculus
ccagcccgaggacaagaaaagaaaa

SEQ ID NO: 239448 - DNA, 25 bp, Mus musculus
ccagcccgccgctcgaaacctcgac

SEQ ID NO: 239449 - DNA, 25 bp, Mus musculus
ccagcccgcctttggctcccatcca

SEQ ID NO: 239450 - DNA, 25 bp, Mus musculus
ccagcccggatgaggtggctctggt

SEQ ID NO: 239451 - DNA, 25 bp, Mus musculus
ccagcccgtaagtttggtgagcggc

SEQ ID NO: 239452 - DNA, 25 bp, Mus musculus
ccagccctcacctcctgtctcacac

SEQ ID NO: 239453 - DNA, 25 bp, Mus musculus
ccagccctgaagccgaacaaaaaag

SEQ ID NO: 239454 - DNA, 25 bp, Mus musculus
ccagccctgagcaggagtctgcagg

SEQ ID NO: 239455 - DNA, 25 bp, Mus musculus
ccagccctgagggccatggcggact

SEQ ID NO: 239456 - DNA, 25 bp, Mus musculus
ccagccctgccccagcaccacctac

SEQ ID NO: 239457 - DNA, 25 bp, Mus musculus
ccagccctggggtacttgttgactg

SEQ ID NO: 239458 - DNA, 25 bp, Mus musculus
ccagccctgtgcagtatcgtaccga

SEQ ID NO: 239459 - DNA, 25 bp, Mus musculus
ccagcccttcactggccccttcatg

SEQ ID NO: 239460 - DNA, 25 bp, Mus musculus
ccagccctttaaggcctccagcata

SEQ ID NO: 239461 - DNA, 25 bp, Mus musculus
ccagccgaccaggaactaggaagta

SEQ ID NO: 239462 - DNA, 25 bp, Mus musculus
ccagccgaccgaggatttggagttt

SEQ ID NO: 239463 - DNA, 25 bp, Mus musculus
ccagccgagggagaggcaatacaga

SEQ ID NO: 239464 - DNA, 25 bp, Mus musculus
ccagccgatggaaaggtcaatttac

SEQ ID NO: 239465 - DNA, 25 bp, Mus musculus
ccagccgcacctacgagctcctgga

SEQ ID NO: 239466 - DNA, 25 bp, Mus musculus
ccagccgcagagccccaaggacgat

SEQ ID NO: 239467 - DNA, 25 bp, Mus musculus
ccagccgccacaggaactggtgtgc

SEQ ID NO: 239468 - DNA, 25 bp, Mus musculus
ccagccgccacaggtcctgttgagt

SEQ ID NO: 239469 - DNA, 25 bp, Mus musculus
ccagccgccccacggcggagcctga

SEQ ID NO: 239470 - DNA, 25 bp, Mus musculus
ccagccgccccacgggccatggagg

SEQ ID NO: 239471 - DNA, 25 bp, Mus musculus
ccagccgcccgcacggagcggcggc

SEQ ID NO: 239472 - DNA, 25 bp, Mus musculus
ccagccgctatggagatggaaaccc

SEQ ID NO: 239473 - DNA, 25 bp, Mus musculus
ccagccgctcatgtgggatatgagc

SEQ ID NO: 239474 - DNA, 25 bp, Mus musculus
ccagccgctgtggtgatgagatgga

SEQ ID NO: 239475 - DNA, 25 bp, Mus musculus
ccagccggagtgcccatgaacggga

SEQ ID NO: 239476 - DNA, 25 bp, Mus musculus
ccagccggatactggacatgctggt

SEQ ID NO: 239477 - DNA, 25 bp, Mus musculus
ccagccggatactggatgaagacag

SEQ ID NO: 239478 - DNA, 25 bp, Mus musculus
ccagccgggatacaggtgtgaatga

SEQ ID NO: 239479 - DNA, 25 bp, Mus musculus
ccagccgggatgctgtccaggcccc

SEQ ID NO: 239480 - DNA, 25 bp, Mus musculus
ccagccgtcctcaaagcctatgaag

SEQ ID NO: 239481 - DNA, 25 bp, Mus musculus
ccagccgtgggcagagttctctgaa

SEQ ID NO: 239482 - DNA, 25 bp, Mus musculus
ccagcctacctgccgcaaatctccc

SEQ ID NO: 239483 - DNA, 25 bp, Mus musculus
ccagcctagaagagctccgaggttg

SEQ ID NO: 239484 - DNA, 25 bp, Mus musculus
ccagcctagaagagtatgagcccag

SEQ ID NO: 239485 - DNA, 25 bp, Mus musculus
ccagcctatacaaggctggacgtaa

SEQ ID NO: 239486 - DNA, 25 bp, Mus musculus
ccagcctattcttttacttttggag

SEQ ID NO: 239487 - DNA, 25 bp, Mus musculus
ccagcctcaagctcccagggcttgc

SEQ ID NO: 239488 - DNA, 25 bp, Mus musculus
ccagcctcaagggcttgccaacaca

SEQ ID NO: 239489 - DNA, 25 bp, Mus musculus
ccagcctcaaggtgagcaaagcaac

SEQ ID NO: 239490 - DNA, 25 bp, Mus musculus
ccagcctcagaggccagaaaggaca

SEQ ID NO: 239491 - DNA, 25 bp, Mus musculus
ccagcctcagaggccagaagaaggc

SEQ ID NO: 239492 - DNA, 25 bp, Mus musculus
ccagcctcagattcagcgtttaaag

SEQ ID NO: 239493 - DNA, 25 bp, Mus musculus
ccagcctcaggaagcaggccagcag

SEQ ID NO: 239494 - DNA, 25 bp, Mus musculus
ccagcctcaggtcacgcccgggtct

SEQ ID NO: 239495 - DNA, 25 bp, Mus musculus
ccagcctccaaaagccctgcccttc

SEQ ID NO: 239496 - DNA, 25 bp, Mus musculus
ccagcctccacctcctcagtggcat

SEQ ID NO: 239497 - DNA, 25 bp, Mus musculus
ccagcctcccaggtccacttgaaga

SEQ ID NO: 239498 - DNA, 25 bp, Mus musculus
ccagcctcctccatgaagcttcgtg

SEQ ID NO: 239499 - DNA, 25 bp, Mus musculus
ccagcctcctgggtgttctcttcca

SEQ ID NO: 239500 - DNA, 25 bp, Mus musculus
ccagcctcctgggttggctgcaagc

SEQ ID NO: 239501 - DNA, 25 bp, Mus musculus
ccagcctcgtgcccagcagcaggag

SEQ ID NO: 239502 - DNA, 25 bp, Mus musculus
ccagcctctcaacgattcccacgcc

SEQ ID NO: 239503 - DNA, 25 bp, Mus musculus
ccagcctctcaatgggtgttcagga

SEQ ID NO: 239504 - DNA, 25 bp, Mus musculus
ccagcctctccagggccctgacgtc

SEQ ID NO: 239505 - DNA, 25 bp, Mus musculus
ccagcctctgaaactagacaccatg

SEQ ID NO: 239506 - DNA, 25 bp, Mus musculus
ccagcctctggggccctggcccagc

SEQ ID NO: 239507 - DNA, 25 bp, Mus musculus
ccagcctgacatgggattctctcca

SEQ ID NO: 239508 - DNA, 25 bp, Mus musculus
ccagcctgacatgggcctccttgaa

SEQ ID NO: 239509 - DNA, 25 bp, Mus musculus
ccagcctgacgggaggaaaacttta

SEQ ID NO: 239510 - DNA, 25 bp, Mus musculus
ccagcctgacgtttctcttcagcaa

SEQ ID NO: 239511 - DNA, 25 bp, Mus musculus
ccagcctgactggttgtgtcaccaa

SEQ ID NO: 239512 - DNA, 25 bp, Mus musculus
ccagcctgagagcttcggtgcaacc

SEQ ID NO: 239513 - DNA, 25 bp, Mus musculus
ccagcctgagcgagccagaggaaga

SEQ ID NO: 239514 - DNA, 25 bp, Mus musculus
ccagcctgcacgtggaccacagtga

SEQ ID NO: 239515 - DNA, 25 bp, Mus musculus
ccagcctgcacgtgggtccctggag

SEQ ID NO: 239516 - DNA, 25 bp, Mus musculus
ccagcctggagaaggtcccacctgc

SEQ ID NO: 239517 - DNA, 25 bp, Mus musculus
ccagcctggagaggtccatatcctg

SEQ ID NO: 239518 - DNA, 25 bp, Mus musculus
ccagcctgggccacggagcagctga

SEQ ID NO: 239519 - DNA, 25 bp, Mus musculus
ccagcctgtccagcaccatggctgg

SEQ ID NO: 239520 - DNA, 25 bp, Mus musculus
ccagcctgtggaatagtcactgctg

SEQ ID NO: 239521 - DNA, 25 bp, Mus musculus
ccagcctgtgggtccgaagcagtac

SEQ ID NO: 239522 - DNA, 25 bp, Mus musculus
ccagccttaactaactccacggaca

SEQ ID NO: 239523 - DNA, 25 bp, Mus musculus
ccagccttaactggctccataggaa

SEQ ID NO: 239524 - DNA, 25 bp, Mus musculus
ccagccttcaccgtatggtgtggaa

SEQ ID NO: 239525 - DNA, 25 bp, Mus musculus
ccagccttcctggagcatgcagacg

SEQ ID NO: 239526 - DNA, 25 bp, Mus musculus
ccagcctttacaggacgcctttgat

SEQ ID NO: 239527 - DNA, 25 bp, Mus musculus
ccagcgaacatgctcactgttggta

SEQ ID NO: 239528 - DNA, 25 bp, Mus musculus
ccagcgaacatggcctcaggagttc

SEQ ID NO: 239529 - DNA, 25 bp, Mus musculus
ccagcgaaggatgggacaaggcctg

SEQ ID NO: 239530 - DNA, 25 bp, Mus musculus
ccagcgaaggatggtggaagaaaag

SEQ ID NO: 239531 - DNA, 25 bp, Mus musculus
ccagcgacatcgctgacttcaggga

SEQ ID NO: 239532 - DNA, 25 bp, Mus musculus
ccagcgaccagatgaccaatgcaag

SEQ ID NO: 239533 - DNA, 25 bp, Mus musculus
ccagcgaccagtcttgtgccattga

SEQ ID NO: 239534 - DNA, 25 bp, Mus musculus
ccagcgagagggtggtccggtgagc

SEQ ID NO: 239535 - DNA, 25 bp, Mus musculus
ccagcgagcagccctgcaactccca

SEQ ID NO: 239536 - DNA, 25 bp, Mus musculus
ccagcgagcgctgcgaagctggggt

SEQ ID NO: 239537 - DNA, 25 bp, Mus musculus
ccagcgaggaaacaggcactctcga

SEQ ID NO: 239538 - DNA, 25 bp, Mus musculus
ccagcgaggagagagtgtatatggt

SEQ ID NO: 239539 - DNA, 25 bp, Mus musculus
ccagcgagttattaggatgcctggt

SEQ ID NO: 239540 - DNA, 25 bp, Mus musculus
ccagcgagttattaggcacatgact

SEQ ID NO: 239541 - DNA, 25 bp, Mus musculus
ccagcgatcgcaggattgaaattcc

SEQ ID NO: 239542 - DNA, 25 bp, Mus musculus
ccagcgattctgaaggtgaagagat

SEQ ID NO: 239543 - DNA, 25 bp, Mus musculus
ccagcgcacctacgggctgactcct

SEQ ID NO: 239544 - DNA, 25 bp, Mus musculus
ccagcgcacgtgcatagatacctgc

SEQ ID NO: 239545 - DNA, 25 bp, Mus musculus
ccagcgcagccatggagccccgcgc

SEQ ID NO: 239546 - DNA, 25 bp, Mus musculus
ccagcgcagggacagtcacgaggac

SEQ ID NO: 239547 - DNA, 25 bp, Mus musculus
ccagcgccaccccctgctcctgctg

SEQ ID NO: 239548 - DNA, 25 bp, Mus musculus
ccagcgccggggactctgatgggga

SEQ ID NO: 239549 - DNA, 25 bp, Mus musculus
ccagcgcctgcaggcttttgaggct

SEQ ID NO: 239550 - DNA, 25 bp, Mus musculus
ccagcgcctgcaggggctccctcca

SEQ ID NO: 239551 - DNA, 25 bp, Mus musculus
ccagcgcgaaggtgatgctagaaga

SEQ ID NO: 239552 - DNA, 25 bp, Mus musculus
ccagcgcggggcaaggaggaggagt

SEQ ID NO: 239553 - DNA, 25 bp, Mus musculus
ccagcgcggggcaagtgtggtcccc

SEQ ID NO: 239554 - DNA, 25 bp, Mus musculus
ccagcgcgtggcatgaagcactacc

SEQ ID NO: 239555 - DNA, 25 bp, Mus musculus
ccagcgcgtgggacgaattcatacc

SEQ ID NO: 239556 - DNA, 25 bp, Mus musculus
ccagcgctaagaggatccagaagga

SEQ ID NO: 239557 - DNA, 25 bp, Mus musculus
ccagcgctcttctgttatgttcttg

SEQ ID NO: 239558 - DNA, 25 bp, Mus musculus
ccagcgctgagcttcacctggttca

SEQ ID NO: 239559 - DNA, 25 bp, Mus musculus
ccagcgctgcttcagagatgagtga

SEQ ID NO: 239560 - DNA, 25 bp, Mus musculus
ccagcgctgcttcagcacctctggg

SEQ ID NO: 239561 - DNA, 25 bp, Mus musculus
ccagcgcttcaacagggccatggag

SEQ ID NO: 239562 - DNA, 25 bp, Mus musculus
ccagcgcttcagcaccgcacagtgt

SEQ ID NO: 239563 - DNA, 25 bp, Mus musculus
ccagcgcttcagggagcgacaggca

SEQ ID NO: 239564 - DNA, 25 bp, Mus musculus
ccagcgctttggagctgtgtggaca

SEQ ID NO: 239565 - DNA, 25 bp, Mus musculus
ccagcgctttggagctgtgtgtggg

SEQ ID NO: 239566 - DNA, 25 bp, Mus musculus
ccagcggactctgggagtctgtccc

SEQ ID NO: 239567 - DNA, 25 bp, Mus musculus
ccagcggaggaggttgtaagcatca

SEQ ID NO: 239568 - DNA, 25 bp, Mus musculus
ccagcggatccgggagcctgagcct

SEQ ID NO: 239569 - DNA, 25 bp, Mus musculus
ccagcggatcctgagagaaggcttt

SEQ ID NO: 239570 - DNA, 25 bp, Mus musculus
ccagcggcaagatgtcattgatcag

SEQ ID NO: 239571 - DNA, 25 bp, Mus musculus
ccagcggcaagcctgagactggtgt

SEQ ID NO: 239572 - DNA, 25 bp, Mus musculus
ccagcggcaaggtgcgccgtcatga

SEQ ID NO: 239573 - DNA, 25 bp, Mus musculus
ccagcggcagagatagctgttgtgg

SEQ ID NO: 239574 - DNA, 25 bp, Mus musculus
ccagcggcagcaggaacggagcacc

SEQ ID NO: 239575 - DNA, 25 bp, Mus musculus
ccagcggcagcagggccgggagcag

SEQ ID NO: 239576 - DNA, 25 bp, Mus musculus
ccagcggcagccagcaccagctgct

SEQ ID NO: 239577 - DNA, 25 bp, Mus musculus
ccagcggcagctgagcagaataagg

SEQ ID NO: 239578 - DNA, 25 bp, Mus musculus
ccagcggccacagccccactccaca

SEQ ID NO: 239579 - DNA, 25 bp, Mus musculus
ccagcggccgggggaacacacccgt

SEQ ID NO: 239580 - DNA, 25 bp, Mus musculus
ccagcggcgcagaaacatctgtggc

SEQ ID NO: 239581 - DNA, 25 bp, Mus musculus
ccagcggcgcaggtgattcctccta

SEQ ID NO: 239582 - DNA, 25 bp, Mus musculus
ccagcgggacaggtggtgtccctca

SEQ ID NO: 239583 - DNA, 25 bp, Mus musculus
ccagcgggacagtgacgttgcccgc

SEQ ID NO: 239584 - DNA, 25 bp, Mus musculus
ccagcgggaccaagactccacttca

SEQ ID NO: 239585 - DNA, 25 bp, Mus musculus
ccagcgggaccaaggttatttcgtc

SEQ ID NO: 239586 - DNA, 25 bp, Mus musculus
ccagcgggagaagatggttggtaaa

SEQ ID NO: 239587 - DNA, 25 bp, Mus musculus
ccagcgggagaaggctctgcacccc

SEQ ID NO: 239588 - DNA, 25 bp, Mus musculus
ccagcgggagaaggttgatccaaaa

SEQ ID NO: 239589 - DNA, 25 bp, Mus musculus
ccagcgggagaccgggtcccagcag

SEQ ID NO: 239590 - DNA, 25 bp, Mus musculus
ccagcgggcagaggcggatcttaga

SEQ ID NO: 239591 - DNA, 25 bp, Mus musculus
ccagcgggcaggtcatgttagcggc

SEQ ID NO: 239592 - DNA, 25 bp, Mus musculus
ccagcggtaactcgatcccgtactc

SEQ ID NO: 239593 - DNA, 25 bp, Mus musculus
ccagcggtggcaacggggaggcaca

SEQ ID NO: 239594 - DNA, 25 bp, Mus musculus
ccagcgtacagattgcatctgggta

SEQ ID NO: 239595 - DNA, 25 bp, Mus musculus
ccagcgtagaagatccaggtgctgt

SEQ ID NO: 239596 - DNA, 25 bp, Mus musculus
ccagcgtagagaaggctggcaagag

SEQ ID NO: 239597 - DNA, 25 bp, Mus musculus
ccagcgtcaagcaggtgtcttctgc

SEQ ID NO: 239598 - DNA, 25 bp, Mus musculus
ccagcgtcctaacgggcaatgtcat

SEQ ID NO: 239599 - DNA, 25 bp, Mus musculus
ccagcgtcgccaccatgaccaccgc

SEQ ID NO: 239600 - DNA, 25 bp, Mus musculus
ccagcgtctaaggttcctgtgtccg

SEQ ID NO: 239601 - DNA, 25 bp, Mus musculus
ccagcgtggctggtcttgagaccat

SEQ ID NO: 239602 - DNA, 25 bp, Mus musculus
ccagcgtggggaaacctgctcggta

SEQ ID NO: 239603 - DNA, 25 bp, Mus musculus
ccagcgtggggtctgagatcccaag

SEQ ID NO: 239604 - DNA, 25 bp, Mus musculus
ccagcgttggtttttcagaagatat

SEQ ID NO: 239605 - DNA, 25 bp, Mus musculus
ccagcgttggtttttctaggaaatc

SEQ ID NO: 239606 - DNA, 25 bp, Mus musculus
ccagcgttggtttttgtctccctgc

SEQ ID NO: 239607 - DNA, 25 bp, Mus musculus
ccagctaaaggaggctgtgagggga

SEQ ID NO: 239608 - DNA, 25 bp, Mus musculus
ccagctaaaggtatgctaacagaac

SEQ ID NO: 239609 - DNA, 25 bp, Mus musculus
ccagctaagcaggtctgaagaaagg

SEQ ID NO: 239610 - DNA, 25 bp, Mus musculus
ccagctaagggtgtcagggtcactg

SEQ ID NO: 239611 - DNA, 25 bp, Mus musculus
ccagctacaaagtgtctttgccatg

SEQ ID NO: 239612 - DNA, 25 bp, Mus musculus
ccagctacaagaggaatcattgacc

SEQ ID NO: 239613 - DNA, 25 bp, Mus musculus
ccagctacagatgcagactcagccc

SEQ ID NO: 239614 - DNA, 25 bp, Mus musculus
ccagctacaggtacattactgggct

SEQ ID NO: 239615 - DNA, 25 bp, Mus musculus
ccagctacatctcaggccagggctt

SEQ ID NO: 239616 - DNA, 25 bp, Mus musculus
ccagctacatctcaggcccctggtt

SEQ ID NO: 239617 - DNA, 25 bp, Mus musculus
ccagctaccagtgtccaaatgatga

SEQ ID NO: 239618 - DNA, 25 bp, Mus musculus
ccagctacccccagatccctgcagc

SEQ ID NO: 239619 - DNA, 25 bp, Mus musculus
ccagctacccttcctgcacccagga

SEQ ID NO: 239620 - DNA, 25 bp, Mus musculus
ccagctagaaacgagatgtccctgc

SEQ ID NO: 239621 - DNA, 25 bp, Mus musculus
ccagctagaaacttctcctctgttc

SEQ ID NO: 239622 - DNA, 25 bp, Mus musculus
ccagctagaggaagcctccatttac

SEQ ID NO: 239623 - DNA, 25 bp, Mus musculus
ccagctagaggaaggcagagcatgg

SEQ ID NO: 239624 - DNA, 25 bp, Mus musculus
ccagctagccctcctgtaagtaacc

SEQ ID NO: 239625 - DNA, 25 bp, Mus musculus
ccagctagctgtgcgcagttcctgg

SEQ ID NO: 239626 - DNA, 25 bp, Mus musculus
ccagctagggaatgaaggtgaagag

SEQ ID NO: 239627 - DNA, 25 bp, Mus musculus
ccagctatagacccatgcttgtaca

SEQ ID NO: 239628 - DNA, 25 bp, Mus musculus
ccagctatgagaagcaacaggccac

SEQ ID NO: 239629 - DNA, 25 bp, Mus musculus
ccagctatgagcctggagtactcgg

SEQ ID NO: 239630 - DNA, 25 bp, Mus musculus
ccagctcaaagctgctgagagcctc

SEQ ID NO: 239631 - DNA, 25 bp, Mus musculus
ccagctcaaagctgtgtgtcaacca

SEQ ID NO: 239632 - DNA, 25 bp, Mus musculus
ccagctcacgagacagggcagggca

SEQ ID NO: 239633 - DNA, 25 bp, Mus musculus
ccagctcactactgtaacagaagac

SEQ ID NO: 239634 - DNA, 25 bp, Mus musculus
ccagctcagaggcaggtttttccct

SEQ ID NO: 239635 - DNA, 25 bp, Mus musculus
ccagctcagcatgaaagcatccctg

SEQ ID NO: 239636 - DNA, 25 bp, Mus musculus
ccagctcaggagcgccccacccatc

SEQ ID NO: 239637 - DNA, 25 bp, Mus musculus
ccagctcattgtgggaaactccaaa

SEQ ID NO: 239638 - DNA, 25 bp, Mus musculus
ccagctcattgtggggaccagcggg

SEQ ID NO: 239639 - DNA, 25 bp, Mus musculus
ccagctccaacatagtttgtgattc

SEQ ID NO: 239640 - DNA, 25 bp, Mus musculus
ccagctccaacgatgtgaaagagtt

SEQ ID NO: 239641 - DNA, 25 bp, Mus musculus
ccagctccaagaaaagcaccttcat

SEQ ID NO: 239642 - DNA, 25 bp, Mus musculus
ccagctccaatttttcaagacaaaa

SEQ ID NO: 239643 - DNA, 25 bp, Mus musculus
ccagctccacagcaggtggctggat

SEQ ID NO: 239644 - DNA, 25 bp, Mus musculus
ccagctccaccccctactccccgag

SEQ ID NO: 239645 - DNA, 25 bp, Mus musculus
ccagctccacctggaaatgttctgc

SEQ ID NO: 239646 - DNA, 25 bp, Mus musculus
ccagctccacctgttatttggccgg

SEQ ID NO: 239647 - DNA, 25 bp, Mus musculus
ccagctccagagccggggaatggtc

SEQ ID NO: 239648 - DNA, 25 bp, Mus musculus
ccagctccagagccggtttagtctc

SEQ ID NO: 239649 - DNA, 25 bp, Mus musculus
ccagctccagccccctgaagacgat

SEQ ID NO: 239650 - DNA, 25 bp, Mus musculus
ccagctccaggaagcagtcatgaca

SEQ ID NO: 239651 - DNA, 25 bp, Mus musculus
ccagctccaggactcccctgaggca

SEQ ID NO: 239652 - DNA, 25 bp, Mus musculus
ccagctccaggtacttcgagtttta

SEQ ID NO: 239653 - DNA, 25 bp, Mus musculus
ccagctccagtgaggacagcgatga

SEQ ID NO: 239654 - DNA, 25 bp, Mus musculus
ccagctccagttaacctgtggaaga

SEQ ID NO: 239655 - DNA, 25 bp, Mus musculus
ccagctcccaacccctccaaggccc

SEQ ID NO: 239656 - DNA, 25 bp, Mus musculus
ccagctcccagctaaatgtggtcaa

SEQ ID NO: 239657 - DNA, 25 bp, Mus musculus
ccagctccccgttaggccagcaggt

SEQ ID NO: 239658 - DNA, 25 bp, Mus musculus
ccagctcccggttgcttcctagaaa

SEQ ID NO: 239659 - DNA, 25 bp, Mus musculus
ccagctccctgacagaggatggttt

SEQ ID NO: 239660 - DNA, 25 bp, Mus musculus
ccagctccctgacagctatattgtc

SEQ ID NO: 239661 - DNA, 25 bp, Mus musculus
ccagctccggaactctgtggaactt

SEQ ID NO: 239662 - DNA, 25 bp, Mus musculus
ccagctccgggcatgggatatcaca

SEQ ID NO: 239663 - DNA, 25 bp, Mus musculus
ccagctcctattcaggccatgtggc

SEQ ID NO: 239664 - DNA, 25 bp, Mus musculus
ccagctcctccgacgtggtgacgta

SEQ ID NO: 239665 - DNA, 25 bp, Mus musculus
ccagctcctgggatacgtattatca

SEQ ID NO: 239666 - DNA, 25 bp, Mus musculus
ccagctcgaaaaaacaatggcaagg

SEQ ID NO: 239667 - DNA, 25 bp, Mus musculus
ccagctcgagcaggacttccaatag

SEQ ID NO: 239668 - DNA, 25 bp, Mus musculus
ccagctcgagcaggttaggagaagg

SEQ ID NO: 239669 - DNA, 25 bp, Mus musculus
ccagctcgagccagacagattccct

SEQ ID NO: 239670 - DNA, 25 bp, Mus musculus
ccagctcgctgagcctgttcctgcg

SEQ ID NO: 239671 - DNA, 25 bp, Mus musculus
ccagctcgtaaagctcaatgtcgac

SEQ ID NO: 239672 - DNA, 25 bp, Mus musculus
ccagctctcaccgagcgcagccttg

SEQ ID NO: 239673 - DNA, 25 bp, Mus musculus
ccagctctccagatcatggctcctt

SEQ ID NO: 239674 - DNA, 25 bp, Mus musculus
ccagctctcctgcaaaggctgagga

SEQ ID NO: 239675 - DNA, 25 bp, Mus musculus
ccagctctcctgcaaatgtccaaac

SEQ ID NO: 239676 - DNA, 25 bp, Mus musculus
ccagctctcctgcaagtgtcctgtg

SEQ ID NO: 239677 - DNA, 25 bp, Mus musculus
ccagctctcggggatcttgaaacag

SEQ ID NO: 239678 - DNA, 25 bp, Mus musculus
ccagctctgaaaaagtcaccttaat

SEQ ID NO: 239679 - DNA, 25 bp, Mus musculus
ccagctctgccctggattggtagct

SEQ ID NO: 239680 - DNA, 25 bp, Mus musculus
ccagctctggacgctatgctgcgaa

SEQ ID NO: 239681 - DNA, 25 bp, Mus musculus
ccagctctgggatgggttgaagaca

SEQ ID NO: 239682 - DNA, 25 bp, Mus musculus
ccagctctggggaagccttggccac

SEQ ID NO: 239683 - DNA, 25 bp, Mus musculus
ccagctctggggaagctgctgccca

SEQ ID NO: 239684 - DNA, 25 bp, Mus musculus
ccagctctggggagaactctgatat

SEQ ID NO: 239685 - DNA, 25 bp, Mus musculus
ccagctctggggagaatgtactggt

SEQ ID NO: 239686 - DNA, 25 bp, Mus musculus
ccagctcttcacggcactggttcta

SEQ ID NO: 239687 - DNA, 25 bp, Mus musculus
ccagctcttcaggttgatcgcctta

SEQ ID NO: 239688 - DNA, 25 bp, Mus musculus
ccagctcttggcagaagactttaac

SEQ ID NO: 239689 - DNA, 25 bp, Mus musculus
ccagctgaagacttgattgcaattt

SEQ ID NO: 239690 - DNA, 25 bp, Mus musculus
ccagctgaaggctctgtgggtgagt

SEQ ID NO: 239691 - DNA, 25 bp, Mus musculus
ccagctgacagaaccagcagataga

SEQ ID NO: 239692 - DNA, 25 bp, Mus musculus
ccagctgacagatggcgttgacgtt

SEQ ID NO: 239693 - DNA, 25 bp, Mus musculus
ccagctgacccactgaagctggggg

SEQ ID NO: 239694 - DNA, 25 bp, Mus musculus
ccagctgacgctgagagggccttgg

SEQ ID NO: 239695 - DNA, 25 bp, Mus musculus
ccagctgactcagcaaatggaactt

SEQ ID NO: 239696 - DNA, 25 bp, Mus musculus
ccagctgagcacgttgagccacgtg

SEQ ID NO: 239697 - DNA, 25 bp, Mus musculus
ccagctgagcggcagccgccaccta

SEQ ID NO: 239698 - DNA, 25 bp, Mus musculus
ccagctgagcggtcaaagcagccgc

SEQ ID NO: 239699 - DNA, 25 bp, Mus musculus
ccagctgatcaagaggcctgccaag

SEQ ID NO: 239700 - DNA, 25 bp, Mus musculus
ccagctgatcaagccagccatctcc

SEQ ID NO: 239701 - DNA, 25 bp, Mus musculus
ccagctgatcctgataccgctattg

SEQ ID NO: 239702 - DNA, 25 bp, Mus musculus
ccagctgatcgagaaaacataaaga

SEQ ID NO: 239703 - DNA, 25 bp, Mus musculus
ccagctgatcgctggtgttcgacat

SEQ ID NO: 239704 - DNA, 25 bp, Mus musculus
ccagctgcaatggggactctggcgg

SEQ ID NO: 239705 - DNA, 25 bp, Mus musculus
ccagctgcactcaggaagaggagac

SEQ ID NO: 239706 - DNA, 25 bp, Mus musculus
ccagctgcagaaaggtcagacggga

SEQ ID NO: 239707 - DNA, 25 bp, Mus musculus
ccagctgcagacgaagcttcttcca

SEQ ID NO: 239708 - DNA, 25 bp, Mus musculus
ccagctgcagagaatgttgctgagg

SEQ ID NO: 239709 - DNA, 25 bp, Mus musculus
ccagctgcagagcgaagtcaccctg
